United States Patent 7,888,497 (BIOINFORMATICALLY DETECTABLE GROUP OF NOVEL REGULATORY OLIGONUCLEOTIDES AND USES THEREOF) - sequence listing, part 80

SEQ ID NO: 3375333 - DNA, 22 bp, Homo sapiens
gctgggcggggctcgaggctgg

SEQ ID NO: 3375334 - DNA, 15 bp, Homo sapiens
gctgggctcacaggc

SEQ ID NO: 3375335 - DNA, 17 bp, Homo sapiens
gctgggctcacaggcct

SEQ ID NO: 3375336 - DNA, 13 bp, Homo sapiens
gctgggctccctg

SEQ ID NO: 3375337 - DNA, 21 bp, Homo sapiens
gctgggctccctgatgacacc

SEQ ID NO: 3375338 - DNA, 12 bp, Homo sapiens
gctgggctgggc

SEQ ID NO: 3375339 - DNA, 18 bp, Homo sapiens
gctgggctgggccctctt

SEQ ID NO: 3375340 - DNA, 17 bp, Homo sapiens
gctgggcttcagtggca

SEQ ID NO: 3375341 - DNA, 18 bp, Homo sapiens
gctgggcttcagtggcag

SEQ ID NO: 3375342 - DNA, 20 bp, Homo sapiens
gctgggcttcagtggcagct

SEQ ID NO: 3375343 - DNA, 16 bp, Homo sapiens
gctggggacagagggt

SEQ ID NO: 3375344 - DNA, 14 bp, Homo sapiens
gctggggactcagg

SEQ ID NO: 3375345 - DNA, 15 bp, Homo sapiens
gctggggactcaggg

SEQ ID NO: 3375346 - DNA, 22 bp, Homo sapiens
gctggggatccccgcctggcca

SEQ ID NO: 3375347 - DNA, 17 bp, Homo sapiens
gctggggcaagtccctg

SEQ ID NO: 3375348 - DNA, 19 bp, Homo sapiens
gctggggcagaggggcagc

SEQ ID NO: 3375349 - DNA, 20 bp, Homo sapiens
gctggggcagaggggcagcc

SEQ ID NO: 3375350 - DNA, 22 bp, Homo sapiens
gctggggcagaggggcagccgc

SEQ ID NO: 3375351 - DNA, 24 bp, Homo sapiens
gctggggcagaggggcagccgcta

SEQ ID NO: 3375352 - DNA, 14 bp, Homo sapiens
gctggggccgccac

SEQ ID NO: 3375353 - DNA, 14 bp, Homo sapiens
gctggggcctcaga

SEQ ID NO: 3375354 - DNA, 15 bp, Homo sapiens
gctggggcctcagac

SEQ ID NO: 3375355 - DNA, 16 bp, Homo sapiens
gctggggcctcagacg

SEQ ID NO: 3375356 - DNA, 19 bp, Homo sapiens
gctggggcgtggggagggc

SEQ ID NO: 3375357 - DNA, 20 bp, Homo sapiens
gctgggggaatgagcccaga

SEQ ID NO: 3375358 - DNA, 22 bp, Homo sapiens
gctgggggaatgagcccagaga

SEQ ID NO: 3375359 - DNA, 15 bp, Homo sapiens
gctgggggcctcagt

SEQ ID NO: 3375360 - DNA, 15 bp, Homo sapiens
gctggggggcacccc

SEQ ID NO: 3375361 - DNA, 20 bp, Homo sapiens
gctgggtataagcagagagg

SEQ ID NO: 3375362 - DNA, 12 bp, Homo sapiens
gctgggtcaggg

SEQ ID NO: 3375363 - DNA, 16 bp, Homo sapiens
gctgggtcagggccag

SEQ ID NO: 3375364 - DNA, 23 bp, Homo sapiens
gctgggtcagggccagactggaa

SEQ ID NO: 3375365 - DNA, 19 bp, Homo sapiens
gctgggtggcacaccaccc

SEQ ID NO: 3375366 - DNA, 14 bp, Homo sapiens
gctgggtggcctgt

SEQ ID NO: 3375367 - DNA, 17 bp, Homo sapiens
gctgggtggtaccctct

SEQ ID NO: 3375368 - DNA, 13 bp, Homo sapiens
gctgggtggtttt

SEQ ID NO: 3375369 - DNA, 18 bp, Homo sapiens
gctggtaacagtggctgc

SEQ ID NO: 3375370 - DNA, 13 bp, Homo sapiens
gctggtaacagtt

SEQ ID NO: 3375371 - DNA, 15 bp, Homo sapiens
gctggtagagacccc

SEQ ID NO: 3375372 - DNA, 15 bp, Homo sapiens
gctggtatctcagaa

SEQ ID NO: 3375373 - DNA, 14 bp, Homo sapiens
gctggtcagagacg

SEQ ID NO: 3375374 - DNA, 14 bp, Homo sapiens
gctggtcccactca

SEQ ID NO: 3375375 - DNA, 15 bp, Homo sapiens
gctggtcccactcag

SEQ ID NO: 3375376 - DNA, 20 bp, Homo sapiens
gctggtcccactcagtccat

SEQ ID NO: 3375377 - DNA, 18 bp, Homo sapiens
gctggtcccctcctcagt

SEQ ID NO: 3375378 - DNA, 14 bp, Homo sapiens
gctggtgccaggcg

SEQ ID NO: 3375379 - DNA, 15 bp, Homo sapiens
gctggtgccccacag

SEQ ID NO: 3375380 - DNA, 23 bp, Homo sapiens
gctggtggaaagcgattcactgt

SEQ ID NO: 3375381 - DNA, 14 bp, Homo sapiens
gctggtgtcacctg

SEQ ID NO: 3375382 - DNA, 18 bp, Homo sapiens
gctggtgtcacctgaaga

SEQ ID NO: 3375383 - DNA, 15 bp, Homo sapiens
gctggtgtcctgacc

SEQ ID NO: 3375384 - DNA, 16 bp, Homo sapiens
gctggtgtcctgacca

SEQ ID NO: 3375385 - DNA, 22 bp, Homo sapiens
gctggtgtcctgaccaccctcc

SEQ ID NO: 3375386 - DNA, 17 bp, Homo sapiens
gctggttactcagggtt

SEQ ID NO: 3375387 - DNA, 23 bp, Homo sapiens
gctggttcagggttggcccctgc

SEQ ID NO: 3375388 - DNA, 14 bp, Homo sapiens
gctggttgctgtgt

SEQ ID NO: 3375389 - DNA, 16 bp, Homo sapiens
gctggttgctgtgtgg

SEQ ID NO: 3375390 - DNA, 12 bp, Homo sapiens
gctggttttcct

SEQ ID NO: 3375391 - DNA, 14 bp, Homo sapiens
gctggttttcctaa

SEQ ID NO: 3375392 - DNA, 20 bp, Homo sapiens
gctggttttgtaagatgctg

SEQ ID NO: 3375393 - DNA, 15 bp, Homo sapiens
gctgtaaaacgctgt

SEQ ID NO: 3375394 - DNA, 14 bp, Homo sapiens
gctgtaaaatcttg

SEQ ID NO: 3375395 - DNA, 20 bp, Homo sapiens
gctgtaaaatgcatgatttt

SEQ ID NO: 3375396 - DNA, 22 bp, Homo sapiens
gctgtaaatcctagacttgaaa

SEQ ID NO: 3375397 - DNA, 14 bp, Homo sapiens
gctgtaactgctga

SEQ ID NO: 3375398 - DNA, 15 bp, Homo sapiens
gctgtaactgctgag

SEQ ID NO: 3375399 - DNA, 22 bp, Homo sapiens
gctgtaactgctgagccactcg

SEQ ID NO: 3375400 - DNA, 16 bp, Homo sapiens
gctgtaagaagagact

SEQ ID NO: 3375401 - DNA, 24 bp, Homo sapiens
gctgtaagaagagactgggaagat

SEQ ID NO: 3375402 - DNA, 15 bp, Homo sapiens
gctgtaaggctctag

SEQ ID NO: 3375403 - DNA, 23 bp, Homo sapiens
gctgtaaggctctagatcataag

SEQ ID NO: 3375404 - DNA, 13 bp, Homo sapiens
gctgtaagggcag

SEQ ID NO: 3375405 - DNA, 15 bp, Homo sapiens
gctgtaatcatttgt

SEQ ID NO: 3375406 - DNA, 22 bp, Homo sapiens
gctgtaatcatttgtttacatt

SEQ ID NO: 3375407 - DNA, 20 bp, Homo sapiens
gctgtacatctattttggat

SEQ ID NO: 3375408 - DNA, 22 bp, Homo sapiens
gctgtacatctattttggattg

SEQ ID NO: 3375409 - DNA, 15 bp, Homo sapiens
gctgtaccacatctg

SEQ ID NO: 3375410 - DNA, 19 bp, Homo sapiens
gctgtaccacatctgctct

SEQ ID NO: 3375411 - DNA, 20 bp, Homo sapiens
gctgtacccagatgcctaca

SEQ ID NO: 3375412 - DNA, 14 bp, Homo sapiens
gctgtacccttcca

SEQ ID NO: 3375413 - DNA, 17 bp, Homo sapiens
gctgtacgcgtttgtct

SEQ ID NO: 3375414 - DNA, 18 bp, Homo sapiens
gctgtacgcgtttgtctc

SEQ ID NO: 3375415 - DNA, 22 bp, Homo sapiens
gctgtacgcgtttgtctcgtgg

SEQ ID NO: 3375416 - DNA, 13 bp, Homo sapiens
gctgtactcagag

SEQ ID NO: 3375417 - DNA, 14 bp, Homo sapiens
gctgtactcagagc

SEQ ID NO: 3375418 - DNA, 17 bp, Homo sapiens
gctgtactcagagcaga

SEQ ID NO: 3375419 - DNA, 19 bp, Homo sapiens
gctgtactcagagcagagc

SEQ ID NO: 3375420 - DNA, 13 bp, Homo sapiens
gctgtagccatgg

SEQ ID NO: 3375421 - DNA, 20 bp, Homo sapiens
gctgtagccatggctcaggc

SEQ ID NO: 3375422 - DNA, 22 bp, Homo sapiens
gctgtagccatggctcaggcaa

SEQ ID NO: 3375423 - DNA, 21 bp, Homo sapiens
gctgtagtcctttctgccttg

SEQ ID NO: 3375424 - DNA, 15 bp, Homo sapiens
gctgtataagttatt

SEQ ID NO: 3375425 - DNA, 12 bp, Homo sapiens
gctgtatgattt

SEQ ID NO: 3375426 - DNA, 16 bp, Homo sapiens
gctgtatgatttgttt

SEQ ID NO: 3375427 - DNA, 21 bp, Homo sapiens
gctgtatggaaatgcaccctc

SEQ ID NO: 3375428 - DNA, 18 bp, Homo sapiens
gctgtattttaacacttt

SEQ ID NO: 3375429 - DNA, 20 bp, Homo sapiens
gctgtattttaacactttgt

SEQ ID NO: 3375430 - DNA, 23 bp, Homo sapiens
gctgtattttaacactttgtatt

SEQ ID NO: 3375431 - DNA, 20 bp, Homo sapiens
gctgtcaaaacaagtttttc

SEQ ID NO: 3375432 - DNA, 14 bp, Homo sapiens
gctgtcactggctg

SEQ ID NO: 3375433 - DNA, 18 bp, Homo sapiens
gctgtcactggctggctc

SEQ ID NO: 3375434 - DNA, 19 bp, Homo sapiens
gctgtcactggctggctcc

SEQ ID NO: 3375435 - DNA, 23 bp, Homo sapiens
gctgtcatcaattgaatggtcag

SEQ ID NO: 3375436 - DNA, 21 bp, Homo sapiens
gctgtcatggtcctttctgga

SEQ ID NO: 3375437 - DNA, 22 bp, Homo sapiens
gctgtcatggtcctttctggaa

SEQ ID NO: 3375438 - DNA, 15 bp, Homo sapiens
gctgtcccctctgtc

SEQ ID NO: 3375439 - DNA, 16 bp, Homo sapiens
gctgtccctgcagggc

SEQ ID NO: 3375440 - DNA, 14 bp, Homo sapiens
gctgtcctaggcca

SEQ ID NO: 3375441 - DNA, 19 bp, Homo sapiens
gctgtcctctcgagcccag

SEQ ID NO: 3375442 - DNA, 14 bp, Homo sapiens
gctgtcgccccagg

SEQ ID NO: 3375443 - DNA, 16 bp, Homo sapiens
gctgtcgccccaggcc

SEQ ID NO: 3375444 - DNA, 17 bp, Homo sapiens
gctgtcgccccaggccc

SEQ ID NO: 3375445 - DNA, 18 bp, Homo sapiens
gctgtcgccccaggccct

SEQ ID NO: 3375446 - DNA, 15 bp, Homo sapiens
gctgtctgcctgtat

SEQ ID NO: 3375447 - DNA, 17 bp, Homo sapiens
gctgtctggccaggcct

SEQ ID NO: 3375448 - DNA, 12 bp, Homo sapiens
gctgtctggggc

SEQ ID NO: 3375449 - DNA, 12 bp, Homo sapiens
gctgtctgtcac

SEQ ID NO: 3375450 - DNA, 16 bp, Homo sapiens
gctgtctgtcaccagc

SEQ ID NO: 3375451 - DNA, 17 bp, Homo sapiens
gctgtcttctggtctgt

SEQ ID NO: 3375452 - DNA, 20 bp, Homo sapiens
gctgtcttctggtctgtgtg

SEQ ID NO: 3375453 - DNA, 12 bp, Homo sapiens
gctgtgagcccc

SEQ ID NO: 3375454 - DNA, 20 bp, Homo sapiens
gctgtgagcccctggtcctg

SEQ ID NO: 3375455 - DNA, 18 bp, Homo sapiens
gctgtgaggaatgctctg

SEQ ID NO: 3375456 - DNA, 21 bp, Homo sapiens
gctgtgaggaatgctctgtgc

SEQ ID NO: 3375457 - DNA, 22 bp, Homo sapiens
gctgtgagtctttggttctaag

SEQ ID NO: 3375458 - DNA, 18 bp, Homo sapiens
gctgtgagtgtaagtgtg

SEQ ID NO: 3375459 - DNA, 22 bp, Homo sapiens
gctgtgagtgtaagtgtgagta

SEQ ID NO: 3375460 - DNA, 18 bp, Homo sapiens
gctgtgagttctccctgt

SEQ ID NO: 3375461 - DNA, 15 bp, Homo sapiens
gctgtgccatgctgg

SEQ ID NO: 3375462 - DNA, 17 bp, Homo sapiens
gctgtgccatgctgggc

SEQ ID NO: 3375463 - DNA, 14 bp, Homo sapiens
gctgtgcctctgcc

SEQ ID NO: 3375464 - DNA, 16 bp, Homo sapiens
gctgtgcctctgcctg

SEQ ID NO: 3375465 - DNA, 12 bp, Homo sapiens
gctgtgcctgct

SEQ ID NO: 3375466 - DNA, 14 bp, Homo sapiens
gctgtgcctgctag

SEQ ID NO: 3375467 - DNA, 17 bp, Homo sapiens
gctgtgcctgctagagc

SEQ ID NO: 3375468 - DNA, 20 bp, Homo sapiens
gctgtgcctgctagagcaac

SEQ ID NO: 3375469 - DNA, 22 bp, Homo sapiens
gctgtgcctgctagagcaaccc

SEQ ID NO: 3375470 - DNA, 18 bp, Homo sapiens
gctgtgctctggacaggc

SEQ ID NO: 3375471 - DNA, 13 bp, Homo sapiens
gctgtgctgcttt

SEQ ID NO: 3375472 - DNA, 23 bp, Homo sapiens
gctgtgctgcttttgagcctcag

SEQ ID NO: 3375473 - DNA, 12 bp, Homo sapiens
gctgtggaccgt

SEQ ID NO: 3375474 - DNA, 21 bp, Homo sapiens
gctgtggaccgtggacaggcc

SEQ ID NO: 3375475 - DNA, 20 bp, Homo sapiens
gctgtggagcaaaaggcagc

SEQ ID NO: 3375476 - DNA, 13 bp, Homo sapiens
gctgtggaggcct

SEQ ID NO: 3375477 - DNA, 13 bp, Homo sapiens
gctgtggccctgg

SEQ ID NO: 3375478 - DNA, 14 bp, Homo sapiens
gctgtggccctgga

SEQ ID NO: 3375479 - DNA, 15 bp, Homo sapiens
gctgtggccgtctcc

SEQ ID NO: 3375480 - DNA, 20 bp, Homo sapiens
gctgtggccgtctcctccct

SEQ ID NO: 3375481 - DNA, 14 bp, Homo sapiens
gctgtggcctcacc

SEQ ID NO: 3375482 - DNA, 18 bp, Homo sapiens
gctgtggcctcaccctga

SEQ ID NO: 3375483 - DNA, 14 bp, Homo sapiens
gctgtggcctgggc

SEQ ID NO: 3375484 - DNA, 15 bp, Homo sapiens
gctgtggcctgggca

SEQ ID NO: 3375485 - DNA, 20 bp, Homo sapiens
gctgtgggcagcaccctccc

SEQ ID NO: 3375486 - DNA, 22 bp, Homo sapiens
gctgtgggcaggcaagcccttc

SEQ ID NO: 3375487 - DNA, 18 bp, Homo sapiens
gctgtgggcctcaaggac

SEQ ID NO: 3375488 - DNA, 19 bp, Homo sapiens
gctgtgggcctcaaggact

SEQ ID NO: 3375489 - DNA, 21 bp, Homo sapiens
gctgtggggctggtagctcag

SEQ ID NO: 3375490 - DNA, 20 bp, Homo sapiens
gctgtgtgaatacctgctca

SEQ ID NO: 3375491 - DNA, 13 bp, Homo sapiens
gctgtgtggtttg

SEQ ID NO: 3375492 - DNA, 13 bp, Homo sapiens
gctgtgtgtgagc

SEQ ID NO: 3375493 - DNA, 18 bp, Homo sapiens
gctgtgttaaataaacct

SEQ ID NO: 3375494 - DNA, 19 bp, Homo sapiens
gctgtgttgaaacagaaaa

SEQ ID NO: 3375495 - DNA, 22 bp, Homo sapiens
gctgtgtttatatggaagaaag

SEQ ID NO: 3375496 - DNA, 15 bp, Homo sapiens
gctgttaaactgtta

SEQ ID NO: 3375497 - DNA, 23 bp, Homo sapiens
gctgttactttctttcagatgtt

SEQ ID NO: 3375498 - DNA, 22 bp, Homo sapiens
gctgttcccatgtagccccctg

SEQ ID NO: 3375499 - DNA, 19 bp, Homo sapiens
gctgttccttgtactctta

SEQ ID NO: 3375500 - DNA, 15 bp, Homo sapiens
gctgttctgcactga

SEQ ID NO: 3375501 - DNA, 17 bp, Homo sapiens
gctgttctgcactgaaa

SEQ ID NO: 3375502 - DNA, 18 bp, Homo sapiens
gctgttgagctgttttcc

SEQ ID NO: 3375503 - DNA, 18 bp, Homo sapiens
gctgttgagggccacttt

SEQ ID NO: 3375504 - DNA, 15 bp, Homo sapiens
gctgttgccatagcc

SEQ ID NO: 3375505 - DNA, 16 bp, Homo sapiens
gctgttgccatagccc

SEQ ID NO: 3375506 - DNA, 22 bp, Homo sapiens
gctgttggcactcacagacctg

SEQ ID NO: 3375507 - DNA, 23 bp, Homo sapiens
gctgttggcactcacagacctgg

SEQ ID NO: 3375508 - DNA, 12 bp, Homo sapiens
gctgttgtacat

SEQ ID NO: 3375509 - DNA, 13 bp, Homo sapiens
gctgttgtacatt

SEQ ID NO: 3375510 - DNA, 15 bp, Homo sapiens
gctgttgtacattta

SEQ ID NO: 3375511 - DNA, 18 bp, Homo sapiens
gctgttgttccattgaag

SEQ ID NO: 3375512 - DNA, 15 bp, Homo sapiens
gctgtttagcagaac

SEQ ID NO: 3375513 - DNA, 17 bp, Homo sapiens
gctgtttatggcctcag

SEQ ID NO: 3375514 - DNA, 22 bp, Homo sapiens
gctgtttatggcctcagctgcc

SEQ ID NO: 3375515 - DNA, 17 bp, Homo sapiens
gctgtttatgtttttat

SEQ ID NO: 3375516 - DNA, 16 bp, Homo sapiens
gctgtttattttatat

SEQ ID NO: 3375517 - DNA, 13 bp, Homo sapiens
gctgtttgcgtga

SEQ ID NO: 3375518 - DNA, 16 bp, Homo sapiens
gctgtttgcgtgaatg

SEQ ID NO: 3375519 - DNA, 12 bp, Homo sapiens
gctgtttgtcat

SEQ ID NO: 3375520 - DNA, 17 bp, Homo sapiens
gctgttttccctgacct

SEQ ID NO: 3375521 - DNA, 21 bp, Homo sapiens
gctgtttttaggctgttcctt

SEQ ID NO: 3375522 - DNA, 23 bp, Homo sapiens
gctgtttttaggctgttccttgt

SEQ ID NO: 3375523 - DNA, 14 bp, Homo sapiens
gctgtttttgttgt

SEQ ID NO: 3375524 - DNA, 22 bp, Homo sapiens
gcttaaaaaagagttttcttta

SEQ ID NO: 3375525 - DNA, 20 bp, Homo sapiens
gcttaaaaggtataattaaa

SEQ ID NO: 3375526 - DNA, 12 bp, Homo sapiens
gcttaaacaaag

SEQ ID NO: 3375527 - DNA, 12 bp, Homo sapiens
gcttaaactaaa

SEQ ID NO: 3375528 - DNA, 17 bp, Homo sapiens
gcttaaataggaaagtt

SEQ ID NO: 3375529 - DNA, 15 bp, Homo sapiens
gcttaacaatgcaac

SEQ ID NO: 3375530 - DNA, 21 bp, Homo sapiens
gcttaacaatgcaacttttaa

SEQ ID NO: 3375531 - DNA, 22 bp, Homo sapiens
gcttaacctttccgctgtcgcc

SEQ ID NO: 3375532 - DNA, 20 bp, Homo sapiens
gcttaagaaatctagtattt

SEQ ID NO: 3375533 - DNA, 15 bp, Homo sapiens
gcttaagcagaagca

SEQ ID NO: 3375534 - DNA, 21 bp, Homo sapiens
gcttaataaaaatgacagact

SEQ ID NO: 3375535 - DNA, 15 bp, Homo sapiens
gcttacaatctttat

SEQ ID NO: 3375536 - DNA, 11 bp, Homo sapiens
gcttacatttt

SEQ ID NO: 3375537 - DNA, 18 bp, Homo sapiens
gcttacatttttacaata

SEQ ID NO: 3375538 - DNA, 13 bp, Homo sapiens
gcttacctcctca

SEQ ID NO: 3375539 - DNA, 21 bp, Homo sapiens
gcttacctgacctcttgctgt

SEQ ID NO: 3375540 - DNA, 21 bp, Homo sapiens
gcttactgatatattttacaa

SEQ ID NO: 3375541 - DNA, 23 bp, Homo sapiens
gcttagagagaggaggcagcccc

SEQ ID NO: 3375542 - DNA, 13 bp, Homo sapiens
gcttagatttcat

SEQ ID NO: 3375543 - DNA, 23 bp, Homo sapiens
gcttagcagggtgctaacgtatc

SEQ ID NO: 3375544 - DNA, 12 bp, Homo sapiens
gcttagccttgt

SEQ ID NO: 3375545 - DNA, 20 bp, Homo sapiens
gcttagctgccttgagctaa

SEQ ID NO: 3375546 - DNA, 22 bp, Homo sapiens
gcttagcttatctttctttcca

SEQ ID NO: 3375547 - DNA, 12 bp, Homo sapiens
gcttaggagaga

SEQ ID NO: 3375548 - DNA, 22 bp, Homo sapiens
gcttaggatgtgtgcatgtgtg

SEQ ID NO: 3375549 - DNA, 15 bp, Homo sapiens
gcttagtaaaattta

SEQ ID NO: 3375550 - DNA, 14 bp, Homo sapiens
gcttagtttgtgtg

SEQ ID NO: 3375551 - DNA, 21 bp, Homo sapiens
gcttagtttgtgtgttgtctc

SEQ ID NO: 3375552 - DNA, 20 bp, Homo sapiens
gcttagtttttttttaatct

SEQ ID NO: 3375553 - DNA, 14 bp, Homo sapiens
gcttataaacacat

SEQ ID NO: 3375554 - DNA, 21 bp, Homo sapiens
gcttatctcttttatatttgt

SEQ ID NO: 3375555 - DNA, 21 bp, Homo sapiens
gcttatctttgcacatgttaa

SEQ ID NO: 3375556 - DNA, 18 bp, Homo sapiens
gcttatgaaagaggcagc

SEQ ID NO: 3375557 - DNA, 18 bp, Homo sapiens
gcttatgacatcacttgt

SEQ ID NO: 3375558 - DNA, 22 bp, Homo sapiens
gcttatgagatctaatgtgaaa

SEQ ID NO: 3375559 - DNA, 15 bp, Homo sapiens
gcttattacatttta

SEQ ID NO: 3375560 - DNA, 17 bp, Homo sapiens
gcttattgttccaagac

SEQ ID NO: 3375561 - DNA, 16 bp, Homo sapiens
gcttatttattaacag

SEQ ID NO: 3375562 - DNA, 12 bp, Homo sapiens
gcttattttaat

SEQ ID NO: 3375563 - DNA, 13 bp, Homo sapiens
gcttattttaatg

SEQ ID NO: 3375564 - DNA, 21 bp, Homo sapiens
gcttattttaatgtgatgatg

SEQ ID NO: 3375565 - DNA, 14 bp, Homo sapiens
gcttattttattat

SEQ ID NO: 3375566 - DNA, 19 bp, Homo sapiens
gcttcaagtgccttttgct

SEQ ID NO: 3375567 - DNA, 15 bp, Homo sapiens
gcttcaattaataaa

SEQ ID NO: 3375568 - DNA, 15 bp, Homo sapiens
gcttcaccagagcat

SEQ ID NO: 3375569 - DNA, 17 bp, Homo sapiens
gcttcaccagtctgtct

SEQ ID NO: 3375570 - DNA, 18 bp, Homo sapiens
gcttcaccagtctgtcta

SEQ ID NO: 3375571 - DNA, 20 bp, Homo sapiens
gcttcaccatggccttatga

SEQ ID NO: 3375572 - DNA, 16 bp, Homo sapiens
gcttcacccctgcact

SEQ ID NO: 3375573 - DNA, 20 bp, Homo sapiens
gcttcacccctgcacttcag

SEQ ID NO: 3375574 - DNA, 22 bp, Homo sapiens
gcttcaccctgaatggttccat

SEQ ID NO: 3375575 - DNA, 16 bp, Homo sapiens
gcttcactgtataaat

SEQ ID NO: 3375576 - DNA, 17 bp, Homo sapiens
gcttcactgtataaata

SEQ ID NO: 3375577 - DNA, 18 bp, Homo sapiens
gcttcagagtttgtgtgt

SEQ ID NO: 3375578 - DNA, 20 bp, Homo sapiens
gcttcagagtttgtgtgtat

SEQ ID NO: 3375579 - DNA, 19 bp, Homo sapiens
gcttcagcatatttatagc

SEQ ID NO: 3375580 - DNA, 16 bp, Homo sapiens
gcttcaggcaccagca

SEQ ID NO: 3375581 - DNA, 20 bp, Homo sapiens
gcttcaggcaccagcatcca

SEQ ID NO: 3375582 - DNA, 20 bp, Homo sapiens
gcttcagggaggtagtttca

SEQ ID NO: 3375583 - DNA, 20 bp, Homo sapiens
gcttcaggttatcgaaataa

SEQ ID NO: 3375584 - DNA, 23 bp, Homo sapiens
gcttcaggttatcgaaataacaa

SEQ ID NO: 3375585 - DNA, 19 bp, Homo sapiens
gcttcagtcatcagccagc

SEQ ID NO: 3375586 - DNA, 16 bp, Homo sapiens
gcttcagtggcagctg

SEQ ID NO: 3375587 - DNA, 22 bp, Homo sapiens
gcttcataaatgaagcagcttt

SEQ ID NO: 3375588 - DNA, 14 bp, Homo sapiens
gcttcatgccagct

SEQ ID NO: 3375589 - DNA, 16 bp, Homo sapiens
gcttcatgcctttgta

SEQ ID NO: 3375590 - DNA, 15 bp, Homo sapiens
gcttcattctccttg

SEQ ID NO: 3375591 - DNA, 14 bp, Homo sapiens
gcttcatttcaatc

SEQ ID NO: 3375592 - DNA, 17 bp, Homo sapiens
gcttcatttcctgtgtc

SEQ ID NO: 3375593 - DNA, 15 bp, Homo sapiens
gcttccaaatattgt

SEQ ID NO: 3375594 - DNA, 22 bp, Homo sapiens
gcttccagattgacgacaagtg

SEQ ID NO: 3375595 - DNA, 19 bp, Homo sapiens
gcttccaggataaggagac

SEQ ID NO: 3375596 - DNA, 18 bp, Homo sapiens
gcttccaggctcttcctg

SEQ ID NO: 3375597 - DNA, 21 bp, Homo sapiens
gcttccaggctcttcctggac

SEQ ID NO: 3375598 - DNA, 17 bp, Homo sapiens
gcttccatgagaacagc

SEQ ID NO: 3375599 - DNA, 12 bp, Homo sapiens
gcttccatgcct

SEQ ID NO: 3375600 - DNA, 22 bp, Homo sapiens
gcttccatgcctgtagctttcc

SEQ ID NO: 3375601 - DNA, 13 bp, Homo sapiens
gcttcccacctcc

SEQ ID NO: 3375602 - DNA, 23 bp, Homo sapiens
gcttcccacctccctgcccaggc

SEQ ID NO: 3375603 - DNA, 12 bp, Homo sapiens
gcttcccagagg

SEQ ID NO: 3375604 - DNA, 15 bp, Homo sapiens
gcttcccagagggag

SEQ ID NO: 3375605 - DNA, 15 bp, Homo sapiens
gcttcccagccatgc

SEQ ID NO: 3375606 - DNA, 14 bp, Homo sapiens
gcttcccagctctg

SEQ ID NO: 3375607 - DNA, 13 bp, Homo sapiens
gcttcccatccta

SEQ ID NO: 3375608 - DNA, 19 bp, Homo sapiens
gcttcccattgtggctcct

SEQ ID NO: 3375609 - DNA, 14 bp, Homo sapiens
gcttcccccatagc

SEQ ID NO: 3375610 - DNA, 15 bp, Homo sapiens
gcttcccttactttg

SEQ ID NO: 3375611 - DNA, 13 bp, Homo sapiens
gcttccgccactc

SEQ ID NO: 3375612 - DNA, 15 bp, Homo sapiens
gcttccgccactcag

SEQ ID NO: 3375613 - DNA, 17 bp, Homo sapiens
gcttccgccactcagcc

SEQ ID NO: 3375614 - DNA, 22 bp, Homo sapiens
gcttcctcagtaacatttctgt

SEQ ID NO: 3375615 - DNA, 21 bp, Homo sapiens
gcttcctcctccccaactgtg

SEQ ID NO: 3375616 - DNA, 11 bp, Homo sapiens
gcttcctcctg

SEQ ID NO: 3375617 - DNA, 15 bp, Homo sapiens
gcttcctctagaagc

SEQ ID NO: 3375618 - DNA, 16 bp, Homo sapiens
gcttcctgaaataaac

SEQ ID NO: 3375619 - DNA, 17 bp, Homo sapiens
gcttcctgaaataaaca

SEQ ID NO: 3375620 - DNA, 19 bp, Homo sapiens
gcttcctgaaataaacact

SEQ ID NO: 3375621 - DNA, 18 bp, Homo sapiens
gcttcctgacaatcaact

SEQ ID NO: 3375622 - DNA, 12 bp, Homo sapiens
gcttcctggtgt

SEQ ID NO: 3375623 - DNA, 14 bp, Homo sapiens
gcttcctgtccact

SEQ ID NO: 3375624 - DNA, 23 bp, Homo sapiens
gcttcctgtccactctcggggcc

SEQ ID NO: 3375625 - DNA, 15 bp, Homo sapiens
gcttccttctgggac

SEQ ID NO: 3375626 - DNA, 22 bp, Homo sapiens
gcttccttctgtgaaagtacat

SEQ ID NO: 3375627 - DNA, 16 bp, Homo sapiens
gcttcgacttttctta

SEQ ID NO: 3375628 - DNA, 15 bp, Homo sapiens
gcttcgagccaactc

SEQ ID NO: 3375629 - DNA, 23 bp, Homo sapiens
gcttcggttctccagaatgtaag

SEQ ID NO: 3375630 - DNA, 12 bp, Homo sapiens
gcttctatccca

SEQ ID NO: 3375631 - DNA, 20 bp, Homo sapiens
gcttctatcccaggaggtgg

SEQ ID NO: 3375632 - DNA, 20 bp, Homo sapiens
gcttctcaccgtgcagagct

SEQ ID NO: 3375633 - DNA, 13 bp, Homo sapiens
gcttctccagcct

SEQ ID NO: 3375634 - DNA, 14 bp, Homo sapiens
gcttctccccagaa

SEQ ID NO: 3375635 - DNA, 15 bp, Homo sapiens
gcttctccccagaat

SEQ ID NO: 3375636 - DNA, 15 bp, Homo sapiens
gcttctccgccagcc

SEQ ID NO: 3375637 - DNA, 20 bp, Homo sapiens
gcttctccgccagcctcctc

SEQ ID NO: 3375638 - DNA, 24 bp, Homo sapiens
gcttctccgccagcctcctctgga

SEQ ID NO: 3375639 - DNA, 15 bp, Homo sapiens
gcttctcctcccagc

SEQ ID NO: 3375640 - DNA, 12 bp, Homo sapiens
gcttctcctgac

SEQ ID NO: 3375641 - DNA, 14 bp, Homo sapiens
gcttctcctgaccc

SEQ ID NO: 3375642 - DNA, 13 bp, Homo sapiens
gcttctcctgcgc

SEQ ID NO: 3375643 - DNA, 18 bp, Homo sapiens
gcttctcctgttttatat

SEQ ID NO: 3375644 - DNA, 14 bp, Homo sapiens
gcttctctacagac

SEQ ID NO: 3375645 - DNA, 18 bp, Homo sapiens
gcttctctagctctctag

SEQ ID NO: 3375646 - DNA, 22 bp, Homo sapiens
gcttctctagctctctaggcct

SEQ ID NO: 3375647 - DNA, 18 bp, Homo sapiens
gcttctctgacttctgcc

SEQ ID NO: 3375648 - DNA, 11 bp, Homo sapiens
gcttctctgca

SEQ ID NO: 3375649 - DNA, 20 bp, Homo sapiens
gcttctctgctagatttcta

SEQ ID NO: 3375650 - DNA, 19 bp, Homo sapiens
gcttctctgtgaacgattt

SEQ ID NO: 3375651 - DNA, 22 bp, Homo sapiens
gcttctctgtgaacgatttaga

SEQ ID NO: 3375652 - DNA, 19 bp, Homo sapiens
gcttctgaatgctgctact

SEQ ID NO: 3375653 - DNA, 15 bp, Homo sapiens
gcttctgcaccctcc

SEQ ID NO: 3375654 - DNA, 17 bp, Homo sapiens
gcttctgcaccctccac

SEQ ID NO: 3375655 - DNA, 14 bp, Homo sapiens
gcttctgcttttct

SEQ ID NO: 3375656 - DNA, 20 bp, Homo sapiens
gcttctgcttttctgccctg

SEQ ID NO: 3375657 - DNA, 21 bp, Homo sapiens
gcttctgcttttctgccctgg

SEQ ID NO: 3375658 - DNA, 17 bp, Homo sapiens
gcttctggaatttgttc

SEQ ID NO: 3375659 - DNA, 23 bp, Homo sapiens
gcttctggaatttgttcaagttt

SEQ ID NO: 3375660 - DNA, 17 bp, Homo sapiens
gcttctggagcccttgg

SEQ ID NO: 3375661 - DNA, 16 bp, Homo sapiens
gcttctggtactctcc

SEQ ID NO: 3375662 - DNA, 17 bp, Homo sapiens
gcttctggtactctcct

SEQ ID NO: 3375663 - DNA, 14 bp, Homo sapiens
gcttctgtagcttc

SEQ ID NO: 3375664 - DNA, 15 bp, Homo sapiens
gcttctgtagcttct

SEQ ID NO: 3375665 - DNA, 20 bp, Homo sapiens
gcttctgtagtactccttaa

SEQ ID NO: 3375666 - DNA, 16 bp, Homo sapiens
gcttctgtgatgagct

SEQ ID NO: 3375667 - DNA, 14 bp, Homo sapiens
gcttctgtttctag

SEQ ID NO: 3375668 - DNA, 15 bp, Homo sapiens
gcttctgtttctagt

SEQ ID NO: 3375669 - DNA, 17 bp, Homo sapiens
gcttcttaattaatttg

SEQ ID NO: 3375670 - DNA, 18 bp, Homo sapiens
gcttcttactgataattt

SEQ ID NO: 3375671 - DNA, 22 bp, Homo sapiens
gcttcttcctaggtccaagccc

SEQ ID NO: 3375672 - DNA, 21 bp, Homo sapiens
gcttcttgcctctgtgctgtg

SEQ ID NO: 3375673 - DNA, 12 bp, Homo sapiens
gcttctttctag

SEQ ID NO: 3375674 - DNA, 21 bp, Homo sapiens
gcttgaaattactgtgtaaat

SEQ ID NO: 3375675 - DNA, 23 bp, Homo sapiens
gcttgaacacagtattttcccaa

SEQ ID NO: 3375676 - DNA, 13 bp, Homo sapiens
gcttgaacccagg

SEQ ID NO: 3375677 - DNA, 21 bp, Homo sapiens
gcttgaagatcgttagtatct

SEQ ID NO: 3375678 - DNA, 15 bp, Homo sapiens
gcttgaagccaaaga

SEQ ID NO: 3375679 - DNA, 16 bp, Homo sapiens
gcttgaagccaaagaa

SEQ ID NO: 3375680 - DNA, 20 bp, Homo sapiens
gcttgaagccaaagaaaaat

SEQ ID NO: 3375681 - DNA, 11 bp, Homo sapiens
gcttgaatgct

SEQ ID NO: 3375682 - DNA, 20 bp, Homo sapiens
gcttgacaaatattttcatg

SEQ ID NO: 3375683 - DNA, 17 bp, Homo sapiens
gcttgacacagtcagca

SEQ ID NO: 3375684 - DNA, 21 bp, Homo sapiens
gcttgagccgggcccctgggc

SEQ ID NO: 3375685 - DNA, 12 bp, Homo sapiens
gcttgagcctcc

SEQ ID NO: 3375686 - DNA, 13 bp, Homo sapiens
gcttgagcctccc

SEQ ID NO: 3375687 - DNA, 16 bp, Homo sapiens
gcttgagcctccccca

SEQ ID NO: 3375688 - DNA, 20 bp, Homo sapiens
gcttgagcctcccccaaagc

SEQ ID NO: 3375689 - DNA, 14 bp, Homo sapiens
gcttgatgaagcaa

SEQ ID NO: 3375690 - DNA, 14 bp, Homo sapiens
gcttgattctgcag

SEQ ID NO: 3375691 - DNA, 20 bp, Homo sapiens
gcttgccgagcctaatgaaa

SEQ ID NO: 3375692 - DNA, 14 bp, Homo sapiens
gcttgcctggagac

SEQ ID NO: 3375693 - DNA, 21 bp, Homo sapiens
gcttgcgaactagagatgtgc

SEQ ID NO: 3375694 - DNA, 18 bp, Homo sapiens
gcttgcggcaaaaggaaa

SEQ ID NO: 3375695 - DNA, 23 bp, Homo sapiens
gcttggaaattccttgccccaca

SEQ ID NO: 3375696 - DNA, 18 bp, Homo sapiens
gcttggacttcctggggc

SEQ ID NO: 3375697 - DNA, 21 bp, Homo sapiens
gcttggagagtcttgggcctg

SEQ ID NO: 3375698 - DNA, 12 bp, Homo sapiens
gcttggcccagc

SEQ ID NO: 3375699 - DNA, 17 bp, Homo sapiens
gcttggcccggccggcc

SEQ ID NO: 3375700 - DNA, 19 bp, Homo sapiens
gcttggcccggccggcctg

SEQ ID NO: 3375701 - DNA, 23 bp, Homo sapiens
gcttggcccggccggcctggcac

SEQ ID NO: 3375702 - DNA, 15 bp, Homo sapiens
gcttggccctttcct

SEQ ID NO: 3375703 - DNA, 22 bp, Homo sapiens
gcttgggaaaaaaacttggcac

SEQ ID NO: 3375704 - DNA, 22 bp, Homo sapiens
gcttggggccaccaaagctgcc

SEQ ID NO: 3375705 - DNA, 20 bp, Homo sapiens
gcttggggtgtggggtgggg

SEQ ID NO: 3375706 - DNA, 16 bp, Homo sapiens
gcttggtggggctcgt

SEQ ID NO: 3375707 - DNA, 18 bp, Homo sapiens
gcttggtggggctcgtgg

SEQ ID NO: 3375708 - DNA, 19 bp, Homo sapiens
gcttggtggggctcgtggc

SEQ ID NO: 3375709 - DNA, 17 bp, Homo sapiens
gcttgtaaataccagga

SEQ ID NO: 3375710 - DNA, 17 bp, Homo sapiens
gcttgtaaatagctcag

SEQ ID NO: 3375711 - DNA, 15 bp, Homo sapiens
gcttgtaacaagaaa

SEQ ID NO: 3375712 - DNA, 19 bp, Homo sapiens
gcttgtagaactcactctg

SEQ ID NO: 3375713 - DNA, 17 bp, Homo sapiens
gcttgtagaattgttat

SEQ ID NO: 3375714 - DNA, 22 bp, Homo sapiens
gcttgtaggagctgaggtttca

SEQ ID NO: 3375715 - DNA, 17 bp, Homo sapiens
gcttgtatcaacactgt

SEQ ID NO: 3375716 - DNA, 20 bp, Homo sapiens
gcttgtcttcgctggctcct

SEQ ID NO: 3375717 - DNA, 21 bp, Homo sapiens
gcttgtcttcgctggctccta

SEQ ID NO: 3375718 - DNA, 21 bp, Homo sapiens
gcttgtcttttctgctgagga

SEQ ID NO: 3375719 - DNA, 12 bp, Homo sapiens
gcttgtgaacag

SEQ ID NO: 3375720 - DNA, 14 bp, Homo sapiens
gcttgtgaactgct

SEQ ID NO: 3375721 - DNA, 16 bp, Homo sapiens
gcttgtgaactgctgg

SEQ ID NO: 3375722 - DNA, 23 bp, Homo sapiens
gcttgtggattgagggtaggagg

SEQ ID NO: 3375723 - DNA, 16 bp, Homo sapiens
gcttgtgggctggtgc

SEQ ID NO: 3375724 - DNA, 18 bp, Homo sapiens
gcttgtggggacccaggc

SEQ ID NO: 3375725 - DNA, 19 bp, Homo sapiens
gcttgtgtgtttcactttt

SEQ ID NO: 3375726 - DNA, 15 bp, Homo sapiens
gcttgttagagagaa

SEQ ID NO: 3375727 - DNA, 17 bp, Homo sapiens
gcttgttatcagctttc

SEQ ID NO: 3375728 - DNA, 15 bp, Homo sapiens
gcttgttatttataa

SEQ ID NO: 3375729 - DNA, 18 bp, Homo sapiens
gcttgtttacctttctct

SEQ ID NO: 3375730 - DNA, 17 bp, Homo sapiens
gcttgtttgatttcaac

SEQ ID NO: 3375731 - DNA, 19 bp, Homo sapiens
gcttgtttgatttcaacat

SEQ ID NO: 3375732 - DNA, 16 bp, Homo sapiens
gctttaaacacccttc

SEQ ID NO: 3375733 - DNA, 18 bp, Homo sapiens
gctttaaactcagggaca

SEQ ID NO: 3375734 - DNA, 15 bp, Homo sapiens
gctttaaagtgtaat

SEQ ID NO: 3375735 - DNA, 13 bp, Homo sapiens
gctttaagccttc

SEQ ID NO: 3375736 - DNA, 15 bp, Homo sapiens
gctttaatcaatcat

SEQ ID NO: 3375737 - DNA, 15 bp, Homo sapiens
gctttaattgtataa

SEQ ID NO: 3375738 - DNA, 16 bp, Homo sapiens
gctttaattgtataag

SEQ ID NO: 3375739 - DNA, 20 bp, Homo sapiens
gctttaattgtataagtcaa

SEQ ID NO: 3375740 - DNA, 12 bp, Homo sapiens
gctttacacaca

SEQ ID NO: 3375741 - DNA, 22 bp, Homo sapiens
gctttacctttttgtatgtgaa

SEQ ID NO: 3375742 - DNA, 21 bp, Homo sapiens
gctttagaattctaattgtca

SEQ ID NO: 3375743 - DNA, 17 bp, Homo sapiens
gctttagaccctgggtg

SEQ ID NO: 3375744 - DNA, 20 bp, Homo sapiens
gctttatacgtgtagctata

SEQ ID NO: 3375745 - DNA, 16 bp, Homo sapiens
gctttattatggcttg

SEQ ID NO: 3375746 - DNA, 20 bp, Homo sapiens
gctttattatggcttgtgaa

SEQ ID NO: 3375747 - DNA, 21 bp, Homo sapiens
gctttattgcccatgggatat

SEQ ID NO: 3375748 - DNA, 11 bp, Homo sapiens
gctttcaagtg

SEQ ID NO: 3375749 - DNA, 21 bp, Homo sapiens
gctttcaattgacaaatgatg

SEQ ID NO: 3375750 - DNA, 13 bp, Homo sapiens
gctttcagagcca

SEQ ID NO: 3375751 - DNA, 22 bp, Homo sapiens
gctttcccccaggcgcctgcgc

SEQ ID NO: 3375752 - DNA, 22 bp, Homo sapiens
gctttccccgggggaggaaggg

SEQ ID NO: 3375753 - DNA, 15 bp, Homo sapiens
gctttcccctgtggg

SEQ ID NO: 3375754 - DNA, 12 bp, Homo sapiens
gctttcctgaat

SEQ ID NO: 3375755 - DNA, 19 bp, Homo sapiens
gctttcctgggcctttgca

SEQ ID NO: 3375756 - DNA, 17 bp, Homo sapiens
gctttcctgtttccagg

SEQ ID NO: 3375757 - DNA, 22 bp, Homo sapiens
gctttccttgtggcagaggatg

SEQ ID NO: 3375758 - DNA, 17 bp, Homo sapiens
gctttcggagctcctgt

SEQ ID NO: 3375759 - DNA, 19 bp, Homo sapiens
gctttctacccagcgagcc

SEQ ID NO: 3375760 - DNA, 22 bp, Homo sapiens
gctttctacccagcgagccctg

SEQ ID NO: 3375761 - DNA, 12 bp, Homo sapiens
gctttctcaggg

SEQ ID NO: 3375762 - DNA, 15 bp, Homo sapiens
gctttctccggggtc

SEQ ID NO: 3375763 - DNA, 13 bp, Homo sapiens
gctttctctcaga

SEQ ID NO: 3375764 - DNA, 19 bp, Homo sapiens
gctttctcttttctctttt

SEQ ID NO: 3375765 - DNA, 17 bp, Homo sapiens
gctttctggggcctagc

SEQ ID NO: 3375766 - DNA, 13 bp, Homo sapiens
gctttctgttcca

SEQ ID NO: 3375767 - DNA, 15 bp, Homo sapiens
gctttctgtttctta

SEQ ID NO: 3375768 - DNA, 20 bp, Homo sapiens
gctttcttgctcccttcagc

SEQ ID NO: 3375769 - DNA, 17 bp, Homo sapiens
gctttctttgattctcc

SEQ ID NO: 3375770 - DNA, 19 bp, Homo sapiens
gctttctttgattctcctt

SEQ ID NO: 3375771 - DNA, 15 bp, Homo sapiens
gctttgaaagaagca

SEQ ID NO: 3375772 - DNA, 16 bp, Homo sapiens
gctttgaaagaagcaa

SEQ ID NO: 3375773 - DNA, 22 bp, Homo sapiens
gctttgagaagccttcagctcc

SEQ ID NO: 3375774 - DNA, 20 bp, Homo sapiens
gctttgattcatagtaactt

SEQ ID NO: 3375775 - DNA, 21 bp, Homo sapiens
gctttgcaggctctgggctca

SEQ ID NO: 3375776 - DNA, 20 bp, Homo sapiens
gctttgcattcctacaaaga

SEQ ID NO: 3375777 - DNA, 22 bp, Homo sapiens
gctttgcattcctacaaagatg

SEQ ID NO: 3375778 - DNA, 19 bp, Homo sapiens
gctttgccaagttgctgtc

SEQ ID NO: 3375779 - DNA, 20 bp, Homo sapiens
gctttgcctggttttgtctt

SEQ ID NO: 3375780 - DNA, 17 bp, Homo sapiens
gctttgccttgcagcca

SEQ ID NO: 3375781 - DNA, 22 bp, Homo sapiens
gctttgctacaaatttatgcat

SEQ ID NO: 3375782 - DNA, 14 bp, Homo sapiens
gctttgctgctacc

SEQ ID NO: 3375783 - DNA, 14 bp, Homo sapiens
gctttgctgctatg

SEQ ID NO: 3375784 - DNA, 15 bp, Homo sapiens
gctttgctgctatga

SEQ ID NO: 3375785 - DNA, 18 bp, Homo sapiens
gctttggacccaaggaaa

SEQ ID NO: 3375786 - DNA, 22 bp, Homo sapiens
gctttggacctaaatggcctca

SEQ ID NO: 3375787 - DNA, 16 bp, Homo sapiens
gctttggcagtgccat

SEQ ID NO: 3375788 - DNA, 14 bp, Homo sapiens
gctttggctgaggg

SEQ ID NO: 3375789 - DNA, 16 bp, Homo sapiens
gctttgggaaagccca

SEQ ID NO: 3375790 - DNA, 18 bp, Homo sapiens
gctttgggaaagcccaga

SEQ ID NO: 3375791 - DNA, 19 bp, Homo sapiens
gctttgggaaagcccagac

SEQ ID NO: 3375792 - DNA, 22 bp, Homo sapiens
gctttgggaatgtttttagctg

SEQ ID NO: 3375793 - DNA, 17 bp, Homo sapiens
gctttgggaggccaagg

SEQ ID NO: 3375794 - DNA, 19 bp, Homo sapiens
gctttgggaggccaaggca

SEQ ID NO: 3375795 - DNA, 20 bp, Homo sapiens
gctttgggatcccaccctgg

SEQ ID NO: 3375796 - DNA, 21 bp, Homo sapiens
gctttgggccgaatcccccag

SEQ ID NO: 3375797 - DNA, 14 bp, Homo sapiens
gctttgggctgccc

SEQ ID NO: 3375798 - DNA, 18 bp, Homo sapiens
gctttggggtgtcttttt

SEQ ID NO: 3375799 - DNA, 17 bp, Homo sapiens
gctttggttaaaaatgg

SEQ ID NO: 3375800 - DNA, 15 bp, Homo sapiens
gctttgtatgcactt

SEQ ID NO: 3375801 - DNA, 14 bp, Homo sapiens
gctttgtctgtcgt

SEQ ID NO: 3375802 - DNA, 16 bp, Homo sapiens
gctttgtttggatgcc

SEQ ID NO: 3375803 - DNA, 20 bp, Homo sapiens
gcttttacgtagtaaaagtc

SEQ ID NO: 3375804 - DNA, 13 bp, Homo sapiens
gcttttactgttt

SEQ ID NO: 3375805 - DNA, 13 bp, Homo sapiens
gcttttactttat

SEQ ID NO: 3375806 - DNA, 21 bp, Homo sapiens
gcttttaggcttgaaatctcc

SEQ ID NO: 3375807 - DNA, 16 bp, Homo sapiens
gcttttatatggccca

SEQ ID NO: 3375808 - DNA, 22 bp, Homo sapiens
gcttttatatggcccagccttg

SEQ ID NO: 3375809 - DNA, 20 bp, Homo sapiens
gcttttatggatgattaaat

SEQ ID NO: 3375810 - DNA, 15 bp, Homo sapiens
gcttttattaaattt

SEQ ID NO: 3375811 - DNA, 19 bp, Homo sapiens
gcttttattttaatattga

SEQ ID NO: 3375812 - DNA, 13 bp, Homo sapiens
gcttttcactgct

SEQ ID NO: 3375813 - DNA, 18 bp, Homo sapiens
gcttttcactgctggctg

SEQ ID NO: 3375814 - DNA, 14 bp, Homo sapiens
gcttttcatgtaga

SEQ ID NO: 3375815 - DNA, 20 bp, Homo sapiens
gcttttccaggatcctgcag

SEQ ID NO: 3375816 - DNA, 16 bp, Homo sapiens
gcttttcctcaagcaa

SEQ ID NO: 3375817 - DNA, 13 bp, Homo sapiens
gcttttctgccac

SEQ ID NO: 3375818 - DNA, 17 bp, Homo sapiens
gcttttctgccactcca

SEQ ID NO: 3375819 - DNA, 15 bp, Homo sapiens
gcttttctgccctgg

SEQ ID NO: 3375820 - DNA, 16 bp, Homo sapiens
gcttttctgccctggc

SEQ ID NO: 3375821 - DNA, 19 bp, Homo sapiens
gcttttctgccctggctgc

SEQ ID NO: 3375822 - DNA, 23 bp, Homo sapiens
gcttttctgtagatgttgtcttg

SEQ ID NO: 3375823 - DNA, 18 bp, Homo sapiens
gcttttgccactccttgt

SEQ ID NO: 3375824 - DNA, 18 bp, Homo sapiens
gcttttggggagccagaa

SEQ ID NO: 3375825 - DNA, 18 bp, Homo sapiens
gcttttgttccaatgtca

SEQ ID NO: 3375826 - DNA, 20 bp, Homo sapiens
gcttttgttgtgacttttta

SEQ ID NO: 3375827 - DNA, 14 bp, Homo sapiens
gcttttgttgttta

SEQ ID NO: 3375828 - DNA, 14 bp, Homo sapiens
gcttttgttttttt

SEQ ID NO: 3375829 - DNA, 22 bp, Homo sapiens
gcttttgtttttttcctcatgt

SEQ ID NO: 3375830 - DNA, 22 bp, Homo sapiens
gctttttaattgttgtttcttt

SEQ ID NO: 3375831 - DNA, 21 bp, Homo sapiens
gctttttatttctgcatatgt

SEQ ID NO: 3375832 - DNA, 16 bp, Homo sapiens
gctttttcctcctgga

SEQ ID NO: 3375833 - DNA, 16 bp, Homo sapiens
gctttttcctctgagc

SEQ ID NO: 3375834 - DNA, 18 bp, Homo sapiens
gctttttcctctgagccc

SEQ ID NO: 3375835 - DNA, 20 bp, Homo sapiens
gctttttcctctgagcccag

SEQ ID NO: 3375836 - DNA, 12 bp, Homo sapiens
gctttttgaaat

SEQ ID NO: 3375837 - DNA, 13 bp, Homo sapiens
gctttttgaaatg

SEQ ID NO: 3375838 - DNA, 16 bp, Homo sapiens
gctttttgaaatgaaa

SEQ ID NO: 3375839 - DNA, 18 bp, Homo sapiens
gctttttggtgtatagaa

SEQ ID NO: 3375840 - DNA, 22 bp, Homo sapiens
gcttttttatttaccttttaag

SEQ ID NO: 3375841 - DNA, 20 bp, Homo sapiens
gcttttttccaaaacaaaaa

SEQ ID NO: 3375842 - DNA, 17 bp, Homo sapiens
gcttttttgttttggct

SEQ ID NO: 3375843 - DNA, 16 bp, Homo sapiens
gctttttttcttgcta

SEQ ID NO: 3375844 - DNA, 20 bp, Homo sapiens
gctttttttcttgctagtat

SEQ ID NO: 3375845 - DNA, 20 bp, Homo sapiens
gctttttttgcctaccattt

SEQ ID NO: 3375846 - DNA, 15 bp, Homo sapiens
gcttttttttccttc

SEQ ID NO: 3375847 - DNA, 15 bp, Homo sapiens
gcttttttttttcca

SEQ ID NO: 3375848 - DNA, 17 bp, Homo sapiens
gcttttttttttccagc

SEQ ID NO: 3375849 - DNA, 21 bp, Homo sapiens
gcttttttttttccagcaagt

SEQ ID NO: 3375850 - DNA, 15 bp, Homo sapiens
ggaaaaaaaaacagc

SEQ ID NO: 3375851 - DNA, 23 bp, Homo sapiens
ggaaaaagcaagttcgtctgttg

SEQ ID NO: 3375852 - DNA, 18 bp, Homo sapiens
ggaaaaataaaagaaaat

SEQ ID NO: 3375853 - DNA, 14 bp, Homo sapiens
ggaaaaataatcaa

SEQ ID NO: 3375854 - DNA, 23 bp, Homo sapiens
ggaaaaataatcaagattttagg

SEQ ID NO: 3375855 - DNA, 15 bp, Homo sapiens
ggaaaaatggttgat

SEQ ID NO: 3375856 - DNA, 21 bp, Homo sapiens
ggaaaaatggttgatggaaaa

SEQ ID NO: 3375857 - DNA, 14 bp, Homo sapiens
ggaaaaatgtgaaa

SEQ ID NO: 3375858 - DNA, 12 bp, Homo sapiens
ggaaaaatgttt

SEQ ID NO: 3375859 - DNA, 13 bp, Homo sapiens
ggaaaaatgtttg

SEQ ID NO: 3375860 - DNA, 13 bp, Homo sapiens
ggaaaaatttgaa

SEQ ID NO: 3375861 - DNA, 14 bp, Homo sapiens
ggaaaacatttgct

SEQ ID NO: 3375862 - DNA, 22 bp, Homo sapiens
ggaaaaccaagccgtggcttcc

SEQ ID NO: 3375863 - DNA, 14 bp, Homo sapiens
ggaaaactgtgttg

SEQ ID NO: 3375864 - DNA, 14 bp, Homo sapiens
ggaaaagaaacctg

SEQ ID NO: 3375865 - DNA, 22 bp, Homo sapiens
ggaaaagataaagaccagaaat

SEQ ID NO: 3375866 - DNA, 18 bp, Homo sapiens
ggaaaagcgtctttaaga

SEQ ID NO: 3375867 - DNA, 20 bp, Homo sapiens
ggaaaagctgctgacagtgt

SEQ ID NO: 3375868 - DNA, 15 bp, Homo sapiens
ggaaaagtacattta

SEQ ID NO: 3375869 - DNA, 18 bp, Homo sapiens
ggaaaagttaaactaaaa

SEQ ID NO: 3375870 - DNA, 14 bp, Homo sapiens
ggaaaataaattat

SEQ ID NO: 3375871 - DNA, 21 bp, Homo sapiens
ggaaaatacctaattgtggat

SEQ ID NO: 3375872 - DNA, 19 bp, Homo sapiens
ggaaaataggcaggaagcc

SEQ ID NO: 3375873 - DNA, 21 bp, Homo sapiens
ggaaaatgagtatttggtcca

SEQ ID NO: 3375874 - DNA, 19 bp, Homo sapiens
ggaaaatgccatgaattac

SEQ ID NO: 3375875 - DNA, 14 bp, Homo sapiens
ggaaacagcatgaa

SEQ ID NO: 3375876 - DNA, 15 bp, Homo sapiens
ggaaacagcatgaat

SEQ ID NO: 3375877 - DNA, 15 bp, Homo sapiens
ggaaacaggaccaca

SEQ ID NO: 3375878 - DNA, 18 bp, Homo sapiens
ggaaacattacagttcat

SEQ ID NO: 3375879 - DNA, 15 bp, Homo sapiens
ggaaactaagcattg

SEQ ID NO: 3375880 - DNA, 18 bp, Homo sapiens
ggaaactccacatctgcc

SEQ ID NO: 3375881 - DNA, 21 bp, Homo sapiens
ggaaactccacatctgcctta

SEQ ID NO: 3375882 - DNA, 15 bp, Homo sapiens
ggaaagaagggggcc

SEQ ID NO: 3375883 - DNA, 15 bp, Homo sapiens
ggaaagcaataaatg

SEQ ID NO: 3375884 - DNA, 18 bp, Homo sapiens
ggaaagcatcacctcagg

SEQ ID NO: 3375885 - DNA, 11 bp, Homo sapiens
ggaaagcccag

SEQ ID NO: 3375886 - DNA, 12 bp, Homo sapiens
ggaaagccctcc

SEQ ID NO: 3375887 - DNA, 14 bp, Homo sapiens
ggaaagcctctgct

SEQ ID NO: 3375888 - DNA, 16 bp, Homo sapiens
ggaaagcctctgctgc

SEQ ID NO: 3375889 - DNA, 13 bp, Homo sapiens
ggaaaggacccac

SEQ ID NO: 3375890 - DNA, 14 bp, Homo sapiens
ggaaaggggggagc

SEQ ID NO: 3375891 - DNA, 18 bp, Homo sapiens
ggaaaggggggagctggg

SEQ ID NO: 3375892 - DNA, 22 bp, Homo sapiens
ggaaagggggtcccagtgggag

SEQ ID NO: 3375893 - DNA, 17 bp, Homo sapiens
ggaaagtcaagaagaat

SEQ ID NO: 3375894 - DNA, 14 bp, Homo sapiens
ggaaagtgaatttg

SEQ ID NO: 3375895 - DNA, 13 bp, Homo sapiens
ggaaagtgccagc

SEQ ID NO: 3375896 - DNA, 18 bp, Homo sapiens
ggaaatacccttctttta

SEQ ID NO: 3375897 - DNA, 20 bp, Homo sapiens
ggaaatattttgataataaa

SEQ ID NO: 3375898 - DNA, 19 bp, Homo sapiens
ggaaatcatcgaaaattca

SEQ ID NO: 3375899 - DNA, 20 bp, Homo sapiens
ggaaatccattgtttaaaga

SEQ ID NO: 3375900 - DNA, 20 bp, Homo sapiens
ggaaatcctagtttcctctc

SEQ ID NO: 3375901 - DNA, 19 bp, Homo sapiens
ggaaatcctgccctggagg

SEQ ID NO: 3375902 - DNA, 16 bp, Homo sapiens
ggaaatctacttccta

SEQ ID NO: 3375903 - DNA, 13 bp, Homo sapiens
ggaaatcttaaac

SEQ ID NO: 3375904 - DNA, 12 bp, Homo sapiens
ggaaatgtactt

SEQ ID NO: 3375905 - DNA, 17 bp, Homo sapiens
ggaaatgtcaacaagta

SEQ ID NO: 3375906 - DNA, 19 bp, Homo sapiens
ggaaatgtcatctaaccat

SEQ ID NO: 3375907 - DNA, 20 bp, Homo sapiens
ggaaattaaatccaataaaa

SEQ ID NO: 3375908 - DNA, 23 bp, Homo sapiens
ggaaattcaggtgaaaatgttca

SEQ ID NO: 3375909 - DNA, 16 bp, Homo sapiens
ggaaattcctgtactg

SEQ ID NO: 3375910 - DNA, 20 bp, Homo sapiens
ggaaattccttgccccacag

SEQ ID NO: 3375911 - DNA, 21 bp, Homo sapiens
ggaaattccttgccccacagt

SEQ ID NO: 3375912 - DNA, 16 bp, Homo sapiens
ggaacaaaaaaaccac

SEQ ID NO: 3375913 - DNA, 21 bp, Homo sapiens
ggaacaaaaaaaccacaaagg

SEQ ID NO: 3375914 - DNA, 19 bp, Homo sapiens
ggaacaaaaattacaaaga

SEQ ID NO: 3375915 - DNA, 18 bp, Homo sapiens
ggaacaaggagtcagaca

SEQ ID NO: 3375916 - DNA, 19 bp, Homo sapiens
ggaacaattgaagtaaact

SEQ ID NO: 3375917 - DNA, 16 bp, Homo sapiens
ggaacacctgatctta

SEQ ID NO: 3375918 - DNA, 17 bp, Homo sapiens
ggaacagacctgaggct

SEQ ID NO: 3375919 - DNA, 11 bp, Homo sapiens
ggaacagcaga

SEQ ID NO: 3375920 - DNA, 19 bp, Homo sapiens
ggaacagcgggagacctgt

SEQ ID NO: 3375921 - DNA, 20 bp, Homo sapiens
ggaacagcgggagacctgtg

SEQ ID NO: 3375922 - DNA, 19 bp, Homo sapiens
ggaacagctatgggagccc

SEQ ID NO: 3375923 - DNA, 15 bp, Homo sapiens
ggaacagtaagaaca

SEQ ID NO: 3375924 - DNA, 17 bp, Homo sapiens
ggaacagtggctgggtg

SEQ ID NO: 3375925 - DNA, 20 bp, Homo sapiens
ggaacatcctttgcagggca

SEQ ID NO: 3375926 - DNA, 11 bp, Homo sapiens
ggaacatttct

SEQ ID NO: 3375927 - DNA, 22 bp, Homo sapiens
ggaacatttctgtaaataccat

SEQ ID NO: 3375928 - DNA, 19 bp, Homo sapiens
ggaaccacagggccagagg

SEQ ID NO: 3375929 - DNA, 23 bp, Homo sapiens
ggaaccacagggccagagggagc

SEQ ID NO: 3375930 - DNA, 13 bp, Homo sapiens
ggaaccactccca

SEQ ID NO: 3375931 - DNA, 17 bp, Homo sapiens
ggaaccagggaggagag

SEQ ID NO: 3375932 - DNA, 19 bp, Homo sapiens
ggaaccagggaggagagga

SEQ ID NO: 3375933 - DNA, 18 bp, Homo sapiens
ggaaccatgaagacagga

SEQ ID NO: 3375934 - DNA, 18 bp, Homo sapiens
ggaacctagtactctctg

SEQ ID NO: 3375935 - DNA, 14 bp, Homo sapiens
ggaacctcccagag

SEQ ID NO: 3375936 - DNA, 16 bp, Homo sapiens
ggaacctcccagaggt

SEQ ID NO: 3375937 - DNA, 22 bp, Homo sapiens
ggaacctcccagaggtccagcc

SEQ ID NO: 3375938 - DNA, 19 bp, Homo sapiens
ggaacctgaggcctgaagg

SEQ ID NO: 3375939 - DNA, 15 bp, Homo sapiens
ggaaccttccctcca

SEQ ID NO: 3375940 - DNA, 16 bp, Homo sapiens
ggaaccttccttcctg

SEQ ID NO: 3375941 - DNA, 13 bp, Homo sapiens
ggaaccttgctgt

SEQ ID NO: 3375942 - DNA, 14 bp, Homo sapiens
ggaacgagcactgg

SEQ ID NO: 3375943 - DNA, 16 bp, Homo sapiens
ggaacgagcactggcc

SEQ ID NO: 3375944 - DNA, 14 bp, Homo sapiens
ggaacgatgtgtct

SEQ ID NO: 3375945 - DNA, 14 bp, Homo sapiens
ggaactaaagcaaa

SEQ ID NO: 3375946 - DNA, 13 bp, Homo sapiens
ggaactactgtac

SEQ ID NO: 3375947 - DNA, 16 bp, Homo sapiens
ggaactactgtacttt

SEQ ID NO: 3375948 - DNA, 21 bp, Homo sapiens
ggaactagagggatacactga

SEQ ID NO: 3375949 - DNA, 18 bp, Homo sapiens
ggaactatggcaaggaac

SEQ ID NO: 3375950 - DNA, 19 bp, Homo sapiens
ggaactccactctccttcg

SEQ ID NO: 3375951 - DNA, 12 bp, Homo sapiens
ggaactctgaca

SEQ ID NO: 3375952 - DNA, 13 bp, Homo sapiens
ggaactctgacaa

SEQ ID NO: 3375953 - DNA, 14 bp, Homo sapiens
ggaactctgacaag

SEQ ID NO: 3375954 - DNA, 23 bp, Homo sapiens
ggaactgagtcacgctggggctc

SEQ ID NO: 3375955 - DNA, 23 bp, Homo sapiens
ggaactggctgtgaagacccagg

SEQ ID NO: 3375956 - DNA, 16 bp, Homo sapiens
ggaactgggctgggcc

SEQ ID NO: 3375957 - DNA, 20 bp, Homo sapiens
ggaactggggctttgccttg

SEQ ID NO: 3375958 - DNA, 15 bp, Homo sapiens
ggaactgtagggcca

SEQ ID NO: 3375959 - DNA, 14 bp, Homo sapiens
ggaactgtccagag

SEQ ID NO: 3375960 - DNA, 15 bp, Homo sapiens
ggaactgtccagaga

SEQ ID NO: 3375961 - DNA, 16 bp, Homo sapiens
ggaactgtccagagag

SEQ ID NO: 3375962 - DNA, 15 bp, Homo sapiens
ggaacttctaatata

SEQ ID NO: 3375963 - DNA, 14 bp, Homo sapiens
ggaagaaaatggtt

SEQ ID NO: 3375964 - DNA, 20 bp, Homo sapiens
ggaagaaaatggtttatttt

SEQ ID NO: 3375965 - DNA, 16 bp, Homo sapiens
ggaagaacatagaact

SEQ ID NO: 3375966 - DNA, 13 bp, Homo sapiens
ggaagaagggaga

SEQ ID NO: 3375967 - DNA, 13 bp, Homo sapiens
ggaagaaggggcc

SEQ ID NO: 3375968 - DNA, 19 bp, Homo sapiens
ggaagaccaaaggaaggaa

SEQ ID NO: 3375969 - DNA, 19 bp, Homo sapiens
ggaagacttgaagcacaga

SEQ ID NO: 3375970 - DNA, 12 bp, Homo sapiens
ggaagagaaatc

SEQ ID NO: 3375971 - DNA, 23 bp, Homo sapiens
ggaagagaagagggcccagccca

SEQ ID NO: 3375972 - DNA, 13 bp, Homo sapiens
ggaagagaatcac

SEQ ID NO: 3375973 - DNA, 19 bp, Homo sapiens
ggaagagcagcctgatggc

SEQ ID NO: 3375974 - DNA, 14 bp, Homo sapiens
ggaagagcaggcac

SEQ ID NO: 3375975 - DNA, 17 bp, Homo sapiens
ggaagagttggtctctg

SEQ ID NO: 3375976 - DNA, 17 bp, Homo sapiens
ggaagataggctctgca

SEQ ID NO: 3375977 - DNA, 14 bp, Homo sapiens
ggaagatatacatg

SEQ ID NO: 3375978 - DNA, 17 bp, Homo sapiens
ggaagatgaggttctga

SEQ ID NO: 3375979 - DNA, 18 bp, Homo sapiens
ggaagattttaaattcac

SEQ ID NO: 3375980 - DNA, 15 bp, Homo sapiens
ggaagcagccagctc

SEQ ID NO: 3375981 - DNA, 11 bp, Homo sapiens
ggaagcagtgc

SEQ ID NO: 3375982 - DNA, 16 bp, Homo sapiens
ggaagcattcagagag

SEQ ID NO: 3375983 - DNA, 20 bp, Homo sapiens
ggaagcattcagagagcagc

SEQ ID NO: 3375984 - DNA, 15 bp, Homo sapiens
ggaagccaaatttat

SEQ ID NO: 3375985 - DNA, 12 bp, Homo sapiens
ggaagccaggta

SEQ ID NO: 3375986 - DNA, 18 bp, Homo sapiens
ggaagccaggtacaggag

SEQ ID NO: 3375987 - DNA, 23 bp, Homo sapiens
ggaagccatccctttttttacat

SEQ ID NO: 3375988 - DNA, 12 bp, Homo sapiens
ggaagcccacac

SEQ ID NO: 3375989 - DNA, 19 bp, Homo sapiens
ggaagcccacactatgcac

SEQ ID NO: 3375990 - DNA, 15 bp, Homo sapiens
ggaagccccaacggg

SEQ ID NO: 3375991 - DNA, 18 bp, Homo sapiens
ggaagcccctgggcccag

SEQ ID NO: 3375992 - DNA, 17 bp, Homo sapiens
ggaagcctccccttggc

SEQ ID NO: 3375993 - DNA, 11 bp, Homo sapiens
ggaagccttgc

SEQ ID NO: 3375994 - DNA, 23 bp, Homo sapiens
ggaagcgatgaatttggagactc

SEQ ID NO: 3375995 - DNA, 10 bp, Homo sapiens
ggaagctgca

SEQ ID NO: 3375996 - DNA, 17 bp, Homo sapiens
ggaagctgcacatgtgc

SEQ ID NO: 3375997 - DNA, 12 bp, Homo sapiens
ggaagctgcagc

SEQ ID NO: 3375998 - DNA, 16 bp, Homo sapiens
ggaagctgcagcttgg

SEQ ID NO: 3375999 - DNA, 16 bp, Homo sapiens
ggaagctgccagccca

SEQ ID NO: 3376000 - DNA, 18 bp, Homo sapiens
ggaagctggccgagggtc

SEQ ID NO: 3376001 - DNA, 17 bp, Homo sapiens
ggaagctgtactcagag

SEQ ID NO: 3376002 - DNA, 19 bp, Homo sapiens
ggaagctgtactcagagca

SEQ ID NO: 3376003 - DNA, 21 bp, Homo sapiens
ggaagctgtactcagagcaga

SEQ ID NO: 3376004 - DNA, 16 bp, Homo sapiens
ggaagcttgagcctcc

SEQ ID NO: 3376005 - DNA, 15 bp, Homo sapiens
ggaagcttggggaac

SEQ ID NO: 3376006 - DNA, 21 bp, Homo sapiens
ggaaggaaatcccatcagtga

SEQ ID NO: 3376007 - DNA, 16 bp, Homo sapiens
ggaaggacagactggc

SEQ ID NO: 3376008 - DNA, 15 bp, Homo sapiens
ggaaggagacttagg

SEQ ID NO: 3376009 - DNA, 15 bp, Homo sapiens
ggaaggagagcctgc

SEQ ID NO: 3376010 - DNA, 16 bp, Homo sapiens
ggaaggagagcctgct

SEQ ID NO: 3376011 - DNA, 12 bp, Homo sapiens
ggaaggagcagt

SEQ ID NO: 3376012 - DNA, 12 bp, Homo sapiens
ggaaggagcggc

SEQ ID NO: 3376013 - DNA, 15 bp, Homo sapiens
ggaaggagcggcgcc

SEQ ID NO: 3376014 - DNA, 20 bp, Homo sapiens
ggaaggaggggaagctgcag

SEQ ID NO: 3376015 - DNA, 23 bp, Homo sapiens
ggaaggattgtaaaaaaaaatgc

SEQ ID NO: 3376016 - DNA, 17 bp, Homo sapiens
ggaaggcagacagcagg

SEQ ID NO: 3376017 - DNA, 12 bp, Homo sapiens
ggaaggcagctg

SEQ ID NO: 3376018 - DNA, 20 bp, Homo sapiens
ggaaggcagggcagagggaa

SEQ ID NO: 3376019 - DNA, 18 bp, Homo sapiens
ggaaggcctaggctagga

SEQ ID NO: 3376020 - DNA, 14 bp, Homo sapiens
ggaaggctggctga

SEQ ID NO: 3376021 - DNA, 15 bp, Homo sapiens
ggaaggctggctgag

SEQ ID NO: 3376022 - DNA, 13 bp, Homo sapiens
ggaagggacctgg

SEQ ID NO: 3376023 - DNA, 12 bp, Homo sapiens
ggaagggcagga

SEQ ID NO: 3376024 - DNA, 13 bp, Homo sapiens
ggaaggggccacg

SEQ ID NO: 3376025 - DNA, 18 bp, Homo sapiens
ggaaggggccttgctgag

SEQ ID NO: 3376026 - DNA, 18 bp, Homo sapiens
ggaagggtttgtggctgg

SEQ ID NO: 3376027 - DNA, 19 bp, Homo sapiens
ggaaggtcccttgtttcca

SEQ ID NO: 3376028 - DNA, 13 bp, Homo sapiens
ggaaggtctcatt

SEQ ID NO: 3376029 - DNA, 15 bp, Homo sapiens
ggaaggtgaagatga

SEQ ID NO: 3376030 - DNA, 16 bp, Homo sapiens
ggaaggtgctgagctt

SEQ ID NO: 3376031 - DNA, 21 bp, Homo sapiens
ggaagtaagcaaacaaatatt

SEQ ID NO: 3376032 - DNA, 15 bp, Homo sapiens
ggaagtccaatgtgg

SEQ ID NO: 3376033 - DNA, 16 bp, Homo sapiens
ggaagtccaatgtggc

SEQ ID NO: 3376034 - DNA, 15 bp, Homo sapiens
ggaagtctacctgct

SEQ ID NO: 3376035 - DNA, 16 bp, Homo sapiens
ggaagtctacctgctg

SEQ ID NO: 3376036 - DNA, 17 bp, Homo sapiens
ggaagtctacctgctgg

SEQ ID NO: 3376037 - DNA, 18 bp, Homo sapiens
ggaagtctacctgctgga

SEQ ID NO: 3376038 - DNA, 20 bp, Homo sapiens
ggaagtgaagactggaagct

SEQ ID NO: 3376039 - DNA, 17 bp, Homo sapiens
ggaagtgcttgatatgt

SEQ ID NO: 3376040 - DNA, 19 bp, Homo sapiens
ggaagtgtaacagctgagg

SEQ ID NO: 3376041 - DNA, 21 bp, Homo sapiens
ggaagtgtaacagctgaggtc

SEQ ID NO: 3376042 - DNA, 18 bp, Homo sapiens
ggaagtgtgagcgccttg

SEQ ID NO: 3376043 - DNA, 12 bp, Homo sapiens
ggaagtgttcaa

SEQ ID NO: 3376044 - DNA, 18 bp, Homo sapiens
ggaagtgttcaagaaata

SEQ ID NO: 3376045 - DNA, 14 bp, Homo sapiens
ggaagttttctgta

SEQ ID NO: 3376046 - DNA, 18 bp, Homo sapiens
ggaagttttgcatttatg

SEQ ID NO: 3376047 - DNA, 18 bp, Homo sapiens
ggaataaaaggcttgaag

SEQ ID NO: 3376048 - DNA, 21 bp, Homo sapiens
ggaataaaatcctaagacaca

SEQ ID NO: 3376049 - DNA, 20 bp, Homo sapiens
ggaataaacattaattttgt

SEQ ID NO: 3376050 - DNA, 18 bp, Homo sapiens
ggaataaagttgcagatg

SEQ ID NO: 3376051 - DNA, 18 bp, Homo sapiens
ggaataacatgtaattaa

SEQ ID NO: 3376052 - DNA, 17 bp, Homo sapiens
ggaataacctttctgga

SEQ ID NO: 3376053 - DNA, 21 bp, Homo sapiens
ggaataacttttacacgacca

SEQ ID NO: 3376054 - DNA, 15 bp, Homo sapiens
ggaataatagaagaa

SEQ ID NO: 3376055 - DNA, 21 bp, Homo sapiens
ggaataattatttatttaata

SEQ ID NO: 3376056 - DNA, 17 bp, Homo sapiens
ggaatactttttgttat

SEQ ID NO: 3376057 - DNA, 22 bp, Homo sapiens
ggaatcaagatgtcagactggc

SEQ ID NO: 3376058 - DNA, 16 bp, Homo sapiens
ggaatcagggaccagc

SEQ ID NO: 3376059 - DNA, 19 bp, Homo sapiens
ggaatcatgtcaggcctgt

SEQ ID NO: 3376060 - DNA, 23 bp, Homo sapiens
ggaatcatgtccatcccttttcc

SEQ ID NO: 3376061 - DNA, 22 bp, Homo sapiens
ggaatcattccagtgctagaaa

SEQ ID NO: 3376062 - DNA, 21 bp, Homo sapiens
ggaatccaagcctccacagcg

SEQ ID NO: 3376063 - DNA, 16 bp, Homo sapiens
ggaatccagacccggc

SEQ ID NO: 3376064 - DNA, 14 bp, Homo sapiens
ggaatcctcctcca

SEQ ID NO: 3376065 - DNA, 22 bp, Homo sapiens
ggaatctaatatccccaaatta

SEQ ID NO: 3376066 - DNA, 13 bp, Homo sapiens
ggaatctggatta

SEQ ID NO: 3376067 - DNA, 12 bp, Homo sapiens
ggaatgaagaac

SEQ ID NO: 3376068 - DNA, 13 bp, Homo sapiens
ggaatgagcccag

SEQ ID NO: 3376069 - DNA, 21 bp, Homo sapiens
ggaatgagcccagagaacagc

SEQ ID NO: 3376070 - DNA, 18 bp, Homo sapiens
ggaatgatagcccagaac

SEQ ID NO: 3376071 - DNA, 12 bp, Homo sapiens
ggaatgcaggga

SEQ ID NO: 3376072 - DNA, 18 bp, Homo sapiens
ggaatgcagggaagaggg

SEQ ID NO: 3376073 - DNA, 12 bp, Homo sapiens
ggaatgcagtgg

SEQ ID NO: 3376074 - DNA, 21 bp, Homo sapiens
ggaatgcatcccaccttgcca

SEQ ID NO: 3376075 - DNA, 21 bp, Homo sapiens
ggaatgctcccagctgtgctg

SEQ ID NO: 3376076 - DNA, 14 bp, Homo sapiens
ggaatgctgtgtta

SEQ ID NO: 3376077 - DNA, 17 bp, Homo sapiens
ggaatggaactactgta

SEQ ID NO: 3376078 - DNA, 17 bp, Homo sapiens
ggaatgttccctgcacc

SEQ ID NO: 3376079 - DNA, 20 bp, Homo sapiens
ggaatgttccctgcaccctg

SEQ ID NO: 3376080 - DNA, 19 bp, Homo sapiens
ggaatgtttgcctctgcct

SEQ ID NO: 3376081 - DNA, 21 bp, Homo sapiens
ggaattattttgaatgtcaca

SEQ ID NO: 3376082 - DNA, 15 bp, Homo sapiens
ggaattcagcaccct

SEQ ID NO: 3376083 - DNA, 22 bp, Homo sapiens
ggaattcagcaccctgggtgcc

SEQ ID NO: 3376084 - DNA, 14 bp, Homo sapiens
ggaattcagtgcct

SEQ ID NO: 3376085 - DNA, 15 bp, Homo sapiens
ggaattgatttgcat

SEQ ID NO: 3376086 - DNA, 19 bp, Homo sapiens
ggaattgatttgcattgaa

SEQ ID NO: 3376087 - DNA, 20 bp, Homo sapiens
ggaattgcttaccaaaggat

SEQ ID NO: 3376088 - DNA, 17 bp, Homo sapiens
ggaatttataacaaata

SEQ ID NO: 3376089 - DNA, 23 bp, Homo sapiens
ggaatttcttttccttcattcat

SEQ ID NO: 3376090 - DNA, 13 bp, Homo sapiens
ggaatttgtcagc

SEQ ID NO: 3376091 - DNA, 11 bp, Homo sapiens
ggaattttatt

SEQ ID NO: 3376092 - DNA, 22 bp, Homo sapiens
ggacaaaaatgaactgaagttt

SEQ ID NO: 3376093 - DNA, 17 bp, Homo sapiens
ggacaaaacatagctgg

SEQ ID NO: 3376094 - DNA, 21 bp, Homo sapiens
ggacaaaacttcttgtcagac

SEQ ID NO: 3376095 - DNA, 12 bp, Homo sapiens
ggacaacacttc

SEQ ID NO: 3376096 - DNA, 20 bp, Homo sapiens
ggacaacagtgctttgtaaa

SEQ ID NO: 3376097 - DNA, 14 bp, Homo sapiens
ggacaacttattta

SEQ ID NO: 3376098 - DNA, 17 bp, Homo sapiens
ggacaacttatttaaaa

SEQ ID NO: 3376099 - DNA, 22 bp, Homo sapiens
ggacaacttatttaaaaatatt

SEQ ID NO: 3376100 - DNA, 21 bp, Homo sapiens
ggacaagccaacttgtaaata

SEQ ID NO: 3376101 - DNA, 23 bp, Homo sapiens
ggacaagccaacttgtaaataca

SEQ ID NO: 3376102 - DNA, 16 bp, Homo sapiens
ggacaatcagtcccct

SEQ ID NO: 3376103 - DNA, 17 bp, Homo sapiens
ggacaatcagtcccctc

SEQ ID NO: 3376104 - DNA, 17 bp, Homo sapiens
ggacacaaaactccgcc

SEQ ID NO: 3376105 - DNA, 18 bp, Homo sapiens
ggacacagttcctgggaa

SEQ ID NO: 3376106 - DNA, 21 bp, Homo sapiens
ggacacatcccggcctcttcc

SEQ ID NO: 3376107 - DNA, 23 bp, Homo sapiens
ggacacatcccggcctcttccac

SEQ ID NO: 3376108 - DNA, 18 bp, Homo sapiens
ggacaccacacccagcct

SEQ ID NO: 3376109 - DNA, 12 bp, Homo sapiens
ggacaccagagc

SEQ ID NO: 3376110 - DNA, 17 bp, Homo sapiens
ggacactaaccacgctg

SEQ ID NO: 3376111 - DNA, 22 bp, Homo sapiens
ggacactaaccacgctggacct

SEQ ID NO: 3376112 - DNA, 15 bp, Homo sapiens
ggacactccagtgcc

SEQ ID NO: 3376113 - DNA, 21 bp, Homo sapiens
ggacacttggttagacgcctt

SEQ ID NO: 3376114 - DNA, 22 bp, Homo sapiens
ggacagaaaggagagtggccat

SEQ ID NO: 3376115 - DNA, 14 bp, Homo sapiens
ggacagactggccg

SEQ ID NO: 3376116 - DNA, 15 bp, Homo sapiens
ggacagagttcacag

SEQ ID NO: 3376117 - DNA, 17 bp, Homo sapiens
ggacagagttcacagga

SEQ ID NO: 3376118 - DNA, 19 bp, Homo sapiens
ggacagccacggccaggcc

SEQ ID NO: 3376119 - DNA, 20 bp, Homo sapiens
ggacagccacggccaggcca

SEQ ID NO: 3376120 - DNA, 14 bp, Homo sapiens
ggacagcccagagc

SEQ ID NO: 3376121 - DNA, 17 bp, Homo sapiens
ggacagcccagagcctg

SEQ ID NO: 3376122 - DNA, 11 bp, Homo sapiens
ggacagcctct

SEQ ID NO: 3376123 - DNA, 12 bp, Homo sapiens
ggacagcctctt

SEQ ID NO: 3376124 - DNA, 17 bp, Homo sapiens
ggacagcctcttcagcc

SEQ ID NO: 3376125 - DNA, 19 bp, Homo sapiens
ggacagcctcttcagcccc

SEQ ID NO: 3376126 - DNA, 20 bp, Homo sapiens
ggacagcctcttcagcccct

SEQ ID NO: 3376127 - DNA, 17 bp, Homo sapiens
ggacagctccttctgtc

SEQ ID NO: 3376128 - DNA, 15 bp, Homo sapiens
ggacaggaccctcag

SEQ ID NO: 3376129 - DNA, 16 bp, Homo sapiens
ggacaggaccctcagg

SEQ ID NO: 3376130 - DNA, 23 bp, Homo sapiens
ggacaggaccctcaggaattcag

SEQ ID NO: 3376131 - DNA, 21 bp, Homo sapiens
ggacaggcccagcgcggccag

SEQ ID NO: 3376132 - DNA, 23 bp, Homo sapiens
ggacaggcccagcgcggccagcg

SEQ ID NO: 3376133 - DNA, 11 bp, Homo sapiens
ggacaggcctc

SEQ ID NO: 3376134 - DNA, 18 bp, Homo sapiens
ggacaggctgaagagagg

SEQ ID NO: 3376135 - DNA, 23 bp, Homo sapiens
ggacaggctgaagagagggacag

SEQ ID NO: 3376136 - DNA, 15 bp, Homo sapiens
ggacagggcatggcc

SEQ ID NO: 3376137 - DNA, 14 bp, Homo sapiens
ggacagtcctggga

SEQ ID NO: 3376138 - DNA, 19 bp, Homo sapiens
ggacagtcctgggagaacc

SEQ ID NO: 3376139 - DNA, 20 bp, Homo sapiens
ggacagtgcttcagcctgag

SEQ ID NO: 3376140 - DNA, 15 bp, Homo sapiens
ggacagttcacaccc

SEQ ID NO: 3376141 - DNA, 16 bp, Homo sapiens
ggacagttcacaccct

SEQ ID NO: 3376142 - DNA, 17 bp, Homo sapiens
ggacagttcacaccctg

SEQ ID NO: 3376143 - DNA, 14 bp, Homo sapiens
ggacagttggcaga

SEQ ID NO: 3376144 - DNA, 22 bp, Homo sapiens
ggacatactctctgcctggtgg

SEQ ID NO: 3376145 - DNA, 13 bp, Homo sapiens
ggacatcctcctc

SEQ ID NO: 3376146 - DNA, 16 bp, Homo sapiens
ggacatcctcctccca

SEQ ID NO: 3376147 - DNA, 18 bp, Homo sapiens
ggacatcctgtataagca

SEQ ID NO: 3376148 - DNA, 16 bp, Homo sapiens
ggacatgcaataaaat

SEQ ID NO: 3376149 - DNA, 20 bp, Homo sapiens
ggacatgcttttctgccact

SEQ ID NO: 3376150 - DNA, 17 bp, Homo sapiens
ggacattgctctctggg

SEQ ID NO: 3376151 - DNA, 16 bp, Homo sapiens
ggaccaaccctgggga

SEQ ID NO: 3376152 - DNA, 12 bp, Homo sapiens
ggaccacacagt

SEQ ID NO: 3376153 - DNA, 21 bp, Homo sapiens
ggaccacacagtccccagact

SEQ ID NO: 3376154 - DNA, 21 bp, Homo sapiens
ggaccacacctccctgaacca

SEQ ID NO: 3376155 - DNA, 17 bp, Homo sapiens
ggaccacagtgggtggc

SEQ ID NO: 3376156 - DNA, 20 bp, Homo sapiens
ggaccacagtgggtggcacc

SEQ ID NO: 3376157 - DNA, 14 bp, Homo sapiens
ggaccacattttat

SEQ ID NO: 3376158 - DNA, 17 bp, Homo sapiens
ggaccactcagccccta

SEQ ID NO: 3376159 - DNA, 18 bp, Homo sapiens
ggaccactcgaggcctgc

SEQ ID NO: 3376160 - DNA, 21 bp, Homo sapiens
ggaccactttggagactgggg

SEQ ID NO: 3376161 - DNA, 15 bp, Homo sapiens
ggaccaggactccct

SEQ ID NO: 3376162 - DNA, 17 bp, Homo sapiens
ggaccaggactccctcc

SEQ ID NO: 3376163 - DNA, 21 bp, Homo sapiens
ggaccatgtgtcacttgtgct

SEQ ID NO: 3376164 - DNA, 22 bp, Homo sapiens
ggaccatgtgtcacttgtgctt

SEQ ID NO: 3376165 - DNA, 18 bp, Homo sapiens
ggacccaaaacacaggaa

SEQ ID NO: 3376166 - DNA, 19 bp, Homo sapiens
ggacccaaggaaaactgca

SEQ ID NO: 3376167 - DNA, 17 bp, Homo sapiens
ggacccacggagccctc

SEQ ID NO: 3376168 - DNA, 23 bp, Homo sapiens
ggacccagctactctgtccaggc

SEQ ID NO: 3376169 - DNA, 13 bp, Homo sapiens
ggacccaggccct

SEQ ID NO: 3376170 - DNA, 17 bp, Homo sapiens
ggacccaggctccgccc

SEQ ID NO: 3376171 - DNA, 19 bp, Homo sapiens
ggacccatagatcttctga

SEQ ID NO: 3376172 - DNA, 13 bp, Homo sapiens
ggaccccagctgg

SEQ ID NO: 3376173 - DNA, 14 bp, Homo sapiens
ggaccccagctggg

SEQ ID NO: 3376174 - DNA, 18 bp, Homo sapiens
ggaccccctggccctgcc

SEQ ID NO: 3376175 - DNA, 20 bp, Homo sapiens
ggacccctgctcccagcctg

SEQ ID NO: 3376176 - DNA, 21 bp, Homo sapiens
ggacccggaggggcctggcag

SEQ ID NO: 3376177 - DNA, 15 bp, Homo sapiens
ggaccctgcttcacc

SEQ ID NO: 3376178 - DNA, 21 bp, Homo sapiens
ggaccctgtccggcccagtgc

SEQ ID NO: 3376179 - DNA, 23 bp, Homo sapiens
ggaccctgtccggcccagtgcca

SEQ ID NO: 3376180 - DNA, 19 bp, Homo sapiens
ggacccttaggatggggct

SEQ ID NO: 3376181 - DNA, 22 bp, Homo sapiens
ggacccttaggatggggctccc

SEQ ID NO: 3376182 - DNA, 17 bp, Homo sapiens
ggaccggtgctgcagga

SEQ ID NO: 3376183 - DNA, 19 bp, Homo sapiens
ggaccggtgctgcaggagt

SEQ ID NO: 3376184 - DNA, 16 bp, Homo sapiens
ggaccgtggacaggcc

SEQ ID NO: 3376185 - DNA, 19 bp, Homo sapiens
ggaccgtggacaggcccag

SEQ ID NO: 3376186 - DNA, 13 bp, Homo sapiens
ggacctcccttcc

SEQ ID NO: 3376187 - DNA, 20 bp, Homo sapiens
ggacctcccttccgaccctc

SEQ ID NO: 3376188 - DNA, 21 bp, Homo sapiens
ggacctccttagccctgtctg

SEQ ID NO: 3376189 - DNA, 16 bp, Homo sapiens
ggacctgccaggcagg

SEQ ID NO: 3376190 - DNA, 21 bp, Homo sapiens
ggaccttaggccttcctctct

SEQ ID NO: 3376191 - DNA, 18 bp, Homo sapiens
ggaccttcgggctgtgcc

SEQ ID NO: 3376192 - DNA, 19 bp, Homo sapiens
ggaccttcgggctgtgccc

SEQ ID NO: 3376193 - DNA, 19 bp, Homo sapiens
ggacctttccaccacagcc

SEQ ID NO: 3376194 - DNA, 22 bp, Homo sapiens
ggacctttccaccacagccagc

SEQ ID NO: 3376195 - DNA, 21 bp, Homo sapiens
ggacgcacgctcgctgccatc

SEQ ID NO: 3376196 - DNA, 22 bp, Homo sapiens
ggacgcacgctcgctgccatca

SEQ ID NO: 3376197 - DNA, 15 bp, Homo sapiens
ggacgctctctggcc

SEQ ID NO: 3376198 - DNA, 13 bp, Homo sapiens
ggacgcttctgaa

SEQ ID NO: 3376199 - DNA, 18 bp, Homo sapiens
ggacggcattcctgctta

SEQ ID NO: 3376200 - DNA, 12 bp, Homo sapiens
ggacggctgtgg

SEQ ID NO: 3376201 - DNA, 17 bp, Homo sapiens
ggacggggaagccgagc

SEQ ID NO: 3376202 - DNA, 17 bp, Homo sapiens
ggacggtgcccaagcca

SEQ ID NO: 3376203 - DNA, 21 bp, Homo sapiens
ggacggtgcccaagccagagg

SEQ ID NO: 3376204 - DNA, 21 bp, Homo sapiens
ggacgtcatcggaggctgggc

SEQ ID NO: 3376205 - DNA, 19 bp, Homo sapiens
ggacgtcctatctccccca

SEQ ID NO: 3376206 - DNA, 13 bp, Homo sapiens
ggacgtctttctt

SEQ ID NO: 3376207 - DNA, 14 bp, Homo sapiens
ggacgtgtgtaaat

SEQ ID NO: 3376208 - DNA, 19 bp, Homo sapiens
ggacgttggcctcagggcc

SEQ ID NO: 3376209 - DNA, 23 bp, Homo sapiens
ggacgttggcctcagggccagga

SEQ ID NO: 3376210 - DNA, 14 bp, Homo sapiens
ggacgttgttttgg

SEQ ID NO: 3376211 - DNA, 18 bp, Homo sapiens
ggactaacataaaatctg

SEQ ID NO: 3376212 - DNA, 21 bp, Homo sapiens
ggactaacataaaatctgtga

SEQ ID NO: 3376213 - DNA, 20 bp, Homo sapiens
ggactacaggtgtgagtcac

SEQ ID NO: 3376214 - DNA, 14 bp, Homo sapiens
ggactagcccctgt

SEQ ID NO: 3376215 - DNA, 20 bp, Homo sapiens
ggactaggacctgagcctgg

SEQ ID NO: 3376216 - DNA, 20 bp, Homo sapiens
ggactcacaggttggaagag

SEQ ID NO: 3376217 - DNA, 21 bp, Homo sapiens
ggactcacaggttggaagaga

SEQ ID NO: 3376218 - DNA, 14 bp, Homo sapiens
ggactcagcagtga

SEQ ID NO: 3376219 - DNA, 24 bp, Homo sapiens
ggactcatttcattcctaacacag

SEQ ID NO: 3376220 - DNA, 22 bp, Homo sapiens
ggactccaggcccaaggctccc

SEQ ID NO: 3376221 - DNA, 11 bp, Homo sapiens
ggactccatct

SEQ ID NO: 3376222 - DNA, 15 bp, Homo sapiens
ggactcccgggccac

SEQ ID NO: 3376223 - DNA, 20 bp, Homo sapiens
ggactcccgggccacgcccc

SEQ ID NO: 3376224 - DNA, 13 bp, Homo sapiens
ggactctcaggga

SEQ ID NO: 3376225 - DNA, 20 bp, Homo sapiens
ggactctcagggattctggg

SEQ ID NO: 3376226 - DNA, 19 bp, Homo sapiens
ggactctgagcgggaggca

SEQ ID NO: 3376227 - DNA, 18 bp, Homo sapiens
ggactctggtgcctccag

SEQ ID NO: 3376228 - DNA, 19 bp, Homo sapiens
ggactcttctcggctcagg

SEQ ID NO: 3376229 - DNA, 20 bp, Homo sapiens
ggactcttctcggctcaggc

SEQ ID NO: 3376230 - DNA, 21 bp, Homo sapiens
ggactgagccaaggaggcctg

SEQ ID NO: 3376231 - DNA, 15 bp, Homo sapiens
ggactgagccccgca

SEQ ID NO: 3376232 - DNA, 22 bp, Homo sapiens
ggactgagcggccgcagagact

SEQ ID NO: 3376233 - DNA, 23 bp, Homo sapiens
ggactgagcggccgcagagactg

SEQ ID NO: 3376234 - DNA, 14 bp, Homo sapiens
ggactgaggagtgg

SEQ ID NO: 3376235 - DNA, 22 bp, Homo sapiens
ggactgagtcccctccaggaag

SEQ ID NO: 3376236 - DNA, 12 bp, Homo sapiens
ggactgcattta

SEQ ID NO: 3376237 - DNA, 16 bp, Homo sapiens
ggactgcgctggacga

SEQ ID NO: 3376238 - DNA, 17 bp, Homo sapiens
ggactggaggcccctgg

SEQ ID NO: 3376239 - DNA, 23 bp, Homo sapiens
ggactggaggtgggcatgccacc

SEQ ID NO: 3376240 - DNA, 17 bp, Homo sapiens
ggactggagtccctgtg

SEQ ID NO: 3376241 - DNA, 22 bp, Homo sapiens
ggactggctagagtcctcactc

SEQ ID NO: 3376242 - DNA, 11 bp, Homo sapiens
ggactgggagg

SEQ ID NO: 3376243 - DNA, 12 bp, Homo sapiens
ggactgggaggt

SEQ ID NO: 3376244 - DNA, 17 bp, Homo sapiens
ggactgggagtcagagc

SEQ ID NO: 3376245 - DNA, 17 bp, Homo sapiens
ggactggggatgtggga

SEQ ID NO: 3376246 - DNA, 21 bp, Homo sapiens
ggactgggtttggaccccagc

SEQ ID NO: 3376247 - DNA, 11 bp, Homo sapiens
ggactggtgcc

SEQ ID NO: 3376248 - DNA, 14 bp, Homo sapiens
ggactggtgccctc

SEQ ID NO: 3376249 - DNA, 17 bp, Homo sapiens
ggactggtgccctcctc

SEQ ID NO: 3376250 - DNA, 15 bp, Homo sapiens
ggactgtaagggatt

SEQ ID NO: 3376251 - DNA, 13 bp, Homo sapiens
ggactgtacacac

SEQ ID NO: 3376252 - DNA, 22 bp, Homo sapiens
ggactgtacacactttatttac

SEQ ID NO: 3376253 - DNA, 18 bp, Homo sapiens
ggactgtagggagggcgg

SEQ ID NO: 3376254 - DNA, 21 bp, Homo sapiens
ggactgttcacggcagaccag

SEQ ID NO: 3376255 - DNA, 20 bp, Homo sapiens
ggactgttccaggccctcca

SEQ ID NO: 3376256 - DNA, 19 bp, Homo sapiens
ggacttaacggctccagga

SEQ ID NO: 3376257 - DNA, 20 bp, Homo sapiens
ggacttaacggctccaggat

SEQ ID NO: 3376258 - DNA, 14 bp, Homo sapiens
ggacttcctggggc

SEQ ID NO: 3376259 - DNA, 16 bp, Homo sapiens
ggacttctgtgggccc

SEQ ID NO: 3376260 - DNA, 23 bp, Homo sapiens
ggacttgaaagcatccatgtgtg

SEQ ID NO: 3376261 - DNA, 16 bp, Homo sapiens
ggacttgctaaagcac

SEQ ID NO: 3376262 - DNA, 21 bp, Homo sapiens
ggacttgctaaagcactttgc

SEQ ID NO: 3376263 - DNA, 17 bp, Homo sapiens
ggacttggaagctccgc

SEQ ID NO: 3376264 - DNA, 15 bp, Homo sapiens
ggacttgggagctgg

SEQ ID NO: 3376265 - DNA, 14 bp, Homo sapiens
ggacttgtatattt

SEQ ID NO: 3376266 - DNA, 16 bp, Homo sapiens
ggacttgtgtctctgt

SEQ ID NO: 3376267 - DNA, 11 bp, Homo sapiens
ggagaaaaaaa

SEQ ID NO: 3376268 - DNA, 11 bp, Homo sapiens
ggagaaacaca

SEQ ID NO: 3376269 - DNA, 15 bp, Homo sapiens
ggagaaacagagaca

SEQ ID NO: 3376270 - DNA, 12 bp, Homo sapiens
ggagaaagaagt

SEQ ID NO: 3376271 - DNA, 20 bp, Homo sapiens
ggagaaagaagtggagacag

SEQ ID NO: 3376272 - DNA, 12 bp, Homo sapiens
ggagaaagagct

SEQ ID NO: 3376273 - DNA, 16 bp, Homo sapiens
ggagaaagagctgcct

SEQ ID NO: 3376274 - DNA, 17 bp, Homo sapiens
ggagaaagagctgcctg

SEQ ID NO: 3376275 - DNA, 22 bp, Homo sapiens
ggagaaagagctgcctggatga

SEQ ID NO: 3376276 - DNA, 17 bp, Homo sapiens
ggagaaagcactgacct

SEQ ID NO: 3376277 - DNA, 13 bp, Homo sapiens
ggagaactagaga

SEQ ID NO: 3376278 - DNA, 14 bp, Homo sapiens
ggagaagacccacg

SEQ ID NO: 3376279 - DNA, 16 bp, Homo sapiens
ggagaagagaggagag

SEQ ID NO: 3376280 - DNA, 22 bp, Homo sapiens
ggagaagagaggagaggagaga

SEQ ID NO: 3376281 - DNA, 14 bp, Homo sapiens
ggagaagagccctg

SEQ ID NO: 3376282 - DNA, 19 bp, Homo sapiens
ggagaagagttgaggaact

SEQ ID NO: 3376283 - DNA, 18 bp, Homo sapiens
ggagaagctttttttctt

SEQ ID NO: 3376284 - DNA, 13 bp, Homo sapiens
ggagaaggaaggg

SEQ ID NO: 3376285 - DNA, 19 bp, Homo sapiens
ggagaaggaagggcagaga

SEQ ID NO: 3376286 - DNA, 14 bp, Homo sapiens
ggagaatcatgtga

SEQ ID NO: 3376287 - DNA, 15 bp, Homo sapiens
ggagacagccccaga

SEQ ID NO: 3376288 - DNA, 21 bp, Homo sapiens
ggagacagccccagagcaggg

SEQ ID NO: 3376289 - DNA, 17 bp, Homo sapiens
ggagacagcttctctgc

SEQ ID NO: 3376290 - DNA, 18 bp, Homo sapiens
ggagacagcttctctgca

SEQ ID NO: 3376291 - DNA, 19 bp, Homo sapiens
ggagacagcttctctgcag

SEQ ID NO: 3376292 - DNA, 17 bp, Homo sapiens
ggagacaggagcctagc

SEQ ID NO: 3376293 - DNA, 21 bp, Homo sapiens
ggagacatctacacacaccag

SEQ ID NO: 3376294 - DNA, 15 bp, Homo sapiens
ggagacatgtgacat

SEQ ID NO: 3376295 - DNA, 19 bp, Homo sapiens
ggagacatgtgacatttat

SEQ ID NO: 3376296 - DNA, 19 bp, Homo sapiens
ggagaccatgcagagcgcc

SEQ ID NO: 3376297 - DNA, 23 bp, Homo sapiens
ggagaccctgcaaacagaacagg

SEQ ID NO: 3376298 - DNA, 13 bp, Homo sapiens
ggagacctgtgct

SEQ ID NO: 3376299 - DNA, 15 bp, Homo sapiens
ggagacctgtgctag

SEQ ID NO: 3376300 - DNA, 23 bp, Homo sapiens
ggagacgtggaacctctgtctca

SEQ ID NO: 3376301 - DNA, 13 bp, Homo sapiens
ggagactctgtgg

SEQ ID NO: 3376302 - DNA, 15 bp, Homo sapiens
ggagactggggtggc

SEQ ID NO: 3376303 - DNA, 22 bp, Homo sapiens
ggagacttagggcaccaggggt

SEQ ID NO: 3376304 - DNA, 18 bp, Homo sapiens
ggagagaaacaataaaga

SEQ ID NO: 3376305 - DNA, 11 bp, Homo sapiens
ggagagacctc

SEQ ID NO: 3376306 - DNA, 19 bp, Homo sapiens
ggagagactgaaagcagca

SEQ ID NO: 3376307 - DNA, 21 bp, Homo sapiens
ggagagactgaaagcagcagc

SEQ ID NO: 3376308 - DNA, 22 bp, Homo sapiens
ggagagactgaaagcagcagct

SEQ ID NO: 3376309 - DNA, 17 bp, Homo sapiens
ggagagagaaagccagg

SEQ ID NO: 3376310 - DNA, 21 bp, Homo sapiens
ggagagagaaagccaggcagg

SEQ ID NO: 3376311 - DNA, 13 bp, Homo sapiens
ggagagagccagg

SEQ ID NO: 3376312 - DNA, 14 bp, Homo sapiens
ggagagagccagga

SEQ ID NO: 3376313 - DNA, 15 bp, Homo sapiens
ggagagagccaggat

SEQ ID NO: 3376314 - DNA, 13 bp, Homo sapiens
ggagagaggcaga

SEQ ID NO: 3376315 - DNA, 16 bp, Homo sapiens
ggagagaggcagagag

SEQ ID NO: 3376316 - DNA, 12 bp, Homo sapiens
ggagagagggga

SEQ ID NO: 3376317 - DNA, 23 bp, Homo sapiens
ggagagcagcagcaccaaccaca

SEQ ID NO: 3376318 - DNA, 12 bp, Homo sapiens
ggagagcaggct

SEQ ID NO: 3376319 - DNA, 13 bp, Homo sapiens
ggagagcaggctg

SEQ ID NO: 3376320 - DNA, 14 bp, Homo sapiens
ggagagcaggctgg

SEQ ID NO: 3376321 - DNA, 13 bp, Homo sapiens
ggagagccaacct

SEQ ID NO: 3376322 - DNA, 11 bp, Homo sapiens
ggagagcccag

SEQ ID NO: 3376323 - DNA, 11 bp, Homo sapiens
ggagagcctgc

SEQ ID NO: 3376324 - DNA, 15 bp, Homo sapiens
ggagagcgaggaggc

SEQ ID NO: 3376325 - DNA, 22 bp, Homo sapiens
ggagagcgaggaggcgcggcct

SEQ ID NO: 3376326 - DNA, 22 bp, Homo sapiens
ggagaggaacgggcagcctggg

SEQ ID NO: 3376327 - DNA, 16 bp, Homo sapiens
ggagaggaactccttg

SEQ ID NO: 3376328 - DNA, 14 bp, Homo sapiens
ggagaggcagcatg

SEQ ID NO: 3376329 - DNA, 22 bp, Homo sapiens
ggagaggcagcatgcttgggct

SEQ ID NO: 3376330 - DNA, 14 bp, Homo sapiens
ggagaggcgagagg

SEQ ID NO: 3376331 - DNA, 13 bp, Homo sapiens
ggagaggcggcct

SEQ ID NO: 3376332 - DNA, 21 bp, Homo sapiens
ggagaggctgggctgggtggc

SEQ ID NO: 3376333 - DNA, 14 bp, Homo sapiens
ggagaggctgtctg

SEQ ID NO: 3376334 - DNA, 19 bp, Homo sapiens
ggagaggctgtctggggcc

SEQ ID NO: 3376335 - DNA, 18 bp, Homo sapiens
ggagaggggaagggccag

SEQ ID NO: 3376336 - DNA, 22 bp, Homo sapiens
ggagaggggaagggccagtctg

SEQ ID NO: 3376337 - DNA, 12 bp, Homo sapiens
ggagataaattt

SEQ ID NO: 3376338 - DNA, 22 bp, Homo sapiens
ggagatatctgagggaggaggc

SEQ ID NO: 3376339 - DNA, 16 bp, Homo sapiens
ggagatgaccagggat

SEQ ID NO: 3376340 - DNA, 17 bp, Homo sapiens
ggagatgaccagggatg

SEQ ID NO: 3376341 - DNA, 18 bp, Homo sapiens
ggagatgcatcgggaaag

SEQ ID NO: 3376342 - DNA, 22 bp, Homo sapiens
ggagatgcatcgggaaagaaga

SEQ ID NO: 3376343 - DNA, 20 bp, Homo sapiens
ggagatggaagttgcagtga

SEQ ID NO: 3376344 - DNA, 16 bp, Homo sapiens
ggagatggagggcttg

SEQ ID NO: 3376345 - DNA, 13 bp, Homo sapiens
ggagatggagttc

SEQ ID NO: 3376346 - DNA, 15 bp, Homo sapiens
ggagatggtcagtgt

SEQ ID NO: 3376347 - DNA, 16 bp, Homo sapiens
ggagatgtagcaaaac

SEQ ID NO: 3376348 - DNA, 16 bp, Homo sapiens
ggagattccacacagg

SEQ ID NO: 3376349 - DNA, 21 bp, Homo sapiens
ggagattgagaaggagagaaa

SEQ ID NO: 3376350 - DNA, 17 bp, Homo sapiens
ggagattggacggcctg

SEQ ID NO: 3376351 - DNA, 21 bp, Homo sapiens
ggagattttgaggtaaagata

SEQ ID NO: 3376352 - DNA, 16 bp, Homo sapiens
ggagcaaaaggcagct

SEQ ID NO: 3376353 - DNA, 16 bp, Homo sapiens
ggagcacagccctggg

SEQ ID NO: 3376354 - DNA, 17 bp, Homo sapiens
ggagcacagccctggga

SEQ ID NO: 3376355 - DNA, 14 bp, Homo sapiens
ggagcacaggcagc

SEQ ID NO: 3376356 - DNA, 15 bp, Homo sapiens
ggagcacaggtccca

SEQ ID NO: 3376357 - DNA, 17 bp, Homo sapiens
ggagcacaggtcccacc

SEQ ID NO: 3376358 - DNA, 18 bp, Homo sapiens
ggagcacaggtcccacct

SEQ ID NO: 3376359 - DNA, 16 bp, Homo sapiens
ggagcacccagagcac

SEQ ID NO: 3376360 - DNA, 13 bp, Homo sapiens
ggagcacctgaac

SEQ ID NO: 3376361 - DNA, 15 bp, Homo sapiens
ggagcacctgaaccc

SEQ ID NO: 3376362 - DNA, 18 bp, Homo sapiens
ggagcactggagtgcagg

SEQ ID NO: 3376363 - DNA, 18 bp, Homo sapiens
ggagcacttgcgtcctgc

SEQ ID NO: 3376364 - DNA, 19 bp, Homo sapiens
ggagcacttgcgtcctgca

SEQ ID NO: 3376365 - DNA, 20 bp, Homo sapiens
ggagcacttgcgtcctgcag

SEQ ID NO: 3376366 - DNA, 18 bp, Homo sapiens
ggagcagaaacagccatt

SEQ ID NO: 3376367 - DNA, 16 bp, Homo sapiens
ggagcagatggacagc

SEQ ID NO: 3376368 - DNA, 23 bp, Homo sapiens
ggagcagcttccttctgggactg

SEQ ID NO: 3376369 - DNA, 13 bp, Homo sapiens
ggagcaggaacaa

SEQ ID NO: 3376370 - DNA, 22 bp, Homo sapiens
ggagcaggagattgagaaggag

SEQ ID NO: 3376371 - DNA, 21 bp, Homo sapiens
ggagcaggaggccaataaaaa

SEQ ID NO: 3376372 - DNA, 16 bp, Homo sapiens
ggagcaggcacgggtg

SEQ ID NO: 3376373 - DNA, 17 bp, Homo sapiens
ggagcaggccggaacca

SEQ ID NO: 3376374 - DNA, 21 bp, Homo sapiens
ggagcaggccggaaccacagg

SEQ ID NO: 3376375 - DNA, 18 bp, Homo sapiens
ggagcaggcggtggggag

SEQ ID NO: 3376376 - DNA, 23 bp, Homo sapiens
ggagcaggcggtggggagagatg

SEQ ID NO: 3376377 - DNA, 13 bp, Homo sapiens
ggagcagggaagg

SEQ ID NO: 3376378 - DNA, 19 bp, Homo sapiens
ggagcagggaaggcctgac

SEQ ID NO: 3376379 - DNA, 17 bp, Homo sapiens
ggagcaggttccccaag

SEQ ID NO: 3376380 - DNA, 23 bp, Homo sapiens
ggagcaggttccccaagggccct

SEQ ID NO: 3376381 - DNA, 17 bp, Homo sapiens
ggagcagtgtcttccat

SEQ ID NO: 3376382 - DNA, 18 bp, Homo sapiens
ggagcagttttcccctgg

SEQ ID NO: 3376383 - DNA, 14 bp, Homo sapiens
ggagcatcagccag

SEQ ID NO: 3376384 - DNA, 15 bp, Homo sapiens
ggagccaactgctgc

SEQ ID NO: 3376385 - DNA, 15 bp, Homo sapiens
ggagccaccagttct

SEQ ID NO: 3376386 - DNA, 13 bp, Homo sapiens
ggagccagctgct

SEQ ID NO: 3376387 - DNA, 14 bp, Homo sapiens
ggagccagctgctt

SEQ ID NO: 3376388 - DNA, 15 bp, Homo sapiens
ggagcccacaacctt

SEQ ID NO: 3376389 - DNA, 20 bp, Homo sapiens
ggagcccacgctcaccccct

SEQ ID NO: 3376390 - DNA, 13 bp, Homo sapiens
ggagcccagaggg

SEQ ID NO: 3376391 - DNA, 16 bp, Homo sapiens
ggagcccagccctccc

SEQ ID NO: 3376392 - DNA, 19 bp, Homo sapiens
ggagcccagccctccccat

SEQ ID NO: 3376393 - DNA, 20 bp, Homo sapiens
ggagcccagcctgggagccc

SEQ ID NO: 3376394 - DNA, 22 bp, Homo sapiens
ggagcccaggcgggagcggtgg

SEQ ID NO: 3376395 - DNA, 20 bp, Homo sapiens
ggagcccatactcagcctgc

SEQ ID NO: 3376396 - DNA, 13 bp, Homo sapiens
ggagccccagggt

SEQ ID NO: 3376397 - DNA, 13 bp, Homo sapiens
ggagccccctctg

SEQ ID NO: 3376398 - DNA, 15 bp, Homo sapiens
ggagccccctctgcc

SEQ ID NO: 3376399 - DNA, 13 bp, Homo sapiens
ggagcccctgggt

SEQ ID NO: 3376400 - DNA, 16 bp, Homo sapiens
ggagcccctgggtggg

SEQ ID NO: 3376401 - DNA, 22 bp, Homo sapiens
ggagcccgaagtctgctgctgt

SEQ ID NO: 3376402 - DNA, 14 bp, Homo sapiens
ggagcctccccctc

SEQ ID NO: 3376403 - DNA, 16 bp, Homo sapiens
ggagcctccccctcag

SEQ ID NO: 3376404 - DNA, 19 bp, Homo sapiens
ggagcctccccctcagatg

SEQ ID NO: 3376405 - DNA, 13 bp, Homo sapiens
ggagcctcctgcc

SEQ ID NO: 3376406 - DNA, 20 bp, Homo sapiens
ggagcctgagtcagggccca

SEQ ID NO: 3376407 - DNA, 21 bp, Homo sapiens
ggagcctgagtcagggcccag

SEQ ID NO: 3376408 - DNA, 16 bp, Homo sapiens
ggagcctggcacagga

SEQ ID NO: 3376409 - DNA, 21 bp, Homo sapiens
ggagcctgtgcgtcccagctg

SEQ ID NO: 3376410 - DNA, 22 bp, Homo sapiens
ggagccttcccaagttgtgctt

SEQ ID NO: 3376411 - DNA, 16 bp, Homo sapiens
ggagcggcgccctgga

SEQ ID NO: 3376412 - DNA, 13 bp, Homo sapiens
ggagcggctgctc

SEQ ID NO: 3376413 - DNA, 22 bp, Homo sapiens
ggagcggctgctcgcccaggaa

SEQ ID NO: 3376414 - DNA, 15 bp, Homo sapiens
ggagcggtggccctg

SEQ ID NO: 3376415 - DNA, 15 bp, Homo sapiens
ggagctatcaggaac

SEQ ID NO: 3376416 - DNA, 22 bp, Homo sapiens
ggagctatcaggaacagctatg

SEQ ID NO: 3376417 - DNA, 22 bp, Homo sapiens
ggagctatgatttttttttcca

SEQ ID NO: 3376418 - DNA, 16 bp, Homo sapiens
ggagctcaccctgccc

SEQ ID NO: 3376419 - DNA, 17 bp, Homo sapiens
ggagctcaccctgcccg

SEQ ID NO: 3376420 - DNA, 12 bp, Homo sapiens
ggagctcagccc

SEQ ID NO: 3376421 - DNA, 22 bp, Homo sapiens
ggagctcaggaagaagagatgc

SEQ ID NO: 3376422 - DNA, 17 bp, Homo sapiens
ggagctcatctgcaaaa

SEQ ID NO: 3376423 - DNA, 20 bp, Homo sapiens
ggagctccactctgcttctc

SEQ ID NO: 3376424 - DNA, 11 bp, Homo sapiens
ggagctcctgg

SEQ ID NO: 3376425 - DNA, 16 bp, Homo sapiens
ggagctctgtatggtc

SEQ ID NO: 3376426 - DNA, 20 bp, Homo sapiens
ggagctcttcaggcctccct

SEQ ID NO: 3376427 - DNA, 19 bp, Homo sapiens
ggagctgatttccaggccc

SEQ ID NO: 3376428 - DNA, 14 bp, Homo sapiens
ggagctgcactgat

SEQ ID NO: 3376429 - DNA, 15 bp, Homo sapiens
ggagctgccacagag

SEQ ID NO: 3376430 - DNA, 12 bp, Homo sapiens
ggagctgcctgt

SEQ ID NO: 3376431 - DNA, 21 bp, Homo sapiens
ggagctgcctgttcagctcca

SEQ ID NO: 3376432 - DNA, 22 bp, Homo sapiens
ggagctgcctgttcagctccag

SEQ ID NO: 3376433 - DNA, 20 bp, Homo sapiens
ggagctggggagaggaaaga

SEQ ID NO: 3376434 - DNA, 15 bp, Homo sapiens
ggagcttgggaatgg

SEQ ID NO: 3376435 - DNA, 21 bp, Homo sapiens
ggaggaaaaccaagccgtggc

SEQ ID NO: 3376436 - DNA, 15 bp, Homo sapiens
ggaggaaagggagga

SEQ ID NO: 3376437 - DNA, 11 bp, Homo sapiens
ggaggaaggat

SEQ ID NO: 3376438 - DNA, 13 bp, Homo sapiens
ggaggaaggattg

SEQ ID NO: 3376439 - DNA, 13 bp, Homo sapiens
ggaggaaggcaag

SEQ ID NO: 3376440 - DNA, 14 bp, Homo sapiens
ggaggaaggtgctg

SEQ ID NO: 3376441 - DNA, 18 bp, Homo sapiens
ggaggaaggtgctgagct

SEQ ID NO: 3376442 - DNA, 14 bp, Homo sapiens
ggaggaattcagct

SEQ ID NO: 3376443 - DNA, 22 bp, Homo sapiens
ggaggacctgaccctactccct

SEQ ID NO: 3376444 - DNA, 13 bp, Homo sapiens
ggaggagagagac

SEQ ID NO: 3376445 - DNA, 14 bp, Homo sapiens
ggaggagagagacc

SEQ ID NO: 3376446 - DNA, 15 bp, Homo sapiens
ggaggagcacagttt

SEQ ID NO: 3376447 - DNA, 13 bp, Homo sapiens
ggaggagcctgtg

SEQ ID NO: 3376448 - DNA, 18 bp, Homo sapiens
ggaggagcgaaatctaaa

SEQ ID NO: 3376449 - DNA, 12 bp, Homo sapiens
ggaggaggaaga

SEQ ID NO: 3376450 - DNA, 15 bp, Homo sapiens
ggaggaggagatggc

SEQ ID NO: 3376451 - DNA, 14 bp, Homo sapiens
ggaggaggccacct

SEQ ID NO: 3376452 - DNA, 15 bp, Homo sapiens
ggaggaggccacctc

SEQ ID NO: 3376453 - DNA, 14 bp, Homo sapiens
ggaggagggaggcg

SEQ ID NO: 3376454 - DNA, 15 bp, Homo sapiens
ggaggagggatgctg

SEQ ID NO: 3376455 - DNA, 15 bp, Homo sapiens
ggaggagggggccgg

SEQ ID NO: 3376456 - DNA, 14 bp, Homo sapiens
ggaggatggagaga

SEQ ID NO: 3376457 - DNA, 21 bp, Homo sapiens
ggaggatggagagaggggaat

SEQ ID NO: 3376458 - DNA, 18 bp, Homo sapiens
ggaggatgttctgggaca

SEQ ID NO: 3376459 - DNA, 21 bp, Homo sapiens
ggaggatgttctgggacacag

SEQ ID NO: 3376460 - DNA, 23 bp, Homo sapiens
ggaggcaagagactgggagccac

SEQ ID NO: 3376461 - DNA, 14 bp, Homo sapiens
ggaggcaccagctc

SEQ ID NO: 3376462 - DNA, 17 bp, Homo sapiens
ggaggcaccagctctgt

SEQ ID NO: 3376463 - DNA, 11 bp, Homo sapiens
ggaggcagcat

SEQ ID NO: 3376464 - DNA, 23 bp, Homo sapiens
ggaggcagcatggagagaggcct

SEQ ID NO: 3376465 - DNA, 23 bp, Homo sapiens
ggaggcagccccctccacaccag

SEQ ID NO: 3376466 - DNA, 17 bp, Homo sapiens
ggaggcatggccctggg

SEQ ID NO: 3376467 - DNA, 21 bp, Homo sapiens
ggaggccaaccagcccgacag

SEQ ID NO: 3376468 - DNA, 15 bp, Homo sapiens
ggaggccaaggcagg

SEQ ID NO: 3376469 - DNA, 18 bp, Homo sapiens
ggaggccaaggcaggtag

SEQ ID NO: 3376470 - DNA, 22 bp, Homo sapiens
ggaggccaataaaaagttcaga

SEQ ID NO: 3376471 - DNA, 18 bp, Homo sapiens
ggaggccacctctccaag

SEQ ID NO: 3376472 - DNA, 18 bp, Homo sapiens
ggaggccccactgatgct

SEQ ID NO: 3376473 - DNA, 14 bp, Homo sapiens
ggaggccccagctc

SEQ ID NO: 3376474 - DNA, 19 bp, Homo sapiens
ggaggccccagctctgagg

SEQ ID NO: 3376475 - DNA, 18 bp, Homo sapiens
ggaggccccccgtgtgga

SEQ ID NO: 3376476 - DNA, 16 bp, Homo sapiens
ggaggccctcctgtgc

SEQ ID NO: 3376477 - DNA, 16 bp, Homo sapiens
ggaggcctcgagcaga

SEQ ID NO: 3376478 - DNA, 13 bp, Homo sapiens
ggaggcctgggga

SEQ ID NO: 3376479 - DNA, 19 bp, Homo sapiens
ggaggcctggggaggccct

SEQ ID NO: 3376480 - DNA, 20 bp, Homo sapiens
ggaggctcccgaggggaagg

SEQ ID NO: 3376481 - DNA, 16 bp, Homo sapiens
ggaggctgaggcagga

SEQ ID NO: 3376482 - DNA, 13 bp, Homo sapiens
ggaggctgcagag

SEQ ID NO: 3376483 - DNA, 20 bp, Homo sapiens
ggaggctggaggaagggggg

SEQ ID NO: 3376484 - DNA, 12 bp, Homo sapiens
ggaggctgggca

SEQ ID NO: 3376485 - DNA, 13 bp, Homo sapiens
ggaggctgggcac

SEQ ID NO: 3376486 - DNA, 16 bp, Homo sapiens
ggaggctgggcccctg

SEQ ID NO: 3376487 - DNA, 23 bp, Homo sapiens
ggaggctgggcccctgggatggg

SEQ ID NO: 3376488 - DNA, 17 bp, Homo sapiens
ggaggcttttcactgcc

SEQ ID NO: 3376489 - DNA, 14 bp, Homo sapiens
ggagggagaagaga

SEQ ID NO: 3376490 - DNA, 15 bp, Homo sapiens
ggagggagaagagaa

SEQ ID NO: 3376491 - DNA, 16 bp, Homo sapiens
ggagggagcagacagg

SEQ ID NO: 3376492 - DNA, 19 bp, Homo sapiens
ggagggaggctgggcgggt

SEQ ID NO: 3376493 - DNA, 22 bp, Homo sapiens
ggagggagtgttcaaaatacta

SEQ ID NO: 3376494 - DNA, 17 bp, Homo sapiens
ggagggattctggttcc

SEQ ID NO: 3376495 - DNA, 14 bp, Homo sapiens
ggagggcagagcca

SEQ ID NO: 3376496 - DNA, 17 bp, Homo sapiens
ggagggcagagccatgg

SEQ ID NO: 3376497 - DNA, 14 bp, Homo sapiens
ggagggcccctgcg

SEQ ID NO: 3376498 - DNA, 16 bp, Homo sapiens
ggagggccctacctga

SEQ ID NO: 3376499 - DNA, 19 bp, Homo sapiens
ggagggcttggcccagcgc

SEQ ID NO: 3376500 - DNA, 21 bp, Homo sapiens
ggaggggaaaggctgccgagg

SEQ ID NO: 3376501 - DNA, 13 bp, Homo sapiens
ggaggggaagctg

SEQ ID NO: 3376502 - DNA, 21 bp, Homo sapiens
ggaggggcccctgcttctcca

SEQ ID NO: 3376503 - DNA, 21 bp, Homo sapiens
ggaggggcccggtggcggcag

SEQ ID NO: 3376504 - DNA, 13 bp, Homo sapiens
ggaggggcctggc

SEQ ID NO: 3376505 - DNA, 21 bp, Homo sapiens
ggaggggcctggcagccgtgc

SEQ ID NO: 3376506 - DNA, 19 bp, Homo sapiens
ggaggggcgctggcccagc

SEQ ID NO: 3376507 - DNA, 14 bp, Homo sapiens
ggagggggatccga

SEQ ID NO: 3376508 - DNA, 16 bp, Homo sapiens
ggagggggcgctcagg

SEQ ID NO: 3376509 - DNA, 18 bp, Homo sapiens
ggagggggcgctcaggac

SEQ ID NO: 3376510 - DNA, 21 bp, Homo sapiens
ggagggggcgctcaggaccca

SEQ ID NO: 3376511 - DNA, 15 bp, Homo sapiens
ggagggggctgggct

SEQ ID NO: 3376512 - DNA, 15 bp, Homo sapiens
ggaggggggtgctgg

SEQ ID NO: 3376513 - DNA, 15 bp, Homo sapiens
ggaggggtgtggctc

SEQ ID NO: 3376514 - DNA, 19 bp, Homo sapiens
ggaggggttgccacaggcc

SEQ ID NO: 3376515 - DNA, 22 bp, Homo sapiens
ggaggggttgccacaggcctcc

SEQ ID NO: 3376516 - DNA, 13 bp, Homo sapiens
ggaggtcactgga

SEQ ID NO: 3376517 - DNA, 17 bp, Homo sapiens
ggaggtcactggaaagg

SEQ ID NO: 3376518 - DNA, 18 bp, Homo sapiens
ggaggtcggtaggttcag

SEQ ID NO: 3376519 - DNA, 13 bp, Homo sapiens
ggaggtctccagg

SEQ ID NO: 3376520 - DNA, 14 bp, Homo sapiens
ggaggtgaccccag

SEQ ID NO: 3376521 - DNA, 18 bp, Homo sapiens
ggaggtgagagtgggagg

SEQ ID NO: 3376522 - DNA, 21 bp, Homo sapiens
ggaggtgagatcacagcctcc

SEQ ID NO: 3376523 - DNA, 22 bp, Homo sapiens
ggaggtgagatcacagcctcca

SEQ ID NO: 3376524 - DNA, 18 bp, Homo sapiens
ggaggtgaggggggctgg

SEQ ID NO: 3376525 - DNA, 17 bp, Homo sapiens
ggaggtggaagaaggga

SEQ ID NO: 3376526 - DNA, 16 bp, Homo sapiens
ggaggtgggcatgcca

SEQ ID NO: 3376527 - DNA, 20 bp, Homo sapiens
ggaggtgggcatgccaccct

SEQ ID NO: 3376528 - DNA, 22 bp, Homo sapiens
ggaggtgggcatgccaccctca

SEQ ID NO: 3376529 - DNA, 14 bp, Homo sapiens
ggaggtggggaagg

SEQ ID NO: 3376530 - DNA, 23 bp, Homo sapiens
ggaggttctaaggcctaggattc

SEQ ID NO: 3376531 - DNA, 14 bp, Homo sapiens
ggaggttctcagag

SEQ ID NO: 3376532 - DNA, 12 bp, Homo sapiens
ggaggttgcagg

SEQ ID NO: 3376533 - DNA, 13 bp, Homo sapiens
ggagtagccaagc

SEQ ID NO: 3376534 - DNA, 17 bp, Homo sapiens
ggagtatgtctgatgga

SEQ ID NO: 3376535 - DNA, 13 bp, Homo sapiens
ggagtcacacagt

SEQ ID NO: 3376536 - DNA, 15 bp, Homo sapiens
ggagtcagagccctg

SEQ ID NO: 3376537 - DNA, 22 bp, Homo sapiens
ggagtcagagccctggctgggt

SEQ ID NO: 3376538 - DNA, 23 bp, Homo sapiens
ggagtcagtaggtccaagggcca

SEQ ID NO: 3376539 - DNA, 21 bp, Homo sapiens
ggagtcccaccttggctgcag

SEQ ID NO: 3376540 - DNA, 22 bp, Homo sapiens
ggagtcccaccttggctgcagg

SEQ ID NO: 3376541 - DNA, 20 bp, Homo sapiens
ggagtctgaggcctgagtga

SEQ ID NO: 3376542 - DNA, 18 bp, Homo sapiens
ggagtctggagtgggcag

SEQ ID NO: 3376543 - DNA, 22 bp, Homo sapiens
ggagtgaaacctttagggcagc

SEQ ID NO: 3376544 - DNA, 23 bp, Homo sapiens
ggagtgaaacctttagggcagct

SEQ ID NO: 3376545 - DNA, 12 bp, Homo sapiens
ggagtgaagagg

SEQ ID NO: 3376546 - DNA, 15 bp, Homo sapiens
ggagtgaagaggggc

SEQ ID NO: 3376547 - DNA, 11 bp, Homo sapiens
ggagtgacaga

SEQ ID NO: 3376548 - DNA, 18 bp, Homo sapiens
ggagtgacagaggcagcc

SEQ ID NO: 3376549 - DNA, 21 bp, Homo sapiens
ggagtgacagaggcagcccca

SEQ ID NO: 3376550 - DNA, 13 bp, Homo sapiens
ggagtgagactga

SEQ ID NO: 3376551 - DNA, 14 bp, Homo sapiens
ggagtgagactgac

SEQ ID NO: 3376552 - DNA, 12 bp, Homo sapiens
ggagtgagctgg

SEQ ID NO: 3376553 - DNA, 21 bp, Homo sapiens
ggagtgaggaatagttgagcc

SEQ ID NO: 3376554 - DNA, 21 bp, Homo sapiens
ggagtgatatgatccagagca

SEQ ID NO: 3376555 - DNA, 12 bp, Homo sapiens
ggagtgcagtga

SEQ ID NO: 3376556 - DNA, 19 bp, Homo sapiens
ggagtgcccaccctgggag

SEQ ID NO: 3376557 - DNA, 16 bp, Homo sapiens
ggagtgctggctcaca

SEQ ID NO: 3376558 - DNA, 18 bp, Homo sapiens
ggagtgggcacctcagaa

SEQ ID NO: 3376559 - DNA, 20 bp, Homo sapiens
ggagtgtatgactgcacatg

SEQ ID NO: 3376560 - DNA, 13 bp, Homo sapiens
ggagtgtcctctt

SEQ ID NO: 3376561 - DNA, 17 bp, Homo sapiens
ggagtgtcctgcccatg

SEQ ID NO: 3376562 - DNA, 16 bp, Homo sapiens
ggagtgtgtattgttc

SEQ ID NO: 3376563 - DNA, 17 bp, Homo sapiens
ggagtgtgtattgttcc

SEQ ID NO: 3376564 - DNA, 20 bp, Homo sapiens
ggagtttaagaccagcctgg

SEQ ID NO: 3376565 - DNA, 19 bp, Homo sapiens
ggagtttcctaaaagttca

SEQ ID NO: 3376566 - DNA, 20 bp, Homo sapiens
ggagtttgaggctgcagcga

SEQ ID NO: 3376567 - DNA, 15 bp, Homo sapiens
ggataaactgagcct

SEQ ID NO: 3376568 - DNA, 16 bp, Homo sapiens
ggataaactgagcctc

SEQ ID NO: 3376569 - DNA, 14 bp, Homo sapiens
ggataacctatatg

SEQ ID NO: 3376570 - DNA, 23 bp, Homo sapiens
ggataagtttctattctgtcagt

SEQ ID NO: 3376571 - DNA, 20 bp, Homo sapiens
ggataatgtcattaatatat

SEQ ID NO: 3376572 - DNA, 18 bp, Homo sapiens
ggatacaacctccctctt

SEQ ID NO: 3376573 - DNA, 22 bp, Homo sapiens
ggatacaacctccctcttgttt

SEQ ID NO: 3376574 - DNA, 12 bp, Homo sapiens
ggatacacagga

SEQ ID NO: 3376575 - DNA, 15 bp, Homo sapiens
ggatactgcagggcc

SEQ ID NO: 3376576 - DNA, 17 bp, Homo sapiens
ggatactggcacagagg

SEQ ID NO: 3376577 - DNA, 13 bp, Homo sapiens
ggatacttcctgg

SEQ ID NO: 3376578 - DNA, 13 bp, Homo sapiens
ggatagcattttt

SEQ ID NO: 3376579 - DNA, 18 bp, Homo sapiens
ggatagctaactgtaaat

SEQ ID NO: 3376580 - DNA, 19 bp, Homo sapiens
ggatagctaactgtaaatc

SEQ ID NO: 3376581 - DNA, 17 bp, Homo sapiens
ggataggagaagaggca

SEQ ID NO: 3376582 - DNA, 16 bp, Homo sapiens
ggatagtatgagccct

SEQ ID NO: 3376583 - DNA, 18 bp, Homo sapiens
ggatagtatttttatcca

SEQ ID NO: 3376584 - DNA, 19 bp, Homo sapiens
ggatagttgatgcatgtta

SEQ ID NO: 3376585 - DNA, 20 bp, Homo sapiens
ggatatagttttacttttaa

SEQ ID NO: 3376586 - DNA, 16 bp, Homo sapiens
ggatatattattgtaa

SEQ ID NO: 3376587 - DNA, 12 bp, Homo sapiens
ggatatggtctt

SEQ ID NO: 3376588 - DNA, 13 bp, Homo sapiens
ggatatgtggaga

SEQ ID NO: 3376589 - DNA, 11 bp, Homo sapiens
ggatatttaag

SEQ ID NO: 3376590 - DNA, 22 bp, Homo sapiens
ggatatttaagaaaatacaata

SEQ ID NO: 3376591 - DNA, 19 bp, Homo sapiens
ggatatttgatatttggtt

SEQ ID NO: 3376592 - DNA, 13 bp, Homo sapiens
ggatcaattttca

SEQ ID NO: 3376593 - DNA, 19 bp, Homo sapiens
ggatcaattttcattaaac

SEQ ID NO: 3376594 - DNA, 18 bp, Homo sapiens
ggatcacaagatggaatt

SEQ ID NO: 3376595 - DNA, 19 bp, Homo sapiens
ggatcactggagcccagga

SEQ ID NO: 3376596 - DNA, 17 bp, Homo sapiens
ggatcacttgagcccag

SEQ ID NO: 3376597 - DNA, 16 bp, Homo sapiens
ggatcagagcaggacc

SEQ ID NO: 3376598 - DNA, 19 bp, Homo sapiens
ggatcagagcgcacaggga

SEQ ID NO: 3376599 - DNA, 16 bp, Homo sapiens
ggatcatggtgtaata

SEQ ID NO: 3376600 - DNA, 12 bp, Homo sapiens
ggatccagccac

SEQ ID NO: 3376601 - DNA, 21 bp, Homo sapiens
ggatccagccacttccccctc

SEQ ID NO: 3376602 - DNA, 23 bp, Homo sapiens
ggatccagccacttccccctctt

SEQ ID NO: 3376603 - DNA, 16 bp, Homo sapiens
ggatccccgcctggcc

SEQ ID NO: 3376604 - DNA, 22 bp, Homo sapiens
ggatcccctctgtctacaaata

SEQ ID NO: 3376605 - DNA, 21 bp, Homo sapiens
ggatcccctgcggtcaggctg

SEQ ID NO: 3376606 - DNA, 14 bp, Homo sapiens
ggatccgctgccac

SEQ ID NO: 3376607 - DNA, 17 bp, Homo sapiens
ggatccgctgccaccac

SEQ ID NO: 3376608 - DNA, 12 bp, Homo sapiens
ggatcctccctc

SEQ ID NO: 3376609 - DNA, 18 bp, Homo sapiens
ggatctaccagcataaat

SEQ ID NO: 3376610 - DNA, 14 bp, Homo sapiens
ggatctatttcatg

SEQ ID NO: 3376611 - DNA, 21 bp, Homo sapiens
ggatctatttcatgtttttga

SEQ ID NO: 3376612 - DNA, 17 bp, Homo sapiens
ggatctcagctttgaga

SEQ ID NO: 3376613 - DNA, 21 bp, Homo sapiens
ggatctccactgataagactg

SEQ ID NO: 3376614 - DNA, 13 bp, Homo sapiens
ggatctctcagga

SEQ ID NO: 3376615 - DNA, 18 bp, Homo sapiens
ggatctggggctctggga

SEQ ID NO: 3376616 - DNA, 14 bp, Homo sapiens
ggatcttgaatgtg

SEQ ID NO: 3376617 - DNA, 23 bp, Homo sapiens
ggatcttgccacatttctgatca

SEQ ID NO: 3376618 - DNA, 14 bp, Homo sapiens
ggatctttgactga

SEQ ID NO: 3376619 - DNA, 18 bp, Homo sapiens
ggatgaaataactccttc

SEQ ID NO: 3376620 - DNA, 23 bp, Homo sapiens
ggatgaatgtatgtgcactgtca

SEQ ID NO: 3376621 - DNA, 19 bp, Homo sapiens
ggatgacaccctggcctga

SEQ ID NO: 3376622 - DNA, 19 bp, Homo sapiens
ggatgacaggcgcctgcca

SEQ ID NO: 3376623 - DNA, 16 bp, Homo sapiens
ggatgactaacaagat

SEQ ID NO: 3376624 - DNA, 13 bp, Homo sapiens
ggatgagaaacag

SEQ ID NO: 3376625 - DNA, 17 bp, Homo sapiens
ggatgagaaacagctca

SEQ ID NO: 3376626 - DNA, 23 bp, Homo sapiens
ggatgagaaacagctcagccagt

SEQ ID NO: 3376627 - DNA, 15 bp, Homo sapiens
ggatgagagcccaga

SEQ ID NO: 3376628 - DNA, 18 bp, Homo sapiens
ggatgagagcccagaggt

SEQ ID NO: 3376629 - DNA, 20 bp, Homo sapiens
ggatgaggggcttcctgggt

SEQ ID NO: 3376630 - DNA, 21 bp, Homo sapiens
ggatgagggtggcatgaggag

SEQ ID NO: 3376631 - DNA, 14 bp, Homo sapiens
ggatgattaaattt

SEQ ID NO: 3376632 - DNA, 16 bp, Homo sapiens
ggatgattcagaaatt

SEQ ID NO: 3376633 - DNA, 20 bp, Homo sapiens
ggatgattcagaaattggaa

SEQ ID NO: 3376634 - DNA, 17 bp, Homo sapiens
ggatgattggattattc

SEQ ID NO: 3376635 - DNA, 19 bp, Homo sapiens
ggatgatttcatcttctgg

SEQ ID NO: 3376636 - DNA, 11 bp, Homo sapiens
ggatgcacatt

SEQ ID NO: 3376637 - DNA, 20 bp, Homo sapiens
ggatgcacatttctggattg

SEQ ID NO: 3376638 - DNA, 12 bp, Homo sapiens
ggatgcatttca

SEQ ID NO: 3376639 - DNA, 15 bp, Homo sapiens
ggatgcatttcaaat

SEQ ID NO: 3376640 - DNA, 18 bp, Homo sapiens
ggatgccaaggagcccct

SEQ ID NO: 3376641 - DNA, 19 bp, Homo sapiens
ggatgccaaggagcccctg

SEQ ID NO: 3376642 - DNA, 22 bp, Homo sapiens
ggatgccaatattaaatctgct

SEQ ID NO: 3376643 - DNA, 21 bp, Homo sapiens
ggatgccagcccctgcctggg

SEQ ID NO: 3376644 - DNA, 13 bp, Homo sapiens
ggatgcccagaag

SEQ ID NO: 3376645 - DNA, 14 bp, Homo sapiens
ggatgcgaggacca

SEQ ID NO: 3376646 - DNA, 16 bp, Homo sapiens
ggatgctaacatctaa

SEQ ID NO: 3376647 - DNA, 15 bp, Homo sapiens
ggatgctctttccct

SEQ ID NO: 3376648 - DNA, 20 bp, Homo sapiens
ggatgctctttcccttttct

SEQ ID NO: 3376649 - DNA, 12 bp, Homo sapiens
ggatgctgcagc

SEQ ID NO: 3376650 - DNA, 14 bp, Homo sapiens
ggatgctgggctgg

SEQ ID NO: 3376651 - DNA, 15 bp, Homo sapiens
ggatggaaggagact

SEQ ID NO: 3376652 - DNA, 16 bp, Homo sapiens
ggatggagaaagaagt

SEQ ID NO: 3376653 - DNA, 20 bp, Homo sapiens
ggatggagaaagaagtggag

SEQ ID NO: 3376654 - DNA, 17 bp, Homo sapiens
ggatggagaggcggcct

SEQ ID NO: 3376655 - DNA, 18 bp, Homo sapiens
ggatggagaggcggcctc

SEQ ID NO: 3376656 - DNA, 21 bp, Homo sapiens
ggatggagcccaggcgggagc

SEQ ID NO: 3376657 - DNA, 19 bp, Homo sapiens
ggatggaggggtggtcctg

SEQ ID NO: 3376658 - DNA, 14 bp, Homo sapiens
ggatggcttgtcta

SEQ ID NO: 3376659 - DNA, 14 bp, Homo sapiens
ggatgggaacactg

SEQ ID NO: 3376660 - DNA, 15 bp, Homo sapiens
ggatgggagtgagac

SEQ ID NO: 3376661 - DNA, 21 bp, Homo sapiens
ggatgggatcccaggccaggg

SEQ ID NO: 3376662 - DNA, 16 bp, Homo sapiens
ggatgggggtggctgg

SEQ ID NO: 3376663 - DNA, 22 bp, Homo sapiens
ggatgtacttaagagtggcata

SEQ ID NO: 3376664 - DNA, 15 bp, Homo sapiens
ggatgtcaggcccag

SEQ ID NO: 3376665 - DNA, 23 bp, Homo sapiens
ggatgtccctgggccagggtctg

SEQ ID NO: 3376666 - DNA, 16 bp, Homo sapiens
ggatgtgagccccagg

SEQ ID NO: 3376667 - DNA, 22 bp, Homo sapiens
ggatgtggggtccccatcatcc

SEQ ID NO: 3376668 - DNA, 17 bp, Homo sapiens
ggatgtgtggggcatgg

SEQ ID NO: 3376669 - DNA, 13 bp, Homo sapiens
ggatgttctggga

SEQ ID NO: 3376670 - DNA, 16 bp, Homo sapiens
ggatgttctgggacac

SEQ ID NO: 3376671 - DNA, 16 bp, Homo sapiens
ggattaacctctgcac

SEQ ID NO: 3376672 - DNA, 17 bp, Homo sapiens
ggattaacctctgcact

SEQ ID NO: 3376673 - DNA, 18 bp, Homo sapiens
ggattaacctctgcacta

SEQ ID NO: 3376674 - DNA, 13 bp, Homo sapiens
ggattaagggcaa

SEQ ID NO: 3376675 - DNA, 20 bp, Homo sapiens
ggattaatctttaataacaa

SEQ ID NO: 3376676 - DNA, 19 bp, Homo sapiens
ggattacaagcgtgagcca

SEQ ID NO: 3376677 - DNA, 23 bp, Homo sapiens
ggattacaagcgtgagccactgc

SEQ ID NO: 3376678 - DNA, 20 bp, Homo sapiens
ggattacagaaactgatgcc

SEQ ID NO: 3376679 - DNA, 21 bp, Homo sapiens
ggattatgttatacaaggcaa

SEQ ID NO: 3376680 - DNA, 22 bp, Homo sapiens
ggattattcatttaaaatgatt

SEQ ID NO: 3376681 - DNA, 16 bp, Homo sapiens
ggattcagcatgtcca

SEQ ID NO: 3376682 - DNA, 11 bp, Homo sapiens
ggattcctcac

SEQ ID NO: 3376683 - DNA, 22 bp, Homo sapiens
ggattctgggaggcaagaaaag

SEQ ID NO: 3376684 - DNA, 14 bp, Homo sapiens
ggattctggttcca

SEQ ID NO: 3376685 - DNA, 16 bp, Homo sapiens
ggattgaagccctcca

SEQ ID NO: 3376686 - DNA, 16 bp, Homo sapiens
ggattgatcattcttt

SEQ ID NO: 3376687 - DNA, 18 bp, Homo sapiens
ggattgcacgtggcctct

SEQ ID NO: 3376688 - DNA, 15 bp, Homo sapiens
ggattgcctctgaaa

SEQ ID NO: 3376689 - DNA, 22 bp, Homo sapiens
ggattggccaaacatcagacct

SEQ ID NO: 3376690 - DNA, 20 bp, Homo sapiens
ggattggcttgtgtgtttca

SEQ ID NO: 3376691 - DNA, 22 bp, Homo sapiens
ggattggtttggcaagaacttg

SEQ ID NO: 3376692 - DNA, 20 bp, Homo sapiens
ggattgtatcaagtggcatg

SEQ ID NO: 3376693 - DNA, 13 bp, Homo sapiens
ggattgtggaaaa

SEQ ID NO: 3376694 - DNA, 17 bp, Homo sapiens
ggatttaaaagcctgct

SEQ ID NO: 3376695 - DNA, 21 bp, Homo sapiens
ggatttaacagtcatttaaaa

SEQ ID NO: 3376696 - DNA, 14 bp, Homo sapiens
ggatttcgtgggtc

SEQ ID NO: 3376697 - DNA, 13 bp, Homo sapiens
ggatttcttaggg

SEQ ID NO: 3376698 - DNA, 15 bp, Homo sapiens
ggattttaccaaagc

SEQ ID NO: 3376699 - DNA, 21 bp, Homo sapiens
ggattttgatccaagctggtc

SEQ ID NO: 3376700 - DNA, 12 bp, Homo sapiens
ggattttttcca

SEQ ID NO: 3376701 - DNA, 15 bp, Homo sapiens
ggcaaaaaaattaaa

SEQ ID NO: 3376702 - DNA, 11 bp, Homo sapiens
ggcaaaaccca

SEQ ID NO: 3376703 - DNA, 15 bp, Homo sapiens
ggcaaaagccttgtg

SEQ ID NO: 3376704 - DNA, 16 bp, Homo sapiens
ggcaaaagccttgtgt

SEQ ID NO: 3376705 - DNA, 20 bp, Homo sapiens
ggcaaaagccttgtgtatat

SEQ ID NO: 3376706 - DNA, 13 bp, Homo sapiens
ggcaaactctcta

SEQ ID NO: 3376707 - DNA, 20 bp, Homo sapiens
ggcaaagccacaaggctggc

SEQ ID NO: 3376708 - DNA, 21 bp, Homo sapiens
ggcaaagtgctgtacccttcc

SEQ ID NO: 3376709 - DNA, 18 bp, Homo sapiens
ggcaaatgacatgcactg

SEQ ID NO: 3376710 - DNA, 20 bp, Homo sapiens
ggcaaatgacatgcactgac

SEQ ID NO: 3376711 - DNA, 13 bp, Homo sapiens
ggcaaatggctga

SEQ ID NO: 3376712 - DNA, 14 bp, Homo sapiens
ggcaacacagaggc

SEQ ID NO: 3376713 - DNA, 13 bp, Homo sapiens
ggcaacagatgaa

SEQ ID NO: 3376714 - DNA, 19 bp, Homo sapiens
ggcaaccactaagaattca

SEQ ID NO: 3376715 - DNA, 21 bp, Homo sapiens
ggcaaccccagttctgctcct

SEQ ID NO: 3376716 - DNA, 19 bp, Homo sapiens
ggcaacccccagcctgcta

SEQ ID NO: 3376717 - DNA, 16 bp, Homo sapiens
ggcaacgaagaaaaaa

SEQ ID NO: 3376718 - DNA, 20 bp, Homo sapiens
ggcaacgaagaaaaaaaata

SEQ ID NO: 3376719 - DNA, 21 bp, Homo sapiens
ggcaacttcagtcctgggaga

SEQ ID NO: 3376720 - DNA, 14 bp, Homo sapiens
ggcaagaaaaggac

SEQ ID NO: 3376721 - DNA, 13 bp, Homo sapiens
ggcaagaagctgc

SEQ ID NO: 3376722 - DNA, 15 bp, Homo sapiens
ggcaagaagctgctt

SEQ ID NO: 3376723 - DNA, 17 bp, Homo sapiens
ggcaagactgcaaactt

SEQ ID NO: 3376724 - DNA, 19 bp, Homo sapiens
ggcaagagcccccttgaca

SEQ ID NO: 3376725 - DNA, 18 bp, Homo sapiens
ggcaagcacctcctgcct

SEQ ID NO: 3376726 - DNA, 19 bp, Homo sapiens
ggcaagcacctcctgcctc

SEQ ID NO: 3376727 - DNA, 19 bp, Homo sapiens
ggcaagcaggacctggcat

SEQ ID NO: 3376728 - DNA, 13 bp, Homo sapiens
ggcaagcagggaa

SEQ ID NO: 3376729 - DNA, 15 bp, Homo sapiens
ggcaagcccctcagc

SEQ ID NO: 3376730 - DNA, 16 bp, Homo sapiens
ggcaagcccctcagcc

SEQ ID NO: 3376731 - DNA, 17 bp, Homo sapiens
ggcaagcccctcagccc

SEQ ID NO: 3376732 - DNA, 20 bp, Homo sapiens
ggcaagcccctcagcccttg

SEQ ID NO: 3376733 - DNA, 22 bp, Homo sapiens
ggcaagcccctcagcccttgcc

SEQ ID NO: 3376734 - DNA, 22 bp, Homo sapiens
ggcaagctaggccccagaggcc

SEQ ID NO: 3376735 - DNA, 23 bp, Homo sapiens
ggcaagctaggccccagaggccc

SEQ ID NO: 3376736 - DNA, 11 bp, Homo sapiens
ggcaaggaaag

SEQ ID NO: 3376737 - DNA, 13 bp, Homo sapiens
ggcaaggcaggtg

SEQ ID NO: 3376738 - DNA, 16 bp, Homo sapiens
ggcaaggtctccttac

SEQ ID NO: 3376739 - DNA, 23 bp, Homo sapiens
ggcaagtccctgactctctgtga

SEQ ID NO: 3376740 - DNA, 13 bp, Homo sapiens
ggcaagtgtgggc

SEQ ID NO: 3376741 - DNA, 14 bp, Homo sapiens
ggcaattttgtaac

SEQ ID NO: 3376742 - DNA, 13 bp, Homo sapiens
ggcacacagcagc

SEQ ID NO: 3376743 - DNA, 19 bp, Homo sapiens
ggcacacagcagcccccca

SEQ ID NO: 3376744 - DNA, 18 bp, Homo sapiens
ggcacaccactgccctgc

SEQ ID NO: 3376745 - DNA, 21 bp, Homo sapiens
ggcacaccactgccctgcctg

SEQ ID NO: 3376746 - DNA, 11 bp, Homo sapiens
ggcacactgcc

SEQ ID NO: 3376747 - DNA, 14 bp, Homo sapiens
ggcacactgccaaa

SEQ ID NO: 3376748 - DNA, 21 bp, Homo sapiens
ggcacagaaacacaatatttt

SEQ ID NO: 3376749 - DNA, 23 bp, Homo sapiens
ggcacagacacgctcgcgggcag

SEQ ID NO: 3376750 - DNA, 22 bp, Homo sapiens
ggcacagacttctggaaggctg

SEQ ID NO: 3376751 - DNA, 15 bp, Homo sapiens
ggcacagcctagggt

SEQ ID NO: 3376752 - DNA, 20 bp, Homo sapiens
ggcacagcggagtctgtcct

SEQ ID NO: 3376753 - DNA, 22 bp, Homo sapiens
ggcacagcggagtctgtcctgt

SEQ ID NO: 3376754 - DNA, 13 bp, Homo sapiens
ggcacaggactga

SEQ ID NO: 3376755 - DNA, 20 bp, Homo sapiens
ggcacaggagtgtcctcttc

SEQ ID NO: 3376756 - DNA, 14 bp, Homo sapiens
ggcacagggcacca

SEQ ID NO: 3376757 - DNA, 20 bp, Homo sapiens
ggcacagggcaccagaggcc

SEQ ID NO: 3376758 - DNA, 16 bp, Homo sapiens
ggcacagggcagtggg

SEQ ID NO: 3376759 - DNA, 14 bp, Homo sapiens
ggcacagggcccgc

SEQ ID NO: 3376760 - DNA, 23 bp, Homo sapiens
ggcacagggcccgcagtgctggg

SEQ ID NO: 3376761 - DNA, 12 bp, Homo sapiens
ggcacagggtct

SEQ ID NO: 3376762 - DNA, 18 bp, Homo sapiens
ggcacagggtctgctctt

SEQ ID NO: 3376763 - DNA, 13 bp, Homo sapiens
ggcacagtgggag

SEQ ID NO: 3376764 - DNA, 16 bp, Homo sapiens
ggcacatgccccgatg

SEQ ID NO: 3376765 - DNA, 20 bp, Homo sapiens
ggcacatttcagggagaaac

SEQ ID NO: 3376766 - DNA, 16 bp, Homo sapiens
ggcaccaaagatgcag

SEQ ID NO: 3376767 - DNA, 17 bp, Homo sapiens
ggcaccagatgcaacct

SEQ ID NO: 3376768 - DNA, 19 bp, Homo sapiens
ggcaccagcatccaccttg

SEQ ID NO: 3376769 - DNA, 17 bp, Homo sapiens
ggcaccagccccctgga

SEQ ID NO: 3376770 - DNA, 21 bp, Homo sapiens
ggcaccagggcgctgggaagg

SEQ ID NO: 3376771 - DNA, 20 bp, Homo sapiens
ggcacccccacaagctgtcc

SEQ ID NO: 3376772 - DNA, 23 bp, Homo sapiens
ggcacccccacaagctgtccctg

SEQ ID NO: 3376773 - DNA, 24 bp, Homo sapiens
ggcacccccacaagctgtccctgc

SEQ ID NO: 3376774 - DNA, 20 bp, Homo sapiens
ggcacccggcccctgctggt

SEQ ID NO: 3376775 - DNA, 22 bp, Homo sapiens
ggcacccggcccctgctggttc

SEQ ID NO: 3376776 - DNA, 21 bp, Homo sapiens
ggcacccggggccagagacat

SEQ ID NO: 3376777 - DNA, 20 bp, Homo sapiens
ggcacccttctttcctcttc

SEQ ID NO: 3376778 - DNA, 17 bp, Homo sapiens
ggcaccggcgctgcagg

SEQ ID NO: 3376779 - DNA, 23 bp, Homo sapiens
ggcaccgggctccatgcctctgg

SEQ ID NO: 3376780 - DNA, 21 bp, Homo sapiens
ggcacctacactcacctgcac

SEQ ID NO: 3376781 - DNA, 18 bp, Homo sapiens
ggcacctatagtcccagc

SEQ ID NO: 3376782 - DNA, 19 bp, Homo sapiens
ggcacctatagtcccagct

SEQ ID NO: 3376783 - DNA, 19 bp, Homo sapiens
ggcacctcacaggccccag

SEQ ID NO: 3376784 - DNA, 13 bp, Homo sapiens
ggcacctggcctg

SEQ ID NO: 3376785 - DNA, 16 bp, Homo sapiens
ggcacctggcctgctg

SEQ ID NO: 3376786 - DNA, 17 bp, Homo sapiens
ggcacctggcctgctgg

SEQ ID NO: 3376787 - DNA, 18 bp, Homo sapiens
ggcaccttccgacatccc

SEQ ID NO: 3376788 - DNA, 17 bp, Homo sapiens
ggcacggactgtccacc

SEQ ID NO: 3376789 - DNA, 13 bp, Homo sapiens
ggcacgggtccct

SEQ ID NO: 3376790 - DNA, 15 bp, Homo sapiens
ggcacgggtggtccc

SEQ ID NO: 3376791 - DNA, 23 bp, Homo sapiens
ggcactaacgttgagcccctgga

SEQ ID NO: 3376792 - DNA, 20 bp, Homo sapiens
ggcactagcctttggctctg

SEQ ID NO: 3376793 - DNA, 22 bp, Homo sapiens
ggcactcacagacctggagccc

SEQ ID NO: 3376794 - DNA, 19 bp, Homo sapiens
ggcactcagaagacactga

SEQ ID NO: 3376795 - DNA, 22 bp, Homo sapiens
ggcactcagccacgaccagccc

SEQ ID NO: 3376796 - DNA, 22 bp, Homo sapiens
ggcactgattgttttagagact

SEQ ID NO: 3376797 - DNA, 21 bp, Homo sapiens
ggcactgccttctcctctctg

SEQ ID NO: 3376798 - DNA, 23 bp, Homo sapiens
ggcactgccttctcctctctggg

SEQ ID NO: 3376799 - DNA, 20 bp, Homo sapiens
ggcactggcattgtccctgt

SEQ ID NO: 3376800 - DNA, 21 bp, Homo sapiens
ggcactggccacccctcccca

SEQ ID NO: 3376801 - DNA, 22 bp, Homo sapiens
ggcactggccacccctccccag

SEQ ID NO: 3376802 - DNA, 14 bp, Homo sapiens
ggcactggcccagg

SEQ ID NO: 3376803 - DNA, 21 bp, Homo sapiens
ggcactgggatgagccgctgt

SEQ ID NO: 3376804 - DNA, 21 bp, Homo sapiens
ggcactggtaggttgggacac

SEQ ID NO: 3376805 - DNA, 16 bp, Homo sapiens
ggcactggtggcatcg

SEQ ID NO: 3376806 - DNA, 18 bp, Homo sapiens
ggcactgtagttctaaga

SEQ ID NO: 3376807 - DNA, 12 bp, Homo sapiens
ggcactgttaat

SEQ ID NO: 3376808 - DNA, 15 bp, Homo sapiens
ggcacttaagcacaa

SEQ ID NO: 3376809 - DNA, 21 bp, Homo sapiens
ggcacttaagtgcactttttt

SEQ ID NO: 3376810 - DNA, 13 bp, Homo sapiens
ggcacttaatttg

SEQ ID NO: 3376811 - DNA, 19 bp, Homo sapiens
ggcacttaatttgtaaact

SEQ ID NO: 3376812 - DNA, 20 bp, Homo sapiens
ggcacttaatttgtaaactt

SEQ ID NO: 3376813 - DNA, 10 bp, Homo sapiens
ggcacttgta

SEQ ID NO: 3376814 - DNA, 14 bp, Homo sapiens
ggcacttgtattta

SEQ ID NO: 3376815 - DNA, 17 bp, Homo sapiens
ggcacttgtatttaatt

SEQ ID NO: 3376816 - DNA, 14 bp, Homo sapiens
ggcactttttaatt

SEQ ID NO: 3376817 - DNA, 20 bp, Homo sapiens
ggcagaaaacagagcctgcc

SEQ ID NO: 3376818 - DNA, 21 bp, Homo sapiens
ggcagaaaacagagcctgcct

SEQ ID NO: 3376819 - DNA, 17 bp, Homo sapiens
ggcagaaaagaggagac

SEQ ID NO: 3376820 - DNA, 21 bp, Homo sapiens
ggcagaaaagaggagaccctg

SEQ ID NO: 3376821 - DNA, 14 bp, Homo sapiens
ggcagaaaggaaaa

SEQ ID NO: 3376822 - DNA, 16 bp, Homo sapiens
ggcagaagacaccaga

SEQ ID NO: 3376823 - DNA, 17 bp, Homo sapiens
ggcagaagacaccagag

SEQ ID NO: 3376824 - DNA, 11 bp, Homo sapiens
ggcagaaggga

SEQ ID NO: 3376825 - DNA, 17 bp, Homo sapiens
ggcagacagcaggcagc

SEQ ID NO: 3376826 - DNA, 23 bp, Homo sapiens
ggcagacagcaggcagcgccaag

SEQ ID NO: 3376827 - DNA, 11 bp, Homo sapiens
ggcagactctt

SEQ ID NO: 3376828 - DNA, 20 bp, Homo sapiens
ggcagagaatggctgggtca

SEQ ID NO: 3376829 - DNA, 18 bp, Homo sapiens
ggcagagacctccaataa

SEQ ID NO: 3376830 - DNA, 19 bp, Homo sapiens
ggcagagagcggtctcagg

SEQ ID NO: 3376831 - DNA, 14 bp, Homo sapiens
ggcagagccatggg

SEQ ID NO: 3376832 - DNA, 23 bp, Homo sapiens
ggcagagccatgggcctgggcct

SEQ ID NO: 3376833 - DNA, 24 bp, Homo sapiens
ggcagagccatgggcctgggcctg

SEQ ID NO: 3376834 - DNA, 21 bp, Homo sapiens
ggcagagctgacgggaggccc

SEQ ID NO: 3376835 - DNA, 17 bp, Homo sapiens
ggcagagctggctctga

SEQ ID NO: 3376836 - DNA, 20 bp, Homo sapiens
ggcagagggaatgttccctg

SEQ ID NO: 3376837 - DNA, 23 bp, Homo sapiens
ggcagagggaatgttccctgcac

SEQ ID NO: 3376838 - DNA, 13 bp, Homo sapiens
ggcagagggctgg

SEQ ID NO: 3376839 - DNA, 13 bp, Homo sapiens
ggcagaggtggcg

SEQ ID NO: 3376840 - DNA, 21 bp, Homo sapiens
ggcagaggttgcagtgagccg

SEQ ID NO: 3376841 - DNA, 21 bp, Homo sapiens
ggcagagtttgtgtgttgtct

SEQ ID NO: 3376842 - DNA, 19 bp, Homo sapiens
ggcagataatcagcctctt

SEQ ID NO: 3376843 - DNA, 23 bp, Homo sapiens
ggcagatacaggaaaagctgctg

SEQ ID NO: 3376844 - DNA, 15 bp, Homo sapiens
ggcagatctgtgccc

SEQ ID NO: 3376845 - DNA, 18 bp, Homo sapiens
ggcagatctgtgccccat

SEQ ID NO: 3376846 - DNA, 15 bp, Homo sapiens
ggcagcacagcccag

SEQ ID NO: 3376847 - DNA, 20 bp, Homo sapiens
ggcagcacagcccagggcct

SEQ ID NO: 3376848 - DNA, 13 bp, Homo sapiens
ggcagcaccctcc

SEQ ID NO: 3376849 - DNA, 16 bp, Homo sapiens
ggcagcaccctccccc

SEQ ID NO: 3376850 - DNA, 14 bp, Homo sapiens
ggcagcactcccca

SEQ ID NO: 3376851 - DNA, 20 bp, Homo sapiens
ggcagcactccccagagctg

SEQ ID NO: 3376852 - DNA, 13 bp, Homo sapiens
ggcagcagcaggt

SEQ ID NO: 3376853 - DNA, 19 bp, Homo sapiens
ggcagcatgcttgggctga

SEQ ID NO: 3376854 - DNA, 23 bp, Homo sapiens
ggcagcatgcttgggctgaccca

SEQ ID NO: 3376855 - DNA, 17 bp, Homo sapiens
ggcagcatggagagcct

SEQ ID NO: 3376856 - DNA, 11 bp, Homo sapiens
ggcagccatgc

SEQ ID NO: 3376857 - DNA, 16 bp, Homo sapiens
ggcagccatgcctcat

SEQ ID NO: 3376858 - DNA, 21 bp, Homo sapiens
ggcagcccagagactttgtag

SEQ ID NO: 3376859 - DNA, 22 bp, Homo sapiens
ggcagcccagagactttgtaga

SEQ ID NO: 3376860 - DNA, 22 bp, Homo sapiens
ggcagccccattctgcctgccc

SEQ ID NO: 3376861 - DNA, 15 bp, Homo sapiens
ggcagccccctccac

SEQ ID NO: 3376862 - DNA, 15 bp, Homo sapiens
ggcagccctgtaggg

SEQ ID NO: 3376863 - DNA, 21 bp, Homo sapiens
ggcagcccttgcttgttggga

SEQ ID NO: 3376864 - DNA, 13 bp, Homo sapiens
ggcagcctccaga

SEQ ID NO: 3376865 - DNA, 18 bp, Homo sapiens
ggcagcctccagagccag

SEQ ID NO: 3376866 - DNA, 19 bp, Homo sapiens
ggcagcctccagagccagc

SEQ ID NO: 3376867 - DNA, 17 bp, Homo sapiens
ggcagcctgggcctggg

SEQ ID NO: 3376868 - DNA, 18 bp, Homo sapiens
ggcagcgccaagtgcgtg

SEQ ID NO: 3376869 - DNA, 12 bp, Homo sapiens
ggcagcgggcca

SEQ ID NO: 3376870 - DNA, 13 bp, Homo sapiens
ggcagcgggccag

SEQ ID NO: 3376871 - DNA, 16 bp, Homo sapiens
ggcagcgggccaggcc

SEQ ID NO: 3376872 - DNA, 13 bp, Homo sapiens
ggcagctagtgcc

SEQ ID NO: 3376873 - DNA, 16 bp, Homo sapiens
ggcagctagtgccttt

SEQ ID NO: 3376874 - DNA, 20 bp, Homo sapiens
ggcagctcacccctgggcag

SEQ ID NO: 3376875 - DNA, 21 bp, Homo sapiens
ggcagctcacccctgggcagg

SEQ ID NO: 3376876 - DNA, 14 bp, Homo sapiens
ggcagctcctctcc

SEQ ID NO: 3376877 - DNA, 19 bp, Homo sapiens
ggcagctcctctccttggg

SEQ ID NO: 3376878 - DNA, 16 bp, Homo sapiens
ggcagctctccagtca

SEQ ID NO: 3376879 - DNA, 21 bp, Homo sapiens
ggcagctgaactattggaggg

SEQ ID NO: 3376880 - DNA, 13 bp, Homo sapiens
ggcagctgcctct

SEQ ID NO: 3376881 - DNA, 19 bp, Homo sapiens
ggcagctgcctctgctccc

SEQ ID NO: 3376882 - DNA, 19 bp, Homo sapiens
ggcagctgcggtccaccca

SEQ ID NO: 3376883 - DNA, 22 bp, Homo sapiens
ggcagctgctcttagtgcccgc

SEQ ID NO: 3376884 - DNA, 14 bp, Homo sapiens
ggcagctgggcccc

SEQ ID NO: 3376885 - DNA, 16 bp, Homo sapiens
ggcagcttcaagtgcc

SEQ ID NO: 3376886 - DNA, 13 bp, Homo sapiens
ggcagcttgcccc

SEQ ID NO: 3376887 - DNA, 18 bp, Homo sapiens
ggcagcttgccccggccc

SEQ ID NO: 3376888 - DNA, 23 bp, Homo sapiens
ggcaggaaggagagcctgctgca

SEQ ID NO: 3376889 - DNA, 19 bp, Homo sapiens
ggcaggaaggagcggcgcc

SEQ ID NO: 3376890 - DNA, 22 bp, Homo sapiens
ggcaggacacatcccggcctct

SEQ ID NO: 3376891 - DNA, 21 bp, Homo sapiens
ggcaggaccttcgggctgtgc

SEQ ID NO: 3376892 - DNA, 15 bp, Homo sapiens
ggcaggagaggctgg

SEQ ID NO: 3376893 - DNA, 20 bp, Homo sapiens
ggcaggagaggctgggctgg

SEQ ID NO: 3376894 - DNA, 14 bp, Homo sapiens
ggcaggagggaggt

SEQ ID NO: 3376895 - DNA, 14 bp, Homo sapiens
ggcaggagggccct

SEQ ID NO: 3376896 - DNA, 19 bp, Homo sapiens
ggcaggccagatggcccct

SEQ ID NO: 3376897 - DNA, 23 bp, Homo sapiens
ggcaggcgtgactcagcagcctg

SEQ ID NO: 3376898 - DNA, 22 bp, Homo sapiens
ggcaggctcactgccaggccag

SEQ ID NO: 3376899 - DNA, 13 bp, Homo sapiens
ggcaggctggcca

SEQ ID NO: 3376900 - DNA, 15 bp, Homo sapiens
ggcaggctgggccat

SEQ ID NO: 3376901 - DNA, 16 bp, Homo sapiens
ggcaggctgggccatg

SEQ ID NO: 3376902 - DNA, 21 bp, Homo sapiens
ggcagggatgggggtggctgg

SEQ ID NO: 3376903 - DNA, 23 bp, Homo sapiens
ggcagggatgggggtggctggga

SEQ ID NO: 3376904 - DNA, 14 bp, Homo sapiens
ggcagggcagaggg

SEQ ID NO: 3376905 - DNA, 17 bp, Homo sapiens
ggcagggccaccccact

SEQ ID NO: 3376906 - DNA, 13 bp, Homo sapiens
ggcagggccaggc

SEQ ID NO: 3376907 - DNA, 18 bp, Homo sapiens
ggcagggccaggctggtc

SEQ ID NO: 3376908 - DNA, 20 bp, Homo sapiens
ggcagggcccacgtgtatag

SEQ ID NO: 3376909 - DNA, 20 bp, Homo sapiens
ggcagggcccttggggctgg

SEQ ID NO: 3376910 - DNA, 15 bp, Homo sapiens
ggcagggccttcctg

SEQ ID NO: 3376911 - DNA, 11 bp, Homo sapiens
ggcagggctca

SEQ ID NO: 3376912 - DNA, 13 bp, Homo sapiens
ggcaggggtgggg

SEQ ID NO: 3376913 - DNA, 16 bp, Homo sapiens
ggcaggggtgggggtg

SEQ ID NO: 3376914 - DNA, 14 bp, Homo sapiens
ggcaggggtggtgg

SEQ ID NO: 3376915 - DNA, 17 bp, Homo sapiens
ggcagggtctcactctg

SEQ ID NO: 3376916 - DNA, 19 bp, Homo sapiens
ggcagggtctcactctgtc

SEQ ID NO: 3376917 - DNA, 24 bp, Homo sapiens
ggcaggtagatcgcttgagcccag

SEQ ID NO: 3376918 - DNA, 15 bp, Homo sapiens
ggcaggtagccaggg

SEQ ID NO: 3376919 - DNA, 13 bp, Homo sapiens
ggcaggtccaggg

SEQ ID NO: 3376920 - DNA, 12 bp, Homo sapiens
ggcaggtgcaga

SEQ ID NO: 3376921 - DNA, 19 bp, Homo sapiens
ggcaggtgcagatgggctg

SEQ ID NO: 3376922 - DNA, 15 bp, Homo sapiens
ggcaggtgggcagac

SEQ ID NO: 3376923 - DNA, 22 bp, Homo sapiens
ggcaggtggtggcactgagccc

SEQ ID NO: 3376924 - DNA, 16 bp, Homo sapiens
ggcaggttggatggga

SEQ ID NO: 3376925 - DNA, 19 bp, Homo sapiens
ggcagtaaagagaaacttt

SEQ ID NO: 3376926 - DNA, 13 bp, Homo sapiens
ggcagtacctggg

SEQ ID NO: 3376927 - DNA, 11 bp, Homo sapiens
ggcagtccctt

SEQ ID NO: 3376928 - DNA, 18 bp, Homo sapiens
ggcagtcgggggctggcc

SEQ ID NO: 3376929 - DNA, 21 bp, Homo sapiens
ggcagtcgggggctggcctag

SEQ ID NO: 3376930 - DNA, 15 bp, Homo sapiens
ggcagtctgaaccct

SEQ ID NO: 3376931 - DNA, 13 bp, Homo sapiens
ggcagtgactggc

SEQ ID NO: 3376932 - DNA, 16 bp, Homo sapiens
ggcagtgactggcagg

SEQ ID NO: 3376933 - DNA, 18 bp, Homo sapiens
ggcagtgactggcaggtg

SEQ ID NO: 3376934 - DNA, 15 bp, Homo sapiens
ggcagtgccacccgc

SEQ ID NO: 3376935 - DNA, 19 bp, Homo sapiens
ggcagtgccacccgcagat

SEQ ID NO: 3376936 - DNA, 14 bp, Homo sapiens
ggcagtgcccatgt

SEQ ID NO: 3376937 - DNA, 17 bp, Homo sapiens
ggcagtggcaggggagc

SEQ ID NO: 3376938 - DNA, 16 bp, Homo sapiens
ggcagtgggagctgcc

SEQ ID NO: 3376939 - DNA, 13 bp, Homo sapiens
ggcagtgttttgg

SEQ ID NO: 3376940 - DNA, 19 bp, Homo sapiens
ggcagttctcactcctagg

SEQ ID NO: 3376941 - DNA, 21 bp, Homo sapiens
ggcagttctcactcctaggag

SEQ ID NO: 3376942 - DNA, 17 bp, Homo sapiens
ggcagttgaacagaggg

SEQ ID NO: 3376943 - DNA, 14 bp, Homo sapiens
ggcagttgcttgtg

SEQ ID NO: 3376944 - DNA, 20 bp, Homo sapiens
ggcagttgggtagatgggtg

SEQ ID NO: 3376945 - DNA, 22 bp, Homo sapiens
ggcagttgggtagatgggtggg

SEQ ID NO: 3376946 - DNA, 13 bp, Homo sapiens
ggcatcacagggc

SEQ ID NO: 3376947 - DNA, 23 bp, Homo sapiens
ggcatcacagggcagagccggga

SEQ ID NO: 3376948 - DNA, 12 bp, Homo sapiens
ggcatcaggcac

SEQ ID NO: 3376949 - DNA, 14 bp, Homo sapiens
ggcatcaggcactg

SEQ ID NO: 3376950 - DNA, 15 bp, Homo sapiens
ggcatcaggcactgg

SEQ ID NO: 3376951 - DNA, 18 bp, Homo sapiens
ggcatcaggcactggtgg

SEQ ID NO: 3376952 - DNA, 20 bp, Homo sapiens
ggcatcaggcactggtggca

SEQ ID NO: 3376953 - DNA, 18 bp, Homo sapiens
ggcatcagtccctatgta

SEQ ID NO: 3376954 - DNA, 20 bp, Homo sapiens
ggcatccacccagtgctgcc

SEQ ID NO: 3376955 - DNA, 22 bp, Homo sapiens
ggcatccacccagtgctgccat

SEQ ID NO: 3376956 - DNA, 23 bp, Homo sapiens
ggcatccacccagtgctgccatg

SEQ ID NO: 3376957 - DNA, 15 bp, Homo sapiens
ggcatcctgcctggg

SEQ ID NO: 3376958 - DNA, 21 bp, Homo sapiens
ggcatcgcaccattctgactc

SEQ ID NO: 3376959 - DNA, 14 bp, Homo sapiens
ggcatcgcaggagt

SEQ ID NO: 3376960 - DNA, 17 bp, Homo sapiens
ggcatctcctgtgcatg

SEQ ID NO: 3376961 - DNA, 15 bp, Homo sapiens
ggcatctgacacaaa

SEQ ID NO: 3376962 - DNA, 16 bp, Homo sapiens
ggcatctgacacaaaa

SEQ ID NO: 3376963 - DNA, 22 bp, Homo sapiens
ggcatctgcaccctcgatgaag

SEQ ID NO: 3376964 - DNA, 14 bp, Homo sapiens
ggcatctgcccctc

SEQ ID NO: 3376965 - DNA, 18 bp, Homo sapiens
ggcatctgcccctccccc

SEQ ID NO: 3376966 - DNA, 19 bp, Homo sapiens
ggcatctgcccctccccca

SEQ ID NO: 3376967 - DNA, 16 bp, Homo sapiens
ggcatctttgccttgg

SEQ ID NO: 3376968 - DNA, 22 bp, Homo sapiens
ggcatctttgccttgggctgct

SEQ ID NO: 3376969 - DNA, 16 bp, Homo sapiens
ggcatctttggggagg

SEQ ID NO: 3376970 - DNA, 23 bp, Homo sapiens
ggcatgagccactgagcctggcc

SEQ ID NO: 3376971 - DNA, 14 bp, Homo sapiens
ggcatgaggaggtc

SEQ ID NO: 3376972 - DNA, 13 bp, Homo sapiens
ggcatgccaccct

SEQ ID NO: 3376973 - DNA, 20 bp, Homo sapiens
ggcatgccccggccacctct

SEQ ID NO: 3376974 - DNA, 22 bp, Homo sapiens
ggcatgccccggccacctctgc

SEQ ID NO: 3376975 - DNA, 13 bp, Homo sapiens
ggcatgccttgtg

SEQ ID NO: 3376976 - DNA, 13 bp, Homo sapiens
ggcatgctggggc

SEQ ID NO: 3376977 - DNA, 17 bp, Homo sapiens
ggcatggccaggtggcc

SEQ ID NO: 3376978 - DNA, 16 bp, Homo sapiens
ggcatggccctggggt

SEQ ID NO: 3376979 - DNA, 17 bp, Homo sapiens
ggcatggccctggggtc

SEQ ID NO: 3376980 - DNA, 21 bp, Homo sapiens
ggcatgggaaagccacctctc

SEQ ID NO: 3376981 - DNA, 16 bp, Homo sapiens
ggcatggtaccagccc

SEQ ID NO: 3376982 - DNA, 19 bp, Homo sapiens
ggcatggtcccttaaggca

SEQ ID NO: 3376983 - DNA, 21 bp, Homo sapiens
ggcatggttccttccctggga

SEQ ID NO: 3376984 - DNA, 21 bp, Homo sapiens
ggcatgtgcctatagtcccag

SEQ ID NO: 3376985 - DNA, 14 bp, Homo sapiens
ggcatgtggagaca

SEQ ID NO: 3376986 - DNA, 13 bp, Homo sapiens
ggcatgtggcctg

SEQ ID NO: 3376987 - DNA, 14 bp, Homo sapiens
ggcatgtgtgcctg

SEQ ID NO: 3376988 - DNA, 19 bp, Homo sapiens
ggcatgtgtgcctgtggca

SEQ ID NO: 3376989 - DNA, 20 bp, Homo sapiens
ggcatgttctctgaggacac

SEQ ID NO: 3376990 - DNA, 19 bp, Homo sapiens
ggcatgttttgtgcatttg

SEQ ID NO: 3376991 - DNA, 17 bp, Homo sapiens
ggcattaccctctgcag

SEQ ID NO: 3376992 - DNA, 17 bp, Homo sapiens
ggcattagaattattta

SEQ ID NO: 3376993 - DNA, 19 bp, Homo sapiens
ggcattagaattatttaaa

SEQ ID NO: 3376994 - DNA, 20 bp, Homo sapiens
ggcattatgtccactgtgta

SEQ ID NO: 3376995 - DNA, 15 bp, Homo sapiens
ggcattcctgcttat

SEQ ID NO: 3376996 - DNA, 17 bp, Homo sapiens
ggcattcgggccacagg

SEQ ID NO: 3376997 - DNA, 15 bp, Homo sapiens
ggcattcggggaagc

SEQ ID NO: 3376998 - DNA, 23 bp, Homo sapiens
ggcattcggggaagctgcacatg

SEQ ID NO: 3376999 - DNA, 12 bp, Homo sapiens
ggcattgctttc

SEQ ID NO: 3377000 - DNA, 13 bp, Homo sapiens
ggcattgctttcc

SEQ ID NO: 3377001 - DNA, 22 bp, Homo sapiens
ggcatttggtgagagtcaaagc

SEQ ID NO: 3377002 - DNA, 19 bp, Homo sapiens
ggccaaacccttgctttcc

SEQ ID NO: 3377003 - DNA, 20 bp, Homo sapiens
ggccaaacccttgctttcct

SEQ ID NO: 3377004 - DNA, 11 bp, Homo sapiens
ggccaaactgc

SEQ ID NO: 3377005 - DNA, 15 bp, Homo sapiens
ggccaaagccaaagc

SEQ ID NO: 3377006 - DNA, 22 bp, Homo sapiens
ggccaaatgcacaagctcagaa

SEQ ID NO: 3377007 - DNA, 19 bp, Homo sapiens
ggccaacatcgtgaaaccc

SEQ ID NO: 3377008 - DNA, 13 bp, Homo sapiens
ggccaaggcaggt

SEQ ID NO: 3377009 - DNA, 15 bp, Homo sapiens
ggccaaggtcctgct

SEQ ID NO: 3377010 - DNA, 12 bp, Homo sapiens
ggccaataaaaa

SEQ ID NO: 3377011 - DNA, 17 bp, Homo sapiens
ggccaatggaaacctca

SEQ ID NO: 3377012 - DNA, 20 bp, Homo sapiens
ggccacaacctgaaagacaa

SEQ ID NO: 3377013 - DNA, 16 bp, Homo sapiens
ggccacacccagcggc

SEQ ID NO: 3377014 - DNA, 21 bp, Homo sapiens
ggccacactattaccatgaga

SEQ ID NO: 3377015 - DNA, 13 bp, Homo sapiens
ggccacagccccc

SEQ ID NO: 3377016 - DNA, 22 bp, Homo sapiens
ggccacagcccccttgccctcc

SEQ ID NO: 3377017 - DNA, 12 bp, Homo sapiens
ggccacagccgc

SEQ ID NO: 3377018 - DNA, 14 bp, Homo sapiens
ggccacatacctct

SEQ ID NO: 3377019 - DNA, 18 bp, Homo sapiens
ggccacatacctctctga

SEQ ID NO: 3377020 - DNA, 14 bp, Homo sapiens
ggccacatttaata

SEQ ID NO: 3377021 - DNA, 16 bp, Homo sapiens
ggccaccagatgctga

SEQ ID NO: 3377022 - DNA, 12 bp, Homo sapiens
ggccaccaggct

SEQ ID NO: 3377023 - DNA, 13 bp, Homo sapiens
ggccaccaggctg

SEQ ID NO: 3377024 - DNA, 19 bp, Homo sapiens
ggccaccaggctggcgcag

SEQ ID NO: 3377025 - DNA, 13 bp, Homo sapiens
ggccacctcctcc

SEQ ID NO: 3377026 - DNA, 15 bp, Homo sapiens
ggccacctcctcccc

SEQ ID NO: 3377027 - DNA, 15 bp, Homo sapiens
ggccacctctccaag

SEQ ID NO: 3377028 - DNA, 12 bp, Homo sapiens
ggccacctctgc

SEQ ID NO: 3377029 - DNA, 20 bp, Homo sapiens
ggccacctgaggtgggccca

SEQ ID NO: 3377030 - DNA, 23 bp, Homo sapiens
ggccacctgaggtgggcccagga

SEQ ID NO: 3377031 - DNA, 19 bp, Homo sapiens
ggccacctgtagccatctg

SEQ ID NO: 3377032 - DNA, 13 bp, Homo sapiens
ggccactccgaga

SEQ ID NO: 3377033 - DNA, 12 bp, Homo sapiens
ggccactgggga

SEQ ID NO: 3377034 - DNA, 14 bp, Homo sapiens
ggccactggggact

SEQ ID NO: 3377035 - DNA, 21 bp, Homo sapiens
ggccactgtggccagagctgg

SEQ ID NO: 3377036 - DNA, 17 bp, Homo sapiens
ggccactttcagagccc

SEQ ID NO: 3377037 - DNA, 19 bp, Homo sapiens
ggccagaaggagggcagag

SEQ ID NO: 3377038 - DNA, 15 bp, Homo sapiens
ggccagactggaaga

SEQ ID NO: 3377039 - DNA, 18 bp, Homo sapiens
ggccagagagcctggtgc

SEQ ID NO: 3377040 - DNA, 21 bp, Homo sapiens
ggccagagagcctggtgctgc

SEQ ID NO: 3377041 - DNA, 12 bp, Homo sapiens
ggccagagaggg

SEQ ID NO: 3377042 - DNA, 15 bp, Homo sapiens
ggccagagagggccc

SEQ ID NO: 3377043 - DNA, 19 bp, Homo sapiens
ggccagagagggcccagct

SEQ ID NO: 3377044 - DNA, 21 bp, Homo sapiens
ggccagagagggcccagctgt

SEQ ID NO: 3377045 - DNA, 23 bp, Homo sapiens
ggccagagagggcccagctgtag

SEQ ID NO: 3377046 - DNA, 22 bp, Homo sapiens
ggccagagctggaaggcagggc

SEQ ID NO: 3377047 - DNA, 21 bp, Homo sapiens
ggccagaggaactgtccagag

SEQ ID NO: 3377048 - DNA, 18 bp, Homo sapiens
ggccagaggcccccagcc

SEQ ID NO: 3377049 - DNA, 19 bp, Homo sapiens
ggccagaggcccccagccc

SEQ ID NO: 3377050 - DNA, 22 bp, Homo sapiens
ggccagaggcccccagcccagg

SEQ ID NO: 3377051 - DNA, 18 bp, Homo sapiens
ggccagagggagctggaa

SEQ ID NO: 3377052 - DNA, 22 bp, Homo sapiens
ggccagagggagtgacagaggc

SEQ ID NO: 3377053 - DNA, 15 bp, Homo sapiens
ggccagagtggcctg

SEQ ID NO: 3377054 - DNA, 16 bp, Homo sapiens
ggccagagtggcctgg

SEQ ID NO: 3377055 - DNA, 15 bp, Homo sapiens
ggccagatgcaccag

SEQ ID NO: 3377056 - DNA, 15 bp, Homo sapiens
ggccagatggcccct

SEQ ID NO: 3377057 - DNA, 17 bp, Homo sapiens
ggccagcaacgcttgta

SEQ ID NO: 3377058 - DNA, 17 bp, Homo sapiens
ggccagcaaggcaggtt

SEQ ID NO: 3377059 - DNA, 12 bp, Homo sapiens
ggccagcaccct

SEQ ID NO: 3377060 - DNA, 20 bp, Homo sapiens
ggccagcaccctctcctggg

SEQ ID NO: 3377061 - DNA, 11 bp, Homo sapiens
ggccagccagg

SEQ ID NO: 3377062 - DNA, 17 bp, Homo sapiens
ggccagcccagccaggc

SEQ ID NO: 3377063 - DNA, 18 bp, Homo sapiens
ggccagcccagccaggcc

SEQ ID NO: 3377064 - DNA, 14 bp, Homo sapiens
ggccagccccaccc

SEQ ID NO: 3377065 - DNA, 23 bp, Homo sapiens
ggccagccccacccccagccagg

SEQ ID NO: 3377066 - DNA, 15 bp, Homo sapiens
ggccagcccggctgg

SEQ ID NO: 3377067 - DNA, 17 bp, Homo sapiens
ggccagccctgcagccc

SEQ ID NO: 3377068 - DNA, 19 bp, Homo sapiens
ggccagccctgcagcccaa

SEQ ID NO: 3377069 - DNA, 15 bp, Homo sapiens
ggccagcccttcctc

SEQ ID NO: 3377070 - DNA, 18 bp, Homo sapiens
ggccagcccttcctctca

SEQ ID NO: 3377071 - DNA, 21 bp, Homo sapiens
ggccagcctggggcctggcag

SEQ ID NO: 3377072 - DNA, 14 bp, Homo sapiens
ggccagcgggcaca

SEQ ID NO: 3377073 - DNA, 15 bp, Homo sapiens
ggccagcgggcacag

SEQ ID NO: 3377074 - DNA, 13 bp, Homo sapiens
ggccagcgtccca

SEQ ID NO: 3377075 - DNA, 21 bp, Homo sapiens
ggccagctcataaaatggaag

SEQ ID NO: 3377076 - DNA, 18 bp, Homo sapiens
ggccagctgcctgtgcct

SEQ ID NO: 3377077 - DNA, 21 bp, Homo sapiens
ggccagctgcctgtgcctgcc

SEQ ID NO: 3377078 - DNA, 22 bp, Homo sapiens
ggccagctgcctgtgcctgcca

SEQ ID NO: 3377079 - DNA, 21 bp, Homo sapiens
ggccaggaccacacagtcccc

SEQ ID NO: 3377080 - DNA, 13 bp, Homo sapiens
ggccaggactgag

SEQ ID NO: 3377081 - DNA, 15 bp, Homo sapiens
ggccaggactgagcc

SEQ ID NO: 3377082 - DNA, 23 bp, Homo sapiens
ggccaggagtttaagaccagcct

SEQ ID NO: 3377083 - DNA, 16 bp, Homo sapiens
ggccaggatggagggg

SEQ ID NO: 3377084 - DNA, 12 bp, Homo sapiens
ggccaggcacag

SEQ ID NO: 3377085 - DNA, 13 bp, Homo sapiens
ggccaggcacagg

SEQ ID NO: 3377086 - DNA, 18 bp, Homo sapiens
ggccaggcacagggcccg

SEQ ID NO: 3377087 - DNA, 14 bp, Homo sapiens
ggccaggcactgcc

SEQ ID NO: 3377088 - DNA, 22 bp, Homo sapiens
ggccaggcagatctgtgcccca

SEQ ID NO: 3377089 - DNA, 13 bp, Homo sapiens
ggccaggcccagg

SEQ ID NO: 3377090 - DNA, 20 bp, Homo sapiens
ggccaggcccaggcagagct

SEQ ID NO: 3377091 - DNA, 11 bp, Homo sapiens
ggccaggctgg

SEQ ID NO: 3377092 - DNA, 16 bp, Homo sapiens
ggccagggatctctct

SEQ ID NO: 3377093 - DNA, 23 bp, Homo sapiens
ggccagggcccctcaccctgcct

SEQ ID NO: 3377094 - DNA, 18 bp, Homo sapiens
ggccagggctgccctgag

SEQ ID NO: 3377095 - DNA, 14 bp, Homo sapiens
ggccagtccaggct

SEQ ID NO: 3377096 - DNA, 15 bp, Homo sapiens
ggccagtccccgagg

SEQ ID NO: 3377097 - DNA, 18 bp, Homo sapiens
ggccagtcctgcctggcc

SEQ ID NO: 3377098 - DNA, 17 bp, Homo sapiens
ggccagtctgggctgcc

SEQ ID NO: 3377099 - DNA, 18 bp, Homo sapiens
ggccagtctgtggatcag

SEQ ID NO: 3377100 - DNA, 23 bp, Homo sapiens
ggccagtctgtggatcagagatg

SEQ ID NO: 3377101 - DNA, 14 bp, Homo sapiens
ggccagtggggcct

SEQ ID NO: 3377102 - DNA, 15 bp, Homo sapiens
ggccagtggggcctg

SEQ ID NO: 3377103 - DNA, 16 bp, Homo sapiens
ggccagtgtctgggtt

SEQ ID NO: 3377104 - DNA, 20 bp, Homo sapiens
ggccagttgcccagagcact

SEQ ID NO: 3377105 - DNA, 19 bp, Homo sapiens
ggccataaacggttcctgg

SEQ ID NO: 3377106 - DNA, 19 bp, Homo sapiens
ggccatacttttgagaggg

SEQ ID NO: 3377107 - DNA, 16 bp, Homo sapiens
ggccatcacaggatgc

SEQ ID NO: 3377108 - DNA, 16 bp, Homo sapiens
ggccatccctgggccc

SEQ ID NO: 3377109 - DNA, 15 bp, Homo sapiens
ggccatctccctccc

SEQ ID NO: 3377110 - DNA, 17 bp, Homo sapiens
ggccatctccctcccca

SEQ ID NO: 3377111 - DNA, 23 bp, Homo sapiens
ggccatctgactgccaagccaga

SEQ ID NO: 3377112 - DNA, 19 bp, Homo sapiens
ggccatgcaattcatccca

SEQ ID NO: 3377113 - DNA, 13 bp, Homo sapiens
ggccatgctgagg

SEQ ID NO: 3377114 - DNA, 15 bp, Homo sapiens
ggccatgctgaggcc

SEQ ID NO: 3377115 - DNA, 13 bp, Homo sapiens
ggccatgggcctc

SEQ ID NO: 3377116 - DNA, 19 bp, Homo sapiens
ggccatggtacccccttct

SEQ ID NO: 3377117 - DNA, 20 bp, Homo sapiens
ggccatggtacccccttctg

SEQ ID NO: 3377118 - DNA, 13 bp, Homo sapiens
ggccatgtccaaa

SEQ ID NO: 3377119 - DNA, 15 bp, Homo sapiens
ggccatgtccaaaga

SEQ ID NO: 3377120 - DNA, 23 bp, Homo sapiens
ggccatgtccaaagaggctgccc

SEQ ID NO: 3377121 - DNA, 23 bp, Homo sapiens
ggccatgtgagccaccgctgcca

SEQ ID NO: 3377122 - DNA, 20 bp, Homo sapiens
ggcccaagagcagagtctgg

SEQ ID NO: 3377123 - DNA, 22 bp, Homo sapiens
ggcccaagccccatctcatcct

SEQ ID NO: 3377124 - DNA, 19 bp, Homo sapiens
ggcccaaggtcccctccac

SEQ ID NO: 3377125 - DNA, 20 bp, Homo sapiens
ggcccaaggtcccctccaca

SEQ ID NO: 3377126 - DNA, 15 bp, Homo sapiens
ggcccaagtcattgt

SEQ ID NO: 3377127 - DNA, 23 bp, Homo sapiens
ggcccacaggaggcaagcaagct

SEQ ID NO: 3377128 - DNA, 14 bp, Homo sapiens
ggcccaccagggtc

SEQ ID NO: 3377129 - DNA, 20 bp, Homo sapiens
ggcccaccatcaccaccgcc

SEQ ID NO: 3377130 - DNA, 12 bp, Homo sapiens
ggcccacctggc

SEQ ID NO: 3377131 - DNA, 15 bp, Homo sapiens
ggcccacctggccac

SEQ ID NO: 3377132 - DNA, 16 bp, Homo sapiens
ggcccacctggccacc

SEQ ID NO: 3377133 - DNA, 18 bp, Homo sapiens
ggcccagaactgccccca

SEQ ID NO: 3377134 - DNA, 20 bp, Homo sapiens
ggcccagagcgaggaaagga

SEQ ID NO: 3377135 - DNA, 23 bp, Homo sapiens
ggcccagaggctgagttttctct

SEQ ID NO: 3377136 - DNA, 20 bp, Homo sapiens
ggcccagagtttacattcta

SEQ ID NO: 3377137 - DNA, 15 bp, Homo sapiens
ggcccagcattgctg

SEQ ID NO: 3377138 - DNA, 20 bp, Homo sapiens
ggcccagcattgctggttct

SEQ ID NO: 3377139 - DNA, 14 bp, Homo sapiens
ggcccagcccagag

SEQ ID NO: 3377140 - DNA, 15 bp, Homo sapiens
ggcccagcccagagc

SEQ ID NO: 3377141 - DNA, 22 bp, Homo sapiens
ggcccagcccagagccacctgg

SEQ ID NO: 3377142 - DNA, 14 bp, Homo sapiens
ggcccagcccctag

SEQ ID NO: 3377143 - DNA, 12 bp, Homo sapiens
ggcccagccggc

SEQ ID NO: 3377144 - DNA, 16 bp, Homo sapiens
ggcccagccggcctct

SEQ ID NO: 3377145 - DNA, 17 bp, Homo sapiens
ggcccagccggcctctc

SEQ ID NO: 3377146 - DNA, 21 bp, Homo sapiens
ggcccagccggcctctctggc

SEQ ID NO: 3377147 - DNA, 15 bp, Homo sapiens
ggcccagcgcggcca

SEQ ID NO: 3377148 - DNA, 21 bp, Homo sapiens
ggcccagcgcggccagcgtcc

SEQ ID NO: 3377149 - DNA, 14 bp, Homo sapiens
ggcccagcgggcag

SEQ ID NO: 3377150 - DNA, 15 bp, Homo sapiens
ggcccagctgtagcc

SEQ ID NO: 3377151 - DNA, 16 bp, Homo sapiens
ggcccagctgtagcca

SEQ ID NO: 3377152 - DNA, 22 bp, Homo sapiens
ggcccagctgtagccatggctc

SEQ ID NO: 3377153 - DNA, 21 bp, Homo sapiens
ggcccaggatatttctgagag

SEQ ID NO: 3377154 - DNA, 12 bp, Homo sapiens
ggcccaggccta

SEQ ID NO: 3377155 - DNA, 14 bp, Homo sapiens
ggcccaggctggga

SEQ ID NO: 3377156 - DNA, 13 bp, Homo sapiens
ggcccagggaggg

SEQ ID NO: 3377157 - DNA, 21 bp, Homo sapiens
ggcccagggagggaagtgtga

SEQ ID NO: 3377158 - DNA, 22 bp, Homo sapiens
ggcccagtacctagctggctct

SEQ ID NO: 3377159 - DNA, 16 bp, Homo sapiens
ggcccagtgccactgc

SEQ ID NO: 3377160 - DNA, 17 bp, Homo sapiens
ggcccagtgccactgcc

SEQ ID NO: 3377161 - DNA, 22 bp, Homo sapiens
ggcccagtgtcaagttgtgctt

SEQ ID NO: 3377162 - DNA, 23 bp, Homo sapiens
ggcccagtgtcaagttgtgcttg

SEQ ID NO: 3377163 - DNA, 23 bp, Homo sapiens
ggcccataatagttagccctcag

SEQ ID NO: 3377164 - DNA, 22 bp, Homo sapiens
ggcccatagaaacatgacactg

SEQ ID NO: 3377165 - DNA, 18 bp, Homo sapiens
ggcccatagcagccagtt

SEQ ID NO: 3377166 - DNA, 15 bp, Homo sapiens
ggcccatctcagcct

SEQ ID NO: 3377167 - DNA, 15 bp, Homo sapiens
ggccccaccctgggc

SEQ ID NO: 3377168 - DNA, 19 bp, Homo sapiens
ggccccagaaggcagggaa

SEQ ID NO: 3377169 - DNA, 15 bp, Homo sapiens
ggccccagaggccct

SEQ ID NO: 3377170 - DNA, 18 bp, Homo sapiens
ggccccagaggccctgga

SEQ ID NO: 3377171 - DNA, 21 bp, Homo sapiens
ggccccagaggccctggaggt

SEQ ID NO: 3377172 - DNA, 17 bp, Homo sapiens
ggccccagatctgcctg

SEQ ID NO: 3377173 - DNA, 21 bp, Homo sapiens
ggccccagatctgcctgggcc

SEQ ID NO: 3377174 - DNA, 13 bp, Homo sapiens
ggccccagccctg

SEQ ID NO: 3377175 - DNA, 16 bp, Homo sapiens
ggccccagccctgctg

SEQ ID NO: 3377176 - DNA, 14 bp, Homo sapiens
ggccccagctctga

SEQ ID NO: 3377177 - DNA, 16 bp, Homo sapiens
ggccccagctctgagg

SEQ ID NO: 3377178 - DNA, 11 bp, Homo sapiens
ggccccaggag

SEQ ID NO: 3377179 - DNA, 12 bp, Homo sapiens
ggccccaggagg

SEQ ID NO: 3377180 - DNA, 15 bp, Homo sapiens
ggccccatgctctgc

SEQ ID NO: 3377181 - DNA, 20 bp, Homo sapiens
ggcccccaaacatagcccct

SEQ ID NO: 3377182 - DNA, 13 bp, Homo sapiens
ggcccccaataaa

SEQ ID NO: 3377183 - DNA, 15 bp, Homo sapiens
ggcccccaataaagg

SEQ ID NO: 3377184 - DNA, 20 bp, Homo sapiens
ggcccccaataaaggcagct

SEQ ID NO: 3377185 - DNA, 15 bp, Homo sapiens
ggcccccacttgcct

SEQ ID NO: 3377186 - DNA, 14 bp, Homo sapiens
ggcccccagcccag

SEQ ID NO: 3377187 - DNA, 18 bp, Homo sapiens
ggcccccagcccagggct

SEQ ID NO: 3377188 - DNA, 19 bp, Homo sapiens
ggcccccaggattccccca

SEQ ID NO: 3377189 - DNA, 22 bp, Homo sapiens
ggcccccaggattcccccagcc

SEQ ID NO: 3377190 - DNA, 12 bp, Homo sapiens
ggcccccagggg

SEQ ID NO: 3377191 - DNA, 13 bp, Homo sapiens
ggcccccaggggc

SEQ ID NO: 3377192 - DNA, 14 bp, Homo sapiens
ggcccccaggggca

SEQ ID NO: 3377193 - DNA, 18 bp, Homo sapiens
ggcccccaggggcaggac

SEQ ID NO: 3377194 - DNA, 13 bp, Homo sapiens
ggccccctccctg

SEQ ID NO: 3377195 - DNA, 13 bp, Homo sapiens
ggccccctgcatc

SEQ ID NO: 3377196 - DNA, 13 bp, Homo sapiens
ggccccgccaggg

SEQ ID NO: 3377197 - DNA, 15 bp, Homo sapiens
ggccccgccagggct

SEQ ID NO: 3377198 - DNA, 19 bp, Homo sapiens
ggccccgccagggctgggg

SEQ ID NO: 3377199 - DNA, 18 bp, Homo sapiens
ggccccggatcagagcag

SEQ ID NO: 3377200 - DNA, 23 bp, Homo sapiens
ggccccggatcagagcaggacct

SEQ ID NO: 3377201 - DNA, 24 bp, Homo sapiens
ggccccggatcagagcaggacctc

SEQ ID NO: 3377202 - DNA, 14 bp, Homo sapiens
ggccccggccccag

SEQ ID NO: 3377203 - DNA, 21 bp, Homo sapiens
ggccccggccccagccagagt

SEQ ID NO: 3377204 - DNA, 16 bp, Homo sapiens
ggccccgggctggaga

SEQ ID NO: 3377205 - DNA, 13 bp, Homo sapiens
ggccccggggctg

SEQ ID NO: 3377206 - DNA, 16 bp, Homo sapiens
ggccccggggctggca

SEQ ID NO: 3377207 - DNA, 18 bp, Homo sapiens
ggccccggggctggcaag

SEQ ID NO: 3377208 - DNA, 15 bp, Homo sapiens
ggccccgtggtgaca

SEQ ID NO: 3377209 - DNA, 14 bp, Homo sapiens
ggcccctcaacagc

SEQ ID NO: 3377210 - DNA, 14 bp, Homo sapiens
ggcccctcagagcc

SEQ ID NO: 3377211 - DNA, 14 bp, Homo sapiens
ggcccctccctctg

SEQ ID NO: 3377212 - DNA, 16 bp, Homo sapiens
ggcccctccctctgcc

SEQ ID NO: 3377213 - DNA, 21 bp, Homo sapiens
ggcccctcctagacccaggtg

SEQ ID NO: 3377214 - DNA, 21 bp, Homo sapiens
ggcccctcttattcctctagg

SEQ ID NO: 3377215 - DNA, 23 bp, Homo sapiens
ggcccctcttattcctctaggca

SEQ ID NO: 3377216 - DNA, 15 bp, Homo sapiens
ggcccctgaggactg

SEQ ID NO: 3377217 - DNA, 16 bp, Homo sapiens
ggcccctgaggactgg

SEQ ID NO: 3377218 - DNA, 17 bp, Homo sapiens
ggcccctgcatcccctt

SEQ ID NO: 3377219 - DNA, 13 bp, Homo sapiens
ggcccctgccacc

SEQ ID NO: 3377220 - DNA, 17 bp, Homo sapiens
ggcccctgcccggctgc

SEQ ID NO: 3377221 - DNA, 23 bp, Homo sapiens
ggcccctgctggttcagggttgg

SEQ ID NO: 3377222 - DNA, 16 bp, Homo sapiens
ggcccctgcttctcca

SEQ ID NO: 3377223 - DNA, 19 bp, Homo sapiens
ggcccctgcttctccagcc

SEQ ID NO: 3377224 - DNA, 20 bp, Homo sapiens
ggcccctgcttctccagcct

SEQ ID NO: 3377225 - DNA, 13 bp, Homo sapiens
ggcccctgggatg

SEQ ID NO: 3377226 - DNA, 23 bp, Homo sapiens
ggcccctgggcttggcctgctgt

SEQ ID NO: 3377227 - DNA, 23 bp, Homo sapiens
ggccccttctctccctgccagag

SEQ ID NO: 3377228 - DNA, 16 bp, Homo sapiens
ggccccttttcactcc

SEQ ID NO: 3377229 - DNA, 18 bp, Homo sapiens
ggccccttttcactccct

SEQ ID NO: 3377230 - DNA, 15 bp, Homo sapiens
ggcccgacagcctgg

SEQ ID NO: 3377231 - DNA, 17 bp, Homo sapiens
ggcccgacagcctggca

SEQ ID NO: 3377232 - DNA, 21 bp, Homo sapiens
ggcccgagatgtgacccacca

SEQ ID NO: 3377233 - DNA, 20 bp, Homo sapiens
ggcccgcaccccggcctcag

SEQ ID NO: 3377234 - DNA, 23 bp, Homo sapiens
ggcccgcaccccggcctcagggc

SEQ ID NO: 3377235 - DNA, 22 bp, Homo sapiens
ggcccgcagtgctgggaccaga

SEQ ID NO: 3377236 - DNA, 18 bp, Homo sapiens
ggcccggcagggcgggca

SEQ ID NO: 3377237 - DNA, 14 bp, Homo sapiens
ggcccggccacacc

SEQ ID NO: 3377238 - DNA, 15 bp, Homo sapiens
ggcccggccacaccc

SEQ ID NO: 3377239 - DNA, 18 bp, Homo sapiens
ggcccggccacacccagc

SEQ ID NO: 3377240 - DNA, 21 bp, Homo sapiens
ggcccggccacacccagcggc

SEQ ID NO: 3377241 - DNA, 13 bp, Homo sapiens
ggcccggccagcg

SEQ ID NO: 3377242 - DNA, 21 bp, Homo sapiens
ggcccggccagcgggcacagg

SEQ ID NO: 3377243 - DNA, 15 bp, Homo sapiens
ggcccggctccaggc

SEQ ID NO: 3377244 - DNA, 21 bp, Homo sapiens
ggcccggggggaccaggatga

SEQ ID NO: 3377245 - DNA, 20 bp, Homo sapiens
ggcccggtggcggcagggcc

SEQ ID NO: 3377246 - DNA, 13 bp, Homo sapiens
ggccctagcattg

SEQ ID NO: 3377247 - DNA, 15 bp, Homo sapiens
ggccctaggcccctc

SEQ ID NO: 3377248 - DNA, 17 bp, Homo sapiens
ggccctaggcccctcct

SEQ ID NO: 3377249 - DNA, 21 bp, Homo sapiens
ggccctaggggtcactgtact

SEQ ID NO: 3377250 - DNA, 19 bp, Homo sapiens
ggccctccctgactccctg

SEQ ID NO: 3377251 - DNA, 15 bp, Homo sapiens
ggccctcgacactca

SEQ ID NO: 3377252 - DNA, 17 bp, Homo sapiens
ggccctctttccctgcg

SEQ ID NO: 3377253 - DNA, 19 bp, Homo sapiens
ggccctgaggtgtgggggc

SEQ ID NO: 3377254 - DNA, 16 bp, Homo sapiens
ggccctgcagccagct

SEQ ID NO: 3377255 - DNA, 22 bp, Homo sapiens
ggccctgcagtgttcgcttggc

SEQ ID NO: 3377256 - DNA, 11 bp, Homo sapiens
ggccctgccca

SEQ ID NO: 3377257 - DNA, 15 bp, Homo sapiens
ggccctgccctctcc

SEQ ID NO: 3377258 - DNA, 14 bp, Homo sapiens
ggccctgccctgag

SEQ ID NO: 3377259 - DNA, 12 bp, Homo sapiens
ggccctgcctcc

SEQ ID NO: 3377260 - DNA, 9 bp, Homo sapiens
ggccctgct

SEQ ID NO: 3377261 - DNA, 14 bp, Homo sapiens
ggccctgctacctg

SEQ ID NO: 3377262 - DNA, 18 bp, Homo sapiens
ggccctgctcctgcagca

SEQ ID NO: 3377263 - DNA, 13 bp, Homo sapiens
ggccctgctgccc

SEQ ID NO: 3377264 - DNA, 22 bp, Homo sapiens
ggccctggaggaattcagctca

SEQ ID NO: 3377265 - DNA, 12 bp, Homo sapiens
ggccctggaggg

SEQ ID NO: 3377266 - DNA, 14 bp, Homo sapiens
ggccctggccagga

SEQ ID NO: 3377267 - DNA, 15 bp, Homo sapiens
ggccctggccaggac

SEQ ID NO: 3377268 - DNA, 22 bp, Homo sapiens
ggccctggctcccacaggccct

SEQ ID NO: 3377269 - DNA, 13 bp, Homo sapiens
ggccctgggcctc

SEQ ID NO: 3377270 - DNA, 16 bp, Homo sapiens
ggccctgggcctcagt

SEQ ID NO: 3377271 - DNA, 13 bp, Homo sapiens
ggccctgggctgg

SEQ ID NO: 3377272 - DNA, 12 bp, Homo sapiens
ggccctggtcct

SEQ ID NO: 3377273 - DNA, 17 bp, Homo sapiens
ggccctggtccttccag

SEQ ID NO: 3377274 - DNA, 16 bp, Homo sapiens
ggccctgtccctccca

SEQ ID NO: 3377275 - DNA, 17 bp, Homo sapiens
ggccctgtccctcccac

SEQ ID NO: 3377276 - DNA, 11 bp, Homo sapiens
ggccctgtgta

SEQ ID NO: 3377277 - DNA, 20 bp, Homo sapiens
ggccctgtgtaggggcaggg

SEQ ID NO: 3377278 - DNA, 20 bp, Homo sapiens
ggcccttacttgcttctcta

SEQ ID NO: 3377279 - DNA, 13 bp, Homo sapiens
ggcccttcctctc

SEQ ID NO: 3377280 - DNA, 19 bp, Homo sapiens
ggcccttcctctccactgc

SEQ ID NO: 3377281 - DNA, 20 bp, Homo sapiens
ggcccttgcctttgtggcct

SEQ ID NO: 3377282 - DNA, 13 bp, Homo sapiens
ggcccttggaata

SEQ ID NO: 3377283 - DNA, 17 bp, Homo sapiens
ggcccttggaataaagt

SEQ ID NO: 3377284 - DNA, 16 bp, Homo sapiens
ggcccttggggcctgg

SEQ ID NO: 3377285 - DNA, 17 bp, Homo sapiens
ggcccttggggcctggc

SEQ ID NO: 3377286 - DNA, 18 bp, Homo sapiens
ggcccttggggcctggct

SEQ ID NO: 3377287 - DNA, 20 bp, Homo sapiens
ggcccttggggcctggcttg

SEQ ID NO: 3377288 - DNA, 20 bp, Homo sapiens
ggcccttgtcctgccagctg

SEQ ID NO: 3377289 - DNA, 15 bp, Homo sapiens
ggccctttccccttc

SEQ ID NO: 3377290 - DNA, 19 bp, Homo sapiens
ggccctttccttccagatc

SEQ ID NO: 3377291 - DNA, 19 bp, Homo sapiens
ggccctttgaagcctcagc

SEQ ID NO: 3377292 - DNA, 16 bp, Homo sapiens
ggccgaagctctggct

SEQ ID NO: 3377293 - DNA, 17 bp, Homo sapiens
ggccgaaggtgcctcag

SEQ ID NO: 3377294 - DNA, 16 bp, Homo sapiens
ggccgactctgcactc

SEQ ID NO: 3377295 - DNA, 20 bp, Homo sapiens
ggccgactctgcactctcca

SEQ ID NO: 3377296 - DNA, 18 bp, Homo sapiens
ggccgagcgttcccagca

SEQ ID NO: 3377297 - DNA, 12 bp, Homo sapiens
ggccgaggccca

SEQ ID NO: 3377298 - DNA, 13 bp, Homo sapiens
ggccgaggcccag

SEQ ID NO: 3377299 - DNA, 18 bp, Homo sapiens
ggccgaggcccagcgggc

SEQ ID NO: 3377300 - DNA, 12 bp, Homo sapiens
ggccgaggcggg

SEQ ID NO: 3377301 - DNA, 13 bp, Homo sapiens
ggccgcagagact

SEQ ID NO: 3377302 - DNA, 18 bp, Homo sapiens
ggccgccacccccatctt

SEQ ID NO: 3377303 - DNA, 22 bp, Homo sapiens
ggccgccacggcctggctggtg

SEQ ID NO: 3377304 - DNA, 16 bp, Homo sapiens
ggccgccccctgcccc

SEQ ID NO: 3377305 - DNA, 14 bp, Homo sapiens
ggccgccgcctctt

SEQ ID NO: 3377306 - DNA, 17 bp, Homo sapiens
ggccgcctgcgggctgc

SEQ ID NO: 3377307 - DNA, 13 bp, Homo sapiens
ggccgctccaggg

SEQ ID NO: 3377308 - DNA, 19 bp, Homo sapiens
ggccgctccaggggtggct

SEQ ID NO: 3377309 - DNA, 17 bp, Homo sapiens
ggccggaaccacagggc

SEQ ID NO: 3377310 - DNA, 16 bp, Homo sapiens
ggccggacgcatctca

SEQ ID NO: 3377311 - DNA, 16 bp, Homo sapiens
ggccggcctggcaccg

SEQ ID NO: 3377312 - DNA, 19 bp, Homo sapiens
ggccggctgtgctcagaga

SEQ ID NO: 3377313 - DNA, 19 bp, Homo sapiens
ggccgggcaggcgtgactc

SEQ ID NO: 3377314 - DNA, 18 bp, Homo sapiens
ggccggggaagctgccag

SEQ ID NO: 3377315 - DNA, 16 bp, Homo sapiens
ggccgggggaggtggg

SEQ ID NO: 3377316 - DNA, 21 bp, Homo sapiens
ggccggtctgcaagtcagagg

SEQ ID NO: 3377317 - DNA, 14 bp, Homo sapiens
ggccgtaccccacc

SEQ ID NO: 3377318 - DNA, 22 bp, Homo sapiens
ggccgtaccccaccctcagcac

SEQ ID NO: 3377319 - DNA, 15 bp, Homo sapiens
ggccgtctcctccct

SEQ ID NO: 3377320 - DNA, 16 bp, Homo sapiens
ggccgtgggggttgag

SEQ ID NO: 3377321 - DNA, 18 bp, Homo sapiens
ggccgtgtctctgaggac

SEQ ID NO: 3377322 - DNA, 16 bp, Homo sapiens
ggccgttccccttggc

SEQ ID NO: 3377323 - DNA, 17 bp, Homo sapiens
ggccgttccccttggct

SEQ ID NO: 3377324 - DNA, 22 bp, Homo sapiens
ggccgttccccttggcttcctc

SEQ ID NO: 3377325 - DNA, 18 bp, Homo sapiens
ggcctaaaactggcctga

SEQ ID NO: 3377326 - DNA, 20 bp, Homo sapiens
ggcctaaaactggcctgact

SEQ ID NO: 3377327 - DNA, 17 bp, Homo sapiens
ggcctaaaagtaaacat

SEQ ID NO: 3377328 - DNA, 23 bp, Homo sapiens
ggcctaagacatgtgaggaggaa

SEQ ID NO: 3377329 - DNA, 23 bp, Homo sapiens
ggcctaccccgcagacaccttgg

SEQ ID NO: 3377330 - DNA, 17 bp, Homo sapiens
ggcctagatccacacac

SEQ ID NO: 3377331 - DNA, 23 bp, Homo sapiens
ggcctagcgatctctcctggcct

SEQ ID NO: 3377332 - DNA, 13 bp, Homo sapiens
ggcctaggaggcc

SEQ ID NO: 3377333 - DNA, 21 bp, Homo sapiens
ggcctatgcacatatggactc

SEQ ID NO: 3377334 - DNA, 20 bp, Homo sapiens
ggcctcaaaggcccgctcta

SEQ ID NO: 3377335 - DNA, 17 bp, Homo sapiens
ggcctcaagagcacaca

SEQ ID NO: 3377336 - DNA, 13 bp, Homo sapiens
ggcctcacccacc

SEQ ID NO: 3377337 - DNA, 19 bp, Homo sapiens
ggcctcaccgagtgggggc

SEQ ID NO: 3377338 - DNA, 13 bp, Homo sapiens
ggcctcactggct

SEQ ID NO: 3377339 - DNA, 19 bp, Homo sapiens
ggcctcactggctggggca

SEQ ID NO: 3377340 - DNA, 14 bp, Homo sapiens
ggcctcagccctca

SEQ ID NO: 3377341 - DNA, 16 bp, Homo sapiens
ggcctcagctgcctca

SEQ ID NO: 3377342 - DNA, 22 bp, Homo sapiens
ggcctcagctgcctcacttcct

SEQ ID NO: 3377343 - DNA, 15 bp, Homo sapiens
ggcctcaggctctgc

SEQ ID NO: 3377344 - DNA, 17 bp, Homo sapiens
ggcctcaggctctgcac

SEQ ID NO: 3377345 - DNA, 10 bp, Homo sapiens
ggcctcaggg

SEQ ID NO: 3377346 - DNA, 19 bp, Homo sapiens
ggcctcagggccaggaagg

SEQ ID NO: 3377347 - DNA, 16 bp, Homo sapiens
ggcctcagggcgctca

SEQ ID NO: 3377348 - DNA, 19 bp, Homo sapiens
ggcctcagggcgctcagac

SEQ ID NO: 3377349 - DNA, 19 bp, Homo sapiens
ggcctcagtttctccatca

SEQ ID NO: 3377350 - DNA, 18 bp, Homo sapiens
ggcctcatgcctgctgag

SEQ ID NO: 3377351 - DNA, 18 bp, Homo sapiens
ggcctcatgctggaggga

SEQ ID NO: 3377352 - DNA, 16 bp, Homo sapiens
ggcctcatgtggctgg

SEQ ID NO: 3377353 - DNA, 23 bp, Homo sapiens
ggcctccaacgcccctgtggcca

SEQ ID NO: 3377354 - DNA, 15 bp, Homo sapiens
ggcctccagaactca

SEQ ID NO: 3377355 - DNA, 18 bp, Homo sapiens
ggcctccagcctctcccg

SEQ ID NO: 3377356 - DNA, 21 bp, Homo sapiens
ggcctccagcctctcccggct

SEQ ID NO: 3377357 - DNA, 15 bp, Homo sapiens
ggcctccatcctgag

SEQ ID NO: 3377358 - DNA, 16 bp, Homo sapiens
ggcctccatcctgagg

SEQ ID NO: 3377359 - DNA, 11 bp, Homo sapiens
ggcctcccacc

SEQ ID NO: 3377360 - DNA, 20 bp, Homo sapiens
ggcctcccacccgatgctgc

SEQ ID NO: 3377361 - DNA, 21 bp, Homo sapiens
ggcctcccacccgatgctgct

SEQ ID NO: 3377362 - DNA, 23 bp, Homo sapiens
ggcctcccacccgatgctgcttt

SEQ ID NO: 3377363 - DNA, 14 bp, Homo sapiens
ggcctcccgaggag

SEQ ID NO: 3377364 - DNA, 17 bp, Homo sapiens
ggcctccctccttgggt

SEQ ID NO: 3377365 - DNA, 15 bp, Homo sapiens
ggcctccctctctct

SEQ ID NO: 3377366 - DNA, 12 bp, Homo sapiens
ggcctccctgct

SEQ ID NO: 3377367 - DNA, 11 bp, Homo sapiens
ggcctcctccc

SEQ ID NO: 3377368 - DNA, 19 bp, Homo sapiens
ggcctcctcggagagcagc

SEQ ID NO: 3377369 - DNA, 20 bp, Homo sapiens
ggcctcctcggagagcagca

SEQ ID NO: 3377370 - DNA, 21 bp, Homo sapiens
ggcctcctcggagagcagcag

SEQ ID NO: 3377371 - DNA, 21 bp, Homo sapiens
ggcctcctcttcaccccggca

SEQ ID NO: 3377372 - DNA, 23 bp, Homo sapiens
ggcctcgcctccccaccctcctc

SEQ ID NO: 3377373 - DNA, 17 bp, Homo sapiens
ggcctcgtgaggggcaa

SEQ ID NO: 3377374 - DNA, 19 bp, Homo sapiens
ggcctctaccacaagggct

SEQ ID NO: 3377375 - DNA, 15 bp, Homo sapiens
ggcctctctggcctc

SEQ ID NO: 3377376 - DNA, 16 bp, Homo sapiens
ggcctctctggcctcc

SEQ ID NO: 3377377 - DNA, 21 bp, Homo sapiens
ggcctctctggcctcccaccc

SEQ ID NO: 3377378 - DNA, 15 bp, Homo sapiens
ggcctcttccaccca

SEQ ID NO: 3377379 - DNA, 16 bp, Homo sapiens
ggcctcttgagcagtg

SEQ ID NO: 3377380 - DNA, 22 bp, Homo sapiens
ggcctcttgagcagtggctggt

SEQ ID NO: 3377381 - DNA, 19 bp, Homo sapiens
ggcctcttgggtcccccac

SEQ ID NO: 3377382 - DNA, 17 bp, Homo sapiens
ggcctgaaagaggctga

SEQ ID NO: 3377383 - DNA, 20 bp, Homo sapiens
ggcctgaccaaacagccaac

SEQ ID NO: 3377384 - DNA, 13 bp, Homo sapiens
ggcctgagctggg

SEQ ID NO: 3377385 - DNA, 20 bp, Homo sapiens
ggcctgaggcctgtgcctgt

SEQ ID NO: 3377386 - DNA, 20 bp, Homo sapiens
ggcctgatgctccctcccct

SEQ ID NO: 3377387 - DNA, 22 bp, Homo sapiens
ggcctgatgctccctcccctgc

SEQ ID NO: 3377388 - DNA, 13 bp, Homo sapiens
ggcctgatgctgc

SEQ ID NO: 3377389 - DNA, 19 bp, Homo sapiens
ggcctgcaaaccttcctgg

SEQ ID NO: 3377390 - DNA, 20 bp, Homo sapiens
ggcctgcaaaccttcctggg

SEQ ID NO: 3377391 - DNA, 13 bp, Homo sapiens
ggcctgcacacaa

SEQ ID NO: 3377392 - DNA, 14 bp, Homo sapiens
ggcctgcacacaag

SEQ ID NO: 3377393 - DNA, 14 bp, Homo sapiens
ggcctgcacagtga

SEQ ID NO: 3377394 - DNA, 14 bp, Homo sapiens
ggcctgcagaagga

SEQ ID NO: 3377395 - DNA, 19 bp, Homo sapiens
ggcctgcagcaggagtggt

SEQ ID NO: 3377396 - DNA, 20 bp, Homo sapiens
ggcctgcagcaggagtggtg

SEQ ID NO: 3377397 - DNA, 21 bp, Homo sapiens
ggcctgcccaatgctttggga

SEQ ID NO: 3377398 - DNA, 15 bp, Homo sapiens
ggcctgcctcccact

SEQ ID NO: 3377399 - DNA, 18 bp, Homo sapiens
ggcctgccttgaagccac

SEQ ID NO: 3377400 - DNA, 12 bp, Homo sapiens
ggcctgctggga

SEQ ID NO: 3377401 - DNA, 19 bp, Homo sapiens
ggcctgctgtgattccact

SEQ ID NO: 3377402 - DNA, 14 bp, Homo sapiens
ggcctggagatcct

SEQ ID NO: 3377403 - DNA, 15 bp, Homo sapiens
ggcctggagatcctc

SEQ ID NO: 3377404 - DNA, 17 bp, Homo sapiens
ggcctggagatcctcct

SEQ ID NO: 3377405 - DNA, 21 bp, Homo sapiens
ggcctggcagggaggtcaggc

SEQ ID NO: 3377406 - DNA, 12 bp, Homo sapiens
ggcctggccaga

SEQ ID NO: 3377407 - DNA, 16 bp, Homo sapiens
ggcctggccaggagct

SEQ ID NO: 3377408 - DNA, 12 bp, Homo sapiens
ggcctggccctg

SEQ ID NO: 3377409 - DNA, 19 bp, Homo sapiens
ggcctggccctgccctgag

SEQ ID NO: 3377410 - DNA, 11 bp, Homo sapiens
ggcctggcctg

SEQ ID NO: 3377411 - DNA, 14 bp, Homo sapiens
ggcctggctcccca

SEQ ID NO: 3377412 - DNA, 15 bp, Homo sapiens
ggcctggctccccac

SEQ ID NO: 3377413 - DNA, 12 bp, Homo sapiens
ggcctggctgga

SEQ ID NO: 3377414 - DNA, 16 bp, Homo sapiens
ggcctgggacccagct

SEQ ID NO: 3377415 - DNA, 20 bp, Homo sapiens
ggcctgggagggttcccctg

SEQ ID NO: 3377416 - DNA, 20 bp, Homo sapiens
ggcctgggatgctagcccca

SEQ ID NO: 3377417 - DNA, 22 bp, Homo sapiens
ggcctgggatgctagccccaga

SEQ ID NO: 3377418 - DNA, 15 bp, Homo sapiens
ggcctgggccgctgc

SEQ ID NO: 3377419 - DNA, 17 bp, Homo sapiens
ggcctgggcctctgccc

SEQ ID NO: 3377420 - DNA, 13 bp, Homo sapiens
ggcctgggcctgc

SEQ ID NO: 3377421 - DNA, 14 bp, Homo sapiens
ggcctgggcctgct

SEQ ID NO: 3377422 - DNA, 15 bp, Homo sapiens
ggcctgggcctgctt

SEQ ID NO: 3377423 - DNA, 19 bp, Homo sapiens
ggcctgggggcagtgactg

SEQ ID NO: 3377424 - DNA, 14 bp, Homo sapiens
ggcctggggtgcat

SEQ ID NO: 3377425 - DNA, 21 bp, Homo sapiens
ggcctggggtgcatcctcctc

SEQ ID NO: 3377426 - DNA, 24 bp, Homo sapiens
ggcctggggtgcatcctcctcagc

SEQ ID NO: 3377427 - DNA, 14 bp, Homo sapiens
ggcctgggtctgtg

SEQ ID NO: 3377428 - DNA, 23 bp, Homo sapiens
ggcctgggtggatcggcctcctc

SEQ ID NO: 3377429 - DNA, 11 bp, Homo sapiens
ggcctggtccc

SEQ ID NO: 3377430 - DNA, 15 bp, Homo sapiens
ggcctgtcgtgccag

SEQ ID NO: 3377431 - DNA, 19 bp, Homo sapiens
ggcctgtctcatccccagg

SEQ ID NO: 3377432 - DNA, 23 bp, Homo sapiens
ggcctgtctcatccccaggggtc

SEQ ID NO: 3377433 - DNA, 13 bp, Homo sapiens
ggcctgtgcagca

SEQ ID NO: 3377434 - DNA, 21 bp, Homo sapiens
ggcctgtgcagcagcccagct

SEQ ID NO: 3377435 - DNA, 16 bp, Homo sapiens
ggcctgtggaatgagt

SEQ ID NO: 3377436 - DNA, 22 bp, Homo sapiens
ggcctgtggaatgagtgtgcat

SEQ ID NO: 3377437 - DNA, 20 bp, Homo sapiens
ggcctgtgggagcctgcaaa

SEQ ID NO: 3377438 - DNA, 20 bp, Homo sapiens
ggcctgtgtcccatgaccca

SEQ ID NO: 3377439 - DNA, 21 bp, Homo sapiens
ggcctgtgtcccatgacccac

SEQ ID NO: 3377440 - DNA, 22 bp, Homo sapiens
ggcctgtgtgtgaaaggaagct

SEQ ID NO: 3377441 - DNA, 11 bp, Homo sapiens
ggcctgttgcc

SEQ ID NO: 3377442 - DNA, 21 bp, Homo sapiens
ggcctgttgctatagagccta

SEQ ID NO: 3377443 - DNA, 24 bp, Homo sapiens
ggcctgttgctatagagcctacct

SEQ ID NO: 3377444 - DNA, 20 bp, Homo sapiens
ggcctgtttctgcagccctt

SEQ ID NO: 3377445 - DNA, 22 bp, Homo sapiens
ggcctgtttgatgtatgtgtga

SEQ ID NO: 3377446 - DNA, 23 bp, Homo sapiens
ggccttaaaaggggcccaagccc

SEQ ID NO: 3377447 - DNA, 21 bp, Homo sapiens
ggccttccccttttgcctggc

SEQ ID NO: 3377448 - DNA, 22 bp, Homo sapiens
ggccttcggcctccatcctgag

SEQ ID NO: 3377449 - DNA, 23 bp, Homo sapiens
ggccttcggcctccatcctgagg

SEQ ID NO: 3377450 - DNA, 12 bp, Homo sapiens
ggccttctctga

SEQ ID NO: 3377451 - DNA, 18 bp, Homo sapiens
ggccttctgctgcccagg

SEQ ID NO: 3377452 - DNA, 18 bp, Homo sapiens
ggccttgctgctgctgca

SEQ ID NO: 3377453 - DNA, 12 bp, Homo sapiens
ggccttggaaat

SEQ ID NO: 3377454 - DNA, 21 bp, Homo sapiens
ggcctttaagaaccttaatga

SEQ ID NO: 3377455 - DNA, 24 bp, Homo sapiens
ggcctttaagaaccttaatgacaa

SEQ ID NO: 3377456 - DNA, 14 bp, Homo sapiens
ggcctttcctctct

SEQ ID NO: 3377457 - DNA, 17 bp, Homo sapiens
ggccttttaacattttg

SEQ ID NO: 3377458 - DNA, 22 bp, Homo sapiens
ggccttttagaaacctcattgg

SEQ ID NO: 3377459 - DNA, 23 bp, Homo sapiens
ggccttttgttaaacccttctgt

SEQ ID NO: 3377460 - DNA, 16 bp, Homo sapiens
ggcgagagaggagcca

SEQ ID NO: 3377461 - DNA, 18 bp, Homo sapiens
ggcgagtccaggagctca

SEQ ID NO: 3377462 - DNA, 23 bp, Homo sapiens
ggcgagtccaggagctcaggaag

SEQ ID NO: 3377463 - DNA, 22 bp, Homo sapiens
ggcgatccacctgtctcagcct

SEQ ID NO: 3377464 - DNA, 14 bp, Homo sapiens
ggcgatgccacgct

SEQ ID NO: 3377465 - DNA, 22 bp, Homo sapiens
ggcgatgctccctcagcctcag

SEQ ID NO: 3377466 - DNA, 17 bp, Homo sapiens
ggcgcaatctcggctca

SEQ ID NO: 3377467 - DNA, 15 bp, Homo sapiens
ggcgcagccaaggcc

SEQ ID NO: 3377468 - DNA, 11 bp, Homo sapiens
ggcgcaggagg

SEQ ID NO: 3377469 - DNA, 13 bp, Homo sapiens
ggcgcaggcccag

SEQ ID NO: 3377470 - DNA, 23 bp, Homo sapiens
ggcgccaacgttcgatttctacc

SEQ ID NO: 3377471 - DNA, 14 bp, Homo sapiens
ggcgcccccagtgt

SEQ ID NO: 3377472 - DNA, 12 bp, Homo sapiens
ggcgccctggac

SEQ ID NO: 3377473 - DNA, 16 bp, Homo sapiens
ggcgccctggacttgg

SEQ ID NO: 3377474 - DNA, 22 bp, Homo sapiens
ggcgcctagagcgcggctggct

SEQ ID NO: 3377475 - DNA, 12 bp, Homo sapiens
ggcgcctggaga

SEQ ID NO: 3377476 - DNA, 13 bp, Homo sapiens
ggcgcctggagag

SEQ ID NO: 3377477 - DNA, 18 bp, Homo sapiens
ggcgcctggagagcgagg

SEQ ID NO: 3377478 - DNA, 20 bp, Homo sapiens
ggcgcctggagagcgaggag

SEQ ID NO: 3377479 - DNA, 18 bp, Homo sapiens
ggcgcggcctcccgagga

SEQ ID NO: 3377480 - DNA, 18 bp, Homo sapiens
ggcgcgggaggcaccagc

SEQ ID NO: 3377481 - DNA, 16 bp, Homo sapiens
ggcgcgggcagccacc

SEQ ID NO: 3377482 - DNA, 12 bp, Homo sapiens
ggcgctcagacg

SEQ ID NO: 3377483 - DNA, 19 bp, Homo sapiens
ggcgctcagacggcggcca

SEQ ID NO: 3377484 - DNA, 18 bp, Homo sapiens
ggcgctgccacctgcccc

SEQ ID NO: 3377485 - DNA, 11 bp, Homo sapiens
ggcgctggccc

SEQ ID NO: 3377486 - DNA, 12 bp, Homo sapiens
ggcgctggccca

SEQ ID NO: 3377487 - DNA, 14 bp, Homo sapiens
ggcgctggcccagc

SEQ ID NO: 3377488 - DNA, 18 bp, Homo sapiens
ggcgctggcccagccggc

SEQ ID NO: 3377489 - DNA, 19 bp, Homo sapiens
ggcgctggcccagccggcc

SEQ ID NO: 3377490 - DNA, 20 bp, Homo sapiens
ggcggcacaggtcgggcgca

SEQ ID NO: 3377491 - DNA, 12 bp, Homo sapiens
ggcggcagcagc

SEQ ID NO: 3377492 - DNA, 18 bp, Homo sapiens
ggcggcaggggcctggag

SEQ ID NO: 3377493 - DNA, 21 bp, Homo sapiens
ggcggccacgcactgggccac

SEQ ID NO: 3377494 - DNA, 14 bp, Homo sapiens
ggcggccaggcaca

SEQ ID NO: 3377495 - DNA, 16 bp, Homo sapiens
ggcggccaggcacagg

SEQ ID NO: 3377496 - DNA, 22 bp, Homo sapiens
ggcggccaggcacagggcccgc

SEQ ID NO: 3377497 - DNA, 16 bp, Homo sapiens
ggcggcccggccagcg

SEQ ID NO: 3377498 - DNA, 14 bp, Homo sapiens
ggcggcggccacgc

SEQ ID NO: 3377499 - DNA, 16 bp, Homo sapiens
ggcggcgggcggctgg

SEQ ID NO: 3377500 - DNA, 17 bp, Homo sapiens
ggcggcttcctgtccac

SEQ ID NO: 3377501 - DNA, 14 bp, Homo sapiens
ggcgggcggtcagg

SEQ ID NO: 3377502 - DNA, 22 bp, Homo sapiens
ggcgggcttttctggggcccag

SEQ ID NO: 3377503 - DNA, 15 bp, Homo sapiens
ggcggggcccaggag

SEQ ID NO: 3377504 - DNA, 20 bp, Homo sapiens
ggcggtcttcaacatcctgc

SEQ ID NO: 3377505 - DNA, 17 bp, Homo sapiens
ggcggtgcccacaccgg

SEQ ID NO: 3377506 - DNA, 23 bp, Homo sapiens
ggcggtgcccacaccggggacag

SEQ ID NO: 3377507 - DNA, 14 bp, Homo sapiens
ggcggtggctgccc

SEQ ID NO: 3377508 - DNA, 19 bp, Homo sapiens
ggcgtaatgggcctgccca

SEQ ID NO: 3377509 - DNA, 19 bp, Homo sapiens
ggcgtcctttgggtgactc

SEQ ID NO: 3377510 - DNA, 14 bp, Homo sapiens
ggcgtgcagtggtg

SEQ ID NO: 3377511 - DNA, 21 bp, Homo sapiens
ggcgtgctggtcccctcctca

SEQ ID NO: 3377512 - DNA, 20 bp, Homo sapiens
ggcgtggagactggcaggcg

SEQ ID NO: 3377513 - DNA, 14 bp, Homo sapiens
ggcgtggaggagga

SEQ ID NO: 3377514 - DNA, 16 bp, Homo sapiens
ggcgtggcaaatataa

SEQ ID NO: 3377515 - DNA, 16 bp, Homo sapiens
ggcgtggtggcgggca

SEQ ID NO: 3377516 - DNA, 22 bp, Homo sapiens
ggcgtggtgtgtccctggacac

SEQ ID NO: 3377517 - DNA, 20 bp, Homo sapiens
ggcgttatttatggaccact

SEQ ID NO: 3377518 - DNA, 19 bp, Homo sapiens
ggcgttcacctccctgctc

SEQ ID NO: 3377519 - DNA, 18 bp, Homo sapiens
ggcgttgggagcctagct

SEQ ID NO: 3377520 - DNA, 18 bp, Homo sapiens
ggcgttttgtctgtgttg

SEQ ID NO: 3377521 - DNA, 17 bp, Homo sapiens
ggctaacctggacctgg

SEQ ID NO: 3377522 - DNA, 17 bp, Homo sapiens
ggctaactatatttgct

SEQ ID NO: 3377523 - DNA, 14 bp, Homo sapiens
ggctaagaggctgc

SEQ ID NO: 3377524 - DNA, 16 bp, Homo sapiens
ggctaagaggctgctg

SEQ ID NO: 3377525 - DNA, 22 bp, Homo sapiens
ggctaagatgagatttgccagc

SEQ ID NO: 3377526 - DNA, 20 bp, Homo sapiens
ggctaagtgatcctcccacc

SEQ ID NO: 3377527 - DNA, 18 bp, Homo sapiens
ggctaataaactgtatta

SEQ ID NO: 3377528 - DNA, 13 bp, Homo sapiens
ggctaatttaaca

SEQ ID NO: 3377529 - DNA, 19 bp, Homo sapiens
ggctacatcccagcctgtg

SEQ ID NO: 3377530 - DNA, 15 bp, Homo sapiens
ggctactgcagcttt

SEQ ID NO: 3377531 - DNA, 18 bp, Homo sapiens
ggctactgcagctttaca

SEQ ID NO: 3377532 - DNA, 23 bp, Homo sapiens
ggctactggcagctcctctcctt

SEQ ID NO: 3377533 - DNA, 16 bp, Homo sapiens
ggctagaggccagccc

SEQ ID NO: 3377534 - DNA, 20 bp, Homo sapiens
ggctaggacgttggcctcag

SEQ ID NO: 3377535 - DNA, 19 bp, Homo sapiens
ggctatagctacaggaagc

SEQ ID NO: 3377536 - DNA, 21 bp, Homo sapiens
ggctatcaaaagaaatagaaa

SEQ ID NO: 3377537 - DNA, 19 bp, Homo sapiens
ggctatgggggcactgagg

SEQ ID NO: 3377538 - DNA, 13 bp, Homo sapiens
ggctatttgaaat

SEQ ID NO: 3377539 - DNA, 14 bp, Homo sapiens
ggctatttgaaata

SEQ ID NO: 3377540 - DNA, 16 bp, Homo sapiens
ggctatttgtgtgtat

SEQ ID NO: 3377541 - DNA, 15 bp, Homo sapiens
ggctatttgttcaga

SEQ ID NO: 3377542 - DNA, 16 bp, Homo sapiens
ggctcaagtagaaaag

SEQ ID NO: 3377543 - DNA, 15 bp, Homo sapiens
ggctcaagtcctctt

SEQ ID NO: 3377544 - DNA, 21 bp, Homo sapiens
ggctcaagtcctcttttctga

SEQ ID NO: 3377545 - DNA, 15 bp, Homo sapiens
ggctcacacctgcaa

SEQ ID NO: 3377546 - DNA, 22 bp, Homo sapiens
ggctcacacctgcaatcccagc

SEQ ID NO: 3377547 - DNA, 23 bp, Homo sapiens
ggctcacagtacagcatgtgcct

SEQ ID NO: 3377548 - DNA, 19 bp, Homo sapiens
ggctcacggggcctccaac

SEQ ID NO: 3377549 - DNA, 21 bp, Homo sapiens
ggctcactgaaacctctgcct

SEQ ID NO: 3377550 - DNA, 15 bp, Homo sapiens
ggctcactgcagcct

SEQ ID NO: 3377551 - DNA, 14 bp, Homo sapiens
ggctcactgccagg

SEQ ID NO: 3377552 - DNA, 19 bp, Homo sapiens
ggctcactgccaggccagc

SEQ ID NO: 3377553 - DNA, 18 bp, Homo sapiens
ggctcagcggggacagct

SEQ ID NO: 3377554 - DNA, 12 bp, Homo sapiens
ggctcagggctg

SEQ ID NO: 3377555 - DNA, 14 bp, Homo sapiens
ggctcagggctgga

SEQ ID NO: 3377556 - DNA, 21 bp, Homo sapiens
ggctcatgcctgtaatctcag

SEQ ID NO: 3377557 - DNA, 12 bp, Homo sapiens
ggctccaacaga

SEQ ID NO: 3377558 - DNA, 18 bp, Homo sapiens
ggctccaagacctaggct

SEQ ID NO: 3377559 - DNA, 17 bp, Homo sapiens
ggctccacacctccacc

SEQ ID NO: 3377560 - DNA, 18 bp, Homo sapiens
ggctccagcaccttcttt

SEQ ID NO: 3377561 - DNA, 10 bp, Homo sapiens
ggctccaggc

SEQ ID NO: 3377562 - DNA, 22 bp, Homo sapiens
ggctccatgattctctgagtgg

SEQ ID NO: 3377563 - DNA, 16 bp, Homo sapiens
ggctccatgcctctgg

SEQ ID NO: 3377564 - DNA, 21 bp, Homo sapiens
ggctccatgcctctggaggcc

SEQ ID NO: 3377565 - DNA, 11 bp, Homo sapiens
ggctccatgct

SEQ ID NO: 3377566 - DNA, 22 bp, Homo sapiens
ggctcccagctcctttctcctg

SEQ ID NO: 3377567 - DNA, 12 bp, Homo sapiens
ggctcccagggg

SEQ ID NO: 3377568 - DNA, 23 bp, Homo sapiens
ggctcccaggggtctccctggct

SEQ ID NO: 3377569 - DNA, 13 bp, Homo sapiens
ggctccccagggc

SEQ ID NO: 3377570 - DNA, 14 bp, Homo sapiens
ggctccccagggct

SEQ ID NO: 3377571 - DNA, 17 bp, Homo sapiens
ggctccccatgtgtcct

SEQ ID NO: 3377572 - DNA, 21 bp, Homo sapiens
ggctccccatgtgtcctggtt

SEQ ID NO: 3377573 - DNA, 20 bp, Homo sapiens
ggctcccctttttcttcctc

SEQ ID NO: 3377574 - DNA, 15 bp, Homo sapiens
ggctcccggaattcc

SEQ ID NO: 3377575 - DNA, 15 bp, Homo sapiens
ggctccctcctccag

SEQ ID NO: 3377576 - DNA, 15 bp, Homo sapiens
ggctccctggcagga

SEQ ID NO: 3377577 - DNA, 18 bp, Homo sapiens
ggctccctttgctgctga

SEQ ID NO: 3377578 - DNA, 22 bp, Homo sapiens
ggctcctaggggaacagaccag

SEQ ID NO: 3377579 - DNA, 12 bp, Homo sapiens
ggctcctccttg

SEQ ID NO: 3377580 - DNA, 16 bp, Homo sapiens
ggctcctccttgccca

SEQ ID NO: 3377581 - DNA, 13 bp, Homo sapiens
ggctcctgagaaa

SEQ ID NO: 3377582 - DNA, 15 bp, Homo sapiens
ggctcctggctgcca

SEQ ID NO: 3377583 - DNA, 20 bp, Homo sapiens
ggctcctggctgccaggcgt

SEQ ID NO: 3377584 - DNA, 13 bp, Homo sapiens
ggctcctggtggc

SEQ ID NO: 3377585 - DNA, 20 bp, Homo sapiens
ggctccttcccatcgctgtc

SEQ ID NO: 3377586 - DNA, 17 bp, Homo sapiens
ggctcgaatctctgtgc

SEQ ID NO: 3377587 - DNA, 18 bp, Homo sapiens
ggctcgaatctctgtgcc

SEQ ID NO: 3377588 - DNA, 17 bp, Homo sapiens
ggctcgaggctggtgcc

SEQ ID NO: 3377589 - DNA, 18 bp, Homo sapiens
ggctcgaggctggtgcca

SEQ ID NO: 3377590 - DNA, 16 bp, Homo sapiens
ggctcgccatgccggg

SEQ ID NO: 3377591 - DNA, 17 bp, Homo sapiens
ggctcgccatgccgggg

SEQ ID NO: 3377592 - DNA, 23 bp, Homo sapiens
ggctcgctccctgtagctctgcc

SEQ ID NO: 3377593 - DNA, 14 bp, Homo sapiens
ggctcgtggccttc

SEQ ID NO: 3377594 - DNA, 17 bp, Homo sapiens
ggctctaattcacagtg

SEQ ID NO: 3377595 - DNA, 20 bp, Homo sapiens
ggctctccaaaggggctgct

SEQ ID NO: 3377596 - DNA, 23 bp, Homo sapiens
ggctctccaaaggggctgctggg

SEQ ID NO: 3377597 - DNA, 12 bp, Homo sapiens
ggctctccaagt

SEQ ID NO: 3377598 - DNA, 20 bp, Homo sapiens
ggctctccaagtgccagagg

SEQ ID NO: 3377599 - DNA, 23 bp, Homo sapiens
ggctctccaagtgccagaggtgg

SEQ ID NO: 3377600 - DNA, 23 bp, Homo sapiens
ggctctctgagactctttagagc

SEQ ID NO: 3377601 - DNA, 14 bp, Homo sapiens
ggctctgaaagcca

SEQ ID NO: 3377602 - DNA, 18 bp, Homo sapiens
ggctctgagagtctagat

SEQ ID NO: 3377603 - DNA, 20 bp, Homo sapiens
ggctctgcaattcccctctg

SEQ ID NO: 3377604 - DNA, 15 bp, Homo sapiens
ggctctgcactaaga

SEQ ID NO: 3377605 - DNA, 23 bp, Homo sapiens
ggctctgccccagctctggcttc

SEQ ID NO: 3377606 - DNA, 21 bp, Homo sapiens
ggctctgccctccctccttcc

SEQ ID NO: 3377607 - DNA, 15 bp, Homo sapiens
ggctctggagacagc

SEQ ID NO: 3377608 - DNA, 17 bp, Homo sapiens
ggctctggagacagccc

SEQ ID NO: 3377609 - DNA, 17 bp, Homo sapiens
ggctctggcccttgcct

SEQ ID NO: 3377610 - DNA, 14 bp, Homo sapiens
ggctctgggctcag

SEQ ID NO: 3377611 - DNA, 20 bp, Homo sapiens
ggctctgggctcagggctgg

SEQ ID NO: 3377612 - DNA, 19 bp, Homo sapiens
ggctcttagcagcttccag

SEQ ID NO: 3377613 - DNA, 20 bp, Homo sapiens
ggctcttatgtgtgcctttg

SEQ ID NO: 3377614 - DNA, 16 bp, Homo sapiens
ggctcttcctggacct

SEQ ID NO: 3377615 - DNA, 19 bp, Homo sapiens
ggctcttcctggacctgag

SEQ ID NO: 3377616 - DNA, 14 bp, Homo sapiens
ggctcttctccttt

SEQ ID NO: 3377617 - DNA, 15 bp, Homo sapiens
ggctcttctcctttc

SEQ ID NO: 3377618 - DNA, 19 bp, Homo sapiens
ggctcttgatacccccctc

SEQ ID NO: 3377619 - DNA, 23 bp, Homo sapiens
ggctcttgtgctggatggagccc

SEQ ID NO: 3377620 - DNA, 13 bp, Homo sapiens
ggctctttcagag

SEQ ID NO: 3377621 - DNA, 15 bp, Homo sapiens
ggctctttccttgct

SEQ ID NO: 3377622 - DNA, 15 bp, Homo sapiens
ggctgaaccctgtgc

SEQ ID NO: 3377623 - DNA, 16 bp, Homo sapiens
ggctgaaccctgtgct

SEQ ID NO: 3377624 - DNA, 20 bp, Homo sapiens
ggctgaaccctgtgctggtg

SEQ ID NO: 3377625 - DNA, 23 bp, Homo sapiens
ggctgaaccctgtgctggtgtcc

SEQ ID NO: 3377626 - DNA, 21 bp, Homo sapiens
ggctgaatccgtggtggcacc

SEQ ID NO: 3377627 - DNA, 17 bp, Homo sapiens
ggctgacacctaccatg

SEQ ID NO: 3377628 - DNA, 19 bp, Homo sapiens
ggctgacacctaccatgct

SEQ ID NO: 3377629 - DNA, 20 bp, Homo sapiens
ggctgacacctaccatgctg

SEQ ID NO: 3377630 - DNA, 21 bp, Homo sapiens
ggctgacacctaccatgctgc

SEQ ID NO: 3377631 - DNA, 14 bp, Homo sapiens
ggctgacatctgtg

SEQ ID NO: 3377632 - DNA, 18 bp, Homo sapiens
ggctgacatctgtgtttc

SEQ ID NO: 3377633 - DNA, 22 bp, Homo sapiens
ggctgacatgaagctgttgtgt

SEQ ID NO: 3377634 - DNA, 20 bp, Homo sapiens
ggctgacccagcatctccca

SEQ ID NO: 3377635 - DNA, 21 bp, Homo sapiens
ggctgacccagcatctcccag

SEQ ID NO: 3377636 - DNA, 17 bp, Homo sapiens
ggctgacctgcctctca

SEQ ID NO: 3377637 - DNA, 13 bp, Homo sapiens
ggctgactggcca

SEQ ID NO: 3377638 - DNA, 23 bp, Homo sapiens
ggctgactggccagttgcccaga

SEQ ID NO: 3377639 - DNA, 16 bp, Homo sapiens
ggctgactggggctgg

SEQ ID NO: 3377640 - DNA, 18 bp, Homo sapiens
ggctgactggggctgggg

SEQ ID NO: 3377641 - DNA, 15 bp, Homo sapiens
ggctgacttcatctg

SEQ ID NO: 3377642 - DNA, 10 bp, Homo sapiens
ggctgagaag

SEQ ID NO: 3377643 - DNA, 13 bp, Homo sapiens
ggctgagaaggaa

SEQ ID NO: 3377644 - DNA, 14 bp, Homo sapiens
ggctgagaaggaac

SEQ ID NO: 3377645 - DNA, 19 bp, Homo sapiens
ggctgagaaggaacaggga

SEQ ID NO: 3377646 - DNA, 14 bp, Homo sapiens
ggctgagccctggc

SEQ ID NO: 3377647 - DNA, 15 bp, Homo sapiens
ggctgagctgagctt

SEQ ID NO: 3377648 - DNA, 21 bp, Homo sapiens
ggctgaggaagcacagcagca

SEQ ID NO: 3377649 - DNA, 14 bp, Homo sapiens
ggctgaggcagaag

SEQ ID NO: 3377650 - DNA, 15 bp, Homo sapiens
ggctgaggcaggaga

SEQ ID NO: 3377651 - DNA, 16 bp, Homo sapiens
ggctgaggcctggact

SEQ ID NO: 3377652 - DNA, 14 bp, Homo sapiens
ggctgagggcagct

SEQ ID NO: 3377653 - DNA, 17 bp, Homo sapiens
ggctgaggggcttggga

SEQ ID NO: 3377654 - DNA, 14 bp, Homo sapiens
ggctgaggttcctc

SEQ ID NO: 3377655 - DNA, 17 bp, Homo sapiens
ggctgaggttcctctgc

SEQ ID NO: 3377656 - DNA, 21 bp, Homo sapiens
ggctgaggttcctctgcctgc

SEQ ID NO: 3377657 - DNA, 22 bp, Homo sapiens
ggctgaggttcctctgcctgcc

SEQ ID NO: 3377658 - DNA, 17 bp, Homo sapiens
ggctgagtggggagcag

SEQ ID NO: 3377659 - DNA, 16 bp, Homo sapiens
ggctgatttacatgta

SEQ ID NO: 3377660 - DNA, 17 bp, Homo sapiens
ggctgatttacatgtat

SEQ ID NO: 3377661 - DNA, 23 bp, Homo sapiens
ggctgatttacatgtatggttac

SEQ ID NO: 3377662 - DNA, 22 bp, Homo sapiens
ggctgcaaagggtatcaggtgc

SEQ ID NO: 3377663 - DNA, 23 bp, Homo sapiens
ggctgcaaagggtatcaggtgct

SEQ ID NO: 3377664 - DNA, 18 bp, Homo sapiens
ggctgcagagctgaccca

SEQ ID NO: 3377665 - DNA, 13 bp, Homo sapiens
ggctgcagaggcc

SEQ ID NO: 3377666 - DNA, 16 bp, Homo sapiens
ggctgcagaggccaga

SEQ ID NO: 3377667 - DNA, 12 bp, Homo sapiens
ggctgcagggag

SEQ ID NO: 3377668 - DNA, 14 bp, Homo sapiens
ggctgcaggtggga

SEQ ID NO: 3377669 - DNA, 15 bp, Homo sapiens
ggctgcagtgagcca

SEQ ID NO: 3377670 - DNA, 15 bp, Homo sapiens
ggctgccaaggccag

SEQ ID NO: 3377671 - DNA, 11 bp, Homo sapiens
ggctgccaggc

SEQ ID NO: 3377672 - DNA, 12 bp, Homo sapiens
ggctgccaggcg

SEQ ID NO: 3377673 - DNA, 20 bp, Homo sapiens
ggctgcccagccccgctcag

SEQ ID NO: 3377674 - DNA, 19 bp, Homo sapiens
ggctgcccatcatgtggcc

SEQ ID NO: 3377675 - DNA, 20 bp, Homo sapiens
ggctgcccccaacactccag

SEQ ID NO: 3377676 - DNA, 17 bp, Homo sapiens
ggctgccccggcctcct

SEQ ID NO: 3377677 - DNA, 13 bp, Homo sapiens
ggctgcccctctc

SEQ ID NO: 3377678 - DNA, 16 bp, Homo sapiens
ggctgccctggccctg

SEQ ID NO: 3377679 - DNA, 17 bp, Homo sapiens
ggctgccctggccctga

SEQ ID NO: 3377680 - DNA, 20 bp, Homo sapiens
ggctgccctggccctgaggt

SEQ ID NO: 3377681 - DNA, 22 bp, Homo sapiens
ggctgccctggccctgaggtgt

SEQ ID NO: 3377682 - DNA, 21 bp, Homo sapiens
ggctgccgggttctagtctcc

SEQ ID NO: 3377683 - DNA, 18 bp, Homo sapiens
ggctgcgggaggccctgg

SEQ ID NO: 3377684 - DNA, 19 bp, Homo sapiens
ggctgcgggaggccctggc

SEQ ID NO: 3377685 - DNA, 22 bp, Homo sapiens
ggctgcgggaggccctggccct

SEQ ID NO: 3377686 - DNA, 15 bp, Homo sapiens
ggctgctcgcccagg

SEQ ID NO: 3377687 - DNA, 19 bp, Homo sapiens
ggctgctcgcccaggaagg

SEQ ID NO: 3377688 - DNA, 11 bp, Homo sapiens
ggctgctgccc

SEQ ID NO: 3377689 - DNA, 16 bp, Homo sapiens
ggctgctggggcatgt

SEQ ID NO: 3377690 - DNA, 14 bp, Homo sapiens
ggctgcttagaatc

SEQ ID NO: 3377691 - DNA, 16 bp, Homo sapiens
ggctgcttcctcctgg

SEQ ID NO: 3377692 - DNA, 14 bp, Homo sapiens
ggctggactggagg

SEQ ID NO: 3377693 - DNA, 14 bp, Homo sapiens
ggctggagaaagag

SEQ ID NO: 3377694 - DNA, 21 bp, Homo sapiens
ggctggagaaagagctgcctg

SEQ ID NO: 3377695 - DNA, 15 bp, Homo sapiens
ggctggaggcccagg

SEQ ID NO: 3377696 - DNA, 20 bp, Homo sapiens
ggctggagtgcagtggcgca

SEQ ID NO: 3377697 - DNA, 20 bp, Homo sapiens
ggctggagtgcagtggtgtg

SEQ ID NO: 3377698 - DNA, 16 bp, Homo sapiens
ggctggcaagcaggga

SEQ ID NO: 3377699 - DNA, 17 bp, Homo sapiens
ggctggcaagcagggaa

SEQ ID NO: 3377700 - DNA, 18 bp, Homo sapiens
ggctggcagctctccagt

SEQ ID NO: 3377701 - DNA, 20 bp, Homo sapiens
ggctggcagctctccagtca

SEQ ID NO: 3377702 - DNA, 13 bp, Homo sapiens
ggctggccactgc

SEQ ID NO: 3377703 - DNA, 12 bp, Homo sapiens
ggctggccagca

SEQ ID NO: 3377704 - DNA, 18 bp, Homo sapiens
ggctggccagcaaggcag

SEQ ID NO: 3377705 - DNA, 21 bp, Homo sapiens
ggctggccagtccaggctgcc

SEQ ID NO: 3377706 - DNA, 20 bp, Homo sapiens
ggctggccccagggcaccct

SEQ ID NO: 3377707 - DNA, 21 bp, Homo sapiens
ggctggcctaggagatatctg

SEQ ID NO: 3377708 - DNA, 19 bp, Homo sapiens
ggctggcctctggctctca

SEQ ID NO: 3377709 - DNA, 16 bp, Homo sapiens
ggctggcgcagccaag

SEQ ID NO: 3377710 - DNA, 17 bp, Homo sapiens
ggctggcgcagccaagg

SEQ ID NO: 3377711 - DNA, 19 bp, Homo sapiens
ggctggcgcagccaaggcc

SEQ ID NO: 3377712 - DNA, 20 bp, Homo sapiens
ggctggcgtgcagtggtgcg

SEQ ID NO: 3377713 - DNA, 11 bp, Homo sapiens
ggctggctcct

SEQ ID NO: 3377714 - DNA, 17 bp, Homo sapiens
ggctggctcctagggga

SEQ ID NO: 3377715 - DNA, 12 bp, Homo sapiens
ggctggctctgc

SEQ ID NO: 3377716 - DNA, 15 bp, Homo sapiens
ggctggctgcagtga

SEQ ID NO: 3377717 - DNA, 13 bp, Homo sapiens
ggctggctggcct

SEQ ID NO: 3377718 - DNA, 15 bp, Homo sapiens
ggctgggagcatagc

SEQ ID NO: 3377719 - DNA, 15 bp, Homo sapiens
ggctgggaggaaggg

SEQ ID NO: 3377720 - DNA, 15 bp, Homo sapiens
ggctgggaggaggaa

SEQ ID NO: 3377721 - DNA, 17 bp, Homo sapiens
ggctgggaggaggaaga

SEQ ID NO: 3377722 - DNA, 16 bp, Homo sapiens
ggctgggcagccccag

SEQ ID NO: 3377723 - DNA, 13 bp, Homo sapiens
ggctgggcccccc

SEQ ID NO: 3377724 - DNA, 15 bp, Homo sapiens
ggctgggcccctggg

SEQ ID NO: 3377725 - DNA, 16 bp, Homo sapiens
ggctgggctcacaggc

SEQ ID NO: 3377726 - DNA, 20 bp, Homo sapiens
ggctgggctcacaggcctct

SEQ ID NO: 3377727 - DNA, 13 bp, Homo sapiens
ggctgggcttcag

SEQ ID NO: 3377728 - DNA, 18 bp, Homo sapiens
ggctgggcttcagtggca

SEQ ID NO: 3377729 - DNA, 21 bp, Homo sapiens
ggctgggcttcagtggcagct

SEQ ID NO: 3377730 - DNA, 19 bp, Homo sapiens
ggctggggactgctacctc

SEQ ID NO: 3377731 - DNA, 15 bp, Homo sapiens
ggctggggaggacct

SEQ ID NO: 3377732 - DNA, 16 bp, Homo sapiens
ggctggggaggacctg

SEQ ID NO: 3377733 - DNA, 12 bp, Homo sapiens
ggctggggcaga

SEQ ID NO: 3377734 - DNA, 14 bp, Homo sapiens
ggctggggcagagg

SEQ ID NO: 3377735 - DNA, 16 bp, Homo sapiens
ggctggggcagagggg

SEQ ID NO: 3377736 - DNA, 22 bp, Homo sapiens
ggctggggcagaggggcagccg

SEQ ID NO: 3377737 - DNA, 18 bp, Homo sapiens
ggctgggggcaggagggc

SEQ ID NO: 3377738 - DNA, 19 bp, Homo sapiens
ggctgggggcctcagtgcc

SEQ ID NO: 3377739 - DNA, 16 bp, Homo sapiens
ggctgggggtgctgga

SEQ ID NO: 3377740 - DNA, 19 bp, Homo sapiens
ggctgggtcagggccagac

SEQ ID NO: 3377741 - DNA, 22 bp, Homo sapiens
ggctgggtgaccgactacccca

SEQ ID NO: 3377742 - DNA, 20 bp, Homo sapiens
ggctgggtggcacaccaccc

SEQ ID NO: 3377743 - DNA, 19 bp, Homo sapiens
ggctgggtgggcccagaac

SEQ ID NO: 3377744 - DNA, 17 bp, Homo sapiens
ggctggtagctcaggtg

SEQ ID NO: 3377745 - DNA, 23 bp, Homo sapiens
ggctggtccagggctagtgactt

SEQ ID NO: 3377746 - DNA, 16 bp, Homo sapiens
ggctggtccgagctga

SEQ ID NO: 3377747 - DNA, 21 bp, Homo sapiens
ggctggtgccccacagctacc

SEQ ID NO: 3377748 - DNA, 18 bp, Homo sapiens
ggctggtgggaaggccgg

SEQ ID NO: 3377749 - DNA, 13 bp, Homo sapiens
ggctggttttgta

SEQ ID NO: 3377750 - DNA, 23 bp, Homo sapiens
ggctgtatcccatgagcctcagc

SEQ ID NO: 3377751 - DNA, 15 bp, Homo sapiens
ggctgtcaggacacc

SEQ ID NO: 3377752 - DNA, 22 bp, Homo sapiens
ggctgtcctgtacattgtggga

SEQ ID NO: 3377753 - DNA, 15 bp, Homo sapiens
ggctgtctgcctgta

SEQ ID NO: 3377754 - DNA, 13 bp, Homo sapiens
ggctgtgcctctg

SEQ ID NO: 3377755 - DNA, 19 bp, Homo sapiens
ggctgtggaccgtggacag

SEQ ID NO: 3377756 - DNA, 21 bp, Homo sapiens
ggctgtggaccgtggacaggc

SEQ ID NO: 3377757 - DNA, 22 bp, Homo sapiens
ggctgtggaccgtggacaggcc

SEQ ID NO: 3377758 - DNA, 23 bp, Homo sapiens
ggctgtggaccgtggacaggccc

SEQ ID NO: 3377759 - DNA, 21 bp, Homo sapiens
ggctgtggagcaaaaggcagc

SEQ ID NO: 3377760 - DNA, 13 bp, Homo sapiens
ggctgtggaggcc

SEQ ID NO: 3377761 - DNA, 13 bp, Homo sapiens
ggctgtggcacag

SEQ ID NO: 3377762 - DNA, 14 bp, Homo sapiens
ggctgtggcacaga

SEQ ID NO: 3377763 - DNA, 21 bp, Homo sapiens
ggctgtgggcctcaaggactt

SEQ ID NO: 3377764 - DNA, 13 bp, Homo sapiens
ggctgttccttgt

SEQ ID NO: 3377765 - DNA, 15 bp, Homo sapiens
ggctgttctgcactg

SEQ ID NO: 3377766 - DNA, 18 bp, Homo sapiens
ggctgttctgcactgaaa

SEQ ID NO: 3377767 - DNA, 21 bp, Homo sapiens
ggctgttctgtggttcctctg

SEQ ID NO: 3377768 - DNA, 17 bp, Homo sapiens
ggctgttggcactcaca

SEQ ID NO: 3377769 - DNA, 15 bp, Homo sapiens
ggctgttggcagtga

SEQ ID NO: 3377770 - DNA, 16 bp, Homo sapiens
ggctgttggctggggg

SEQ ID NO: 3377771 - DNA, 17 bp, Homo sapiens
ggctgtttagcagaact

SEQ ID NO: 3377772 - DNA, 18 bp, Homo sapiens
ggctgtttcgtgtagtgg

SEQ ID NO: 3377773 - DNA, 15 bp, Homo sapiens
ggcttaagaactgct

SEQ ID NO: 3377774 - DNA, 12 bp, Homo sapiens
ggcttaatgttt

SEQ ID NO: 3377775 - DNA, 14 bp, Homo sapiens
ggcttaatgtttat

SEQ ID NO: 3377776 - DNA, 13 bp, Homo sapiens
ggcttagtgccac

SEQ ID NO: 3377777 - DNA, 15 bp, Homo sapiens
ggcttagtgccaccc

SEQ ID NO: 3377778 - DNA, 22 bp, Homo sapiens
ggcttagtttgtgtgttgtctc

SEQ ID NO: 3377779 - DNA, 18 bp, Homo sapiens
ggcttattttaatgtgat

SEQ ID NO: 3377780 - DNA, 21 bp, Homo sapiens
ggcttattttaatgtgatgat

SEQ ID NO: 3377781 - DNA, 21 bp, Homo sapiens
ggcttcaagttgtaaaaatga

SEQ ID NO: 3377782 - DNA, 15 bp, Homo sapiens
ggcttcatttcaatc

SEQ ID NO: 3377783 - DNA, 21 bp, Homo sapiens
ggcttccagaaaaccccagca

SEQ ID NO: 3377784 - DNA, 17 bp, Homo sapiens
ggcttccaggctcttcc

SEQ ID NO: 3377785 - DNA, 20 bp, Homo sapiens
ggcttcccatagtggggcct

SEQ ID NO: 3377786 - DNA, 18 bp, Homo sapiens
ggcttcccgctcagccct

SEQ ID NO: 3377787 - DNA, 22 bp, Homo sapiens
ggcttcccgctcagccctccct

SEQ ID NO: 3377788 - DNA, 20 bp, Homo sapiens
ggcttcctccgtccacccag

SEQ ID NO: 3377789 - DNA, 23 bp, Homo sapiens
ggcttcctccgtccacccaggct

SEQ ID NO: 3377790 - DNA, 21 bp, Homo sapiens
ggcttcctctagaagccaagg

SEQ ID NO: 3377791 - DNA, 20 bp, Homo sapiens
ggcttcctgcgtcctcctca

SEQ ID NO: 3377792 - DNA, 12 bp, Homo sapiens
ggcttcctgtcc

SEQ ID NO: 3377793 - DNA, 13 bp, Homo sapiens
ggcttcctgtcca

SEQ ID NO: 3377794 - DNA, 14 bp, Homo sapiens
ggcttcctgtccac

SEQ ID NO: 3377795 - DNA, 17 bp, Homo sapiens
ggcttcggacaaaatat

SEQ ID NO: 3377796 - DNA, 21 bp, Homo sapiens
ggcttctccgccagcctcctc

SEQ ID NO: 3377797 - DNA, 14 bp, Homo sapiens
ggcttctcctgttt

SEQ ID NO: 3377798 - DNA, 20 bp, Homo sapiens
ggcttctcctgttttatata

SEQ ID NO: 3377799 - DNA, 14 bp, Homo sapiens
ggcttctgcaccct

SEQ ID NO: 3377800 - DNA, 21 bp, Homo sapiens
ggcttctgcaccctccaccct

SEQ ID NO: 3377801 - DNA, 13 bp, Homo sapiens
ggcttctggagcc

SEQ ID NO: 3377802 - DNA, 18 bp, Homo sapiens
ggcttctggagcccttgg

SEQ ID NO: 3377803 - DNA, 20 bp, Homo sapiens
ggcttctggagcccttgggt

SEQ ID NO: 3377804 - DNA, 18 bp, Homo sapiens
ggcttctgtgatgagctg

SEQ ID NO: 3377805 - DNA, 20 bp, Homo sapiens
ggcttgaagccaaagaaaaa

SEQ ID NO: 3377806 - DNA, 14 bp, Homo sapiens
ggcttgactggatg

SEQ ID NO: 3377807 - DNA, 13 bp, Homo sapiens
ggcttgctccagg

SEQ ID NO: 3377808 - DNA, 15 bp, Homo sapiens
ggcttgctccagggt

SEQ ID NO: 3377809 - DNA, 22 bp, Homo sapiens
ggcttgctccagggtcttgggc

SEQ ID NO: 3377810 - DNA, 18 bp, Homo sapiens
ggcttgcttgccgagcct

SEQ ID NO: 3377811 - DNA, 15 bp, Homo sapiens
ggcttggccttggca

SEQ ID NO: 3377812 - DNA, 22 bp, Homo sapiens
ggcttgggaaaaaaacttggca

SEQ ID NO: 3377813 - DNA, 17 bp, Homo sapiens
ggcttgggatttgctgt

SEQ ID NO: 3377814 - DNA, 12 bp, Homo sapiens
ggcttgtgaact

SEQ ID NO: 3377815 - DNA, 17 bp, Homo sapiens
ggctttaattgtataag

SEQ ID NO: 3377816 - DNA, 23 bp, Homo sapiens
ggctttacctttttgtatgtgaa

SEQ ID NO: 3377817 - DNA, 23 bp, Homo sapiens
ggctttcaaagctaaaatatata

SEQ ID NO: 3377818 - DNA, 24 bp, Homo sapiens
ggctttctccggggtctgtgctgt

SEQ ID NO: 3377819 - DNA, 12 bp, Homo sapiens
ggctttctggag

SEQ ID NO: 3377820 - DNA, 13 bp, Homo sapiens
ggctttctggaga

SEQ ID NO: 3377821 - DNA, 15 bp, Homo sapiens
ggctttgcaggctct

SEQ ID NO: 3377822 - DNA, 13 bp, Homo sapiens
ggctttgccttgc

SEQ ID NO: 3377823 - DNA, 15 bp, Homo sapiens
ggctttgccttgcag

SEQ ID NO: 3377824 - DNA, 15 bp, Homo sapiens
ggctttgtgcttggg

SEQ ID NO: 3377825 - DNA, 18 bp, Homo sapiens
ggcttttaccattagcat

SEQ ID NO: 3377826 - DNA, 23 bp, Homo sapiens
ggcttttaccattagcataattt

SEQ ID NO: 3377827 - DNA, 22 bp, Homo sapiens
ggcttttcactgcctgtagaga

SEQ ID NO: 3377828 - DNA, 22 bp, Homo sapiens
ggcttttcactgctggctgcct

SEQ ID NO: 3377829 - DNA, 16 bp, Homo sapiens
ggctttttcctctgag

SEQ ID NO: 3377830 - DNA, 20 bp, Homo sapiens
ggctttttcctctgagccca

SEQ ID NO: 3377831 - DNA, 21 bp, Homo sapiens
ggctttttcctctgagcccag

SEQ ID NO: 3377832 - DNA, 13 bp, Homo sapiens
gggaaaaaaaaaa

SEQ ID NO: 3377833 - DNA, 16 bp, Homo sapiens
gggaaaaaaaaaaaag

SEQ ID NO: 3377834 - DNA, 21 bp, Homo sapiens
gggaaaaaaaaaaaagaaaag

SEQ ID NO: 3377835 - DNA, 14 bp, Homo sapiens
gggaaacaaagaag

SEQ ID NO: 3377836 - DNA, 18 bp, Homo sapiens
gggaaactaagattcttt

SEQ ID NO: 3377837 - DNA, 12 bp, Homo sapiens
gggaaagaagaa

SEQ ID NO: 3377838 - DNA, 13 bp, Homo sapiens
gggaaagaagaaa

SEQ ID NO: 3377839 - DNA, 11 bp, Homo sapiens
gggaaaggaaa

SEQ ID NO: 3377840 - DNA, 17 bp, Homo sapiens
gggaaaggaaacgcccc

SEQ ID NO: 3377841 - DNA, 16 bp, Homo sapiens
gggaaagggaggaaga

SEQ ID NO: 3377842 - DNA, 20 bp, Homo sapiens
gggaaaggggttggggtgac

SEQ ID NO: 3377843 - DNA, 21 bp, Homo sapiens
gggaacaaaactgttcttttg

SEQ ID NO: 3377844 - DNA, 14 bp, Homo sapiens
gggaacagactgga

SEQ ID NO: 3377845 - DNA, 19 bp, Homo sapiens
gggaaccatgaagacagga

SEQ ID NO: 3377846 - DNA, 14 bp, Homo sapiens
gggaacccccttcc

SEQ ID NO: 3377847 - DNA, 16 bp, Homo sapiens
gggaaccccgcagccc

SEQ ID NO: 3377848 - DNA, 17 bp, Homo sapiens
gggaaccccgcagcccg

SEQ ID NO: 3377849 - DNA, 19 bp, Homo sapiens
gggaacctagtactctctg

SEQ ID NO: 3377850 - DNA, 13 bp, Homo sapiens
gggaacctgtgtc

SEQ ID NO: 3377851 - DNA, 18 bp, Homo sapiens
gggaactccactctcctt

SEQ ID NO: 3377852 - DNA, 19 bp, Homo sapiens
gggaactctgacaagggct

SEQ ID NO: 3377853 - DNA, 15 bp, Homo sapiens
gggaagagggcagta

SEQ ID NO: 3377854 - DNA, 22 bp, Homo sapiens
gggaagataggctctgcacaga

SEQ ID NO: 3377855 - DNA, 17 bp, Homo sapiens
gggaagcagccagctcc

SEQ ID NO: 3377856 - DNA, 13 bp, Homo sapiens
gggaagctgcagc

SEQ ID NO: 3377857 - DNA, 19 bp, Homo sapiens
gggaagctgcagcttggga

SEQ ID NO: 3377858 - DNA, 15 bp, Homo sapiens
gggaagctgccagcc

SEQ ID NO: 3377859 - DNA, 16 bp, Homo sapiens
gggaagctggcctgag

SEQ ID NO: 3377860 - DNA, 22 bp, Homo sapiens
gggaagctgtactcagagcaga

SEQ ID NO: 3377861 - DNA, 13 bp, Homo sapiens
gggaaggacagga

SEQ ID NO: 3377862 - DNA, 13 bp, Homo sapiens
gggaaggagccag

SEQ ID NO: 3377863 - DNA, 15 bp, Homo sapiens
gggaaggcctgactt

SEQ ID NO: 3377864 - DNA, 12 bp, Homo sapiens
gggaagggccag

SEQ ID NO: 3377865 - DNA, 16 bp, Homo sapiens
gggaagggccagtctg

SEQ ID NO: 3377866 - DNA, 16 bp, Homo sapiens
gggaagggtttgaatt

SEQ ID NO: 3377867 - DNA, 21 bp, Homo sapiens
gggaaggtggggccctgcccc

SEQ ID NO: 3377868 - DNA, 12 bp, Homo sapiens
gggaatatttta

SEQ ID NO: 3377869 - DNA, 22 bp, Homo sapiens
gggaatcatttttcactgtaca

SEQ ID NO: 3377870 - DNA, 21 bp, Homo sapiens
gggaatccagctccctagact

SEQ ID NO: 3377871 - DNA, 17 bp, Homo sapiens
gggaatgagcccagaga

SEQ ID NO: 3377872 - DNA, 13 bp, Homo sapiens
gggaatgggagag

SEQ ID NO: 3377873 - DNA, 20 bp, Homo sapiens
gggaatgtattattctgcag

SEQ ID NO: 3377874 - DNA, 21 bp, Homo sapiens
gggaatgtattattctgcagc

SEQ ID NO: 3377875 - DNA, 17 bp, Homo sapiens
gggaatgttccctgcac

SEQ ID NO: 3377876 - DNA, 22 bp, Homo sapiens
gggaatgttccctgcaccctgg

SEQ ID NO: 3377877 - DNA, 23 bp, Homo sapiens
gggaatgttccctgcaccctgga

SEQ ID NO: 3377878 - DNA, 21 bp, Homo sapiens
gggaatgtttgcctctgcctc

SEQ ID NO: 3377879 - DNA, 18 bp, Homo sapiens
gggacaagggattctggg

SEQ ID NO: 3377880 - DNA, 20 bp, Homo sapiens
gggacacaaaactccgcccc

SEQ ID NO: 3377881 - DNA, 17 bp, Homo sapiens
gggacaccagagctgcc

SEQ ID NO: 3377882 - DNA, 16 bp, Homo sapiens
gggacacctgccctgc

SEQ ID NO: 3377883 - DNA, 18 bp, Homo sapiens
gggacagccagagctggg

SEQ ID NO: 3377884 - DNA, 19 bp, Homo sapiens
gggacagcccagagcctgg

SEQ ID NO: 3377885 - DNA, 21 bp, Homo sapiens
gggacagctccttctgtccta

SEQ ID NO: 3377886 - DNA, 13 bp, Homo sapiens
gggacaggcctca

SEQ ID NO: 3377887 - DNA, 17 bp, Homo sapiens
gggacaggcctcacctc

SEQ ID NO: 3377888 - DNA, 12 bp, Homo sapiens
gggacaggctga

SEQ ID NO: 3377889 - DNA, 19 bp, Homo sapiens
gggacaggctgaagagagg

SEQ ID NO: 3377890 - DNA, 15 bp, Homo sapiens
gggacagttggcaga

SEQ ID NO: 3377891 - DNA, 16 bp, Homo sapiens
gggacagttggcagag

SEQ ID NO: 3377892 - DNA, 19 bp, Homo sapiens
gggacagttggcagagaag

SEQ ID NO: 3377893 - DNA, 17 bp, Homo sapiens
gggacatgctcacctct

SEQ ID NO: 3377894 - DNA, 17 bp, Homo sapiens
gggacattgctctctgg

SEQ ID NO: 3377895 - DNA, 16 bp, Homo sapiens
gggaccagagccagat

SEQ ID NO: 3377896 - DNA, 18 bp, Homo sapiens
gggacccacggagccctc

SEQ ID NO: 3377897 - DNA, 21 bp, Homo sapiens
gggacccagctactctgtcca

SEQ ID NO: 3377898 - DNA, 22 bp, Homo sapiens
gggacccaggctccgcccttag

SEQ ID NO: 3377899 - DNA, 20 bp, Homo sapiens
gggacccatagatcttctga

SEQ ID NO: 3377900 - DNA, 22 bp, Homo sapiens
gggaccccaacctcagaggcag

SEQ ID NO: 3377901 - DNA, 20 bp, Homo sapiens
gggaccccactccctgctct

SEQ ID NO: 3377902 - DNA, 20 bp, Homo sapiens
gggaccggtgctgcaggagt

SEQ ID NO: 3377903 - DNA, 17 bp, Homo sapiens
gggactacaggcaccca

SEQ ID NO: 3377904 - DNA, 15 bp, Homo sapiens
gggactagcccctgt

SEQ ID NO: 3377905 - DNA, 16 bp, Homo sapiens
gggactcaatgcactg

SEQ ID NO: 3377906 - DNA, 16 bp, Homo sapiens
gggactcagccctgag

SEQ ID NO: 3377907 - DNA, 15 bp, Homo sapiens
gggactcctggtgcc

SEQ ID NO: 3377908 - DNA, 19 bp, Homo sapiens
gggactctgagcgggaggc

SEQ ID NO: 3377909 - DNA, 23 bp, Homo sapiens
gggactctgagcgggaggcagag

SEQ ID NO: 3377910 - DNA, 20 bp, Homo sapiens
gggactggggatgtgggagg

SEQ ID NO: 3377911 - DNA, 19 bp, Homo sapiens
gggactgttccaaagccag

SEQ ID NO: 3377912 - DNA, 15 bp, Homo sapiens
gggacttggaagctc

SEQ ID NO: 3377913 - DNA, 14 bp, Homo sapiens
gggacttgtgtctg

SEQ ID NO: 3377914 - DNA, 20 bp, Homo sapiens
gggagaaaaagaaacacaag

SEQ ID NO: 3377915 - DNA, 16 bp, Homo sapiens
gggagaagagccctgg

SEQ ID NO: 3377916 - DNA, 18 bp, Homo sapiens
gggagaaggaagggcaga

SEQ ID NO: 3377917 - DNA, 20 bp, Homo sapiens
gggagaaggaagggcagaga

SEQ ID NO: 3377918 - DNA, 14 bp, Homo sapiens
gggagacactggcc

SEQ ID NO: 3377919 - DNA, 21 bp, Homo sapiens
gggagacagcttctctgcagt

SEQ ID NO: 3377920 - DNA, 15 bp, Homo sapiens
gggagacatgtgaca

SEQ ID NO: 3377921 - DNA, 23 bp, Homo sapiens
gggagagagagagagagaggaca

SEQ ID NO: 3377922 - DNA, 16 bp, Homo sapiens
gggagagcaggctggc

SEQ ID NO: 3377923 - DNA, 12 bp, Homo sapiens
gggagagccagc

SEQ ID NO: 3377924 - DNA, 15 bp, Homo sapiens
gggagagccagctcc

SEQ ID NO: 3377925 - DNA, 15 bp, Homo sapiens
gggagagcccctggg

SEQ ID NO: 3377926 - DNA, 13 bp, Homo sapiens
gggagagcctgct

SEQ ID NO: 3377927 - DNA, 22 bp, Homo sapiens
gggagagctgagccagttgtcc

SEQ ID NO: 3377928 - DNA, 18 bp, Homo sapiens
gggagagggtgaaggagg

SEQ ID NO: 3377929 - DNA, 14 bp, Homo sapiens
gggagatggtcagt

SEQ ID NO: 3377930 - DNA, 22 bp, Homo sapiens
gggagatggtcagtgtggagag

SEQ ID NO: 3377931 - DNA, 14 bp, Homo sapiens
gggagcaagacaga

SEQ ID NO: 3377932 - DNA, 12 bp, Homo sapiens
gggagcaagccc

SEQ ID NO: 3377933 - DNA, 12 bp, Homo sapiens
gggagcacccag

SEQ ID NO: 3377934 - DNA, 20 bp, Homo sapiens
gggagcacttgcgtcctgca

SEQ ID NO: 3377935 - DNA, 23 bp, Homo sapiens
gggagcacttgcgtcctgcagag

SEQ ID NO: 3377936 - DNA, 16 bp, Homo sapiens
gggagcagacaggagg

SEQ ID NO: 3377937 - DNA, 12 bp, Homo sapiens
gggagcaggaga

SEQ ID NO: 3377938 - DNA, 18 bp, Homo sapiens
gggagcaggagattgaga

SEQ ID NO: 3377939 - DNA, 15 bp, Homo sapiens
gggagcaggaggcca

SEQ ID NO: 3377940 - DNA, 21 bp, Homo sapiens
gggagcaggttccccaagggc

SEQ ID NO: 3377941 - DNA, 21 bp, Homo sapiens
gggagcatagcagaggggcca

SEQ ID NO: 3377942 - DNA, 22 bp, Homo sapiens
gggagcatagcagaggggccag

SEQ ID NO: 3377943 - DNA, 21 bp, Homo sapiens
gggagcatttaatggcagcta

SEQ ID NO: 3377944 - DNA, 11 bp, Homo sapiens
gggagccagcc

SEQ ID NO: 3377945 - DNA, 13 bp, Homo sapiens
gggagccccaggg

SEQ ID NO: 3377946 - DNA, 16 bp, Homo sapiens
gggagccccagggtct

SEQ ID NO: 3377947 - DNA, 14 bp, Homo sapiens
gggagccctgacct

SEQ ID NO: 3377948 - DNA, 12 bp, Homo sapiens
gggagcctagct

SEQ ID NO: 3377949 - DNA, 21 bp, Homo sapiens
gggagcctagctcctgccaca

SEQ ID NO: 3377950 - DNA, 20 bp, Homo sapiens
gggagcctaggaccactcag

SEQ ID NO: 3377951 - DNA, 20 bp, Homo sapiens
gggagcctccccctcagatg

SEQ ID NO: 3377952 - DNA, 12 bp, Homo sapiens
gggagcctcctg

SEQ ID NO: 3377953 - DNA, 13 bp, Homo sapiens
gggagcctcctgc

SEQ ID NO: 3377954 - DNA, 21 bp, Homo sapiens
gggagcctttggttctggcca

SEQ ID NO: 3377955 - DNA, 16 bp, Homo sapiens
gggagctcctggccag

SEQ ID NO: 3377956 - DNA, 22 bp, Homo sapiens
gggagctgagctggaaggggcc

SEQ ID NO: 3377957 - DNA, 19 bp, Homo sapiens
gggagctggttagaaatgc

SEQ ID NO: 3377958 - DNA, 22 bp, Homo sapiens
gggagcttccgctttgaaagaa

SEQ ID NO: 3377959 - DNA, 12 bp, Homo sapiens
gggaggaaaaaa

SEQ ID NO: 3377960 - DNA, 13 bp, Homo sapiens
gggaggaaaaaag

SEQ ID NO: 3377961 - DNA, 20 bp, Homo sapiens
gggaggacctgaccctactc

SEQ ID NO: 3377962 - DNA, 21 bp, Homo sapiens
gggaggagaggggaagggcca

SEQ ID NO: 3377963 - DNA, 15 bp, Homo sapiens
gggaggagcctgtgc

SEQ ID NO: 3377964 - DNA, 14 bp, Homo sapiens
gggaggagggagag

SEQ ID NO: 3377965 - DNA, 17 bp, Homo sapiens
gggaggagggagaggga

SEQ ID NO: 3377966 - DNA, 18 bp, Homo sapiens
gggaggagggagagggag

SEQ ID NO: 3377967 - DNA, 23 bp, Homo sapiens
gggaggatcactggagcccagga

SEQ ID NO: 3377968 - DNA, 16 bp, Homo sapiens
gggaggcaccagctct

SEQ ID NO: 3377969 - DNA, 13 bp, Homo sapiens
gggaggcagccgg

SEQ ID NO: 3377970 - DNA, 14 bp, Homo sapiens
gggaggccaaggca

SEQ ID NO: 3377971 - DNA, 17 bp, Homo sapiens
gggaggccaaggcaggc

SEQ ID NO: 3377972 - DNA, 19 bp, Homo sapiens
gggaggccaaggcaggtag

SEQ ID NO: 3377973 - DNA, 15 bp, Homo sapiens
gggaggccccagctc

SEQ ID NO: 3377974 - DNA, 15 bp, Homo sapiens
gggaggccccttctc

SEQ ID NO: 3377975 - DNA, 12 bp, Homo sapiens
gggaggccctgg

SEQ ID NO: 3377976 - DNA, 15 bp, Homo sapiens
gggaggccgaggcgg

SEQ ID NO: 3377977 - DNA, 16 bp, Homo sapiens
gggagggaagtgtgag

SEQ ID NO: 3377978 - DNA, 22 bp, Homo sapiens
gggagggaagtgtgagcgcctt

SEQ ID NO: 3377979 - DNA, 17 bp, Homo sapiens
gggagggagggcggtgg

SEQ ID NO: 3377980 - DNA, 12 bp, Homo sapiens
gggaggggaggc

SEQ ID NO: 3377981 - DNA, 17 bp, Homo sapiens
gggaggggcaggctgac

SEQ ID NO: 3377982 - DNA, 20 bp, Homo sapiens
gggaggggcgctggcccagc

SEQ ID NO: 3377983 - DNA, 21 bp, Homo sapiens
gggaggggcgctggcccagcc

SEQ ID NO: 3377984 - DNA, 13 bp, Homo sapiens
gggagggggaggg

SEQ ID NO: 3377985 - DNA, 17 bp, Homo sapiens
gggaggtcaggccctgg

SEQ ID NO: 3377986 - DNA, 22 bp, Homo sapiens
gggaggtcaggccctggaactc

SEQ ID NO: 3377987 - DNA, 16 bp, Homo sapiens
gggaggtgaccccagg

SEQ ID NO: 3377988 - DNA, 23 bp, Homo sapiens
gggaggtggaagaagggagaaga

SEQ ID NO: 3377989 - DNA, 20 bp, Homo sapiens
gggaggtgtttaaagagagg

SEQ ID NO: 3377990 - DNA, 21 bp, Homo sapiens
gggaggttttattctgacttc

SEQ ID NO: 3377991 - DNA, 21 bp, Homo sapiens
gggagtcagagccctggctgg

SEQ ID NO: 3377992 - DNA, 22 bp, Homo sapiens
gggagtcagagccctggctggg

SEQ ID NO: 3377993 - DNA, 11 bp, Homo sapiens
gggagtgagct

SEQ ID NO: 3377994 - DNA, 12 bp, Homo sapiens
gggagtgggcac

SEQ ID NO: 3377995 - DNA, 20 bp, Homo sapiens
gggagtgggcacctcagaaa

SEQ ID NO: 3377996 - DNA, 20 bp, Homo sapiens
gggagttgagtcacaagagg

SEQ ID NO: 3377997 - DNA, 21 bp, Homo sapiens
gggagtttctttcctgccttc

SEQ ID NO: 3377998 - DNA, 16 bp, Homo sapiens
gggataactgatttct

SEQ ID NO: 3377999 - DNA, 13 bp, Homo sapiens
gggatacttagtg

SEQ ID NO: 3378000 - DNA, 20 bp, Homo sapiens
gggataggagaagaggcatc

SEQ ID NO: 3378001 - DNA, 16 bp, Homo sapiens
gggatataggagagga

SEQ ID NO: 3378002 - DNA, 15 bp, Homo sapiens
gggatatttttttct

SEQ ID NO: 3378003 - DNA, 14 bp, Homo sapiens
gggatcagagcagg

SEQ ID NO: 3378004 - DNA, 15 bp, Homo sapiens
gggatccagccactt

SEQ ID NO: 3378005 - DNA, 14 bp, Homo sapiens
gggatcccaccctg

SEQ ID NO: 3378006 - DNA, 19 bp, Homo sapiens
gggatccccgcctggccag

SEQ ID NO: 3378007 - DNA, 22 bp, Homo sapiens
gggatccccgcctggccaggag

SEQ ID NO: 3378008 - DNA, 23 bp, Homo sapiens
gggatccccgcctggccaggagc

SEQ ID NO: 3378009 - DNA, 14 bp, Homo sapiens
gggatcctgcctgc

SEQ ID NO: 3378010 - DNA, 18 bp, Homo sapiens
gggatctctctacaagag

SEQ ID NO: 3378011 - DNA, 19 bp, Homo sapiens
gggatgactaaaatattta

SEQ ID NO: 3378012 - DNA, 22 bp, Homo sapiens
gggatgaggtcaccaggggagg

SEQ ID NO: 3378013 - DNA, 15 bp, Homo sapiens
gggatgcccagaaga

SEQ ID NO: 3378014 - DNA, 12 bp, Homo sapiens
gggatgctgctc

SEQ ID NO: 3378015 - DNA, 15 bp, Homo sapiens
gggatggggcctccc

SEQ ID NO: 3378016 - DNA, 15 bp, Homo sapiens
gggatggtccaggat

SEQ ID NO: 3378017 - DNA, 18 bp, Homo sapiens
gggatgtgagccccaggg

SEQ ID NO: 3378018 - DNA, 22 bp, Homo sapiens
gggatgttcagcactgtccctt

SEQ ID NO: 3378019 - DNA, 16 bp, Homo sapiens
gggattaacctctgca

SEQ ID NO: 3378020 - DNA, 16 bp, Homo sapiens
gggattcaggctgctt

SEQ ID NO: 3378021 - DNA, 13 bp, Homo sapiens
gggattcctgacc

SEQ ID NO: 3378022 - DNA, 20 bp, Homo sapiens
gggatttaatttccagggtt

SEQ ID NO: 3378023 - DNA, 18 bp, Homo sapiens
gggatttcttcgctgctc

SEQ ID NO: 3378024 - DNA, 22 bp, Homo sapiens
gggcaaatgacatgcactgacc

SEQ ID NO: 3378025 - DNA, 16 bp, Homo sapiens
gggcaacccccagcct

SEQ ID NO: 3378026 - DNA, 20 bp, Homo sapiens
gggcaacccccagcctgcta

SEQ ID NO: 3378027 - DNA, 14 bp, Homo sapiens
gggcaacgaagaaa

SEQ ID NO: 3378028 - DNA, 17 bp, Homo sapiens
gggcaacgaagaaaaaa

SEQ ID NO: 3378029 - DNA, 23 bp, Homo sapiens
gggcaagctaggccccagaggcc

SEQ ID NO: 3378030 - DNA, 21 bp, Homo sapiens
gggcacaactgcaataacttc

SEQ ID NO: 3378031 - DNA, 14 bp, Homo sapiens
gggcacaccactgc

SEQ ID NO: 3378032 - DNA, 13 bp, Homo sapiens
gggcacagccctc

SEQ ID NO: 3378033 - DNA, 9 bp, Homo sapiens
gggcacagg

SEQ ID NO: 3378034 - DNA, 13 bp, Homo sapiens
gggcacagggcac

SEQ ID NO: 3378035 - DNA, 22 bp, Homo sapiens
gggcacagggcaccagaggccg

SEQ ID NO: 3378036 - DNA, 23 bp, Homo sapiens
gggcacatgctgagtctcccaag

SEQ ID NO: 3378037 - DNA, 17 bp, Homo sapiens
gggcaccacaaaatata

SEQ ID NO: 3378038 - DNA, 22 bp, Homo sapiens
gggcaccacaaaatatacaaaa

SEQ ID NO: 3378039 - DNA, 15 bp, Homo sapiens
gggcaccagaggccg

SEQ ID NO: 3378040 - DNA, 18 bp, Homo sapiens
gggcaccccagcctgaag

SEQ ID NO: 3378041 - DNA, 20 bp, Homo sapiens
gggcactcagaagacactga

SEQ ID NO: 3378042 - DNA, 12 bp, Homo sapiens
gggcactcagcc

SEQ ID NO: 3378043 - DNA, 14 bp, Homo sapiens
gggcactcagccac

SEQ ID NO: 3378044 - DNA, 13 bp, Homo sapiens
gggcactggccca

SEQ ID NO: 3378045 - DNA, 22 bp, Homo sapiens
gggcacttaatttgtaaacttc

SEQ ID NO: 3378046 - DNA, 22 bp, Homo sapiens
gggcactttttaattcaccaaa

SEQ ID NO: 3378047 - DNA, 18 bp, Homo sapiens
gggcagactgtgaacttg

SEQ ID NO: 3378048 - DNA, 14 bp, Homo sapiens
gggcagagccatgg

SEQ ID NO: 3378049 - DNA, 15 bp, Homo sapiens
gggcagagccatggg

SEQ ID NO: 3378050 - DNA, 17 bp, Homo sapiens
gggcagagccatgggcc

SEQ ID NO: 3378051 - DNA, 18 bp, Homo sapiens
gggcagagccatgggcct

SEQ ID NO: 3378052 - DNA, 11 bp, Homo sapiens
gggcagagctg

SEQ ID NO: 3378053 - DNA, 22 bp, Homo sapiens
gggcagagggaatgttccctgc

SEQ ID NO: 3378054 - DNA, 16 bp, Homo sapiens
gggcagagggctggag

SEQ ID NO: 3378055 - DNA, 23 bp, Homo sapiens
gggcagaggtggcgcccaggggc

SEQ ID NO: 3378056 - DNA, 21 bp, Homo sapiens
gggcagatccccactgtccta

SEQ ID NO: 3378057 - DNA, 15 bp, Homo sapiens
gggcagcaccctccc

SEQ ID NO: 3378058 - DNA, 17 bp, Homo sapiens
gggcagcaccctccccc

SEQ ID NO: 3378059 - DNA, 14 bp, Homo sapiens
gggcagcactcccc

SEQ ID NO: 3378060 - DNA, 16 bp, Homo sapiens
gggcagcactccccag

SEQ ID NO: 3378061 - DNA, 15 bp, Homo sapiens
gggcagccacccaag

SEQ ID NO: 3378062 - DNA, 23 bp, Homo sapiens
gggcagccacccaagcctgctgg

SEQ ID NO: 3378063 - DNA, 11 bp, Homo sapiens
gggcagccagc

SEQ ID NO: 3378064 - DNA, 14 bp, Homo sapiens
gggcagccaggctg

SEQ ID NO: 3378065 - DNA, 13 bp, Homo sapiens
gggcagccccaga

SEQ ID NO: 3378066 - DNA, 19 bp, Homo sapiens
gggcagcccttgcttgttg

SEQ ID NO: 3378067 - DNA, 17 bp, Homo sapiens
gggcagccgctaggaga

SEQ ID NO: 3378068 - DNA, 22 bp, Homo sapiens
gggcagccgctaggagagactg

SEQ ID NO: 3378069 - DNA, 14 bp, Homo sapiens
gggcagcctttcca

SEQ ID NO: 3378070 - DNA, 14 bp, Homo sapiens
gggcagcgggccag

SEQ ID NO: 3378071 - DNA, 16 bp, Homo sapiens
gggcagcgggccaggc

SEQ ID NO: 3378072 - DNA, 13 bp, Homo sapiens
gggcagctgggcc

SEQ ID NO: 3378073 - DNA, 12 bp, Homo sapiens
gggcaggcctgg

SEQ ID NO: 3378074 - DNA, 14 bp, Homo sapiens
gggcaggcctggga

SEQ ID NO: 3378075 - DNA, 21 bp, Homo sapiens
gggcaggcctgggacccagct

SEQ ID NO: 3378076 - DNA, 12 bp, Homo sapiens
gggcaggcggtc

SEQ ID NO: 3378077 - DNA, 22 bp, Homo sapiens
gggcaggcgtgactcagcagcc

SEQ ID NO: 3378078 - DNA, 13 bp, Homo sapiens
gggcaggctgaca

SEQ ID NO: 3378079 - DNA, 14 bp, Homo sapiens
gggcaggctgggcc

SEQ ID NO: 3378080 - DNA, 22 bp, Homo sapiens
gggcagggaaggacaggaccct

SEQ ID NO: 3378081 - DNA, 16 bp, Homo sapiens
gggcagggagtgatga

SEQ ID NO: 3378082 - DNA, 11 bp, Homo sapiens
gggcagggcca

SEQ ID NO: 3378083 - DNA, 21 bp, Homo sapiens
gggcagggccaccccactcta

SEQ ID NO: 3378084 - DNA, 16 bp, Homo sapiens
gggcagggcccacgtg

SEQ ID NO: 3378085 - DNA, 22 bp, Homo sapiens
gggcaggtggtggcactgagcc

SEQ ID NO: 3378086 - DNA, 19 bp, Homo sapiens
gggcagtgctagtgagctg

SEQ ID NO: 3378087 - DNA, 21 bp, Homo sapiens
gggcagttcgggaaccccctt

SEQ ID NO: 3378088 - DNA, 16 bp, Homo sapiens
gggcagttctcactcc

SEQ ID NO: 3378089 - DNA, 17 bp, Homo sapiens
gggcagttgggtagatg

SEQ ID NO: 3378090 - DNA, 17 bp, Homo sapiens
gggcatatccaccacct

SEQ ID NO: 3378091 - DNA, 17 bp, Homo sapiens
gggcatcaggcactggt

SEQ ID NO: 3378092 - DNA, 22 bp, Homo sapiens
gggcatccacccagtgctgcca

SEQ ID NO: 3378093 - DNA, 19 bp, Homo sapiens
gggcatccataccagctcg

SEQ ID NO: 3378094 - DNA, 17 bp, Homo sapiens
gggcatctgcccctccc

SEQ ID NO: 3378095 - DNA, 20 bp, Homo sapiens
gggcatctgcccctccccca

SEQ ID NO: 3378096 - DNA, 22 bp, Homo sapiens
gggcatgccccggccacctctg

SEQ ID NO: 3378097 - DNA, 17 bp, Homo sapiens
gggcatggccaggtggc

SEQ ID NO: 3378098 - DNA, 20 bp, Homo sapiens
gggcatggccaggtggccac

SEQ ID NO: 3378099 - DNA, 16 bp, Homo sapiens
gggcatgtgtgcctgt

SEQ ID NO: 3378100 - DNA, 20 bp, Homo sapiens
gggcatgtgtgcctgtggca

SEQ ID NO: 3378101 - DNA, 23 bp, Homo sapiens
gggcatgtgtgcctgtggcagaa

SEQ ID NO: 3378102 - DNA, 23 bp, Homo sapiens
gggcattgggctgacacctacca

SEQ ID NO: 3378103 - DNA, 17 bp, Homo sapiens
gggccaagacttggcaa

SEQ ID NO: 3378104 - DNA, 16 bp, Homo sapiens
gggccacagagaaagt

SEQ ID NO: 3378105 - DNA, 22 bp, Homo sapiens
gggccacagggcggtgctagct

SEQ ID NO: 3378106 - DNA, 16 bp, Homo sapiens
gggccaccaaagctgc

SEQ ID NO: 3378107 - DNA, 19 bp, Homo sapiens
gggccaccaaagctgccca

SEQ ID NO: 3378108 - DNA, 17 bp, Homo sapiens
gggccaccccactctac

SEQ ID NO: 3378109 - DNA, 16 bp, Homo sapiens
gggccacgccccagcc

SEQ ID NO: 3378110 - DNA, 18 bp, Homo sapiens
gggccacgccccagcccg

SEQ ID NO: 3378111 - DNA, 21 bp, Homo sapiens
gggccacgccccagcccgaca

SEQ ID NO: 3378112 - DNA, 22 bp, Homo sapiens
gggccacgccccagcccgacaa

SEQ ID NO: 3378113 - DNA, 24 bp, Homo sapiens
gggccacggaggagggatgctgct

SEQ ID NO: 3378114 - DNA, 13 bp, Homo sapiens
gggccactgggga

SEQ ID NO: 3378115 - DNA, 20 bp, Homo sapiens
gggccactgtggtggcagtg

SEQ ID NO: 3378116 - DNA, 19 bp, Homo sapiens
gggccagaaggagggcaga

SEQ ID NO: 3378117 - DNA, 22 bp, Homo sapiens
gggccagaggaactgtccagag

SEQ ID NO: 3378118 - DNA, 11 bp, Homo sapiens
gggccagaggg

SEQ ID NO: 3378119 - DNA, 14 bp, Homo sapiens
gggccagagggagc

SEQ ID NO: 3378120 - DNA, 13 bp, Homo sapiens
gggccagccaggc

SEQ ID NO: 3378121 - DNA, 17 bp, Homo sapiens
gggccagccaggcgggc

SEQ ID NO: 3378122 - DNA, 22 bp, Homo sapiens
gggccagccccacccccagcca

SEQ ID NO: 3378123 - DNA, 19 bp, Homo sapiens
gggccagcctagcccttgt

SEQ ID NO: 3378124 - DNA, 12 bp, Homo sapiens
gggccaggcagg

SEQ ID NO: 3378125 - DNA, 23 bp, Homo sapiens
gggccaggcaggtgcctggacat

SEQ ID NO: 3378126 - DNA, 17 bp, Homo sapiens
gggccaggccaggacca

SEQ ID NO: 3378127 - DNA, 18 bp, Homo sapiens
gggccaggccaggaccac

SEQ ID NO: 3378128 - DNA, 12 bp, Homo sapiens
gggccaggccca

SEQ ID NO: 3378129 - DNA, 13 bp, Homo sapiens
gggccaggcccag

SEQ ID NO: 3378130 - DNA, 17 bp, Homo sapiens
gggccaggcccaggcag

SEQ ID NO: 3378131 - DNA, 18 bp, Homo sapiens
gggccaggcccaggcaga

SEQ ID NO: 3378132 - DNA, 13 bp, Homo sapiens
gggccagggccct

SEQ ID NO: 3378133 - DNA, 13 bp, Homo sapiens
gggccagggctgc

SEQ ID NO: 3378134 - DNA, 21 bp, Homo sapiens
gggccagggctgccctgagaa

SEQ ID NO: 3378135 - DNA, 13 bp, Homo sapiens
gggccagtcctcc

SEQ ID NO: 3378136 - DNA, 20 bp, Homo sapiens
gggccagtcctgcctggcca

SEQ ID NO: 3378137 - DNA, 16 bp, Homo sapiens
gggccagtctgggctg

SEQ ID NO: 3378138 - DNA, 20 bp, Homo sapiens
gggccagtctgggctgccgg

SEQ ID NO: 3378139 - DNA, 15 bp, Homo sapiens
gggccagtggggcct

SEQ ID NO: 3378140 - DNA, 20 bp, Homo sapiens
gggccagtggggcctgtgga

SEQ ID NO: 3378141 - DNA, 20 bp, Homo sapiens
gggccataaacggttcctgg

SEQ ID NO: 3378142 - DNA, 22 bp, Homo sapiens
gggccatcacaggatgccagcc

SEQ ID NO: 3378143 - DNA, 23 bp, Homo sapiens
gggccatcacaggatgccagccc

SEQ ID NO: 3378144 - DNA, 17 bp, Homo sapiens
gggccatctgactgcca

SEQ ID NO: 3378145 - DNA, 22 bp, Homo sapiens
gggccatctgactgccaagcca

SEQ ID NO: 3378146 - DNA, 23 bp, Homo sapiens
gggccatgctgaggcctgggccg

SEQ ID NO: 3378147 - DNA, 15 bp, Homo sapiens
gggccatgtccaaag

SEQ ID NO: 3378148 - DNA, 23 bp, Homo sapiens
gggccatgtccaaagaggctgcc

SEQ ID NO: 3378149 - DNA, 16 bp, Homo sapiens
gggcccaagccccatc

SEQ ID NO: 3378150 - DNA, 15 bp, Homo sapiens
gggcccacctggcca

SEQ ID NO: 3378151 - DNA, 18 bp, Homo sapiens
gggcccacctggccacct

SEQ ID NO: 3378152 - DNA, 19 bp, Homo sapiens
gggcccacgtggttggggc

SEQ ID NO: 3378153 - DNA, 22 bp, Homo sapiens
gggcccagaactgcccccactg

SEQ ID NO: 3378154 - DNA, 22 bp, Homo sapiens
gggcccagctgtagccatggct

SEQ ID NO: 3378155 - DNA, 20 bp, Homo sapiens
gggcccaggaagcccacact

SEQ ID NO: 3378156 - DNA, 19 bp, Homo sapiens
gggcccaggaccagctggg

SEQ ID NO: 3378157 - DNA, 13 bp, Homo sapiens
gggcccaggaggg

SEQ ID NO: 3378158 - DNA, 13 bp, Homo sapiens
gggccccacctac

SEQ ID NO: 3378159 - DNA, 18 bp, Homo sapiens
gggccccagaaggcaggg

SEQ ID NO: 3378160 - DNA, 12 bp, Homo sapiens
gggccccagacc

SEQ ID NO: 3378161 - DNA, 21 bp, Homo sapiens
gggccccagaccccagggcag

SEQ ID NO: 3378162 - DNA, 23 bp, Homo sapiens
gggccccagatctgcctgggcct

SEQ ID NO: 3378163 - DNA, 20 bp, Homo sapiens
gggccccatgctctgcccca

SEQ ID NO: 3378164 - DNA, 18 bp, Homo sapiens
gggccccgccagggctgg

SEQ ID NO: 3378165 - DNA, 14 bp, Homo sapiens
gggccccggggctg

SEQ ID NO: 3378166 - DNA, 18 bp, Homo sapiens
gggccccggggctggcaa

SEQ ID NO: 3378167 - DNA, 21 bp, Homo sapiens
gggccccggggctggcaagca

SEQ ID NO: 3378168 - DNA, 17 bp, Homo sapiens
gggcccctcaccctgcc

SEQ ID NO: 3378169 - DNA, 19 bp, Homo sapiens
gggcccctcaccctgcctt

SEQ ID NO: 3378170 - DNA, 12 bp, Homo sapiens
gggcccctccac

SEQ ID NO: 3378171 - DNA, 14 bp, Homo sapiens
gggcccctccatcc

SEQ ID NO: 3378172 - DNA, 19 bp, Homo sapiens
gggcccctccctctgcccc

SEQ ID NO: 3378173 - DNA, 19 bp, Homo sapiens
gggcccgcagtgctgggac

SEQ ID NO: 3378174 - DNA, 22 bp, Homo sapiens
gggcccgcagtgctgggaccag

SEQ ID NO: 3378175 - DNA, 14 bp, Homo sapiens
gggcccgcggggca

SEQ ID NO: 3378176 - DNA, 23 bp, Homo sapiens
gggccctccgacagccccctctg

SEQ ID NO: 3378177 - DNA, 21 bp, Homo sapiens
gggccctctctctgggcccag

SEQ ID NO: 3378178 - DNA, 18 bp, Homo sapiens
gggccctctttccctgcg

SEQ ID NO: 3378179 - DNA, 19 bp, Homo sapiens
gggccctgcacctgtgcag

SEQ ID NO: 3378180 - DNA, 15 bp, Homo sapiens
gggccctgcagaggg

SEQ ID NO: 3378181 - DNA, 19 bp, Homo sapiens
gggccctgccctggcaggg

SEQ ID NO: 3378182 - DNA, 11 bp, Homo sapiens
gggccctgggc

SEQ ID NO: 3378183 - DNA, 14 bp, Homo sapiens
gggccctgggcctc

SEQ ID NO: 3378184 - DNA, 15 bp, Homo sapiens
gggccctgggcctca

SEQ ID NO: 3378185 - DNA, 18 bp, Homo sapiens
gggccctgggcctcagtt

SEQ ID NO: 3378186 - DNA, 13 bp, Homo sapiens
gggccctgggctg

SEQ ID NO: 3378187 - DNA, 14 bp, Homo sapiens
gggccctgggctgg

SEQ ID NO: 3378188 - DNA, 16 bp, Homo sapiens
gggcccttggggcctg

SEQ ID NO: 3378189 - DNA, 18 bp, Homo sapiens
gggcccttggggcctggc

SEQ ID NO: 3378190 - DNA, 17 bp, Homo sapiens
gggcccttggggctggg

SEQ ID NO: 3378191 - DNA, 20 bp, Homo sapiens
gggccgaggaggtgcctgga

SEQ ID NO: 3378192 - DNA, 14 bp, Homo sapiens
gggccgaggcccag

SEQ ID NO: 3378193 - DNA, 21 bp, Homo sapiens
gggccgggcaggtcctgccca

SEQ ID NO: 3378194 - DNA, 19 bp, Homo sapiens
gggccggggaagctgccag

SEQ ID NO: 3378195 - DNA, 23 bp, Homo sapiens
gggccggggaagctgccagccca

SEQ ID NO: 3378196 - DNA, 22 bp, Homo sapiens
gggccggtagaggctccccagg

SEQ ID NO: 3378197 - DNA, 16 bp, Homo sapiens
gggccgtaccccaccc

SEQ ID NO: 3378198 - DNA, 18 bp, Homo sapiens
gggccgtaccccaccctc

SEQ ID NO: 3378199 - DNA, 17 bp, Homo sapiens
gggcctactagagtctg

SEQ ID NO: 3378200 - DNA, 20 bp, Homo sapiens
gggcctagcgatctctcctg

SEQ ID NO: 3378201 - DNA, 23 bp, Homo sapiens
gggcctagcgatctctcctggcc

SEQ ID NO: 3378202 - DNA, 20 bp, Homo sapiens
gggcctcaccgagtgggggc

SEQ ID NO: 3378203 - DNA, 15 bp, Homo sapiens
gggcctcaggctctg

SEQ ID NO: 3378204 - DNA, 14 bp, Homo sapiens
gggcctcagtgcca

SEQ ID NO: 3378205 - DNA, 12 bp, Homo sapiens
gggcctcatcac

SEQ ID NO: 3378206 - DNA, 14 bp, Homo sapiens
gggcctccagaact

SEQ ID NO: 3378207 - DNA, 23 bp, Homo sapiens
gggcctcccataattgctttgcc

SEQ ID NO: 3378208 - DNA, 19 bp, Homo sapiens
gggcctcccctccatgggc

SEQ ID NO: 3378209 - DNA, 18 bp, Homo sapiens
gggcctccctccttgggt

SEQ ID NO: 3378210 - DNA, 13 bp, Homo sapiens
gggcctcctccta

SEQ ID NO: 3378211 - DNA, 22 bp, Homo sapiens
gggcctccttcccatgcctgtc

SEQ ID NO: 3378212 - DNA, 14 bp, Homo sapiens
gggcctgagagaat

SEQ ID NO: 3378213 - DNA, 12 bp, Homo sapiens
gggcctgcccaa

SEQ ID NO: 3378214 - DNA, 21 bp, Homo sapiens
gggcctggagatcctcctgca

SEQ ID NO: 3378215 - DNA, 10 bp, Homo sapiens
gggcctggca

SEQ ID NO: 3378216 - DNA, 18 bp, Homo sapiens
gggcctggcccaaagcag

SEQ ID NO: 3378217 - DNA, 13 bp, Homo sapiens
gggcctggcctga

SEQ ID NO: 3378218 - DNA, 19 bp, Homo sapiens
gggcctggcctgagctggg

SEQ ID NO: 3378219 - DNA, 22 bp, Homo sapiens
gggcctgggagggttcccctgg

SEQ ID NO: 3378220 - DNA, 15 bp, Homo sapiens
gggcctgggcctctg

SEQ ID NO: 3378221 - DNA, 13 bp, Homo sapiens
gggcctggggcct

SEQ ID NO: 3378222 - DNA, 16 bp, Homo sapiens
gggcctggggcctgag

SEQ ID NO: 3378223 - DNA, 17 bp, Homo sapiens
gggcctggggcctgaga

SEQ ID NO: 3378224 - DNA, 19 bp, Homo sapiens
gggcctggggcctgagaga

SEQ ID NO: 3378225 - DNA, 13 bp, Homo sapiens
gggcctggggtgc

SEQ ID NO: 3378226 - DNA, 20 bp, Homo sapiens
gggcctgtcgtgccagtcct

SEQ ID NO: 3378227 - DNA, 12 bp, Homo sapiens
gggcctgtgcag

SEQ ID NO: 3378228 - DNA, 18 bp, Homo sapiens
gggcctgtgcagcagccc

SEQ ID NO: 3378229 - DNA, 17 bp, Homo sapiens
gggccttagggcactgg

SEQ ID NO: 3378230 - DNA, 17 bp, Homo sapiens
gggccttagtgggccag

SEQ ID NO: 3378231 - DNA, 23 bp, Homo sapiens
gggccttgctacctcaaggggga

SEQ ID NO: 3378232 - DNA, 19 bp, Homo sapiens
gggcgaagcccaggcccct

SEQ ID NO: 3378233 - DNA, 15 bp, Homo sapiens
gggcgatgctccctc

SEQ ID NO: 3378234 - DNA, 13 bp, Homo sapiens
gggcgcaggccca

SEQ ID NO: 3378235 - DNA, 14 bp, Homo sapiens
gggcgcaggcccag

SEQ ID NO: 3378236 - DNA, 15 bp, Homo sapiens
gggcgcaggcccagt

SEQ ID NO: 3378237 - DNA, 12 bp, Homo sapiens
gggcgcctggag

SEQ ID NO: 3378238 - DNA, 13 bp, Homo sapiens
gggcgcctggaga

SEQ ID NO: 3378239 - DNA, 13 bp, Homo sapiens
gggcgctcagacg

SEQ ID NO: 3378240 - DNA, 20 bp, Homo sapiens
gggcgctcagacggcggcca

SEQ ID NO: 3378241 - DNA, 12 bp, Homo sapiens
gggcgctggccc

SEQ ID NO: 3378242 - DNA, 16 bp, Homo sapiens
gggcgctggcccagcc

SEQ ID NO: 3378243 - DNA, 17 bp, Homo sapiens
gggcgctggcccagccg

SEQ ID NO: 3378244 - DNA, 15 bp, Homo sapiens
gggcggcaggaggga

SEQ ID NO: 3378245 - DNA, 17 bp, Homo sapiens
gggctaacgggaggctg

SEQ ID NO: 3378246 - DNA, 19 bp, Homo sapiens
gggctaacgggaggctggg

SEQ ID NO: 3378247 - DNA, 13 bp, Homo sapiens
gggctaaggcccc

SEQ ID NO: 3378248 - DNA, 19 bp, Homo sapiens
gggctaccctaaagggaga

SEQ ID NO: 3378249 - DNA, 16 bp, Homo sapiens
gggctactggcagctc

SEQ ID NO: 3378250 - DNA, 21 bp, Homo sapiens
gggctagtgtgagtggcagcc

SEQ ID NO: 3378251 - DNA, 18 bp, Homo sapiens
gggctagttgggcttcct

SEQ ID NO: 3378252 - DNA, 15 bp, Homo sapiens
gggctatggcaaggg

SEQ ID NO: 3378253 - DNA, 16 bp, Homo sapiens
gggctatggcaagggg

SEQ ID NO: 3378254 - DNA, 22 bp, Homo sapiens
gggctatttctctccccactga

SEQ ID NO: 3378255 - DNA, 14 bp, Homo sapiens
gggctcacacacct

SEQ ID NO: 3378256 - DNA, 15 bp, Homo sapiens
gggctcacggggcct

SEQ ID NO: 3378257 - DNA, 17 bp, Homo sapiens
gggctcagcggggacag

SEQ ID NO: 3378258 - DNA, 18 bp, Homo sapiens
gggctccagcaccttctt

SEQ ID NO: 3378259 - DNA, 21 bp, Homo sapiens
gggctccagcatccagcctgt

SEQ ID NO: 3378260 - DNA, 22 bp, Homo sapiens
gggctccagcatccagcctgtg

SEQ ID NO: 3378261 - DNA, 23 bp, Homo sapiens
gggctccagcatccagcctgtgt

SEQ ID NO: 3378262 - DNA, 11 bp, Homo sapiens
gggctccaggc

SEQ ID NO: 3378263 - DNA, 16 bp, Homo sapiens
gggctccaggctggct

SEQ ID NO: 3378264 - DNA, 11 bp, Homo sapiens
gggctcccagg

SEQ ID NO: 3378265 - DNA, 14 bp, Homo sapiens
gggctcccaggggt

SEQ ID NO: 3378266 - DNA, 10 bp, Homo sapiens
gggctccccg

SEQ ID NO: 3378267 - DNA, 13 bp, Homo sapiens
gggctccctctct

SEQ ID NO: 3378268 - DNA, 15 bp, Homo sapiens
gggctccctctctgg

SEQ ID NO: 3378269 - DNA, 14 bp, Homo sapiens
gggctccctggcag

SEQ ID NO: 3378270 - DNA, 14 bp, Homo sapiens
gggctcctcccagc

SEQ ID NO: 3378271 - DNA, 18 bp, Homo sapiens
gggctcctgcacttactt

SEQ ID NO: 3378272 - DNA, 18 bp, Homo sapiens
gggctcctgccttctgtc

SEQ ID NO: 3378273 - DNA, 12 bp, Homo sapiens
gggctcctggaa

SEQ ID NO: 3378274 - DNA, 14 bp, Homo sapiens
gggctcctggctgc

SEQ ID NO: 3378275 - DNA, 15 bp, Homo sapiens
gggctcctggctgcc

SEQ ID NO: 3378276 - DNA, 14 bp, Homo sapiens
gggctcgaggctgg

SEQ ID NO: 3378277 - DNA, 15 bp, Homo sapiens
gggctcgaggctggt

SEQ ID NO: 3378278 - DNA, 20 bp, Homo sapiens
gggctcgaggggtgggctgg

SEQ ID NO: 3378279 - DNA, 17 bp, Homo sapiens
gggctctcaaagtataa

SEQ ID NO: 3378280 - DNA, 13 bp, Homo sapiens
gggctctcagctc

SEQ ID NO: 3378281 - DNA, 19 bp, Homo sapiens
gggctctccaaaggggctg

SEQ ID NO: 3378282 - DNA, 13 bp, Homo sapiens
gggctctctgaga

SEQ ID NO: 3378283 - DNA, 23 bp, Homo sapiens
gggctctgcaattcccctctgct

SEQ ID NO: 3378284 - DNA, 11 bp, Homo sapiens
gggctctgccc

SEQ ID NO: 3378285 - DNA, 14 bp, Homo sapiens
gggctctgccccag

SEQ ID NO: 3378286 - DNA, 21 bp, Homo sapiens
gggctctgccctccctccttc

SEQ ID NO: 3378287 - DNA, 22 bp, Homo sapiens
gggctctttctctctgctgagc

SEQ ID NO: 3378288 - DNA, 21 bp, Homo sapiens
gggctgacacctaccatgctg

SEQ ID NO: 3378289 - DNA, 21 bp, Homo sapiens
gggctgacccagcatctccca

SEQ ID NO: 3378290 - DNA, 20 bp, Homo sapiens
gggctgactagaagggccag

SEQ ID NO: 3378291 - DNA, 22 bp, Homo sapiens
gggctgactctccagggagctg

SEQ ID NO: 3378292 - DNA, 13 bp, Homo sapiens
gggctgagccctg

SEQ ID NO: 3378293 - DNA, 15 bp, Homo sapiens
gggctgagccctggc

SEQ ID NO: 3378294 - DNA, 16 bp, Homo sapiens
gggctgagctgcctgt

SEQ ID NO: 3378295 - DNA, 17 bp, Homo sapiens
gggctgatttacatgta

SEQ ID NO: 3378296 - DNA, 22 bp, Homo sapiens
gggctgcagcatgttgctgagg

SEQ ID NO: 3378297 - DNA, 18 bp, Homo sapiens
gggctgccatgtgaagag

SEQ ID NO: 3378298 - DNA, 14 bp, Homo sapiens
gggctgccctgaga

SEQ ID NO: 3378299 - DNA, 12 bp, Homo sapiens
gggctgccctgc

SEQ ID NO: 3378300 - DNA, 13 bp, Homo sapiens
gggctgccctgcc

SEQ ID NO: 3378301 - DNA, 13 bp, Homo sapiens
gggctgccctggt

SEQ ID NO: 3378302 - DNA, 15 bp, Homo sapiens
gggctgccctggtgc

SEQ ID NO: 3378303 - DNA, 19 bp, Homo sapiens
gggctgcctgggctgttgg

SEQ ID NO: 3378304 - DNA, 22 bp, Homo sapiens
gggctgcgggaggccctggccc

SEQ ID NO: 3378305 - DNA, 12 bp, Homo sapiens
gggctgcttcct

SEQ ID NO: 3378306 - DNA, 18 bp, Homo sapiens
gggctggacttctacctg

SEQ ID NO: 3378307 - DNA, 24 bp, Homo sapiens
gggctggagaaagagctgcctgga

SEQ ID NO: 3378308 - DNA, 19 bp, Homo sapiens
gggctggaggcccaggctg

SEQ ID NO: 3378309 - DNA, 16 bp, Homo sapiens
gggctggcaagcaggg

SEQ ID NO: 3378310 - DNA, 19 bp, Homo sapiens
gggctggcctctggctctc

SEQ ID NO: 3378311 - DNA, 17 bp, Homo sapiens
gggctggctctgcacta

SEQ ID NO: 3378312 - DNA, 16 bp, Homo sapiens
gggctgggagctctgc

SEQ ID NO: 3378313 - DNA, 18 bp, Homo sapiens
gggctgggagctctgcag

SEQ ID NO: 3378314 - DNA, 12 bp, Homo sapiens
gggctggggagg

SEQ ID NO: 3378315 - DNA, 17 bp, Homo sapiens
gggctggggctgctccc

SEQ ID NO: 3378316 - DNA, 18 bp, Homo sapiens
gggctggggtgagagagg

SEQ ID NO: 3378317 - DNA, 18 bp, Homo sapiens
gggctgtaaaatgcatga

SEQ ID NO: 3378318 - DNA, 23 bp, Homo sapiens
gggctgtgctgcttttgagcctc

SEQ ID NO: 3378319 - DNA, 14 bp, Homo sapiens
gggcttccatgcct

SEQ ID NO: 3378320 - DNA, 19 bp, Homo sapiens
gggcttcctctagaagcca

SEQ ID NO: 3378321 - DNA, 18 bp, Homo sapiens
gggcttctgcaccctcca

SEQ ID NO: 3378322 - DNA, 21 bp, Homo sapiens
gggcttctgcaccctccaccc

SEQ ID NO: 3378323 - DNA, 23 bp, Homo sapiens
gggcttctgcaccctccaccctg

SEQ ID NO: 3378324 - DNA, 13 bp, Homo sapiens
gggcttgaagcca

SEQ ID NO: 3378325 - DNA, 17 bp, Homo sapiens
gggcttgagctgcagaa

SEQ ID NO: 3378326 - DNA, 15 bp, Homo sapiens
gggctttctggggcc

SEQ ID NO: 3378327 - DNA, 14 bp, Homo sapiens
gggctttgcaggct

SEQ ID NO: 3378328 - DNA, 18 bp, Homo sapiens
gggctttgcaggctctgg

SEQ ID NO: 3378329 - DNA, 13 bp, Homo sapiens
gggctttgggccg

SEQ ID NO: 3378330 - DNA, 14 bp, Homo sapiens
gggcttttttcttt

SEQ ID NO: 3378331 - DNA, 15 bp, Homo sapiens
ggggaagctgcagct

SEQ ID NO: 3378332 - DNA, 13 bp, Homo sapiens
ggggaaggagcca

SEQ ID NO: 3378333 - DNA, 21 bp, Homo sapiens
ggggaaggagggtacagctgg

SEQ ID NO: 3378334 - DNA, 22 bp, Homo sapiens
ggggaatgtttgcctctgcctc

SEQ ID NO: 3378335 - DNA, 14 bp, Homo sapiens
ggggacaccagagc

SEQ ID NO: 3378336 - DNA, 14 bp, Homo sapiens
ggggacagctcctt

SEQ ID NO: 3378337 - DNA, 17 bp, Homo sapiens
ggggacaggcctcacct

SEQ ID NO: 3378338 - DNA, 18 bp, Homo sapiens
ggggacagttggcagaga

SEQ ID NO: 3378339 - DNA, 19 bp, Homo sapiens
ggggacccaggctccgccc

SEQ ID NO: 3378340 - DNA, 18 bp, Homo sapiens
ggggaccccaacctcaga

SEQ ID NO: 3378341 - DNA, 14 bp, Homo sapiens
ggggactcagccct

SEQ ID NO: 3378342 - DNA, 21 bp, Homo sapiens
ggggactctgagcgggaggca

SEQ ID NO: 3378343 - DNA, 14 bp, Homo sapiens
ggggactgtctttc

SEQ ID NO: 3378344 - DNA, 20 bp, Homo sapiens
ggggactgttccaaagccag

SEQ ID NO: 3378345 - DNA, 23 bp, Homo sapiens
ggggactgttccaaagccagtga

SEQ ID NO: 3378346 - DNA, 11 bp, Homo sapiens
ggggagaaagt

SEQ ID NO: 3378347 - DNA, 13 bp, Homo sapiens
ggggagaagagcc

SEQ ID NO: 3378348 - DNA, 17 bp, Homo sapiens
ggggagaagagccctgg

SEQ ID NO: 3378349 - DNA, 16 bp, Homo sapiens
ggggagagcctgctgg

SEQ ID NO: 3378350 - DNA, 18 bp, Homo sapiens
ggggagagcctgctggca

SEQ ID NO: 3378351 - DNA, 19 bp, Homo sapiens
ggggagcacttgcgtcctg

SEQ ID NO: 3378352 - DNA, 19 bp, Homo sapiens
ggggaggatcactggagcc

SEQ ID NO: 3378353 - DNA, 14 bp, Homo sapiens
ggggagggatgaag

SEQ ID NO: 3378354 - DNA, 21 bp, Homo sapiens
ggggagggccgtaccccaccc

SEQ ID NO: 3378355 - DNA, 16 bp, Homo sapiens
ggggaggggcgctggc

SEQ ID NO: 3378356 - DNA, 15 bp, Homo sapiens
ggggaggtgggtgtg

SEQ ID NO: 3378357 - DNA, 20 bp, Homo sapiens
ggggagtttctttcctgcct

SEQ ID NO: 3378358 - DNA, 17 bp, Homo sapiens
ggggatccagccacttc

SEQ ID NO: 3378359 - DNA, 13 bp, Homo sapiens
ggggatccccgcc

SEQ ID NO: 3378360 - DNA, 21 bp, Homo sapiens
ggggatgactagaggcaggga

SEQ ID NO: 3378361 - DNA, 13 bp, Homo sapiens
ggggatgggtgtg

SEQ ID NO: 3378362 - DNA, 14 bp, Homo sapiens
ggggatgtgggagg

SEQ ID NO: 3378363 - DNA, 15 bp, Homo sapiens
ggggcaactgtatga

SEQ ID NO: 3378364 - DNA, 13 bp, Homo sapiens
ggggcaagctagg

SEQ ID NO: 3378365 - DNA, 14 bp, Homo sapiens
ggggcaaggtctcc

SEQ ID NO: 3378366 - DNA, 15 bp, Homo sapiens
ggggcaaggtctcct

SEQ ID NO: 3378367 - DNA, 21 bp, Homo sapiens
ggggcacaccactgccctgcc

SEQ ID NO: 3378368 - DNA, 19 bp, Homo sapiens
ggggcacggactgtccacc

SEQ ID NO: 3378369 - DNA, 20 bp, Homo sapiens
ggggcagaggggcagccgct

SEQ ID NO: 3378370 - DNA, 13 bp, Homo sapiens
ggggcaggactga

SEQ ID NO: 3378371 - DNA, 16 bp, Homo sapiens
ggggcaggagggccct

SEQ ID NO: 3378372 - DNA, 15 bp, Homo sapiens
ggggcaggctgggcc

SEQ ID NO: 3378373 - DNA, 18 bp, Homo sapiens
ggggcagggaaggacagg

SEQ ID NO: 3378374 - DNA, 19 bp, Homo sapiens
ggggcagggaaggacagga

SEQ ID NO: 3378375 - DNA, 14 bp, Homo sapiens
ggggcagggccttc

SEQ ID NO: 3378376 - DNA, 20 bp, Homo sapiens
ggggcatctgcccctccccc

SEQ ID NO: 3378377 - DNA, 20 bp, Homo sapiens
ggggcatgtgtgcctgtggc

SEQ ID NO: 3378378 - DNA, 18 bp, Homo sapiens
ggggccaccaaagctgcc

SEQ ID NO: 3378379 - DNA, 13 bp, Homo sapiens
ggggccagagaca

SEQ ID NO: 3378380 - DNA, 23 bp, Homo sapiens
ggggccagaggaactgtccagag

SEQ ID NO: 3378381 - DNA, 13 bp, Homo sapiens
ggggccaggccag

SEQ ID NO: 3378382 - DNA, 15 bp, Homo sapiens
ggggccaggccagga

SEQ ID NO: 3378383 - DNA, 17 bp, Homo sapiens
ggggccaggccaggacc

SEQ ID NO: 3378384 - DNA, 16 bp, Homo sapiens
ggggccaggcccaggc

SEQ ID NO: 3378385 - DNA, 10 bp, Homo sapiens
ggggccatca

SEQ ID NO: 3378386 - DNA, 23 bp, Homo sapiens
ggggccatcacaggatgccagcc

SEQ ID NO: 3378387 - DNA, 17 bp, Homo sapiens
ggggccccagatctgcc

SEQ ID NO: 3378388 - DNA, 20 bp, Homo sapiens
ggggccccagatctgcctgg

SEQ ID NO: 3378389 - DNA, 22 bp, Homo sapiens
ggggccccagatctgcctgggc

SEQ ID NO: 3378390 - DNA, 15 bp, Homo sapiens
ggggccccgccaggg

SEQ ID NO: 3378391 - DNA, 19 bp, Homo sapiens
ggggccccgccagggctgg

SEQ ID NO: 3378392 - DNA, 20 bp, Homo sapiens
ggggccccgccagggctggg

SEQ ID NO: 3378393 - DNA, 22 bp, Homo sapiens
ggggccccgccagggctgggga

SEQ ID NO: 3378394 - DNA, 15 bp, Homo sapiens
ggggcccggagatag

SEQ ID NO: 3378395 - DNA, 20 bp, Homo sapiens
ggggcccgggaactcctgcc

SEQ ID NO: 3378396 - DNA, 22 bp, Homo sapiens
ggggcccggtggcggcagggcc

SEQ ID NO: 3378397 - DNA, 14 bp, Homo sapiens
ggggccctgggcct

SEQ ID NO: 3378398 - DNA, 18 bp, Homo sapiens
ggggccctgggcctcagt

SEQ ID NO: 3378399 - DNA, 22 bp, Homo sapiens
ggggcccttgggacagccagag

SEQ ID NO: 3378400 - DNA, 19 bp, Homo sapiens
ggggcccttggggcctggc

SEQ ID NO: 3378401 - DNA, 16 bp, Homo sapiens
ggggccgggcaggtcc

SEQ ID NO: 3378402 - DNA, 21 bp, Homo sapiens
ggggccgggcaggtcctgccc

SEQ ID NO: 3378403 - DNA, 21 bp, Homo sapiens
ggggccgggcgcggtggctca

SEQ ID NO: 3378404 - DNA, 13 bp, Homo sapiens
ggggcctggcagg

SEQ ID NO: 3378405 - DNA, 14 bp, Homo sapiens
ggggcctggcttgc

SEQ ID NO: 3378406 - DNA, 22 bp, Homo sapiens
ggggcctgggagggttcccctg

SEQ ID NO: 3378407 - DNA, 20 bp, Homo sapiens
ggggccttagggcactgggc

SEQ ID NO: 3378408 - DNA, 15 bp, Homo sapiens
ggggcgcctggagag

SEQ ID NO: 3378409 - DNA, 20 bp, Homo sapiens
ggggcgctcaggacccaggc

SEQ ID NO: 3378410 - DNA, 14 bp, Homo sapiens
ggggcgctggccca

SEQ ID NO: 3378411 - DNA, 17 bp, Homo sapiens
ggggcgctggcccagcc

SEQ ID NO: 3378412 - DNA, 14 bp, Homo sapiens
ggggcggggcagga

SEQ ID NO: 3378413 - DNA, 20 bp, Homo sapiens
ggggcgttatttatggacca

SEQ ID NO: 3378414 - DNA, 12 bp, Homo sapiens
ggggctccctct

SEQ ID NO: 3378415 - DNA, 15 bp, Homo sapiens
ggggctcgaggctgg

SEQ ID NO: 3378416 - DNA, 15 bp, Homo sapiens
ggggctcgccatgcc

SEQ ID NO: 3378417 - DNA, 22 bp, Homo sapiens
ggggctctagggttgctggagc

SEQ ID NO: 3378418 - DNA, 16 bp, Homo sapiens
ggggctctcagctcag

SEQ ID NO: 3378419 - DNA, 18 bp, Homo sapiens
ggggctctccaaaggggc

SEQ ID NO: 3378420 - DNA, 13 bp, Homo sapiens
ggggctctggaga

SEQ ID NO: 3378421 - DNA, 16 bp, Homo sapiens
ggggctctggagagaa

SEQ ID NO: 3378422 - DNA, 12 bp, Homo sapiens
ggggctctggga

SEQ ID NO: 3378423 - DNA, 13 bp, Homo sapiens
ggggctgcagcat

SEQ ID NO: 3378424 - DNA, 15 bp, Homo sapiens
ggggctgctggggca

SEQ ID NO: 3378425 - DNA, 16 bp, Homo sapiens
ggggctggccttcctg

SEQ ID NO: 3378426 - DNA, 18 bp, Homo sapiens
ggggctgggctcacaggc

SEQ ID NO: 3378427 - DNA, 12 bp, Homo sapiens
ggggctggggca

SEQ ID NO: 3378428 - DNA, 14 bp, Homo sapiens
ggggctgtgccaac

SEQ ID NO: 3378429 - DNA, 11 bp, Homo sapiens
ggggcttggcg

SEQ ID NO: 3378430 - DNA, 16 bp, Homo sapiens
ggggcttttgccactc

SEQ ID NO: 3378431 - DNA, 19 bp, Homo sapiens
gggggaaaaaaaaaaaaga

SEQ ID NO: 3378432 - DNA, 17 bp, Homo sapiens
gggggaacgatgtgtct

SEQ ID NO: 3378433 - DNA, 20 bp, Homo sapiens
gggggaagtcgaaggatgct

SEQ ID NO: 3378434 - DNA, 12 bp, Homo sapiens
gggggaatgagc

SEQ ID NO: 3378435 - DNA, 15 bp, Homo sapiens
gggggacagagaagg

SEQ ID NO: 3378436 - DNA, 20 bp, Homo sapiens
gggggactctgagcgggagg

SEQ ID NO: 3378437 - DNA, 20 bp, Homo sapiens
gggggactgggagtcagagc

SEQ ID NO: 3378438 - DNA, 11 bp, Homo sapiens
gggggagaggg

SEQ ID NO: 3378439 - DNA, 21 bp, Homo sapiens
gggggagcccagtgaagcctc

SEQ ID NO: 3378440 - DNA, 23 bp, Homo sapiens
gggggcacatgctgagtctccca

SEQ ID NO: 3378441 - DNA, 14 bp, Homo sapiens
gggggccaaggtcc

SEQ ID NO: 3378442 - DNA, 18 bp, Homo sapiens
gggggccccgccagggct

SEQ ID NO: 3378443 - DNA, 12 bp, Homo sapiens
gggggcctcagt

SEQ ID NO: 3378444 - DNA, 14 bp, Homo sapiens
gggggcctcctcct

SEQ ID NO: 3378445 - DNA, 14 bp, Homo sapiens
gggggcgcctggag

SEQ ID NO: 3378446 - DNA, 12 bp, Homo sapiens
gggggctctcca

SEQ ID NO: 3378447 - DNA, 13 bp, Homo sapiens
gggggctggccta

SEQ ID NO: 3378448 - DNA, 12 bp, Homo sapiens
gggggctttctg

SEQ ID NO: 3378449 - DNA, 12 bp, Homo sapiens
gggggtggccat

SEQ ID NO: 3378450 - DNA, 19 bp, Homo sapiens
ggggtaagccagagcctgg

SEQ ID NO: 3378451 - DNA, 20 bp, Homo sapiens
ggggtacatttctctgagca

SEQ ID NO: 3378452 - DNA, 15 bp, Homo sapiens
ggggtataggtctca

SEQ ID NO: 3378453 - DNA, 20 bp, Homo sapiens
ggggtataggtctcatctct

SEQ ID NO: 3378454 - DNA, 14 bp, Homo sapiens
ggggtatgaagagc

SEQ ID NO: 3378455 - DNA, 20 bp, Homo sapiens
ggggtatttcaattaccttc

SEQ ID NO: 3378456 - DNA, 12 bp, Homo sapiens
ggggtcacaggc

SEQ ID NO: 3378457 - DNA, 20 bp, Homo sapiens
ggggtcacaggcccagaagg

SEQ ID NO: 3378458 - DNA, 20 bp, Homo sapiens
ggggtcagagcactccctaa

SEQ ID NO: 3378459 - DNA, 16 bp, Homo sapiens
ggggtcccatcagtga

SEQ ID NO: 3378460 - DNA, 23 bp, Homo sapiens
ggggtccgtggtagaggcctggg

SEQ ID NO: 3378461 - DNA, 22 bp, Homo sapiens
ggggtccttcaagttagctcag

SEQ ID NO: 3378462 - DNA, 21 bp, Homo sapiens
ggggtctccctggctccctcc

SEQ ID NO: 3378463 - DNA, 19 bp, Homo sapiens
ggggtctcttttgtaaatt

SEQ ID NO: 3378464 - DNA, 14 bp, Homo sapiens
ggggtgagtcccct

SEQ ID NO: 3378465 - DNA, 23 bp, Homo sapiens
ggggtgcatcctcctcagccccc

SEQ ID NO: 3378466 - DNA, 14 bp, Homo sapiens
ggggtgctgagtga

SEQ ID NO: 3378467 - DNA, 11 bp, Homo sapiens
ggggtgctgcc

SEQ ID NO: 3378468 - DNA, 20 bp, Homo sapiens
ggggtgcttttatagaggct

SEQ ID NO: 3378469 - DNA, 17 bp, Homo sapiens
ggggtggagtgagactg

SEQ ID NO: 3378470 - DNA, 13 bp, Homo sapiens
ggggtgggctggt

SEQ ID NO: 3378471 - DNA, 18 bp, Homo sapiens
ggggtgggggtggaggct

SEQ ID NO: 3378472 - DNA, 19 bp, Homo sapiens
ggggttaacttggtcagag

SEQ ID NO: 3378473 - DNA, 13 bp, Homo sapiens
ggggttacaaact

SEQ ID NO: 3378474 - DNA, 15 bp, Homo sapiens
ggggttatctctgtg

SEQ ID NO: 3378475 - DNA, 14 bp, Homo sapiens
ggggttcaggcccg

SEQ ID NO: 3378476 - DNA, 21 bp, Homo sapiens
ggggttcgagaccagtctggc

SEQ ID NO: 3378477 - DNA, 20 bp, Homo sapiens
ggggttctttcttcctctgc

SEQ ID NO: 3378478 - DNA, 20 bp, Homo sapiens
ggggttgccacaggcctccc

SEQ ID NO: 3378479 - DNA, 12 bp, Homo sapiens
ggggttgggcgg

SEQ ID NO: 3378480 - DNA, 17 bp, Homo sapiens
ggggttggggtgacagt

SEQ ID NO: 3378481 - DNA, 13 bp, Homo sapiens
gggtaagagagga

SEQ ID NO: 3378482 - DNA, 17 bp, Homo sapiens
gggtaagccagagcctg

SEQ ID NO: 3378483 - DNA, 20 bp, Homo sapiens
gggtaagggatttcttaggg

SEQ ID NO: 3378484 - DNA, 22 bp, Homo sapiens
gggtacttgtggacacagctct

SEQ ID NO: 3378485 - DNA, 23 bp, Homo sapiens
gggtacttgtggacacagctctt

SEQ ID NO: 3378486 - DNA, 24 bp, Homo sapiens
gggtagatgggtgggggctcctgg

SEQ ID NO: 3378487 - DNA, 14 bp, Homo sapiens
gggtagcagctgga

SEQ ID NO: 3378488 - DNA, 13 bp, Homo sapiens
gggtagctgggcg

SEQ ID NO: 3378489 - DNA, 15 bp, Homo sapiens
gggtagggaataaaa

SEQ ID NO: 3378490 - DNA, 22 bp, Homo sapiens
gggtagggtaaatcagtaagag

SEQ ID NO: 3378491 - DNA, 12 bp, Homo sapiens
gggtagtgagca

SEQ ID NO: 3378492 - DNA, 20 bp, Homo sapiens
gggtatcaggtgctgccatc

SEQ ID NO: 3378493 - DNA, 19 bp, Homo sapiens
gggtatccaagttggactg

SEQ ID NO: 3378494 - DNA, 20 bp, Homo sapiens
gggtatccaagttggactgg

SEQ ID NO: 3378495 - DNA, 16 bp, Homo sapiens
gggtatgcgtttcatg

SEQ ID NO: 3378496 - DNA, 15 bp, Homo sapiens
gggtcacaggcccag

SEQ ID NO: 3378497 - DNA, 17 bp, Homo sapiens
gggtcaccctctccagc

SEQ ID NO: 3378498 - DNA, 21 bp, Homo sapiens
gggtcagggccagactggaag

SEQ ID NO: 3378499 - DNA, 12 bp, Homo sapiens
gggtcagggggg

SEQ ID NO: 3378500 - DNA, 20 bp, Homo sapiens
gggtcatgtttgcaggggtg

SEQ ID NO: 3378501 - DNA, 20 bp, Homo sapiens
gggtcattgacctctcaggg

SEQ ID NO: 3378502 - DNA, 12 bp, Homo sapiens
gggtccaaataa

SEQ ID NO: 3378503 - DNA, 11 bp, Homo sapiens
gggtccaggaa

SEQ ID NO: 3378504 - DNA, 16 bp, Homo sapiens
gggtccaggaaggcag

SEQ ID NO: 3378505 - DNA, 19 bp, Homo sapiens
gggtccaggaaggcagctg

SEQ ID NO: 3378506 - DNA, 19 bp, Homo sapiens
gggtccagtggatgccaca

SEQ ID NO: 3378507 - DNA, 14 bp, Homo sapiens
gggtcccagtggga

SEQ ID NO: 3378508 - DNA, 23 bp, Homo sapiens
gggtcccagtgggaggggcaggc

SEQ ID NO: 3378509 - DNA, 19 bp, Homo sapiens
gggtccgcaccagctgctc

SEQ ID NO: 3378510 - DNA, 22 bp, Homo sapiens
gggtccgcaccagctgctctgc

SEQ ID NO: 3378511 - DNA, 13 bp, Homo sapiens
gggtcctcttctg

SEQ ID NO: 3378512 - DNA, 13 bp, Homo sapiens
gggtcctggctcc

SEQ ID NO: 3378513 - DNA, 18 bp, Homo sapiens
gggtcctggctcctgagg

SEQ ID NO: 3378514 - DNA, 15 bp, Homo sapiens
gggtccttctccaca

SEQ ID NO: 3378515 - DNA, 22 bp, Homo sapiens
gggtccttttgacactgctcta

SEQ ID NO: 3378516 - DNA, 16 bp, Homo sapiens
gggtcgaaagctctag

SEQ ID NO: 3378517 - DNA, 15 bp, Homo sapiens
gggtcggccctgccc

SEQ ID NO: 3378518 - DNA, 14 bp, Homo sapiens
gggtcggctgacca

SEQ ID NO: 3378519 - DNA, 15 bp, Homo sapiens
gggtcggctgaccat

SEQ ID NO: 3378520 - DNA, 20 bp, Homo sapiens
gggtcggctgaccatgctca

SEQ ID NO: 3378521 - DNA, 14 bp, Homo sapiens
gggtctccctggct

SEQ ID NO: 3378522 - DNA, 17 bp, Homo sapiens
gggtctccctggctccc

SEQ ID NO: 3378523 - DNA, 18 bp, Homo sapiens
gggtctccctggctccct

SEQ ID NO: 3378524 - DNA, 22 bp, Homo sapiens
gggtctccctggctccctcctc

SEQ ID NO: 3378525 - DNA, 22 bp, Homo sapiens
gggtctcggatgacaccctggc

SEQ ID NO: 3378526 - DNA, 14 bp, Homo sapiens
gggtctcttccttc

SEQ ID NO: 3378527 - DNA, 21 bp, Homo sapiens
gggtctcttttgtaaattaaa

SEQ ID NO: 3378528 - DNA, 21 bp, Homo sapiens
gggtctgctctttctctgcca

SEQ ID NO: 3378529 - DNA, 22 bp, Homo sapiens
gggtctgctctttctctgccag

SEQ ID NO: 3378530 - DNA, 23 bp, Homo sapiens
gggtctgggcggcgggcggctgg

SEQ ID NO: 3378531 - DNA, 15 bp, Homo sapiens
gggtctgtgctgtgc

SEQ ID NO: 3378532 - DNA, 15 bp, Homo sapiens
gggtctgtgtgaatg

SEQ ID NO: 3378533 - DNA, 17 bp, Homo sapiens
gggtctgtgtgaatgtg

SEQ ID NO: 3378534 - DNA, 21 bp, Homo sapiens
gggtcttcagcattccctccc

SEQ ID NO: 3378535 - DNA, 22 bp, Homo sapiens
gggtcttgggctactggcagct

SEQ ID NO: 3378536 - DNA, 14 bp, Homo sapiens
gggtgaaggcctgg

SEQ ID NO: 3378537 - DNA, 18 bp, Homo sapiens
gggtgacggccctcatct

SEQ ID NO: 3378538 - DNA, 11 bp, Homo sapiens
gggtgagccag

SEQ ID NO: 3378539 - DNA, 18 bp, Homo sapiens
gggtgaggaccactcctg

SEQ ID NO: 3378540 - DNA, 19 bp, Homo sapiens
gggtgagtccattctccca

SEQ ID NO: 3378541 - DNA, 21 bp, Homo sapiens
gggtgagtcccctactccctc

SEQ ID NO: 3378542 - DNA, 14 bp, Homo sapiens
gggtgcagcagtga

SEQ ID NO: 3378543 - DNA, 24 bp, Homo sapiens
gggtgcatcctcctcagcccccag

SEQ ID NO: 3378544 - DNA, 15 bp, Homo sapiens
gggtgccccctcctc

SEQ ID NO: 3378545 - DNA, 18 bp, Homo sapiens
gggtgctcagaataaggc

SEQ ID NO: 3378546 - DNA, 18 bp, Homo sapiens
gggtgctgggaggaggga

SEQ ID NO: 3378547 - DNA, 21 bp, Homo sapiens
gggtgcttttatagaggctag

SEQ ID NO: 3378548 - DNA, 14 bp, Homo sapiens
gggtggaagggctg

SEQ ID NO: 3378549 - DNA, 22 bp, Homo sapiens
gggtggagactgcttcccatcc

SEQ ID NO: 3378550 - DNA, 23 bp, Homo sapiens
gggtggagactgcttcccatcct

SEQ ID NO: 3378551 - DNA, 15 bp, Homo sapiens
gggtggatcacctgt

SEQ ID NO: 3378552 - DNA, 17 bp, Homo sapiens
gggtggatcacgaggtc

SEQ ID NO: 3378553 - DNA, 18 bp, Homo sapiens
gggtggcacctcctgaga

SEQ ID NO: 3378554 - DNA, 17 bp, Homo sapiens
gggtggcctcaagagca

SEQ ID NO: 3378555 - DNA, 15 bp, Homo sapiens
gggtgggaagaaaga

SEQ ID NO: 3378556 - DNA, 16 bp, Homo sapiens
gggtgggaagaaagaa

SEQ ID NO: 3378557 - DNA, 14 bp, Homo sapiens
gggtgggagagccc

SEQ ID NO: 3378558 - DNA, 17 bp, Homo sapiens
gggtgggcccagaactg

SEQ ID NO: 3378559 - DNA, 19 bp, Homo sapiens
gggtgggcctggcctgagc

SEQ ID NO: 3378560 - DNA, 17 bp, Homo sapiens
gggtgggggctcctggt

SEQ ID NO: 3378561 - DNA, 13 bp, Homo sapiens
gggtgggtgaagg

SEQ ID NO: 3378562 - DNA, 13 bp, Homo sapiens
gggtgtagccagg

SEQ ID NO: 3378563 - DNA, 21 bp, Homo sapiens
gggtgtaggggccacctcctc

SEQ ID NO: 3378564 - DNA, 17 bp, Homo sapiens
gggtgtcatctgaggag

SEQ ID NO: 3378565 - DNA, 21 bp, Homo sapiens
gggtgtcttgggcagagctgg

SEQ ID NO: 3378566 - DNA, 16 bp, Homo sapiens
gggtgtgcggtctcga

SEQ ID NO: 3378567 - DNA, 16 bp, Homo sapiens
gggtgtggggtggggt

SEQ ID NO: 3378568 - DNA, 12 bp, Homo sapiens
gggttacaaact

SEQ ID NO: 3378569 - DNA, 18 bp, Homo sapiens
gggttatgtatcagaaga

SEQ ID NO: 3378570 - DNA, 19 bp, Homo sapiens
gggttatgtatcagaagag

SEQ ID NO: 3378571 - DNA, 16 bp, Homo sapiens
gggttcaaaatgtctg

SEQ ID NO: 3378572 - DNA, 14 bp, Homo sapiens
gggttcatttgtgt

SEQ ID NO: 3378573 - DNA, 20 bp, Homo sapiens
gggttccatcttgctaataa

SEQ ID NO: 3378574 - DNA, 16 bp, Homo sapiens
gggttccgcactttcc

SEQ ID NO: 3378575 - DNA, 14 bp, Homo sapiens
gggttcctcttccc

SEQ ID NO: 3378576 - DNA, 17 bp, Homo sapiens
gggttctttcttcctct

SEQ ID NO: 3378577 - DNA, 16 bp, Homo sapiens
gggttgaaaatgtgtt

SEQ ID NO: 3378578 - DNA, 13 bp, Homo sapiens
gggttgaaggcag

SEQ ID NO: 3378579 - DNA, 19 bp, Homo sapiens
gggttgaatatagcctgcc

SEQ ID NO: 3378580 - DNA, 18 bp, Homo sapiens
gggttgccacaggcctcc

SEQ ID NO: 3378581 - DNA, 20 bp, Homo sapiens
gggttgccacaggcctccct

SEQ ID NO: 3378582 - DNA, 14 bp, Homo sapiens
gggttgctggagcc

SEQ ID NO: 3378583 - DNA, 19 bp, Homo sapiens
gggttggtgcacagtgatt

SEQ ID NO: 3378584 - DNA, 20 bp, Homo sapiens
gggtttacccagtgggacag

SEQ ID NO: 3378585 - DNA, 20 bp, Homo sapiens
gggtttcacctgggccctgg

SEQ ID NO: 3378586 - DNA, 14 bp, Homo sapiens
gggtttcctgcagg

SEQ ID NO: 3378587 - DNA, 19 bp, Homo sapiens
gggtttcgactggtccagc

SEQ ID NO: 3378588 - DNA, 17 bp, Homo sapiens
gggtttcttaaatatat

SEQ ID NO: 3378589 - DNA, 14 bp, Homo sapiens
gggtttgaattgtt

SEQ ID NO: 3378590 - DNA, 17 bp, Homo sapiens
gggtttgccatttgata

SEQ ID NO: 3378591 - DNA, 21 bp, Homo sapiens
gggtttggaccccagctggga

SEQ ID NO: 3378592 - DNA, 23 bp, Homo sapiens
gggttttattgtccttcagagct

SEQ ID NO: 3378593 - DNA, 13 bp, Homo sapiens
gggttttcatcta

SEQ ID NO: 3378594 - DNA, 16 bp, Homo sapiens
gggttttccaccctgg

SEQ ID NO: 3378595 - DNA, 12 bp, Homo sapiens
gggttttgtatt

SEQ ID NO: 3378596 - DNA, 20 bp, Homo sapiens
ggtaaacccattttgaatat

SEQ ID NO: 3378597 - DNA, 16 bp, Homo sapiens
ggtaaagttacacttt

SEQ ID NO: 3378598 - DNA, 17 bp, Homo sapiens
ggtaaatgcaaagttct

SEQ ID NO: 3378599 - DNA, 12 bp, Homo sapiens
ggtaaatgtttc

SEQ ID NO: 3378600 - DNA, 14 bp, Homo sapiens
ggtaacagaacagc

SEQ ID NO: 3378601 - DNA, 18 bp, Homo sapiens
ggtaacagaacagcttca

SEQ ID NO: 3378602 - DNA, 18 bp, Homo sapiens
ggtaactgctttctgttc

SEQ ID NO: 3378603 - DNA, 13 bp, Homo sapiens
ggtaagaagaaag

SEQ ID NO: 3378604 - DNA, 17 bp, Homo sapiens
ggtaagaagaaagcaaa

SEQ ID NO: 3378605 - DNA, 23 bp, Homo sapiens
ggtaagaagttttaaaaagccag

SEQ ID NO: 3378606 - DNA, 18 bp, Homo sapiens
ggtaatgttttgtatata

SEQ ID NO: 3378607 - DNA, 19 bp, Homo sapiens
ggtaatgttttgtatatac

SEQ ID NO: 3378608 - DNA, 23 bp, Homo sapiens
ggtaattattttggtacttttat

SEQ ID NO: 3378609 - DNA, 17 bp, Homo sapiens
ggtaattcacttcagtt

SEQ ID NO: 3378610 - DNA, 22 bp, Homo sapiens
ggtaattgttgctaatcttctt

SEQ ID NO: 3378611 - DNA, 20 bp, Homo sapiens
ggtaatttttaccctaatgt

SEQ ID NO: 3378612 - DNA, 18 bp, Homo sapiens
ggtacatggtgtttgtgg

SEQ ID NO: 3378613 - DNA, 22 bp, Homo sapiens
ggtaccacccttcagaccccag

SEQ ID NO: 3378614 - DNA, 18 bp, Homo sapiens
ggtaccagccctggggct

SEQ ID NO: 3378615 - DNA, 15 bp, Homo sapiens
ggtaccagctgcgct

SEQ ID NO: 3378616 - DNA, 13 bp, Homo sapiens
ggtacccactgct

SEQ ID NO: 3378617 - DNA, 20 bp, Homo sapiens
ggtacccagccatctgccca

SEQ ID NO: 3378618 - DNA, 21 bp, Homo sapiens
ggtacccagccatctgcccag

SEQ ID NO: 3378619 - DNA, 16 bp, Homo sapiens
ggtacctcaagcccca

SEQ ID NO: 3378620 - DNA, 17 bp, Homo sapiens
ggtacctcaagccccat

SEQ ID NO: 3378621 - DNA, 20 bp, Homo sapiens
ggtactagtgtggtgtgttt

SEQ ID NO: 3378622 - DNA, 12 bp, Homo sapiens
ggtactctccta

SEQ ID NO: 3378623 - DNA, 14 bp, Homo sapiens
ggtactctcctaga

SEQ ID NO: 3378624 - DNA, 19 bp, Homo sapiens
ggtactgcattctctccca

SEQ ID NO: 3378625 - DNA, 17 bp, Homo sapiens
ggtactgctgtcttcca

SEQ ID NO: 3378626 - DNA, 16 bp, Homo sapiens
ggtacttgtcatttcg

SEQ ID NO: 3378627 - DNA, 21 bp, Homo sapiens
ggtacttgtggacacagctct

SEQ ID NO: 3378628 - DNA, 18 bp, Homo sapiens
ggtactttattcttgctg

SEQ ID NO: 3378629 - DNA, 21 bp, Homo sapiens
ggtacttttatgatgtatatt

SEQ ID NO: 3378630 - DNA, 22 bp, Homo sapiens
ggtagaaatatctgaaaatgta

SEQ ID NO: 3378631 - DNA, 15 bp, Homo sapiens
ggtagagacccccag

SEQ ID NO: 3378632 - DNA, 17 bp, Homo sapiens
ggtagagaggggactgg

SEQ ID NO: 3378633 - DNA, 19 bp, Homo sapiens
ggtagagattcattatttt

SEQ ID NO: 3378634 - DNA, 19 bp, Homo sapiens
ggtagaggctccccagggc

SEQ ID NO: 3378635 - DNA, 14 bp, Homo sapiens
ggtagatgggtggg

SEQ ID NO: 3378636 - DNA, 21 bp, Homo sapiens
ggtagatgggtgggggctcct

SEQ ID NO: 3378637 - DNA, 21 bp, Homo sapiens
ggtagccatgatttgtcccag

SEQ ID NO: 3378638 - DNA, 12 bp, Homo sapiens
ggtagctcaggt

SEQ ID NO: 3378639 - DNA, 12 bp, Homo sapiens
ggtagctgggcg

SEQ ID NO: 3378640 - DNA, 14 bp, Homo sapiens
ggtagcttttccct

SEQ ID NO: 3378641 - DNA, 11 bp, Homo sapiens
ggtaggccctt

SEQ ID NO: 3378642 - DNA, 12 bp, Homo sapiens
ggtaggcccttg

SEQ ID NO: 3378643 - DNA, 16 bp, Homo sapiens
ggtaggcccttgtcct

SEQ ID NO: 3378644 - DNA, 19 bp, Homo sapiens
ggtaggcccttgtcctgcc

SEQ ID NO: 3378645 - DNA, 21 bp, Homo sapiens
ggtaggcccttgtcctgccag

SEQ ID NO: 3378646 - DNA, 22 bp, Homo sapiens
ggtaggcccttgtcctgccagc

SEQ ID NO: 3378647 - DNA, 23 bp, Homo sapiens
ggtaggcccttgtcctgccagct

SEQ ID NO: 3378648 - DNA, 15 bp, Homo sapiens
ggtagggtaaatcag

SEQ ID NO: 3378649 - DNA, 16 bp, Homo sapiens
ggtagggtaaatcagt

SEQ ID NO: 3378650 - DNA, 16 bp, Homo sapiens
ggtaggttcagccaag

SEQ ID NO: 3378651 - DNA, 15 bp, Homo sapiens
ggtaggttgggacac

SEQ ID NO: 3378652 - DNA, 18 bp, Homo sapiens
ggtaggttgggacaccag

SEQ ID NO: 3378653 - DNA, 22 bp, Homo sapiens
ggtagtactcctgcaaaatttt

SEQ ID NO: 3378654 - DNA, 23 bp, Homo sapiens
ggtagtactcctgcaaaatttta

SEQ ID NO: 3378655 - DNA, 15 bp, Homo sapiens
ggtagtctcactgct

SEQ ID NO: 3378656 - DNA, 21 bp, Homo sapiens
ggtataaaactttcctcgcct

SEQ ID NO: 3378657 - DNA, 21 bp, Homo sapiens
ggtataggtctcatctcttca

SEQ ID NO: 3378658 - DNA, 14 bp, Homo sapiens
ggtatcaggtgctg

SEQ ID NO: 3378659 - DNA, 23 bp, Homo sapiens
ggtatcctactgagcatttgcac

SEQ ID NO: 3378660 - DNA, 12 bp, Homo sapiens
ggtatcctgccc

SEQ ID NO: 3378661 - DNA, 15 bp, Homo sapiens
ggtatcctgcccagt

SEQ ID NO: 3378662 - DNA, 15 bp, Homo sapiens
ggtatctcagaaagt

SEQ ID NO: 3378663 - DNA, 22 bp, Homo sapiens
ggtatgatcacggctcactgca

SEQ ID NO: 3378664 - DNA, 17 bp, Homo sapiens
ggtatgctggccagcac

SEQ ID NO: 3378665 - DNA, 20 bp, Homo sapiens
ggtatgctggccagcaccct

SEQ ID NO: 3378666 - DNA, 21 bp, Homo sapiens
ggtatggaagggtttgtggct

SEQ ID NO: 3378667 - DNA, 12 bp, Homo sapiens
ggtatgtttaat

SEQ ID NO: 3378668 - DNA, 18 bp, Homo sapiens
ggtatgtttaatctgtta

SEQ ID NO: 3378669 - DNA, 22 bp, Homo sapiens
ggtattaatatatagtccagac

SEQ ID NO: 3378670 - DNA, 19 bp, Homo sapiens
ggtatttttcagagattta

SEQ ID NO: 3378671 - DNA, 23 bp, Homo sapiens
ggtcaacatcttttacattctgc

SEQ ID NO: 3378672 - DNA, 18 bp, Homo sapiens
ggtcaagaaacagccagc

SEQ ID NO: 3378673 - DNA, 21 bp, Homo sapiens
ggtcaagggcttactatttct

SEQ ID NO: 3378674 - DNA, 20 bp, Homo sapiens
ggtcaagtaagaagacatga

SEQ ID NO: 3378675 - DNA, 11 bp, Homo sapiens
ggtcaataaac

SEQ ID NO: 3378676 - DNA, 13 bp, Homo sapiens
ggtcaatcccaaa

SEQ ID NO: 3378677 - DNA, 22 bp, Homo sapiens
ggtcacaaatcctaaaagaagc

SEQ ID NO: 3378678 - DNA, 18 bp, Homo sapiens
ggtcacaggactctgcct

SEQ ID NO: 3378679 - DNA, 22 bp, Homo sapiens
ggtcaccaggggaggagcctgt

SEQ ID NO: 3378680 - DNA, 17 bp, Homo sapiens
ggtcactaaccaacaag

SEQ ID NO: 3378681 - DNA, 20 bp, Homo sapiens
ggtcactaaccaacaaggtt

SEQ ID NO: 3378682 - DNA, 17 bp, Homo sapiens
ggtcactccaccatccc

SEQ ID NO: 3378683 - DNA, 13 bp, Homo sapiens
ggtcactggctct

SEQ ID NO: 3378684 - DNA, 16 bp, Homo sapiens
ggtcactggctctcca

SEQ ID NO: 3378685 - DNA, 21 bp, Homo sapiens
ggtcagagacggcagaaaaca

SEQ ID NO: 3378686 - DNA, 13 bp, Homo sapiens
ggtcagagccact

SEQ ID NO: 3378687 - DNA, 15 bp, Homo sapiens
ggtcagagccactct

SEQ ID NO: 3378688 - DNA, 12 bp, Homo sapiens
ggtcagagcctg

SEQ ID NO: 3378689 - DNA, 16 bp, Homo sapiens
ggtcagagtgccactg

SEQ ID NO: 3378690 - DNA, 11 bp, Homo sapiens
ggtcagccatt

SEQ ID NO: 3378691 - DNA, 14 bp, Homo sapiens
ggtcagccattttt

SEQ ID NO: 3378692 - DNA, 18 bp, Homo sapiens
ggtcagccatttttaatg

SEQ ID NO: 3378693 - DNA, 18 bp, Homo sapiens
ggtcagctgttactttct

SEQ ID NO: 3378694 - DNA, 13 bp, Homo sapiens
ggtcaggccctgg

SEQ ID NO: 3378695 - DNA, 14 bp, Homo sapiens
ggtcaggccctgga

SEQ ID NO: 3378696 - DNA, 14 bp, Homo sapiens
ggtcaggctgggca

SEQ ID NO: 3378697 - DNA, 21 bp, Homo sapiens
ggtcaggctgggcagccccag

SEQ ID NO: 3378698 - DNA, 20 bp, Homo sapiens
ggtcaggttatactcctcct

SEQ ID NO: 3378699 - DNA, 17 bp, Homo sapiens
ggtcagtggaagcccca

SEQ ID NO: 3378700 - DNA, 15 bp, Homo sapiens
ggtcagtgtggagag

SEQ ID NO: 3378701 - DNA, 19 bp, Homo sapiens
ggtcagtgtggagaggggt

SEQ ID NO: 3378702 - DNA, 14 bp, Homo sapiens
ggtcatcctgcccc

SEQ ID NO: 3378703 - DNA, 14 bp, Homo sapiens
ggtcatgtttgcag

SEQ ID NO: 3378704 - DNA, 19 bp, Homo sapiens
ggtcatgtttgcaggggtg

SEQ ID NO: 3378705 - DNA, 18 bp, Homo sapiens
ggtcattgacctctcagg

SEQ ID NO: 3378706 - DNA, 22 bp, Homo sapiens
ggtcattgacctctcagggcct

SEQ ID NO: 3378707 - DNA, 23 bp, Homo sapiens
ggtcattgacctctcagggcctg

SEQ ID NO: 3378708 - DNA, 20 bp, Homo sapiens
ggtcatttcttcagtcagaa

SEQ ID NO: 3378709 - DNA, 18 bp, Homo sapiens
ggtccaaaaaaaggaaaa

SEQ ID NO: 3378710 - DNA, 20 bp, Homo sapiens
ggtccaaaaaaaggaaaaat

SEQ ID NO: 3378711 - DNA, 15 bp, Homo sapiens
ggtccaaataaaaac

SEQ ID NO: 3378712 - DNA, 18 bp, Homo sapiens
ggtccacaggtctagact

SEQ ID NO: 3378713 - DNA, 20 bp, Homo sapiens
ggtccacccaggagccccga

SEQ ID NO: 3378714 - DNA, 16 bp, Homo sapiens
ggtccaccggcccctg

SEQ ID NO: 3378715 - DNA, 17 bp, Homo sapiens
ggtccactccctgctcc

SEQ ID NO: 3378716 - DNA, 22 bp, Homo sapiens
ggtccagcctcgttggaagagg

SEQ ID NO: 3378717 - DNA, 12 bp, Homo sapiens
ggtccagctctg

SEQ ID NO: 3378718 - DNA, 13 bp, Homo sapiens
ggtccagctctga

SEQ ID NO: 3378719 - DNA, 14 bp, Homo sapiens
ggtccagctctgac

SEQ ID NO: 3378720 - DNA, 14 bp, Homo sapiens
ggtccagctctgga

SEQ ID NO: 3378721 - DNA, 11 bp, Homo sapiens
ggtccagggaa

SEQ ID NO: 3378722 - DNA, 18 bp, Homo sapiens
ggtccagtggatgccaca

SEQ ID NO: 3378723 - DNA, 16 bp, Homo sapiens
ggtccatcagcccctc

SEQ ID NO: 3378724 - DNA, 16 bp, Homo sapiens
ggtcccacctccagcc

SEQ ID NO: 3378725 - DNA, 22 bp, Homo sapiens
ggtcccacgaatttgctgggga

SEQ ID NO: 3378726 - DNA, 12 bp, Homo sapiens
ggtcccactcag

SEQ ID NO: 3378727 - DNA, 15 bp, Homo sapiens
ggtcccagccacccc

SEQ ID NO: 3378728 - DNA, 20 bp, Homo sapiens
ggtcccagtgggaggggcag

SEQ ID NO: 3378729 - DNA, 17 bp, Homo sapiens
ggtcccatccaggcagt

SEQ ID NO: 3378730 - DNA, 16 bp, Homo sapiens
ggtccccacctgggac

SEQ ID NO: 3378731 - DNA, 21 bp, Homo sapiens
ggtccccactcaccccctttg

SEQ ID NO: 3378732 - DNA, 18 bp, Homo sapiens
ggtccccatcatcccagc

SEQ ID NO: 3378733 - DNA, 22 bp, Homo sapiens
ggtccccatccccaccagctcg

SEQ ID NO: 3378734 - DNA, 23 bp, Homo sapiens
ggtccccatccccaccagctcgt

SEQ ID NO: 3378735 - DNA, 12 bp, Homo sapiens
ggtcccctccac

SEQ ID NO: 3378736 - DNA, 18 bp, Homo sapiens
ggtcccctcctcagtgac

SEQ ID NO: 3378737 - DNA, 16 bp, Homo sapiens
ggtcccctgcctggaa

SEQ ID NO: 3378738 - DNA, 21 bp, Homo sapiens
ggtccctccgcggctggagcg

SEQ ID NO: 3378739 - DNA, 13 bp, Homo sapiens
ggtccctctgagg

SEQ ID NO: 3378740 - DNA, 14 bp, Homo sapiens
ggtccctctgtgta

SEQ ID NO: 3378741 - DNA, 13 bp, Homo sapiens
ggtccctgcctta

SEQ ID NO: 3378742 - DNA, 14 bp, Homo sapiens
ggtccctgccttag

SEQ ID NO: 3378743 - DNA, 13 bp, Homo sapiens
ggtccctgggagg

SEQ ID NO: 3378744 - DNA, 23 bp, Homo sapiens
ggtccctgggaggaaatttgaat

SEQ ID NO: 3378745 - DNA, 22 bp, Homo sapiens
ggtccctgtgtgtaggctgggg

SEQ ID NO: 3378746 - DNA, 19 bp, Homo sapiens
ggtcccttgaaggaagagg

SEQ ID NO: 3378747 - DNA, 15 bp, Homo sapiens
ggtccgcaccagctg

SEQ ID NO: 3378748 - DNA, 17 bp, Homo sapiens
ggtccgcaccagctgct

SEQ ID NO: 3378749 - DNA, 13 bp, Homo sapiens
ggtccgtgggacg

SEQ ID NO: 3378750 - DNA, 22 bp, Homo sapiens
ggtcctaattaccagtctttaa

SEQ ID NO: 3378751 - DNA, 23 bp, Homo sapiens
ggtcctcacccctcgccaccttt

SEQ ID NO: 3378752 - DNA, 14 bp, Homo sapiens
ggtcctcagagaat

SEQ ID NO: 3378753 - DNA, 21 bp, Homo sapiens
ggtcctcagagaatttctacc

SEQ ID NO: 3378754 - DNA, 23 bp, Homo sapiens
ggtcctccatcccaacagccatg

SEQ ID NO: 3378755 - DNA, 15 bp, Homo sapiens
ggtcctctggagccc

SEQ ID NO: 3378756 - DNA, 22 bp, Homo sapiens
ggtcctggccagatggcccgga

SEQ ID NO: 3378757 - DNA, 12 bp, Homo sapiens
ggtcctgtggca

SEQ ID NO: 3378758 - DNA, 14 bp, Homo sapiens
ggtcctgtggcagg

SEQ ID NO: 3378759 - DNA, 21 bp, Homo sapiens
ggtcctgtggcaggcagcgcc

SEQ ID NO: 3378760 - DNA, 16 bp, Homo sapiens
ggtccttccaggcccc

SEQ ID NO: 3378761 - DNA, 23 bp, Homo sapiens
ggtcctttctggaagtttctggt

SEQ ID NO: 3378762 - DNA, 22 bp, Homo sapiens
ggtcgcttactttgagtgatcc

SEQ ID NO: 3378763 - DNA, 20 bp, Homo sapiens
ggtcggtaggttcagccaag

SEQ ID NO: 3378764 - DNA, 14 bp, Homo sapiens
ggtcgtgggccagt

SEQ ID NO: 3378765 - DNA, 13 bp, Homo sapiens
ggtctaccaggaa

SEQ ID NO: 3378766 - DNA, 14 bp, Homo sapiens
ggtctatggggaga

SEQ ID NO: 3378767 - DNA, 16 bp, Homo sapiens
ggtctatgttccccag

SEQ ID NO: 3378768 - DNA, 21 bp, Homo sapiens
ggtctcaaactcctgggctca

SEQ ID NO: 3378769 - DNA, 23 bp, Homo sapiens
ggtctcaaactcctgggctcagg

SEQ ID NO: 3378770 - DNA, 18 bp, Homo sapiens
ggtctcacagtgttgccc

SEQ ID NO: 3378771 - DNA, 22 bp, Homo sapiens
ggtctcactatgttgcccaggc

SEQ ID NO: 3378772 - DNA, 16 bp, Homo sapiens
ggtctcactctgtcgc

SEQ ID NO: 3378773 - DNA, 14 bp, Homo sapiens
ggtctcaggcctcc

SEQ ID NO: 3378774 - DNA, 15 bp, Homo sapiens
ggtctcaggttcttt

SEQ ID NO: 3378775 - DNA, 19 bp, Homo sapiens
ggtctcatgtcctgctggc

SEQ ID NO: 3378776 - DNA, 23 bp, Homo sapiens
ggtctcatgtcctgctggcttcc

SEQ ID NO: 3378777 - DNA, 19 bp, Homo sapiens
ggtctcattgcttctgact

SEQ ID NO: 3378778 - DNA, 13 bp, Homo sapiens
ggtctccaggggc

SEQ ID NO: 3378779 - DNA, 21 bp, Homo sapiens
ggtctccaggggcctgcagaa

SEQ ID NO: 3378780 - DNA, 16 bp, Homo sapiens
ggtctcccacgtggga

SEQ ID NO: 3378781 - DNA, 15 bp, Homo sapiens
ggtctccctggctcc

SEQ ID NO: 3378782 - DNA, 21 bp, Homo sapiens
ggtctcctcagggtggggggt

SEQ ID NO: 3378783 - DNA, 23 bp, Homo sapiens
ggtctccttactctgagcccagg

SEQ ID NO: 3378784 - DNA, 15 bp, Homo sapiens
ggtctcgattcgctg

SEQ ID NO: 3378785 - DNA, 14 bp, Homo sapiens
ggtctctatttcat

SEQ ID NO: 3378786 - DNA, 17 bp, Homo sapiens
ggtctcttctcccagaa

SEQ ID NO: 3378787 - DNA, 21 bp, Homo sapiens
ggtctcttgagggagcttagc

SEQ ID NO: 3378788 - DNA, 10 bp, Homo sapiens
ggtctctttt

SEQ ID NO: 3378789 - DNA, 11 bp, Homo sapiens
ggtctgaatgt

SEQ ID NO: 3378790 - DNA, 17 bp, Homo sapiens
ggtctgaatgttctgac

SEQ ID NO: 3378791 - DNA, 14 bp, Homo sapiens
ggtctgacccactg

SEQ ID NO: 3378792 - DNA, 15 bp, Homo sapiens
ggtctgacccactgc

SEQ ID NO: 3378793 - DNA, 16 bp, Homo sapiens
ggtctgacccactgct

SEQ ID NO: 3378794 - DNA, 13 bp, Homo sapiens
ggtctgagcatga

SEQ ID NO: 3378795 - DNA, 19 bp, Homo sapiens
ggtctgagtgcaagttcat

SEQ ID NO: 3378796 - DNA, 19 bp, Homo sapiens
ggtctgcaagtcagaggat

SEQ ID NO: 3378797 - DNA, 20 bp, Homo sapiens
ggtctgcaagtcagaggatg

SEQ ID NO: 3378798 - DNA, 18 bp, Homo sapiens
ggtctgctctttctctgc

SEQ ID NO: 3378799 - DNA, 16 bp, Homo sapiens
ggtctgggatatggct

SEQ ID NO: 3378800 - DNA, 20 bp, Homo sapiens
ggtctgggatatggctgccc

SEQ ID NO: 3378801 - DNA, 22 bp, Homo sapiens
ggtctgggcggcgggcggctgg

SEQ ID NO: 3378802 - DNA, 15 bp, Homo sapiens
ggtctggttgggcag

SEQ ID NO: 3378803 - DNA, 24 bp, Homo sapiens
ggtctggttgttgcaccatctgct

SEQ ID NO: 3378804 - DNA, 14 bp, Homo sapiens
ggtctgtagggatt

SEQ ID NO: 3378805 - DNA, 15 bp, Homo sapiens
ggtctgtcccaccag

SEQ ID NO: 3378806 - DNA, 24 bp, Homo sapiens
ggtctgtgagatgctagaactccc

SEQ ID NO: 3378807 - DNA, 16 bp, Homo sapiens
ggtctgtgcatttctg

SEQ ID NO: 3378808 - DNA, 21 bp, Homo sapiens
ggtctgtgctgtgcctgctag

SEQ ID NO: 3378809 - DNA, 13 bp, Homo sapiens
ggtctgtgtctct

SEQ ID NO: 3378810 - DNA, 19 bp, Homo sapiens
ggtctgtgtctcttttctc

SEQ ID NO: 3378811 - DNA, 17 bp, Homo sapiens
ggtctgtgtgaatgtgg

SEQ ID NO: 3378812 - DNA, 16 bp, Homo sapiens
ggtctgtgtgtgttct

SEQ ID NO: 3378813 - DNA, 17 bp, Homo sapiens
ggtctgttctgtttcaa

SEQ ID NO: 3378814 - DNA, 20 bp, Homo sapiens
ggtctgttggcaggctggcc

SEQ ID NO: 3378815 - DNA, 17 bp, Homo sapiens
ggtctgttttcctttct

SEQ ID NO: 3378816 - DNA, 20 bp, Homo sapiens
ggtcttaggatgtctgtaat

SEQ ID NO: 3378817 - DNA, 17 bp, Homo sapiens
ggtcttccctacctcag

SEQ ID NO: 3378818 - DNA, 20 bp, Homo sapiens
ggtcttccctacctcaggca

SEQ ID NO: 3378819 - DNA, 21 bp, Homo sapiens
ggtcttgaactcctggactca

SEQ ID NO: 3378820 - DNA, 22 bp, Homo sapiens
ggtcttgaactcctggcctcaa

SEQ ID NO: 3378821 - DNA, 23 bp, Homo sapiens
ggtcttgagccagtaatctttat

SEQ ID NO: 3378822 - DNA, 20 bp, Homo sapiens
ggtcttgggctactggcagc

SEQ ID NO: 3378823 - DNA, 21 bp, Homo sapiens
ggtcttgggctactggcagct

SEQ ID NO: 3378824 - DNA, 18 bp, Homo sapiens
ggtctttctaatgtagct

SEQ ID NO: 3378825 - DNA, 14 bp, Homo sapiens
ggtctttctctcag

SEQ ID NO: 3378826 - DNA, 12 bp, Homo sapiens
ggtctttgtaag

SEQ ID NO: 3378827 - DNA, 20 bp, Homo sapiens
ggtctttgtaagagtgtaga

SEQ ID NO: 3378828 - DNA, 15 bp, Homo sapiens
ggtcttttttcattt

SEQ ID NO: 3378829 - DNA, 17 bp, Homo sapiens
ggtcttttttcatttct

SEQ ID NO: 3378830 - DNA, 18 bp, Homo sapiens
ggtgaaccacttcattct

SEQ ID NO: 3378831 - DNA, 17 bp, Homo sapiens
ggtgaagctatttatct

SEQ ID NO: 3378832 - DNA, 15 bp, Homo sapiens
ggtgaaggatccagg

SEQ ID NO: 3378833 - DNA, 16 bp, Homo sapiens
ggtgaagggagagcca

SEQ ID NO: 3378834 - DNA, 14 bp, Homo sapiens
ggtgacaagagcct

SEQ ID NO: 3378835 - DNA, 13 bp, Homo sapiens
ggtgactgtccca

SEQ ID NO: 3378836 - DNA, 12 bp, Homo sapiens
ggtgagaaaaaa

SEQ ID NO: 3378837 - DNA, 12 bp, Homo sapiens
ggtgagagagac

SEQ ID NO: 3378838 - DNA, 16 bp, Homo sapiens
ggtgagagaggaaaga

SEQ ID NO: 3378839 - DNA, 15 bp, Homo sapiens
ggtgataagtggaaa

SEQ ID NO: 3378840 - DNA, 18 bp, Homo sapiens
ggtgataagtggaaaaaa

SEQ ID NO: 3378841 - DNA, 16 bp, Homo sapiens
ggtgatcctctatttt

SEQ ID NO: 3378842 - DNA, 19 bp, Homo sapiens
ggtgatctgtagacttctg

SEQ ID NO: 3378843 - DNA, 16 bp, Homo sapiens
ggtgcaacccttaccc

SEQ ID NO: 3378844 - DNA, 15 bp, Homo sapiens
ggtgcacagtgattt

SEQ ID NO: 3378845 - DNA, 15 bp, Homo sapiens
ggtgcagacagaagt

SEQ ID NO: 3378846 - DNA, 20 bp, Homo sapiens
ggtgcagagaagctggactt

SEQ ID NO: 3378847 - DNA, 16 bp, Homo sapiens
ggtgcagatgggctgt

SEQ ID NO: 3378848 - DNA, 15 bp, Homo sapiens
ggtgcagctcctcag

SEQ ID NO: 3378849 - DNA, 16 bp, Homo sapiens
ggtgcaggtgggcact

SEQ ID NO: 3378850 - DNA, 19 bp, Homo sapiens
ggtgcaggtgggcactgga

SEQ ID NO: 3378851 - DNA, 20 bp, Homo sapiens
ggtgcatcctcctcagcccc

SEQ ID NO: 3378852 - DNA, 19 bp, Homo sapiens
ggtgcattacagagaggag

SEQ ID NO: 3378853 - DNA, 18 bp, Homo sapiens
ggtgccactccctgagct

SEQ ID NO: 3378854 - DNA, 22 bp, Homo sapiens
ggtgccacttcttaaaggcctg

SEQ ID NO: 3378855 - DNA, 13 bp, Homo sapiens
ggtgccagcctga

SEQ ID NO: 3378856 - DNA, 17 bp, Homo sapiens
ggtgccaggttttctgg

SEQ ID NO: 3378857 - DNA, 21 bp, Homo sapiens
ggtgccaggttttctgggtgt

SEQ ID NO: 3378858 - DNA, 22 bp, Homo sapiens
ggtgcccaagccagaggctggg

SEQ ID NO: 3378859 - DNA, 19 bp, Homo sapiens
ggtgcccagaacttccctg

SEQ ID NO: 3378860 - DNA, 20 bp, Homo sapiens
ggtgccccctcctctcccat

SEQ ID NO: 3378861 - DNA, 21 bp, Homo sapiens
ggtgcccgagtgcggcgtgga

SEQ ID NO: 3378862 - DNA, 14 bp, Homo sapiens
ggtgcctccaggtg

SEQ ID NO: 3378863 - DNA, 17 bp, Homo sapiens
ggtgcctgagaggcagg

SEQ ID NO: 3378864 - DNA, 10 bp, Homo sapiens
ggtgcctggc

SEQ ID NO: 3378865 - DNA, 16 bp, Homo sapiens
ggtgcctttgagttct

SEQ ID NO: 3378866 - DNA, 17 bp, Homo sapiens
ggtgcgtggctgtggca

SEQ ID NO: 3378867 - DNA, 21 bp, Homo sapiens
ggtgcgtggctgtggcacaga

SEQ ID NO: 3378868 - DNA, 13 bp, Homo sapiens
ggtgcgtttttac

SEQ ID NO: 3378869 - DNA, 16 bp, Homo sapiens
ggtgcgtttttacagt

SEQ ID NO: 3378870 - DNA, 22 bp, Homo sapiens
ggtgctagcttgacacagtcag

SEQ ID NO: 3378871 - DNA, 14 bp, Homo sapiens
ggtgctatttgaag

SEQ ID NO: 3378872 - DNA, 10 bp, Homo sapiens
ggtgctctgg

SEQ ID NO: 3378873 - DNA, 12 bp, Homo sapiens
ggtgctctggcg

SEQ ID NO: 3378874 - DNA, 22 bp, Homo sapiens
ggtgctgatggagggaggggga

SEQ ID NO: 3378875 - DNA, 12 bp, Homo sapiens
ggtgctgcagga

SEQ ID NO: 3378876 - DNA, 14 bp, Homo sapiens
ggtgctgcaggagt

SEQ ID NO: 3378877 - DNA, 12 bp, Homo sapiens
ggtgctgccctg

SEQ ID NO: 3378878 - DNA, 13 bp, Homo sapiens
ggtgctgccctgt

SEQ ID NO: 3378879 - DNA, 13 bp, Homo sapiens
ggtgctggaggat

SEQ ID NO: 3378880 - DNA, 16 bp, Homo sapiens
ggtgctggaggtggga

SEQ ID NO: 3378881 - DNA, 14 bp, Homo sapiens
ggtgctggccccca

SEQ ID NO: 3378882 - DNA, 11 bp, Homo sapiens
ggtgctggtcc

SEQ ID NO: 3378883 - DNA, 18 bp, Homo sapiens
ggtgcttaagcagaagca

SEQ ID NO: 3378884 - DNA, 19 bp, Homo sapiens
ggtgcttattctcaaagca

SEQ ID NO: 3378885 - DNA, 21 bp, Homo sapiens
ggtggaaaggtgtgagactgg

SEQ ID NO: 3378886 - DNA, 15 bp, Homo sapiens
ggtggaacaagcaca

SEQ ID NO: 3378887 - DNA, 16 bp, Homo sapiens
ggtggaagggctgggt

SEQ ID NO: 3378888 - DNA, 17 bp, Homo sapiens
ggtggaagggctgggtg

SEQ ID NO: 3378889 - DNA, 16 bp, Homo sapiens
ggtggacagtcctggg

SEQ ID NO: 3378890 - DNA, 17 bp, Homo sapiens
ggtggacagtcctggga

SEQ ID NO: 3378891 - DNA, 17 bp, Homo sapiens
ggtggacttagaaagca

SEQ ID NO: 3378892 - DNA, 20 bp, Homo sapiens
ggtggacttagaaagcaggg

SEQ ID NO: 3378893 - DNA, 16 bp, Homo sapiens
ggtggagaaagcactg

SEQ ID NO: 3378894 - DNA, 15 bp, Homo sapiens
ggtggagagtggaag

SEQ ID NO: 3378895 - DNA, 21 bp, Homo sapiens
ggtggagagtggaaggactgt

SEQ ID NO: 3378896 - DNA, 15 bp, Homo sapiens
ggtggagggcacagc

SEQ ID NO: 3378897 - DNA, 20 bp, Homo sapiens
ggtggagggcacagccctcc

SEQ ID NO: 3378898 - DNA, 15 bp, Homo sapiens
ggtggagttgaaaga

SEQ ID NO: 3378899 - DNA, 13 bp, Homo sapiens
ggtggagtttctg

SEQ ID NO: 3378900 - DNA, 14 bp, Homo sapiens
ggtggatgcctggt

SEQ ID NO: 3378901 - DNA, 21 bp, Homo sapiens
ggtggatgcctggtggcagct

SEQ ID NO: 3378902 - DNA, 22 bp, Homo sapiens
ggtggatggccccagcacagct

SEQ ID NO: 3378903 - DNA, 13 bp, Homo sapiens
ggtggatgtaaat

SEQ ID NO: 3378904 - DNA, 17 bp, Homo sapiens
ggtggcacaggccccct

SEQ ID NO: 3378905 - DNA, 20 bp, Homo sapiens
ggtggcacctcctgagaagg

SEQ ID NO: 3378906 - DNA, 16 bp, Homo sapiens
ggtggcactgagcccc

SEQ ID NO: 3378907 - DNA, 15 bp, Homo sapiens
ggtggcagctgcggt

SEQ ID NO: 3378908 - DNA, 22 bp, Homo sapiens
ggtggcaggcacacagcagccc

SEQ ID NO: 3378909 - DNA, 23 bp, Homo sapiens
ggtggcaggcacacagcagcccc

SEQ ID NO: 3378910 - DNA, 18 bp, Homo sapiens
ggtggcatcctccggaga

SEQ ID NO: 3378911 - DNA, 23 bp, Homo sapiens
ggtggcatgtgcctatagtccca

SEQ ID NO: 3378912 - DNA, 20 bp, Homo sapiens
ggtggccactccagacccct

SEQ ID NO: 3378913 - DNA, 18 bp, Homo sapiens
ggtggccatccctgggcc

SEQ ID NO: 3378914 - DNA, 16 bp, Homo sapiens
ggtggcccgacagcct

SEQ ID NO: 3378915 - DNA, 18 bp, Homo sapiens
ggtggcccgacagcctgg

SEQ ID NO: 3378916 - DNA, 13 bp, Homo sapiens
ggtggccctgtcc

SEQ ID NO: 3378917 - DNA, 11 bp, Homo sapiens
ggtggcctcag

SEQ ID NO: 3378918 - DNA, 12 bp, Homo sapiens
ggtggcctcagc

SEQ ID NO: 3378919 - DNA, 15 bp, Homo sapiens
ggtggccttctgctg

SEQ ID NO: 3378920 - DNA, 21 bp, Homo sapiens
ggtggccttctgctgcccagg

SEQ ID NO: 3378921 - DNA, 20 bp, Homo sapiens
ggtggcgtgagcctgtagtc

SEQ ID NO: 3378922 - DNA, 16 bp, Homo sapiens
ggtggctcacacctgc

SEQ ID NO: 3378923 - DNA, 23 bp, Homo sapiens
ggtggctctgggaatgggagagg

SEQ ID NO: 3378924 - DNA, 21 bp, Homo sapiens
ggtggctgccccggcctcctc

SEQ ID NO: 3378925 - DNA, 12 bp, Homo sapiens
ggtggctgggca

SEQ ID NO: 3378926 - DNA, 18 bp, Homo sapiens
ggtggctgggttggaggg

SEQ ID NO: 3378927 - DNA, 21 bp, Homo sapiens
ggtggctttccttgtggcaga

SEQ ID NO: 3378928 - DNA, 13 bp, Homo sapiens
ggtgggacagcct

SEQ ID NO: 3378929 - DNA, 13 bp, Homo sapiens
ggtgggagcagga

SEQ ID NO: 3378930 - DNA, 13 bp, Homo sapiens
ggtgggcagctgg

SEQ ID NO: 3378931 - DNA, 18 bp, Homo sapiens
ggtgggcagctgggcccc

SEQ ID NO: 3378932 - DNA, 20 bp, Homo sapiens
ggtgggcccagaactgcccc

SEQ ID NO: 3378933 - DNA, 22 bp, Homo sapiens
ggtgggcccagaactgccccca

SEQ ID NO: 3378934 - DNA, 21 bp, Homo sapiens
ggtgggcccaggaccagctgg

SEQ ID NO: 3378935 - DNA, 23 bp, Homo sapiens
ggtgggcccaggaccagctgggg

SEQ ID NO: 3378936 - DNA, 13 bp, Homo sapiens
ggtgggcctggcc

SEQ ID NO: 3378937 - DNA, 18 bp, Homo sapiens
ggtgggcctggcctgagc

SEQ ID NO: 3378938 - DNA, 18 bp, Homo sapiens
ggtgggctgagccctggc

SEQ ID NO: 3378939 - DNA, 14 bp, Homo sapiens
ggtgggctggactt

SEQ ID NO: 3378940 - DNA, 11 bp, Homo sapiens
ggtggggaggg

SEQ ID NO: 3378941 - DNA, 13 bp, Homo sapiens
ggtggggaggggc

SEQ ID NO: 3378942 - DNA, 13 bp, Homo sapiens
ggtggggcagctt

SEQ ID NO: 3378943 - DNA, 15 bp, Homo sapiens
ggtggggccaggcca

SEQ ID NO: 3378944 - DNA, 14 bp, Homo sapiens
ggtggggccctgcc

SEQ ID NO: 3378945 - DNA, 12 bp, Homo sapiens
ggtggggctcgt

SEQ ID NO: 3378946 - DNA, 18 bp, Homo sapiens
ggtgggggctcctggtgg

SEQ ID NO: 3378947 - DNA, 23 bp, Homo sapiens
ggtggggtcctggagcagaccac

SEQ ID NO: 3378948 - DNA, 22 bp, Homo sapiens
ggtgggtctatgttccccagga

SEQ ID NO: 3378949 - DNA, 20 bp, Homo sapiens
ggtgggtgaaggcctggctg

SEQ ID NO: 3378950 - DNA, 14 bp, Homo sapiens
ggtgggtgctcaga

SEQ ID NO: 3378951 - DNA, 15 bp, Homo sapiens
ggtgggtgctgccct

SEQ ID NO: 3378952 - DNA, 12 bp, Homo sapiens
ggtggtaaagaa

SEQ ID NO: 3378953 - DNA, 22 bp, Homo sapiens
ggtggtaaatattttcaaagag

SEQ ID NO: 3378954 - DNA, 22 bp, Homo sapiens
ggtggtactttattcttgctgg

SEQ ID NO: 3378955 - DNA, 19 bp, Homo sapiens
ggtggtctgaatgttctga

SEQ ID NO: 3378956 - DNA, 15 bp, Homo sapiens
ggtggtgacctctgc

SEQ ID NO: 3378957 - DNA, 14 bp, Homo sapiens
ggtggtgcccgtgc

SEQ ID NO: 3378958 - DNA, 17 bp, Homo sapiens
ggtggtgcccgtgcccg

SEQ ID NO: 3378959 - DNA, 17 bp, Homo sapiens
ggtggtggcactgagcc

SEQ ID NO: 3378960 - DNA, 15 bp, Homo sapiens
ggtggtttgccatgt

SEQ ID NO: 3378961 - DNA, 17 bp, Homo sapiens
ggtggttttttccccct

SEQ ID NO: 3378962 - DNA, 19 bp, Homo sapiens
ggtgtaaagctggccctgc

SEQ ID NO: 3378963 - DNA, 16 bp, Homo sapiens
ggtgtaataagacata

SEQ ID NO: 3378964 - DNA, 18 bp, Homo sapiens
ggtgtactgggttaatgg

SEQ ID NO: 3378965 - DNA, 20 bp, Homo sapiens
ggtgtaggggccacctcctc

SEQ ID NO: 3378966 - DNA, 22 bp, Homo sapiens
ggtgtaggggccacctcctccc

SEQ ID NO: 3378967 - DNA, 21 bp, Homo sapiens
ggtgtatgccacacctggcct

SEQ ID NO: 3378968 - DNA, 23 bp, Homo sapiens
ggtgtcaaacattcgtgagctgg

SEQ ID NO: 3378969 - DNA, 19 bp, Homo sapiens
ggtgtcaagagggtctgag

SEQ ID NO: 3378970 - DNA, 17 bp, Homo sapiens
ggtgtcacatggggcct

SEQ ID NO: 3378971 - DNA, 19 bp, Homo sapiens
ggtgtcctgcagaagaagc

SEQ ID NO: 3378972 - DNA, 16 bp, Homo sapiens
ggtgtcctttcccctc

SEQ ID NO: 3378973 - DNA, 21 bp, Homo sapiens
ggtgtcgctctgctggcctgg

SEQ ID NO: 3378974 - DNA, 17 bp, Homo sapiens
ggtgtcgtctgtgaatg

SEQ ID NO: 3378975 - DNA, 20 bp, Homo sapiens
ggtgtcttgggcagagctgg

SEQ ID NO: 3378976 - DNA, 15 bp, Homo sapiens
ggtgtgaacccggga

SEQ ID NO: 3378977 - DNA, 16 bp, Homo sapiens
ggtgtgaacccgggag

SEQ ID NO: 3378978 - DNA, 17 bp, Homo sapiens
ggtgtgaacccgggagc

SEQ ID NO: 3378979 - DNA, 14 bp, Homo sapiens
ggtgtgaccatgtt

SEQ ID NO: 3378980 - DNA, 20 bp, Homo sapiens
ggtgtgcaatgtctgagtga

SEQ ID NO: 3378981 - DNA, 13 bp, Homo sapiens
ggtgtgctctgat

SEQ ID NO: 3378982 - DNA, 12 bp, Homo sapiens
ggtgtgctggga

SEQ ID NO: 3378983 - DNA, 12 bp, Homo sapiens
ggtgtggcctca

SEQ ID NO: 3378984 - DNA, 20 bp, Homo sapiens
ggtgtgggtggaagggctgg

SEQ ID NO: 3378985 - DNA, 15 bp, Homo sapiens
ggtgtggtgcagtgt

SEQ ID NO: 3378986 - DNA, 20 bp, Homo sapiens
ggtgtgtccctggacacagc

SEQ ID NO: 3378987 - DNA, 22 bp, Homo sapiens
ggtgtgtccctggacacagctc

SEQ ID NO: 3378988 - DNA, 23 bp, Homo sapiens
ggtgtgtccctggacacagctct

SEQ ID NO: 3378989 - DNA, 21 bp, Homo sapiens
ggtgtgttggacagagaaggg

SEQ ID NO: 3378990 - DNA, 21 bp, Homo sapiens
ggtgtgtttggcttggccttg

SEQ ID NO: 3378991 - DNA, 14 bp, Homo sapiens
ggtgtgtttttggg

SEQ ID NO: 3378992 - DNA, 17 bp, Homo sapiens
ggtgttcctggaagcag

SEQ ID NO: 3378993 - DNA, 13 bp, Homo sapiens
ggtgttctaagat

SEQ ID NO: 3378994 - DNA, 23 bp, Homo sapiens
ggtgttcttcttctcttctctgc

SEQ ID NO: 3378995 - DNA, 15 bp, Homo sapiens
ggtgtttcctctaaa

SEQ ID NO: 3378996 - DNA, 16 bp, Homo sapiens
ggtgtttgcttgaatg

SEQ ID NO: 3378997 - DNA, 17 bp, Homo sapiens
ggtgttttaaaaaatct

SEQ ID NO: 3378998 - DNA, 22 bp, Homo sapiens
ggttaaaactgtacatttaaaa

SEQ ID NO: 3378999 - DNA, 19 bp, Homo sapiens
ggttaatcatatttgaaaa

SEQ ID NO: 3379000 - DNA, 22 bp, Homo sapiens
ggttaatcatatttgaaaacca

SEQ ID NO: 3379001 - DNA, 14 bp, Homo sapiens
ggttacaaactgca

SEQ ID NO: 3379002 - DNA, 21 bp, Homo sapiens
ggttacactgttagaacacta

SEQ ID NO: 3379003 - DNA, 19 bp, Homo sapiens
ggttacaggaaggcaggag

SEQ ID NO: 3379004 - DNA, 18 bp, Homo sapiens
ggttacagtgcagacagg

SEQ ID NO: 3379005 - DNA, 22 bp, Homo sapiens
ggttactcagggttcatctgtc

SEQ ID NO: 3379006 - DNA, 18 bp, Homo sapiens
ggttagattcaaggcccc

SEQ ID NO: 3379007 - DNA, 20 bp, Homo sapiens
ggttaggagttcgagaccag

SEQ ID NO: 3379008 - DNA, 13 bp, Homo sapiens
ggttatacaataa

SEQ ID NO: 3379009 - DNA, 23 bp, Homo sapiens
ggttatcgaaataacaatgttaa

SEQ ID NO: 3379010 - DNA, 13 bp, Homo sapiens
ggttatctgcctg

SEQ ID NO: 3379011 - DNA, 18 bp, Homo sapiens
ggttatctgcctggcctg

SEQ ID NO: 3379012 - DNA, 21 bp, Homo sapiens
ggttatctgcctggcctggct

SEQ ID NO: 3379013 - DNA, 11 bp, Homo sapiens
ggttattttaa

SEQ ID NO: 3379014 - DNA, 19 bp, Homo sapiens
ggttattttaaatataaat

SEQ ID NO: 3379015 - DNA, 21 bp, Homo sapiens
ggttcaagcgattcttctgct

SEQ ID NO: 3379016 - DNA, 13 bp, Homo sapiens
ggttcacactcag

SEQ ID NO: 3379017 - DNA, 20 bp, Homo sapiens
ggttcacactcagaaagagg

SEQ ID NO: 3379018 - DNA, 16 bp, Homo sapiens
ggttcactgagctccc

SEQ ID NO: 3379019 - DNA, 17 bp, Homo sapiens
ggttcagacccctgcct

SEQ ID NO: 3379020 - DNA, 13 bp, Homo sapiens
ggttcaggcccgg

SEQ ID NO: 3379021 - DNA, 12 bp, Homo sapiens
ggttcagtttct

SEQ ID NO: 3379022 - DNA, 14 bp, Homo sapiens
ggttcagtttcttc

SEQ ID NO: 3379023 - DNA, 21 bp, Homo sapiens
ggttcataggtcactggctct

SEQ ID NO: 3379024 - DNA, 14 bp, Homo sapiens
ggttcatcagtgtt

SEQ ID NO: 3379025 - DNA, 15 bp, Homo sapiens
ggttcatcagtgtta

SEQ ID NO: 3379026 - DNA, 14 bp, Homo sapiens
ggttcatctgtcca

SEQ ID NO: 3379027 - DNA, 16 bp, Homo sapiens
ggttccaaccaggcag

SEQ ID NO: 3379028 - DNA, 14 bp, Homo sapiens
ggttccatcttgct

SEQ ID NO: 3379029 - DNA, 18 bp, Homo sapiens
ggttccatgcctgagggt

SEQ ID NO: 3379030 - DNA, 20 bp, Homo sapiens
ggttccatttttcctctgtt

SEQ ID NO: 3379031 - DNA, 15 bp, Homo sapiens
ggttcccctggcctt

SEQ ID NO: 3379032 - DNA, 17 bp, Homo sapiens
ggttccctttccttcca

SEQ ID NO: 3379033 - DNA, 21 bp, Homo sapiens
ggttccgcactttccacttct

SEQ ID NO: 3379034 - DNA, 15 bp, Homo sapiens
ggttcctctgcctgc

SEQ ID NO: 3379035 - DNA, 17 bp, Homo sapiens
ggttcctggtgactcct

SEQ ID NO: 3379036 - DNA, 11 bp, Homo sapiens
ggttctaaagt

SEQ ID NO: 3379037 - DNA, 15 bp, Homo sapiens
ggttctaaagttcta

SEQ ID NO: 3379038 - DNA, 11 bp, Homo sapiens
ggttctaaggc

SEQ ID NO: 3379039 - DNA, 23 bp, Homo sapiens
ggttctaaggcctaggattctaa

SEQ ID NO: 3379040 - DNA, 17 bp, Homo sapiens
ggttctcagagccaagt

SEQ ID NO: 3379041 - DNA, 19 bp, Homo sapiens
ggttctccgttagctcctg

SEQ ID NO: 3379042 - DNA, 16 bp, Homo sapiens
ggttctgcctgctttg

SEQ ID NO: 3379043 - DNA, 19 bp, Homo sapiens
ggttctgtgacccatctgt

SEQ ID NO: 3379044 - DNA, 15 bp, Homo sapiens
ggttcttaaaagcat

SEQ ID NO: 3379045 - DNA, 18 bp, Homo sapiens
ggttcttagttctcactg

SEQ ID NO: 3379046 - DNA, 14 bp, Homo sapiens
ggttctttcttcct

SEQ ID NO: 3379047 - DNA, 20 bp, Homo sapiens
ggttgaaaatgtgtttgctg

SEQ ID NO: 3379048 - DNA, 18 bp, Homo sapiens
ggttgaggggcctggaga

SEQ ID NO: 3379049 - DNA, 16 bp, Homo sapiens
ggttgatggaaaataa

SEQ ID NO: 3379050 - DNA, 19 bp, Homo sapiens
ggttgatggaaaataaaca

SEQ ID NO: 3379051 - DNA, 11 bp, Homo sapiens
ggttgcagtgc

SEQ ID NO: 3379052 - DNA, 14 bp, Homo sapiens
ggttgccacaggcc

SEQ ID NO: 3379053 - DNA, 20 bp, Homo sapiens
ggttgccacaggcctccctg

SEQ ID NO: 3379054 - DNA, 13 bp, Homo sapiens
ggttgcctggggg

SEQ ID NO: 3379055 - DNA, 15 bp, Homo sapiens
ggttgctggagcctg

SEQ ID NO: 3379056 - DNA, 14 bp, Homo sapiens
ggttggaccccaga

SEQ ID NO: 3379057 - DNA, 21 bp, Homo sapiens
ggttggcccctgcccggctgc

SEQ ID NO: 3379058 - DNA, 13 bp, Homo sapiens
ggttggctcccgc

SEQ ID NO: 3379059 - DNA, 21 bp, Homo sapiens
ggttgggcagccagaccagca

SEQ ID NO: 3379060 - DNA, 17 bp, Homo sapiens
ggttgggcccagatctg

SEQ ID NO: 3379061 - DNA, 14 bp, Homo sapiens
ggttgggctggtgt

SEQ ID NO: 3379062 - DNA, 14 bp, Homo sapiens
ggttggggtgacag

SEQ ID NO: 3379063 - DNA, 13 bp, Homo sapiens
ggttgtcaatatt

SEQ ID NO: 3379064 - DNA, 13 bp, Homo sapiens
ggttgttatgtga

SEQ ID NO: 3379065 - DNA, 22 bp, Homo sapiens
ggttgttgcaccatctgcttgg

SEQ ID NO: 3379066 - DNA, 14 bp, Homo sapiens
ggttgtttctgttc

SEQ ID NO: 3379067 - DNA, 19 bp, Homo sapiens
ggttgtttctgttccaaat

SEQ ID NO: 3379068 - DNA, 20 bp, Homo sapiens
ggttgttttttcctttgctc

SEQ ID NO: 3379069 - DNA, 18 bp, Homo sapiens
ggtttaaagaaagtgtat

SEQ ID NO: 3379070 - DNA, 22 bp, Homo sapiens
ggtttacatgtgatgttttagt

SEQ ID NO: 3379071 - DNA, 18 bp, Homo sapiens
ggtttcaaagatgctgtg

SEQ ID NO: 3379072 - DNA, 23 bp, Homo sapiens
ggtttcaaagtaaaggcctcctc

SEQ ID NO: 3379073 - DNA, 18 bp, Homo sapiens
ggtttcaagaaaatcttt

SEQ ID NO: 3379074 - DNA, 21 bp, Homo sapiens
ggtttcaattcagattgtctt

SEQ ID NO: 3379075 - DNA, 19 bp, Homo sapiens
ggtttcacctgggccctgg

SEQ ID NO: 3379076 - DNA, 13 bp, Homo sapiens
ggtttcatgttca

SEQ ID NO: 3379077 - DNA, 14 bp, Homo sapiens
ggtttccatatttt

SEQ ID NO: 3379078 - DNA, 19 bp, Homo sapiens
ggtttccccagggaaggaa

SEQ ID NO: 3379079 - DNA, 20 bp, Homo sapiens
ggtttcccttgccctttcca

SEQ ID NO: 3379080 - DNA, 18 bp, Homo sapiens
ggtttccttttggaacat

SEQ ID NO: 3379081 - DNA, 15 bp, Homo sapiens
ggtttcgactggtcc

SEQ ID NO: 3379082 - DNA, 22 bp, Homo sapiens
ggtttcgactggtccagctctg

SEQ ID NO: 3379083 - DNA, 18 bp, Homo sapiens
ggtttctctctacagtgc

SEQ ID NO: 3379084 - DNA, 18 bp, Homo sapiens
ggtttctttttttttcct

SEQ ID NO: 3379085 - DNA, 21 bp, Homo sapiens
ggtttgccaaaattcatttct

SEQ ID NO: 3379086 - DNA, 16 bp, Homo sapiens
ggtttggaatattaaa

SEQ ID NO: 3379087 - DNA, 19 bp, Homo sapiens
ggtttggggagcagagaca

SEQ ID NO: 3379088 - DNA, 17 bp, Homo sapiens
ggtttgggggcgccctc

SEQ ID NO: 3379089 - DNA, 13 bp, Homo sapiens
ggtttgtatattg

SEQ ID NO: 3379090 - DNA, 13 bp, Homo sapiens
ggttttacttaca

SEQ ID NO: 3379091 - DNA, 19 bp, Homo sapiens
ggttttattgtccttcaga

SEQ ID NO: 3379092 - DNA, 21 bp, Homo sapiens
ggttttctctaacttctcaag

SEQ ID NO: 3379093 - DNA, 17 bp, Homo sapiens
ggttttgcaataacttc

SEQ ID NO: 3379094 - DNA, 14 bp, Homo sapiens
ggttttggagtcag

SEQ ID NO: 3379095 - DNA, 15 bp, Homo sapiens
ggttttggagtcagt

SEQ ID NO: 3379096 - DNA, 17 bp, Homo sapiens
ggttttggagtcagtag

SEQ ID NO: 3379097 - DNA, 21 bp, Homo sapiens
ggttttggcaaacgctaaaga

SEQ ID NO: 3379098 - DNA, 20 bp, Homo sapiens
ggttttgtaagatgctgggt

SEQ ID NO: 3379099 - DNA, 21 bp, Homo sapiens
ggtttttatttctcgggtgca

SEQ ID NO: 3379100 - DNA, 12 bp, Homo sapiens
ggtttttccctg

SEQ ID NO: 3379101 - DNA, 12 bp, Homo sapiens
ggtttttgctct

SEQ ID NO: 3379102 - DNA, 23 bp, Homo sapiens
gtaaaaaaaaaaaaaatgttctt

SEQ ID NO: 3379103 - DNA, 13 bp, Homo sapiens
gtaaaaaaaaatg

SEQ ID NO: 3379104 - DNA, 15 bp, Homo sapiens
gtaaaaaacaaaaac

SEQ ID NO: 3379105 - DNA, 15 bp, Homo sapiens
gtaaaaaatggaaaa

SEQ ID NO: 3379106 - DNA, 21 bp, Homo sapiens
gtaaaaaatggaaaaaaacat

SEQ ID NO: 3379107 - DNA, 22 bp, Homo sapiens
gtaaaaacactgaaaaattata

SEQ ID NO: 3379108 - DNA, 19 bp, Homo sapiens
gtaaaaacagcattgcttt

SEQ ID NO: 3379109 - DNA, 20 bp, Homo sapiens
gtaaaaataaaatactttga

SEQ ID NO: 3379110 - DNA, 15 bp, Homo sapiens
gtaaaaatgctgctc

SEQ ID NO: 3379111 - DNA, 20 bp, Homo sapiens
gtaaaacaaaaatgtaatga

SEQ ID NO: 3379112 - DNA, 17 bp, Homo sapiens
gtaaaacagggccacat

SEQ ID NO: 3379113 - DNA, 17 bp, Homo sapiens
gtaaaacctgttctcca

SEQ ID NO: 3379114 - DNA, 16 bp, Homo sapiens
gtaaaaccttgttcta

SEQ ID NO: 3379115 - DNA, 19 bp, Homo sapiens
gtaaaagcagggcagcagg

SEQ ID NO: 3379116 - DNA, 12 bp, Homo sapiens
gtaaaagtctac

SEQ ID NO: 3379117 - DNA, 12 bp, Homo sapiens
gtaaaatacttt

SEQ ID NO: 3379118 - DNA, 22 bp, Homo sapiens
gtaaaatacttttactctgcct

SEQ ID NO: 3379119 - DNA, 22 bp, Homo sapiens
gtaaaatcccatctgctagaag

SEQ ID NO: 3379120 - DNA, 15 bp, Homo sapiens
gtaaaatgtctttcc

SEQ ID NO: 3379121 - DNA, 17 bp, Homo sapiens
gtaaaatgtctttccaa

SEQ ID NO: 3379122 - DNA, 20 bp, Homo sapiens
gtaaaatgtgaagtgaatga

SEQ ID NO: 3379123 - DNA, 22 bp, Homo sapiens
gtaaaatgtgaagtgaatgaaa

SEQ ID NO: 3379124 - DNA, 15 bp, Homo sapiens
gtaaaatgttgaata

SEQ ID NO: 3379125 - DNA, 16 bp, Homo sapiens
gtaaaatgttgaataa

SEQ ID NO: 3379126 - DNA, 17 bp, Homo sapiens
gtaaaattataaacttt

SEQ ID NO: 3379127 - DNA, 13 bp, Homo sapiens
gtaaaatttattt

SEQ ID NO: 3379128 - DNA, 23 bp, Homo sapiens
gtaaacaaaatttagtttttgtt

SEQ ID NO: 3379129 - DNA, 23 bp, Homo sapiens
gtaaacaacgtgtatagtgccta

SEQ ID NO: 3379130 - DNA, 19 bp, Homo sapiens
gtaaacagcctctttttga

SEQ ID NO: 3379131 - DNA, 23 bp, Homo sapiens
gtaaacataattcttgtatatta

SEQ ID NO: 3379132 - DNA, 20 bp, Homo sapiens
gtaaacctagtaaaaccttg

SEQ ID NO: 3379133 - DNA, 21 bp, Homo sapiens
gtaaacgtttcagtaataaaa

SEQ ID NO: 3379134 - DNA, 22 bp, Homo sapiens
gtaaactatcttggtgaatttt

SEQ ID NO: 3379135 - DNA, 16 bp, Homo sapiens
gtaaactatttatctg

SEQ ID NO: 3379136 - DNA, 21 bp, Homo sapiens
gtaaactatttatctgtgttt

SEQ ID NO: 3379137 - DNA, 16 bp, Homo sapiens
gtaaactcaaaatatt

SEQ ID NO: 3379138 - DNA, 23 bp, Homo sapiens
gtaaactcaaaatatttgtacat

SEQ ID NO: 3379139 - DNA, 17 bp, Homo sapiens
gtaaactggaattaaaa

SEQ ID NO: 3379140 - DNA, 19 bp, Homo sapiens
gtaaactgtactagtctgt

SEQ ID NO: 3379141 - DNA, 16 bp, Homo sapiens
gtaaactgtggatgat

SEQ ID NO: 3379142 - DNA, 18 bp, Homo sapiens
gtaaagactggttttctg

SEQ ID NO: 3379143 - DNA, 14 bp, Homo sapiens
gtaaagagacctac

SEQ ID NO: 3379144 - DNA, 23 bp, Homo sapiens
gtaaagagacctacctcaggttg

SEQ ID NO: 3379145 - DNA, 22 bp, Homo sapiens
gtaaagatatttttatctttat

SEQ ID NO: 3379146 - DNA, 15 bp, Homo sapiens
gtaaagccattaaat

SEQ ID NO: 3379147 - DNA, 13 bp, Homo sapiens
gtaaagctggccc

SEQ ID NO: 3379148 - DNA, 19 bp, Homo sapiens
gtaaaggcctcctccccca

SEQ ID NO: 3379149 - DNA, 21 bp, Homo sapiens
gtaaagtatgtaaacaggaga

SEQ ID NO: 3379150 - DNA, 21 bp, Homo sapiens
gtaaagtatgtttttaaattt

SEQ ID NO: 3379151 - DNA, 17 bp, Homo sapiens
gtaaagttacactttta

SEQ ID NO: 3379152 - DNA, 19 bp, Homo sapiens
gtaaataaaatgtgtacag

SEQ ID NO: 3379153 - DNA, 17 bp, Homo sapiens
gtaaataaactgtttat

SEQ ID NO: 3379154 - DNA, 19 bp, Homo sapiens
gtaaataaactgtttatat

SEQ ID NO: 3379155 - DNA, 15 bp, Homo sapiens
gtaaataataaataa

SEQ ID NO: 3379156 - DNA, 13 bp, Homo sapiens
gtaaataccagga

SEQ ID NO: 3379157 - DNA, 16 bp, Homo sapiens
gtaaataccattgaca

SEQ ID NO: 3379158 - DNA, 17 bp, Homo sapiens
gtaaataggaatcattc

SEQ ID NO: 3379159 - DNA, 20 bp, Homo sapiens
gtaaataggatttttagaat

SEQ ID NO: 3379160 - DNA, 13 bp, Homo sapiens
gtaaatattctat

SEQ ID NO: 3379161 - DNA, 14 bp, Homo sapiens
gtaaatattctata

SEQ ID NO: 3379162 - DNA, 15 bp, Homo sapiens
gtaaatattctatat

SEQ ID NO: 3379163 - DNA, 18 bp, Homo sapiens
gtaaatatttactctttg

SEQ ID NO: 3379164 - DNA, 17 bp, Homo sapiens
gtaaatcagtaagaggt

SEQ ID NO: 3379165 - DNA, 19 bp, Homo sapiens
gtaaatcctgccatttaaa

SEQ ID NO: 3379166 - DNA, 15 bp, Homo sapiens
gtaaatcctttttct

SEQ ID NO: 3379167 - DNA, 14 bp, Homo sapiens
gtaaatctgccaca

SEQ ID NO: 3379168 - DNA, 17 bp, Homo sapiens
gtaaatgcaaagttctg

SEQ ID NO: 3379169 - DNA, 22 bp, Homo sapiens
gtaaatgcctcttaaattatat

SEQ ID NO: 3379170 - DNA, 14 bp, Homo sapiens
gtaaatggttttgt

SEQ ID NO: 3379171 - DNA, 20 bp, Homo sapiens
gtaaatggttttgttttgca

SEQ ID NO: 3379172 - DNA, 12 bp, Homo sapiens
gtaaatgtttct

SEQ ID NO: 3379173 - DNA, 14 bp, Homo sapiens
gtaaatgtttcttt

SEQ ID NO: 3379174 - DNA, 19 bp, Homo sapiens
gtaaattaaacataaaaca

SEQ ID NO: 3379175 - DNA, 14 bp, Homo sapiens
gtaacaatacaaat

SEQ ID NO: 3379176 - DNA, 17 bp, Homo sapiens
gtaacaatacaaatgga

SEQ ID NO: 3379177 - DNA, 19 bp, Homo sapiens
gtaacaatacaaatggatt

SEQ ID NO: 3379178 - DNA, 21 bp, Homo sapiens
gtaacaattgtgtagcctttt

SEQ ID NO: 3379179 - DNA, 19 bp, Homo sapiens
gtaacaattttaatgctat

SEQ ID NO: 3379180 - DNA, 18 bp, Homo sapiens
gtaacagaacagcttcag

SEQ ID NO: 3379181 - DNA, 21 bp, Homo sapiens
gtaacagaacagcttcaggtt

SEQ ID NO: 3379182 - DNA, 22 bp, Homo sapiens
gtaacaggaaaattttaaaaat

SEQ ID NO: 3379183 - DNA, 12 bp, Homo sapiens
gtaacaggcaga

SEQ ID NO: 3379184 - DNA, 20 bp, Homo sapiens
gtaacagttcatgtttgctt

SEQ ID NO: 3379185 - DNA, 19 bp, Homo sapiens
gtaacatcactatccatgc

SEQ ID NO: 3379186 - DNA, 19 bp, Homo sapiens
gtaacatcataattacatt

SEQ ID NO: 3379187 - DNA, 23 bp, Homo sapiens
gtaacctaccccatgaagatatt

SEQ ID NO: 3379188 - DNA, 15 bp, Homo sapiens
gtaactaatgttatt

SEQ ID NO: 3379189 - DNA, 14 bp, Homo sapiens
gtaactactttata

SEQ ID NO: 3379190 - DNA, 20 bp, Homo sapiens
gtaactaggtttttgcttct

SEQ ID NO: 3379191 - DNA, 20 bp, Homo sapiens
gtaactcaccgtgctgtctt

SEQ ID NO: 3379192 - DNA, 19 bp, Homo sapiens
gtaactctaattcccattt

SEQ ID NO: 3379193 - DNA, 15 bp, Homo sapiens
gtaactgctgagcca

SEQ ID NO: 3379194 - DNA, 15 bp, Homo sapiens
gtaactgctttctgt

SEQ ID NO: 3379195 - DNA, 20 bp, Homo sapiens
gtaactgctttctgttccaa

SEQ ID NO: 3379196 - DNA, 14 bp, Homo sapiens
gtaacttaaaatag

SEQ ID NO: 3379197 - DNA, 16 bp, Homo sapiens
gtaacttatgtagata

SEQ ID NO: 3379198 - DNA, 20 bp, Homo sapiens
gtaacttcacattaaaaaat

SEQ ID NO: 3379199 - DNA, 17 bp, Homo sapiens
gtaactttactctgtgt

SEQ ID NO: 3379200 - DNA, 16 bp, Homo sapiens
gtaactttatgtgtaa

SEQ ID NO: 3379201 - DNA, 14 bp, Homo sapiens
gtaacttttgtgaa

SEQ ID NO: 3379202 - DNA, 17 bp, Homo sapiens
gtaacttttttgtgtat

SEQ ID NO: 3379203 - DNA, 20 bp, Homo sapiens
gtaagaaaacaaactaaatg

SEQ ID NO: 3379204 - DNA, 14 bp, Homo sapiens
gtaagaagaaagca

SEQ ID NO: 3379205 - DNA, 15 bp, Homo sapiens
gtaagaagacatgaa

SEQ ID NO: 3379206 - DNA, 17 bp, Homo sapiens
gtaagaattcagaagac

SEQ ID NO: 3379207 - DNA, 13 bp, Homo sapiens
gtaagacatctca

SEQ ID NO: 3379208 - DNA, 14 bp, Homo sapiens
gtaagagacagaat

SEQ ID NO: 3379209 - DNA, 17 bp, Homo sapiens
gtaagagcaccttcctc

SEQ ID NO: 3379210 - DNA, 14 bp, Homo sapiens
gtaagagctggtgt

SEQ ID NO: 3379211 - DNA, 18 bp, Homo sapiens
gtaagagtgtagaagcat

SEQ ID NO: 3379212 - DNA, 15 bp, Homo sapiens
gtaagatgcactgaa

SEQ ID NO: 3379213 - DNA, 11 bp, Homo sapiens
gtaagatgctg

SEQ ID NO: 3379214 - DNA, 22 bp, Homo sapiens
gtaagattatagattctaaaga

SEQ ID NO: 3379215 - DNA, 17 bp, Homo sapiens
gtaagccaaagaaatga

SEQ ID NO: 3379216 - DNA, 12 bp, Homo sapiens
gtaagccagagc

SEQ ID NO: 3379217 - DNA, 14 bp, Homo sapiens
gtaagccagagcct

SEQ ID NO: 3379218 - DNA, 24 bp, Homo sapiens
gtaagctcctttgtggagtgctgg

SEQ ID NO: 3379219 - DNA, 17 bp, Homo sapiens
gtaagctgctctattgt

SEQ ID NO: 3379220 - DNA, 18 bp, Homo sapiens
gtaaggatccggaaagaa

SEQ ID NO: 3379221 - DNA, 23 bp, Homo sapiens
gtaaggcagggtcccatttctca

SEQ ID NO: 3379222 - DNA, 15 bp, Homo sapiens
gtaagggatttctta

SEQ ID NO: 3379223 - DNA, 13 bp, Homo sapiens
gtaaggtgcagtt

SEQ ID NO: 3379224 - DNA, 22 bp, Homo sapiens
gtaagtcatctacttaataaat

SEQ ID NO: 3379225 - DNA, 18 bp, Homo sapiens
gtaagttaatgtatataa

SEQ ID NO: 3379226 - DNA, 13 bp, Homo sapiens
gtaagttgtacaa

SEQ ID NO: 3379227 - DNA, 15 bp, Homo sapiens
gtaagttgtacaaat

SEQ ID NO: 3379228 - DNA, 17 bp, Homo sapiens
gtaagttgtacaaatgt

SEQ ID NO: 3379229 - DNA, 16 bp, Homo sapiens
gtaagtttcaggtgac

SEQ ID NO: 3379230 - DNA, 22 bp, Homo sapiens
gtaagtttcaggtgacatgtga

SEQ ID NO: 3379231 - DNA, 13 bp, Homo sapiens
gtaataaaattaa

SEQ ID NO: 3379232 - DNA, 12 bp, Homo sapiens
gtaataaagtat

SEQ ID NO: 3379233 - DNA, 17 bp, Homo sapiens
gtaataaagtatataat

SEQ ID NO: 3379234 - DNA, 19 bp, Homo sapiens
gtaataagacataacgttt

SEQ ID NO: 3379235 - DNA, 23 bp, Homo sapiens
gtaataagacataacgtttttcc

SEQ ID NO: 3379236 - DNA, 22 bp, Homo sapiens
gtaatagttcagtagaattacc

SEQ ID NO: 3379237 - DNA, 15 bp, Homo sapiens
gtaatatattgtaca

SEQ ID NO: 3379238 - DNA, 16 bp, Homo sapiens
gtaatatttaaatatt

SEQ ID NO: 3379239 - DNA, 14 bp, Homo sapiens
gtaatcactcccat

SEQ ID NO: 3379240 - DNA, 16 bp, Homo sapiens
gtaatcagctctcctg

SEQ ID NO: 3379241 - DNA, 18 bp, Homo sapiens
gtaatcagctctcctggc

SEQ ID NO: 3379242 - DNA, 15 bp, Homo sapiens
gtaatcatttgttta

SEQ ID NO: 3379243 - DNA, 18 bp, Homo sapiens
gtaatcatttgtttacat

SEQ ID NO: 3379244 - DNA, 20 bp, Homo sapiens
gtaatcccagcactttggga

SEQ ID NO: 3379245 - DNA, 22 bp, Homo sapiens
gtaatctatgaattctaagtga

SEQ ID NO: 3379246 - DNA, 13 bp, Homo sapiens
gtaatctttaaac

SEQ ID NO: 3379247 - DNA, 16 bp, Homo sapiens
gtaatctttatactgg

SEQ ID NO: 3379248 - DNA, 21 bp, Homo sapiens
gtaatgaatttttatgatatt

SEQ ID NO: 3379249 - DNA, 21 bp, Homo sapiens
gtaatgatactgattatgaaa

SEQ ID NO: 3379250 - DNA, 16 bp, Homo sapiens
gtaatggaactgaccc

SEQ ID NO: 3379251 - DNA, 13 bp, Homo sapiens
gtaatggcagagc

SEQ ID NO: 3379252 - DNA, 12 bp, Homo sapiens
gtaatgggcctg

SEQ ID NO: 3379253 - DNA, 15 bp, Homo sapiens
gtaatgggcctgccc

SEQ ID NO: 3379254 - DNA, 14 bp, Homo sapiens
gtaatggtgtagaa

SEQ ID NO: 3379255 - DNA, 20 bp, Homo sapiens
gtaatgtagcgtgtttacat

SEQ ID NO: 3379256 - DNA, 17 bp, Homo sapiens
gtaatgtggaagaaaat

SEQ ID NO: 3379257 - DNA, 14 bp, Homo sapiens
gtaatgttactgat

SEQ ID NO: 3379258 - DNA, 17 bp, Homo sapiens
gtaatgttactgatcat

SEQ ID NO: 3379259 - DNA, 15 bp, Homo sapiens
gtaatgttttgtata

SEQ ID NO: 3379260 - DNA, 17 bp, Homo sapiens
gtaattaaagtagatta

SEQ ID NO: 3379261 - DNA, 14 bp, Homo sapiens
gtaattaaattatg

SEQ ID NO: 3379262 - DNA, 17 bp, Homo sapiens
gtaattaagtactatgt

SEQ ID NO: 3379263 - DNA, 20 bp, Homo sapiens
gtaattaagtactatgtatc

SEQ ID NO: 3379264 - DNA, 21 bp, Homo sapiens
gtaattaagtactatgtatca

SEQ ID NO: 3379265 - DNA, 21 bp, Homo sapiens
gtaattatgcactaaatatga

SEQ ID NO: 3379266 - DNA, 14 bp, Homo sapiens
gtaattcaagaaaa

SEQ ID NO: 3379267 - DNA, 14 bp, Homo sapiens
gtaattctaaatga

SEQ ID NO: 3379268 - DNA, 18 bp, Homo sapiens
gtaattctaaatgaatgt

SEQ ID NO: 3379269 - DNA, 18 bp, Homo sapiens
gtaattgacggtttttta

SEQ ID NO: 3379270 - DNA, 16 bp, Homo sapiens
gtaattgcttacattt

SEQ ID NO: 3379271 - DNA, 23 bp, Homo sapiens
gtaattgcttacatttttacaat

SEQ ID NO: 3379272 - DNA, 13 bp, Homo sapiens
gtaattgtgaaaa

SEQ ID NO: 3379273 - DNA, 17 bp, Homo sapiens
gtaattgtgtaaaaaat

SEQ ID NO: 3379274 - DNA, 21 bp, Homo sapiens
gtaattgtgtggattctttaa

SEQ ID NO: 3379275 - DNA, 19 bp, Homo sapiens
gtaattgttttttaaagca

SEQ ID NO: 3379276 - DNA, 14 bp, Homo sapiens
gtaatttaaacagg

SEQ ID NO: 3379277 - DNA, 21 bp, Homo sapiens
gtaatttaaacaggcccagca

SEQ ID NO: 3379278 - DNA, 15 bp, Homo sapiens
gtaatttaatgaaaa

SEQ ID NO: 3379279 - DNA, 19 bp, Homo sapiens
gtaatttagaaactgattt

SEQ ID NO: 3379280 - DNA, 15 bp, Homo sapiens
gtaatttataaaatt

SEQ ID NO: 3379281 - DNA, 12 bp, Homo sapiens
gtaatttatgca

SEQ ID NO: 3379282 - DNA, 13 bp, Homo sapiens
gtaatttatgcaa

SEQ ID NO: 3379283 - DNA, 15 bp, Homo sapiens
gtaatttattgtctg

SEQ ID NO: 3379284 - DNA, 21 bp, Homo sapiens
gtaatttctttttttcctttt

SEQ ID NO: 3379285 - DNA, 16 bp, Homo sapiens
gtaatttgaggacaac

SEQ ID NO: 3379286 - DNA, 20 bp, Homo sapiens
gtaatttgatggtatttctt

SEQ ID NO: 3379287 - DNA, 23 bp, Homo sapiens
gtaatttgatggtatttctttct

SEQ ID NO: 3379288 - DNA, 15 bp, Homo sapiens
gtaatttgtgtaata

SEQ ID NO: 3379289 - DNA, 22 bp, Homo sapiens
gtaattttaaaagtctatttta

SEQ ID NO: 3379290 - DNA, 15 bp, Homo sapiens
gtaattttatatgaa

SEQ ID NO: 3379291 - DNA, 18 bp, Homo sapiens
gtaattttatatgaagat

SEQ ID NO: 3379292 - DNA, 16 bp, Homo sapiens
gtaattttattttaaa

SEQ ID NO: 3379293 - DNA, 15 bp, Homo sapiens
gtaattttgtcacat

SEQ ID NO: 3379294 - DNA, 21 bp, Homo sapiens
gtaatttttggggaaaaaagc

SEQ ID NO: 3379295 - DNA, 23 bp, Homo sapiens
gtaatttttggggaaaaaagcac

SEQ ID NO: 3379296 - DNA, 22 bp, Homo sapiens
gtaattttttttgttttttgta

SEQ ID NO: 3379297 - DNA, 23 bp, Homo sapiens
gtacaaaaattgttcaacctaaa

SEQ ID NO: 3379298 - DNA, 16 bp, Homo sapiens
gtacaaaataaacaaa

SEQ ID NO: 3379299 - DNA, 12 bp, Homo sapiens
gtacaaaattaa

SEQ ID NO: 3379300 - DNA, 14 bp, Homo sapiens
gtacaaaattaagc

SEQ ID NO: 3379301 - DNA, 16 bp, Homo sapiens
gtacaaagttttcctt

SEQ ID NO: 3379302 - DNA, 17 bp, Homo sapiens
gtacaaagttttccttt

SEQ ID NO: 3379303 - DNA, 18 bp, Homo sapiens
gtacaaatgtaagcaaag

SEQ ID NO: 3379304 - DNA, 14 bp, Homo sapiens
gtacaaatgtattt

SEQ ID NO: 3379305 - DNA, 16 bp, Homo sapiens
gtacaaatgtattttg

SEQ ID NO: 3379306 - DNA, 17 bp, Homo sapiens
gtacaaatgtattttga

SEQ ID NO: 3379307 - DNA, 17 bp, Homo sapiens
gtacaaggtaattgttt

SEQ ID NO: 3379308 - DNA, 22 bp, Homo sapiens
gtacaataagtgtttttgtatt

SEQ ID NO: 3379309 - DNA, 21 bp, Homo sapiens
gtacaatcaaaacacactact

SEQ ID NO: 3379310 - DNA, 17 bp, Homo sapiens
gtacaatcctttgagtt

SEQ ID NO: 3379311 - DNA, 18 bp, Homo sapiens
gtacaatcttagtgaatg

SEQ ID NO: 3379312 - DNA, 17 bp, Homo sapiens
gtacaatgtgtttttct

SEQ ID NO: 3379313 - DNA, 21 bp, Homo sapiens
gtacaattactaaattgtata

SEQ ID NO: 3379314 - DNA, 20 bp, Homo sapiens
gtacacagctctagacactg

SEQ ID NO: 3379315 - DNA, 12 bp, Homo sapiens
gtacactgctgt

SEQ ID NO: 3379316 - DNA, 17 bp, Homo sapiens
gtacacttggtgtactg

SEQ ID NO: 3379317 - DNA, 18 bp, Homo sapiens
gtacacttggtgtactgg

SEQ ID NO: 3379318 - DNA, 14 bp, Homo sapiens
gtacagaaagctgc

SEQ ID NO: 3379319 - DNA, 15 bp, Homo sapiens
gtacagaattttgga

SEQ ID NO: 3379320 - DNA, 15 bp, Homo sapiens
gtacagactgtttta

SEQ ID NO: 3379321 - DNA, 18 bp, Homo sapiens
gtacagactgttttactg

SEQ ID NO: 3379322 - DNA, 16 bp, Homo sapiens
gtacagacttgttgtg

SEQ ID NO: 3379323 - DNA, 13 bp, Homo sapiens
gtacagctgggct

SEQ ID NO: 3379324 - DNA, 13 bp, Homo sapiens
gtacagtattttg

SEQ ID NO: 3379325 - DNA, 12 bp, Homo sapiens
gtacagtctgtc

SEQ ID NO: 3379326 - DNA, 21 bp, Homo sapiens
gtacagttatttatgcctctg

SEQ ID NO: 3379327 - DNA, 14 bp, Homo sapiens
gtacagtttgctgt

SEQ ID NO: 3379328 - DNA, 15 bp, Homo sapiens
gtacagtttgctgta

SEQ ID NO: 3379329 - DNA, 15 bp, Homo sapiens
gtacataaaattttc

SEQ ID NO: 3379330 - DNA, 15 bp, Homo sapiens
gtacataaacaatga

SEQ ID NO: 3379331 - DNA, 20 bp, Homo sapiens
gtacataaattgcataaagc

SEQ ID NO: 3379332 - DNA, 16 bp, Homo sapiens
gtacataactctgtaa

SEQ ID NO: 3379333 - DNA, 19 bp, Homo sapiens
gtacataccctggccgccc

SEQ ID NO: 3379334 - DNA, 17 bp, Homo sapiens
gtacatagttatttatt

SEQ ID NO: 3379335 - DNA, 18 bp, Homo sapiens
gtacatagttatttattt

SEQ ID NO: 3379336 - DNA, 23 bp, Homo sapiens
gtacatataaatgaatctggtgt

SEQ ID NO: 3379337 - DNA, 23 bp, Homo sapiens
gtacatattgttagggtcagcca

SEQ ID NO: 3379338 - DNA, 20 bp, Homo sapiens
gtacatatttgtggaataat

SEQ ID NO: 3379339 - DNA, 20 bp, Homo sapiens
gtacatctattttggattgt

SEQ ID NO: 3379340 - DNA, 14 bp, Homo sapiens
gtacatctggcctt

SEQ ID NO: 3379341 - DNA, 16 bp, Homo sapiens
gtacatctggcttatt

SEQ ID NO: 3379342 - DNA, 13 bp, Homo sapiens
gtacatttaaatt

SEQ ID NO: 3379343 - DNA, 14 bp, Homo sapiens
gtacatttaaattt

SEQ ID NO: 3379344 - DNA, 15 bp, Homo sapiens
gtacatttataattg

SEQ ID NO: 3379345 - DNA, 14 bp, Homo sapiens
gtacatttatgatt

SEQ ID NO: 3379346 - DNA, 18 bp, Homo sapiens
gtacatttatgatttaat

SEQ ID NO: 3379347 - DNA, 19 bp, Homo sapiens
gtacatttatgatttaata

SEQ ID NO: 3379348 - DNA, 21 bp, Homo sapiens
gtacatttatgatttaataaa

SEQ ID NO: 3379349 - DNA, 19 bp, Homo sapiens
gtacattttgttgtaaaaa

SEQ ID NO: 3379350 - DNA, 23 bp, Homo sapiens
gtacattttgttgtaaaaagaaa

SEQ ID NO: 3379351 - DNA, 15 bp, Homo sapiens
gtaccaaatctgaca

SEQ ID NO: 3379352 - DNA, 18 bp, Homo sapiens
gtaccaaatctgacatat

SEQ ID NO: 3379353 - DNA, 20 bp, Homo sapiens
gtaccaaatctgacatatta

SEQ ID NO: 3379354 - DNA, 14 bp, Homo sapiens
gtaccaatcatttt

SEQ ID NO: 3379355 - DNA, 15 bp, Homo sapiens
gtaccaatcatttta

SEQ ID NO: 3379356 - DNA, 15 bp, Homo sapiens
gtaccaatgctgttg

SEQ ID NO: 3379357 - DNA, 13 bp, Homo sapiens
gtaccagcatgtt

SEQ ID NO: 3379358 - DNA, 21 bp, Homo sapiens
gtaccagcgctctaaaagcac

SEQ ID NO: 3379359 - DNA, 17 bp, Homo sapiens
gtaccaggggctgggct

SEQ ID NO: 3379360 - DNA, 18 bp, Homo sapiens
gtaccaggggctgggctc

SEQ ID NO: 3379361 - DNA, 19 bp, Homo sapiens
gtaccaggggctgggctcc

SEQ ID NO: 3379362 - DNA, 22 bp, Homo sapiens
gtaccaggggctgggctccctg

SEQ ID NO: 3379363 - DNA, 11 bp, Homo sapiens
gtaccagttaa

SEQ ID NO: 3379364 - DNA, 16 bp, Homo sapiens
gtaccagttaattttt

SEQ ID NO: 3379365 - DNA, 18 bp, Homo sapiens
gtaccatggttgtgcaca

SEQ ID NO: 3379366 - DNA, 12 bp, Homo sapiens
gtacccactgct

SEQ ID NO: 3379367 - DNA, 13 bp, Homo sapiens
gtacccagatgcc

SEQ ID NO: 3379368 - DNA, 12 bp, Homo sapiens
gtacccagccat

SEQ ID NO: 3379369 - DNA, 12 bp, Homo sapiens
gtaccccaccct

SEQ ID NO: 3379370 - DNA, 13 bp, Homo sapiens
gtaccccaccctc

SEQ ID NO: 3379371 - DNA, 15 bp, Homo sapiens
gtaccctctggaggg

SEQ ID NO: 3379372 - DNA, 13 bp, Homo sapiens
gtacctataaagt

SEQ ID NO: 3379373 - DNA, 12 bp, Homo sapiens
gtacctcagtgg

SEQ ID NO: 3379374 - DNA, 21 bp, Homo sapiens
gtacctcagtggatcttcaga

SEQ ID NO: 3379375 - DNA, 12 bp, Homo sapiens
gtacctgaaaag

SEQ ID NO: 3379376 - DNA, 14 bp, Homo sapiens
gtacctgaaaagta

SEQ ID NO: 3379377 - DNA, 12 bp, Homo sapiens
gtacctgctgcc

SEQ ID NO: 3379378 - DNA, 22 bp, Homo sapiens
gtacctgggaaaggacccaccc

SEQ ID NO: 3379379 - DNA, 11 bp, Homo sapiens
gtaccttgctt

SEQ ID NO: 3379380 - DNA, 23 bp, Homo sapiens
gtaccttgcttcttactgataat

SEQ ID NO: 3379381 - DNA, 14 bp, Homo sapiens
gtacgtctgacagg

SEQ ID NO: 3379382 - DNA, 15 bp, Homo sapiens
gtacgtctgacaggc

SEQ ID NO: 3379383 - DNA, 17 bp, Homo sapiens
gtacgtttgtatgtgtg

SEQ ID NO: 3379384 - DNA, 15 bp, Homo sapiens
gtactacctgtgtat

SEQ ID NO: 3379385 - DNA, 21 bp, Homo sapiens
gtactactagatgtctttagg

SEQ ID NO: 3379386 - DNA, 19 bp, Homo sapiens
gtactagaatttgtatttt

SEQ ID NO: 3379387 - DNA, 22 bp, Homo sapiens
gtactagagatctggttttgct

SEQ ID NO: 3379388 - DNA, 15 bp, Homo sapiens
gtactatgtatcaat

SEQ ID NO: 3379389 - DNA, 15 bp, Homo sapiens
gtactcactgaagcc

SEQ ID NO: 3379390 - DNA, 20 bp, Homo sapiens
gtactcactgaagcctgcgt

SEQ ID NO: 3379391 - DNA, 15 bp, Homo sapiens
gtactcagagcagag

SEQ ID NO: 3379392 - DNA, 15 bp, Homo sapiens
gtactccctctcagg

SEQ ID NO: 3379393 - DNA, 16 bp, Homo sapiens
gtactcctgcaaaatt

SEQ ID NO: 3379394 - DNA, 17 bp, Homo sapiens
gtactctctgctctagc

SEQ ID NO: 3379395 - DNA, 19 bp, Homo sapiens
gtactctctgctctagcca

SEQ ID NO: 3379396 - DNA, 21 bp, Homo sapiens
gtactctctgctctagccagg

SEQ ID NO: 3379397 - DNA, 23 bp, Homo sapiens
gtactgaaagccttagggaagct

SEQ ID NO: 3379398 - DNA, 14 bp, Homo sapiens
gtactgataaaata

SEQ ID NO: 3379399 - DNA, 14 bp, Homo sapiens
gtactgatttcagt

SEQ ID NO: 3379400 - DNA, 21 bp, Homo sapiens
gtactgccccccatgaggaag

SEQ ID NO: 3379401 - DNA, 13 bp, Homo sapiens
gtactgtaataat

SEQ ID NO: 3379402 - DNA, 20 bp, Homo sapiens
gtactgtaataatacctcaa

SEQ ID NO: 3379403 - DNA, 13 bp, Homo sapiens
gtactgtactaat

SEQ ID NO: 3379404 - DNA, 21 bp, Homo sapiens
gtactgtatggaaacactgat

SEQ ID NO: 3379405 - DNA, 23 bp, Homo sapiens
gtactgtatggaaacactgattt

SEQ ID NO: 3379406 - DNA, 14 bp, Homo sapiens
gtactgttctgtgt

SEQ ID NO: 3379407 - DNA, 20 bp, Homo sapiens
gtactgtttaccatttttca

SEQ ID NO: 3379408 - DNA, 23 bp, Homo sapiens
gtacttagccagttcaaagtgta

SEQ ID NO: 3379409 - DNA, 20 bp, Homo sapiens
gtacttccaatttataatga

SEQ ID NO: 3379410 - DNA, 14 bp, Homo sapiens
gtacttctccaccc

SEQ ID NO: 3379411 - DNA, 15 bp, Homo sapiens
gtacttctccaccct

SEQ ID NO: 3379412 - DNA, 14 bp, Homo sapiens
gtacttctgtgttc

SEQ ID NO: 3379413 - DNA, 19 bp, Homo sapiens
gtacttctgtgttcatttt

SEQ ID NO: 3379414 - DNA, 16 bp, Homo sapiens
gtacttcttattgcaa

SEQ ID NO: 3379415 - DNA, 19 bp, Homo sapiens
gtacttcttgaatataaaa

SEQ ID NO: 3379416 - DNA, 18 bp, Homo sapiens
gtacttgatactgaatgc

SEQ ID NO: 3379417 - DNA, 21 bp, Homo sapiens
gtacttgatactgaatgcata

SEQ ID NO: 3379418 - DNA, 23 bp, Homo sapiens
gtacttgatttgatgtgactttt

SEQ ID NO: 3379419 - DNA, 16 bp, Homo sapiens
gtacttgtttctctgt

SEQ ID NO: 3379420 - DNA, 16 bp, Homo sapiens
gtactttaaaaaggaa

SEQ ID NO: 3379421 - DNA, 20 bp, Homo sapiens
gtactttatcatgaatgctt

SEQ ID NO: 3379422 - DNA, 13 bp, Homo sapiens
gtactttattctt

SEQ ID NO: 3379423 - DNA, 14 bp, Homo sapiens
gtactttattcttg

SEQ ID NO: 3379424 - DNA, 15 bp, Homo sapiens
gtactttcttataaa

SEQ ID NO: 3379425 - DNA, 17 bp, Homo sapiens
gtacttttcattctctt

SEQ ID NO: 3379426 - DNA, 18 bp, Homo sapiens
gtacttttcattctcttt

SEQ ID NO: 3379427 - DNA, 21 bp, Homo sapiens
gtacttttcattctcttttaa

SEQ ID NO: 3379428 - DNA, 18 bp, Homo sapiens
gtacttttgttgtatggg

SEQ ID NO: 3379429 - DNA, 20 bp, Homo sapiens
gtacttttttaaatattttc

SEQ ID NO: 3379430 - DNA, 21 bp, Homo sapiens
gtacttttttaaatattttct

SEQ ID NO: 3379431 - DNA, 16 bp, Homo sapiens
gtagaaaatttgcttt

SEQ ID NO: 3379432 - DNA, 18 bp, Homo sapiens
gtagaaacatttagattt

SEQ ID NO: 3379433 - DNA, 16 bp, Homo sapiens
gtagaaataatatgca

SEQ ID NO: 3379434 - DNA, 17 bp, Homo sapiens
gtagaaataatatgcat

SEQ ID NO: 3379435 - DNA, 14 bp, Homo sapiens
gtagaaatgatgat

SEQ ID NO: 3379436 - DNA, 14 bp, Homo sapiens
gtagaacaaaaaac

SEQ ID NO: 3379437 - DNA, 16 bp, Homo sapiens
gtagaactcactctgg

SEQ ID NO: 3379438 - DNA, 17 bp, Homo sapiens
gtagaactcactctggg

SEQ ID NO: 3379439 - DNA, 17 bp, Homo sapiens
gtagaacttactattca

SEQ ID NO: 3379440 - DNA, 20 bp, Homo sapiens
gtagaagatttgatgctgga

SEQ ID NO: 3379441 - DNA, 22 bp, Homo sapiens
gtagaagcattccttctttgat

SEQ ID NO: 3379442 - DNA, 21 bp, Homo sapiens
gtagaagtcttagatgtatat

SEQ ID NO: 3379443 - DNA, 17 bp, Homo sapiens
gtagaattatctaattt

SEQ ID NO: 3379444 - DNA, 14 bp, Homo sapiens
gtagaattgtatat

SEQ ID NO: 3379445 - DNA, 17 bp, Homo sapiens
gtagacctagggaggac

SEQ ID NO: 3379446 - DNA, 21 bp, Homo sapiens
gtagacctgtgagaaaacgtt

SEQ ID NO: 3379447 - DNA, 21 bp, Homo sapiens
gtagacggctcagtatagata

SEQ ID NO: 3379448 - DNA, 13 bp, Homo sapiens
gtagactagtgcc

SEQ ID NO: 3379449 - DNA, 15 bp, Homo sapiens
gtagactatatacat

SEQ ID NO: 3379450 - DNA, 16 bp, Homo sapiens
gtagactatatacatg

SEQ ID NO: 3379451 - DNA, 21 bp, Homo sapiens
gtagactgatgttttagcatt

SEQ ID NO: 3379452 - DNA, 12 bp, Homo sapiens
gtagagacaggg

SEQ ID NO: 3379453 - DNA, 16 bp, Homo sapiens
gtagagacccccaggc

SEQ ID NO: 3379454 - DNA, 13 bp, Homo sapiens
gtagagaggcccg

SEQ ID NO: 3379455 - DNA, 16 bp, Homo sapiens
gtagaggcctggggcc

SEQ ID NO: 3379456 - DNA, 16 bp, Homo sapiens
gtagaggctccccagg

SEQ ID NO: 3379457 - DNA, 22 bp, Homo sapiens
gtagagtcttacaatcaaatct

SEQ ID NO: 3379458 - DNA, 18 bp, Homo sapiens
gtagagttaagaagctgt

SEQ ID NO: 3379459 - DNA, 14 bp, Homo sapiens
gtagatagaaataa

SEQ ID NO: 3379460 - DNA, 13 bp, Homo sapiens
gtagatatttggc

SEQ ID NO: 3379461 - DNA, 14 bp, Homo sapiens
gtagatatttggct

SEQ ID NO: 3379462 - DNA, 13 bp, Homo sapiens
gtagatccagatc

SEQ ID NO: 3379463 - DNA, 21 bp, Homo sapiens
gtagatccagatccagactgt

SEQ ID NO: 3379464 - DNA, 15 bp, Homo sapiens
gtagatccatttcca

SEQ ID NO: 3379465 - DNA, 20 bp, Homo sapiens
gtagatcgcttgagcccagg

SEQ ID NO: 3379466 - DNA, 19 bp, Homo sapiens
gtagatgcatgacttgtgt

SEQ ID NO: 3379467 - DNA, 19 bp, Homo sapiens
gtagatgggggaactgtga

SEQ ID NO: 3379468 - DNA, 13 bp, Homo sapiens
gtagatgggtggg

SEQ ID NO: 3379469 - DNA, 14 bp, Homo sapiens
gtagatgggtgggg

SEQ ID NO: 3379470 - DNA, 16 bp, Homo sapiens
gtagatgggtgggggc

SEQ ID NO: 3379471 - DNA, 13 bp, Homo sapiens
gtagatgttctag

SEQ ID NO: 3379472 - DNA, 15 bp, Homo sapiens
gtagatgttctagga

SEQ ID NO: 3379473 - DNA, 20 bp, Homo sapiens
gtagattatggcctttttaa

SEQ ID NO: 3379474 - DNA, 14 bp, Homo sapiens
gtagattgcttctg

SEQ ID NO: 3379475 - DNA, 13 bp, Homo sapiens
gtagcagctggac

SEQ ID NO: 3379476 - DNA, 19 bp, Homo sapiens
gtagcataaataaaactga

SEQ ID NO: 3379477 - DNA, 13 bp, Homo sapiens
gtagcataactgt

SEQ ID NO: 3379478 - DNA, 13 bp, Homo sapiens
gtagcatacattt

SEQ ID NO: 3379479 - DNA, 21 bp, Homo sapiens
gtagcatgggtccaagagaca

SEQ ID NO: 3379480 - DNA, 14 bp, Homo sapiens
gtagccaaaggttc

SEQ ID NO: 3379481 - DNA, 18 bp, Homo sapiens
gtagccaaggtgggctga

SEQ ID NO: 3379482 - DNA, 19 bp, Homo sapiens
gtagccagggggactagcc

SEQ ID NO: 3379483 - DNA, 23 bp, Homo sapiens
gtagccatgatttgtcccagcct

SEQ ID NO: 3379484 - DNA, 22 bp, Homo sapiens
gtagccatggctcaggcaagcc

SEQ ID NO: 3379485 - DNA, 14 bp, Homo sapiens
gtagccctttctgt

SEQ ID NO: 3379486 - DNA, 22 bp, Homo sapiens
gtagccgagtcacacccggtgg

SEQ ID NO: 3379487 - DNA, 20 bp, Homo sapiens
gtagcctaaagggcagggcc

SEQ ID NO: 3379488 - DNA, 19 bp, Homo sapiens
gtagcctccgtttatgggc

SEQ ID NO: 3379489 - DNA, 20 bp, Homo sapiens
gtagcctccgtttatgggcc

SEQ ID NO: 3379490 - DNA, 23 bp, Homo sapiens
gtagccttgcccggattctggga

SEQ ID NO: 3379491 - DNA, 13 bp, Homo sapiens
gtagctatatcta

SEQ ID NO: 3379492 - DNA, 19 bp, Homo sapiens
gtagctcaagtttaaaagc

SEQ ID NO: 3379493 - DNA, 22 bp, Homo sapiens
gtagctctaggagggctggcaa

SEQ ID NO: 3379494 - DNA, 13 bp, Homo sapiens
gtagctctgcctc

SEQ ID NO: 3379495 - DNA, 18 bp, Homo sapiens
gtagctctgcctccctct

SEQ ID NO: 3379496 - DNA, 16 bp, Homo sapiens
gtagctgcaaaaataa

SEQ ID NO: 3379497 - DNA, 10 bp, Homo sapiens
gtagctgcga

SEQ ID NO: 3379498 - DNA, 12 bp, Homo sapiens
gtagctgggact

SEQ ID NO: 3379499 - DNA, 19 bp, Homo sapiens
gtagctgggactacaggca

SEQ ID NO: 3379500 - DNA, 21 bp, Homo sapiens
gtagctgggactacaggcacc

SEQ ID NO: 3379501 - DNA, 18 bp, Homo sapiens
gtagctgggatgacaggc

SEQ ID NO: 3379502 - DNA, 17 bp, Homo sapiens
gtagcttaccagaagct

SEQ ID NO: 3379503 - DNA, 22 bp, Homo sapiens
gtagcttacctgacacaagagg

SEQ ID NO: 3379504 - DNA, 14 bp, Homo sapiens
gtagcttgctccct

SEQ ID NO: 3379505 - DNA, 17 bp, Homo sapiens
gtaggaagagtagcatt

SEQ ID NO: 3379506 - DNA, 14 bp, Homo sapiens
gtaggactgtatag

SEQ ID NO: 3379507 - DNA, 23 bp, Homo sapiens
gtaggcctataaaattaaatgcc

SEQ ID NO: 3379508 - DNA, 20 bp, Homo sapiens
gtaggccttttaacattttg

SEQ ID NO: 3379509 - DNA, 13 bp, Homo sapiens
gtaggctggggcg

SEQ ID NO: 3379510 - DNA, 13 bp, Homo sapiens
gtagggaataaaa

SEQ ID NO: 3379511 - DNA, 13 bp, Homo sapiens
gtagggaggcagc

SEQ ID NO: 3379512 - DNA, 15 bp, Homo sapiens
gtagggaggcagcct

SEQ ID NO: 3379513 - DNA, 12 bp, Homo sapiens
gtaggggcaggg

SEQ ID NO: 3379514 - DNA, 16 bp, Homo sapiens
gtaggtccaagggcca

SEQ ID NO: 3379515 - DNA, 19 bp, Homo sapiens
gtaggttatctttttaaaa

SEQ ID NO: 3379516 - DNA, 17 bp, Homo sapiens
gtaggttcagccaaggt

SEQ ID NO: 3379517 - DNA, 20 bp, Homo sapiens
gtagtactccttaagaacac

SEQ ID NO: 3379518 - DNA, 22 bp, Homo sapiens
gtagtattaaaagttgcatttg

SEQ ID NO: 3379519 - DNA, 20 bp, Homo sapiens
gtagtattttttgtataatt

SEQ ID NO: 3379520 - DNA, 23 bp, Homo sapiens
gtagtattttttgtataattgga

SEQ ID NO: 3379521 - DNA, 22 bp, Homo sapiens
gtagtcctttctgccttggcct

SEQ ID NO: 3379522 - DNA, 19 bp, Homo sapiens
gtagtctcactgcttgaac

SEQ ID NO: 3379523 - DNA, 18 bp, Homo sapiens
gtagtctcattacttttg

SEQ ID NO: 3379524 - DNA, 13 bp, Homo sapiens
gtagtgagcagtg

SEQ ID NO: 3379525 - DNA, 14 bp, Homo sapiens
gtagtggaagagca

SEQ ID NO: 3379526 - DNA, 15 bp, Homo sapiens
gtagtggaagagcag

SEQ ID NO: 3379527 - DNA, 16 bp, Homo sapiens
gtagtggaagagcagc

SEQ ID NO: 3379528 - DNA, 21 bp, Homo sapiens
gtagtggaagagcagcctgat

SEQ ID NO: 3379529 - DNA, 22 bp, Homo sapiens
gtagtggcttcttttgaactgt

SEQ ID NO: 3379530 - DNA, 15 bp, Homo sapiens
gtagttaggaaataa

SEQ ID NO: 3379531 - DNA, 22 bp, Homo sapiens
gtagttaggaaataaaaccttt

SEQ ID NO: 3379532 - DNA, 12 bp, Homo sapiens
gtagttgtcttt

SEQ ID NO: 3379533 - DNA, 16 bp, Homo sapiens
gtagttgtctttcctg

SEQ ID NO: 3379534 - DNA, 21 bp, Homo sapiens
gtagtttatggcagaagggaa

SEQ ID NO: 3379535 - DNA, 19 bp, Homo sapiens
gtagtttggatatttttgt

SEQ ID NO: 3379536 - DNA, 20 bp, Homo sapiens
gtagtttggatatttttgta

SEQ ID NO: 3379537 - DNA, 22 bp, Homo sapiens
gtagtttttacagctgtgttat

SEQ ID NO: 3379538 - DNA, 17 bp, Homo sapiens
gtagtttttcttcaaca

SEQ ID NO: 3379539 - DNA, 15 bp, Homo sapiens
gtataaaactttcct

SEQ ID NO: 3379540 - DNA, 21 bp, Homo sapiens
gtataaaactttcctcgcctg

SEQ ID NO: 3379541 - DNA, 18 bp, Homo sapiens
gtataaacattaaatgtc

SEQ ID NO: 3379542 - DNA, 13 bp, Homo sapiens
gtataaactatca

SEQ ID NO: 3379543 - DNA, 17 bp, Homo sapiens
gtataaactatcagttt

SEQ ID NO: 3379544 - DNA, 20 bp, Homo sapiens
gtataaagcaactgttatga

SEQ ID NO: 3379545 - DNA, 21 bp, Homo sapiens
gtataaagcaactgttatgaa

SEQ ID NO: 3379546 - DNA, 19 bp, Homo sapiens
gtataaataataaagaact

SEQ ID NO: 3379547 - DNA, 12 bp, Homo sapiens
gtataaatatac

SEQ ID NO: 3379548 - DNA, 13 bp, Homo sapiens
gtataaatgtata

SEQ ID NO: 3379549 - DNA, 14 bp, Homo sapiens
gtataaatgtatat

SEQ ID NO: 3379550 - DNA, 16 bp, Homo sapiens
gtataaatgtatatac

SEQ ID NO: 3379551 - DNA, 22 bp, Homo sapiens
gtataaattgtctttaaaaact

SEQ ID NO: 3379552 - DNA, 19 bp, Homo sapiens
gtataaccaagtgtgctct

SEQ ID NO: 3379553 - DNA, 20 bp, Homo sapiens
gtataaccaagtgtgctctt

SEQ ID NO: 3379554 - DNA, 14 bp, Homo sapiens
gtataagatcctag

SEQ ID NO: 3379555 - DNA, 22 bp, Homo sapiens
gtataagatcctagatcctaag

SEQ ID NO: 3379556 - DNA, 22 bp, Homo sapiens
gtataagcactgaaaaacaaca

SEQ ID NO: 3379557 - DNA, 20 bp, Homo sapiens
gtataagtggaggcacttta

SEQ ID NO: 3379558 - DNA, 22 bp, Homo sapiens
gtataagttatttttgtacatg

SEQ ID NO: 3379559 - DNA, 13 bp, Homo sapiens
gtataatagagat

SEQ ID NO: 3379560 - DNA, 17 bp, Homo sapiens
gtataatagagataagt

SEQ ID NO: 3379561 - DNA, 15 bp, Homo sapiens
gtataatattgaaaa

SEQ ID NO: 3379562 - DNA, 18 bp, Homo sapiens
gtataatcccacccacct

SEQ ID NO: 3379563 - DNA, 13 bp, Homo sapiens
gtataatcttgta

SEQ ID NO: 3379564 - DNA, 20 bp, Homo sapiens
gtataatcttgtagacactt

SEQ ID NO: 3379565 - DNA, 17 bp, Homo sapiens
gtataatctttctatag

SEQ ID NO: 3379566 - DNA, 13 bp, Homo sapiens
gtataatgtttaa

SEQ ID NO: 3379567 - DNA, 19 bp, Homo sapiens
gtataatgtttaaatcatg

SEQ ID NO: 3379568 - DNA, 17 bp, Homo sapiens
gtataatttcgagattt

SEQ ID NO: 3379569 - DNA, 18 bp, Homo sapiens
gtatacaatatataaaaa

SEQ ID NO: 3379570 - DNA, 17 bp, Homo sapiens
gtatacatcctgggtaa

SEQ ID NO: 3379571 - DNA, 12 bp, Homo sapiens
gtatacctcatt

SEQ ID NO: 3379572 - DNA, 17 bp, Homo sapiens
gtatacctcatttttca

SEQ ID NO: 3379573 - DNA, 21 bp, Homo sapiens
gtatacttccttacttttaag

SEQ ID NO: 3379574 - DNA, 13 bp, Homo sapiens
gtatactttagta

SEQ ID NO: 3379575 - DNA, 18 bp, Homo sapiens
gtatagagaaaagtgtat

SEQ ID NO: 3379576 - DNA, 14 bp, Homo sapiens
gtatagatgcaaga

SEQ ID NO: 3379577 - DNA, 16 bp, Homo sapiens
gtatagatgcaagata

SEQ ID NO: 3379578 - DNA, 15 bp, Homo sapiens
gtatagtatctgtat

SEQ ID NO: 3379579 - DNA, 13 bp, Homo sapiens
gtatagtgtaaaa

SEQ ID NO: 3379580 - DNA, 15 bp, Homo sapiens
gtatagtgtaaaata

SEQ ID NO: 3379581 - DNA, 19 bp, Homo sapiens
gtatagttaggatagcatt

SEQ ID NO: 3379582 - DNA, 18 bp, Homo sapiens
gtatataagttgctgtgt

SEQ ID NO: 3379583 - DNA, 13 bp, Homo sapiens
gtatatacacata

SEQ ID NO: 3379584 - DNA, 18 bp, Homo sapiens
gtatatacagttattttg

SEQ ID NO: 3379585 - DNA, 23 bp, Homo sapiens
gtatatactttgaaaggagatgt

SEQ ID NO: 3379586 - DNA, 18 bp, Homo sapiens
gtatatacttttaaatta

SEQ ID NO: 3379587 - DNA, 13 bp, Homo sapiens
gtatatacttttt

SEQ ID NO: 3379588 - DNA, 11 bp, Homo sapiens
gtatatataca

SEQ ID NO: 3379589 - DNA, 21 bp, Homo sapiens
gtatatatatgccatgatgga

SEQ ID NO: 3379590 - DNA, 23 bp, Homo sapiens
gtatatatgtgtatatatacata

SEQ ID NO: 3379591 - DNA, 19 bp, Homo sapiens
gtatatcagaaaagggaag

SEQ ID NO: 3379592 - DNA, 20 bp, Homo sapiens
gtatatcattctacagaata

SEQ ID NO: 3379593 - DNA, 21 bp, Homo sapiens
gtatatcattctacagaataa

SEQ ID NO: 3379594 - DNA, 18 bp, Homo sapiens
gtatatcctatataggaa

SEQ ID NO: 3379595 - DNA, 22 bp, Homo sapiens
gtatatctcttggaaaataaga

SEQ ID NO: 3379596 - DNA, 18 bp, Homo sapiens
gtatatctggacaagcca

SEQ ID NO: 3379597 - DNA, 21 bp, Homo sapiens
gtatatctggacaagccaact

SEQ ID NO: 3379598 - DNA, 14 bp, Homo sapiens
gtatatctgggctg

SEQ ID NO: 3379599 - DNA, 22 bp, Homo sapiens
gtatatgaaaacaagttccaaa

SEQ ID NO: 3379600 - DNA, 22 bp, Homo sapiens
gtatatgtcaagccataattgt

SEQ ID NO: 3379601 - DNA, 17 bp, Homo sapiens
gtatatgttgtaataaa

SEQ ID NO: 3379602 - DNA, 17 bp, Homo sapiens
gtatatgtttatatact

SEQ ID NO: 3379603 - DNA, 12 bp, Homo sapiens
gtatatgtttta

SEQ ID NO: 3379604 - DNA, 13 bp, Homo sapiens
gtatatgttttat

SEQ ID NO: 3379605 - DNA, 23 bp, Homo sapiens
gtatattatgtatttatattttg

SEQ ID NO: 3379606 - DNA, 12 bp, Homo sapiens
gtatattcagga

SEQ ID NO: 3379607 - DNA, 23 bp, Homo sapiens
gtatattcaggacttgaaagaaa

SEQ ID NO: 3379608 - DNA, 22 bp, Homo sapiens
gtatattgtataggggcaactg

SEQ ID NO: 3379609 - DNA, 20 bp, Homo sapiens
gtatattgtggatgtgttca

SEQ ID NO: 3379610 - DNA, 15 bp, Homo sapiens
gtatatttgtacaaa

SEQ ID NO: 3379611 - DNA, 21 bp, Homo sapiens
gtatatttgtgatagcacttt

SEQ ID NO: 3379612 - DNA, 23 bp, Homo sapiens
gtatatttgtgatagcactttct

SEQ ID NO: 3379613 - DNA, 22 bp, Homo sapiens
gtatatttttatctatataaaa

SEQ ID NO: 3379614 - DNA, 19 bp, Homo sapiens
gtatatttttttaatttaa

SEQ ID NO: 3379615 - DNA, 15 bp, Homo sapiens
gtatcaaaattacat

SEQ ID NO: 3379616 - DNA, 14 bp, Homo sapiens
gtatcaaatctgta

SEQ ID NO: 3379617 - DNA, 21 bp, Homo sapiens
gtatcaagacgtttaactgca

SEQ ID NO: 3379618 - DNA, 18 bp, Homo sapiens
gtatcagaagagagggga

SEQ ID NO: 3379619 - DNA, 12 bp, Homo sapiens
gtatcagaggcc

SEQ ID NO: 3379620 - DNA, 21 bp, Homo sapiens
gtatcaggaaatatatatgtg

SEQ ID NO: 3379621 - DNA, 19 bp, Homo sapiens
gtatcaggaatataaatat

SEQ ID NO: 3379622 - DNA, 17 bp, Homo sapiens
gtatcaggtcagggact

SEQ ID NO: 3379623 - DNA, 18 bp, Homo sapiens
gtatcaggtgctgccatc

SEQ ID NO: 3379624 - DNA, 22 bp, Homo sapiens
gtatcaggtgctgccatccagg

SEQ ID NO: 3379625 - DNA, 20 bp, Homo sapiens
gtatcagtgttttaaattct

SEQ ID NO: 3379626 - DNA, 22 bp, Homo sapiens
gtatcagtgttttaaattctga

SEQ ID NO: 3379627 - DNA, 15 bp, Homo sapiens
gtatcatagaaatgt

SEQ ID NO: 3379628 - DNA, 13 bp, Homo sapiens
gtatcatctccat

SEQ ID NO: 3379629 - DNA, 20 bp, Homo sapiens
gtatccaaaaatagccctgc

SEQ ID NO: 3379630 - DNA, 19 bp, Homo sapiens
gtatccaaccaacttggtt

SEQ ID NO: 3379631 - DNA, 19 bp, Homo sapiens
gtatccactttgcacagct

SEQ ID NO: 3379632 - DNA, 19 bp, Homo sapiens
gtatcccaactcctataat

SEQ ID NO: 3379633 - DNA, 14 bp, Homo sapiens
gtatccccccatct

SEQ ID NO: 3379634 - DNA, 17 bp, Homo sapiens
gtatccccccatcttgc

SEQ ID NO: 3379635 - DNA, 18 bp, Homo sapiens
gtatccccccatcttgct

SEQ ID NO: 3379636 - DNA, 20 bp, Homo sapiens
gtatcccccccctgtatagt

SEQ ID NO: 3379637 - DNA, 18 bp, Homo sapiens
gtatcccttctcacagca

SEQ ID NO: 3379638 - DNA, 17 bp, Homo sapiens
gtatccgactctaagct

SEQ ID NO: 3379639 - DNA, 21 bp, Homo sapiens
gtatccgactctaagctgtgt

SEQ ID NO: 3379640 - DNA, 18 bp, Homo sapiens
gtatcctccctggcagac

SEQ ID NO: 3379641 - DNA, 20 bp, Homo sapiens
gtatcctccctggcagacac

SEQ ID NO: 3379642 - DNA, 21 bp, Homo sapiens
gtatcctccctggcagacaca

SEQ ID NO: 3379643 - DNA, 18 bp, Homo sapiens
gtatcctgcccagtgttg

SEQ ID NO: 3379644 - DNA, 15 bp, Homo sapiens
gtatcggagacagtg

SEQ ID NO: 3379645 - DNA, 13 bp, Homo sapiens
gtatctagtgcag

SEQ ID NO: 3379646 - DNA, 15 bp, Homo sapiens
gtatctagtgcagct

SEQ ID NO: 3379647 - DNA, 22 bp, Homo sapiens
gtatctcagaaagtgcctgaca

SEQ ID NO: 3379648 - DNA, 23 bp, Homo sapiens
gtatctcatactgtctgggatta

SEQ ID NO: 3379649 - DNA, 17 bp, Homo sapiens
gtatctctgaagcatgt

SEQ ID NO: 3379650 - DNA, 22 bp, Homo sapiens
gtatctctttcacattgtttgc

SEQ ID NO: 3379651 - DNA, 18 bp, Homo sapiens
gtatctgagttgccaaga

SEQ ID NO: 3379652 - DNA, 19 bp, Homo sapiens
gtatctgggtaagaagaaa

SEQ ID NO: 3379653 - DNA, 20 bp, Homo sapiens
gtatcttacctgtaaagtct

SEQ ID NO: 3379654 - DNA, 17 bp, Homo sapiens
gtatcttattataaaat

SEQ ID NO: 3379655 - DNA, 17 bp, Homo sapiens
gtatcttccatatttgg

SEQ ID NO: 3379656 - DNA, 21 bp, Homo sapiens
gtatcttccatatttggaaga

SEQ ID NO: 3379657 - DNA, 12 bp, Homo sapiens
gtatcttccttt

SEQ ID NO: 3379658 - DNA, 14 bp, Homo sapiens
gtatcttcctttct

SEQ ID NO: 3379659 - DNA, 19 bp, Homo sapiens
gtatcttcctttcttgtct

SEQ ID NO: 3379660 - DNA, 15 bp, Homo sapiens
gtatcttctattttt

SEQ ID NO: 3379661 - DNA, 17 bp, Homo sapiens
gtatcttctatttttat

SEQ ID NO: 3379662 - DNA, 22 bp, Homo sapiens
gtatcttctatttttatcatga

SEQ ID NO: 3379663 - DNA, 21 bp, Homo sapiens
gtatcttggggcaagactgca

SEQ ID NO: 3379664 - DNA, 15 bp, Homo sapiens
gtatctttccaggct

SEQ ID NO: 3379665 - DNA, 16 bp, Homo sapiens
gtatcttttttcaaaa

SEQ ID NO: 3379666 - DNA, 14 bp, Homo sapiens
gtatgaaagattgt

SEQ ID NO: 3379667 - DNA, 18 bp, Homo sapiens
gtatgaaggaatcattcc

SEQ ID NO: 3379668 - DNA, 15 bp, Homo sapiens
gtatgaatgcagtgg

SEQ ID NO: 3379669 - DNA, 18 bp, Homo sapiens
gtatgactaaagagagaa

SEQ ID NO: 3379670 - DNA, 14 bp, Homo sapiens
gtatgagatggtta

SEQ ID NO: 3379671 - DNA, 21 bp, Homo sapiens
gtatgagtcaatgtgcagtgt

SEQ ID NO: 3379672 - DNA, 15 bp, Homo sapiens
gtatgatagtgacta

SEQ ID NO: 3379673 - DNA, 22 bp, Homo sapiens
gtatgatcacggctcactgcag

SEQ ID NO: 3379674 - DNA, 13 bp, Homo sapiens
gtatgatgtgttg

SEQ ID NO: 3379675 - DNA, 16 bp, Homo sapiens
gtatgatttgttttga

SEQ ID NO: 3379676 - DNA, 16 bp, Homo sapiens
gtatgcattattaaat

SEQ ID NO: 3379677 - DNA, 17 bp, Homo sapiens
gtatgcattattaaatt

SEQ ID NO: 3379678 - DNA, 20 bp, Homo sapiens
gtatgccacacctggcctta

SEQ ID NO: 3379679 - DNA, 19 bp, Homo sapiens
gtatgctggccagcaccct

SEQ ID NO: 3379680 - DNA, 17 bp, Homo sapiens
gtatggaagttttccta

SEQ ID NO: 3379681 - DNA, 13 bp, Homo sapiens
gtatggtctaaca

SEQ ID NO: 3379682 - DNA, 17 bp, Homo sapiens
gtatggttcaagattgt

SEQ ID NO: 3379683 - DNA, 16 bp, Homo sapiens
gtatgtaatttatgca

SEQ ID NO: 3379684 - DNA, 22 bp, Homo sapiens
gtatgtcaataaacaacagctg

SEQ ID NO: 3379685 - DNA, 12 bp, Homo sapiens
gtatgtctgttt

SEQ ID NO: 3379686 - DNA, 13 bp, Homo sapiens
gtatgtctgtttt

SEQ ID NO: 3379687 - DNA, 23 bp, Homo sapiens
gtatgtgaacaaatcaaattgct

SEQ ID NO: 3379688 - DNA, 12 bp, Homo sapiens
gtatgtggaagg

SEQ ID NO: 3379689 - DNA, 16 bp, Homo sapiens
gtatgtgtgtaggtta

SEQ ID NO: 3379690 - DNA, 18 bp, Homo sapiens
gtatgttaaagagaatga

SEQ ID NO: 3379691 - DNA, 22 bp, Homo sapiens
gtatgttcctaaggtcatttct

SEQ ID NO: 3379692 - DNA, 19 bp, Homo sapiens
gtatgtttaatctgttatg

SEQ ID NO: 3379693 - DNA, 14 bp, Homo sapiens
gtatgtttgcacac

SEQ ID NO: 3379694 - DNA, 21 bp, Homo sapiens
gtatgtttgcacacttgtgtg

SEQ ID NO: 3379695 - DNA, 13 bp, Homo sapiens
gtattaaatctta

SEQ ID NO: 3379696 - DNA, 23 bp, Homo sapiens
gtattaaatcttaaacaatgtat

SEQ ID NO: 3379697 - DNA, 16 bp, Homo sapiens
gtattaataaagcatt

SEQ ID NO: 3379698 - DNA, 19 bp, Homo sapiens
gtattaataaagcattctt

SEQ ID NO: 3379699 - DNA, 21 bp, Homo sapiens
gtattaataaagcattcttta

SEQ ID NO: 3379700 - DNA, 14 bp, Homo sapiens
gtattaatactaaa

SEQ ID NO: 3379701 - DNA, 14 bp, Homo sapiens
gtattacaaacaag

SEQ ID NO: 3379702 - DNA, 13 bp, Homo sapiens
gtattacactgta

SEQ ID NO: 3379703 - DNA, 19 bp, Homo sapiens
gtattacagctttcacagt

SEQ ID NO: 3379704 - DNA, 18 bp, Homo sapiens
gtattacatctaatgctt

SEQ ID NO: 3379705 - DNA, 18 bp, Homo sapiens
gtattacttaggttattt

SEQ ID NO: 3379706 - DNA, 23 bp, Homo sapiens
gtattacttaggttattttgctt

SEQ ID NO: 3379707 - DNA, 14 bp, Homo sapiens
gtattacttctgct

SEQ ID NO: 3379708 - DNA, 15 bp, Homo sapiens
gtattacttctgcta

SEQ ID NO: 3379709 - DNA, 20 bp, Homo sapiens
gtattatacatgtgatacat

SEQ ID NO: 3379710 - DNA, 22 bp, Homo sapiens
gtattatacatgtgatacattt

SEQ ID NO: 3379711 - DNA, 17 bp, Homo sapiens
gtattatgcatatataa

SEQ ID NO: 3379712 - DNA, 12 bp, Homo sapiens
gtattatttata

SEQ ID NO: 3379713 - DNA, 18 bp, Homo sapiens
gtattcaagcaaacatca

SEQ ID NO: 3379714 - DNA, 18 bp, Homo sapiens
gtattccttaaataaact

SEQ ID NO: 3379715 - DNA, 12 bp, Homo sapiens
gtattctcagag

SEQ ID NO: 3379716 - DNA, 18 bp, Homo sapiens
gtattctcagagcatgtg

SEQ ID NO: 3379717 - DNA, 21 bp, Homo sapiens
gtattctcagagcatgtgtca

SEQ ID NO: 3379718 - DNA, 11 bp, Homo sapiens
gtattcttttt

SEQ ID NO: 3379719 - DNA, 23 bp, Homo sapiens
gtattgaatattgtgttcctttt

SEQ ID NO: 3379720 - DNA, 20 bp, Homo sapiens
gtattgactttatgttgtat

SEQ ID NO: 3379721 - DNA, 13 bp, Homo sapiens
gtattgcacattg

SEQ ID NO: 3379722 - DNA, 16 bp, Homo sapiens
gtattgcacattgtaa

SEQ ID NO: 3379723 - DNA, 10 bp, Homo sapiens
gtattggaaa

SEQ ID NO: 3379724 - DNA, 18 bp, Homo sapiens
gtattgttcccagtgaca

SEQ ID NO: 3379725 - DNA, 13 bp, Homo sapiens
gtatttaattaaa

SEQ ID NO: 3379726 - DNA, 14 bp, Homo sapiens
gtatttactgtact

SEQ ID NO: 3379727 - DNA, 12 bp, Homo sapiens
gtatttatatat

SEQ ID NO: 3379728 - DNA, 14 bp, Homo sapiens
gtatttatatttgg

SEQ ID NO: 3379729 - DNA, 16 bp, Homo sapiens
gtatttatatttggaa

SEQ ID NO: 3379730 - DNA, 20 bp, Homo sapiens
gtatttatatttggaaagag

SEQ ID NO: 3379731 - DNA, 21 bp, Homo sapiens
gtatttatatttggaaagaga

SEQ ID NO: 3379732 - DNA, 17 bp, Homo sapiens
gtatttattaatttgaa

SEQ ID NO: 3379733 - DNA, 18 bp, Homo sapiens
gtatttattaatttgaaa

SEQ ID NO: 3379734 - DNA, 14 bp, Homo sapiens
gtatttattatttg

SEQ ID NO: 3379735 - DNA, 13 bp, Homo sapiens
gtatttattccat

SEQ ID NO: 3379736 - DNA, 11 bp, Homo sapiens
gtatttattgg

SEQ ID NO: 3379737 - DNA, 14 bp, Homo sapiens
gtatttcaactgct

SEQ ID NO: 3379738 - DNA, 21 bp, Homo sapiens
gtatttcaactgctgtaaaat

SEQ ID NO: 3379739 - DNA, 13 bp, Homo sapiens
gtatttcagtgta

SEQ ID NO: 3379740 - DNA, 16 bp, Homo sapiens
gtatttccagtgcaat

SEQ ID NO: 3379741 - DNA, 12 bp, Homo sapiens
gtatttctatat

SEQ ID NO: 3379742 - DNA, 17 bp, Homo sapiens
gtatttctatatttatt

SEQ ID NO: 3379743 - DNA, 21 bp, Homo sapiens
gtatttctcctttgcaatagc

SEQ ID NO: 3379744 - DNA, 14 bp, Homo sapiens
gtatttctttctcg

SEQ ID NO: 3379745 - DNA, 12 bp, Homo sapiens
gtatttgctttt

SEQ ID NO: 3379746 - DNA, 19 bp, Homo sapiens
gtatttggaaataaagtca

SEQ ID NO: 3379747 - DNA, 19 bp, Homo sapiens
gtatttggaatatttgaat

SEQ ID NO: 3379748 - DNA, 20 bp, Homo sapiens
gtatttggctgggctacaat

SEQ ID NO: 3379749 - DNA, 21 bp, Homo sapiens
gtatttggtccaaaaaaagga

SEQ ID NO: 3379750 - DNA, 13 bp, Homo sapiens
gtatttgtattaa

SEQ ID NO: 3379751 - DNA, 18 bp, Homo sapiens
gtatttgtattaataaag

SEQ ID NO: 3379752 - DNA, 19 bp, Homo sapiens
gtatttgtattaataaagc

SEQ ID NO: 3379753 - DNA, 18 bp, Homo sapiens
gtatttgttcatgtttgg

SEQ ID NO: 3379754 - DNA, 14 bp, Homo sapiens
gtattttaatcctg

SEQ ID NO: 3379755 - DNA, 24 bp, Homo sapiens
gtattttaatcctgtaccaaatct

SEQ ID NO: 3379756 - DNA, 12 bp, Homo sapiens
gtattttcagtc

SEQ ID NO: 3379757 - DNA, 15 bp, Homo sapiens
gtattttcatgaaaa

SEQ ID NO: 3379758 - DNA, 19 bp, Homo sapiens
gtattttcatgaaaatacc

SEQ ID NO: 3379759 - DNA, 11 bp, Homo sapiens
gtattttcctg

SEQ ID NO: 3379760 - DNA, 18 bp, Homo sapiens
gtattttcctggatttat

SEQ ID NO: 3379761 - DNA, 13 bp, Homo sapiens
gtattttgaagaa

SEQ ID NO: 3379762 - DNA, 14 bp, Homo sapiens
gtattttggagaaa

SEQ ID NO: 3379763 - DNA, 15 bp, Homo sapiens
gtattttgtaatatt

SEQ ID NO: 3379764 - DNA, 16 bp, Homo sapiens
gtattttgttaaagct

SEQ ID NO: 3379765 - DNA, 22 bp, Homo sapiens
gtatttttaatgggggtagcag

SEQ ID NO: 3379766 - DNA, 18 bp, Homo sapiens
gtatttttcaataaagca

SEQ ID NO: 3379767 - DNA, 21 bp, Homo sapiens
gtatttttcaataaagcattt

SEQ ID NO: 3379768 - DNA, 19 bp, Homo sapiens
gtatttttcaataataaaa

SEQ ID NO: 3379769 - DNA, 21 bp, Homo sapiens
gtatttttcaggtaggccctt

SEQ ID NO: 3379770 - DNA, 18 bp, Homo sapiens
gtatttttggtttatatg

SEQ ID NO: 3379771 - DNA, 23 bp, Homo sapiens
gtatttttgtgaagtattcacaa

SEQ ID NO: 3379772 - DNA, 17 bp, Homo sapiens
gtattttttaaaacact

SEQ ID NO: 3379773 - DNA, 20 bp, Homo sapiens
gtattttttaaaacactaaa

SEQ ID NO: 3379774 - DNA, 22 bp, Homo sapiens
gtattttttaaaacactaaaag

SEQ ID NO: 3379775 - DNA, 16 bp, Homo sapiens
gtattttttatttaca

SEQ ID NO: 3379776 - DNA, 21 bp, Homo sapiens
gtattttttatttacatttta

SEQ ID NO: 3379777 - DNA, 23 bp, Homo sapiens
gtattttttatttacattttata

SEQ ID NO: 3379778 - DNA, 14 bp, Homo sapiens
gtattttttccttt

SEQ ID NO: 3379779 - DNA, 18 bp, Homo sapiens
gtatttttttttctaaga

SEQ ID NO: 3379780 - DNA, 23 bp, Homo sapiens
gtattttttttttaaataaaagc

SEQ ID NO: 3379781 - DNA, 16 bp, Homo sapiens
gtcaaaagttggacta

SEQ ID NO: 3379782 - DNA, 23 bp, Homo sapiens
gtcaaaataaaggataactctgt

SEQ ID NO: 3379783 - DNA, 23 bp, Homo sapiens
gtcaaacattcgtgagctgggga

SEQ ID NO: 3379784 - DNA, 16 bp, Homo sapiens
gtcaaagaaatgctga

SEQ ID NO: 3379785 - DNA, 15 bp, Homo sapiens
gtcaaataaagcaaa

SEQ ID NO: 3379786 - DNA, 22 bp, Homo sapiens
gtcaaatgcatacaagtttcat

SEQ ID NO: 3379787 - DNA, 14 bp, Homo sapiens
gtcaaatttacatt

SEQ ID NO: 3379788 - DNA, 17 bp, Homo sapiens
gtcaaatttacatttat

SEQ ID NO: 3379789 - DNA, 18 bp, Homo sapiens
gtcaagaaacagccagca

SEQ ID NO: 3379790 - DNA, 16 bp, Homo sapiens
gtcaagaagaatgaac

SEQ ID NO: 3379791 - DNA, 14 bp, Homo sapiens
gtcaagacatttct

SEQ ID NO: 3379792 - DNA, 14 bp, Homo sapiens
gtcaagcacatgta

SEQ ID NO: 3379793 - DNA, 18 bp, Homo sapiens
gtcaaggctgcttagaat

SEQ ID NO: 3379794 - DNA, 14 bp, Homo sapiens
gtcaagtaagaaga

SEQ ID NO: 3379795 - DNA, 15 bp, Homo sapiens
gtcaagtaagaagac

SEQ ID NO: 3379796 - DNA, 17 bp, Homo sapiens
gtcaagttgtgcttgtt

SEQ ID NO: 3379797 - DNA, 18 bp, Homo sapiens
gtcaagttgtgcttgttt

SEQ ID NO: 3379798 - DNA, 13 bp, Homo sapiens
gtcaataaacagc

SEQ ID NO: 3379799 - DNA, 18 bp, Homo sapiens
gtcaataaacttagagga

SEQ ID NO: 3379800 - DNA, 22 bp, Homo sapiens
gtcaataaacttagaggaaaat

SEQ ID NO: 3379801 - DNA, 17 bp, Homo sapiens
gtcaatacaaatagatt

SEQ ID NO: 3379802 - DNA, 23 bp, Homo sapiens
gtcaatattaaatacagacacta

SEQ ID NO: 3379803 - DNA, 14 bp, Homo sapiens
gtcaatcatttctc

SEQ ID NO: 3379804 - DNA, 12 bp, Homo sapiens
gtcaatccaaga

SEQ ID NO: 3379805 - DNA, 20 bp, Homo sapiens
gtcaatcccaaaagtcacca

SEQ ID NO: 3379806 - DNA, 18 bp, Homo sapiens
gtcaatgtgcagtgtagc

SEQ ID NO: 3379807 - DNA, 22 bp, Homo sapiens
gtcaatttctgtgttgccaagc

SEQ ID NO: 3379808 - DNA, 14 bp, Homo sapiens
gtcacaaagagttc

SEQ ID NO: 3379809 - DNA, 13 bp, Homo sapiens
gtcacaaattgat

SEQ ID NO: 3379810 - DNA, 16 bp, Homo sapiens
gtcacacactttggct

SEQ ID NO: 3379811 - DNA, 22 bp, Homo sapiens
gtcacacagtattacttctgct

SEQ ID NO: 3379812 - DNA, 17 bp, Homo sapiens
gtcacactaaaatttaa

SEQ ID NO: 3379813 - DNA, 19 bp, Homo sapiens
gtcacagaaatcagaggag

SEQ ID NO: 3379814 - DNA, 17 bp, Homo sapiens
gtcacagcatggaggag

SEQ ID NO: 3379815 - DNA, 13 bp, Homo sapiens
gtcacagctgcag

SEQ ID NO: 3379816 - DNA, 15 bp, Homo sapiens
gtcacagctgcagct

SEQ ID NO: 3379817 - DNA, 16 bp, Homo sapiens
gtcacagctgcagctg

SEQ ID NO: 3379818 - DNA, 17 bp, Homo sapiens
gtcacaggactctgcct

SEQ ID NO: 3379819 - DNA, 16 bp, Homo sapiens
gtcacaggcaggtcca

SEQ ID NO: 3379820 - DNA, 14 bp, Homo sapiens
gtcacaggcccaga

SEQ ID NO: 3379821 - DNA, 20 bp, Homo sapiens
gtcacagggcatgccccggc

SEQ ID NO: 3379822 - DNA, 22 bp, Homo sapiens
gtcacagttcttggtgactgtc

SEQ ID NO: 3379823 - DNA, 22 bp, Homo sapiens
gtcacattatttattaaaaatg

SEQ ID NO: 3379824 - DNA, 22 bp, Homo sapiens
gtcacattgccatcactcttgt

SEQ ID NO: 3379825 - DNA, 12 bp, Homo sapiens
gtcaccaagccc

SEQ ID NO: 3379826 - DNA, 14 bp, Homo sapiens
gtcaccaaggaaac

SEQ ID NO: 3379827 - DNA, 21 bp, Homo sapiens
gtcaccaccacccgaaatgcc

SEQ ID NO: 3379828 - DNA, 22 bp, Homo sapiens
gtcaccaccacccgaaatgcca

SEQ ID NO: 3379829 - DNA, 13 bp, Homo sapiens
gtcaccaggggag

SEQ ID NO: 3379830 - DNA, 22 bp, Homo sapiens
gtcaccaggggaggagcctgtg

SEQ ID NO: 3379831 - DNA, 15 bp, Homo sapiens
gtcacccaacatcaa

SEQ ID NO: 3379832 - DNA, 23 bp, Homo sapiens
gtcaccccaagtagtctgctcac

SEQ ID NO: 3379833 - DNA, 15 bp, Homo sapiens
gtcacccctccagga

SEQ ID NO: 3379834 - DNA, 20 bp, Homo sapiens
gtcacccctccaggaatgat

SEQ ID NO: 3379835 - DNA, 18 bp, Homo sapiens
gtcaccggtcagtgcctt

SEQ ID NO: 3379836 - DNA, 20 bp, Homo sapiens
gtcacctctctcagagcatc

SEQ ID NO: 3379837 - DNA, 14 bp, Homo sapiens
gtcacctgcaagcc

SEQ ID NO: 3379838 - DNA, 19 bp, Homo sapiens
gtcacctgcaagccccagg

SEQ ID NO: 3379839 - DNA, 22 bp, Homo sapiens
gtcacctgcaagccccagggcc

SEQ ID NO: 3379840 - DNA, 23 bp, Homo sapiens
gtcacctgcaagccccagggcct

SEQ ID NO: 3379841 - DNA, 21 bp, Homo sapiens
gtcacctgttggctacacaga

SEQ ID NO: 3379842 - DNA, 22 bp, Homo sapiens
gtcacgaggtccagacccactc

SEQ ID NO: 3379843 - DNA, 19 bp, Homo sapiens
gtcacgctggggctctctg

SEQ ID NO: 3379844 - DNA, 16 bp, Homo sapiens
gtcacgtactgtctga

SEQ ID NO: 3379845 - DNA, 17 bp, Homo sapiens
gtcacgtgtattttcat

SEQ ID NO: 3379846 - DNA, 16 bp, Homo sapiens
gtcactacagggagaa

SEQ ID NO: 3379847 - DNA, 17 bp, Homo sapiens
gtcactactcacagtct

SEQ ID NO: 3379848 - DNA, 14 bp, Homo sapiens
gtcactcattgctg

SEQ ID NO: 3379849 - DNA, 22 bp, Homo sapiens
gtcactcattgctgagcctctg

SEQ ID NO: 3379850 - DNA, 21 bp, Homo sapiens
gtcactcctggggcctcttgg

SEQ ID NO: 3379851 - DNA, 14 bp, Homo sapiens
gtcactctttttta

SEQ ID NO: 3379852 - DNA, 16 bp, Homo sapiens
gtcactgccactttgc

SEQ ID NO: 3379853 - DNA, 17 bp, Homo sapiens
gtcactgccactttgca

SEQ ID NO: 3379854 - DNA, 18 bp, Homo sapiens
gtcactggctctccaagt

SEQ ID NO: 3379855 - DNA, 21 bp, Homo sapiens
gtcactggctctccaagtgcc

SEQ ID NO: 3379856 - DNA, 21 bp, Homo sapiens
gtcactggctggctcctaggg

SEQ ID NO: 3379857 - DNA, 16 bp, Homo sapiens
gtcactgtgcactgcc

SEQ ID NO: 3379858 - DNA, 16 bp, Homo sapiens
gtcactgtttctctgc

SEQ ID NO: 3379859 - DNA, 13 bp, Homo sapiens
gtcagaaaccctg

SEQ ID NO: 3379860 - DNA, 14 bp, Homo sapiens
gtcagaacatgtta

SEQ ID NO: 3379861 - DNA, 18 bp, Homo sapiens
gtcagaactgcagggcct

SEQ ID NO: 3379862 - DNA, 18 bp, Homo sapiens
gtcagaagcctccaagcc

SEQ ID NO: 3379863 - DNA, 15 bp, Homo sapiens
gtcagaatgctattg

SEQ ID NO: 3379864 - DNA, 20 bp, Homo sapiens
gtcagacacttatttattgg

SEQ ID NO: 3379865 - DNA, 18 bp, Homo sapiens
gtcagacagaacttgaat

SEQ ID NO: 3379866 - DNA, 18 bp, Homo sapiens
gtcagacagatgtcagct

SEQ ID NO: 3379867 - DNA, 15 bp, Homo sapiens
gtcagacataaagcc

SEQ ID NO: 3379868 - DNA, 16 bp, Homo sapiens
gtcagacataaagcca

SEQ ID NO: 3379869 - DNA, 18 bp, Homo sapiens
gtcagacatccatgtttg

SEQ ID NO: 3379870 - DNA, 15 bp, Homo sapiens
gtcagactaagaaat

SEQ ID NO: 3379871 - DNA, 15 bp, Homo sapiens
gtcagactgctggga

SEQ ID NO: 3379872 - DNA, 14 bp, Homo sapiens
gtcagactggctgg

SEQ ID NO: 3379873 - DNA, 15 bp, Homo sapiens
gtcagagacggcaga

SEQ ID NO: 3379874 - DNA, 18 bp, Homo sapiens
gtcagagccctggctggg

SEQ ID NO: 3379875 - DNA, 15 bp, Homo sapiens
gtcagaggatggcca

SEQ ID NO: 3379876 - DNA, 13 bp, Homo sapiens
gtcagagtgttgt

SEQ ID NO: 3379877 - DNA, 16 bp, Homo sapiens
gtcagagtgttgttcc

SEQ ID NO: 3379878 - DNA, 22 bp, Homo sapiens
gtcagatgagaacaaagctgtt

SEQ ID NO: 3379879 - DNA, 16 bp, Homo sapiens
gtcagatgcgtgccca

SEQ ID NO: 3379880 - DNA, 21 bp, Homo sapiens
gtcagatggaggttctcagag

SEQ ID NO: 3379881 - DNA, 13 bp, Homo sapiens
gtcagatttttaa

SEQ ID NO: 3379882 - DNA, 17 bp, Homo sapiens
gtcagatttttaaagtt

SEQ ID NO: 3379883 - DNA, 18 bp, Homo sapiens
gtcagatttttaaagttt

SEQ ID NO: 3379884 - DNA, 16 bp, Homo sapiens
gtcagcatgcttccca

SEQ ID NO: 3379885 - DNA, 21 bp, Homo sapiens
gtcagcatgcttcccagaggg

SEQ ID NO: 3379886 - DNA, 15 bp, Homo sapiens
gtcagccaaatgtaa

SEQ ID NO: 3379887 - DNA, 11 bp, Homo sapiens
gtcagccagcc

SEQ ID NO: 3379888 - DNA, 18 bp, Homo sapiens
gtcagccagccgccctgg

SEQ ID NO: 3379889 - DNA, 15 bp, Homo sapiens
gtcagccaggagctg

SEQ ID NO: 3379890 - DNA, 12 bp, Homo sapiens
gtcagccaggct

SEQ ID NO: 3379891 - DNA, 19 bp, Homo sapiens
gtcagccatcgtcctggga

SEQ ID NO: 3379892 - DNA, 20 bp, Homo sapiens
gtcagccgagccgggcctgg

SEQ ID NO: 3379893 - DNA, 21 bp, Homo sapiens
gtcagccgagccgggcctggg

SEQ ID NO: 3379894 - DNA, 19 bp, Homo sapiens
gtcagcctgtgctgtggca

SEQ ID NO: 3379895 - DNA, 22 bp, Homo sapiens
gtcagccttccccctcccaggg

SEQ ID NO: 3379896 - DNA, 18 bp, Homo sapiens
gtcagcgggcccaggcct

SEQ ID NO: 3379897 - DNA, 16 bp, Homo sapiens
gtcagcgttgcatgtc

SEQ ID NO: 3379898 - DNA, 18 bp, Homo sapiens
gtcagcgttgcatgtcgt

SEQ ID NO: 3379899 - DNA, 14 bp, Homo sapiens
gtcagctactaatg

SEQ ID NO: 3379900 - DNA, 19 bp, Homo sapiens
gtcagctactaatgatgtt

SEQ ID NO: 3379901 - DNA, 19 bp, Homo sapiens
gtcagctcaggcagctcga

SEQ ID NO: 3379902 - DNA, 12 bp, Homo sapiens
gtcagctccagc

SEQ ID NO: 3379903 - DNA, 20 bp, Homo sapiens
gtcagctcttgtcaaaaggt

SEQ ID NO: 3379904 - DNA, 11 bp, Homo sapiens
gtcagctgtta

SEQ ID NO: 3379905 - DNA, 23 bp, Homo sapiens
gtcagcttcccagccatgcccag

SEQ ID NO: 3379906 - DNA, 17 bp, Homo sapiens
gtcagctttcagagcca

SEQ ID NO: 3379907 - DNA, 21 bp, Homo sapiens
gtcagctttcagagccagtga

SEQ ID NO: 3379908 - DNA, 19 bp, Homo sapiens
gtcagcttttgttgtttat

SEQ ID NO: 3379909 - DNA, 20 bp, Homo sapiens
gtcaggaagcaggggtgggg

SEQ ID NO: 3379910 - DNA, 12 bp, Homo sapiens
gtcaggagagca

SEQ ID NO: 3379911 - DNA, 14 bp, Homo sapiens
gtcaggagagcagc

SEQ ID NO: 3379912 - DNA, 22 bp, Homo sapiens
gtcaggagttcgagaccagcct

SEQ ID NO: 3379913 - DNA, 21 bp, Homo sapiens
gtcaggatgcacatttctgga

SEQ ID NO: 3379914 - DNA, 22 bp, Homo sapiens
gtcaggcctctgagcccaagct

SEQ ID NO: 3379915 - DNA, 15 bp, Homo sapiens
gtcaggcctgtgtgt

SEQ ID NO: 3379916 - DNA, 13 bp, Homo sapiens
gtcaggctctggc

SEQ ID NO: 3379917 - DNA, 17 bp, Homo sapiens
gtcaggctgggcagccc

SEQ ID NO: 3379918 - DNA, 18 bp, Homo sapiens
gtcagggacttggacagg

SEQ ID NO: 3379919 - DNA, 14 bp, Homo sapiens
gtcagggagtgctg

SEQ ID NO: 3379920 - DNA, 13 bp, Homo sapiens
gtcagggccagac

SEQ ID NO: 3379921 - DNA, 19 bp, Homo sapiens
gtcagggcccaagtccctg

SEQ ID NO: 3379922 - DNA, 15 bp, Homo sapiens
gtcagggcccagagg

SEQ ID NO: 3379923 - DNA, 20 bp, Homo sapiens
gtcagggcccagaggctgag

SEQ ID NO: 3379924 - DNA, 14 bp, Homo sapiens
gtcaggggggagaa

SEQ ID NO: 3379925 - DNA, 14 bp, Homo sapiens
gtcaggtgaccctg

SEQ ID NO: 3379926 - DNA, 17 bp, Homo sapiens
gtcaggtggggcagctt

SEQ ID NO: 3379927 - DNA, 22 bp, Homo sapiens
gtcaggtggggcagcttgaggg

SEQ ID NO: 3379928 - DNA, 14 bp, Homo sapiens
gtcagtatccaggc

SEQ ID NO: 3379929 - DNA, 14 bp, Homo sapiens
gtcagtatgacatt

SEQ ID NO: 3379930 - DNA, 21 bp, Homo sapiens
gtcagtatttcaactgctgta

SEQ ID NO: 3379931 - DNA, 12 bp, Homo sapiens
gtcagtggaagc

SEQ ID NO: 3379932 - DNA, 19 bp, Homo sapiens
gtcagtgtggagaggggtg

SEQ ID NO: 3379933 - DNA, 20 bp, Homo sapiens
gtcagttcaactttcagaag

SEQ ID NO: 3379934 - DNA, 19 bp, Homo sapiens
gtcagttcttggtgctctg

SEQ ID NO: 3379935 - DNA, 22 bp, Homo sapiens
gtcagttcttggtgctctgtgt

SEQ ID NO: 3379936 - DNA, 19 bp, Homo sapiens
gtcagttgtgttttttaag

SEQ ID NO: 3379937 - DNA, 17 bp, Homo sapiens
gtcatagagctgcaggg

SEQ ID NO: 3379938 - DNA, 21 bp, Homo sapiens
gtcatataagattcatattta

SEQ ID NO: 3379939 - DNA, 17 bp, Homo sapiens
gtcatatactgccatgt

SEQ ID NO: 3379940 - DNA, 14 bp, Homo sapiens
gtcatatagtaaac

SEQ ID NO: 3379941 - DNA, 14 bp, Homo sapiens
gtcatcactccctg

SEQ ID NO: 3379942 - DNA, 16 bp, Homo sapiens
gtcatcactccctgga

SEQ ID NO: 3379943 - DNA, 14 bp, Homo sapiens
gtcatcatcagggc

SEQ ID NO: 3379944 - DNA, 15 bp, Homo sapiens
gtcatcatcagggcc

SEQ ID NO: 3379945 - DNA, 17 bp, Homo sapiens
gtcatcatcagggcctg

SEQ ID NO: 3379946 - DNA, 22 bp, Homo sapiens
gtcatccttggtctttgtatct

SEQ ID NO: 3379947 - DNA, 15 bp, Homo sapiens
gtcatctacttaata

SEQ ID NO: 3379948 - DNA, 18 bp, Homo sapiens
gtcatctcattccactgt

SEQ ID NO: 3379949 - DNA, 17 bp, Homo sapiens
gtcatctccatcagctg

SEQ ID NO: 3379950 - DNA, 15 bp, Homo sapiens
gtcatctctctgggg

SEQ ID NO: 3379951 - DNA, 22 bp, Homo sapiens
gtcatctctctggggccctggg

SEQ ID NO: 3379952 - DNA, 19 bp, Homo sapiens
gtcatctgattggacaggc

SEQ ID NO: 3379953 - DNA, 16 bp, Homo sapiens
gtcatctggtagattt

SEQ ID NO: 3379954 - DNA, 12 bp, Homo sapiens
gtcatcttgcta

SEQ ID NO: 3379955 - DNA, 14 bp, Homo sapiens
gtcatcttgctacc

SEQ ID NO: 3379956 - DNA, 23 bp, Homo sapiens
gtcatctttcttttctttgagtc

SEQ ID NO: 3379957 - DNA, 20 bp, Homo sapiens
gtcatgaattcttatgctta

SEQ ID NO: 3379958 - DNA, 14 bp, Homo sapiens
gtcatgcataaata

SEQ ID NO: 3379959 - DNA, 15 bp, Homo sapiens
gtcatggcttaatgt

SEQ ID NO: 3379960 - DNA, 20 bp, Homo sapiens
gtcatggcttaatgtttatt

SEQ ID NO: 3379961 - DNA, 21 bp, Homo sapiens
gtcatggtttcttggagggcc

SEQ ID NO: 3379962 - DNA, 16 bp, Homo sapiens
gtcatgtgtgaacaca

SEQ ID NO: 3379963 - DNA, 23 bp, Homo sapiens
gtcatgttggtcaaaagctggat

SEQ ID NO: 3379964 - DNA, 16 bp, Homo sapiens
gtcattatattctaat

SEQ ID NO: 3379965 - DNA, 21 bp, Homo sapiens
gtcattatgggttaggcatta

SEQ ID NO: 3379966 - DNA, 13 bp, Homo sapiens
gtcattgacctct

SEQ ID NO: 3379967 - DNA, 17 bp, Homo sapiens
gtcattgacctctcagg

SEQ ID NO: 3379968 - DNA, 15 bp, Homo sapiens
gtcattgactcttgc

SEQ ID NO: 3379969 - DNA, 21 bp, Homo sapiens
gtcattgactcttgcgtgtca

SEQ ID NO: 3379970 - DNA, 20 bp, Homo sapiens
gtcattgacttcattttata

SEQ ID NO: 3379971 - DNA, 18 bp, Homo sapiens
gtcattgcagtttaagag

SEQ ID NO: 3379972 - DNA, 14 bp, Homo sapiens
gtcattgctgctgc

SEQ ID NO: 3379973 - DNA, 17 bp, Homo sapiens
gtcatttactaaacata

SEQ ID NO: 3379974 - DNA, 21 bp, Homo sapiens
gtcatttgctgagcatgtact

SEQ ID NO: 3379975 - DNA, 15 bp, Homo sapiens
gtccaaaaaaaggaa

SEQ ID NO: 3379976 - DNA, 19 bp, Homo sapiens
gtccaaaaaaaggaaaaat

SEQ ID NO: 3379977 - DNA, 20 bp, Homo sapiens
gtccaaaaaaaggaaaaata

SEQ ID NO: 3379978 - DNA, 14 bp, Homo sapiens
gtccaaaggaggct

SEQ ID NO: 3379979 - DNA, 11 bp, Homo sapiens
gtccaaataaa

SEQ ID NO: 3379980 - DNA, 18 bp, Homo sapiens
gtccaaataaaaactaaa

SEQ ID NO: 3379981 - DNA, 19 bp, Homo sapiens
gtccaaatgtgatcaactg

SEQ ID NO: 3379982 - DNA, 20 bp, Homo sapiens
gtccaaggtttaaagagtct

SEQ ID NO: 3379983 - DNA, 15 bp, Homo sapiens
gtccaatttaaggaa

SEQ ID NO: 3379984 - DNA, 19 bp, Homo sapiens
gtccaatttgtaaaaacag

SEQ ID NO: 3379985 - DNA, 15 bp, Homo sapiens
gtccacaggggcagg

SEQ ID NO: 3379986 - DNA, 18 bp, Homo sapiens
gtccaccacttcagggga

SEQ ID NO: 3379987 - DNA, 16 bp, Homo sapiens
gtccacccaggagccc

SEQ ID NO: 3379988 - DNA, 12 bp, Homo sapiens
gtccacccaggc

SEQ ID NO: 3379989 - DNA, 14 bp, Homo sapiens
gtccacccaggctg

SEQ ID NO: 3379990 - DNA, 21 bp, Homo sapiens
gtccacccaggctgcactgca

SEQ ID NO: 3379991 - DNA, 11 bp, Homo sapiens
gtccaccctgc

SEQ ID NO: 3379992 - DNA, 14 bp, Homo sapiens
gtccaccctgccaa

SEQ ID NO: 3379993 - DNA, 16 bp, Homo sapiens
gtccaccggcccctgg

SEQ ID NO: 3379994 - DNA, 15 bp, Homo sapiens
gtccactccctgctc

SEQ ID NO: 3379995 - DNA, 17 bp, Homo sapiens
gtccactccctgctcca

SEQ ID NO: 3379996 - DNA, 21 bp, Homo sapiens
gtccactgtggcactggccac

SEQ ID NO: 3379997 - DNA, 15 bp, Homo sapiens
gtccagaagaatatt

SEQ ID NO: 3379998 - DNA, 21 bp, Homo sapiens
gtccagaagaatattcaggac

SEQ ID NO: 3379999 - DNA, 21 bp, Homo sapiens
gtccagagcggaggctgtgtg

SEQ ID NO: 3380000 - DNA, 15 bp, Homo sapiens
gtccagcccatctcg

SEQ ID NO: 3380001 - DNA, 22 bp, Homo sapiens
gtccagccgccattgccaccag

SEQ ID NO: 3380002 - DNA, 11 bp, Homo sapiens
gtccagctctg

SEQ ID NO: 3380003 - DNA, 14 bp, Homo sapiens
gtccagctctgaca

SEQ ID NO: 3380004 - DNA, 15 bp, Homo sapiens
gtccagctctgacat

SEQ ID NO: 3380005 - DNA, 20 bp, Homo sapiens
gtccagctctgacatccctt

SEQ ID NO: 3380006 - DNA, 14 bp, Homo sapiens
gtccagctctggag

SEQ ID NO: 3380007 - DNA, 16 bp, Homo sapiens
gtccagctctggaggg

SEQ ID NO: 3380008 - DNA, 21 bp, Homo sapiens
gtccagctctggaggggaggg

SEQ ID NO: 3380009 - DNA, 12 bp, Homo sapiens
gtccagctggcc

SEQ ID NO: 3380010 - DNA, 13 bp, Homo sapiens
gtccagctggcct

SEQ ID NO: 3380011 - DNA, 14 bp, Homo sapiens
gtccagctggcctg

SEQ ID NO: 3380012 - DNA, 19 bp, Homo sapiens
gtccagctggcctggacag

SEQ ID NO: 3380013 - DNA, 22 bp, Homo sapiens
gtccagctgggaagcccttttt

SEQ ID NO: 3380014 - DNA, 14 bp, Homo sapiens
gtccaggaaggcag

SEQ ID NO: 3380015 - DNA, 19 bp, Homo sapiens
gtccaggaaggcagctgct

SEQ ID NO: 3380016 - DNA, 12 bp, Homo sapiens
gtccaggatctc

SEQ ID NO: 3380017 - DNA, 22 bp, Homo sapiens
gtccaggatctccactgataag

SEQ ID NO: 3380018 - DNA, 11 bp, Homo sapiens
gtccaggccac

SEQ ID NO: 3380019 - DNA, 18 bp, Homo sapiens
gtccaggccactgtggcc

SEQ ID NO: 3380020 - DNA, 20 bp, Homo sapiens
gtccaggccactgtggccag

SEQ ID NO: 3380021 - DNA, 21 bp, Homo sapiens
gtccaggccactgtggccaga

SEQ ID NO: 3380022 - DNA, 22 bp, Homo sapiens
gtccaggccactgtggccagag

SEQ ID NO: 3380023 - DNA, 15 bp, Homo sapiens
gtccagggaagctgg

SEQ ID NO: 3380024 - DNA, 12 bp, Homo sapiens
gtccaggtgagg

SEQ ID NO: 3380025 - DNA, 21 bp, Homo sapiens
gtccaggtgaggcccaagagc

SEQ ID NO: 3380026 - DNA, 18 bp, Homo sapiens
gtccagtgtcacctctct

SEQ ID NO: 3380027 - DNA, 23 bp, Homo sapiens
gtccagtgtcacctctctcagag

SEQ ID NO: 3380028 - DNA, 16 bp, Homo sapiens
gtccatcccttttcct

SEQ ID NO: 3380029 - DNA, 17 bp, Homo sapiens
gtccatcccttttcctg

SEQ ID NO: 3380030 - DNA, 22 bp, Homo sapiens
gtccatcccttttcctgtcagt

SEQ ID NO: 3380031 - DNA, 14 bp, Homo sapiens
gtccatgcttctca

SEQ ID NO: 3380032 - DNA, 13 bp, Homo sapiens
gtccatggcacca

SEQ ID NO: 3380033 - DNA, 15 bp, Homo sapiens
gtccatggcaccagc

SEQ ID NO: 3380034 - DNA, 16 bp, Homo sapiens
gtccatggcaccagcc

SEQ ID NO: 3380035 - DNA, 17 bp, Homo sapiens
gtccatggcaccagccc

SEQ ID NO: 3380036 - DNA, 19 bp, Homo sapiens
gtccatggcaccagccccc

SEQ ID NO: 3380037 - DNA, 21 bp, Homo sapiens
gtccatggcaccagccccctg

SEQ ID NO: 3380038 - DNA, 16 bp, Homo sapiens
gtccatggcctttcta

SEQ ID NO: 3380039 - DNA, 19 bp, Homo sapiens
gtccatggcctttctaata

SEQ ID NO: 3380040 - DNA, 19 bp, Homo sapiens
gtccatttcccacatcttt

SEQ ID NO: 3380041 - DNA, 15 bp, Homo sapiens
gtccatttgtaaaac

SEQ ID NO: 3380042 - DNA, 18 bp, Homo sapiens
gtcccaaaacccttacag

SEQ ID NO: 3380043 - DNA, 14 bp, Homo sapiens
gtcccaaggagctg

SEQ ID NO: 3380044 - DNA, 22 bp, Homo sapiens
gtcccaatcttaccagatgcta

SEQ ID NO: 3380045 - DNA, 20 bp, Homo sapiens
gtcccaatggtcctgacttt

SEQ ID NO: 3380046 - DNA, 19 bp, Homo sapiens
gtcccacccccacccccag

SEQ ID NO: 3380047 - DNA, 19 bp, Homo sapiens
gtcccacccccttccccca

SEQ ID NO: 3380048 - DNA, 17 bp, Homo sapiens
gtcccacccctccctct

SEQ ID NO: 3380049 - DNA, 16 bp, Homo sapiens
gtcccacctccagccc

SEQ ID NO: 3380050 - DNA, 22 bp, Homo sapiens
gtcccacgaatttgctggggaa

SEQ ID NO: 3380051 - DNA, 18 bp, Homo sapiens
gtcccacgtgtcttccac

SEQ ID NO: 3380052 - DNA, 21 bp, Homo sapiens
gtcccacgtgtcttccacttt

SEQ ID NO: 3380053 - DNA, 15 bp, Homo sapiens
gtcccactcagtcca

SEQ ID NO: 3380054 - DNA, 11 bp, Homo sapiens
gtcccactgcc

SEQ ID NO: 3380055 - DNA, 18 bp, Homo sapiens
gtcccactgcctcaggtt

SEQ ID NO: 3380056 - DNA, 14 bp, Homo sapiens
gtcccacttctcat

SEQ ID NO: 3380057 - DNA, 19 bp, Homo sapiens
gtcccagaggttatctgcc

SEQ ID NO: 3380058 - DNA, 24 bp, Homo sapiens
gtcccagaggttatctgcctggcc

SEQ ID NO: 3380059 - DNA, 15 bp, Homo sapiens
gtcccagcatccctg

SEQ ID NO: 3380060 - DNA, 16 bp, Homo sapiens
gtcccagccaccccgg

SEQ ID NO: 3380061 - DNA, 22 bp, Homo sapiens
gtcccagcctggggctccctct

SEQ ID NO: 3380062 - DNA, 16 bp, Homo sapiens
gtcccagctgaaggca

SEQ ID NO: 3380063 - DNA, 11 bp, Homo sapiens
gtcccagtggg

SEQ ID NO: 3380064 - DNA, 19 bp, Homo sapiens
gtcccagtgggaggggcag

SEQ ID NO: 3380065 - DNA, 13 bp, Homo sapiens
gtcccatccaggc

SEQ ID NO: 3380066 - DNA, 17 bp, Homo sapiens
gtcccatccaggcagtc

SEQ ID NO: 3380067 - DNA, 15 bp, Homo sapiens
gtcccatcggaagtt

SEQ ID NO: 3380068 - DNA, 17 bp, Homo sapiens
gtcccatgacccacccc

SEQ ID NO: 3380069 - DNA, 18 bp, Homo sapiens
gtcccatgacccacccct

SEQ ID NO: 3380070 - DNA, 22 bp, Homo sapiens
gtcccatgacccacccctgtgc

SEQ ID NO: 3380071 - DNA, 21 bp, Homo sapiens
gtcccatggacactccagtgc

SEQ ID NO: 3380072 - DNA, 14 bp, Homo sapiens
gtccccacccctgc

SEQ ID NO: 3380073 - DNA, 17 bp, Homo sapiens
gtccccacccctgcccc

SEQ ID NO: 3380074 - DNA, 14 bp, Homo sapiens
gtccccactcaccc

SEQ ID NO: 3380075 - DNA, 12 bp, Homo sapiens
gtccccagccct

SEQ ID NO: 3380076 - DNA, 19 bp, Homo sapiens
gtccccagccctgtcctgg

SEQ ID NO: 3380077 - DNA, 12 bp, Homo sapiens
gtccccagggcc

SEQ ID NO: 3380078 - DNA, 22 bp, Homo sapiens
gtccccagggcccctccctctg

SEQ ID NO: 3380079 - DNA, 15 bp, Homo sapiens
gtccccatccccacc

SEQ ID NO: 3380080 - DNA, 17 bp, Homo sapiens
gtccccatccccaccag

SEQ ID NO: 3380081 - DNA, 19 bp, Homo sapiens
gtccccatggcaccctgct

SEQ ID NO: 3380082 - DNA, 16 bp, Homo sapiens
gtcccccaactctgag

SEQ ID NO: 3380083 - DNA, 14 bp, Homo sapiens
gtcccccagctctg

SEQ ID NO: 3380084 - DNA, 16 bp, Homo sapiens
gtcccccagctctggt

SEQ ID NO: 3380085 - DNA, 22 bp, Homo sapiens
gtcccccatccccatcctccag

SEQ ID NO: 3380086 - DNA, 15 bp, Homo sapiens
gtccccctacccacc

SEQ ID NO: 3380087 - DNA, 22 bp, Homo sapiens
gtccccctacccaccgatggag

SEQ ID NO: 3380088 - DNA, 19 bp, Homo sapiens
gtccccctcccctcccagt

SEQ ID NO: 3380089 - DNA, 20 bp, Homo sapiens
gtccccctcccctcccagtc

SEQ ID NO: 3380090 - DNA, 23 bp, Homo sapiens
gtccccctcccctcccagtcctc

SEQ ID NO: 3380091 - DNA, 16 bp, Homo sapiens
gtccccgaggagctgg

SEQ ID NO: 3380092 - DNA, 23 bp, Homo sapiens
gtccccgaggagctgggcccctg

SEQ ID NO: 3380093 - DNA, 15 bp, Homo sapiens
gtcccctaaggaaat

SEQ ID NO: 3380094 - DNA, 16 bp, Homo sapiens
gtcccctactccctct

SEQ ID NO: 3380095 - DNA, 20 bp, Homo sapiens
gtcccctactccctcttcac

SEQ ID NO: 3380096 - DNA, 19 bp, Homo sapiens
gtcccctcactctgtcagc

SEQ ID NO: 3380097 - DNA, 19 bp, Homo sapiens
gtcccctccacatcccagc

SEQ ID NO: 3380098 - DNA, 14 bp, Homo sapiens
gtcccctcctcagt

SEQ ID NO: 3380099 - DNA, 17 bp, Homo sapiens
gtcccctgagttggagc

SEQ ID NO: 3380100 - DNA, 20 bp, Homo sapiens
gtcccctgcgggcgcgggca

SEQ ID NO: 3380101 - DNA, 22 bp, Homo sapiens
gtcccctttgtattccttaaat

SEQ ID NO: 3380102 - DNA, 17 bp, Homo sapiens
gtcccgcactctgcccc

SEQ ID NO: 3380103 - DNA, 14 bp, Homo sapiens
gtcccgccttcctc

SEQ ID NO: 3380104 - DNA, 19 bp, Homo sapiens
gtcccgccttcctcctcca

SEQ ID NO: 3380105 - DNA, 21 bp, Homo sapiens
gtcccgccttcctcctccaca

SEQ ID NO: 3380106 - DNA, 15 bp, Homo sapiens
gtcccggggctccac

SEQ ID NO: 3380107 - DNA, 16 bp, Homo sapiens
gtcccggggtcctgtg

SEQ ID NO: 3380108 - DNA, 20 bp, Homo sapiens
gtcccggggtcctgtggcag

SEQ ID NO: 3380109 - DNA, 23 bp, Homo sapiens
gtcccggggtcctgtggcaggca

SEQ ID NO: 3380110 - DNA, 17 bp, Homo sapiens
gtccctaaagaaaaaaa

SEQ ID NO: 3380111 - DNA, 23 bp, Homo sapiens
gtccctaagtaagtttcttcctg

SEQ ID NO: 3380112 - DNA, 15 bp, Homo sapiens
gtccctatgcatatc

SEQ ID NO: 3380113 - DNA, 13 bp, Homo sapiens
gtccctcccacct

SEQ ID NO: 3380114 - DNA, 15 bp, Homo sapiens
gtccctcccacctct

SEQ ID NO: 3380115 - DNA, 16 bp, Homo sapiens
gtccctcccacctctg

SEQ ID NO: 3380116 - DNA, 18 bp, Homo sapiens
gtccctcctctcacctct

SEQ ID NO: 3380117 - DNA, 12 bp, Homo sapiens
gtccctctcact

SEQ ID NO: 3380118 - DNA, 16 bp, Homo sapiens
gtccctctcactcccc

SEQ ID NO: 3380119 - DNA, 21 bp, Homo sapiens
gtccctctcactccccagccc

SEQ ID NO: 3380120 - DNA, 13 bp, Homo sapiens
gtccctctgaggc

SEQ ID NO: 3380121 - DNA, 16 bp, Homo sapiens
gtccctgcacttgcag

SEQ ID NO: 3380122 - DNA, 21 bp, Homo sapiens
gtccctgcacttgcagactct

SEQ ID NO: 3380123 - DNA, 18 bp, Homo sapiens
gtccctgcagggccatct

SEQ ID NO: 3380124 - DNA, 21 bp, Homo sapiens
gtccctgcagggccatctgac

SEQ ID NO: 3380125 - DNA, 22 bp, Homo sapiens
gtccctgctgctgccagggctt

SEQ ID NO: 3380126 - DNA, 11 bp, Homo sapiens
gtccctggaca

SEQ ID NO: 3380127 - DNA, 12 bp, Homo sapiens
gtccctggacac

SEQ ID NO: 3380128 - DNA, 13 bp, Homo sapiens
gtccctggacaca

SEQ ID NO: 3380129 - DNA, 16 bp, Homo sapiens
gtccctggacacagct

SEQ ID NO: 3380130 - DNA, 22 bp, Homo sapiens
gtccctggacacagctcttcat

SEQ ID NO: 3380131 - DNA, 14 bp, Homo sapiens
gtccctgggccagg

SEQ ID NO: 3380132 - DNA, 12 bp, Homo sapiens
gtccctggtccc

SEQ ID NO: 3380133 - DNA, 11 bp, Homo sapiens
gtccctgtatg

SEQ ID NO: 3380134 - DNA, 19 bp, Homo sapiens
gtccctgtgtgtaggctgg

SEQ ID NO: 3380135 - DNA, 18 bp, Homo sapiens
gtccctgttttctgagcc

SEQ ID NO: 3380136 - DNA, 18 bp, Homo sapiens
gtcccttcccctccctgg

SEQ ID NO: 3380137 - DNA, 21 bp, Homo sapiens
gtcccttgaaggaagagggac

SEQ ID NO: 3380138 - DNA, 14 bp, Homo sapiens
gtcccttgcctcaa

SEQ ID NO: 3380139 - DNA, 16 bp, Homo sapiens
gtccctttccctacct

SEQ ID NO: 3380140 - DNA, 17 bp, Homo sapiens
gtccctttcttggccag

SEQ ID NO: 3380141 - DNA, 13 bp, Homo sapiens
gtcccttttgcta

SEQ ID NO: 3380142 - DNA, 21 bp, Homo sapiens
gtccgaaagggacttggaagc

SEQ ID NO: 3380143 - DNA, 15 bp, Homo sapiens
gtccgcaccagctgc

SEQ ID NO: 3380144 - DNA, 18 bp, Homo sapiens
gtccgccctgctcctccc

SEQ ID NO: 3380145 - DNA, 14 bp, Homo sapiens
gtccgccttaatct

SEQ ID NO: 3380146 - DNA, 22 bp, Homo sapiens
gtccgctgggtggtaccctctg

SEQ ID NO: 3380147 - DNA, 15 bp, Homo sapiens
gtccggcctcttttt

SEQ ID NO: 3380148 - DNA, 16 bp, Homo sapiens
gtccggtgttctaaga

SEQ ID NO: 3380149 - DNA, 19 bp, Homo sapiens
gtccgttcacatgtgtggt

SEQ ID NO: 3380150 - DNA, 22 bp, Homo sapiens
gtcctaacctcgggcctgctgc

SEQ ID NO: 3380151 - DNA, 19 bp, Homo sapiens
gtcctaccagttgccctag

SEQ ID NO: 3380152 - DNA, 12 bp, Homo sapiens
gtcctactctgt

SEQ ID NO: 3380153 - DNA, 15 bp, Homo sapiens
gtcctactctgtgtc

SEQ ID NO: 3380154 - DNA, 20 bp, Homo sapiens
gtcctacttctgactttact

SEQ ID NO: 3380155 - DNA, 22 bp, Homo sapiens
gtcctaggccacaccatctcct

SEQ ID NO: 3380156 - DNA, 15 bp, Homo sapiens
gtcctatctccccca

SEQ ID NO: 3380157 - DNA, 23 bp, Homo sapiens
gtcctatctcccccaacccacct

SEQ ID NO: 3380158 - DNA, 17 bp, Homo sapiens
gtcctatggacaactta

SEQ ID NO: 3380159 - DNA, 19 bp, Homo sapiens
gtcctatggacaacttatt

SEQ ID NO: 3380160 - DNA, 13 bp, Homo sapiens
gtcctatgtgtga

SEQ ID NO: 3380161 - DNA, 18 bp, Homo sapiens
gtcctcactcccagtcca

SEQ ID NO: 3380162 - DNA, 21 bp, Homo sapiens
gtcctcactgctccctgaagc

SEQ ID NO: 3380163 - DNA, 16 bp, Homo sapiens
gtcctcacttggggga

SEQ ID NO: 3380164 - DNA, 21 bp, Homo sapiens
gtcctcacttgggggaaaaaa

SEQ ID NO: 3380165 - DNA, 15 bp, Homo sapiens
gtcctcattataaaa

SEQ ID NO: 3380166 - DNA, 20 bp, Homo sapiens
gtcctccagaagcctctggc

SEQ ID NO: 3380167 - DNA, 18 bp, Homo sapiens
gtcctcccatcccctgga

SEQ ID NO: 3380168 - DNA, 21 bp, Homo sapiens
gtcctcccatcccctggactg

SEQ ID NO: 3380169 - DNA, 16 bp, Homo sapiens
gtcctcccctcacagc

SEQ ID NO: 3380170 - DNA, 19 bp, Homo sapiens
gtcctcccctcacagcctc

SEQ ID NO: 3380171 - DNA, 22 bp, Homo sapiens
gtcctcccctcacagcctctga

SEQ ID NO: 3380172 - DNA, 13 bp, Homo sapiens
gtcctcctcacct

SEQ ID NO: 3380173 - DNA, 15 bp, Homo sapiens
gtcctcctcacctca

SEQ ID NO: 3380174 - DNA, 17 bp, Homo sapiens
gtcctcctcacctcatg

SEQ ID NO: 3380175 - DNA, 21 bp, Homo sapiens
gtcctcctcacctcatgccca

SEQ ID NO: 3380176 - DNA, 16 bp, Homo sapiens
gtcctcgttcaaaaca

SEQ ID NO: 3380177 - DNA, 19 bp, Homo sapiens
gtcctctcagttctctccc

SEQ ID NO: 3380178 - DNA, 20 bp, Homo sapiens
gtcctctcagttctctccct

SEQ ID NO: 3380179 - DNA, 19 bp, Homo sapiens
gtcctctcccctccagcct

SEQ ID NO: 3380180 - DNA, 16 bp, Homo sapiens
gtcctctccctgccaa

SEQ ID NO: 3380181 - DNA, 13 bp, Homo sapiens
gtcctctggagcc

SEQ ID NO: 3380182 - DNA, 23 bp, Homo sapiens
gtcctctttactcccttcctggc

SEQ ID NO: 3380183 - DNA, 17 bp, Homo sapiens
gtcctgaagaggcgggc

SEQ ID NO: 3380184 - DNA, 13 bp, Homo sapiens
gtcctgaccaccc

SEQ ID NO: 3380185 - DNA, 14 bp, Homo sapiens
gtcctgaccaccct

SEQ ID NO: 3380186 - DNA, 15 bp, Homo sapiens
gtcctgacgccctgc

SEQ ID NO: 3380187 - DNA, 13 bp, Homo sapiens
gtcctgactcaac

SEQ ID NO: 3380188 - DNA, 17 bp, Homo sapiens
gtcctgatggtcagctc

SEQ ID NO: 3380189 - DNA, 23 bp, Homo sapiens
gtcctgatggtcagctcccttct

SEQ ID NO: 3380190 - DNA, 17 bp, Homo sapiens
gtcctgcagaagaagct

SEQ ID NO: 3380191 - DNA, 20 bp, Homo sapiens
gtcctgcagaggaccacagt

SEQ ID NO: 3380192 - DNA, 21 bp, Homo sapiens
gtcctgcagaggaccacagtg

SEQ ID NO: 3380193 - DNA, 20 bp, Homo sapiens
gtcctgcagcaaacactcca

SEQ ID NO: 3380194 - DNA, 21 bp, Homo sapiens
gtcctgcagcaaacactccac

SEQ ID NO: 3380195 - DNA, 14 bp, Homo sapiens
gtcctgccagctgc

SEQ ID NO: 3380196 - DNA, 16 bp, Homo sapiens
gtcctgccagctgcct

SEQ ID NO: 3380197 - DNA, 22 bp, Homo sapiens
gtcctgccagctgccttcctca

SEQ ID NO: 3380198 - DNA, 13 bp, Homo sapiens
gtcctgcccatgt

SEQ ID NO: 3380199 - DNA, 14 bp, Homo sapiens
gtcctgcccatgtg

SEQ ID NO: 3380200 - DNA, 16 bp, Homo sapiens
gtcctgcccatgtgtc

SEQ ID NO: 3380201 - DNA, 21 bp, Homo sapiens
gtcctgcccatgtgtcccctc

SEQ ID NO: 3380202 - DNA, 17 bp, Homo sapiens
gtcctgcctgcaatatt

SEQ ID NO: 3380203 - DNA, 20 bp, Homo sapiens
gtcctgcctggccaggcaga

SEQ ID NO: 3380204 - DNA, 15 bp, Homo sapiens
gtcctgcctgtggcg

SEQ ID NO: 3380205 - DNA, 15 bp, Homo sapiens
gtcctgctggcttcc

SEQ ID NO: 3380206 - DNA, 12 bp, Homo sapiens
gtcctgcttctg

SEQ ID NO: 3380207 - DNA, 22 bp, Homo sapiens
gtcctggactcctgccaccagc

SEQ ID NO: 3380208 - DNA, 13 bp, Homo sapiens
gtcctggaggggc

SEQ ID NO: 3380209 - DNA, 20 bp, Homo sapiens
gtcctggaggggctggggac

SEQ ID NO: 3380210 - DNA, 20 bp, Homo sapiens
gtcctggctacatcccagcc

SEQ ID NO: 3380211 - DNA, 22 bp, Homo sapiens
gtcctggctacatcccagcctg

SEQ ID NO: 3380212 - DNA, 15 bp, Homo sapiens
gtcctgggagtgagc

SEQ ID NO: 3380213 - DNA, 19 bp, Homo sapiens
gtcctgggagtgagctggt

SEQ ID NO: 3380214 - DNA, 15 bp, Homo sapiens
gtcctggggctctgt

SEQ ID NO: 3380215 - DNA, 17 bp, Homo sapiens
gtcctggggctctgtgc

SEQ ID NO: 3380216 - DNA, 16 bp, Homo sapiens
gtcctggtccctctga

SEQ ID NO: 3380217 - DNA, 17 bp, Homo sapiens
gtcctggtccctctgag

SEQ ID NO: 3380218 - DNA, 11 bp, Homo sapiens
gtcctggtgtc

SEQ ID NO: 3380219 - DNA, 13 bp, Homo sapiens
gtcctgtcccaga

SEQ ID NO: 3380220 - DNA, 16 bp, Homo sapiens
gtcctgtcccagaggt

SEQ ID NO: 3380221 - DNA, 12 bp, Homo sapiens
gtcctgtgaatg

SEQ ID NO: 3380222 - DNA, 19 bp, Homo sapiens
gtcctgtgaatgccactgc

SEQ ID NO: 3380223 - DNA, 17 bp, Homo sapiens
gtcctgtgaatggaagc

SEQ ID NO: 3380224 - DNA, 15 bp, Homo sapiens
gtcctgtgaatttct

SEQ ID NO: 3380225 - DNA, 15 bp, Homo sapiens
gtcctgtggcaggca

SEQ ID NO: 3380226 - DNA, 21 bp, Homo sapiens
gtcctgtggcaggcagcgcca

SEQ ID NO: 3380227 - DNA, 16 bp, Homo sapiens
gtcctgttccctaccc

SEQ ID NO: 3380228 - DNA, 17 bp, Homo sapiens
gtcctgttgatcccagt

SEQ ID NO: 3380229 - DNA, 19 bp, Homo sapiens
gtccttaaaaatcacactg

SEQ ID NO: 3380230 - DNA, 20 bp, Homo sapiens
gtccttaggagacgctgcac

SEQ ID NO: 3380231 - DNA, 17 bp, Homo sapiens
gtccttattcttctcat

SEQ ID NO: 3380232 - DNA, 13 bp, Homo sapiens
gtccttcagagct

SEQ ID NO: 3380233 - DNA, 14 bp, Homo sapiens
gtccttcagagctc

SEQ ID NO: 3380234 - DNA, 22 bp, Homo sapiens
gtccttccaggcccccaccact

SEQ ID NO: 3380235 - DNA, 18 bp, Homo sapiens
gtccttcccctcttcttc

SEQ ID NO: 3380236 - DNA, 16 bp, Homo sapiens
gtccttcctctcaagc

SEQ ID NO: 3380237 - DNA, 23 bp, Homo sapiens
gtccttcctttaggtctggttgt

SEQ ID NO: 3380238 - DNA, 11 bp, Homo sapiens
gtccttgaaaa

SEQ ID NO: 3380239 - DNA, 19 bp, Homo sapiens
gtccttgatttcaaagttt

SEQ ID NO: 3380240 - DNA, 18 bp, Homo sapiens
gtccttgcacccctcact

SEQ ID NO: 3380241 - DNA, 17 bp, Homo sapiens
gtccttggaagtttcat

SEQ ID NO: 3380242 - DNA, 16 bp, Homo sapiens
gtcctttatgtggaaa

SEQ ID NO: 3380243 - DNA, 20 bp, Homo sapiens
gtcctttatgtggaaaacag

SEQ ID NO: 3380244 - DNA, 21 bp, Homo sapiens
gtcctttatgtggaaaacaga

SEQ ID NO: 3380245 - DNA, 20 bp, Homo sapiens
gtcctttccaaggcttctcc

SEQ ID NO: 3380246 - DNA, 14 bp, Homo sapiens
gtcctttcccacca

SEQ ID NO: 3380247 - DNA, 12 bp, Homo sapiens
gtcctttcccct

SEQ ID NO: 3380248 - DNA, 15 bp, Homo sapiens
gtcctttcccctctc

SEQ ID NO: 3380249 - DNA, 22 bp, Homo sapiens
gtcctttcccctctctgcccct

SEQ ID NO: 3380250 - DNA, 14 bp, Homo sapiens
gtcctttctgcctt

SEQ ID NO: 3380251 - DNA, 18 bp, Homo sapiens
gtcctttctgccttggcc

SEQ ID NO: 3380252 - DNA, 20 bp, Homo sapiens
gtccttttcccctacagaat

SEQ ID NO: 3380253 - DNA, 16 bp, Homo sapiens
gtccttttgacactgc

SEQ ID NO: 3380254 - DNA, 17 bp, Homo sapiens
gtccttttgacactgct

SEQ ID NO: 3380255 - DNA, 21 bp, Homo sapiens
gtccttttgacactgctctaa

SEQ ID NO: 3380256 - DNA, 12 bp, Homo sapiens
gtccttttggtt

SEQ ID NO: 3380257 - DNA, 16 bp, Homo sapiens
gtcctttttttccatc

SEQ ID NO: 3380258 - DNA, 19 bp, Homo sapiens
gtcctttttttccatcttt

SEQ ID NO: 3380259 - DNA, 12 bp, Homo sapiens
gtcgagacactt

SEQ ID NO: 3380260 - DNA, 14 bp, Homo sapiens
gtcgaggacaggga

SEQ ID NO: 3380261 - DNA, 15 bp, Homo sapiens
gtcgaggagtaacaa

SEQ ID NO: 3380262 - DNA, 16 bp, Homo sapiens
gtcgaggggctctcag

SEQ ID NO: 3380263 - DNA, 14 bp, Homo sapiens
gtcgataatcagag

SEQ ID NO: 3380264 - DNA, 17 bp, Homo sapiens
gtcgcaggatccgctgc

SEQ ID NO: 3380265 - DNA, 20 bp, Homo sapiens
gtcgcccaggctggagtgca

SEQ ID NO: 3380266 - DNA, 13 bp, Homo sapiens
gtcgcccagtctg

SEQ ID NO: 3380267 - DNA, 14 bp, Homo sapiens
gtcgcccagtctgg

SEQ ID NO: 3380268 - DNA, 13 bp, Homo sapiens
gtcgccccaggcc

SEQ ID NO: 3380269 - DNA, 14 bp, Homo sapiens
gtcgccccaggccc

SEQ ID NO: 3380270 - DNA, 18 bp, Homo sapiens
gtcgcccgctgagctgag

SEQ ID NO: 3380271 - DNA, 15 bp, Homo sapiens
gtcgctcctgcccac

SEQ ID NO: 3380272 - DNA, 14 bp, Homo sapiens
gtcggaacagcaga

SEQ ID NO: 3380273 - DNA, 22 bp, Homo sapiens
gtcgggcatggtggctcatgcc

SEQ ID NO: 3380274 - DNA, 16 bp, Homo sapiens
gtcgggggctggccta

SEQ ID NO: 3380275 - DNA, 20 bp, Homo sapiens
gtcgtagccaaggtgggctg

SEQ ID NO: 3380276 - DNA, 17 bp, Homo sapiens
gtcgtcatcagatgctt

SEQ ID NO: 3380277 - DNA, 15 bp, Homo sapiens
gtcgtctgtgaatgc

SEQ ID NO: 3380278 - DNA, 21 bp, Homo sapiens
gtcgtgcctccttccacctcc

SEQ ID NO: 3380279 - DNA, 12 bp, Homo sapiens
gtcgtgcctgtg

SEQ ID NO: 3380280 - DNA, 14 bp, Homo sapiens
gtcgtgcctgtgtc

SEQ ID NO: 3380281 - DNA, 17 bp, Homo sapiens
gtcgtgcctgtgtccat

SEQ ID NO: 3380282 - DNA, 19 bp, Homo sapiens
gtcgtgggccagtccccga

SEQ ID NO: 3380283 - DNA, 15 bp, Homo sapiens
gtcgtgtaattggcc

SEQ ID NO: 3380284 - DNA, 15 bp, Homo sapiens
gtcgttggagactga

SEQ ID NO: 3380285 - DNA, 21 bp, Homo sapiens
gtctaaacaatgctgatttgg

SEQ ID NO: 3380286 - DNA, 20 bp, Homo sapiens
gtctaaagatggagtttcta

SEQ ID NO: 3380287 - DNA, 16 bp, Homo sapiens
gtctaaatatttcctt

SEQ ID NO: 3380288 - DNA, 23 bp, Homo sapiens
gtctaactttagaagtgcatttc

SEQ ID NO: 3380289 - DNA, 23 bp, Homo sapiens
gtctaagatagtaacaatgaaga

SEQ ID NO: 3380290 - DNA, 12 bp, Homo sapiens
gtctaagattct

SEQ ID NO: 3380291 - DNA, 21 bp, Homo sapiens
gtctaatctagatatcgactt

SEQ ID NO: 3380292 - DNA, 12 bp, Homo sapiens
gtctacatttct

SEQ ID NO: 3380293 - DNA, 17 bp, Homo sapiens
gtctacatttctgcaga

SEQ ID NO: 3380294 - DNA, 22 bp, Homo sapiens
gtctactgtggtgatctgtaga

SEQ ID NO: 3380295 - DNA, 16 bp, Homo sapiens
gtctagagtcatgtga

SEQ ID NO: 3380296 - DNA, 15 bp, Homo sapiens
gtctagattcaaagg

SEQ ID NO: 3380297 - DNA, 19 bp, Homo sapiens
gtctagcagagcaggggca

SEQ ID NO: 3380298 - DNA, 16 bp, Homo sapiens
gtctagtcattgtcat

SEQ ID NO: 3380299 - DNA, 21 bp, Homo sapiens
gtctagttgccaaatctggct

SEQ ID NO: 3380300 - DNA, 23 bp, Homo sapiens
gtctagttgccaaatctggctcc

SEQ ID NO: 3380301 - DNA, 14 bp, Homo sapiens
gtctagtttcccac

SEQ ID NO: 3380302 - DNA, 18 bp, Homo sapiens
gtctagtttcccacattc

SEQ ID NO: 3380303 - DNA, 14 bp, Homo sapiens
gtctagtttcctgg

SEQ ID NO: 3380304 - DNA, 18 bp, Homo sapiens
gtctatcaagtcaatcat

SEQ ID NO: 3380305 - DNA, 14 bp, Homo sapiens
gtctatccacagag

SEQ ID NO: 3380306 - DNA, 18 bp, Homo sapiens
gtctatgaagttgctgtt

SEQ ID NO: 3380307 - DNA, 16 bp, Homo sapiens
gtctatgattgtactt

SEQ ID NO: 3380308 - DNA, 15 bp, Homo sapiens
gtctatgcagcctgc

SEQ ID NO: 3380309 - DNA, 17 bp, Homo sapiens
gtctatgcagcctgctc

SEQ ID NO: 3380310 - DNA, 23 bp, Homo sapiens
gtctatgtagctgaaaataaaat

SEQ ID NO: 3380311 - DNA, 10 bp, Homo sapiens
gtctatttaa

SEQ ID NO: 3380312 - DNA, 15 bp, Homo sapiens
gtctattttaaaata

SEQ ID NO: 3380313 - DNA, 17 bp, Homo sapiens
gtctcaaaataaagcaa

SEQ ID NO: 3380314 - DNA, 20 bp, Homo sapiens
gtctcaagagggcactggtg

SEQ ID NO: 3380315 - DNA, 22 bp, Homo sapiens
gtctcaagagggcactggtggc

SEQ ID NO: 3380316 - DNA, 19 bp, Homo sapiens
gtctcacagtgttgcccag

SEQ ID NO: 3380317 - DNA, 23 bp, Homo sapiens
gtctcacagtgttgcccaggctg

SEQ ID NO: 3380318 - DNA, 23 bp, Homo sapiens
gtctcacgggcatgggcactccc

SEQ ID NO: 3380319 - DNA, 18 bp, Homo sapiens
gtctcactatgttgccca

SEQ ID NO: 3380320 - DNA, 22 bp, Homo sapiens
gtctcactctgtcgcccagtct

SEQ ID NO: 3380321 - DNA, 20 bp, Homo sapiens
gtctcactgttgcccaggct

SEQ ID NO: 3380322 - DNA, 22 bp, Homo sapiens
gtctcactgttgcccaggctgg

SEQ ID NO: 3380323 - DNA, 14 bp, Homo sapiens
gtctcacttttcat

SEQ ID NO: 3380324 - DNA, 21 bp, Homo sapiens
gtctcagaaactcccctgggg

SEQ ID NO: 3380325 - DNA, 23 bp, Homo sapiens
gtctcagaaactcccctgggggt

SEQ ID NO: 3380326 - DNA, 13 bp, Homo sapiens
gtctcagcctccc

SEQ ID NO: 3380327 - DNA, 12 bp, Homo sapiens
gtctcaggagca

SEQ ID NO: 3380328 - DNA, 13 bp, Homo sapiens
gtctcaggcctcc

SEQ ID NO: 3380329 - DNA, 14 bp, Homo sapiens
gtctcaggcctcca

SEQ ID NO: 3380330 - DNA, 18 bp, Homo sapiens
gtctcaggctggtgggag

SEQ ID NO: 3380331 - DNA, 12 bp, Homo sapiens
gtctcagggccg

SEQ ID NO: 3380332 - DNA, 17 bp, Homo sapiens
gtctcagggtgcagagg

SEQ ID NO: 3380333 - DNA, 18 bp, Homo sapiens
gtctcagggtgcagaggt

SEQ ID NO: 3380334 - DNA, 15 bp, Homo sapiens
gtctcagtttcactt

SEQ ID NO: 3380335 - DNA, 18 bp, Homo sapiens
gtctcagtttgtgtgtct

SEQ ID NO: 3380336 - DNA, 21 bp, Homo sapiens
gtctcagtttgtgtgtcttaa

SEQ ID NO: 3380337 - DNA, 14 bp, Homo sapiens
gtctcatcctcctg

SEQ ID NO: 3380338 - DNA, 12 bp, Homo sapiens
gtctcatctctt

SEQ ID NO: 3380339 - DNA, 15 bp, Homo sapiens
gtctcatctcttcag

SEQ ID NO: 3380340 - DNA, 14 bp, Homo sapiens
gtctcatgggaagc

SEQ ID NO: 3380341 - DNA, 17 bp, Homo sapiens
gtctcatgtcctgctgg

SEQ ID NO: 3380342 - DNA, 21 bp, Homo sapiens
gtctcattcgcctttgtcttg

SEQ ID NO: 3380343 - DNA, 15 bp, Homo sapiens
gtctcattgcttctg

SEQ ID NO: 3380344 - DNA, 23 bp, Homo sapiens
gtctccaaaaaaaaaaaaaatac

SEQ ID NO: 3380345 - DNA, 21 bp, Homo sapiens
gtctccaggggctgcttcctc

SEQ ID NO: 3380346 - DNA, 23 bp, Homo sapiens
gtctccaggggctgcttcctcct

SEQ ID NO: 3380347 - DNA, 17 bp, Homo sapiens
gtctcccacgtgggaga

SEQ ID NO: 3380348 - DNA, 23 bp, Homo sapiens
gtctccctcgacagcgcccctgc

SEQ ID NO: 3380349 - DNA, 18 bp, Homo sapiens
gtctccctttcccttctt

SEQ ID NO: 3380350 - DNA, 18 bp, Homo sapiens
gtctcctcactctgtccc

SEQ ID NO: 3380351 - DNA, 16 bp, Homo sapiens
gtctcctccccttccc

SEQ ID NO: 3380352 - DNA, 12 bp, Homo sapiens
gtctcctccctc

SEQ ID NO: 3380353 - DNA, 20 bp, Homo sapiens
gtctccttactctgagccca

SEQ ID NO: 3380354 - DNA, 15 bp, Homo sapiens
gtctccttcagcacg

SEQ ID NO: 3380355 - DNA, 20 bp, Homo sapiens
gtctccttcagcacggcgtg

SEQ ID NO: 3380356 - DNA, 14 bp, Homo sapiens
gtctccttgcactt

SEQ ID NO: 3380357 - DNA, 20 bp, Homo sapiens
gtctcctttgcactgagggc

SEQ ID NO: 3380358 - DNA, 22 bp, Homo sapiens
gtctcctttgcactgagggcca

SEQ ID NO: 3380359 - DNA, 15 bp, Homo sapiens
gtctcctttgctctt

SEQ ID NO: 3380360 - DNA, 18 bp, Homo sapiens
gtctcctttgctcttgcc

SEQ ID NO: 3380361 - DNA, 16 bp, Homo sapiens
gtctcgatctcctgac

SEQ ID NO: 3380362 - DNA, 22 bp, Homo sapiens
gtctcgctgtcactggctggct

SEQ ID NO: 3380363 - DNA, 17 bp, Homo sapiens
gtctcgctttgttgccc

SEQ ID NO: 3380364 - DNA, 13 bp, Homo sapiens
gtctctaaagcac

SEQ ID NO: 3380365 - DNA, 14 bp, Homo sapiens
gtctctaaagcact

SEQ ID NO: 3380366 - DNA, 19 bp, Homo sapiens
gtctctaagtgtaaaagta

SEQ ID NO: 3380367 - DNA, 21 bp, Homo sapiens
gtctctaattctattaaagtg

SEQ ID NO: 3380368 - DNA, 18 bp, Homo sapiens
gtctctatattatgtctt

SEQ ID NO: 3380369 - DNA, 21 bp, Homo sapiens
gtctctatattatgtcttctt

SEQ ID NO: 3380370 - DNA, 22 bp, Homo sapiens
gtctctatattatgtcttcttt

SEQ ID NO: 3380371 - DNA, 11 bp, Homo sapiens
gtctctattta

SEQ ID NO: 3380372 - DNA, 17 bp, Homo sapiens
gtctctatttaaattct

SEQ ID NO: 3380373 - DNA, 20 bp, Homo sapiens
gtctctatttaaattctttt

SEQ ID NO: 3380374 - DNA, 21 bp, Homo sapiens
gtctctatttaaattcttttt

SEQ ID NO: 3380375 - DNA, 16 bp, Homo sapiens
gtctctatttcatttt

SEQ ID NO: 3380376 - DNA, 21 bp, Homo sapiens
gtctctcactgtcgcccaggc

SEQ ID NO: 3380377 - DNA, 13 bp, Homo sapiens
gtctctcccaccc

SEQ ID NO: 3380378 - DNA, 20 bp, Homo sapiens
gtctctcccaccccggcctc

SEQ ID NO: 3380379 - DNA, 15 bp, Homo sapiens
gtctctccctcaggt

SEQ ID NO: 3380380 - DNA, 21 bp, Homo sapiens
gtctctcctgtaagccaaaga

SEQ ID NO: 3380381 - DNA, 19 bp, Homo sapiens
gtctctctctctctacaaa

SEQ ID NO: 3380382 - DNA, 11 bp, Homo sapiens
gtctctctgtg

SEQ ID NO: 3380383 - DNA, 21 bp, Homo sapiens
gtctctctgtgaatacaatta

SEQ ID NO: 3380384 - DNA, 22 bp, Homo sapiens
gtctctctgtgaatacaattaa

SEQ ID NO: 3380385 - DNA, 16 bp, Homo sapiens
gtctctcttaaagttg

SEQ ID NO: 3380386 - DNA, 14 bp, Homo sapiens
gtctctcttctctc

SEQ ID NO: 3380387 - DNA, 17 bp, Homo sapiens
gtctctgaagtactaac

SEQ ID NO: 3380388 - DNA, 13 bp, Homo sapiens
gtctctgagtcct

SEQ ID NO: 3380389 - DNA, 17 bp, Homo sapiens
gtctctgagtcctttgc

SEQ ID NO: 3380390 - DNA, 12 bp, Homo sapiens
gtctctgcatct

SEQ ID NO: 3380391 - DNA, 13 bp, Homo sapiens
gtctctgccaccc

SEQ ID NO: 3380392 - DNA, 14 bp, Homo sapiens
gtctctgccaccca

SEQ ID NO: 3380393 - DNA, 16 bp, Homo sapiens
gtctctgccacccact

SEQ ID NO: 3380394 - DNA, 22 bp, Homo sapiens
gtctctgccacccactcaggat

SEQ ID NO: 3380395 - DNA, 15 bp, Homo sapiens
gtctctgctcgccct

SEQ ID NO: 3380396 - DNA, 17 bp, Homo sapiens
gtctctgctggcccagc

SEQ ID NO: 3380397 - DNA, 11 bp, Homo sapiens
gtctctggggc

SEQ ID NO: 3380398 - DNA, 19 bp, Homo sapiens
gtctctggggcaggctgct

SEQ ID NO: 3380399 - DNA, 11 bp, Homo sapiens
gtctcttcaga

SEQ ID NO: 3380400 - DNA, 17 bp, Homo sapiens
gtctcttccacaggaag

SEQ ID NO: 3380401 - DNA, 14 bp, Homo sapiens
gtctcttctccact

SEQ ID NO: 3380402 - DNA, 22 bp, Homo sapiens
gtctcttctcccagaatcccag

SEQ ID NO: 3380403 - DNA, 22 bp, Homo sapiens
gtctcttctgagctatttcatc

SEQ ID NO: 3380404 - DNA, 19 bp, Homo sapiens
gtctcttgtattaaactct

SEQ ID NO: 3380405 - DNA, 23 bp, Homo sapiens
gtctctttaagggcatgccttgt

SEQ ID NO: 3380406 - DNA, 17 bp, Homo sapiens
gtctctttaatcttcag

SEQ ID NO: 3380407 - DNA, 20 bp, Homo sapiens
gtctctttaatgtcacaggc

SEQ ID NO: 3380408 - DNA, 12 bp, Homo sapiens
gtctctttctgt

SEQ ID NO: 3380409 - DNA, 17 bp, Homo sapiens
gtctctttctgtacaag

SEQ ID NO: 3380410 - DNA, 15 bp, Homo sapiens
gtctctttcttcctt

SEQ ID NO: 3380411 - DNA, 13 bp, Homo sapiens
gtctcttttctct

SEQ ID NO: 3380412 - DNA, 14 bp, Homo sapiens
gtctcttttctctt

SEQ ID NO: 3380413 - DNA, 17 bp, Homo sapiens
gtctcttttgtaaatta

SEQ ID NO: 3380414 - DNA, 18 bp, Homo sapiens
gtctcttttgtaaattaa

SEQ ID NO: 3380415 - DNA, 11 bp, Homo sapiens
gtctgaaatgg

SEQ ID NO: 3380416 - DNA, 15 bp, Homo sapiens
gtctgaacccttgtg

SEQ ID NO: 3380417 - DNA, 21 bp, Homo sapiens
gtctgaaggaatagccagaga

SEQ ID NO: 3380418 - DNA, 15 bp, Homo sapiens
gtctgacaaatgtgt

SEQ ID NO: 3380419 - DNA, 18 bp, Homo sapiens
gtctgacaggcaatgctg

SEQ ID NO: 3380420 - DNA, 14 bp, Homo sapiens
gtctgacccactgc

SEQ ID NO: 3380421 - DNA, 15 bp, Homo sapiens
gtctgactccagagt

SEQ ID NO: 3380422 - DNA, 18 bp, Homo sapiens
gtctgactccagagtctg

SEQ ID NO: 3380423 - DNA, 21 bp, Homo sapiens
gtctgactccagagtctgagc

SEQ ID NO: 3380424 - DNA, 23 bp, Homo sapiens
gtctgactccagagtctgagccc

SEQ ID NO: 3380425 - DNA, 21 bp, Homo sapiens
gtctgagactcacaggaagga

SEQ ID NO: 3380426 - DNA, 16 bp, Homo sapiens
gtctgagcatgatggg

SEQ ID NO: 3380427 - DNA, 18 bp, Homo sapiens
gtctgagccaaagagaat

SEQ ID NO: 3380428 - DNA, 12 bp, Homo sapiens
gtctgagccccc

SEQ ID NO: 3380429 - DNA, 16 bp, Homo sapiens
gtctgagcccccggct

SEQ ID NO: 3380430 - DNA, 18 bp, Homo sapiens
gtctgaggaatccagacc

SEQ ID NO: 3380431 - DNA, 19 bp, Homo sapiens
gtctgaggcctcatccctc

SEQ ID NO: 3380432 - DNA, 22 bp, Homo sapiens
gtctgaggcctcatccctcgga

SEQ ID NO: 3380433 - DNA, 21 bp, Homo sapiens
gtctgagtcctgtctctgcct

SEQ ID NO: 3380434 - DNA, 22 bp, Homo sapiens
gtctgagtcctgtctctgcctg

SEQ ID NO: 3380435 - DNA, 21 bp, Homo sapiens
gtctgattcccaagctctgct

SEQ ID NO: 3380436 - DNA, 13 bp, Homo sapiens
gtctgattggctt

SEQ ID NO: 3380437 - DNA, 20 bp, Homo sapiens
gtctgatttatggttttttt

SEQ ID NO: 3380438 - DNA, 23 bp, Homo sapiens
gtctgcaactttaagcagctctt

SEQ ID NO: 3380439 - DNA, 13 bp, Homo sapiens
gtctgcaagtcag

SEQ ID NO: 3380440 - DNA, 16 bp, Homo sapiens
gtctgcaagtcagagg

SEQ ID NO: 3380441 - DNA, 18 bp, Homo sapiens
gtctgcaagtcagaggat

SEQ ID NO: 3380442 - DNA, 19 bp, Homo sapiens
gtctgcatacgagagactt

SEQ ID NO: 3380443 - DNA, 18 bp, Homo sapiens
gtctgcattgttattgtg

SEQ ID NO: 3380444 - DNA, 14 bp, Homo sapiens
gtctgccatgctct

SEQ ID NO: 3380445 - DNA, 17 bp, Homo sapiens
gtctgctctttctctgc

SEQ ID NO: 3380446 - DNA, 12 bp, Homo sapiens
gtctgctgctgt

SEQ ID NO: 3380447 - DNA, 23 bp, Homo sapiens
gtctgctttaaagggcctgcctg

SEQ ID NO: 3380448 - DNA, 18 bp, Homo sapiens
gtctggaatgcagtggta

SEQ ID NO: 3380449 - DNA, 16 bp, Homo sapiens
gtctggagaaggtatt

SEQ ID NO: 3380450 - DNA, 14 bp, Homo sapiens
gtctggagcggctg

SEQ ID NO: 3380451 - DNA, 21 bp, Homo sapiens
gtctggagcggctgctcgccc

SEQ ID NO: 3380452 - DNA, 14 bp, Homo sapiens
gtctggagtgggca

SEQ ID NO: 3380453 - DNA, 19 bp, Homo sapiens
gtctggagtgggcagagcc

SEQ ID NO: 3380454 - DNA, 16 bp, Homo sapiens
gtctggctttaccttt

SEQ ID NO: 3380455 - DNA, 18 bp, Homo sapiens
gtctggctttttcctctg

SEQ ID NO: 3380456 - DNA, 20 bp, Homo sapiens
gtctggctttttcctctgag

SEQ ID NO: 3380457 - DNA, 24 bp, Homo sapiens
gtctggctttttcctctgagccca

SEQ ID NO: 3380458 - DNA, 19 bp, Homo sapiens
gtctgggatatggctgccc

SEQ ID NO: 3380459 - DNA, 17 bp, Homo sapiens
gtctgggattaagggca

SEQ ID NO: 3380460 - DNA, 20 bp, Homo sapiens
gtctggtggccccgtttctg

SEQ ID NO: 3380461 - DNA, 16 bp, Homo sapiens
gtctggttttaacaat

SEQ ID NO: 3380462 - DNA, 14 bp, Homo sapiens
gtctgtacacgtgt

SEQ ID NO: 3380463 - DNA, 18 bp, Homo sapiens
gtctgtacctcaaatgaa

SEQ ID NO: 3380464 - DNA, 16 bp, Homo sapiens
gtctgtaggtgaaaga

SEQ ID NO: 3380465 - DNA, 18 bp, Homo sapiens
gtctgtatttcatgtggc

SEQ ID NO: 3380466 - DNA, 22 bp, Homo sapiens
gtctgtcatgaacatgttcctg

SEQ ID NO: 3380467 - DNA, 20 bp, Homo sapiens
gtctgtcccggggtcctgtg

SEQ ID NO: 3380468 - DNA, 14 bp, Homo sapiens
gtctgtgaagagcc

SEQ ID NO: 3380469 - DNA, 15 bp, Homo sapiens
gtctgtgaatgctaa

SEQ ID NO: 3380470 - DNA, 17 bp, Homo sapiens
gtctgtgagatgctaga

SEQ ID NO: 3380471 - DNA, 21 bp, Homo sapiens
gtctgtgagatgctagaactc

SEQ ID NO: 3380472 - DNA, 19 bp, Homo sapiens
gtctgtgccctccaaagag

SEQ ID NO: 3380473 - DNA, 18 bp, Homo sapiens
gtctgtgctgtgcctgct

SEQ ID NO: 3380474 - DNA, 14 bp, Homo sapiens
gtctgtggactgca

SEQ ID NO: 3380475 - DNA, 13 bp, Homo sapiens
gtctgtggatcag

SEQ ID NO: 3380476 - DNA, 16 bp, Homo sapiens
gtctgtgtgaatgtgg

SEQ ID NO: 3380477 - DNA, 20 bp, Homo sapiens
gtctgtgtgatgaactttct

SEQ ID NO: 3380478 - DNA, 22 bp, Homo sapiens
gtctgtgttgcgtgtcgtgggt

SEQ ID NO: 3380479 - DNA, 15 bp, Homo sapiens
gtctgtgttgctgtt

SEQ ID NO: 3380480 - DNA, 16 bp, Homo sapiens
gtctgtgtttacagac

SEQ ID NO: 3380481 - DNA, 16 bp, Homo sapiens
gtctgttaacttaata

SEQ ID NO: 3380482 - DNA, 15 bp, Homo sapiens
gtctgttaccatgtc

SEQ ID NO: 3380483 - DNA, 20 bp, Homo sapiens
gtctgttaccatgtcactgt

SEQ ID NO: 3380484 - DNA, 18 bp, Homo sapiens
gtctgttctgtttcaagg

SEQ ID NO: 3380485 - DNA, 18 bp, Homo sapiens
gtctgttggcaggctggc

SEQ ID NO: 3380486 - DNA, 19 bp, Homo sapiens
gtctgttggcaggctggcc

SEQ ID NO: 3380487 - DNA, 20 bp, Homo sapiens
gtctgttggcaggctggcca

SEQ ID NO: 3380488 - DNA, 21 bp, Homo sapiens
gtctgttggcaggctggccag

SEQ ID NO: 3380489 - DNA, 13 bp, Homo sapiens
gtctgtttggact

SEQ ID NO: 3380490 - DNA, 20 bp, Homo sapiens
gtctgttttcctttctcacc

SEQ ID NO: 3380491 - DNA, 21 bp, Homo sapiens
gtctgttttcctttctcaccg

SEQ ID NO: 3380492 - DNA, 13 bp, Homo sapiens
gtcttaaatgaga

SEQ ID NO: 3380493 - DNA, 21 bp, Homo sapiens
gtcttaacaaaccaacatctt

SEQ ID NO: 3380494 - DNA, 21 bp, Homo sapiens
gtcttaatggtatcctactga

SEQ ID NO: 3380495 - DNA, 18 bp, Homo sapiens
gtcttaattattatttgt

SEQ ID NO: 3380496 - DNA, 18 bp, Homo sapiens
gtcttacaatcaaatctc

SEQ ID NO: 3380497 - DNA, 15 bp, Homo sapiens
gtcttagagcctttt

SEQ ID NO: 3380498 - DNA, 17 bp, Homo sapiens
gtcttcaacatcctgcc

SEQ ID NO: 3380499 - DNA, 20 bp, Homo sapiens
gtcttcaacatcctgccagc

SEQ ID NO: 3380500 - DNA, 19 bp, Homo sapiens
gtcttcacctgccaccaca

SEQ ID NO: 3380501 - DNA, 22 bp, Homo sapiens
gtcttcagagataggcctgtgg

SEQ ID NO: 3380502 - DNA, 11 bp, Homo sapiens
gtcttcataaa

SEQ ID NO: 3380503 - DNA, 17 bp, Homo sapiens
gtcttcatttcattgta

SEQ ID NO: 3380504 - DNA, 19 bp, Homo sapiens
gtcttccaaggagaccaag

SEQ ID NO: 3380505 - DNA, 13 bp, Homo sapiens
gtcttccagacct

SEQ ID NO: 3380506 - DNA, 16 bp, Homo sapiens
gtcttccagacctgct

SEQ ID NO: 3380507 - DNA, 15 bp, Homo sapiens
gtcttccataatgta

SEQ ID NO: 3380508 - DNA, 17 bp, Homo sapiens
gtcttccataatgtata

SEQ ID NO: 3380509 - DNA, 15 bp, Homo sapiens
gtcttccctacctca

SEQ ID NO: 3380510 - DNA, 18 bp, Homo sapiens
gtcttcctgaaatgcagt

SEQ ID NO: 3380511 - DNA, 14 bp, Homo sapiens
gtcttcctgacact

SEQ ID NO: 3380512 - DNA, 12 bp, Homo sapiens
gtcttcctgagt

SEQ ID NO: 3380513 - DNA, 14 bp, Homo sapiens
gtcttctaaacttc

SEQ ID NO: 3380514 - DNA, 23 bp, Homo sapiens
gtcttctcatagcattaactaat

SEQ ID NO: 3380515 - DNA, 22 bp, Homo sapiens
gtcttctggtctgtgtgtgttc

SEQ ID NO: 3380516 - DNA, 23 bp, Homo sapiens
gtcttctggtctgtgtgtgttct

SEQ ID NO: 3380517 - DNA, 16 bp, Homo sapiens
gtcttgaactcctggc

SEQ ID NO: 3380518 - DNA, 20 bp, Homo sapiens
gtcttgaactcctggcctca

SEQ ID NO: 3380519 - DNA, 21 bp, Homo sapiens
gtcttgagccagtaatcttta

SEQ ID NO: 3380520 - DNA, 20 bp, Homo sapiens
gtcttgcaatggcagccttg

SEQ ID NO: 3380521 - DNA, 22 bp, Homo sapiens
gtcttggaagctgtttggaaaa

SEQ ID NO: 3380522 - DNA, 18 bp, Homo sapiens
gtcttggacactgtacaa

SEQ ID NO: 3380523 - DNA, 16 bp, Homo sapiens
gtcttggcggcagcag

SEQ ID NO: 3380524 - DNA, 19 bp, Homo sapiens
gtcttgggcagagctggct

SEQ ID NO: 3380525 - DNA, 22 bp, Homo sapiens
gtcttgggctactggcagctcc

SEQ ID NO: 3380526 - DNA, 19 bp, Homo sapiens
gtcttgggggtcagggggg

SEQ ID NO: 3380527 - DNA, 18 bp, Homo sapiens
gtcttggtttctctctac

SEQ ID NO: 3380528 - DNA, 12 bp, Homo sapiens
gtcttgtacttc

SEQ ID NO: 3380529 - DNA, 14 bp, Homo sapiens
gtcttgttctgtcc

SEQ ID NO: 3380530 - DNA, 23 bp, Homo sapiens
gtcttgttctgtcccttccactt

SEQ ID NO: 3380531 - DNA, 19 bp, Homo sapiens
gtctttaaaaactgtttta

SEQ ID NO: 3380532 - DNA, 15 bp, Homo sapiens
gtctttactggacct

SEQ ID NO: 3380533 - DNA, 17 bp, Homo sapiens
gtctttaggcagcagct

SEQ ID NO: 3380534 - DNA, 17 bp, Homo sapiens
gtctttagttttgattt

SEQ ID NO: 3380535 - DNA, 18 bp, Homo sapiens
gtctttattcttattact

SEQ ID NO: 3380536 - DNA, 16 bp, Homo sapiens
gtctttcacagctcct

SEQ ID NO: 3380537 - DNA, 21 bp, Homo sapiens
gtctttcaggaccttttgaag

SEQ ID NO: 3380538 - DNA, 15 bp, Homo sapiens
gtctttcagtacttt

SEQ ID NO: 3380539 - DNA, 13 bp, Homo sapiens
gtctttcatggct

SEQ ID NO: 3380540 - DNA, 16 bp, Homo sapiens
gtctttcatggctgct

SEQ ID NO: 3380541 - DNA, 19 bp, Homo sapiens
gtctttcatggctgctgtt

SEQ ID NO: 3380542 - DNA, 23 bp, Homo sapiens
gtctttcatggctgctgttgctt

SEQ ID NO: 3380543 - DNA, 22 bp, Homo sapiens
gtctttccaaattatttcttaa

SEQ ID NO: 3380544 - DNA, 16 bp, Homo sapiens
gtctttccactttcat

SEQ ID NO: 3380545 - DNA, 17 bp, Homo sapiens
gtctttccactttcatc

SEQ ID NO: 3380546 - DNA, 19 bp, Homo sapiens
gtctttcctcctacctttt

SEQ ID NO: 3380547 - DNA, 16 bp, Homo sapiens
gtctttcctggcacta

SEQ ID NO: 3380548 - DNA, 21 bp, Homo sapiens
gtctttctaatgtagctattt

SEQ ID NO: 3380549 - DNA, 13 bp, Homo sapiens
gtctttgccttct

SEQ ID NO: 3380550 - DNA, 20 bp, Homo sapiens
gtctttggaaaaatgtttgt

SEQ ID NO: 3380551 - DNA, 12 bp, Homo sapiens
gtctttgtaaga

SEQ ID NO: 3380552 - DNA, 15 bp, Homo sapiens
gtctttgtaagagtg

SEQ ID NO: 3380553 - DNA, 22 bp, Homo sapiens
gtctttgtcaccacgtggggct

SEQ ID NO: 3380554 - DNA, 19 bp, Homo sapiens
gtcttttatatttgtatcg

SEQ ID NO: 3380555 - DNA, 16 bp, Homo sapiens
gtcttttcaggtttgt

SEQ ID NO: 3380556 - DNA, 23 bp, Homo sapiens
gtcttttcttggcaaaagccttg

SEQ ID NO: 3380557 - DNA, 23 bp, Homo sapiens
gtcttttgcatgtcgcacaatgt

SEQ ID NO: 3380558 - DNA, 14 bp, Homo sapiens
gtcttttgcttttg

SEQ ID NO: 3380559 - DNA, 16 bp, Homo sapiens
gtcttttgcttttggc

SEQ ID NO: 3380560 - DNA, 22 bp, Homo sapiens
gtctttttctgttgtaacttat

SEQ ID NO: 3380561 - DNA, 16 bp, Homo sapiens
gtcttttttcactaca

SEQ ID NO: 3380562 - DNA, 22 bp, Homo sapiens
gtcttttttcatttcttcctca

SEQ ID NO: 3380563 - DNA, 20 bp, Homo sapiens
gtgaaaaaagaaaatggcta

SEQ ID NO: 3380564 - DNA, 19 bp, Homo sapiens
gtgaaaaactgctgtaaac

SEQ ID NO: 3380565 - DNA, 15 bp, Homo sapiens
gtgaaaacggagctg

SEQ ID NO: 3380566 - DNA, 23 bp, Homo sapiens
gtgaaaatatacttgactctaat

SEQ ID NO: 3380567 - DNA, 12 bp, Homo sapiens
gtgaaaatcttg

SEQ ID NO: 3380568 - DNA, 15 bp, Homo sapiens
gtgaaaatgaagaag

SEQ ID NO: 3380569 - DNA, 22 bp, Homo sapiens
gtgaaacaatgttgtccaacaa

SEQ ID NO: 3380570 - DNA, 20 bp, Homo sapiens
gtgaaacacaccaggctgtg

SEQ ID NO: 3380571 - DNA, 13 bp, Homo sapiens
gtgaaacacagct

SEQ ID NO: 3380572 - DNA, 14 bp, Homo sapiens
gtgaaacacagctg

SEQ ID NO: 3380573 - DNA, 20 bp, Homo sapiens
gtgaaaccccatctctacta

SEQ ID NO: 3380574 - DNA, 17 bp, Homo sapiens
gtgaaacctgtgaagct

SEQ ID NO: 3380575 - DNA, 18 bp, Homo sapiens
gtgaaacctttagggcag

SEQ ID NO: 3380576 - DNA, 22 bp, Homo sapiens
gtgaaacctttagggcagcttg

SEQ ID NO: 3380577 - DNA, 17 bp, Homo sapiens
gtgaaaccttttttaag

SEQ ID NO: 3380578 - DNA, 22 bp, Homo sapiens
gtgaaaccttttttaagatttt

SEQ ID NO: 3380579 - DNA, 14 bp, Homo sapiens
gtgaaactttcatt

SEQ ID NO: 3380580 - DNA, 12 bp, Homo sapiens
gtgaaagaaagc

SEQ ID NO: 3380581 - DNA, 20 bp, Homo sapiens
gtgaaagaaagctgagaaga

SEQ ID NO: 3380582 - DNA, 17 bp, Homo sapiens
gtgaaagctgagaactc

SEQ ID NO: 3380583 - DNA, 17 bp, Homo sapiens
gtgaaaggcagggccct

SEQ ID NO: 3380584 - DNA, 12 bp, Homo sapiens
gtgaaagggcta

SEQ ID NO: 3380585 - DNA, 18 bp, Homo sapiens
gtgaaagtgtaaaataga

SEQ ID NO: 3380586 - DNA, 19 bp, Homo sapiens
gtgaaagtgtaaaatagaa

SEQ ID NO: 3380587 - DNA, 15 bp, Homo sapiens
gtgaaagtgtcgtct

SEQ ID NO: 3380588 - DNA, 21 bp, Homo sapiens
gtgaaataattaaaaaccact

SEQ ID NO: 3380589 - DNA, 23 bp, Homo sapiens
gtgaaataccacaagcctgagaa

SEQ ID NO: 3380590 - DNA, 14 bp, Homo sapiens
gtgaaatataattg

SEQ ID NO: 3380591 - DNA, 17 bp, Homo sapiens
gtgaacacttagtgatc

SEQ ID NO: 3380592 - DNA, 24 bp, Homo sapiens
gtgaacatcccttattagttacaa

SEQ ID NO: 3380593 - DNA, 21 bp, Homo sapiens
gtgaaccaccacacccagccc

SEQ ID NO: 3380594 - DNA, 23 bp, Homo sapiens
gtgaaccaccacacccagcccac

SEQ ID NO: 3380595 - DNA, 14 bp, Homo sapiens
gtgaacgatttaga

SEQ ID NO: 3380596 - DNA, 17 bp, Homo sapiens
gtgaactagggaagctc

SEQ ID NO: 3380597 - DNA, 20 bp, Homo sapiens
gtgaactatttctacacagt

SEQ ID NO: 3380598 - DNA, 17 bp, Homo sapiens
gtgaactggaagaaagc

SEQ ID NO: 3380599 - DNA, 18 bp, Homo sapiens
gtgaactggaagaaagca

SEQ ID NO: 3380600 - DNA, 12 bp, Homo sapiens
gtgaacttgtag

SEQ ID NO: 3380601 - DNA, 13 bp, Homo sapiens
gtgaacttgtagc

SEQ ID NO: 3380602 - DNA, 15 bp, Homo sapiens
gtgaacttgtagctg

SEQ ID NO: 3380603 - DNA, 18 bp, Homo sapiens
gtgaacttgtagctgtaa

SEQ ID NO: 3380604 - DNA, 23 bp, Homo sapiens
gtgaagaatgcacaagaatggat

SEQ ID NO: 3380605 - DNA, 17 bp, Homo sapiens
gtgaagaatttagatct

SEQ ID NO: 3380606 - DNA, 23 bp, Homo sapiens
gtgaagaatttagatcttatatt

SEQ ID NO: 3380607 - DNA, 13 bp, Homo sapiens
gtgaagacatttt

SEQ ID NO: 3380608 - DNA, 14 bp, Homo sapiens
gtgaagaggggcag

SEQ ID NO: 3380609 - DNA, 19 bp, Homo sapiens
gtgaagaggggcagccctt

SEQ ID NO: 3380610 - DNA, 14 bp, Homo sapiens
gtgaagataatttg

SEQ ID NO: 3380611 - DNA, 15 bp, Homo sapiens
gtgaagataatttgc

SEQ ID NO: 3380612 - DNA, 20 bp, Homo sapiens
gtgaagatgaagaagccttt

SEQ ID NO: 3380613 - DNA, 13 bp, Homo sapiens
gtgaagatgttta

SEQ ID NO: 3380614 - DNA, 12 bp, Homo sapiens
gtgaaggactta

SEQ ID NO: 3380615 - DNA, 18 bp, Homo sapiens
gtgaagggaagagacagc

SEQ ID NO: 3380616 - DNA, 23 bp, Homo sapiens
gtgaaggtctttgttatgacagt

SEQ ID NO: 3380617 - DNA, 21 bp, Homo sapiens
gtgaagtcatgacctccaggg

SEQ ID NO: 3380618 - DNA, 14 bp, Homo sapiens
gtgaagtttacatt

SEQ ID NO: 3380619 - DNA, 18 bp, Homo sapiens
gtgaagttttactgtcta

SEQ ID NO: 3380620 - DNA, 23 bp, Homo sapiens
gtgaatacttattttcagtgcat

SEQ ID NO: 3380621 - DNA, 22 bp, Homo sapiens
gtgaatcctctgtttagaacac

SEQ ID NO: 3380622 - DNA, 13 bp, Homo sapiens
gtgaatcttgtct

SEQ ID NO: 3380623 - DNA, 13 bp, Homo sapiens
gtgaatgaacact

SEQ ID NO: 3380624 - DNA, 21 bp, Homo sapiens
gtgaatgctaagtccatcacc

SEQ ID NO: 3380625 - DNA, 20 bp, Homo sapiens
gtgaatgctgggactcagcc

SEQ ID NO: 3380626 - DNA, 21 bp, Homo sapiens
gtgaatgctgggactcagcct

SEQ ID NO: 3380627 - DNA, 19 bp, Homo sapiens
gtgaatggaagcaaagtgc

SEQ ID NO: 3380628 - DNA, 14 bp, Homo sapiens
gtgaatggaggcag

SEQ ID NO: 3380629 - DNA, 14 bp, Homo sapiens
gtgaatgtgggcac

SEQ ID NO: 3380630 - DNA, 11 bp, Homo sapiens
gtgaattctgc

SEQ ID NO: 3380631 - DNA, 15 bp, Homo sapiens
gtgaattgtctttta

SEQ ID NO: 3380632 - DNA, 16 bp, Homo sapiens
gtgaattgtcttttag

SEQ ID NO: 3380633 - DNA, 18 bp, Homo sapiens
gtgaattgtcttttagac

SEQ ID NO: 3380634 - DNA, 19 bp, Homo sapiens
gtgaattgtcttttagaca

SEQ ID NO: 3380635 - DNA, 20 bp, Homo sapiens
gtgaatttatacctacctgt

SEQ ID NO: 3380636 - DNA, 14 bp, Homo sapiens
gtgaatttctaaat

SEQ ID NO: 3380637 - DNA, 16 bp, Homo sapiens
gtgaatttctaaatgt

SEQ ID NO: 3380638 - DNA, 19 bp, Homo sapiens
gtgaatttctgaaagatga

SEQ ID NO: 3380639 - DNA, 19 bp, Homo sapiens
gtgaatttcttcactgttg

SEQ ID NO: 3380640 - DNA, 13 bp, Homo sapiens
gtgaatttgaatg

SEQ ID NO: 3380641 - DNA, 14 bp, Homo sapiens
gtgaatttgaatga

SEQ ID NO: 3380642 - DNA, 18 bp, Homo sapiens
gtgaatttgaatgaaaaa

SEQ ID NO: 3380643 - DNA, 17 bp, Homo sapiens
gtgaatttttttttcct

SEQ ID NO: 3380644 - DNA, 20 bp, Homo sapiens
gtgacaaaattttataagca

SEQ ID NO: 3380645 - DNA, 23 bp, Homo sapiens
gtgacaaaccatccagtggaggt

SEQ ID NO: 3380646 - DNA, 16 bp, Homo sapiens
gtgacaaagactcctc

SEQ ID NO: 3380647 - DNA, 16 bp, Homo sapiens
gtgacaacacttgtgt

SEQ ID NO: 3380648 - DNA, 16 bp, Homo sapiens
gtgacaattttgtaca

SEQ ID NO: 3380649 - DNA, 16 bp, Homo sapiens
gtgacagacaggctct

SEQ ID NO: 3380650 - DNA, 17 bp, Homo sapiens
gtgacagacaggctctt

SEQ ID NO: 3380651 - DNA, 13 bp, Homo sapiens
gtgacagaggcag

SEQ ID NO: 3380652 - DNA, 14 bp, Homo sapiens
gtgacagaggcagc

SEQ ID NO: 3380653 - DNA, 16 bp, Homo sapiens
gtgacagaggcagccc

SEQ ID NO: 3380654 - DNA, 14 bp, Homo sapiens
gtgacagcttcctt

SEQ ID NO: 3380655 - DNA, 18 bp, Homo sapiens
gtgacaggaaagccctcc

SEQ ID NO: 3380656 - DNA, 19 bp, Homo sapiens
gtgacagggcaagaccctg

SEQ ID NO: 3380657 - DNA, 12 bp, Homo sapiens
gtgacagggcca

SEQ ID NO: 3380658 - DNA, 14 bp, Homo sapiens
gtgacagggccagt

SEQ ID NO: 3380659 - DNA, 19 bp, Homo sapiens
gtgacagggccagtggggc

SEQ ID NO: 3380660 - DNA, 21 bp, Homo sapiens
gtgacagggccagtggggcct

SEQ ID NO: 3380661 - DNA, 19 bp, Homo sapiens
gtgacagtattttggttct

SEQ ID NO: 3380662 - DNA, 16 bp, Homo sapiens
gtgacagtcatcatca

SEQ ID NO: 3380663 - DNA, 20 bp, Homo sapiens
gtgacagtcatcatcagggc

SEQ ID NO: 3380664 - DNA, 15 bp, Homo sapiens
gtgacagtgcctggg

SEQ ID NO: 3380665 - DNA, 23 bp, Homo sapiens
gtgacagtgcctgggaatgtatt

SEQ ID NO: 3380666 - DNA, 16 bp, Homo sapiens
gtgacatcaaagcctg

SEQ ID NO: 3380667 - DNA, 15 bp, Homo sapiens
gtgacatggtgcctg

SEQ ID NO: 3380668 - DNA, 18 bp, Homo sapiens
gtgacatgtgaaaccttt

SEQ ID NO: 3380669 - DNA, 15 bp, Homo sapiens
gtgacatttcccaag

SEQ ID NO: 3380670 - DNA, 17 bp, Homo sapiens
gtgacatttcccaagtc

SEQ ID NO: 3380671 - DNA, 15 bp, Homo sapiens
gtgaccaactgtgtt

SEQ ID NO: 3380672 - DNA, 19 bp, Homo sapiens
gtgaccaactgtgttgtat

SEQ ID NO: 3380673 - DNA, 17 bp, Homo sapiens
gtgaccaggcatcctcc

SEQ ID NO: 3380674 - DNA, 16 bp, Homo sapiens
gtgacccatctgtagt

SEQ ID NO: 3380675 - DNA, 18 bp, Homo sapiens
gtgacccttcagggccag

SEQ ID NO: 3380676 - DNA, 19 bp, Homo sapiens
gtgacccttcagggccaga

SEQ ID NO: 3380677 - DNA, 19 bp, Homo sapiens
gtgaccggacttttctgca

SEQ ID NO: 3380678 - DNA, 22 bp, Homo sapiens
gtgacctctctaggtgtgtcca

SEQ ID NO: 3380679 - DNA, 13 bp, Homo sapiens
gtgacctgtttat

SEQ ID NO: 3380680 - DNA, 13 bp, Homo sapiens
gtgacctttgtct

SEQ ID NO: 3380681 - DNA, 19 bp, Homo sapiens
gtgaccttttcttcatttt

SEQ ID NO: 3380682 - DNA, 19 bp, Homo sapiens
gtgactagtacaaattata

SEQ ID NO: 3380683 - DNA, 14 bp, Homo sapiens
gtgactatgaactt

SEQ ID NO: 3380684 - DNA, 22 bp, Homo sapiens
gtgactcacacttgtaatccca

SEQ ID NO: 3380685 - DNA, 17 bp, Homo sapiens
gtgactcacttcaatgt

SEQ ID NO: 3380686 - DNA, 15 bp, Homo sapiens
gtgactcctgctggt

SEQ ID NO: 3380687 - DNA, 20 bp, Homo sapiens
gtgactcctgctggtacctg

SEQ ID NO: 3380688 - DNA, 14 bp, Homo sapiens
gtgactgaaaccat

SEQ ID NO: 3380689 - DNA, 18 bp, Homo sapiens
gtgactgaaggggcacac

SEQ ID NO: 3380690 - DNA, 23 bp, Homo sapiens
gtgactgagcaagaccctgtctc

SEQ ID NO: 3380691 - DNA, 12 bp, Homo sapiens
gtgactggcaag

SEQ ID NO: 3380692 - DNA, 13 bp, Homo sapiens
gtgactggcaggt

SEQ ID NO: 3380693 - DNA, 13 bp, Homo sapiens
gtgactgtcccac

SEQ ID NO: 3380694 - DNA, 21 bp, Homo sapiens
gtgactgtcccaccgggagcc

SEQ ID NO: 3380695 - DNA, 13 bp, Homo sapiens
gtgactgttgtac

SEQ ID NO: 3380696 - DNA, 14 bp, Homo sapiens
gtgactgtttggct

SEQ ID NO: 3380697 - DNA, 23 bp, Homo sapiens
gtgacttgtgtcccatgatccct

SEQ ID NO: 3380698 - DNA, 13 bp, Homo sapiens
gtgactttaaaag

SEQ ID NO: 3380699 - DNA, 19 bp, Homo sapiens
gtgacttttctgattaata

SEQ ID NO: 3380700 - DNA, 20 bp, Homo sapiens
gtgactttttagccagtgac

SEQ ID NO: 3380701 - DNA, 16 bp, Homo sapiens
gtgactttttttggta

SEQ ID NO: 3380702 - DNA, 17 bp, Homo sapiens
gtgagaaaaagctcctg

SEQ ID NO: 3380703 - DNA, 17 bp, Homo sapiens
gtgagaaaatgcctcaa

SEQ ID NO: 3380704 - DNA, 20 bp, Homo sapiens
gtgagaaatttctgtgaaac

SEQ ID NO: 3380705 - DNA, 17 bp, Homo sapiens
gtgagaagtgccttctc

SEQ ID NO: 3380706 - DNA, 16 bp, Homo sapiens
gtgagacccctgtctc

SEQ ID NO: 3380707 - DNA, 20 bp, Homo sapiens
gtgagagaaagagagaagcc

SEQ ID NO: 3380708 - DNA, 21 bp, Homo sapiens
gtgagagaaagagagaagcca

SEQ ID NO: 3380709 - DNA, 13 bp, Homo sapiens
gtgagagaattta

SEQ ID NO: 3380710 - DNA, 13 bp, Homo sapiens
gtgagagctgggt

SEQ ID NO: 3380711 - DNA, 16 bp, Homo sapiens
gtgagagtcaaagctg

SEQ ID NO: 3380712 - DNA, 20 bp, Homo sapiens
gtgagatcacagcctccagg

SEQ ID NO: 3380713 - DNA, 17 bp, Homo sapiens
gtgagatgctggagaag

SEQ ID NO: 3380714 - DNA, 20 bp, Homo sapiens
gtgagatgctggagaagaga

SEQ ID NO: 3380715 - DNA, 15 bp, Homo sapiens
gtgagatgtaattgt

SEQ ID NO: 3380716 - DNA, 13 bp, Homo sapiens
gtgagcaaccagc

SEQ ID NO: 3380717 - DNA, 15 bp, Homo sapiens
gtgagcaaccagctg

SEQ ID NO: 3380718 - DNA, 21 bp, Homo sapiens
gtgagcactaaggtgtgctct

SEQ ID NO: 3380719 - DNA, 20 bp, Homo sapiens
gtgagcaggaaggcctgggt

SEQ ID NO: 3380720 - DNA, 16 bp, Homo sapiens
gtgagcatgggtgtgc

SEQ ID NO: 3380721 - DNA, 20 bp, Homo sapiens
gtgagccaccgctgccagca

SEQ ID NO: 3380722 - DNA, 19 bp, Homo sapiens
gtgagccactcagtctctt

SEQ ID NO: 3380723 - DNA, 15 bp, Homo sapiens
gtgagccactgcacc

SEQ ID NO: 3380724 - DNA, 20 bp, Homo sapiens
gtgagccactgcaccgggcc

SEQ ID NO: 3380725 - DNA, 17 bp, Homo sapiens
gtgagccccaggggggc

SEQ ID NO: 3380726 - DNA, 20 bp, Homo sapiens
gtgagccccaggggggcctc

SEQ ID NO: 3380727 - DNA, 17 bp, Homo sapiens
gtgagcccctggtcctg

SEQ ID NO: 3380728 - DNA, 23 bp, Homo sapiens
gtgagcctggctcttgtgctgga

SEQ ID NO: 3380729 - DNA, 20 bp, Homo sapiens
gtgagcgcctgtgcacacac

SEQ ID NO: 3380730 - DNA, 14 bp, Homo sapiens
gtgagctgggaagc

SEQ ID NO: 3380731 - DNA, 12 bp, Homo sapiens
gtgagctgggca

SEQ ID NO: 3380732 - DNA, 19 bp, Homo sapiens
gtgagctggggactcaggg

SEQ ID NO: 3380733 - DNA, 20 bp, Homo sapiens
gtgaggaatgctctgtgcca

SEQ ID NO: 3380734 - DNA, 14 bp, Homo sapiens
gtgaggagctgctg

SEQ ID NO: 3380735 - DNA, 17 bp, Homo sapiens
gtgaggagctgctggct

SEQ ID NO: 3380736 - DNA, 18 bp, Homo sapiens
gtgaggagctgctggctt

SEQ ID NO: 3380737 - DNA, 15 bp, Homo sapiens
gtgaggaggaaaagg

SEQ ID NO: 3380738 - DNA, 14 bp, Homo sapiens
gtgaggagggcagt

SEQ ID NO: 3380739 - DNA, 14 bp, Homo sapiens
gtgaggctgtcctg

SEQ ID NO: 3380740 - DNA, 16 bp, Homo sapiens
gtgaggctgtcctgta

SEQ ID NO: 3380741 - DNA, 18 bp, Homo sapiens
gtgaggcttccaggctct

SEQ ID NO: 3380742 - DNA, 21 bp, Homo sapiens
gtgaggggtatatctgggctg

SEQ ID NO: 3380743 - DNA, 14 bp, Homo sapiens
gtgagtaagagctg

SEQ ID NO: 3380744 - DNA, 16 bp, Homo sapiens
gtgagtaagagctggt

SEQ ID NO: 3380745 - DNA, 19 bp, Homo sapiens
gtgagtcaccaagcccagt

SEQ ID NO: 3380746 - DNA, 14 bp, Homo sapiens
gtgagtcaccactt

SEQ ID NO: 3380747 - DNA, 19 bp, Homo sapiens
gtgagtcttggcggcagca

SEQ ID NO: 3380748 - DNA, 19 bp, Homo sapiens
gtgagtctttggttctaag

SEQ ID NO: 3380749 - DNA, 18 bp, Homo sapiens
gtgagtgagcctggctct

SEQ ID NO: 3380750 - DNA, 16 bp, Homo sapiens
gtgagtgcgtctgagg

SEQ ID NO: 3380751 - DNA, 17 bp, Homo sapiens
gtgagtggagttgaggt

SEQ ID NO: 3380752 - DNA, 14 bp, Homo sapiens
gtgagtggcagcca

SEQ ID NO: 3380753 - DNA, 17 bp, Homo sapiens
gtgagtggcagccatgc

SEQ ID NO: 3380754 - DNA, 13 bp, Homo sapiens
gtgagtgtaaata

SEQ ID NO: 3380755 - DNA, 16 bp, Homo sapiens
gtgagtgtgacagggc

SEQ ID NO: 3380756 - DNA, 17 bp, Homo sapiens
gtgagtgtgacagggcc

SEQ ID NO: 3380757 - DNA, 18 bp, Homo sapiens
gtgagtgtgacagggcca

SEQ ID NO: 3380758 - DNA, 18 bp, Homo sapiens
gtgagttctcagggctcc

SEQ ID NO: 3380759 - DNA, 21 bp, Homo sapiens
gtgagtttgagctgccttccc

SEQ ID NO: 3380760 - DNA, 19 bp, Homo sapiens
gtgataagggaaaagataa

SEQ ID NO: 3380761 - DNA, 15 bp, Homo sapiens
gtgataagtggaaaa

SEQ ID NO: 3380762 - DNA, 16 bp, Homo sapiens
gtgataagtggaaaaa

SEQ ID NO: 3380763 - DNA, 15 bp, Homo sapiens
gtgataatttaagag

SEQ ID NO: 3380764 - DNA, 14 bp, Homo sapiens
gtgatagcactttc

SEQ ID NO: 3380765 - DNA, 20 bp, Homo sapiens
gtgataggcccaaggtcccc

SEQ ID NO: 3380766 - DNA, 21 bp, Homo sapiens
gtgatatataagtgtacatat

SEQ ID NO: 3380767 - DNA, 16 bp, Homo sapiens
gtgatatggcagaaga

SEQ ID NO: 3380768 - DNA, 13 bp, Homo sapiens
gtgatattctaag

SEQ ID NO: 3380769 - DNA, 18 bp, Homo sapiens
gtgatcaataaaatgtga

SEQ ID NO: 3380770 - DNA, 17 bp, Homo sapiens
gtgatcaatatttttat

SEQ ID NO: 3380771 - DNA, 18 bp, Homo sapiens
gtgatcatgtgtggaagt

SEQ ID NO: 3380772 - DNA, 15 bp, Homo sapiens
gtgatccacccacct

SEQ ID NO: 3380773 - DNA, 20 bp, Homo sapiens
gtgatccacccacctcagcc

SEQ ID NO: 3380774 - DNA, 20 bp, Homo sapiens
gtgatccatccatctccagg

SEQ ID NO: 3380775 - DNA, 22 bp, Homo sapiens
gtgatccgcctacctcagcctc

SEQ ID NO: 3380776 - DNA, 22 bp, Homo sapiens
gtgatcctcccacctcagcctc

SEQ ID NO: 3380777 - DNA, 21 bp, Homo sapiens
gtgatcctctattttgtgatg

SEQ ID NO: 3380778 - DNA, 15 bp, Homo sapiens
gtgatctcagatcag

SEQ ID NO: 3380779 - DNA, 23 bp, Homo sapiens
gtgatctcccctcacactttgcc

SEQ ID NO: 3380780 - DNA, 18 bp, Homo sapiens
gtgatctgtagacttctg

SEQ ID NO: 3380781 - DNA, 22 bp, Homo sapiens
gtgatcttggcttactgcagcc

SEQ ID NO: 3380782 - DNA, 15 bp, Homo sapiens
gtgatgaactttctc

SEQ ID NO: 3380783 - DNA, 15 bp, Homo sapiens
gtgatgaggggaggg

SEQ ID NO: 3380784 - DNA, 16 bp, Homo sapiens
gtgatgctcaggcttg

SEQ ID NO: 3380785 - DNA, 16 bp, Homo sapiens
gtgatgggggagaggg

SEQ ID NO: 3380786 - DNA, 14 bp, Homo sapiens
gtgatggttcccct

SEQ ID NO: 3380787 - DNA, 16 bp, Homo sapiens
gtgatggttcccctgt

SEQ ID NO: 3380788 - DNA, 15 bp, Homo sapiens
gtgatgtaccagttt

SEQ ID NO: 3380789 - DNA, 19 bp, Homo sapiens
gtgattaaacgtgcagact

SEQ ID NO: 3380790 - DNA, 16 bp, Homo sapiens
gtgattcaatctgtaa

SEQ ID NO: 3380791 - DNA, 21 bp, Homo sapiens
gtgattcaatctgtaaactgt

SEQ ID NO: 3380792 - DNA, 23 bp, Homo sapiens
gtgattcaatctgtaaactgtgt

SEQ ID NO: 3380793 - DNA, 16 bp, Homo sapiens
gtgattctaatgtctt

SEQ ID NO: 3380794 - DNA, 17 bp, Homo sapiens
gtgattctcctgcctca

SEQ ID NO: 3380795 - DNA, 18 bp, Homo sapiens
gtgattctcctgcctcag

SEQ ID NO: 3380796 - DNA, 22 bp, Homo sapiens
gtgattctcctgcctcagcctc

SEQ ID NO: 3380797 - DNA, 14 bp, Homo sapiens
gtgattctgatttc

SEQ ID NO: 3380798 - DNA, 13 bp, Homo sapiens
gtgattctgcctt

SEQ ID NO: 3380799 - DNA, 13 bp, Homo sapiens
gtgattgcacaga

SEQ ID NO: 3380800 - DNA, 15 bp, Homo sapiens
gtgattgcacagaat

SEQ ID NO: 3380801 - DNA, 13 bp, Homo sapiens
gtgattgctgcca

SEQ ID NO: 3380802 - DNA, 24 bp, Homo sapiens
gtgattggcctgtagagttgctga

SEQ ID NO: 3380803 - DNA, 23 bp, Homo sapiens
gtgattgtggaatggagattcag

SEQ ID NO: 3380804 - DNA, 23 bp, Homo sapiens
gtgatttcagactgcagagggga

SEQ ID NO: 3380805 - DNA, 15 bp, Homo sapiens
gtgatttccatctct

SEQ ID NO: 3380806 - DNA, 16 bp, Homo sapiens
gtgatttccatttctg

SEQ ID NO: 3380807 - DNA, 23 bp, Homo sapiens
gtgatttgaaaaatataaaatta

SEQ ID NO: 3380808 - DNA, 21 bp, Homo sapiens
gtgattttatgatcagtgttg

SEQ ID NO: 3380809 - DNA, 19 bp, Homo sapiens
gtgcaaaagcttcaaatta

SEQ ID NO: 3380810 - DNA, 18 bp, Homo sapiens
gtgcaaattgtatcttat

SEQ ID NO: 3380811 - DNA, 12 bp, Homo sapiens
gtgcaacagcac

SEQ ID NO: 3380812 - DNA, 14 bp, Homo sapiens
gtgcaacagggtat

SEQ ID NO: 3380813 - DNA, 24 bp, Homo sapiens
gtgcaacagggtatggactatctg

SEQ ID NO: 3380814 - DNA, 23 bp, Homo sapiens
gtgcaacccttaccccttagcct

SEQ ID NO: 3380815 - DNA, 23 bp, Homo sapiens
gtgcacacagaaatatatataca

SEQ ID NO: 3380816 - DNA, 11 bp, Homo sapiens
gtgcacagctg

SEQ ID NO: 3380817 - DNA, 21 bp, Homo sapiens
gtgcacatgcacgtgtgtgca

SEQ ID NO: 3380818 - DNA, 13 bp, Homo sapiens
gtgcacccactca

SEQ ID NO: 3380819 - DNA, 20 bp, Homo sapiens
gtgcacccactcaccagggt

SEQ ID NO: 3380820 - DNA, 21 bp, Homo sapiens
gtgcacccactcaccagggtc

SEQ ID NO: 3380821 - DNA, 21 bp, Homo sapiens
gtgcacctgtactcaggaggc

SEQ ID NO: 3380822 - DNA, 16 bp, Homo sapiens
gtgcacgtggagagct

SEQ ID NO: 3380823 - DNA, 12 bp, Homo sapiens
gtgcacgttgct

SEQ ID NO: 3380824 - DNA, 13 bp, Homo sapiens
gtgcactccagct

SEQ ID NO: 3380825 - DNA, 13 bp, Homo sapiens
gtgcactctgcta

SEQ ID NO: 3380826 - DNA, 13 bp, Homo sapiens
gtgcactgccctg

SEQ ID NO: 3380827 - DNA, 15 bp, Homo sapiens
gtgcactgtcacttt

SEQ ID NO: 3380828 - DNA, 23 bp, Homo sapiens
gtgcactgtcactttgctctggg

SEQ ID NO: 3380829 - DNA, 12 bp, Homo sapiens
gtgcagaataat

SEQ ID NO: 3380830 - DNA, 13 bp, Homo sapiens
gtgcagagctgca

SEQ ID NO: 3380831 - DNA, 19 bp, Homo sapiens
gtgcagagctgcacttggc

SEQ ID NO: 3380832 - DNA, 19 bp, Homo sapiens
gtgcagcagcccagcttcc

SEQ ID NO: 3380833 - DNA, 12 bp, Homo sapiens
gtgcagctgatt

SEQ ID NO: 3380834 - DNA, 20 bp, Homo sapiens
gtgcagggagggcagttttc

SEQ ID NO: 3380835 - DNA, 20 bp, Homo sapiens
gtgcagtggtgcgatctggg

SEQ ID NO: 3380836 - DNA, 23 bp, Homo sapiens
gtgcagtggtgcgatctgggttc

SEQ ID NO: 3380837 - DNA, 22 bp, Homo sapiens
gtgcagttcccccaacctcaga

SEQ ID NO: 3380838 - DNA, 15 bp, Homo sapiens
gtgcataatgctttg

SEQ ID NO: 3380839 - DNA, 22 bp, Homo sapiens
gtgcatagttgtagacaaagta

SEQ ID NO: 3380840 - DNA, 12 bp, Homo sapiens
gtgcatcattac

SEQ ID NO: 3380841 - DNA, 17 bp, Homo sapiens
gtgcatcattactgttc

SEQ ID NO: 3380842 - DNA, 12 bp, Homo sapiens
gtgcatcctgtg

SEQ ID NO: 3380843 - DNA, 13 bp, Homo sapiens
gtgcatcctgtga

SEQ ID NO: 3380844 - DNA, 15 bp, Homo sapiens
gtgcatctcagccca

SEQ ID NO: 3380845 - DNA, 12 bp, Homo sapiens
gtgcatgatggt

SEQ ID NO: 3380846 - DNA, 16 bp, Homo sapiens
gtgcatggaggccctc

SEQ ID NO: 3380847 - DNA, 14 bp, Homo sapiens
gtgcatgtcctttg

SEQ ID NO: 3380848 - DNA, 23 bp, Homo sapiens
gtgcattagcacagattttaatt

SEQ ID NO: 3380849 - DNA, 18 bp, Homo sapiens
gtgcatttgagagaagcc

SEQ ID NO: 3380850 - DNA, 24 bp, Homo sapiens
gtgcatttgagagaagccacgctg

SEQ ID NO: 3380851 - DNA, 16 bp, Homo sapiens
gtgcatttttgtgaaa

SEQ ID NO: 3380852 - DNA, 22 bp, Homo sapiens
gtgcatttttgtgaaatgaaaa

SEQ ID NO: 3380853 - DNA, 13 bp, Homo sapiens
gtgccaacctgtt

SEQ ID NO: 3380854 - DNA, 15 bp, Homo sapiens
gtgccaactcctcac

SEQ ID NO: 3380855 - DNA, 16 bp, Homo sapiens
gtgccaagattctact

SEQ ID NO: 3380856 - DNA, 11 bp, Homo sapiens
gtgccaaggac

SEQ ID NO: 3380857 - DNA, 17 bp, Homo sapiens
gtgccaatatgtattgt

SEQ ID NO: 3380858 - DNA, 19 bp, Homo sapiens
gtgccaatatgtattgtaa

SEQ ID NO: 3380859 - DNA, 21 bp, Homo sapiens
gtgccaatatgtattgtaaac

SEQ ID NO: 3380860 - DNA, 16 bp, Homo sapiens
gtgccaccaccctgcc

SEQ ID NO: 3380861 - DNA, 22 bp, Homo sapiens
gtgccacccacctttgccacaa

SEQ ID NO: 3380862 - DNA, 12 bp, Homo sapiens
gtgccacccgca

SEQ ID NO: 3380863 - DNA, 17 bp, Homo sapiens
gtgccactccctgagct

SEQ ID NO: 3380864 - DNA, 23 bp, Homo sapiens
gtgccactgccccccgaggctgc

SEQ ID NO: 3380865 - DNA, 17 bp, Homo sapiens
gtgccactgcccgagct

SEQ ID NO: 3380866 - DNA, 19 bp, Homo sapiens
gtgccactgcccgagctgg

SEQ ID NO: 3380867 - DNA, 20 bp, Homo sapiens
gtgccactgcccgagctggt

SEQ ID NO: 3380868 - DNA, 13 bp, Homo sapiens
gtgccactgcggg

SEQ ID NO: 3380869 - DNA, 21 bp, Homo sapiens
gtgccacttcttaaaggcctg

SEQ ID NO: 3380870 - DNA, 23 bp, Homo sapiens
gtgccactttacccacctagaac

SEQ ID NO: 3380871 - DNA, 13 bp, Homo sapiens
gtgccagagaggg

SEQ ID NO: 3380872 - DNA, 20 bp, Homo sapiens
gtgccagaggaatcctggca

SEQ ID NO: 3380873 - DNA, 21 bp, Homo sapiens
gtgccagaggaatcctggcag

SEQ ID NO: 3380874 - DNA, 14 bp, Homo sapiens
gtgccagaggtggg

SEQ ID NO: 3380875 - DNA, 16 bp, Homo sapiens
gtgccagaggtgggca

SEQ ID NO: 3380876 - DNA, 19 bp, Homo sapiens
gtgccagaggtgggcaggt

SEQ ID NO: 3380877 - DNA, 16 bp, Homo sapiens
gtgccagcattccaga

SEQ ID NO: 3380878 - DNA, 18 bp, Homo sapiens
gtgccaggcgcgtgtaaa

SEQ ID NO: 3380879 - DNA, 22 bp, Homo sapiens
gtgccaggtttttggtctgacc

SEQ ID NO: 3380880 - DNA, 23 bp, Homo sapiens
gtgccatagagtttaacacaagt

SEQ ID NO: 3380881 - DNA, 22 bp, Homo sapiens
gtgccatgtaaatccccactgg

SEQ ID NO: 3380882 - DNA, 16 bp, Homo sapiens
gtgccatgtgccaggt

SEQ ID NO: 3380883 - DNA, 11 bp, Homo sapiens
gtgccattcca

SEQ ID NO: 3380884 - DNA, 23 bp, Homo sapiens
gtgccattccactccactcaggt

SEQ ID NO: 3380885 - DNA, 13 bp, Homo sapiens
gtgccattgtctt

SEQ ID NO: 3380886 - DNA, 11 bp, Homo sapiens
gtgcccaaagt

SEQ ID NO: 3380887 - DNA, 15 bp, Homo sapiens
gtgcccaaagtgggg

SEQ ID NO: 3380888 - DNA, 17 bp, Homo sapiens
gtgcccaaagtggggag

SEQ ID NO: 3380889 - DNA, 19 bp, Homo sapiens
gtgcccaaagtggggaggg

SEQ ID NO: 3380890 - DNA, 20 bp, Homo sapiens
gtgcccaagaatagatgctg

SEQ ID NO: 3380891 - DNA, 12 bp, Homo sapiens
gtgcccaagcca

SEQ ID NO: 3380892 - DNA, 20 bp, Homo sapiens
gtgcccaagccagaggctgg

SEQ ID NO: 3380893 - DNA, 15 bp, Homo sapiens
gtgcccacatcccag

SEQ ID NO: 3380894 - DNA, 20 bp, Homo sapiens
gtgcccacatcccaggcttc

SEQ ID NO: 3380895 - DNA, 20 bp, Homo sapiens
gtgcccagaacttccctgat

SEQ ID NO: 3380896 - DNA, 14 bp, Homo sapiens
gtgcccaggggagc

SEQ ID NO: 3380897 - DNA, 16 bp, Homo sapiens
gtgcccagggttttgc

SEQ ID NO: 3380898 - DNA, 22 bp, Homo sapiens
gtgcccagggttttgccccaag

SEQ ID NO: 3380899 - DNA, 12 bp, Homo sapiens
gtgccccacagc

SEQ ID NO: 3380900 - DNA, 17 bp, Homo sapiens
gtgccccacagctacct

SEQ ID NO: 3380901 - DNA, 22 bp, Homo sapiens
gtgccccacagctacctgagac

SEQ ID NO: 3380902 - DNA, 19 bp, Homo sapiens
gtgcccccgcctgccaccg

SEQ ID NO: 3380903 - DNA, 22 bp, Homo sapiens
gtgcccctcgccagcttctcct

SEQ ID NO: 3380904 - DNA, 16 bp, Homo sapiens
gtgcccgcaggaactg

SEQ ID NO: 3380905 - DNA, 15 bp, Homo sapiens
gtgccctccaaagag

SEQ ID NO: 3380906 - DNA, 11 bp, Homo sapiens
gtgccctgccc

SEQ ID NO: 3380907 - DNA, 14 bp, Homo sapiens
gtgccctgccccca

SEQ ID NO: 3380908 - DNA, 18 bp, Homo sapiens
gtgccctgcccccatctc

SEQ ID NO: 3380909 - DNA, 16 bp, Homo sapiens
gtgccctgccccctgg

SEQ ID NO: 3380910 - DNA, 23 bp, Homo sapiens
gtgccctgccccctggctgactg

SEQ ID NO: 3380911 - DNA, 22 bp, Homo sapiens
gtgcccttcctcacagagttaa

SEQ ID NO: 3380912 - DNA, 14 bp, Homo sapiens
gtgccgcctgctcc

SEQ ID NO: 3380913 - DNA, 15 bp, Homo sapiens
gtgccgcctgctcct

SEQ ID NO: 3380914 - DNA, 14 bp, Homo sapiens
gtgccggctgtgga

SEQ ID NO: 3380915 - DNA, 23 bp, Homo sapiens
gtgccgtagggagtacctgctgc

SEQ ID NO: 3380916 - DNA, 23 bp, Homo sapiens
gtgccgtgtgagtgtgacagggc

SEQ ID NO: 3380917 - DNA, 16 bp, Homo sapiens
gtgcctaatggagaag

SEQ ID NO: 3380918 - DNA, 19 bp, Homo sapiens
gtgcctagttcctgtggcc

SEQ ID NO: 3380919 - DNA, 18 bp, Homo sapiens
gtgcctatagtcccagct

SEQ ID NO: 3380920 - DNA, 22 bp, Homo sapiens
gtgcctcacatttttttctacc

SEQ ID NO: 3380921 - DNA, 16 bp, Homo sapiens
gtgcctcactgggggc

SEQ ID NO: 3380922 - DNA, 17 bp, Homo sapiens
gtgcctcactgggggct

SEQ ID NO: 3380923 - DNA, 14 bp, Homo sapiens
gtgcctcagactcc

SEQ ID NO: 3380924 - DNA, 17 bp, Homo sapiens
gtgcctcagactccgcc

SEQ ID NO: 3380925 - DNA, 21 bp, Homo sapiens
gtgcctccaccaccactggcc

SEQ ID NO: 3380926 - DNA, 23 bp, Homo sapiens
gtgcctccaccaccactggccac

SEQ ID NO: 3380927 - DNA, 23 bp, Homo sapiens
gtgcctccagaggggctcaggtc

SEQ ID NO: 3380928 - DNA, 15 bp, Homo sapiens
gtgcctccaggtgtg

SEQ ID NO: 3380929 - DNA, 20 bp, Homo sapiens
gtgcctcctcagaggacagt

SEQ ID NO: 3380930 - DNA, 13 bp, Homo sapiens
gtgcctccttcca

SEQ ID NO: 3380931 - DNA, 18 bp, Homo sapiens
gtgcctccttccacctcc

SEQ ID NO: 3380932 - DNA, 21 bp, Homo sapiens
gtgcctccttccacctccctc

SEQ ID NO: 3380933 - DNA, 22 bp, Homo sapiens
gtgcctccttccacctccctcc

SEQ ID NO: 3380934 - DNA, 22 bp, Homo sapiens
gtgcctctgcggggcagggcct

SEQ ID NO: 3380935 - DNA, 12 bp, Homo sapiens
gtgcctctggga

SEQ ID NO: 3380936 - DNA, 13 bp, Homo sapiens
gtgcctctgggac

SEQ ID NO: 3380937 - DNA, 12 bp, Homo sapiens
gtgcctgagagt

SEQ ID NO: 3380938 - DNA, 17 bp, Homo sapiens
gtgcctgcaccaggaga

SEQ ID NO: 3380939 - DNA, 11 bp, Homo sapiens
gtgcctgcagc

SEQ ID NO: 3380940 - DNA, 16 bp, Homo sapiens
gtgcctgcaggggagc

SEQ ID NO: 3380941 - DNA, 18 bp, Homo sapiens
gtgcctgccatgggccag

SEQ ID NO: 3380942 - DNA, 20 bp, Homo sapiens
gtgcctgccatgggccagcc

SEQ ID NO: 3380943 - DNA, 21 bp, Homo sapiens
gtgcctgccatgggccagcct

SEQ ID NO: 3380944 - DNA, 23 bp, Homo sapiens
gtgcctgccatgggccagcctag

SEQ ID NO: 3380945 - DNA, 18 bp, Homo sapiens
gtgcctgctagagcaacc

SEQ ID NO: 3380946 - DNA, 19 bp, Homo sapiens
gtgcctgctagagcaaccc

SEQ ID NO: 3380947 - DNA, 15 bp, Homo sapiens
gtgcctggcctggca

SEQ ID NO: 3380948 - DNA, 16 bp, Homo sapiens
gtgcctgggggagaga

SEQ ID NO: 3380949 - DNA, 15 bp, Homo sapiens
gtgcctgtcccaccc

SEQ ID NO: 3380950 - DNA, 12 bp, Homo sapiens
gtgccttccata

SEQ ID NO: 3380951 - DNA, 20 bp, Homo sapiens
gtgccttctccttccccagg

SEQ ID NO: 3380952 - DNA, 20 bp, Homo sapiens
gtgccttggggaatttcctc

SEQ ID NO: 3380953 - DNA, 13 bp, Homo sapiens
gtgccttgttttt

SEQ ID NO: 3380954 - DNA, 17 bp, Homo sapiens
gtgcctttcctgttcag

SEQ ID NO: 3380955 - DNA, 18 bp, Homo sapiens
gtgcctttcctgttcagc

SEQ ID NO: 3380956 - DNA, 18 bp, Homo sapiens
gtgccttttgcacccctc

SEQ ID NO: 3380957 - DNA, 16 bp, Homo sapiens
gtgccttttgctgcgc

SEQ ID NO: 3380958 - DNA, 19 bp, Homo sapiens
gtgccttttgctgcgcacc

SEQ ID NO: 3380959 - DNA, 20 bp, Homo sapiens
gtgccttttgctgcgcacca

SEQ ID NO: 3380960 - DNA, 12 bp, Homo sapiens
gtgcgagcacac

SEQ ID NO: 3380961 - DNA, 18 bp, Homo sapiens
gtgcggcgtggagactgg

SEQ ID NO: 3380962 - DNA, 13 bp, Homo sapiens
gtgcgtggctgtg

SEQ ID NO: 3380963 - DNA, 17 bp, Homo sapiens
gtgcgtgtgtagagtta

SEQ ID NO: 3380964 - DNA, 16 bp, Homo sapiens
gtgctaaattttcagt

SEQ ID NO: 3380965 - DNA, 13 bp, Homo sapiens
gtgctaaggttct

SEQ ID NO: 3380966 - DNA, 13 bp, Homo sapiens
gtgctaagtgctt

SEQ ID NO: 3380967 - DNA, 16 bp, Homo sapiens
gtgctactgattgttt

SEQ ID NO: 3380968 - DNA, 15 bp, Homo sapiens
gtgctactgtctttg

SEQ ID NO: 3380969 - DNA, 17 bp, Homo sapiens
gtgctatacacacacac

SEQ ID NO: 3380970 - DNA, 15 bp, Homo sapiens
gtgctatataaatat

SEQ ID NO: 3380971 - DNA, 19 bp, Homo sapiens
gtgctatggatggcttcta

SEQ ID NO: 3380972 - DNA, 12 bp, Homo sapiens
gtgctatgttct

SEQ ID NO: 3380973 - DNA, 19 bp, Homo sapiens
gtgctcaccatgcttccag

SEQ ID NO: 3380974 - DNA, 14 bp, Homo sapiens
gtgctcacgctccc

SEQ ID NO: 3380975 - DNA, 15 bp, Homo sapiens
gtgctcagaagagga

SEQ ID NO: 3380976 - DNA, 19 bp, Homo sapiens
gtgctcagaataaggcagg

SEQ ID NO: 3380977 - DNA, 13 bp, Homo sapiens
gtgctccgtgcct

SEQ ID NO: 3380978 - DNA, 16 bp, Homo sapiens
gtgctccgtgcctcca

SEQ ID NO: 3380979 - DNA, 14 bp, Homo sapiens
gtgctcctccttgg

SEQ ID NO: 3380980 - DNA, 13 bp, Homo sapiens
gtgctctctgtgg

SEQ ID NO: 3380981 - DNA, 16 bp, Homo sapiens
gtgctctggacaggca

SEQ ID NO: 3380982 - DNA, 17 bp, Homo sapiens
gtgctctggacaggcat

SEQ ID NO: 3380983 - DNA, 11 bp, Homo sapiens
gtgctctggcg

SEQ ID NO: 3380984 - DNA, 14 bp, Homo sapiens
gtgctctggcggct

SEQ ID NO: 3380985 - DNA, 19 bp, Homo sapiens
gtgctgaatggttttcaaa

SEQ ID NO: 3380986 - DNA, 23 bp, Homo sapiens
gtgctgaatggttttcaaaataa

SEQ ID NO: 3380987 - DNA, 15 bp, Homo sapiens
gtgctgcagatttga

SEQ ID NO: 3380988 - DNA, 11 bp, Homo sapiens
gtgctgcagga

SEQ ID NO: 3380989 - DNA, 18 bp, Homo sapiens
gtgctgccatccaggttc

SEQ ID NO: 3380990 - DNA, 12 bp, Homo sapiens
gtgctgccatgc

SEQ ID NO: 3380991 - DNA, 13 bp, Homo sapiens
gtgctgccatgcc

SEQ ID NO: 3380992 - DNA, 17 bp, Homo sapiens
gtgctgccatgccactg

SEQ ID NO: 3380993 - DNA, 15 bp, Homo sapiens
gtgctgccctgtgta

SEQ ID NO: 3380994 - DNA, 15 bp, Homo sapiens
gtgctgctgctgctg

SEQ ID NO: 3380995 - DNA, 13 bp, Homo sapiens
gtgctgcttctct

SEQ ID NO: 3380996 - DNA, 21 bp, Homo sapiens
gtgctgcttttgagcctcaga

SEQ ID NO: 3380997 - DNA, 22 bp, Homo sapiens
gtgctggactgttccaggccct

SEQ ID NO: 3380998 - DNA, 17 bp, Homo sapiens
gtgctggaggtgggagc

SEQ ID NO: 3380999 - DNA, 18 bp, Homo sapiens
gtgctggatggagcccag

SEQ ID NO: 3381000 - DNA, 14 bp, Homo sapiens
gtgctggcccccag

SEQ ID NO: 3381001 - DNA, 13 bp, Homo sapiens
gtgctgggaccag

SEQ ID NO: 3381002 - DNA, 16 bp, Homo sapiens
gtgctgggagctccac

SEQ ID NO: 3381003 - DNA, 21 bp, Homo sapiens
gtgctgggattacaagcgtga

SEQ ID NO: 3381004 - DNA, 13 bp, Homo sapiens
gtgctggtgtcct

SEQ ID NO: 3381005 - DNA, 15 bp, Homo sapiens
gtgctggtgtcctga

SEQ ID NO: 3381006 - DNA, 19 bp, Homo sapiens
gtgctggtgtcctgaccac

SEQ ID NO: 3381007 - DNA, 23 bp, Homo sapiens
gtgctggtgtcctgaccaccctc

SEQ ID NO: 3381008 - DNA, 16 bp, Homo sapiens
gtgctgtacccttcca

SEQ ID NO: 3381009 - DNA, 18 bp, Homo sapiens
gtgctgtacccttccacc

SEQ ID NO: 3381010 - DNA, 20 bp, Homo sapiens
gtgctgtacccttccacctc

SEQ ID NO: 3381011 - DNA, 14 bp, Homo sapiens
gtgctgtcttctgg

SEQ ID NO: 3381012 - DNA, 20 bp, Homo sapiens
gtgctgtcttctggtctgtg

SEQ ID NO: 3381013 - DNA, 18 bp, Homo sapiens
gtgctgtgaccatttata

SEQ ID NO: 3381014 - DNA, 20 bp, Homo sapiens
gtgctgtgcctgctagagca

SEQ ID NO: 3381015 - DNA, 14 bp, Homo sapiens
gtgctgtggagaga

SEQ ID NO: 3381016 - DNA, 13 bp, Homo sapiens
gtgctgtgggcag

SEQ ID NO: 3381017 - DNA, 17 bp, Homo sapiens
gtgctgtgggcagcacc

SEQ ID NO: 3381018 - DNA, 18 bp, Homo sapiens
gtgctgtgggcagcaccc

SEQ ID NO: 3381019 - DNA, 23 bp, Homo sapiens
gtgctgtggggctggtagctcag

SEQ ID NO: 3381020 - DNA, 12 bp, Homo sapiens
gtgctgtgtgcc

SEQ ID NO: 3381021 - DNA, 15 bp, Homo sapiens
gtgctgtttattaat

SEQ ID NO: 3381022 - DNA, 14 bp, Homo sapiens
gtgcttaagttcca

SEQ ID NO: 3381023 - DNA, 17 bp, Homo sapiens
gtgcttcagagtttgtg

SEQ ID NO: 3381024 - DNA, 14 bp, Homo sapiens
gtgcttctggaaac

SEQ ID NO: 3381025 - DNA, 13 bp, Homo sapiens
gtgcttgggctcc

SEQ ID NO: 3381026 - DNA, 16 bp, Homo sapiens
gtgcttgttagagaga

SEQ ID NO: 3381027 - DNA, 21 bp, Homo sapiens
gtgcttgttagagagaaagag

SEQ ID NO: 3381028 - DNA, 20 bp, Homo sapiens
gtgcttgttatgtctagaaa

SEQ ID NO: 3381029 - DNA, 13 bp, Homo sapiens
gtgcttgttttat

SEQ ID NO: 3381030 - DNA, 20 bp, Homo sapiens
gtgcttgttttataaaattt

SEQ ID NO: 3381031 - DNA, 15 bp, Homo sapiens
gtgcttttaaatgca

SEQ ID NO: 3381032 - DNA, 22 bp, Homo sapiens
gtgcttttaggcttgaaatctc

SEQ ID NO: 3381033 - DNA, 17 bp, Homo sapiens
gtgcttttcctatttgt

SEQ ID NO: 3381034 - DNA, 16 bp, Homo sapiens
gtgctttttataaaaa

SEQ ID NO: 3381035 - DNA, 18 bp, Homo sapiens
gtgctttttataaaaaga

SEQ ID NO: 3381036 - DNA, 17 bp, Homo sapiens
gtggaaaaaagagaaaa

SEQ ID NO: 3381037 - DNA, 16 bp, Homo sapiens
gtggaaaacttatgct

SEQ ID NO: 3381038 - DNA, 19 bp, Homo sapiens
gtggaaaatggactggctt

SEQ ID NO: 3381039 - DNA, 20 bp, Homo sapiens
gtggaaattaagactttatg

SEQ ID NO: 3381040 - DNA, 15 bp, Homo sapiens
gtggaacctctgtct

SEQ ID NO: 3381041 - DNA, 13 bp, Homo sapiens
gtggaagagcagc

SEQ ID NO: 3381042 - DNA, 15 bp, Homo sapiens
gtggaagagcagcct

SEQ ID NO: 3381043 - DNA, 15 bp, Homo sapiens
gtggaagagtgtgtg

SEQ ID NO: 3381044 - DNA, 15 bp, Homo sapiens
gtggaaggactgtgg

SEQ ID NO: 3381045 - DNA, 21 bp, Homo sapiens
gtggaaggactgtggctgcag

SEQ ID NO: 3381046 - DNA, 20 bp, Homo sapiens
gtggaaggcatcagtcccta

SEQ ID NO: 3381047 - DNA, 23 bp, Homo sapiens
gtggaataaacattaattttgtg

SEQ ID NO: 3381048 - DNA, 18 bp, Homo sapiens
gtggaatataaggaaagc

SEQ ID NO: 3381049 - DNA, 14 bp, Homo sapiens
gtggacacagctct

SEQ ID NO: 3381050 - DNA, 15 bp, Homo sapiens
gtggacacagctctt

SEQ ID NO: 3381051 - DNA, 17 bp, Homo sapiens
gtggacacagctcttct

SEQ ID NO: 3381052 - DNA, 12 bp, Homo sapiens
gtggacaggccc

SEQ ID NO: 3381053 - DNA, 14 bp, Homo sapiens
gtggacaggcccag

SEQ ID NO: 3381054 - DNA, 23 bp, Homo sapiens
gtggacaggcccagcgcggccag

SEQ ID NO: 3381055 - DNA, 14 bp, Homo sapiens
gtggacagtcctgg

SEQ ID NO: 3381056 - DNA, 16 bp, Homo sapiens
gtggacagtcctggga

SEQ ID NO: 3381057 - DNA, 22 bp, Homo sapiens
gtggaccctgtcttctgggcac

SEQ ID NO: 3381058 - DNA, 15 bp, Homo sapiens
gtggaccgtggacag

SEQ ID NO: 3381059 - DNA, 17 bp, Homo sapiens
gtggaccgtggacaggc

SEQ ID NO: 3381060 - DNA, 18 bp, Homo sapiens
gtggacggggaggctctc

SEQ ID NO: 3381061 - DNA, 14 bp, Homo sapiens
gtggactctgcaca

SEQ ID NO: 3381062 - DNA, 14 bp, Homo sapiens
gtggactgcattta

SEQ ID NO: 3381063 - DNA, 20 bp, Homo sapiens
gtggactgcatttaaatttg

SEQ ID NO: 3381064 - DNA, 16 bp, Homo sapiens
gtggacttagaaagca

SEQ ID NO: 3381065 - DNA, 11 bp, Homo sapiens
gtggagacagt

SEQ ID NO: 3381066 - DNA, 14 bp, Homo sapiens
gtggagactggcag

SEQ ID NO: 3381067 - DNA, 15 bp, Homo sapiens
gtggagactggcagg

SEQ ID NO: 3381068 - DNA, 12 bp, Homo sapiens
gtggagagctgg

SEQ ID NO: 3381069 - DNA, 14 bp, Homo sapiens
gtggagagctggtg

SEQ ID NO: 3381070 - DNA, 21 bp, Homo sapiens
gtggagcaaaaggcagctcac

SEQ ID NO: 3381071 - DNA, 18 bp, Homo sapiens
gtggagctgccacagaga

SEQ ID NO: 3381072 - DNA, 12 bp, Homo sapiens
gtggaggaaggt

SEQ ID NO: 3381073 - DNA, 19 bp, Homo sapiens
gtggaggaaggtgctgagc

SEQ ID NO: 3381074 - DNA, 19 bp, Homo sapiens
gtggaggaggaaggcaaga

SEQ ID NO: 3381075 - DNA, 17 bp, Homo sapiens
gtggaggaggagggagg

SEQ ID NO: 3381076 - DNA, 18 bp, Homo sapiens
gtggaggaggagggaggc

SEQ ID NO: 3381077 - DNA, 11 bp, Homo sapiens
gtggaggcctg

SEQ ID NO: 3381078 - DNA, 16 bp, Homo sapiens
gtggaggcctgatgct

SEQ ID NO: 3381079 - DNA, 15 bp, Homo sapiens
gtggaggggtgtggc

SEQ ID NO: 3381080 - DNA, 18 bp, Homo sapiens
gtggagtctgagtctgag

SEQ ID NO: 3381081 - DNA, 15 bp, Homo sapiens
gtggagtgagactga

SEQ ID NO: 3381082 - DNA, 14 bp, Homo sapiens
gtggatattgttac

SEQ ID NO: 3381083 - DNA, 13 bp, Homo sapiens
gtggatcacctga

SEQ ID NO: 3381084 - DNA, 15 bp, Homo sapiens
gtggatcacctgagg

SEQ ID NO: 3381085 - DNA, 14 bp, Homo sapiens
gtggatcttcagaa

SEQ ID NO: 3381086 - DNA, 21 bp, Homo sapiens
gtggatgccacagcccagctt

SEQ ID NO: 3381087 - DNA, 18 bp, Homo sapiens
gtggatgcctggtggcag

SEQ ID NO: 3381088 - DNA, 22 bp, Homo sapiens
gtggatggccccagcacagctt

SEQ ID NO: 3381089 - DNA, 16 bp, Homo sapiens
gtggatgggaatttgt

SEQ ID NO: 3381090 - DNA, 22 bp, Homo sapiens
gtggatgggaatttgtcagcgt

SEQ ID NO: 3381091 - DNA, 13 bp, Homo sapiens
gtggatgtcttcc

SEQ ID NO: 3381092 - DNA, 15 bp, Homo sapiens
gtggatgtcttcctt

SEQ ID NO: 3381093 - DNA, 17 bp, Homo sapiens
gtggattgcctctgaaa

SEQ ID NO: 3381094 - DNA, 14 bp, Homo sapiens
gtggattggctttg

SEQ ID NO: 3381095 - DNA, 16 bp, Homo sapiens
gtggattggctttgtg

SEQ ID NO: 3381096 - DNA, 15 bp, Homo sapiens
gtggcaaagtgctgt

SEQ ID NO: 3381097 - DNA, 16 bp, Homo sapiens
gtggcaaagtgctgta

SEQ ID NO: 3381098 - DNA, 13 bp, Homo sapiens
gtggcaaatataa

SEQ ID NO: 3381099 - DNA, 15 bp, Homo sapiens
gtggcaaatataaaa

SEQ ID NO: 3381100 - DNA, 21 bp, Homo sapiens
gtggcaagctgtgacttctcc

SEQ ID NO: 3381101 - DNA, 14 bp, Homo sapiens
gtggcacaaaaaaa

SEQ ID NO: 3381102 - DNA, 12 bp, Homo sapiens
gtggcacctcct

SEQ ID NO: 3381103 - DNA, 15 bp, Homo sapiens
gtggcacctcctgag

SEQ ID NO: 3381104 - DNA, 19 bp, Homo sapiens
gtggcactcaactctgagc

SEQ ID NO: 3381105 - DNA, 14 bp, Homo sapiens
gtggcactgagccc

SEQ ID NO: 3381106 - DNA, 19 bp, Homo sapiens
gtggcactttttcatttgc

SEQ ID NO: 3381107 - DNA, 11 bp, Homo sapiens
gtggcagagga

SEQ ID NO: 3381108 - DNA, 15 bp, Homo sapiens
gtggcagagttacag

SEQ ID NO: 3381109 - DNA, 18 bp, Homo sapiens
gtggcagattttacaaaa

SEQ ID NO: 3381110 - DNA, 18 bp, Homo sapiens
gtggcagcatcctccaaa

SEQ ID NO: 3381111 - DNA, 17 bp, Homo sapiens
gtggcagccatgcctca

SEQ ID NO: 3381112 - DNA, 12 bp, Homo sapiens
gtggcagccctg

SEQ ID NO: 3381113 - DNA, 14 bp, Homo sapiens
gtggcagctgcggt

SEQ ID NO: 3381114 - DNA, 17 bp, Homo sapiens
gtggcagctgcggtcca

SEQ ID NO: 3381115 - DNA, 12 bp, Homo sapiens
gtggcagctgct

SEQ ID NO: 3381116 - DNA, 13 bp, Homo sapiens
gtggcagctgctt

SEQ ID NO: 3381117 - DNA, 22 bp, Homo sapiens
gtggcaggcacacagcagcccc

SEQ ID NO: 3381118 - DNA, 14 bp, Homo sapiens
gtggcagtaaagag

SEQ ID NO: 3381119 - DNA, 21 bp, Homo sapiens
gtggcagtgggagctgcctgt

SEQ ID NO: 3381120 - DNA, 21 bp, Homo sapiens
gtggcagtggttttggcaaac

SEQ ID NO: 3381121 - DNA, 17 bp, Homo sapiens
gtggcatgtggcctgtg

SEQ ID NO: 3381122 - DNA, 18 bp, Homo sapiens
gtggcatgtggcctgtgg

SEQ ID NO: 3381123 - DNA, 14 bp, Homo sapiens
gtggcattgaaatg

SEQ ID NO: 3381124 - DNA, 20 bp, Homo sapiens
gtggccacagcccccttgcc

SEQ ID NO: 3381125 - DNA, 21 bp, Homo sapiens
gtggccactccagacccctgg

SEQ ID NO: 3381126 - DNA, 13 bp, Homo sapiens
gtggccagcccgg

SEQ ID NO: 3381127 - DNA, 15 bp, Homo sapiens
gtggccatccctggg

SEQ ID NO: 3381128 - DNA, 19 bp, Homo sapiens
gtggccatccctgggcccc

SEQ ID NO: 3381129 - DNA, 21 bp, Homo sapiens
gtggccatccctgggcccctc

SEQ ID NO: 3381130 - DNA, 18 bp, Homo sapiens
gtggccatccctgtgagg

SEQ ID NO: 3381131 - DNA, 23 bp, Homo sapiens
gtggccattctttttttcttggc

SEQ ID NO: 3381132 - DNA, 15 bp, Homo sapiens
gtggccccaccctgg

SEQ ID NO: 3381133 - DNA, 16 bp, Homo sapiens
gtggccccgccctcag

SEQ ID NO: 3381134 - DNA, 17 bp, Homo sapiens
gtggccccgtttctggt

SEQ ID NO: 3381135 - DNA, 17 bp, Homo sapiens
gtggcccgacagcctgg

SEQ ID NO: 3381136 - DNA, 19 bp, Homo sapiens
gtggcccgacagcctggca

SEQ ID NO: 3381137 - DNA, 18 bp, Homo sapiens
gtggccctgccctctcct

SEQ ID NO: 3381138 - DNA, 11 bp, Homo sapiens
gtggccctggc

SEQ ID NO: 3381139 - DNA, 22 bp, Homo sapiens
gtggccctgtccctcccacctc

SEQ ID NO: 3381140 - DNA, 11 bp, Homo sapiens
gtggcccttgc

SEQ ID NO: 3381141 - DNA, 18 bp, Homo sapiens
gtggccgtctcctccctc

SEQ ID NO: 3381142 - DNA, 11 bp, Homo sapiens
gtggcctcaga

SEQ ID NO: 3381143 - DNA, 11 bp, Homo sapiens
gtggcctcagc

SEQ ID NO: 3381144 - DNA, 13 bp, Homo sapiens
gtggcctcagccc

SEQ ID NO: 3381145 - DNA, 14 bp, Homo sapiens
gtggcctcagccct

SEQ ID NO: 3381146 - DNA, 17 bp, Homo sapiens
gtggcctcagccctcag

SEQ ID NO: 3381147 - DNA, 22 bp, Homo sapiens
gtggcctcagctcaatgcagtt

SEQ ID NO: 3381148 - DNA, 18 bp, Homo sapiens
gtggcctcagctgaatgc

SEQ ID NO: 3381149 - DNA, 23 bp, Homo sapiens
gtggcctcagctgaatgcctcct

SEQ ID NO: 3381150 - DNA, 22 bp, Homo sapiens
gtggcctccctgctgtgccatg

SEQ ID NO: 3381151 - DNA, 22 bp, Homo sapiens
gtggcctcgggacacctgccct

SEQ ID NO: 3381152 - DNA, 20 bp, Homo sapiens
gtggcctcttgagcagtggc

SEQ ID NO: 3381153 - DNA, 21 bp, Homo sapiens
gtggcctcttgagcagtggct

SEQ ID NO: 3381154 - DNA, 13 bp, Homo sapiens
gtggcctggccag

SEQ ID NO: 3381155 - DNA, 16 bp, Homo sapiens
gtggcctggccaggag

SEQ ID NO: 3381156 - DNA, 20 bp, Homo sapiens
gtggcctggccaggagctct

SEQ ID NO: 3381157 - DNA, 15 bp, Homo sapiens
gtggcctgtgtccag

SEQ ID NO: 3381158 - DNA, 19 bp, Homo sapiens
gtggcctgtgtccagcagc

SEQ ID NO: 3381159 - DNA, 18 bp, Homo sapiens
gtggccttctgctgccca

SEQ ID NO: 3381160 - DNA, 20 bp, Homo sapiens
gtggcgactctatagactct

SEQ ID NO: 3381161 - DNA, 13 bp, Homo sapiens
gtggcggcagggc

SEQ ID NO: 3381162 - DNA, 14 bp, Homo sapiens
gtggcgggcacctg

SEQ ID NO: 3381163 - DNA, 15 bp, Homo sapiens
gtggcgggcgcctgt

SEQ ID NO: 3381164 - DNA, 14 bp, Homo sapiens
gtggctcataaaaa

SEQ ID NO: 3381165 - DNA, 15 bp, Homo sapiens
gtggctcgctccctg

SEQ ID NO: 3381166 - DNA, 17 bp, Homo sapiens
gtggctcttatttctga

SEQ ID NO: 3381167 - DNA, 15 bp, Homo sapiens
gtggctgcaaaacta

SEQ ID NO: 3381168 - DNA, 15 bp, Homo sapiens
gtggctgccccggcc

SEQ ID NO: 3381169 - DNA, 20 bp, Homo sapiens
gtggctgggactcctggtgc

SEQ ID NO: 3381170 - DNA, 12 bp, Homo sapiens
gtggctgggcag

SEQ ID NO: 3381171 - DNA, 20 bp, Homo sapiens
gtggcttcccgctcagccct

SEQ ID NO: 3381172 - DNA, 21 bp, Homo sapiens
gtggcttcccgctcagccctc

SEQ ID NO: 3381173 - DNA, 19 bp, Homo sapiens
gtggctttggcagtgtttt

SEQ ID NO: 3381174 - DNA, 12 bp, Homo sapiens
gtgggaaaacac

SEQ ID NO: 3381175 - DNA, 19 bp, Homo sapiens
gtgggaaacattagtgaaa

SEQ ID NO: 3381176 - DNA, 14 bp, Homo sapiens
gtgggaagaaagaa

SEQ ID NO: 3381177 - DNA, 23 bp, Homo sapiens
gtgggaaggacttggcgcgccct

SEQ ID NO: 3381178 - DNA, 14 bp, Homo sapiens
gtgggaaggccagc

SEQ ID NO: 3381179 - DNA, 13 bp, Homo sapiens
gtgggacagccca

SEQ ID NO: 3381180 - DNA, 21 bp, Homo sapiens
gtgggacagcccagagcctgg

SEQ ID NO: 3381181 - DNA, 13 bp, Homo sapiens
gtgggacagcctc

SEQ ID NO: 3381182 - DNA, 14 bp, Homo sapiens
gtgggacagcctct

SEQ ID NO: 3381183 - DNA, 20 bp, Homo sapiens
gtgggacggtgcccaagcca

SEQ ID NO: 3381184 - DNA, 14 bp, Homo sapiens
gtgggactgtacac

SEQ ID NO: 3381185 - DNA, 14 bp, Homo sapiens
gtgggagagcccag

SEQ ID NO: 3381186 - DNA, 13 bp, Homo sapiens
gtgggagctgagc

SEQ ID NO: 3381187 - DNA, 14 bp, Homo sapiens
gtgggagggagcag

SEQ ID NO: 3381188 - DNA, 15 bp, Homo sapiens
gtgggagggagcaga

SEQ ID NO: 3381189 - DNA, 15 bp, Homo sapiens
gtgggaggggcaggc

SEQ ID NO: 3381190 - DNA, 16 bp, Homo sapiens
gtgggaggggcaggct

SEQ ID NO: 3381191 - DNA, 13 bp, Homo sapiens
gtgggatcctccc

SEQ ID NO: 3381192 - DNA, 16 bp, Homo sapiens
gtgggatcctccctca

SEQ ID NO: 3381193 - DNA, 20 bp, Homo sapiens
gtgggatttccagaaccaca

SEQ ID NO: 3381194 - DNA, 21 bp, Homo sapiens
gtgggcagagcccccaggaag

SEQ ID NO: 3381195 - DNA, 14 bp, Homo sapiens
gtgggcagcaccct

SEQ ID NO: 3381196 - DNA, 15 bp, Homo sapiens
gtgggcagcaccctc

SEQ ID NO: 3381197 - DNA, 15 bp, Homo sapiens
gtgggcagctgagga

SEQ ID NO: 3381198 - DNA, 17 bp, Homo sapiens
gtgggcagctgggcccc

SEQ ID NO: 3381199 - DNA, 14 bp, Homo sapiens
gtgggccagggctg

SEQ ID NO: 3381200 - DNA, 19 bp, Homo sapiens
gtgggccagggctgccctg

SEQ ID NO: 3381201 - DNA, 15 bp, Homo sapiens
gtgggccagtctgtg

SEQ ID NO: 3381202 - DNA, 19 bp, Homo sapiens
gtgggcccagaactgcccc

SEQ ID NO: 3381203 - DNA, 21 bp, Homo sapiens
gtgggcccagaactgccccca

SEQ ID NO: 3381204 - DNA, 11 bp, Homo sapiens
gtgggcccagg

SEQ ID NO: 3381205 - DNA, 17 bp, Homo sapiens
gtgggccccgggctgga

SEQ ID NO: 3381206 - DNA, 14 bp, Homo sapiens
gtgggcccctcaac

SEQ ID NO: 3381207 - DNA, 18 bp, Homo sapiens
gtgggccctccgacagcc

SEQ ID NO: 3381208 - DNA, 16 bp, Homo sapiens
gtgggccttttgctca

SEQ ID NO: 3381209 - DNA, 17 bp, Homo sapiens
gtgggcgtggtcactgc

SEQ ID NO: 3381210 - DNA, 20 bp, Homo sapiens
gtgggcgttgggagcctagc

SEQ ID NO: 3381211 - DNA, 14 bp, Homo sapiens
gtgggctaattaaa

SEQ ID NO: 3381212 - DNA, 15 bp, Homo sapiens
gtgggctagttgggc

SEQ ID NO: 3381213 - DNA, 14 bp, Homo sapiens
gtgggctgagccct

SEQ ID NO: 3381214 - DNA, 17 bp, Homo sapiens
gtgggctggacttctac

SEQ ID NO: 3381215 - DNA, 15 bp, Homo sapiens
gtgggctgggccctc

SEQ ID NO: 3381216 - DNA, 12 bp, Homo sapiens
gtgggctggggc

SEQ ID NO: 3381217 - DNA, 13 bp, Homo sapiens
gtgggctggggct

SEQ ID NO: 3381218 - DNA, 19 bp, Homo sapiens
gtgggctggggctgctccc

SEQ ID NO: 3381219 - DNA, 14 bp, Homo sapiens
gtgggctgtgagtg

SEQ ID NO: 3381220 - DNA, 14 bp, Homo sapiens
gtgggcttgattct

SEQ ID NO: 3381221 - DNA, 21 bp, Homo sapiens
gtggggaagaggggctggggc

SEQ ID NO: 3381222 - DNA, 16 bp, Homo sapiens
gtggggacccaggctc

SEQ ID NO: 3381223 - DNA, 20 bp, Homo sapiens
gtggggagcagttttcccct

SEQ ID NO: 3381224 - DNA, 23 bp, Homo sapiens
gtggggagcagttttcccctggc

SEQ ID NO: 3381225 - DNA, 19 bp, Homo sapiens
gtggggaggcccaaatgat

SEQ ID NO: 3381226 - DNA, 12 bp, Homo sapiens
gtggggccaggc

SEQ ID NO: 3381227 - DNA, 14 bp, Homo sapiens
gtggggccaggcca

SEQ ID NO: 3381228 - DNA, 16 bp, Homo sapiens
gtggggccaggccagg

SEQ ID NO: 3381229 - DNA, 20 bp, Homo sapiens
gtggggccaggccaggacca

SEQ ID NO: 3381230 - DNA, 14 bp, Homo sapiens
gtggggccaggtca

SEQ ID NO: 3381231 - DNA, 23 bp, Homo sapiens
gtggggccataaacggttcctgg

SEQ ID NO: 3381232 - DNA, 15 bp, Homo sapiens
gtggggccctgcccc

SEQ ID NO: 3381233 - DNA, 13 bp, Homo sapiens
gtggggctccccg

SEQ ID NO: 3381234 - DNA, 18 bp, Homo sapiens
gtggggctcgtggccttc

SEQ ID NO: 3381235 - DNA, 20 bp, Homo sapiens
gtggggctggtagctcaggt

SEQ ID NO: 3381236 - DNA, 15 bp, Homo sapiens
gtggggcttggcgtg

SEQ ID NO: 3381237 - DNA, 17 bp, Homo sapiens
gtggggcttggcgtgga

SEQ ID NO: 3381238 - DNA, 12 bp, Homo sapiens
gtggggcttggg

SEQ ID NO: 3381239 - DNA, 20 bp, Homo sapiens
gtgggggagagcaggctggc

SEQ ID NO: 3381240 - DNA, 13 bp, Homo sapiens
gtggggggtcctt

SEQ ID NO: 3381241 - DNA, 18 bp, Homo sapiens
gtggggggtgcaggtggg

SEQ ID NO: 3381242 - DNA, 12 bp, Homo sapiens
gtgggggtggcc

SEQ ID NO: 3381243 - DNA, 12 bp, Homo sapiens
gtggggtggggt

SEQ ID NO: 3381244 - DNA, 16 bp, Homo sapiens
gtggggtggggtgggg

SEQ ID NO: 3381245 - DNA, 16 bp, Homo sapiens
gtggggtgtgctggga

SEQ ID NO: 3381246 - DNA, 16 bp, Homo sapiens
gtgggtcagaacatgt

SEQ ID NO: 3381247 - DNA, 18 bp, Homo sapiens
gtgggtcagaacatgtta

SEQ ID NO: 3381248 - DNA, 18 bp, Homo sapiens
gtgggtccaggaaggcag

SEQ ID NO: 3381249 - DNA, 21 bp, Homo sapiens
gtgggtccaggaaggcagctg

SEQ ID NO: 3381250 - DNA, 22 bp, Homo sapiens
gtgggtccaggaaggcagctgc

SEQ ID NO: 3381251 - DNA, 19 bp, Homo sapiens
gtgggtctatgttccccag

SEQ ID NO: 3381252 - DNA, 13 bp, Homo sapiens
gtgggtctgggat

SEQ ID NO: 3381253 - DNA, 13 bp, Homo sapiens
gtgggtgagagag

SEQ ID NO: 3381254 - DNA, 23 bp, Homo sapiens
gtgggtgagatgctggagaagag

SEQ ID NO: 3381255 - DNA, 14 bp, Homo sapiens
gtgggtgctcagaa

SEQ ID NO: 3381256 - DNA, 14 bp, Homo sapiens
gtgggtgctgccct

SEQ ID NO: 3381257 - DNA, 15 bp, Homo sapiens
gtgggtgctgccctg

SEQ ID NO: 3381258 - DNA, 18 bp, Homo sapiens
gtgggtggcacctcctga

SEQ ID NO: 3381259 - DNA, 20 bp, Homo sapiens
gtgggtggcacctcctgaga

SEQ ID NO: 3381260 - DNA, 14 bp, Homo sapiens
gtgggtggtgggga

SEQ ID NO: 3381261 - DNA, 20 bp, Homo sapiens
gtgggttgaatatagcctgc

SEQ ID NO: 3381262 - DNA, 22 bp, Homo sapiens
gtgggttgaatatagcctgcct

SEQ ID NO: 3381263 - DNA, 20 bp, Homo sapiens
gtggtaacagctctcttctt

SEQ ID NO: 3381264 - DNA, 20 bp, Homo sapiens
gtggtactttattcttgctg

SEQ ID NO: 3381265 - DNA, 13 bp, Homo sapiens
gtggtagaggcct

SEQ ID NO: 3381266 - DNA, 17 bp, Homo sapiens
gtggtaggcctataaaa

SEQ ID NO: 3381267 - DNA, 22 bp, Homo sapiens
gtggtaggccttttaacatttt

SEQ ID NO: 3381268 - DNA, 19 bp, Homo sapiens
gtggtatgatcacggctca

SEQ ID NO: 3381269 - DNA, 14 bp, Homo sapiens
gtggtatgtctctt

SEQ ID NO: 3381270 - DNA, 14 bp, Homo sapiens
gtggtcactgctgt

SEQ ID NO: 3381271 - DNA, 13 bp, Homo sapiens
gtggtccccaaca

SEQ ID NO: 3381272 - DNA, 18 bp, Homo sapiens
gtggtctgaatgttctga

SEQ ID NO: 3381273 - DNA, 23 bp, Homo sapiens
gtggtctgaatgttctgacatta

SEQ ID NO: 3381274 - DNA, 24 bp, Homo sapiens
gtggtctgaatgttctgacattaa

SEQ ID NO: 3381275 - DNA, 21 bp, Homo sapiens
gtggtctgttggcaggctggc

SEQ ID NO: 3381276 - DNA, 22 bp, Homo sapiens
gtggtctgttggcaggctggcc

SEQ ID NO: 3381277 - DNA, 20 bp, Homo sapiens
gtggtggagggggctgggct

SEQ ID NO: 3381278 - DNA, 17 bp, Homo sapiens
gtggtggcagtggaggt

SEQ ID NO: 3381279 - DNA, 11 bp, Homo sapiens
gtggtgtaaag

SEQ ID NO: 3381280 - DNA, 17 bp, Homo sapiens
gtggtgtaaagctggcc

SEQ ID NO: 3381281 - DNA, 12 bp, Homo sapiens
gtggtgtaattt

SEQ ID NO: 3381282 - DNA, 13 bp, Homo sapiens
gtggtgtgaccat

SEQ ID NO: 3381283 - DNA, 21 bp, Homo sapiens
gtggtgtgaccatgttcatta

SEQ ID NO: 3381284 - DNA, 20 bp, Homo sapiens
gtggtgtgtccctggacaca

SEQ ID NO: 3381285 - DNA, 22 bp, Homo sapiens
gtggtgtgtccctggacacagc

SEQ ID NO: 3381286 - DNA, 22 bp, Homo sapiens
gtggttattagcaaggctgggt

SEQ ID NO: 3381287 - DNA, 22 bp, Homo sapiens
gtggttatttctcaacaaagca

SEQ ID NO: 3381288 - DNA, 22 bp, Homo sapiens
gtggttcctttgcaccctgtag

SEQ ID NO: 3381289 - DNA, 16 bp, Homo sapiens
gtggttctattttact

SEQ ID NO: 3381290 - DNA, 19 bp, Homo sapiens
gtggttctattttactttg

SEQ ID NO: 3381291 - DNA, 12 bp, Homo sapiens
gtggttcttaaa

SEQ ID NO: 3381292 - DNA, 19 bp, Homo sapiens
gtggttcttaaatgtttat

SEQ ID NO: 3381293 - DNA, 20 bp, Homo sapiens
gtggttggggccctgccctg

SEQ ID NO: 3381294 - DNA, 16 bp, Homo sapiens
gtggttgtagaaggag

SEQ ID NO: 3381295 - DNA, 18 bp, Homo sapiens
gtggtttaggctatttgt

SEQ ID NO: 3381296 - DNA, 14 bp, Homo sapiens
gtggtttcatgtta

SEQ ID NO: 3381297 - DNA, 16 bp, Homo sapiens
gtggtttggtgtgttc

SEQ ID NO: 3381298 - DNA, 16 bp, Homo sapiens
gtggtttttaattttg

SEQ ID NO: 3381299 - DNA, 14 bp, Homo sapiens
gtgtaaagctggcc

SEQ ID NO: 3381300 - DNA, 17 bp, Homo sapiens
gtgtaaagctggccctg

SEQ ID NO: 3381301 - DNA, 19 bp, Homo sapiens
gtgtaaagctggccctgcc

SEQ ID NO: 3381302 - DNA, 19 bp, Homo sapiens
gtgtaaatatatgtctgat

SEQ ID NO: 3381303 - DNA, 12 bp, Homo sapiens
gtgtaaatatgt

SEQ ID NO: 3381304 - DNA, 17 bp, Homo sapiens
gtgtaaatatgtacatt

SEQ ID NO: 3381305 - DNA, 16 bp, Homo sapiens
gtgtaaatggttttgt

SEQ ID NO: 3381306 - DNA, 21 bp, Homo sapiens
gtgtaaatggttttgttttgc

SEQ ID NO: 3381307 - DNA, 20 bp, Homo sapiens
gtgtaagaaaacaaactaaa

SEQ ID NO: 3381308 - DNA, 22 bp, Homo sapiens
gtgtaagtgtgagtaagagctg

SEQ ID NO: 3381309 - DNA, 14 bp, Homo sapiens
gtgtaataaagtgt

SEQ ID NO: 3381310 - DNA, 15 bp, Homo sapiens
gtgtaataaagtgtt

SEQ ID NO: 3381311 - DNA, 13 bp, Homo sapiens
gtgtaataagaca

SEQ ID NO: 3381312 - DNA, 19 bp, Homo sapiens
gtgtaatccaggggtgtag

SEQ ID NO: 3381313 - DNA, 16 bp, Homo sapiens
gtgtacaaaactgtaa

SEQ ID NO: 3381314 - DNA, 14 bp, Homo sapiens
gtgtacataactga

SEQ ID NO: 3381315 - DNA, 16 bp, Homo sapiens
gtgtacataactgaaa

SEQ ID NO: 3381316 - DNA, 18 bp, Homo sapiens
gtgtacatagtgtaatgt

SEQ ID NO: 3381317 - DNA, 22 bp, Homo sapiens
gtgtacatggaataacatgtaa

SEQ ID NO: 3381318 - DNA, 20 bp, Homo sapiens
gtgtacctgtgtacataact

SEQ ID NO: 3381319 - DNA, 18 bp, Homo sapiens
gtgtactcactgaagcct

SEQ ID NO: 3381320 - DNA, 14 bp, Homo sapiens
gtgtactctgtgtg

SEQ ID NO: 3381321 - DNA, 15 bp, Homo sapiens
gtgtacttaactatt

SEQ ID NO: 3381322 - DNA, 16 bp, Homo sapiens
gtgtactttttttgga

SEQ ID NO: 3381323 - DNA, 19 bp, Homo sapiens
gtgtagaacactaattcat

SEQ ID NO: 3381324 - DNA, 13 bp, Homo sapiens
gtgtagaagcatt

SEQ ID NO: 3381325 - DNA, 14 bp, Homo sapiens
gtgtagaagcattc

SEQ ID NO: 3381326 - DNA, 23 bp, Homo sapiens
gtgtagaagcattccttctttga

SEQ ID NO: 3381327 - DNA, 16 bp, Homo sapiens
gtgtagcctaaagggc

SEQ ID NO: 3381328 - DNA, 18 bp, Homo sapiens
gtgtagcctaaagggcag

SEQ ID NO: 3381329 - DNA, 17 bp, Homo sapiens
gtgtagctgcaaaaata

SEQ ID NO: 3381330 - DNA, 23 bp, Homo sapiens
gtgtagctgcaaaaataatcatg

SEQ ID NO: 3381331 - DNA, 12 bp, Homo sapiens
gtgtagctgtaa

SEQ ID NO: 3381332 - DNA, 16 bp, Homo sapiens
gtgtagctgtaagggc

SEQ ID NO: 3381333 - DNA, 18 bp, Homo sapiens
gtgtagctgtaagggcag

SEQ ID NO: 3381334 - DNA, 19 bp, Homo sapiens
gtgtagctgtaagggcagt

SEQ ID NO: 3381335 - DNA, 22 bp, Homo sapiens
gtgtagctgtaagggcagtgcc

SEQ ID NO: 3381336 - DNA, 14 bp, Homo sapiens
gtgtagctttgctc

SEQ ID NO: 3381337 - DNA, 17 bp, Homo sapiens
gtgtaggggccacctcc

SEQ ID NO: 3381338 - DNA, 13 bp, Homo sapiens
gtgtaggtgactt

SEQ ID NO: 3381339 - DNA, 17 bp, Homo sapiens
gtgtagtggaagagcag

SEQ ID NO: 3381340 - DNA, 20 bp, Homo sapiens
gtgtagtggaagagcagcct

SEQ ID NO: 3381341 - DNA, 23 bp, Homo sapiens
gtgtagtggaagagcagcctgat

SEQ ID NO: 3381342 - DNA, 18 bp, Homo sapiens
gtgtatagaagtagatta

SEQ ID NO: 3381343 - DNA, 14 bp, Homo sapiens
gtgtatatccttcc

SEQ ID NO: 3381344 - DNA, 17 bp, Homo sapiens
gtgtatattatttggca

SEQ ID NO: 3381345 - DNA, 16 bp, Homo sapiens
gtgtatcagtttccat

SEQ ID NO: 3381346 - DNA, 21 bp, Homo sapiens
gtgtatcccccccctgtatag

SEQ ID NO: 3381347 - DNA, 16 bp, Homo sapiens
gtgtatccgactctaa

SEQ ID NO: 3381348 - DNA, 23 bp, Homo sapiens
gtgtatccgactctaagctgtgt

SEQ ID NO: 3381349 - DNA, 15 bp, Homo sapiens
gtgtatgactaaaga

SEQ ID NO: 3381350 - DNA, 18 bp, Homo sapiens
gtgtatgagagagagaaa

SEQ ID NO: 3381351 - DNA, 21 bp, Homo sapiens
gtgtatggaaaaaccatttga

SEQ ID NO: 3381352 - DNA, 12 bp, Homo sapiens
gtgtatgtgtat

SEQ ID NO: 3381353 - DNA, 17 bp, Homo sapiens
gtgtatttaattgtaaa

SEQ ID NO: 3381354 - DNA, 17 bp, Homo sapiens
gtgtatttattgaagaa

SEQ ID NO: 3381355 - DNA, 19 bp, Homo sapiens
gtgtatttggaaataaagt

SEQ ID NO: 3381356 - DNA, 15 bp, Homo sapiens
gtgtatttgtattaa

SEQ ID NO: 3381357 - DNA, 16 bp, Homo sapiens
gtgtatttgtattaat

SEQ ID NO: 3381358 - DNA, 19 bp, Homo sapiens
gtgtatttgtattaataaa

SEQ ID NO: 3381359 - DNA, 16 bp, Homo sapiens
gtgtcaagacatttct

SEQ ID NO: 3381360 - DNA, 20 bp, Homo sapiens
gtgtcaagagggtctgagga

SEQ ID NO: 3381361 - DNA, 23 bp, Homo sapiens
gtgtcaagttgtgcttgtttaca

SEQ ID NO: 3381362 - DNA, 10 bp, Homo sapiens
gtgtcacagt

SEQ ID NO: 3381363 - DNA, 23 bp, Homo sapiens
gtgtcacagttcttggtgactgt

SEQ ID NO: 3381364 - DNA, 20 bp, Homo sapiens
gtgtcacctctctcagagca

SEQ ID NO: 3381365 - DNA, 20 bp, Homo sapiens
gtgtcagaaaccctggtctc

SEQ ID NO: 3381366 - DNA, 15 bp, Homo sapiens
gtgtcagagtgttgt

SEQ ID NO: 3381367 - DNA, 19 bp, Homo sapiens
gtgtcaggtggggcagctt

SEQ ID NO: 3381368 - DNA, 21 bp, Homo sapiens
gtgtcagttcaactttcagaa

SEQ ID NO: 3381369 - DNA, 16 bp, Homo sapiens
gtgtcatcagaagata

SEQ ID NO: 3381370 - DNA, 18 bp, Homo sapiens
gtgtcatttatgaaaaga

SEQ ID NO: 3381371 - DNA, 21 bp, Homo sapiens
gtgtcattttattttttccct

SEQ ID NO: 3381372 - DNA, 17 bp, Homo sapiens
gtgtccacctgtgggtg

SEQ ID NO: 3381373 - DNA, 15 bp, Homo sapiens
gtgtccagcagctgc

SEQ ID NO: 3381374 - DNA, 19 bp, Homo sapiens
gtgtccagcagctgcgggt

SEQ ID NO: 3381375 - DNA, 19 bp, Homo sapiens
gtgtccatgcgctcagggc

SEQ ID NO: 3381376 - DNA, 20 bp, Homo sapiens
gtgtcccaaaaagaaaggag

SEQ ID NO: 3381377 - DNA, 14 bp, Homo sapiens
gtgtccctaatgtg

SEQ ID NO: 3381378 - DNA, 16 bp, Homo sapiens
gtgtccctgcacttgc

SEQ ID NO: 3381379 - DNA, 18 bp, Homo sapiens
gtgtccctgcacttgcag

SEQ ID NO: 3381380 - DNA, 23 bp, Homo sapiens
gtgtccctgcacttgcagactct

SEQ ID NO: 3381381 - DNA, 18 bp, Homo sapiens
gtgtccctggacacagct

SEQ ID NO: 3381382 - DNA, 19 bp, Homo sapiens
gtgtccctggacacagctc

SEQ ID NO: 3381383 - DNA, 20 bp, Homo sapiens
gtgtccctggacacagctct

SEQ ID NO: 3381384 - DNA, 16 bp, Homo sapiens
gtgtcctctccctgcc

SEQ ID NO: 3381385 - DNA, 21 bp, Homo sapiens
gtgtcctctctgtgtccctgc

SEQ ID NO: 3381386 - DNA, 13 bp, Homo sapiens
gtgtcctgaccac

SEQ ID NO: 3381387 - DNA, 20 bp, Homo sapiens
gtgtcctttcccctctctgc

SEQ ID NO: 3381388 - DNA, 14 bp, Homo sapiens
gtgtcgtctgtgaa

SEQ ID NO: 3381389 - DNA, 19 bp, Homo sapiens
gtgtcgtctgtgaatgcta

SEQ ID NO: 3381390 - DNA, 14 bp, Homo sapiens
gtgtctaagattct

SEQ ID NO: 3381391 - DNA, 15 bp, Homo sapiens
gtgtctaagattcta

SEQ ID NO: 3381392 - DNA, 23 bp, Homo sapiens
gtgtctcagggtgcagaggtcag

SEQ ID NO: 3381393 - DNA, 16 bp, Homo sapiens
gtgtctccccgtgtcc

SEQ ID NO: 3381394 - DNA, 22 bp, Homo sapiens
gtgtctccttaagctgcagaga

SEQ ID NO: 3381395 - DNA, 12 bp, Homo sapiens
gtgtctctccca

SEQ ID NO: 3381396 - DNA, 14 bp, Homo sapiens
gtgtctctcccacc

SEQ ID NO: 3381397 - DNA, 16 bp, Homo sapiens
gtgtctgactcaggcg

SEQ ID NO: 3381398 - DNA, 20 bp, Homo sapiens
gtgtctgcattgttattgtg

SEQ ID NO: 3381399 - DNA, 16 bp, Homo sapiens
gtgtctgtacacgtgt

SEQ ID NO: 3381400 - DNA, 22 bp, Homo sapiens
gtgtctgtacacgtgtcctgta

SEQ ID NO: 3381401 - DNA, 13 bp, Homo sapiens
gtgtctgtattta

SEQ ID NO: 3381402 - DNA, 15 bp, Homo sapiens
gtgtcttaattatta

SEQ ID NO: 3381403 - DNA, 12 bp, Homo sapiens
gtgtcttagcat

SEQ ID NO: 3381404 - DNA, 17 bp, Homo sapiens
gtgtcttccactttgca

SEQ ID NO: 3381405 - DNA, 15 bp, Homo sapiens
gtgtcttccataatg

SEQ ID NO: 3381406 - DNA, 17 bp, Homo sapiens
gtgtcttgcaatggcag

SEQ ID NO: 3381407 - DNA, 18 bp, Homo sapiens
gtgtcttgcaatggcagc

SEQ ID NO: 3381408 - DNA, 21 bp, Homo sapiens
gtgtcttgcaatggcagcctt

SEQ ID NO: 3381409 - DNA, 23 bp, Homo sapiens
gtgtcttgggcagagctggctct

SEQ ID NO: 3381410 - DNA, 17 bp, Homo sapiens
gtgtctttatagatgta

SEQ ID NO: 3381411 - DNA, 18 bp, Homo sapiens
gtgtctttcacagctcct

SEQ ID NO: 3381412 - DNA, 12 bp, Homo sapiens
gtgtctttctct

SEQ ID NO: 3381413 - DNA, 16 bp, Homo sapiens
gtgtctttctctctct

SEQ ID NO: 3381414 - DNA, 21 bp, Homo sapiens
gtgtctttctttggtgccttt

SEQ ID NO: 3381415 - DNA, 13 bp, Homo sapiens
gtgtgaaaatggg

SEQ ID NO: 3381416 - DNA, 13 bp, Homo sapiens
gtgtgaaacaatg

SEQ ID NO: 3381417 - DNA, 13 bp, Homo sapiens
gtgtgaaatatat

SEQ ID NO: 3381418 - DNA, 13 bp, Homo sapiens
gtgtgaatgaaca

SEQ ID NO: 3381419 - DNA, 14 bp, Homo sapiens
gtgtgaatgaacac

SEQ ID NO: 3381420 - DNA, 15 bp, Homo sapiens
gtgtgaatgaacact

SEQ ID NO: 3381421 - DNA, 11 bp, Homo sapiens
gtgtgaatgca

SEQ ID NO: 3381422 - DNA, 14 bp, Homo sapiens
gtgtgaatgcacgt

SEQ ID NO: 3381423 - DNA, 11 bp, Homo sapiens
gtgtgaatgtg

SEQ ID NO: 3381424 - DNA, 15 bp, Homo sapiens
gtgtgaatgtgggca

SEQ ID NO: 3381425 - DNA, 14 bp, Homo sapiens
gtgtgacattccag

SEQ ID NO: 3381426 - DNA, 15 bp, Homo sapiens
gtgtgacattccagg

SEQ ID NO: 3381427 - DNA, 14 bp, Homo sapiens
gtgtgaccaactgt

SEQ ID NO: 3381428 - DNA, 19 bp, Homo sapiens
gtgtgactggcaagaggcc

SEQ ID NO: 3381429 - DNA, 21 bp, Homo sapiens
gtgtgagaagtgaatgctggg

SEQ ID NO: 3381430 - DNA, 18 bp, Homo sapiens
gtgtgagtcaccaagccc

SEQ ID NO: 3381431 - DNA, 14 bp, Homo sapiens
gtgtgagtggcagc

SEQ ID NO: 3381432 - DNA, 19 bp, Homo sapiens
gtgtgatcccaagtgccag

SEQ ID NO: 3381433 - DNA, 17 bp, Homo sapiens
gtgtgatttcctaaaca

SEQ ID NO: 3381434 - DNA, 22 bp, Homo sapiens
gtgtgatttcctaaacataatt

SEQ ID NO: 3381435 - DNA, 20 bp, Homo sapiens
gtgtgcacaaatatttattt

SEQ ID NO: 3381436 - DNA, 22 bp, Homo sapiens
gtgtgcaccttaccaactttct

SEQ ID NO: 3381437 - DNA, 13 bp, Homo sapiens
gtgtgcagtgaag

SEQ ID NO: 3381438 - DNA, 16 bp, Homo sapiens
gtgtgcatgtgtgtat

SEQ ID NO: 3381439 - DNA, 16 bp, Homo sapiens
gtgtgcccccttcaag

SEQ ID NO: 3381440 - DNA, 19 bp, Homo sapiens
gtgtgcctcagtatattta

SEQ ID NO: 3381441 - DNA, 13 bp, Homo sapiens
gtgtgcctgcagc

SEQ ID NO: 3381442 - DNA, 18 bp, Homo sapiens
gtgtgcctgcagccccgc

SEQ ID NO: 3381443 - DNA, 13 bp, Homo sapiens
gtgtgcctgtggc

SEQ ID NO: 3381444 - DNA, 22 bp, Homo sapiens
gtgtgctctgatcatccactgt

SEQ ID NO: 3381445 - DNA, 19 bp, Homo sapiens
gtgtgctctttttttaaaa

SEQ ID NO: 3381446 - DNA, 21 bp, Homo sapiens
gtgtggaagttattaacttta

SEQ ID NO: 3381447 - DNA, 23 bp, Homo sapiens
gtgtggatcttgccacatttctg

SEQ ID NO: 3381448 - DNA, 21 bp, Homo sapiens
gtgtggatgtaattagctctg

SEQ ID NO: 3381449 - DNA, 12 bp, Homo sapiens
gtgtggcagtgg

SEQ ID NO: 3381450 - DNA, 14 bp, Homo sapiens
gtgtggcagtggtt

SEQ ID NO: 3381451 - DNA, 13 bp, Homo sapiens
gtgtggcctcagc

SEQ ID NO: 3381452 - DNA, 14 bp, Homo sapiens
gtgtggctccttcc

SEQ ID NO: 3381453 - DNA, 17 bp, Homo sapiens
gtgtgggactgtacaca

SEQ ID NO: 3381454 - DNA, 14 bp, Homo sapiens
gtgtggtgcagtgt

SEQ ID NO: 3381455 - DNA, 12 bp, Homo sapiens
gtgtggtggcct

SEQ ID NO: 3381456 - DNA, 13 bp, Homo sapiens
gtgtggtggcctc

SEQ ID NO: 3381457 - DNA, 15 bp, Homo sapiens
gtgtggtggcctcag

SEQ ID NO: 3381458 - DNA, 16 bp, Homo sapiens
gtgtggtggcctcagc

SEQ ID NO: 3381459 - DNA, 23 bp, Homo sapiens
gtgtggtggcctcagctgaatgc

SEQ ID NO: 3381460 - DNA, 13 bp, Homo sapiens
gtgtggtggctca

SEQ ID NO: 3381461 - DNA, 22 bp, Homo sapiens
gtgtggtgtcgtctgtgaatgc

SEQ ID NO: 3381462 - DNA, 20 bp, Homo sapiens
gtgtggtgtgtttgcttgga

SEQ ID NO: 3381463 - DNA, 15 bp, Homo sapiens
gtgtggttatgaact

SEQ ID NO: 3381464 - DNA, 18 bp, Homo sapiens
gtgtggttgctcacagct

SEQ ID NO: 3381465 - DNA, 16 bp, Homo sapiens
gtgtgtaacactgtgt

SEQ ID NO: 3381466 - DNA, 17 bp, Homo sapiens
gtgtgtactctgtccag

SEQ ID NO: 3381467 - DNA, 17 bp, Homo sapiens
gtgtgtagacaaatatt

SEQ ID NO: 3381468 - DNA, 21 bp, Homo sapiens
gtgtgtagagttaagaagctg

SEQ ID NO: 3381469 - DNA, 14 bp, Homo sapiens
gtgtgtagccaagg

SEQ ID NO: 3381470 - DNA, 23 bp, Homo sapiens
gtgtgtatatatgtgtatatata

SEQ ID NO: 3381471 - DNA, 22 bp, Homo sapiens
gtgtgtatccgactctaagctg

SEQ ID NO: 3381472 - DNA, 21 bp, Homo sapiens
gtgtgtatgactaaagagaga

SEQ ID NO: 3381473 - DNA, 15 bp, Homo sapiens
gtgtgtatgtgtatt

SEQ ID NO: 3381474 - DNA, 18 bp, Homo sapiens
gtgtgtccaaaactgcct

SEQ ID NO: 3381475 - DNA, 20 bp, Homo sapiens
gtgtgtccctggacacagct

SEQ ID NO: 3381476 - DNA, 23 bp, Homo sapiens
gtgtgtccctggacacagctctt

SEQ ID NO: 3381477 - DNA, 15 bp, Homo sapiens
gtgtgtctgctcagt

SEQ ID NO: 3381478 - DNA, 15 bp, Homo sapiens
gtgtgtctgttcact

SEQ ID NO: 3381479 - DNA, 21 bp, Homo sapiens
gtgtgtcttaattattatttg

SEQ ID NO: 3381480 - DNA, 14 bp, Homo sapiens
gtgtgtgaaaggaa

SEQ ID NO: 3381481 - DNA, 13 bp, Homo sapiens
gtgtgtgtgaatg

SEQ ID NO: 3381482 - DNA, 10 bp, Homo sapiens
gtgtgtgtgt

SEQ ID NO: 3381483 - DNA, 18 bp, Homo sapiens
gtgtgttctgattagaaa

SEQ ID NO: 3381484 - DNA, 21 bp, Homo sapiens
gtgtgttctgtaatggaactg

SEQ ID NO: 3381485 - DNA, 19 bp, Homo sapiens
gtgtgttcttcaagccagc

SEQ ID NO: 3381486 - DNA, 22 bp, Homo sapiens
gtgtgttcttcaagccagctct

SEQ ID NO: 3381487 - DNA, 15 bp, Homo sapiens
gtgtgttgtcagcct

SEQ ID NO: 3381488 - DNA, 16 bp, Homo sapiens
gtgtgttgtctcttga

SEQ ID NO: 3381489 - DNA, 22 bp, Homo sapiens
gtgtgtttccagatcgatcctg

SEQ ID NO: 3381490 - DNA, 23 bp, Homo sapiens
gtgtgtttccagatcgatcctgg

SEQ ID NO: 3381491 - DNA, 18 bp, Homo sapiens
gtgtgttttcataataaa

SEQ ID NO: 3381492 - DNA, 20 bp, Homo sapiens
gtgtgttttgagagtatatt

SEQ ID NO: 3381493 - DNA, 21 bp, Homo sapiens
gtgtgttttgagagtatatta

SEQ ID NO: 3381494 - DNA, 17 bp, Homo sapiens
gtgttaacattccaaga

SEQ ID NO: 3381495 - DNA, 14 bp, Homo sapiens
gtgttaagattgca

SEQ ID NO: 3381496 - DNA, 21 bp, Homo sapiens
gtgttactaaaaaaaagatga

SEQ ID NO: 3381497 - DNA, 16 bp, Homo sapiens
gtgttaggggcctggc

SEQ ID NO: 3381498 - DNA, 13 bp, Homo sapiens
gtgttatttttca

SEQ ID NO: 3381499 - DNA, 14 bp, Homo sapiens
gtgttcaagaaata

SEQ ID NO: 3381500 - DNA, 11 bp, Homo sapiens
gtgttcatttt

SEQ ID NO: 3381501 - DNA, 19 bp, Homo sapiens
gtgttccccatctgggtcc

SEQ ID NO: 3381502 - DNA, 22 bp, Homo sapiens
gtgttccgaagatgctgtagta

SEQ ID NO: 3381503 - DNA, 16 bp, Homo sapiens
gtgttcctcctgctgt

SEQ ID NO: 3381504 - DNA, 19 bp, Homo sapiens
gtgttcctggcagtttaaa

SEQ ID NO: 3381505 - DNA, 22 bp, Homo sapiens
gtgttctaagatgtgatattct

SEQ ID NO: 3381506 - DNA, 18 bp, Homo sapiens
gtgttcttcttctcttct

SEQ ID NO: 3381507 - DNA, 19 bp, Homo sapiens
gtgttgccaaatatgtcct

SEQ ID NO: 3381508 - DNA, 18 bp, Homo sapiens
gtgttgccaagctccaag

SEQ ID NO: 3381509 - DNA, 20 bp, Homo sapiens
gtgttgcccaggctggtctc

SEQ ID NO: 3381510 - DNA, 21 bp, Homo sapiens
gtgttgggatactgcagggcc

SEQ ID NO: 3381511 - DNA, 23 bp, Homo sapiens
gtgttggtctttctaatgtagct

SEQ ID NO: 3381512 - DNA, 14 bp, Homo sapiens
gtgttgtatgcctt

SEQ ID NO: 3381513 - DNA, 14 bp, Homo sapiens
gtgttgtattaaca

SEQ ID NO: 3381514 - DNA, 17 bp, Homo sapiens
gtgttgtcagcctgtgc

SEQ ID NO: 3381515 - DNA, 15 bp, Homo sapiens
gtgttgtcattgtaa

SEQ ID NO: 3381516 - DNA, 17 bp, Homo sapiens
gtgttgtcattgtaaac

SEQ ID NO: 3381517 - DNA, 17 bp, Homo sapiens
gtgttgtcttcagcagt

SEQ ID NO: 3381518 - DNA, 16 bp, Homo sapiens
gtgtttaatttcttca

SEQ ID NO: 3381519 - DNA, 17 bp, Homo sapiens
gtgtttaatttcttcaa

SEQ ID NO: 3381520 - DNA, 12 bp, Homo sapiens
gtgtttacagac

SEQ ID NO: 3381521 - DNA, 15 bp, Homo sapiens
gtgtttacagacaga

SEQ ID NO: 3381522 - DNA, 13 bp, Homo sapiens
gtgtttatttata

SEQ ID NO: 3381523 - DNA, 20 bp, Homo sapiens
gtgtttatttttcatattgt

SEQ ID NO: 3381524 - DNA, 18 bp, Homo sapiens
gtgtttcacttttaggga

SEQ ID NO: 3381525 - DNA, 13 bp, Homo sapiens
gtgtttctgactc

SEQ ID NO: 3381526 - DNA, 19 bp, Homo sapiens
gtgtttgcttaaacaaagt

SEQ ID NO: 3381527 - DNA, 23 bp, Homo sapiens
gtgtttgcttggaaattccttgc

SEQ ID NO: 3381528 - DNA, 15 bp, Homo sapiens
gtgtttggcttggcc

SEQ ID NO: 3381529 - DNA, 14 bp, Homo sapiens
gtgtttgtgtgtgt

SEQ ID NO: 3381530 - DNA, 12 bp, Homo sapiens
gtgtttgttcct

SEQ ID NO: 3381531 - DNA, 18 bp, Homo sapiens
gtgttttaaagagaatgt

SEQ ID NO: 3381532 - DNA, 22 bp, Homo sapiens
gtgttttaattccaatatgatg

SEQ ID NO: 3381533 - DNA, 16 bp, Homo sapiens
gtgttttaattgtaaa

SEQ ID NO: 3381534 - DNA, 14 bp, Homo sapiens
gtgttttaatttaa

SEQ ID NO: 3381535 - DNA, 15 bp, Homo sapiens
gtgttttaatttaaa

SEQ ID NO: 3381536 - DNA, 14 bp, Homo sapiens
gtgttttactcttt

SEQ ID NO: 3381537 - DNA, 20 bp, Homo sapiens
gtgttttactgtcagattaa

SEQ ID NO: 3381538 - DNA, 14 bp, Homo sapiens
gtgttttcataata

SEQ ID NO: 3381539 - DNA, 17 bp, Homo sapiens
gtgtttttagctgtgac

SEQ ID NO: 3381540 - DNA, 12 bp, Homo sapiens
gtgtttttctca

SEQ ID NO: 3381541 - DNA, 15 bp, Homo sapiens
gtgtttttctccagt

SEQ ID NO: 3381542 - DNA, 19 bp, Homo sapiens
gtgtttttttatgaatggg

SEQ ID NO: 3381543 - DNA, 23 bp, Homo sapiens
gttaaaaataaaaactaatttca

SEQ ID NO: 3381544 - DNA, 17 bp, Homo sapiens
gttaaaaatcagctggg

SEQ ID NO: 3381545 - DNA, 22 bp, Homo sapiens
gttaaaactgtacatttaaaat

SEQ ID NO: 3381546 - DNA, 23 bp, Homo sapiens
gttaaaagttatttgttcattat

SEQ ID NO: 3381547 - DNA, 15 bp, Homo sapiens
gttaaaattccatcc

SEQ ID NO: 3381548 - DNA, 12 bp, Homo sapiens
gttaaacagtag

SEQ ID NO: 3381549 - DNA, 15 bp, Homo sapiens
gttaaactaaaaaaa

SEQ ID NO: 3381550 - DNA, 15 bp, Homo sapiens
gttaaagaaaggaaa

SEQ ID NO: 3381551 - DNA, 17 bp, Homo sapiens
gttaaagcatcagagat

SEQ ID NO: 3381552 - DNA, 15 bp, Homo sapiens
gttaaagctgccggc

SEQ ID NO: 3381553 - DNA, 21 bp, Homo sapiens
gttaaagggatatttttttct

SEQ ID NO: 3381554 - DNA, 18 bp, Homo sapiens
gttaaaggttttctctaa

SEQ ID NO: 3381555 - DNA, 13 bp, Homo sapiens
gttaaagtttaag

SEQ ID NO: 3381556 - DNA, 20 bp, Homo sapiens
gttaaatagagtatatgcac

SEQ ID NO: 3381557 - DNA, 17 bp, Homo sapiens
gttaaatgaaattgtaa

SEQ ID NO: 3381558 - DNA, 20 bp, Homo sapiens
gttaaatgaaattgtaaaac

SEQ ID NO: 3381559 - DNA, 14 bp, Homo sapiens
gttaaatttgtaag

SEQ ID NO: 3381560 - DNA, 23 bp, Homo sapiens
gttaaatttgtaagtttcaggtg

SEQ ID NO: 3381561 - DNA, 13 bp, Homo sapiens
gttaacaaggaat

SEQ ID NO: 3381562 - DNA, 15 bp, Homo sapiens
gttaacaaggaatgc

SEQ ID NO: 3381563 - DNA, 19 bp, Homo sapiens
gttaacaaggaatgcctgt

SEQ ID NO: 3381564 - DNA, 17 bp, Homo sapiens
gttaacaataaagtgac

SEQ ID NO: 3381565 - DNA, 15 bp, Homo sapiens
gttaacattaacatc

SEQ ID NO: 3381566 - DNA, 23 bp, Homo sapiens
gttaacattccaagactctagag

SEQ ID NO: 3381567 - DNA, 21 bp, Homo sapiens
gttaacattgaccaagaactg

SEQ ID NO: 3381568 - DNA, 22 bp, Homo sapiens
gttaacattgttgctccctgtg

SEQ ID NO: 3381569 - DNA, 15 bp, Homo sapiens
gttaaccatttaagt

SEQ ID NO: 3381570 - DNA, 16 bp, Homo sapiens
gttaacctctgctttt

SEQ ID NO: 3381571 - DNA, 14 bp, Homo sapiens
gttaactacatatt

SEQ ID NO: 3381572 - DNA, 19 bp, Homo sapiens
gttaactgtgaaataccac

SEQ ID NO: 3381573 - DNA, 14 bp, Homo sapiens
gttaacttggtcag

SEQ ID NO: 3381574 - DNA, 19 bp, Homo sapiens
gttaacttggtcagagcca

SEQ ID NO: 3381575 - DNA, 19 bp, Homo sapiens
gttaagaagctgttgtaca

SEQ ID NO: 3381576 - DNA, 15 bp, Homo sapiens
gttaagaatgtcgat

SEQ ID NO: 3381577 - DNA, 22 bp, Homo sapiens
gttaagagatcccttaagaagt

SEQ ID NO: 3381578 - DNA, 12 bp, Homo sapiens
gttaaggaaact

SEQ ID NO: 3381579 - DNA, 14 bp, Homo sapiens
gttaaggaaactct

SEQ ID NO: 3381580 - DNA, 14 bp, Homo sapiens
gttaagggcagagt

SEQ ID NO: 3381581 - DNA, 19 bp, Homo sapiens
gttaatctctgttatgtac

SEQ ID NO: 3381582 - DNA, 16 bp, Homo sapiens
gttaatgaaaatgtca

SEQ ID NO: 3381583 - DNA, 18 bp, Homo sapiens
gttaatgatagctactgt

SEQ ID NO: 3381584 - DNA, 18 bp, Homo sapiens
gttaatgatggcagagga

SEQ ID NO: 3381585 - DNA, 19 bp, Homo sapiens
gttaatggctagtactgta

SEQ ID NO: 3381586 - DNA, 22 bp, Homo sapiens
gttaatggctagtactgtattg

SEQ ID NO: 3381587 - DNA, 16 bp, Homo sapiens
gttaattcctatgaag

SEQ ID NO: 3381588 - DNA, 14 bp, Homo sapiens
gttaatttatttag

SEQ ID NO: 3381589 - DNA, 18 bp, Homo sapiens
gttaatttgtgtgttttt

SEQ ID NO: 3381590 - DNA, 16 bp, Homo sapiens
gttaattttcctcatt

SEQ ID NO: 3381591 - DNA, 16 bp, Homo sapiens
gttacaaactacagac

SEQ ID NO: 3381592 - DNA, 23 bp, Homo sapiens
gttacaaactgcaatagagactg

SEQ ID NO: 3381593 - DNA, 17 bp, Homo sapiens
gttacaacgaatttaca

SEQ ID NO: 3381594 - DNA, 16 bp, Homo sapiens
gttacaattacatctc

SEQ ID NO: 3381595 - DNA, 19 bp, Homo sapiens
gttacactgttagaacact

SEQ ID NO: 3381596 - DNA, 15 bp, Homo sapiens
gttacagtgcagaca

SEQ ID NO: 3381597 - DNA, 22 bp, Homo sapiens
gttacataatcagtatatttgg

SEQ ID NO: 3381598 - DNA, 14 bp, Homo sapiens
gttacattaaaata

SEQ ID NO: 3381599 - DNA, 15 bp, Homo sapiens
gttacattaaaataa

SEQ ID NO: 3381600 - DNA, 14 bp, Homo sapiens
gttacattaatgtt

SEQ ID NO: 3381601 - DNA, 23 bp, Homo sapiens
gttaccaaatacacatttcacat

SEQ ID NO: 3381602 - DNA, 21 bp, Homo sapiens
gttaccatatttatccatttg

SEQ ID NO: 3381603 - DNA, 20 bp, Homo sapiens
gttacccaggctggagtgca

SEQ ID NO: 3381604 - DNA, 17 bp, Homo sapiens
gttacccattcaaccat

SEQ ID NO: 3381605 - DNA, 16 bp, Homo sapiens
gttaccgcctgtctct

SEQ ID NO: 3381606 - DNA, 16 bp, Homo sapiens
gttacctaaagtattt

SEQ ID NO: 3381607 - DNA, 13 bp, Homo sapiens
gttacctactttg

SEQ ID NO: 3381608 - DNA, 22 bp, Homo sapiens
gttaccttatagttactgtgta

SEQ ID NO: 3381609 - DNA, 14 bp, Homo sapiens
gttacgaagacaaa

SEQ ID NO: 3381610 - DNA, 12 bp, Homo sapiens
gttactaaaaag

SEQ ID NO: 3381611 - DNA, 14 bp, Homo sapiens
gttactagcctctc

SEQ ID NO: 3381612 - DNA, 20 bp, Homo sapiens
gttactcagggctcctccca

SEQ ID NO: 3381613 - DNA, 23 bp, Homo sapiens
gttactcagggttcatctgtcca

SEQ ID NO: 3381614 - DNA, 11 bp, Homo sapiens
gttactctctt

SEQ ID NO: 3381615 - DNA, 23 bp, Homo sapiens
gttactctgcctttctaagactc

SEQ ID NO: 3381616 - DNA, 21 bp, Homo sapiens
gttactgaaggtgatggaggt

SEQ ID NO: 3381617 - DNA, 18 bp, Homo sapiens
gttactgatcatgcattg

SEQ ID NO: 3381618 - DNA, 19 bp, Homo sapiens
gttactgcctataatctta

SEQ ID NO: 3381619 - DNA, 18 bp, Homo sapiens
gttactggataaattgtt

SEQ ID NO: 3381620 - DNA, 19 bp, Homo sapiens
gttactggataaattgttt

SEQ ID NO: 3381621 - DNA, 10 bp, Homo sapiens
gttactgttc

SEQ ID NO: 3381622 - DNA, 14 bp, Homo sapiens
gttactgttcttgc

SEQ ID NO: 3381623 - DNA, 15 bp, Homo sapiens
gttactgttcttgct

SEQ ID NO: 3381624 - DNA, 17 bp, Homo sapiens
gttactgttcttgctgc

SEQ ID NO: 3381625 - DNA, 17 bp, Homo sapiens
gttacttacctaaacag

SEQ ID NO: 3381626 - DNA, 23 bp, Homo sapiens
gttacttgtctgaggcctcatcc

SEQ ID NO: 3381627 - DNA, 20 bp, Homo sapiens
gttactttctttcagatgtt

SEQ ID NO: 3381628 - DNA, 21 bp, Homo sapiens
gttactttctttcagatgttt

SEQ ID NO: 3381629 - DNA, 11 bp, Homo sapiens
gttactttgta

SEQ ID NO: 3381630 - DNA, 14 bp, Homo sapiens
gttactttgtaatt

SEQ ID NO: 3381631 - DNA, 16 bp, Homo sapiens
gttactttgtaatttt

SEQ ID NO: 3381632 - DNA, 17 bp, Homo sapiens
gttactttgtaattttt

SEQ ID NO: 3381633 - DNA, 22 bp, Homo sapiens
gttagaatataggtctcttctc

SEQ ID NO: 3381634 - DNA, 23 bp, Homo sapiens
gttagagaactaaactagttttt

SEQ ID NO: 3381635 - DNA, 17 bp, Homo sapiens
gttagagagaaagagaa

SEQ ID NO: 3381636 - DNA, 13 bp, Homo sapiens
gttagaggaaggc

SEQ ID NO: 3381637 - DNA, 22 bp, Homo sapiens
gttagaggttttaaagtgatta

SEQ ID NO: 3381638 - DNA, 11 bp, Homo sapiens
gttagatgctg

SEQ ID NO: 3381639 - DNA, 20 bp, Homo sapiens
gttagccctcagtcagttcc

SEQ ID NO: 3381640 - DNA, 20 bp, Homo sapiens
gttagctcaggaggcttgga

SEQ ID NO: 3381641 - DNA, 11 bp, Homo sapiens
gttagctggag

SEQ ID NO: 3381642 - DNA, 14 bp, Homo sapiens
gttaggaaataaaa

SEQ ID NO: 3381643 - DNA, 22 bp, Homo sapiens
gttaggaaataaaacctttcaa

SEQ ID NO: 3381644 - DNA, 23 bp, Homo sapiens
gttaggaaataaaacctttcaaa

SEQ ID NO: 3381645 - DNA, 15 bp, Homo sapiens
gttaggatttaacag

SEQ ID NO: 3381646 - DNA, 18 bp, Homo sapiens
gttaggcattaatgtttc

SEQ ID NO: 3381647 - DNA, 22 bp, Homo sapiens
gttaggggccttagggcactgg

SEQ ID NO: 3381648 - DNA, 23 bp, Homo sapiens
gttagggtgctctggaagagagg

SEQ ID NO: 3381649 - DNA, 22 bp, Homo sapiens
gttaggtcctcacttgggggaa

SEQ ID NO: 3381650 - DNA, 19 bp, Homo sapiens
gttagtaatggcagagcag

SEQ ID NO: 3381651 - DNA, 22 bp, Homo sapiens
gttagtcatttgctgagcatgt

SEQ ID NO: 3381652 - DNA, 17 bp, Homo sapiens
gttagttaccttatagt

SEQ ID NO: 3381653 - DNA, 23 bp, Homo sapiens
gttagttaccttatagttactgt

SEQ ID NO: 3381654 - DNA, 14 bp, Homo sapiens
gttagtttttactt

SEQ ID NO: 3381655 - DNA, 15 bp, Homo sapiens
gttataaaaaatggt

SEQ ID NO: 3381656 - DNA, 14 bp, Homo sapiens
gttatacaaggcaa

SEQ ID NO: 3381657 - DNA, 16 bp, Homo sapiens
gttatacaataaccca

SEQ ID NO: 3381658 - DNA, 22 bp, Homo sapiens
gttatacaataacccagttact

SEQ ID NO: 3381659 - DNA, 23 bp, Homo sapiens
gttatacaataacccagttactt

SEQ ID NO: 3381660 - DNA, 17 bp, Homo sapiens
gttatacagttataaaa

SEQ ID NO: 3381661 - DNA, 13 bp, Homo sapiens
gttatacttcaaa

SEQ ID NO: 3381662 - DNA, 16 bp, Homo sapiens
gttatagtatatctgg

SEQ ID NO: 3381663 - DNA, 21 bp, Homo sapiens
gttatagtgaatactgctaca

SEQ ID NO: 3381664 - DNA, 16 bp, Homo sapiens
gttatatcatatgtat

SEQ ID NO: 3381665 - DNA, 14 bp, Homo sapiens
gttatattttgctg

SEQ ID NO: 3381666 - DNA, 17 bp, Homo sapiens
gttatattttgctgttt

SEQ ID NO: 3381667 - DNA, 18 bp, Homo sapiens
gttatattttgctgttta

SEQ ID NO: 3381668 - DNA, 14 bp, Homo sapiens
gttatcatgaattt

SEQ ID NO: 3381669 - DNA, 16 bp, Homo sapiens
gttatcatgaatttta

SEQ ID NO: 3381670 - DNA, 15 bp, Homo sapiens
gttatcgaaataaca

SEQ ID NO: 3381671 - DNA, 15 bp, Homo sapiens
gttatctaaaagaaa

SEQ ID NO: 3381672 - DNA, 13 bp, Homo sapiens
gttatctctgtgt

SEQ ID NO: 3381673 - DNA, 16 bp, Homo sapiens
gttatctgcctggcct

SEQ ID NO: 3381674 - DNA, 17 bp, Homo sapiens
gttatctgcctggcctg

SEQ ID NO: 3381675 - DNA, 21 bp, Homo sapiens
gttatcttctcaagttctaag

SEQ ID NO: 3381676 - DNA, 20 bp, Homo sapiens
gttatgaaattcaccccctt

SEQ ID NO: 3381677 - DNA, 13 bp, Homo sapiens
gttatgaatcagt

SEQ ID NO: 3381678 - DNA, 20 bp, Homo sapiens
gttatgatttttttttcata

SEQ ID NO: 3381679 - DNA, 13 bp, Homo sapiens
gttatgctgtgac

SEQ ID NO: 3381680 - DNA, 17 bp, Homo sapiens
gttatgggatgtaaaca

SEQ ID NO: 3381681 - DNA, 14 bp, Homo sapiens
gttatgtaaaactc

SEQ ID NO: 3381682 - DNA, 13 bp, Homo sapiens
gttatgtactgta

SEQ ID NO: 3381683 - DNA, 22 bp, Homo sapiens
gttatgtgaatgatctctctga

SEQ ID NO: 3381684 - DNA, 16 bp, Homo sapiens
gttatgttcatttttc

SEQ ID NO: 3381685 - DNA, 13 bp, Homo sapiens
gttattataattg

SEQ ID NO: 3381686 - DNA, 21 bp, Homo sapiens
gttattcataaagagaaaatg

SEQ ID NO: 3381687 - DNA, 12 bp, Homo sapiens
gttattccatca

SEQ ID NO: 3381688 - DNA, 17 bp, Homo sapiens
gttattgtacagctgtt

SEQ ID NO: 3381689 - DNA, 12 bp, Homo sapiens
gttattgtggaa

SEQ ID NO: 3381690 - DNA, 12 bp, Homo sapiens
gttattgttgaa

SEQ ID NO: 3381691 - DNA, 14 bp, Homo sapiens
gttattgttttgtt

SEQ ID NO: 3381692 - DNA, 18 bp, Homo sapiens
gttatttattctttattt

SEQ ID NO: 3381693 - DNA, 22 bp, Homo sapiens
gttatttgaaaacatgtttatt

SEQ ID NO: 3381694 - DNA, 16 bp, Homo sapiens
gttatttgcacactgc

SEQ ID NO: 3381695 - DNA, 14 bp, Homo sapiens
gttattttaaatat

SEQ ID NO: 3381696 - DNA, 17 bp, Homo sapiens
gttattttcagtatttt

SEQ ID NO: 3381697 - DNA, 12 bp, Homo sapiens
gttattttctac

SEQ ID NO: 3381698 - DNA, 14 bp, Homo sapiens
gttattttctacag

SEQ ID NO: 3381699 - DNA, 17 bp, Homo sapiens
gttattttctacagtgg

SEQ ID NO: 3381700 - DNA, 23 bp, Homo sapiens
gttatttttatatcagcctgagt

SEQ ID NO: 3381701 - DNA, 16 bp, Homo sapiens
gttcaaaacattccaa

SEQ ID NO: 3381702 - DNA, 14 bp, Homo sapiens
gttcaactatttta

SEQ ID NO: 3381703 - DNA, 16 bp, Homo sapiens
gttcaactttcagaag

SEQ ID NO: 3381704 - DNA, 15 bp, Homo sapiens
gttcaagaccagcct

SEQ ID NO: 3381705 - DNA, 16 bp, Homo sapiens
gttcaagaccagcctg

SEQ ID NO: 3381706 - DNA, 14 bp, Homo sapiens
gttcaagcctgtgg

SEQ ID NO: 3381707 - DNA, 16 bp, Homo sapiens
gttcaagcctgtggga

SEQ ID NO: 3381708 - DNA, 19 bp, Homo sapiens
gttcaagcgattcttctgc

SEQ ID NO: 3381709 - DNA, 20 bp, Homo sapiens
gttcaagcgattcttctgct

SEQ ID NO: 3381710 - DNA, 14 bp, Homo sapiens
gttcaagcgccaga

SEQ ID NO: 3381711 - DNA, 12 bp, Homo sapiens
gttcaagttttg

SEQ ID NO: 3381712 - DNA, 20 bp, Homo sapiens
gttcaataaacttaacttta

SEQ ID NO: 3381713 - DNA, 15 bp, Homo sapiens
gttcaatgttccatt

SEQ ID NO: 3381714 - DNA, 15 bp, Homo sapiens
gttcaattccctgaa

SEQ ID NO: 3381715 - DNA, 16 bp, Homo sapiens
gttcaattctcatttg

SEQ ID NO: 3381716 - DNA, 23 bp, Homo sapiens
gttcacaaactacctctggacag

SEQ ID NO: 3381717 - DNA, 15 bp, Homo sapiens
gttcacaccctgcaa

SEQ ID NO: 3381718 - DNA, 16 bp, Homo sapiens
gttcacaccctgcaag

SEQ ID NO: 3381719 - DNA, 13 bp, Homo sapiens
gttcacagaaaaa

SEQ ID NO: 3381720 - DNA, 17 bp, Homo sapiens
gttcacagaaaaagcat

SEQ ID NO: 3381721 - DNA, 22 bp, Homo sapiens
gttcaccatctcttcattcaaa

SEQ ID NO: 3381722 - DNA, 13 bp, Homo sapiens
gttcacctccctg

SEQ ID NO: 3381723 - DNA, 24 bp, Homo sapiens
gttcactctacttagcatgtccct

SEQ ID NO: 3381724 - DNA, 14 bp, Homo sapiens
gttcactgaagacg

SEQ ID NO: 3381725 - DNA, 21 bp, Homo sapiens
gttcactgagctccccagatc

SEQ ID NO: 3381726 - DNA, 24 bp, Homo sapiens
gttcactgagctccccagatctcc

SEQ ID NO: 3381727 - DNA, 19 bp, Homo sapiens
gttcactgcaacctccgcc

SEQ ID NO: 3381728 - DNA, 13 bp, Homo sapiens
gttcagaacaact

SEQ ID NO: 3381729 - DNA, 22 bp, Homo sapiens
gttcagaatttagtgtatccat

SEQ ID NO: 3381730 - DNA, 19 bp, Homo sapiens
gttcagagtccttaaaatg

SEQ ID NO: 3381731 - DNA, 17 bp, Homo sapiens
gttcagatgtgcatttc

SEQ ID NO: 3381732 - DNA, 16 bp, Homo sapiens
gttcagcaccacccta

SEQ ID NO: 3381733 - DNA, 18 bp, Homo sapiens
gttcagcactgtcccttg

SEQ ID NO: 3381734 - DNA, 22 bp, Homo sapiens
gttcagcactgtcccttgcctc

SEQ ID NO: 3381735 - DNA, 12 bp, Homo sapiens
gttcagccaagg

SEQ ID NO: 3381736 - DNA, 15 bp, Homo sapiens
gttcagccaaggttt

SEQ ID NO: 3381737 - DNA, 17 bp, Homo sapiens
gttcagctgtcctccct

SEQ ID NO: 3381738 - DNA, 15 bp, Homo sapiens
gttcagtagaattac

SEQ ID NO: 3381739 - DNA, 19 bp, Homo sapiens
gttcagtatttaatgaaac

SEQ ID NO: 3381740 - DNA, 20 bp, Homo sapiens
gttcagtggcagggctcagg

SEQ ID NO: 3381741 - DNA, 21 bp, Homo sapiens
gttcagtggcagggctcagga

SEQ ID NO: 3381742 - DNA, 22 bp, Homo sapiens
gttcagtggcagggctcaggat

SEQ ID NO: 3381743 - DNA, 16 bp, Homo sapiens
gttcagtgtcccaggc

SEQ ID NO: 3381744 - DNA, 18 bp, Homo sapiens
gttcagtgtcccaggcag

SEQ ID NO: 3381745 - DNA, 18 bp, Homo sapiens
gttcagtttcttctgcgc

SEQ ID NO: 3381746 - DNA, 19 bp, Homo sapiens
gttcataacagtgccattg

SEQ ID NO: 3381747 - DNA, 14 bp, Homo sapiens
gttcatacatttga

SEQ ID NO: 3381748 - DNA, 17 bp, Homo sapiens
gttcatacctaagtact

SEQ ID NO: 3381749 - DNA, 20 bp, Homo sapiens
gttcatacctaagtactgta

SEQ ID NO: 3381750 - DNA, 20 bp, Homo sapiens
gttcatagggtctcttcagg

SEQ ID NO: 3381751 - DNA, 12 bp, Homo sapiens
gttcatatatac

SEQ ID NO: 3381752 - DNA, 14 bp, Homo sapiens
gttcatatatacat

SEQ ID NO: 3381753 - DNA, 16 bp, Homo sapiens
gttcatcagtgttaaa

SEQ ID NO: 3381754 - DNA, 21 bp, Homo sapiens
gttcatcagtgttaaaaaatt

SEQ ID NO: 3381755 - DNA, 21 bp, Homo sapiens
gttcatccaatcctcactggg

SEQ ID NO: 3381756 - DNA, 21 bp, Homo sapiens
gttcatcctcattgcctcctg

SEQ ID NO: 3381757 - DNA, 15 bp, Homo sapiens
gttcatctgtccatg

SEQ ID NO: 3381758 - DNA, 21 bp, Homo sapiens
gttcatctgtccatggccttt

SEQ ID NO: 3381759 - DNA, 24 bp, Homo sapiens
gttcatctgtccatggcctttcta

SEQ ID NO: 3381760 - DNA, 16 bp, Homo sapiens
gttcatgcagctgtgg

SEQ ID NO: 3381761 - DNA, 14 bp, Homo sapiens
gttcatgtttgctt

SEQ ID NO: 3381762 - DNA, 15 bp, Homo sapiens
gttcatgtttgtaaa

SEQ ID NO: 3381763 - DNA, 18 bp, Homo sapiens
gttcattgcaattaaact

SEQ ID NO: 3381764 - DNA, 19 bp, Homo sapiens
gttcattgtaatgttactg

SEQ ID NO: 3381765 - DNA, 15 bp, Homo sapiens
gttcatttagataat

SEQ ID NO: 3381766 - DNA, 12 bp, Homo sapiens
gttcattttagt

SEQ ID NO: 3381767 - DNA, 18 bp, Homo sapiens
gttcattttagtgactgt

SEQ ID NO: 3381768 - DNA, 15 bp, Homo sapiens
gttccaagacattgt

SEQ ID NO: 3381769 - DNA, 14 bp, Homo sapiens
gttccaagagtcta

SEQ ID NO: 3381770 - DNA, 18 bp, Homo sapiens
gttccaagagtctaaaga

SEQ ID NO: 3381771 - DNA, 20 bp, Homo sapiens
gttccaagagtctaaagatg

SEQ ID NO: 3381772 - DNA, 16 bp, Homo sapiens
gttccaagtttccaaa

SEQ ID NO: 3381773 - DNA, 23 bp, Homo sapiens
gttccaatcctggctctgtggct

SEQ ID NO: 3381774 - DNA, 20 bp, Homo sapiens
gttccacacccaatgctgct

SEQ ID NO: 3381775 - DNA, 18 bp, Homo sapiens
gttccacagttgccacca

SEQ ID NO: 3381776 - DNA, 20 bp, Homo sapiens
gttccacctggggcttccct

SEQ ID NO: 3381777 - DNA, 19 bp, Homo sapiens
gttccagattcctatgatg

SEQ ID NO: 3381778 - DNA, 20 bp, Homo sapiens
gttccagcagcagaatggaa

SEQ ID NO: 3381779 - DNA, 12 bp, Homo sapiens
gttccagctctt

SEQ ID NO: 3381780 - DNA, 22 bp, Homo sapiens
gttccatctcctataatctgtc

SEQ ID NO: 3381781 - DNA, 23 bp, Homo sapiens
gttccatctcctataatctgtca

SEQ ID NO: 3381782 - DNA, 12 bp, Homo sapiens
gttccatgcagc

SEQ ID NO: 3381783 - DNA, 14 bp, Homo sapiens
gttccatgcctgag

SEQ ID NO: 3381784 - DNA, 17 bp, Homo sapiens
gttccatgcctgagggt

SEQ ID NO: 3381785 - DNA, 21 bp, Homo sapiens
gttccattgcctcttttcaca

SEQ ID NO: 3381786 - DNA, 18 bp, Homo sapiens
gttccattttatgcagaa

SEQ ID NO: 3381787 - DNA, 18 bp, Homo sapiens
gttccatttttcctctgt

SEQ ID NO: 3381788 - DNA, 23 bp, Homo sapiens
gttccatttttcctctgttcaca

SEQ ID NO: 3381789 - DNA, 23 bp, Homo sapiens
gttcccaaggacttccacatttt

SEQ ID NO: 3381790 - DNA, 15 bp, Homo sapiens
gttcccactgccctg

SEQ ID NO: 3381791 - DNA, 21 bp, Homo sapiens
gttcccagctccccccgccca

SEQ ID NO: 3381792 - DNA, 14 bp, Homo sapiens
gttcccaggctgcc

SEQ ID NO: 3381793 - DNA, 14 bp, Homo sapiens
aaaacgcatggagt

SEQ ID NO: 3381794 - DNA, 18 bp, Homo sapiens
aaaacgcatggagtgtgt

SEQ ID NO: 3381795 - DNA, 19 bp, Homo sapiens
aaaacgctgtcaaaagttg

SEQ ID NO: 3381796 - DNA, 16 bp, Homo sapiens
aaaacgttttattgtg

SEQ ID NO: 3381797 - DNA, 23 bp, Homo sapiens
aaaacgttttgtttgaaaaagca

SEQ ID NO: 3381798 - DNA, 17 bp, Homo sapiens
aaaactaaaatcattgt

SEQ ID NO: 3381799 - DNA, 19 bp, Homo sapiens
aaaactaaatctctaatat

SEQ ID NO: 3381800 - DNA, 13 bp, Homo sapiens
aaaactaatgtga

SEQ ID NO: 3381801 - DNA, 20 bp, Homo sapiens
aaaactatgtattaatttag

SEQ ID NO: 3381802 - DNA, 21 bp, Homo sapiens
aaaactatgtattaatttaga

SEQ ID NO: 3381803 - DNA, 14 bp, Homo sapiens
aaaactcactgtga

SEQ ID NO: 3381804 - DNA, 14 bp, Homo sapiens
aaaactcagaatat

SEQ ID NO: 3381805 - DNA, 16 bp, Homo sapiens
aaaactccaccttccc

SEQ ID NO: 3381806 - DNA, 19 bp, Homo sapiens
aaaactccgcccccagcct

SEQ ID NO: 3381807 - DNA, 14 bp, Homo sapiens
aaaactcgaaaata

SEQ ID NO: 3381808 - DNA, 15 bp, Homo sapiens
aaaactctacttaat

SEQ ID NO: 3381809 - DNA, 17 bp, Homo sapiens
aaaactctagcagttgt

SEQ ID NO: 3381810 - DNA, 22 bp, Homo sapiens
aaaactctccttttccttacca

SEQ ID NO: 3381811 - DNA, 16 bp, Homo sapiens
aaaactcttaatctgt

SEQ ID NO: 3381812 - DNA, 15 bp, Homo sapiens
aaaactcttcagtgc

SEQ ID NO: 3381813 - DNA, 13 bp, Homo sapiens
aaaactggcctga

SEQ ID NO: 3381814 - DNA, 12 bp, Homo sapiens
aaaactgggata

SEQ ID NO: 3381815 - DNA, 16 bp, Homo sapiens
aaaactgggataactg

SEQ ID NO: 3381816 - DNA, 19 bp, Homo sapiens
aaaactgggataactgatt

SEQ ID NO: 3381817 - DNA, 21 bp, Homo sapiens
aaaactgggataactgatttc

SEQ ID NO: 3381818 - DNA, 23 bp, Homo sapiens
aaaactgggataactgatttcta

SEQ ID NO: 3381819 - DNA, 21 bp, Homo sapiens
aaaactgtaaataaaatgtgt

SEQ ID NO: 3381820 - DNA, 22 bp, Homo sapiens
aaaactgtaaataaaatgtgta

SEQ ID NO: 3381821 - DNA, 20 bp, Homo sapiens
aaaactgtacatttaaaatt

SEQ ID NO: 3381822 - DNA, 15 bp, Homo sapiens
aaaactgttcttttg

SEQ ID NO: 3381823 - DNA, 16 bp, Homo sapiens
aaaactgttcttttgc

SEQ ID NO: 3381824 - DNA, 21 bp, Homo sapiens
aaaacttatgctgatttattt

SEQ ID NO: 3381825 - DNA, 18 bp, Homo sapiens
aaaacttcttgtcagaca

SEQ ID NO: 3381826 - DNA, 24 bp, Homo sapiens
aaaacttcttgtcagacataaagc

SEQ ID NO: 3381827 - DNA, 22 bp, Homo sapiens
aaaacttgatgtgttatctctt

SEQ ID NO: 3381828 - DNA, 14 bp, Homo sapiens
aaaacttggcactt

SEQ ID NO: 3381829 - DNA, 21 bp, Homo sapiens
aaaactttattgggtttttat

SEQ ID NO: 3381830 - DNA, 20 bp, Homo sapiens
aaaagaaaaccattttagtt

SEQ ID NO: 3381831 - DNA, 22 bp, Homo sapiens
aaaagaaaatgaaaaacaacca

SEQ ID NO: 3381832 - DNA, 12 bp, Homo sapiens
aaaagaaaattt

SEQ ID NO: 3381833 - DNA, 10 bp, Homo sapiens
aaaagaaagc

SEQ ID NO: 3381834 - DNA, 17 bp, Homo sapiens
aaaagaaatagaaaagg

SEQ ID NO: 3381835 - DNA, 12 bp, Homo sapiens
aaaagaaatctt

SEQ ID NO: 3381836 - DNA, 15 bp, Homo sapiens
aaaagaaatgactaa

SEQ ID NO: 3381837 - DNA, 15 bp, Homo sapiens
aaaagaagactggaa

SEQ ID NO: 3381838 - DNA, 19 bp, Homo sapiens
aaaagaagcactttgattg

SEQ ID NO: 3381839 - DNA, 12 bp, Homo sapiens
aaaagaagttac

SEQ ID NO: 3381840 - DNA, 16 bp, Homo sapiens
aaaagaagttactttg

SEQ ID NO: 3381841 - DNA, 17 bp, Homo sapiens
aaaagaagttactttgt

SEQ ID NO: 3381842 - DNA, 11 bp, Homo sapiens
aaaagaatgac

SEQ ID NO: 3381843 - DNA, 23 bp, Homo sapiens
aaaagaatgacgtttacatataa

SEQ ID NO: 3381844 - DNA, 18 bp, Homo sapiens
aaaagacatgttgtaaat

SEQ ID NO: 3381845 - DNA, 13 bp, Homo sapiens
aaaagacattttt

SEQ ID NO: 3381846 - DNA, 16 bp, Homo sapiens
aaaagactcagtgttc

SEQ ID NO: 3381847 - DNA, 17 bp, Homo sapiens
aaaagactgaacatgtt

SEQ ID NO: 3381848 - DNA, 23 bp, Homo sapiens
aaaagagaattagattatattgg

SEQ ID NO: 3381849 - DNA, 15 bp, Homo sapiens
aaaagaggagcactt

SEQ ID NO: 3381850 - DNA, 15 bp, Homo sapiens
aaaagagtcttccaa

SEQ ID NO: 3381851 - DNA, 12 bp, Homo sapiens
aaaagataaaga

SEQ ID NO: 3381852 - DNA, 14 bp, Homo sapiens
aaaagataaagatg

SEQ ID NO: 3381853 - DNA, 17 bp, Homo sapiens
aaaagataaagatgatc

SEQ ID NO: 3381854 - DNA, 12 bp, Homo sapiens
aaaagataagaa

SEQ ID NO: 3381855 - DNA, 15 bp, Homo sapiens
aaaagatatatatat

SEQ ID NO: 3381856 - DNA, 14 bp, Homo sapiens
aaaagatgtatcct

SEQ ID NO: 3381857 - DNA, 20 bp, Homo sapiens
aaaagcaaaaaaaaaaaagg

SEQ ID NO: 3381858 - DNA, 19 bp, Homo sapiens
aaaagcaaaaatgacaaca

SEQ ID NO: 3381859 - DNA, 14 bp, Homo sapiens
aaaagcaagactgt

SEQ ID NO: 3381860 - DNA, 18 bp, Homo sapiens
aaaagcaagggagaaaag

SEQ ID NO: 3381861 - DNA, 14 bp, Homo sapiens
aaaagcacaagaag

SEQ ID NO: 3381862 - DNA, 17 bp, Homo sapiens
aaaagcacaagtacttt

SEQ ID NO: 3381863 - DNA, 16 bp, Homo sapiens
aaaagcacaatcacta

SEQ ID NO: 3381864 - DNA, 20 bp, Homo sapiens
aaaagcacaatcactaaact

SEQ ID NO: 3381865 - DNA, 19 bp, Homo sapiens
aaaagcacatacattaaaa

SEQ ID NO: 3381866 - DNA, 18 bp, Homo sapiens
aaaagcagtcccattcat

SEQ ID NO: 3381867 - DNA, 20 bp, Homo sapiens
aaaagcatgatgggaaaata

SEQ ID NO: 3381868 - DNA, 11 bp, Homo sapiens
aaaagccaagc

SEQ ID NO: 3381869 - DNA, 17 bp, Homo sapiens
aaaagccactagactct

SEQ ID NO: 3381870 - DNA, 15 bp, Homo sapiens
aaaagccttattcta

SEQ ID NO: 3381871 - DNA, 13 bp, Homo sapiens
aaaagccttgtgt

SEQ ID NO: 3381872 - DNA, 23 bp, Homo sapiens
aaaagccttgtgtatatttgtat

SEQ ID NO: 3381873 - DNA, 18 bp, Homo sapiens
aaaagcgtctttaagaga

SEQ ID NO: 3381874 - DNA, 19 bp, Homo sapiens
aaaagcgtctttaagagac

SEQ ID NO: 3381875 - DNA, 20 bp, Homo sapiens
aaaagcgtctttaagagact

SEQ ID NO: 3381876 - DNA, 22 bp, Homo sapiens
aaaagcgtctttaagagactca

SEQ ID NO: 3381877 - DNA, 15 bp, Homo sapiens
aaaagctattagcca

SEQ ID NO: 3381878 - DNA, 21 bp, Homo sapiens
aaaagctattagccaggatca

SEQ ID NO: 3381879 - DNA, 17 bp, Homo sapiens
aaaagctcactgctgat

SEQ ID NO: 3381880 - DNA, 12 bp, Homo sapiens
aaaagctcctgt

SEQ ID NO: 3381881 - DNA, 23 bp, Homo sapiens
aaaagctgatcataagtgaattt

SEQ ID NO: 3381882 - DNA, 17 bp, Homo sapiens
aaaagctgtaagaaaat

SEQ ID NO: 3381883 - DNA, 14 bp, Homo sapiens
aaaagcttcaaatt

SEQ ID NO: 3381884 - DNA, 16 bp, Homo sapiens
aaaagcttcttaatta

SEQ ID NO: 3381885 - DNA, 11 bp, Homo sapiens
aaaaggaaagc

SEQ ID NO: 3381886 - DNA, 13 bp, Homo sapiens
aaaaggaaatttg

SEQ ID NO: 3381887 - DNA, 15 bp, Homo sapiens
aaaaggaaatttgtt

SEQ ID NO: 3381888 - DNA, 17 bp, Homo sapiens
aaaaggaaatttgtttg

SEQ ID NO: 3381889 - DNA, 20 bp, Homo sapiens
aaaaggaaatttgtttgtat

SEQ ID NO: 3381890 - DNA, 15 bp, Homo sapiens
aaaaggaacaaaaat

SEQ ID NO: 3381891 - DNA, 14 bp, Homo sapiens
aaaaggaagactag

SEQ ID NO: 3381892 - DNA, 16 bp, Homo sapiens
aaaaggacacctttta

SEQ ID NO: 3381893 - DNA, 18 bp, Homo sapiens
aaaaggacttcaggaaca

SEQ ID NO: 3381894 - DNA, 22 bp, Homo sapiens
aaaaggagccaatttaaagaaa

SEQ ID NO: 3381895 - DNA, 13 bp, Homo sapiens
aaaaggaggaaat

SEQ ID NO: 3381896 - DNA, 15 bp, Homo sapiens
aaaaggatagtattt

SEQ ID NO: 3381897 - DNA, 16 bp, Homo sapiens
aaaaggcaaatgtgta

SEQ ID NO: 3381898 - DNA, 21 bp, Homo sapiens
aaaaggcctcttgtaaagact

SEQ ID NO: 3381899 - DNA, 22 bp, Homo sapiens
aaaaggcctcttgtaaagactg

SEQ ID NO: 3381900 - DNA, 15 bp, Homo sapiens
aaaaggctgagaagg

SEQ ID NO: 3381901 - DNA, 14 bp, Homo sapiens
aaaaggcttgaagc

SEQ ID NO: 3381902 - DNA, 19 bp, Homo sapiens
aaaagggagtttaaaaatg

SEQ ID NO: 3381903 - DNA, 23 bp, Homo sapiens
aaaaggggggggcaatctctctc

SEQ ID NO: 3381904 - DNA, 19 bp, Homo sapiens
aaaaggtagagtcttacaa

SEQ ID NO: 3381905 - DNA, 14 bp, Homo sapiens
aaaaggtattatac

SEQ ID NO: 3381906 - DNA, 20 bp, Homo sapiens
aaaaggttcttcatcccttt

SEQ ID NO: 3381907 - DNA, 12 bp, Homo sapiens
aaaagtaaaatg

SEQ ID NO: 3381908 - DNA, 11 bp, Homo sapiens
aaaagtaaaca

SEQ ID NO: 3381909 - DNA, 12 bp, Homo sapiens
aaaagtaacttg

SEQ ID NO: 3381910 - DNA, 22 bp, Homo sapiens
aaaagtaagtaccactcaggcc

SEQ ID NO: 3381911 - DNA, 20 bp, Homo sapiens
aaaagtacaatgaactgctt

SEQ ID NO: 3381912 - DNA, 13 bp, Homo sapiens
aaaagtacattta

SEQ ID NO: 3381913 - DNA, 17 bp, Homo sapiens
aaaagtaccagcatgtt

SEQ ID NO: 3381914 - DNA, 13 bp, Homo sapiens
aaaagtatatgtt

SEQ ID NO: 3381915 - DNA, 22 bp, Homo sapiens
aaaagtatattaaacaaagttt

SEQ ID NO: 3381916 - DNA, 18 bp, Homo sapiens
aaaagtatcactctaaaa

SEQ ID NO: 3381917 - DNA, 23 bp, Homo sapiens
aaaagtcaccaaatagtgtgaaa

SEQ ID NO: 3381918 - DNA, 22 bp, Homo sapiens
aaaagtcgttttccaaactgac

SEQ ID NO: 3381919 - DNA, 23 bp, Homo sapiens
aaaagtcgttttccaaactgact

SEQ ID NO: 3381920 - DNA, 21 bp, Homo sapiens
aaagcattttcagtcttgtag

SEQ ID NO: 3381921 - DNA, 19 bp, Homo sapiens
aaagccaaacaaaactgaa

SEQ ID NO: 3381922 - DNA, 23 bp, Homo sapiens
aaagccaagcaaaccaatggtga

SEQ ID NO: 3381923 - DNA, 17 bp, Homo sapiens
aaagccacattatttct

SEQ ID NO: 3381924 - DNA, 12 bp, Homo sapiens
aaagccacctct

SEQ ID NO: 3381925 - DNA, 19 bp, Homo sapiens
aaagccacctctgtcattt

SEQ ID NO: 3381926 - DNA, 20 bp, Homo sapiens
aaagccacctctgtcatttg

SEQ ID NO: 3381927 - DNA, 22 bp, Homo sapiens
aaagccagggtctctccctcag

SEQ ID NO: 3381928 - DNA, 13 bp, Homo sapiens
aaagccagtgaaa

SEQ ID NO: 3381929 - DNA, 19 bp, Homo sapiens
aaagccagtgaaatgtgaa

SEQ ID NO: 3381930 - DNA, 17 bp, Homo sapiens
aaagccattctgattat

SEQ ID NO: 3381931 - DNA, 16 bp, Homo sapiens
aaagcccaacctcctg

SEQ ID NO: 3381932 - DNA, 11 bp, Homo sapiens
aaagcccagac

SEQ ID NO: 3381933 - DNA, 17 bp, Homo sapiens
aaagcccagactttagt

SEQ ID NO: 3381934 - DNA, 23 bp, Homo sapiens
aaagcccattttcaactgctttg

SEQ ID NO: 3381935 - DNA, 17 bp, Homo sapiens
aaagccctcccccttcc

SEQ ID NO: 3381936 - DNA, 17 bp, Homo sapiens
aaagccgaaagggttaa

SEQ ID NO: 3381937 - DNA, 20 bp, Homo sapiens
aaagcctcaaggttttaggt

SEQ ID NO: 3381938 - DNA, 13 bp, Homo sapiens
aaagcctcagtga

SEQ ID NO: 3381939 - DNA, 14 bp, Homo sapiens
aaagcctcttcaaa

SEQ ID NO: 3381940 - DNA, 13 bp, Homo sapiens
aaagcctgcaatt

SEQ ID NO: 3381941 - DNA, 18 bp, Homo sapiens
aaagcctgcaatttcata

SEQ ID NO: 3381942 - DNA, 12 bp, Homo sapiens
aaagcctgctca

SEQ ID NO: 3381943 - DNA, 17 bp, Homo sapiens
aaagcctgggtgacatt

SEQ ID NO: 3381944 - DNA, 20 bp, Homo sapiens
aaagcctgttcccctcactg

SEQ ID NO: 3381945 - DNA, 14 bp, Homo sapiens
aaagccttaaaaat

SEQ ID NO: 3381946 - DNA, 18 bp, Homo sapiens
aaagccttaaaatgcatt

SEQ ID NO: 3381947 - DNA, 12 bp, Homo sapiens
aaagccttgtgt

SEQ ID NO: 3381948 - DNA, 18 bp, Homo sapiens
aaagccttttaaatcatc

SEQ ID NO: 3381949 - DNA, 18 bp, Homo sapiens
aaagcgctgcagtagctg

SEQ ID NO: 3381950 - DNA, 18 bp, Homo sapiens
aaagcggggggagggttg

SEQ ID NO: 3381951 - DNA, 14 bp, Homo sapiens
aaagcggtccctgt

SEQ ID NO: 3381952 - DNA, 17 bp, Homo sapiens
aaagcgtttctttactt

SEQ ID NO: 3381953 - DNA, 17 bp, Homo sapiens
aaagctaggcctggcca

SEQ ID NO: 3381954 - DNA, 20 bp, Homo sapiens
aaagctagtgtacctcctct

SEQ ID NO: 3381955 - DNA, 23 bp, Homo sapiens
aaagctagtgtacctcctctcag

SEQ ID NO: 3381956 - DNA, 15 bp, Homo sapiens
aaagctattagccag

SEQ ID NO: 3381957 - DNA, 17 bp, Homo sapiens
aaagctattagccagga

SEQ ID NO: 3381958 - DNA, 23 bp, Homo sapiens
aaagctattagccaggatcatgg

SEQ ID NO: 3381959 - DNA, 13 bp, Homo sapiens
aaagctcctgtcc

SEQ ID NO: 3381960 - DNA, 17 bp, Homo sapiens
aaagctgagaactcctg

SEQ ID NO: 3381961 - DNA, 20 bp, Homo sapiens
aaagctgagaactcctgact

SEQ ID NO: 3381962 - DNA, 23 bp, Homo sapiens
aaagctgatgatgtctcttgtag

SEQ ID NO: 3381963 - DNA, 14 bp, Homo sapiens
aaagctgatttttt

SEQ ID NO: 3381964 - DNA, 17 bp, Homo sapiens
aaagctgcatttaaatc

SEQ ID NO: 3381965 - DNA, 19 bp, Homo sapiens
aaagctgcatttaaatcaa

SEQ ID NO: 3381966 - DNA, 17 bp, Homo sapiens
aaagctgccatttccct

SEQ ID NO: 3381967 - DNA, 24 bp, Homo sapiens
aaagctgcccactgtttctcttga

SEQ ID NO: 3381968 - DNA, 16 bp, Homo sapiens
aaagctgcctgtagtt

SEQ ID NO: 3381969 - DNA, 23 bp, Homo sapiens
aaagctgcctgtagttaggaaat

SEQ ID NO: 3381970 - DNA, 15 bp, Homo sapiens
aaagctgctaaatct

SEQ ID NO: 3381971 - DNA, 20 bp, Homo sapiens
aaagctggccctgcctcctg

SEQ ID NO: 3381972 - DNA, 19 bp, Homo sapiens
aaagctgtaagaaaatgct

SEQ ID NO: 3381973 - DNA, 14 bp, Homo sapiens
aaagctgtgtttat

SEQ ID NO: 3381974 - DNA, 16 bp, Homo sapiens
aaagctgttaaactgt

SEQ ID NO: 3381975 - DNA, 19 bp, Homo sapiens
aaagcttaaattgcttttg

SEQ ID NO: 3381976 - DNA, 17 bp, Homo sapiens
aaagcttccatgattct

SEQ ID NO: 3381977 - DNA, 18 bp, Homo sapiens
aaagcttccatgattcta

SEQ ID NO: 3381978 - DNA, 19 bp, Homo sapiens
aaagcttctatcccaggag

SEQ ID NO: 3381979 - DNA, 22 bp, Homo sapiens
aaagcttgaaaagattctgaaa

SEQ ID NO: 3381980 - DNA, 19 bp, Homo sapiens
aaagcttgcaacaaaattc

SEQ ID NO: 3381981 - DNA, 14 bp, Homo sapiens
aaagcttgtgaaaa

SEQ ID NO: 3381982 - DNA, 20 bp, Homo sapiens
aaagcttgtggccaatggaa

SEQ ID NO: 3381983 - DNA, 23 bp, Homo sapiens
aaagctttcctgccccaggcctg

SEQ ID NO: 3381984 - DNA, 14 bp, Homo sapiens
aaagctttgctaca

SEQ ID NO: 3381985 - DNA, 18 bp, Homo sapiens
aaagctttgctacaaatt

SEQ ID NO: 3381986 - DNA, 24 bp, Homo sapiens
aaagctttgctacaaatttatgca

SEQ ID NO: 3381987 - DNA, 19 bp, Homo sapiens
aaagctttttattcctcct

SEQ ID NO: 3381988 - DNA, 17 bp, Homo sapiens
aaagctttttcctcctg

SEQ ID NO: 3381989 - DNA, 13 bp, Homo sapiens
aaaggaaaagaag

SEQ ID NO: 3381990 - DNA, 16 bp, Homo sapiens
aaaggaaaagttaaac

SEQ ID NO: 3381991 - DNA, 14 bp, Homo sapiens
aaaggaaaccaagt

SEQ ID NO: 3381992 - DNA, 20 bp, Homo sapiens
aaaggaaagtcaagaagaat

SEQ ID NO: 3381993 - DNA, 17 bp, Homo sapiens
aaaggaaatctcacccc

SEQ ID NO: 3381994 - DNA, 22 bp, Homo sapiens
aaaggaacaaaaattacaaaga

SEQ ID NO: 3381995 - DNA, 17 bp, Homo sapiens
aaaggaagtgccccctc

SEQ ID NO: 3381996 - DNA, 22 bp, Homo sapiens
aaaggacaccttttaactcacc

SEQ ID NO: 3381997 - DNA, 19 bp, Homo sapiens
aaaggacagagtatgaaca

SEQ ID NO: 3381998 - DNA, 14 bp, Homo sapiens
aaaggacaggagga

SEQ ID NO: 3381999 - DNA, 20 bp, Homo sapiens
aaaggagaaaaaaaaccttg

SEQ ID NO: 3382000 - DNA, 20 bp, Homo sapiens
aaaggagaattgaattctgg

SEQ ID NO: 3382001 - DNA, 19 bp, Homo sapiens
aaaggagacaagttccatg

SEQ ID NO: 3382002 - DNA, 14 bp, Homo sapiens
aaaggaggctggca

SEQ ID NO: 3382003 - DNA, 12 bp, Homo sapiens
aaaggagggaga

SEQ ID NO: 3382004 - DNA, 16 bp, Homo sapiens
aaaggagtcaaaacta

SEQ ID NO: 3382005 - DNA, 18 bp, Homo sapiens
aaaggataactctgtatt

SEQ ID NO: 3382006 - DNA, 21 bp, Homo sapiens
aaaggatagtaagcatagaaa

SEQ ID NO: 3382007 - DNA, 13 bp, Homo sapiens
aaaggatatttaa

SEQ ID NO: 3382008 - DNA, 23 bp, Homo sapiens
aaaggatgtgatatataagtgta

SEQ ID NO: 3382009 - DNA, 19 bp, Homo sapiens
aaaggattttaccaaagca

SEQ ID NO: 3382010 - DNA, 17 bp, Homo sapiens
aaaggcaccatctaata

SEQ ID NO: 3382011 - DNA, 18 bp, Homo sapiens
aaaggcagagaagttctc

SEQ ID NO: 3382012 - DNA, 13 bp, Homo sapiens
aaaggcagctgcc

SEQ ID NO: 3382013 - DNA, 18 bp, Homo sapiens
aaaggcagctgcctctgc

SEQ ID NO: 3382014 - DNA, 23 bp, Homo sapiens
aaaggcagctgcctctgctccct

SEQ ID NO: 3382015 - DNA, 16 bp, Homo sapiens
aaaggcagttttctaa

SEQ ID NO: 3382016 - DNA, 15 bp, Homo sapiens
aaaggcattagagtc

SEQ ID NO: 3382017 - DNA, 15 bp, Homo sapiens
aaaggccaaactgct

SEQ ID NO: 3382018 - DNA, 16 bp, Homo sapiens
aaaggccaaagataaa

SEQ ID NO: 3382019 - DNA, 13 bp, Homo sapiens
aaaggcccagccc

SEQ ID NO: 3382020 - DNA, 14 bp, Homo sapiens
aaaggcccagcccc

SEQ ID NO: 3382021 - DNA, 12 bp, Homo sapiens
aaaggcctggaa

SEQ ID NO: 3382022 - DNA, 17 bp, Homo sapiens
aaaggcttgaagctgtg

SEQ ID NO: 3382023 - DNA, 14 bp, Homo sapiens
aaagggaaactatt

SEQ ID NO: 3382024 - DNA, 15 bp, Homo sapiens
aaagggaagaaagga

SEQ ID NO: 3382025 - DNA, 22 bp, Homo sapiens
aaagggacagcatgccccttgg

SEQ ID NO: 3382026 - DNA, 21 bp, Homo sapiens
aaagggagaaggaagggcaga

SEQ ID NO: 3382027 - DNA, 15 bp, Homo sapiens
aaagggagtttaaaa

SEQ ID NO: 3382028 - DNA, 19 bp, Homo sapiens
aaagggcacttaatttgta

SEQ ID NO: 3382029 - DNA, 13 bp, Homo sapiens
aaagggcagggcc

SEQ ID NO: 3382030 - DNA, 19 bp, Homo sapiens
aaagggcccaatgaattat

SEQ ID NO: 3382031 - DNA, 15 bp, Homo sapiens
aaaggggacaggcct

SEQ ID NO: 3382032 - DNA, 17 bp, Homo sapiens
aaaggggagaaactgaa

SEQ ID NO: 3382033 - DNA, 23 bp, Homo sapiens
aaaggggagaaactgaaagtgtt

SEQ ID NO: 3382034 - DNA, 18 bp, Homo sapiens
aaaggggggagggggagg

SEQ ID NO: 3382035 - DNA, 23 bp, Homo sapiens
aaaggggggggcaatctctctct

SEQ ID NO: 3382036 - DNA, 21 bp, Homo sapiens
aaagggggtcccagtgggagg

SEQ ID NO: 3382037 - DNA, 23 bp, Homo sapiens
aaaggggtcggctgaccatgctc

SEQ ID NO: 3382038 - DNA, 10 bp, Homo sapiens
aaagggtgaa

SEQ ID NO: 3382039 - DNA, 21 bp, Homo sapiens
aaagggtgaagctatttatct

SEQ ID NO: 3382040 - DNA, 17 bp, Homo sapiens
aaagggtgtaggggcca

SEQ ID NO: 3382041 - DNA, 14 bp, Homo sapiens
aaagggttaatcat

SEQ ID NO: 3382042 - DNA, 22 bp, Homo sapiens
aaagggttaatcatatttgaaa

SEQ ID NO: 3382043 - DNA, 16 bp, Homo sapiens
aaaggtataattttat

SEQ ID NO: 3382044 - DNA, 19 bp, Homo sapiens
aaaggtccacaggtctaga

SEQ ID NO: 3382045 - DNA, 17 bp, Homo sapiens
aaatgcaaccagaattg

SEQ ID NO: 3382046 - DNA, 18 bp, Homo sapiens
aaatgcaatctcttttct

SEQ ID NO: 3382047 - DNA, 22 bp, Homo sapiens
aaatgcaccctccctcctgccg

SEQ ID NO: 3382048 - DNA, 15 bp, Homo sapiens
aaatgcagaaccaca

SEQ ID NO: 3382049 - DNA, 14 bp, Homo sapiens
aaatgcataaaata

SEQ ID NO: 3382050 - DNA, 19 bp, Homo sapiens
aaatgcatatcctgagcca

SEQ ID NO: 3382051 - DNA, 14 bp, Homo sapiens
aaatgcatgatttt

SEQ ID NO: 3382052 - DNA, 20 bp, Homo sapiens
aaatgcattataggatcatt

SEQ ID NO: 3382053 - DNA, 16 bp, Homo sapiens
aaatgcattgaaagaa

SEQ ID NO: 3382054 - DNA, 20 bp, Homo sapiens
aaatgccatttagcaataaa

SEQ ID NO: 3382055 - DNA, 19 bp, Homo sapiens
aaatgccctcctaaatgtc

SEQ ID NO: 3382056 - DNA, 14 bp, Homo sapiens
aaatgcctcttaaa

SEQ ID NO: 3382057 - DNA, 17 bp, Homo sapiens
aaatgccttagaaatgt

SEQ ID NO: 3382058 - DNA, 19 bp, Homo sapiens
aaatgcctttgagacagtt

SEQ ID NO: 3382059 - DNA, 16 bp, Homo sapiens
aaatgcggtctggtct

SEQ ID NO: 3382060 - DNA, 22 bp, Homo sapiens
aaatgcggttataaaaaatggt

SEQ ID NO: 3382061 - DNA, 23 bp, Homo sapiens
aaatgcggttataaaaaatggtt

SEQ ID NO: 3382062 - DNA, 20 bp, Homo sapiens
aaatgctaggttaattccaa

SEQ ID NO: 3382063 - DNA, 21 bp, Homo sapiens
aaatgctattgttgtgggctt

SEQ ID NO: 3382064 - DNA, 17 bp, Homo sapiens
aaatgctctgtcttcaa

SEQ ID NO: 3382065 - DNA, 13 bp, Homo sapiens
aaatgctgctctc

SEQ ID NO: 3382066 - DNA, 16 bp, Homo sapiens
aaatgctgcttctcct

SEQ ID NO: 3382067 - DNA, 20 bp, Homo sapiens
aaatgctgcttctcctccca

SEQ ID NO: 3382068 - DNA, 19 bp, Homo sapiens
aaatgcttcatttgtatgt

SEQ ID NO: 3382069 - DNA, 17 bp, Homo sapiens
aaatgcttgacaaatat

SEQ ID NO: 3382070 - DNA, 13 bp, Homo sapiens
aaatgcttttaaa

SEQ ID NO: 3382071 - DNA, 21 bp, Homo sapiens
aaatggaaagcagagttttca

SEQ ID NO: 3382072 - DNA, 16 bp, Homo sapiens
aaatggaattattttg

SEQ ID NO: 3382073 - DNA, 19 bp, Homo sapiens
aaatggaggcttttcactg

SEQ ID NO: 3382074 - DNA, 15 bp, Homo sapiens
aaatggatactacat

SEQ ID NO: 3382075 - DNA, 21 bp, Homo sapiens
aaatggatactacatctttaa

SEQ ID NO: 3382076 - DNA, 17 bp, Homo sapiens
aaatggatgcaaagtac

SEQ ID NO: 3382077 - DNA, 18 bp, Homo sapiens
aaatggcatcaaccacca

SEQ ID NO: 3382078 - DNA, 23 bp, Homo sapiens
aaatggccatttgctttttcacc

SEQ ID NO: 3382079 - DNA, 21 bp, Homo sapiens
aaatggctaataaactgtatt

SEQ ID NO: 3382080 - DNA, 17 bp, Homo sapiens
aaatggctggtttttag

SEQ ID NO: 3382081 - DNA, 19 bp, Homo sapiens
aaatggctgtaatcatttg

SEQ ID NO: 3382082 - DNA, 23 bp, Homo sapiens
aaatggcttcggacaaaatatct

SEQ ID NO: 3382083 - DNA, 19 bp, Homo sapiens
aaatgggaaaaataaaaga

SEQ ID NO: 3382084 - DNA, 16 bp, Homo sapiens
aaatgggacttaactc

SEQ ID NO: 3382085 - DNA, 17 bp, Homo sapiens
aaatgggagacagcctc

SEQ ID NO: 3382086 - DNA, 20 bp, Homo sapiens
aaatgggtcttttataggaa

SEQ ID NO: 3382087 - DNA, 22 bp, Homo sapiens
aaatgggttggtgcttctaacc

SEQ ID NO: 3382088 - DNA, 19 bp, Homo sapiens
aaatggtaggcatttccta

SEQ ID NO: 3382089 - DNA, 18 bp, Homo sapiens
aaatggtcatggggatga

SEQ ID NO: 3382090 - DNA, 19 bp, Homo sapiens
aaatggtgctgcagatttg

SEQ ID NO: 3382091 - DNA, 14 bp, Homo sapiens
aaatggtgtacata

SEQ ID NO: 3382092 - DNA, 18 bp, Homo sapiens
aaatggttcttacttttc

SEQ ID NO: 3382093 - DNA, 20 bp, Homo sapiens
aaatggttgatggaaaataa

SEQ ID NO: 3382094 - DNA, 20 bp, Homo sapiens
aaatggtttggtgcttttta

SEQ ID NO: 3382095 - DNA, 19 bp, Homo sapiens
aaatggttttgttttgcac

SEQ ID NO: 3382096 - DNA, 19 bp, Homo sapiens
aaatgtaaaaataataatt

SEQ ID NO: 3382097 - DNA, 17 bp, Homo sapiens
aaatgtaaaagtactct

SEQ ID NO: 3382098 - DNA, 13 bp, Homo sapiens
aaatgtaaactgc

SEQ ID NO: 3382099 - DNA, 15 bp, Homo sapiens
aaatgtaaactgcca

SEQ ID NO: 3382100 - DNA, 14 bp, Homo sapiens
aaatgtaaaggagg

SEQ ID NO: 3382101 - DNA, 17 bp, Homo sapiens
aaatgtaaatattctat

SEQ ID NO: 3382102 - DNA, 22 bp, Homo sapiens
aaatgtaacatcataattacat

SEQ ID NO: 3382103 - DNA, 18 bp, Homo sapiens
aaatgtaactgtgccagt

SEQ ID NO: 3382104 - DNA, 23 bp, Homo sapiens
aaatgtaactgtgccagttcttt

SEQ ID NO: 3382105 - DNA, 22 bp, Homo sapiens
aaatgtaagattatagattcta

SEQ ID NO: 3382106 - DNA, 13 bp, Homo sapiens
aaatgtaagcaaa

SEQ ID NO: 3382107 - DNA, 18 bp, Homo sapiens
aaatgtaatttaaatgaa

SEQ ID NO: 3382108 - DNA, 18 bp, Homo sapiens
aaatgtaatttagaaact

SEQ ID NO: 3382109 - DNA, 20 bp, Homo sapiens
aaatgtaggcttagtttgtg

SEQ ID NO: 3382110 - DNA, 19 bp, Homo sapiens
aaatgtataaatatacagt

SEQ ID NO: 3382111 - DNA, 13 bp, Homo sapiens
aaatgtatataca

SEQ ID NO: 3382112 - DNA, 19 bp, Homo sapiens
aaatgtatatacacatata

SEQ ID NO: 3382113 - DNA, 13 bp, Homo sapiens
aaatgtatatatt

SEQ ID NO: 3382114 - DNA, 18 bp, Homo sapiens
aaatgtatatatttagtg

SEQ ID NO: 3382115 - DNA, 14 bp, Homo sapiens
aaatgtatcttatt

SEQ ID NO: 3382116 - DNA, 13 bp, Homo sapiens
aaatgtattaatg

SEQ ID NO: 3382117 - DNA, 17 bp, Homo sapiens
aaatgtattcaagcaaa

SEQ ID NO: 3382118 - DNA, 21 bp, Homo sapiens
aaatgtcccctcaaactcatt

SEQ ID NO: 3382119 - DNA, 22 bp, Homo sapiens
aaatgtcctccagaagcctctg

SEQ ID NO: 3382120 - DNA, 16 bp, Homo sapiens
aaatgtctattaaggt

SEQ ID NO: 3382121 - DNA, 16 bp, Homo sapiens
aaatgtcttatatagc

SEQ ID NO: 3382122 - DNA, 18 bp, Homo sapiens
aaatgtcttatatagcag

SEQ ID NO: 3382123 - DNA, 17 bp, Homo sapiens
aaatgtcttttagaaga

SEQ ID NO: 3382124 - DNA, 18 bp, Homo sapiens
aaatgtcttttagaagat

SEQ ID NO: 3382125 - DNA, 22 bp, Homo sapiens
aaatgtgaaaaaaattattcat

SEQ ID NO: 3382126 - DNA, 13 bp, Homo sapiens
aaatgtgaatttt

SEQ ID NO: 3382127 - DNA, 14 bp, Homo sapiens
aaatgtgaggaaga

SEQ ID NO: 3382128 - DNA, 16 bp, Homo sapiens
aaatgtgagtgttttt

SEQ ID NO: 3382129 - DNA, 18 bp, Homo sapiens
aaatgtgatgttctaagg

SEQ ID NO: 3382130 - DNA, 19 bp, Homo sapiens
aaatgtgatgttctaaggc

SEQ ID NO: 3382131 - DNA, 17 bp, Homo sapiens
aaatgtgatttttctga

SEQ ID NO: 3382132 - DNA, 16 bp, Homo sapiens
aaatgttagtatttta

SEQ ID NO: 3382133 - DNA, 23 bp, Homo sapiens
aaatgttagtattttaatcctgt

SEQ ID NO: 3382134 - DNA, 18 bp, Homo sapiens
aaatgttagtcattgtta

SEQ ID NO: 3382135 - DNA, 15 bp, Homo sapiens
aaatgttatttaaca

SEQ ID NO: 3382136 - DNA, 21 bp, Homo sapiens
aaatgttattttttaattatt

SEQ ID NO: 3382137 - DNA, 15 bp, Homo sapiens
aaatgttcagaaggt

SEQ ID NO: 3382138 - DNA, 21 bp, Homo sapiens
aaatgttcagaaggttgctct

SEQ ID NO: 3382139 - DNA, 15 bp, Homo sapiens
aaatgttctcaaata

SEQ ID NO: 3382140 - DNA, 15 bp, Homo sapiens
aaatgttctttgggg

SEQ ID NO: 3382141 - DNA, 22 bp, Homo sapiens
aaatgttgagaagcgtttttaa

SEQ ID NO: 3382142 - DNA, 18 bp, Homo sapiens
aaatgttggaatgttatg

SEQ ID NO: 3382143 - DNA, 17 bp, Homo sapiens
aaatgttggtcatttta

SEQ ID NO: 3382144 - DNA, 20 bp, Homo sapiens
aaatgtttacagggagcctc

SEQ ID NO: 3382145 - DNA, 21 bp, Homo sapiens
aaatgtttacagggagcctcc

SEQ ID NO: 3382146 - DNA, 15 bp, Homo sapiens
aaatgtttatactgt

SEQ ID NO: 3382147 - DNA, 10 bp, Homo sapiens
aaatgtttct

SEQ ID NO: 3382148 - DNA, 18 bp, Homo sapiens
aaatgtttcttttaaaga

SEQ ID NO: 3382149 - DNA, 14 bp, Homo sapiens
aaatgtttcttttg

SEQ ID NO: 3382150 - DNA, 16 bp, Homo sapiens
aaatgtttttctgcca

SEQ ID NO: 3382151 - DNA, 17 bp, Homo sapiens
aaattaaaaaaaaattg

SEQ ID NO: 3382152 - DNA, 13 bp, Homo sapiens
aaattaaaaagat

SEQ ID NO: 3382153 - DNA, 17 bp, Homo sapiens
aaattaaaaagattctt

SEQ ID NO: 3382154 - DNA, 20 bp, Homo sapiens
aaattaaaacatatttcatt

SEQ ID NO: 3382155 - DNA, 22 bp, Homo sapiens
aaattaaaacatatttcatttt

SEQ ID NO: 3382156 - DNA, 13 bp, Homo sapiens
aaattaaaacgaa

SEQ ID NO: 3382157 - DNA, 21 bp, Homo sapiens
aaattaaaacgaaaataaagt

SEQ ID NO: 3382158 - DNA, 13 bp, Homo sapiens
aaattaaatctgt

SEQ ID NO: 3382159 - DNA, 18 bp, Homo sapiens
aaattaaatgccttgtat

SEQ ID NO: 3382160 - DNA, 23 bp, Homo sapiens
aaattaaatgccttgtataaaat

SEQ ID NO: 3382161 - DNA, 19 bp, Homo sapiens
aaattaacacaaaggaagt

SEQ ID NO: 3382162 - DNA, 18 bp, Homo sapiens
aaattaacagtcctaact

SEQ ID NO: 3382163 - DNA, 13 bp, Homo sapiens
aaattaactgtat

SEQ ID NO: 3382164 - DNA, 16 bp, Homo sapiens
aaattaagcaaatgtt

SEQ ID NO: 3382165 - DNA, 14 bp, Homo sapiens
aaattaagtagaac

SEQ ID NO: 3382166 - DNA, 16 bp, Homo sapiens
aaattaatacttcatt

SEQ ID NO: 3382167 - DNA, 15 bp, Homo sapiens
aaattacaattttat

SEQ ID NO: 3382168 - DNA, 16 bp, Homo sapiens
aaattacaattttatc

SEQ ID NO: 3382169 - DNA, 16 bp, Homo sapiens
aaattacagatgtgaa

SEQ ID NO: 3382170 - DNA, 14 bp, Homo sapiens
aacatcaacatctt

SEQ ID NO: 3382171 - DNA, 18 bp, Homo sapiens
aacatcaatgttcattgt

SEQ ID NO: 3382172 - DNA, 19 bp, Homo sapiens
aacatcaatgttcattgta

SEQ ID NO: 3382173 - DNA, 11 bp, Homo sapiens
aacatccaaaa

SEQ ID NO: 3382174 - DNA, 17 bp, Homo sapiens
aacatccaaccttccca

SEQ ID NO: 3382175 - DNA, 22 bp, Homo sapiens
aacatccatgtcctatgtgtga

SEQ ID NO: 3382176 - DNA, 22 bp, Homo sapiens
aacatcccacttagccgcaccc

SEQ ID NO: 3382177 - DNA, 14 bp, Homo sapiens
aacatcgatatgta

SEQ ID NO: 3382178 - DNA, 16 bp, Homo sapiens
aacatcgatatgtata

SEQ ID NO: 3382179 - DNA, 20 bp, Homo sapiens
aacatctttgcgaaaagata

SEQ ID NO: 3382180 - DNA, 14 bp, Homo sapiens
aacatgaaatgccc

SEQ ID NO: 3382181 - DNA, 22 bp, Homo sapiens
aacatgaacacccttagaaaat

SEQ ID NO: 3382182 - DNA, 18 bp, Homo sapiens
aacatgaggggacatttt

SEQ ID NO: 3382183 - DNA, 14 bp, Homo sapiens
aacatgatgaaacc

SEQ ID NO: 3382184 - DNA, 14 bp, Homo sapiens
aacatgatttcaaa

SEQ ID NO: 3382185 - DNA, 16 bp, Homo sapiens
aacatgcactgatgtt

SEQ ID NO: 3382186 - DNA, 15 bp, Homo sapiens
aacatgcagtacttt

SEQ ID NO: 3382187 - DNA, 20 bp, Homo sapiens
aacatgcagttcattatttt

SEQ ID NO: 3382188 - DNA, 22 bp, Homo sapiens
aacatgcagttcattattttgt

SEQ ID NO: 3382189 - DNA, 22 bp, Homo sapiens
aacatgccccctgcagacacgt

SEQ ID NO: 3382190 - DNA, 18 bp, Homo sapiens
aacatggacttgtatatt

SEQ ID NO: 3382191 - DNA, 20 bp, Homo sapiens
aacatggacttgtatatttg

SEQ ID NO: 3382192 - DNA, 23 bp, Homo sapiens
aacatggtgaaaccccatctcta

SEQ ID NO: 3382193 - DNA, 13 bp, Homo sapiens
aacatgtgtttta

SEQ ID NO: 3382194 - DNA, 22 bp, Homo sapiens
aacatgttaatgacaatattcc

SEQ ID NO: 3382195 - DNA, 17 bp, Homo sapiens
aacatgttactgaccag

SEQ ID NO: 3382196 - DNA, 13 bp, Homo sapiens
aacatgttcctga

SEQ ID NO: 3382197 - DNA, 21 bp, Homo sapiens
aacatgtttacaggtttgaat

SEQ ID NO: 3382198 - DNA, 15 bp, Homo sapiens
aacatgtttcactta

SEQ ID NO: 3382199 - DNA, 15 bp, Homo sapiens
aacattaaaaatgga

SEQ ID NO: 3382200 - DNA, 19 bp, Homo sapiens
aacattaaaaatggaactg

SEQ ID NO: 3382201 - DNA, 21 bp, Homo sapiens
aacattaaaagaagactggaa

SEQ ID NO: 3382202 - DNA, 15 bp, Homo sapiens
aacattaaatgtctt

SEQ ID NO: 3382203 - DNA, 18 bp, Homo sapiens
aacattaattttgtgcat

SEQ ID NO: 3382204 - DNA, 17 bp, Homo sapiens
aacattacagttcataa

SEQ ID NO: 3382205 - DNA, 18 bp, Homo sapiens
aacattacagttcataat

SEQ ID NO: 3382206 - DNA, 16 bp, Homo sapiens
aacattaccttactgt

SEQ ID NO: 3382207 - DNA, 23 bp, Homo sapiens
aacattatttattcagcttcatt

SEQ ID NO: 3382208 - DNA, 22 bp, Homo sapiens
aacattcacacagggctctttg

SEQ ID NO: 3382209 - DNA, 18 bp, Homo sapiens
aacattcagctctggaga

SEQ ID NO: 3382210 - DNA, 17 bp, Homo sapiens
aacattccaagactcta

SEQ ID NO: 3382211 - DNA, 23 bp, Homo sapiens
aacattcccctccccactcctct

SEQ ID NO: 3382212 - DNA, 18 bp, Homo sapiens
aacattctgatttggaaa

SEQ ID NO: 3382213 - DNA, 16 bp, Homo sapiens
aacattgaagtaatga

SEQ ID NO: 3382214 - DNA, 18 bp, Homo sapiens
aacattgaagtaatgaat

SEQ ID NO: 3382215 - DNA, 19 bp, Homo sapiens
aacattgaccaagaactgc

SEQ ID NO: 3382216 - DNA, 22 bp, Homo sapiens
aacattgaccaagaactgcatg

SEQ ID NO: 3382217 - DNA, 21 bp, Homo sapiens
aacattggaatgttctcagat

SEQ ID NO: 3382218 - DNA, 15 bp, Homo sapiens
aacatttacagtcct

SEQ ID NO: 3382219 - DNA, 19 bp, Homo sapiens
aacatttgatatttttcca

SEQ ID NO: 3382220 - DNA, 12 bp, Homo sapiens
aacatttgcctt

SEQ ID NO: 3382221 - DNA, 13 bp, Homo sapiens
aacatttgccttg

SEQ ID NO: 3382222 - DNA, 12 bp, Homo sapiens
aacatttgctgc

SEQ ID NO: 3382223 - DNA, 13 bp, Homo sapiens
aacatttgctgcc

SEQ ID NO: 3382224 - DNA, 16 bp, Homo sapiens
aacatttgctgccatt

SEQ ID NO: 3382225 - DNA, 19 bp, Homo sapiens
aacattttaaataaaagaa

SEQ ID NO: 3382226 - DNA, 14 bp, Homo sapiens
aacattttatttat

SEQ ID NO: 3382227 - DNA, 15 bp, Homo sapiens
aacattttgaagtgt

SEQ ID NO: 3382228 - DNA, 19 bp, Homo sapiens
aacatttttaatttaacaa

SEQ ID NO: 3382229 - DNA, 18 bp, Homo sapiens
aaccaaagcctcttcaaa

SEQ ID NO: 3382230 - DNA, 13 bp, Homo sapiens
aaccaaaggacat

SEQ ID NO: 3382231 - DNA, 18 bp, Homo sapiens
aaccaaattgcactgaag

SEQ ID NO: 3382232 - DNA, 20 bp, Homo sapiens
aaccaaattgcactgaagtt

SEQ ID NO: 3382233 - DNA, 13 bp, Homo sapiens
aaccaacatcttt

SEQ ID NO: 3382234 - DNA, 14 bp, Homo sapiens
aaccaacctttaaa

SEQ ID NO: 3382235 - DNA, 21 bp, Homo sapiens
aaccaacctttaaaattgtca

SEQ ID NO: 3382236 - DNA, 15 bp, Homo sapiens
aaccaactctaatat

SEQ ID NO: 3382237 - DNA, 18 bp, Homo sapiens
aaccaagccgtggcttcc

SEQ ID NO: 3382238 - DNA, 22 bp, Homo sapiens
aaccaaggcagcctccagagcc

SEQ ID NO: 3382239 - DNA, 19 bp, Homo sapiens
aaccaatgattcataacaa

SEQ ID NO: 3382240 - DNA, 22 bp, Homo sapiens
aaccaatgattcataacaatgt

SEQ ID NO: 3382241 - DNA, 22 bp, Homo sapiens
aaccaatggtgatcctctattt

SEQ ID NO: 3382242 - DNA, 20 bp, Homo sapiens
aaccaattcaccaacacagt

SEQ ID NO: 3382243 - DNA, 12 bp, Homo sapiens
aaccaatttctt

SEQ ID NO: 3382244 - DNA, 16 bp, Homo sapiens
aaccaatttcttcctt

SEQ ID NO: 3382245 - DNA, 19 bp, Homo sapiens
aaccaatttcttccttcca

SEQ ID NO: 3382246 - DNA, 20 bp, Homo sapiens
aaccacaaaggccaaactgc

SEQ ID NO: 3382247 - DNA, 21 bp, Homo sapiens
aaccacagggccagagggagc

SEQ ID NO: 3382248 - DNA, 21 bp, Homo sapiens
aaccacaggttttagcattgt

SEQ ID NO: 3382249 - DNA, 19 bp, Homo sapiens
aaccaccacacccagccca

SEQ ID NO: 3382250 - DNA, 21 bp, Homo sapiens
aaccaccacacccagcccact

SEQ ID NO: 3382251 - DNA, 16 bp, Homo sapiens
aaccacctatttttga

SEQ ID NO: 3382252 - DNA, 16 bp, Homo sapiens
aaccacggccacattt

SEQ ID NO: 3382253 - DNA, 18 bp, Homo sapiens
aaccacgtctgtcttcac

SEQ ID NO: 3382254 - DNA, 14 bp, Homo sapiens
aaccactaaagtat

SEQ ID NO: 3382255 - DNA, 14 bp, Homo sapiens
aaccactgaacatt

SEQ ID NO: 3382256 - DNA, 20 bp, Homo sapiens
aaccactgtaaaatgaaatt

SEQ ID NO: 3382257 - DNA, 13 bp, Homo sapiens
aaccacttcattc

SEQ ID NO: 3382258 - DNA, 16 bp, Homo sapiens
aaccacttcattctgc

SEQ ID NO: 3382259 - DNA, 22 bp, Homo sapiens
aaccacttcctgctacaggagg

SEQ ID NO: 3382260 - DNA, 23 bp, Homo sapiens
aaccacttcctgctacaggaggg

SEQ ID NO: 3382261 - DNA, 13 bp, Homo sapiens
aaccactttcctt

SEQ ID NO: 3382262 - DNA, 18 bp, Homo sapiens
aaccagaataaagttctg

SEQ ID NO: 3382263 - DNA, 16 bp, Homo sapiens
aaccagaattgtcctc

SEQ ID NO: 3382264 - DNA, 18 bp, Homo sapiens
aaccagagtcagcacagg

SEQ ID NO: 3382265 - DNA, 23 bp, Homo sapiens
aaccagcacagcttagatttcat

SEQ ID NO: 3382266 - DNA, 20 bp, Homo sapiens
aaccagcccgacagtgccat

SEQ ID NO: 3382267 - DNA, 16 bp, Homo sapiens
aaccagctggaaggta

SEQ ID NO: 3382268 - DNA, 22 bp, Homo sapiens
aaccagctgtaacacagctgag

SEQ ID NO: 3382269 - DNA, 23 bp, Homo sapiens
aaccagcttgcgaataacagtcc

SEQ ID NO: 3382270 - DNA, 13 bp, Homo sapiens
aaccaggaaaagg

SEQ ID NO: 3382271 - DNA, 18 bp, Homo sapiens
aaccaggcacctcttcct

SEQ ID NO: 3382272 - DNA, 21 bp, Homo sapiens
aaccaggtttagacagtatga

SEQ ID NO: 3382273 - DNA, 15 bp, Homo sapiens
aaccagtctcctcac

SEQ ID NO: 3382274 - DNA, 19 bp, Homo sapiens
aaccagtctcctcactctg

SEQ ID NO: 3382275 - DNA, 13 bp, Homo sapiens
aaccagtgccaag

SEQ ID NO: 3382276 - DNA, 15 bp, Homo sapiens
aaccagtgccaagga

SEQ ID NO: 3382277 - DNA, 16 bp, Homo sapiens
aaccagtgccaaggac

SEQ ID NO: 3382278 - DNA, 14 bp, Homo sapiens
aaccagtgtagcct

SEQ ID NO: 3382279 - DNA, 18 bp, Homo sapiens
aaccataacaacttcata

SEQ ID NO: 3382280 - DNA, 22 bp, Homo sapiens
aaccataggctgctctgcctgt

SEQ ID NO: 3382281 - DNA, 16 bp, Homo sapiens
aaccatcagaattcag

SEQ ID NO: 3382282 - DNA, 22 bp, Homo sapiens
aaccatccagtgacaaaccatc

SEQ ID NO: 3382283 - DNA, 15 bp, Homo sapiens
aaccatccctgccac

SEQ ID NO: 3382284 - DNA, 16 bp, Homo sapiens
aaccatctctcttcca

SEQ ID NO: 3382285 - DNA, 22 bp, Homo sapiens
aaccatctctcttccagctgct

SEQ ID NO: 3382286 - DNA, 15 bp, Homo sapiens
aaccatctggcctgg

SEQ ID NO: 3382287 - DNA, 16 bp, Homo sapiens
aaccatctggcctggc

SEQ ID NO: 3382288 - DNA, 12 bp, Homo sapiens
aaccatgactgt

SEQ ID NO: 3382289 - DNA, 17 bp, Homo sapiens
aaccatgagaatttgca

SEQ ID NO: 3382290 - DNA, 22 bp, Homo sapiens
aaccatgagaccactgttatca

SEQ ID NO: 3382291 - DNA, 19 bp, Homo sapiens
aaccatgcaaatgctatga

SEQ ID NO: 3382292 - DNA, 22 bp, Homo sapiens
aaccatgcaggaaggaaaacta

SEQ ID NO: 3382293 - DNA, 22 bp, Homo sapiens
aaccatggctgaaggaaaccag

SEQ ID NO: 3382294 - DNA, 15 bp, Homo sapiens
aaccattaaagtcag

SEQ ID NO: 3382295 - DNA, 15 bp, Homo sapiens
aagaaatttattact

SEQ ID NO: 3382296 - DNA, 16 bp, Homo sapiens
aagaaatttgatttct

SEQ ID NO: 3382297 - DNA, 16 bp, Homo sapiens
aagaacacagcatgtg

SEQ ID NO: 3382298 - DNA, 21 bp, Homo sapiens
aagaacaccctatattttgca

SEQ ID NO: 3382299 - DNA, 22 bp, Homo sapiens
aagaacaggcttggcaaagaag

SEQ ID NO: 3382300 - DNA, 12 bp, Homo sapiens
aagaacatagaa

SEQ ID NO: 3382301 - DNA, 16 bp, Homo sapiens
aagaaccaaaacttcc

SEQ ID NO: 3382302 - DNA, 17 bp, Homo sapiens
aagaaccatgcaggaag

SEQ ID NO: 3382303 - DNA, 22 bp, Homo sapiens
aagaaccatgcaggaaggaaaa

SEQ ID NO: 3382304 - DNA, 16 bp, Homo sapiens
aagaactccttatttt

SEQ ID NO: 3382305 - DNA, 20 bp, Homo sapiens
aagaactccttattttgtat

SEQ ID NO: 3382306 - DNA, 11 bp, Homo sapiens
aagaactgcat

SEQ ID NO: 3382307 - DNA, 13 bp, Homo sapiens
aagaactgcatgg

SEQ ID NO: 3382308 - DNA, 18 bp, Homo sapiens
aagaactgcatggaccta

SEQ ID NO: 3382309 - DNA, 15 bp, Homo sapiens
aagaacttactgatt

SEQ ID NO: 3382310 - DNA, 18 bp, Homo sapiens
aagaacttgatttgcatg

SEQ ID NO: 3382311 - DNA, 22 bp, Homo sapiens
aagaacttgatttgcatggatt

SEQ ID NO: 3382312 - DNA, 15 bp, Homo sapiens
aagaacttgtttaca

SEQ ID NO: 3382313 - DNA, 16 bp, Homo sapiens
aagaacttgtttacaa

SEQ ID NO: 3382314 - DNA, 17 bp, Homo sapiens
aagaactttaaattgtg

SEQ ID NO: 3382315 - DNA, 16 bp, Homo sapiens
aagaagaaagcaaaag

SEQ ID NO: 3382316 - DNA, 16 bp, Homo sapiens
aagaagacatgaacca

SEQ ID NO: 3382317 - DNA, 19 bp, Homo sapiens
aagaagagcgagagatcaa

SEQ ID NO: 3382318 - DNA, 21 bp, Homo sapiens
aagaagatcacgctccccgcc

SEQ ID NO: 3382319 - DNA, 19 bp, Homo sapiens
aagaagccacagacctagg

SEQ ID NO: 3382320 - DNA, 16 bp, Homo sapiens
aagaagccttaatttg

SEQ ID NO: 3382321 - DNA, 19 bp, Homo sapiens
aagaagccttaatttgcac

SEQ ID NO: 3382322 - DNA, 22 bp, Homo sapiens
aagaagccttaatttgcacagt

SEQ ID NO: 3382323 - DNA, 11 bp, Homo sapiens
aagaagctgct

SEQ ID NO: 3382324 - DNA, 14 bp, Homo sapiens
aagaagctgttgta

SEQ ID NO: 3382325 - DNA, 22 bp, Homo sapiens
aagaagctgttgtacatttatg

SEQ ID NO: 3382326 - DNA, 19 bp, Homo sapiens
aagaagcttctaataaatt

SEQ ID NO: 3382327 - DNA, 21 bp, Homo sapiens
aagaagctttaatatttaaat

SEQ ID NO: 3382328 - DNA, 18 bp, Homo sapiens
aagaaggaaagatggtta

SEQ ID NO: 3382329 - DNA, 13 bp, Homo sapiens
aagaaggaagctg

SEQ ID NO: 3382330 - DNA, 14 bp, Homo sapiens
aagaaggagagcaa

SEQ ID NO: 3382331 - DNA, 16 bp, Homo sapiens
aagaaggagagcaaga

SEQ ID NO: 3382332 - DNA, 14 bp, Homo sapiens
aagaaggcaaaaat

SEQ ID NO: 3382333 - DNA, 14 bp, Homo sapiens
aagaagggagaaga

SEQ ID NO: 3382334 - DNA, 15 bp, Homo sapiens
aagaagggggccctg

SEQ ID NO: 3382335 - DNA, 17 bp, Homo sapiens
aagaagggggccctgct

SEQ ID NO: 3382336 - DNA, 19 bp, Homo sapiens
aagaagggggccctgctac

SEQ ID NO: 3382337 - DNA, 19 bp, Homo sapiens
aagaagtggagacagtcct

SEQ ID NO: 3382338 - DNA, 19 bp, Homo sapiens
aagaagtgtccgagaacta

SEQ ID NO: 3382339 - DNA, 15 bp, Homo sapiens
aagaagttactttgt

SEQ ID NO: 3382340 - DNA, 18 bp, Homo sapiens
aagaagttttaaaaagcc

SEQ ID NO: 3382341 - DNA, 13 bp, Homo sapiens
aagaatacagaaa

SEQ ID NO: 3382342 - DNA, 14 bp, Homo sapiens
aagaatacagaaag

SEQ ID NO: 3382343 - DNA, 23 bp, Homo sapiens
aagaatacagttaggcaccagaa

SEQ ID NO: 3382344 - DNA, 12 bp, Homo sapiens
aagaatacttga

SEQ ID NO: 3382345 - DNA, 21 bp, Homo sapiens
aagaatatgtttccttgttta

SEQ ID NO: 3382346 - DNA, 21 bp, Homo sapiens
aagaatattcagagaatatca

SEQ ID NO: 3382347 - DNA, 22 bp, Homo sapiens
aagaatattcagagaatatcaa

SEQ ID NO: 3382348 - DNA, 14 bp, Homo sapiens
aagaatatttaaga

SEQ ID NO: 3382349 - DNA, 14 bp, Homo sapiens
aagaatcagagtag

SEQ ID NO: 3382350 - DNA, 22 bp, Homo sapiens
aagaatcagagtagaaataaaa

SEQ ID NO: 3382351 - DNA, 22 bp, Homo sapiens
aagaatcaggagagggatacaa

SEQ ID NO: 3382352 - DNA, 21 bp, Homo sapiens
aagaatccacatttctaaaat

SEQ ID NO: 3382353 - DNA, 13 bp, Homo sapiens
aagaatgaaagct

SEQ ID NO: 3382354 - DNA, 18 bp, Homo sapiens
aagaatgactatataatt

SEQ ID NO: 3382355 - DNA, 17 bp, Homo sapiens
aagaatgcacaagaatg

SEQ ID NO: 3382356 - DNA, 22 bp, Homo sapiens
aagaatgcagattcctgggcct

SEQ ID NO: 3382357 - DNA, 18 bp, Homo sapiens
aagaatgctggttttcct

SEQ ID NO: 3382358 - DNA, 16 bp, Homo sapiens
aagaatggagcagtac

SEQ ID NO: 3382359 - DNA, 20 bp, Homo sapiens
aagaatggggatcacagaga

SEQ ID NO: 3382360 - DNA, 17 bp, Homo sapiens
aagaatgtcgattaaaa

SEQ ID NO: 3382361 - DNA, 12 bp, Homo sapiens
aagaattacagt

SEQ ID NO: 3382362 - DNA, 13 bp, Homo sapiens
aagaattacagta

SEQ ID NO: 3382363 - DNA, 20 bp, Homo sapiens
aagaattagaagtctttcag

SEQ ID NO: 3382364 - DNA, 22 bp, Homo sapiens
aagaattagaagtctttcagtg

SEQ ID NO: 3382365 - DNA, 22 bp, Homo sapiens
aagaattatgtaatatattgta

SEQ ID NO: 3382366 - DNA, 23 bp, Homo sapiens
aagaattatgtaatatattgtac

SEQ ID NO: 3382367 - DNA, 13 bp, Homo sapiens
aagaattctgtga

SEQ ID NO: 3382368 - DNA, 15 bp, Homo sapiens
aagaattgaaaagtt

SEQ ID NO: 3382369 - DNA, 17 bp, Homo sapiens
aagaattgagtaatggt

SEQ ID NO: 3382370 - DNA, 17 bp, Homo sapiens
aagaatttagatcttat

SEQ ID NO: 3382371 - DNA, 15 bp, Homo sapiens
aagaatttagggaga

SEQ ID NO: 3382372 - DNA, 13 bp, Homo sapiens
aagaatttttaaa

SEQ ID NO: 3382373 - DNA, 14 bp, Homo sapiens
aagacaaaagtctg

SEQ ID NO: 3382374 - DNA, 22 bp, Homo sapiens
aagacaaatcaacagaagcatt

SEQ ID NO: 3382375 - DNA, 16 bp, Homo sapiens
aagacaagtatgaata

SEQ ID NO: 3382376 - DNA, 19 bp, Homo sapiens
aagacaatcactgaaacaa

SEQ ID NO: 3382377 - DNA, 21 bp, Homo sapiens
aagacacaaggtgatttcaga

SEQ ID NO: 3382378 - DNA, 16 bp, Homo sapiens
aagacaccaaatataa

SEQ ID NO: 3382379 - DNA, 21 bp, Homo sapiens
aagacaccttctgagtattct

SEQ ID NO: 3382380 - DNA, 16 bp, Homo sapiens
aagacagagacgcagg

SEQ ID NO: 3382381 - DNA, 22 bp, Homo sapiens
aagacaggttacgaagacaaag

SEQ ID NO: 3382382 - DNA, 14 bp, Homo sapiens
aagacagtggttct

SEQ ID NO: 3382383 - DNA, 21 bp, Homo sapiens
aagacataacgtttttccttt

SEQ ID NO: 3382384 - DNA, 13 bp, Homo sapiens
aagacatgaacca

SEQ ID NO: 3382385 - DNA, 21 bp, Homo sapiens
aagacatgatttccttgaatg

SEQ ID NO: 3382386 - DNA, 19 bp, Homo sapiens
aagacatgcactatgagga

SEQ ID NO: 3382387 - DNA, 18 bp, Homo sapiens
aagacatggagactcctg

SEQ ID NO: 3382388 - DNA, 19 bp, Homo sapiens
aagacatggagactcctgc

SEQ ID NO: 3382389 - DNA, 17 bp, Homo sapiens
aagacatgtgaggagga

SEQ ID NO: 3382390 - DNA, 23 bp, Homo sapiens
aagacatgtgaggaggaaaagga

SEQ ID NO: 3382391 - DNA, 16 bp, Homo sapiens
aagacatgttgtaaat

SEQ ID NO: 3382392 - DNA, 13 bp, Homo sapiens
aagacattttcat

SEQ ID NO: 3382393 - DNA, 18 bp, Homo sapiens
aagaccaccacttcgaaa

SEQ ID NO: 3382394 - DNA, 12 bp, Homo sapiens
aagaccagtcca

SEQ ID NO: 3382395 - DNA, 17 bp, Homo sapiens
aagaccattctgtgacc

SEQ ID NO: 3382396 - DNA, 14 bp, Homo sapiens
aagaccccatctct

SEQ ID NO: 3382397 - DNA, 14 bp, Homo sapiens
aagacccctgtctt

SEQ ID NO: 3382398 - DNA, 14 bp, Homo sapiens
aagacccggccagg

SEQ ID NO: 3382399 - DNA, 13 bp, Homo sapiens
aagaccctccccg

SEQ ID NO: 3382400 - DNA, 22 bp, Homo sapiens
aagaccctcttgcccatcctga

SEQ ID NO: 3382401 - DNA, 13 bp, Homo sapiens
aagaccctgtctc

SEQ ID NO: 3382402 - DNA, 19 bp, Homo sapiens
aagacctacattccctctc

SEQ ID NO: 3382403 - DNA, 23 bp, Homo sapiens
aagacctaggctcatggacgaga

SEQ ID NO: 3382404 - DNA, 13 bp, Homo sapiens
aagacctctgtga

SEQ ID NO: 3382405 - DNA, 18 bp, Homo sapiens
aagaccttggcctctcct

SEQ ID NO: 3382406 - DNA, 21 bp, Homo sapiens
aagacctttggagcaaagctg

SEQ ID NO: 3382407 - DNA, 13 bp, Homo sapiens
aagacgccttcat

SEQ ID NO: 3382408 - DNA, 21 bp, Homo sapiens
aagactagaaaattagactgt

SEQ ID NO: 3382409 - DNA, 21 bp, Homo sapiens
aagactagactactcaatatt

SEQ ID NO: 3382410 - DNA, 14 bp, Homo sapiens
aagactatatatat

SEQ ID NO: 3382411 - DNA, 21 bp, Homo sapiens
aagactatatatataaatgta

SEQ ID NO: 3382412 - DNA, 17 bp, Homo sapiens
aagactcattccctaga

SEQ ID NO: 3382413 - DNA, 17 bp, Homo sapiens
aagactcattcttctgt

SEQ ID NO: 3382414 - DNA, 14 bp, Homo sapiens
aagactcctctggg

SEQ ID NO: 3382415 - DNA, 23 bp, Homo sapiens
aagactcctctgggcctggggtg

SEQ ID NO: 3382416 - DNA, 15 bp, Homo sapiens
aagactctagagtcc

SEQ ID NO: 3382417 - DNA, 17 bp, Homo sapiens
aagactctattctcaaa

SEQ ID NO: 3382418 - DNA, 18 bp, Homo sapiens
aagactgcaaactttttt

SEQ ID NO: 3382419 - DNA, 13 bp, Homo sapiens
aagactggaagca

SEQ ID NO: 3382420 - DNA, 15 bp, Homo sapiens
aagactggttttctg

SEQ ID NO: 3382421 - DNA, 14 bp, Homo sapiens
aagcctcctgtacc

SEQ ID NO: 3382422 - DNA, 23 bp, Homo sapiens
aagcctctggctagaggccagcc

SEQ ID NO: 3382423 - DNA, 15 bp, Homo sapiens
aagcctgaggctggg

SEQ ID NO: 3382424 - DNA, 22 bp, Homo sapiens
aagcctgcaatttcatatgctg

SEQ ID NO: 3382425 - DNA, 18 bp, Homo sapiens
aagcctgcccttgtctga

SEQ ID NO: 3382426 - DNA, 13 bp, Homo sapiens
aagcctgcctccc

SEQ ID NO: 3382427 - DNA, 22 bp, Homo sapiens
aagcctgcgttggtccagagcg

SEQ ID NO: 3382428 - DNA, 19 bp, Homo sapiens
aagcctgctggctgcggcc

SEQ ID NO: 3382429 - DNA, 22 bp, Homo sapiens
aagcctgctggctgcggccccc

SEQ ID NO: 3382430 - DNA, 16 bp, Homo sapiens
aagcctggactctgcc

SEQ ID NO: 3382431 - DNA, 17 bp, Homo sapiens
aagcctggactctgccc

SEQ ID NO: 3382432 - DNA, 18 bp, Homo sapiens
aagcctgttcccctcact

SEQ ID NO: 3382433 - DNA, 23 bp, Homo sapiens
aagccttatcaagtgtcttccat

SEQ ID NO: 3382434 - DNA, 19 bp, Homo sapiens
aagccttcagctccaggga

SEQ ID NO: 3382435 - DNA, 11 bp, Homo sapiens
aagccttgtgt

SEQ ID NO: 3382436 - DNA, 13 bp, Homo sapiens
aagccttgtgtat

SEQ ID NO: 3382437 - DNA, 21 bp, Homo sapiens
aagccttgtgtatatttgtat

SEQ ID NO: 3382438 - DNA, 17 bp, Homo sapiens
aagccttttaaatcatc

SEQ ID NO: 3382439 - DNA, 18 bp, Homo sapiens
aagcgagatcccatctct

SEQ ID NO: 3382440 - DNA, 22 bp, Homo sapiens
aagcgatatacagatgaaaatt

SEQ ID NO: 3382441 - DNA, 15 bp, Homo sapiens
aagcgattcttctgc

SEQ ID NO: 3382442 - DNA, 17 bp, Homo sapiens
aagcgattcttctgctt

SEQ ID NO: 3382443 - DNA, 17 bp, Homo sapiens
aagcgctcccagcctgc

SEQ ID NO: 3382444 - DNA, 18 bp, Homo sapiens
aagcgctcccagcctgcc

SEQ ID NO: 3382445 - DNA, 21 bp, Homo sapiens
aagcggagttcctaacaggat

SEQ ID NO: 3382446 - DNA, 13 bp, Homo sapiens
aagcggggggagg

SEQ ID NO: 3382447 - DNA, 15 bp, Homo sapiens
aagcgtctttaagag

SEQ ID NO: 3382448 - DNA, 19 bp, Homo sapiens
aagcgtctttaagagactc

SEQ ID NO: 3382449 - DNA, 17 bp, Homo sapiens
aagcgtgagccactgca

SEQ ID NO: 3382450 - DNA, 20 bp, Homo sapiens
aagcgtgagccactgcaccg

SEQ ID NO: 3382451 - DNA, 21 bp, Homo sapiens
aagcgtgagccactgcaccgg

SEQ ID NO: 3382452 - DNA, 23 bp, Homo sapiens
aagcgtgcacaaggattgaaaat

SEQ ID NO: 3382453 - DNA, 20 bp, Homo sapiens
aagcgttcatatgctctgct

SEQ ID NO: 3382454 - DNA, 21 bp, Homo sapiens
aagcgtttttaacctgttttg

SEQ ID NO: 3382455 - DNA, 12 bp, Homo sapiens
aagcgtttttct

SEQ ID NO: 3382456 - DNA, 11 bp, Homo sapiens
aagctaaagag

SEQ ID NO: 3382457 - DNA, 21 bp, Homo sapiens
aagctacttgccttgagttta

SEQ ID NO: 3382458 - DNA, 15 bp, Homo sapiens
aagctagacagatcc

SEQ ID NO: 3382459 - DNA, 15 bp, Homo sapiens
aagctaggccccaga

SEQ ID NO: 3382460 - DNA, 12 bp, Homo sapiens
aagctaggcctg

SEQ ID NO: 3382461 - DNA, 19 bp, Homo sapiens
aagctagtggcttcaaaat

SEQ ID NO: 3382462 - DNA, 21 bp, Homo sapiens
aagctagtgtacctcctctca

SEQ ID NO: 3382463 - DNA, 21 bp, Homo sapiens
aagctatcacctagcagcctc

SEQ ID NO: 3382464 - DNA, 15 bp, Homo sapiens
aagctatcagcaata

SEQ ID NO: 3382465 - DNA, 17 bp, Homo sapiens
aagctatccaaataact

SEQ ID NO: 3382466 - DNA, 13 bp, Homo sapiens
aagctatctgtgc

SEQ ID NO: 3382467 - DNA, 21 bp, Homo sapiens
aagctattccctcaaatctga

SEQ ID NO: 3382468 - DNA, 23 bp, Homo sapiens
aagctcactgctgatcgtagaaa

SEQ ID NO: 3382469 - DNA, 16 bp, Homo sapiens
aagctcagattattta

SEQ ID NO: 3382470 - DNA, 17 bp, Homo sapiens
aagctcagctactgatt

SEQ ID NO: 3382471 - DNA, 13 bp, Homo sapiens
aagctccaagccc

SEQ ID NO: 3382472 - DNA, 21 bp, Homo sapiens
aagctccacggtgcgtggctg

SEQ ID NO: 3382473 - DNA, 16 bp, Homo sapiens
aagctccactgtcacc

SEQ ID NO: 3382474 - DNA, 19 bp, Homo sapiens
aagctccactgtcaccctc

SEQ ID NO: 3382475 - DNA, 12 bp, Homo sapiens
aagctccctgga

SEQ ID NO: 3382476 - DNA, 21 bp, Homo sapiens
aagctccctggagccctgttg

SEQ ID NO: 3382477 - DNA, 17 bp, Homo sapiens
aagctcctcctcggaac

SEQ ID NO: 3382478 - DNA, 21 bp, Homo sapiens
aagctcgccccacctccacct

SEQ ID NO: 3382479 - DNA, 12 bp, Homo sapiens
aagctctgacat

SEQ ID NO: 3382480 - DNA, 13 bp, Homo sapiens
aagctctggctga

SEQ ID NO: 3382481 - DNA, 14 bp, Homo sapiens
aagctgaaaatata

SEQ ID NO: 3382482 - DNA, 20 bp, Homo sapiens
aagctgaaattttagaaata

SEQ ID NO: 3382483 - DNA, 18 bp, Homo sapiens
aagctgaagaccatggat

SEQ ID NO: 3382484 - DNA, 14 bp, Homo sapiens
aagctgaatatttt

SEQ ID NO: 3382485 - DNA, 13 bp, Homo sapiens
aagctgacataat

SEQ ID NO: 3382486 - DNA, 18 bp, Homo sapiens
aagctgagaactcctgac

SEQ ID NO: 3382487 - DNA, 14 bp, Homo sapiens
aagctgaggcggga

SEQ ID NO: 3382488 - DNA, 21 bp, Homo sapiens
aagctgagttacttgtctgag

SEQ ID NO: 3382489 - DNA, 22 bp, Homo sapiens
aagctgagtttcctatgggaac

SEQ ID NO: 3382490 - DNA, 21 bp, Homo sapiens
aagctgatgatgtctcttgta

SEQ ID NO: 3382491 - DNA, 17 bp, Homo sapiens
aagctgattactgtcaa

SEQ ID NO: 3382492 - DNA, 22 bp, Homo sapiens
aagctgattactgtcaataaac

SEQ ID NO: 3382493 - DNA, 19 bp, Homo sapiens
aagctgccagcccagaaca

SEQ ID NO: 3382494 - DNA, 20 bp, Homo sapiens
aagctgcccactgtttctct

SEQ ID NO: 3382495 - DNA, 20 bp, Homo sapiens
aagctgccgaaccaaaagaa

SEQ ID NO: 3382496 - DNA, 23 bp, Homo sapiens
aagctgcctcccctctccttcct

SEQ ID NO: 3382497 - DNA, 19 bp, Homo sapiens
aagctgcctgtagttagga

SEQ ID NO: 3382498 - DNA, 16 bp, Homo sapiens
aagctgctccaggcct

SEQ ID NO: 3382499 - DNA, 14 bp, Homo sapiens
aagctgcttctgcc

SEQ ID NO: 3382500 - DNA, 14 bp, Homo sapiens
aagctggaacattt

SEQ ID NO: 3382501 - DNA, 16 bp, Homo sapiens
aagctggaacatttga

SEQ ID NO: 3382502 - DNA, 23 bp, Homo sapiens
aagctggaggctccaggactcca

SEQ ID NO: 3382503 - DNA, 15 bp, Homo sapiens
aagctggccctgcct

SEQ ID NO: 3382504 - DNA, 16 bp, Homo sapiens
aagctggccctgcctc

SEQ ID NO: 3382505 - DNA, 19 bp, Homo sapiens
aagctggccctgcctcctg

SEQ ID NO: 3382506 - DNA, 12 bp, Homo sapiens
aagctggcctct

SEQ ID NO: 3382507 - DNA, 14 bp, Homo sapiens
aagctggcctgaga

SEQ ID NO: 3382508 - DNA, 21 bp, Homo sapiens
aagctggtcccactcagtcca

SEQ ID NO: 3382509 - DNA, 18 bp, Homo sapiens
aagctggtggcctctgca

SEQ ID NO: 3382510 - DNA, 19 bp, Homo sapiens
aagctgtactcagagcaga

SEQ ID NO: 3382511 - DNA, 12 bp, Homo sapiens
aagctgtccctg

SEQ ID NO: 3382512 - DNA, 16 bp, Homo sapiens
aagctgtgaacaggct

SEQ ID NO: 3382513 - DNA, 19 bp, Homo sapiens
aagctgtgacttctccagg

SEQ ID NO: 3382514 - DNA, 13 bp, Homo sapiens
aagctgtgcaggc

SEQ ID NO: 3382515 - DNA, 23 bp, Homo sapiens
aagctgtgtctgcccaatgaata

SEQ ID NO: 3382516 - DNA, 14 bp, Homo sapiens
aagctgtgtgcagg

SEQ ID NO: 3382517 - DNA, 20 bp, Homo sapiens
aagctgtgttgaaacagaaa

SEQ ID NO: 3382518 - DNA, 15 bp, Homo sapiens
aagctgttaaactgt

SEQ ID NO: 3382519 - DNA, 16 bp, Homo sapiens
aagctgttaaactgtt

SEQ ID NO: 3382520 - DNA, 13 bp, Homo sapiens
aagctgttcctgt

SEQ ID NO: 3382521 - DNA, 18 bp, Homo sapiens
aagctgttgtacatttat

SEQ ID NO: 3382522 - DNA, 14 bp, Homo sapiens
aagctgtttggaaa

SEQ ID NO: 3382523 - DNA, 21 bp, Homo sapiens
aagctgtttggaaaagacagt

SEQ ID NO: 3382524 - DNA, 14 bp, Homo sapiens
aagcttaaatagga

SEQ ID NO: 3382525 - DNA, 18 bp, Homo sapiens
aagcttaaataggaaagt

SEQ ID NO: 3382526 - DNA, 22 bp, Homo sapiens
aagcttaaataggaaagtttct

SEQ ID NO: 3382527 - DNA, 14 bp, Homo sapiens
aagcttcaaattaa

SEQ ID NO: 3382528 - DNA, 16 bp, Homo sapiens
aagcttcaatattttt

SEQ ID NO: 3382529 - DNA, 16 bp, Homo sapiens
aagcttcagttgcttg

SEQ ID NO: 3382530 - DNA, 21 bp, Homo sapiens
aagcttcattctccttgttgt

SEQ ID NO: 3382531 - DNA, 20 bp, Homo sapiens
aagcttccatgattctattt

SEQ ID NO: 3382532 - DNA, 15 bp, Homo sapiens
aagcttctaaatggt

SEQ ID NO: 3382533 - DNA, 11 bp, Homo sapiens
aagcttctaat

SEQ ID NO: 3382534 - DNA, 19 bp, Homo sapiens
aagcttcttaattaatttg

SEQ ID NO: 3382535 - DNA, 18 bp, Homo sapiens
aagcttgactcccaagtt

SEQ ID NO: 3382536 - DNA, 17 bp, Homo sapiens
aagctttaaattatgtg

SEQ ID NO: 3382537 - DNA, 19 bp, Homo sapiens
aagctttatacgtgtagct

SEQ ID NO: 3382538 - DNA, 21 bp, Homo sapiens
aagctttcatgtcccagaact

SEQ ID NO: 3382539 - DNA, 20 bp, Homo sapiens
aagctttgactctataagca

SEQ ID NO: 3382540 - DNA, 11 bp, Homo sapiens
aagctttgcta

SEQ ID NO: 3382541 - DNA, 23 bp, Homo sapiens
aagctttgctacaaatttatgca

SEQ ID NO: 3382542 - DNA, 13 bp, Homo sapiens
aagcttttggaag

SEQ ID NO: 3382543 - DNA, 13 bp, Homo sapiens
aagctttttggaa

SEQ ID NO: 3382544 - DNA, 22 bp, Homo sapiens
aagctttttttcttgctagtat

SEQ ID NO: 3382545 - DNA, 21 bp, Homo sapiens
aaggaaaaagcacaagaagcg

SEQ ID NO: 3382546 - DNA, 19 bp, Homo sapiens
aaggaaaaataatcaagat

SEQ ID NO: 3382547 - DNA, 15 bp, Homo sapiens
aagtctcagaagagg

SEQ ID NO: 3382548 - DNA, 16 bp, Homo sapiens
aagtctcatgggaagc

SEQ ID NO: 3382549 - DNA, 18 bp, Homo sapiens
aagtctctaattctatta

SEQ ID NO: 3382550 - DNA, 13 bp, Homo sapiens
aagtctctattta

SEQ ID NO: 3382551 - DNA, 20 bp, Homo sapiens
aagtctctatttaaattctt

SEQ ID NO: 3382552 - DNA, 13 bp, Homo sapiens
aagtctctctgtg

SEQ ID NO: 3382553 - DNA, 23 bp, Homo sapiens
aagtctctctgtgaatacaatta

SEQ ID NO: 3382554 - DNA, 15 bp, Homo sapiens
aagtctctgctggcc

SEQ ID NO: 3382555 - DNA, 18 bp, Homo sapiens
aagtctcttttctttaga

SEQ ID NO: 3382556 - DNA, 18 bp, Homo sapiens
aagtctgtacctcaaatg

SEQ ID NO: 3382557 - DNA, 21 bp, Homo sapiens
aagtctgtgagtgcgtctgag

SEQ ID NO: 3382558 - DNA, 23 bp, Homo sapiens
aagtctgtgagtgcgtctgaggg

SEQ ID NO: 3382559 - DNA, 22 bp, Homo sapiens
aagtctgtgtgatgaactttct

SEQ ID NO: 3382560 - DNA, 19 bp, Homo sapiens
aagtcttgggtctgaattt

SEQ ID NO: 3382561 - DNA, 11 bp, Homo sapiens
aagtctttccc

SEQ ID NO: 3382562 - DNA, 18 bp, Homo sapiens
aagtcttttgttcgcatg

SEQ ID NO: 3382563 - DNA, 16 bp, Homo sapiens
aagtgaatgaaagatt

SEQ ID NO: 3382564 - DNA, 15 bp, Homo sapiens
aagtgaatgctggga

SEQ ID NO: 3382565 - DNA, 14 bp, Homo sapiens
aagtgaatttgaat

SEQ ID NO: 3382566 - DNA, 16 bp, Homo sapiens
aagtgaatttgaatga

SEQ ID NO: 3382567 - DNA, 14 bp, Homo sapiens
aagtgacaaaagct

SEQ ID NO: 3382568 - DNA, 24 bp, Homo sapiens
aagtgacacagcagcttcaccaga

SEQ ID NO: 3382569 - DNA, 14 bp, Homo sapiens
aagtgagagctggg

SEQ ID NO: 3382570 - DNA, 22 bp, Homo sapiens
aagtgatcaataaaatgtgatt

SEQ ID NO: 3382571 - DNA, 18 bp, Homo sapiens
aagtgattcactgtgctt

SEQ ID NO: 3382572 - DNA, 19 bp, Homo sapiens
aagtgattctcctgcctca

SEQ ID NO: 3382573 - DNA, 20 bp, Homo sapiens
aagtgattctcctgcctcag

SEQ ID NO: 3382574 - DNA, 17 bp, Homo sapiens
aagtgcacacagaaata

SEQ ID NO: 3382575 - DNA, 21 bp, Homo sapiens
aagtgcacacagaaatatata

SEQ ID NO: 3382576 - DNA, 18 bp, Homo sapiens
aagtgcatatgaaatcct

SEQ ID NO: 3382577 - DNA, 16 bp, Homo sapiens
aagtgcatgatggtga

SEQ ID NO: 3382578 - DNA, 13 bp, Homo sapiens
aagtgcatttctg

SEQ ID NO: 3382579 - DNA, 23 bp, Homo sapiens
aagtgcatttctgaatagaaatg

SEQ ID NO: 3382580 - DNA, 11 bp, Homo sapiens
aagtgccaaac

SEQ ID NO: 3382581 - DNA, 23 bp, Homo sapiens
aagtgccactgcccgagctggtg

SEQ ID NO: 3382582 - DNA, 19 bp, Homo sapiens
aagtgccagaggtgggcag

SEQ ID NO: 3382583 - DNA, 17 bp, Homo sapiens
aagtgcccaaagtgggg

SEQ ID NO: 3382584 - DNA, 18 bp, Homo sapiens
aagtgcccaaagtgggga

SEQ ID NO: 3382585 - DNA, 19 bp, Homo sapiens
aagtgcccaaagtggggag

SEQ ID NO: 3382586 - DNA, 18 bp, Homo sapiens
aagtgccctccaggcttt

SEQ ID NO: 3382587 - DNA, 18 bp, Homo sapiens
aagtgcctagactgttac

SEQ ID NO: 3382588 - DNA, 20 bp, Homo sapiens
aagtgccttctccttcccca

SEQ ID NO: 3382589 - DNA, 17 bp, Homo sapiens
aagtgcggtgctttagc

SEQ ID NO: 3382590 - DNA, 15 bp, Homo sapiens
aagtgcgtgtgtaga

SEQ ID NO: 3382591 - DNA, 17 bp, Homo sapiens
aagtgctaaggttctaa

SEQ ID NO: 3382592 - DNA, 20 bp, Homo sapiens
aagtgctaaggttctaaggc

SEQ ID NO: 3382593 - DNA, 19 bp, Homo sapiens
aagtgctggattgtccttg

SEQ ID NO: 3382594 - DNA, 20 bp, Homo sapiens
aagtgctggattgtccttgg

SEQ ID NO: 3382595 - DNA, 12 bp, Homo sapiens
aagtgctgggat

SEQ ID NO: 3382596 - DNA, 22 bp, Homo sapiens
aagtgctgggattacaggtgtg

SEQ ID NO: 3382597 - DNA, 22 bp, Homo sapiens
aagtgctgtacccttccacctc

SEQ ID NO: 3382598 - DNA, 14 bp, Homo sapiens
aagtgctgtttatt

SEQ ID NO: 3382599 - DNA, 17 bp, Homo sapiens
aagtgctgtttattaat

SEQ ID NO: 3382600 - DNA, 17 bp, Homo sapiens
aagtggaaaaaagagaa

SEQ ID NO: 3382601 - DNA, 20 bp, Homo sapiens
aagtggaacgaaaatgaaag

SEQ ID NO: 3382602 - DNA, 22 bp, Homo sapiens
aagtggacagagcgcccctccc

SEQ ID NO: 3382603 - DNA, 16 bp, Homo sapiens
aagtggatgtttttaa

SEQ ID NO: 3382604 - DNA, 18 bp, Homo sapiens
aagtggcatgtgctgtga

SEQ ID NO: 3382605 - DNA, 16 bp, Homo sapiens
aagtgggcttgattct

SEQ ID NO: 3382606 - DNA, 15 bp, Homo sapiens
aagtgtaaaatagaa

SEQ ID NO: 3382607 - DNA, 18 bp, Homo sapiens
aagtgtaagttcacaact

SEQ ID NO: 3382608 - DNA, 16 bp, Homo sapiens
aagtgtaataatatga

SEQ ID NO: 3382609 - DNA, 13 bp, Homo sapiens
aagtgtatttgga

SEQ ID NO: 3382610 - DNA, 15 bp, Homo sapiens
aagtgtatttttcaa

SEQ ID NO: 3382611 - DNA, 16 bp, Homo sapiens
aagtgtcaactctttg

SEQ ID NO: 3382612 - DNA, 17 bp, Homo sapiens
aagtgtcaactctttgt

SEQ ID NO: 3382613 - DNA, 15 bp, Homo sapiens
aagtgtccgagaact

SEQ ID NO: 3382614 - DNA, 14 bp, Homo sapiens
aagtgtccttcttg

SEQ ID NO: 3382615 - DNA, 20 bp, Homo sapiens
aagtgtctagagtcatgtga

SEQ ID NO: 3382616 - DNA, 14 bp, Homo sapiens
aagtgtctggagcg

SEQ ID NO: 3382617 - DNA, 19 bp, Homo sapiens
aagtgtgagtaagagctgg

SEQ ID NO: 3382618 - DNA, 19 bp, Homo sapiens
aagtgtgcagccatagttt

SEQ ID NO: 3382619 - DNA, 23 bp, Homo sapiens
aagtgtgctctttttttaaaagg

SEQ ID NO: 3382620 - DNA, 18 bp, Homo sapiens
aagtgtgctgtgacaagc

SEQ ID NO: 3382621 - DNA, 20 bp, Homo sapiens
aagtgtggggattttcactg

SEQ ID NO: 3382622 - DNA, 23 bp, Homo sapiens
aagtgtgggtttggttagaggaa

SEQ ID NO: 3382623 - DNA, 15 bp, Homo sapiens
aagtgtgtatatatt

SEQ ID NO: 3382624 - DNA, 18 bp, Homo sapiens
aagtgtgtgattgaaggt

SEQ ID NO: 3382625 - DNA, 15 bp, Homo sapiens
aagtgttagatagaa

SEQ ID NO: 3382626 - DNA, 13 bp, Homo sapiens
aagtgttcaagaa

SEQ ID NO: 3382627 - DNA, 18 bp, Homo sapiens
aagtgttgtaaatattta

SEQ ID NO: 3382628 - DNA, 20 bp, Homo sapiens
aagtgttgtaaatatttatg

SEQ ID NO: 3382629 - DNA, 22 bp, Homo sapiens
aagtgttgtaaatatttatgta

SEQ ID NO: 3382630 - DNA, 14 bp, Homo sapiens
aagtgtttctgtta

SEQ ID NO: 3382631 - DNA, 14 bp, Homo sapiens
aagtgttttcagag

SEQ ID NO: 3382632 - DNA, 19 bp, Homo sapiens
aagttaaaagtaaaattgt

SEQ ID NO: 3382633 - DNA, 12 bp, Homo sapiens
aagttaaataaa

SEQ ID NO: 3382634 - DNA, 16 bp, Homo sapiens
aagttaataatgtatt

SEQ ID NO: 3382635 - DNA, 19 bp, Homo sapiens
aagttaattcacctatgtt

SEQ ID NO: 3382636 - DNA, 20 bp, Homo sapiens
aagttaattcacctatgtta

SEQ ID NO: 3382637 - DNA, 17 bp, Homo sapiens
aagttacaattacatct

SEQ ID NO: 3382638 - DNA, 21 bp, Homo sapiens
aagttactaggtaacttcata

SEQ ID NO: 3382639 - DNA, 16 bp, Homo sapiens
aagttacttattctag

SEQ ID NO: 3382640 - DNA, 11 bp, Homo sapiens
aagttactttg

SEQ ID NO: 3382641 - DNA, 18 bp, Homo sapiens
aagttactttgtaatttt

SEQ ID NO: 3382642 - DNA, 19 bp, Homo sapiens
aagttactttgtcagaggc

SEQ ID NO: 3382643 - DNA, 22 bp, Homo sapiens
aagttagaactagccaaaccag

SEQ ID NO: 3382644 - DNA, 23 bp, Homo sapiens
aagttagaaggcttaagaactgc

SEQ ID NO: 3382645 - DNA, 22 bp, Homo sapiens
aagttagagaactaaactagtt

SEQ ID NO: 3382646 - DNA, 23 bp, Homo sapiens
aagttagtgcttgttctaagatt

SEQ ID NO: 3382647 - DNA, 23 bp, Homo sapiens
aagttagtggaaatctgaacatt

SEQ ID NO: 3382648 - DNA, 14 bp, Homo sapiens
aagttataagactc

SEQ ID NO: 3382649 - DNA, 18 bp, Homo sapiens
aagttatattagtgaaga

SEQ ID NO: 3382650 - DNA, 20 bp, Homo sapiens
aagttattgtacagctgttt

SEQ ID NO: 3382651 - DNA, 15 bp, Homo sapiens
aagttatttcttgtt

SEQ ID NO: 3382652 - DNA, 10 bp, Homo sapiens
aagttatttt

SEQ ID NO: 3382653 - DNA, 15 bp, Homo sapiens
aagttattttatgac

SEQ ID NO: 3382654 - DNA, 21 bp, Homo sapiens
aagttattttatgacatgaaa

SEQ ID NO: 3382655 - DNA, 16 bp, Homo sapiens
aagttatttttgtaca

SEQ ID NO: 3382656 - DNA, 18 bp, Homo sapiens
aagttatttttgtacatg

SEQ ID NO: 3382657 - DNA, 19 bp, Homo sapiens
aagttatttttgtacatgt

SEQ ID NO: 3382658 - DNA, 19 bp, Homo sapiens
aagttcatacctaagtact

SEQ ID NO: 3382659 - DNA, 14 bp, Homo sapiens
aagttcatagggtc

SEQ ID NO: 3382660 - DNA, 21 bp, Homo sapiens
aagttcatattccatatttat

SEQ ID NO: 3382661 - DNA, 19 bp, Homo sapiens
aagttccagtgttctctct

SEQ ID NO: 3382662 - DNA, 19 bp, Homo sapiens
aagttccatgggatacaac

SEQ ID NO: 3382663 - DNA, 20 bp, Homo sapiens
aagttcccccatcagttccc

SEQ ID NO: 3382664 - DNA, 14 bp, Homo sapiens
aagttccctacttc

SEQ ID NO: 3382665 - DNA, 16 bp, Homo sapiens
aagttccctggagaaa

SEQ ID NO: 3382666 - DNA, 23 bp, Homo sapiens
aagttccctggagaaaaaaattg

SEQ ID NO: 3382667 - DNA, 18 bp, Homo sapiens
aagttcgaacatgtttca

SEQ ID NO: 3382668 - DNA, 23 bp, Homo sapiens
aagttcgaacatgtttcacttaa

SEQ ID NO: 3382669 - DNA, 16 bp, Homo sapiens
aagttctaagattcta

SEQ ID NO: 3382670 - DNA, 17 bp, Homo sapiens
aagttctaagattctga

SEQ ID NO: 3382671 - DNA, 16 bp, Homo sapiens
aagttctcaaagttaa

SEQ ID NO: 3382672 - DNA, 21 bp, Homo sapiens
aattgtttccaacttgtctgg

SEQ ID NO: 3382673 - DNA, 17 bp, Homo sapiens
aattgtttggcttcctc

SEQ ID NO: 3382674 - DNA, 15 bp, Homo sapiens
aattgtttgtcctca

SEQ ID NO: 3382675 - DNA, 19 bp, Homo sapiens
aattgttttaaagagatac

SEQ ID NO: 3382676 - DNA, 13 bp, Homo sapiens
aattgttttcact

SEQ ID NO: 3382677 - DNA, 14 bp, Homo sapiens
aattgttttcttta

SEQ ID NO: 3382678 - DNA, 20 bp, Homo sapiens
aattgttttttaaagcaagt

SEQ ID NO: 3382679 - DNA, 17 bp, Homo sapiens
aatttaaaaagcaaaaa

SEQ ID NO: 3382680 - DNA, 12 bp, Homo sapiens
aatttaaaatta

SEQ ID NO: 3382681 - DNA, 19 bp, Homo sapiens
aatttaaaattaagtagaa

SEQ ID NO: 3382682 - DNA, 10 bp, Homo sapiens
aatttaaaca

SEQ ID NO: 3382683 - DNA, 15 bp, Homo sapiens
aatttaaacacctcc

SEQ ID NO: 3382684 - DNA, 19 bp, Homo sapiens
aatttaaacacctcctcat

SEQ ID NO: 3382685 - DNA, 19 bp, Homo sapiens
aatttaaacaggcccagca

SEQ ID NO: 3382686 - DNA, 20 bp, Homo sapiens
aatttaaacaggcccagcat

SEQ ID NO: 3382687 - DNA, 13 bp, Homo sapiens
aatttaaacatta

SEQ ID NO: 3382688 - DNA, 19 bp, Homo sapiens
aatttaaatataattctgt

SEQ ID NO: 3382689 - DNA, 23 bp, Homo sapiens
aatttaaatataattctgtaaat

SEQ ID NO: 3382690 - DNA, 12 bp, Homo sapiens
aatttaaatgaa

SEQ ID NO: 3382691 - DNA, 18 bp, Homo sapiens
aatttaaatgaaagaaaa

SEQ ID NO: 3382692 - DNA, 19 bp, Homo sapiens
aatttaaatgaaagaaaat

SEQ ID NO: 3382693 - DNA, 15 bp, Homo sapiens
aatttaaatttaaag

SEQ ID NO: 3382694 - DNA, 16 bp, Homo sapiens
aatttaacaaactaaa

SEQ ID NO: 3382695 - DNA, 17 bp, Homo sapiens
aatttaacaaactaaaa

SEQ ID NO: 3382696 - DNA, 13 bp, Homo sapiens
aatttaagcattg

SEQ ID NO: 3382697 - DNA, 16 bp, Homo sapiens
aatttaagcattgttt

SEQ ID NO: 3382698 - DNA, 21 bp, Homo sapiens
aatttaagcattgtttgctta

SEQ ID NO: 3382699 - DNA, 18 bp, Homo sapiens
aatttaagctgtaaatta

SEQ ID NO: 3382700 - DNA, 14 bp, Homo sapiens
aatttaagtatctt

SEQ ID NO: 3382701 - DNA, 20 bp, Homo sapiens
aatttaagtgcgtgtgtaga

SEQ ID NO: 3382702 - DNA, 23 bp, Homo sapiens
aatttaagtgcgtgtgtagagtt

SEQ ID NO: 3382703 - DNA, 17 bp, Homo sapiens
aatttaatgctgccttt

SEQ ID NO: 3382704 - DNA, 13 bp, Homo sapiens
aatttacatttat

SEQ ID NO: 3382705 - DNA, 14 bp, Homo sapiens
aatttacctaagat

SEQ ID NO: 3382706 - DNA, 13 bp, Homo sapiens
aatttactatata

SEQ ID NO: 3382707 - DNA, 15 bp, Homo sapiens
aatttacttgttttg

SEQ ID NO: 3382708 - DNA, 12 bp, Homo sapiens
aatttagatctt

SEQ ID NO: 3382709 - DNA, 16 bp, Homo sapiens
aatttagggtactaaa

SEQ ID NO: 3382710 - DNA, 17 bp, Homo sapiens
aatttagggtactaaat

SEQ ID NO: 3382711 - DNA, 18 bp, Homo sapiens
aatttagggtactaaatt

SEQ ID NO: 3382712 - DNA, 20 bp, Homo sapiens
aatttaggtttttattagta

SEQ ID NO: 3382713 - DNA, 16 bp, Homo sapiens
aatttagtgtatccat

SEQ ID NO: 3382714 - DNA, 18 bp, Homo sapiens
aatttagtttttgttctt

SEQ ID NO: 3382715 - DNA, 14 bp, Homo sapiens
aatttataaaatta

SEQ ID NO: 3382716 - DNA, 15 bp, Homo sapiens
aatttataaaattag

SEQ ID NO: 3382717 - DNA, 16 bp, Homo sapiens
aatttataaaattaga

SEQ ID NO: 3382718 - DNA, 18 bp, Homo sapiens
aatttataaaattagaaa

SEQ ID NO: 3382719 - DNA, 15 bp, Homo sapiens
aatttatacaatatc

SEQ ID NO: 3382720 - DNA, 16 bp, Homo sapiens
aatttatcaaagcata

SEQ ID NO: 3382721 - DNA, 12 bp, Homo sapiens
aatttatctaaa

SEQ ID NO: 3382722 - DNA, 20 bp, Homo sapiens
aatttatgaagcagatttat

SEQ ID NO: 3382723 - DNA, 21 bp, Homo sapiens
aatttatgaattgaattatct

SEQ ID NO: 3382724 - DNA, 20 bp, Homo sapiens
aatttatgagtttttgatag

SEQ ID NO: 3382725 - DNA, 19 bp, Homo sapiens
aatttatgcatttcattca

SEQ ID NO: 3382726 - DNA, 21 bp, Homo sapiens
aatttatgcatttcattcaaa

SEQ ID NO: 3382727 - DNA, 22 bp, Homo sapiens
aatttatgcatttcattcaaat

SEQ ID NO: 3382728 - DNA, 15 bp, Homo sapiens
aatttattaaaatga

SEQ ID NO: 3382729 - DNA, 19 bp, Homo sapiens
aatttattacttgttgcaa

SEQ ID NO: 3382730 - DNA, 15 bp, Homo sapiens
aatttattgtctgtc

SEQ ID NO: 3382731 - DNA, 22 bp, Homo sapiens
aatttatttattaagatggatt

SEQ ID NO: 3382732 - DNA, 21 bp, Homo sapiens
aatttatttccactaaaaata

SEQ ID NO: 3382733 - DNA, 17 bp, Homo sapiens
aatttatttcttaacct

SEQ ID NO: 3382734 - DNA, 17 bp, Homo sapiens
aatttcaaaaatataac

SEQ ID NO: 3382735 - DNA, 15 bp, Homo sapiens
aatttcaaaagacat

SEQ ID NO: 3382736 - DNA, 16 bp, Homo sapiens
aatttcaaaatgcttt

SEQ ID NO: 3382737 - DNA, 15 bp, Homo sapiens
aatttcaaggttcta

SEQ ID NO: 3382738 - DNA, 16 bp, Homo sapiens
aatttcacctgtaaac

SEQ ID NO: 3382739 - DNA, 22 bp, Homo sapiens
aatttcactactagattgacta

SEQ ID NO: 3382740 - DNA, 17 bp, Homo sapiens
aatttccagtacctttg

SEQ ID NO: 3382741 - DNA, 15 bp, Homo sapiens
aatttccctcaggtt

SEQ ID NO: 3382742 - DNA, 13 bp, Homo sapiens
aatttcctctatt

SEQ ID NO: 3382743 - DNA, 19 bp, Homo sapiens
aatttcgcttcttagaaca

SEQ ID NO: 3382744 - DNA, 18 bp, Homo sapiens
aatttcggattttttcca

SEQ ID NO: 3382745 - DNA, 22 bp, Homo sapiens
aatttctaaaaagattagcaag

SEQ ID NO: 3382746 - DNA, 13 bp, Homo sapiens
aatttctaaagat

SEQ ID NO: 3382747 - DNA, 15 bp, Homo sapiens
aatttctaaagataa

SEQ ID NO: 3382748 - DNA, 16 bp, Homo sapiens
aatttctgtcagaatg

SEQ ID NO: 3382749 - DNA, 18 bp, Homo sapiens
aatttctgtcagaatgct

SEQ ID NO: 3382750 - DNA, 13 bp, Homo sapiens
aatttctgtcctt

SEQ ID NO: 3382751 - DNA, 21 bp, Homo sapiens
aatttcttcactgttgaaaat

SEQ ID NO: 3382752 - DNA, 12 bp, Homo sapiens
aatttcttcctt

SEQ ID NO: 3382753 - DNA, 13 bp, Homo sapiens
aatttcttccttc

SEQ ID NO: 3382754 - DNA, 21 bp, Homo sapiens
aatttcttgctctatctctca

SEQ ID NO: 3382755 - DNA, 12 bp, Homo sapiens
aatttcttttcc

SEQ ID NO: 3382756 - DNA, 23 bp, Homo sapiens
aatttcttttccttcattcatag

SEQ ID NO: 3382757 - DNA, 19 bp, Homo sapiens
aatttcttttttcctctga

SEQ ID NO: 3382758 - DNA, 22 bp, Homo sapiens
aatttctttttttcctttttaa

SEQ ID NO: 3382759 - DNA, 14 bp, Homo sapiens
aatttgaagtaatg

SEQ ID NO: 3382760 - DNA, 13 bp, Homo sapiens
aatttgaatgaaa

SEQ ID NO: 3382761 - DNA, 14 bp, Homo sapiens
aatttgaatgaaaa

SEQ ID NO: 3382762 - DNA, 16 bp, Homo sapiens
aatttgaatgaaaaat

SEQ ID NO: 3382763 - DNA, 18 bp, Homo sapiens
aatttgagagaaatatga

SEQ ID NO: 3382764 - DNA, 12 bp, Homo sapiens
aatttgatactt

SEQ ID NO: 3382765 - DNA, 20 bp, Homo sapiens
aatttgatacttatattttc

SEQ ID NO: 3382766 - DNA, 18 bp, Homo sapiens
aatttgatggtatttctt

SEQ ID NO: 3382767 - DNA, 14 bp, Homo sapiens
aatttgattgattt

SEQ ID NO: 3382768 - DNA, 17 bp, Homo sapiens
aatttgattgatttgaa

SEQ ID NO: 3382769 - DNA, 20 bp, Homo sapiens
aatttgattgatttgaagaa

SEQ ID NO: 3382770 - DNA, 12 bp, Homo sapiens
aatttgatttcc

SEQ ID NO: 3382771 - DNA, 22 bp, Homo sapiens
aatttgcaacaggggaggaaaa

SEQ ID NO: 3382772 - DNA, 13 bp, Homo sapiens
aatttgcaactca

SEQ ID NO: 3382773 - DNA, 17 bp, Homo sapiens
aatttgcatattctatt

SEQ ID NO: 3382774 - DNA, 19 bp, Homo sapiens
aatttgcatattctattgt

SEQ ID NO: 3382775 - DNA, 14 bp, Homo sapiens
aatttggaaatcct

SEQ ID NO: 3382776 - DNA, 12 bp, Homo sapiens
aatttggattta

SEQ ID NO: 3382777 - DNA, 18 bp, Homo sapiens
aatttgggggaaaattta

SEQ ID NO: 3382778 - DNA, 17 bp, Homo sapiens
aatttggttctaggccg

SEQ ID NO: 3382779 - DNA, 12 bp, Homo sapiens
aatttgtaaact

SEQ ID NO: 3382780 - DNA, 18 bp, Homo sapiens
aatttgtaaacttctgaa

SEQ ID NO: 3382781 - DNA, 20 bp, Homo sapiens
aatttgtaaacttctgaaga

SEQ ID NO: 3382782 - DNA, 22 bp, Homo sapiens
aatttgtaaacttctgaagact

SEQ ID NO: 3382783 - DNA, 12 bp, Homo sapiens
aatttgtatttt

SEQ ID NO: 3382784 - DNA, 20 bp, Homo sapiens
aatttgtcagcgttctacca

SEQ ID NO: 3382785 - DNA, 20 bp, Homo sapiens
aatttgtctgaaacatttca

SEQ ID NO: 3382786 - DNA, 14 bp, Homo sapiens
aatttgtgtgtttt

SEQ ID NO: 3382787 - DNA, 17 bp, Homo sapiens
aatttgtgtgtttttag

SEQ ID NO: 3382788 - DNA, 20 bp, Homo sapiens
aatttgttaattcctatgaa

SEQ ID NO: 3382789 - DNA, 19 bp, Homo sapiens
aatttgttatacttcaaaa

SEQ ID NO: 3382790 - DNA, 21 bp, Homo sapiens
aatttgtttaattaaatttaa

SEQ ID NO: 3382791 - DNA, 17 bp, Homo sapiens
aatttgtttgaaatctt

SEQ ID NO: 3382792 - DNA, 17 bp, Homo sapiens
aatttgtttgtattttt

SEQ ID NO: 3382793 - DNA, 15 bp, Homo sapiens
aattttaaaaagcag

SEQ ID NO: 3382794 - DNA, 19 bp, Homo sapiens
aattttaaaagtctatttt

SEQ ID NO: 3382795 - DNA, 13 bp, Homo sapiens
aattttaaagcca

SEQ ID NO: 3382796 - DNA, 15 bp, Homo sapiens
aattttaaagccatt

SEQ ID NO: 3382797 - DNA, 19 bp, Homo sapiens
aattttaaagtaatttcta

SEQ ID NO: 3382798 - DNA, 13 bp, Homo sapiens
aattttaaagtat

SEQ ID NO: 3382799 - DNA, 21 bp, Homo sapiens
acacaaattttcaagtttaca

SEQ ID NO: 3382800 - DNA, 23 bp, Homo sapiens
acacaaattttcaagtttacact

SEQ ID NO: 3382801 - DNA, 18 bp, Homo sapiens
acacaagaaaaagataag

SEQ ID NO: 3382802 - DNA, 14 bp, Homo sapiens
acacaagtaaaact

SEQ ID NO: 3382803 - DNA, 14 bp, Homo sapiens
acacaagtaaacat

SEQ ID NO: 3382804 - DNA, 15 bp, Homo sapiens
acacaagtcctgtga

SEQ ID NO: 3382805 - DNA, 12 bp, Homo sapiens
acacaataccta

SEQ ID NO: 3382806 - DNA, 21 bp, Homo sapiens
acacaataggtctttctctca

SEQ ID NO: 3382807 - DNA, 23 bp, Homo sapiens
acacaataggtctttctctcagt

SEQ ID NO: 3382808 - DNA, 14 bp, Homo sapiens
acacaatatgaata

SEQ ID NO: 3382809 - DNA, 22 bp, Homo sapiens
acacaatatgtatgctttttac

SEQ ID NO: 3382810 - DNA, 19 bp, Homo sapiens
acacaattcattggctcct

SEQ ID NO: 3382811 - DNA, 11 bp, Homo sapiens
acacacacaca

SEQ ID NO: 3382812 - DNA, 13 bp, Homo sapiens
acacacacacaca

SEQ ID NO: 3382813 - DNA, 15 bp, Homo sapiens
acacacacacacaca

SEQ ID NO: 3382814 - DNA, 15 bp, Homo sapiens
acacacacacacatc

SEQ ID NO: 3382815 - DNA, 13 bp, Homo sapiens
acacacacacatc

SEQ ID NO: 3382816 - DNA, 13 bp, Homo sapiens
acacacacagaaa

SEQ ID NO: 3382817 - DNA, 14 bp, Homo sapiens
acacacacagatgt

SEQ ID NO: 3382818 - DNA, 16 bp, Homo sapiens
acacacacgatgcatt

SEQ ID NO: 3382819 - DNA, 12 bp, Homo sapiens
acacacacgcac

SEQ ID NO: 3382820 - DNA, 21 bp, Homo sapiens
acacacacgcacgcacacaca

SEQ ID NO: 3382821 - DNA, 16 bp, Homo sapiens
acacacagaaaagcat

SEQ ID NO: 3382822 - DNA, 13 bp, Homo sapiens
acacacagaaatg

SEQ ID NO: 3382823 - DNA, 19 bp, Homo sapiens
acacacagaaatgtgtcaa

SEQ ID NO: 3382824 - DNA, 19 bp, Homo sapiens
acacacagatacacacaca

SEQ ID NO: 3382825 - DNA, 17 bp, Homo sapiens
acacacagctctgtcct

SEQ ID NO: 3382826 - DNA, 11 bp, Homo sapiens
acacacagctg

SEQ ID NO: 3382827 - DNA, 21 bp, Homo sapiens
acacacagctgggcaaagcca

SEQ ID NO: 3382828 - DNA, 12 bp, Homo sapiens
acacacagtacg

SEQ ID NO: 3382829 - DNA, 12 bp, Homo sapiens
acacacatagat

SEQ ID NO: 3382830 - DNA, 12 bp, Homo sapiens
acacacatgcac

SEQ ID NO: 3382831 - DNA, 13 bp, Homo sapiens
acacacatgcaca

SEQ ID NO: 3382832 - DNA, 16 bp, Homo sapiens
acacacatgccctcct

SEQ ID NO: 3382833 - DNA, 17 bp, Homo sapiens
acacacatgccctcctg

SEQ ID NO: 3382834 - DNA, 14 bp, Homo sapiens
acacaccagagccc

SEQ ID NO: 3382835 - DNA, 13 bp, Homo sapiens
acacaccctgagg

SEQ ID NO: 3382836 - DNA, 14 bp, Homo sapiens
acacaccctgaggt

SEQ ID NO: 3382837 - DNA, 13 bp, Homo sapiens
acacaccctgccc

SEQ ID NO: 3382838 - DNA, 14 bp, Homo sapiens
acacaccctgcccc

SEQ ID NO: 3382839 - DNA, 18 bp, Homo sapiens
acacaccctgcccctgca

SEQ ID NO: 3382840 - DNA, 11 bp, Homo sapiens
acacacctgta

SEQ ID NO: 3382841 - DNA, 13 bp, Homo sapiens
acacacgatgcat

SEQ ID NO: 3382842 - DNA, 15 bp, Homo sapiens
acacacgcacgcaca

SEQ ID NO: 3382843 - DNA, 17 bp, Homo sapiens
acacacgcacgcacaca

SEQ ID NO: 3382844 - DNA, 21 bp, Homo sapiens
acacacgcgtgcacacaccag

SEQ ID NO: 3382845 - DNA, 21 bp, Homo sapiens
acacacgtatttatatttgga

SEQ ID NO: 3382846 - DNA, 23 bp, Homo sapiens
acacacgtatttatatttggaaa

SEQ ID NO: 3382847 - DNA, 22 bp, Homo sapiens
acacacgtgcgtgcgagcacac

SEQ ID NO: 3382848 - DNA, 12 bp, Homo sapiens
acacactgaaag

SEQ ID NO: 3382849 - DNA, 13 bp, Homo sapiens
acacactttattt

SEQ ID NO: 3382850 - DNA, 19 bp, Homo sapiens
acacactttttaagaaata

SEQ ID NO: 3382851 - DNA, 21 bp, Homo sapiens
acacagactggcaataaactc

SEQ ID NO: 3382852 - DNA, 17 bp, Homo sapiens
acacagagaagggaaga

SEQ ID NO: 3382853 - DNA, 21 bp, Homo sapiens
acacagaggaagagcaggcac

SEQ ID NO: 3382854 - DNA, 20 bp, Homo sapiens
acacagatcccactggaaga

SEQ ID NO: 3382855 - DNA, 18 bp, Homo sapiens
acacagatgacaaattat

SEQ ID NO: 3382856 - DNA, 19 bp, Homo sapiens
acacagcacaccagccgct

SEQ ID NO: 3382857 - DNA, 14 bp, Homo sapiens
acacagcatgtgcc

SEQ ID NO: 3382858 - DNA, 15 bp, Homo sapiens
acacagctacagctt

SEQ ID NO: 3382859 - DNA, 17 bp, Homo sapiens
acacagctactctcccc

SEQ ID NO: 3382860 - DNA, 12 bp, Homo sapiens
acacagctctgt

SEQ ID NO: 3382861 - DNA, 12 bp, Homo sapiens
acacagctcttc

SEQ ID NO: 3382862 - DNA, 15 bp, Homo sapiens
acacagctcttcatt

SEQ ID NO: 3382863 - DNA, 22 bp, Homo sapiens
acacagctcttctccaggctgt

SEQ ID NO: 3382864 - DNA, 17 bp, Homo sapiens
acacagctgagcactta

SEQ ID NO: 3382865 - DNA, 19 bp, Homo sapiens
acacaggactgaaaaggga

SEQ ID NO: 3382866 - DNA, 15 bp, Homo sapiens
acacaggcagctttc

SEQ ID NO: 3382867 - DNA, 16 bp, Homo sapiens
acacaggcccggctcc

SEQ ID NO: 3382868 - DNA, 17 bp, Homo sapiens
acacaggcccggctcca

SEQ ID NO: 3382869 - DNA, 20 bp, Homo sapiens
acacaggcccggctccaggc

SEQ ID NO: 3382870 - DNA, 21 bp, Homo sapiens
acacaggggtggagtttctga

SEQ ID NO: 3382871 - DNA, 19 bp, Homo sapiens
acacaggtctcattgcttc

SEQ ID NO: 3382872 - DNA, 20 bp, Homo sapiens
acacaggtctcattgcttct

SEQ ID NO: 3382873 - DNA, 16 bp, Homo sapiens
acacagtattacttct

SEQ ID NO: 3382874 - DNA, 16 bp, Homo sapiens
acacagtcacattcga

SEQ ID NO: 3382875 - DNA, 13 bp, Homo sapiens
acacagtgagtcg

SEQ ID NO: 3382876 - DNA, 22 bp, Homo sapiens
acacagttgctgtcataagaat

SEQ ID NO: 3382877 - DNA, 20 bp, Homo sapiens
acacagttgggacccaaaac

SEQ ID NO: 3382878 - DNA, 15 bp, Homo sapiens
acacataaattatga

SEQ ID NO: 3382879 - DNA, 14 bp, Homo sapiens
acacataagaaaat

SEQ ID NO: 3382880 - DNA, 17 bp, Homo sapiens
acacatacagttttatg

SEQ ID NO: 3382881 - DNA, 19 bp, Homo sapiens
acacatacgtgcacagggt

SEQ ID NO: 3382882 - DNA, 23 bp, Homo sapiens
acacatagattaatggcactgat

SEQ ID NO: 3382883 - DNA, 17 bp, Homo sapiens
acacatagcatgtaatg

SEQ ID NO: 3382884 - DNA, 20 bp, Homo sapiens
acacatagcgccgtgctgta

SEQ ID NO: 3382885 - DNA, 21 bp, Homo sapiens
acacatagcgccgtgctgtaa

SEQ ID NO: 3382886 - DNA, 14 bp, Homo sapiens
acacatataaacat

SEQ ID NO: 3382887 - DNA, 23 bp, Homo sapiens
acacatatacctataatgtgtgt

SEQ ID NO: 3382888 - DNA, 14 bp, Homo sapiens
acacatccacccca

SEQ ID NO: 3382889 - DNA, 17 bp, Homo sapiens
acacatcccggcctctt

SEQ ID NO: 3382890 - DNA, 20 bp, Homo sapiens
acacatcccggcctcttcca

SEQ ID NO: 3382891 - DNA, 22 bp, Homo sapiens
acacatcccggcctcttccacc

SEQ ID NO: 3382892 - DNA, 21 bp, Homo sapiens
acacatccgccttttgtatac

SEQ ID NO: 3382893 - DNA, 23 bp, Homo sapiens
acacatccgccttttgtatacat

SEQ ID NO: 3382894 - DNA, 14 bp, Homo sapiens
acacatctcctcca

SEQ ID NO: 3382895 - DNA, 15 bp, Homo sapiens
acacatcttcaacag

SEQ ID NO: 3382896 - DNA, 15 bp, Homo sapiens
acacatcttccctag

SEQ ID NO: 3382897 - DNA, 22 bp, Homo sapiens
acacatgacgccagataaaatg

SEQ ID NO: 3382898 - DNA, 15 bp, Homo sapiens
acacatgccctcctg

SEQ ID NO: 3382899 - DNA, 18 bp, Homo sapiens
acacatgccttaaatttg

SEQ ID NO: 3382900 - DNA, 23 bp, Homo sapiens
acacatgccttaaatttgtttaa

SEQ ID NO: 3382901 - DNA, 23 bp, Homo sapiens
acacattagattttattttacta

SEQ ID NO: 3382902 - DNA, 16 bp, Homo sapiens
acacatttgctactgt

SEQ ID NO: 3382903 - DNA, 22 bp, Homo sapiens
acacatttgggatgttcctttt

SEQ ID NO: 3382904 - DNA, 13 bp, Homo sapiens
acacatttttttg

SEQ ID NO: 3382905 - DNA, 13 bp, Homo sapiens
acaccaaacttca

SEQ ID NO: 3382906 - DNA, 14 bp, Homo sapiens
acaccaaataaata

SEQ ID NO: 3382907 - DNA, 16 bp, Homo sapiens
acaccaaccagacagc

SEQ ID NO: 3382908 - DNA, 18 bp, Homo sapiens
acaccaaccagacagcac

SEQ ID NO: 3382909 - DNA, 13 bp, Homo sapiens
acaccaagcagca

SEQ ID NO: 3382910 - DNA, 16 bp, Homo sapiens
acaccaatcccagggc

SEQ ID NO: 3382911 - DNA, 17 bp, Homo sapiens
acaccacagacacacac

SEQ ID NO: 3382912 - DNA, 22 bp, Homo sapiens
acaccacagacacacacacgca

SEQ ID NO: 3382913 - DNA, 18 bp, Homo sapiens
acaccactgccctgcctg

SEQ ID NO: 3382914 - DNA, 19 bp, Homo sapiens
acaccactttctgctttcc

SEQ ID NO: 3382915 - DNA, 18 bp, Homo sapiens
acaccagagcagatgcag

SEQ ID NO: 3382916 - DNA, 19 bp, Homo sapiens
acaccagagcagatgcaga

SEQ ID NO: 3382917 - DNA, 22 bp, Homo sapiens
acaccagagcagatgcagagag

SEQ ID NO: 3382918 - DNA, 13 bp, Homo sapiens
acaccagagccca

SEQ ID NO: 3382919 - DNA, 23 bp, Homo sapiens
acaccagagcccaccttggctca

SEQ ID NO: 3382920 - DNA, 15 bp, Homo sapiens
acaccagcccccagg

SEQ ID NO: 3382921 - DNA, 13 bp, Homo sapiens
acaccagccgctg

SEQ ID NO: 3382922 - DNA, 14 bp, Homo sapiens
acaccatagtttac

SEQ ID NO: 3382923 - DNA, 16 bp, Homo sapiens
acaccatagtttacaa

SEQ ID NO: 3382924 - DNA, 15 bp, Homo sapiens
acaccattaccaaaa

SEQ ID NO: 3382925 - DNA, 18 bp, Homo sapiens
acaccattctcctgcctc

SEQ ID NO: 3382926 - DNA, 19 bp, Homo sapiens
acatacttcaaaaataatg

SEQ ID NO: 3382927 - DNA, 15 bp, Homo sapiens
acatactttatcaat

SEQ ID NO: 3382928 - DNA, 12 bp, Homo sapiens
acatagaaagtt

SEQ ID NO: 3382929 - DNA, 14 bp, Homo sapiens
acatagattaatgg

SEQ ID NO: 3382930 - DNA, 19 bp, Homo sapiens
acatagattaatggcactg

SEQ ID NO: 3382931 - DNA, 22 bp, Homo sapiens
acatagatttatttttcagttc

SEQ ID NO: 3382932 - DNA, 18 bp, Homo sapiens
acatagcccatccctgcc

SEQ ID NO: 3382933 - DNA, 19 bp, Homo sapiens
acatagcccatccctgcct

SEQ ID NO: 3382934 - DNA, 13 bp, Homo sapiens
acatagcccctgc

SEQ ID NO: 3382935 - DNA, 21 bp, Homo sapiens
acatagcgccgtgctgtaaat

SEQ ID NO: 3382936 - DNA, 21 bp, Homo sapiens
acatagctacccaaaagagaa

SEQ ID NO: 3382937 - DNA, 22 bp, Homo sapiens
acatagctacccaaaagagaaa

SEQ ID NO: 3382938 - DNA, 21 bp, Homo sapiens
acatagtaagaccccatctct

SEQ ID NO: 3382939 - DNA, 15 bp, Homo sapiens
acatagttatttatt

SEQ ID NO: 3382940 - DNA, 21 bp, Homo sapiens
acatagttggtaatgcttgga

SEQ ID NO: 3382941 - DNA, 17 bp, Homo sapiens
acatagttttaaactca

SEQ ID NO: 3382942 - DNA, 21 bp, Homo sapiens
acatatacctataatgtgtgt

SEQ ID NO: 3382943 - DNA, 23 bp, Homo sapiens
acatatacctataatgtgtgtat

SEQ ID NO: 3382944 - DNA, 11 bp, Homo sapiens
acatatatata

SEQ ID NO: 3382945 - DNA, 22 bp, Homo sapiens
acatatcaaaataggatttctt

SEQ ID NO: 3382946 - DNA, 15 bp, Homo sapiens
acatatcttagatgg

SEQ ID NO: 3382947 - DNA, 15 bp, Homo sapiens
acatatgaaaataca

SEQ ID NO: 3382948 - DNA, 14 bp, Homo sapiens
acatatgacttgat

SEQ ID NO: 3382949 - DNA, 19 bp, Homo sapiens
acatatgagtgtggaagcc

SEQ ID NO: 3382950 - DNA, 19 bp, Homo sapiens
acatatgtagaaacattta

SEQ ID NO: 3382951 - DNA, 21 bp, Homo sapiens
acatatgtgctggaattctaa

SEQ ID NO: 3382952 - DNA, 19 bp, Homo sapiens
acatattactgttgcattt

SEQ ID NO: 3382953 - DNA, 20 bp, Homo sapiens
acatattcaaagcagcagcc

SEQ ID NO: 3382954 - DNA, 21 bp, Homo sapiens
acatattgcaggagacatttt

SEQ ID NO: 3382955 - DNA, 12 bp, Homo sapiens
acatattgttag

SEQ ID NO: 3382956 - DNA, 12 bp, Homo sapiens
acatatttcatt

SEQ ID NO: 3382957 - DNA, 16 bp, Homo sapiens
acatatttcattttaa

SEQ ID NO: 3382958 - DNA, 16 bp, Homo sapiens
acatatttgtggaata

SEQ ID NO: 3382959 - DNA, 19 bp, Homo sapiens
acatatttgtggaataatg

SEQ ID NO: 3382960 - DNA, 18 bp, Homo sapiens
acatattttcctttagat

SEQ ID NO: 3382961 - DNA, 18 bp, Homo sapiens
acatcaaagcctggccta

SEQ ID NO: 3382962 - DNA, 14 bp, Homo sapiens
acatcaaataaact

SEQ ID NO: 3382963 - DNA, 16 bp, Homo sapiens
acatcaacatcttggt

SEQ ID NO: 3382964 - DNA, 16 bp, Homo sapiens
acatcaatgttcattg

SEQ ID NO: 3382965 - DNA, 18 bp, Homo sapiens
acatcaatttaaaaagca

SEQ ID NO: 3382966 - DNA, 13 bp, Homo sapiens
acatcacacacac

SEQ ID NO: 3382967 - DNA, 21 bp, Homo sapiens
acatcaccgacgcgtctcctg

SEQ ID NO: 3382968 - DNA, 22 bp, Homo sapiens
acatcaccgacgcgtctcctgt

SEQ ID NO: 3382969 - DNA, 23 bp, Homo sapiens
acatcaccgacgcgtctcctgtt

SEQ ID NO: 3382970 - DNA, 17 bp, Homo sapiens
acatcagaactgaaata

SEQ ID NO: 3382971 - DNA, 19 bp, Homo sapiens
acatcagacctgtcttcca

SEQ ID NO: 3382972 - DNA, 20 bp, Homo sapiens
acatcagacctgtcttccaa

SEQ ID NO: 3382973 - DNA, 23 bp, Homo sapiens
acatcagtttgatacagtattga

SEQ ID NO: 3382974 - DNA, 17 bp, Homo sapiens
acatcatgaattttaca

SEQ ID NO: 3382975 - DNA, 14 bp, Homo sapiens
acatcatgttattt

SEQ ID NO: 3382976 - DNA, 19 bp, Homo sapiens
acatccaactccagcaact

SEQ ID NO: 3382977 - DNA, 22 bp, Homo sapiens
acatccaaggagaaacagagac

SEQ ID NO: 3382978 - DNA, 20 bp, Homo sapiens
acatccattcccaagaaatg

SEQ ID NO: 3382979 - DNA, 16 bp, Homo sapiens
acatcccagaccagcc

SEQ ID NO: 3382980 - DNA, 14 bp, Homo sapiens
acatcccagcctgt

SEQ ID NO: 3382981 - DNA, 15 bp, Homo sapiens
acatcccggcctctt

SEQ ID NO: 3382982 - DNA, 18 bp, Homo sapiens
acatccctcctgctttta

SEQ ID NO: 3382983 - DNA, 13 bp, Homo sapiens
acatcccttcctg

SEQ ID NO: 3382984 - DNA, 17 bp, Homo sapiens
acatcccttcctggaaa

SEQ ID NO: 3382985 - DNA, 19 bp, Homo sapiens
acatcccttcctggaaaca

SEQ ID NO: 3382986 - DNA, 23 bp, Homo sapiens
acatcccttcctggaaacagcat

SEQ ID NO: 3382987 - DNA, 20 bp, Homo sapiens
acatccgccttttgtataca

SEQ ID NO: 3382988 - DNA, 17 bp, Homo sapiens
acatcctccgtccagcc

SEQ ID NO: 3382989 - DNA, 13 bp, Homo sapiens
acatcctcttctg

SEQ ID NO: 3382990 - DNA, 19 bp, Homo sapiens
acatcctgtataagcactg

SEQ ID NO: 3382991 - DNA, 13 bp, Homo sapiens
acatcctgtgtca

SEQ ID NO: 3382992 - DNA, 18 bp, Homo sapiens
acatcgatatgtatatca

SEQ ID NO: 3382993 - DNA, 21 bp, Homo sapiens
acatcgcaatagttttttact

SEQ ID NO: 3382994 - DNA, 17 bp, Homo sapiens
acatcgtgaaaccctgt

SEQ ID NO: 3382995 - DNA, 20 bp, Homo sapiens
acatcgtgaaaccctgtctc

SEQ ID NO: 3382996 - DNA, 19 bp, Homo sapiens
acatctattataaaaccat

SEQ ID NO: 3382997 - DNA, 20 bp, Homo sapiens
acatctcaggggccagagga

SEQ ID NO: 3382998 - DNA, 12 bp, Homo sapiens
acatctcgggag

SEQ ID NO: 3382999 - DNA, 15 bp, Homo sapiens
acatctctgaaagca

SEQ ID NO: 3383000 - DNA, 18 bp, Homo sapiens
acatctggcttattttaa

SEQ ID NO: 3383001 - DNA, 19 bp, Homo sapiens
acatctggcttattttaat

SEQ ID NO: 3383002 - DNA, 20 bp, Homo sapiens
acatctggcttattttaatg

SEQ ID NO: 3383003 - DNA, 21 bp, Homo sapiens
acatctggcttattttaatgt

SEQ ID NO: 3383004 - DNA, 17 bp, Homo sapiens
acatcttgctctgctga

SEQ ID NO: 3383005 - DNA, 22 bp, Homo sapiens
acatcttgctctgctgacagac

SEQ ID NO: 3383006 - DNA, 13 bp, Homo sapiens
acatctttatccg

SEQ ID NO: 3383007 - DNA, 22 bp, Homo sapiens
acatctttattgaaattctatt

SEQ ID NO: 3383008 - DNA, 14 bp, Homo sapiens
acatctttcctgtc

SEQ ID NO: 3383009 - DNA, 14 bp, Homo sapiens
acatgaaaagttat

SEQ ID NO: 3383010 - DNA, 15 bp, Homo sapiens
acatgaaaagttatt

SEQ ID NO: 3383011 - DNA, 23 bp, Homo sapiens
acatgaaacctacacactgtcat

SEQ ID NO: 3383012 - DNA, 22 bp, Homo sapiens
acatgaaagaacccaagacatc

SEQ ID NO: 3383013 - DNA, 11 bp, Homo sapiens
acatgaaagcg

SEQ ID NO: 3383014 - DNA, 16 bp, Homo sapiens
acatgaagaagctaaa

SEQ ID NO: 3383015 - DNA, 13 bp, Homo sapiens
acatgaagctgtt

SEQ ID NO: 3383016 - DNA, 23 bp, Homo sapiens
acatgaatcccacccacatgtga

SEQ ID NO: 3383017 - DNA, 15 bp, Homo sapiens
acatgaatgcacact

SEQ ID NO: 3383018 - DNA, 15 bp, Homo sapiens
acatgacacccgtga

SEQ ID NO: 3383019 - DNA, 14 bp, Homo sapiens
acatgacactgacc

SEQ ID NO: 3383020 - DNA, 16 bp, Homo sapiens
acatgacactgacctt

SEQ ID NO: 3383021 - DNA, 13 bp, Homo sapiens
acatgactgggcc

SEQ ID NO: 3383022 - DNA, 15 bp, Homo sapiens
acatgagaacaaaca

SEQ ID NO: 3383023 - DNA, 16 bp, Homo sapiens
acatgaggggacattt

SEQ ID NO: 3383024 - DNA, 17 bp, Homo sapiens
acatgaggggacatttt

SEQ ID NO: 3383025 - DNA, 15 bp, Homo sapiens
acatgatcttcttta

SEQ ID NO: 3383026 - DNA, 14 bp, Homo sapiens
acatgcaaaaagaa

SEQ ID NO: 3383027 - DNA, 21 bp, Homo sapiens
acatgcaaaaagaaatgacta

SEQ ID NO: 3383028 - DNA, 14 bp, Homo sapiens
acatgcaataaaat

SEQ ID NO: 3383029 - DNA, 15 bp, Homo sapiens
acatgcaataaaatt

SEQ ID NO: 3383030 - DNA, 12 bp, Homo sapiens
acatgcacacac

SEQ ID NO: 3383031 - DNA, 16 bp, Homo sapiens
acatgcactatgagga

SEQ ID NO: 3383032 - DNA, 12 bp, Homo sapiens
acatgcactgac

SEQ ID NO: 3383033 - DNA, 19 bp, Homo sapiens
acatgcactgacccttcca

SEQ ID NO: 3383034 - DNA, 22 bp, Homo sapiens
acatgcagttcattattttgtg

SEQ ID NO: 3383035 - DNA, 23 bp, Homo sapiens
acatgcagttcattattttgtgg

SEQ ID NO: 3383036 - DNA, 13 bp, Homo sapiens
acatgcattgttg

SEQ ID NO: 3383037 - DNA, 17 bp, Homo sapiens
acatgcatttgaggtca

SEQ ID NO: 3383038 - DNA, 22 bp, Homo sapiens
acatgccacatcaaacctttga

SEQ ID NO: 3383039 - DNA, 22 bp, Homo sapiens
acatgccagaaggaatcttctc

SEQ ID NO: 3383040 - DNA, 22 bp, Homo sapiens
acatgcctgccccaaacaaata

SEQ ID NO: 3383041 - DNA, 18 bp, Homo sapiens
acatgctaggatgcggaa

SEQ ID NO: 3383042 - DNA, 20 bp, Homo sapiens
acatgctcacctctagcctt

SEQ ID NO: 3383043 - DNA, 12 bp, Homo sapiens
acatgctctttt

SEQ ID NO: 3383044 - DNA, 21 bp, Homo sapiens
acatgctgagtctcccaaggc

SEQ ID NO: 3383045 - DNA, 18 bp, Homo sapiens
acatgctgctatacacaa

SEQ ID NO: 3383046 - DNA, 18 bp, Homo sapiens
acatgctgtgctctttga

SEQ ID NO: 3383047 - DNA, 23 bp, Homo sapiens
acatgctgtgctctttgaagaga

SEQ ID NO: 3383048 - DNA, 13 bp, Homo sapiens
acatggaaaagga

SEQ ID NO: 3383049 - DNA, 14 bp, Homo sapiens
acatggaagagaga

SEQ ID NO: 3383050 - DNA, 14 bp, Homo sapiens
acatggacttgtat

SEQ ID NO: 3383051 - DNA, 15 bp, Homo sapiens
acatggacttgtata

SEQ ID NO: 3383052 - DNA, 17 bp, Homo sapiens
accagtgcaacagcact

SEQ ID NO: 3383053 - DNA, 14 bp, Homo sapiens
accagtgccaagga

SEQ ID NO: 3383054 - DNA, 13 bp, Homo sapiens
accagtgtagcct

SEQ ID NO: 3383055 - DNA, 22 bp, Homo sapiens
accagttctcgttttgggccag

SEQ ID NO: 3383056 - DNA, 16 bp, Homo sapiens
accagttggccatgat

SEQ ID NO: 3383057 - DNA, 18 bp, Homo sapiens
accagttgggagcactgg

SEQ ID NO: 3383058 - DNA, 19 bp, Homo sapiens
accagttgggagcactgga

SEQ ID NO: 3383059 - DNA, 15 bp, Homo sapiens
accagttgtatttaa

SEQ ID NO: 3383060 - DNA, 19 bp, Homo sapiens
accagttgtatttaatttt

SEQ ID NO: 3383061 - DNA, 21 bp, Homo sapiens
accataagggactgtgccaga

SEQ ID NO: 3383062 - DNA, 19 bp, Homo sapiens
accataattttttttaaag

SEQ ID NO: 3383063 - DNA, 23 bp, Homo sapiens
accatagtaccatttatacaaat

SEQ ID NO: 3383064 - DNA, 16 bp, Homo sapiens
accatatgaacatata

SEQ ID NO: 3383065 - DNA, 22 bp, Homo sapiens
accatattgtgcttcacagtag

SEQ ID NO: 3383066 - DNA, 20 bp, Homo sapiens
accatatttatccatttgta

SEQ ID NO: 3383067 - DNA, 12 bp, Homo sapiens
accatattttat

SEQ ID NO: 3383068 - DNA, 20 bp, Homo sapiens
accatattttattgtatttt

SEQ ID NO: 3383069 - DNA, 18 bp, Homo sapiens
accatcacaatacagata

SEQ ID NO: 3383070 - DNA, 13 bp, Homo sapiens
accatcaccaccg

SEQ ID NO: 3383071 - DNA, 19 bp, Homo sapiens
accatcaccaccgcctctg

SEQ ID NO: 3383072 - DNA, 20 bp, Homo sapiens
accatcaccaccgcctctgg

SEQ ID NO: 3383073 - DNA, 16 bp, Homo sapiens
accatcagaattcaga

SEQ ID NO: 3383074 - DNA, 18 bp, Homo sapiens
accatcagaattcagaat

SEQ ID NO: 3383075 - DNA, 14 bp, Homo sapiens
accatcagggacag

SEQ ID NO: 3383076 - DNA, 22 bp, Homo sapiens
accatccactctaccctcccac

SEQ ID NO: 3383077 - DNA, 17 bp, Homo sapiens
accatccccaccccacc

SEQ ID NO: 3383078 - DNA, 21 bp, Homo sapiens
accatccctgccacatacagg

SEQ ID NO: 3383079 - DNA, 17 bp, Homo sapiens
accatcctgcagcctcc

SEQ ID NO: 3383080 - DNA, 18 bp, Homo sapiens
accatcctgtattcttca

SEQ ID NO: 3383081 - DNA, 12 bp, Homo sapiens
accatctctctt

SEQ ID NO: 3383082 - DNA, 16 bp, Homo sapiens
accatctgatgtttca

SEQ ID NO: 3383083 - DNA, 14 bp, Homo sapiens
accatctgctttta

SEQ ID NO: 3383084 - DNA, 16 bp, Homo sapiens
accatctggcctggcc

SEQ ID NO: 3383085 - DNA, 17 bp, Homo sapiens
accatctggcctggcct

SEQ ID NO: 3383086 - DNA, 16 bp, Homo sapiens
accatctggggcacct

SEQ ID NO: 3383087 - DNA, 18 bp, Homo sapiens
accatcttctgtgtttat

SEQ ID NO: 3383088 - DNA, 19 bp, Homo sapiens
accatcttttattcttttt

SEQ ID NO: 3383089 - DNA, 14 bp, Homo sapiens
accatgaaacaaag

SEQ ID NO: 3383090 - DNA, 15 bp, Homo sapiens
accatgaagacagga

SEQ ID NO: 3383091 - DNA, 18 bp, Homo sapiens
accatgagaagagggcct

SEQ ID NO: 3383092 - DNA, 20 bp, Homo sapiens
accatgagaagagggcctgt

SEQ ID NO: 3383093 - DNA, 19 bp, Homo sapiens
accatgagaatttgcaaca

SEQ ID NO: 3383094 - DNA, 20 bp, Homo sapiens
accatgagtgaatttatatc

SEQ ID NO: 3383095 - DNA, 17 bp, Homo sapiens
accatgcaggaaggaaa

SEQ ID NO: 3383096 - DNA, 20 bp, Homo sapiens
accatgcctcactaattttt

SEQ ID NO: 3383097 - DNA, 12 bp, Homo sapiens
accatgctgctt

SEQ ID NO: 3383098 - DNA, 23 bp, Homo sapiens
accatgctgctttttggcacagt

SEQ ID NO: 3383099 - DNA, 16 bp, Homo sapiens
accatggagacaagaa

SEQ ID NO: 3383100 - DNA, 15 bp, Homo sapiens
accatggctgaagga

SEQ ID NO: 3383101 - DNA, 21 bp, Homo sapiens
accatggttaagagtccaaga

SEQ ID NO: 3383102 - DNA, 21 bp, Homo sapiens
accatgtgccatctgtacata

SEQ ID NO: 3383103 - DNA, 16 bp, Homo sapiens
accatgttcattataa

SEQ ID NO: 3383104 - DNA, 17 bp, Homo sapiens
accattaaaactgcttt

SEQ ID NO: 3383105 - DNA, 19 bp, Homo sapiens
accattaaaactgcttttt

SEQ ID NO: 3383106 - DNA, 19 bp, Homo sapiens
accattcctgcctttaagc

SEQ ID NO: 3383107 - DNA, 13 bp, Homo sapiens
accattctcctgc

SEQ ID NO: 3383108 - DNA, 13 bp, Homo sapiens
accattctgactc

SEQ ID NO: 3383109 - DNA, 11 bp, Homo sapiens
accattctgtg

SEQ ID NO: 3383110 - DNA, 13 bp, Homo sapiens
accattgaaggct

SEQ ID NO: 3383111 - DNA, 16 bp, Homo sapiens
accattgagtccctgc

SEQ ID NO: 3383112 - DNA, 16 bp, Homo sapiens
accatttatacaaatt

SEQ ID NO: 3383113 - DNA, 22 bp, Homo sapiens
accatttatacaaattagaaaa

SEQ ID NO: 3383114 - DNA, 22 bp, Homo sapiens
accatttgcatggctccagaaa

SEQ ID NO: 3383115 - DNA, 16 bp, Homo sapiens
accatttgctactgta

SEQ ID NO: 3383116 - DNA, 19 bp, Homo sapiens
accatttgctactgtacat

SEQ ID NO: 3383117 - DNA, 15 bp, Homo sapiens
accatttgtaataaa

SEQ ID NO: 3383118 - DNA, 19 bp, Homo sapiens
accatttgtaataaagtat

SEQ ID NO: 3383119 - DNA, 21 bp, Homo sapiens
accatttgtaataaagtatat

SEQ ID NO: 3383120 - DNA, 20 bp, Homo sapiens
accattttatagactaccaa

SEQ ID NO: 3383121 - DNA, 23 bp, Homo sapiens
accattttcccatcatcctttgt

SEQ ID NO: 3383122 - DNA, 11 bp, Homo sapiens
accattttcta

SEQ ID NO: 3383123 - DNA, 21 bp, Homo sapiens
accattttggggtacccactg

SEQ ID NO: 3383124 - DNA, 23 bp, Homo sapiens
accattttgttattgactaacag

SEQ ID NO: 3383125 - DNA, 22 bp, Homo sapiens
accatttttaaagtagaagagg

SEQ ID NO: 3383126 - DNA, 11 bp, Homo sapiens
accatttttca

SEQ ID NO: 3383127 - DNA, 17 bp, Homo sapiens
accatttttcattcact

SEQ ID NO: 3383128 - DNA, 16 bp, Homo sapiens
accatttttgttactc

SEQ ID NO: 3383129 - DNA, 22 bp, Homo sapiens
accattttttaaggaaacaata

SEQ ID NO: 3383130 - DNA, 17 bp, Homo sapiens
accattttttaatttac

SEQ ID NO: 3383131 - DNA, 23 bp, Homo sapiens
acccaaaacacgcacaccctgcc

SEQ ID NO: 3383132 - DNA, 16 bp, Homo sapiens
acccaaaagagaaaaa

SEQ ID NO: 3383133 - DNA, 18 bp, Homo sapiens
acccaaagaggtatttat

SEQ ID NO: 3383134 - DNA, 16 bp, Homo sapiens
acccaaagcatggact

SEQ ID NO: 3383135 - DNA, 13 bp, Homo sapiens
acccaaagccctg

SEQ ID NO: 3383136 - DNA, 16 bp, Homo sapiens
acccaaagccctggta

SEQ ID NO: 3383137 - DNA, 12 bp, Homo sapiens
acccaaccactc

SEQ ID NO: 3383138 - DNA, 16 bp, Homo sapiens
acccaacccaaaccat

SEQ ID NO: 3383139 - DNA, 23 bp, Homo sapiens
acccaacggccctgcagccagct

SEQ ID NO: 3383140 - DNA, 19 bp, Homo sapiens
acccaagccctgaggcctg

SEQ ID NO: 3383141 - DNA, 17 bp, Homo sapiens
acccaagcctgctggct

SEQ ID NO: 3383142 - DNA, 19 bp, Homo sapiens
acccaagcctgctggctgc

SEQ ID NO: 3383143 - DNA, 21 bp, Homo sapiens
acccaaggagcacaggtccca

SEQ ID NO: 3383144 - DNA, 16 bp, Homo sapiens
acccaagtccctgtca

SEQ ID NO: 3383145 - DNA, 18 bp, Homo sapiens
acccaagtttatttctct

SEQ ID NO: 3383146 - DNA, 15 bp, Homo sapiens
acccaatcagatgcc

SEQ ID NO: 3383147 - DNA, 14 bp, Homo sapiens
acccaatccaaatg

SEQ ID NO: 3383148 - DNA, 17 bp, Homo sapiens
acccacaatcccaccta

SEQ ID NO: 3383149 - DNA, 19 bp, Homo sapiens
acccacaatcccacctagc

SEQ ID NO: 3383150 - DNA, 17 bp, Homo sapiens
acccacaccgtcttcct

SEQ ID NO: 3383151 - DNA, 17 bp, Homo sapiens
acccacagttttagttg

SEQ ID NO: 3383152 - DNA, 11 bp, Homo sapiens
acccaccagtg

SEQ ID NO: 3383153 - DNA, 13 bp, Homo sapiens
acccaccagtgcc

SEQ ID NO: 3383154 - DNA, 14 bp, Homo sapiens
acccacccatcttc

SEQ ID NO: 3383155 - DNA, 22 bp, Homo sapiens
acccacccatcttcctgctgct

SEQ ID NO: 3383156 - DNA, 15 bp, Homo sapiens
acccaccccacgccc

SEQ ID NO: 3383157 - DNA, 20 bp, Homo sapiens
acccaccccacgcccgcacc

SEQ ID NO: 3383158 - DNA, 15 bp, Homo sapiens
acccacccctgtgct

SEQ ID NO: 3383159 - DNA, 16 bp, Homo sapiens
acccacccctgtgctc

SEQ ID NO: 3383160 - DNA, 14 bp, Homo sapiens
acccaccctgtgcc

SEQ ID NO: 3383161 - DNA, 13 bp, Homo sapiens
acccacctagaac

SEQ ID NO: 3383162 - DNA, 13 bp, Homo sapiens
acccacctcagcc

SEQ ID NO: 3383163 - DNA, 15 bp, Homo sapiens
acccacctcagcctc

SEQ ID NO: 3383164 - DNA, 17 bp, Homo sapiens
acccacctccacccagc

SEQ ID NO: 3383165 - DNA, 21 bp, Homo sapiens
acccacctccacccagcccct

SEQ ID NO: 3383166 - DNA, 13 bp, Homo sapiens
acccacctctggc

SEQ ID NO: 3383167 - DNA, 18 bp, Homo sapiens
acccactatccttcgtga

SEQ ID NO: 3383168 - DNA, 15 bp, Homo sapiens
acccactcaccaggg

SEQ ID NO: 3383169 - DNA, 12 bp, Homo sapiens
acccactcagga

SEQ ID NO: 3383170 - DNA, 10 bp, Homo sapiens
acccactgct

SEQ ID NO: 3383171 - DNA, 11 bp, Homo sapiens
acccactgctt

SEQ ID NO: 3383172 - DNA, 23 bp, Homo sapiens
acccacttgtcactgacacaaag

SEQ ID NO: 3383173 - DNA, 14 bp, Homo sapiens
acccagaatggagc

SEQ ID NO: 3383174 - DNA, 18 bp, Homo sapiens
acccagacaaccaaaaca

SEQ ID NO: 3383175 - DNA, 19 bp, Homo sapiens
acccagacccaactcgcct

SEQ ID NO: 3383176 - DNA, 18 bp, Homo sapiens
acccagagaatatataca

SEQ ID NO: 3383177 - DNA, 19 bp, Homo sapiens
acccagagtggagtctgag

SEQ ID NO: 3383178 - DNA, 22 bp, Homo sapiens
acctagttaaagaaaggaaaag

SEQ ID NO: 3383179 - DNA, 15 bp, Homo sapiens
acctatagtcccagc

SEQ ID NO: 3383180 - DNA, 22 bp, Homo sapiens
acctatagtcccagctactcag

SEQ ID NO: 3383181 - DNA, 22 bp, Homo sapiens
acctatataataaagctactga

SEQ ID NO: 3383182 - DNA, 14 bp, Homo sapiens
acctatatttcaat

SEQ ID NO: 3383183 - DNA, 14 bp, Homo sapiens
acctatcccacctc

SEQ ID NO: 3383184 - DNA, 15 bp, Homo sapiens
acctatcctcactgc

SEQ ID NO: 3383185 - DNA, 17 bp, Homo sapiens
acctatgtcctaaggac

SEQ ID NO: 3383186 - DNA, 17 bp, Homo sapiens
acctattcaccctccac

SEQ ID NO: 3383187 - DNA, 19 bp, Homo sapiens
acctattcaccctccactt

SEQ ID NO: 3383188 - DNA, 16 bp, Homo sapiens
acctattttcatttgt

SEQ ID NO: 3383189 - DNA, 21 bp, Homo sapiens
acctattttcatttgtacaag

SEQ ID NO: 3383190 - DNA, 22 bp, Homo sapiens
acctcaacccccatttctattt

SEQ ID NO: 3383191 - DNA, 15 bp, Homo sapiens
acctcaagccctgag

SEQ ID NO: 3383192 - DNA, 10 bp, Homo sapiens
acctcaaggg

SEQ ID NO: 3383193 - DNA, 15 bp, Homo sapiens
acctcaagggggact

SEQ ID NO: 3383194 - DNA, 19 bp, Homo sapiens
acctcaagtttttgttttg

SEQ ID NO: 3383195 - DNA, 14 bp, Homo sapiens
acctcacagtgacc

SEQ ID NO: 3383196 - DNA, 19 bp, Homo sapiens
acctcaccattgtgaagca

SEQ ID NO: 3383197 - DNA, 22 bp, Homo sapiens
acctcaccattgtgaagcacct

SEQ ID NO: 3383198 - DNA, 14 bp, Homo sapiens
acctcacctagaaa

SEQ ID NO: 3383199 - DNA, 13 bp, Homo sapiens
acctcactcctgt

SEQ ID NO: 3383200 - DNA, 20 bp, Homo sapiens
acctcactgagaggcctgga

SEQ ID NO: 3383201 - DNA, 15 bp, Homo sapiens
acctcacttttgaat

SEQ ID NO: 3383202 - DNA, 20 bp, Homo sapiens
acctcacttttgaatctata

SEQ ID NO: 3383203 - DNA, 12 bp, Homo sapiens
acctcagaggca

SEQ ID NO: 3383204 - DNA, 18 bp, Homo sapiens
acctcagaggcagcttca

SEQ ID NO: 3383205 - DNA, 22 bp, Homo sapiens
acctcagaggcagcttcaagtg

SEQ ID NO: 3383206 - DNA, 12 bp, Homo sapiens
acctcagctctg

SEQ ID NO: 3383207 - DNA, 17 bp, Homo sapiens
acctcaggcagctcaag

SEQ ID NO: 3383208 - DNA, 12 bp, Homo sapiens
acctcaggcagg

SEQ ID NO: 3383209 - DNA, 12 bp, Homo sapiens
acctcagggcac

SEQ ID NO: 3383210 - DNA, 12 bp, Homo sapiens
acctcagggctc

SEQ ID NO: 3383211 - DNA, 17 bp, Homo sapiens
acctcagggctcccagg

SEQ ID NO: 3383212 - DNA, 20 bp, Homo sapiens
acctcagggctcccaggggt

SEQ ID NO: 3383213 - DNA, 18 bp, Homo sapiens
acctcaggtacggagaag

SEQ ID NO: 3383214 - DNA, 21 bp, Homo sapiens
acctcaggtacggagaagaat

SEQ ID NO: 3383215 - DNA, 14 bp, Homo sapiens
acctcaggttgctg

SEQ ID NO: 3383216 - DNA, 15 bp, Homo sapiens
acctcaggttgctgg

SEQ ID NO: 3383217 - DNA, 21 bp, Homo sapiens
acctcagtgtcatttatgaaa

SEQ ID NO: 3383218 - DNA, 18 bp, Homo sapiens
acctcagttcattgtggt

SEQ ID NO: 3383219 - DNA, 18 bp, Homo sapiens
acctcatcaggatgaacc

SEQ ID NO: 3383220 - DNA, 16 bp, Homo sapiens
acctcatctttctcct

SEQ ID NO: 3383221 - DNA, 20 bp, Homo sapiens
acctcatgcccaccccctgc

SEQ ID NO: 3383222 - DNA, 23 bp, Homo sapiens
acctcatgcccaccccctgccct

SEQ ID NO: 3383223 - DNA, 20 bp, Homo sapiens
acctcatgtttatgaaaata

SEQ ID NO: 3383224 - DNA, 15 bp, Homo sapiens
acctcatttttcata

SEQ ID NO: 3383225 - DNA, 16 bp, Homo sapiens
acctccaactggatgt

SEQ ID NO: 3383226 - DNA, 21 bp, Homo sapiens
acctccaagcaagtagctttc

SEQ ID NO: 3383227 - DNA, 19 bp, Homo sapiens
acctccaataaagtgcctt

SEQ ID NO: 3383228 - DNA, 23 bp, Homo sapiens
acctccaataaagtgccttctgg

SEQ ID NO: 3383229 - DNA, 18 bp, Homo sapiens
acctccacagttcagtgg

SEQ ID NO: 3383230 - DNA, 17 bp, Homo sapiens
acctccaccacatctgc

SEQ ID NO: 3383231 - DNA, 18 bp, Homo sapiens
acctccaccacatctgcc

SEQ ID NO: 3383232 - DNA, 19 bp, Homo sapiens
acctccaccacatctgcca

SEQ ID NO: 3383233 - DNA, 20 bp, Homo sapiens
acctccaccacatctgccag

SEQ ID NO: 3383234 - DNA, 22 bp, Homo sapiens
acctccaccacatctgccagac

SEQ ID NO: 3383235 - DNA, 23 bp, Homo sapiens
acctccaccacatctgccagacc

SEQ ID NO: 3383236 - DNA, 12 bp, Homo sapiens
acctccacccag

SEQ ID NO: 3383237 - DNA, 17 bp, Homo sapiens
acctccagcccgggagc

SEQ ID NO: 3383238 - DNA, 21 bp, Homo sapiens
acctccagcccgggagcctag

SEQ ID NO: 3383239 - DNA, 19 bp, Homo sapiens
acctccattaaagtctgaa

SEQ ID NO: 3383240 - DNA, 14 bp, Homo sapiens
acctccattaaatg

SEQ ID NO: 3383241 - DNA, 16 bp, Homo sapiens
acctccattaaatggt

SEQ ID NO: 3383242 - DNA, 12 bp, Homo sapiens
acctcccagagg

SEQ ID NO: 3383243 - DNA, 19 bp, Homo sapiens
acctcccagaggtccagcc

SEQ ID NO: 3383244 - DNA, 21 bp, Homo sapiens
acctcccagaggtccagccca

SEQ ID NO: 3383245 - DNA, 19 bp, Homo sapiens
acctccccacgccctcccc

SEQ ID NO: 3383246 - DNA, 11 bp, Homo sapiens
acctccctact

SEQ ID NO: 3383247 - DNA, 22 bp, Homo sapiens
acctccctcttgttttgtttgt

SEQ ID NO: 3383248 - DNA, 14 bp, Homo sapiens
acctccctgcccag

SEQ ID NO: 3383249 - DNA, 18 bp, Homo sapiens
acctccctgcccaggccg

SEQ ID NO: 3383250 - DNA, 21 bp, Homo sapiens
acctccctgcccaggccggcc

SEQ ID NO: 3383251 - DNA, 13 bp, Homo sapiens
acctcccttccga

SEQ ID NO: 3383252 - DNA, 14 bp, Homo sapiens
acctccgagacagt

SEQ ID NO: 3383253 - DNA, 22 bp, Homo sapiens
acctccgcccctgcccccgctc

SEQ ID NO: 3383254 - DNA, 15 bp, Homo sapiens
acctccgcctcccag

SEQ ID NO: 3383255 - DNA, 16 bp, Homo sapiens
acctccgcctcccagg

SEQ ID NO: 3383256 - DNA, 23 bp, Homo sapiens
acctcctagaggtgggcagctgg

SEQ ID NO: 3383257 - DNA, 12 bp, Homo sapiens
acctcctctcag

SEQ ID NO: 3383258 - DNA, 16 bp, Homo sapiens
acctcctctcagtgtt

SEQ ID NO: 3383259 - DNA, 17 bp, Homo sapiens
acctcctctcagtgttt

SEQ ID NO: 3383260 - DNA, 21 bp, Homo sapiens
acctcctctgtgatttctttc

SEQ ID NO: 3383261 - DNA, 21 bp, Homo sapiens
acctcctgagaaggcgaggag

SEQ ID NO: 3383262 - DNA, 12 bp, Homo sapiens
acctcctgcctc

SEQ ID NO: 3383263 - DNA, 13 bp, Homo sapiens
acctcctggtggt

SEQ ID NO: 3383264 - DNA, 14 bp, Homo sapiens
acctcctgtggaac

SEQ ID NO: 3383265 - DNA, 18 bp, Homo sapiens
acctccttagctttccct

SEQ ID NO: 3383266 - DNA, 22 bp, Homo sapiens
acctccttagctttccctgtgc

SEQ ID NO: 3383267 - DNA, 23 bp, Homo sapiens
acctccttagctttccctgtgcc

SEQ ID NO: 3383268 - DNA, 18 bp, Homo sapiens
acctccttgtcactttat

SEQ ID NO: 3383269 - DNA, 22 bp, Homo sapiens
acctcggagcatggtgttttca

SEQ ID NO: 3383270 - DNA, 17 bp, Homo sapiens
acctcggcttgtgggct

SEQ ID NO: 3383271 - DNA, 18 bp, Homo sapiens
acctcggcttgtgggctg

SEQ ID NO: 3383272 - DNA, 21 bp, Homo sapiens
acctcggggacaccagagctg

SEQ ID NO: 3383273 - DNA, 18 bp, Homo sapiens
acctcggtcactccaact

SEQ ID NO: 3383274 - DNA, 20 bp, Homo sapiens
acctctacccaaaccctagg

SEQ ID NO: 3383275 - DNA, 15 bp, Homo sapiens
acctctactttccag

SEQ ID NO: 3383276 - DNA, 12 bp, Homo sapiens
acctctcactcc

SEQ ID NO: 3383277 - DNA, 13 bp, Homo sapiens
acctctccaaggg

SEQ ID NO: 3383278 - DNA, 23 bp, Homo sapiens
acctctccaagtctctctgtgaa

SEQ ID NO: 3383279 - DNA, 13 bp, Homo sapiens
acctctctcagag

SEQ ID NO: 3383280 - DNA, 16 bp, Homo sapiens
acctctctcagagcat

SEQ ID NO: 3383281 - DNA, 18 bp, Homo sapiens
acctctctcagagcatct

SEQ ID NO: 3383282 - DNA, 21 bp, Homo sapiens
acctctctcagagcatctggc

SEQ ID NO: 3383283 - DNA, 14 bp, Homo sapiens
acctctctgtagtt

SEQ ID NO: 3383284 - DNA, 20 bp, Homo sapiens
acctctctgtagtttatggc

SEQ ID NO: 3383285 - DNA, 22 bp, Homo sapiens
acctctctgtcccttgctgtat

SEQ ID NO: 3383286 - DNA, 13 bp, Homo sapiens
acctctgaaggca

SEQ ID NO: 3383287 - DNA, 13 bp, Homo sapiens
acctctgagaaga

SEQ ID NO: 3383288 - DNA, 20 bp, Homo sapiens
acctctgcggaccccagctg

SEQ ID NO: 3383289 - DNA, 12 bp, Homo sapiens
acctctgctggg

SEQ ID NO: 3383290 - DNA, 16 bp, Homo sapiens
acctctgctgggatgt

SEQ ID NO: 3383291 - DNA, 15 bp, Homo sapiens
acctctgcttttatc

SEQ ID NO: 3383292 - DNA, 15 bp, Homo sapiens
acctctggactggct

SEQ ID NO: 3383293 - DNA, 9 bp, Homo sapiens
acctctggc

SEQ ID NO: 3383294 - DNA, 15 bp, Homo sapiens
acctctggcccttgg

SEQ ID NO: 3383295 - DNA, 16 bp, Homo sapiens
acctctggcccttgga

SEQ ID NO: 3383296 - DNA, 16 bp, Homo sapiens
acctctggggacccca

SEQ ID NO: 3383297 - DNA, 23 bp, Homo sapiens
acctctggggaccccaacctcag

SEQ ID NO: 3383298 - DNA, 12 bp, Homo sapiens
acctctggtcca

SEQ ID NO: 3383299 - DNA, 17 bp, Homo sapiens
acctctggtccacacta

SEQ ID NO: 3383300 - DNA, 19 bp, Homo sapiens
acctctggtccacactaga

SEQ ID NO: 3383301 - DNA, 14 bp, Homo sapiens
acctctgtatagaa

SEQ ID NO: 3383302 - DNA, 19 bp, Homo sapiens
acctctgtatagaaatcta

SEQ ID NO: 3383303 - DNA, 15 bp, Homo sapiens
acctctgtcatttgt

SEQ ID NO: 3383304 - DNA, 20 bp, Homo sapiens
acgtgatcctctcacctcag

SEQ ID NO: 3383305 - DNA, 18 bp, Homo sapiens
acgtgatttccagtgagt

SEQ ID NO: 3383306 - DNA, 15 bp, Homo sapiens
acgtgccttttgcac

SEQ ID NO: 3383307 - DNA, 17 bp, Homo sapiens
acgtgccttttgcaccc

SEQ ID NO: 3383308 - DNA, 16 bp, Homo sapiens
acgtgcgacagagaga

SEQ ID NO: 3383309 - DNA, 17 bp, Homo sapiens
acgtgctaggggatgag

SEQ ID NO: 3383310 - DNA, 16 bp, Homo sapiens
acgtggaacctctgtc

SEQ ID NO: 3383311 - DNA, 17 bp, Homo sapiens
acgtggaacctctgtct

SEQ ID NO: 3383312 - DNA, 20 bp, Homo sapiens
acgtggaacctctgtctcat

SEQ ID NO: 3383313 - DNA, 19 bp, Homo sapiens
acgtggagagctggtgccc

SEQ ID NO: 3383314 - DNA, 15 bp, Homo sapiens
acgtggtcaccttcg

SEQ ID NO: 3383315 - DNA, 19 bp, Homo sapiens
acgtggtcaccttcgagta

SEQ ID NO: 3383316 - DNA, 18 bp, Homo sapiens
acgtggttggggccctgc

SEQ ID NO: 3383317 - DNA, 17 bp, Homo sapiens
acgtgtatagtatctgt

SEQ ID NO: 3383318 - DNA, 13 bp, Homo sapiens
acgtgtcttccac

SEQ ID NO: 3383319 - DNA, 23 bp, Homo sapiens
acgttactcagggctcctcccag

SEQ ID NO: 3383320 - DNA, 15 bp, Homo sapiens
acgttcgatttctac

SEQ ID NO: 3383321 - DNA, 20 bp, Homo sapiens
acgttcgatttctacctcag

SEQ ID NO: 3383322 - DNA, 14 bp, Homo sapiens
acgttcggggcatg

SEQ ID NO: 3383323 - DNA, 17 bp, Homo sapiens
acgttctcacacccacc

SEQ ID NO: 3383324 - DNA, 12 bp, Homo sapiens
acgttggcctca

SEQ ID NO: 3383325 - DNA, 19 bp, Homo sapiens
acgttggcctcagggccag

SEQ ID NO: 3383326 - DNA, 15 bp, Homo sapiens
acgtttaaagttctg

SEQ ID NO: 3383327 - DNA, 18 bp, Homo sapiens
acgtttaaagttctgtgt

SEQ ID NO: 3383328 - DNA, 15 bp, Homo sapiens
acgttttattgtgtt

SEQ ID NO: 3383329 - DNA, 20 bp, Homo sapiens
acgttttgtttgaaaaagca

SEQ ID NO: 3383330 - DNA, 20 bp, Homo sapiens
acgtttttaatataaagcct

SEQ ID NO: 3383331 - DNA, 12 bp, Homo sapiens
acgtttttacat

SEQ ID NO: 3383332 - DNA, 22 bp, Homo sapiens
acgtttttctggaccaaggtga

SEQ ID NO: 3383333 - DNA, 16 bp, Homo sapiens
actaaaaaaaaaaagg

SEQ ID NO: 3383334 - DNA, 17 bp, Homo sapiens
actaaaaaggaaacttc

SEQ ID NO: 3383335 - DNA, 17 bp, Homo sapiens
actaaaaagttgaacca

SEQ ID NO: 3383336 - DNA, 13 bp, Homo sapiens
actaaaaatatta

SEQ ID NO: 3383337 - DNA, 13 bp, Homo sapiens
actaaaagacatt

SEQ ID NO: 3383338 - DNA, 15 bp, Homo sapiens
actaaaagacatttg

SEQ ID NO: 3383339 - DNA, 15 bp, Homo sapiens
actaaaagcaaatct

SEQ ID NO: 3383340 - DNA, 22 bp, Homo sapiens
actaaaattttaggcactctta

SEQ ID NO: 3383341 - DNA, 16 bp, Homo sapiens
actaaaccaactctaa

SEQ ID NO: 3383342 - DNA, 20 bp, Homo sapiens
actaaactatctgtatttat

SEQ ID NO: 3383343 - DNA, 17 bp, Homo sapiens
actaaactcttaccata

SEQ ID NO: 3383344 - DNA, 18 bp, Homo sapiens
actaaactttatttgtaa

SEQ ID NO: 3383345 - DNA, 18 bp, Homo sapiens
actaaactttttttctgt

SEQ ID NO: 3383346 - DNA, 20 bp, Homo sapiens
actaaactttttttctgtac

SEQ ID NO: 3383347 - DNA, 22 bp, Homo sapiens
actaaactttttttctgtacca

SEQ ID NO: 3383348 - DNA, 12 bp, Homo sapiens
actaaagagaga

SEQ ID NO: 3383349 - DNA, 14 bp, Homo sapiens
actaaagagagaat

SEQ ID NO: 3383350 - DNA, 19 bp, Homo sapiens
actaaagatatcagagctc

SEQ ID NO: 3383351 - DNA, 22 bp, Homo sapiens
actaaagggcaggtggttctaa

SEQ ID NO: 3383352 - DNA, 22 bp, Homo sapiens
actaaatatgaaccctttgttt

SEQ ID NO: 3383353 - DNA, 18 bp, Homo sapiens
actaaatcagagacaaaa

SEQ ID NO: 3383354 - DNA, 14 bp, Homo sapiens
actaaatctctaat

SEQ ID NO: 3383355 - DNA, 22 bp, Homo sapiens
actaaatgtagttgtcacacta

SEQ ID NO: 3383356 - DNA, 20 bp, Homo sapiens
actaaattcgtgattttcaa

SEQ ID NO: 3383357 - DNA, 18 bp, Homo sapiens
actaaattgtaaactcct

SEQ ID NO: 3383358 - DNA, 20 bp, Homo sapiens
actaaatttgatacttatat

SEQ ID NO: 3383359 - DNA, 22 bp, Homo sapiens
actaaatttgatacttatattt

SEQ ID NO: 3383360 - DNA, 15 bp, Homo sapiens
actaaattttaaagc

SEQ ID NO: 3383361 - DNA, 14 bp, Homo sapiens
actaacacaaggac

SEQ ID NO: 3383362 - DNA, 15 bp, Homo sapiens
actaacacaaggaca

SEQ ID NO: 3383363 - DNA, 13 bp, Homo sapiens
actaacagataag

SEQ ID NO: 3383364 - DNA, 17 bp, Homo sapiens
actaacataaaatctgt

SEQ ID NO: 3383365 - DNA, 20 bp, Homo sapiens
actaacataaaatctgtgaa

SEQ ID NO: 3383366 - DNA, 12 bp, Homo sapiens
actaacatttcc

SEQ ID NO: 3383367 - DNA, 18 bp, Homo sapiens
actaaccaagctgagttt

SEQ ID NO: 3383368 - DNA, 19 bp, Homo sapiens
actaaccagtacctctgta

SEQ ID NO: 3383369 - DNA, 17 bp, Homo sapiens
actaaccccaacgcaca

SEQ ID NO: 3383370 - DNA, 21 bp, Homo sapiens
actaaccccaacgcacaggaa

SEQ ID NO: 3383371 - DNA, 18 bp, Homo sapiens
actaacgttgagcccctg

SEQ ID NO: 3383372 - DNA, 21 bp, Homo sapiens
actaactcctgagaaatgtta

SEQ ID NO: 3383373 - DNA, 20 bp, Homo sapiens
actaagagaaaattgcacta

SEQ ID NO: 3383374 - DNA, 22 bp, Homo sapiens
actaagagaaaattgcactaaa

SEQ ID NO: 3383375 - DNA, 18 bp, Homo sapiens
actaagatgttcactgtg

SEQ ID NO: 3383376 - DNA, 13 bp, Homo sapiens
actaagattcttt

SEQ ID NO: 3383377 - DNA, 17 bp, Homo sapiens
actaagcaatttccccc

SEQ ID NO: 3383378 - DNA, 16 bp, Homo sapiens
actaagccacaagaaa

SEQ ID NO: 3383379 - DNA, 23 bp, Homo sapiens
actaagccctcgaaccaaggcag

SEQ ID NO: 3383380 - DNA, 18 bp, Homo sapiens
actaagccctgtcgagac

SEQ ID NO: 3383381 - DNA, 16 bp, Homo sapiens
actaaggatttttcaa

SEQ ID NO: 3383382 - DNA, 14 bp, Homo sapiens
actaaggcaggtgg

SEQ ID NO: 3383383 - DNA, 14 bp, Homo sapiens
actaataaatacat

SEQ ID NO: 3383384 - DNA, 16 bp, Homo sapiens
actaatagtttgttga

SEQ ID NO: 3383385 - DNA, 18 bp, Homo sapiens
actaatggggcggtgaga

SEQ ID NO: 3383386 - DNA, 20 bp, Homo sapiens
actaattagggtacatttat

SEQ ID NO: 3383387 - DNA, 23 bp, Homo sapiens
actaattagggtacatttataat

SEQ ID NO: 3383388 - DNA, 17 bp, Homo sapiens
actaattatactacttt

SEQ ID NO: 3383389 - DNA, 15 bp, Homo sapiens
actaattccacacct

SEQ ID NO: 3383390 - DNA, 14 bp, Homo sapiens
actaatttcaaaat

SEQ ID NO: 3383391 - DNA, 12 bp, Homo sapiens
actaatttcata

SEQ ID NO: 3383392 - DNA, 14 bp, Homo sapiens
actaattttgttga

SEQ ID NO: 3383393 - DNA, 15 bp, Homo sapiens
actacaaaatacaat

SEQ ID NO: 3383394 - DNA, 20 bp, Homo sapiens
actacaaaatacaatcctgt

SEQ ID NO: 3383395 - DNA, 16 bp, Homo sapiens
actacaaaatttgaaa

SEQ ID NO: 3383396 - DNA, 18 bp, Homo sapiens
actacaaagctttgctac

SEQ ID NO: 3383397 - DNA, 19 bp, Homo sapiens
actacaaatcaagtatttg

SEQ ID NO: 3383398 - DNA, 13 bp, Homo sapiens
actacaagtcagc

SEQ ID NO: 3383399 - DNA, 20 bp, Homo sapiens
actacacagcacaccagccg

SEQ ID NO: 3383400 - DNA, 14 bp, Homo sapiens
actacacctggctg

SEQ ID NO: 3383401 - DNA, 17 bp, Homo sapiens
actacactccagcctga

SEQ ID NO: 3383402 - DNA, 15 bp, Homo sapiens
actacagaataatgt

SEQ ID NO: 3383403 - DNA, 19 bp, Homo sapiens
actacagacctgctttttg

SEQ ID NO: 3383404 - DNA, 11 bp, Homo sapiens
actacaggcac

SEQ ID NO: 3383405 - DNA, 16 bp, Homo sapiens
actacataaactgact

SEQ ID NO: 3383406 - DNA, 17 bp, Homo sapiens
actacataaactgactt

SEQ ID NO: 3383407 - DNA, 19 bp, Homo sapiens
actacatgtggtttataga

SEQ ID NO: 3383408 - DNA, 11 bp, Homo sapiens
actacatttat

SEQ ID NO: 3383409 - DNA, 21 bp, Homo sapiens
actaccaggtgtgcctggaag

SEQ ID NO: 3383410 - DNA, 23 bp, Homo sapiens
actaccatctgatgtttcatatt

SEQ ID NO: 3383411 - DNA, 15 bp, Homo sapiens
actacccatagacat

SEQ ID NO: 3383412 - DNA, 18 bp, Homo sapiens
actacccccttttcagct

SEQ ID NO: 3383413 - DNA, 17 bp, Homo sapiens
actaccttgaaaataag

SEQ ID NO: 3383414 - DNA, 14 bp, Homo sapiens
actacggttgggag

SEQ ID NO: 3383415 - DNA, 13 bp, Homo sapiens
actactacatctg

SEQ ID NO: 3383416 - DNA, 19 bp, Homo sapiens
actactagatgtctttagg

SEQ ID NO: 3383417 - DNA, 19 bp, Homo sapiens
actactagtttttactttt

SEQ ID NO: 3383418 - DNA, 17 bp, Homo sapiens
actactgaaacagattt

SEQ ID NO: 3383419 - DNA, 12 bp, Homo sapiens
actactgcagca

SEQ ID NO: 3383420 - DNA, 13 bp, Homo sapiens
actactgcagcac

SEQ ID NO: 3383421 - DNA, 13 bp, Homo sapiens
actactgtacttt

SEQ ID NO: 3383422 - DNA, 18 bp, Homo sapiens
actactgtgttcctggca

SEQ ID NO: 3383423 - DNA, 15 bp, Homo sapiens
actacttaccatttg

SEQ ID NO: 3383424 - DNA, 17 bp, Homo sapiens
actacttgggagcaccg

SEQ ID NO: 3383425 - DNA, 13 bp, Homo sapiens
actactttgcctt

SEQ ID NO: 3383426 - DNA, 21 bp, Homo sapiens
actactttgccttcttttgta

SEQ ID NO: 3383427 - DNA, 22 bp, Homo sapiens
actactttgttaggattttcac

SEQ ID NO: 3383428 - DNA, 23 bp, Homo sapiens
actacttttgcttttttatttac

SEQ ID NO: 3383429 - DNA, 15 bp, Homo sapiens
actagaaattcttaa

SEQ ID NO: 3383430 - DNA, 18 bp, Homo sapiens
actcttaatctgtgtgta

SEQ ID NO: 3383431 - DNA, 14 bp, Homo sapiens
actcttagaaatga

SEQ ID NO: 3383432 - DNA, 18 bp, Homo sapiens
actcttaggtatgtatga

SEQ ID NO: 3383433 - DNA, 22 bp, Homo sapiens
actcttatctcagtcatgcata

SEQ ID NO: 3383434 - DNA, 19 bp, Homo sapiens
actcttattgcccacgctg

SEQ ID NO: 3383435 - DNA, 13 bp, Homo sapiens
actcttcagaaca

SEQ ID NO: 3383436 - DNA, 19 bp, Homo sapiens
actcttcagaacacacaga

SEQ ID NO: 3383437 - DNA, 15 bp, Homo sapiens
actcttccatttatt

SEQ ID NO: 3383438 - DNA, 22 bp, Homo sapiens
actcttcctatttttgtagtga

SEQ ID NO: 3383439 - DNA, 15 bp, Homo sapiens
actcttctcggctca

SEQ ID NO: 3383440 - DNA, 17 bp, Homo sapiens
actcttctcggctcagg

SEQ ID NO: 3383441 - DNA, 18 bp, Homo sapiens
actcttctcggctcaggc

SEQ ID NO: 3383442 - DNA, 15 bp, Homo sapiens
actcttcttgaaatt

SEQ ID NO: 3383443 - DNA, 13 bp, Homo sapiens
actcttgaagagg

SEQ ID NO: 3383444 - DNA, 15 bp, Homo sapiens
actcttgcggcaagc

SEQ ID NO: 3383445 - DNA, 22 bp, Homo sapiens
actcttgcgtgtcaatttccct

SEQ ID NO: 3383446 - DNA, 13 bp, Homo sapiens
actcttgctcttt

SEQ ID NO: 3383447 - DNA, 14 bp, Homo sapiens
actcttgctctttc

SEQ ID NO: 3383448 - DNA, 16 bp, Homo sapiens
actcttgctgatggct

SEQ ID NO: 3383449 - DNA, 18 bp, Homo sapiens
actcttgtcatttttaat

SEQ ID NO: 3383450 - DNA, 21 bp, Homo sapiens
actcttgttgagttctgtaga

SEQ ID NO: 3383451 - DNA, 13 bp, Homo sapiens
actctttaataaa

SEQ ID NO: 3383452 - DNA, 20 bp, Homo sapiens
actctttaataaattgctta

SEQ ID NO: 3383453 - DNA, 13 bp, Homo sapiens
actctttagagca

SEQ ID NO: 3383454 - DNA, 19 bp, Homo sapiens
actctttctaactttcttt

SEQ ID NO: 3383455 - DNA, 22 bp, Homo sapiens
actctttctgaaggaagagaag

SEQ ID NO: 3383456 - DNA, 13 bp, Homo sapiens
actctttgtaaga

SEQ ID NO: 3383457 - DNA, 14 bp, Homo sapiens
actctttgtaagag

SEQ ID NO: 3383458 - DNA, 21 bp, Homo sapiens
actctttgtggggaagagggg

SEQ ID NO: 3383459 - DNA, 15 bp, Homo sapiens
actcttttctatttt

SEQ ID NO: 3383460 - DNA, 16 bp, Homo sapiens
actcttttctattttg

SEQ ID NO: 3383461 - DNA, 12 bp, Homo sapiens
actcttttgctt

SEQ ID NO: 3383462 - DNA, 14 bp, Homo sapiens
actcttttgcttta

SEQ ID NO: 3383463 - DNA, 20 bp, Homo sapiens
actcttttgctttattccag

SEQ ID NO: 3383464 - DNA, 14 bp, Homo sapiens
actctttttagggc

SEQ ID NO: 3383465 - DNA, 20 bp, Homo sapiens
actctttttagggccaggca

SEQ ID NO: 3383466 - DNA, 14 bp, Homo sapiens
actctttttctaaa

SEQ ID NO: 3383467 - DNA, 23 bp, Homo sapiens
actctttttctaaagtgttggtc

SEQ ID NO: 3383468 - DNA, 22 bp, Homo sapiens
actctttttggactcagcccac

SEQ ID NO: 3383469 - DNA, 18 bp, Homo sapiens
actgaaaaaaaaaaagaa

SEQ ID NO: 3383470 - DNA, 17 bp, Homo sapiens
actgaaaacttagccag

SEQ ID NO: 3383471 - DNA, 14 bp, Homo sapiens
actgaaaagaagga

SEQ ID NO: 3383472 - DNA, 23 bp, Homo sapiens
actgaaaatctaatattaaaaat

SEQ ID NO: 3383473 - DNA, 19 bp, Homo sapiens
actgaaaatgtaaatttat

SEQ ID NO: 3383474 - DNA, 18 bp, Homo sapiens
actgaaacagatttcata

SEQ ID NO: 3383475 - DNA, 15 bp, Homo sapiens
actgaaaccaaaaca

SEQ ID NO: 3383476 - DNA, 17 bp, Homo sapiens
actgaaacctctgcctt

SEQ ID NO: 3383477 - DNA, 15 bp, Homo sapiens
actgaaagcagcagc

SEQ ID NO: 3383478 - DNA, 13 bp, Homo sapiens
actgaaataaaaa

SEQ ID NO: 3383479 - DNA, 17 bp, Homo sapiens
actgaaatgagcatgca

SEQ ID NO: 3383480 - DNA, 17 bp, Homo sapiens
actgaaatgcctggaag

SEQ ID NO: 3383481 - DNA, 16 bp, Homo sapiens
actgaaattattttct

SEQ ID NO: 3383482 - DNA, 23 bp, Homo sapiens
actgaaatttgttatacttcaaa

SEQ ID NO: 3383483 - DNA, 22 bp, Homo sapiens
actgaacaccattgaaggctta

SEQ ID NO: 3383484 - DNA, 16 bp, Homo sapiens
actgaacatgtttaca

SEQ ID NO: 3383485 - DNA, 16 bp, Homo sapiens
actgaaccaaattgca

SEQ ID NO: 3383486 - DNA, 18 bp, Homo sapiens
actgaactcactttcctc

SEQ ID NO: 3383487 - DNA, 19 bp, Homo sapiens
actgaagaaatctttccag

SEQ ID NO: 3383488 - DNA, 13 bp, Homo sapiens
actgaagcagcct

SEQ ID NO: 3383489 - DNA, 16 bp, Homo sapiens
actgaagccaaatgaa

SEQ ID NO: 3383490 - DNA, 12 bp, Homo sapiens
actgaagcctgc

SEQ ID NO: 3383491 - DNA, 15 bp, Homo sapiens
actgaagcctgcagg

SEQ ID NO: 3383492 - DNA, 18 bp, Homo sapiens
actgaaggaaaaacacaa

SEQ ID NO: 3383493 - DNA, 23 bp, Homo sapiens
actgaaggaaaaacacaagcaaa

SEQ ID NO: 3383494 - DNA, 17 bp, Homo sapiens
actgaagtgcttagtgt

SEQ ID NO: 3383495 - DNA, 16 bp, Homo sapiens
actgaagtttcacatg

SEQ ID NO: 3383496 - DNA, 19 bp, Homo sapiens
actgaagtttcacatgagc

SEQ ID NO: 3383497 - DNA, 20 bp, Homo sapiens
actgaagtttttgaaatacc

SEQ ID NO: 3383498 - DNA, 21 bp, Homo sapiens
actgaagtttttgaaatacct

SEQ ID NO: 3383499 - DNA, 15 bp, Homo sapiens
actgaatatttatat

SEQ ID NO: 3383500 - DNA, 22 bp, Homo sapiens
actgaatatttatatttcacta

SEQ ID NO: 3383501 - DNA, 17 bp, Homo sapiens
actgaatattttggaaa

SEQ ID NO: 3383502 - DNA, 18 bp, Homo sapiens
actgaatattttggaaac

SEQ ID NO: 3383503 - DNA, 19 bp, Homo sapiens
actgaatattttggaaact

SEQ ID NO: 3383504 - DNA, 22 bp, Homo sapiens
actgaattgtcagatgtggagt

SEQ ID NO: 3383505 - DNA, 14 bp, Homo sapiens
actgacacaaagga

SEQ ID NO: 3383506 - DNA, 16 bp, Homo sapiens
actgacacaaaggaag

SEQ ID NO: 3383507 - DNA, 21 bp, Homo sapiens
actgacacaggaaaccaacac

SEQ ID NO: 3383508 - DNA, 18 bp, Homo sapiens
actgacatgtggggccag

SEQ ID NO: 3383509 - DNA, 12 bp, Homo sapiens
actgacccttcc

SEQ ID NO: 3383510 - DNA, 22 bp, Homo sapiens
actgaccttggagagacacagc

SEQ ID NO: 3383511 - DNA, 12 bp, Homo sapiens
actgactttctc

SEQ ID NO: 3383512 - DNA, 15 bp, Homo sapiens
actgactttgcttgc

SEQ ID NO: 3383513 - DNA, 16 bp, Homo sapiens
actgactttgcttgct

SEQ ID NO: 3383514 - DNA, 18 bp, Homo sapiens
actgactttttcccccca

SEQ ID NO: 3383515 - DNA, 20 bp, Homo sapiens
actgagacacgatgccgaga

SEQ ID NO: 3383516 - DNA, 21 bp, Homo sapiens
actgagcaagaccctgtctct

SEQ ID NO: 3383517 - DNA, 16 bp, Homo sapiens
actgagccaaggaggc

SEQ ID NO: 3383518 - DNA, 14 bp, Homo sapiens
actgagccccgcag

SEQ ID NO: 3383519 - DNA, 19 bp, Homo sapiens
actgagcggccgcagagac

SEQ ID NO: 3383520 - DNA, 21 bp, Homo sapiens
actgagcggccgcagagactg

SEQ ID NO: 3383521 - DNA, 13 bp, Homo sapiens
actgagctcccca

SEQ ID NO: 3383522 - DNA, 19 bp, Homo sapiens
actgaggacaaagtggagg

SEQ ID NO: 3383523 - DNA, 20 bp, Homo sapiens
actgagggaccaactgggcc

SEQ ID NO: 3383524 - DNA, 14 bp, Homo sapiens
actgaggtataaag

SEQ ID NO: 3383525 - DNA, 19 bp, Homo sapiens
actgaggtataaagacaag

SEQ ID NO: 3383526 - DNA, 17 bp, Homo sapiens
actgagtcccctccagg

SEQ ID NO: 3383527 - DNA, 20 bp, Homo sapiens
actgagtcccctccaggaag

SEQ ID NO: 3383528 - DNA, 19 bp, Homo sapiens
actgataaaagttttgata

SEQ ID NO: 3383529 - DNA, 21 bp, Homo sapiens
actgataacttggggaggcaa

SEQ ID NO: 3383530 - DNA, 17 bp, Homo sapiens
actgatatattttacaa

SEQ ID NO: 3383531 - DNA, 16 bp, Homo sapiens
actgatcatgcattgt

SEQ ID NO: 3383532 - DNA, 17 bp, Homo sapiens
actgatcatgcattgtt

SEQ ID NO: 3383533 - DNA, 18 bp, Homo sapiens
actgatcatgcattgttg

SEQ ID NO: 3383534 - DNA, 15 bp, Homo sapiens
actgatgacttacta

SEQ ID NO: 3383535 - DNA, 16 bp, Homo sapiens
actgatgcaaggatta

SEQ ID NO: 3383536 - DNA, 22 bp, Homo sapiens
actgatgcaaggattacagaaa

SEQ ID NO: 3383537 - DNA, 22 bp, Homo sapiens
actgatgccaaggggctgagtg

SEQ ID NO: 3383538 - DNA, 15 bp, Homo sapiens
actgatgctgagatt

SEQ ID NO: 3383539 - DNA, 15 bp, Homo sapiens
actgatgcttagatg

SEQ ID NO: 3383540 - DNA, 23 bp, Homo sapiens
actgatggaccgggtgggcctgg

SEQ ID NO: 3383541 - DNA, 22 bp, Homo sapiens
actgatgggcaacccccagcct

SEQ ID NO: 3383542 - DNA, 18 bp, Homo sapiens
actgatgtacaattaaaa

SEQ ID NO: 3383543 - DNA, 17 bp, Homo sapiens
actgatgttactagcct

SEQ ID NO: 3383544 - DNA, 17 bp, Homo sapiens
actgatgttgtgttttt

SEQ ID NO: 3383545 - DNA, 15 bp, Homo sapiens
actgattacctgcca

SEQ ID NO: 3383546 - DNA, 17 bp, Homo sapiens
actgattacctgccaat

SEQ ID NO: 3383547 - DNA, 18 bp, Homo sapiens
actgattatgtcttttat

SEQ ID NO: 3383548 - DNA, 20 bp, Homo sapiens
actgattatgtcttttatat

SEQ ID NO: 3383549 - DNA, 15 bp, Homo sapiens
actgattattttctt

SEQ ID NO: 3383550 - DNA, 18 bp, Homo sapiens
actgattattttcttcat

SEQ ID NO: 3383551 - DNA, 20 bp, Homo sapiens
actgattcataataaatatc

SEQ ID NO: 3383552 - DNA, 13 bp, Homo sapiens
actgattgtttca

SEQ ID NO: 3383553 - DNA, 13 bp, Homo sapiens
actgatttccttt

SEQ ID NO: 3383554 - DNA, 13 bp, Homo sapiens
actgatttctatg

SEQ ID NO: 3383555 - DNA, 18 bp, Homo sapiens
actgatttctatggcttt

SEQ ID NO: 3383556 - DNA, 15 bp, Homo sapiens
actgtttctgtcagg

SEQ ID NO: 3383557 - DNA, 22 bp, Homo sapiens
actgtttgccttctacttttaa

SEQ ID NO: 3383558 - DNA, 15 bp, Homo sapiens
actgttttaattgta

SEQ ID NO: 3383559 - DNA, 13 bp, Homo sapiens
actgttttcaaat

SEQ ID NO: 3383560 - DNA, 19 bp, Homo sapiens
actgtttttctctaatgct

SEQ ID NO: 3383561 - DNA, 15 bp, Homo sapiens
actgttttttaagtc

SEQ ID NO: 3383562 - DNA, 16 bp, Homo sapiens
acttaaaaaaatgaca

SEQ ID NO: 3383563 - DNA, 22 bp, Homo sapiens
acttaaaaaaatgacagatgtt

SEQ ID NO: 3383564 - DNA, 23 bp, Homo sapiens
acttaaaaatgtaaatattctat

SEQ ID NO: 3383565 - DNA, 15 bp, Homo sapiens
acttaaaaattagca

SEQ ID NO: 3383566 - DNA, 18 bp, Homo sapiens
acttaaaagtattcatac

SEQ ID NO: 3383567 - DNA, 22 bp, Homo sapiens
acttaaaataggggatatttaa

SEQ ID NO: 3383568 - DNA, 13 bp, Homo sapiens
acttaaaatattt

SEQ ID NO: 3383569 - DNA, 21 bp, Homo sapiens
acttaaaattgtaacctgcat

SEQ ID NO: 3383570 - DNA, 20 bp, Homo sapiens
acttaaaggacaggaggagg

SEQ ID NO: 3383571 - DNA, 19 bp, Homo sapiens
acttaaatggtaataagca

SEQ ID NO: 3383572 - DNA, 15 bp, Homo sapiens
acttaaattcctcaa

SEQ ID NO: 3383573 - DNA, 14 bp, Homo sapiens
acttaacagatgca

SEQ ID NO: 3383574 - DNA, 19 bp, Homo sapiens
acttaacggctccaggatt

SEQ ID NO: 3383575 - DNA, 21 bp, Homo sapiens
acttaactgtccgtaagcagt

SEQ ID NO: 3383576 - DNA, 14 bp, Homo sapiens
acttaagcaaaaga

SEQ ID NO: 3383577 - DNA, 15 bp, Homo sapiens
acttaagcacaagca

SEQ ID NO: 3383578 - DNA, 16 bp, Homo sapiens
acttaaggaagtttga

SEQ ID NO: 3383579 - DNA, 20 bp, Homo sapiens
acttaaggaagtttgatttt

SEQ ID NO: 3383580 - DNA, 18 bp, Homo sapiens
acttaatactaccttgaa

SEQ ID NO: 3383581 - DNA, 12 bp, Homo sapiens
acttaatggaaa

SEQ ID NO: 3383582 - DNA, 16 bp, Homo sapiens
acttaatttgtaaact

SEQ ID NO: 3383583 - DNA, 14 bp, Homo sapiens
acttacaaaaatgg

SEQ ID NO: 3383584 - DNA, 16 bp, Homo sapiens
acttacaccagtttga

SEQ ID NO: 3383585 - DNA, 16 bp, Homo sapiens
acttacacttggagcc

SEQ ID NO: 3383586 - DNA, 16 bp, Homo sapiens
acttacactttatgca

SEQ ID NO: 3383587 - DNA, 17 bp, Homo sapiens
acttacagctctggcca

SEQ ID NO: 3383588 - DNA, 17 bp, Homo sapiens
acttacatcttctgtga

SEQ ID NO: 3383589 - DNA, 18 bp, Homo sapiens
acttacatcttctgtgaa

SEQ ID NO: 3383590 - DNA, 13 bp, Homo sapiens
acttacttgctta

SEQ ID NO: 3383591 - DNA, 23 bp, Homo sapiens
acttactttttttggaagttatt

SEQ ID NO: 3383592 - DNA, 15 bp, Homo sapiens
acttagaaagcaggg

SEQ ID NO: 3383593 - DNA, 16 bp, Homo sapiens
acttagaaattgcatt

SEQ ID NO: 3383594 - DNA, 19 bp, Homo sapiens
acttagactctagtattta

SEQ ID NO: 3383595 - DNA, 15 bp, Homo sapiens
acttagaggaaaagg

SEQ ID NO: 3383596 - DNA, 16 bp, Homo sapiens
acttagaggaaaatga

SEQ ID NO: 3383597 - DNA, 14 bp, Homo sapiens
acttagcaggcacc

SEQ ID NO: 3383598 - DNA, 13 bp, Homo sapiens
acttagcccaaga

SEQ ID NO: 3383599 - DNA, 15 bp, Homo sapiens
acttagcccaagagg

SEQ ID NO: 3383600 - DNA, 14 bp, Homo sapiens
acttagccgactgc

SEQ ID NO: 3383601 - DNA, 17 bp, Homo sapiens
acttagccgactgcgct

SEQ ID NO: 3383602 - DNA, 20 bp, Homo sapiens
acttagcctttacctgtgaa

SEQ ID NO: 3383603 - DNA, 16 bp, Homo sapiens
acttagctatcagaag

SEQ ID NO: 3383604 - DNA, 15 bp, Homo sapiens
acttagctgtactat

SEQ ID NO: 3383605 - DNA, 18 bp, Homo sapiens
acttagctgtactataag

SEQ ID NO: 3383606 - DNA, 23 bp, Homo sapiens
acttagggccaagtcttgggtct

SEQ ID NO: 3383607 - DNA, 19 bp, Homo sapiens
acttaggttattttgcttt

SEQ ID NO: 3383608 - DNA, 17 bp, Homo sapiens
acttagtatattttctt

SEQ ID NO: 3383609 - DNA, 15 bp, Homo sapiens
acttagtattttacc

SEQ ID NO: 3383610 - DNA, 18 bp, Homo sapiens
acttagtgacaaaataga

SEQ ID NO: 3383611 - DNA, 23 bp, Homo sapiens
acttataagtgaagtgatactat

SEQ ID NO: 3383612 - DNA, 17 bp, Homo sapiens
acttatagttaatattt

SEQ ID NO: 3383613 - DNA, 22 bp, Homo sapiens
acttatattttcgtatgaaaat

SEQ ID NO: 3383614 - DNA, 18 bp, Homo sapiens
acttatctagaaagaaaa

SEQ ID NO: 3383615 - DNA, 17 bp, Homo sapiens
acttatcttctggatta

SEQ ID NO: 3383616 - DNA, 16 bp, Homo sapiens
acttatgctagtttat

SEQ ID NO: 3383617 - DNA, 20 bp, Homo sapiens
acttatggtaatcagttttg

SEQ ID NO: 3383618 - DNA, 13 bp, Homo sapiens
acttatgtacttg

SEQ ID NO: 3383619 - DNA, 22 bp, Homo sapiens
acttatgtacttgatactgaat

SEQ ID NO: 3383620 - DNA, 23 bp, Homo sapiens
acttatgtacttgatactgaatg

SEQ ID NO: 3383621 - DNA, 21 bp, Homo sapiens
acttatgtagatatttggctt

SEQ ID NO: 3383622 - DNA, 15 bp, Homo sapiens
acttatgtttttaaa

SEQ ID NO: 3383623 - DNA, 12 bp, Homo sapiens
acttattagcag

SEQ ID NO: 3383624 - DNA, 19 bp, Homo sapiens
acttattcttttataataa

SEQ ID NO: 3383625 - DNA, 20 bp, Homo sapiens
acttattggaactctgcttg

SEQ ID NO: 3383626 - DNA, 12 bp, Homo sapiens
acttatttaaaa

SEQ ID NO: 3383627 - DNA, 18 bp, Homo sapiens
acttatttaaaaatattt

SEQ ID NO: 3383628 - DNA, 13 bp, Homo sapiens
acttatttaatgc

SEQ ID NO: 3383629 - DNA, 14 bp, Homo sapiens
acttatttattggg

SEQ ID NO: 3383630 - DNA, 23 bp, Homo sapiens
acttatttcactatcttcttcaa

SEQ ID NO: 3383631 - DNA, 16 bp, Homo sapiens
acttattttatttcca

SEQ ID NO: 3383632 - DNA, 15 bp, Homo sapiens
acttattttgtctta

SEQ ID NO: 3383633 - DNA, 20 bp, Homo sapiens
acttattttgtcttattctt

SEQ ID NO: 3383634 - DNA, 22 bp, Homo sapiens
acttattttgtcttattcttaa

SEQ ID NO: 3383635 - DNA, 16 bp, Homo sapiens
acttatttttgacagt

SEQ ID NO: 3383636 - DNA, 19 bp, Homo sapiens
acttatttttgacagtgtt

SEQ ID NO: 3383637 - DNA, 22 bp, Homo sapiens
acttatttttgacagtgttgaa

SEQ ID NO: 3383638 - DNA, 15 bp, Homo sapiens
acttcaaaaactaaa

SEQ ID NO: 3383639 - DNA, 21 bp, Homo sapiens
acttcaaaaataaaaaatctg

SEQ ID NO: 3383640 - DNA, 23 bp, Homo sapiens
acttcaaaaataaaaaatctgaa

SEQ ID NO: 3383641 - DNA, 14 bp, Homo sapiens
acttcaaaaggaat

SEQ ID NO: 3383642 - DNA, 19 bp, Homo sapiens
acttcaaaaggaatgaact

SEQ ID NO: 3383643 - DNA, 19 bp, Homo sapiens
acttcaaagctgaatattt

SEQ ID NO: 3383644 - DNA, 15 bp, Homo sapiens
acttcaatgatagta

SEQ ID NO: 3383645 - DNA, 18 bp, Homo sapiens
acttcacattaaaaaatg

SEQ ID NO: 3383646 - DNA, 15 bp, Homo sapiens
acttcactgaaagac

SEQ ID NO: 3383647 - DNA, 20 bp, Homo sapiens
acttcagagtcctcattata

SEQ ID NO: 3383648 - DNA, 18 bp, Homo sapiens
acttcagatgggaggaaa

SEQ ID NO: 3383649 - DNA, 22 bp, Homo sapiens
acttcaggaacaagtaatgtat

SEQ ID NO: 3383650 - DNA, 17 bp, Homo sapiens
acttcaggctcttctcc

SEQ ID NO: 3383651 - DNA, 20 bp, Homo sapiens
acttcagggcagggctctga

SEQ ID NO: 3383652 - DNA, 19 bp, Homo sapiens
acttcagtactcaaattca

SEQ ID NO: 3383653 - DNA, 16 bp, Homo sapiens
acttcagtcctgggag

SEQ ID NO: 3383654 - DNA, 23 bp, Homo sapiens
acttcagtgtcccaccttgacca

SEQ ID NO: 3383655 - DNA, 16 bp, Homo sapiens
acttcagttgatcttc

SEQ ID NO: 3383656 - DNA, 18 bp, Homo sapiens
acttcatatatgaggact

SEQ ID NO: 3383657 - DNA, 22 bp, Homo sapiens
acttcatgtaattttattttaa

SEQ ID NO: 3383658 - DNA, 23 bp, Homo sapiens
acttcatgtaattttattttaaa

SEQ ID NO: 3383659 - DNA, 14 bp, Homo sapiens
acttcattcttgaa

SEQ ID NO: 3383660 - DNA, 21 bp, Homo sapiens
acttcattgagagttttgtct

SEQ ID NO: 3383661 - DNA, 15 bp, Homo sapiens
acttccaaaattctt

SEQ ID NO: 3383662 - DNA, 16 bp, Homo sapiens
acttccaaaattctta

SEQ ID NO: 3383663 - DNA, 18 bp, Homo sapiens
acttccaaagaaagttct

SEQ ID NO: 3383664 - DNA, 15 bp, Homo sapiens
acttccaatttataa

SEQ ID NO: 3383665 - DNA, 17 bp, Homo sapiens
acttccactgccatcct

SEQ ID NO: 3383666 - DNA, 20 bp, Homo sapiens
acttccacttgtgtatattt

SEQ ID NO: 3383667 - DNA, 17 bp, Homo sapiens
acttccatacagctcta

SEQ ID NO: 3383668 - DNA, 22 bp, Homo sapiens
acttccataggacatactgcat

SEQ ID NO: 3383669 - DNA, 17 bp, Homo sapiens
acttccatgaggccaaa

SEQ ID NO: 3383670 - DNA, 17 bp, Homo sapiens
acttcccagtgaattct

SEQ ID NO: 3383671 - DNA, 21 bp, Homo sapiens
acttccccctcttcttctgaa

SEQ ID NO: 3383672 - DNA, 19 bp, Homo sapiens
acttcccgtctcagaatct

SEQ ID NO: 3383673 - DNA, 14 bp, Homo sapiens
acttccctagtccc

SEQ ID NO: 3383674 - DNA, 15 bp, Homo sapiens
acttccctagtcccc

SEQ ID NO: 3383675 - DNA, 22 bp, Homo sapiens
acttccctttctgcttgtgtta

SEQ ID NO: 3383676 - DNA, 14 bp, Homo sapiens
acttccgctgaggg

SEQ ID NO: 3383677 - DNA, 22 bp, Homo sapiens
acttccgctgaggggtctcgga

SEQ ID NO: 3383678 - DNA, 17 bp, Homo sapiens
acttcctgctacaggag

SEQ ID NO: 3383679 - DNA, 18 bp, Homo sapiens
acttcctggggccccgct

SEQ ID NO: 3383680 - DNA, 15 bp, Homo sapiens
acttccttactttta

SEQ ID NO: 3383681 - DNA, 23 bp, Homo sapiens
agaaaattgaggtttggaagagt

SEQ ID NO: 3383682 - DNA, 13 bp, Homo sapiens
agaaaattgagtt

SEQ ID NO: 3383683 - DNA, 22 bp, Homo sapiens
agaaaattgagttgcacttatt

SEQ ID NO: 3383684 - DNA, 20 bp, Homo sapiens
agaaaattgcctttaaaact

SEQ ID NO: 3383685 - DNA, 20 bp, Homo sapiens
agaaaatttagccctttaaa

SEQ ID NO: 3383686 - DNA, 20 bp, Homo sapiens
agaaaattttttttcaaaaa

SEQ ID NO: 3383687 - DNA, 22 bp, Homo sapiens
agaaaattttttttcaaaaatg

SEQ ID NO: 3383688 - DNA, 15 bp, Homo sapiens
agaaacacacagtca

SEQ ID NO: 3383689 - DNA, 16 bp, Homo sapiens
agaaacacagttttga

SEQ ID NO: 3383690 - DNA, 18 bp, Homo sapiens
agaaacacataaattatg

SEQ ID NO: 3383691 - DNA, 19 bp, Homo sapiens
agaaacacattcttattaa

SEQ ID NO: 3383692 - DNA, 15 bp, Homo sapiens
agaaacactttctct

SEQ ID NO: 3383693 - DNA, 17 bp, Homo sapiens
agaaacagagtggcctc

SEQ ID NO: 3383694 - DNA, 21 bp, Homo sapiens
agaaacagagtggcctccctg

SEQ ID NO: 3383695 - DNA, 22 bp, Homo sapiens
agaaacagagtggcctccctgc

SEQ ID NO: 3383696 - DNA, 16 bp, Homo sapiens
agaaacagataccata

SEQ ID NO: 3383697 - DNA, 21 bp, Homo sapiens
agaaacagataccatactcat

SEQ ID NO: 3383698 - DNA, 13 bp, Homo sapiens
agaaacagccagc

SEQ ID NO: 3383699 - DNA, 14 bp, Homo sapiens
agaaacagctcagc

SEQ ID NO: 3383700 - DNA, 17 bp, Homo sapiens
agaaacagctcagccag

SEQ ID NO: 3383701 - DNA, 18 bp, Homo sapiens
agaaacagctcagccagt

SEQ ID NO: 3383702 - DNA, 17 bp, Homo sapiens
agaaacagctttcaagt

SEQ ID NO: 3383703 - DNA, 20 bp, Homo sapiens
agaaacagctttcaagtgcc

SEQ ID NO: 3383704 - DNA, 13 bp, Homo sapiens
agaaacagttaac

SEQ ID NO: 3383705 - DNA, 17 bp, Homo sapiens
agaaacagttggtaact

SEQ ID NO: 3383706 - DNA, 13 bp, Homo sapiens
agaaacagtttct

SEQ ID NO: 3383707 - DNA, 19 bp, Homo sapiens
agaaacagtttcttgcttg

SEQ ID NO: 3383708 - DNA, 13 bp, Homo sapiens
agaaacatgacac

SEQ ID NO: 3383709 - DNA, 15 bp, Homo sapiens
agaaacatgacactg

SEQ ID NO: 3383710 - DNA, 18 bp, Homo sapiens
agaaacattgtaaatatt

SEQ ID NO: 3383711 - DNA, 15 bp, Homo sapiens
agaaaccagaaaagc

SEQ ID NO: 3383712 - DNA, 15 bp, Homo sapiens
agaaacccaagctcc

SEQ ID NO: 3383713 - DNA, 18 bp, Homo sapiens
agaaacccggcttcctgt

SEQ ID NO: 3383714 - DNA, 21 bp, Homo sapiens
agaaaccctcattgtgtttct

SEQ ID NO: 3383715 - DNA, 17 bp, Homo sapiens
agaaaccctggtctccg

SEQ ID NO: 3383716 - DNA, 22 bp, Homo sapiens
agaaacctcattggccagctca

SEQ ID NO: 3383717 - DNA, 20 bp, Homo sapiens
agaaaccttattgtacctct

SEQ ID NO: 3383718 - DNA, 18 bp, Homo sapiens
agaaacgcatccagcaag

SEQ ID NO: 3383719 - DNA, 15 bp, Homo sapiens
agaaacgcctgcccc

SEQ ID NO: 3383720 - DNA, 21 bp, Homo sapiens
agaaacgtcttctaaacttcc

SEQ ID NO: 3383721 - DNA, 18 bp, Homo sapiens
agaaacgtgttaaaggtt

SEQ ID NO: 3383722 - DNA, 14 bp, Homo sapiens
agaaactactaatt

SEQ ID NO: 3383723 - DNA, 17 bp, Homo sapiens
agaaactactaattttt

SEQ ID NO: 3383724 - DNA, 17 bp, Homo sapiens
agaaactccaaagtcca

SEQ ID NO: 3383725 - DNA, 21 bp, Homo sapiens
agaaactccaaagtccacaca

SEQ ID NO: 3383726 - DNA, 18 bp, Homo sapiens
agaaactcccctgggggt

SEQ ID NO: 3383727 - DNA, 20 bp, Homo sapiens
agaaactccgaagaaaagaa

SEQ ID NO: 3383728 - DNA, 15 bp, Homo sapiens
agaaactgaaagtgt

SEQ ID NO: 3383729 - DNA, 16 bp, Homo sapiens
agaaactgaaagtgtt

SEQ ID NO: 3383730 - DNA, 19 bp, Homo sapiens
agaaactgaaagtgtttta

SEQ ID NO: 3383731 - DNA, 16 bp, Homo sapiens
agaaactgaggaattt

SEQ ID NO: 3383732 - DNA, 12 bp, Homo sapiens
agaaactgatgc

SEQ ID NO: 3383733 - DNA, 13 bp, Homo sapiens
agaaactgatgcc

SEQ ID NO: 3383734 - DNA, 21 bp, Homo sapiens
agaaactggattaaaacaatt

SEQ ID NO: 3383735 - DNA, 19 bp, Homo sapiens
agaaacttgaagctttgta

SEQ ID NO: 3383736 - DNA, 13 bp, Homo sapiens
agaaacttttgta

SEQ ID NO: 3383737 - DNA, 21 bp, Homo sapiens
agaaagaaaagaccctgagac

SEQ ID NO: 3383738 - DNA, 15 bp, Homo sapiens
agaaagaagtggaga

SEQ ID NO: 3383739 - DNA, 20 bp, Homo sapiens
agaaagactatctaaatgtt

SEQ ID NO: 3383740 - DNA, 22 bp, Homo sapiens
agaaagagagaagccagccaca

SEQ ID NO: 3383741 - DNA, 19 bp, Homo sapiens
agaaagaggtctccccatc

SEQ ID NO: 3383742 - DNA, 18 bp, Homo sapiens
agaaagatcattgaaatt

SEQ ID NO: 3383743 - DNA, 12 bp, Homo sapiens
agaaagcagggg

SEQ ID NO: 3383744 - DNA, 19 bp, Homo sapiens
agaaagcctgggtgacatt

SEQ ID NO: 3383745 - DNA, 20 bp, Homo sapiens
agaaagcctgggtgacattt

SEQ ID NO: 3383746 - DNA, 19 bp, Homo sapiens
agaaagcctgttcccctca

SEQ ID NO: 3383747 - DNA, 19 bp, Homo sapiens
agaaaggatatttaagaaa

SEQ ID NO: 3383748 - DNA, 16 bp, Homo sapiens
agaaaggcctgcacac

SEQ ID NO: 3383749 - DNA, 14 bp, Homo sapiens
agaaaggctctgaa

SEQ ID NO: 3383750 - DNA, 23 bp, Homo sapiens
agaaagtacttctccaccctgct

SEQ ID NO: 3383751 - DNA, 22 bp, Homo sapiens
agaaagtgcctgacacactaac

SEQ ID NO: 3383752 - DNA, 16 bp, Homo sapiens
agaaagtgggaggtca

SEQ ID NO: 3383753 - DNA, 19 bp, Homo sapiens
agaaagtgggaggtcagga

SEQ ID NO: 3383754 - DNA, 20 bp, Homo sapiens
agaaagtgggtgagatgctg

SEQ ID NO: 3383755 - DNA, 17 bp, Homo sapiens
agaaagtgtatttggaa

SEQ ID NO: 3383756 - DNA, 23 bp, Homo sapiens
agaaagtgtgagcaaactaactt

SEQ ID NO: 3383757 - DNA, 21 bp, Homo sapiens
agaaagtgtgggtttggttag

SEQ ID NO: 3383758 - DNA, 22 bp, Homo sapiens
agaaataaaaatcaacttgtgt

SEQ ID NO: 3383759 - DNA, 15 bp, Homo sapiens
agaaataaatagcta

SEQ ID NO: 3383760 - DNA, 23 bp, Homo sapiens
agaaataaattcctaaactccct

SEQ ID NO: 3383761 - DNA, 22 bp, Homo sapiens
agaaataatgctacaattttaa

SEQ ID NO: 3383762 - DNA, 23 bp, Homo sapiens
agaaatactagagtaaaggccat

SEQ ID NO: 3383763 - DNA, 13 bp, Homo sapiens
agaaatagaaaag

SEQ ID NO: 3383764 - DNA, 16 bp, Homo sapiens
agaaatagaaaaggaa

SEQ ID NO: 3383765 - DNA, 16 bp, Homo sapiens
agaaatagaattataa

SEQ ID NO: 3383766 - DNA, 14 bp, Homo sapiens
agaaatagacaaaa

SEQ ID NO: 3383767 - DNA, 20 bp, Homo sapiens
agaaatataataaaatgtgt

SEQ ID NO: 3383768 - DNA, 13 bp, Homo sapiens
agaaatatatata

SEQ ID NO: 3383769 - DNA, 16 bp, Homo sapiens
agaaatatatatacat

SEQ ID NO: 3383770 - DNA, 20 bp, Homo sapiens
agaaatatatatacatatgt

SEQ ID NO: 3383771 - DNA, 14 bp, Homo sapiens
agaaatatggacac

SEQ ID NO: 3383772 - DNA, 17 bp, Homo sapiens
agaaatatggacactta

SEQ ID NO: 3383773 - DNA, 19 bp, Homo sapiens
agaaatcacaggggcgggg

SEQ ID NO: 3383774 - DNA, 18 bp, Homo sapiens
agaaatcagtaatattta

SEQ ID NO: 3383775 - DNA, 22 bp, Homo sapiens
agaaatcattgtagaaacacag

SEQ ID NO: 3383776 - DNA, 22 bp, Homo sapiens
agaaatccctgtttaatattta

SEQ ID NO: 3383777 - DNA, 15 bp, Homo sapiens
agaaatctaagctgt

SEQ ID NO: 3383778 - DNA, 22 bp, Homo sapiens
agaaatctggtcttgttagaaa

SEQ ID NO: 3383779 - DNA, 19 bp, Homo sapiens
agaaatcttgtcttaccac

SEQ ID NO: 3383780 - DNA, 15 bp, Homo sapiens
agaaatctttccagt

SEQ ID NO: 3383781 - DNA, 15 bp, Homo sapiens
agaaatgaacattcc

SEQ ID NO: 3383782 - DNA, 16 bp, Homo sapiens
agaaatgaataagctt

SEQ ID NO: 3383783 - DNA, 18 bp, Homo sapiens
agaaatgcggtctggtct

SEQ ID NO: 3383784 - DNA, 16 bp, Homo sapiens
agaaatggggaattct

SEQ ID NO: 3383785 - DNA, 15 bp, Homo sapiens
agaaatgtaaactgc

SEQ ID NO: 3383786 - DNA, 18 bp, Homo sapiens
agaaatgtaaactgccat

SEQ ID NO: 3383787 - DNA, 20 bp, Homo sapiens
agaaatgtctaaatgctgaa

SEQ ID NO: 3383788 - DNA, 20 bp, Homo sapiens
agaaatgtgtcaatgtaaag

SEQ ID NO: 3383789 - DNA, 18 bp, Homo sapiens
agaaattacctgtggata

SEQ ID NO: 3383790 - DNA, 19 bp, Homo sapiens
agaaattacctgtggatat

SEQ ID NO: 3383791 - DNA, 20 bp, Homo sapiens
agaaattacctgtggatatt

SEQ ID NO: 3383792 - DNA, 11 bp, Homo sapiens
agaaattagaa

SEQ ID NO: 3383793 - DNA, 18 bp, Homo sapiens
agaaattataattttagt

SEQ ID NO: 3383794 - DNA, 14 bp, Homo sapiens
agaaattctcttta

SEQ ID NO: 3383795 - DNA, 22 bp, Homo sapiens
agaaattctgttaaaatctatt

SEQ ID NO: 3383796 - DNA, 15 bp, Homo sapiens
agaaatttactatat

SEQ ID NO: 3383797 - DNA, 20 bp, Homo sapiens
agaaatttatgaagcagatt

SEQ ID NO: 3383798 - DNA, 22 bp, Homo sapiens
agaaatttatgaagcagattta

SEQ ID NO: 3383799 - DNA, 15 bp, Homo sapiens
agaaatttgatttct

SEQ ID NO: 3383800 - DNA, 20 bp, Homo sapiens
agaaatttgatttctattca

SEQ ID NO: 3383801 - DNA, 13 bp, Homo sapiens
agaaatttgcaac

SEQ ID NO: 3383802 - DNA, 14 bp, Homo sapiens
agaaatttttatca

SEQ ID NO: 3383803 - DNA, 18 bp, Homo sapiens
agaaatttttatttttga

SEQ ID NO: 3383804 - DNA, 20 bp, Homo sapiens
agaacaaaaagaaatcttgt

SEQ ID NO: 3383805 - DNA, 13 bp, Homo sapiens
agaacaaagctgt

SEQ ID NO: 3383806 - DNA, 15 bp, Homo sapiens
agacacctggactga

SEQ ID NO: 3383807 - DNA, 17 bp, Homo sapiens
agacacctgttcacaga

SEQ ID NO: 3383808 - DNA, 21 bp, Homo sapiens
agacacctgttcacagaaaaa

SEQ ID NO: 3383809 - DNA, 12 bp, Homo sapiens
agacaccttcat

SEQ ID NO: 3383810 - DNA, 19 bp, Homo sapiens
agacaccttgacagggcac

SEQ ID NO: 3383811 - DNA, 22 bp, Homo sapiens
agacaccttggacatcctcctc

SEQ ID NO: 3383812 - DNA, 21 bp, Homo sapiens
agacacgctcgcgggcagcgg

SEQ ID NO: 3383813 - DNA, 17 bp, Homo sapiens
agacacgtggcctcgtg

SEQ ID NO: 3383814 - DNA, 19 bp, Homo sapiens
agacacgtggcctcgtgag

SEQ ID NO: 3383815 - DNA, 17 bp, Homo sapiens
agacactaaatgcagac

SEQ ID NO: 3383816 - DNA, 22 bp, Homo sapiens
agacactaacgacttcagggca

SEQ ID NO: 3383817 - DNA, 20 bp, Homo sapiens
agacactgccgacatcagca

SEQ ID NO: 3383818 - DNA, 23 bp, Homo sapiens
agacactgccgacatcagcattg

SEQ ID NO: 3383819 - DNA, 14 bp, Homo sapiens
agacacttatttat

SEQ ID NO: 3383820 - DNA, 15 bp, Homo sapiens
agacacttatttatt

SEQ ID NO: 3383821 - DNA, 15 bp, Homo sapiens
agacacttcagatct

SEQ ID NO: 3383822 - DNA, 15 bp, Homo sapiens
agacacttgccttct

SEQ ID NO: 3383823 - DNA, 13 bp, Homo sapiens
agacactttggaa

SEQ ID NO: 3383824 - DNA, 14 bp, Homo sapiens
agacagaaactgga

SEQ ID NO: 3383825 - DNA, 17 bp, Homo sapiens
agacagaacttgaatgt

SEQ ID NO: 3383826 - DNA, 14 bp, Homo sapiens
agacagaatgtatc

SEQ ID NO: 3383827 - DNA, 14 bp, Homo sapiens
agacagacacacag

SEQ ID NO: 3383828 - DNA, 17 bp, Homo sapiens
agacagaccacttgcca

SEQ ID NO: 3383829 - DNA, 15 bp, Homo sapiens
agacagagacaagta

SEQ ID NO: 3383830 - DNA, 20 bp, Homo sapiens
agacagagaggactgtaggg

SEQ ID NO: 3383831 - DNA, 22 bp, Homo sapiens
agacagaggggatggggataga

SEQ ID NO: 3383832 - DNA, 20 bp, Homo sapiens
agacagagtccctggctcct

SEQ ID NO: 3383833 - DNA, 11 bp, Homo sapiens
agacagagtct

SEQ ID NO: 3383834 - DNA, 20 bp, Homo sapiens
agacagccccagagcagggt

SEQ ID NO: 3383835 - DNA, 11 bp, Homo sapiens
agacagcctct

SEQ ID NO: 3383836 - DNA, 15 bp, Homo sapiens
agacaggaacccttg

SEQ ID NO: 3383837 - DNA, 21 bp, Homo sapiens
agacaggacagtgcttcagcc

SEQ ID NO: 3383838 - DNA, 23 bp, Homo sapiens
agacaggcaagcacctcctgcct

SEQ ID NO: 3383839 - DNA, 16 bp, Homo sapiens
agacaggcccaagaga

SEQ ID NO: 3383840 - DNA, 16 bp, Homo sapiens
agacagggtaggaaag

SEQ ID NO: 3383841 - DNA, 15 bp, Homo sapiens
agacagtatatttat

SEQ ID NO: 3383842 - DNA, 23 bp, Homo sapiens
agacagtatttattggtgggttg

SEQ ID NO: 3383843 - DNA, 20 bp, Homo sapiens
agacagtgagacagtctgga

SEQ ID NO: 3383844 - DNA, 19 bp, Homo sapiens
agacagtgatattggaact

SEQ ID NO: 3383845 - DNA, 18 bp, Homo sapiens
agacagtgatctccatat

SEQ ID NO: 3383846 - DNA, 13 bp, Homo sapiens
agacagtggttct

SEQ ID NO: 3383847 - DNA, 11 bp, Homo sapiens
agacagtgtac

SEQ ID NO: 3383848 - DNA, 14 bp, Homo sapiens
agacagttcaagaa

SEQ ID NO: 3383849 - DNA, 21 bp, Homo sapiens
agacagtttcttagcttttta

SEQ ID NO: 3383850 - DNA, 11 bp, Homo sapiens
agacataaagc

SEQ ID NO: 3383851 - DNA, 12 bp, Homo sapiens
agacataaagcc

SEQ ID NO: 3383852 - DNA, 16 bp, Homo sapiens
agacatagcatccaag

SEQ ID NO: 3383853 - DNA, 18 bp, Homo sapiens
agacataggccatgaaaa

SEQ ID NO: 3383854 - DNA, 17 bp, Homo sapiens
agacatgaatgcacact

SEQ ID NO: 3383855 - DNA, 15 bp, Homo sapiens
agacatgatttcctt

SEQ ID NO: 3383856 - DNA, 15 bp, Homo sapiens
agacatggaaaagga

SEQ ID NO: 3383857 - DNA, 18 bp, Homo sapiens
agacatggagactcctgc

SEQ ID NO: 3383858 - DNA, 19 bp, Homo sapiens
agacatggagactcctgcc

SEQ ID NO: 3383859 - DNA, 22 bp, Homo sapiens
agacatggagactcctgccctg

SEQ ID NO: 3383860 - DNA, 20 bp, Homo sapiens
agacatggaggttctaaggc

SEQ ID NO: 3383861 - DNA, 21 bp, Homo sapiens
agacatggaggttctaaggcc

SEQ ID NO: 3383862 - DNA, 21 bp, Homo sapiens
agacatggatgcgaggaccac

SEQ ID NO: 3383863 - DNA, 13 bp, Homo sapiens
agacatgtgacat

SEQ ID NO: 3383864 - DNA, 17 bp, Homo sapiens
agacatgttgtaaatta

SEQ ID NO: 3383865 - DNA, 13 bp, Homo sapiens
agacattgtcaat

SEQ ID NO: 3383866 - DNA, 16 bp, Homo sapiens
agacattgtcaataaa

SEQ ID NO: 3383867 - DNA, 17 bp, Homo sapiens
agacatttgatagaaag

SEQ ID NO: 3383868 - DNA, 13 bp, Homo sapiens
agacattttcata

SEQ ID NO: 3383869 - DNA, 14 bp, Homo sapiens
agacattttcatat

SEQ ID NO: 3383870 - DNA, 15 bp, Homo sapiens
agacattttttgcta

SEQ ID NO: 3383871 - DNA, 18 bp, Homo sapiens
agacattttttgctataa

SEQ ID NO: 3383872 - DNA, 22 bp, Homo sapiens
agacattttttgctataatcat

SEQ ID NO: 3383873 - DNA, 17 bp, Homo sapiens
agaccaaaatgacaatg

SEQ ID NO: 3383874 - DNA, 17 bp, Homo sapiens
agaccaaaggaaggaac

SEQ ID NO: 3383875 - DNA, 11 bp, Homo sapiens
agaccaaggaa

SEQ ID NO: 3383876 - DNA, 21 bp, Homo sapiens
agaccacagggttcaaaatgt

SEQ ID NO: 3383877 - DNA, 12 bp, Homo sapiens
agaccagcctcg

SEQ ID NO: 3383878 - DNA, 16 bp, Homo sapiens
agaccaggatttctaa

SEQ ID NO: 3383879 - DNA, 15 bp, Homo sapiens
agaccaggctgtgtc

SEQ ID NO: 3383880 - DNA, 13 bp, Homo sapiens
agaccagtgaccc

SEQ ID NO: 3383881 - DNA, 23 bp, Homo sapiens
agaccagttgggagcactggagt

SEQ ID NO: 3383882 - DNA, 15 bp, Homo sapiens
agaccatagtgacca

SEQ ID NO: 3383883 - DNA, 12 bp, Homo sapiens
agaccattctgt

SEQ ID NO: 3383884 - DNA, 15 bp, Homo sapiens
agaccattctgtgac

SEQ ID NO: 3383885 - DNA, 22 bp, Homo sapiens
agacccaaagcggtccctgtcc

SEQ ID NO: 3383886 - DNA, 13 bp, Homo sapiens
agacccaccccac

SEQ ID NO: 3383887 - DNA, 18 bp, Homo sapiens
agacccaccccacctgca

SEQ ID NO: 3383888 - DNA, 14 bp, Homo sapiens
agacccaggtcttc

SEQ ID NO: 3383889 - DNA, 16 bp, Homo sapiens
agacccaggtcttcca

SEQ ID NO: 3383890 - DNA, 21 bp, Homo sapiens
agacccaggtcttccagacct

SEQ ID NO: 3383891 - DNA, 21 bp, Homo sapiens
agacccaggtggagggcacag

SEQ ID NO: 3383892 - DNA, 13 bp, Homo sapiens
agacccatgctgg

SEQ ID NO: 3383893 - DNA, 14 bp, Homo sapiens
agacccatgctggt

SEQ ID NO: 3383894 - DNA, 13 bp, Homo sapiens
agaccccagggca

SEQ ID NO: 3383895 - DNA, 13 bp, Homo sapiens
agacccccacacc

SEQ ID NO: 3383896 - DNA, 15 bp, Homo sapiens
agacccccaggcctg

SEQ ID NO: 3383897 - DNA, 17 bp, Homo sapiens
agacccctctggccagg

SEQ ID NO: 3383898 - DNA, 14 bp, Homo sapiens
agacccctggcttt

SEQ ID NO: 3383899 - DNA, 13 bp, Homo sapiens
agacccctgggag

SEQ ID NO: 3383900 - DNA, 13 bp, Homo sapiens
agacccctgtctt

SEQ ID NO: 3383901 - DNA, 17 bp, Homo sapiens
agacccggtcctgccct

SEQ ID NO: 3383902 - DNA, 12 bp, Homo sapiens
agaccctcgggc

SEQ ID NO: 3383903 - DNA, 15 bp, Homo sapiens
agaccctctgccacc

SEQ ID NO: 3383904 - DNA, 16 bp, Homo sapiens
agaccctctgccacca

SEQ ID NO: 3383905 - DNA, 15 bp, Homo sapiens
agaccctcttgccca

SEQ ID NO: 3383906 - DNA, 11 bp, Homo sapiens
agaccctgaga

SEQ ID NO: 3383907 - DNA, 14 bp, Homo sapiens
agaccctgagactc

SEQ ID NO: 3383908 - DNA, 18 bp, Homo sapiens
agaccctgagactccaga

SEQ ID NO: 3383909 - DNA, 20 bp, Homo sapiens
agaccctgcaaacagaacag

SEQ ID NO: 3383910 - DNA, 20 bp, Homo sapiens
agaccctggaattcagcacc

SEQ ID NO: 3383911 - DNA, 22 bp, Homo sapiens
agaccctggaattcagcaccct

SEQ ID NO: 3383912 - DNA, 15 bp, Homo sapiens
agaccctgggagaga

SEQ ID NO: 3383913 - DNA, 22 bp, Homo sapiens
agaccctgggtgggctctgtgc

SEQ ID NO: 3383914 - DNA, 14 bp, Homo sapiens
agaccctggtgcct

SEQ ID NO: 3383915 - DNA, 19 bp, Homo sapiens
agaccctggtgcctggctc

SEQ ID NO: 3383916 - DNA, 14 bp, Homo sapiens
agaccctgtgttca

SEQ ID NO: 3383917 - DNA, 16 bp, Homo sapiens
agaccgagtgaaccta

SEQ ID NO: 3383918 - DNA, 14 bp, Homo sapiens
agaccgctctcttt

SEQ ID NO: 3383919 - DNA, 19 bp, Homo sapiens
agaccgcttcacccctgca

SEQ ID NO: 3383920 - DNA, 21 bp, Homo sapiens
agaccgcttcacccctgcact

SEQ ID NO: 3383921 - DNA, 14 bp, Homo sapiens
agaccgtcctcacc

SEQ ID NO: 3383922 - DNA, 15 bp, Homo sapiens
agaccgtcctcaccc

SEQ ID NO: 3383923 - DNA, 18 bp, Homo sapiens
agaccgtcctcacccctg

SEQ ID NO: 3383924 - DNA, 19 bp, Homo sapiens
agaccgtcctcacccctgt

SEQ ID NO: 3383925 - DNA, 23 bp, Homo sapiens
agacctacctcaggttgctggtt

SEQ ID NO: 3383926 - DNA, 17 bp, Homo sapiens
agacctactgttctaaa

SEQ ID NO: 3383927 - DNA, 19 bp, Homo sapiens
agacctactgttctaaagc

SEQ ID NO: 3383928 - DNA, 21 bp, Homo sapiens
agacctactgttctaaagctc

SEQ ID NO: 3383929 - DNA, 19 bp, Homo sapiens
agacctagggaggacctta

SEQ ID NO: 3383930 - DNA, 16 bp, Homo sapiens
agacctatgtaagaat

SEQ ID NO: 3383931 - DNA, 14 bp, Homo sapiens
agacctcaagccct

SEQ ID NO: 3383932 - DNA, 17 bp, Homo sapiens
agacctcaagccctgag

SEQ ID NO: 3383933 - DNA, 16 bp, Homo sapiens
agatagaatttccaat

SEQ ID NO: 3383934 - DNA, 13 bp, Homo sapiens
agatagagaaata

SEQ ID NO: 3383935 - DNA, 14 bp, Homo sapiens
agatagagctgggt

SEQ ID NO: 3383936 - DNA, 15 bp, Homo sapiens
agatagagctgggtg

SEQ ID NO: 3383937 - DNA, 20 bp, Homo sapiens
agatagagctgggtggcctg

SEQ ID NO: 3383938 - DNA, 14 bp, Homo sapiens
agatagatttggaa

SEQ ID NO: 3383939 - DNA, 16 bp, Homo sapiens
agatagatttggaata

SEQ ID NO: 3383940 - DNA, 20 bp, Homo sapiens
agatagctattaagatactt

SEQ ID NO: 3383941 - DNA, 14 bp, Homo sapiens
agataggctctgca

SEQ ID NO: 3383942 - DNA, 22 bp, Homo sapiens
agataggctctgcacagatgga

SEQ ID NO: 3383943 - DNA, 15 bp, Homo sapiens
agataggtaaatacc

SEQ ID NO: 3383944 - DNA, 18 bp, Homo sapiens
agatagtaaaacacttat

SEQ ID NO: 3383945 - DNA, 17 bp, Homo sapiens
agatagtagcatacatt

SEQ ID NO: 3383946 - DNA, 11 bp, Homo sapiens
agatagtttat

SEQ ID NO: 3383947 - DNA, 15 bp, Homo sapiens
agatataactgtaca

SEQ ID NO: 3383948 - DNA, 21 bp, Homo sapiens
agatataatgaacaaaattat

SEQ ID NO: 3383949 - DNA, 15 bp, Homo sapiens
agatatactttgtgg

SEQ ID NO: 3383950 - DNA, 17 bp, Homo sapiens
agatatactttgtggac

SEQ ID NO: 3383951 - DNA, 23 bp, Homo sapiens
agatatactttgtggaccaatta

SEQ ID NO: 3383952 - DNA, 16 bp, Homo sapiens
agatatatttcacttt

SEQ ID NO: 3383953 - DNA, 22 bp, Homo sapiens
agatatatttcacttttgttct

SEQ ID NO: 3383954 - DNA, 15 bp, Homo sapiens
agatatcaaaattct

SEQ ID NO: 3383955 - DNA, 17 bp, Homo sapiens
agatatcagtgtctccc

SEQ ID NO: 3383956 - DNA, 14 bp, Homo sapiens
agatatctttttca

SEQ ID NO: 3383957 - DNA, 18 bp, Homo sapiens
agatatgaacatattgtt

SEQ ID NO: 3383958 - DNA, 19 bp, Homo sapiens
agatattataagggagagc

SEQ ID NO: 3383959 - DNA, 16 bp, Homo sapiens
agatattgatattgaa

SEQ ID NO: 3383960 - DNA, 14 bp, Homo sapiens
agatattgctacta

SEQ ID NO: 3383961 - DNA, 19 bp, Homo sapiens
agatattgtgaagtacata

SEQ ID NO: 3383962 - DNA, 21 bp, Homo sapiens
agatattgtgaagtacatatt

SEQ ID NO: 3383963 - DNA, 16 bp, Homo sapiens
agatatttggcttaaa

SEQ ID NO: 3383964 - DNA, 20 bp, Homo sapiens
agatatttggcttaaatata

SEQ ID NO: 3383965 - DNA, 21 bp, Homo sapiens
agatatttggcttaaatatag

SEQ ID NO: 3383966 - DNA, 22 bp, Homo sapiens
agatattttttcagaaatatgt

SEQ ID NO: 3383967 - DNA, 12 bp, Homo sapiens
agatcaaaataa

SEQ ID NO: 3383968 - DNA, 14 bp, Homo sapiens
agatcaaaataaaa

SEQ ID NO: 3383969 - DNA, 19 bp, Homo sapiens
agatcaaccccttcgctcc

SEQ ID NO: 3383970 - DNA, 21 bp, Homo sapiens
agatcaaccccttcgctcctg

SEQ ID NO: 3383971 - DNA, 17 bp, Homo sapiens
agatcaacgcctcactg

SEQ ID NO: 3383972 - DNA, 21 bp, Homo sapiens
agatcaatttgtaattgctta

SEQ ID NO: 3383973 - DNA, 18 bp, Homo sapiens
agatcacaccactgtact

SEQ ID NO: 3383974 - DNA, 18 bp, Homo sapiens
agatcacagcctccaggg

SEQ ID NO: 3383975 - DNA, 15 bp, Homo sapiens
agatcaccagcccgg

SEQ ID NO: 3383976 - DNA, 14 bp, Homo sapiens
agatcacgccactg

SEQ ID NO: 3383977 - DNA, 15 bp, Homo sapiens
agatcacgccactgc

SEQ ID NO: 3383978 - DNA, 18 bp, Homo sapiens
agatcactgaatttataa

SEQ ID NO: 3383979 - DNA, 19 bp, Homo sapiens
agatcactttctcagtttt

SEQ ID NO: 3383980 - DNA, 20 bp, Homo sapiens
agatcagaacattcagctct

SEQ ID NO: 3383981 - DNA, 21 bp, Homo sapiens
agatcagaacattcagctctg

SEQ ID NO: 3383982 - DNA, 22 bp, Homo sapiens
agatcagatgctccaagattct

SEQ ID NO: 3383983 - DNA, 18 bp, Homo sapiens
agatcaggcagtgtttaa

SEQ ID NO: 3383984 - DNA, 21 bp, Homo sapiens
agatcatccagaagttcctca

SEQ ID NO: 3383985 - DNA, 19 bp, Homo sapiens
agatccaaggcagggaaag

SEQ ID NO: 3383986 - DNA, 14 bp, Homo sapiens
agatccacacacag

SEQ ID NO: 3383987 - DNA, 19 bp, Homo sapiens
agatccatttgcctttctg

SEQ ID NO: 3383988 - DNA, 22 bp, Homo sapiens
agatccatttgcctttctggga

SEQ ID NO: 3383989 - DNA, 13 bp, Homo sapiens
agatcccatctct

SEQ ID NO: 3383990 - DNA, 21 bp, Homo sapiens
agatccccaaaacaggccagg

SEQ ID NO: 3383991 - DNA, 17 bp, Homo sapiens
agatccccgttcctgac

SEQ ID NO: 3383992 - DNA, 14 bp, Homo sapiens
agatcccctgagcc

SEQ ID NO: 3383993 - DNA, 15 bp, Homo sapiens
agatccgtgaattct

SEQ ID NO: 3383994 - DNA, 16 bp, Homo sapiens
agatcctaagatgtgt

SEQ ID NO: 3383995 - DNA, 12 bp, Homo sapiens
agatcctcctgc

SEQ ID NO: 3383996 - DNA, 16 bp, Homo sapiens
agatcgagaccatcct

SEQ ID NO: 3383997 - DNA, 17 bp, Homo sapiens
agatcgagaccatcctg

SEQ ID NO: 3383998 - DNA, 14 bp, Homo sapiens
agatcgctcactgt

SEQ ID NO: 3383999 - DNA, 15 bp, Homo sapiens
agatcgctcactgtt

SEQ ID NO: 3384000 - DNA, 14 bp, Homo sapiens
agatcgcttgagcc

SEQ ID NO: 3384001 - DNA, 16 bp, Homo sapiens
agatcgcttgagccca

SEQ ID NO: 3384002 - DNA, 20 bp, Homo sapiens
agatcgcttgagcccaggag

SEQ ID NO: 3384003 - DNA, 13 bp, Homo sapiens
agatcggccacag

SEQ ID NO: 3384004 - DNA, 16 bp, Homo sapiens
agatcggccacagggc

SEQ ID NO: 3384005 - DNA, 23 bp, Homo sapiens
agatcgtgtattgagatttctta

SEQ ID NO: 3384006 - DNA, 14 bp, Homo sapiens
agatctaatgtgaa

SEQ ID NO: 3384007 - DNA, 14 bp, Homo sapiens
agatctataaagcg

SEQ ID NO: 3384008 - DNA, 16 bp, Homo sapiens
agatctataaagcgat

SEQ ID NO: 3384009 - DNA, 19 bp, Homo sapiens
agatctatatttttgtact

SEQ ID NO: 3384010 - DNA, 12 bp, Homo sapiens
agatctcccact

SEQ ID NO: 3384011 - DNA, 16 bp, Homo sapiens
agatctcggtttgcca

SEQ ID NO: 3384012 - DNA, 19 bp, Homo sapiens
agatctgaacacagtttag

SEQ ID NO: 3384013 - DNA, 23 bp, Homo sapiens
agatctgatggtgagctgggaag

SEQ ID NO: 3384014 - DNA, 21 bp, Homo sapiens
agatctgcagggggtgtgtct

SEQ ID NO: 3384015 - DNA, 20 bp, Homo sapiens
agatctgcctgggcctgtgc

SEQ ID NO: 3384016 - DNA, 22 bp, Homo sapiens
agatctgcctgggcctgtgcag

SEQ ID NO: 3384017 - DNA, 18 bp, Homo sapiens
agatctggttttgctatt

SEQ ID NO: 3384018 - DNA, 15 bp, Homo sapiens
agatctgtctccaag

SEQ ID NO: 3384019 - DNA, 12 bp, Homo sapiens
agatctgtgccc

SEQ ID NO: 3384020 - DNA, 13 bp, Homo sapiens
agatctgtgcccc

SEQ ID NO: 3384021 - DNA, 16 bp, Homo sapiens
agatctgtgccccatg

SEQ ID NO: 3384022 - DNA, 14 bp, Homo sapiens
agatctgttttgaa

SEQ ID NO: 3384023 - DNA, 18 bp, Homo sapiens
agatctgttttgaaggca

SEQ ID NO: 3384024 - DNA, 17 bp, Homo sapiens
agatcttatattggttt

SEQ ID NO: 3384025 - DNA, 20 bp, Homo sapiens
agatcttccgtggtcagagt

SEQ ID NO: 3384026 - DNA, 19 bp, Homo sapiens
agatctttcagaaatataa

SEQ ID NO: 3384027 - DNA, 20 bp, Homo sapiens
agatctttcagaaatataac

SEQ ID NO: 3384028 - DNA, 13 bp, Homo sapiens
agatctttcccag

SEQ ID NO: 3384029 - DNA, 20 bp, Homo sapiens
agatctttctttccaaaaca

SEQ ID NO: 3384030 - DNA, 21 bp, Homo sapiens
agatgaaataaagacccaggg

SEQ ID NO: 3384031 - DNA, 21 bp, Homo sapiens
agatgaactctgaactttgga

SEQ ID NO: 3384032 - DNA, 21 bp, Homo sapiens
agatgaactctttctggcctg

SEQ ID NO: 3384033 - DNA, 20 bp, Homo sapiens
agatgaactgactgaaggaa

SEQ ID NO: 3384034 - DNA, 14 bp, Homo sapiens
agatgaagaagcct

SEQ ID NO: 3384035 - DNA, 20 bp, Homo sapiens
agatgaagagtgagagggca

SEQ ID NO: 3384036 - DNA, 15 bp, Homo sapiens
agatgaagttttaca

SEQ ID NO: 3384037 - DNA, 11 bp, Homo sapiens
agatgaataaa

SEQ ID NO: 3384038 - DNA, 23 bp, Homo sapiens
agatgaccataattttttttaaa

SEQ ID NO: 3384039 - DNA, 15 bp, Homo sapiens
agatgagaacaaagc

SEQ ID NO: 3384040 - DNA, 18 bp, Homo sapiens
agatgagaacaaagctgt

SEQ ID NO: 3384041 - DNA, 20 bp, Homo sapiens
agatgagatttgccagcaca

SEQ ID NO: 3384042 - DNA, 17 bp, Homo sapiens
agatgaggacagagtgg

SEQ ID NO: 3384043 - DNA, 16 bp, Homo sapiens
agatgagggtgactgt

SEQ ID NO: 3384044 - DNA, 14 bp, Homo sapiens
agatgataaagaga

SEQ ID NO: 3384045 - DNA, 18 bp, Homo sapiens
agatgataaagagacagt

SEQ ID NO: 3384046 - DNA, 13 bp, Homo sapiens
agatgatccatga

SEQ ID NO: 3384047 - DNA, 14 bp, Homo sapiens
agatgatctctcca

SEQ ID NO: 3384048 - DNA, 18 bp, Homo sapiens
agatgattaaataagatt

SEQ ID NO: 3384049 - DNA, 21 bp, Homo sapiens
agatgattaaataagattcta

SEQ ID NO: 3384050 - DNA, 21 bp, Homo sapiens
agatgattatatattgttgtt

SEQ ID NO: 3384051 - DNA, 14 bp, Homo sapiens
agatgatttggtca

SEQ ID NO: 3384052 - DNA, 18 bp, Homo sapiens
agatgcaatgtgctactg

SEQ ID NO: 3384053 - DNA, 15 bp, Homo sapiens
agatgcaccagccct

SEQ ID NO: 3384054 - DNA, 23 bp, Homo sapiens
agatgcactatatgtttacacaa

SEQ ID NO: 3384055 - DNA, 12 bp, Homo sapiens
agatgcactgaa

SEQ ID NO: 3384056 - DNA, 14 bp, Homo sapiens
agatgcagagagcc

SEQ ID NO: 3384057 - DNA, 17 bp, Homo sapiens
agatgcagagagccatt

SEQ ID NO: 3384058 - DNA, 18 bp, Homo sapiens
agatgcagagagccattt

SEQ ID NO: 3384059 - DNA, 22 bp, Homo sapiens
agcagagaatgaaagggcccag

SEQ ID NO: 3384060 - DNA, 23 bp, Homo sapiens
agcagagaatgaaagggcccaga

SEQ ID NO: 3384061 - DNA, 14 bp, Homo sapiens
agcagagaattctc

SEQ ID NO: 3384062 - DNA, 17 bp, Homo sapiens
agcagagcaaatgaggg

SEQ ID NO: 3384063 - DNA, 18 bp, Homo sapiens
agcagagcaaatgaggga

SEQ ID NO: 3384064 - DNA, 18 bp, Homo sapiens
agcagaggaattatgaac

SEQ ID NO: 3384065 - DNA, 21 bp, Homo sapiens
agcagaggacagtctggagaa

SEQ ID NO: 3384066 - DNA, 21 bp, Homo sapiens
agcagaggccctgtggtcccc

SEQ ID NO: 3384067 - DNA, 23 bp, Homo sapiens
agcagaggggccaggcccaggca

SEQ ID NO: 3384068 - DNA, 19 bp, Homo sapiens
agcagagggggagtagcca

SEQ ID NO: 3384069 - DNA, 19 bp, Homo sapiens
agcagagtctgggcctctg

SEQ ID NO: 3384070 - DNA, 17 bp, Homo sapiens
agcagagtgcacagctg

SEQ ID NO: 3384071 - DNA, 23 bp, Homo sapiens
agcagagtgcacagctgtccact

SEQ ID NO: 3384072 - DNA, 16 bp, Homo sapiens
agcagagtggactgca

SEQ ID NO: 3384073 - DNA, 14 bp, Homo sapiens
agcagagttaaatc

SEQ ID NO: 3384074 - DNA, 18 bp, Homo sapiens
agcagagttaaatctcaa

SEQ ID NO: 3384075 - DNA, 12 bp, Homo sapiens
agcagagtttac

SEQ ID NO: 3384076 - DNA, 12 bp, Homo sapiens
agcagataactt

SEQ ID NO: 3384077 - DNA, 18 bp, Homo sapiens
agcagatctgttttgtgg

SEQ ID NO: 3384078 - DNA, 16 bp, Homo sapiens
agcagatgcagagagc

SEQ ID NO: 3384079 - DNA, 21 bp, Homo sapiens
agcagattttaattttgaata

SEQ ID NO: 3384080 - DNA, 15 bp, Homo sapiens
agcagcaaaaatata

SEQ ID NO: 3384081 - DNA, 18 bp, Homo sapiens
agcagcaccaaccacagc

SEQ ID NO: 3384082 - DNA, 15 bp, Homo sapiens
agcagcaggtctaga

SEQ ID NO: 3384083 - DNA, 13 bp, Homo sapiens
agcagcaggtgat

SEQ ID NO: 3384084 - DNA, 18 bp, Homo sapiens
agcagcatctgctaataa

SEQ ID NO: 3384085 - DNA, 14 bp, Homo sapiens
agcagcatggaaaa

SEQ ID NO: 3384086 - DNA, 17 bp, Homo sapiens
agcagcatggaaaaatg

SEQ ID NO: 3384087 - DNA, 19 bp, Homo sapiens
agcagcatggaaaaatggt

SEQ ID NO: 3384088 - DNA, 12 bp, Homo sapiens
agcagccagcca

SEQ ID NO: 3384089 - DNA, 21 bp, Homo sapiens
agcagccagccagtcttgcct

SEQ ID NO: 3384090 - DNA, 12 bp, Homo sapiens
agcagccagctc

SEQ ID NO: 3384091 - DNA, 17 bp, Homo sapiens
agcagcccatggcctct

SEQ ID NO: 3384092 - DNA, 18 bp, Homo sapiens
agcagcccatggcctctg

SEQ ID NO: 3384093 - DNA, 14 bp, Homo sapiens
agcagccctaagga

SEQ ID NO: 3384094 - DNA, 20 bp, Homo sapiens
agcagccctcaacaggccca

SEQ ID NO: 3384095 - DNA, 21 bp, Homo sapiens
agcagccctcaacaggcccag

SEQ ID NO: 3384096 - DNA, 12 bp, Homo sapiens
agcagcccttgc

SEQ ID NO: 3384097 - DNA, 13 bp, Homo sapiens
agcagcccttgct

SEQ ID NO: 3384098 - DNA, 13 bp, Homo sapiens
agcagcctgagca

SEQ ID NO: 3384099 - DNA, 23 bp, Homo sapiens
agcagcctgcgctcggcaggaag

SEQ ID NO: 3384100 - DNA, 18 bp, Homo sapiens
agcagcgaccgccccctc

SEQ ID NO: 3384101 - DNA, 12 bp, Homo sapiens
agcagcgggcta

SEQ ID NO: 3384102 - DNA, 23 bp, Homo sapiens
agcagcgggctaacgggaggctg

SEQ ID NO: 3384103 - DNA, 22 bp, Homo sapiens
agcagcggtttggggagcagag

SEQ ID NO: 3384104 - DNA, 21 bp, Homo sapiens
agcagctagctctttggtcta

SEQ ID NO: 3384105 - DNA, 13 bp, Homo sapiens
agcagctcttgct

SEQ ID NO: 3384106 - DNA, 17 bp, Homo sapiens
agcagctcttgctaatc

SEQ ID NO: 3384107 - DNA, 19 bp, Homo sapiens
agcagctgaagaaaaaatc

SEQ ID NO: 3384108 - DNA, 12 bp, Homo sapiens
agcagctgcggg

SEQ ID NO: 3384109 - DNA, 18 bp, Homo sapiens
agcagctggactacccac

SEQ ID NO: 3384110 - DNA, 15 bp, Homo sapiens
agcagcttcaccaga

SEQ ID NO: 3384111 - DNA, 18 bp, Homo sapiens
agcagcttcaccagagca

SEQ ID NO: 3384112 - DNA, 16 bp, Homo sapiens
agcagcttccttctgg

SEQ ID NO: 3384113 - DNA, 22 bp, Homo sapiens
agcagctttaaactcagggaca

SEQ ID NO: 3384114 - DNA, 23 bp, Homo sapiens
agcagctttgggatcccaccctg

SEQ ID NO: 3384115 - DNA, 22 bp, Homo sapiens
agcaggaagcattcagagagca

SEQ ID NO: 3384116 - DNA, 14 bp, Homo sapiens
agcaggacctccct

SEQ ID NO: 3384117 - DNA, 12 bp, Homo sapiens
agcaggacctgg

SEQ ID NO: 3384118 - DNA, 18 bp, Homo sapiens
agcaggagagactgagca

SEQ ID NO: 3384119 - DNA, 15 bp, Homo sapiens
agcaggagattgaga

SEQ ID NO: 3384120 - DNA, 15 bp, Homo sapiens
agcaggaggccaata

SEQ ID NO: 3384121 - DNA, 17 bp, Homo sapiens
agcaggaggccaataaa

SEQ ID NO: 3384122 - DNA, 20 bp, Homo sapiens
agcaggaggccaataaaaag

SEQ ID NO: 3384123 - DNA, 21 bp, Homo sapiens
agcaggaggccaataaaaagt

SEQ ID NO: 3384124 - DNA, 22 bp, Homo sapiens
agcaggaggccaataaaaagtt

SEQ ID NO: 3384125 - DNA, 13 bp, Homo sapiens
agcaggagtggtg

SEQ ID NO: 3384126 - DNA, 21 bp, Homo sapiens
agcaggagtggtgcagacaga

SEQ ID NO: 3384127 - DNA, 14 bp, Homo sapiens
agcaggcagcgcca

SEQ ID NO: 3384128 - DNA, 23 bp, Homo sapiens
agcaggccggaaccacagggcca

SEQ ID NO: 3384129 - DNA, 15 bp, Homo sapiens
agcagggaaacagct

SEQ ID NO: 3384130 - DNA, 17 bp, Homo sapiens
agcagggaaagctccac

SEQ ID NO: 3384131 - DNA, 12 bp, Homo sapiens
agcagggaaggc

SEQ ID NO: 3384132 - DNA, 14 bp, Homo sapiens
agcagggaaggcct

SEQ ID NO: 3384133 - DNA, 17 bp, Homo sapiens
agcagggaaggcctgac

SEQ ID NO: 3384134 - DNA, 20 bp, Homo sapiens
agcagggattaacctctgca

SEQ ID NO: 3384135 - DNA, 21 bp, Homo sapiens
agcagggattaacctctgcac

SEQ ID NO: 3384136 - DNA, 14 bp, Homo sapiens
agcagggcagcagg

SEQ ID NO: 3384137 - DNA, 15 bp, Homo sapiens
agcagggctcagcgg

SEQ ID NO: 3384138 - DNA, 13 bp, Homo sapiens
agcaggggctcca

SEQ ID NO: 3384139 - DNA, 22 bp, Homo sapiens
agcagggggagaaacccttcac

SEQ ID NO: 3384140 - DNA, 15 bp, Homo sapiens
agcaggggggctgtg

SEQ ID NO: 3384141 - DNA, 23 bp, Homo sapiens
agcaggggggctgtgccaacctg

SEQ ID NO: 3384142 - DNA, 17 bp, Homo sapiens
agcagggtaccctttgg

SEQ ID NO: 3384143 - DNA, 21 bp, Homo sapiens
agcagggtagtctggtttcta

SEQ ID NO: 3384144 - DNA, 18 bp, Homo sapiens
agcagggtcgggaaaggc

SEQ ID NO: 3384145 - DNA, 23 bp, Homo sapiens
agcaggtgattggaccaggccat

SEQ ID NO: 3384146 - DNA, 21 bp, Homo sapiens
agcaggtgtcctttcccctct

SEQ ID NO: 3384147 - DNA, 21 bp, Homo sapiens
agcaggttccccaagggccct

SEQ ID NO: 3384148 - DNA, 22 bp, Homo sapiens
agcaggttccccaagggccctg

SEQ ID NO: 3384149 - DNA, 23 bp, Homo sapiens
agcaggttccccaagggccctgg

SEQ ID NO: 3384150 - DNA, 15 bp, Homo sapiens
agcagtacatgggaa

SEQ ID NO: 3384151 - DNA, 14 bp, Homo sapiens
agcagtatatgtta

SEQ ID NO: 3384152 - DNA, 14 bp, Homo sapiens
agcagtcactggga

SEQ ID NO: 3384153 - DNA, 15 bp, Homo sapiens
agcagtcccattcat

SEQ ID NO: 3384154 - DNA, 18 bp, Homo sapiens
agcagtcgcgagcacatg

SEQ ID NO: 3384155 - DNA, 14 bp, Homo sapiens
agcagtcgtgcctg

SEQ ID NO: 3384156 - DNA, 21 bp, Homo sapiens
agcagtcgtgcctgtgtccat

SEQ ID NO: 3384157 - DNA, 15 bp, Homo sapiens
agcagtctaaacaga

SEQ ID NO: 3384158 - DNA, 17 bp, Homo sapiens
agcagtctaaacagagt

SEQ ID NO: 3384159 - DNA, 17 bp, Homo sapiens
agcagtctccttcagca

SEQ ID NO: 3384160 - DNA, 22 bp, Homo sapiens
agcagtgcctcgaggcaccggc

SEQ ID NO: 3384161 - DNA, 17 bp, Homo sapiens
agcagtgccttccataa

SEQ ID NO: 3384162 - DNA, 20 bp, Homo sapiens
agcagtgccttccataatta

SEQ ID NO: 3384163 - DNA, 11 bp, Homo sapiens
agcagtggctg

SEQ ID NO: 3384164 - DNA, 21 bp, Homo sapiens
agcagtggctggtccagggct

SEQ ID NO: 3384165 - DNA, 19 bp, Homo sapiens
agcagtgtcatcagaagat

SEQ ID NO: 3384166 - DNA, 15 bp, Homo sapiens
agcagtgtcttccat

SEQ ID NO: 3384167 - DNA, 21 bp, Homo sapiens
agcagttactccctacactga

SEQ ID NO: 3384168 - DNA, 23 bp, Homo sapiens
agcagttactccctacactgatg

SEQ ID NO: 3384169 - DNA, 13 bp, Homo sapiens
agcagttataaca

SEQ ID NO: 3384170 - DNA, 22 bp, Homo sapiens
agcagttataacagatgtgaaa

SEQ ID NO: 3384171 - DNA, 21 bp, Homo sapiens
agcagttctgttatatcccct

SEQ ID NO: 3384172 - DNA, 20 bp, Homo sapiens
agcagttgacatccaaatct

SEQ ID NO: 3384173 - DNA, 23 bp, Homo sapiens
agcagttgagtcgtcatcacttt

SEQ ID NO: 3384174 - DNA, 19 bp, Homo sapiens
agcagttggatcttttgaa

SEQ ID NO: 3384175 - DNA, 15 bp, Homo sapiens
agcagtttattataa

SEQ ID NO: 3384176 - DNA, 13 bp, Homo sapiens
agcataaaaacat

SEQ ID NO: 3384177 - DNA, 23 bp, Homo sapiens
agcataaagctcaaatgaaatgt

SEQ ID NO: 3384178 - DNA, 17 bp, Homo sapiens
agcataaataaaactga

SEQ ID NO: 3384179 - DNA, 18 bp, Homo sapiens
agcataaataaaactgaa

SEQ ID NO: 3384180 - DNA, 22 bp, Homo sapiens
agcataactgtagctcaagttt

SEQ ID NO: 3384181 - DNA, 18 bp, Homo sapiens
agcataagtatacagttc

SEQ ID NO: 3384182 - DNA, 23 bp, Homo sapiens
agcataattttgtgttgtacaat

SEQ ID NO: 3384183 - DNA, 15 bp, Homo sapiens
agcatacaaaataaa

SEQ ID NO: 3384184 - DNA, 20 bp, Homo sapiens
agccccagggtcttccctac

SEQ ID NO: 3384185 - DNA, 22 bp, Homo sapiens
agccccagggtcttccctacct

SEQ ID NO: 3384186 - DNA, 18 bp, Homo sapiens
agccccagggtgcccaga

SEQ ID NO: 3384187 - DNA, 16 bp, Homo sapiens
agccccagtcttcctt

SEQ ID NO: 3384188 - DNA, 20 bp, Homo sapiens
agccccagtcttccttgtct

SEQ ID NO: 3384189 - DNA, 21 bp, Homo sapiens
agccccagtcttccttgtctc

SEQ ID NO: 3384190 - DNA, 19 bp, Homo sapiens
agccccatctcatcctggc

SEQ ID NO: 3384191 - DNA, 20 bp, Homo sapiens
agccccatctcatcctggca

SEQ ID NO: 3384192 - DNA, 20 bp, Homo sapiens
agcccccaaccccgcggtgc

SEQ ID NO: 3384193 - DNA, 17 bp, Homo sapiens
agcccccaccacaaact

SEQ ID NO: 3384194 - DNA, 19 bp, Homo sapiens
agcccccagatagagctgg

SEQ ID NO: 3384195 - DNA, 23 bp, Homo sapiens
agcccccagatagagctgggtgg

SEQ ID NO: 3384196 - DNA, 16 bp, Homo sapiens
agcccccagccctggg

SEQ ID NO: 3384197 - DNA, 12 bp, Homo sapiens
agcccccaggaa

SEQ ID NO: 3384198 - DNA, 21 bp, Homo sapiens
agcccccaggaagcccaggag

SEQ ID NO: 3384199 - DNA, 16 bp, Homo sapiens
agccccctggcctctg

SEQ ID NO: 3384200 - DNA, 19 bp, Homo sapiens
agccccctggcctctgtgc

SEQ ID NO: 3384201 - DNA, 16 bp, Homo sapiens
agccccgaggccttct

SEQ ID NO: 3384202 - DNA, 22 bp, Homo sapiens
agccccgaggccttctctgaag

SEQ ID NO: 3384203 - DNA, 18 bp, Homo sapiens
agccccgcagacctcccc

SEQ ID NO: 3384204 - DNA, 23 bp, Homo sapiens
agccccgcagacctccccagccc

SEQ ID NO: 3384205 - DNA, 17 bp, Homo sapiens
agccccgccctcttcct

SEQ ID NO: 3384206 - DNA, 18 bp, Homo sapiens
agccccgccctcttcctg

SEQ ID NO: 3384207 - DNA, 14 bp, Homo sapiens
agccccggcccccc

SEQ ID NO: 3384208 - DNA, 17 bp, Homo sapiens
agccccggtggctgggc

SEQ ID NO: 3384209 - DNA, 14 bp, Homo sapiens
agcccctagcccag

SEQ ID NO: 3384210 - DNA, 18 bp, Homo sapiens
agcccctagcccaggaga

SEQ ID NO: 3384211 - DNA, 19 bp, Homo sapiens
agcccctagcccaggagag

SEQ ID NO: 3384212 - DNA, 11 bp, Homo sapiens
agcccctagga

SEQ ID NO: 3384213 - DNA, 16 bp, Homo sapiens
agcccctcagcccttg

SEQ ID NO: 3384214 - DNA, 16 bp, Homo sapiens
agcccctccacgtgat

SEQ ID NO: 3384215 - DNA, 13 bp, Homo sapiens
agcccctccccca

SEQ ID NO: 3384216 - DNA, 21 bp, Homo sapiens
agcccctcccccatctcccac

SEQ ID NO: 3384217 - DNA, 20 bp, Homo sapiens
agcccctcctccagcccctg

SEQ ID NO: 3384218 - DNA, 13 bp, Homo sapiens
agcccctctggtc

SEQ ID NO: 3384219 - DNA, 22 bp, Homo sapiens
agcccctctggtcgctcctgcc

SEQ ID NO: 3384220 - DNA, 17 bp, Homo sapiens
agcccctcttccccaat

SEQ ID NO: 3384221 - DNA, 12 bp, Homo sapiens
agcccctgcccc

SEQ ID NO: 3384222 - DNA, 15 bp, Homo sapiens
agcccctgccccagc

SEQ ID NO: 3384223 - DNA, 16 bp, Homo sapiens
agcccctgccccagcc

SEQ ID NO: 3384224 - DNA, 17 bp, Homo sapiens
agcccctgccccagccc

SEQ ID NO: 3384225 - DNA, 21 bp, Homo sapiens
agcccctgccccagcccaagt

SEQ ID NO: 3384226 - DNA, 13 bp, Homo sapiens
agcccctgcctgg

SEQ ID NO: 3384227 - DNA, 22 bp, Homo sapiens
agcccctggggcctagactctg

SEQ ID NO: 3384228 - DNA, 21 bp, Homo sapiens
agcccctggggtggccaccag

SEQ ID NO: 3384229 - DNA, 12 bp, Homo sapiens
agcccctgggtg

SEQ ID NO: 3384230 - DNA, 14 bp, Homo sapiens
agcccctgtggaga

SEQ ID NO: 3384231 - DNA, 17 bp, Homo sapiens
agccccttatttttagc

SEQ ID NO: 3384232 - DNA, 14 bp, Homo sapiens
agccccttctccca

SEQ ID NO: 3384233 - DNA, 15 bp, Homo sapiens
agccccttctcccct

SEQ ID NO: 3384234 - DNA, 19 bp, Homo sapiens
agccccttctcccctcccc

SEQ ID NO: 3384235 - DNA, 13 bp, Homo sapiens
agcccgcttttgt

SEQ ID NO: 3384236 - DNA, 21 bp, Homo sapiens
agcccggcgccaccatcctgc

SEQ ID NO: 3384237 - DNA, 21 bp, Homo sapiens
agcccggcggggaccttggtc

SEQ ID NO: 3384238 - DNA, 13 bp, Homo sapiens
agcccgggctgcc

SEQ ID NO: 3384239 - DNA, 18 bp, Homo sapiens
agcccgggctgcctgggc

SEQ ID NO: 3384240 - DNA, 19 bp, Homo sapiens
agcccgggctgcctgggct

SEQ ID NO: 3384241 - DNA, 20 bp, Homo sapiens
agcccgggctgcctgggctg

SEQ ID NO: 3384242 - DNA, 14 bp, Homo sapiens
agcccgtctcagtg

SEQ ID NO: 3384243 - DNA, 17 bp, Homo sapiens
agcccgtgaagcagtgc

SEQ ID NO: 3384244 - DNA, 20 bp, Homo sapiens
agcccgtgcagtacaggcaa

SEQ ID NO: 3384245 - DNA, 19 bp, Homo sapiens
agcccgttagccccaggga

SEQ ID NO: 3384246 - DNA, 17 bp, Homo sapiens
agccctaaccccttcca

SEQ ID NO: 3384247 - DNA, 18 bp, Homo sapiens
agccctaaccccttccag

SEQ ID NO: 3384248 - DNA, 16 bp, Homo sapiens
agccctaaggatctct

SEQ ID NO: 3384249 - DNA, 21 bp, Homo sapiens
agccctaaggatctctcagga

SEQ ID NO: 3384250 - DNA, 20 bp, Homo sapiens
agccctactcggatggggca

SEQ ID NO: 3384251 - DNA, 22 bp, Homo sapiens
agccctactcggatggggcacg

SEQ ID NO: 3384252 - DNA, 13 bp, Homo sapiens
agccctatggatg

SEQ ID NO: 3384253 - DNA, 14 bp, Homo sapiens
agccctatggatgt

SEQ ID NO: 3384254 - DNA, 16 bp, Homo sapiens
agccctcaacaggccc

SEQ ID NO: 3384255 - DNA, 20 bp, Homo sapiens
agccctcaacaggcccaggg

SEQ ID NO: 3384256 - DNA, 17 bp, Homo sapiens
agccctcagtcagttcc

SEQ ID NO: 3384257 - DNA, 14 bp, Homo sapiens
agccctccccctca

SEQ ID NO: 3384258 - DNA, 23 bp, Homo sapiens
agccctccccctcaacctcacca

SEQ ID NO: 3384259 - DNA, 21 bp, Homo sapiens
agccctcccccttccccttct

SEQ ID NO: 3384260 - DNA, 22 bp, Homo sapiens
agccctcccccttccccttctg

SEQ ID NO: 3384261 - DNA, 12 bp, Homo sapiens
agccctccctgc

SEQ ID NO: 3384262 - DNA, 19 bp, Homo sapiens
agccctccgaccctcatgg

SEQ ID NO: 3384263 - DNA, 17 bp, Homo sapiens
agccctcctctgcactc

SEQ ID NO: 3384264 - DNA, 18 bp, Homo sapiens
agccctcgaaccaaggca

SEQ ID NO: 3384265 - DNA, 21 bp, Homo sapiens
agccctcgaaccaaggcagcc

SEQ ID NO: 3384266 - DNA, 24 bp, Homo sapiens
agccctcgaaccaaggcagcctcc

SEQ ID NO: 3384267 - DNA, 16 bp, Homo sapiens
agccctgaccttggct

SEQ ID NO: 3384268 - DNA, 22 bp, Homo sapiens
agccctgaggtgaaagggagct

SEQ ID NO: 3384269 - DNA, 12 bp, Homo sapiens
agccctgcagcc

SEQ ID NO: 3384270 - DNA, 17 bp, Homo sapiens
agccctgctgtgggaga

SEQ ID NO: 3384271 - DNA, 20 bp, Homo sapiens
agccctgctttgggctgccc

SEQ ID NO: 3384272 - DNA, 21 bp, Homo sapiens
agccctgctttgggctgccct

SEQ ID NO: 3384273 - DNA, 22 bp, Homo sapiens
agccctgctttgggctgccctg

SEQ ID NO: 3384274 - DNA, 17 bp, Homo sapiens
agccctggacacccctg

SEQ ID NO: 3384275 - DNA, 21 bp, Homo sapiens
agccctggagccaactgctgc

SEQ ID NO: 3384276 - DNA, 22 bp, Homo sapiens
agccctggagccaactgctgct

SEQ ID NO: 3384277 - DNA, 23 bp, Homo sapiens
agccctggagccaactgctgctt

SEQ ID NO: 3384278 - DNA, 12 bp, Homo sapiens
agccctggcagg

SEQ ID NO: 3384279 - DNA, 13 bp, Homo sapiens
agccctggcagga

SEQ ID NO: 3384280 - DNA, 14 bp, Homo sapiens
agccctggctctgc

SEQ ID NO: 3384281 - DNA, 14 bp, Homo sapiens
agccctggctgggt

SEQ ID NO: 3384282 - DNA, 16 bp, Homo sapiens
agccctggctgggttc

SEQ ID NO: 3384283 - DNA, 15 bp, Homo sapiens
agccctgggaaccac

SEQ ID NO: 3384284 - DNA, 16 bp, Homo sapiens
agccctgggaaccact

SEQ ID NO: 3384285 - DNA, 19 bp, Homo sapiens
agccctgggaaccactccc

SEQ ID NO: 3384286 - DNA, 20 bp, Homo sapiens
agccctgggaaccactccca

SEQ ID NO: 3384287 - DNA, 12 bp, Homo sapiens
agccctggggac

SEQ ID NO: 3384288 - DNA, 13 bp, Homo sapiens
agccctggggact

SEQ ID NO: 3384289 - DNA, 13 bp, Homo sapiens
agccctggggctg

SEQ ID NO: 3384290 - DNA, 22 bp, Homo sapiens
agccctggtggcagtgggagct

SEQ ID NO: 3384291 - DNA, 23 bp, Homo sapiens
agccctggtggcagtgggagctg

SEQ ID NO: 3384292 - DNA, 18 bp, Homo sapiens
agccctgtcgagacactt

SEQ ID NO: 3384293 - DNA, 23 bp, Homo sapiens
agccctgtggccgactctgcact

SEQ ID NO: 3384294 - DNA, 14 bp, Homo sapiens
agccctgtggccgc

SEQ ID NO: 3384295 - DNA, 20 bp, Homo sapiens
agccctgtggccgccacctg

SEQ ID NO: 3384296 - DNA, 15 bp, Homo sapiens
agccctgttggcagc

SEQ ID NO: 3384297 - DNA, 18 bp, Homo sapiens
agccctgttggcagctct

SEQ ID NO: 3384298 - DNA, 21 bp, Homo sapiens
agcccttatgcggttaatttt

SEQ ID NO: 3384299 - DNA, 18 bp, Homo sapiens
agcccttcactgccatga

SEQ ID NO: 3384300 - DNA, 15 bp, Homo sapiens
agcccttcaggaagc

SEQ ID NO: 3384301 - DNA, 13 bp, Homo sapiens
agcccttcatttg

SEQ ID NO: 3384302 - DNA, 23 bp, Homo sapiens
agcccttccatgtcgcctctgca

SEQ ID NO: 3384303 - DNA, 14 bp, Homo sapiens
agcccttcctctca

SEQ ID NO: 3384304 - DNA, 18 bp, Homo sapiens
agcccttcggtcacctgt

SEQ ID NO: 3384305 - DNA, 20 bp, Homo sapiens
agcccttgagggagaactta

SEQ ID NO: 3384306 - DNA, 18 bp, Homo sapiens
agcccttgcccccatccc

SEQ ID NO: 3384307 - DNA, 19 bp, Homo sapiens
agcccttgcccccatccct

SEQ ID NO: 3384308 - DNA, 20 bp, Homo sapiens
agcccttgcccccatccctc

SEQ ID NO: 3384309 - DNA, 16 bp, Homo sapiens
agctccccctgtcccc

SEQ ID NO: 3384310 - DNA, 23 bp, Homo sapiens
agctccccctgtcccctcagctc

SEQ ID NO: 3384311 - DNA, 12 bp, Homo sapiens
agctccctgcca

SEQ ID NO: 3384312 - DNA, 12 bp, Homo sapiens
agctccctggag

SEQ ID NO: 3384313 - DNA, 16 bp, Homo sapiens
agctcccttctctgta

SEQ ID NO: 3384314 - DNA, 23 bp, Homo sapiens
agctcccttctctgtagggaact

SEQ ID NO: 3384315 - DNA, 16 bp, Homo sapiens
agctcctcaactcacc

SEQ ID NO: 3384316 - DNA, 16 bp, Homo sapiens
agctcctcagcggctc

SEQ ID NO: 3384317 - DNA, 12 bp, Homo sapiens
agctcctcccac

SEQ ID NO: 3384318 - DNA, 19 bp, Homo sapiens
agctcctccccttcctctt

SEQ ID NO: 3384319 - DNA, 20 bp, Homo sapiens
agctcctctccctcacaagc

SEQ ID NO: 3384320 - DNA, 13 bp, Homo sapiens
agctcctctcctt

SEQ ID NO: 3384321 - DNA, 21 bp, Homo sapiens
agctcctctccttgggctcct

SEQ ID NO: 3384322 - DNA, 15 bp, Homo sapiens
agctcctctgtcctg

SEQ ID NO: 3384323 - DNA, 21 bp, Homo sapiens
agctcctgccacatggagccc

SEQ ID NO: 3384324 - DNA, 18 bp, Homo sapiens
agctcctgctgcggagga

SEQ ID NO: 3384325 - DNA, 22 bp, Homo sapiens
agctcctggtcttgagatgtct

SEQ ID NO: 3384326 - DNA, 13 bp, Homo sapiens
agctcctgtcctc

SEQ ID NO: 3384327 - DNA, 16 bp, Homo sapiens
agctcctgtcctccca

SEQ ID NO: 3384328 - DNA, 17 bp, Homo sapiens
agctcctgtcctcccat

SEQ ID NO: 3384329 - DNA, 15 bp, Homo sapiens
agctcctgtggcccc

SEQ ID NO: 3384330 - DNA, 16 bp, Homo sapiens
agctccttctgtccta

SEQ ID NO: 3384331 - DNA, 21 bp, Homo sapiens
agctccttctgtcctactctg

SEQ ID NO: 3384332 - DNA, 22 bp, Homo sapiens
agctccttctgtcctactctgt

SEQ ID NO: 3384333 - DNA, 23 bp, Homo sapiens
agctccttctgtcctactctgtg

SEQ ID NO: 3384334 - DNA, 12 bp, Homo sapiens
agctccttggag

SEQ ID NO: 3384335 - DNA, 16 bp, Homo sapiens
agctcctttctcctgt

SEQ ID NO: 3384336 - DNA, 18 bp, Homo sapiens
agctcctttctcctgtga

SEQ ID NO: 3384337 - DNA, 23 bp, Homo sapiens
agctccttttccgttctgttctg

SEQ ID NO: 3384338 - DNA, 17 bp, Homo sapiens
agctcgaattaagaata

SEQ ID NO: 3384339 - DNA, 13 bp, Homo sapiens
agctcgatccaaa

SEQ ID NO: 3384340 - DNA, 17 bp, Homo sapiens
agctcgccccacctcca

SEQ ID NO: 3384341 - DNA, 18 bp, Homo sapiens
agctcgccccacctccac

SEQ ID NO: 3384342 - DNA, 21 bp, Homo sapiens
agctcgccccacctccacctg

SEQ ID NO: 3384343 - DNA, 22 bp, Homo sapiens
agctcgccccacctccacctgt

SEQ ID NO: 3384344 - DNA, 14 bp, Homo sapiens
agctcgtttttcag

SEQ ID NO: 3384345 - DNA, 22 bp, Homo sapiens
agctcgtttttcagcaccccca

SEQ ID NO: 3384346 - DNA, 15 bp, Homo sapiens
agctctaccctgctc

SEQ ID NO: 3384347 - DNA, 20 bp, Homo sapiens
agctctaccctgctccctgc

SEQ ID NO: 3384348 - DNA, 14 bp, Homo sapiens
agctctagaatctg

SEQ ID NO: 3384349 - DNA, 20 bp, Homo sapiens
agctctagttttcagccttg

SEQ ID NO: 3384350 - DNA, 20 bp, Homo sapiens
agctctattaagatttccaa

SEQ ID NO: 3384351 - DNA, 19 bp, Homo sapiens
agctctccagtcaggaggc

SEQ ID NO: 3384352 - DNA, 19 bp, Homo sapiens
agctctctgtataaacatt

SEQ ID NO: 3384353 - DNA, 21 bp, Homo sapiens
agctctgaagaactctctgga

SEQ ID NO: 3384354 - DNA, 15 bp, Homo sapiens
agctctgacatccct

SEQ ID NO: 3384355 - DNA, 16 bp, Homo sapiens
agctctgacatccctt

SEQ ID NO: 3384356 - DNA, 19 bp, Homo sapiens
agctctgacatcccttcct

SEQ ID NO: 3384357 - DNA, 21 bp, Homo sapiens
agctctgacatcccttcctgg

SEQ ID NO: 3384358 - DNA, 15 bp, Homo sapiens
agctctgacccttgg

SEQ ID NO: 3384359 - DNA, 19 bp, Homo sapiens
agctctgagccagattaca

SEQ ID NO: 3384360 - DNA, 13 bp, Homo sapiens
agctctgagggga

SEQ ID NO: 3384361 - DNA, 11 bp, Homo sapiens
agctctgcctc

SEQ ID NO: 3384362 - DNA, 12 bp, Homo sapiens
agctctgctcct

SEQ ID NO: 3384363 - DNA, 12 bp, Homo sapiens
agctctggctga

SEQ ID NO: 3384364 - DNA, 18 bp, Homo sapiens
agctctggctgaaccctg

SEQ ID NO: 3384365 - DNA, 14 bp, Homo sapiens
agctctgtcctggg

SEQ ID NO: 3384366 - DNA, 15 bp, Homo sapiens
agctctgtggcctgt

SEQ ID NO: 3384367 - DNA, 18 bp, Homo sapiens
agctctgtggcctgtgtc

SEQ ID NO: 3384368 - DNA, 10 bp, Homo sapiens
agctcttcat

SEQ ID NO: 3384369 - DNA, 18 bp, Homo sapiens
agctcttcattccattga

SEQ ID NO: 3384370 - DNA, 19 bp, Homo sapiens
agctcttcctatccctctc

SEQ ID NO: 3384371 - DNA, 22 bp, Homo sapiens
agctcttcctatccctctccta

SEQ ID NO: 3384372 - DNA, 15 bp, Homo sapiens
agctcttctccaggc

SEQ ID NO: 3384373 - DNA, 18 bp, Homo sapiens
agctcttctccaggctgt

SEQ ID NO: 3384374 - DNA, 16 bp, Homo sapiens
agctcttgcccttccc

SEQ ID NO: 3384375 - DNA, 18 bp, Homo sapiens
agctcttgcccttccctg

SEQ ID NO: 3384376 - DNA, 21 bp, Homo sapiens
agctcttgcccttccctgtcc

SEQ ID NO: 3384377 - DNA, 22 bp, Homo sapiens
agctcttgcccttccctgtccc

SEQ ID NO: 3384378 - DNA, 15 bp, Homo sapiens
agctcttgctaatca

SEQ ID NO: 3384379 - DNA, 15 bp, Homo sapiens
agctcttggagctgt

SEQ ID NO: 3384380 - DNA, 12 bp, Homo sapiens
agctcttggcct

SEQ ID NO: 3384381 - DNA, 14 bp, Homo sapiens
agctctttggtcta

SEQ ID NO: 3384382 - DNA, 15 bp, Homo sapiens
agctgaaacaaaaat

SEQ ID NO: 3384383 - DNA, 22 bp, Homo sapiens
agctgaaacattccgaagaggg

SEQ ID NO: 3384384 - DNA, 17 bp, Homo sapiens
agctgaaattttagaaa

SEQ ID NO: 3384385 - DNA, 21 bp, Homo sapiens
agctgaaccaaagcctcttca

SEQ ID NO: 3384386 - DNA, 22 bp, Homo sapiens
agctgaagaaaaaatcagaact

SEQ ID NO: 3384387 - DNA, 22 bp, Homo sapiens
agctgaatattttttatttcta

SEQ ID NO: 3384388 - DNA, 18 bp, Homo sapiens
agctgaatgcctcctgtg

SEQ ID NO: 3384389 - DNA, 22 bp, Homo sapiens
agctgaatgcctcctgtgggga

SEQ ID NO: 3384390 - DNA, 21 bp, Homo sapiens
agctgacccagagtggagtct

SEQ ID NO: 3384391 - DNA, 21 bp, Homo sapiens
agctgacgggaggccccagct

SEQ ID NO: 3384392 - DNA, 16 bp, Homo sapiens
agctgagaactcctga

SEQ ID NO: 3384393 - DNA, 15 bp, Homo sapiens
agctgagaagaatga

SEQ ID NO: 3384394 - DNA, 16 bp, Homo sapiens
agctgagagccctgct

SEQ ID NO: 3384395 - DNA, 18 bp, Homo sapiens
agctgagagccctgctgt

SEQ ID NO: 3384396 - DNA, 10 bp, Homo sapiens
agctgagcca

SEQ ID NO: 3384397 - DNA, 16 bp, Homo sapiens
agctgagccctgggga

SEQ ID NO: 3384398 - DNA, 11 bp, Homo sapiens
agctgagctgg

SEQ ID NO: 3384399 - DNA, 19 bp, Homo sapiens
agctgagctggaaggggcc

SEQ ID NO: 3384400 - DNA, 21 bp, Homo sapiens
agctgagcttcggttctccag

SEQ ID NO: 3384401 - DNA, 22 bp, Homo sapiens
agctgagttacttgtctgaggc

SEQ ID NO: 3384402 - DNA, 13 bp, Homo sapiens
agctgagtttcct

SEQ ID NO: 3384403 - DNA, 14 bp, Homo sapiens
agctgatataaatt

SEQ ID NO: 3384404 - DNA, 16 bp, Homo sapiens
agctgatataaattct

SEQ ID NO: 3384405 - DNA, 17 bp, Homo sapiens
agctgatataaattctg

SEQ ID NO: 3384406 - DNA, 11 bp, Homo sapiens
agctgatgaaa

SEQ ID NO: 3384407 - DNA, 15 bp, Homo sapiens
agctgatgatgtctc

SEQ ID NO: 3384408 - DNA, 21 bp, Homo sapiens
agctgatgttggaagagaaag

SEQ ID NO: 3384409 - DNA, 21 bp, Homo sapiens
agctgattactgtcaataaac

SEQ ID NO: 3384410 - DNA, 19 bp, Homo sapiens
agctgattgcagaaaggag

SEQ ID NO: 3384411 - DNA, 21 bp, Homo sapiens
agctgattgcagaaaggagag

SEQ ID NO: 3384412 - DNA, 17 bp, Homo sapiens
agctgatttccaggccc

SEQ ID NO: 3384413 - DNA, 15 bp, Homo sapiens
agctgattttaacaa

SEQ ID NO: 3384414 - DNA, 23 bp, Homo sapiens
agctgcaaggtactctggtgagt

SEQ ID NO: 3384415 - DNA, 11 bp, Homo sapiens
agctgcacatg

SEQ ID NO: 3384416 - DNA, 21 bp, Homo sapiens
agctgcacatgtgccacacag

SEQ ID NO: 3384417 - DNA, 14 bp, Homo sapiens
agctgcaccagagc

SEQ ID NO: 3384418 - DNA, 23 bp, Homo sapiens
agctgcaccagagcaacctctca

SEQ ID NO: 3384419 - DNA, 18 bp, Homo sapiens
agctgcacctgccagcct

SEQ ID NO: 3384420 - DNA, 21 bp, Homo sapiens
agctgcacctgccagcctggc

SEQ ID NO: 3384421 - DNA, 11 bp, Homo sapiens
agctgcactga

SEQ ID NO: 3384422 - DNA, 18 bp, Homo sapiens
agctgcacttggcctcag

SEQ ID NO: 3384423 - DNA, 19 bp, Homo sapiens
agctgcagagatttctcat

SEQ ID NO: 3384424 - DNA, 12 bp, Homo sapiens
agctgcagctgg

SEQ ID NO: 3384425 - DNA, 16 bp, Homo sapiens
agctgcagctgggccc

SEQ ID NO: 3384426 - DNA, 14 bp, Homo sapiens
agctgcagcttggg

SEQ ID NO: 3384427 - DNA, 14 bp, Homo sapiens
agctgcaggggcag

SEQ ID NO: 3384428 - DNA, 23 bp, Homo sapiens
agctgcatgtggcttttttaaaa

SEQ ID NO: 3384429 - DNA, 16 bp, Homo sapiens
agctgccagcccagaa

SEQ ID NO: 3384430 - DNA, 18 bp, Homo sapiens
agctgccagcccagaaca

SEQ ID NO: 3384431 - DNA, 19 bp, Homo sapiens
agctgccagcccagaacac

SEQ ID NO: 3384432 - DNA, 15 bp, Homo sapiens
agctgccccagccag

SEQ ID NO: 3384433 - DNA, 17 bp, Homo sapiens
agctgccccggcccctc

SEQ ID NO: 3384434 - DNA, 19 bp, Homo sapiens
agctgccccggcccctccc

SEQ ID NO: 3384435 - DNA, 16 bp, Homo sapiens
aggacatactgcatgt

SEQ ID NO: 3384436 - DNA, 20 bp, Homo sapiens
aggacatgcaataaaattta

SEQ ID NO: 3384437 - DNA, 23 bp, Homo sapiens
aggacatgtttttgttttctttg

SEQ ID NO: 3384438 - DNA, 16 bp, Homo sapiens
aggacattatgtgtgc

SEQ ID NO: 3384439 - DNA, 23 bp, Homo sapiens
aggacattgcggacagccacggc

SEQ ID NO: 3384440 - DNA, 21 bp, Homo sapiens
aggaccacacagtccccagac

SEQ ID NO: 3384441 - DNA, 23 bp, Homo sapiens
aggaccacacagtccccagactc

SEQ ID NO: 3384442 - DNA, 19 bp, Homo sapiens
aggaccacagtgggtggca

SEQ ID NO: 3384443 - DNA, 14 bp, Homo sapiens
aggaccactcagcc

SEQ ID NO: 3384444 - DNA, 22 bp, Homo sapiens
aggaccactcctgtacactgaa

SEQ ID NO: 3384445 - DNA, 15 bp, Homo sapiens
aggaccagctggggc

SEQ ID NO: 3384446 - DNA, 19 bp, Homo sapiens
aggaccagctggggcgtgg

SEQ ID NO: 3384447 - DNA, 17 bp, Homo sapiens
aggaccaggactccctc

SEQ ID NO: 3384448 - DNA, 19 bp, Homo sapiens
aggaccaggactccctcct

SEQ ID NO: 3384449 - DNA, 20 bp, Homo sapiens
aggacccacccatcttcctg

SEQ ID NO: 3384450 - DNA, 22 bp, Homo sapiens
aggacccacccatcttcctgct

SEQ ID NO: 3384451 - DNA, 12 bp, Homo sapiens
aggacccaggcc

SEQ ID NO: 3384452 - DNA, 13 bp, Homo sapiens
aggacccaggccc

SEQ ID NO: 3384453 - DNA, 19 bp, Homo sapiens
aggacccaggccctccatg

SEQ ID NO: 3384454 - DNA, 20 bp, Homo sapiens
aggacccctccatgtgggct

SEQ ID NO: 3384455 - DNA, 21 bp, Homo sapiens
aggacccggaggggcctggca

SEQ ID NO: 3384456 - DNA, 21 bp, Homo sapiens
aggaccctcaggaattcagtg

SEQ ID NO: 3384457 - DNA, 13 bp, Homo sapiens
aggaccctgacct

SEQ ID NO: 3384458 - DNA, 22 bp, Homo sapiens
aggaccctgacctccgcccctg

SEQ ID NO: 3384459 - DNA, 17 bp, Homo sapiens
aggaccgctgataagca

SEQ ID NO: 3384460 - DNA, 18 bp, Homo sapiens
aggacctagagccgggca

SEQ ID NO: 3384461 - DNA, 16 bp, Homo sapiens
aggacctcccttccga

SEQ ID NO: 3384462 - DNA, 22 bp, Homo sapiens
aggacctgaccctactcccttg

SEQ ID NO: 3384463 - DNA, 22 bp, Homo sapiens
aggacctggcatcatggtggat

SEQ ID NO: 3384464 - DNA, 16 bp, Homo sapiens
aggaccttatctgtgc

SEQ ID NO: 3384465 - DNA, 22 bp, Homo sapiens
aggacctttaggtcaaactccc

SEQ ID NO: 3384466 - DNA, 23 bp, Homo sapiens
aggacctttaggtcaaactccct

SEQ ID NO: 3384467 - DNA, 21 bp, Homo sapiens
aggacctttccaccacagcca

SEQ ID NO: 3384468 - DNA, 21 bp, Homo sapiens
aggacctttgggtctacaagt

SEQ ID NO: 3384469 - DNA, 23 bp, Homo sapiens
aggacgcaccgccgccaccagcc

SEQ ID NO: 3384470 - DNA, 18 bp, Homo sapiens
aggacgcacgctcgctgc

SEQ ID NO: 3384471 - DNA, 14 bp, Homo sapiens
aggacgctctctgg

SEQ ID NO: 3384472 - DNA, 15 bp, Homo sapiens
aggacgcttctgaat

SEQ ID NO: 3384473 - DNA, 22 bp, Homo sapiens
aggacgtggatgaccctcccct

SEQ ID NO: 3384474 - DNA, 20 bp, Homo sapiens
aggactaacataaaatctgt

SEQ ID NO: 3384475 - DNA, 22 bp, Homo sapiens
aggactccactggacagaccca

SEQ ID NO: 3384476 - DNA, 17 bp, Homo sapiens
aggactccctcctcacc

SEQ ID NO: 3384477 - DNA, 18 bp, Homo sapiens
aggactccctcctcacct

SEQ ID NO: 3384478 - DNA, 23 bp, Homo sapiens
aggactccctcctcacctctgga

SEQ ID NO: 3384479 - DNA, 21 bp, Homo sapiens
aggactcgcttgtaaatacca

SEQ ID NO: 3384480 - DNA, 17 bp, Homo sapiens
aggactctgaggctctt

SEQ ID NO: 3384481 - DNA, 22 bp, Homo sapiens
aggactctgcaagtgtctggag

SEQ ID NO: 3384482 - DNA, 13 bp, Homo sapiens
aggactctgcctc

SEQ ID NO: 3384483 - DNA, 18 bp, Homo sapiens
aggactctgcctcctctt

SEQ ID NO: 3384484 - DNA, 21 bp, Homo sapiens
aggactgagtcccctccagga

SEQ ID NO: 3384485 - DNA, 16 bp, Homo sapiens
aggactggagaccgct

SEQ ID NO: 3384486 - DNA, 17 bp, Homo sapiens
aggactggattggccaa

SEQ ID NO: 3384487 - DNA, 12 bp, Homo sapiens
aggactgtggct

SEQ ID NO: 3384488 - DNA, 16 bp, Homo sapiens
aggacttccacatttt

SEQ ID NO: 3384489 - DNA, 14 bp, Homo sapiens
aggacttctgcagc

SEQ ID NO: 3384490 - DNA, 15 bp, Homo sapiens
aggacttctgcagct

SEQ ID NO: 3384491 - DNA, 13 bp, Homo sapiens
aggacttgaaaga

SEQ ID NO: 3384492 - DNA, 24 bp, Homo sapiens
aggacttgctaaagcactttgcac

SEQ ID NO: 3384493 - DNA, 23 bp, Homo sapiens
aggacttggtctgatttcaggat

SEQ ID NO: 3384494 - DNA, 13 bp, Homo sapiens
aggacttgtgtct

SEQ ID NO: 3384495 - DNA, 23 bp, Homo sapiens
aggactttgaggcaagtgtgggc

SEQ ID NO: 3384496 - DNA, 13 bp, Homo sapiens
aggagaaaaacaa

SEQ ID NO: 3384497 - DNA, 14 bp, Homo sapiens
aggagaaacagaga

SEQ ID NO: 3384498 - DNA, 18 bp, Homo sapiens
aggagaaacagagacagg

SEQ ID NO: 3384499 - DNA, 13 bp, Homo sapiens
aggagaagagaca

SEQ ID NO: 3384500 - DNA, 15 bp, Homo sapiens
aggagaagaggcatc

SEQ ID NO: 3384501 - DNA, 18 bp, Homo sapiens
aggagaagagttgaggaa

SEQ ID NO: 3384502 - DNA, 15 bp, Homo sapiens
aggagaatgagcctc

SEQ ID NO: 3384503 - DNA, 20 bp, Homo sapiens
aggagacacgtgtggcgggc

SEQ ID NO: 3384504 - DNA, 22 bp, Homo sapiens
aggagacactgtgctataaatc

SEQ ID NO: 3384505 - DNA, 12 bp, Homo sapiens
aggagaccctgg

SEQ ID NO: 3384506 - DNA, 13 bp, Homo sapiens
aggagaccctgga

SEQ ID NO: 3384507 - DNA, 15 bp, Homo sapiens
aggagaccctggaat

SEQ ID NO: 3384508 - DNA, 17 bp, Homo sapiens
aggagagacacctagct

SEQ ID NO: 3384509 - DNA, 23 bp, Homo sapiens
aggagagactgaaagcagcagct

SEQ ID NO: 3384510 - DNA, 18 bp, Homo sapiens
aggagagactgagcagcc

SEQ ID NO: 3384511 - DNA, 14 bp, Homo sapiens
aggagagagaaagc

SEQ ID NO: 3384512 - DNA, 21 bp, Homo sapiens
aggagagagaaagccaggcag

SEQ ID NO: 3384513 - DNA, 22 bp, Homo sapiens
aggagagagaaagccaggcagg

SEQ ID NO: 3384514 - DNA, 10 bp, Homo sapiens
aggagagagg

SEQ ID NO: 3384515 - DNA, 18 bp, Homo sapiens
aggagagaggcagagagc

SEQ ID NO: 3384516 - DNA, 16 bp, Homo sapiens
aggagagcctgctgca

SEQ ID NO: 3384517 - DNA, 20 bp, Homo sapiens
aggagagcctgctgcatggg

SEQ ID NO: 3384518 - DNA, 20 bp, Homo sapiens
aggagaggaaaagtaaggtg

SEQ ID NO: 3384519 - DNA, 13 bp, Homo sapiens
aggagaggagaga

SEQ ID NO: 3384520 - DNA, 17 bp, Homo sapiens
aggagaggagagaggca

SEQ ID NO: 3384521 - DNA, 15 bp, Homo sapiens
aggagaggatgagag

SEQ ID NO: 3384522 - DNA, 18 bp, Homo sapiens
aggagaggatgagagccc

SEQ ID NO: 3384523 - DNA, 20 bp, Homo sapiens
aggagaggatgagagcccag

SEQ ID NO: 3384524 - DNA, 23 bp, Homo sapiens
aggagaggatgagagcccagagg

SEQ ID NO: 3384525 - DNA, 21 bp, Homo sapiens
aggagaggcaacatccaaaat

SEQ ID NO: 3384526 - DNA, 19 bp, Homo sapiens
aggagaggggaagggccag

SEQ ID NO: 3384527 - DNA, 14 bp, Homo sapiens
aggagagtggccat

SEQ ID NO: 3384528 - DNA, 19 bp, Homo sapiens
aggagatatctgagggagg

SEQ ID NO: 3384529 - DNA, 16 bp, Homo sapiens
aggagatgaccaggga

SEQ ID NO: 3384530 - DNA, 19 bp, Homo sapiens
aggagatgaccagggatgc

SEQ ID NO: 3384531 - DNA, 13 bp, Homo sapiens
aggagattgagaa

SEQ ID NO: 3384532 - DNA, 16 bp, Homo sapiens
aggagcaaacactgaa

SEQ ID NO: 3384533 - DNA, 15 bp, Homo sapiens
aggagcacaggcagc

SEQ ID NO: 3384534 - DNA, 17 bp, Homo sapiens
aggagcacaggtcccac

SEQ ID NO: 3384535 - DNA, 16 bp, Homo sapiens
aggagcacctgaaccc

SEQ ID NO: 3384536 - DNA, 18 bp, Homo sapiens
aggagcagcttccttctg

SEQ ID NO: 3384537 - DNA, 24 bp, Homo sapiens
aggagccagtgaacttggctttcc

SEQ ID NO: 3384538 - DNA, 17 bp, Homo sapiens
aggagccccgaggcctt

SEQ ID NO: 3384539 - DNA, 14 bp, Homo sapiens
aggagccccgccac

SEQ ID NO: 3384540 - DNA, 13 bp, Homo sapiens
aggagccctcatc

SEQ ID NO: 3384541 - DNA, 22 bp, Homo sapiens
aggagccggccaccagatgctg

SEQ ID NO: 3384542 - DNA, 23 bp, Homo sapiens
aggagccggccaccagatgctga

SEQ ID NO: 3384543 - DNA, 18 bp, Homo sapiens
aggagcctagcggagccc

SEQ ID NO: 3384544 - DNA, 11 bp, Homo sapiens
aggagcctggc

SEQ ID NO: 3384545 - DNA, 13 bp, Homo sapiens
aggagcctggcct

SEQ ID NO: 3384546 - DNA, 13 bp, Homo sapiens
aggagcctgtgcg

SEQ ID NO: 3384547 - DNA, 18 bp, Homo sapiens
aggagcggcgccctggac

SEQ ID NO: 3384548 - DNA, 21 bp, Homo sapiens
aggagcggcgccctggacttg

SEQ ID NO: 3384549 - DNA, 13 bp, Homo sapiens
aggagctaaggct

SEQ ID NO: 3384550 - DNA, 14 bp, Homo sapiens
aggagctaaggctc

SEQ ID NO: 3384551 - DNA, 15 bp, Homo sapiens
aggagctaaggctct

SEQ ID NO: 3384552 - DNA, 19 bp, Homo sapiens
aggagctaaggctctatga

SEQ ID NO: 3384553 - DNA, 21 bp, Homo sapiens
aggagctcaccctgcccgctc

SEQ ID NO: 3384554 - DNA, 19 bp, Homo sapiens
aggagctcaggaagaagag

SEQ ID NO: 3384555 - DNA, 22 bp, Homo sapiens
aggagctgatttccaggcccct

SEQ ID NO: 3384556 - DNA, 12 bp, Homo sapiens
aggagctgcctg

SEQ ID NO: 3384557 - DNA, 18 bp, Homo sapiens
aggagctgccttggctca

SEQ ID NO: 3384558 - DNA, 22 bp, Homo sapiens
aggagctgccttggctcagaca

SEQ ID NO: 3384559 - DNA, 23 bp, Homo sapiens
aggagctgccttggctcagacat

SEQ ID NO: 3384560 - DNA, 15 bp, Homo sapiens
aggccgaagctctgg

SEQ ID NO: 3384561 - DNA, 17 bp, Homo sapiens
aggccgaagctctggct

SEQ ID NO: 3384562 - DNA, 23 bp, Homo sapiens
aggccgaagctctggctgaaccc

SEQ ID NO: 3384563 - DNA, 19 bp, Homo sapiens
aggccgaaggtgcctcaga

SEQ ID NO: 3384564 - DNA, 20 bp, Homo sapiens
aggccgagccaggttcacac

SEQ ID NO: 3384565 - DNA, 16 bp, Homo sapiens
aggccgaggcgggtgg

SEQ ID NO: 3384566 - DNA, 13 bp, Homo sapiens
aggccgcagctct

SEQ ID NO: 3384567 - DNA, 16 bp, Homo sapiens
aggccgcagctcttgc

SEQ ID NO: 3384568 - DNA, 17 bp, Homo sapiens
aggccgcagctcttgcc

SEQ ID NO: 3384569 - DNA, 16 bp, Homo sapiens
aggccgccgtgaccta

SEQ ID NO: 3384570 - DNA, 14 bp, Homo sapiens
aggccggaaccaca

SEQ ID NO: 3384571 - DNA, 16 bp, Homo sapiens
aggccggcagcgggcg

SEQ ID NO: 3384572 - DNA, 18 bp, Homo sapiens
aggccggcagcgggcgga

SEQ ID NO: 3384573 - DNA, 14 bp, Homo sapiens
aggccggccagcct

SEQ ID NO: 3384574 - DNA, 18 bp, Homo sapiens
aggccgggcggtcacagc

SEQ ID NO: 3384575 - DNA, 14 bp, Homo sapiens
aggccgtgtctctg

SEQ ID NO: 3384576 - DNA, 21 bp, Homo sapiens
aggccgttccccttggcttcc

SEQ ID NO: 3384577 - DNA, 16 bp, Homo sapiens
aggcctaaaagtaaac

SEQ ID NO: 3384578 - DNA, 17 bp, Homo sapiens
aggcctaaaagtaaaca

SEQ ID NO: 3384579 - DNA, 13 bp, Homo sapiens
aggcctaagacat

SEQ ID NO: 3384580 - DNA, 16 bp, Homo sapiens
aggcctagactctgtc

SEQ ID NO: 3384581 - DNA, 17 bp, Homo sapiens
aggcctagactctgtct

SEQ ID NO: 3384582 - DNA, 23 bp, Homo sapiens
aggcctaggaggccccccgtgtg

SEQ ID NO: 3384583 - DNA, 18 bp, Homo sapiens
aggcctcacctctaccca

SEQ ID NO: 3384584 - DNA, 19 bp, Homo sapiens
aggcctcacctctacccaa

SEQ ID NO: 3384585 - DNA, 21 bp, Homo sapiens
aggcctcagtttctccatcag

SEQ ID NO: 3384586 - DNA, 14 bp, Homo sapiens
aggcctcatccctc

SEQ ID NO: 3384587 - DNA, 13 bp, Homo sapiens
aggcctcatgcct

SEQ ID NO: 3384588 - DNA, 16 bp, Homo sapiens
aggcctcatgcctgct

SEQ ID NO: 3384589 - DNA, 18 bp, Homo sapiens
aggcctcatgcctgctga

SEQ ID NO: 3384590 - DNA, 18 bp, Homo sapiens
aggcctccaacgcccctg

SEQ ID NO: 3384591 - DNA, 22 bp, Homo sapiens
aggcctccaacgcccctgtggc

SEQ ID NO: 3384592 - DNA, 24 bp, Homo sapiens
aggcctccaacgcccctgtggcca

SEQ ID NO: 3384593 - DNA, 13 bp, Homo sapiens
aggcctccagcct

SEQ ID NO: 3384594 - DNA, 15 bp, Homo sapiens
aggcctccagcctct

SEQ ID NO: 3384595 - DNA, 18 bp, Homo sapiens
aggcctccagcctctccc

SEQ ID NO: 3384596 - DNA, 13 bp, Homo sapiens
aggcctccctgtt

SEQ ID NO: 3384597 - DNA, 14 bp, Homo sapiens
aggcctcctccccc

SEQ ID NO: 3384598 - DNA, 20 bp, Homo sapiens
aggcctcctcccccacccct

SEQ ID NO: 3384599 - DNA, 17 bp, Homo sapiens
aggcctcgagcagagag

SEQ ID NO: 3384600 - DNA, 21 bp, Homo sapiens
aggcctctccagtttgcacct

SEQ ID NO: 3384601 - DNA, 24 bp, Homo sapiens
aggcctctccagtttgcacctgtc

SEQ ID NO: 3384602 - DNA, 12 bp, Homo sapiens
aggcctctctca

SEQ ID NO: 3384603 - DNA, 17 bp, Homo sapiens
aggcctctgagcccaag

SEQ ID NO: 3384604 - DNA, 19 bp, Homo sapiens
aggcctctgagcccaagct

SEQ ID NO: 3384605 - DNA, 13 bp, Homo sapiens
aggcctctgtgtc

SEQ ID NO: 3384606 - DNA, 15 bp, Homo sapiens
aggcctcttgtgctc

SEQ ID NO: 3384607 - DNA, 21 bp, Homo sapiens
aggcctgaaagaggctgaggc

SEQ ID NO: 3384608 - DNA, 16 bp, Homo sapiens
aggcctgacttctgct

SEQ ID NO: 3384609 - DNA, 17 bp, Homo sapiens
aggcctgaggcctgtgc

SEQ ID NO: 3384610 - DNA, 18 bp, Homo sapiens
aggcctgcaaaccttcct

SEQ ID NO: 3384611 - DNA, 20 bp, Homo sapiens
aggcctgcaaaccttcctgg

SEQ ID NO: 3384612 - DNA, 21 bp, Homo sapiens
aggcctgcaaaccttcctggg

SEQ ID NO: 3384613 - DNA, 14 bp, Homo sapiens
aggcctgcacacaa

SEQ ID NO: 3384614 - DNA, 20 bp, Homo sapiens
aggcctgctgccagtgcagc

SEQ ID NO: 3384615 - DNA, 22 bp, Homo sapiens
aggcctgctgccagtgcagcca

SEQ ID NO: 3384616 - DNA, 14 bp, Homo sapiens
aggcctggaaccag

SEQ ID NO: 3384617 - DNA, 15 bp, Homo sapiens
aggcctggaaccagg

SEQ ID NO: 3384618 - DNA, 22 bp, Homo sapiens
aggcctggactttcctgcaact

SEQ ID NO: 3384619 - DNA, 13 bp, Homo sapiens
aggcctggccaga

SEQ ID NO: 3384620 - DNA, 21 bp, Homo sapiens
aggcctggccagatgcaccag

SEQ ID NO: 3384621 - DNA, 12 bp, Homo sapiens
aggcctggctgg

SEQ ID NO: 3384622 - DNA, 15 bp, Homo sapiens
aggcctgggacccag

SEQ ID NO: 3384623 - DNA, 16 bp, Homo sapiens
aggcctgggacccagc

SEQ ID NO: 3384624 - DNA, 17 bp, Homo sapiens
aggcctgggtctgtgtc

SEQ ID NO: 3384625 - DNA, 19 bp, Homo sapiens
aggcctgggtctgtgtctc

SEQ ID NO: 3384626 - DNA, 12 bp, Homo sapiens
aggcctgggtgc

SEQ ID NO: 3384627 - DNA, 15 bp, Homo sapiens
aggcctgtccaccct

SEQ ID NO: 3384628 - DNA, 18 bp, Homo sapiens
aggccttctctgaaggac

SEQ ID NO: 3384629 - DNA, 16 bp, Homo sapiens
aggccttttaacattt

SEQ ID NO: 3384630 - DNA, 16 bp, Homo sapiens
aggccttttggaatgt

SEQ ID NO: 3384631 - DNA, 15 bp, Homo sapiens
aggcgaccgggcctc

SEQ ID NO: 3384632 - DNA, 17 bp, Homo sapiens
aggcgattttgtctacc

SEQ ID NO: 3384633 - DNA, 23 bp, Homo sapiens
aggcgcaggcgaccgggcctccc

SEQ ID NO: 3384634 - DNA, 19 bp, Homo sapiens
aggcgcctggcacatttca

SEQ ID NO: 3384635 - DNA, 14 bp, Homo sapiens
aggcgcggcctccc

SEQ ID NO: 3384636 - DNA, 18 bp, Homo sapiens
aggcgcggcctcccgagg

SEQ ID NO: 3384637 - DNA, 22 bp, Homo sapiens
aggcgcgtgtaaatggttttgt

SEQ ID NO: 3384638 - DNA, 15 bp, Homo sapiens
aggcgcttcccaact

SEQ ID NO: 3384639 - DNA, 13 bp, Homo sapiens
aggcggcccggcc

SEQ ID NO: 3384640 - DNA, 17 bp, Homo sapiens
aggcggcccggccagcg

SEQ ID NO: 3384641 - DNA, 12 bp, Homo sapiens
aggcgggccagc

SEQ ID NO: 3384642 - DNA, 13 bp, Homo sapiens
aggcgggccagcc

SEQ ID NO: 3384643 - DNA, 16 bp, Homo sapiens
aggcgggccagccagg

SEQ ID NO: 3384644 - DNA, 23 bp, Homo sapiens
aggcggggggggcgcctggagag

SEQ ID NO: 3384645 - DNA, 23 bp, Homo sapiens
aggcggtccccatccccaccagc

SEQ ID NO: 3384646 - DNA, 15 bp, Homo sapiens
aggcgtgactcagca

SEQ ID NO: 3384647 - DNA, 12 bp, Homo sapiens
aggcgtgatcca

SEQ ID NO: 3384648 - DNA, 17 bp, Homo sapiens
aggcgtggtggctggcg

SEQ ID NO: 3384649 - DNA, 13 bp, Homo sapiens
aggctaaacatcc

SEQ ID NO: 3384650 - DNA, 21 bp, Homo sapiens
aggctaaacatccaatatttt

SEQ ID NO: 3384651 - DNA, 15 bp, Homo sapiens
aggctaccagaagag

SEQ ID NO: 3384652 - DNA, 17 bp, Homo sapiens
aggctagtttattttgt

SEQ ID NO: 3384653 - DNA, 21 bp, Homo sapiens
aggctatggagggtcctcctc

SEQ ID NO: 3384654 - DNA, 20 bp, Homo sapiens
aggctatggttgccacccca

SEQ ID NO: 3384655 - DNA, 14 bp, Homo sapiens
aggctatgtgatta

SEQ ID NO: 3384656 - DNA, 11 bp, Homo sapiens
aggctatttgt

SEQ ID NO: 3384657 - DNA, 17 bp, Homo sapiens
aggctatttgtaaatct

SEQ ID NO: 3384658 - DNA, 22 bp, Homo sapiens
aggctatttgtaaatctgccac

SEQ ID NO: 3384659 - DNA, 19 bp, Homo sapiens
aggctatttgttcagagag

SEQ ID NO: 3384660 - DNA, 14 bp, Homo sapiens
aggctcactgccag

SEQ ID NO: 3384661 - DNA, 16 bp, Homo sapiens
aggctcactgccaggc

SEQ ID NO: 3384662 - DNA, 22 bp, Homo sapiens
aggctcactgccaggccagcct

SEQ ID NO: 3384663 - DNA, 16 bp, Homo sapiens
aggctcagtctcagga

SEQ ID NO: 3384664 - DNA, 17 bp, Homo sapiens
aggctcagtctcaggag

SEQ ID NO: 3384665 - DNA, 19 bp, Homo sapiens
aggctcagtctcaggagca

SEQ ID NO: 3384666 - DNA, 23 bp, Homo sapiens
aggctcagtctcaggagcatggg

SEQ ID NO: 3384667 - DNA, 11 bp, Homo sapiens
aggctccactt

SEQ ID NO: 3384668 - DNA, 21 bp, Homo sapiens
aggctccaggactccactgga

SEQ ID NO: 3384669 - DNA, 12 bp, Homo sapiens
aggctccccagg

SEQ ID NO: 3384670 - DNA, 19 bp, Homo sapiens
aggctcctttagcgcccag

SEQ ID NO: 3384671 - DNA, 15 bp, Homo sapiens
aggctctcaccccca

SEQ ID NO: 3384672 - DNA, 22 bp, Homo sapiens
aggctctctctttctagaggtg

SEQ ID NO: 3384673 - DNA, 18 bp, Homo sapiens
aggctctgaaagccagct

SEQ ID NO: 3384674 - DNA, 16 bp, Homo sapiens
aggctctgagagtcta

SEQ ID NO: 3384675 - DNA, 23 bp, Homo sapiens
aggctctgagagtctagattctc

SEQ ID NO: 3384676 - DNA, 13 bp, Homo sapiens
aggctctgcacag

SEQ ID NO: 3384677 - DNA, 17 bp, Homo sapiens
aggctctgcacagatgg

SEQ ID NO: 3384678 - DNA, 13 bp, Homo sapiens
aggctctggccct

SEQ ID NO: 3384679 - DNA, 19 bp, Homo sapiens
aggctctggcccttgcctt

SEQ ID NO: 3384680 - DNA, 13 bp, Homo sapiens
aggctctgggctc

SEQ ID NO: 3384681 - DNA, 17 bp, Homo sapiens
aggctctgggctcaggg

SEQ ID NO: 3384682 - DNA, 19 bp, Homo sapiens
aggctcttaagcagcatgg

SEQ ID NO: 3384683 - DNA, 22 bp, Homo sapiens
aggctcttaagcagcatggaaa

SEQ ID NO: 3384684 - DNA, 22 bp, Homo sapiens
aggctcttagcagcttccagat

SEQ ID NO: 3384685 - DNA, 19 bp, Homo sapiens
aggctcttatgtgtgcctt

SEQ ID NO: 3384686 - DNA, 16 bp, Homo sapiens
agggtctcactctgtc

SEQ ID NO: 3384687 - DNA, 18 bp, Homo sapiens
agggtctcgctgtcactg

SEQ ID NO: 3384688 - DNA, 15 bp, Homo sapiens
agggtctcttccttc

SEQ ID NO: 3384689 - DNA, 11 bp, Homo sapiens
agggtctgagt

SEQ ID NO: 3384690 - DNA, 23 bp, Homo sapiens
agggtctgctctttctctgccag

SEQ ID NO: 3384691 - DNA, 17 bp, Homo sapiens
agggtctgtttggactg

SEQ ID NO: 3384692 - DNA, 17 bp, Homo sapiens
agggtcttccctacctc

SEQ ID NO: 3384693 - DNA, 21 bp, Homo sapiens
agggtcttgggctactggcag

SEQ ID NO: 3384694 - DNA, 15 bp, Homo sapiens
agggtcttttttcat

SEQ ID NO: 3384695 - DNA, 18 bp, Homo sapiens
agggtgactcacagccgc

SEQ ID NO: 3384696 - DNA, 17 bp, Homo sapiens
agggtgccctttggggt

SEQ ID NO: 3384697 - DNA, 14 bp, Homo sapiens
agggtgctgactgg

SEQ ID NO: 3384698 - DNA, 11 bp, Homo sapiens
agggtggccct

SEQ ID NO: 3384699 - DNA, 18 bp, Homo sapiens
agggtggctttaattgta

SEQ ID NO: 3384700 - DNA, 11 bp, Homo sapiens
agggtgggggg

SEQ ID NO: 3384701 - DNA, 18 bp, Homo sapiens
agggtgggtgctcagaat

SEQ ID NO: 3384702 - DNA, 17 bp, Homo sapiens
agggtggtgacctctgc

SEQ ID NO: 3384703 - DNA, 21 bp, Homo sapiens
agggtgttgggatactgcagg

SEQ ID NO: 3384704 - DNA, 13 bp, Homo sapiens
agggtgtttcctc

SEQ ID NO: 3384705 - DNA, 19 bp, Homo sapiens
agggttaatcatatttgaa

SEQ ID NO: 3384706 - DNA, 20 bp, Homo sapiens
agggttacagagacctatgt

SEQ ID NO: 3384707 - DNA, 18 bp, Homo sapiens
agggttactatgcacaat

SEQ ID NO: 3384708 - DNA, 16 bp, Homo sapiens
agggttcatctgtcca

SEQ ID NO: 3384709 - DNA, 13 bp, Homo sapiens
agggttcccctgg

SEQ ID NO: 3384710 - DNA, 18 bp, Homo sapiens
agggttcctcttaggtca

SEQ ID NO: 3384711 - DNA, 21 bp, Homo sapiens
agggttgaaaatgtgtttgct

SEQ ID NO: 3384712 - DNA, 21 bp, Homo sapiens
agggttgagttacttcctatc

SEQ ID NO: 3384713 - DNA, 16 bp, Homo sapiens
agggttgctggagcct

SEQ ID NO: 3384714 - DNA, 17 bp, Homo sapiens
agggttgctggagcctg

SEQ ID NO: 3384715 - DNA, 14 bp, Homo sapiens
agggttggcccctg

SEQ ID NO: 3384716 - DNA, 17 bp, Homo sapiens
agggttggcccctgccc

SEQ ID NO: 3384717 - DNA, 14 bp, Homo sapiens
agggtttcgactgg

SEQ ID NO: 3384718 - DNA, 17 bp, Homo sapiens
agggtttcgactggtcc

SEQ ID NO: 3384719 - DNA, 18 bp, Homo sapiens
agggtttcgactggtcca

SEQ ID NO: 3384720 - DNA, 15 bp, Homo sapiens
agggtttgggcagag

SEQ ID NO: 3384721 - DNA, 16 bp, Homo sapiens
agggtttgggcagagc

SEQ ID NO: 3384722 - DNA, 14 bp, Homo sapiens
agggtttgtggctg

SEQ ID NO: 3384723 - DNA, 18 bp, Homo sapiens
agggttttccaccctgga

SEQ ID NO: 3384724 - DNA, 15 bp, Homo sapiens
agggttttgcaataa

SEQ ID NO: 3384725 - DNA, 17 bp, Homo sapiens
agggttttgcaataact

SEQ ID NO: 3384726 - DNA, 23 bp, Homo sapiens
agggttttgccatgttggccagg

SEQ ID NO: 3384727 - DNA, 11 bp, Homo sapiens
agggttttgta

SEQ ID NO: 3384728 - DNA, 14 bp, Homo sapiens
aggtaaaacagggc

SEQ ID NO: 3384729 - DNA, 23 bp, Homo sapiens
aggtaacactagggccttggaaa

SEQ ID NO: 3384730 - DNA, 23 bp, Homo sapiens
aggtaacagaacagcttcaggtt

SEQ ID NO: 3384731 - DNA, 13 bp, Homo sapiens
aggtaacaggcag

SEQ ID NO: 3384732 - DNA, 22 bp, Homo sapiens
aggtaagaagttttaaaaagcc

SEQ ID NO: 3384733 - DNA, 16 bp, Homo sapiens
aggtaatgtgaataaa

SEQ ID NO: 3384734 - DNA, 19 bp, Homo sapiens
aggtaatgttttgtatata

SEQ ID NO: 3384735 - DNA, 21 bp, Homo sapiens
aggtaatgttttgtatataca

SEQ ID NO: 3384736 - DNA, 11 bp, Homo sapiens
aggtaattgtt

SEQ ID NO: 3384737 - DNA, 22 bp, Homo sapiens
aggtaattgttttttaaagcaa

SEQ ID NO: 3384738 - DNA, 20 bp, Homo sapiens
aggtacaacagaataatgca

SEQ ID NO: 3384739 - DNA, 16 bp, Homo sapiens
aggtacacagctctag

SEQ ID NO: 3384740 - DNA, 16 bp, Homo sapiens
aggtacaggagaggca

SEQ ID NO: 3384741 - DNA, 17 bp, Homo sapiens
aggtacaggagaggcag

SEQ ID NO: 3384742 - DNA, 22 bp, Homo sapiens
aggtacaggagaggcagcatgc

SEQ ID NO: 3384743 - DNA, 15 bp, Homo sapiens
aggtaccacccttca

SEQ ID NO: 3384744 - DNA, 13 bp, Homo sapiens
aggtaccagctgc

SEQ ID NO: 3384745 - DNA, 23 bp, Homo sapiens
aggtaccagctgcgcttgctttt

SEQ ID NO: 3384746 - DNA, 17 bp, Homo sapiens
aggtacccctttctggc

SEQ ID NO: 3384747 - DNA, 21 bp, Homo sapiens
aggtacccctttctggctctc

SEQ ID NO: 3384748 - DNA, 19 bp, Homo sapiens
aggtacgatgacagtgttc

SEQ ID NO: 3384749 - DNA, 14 bp, Homo sapiens
aggtactctcctgg

SEQ ID NO: 3384750 - DNA, 16 bp, Homo sapiens
aggtacttcctcctga

SEQ ID NO: 3384751 - DNA, 19 bp, Homo sapiens
aggtacttcctcctgatgg

SEQ ID NO: 3384752 - DNA, 17 bp, Homo sapiens
aggtagaaatatctgaa

SEQ ID NO: 3384753 - DNA, 21 bp, Homo sapiens
aggtagatcgcttgagcccag

SEQ ID NO: 3384754 - DNA, 21 bp, Homo sapiens
aggtagcatgggtccaagaga

SEQ ID NO: 3384755 - DNA, 20 bp, Homo sapiens
aggtagcattctttggagtt

SEQ ID NO: 3384756 - DNA, 23 bp, Homo sapiens
aggtaggcccttgtcctgccagc

SEQ ID NO: 3384757 - DNA, 14 bp, Homo sapiens
aggtagtttggata

SEQ ID NO: 3384758 - DNA, 13 bp, Homo sapiens
aggtataaagaca

SEQ ID NO: 3384759 - DNA, 14 bp, Homo sapiens
aggtataaagacaa

SEQ ID NO: 3384760 - DNA, 15 bp, Homo sapiens
aggtataattttatg

SEQ ID NO: 3384761 - DNA, 15 bp, Homo sapiens
aggtatctagagctt

SEQ ID NO: 3384762 - DNA, 13 bp, Homo sapiens
aggtatgaataag

SEQ ID NO: 3384763 - DNA, 21 bp, Homo sapiens
aggtatgcaatcaaatctgct

SEQ ID NO: 3384764 - DNA, 14 bp, Homo sapiens
aggtatgttgcctt

SEQ ID NO: 3384765 - DNA, 20 bp, Homo sapiens
aggtatgttgcctttatggt

SEQ ID NO: 3384766 - DNA, 13 bp, Homo sapiens
aggtatttgaaaa

SEQ ID NO: 3384767 - DNA, 16 bp, Homo sapiens
aggtcaaactccctag

SEQ ID NO: 3384768 - DNA, 14 bp, Homo sapiens
aggtcaagggaaaa

SEQ ID NO: 3384769 - DNA, 18 bp, Homo sapiens
aggtcaagtaagaagaca

SEQ ID NO: 3384770 - DNA, 20 bp, Homo sapiens
aggtcaccaggggaggagcc

SEQ ID NO: 3384771 - DNA, 15 bp, Homo sapiens
aggtcaccctttgct

SEQ ID NO: 3384772 - DNA, 14 bp, Homo sapiens
aggtcactcctggg

SEQ ID NO: 3384773 - DNA, 15 bp, Homo sapiens
aggtcactcctgggg

SEQ ID NO: 3384774 - DNA, 16 bp, Homo sapiens
aggtcactggaaaggg

SEQ ID NO: 3384775 - DNA, 17 bp, Homo sapiens
aggtcactggctctcca

SEQ ID NO: 3384776 - DNA, 12 bp, Homo sapiens
aggtcagagcct

SEQ ID NO: 3384777 - DNA, 13 bp, Homo sapiens
aggtcagagcctg

SEQ ID NO: 3384778 - DNA, 23 bp, Homo sapiens
aggtcagatggaggttctcagag

SEQ ID NO: 3384779 - DNA, 14 bp, Homo sapiens
aggtcagccaggct

SEQ ID NO: 3384780 - DNA, 20 bp, Homo sapiens
aggtcaggagttcctaacca

SEQ ID NO: 3384781 - DNA, 22 bp, Homo sapiens
aggtcaggagttcgagaccagc

SEQ ID NO: 3384782 - DNA, 17 bp, Homo sapiens
aggtcaggatgcacatt

SEQ ID NO: 3384783 - DNA, 13 bp, Homo sapiens
aggtcaggccctg

SEQ ID NO: 3384784 - DNA, 19 bp, Homo sapiens
aggtcagggacttggacag

SEQ ID NO: 3384785 - DNA, 14 bp, Homo sapiens
aggtcatttcttca

SEQ ID NO: 3384786 - DNA, 13 bp, Homo sapiens
aggtccaagggcc

SEQ ID NO: 3384787 - DNA, 18 bp, Homo sapiens
aggtccaagggccatact

SEQ ID NO: 3384788 - DNA, 14 bp, Homo sapiens
aggtccacaggtct

SEQ ID NO: 3384789 - DNA, 19 bp, Homo sapiens
aggtccaccggcccctggc

SEQ ID NO: 3384790 - DNA, 17 bp, Homo sapiens
aggtccactccctgctc

SEQ ID NO: 3384791 - DNA, 23 bp, Homo sapiens
aggtccagcccatctcggagcat

SEQ ID NO: 3384792 - DNA, 13 bp, Homo sapiens
aggtccagctctg

SEQ ID NO: 3384793 - DNA, 14 bp, Homo sapiens
aggtccagctctgg

SEQ ID NO: 3384794 - DNA, 16 bp, Homo sapiens
aggtccattattttgt

SEQ ID NO: 3384795 - DNA, 17 bp, Homo sapiens
aggtcccacctccagcc

SEQ ID NO: 3384796 - DNA, 19 bp, Homo sapiens
aggtcccacctccagcccg

SEQ ID NO: 3384797 - DNA, 18 bp, Homo sapiens
aggtcccacgtctggcca

SEQ ID NO: 3384798 - DNA, 14 bp, Homo sapiens
aggtcccctccaca

SEQ ID NO: 3384799 - DNA, 21 bp, Homo sapiens
aggtcccctccacatcccagc

SEQ ID NO: 3384800 - DNA, 18 bp, Homo sapiens
aggtccggtgttctaaga

SEQ ID NO: 3384801 - DNA, 15 bp, Homo sapiens
aggtcctcagagaat

SEQ ID NO: 3384802 - DNA, 14 bp, Homo sapiens
aggtcctcatgggt

SEQ ID NO: 3384803 - DNA, 15 bp, Homo sapiens
aggtcctctggagcc

SEQ ID NO: 3384804 - DNA, 13 bp, Homo sapiens
aggtcctgcccat

SEQ ID NO: 3384805 - DNA, 20 bp, Homo sapiens
aggtcctgcccatgtgtccc

SEQ ID NO: 3384806 - DNA, 12 bp, Homo sapiens
aggtcctgccct

SEQ ID NO: 3384807 - DNA, 21 bp, Homo sapiens
aggtctattggccaacaatcc

SEQ ID NO: 3384808 - DNA, 14 bp, Homo sapiens
aggtctcatctctt

SEQ ID NO: 3384809 - DNA, 16 bp, Homo sapiens
aggtctcatctcttca

SEQ ID NO: 3384810 - DNA, 21 bp, Homo sapiens
aggtctcatctcttcaggttc

SEQ ID NO: 3384811 - DNA, 18 bp, Homo sapiens
aggtctcatgctgttgct

SEQ ID NO: 3384812 - DNA, 21 bp, Homo sapiens
aggtctccaaaccagacggtg

SEQ ID NO: 3384813 - DNA, 22 bp, Homo sapiens
agtcaacactatatattttatg

SEQ ID NO: 3384814 - DNA, 16 bp, Homo sapiens
agtcaacaggtcactt

SEQ ID NO: 3384815 - DNA, 17 bp, Homo sapiens
agtcaagatagaaaggg

SEQ ID NO: 3384816 - DNA, 15 bp, Homo sapiens
agtcaagcacatgta

SEQ ID NO: 3384817 - DNA, 12 bp, Homo sapiens
agtcaatcactg

SEQ ID NO: 3384818 - DNA, 13 bp, Homo sapiens
agtcacaaagact

SEQ ID NO: 3384819 - DNA, 11 bp, Homo sapiens
agtcacacagt

SEQ ID NO: 3384820 - DNA, 15 bp, Homo sapiens
agtcacacagtgagt

SEQ ID NO: 3384821 - DNA, 16 bp, Homo sapiens
agtcacactgctagca

SEQ ID NO: 3384822 - DNA, 17 bp, Homo sapiens
agtcacagctgcagctg

SEQ ID NO: 3384823 - DNA, 21 bp, Homo sapiens
agtcacagctgcagctgggcc

SEQ ID NO: 3384824 - DNA, 20 bp, Homo sapiens
agtcaccaaatagtgtgaaa

SEQ ID NO: 3384825 - DNA, 13 bp, Homo sapiens
agtcaccaagccc

SEQ ID NO: 3384826 - DNA, 18 bp, Homo sapiens
agtcaccactccattccc

SEQ ID NO: 3384827 - DNA, 17 bp, Homo sapiens
agtcacccatgaagaca

SEQ ID NO: 3384828 - DNA, 20 bp, Homo sapiens
agtcacccatgaagacagga

SEQ ID NO: 3384829 - DNA, 21 bp, Homo sapiens
agtcaccccaagtagtctgct

SEQ ID NO: 3384830 - DNA, 13 bp, Homo sapiens
agtcacctgcaag

SEQ ID NO: 3384831 - DNA, 18 bp, Homo sapiens
agtcacctgcaagcccca

SEQ ID NO: 3384832 - DNA, 20 bp, Homo sapiens
agtcacctgcaagccccagg

SEQ ID NO: 3384833 - DNA, 14 bp, Homo sapiens
agtcaccttccagg

SEQ ID NO: 3384834 - DNA, 20 bp, Homo sapiens
agtcaccttccaggacccct

SEQ ID NO: 3384835 - DNA, 22 bp, Homo sapiens
agtcacgctggggctctctgag

SEQ ID NO: 3384836 - DNA, 17 bp, Homo sapiens
agtcactcaattgtttt

SEQ ID NO: 3384837 - DNA, 18 bp, Homo sapiens
agtcactccctctgcctt

SEQ ID NO: 3384838 - DNA, 16 bp, Homo sapiens
agtcactgatgtacaa

SEQ ID NO: 3384839 - DNA, 23 bp, Homo sapiens
agtcactgatgtacaattaaaaa

SEQ ID NO: 3384840 - DNA, 23 bp, Homo sapiens
agtcactggtctgtttgcatttg

SEQ ID NO: 3384841 - DNA, 16 bp, Homo sapiens
agtcacttatttcata

SEQ ID NO: 3384842 - DNA, 12 bp, Homo sapiens
agtcagaaaaca

SEQ ID NO: 3384843 - DNA, 20 bp, Homo sapiens
agtcagaaaattggcagtgg

SEQ ID NO: 3384844 - DNA, 14 bp, Homo sapiens
agtcagagccctgg

SEQ ID NO: 3384845 - DNA, 14 bp, Homo sapiens
agtcagaggatggc

SEQ ID NO: 3384846 - DNA, 19 bp, Homo sapiens
agtcagaggatggccagtg

SEQ ID NO: 3384847 - DNA, 18 bp, Homo sapiens
agtcagattgctgggagg

SEQ ID NO: 3384848 - DNA, 15 bp, Homo sapiens
agtcagatttttaaa

SEQ ID NO: 3384849 - DNA, 22 bp, Homo sapiens
agtcagatttttaaagttttgt

SEQ ID NO: 3384850 - DNA, 22 bp, Homo sapiens
agtcagcagcagctctgagcca

SEQ ID NO: 3384851 - DNA, 19 bp, Homo sapiens
agtcagcatgcttcccaga

SEQ ID NO: 3384852 - DNA, 20 bp, Homo sapiens
agtcagcatgcttcccagag

SEQ ID NO: 3384853 - DNA, 23 bp, Homo sapiens
agtcagccttccccctcccaggg

SEQ ID NO: 3384854 - DNA, 16 bp, Homo sapiens
agtcaggctgcagagg

SEQ ID NO: 3384855 - DNA, 16 bp, Homo sapiens
agtcagggcccagagg

SEQ ID NO: 3384856 - DNA, 14 bp, Homo sapiens
agtcaggtccaatt

SEQ ID NO: 3384857 - DNA, 21 bp, Homo sapiens
agtcaggttcaggagttagtg

SEQ ID NO: 3384858 - DNA, 22 bp, Homo sapiens
agtcagtaggtccaagggccat

SEQ ID NO: 3384859 - DNA, 15 bp, Homo sapiens
agtcagtctctttct

SEQ ID NO: 3384860 - DNA, 15 bp, Homo sapiens
agtcagttcccggag

SEQ ID NO: 3384861 - DNA, 17 bp, Homo sapiens
agtcagttcccggagca

SEQ ID NO: 3384862 - DNA, 23 bp, Homo sapiens
agtcagttcccggagcacagccc

SEQ ID NO: 3384863 - DNA, 15 bp, Homo sapiens
agtcatcatcagggc

SEQ ID NO: 3384864 - DNA, 19 bp, Homo sapiens
agtcatcatcagggcctgg

SEQ ID NO: 3384865 - DNA, 22 bp, Homo sapiens
agtcatcatcagggcctggggc

SEQ ID NO: 3384866 - DNA, 18 bp, Homo sapiens
agtcatctacttaataaa

SEQ ID NO: 3384867 - DNA, 19 bp, Homo sapiens
agtcatcttgctaccagta

SEQ ID NO: 3384868 - DNA, 23 bp, Homo sapiens
agtcatcttgctaccagtattta

SEQ ID NO: 3384869 - DNA, 19 bp, Homo sapiens
agtcatcttgtaatttcca

SEQ ID NO: 3384870 - DNA, 13 bp, Homo sapiens
agtcatgcataaa

SEQ ID NO: 3384871 - DNA, 17 bp, Homo sapiens
agtcatgcataaatatg

SEQ ID NO: 3384872 - DNA, 20 bp, Homo sapiens
agtcatgcataaatatgcag

SEQ ID NO: 3384873 - DNA, 22 bp, Homo sapiens
agtcatgcataaatatgcagtg

SEQ ID NO: 3384874 - DNA, 21 bp, Homo sapiens
agtcatggctaatttaacacc

SEQ ID NO: 3384875 - DNA, 15 bp, Homo sapiens
agtcatgtgtgaaca

SEQ ID NO: 3384876 - DNA, 22 bp, Homo sapiens
agtcattcagcagcaaattttc

SEQ ID NO: 3384877 - DNA, 12 bp, Homo sapiens
agtcattccttc

SEQ ID NO: 3384878 - DNA, 18 bp, Homo sapiens
agtcattgacttcatttt

SEQ ID NO: 3384879 - DNA, 13 bp, Homo sapiens
agtcattgtatgt

SEQ ID NO: 3384880 - DNA, 13 bp, Homo sapiens
agtcattgtcata

SEQ ID NO: 3384881 - DNA, 14 bp, Homo sapiens
agtcatttactaaa

SEQ ID NO: 3384882 - DNA, 17 bp, Homo sapiens
agtcatttactaaacat

SEQ ID NO: 3384883 - DNA, 23 bp, Homo sapiens
agtcatttactaaacatatgatt

SEQ ID NO: 3384884 - DNA, 22 bp, Homo sapiens
agtcatttattttaaaaaatga

SEQ ID NO: 3384885 - DNA, 22 bp, Homo sapiens
agtcatttgctgagcatgtact

SEQ ID NO: 3384886 - DNA, 19 bp, Homo sapiens
agtcattttaactttatca

SEQ ID NO: 3384887 - DNA, 16 bp, Homo sapiens
agtccaaatgtcctcc

SEQ ID NO: 3384888 - DNA, 20 bp, Homo sapiens
agtccaaatgtgatcaactg

SEQ ID NO: 3384889 - DNA, 13 bp, Homo sapiens
agtccaaggttta

SEQ ID NO: 3384890 - DNA, 22 bp, Homo sapiens
agtccacacaaagattttctaa

SEQ ID NO: 3384891 - DNA, 18 bp, Homo sapiens
agtccacggacccccaga

SEQ ID NO: 3384892 - DNA, 14 bp, Homo sapiens
agtccaggctgccg

SEQ ID NO: 3384893 - DNA, 17 bp, Homo sapiens
agtccagtgtcacctct

SEQ ID NO: 3384894 - DNA, 24 bp, Homo sapiens
agtccagtgtcacctctctcagag

SEQ ID NO: 3384895 - DNA, 17 bp, Homo sapiens
agtccattctcccaggt

SEQ ID NO: 3384896 - DNA, 19 bp, Homo sapiens
agtccatttcccacatctt

SEQ ID NO: 3384897 - DNA, 18 bp, Homo sapiens
agtcccaccttggctgca

SEQ ID NO: 3384898 - DNA, 20 bp, Homo sapiens
agtcccaccttggctgcagg

SEQ ID NO: 3384899 - DNA, 12 bp, Homo sapiens
agtcccactgcc

SEQ ID NO: 3384900 - DNA, 23 bp, Homo sapiens
agtcccactgcctcaggttccta

SEQ ID NO: 3384901 - DNA, 22 bp, Homo sapiens
agtcccagtattctcagagcat

SEQ ID NO: 3384902 - DNA, 21 bp, Homo sapiens
agtcccattcatattaagaca

SEQ ID NO: 3384903 - DNA, 18 bp, Homo sapiens
agtccccaacctgcactc

SEQ ID NO: 3384904 - DNA, 15 bp, Homo sapiens
agtccccacccctgc

SEQ ID NO: 3384905 - DNA, 19 bp, Homo sapiens
agtccccagactcagctgg

SEQ ID NO: 3384906 - DNA, 14 bp, Homo sapiens
agtccccagccctt

SEQ ID NO: 3384907 - DNA, 15 bp, Homo sapiens
agtccccagcccttc

SEQ ID NO: 3384908 - DNA, 23 bp, Homo sapiens
agtccccagcccttcacattttt

SEQ ID NO: 3384909 - DNA, 18 bp, Homo sapiens
agtccccagcccttctgc

SEQ ID NO: 3384910 - DNA, 18 bp, Homo sapiens
agtcccccaactctgagc

SEQ ID NO: 3384911 - DNA, 23 bp, Homo sapiens
agtcccccaactctgagcccatg

SEQ ID NO: 3384912 - DNA, 18 bp, Homo sapiens
agtcccccagagatgtca

SEQ ID NO: 3384913 - DNA, 20 bp, Homo sapiens
agtcccccctcccacctcca

SEQ ID NO: 3384914 - DNA, 22 bp, Homo sapiens
agtccccgaggagctgggcccc

SEQ ID NO: 3384915 - DNA, 20 bp, Homo sapiens
agtccccgtgccccgcctcc

SEQ ID NO: 3384916 - DNA, 17 bp, Homo sapiens
agtcccctactccctct

SEQ ID NO: 3384917 - DNA, 14 bp, Homo sapiens
agtcccctccagga

SEQ ID NO: 3384918 - DNA, 17 bp, Homo sapiens
agtcccctccaggaaga

SEQ ID NO: 3384919 - DNA, 18 bp, Homo sapiens
agtcccctcccatctggg

SEQ ID NO: 3384920 - DNA, 18 bp, Homo sapiens
agtccctgcaggtgaata

SEQ ID NO: 3384921 - DNA, 16 bp, Homo sapiens
agtccctggttcattg

SEQ ID NO: 3384922 - DNA, 21 bp, Homo sapiens
agtccctgttttctgagcccg

SEQ ID NO: 3384923 - DNA, 14 bp, Homo sapiens
agtcccttcccctc

SEQ ID NO: 3384924 - DNA, 23 bp, Homo sapiens
agtcccttcccctccctggctcc

SEQ ID NO: 3384925 - DNA, 17 bp, Homo sapiens
agtccggacccacctca

SEQ ID NO: 3384926 - DNA, 20 bp, Homo sapiens
agtcctacaagctaaaatta

SEQ ID NO: 3384927 - DNA, 16 bp, Homo sapiens
agtcctatggaaaaaa

SEQ ID NO: 3384928 - DNA, 17 bp, Homo sapiens
agtcctcataaaaagca

SEQ ID NO: 3384929 - DNA, 14 bp, Homo sapiens
agtcctcattataa

SEQ ID NO: 3384930 - DNA, 16 bp, Homo sapiens
agtcctccactcgacc

SEQ ID NO: 3384931 - DNA, 18 bp, Homo sapiens
agtcctcccctcacagcc

SEQ ID NO: 3384932 - DNA, 21 bp, Homo sapiens
agtcctcccctcacagcctct

SEQ ID NO: 3384933 - DNA, 21 bp, Homo sapiens
agtcctcgtagccatctctct

SEQ ID NO: 3384934 - DNA, 12 bp, Homo sapiens
agtcctgaagag

SEQ ID NO: 3384935 - DNA, 23 bp, Homo sapiens
agtcctgaagaggcgggccagcc

SEQ ID NO: 3384936 - DNA, 15 bp, Homo sapiens
agtcctgaggagagg

SEQ ID NO: 3384937 - DNA, 19 bp, Homo sapiens
agtcctgagtgtggacttg

SEQ ID NO: 3384938 - DNA, 13 bp, Homo sapiens
agtgccggctgtg

SEQ ID NO: 3384939 - DNA, 15 bp, Homo sapiens
agtgccgtagggagt

SEQ ID NO: 3384940 - DNA, 22 bp, Homo sapiens
agtgcctagactgttactttgg

SEQ ID NO: 3384941 - DNA, 14 bp, Homo sapiens
agtgcctcgaggca

SEQ ID NO: 3384942 - DNA, 14 bp, Homo sapiens
agtgcctctttgaa

SEQ ID NO: 3384943 - DNA, 15 bp, Homo sapiens
agtgcctctttgaag

SEQ ID NO: 3384944 - DNA, 18 bp, Homo sapiens
agtgcctgacacactaac

SEQ ID NO: 3384945 - DNA, 19 bp, Homo sapiens
agtgccttctccttcccca

SEQ ID NO: 3384946 - DNA, 13 bp, Homo sapiens
agtgccttgctcg

SEQ ID NO: 3384947 - DNA, 16 bp, Homo sapiens
agtgcctttagagggt

SEQ ID NO: 3384948 - DNA, 22 bp, Homo sapiens
agtgcctttctgcagtttttca

SEQ ID NO: 3384949 - DNA, 20 bp, Homo sapiens
agtgccttttgcagaagagg

SEQ ID NO: 3384950 - DNA, 22 bp, Homo sapiens
agtgccttttgcagaagagggt

SEQ ID NO: 3384951 - DNA, 17 bp, Homo sapiens
agtgccttttgctgcgc

SEQ ID NO: 3384952 - DNA, 18 bp, Homo sapiens
agtgccttttgctgcgca

SEQ ID NO: 3384953 - DNA, 19 bp, Homo sapiens
agtgccttttgctgcgcac

SEQ ID NO: 3384954 - DNA, 20 bp, Homo sapiens
agtgccttttgctgcgcacc

SEQ ID NO: 3384955 - DNA, 15 bp, Homo sapiens
agtgccttttggaac

SEQ ID NO: 3384956 - DNA, 18 bp, Homo sapiens
agtgcgatgtttcaggag

SEQ ID NO: 3384957 - DNA, 18 bp, Homo sapiens
agtgcggcgtggagactg

SEQ ID NO: 3384958 - DNA, 14 bp, Homo sapiens
agtgcgtctgaggg

SEQ ID NO: 3384959 - DNA, 13 bp, Homo sapiens
agtgcgtgaatgt

SEQ ID NO: 3384960 - DNA, 17 bp, Homo sapiens
agtgcgtgaatgtatgt

SEQ ID NO: 3384961 - DNA, 16 bp, Homo sapiens
agtgcgtgtgtagagt

SEQ ID NO: 3384962 - DNA, 18 bp, Homo sapiens
agtgctaaggttctaagg

SEQ ID NO: 3384963 - DNA, 13 bp, Homo sapiens
agtgctagaaaat

SEQ ID NO: 3384964 - DNA, 16 bp, Homo sapiens
agtgctatatatataa

SEQ ID NO: 3384965 - DNA, 17 bp, Homo sapiens
agtgctatatatataaa

SEQ ID NO: 3384966 - DNA, 19 bp, Homo sapiens
agtgctatatatataaata

SEQ ID NO: 3384967 - DNA, 23 bp, Homo sapiens
agtgctatatatataaatatttg

SEQ ID NO: 3384968 - DNA, 14 bp, Homo sapiens
agtgctcttttctc

SEQ ID NO: 3384969 - DNA, 16 bp, Homo sapiens
agtgctgaacagtgga

SEQ ID NO: 3384970 - DNA, 15 bp, Homo sapiens
agtgctgagattaca

SEQ ID NO: 3384971 - DNA, 20 bp, Homo sapiens
agtgctgagattacaggcat

SEQ ID NO: 3384972 - DNA, 18 bp, Homo sapiens
agtgctgccatgccactg

SEQ ID NO: 3384973 - DNA, 16 bp, Homo sapiens
agtgctgctgtaaata

SEQ ID NO: 3384974 - DNA, 12 bp, Homo sapiens
agtgctggattt

SEQ ID NO: 3384975 - DNA, 17 bp, Homo sapiens
agtgctggatttgatga

SEQ ID NO: 3384976 - DNA, 15 bp, Homo sapiens
agtgctggctcacag

SEQ ID NO: 3384977 - DNA, 16 bp, Homo sapiens
agtgctggctcacagt

SEQ ID NO: 3384978 - DNA, 18 bp, Homo sapiens
agtgctggctcacagtac

SEQ ID NO: 3384979 - DNA, 20 bp, Homo sapiens
agtgctggctcacagtacag

SEQ ID NO: 3384980 - DNA, 15 bp, Homo sapiens
agtgctgggaccaga

SEQ ID NO: 3384981 - DNA, 16 bp, Homo sapiens
agtgctgggaccagag

SEQ ID NO: 3384982 - DNA, 21 bp, Homo sapiens
agtgctgggatggaggggagt

SEQ ID NO: 3384983 - DNA, 22 bp, Homo sapiens
agtgctgggatggaggggagtg

SEQ ID NO: 3384984 - DNA, 20 bp, Homo sapiens
agtgctgggattacaagcgt

SEQ ID NO: 3384985 - DNA, 16 bp, Homo sapiens
agtgctgtacccttcc

SEQ ID NO: 3384986 - DNA, 15 bp, Homo sapiens
agtgctgttggtggc

SEQ ID NO: 3384987 - DNA, 20 bp, Homo sapiens
agtgctgtttattaatctta

SEQ ID NO: 3384988 - DNA, 22 bp, Homo sapiens
agtgctgtttattaatcttagt

SEQ ID NO: 3384989 - DNA, 21 bp, Homo sapiens
agtgcttcagagtttgtgtgt

SEQ ID NO: 3384990 - DNA, 14 bp, Homo sapiens
agtgcttcagcctg

SEQ ID NO: 3384991 - DNA, 17 bp, Homo sapiens
agtgcttcagcctgagg

SEQ ID NO: 3384992 - DNA, 21 bp, Homo sapiens
agtgcttcttaaagagttctt

SEQ ID NO: 3384993 - DNA, 20 bp, Homo sapiens
agtgcttgttagagagaaag

SEQ ID NO: 3384994 - DNA, 21 bp, Homo sapiens
agtgcttgttagagagaaaga

SEQ ID NO: 3384995 - DNA, 22 bp, Homo sapiens
agtgcttgttagagagaaagag

SEQ ID NO: 3384996 - DNA, 13 bp, Homo sapiens
agtgctttaatgg

SEQ ID NO: 3384997 - DNA, 16 bp, Homo sapiens
agtgcttttctgttta

SEQ ID NO: 3384998 - DNA, 19 bp, Homo sapiens
agtggaaaaaagagaaaaa

SEQ ID NO: 3384999 - DNA, 19 bp, Homo sapiens
agtggaaatcgcttatatg

SEQ ID NO: 3385000 - DNA, 15 bp, Homo sapiens
agtggaaatgttcta

SEQ ID NO: 3385001 - DNA, 22 bp, Homo sapiens
agtggaaattcaggtgaaaatg

SEQ ID NO: 3385002 - DNA, 16 bp, Homo sapiens
agtggaacagcgggag

SEQ ID NO: 3385003 - DNA, 19 bp, Homo sapiens
agtggaagagcagcctgat

SEQ ID NO: 3385004 - DNA, 14 bp, Homo sapiens
agtggaagcttcta

SEQ ID NO: 3385005 - DNA, 17 bp, Homo sapiens
agtggaaggtctattgg

SEQ ID NO: 3385006 - DNA, 15 bp, Homo sapiens
agtggaatgcaggga

SEQ ID NO: 3385007 - DNA, 19 bp, Homo sapiens
agtggaatgcagggaagag

SEQ ID NO: 3385008 - DNA, 21 bp, Homo sapiens
agtggaatgcagggaagaggg

SEQ ID NO: 3385009 - DNA, 19 bp, Homo sapiens
agtggaccttaggccttcc

SEQ ID NO: 3385010 - DNA, 20 bp, Homo sapiens
agtggaccttaggccttcct

SEQ ID NO: 3385011 - DNA, 23 bp, Homo sapiens
agtggaccttaggccttcctctc

SEQ ID NO: 3385012 - DNA, 15 bp, Homo sapiens
agtggactgcattta

SEQ ID NO: 3385013 - DNA, 17 bp, Homo sapiens
agtggaggcactttagg

SEQ ID NO: 3385014 - DNA, 19 bp, Homo sapiens
agtggaggtgggctgggcc

SEQ ID NO: 3385015 - DNA, 14 bp, Homo sapiens
agtggagtctgagt

SEQ ID NO: 3385016 - DNA, 18 bp, Homo sapiens
agtggagtctgagtctga

SEQ ID NO: 3385017 - DNA, 12 bp, Homo sapiens
agtggatgggaa

SEQ ID NO: 3385018 - DNA, 23 bp, Homo sapiens
agtggcaagaccaaaatgacaat

SEQ ID NO: 3385019 - DNA, 13 bp, Homo sapiens
agtggcagccatg

SEQ ID NO: 3385020 - DNA, 15 bp, Homo sapiens
agtggcagccatgcc

SEQ ID NO: 3385021 - DNA, 23 bp, Homo sapiens
agtggcagccatgcctcatgcca

SEQ ID NO: 3385022 - DNA, 11 bp, Homo sapiens
agtggcagctg

SEQ ID NO: 3385023 - DNA, 14 bp, Homo sapiens
agtggcagggctca

SEQ ID NO: 3385024 - DNA, 18 bp, Homo sapiens
agtggcagggctcaggat

SEQ ID NO: 3385025 - DNA, 11 bp, Homo sapiens
agtggcagggg

SEQ ID NO: 3385026 - DNA, 18 bp, Homo sapiens
agtggcaggggacaggag

SEQ ID NO: 3385027 - DNA, 18 bp, Homo sapiens
agtggccagccagtgcca

SEQ ID NO: 3385028 - DNA, 15 bp, Homo sapiens
agtggcctccctgct

SEQ ID NO: 3385029 - DNA, 20 bp, Homo sapiens
agtggcctggccaggagctc

SEQ ID NO: 3385030 - DNA, 15 bp, Homo sapiens
agtggcgcaaggccg

SEQ ID NO: 3385031 - DNA, 19 bp, Homo sapiens
agtggcgtgggagccagcc

SEQ ID NO: 3385032 - DNA, 14 bp, Homo sapiens
agtggctcaacatt

SEQ ID NO: 3385033 - DNA, 14 bp, Homo sapiens
agtggctcacgcct

SEQ ID NO: 3385034 - DNA, 16 bp, Homo sapiens
agtggctcatgcctgt

SEQ ID NO: 3385035 - DNA, 21 bp, Homo sapiens
agtggctcctcccggtgccca

SEQ ID NO: 3385036 - DNA, 16 bp, Homo sapiens
agtggctcgctccctg

SEQ ID NO: 3385037 - DNA, 14 bp, Homo sapiens
agtggctgggtggg

SEQ ID NO: 3385038 - DNA, 20 bp, Homo sapiens
agtggctgggtgggcccaga

SEQ ID NO: 3385039 - DNA, 23 bp, Homo sapiens
agtggctgggtgggcccagaact

SEQ ID NO: 3385040 - DNA, 16 bp, Homo sapiens
agtggctgtccctgtg

SEQ ID NO: 3385041 - DNA, 19 bp, Homo sapiens
agtgggagaaggcagtgat

SEQ ID NO: 3385042 - DNA, 14 bp, Homo sapiens
agtgggaggggcag

SEQ ID NO: 3385043 - DNA, 15 bp, Homo sapiens
agtgggaggggcagg

SEQ ID NO: 3385044 - DNA, 22 bp, Homo sapiens
agtgggaggggcaggctgacat

SEQ ID NO: 3385045 - DNA, 14 bp, Homo sapiens
agtgggcacctcag

SEQ ID NO: 3385046 - DNA, 12 bp, Homo sapiens
agtgggccaggg

SEQ ID NO: 3385047 - DNA, 15 bp, Homo sapiens
agtgggccagggctg

SEQ ID NO: 3385048 - DNA, 20 bp, Homo sapiens
agtgggccccgggctggaga

SEQ ID NO: 3385049 - DNA, 18 bp, Homo sapiens
agtgggcgttgggagcct

SEQ ID NO: 3385050 - DNA, 20 bp, Homo sapiens
agtgggctgatgctgggacc

SEQ ID NO: 3385051 - DNA, 22 bp, Homo sapiens
agtgggcttgattctgcagtaa

SEQ ID NO: 3385052 - DNA, 14 bp, Homo sapiens
agtggggagggaca

SEQ ID NO: 3385053 - DNA, 22 bp, Homo sapiens
agtggggatggggcctccctcc

SEQ ID NO: 3385054 - DNA, 12 bp, Homo sapiens
agtggggcctgt

SEQ ID NO: 3385055 - DNA, 18 bp, Homo sapiens
agtggggctcgccatgcc

SEQ ID NO: 3385056 - DNA, 16 bp, Homo sapiens
agtggggggacagaga

SEQ ID NO: 3385057 - DNA, 18 bp, Homo sapiens
agtggggttatctctgtg

SEQ ID NO: 3385058 - DNA, 20 bp, Homo sapiens
agtggggttatctctgtgtt

SEQ ID NO: 3385059 - DNA, 18 bp, Homo sapiens
agtgggtgacaagagcct

SEQ ID NO: 3385060 - DNA, 19 bp, Homo sapiens
agtgggtgacaagagcctg

SEQ ID NO: 3385061 - DNA, 22 bp, Homo sapiens
agtgggttttattgtccttcag

SEQ ID NO: 3385062 - DNA, 14 bp, Homo sapiens
agtggtaacagctc

SEQ ID NO: 3385063 - DNA, 17 bp, Homo sapiens
agtggtaacagctctct

SEQ ID NO: 3385064 - DNA, 23 bp, Homo sapiens
agtttcttgcttggaagccaggt

SEQ ID NO: 3385065 - DNA, 19 bp, Homo sapiens
agtttctttcctgccttct

SEQ ID NO: 3385066 - DNA, 23 bp, Homo sapiens
agtttctttcctgccttcttctt

SEQ ID NO: 3385067 - DNA, 21 bp, Homo sapiens
agtttgaaaagcaatattgta

SEQ ID NO: 3385068 - DNA, 16 bp, Homo sapiens
agtttgaaggaaacag

SEQ ID NO: 3385069 - DNA, 16 bp, Homo sapiens
agtttgaattcagtaa

SEQ ID NO: 3385070 - DNA, 19 bp, Homo sapiens
agtttgagacaagccctgg

SEQ ID NO: 3385071 - DNA, 23 bp, Homo sapiens
agtttgagacaagccctggcaac

SEQ ID NO: 3385072 - DNA, 11 bp, Homo sapiens
agtttgaggcc

SEQ ID NO: 3385073 - DNA, 14 bp, Homo sapiens
agtttgaggctgca

SEQ ID NO: 3385074 - DNA, 20 bp, Homo sapiens
agtttgatgtcattaatgtg

SEQ ID NO: 3385075 - DNA, 21 bp, Homo sapiens
agtttgccctggtttcactgg

SEQ ID NO: 3385076 - DNA, 20 bp, Homo sapiens
agtttgctaagtaaattagt

SEQ ID NO: 3385077 - DNA, 14 bp, Homo sapiens
agtttgctattaga

SEQ ID NO: 3385078 - DNA, 13 bp, Homo sapiens
agtttgcttagaa

SEQ ID NO: 3385079 - DNA, 20 bp, Homo sapiens
agtttggatatttttgtact

SEQ ID NO: 3385080 - DNA, 16 bp, Homo sapiens
agtttggcaatagttt

SEQ ID NO: 3385081 - DNA, 13 bp, Homo sapiens
agtttgggtaaaa

SEQ ID NO: 3385082 - DNA, 18 bp, Homo sapiens
agtttgggtaaaatactt

SEQ ID NO: 3385083 - DNA, 14 bp, Homo sapiens
agtttgggtatttt

SEQ ID NO: 3385084 - DNA, 21 bp, Homo sapiens
agtttggttgtgtaagagaat

SEQ ID NO: 3385085 - DNA, 13 bp, Homo sapiens
agtttgtaaaaat

SEQ ID NO: 3385086 - DNA, 16 bp, Homo sapiens
agtttgtagccaggta

SEQ ID NO: 3385087 - DNA, 21 bp, Homo sapiens
agtttgtaggtaaaatgtatt

SEQ ID NO: 3385088 - DNA, 21 bp, Homo sapiens
agtttgtatagagttcatccc

SEQ ID NO: 3385089 - DNA, 15 bp, Homo sapiens
agtttgtccatttgt

SEQ ID NO: 3385090 - DNA, 17 bp, Homo sapiens
agtttgtcgctcatgtg

SEQ ID NO: 3385091 - DNA, 19 bp, Homo sapiens
agtttgtcgctcatgtgtg

SEQ ID NO: 3385092 - DNA, 21 bp, Homo sapiens
agtttgtcgctcatgtgtgca

SEQ ID NO: 3385093 - DNA, 21 bp, Homo sapiens
agtttgtctattttaaaataa

SEQ ID NO: 3385094 - DNA, 14 bp, Homo sapiens
agtttgtgtgtctt

SEQ ID NO: 3385095 - DNA, 22 bp, Homo sapiens
agtttgtgtgtcttaattatta

SEQ ID NO: 3385096 - DNA, 21 bp, Homo sapiens
agtttgtgtgttgtctcttga

SEQ ID NO: 3385097 - DNA, 13 bp, Homo sapiens
agtttgttggaaa

SEQ ID NO: 3385098 - DNA, 22 bp, Homo sapiens
agtttgtttaaacacttatctt

SEQ ID NO: 3385099 - DNA, 12 bp, Homo sapiens
agtttgttttag

SEQ ID NO: 3385100 - DNA, 22 bp, Homo sapiens
agttttaaaaagccagtttggg

SEQ ID NO: 3385101 - DNA, 14 bp, Homo sapiens
agttttaaaagtct

SEQ ID NO: 3385102 - DNA, 23 bp, Homo sapiens
agttttaaactcatttttgccat

SEQ ID NO: 3385103 - DNA, 16 bp, Homo sapiens
agttttaatccagaat

SEQ ID NO: 3385104 - DNA, 23 bp, Homo sapiens
agttttactgtctattaatattc

SEQ ID NO: 3385105 - DNA, 21 bp, Homo sapiens
agttttagaataaggaggagg

SEQ ID NO: 3385106 - DNA, 15 bp, Homo sapiens
agttttagttgcaga

SEQ ID NO: 3385107 - DNA, 17 bp, Homo sapiens
agttttatatgctttat

SEQ ID NO: 3385108 - DNA, 15 bp, Homo sapiens
agttttatcattttc

SEQ ID NO: 3385109 - DNA, 14 bp, Homo sapiens
agttttatgctctt

SEQ ID NO: 3385110 - DNA, 23 bp, Homo sapiens
agttttatgctcttttttactca

SEQ ID NO: 3385111 - DNA, 16 bp, Homo sapiens
agttttattgagaatt

SEQ ID NO: 3385112 - DNA, 21 bp, Homo sapiens
agttttattgagaattttaaa

SEQ ID NO: 3385113 - DNA, 15 bp, Homo sapiens
agttttatttttgcc

SEQ ID NO: 3385114 - DNA, 15 bp, Homo sapiens
agttttcaaatttgt

SEQ ID NO: 3385115 - DNA, 22 bp, Homo sapiens
agttttcactcttattgcccac

SEQ ID NO: 3385116 - DNA, 17 bp, Homo sapiens
agttttcagaacctctt

SEQ ID NO: 3385117 - DNA, 10 bp, Homo sapiens
agttttccta

SEQ ID NO: 3385118 - DNA, 13 bp, Homo sapiens
agttttcctttgt

SEQ ID NO: 3385119 - DNA, 15 bp, Homo sapiens
agttttcttccatga

SEQ ID NO: 3385120 - DNA, 13 bp, Homo sapiens
agttttctttagt

SEQ ID NO: 3385121 - DNA, 14 bp, Homo sapiens
agttttgaaaagct

SEQ ID NO: 3385122 - DNA, 17 bp, Homo sapiens
agttttgaaaagctatt

SEQ ID NO: 3385123 - DNA, 14 bp, Homo sapiens
agttttgaaagaaa

SEQ ID NO: 3385124 - DNA, 18 bp, Homo sapiens
agttttgatatgagtata

SEQ ID NO: 3385125 - DNA, 14 bp, Homo sapiens
agttttgatgaaat

SEQ ID NO: 3385126 - DNA, 19 bp, Homo sapiens
agttttgattaatgtttct

SEQ ID NO: 3385127 - DNA, 20 bp, Homo sapiens
agttttgattaatgtttctt

SEQ ID NO: 3385128 - DNA, 24 bp, Homo sapiens
agttttgattaatgtttcttaaat

SEQ ID NO: 3385129 - DNA, 14 bp, Homo sapiens
agttttgctgtctc

SEQ ID NO: 3385130 - DNA, 18 bp, Homo sapiens
agttttgttgtacttaaa

SEQ ID NO: 3385131 - DNA, 18 bp, Homo sapiens
agtttttacagctgtgtt

SEQ ID NO: 3385132 - DNA, 22 bp, Homo sapiens
agtttttacctaccacagtgtc

SEQ ID NO: 3385133 - DNA, 23 bp, Homo sapiens
agtttttacctaccacagtgtct

SEQ ID NO: 3385134 - DNA, 21 bp, Homo sapiens
agtttttagtaatctgtacat

SEQ ID NO: 3385135 - DNA, 18 bp, Homo sapiens
agtttttattccttgtga

SEQ ID NO: 3385136 - DNA, 13 bp, Homo sapiens
agtttttcatttg

SEQ ID NO: 3385137 - DNA, 14 bp, Homo sapiens
agtttttcatttgt

SEQ ID NO: 3385138 - DNA, 22 bp, Homo sapiens
agtttttcatttgttttgcttt

SEQ ID NO: 3385139 - DNA, 12 bp, Homo sapiens
agtttttctgtc

SEQ ID NO: 3385140 - DNA, 16 bp, Homo sapiens
agtttttgatagcttt

SEQ ID NO: 3385141 - DNA, 13 bp, Homo sapiens
agtttttgatagt

SEQ ID NO: 3385142 - DNA, 16 bp, Homo sapiens
agtttttggttgggaa

SEQ ID NO: 3385143 - DNA, 12 bp, Homo sapiens
agtttttgtact

SEQ ID NO: 3385144 - DNA, 18 bp, Homo sapiens
agtttttgtactgtaaag

SEQ ID NO: 3385145 - DNA, 14 bp, Homo sapiens
agtttttgtatctt

SEQ ID NO: 3385146 - DNA, 12 bp, Homo sapiens
agtttttgttct

SEQ ID NO: 3385147 - DNA, 20 bp, Homo sapiens
agtttttgttcttaattgca

SEQ ID NO: 3385148 - DNA, 12 bp, Homo sapiens
agtttttgtttg

SEQ ID NO: 3385149 - DNA, 16 bp, Homo sapiens
agtttttgtttttgca

SEQ ID NO: 3385150 - DNA, 21 bp, Homo sapiens
agttttttacttttgtttatt

SEQ ID NO: 3385151 - DNA, 22 bp, Homo sapiens
agttttttgaaaatgggctcaa

SEQ ID NO: 3385152 - DNA, 16 bp, Homo sapiens
agttttttgttttaca

SEQ ID NO: 3385153 - DNA, 15 bp, Homo sapiens
agtttttttttaatc

SEQ ID NO: 3385154 - DNA, 19 bp, Homo sapiens
ataaaaaaacaatcatttg

SEQ ID NO: 3385155 - DNA, 15 bp, Homo sapiens
ataaaaaatagacat

SEQ ID NO: 3385156 - DNA, 17 bp, Homo sapiens
ataaaaaatagacatgt

SEQ ID NO: 3385157 - DNA, 13 bp, Homo sapiens
ataaaaaatcatg

SEQ ID NO: 3385158 - DNA, 16 bp, Homo sapiens
ataaaaaatcatgcca

SEQ ID NO: 3385159 - DNA, 13 bp, Homo sapiens
ataaaaaatctga

SEQ ID NO: 3385160 - DNA, 13 bp, Homo sapiens
ataaaaaatgtaa

SEQ ID NO: 3385161 - DNA, 19 bp, Homo sapiens
ataaaaacattttgaagtg

SEQ ID NO: 3385162 - DNA, 16 bp, Homo sapiens
ataaaaactaatttca

SEQ ID NO: 3385163 - DNA, 22 bp, Homo sapiens
ataaaaagaaaagataaagatg

SEQ ID NO: 3385164 - DNA, 18 bp, Homo sapiens
ataaaaagatcactttct

SEQ ID NO: 3385165 - DNA, 22 bp, Homo sapiens
ataaaaagatcactttctcagt

SEQ ID NO: 3385166 - DNA, 13 bp, Homo sapiens
ataaaaagcaaaa

SEQ ID NO: 3385167 - DNA, 13 bp, Homo sapiens
ataaaaagcagaa

SEQ ID NO: 3385168 - DNA, 17 bp, Homo sapiens
ataaaaagtgacacagc

SEQ ID NO: 3385169 - DNA, 13 bp, Homo sapiens
ataaaaagtttca

SEQ ID NO: 3385170 - DNA, 23 bp, Homo sapiens
ataaaaatatatatagtgctata

SEQ ID NO: 3385171 - DNA, 12 bp, Homo sapiens
ataaaaatgaca

SEQ ID NO: 3385172 - DNA, 14 bp, Homo sapiens
ataaaaatggaatt

SEQ ID NO: 3385173 - DNA, 22 bp, Homo sapiens
ataaaaatgtctcagcaacagt

SEQ ID NO: 3385174 - DNA, 12 bp, Homo sapiens
ataaaaatgttt

SEQ ID NO: 3385175 - DNA, 14 bp, Homo sapiens
ataaaacagctttg

SEQ ID NO: 3385176 - DNA, 14 bp, Homo sapiens
ataaaacaggaccg

SEQ ID NO: 3385177 - DNA, 12 bp, Homo sapiens
ataaaacaggta

SEQ ID NO: 3385178 - DNA, 16 bp, Homo sapiens
ataaaacatctttcca

SEQ ID NO: 3385179 - DNA, 11 bp, Homo sapiens
ataaaaccatg

SEQ ID NO: 3385180 - DNA, 13 bp, Homo sapiens
ataaaacctttca

SEQ ID NO: 3385181 - DNA, 20 bp, Homo sapiens
ataaaacctttcaaatttca

SEQ ID NO: 3385182 - DNA, 12 bp, Homo sapiens
ataaaactgaat

SEQ ID NO: 3385183 - DNA, 14 bp, Homo sapiens
ataaaacttatgct

SEQ ID NO: 3385184 - DNA, 19 bp, Homo sapiens
ataaaactttatgtactgc

SEQ ID NO: 3385185 - DNA, 15 bp, Homo sapiens
ataaaagaaaaaata

SEQ ID NO: 3385186 - DNA, 14 bp, Homo sapiens
ataaaagacacaga

SEQ ID NO: 3385187 - DNA, 20 bp, Homo sapiens
ataaaagcacaagtactttt

SEQ ID NO: 3385188 - DNA, 13 bp, Homo sapiens
ataaaagccttgg

SEQ ID NO: 3385189 - DNA, 20 bp, Homo sapiens
ataaaagctataaagtatat

SEQ ID NO: 3385190 - DNA, 19 bp, Homo sapiens
ataaaataaaaaccaaatt

SEQ ID NO: 3385191 - DNA, 17 bp, Homo sapiens
ataattttttattcaag

SEQ ID NO: 3385192 - DNA, 23 bp, Homo sapiens
ataatttttttattactgatttt

SEQ ID NO: 3385193 - DNA, 22 bp, Homo sapiens
ataatttttttcaatatttatt

SEQ ID NO: 3385194 - DNA, 17 bp, Homo sapiens
atacaaactggtattct

SEQ ID NO: 3385195 - DNA, 18 bp, Homo sapiens
atacaaagcgtgcacaag

SEQ ID NO: 3385196 - DNA, 17 bp, Homo sapiens
atacaaagtaaatacaa

SEQ ID NO: 3385197 - DNA, 19 bp, Homo sapiens
atacaaagttagagaacta

SEQ ID NO: 3385198 - DNA, 17 bp, Homo sapiens
atacaaatggattttgg

SEQ ID NO: 3385199 - DNA, 18 bp, Homo sapiens
atacaaattagaaaatgt

SEQ ID NO: 3385200 - DNA, 20 bp, Homo sapiens
atacaacagcaaaccctgat

SEQ ID NO: 3385201 - DNA, 15 bp, Homo sapiens
atacaacctccctct

SEQ ID NO: 3385202 - DNA, 20 bp, Homo sapiens
atacaacctccctcttgttt

SEQ ID NO: 3385203 - DNA, 16 bp, Homo sapiens
atacaacttaaataat

SEQ ID NO: 3385204 - DNA, 15 bp, Homo sapiens
atacaagattgaaaa

SEQ ID NO: 3385205 - DNA, 12 bp, Homo sapiens
atacaagccaaa

SEQ ID NO: 3385206 - DNA, 19 bp, Homo sapiens
atacaaggcaagcattttt

SEQ ID NO: 3385207 - DNA, 20 bp, Homo sapiens
atacaataaactattggaaa

SEQ ID NO: 3385208 - DNA, 19 bp, Homo sapiens
atacaataacccagttact

SEQ ID NO: 3385209 - DNA, 20 bp, Homo sapiens
atacaataacccagttactt

SEQ ID NO: 3385210 - DNA, 21 bp, Homo sapiens
atacaatatataaaaatatat

SEQ ID NO: 3385211 - DNA, 19 bp, Homo sapiens
atacaatcctgtttataat

SEQ ID NO: 3385212 - DNA, 21 bp, Homo sapiens
atacaatgactagtcacctgg

SEQ ID NO: 3385213 - DNA, 16 bp, Homo sapiens
atacaattaaaggtcc

SEQ ID NO: 3385214 - DNA, 19 bp, Homo sapiens
atacacacatgccctcctg

SEQ ID NO: 3385215 - DNA, 15 bp, Homo sapiens
atacacagtacttta

SEQ ID NO: 3385216 - DNA, 16 bp, Homo sapiens
atacacagtactttat

SEQ ID NO: 3385217 - DNA, 21 bp, Homo sapiens
atacacatatacctataatgt

SEQ ID NO: 3385218 - DNA, 15 bp, Homo sapiens
atacacttgtataaa

SEQ ID NO: 3385219 - DNA, 15 bp, Homo sapiens
atacagacactaagt

SEQ ID NO: 3385220 - DNA, 14 bp, Homo sapiens
atacagataacatt

SEQ ID NO: 3385221 - DNA, 18 bp, Homo sapiens
atacagataattcatttg

SEQ ID NO: 3385222 - DNA, 19 bp, Homo sapiens
atacagatcaggcagtgtt

SEQ ID NO: 3385223 - DNA, 16 bp, Homo sapiens
atacagatgaaaattt

SEQ ID NO: 3385224 - DNA, 20 bp, Homo sapiens
atacagatgaaaatttgaga

SEQ ID NO: 3385225 - DNA, 22 bp, Homo sapiens
atacagattctagccaaactat

SEQ ID NO: 3385226 - DNA, 13 bp, Homo sapiens
atacagattttac

SEQ ID NO: 3385227 - DNA, 16 bp, Homo sapiens
atacagcaacaattta

SEQ ID NO: 3385228 - DNA, 20 bp, Homo sapiens
atacagccctcccccagcag

SEQ ID NO: 3385229 - DNA, 11 bp, Homo sapiens
atacagctcta

SEQ ID NO: 3385230 - DNA, 19 bp, Homo sapiens
atacaggaaaagctgctga

SEQ ID NO: 3385231 - DNA, 12 bp, Homo sapiens
atacaggaagaa

SEQ ID NO: 3385232 - DNA, 23 bp, Homo sapiens
atacaggaagaaagagcttgagg

SEQ ID NO: 3385233 - DNA, 12 bp, Homo sapiens
atacaggtgctc

SEQ ID NO: 3385234 - DNA, 17 bp, Homo sapiens
atacagtaactttatgt

SEQ ID NO: 3385235 - DNA, 19 bp, Homo sapiens
atacagtaagctgctctat

SEQ ID NO: 3385236 - DNA, 12 bp, Homo sapiens
atacagtacaca

SEQ ID NO: 3385237 - DNA, 16 bp, Homo sapiens
atacagtattgaaaaa

SEQ ID NO: 3385238 - DNA, 14 bp, Homo sapiens
atacagtgttattt

SEQ ID NO: 3385239 - DNA, 14 bp, Homo sapiens
atacagttattttg

SEQ ID NO: 3385240 - DNA, 18 bp, Homo sapiens
atacataaatagtagaaa

SEQ ID NO: 3385241 - DNA, 24 bp, Homo sapiens
atacataactaaatttgatactta

SEQ ID NO: 3385242 - DNA, 21 bp, Homo sapiens
atacatacggtcaggtttaac

SEQ ID NO: 3385243 - DNA, 22 bp, Homo sapiens
atacatacggtcaggtttaaca

SEQ ID NO: 3385244 - DNA, 16 bp, Homo sapiens
atacatatcgctgact

SEQ ID NO: 3385245 - DNA, 17 bp, Homo sapiens
atacatatctttattaa

SEQ ID NO: 3385246 - DNA, 19 bp, Homo sapiens
atacatcactgcttgatga

SEQ ID NO: 3385247 - DNA, 22 bp, Homo sapiens
atacatcactgcttgatgaagc

SEQ ID NO: 3385248 - DNA, 16 bp, Homo sapiens
atacatcctgggtaat

SEQ ID NO: 3385249 - DNA, 18 bp, Homo sapiens
atacatcctgggtaatga

SEQ ID NO: 3385250 - DNA, 17 bp, Homo sapiens
atacatgaaaattttaa

SEQ ID NO: 3385251 - DNA, 10 bp, Homo sapiens
atacatgcca

SEQ ID NO: 3385252 - DNA, 21 bp, Homo sapiens
atacatgccacatcaaacctt

SEQ ID NO: 3385253 - DNA, 16 bp, Homo sapiens
atacatgcgtgtacct

SEQ ID NO: 3385254 - DNA, 13 bp, Homo sapiens
atacatgctactt

SEQ ID NO: 3385255 - DNA, 15 bp, Homo sapiens
atacatgctgctaat

SEQ ID NO: 3385256 - DNA, 14 bp, Homo sapiens
atacatggataaca

SEQ ID NO: 3385257 - DNA, 14 bp, Homo sapiens
atacatggttgtga

SEQ ID NO: 3385258 - DNA, 20 bp, Homo sapiens
atacatggttgtgacctgag

SEQ ID NO: 3385259 - DNA, 19 bp, Homo sapiens
atacatgtgatacattttt

SEQ ID NO: 3385260 - DNA, 14 bp, Homo sapiens
atacatgtgtgtat

SEQ ID NO: 3385261 - DNA, 18 bp, Homo sapiens
atacatgtgtgtatatat

SEQ ID NO: 3385262 - DNA, 19 bp, Homo sapiens
atacatgtgtgtatatatg

SEQ ID NO: 3385263 - DNA, 18 bp, Homo sapiens
atacattaaaactaggta

SEQ ID NO: 3385264 - DNA, 15 bp, Homo sapiens
atacatttaaaactt

SEQ ID NO: 3385265 - DNA, 20 bp, Homo sapiens
atacatttataatgtttgct

SEQ ID NO: 3385266 - DNA, 13 bp, Homo sapiens
atacatttgttgg

SEQ ID NO: 3385267 - DNA, 16 bp, Homo sapiens
atacattttttaagct

SEQ ID NO: 3385268 - DNA, 20 bp, Homo sapiens
ataccacaagcctgagaact

SEQ ID NO: 3385269 - DNA, 19 bp, Homo sapiens
ataccaccaccaagaaagc

SEQ ID NO: 3385270 - DNA, 16 bp, Homo sapiens
ataccacctttactgt

SEQ ID NO: 3385271 - DNA, 12 bp, Homo sapiens
ataccacttacc

SEQ ID NO: 3385272 - DNA, 14 bp, Homo sapiens
ataccacttacctc

SEQ ID NO: 3385273 - DNA, 17 bp, Homo sapiens
ataccagacctcttcta

SEQ ID NO: 3385274 - DNA, 12 bp, Homo sapiens
ataccagagcct

SEQ ID NO: 3385275 - DNA, 22 bp, Homo sapiens
ataccagcccctgtatggcact

SEQ ID NO: 3385276 - DNA, 18 bp, Homo sapiens
ataccagcttagatttta

SEQ ID NO: 3385277 - DNA, 19 bp, Homo sapiens
ataccattaaaactgcttt

SEQ ID NO: 3385278 - DNA, 22 bp, Homo sapiens
ataccattcagatcactgaatt

SEQ ID NO: 3385279 - DNA, 15 bp, Homo sapiens
ataccattgacacat

SEQ ID NO: 3385280 - DNA, 18 bp, Homo sapiens
ataccatttagtaagaat

SEQ ID NO: 3385281 - DNA, 22 bp, Homo sapiens
ataccatttagtaagaatacca

SEQ ID NO: 3385282 - DNA, 15 bp, Homo sapiens
atacccccaggaaac

SEQ ID NO: 3385283 - DNA, 16 bp, Homo sapiens
atacccccaggaaact

SEQ ID NO: 3385284 - DNA, 18 bp, Homo sapiens
atacccccattaaattca

SEQ ID NO: 3385285 - DNA, 19 bp, Homo sapiens
ataccccttacttagcatg

SEQ ID NO: 3385286 - DNA, 14 bp, Homo sapiens
atacctaagtactg

SEQ ID NO: 3385287 - DNA, 21 bp, Homo sapiens
atacctaagtactgtaataat

SEQ ID NO: 3385288 - DNA, 16 bp, Homo sapiens
atacctaattgtggat

SEQ ID NO: 3385289 - DNA, 17 bp, Homo sapiens
atacctacaataaactg

SEQ ID NO: 3385290 - DNA, 14 bp, Homo sapiens
atacctataatgtg

SEQ ID NO: 3385291 - DNA, 14 bp, Homo sapiens
atacctcaatgttt

SEQ ID NO: 3385292 - DNA, 16 bp, Homo sapiens
atacctccattaaatg

SEQ ID NO: 3385293 - DNA, 13 bp, Homo sapiens
atacctctgacca

SEQ ID NO: 3385294 - DNA, 15 bp, Homo sapiens
atacctctgctggga

SEQ ID NO: 3385295 - DNA, 13 bp, Homo sapiens
atacctctgtgtg

SEQ ID NO: 3385296 - DNA, 17 bp, Homo sapiens
atacctctgtgtgctcc

SEQ ID NO: 3385297 - DNA, 17 bp, Homo sapiens
atacctggcttttactt

SEQ ID NO: 3385298 - DNA, 17 bp, Homo sapiens
atacgactttattttct

SEQ ID NO: 3385299 - DNA, 19 bp, Homo sapiens
atacgctactataaagaga

SEQ ID NO: 3385300 - DNA, 15 bp, Homo sapiens
atacgcttttctttg

SEQ ID NO: 3385301 - DNA, 24 bp, Homo sapiens
atacgcttttctttgttataccat

SEQ ID NO: 3385302 - DNA, 22 bp, Homo sapiens
atacggtcaggtttaacatttg

SEQ ID NO: 3385303 - DNA, 21 bp, Homo sapiens
atacgtagttgtgcttttgtt

SEQ ID NO: 3385304 - DNA, 16 bp, Homo sapiens
atacgttcactggtct

SEQ ID NO: 3385305 - DNA, 15 bp, Homo sapiens
atactaacttattta

SEQ ID NO: 3385306 - DNA, 20 bp, Homo sapiens
atactaagatgttcactgtg

SEQ ID NO: 3385307 - DNA, 12 bp, Homo sapiens
atactacatctt

SEQ ID NO: 3385308 - DNA, 15 bp, Homo sapiens
atactacctctgaat

SEQ ID NO: 3385309 - DNA, 15 bp, Homo sapiens
atactaccttgaaaa

SEQ ID NO: 3385310 - DNA, 14 bp, Homo sapiens
atactactgaaaca

SEQ ID NO: 3385311 - DNA, 21 bp, Homo sapiens
atactactgaaacagatttca

SEQ ID NO: 3385312 - DNA, 18 bp, Homo sapiens
atactaggatacagaaat

SEQ ID NO: 3385313 - DNA, 23 bp, Homo sapiens
atactaggatacagaaatgcaaa

SEQ ID NO: 3385314 - DNA, 16 bp, Homo sapiens
atactagggagccatt

SEQ ID NO: 3385315 - DNA, 20 bp, Homo sapiens
atactagggagccatttgag

SEQ ID NO: 3385316 - DNA, 21 bp, Homo sapiens
atactagggagccatttgaga

SEQ ID NO: 3385317 - DNA, 22 bp, Homo sapiens
atataaaatatctatattctat

SEQ ID NO: 3385318 - DNA, 14 bp, Homo sapiens
atataaacatttta

SEQ ID NO: 3385319 - DNA, 21 bp, Homo sapiens
atataaacattttatttatag

SEQ ID NO: 3385320 - DNA, 13 bp, Homo sapiens
atataaagaatat

SEQ ID NO: 3385321 - DNA, 15 bp, Homo sapiens
atataaagaatatat

SEQ ID NO: 3385322 - DNA, 13 bp, Homo sapiens
atataaagtatag

SEQ ID NO: 3385323 - DNA, 17 bp, Homo sapiens
atataaagtattcaaca

SEQ ID NO: 3385324 - DNA, 17 bp, Homo sapiens
atataaagtattctttt

SEQ ID NO: 3385325 - DNA, 20 bp, Homo sapiens
atataaagtattctttttct

SEQ ID NO: 3385326 - DNA, 16 bp, Homo sapiens
atataaatatatattc

SEQ ID NO: 3385327 - DNA, 13 bp, Homo sapiens
atataaatatttg

SEQ ID NO: 3385328 - DNA, 12 bp, Homo sapiens
atataaattctg

SEQ ID NO: 3385329 - DNA, 13 bp, Homo sapiens
atataaattctgt

SEQ ID NO: 3385330 - DNA, 14 bp, Homo sapiens
atataactgtacaa

SEQ ID NO: 3385331 - DNA, 18 bp, Homo sapiens
atataagaaggaaaaatt

SEQ ID NO: 3385332 - DNA, 18 bp, Homo sapiens
atataagtgtacatatgt

SEQ ID NO: 3385333 - DNA, 21 bp, Homo sapiens
atataagtttgaaggaaacag

SEQ ID NO: 3385334 - DNA, 18 bp, Homo sapiens
atataataaagctactga

SEQ ID NO: 3385335 - DNA, 16 bp, Homo sapiens
atataataatgatgat

SEQ ID NO: 3385336 - DNA, 13 bp, Homo sapiens
atataatatacta

SEQ ID NO: 3385337 - DNA, 16 bp, Homo sapiens
atataatggaagagaa

SEQ ID NO: 3385338 - DNA, 14 bp, Homo sapiens
atataattatcgga

SEQ ID NO: 3385339 - DNA, 22 bp, Homo sapiens
atataattgtaccaacctcata

SEQ ID NO: 3385340 - DNA, 16 bp, Homo sapiens
atatacagatgaaaat

SEQ ID NO: 3385341 - DNA, 17 bp, Homo sapiens
atatacagatgaaaatt

SEQ ID NO: 3385342 - DNA, 21 bp, Homo sapiens
atatacagatgaaaatttgag

SEQ ID NO: 3385343 - DNA, 13 bp, Homo sapiens
atatacagttatt

SEQ ID NO: 3385344 - DNA, 19 bp, Homo sapiens
atatacagttattttggat

SEQ ID NO: 3385345 - DNA, 13 bp, Homo sapiens
atatacatacact

SEQ ID NO: 3385346 - DNA, 15 bp, Homo sapiens
atatacatgtgtgta

SEQ ID NO: 3385347 - DNA, 12 bp, Homo sapiens
atatacattgtg

SEQ ID NO: 3385348 - DNA, 13 bp, Homo sapiens
atatacattgtgt

SEQ ID NO: 3385349 - DNA, 17 bp, Homo sapiens
atatacattgtgtgaaa

SEQ ID NO: 3385350 - DNA, 23 bp, Homo sapiens
atatacatttgttggtaactaat

SEQ ID NO: 3385351 - DNA, 14 bp, Homo sapiens
atataccaaattaa

SEQ ID NO: 3385352 - DNA, 19 bp, Homo sapiens
atataccaaattaaaaaaa

SEQ ID NO: 3385353 - DNA, 17 bp, Homo sapiens
atatacccccccatgca

SEQ ID NO: 3385354 - DNA, 15 bp, Homo sapiens
atatacctataatgt

SEQ ID NO: 3385355 - DNA, 17 bp, Homo sapiens
atatacctataatgtgt

SEQ ID NO: 3385356 - DNA, 22 bp, Homo sapiens
atatactaaaccaactctaata

SEQ ID NO: 3385357 - DNA, 17 bp, Homo sapiens
atatacttgactctaat

SEQ ID NO: 3385358 - DNA, 22 bp, Homo sapiens
atatacttgtggttttcaaatt

SEQ ID NO: 3385359 - DNA, 20 bp, Homo sapiens
atatactttgaaaggagatg

SEQ ID NO: 3385360 - DNA, 14 bp, Homo sapiens
atatactttgtgga

SEQ ID NO: 3385361 - DNA, 12 bp, Homo sapiens
atatacttttaa

SEQ ID NO: 3385362 - DNA, 18 bp, Homo sapiens
atatacttttaaattatg

SEQ ID NO: 3385363 - DNA, 11 bp, Homo sapiens
atatacttttt

SEQ ID NO: 3385364 - DNA, 20 bp, Homo sapiens
atatagaattgtagactgat

SEQ ID NO: 3385365 - DNA, 21 bp, Homo sapiens
atatagaattgtagactgatg

SEQ ID NO: 3385366 - DNA, 13 bp, Homo sapiens
atatagagatgtt

SEQ ID NO: 3385367 - DNA, 22 bp, Homo sapiens
atatagagatgtttttaaaagt

SEQ ID NO: 3385368 - DNA, 16 bp, Homo sapiens
atatagattagaaaaa

SEQ ID NO: 3385369 - DNA, 14 bp, Homo sapiens
atatagcattgata

SEQ ID NO: 3385370 - DNA, 14 bp, Homo sapiens
atatagcctgcctc

SEQ ID NO: 3385371 - DNA, 22 bp, Homo sapiens
atatagcctgcctcagtggcag

SEQ ID NO: 3385372 - DNA, 15 bp, Homo sapiens
atatagcctttaaat

SEQ ID NO: 3385373 - DNA, 18 bp, Homo sapiens
atatagcgttcccaacaa

SEQ ID NO: 3385374 - DNA, 18 bp, Homo sapiens
atatagcttgaaacatag

SEQ ID NO: 3385375 - DNA, 19 bp, Homo sapiens
atataggtctcttctccca

SEQ ID NO: 3385376 - DNA, 21 bp, Homo sapiens
atataggtctcttctcccaga

SEQ ID NO: 3385377 - DNA, 15 bp, Homo sapiens
atataggttgtgcaa

SEQ ID NO: 3385378 - DNA, 18 bp, Homo sapiens
atatagttttacttttaa

SEQ ID NO: 3385379 - DNA, 23 bp, Homo sapiens
atatagttttacttttaaactgt

SEQ ID NO: 3385380 - DNA, 17 bp, Homo sapiens
atatagtttttaccttt

SEQ ID NO: 3385381 - DNA, 10 bp, Homo sapiens
atatataaaa

SEQ ID NO: 3385382 - DNA, 17 bp, Homo sapiens
atatataaaatatctat

SEQ ID NO: 3385383 - DNA, 19 bp, Homo sapiens
atatataaagaatatatat

SEQ ID NO: 3385384 - DNA, 14 bp, Homo sapiens
atatataaatgtat

SEQ ID NO: 3385385 - DNA, 16 bp, Homo sapiens
atatataaatgtataa

SEQ ID NO: 3385386 - DNA, 16 bp, Homo sapiens
atatataagtgtacat

SEQ ID NO: 3385387 - DNA, 16 bp, Homo sapiens
atatatacagtaactt

SEQ ID NO: 3385388 - DNA, 21 bp, Homo sapiens
atatatacagtaactttatgt

SEQ ID NO: 3385389 - DNA, 10 bp, Homo sapiens
atatatacat

SEQ ID NO: 3385390 - DNA, 14 bp, Homo sapiens
atatatacatacac

SEQ ID NO: 3385391 - DNA, 19 bp, Homo sapiens
atatatacccccccatgca

SEQ ID NO: 3385392 - DNA, 13 bp, Homo sapiens
atatatagaatct

SEQ ID NO: 3385393 - DNA, 12 bp, Homo sapiens
atatatataaaa

SEQ ID NO: 3385394 - DNA, 13 bp, Homo sapiens
atatatataaata

SEQ ID NO: 3385395 - DNA, 15 bp, Homo sapiens
atatatataaatata

SEQ ID NO: 3385396 - DNA, 13 bp, Homo sapiens
atatatatacata

SEQ ID NO: 3385397 - DNA, 16 bp, Homo sapiens
atatatatacatatgt

SEQ ID NO: 3385398 - DNA, 13 bp, Homo sapiens
atatatatataaa

SEQ ID NO: 3385399 - DNA, 15 bp, Homo sapiens
atatatatataaagt

SEQ ID NO: 3385400 - DNA, 12 bp, Homo sapiens
atatatatatat

SEQ ID NO: 3385401 - DNA, 15 bp, Homo sapiens
atatatatgaataaa

SEQ ID NO: 3385402 - DNA, 19 bp, Homo sapiens
atatatatgcctttttcct

SEQ ID NO: 3385403 - DNA, 19 bp, Homo sapiens
atatatattataaatatat

SEQ ID NO: 3385404 - DNA, 23 bp, Homo sapiens
atatatattttttgcttttgtat

SEQ ID NO: 3385405 - DNA, 16 bp, Homo sapiens
atatatccccactact

SEQ ID NO: 3385406 - DNA, 18 bp, Homo sapiens
atatatctgcttcagtgg

SEQ ID NO: 3385407 - DNA, 12 bp, Homo sapiens
atatatgaataa

SEQ ID NO: 3385408 - DNA, 16 bp, Homo sapiens
atatatgcctttttcc

SEQ ID NO: 3385409 - DNA, 17 bp, Homo sapiens
atatatgcctttttcct

SEQ ID NO: 3385410 - DNA, 12 bp, Homo sapiens
atatatgtattt

SEQ ID NO: 3385411 - DNA, 12 bp, Homo sapiens
atatatgtgtat

SEQ ID NO: 3385412 - DNA, 18 bp, Homo sapiens
atatatgtgtatatatac

SEQ ID NO: 3385413 - DNA, 19 bp, Homo sapiens
atatatgtgtatatataca

SEQ ID NO: 3385414 - DNA, 20 bp, Homo sapiens
atatatgtgtatatatacat

SEQ ID NO: 3385415 - DNA, 15 bp, Homo sapiens
atatatgtgtatgta

SEQ ID NO: 3385416 - DNA, 17 bp, Homo sapiens
atatattattgtaagtt

SEQ ID NO: 3385417 - DNA, 19 bp, Homo sapiens
atatattattgtaagttgt

SEQ ID NO: 3385418 - DNA, 14 bp, Homo sapiens
atatattcttataa

SEQ ID NO: 3385419 - DNA, 13 bp, Homo sapiens
atatatttaagcc

SEQ ID NO: 3385420 - DNA, 15 bp, Homo sapiens
atatatttaatgata

SEQ ID NO: 3385421 - DNA, 12 bp, Homo sapiens
atatatttataa

SEQ ID NO: 3385422 - DNA, 16 bp, Homo sapiens
atatatttataactca

SEQ ID NO: 3385423 - DNA, 21 bp, Homo sapiens
atatatttataactcatcata

SEQ ID NO: 3385424 - DNA, 23 bp, Homo sapiens
atatatttataactcatcataaa

SEQ ID NO: 3385425 - DNA, 14 bp, Homo sapiens
atatatttatttaa

SEQ ID NO: 3385426 - DNA, 16 bp, Homo sapiens
atatatttatttaaag

SEQ ID NO: 3385427 - DNA, 19 bp, Homo sapiens
atatatttatttaaagcat

SEQ ID NO: 3385428 - DNA, 18 bp, Homo sapiens
atatatttattttattct

SEQ ID NO: 3385429 - DNA, 12 bp, Homo sapiens
atatatttctat

SEQ ID NO: 3385430 - DNA, 21 bp, Homo sapiens
atatatttgaatatcattaaa

SEQ ID NO: 3385431 - DNA, 16 bp, Homo sapiens
atatattttaaaaaca

SEQ ID NO: 3385432 - DNA, 19 bp, Homo sapiens
atatattttgtgtgaaatt

SEQ ID NO: 3385433 - DNA, 15 bp, Homo sapiens
atatatttttatatt

SEQ ID NO: 3385434 - DNA, 21 bp, Homo sapiens
atatatttttatatttagtta

SEQ ID NO: 3385435 - DNA, 14 bp, Homo sapiens
atatatttttcaca

SEQ ID NO: 3385436 - DNA, 13 bp, Homo sapiens
atatcaaagtatt

SEQ ID NO: 3385437 - DNA, 21 bp, Homo sapiens
atatcaacagatagttgtgtt

SEQ ID NO: 3385438 - DNA, 14 bp, Homo sapiens
atatcagaaaaggg

SEQ ID NO: 3385439 - DNA, 17 bp, Homo sapiens
atatcagaaaagggaag

SEQ ID NO: 3385440 - DNA, 16 bp, Homo sapiens
atatcagacaagcact

SEQ ID NO: 3385441 - DNA, 19 bp, Homo sapiens
atatcagacaagcactatt

SEQ ID NO: 3385442 - DNA, 13 bp, Homo sapiens
atatcagtttgct

SEQ ID NO: 3385443 - DNA, 14 bp, Homo sapiens
atatcatataaaca

SEQ ID NO: 3385444 - DNA, 14 bp, Homo sapiens
atatcatattggta

SEQ ID NO: 3385445 - DNA, 16 bp, Homo sapiens
atcacaatacagataa

SEQ ID NO: 3385446 - DNA, 21 bp, Homo sapiens
atcacacaagatttgactgta

SEQ ID NO: 3385447 - DNA, 18 bp, Homo sapiens
atcacacttctgtgagac

SEQ ID NO: 3385448 - DNA, 14 bp, Homo sapiens
atcacagagacatt

SEQ ID NO: 3385449 - DNA, 15 bp, Homo sapiens
atcacagagacattc

SEQ ID NO: 3385450 - DNA, 18 bp, Homo sapiens
atcacagagacattcctc

SEQ ID NO: 3385451 - DNA, 19 bp, Homo sapiens
atcacagcaatatttaaca

SEQ ID NO: 3385452 - DNA, 14 bp, Homo sapiens
atcacagcagcctc

SEQ ID NO: 3385453 - DNA, 13 bp, Homo sapiens
atcacagcctcca

SEQ ID NO: 3385454 - DNA, 17 bp, Homo sapiens
atcacagcctccagggc

SEQ ID NO: 3385455 - DNA, 16 bp, Homo sapiens
atcacagggccccaga

SEQ ID NO: 3385456 - DNA, 12 bp, Homo sapiens
atcacaggggcg

SEQ ID NO: 3385457 - DNA, 18 bp, Homo sapiens
atcacaggggcggggcag

SEQ ID NO: 3385458 - DNA, 18 bp, Homo sapiens
atcacagggttgggccca

SEQ ID NO: 3385459 - DNA, 19 bp, Homo sapiens
atcacagggttgggcccag

SEQ ID NO: 3385460 - DNA, 22 bp, Homo sapiens
atcacattatttgcatgttacc

SEQ ID NO: 3385461 - DNA, 18 bp, Homo sapiens
atcaccattatattttga

SEQ ID NO: 3385462 - DNA, 20 bp, Homo sapiens
atcaccccaaccccccaaaa

SEQ ID NO: 3385463 - DNA, 16 bp, Homo sapiens
atcaccctcttcctgt

SEQ ID NO: 3385464 - DNA, 14 bp, Homo sapiens
atcaccgctgggtg

SEQ ID NO: 3385465 - DNA, 14 bp, Homo sapiens
atcacctcaggcca

SEQ ID NO: 3385466 - DNA, 17 bp, Homo sapiens
atcacgacgctgcagag

SEQ ID NO: 3385467 - DNA, 12 bp, Homo sapiens
atcacgctcccc

SEQ ID NO: 3385468 - DNA, 14 bp, Homo sapiens
atcacgctttcctg

SEQ ID NO: 3385469 - DNA, 18 bp, Homo sapiens
atcacggctcactgcagc

SEQ ID NO: 3385470 - DNA, 19 bp, Homo sapiens
atcacggctcactgcagcc

SEQ ID NO: 3385471 - DNA, 19 bp, Homo sapiens
atcacggtggtaaagaaag

SEQ ID NO: 3385472 - DNA, 22 bp, Homo sapiens
atcacgtaccccactgggccag

SEQ ID NO: 3385473 - DNA, 14 bp, Homo sapiens
atcactaaacttta

SEQ ID NO: 3385474 - DNA, 16 bp, Homo sapiens
atcactaaactttatt

SEQ ID NO: 3385475 - DNA, 20 bp, Homo sapiens
atcactaaactttatttgta

SEQ ID NO: 3385476 - DNA, 21 bp, Homo sapiens
atcactaaactttatttgtaa

SEQ ID NO: 3385477 - DNA, 22 bp, Homo sapiens
atcactaaactttatttgtaaa

SEQ ID NO: 3385478 - DNA, 13 bp, Homo sapiens
atcactaacatta

SEQ ID NO: 3385479 - DNA, 16 bp, Homo sapiens
atcactaacattatat

SEQ ID NO: 3385480 - DNA, 15 bp, Homo sapiens
atcactatccatgca

SEQ ID NO: 3385481 - DNA, 12 bp, Homo sapiens
atcactccctgg

SEQ ID NO: 3385482 - DNA, 16 bp, Homo sapiens
atcactctaaaaaaca

SEQ ID NO: 3385483 - DNA, 17 bp, Homo sapiens
atcactctaaaaaacat

SEQ ID NO: 3385484 - DNA, 18 bp, Homo sapiens
atcactctaaaaaacatt

SEQ ID NO: 3385485 - DNA, 20 bp, Homo sapiens
atcactctaattaattgtaa

SEQ ID NO: 3385486 - DNA, 14 bp, Homo sapiens
atcactctgctgct

SEQ ID NO: 3385487 - DNA, 12 bp, Homo sapiens
atcactgaaaca

SEQ ID NO: 3385488 - DNA, 19 bp, Homo sapiens
atcactgaaacaaaaattg

SEQ ID NO: 3385489 - DNA, 24 bp, Homo sapiens
atcactgaaacaaaaattgtcttt

SEQ ID NO: 3385490 - DNA, 15 bp, Homo sapiens
atcactgcagcccag

SEQ ID NO: 3385491 - DNA, 12 bp, Homo sapiens
atcactggagcc

SEQ ID NO: 3385492 - DNA, 13 bp, Homo sapiens
atcactggagccc

SEQ ID NO: 3385493 - DNA, 16 bp, Homo sapiens
atcactggctggcctg

SEQ ID NO: 3385494 - DNA, 21 bp, Homo sapiens
atcactggctggcctgagcaa

SEQ ID NO: 3385495 - DNA, 15 bp, Homo sapiens
atcactgtttttaga

SEQ ID NO: 3385496 - DNA, 19 bp, Homo sapiens
atcacttgaggtcaggagt

SEQ ID NO: 3385497 - DNA, 21 bp, Homo sapiens
atcactttctcagttttcata

SEQ ID NO: 3385498 - DNA, 21 bp, Homo sapiens
atcactttgtctaactcagaa

SEQ ID NO: 3385499 - DNA, 15 bp, Homo sapiens
atcacttttcagtga

SEQ ID NO: 3385500 - DNA, 17 bp, Homo sapiens
atcactttttgaactaa

SEQ ID NO: 3385501 - DNA, 18 bp, Homo sapiens
atcagaacattcagctct

SEQ ID NO: 3385502 - DNA, 20 bp, Homo sapiens
atcagaacattcagctctgg

SEQ ID NO: 3385503 - DNA, 23 bp, Homo sapiens
atcagaagaccacaaaaattgac

SEQ ID NO: 3385504 - DNA, 17 bp, Homo sapiens
atcagaagataacttga

SEQ ID NO: 3385505 - DNA, 18 bp, Homo sapiens
atcagaagtcatcttgct

SEQ ID NO: 3385506 - DNA, 18 bp, Homo sapiens
atcagaagtttctcagct

SEQ ID NO: 3385507 - DNA, 22 bp, Homo sapiens
atcagaatagccacatttggaa

SEQ ID NO: 3385508 - DNA, 19 bp, Homo sapiens
atcagaatatcagaatatg

SEQ ID NO: 3385509 - DNA, 14 bp, Homo sapiens
atcagacaagcact

SEQ ID NO: 3385510 - DNA, 15 bp, Homo sapiens
atcagacctgtcttc

SEQ ID NO: 3385511 - DNA, 22 bp, Homo sapiens
atcagaccttggatcagatgaa

SEQ ID NO: 3385512 - DNA, 22 bp, Homo sapiens
atcagagacaaaatatttccca

SEQ ID NO: 3385513 - DNA, 16 bp, Homo sapiens
atcagagagcaaggca

SEQ ID NO: 3385514 - DNA, 16 bp, Homo sapiens
atcagagagtgtacat

SEQ ID NO: 3385515 - DNA, 14 bp, Homo sapiens
atcagagcaggacc

SEQ ID NO: 3385516 - DNA, 15 bp, Homo sapiens
atcagagcaggacct

SEQ ID NO: 3385517 - DNA, 17 bp, Homo sapiens
atcagagcgcacaggga

SEQ ID NO: 3385518 - DNA, 21 bp, Homo sapiens
atcagagctcttaatgttgct

SEQ ID NO: 3385519 - DNA, 15 bp, Homo sapiens
atcagaggcctataa

SEQ ID NO: 3385520 - DNA, 17 bp, Homo sapiens
atcagaggtgtacacta

SEQ ID NO: 3385521 - DNA, 18 bp, Homo sapiens
atcagaggtgtacactaa

SEQ ID NO: 3385522 - DNA, 20 bp, Homo sapiens
atcagaggtttgcttcctca

SEQ ID NO: 3385523 - DNA, 20 bp, Homo sapiens
atcagagtagaaataaaagt

SEQ ID NO: 3385524 - DNA, 21 bp, Homo sapiens
atcagagtagaaataaaagtg

SEQ ID NO: 3385525 - DNA, 15 bp, Homo sapiens
atcagagtgtacaaa

SEQ ID NO: 3385526 - DNA, 19 bp, Homo sapiens
atcagataagacatatctc

SEQ ID NO: 3385527 - DNA, 14 bp, Homo sapiens
atcagatacatcac

SEQ ID NO: 3385528 - DNA, 17 bp, Homo sapiens
atcagatacatcactgc

SEQ ID NO: 3385529 - DNA, 23 bp, Homo sapiens
atcagatcaagagttttggagat

SEQ ID NO: 3385530 - DNA, 23 bp, Homo sapiens
atcagatgaactcttagaaatga

SEQ ID NO: 3385531 - DNA, 20 bp, Homo sapiens
atcagatgctccaagattct

SEQ ID NO: 3385532 - DNA, 21 bp, Homo sapiens
atcagatggaaatattttgat

SEQ ID NO: 3385533 - DNA, 15 bp, Homo sapiens
atcagcactgaaaat

SEQ ID NO: 3385534 - DNA, 20 bp, Homo sapiens
atcagccagcccatggcccc

SEQ ID NO: 3385535 - DNA, 17 bp, Homo sapiens
atcagccccgctcctcc

SEQ ID NO: 3385536 - DNA, 23 bp, Homo sapiens
atcagccccgctcctcccctctt

SEQ ID NO: 3385537 - DNA, 18 bp, Homo sapiens
atcagctacttaagagaa

SEQ ID NO: 3385538 - DNA, 20 bp, Homo sapiens
atcagctacttaagagaaat

SEQ ID NO: 3385539 - DNA, 21 bp, Homo sapiens
atcagctacttaagagaaatg

SEQ ID NO: 3385540 - DNA, 15 bp, Homo sapiens
atcagctatttactg

SEQ ID NO: 3385541 - DNA, 21 bp, Homo sapiens
atcagctccttttccgttctg

SEQ ID NO: 3385542 - DNA, 16 bp, Homo sapiens
atcagctctcctggct

SEQ ID NO: 3385543 - DNA, 13 bp, Homo sapiens
atcagctgctact

SEQ ID NO: 3385544 - DNA, 16 bp, Homo sapiens
atcagctgtttgtcat

SEQ ID NO: 3385545 - DNA, 16 bp, Homo sapiens
atcagcttcttgcact

SEQ ID NO: 3385546 - DNA, 21 bp, Homo sapiens
atcaggaaatatatatgtgtg

SEQ ID NO: 3385547 - DNA, 16 bp, Homo sapiens
atcaggcactggtggc

SEQ ID NO: 3385548 - DNA, 15 bp, Homo sapiens
atcaggctatgtatg

SEQ ID NO: 3385549 - DNA, 15 bp, Homo sapiens
atcagggaccagctt

SEQ ID NO: 3385550 - DNA, 16 bp, Homo sapiens
atcagggaccagcttt

SEQ ID NO: 3385551 - DNA, 17 bp, Homo sapiens
atcagggaccagcttta

SEQ ID NO: 3385552 - DNA, 24 bp, Homo sapiens
atcagggcctggggcctgagagaa

SEQ ID NO: 3385553 - DNA, 17 bp, Homo sapiens
atcaggtaccaaggaaa

SEQ ID NO: 3385554 - DNA, 13 bp, Homo sapiens
atcaggtcaggga

SEQ ID NO: 3385555 - DNA, 21 bp, Homo sapiens
atcaggtcagggacttggaca

SEQ ID NO: 3385556 - DNA, 16 bp, Homo sapiens
atcaggtcctcagaga

SEQ ID NO: 3385557 - DNA, 19 bp, Homo sapiens
atcagtaagaaaaagaaga

SEQ ID NO: 3385558 - DNA, 16 bp, Homo sapiens
atcagtataaacaaag

SEQ ID NO: 3385559 - DNA, 17 bp, Homo sapiens
atcagtattaatactaa

SEQ ID NO: 3385560 - DNA, 23 bp, Homo sapiens
atcagtatttttttttaattttg

SEQ ID NO: 3385561 - DNA, 16 bp, Homo sapiens
atcagtcccctcccat

SEQ ID NO: 3385562 - DNA, 17 bp, Homo sapiens
atcagtcccctcccatc

SEQ ID NO: 3385563 - DNA, 22 bp, Homo sapiens
atcagtcccctcccatctggga

SEQ ID NO: 3385564 - DNA, 16 bp, Homo sapiens
atcagtccctatgtat

SEQ ID NO: 3385565 - DNA, 19 bp, Homo sapiens
atcagtgactgaaaccatt

SEQ ID NO: 3385566 - DNA, 16 bp, Homo sapiens
atcagtgatctatgtt

SEQ ID NO: 3385567 - DNA, 17 bp, Homo sapiens
atcagtgatctatgttt

SEQ ID NO: 3385568 - DNA, 19 bp, Homo sapiens
atcagtgatctatgtttgt

SEQ ID NO: 3385569 - DNA, 20 bp, Homo sapiens
atcagtgctctgcttttagt

SEQ ID NO: 3385570 - DNA, 20 bp, Homo sapiens
atctctactaccacaaggaa

SEQ ID NO: 3385571 - DNA, 21 bp, Homo sapiens
atctctactaccacaaggaaa

SEQ ID NO: 3385572 - DNA, 15 bp, Homo sapiens
atctctatttaatat

SEQ ID NO: 3385573 - DNA, 17 bp, Homo sapiens
atctctatttaatattt

SEQ ID NO: 3385574 - DNA, 18 bp, Homo sapiens
atctctatttaatattta

SEQ ID NO: 3385575 - DNA, 19 bp, Homo sapiens
atctctatttaatatttat

SEQ ID NO: 3385576 - DNA, 14 bp, Homo sapiens
atctctcaggagca

SEQ ID NO: 3385577 - DNA, 18 bp, Homo sapiens
atctctcaggagcacagg

SEQ ID NO: 3385578 - DNA, 15 bp, Homo sapiens
atctctctctgtgtc

SEQ ID NO: 3385579 - DNA, 13 bp, Homo sapiens
atctctctggggc

SEQ ID NO: 3385580 - DNA, 13 bp, Homo sapiens
atctctgaagcat

SEQ ID NO: 3385581 - DNA, 16 bp, Homo sapiens
atctctgaagcatgtt

SEQ ID NO: 3385582 - DNA, 17 bp, Homo sapiens
atctctgaagcatgttt

SEQ ID NO: 3385583 - DNA, 20 bp, Homo sapiens
atctctgaagcatgtttcat

SEQ ID NO: 3385584 - DNA, 11 bp, Homo sapiens
atctctgagac

SEQ ID NO: 3385585 - DNA, 16 bp, Homo sapiens
atctctgttatgtact

SEQ ID NO: 3385586 - DNA, 20 bp, Homo sapiens
atctctgttatgtactgtac

SEQ ID NO: 3385587 - DNA, 14 bp, Homo sapiens
atctcttattctaa

SEQ ID NO: 3385588 - DNA, 15 bp, Homo sapiens
atctcttattctaat

SEQ ID NO: 3385589 - DNA, 14 bp, Homo sapiens
atctcttcaggttc

SEQ ID NO: 3385590 - DNA, 24 bp, Homo sapiens
atctcttcattcaaactgcacttt

SEQ ID NO: 3385591 - DNA, 22 bp, Homo sapiens
atctcttgtgcttttttgattt

SEQ ID NO: 3385592 - DNA, 19 bp, Homo sapiens
atctctttcacattgtttg

SEQ ID NO: 3385593 - DNA, 12 bp, Homo sapiens
atctcttttata

SEQ ID NO: 3385594 - DNA, 20 bp, Homo sapiens
atctcttttatatttgtagg

SEQ ID NO: 3385595 - DNA, 13 bp, Homo sapiens
atctgaaattcta

SEQ ID NO: 3385596 - DNA, 13 bp, Homo sapiens
atctgaactctca

SEQ ID NO: 3385597 - DNA, 21 bp, Homo sapiens
atctgaagagctattatataa

SEQ ID NO: 3385598 - DNA, 21 bp, Homo sapiens
atctgaagaggcttctcctgt

SEQ ID NO: 3385599 - DNA, 23 bp, Homo sapiens
atctgaagagtatccttccttca

SEQ ID NO: 3385600 - DNA, 23 bp, Homo sapiens
atctgaagcttcactcactgtca

SEQ ID NO: 3385601 - DNA, 16 bp, Homo sapiens
atctgaatgaaaataa

SEQ ID NO: 3385602 - DNA, 19 bp, Homo sapiens
atctgaatgaaaataactg

SEQ ID NO: 3385603 - DNA, 18 bp, Homo sapiens
atctgaatgtaatttgtg

SEQ ID NO: 3385604 - DNA, 18 bp, Homo sapiens
atctgacatattatgcct

SEQ ID NO: 3385605 - DNA, 20 bp, Homo sapiens
atctgacatattatgcctga

SEQ ID NO: 3385606 - DNA, 17 bp, Homo sapiens
atctgactgccaagcca

SEQ ID NO: 3385607 - DNA, 15 bp, Homo sapiens
atctgagccagtgct

SEQ ID NO: 3385608 - DNA, 16 bp, Homo sapiens
atctgagggaggaggc

SEQ ID NO: 3385609 - DNA, 20 bp, Homo sapiens
atctgagggaggaggccacc

SEQ ID NO: 3385610 - DNA, 22 bp, Homo sapiens
atctgagggaggaggccacctc

SEQ ID NO: 3385611 - DNA, 16 bp, Homo sapiens
atctgaggttggattt

SEQ ID NO: 3385612 - DNA, 21 bp, Homo sapiens
atctgaggttggatttgctca

SEQ ID NO: 3385613 - DNA, 13 bp, Homo sapiens
atctgataagcaa

SEQ ID NO: 3385614 - DNA, 17 bp, Homo sapiens
atctgatctgagtgaga

SEQ ID NO: 3385615 - DNA, 17 bp, Homo sapiens
atctgatggtgagctgg

SEQ ID NO: 3385616 - DNA, 13 bp, Homo sapiens
atctgatgtttca

SEQ ID NO: 3385617 - DNA, 20 bp, Homo sapiens
atctgcaaacaatgaagaat

SEQ ID NO: 3385618 - DNA, 18 bp, Homo sapiens
atctgcaccccttctctc

SEQ ID NO: 3385619 - DNA, 22 bp, Homo sapiens
atctgcaccccttctctcctcc

SEQ ID NO: 3385620 - DNA, 23 bp, Homo sapiens
atctgcaccccttctctcctccc

SEQ ID NO: 3385621 - DNA, 20 bp, Homo sapiens
atctgcagggggtgtgtctg

SEQ ID NO: 3385622 - DNA, 14 bp, Homo sapiens
atctgcattcctga

SEQ ID NO: 3385623 - DNA, 23 bp, Homo sapiens
atctgcattttcaccccaccctt

SEQ ID NO: 3385624 - DNA, 15 bp, Homo sapiens
atctgccacaaaaac

SEQ ID NO: 3385625 - DNA, 13 bp, Homo sapiens
atctgccagacct

SEQ ID NO: 3385626 - DNA, 15 bp, Homo sapiens
atctgcccaggggtg

SEQ ID NO: 3385627 - DNA, 16 bp, Homo sapiens
atctgcccctccccca

SEQ ID NO: 3385628 - DNA, 17 bp, Homo sapiens
atctgcccctcccccaa

SEQ ID NO: 3385629 - DNA, 16 bp, Homo sapiens
atctgccgcctcagct

SEQ ID NO: 3385630 - DNA, 16 bp, Homo sapiens
atctgcctggcctggc

SEQ ID NO: 3385631 - DNA, 13 bp, Homo sapiens
atctgcctgggcc

SEQ ID NO: 3385632 - DNA, 19 bp, Homo sapiens
atctgcctgggcctgtgca

SEQ ID NO: 3385633 - DNA, 20 bp, Homo sapiens
atctgcctgggcctgtgcag

SEQ ID NO: 3385634 - DNA, 23 bp, Homo sapiens
atctgcctgggcctgtgcagcag

SEQ ID NO: 3385635 - DNA, 21 bp, Homo sapiens
atctgctgcatagctctattt

SEQ ID NO: 3385636 - DNA, 14 bp, Homo sapiens
atctgctgttgcca

SEQ ID NO: 3385637 - DNA, 22 bp, Homo sapiens
atctgctgttgccatagcccca

SEQ ID NO: 3385638 - DNA, 16 bp, Homo sapiens
atctgcttttattaaa

SEQ ID NO: 3385639 - DNA, 14 bp, Homo sapiens
atctggacagaaca

SEQ ID NO: 3385640 - DNA, 20 bp, Homo sapiens
atctggagaccagggagcct

SEQ ID NO: 3385641 - DNA, 21 bp, Homo sapiens
atctggagaccagggagcctt

SEQ ID NO: 3385642 - DNA, 20 bp, Homo sapiens
atctggatgcctcattatgt

SEQ ID NO: 3385643 - DNA, 13 bp, Homo sapiens
atctggcctggcc

SEQ ID NO: 3385644 - DNA, 17 bp, Homo sapiens
atctggctcctttacaa

SEQ ID NO: 3385645 - DNA, 21 bp, Homo sapiens
atctggctgcagttttgctat

SEQ ID NO: 3385646 - DNA, 17 bp, Homo sapiens
atctggcttagtgccac

SEQ ID NO: 3385647 - DNA, 17 bp, Homo sapiens
atctgggattattcttt

SEQ ID NO: 3385648 - DNA, 14 bp, Homo sapiens
atctgggcctgggc

SEQ ID NO: 3385649 - DNA, 13 bp, Homo sapiens
atctggggtgggg

SEQ ID NO: 3385650 - DNA, 17 bp, Homo sapiens
atctggggtggggtggg

SEQ ID NO: 3385651 - DNA, 18 bp, Homo sapiens
atctgggtccttgcaccc

SEQ ID NO: 3385652 - DNA, 15 bp, Homo sapiens
atctgggtgactgag

SEQ ID NO: 3385653 - DNA, 17 bp, Homo sapiens
atctggtcccttgcagc

SEQ ID NO: 3385654 - DNA, 18 bp, Homo sapiens
atctggtcttgttagaaa

SEQ ID NO: 3385655 - DNA, 14 bp, Homo sapiens
atctggtgatctcc

SEQ ID NO: 3385656 - DNA, 13 bp, Homo sapiens
atctggtgcctcc

SEQ ID NO: 3385657 - DNA, 14 bp, Homo sapiens
atctggttttgcta

SEQ ID NO: 3385658 - DNA, 15 bp, Homo sapiens
atctggttttgctat

SEQ ID NO: 3385659 - DNA, 22 bp, Homo sapiens
atctgtaaactgtgtattccaa

SEQ ID NO: 3385660 - DNA, 17 bp, Homo sapiens
atctgtaatgatactga

SEQ ID NO: 3385661 - DNA, 15 bp, Homo sapiens
atctgtacattttgt

SEQ ID NO: 3385662 - DNA, 20 bp, Homo sapiens
atctgtacattttgttgtaa

SEQ ID NO: 3385663 - DNA, 21 bp, Homo sapiens
atctgtacattttgttgtaaa

SEQ ID NO: 3385664 - DNA, 18 bp, Homo sapiens
atctgtagggctggacct

SEQ ID NO: 3385665 - DNA, 13 bp, Homo sapiens
atctgtagtaatt

SEQ ID NO: 3385666 - DNA, 21 bp, Homo sapiens
atctgtagtaatttattgtct

SEQ ID NO: 3385667 - DNA, 14 bp, Homo sapiens
atctgtatctctct

SEQ ID NO: 3385668 - DNA, 18 bp, Homo sapiens
atctgtatttattatttg

SEQ ID NO: 3385669 - DNA, 20 bp, Homo sapiens
atctgtcaaaacactgtgga

SEQ ID NO: 3385670 - DNA, 19 bp, Homo sapiens
atctgtcatctctctgggg

SEQ ID NO: 3385671 - DNA, 19 bp, Homo sapiens
atctgtcattatattctaa

SEQ ID NO: 3385672 - DNA, 12 bp, Homo sapiens
atctgtcatttg

SEQ ID NO: 3385673 - DNA, 17 bp, Homo sapiens
atctgtcatttgagcag

SEQ ID NO: 3385674 - DNA, 21 bp, Homo sapiens
atctgtgaagtagttctgttt

SEQ ID NO: 3385675 - DNA, 18 bp, Homo sapiens
atctgtgccatagaacaa

SEQ ID NO: 3385676 - DNA, 13 bp, Homo sapiens
atctgtgccccat

SEQ ID NO: 3385677 - DNA, 23 bp, Homo sapiens
atctgtgccccatgcctgtccag

SEQ ID NO: 3385678 - DNA, 17 bp, Homo sapiens
atctgtgcgtgaaacac

SEQ ID NO: 3385679 - DNA, 19 bp, Homo sapiens
atctgtgggcatggtcaaa

SEQ ID NO: 3385680 - DNA, 15 bp, Homo sapiens
atctgtgtgaaaatg

SEQ ID NO: 3385681 - DNA, 17 bp, Homo sapiens
atctgtgtgaaaatggg

SEQ ID NO: 3385682 - DNA, 20 bp, Homo sapiens
atctgtgtgaaactttcatt

SEQ ID NO: 3385683 - DNA, 18 bp, Homo sapiens
atctgttcccctgtcctg

SEQ ID NO: 3385684 - DNA, 21 bp, Homo sapiens
atctgttcccctgtcctgtga

SEQ ID NO: 3385685 - DNA, 20 bp, Homo sapiens
atctgttctgggctctttcc

SEQ ID NO: 3385686 - DNA, 15 bp, Homo sapiens
atctgttgttccaaa

SEQ ID NO: 3385687 - DNA, 16 bp, Homo sapiens
atctgttgttccaaat

SEQ ID NO: 3385688 - DNA, 22 bp, Homo sapiens
atctgttgttccaaatgtgtat

SEQ ID NO: 3385689 - DNA, 18 bp, Homo sapiens
atctgttttgaaggcaaa

SEQ ID NO: 3385690 - DNA, 19 bp, Homo sapiens
atcttaaaaagttgttcaa

SEQ ID NO: 3385691 - DNA, 16 bp, Homo sapiens
atcttaaacaatgtat

SEQ ID NO: 3385692 - DNA, 23 bp, Homo sapiens
atcttaaagaaacagctttcaag

SEQ ID NO: 3385693 - DNA, 17 bp, Homo sapiens
atcttaaagatcgtgta

SEQ ID NO: 3385694 - DNA, 15 bp, Homo sapiens
atcttaatgttactc

SEQ ID NO: 3385695 - DNA, 18 bp, Homo sapiens
atcttaattctttgttct

SEQ ID NO: 3385696 - DNA, 18 bp, Homo sapiens
atgatgtccagaagaata

SEQ ID NO: 3385697 - DNA, 15 bp, Homo sapiens
atgatgtgttgtgat

SEQ ID NO: 3385698 - DNA, 14 bp, Homo sapiens
atgatgttttccct

SEQ ID NO: 3385699 - DNA, 18 bp, Homo sapiens
atgattaaataagattct

SEQ ID NO: 3385700 - DNA, 19 bp, Homo sapiens
atgattaaataagattcta

SEQ ID NO: 3385701 - DNA, 24 bp, Homo sapiens
atgattaaataagattctaacggt

SEQ ID NO: 3385702 - DNA, 13 bp, Homo sapiens
atgattaatcaaa

SEQ ID NO: 3385703 - DNA, 15 bp, Homo sapiens
atgattaatcaaagg

SEQ ID NO: 3385704 - DNA, 17 bp, Homo sapiens
atgattaatgtgtattt

SEQ ID NO: 3385705 - DNA, 22 bp, Homo sapiens
atgattactggcctttttcatt

SEQ ID NO: 3385706 - DNA, 22 bp, Homo sapiens
atgattagaaattacctgtgga

SEQ ID NO: 3385707 - DNA, 21 bp, Homo sapiens
atgattagttaaaaaaagaaa

SEQ ID NO: 3385708 - DNA, 17 bp, Homo sapiens
atgattatgccactgct

SEQ ID NO: 3385709 - DNA, 17 bp, Homo sapiens
atgattatttgtattta

SEQ ID NO: 3385710 - DNA, 18 bp, Homo sapiens
atgattattttcattaca

SEQ ID NO: 3385711 - DNA, 20 bp, Homo sapiens
atgattcactatttaaacta

SEQ ID NO: 3385712 - DNA, 15 bp, Homo sapiens
atgattcatgttata

SEQ ID NO: 3385713 - DNA, 22 bp, Homo sapiens
atgattccaatctctgttctgt

SEQ ID NO: 3385714 - DNA, 21 bp, Homo sapiens
atgattccttgagcattttat

SEQ ID NO: 3385715 - DNA, 23 bp, Homo sapiens
atgattctaatttttaagcaaaa

SEQ ID NO: 3385716 - DNA, 14 bp, Homo sapiens
atgattctctgagt

SEQ ID NO: 3385717 - DNA, 19 bp, Homo sapiens
atgattggaatattacaat

SEQ ID NO: 3385718 - DNA, 21 bp, Homo sapiens
atgattggattattcatttaa

SEQ ID NO: 3385719 - DNA, 15 bp, Homo sapiens
atgattgtaaaatag

SEQ ID NO: 3385720 - DNA, 18 bp, Homo sapiens
atgattgtaaaatagctt

SEQ ID NO: 3385721 - DNA, 19 bp, Homo sapiens
atgatttaataaaataatt

SEQ ID NO: 3385722 - DNA, 20 bp, Homo sapiens
atgatttataaacagacaat

SEQ ID NO: 3385723 - DNA, 14 bp, Homo sapiens
atgatttatagttt

SEQ ID NO: 3385724 - DNA, 18 bp, Homo sapiens
atgatttcactagaaaag

SEQ ID NO: 3385725 - DNA, 15 bp, Homo sapiens
atgatttcatattga

SEQ ID NO: 3385726 - DNA, 21 bp, Homo sapiens
atgatttcatcttctggaata

SEQ ID NO: 3385727 - DNA, 22 bp, Homo sapiens
atgatttcatcttctggaatat

SEQ ID NO: 3385728 - DNA, 13 bp, Homo sapiens
atgatttccttga

SEQ ID NO: 3385729 - DNA, 17 bp, Homo sapiens
atgatttccttgaatgt

SEQ ID NO: 3385730 - DNA, 18 bp, Homo sapiens
atgatttccttgaatgtg

SEQ ID NO: 3385731 - DNA, 20 bp, Homo sapiens
atgatttccttgaatgtggc

SEQ ID NO: 3385732 - DNA, 13 bp, Homo sapiens
atgatttggggga

SEQ ID NO: 3385733 - DNA, 15 bp, Homo sapiens
atgatttgttttgaa

SEQ ID NO: 3385734 - DNA, 18 bp, Homo sapiens
atgattttgcaaaatgag

SEQ ID NO: 3385735 - DNA, 16 bp, Homo sapiens
atgatttttttttcca

SEQ ID NO: 3385736 - DNA, 17 bp, Homo sapiens
atgcaaaattgttttca

SEQ ID NO: 3385737 - DNA, 15 bp, Homo sapiens
atgcaaacaagaaac

SEQ ID NO: 3385738 - DNA, 16 bp, Homo sapiens
atgcaaacaagaaacg

SEQ ID NO: 3385739 - DNA, 17 bp, Homo sapiens
atgcaaagtacaatgtg

SEQ ID NO: 3385740 - DNA, 20 bp, Homo sapiens
atgcaaatgagctctgaaat

SEQ ID NO: 3385741 - DNA, 23 bp, Homo sapiens
atgcaaatgagctctgaaatctt

SEQ ID NO: 3385742 - DNA, 19 bp, Homo sapiens
atgcaacaaatatttatat

SEQ ID NO: 3385743 - DNA, 13 bp, Homo sapiens
atgcaacttttaa

SEQ ID NO: 3385744 - DNA, 14 bp, Homo sapiens
atgcaacttttaat

SEQ ID NO: 3385745 - DNA, 20 bp, Homo sapiens
atgcaacttttaattactgt

SEQ ID NO: 3385746 - DNA, 15 bp, Homo sapiens
atgcaagcagctttt

SEQ ID NO: 3385747 - DNA, 14 bp, Homo sapiens
atgcaaggaccagg

SEQ ID NO: 3385748 - DNA, 15 bp, Homo sapiens
atgcaaggaccagga

SEQ ID NO: 3385749 - DNA, 21 bp, Homo sapiens
atgcaaggcactgtactaggc

SEQ ID NO: 3385750 - DNA, 13 bp, Homo sapiens
atgcaagtctgtg

SEQ ID NO: 3385751 - DNA, 17 bp, Homo sapiens
atgcaagtctgtgagtg

SEQ ID NO: 3385752 - DNA, 18 bp, Homo sapiens
atgcaataaaatttaaaa

SEQ ID NO: 3385753 - DNA, 18 bp, Homo sapiens
atgcaatatatccccact

SEQ ID NO: 3385754 - DNA, 21 bp, Homo sapiens
atgcaatatatccccactact

SEQ ID NO: 3385755 - DNA, 13 bp, Homo sapiens
atgcaatctcttt

SEQ ID NO: 3385756 - DNA, 19 bp, Homo sapiens
atgcaatgacatcttcaaa

SEQ ID NO: 3385757 - DNA, 16 bp, Homo sapiens
atgcaatgtgctactg

SEQ ID NO: 3385758 - DNA, 18 bp, Homo sapiens
atgcaatgtgctactgat

SEQ ID NO: 3385759 - DNA, 15 bp, Homo sapiens
atgcacaaagtgtat

SEQ ID NO: 3385760 - DNA, 18 bp, Homo sapiens
atgcacaaattgaaaaca

SEQ ID NO: 3385761 - DNA, 22 bp, Homo sapiens
atgcacagatatactttgtgga

SEQ ID NO: 3385762 - DNA, 12 bp, Homo sapiens
atgcacagctgt

SEQ ID NO: 3385763 - DNA, 21 bp, Homo sapiens
atgcacatccattcccaagaa

SEQ ID NO: 3385764 - DNA, 14 bp, Homo sapiens
atgcacatccctgg

SEQ ID NO: 3385765 - DNA, 13 bp, Homo sapiens
atgcacatttctg

SEQ ID NO: 3385766 - DNA, 15 bp, Homo sapiens
atgcacatttctgga

SEQ ID NO: 3385767 - DNA, 16 bp, Homo sapiens
atgcacatttctggat

SEQ ID NO: 3385768 - DNA, 11 bp, Homo sapiens
atgcaccaaac

SEQ ID NO: 3385769 - DNA, 18 bp, Homo sapiens
atgcaccaccaagccaag

SEQ ID NO: 3385770 - DNA, 14 bp, Homo sapiens
atgcaccagccctt

SEQ ID NO: 3385771 - DNA, 22 bp, Homo sapiens
atgcaccagcccttagcaggga

SEQ ID NO: 3385772 - DNA, 22 bp, Homo sapiens
atgcaccctccctcctgccgct

SEQ ID NO: 3385773 - DNA, 19 bp, Homo sapiens
atgcacggtgaggccgggc

SEQ ID NO: 3385774 - DNA, 16 bp, Homo sapiens
atgcactgatgttgtg

SEQ ID NO: 3385775 - DNA, 17 bp, Homo sapiens
atgcactgtttttaatc

SEQ ID NO: 3385776 - DNA, 11 bp, Homo sapiens
atgcagaaata

SEQ ID NO: 3385777 - DNA, 20 bp, Homo sapiens
atgcagaaatagacaaaaag

SEQ ID NO: 3385778 - DNA, 21 bp, Homo sapiens
atgcagaagcatattttgctg

SEQ ID NO: 3385779 - DNA, 20 bp, Homo sapiens
atgcagaatgtttttaaaat

SEQ ID NO: 3385780 - DNA, 15 bp, Homo sapiens
atgcagaatttgatt

SEQ ID NO: 3385781 - DNA, 20 bp, Homo sapiens
atgcagagagccattttgtg

SEQ ID NO: 3385782 - DNA, 23 bp, Homo sapiens
atgcagagagccattttgtgaat

SEQ ID NO: 3385783 - DNA, 23 bp, Homo sapiens
atgcagagcgccgtgagttctca

SEQ ID NO: 3385784 - DNA, 22 bp, Homo sapiens
atgcagaggaggtgagagtggg

SEQ ID NO: 3385785 - DNA, 19 bp, Homo sapiens
atgcagattcctgggcctg

SEQ ID NO: 3385786 - DNA, 20 bp, Homo sapiens
atgcagattcctgggcctgt

SEQ ID NO: 3385787 - DNA, 22 bp, Homo sapiens
atgcagattcctgggcctgtcc

SEQ ID NO: 3385788 - DNA, 16 bp, Homo sapiens
atgcagcaaggccctg

SEQ ID NO: 3385789 - DNA, 19 bp, Homo sapiens
atgcagcaaggccctgctg

SEQ ID NO: 3385790 - DNA, 21 bp, Homo sapiens
atgcagcaaggccctgctgcc

SEQ ID NO: 3385791 - DNA, 16 bp, Homo sapiens
atgcagccttggggca

SEQ ID NO: 3385792 - DNA, 18 bp, Homo sapiens
atgcagccttggggcatt

SEQ ID NO: 3385793 - DNA, 15 bp, Homo sapiens
atgcagctgtggcag

SEQ ID NO: 3385794 - DNA, 15 bp, Homo sapiens
atgcagctttgcaaa

SEQ ID NO: 3385795 - DNA, 17 bp, Homo sapiens
atgcaggaaggaaaact

SEQ ID NO: 3385796 - DNA, 15 bp, Homo sapiens
atgcaggacaggagg

SEQ ID NO: 3385797 - DNA, 17 bp, Homo sapiens
atgcagggaagagggca

SEQ ID NO: 3385798 - DNA, 16 bp, Homo sapiens
atgcaggggtcagtgc

SEQ ID NO: 3385799 - DNA, 16 bp, Homo sapiens
atgcagtaaattatct

SEQ ID NO: 3385800 - DNA, 23 bp, Homo sapiens
atgcagtcacttattgtccaggt

SEQ ID NO: 3385801 - DNA, 18 bp, Homo sapiens
atgcagttcattattttg

SEQ ID NO: 3385802 - DNA, 13 bp, Homo sapiens
atgcataaataaa

SEQ ID NO: 3385803 - DNA, 14 bp, Homo sapiens
atgcataaataaat

SEQ ID NO: 3385804 - DNA, 16 bp, Homo sapiens
atgcataaatatgcag

SEQ ID NO: 3385805 - DNA, 14 bp, Homo sapiens
atgcatacaagttt

SEQ ID NO: 3385806 - DNA, 18 bp, Homo sapiens
atgcatatcctgagccat

SEQ ID NO: 3385807 - DNA, 22 bp, Homo sapiens
atgcatcccaccttgccaaagc

SEQ ID NO: 3385808 - DNA, 16 bp, Homo sapiens
atgcatcgggaaagaa

SEQ ID NO: 3385809 - DNA, 19 bp, Homo sapiens
atgcatctggcccaggaat

SEQ ID NO: 3385810 - DNA, 23 bp, Homo sapiens
atgcatggagggctgccctgtac

SEQ ID NO: 3385811 - DNA, 17 bp, Homo sapiens
atgcatgtcctgtaaag

SEQ ID NO: 3385812 - DNA, 23 bp, Homo sapiens
atgcatgtggtttggttcctctc

SEQ ID NO: 3385813 - DNA, 13 bp, Homo sapiens
atgcattattaaa

SEQ ID NO: 3385814 - DNA, 17 bp, Homo sapiens
atgcattcaaaatataa

SEQ ID NO: 3385815 - DNA, 22 bp, Homo sapiens
atgcattcacatttagaaaagt

SEQ ID NO: 3385816 - DNA, 14 bp, Homo sapiens
atgcattcttctct

SEQ ID NO: 3385817 - DNA, 19 bp, Homo sapiens
atgcattcttctctgttgt

SEQ ID NO: 3385818 - DNA, 15 bp, Homo sapiens
atgcattgttgaggt

SEQ ID NO: 3385819 - DNA, 16 bp, Homo sapiens
atgcattgttgaggtg

SEQ ID NO: 3385820 - DNA, 12 bp, Homo sapiens
atgcattgttgg

SEQ ID NO: 3385821 - DNA, 22 bp, Homo sapiens
atgggattggtgggctgattta

SEQ ID NO: 3385822 - DNA, 20 bp, Homo sapiens
atgggcaaagcttgtcaaag

SEQ ID NO: 3385823 - DNA, 16 bp, Homo sapiens
atgggcattgacaaat

SEQ ID NO: 3385824 - DNA, 22 bp, Homo sapiens
atgggccccgccttcctgggca

SEQ ID NO: 3385825 - DNA, 15 bp, Homo sapiens
atgggcctcctgtgt

SEQ ID NO: 3385826 - DNA, 17 bp, Homo sapiens
atgggcctcctgtgtgt

SEQ ID NO: 3385827 - DNA, 21 bp, Homo sapiens
atgggcctgcccaatgctttg

SEQ ID NO: 3385828 - DNA, 12 bp, Homo sapiens
atgggcctgggc

SEQ ID NO: 3385829 - DNA, 13 bp, Homo sapiens
atgggcctgggcc

SEQ ID NO: 3385830 - DNA, 21 bp, Homo sapiens
atgggcctttaagaaccttaa

SEQ ID NO: 3385831 - DNA, 17 bp, Homo sapiens
atgggcgcaggcccagt

SEQ ID NO: 3385832 - DNA, 15 bp, Homo sapiens
atgggcttcactgta

SEQ ID NO: 3385833 - DNA, 18 bp, Homo sapiens
atgggcttggacttcctg

SEQ ID NO: 3385834 - DNA, 19 bp, Homo sapiens
atgggcttggacttcctgg

SEQ ID NO: 3385835 - DNA, 22 bp, Homo sapiens
atgggcttggacttcctggggc

SEQ ID NO: 3385836 - DNA, 22 bp, Homo sapiens
atggggcctccctccttgggtc

SEQ ID NO: 3385837 - DNA, 19 bp, Homo sapiens
atggggggctgatggctgc

SEQ ID NO: 3385838 - DNA, 16 bp, Homo sapiens
atgggggtagcagctg

SEQ ID NO: 3385839 - DNA, 19 bp, Homo sapiens
atgggtcccttgaaggaag

SEQ ID NO: 3385840 - DNA, 16 bp, Homo sapiens
atgggtctgatattaa

SEQ ID NO: 3385841 - DNA, 20 bp, Homo sapiens
atgggtgggggctcctggtg

SEQ ID NO: 3385842 - DNA, 23 bp, Homo sapiens
atgggtgggggctcctggtggcc

SEQ ID NO: 3385843 - DNA, 21 bp, Homo sapiens
atgggtgttgtatggggaggc

SEQ ID NO: 3385844 - DNA, 23 bp, Homo sapiens
atggtaaaagttacttattctag

SEQ ID NO: 3385845 - DNA, 13 bp, Homo sapiens
atggtaacagatt

SEQ ID NO: 3385846 - DNA, 22 bp, Homo sapiens
atggtaagactgtaattaagta

SEQ ID NO: 3385847 - DNA, 15 bp, Homo sapiens
atggtaagagaaaag

SEQ ID NO: 3385848 - DNA, 23 bp, Homo sapiens
atggtaatcagttttgtataact

SEQ ID NO: 3385849 - DNA, 17 bp, Homo sapiens
atggtaatctacagctc

SEQ ID NO: 3385850 - DNA, 19 bp, Homo sapiens
atggtacatttatcactga

SEQ ID NO: 3385851 - DNA, 14 bp, Homo sapiens
atggtacccccttc

SEQ ID NO: 3385852 - DNA, 17 bp, Homo sapiens
atggtacccccttctgg

SEQ ID NO: 3385853 - DNA, 15 bp, Homo sapiens
atggtatcctactga

SEQ ID NO: 3385854 - DNA, 18 bp, Homo sapiens
atggtatcctactgagca

SEQ ID NO: 3385855 - DNA, 16 bp, Homo sapiens
atggtatgctggccag

SEQ ID NO: 3385856 - DNA, 12 bp, Homo sapiens
atggtcagctcc

SEQ ID NO: 3385857 - DNA, 13 bp, Homo sapiens
atggtcagctccc

SEQ ID NO: 3385858 - DNA, 20 bp, Homo sapiens
atggtcagctcccttctctg

SEQ ID NO: 3385859 - DNA, 20 bp, Homo sapiens
atggtcagtgtggagagggg

SEQ ID NO: 3385860 - DNA, 19 bp, Homo sapiens
atggtccaattagtttcct

SEQ ID NO: 3385861 - DNA, 20 bp, Homo sapiens
atggtccaattagtttcctt

SEQ ID NO: 3385862 - DNA, 20 bp, Homo sapiens
atggtcccatccaggcagtc

SEQ ID NO: 3385863 - DNA, 14 bp, Homo sapiens
atggtcctggggct

SEQ ID NO: 3385864 - DNA, 14 bp, Homo sapiens
atggtctcagaaac

SEQ ID NO: 3385865 - DNA, 18 bp, Homo sapiens
atggtctcagaaaccaaa

SEQ ID NO: 3385866 - DNA, 12 bp, Homo sapiens
atggtcttgagc

SEQ ID NO: 3385867 - DNA, 12 bp, Homo sapiens
atggtgaaaatg

SEQ ID NO: 3385868 - DNA, 14 bp, Homo sapiens
atggtgaaaatgta

SEQ ID NO: 3385869 - DNA, 19 bp, Homo sapiens
atggtgaaaccccgtctct

SEQ ID NO: 3385870 - DNA, 14 bp, Homo sapiens
atggtgaagtaaca

SEQ ID NO: 3385871 - DNA, 19 bp, Homo sapiens
atggtgacagtctccccca

SEQ ID NO: 3385872 - DNA, 16 bp, Homo sapiens
atggtgatcctctatt

SEQ ID NO: 3385873 - DNA, 18 bp, Homo sapiens
atggtgcagagaagctgg

SEQ ID NO: 3385874 - DNA, 18 bp, Homo sapiens
atggtgcattgtatagat

SEQ ID NO: 3385875 - DNA, 18 bp, Homo sapiens
atggtgcctgagaggcag

SEQ ID NO: 3385876 - DNA, 20 bp, Homo sapiens
atggtgcctgagaggcaggc

SEQ ID NO: 3385877 - DNA, 17 bp, Homo sapiens
atggtgctgcagatttg

SEQ ID NO: 3385878 - DNA, 16 bp, Homo sapiens
atggtggcgcgcacct

SEQ ID NO: 3385879 - DNA, 14 bp, Homo sapiens
atggtgtaataaga

SEQ ID NO: 3385880 - DNA, 18 bp, Homo sapiens
atggtgtagaacactaat

SEQ ID NO: 3385881 - DNA, 18 bp, Homo sapiens
atggtgtgaaagtcagat

SEQ ID NO: 3385882 - DNA, 22 bp, Homo sapiens
atggtgtgaaagtcagatgccc

SEQ ID NO: 3385883 - DNA, 18 bp, Homo sapiens
atggtgtgaacccgggag

SEQ ID NO: 3385884 - DNA, 17 bp, Homo sapiens
atggtgttttcattccc

SEQ ID NO: 3385885 - DNA, 16 bp, Homo sapiens
atggttaataaaactg

SEQ ID NO: 3385886 - DNA, 23 bp, Homo sapiens
atggttacactgttagaacacta

SEQ ID NO: 3385887 - DNA, 15 bp, Homo sapiens
atggttcaagattgt

SEQ ID NO: 3385888 - DNA, 22 bp, Homo sapiens
atggttccatgcctgagggtgg

SEQ ID NO: 3385889 - DNA, 13 bp, Homo sapiens
atggttctgtgac

SEQ ID NO: 3385890 - DNA, 16 bp, Homo sapiens
atggttgagttacatt

SEQ ID NO: 3385891 - DNA, 22 bp, Homo sapiens
atggttgatggaaaataaacat

SEQ ID NO: 3385892 - DNA, 13 bp, Homo sapiens
atggttgccaccc

SEQ ID NO: 3385893 - DNA, 15 bp, Homo sapiens
atggttgccacccca

SEQ ID NO: 3385894 - DNA, 17 bp, Homo sapiens
atggttgccaccccaac

SEQ ID NO: 3385895 - DNA, 23 bp, Homo sapiens
atggttgccaccccaacccaata

SEQ ID NO: 3385896 - DNA, 17 bp, Homo sapiens
atggttgccttaaagaa

SEQ ID NO: 3385897 - DNA, 21 bp, Homo sapiens
atggtttattttgtattgtgg

SEQ ID NO: 3385898 - DNA, 18 bp, Homo sapiens
atggtttcaagttattca

SEQ ID NO: 3385899 - DNA, 20 bp, Homo sapiens
atggtttctgaaaatgttta

SEQ ID NO: 3385900 - DNA, 12 bp, Homo sapiens
atggtttggttt

SEQ ID NO: 3385901 - DNA, 17 bp, Homo sapiens
atgtaaaaaacaaaaac

SEQ ID NO: 3385902 - DNA, 15 bp, Homo sapiens
atgtaaaactcgctt

SEQ ID NO: 3385903 - DNA, 14 bp, Homo sapiens
atgtaaaagaaaat

SEQ ID NO: 3385904 - DNA, 17 bp, Homo sapiens
atgtaaaatgttgaata

SEQ ID NO: 3385905 - DNA, 23 bp, Homo sapiens
atgtaaacataattcttgtatat

SEQ ID NO: 3385906 - DNA, 11 bp, Homo sapiens
atgtaaactgc

SEQ ID NO: 3385907 - DNA, 15 bp, Homo sapiens
atgtaaactgccata

SEQ ID NO: 3385908 - DNA, 20 bp, Homo sapiens
atgtaaagaacttaaattat

SEQ ID NO: 3385909 - DNA, 21 bp, Homo sapiens
atgtaaagatatttttatctt

SEQ ID NO: 3385910 - DNA, 21 bp, Homo sapiens
atgtaaataaccccattcttt

SEQ ID NO: 3385911 - DNA, 21 bp, Homo sapiens
atgtaacagccaggagtgtta

SEQ ID NO: 3385912 - DNA, 17 bp, Homo sapiens
atgtaactccagataga

SEQ ID NO: 3385913 - DNA, 21 bp, Homo sapiens
atgtaagaaaacaaaatctaa

SEQ ID NO: 3385914 - DNA, 20 bp, Homo sapiens
atgtaagagcaccttcctca

SEQ ID NO: 3385915 - DNA, 21 bp, Homo sapiens
atgtaagattatagattctaa

SEQ ID NO: 3385916 - DNA, 17 bp, Homo sapiens
atgtaagccaagtcatg

SEQ ID NO: 3385917 - DNA, 14 bp, Homo sapiens
atgtaataaattca

SEQ ID NO: 3385918 - DNA, 15 bp, Homo sapiens
atgtaataaattcaa

SEQ ID NO: 3385919 - DNA, 20 bp, Homo sapiens
atgtaatgtgtggtggcctc

SEQ ID NO: 3385920 - DNA, 22 bp, Homo sapiens
atgtaatgtgtggtggcctcag

SEQ ID NO: 3385921 - DNA, 23 bp, Homo sapiens
atgtaatgtgtggtggcctcagc

SEQ ID NO: 3385922 - DNA, 23 bp, Homo sapiens
atgtaattaagtactatgtatca

SEQ ID NO: 3385923 - DNA, 11 bp, Homo sapiens
atgtaattgtt

SEQ ID NO: 3385924 - DNA, 13 bp, Homo sapiens
atgtaatttaaat

SEQ ID NO: 3385925 - DNA, 15 bp, Homo sapiens
atgtaatttaaatga

SEQ ID NO: 3385926 - DNA, 21 bp, Homo sapiens
atgtaatttagaaactgattt

SEQ ID NO: 3385927 - DNA, 21 bp, Homo sapiens
atgtaatttagggtactaaat

SEQ ID NO: 3385928 - DNA, 16 bp, Homo sapiens
atgtacaagttttgta

SEQ ID NO: 3385929 - DNA, 18 bp, Homo sapiens
atgtacagattctttcag

SEQ ID NO: 3385930 - DNA, 13 bp, Homo sapiens
atgtacagctctc

SEQ ID NO: 3385931 - DNA, 13 bp, Homo sapiens
atgtacagtattt

SEQ ID NO: 3385932 - DNA, 19 bp, Homo sapiens
atgtacataaactgtcact

SEQ ID NO: 3385933 - DNA, 15 bp, Homo sapiens
atgtacatgagaagg

SEQ ID NO: 3385934 - DNA, 16 bp, Homo sapiens
atgtacatttattcat

SEQ ID NO: 3385935 - DNA, 18 bp, Homo sapiens
atgtaccatgaaacaaag

SEQ ID NO: 3385936 - DNA, 22 bp, Homo sapiens
atgtactagtgttctgtttgtt

SEQ ID NO: 3385937 - DNA, 17 bp, Homo sapiens
atgtactcctctttaca

SEQ ID NO: 3385938 - DNA, 16 bp, Homo sapiens
atgtactgatttcagt

SEQ ID NO: 3385939 - DNA, 18 bp, Homo sapiens
atgtactgatttcagtaa

SEQ ID NO: 3385940 - DNA, 11 bp, Homo sapiens
atgtactgtac

SEQ ID NO: 3385941 - DNA, 16 bp, Homo sapiens
atgtactgtactaatt

SEQ ID NO: 3385942 - DNA, 19 bp, Homo sapiens
atgtactgtagtttttctt

SEQ ID NO: 3385943 - DNA, 19 bp, Homo sapiens
atgtactgtatattacaga

SEQ ID NO: 3385944 - DNA, 18 bp, Homo sapiens
atgtacttaagagtggca

SEQ ID NO: 3385945 - DNA, 17 bp, Homo sapiens
atgtacttgatactgaa

SEQ ID NO: 3385946 - DNA, 17 bp, Homo sapiens
atgtttaacaaatctaa

SEQ ID NO: 3385947 - DNA, 14 bp, Homo sapiens
atgtttaatctgtt

SEQ ID NO: 3385948 - DNA, 22 bp, Homo sapiens
atgtttacactctttgtaagag

SEQ ID NO: 3385949 - DNA, 23 bp, Homo sapiens
atgtttactcattgcccccacct

SEQ ID NO: 3385950 - DNA, 20 bp, Homo sapiens
atgtttataaatcttatgct

SEQ ID NO: 3385951 - DNA, 15 bp, Homo sapiens
atgtttatgaaaata

SEQ ID NO: 3385952 - DNA, 19 bp, Homo sapiens
atgtttatgaaaataaata

SEQ ID NO: 3385953 - DNA, 21 bp, Homo sapiens
atgtttatgagccagacaaat

SEQ ID NO: 3385954 - DNA, 13 bp, Homo sapiens
atgtttattaaat

SEQ ID NO: 3385955 - DNA, 20 bp, Homo sapiens
atgtttattaaatgcttcat

SEQ ID NO: 3385956 - DNA, 21 bp, Homo sapiens
atgtttattcttctagagttc

SEQ ID NO: 3385957 - DNA, 17 bp, Homo sapiens
atgtttatttactaatt

SEQ ID NO: 3385958 - DNA, 16 bp, Homo sapiens
atgtttcaactgtgct

SEQ ID NO: 3385959 - DNA, 21 bp, Homo sapiens
atgtttcacataaaacctcat

SEQ ID NO: 3385960 - DNA, 13 bp, Homo sapiens
atgtttcacttaa

SEQ ID NO: 3385961 - DNA, 18 bp, Homo sapiens
atgtttcaggaggctgga

SEQ ID NO: 3385962 - DNA, 13 bp, Homo sapiens
atgtttccaacct

SEQ ID NO: 3385963 - DNA, 14 bp, Homo sapiens
atgtttcctctagt

SEQ ID NO: 3385964 - DNA, 20 bp, Homo sapiens
atgtttcctctagttctttg

SEQ ID NO: 3385965 - DNA, 20 bp, Homo sapiens
atgtttctgggtcctgaaga

SEQ ID NO: 3385966 - DNA, 18 bp, Homo sapiens
atgtttgatgtccccaaa

SEQ ID NO: 3385967 - DNA, 16 bp, Homo sapiens
atgtttgcacttgtga

SEQ ID NO: 3385968 - DNA, 22 bp, Homo sapiens
atgtttgcctctgcctctgaca

SEQ ID NO: 3385969 - DNA, 16 bp, Homo sapiens
atgtttgctattgaca

SEQ ID NO: 3385970 - DNA, 23 bp, Homo sapiens
atgtttgctcttgtttttattaa

SEQ ID NO: 3385971 - DNA, 15 bp, Homo sapiens
atgtttgtggcctca

SEQ ID NO: 3385972 - DNA, 16 bp, Homo sapiens
atgtttgtggcctcag

SEQ ID NO: 3385973 - DNA, 14 bp, Homo sapiens
atgtttgttaaaaa

SEQ ID NO: 3385974 - DNA, 17 bp, Homo sapiens
atgtttgttaaaaataa

SEQ ID NO: 3385975 - DNA, 22 bp, Homo sapiens
atgttttaaagaatatgacttt

SEQ ID NO: 3385976 - DNA, 16 bp, Homo sapiens
atgttttaagaggcag

SEQ ID NO: 3385977 - DNA, 13 bp, Homo sapiens
atgttttagcatt

SEQ ID NO: 3385978 - DNA, 20 bp, Homo sapiens
atgttttattatttctatta

SEQ ID NO: 3385979 - DNA, 12 bp, Homo sapiens
atgttttcatta

SEQ ID NO: 3385980 - DNA, 17 bp, Homo sapiens
atgttttcattatgttc

SEQ ID NO: 3385981 - DNA, 12 bp, Homo sapiens
atgttttgtaca

SEQ ID NO: 3385982 - DNA, 19 bp, Homo sapiens
atgttttgtacaattacta

SEQ ID NO: 3385983 - DNA, 20 bp, Homo sapiens
atgttttgtatacaaatata

SEQ ID NO: 3385984 - DNA, 23 bp, Homo sapiens
atgttttgtatatacagttattt

SEQ ID NO: 3385985 - DNA, 17 bp, Homo sapiens
atgttttgtgactatat

SEQ ID NO: 3385986 - DNA, 19 bp, Homo sapiens
atgttttgtgactatatag

SEQ ID NO: 3385987 - DNA, 15 bp, Homo sapiens
atgttttgtgcattt

SEQ ID NO: 3385988 - DNA, 16 bp, Homo sapiens
atgttttgtttctgaa

SEQ ID NO: 3385989 - DNA, 14 bp, Homo sapiens
atgtttttaatgac

SEQ ID NO: 3385990 - DNA, 21 bp, Homo sapiens
atgtttttataaaaataaata

SEQ ID NO: 3385991 - DNA, 18 bp, Homo sapiens
atgttttttgccacagct

SEQ ID NO: 3385992 - DNA, 21 bp, Homo sapiens
atgttttttgccacagctttt

SEQ ID NO: 3385993 - DNA, 17 bp, Homo sapiens
atgttttttgtaagata

SEQ ID NO: 3385994 - DNA, 16 bp, Homo sapiens
atgtttttttaattaa

SEQ ID NO: 3385995 - DNA, 14 bp, Homo sapiens
attaaaaaaaaaga

SEQ ID NO: 3385996 - DNA, 12 bp, Homo sapiens
attaaaaaacaa

SEQ ID NO: 3385997 - DNA, 13 bp, Homo sapiens
attaaaaaagtct

SEQ ID NO: 3385998 - DNA, 12 bp, Homo sapiens
attaaaaaccac

SEQ ID NO: 3385999 - DNA, 16 bp, Homo sapiens
attaaaaagaatagaa

SEQ ID NO: 3386000 - DNA, 19 bp, Homo sapiens
attaaaaagattctttttc

SEQ ID NO: 3386001 - DNA, 13 bp, Homo sapiens
attaaaaatgttc

SEQ ID NO: 3386002 - DNA, 18 bp, Homo sapiens
attaaaaatgttctcaaa

SEQ ID NO: 3386003 - DNA, 17 bp, Homo sapiens
attaaaacatatttcat

SEQ ID NO: 3386004 - DNA, 19 bp, Homo sapiens
attaaaacatatttcattt

SEQ ID NO: 3386005 - DNA, 22 bp, Homo sapiens
attaaaactcaacattactgtt

SEQ ID NO: 3386006 - DNA, 14 bp, Homo sapiens
attaaaagcacaag

SEQ ID NO: 3386007 - DNA, 15 bp, Homo sapiens
attaaaataaaccaa

SEQ ID NO: 3386008 - DNA, 18 bp, Homo sapiens
attaaaataaaccaaata

SEQ ID NO: 3386009 - DNA, 22 bp, Homo sapiens
attaaaatatggctataaatat

SEQ ID NO: 3386010 - DNA, 14 bp, Homo sapiens
attaaaatattttg

SEQ ID NO: 3386011 - DNA, 13 bp, Homo sapiens
attaaacaaagtt

SEQ ID NO: 3386012 - DNA, 18 bp, Homo sapiens
attaaacagatttttaca

SEQ ID NO: 3386013 - DNA, 18 bp, Homo sapiens
attaaacattttcatgca

SEQ ID NO: 3386014 - DNA, 14 bp, Homo sapiens
attaaaccaattat

SEQ ID NO: 3386015 - DNA, 14 bp, Homo sapiens
attaaaccgcatgt

SEQ ID NO: 3386016 - DNA, 23 bp, Homo sapiens
attaaactcttcacaaaatctgt

SEQ ID NO: 3386017 - DNA, 17 bp, Homo sapiens
attaaacttgaagcagt

SEQ ID NO: 3386018 - DNA, 15 bp, Homo sapiens
attaaagattctctt

SEQ ID NO: 3386019 - DNA, 17 bp, Homo sapiens
attaaagtctattcaaa

SEQ ID NO: 3386020 - DNA, 16 bp, Homo sapiens
attaaagtctgaatca

SEQ ID NO: 3386021 - DNA, 18 bp, Homo sapiens
attaaagtgctaaggttc

SEQ ID NO: 3386022 - DNA, 20 bp, Homo sapiens
attaaagtgctaaggttcta

SEQ ID NO: 3386023 - DNA, 22 bp, Homo sapiens
attaaagtgctaaggttctaag

SEQ ID NO: 3386024 - DNA, 13 bp, Homo sapiens
attaaataaaatc

SEQ ID NO: 3386025 - DNA, 21 bp, Homo sapiens
attaaataaaatcaattttta

SEQ ID NO: 3386026 - DNA, 14 bp, Homo sapiens
attaaataaataaa

SEQ ID NO: 3386027 - DNA, 16 bp, Homo sapiens
attaaataaatgaata

SEQ ID NO: 3386028 - DNA, 21 bp, Homo sapiens
attaaataaatgaataaatcc

SEQ ID NO: 3386029 - DNA, 16 bp, Homo sapiens
attaaataagattcta

SEQ ID NO: 3386030 - DNA, 16 bp, Homo sapiens
attaaatacaaaactt

SEQ ID NO: 3386031 - DNA, 14 bp, Homo sapiens
attaaatacagaca

SEQ ID NO: 3386032 - DNA, 20 bp, Homo sapiens
attaaatacagacactaagt

SEQ ID NO: 3386033 - DNA, 15 bp, Homo sapiens
attaaatcttaaaca

SEQ ID NO: 3386034 - DNA, 17 bp, Homo sapiens
attaaatcttaaacaat

SEQ ID NO: 3386035 - DNA, 19 bp, Homo sapiens
attaaatcttaaacaatgt

SEQ ID NO: 3386036 - DNA, 20 bp, Homo sapiens
attaaatcttaaacaatgta

SEQ ID NO: 3386037 - DNA, 21 bp, Homo sapiens
attaaatcttaaacaatgtat

SEQ ID NO: 3386038 - DNA, 13 bp, Homo sapiens
attaaatgaatat

SEQ ID NO: 3386039 - DNA, 18 bp, Homo sapiens
attaaatgaatattttga

SEQ ID NO: 3386040 - DNA, 14 bp, Homo sapiens
attaaatgtattta

SEQ ID NO: 3386041 - DNA, 13 bp, Homo sapiens
attaaattacagc

SEQ ID NO: 3386042 - DNA, 22 bp, Homo sapiens
attaaattacagcttttatgga

SEQ ID NO: 3386043 - DNA, 13 bp, Homo sapiens
attaaattaggaa

SEQ ID NO: 3386044 - DNA, 11 bp, Homo sapiens
attaaattatg

SEQ ID NO: 3386045 - DNA, 15 bp, Homo sapiens
attaaattgtaaaac

SEQ ID NO: 3386046 - DNA, 12 bp, Homo sapiens
attaaattttag

SEQ ID NO: 3386047 - DNA, 18 bp, Homo sapiens
attaaattttagtacatt

SEQ ID NO: 3386048 - DNA, 12 bp, Homo sapiens
attaacaaaagt

SEQ ID NO: 3386049 - DNA, 16 bp, Homo sapiens
attaacaaatatgcta

SEQ ID NO: 3386050 - DNA, 20 bp, Homo sapiens
attaacaaatatgctaattt

SEQ ID NO: 3386051 - DNA, 21 bp, Homo sapiens
attaacaaatatgctaatttg

SEQ ID NO: 3386052 - DNA, 22 bp, Homo sapiens
attaacaaatgctctgtcttca

SEQ ID NO: 3386053 - DNA, 20 bp, Homo sapiens
attaacaaattatgttacat

SEQ ID NO: 3386054 - DNA, 13 bp, Homo sapiens
attaacacaaagg

SEQ ID NO: 3386055 - DNA, 17 bp, Homo sapiens
attaacactaattatca

SEQ ID NO: 3386056 - DNA, 12 bp, Homo sapiens
attaacagtttt

SEQ ID NO: 3386057 - DNA, 21 bp, Homo sapiens
attaacagttttccatgaaaa

SEQ ID NO: 3386058 - DNA, 17 bp, Homo sapiens
attaacatcgtgggtca

SEQ ID NO: 3386059 - DNA, 21 bp, Homo sapiens
attaacatgcttatgacaatg

SEQ ID NO: 3386060 - DNA, 14 bp, Homo sapiens
attaacctggtgct

SEQ ID NO: 3386061 - DNA, 17 bp, Homo sapiens
attaaccttactaatta

SEQ ID NO: 3386062 - DNA, 17 bp, Homo sapiens
attaaccttttttgtct

SEQ ID NO: 3386063 - DNA, 18 bp, Homo sapiens
attaaccttttttgtctt

SEQ ID NO: 3386064 - DNA, 23 bp, Homo sapiens
attaaccttttttgtcttattga

SEQ ID NO: 3386065 - DNA, 14 bp, Homo sapiens
attaacttatttag

SEQ ID NO: 3386066 - DNA, 13 bp, Homo sapiens
attaactttaatg

SEQ ID NO: 3386067 - DNA, 19 bp, Homo sapiens
attaagaaggcaaaaatgt

SEQ ID NO: 3386068 - DNA, 21 bp, Homo sapiens
attaagacaatagcacttaaa

SEQ ID NO: 3386069 - DNA, 15 bp, Homo sapiens
attaagacagtgtac

SEQ ID NO: 3386070 - DNA, 17 bp, Homo sapiens
attaagacagtgtacaa

SEQ ID NO: 3386071 - DNA, 19 bp, Homo sapiens
attaagacagtgtacaaaa

SEQ ID NO: 3386072 - DNA, 12 bp, Homo sapiens
attcatttgtat

SEQ ID NO: 3386073 - DNA, 18 bp, Homo sapiens
attcatttgtattgctta

SEQ ID NO: 3386074 - DNA, 12 bp, Homo sapiens
attcatttgttt

SEQ ID NO: 3386075 - DNA, 13 bp, Homo sapiens
attcattttctga

SEQ ID NO: 3386076 - DNA, 20 bp, Homo sapiens
attcattttctgacatgcat

SEQ ID NO: 3386077 - DNA, 15 bp, Homo sapiens
attccaaaatattat

SEQ ID NO: 3386078 - DNA, 18 bp, Homo sapiens
attccaaagtctctaatt

SEQ ID NO: 3386079 - DNA, 13 bp, Homo sapiens
attccaaattcat

SEQ ID NO: 3386080 - DNA, 14 bp, Homo sapiens
attccaacagctca

SEQ ID NO: 3386081 - DNA, 15 bp, Homo sapiens
attccaactttcagg

SEQ ID NO: 3386082 - DNA, 9 bp, Homo sapiens
attccacac

SEQ ID NO: 3386083 - DNA, 17 bp, Homo sapiens
attccactacacctggc

SEQ ID NO: 3386084 - DNA, 19 bp, Homo sapiens
attccactacacctggctg

SEQ ID NO: 3386085 - DNA, 22 bp, Homo sapiens
attccactacacctggctgagg

SEQ ID NO: 3386086 - DNA, 18 bp, Homo sapiens
attccagaatatctggga

SEQ ID NO: 3386087 - DNA, 14 bp, Homo sapiens
attccagaatgctg

SEQ ID NO: 3386088 - DNA, 20 bp, Homo sapiens
attccagaatgctgtacatc

SEQ ID NO: 3386089 - DNA, 15 bp, Homo sapiens
attccagacttcaaa

SEQ ID NO: 3386090 - DNA, 19 bp, Homo sapiens
attccagagagtggctcct

SEQ ID NO: 3386091 - DNA, 16 bp, Homo sapiens
attccagatctttcag

SEQ ID NO: 3386092 - DNA, 20 bp, Homo sapiens
attccagcaagtacagagat

SEQ ID NO: 3386093 - DNA, 16 bp, Homo sapiens
attccagtaacttttt

SEQ ID NO: 3386094 - DNA, 20 bp, Homo sapiens
attccagtgctagaaaattt

SEQ ID NO: 3386095 - DNA, 21 bp, Homo sapiens
attccatatcttgcgaatcca

SEQ ID NO: 3386096 - DNA, 16 bp, Homo sapiens
attccatattcatgta

SEQ ID NO: 3386097 - DNA, 17 bp, Homo sapiens
attccatattcatgtaa

SEQ ID NO: 3386098 - DNA, 18 bp, Homo sapiens
attccatattcatgtaaa

SEQ ID NO: 3386099 - DNA, 17 bp, Homo sapiens
attccatgaatgtatca

SEQ ID NO: 3386100 - DNA, 17 bp, Homo sapiens
attccattggtccaaga

SEQ ID NO: 3386101 - DNA, 21 bp, Homo sapiens
attcccaactagacattacca

SEQ ID NO: 3386102 - DNA, 22 bp, Homo sapiens
attcccaactgagtgttatttg

SEQ ID NO: 3386103 - DNA, 15 bp, Homo sapiens
attcccaagaaatgc

SEQ ID NO: 3386104 - DNA, 22 bp, Homo sapiens
attcccaagctctagtgggaag

SEQ ID NO: 3386105 - DNA, 14 bp, Homo sapiens
attcccaagctctg

SEQ ID NO: 3386106 - DNA, 17 bp, Homo sapiens
attcccagagcaaaata

SEQ ID NO: 3386107 - DNA, 15 bp, Homo sapiens
attcccatctgtcac

SEQ ID NO: 3386108 - DNA, 15 bp, Homo sapiens
attcccattttgcaa

SEQ ID NO: 3386109 - DNA, 23 bp, Homo sapiens
attcccattttgcaaaatttcca

SEQ ID NO: 3386110 - DNA, 14 bp, Homo sapiens
attccccattcttc

SEQ ID NO: 3386111 - DNA, 21 bp, Homo sapiens
attcccccagccaaactgtct

SEQ ID NO: 3386112 - DNA, 21 bp, Homo sapiens
attcccccccctttcctaaag

SEQ ID NO: 3386113 - DNA, 13 bp, Homo sapiens
attccctcatcct

SEQ ID NO: 3386114 - DNA, 16 bp, Homo sapiens
attccctctcatctca

SEQ ID NO: 3386115 - DNA, 19 bp, Homo sapiens
attccctctcctgcccaga

SEQ ID NO: 3386116 - DNA, 18 bp, Homo sapiens
attccctgcccaaaccct

SEQ ID NO: 3386117 - DNA, 13 bp, Homo sapiens
attcccttgtatt

SEQ ID NO: 3386118 - DNA, 14 bp, Homo sapiens
attcccttgtattt

SEQ ID NO: 3386119 - DNA, 17 bp, Homo sapiens
attcccttgtattttgt

SEQ ID NO: 3386120 - DNA, 20 bp, Homo sapiens
attccctttgacttcagctg

SEQ ID NO: 3386121 - DNA, 13 bp, Homo sapiens
attccgagcattc

SEQ ID NO: 3386122 - DNA, 15 bp, Homo sapiens
attccgagcattcca

SEQ ID NO: 3386123 - DNA, 15 bp, Homo sapiens
attccggatcctaag

SEQ ID NO: 3386124 - DNA, 12 bp, Homo sapiens
attccgtcacca

SEQ ID NO: 3386125 - DNA, 19 bp, Homo sapiens
attccgttgtctgtggatg

SEQ ID NO: 3386126 - DNA, 17 bp, Homo sapiens
attcctaaagaaaaata

SEQ ID NO: 3386127 - DNA, 18 bp, Homo sapiens
attcctaaagaaaaatat

SEQ ID NO: 3386128 - DNA, 21 bp, Homo sapiens
attcctaactagaattagtat

SEQ ID NO: 3386129 - DNA, 18 bp, Homo sapiens
attcctacaaagatgttt

SEQ ID NO: 3386130 - DNA, 13 bp, Homo sapiens
attcctacaactt

SEQ ID NO: 3386131 - DNA, 15 bp, Homo sapiens
attcctactccctct

SEQ ID NO: 3386132 - DNA, 19 bp, Homo sapiens
attcctactccctcttcca

SEQ ID NO: 3386133 - DNA, 20 bp, Homo sapiens
attcctactccctcttccaa

SEQ ID NO: 3386134 - DNA, 22 bp, Homo sapiens
attcctactccctcttccaaat

SEQ ID NO: 3386135 - DNA, 19 bp, Homo sapiens
attcctagataaaaagatg

SEQ ID NO: 3386136 - DNA, 22 bp, Homo sapiens
attcctatgatggatggcagac

SEQ ID NO: 3386137 - DNA, 17 bp, Homo sapiens
attcctcaacgtattgt

SEQ ID NO: 3386138 - DNA, 21 bp, Homo sapiens
attcctcacagccttggctcc

SEQ ID NO: 3386139 - DNA, 14 bp, Homo sapiens
attcctcctgctca

SEQ ID NO: 3386140 - DNA, 13 bp, Homo sapiens
attcctctgggaa

SEQ ID NO: 3386141 - DNA, 15 bp, Homo sapiens
attcctcttcattgt

SEQ ID NO: 3386142 - DNA, 18 bp, Homo sapiens
attcctcttgcctctctc

SEQ ID NO: 3386143 - DNA, 13 bp, Homo sapiens
attcctcttttta

SEQ ID NO: 3386144 - DNA, 17 bp, Homo sapiens
attcctgacccaggccg

SEQ ID NO: 3386145 - DNA, 15 bp, Homo sapiens
attcctgcatttgtg

SEQ ID NO: 3386146 - DNA, 21 bp, Homo sapiens
attcctgcctttaagccaaag

SEQ ID NO: 3386147 - DNA, 11 bp, Homo sapiens
attcctgggcc

SEQ ID NO: 3386148 - DNA, 13 bp, Homo sapiens
attcctgggcctg

SEQ ID NO: 3386149 - DNA, 18 bp, Homo sapiens
attcctggtacccagcca

SEQ ID NO: 3386150 - DNA, 15 bp, Homo sapiens
attcctgtaactttt

SEQ ID NO: 3386151 - DNA, 16 bp, Homo sapiens
attcctgtaactttta

SEQ ID NO: 3386152 - DNA, 21 bp, Homo sapiens
attcctgtactgtgtctcatg

SEQ ID NO: 3386153 - DNA, 17 bp, Homo sapiens
attcctgtatgttgtcc

SEQ ID NO: 3386154 - DNA, 18 bp, Homo sapiens
attcctgtatgttgtcca

SEQ ID NO: 3386155 - DNA, 14 bp, Homo sapiens
attccttcactcat

SEQ ID NO: 3386156 - DNA, 14 bp, Homo sapiens
attccttctggcct

SEQ ID NO: 3386157 - DNA, 16 bp, Homo sapiens
attccttctttgataa

SEQ ID NO: 3386158 - DNA, 22 bp, Homo sapiens
attccttctttgataatgttaa

SEQ ID NO: 3386159 - DNA, 13 bp, Homo sapiens
attccttgcccca

SEQ ID NO: 3386160 - DNA, 16 bp, Homo sapiens
attcctttctatcatt

SEQ ID NO: 3386161 - DNA, 17 bp, Homo sapiens
attcctttctcatccca

SEQ ID NO: 3386162 - DNA, 16 bp, Homo sapiens
attcctttgtcttcaa

SEQ ID NO: 3386163 - DNA, 18 bp, Homo sapiens
attcctttgtgtttctat

SEQ ID NO: 3386164 - DNA, 16 bp, Homo sapiens
attcgcctttgtcttg

SEQ ID NO: 3386165 - DNA, 17 bp, Homo sapiens
attcgctcccacattct

SEQ ID NO: 3386166 - DNA, 21 bp, Homo sapiens
attcggtatccccccatcttg

SEQ ID NO: 3386167 - DNA, 23 bp, Homo sapiens
attcggtgtggtgcagtgtgaaa

SEQ ID NO: 3386168 - DNA, 23 bp, Homo sapiens
attcgtatgatcagtactgactt

SEQ ID NO: 3386169 - DNA, 17 bp, Homo sapiens
attcgtggcatgttttg

SEQ ID NO: 3386170 - DNA, 23 bp, Homo sapiens
attctaaaatgtgatgttctaag

SEQ ID NO: 3386171 - DNA, 14 bp, Homo sapiens
attctaaagattct

SEQ ID NO: 3386172 - DNA, 22 bp, Homo sapiens
attctaaagattctatagttct

SEQ ID NO: 3386173 - DNA, 23 bp, Homo sapiens
attctaagccagttttcattttg

SEQ ID NO: 3386174 - DNA, 19 bp, Homo sapiens
attctaagccctttgccat

SEQ ID NO: 3386175 - DNA, 15 bp, Homo sapiens
attctaagtgaaatt

SEQ ID NO: 3386176 - DNA, 13 bp, Homo sapiens
attctaagttatt

SEQ ID NO: 3386177 - DNA, 17 bp, Homo sapiens
attctaagttatttact

SEQ ID NO: 3386178 - DNA, 20 bp, Homo sapiens
attctaagttatttactttt

SEQ ID NO: 3386179 - DNA, 14 bp, Homo sapiens
attctaatgtcttc

SEQ ID NO: 3386180 - DNA, 14 bp, Homo sapiens
attctaattaaaat

SEQ ID NO: 3386181 - DNA, 17 bp, Homo sapiens
attctaattaaaattgt

SEQ ID NO: 3386182 - DNA, 13 bp, Homo sapiens
attctaattgtca

SEQ ID NO: 3386183 - DNA, 12 bp, Homo sapiens
attctacagaat

SEQ ID NO: 3386184 - DNA, 22 bp, Homo sapiens
attctactaagttattttatga

SEQ ID NO: 3386185 - DNA, 16 bp, Homo sapiens
attctagccaaactat

SEQ ID NO: 3386186 - DNA, 21 bp, Homo sapiens
attctagctgtatgatttgtt

SEQ ID NO: 3386187 - DNA, 22 bp, Homo sapiens
attctagctgtatgatttgttt

SEQ ID NO: 3386188 - DNA, 13 bp, Homo sapiens
attctaggcatcc

SEQ ID NO: 3386189 - DNA, 20 bp, Homo sapiens
attctaggcatcccagggga

SEQ ID NO: 3386190 - DNA, 17 bp, Homo sapiens
attctagggtttcttaa

SEQ ID NO: 3386191 - DNA, 19 bp, Homo sapiens
attctagggtttcttaaat

SEQ ID NO: 3386192 - DNA, 13 bp, Homo sapiens
attctatagttct

SEQ ID NO: 3386193 - DNA, 23 bp, Homo sapiens
attctatatgaatttaaatataa

SEQ ID NO: 3386194 - DNA, 20 bp, Homo sapiens
attctatccccaatcagctc

SEQ ID NO: 3386195 - DNA, 20 bp, Homo sapiens
attctatgttaaatactgtg

SEQ ID NO: 3386196 - DNA, 21 bp, Homo sapiens
attctatgttaaatactgtgc

SEQ ID NO: 3386197 - DNA, 17 bp, Homo sapiens
attctattgtattattt

SEQ ID NO: 3386198 - DNA, 21 bp, Homo sapiens
attgttgaggtggtctgaatg

SEQ ID NO: 3386199 - DNA, 23 bp, Homo sapiens
attgttgaggtggtctgaatgtt

SEQ ID NO: 3386200 - DNA, 12 bp, Homo sapiens
attgttggctat

SEQ ID NO: 3386201 - DNA, 23 bp, Homo sapiens
attgttggctatttgaaatacta

SEQ ID NO: 3386202 - DNA, 14 bp, Homo sapiens
attgttgtataatt

SEQ ID NO: 3386203 - DNA, 18 bp, Homo sapiens
attgttgtggtttaaata

SEQ ID NO: 3386204 - DNA, 19 bp, Homo sapiens
attgttgtggtttaaatac

SEQ ID NO: 3386205 - DNA, 24 bp, Homo sapiens
attgttgttactttttcttgtatt

SEQ ID NO: 3386206 - DNA, 14 bp, Homo sapiens
attgttgtttcttt

SEQ ID NO: 3386207 - DNA, 16 bp, Homo sapiens
attgttgtttctttct

SEQ ID NO: 3386208 - DNA, 16 bp, Homo sapiens
attgtttaaaatgtaa

SEQ ID NO: 3386209 - DNA, 16 bp, Homo sapiens
attgtttaaaattcag

SEQ ID NO: 3386210 - DNA, 21 bp, Homo sapiens
attgtttaagtgttgtaaata

SEQ ID NO: 3386211 - DNA, 15 bp, Homo sapiens
attgtttatttatca

SEQ ID NO: 3386212 - DNA, 17 bp, Homo sapiens
attgtttatttatcagt

SEQ ID NO: 3386213 - DNA, 22 bp, Homo sapiens
attgtttcattgcgaatctttt

SEQ ID NO: 3386214 - DNA, 17 bp, Homo sapiens
attgtttcctcttccaa

SEQ ID NO: 3386215 - DNA, 20 bp, Homo sapiens
attgtttcctcttccaaagt

SEQ ID NO: 3386216 - DNA, 16 bp, Homo sapiens
attgtttctagaacag

SEQ ID NO: 3386217 - DNA, 19 bp, Homo sapiens
attgtttctatacaaatat

SEQ ID NO: 3386218 - DNA, 12 bp, Homo sapiens
attgtttctgca

SEQ ID NO: 3386219 - DNA, 14 bp, Homo sapiens
attgtttcttgaca

SEQ ID NO: 3386220 - DNA, 20 bp, Homo sapiens
attgtttctttaagaaagta

SEQ ID NO: 3386221 - DNA, 15 bp, Homo sapiens
attgtttgcttattg

SEQ ID NO: 3386222 - DNA, 18 bp, Homo sapiens
attgtttgcttattgttc

SEQ ID NO: 3386223 - DNA, 17 bp, Homo sapiens
attgtttggtaaatgtt

SEQ ID NO: 3386224 - DNA, 17 bp, Homo sapiens
attgttttaatctgaaa

SEQ ID NO: 3386225 - DNA, 15 bp, Homo sapiens
attgttttcacttgt

SEQ ID NO: 3386226 - DNA, 16 bp, Homo sapiens
attgttttcacttgta

SEQ ID NO: 3386227 - DNA, 19 bp, Homo sapiens
attgttttcacttgtattg

SEQ ID NO: 3386228 - DNA, 17 bp, Homo sapiens
attgttttcttttacag

SEQ ID NO: 3386229 - DNA, 15 bp, Homo sapiens
attgttttgaatatt

SEQ ID NO: 3386230 - DNA, 21 bp, Homo sapiens
atttaaaaaaatcacaaaaat

SEQ ID NO: 3386231 - DNA, 15 bp, Homo sapiens
atttaaaaaataact

SEQ ID NO: 3386232 - DNA, 13 bp, Homo sapiens
atttaaaaagctc

SEQ ID NO: 3386233 - DNA, 22 bp, Homo sapiens
atttaaaaatatttcagatatc

SEQ ID NO: 3386234 - DNA, 18 bp, Homo sapiens
atttaaaacagacactgg

SEQ ID NO: 3386235 - DNA, 23 bp, Homo sapiens
atttaaaacagacactggcatgg

SEQ ID NO: 3386236 - DNA, 17 bp, Homo sapiens
atttaaaagcctgctca

SEQ ID NO: 3386237 - DNA, 19 bp, Homo sapiens
atttaaaattaagtagaac

SEQ ID NO: 3386238 - DNA, 16 bp, Homo sapiens
atttaaaattacgttt

SEQ ID NO: 3386239 - DNA, 18 bp, Homo sapiens
atttaaacaatgccaagt

SEQ ID NO: 3386240 - DNA, 14 bp, Homo sapiens
atttaaacagcagt

SEQ ID NO: 3386241 - DNA, 15 bp, Homo sapiens
atttaaacagcagtg

SEQ ID NO: 3386242 - DNA, 17 bp, Homo sapiens
atttaaacaggcccagc

SEQ ID NO: 3386243 - DNA, 18 bp, Homo sapiens
atttaaacaggcccagca

SEQ ID NO: 3386244 - DNA, 16 bp, Homo sapiens
atttaaacccaatcag

SEQ ID NO: 3386245 - DNA, 11 bp, Homo sapiens
atttaaacctt

SEQ ID NO: 3386246 - DNA, 15 bp, Homo sapiens
atttaaacctttttc

SEQ ID NO: 3386247 - DNA, 16 bp, Homo sapiens
atttaaacctttttct

SEQ ID NO: 3386248 - DNA, 16 bp, Homo sapiens
atttaaagcattgctt

SEQ ID NO: 3386249 - DNA, 15 bp, Homo sapiens
atttaaataaaatca

SEQ ID NO: 3386250 - DNA, 15 bp, Homo sapiens
atttaaatataattc

SEQ ID NO: 3386251 - DNA, 23 bp, Homo sapiens
atttaaatataattctgtaaatg

SEQ ID NO: 3386252 - DNA, 22 bp, Homo sapiens
atttaaatgcaaccagaattgt

SEQ ID NO: 3386253 - DNA, 19 bp, Homo sapiens
atttaaattcttttttaaa

SEQ ID NO: 3386254 - DNA, 16 bp, Homo sapiens
atttaaatttaaagat

SEQ ID NO: 3386255 - DNA, 19 bp, Homo sapiens
atttaaattttacccttta

SEQ ID NO: 3386256 - DNA, 17 bp, Homo sapiens
atttaaatttttttcct

SEQ ID NO: 3386257 - DNA, 17 bp, Homo sapiens
atttaacaaactaaaaa

SEQ ID NO: 3386258 - DNA, 18 bp, Homo sapiens
atttaacaaactaaaaat

SEQ ID NO: 3386259 - DNA, 16 bp, Homo sapiens
atttaacaatttattc

SEQ ID NO: 3386260 - DNA, 15 bp, Homo sapiens
atttaacagctgaat

SEQ ID NO: 3386261 - DNA, 15 bp, Homo sapiens
atttaacagtcattt

SEQ ID NO: 3386262 - DNA, 16 bp, Homo sapiens
atttaacattatttat

SEQ ID NO: 3386263 - DNA, 22 bp, Homo sapiens
atttaaccccttggtactgaaa

SEQ ID NO: 3386264 - DNA, 22 bp, Homo sapiens
atttaacctatttccacattct

SEQ ID NO: 3386265 - DNA, 15 bp, Homo sapiens
atttaagaaaagcac

SEQ ID NO: 3386266 - DNA, 16 bp, Homo sapiens
atttaagaaaagcact

SEQ ID NO: 3386267 - DNA, 18 bp, Homo sapiens
atttaagcacaaacttta

SEQ ID NO: 3386268 - DNA, 12 bp, Homo sapiens
atttaagcattg

SEQ ID NO: 3386269 - DNA, 14 bp, Homo sapiens
atttaagcattgtt

SEQ ID NO: 3386270 - DNA, 19 bp, Homo sapiens
atttaagcctcatatttaa

SEQ ID NO: 3386271 - DNA, 21 bp, Homo sapiens
atttaagcctcatatttaaag

SEQ ID NO: 3386272 - DNA, 20 bp, Homo sapiens
atttaagccttataaaccaa

SEQ ID NO: 3386273 - DNA, 22 bp, Homo sapiens
atttaagctgtaaattacataa

SEQ ID NO: 3386274 - DNA, 18 bp, Homo sapiens
atttaagtagaaaagttg

SEQ ID NO: 3386275 - DNA, 14 bp, Homo sapiens
atttaagtgcgtgt

SEQ ID NO: 3386276 - DNA, 20 bp, Homo sapiens
atttaagtgcgtgtgtagag

SEQ ID NO: 3386277 - DNA, 18 bp, Homo sapiens
atttaagtgttggaaaaa

SEQ ID NO: 3386278 - DNA, 18 bp, Homo sapiens
atttaagttatcaacttt

SEQ ID NO: 3386279 - DNA, 21 bp, Homo sapiens
atttaataaaataattctaaa

SEQ ID NO: 3386280 - DNA, 22 bp, Homo sapiens
atttaataaaataattctaaag

SEQ ID NO: 3386281 - DNA, 14 bp, Homo sapiens
atttaataaagatg

SEQ ID NO: 3386282 - DNA, 17 bp, Homo sapiens
atttaataaagatgagt

SEQ ID NO: 3386283 - DNA, 15 bp, Homo sapiens
atttaataacattac

SEQ ID NO: 3386284 - DNA, 19 bp, Homo sapiens
atttaataatgtatgtaca

SEQ ID NO: 3386285 - DNA, 15 bp, Homo sapiens
atttaatcacagtca

SEQ ID NO: 3386286 - DNA, 14 bp, Homo sapiens
atttaatgaaagac

SEQ ID NO: 3386287 - DNA, 22 bp, Homo sapiens
atttaatgataagtaaatgcta

SEQ ID NO: 3386288 - DNA, 20 bp, Homo sapiens
atttaatgcattaaacctgt

SEQ ID NO: 3386289 - DNA, 15 bp, Homo sapiens
atttaattattaact

SEQ ID NO: 3386290 - DNA, 20 bp, Homo sapiens
atttaattattaactacatt

SEQ ID NO: 3386291 - DNA, 21 bp, Homo sapiens
atttaattcttcacctttgta

SEQ ID NO: 3386292 - DNA, 22 bp, Homo sapiens
atttaattcttcacctttgtaa

SEQ ID NO: 3386293 - DNA, 16 bp, Homo sapiens
atttaattgtaaactg

SEQ ID NO: 3386294 - DNA, 18 bp, Homo sapiens
atttaattgtaaactgta

SEQ ID NO: 3386295 - DNA, 23 bp, Homo sapiens
atttaatttttttgagacagagt

SEQ ID NO: 3386296 - DNA, 14 bp, Homo sapiens
atttacaccacact

SEQ ID NO: 3386297 - DNA, 16 bp, Homo sapiens
atttacaccacacttt

SEQ ID NO: 3386298 - DNA, 20 bp, Homo sapiens
atttacacttttgagacttt

SEQ ID NO: 3386299 - DNA, 21 bp, Homo sapiens
atttacagcctcacttgaatg

SEQ ID NO: 3386300 - DNA, 18 bp, Homo sapiens
atttacagtccttcaaaa

SEQ ID NO: 3386301 - DNA, 20 bp, Homo sapiens
atttacagtctctttcttcc

SEQ ID NO: 3386302 - DNA, 18 bp, Homo sapiens
atttacatgaattgcatt

SEQ ID NO: 3386303 - DNA, 20 bp, Homo sapiens
atttacatgaattgcatttt

SEQ ID NO: 3386304 - DNA, 17 bp, Homo sapiens
atttacatgtatggtta

SEQ ID NO: 3386305 - DNA, 13 bp, Homo sapiens
atttacatttatc

SEQ ID NO: 3386306 - DNA, 13 bp, Homo sapiens
atttacctgcagg

SEQ ID NO: 3386307 - DNA, 13 bp, Homo sapiens
atttaccttttaa

SEQ ID NO: 3386308 - DNA, 14 bp, Homo sapiens
atttaccttttaag

SEQ ID NO: 3386309 - DNA, 19 bp, Homo sapiens
atttacgctttgattcata

SEQ ID NO: 3386310 - DNA, 16 bp, Homo sapiens
atttactaaacatatg

SEQ ID NO: 3386311 - DNA, 19 bp, Homo sapiens
atttactaaacatatgatt

SEQ ID NO: 3386312 - DNA, 12 bp, Homo sapiens
atttactatata

SEQ ID NO: 3386313 - DNA, 14 bp, Homo sapiens
atttactatatata

SEQ ID NO: 3386314 - DNA, 13 bp, Homo sapiens
atttactcacagc

SEQ ID NO: 3386315 - DNA, 16 bp, Homo sapiens
atttacttcttataca

SEQ ID NO: 3386316 - DNA, 17 bp, Homo sapiens
atttacttcttatacat

SEQ ID NO: 3386317 - DNA, 19 bp, Homo sapiens
atttacttcttatacattt

SEQ ID NO: 3386318 - DNA, 20 bp, Homo sapiens
atttacttcttatacatttg

SEQ ID NO: 3386319 - DNA, 15 bp, Homo sapiens
atttacttgttttgg

SEQ ID NO: 3386320 - DNA, 12 bp, Homo sapiens
atttacttttaa

SEQ ID NO: 3386321 - DNA, 21 bp, Homo sapiens
atttacttttaccactattta

SEQ ID NO: 3386322 - DNA, 12 bp, Homo sapiens
atttagaagcca

SEQ ID NO: 3386323 - DNA, 21 bp, Homo sapiens
atttagaagccaactatgatt

SEQ ID NO: 3386324 - DNA, 13 bp, Homo sapiens
atttgtgtttttc

SEQ ID NO: 3386325 - DNA, 19 bp, Homo sapiens
atttgtgtttttctttttc

SEQ ID NO: 3386326 - DNA, 14 bp, Homo sapiens
atttgttaaaatta

SEQ ID NO: 3386327 - DNA, 21 bp, Homo sapiens
atttgttaaaattatcaatat

SEQ ID NO: 3386328 - DNA, 19 bp, Homo sapiens
atttgttaattcctatgaa

SEQ ID NO: 3386329 - DNA, 12 bp, Homo sapiens
atttgttcatgt

SEQ ID NO: 3386330 - DNA, 15 bp, Homo sapiens
atttgttcatgtttg

SEQ ID NO: 3386331 - DNA, 14 bp, Homo sapiens
atttgttgaaatta

SEQ ID NO: 3386332 - DNA, 18 bp, Homo sapiens
atttgttgaaattatgta

SEQ ID NO: 3386333 - DNA, 19 bp, Homo sapiens
atttgttgacaaaattttc

SEQ ID NO: 3386334 - DNA, 14 bp, Homo sapiens
atttgttggaatga

SEQ ID NO: 3386335 - DNA, 15 bp, Homo sapiens
atttgttggaatgaa

SEQ ID NO: 3386336 - DNA, 20 bp, Homo sapiens
atttgttggggctttacata

SEQ ID NO: 3386337 - DNA, 13 bp, Homo sapiens
atttgttggtaac

SEQ ID NO: 3386338 - DNA, 21 bp, Homo sapiens
atttgttggtaactaatgtta

SEQ ID NO: 3386339 - DNA, 23 bp, Homo sapiens
atttgtttatttttatatagctt

SEQ ID NO: 3386340 - DNA, 16 bp, Homo sapiens
atttgtttccagcatg

SEQ ID NO: 3386341 - DNA, 11 bp, Homo sapiens
atttgtttgac

SEQ ID NO: 3386342 - DNA, 15 bp, Homo sapiens
atttgttttcatggt

SEQ ID NO: 3386343 - DNA, 12 bp, Homo sapiens
atttgttttgct

SEQ ID NO: 3386344 - DNA, 14 bp, Homo sapiens
atttgttttgcttt

SEQ ID NO: 3386345 - DNA, 15 bp, Homo sapiens
atttgttttggatat

SEQ ID NO: 3386346 - DNA, 15 bp, Homo sapiens
atttgtttttcattc

SEQ ID NO: 3386347 - DNA, 12 bp, Homo sapiens
attttaaaaaag

SEQ ID NO: 3386348 - DNA, 18 bp, Homo sapiens
attttaaaaaagccttcc

SEQ ID NO: 3386349 - DNA, 16 bp, Homo sapiens
attttaaaaaatgaaa

SEQ ID NO: 3386350 - DNA, 16 bp, Homo sapiens
attttaaaaacataga

SEQ ID NO: 3386351 - DNA, 22 bp, Homo sapiens
attttaaaaatacatatcgctg

SEQ ID NO: 3386352 - DNA, 14 bp, Homo sapiens
attttaaaaattgg

SEQ ID NO: 3386353 - DNA, 14 bp, Homo sapiens
attttaaaatttca

SEQ ID NO: 3386354 - DNA, 15 bp, Homo sapiens
attttaaaatttcat

SEQ ID NO: 3386355 - DNA, 17 bp, Homo sapiens
attttaaacaaaataga

SEQ ID NO: 3386356 - DNA, 22 bp, Homo sapiens
attttaaacaaaggttgagatg

SEQ ID NO: 3386357 - DNA, 16 bp, Homo sapiens
attttaaaggataatg

SEQ ID NO: 3386358 - DNA, 14 bp, Homo sapiens
attttaaaggcaga

SEQ ID NO: 3386359 - DNA, 14 bp, Homo sapiens
attttaaagtaatt

SEQ ID NO: 3386360 - DNA, 13 bp, Homo sapiens
attttaaagtatg

SEQ ID NO: 3386361 - DNA, 22 bp, Homo sapiens
attttaaagtatgcattattaa

SEQ ID NO: 3386362 - DNA, 17 bp, Homo sapiens
attttaaagtgcaaaag

SEQ ID NO: 3386363 - DNA, 11 bp, Homo sapiens
attttaaataa

SEQ ID NO: 3386364 - DNA, 14 bp, Homo sapiens
attttaaataaaag

SEQ ID NO: 3386365 - DNA, 21 bp, Homo sapiens
attttaaataaaagtgatcaa

SEQ ID NO: 3386366 - DNA, 14 bp, Homo sapiens
attttaaataacct

SEQ ID NO: 3386367 - DNA, 18 bp, Homo sapiens
attttaaataacctctgg

SEQ ID NO: 3386368 - DNA, 17 bp, Homo sapiens
attttaaataatttcta

SEQ ID NO: 3386369 - DNA, 21 bp, Homo sapiens
attttaaatctaaatctattt

SEQ ID NO: 3386370 - DNA, 16 bp, Homo sapiens
attttaacaaaagcaa

SEQ ID NO: 3386371 - DNA, 18 bp, Homo sapiens
attttaacaaaagcaaga

SEQ ID NO: 3386372 - DNA, 14 bp, Homo sapiens
attttaacaataac

SEQ ID NO: 3386373 - DNA, 16 bp, Homo sapiens
attttaacaataacta

SEQ ID NO: 3386374 - DNA, 13 bp, Homo sapiens
attttaacacttt

SEQ ID NO: 3386375 - DNA, 16 bp, Homo sapiens
attttaacatgatttc

SEQ ID NO: 3386376 - DNA, 22 bp, Homo sapiens
attttaacctagatgtttaaca

SEQ ID NO: 3386377 - DNA, 16 bp, Homo sapiens
attttaacgctgccta

SEQ ID NO: 3386378 - DNA, 21 bp, Homo sapiens
attttaactaaattttaaagc

SEQ ID NO: 3386379 - DNA, 13 bp, Homo sapiens
attttaactcata

SEQ ID NO: 3386380 - DNA, 15 bp, Homo sapiens
attttaactttatca

SEQ ID NO: 3386381 - DNA, 16 bp, Homo sapiens
attttaagactgattt

SEQ ID NO: 3386382 - DNA, 16 bp, Homo sapiens
attttaagtgctttgt

SEQ ID NO: 3386383 - DNA, 17 bp, Homo sapiens
attttaagtgctttgta

SEQ ID NO: 3386384 - DNA, 15 bp, Homo sapiens
attttaatagaaata

SEQ ID NO: 3386385 - DNA, 20 bp, Homo sapiens
attttaatagggaatatatc

SEQ ID NO: 3386386 - DNA, 20 bp, Homo sapiens
attttaatattgatgtcagt

SEQ ID NO: 3386387 - DNA, 14 bp, Homo sapiens
attttaatcaagtt

SEQ ID NO: 3386388 - DNA, 14 bp, Homo sapiens
attttaatcctgta

SEQ ID NO: 3386389 - DNA, 17 bp, Homo sapiens
attttaatcctgtacca

SEQ ID NO: 3386390 - DNA, 22 bp, Homo sapiens
attttaatcctgtaccaaatct

SEQ ID NO: 3386391 - DNA, 22 bp, Homo sapiens
attttaatgcagttgcttacta

SEQ ID NO: 3386392 - DNA, 15 bp, Homo sapiens
attttaatgtgaaga

SEQ ID NO: 3386393 - DNA, 18 bp, Homo sapiens
attttaatgtgatgatgt

SEQ ID NO: 3386394 - DNA, 24 bp, Homo sapiens
attttaatgtgatgatgtaattga

SEQ ID NO: 3386395 - DNA, 18 bp, Homo sapiens
attttaattatcttttct

SEQ ID NO: 3386396 - DNA, 14 bp, Homo sapiens
attttaattgtcat

SEQ ID NO: 3386397 - DNA, 18 bp, Homo sapiens
attttaatttatgagttt

SEQ ID NO: 3386398 - DNA, 19 bp, Homo sapiens
attttaatttttgctttta

SEQ ID NO: 3386399 - DNA, 22 bp, Homo sapiens
attttacaaaagaggagcactt

SEQ ID NO: 3386400 - DNA, 17 bp, Homo sapiens
attttacaaaagatgta

SEQ ID NO: 3386401 - DNA, 12 bp, Homo sapiens
attttacaattt

SEQ ID NO: 3386402 - DNA, 11 bp, Homo sapiens
attttacagtg

SEQ ID NO: 3386403 - DNA, 12 bp, Homo sapiens
attttaccaaag

SEQ ID NO: 3386404 - DNA, 14 bp, Homo sapiens
attttaccaaagca

SEQ ID NO: 3386405 - DNA, 22 bp, Homo sapiens
attttactccataaacagactg

SEQ ID NO: 3386406 - DNA, 19 bp, Homo sapiens
attttagcatgatgaaact

SEQ ID NO: 3386407 - DNA, 23 bp, Homo sapiens
attttagcatgatgaaactgtca

SEQ ID NO: 3386408 - DNA, 12 bp, Homo sapiens
attttagcattt

SEQ ID NO: 3386409 - DNA, 18 bp, Homo sapiens
attttaggagctaaggct

SEQ ID NO: 3386410 - DNA, 20 bp, Homo sapiens
attttaggcactcttaaatg

SEQ ID NO: 3386411 - DNA, 16 bp, Homo sapiens
attttaggtgttgatt

SEQ ID NO: 3386412 - DNA, 14 bp, Homo sapiens
attttagtccaaat

SEQ ID NO: 3386413 - DNA, 19 bp, Homo sapiens
attttataagcaaatttca

SEQ ID NO: 3386414 - DNA, 15 bp, Homo sapiens
attttataattggtg

SEQ ID NO: 3386415 - DNA, 21 bp, Homo sapiens
attttataattggtgctattt

SEQ ID NO: 3386416 - DNA, 19 bp, Homo sapiens
attttataggactgttctt

SEQ ID NO: 3386417 - DNA, 15 bp, Homo sapiens
attttatataaagta

SEQ ID NO: 3386418 - DNA, 16 bp, Homo sapiens
attttatataaagtat

SEQ ID NO: 3386419 - DNA, 21 bp, Homo sapiens
attttatataaagtattcttt

SEQ ID NO: 3386420 - DNA, 19 bp, Homo sapiens
attttatctttcgcacagc

SEQ ID NO: 3386421 - DNA, 12 bp, Homo sapiens
attttatgatct

SEQ ID NO: 3386422 - DNA, 22 bp, Homo sapiens
attttatgttaagggaagaatt

SEQ ID NO: 3386423 - DNA, 20 bp, Homo sapiens
attttattaaacattttcat

SEQ ID NO: 3386424 - DNA, 22 bp, Homo sapiens
attttattctagggtttcttaa

SEQ ID NO: 3386425 - DNA, 19 bp, Homo sapiens
attttattctatgtatgtt

SEQ ID NO: 3386426 - DNA, 20 bp, Homo sapiens
attttattctttaagttcac

SEQ ID NO: 3386427 - DNA, 20 bp, Homo sapiens
attttattgtataaaaagtt

SEQ ID NO: 3386428 - DNA, 23 bp, Homo sapiens
attttattgtataaaaagtttca

SEQ ID NO: 3386429 - DNA, 19 bp, Homo sapiens
attttatttagacaagaga

SEQ ID NO: 3386430 - DNA, 22 bp, Homo sapiens
attttatttagacaagagatgg

SEQ ID NO: 3386431 - DNA, 13 bp, Homo sapiens
attttatttatat

SEQ ID NO: 3386432 - DNA, 23 bp, Homo sapiens
attttatttcctggacatcctct

SEQ ID NO: 3386433 - DNA, 14 bp, Homo sapiens
attttatttgacaa

SEQ ID NO: 3386434 - DNA, 12 bp, Homo sapiens
attttatttgta

SEQ ID NO: 3386435 - DNA, 14 bp, Homo sapiens
attttattttctaa

SEQ ID NO: 3386436 - DNA, 20 bp, Homo sapiens
attttcaacgcagccctgct

SEQ ID NO: 3386437 - DNA, 16 bp, Homo sapiens
attttcaagaaactga

SEQ ID NO: 3386438 - DNA, 17 bp, Homo sapiens
attttcaagaaactgag

SEQ ID NO: 3386439 - DNA, 19 bp, Homo sapiens
attttcaagtaattgtgaa

SEQ ID NO: 3386440 - DNA, 15 bp, Homo sapiens
attttcacattcttg

SEQ ID NO: 3386441 - DNA, 15 bp, Homo sapiens
attttcagaatctga

SEQ ID NO: 3386442 - DNA, 20 bp, Homo sapiens
attttcagcattaagctgtt

SEQ ID NO: 3386443 - DNA, 17 bp, Homo sapiens
attttcagtatactgtg

SEQ ID NO: 3386444 - DNA, 16 bp, Homo sapiens
attttcagtgcatcat

SEQ ID NO: 3386445 - DNA, 22 bp, Homo sapiens
attttcagttacaagattgtaa

SEQ ID NO: 3386446 - DNA, 14 bp, Homo sapiens
attttcatgaaaat

SEQ ID NO: 3386447 - DNA, 20 bp, Homo sapiens
attttcatgaaaataccatt

SEQ ID NO: 3386448 - DNA, 16 bp, Homo sapiens
attttcattaaacttg

SEQ ID NO: 3386449 - DNA, 19 bp, Homo sapiens
attttcattaaacttgaag

SEQ ID NO: 3386450 - DNA, 16 bp, Homo sapiens
attttcattacaatgg

SEQ ID NO: 3386451 - DNA, 23 bp, Homo sapiens
caaagtaaatacaagactgttgt

SEQ ID NO: 3386452 - DNA, 16 bp, Homo sapiens
caaagtaccacactga

SEQ ID NO: 3386453 - DNA, 13 bp, Homo sapiens
caaagtataacca

SEQ ID NO: 3386454 - DNA, 22 bp, Homo sapiens
caaagtatttttttatcttggg

SEQ ID NO: 3386455 - DNA, 18 bp, Homo sapiens
caaagtgactgtttggct

SEQ ID NO: 3386456 - DNA, 22 bp, Homo sapiens
caaagtgccactcattcctgta

SEQ ID NO: 3386457 - DNA, 15 bp, Homo sapiens
caaagtgctgagatt

SEQ ID NO: 3386458 - DNA, 23 bp, Homo sapiens
caaagtgctgggattacaagcgt

SEQ ID NO: 3386459 - DNA, 19 bp, Homo sapiens
caaagtgctgggattacag

SEQ ID NO: 3386460 - DNA, 23 bp, Homo sapiens
caaagtgctgggattacaggtgt

SEQ ID NO: 3386461 - DNA, 14 bp, Homo sapiens
caaagtgctgtacc

SEQ ID NO: 3386462 - DNA, 15 bp, Homo sapiens
caaagtggaacgaaa

SEQ ID NO: 3386463 - DNA, 21 bp, Homo sapiens
caaagttactaggtaacttca

SEQ ID NO: 3386464 - DNA, 14 bp, Homo sapiens
caaagttagagaac

SEQ ID NO: 3386465 - DNA, 20 bp, Homo sapiens
caaagttatattcacagttt

SEQ ID NO: 3386466 - DNA, 23 bp, Homo sapiens
caaagttctaataatttctaatg

SEQ ID NO: 3386467 - DNA, 17 bp, Homo sapiens
caaagttggggcaggct

SEQ ID NO: 3386468 - DNA, 12 bp, Homo sapiens
caaagttttcct

SEQ ID NO: 3386469 - DNA, 17 bp, Homo sapiens
caaagttttcctttgta

SEQ ID NO: 3386470 - DNA, 13 bp, Homo sapiens
caaagttttgaaa

SEQ ID NO: 3386471 - DNA, 20 bp, Homo sapiens
caaagttttgaaaagctatt

SEQ ID NO: 3386472 - DNA, 14 bp, Homo sapiens
caaagttttgctgt

SEQ ID NO: 3386473 - DNA, 22 bp, Homo sapiens
caaagttttgttgtacttaaat

SEQ ID NO: 3386474 - DNA, 21 bp, Homo sapiens
caaataaaaactaaattgtaa

SEQ ID NO: 3386475 - DNA, 14 bp, Homo sapiens
caaataaaattggc

SEQ ID NO: 3386476 - DNA, 14 bp, Homo sapiens
caaataaacagcta

SEQ ID NO: 3386477 - DNA, 18 bp, Homo sapiens
caaataaacagctattta

SEQ ID NO: 3386478 - DNA, 19 bp, Homo sapiens
caaataaacagctatttaa

SEQ ID NO: 3386479 - DNA, 12 bp, Homo sapiens
caaataaagcct

SEQ ID NO: 3386480 - DNA, 13 bp, Homo sapiens
caaataaagcctt

SEQ ID NO: 3386481 - DNA, 14 bp, Homo sapiens
caaataaagccttt

SEQ ID NO: 3386482 - DNA, 17 bp, Homo sapiens
caaataaagccttttaa

SEQ ID NO: 3386483 - DNA, 16 bp, Homo sapiens
caaataaataaataat

SEQ ID NO: 3386484 - DNA, 14 bp, Homo sapiens
caaataaatttctg

SEQ ID NO: 3386485 - DNA, 23 bp, Homo sapiens
caaataacttcagtcctgctcca

SEQ ID NO: 3386486 - DNA, 12 bp, Homo sapiens
caaataagactt

SEQ ID NO: 3386487 - DNA, 13 bp, Homo sapiens
caaataagacttc

SEQ ID NO: 3386488 - DNA, 23 bp, Homo sapiens
caaataatgatcgaaaaaataat

SEQ ID NO: 3386489 - DNA, 16 bp, Homo sapiens
caaatacaaagtaaat

SEQ ID NO: 3386490 - DNA, 24 bp, Homo sapiens
caaatacaaagtaaatacaagact

SEQ ID NO: 3386491 - DNA, 15 bp, Homo sapiens
caaatacacatttca

SEQ ID NO: 3386492 - DNA, 17 bp, Homo sapiens
caaatacacatttgcta

SEQ ID NO: 3386493 - DNA, 22 bp, Homo sapiens
caaatacctccattaaatggtc

SEQ ID NO: 3386494 - DNA, 15 bp, Homo sapiens
caaatagcataagtt

SEQ ID NO: 3386495 - DNA, 20 bp, Homo sapiens
caaatagtttataaatgtga

SEQ ID NO: 3386496 - DNA, 17 bp, Homo sapiens
caaatataaaacttaca

SEQ ID NO: 3386497 - DNA, 21 bp, Homo sapiens
caaatataacaagtataatta

SEQ ID NO: 3386498 - DNA, 18 bp, Homo sapiens
caaatataagattttctg

SEQ ID NO: 3386499 - DNA, 17 bp, Homo sapiens
caaatatcttgtgttgt

SEQ ID NO: 3386500 - DNA, 21 bp, Homo sapiens
caaatatcttgtgttgtcctt

SEQ ID NO: 3386501 - DNA, 17 bp, Homo sapiens
caaatatgtcctggggt

SEQ ID NO: 3386502 - DNA, 13 bp, Homo sapiens
caaatatgttaaa

SEQ ID NO: 3386503 - DNA, 17 bp, Homo sapiens
caaatatgttaaagttt

SEQ ID NO: 3386504 - DNA, 12 bp, Homo sapiens
caaatattattt

SEQ ID NO: 3386505 - DNA, 21 bp, Homo sapiens
caaatattgccaactcttcta

SEQ ID NO: 3386506 - DNA, 12 bp, Homo sapiens
caaatatttatt

SEQ ID NO: 3386507 - DNA, 15 bp, Homo sapiens
caaatatttattttc

SEQ ID NO: 3386508 - DNA, 13 bp, Homo sapiens
caaatattttcat

SEQ ID NO: 3386509 - DNA, 14 bp, Homo sapiens
caaatattttcatg

SEQ ID NO: 3386510 - DNA, 16 bp, Homo sapiens
caaatcaaagcaaggg

SEQ ID NO: 3386511 - DNA, 15 bp, Homo sapiens
caaatcaacagaagc

SEQ ID NO: 3386512 - DNA, 19 bp, Homo sapiens
caaatcaacagaagcattt

SEQ ID NO: 3386513 - DNA, 17 bp, Homo sapiens
caaatcaatacactagt

SEQ ID NO: 3386514 - DNA, 16 bp, Homo sapiens
caaatcagctgctact

SEQ ID NO: 3386515 - DNA, 17 bp, Homo sapiens
caaatcagctgctacta

SEQ ID NO: 3386516 - DNA, 16 bp, Homo sapiens
caaatcagtgatctat

SEQ ID NO: 3386517 - DNA, 14 bp, Homo sapiens
caaatcccagggaa

SEQ ID NO: 3386518 - DNA, 18 bp, Homo sapiens
caaatcccagggaaggac

SEQ ID NO: 3386519 - DNA, 14 bp, Homo sapiens
caaatctaatctct

SEQ ID NO: 3386520 - DNA, 15 bp, Homo sapiens
caaatctaatctctt

SEQ ID NO: 3386521 - DNA, 14 bp, Homo sapiens
caaatctacagatc

SEQ ID NO: 3386522 - DNA, 14 bp, Homo sapiens
caaatctaccactg

SEQ ID NO: 3386523 - DNA, 20 bp, Homo sapiens
caaatctattcagacaagca

SEQ ID NO: 3386524 - DNA, 15 bp, Homo sapiens
caaatctgacatatt

SEQ ID NO: 3386525 - DNA, 13 bp, Homo sapiens
caaatctggaagc

SEQ ID NO: 3386526 - DNA, 20 bp, Homo sapiens
caaatctgggtatctttcca

SEQ ID NO: 3386527 - DNA, 12 bp, Homo sapiens
caaatctgtata

SEQ ID NO: 3386528 - DNA, 15 bp, Homo sapiens
caaatctgtgtatat

SEQ ID NO: 3386529 - DNA, 18 bp, Homo sapiens
caaatctgtgtatattat

SEQ ID NO: 3386530 - DNA, 19 bp, Homo sapiens
caaatctttaagaatagtt

SEQ ID NO: 3386531 - DNA, 22 bp, Homo sapiens
caaatgaatgttgtctgtttgt

SEQ ID NO: 3386532 - DNA, 18 bp, Homo sapiens
caaatgacagattctgac

SEQ ID NO: 3386533 - DNA, 19 bp, Homo sapiens
caaatgacagattctgaca

SEQ ID NO: 3386534 - DNA, 10 bp, Homo sapiens
caaatgacat

SEQ ID NO: 3386535 - DNA, 15 bp, Homo sapiens
caaatgacatgcact

SEQ ID NO: 3386536 - DNA, 16 bp, Homo sapiens
caaatgacatgcactg

SEQ ID NO: 3386537 - DNA, 19 bp, Homo sapiens
caaatgacatgcactgacc

SEQ ID NO: 3386538 - DNA, 22 bp, Homo sapiens
caaatgaccagcagattcaaat

SEQ ID NO: 3386539 - DNA, 20 bp, Homo sapiens
caaatgagatctaagccttt

SEQ ID NO: 3386540 - DNA, 20 bp, Homo sapiens
caaatgagctctgaaatctt

SEQ ID NO: 3386541 - DNA, 15 bp, Homo sapiens
caaatgagggagggg

SEQ ID NO: 3386542 - DNA, 18 bp, Homo sapiens
caaatgagtaacatttgc

SEQ ID NO: 3386543 - DNA, 9 bp, Homo sapiens
caaatgatg

SEQ ID NO: 3386544 - DNA, 12 bp, Homo sapiens
caaatgatttca

SEQ ID NO: 3386545 - DNA, 17 bp, Homo sapiens
caaatgcatgaacaagt

SEQ ID NO: 3386546 - DNA, 15 bp, Homo sapiens
caaatgccttgaact

SEQ ID NO: 3386547 - DNA, 16 bp, Homo sapiens
caaatggaggcttttc

SEQ ID NO: 3386548 - DNA, 18 bp, Homo sapiens
caaatggcgtctggaagt

SEQ ID NO: 3386549 - DNA, 22 bp, Homo sapiens
caaatggcgtctggaagtccaa

SEQ ID NO: 3386550 - DNA, 18 bp, Homo sapiens
caaatgggtgatatcctg

SEQ ID NO: 3386551 - DNA, 22 bp, Homo sapiens
caaatgggtgatatcctgaaaa

SEQ ID NO: 3386552 - DNA, 21 bp, Homo sapiens
caaatgtaattgaataaagtt

SEQ ID NO: 3386553 - DNA, 15 bp, Homo sapiens
caaatgtattttgaa

SEQ ID NO: 3386554 - DNA, 20 bp, Homo sapiens
caaatgtgtacatggcagag

SEQ ID NO: 3386555 - DNA, 22 bp, Homo sapiens
caaatgttctaagtttctaaga

SEQ ID NO: 3386556 - DNA, 23 bp, Homo sapiens
caaatgttctaagtttctaagat

SEQ ID NO: 3386557 - DNA, 22 bp, Homo sapiens
caaatgtttacagggagcctcc

SEQ ID NO: 3386558 - DNA, 19 bp, Homo sapiens
caaattaaaaaaaaattgt

SEQ ID NO: 3386559 - DNA, 18 bp, Homo sapiens
caaattaaaaagattctt

SEQ ID NO: 3386560 - DNA, 19 bp, Homo sapiens
caaattaaaaagattcttt

SEQ ID NO: 3386561 - DNA, 19 bp, Homo sapiens
caaattaaaacatatttca

SEQ ID NO: 3386562 - DNA, 20 bp, Homo sapiens
caaattaaaacatatttcat

SEQ ID NO: 3386563 - DNA, 21 bp, Homo sapiens
caaattaaaacatatttcatt

SEQ ID NO: 3386564 - DNA, 16 bp, Homo sapiens
caaattaataatctta

SEQ ID NO: 3386565 - DNA, 15 bp, Homo sapiens
caaattaatctttct

SEQ ID NO: 3386566 - DNA, 11 bp, Homo sapiens
caaattagaaa

SEQ ID NO: 3386567 - DNA, 13 bp, Homo sapiens
caaattagaaaat

SEQ ID NO: 3386568 - DNA, 23 bp, Homo sapiens
caaattagcaggtgcaccttctg

SEQ ID NO: 3386569 - DNA, 17 bp, Homo sapiens
caaattagccagacatg

SEQ ID NO: 3386570 - DNA, 15 bp, Homo sapiens
caaattagggcaatt

SEQ ID NO: 3386571 - DNA, 13 bp, Homo sapiens
caaattatatttg

SEQ ID NO: 3386572 - DNA, 14 bp, Homo sapiens
caaattatttgtgt

SEQ ID NO: 3386573 - DNA, 17 bp, Homo sapiens
caaattatttgtgtaat

SEQ ID NO: 3386574 - DNA, 19 bp, Homo sapiens
caaattcaaggccttccaa

SEQ ID NO: 3386575 - DNA, 14 bp, Homo sapiens
caaattcagtttca

SEQ ID NO: 3386576 - DNA, 15 bp, Homo sapiens
caaattcagtttcat

SEQ ID NO: 3386577 - DNA, 13 bp, Homo sapiens
caagaaaatcttt

SEQ ID NO: 3386578 - DNA, 22 bp, Homo sapiens
caagaaaattgcctttaaaact

SEQ ID NO: 3386579 - DNA, 12 bp, Homo sapiens
caagaaacagcc

SEQ ID NO: 3386580 - DNA, 19 bp, Homo sapiens
caagaaacgtgtcacactt

SEQ ID NO: 3386581 - DNA, 23 bp, Homo sapiens
caagaaacgtgtcacacttgtga

SEQ ID NO: 3386582 - DNA, 16 bp, Homo sapiens
caagaaaggttaagga

SEQ ID NO: 3386583 - DNA, 14 bp, Homo sapiens
caagaaatccctgt

SEQ ID NO: 3386584 - DNA, 15 bp, Homo sapiens
caagaaatccctgtt

SEQ ID NO: 3386585 - DNA, 16 bp, Homo sapiens
caagaactgcatggac

SEQ ID NO: 3386586 - DNA, 18 bp, Homo sapiens
caagaactgcatggacct

SEQ ID NO: 3386587 - DNA, 15 bp, Homo sapiens
caagaacttgtttac

SEQ ID NO: 3386588 - DNA, 16 bp, Homo sapiens
caagaacttgtttaca

SEQ ID NO: 3386589 - DNA, 18 bp, Homo sapiens
caagaagatcacgctccc

SEQ ID NO: 3386590 - DNA, 20 bp, Homo sapiens
caagaagctgcttctgccca

SEQ ID NO: 3386591 - DNA, 14 bp, Homo sapiens
caagaagtgaagaa

SEQ ID NO: 3386592 - DNA, 17 bp, Homo sapiens
caagaagtttattctca

SEQ ID NO: 3386593 - DNA, 17 bp, Homo sapiens
caagaataatcacgctt

SEQ ID NO: 3386594 - DNA, 22 bp, Homo sapiens
caagaataatcacgctttcctg

SEQ ID NO: 3386595 - DNA, 19 bp, Homo sapiens
caagaatccacatttctaa

SEQ ID NO: 3386596 - DNA, 22 bp, Homo sapiens
caagaatccacatttctaaaat

SEQ ID NO: 3386597 - DNA, 22 bp, Homo sapiens
caagaatggatcacaagatgga

SEQ ID NO: 3386598 - DNA, 13 bp, Homo sapiens
caagacaaatcaa

SEQ ID NO: 3386599 - DNA, 15 bp, Homo sapiens
caagacaaatcaaca

SEQ ID NO: 3386600 - DNA, 14 bp, Homo sapiens
caagacattgtcaa

SEQ ID NO: 3386601 - DNA, 13 bp, Homo sapiens
caagacccccagc

SEQ ID NO: 3386602 - DNA, 15 bp, Homo sapiens
caagacccctgtctt

SEQ ID NO: 3386603 - DNA, 14 bp, Homo sapiens
caagaccctgtctc

SEQ ID NO: 3386604 - DNA, 15 bp, Homo sapiens
caagaccctgtgttc

SEQ ID NO: 3386605 - DNA, 15 bp, Homo sapiens
caagacctaggctca

SEQ ID NO: 3386606 - DNA, 17 bp, Homo sapiens
caagacctcagtgcctt

SEQ ID NO: 3386607 - DNA, 22 bp, Homo sapiens
caagaccttggcctctccttgg

SEQ ID NO: 3386608 - DNA, 13 bp, Homo sapiens
caagacgaggggc

SEQ ID NO: 3386609 - DNA, 11 bp, Homo sapiens
caagactcctc

SEQ ID NO: 3386610 - DNA, 15 bp, Homo sapiens
caagactcctcaggc

SEQ ID NO: 3386611 - DNA, 21 bp, Homo sapiens
caagactctagagtccaaggt

SEQ ID NO: 3386612 - DNA, 15 bp, Homo sapiens
caagactctgtctca

SEQ ID NO: 3386613 - DNA, 16 bp, Homo sapiens
caagactgcaaacttt

SEQ ID NO: 3386614 - DNA, 18 bp, Homo sapiens
caagactgcaaacttttt

SEQ ID NO: 3386615 - DNA, 14 bp, Homo sapiens
caagactgttgctc

SEQ ID NO: 3386616 - DNA, 18 bp, Homo sapiens
caagactgttgctcaaat

SEQ ID NO: 3386617 - DNA, 23 bp, Homo sapiens
caagagaactcgcgctcagtaaa

SEQ ID NO: 3386618 - DNA, 24 bp, Homo sapiens
caagagaactcgcgctcagtaaac

SEQ ID NO: 3386619 - DNA, 22 bp, Homo sapiens
caagagaattgcttgaacccag

SEQ ID NO: 3386620 - DNA, 17 bp, Homo sapiens
caagagagaaagaagta

SEQ ID NO: 3386621 - DNA, 13 bp, Homo sapiens
caagagagatgtt

SEQ ID NO: 3386622 - DNA, 13 bp, Homo sapiens
caagagaggatga

SEQ ID NO: 3386623 - DNA, 24 bp, Homo sapiens
caagagagggccatgcaattcatc

SEQ ID NO: 3386624 - DNA, 22 bp, Homo sapiens
caagagcagagtctgggcctct

SEQ ID NO: 3386625 - DNA, 16 bp, Homo sapiens
caagagcagcctgtgg

SEQ ID NO: 3386626 - DNA, 20 bp, Homo sapiens
caagagcagcctgtggcatc

SEQ ID NO: 3386627 - DNA, 13 bp, Homo sapiens
caagagcccagca

SEQ ID NO: 3386628 - DNA, 17 bp, Homo sapiens
caagagcccccttgaca

SEQ ID NO: 3386629 - DNA, 22 bp, Homo sapiens
caagagccctgtggccgccacc

SEQ ID NO: 3386630 - DNA, 21 bp, Homo sapiens
caagagcctgatctcttcctg

SEQ ID NO: 3386631 - DNA, 23 bp, Homo sapiens
caagagcctgatctcttcctgtt

SEQ ID NO: 3386632 - DNA, 15 bp, Homo sapiens
caagaggactgagac

SEQ ID NO: 3386633 - DNA, 19 bp, Homo sapiens
caagaggcaagctgaaatt

SEQ ID NO: 3386634 - DNA, 20 bp, Homo sapiens
caagaggcaagctgaaattt

SEQ ID NO: 3386635 - DNA, 22 bp, Homo sapiens
caagaggccacttagggaaaga

SEQ ID NO: 3386636 - DNA, 20 bp, Homo sapiens
caagaggcctcatgcctgct

SEQ ID NO: 3386637 - DNA, 23 bp, Homo sapiens
caagaggcctcatgcctgctgag

SEQ ID NO: 3386638 - DNA, 17 bp, Homo sapiens
caagagggcactggtgg

SEQ ID NO: 3386639 - DNA, 14 bp, Homo sapiens
caagagggggtgga

SEQ ID NO: 3386640 - DNA, 21 bp, Homo sapiens
caagagggggtggaggggtgt

SEQ ID NO: 3386641 - DNA, 12 bp, Homo sapiens
caagagggtctg

SEQ ID NO: 3386642 - DNA, 17 bp, Homo sapiens
caagagggtctgaggaa

SEQ ID NO: 3386643 - DNA, 14 bp, Homo sapiens
caagaggtctgagc

SEQ ID NO: 3386644 - DNA, 20 bp, Homo sapiens
caagagtaactttactctgt

SEQ ID NO: 3386645 - DNA, 20 bp, Homo sapiens
caagagtctaatagtctttg

SEQ ID NO: 3386646 - DNA, 22 bp, Homo sapiens
caagagtggactgaatgtgcct

SEQ ID NO: 3386647 - DNA, 15 bp, Homo sapiens
caagataagcctgag

SEQ ID NO: 3386648 - DNA, 16 bp, Homo sapiens
caagatccatttgcct

SEQ ID NO: 3386649 - DNA, 17 bp, Homo sapiens
caagatccatttgcctt

SEQ ID NO: 3386650 - DNA, 14 bp, Homo sapiens
caagatctttcagg

SEQ ID NO: 3386651 - DNA, 16 bp, Homo sapiens
caagatgaaataattt

SEQ ID NO: 3386652 - DNA, 18 bp, Homo sapiens
caagatgaaggagaggca

SEQ ID NO: 3386653 - DNA, 16 bp, Homo sapiens
caagatgactggggtg

SEQ ID NO: 3386654 - DNA, 17 bp, Homo sapiens
caagatgactggggtgg

SEQ ID NO: 3386655 - DNA, 19 bp, Homo sapiens
caagatggaatttatcaaa

SEQ ID NO: 3386656 - DNA, 17 bp, Homo sapiens
caagatgtcagactggc

SEQ ID NO: 3386657 - DNA, 23 bp, Homo sapiens
caagatttaacactaaaaaggtt

SEQ ID NO: 3386658 - DNA, 15 bp, Homo sapiens
caagatttagaaaaa

SEQ ID NO: 3386659 - DNA, 15 bp, Homo sapiens
caagatttgtaatta

SEQ ID NO: 3386660 - DNA, 17 bp, Homo sapiens
caagatttgtaattaca

SEQ ID NO: 3386661 - DNA, 19 bp, Homo sapiens
caagatttgtaattacagg

SEQ ID NO: 3386662 - DNA, 15 bp, Homo sapiens
caagattttaaaagt

SEQ ID NO: 3386663 - DNA, 18 bp, Homo sapiens
caagcaaacatcaaataa

SEQ ID NO: 3386664 - DNA, 19 bp, Homo sapiens
caagcaaaggtgaagagac

SEQ ID NO: 3386665 - DNA, 17 bp, Homo sapiens
caagcaacctgggtcca

SEQ ID NO: 3386666 - DNA, 22 bp, Homo sapiens
caagcaagctctcttgccgagg

SEQ ID NO: 3386667 - DNA, 17 bp, Homo sapiens
caagcacatctgcattt

SEQ ID NO: 3386668 - DNA, 20 bp, Homo sapiens
caagcacatctgcattttca

SEQ ID NO: 3386669 - DNA, 13 bp, Homo sapiens
caagcacatgtaa

SEQ ID NO: 3386670 - DNA, 19 bp, Homo sapiens
caagcacctccaaccaaat

SEQ ID NO: 3386671 - DNA, 18 bp, Homo sapiens
caagcacctcctgcctcg

SEQ ID NO: 3386672 - DNA, 22 bp, Homo sapiens
caagcactaaaaagttgaacca

SEQ ID NO: 3386673 - DNA, 18 bp, Homo sapiens
caagcactattttatatt

SEQ ID NO: 3386674 - DNA, 20 bp, Homo sapiens
caagcactattttatattta

SEQ ID NO: 3386675 - DNA, 11 bp, Homo sapiens
caagcactgat

SEQ ID NO: 3386676 - DNA, 15 bp, Homo sapiens
caagcactgatatct

SEQ ID NO: 3386677 - DNA, 20 bp, Homo sapiens
caagcagaggtggccagagc

SEQ ID NO: 3386678 - DNA, 18 bp, Homo sapiens
caagcagagtgcacagct

SEQ ID NO: 3386679 - DNA, 21 bp, Homo sapiens
caagcagagtgcacagctgtc

SEQ ID NO: 3386680 - DNA, 14 bp, Homo sapiens
caagcagccagcca

SEQ ID NO: 3386681 - DNA, 17 bp, Homo sapiens
caagcagccagccagtc

SEQ ID NO: 3386682 - DNA, 14 bp, Homo sapiens
caagcagcccttgc

SEQ ID NO: 3386683 - DNA, 16 bp, Homo sapiens
caagcaggaagttcaa

SEQ ID NO: 3386684 - DNA, 16 bp, Homo sapiens
caagcaggaattatgt

SEQ ID NO: 3386685 - DNA, 15 bp, Homo sapiens
caagcaggacctggc

SEQ ID NO: 3386686 - DNA, 19 bp, Homo sapiens
caagcaggacctggcatca

SEQ ID NO: 3386687 - DNA, 13 bp, Homo sapiens
caagcaggagacg

SEQ ID NO: 3386688 - DNA, 19 bp, Homo sapiens
caagcaggagacgacaggc

SEQ ID NO: 3386689 - DNA, 19 bp, Homo sapiens
caagcaggcgctgtgctat

SEQ ID NO: 3386690 - DNA, 17 bp, Homo sapiens
caagcatgcagctttgc

SEQ ID NO: 3386691 - DNA, 15 bp, Homo sapiens
caagccaacttgtaa

SEQ ID NO: 3386692 - DNA, 20 bp, Homo sapiens
caagccaacttgtaaataca

SEQ ID NO: 3386693 - DNA, 21 bp, Homo sapiens
caagccaagggaacctgtgtc

SEQ ID NO: 3386694 - DNA, 17 bp, Homo sapiens
caagcccaaatttaatt

SEQ ID NO: 3386695 - DNA, 22 bp, Homo sapiens
caagcccacagcacagctccct

SEQ ID NO: 3386696 - DNA, 14 bp, Homo sapiens
caagcccaggtgcc

SEQ ID NO: 3386697 - DNA, 22 bp, Homo sapiens
caagccccagcagccctcaaca

SEQ ID NO: 3386698 - DNA, 15 bp, Homo sapiens
caagccccagggcct

SEQ ID NO: 3386699 - DNA, 14 bp, Homo sapiens
caagccccccgagt

SEQ ID NO: 3386700 - DNA, 19 bp, Homo sapiens
caagccctgaggcctgagg

SEQ ID NO: 3386701 - DNA, 20 bp, Homo sapiens
caagccctgaggcctgaggc

SEQ ID NO: 3386702 - DNA, 11 bp, Homo sapiens
caagccctggc

SEQ ID NO: 3386703 - DNA, 14 bp, Homo sapiens
caatgatggtcacc

SEQ ID NO: 3386704 - DNA, 14 bp, Homo sapiens
caatgatgtccaga

SEQ ID NO: 3386705 - DNA, 13 bp, Homo sapiens
caatgattatttt

SEQ ID NO: 3386706 - DNA, 20 bp, Homo sapiens
caatgattattttcattaca

SEQ ID NO: 3386707 - DNA, 22 bp, Homo sapiens
caatgattgttaatttacagct

SEQ ID NO: 3386708 - DNA, 14 bp, Homo sapiens
caatgcaactttta

SEQ ID NO: 3386709 - DNA, 18 bp, Homo sapiens
caatgcacatccattccc

SEQ ID NO: 3386710 - DNA, 14 bp, Homo sapiens
caatgcactgacat

SEQ ID NO: 3386711 - DNA, 13 bp, Homo sapiens
caatgcagcaagg

SEQ ID NO: 3386712 - DNA, 20 bp, Homo sapiens
caatgcagcaaggccctgct

SEQ ID NO: 3386713 - DNA, 17 bp, Homo sapiens
caatgcatagagccctg

SEQ ID NO: 3386714 - DNA, 20 bp, Homo sapiens
caatgcatagagccctggcc

SEQ ID NO: 3386715 - DNA, 20 bp, Homo sapiens
caatgcattgtcttgtggag

SEQ ID NO: 3386716 - DNA, 14 bp, Homo sapiens
caatgccaagataa

SEQ ID NO: 3386717 - DNA, 13 bp, Homo sapiens
caatgcctggaga

SEQ ID NO: 3386718 - DNA, 19 bp, Homo sapiens
caatgctgctccaccctcc

SEQ ID NO: 3386719 - DNA, 20 bp, Homo sapiens
caatgctgctccaccctccc

SEQ ID NO: 3386720 - DNA, 20 bp, Homo sapiens
caatgctggctgttggctgg

SEQ ID NO: 3386721 - DNA, 21 bp, Homo sapiens
caatgctggctgttggctggg

SEQ ID NO: 3386722 - DNA, 17 bp, Homo sapiens
caatgctgttgtaaaca

SEQ ID NO: 3386723 - DNA, 18 bp, Homo sapiens
caatgctgttgtaaacaa

SEQ ID NO: 3386724 - DNA, 15 bp, Homo sapiens
caatgcttctgtagc

SEQ ID NO: 3386725 - DNA, 17 bp, Homo sapiens
caatgcttctgtagctt

SEQ ID NO: 3386726 - DNA, 20 bp, Homo sapiens
caatgcttctgtagcttcta

SEQ ID NO: 3386727 - DNA, 18 bp, Homo sapiens
caatgctttgggaggcca

SEQ ID NO: 3386728 - DNA, 19 bp, Homo sapiens
caatgctttgggaggccaa

SEQ ID NO: 3386729 - DNA, 20 bp, Homo sapiens
caatgctttgggaggccaag

SEQ ID NO: 3386730 - DNA, 13 bp, Homo sapiens
caatggaaacaat

SEQ ID NO: 3386731 - DNA, 14 bp, Homo sapiens
caatggaagatttg

SEQ ID NO: 3386732 - DNA, 17 bp, Homo sapiens
caatggaagatttgccc

SEQ ID NO: 3386733 - DNA, 21 bp, Homo sapiens
caatggacctctcagcagaaa

SEQ ID NO: 3386734 - DNA, 23 bp, Homo sapiens
caatggacctctcagcagaaaca

SEQ ID NO: 3386735 - DNA, 19 bp, Homo sapiens
caatggatttgatgctgtt

SEQ ID NO: 3386736 - DNA, 22 bp, Homo sapiens
caatggatttgatgctgtttga

SEQ ID NO: 3386737 - DNA, 13 bp, Homo sapiens
caatggcagcctt

SEQ ID NO: 3386738 - DNA, 14 bp, Homo sapiens
caatggcagccttg

SEQ ID NO: 3386739 - DNA, 17 bp, Homo sapiens
caatggcagctagactg

SEQ ID NO: 3386740 - DNA, 20 bp, Homo sapiens
caatggcagctagactggag

SEQ ID NO: 3386741 - DNA, 23 bp, Homo sapiens
caatggcagctagactggagtga

SEQ ID NO: 3386742 - DNA, 21 bp, Homo sapiens
caatggcctaaaactggcctg

SEQ ID NO: 3386743 - DNA, 15 bp, Homo sapiens
caatggctttttaaa

SEQ ID NO: 3386744 - DNA, 16 bp, Homo sapiens
caatgggctcttccaa

SEQ ID NO: 3386745 - DNA, 21 bp, Homo sapiens
caatggtgatcctctattttg

SEQ ID NO: 3386746 - DNA, 11 bp, Homo sapiens
caatgtataaa

SEQ ID NO: 3386747 - DNA, 17 bp, Homo sapiens
caatgtataaagattgt

SEQ ID NO: 3386748 - DNA, 17 bp, Homo sapiens
caatgtatcccttctca

SEQ ID NO: 3386749 - DNA, 18 bp, Homo sapiens
caatgtcacaacctctct

SEQ ID NO: 3386750 - DNA, 22 bp, Homo sapiens
caatgtcacaacctctctgatc

SEQ ID NO: 3386751 - DNA, 21 bp, Homo sapiens
caatgtcagtatttcagtgta

SEQ ID NO: 3386752 - DNA, 15 bp, Homo sapiens
caatgtctgagtgaa

SEQ ID NO: 3386753 - DNA, 20 bp, Homo sapiens
caatgtctgagtgaacctgt

SEQ ID NO: 3386754 - DNA, 14 bp, Homo sapiens
caatgtgaaaaatc

SEQ ID NO: 3386755 - DNA, 21 bp, Homo sapiens
caatgtgaatagtcatctcct

SEQ ID NO: 3386756 - DNA, 12 bp, Homo sapiens
caatgtgcagtg

SEQ ID NO: 3386757 - DNA, 23 bp, Homo sapiens
caatgtgctactgattgtttcat

SEQ ID NO: 3386758 - DNA, 23 bp, Homo sapiens
caatgtggcaaggaaaaacaggt

SEQ ID NO: 3386759 - DNA, 15 bp, Homo sapiens
caatgtgtataaatt

SEQ ID NO: 3386760 - DNA, 14 bp, Homo sapiens
caatgtgtttttct

SEQ ID NO: 3386761 - DNA, 17 bp, Homo sapiens
caatgtgtttttctcca

SEQ ID NO: 3386762 - DNA, 14 bp, Homo sapiens
caatgttcattgta

SEQ ID NO: 3386763 - DNA, 22 bp, Homo sapiens
caatgttcattgtaatgttact

SEQ ID NO: 3386764 - DNA, 23 bp, Homo sapiens
caatgttcattgtaatgttactg

SEQ ID NO: 3386765 - DNA, 18 bp, Homo sapiens
caatgttctttgtctcaa

SEQ ID NO: 3386766 - DNA, 17 bp, Homo sapiens
caattaaaggtcctgcc

SEQ ID NO: 3386767 - DNA, 12 bp, Homo sapiens
caattaaagtct

SEQ ID NO: 3386768 - DNA, 22 bp, Homo sapiens
caattaaatgtaggtatgaata

SEQ ID NO: 3386769 - DNA, 13 bp, Homo sapiens
caattaaatttat

SEQ ID NO: 3386770 - DNA, 15 bp, Homo sapiens
caattaagttacaat

SEQ ID NO: 3386771 - DNA, 18 bp, Homo sapiens
caattaataaaaaatgga

SEQ ID NO: 3386772 - DNA, 22 bp, Homo sapiens
caattaatagtttgtctatttt

SEQ ID NO: 3386773 - DNA, 18 bp, Homo sapiens
caattacagggtgactca

SEQ ID NO: 3386774 - DNA, 16 bp, Homo sapiens
caattacatctctaat

SEQ ID NO: 3386775 - DNA, 22 bp, Homo sapiens
caattacatctctaattttgga

SEQ ID NO: 3386776 - DNA, 15 bp, Homo sapiens
caattactcaggttt

SEQ ID NO: 3386777 - DNA, 15 bp, Homo sapiens
caattagcattctgt

SEQ ID NO: 3386778 - DNA, 20 bp, Homo sapiens
caattaggaagtgtaacagc

SEQ ID NO: 3386779 - DNA, 16 bp, Homo sapiens
caattaggattttgat

SEQ ID NO: 3386780 - DNA, 20 bp, Homo sapiens
caattataacttattagcag

SEQ ID NO: 3386781 - DNA, 15 bp, Homo sapiens
caattatagtttctg

SEQ ID NO: 3386782 - DNA, 15 bp, Homo sapiens
caattattaaattgt

SEQ ID NO: 3386783 - DNA, 22 bp, Homo sapiens
caattattaaattgtgtacact

SEQ ID NO: 3386784 - DNA, 20 bp, Homo sapiens
caattattgatatatattat

SEQ ID NO: 3386785 - DNA, 22 bp, Homo sapiens
caattattgttacacattaagt

SEQ ID NO: 3386786 - DNA, 19 bp, Homo sapiens
caattcagtgacttaatat

SEQ ID NO: 3386787 - DNA, 15 bp, Homo sapiens
caattcattggctcc

SEQ ID NO: 3386788 - DNA, 16 bp, Homo sapiens
caattcattggctcct

SEQ ID NO: 3386789 - DNA, 10 bp, Homo sapiens
caattccaat

SEQ ID NO: 3386790 - DNA, 22 bp, Homo sapiens
caattccgtcttcttaatctga

SEQ ID NO: 3386791 - DNA, 13 bp, Homo sapiens
caattcctgggcc

SEQ ID NO: 3386792 - DNA, 23 bp, Homo sapiens
caattctcatttgtcacacactt

SEQ ID NO: 3386793 - DNA, 15 bp, Homo sapiens
caattgaatggtcag

SEQ ID NO: 3386794 - DNA, 16 bp, Homo sapiens
caattgacaaatgatg

SEQ ID NO: 3386795 - DNA, 16 bp, Homo sapiens
caattgcactgctgtt

SEQ ID NO: 3386796 - DNA, 12 bp, Homo sapiens
caattgccctgt

SEQ ID NO: 3386797 - DNA, 20 bp, Homo sapiens
caattgcttactcattaaaa

SEQ ID NO: 3386798 - DNA, 16 bp, Homo sapiens
caattggcagtgactt

SEQ ID NO: 3386799 - DNA, 18 bp, Homo sapiens
caattggcagtgactttg

SEQ ID NO: 3386800 - DNA, 17 bp, Homo sapiens
caattgtcatttataaa

SEQ ID NO: 3386801 - DNA, 16 bp, Homo sapiens
caattgtgtagccttt

SEQ ID NO: 3386802 - DNA, 24 bp, Homo sapiens
caattgttgacagttctgaagaat

SEQ ID NO: 3386803 - DNA, 17 bp, Homo sapiens
caattgtttttgttgtg

SEQ ID NO: 3386804 - DNA, 13 bp, Homo sapiens
caatttattctga

SEQ ID NO: 3386805 - DNA, 16 bp, Homo sapiens
caatttcaaggttcta

SEQ ID NO: 3386806 - DNA, 12 bp, Homo sapiens
caatttcctggc

SEQ ID NO: 3386807 - DNA, 13 bp, Homo sapiens
caatttcctggcc

SEQ ID NO: 3386808 - DNA, 15 bp, Homo sapiens
caatttcctttatat

SEQ ID NO: 3386809 - DNA, 20 bp, Homo sapiens
caatttcctttatatttagt

SEQ ID NO: 3386810 - DNA, 17 bp, Homo sapiens
caatttcggattttttc

SEQ ID NO: 3386811 - DNA, 22 bp, Homo sapiens
caatttctgtgttgccaagctc

SEQ ID NO: 3386812 - DNA, 13 bp, Homo sapiens
caatttcttcctt

SEQ ID NO: 3386813 - DNA, 17 bp, Homo sapiens
caatttcttttatgtta

SEQ ID NO: 3386814 - DNA, 21 bp, Homo sapiens
caatttggatttaaaagcctg

SEQ ID NO: 3386815 - DNA, 21 bp, Homo sapiens
caatttggtaaaaatgctgct

SEQ ID NO: 3386816 - DNA, 19 bp, Homo sapiens
caatttgttaattcctatg

SEQ ID NO: 3386817 - DNA, 21 bp, Homo sapiens
caatttgttaattcctatgaa

SEQ ID NO: 3386818 - DNA, 22 bp, Homo sapiens
caatttgttaattcctatgaag

SEQ ID NO: 3386819 - DNA, 15 bp, Homo sapiens
caattttctttgttt

SEQ ID NO: 3386820 - DNA, 11 bp, Homo sapiens
caattttgtaa

SEQ ID NO: 3386821 - DNA, 14 bp, Homo sapiens
caatttttaataaa

SEQ ID NO: 3386822 - DNA, 13 bp, Homo sapiens
caatttttatttc

SEQ ID NO: 3386823 - DNA, 11 bp, Homo sapiens
caatttttcca

SEQ ID NO: 3386824 - DNA, 16 bp, Homo sapiens
caatttttttttgtta

SEQ ID NO: 3386825 - DNA, 18 bp, Homo sapiens
cacaaaagtttctctttt

SEQ ID NO: 3386826 - DNA, 15 bp, Homo sapiens
cacaaaatatacaaa

SEQ ID NO: 3386827 - DNA, 15 bp, Homo sapiens
cacaaaatctgtcca

SEQ ID NO: 3386828 - DNA, 21 bp, Homo sapiens
cacaaacaggaatgtctggag

SEQ ID NO: 3386829 - DNA, 13 bp, Homo sapiens
caccagtgtcccc

SEQ ID NO: 3386830 - DNA, 18 bp, Homo sapiens
caccagtgtggggttctg

SEQ ID NO: 3386831 - DNA, 22 bp, Homo sapiens
caccagttaaaagcattttaat

SEQ ID NO: 3386832 - DNA, 15 bp, Homo sapiens
caccataacctctgg

SEQ ID NO: 3386833 - DNA, 13 bp, Homo sapiens
caccatatgaatt

SEQ ID NO: 3386834 - DNA, 20 bp, Homo sapiens
caccatatgaattgtacaga

SEQ ID NO: 3386835 - DNA, 20 bp, Homo sapiens
caccatcctgcagcctcctc

SEQ ID NO: 3386836 - DNA, 11 bp, Homo sapiens
caccatctctt

SEQ ID NO: 3386837 - DNA, 15 bp, Homo sapiens
caccatgggaaactg

SEQ ID NO: 3386838 - DNA, 23 bp, Homo sapiens
caccatgggaaactgttgtgggc

SEQ ID NO: 3386839 - DNA, 17 bp, Homo sapiens
caccatgtgagctcttc

SEQ ID NO: 3386840 - DNA, 19 bp, Homo sapiens
caccatgtgggcacggagg

SEQ ID NO: 3386841 - DNA, 15 bp, Homo sapiens
caccattcctgcctt

SEQ ID NO: 3386842 - DNA, 22 bp, Homo sapiens
caccattcctgcctttaagcca

SEQ ID NO: 3386843 - DNA, 14 bp, Homo sapiens
caccattcctggaa

SEQ ID NO: 3386844 - DNA, 23 bp, Homo sapiens
caccattcctggaaaccacagtc

SEQ ID NO: 3386845 - DNA, 14 bp, Homo sapiens
caccattctcctgc

SEQ ID NO: 3386846 - DNA, 15 bp, Homo sapiens
caccattctcctgcc

SEQ ID NO: 3386847 - DNA, 13 bp, Homo sapiens
caccattctgact

SEQ ID NO: 3386848 - DNA, 14 bp, Homo sapiens
caccattctgactc

SEQ ID NO: 3386849 - DNA, 14 bp, Homo sapiens
caccattgaaggct

SEQ ID NO: 3386850 - DNA, 15 bp, Homo sapiens
caccattgaaggctt

SEQ ID NO: 3386851 - DNA, 21 bp, Homo sapiens
caccattgtgaagcacctact

SEQ ID NO: 3386852 - DNA, 22 bp, Homo sapiens
cacccaaaacacgcacaccctg

SEQ ID NO: 3386853 - DNA, 18 bp, Homo sapiens
cacccaaagcatggacta

SEQ ID NO: 3386854 - DNA, 24 bp, Homo sapiens
cacccaaccctatctcctgacaga

SEQ ID NO: 3386855 - DNA, 14 bp, Homo sapiens
cacccaactactga

SEQ ID NO: 3386856 - DNA, 19 bp, Homo sapiens
cacccaagagattgttgtt

SEQ ID NO: 3386857 - DNA, 14 bp, Homo sapiens
cacccaagcctgct

SEQ ID NO: 3386858 - DNA, 17 bp, Homo sapiens
cacccaagcctgctggc

SEQ ID NO: 3386859 - DNA, 19 bp, Homo sapiens
cacccacaatcccacctag

SEQ ID NO: 3386860 - DNA, 21 bp, Homo sapiens
cacccacatgtgacacatatg

SEQ ID NO: 3386861 - DNA, 15 bp, Homo sapiens
cacccaccagggcga

SEQ ID NO: 3386862 - DNA, 16 bp, Homo sapiens
cacccaccctgtgcca

SEQ ID NO: 3386863 - DNA, 16 bp, Homo sapiens
cacccacctccaccca

SEQ ID NO: 3386864 - DNA, 17 bp, Homo sapiens
cacccacctccacccag

SEQ ID NO: 3386865 - DNA, 18 bp, Homo sapiens
cacccactcaccagggtc

SEQ ID NO: 3386866 - DNA, 14 bp, Homo sapiens
cacccactcaggat

SEQ ID NO: 3386867 - DNA, 12 bp, Homo sapiens
cacccagcctca

SEQ ID NO: 3386868 - DNA, 19 bp, Homo sapiens
cacccagcctcagtcctcc

SEQ ID NO: 3386869 - DNA, 22 bp, Homo sapiens
cacccagcctcagtcctcccct

SEQ ID NO: 3386870 - DNA, 18 bp, Homo sapiens
cacccaggaactcctgac

SEQ ID NO: 3386871 - DNA, 20 bp, Homo sapiens
cacccaggagccccgaggcc

SEQ ID NO: 3386872 - DNA, 23 bp, Homo sapiens
cacccaggagccccgaggccttc

SEQ ID NO: 3386873 - DNA, 11 bp, Homo sapiens
cacccaggagg

SEQ ID NO: 3386874 - DNA, 12 bp, Homo sapiens
cacccaggctgc

SEQ ID NO: 3386875 - DNA, 13 bp, Homo sapiens
cacccaggctgca

SEQ ID NO: 3386876 - DNA, 15 bp, Homo sapiens
cacccaggctgcact

SEQ ID NO: 3386877 - DNA, 16 bp, Homo sapiens
cacccaggctgcactg

SEQ ID NO: 3386878 - DNA, 17 bp, Homo sapiens
cacccaggctgcactgc

SEQ ID NO: 3386879 - DNA, 21 bp, Homo sapiens
cacccaggctgcactgcagtg

SEQ ID NO: 3386880 - DNA, 13 bp, Homo sapiens
cacccagtgctgc

SEQ ID NO: 3386881 - DNA, 15 bp, Homo sapiens
cacccagtgctgcca

SEQ ID NO: 3386882 - DNA, 18 bp, Homo sapiens
cacccagtgctgccatgc

SEQ ID NO: 3386883 - DNA, 23 bp, Homo sapiens
cacccagtgctgccatgccactg

SEQ ID NO: 3386884 - DNA, 17 bp, Homo sapiens
cacccataatcctttct

SEQ ID NO: 3386885 - DNA, 19 bp, Homo sapiens
cacccatcttcctgctgct

SEQ ID NO: 3386886 - DNA, 14 bp, Homo sapiens
cacccatgaagaca

SEQ ID NO: 3386887 - DNA, 22 bp, Homo sapiens
cacccatgaagacaggacagtg

SEQ ID NO: 3386888 - DNA, 22 bp, Homo sapiens
cacccattcccccatgtggctg

SEQ ID NO: 3386889 - DNA, 19 bp, Homo sapiens
caccccaaagctttcctgc

SEQ ID NO: 3386890 - DNA, 12 bp, Homo sapiens
caccccaagaga

SEQ ID NO: 3386891 - DNA, 21 bp, Homo sapiens
caccccaagtagtctgctcac

SEQ ID NO: 3386892 - DNA, 15 bp, Homo sapiens
caccccacaccccag

SEQ ID NO: 3386893 - DNA, 11 bp, Homo sapiens
caccccacact

SEQ ID NO: 3386894 - DNA, 15 bp, Homo sapiens
caccccacagaacct

SEQ ID NO: 3386895 - DNA, 10 bp, Homo sapiens
caccccaccc

SEQ ID NO: 3386896 - DNA, 16 bp, Homo sapiens
caccccaccccacccc

SEQ ID NO: 3386897 - DNA, 14 bp, Homo sapiens
caccccacccttcc

SEQ ID NO: 3386898 - DNA, 12 bp, Homo sapiens
caccccacctgc

SEQ ID NO: 3386899 - DNA, 15 bp, Homo sapiens
caccccacgcccgca

SEQ ID NO: 3386900 - DNA, 12 bp, Homo sapiens
caccccactcta

SEQ ID NO: 3386901 - DNA, 18 bp, Homo sapiens
caccccagcccaccctgc

SEQ ID NO: 3386902 - DNA, 18 bp, Homo sapiens
caccccaggcccttcagg

SEQ ID NO: 3386903 - DNA, 17 bp, Homo sapiens
caccccatgccaaagct

SEQ ID NO: 3386904 - DNA, 14 bp, Homo sapiens
cacccccaagcctg

SEQ ID NO: 3386905 - DNA, 15 bp, Homo sapiens
cacccccaagcctgg

SEQ ID NO: 3386906 - DNA, 19 bp, Homo sapiens
cacccccacaagctgtccc

SEQ ID NO: 3386907 - DNA, 17 bp, Homo sapiens
cacccccacccacctcc

SEQ ID NO: 3386908 - DNA, 14 bp, Homo sapiens
cacccccaccccca

SEQ ID NO: 3386909 - DNA, 14 bp, Homo sapiens
cacccccagccagg

SEQ ID NO: 3386910 - DNA, 15 bp, Homo sapiens
cacccccagccaggc

SEQ ID NO: 3386911 - DNA, 17 bp, Homo sapiens
cacccccagccaggcta

SEQ ID NO: 3386912 - DNA, 12 bp, Homo sapiens
cacccccagctt

SEQ ID NO: 3386913 - DNA, 15 bp, Homo sapiens
caccccccaagctgt

SEQ ID NO: 3386914 - DNA, 16 bp, Homo sapiens
caccccctcctggcaa

SEQ ID NO: 3386915 - DNA, 16 bp, Homo sapiens
caccccctgccctgca

SEQ ID NO: 3386916 - DNA, 22 bp, Homo sapiens
caccccctgctccaccagcagc

SEQ ID NO: 3386917 - DNA, 12 bp, Homo sapiens
cacccccttccc

SEQ ID NO: 3386918 - DNA, 13 bp, Homo sapiens
cacccccttctct

SEQ ID NO: 3386919 - DNA, 18 bp, Homo sapiens
cacccccttctctgctcc

SEQ ID NO: 3386920 - DNA, 12 bp, Homo sapiens
caccccctttcc

SEQ ID NO: 3386921 - DNA, 19 bp, Homo sapiens
caccccgctgtaagctcct

SEQ ID NO: 3386922 - DNA, 22 bp, Homo sapiens
caccccgctgtaagctcctttg

SEQ ID NO: 3386923 - DNA, 16 bp, Homo sapiens
caccccggcaggccct

SEQ ID NO: 3386924 - DNA, 14 bp, Homo sapiens
caccccggcctcag

SEQ ID NO: 3386925 - DNA, 17 bp, Homo sapiens
caccccggcctcagggc

SEQ ID NO: 3386926 - DNA, 19 bp, Homo sapiens
caccccggcctcagggcgc

SEQ ID NO: 3386927 - DNA, 18 bp, Homo sapiens
caccccggcctccactcc

SEQ ID NO: 3386928 - DNA, 18 bp, Homo sapiens
caccccggggaccctgtg

SEQ ID NO: 3386929 - DNA, 14 bp, Homo sapiens
cacccctaaagaga

SEQ ID NO: 3386930 - DNA, 15 bp, Homo sapiens
cacccctaaagagat

SEQ ID NO: 3386931 - DNA, 20 bp, Homo sapiens
cacccctaagtgcccaaagt

SEQ ID NO: 3386932 - DNA, 17 bp, Homo sapiens
cacccctcactctggcc

SEQ ID NO: 3386933 - DNA, 22 bp, Homo sapiens
cacccctccagaacacggctca

SEQ ID NO: 3386934 - DNA, 13 bp, Homo sapiens
cacccctcccatt

SEQ ID NO: 3386935 - DNA, 13 bp, Homo sapiens
cacccctccccag

SEQ ID NO: 3386936 - DNA, 17 bp, Homo sapiens
cacccctcgccaccttt

SEQ ID NO: 3386937 - DNA, 18 bp, Homo sapiens
cacccctcgccacctttc

SEQ ID NO: 3386938 - DNA, 11 bp, Homo sapiens
cacccctgcac

SEQ ID NO: 3386939 - DNA, 13 bp, Homo sapiens
cacccctgccccc

SEQ ID NO: 3386940 - DNA, 14 bp, Homo sapiens
cacccctgggcagg

SEQ ID NO: 3386941 - DNA, 16 bp, Homo sapiens
cacccctgggcaggcg

SEQ ID NO: 3386942 - DNA, 20 bp, Homo sapiens
cacccctgtcctcactgctc

SEQ ID NO: 3386943 - DNA, 22 bp, Homo sapiens
cacccctgtgctccgtgcctcc

SEQ ID NO: 3386944 - DNA, 17 bp, Homo sapiens
caccccttaggccccgt

SEQ ID NO: 3386945 - DNA, 19 bp, Homo sapiens
caccccttaggccccgtgg

SEQ ID NO: 3386946 - DNA, 19 bp, Homo sapiens
caccccttccccaggccca

SEQ ID NO: 3386947 - DNA, 12 bp, Homo sapiens
caccccttctct

SEQ ID NO: 3386948 - DNA, 15 bp, Homo sapiens
cacccctttctagtt

SEQ ID NO: 3386949 - DNA, 22 bp, Homo sapiens
cacccctttctagttcaatgcc

SEQ ID NO: 3386950 - DNA, 16 bp, Homo sapiens
cacccgactcctcaaa

SEQ ID NO: 3386951 - DNA, 14 bp, Homo sapiens
cacccgaggggggc

SEQ ID NO: 3386952 - DNA, 16 bp, Homo sapiens
cacccgaggggggccc

SEQ ID NO: 3386953 - DNA, 15 bp, Homo sapiens
cacccgatgctgctt

SEQ ID NO: 3386954 - DNA, 21 bp, Homo sapiens
cacccgccgcctcccacggca

SEQ ID NO: 3386955 - DNA, 13 bp, Homo sapiens
cacccggcccctg

SEQ ID NO: 3386956 - DNA, 17 bp, Homo sapiens
cactagttttgtgccag

SEQ ID NO: 3386957 - DNA, 12 bp, Homo sapiens
cactataaatgg

SEQ ID NO: 3386958 - DNA, 19 bp, Homo sapiens
cactataaatggtgttttt

SEQ ID NO: 3386959 - DNA, 20 bp, Homo sapiens
cactatatgatcagtgttac

SEQ ID NO: 3386960 - DNA, 20 bp, Homo sapiens
cactatcccaatcaaagaat

SEQ ID NO: 3386961 - DNA, 21 bp, Homo sapiens
cactatggtatgctggccagc

SEQ ID NO: 3386962 - DNA, 15 bp, Homo sapiens
cactattttatattt

SEQ ID NO: 3386963 - DNA, 12 bp, Homo sapiens
cactattttcag

SEQ ID NO: 3386964 - DNA, 14 bp, Homo sapiens
cactattttcagaa

SEQ ID NO: 3386965 - DNA, 16 bp, Homo sapiens
cactattttcagaatc

SEQ ID NO: 3386966 - DNA, 17 bp, Homo sapiens
cactattttcagaatct

SEQ ID NO: 3386967 - DNA, 21 bp, Homo sapiens
cactattttcagaatctgaat

SEQ ID NO: 3386968 - DNA, 22 bp, Homo sapiens
cactatttttatttatattttt

SEQ ID NO: 3386969 - DNA, 23 bp, Homo sapiens
cactatttttatttatatttttg

SEQ ID NO: 3386970 - DNA, 16 bp, Homo sapiens
cactcaaattaatctt

SEQ ID NO: 3386971 - DNA, 20 bp, Homo sapiens
cactcaaattaatctttctt

SEQ ID NO: 3386972 - DNA, 18 bp, Homo sapiens
cactcaactctgagccca

SEQ ID NO: 3386973 - DNA, 15 bp, Homo sapiens
cactcaagcactgat

SEQ ID NO: 3386974 - DNA, 19 bp, Homo sapiens
cactcacatttattctgct

SEQ ID NO: 3386975 - DNA, 16 bp, Homo sapiens
cactcacattttctca

SEQ ID NO: 3386976 - DNA, 15 bp, Homo sapiens
cactcaccagggtcc

SEQ ID NO: 3386977 - DNA, 22 bp, Homo sapiens
cactcaccagggtccgcaccag

SEQ ID NO: 3386978 - DNA, 14 bp, Homo sapiens
cactcaccatgaag

SEQ ID NO: 3386979 - DNA, 21 bp, Homo sapiens
cactcaccccctttgctgtga

SEQ ID NO: 3386980 - DNA, 22 bp, Homo sapiens
cactcactaggcccccacttgc

SEQ ID NO: 3386981 - DNA, 19 bp, Homo sapiens
cactcagaagacactgatg

SEQ ID NO: 3386982 - DNA, 22 bp, Homo sapiens
cactcagaagacactgatgggc

SEQ ID NO: 3386983 - DNA, 17 bp, Homo sapiens
cactcagccacgaccag

SEQ ID NO: 3386984 - DNA, 19 bp, Homo sapiens
cactcagccacgaccagcc

SEQ ID NO: 3386985 - DNA, 21 bp, Homo sapiens
cactcagccacgaccagcccc

SEQ ID NO: 3386986 - DNA, 15 bp, Homo sapiens
cactcagccatttcc

SEQ ID NO: 3386987 - DNA, 19 bp, Homo sapiens
cactcagccatttccccct

SEQ ID NO: 3386988 - DNA, 18 bp, Homo sapiens
cactcagcccctaggagt

SEQ ID NO: 3386989 - DNA, 22 bp, Homo sapiens
cactcagcccctaggagtatat

SEQ ID NO: 3386990 - DNA, 15 bp, Homo sapiens
cactcaggattggga

SEQ ID NO: 3386991 - DNA, 17 bp, Homo sapiens
cactcaggttcttcagg

SEQ ID NO: 3386992 - DNA, 14 bp, Homo sapiens
cactcagtctcttc

SEQ ID NO: 3386993 - DNA, 15 bp, Homo sapiens
cactcagtctcttcc

SEQ ID NO: 3386994 - DNA, 19 bp, Homo sapiens
cactcagtgcagcaatata

SEQ ID NO: 3386995 - DNA, 23 bp, Homo sapiens
cactcatttacgtaaaaagatat

SEQ ID NO: 3386996 - DNA, 22 bp, Homo sapiens
cactcattttctataacagata

SEQ ID NO: 3386997 - DNA, 21 bp, Homo sapiens
cactccaatgtctgctgagga

SEQ ID NO: 3386998 - DNA, 22 bp, Homo sapiens
cactccacataaggggtttagt

SEQ ID NO: 3386999 - DNA, 12 bp, Homo sapiens
cactccaccatc

SEQ ID NO: 3387000 - DNA, 13 bp, Homo sapiens
cactccaccatcc

SEQ ID NO: 3387001 - DNA, 18 bp, Homo sapiens
cactccaccctccacctt

SEQ ID NO: 3387002 - DNA, 15 bp, Homo sapiens
cactccagcctgagc

SEQ ID NO: 3387003 - DNA, 15 bp, Homo sapiens
cactccagcctgggc

SEQ ID NO: 3387004 - DNA, 16 bp, Homo sapiens
cactccagcctgggcg

SEQ ID NO: 3387005 - DNA, 23 bp, Homo sapiens
cactccagcctgggcgacagagc

SEQ ID NO: 3387006 - DNA, 11 bp, Homo sapiens
cactccaggcc

SEQ ID NO: 3387007 - DNA, 12 bp, Homo sapiens
cactccaggccc

SEQ ID NO: 3387008 - DNA, 17 bp, Homo sapiens
cactccaggccctgccc

SEQ ID NO: 3387009 - DNA, 21 bp, Homo sapiens
cactccaggccctgccccctc

SEQ ID NO: 3387010 - DNA, 13 bp, Homo sapiens
cactccagtgcca

SEQ ID NO: 3387011 - DNA, 17 bp, Homo sapiens
cactccagtgccagcaa

SEQ ID NO: 3387012 - DNA, 14 bp, Homo sapiens
cactccatccctcc

SEQ ID NO: 3387013 - DNA, 20 bp, Homo sapiens
cactccatttggtcctttct

SEQ ID NO: 3387014 - DNA, 17 bp, Homo sapiens
cactcccacctgacaca

SEQ ID NO: 3387015 - DNA, 14 bp, Homo sapiens
cactcccacgcctg

SEQ ID NO: 3387016 - DNA, 15 bp, Homo sapiens
cactcccatttttac

SEQ ID NO: 3387017 - DNA, 15 bp, Homo sapiens
cactccccaaccccc

SEQ ID NO: 3387018 - DNA, 15 bp, Homo sapiens
cactccccaccttca

SEQ ID NO: 3387019 - DNA, 15 bp, Homo sapiens
cactccccagagctg

SEQ ID NO: 3387020 - DNA, 18 bp, Homo sapiens
cactccccagagctgtgc

SEQ ID NO: 3387021 - DNA, 22 bp, Homo sapiens
cactccccctaaacccctgtcc

SEQ ID NO: 3387022 - DNA, 14 bp, Homo sapiens
cactcccctagggg

SEQ ID NO: 3387023 - DNA, 13 bp, Homo sapiens
cactccccttgcc

SEQ ID NO: 3387024 - DNA, 17 bp, Homo sapiens
cactccctctgccttca

SEQ ID NO: 3387025 - DNA, 12 bp, Homo sapiens
cactccctgagc

SEQ ID NO: 3387026 - DNA, 14 bp, Homo sapiens
cactccctgagctt

SEQ ID NO: 3387027 - DNA, 12 bp, Homo sapiens
cactccctgctc

SEQ ID NO: 3387028 - DNA, 14 bp, Homo sapiens
cactccctgctcca

SEQ ID NO: 3387029 - DNA, 17 bp, Homo sapiens
cactcccttgctggccc

SEQ ID NO: 3387030 - DNA, 19 bp, Homo sapiens
cactccggtgtgcctgcag

SEQ ID NO: 3387031 - DNA, 13 bp, Homo sapiens
cactcctacctgg

SEQ ID NO: 3387032 - DNA, 14 bp, Homo sapiens
cactcctaggagag

SEQ ID NO: 3387033 - DNA, 18 bp, Homo sapiens
cactcctaggagagccaa

SEQ ID NO: 3387034 - DNA, 21 bp, Homo sapiens
cactcctaggagagccaacct

SEQ ID NO: 3387035 - DNA, 13 bp, Homo sapiens
cactcctccctcc

SEQ ID NO: 3387036 - DNA, 11 bp, Homo sapiens
cactcctgggg

SEQ ID NO: 3387037 - DNA, 12 bp, Homo sapiens
cactcctggggc

SEQ ID NO: 3387038 - DNA, 12 bp, Homo sapiens
cactcctgtccc

SEQ ID NO: 3387039 - DNA, 18 bp, Homo sapiens
cactcctgtcccgccttc

SEQ ID NO: 3387040 - DNA, 20 bp, Homo sapiens
cactcctgtcccgccttcct

SEQ ID NO: 3387041 - DNA, 14 bp, Homo sapiens
cactcgacccagaa

SEQ ID NO: 3387042 - DNA, 21 bp, Homo sapiens
cactcgacccagaatggagcc

SEQ ID NO: 3387043 - DNA, 14 bp, Homo sapiens
cactcgaggcctgc

SEQ ID NO: 3387044 - DNA, 16 bp, Homo sapiens
cactcgcttcccccat

SEQ ID NO: 3387045 - DNA, 21 bp, Homo sapiens
cactcgggggtggagtgagac

SEQ ID NO: 3387046 - DNA, 15 bp, Homo sapiens
cactctaaaaaacat

SEQ ID NO: 3387047 - DNA, 16 bp, Homo sapiens
cactctaaaaaacatt

SEQ ID NO: 3387048 - DNA, 19 bp, Homo sapiens
cactctaaaaaacattttt

SEQ ID NO: 3387049 - DNA, 19 bp, Homo sapiens
cactctaaaaggttcaggg

SEQ ID NO: 3387050 - DNA, 17 bp, Homo sapiens
cactctaccaaataatt

SEQ ID NO: 3387051 - DNA, 15 bp, Homo sapiens
cactctaccctccca

SEQ ID NO: 3387052 - DNA, 19 bp, Homo sapiens
cactctaccctcccacccc

SEQ ID NO: 3387053 - DNA, 21 bp, Homo sapiens
cactctaccctcccaccccct

SEQ ID NO: 3387054 - DNA, 14 bp, Homo sapiens
cactctacttagca

SEQ ID NO: 3387055 - DNA, 13 bp, Homo sapiens
cactctagcctgg

SEQ ID NO: 3387056 - DNA, 19 bp, Homo sapiens
cactctaggggtcaggctc

SEQ ID NO: 3387057 - DNA, 22 bp, Homo sapiens
cactctaggggtcaggctccat

SEQ ID NO: 3387058 - DNA, 18 bp, Homo sapiens
cactctccaccctggctg

SEQ ID NO: 3387059 - DNA, 23 bp, Homo sapiens
cactctcggggcccttggggcct

SEQ ID NO: 3387060 - DNA, 14 bp, Homo sapiens
cactctctgaagat

SEQ ID NO: 3387061 - DNA, 20 bp, Homo sapiens
cactctctgaagatgatcat

SEQ ID NO: 3387062 - DNA, 23 bp, Homo sapiens
cactctctgaagatgatcatttg

SEQ ID NO: 3387063 - DNA, 20 bp, Homo sapiens
cactctgacgcaaaaccact

SEQ ID NO: 3387064 - DNA, 23 bp, Homo sapiens
cactctgagtttaccatttgtaa

SEQ ID NO: 3387065 - DNA, 18 bp, Homo sapiens
cactctgcagactgctag

SEQ ID NO: 3387066 - DNA, 12 bp, Homo sapiens
cactctgccagg

SEQ ID NO: 3387067 - DNA, 13 bp, Homo sapiens
cactctgccaggg

SEQ ID NO: 3387068 - DNA, 14 bp, Homo sapiens
cactctgccagggc

SEQ ID NO: 3387069 - DNA, 14 bp, Homo sapiens
cactctgctgctta

SEQ ID NO: 3387070 - DNA, 12 bp, Homo sapiens
cactctgcttct

SEQ ID NO: 3387071 - DNA, 16 bp, Homo sapiens
cactctgcttctctga

SEQ ID NO: 3387072 - DNA, 19 bp, Homo sapiens
cactctgcttctctgactt

SEQ ID NO: 3387073 - DNA, 21 bp, Homo sapiens
cactctgcttctctgacttct

SEQ ID NO: 3387074 - DNA, 12 bp, Homo sapiens
cactctggcctc

SEQ ID NO: 3387075 - DNA, 20 bp, Homo sapiens
cactctgggcacactctgcc

SEQ ID NO: 3387076 - DNA, 12 bp, Homo sapiens
cactctgtcagc

SEQ ID NO: 3387077 - DNA, 18 bp, Homo sapiens
cactctgtcagccagccg

SEQ ID NO: 3387078 - DNA, 22 bp, Homo sapiens
cactctgtcagccagccgccct

SEQ ID NO: 3387079 - DNA, 23 bp, Homo sapiens
cactctgtcagccagccgccctg

SEQ ID NO: 3387080 - DNA, 19 bp, Homo sapiens
cactctgtcgcccagtctg

SEQ ID NO: 3387081 - DNA, 14 bp, Homo sapiens
cactcttaaatgat

SEQ ID NO: 3387082 - DNA, 15 bp, Homo sapiens
cagaaagtcaccagg

SEQ ID NO: 3387083 - DNA, 16 bp, Homo sapiens
cagaaagtcaccagga

SEQ ID NO: 3387084 - DNA, 19 bp, Homo sapiens
cagaaagtcaccaggactt

SEQ ID NO: 3387085 - DNA, 15 bp, Homo sapiens
cagaaagtgcctgac

SEQ ID NO: 3387086 - DNA, 19 bp, Homo sapiens
cagaaagtttgtaaaaata

SEQ ID NO: 3387087 - DNA, 20 bp, Homo sapiens
cagaaagtttgtaaaaatat

SEQ ID NO: 3387088 - DNA, 21 bp, Homo sapiens
cagaaatataacacatttttt

SEQ ID NO: 3387089 - DNA, 21 bp, Homo sapiens
cagaaatataataaaatgtgt

SEQ ID NO: 3387090 - DNA, 13 bp, Homo sapiens
cagaaatatatat

SEQ ID NO: 3387091 - DNA, 18 bp, Homo sapiens
cagaaatatatatacata

SEQ ID NO: 3387092 - DNA, 22 bp, Homo sapiens
cagaaatatatatacatatgta

SEQ ID NO: 3387093 - DNA, 15 bp, Homo sapiens
cagaaatatgtggtt

SEQ ID NO: 3387094 - DNA, 16 bp, Homo sapiens
cagaaatcagaggaga

SEQ ID NO: 3387095 - DNA, 15 bp, Homo sapiens
cagaaatggaaagca

SEQ ID NO: 3387096 - DNA, 11 bp, Homo sapiens
cagaaatgtct

SEQ ID NO: 3387097 - DNA, 14 bp, Homo sapiens
cagaaatgtctaaa

SEQ ID NO: 3387098 - DNA, 16 bp, Homo sapiens
cagaaattcaatttgg

SEQ ID NO: 3387099 - DNA, 12 bp, Homo sapiens
cagaacagctga

SEQ ID NO: 3387100 - DNA, 13 bp, Homo sapiens
cagaacagcttca

SEQ ID NO: 3387101 - DNA, 16 bp, Homo sapiens
cagaacagcttcaggt

SEQ ID NO: 3387102 - DNA, 17 bp, Homo sapiens
cagaacaggaggtgtga

SEQ ID NO: 3387103 - DNA, 12 bp, Homo sapiens
cagaacagggtc

SEQ ID NO: 3387104 - DNA, 14 bp, Homo sapiens
cagaacagggtcat

SEQ ID NO: 3387105 - DNA, 15 bp, Homo sapiens
cagaacagtgaaagg

SEQ ID NO: 3387106 - DNA, 17 bp, Homo sapiens
cagaacatcattagaac

SEQ ID NO: 3387107 - DNA, 18 bp, Homo sapiens
cagaacatcgatatgtat

SEQ ID NO: 3387108 - DNA, 20 bp, Homo sapiens
cagaacatcgatatgtatat

SEQ ID NO: 3387109 - DNA, 12 bp, Homo sapiens
cagaacatgtta

SEQ ID NO: 3387110 - DNA, 16 bp, Homo sapiens
cagaacattcagctct

SEQ ID NO: 3387111 - DNA, 18 bp, Homo sapiens
cagaacattcagctctgg

SEQ ID NO: 3387112 - DNA, 16 bp, Homo sapiens
cagaaccaaagctcaa

SEQ ID NO: 3387113 - DNA, 18 bp, Homo sapiens
cagaacccagggctctgc

SEQ ID NO: 3387114 - DNA, 19 bp, Homo sapiens
cagaacccagggctctgcc

SEQ ID NO: 3387115 - DNA, 22 bp, Homo sapiens
cagaacccagggctctgcccca

SEQ ID NO: 3387116 - DNA, 22 bp, Homo sapiens
cagaacccatcggtaggcaaag

SEQ ID NO: 3387117 - DNA, 22 bp, Homo sapiens
cagaacccttggagccaatgga

SEQ ID NO: 3387118 - DNA, 23 bp, Homo sapiens
cagaacctgttattttatgtctg

SEQ ID NO: 3387119 - DNA, 15 bp, Homo sapiens
cagaactcactgggg

SEQ ID NO: 3387120 - DNA, 18 bp, Homo sapiens
cagaactcactggggcct

SEQ ID NO: 3387121 - DNA, 14 bp, Homo sapiens
cagaactcccttca

SEQ ID NO: 3387122 - DNA, 19 bp, Homo sapiens
cagaactcctccaaagcat

SEQ ID NO: 3387123 - DNA, 18 bp, Homo sapiens
cagaactgaaataaaaaa

SEQ ID NO: 3387124 - DNA, 16 bp, Homo sapiens
cagaactgcagggcct

SEQ ID NO: 3387125 - DNA, 12 bp, Homo sapiens
cagaactgccat

SEQ ID NO: 3387126 - DNA, 21 bp, Homo sapiens
cagaactgccattattttctg

SEQ ID NO: 3387127 - DNA, 22 bp, Homo sapiens
cagaactgccattattttctgt

SEQ ID NO: 3387128 - DNA, 16 bp, Homo sapiens
cagaactgcccccact

SEQ ID NO: 3387129 - DNA, 13 bp, Homo sapiens
cagaactgccctt

SEQ ID NO: 3387130 - DNA, 22 bp, Homo sapiens
cagaactgcccttgctgcccgc

SEQ ID NO: 3387131 - DNA, 13 bp, Homo sapiens
cagaacttcagaa

SEQ ID NO: 3387132 - DNA, 17 bp, Homo sapiens
cagaacttcagaaagac

SEQ ID NO: 3387133 - DNA, 15 bp, Homo sapiens
cagaagaaaggaaca

SEQ ID NO: 3387134 - DNA, 15 bp, Homo sapiens
cagaagaatattcag

SEQ ID NO: 3387135 - DNA, 16 bp, Homo sapiens
cagaagaatattcagg

SEQ ID NO: 3387136 - DNA, 17 bp, Homo sapiens
cagaagaatattcagga

SEQ ID NO: 3387137 - DNA, 18 bp, Homo sapiens
cagaagaatattcaggac

SEQ ID NO: 3387138 - DNA, 19 bp, Homo sapiens
cagaagaatattcaggact

SEQ ID NO: 3387139 - DNA, 17 bp, Homo sapiens
cagaagacaccagagca

SEQ ID NO: 3387140 - DNA, 18 bp, Homo sapiens
cagaagacaccagagcag

SEQ ID NO: 3387141 - DNA, 20 bp, Homo sapiens
cagaagacaccagagcagat

SEQ ID NO: 3387142 - DNA, 21 bp, Homo sapiens
cagaagaccacaaaaattgac

SEQ ID NO: 3387143 - DNA, 16 bp, Homo sapiens
cagaagacccctgact

SEQ ID NO: 3387144 - DNA, 19 bp, Homo sapiens
cagaagagactgatccaaa

SEQ ID NO: 3387145 - DNA, 16 bp, Homo sapiens
cagaagagaggggaag

SEQ ID NO: 3387146 - DNA, 22 bp, Homo sapiens
cagaagataacttgagcaccgt

SEQ ID NO: 3387147 - DNA, 23 bp, Homo sapiens
cagaagcagcttcttttgtctcc

SEQ ID NO: 3387148 - DNA, 16 bp, Homo sapiens
cagaagcaggctggag

SEQ ID NO: 3387149 - DNA, 13 bp, Homo sapiens
cagaagcatattt

SEQ ID NO: 3387150 - DNA, 22 bp, Homo sapiens
cagaagcatttgtattttgtgt

SEQ ID NO: 3387151 - DNA, 21 bp, Homo sapiens
cagaagccaagctccctggag

SEQ ID NO: 3387152 - DNA, 23 bp, Homo sapiens
cagaagccaagctccctggagcc

SEQ ID NO: 3387153 - DNA, 23 bp, Homo sapiens
cagaagccaatctacaatctctt

SEQ ID NO: 3387154 - DNA, 21 bp, Homo sapiens
cagaagcctccaagcctgcct

SEQ ID NO: 3387155 - DNA, 14 bp, Homo sapiens
cagaagcctgaggc

SEQ ID NO: 3387156 - DNA, 19 bp, Homo sapiens
cagaagcctgaggctggga

SEQ ID NO: 3387157 - DNA, 16 bp, Homo sapiens
cagaagcttctgccca

SEQ ID NO: 3387158 - DNA, 14 bp, Homo sapiens
cagaaggaaagaag

SEQ ID NO: 3387159 - DNA, 17 bp, Homo sapiens
cagaaggaaagaagggg

SEQ ID NO: 3387160 - DNA, 23 bp, Homo sapiens
cagaaggaaagaagggggccctg

SEQ ID NO: 3387161 - DNA, 15 bp, Homo sapiens
cagaaggagggcaga

SEQ ID NO: 3387162 - DNA, 19 bp, Homo sapiens
cagaaggagggcagagcca

SEQ ID NO: 3387163 - DNA, 20 bp, Homo sapiens
cagaaggattttttaaagtt

SEQ ID NO: 3387164 - DNA, 13 bp, Homo sapiens
cagaaggcaggga

SEQ ID NO: 3387165 - DNA, 17 bp, Homo sapiens
cagaagggaattgctca

SEQ ID NO: 3387166 - DNA, 22 bp, Homo sapiens
cagaaggggtttggtctgggac

SEQ ID NO: 3387167 - DNA, 20 bp, Homo sapiens
cagaagtcactcaattgttt

SEQ ID NO: 3387168 - DNA, 22 bp, Homo sapiens
cagaagtcactcaattgttttt

SEQ ID NO: 3387169 - DNA, 15 bp, Homo sapiens
cagaagtttctcagc

SEQ ID NO: 3387170 - DNA, 20 bp, Homo sapiens
cagaagtttgcaaataggca

SEQ ID NO: 3387171 - DNA, 12 bp, Homo sapiens
cagaataaaata

SEQ ID NO: 3387172 - DNA, 12 bp, Homo sapiens
cagaataaagca

SEQ ID NO: 3387173 - DNA, 16 bp, Homo sapiens
cagaataaagcagcct

SEQ ID NO: 3387174 - DNA, 19 bp, Homo sapiens
cagaataaagcagcctgat

SEQ ID NO: 3387175 - DNA, 18 bp, Homo sapiens
cagaataatggaaacatt

SEQ ID NO: 3387176 - DNA, 18 bp, Homo sapiens
cagaataatgttctattg

SEQ ID NO: 3387177 - DNA, 24 bp, Homo sapiens
cagaatactgcttgcttacaatct

SEQ ID NO: 3387178 - DNA, 21 bp, Homo sapiens
cagaatagatctgatggtgag

SEQ ID NO: 3387179 - DNA, 21 bp, Homo sapiens
cagaatagccacatttggaat

SEQ ID NO: 3387180 - DNA, 15 bp, Homo sapiens
cagaatatctgggat

SEQ ID NO: 3387181 - DNA, 17 bp, Homo sapiens
cagaatccataaatgtg

SEQ ID NO: 3387182 - DNA, 21 bp, Homo sapiens
cagaatccataaatgtgttcc

SEQ ID NO: 3387183 - DNA, 20 bp, Homo sapiens
cagaatctaaacgtggtcac

SEQ ID NO: 3387184 - DNA, 17 bp, Homo sapiens
cagaatctcaaataact

SEQ ID NO: 3387185 - DNA, 18 bp, Homo sapiens
cagaatctcaaataacta

SEQ ID NO: 3387186 - DNA, 21 bp, Homo sapiens
cagaatctctgcctagaatct

SEQ ID NO: 3387187 - DNA, 16 bp, Homo sapiens
cagaatctgaatgtaa

SEQ ID NO: 3387188 - DNA, 18 bp, Homo sapiens
cagaatctgctgttgcca

SEQ ID NO: 3387189 - DNA, 15 bp, Homo sapiens
cagaatgctcctgag

SEQ ID NO: 3387190 - DNA, 20 bp, Homo sapiens
cagaatgtaagaaaacaaaa

SEQ ID NO: 3387191 - DNA, 18 bp, Homo sapiens
cagaatgtatctgtgaag

SEQ ID NO: 3387192 - DNA, 20 bp, Homo sapiens
cagaatgttttactgtgaaa

SEQ ID NO: 3387193 - DNA, 15 bp, Homo sapiens
cagaattaaactttt

SEQ ID NO: 3387194 - DNA, 19 bp, Homo sapiens
cagaattaaacttttaatt

SEQ ID NO: 3387195 - DNA, 23 bp, Homo sapiens
cagaattaaacttttaattcatt

SEQ ID NO: 3387196 - DNA, 20 bp, Homo sapiens
cagaattagatggcttattt

SEQ ID NO: 3387197 - DNA, 11 bp, Homo sapiens
cagaattctca

SEQ ID NO: 3387198 - DNA, 21 bp, Homo sapiens
cagaattgtatctcatactgt

SEQ ID NO: 3387199 - DNA, 18 bp, Homo sapiens
cagaatttagtgtatcca

SEQ ID NO: 3387200 - DNA, 15 bp, Homo sapiens
cagaatttgaattat

SEQ ID NO: 3387201 - DNA, 17 bp, Homo sapiens
cagaattttaatgtgaa

SEQ ID NO: 3387202 - DNA, 19 bp, Homo sapiens
cagaattttaatgtgaaga

SEQ ID NO: 3387203 - DNA, 24 bp, Homo sapiens
cagaattttaatgtgaagacattt

SEQ ID NO: 3387204 - DNA, 15 bp, Homo sapiens
cagaattttaggaac

SEQ ID NO: 3387205 - DNA, 16 bp, Homo sapiens
cagaattttggaagat

SEQ ID NO: 3387206 - DNA, 21 bp, Homo sapiens
cagaatttttccctccactcc

SEQ ID NO: 3387207 - DNA, 22 bp, Homo sapiens
cagatgcccagagggcccaggc

SEQ ID NO: 3387208 - DNA, 13 bp, Homo sapiens
cagatgccccaga

SEQ ID NO: 3387209 - DNA, 16 bp, Homo sapiens
cagatgccccagagct

SEQ ID NO: 3387210 - DNA, 18 bp, Homo sapiens
cagatgccccagagctgt

SEQ ID NO: 3387211 - DNA, 14 bp, Homo sapiens
cagatgcgtgccca

SEQ ID NO: 3387212 - DNA, 16 bp, Homo sapiens
cagatgctccaagatt

SEQ ID NO: 3387213 - DNA, 18 bp, Homo sapiens
cagatgctccaagattct

SEQ ID NO: 3387214 - DNA, 19 bp, Homo sapiens
cagatgctccaagattcta

SEQ ID NO: 3387215 - DNA, 21 bp, Homo sapiens
cagatgctccaagattctaga

SEQ ID NO: 3387216 - DNA, 17 bp, Homo sapiens
cagatgcttctgggaga

SEQ ID NO: 3387217 - DNA, 18 bp, Homo sapiens
cagatggaaaaactgagg

SEQ ID NO: 3387218 - DNA, 21 bp, Homo sapiens
cagatggaaaattcatttttt

SEQ ID NO: 3387219 - DNA, 16 bp, Homo sapiens
cagatggaatgctgtg

SEQ ID NO: 3387220 - DNA, 19 bp, Homo sapiens
cagatggaatgctgtgtta

SEQ ID NO: 3387221 - DNA, 14 bp, Homo sapiens
cagatggagcccat

SEQ ID NO: 3387222 - DNA, 19 bp, Homo sapiens
cagatggaggttctcagag

SEQ ID NO: 3387223 - DNA, 22 bp, Homo sapiens
cagatggatttgcctgtgccac

SEQ ID NO: 3387224 - DNA, 21 bp, Homo sapiens
cagatggcccggatgctgctt

SEQ ID NO: 3387225 - DNA, 22 bp, Homo sapiens
cagatggcccggatgctgcttc

SEQ ID NO: 3387226 - DNA, 19 bp, Homo sapiens
cagatggtttccacattta

SEQ ID NO: 3387227 - DNA, 20 bp, Homo sapiens
cagatgtaattatgttttca

SEQ ID NO: 3387228 - DNA, 17 bp, Homo sapiens
cagatgtcagcttccca

SEQ ID NO: 3387229 - DNA, 16 bp, Homo sapiens
cagatgtcttctgcct

SEQ ID NO: 3387230 - DNA, 17 bp, Homo sapiens
cagatgtcttctgcctg

SEQ ID NO: 3387231 - DNA, 18 bp, Homo sapiens
cagatgtcttctgcctgt

SEQ ID NO: 3387232 - DNA, 20 bp, Homo sapiens
cagatgtgctataatctgtt

SEQ ID NO: 3387233 - DNA, 22 bp, Homo sapiens
cagatgtgctataatctgtttt

SEQ ID NO: 3387234 - DNA, 18 bp, Homo sapiens
cagatgttaaaataaatg

SEQ ID NO: 3387235 - DNA, 23 bp, Homo sapiens
cagatgttgaatgcccacaggca

SEQ ID NO: 3387236 - DNA, 14 bp, Homo sapiens
cagatgtttccaga

SEQ ID NO: 3387237 - DNA, 23 bp, Homo sapiens
cagattaaaagcacaagcgtgtt

SEQ ID NO: 3387238 - DNA, 12 bp, Homo sapiens
cagattaaatta

SEQ ID NO: 3387239 - DNA, 19 bp, Homo sapiens
cagattaaattacagcttt

SEQ ID NO: 3387240 - DNA, 18 bp, Homo sapiens
cagattcaggccagccca

SEQ ID NO: 3387241 - DNA, 22 bp, Homo sapiens
cagattcaggccagcccagcca

SEQ ID NO: 3387242 - DNA, 18 bp, Homo sapiens
cagattcctatgatggat

SEQ ID NO: 3387243 - DNA, 14 bp, Homo sapiens
cagattcctgggcc

SEQ ID NO: 3387244 - DNA, 15 bp, Homo sapiens
cagattcctgggcct

SEQ ID NO: 3387245 - DNA, 18 bp, Homo sapiens
cagattcctgggcctgtc

SEQ ID NO: 3387246 - DNA, 19 bp, Homo sapiens
cagattcctgggcctgtcc

SEQ ID NO: 3387247 - DNA, 20 bp, Homo sapiens
cagattcctgggcctgtccc

SEQ ID NO: 3387248 - DNA, 16 bp, Homo sapiens
cagattcctttccctt

SEQ ID NO: 3387249 - DNA, 20 bp, Homo sapiens
cagattcctttccctttagc

SEQ ID NO: 3387250 - DNA, 15 bp, Homo sapiens
cagattctatattat

SEQ ID NO: 3387251 - DNA, 16 bp, Homo sapiens
cagattctatattatt

SEQ ID NO: 3387252 - DNA, 22 bp, Homo sapiens
cagattctatattattatatat

SEQ ID NO: 3387253 - DNA, 16 bp, Homo sapiens
cagattctgacattta

SEQ ID NO: 3387254 - DNA, 14 bp, Homo sapiens
cagattgaaaagga

SEQ ID NO: 3387255 - DNA, 21 bp, Homo sapiens
cagattgaggtaataatgaca

SEQ ID NO: 3387256 - DNA, 17 bp, Homo sapiens
cagattgcaacaggctg

SEQ ID NO: 3387257 - DNA, 20 bp, Homo sapiens
cagattgcaacaggctgggc

SEQ ID NO: 3387258 - DNA, 14 bp, Homo sapiens
cagattgcctcctt

SEQ ID NO: 3387259 - DNA, 22 bp, Homo sapiens
cagattggcacccctttctagt

SEQ ID NO: 3387260 - DNA, 18 bp, Homo sapiens
cagattgtcttgcaactt

SEQ ID NO: 3387261 - DNA, 13 bp, Homo sapiens
cagattgtttcct

SEQ ID NO: 3387262 - DNA, 19 bp, Homo sapiens
cagattgtttctatacaaa

SEQ ID NO: 3387263 - DNA, 14 bp, Homo sapiens
cagatttgatattt

SEQ ID NO: 3387264 - DNA, 14 bp, Homo sapiens
cagattttacaaaa

SEQ ID NO: 3387265 - DNA, 17 bp, Homo sapiens
cagattttacaaaagat

SEQ ID NO: 3387266 - DNA, 19 bp, Homo sapiens
cagattttacaaaagatgt

SEQ ID NO: 3387267 - DNA, 13 bp, Homo sapiens
cagattttatttg

SEQ ID NO: 3387268 - DNA, 15 bp, Homo sapiens
cagattttatttgta

SEQ ID NO: 3387269 - DNA, 16 bp, Homo sapiens
cagattttatttgtaa

SEQ ID NO: 3387270 - DNA, 19 bp, Homo sapiens
cagattttcagcaaactct

SEQ ID NO: 3387271 - DNA, 16 bp, Homo sapiens
cagattttgctgtata

SEQ ID NO: 3387272 - DNA, 17 bp, Homo sapiens
cagattttgctgtatat

SEQ ID NO: 3387273 - DNA, 21 bp, Homo sapiens
cagattttggggttgtgttgt

SEQ ID NO: 3387274 - DNA, 17 bp, Homo sapiens
cagatttttcggaggcc

SEQ ID NO: 3387275 - DNA, 18 bp, Homo sapiens
cagatttttcggaggccc

SEQ ID NO: 3387276 - DNA, 18 bp, Homo sapiens
cagcaaaaatataaaata

SEQ ID NO: 3387277 - DNA, 15 bp, Homo sapiens
cagcaaaatgttgaa

SEQ ID NO: 3387278 - DNA, 15 bp, Homo sapiens
cagcaaacactccac

SEQ ID NO: 3387279 - DNA, 21 bp, Homo sapiens
cagcaaaccatttttaaagta

SEQ ID NO: 3387280 - DNA, 14 bp, Homo sapiens
cagcaacacagagc

SEQ ID NO: 3387281 - DNA, 17 bp, Homo sapiens
cagcaacagcaagaaat

SEQ ID NO: 3387282 - DNA, 18 bp, Homo sapiens
cagcaacgcttgtagaac

SEQ ID NO: 3387283 - DNA, 15 bp, Homo sapiens
cagcaacttgtcttt

SEQ ID NO: 3387284 - DNA, 20 bp, Homo sapiens
cagcaacttgtctttttctg

SEQ ID NO: 3387285 - DNA, 22 bp, Homo sapiens
cagcaacttgtctttttctgga

SEQ ID NO: 3387286 - DNA, 16 bp, Homo sapiens
cagcaagaataaaaaa

SEQ ID NO: 3387287 - DNA, 13 bp, Homo sapiens
cagcaagacctca

SEQ ID NO: 3387288 - DNA, 21 bp, Homo sapiens
cagcaagagggaacaaaactg

SEQ ID NO: 3387289 - DNA, 17 bp, Homo sapiens
cagcaaggggctctgcc

SEQ ID NO: 3387290 - DNA, 22 bp, Homo sapiens
cagcaagtacagagattctatg

SEQ ID NO: 3387291 - DNA, 22 bp, Homo sapiens
cagcaatactcatcagagcagc

SEQ ID NO: 3387292 - DNA, 22 bp, Homo sapiens
cagcaatatattaccagcaaga

SEQ ID NO: 3387293 - DNA, 14 bp, Homo sapiens
cagcaatatttaac

SEQ ID NO: 3387294 - DNA, 20 bp, Homo sapiens
cagcaatgacatctcagggg

SEQ ID NO: 3387295 - DNA, 18 bp, Homo sapiens
cagcaatgatgtccagaa

SEQ ID NO: 3387296 - DNA, 14 bp, Homo sapiens
cagcacaccagccg

SEQ ID NO: 3387297 - DNA, 18 bp, Homo sapiens
cagcacaccagccgctgc

SEQ ID NO: 3387298 - DNA, 17 bp, Homo sapiens
cagcacagcttgacctg

SEQ ID NO: 3387299 - DNA, 13 bp, Homo sapiens
cagcacaggggcc

SEQ ID NO: 3387300 - DNA, 22 bp, Homo sapiens
cagcacaggggccccagatctg

SEQ ID NO: 3387301 - DNA, 18 bp, Homo sapiens
cagcacatgctggccagc

SEQ ID NO: 3387302 - DNA, 16 bp, Homo sapiens
cagcaccaaccacagc

SEQ ID NO: 3387303 - DNA, 17 bp, Homo sapiens
cagcaccaaccacagca

SEQ ID NO: 3387304 - DNA, 21 bp, Homo sapiens
cagcaccaccctagtcccttc

SEQ ID NO: 3387305 - DNA, 16 bp, Homo sapiens
cagcacccccacccac

SEQ ID NO: 3387306 - DNA, 18 bp, Homo sapiens
cagcacccccacccacct

SEQ ID NO: 3387307 - DNA, 19 bp, Homo sapiens
cagcacccccacccacctc

SEQ ID NO: 3387308 - DNA, 20 bp, Homo sapiens
cagcacccccacccacctcc

SEQ ID NO: 3387309 - DNA, 19 bp, Homo sapiens
cagcaccccttccatgtgg

SEQ ID NO: 3387310 - DNA, 23 bp, Homo sapiens
cagcaccccttccatgtggagaa

SEQ ID NO: 3387311 - DNA, 16 bp, Homo sapiens
cagcaccctctcctgg

SEQ ID NO: 3387312 - DNA, 19 bp, Homo sapiens
cagcaccctctcctggggg

SEQ ID NO: 3387313 - DNA, 11 bp, Homo sapiens
cagcaccctgg

SEQ ID NO: 3387314 - DNA, 12 bp, Homo sapiens
cagcacctggca

SEQ ID NO: 3387315 - DNA, 17 bp, Homo sapiens
cagcaccttctttctgg

SEQ ID NO: 3387316 - DNA, 23 bp, Homo sapiens
cagcaccttctttctggactggc

SEQ ID NO: 3387317 - DNA, 16 bp, Homo sapiens
cagcactaaggccgtg

SEQ ID NO: 3387318 - DNA, 21 bp, Homo sapiens
cagcactaaggccgtgtctct

SEQ ID NO: 3387319 - DNA, 20 bp, Homo sapiens
cagcactccccagagctgtg

SEQ ID NO: 3387320 - DNA, 14 bp, Homo sapiens
cagcactccccttg

SEQ ID NO: 3387321 - DNA, 17 bp, Homo sapiens
cagcactccccttgcct

SEQ ID NO: 3387322 - DNA, 19 bp, Homo sapiens
cagcactccccttgccttc

SEQ ID NO: 3387323 - DNA, 23 bp, Homo sapiens
cagcactccccttgccttcccct

SEQ ID NO: 3387324 - DNA, 11 bp, Homo sapiens
cagcactgaaa

SEQ ID NO: 3387325 - DNA, 23 bp, Homo sapiens
cagcactggctctctccaggatc

SEQ ID NO: 3387326 - DNA, 22 bp, Homo sapiens
cagcactggtgaactgagctgg

SEQ ID NO: 3387327 - DNA, 12 bp, Homo sapiens
cagcactgtccc

SEQ ID NO: 3387328 - DNA, 13 bp, Homo sapiens
cagcactgtccct

SEQ ID NO: 3387329 - DNA, 14 bp, Homo sapiens
cagcactgtccctt

SEQ ID NO: 3387330 - DNA, 18 bp, Homo sapiens
cagcactgtcccttgcct

SEQ ID NO: 3387331 - DNA, 20 bp, Homo sapiens
cagcactgtcccttgcctca

SEQ ID NO: 3387332 - DNA, 19 bp, Homo sapiens
cagccagccggtgcctggc

SEQ ID NO: 3387333 - DNA, 22 bp, Homo sapiens
cagccaggacagtcagctctct

SEQ ID NO: 3387334 - DNA, 18 bp, Homo sapiens
cagccaggagctgtcacc

SEQ ID NO: 3387335 - DNA, 23 bp, Homo sapiens
cagccaggttagcctttgccctg

SEQ ID NO: 3387336 - DNA, 15 bp, Homo sapiens
cagccagtcttgcct

SEQ ID NO: 3387337 - DNA, 16 bp, Homo sapiens
cagccagtcttgccta

SEQ ID NO: 3387338 - DNA, 20 bp, Homo sapiens
cagccagtcttgcctaggcc

SEQ ID NO: 3387339 - DNA, 23 bp, Homo sapiens
cagccagttggtggggccaggcc

SEQ ID NO: 3387340 - DNA, 13 bp, Homo sapiens
cagccatcaaaat

SEQ ID NO: 3387341 - DNA, 17 bp, Homo sapiens
cagccatcgtcctggga

SEQ ID NO: 3387342 - DNA, 15 bp, Homo sapiens
cagccatctgcccag

SEQ ID NO: 3387343 - DNA, 18 bp, Homo sapiens
cagccatctgcccagggg

SEQ ID NO: 3387344 - DNA, 15 bp, Homo sapiens
cagccatgcccagga

SEQ ID NO: 3387345 - DNA, 21 bp, Homo sapiens
cagccatgcccaggacgtcct

SEQ ID NO: 3387346 - DNA, 21 bp, Homo sapiens
cagccatgcccgcattagctc

SEQ ID NO: 3387347 - DNA, 11 bp, Homo sapiens
cagccatgcct

SEQ ID NO: 3387348 - DNA, 20 bp, Homo sapiens
cagccattgcggccccagga

SEQ ID NO: 3387349 - DNA, 15 bp, Homo sapiens
cagccatttccccct

SEQ ID NO: 3387350 - DNA, 16 bp, Homo sapiens
cagccatttccccctc

SEQ ID NO: 3387351 - DNA, 18 bp, Homo sapiens
cagccatttccccctcct

SEQ ID NO: 3387352 - DNA, 22 bp, Homo sapiens
cagccatttccccctcctcaga

SEQ ID NO: 3387353 - DNA, 13 bp, Homo sapiens
cagccatttttaa

SEQ ID NO: 3387354 - DNA, 20 bp, Homo sapiens
cagcccaaaacccagggcaa

SEQ ID NO: 3387355 - DNA, 21 bp, Homo sapiens
cagcccaaaggggacaggcct

SEQ ID NO: 3387356 - DNA, 23 bp, Homo sapiens
cagcccaaaggggacaggcctca

SEQ ID NO: 3387357 - DNA, 24 bp, Homo sapiens
cagcccacattggattcatcagca

SEQ ID NO: 3387358 - DNA, 17 bp, Homo sapiens
cagcccaccctgctcct

SEQ ID NO: 3387359 - DNA, 19 bp, Homo sapiens
cagcccaccctgctcctcc

SEQ ID NO: 3387360 - DNA, 21 bp, Homo sapiens
cagcccaccctgctcctcctg

SEQ ID NO: 3387361 - DNA, 12 bp, Homo sapiens
cagcccacctgc

SEQ ID NO: 3387362 - DNA, 13 bp, Homo sapiens
cagcccacctgca

SEQ ID NO: 3387363 - DNA, 14 bp, Homo sapiens
cagcccacctgcac

SEQ ID NO: 3387364 - DNA, 12 bp, Homo sapiens
cagcccagagac

SEQ ID NO: 3387365 - DNA, 21 bp, Homo sapiens
cagcccagagactttgtagat

SEQ ID NO: 3387366 - DNA, 12 bp, Homo sapiens
cagcccagagcc

SEQ ID NO: 3387367 - DNA, 19 bp, Homo sapiens
cagcccagagccacctgga

SEQ ID NO: 3387368 - DNA, 18 bp, Homo sapiens
cagcccagagcctggctg

SEQ ID NO: 3387369 - DNA, 12 bp, Homo sapiens
cagcccagccag

SEQ ID NO: 3387370 - DNA, 13 bp, Homo sapiens
cagcccagccagg

SEQ ID NO: 3387371 - DNA, 14 bp, Homo sapiens
cagcccaggaggca

SEQ ID NO: 3387372 - DNA, 19 bp, Homo sapiens
cagcccaggcatctccttg

SEQ ID NO: 3387373 - DNA, 16 bp, Homo sapiens
cagcccatctgcctgt

SEQ ID NO: 3387374 - DNA, 21 bp, Homo sapiens
cagcccatgcccacctgccca

SEQ ID NO: 3387375 - DNA, 15 bp, Homo sapiens
cagcccatggccccc

SEQ ID NO: 3387376 - DNA, 15 bp, Homo sapiens
cagccccacaacttt

SEQ ID NO: 3387377 - DNA, 14 bp, Homo sapiens
cagccccacacagc

SEQ ID NO: 3387378 - DNA, 22 bp, Homo sapiens
cagccccacccaggagggaggg

SEQ ID NO: 3387379 - DNA, 19 bp, Homo sapiens
cagccccacccccagccag

SEQ ID NO: 3387380 - DNA, 15 bp, Homo sapiens
cagccccagagcagg

SEQ ID NO: 3387381 - DNA, 14 bp, Homo sapiens
cagccccagtgccc

SEQ ID NO: 3387382 - DNA, 17 bp, Homo sapiens
cagccccagtgcccaca

SEQ ID NO: 3387383 - DNA, 14 bp, Homo sapiens
cagccccattctgc

SEQ ID NO: 3387384 - DNA, 17 bp, Homo sapiens
cagccccattctgcctg

SEQ ID NO: 3387385 - DNA, 18 bp, Homo sapiens
cagccccattctgcctgc

SEQ ID NO: 3387386 - DNA, 23 bp, Homo sapiens
cagccccattctgcctgcccagg

SEQ ID NO: 3387387 - DNA, 15 bp, Homo sapiens
cagcccccagcccct

SEQ ID NO: 3387388 - DNA, 17 bp, Homo sapiens
cagcccccaggccaggt

SEQ ID NO: 3387389 - DNA, 14 bp, Homo sapiens
cagccccccagcac

SEQ ID NO: 3387390 - DNA, 11 bp, Homo sapiens
cagccccctcc

SEQ ID NO: 3387391 - DNA, 19 bp, Homo sapiens
cagcccccttgccctccgc

SEQ ID NO: 3387392 - DNA, 20 bp, Homo sapiens
cagcccccttgccctccgcc

SEQ ID NO: 3387393 - DNA, 21 bp, Homo sapiens
cagcccccttgccctccgcct

SEQ ID NO: 3387394 - DNA, 16 bp, Homo sapiens
cagccccgagctgtcc

SEQ ID NO: 3387395 - DNA, 17 bp, Homo sapiens
cagccccgagctgtccc

SEQ ID NO: 3387396 - DNA, 15 bp, Homo sapiens
cagccccgctcaggc

SEQ ID NO: 3387397 - DNA, 20 bp, Homo sapiens
cagccccggtggctgggcag

SEQ ID NO: 3387398 - DNA, 12 bp, Homo sapiens
cagcccctagaa

SEQ ID NO: 3387399 - DNA, 15 bp, Homo sapiens
cagcccctagcccag

SEQ ID NO: 3387400 - DNA, 17 bp, Homo sapiens
cagcccctagcccagga

SEQ ID NO: 3387401 - DNA, 14 bp, Homo sapiens
cagcccctccccca

SEQ ID NO: 3387402 - DNA, 16 bp, Homo sapiens
cagcccctctggtcgc

SEQ ID NO: 3387403 - DNA, 22 bp, Homo sapiens
cagcccctctggtcgctcctgc

SEQ ID NO: 3387404 - DNA, 15 bp, Homo sapiens
cagcccctgccccag

SEQ ID NO: 3387405 - DNA, 23 bp, Homo sapiens
cagcccctgccccagcccaagtc

SEQ ID NO: 3387406 - DNA, 14 bp, Homo sapiens
cagcccctgcctgg

SEQ ID NO: 3387407 - DNA, 18 bp, Homo sapiens
cagcccctgcctgggttg

SEQ ID NO: 3387408 - DNA, 13 bp, Homo sapiens
cagcccctgtccc

SEQ ID NO: 3387409 - DNA, 13 bp, Homo sapiens
cagccccttcctg

SEQ ID NO: 3387410 - DNA, 15 bp, Homo sapiens
cagccccttcctggg

SEQ ID NO: 3387411 - DNA, 18 bp, Homo sapiens
cagccccttcctgggtat

SEQ ID NO: 3387412 - DNA, 13 bp, Homo sapiens
cagccccttctcc

SEQ ID NO: 3387413 - DNA, 16 bp, Homo sapiens
cagccccttctcccag

SEQ ID NO: 3387414 - DNA, 17 bp, Homo sapiens
cagccccttgagaaacc

SEQ ID NO: 3387415 - DNA, 18 bp, Homo sapiens
cagccccttgagaaacct

SEQ ID NO: 3387416 - DNA, 15 bp, Homo sapiens
cagcccgacagtgcc

SEQ ID NO: 3387417 - DNA, 20 bp, Homo sapiens
cagcccgacagtgccatccc

SEQ ID NO: 3387418 - DNA, 21 bp, Homo sapiens
cagcccgacagtgccatcccc

SEQ ID NO: 3387419 - DNA, 14 bp, Homo sapiens
cagcccgctgagtg

SEQ ID NO: 3387420 - DNA, 15 bp, Homo sapiens
cagcccgctgagtgg

SEQ ID NO: 3387421 - DNA, 12 bp, Homo sapiens
cagcccggcctg

SEQ ID NO: 3387422 - DNA, 15 bp, Homo sapiens
cagcccggcgccacc

SEQ ID NO: 3387423 - DNA, 22 bp, Homo sapiens
cagcccggcggggaccttggtc

SEQ ID NO: 3387424 - DNA, 22 bp, Homo sapiens
cagcccggctggttttgtaaga

SEQ ID NO: 3387425 - DNA, 19 bp, Homo sapiens
cagcccgggagcctaggac

SEQ ID NO: 3387426 - DNA, 20 bp, Homo sapiens
cagcccgggagcctaggacc

SEQ ID NO: 3387427 - DNA, 22 bp, Homo sapiens
cagccctaaggatctctcagga

SEQ ID NO: 3387428 - DNA, 15 bp, Homo sapiens
cagccctatggatgt

SEQ ID NO: 3387429 - DNA, 13 bp, Homo sapiens
cagccctcaacag

SEQ ID NO: 3387430 - DNA, 20 bp, Homo sapiens
cagccctcaacaggcccagg

SEQ ID NO: 3387431 - DNA, 20 bp, Homo sapiens
cagccctccccatggagcca

SEQ ID NO: 3387432 - DNA, 13 bp, Homo sapiens
cagccctccctgc

SEQ ID NO: 3387433 - DNA, 22 bp, Homo sapiens
cagccctccctgcccctccctt

SEQ ID NO: 3387434 - DNA, 17 bp, Homo sapiens
cagccctcctctgcact

SEQ ID NO: 3387435 - DNA, 12 bp, Homo sapiens
cagccctgaggt

SEQ ID NO: 3387436 - DNA, 13 bp, Homo sapiens
cagccctgcagcc

SEQ ID NO: 3387437 - DNA, 23 bp, Homo sapiens
cagccctgcagcccaaaacccag

SEQ ID NO: 3387438 - DNA, 22 bp, Homo sapiens
cagccctgctttgggctgccct

SEQ ID NO: 3387439 - DNA, 12 bp, Homo sapiens
cagccctgggaa

SEQ ID NO: 3387440 - DNA, 18 bp, Homo sapiens
cagccctggggctgggcc

SEQ ID NO: 3387441 - DNA, 19 bp, Homo sapiens
cagccctggggctgggccc

SEQ ID NO: 3387442 - DNA, 15 bp, Homo sapiens
cagccctgtcctggt

SEQ ID NO: 3387443 - DNA, 16 bp, Homo sapiens
cagccctgtcttccta

SEQ ID NO: 3387444 - DNA, 13 bp, Homo sapiens
cagcccttagcag

SEQ ID NO: 3387445 - DNA, 18 bp, Homo sapiens
cagcccttctgcctttct

SEQ ID NO: 3387446 - DNA, 15 bp, Homo sapiens
cagcccttgccccca

SEQ ID NO: 3387447 - DNA, 21 bp, Homo sapiens
cagcccttgcccccatccctc

SEQ ID NO: 3387448 - DNA, 12 bp, Homo sapiens
cagcccttgctt

SEQ ID NO: 3387449 - DNA, 13 bp, Homo sapiens
cagcccttgcttg

SEQ ID NO: 3387450 - DNA, 23 bp, Homo sapiens
cagcccttttgttgagccaggcc

SEQ ID NO: 3387451 - DNA, 19 bp, Homo sapiens
cagccgagccgggcctggg

SEQ ID NO: 3387452 - DNA, 18 bp, Homo sapiens
cagccgcattggtgactc

SEQ ID NO: 3387453 - DNA, 17 bp, Homo sapiens
cagccgccattgccacc

SEQ ID NO: 3387454 - DNA, 18 bp, Homo sapiens
cagccgccattgccacca

SEQ ID NO: 3387455 - DNA, 19 bp, Homo sapiens
cagccgccattgccaccag

SEQ ID NO: 3387456 - DNA, 21 bp, Homo sapiens
cagccgccattgccaccagga

SEQ ID NO: 3387457 - DNA, 23 bp, Homo sapiens
cagccgccattgccaccaggaga

SEQ ID NO: 3387458 - DNA, 17 bp, Homo sapiens
caggaaggagagcctgc

SEQ ID NO: 3387459 - DNA, 12 bp, Homo sapiens
caggaaggagcg

SEQ ID NO: 3387460 - DNA, 14 bp, Homo sapiens
caggaaggcagctg

SEQ ID NO: 3387461 - DNA, 16 bp, Homo sapiens
caggaaggcagctgct

SEQ ID NO: 3387462 - DNA, 20 bp, Homo sapiens
caggaaggcctaggctagga

SEQ ID NO: 3387463 - DNA, 12 bp, Homo sapiens
caggaaggcctg

SEQ ID NO: 3387464 - DNA, 13 bp, Homo sapiens
caggaaggcctgg

SEQ ID NO: 3387465 - DNA, 19 bp, Homo sapiens
caggaagtacttccacctc

SEQ ID NO: 3387466 - DNA, 17 bp, Homo sapiens
caggaagtttggagcct

SEQ ID NO: 3387467 - DNA, 16 bp, Homo sapiens
caggaatagatgtggt

SEQ ID NO: 3387468 - DNA, 14 bp, Homo sapiens
caggaatataaata

SEQ ID NO: 3387469 - DNA, 15 bp, Homo sapiens
caggaatataaatat

SEQ ID NO: 3387470 - DNA, 14 bp, Homo sapiens
caggaatgtctgga

SEQ ID NO: 3387471 - DNA, 19 bp, Homo sapiens
caggaatgtgtggcctgca

SEQ ID NO: 3387472 - DNA, 12 bp, Homo sapiens
caggaattcagt

SEQ ID NO: 3387473 - DNA, 16 bp, Homo sapiens
caggaattcagtgcct

SEQ ID NO: 3387474 - DNA, 19 bp, Homo sapiens
caggaattcagtgccttca

SEQ ID NO: 3387475 - DNA, 21 bp, Homo sapiens
caggaattttattttgctgag

SEQ ID NO: 3387476 - DNA, 16 bp, Homo sapiens
caggacaaagggaggg

SEQ ID NO: 3387477 - DNA, 18 bp, Homo sapiens
caggacaaagggagggag

SEQ ID NO: 3387478 - DNA, 15 bp, Homo sapiens
caggacaacacttca

SEQ ID NO: 3387479 - DNA, 20 bp, Homo sapiens
caggacacatcccggcctct

SEQ ID NO: 3387480 - DNA, 21 bp, Homo sapiens
caggacacatcccggcctctt

SEQ ID NO: 3387481 - DNA, 20 bp, Homo sapiens
caggacaccacacccagcct

SEQ ID NO: 3387482 - DNA, 21 bp, Homo sapiens
caggacaccacacccagcctc

SEQ ID NO: 3387483 - DNA, 22 bp, Homo sapiens
caggacaccacacccagcctca

SEQ ID NO: 3387484 - DNA, 14 bp, Homo sapiens
caggacaccagcct

SEQ ID NO: 3387485 - DNA, 13 bp, Homo sapiens
caggacagagttc

SEQ ID NO: 3387486 - DNA, 15 bp, Homo sapiens
caggacagagttcac

SEQ ID NO: 3387487 - DNA, 20 bp, Homo sapiens
caggacagagttcacaggag

SEQ ID NO: 3387488 - DNA, 22 bp, Homo sapiens
caggacagagttcacaggaggc

SEQ ID NO: 3387489 - DNA, 20 bp, Homo sapiens
caggacagtgcttcagcctg

SEQ ID NO: 3387490 - DNA, 16 bp, Homo sapiens
caggacatctcctggc

SEQ ID NO: 3387491 - DNA, 18 bp, Homo sapiens
caggacatctcctggcta

SEQ ID NO: 3387492 - DNA, 15 bp, Homo sapiens
caggacatgcaataa

SEQ ID NO: 3387493 - DNA, 12 bp, Homo sapiens
caggaccacaaa

SEQ ID NO: 3387494 - DNA, 16 bp, Homo sapiens
caggaccacaaaaatg

SEQ ID NO: 3387495 - DNA, 15 bp, Homo sapiens
caggaccacacagtc

SEQ ID NO: 3387496 - DNA, 17 bp, Homo sapiens
caggaccacacagtccc

SEQ ID NO: 3387497 - DNA, 21 bp, Homo sapiens
caggaccacacagtccccaga

SEQ ID NO: 3387498 - DNA, 24 bp, Homo sapiens
caggaccacacagtccccagactc

SEQ ID NO: 3387499 - DNA, 15 bp, Homo sapiens
caggaccagctgggg

SEQ ID NO: 3387500 - DNA, 14 bp, Homo sapiens
caggacccaggccc

SEQ ID NO: 3387501 - DNA, 15 bp, Homo sapiens
caggacccaggccct

SEQ ID NO: 3387502 - DNA, 17 bp, Homo sapiens
caggacccaggccctcc

SEQ ID NO: 3387503 - DNA, 20 bp, Homo sapiens
caggaccctgacctccgccc

SEQ ID NO: 3387504 - DNA, 20 bp, Homo sapiens
caggacctcccttccgaccc

SEQ ID NO: 3387505 - DNA, 13 bp, Homo sapiens
caggacctggcat

SEQ ID NO: 3387506 - DNA, 20 bp, Homo sapiens
caggaccttcgggctgtgcc

SEQ ID NO: 3387507 - DNA, 22 bp, Homo sapiens
caggaccttcgggctgtgcccg

SEQ ID NO: 3387508 - DNA, 16 bp, Homo sapiens
caggacgcttctgaat

SEQ ID NO: 3387509 - DNA, 17 bp, Homo sapiens
caggactccactggaca

SEQ ID NO: 3387510 - DNA, 19 bp, Homo sapiens
caggactccactggacaga

SEQ ID NO: 3387511 - DNA, 17 bp, Homo sapiens
caggactccaggcccaa

SEQ ID NO: 3387512 - DNA, 19 bp, Homo sapiens
caggactccaggcccaagg

SEQ ID NO: 3387513 - DNA, 20 bp, Homo sapiens
caggactccctcctcacctc

SEQ ID NO: 3387514 - DNA, 23 bp, Homo sapiens
caggactccctcctcacctctgg

SEQ ID NO: 3387515 - DNA, 12 bp, Homo sapiens
caggactctgcc

SEQ ID NO: 3387516 - DNA, 13 bp, Homo sapiens
caggactctgcct

SEQ ID NO: 3387517 - DNA, 15 bp, Homo sapiens
caggactctgcctcc

SEQ ID NO: 3387518 - DNA, 20 bp, Homo sapiens
caggactgagccccgcagac

SEQ ID NO: 3387519 - DNA, 20 bp, Homo sapiens
caggacttaacggctccagg

SEQ ID NO: 3387520 - DNA, 23 bp, Homo sapiens
caggacttaacggctccaggatt

SEQ ID NO: 3387521 - DNA, 16 bp, Homo sapiens
caggacttgaaagaaa

SEQ ID NO: 3387522 - DNA, 17 bp, Homo sapiens
caggacttggggtcagg

SEQ ID NO: 3387523 - DNA, 17 bp, Homo sapiens
caggagaaccactacat

SEQ ID NO: 3387524 - DNA, 20 bp, Homo sapiens
caggagaccacggggagcaa

SEQ ID NO: 3387525 - DNA, 13 bp, Homo sapiens
caggagacgacag

SEQ ID NO: 3387526 - DNA, 20 bp, Homo sapiens
caggagagaaaactgcctga

SEQ ID NO: 3387527 - DNA, 21 bp, Homo sapiens
caggagagactgagcagccgc

SEQ ID NO: 3387528 - DNA, 20 bp, Homo sapiens
caggagagagaaagccaggc

SEQ ID NO: 3387529 - DNA, 13 bp, Homo sapiens
caggagaggcagc

SEQ ID NO: 3387530 - DNA, 12 bp, Homo sapiens
caggagaggctg

SEQ ID NO: 3387531 - DNA, 13 bp, Homo sapiens
caggagaggctgg

SEQ ID NO: 3387532 - DNA, 18 bp, Homo sapiens
caggagaggctgggctgg

SEQ ID NO: 3387533 - DNA, 21 bp, Homo sapiens
caggagaggctgggctgggtg

SEQ ID NO: 3387534 - DNA, 18 bp, Homo sapiens
caggagagggatacaaga

SEQ ID NO: 3387535 - DNA, 20 bp, Homo sapiens
caggagagggatacaagaga

SEQ ID NO: 3387536 - DNA, 18 bp, Homo sapiens
caggagatggagggcttg

SEQ ID NO: 3387537 - DNA, 20 bp, Homo sapiens
caggagatggagggcttggc

SEQ ID NO: 3387538 - DNA, 21 bp, Homo sapiens
caggagatggagggcttggcc

SEQ ID NO: 3387539 - DNA, 17 bp, Homo sapiens
caggagattgagaagga

SEQ ID NO: 3387540 - DNA, 16 bp, Homo sapiens
caggagcacaggcagc

SEQ ID NO: 3387541 - DNA, 18 bp, Homo sapiens
caggagcacaggcagctg

SEQ ID NO: 3387542 - DNA, 17 bp, Homo sapiens
caggagcagatggacag

SEQ ID NO: 3387543 - DNA, 18 bp, Homo sapiens
caggagcagatggacagc

SEQ ID NO: 3387544 - DNA, 17 bp, Homo sapiens
caggagcatcctctgct

SEQ ID NO: 3387545 - DNA, 15 bp, Homo sapiens
caggagccccgaggc

SEQ ID NO: 3387546 - DNA, 23 bp, Homo sapiens
caggagccccgaggccttctctg

SEQ ID NO: 3387547 - DNA, 18 bp, Homo sapiens
caggagcctagcggagcc

SEQ ID NO: 3387548 - DNA, 20 bp, Homo sapiens
caggagcctagcggagccca

SEQ ID NO: 3387549 - DNA, 21 bp, Homo sapiens
caggagcctagcggagcccag

SEQ ID NO: 3387550 - DNA, 12 bp, Homo sapiens
caggagctcttc

SEQ ID NO: 3387551 - DNA, 19 bp, Homo sapiens
caggagctcttcaggcctc

SEQ ID NO: 3387552 - DNA, 20 bp, Homo sapiens
caggagctcttcaggcctcc

SEQ ID NO: 3387553 - DNA, 20 bp, Homo sapiens
caggagcttattacagaaaa

SEQ ID NO: 3387554 - DNA, 17 bp, Homo sapiens
caggagctttggaccta

SEQ ID NO: 3387555 - DNA, 20 bp, Homo sapiens
caggaggcagaggttgcagt

SEQ ID NO: 3387556 - DNA, 15 bp, Homo sapiens
caggaggcaggacct

SEQ ID NO: 3387557 - DNA, 18 bp, Homo sapiens
caggaggcaggaccttcg

SEQ ID NO: 3387558 - DNA, 14 bp, Homo sapiens
caggaggccaataa

SEQ ID NO: 3387559 - DNA, 20 bp, Homo sapiens
caggaggccaataaaaagtt

SEQ ID NO: 3387560 - DNA, 13 bp, Homo sapiens
caggaggcgccct

SEQ ID NO: 3387561 - DNA, 15 bp, Homo sapiens
caggaggcggcccgg

SEQ ID NO: 3387562 - DNA, 16 bp, Homo sapiens
caggaggcggcccggc

SEQ ID NO: 3387563 - DNA, 12 bp, Homo sapiens
caggagggaggg

SEQ ID NO: 3387564 - DNA, 12 bp, Homo sapiens
caggagggaggt

SEQ ID NO: 3387565 - DNA, 12 bp, Homo sapiens
caggagggccct

SEQ ID NO: 3387566 - DNA, 13 bp, Homo sapiens
caggaggggaact

SEQ ID NO: 3387567 - DNA, 19 bp, Homo sapiens
caggaggggaactgagtca

SEQ ID NO: 3387568 - DNA, 19 bp, Homo sapiens
caggaggggtgagtcccct

SEQ ID NO: 3387569 - DNA, 16 bp, Homo sapiens
caggaggtagtttctc

SEQ ID NO: 3387570 - DNA, 21 bp, Homo sapiens
caggaggttggtgactgaaac

SEQ ID NO: 3387571 - DNA, 23 bp, Homo sapiens
caggagtatcttacctgtaaagt

SEQ ID NO: 3387572 - DNA, 14 bp, Homo sapiens
caggagtcagtgtc

SEQ ID NO: 3387573 - DNA, 18 bp, Homo sapiens
caggagtccactttgttt

SEQ ID NO: 3387574 - DNA, 16 bp, Homo sapiens
caggagtctctgccac

SEQ ID NO: 3387575 - DNA, 17 bp, Homo sapiens
caggagtctctgccacc

SEQ ID NO: 3387576 - DNA, 16 bp, Homo sapiens
caggagtctgtgctct

SEQ ID NO: 3387577 - DNA, 17 bp, Homo sapiens
caggagtctgtgctctt

SEQ ID NO: 3387578 - DNA, 22 bp, Homo sapiens
caggagtgggaaaacactgcca

SEQ ID NO: 3387579 - DNA, 20 bp, Homo sapiens
caggagtggtgcagacagaa

SEQ ID NO: 3387580 - DNA, 19 bp, Homo sapiens
caggagtgtcctcttccct

SEQ ID NO: 3387581 - DNA, 14 bp, Homo sapiens
caggagtgtcctgc

SEQ ID NO: 3387582 - DNA, 23 bp, Homo sapiens
caggagtgtcctgcccatgcccc

SEQ ID NO: 3387583 - DNA, 23 bp, Homo sapiens
caggagttagtggagtatttgga

SEQ ID NO: 3387584 - DNA, 22 bp, Homo sapiens
cagggaccactgggtgagagag

SEQ ID NO: 3387585 - DNA, 17 bp, Homo sapiens
cagggacttggacagga

SEQ ID NO: 3387586 - DNA, 23 bp, Homo sapiens
cagggagaaaatccaggtcatgc

SEQ ID NO: 3387587 - DNA, 17 bp, Homo sapiens
cagggagcaagacagag

SEQ ID NO: 3387588 - DNA, 18 bp, Homo sapiens
cagggagcagggaaggcc

SEQ ID NO: 3387589 - DNA, 21 bp, Homo sapiens
cagggagcagggaaggcctga

SEQ ID NO: 3387590 - DNA, 22 bp, Homo sapiens
cagggagcatttaatggcagct

SEQ ID NO: 3387591 - DNA, 23 bp, Homo sapiens
cagggagcatttaatggcagcta

SEQ ID NO: 3387592 - DNA, 13 bp, Homo sapiens
cagggagcctcct

SEQ ID NO: 3387593 - DNA, 14 bp, Homo sapiens
cagggagctgatgt

SEQ ID NO: 3387594 - DNA, 17 bp, Homo sapiens
cagggaggacgctctct

SEQ ID NO: 3387595 - DNA, 19 bp, Homo sapiens
cagggaggacgctctctgg

SEQ ID NO: 3387596 - DNA, 22 bp, Homo sapiens
cagggaggacgctctctggcct

SEQ ID NO: 3387597 - DNA, 15 bp, Homo sapiens
cagggaggagaggaa

SEQ ID NO: 3387598 - DNA, 22 bp, Homo sapiens
cagggaggaggtggcagccctg

SEQ ID NO: 3387599 - DNA, 17 bp, Homo sapiens
cagggagggaagtgtga

SEQ ID NO: 3387600 - DNA, 17 bp, Homo sapiens
cagggaggtcaggccct

SEQ ID NO: 3387601 - DNA, 18 bp, Homo sapiens
cagggaggtcaggccctg

SEQ ID NO: 3387602 - DNA, 16 bp, Homo sapiens
cagggaggtcattttg

SEQ ID NO: 3387603 - DNA, 18 bp, Homo sapiens
cagggaggtgaccccagg

SEQ ID NO: 3387604 - DNA, 22 bp, Homo sapiens
cagggagtccgaaagggacttg

SEQ ID NO: 3387605 - DNA, 16 bp, Homo sapiens
cagggagtgctggctc

SEQ ID NO: 3387606 - DNA, 14 bp, Homo sapiens
cagggatgctgggc

SEQ ID NO: 3387607 - DNA, 15 bp, Homo sapiens
cagggatgctgggct

SEQ ID NO: 3387608 - DNA, 19 bp, Homo sapiens
cagggatgctgggctgggc

SEQ ID NO: 3387609 - DNA, 22 bp, Homo sapiens
cagggatgggggatgggccagg

SEQ ID NO: 3387610 - DNA, 20 bp, Homo sapiens
cagggatgggggtggctggg

SEQ ID NO: 3387611 - DNA, 21 bp, Homo sapiens
cagggatgtagattaaggtga

SEQ ID NO: 3387612 - DNA, 22 bp, Homo sapiens
cagggcaaatgacatgcactga

SEQ ID NO: 3387613 - DNA, 23 bp, Homo sapiens
cagggcaaatgacatgcactgac

SEQ ID NO: 3387614 - DNA, 23 bp, Homo sapiens
cagggcaacaagcccgttagccc

SEQ ID NO: 3387615 - DNA, 14 bp, Homo sapiens
cagggcacaccggg

SEQ ID NO: 3387616 - DNA, 21 bp, Homo sapiens
cagggcacaccgggcactcag

SEQ ID NO: 3387617 - DNA, 22 bp, Homo sapiens
cagggcacaccgggcactcaga

SEQ ID NO: 3387618 - DNA, 15 bp, Homo sapiens
cagggcaccagaggc

SEQ ID NO: 3387619 - DNA, 21 bp, Homo sapiens
cagggcaccctgtggccctgg

SEQ ID NO: 3387620 - DNA, 15 bp, Homo sapiens
cagggcagagccggg

SEQ ID NO: 3387621 - DNA, 16 bp, Homo sapiens
cagggcagagccggga

SEQ ID NO: 3387622 - DNA, 12 bp, Homo sapiens
cagggcagaggg

SEQ ID NO: 3387623 - DNA, 19 bp, Homo sapiens
cagggcagcagggaacaaa

SEQ ID NO: 3387624 - DNA, 22 bp, Homo sapiens
cagggcagcagggaacaaaact

SEQ ID NO: 3387625 - DNA, 15 bp, Homo sapiens
cagggcagggctctg

SEQ ID NO: 3387626 - DNA, 15 bp, Homo sapiens
cagggcatgccacgt

SEQ ID NO: 3387627 - DNA, 18 bp, Homo sapiens
cagggcatgccccggcca

SEQ ID NO: 3387628 - DNA, 21 bp, Homo sapiens
cagggcatgccccggccacct

SEQ ID NO: 3387629 - DNA, 16 bp, Homo sapiens
cagggcatgtgtatgt

SEQ ID NO: 3387630 - DNA, 21 bp, Homo sapiens
cagggcattcgggccacaggg

SEQ ID NO: 3387631 - DNA, 19 bp, Homo sapiens
cagggccaacttgagggcc

SEQ ID NO: 3387632 - DNA, 22 bp, Homo sapiens
cagggccaacttgagggcccag

SEQ ID NO: 3387633 - DNA, 18 bp, Homo sapiens
cagggccacgctccagct

SEQ ID NO: 3387634 - DNA, 22 bp, Homo sapiens
cagggccacgctccagctgccc

SEQ ID NO: 3387635 - DNA, 23 bp, Homo sapiens
cagggccacgctccagctgcccc

SEQ ID NO: 3387636 - DNA, 11 bp, Homo sapiens
cagggccagaa

SEQ ID NO: 3387637 - DNA, 20 bp, Homo sapiens
cagggccagaaggagggcag

SEQ ID NO: 3387638 - DNA, 23 bp, Homo sapiens
cagggccagaaggagggcagagc

SEQ ID NO: 3387639 - DNA, 16 bp, Homo sapiens
cagggccagactggaa

SEQ ID NO: 3387640 - DNA, 13 bp, Homo sapiens
cagggccagaggg

SEQ ID NO: 3387641 - DNA, 15 bp, Homo sapiens
cagggccagagggag

SEQ ID NO: 3387642 - DNA, 16 bp, Homo sapiens
cagggccagagggagc

SEQ ID NO: 3387643 - DNA, 20 bp, Homo sapiens
cagggccagagggagctgga

SEQ ID NO: 3387644 - DNA, 14 bp, Homo sapiens
cagggccaggaagg

SEQ ID NO: 3387645 - DNA, 24 bp, Homo sapiens
cagggccaggaaggacagactggc

SEQ ID NO: 3387646 - DNA, 14 bp, Homo sapiens
cagggccaggactg

SEQ ID NO: 3387647 - DNA, 11 bp, Homo sapiens
cagggccaggc

SEQ ID NO: 3387648 - DNA, 16 bp, Homo sapiens
cagggccagggccctg

SEQ ID NO: 3387649 - DNA, 16 bp, Homo sapiens
cagggccagtggggcc

SEQ ID NO: 3387650 - DNA, 22 bp, Homo sapiens
cagggccagtggggcctgtgga

SEQ ID NO: 3387651 - DNA, 21 bp, Homo sapiens
cagggccatctgactgccaag

SEQ ID NO: 3387652 - DNA, 23 bp, Homo sapiens
cagggccatgctgaggcctgggc

SEQ ID NO: 3387653 - DNA, 12 bp, Homo sapiens
cagggcccagag

SEQ ID NO: 3387654 - DNA, 13 bp, Homo sapiens
cagggcccagagg

SEQ ID NO: 3387655 - DNA, 13 bp, Homo sapiens
cagggccccagaa

SEQ ID NO: 3387656 - DNA, 17 bp, Homo sapiens
cagggccccagaaggca

SEQ ID NO: 3387657 - DNA, 21 bp, Homo sapiens
cagggccccagaaggcaggga

SEQ ID NO: 3387658 - DNA, 21 bp, Homo sapiens
cagggccccccaaatcccagg

SEQ ID NO: 3387659 - DNA, 22 bp, Homo sapiens
cagggccccccaaatcccaggg

SEQ ID NO: 3387660 - DNA, 18 bp, Homo sapiens
cagggcccctcaccctgc

SEQ ID NO: 3387661 - DNA, 22 bp, Homo sapiens
cagggcccctcaccctgcctta

SEQ ID NO: 3387662 - DNA, 15 bp, Homo sapiens
cagggcccggccaca

SEQ ID NO: 3387663 - DNA, 17 bp, Homo sapiens
cagggcccggccacacc

SEQ ID NO: 3387664 - DNA, 18 bp, Homo sapiens
cagggcccggccacaccc

SEQ ID NO: 3387665 - DNA, 22 bp, Homo sapiens
cagggcccggccacacccagcg

SEQ ID NO: 3387666 - DNA, 15 bp, Homo sapiens
cagggccctgcagag

SEQ ID NO: 3387667 - DNA, 18 bp, Homo sapiens
cagggccctgcagagggg

SEQ ID NO: 3387668 - DNA, 22 bp, Homo sapiens
cagggccgaggaggtgcctgga

SEQ ID NO: 3387669 - DNA, 23 bp, Homo sapiens
cagggcctcccgcatcaaggtca

SEQ ID NO: 3387670 - DNA, 21 bp, Homo sapiens
cagggcctggcaggccagtgt

SEQ ID NO: 3387671 - DNA, 17 bp, Homo sapiens
cagggcctggggcctga

SEQ ID NO: 3387672 - DNA, 19 bp, Homo sapiens
cagggcctggggcctgaga

SEQ ID NO: 3387673 - DNA, 21 bp, Homo sapiens
cagggcctggggcctgagaga

SEQ ID NO: 3387674 - DNA, 16 bp, Homo sapiens
cagggcctgggggcag

SEQ ID NO: 3387675 - DNA, 19 bp, Homo sapiens
cagggcctgggggcagtga

SEQ ID NO: 3387676 - DNA, 16 bp, Homo sapiens
cagggcgcccctggga

SEQ ID NO: 3387677 - DNA, 13 bp, Homo sapiens
cagggcgctcaga

SEQ ID NO: 3387678 - DNA, 16 bp, Homo sapiens
cagggcgggcagaggg

SEQ ID NO: 3387679 - DNA, 20 bp, Homo sapiens
cagggcgggcagagggctgg

SEQ ID NO: 3387680 - DNA, 23 bp, Homo sapiens
cagggcggtaccttgtgcccagg

SEQ ID NO: 3387681 - DNA, 18 bp, Homo sapiens
cagggctagtgacttgtg

SEQ ID NO: 3387682 - DNA, 12 bp, Homo sapiens
cagggctcccag

SEQ ID NO: 3387683 - DNA, 21 bp, Homo sapiens
cagggctcccaggggtctccc

SEQ ID NO: 3387684 - DNA, 12 bp, Homo sapiens
cagggctccctt

SEQ ID NO: 3387685 - DNA, 13 bp, Homo sapiens
cagggctcctccc

SEQ ID NO: 3387686 - DNA, 18 bp, Homo sapiens
cagggctcctcccagctt

SEQ ID NO: 3387687 - DNA, 19 bp, Homo sapiens
cagggctcctcccagcttg

SEQ ID NO: 3387688 - DNA, 12 bp, Homo sapiens
cagggctcctgc

SEQ ID NO: 3387689 - DNA, 14 bp, Homo sapiens
cagggctcctgcac

SEQ ID NO: 3387690 - DNA, 20 bp, Homo sapiens
cagggctcctgccttctgtc

SEQ ID NO: 3387691 - DNA, 15 bp, Homo sapiens
cagggctgccctgag

SEQ ID NO: 3387692 - DNA, 17 bp, Homo sapiens
cagggctgccctgagaa

SEQ ID NO: 3387693 - DNA, 22 bp, Homo sapiens
cagggctgccctgagaagctgc

SEQ ID NO: 3387694 - DNA, 23 bp, Homo sapiens
cagggctgccctgagaagctgct

SEQ ID NO: 3387695 - DNA, 18 bp, Homo sapiens
cagggctggagtgcgctc

SEQ ID NO: 3387696 - DNA, 22 bp, Homo sapiens
cagggctggagtgcgctcttgg

SEQ ID NO: 3387697 - DNA, 14 bp, Homo sapiens
cagggctggctctg

SEQ ID NO: 3387698 - DNA, 22 bp, Homo sapiens
cagggctggctctgcactaaga

SEQ ID NO: 3387699 - DNA, 15 bp, Homo sapiens
cagggctggggacag

SEQ ID NO: 3387700 - DNA, 17 bp, Homo sapiens
cagggctggggacagag

SEQ ID NO: 3387701 - DNA, 22 bp, Homo sapiens
cagggctttactccgtaacaga

SEQ ID NO: 3387702 - DNA, 16 bp, Homo sapiens
caggggacaggagtcc

SEQ ID NO: 3387703 - DNA, 21 bp, Homo sapiens
caggggactcagccctgaggt

SEQ ID NO: 3387704 - DNA, 23 bp, Homo sapiens
caggggactcagccctgaggtga

SEQ ID NO: 3387705 - DNA, 18 bp, Homo sapiens
caggggagacaggagcct

SEQ ID NO: 3387706 - DNA, 13 bp, Homo sapiens
caggggaggaaaa

SEQ ID NO: 3387707 - DNA, 17 bp, Homo sapiens
caggggattgaagccct

SEQ ID NO: 3387708 - DNA, 21 bp, Homo sapiens
cagtgagtgagcctggctctt

SEQ ID NO: 3387709 - DNA, 14 bp, Homo sapiens
cagtgagtgtaaat

SEQ ID NO: 3387710 - DNA, 18 bp, Homo sapiens
cagtgatatggcagaaga

SEQ ID NO: 3387711 - DNA, 20 bp, Homo sapiens
cagtgatatggcagaagaca

SEQ ID NO: 3387712 - DNA, 23 bp, Homo sapiens
cagtgatatggcagaagacacca

SEQ ID NO: 3387713 - DNA, 15 bp, Homo sapiens
cagtgatctccatat

SEQ ID NO: 3387714 - DNA, 21 bp, Homo sapiens
cagtgatctccatatgttaca

SEQ ID NO: 3387715 - DNA, 21 bp, Homo sapiens
cagtgatggcgcgggaggcac

SEQ ID NO: 3387716 - DNA, 15 bp, Homo sapiens
cagtgcactcgagcc

SEQ ID NO: 3387717 - DNA, 13 bp, Homo sapiens
cagtgcagacagg

SEQ ID NO: 3387718 - DNA, 15 bp, Homo sapiens
cagtgcagacaggcc

SEQ ID NO: 3387719 - DNA, 15 bp, Homo sapiens
cagtgcagccactgg

SEQ ID NO: 3387720 - DNA, 22 bp, Homo sapiens
cagtgcatagttgtagacaaag

SEQ ID NO: 3387721 - DNA, 14 bp, Homo sapiens
cagtgcatattcct

SEQ ID NO: 3387722 - DNA, 16 bp, Homo sapiens
cagtgcatctcagccc

SEQ ID NO: 3387723 - DNA, 17 bp, Homo sapiens
cagtgcatctcagccca

SEQ ID NO: 3387724 - DNA, 18 bp, Homo sapiens
cagtgcatctcagcccac

SEQ ID NO: 3387725 - DNA, 10 bp, Homo sapiens
cagtgccaac

SEQ ID NO: 3387726 - DNA, 17 bp, Homo sapiens
cagtgccagcaatgaca

SEQ ID NO: 3387727 - DNA, 20 bp, Homo sapiens
cagtgccattccactccact

SEQ ID NO: 3387728 - DNA, 14 bp, Homo sapiens
cagtgccattgtct

SEQ ID NO: 3387729 - DNA, 15 bp, Homo sapiens
cagtgccattgtctt

SEQ ID NO: 3387730 - DNA, 16 bp, Homo sapiens
cagtgccattgtcttt

SEQ ID NO: 3387731 - DNA, 13 bp, Homo sapiens
cagtgcccacagg

SEQ ID NO: 3387732 - DNA, 15 bp, Homo sapiens
cagtgcccacaggat

SEQ ID NO: 3387733 - DNA, 17 bp, Homo sapiens
cagtgcccacaggatca

SEQ ID NO: 3387734 - DNA, 18 bp, Homo sapiens
cagtgcccacaggatcag

SEQ ID NO: 3387735 - DNA, 19 bp, Homo sapiens
cagtgccctcattttatgt

SEQ ID NO: 3387736 - DNA, 14 bp, Homo sapiens
cagtgcctctttga

SEQ ID NO: 3387737 - DNA, 15 bp, Homo sapiens
cagtgccttccataa

SEQ ID NO: 3387738 - DNA, 17 bp, Homo sapiens
cagtgccttccataatt

SEQ ID NO: 3387739 - DNA, 12 bp, Homo sapiens
cagtgccttctc

SEQ ID NO: 3387740 - DNA, 11 bp, Homo sapiens
cagtgccttgc

SEQ ID NO: 3387741 - DNA, 13 bp, Homo sapiens
cagtgccttgctc

SEQ ID NO: 3387742 - DNA, 21 bp, Homo sapiens
cagtgccttgctcggcgccca

SEQ ID NO: 3387743 - DNA, 14 bp, Homo sapiens
cagtgctagaaaat

SEQ ID NO: 3387744 - DNA, 19 bp, Homo sapiens
cagtgctagtgagctgggc

SEQ ID NO: 3387745 - DNA, 23 bp, Homo sapiens
cagtgctcttttctcctcactgt

SEQ ID NO: 3387746 - DNA, 23 bp, Homo sapiens
cagtgctgaccagacagcctccc

SEQ ID NO: 3387747 - DNA, 14 bp, Homo sapiens
cagtgctgccatgc

SEQ ID NO: 3387748 - DNA, 20 bp, Homo sapiens
cagtgctgccatgccactgc

SEQ ID NO: 3387749 - DNA, 14 bp, Homo sapiens
cagtgctgctgtaa

SEQ ID NO: 3387750 - DNA, 18 bp, Homo sapiens
cagtgctgcttctcttgg

SEQ ID NO: 3387751 - DNA, 13 bp, Homo sapiens
cagtgctggattt

SEQ ID NO: 3387752 - DNA, 19 bp, Homo sapiens
cagtgctggatttgatgag

SEQ ID NO: 3387753 - DNA, 15 bp, Homo sapiens
cagtgctgggaccag

SEQ ID NO: 3387754 - DNA, 16 bp, Homo sapiens
cagtgctgggaccaga

SEQ ID NO: 3387755 - DNA, 19 bp, Homo sapiens
cagtgctgggaccagagcc

SEQ ID NO: 3387756 - DNA, 20 bp, Homo sapiens
cagtgctgggaccagagcca

SEQ ID NO: 3387757 - DNA, 21 bp, Homo sapiens
cagtgctgggaccagagccag

SEQ ID NO: 3387758 - DNA, 22 bp, Homo sapiens
cagtgctgggaccagagccaga

SEQ ID NO: 3387759 - DNA, 13 bp, Homo sapiens
cagtgctgtggcc

SEQ ID NO: 3387760 - DNA, 17 bp, Homo sapiens
cagtgcttgggctccac

SEQ ID NO: 3387761 - DNA, 14 bp, Homo sapiens
cagtggaaaacaaa

SEQ ID NO: 3387762 - DNA, 19 bp, Homo sapiens
cagtggaaaccctgagagt

SEQ ID NO: 3387763 - DNA, 19 bp, Homo sapiens
cagtggactcagcagtgac

SEQ ID NO: 3387764 - DNA, 13 bp, Homo sapiens
cagtggagaatta

SEQ ID NO: 3387765 - DNA, 15 bp, Homo sapiens
cagtggaggtttgtc

SEQ ID NO: 3387766 - DNA, 15 bp, Homo sapiens
cagtggatcttcaga

SEQ ID NO: 3387767 - DNA, 19 bp, Homo sapiens
cagtggatcttcagaactg

SEQ ID NO: 3387768 - DNA, 16 bp, Homo sapiens
cagtggcaggggagca

SEQ ID NO: 3387769 - DNA, 17 bp, Homo sapiens
cagtggcaggggagcag

SEQ ID NO: 3387770 - DNA, 21 bp, Homo sapiens
cagtggcgcaatctcggctca

SEQ ID NO: 3387771 - DNA, 15 bp, Homo sapiens
cagtggcttcccagc

SEQ ID NO: 3387772 - DNA, 22 bp, Homo sapiens
cagtgggaactctgacaagggc

SEQ ID NO: 3387773 - DNA, 15 bp, Homo sapiens
cagtgggagccctga

SEQ ID NO: 3387774 - DNA, 22 bp, Homo sapiens
cagtgggagccctgaccttggc

SEQ ID NO: 3387775 - DNA, 16 bp, Homo sapiens
cagtgggagctgcctg

SEQ ID NO: 3387776 - DNA, 12 bp, Homo sapiens
cagtgggagggg

SEQ ID NO: 3387777 - DNA, 16 bp, Homo sapiens
cagtgggaggggcagg

SEQ ID NO: 3387778 - DNA, 20 bp, Homo sapiens
cagtgggaggggcaggctga

SEQ ID NO: 3387779 - DNA, 15 bp, Homo sapiens
cagtgggcatcagca

SEQ ID NO: 3387780 - DNA, 19 bp, Homo sapiens
cagtgggcgggccatgagg

SEQ ID NO: 3387781 - DNA, 23 bp, Homo sapiens
cagtgggcgttgggagcctagct

SEQ ID NO: 3387782 - DNA, 13 bp, Homo sapiens
cagtggggcctgt

SEQ ID NO: 3387783 - DNA, 17 bp, Homo sapiens
cagtggggcctgtggaa

SEQ ID NO: 3387784 - DNA, 20 bp, Homo sapiens
cagtgggtggcacctcctga

SEQ ID NO: 3387785 - DNA, 15 bp, Homo sapiens
cagtggttttatact

SEQ ID NO: 3387786 - DNA, 15 bp, Homo sapiens
cagtgtaaagtgtgt

SEQ ID NO: 3387787 - DNA, 19 bp, Homo sapiens
cagtgtaatcccccaggag

SEQ ID NO: 3387788 - DNA, 21 bp, Homo sapiens
cagtgtacacgtctggacccc

SEQ ID NO: 3387789 - DNA, 19 bp, Homo sapiens
cagtgtacatagtgtaatg

SEQ ID NO: 3387790 - DNA, 16 bp, Homo sapiens
cagtgtacatggaata

SEQ ID NO: 3387791 - DNA, 20 bp, Homo sapiens
cagtgtacatggaataacat

SEQ ID NO: 3387792 - DNA, 16 bp, Homo sapiens
cagtgtagttaattta

SEQ ID NO: 3387793 - DNA, 19 bp, Homo sapiens
cagtgtatcaggtcaggga

SEQ ID NO: 3387794 - DNA, 20 bp, Homo sapiens
cagtgtatcaggtcagggac

SEQ ID NO: 3387795 - DNA, 15 bp, Homo sapiens
cagtgtatggggcag

SEQ ID NO: 3387796 - DNA, 18 bp, Homo sapiens
cagtgtcaagttgtgctt

SEQ ID NO: 3387797 - DNA, 19 bp, Homo sapiens
cagtgtcaagttgtgcttg

SEQ ID NO: 3387798 - DNA, 14 bp, Homo sapiens
cagtgtcacctctc

SEQ ID NO: 3387799 - DNA, 19 bp, Homo sapiens
cagtgtcacctctctcaga

SEQ ID NO: 3387800 - DNA, 20 bp, Homo sapiens
cagtgtcacctctctcagag

SEQ ID NO: 3387801 - DNA, 21 bp, Homo sapiens
cagtgtcattttattttttcc

SEQ ID NO: 3387802 - DNA, 15 bp, Homo sapiens
cagtgtcccaggcag

SEQ ID NO: 3387803 - DNA, 16 bp, Homo sapiens
cagtgtcccaggcagc

SEQ ID NO: 3387804 - DNA, 15 bp, Homo sapiens
cagtgtcccctccac

SEQ ID NO: 3387805 - DNA, 20 bp, Homo sapiens
cagtgtccttagaacatttt

SEQ ID NO: 3387806 - DNA, 13 bp, Homo sapiens
cagtgtctggctt

SEQ ID NO: 3387807 - DNA, 22 bp, Homo sapiens
cagtgtctgtatcggagacagt

SEQ ID NO: 3387808 - DNA, 21 bp, Homo sapiens
cagtgtctgtgccatggattt

SEQ ID NO: 3387809 - DNA, 16 bp, Homo sapiens
cagtgtcttccataat

SEQ ID NO: 3387810 - DNA, 14 bp, Homo sapiens
cagtgtgacaagga

SEQ ID NO: 3387811 - DNA, 19 bp, Homo sapiens
cagtgtgatcccaagtgcc

SEQ ID NO: 3387812 - DNA, 21 bp, Homo sapiens
cagtgtgcacgagtgggaagg

SEQ ID NO: 3387813 - DNA, 22 bp, Homo sapiens
cagtgtgcacgagtgggaagga

SEQ ID NO: 3387814 - DNA, 17 bp, Homo sapiens
cagtgtggagaggggtg

SEQ ID NO: 3387815 - DNA, 23 bp, Homo sapiens
cagtgtgtctaaatttgaatgtt

SEQ ID NO: 3387816 - DNA, 17 bp, Homo sapiens
cagtgttaaatgaaatt

SEQ ID NO: 3387817 - DNA, 14 bp, Homo sapiens
cagtgttagagaaa

SEQ ID NO: 3387818 - DNA, 15 bp, Homo sapiens
cagtgttagagaaat

SEQ ID NO: 3387819 - DNA, 19 bp, Homo sapiens
cagtgttagagaaatcctt

SEQ ID NO: 3387820 - DNA, 14 bp, Homo sapiens
cagtgttccccatc

SEQ ID NO: 3387821 - DNA, 23 bp, Homo sapiens
cagtgttcgcttggctccatgct

SEQ ID NO: 3387822 - DNA, 17 bp, Homo sapiens
cagtgttctatgaacaa

SEQ ID NO: 3387823 - DNA, 15 bp, Homo sapiens
cagtgttgtttgtaa

SEQ ID NO: 3387824 - DNA, 17 bp, Homo sapiens
cagtgttgtttgtaaat

SEQ ID NO: 3387825 - DNA, 14 bp, Homo sapiens
cagtgtttcccata

SEQ ID NO: 3387826 - DNA, 18 bp, Homo sapiens
cagtgtttcccataattt

SEQ ID NO: 3387827 - DNA, 11 bp, Homo sapiens
cagtgttttgg

SEQ ID NO: 3387828 - DNA, 21 bp, Homo sapiens
cagtgtttttgaaacccacag

SEQ ID NO: 3387829 - DNA, 16 bp, Homo sapiens
cagttaaagaagcaat

SEQ ID NO: 3387830 - DNA, 22 bp, Homo sapiens
cagttaactttcagaagagatg

SEQ ID NO: 3387831 - DNA, 16 bp, Homo sapiens
cagttaagaagccctg

SEQ ID NO: 3387832 - DNA, 16 bp, Homo sapiens
cagttaatttttccaa

SEQ ID NO: 3387833 - DNA, 22 bp, Homo sapiens
cagttaccacacatctatgata

SEQ ID NO: 3387834 - DNA, 15 bp, Homo sapiens
catcagaactgaaat

SEQ ID NO: 3387835 - DNA, 13 bp, Homo sapiens
catcagaagataa

SEQ ID NO: 3387836 - DNA, 22 bp, Homo sapiens
catcagacctgtcttccaagga

SEQ ID NO: 3387837 - DNA, 23 bp, Homo sapiens
catcagataagacatatctctaa

SEQ ID NO: 3387838 - DNA, 19 bp, Homo sapiens
catcaggatgaacccagga

SEQ ID NO: 3387839 - DNA, 13 bp, Homo sapiens
catcaggcactgg

SEQ ID NO: 3387840 - DNA, 14 bp, Homo sapiens
catcaggcactggt

SEQ ID NO: 3387841 - DNA, 16 bp, Homo sapiens
catcaggcactggtgg

SEQ ID NO: 3387842 - DNA, 12 bp, Homo sapiens
catcagggacag

SEQ ID NO: 3387843 - DNA, 12 bp, Homo sapiens
catcagggcctg

SEQ ID NO: 3387844 - DNA, 15 bp, Homo sapiens
catcaggtgaggtgt

SEQ ID NO: 3387845 - DNA, 20 bp, Homo sapiens
catcagtattaatactaaaa

SEQ ID NO: 3387846 - DNA, 17 bp, Homo sapiens
catcagtctccaacatg

SEQ ID NO: 3387847 - DNA, 15 bp, Homo sapiens
catcagtgttaaaaa

SEQ ID NO: 3387848 - DNA, 13 bp, Homo sapiens
catcataaaataa

SEQ ID NO: 3387849 - DNA, 20 bp, Homo sapiens
catcataaaataaagtatat

SEQ ID NO: 3387850 - DNA, 22 bp, Homo sapiens
catcataaaataaagtatatat

SEQ ID NO: 3387851 - DNA, 23 bp, Homo sapiens
catcataaaataaagtatatata

SEQ ID NO: 3387852 - DNA, 13 bp, Homo sapiens
catcataattaca

SEQ ID NO: 3387853 - DNA, 23 bp, Homo sapiens
catcataggaagggaccaaggca

SEQ ID NO: 3387854 - DNA, 16 bp, Homo sapiens
catcatatcccctgtg

SEQ ID NO: 3387855 - DNA, 15 bp, Homo sapiens
catcatcagggcctg

SEQ ID NO: 3387856 - DNA, 15 bp, Homo sapiens
catcatcccagctgc

SEQ ID NO: 3387857 - DNA, 11 bp, Homo sapiens
catcatccctt

SEQ ID NO: 3387858 - DNA, 13 bp, Homo sapiens
catcatctgtaga

SEQ ID NO: 3387859 - DNA, 18 bp, Homo sapiens
catcatctgtagatacta

SEQ ID NO: 3387860 - DNA, 16 bp, Homo sapiens
catcatgaattttaca

SEQ ID NO: 3387861 - DNA, 14 bp, Homo sapiens
catcatgccttgat

SEQ ID NO: 3387862 - DNA, 14 bp, Homo sapiens
catcatggctgctt

SEQ ID NO: 3387863 - DNA, 23 bp, Homo sapiens
catcatggctgcttgattttgta

SEQ ID NO: 3387864 - DNA, 13 bp, Homo sapiens
catcatgtctggc

SEQ ID NO: 3387865 - DNA, 19 bp, Homo sapiens
catcatgtggcccaactct

SEQ ID NO: 3387866 - DNA, 16 bp, Homo sapiens
catcatgttattttat

SEQ ID NO: 3387867 - DNA, 22 bp, Homo sapiens
catcattacccttccctgcact

SEQ ID NO: 3387868 - DNA, 14 bp, Homo sapiens
catcattactgttc

SEQ ID NO: 3387869 - DNA, 16 bp, Homo sapiens
catcattactgttcca

SEQ ID NO: 3387870 - DNA, 13 bp, Homo sapiens
catcattagaaca

SEQ ID NO: 3387871 - DNA, 14 bp, Homo sapiens
catcattagaacaa

SEQ ID NO: 3387872 - DNA, 23 bp, Homo sapiens
catcattccctctcatctcaggt

SEQ ID NO: 3387873 - DNA, 12 bp, Homo sapiens
catcatttctgt

SEQ ID NO: 3387874 - DNA, 14 bp, Homo sapiens
catcattttacagt

SEQ ID NO: 3387875 - DNA, 23 bp, Homo sapiens
catccaaaatagttaagacatga

SEQ ID NO: 3387876 - DNA, 14 bp, Homo sapiens
catccaaagttgcc

SEQ ID NO: 3387877 - DNA, 16 bp, Homo sapiens
catccaaccttcccaa

SEQ ID NO: 3387878 - DNA, 18 bp, Homo sapiens
catccaactccagcaact

SEQ ID NO: 3387879 - DNA, 14 bp, Homo sapiens
catccaacttatgt

SEQ ID NO: 3387880 - DNA, 16 bp, Homo sapiens
catccaacttccaaga

SEQ ID NO: 3387881 - DNA, 14 bp, Homo sapiens
catccaatcctcac

SEQ ID NO: 3387882 - DNA, 21 bp, Homo sapiens
catccaatcctcactgggtgg

SEQ ID NO: 3387883 - DNA, 16 bp, Homo sapiens
catccacccagtgctg

SEQ ID NO: 3387884 - DNA, 18 bp, Homo sapiens
catccacccagtgctgcc

SEQ ID NO: 3387885 - DNA, 19 bp, Homo sapiens
catccacccgggggagccc

SEQ ID NO: 3387886 - DNA, 21 bp, Homo sapiens
catccacccgggggagcccag

SEQ ID NO: 3387887 - DNA, 21 bp, Homo sapiens
catccaccttggctctgccag

SEQ ID NO: 3387888 - DNA, 22 bp, Homo sapiens
catccactctaccctcccaccc

SEQ ID NO: 3387889 - DNA, 17 bp, Homo sapiens
catccactgtgccatgt

SEQ ID NO: 3387890 - DNA, 23 bp, Homo sapiens
catccactgtgccatgtgccagg

SEQ ID NO: 3387891 - DNA, 14 bp, Homo sapiens
catccagcctgtgt

SEQ ID NO: 3387892 - DNA, 12 bp, Homo sapiens
catccaggcagt

SEQ ID NO: 3387893 - DNA, 17 bp, Homo sapiens
catccaggttcagcttg

SEQ ID NO: 3387894 - DNA, 19 bp, Homo sapiens
catccagtgacaaaccatc

SEQ ID NO: 3387895 - DNA, 18 bp, Homo sapiens
catccagttggcttttta

SEQ ID NO: 3387896 - DNA, 14 bp, Homo sapiens
catccagtttgttc

SEQ ID NO: 3387897 - DNA, 15 bp, Homo sapiens
catccagtttgttct

SEQ ID NO: 3387898 - DNA, 16 bp, Homo sapiens
catccagtttgttctc

SEQ ID NO: 3387899 - DNA, 18 bp, Homo sapiens
catccatagtaactgaca

SEQ ID NO: 3387900 - DNA, 16 bp, Homo sapiens
catccatctccaggga

SEQ ID NO: 3387901 - DNA, 16 bp, Homo sapiens
catccatgtcctatgt

SEQ ID NO: 3387902 - DNA, 20 bp, Homo sapiens
catccattaggccagcaacg

SEQ ID NO: 3387903 - DNA, 18 bp, Homo sapiens
catcccaaccagtgccaa

SEQ ID NO: 3387904 - DNA, 20 bp, Homo sapiens
catcccaaccagtgccaagg

SEQ ID NO: 3387905 - DNA, 22 bp, Homo sapiens
catcccacttagccgcaccctg

SEQ ID NO: 3387906 - DNA, 20 bp, Homo sapiens
catcccagcacctgcctcct

SEQ ID NO: 3387907 - DNA, 14 bp, Homo sapiens
catcccagcagccc

SEQ ID NO: 3387908 - DNA, 16 bp, Homo sapiens
catcccagccccaatt

SEQ ID NO: 3387909 - DNA, 12 bp, Homo sapiens
catcccagcctg

SEQ ID NO: 3387910 - DNA, 15 bp, Homo sapiens
catcccagcctgtgg

SEQ ID NO: 3387911 - DNA, 16 bp, Homo sapiens
catcccagcctgtggt

SEQ ID NO: 3387912 - DNA, 18 bp, Homo sapiens
catcccagcctgtggtta

SEQ ID NO: 3387913 - DNA, 13 bp, Homo sapiens
catcccaggacac

SEQ ID NO: 3387914 - DNA, 22 bp, Homo sapiens
catcccaggacaccacacccag

SEQ ID NO: 3387915 - DNA, 23 bp, Homo sapiens
catcccaggacaccacacccagc

SEQ ID NO: 3387916 - DNA, 12 bp, Homo sapiens
catcccatcatc

SEQ ID NO: 3387917 - DNA, 18 bp, Homo sapiens
catcccatgagaccctgg

SEQ ID NO: 3387918 - DNA, 20 bp, Homo sapiens
catcccattcacttctgcat

SEQ ID NO: 3387919 - DNA, 12 bp, Homo sapiens
catccccaccag

SEQ ID NO: 3387920 - DNA, 13 bp, Homo sapiens
catccccaccagc

SEQ ID NO: 3387921 - DNA, 17 bp, Homo sapiens
catccccaccagctcgt

SEQ ID NO: 3387922 - DNA, 18 bp, Homo sapiens
catccccatcctccagct

SEQ ID NO: 3387923 - DNA, 12 bp, Homo sapiens
catccccctgcc

SEQ ID NO: 3387924 - DNA, 17 bp, Homo sapiens
catcccctcgtcctgtc

SEQ ID NO: 3387925 - DNA, 18 bp, Homo sapiens
catcccggaggaaatctg

SEQ ID NO: 3387926 - DNA, 16 bp, Homo sapiens
catcccggcctcttcc

SEQ ID NO: 3387927 - DNA, 21 bp, Homo sapiens
catcccggcctcttccaccca

SEQ ID NO: 3387928 - DNA, 16 bp, Homo sapiens
catcccgtgttctcct

SEQ ID NO: 3387929 - DNA, 12 bp, Homo sapiens
catccctacccc

SEQ ID NO: 3387930 - DNA, 23 bp, Homo sapiens
catccctccctcccgtccttccc

SEQ ID NO: 3387931 - DNA, 13 bp, Homo sapiens
catccctgccaca

SEQ ID NO: 3387932 - DNA, 18 bp, Homo sapiens
catccctgccacatacag

SEQ ID NO: 3387933 - DNA, 22 bp, Homo sapiens
catccctgccacatacaggtgc

SEQ ID NO: 3387934 - DNA, 23 bp, Homo sapiens
catccctgccacatacaggtgct

SEQ ID NO: 3387935 - DNA, 15 bp, Homo sapiens
catccctgcctggtc

SEQ ID NO: 3387936 - DNA, 19 bp, Homo sapiens
catccctggagcaggagcc

SEQ ID NO: 3387937 - DNA, 22 bp, Homo sapiens
catccctggagcaggagccccg

SEQ ID NO: 3387938 - DNA, 12 bp, Homo sapiens
catccctggccc

SEQ ID NO: 3387939 - DNA, 13 bp, Homo sapiens
catccctggcccc

SEQ ID NO: 3387940 - DNA, 22 bp, Homo sapiens
catccctgggcccctccacgcc

SEQ ID NO: 3387941 - DNA, 24 bp, Homo sapiens
catccctgggcccctccacgcctc

SEQ ID NO: 3387942 - DNA, 14 bp, Homo sapiens
catcccttcctgga

SEQ ID NO: 3387943 - DNA, 15 bp, Homo sapiens
catcccttcctggaa

SEQ ID NO: 3387944 - DNA, 20 bp, Homo sapiens
catcccttcctggaaacagc

SEQ ID NO: 3387945 - DNA, 14 bp, Homo sapiens
catccctttccctt

SEQ ID NO: 3387946 - DNA, 15 bp, Homo sapiens
catccctttttcaat

SEQ ID NO: 3387947 - DNA, 19 bp, Homo sapiens
catccgccttttgtataca

SEQ ID NO: 3387948 - DNA, 17 bp, Homo sapiens
catccgtcattgctgct

SEQ ID NO: 3387949 - DNA, 23 bp, Homo sapiens
catccgtgtatttggctgggcta

SEQ ID NO: 3387950 - DNA, 17 bp, Homo sapiens
catcctatccactgggc

SEQ ID NO: 3387951 - DNA, 15 bp, Homo sapiens
catcctcatccctga

SEQ ID NO: 3387952 - DNA, 23 bp, Homo sapiens
catcctcattgcctcctgttctg

SEQ ID NO: 3387953 - DNA, 17 bp, Homo sapiens
catcctccacatcctgt

SEQ ID NO: 3387954 - DNA, 19 bp, Homo sapiens
catcctccacatcctgtgt

SEQ ID NO: 3387955 - DNA, 13 bp, Homo sapiens
catcctccagctt

SEQ ID NO: 3387956 - DNA, 17 bp, Homo sapiens
catcctccagcttctgg

SEQ ID NO: 3387957 - DNA, 19 bp, Homo sapiens
catcctccagtaccttgct

SEQ ID NO: 3387958 - DNA, 13 bp, Homo sapiens
catcctccggaga

SEQ ID NO: 3387959 - DNA, 16 bp, Homo sapiens
catcctccgtccagcc

SEQ ID NO: 3387960 - DNA, 14 bp, Homo sapiens
catcctcctggaac

SEQ ID NO: 3387961 - DNA, 22 bp, Homo sapiens
catgtggaaagtgaatttgaat

SEQ ID NO: 3387962 - DNA, 20 bp, Homo sapiens
catgtggcaaaatatggttt

SEQ ID NO: 3387963 - DNA, 20 bp, Homo sapiens
catgtggcccaactctcctg

SEQ ID NO: 3387964 - DNA, 12 bp, Homo sapiens
catgtggctgga

SEQ ID NO: 3387965 - DNA, 13 bp, Homo sapiens
catgtggctggaa

SEQ ID NO: 3387966 - DNA, 15 bp, Homo sapiens
catgtggctggaaga

SEQ ID NO: 3387967 - DNA, 17 bp, Homo sapiens
catgtggggccaggtca

SEQ ID NO: 3387968 - DNA, 16 bp, Homo sapiens
catgtgggtgagccag

SEQ ID NO: 3387969 - DNA, 20 bp, Homo sapiens
catgtgggtgagccagtgga

SEQ ID NO: 3387970 - DNA, 21 bp, Homo sapiens
catgtggtttggttcctctct

SEQ ID NO: 3387971 - DNA, 22 bp, Homo sapiens
catgtggtttggttcctctctg

SEQ ID NO: 3387972 - DNA, 23 bp, Homo sapiens
catgtggtttggttcctctctgg

SEQ ID NO: 3387973 - DNA, 18 bp, Homo sapiens
catgtgtagcctgtgcat

SEQ ID NO: 3387974 - DNA, 14 bp, Homo sapiens
catgtgtcccagga

SEQ ID NO: 3387975 - DNA, 18 bp, Homo sapiens
catgtgtcccaggagcag

SEQ ID NO: 3387976 - DNA, 15 bp, Homo sapiens
catgtgtcccctcac

SEQ ID NO: 3387977 - DNA, 24 bp, Homo sapiens
catgtgtcccctcactctgtcagc

SEQ ID NO: 3387978 - DNA, 18 bp, Homo sapiens
catgtgtgcaacagggta

SEQ ID NO: 3387979 - DNA, 13 bp, Homo sapiens
catgtgtgcctgt

SEQ ID NO: 3387980 - DNA, 14 bp, Homo sapiens
catgtgtgctgaac

SEQ ID NO: 3387981 - DNA, 12 bp, Homo sapiens
catgtgtggaag

SEQ ID NO: 3387982 - DNA, 12 bp, Homo sapiens
catgtgtgtata

SEQ ID NO: 3387983 - DNA, 19 bp, Homo sapiens
catgtgtgtatatatgtgt

SEQ ID NO: 3387984 - DNA, 14 bp, Homo sapiens
catgttaactttat

SEQ ID NO: 3387985 - DNA, 14 bp, Homo sapiens
catgttagttacct

SEQ ID NO: 3387986 - DNA, 22 bp, Homo sapiens
catgttagttaccttatagtta

SEQ ID NO: 3387987 - DNA, 17 bp, Homo sapiens
catgttattttattatt

SEQ ID NO: 3387988 - DNA, 18 bp, Homo sapiens
catgttcattataatctc

SEQ ID NO: 3387989 - DNA, 18 bp, Homo sapiens
catgttctaatactttgt

SEQ ID NO: 3387990 - DNA, 20 bp, Homo sapiens
catgttctgcccccagccca

SEQ ID NO: 3387991 - DNA, 21 bp, Homo sapiens
catgttctgcccccagcccaa

SEQ ID NO: 3387992 - DNA, 20 bp, Homo sapiens
catgttgacgagactggtct

SEQ ID NO: 3387993 - DNA, 19 bp, Homo sapiens
catgttgagccaggcctgg

SEQ ID NO: 3387994 - DNA, 20 bp, Homo sapiens
catgttgatcatgtactttt

SEQ ID NO: 3387995 - DNA, 21 bp, Homo sapiens
catgttgatcatgtacttttt

SEQ ID NO: 3387996 - DNA, 23 bp, Homo sapiens
catgttgcaaagaactccagagt

SEQ ID NO: 3387997 - DNA, 14 bp, Homo sapiens
catgttgctgagga

SEQ ID NO: 3387998 - DNA, 16 bp, Homo sapiens
catgttgctgaggagt

SEQ ID NO: 3387999 - DNA, 12 bp, Homo sapiens
catgttggccag

SEQ ID NO: 3388000 - DNA, 13 bp, Homo sapiens
catgttggccagg

SEQ ID NO: 3388001 - DNA, 15 bp, Homo sapiens
catgttggccaggct

SEQ ID NO: 3388002 - DNA, 18 bp, Homo sapiens
catgttggccaggctggt

SEQ ID NO: 3388003 - DNA, 20 bp, Homo sapiens
catgttggccaggctggtct

SEQ ID NO: 3388004 - DNA, 19 bp, Homo sapiens
catgttgggaaacttggct

SEQ ID NO: 3388005 - DNA, 20 bp, Homo sapiens
catgttgggaaacttggctc

SEQ ID NO: 3388006 - DNA, 21 bp, Homo sapiens
catgttgggaaacttggctcg

SEQ ID NO: 3388007 - DNA, 12 bp, Homo sapiens
catgttgtaatg

SEQ ID NO: 3388008 - DNA, 19 bp, Homo sapiens
catgttgtaatgctgcact

SEQ ID NO: 3388009 - DNA, 20 bp, Homo sapiens
catgttgtaatgctgcactt

SEQ ID NO: 3388010 - DNA, 14 bp, Homo sapiens
catgttgttaaaat

SEQ ID NO: 3388011 - DNA, 23 bp, Homo sapiens
catgtttataaatcttatgctct

SEQ ID NO: 3388012 - DNA, 15 bp, Homo sapiens
catgtttatgaaaat

SEQ ID NO: 3388013 - DNA, 16 bp, Homo sapiens
catgtttatgaaaata

SEQ ID NO: 3388014 - DNA, 15 bp, Homo sapiens
catgtttattctaat

SEQ ID NO: 3388015 - DNA, 19 bp, Homo sapiens
catgtttatttttcttgtc

SEQ ID NO: 3388016 - DNA, 17 bp, Homo sapiens
catgtttcatgttttgt

SEQ ID NO: 3388017 - DNA, 22 bp, Homo sapiens
catgtttcatgttttgtgacta

SEQ ID NO: 3388018 - DNA, 14 bp, Homo sapiens
catgtttgcttcat

SEQ ID NO: 3388019 - DNA, 22 bp, Homo sapiens
catgtttggtgtttgtctgtgt

SEQ ID NO: 3388020 - DNA, 13 bp, Homo sapiens
catgtttgtaaat

SEQ ID NO: 3388021 - DNA, 20 bp, Homo sapiens
catgttttgagacataaatg

SEQ ID NO: 3388022 - DNA, 12 bp, Homo sapiens
catgttttgtat

SEQ ID NO: 3388023 - DNA, 19 bp, Homo sapiens
catgttttgtatacaaata

SEQ ID NO: 3388024 - DNA, 20 bp, Homo sapiens
catgttttgtatacaaatat

SEQ ID NO: 3388025 - DNA, 17 bp, Homo sapiens
catgtttttgttttctt

SEQ ID NO: 3388026 - DNA, 13 bp, Homo sapiens
cattaaaaatgga

SEQ ID NO: 3388027 - DNA, 19 bp, Homo sapiens
cattaaaaatgttagtatt

SEQ ID NO: 3388028 - DNA, 15 bp, Homo sapiens
cattaaaactgcttt

SEQ ID NO: 3388029 - DNA, 16 bp, Homo sapiens
cattaaaactgctttt

SEQ ID NO: 3388030 - DNA, 18 bp, Homo sapiens
cattaaaagaagactgga

SEQ ID NO: 3388031 - DNA, 14 bp, Homo sapiens
cattaaaataaacc

SEQ ID NO: 3388032 - DNA, 12 bp, Homo sapiens
cattaaacctgt

SEQ ID NO: 3388033 - DNA, 15 bp, Homo sapiens
cattaaacttgaagc

SEQ ID NO: 3388034 - DNA, 18 bp, Homo sapiens
cattaaagtcagaagttt

SEQ ID NO: 3388035 - DNA, 14 bp, Homo sapiens
cattaaatgaatat

SEQ ID NO: 3388036 - DNA, 22 bp, Homo sapiens
cattaaatgaatattttgataa

SEQ ID NO: 3388037 - DNA, 17 bp, Homo sapiens
cattaaattcacaaact

SEQ ID NO: 3388038 - DNA, 12 bp, Homo sapiens
cattaacacatt

SEQ ID NO: 3388039 - DNA, 23 bp, Homo sapiens
cattaacacattgttatttctgt

SEQ ID NO: 3388040 - DNA, 17 bp, Homo sapiens
cattaacagttttccat

SEQ ID NO: 3388041 - DNA, 22 bp, Homo sapiens
cattaacagttttccatgaaaa

SEQ ID NO: 3388042 - DNA, 17 bp, Homo sapiens
cattaacttagcatgtg

SEQ ID NO: 3388043 - DNA, 16 bp, Homo sapiens
cattaacttctctgga

SEQ ID NO: 3388044 - DNA, 22 bp, Homo sapiens
cattaagaatgttggtttactt

SEQ ID NO: 3388045 - DNA, 16 bp, Homo sapiens
cattaaggcagtatga

SEQ ID NO: 3388046 - DNA, 19 bp, Homo sapiens
cattaaggggaagaatgaa

SEQ ID NO: 3388047 - DNA, 21 bp, Homo sapiens
cattaaggggaagaatgaaag

SEQ ID NO: 3388048 - DNA, 17 bp, Homo sapiens
cattaagtcatgtgtga

SEQ ID NO: 3388049 - DNA, 20 bp, Homo sapiens
cattaatagcagcctttctc

SEQ ID NO: 3388050 - DNA, 19 bp, Homo sapiens
cattaatgatgatcttcag

SEQ ID NO: 3388051 - DNA, 21 bp, Homo sapiens
cattaatgcctgctttttgga

SEQ ID NO: 3388052 - DNA, 21 bp, Homo sapiens
cattaatgttaattcagcact

SEQ ID NO: 3388053 - DNA, 13 bp, Homo sapiens
cattaattaatta

SEQ ID NO: 3388054 - DNA, 15 bp, Homo sapiens
cattaattacataca

SEQ ID NO: 3388055 - DNA, 20 bp, Homo sapiens
cattaattacatacagattt

SEQ ID NO: 3388056 - DNA, 14 bp, Homo sapiens
cattaattttgtgc

SEQ ID NO: 3388057 - DNA, 15 bp, Homo sapiens
cattaattttgtgca

SEQ ID NO: 3388058 - DNA, 17 bp, Homo sapiens
cattaattttgtgcatt

SEQ ID NO: 3388059 - DNA, 20 bp, Homo sapiens
cattaattttgtgcattctt

SEQ ID NO: 3388060 - DNA, 19 bp, Homo sapiens
cattacaaaatccaactct

SEQ ID NO: 3388061 - DNA, 20 bp, Homo sapiens
cattacagagaggagaaaca

SEQ ID NO: 3388062 - DNA, 14 bp, Homo sapiens
cattacagcttaat

SEQ ID NO: 3388063 - DNA, 16 bp, Homo sapiens
cattacagcttaatca

SEQ ID NO: 3388064 - DNA, 23 bp, Homo sapiens
cattaccaaaataataaaaatca

SEQ ID NO: 3388065 - DNA, 18 bp, Homo sapiens
cattaccctctgcagaac

SEQ ID NO: 3388066 - DNA, 15 bp, Homo sapiens
cattacccttccctg

SEQ ID NO: 3388067 - DNA, 13 bp, Homo sapiens
cattaccttactg

SEQ ID NO: 3388068 - DNA, 17 bp, Homo sapiens
cattaccttactgtgga

SEQ ID NO: 3388069 - DNA, 18 bp, Homo sapiens
cattactaaggcaggtgg

SEQ ID NO: 3388070 - DNA, 23 bp, Homo sapiens
cattactgtacagggttatctgc

SEQ ID NO: 3388071 - DNA, 14 bp, Homo sapiens
cattactgtccttt

SEQ ID NO: 3388072 - DNA, 16 bp, Homo sapiens
cattactgttccagat

SEQ ID NO: 3388073 - DNA, 17 bp, Homo sapiens
cattagaaatagacagt

SEQ ID NO: 3388074 - DNA, 19 bp, Homo sapiens
cattagattttattttact

SEQ ID NO: 3388075 - DNA, 23 bp, Homo sapiens
cattagcacagattttaattgtc

SEQ ID NO: 3388076 - DNA, 18 bp, Homo sapiens
cattagcagtttgctttg

SEQ ID NO: 3388077 - DNA, 20 bp, Homo sapiens
cattaggccagcaacgcttg

SEQ ID NO: 3388078 - DNA, 16 bp, Homo sapiens
cattagtgaaaattct

SEQ ID NO: 3388079 - DNA, 14 bp, Homo sapiens
cattataatctcaa

SEQ ID NO: 3388080 - DNA, 15 bp, Homo sapiens
cattatattctaatt

SEQ ID NO: 3388081 - DNA, 13 bp, Homo sapiens
cattatattttga

SEQ ID NO: 3388082 - DNA, 20 bp, Homo sapiens
cattatcgggagcagtgtct

SEQ ID NO: 3388083 - DNA, 21 bp, Homo sapiens
cattatcgggagcagtgtctt

SEQ ID NO: 3388084 - DNA, 19 bp, Homo sapiens
cattatctcacttagtcct

SEQ ID NO: 3388085 - DNA, 18 bp, Homo sapiens
cattatgggttcttcccc

SEQ ID NO: 3388086 - DNA, 16 bp, Homo sapiens
cattatgtaaaagaaa

SEQ ID NO: 3388087 - DNA, 13 bp, Homo sapiens
ccaacaccagccc

SEQ ID NO: 3388088 - DNA, 17 bp, Homo sapiens
ccaacaccagcccctgc

SEQ ID NO: 3388089 - DNA, 14 bp, Homo sapiens
ccaacactgtgccc

SEQ ID NO: 3388090 - DNA, 18 bp, Homo sapiens
ccaacactgtgccctggt

SEQ ID NO: 3388091 - DNA, 19 bp, Homo sapiens
ccaacactgtgccctggtg

SEQ ID NO: 3388092 - DNA, 20 bp, Homo sapiens
ccaacactttgagcattttt

SEQ ID NO: 3388093 - DNA, 13 bp, Homo sapiens
ccaacagccatgc

SEQ ID NO: 3388094 - DNA, 22 bp, Homo sapiens
ccaacagcgacatagcccatcc

SEQ ID NO: 3388095 - DNA, 19 bp, Homo sapiens
ccaacagtcaaaacagaga

SEQ ID NO: 3388096 - DNA, 20 bp, Homo sapiens
ccaacagtgagtctgtcagc

SEQ ID NO: 3388097 - DNA, 16 bp, Homo sapiens
ccaacatcaacatctt

SEQ ID NO: 3388098 - DNA, 15 bp, Homo sapiens
ccaacatccagatct

SEQ ID NO: 3388099 - DNA, 15 bp, Homo sapiens
ccaacatttctcact

SEQ ID NO: 3388100 - DNA, 15 bp, Homo sapiens
ccaaccaaataagac

SEQ ID NO: 3388101 - DNA, 16 bp, Homo sapiens
ccaaccacagagaaca

SEQ ID NO: 3388102 - DNA, 19 bp, Homo sapiens
ccaaccacagcatcgggag

SEQ ID NO: 3388103 - DNA, 12 bp, Homo sapiens
ccaaccagacag

SEQ ID NO: 3388104 - DNA, 17 bp, Homo sapiens
ccaaccagacagcacag

SEQ ID NO: 3388105 - DNA, 20 bp, Homo sapiens
ccaaccagacagcacagggc

SEQ ID NO: 3388106 - DNA, 18 bp, Homo sapiens
ccaaccagtgccaaggac

SEQ ID NO: 3388107 - DNA, 15 bp, Homo sapiens
ccaaccatcttcact

SEQ ID NO: 3388108 - DNA, 16 bp, Homo sapiens
ccaacccacctctggc

SEQ ID NO: 3388109 - DNA, 18 bp, Homo sapiens
ccaacccccaccccacac

SEQ ID NO: 3388110 - DNA, 20 bp, Homo sapiens
ccaacccccaccccacactt

SEQ ID NO: 3388111 - DNA, 15 bp, Homo sapiens
ccaacccccctcctg

SEQ ID NO: 3388112 - DNA, 16 bp, Homo sapiens
ccaacccccctcctgc

SEQ ID NO: 3388113 - DNA, 18 bp, Homo sapiens
ccaacccccctcctgctc

SEQ ID NO: 3388114 - DNA, 20 bp, Homo sapiens
ccaacccccctcctgctcct

SEQ ID NO: 3388115 - DNA, 21 bp, Homo sapiens
ccaacccccctcctgctcctc

SEQ ID NO: 3388116 - DNA, 22 bp, Homo sapiens
ccaacccccctcctgctcctcc

SEQ ID NO: 3388117 - DNA, 21 bp, Homo sapiens
ccaaccccgcggtgctctggc

SEQ ID NO: 3388118 - DNA, 18 bp, Homo sapiens
ccaacccctgaggaagat

SEQ ID NO: 3388119 - DNA, 19 bp, Homo sapiens
ccaaccctaggttccctgt

SEQ ID NO: 3388120 - DNA, 14 bp, Homo sapiens
ccaaccctcagagc

SEQ ID NO: 3388121 - DNA, 20 bp, Homo sapiens
ccaacctcagaggcagcttc

SEQ ID NO: 3388122 - DNA, 22 bp, Homo sapiens
ccaacctcagggctcccagggg

SEQ ID NO: 3388123 - DNA, 12 bp, Homo sapiens
ccaaccttccca

SEQ ID NO: 3388124 - DNA, 15 bp, Homo sapiens
ccaacgcacaggaaa

SEQ ID NO: 3388125 - DNA, 12 bp, Homo sapiens
ccaacgcccctg

SEQ ID NO: 3388126 - DNA, 19 bp, Homo sapiens
ccaacgcccctgtggccaa

SEQ ID NO: 3388127 - DNA, 21 bp, Homo sapiens
ccaacggccctgcagccagct

SEQ ID NO: 3388128 - DNA, 18 bp, Homo sapiens
ccaacgttactcagggct

SEQ ID NO: 3388129 - DNA, 20 bp, Homo sapiens
ccaacgttcgatttctacct

SEQ ID NO: 3388130 - DNA, 23 bp, Homo sapiens
ccaacgttcgatttctacctcag

SEQ ID NO: 3388131 - DNA, 19 bp, Homo sapiens
ccaactaatgccttactct

SEQ ID NO: 3388132 - DNA, 20 bp, Homo sapiens
ccaactaatgccttactctt

SEQ ID NO: 3388133 - DNA, 22 bp, Homo sapiens
ccaactactaatagaataaagg

SEQ ID NO: 3388134 - DNA, 18 bp, Homo sapiens
ccaactactgagctgaga

SEQ ID NO: 3388135 - DNA, 17 bp, Homo sapiens
ccaactagacattctgt

SEQ ID NO: 3388136 - DNA, 12 bp, Homo sapiens
ccaactctaata

SEQ ID NO: 3388137 - DNA, 13 bp, Homo sapiens
ccaactctaatat

SEQ ID NO: 3388138 - DNA, 23 bp, Homo sapiens
ccaactctcctggcctggccatc

SEQ ID NO: 3388139 - DNA, 15 bp, Homo sapiens
ccaactctctgagag

SEQ ID NO: 3388140 - DNA, 16 bp, Homo sapiens
ccaactctgagcccat

SEQ ID NO: 3388141 - DNA, 22 bp, Homo sapiens
ccaactctgagcccatgttctg

SEQ ID NO: 3388142 - DNA, 20 bp, Homo sapiens
ccaactgcaaaaaaagcctc

SEQ ID NO: 3388143 - DNA, 18 bp, Homo sapiens
ccaactgctaatgcaaat

SEQ ID NO: 3388144 - DNA, 14 bp, Homo sapiens
ccaactgctgcttt

SEQ ID NO: 3388145 - DNA, 11 bp, Homo sapiens
ccaactgtgtt

SEQ ID NO: 3388146 - DNA, 23 bp, Homo sapiens
ccaactgtgttgtattaacaaaa

SEQ ID NO: 3388147 - DNA, 14 bp, Homo sapiens
ccaactgtttccct

SEQ ID NO: 3388148 - DNA, 16 bp, Homo sapiens
ccaactgtttccctgc

SEQ ID NO: 3388149 - DNA, 20 bp, Homo sapiens
ccaactgtttccctgctgaa

SEQ ID NO: 3388150 - DNA, 19 bp, Homo sapiens
ccaacttggttctgcttca

SEQ ID NO: 3388151 - DNA, 23 bp, Homo sapiens
ccaacttgtattaaagacagagg

SEQ ID NO: 3388152 - DNA, 16 bp, Homo sapiens
ccaacttgtctgggaa

SEQ ID NO: 3388153 - DNA, 17 bp, Homo sapiens
ccaacttgttgtggctc

SEQ ID NO: 3388154 - DNA, 14 bp, Homo sapiens
ccaactttctgtaa

SEQ ID NO: 3388155 - DNA, 17 bp, Homo sapiens
ccaactttctgtaaact

SEQ ID NO: 3388156 - DNA, 14 bp, Homo sapiens
ccaagaaaatgaag

SEQ ID NO: 3388157 - DNA, 14 bp, Homo sapiens
ccaagaaacgtctt

SEQ ID NO: 3388158 - DNA, 14 bp, Homo sapiens
ccaagaacattatc

SEQ ID NO: 3388159 - DNA, 15 bp, Homo sapiens
ccaagaatacttgaa

SEQ ID NO: 3388160 - DNA, 16 bp, Homo sapiens
ccaagacaaatcaaca

SEQ ID NO: 3388161 - DNA, 23 bp, Homo sapiens
ccaagacagatgccccagagctg

SEQ ID NO: 3388162 - DNA, 11 bp, Homo sapiens
ccaagacattg

SEQ ID NO: 3388163 - DNA, 19 bp, Homo sapiens
ccaagacctgttggttcca

SEQ ID NO: 3388164 - DNA, 21 bp, Homo sapiens
ccaagactctagagtccaagg

SEQ ID NO: 3388165 - DNA, 20 bp, Homo sapiens
ccaagacttggcaacagaag

SEQ ID NO: 3388166 - DNA, 11 bp, Homo sapiens
ccaagagacat

SEQ ID NO: 3388167 - DNA, 16 bp, Homo sapiens
ccaagagcagagtctg

SEQ ID NO: 3388168 - DNA, 21 bp, Homo sapiens
ccaagagcagagtctgggcct

SEQ ID NO: 3388169 - DNA, 17 bp, Homo sapiens
ccaagagccctgtggcc

SEQ ID NO: 3388170 - DNA, 18 bp, Homo sapiens
ccaagaggactgagactg

SEQ ID NO: 3388171 - DNA, 22 bp, Homo sapiens
ccaagaggggccgctgacttct

SEQ ID NO: 3388172 - DNA, 19 bp, Homo sapiens
ccaagagggtcctttagta

SEQ ID NO: 3388173 - DNA, 19 bp, Homo sapiens
ccaagaggtctgagccctg

SEQ ID NO: 3388174 - DNA, 15 bp, Homo sapiens
ccaagagtctaaaga

SEQ ID NO: 3388175 - DNA, 16 bp, Homo sapiens
ccaagataagcctgag

SEQ ID NO: 3388176 - DNA, 20 bp, Homo sapiens
ccaagataagcctgagcctt

SEQ ID NO: 3388177 - DNA, 13 bp, Homo sapiens
ccaagatctataa

SEQ ID NO: 3388178 - DNA, 20 bp, Homo sapiens
ccaagattccggatcctaag

SEQ ID NO: 3388179 - DNA, 14 bp, Homo sapiens
ccaagattctactc

SEQ ID NO: 3388180 - DNA, 10 bp, Homo sapiens
ccaagcaaac

SEQ ID NO: 3388181 - DNA, 17 bp, Homo sapiens
ccaagcaacctgggtcc

SEQ ID NO: 3388182 - DNA, 18 bp, Homo sapiens
ccaagcaacctgggtcca

SEQ ID NO: 3388183 - DNA, 15 bp, Homo sapiens
ccaagcagccagcca

SEQ ID NO: 3388184 - DNA, 16 bp, Homo sapiens
ccaagcagccagccag

SEQ ID NO: 3388185 - DNA, 17 bp, Homo sapiens
ccaagcaggagacgaca

SEQ ID NO: 3388186 - DNA, 13 bp, Homo sapiens
ccaagcatcttgg

SEQ ID NO: 3388187 - DNA, 19 bp, Homo sapiens
ccaagccagaggctgggtt

SEQ ID NO: 3388188 - DNA, 18 bp, Homo sapiens
ccaagccctgaggcctga

SEQ ID NO: 3388189 - DNA, 19 bp, Homo sapiens
ccaagccctgaggcctgag

SEQ ID NO: 3388190 - DNA, 23 bp, Homo sapiens
ccaagccgaccttccctccgcct

SEQ ID NO: 3388191 - DNA, 16 bp, Homo sapiens
ccaagccgtggcttcc

SEQ ID NO: 3388192 - DNA, 21 bp, Homo sapiens
ccaagccgtggcttcccgctc

SEQ ID NO: 3388193 - DNA, 16 bp, Homo sapiens
ccaagcctccacagcg

SEQ ID NO: 3388194 - DNA, 11 bp, Homo sapiens
ccaagcctggg

SEQ ID NO: 3388195 - DNA, 15 bp, Homo sapiens
ccaagctaatttata

SEQ ID NO: 3388196 - DNA, 15 bp, Homo sapiens
ccaagctccaagccc

SEQ ID NO: 3388197 - DNA, 14 bp, Homo sapiens
ccaagctccatctc

SEQ ID NO: 3388198 - DNA, 11 bp, Homo sapiens
ccaagctccct

SEQ ID NO: 3388199 - DNA, 15 bp, Homo sapiens
ccaagctccctgccc

SEQ ID NO: 3388200 - DNA, 19 bp, Homo sapiens
ccaagctccctgccccaaa

SEQ ID NO: 3388201 - DNA, 18 bp, Homo sapiens
ccaagctccctggagccc

SEQ ID NO: 3388202 - DNA, 20 bp, Homo sapiens
ccaagctcctcctcggaacc

SEQ ID NO: 3388203 - DNA, 15 bp, Homo sapiens
ccaagctctgctcct

SEQ ID NO: 3388204 - DNA, 17 bp, Homo sapiens
ccaagctgagtttccta

SEQ ID NO: 3388205 - DNA, 18 bp, Homo sapiens
ccaagctgagtttcctat

SEQ ID NO: 3388206 - DNA, 18 bp, Homo sapiens
ccaagctgcctctgggcc

SEQ ID NO: 3388207 - DNA, 17 bp, Homo sapiens
ccaagctgttttcttct

SEQ ID NO: 3388208 - DNA, 18 bp, Homo sapiens
ccaagctgttttcttcta

SEQ ID NO: 3388209 - DNA, 18 bp, Homo sapiens
ccaagcttaatagccctc

SEQ ID NO: 3388210 - DNA, 14 bp, Homo sapiens
ccaaggaaaactgc

SEQ ID NO: 3388211 - DNA, 16 bp, Homo sapiens
ccaaggaaaactgcat

SEQ ID NO: 3388212 - DNA, 17 bp, Homo sapiens
ccaaggaaacgctacct

SEQ ID NO: 3388213 - DNA, 18 bp, Homo sapiens
ccacgaccagccccttcc

SEQ ID NO: 3388214 - DNA, 19 bp, Homo sapiens
ccacgagcacgagctggaa

SEQ ID NO: 3388215 - DNA, 19 bp, Homo sapiens
ccacgaggaaaagaacaaa

SEQ ID NO: 3388216 - DNA, 14 bp, Homo sapiens
ccacgagggctggc

SEQ ID NO: 3388217 - DNA, 22 bp, Homo sapiens
ccacgagggctggctggcctca

SEQ ID NO: 3388218 - DNA, 17 bp, Homo sapiens
ccacgatcccctccccc

SEQ ID NO: 3388219 - DNA, 13 bp, Homo sapiens
ccacgatttgtct

SEQ ID NO: 3388220 - DNA, 14 bp, Homo sapiens
ccacgatttgtctt

SEQ ID NO: 3388221 - DNA, 16 bp, Homo sapiens
ccacgattttctccag

SEQ ID NO: 3388222 - DNA, 19 bp, Homo sapiens
ccacgattttctccagctc

SEQ ID NO: 3388223 - DNA, 21 bp, Homo sapiens
ccacgattttctccagctcag

SEQ ID NO: 3388224 - DNA, 22 bp, Homo sapiens
ccacgattttctccagctcaga

SEQ ID NO: 3388225 - DNA, 13 bp, Homo sapiens
ccacgcactccat

SEQ ID NO: 3388226 - DNA, 20 bp, Homo sapiens
ccacgcactgggccacggag

SEQ ID NO: 3388227 - DNA, 13 bp, Homo sapiens
ccacgcagaggac

SEQ ID NO: 3388228 - DNA, 15 bp, Homo sapiens
ccacgcatacacaca

SEQ ID NO: 3388229 - DNA, 15 bp, Homo sapiens
ccacgccccagcccg

SEQ ID NO: 3388230 - DNA, 17 bp, Homo sapiens
ccacgccccagcccgac

SEQ ID NO: 3388231 - DNA, 18 bp, Homo sapiens
ccacgcccgtcctgcctg

SEQ ID NO: 3388232 - DNA, 14 bp, Homo sapiens
ccacgccctcccct

SEQ ID NO: 3388233 - DNA, 20 bp, Homo sapiens
ccacgccctcccctcccctg

SEQ ID NO: 3388234 - DNA, 17 bp, Homo sapiens
ccacgcctcctggccag

SEQ ID NO: 3388235 - DNA, 18 bp, Homo sapiens
ccacgcctcctggccaga

SEQ ID NO: 3388236 - DNA, 22 bp, Homo sapiens
ccacgctagggcggggcacaga

SEQ ID NO: 3388237 - DNA, 12 bp, Homo sapiens
ccacgctccagc

SEQ ID NO: 3388238 - DNA, 18 bp, Homo sapiens
ccacgctggagtgcagtg

SEQ ID NO: 3388239 - DNA, 19 bp, Homo sapiens
ccacgctggagtgcagtga

SEQ ID NO: 3388240 - DNA, 21 bp, Homo sapiens
ccacgctgtcctctcgagccc

SEQ ID NO: 3388241 - DNA, 18 bp, Homo sapiens
ccacgctttgctgctacc

SEQ ID NO: 3388242 - DNA, 13 bp, Homo sapiens
ccacggccaggcc

SEQ ID NO: 3388243 - DNA, 18 bp, Homo sapiens
ccacggccaggccagagg

SEQ ID NO: 3388244 - DNA, 16 bp, Homo sapiens
ccacggccgctccagg

SEQ ID NO: 3388245 - DNA, 20 bp, Homo sapiens
ccacggccgctccaggggtg

SEQ ID NO: 3388246 - DNA, 15 bp, Homo sapiens
ccacggcctggctgg

SEQ ID NO: 3388247 - DNA, 15 bp, Homo sapiens
ccacggggagcaaac

SEQ ID NO: 3388248 - DNA, 24 bp, Homo sapiens
ccacggtgcgtggctgtggcacag

SEQ ID NO: 3388249 - DNA, 22 bp, Homo sapiens
ccacgtccccctggggcttctc

SEQ ID NO: 3388250 - DNA, 16 bp, Homo sapiens
ccacgtctgccaggcc

SEQ ID NO: 3388251 - DNA, 17 bp, Homo sapiens
ccacgtctgccaggccc

SEQ ID NO: 3388252 - DNA, 18 bp, Homo sapiens
ccacgtctgccaggccca

SEQ ID NO: 3388253 - DNA, 23 bp, Homo sapiens
ccacgtctggccaggcactgcct

SEQ ID NO: 3388254 - DNA, 23 bp, Homo sapiens
ccacgtgaatggccctagaactg

SEQ ID NO: 3388255 - DNA, 23 bp, Homo sapiens
ccacgtgatttccagtgagtgta

SEQ ID NO: 3388256 - DNA, 22 bp, Homo sapiens
ccacgtggatgggcaaagcttg

SEQ ID NO: 3388257 - DNA, 16 bp, Homo sapiens
ccacgtggtcactgtg

SEQ ID NO: 3388258 - DNA, 20 bp, Homo sapiens
ccacgtggtcactgtgcact

SEQ ID NO: 3388259 - DNA, 22 bp, Homo sapiens
ccacgtggtcactgtgcactgc

SEQ ID NO: 3388260 - DNA, 18 bp, Homo sapiens
ccacgtgtatagtatctg

SEQ ID NO: 3388261 - DNA, 22 bp, Homo sapiens
ccacgtgtatagtatctgtata

SEQ ID NO: 3388262 - DNA, 13 bp, Homo sapiens
ccactaaaaatat

SEQ ID NO: 3388263 - DNA, 14 bp, Homo sapiens
ccactaataaagtg

SEQ ID NO: 3388264 - DNA, 13 bp, Homo sapiens
ccactacacctgg

SEQ ID NO: 3388265 - DNA, 16 bp, Homo sapiens
ccactacacctggctg

SEQ ID NO: 3388266 - DNA, 17 bp, Homo sapiens
ccactacacctggctga

SEQ ID NO: 3388267 - DNA, 14 bp, Homo sapiens
ccactacactccag

SEQ ID NO: 3388268 - DNA, 22 bp, Homo sapiens
ccactacactccagcctgagca

SEQ ID NO: 3388269 - DNA, 22 bp, Homo sapiens
ccactactcaatactacctctg

SEQ ID NO: 3388270 - DNA, 23 bp, Homo sapiens
ccactactcaatactacctctga

SEQ ID NO: 3388271 - DNA, 14 bp, Homo sapiens
ccactactgcagca

SEQ ID NO: 3388272 - DNA, 23 bp, Homo sapiens
ccactaggaatcccagaggtggg

SEQ ID NO: 3388273 - DNA, 20 bp, Homo sapiens
ccactaggactctgaggctc

SEQ ID NO: 3388274 - DNA, 22 bp, Homo sapiens
ccactatatcatgggctctgca

SEQ ID NO: 3388275 - DNA, 21 bp, Homo sapiens
ccactatcccaatcaaagaat

SEQ ID NO: 3388276 - DNA, 20 bp, Homo sapiens
ccactcaaattaatctttct

SEQ ID NO: 3388277 - DNA, 15 bp, Homo sapiens
ccactcaccagggtc

SEQ ID NO: 3388278 - DNA, 13 bp, Homo sapiens
ccactcaccccct

SEQ ID NO: 3388279 - DNA, 18 bp, Homo sapiens
ccactcaccccctttgct

SEQ ID NO: 3388280 - DNA, 11 bp, Homo sapiens
ccactcagcca

SEQ ID NO: 3388281 - DNA, 17 bp, Homo sapiens
ccactcagccatttccc

SEQ ID NO: 3388282 - DNA, 12 bp, Homo sapiens
ccactcagcccc

SEQ ID NO: 3388283 - DNA, 15 bp, Homo sapiens
ccactcagcccctag

SEQ ID NO: 3388284 - DNA, 20 bp, Homo sapiens
ccactcaggccaacaagcca

SEQ ID NO: 3388285 - DNA, 18 bp, Homo sapiens
ccactcaggttcttcagg

SEQ ID NO: 3388286 - DNA, 18 bp, Homo sapiens
ccactcagtccatagcag

SEQ ID NO: 3388287 - DNA, 17 bp, Homo sapiens
ccactccagacccctgg

SEQ ID NO: 3388288 - DNA, 18 bp, Homo sapiens
ccactccagcgctgagtg

SEQ ID NO: 3388289 - DNA, 17 bp, Homo sapiens
ccactcccaaagctcag

SEQ ID NO: 3388290 - DNA, 15 bp, Homo sapiens
ccactcccccacctg

SEQ ID NO: 3388291 - DNA, 17 bp, Homo sapiens
ccactcccccacctgac

SEQ ID NO: 3388292 - DNA, 17 bp, Homo sapiens
ccactccctgctccacg

SEQ ID NO: 3388293 - DNA, 18 bp, Homo sapiens
ccactcccttgctggccc

SEQ ID NO: 3388294 - DNA, 16 bp, Homo sapiens
ccactccgagaggtgg

SEQ ID NO: 3388295 - DNA, 17 bp, Homo sapiens
ccactccgagaggtggg

SEQ ID NO: 3388296 - DNA, 19 bp, Homo sapiens
ccactccgagaggtgggcc

SEQ ID NO: 3388297 - DNA, 20 bp, Homo sapiens
ccactccgagaggtgggcca

SEQ ID NO: 3388298 - DNA, 11 bp, Homo sapiens
ccactcctccc

SEQ ID NO: 3388299 - DNA, 13 bp, Homo sapiens
ccactcctccctc

SEQ ID NO: 3388300 - DNA, 14 bp, Homo sapiens
ccactcctccctcc

SEQ ID NO: 3388301 - DNA, 13 bp, Homo sapiens
ccactcctctccc

SEQ ID NO: 3388302 - DNA, 14 bp, Homo sapiens
ccactcctgtacac

SEQ ID NO: 3388303 - DNA, 21 bp, Homo sapiens
ccactcctgtcccgccttcct

SEQ ID NO: 3388304 - DNA, 17 bp, Homo sapiens
ccactcgaggcctgcaa

SEQ ID NO: 3388305 - DNA, 14 bp, Homo sapiens
ccactcgcagtcgc

SEQ ID NO: 3388306 - DNA, 13 bp, Homo sapiens
ccactcgcttccc

SEQ ID NO: 3388307 - DNA, 22 bp, Homo sapiens
ccactcgggggtggagtgagac

SEQ ID NO: 3388308 - DNA, 14 bp, Homo sapiens
ccactctacctcct

SEQ ID NO: 3388309 - DNA, 12 bp, Homo sapiens
ccactctcccca

SEQ ID NO: 3388310 - DNA, 13 bp, Homo sapiens
ccactctgcttct

SEQ ID NO: 3388311 - DNA, 14 bp, Homo sapiens
ccactctgcttctc

SEQ ID NO: 3388312 - DNA, 23 bp, Homo sapiens
ccactgaaaacatttcaaagctg

SEQ ID NO: 3388313 - DNA, 15 bp, Homo sapiens
ccactgacagcctcc

SEQ ID NO: 3388314 - DNA, 17 bp, Homo sapiens
ccactgacagcctccca

SEQ ID NO: 3388315 - DNA, 14 bp, Homo sapiens
ccactgagcctggc

SEQ ID NO: 3388316 - DNA, 16 bp, Homo sapiens
ccactgagcctggccc

SEQ ID NO: 3388317 - DNA, 16 bp, Homo sapiens
ccactgagtaccaggg

SEQ ID NO: 3388318 - DNA, 18 bp, Homo sapiens
ccactgagtaccaggggc

SEQ ID NO: 3388319 - DNA, 19 bp, Homo sapiens
ccactgatgctgttctctt

SEQ ID NO: 3388320 - DNA, 20 bp, Homo sapiens
ccactgcaaataaagccttt

SEQ ID NO: 3388321 - DNA, 14 bp, Homo sapiens
ccactgcacagagc

SEQ ID NO: 3388322 - DNA, 16 bp, Homo sapiens
ccactgcacagagctc

SEQ ID NO: 3388323 - DNA, 20 bp, Homo sapiens
ccactgcacagagctctcca

SEQ ID NO: 3388324 - DNA, 13 bp, Homo sapiens
ccactgcaccggg

SEQ ID NO: 3388325 - DNA, 14 bp, Homo sapiens
ccactgcaccgggc

SEQ ID NO: 3388326 - DNA, 16 bp, Homo sapiens
ccactgcactccagcc

SEQ ID NO: 3388327 - DNA, 20 bp, Homo sapiens
ccactgcactccagcctggg

SEQ ID NO: 3388328 - DNA, 16 bp, Homo sapiens
ccactgccagcagcag

SEQ ID NO: 3388329 - DNA, 23 bp, Homo sapiens
ccactgccagcagcagcaggtga

SEQ ID NO: 3388330 - DNA, 11 bp, Homo sapiens
ccactgccagg

SEQ ID NO: 3388331 - DNA, 20 bp, Homo sapiens
ccactgccaggcacctggcc

SEQ ID NO: 3388332 - DNA, 21 bp, Homo sapiens
ccactgccaggcacctggcct

SEQ ID NO: 3388333 - DNA, 22 bp, Homo sapiens
ccactgccaggcacctggcctg

SEQ ID NO: 3388334 - DNA, 16 bp, Homo sapiens
ccactgcccaccccct

SEQ ID NO: 3388335 - DNA, 18 bp, Homo sapiens
ccactgcccgagctggtg

SEQ ID NO: 3388336 - DNA, 23 bp, Homo sapiens
ccactgcccgagctggtgcatta

SEQ ID NO: 3388337 - DNA, 12 bp, Homo sapiens
ccactgccctgc

SEQ ID NO: 3388338 - DNA, 18 bp, Homo sapiens
ccactgccctggcagcag

SEQ ID NO: 3388339 - DNA, 19 bp, Homo sapiens
ccagcctgccctccagctg

SEQ ID NO: 3388340 - DNA, 21 bp, Homo sapiens
ccagcctgccctccagctgct

SEQ ID NO: 3388341 - DNA, 18 bp, Homo sapiens
ccagcctgcctggcaggc

SEQ ID NO: 3388342 - DNA, 18 bp, Homo sapiens
ccagcctggacccccagc

SEQ ID NO: 3388343 - DNA, 19 bp, Homo sapiens
ccagcctggcttctggagc

SEQ ID NO: 3388344 - DNA, 15 bp, Homo sapiens
ccagcctgggagccc

SEQ ID NO: 3388345 - DNA, 18 bp, Homo sapiens
ccagcctgggagcccaga

SEQ ID NO: 3388346 - DNA, 19 bp, Homo sapiens
ccagcctgggcgacagagc

SEQ ID NO: 3388347 - DNA, 12 bp, Homo sapiens
ccagcctggggc

SEQ ID NO: 3388348 - DNA, 20 bp, Homo sapiens
ccagcctggggcctggcagg

SEQ ID NO: 3388349 - DNA, 14 bp, Homo sapiens
ccagcctggggctc

SEQ ID NO: 3388350 - DNA, 18 bp, Homo sapiens
ccagcctggggctccctc

SEQ ID NO: 3388351 - DNA, 22 bp, Homo sapiens
ccagcctggggctccctctctg

SEQ ID NO: 3388352 - DNA, 19 bp, Homo sapiens
ccagcctgtcccatggaca

SEQ ID NO: 3388353 - DNA, 23 bp, Homo sapiens
ccagcctgtcccatggacactcc

SEQ ID NO: 3388354 - DNA, 12 bp, Homo sapiens
ccagcctgtggt

SEQ ID NO: 3388355 - DNA, 21 bp, Homo sapiens
ccagcctgtggttacagtgca

SEQ ID NO: 3388356 - DNA, 13 bp, Homo sapiens
ccagcctgtgtgt

SEQ ID NO: 3388357 - DNA, 18 bp, Homo sapiens
ccagccttcttccatccc

SEQ ID NO: 3388358 - DNA, 17 bp, Homo sapiens
ccagccttgagccctgg

SEQ ID NO: 3388359 - DNA, 18 bp, Homo sapiens
ccagccttgagccctggc

SEQ ID NO: 3388360 - DNA, 20 bp, Homo sapiens
ccagccttgagccctggctg

SEQ ID NO: 3388361 - DNA, 10 bp, Homo sapiens
ccagccttgt

SEQ ID NO: 3388362 - DNA, 13 bp, Homo sapiens
ccagcgcggccag

SEQ ID NO: 3388363 - DNA, 13 bp, Homo sapiens
ccagcgctctgcc

SEQ ID NO: 3388364 - DNA, 15 bp, Homo sapiens
ccagcgctctgcctc

SEQ ID NO: 3388365 - DNA, 13 bp, Homo sapiens
ccagcgggcacag

SEQ ID NO: 3388366 - DNA, 19 bp, Homo sapiens
ccagcgggcacagggcacc

SEQ ID NO: 3388367 - DNA, 15 bp, Homo sapiens
ccagcgggcagatgg

SEQ ID NO: 3388368 - DNA, 22 bp, Homo sapiens
ccagcgggcagatgggcggacg

SEQ ID NO: 3388369 - DNA, 23 bp, Homo sapiens
ccagcgtcagctgctccctggca

SEQ ID NO: 3388370 - DNA, 13 bp, Homo sapiens
ccagcgtcccagg

SEQ ID NO: 3388371 - DNA, 14 bp, Homo sapiens
ccagcgtcccaggg

SEQ ID NO: 3388372 - DNA, 21 bp, Homo sapiens
ccagcgtcctcgttcaaaaca

SEQ ID NO: 3388373 - DNA, 20 bp, Homo sapiens
ccagctaatctgtagggctg

SEQ ID NO: 3388374 - DNA, 21 bp, Homo sapiens
ccagctaatctgtagggctgg

SEQ ID NO: 3388375 - DNA, 23 bp, Homo sapiens
ccagctaccccttctttgcaggg

SEQ ID NO: 3388376 - DNA, 17 bp, Homo sapiens
ccagctactcagaagcc

SEQ ID NO: 3388377 - DNA, 20 bp, Homo sapiens
ccagctactcagaagcctga

SEQ ID NO: 3388378 - DNA, 15 bp, Homo sapiens
ccagctactctgtcc

SEQ ID NO: 3388379 - DNA, 16 bp, Homo sapiens
ccagctactctgtcca

SEQ ID NO: 3388380 - DNA, 18 bp, Homo sapiens
ccagctactctgtccagg

SEQ ID NO: 3388381 - DNA, 23 bp, Homo sapiens
ccagctactctgtccaggccact

SEQ ID NO: 3388382 - DNA, 14 bp, Homo sapiens
ccagctacttggga

SEQ ID NO: 3388383 - DNA, 17 bp, Homo sapiens
ccagctacttgggaagc

SEQ ID NO: 3388384 - DNA, 19 bp, Homo sapiens
ccagctacttgggaggctg

SEQ ID NO: 3388385 - DNA, 14 bp, Homo sapiens
ccagctatctgtca

SEQ ID NO: 3388386 - DNA, 14 bp, Homo sapiens
ccagctcagaaccc

SEQ ID NO: 3388387 - DNA, 18 bp, Homo sapiens
ccagctcagaacccaggg

SEQ ID NO: 3388388 - DNA, 15 bp, Homo sapiens
ccagctcaggggcag

SEQ ID NO: 3388389 - DNA, 19 bp, Homo sapiens
ccagctcaggggcagctca

SEQ ID NO: 3388390 - DNA, 16 bp, Homo sapiens
ccagctcatctccaag

SEQ ID NO: 3388391 - DNA, 14 bp, Homo sapiens
ccagctccaggggc

SEQ ID NO: 3388392 - DNA, 12 bp, Homo sapiens
ccagctcccccc

SEQ ID NO: 3388393 - DNA, 19 bp, Homo sapiens
ccagctccccccgcccacc

SEQ ID NO: 3388394 - DNA, 15 bp, Homo sapiens
ccagctccctagact

SEQ ID NO: 3388395 - DNA, 18 bp, Homo sapiens
ccagctccctagactgca

SEQ ID NO: 3388396 - DNA, 14 bp, Homo sapiens
ccagctccctctat

SEQ ID NO: 3388397 - DNA, 19 bp, Homo sapiens
ccagctcctttctcctgtg

SEQ ID NO: 3388398 - DNA, 21 bp, Homo sapiens
ccagctccttttgtccccagg

SEQ ID NO: 3388399 - DNA, 16 bp, Homo sapiens
ccagctctgaggggag

SEQ ID NO: 3388400 - DNA, 12 bp, Homo sapiens
ccagctctggct

SEQ ID NO: 3388401 - DNA, 14 bp, Homo sapiens
ccagctctggcttc

SEQ ID NO: 3388402 - DNA, 14 bp, Homo sapiens
ccagctctgtggcc

SEQ ID NO: 3388403 - DNA, 18 bp, Homo sapiens
ccagctctgtggcctgtg

SEQ ID NO: 3388404 - DNA, 20 bp, Homo sapiens
ccagctctgtggcctgtgtc

SEQ ID NO: 3388405 - DNA, 16 bp, Homo sapiens
ccagctgaaggcagtg

SEQ ID NO: 3388406 - DNA, 23 bp, Homo sapiens
ccagctgactaaactttttttct

SEQ ID NO: 3388407 - DNA, 15 bp, Homo sapiens
ccagctgactgtggc

SEQ ID NO: 3388408 - DNA, 18 bp, Homo sapiens
ccagctgaggcaggggga

SEQ ID NO: 3388409 - DNA, 20 bp, Homo sapiens
ccagctgcacctgccagcct

SEQ ID NO: 3388410 - DNA, 22 bp, Homo sapiens
ccagctgcacctgccagcctgg

SEQ ID NO: 3388411 - DNA, 18 bp, Homo sapiens
ccagctgccccggcccct

SEQ ID NO: 3388412 - DNA, 18 bp, Homo sapiens
ccagctgccgaccagagc

SEQ ID NO: 3388413 - DNA, 20 bp, Homo sapiens
ccagctgccgaccagagccc

SEQ ID NO: 3388414 - DNA, 18 bp, Homo sapiens
ccagctgcctggagaggg

SEQ ID NO: 3388415 - DNA, 16 bp, Homo sapiens
ccagctgcctgtgcct

SEQ ID NO: 3388416 - DNA, 22 bp, Homo sapiens
ccagctgcctgtgcctgccatg

SEQ ID NO: 3388417 - DNA, 14 bp, Homo sapiens
ccagctgccttcct

SEQ ID NO: 3388418 - DNA, 19 bp, Homo sapiens
ccagctgccttcctcatcc

SEQ ID NO: 3388419 - DNA, 13 bp, Homo sapiens
ccagctgctctgc

SEQ ID NO: 3388420 - DNA, 15 bp, Homo sapiens
ccagctgctctgccc

SEQ ID NO: 3388421 - DNA, 22 bp, Homo sapiens
ccagctgctgctctcccctccc

SEQ ID NO: 3388422 - DNA, 15 bp, Homo sapiens
ccagctgctgctctg

SEQ ID NO: 3388423 - DNA, 18 bp, Homo sapiens
ccagctgcttcagggagg

SEQ ID NO: 3388424 - DNA, 13 bp, Homo sapiens
ccagctgcttttt

SEQ ID NO: 3388425 - DNA, 23 bp, Homo sapiens
ccagctggaaggtactatgccag

SEQ ID NO: 3388426 - DNA, 17 bp, Homo sapiens
ccagctggcctggacag

SEQ ID NO: 3388427 - DNA, 16 bp, Homo sapiens
ccagctgggaagccct

SEQ ID NO: 3388428 - DNA, 17 bp, Homo sapiens
ccagctgggagcactgg

SEQ ID NO: 3388429 - DNA, 21 bp, Homo sapiens
ccagctgggaggcaagagggg

SEQ ID NO: 3388430 - DNA, 20 bp, Homo sapiens
ccagctggggcgtggggagg

SEQ ID NO: 3388431 - DNA, 22 bp, Homo sapiens
ccagctggggcgtggggagggc

SEQ ID NO: 3388432 - DNA, 14 bp, Homo sapiens
ccagctgtagccat

SEQ ID NO: 3388433 - DNA, 15 bp, Homo sapiens
ccagctgtagccatg

SEQ ID NO: 3388434 - DNA, 23 bp, Homo sapiens
ccagctgtagccatggctcaggc

SEQ ID NO: 3388435 - DNA, 15 bp, Homo sapiens
ccagctgtgagcctt

SEQ ID NO: 3388436 - DNA, 16 bp, Homo sapiens
ccagctgtgagccttg

SEQ ID NO: 3388437 - DNA, 19 bp, Homo sapiens
ccagctgtgagccttggct

SEQ ID NO: 3388438 - DNA, 20 bp, Homo sapiens
ccagctgtgctctggacagg

SEQ ID NO: 3388439 - DNA, 21 bp, Homo sapiens
ccagctgtgctctggacaggc

SEQ ID NO: 3388440 - DNA, 22 bp, Homo sapiens
ccagctgtgctctggacaggca

SEQ ID NO: 3388441 - DNA, 15 bp, Homo sapiens
ccagcttcaggcacc

SEQ ID NO: 3388442 - DNA, 17 bp, Homo sapiens
ccagcttcaggcaccag

SEQ ID NO: 3388443 - DNA, 22 bp, Homo sapiens
ccagcttcaggcaccagcatcc

SEQ ID NO: 3388444 - DNA, 13 bp, Homo sapiens
ccagcttcctggt

SEQ ID NO: 3388445 - DNA, 23 bp, Homo sapiens
ccagcttctcctgcgccccgccc

SEQ ID NO: 3388446 - DNA, 21 bp, Homo sapiens
ccagcttctggtactctccta

SEQ ID NO: 3388447 - DNA, 23 bp, Homo sapiens
ccagcttctggtactctcctaga

SEQ ID NO: 3388448 - DNA, 16 bp, Homo sapiens
ccagcttgtaggagct

SEQ ID NO: 3388449 - DNA, 15 bp, Homo sapiens
ccagcttgttattta

SEQ ID NO: 3388450 - DNA, 16 bp, Homo sapiens
ccagcttgttatttat

SEQ ID NO: 3388451 - DNA, 17 bp, Homo sapiens
ccagcttgttatttata

SEQ ID NO: 3388452 - DNA, 14 bp, Homo sapiens
ccagctttccctgc

SEQ ID NO: 3388453 - DNA, 22 bp, Homo sapiens
ccagctttgcccaacaccagcc

SEQ ID NO: 3388454 - DNA, 16 bp, Homo sapiens
ccaggaagaagcaggg

SEQ ID NO: 3388455 - DNA, 17 bp, Homo sapiens
ccaggaagaagcagggg

SEQ ID NO: 3388456 - DNA, 19 bp, Homo sapiens
ccaggaaggacagactggc

SEQ ID NO: 3388457 - DNA, 20 bp, Homo sapiens
ccaggaaggacagactggcc

SEQ ID NO: 3388458 - DNA, 21 bp, Homo sapiens
ccaggaaggacagactggccg

SEQ ID NO: 3388459 - DNA, 14 bp, Homo sapiens
ccaggaaggcagct

SEQ ID NO: 3388460 - DNA, 20 bp, Homo sapiens
ccaggaaggcagctgctctt

SEQ ID NO: 3388461 - DNA, 15 bp, Homo sapiens
ccaggaaggcctagg

SEQ ID NO: 3388462 - DNA, 18 bp, Homo sapiens
ccaggaattagagaagct

SEQ ID NO: 3388463 - DNA, 18 bp, Homo sapiens
ccaggacaccacacccag

SEQ ID NO: 3388464 - DNA, 19 bp, Homo sapiens
ccatataagtttgaaggaa

SEQ ID NO: 3388465 - DNA, 16 bp, Homo sapiens
ccatatataacagata

SEQ ID NO: 3388466 - DNA, 12 bp, Homo sapiens
ccatatgctcca

SEQ ID NO: 3388467 - DNA, 16 bp, Homo sapiens
ccatatgctccaggat

SEQ ID NO: 3388468 - DNA, 22 bp, Homo sapiens
ccatatgctccaggatctttga

SEQ ID NO: 3388469 - DNA, 16 bp, Homo sapiens
ccatatggaggcctga

SEQ ID NO: 3388470 - DNA, 14 bp, Homo sapiens
ccatattgtaaaac

SEQ ID NO: 3388471 - DNA, 20 bp, Homo sapiens
ccatattttattgtattttg

SEQ ID NO: 3388472 - DNA, 16 bp, Homo sapiens
ccatcaaaatgctttt

SEQ ID NO: 3388473 - DNA, 17 bp, Homo sapiens
ccatcacaggatgccag

SEQ ID NO: 3388474 - DNA, 23 bp, Homo sapiens
ccatcacaggatgccagcccctg

SEQ ID NO: 3388475 - DNA, 17 bp, Homo sapiens
ccatcaccaccgcctct

SEQ ID NO: 3388476 - DNA, 15 bp, Homo sapiens
ccatcaccgctgggt

SEQ ID NO: 3388477 - DNA, 17 bp, Homo sapiens
ccatcaccgctgggtgg

SEQ ID NO: 3388478 - DNA, 19 bp, Homo sapiens
ccatcaccgctgggtggtt

SEQ ID NO: 3388479 - DNA, 16 bp, Homo sapiens
ccatcactagaagaaa

SEQ ID NO: 3388480 - DNA, 19 bp, Homo sapiens
ccatcagggttctcttagc

SEQ ID NO: 3388481 - DNA, 16 bp, Homo sapiens
ccatcagtgaaagaaa

SEQ ID NO: 3388482 - DNA, 19 bp, Homo sapiens
ccatcagtgaaagaaactg

SEQ ID NO: 3388483 - DNA, 15 bp, Homo sapiens
ccatcataggaaggg

SEQ ID NO: 3388484 - DNA, 14 bp, Homo sapiens
ccatcatcccagct

SEQ ID NO: 3388485 - DNA, 16 bp, Homo sapiens
ccatcatcccagctgc

SEQ ID NO: 3388486 - DNA, 16 bp, Homo sapiens
ccatcatgcccggtcc

SEQ ID NO: 3388487 - DNA, 12 bp, Homo sapiens
ccatcatgtctg

SEQ ID NO: 3388488 - DNA, 13 bp, Homo sapiens
ccatcatttctgt

SEQ ID NO: 3388489 - DNA, 21 bp, Homo sapiens
ccatcattttacagtgacctt

SEQ ID NO: 3388490 - DNA, 18 bp, Homo sapiens
ccatccaaccactgtaca

SEQ ID NO: 3388491 - DNA, 19 bp, Homo sapiens
ccatccaccgctgctccac

SEQ ID NO: 3388492 - DNA, 13 bp, Homo sapiens
ccatccaggcagt

SEQ ID NO: 3388493 - DNA, 16 bp, Homo sapiens
ccatccattaggccag

SEQ ID NO: 3388494 - DNA, 20 bp, Homo sapiens
ccatcccaaccagtgccaag

SEQ ID NO: 3388495 - DNA, 21 bp, Homo sapiens
ccatcccaaccagtgccaagg

SEQ ID NO: 3388496 - DNA, 23 bp, Homo sapiens
ccatcccaaccagtgccaaggac

SEQ ID NO: 3388497 - DNA, 14 bp, Homo sapiens
ccatcccaggacac

SEQ ID NO: 3388498 - DNA, 24 bp, Homo sapiens
ccatcccaggacaccacacccagc

SEQ ID NO: 3388499 - DNA, 15 bp, Homo sapiens
ccatccccaccagct

SEQ ID NO: 3388500 - DNA, 22 bp, Homo sapiens
ccatccccatcctccagcttct

SEQ ID NO: 3388501 - DNA, 13 bp, Homo sapiens
ccatccccctgcc

SEQ ID NO: 3388502 - DNA, 19 bp, Homo sapiens
ccatcccgaaaatctctcg

SEQ ID NO: 3388503 - DNA, 23 bp, Homo sapiens
ccatccctcgggaagcagccagc

SEQ ID NO: 3388504 - DNA, 11 bp, Homo sapiens
ccatccctgcc

SEQ ID NO: 3388505 - DNA, 13 bp, Homo sapiens
ccatccctgccac

SEQ ID NO: 3388506 - DNA, 14 bp, Homo sapiens
ccatccctgccaca

SEQ ID NO: 3388507 - DNA, 15 bp, Homo sapiens
ccatccctgccacat

SEQ ID NO: 3388508 - DNA, 15 bp, Homo sapiens
ccatccctgcctggt

SEQ ID NO: 3388509 - DNA, 16 bp, Homo sapiens
ccatccctgcctggtc

SEQ ID NO: 3388510 - DNA, 16 bp, Homo sapiens
ccatccctggccccct

SEQ ID NO: 3388511 - DNA, 13 bp, Homo sapiens
ccatccctgggcc

SEQ ID NO: 3388512 - DNA, 19 bp, Homo sapiens
ccatccctgggcccctcca

SEQ ID NO: 3388513 - DNA, 12 bp, Homo sapiens
ccatccctgtga

SEQ ID NO: 3388514 - DNA, 14 bp, Homo sapiens
ccatcccttttcct

SEQ ID NO: 3388515 - DNA, 15 bp, Homo sapiens
ccatcccttttcctg

SEQ ID NO: 3388516 - DNA, 17 bp, Homo sapiens
ccatcccttttcctgtc

SEQ ID NO: 3388517 - DNA, 19 bp, Homo sapiens
ccatcccttttcctgtcag

SEQ ID NO: 3388518 - DNA, 17 bp, Homo sapiens
ccatccctttttttaca

SEQ ID NO: 3388519 - DNA, 20 bp, Homo sapiens
ccatccgactgcccctgctg

SEQ ID NO: 3388520 - DNA, 22 bp, Homo sapiens
ccatccgactgcccctgctgtg

SEQ ID NO: 3388521 - DNA, 12 bp, Homo sapiens
ccatcctaccct

SEQ ID NO: 3388522 - DNA, 16 bp, Homo sapiens
ccatcctaccctcggg

SEQ ID NO: 3388523 - DNA, 18 bp, Homo sapiens
ccatcctaccctcgggcc

SEQ ID NO: 3388524 - DNA, 19 bp, Homo sapiens
ccatcctatccactgggca

SEQ ID NO: 3388525 - DNA, 16 bp, Homo sapiens
ccatcctcatccctga

SEQ ID NO: 3388526 - DNA, 15 bp, Homo sapiens
ccatcctccagcttc

SEQ ID NO: 3388527 - DNA, 12 bp, Homo sapiens
ccatcctgactg

SEQ ID NO: 3388528 - DNA, 15 bp, Homo sapiens
ccatcctgaggctcc

SEQ ID NO: 3388529 - DNA, 18 bp, Homo sapiens
ccatcctgcagcctcctc

SEQ ID NO: 3388530 - DNA, 16 bp, Homo sapiens
ccatcctggggcagca

SEQ ID NO: 3388531 - DNA, 21 bp, Homo sapiens
ccatcctggggcagcactccc

SEQ ID NO: 3388532 - DNA, 17 bp, Homo sapiens
ccatcctgtattcttca

SEQ ID NO: 3388533 - DNA, 15 bp, Homo sapiens
ccatcggccaagaat

SEQ ID NO: 3388534 - DNA, 15 bp, Homo sapiens
ccatcgtcctgggac

SEQ ID NO: 3388535 - DNA, 17 bp, Homo sapiens
ccatcgtcctgggactc

SEQ ID NO: 3388536 - DNA, 23 bp, Homo sapiens
ccatctagccagcccctcttccc

SEQ ID NO: 3388537 - DNA, 14 bp, Homo sapiens
ccatctcagcctcc

SEQ ID NO: 3388538 - DNA, 19 bp, Homo sapiens
ccatctcagcctcctgagc

SEQ ID NO: 3388539 - DNA, 21 bp, Homo sapiens
ccatctcagcctcctgagcct

SEQ ID NO: 3388540 - DNA, 22 bp, Homo sapiens
ccatctcagcctcctgagcctg

SEQ ID NO: 3388541 - DNA, 15 bp, Homo sapiens
ccatctcaggtgcca

SEQ ID NO: 3388542 - DNA, 23 bp, Homo sapiens
ccatctcaggtgccactccctga

SEQ ID NO: 3388543 - DNA, 15 bp, Homo sapiens
ccatctcatcctggc

SEQ ID NO: 3388544 - DNA, 17 bp, Homo sapiens
ccatctcatcctggcac

SEQ ID NO: 3388545 - DNA, 19 bp, Homo sapiens
ccatctccaagataagcct

SEQ ID NO: 3388546 - DNA, 22 bp, Homo sapiens
ccatctccaagataagcctgag

SEQ ID NO: 3388547 - DNA, 14 bp, Homo sapiens
ccatctccagggag

SEQ ID NO: 3388548 - DNA, 15 bp, Homo sapiens
ccatctccccaggcc

SEQ ID NO: 3388549 - DNA, 13 bp, Homo sapiens
ccatctccctgcc

SEQ ID NO: 3388550 - DNA, 18 bp, Homo sapiens
ccatctccctgcctggcc

SEQ ID NO: 3388551 - DNA, 21 bp, Homo sapiens
ccatctcctataatctgtcaa

SEQ ID NO: 3388552 - DNA, 23 bp, Homo sapiens
ccatctcctataatctgtcaaaa

SEQ ID NO: 3388553 - DNA, 20 bp, Homo sapiens
ccatctcggagcatcccgga

SEQ ID NO: 3388554 - DNA, 21 bp, Homo sapiens
ccatctcggagcatcccggag

SEQ ID NO: 3388555 - DNA, 22 bp, Homo sapiens
ccatctcggagcatcccggagg

SEQ ID NO: 3388556 - DNA, 23 bp, Homo sapiens
ccatctcggagcatcccggagga

SEQ ID NO: 3388557 - DNA, 14 bp, Homo sapiens
ccatctctccctcc

SEQ ID NO: 3388558 - DNA, 23 bp, Homo sapiens
ccatctctccctcccctgccatt

SEQ ID NO: 3388559 - DNA, 23 bp, Homo sapiens
ccatctctgattttcaaagcttt

SEQ ID NO: 3388560 - DNA, 21 bp, Homo sapiens
ccatctcttcctacccaacca

SEQ ID NO: 3388561 - DNA, 18 bp, Homo sapiens
ccatctgcacacacctcc

SEQ ID NO: 3388562 - DNA, 21 bp, Homo sapiens
ccatctgcacacacctccgag

SEQ ID NO: 3388563 - DNA, 14 bp, Homo sapiens
ccatctgcacccct

SEQ ID NO: 3388564 - DNA, 14 bp, Homo sapiens
ccatctggcctggc

SEQ ID NO: 3388565 - DNA, 18 bp, Homo sapiens
ccatctggcctggcctgg

SEQ ID NO: 3388566 - DNA, 17 bp, Homo sapiens
ccatctgggagtcccct

SEQ ID NO: 3388567 - DNA, 17 bp, Homo sapiens
ccatctgggtccttgca

SEQ ID NO: 3388568 - DNA, 22 bp, Homo sapiens
ccatctgggtccttgcacccct

SEQ ID NO: 3388569 - DNA, 14 bp, Homo sapiens
ccatctgtacatat

SEQ ID NO: 3388570 - DNA, 15 bp, Homo sapiens
ccatcttacttgagc

SEQ ID NO: 3388571 - DNA, 15 bp, Homo sapiens
ccatcttagtttgga

SEQ ID NO: 3388572 - DNA, 16 bp, Homo sapiens
ccatcttcactggctt

SEQ ID NO: 3388573 - DNA, 23 bp, Homo sapiens
ccatcttcactggcttccatcag

SEQ ID NO: 3388574 - DNA, 15 bp, Homo sapiens
ccatcttccattgcc

SEQ ID NO: 3388575 - DNA, 18 bp, Homo sapiens
ccatcttcctgctgctgt

SEQ ID NO: 3388576 - DNA, 16 bp, Homo sapiens
ccatcttctccccaca

SEQ ID NO: 3388577 - DNA, 22 bp, Homo sapiens
ccatcttctccccacagcctct

SEQ ID NO: 3388578 - DNA, 14 bp, Homo sapiens
ccatcttgagatgg

SEQ ID NO: 3388579 - DNA, 23 bp, Homo sapiens
ccatcttgctaataaacactggc

SEQ ID NO: 3388580 - DNA, 15 bp, Homo sapiens
ccatctttactccca

SEQ ID NO: 3388581 - DNA, 23 bp, Homo sapiens
ccatctttatagaaggaatttgt

SEQ ID NO: 3388582 - DNA, 24 bp, Homo sapiens
ccatctttatagaaggaatttgta

SEQ ID NO: 3388583 - DNA, 21 bp, Homo sapiens
ccatgaaaaaaatgatcccca

SEQ ID NO: 3388584 - DNA, 23 bp, Homo sapiens
ccatgaaaacgttttattgtgtt

SEQ ID NO: 3388585 - DNA, 16 bp, Homo sapiens
ccatgaagacaggaca

SEQ ID NO: 3388586 - DNA, 17 bp, Homo sapiens
ccatgaagacaggacag

SEQ ID NO: 3388587 - DNA, 19 bp, Homo sapiens
ccatgaagacaggacagtg

SEQ ID NO: 3388588 - DNA, 15 bp, Homo sapiens
ccatgaagacaggat

SEQ ID NO: 3388589 - DNA, 19 bp, Homo sapiens
ccatgaatgtatcaggaaa

SEQ ID NO: 3388590 - DNA, 14 bp, Homo sapiens
cccaaggtcctctc

SEQ ID NO: 3388591 - DNA, 17 bp, Homo sapiens
cccaaggtcctctcagt

SEQ ID NO: 3388592 - DNA, 21 bp, Homo sapiens
cccaaggtgctgatgtcaaag

SEQ ID NO: 3388593 - DNA, 20 bp, Homo sapiens
cccaagtagtctgctcacag

SEQ ID NO: 3388594 - DNA, 14 bp, Homo sapiens
cccaagtcagacag

SEQ ID NO: 3388595 - DNA, 19 bp, Homo sapiens
cccaagtcccagagcacct

SEQ ID NO: 3388596 - DNA, 18 bp, Homo sapiens
cccaagtccctgttttct

SEQ ID NO: 3388597 - DNA, 16 bp, Homo sapiens
cccaagtcctgaagag

SEQ ID NO: 3388598 - DNA, 17 bp, Homo sapiens
cccaagtcctgaagagg

SEQ ID NO: 3388599 - DNA, 23 bp, Homo sapiens
cccaagtcctgaagaggcgggcc

SEQ ID NO: 3388600 - DNA, 15 bp, Homo sapiens
cccaagtgccagtct

SEQ ID NO: 3388601 - DNA, 12 bp, Homo sapiens
cccaataaaggc

SEQ ID NO: 3388602 - DNA, 17 bp, Homo sapiens
cccaatattataatttt

SEQ ID NO: 3388603 - DNA, 14 bp, Homo sapiens
cccaatcagctcct

SEQ ID NO: 3388604 - DNA, 21 bp, Homo sapiens
cccaatctctacccctttctt

SEQ ID NO: 3388605 - DNA, 20 bp, Homo sapiens
cccaatcttaccagatgcta

SEQ ID NO: 3388606 - DNA, 23 bp, Homo sapiens
cccaatctttctatataaaatgt

SEQ ID NO: 3388607 - DNA, 21 bp, Homo sapiens
cccaatgcatagagccctggc

SEQ ID NO: 3388608 - DNA, 23 bp, Homo sapiens
cccaatgcatagagccctggcca

SEQ ID NO: 3388609 - DNA, 14 bp, Homo sapiens
cccaatgctttggg

SEQ ID NO: 3388610 - DNA, 13 bp, Homo sapiens
cccacaaagcctt

SEQ ID NO: 3388611 - DNA, 22 bp, Homo sapiens
cccacaaagccttatcaagtgt

SEQ ID NO: 3388612 - DNA, 18 bp, Homo sapiens
cccacaagctgtccctgc

SEQ ID NO: 3388613 - DNA, 19 bp, Homo sapiens
cccacaagctgtccctgca

SEQ ID NO: 3388614 - DNA, 21 bp, Homo sapiens
cccacaagtgccctccaggct

SEQ ID NO: 3388615 - DNA, 22 bp, Homo sapiens
cccacaatcccacctagcccag

SEQ ID NO: 3388616 - DNA, 22 bp, Homo sapiens
cccacaccccagcccaccctgc

SEQ ID NO: 3388617 - DNA, 16 bp, Homo sapiens
cccacaccgtcttcct

SEQ ID NO: 3388618 - DNA, 24 bp, Homo sapiens
cccacacctccacagttcagtggc

SEQ ID NO: 3388619 - DNA, 16 bp, Homo sapiens
cccacacctccctact

SEQ ID NO: 3388620 - DNA, 18 bp, Homo sapiens
cccacacctccctactcc

SEQ ID NO: 3388621 - DNA, 19 bp, Homo sapiens
cccacaccttccagggccc

SEQ ID NO: 3388622 - DNA, 14 bp, Homo sapiens
cccacactaacctg

SEQ ID NO: 3388623 - DNA, 16 bp, Homo sapiens
cccacactatgcacag

SEQ ID NO: 3388624 - DNA, 18 bp, Homo sapiens
cccacactatgcacagag

SEQ ID NO: 3388625 - DNA, 20 bp, Homo sapiens
cccacactatgcacagagcc

SEQ ID NO: 3388626 - DNA, 22 bp, Homo sapiens
cccacactatgcacagagccca

SEQ ID NO: 3388627 - DNA, 19 bp, Homo sapiens
cccacactgaaaccaaaac

SEQ ID NO: 3388628 - DNA, 19 bp, Homo sapiens
cccacagcacagctccctg

SEQ ID NO: 3388629 - DNA, 18 bp, Homo sapiens
cccacagctacctgagac

SEQ ID NO: 3388630 - DNA, 19 bp, Homo sapiens
cccacagctacctgagacg

SEQ ID NO: 3388631 - DNA, 20 bp, Homo sapiens
cccacaggaagcctgcagtc

SEQ ID NO: 3388632 - DNA, 22 bp, Homo sapiens
cccacaggaagcctgcagtcct

SEQ ID NO: 3388633 - DNA, 22 bp, Homo sapiens
cccacaggaggcaagcaagctc

SEQ ID NO: 3388634 - DNA, 16 bp, Homo sapiens
cccacaggcccttcct

SEQ ID NO: 3388635 - DNA, 18 bp, Homo sapiens
cccacaggcccttcctct

SEQ ID NO: 3388636 - DNA, 13 bp, Homo sapiens
cccacagttgtgt

SEQ ID NO: 3388637 - DNA, 15 bp, Homo sapiens
cccacagttgtgttc

SEQ ID NO: 3388638 - DNA, 12 bp, Homo sapiens
cccacagtttta

SEQ ID NO: 3388639 - DNA, 20 bp, Homo sapiens
cccacatcccaggcttcacc

SEQ ID NO: 3388640 - DNA, 18 bp, Homo sapiens
cccacatgaggccatctc

SEQ ID NO: 3388641 - DNA, 20 bp, Homo sapiens
cccacatgaggccatctcag

SEQ ID NO: 3388642 - DNA, 22 bp, Homo sapiens
cccacatgaggccatctcagga

SEQ ID NO: 3388643 - DNA, 23 bp, Homo sapiens
cccacatgaggccatctcaggag

SEQ ID NO: 3388644 - DNA, 21 bp, Homo sapiens
cccacattccaaaagggggcc

SEQ ID NO: 3388645 - DNA, 18 bp, Homo sapiens
cccacattctgatgagca

SEQ ID NO: 3388646 - DNA, 21 bp, Homo sapiens
cccaccaccctttgctgactc

SEQ ID NO: 3388647 - DNA, 12 bp, Homo sapiens
cccaccagctcg

SEQ ID NO: 3388648 - DNA, 14 bp, Homo sapiens
cccaccagtgcctt

SEQ ID NO: 3388649 - DNA, 17 bp, Homo sapiens
cccaccatcaccaccgc

SEQ ID NO: 3388650 - DNA, 22 bp, Homo sapiens
cccaccatcaccaccgcctctg

SEQ ID NO: 3388651 - DNA, 13 bp, Homo sapiens
cccaccattcctg

SEQ ID NO: 3388652 - DNA, 18 bp, Homo sapiens
cccaccattcctgccttt

SEQ ID NO: 3388653 - DNA, 16 bp, Homo sapiens
cccaccattctacctg

SEQ ID NO: 3388654 - DNA, 14 bp, Homo sapiens
cccacccacctcca

SEQ ID NO: 3388655 - DNA, 12 bp, Homo sapiens
cccacccaggag

SEQ ID NO: 3388656 - DNA, 13 bp, Homo sapiens
cccacccaggagg

SEQ ID NO: 3388657 - DNA, 14 bp, Homo sapiens
cccacccatcttcc

SEQ ID NO: 3388658 - DNA, 16 bp, Homo sapiens
cccaccccctgccctg

SEQ ID NO: 3388659 - DNA, 14 bp, Homo sapiens
cccaccccggggac

SEQ ID NO: 3388660 - DNA, 17 bp, Homo sapiens
cccacccctaagtgccc

SEQ ID NO: 3388661 - DNA, 13 bp, Homo sapiens
cccacccctccct

SEQ ID NO: 3388662 - DNA, 15 bp, Homo sapiens
cccacccctgcacag

SEQ ID NO: 3388663 - DNA, 12 bp, Homo sapiens
cccacccctgcc

SEQ ID NO: 3388664 - DNA, 21 bp, Homo sapiens
cccacccctgcctcccatgcc

SEQ ID NO: 3388665 - DNA, 20 bp, Homo sapiens
cccaccccttggaggagaga

SEQ ID NO: 3388666 - DNA, 23 bp, Homo sapiens
cccaccccttggaggagagagac

SEQ ID NO: 3388667 - DNA, 15 bp, Homo sapiens
cccacccgatgctgc

SEQ ID NO: 3388668 - DNA, 13 bp, Homo sapiens
cccacccgccgcc

SEQ ID NO: 3388669 - DNA, 22 bp, Homo sapiens
cccacccgccgcctcccacggc

SEQ ID NO: 3388670 - DNA, 23 bp, Homo sapiens
cccacccgccgcctcccacggca

SEQ ID NO: 3388671 - DNA, 13 bp, Homo sapiens
cccaccctcagca

SEQ ID NO: 3388672 - DNA, 17 bp, Homo sapiens
cccaccctcagcacccc

SEQ ID NO: 3388673 - DNA, 18 bp, Homo sapiens
cccaccctcagcacccct

SEQ ID NO: 3388674 - DNA, 13 bp, Homo sapiens
cccaccctccact

SEQ ID NO: 3388675 - DNA, 16 bp, Homo sapiens
cccaccctccatgctc

SEQ ID NO: 3388676 - DNA, 18 bp, Homo sapiens
cccaccctcctcttggaa

SEQ ID NO: 3388677 - DNA, 12 bp, Homo sapiens
cccaccctgctg

SEQ ID NO: 3388678 - DNA, 14 bp, Homo sapiens
cccaccctgggccc

SEQ ID NO: 3388679 - DNA, 21 bp, Homo sapiens
cccaccgatggagcccccaga

SEQ ID NO: 3388680 - DNA, 15 bp, Homo sapiens
cccaccgcccccacc

SEQ ID NO: 3388681 - DNA, 21 bp, Homo sapiens
cccaccgggagcctccccctc

SEQ ID NO: 3388682 - DNA, 23 bp, Homo sapiens
cccaccgggctgggagctctgca

SEQ ID NO: 3388683 - DNA, 23 bp, Homo sapiens
cccaccggggactggacacaaac

SEQ ID NO: 3388684 - DNA, 18 bp, Homo sapiens
cccaccggtccagctggc

SEQ ID NO: 3388685 - DNA, 21 bp, Homo sapiens
cccacctagaacactaactca

SEQ ID NO: 3388686 - DNA, 13 bp, Homo sapiens
cccacctcacccc

SEQ ID NO: 3388687 - DNA, 12 bp, Homo sapiens
cccacctcagcc

SEQ ID NO: 3388688 - DNA, 14 bp, Homo sapiens
cccacctcagcctc

SEQ ID NO: 3388689 - DNA, 16 bp, Homo sapiens
cccacctccacccagc

SEQ ID NO: 3388690 - DNA, 17 bp, Homo sapiens
cccacctccacccagcc

SEQ ID NO: 3388691 - DNA, 18 bp, Homo sapiens
cccacctccacctgtgag

SEQ ID NO: 3388692 - DNA, 14 bp, Homo sapiens
cccacctccccacg

SEQ ID NO: 3388693 - DNA, 16 bp, Homo sapiens
cccacctccccacgcc

SEQ ID NO: 3388694 - DNA, 17 bp, Homo sapiens
cccacctccccacgccc

SEQ ID NO: 3388695 - DNA, 17 bp, Homo sapiens
cccacctcggtcactcc

SEQ ID NO: 3388696 - DNA, 15 bp, Homo sapiens
cccacctctggccct

SEQ ID NO: 3388697 - DNA, 16 bp, Homo sapiens
cccacctctggccctg

SEQ ID NO: 3388698 - DNA, 17 bp, Homo sapiens
cccacctctggccctgt

SEQ ID NO: 3388699 - DNA, 12 bp, Homo sapiens
cccacctctggt

SEQ ID NO: 3388700 - DNA, 18 bp, Homo sapiens
cccacctctgtgacctca

SEQ ID NO: 3388701 - DNA, 21 bp, Homo sapiens
cccacctctgtgacctcaggc

SEQ ID NO: 3388702 - DNA, 16 bp, Homo sapiens
cccacctgcacccagg

SEQ ID NO: 3388703 - DNA, 12 bp, Homo sapiens
cccacctggcca

SEQ ID NO: 3388704 - DNA, 15 bp, Homo sapiens
cccacctggccacct

SEQ ID NO: 3388705 - DNA, 16 bp, Homo sapiens
cccacctggccacctg

SEQ ID NO: 3388706 - DNA, 21 bp, Homo sapiens
cccaccttcaattcctgggcc

SEQ ID NO: 3388707 - DNA, 17 bp, Homo sapiens
cccaccttggctgcagg

SEQ ID NO: 3388708 - DNA, 19 bp, Homo sapiens
cccaccttggctgcaggga

SEQ ID NO: 3388709 - DNA, 20 bp, Homo sapiens
cccaccttggctgcagggag

SEQ ID NO: 3388710 - DNA, 17 bp, Homo sapiens
cccacgaacgctcttag

SEQ ID NO: 3388711 - DNA, 20 bp, Homo sapiens
cccacgaggatggcctggaa

SEQ ID NO: 3388712 - DNA, 14 bp, Homo sapiens
cccacgagggctgg

SEQ ID NO: 3388713 - DNA, 13 bp, Homo sapiens
cccacgagtcacc

SEQ ID NO: 3388714 - DNA, 15 bp, Homo sapiens
cccacgagtcacctg

SEQ ID NO: 3388715 - DNA, 17 bp, Homo sapiens
cccacgagtcacctgca

SEQ ID NO: 3388716 - DNA, 12 bp, Homo sapiens
ccccaaagcccc

SEQ ID NO: 3388717 - DNA, 21 bp, Homo sapiens
ccccaaagctttcctgcccca

SEQ ID NO: 3388718 - DNA, 12 bp, Homo sapiens
ccccaaatatag

SEQ ID NO: 3388719 - DNA, 15 bp, Homo sapiens
ccccaaatcaataca

SEQ ID NO: 3388720 - DNA, 22 bp, Homo sapiens
ccccaacaaaccatccagtgac

SEQ ID NO: 3388721 - DNA, 16 bp, Homo sapiens
ccccaacactccaggc

SEQ ID NO: 3388722 - DNA, 19 bp, Homo sapiens
ccccaacactccaggccct

SEQ ID NO: 3388723 - DNA, 17 bp, Homo sapiens
ccccaacactgtgccct

SEQ ID NO: 3388724 - DNA, 18 bp, Homo sapiens
ccccaacactgtgccctg

SEQ ID NO: 3388725 - DNA, 22 bp, Homo sapiens
ccccaacactgtgccctggtgg

SEQ ID NO: 3388726 - DNA, 16 bp, Homo sapiens
ccccaacatgcactga

SEQ ID NO: 3388727 - DNA, 13 bp, Homo sapiens
ccccaaccccagc

SEQ ID NO: 3388728 - DNA, 13 bp, Homo sapiens
ccccaacccccac

SEQ ID NO: 3388729 - DNA, 16 bp, Homo sapiens
ccccaacccctgagga

SEQ ID NO: 3388730 - DNA, 17 bp, Homo sapiens
ccccaacccctgaggaa

SEQ ID NO: 3388731 - DNA, 18 bp, Homo sapiens
ccccaacgggaaaggaaa

SEQ ID NO: 3388732 - DNA, 17 bp, Homo sapiens
ccccaactctgagccca

SEQ ID NO: 3388733 - DNA, 18 bp, Homo sapiens
ccccaactctgagcccat

SEQ ID NO: 3388734 - DNA, 16 bp, Homo sapiens
ccccaagcagccagcc

SEQ ID NO: 3388735 - DNA, 13 bp, Homo sapiens
ccccaagggccct

SEQ ID NO: 3388736 - DNA, 20 bp, Homo sapiens
ccccaaggttttggagtcag

SEQ ID NO: 3388737 - DNA, 19 bp, Homo sapiens
ccccaagtagtctgctcac

SEQ ID NO: 3388738 - DNA, 13 bp, Homo sapiens
ccccaataaaggc

SEQ ID NO: 3388739 - DNA, 14 bp, Homo sapiens
ccccaataaaggca

SEQ ID NO: 3388740 - DNA, 20 bp, Homo sapiens
ccccaataaaggcagctgcc

SEQ ID NO: 3388741 - DNA, 22 bp, Homo sapiens
ccccaataaaggcagctgcctc

SEQ ID NO: 3388742 - DNA, 23 bp, Homo sapiens
ccccacaagctgtccctgcaggg

SEQ ID NO: 3388743 - DNA, 12 bp, Homo sapiens
ccccacacagct

SEQ ID NO: 3388744 - DNA, 17 bp, Homo sapiens
ccccacaccccagccca

SEQ ID NO: 3388745 - DNA, 19 bp, Homo sapiens
ccccacaccccagcccacc

SEQ ID NO: 3388746 - DNA, 14 bp, Homo sapiens
ccccacacctcagt

SEQ ID NO: 3388747 - DNA, 21 bp, Homo sapiens
ccccacagactccggcctgta

SEQ ID NO: 3388748 - DNA, 11 bp, Homo sapiens
ccccacagcct

SEQ ID NO: 3388749 - DNA, 14 bp, Homo sapiens
ccccacagcctctg

SEQ ID NO: 3388750 - DNA, 22 bp, Homo sapiens
ccccacagcctctggctccaca

SEQ ID NO: 3388751 - DNA, 14 bp, Homo sapiens
ccccacagctacct

SEQ ID NO: 3388752 - DNA, 17 bp, Homo sapiens
ccccacagttgtgttca

SEQ ID NO: 3388753 - DNA, 19 bp, Homo sapiens
ccccaccatatgaattgta

SEQ ID NO: 3388754 - DNA, 19 bp, Homo sapiens
ccccacccaccccacgccc

SEQ ID NO: 3388755 - DNA, 21 bp, Homo sapiens
ccccacccacctccacccagc

SEQ ID NO: 3388756 - DNA, 17 bp, Homo sapiens
ccccacccccagccagg

SEQ ID NO: 3388757 - DNA, 19 bp, Homo sapiens
ccccacccccagccaggct

SEQ ID NO: 3388758 - DNA, 20 bp, Homo sapiens
ccccacccccagctcaatgg

SEQ ID NO: 3388759 - DNA, 22 bp, Homo sapiens
ccccaccccggggaccctgtga

SEQ ID NO: 3388760 - DNA, 20 bp, Homo sapiens
ccccacccctaagtgcccaa

SEQ ID NO: 3388761 - DNA, 23 bp, Homo sapiens
ccccacccctaagtgcccaaagt

SEQ ID NO: 3388762 - DNA, 14 bp, Homo sapiens
ccccacccctccag

SEQ ID NO: 3388763 - DNA, 13 bp, Homo sapiens
ccccacccctgcc

SEQ ID NO: 3388764 - DNA, 23 bp, Homo sapiens
ccccacccctgcccccagccccg

SEQ ID NO: 3388765 - DNA, 15 bp, Homo sapiens
ccccaccctccactc

SEQ ID NO: 3388766 - DNA, 17 bp, Homo sapiens
ccccaccctccactcag

SEQ ID NO: 3388767 - DNA, 17 bp, Homo sapiens
ccccaccggtccagctg

SEQ ID NO: 3388768 - DNA, 18 bp, Homo sapiens
ccccacctccacctgtga

SEQ ID NO: 3388769 - DNA, 22 bp, Homo sapiens
ccccacctccacctgtgagatc

SEQ ID NO: 3388770 - DNA, 14 bp, Homo sapiens
ccccacctctccaa

SEQ ID NO: 3388771 - DNA, 14 bp, Homo sapiens
ccccacctctggtc

SEQ ID NO: 3388772 - DNA, 11 bp, Homo sapiens
ccccacctggg

SEQ ID NO: 3388773 - DNA, 21 bp, Homo sapiens
ccccaccttcaattcctgggc

SEQ ID NO: 3388774 - DNA, 16 bp, Homo sapiens
ccccacgagggctggc

SEQ ID NO: 3388775 - DNA, 21 bp, Homo sapiens
ccccacgagggctggctggcc

SEQ ID NO: 3388776 - DNA, 19 bp, Homo sapiens
ccccacggccgctccaggg

SEQ ID NO: 3388777 - DNA, 18 bp, Homo sapiens
ccccactctccccacact

SEQ ID NO: 3388778 - DNA, 14 bp, Homo sapiens
ccccactgatgctg

SEQ ID NO: 3388779 - DNA, 19 bp, Homo sapiens
ccccactgatgctgttctc

SEQ ID NO: 3388780 - DNA, 19 bp, Homo sapiens
ccccactgccagcagcagc

SEQ ID NO: 3388781 - DNA, 14 bp, Homo sapiens
ccccactgggccag

SEQ ID NO: 3388782 - DNA, 15 bp, Homo sapiens
ccccactgggccagc

SEQ ID NO: 3388783 - DNA, 21 bp, Homo sapiens
ccccactgggccagccctgca

SEQ ID NO: 3388784 - DNA, 22 bp, Homo sapiens
ccccactgggccagccctgcag

SEQ ID NO: 3388785 - DNA, 22 bp, Homo sapiens
ccccactgtccccctacccacc

SEQ ID NO: 3388786 - DNA, 21 bp, Homo sapiens
ccccacttgcctcttccttga

SEQ ID NO: 3388787 - DNA, 17 bp, Homo sapiens
ccccagacaacagccca

SEQ ID NO: 3388788 - DNA, 14 bp, Homo sapiens
ccccagacacagcc

SEQ ID NO: 3388789 - DNA, 15 bp, Homo sapiens
ccccagactagatgt

SEQ ID NO: 3388790 - DNA, 19 bp, Homo sapiens
ccccagagcccctcctcca

SEQ ID NO: 3388791 - DNA, 12 bp, Homo sapiens
ccccagagctgt

SEQ ID NO: 3388792 - DNA, 16 bp, Homo sapiens
ccccagaggccctgga

SEQ ID NO: 3388793 - DNA, 15 bp, Homo sapiens
ccccagataccagcc

SEQ ID NO: 3388794 - DNA, 23 bp, Homo sapiens
ccccagatagagctgggtggcct

SEQ ID NO: 3388795 - DNA, 18 bp, Homo sapiens
ccccagatcaccagcccg

SEQ ID NO: 3388796 - DNA, 20 bp, Homo sapiens
ccccagattgcaacaggctg

SEQ ID NO: 3388797 - DNA, 22 bp, Homo sapiens
ccccagattgcaacaggctggg

SEQ ID NO: 3388798 - DNA, 17 bp, Homo sapiens
ccccagcaagtgagagc

SEQ ID NO: 3388799 - DNA, 19 bp, Homo sapiens
ccccagcaagtgagagctg

SEQ ID NO: 3388800 - DNA, 22 bp, Homo sapiens
ccccagcaagtgagagctgggt

SEQ ID NO: 3388801 - DNA, 16 bp, Homo sapiens
ccccagcatcactccc

SEQ ID NO: 3388802 - DNA, 20 bp, Homo sapiens
ccccagcatcactccccaag

SEQ ID NO: 3388803 - DNA, 23 bp, Homo sapiens
ccccagccagatggactccagcc

SEQ ID NO: 3388804 - DNA, 13 bp, Homo sapiens
ccccagcccaagt

SEQ ID NO: 3388805 - DNA, 14 bp, Homo sapiens
ccccagcccaagtc

SEQ ID NO: 3388806 - DNA, 13 bp, Homo sapiens
ccccagcccaggg

SEQ ID NO: 3388807 - DNA, 21 bp, Homo sapiens
ccccagcccagggctcctgca

SEQ ID NO: 3388808 - DNA, 13 bp, Homo sapiens
ccccagccccggg

SEQ ID NO: 3388809 - DNA, 22 bp, Homo sapiens
ccccagcccctagcccaggaga

SEQ ID NO: 3388810 - DNA, 20 bp, Homo sapiens
ccccagcccctcccccatct

SEQ ID NO: 3388811 - DNA, 19 bp, Homo sapiens
ccccagcctgacctgagac

SEQ ID NO: 3388812 - DNA, 20 bp, Homo sapiens
ccccagcctgacctgagact

SEQ ID NO: 3388813 - DNA, 12 bp, Homo sapiens
ccccagcctggc

SEQ ID NO: 3388814 - DNA, 23 bp, Homo sapiens
ccccagcggctgttccccctgcc

SEQ ID NO: 3388815 - DNA, 11 bp, Homo sapiens
ccccagctacc

SEQ ID NO: 3388816 - DNA, 14 bp, Homo sapiens
ccccagctcagggg

SEQ ID NO: 3388817 - DNA, 21 bp, Homo sapiens
ccccagctctgaggggagggg

SEQ ID NO: 3388818 - DNA, 14 bp, Homo sapiens
ccccagctctggtg

SEQ ID NO: 3388819 - DNA, 22 bp, Homo sapiens
ccccagctctggtgagtcttgg

SEQ ID NO: 3388820 - DNA, 18 bp, Homo sapiens
ccccagctgactgtggcc

SEQ ID NO: 3388821 - DNA, 10 bp, Homo sapiens
ccccagctgg

SEQ ID NO: 3388822 - DNA, 19 bp, Homo sapiens
ccccaggaaactagctttt

SEQ ID NO: 3388823 - DNA, 15 bp, Homo sapiens
ccccaggattccccc

SEQ ID NO: 3388824 - DNA, 16 bp, Homo sapiens
ccccaggattccccca

SEQ ID NO: 3388825 - DNA, 13 bp, Homo sapiens
ccccaggcccttc

SEQ ID NO: 3388826 - DNA, 14 bp, Homo sapiens
ccccaggcctccag

SEQ ID NO: 3388827 - DNA, 15 bp, Homo sapiens
ccccaggcctctgtg

SEQ ID NO: 3388828 - DNA, 17 bp, Homo sapiens
ccccaggcctctgtgtc

SEQ ID NO: 3388829 - DNA, 22 bp, Homo sapiens
ccccaggctggacatgctgact

SEQ ID NO: 3388830 - DNA, 19 bp, Homo sapiens
ccccagggaatcagggacc

SEQ ID NO: 3388831 - DNA, 23 bp, Homo sapiens
ccccagggacaaaacactgtgtc

SEQ ID NO: 3388832 - DNA, 15 bp, Homo sapiens
ccccagggcaccctg

SEQ ID NO: 3388833 - DNA, 14 bp, Homo sapiens
ccccagggcagggt

SEQ ID NO: 3388834 - DNA, 23 bp, Homo sapiens
ccccagggcagggtgggcagcct

SEQ ID NO: 3388835 - DNA, 11 bp, Homo sapiens
ccccagggccc

SEQ ID NO: 3388836 - DNA, 13 bp, Homo sapiens
ccccagggcccct

SEQ ID NO: 3388837 - DNA, 23 bp, Homo sapiens
ccccaggggcgagttcctcgctc

SEQ ID NO: 3388838 - DNA, 18 bp, Homo sapiens
ccccaggggggcctcctc

SEQ ID NO: 3388839 - DNA, 16 bp, Homo sapiens
ccccaggtcagcatct

SEQ ID NO: 3388840 - DNA, 17 bp, Homo sapiens
ccccaggtccagctctg

SEQ ID NO: 3388841 - DNA, 21 bp, Homo sapiens
ccccaggtccagctctggagg

SEQ ID NO: 3388842 - DNA, 22 bp, Homo sapiens
ccctgccctcgtggccagcccg

SEQ ID NO: 3388843 - DNA, 13 bp, Homo sapiens
ccctgccctgctg

SEQ ID NO: 3388844 - DNA, 16 bp, Homo sapiens
ccctgcctcatccacc

SEQ ID NO: 3388845 - DNA, 12 bp, Homo sapiens
ccctgcctcctg

SEQ ID NO: 3388846 - DNA, 12 bp, Homo sapiens
ccctgcctctca

SEQ ID NO: 3388847 - DNA, 22 bp, Homo sapiens
ccctgcctctcatcaactgaat

SEQ ID NO: 3388848 - DNA, 12 bp, Homo sapiens
ccctgcctgccc

SEQ ID NO: 3388849 - DNA, 13 bp, Homo sapiens
ccctgcctggtca

SEQ ID NO: 3388850 - DNA, 23 bp, Homo sapiens
ccctgccttgggccttgctgctg

SEQ ID NO: 3388851 - DNA, 15 bp, Homo sapiens
ccctgcgcctgtgat

SEQ ID NO: 3388852 - DNA, 19 bp, Homo sapiens
ccctgcgtggcctgagtcc

SEQ ID NO: 3388853 - DNA, 18 bp, Homo sapiens
ccctgcgttggagccact

SEQ ID NO: 3388854 - DNA, 19 bp, Homo sapiens
ccctgcgttggagccactc

SEQ ID NO: 3388855 - DNA, 20 bp, Homo sapiens
ccctgcgttggagccactcc

SEQ ID NO: 3388856 - DNA, 13 bp, Homo sapiens
ccctgctacctgt

SEQ ID NO: 3388857 - DNA, 14 bp, Homo sapiens
ccctgctccaccag

SEQ ID NO: 3388858 - DNA, 20 bp, Homo sapiens
ccctgctccaccagcagcat

SEQ ID NO: 3388859 - DNA, 15 bp, Homo sapiens
ccctgctcccagcct

SEQ ID NO: 3388860 - DNA, 17 bp, Homo sapiens
ccctgctcccagcctgc

SEQ ID NO: 3388861 - DNA, 20 bp, Homo sapiens
ccctgctcccagcctgctga

SEQ ID NO: 3388862 - DNA, 12 bp, Homo sapiens
ccctgctccctg

SEQ ID NO: 3388863 - DNA, 18 bp, Homo sapiens
ccctgctccctgctttgg

SEQ ID NO: 3388864 - DNA, 19 bp, Homo sapiens
ccctgctccctgctttggc

SEQ ID NO: 3388865 - DNA, 16 bp, Homo sapiens
ccctgctcctccctgg

SEQ ID NO: 3388866 - DNA, 17 bp, Homo sapiens
ccctgctcctccctggc

SEQ ID NO: 3388867 - DNA, 19 bp, Homo sapiens
ccctgctcctccctggctg

SEQ ID NO: 3388868 - DNA, 21 bp, Homo sapiens
ccctgctcctccctggctgcc

SEQ ID NO: 3388869 - DNA, 19 bp, Homo sapiens
ccctgctcctcctgccctg

SEQ ID NO: 3388870 - DNA, 15 bp, Homo sapiens
ccctgctcctgcagc

SEQ ID NO: 3388871 - DNA, 13 bp, Homo sapiens
ccctgctgaatgc

SEQ ID NO: 3388872 - DNA, 15 bp, Homo sapiens
ccctgctgcaggggc

SEQ ID NO: 3388873 - DNA, 19 bp, Homo sapiens
ccctgctgcaggggctctg

SEQ ID NO: 3388874 - DNA, 21 bp, Homo sapiens
ccctgctgcaggggctctgga

SEQ ID NO: 3388875 - DNA, 13 bp, Homo sapiens
ccctgctggttca

SEQ ID NO: 3388876 - DNA, 20 bp, Homo sapiens
ccctgctggttcagggttgg

SEQ ID NO: 3388877 - DNA, 20 bp, Homo sapiens
ccctgctgtgccatgctggg

SEQ ID NO: 3388878 - DNA, 14 bp, Homo sapiens
ccctgctgtgggag

SEQ ID NO: 3388879 - DNA, 16 bp, Homo sapiens
ccctgcttctccagcc

SEQ ID NO: 3388880 - DNA, 19 bp, Homo sapiens
ccctgctttggctgagggg

SEQ ID NO: 3388881 - DNA, 17 bp, Homo sapiens
ccctgctttgggctgcc

SEQ ID NO: 3388882 - DNA, 18 bp, Homo sapiens
ccctgctttgggctgccc

SEQ ID NO: 3388883 - DNA, 19 bp, Homo sapiens
ccctgctttgggctgccct

SEQ ID NO: 3388884 - DNA, 16 bp, Homo sapiens
ccctgctttttttctt

SEQ ID NO: 3388885 - DNA, 17 bp, Homo sapiens
ccctggacaagcagagg

SEQ ID NO: 3388886 - DNA, 12 bp, Homo sapiens
ccctggacacag

SEQ ID NO: 3388887 - DNA, 15 bp, Homo sapiens
ccctggacacagctc

SEQ ID NO: 3388888 - DNA, 18 bp, Homo sapiens
ccctggacacagctcttc

SEQ ID NO: 3388889 - DNA, 19 bp, Homo sapiens
ccctggacacagctcttca

SEQ ID NO: 3388890 - DNA, 15 bp, Homo sapiens
ccctggagcaggagc

SEQ ID NO: 3388891 - DNA, 21 bp, Homo sapiens
ccctggagccaactgctgctt

SEQ ID NO: 3388892 - DNA, 14 bp, Homo sapiens
ccctggagccctgt

SEQ ID NO: 3388893 - DNA, 17 bp, Homo sapiens
ccctggaggtctccagg

SEQ ID NO: 3388894 - DNA, 19 bp, Homo sapiens
ccctggatccatcaggcca

SEQ ID NO: 3388895 - DNA, 23 bp, Homo sapiens
ccctggatgggcattgggctgac

SEQ ID NO: 3388896 - DNA, 13 bp, Homo sapiens
ccctggatgtgtg

SEQ ID NO: 3388897 - DNA, 19 bp, Homo sapiens
ccctggatgtgtggggcat

SEQ ID NO: 3388898 - DNA, 15 bp, Homo sapiens
ccctggcagcagcag

SEQ ID NO: 3388899 - DNA, 20 bp, Homo sapiens
ccctggcaggatgaccctgc

SEQ ID NO: 3388900 - DNA, 22 bp, Homo sapiens
ccctggcaggatgaccctgcga

SEQ ID NO: 3388901 - DNA, 13 bp, Homo sapiens
ccctggccagccc

SEQ ID NO: 3388902 - DNA, 16 bp, Homo sapiens
ccctggccagcccttc

SEQ ID NO: 3388903 - DNA, 13 bp, Homo sapiens
ccctggccccctc

SEQ ID NO: 3388904 - DNA, 11 bp, Homo sapiens
ccctggccctt

SEQ ID NO: 3388905 - DNA, 18 bp, Homo sapiens
ccctggccctttcccctt

SEQ ID NO: 3388906 - DNA, 11 bp, Homo sapiens
ccctggcctcc

SEQ ID NO: 3388907 - DNA, 20 bp, Homo sapiens
ccctggcctcccctgccacc

SEQ ID NO: 3388908 - DNA, 19 bp, Homo sapiens
ccctggcctctgtgccttc

SEQ ID NO: 3388909 - DNA, 21 bp, Homo sapiens
ccctggcctctgtgccttctt

SEQ ID NO: 3388910 - DNA, 18 bp, Homo sapiens
ccctggcctgaactgagg

SEQ ID NO: 3388911 - DNA, 21 bp, Homo sapiens
ccctggcctgaactgaggaga

SEQ ID NO: 3388912 - DNA, 19 bp, Homo sapiens
ccctggctcccacaggccc

SEQ ID NO: 3388913 - DNA, 14 bp, Homo sapiens
ccctggctcccatg

SEQ ID NO: 3388914 - DNA, 15 bp, Homo sapiens
ccctggctcccatga

SEQ ID NO: 3388915 - DNA, 15 bp, Homo sapiens
ccctggctccctcct

SEQ ID NO: 3388916 - DNA, 17 bp, Homo sapiens
ccctggctgagggcagc

SEQ ID NO: 3388917 - DNA, 14 bp, Homo sapiens
ccctggctgccctg

SEQ ID NO: 3388918 - DNA, 16 bp, Homo sapiens
ccctggctgccctggc

SEQ ID NO: 3388919 - DNA, 14 bp, Homo sapiens
ccctggctgctgcc

SEQ ID NO: 3388920 - DNA, 21 bp, Homo sapiens
ccctggctgggatcagagcag

SEQ ID NO: 3388921 - DNA, 22 bp, Homo sapiens
ccctggcttttcactgctggct

SEQ ID NO: 3388922 - DNA, 14 bp, Homo sapiens
ccctgggagacaga

SEQ ID NO: 3388923 - DNA, 14 bp, Homo sapiens
ccctgggagagaag

SEQ ID NO: 3388924 - DNA, 16 bp, Homo sapiens
ccctgggaggcccctt

SEQ ID NO: 3388925 - DNA, 11 bp, Homo sapiens
ccctgggcagg

SEQ ID NO: 3388926 - DNA, 19 bp, Homo sapiens
ccctgggcatcttctggct

SEQ ID NO: 3388927 - DNA, 22 bp, Homo sapiens
ccctgggccagggtctgtgtga

SEQ ID NO: 3388928 - DNA, 17 bp, Homo sapiens
ccctgggcccctccacg

SEQ ID NO: 3388929 - DNA, 18 bp, Homo sapiens
ccctgggcccctccacgc

SEQ ID NO: 3388930 - DNA, 16 bp, Homo sapiens
ccctgggccctgggct

SEQ ID NO: 3388931 - DNA, 19 bp, Homo sapiens
ccctgggccctgggctgga

SEQ ID NO: 3388932 - DNA, 13 bp, Homo sapiens
ccctgggcctcag

SEQ ID NO: 3388933 - DNA, 11 bp, Homo sapiens
ccctgggctgg

SEQ ID NO: 3388934 - DNA, 19 bp, Homo sapiens
ccctgggctgtctgtcacc

SEQ ID NO: 3388935 - DNA, 18 bp, Homo sapiens
ccctgggcttggcctgct

SEQ ID NO: 3388936 - DNA, 19 bp, Homo sapiens
ccctgggcttggcctgctg

SEQ ID NO: 3388937 - DNA, 23 bp, Homo sapiens
ccctggggactgttccaaagcca

SEQ ID NO: 3388938 - DNA, 16 bp, Homo sapiens
ccctggggctgggccc

SEQ ID NO: 3388939 - DNA, 21 bp, Homo sapiens
ccctgggggtttcacctgggc

SEQ ID NO: 3388940 - DNA, 17 bp, Homo sapiens
ccctgggtgggctctgt

SEQ ID NO: 3388941 - DNA, 16 bp, Homo sapiens
ccctggtccagggaag

SEQ ID NO: 3388942 - DNA, 18 bp, Homo sapiens
ccctggtccagggaagct

SEQ ID NO: 3388943 - DNA, 13 bp, Homo sapiens
ccctggtccttcc

SEQ ID NO: 3388944 - DNA, 19 bp, Homo sapiens
ccctggtctccgtggcact

SEQ ID NO: 3388945 - DNA, 14 bp, Homo sapiens
ccctggtgctgcca

SEQ ID NO: 3388946 - DNA, 23 bp, Homo sapiens
ccctggtggagaaagcactgacc

SEQ ID NO: 3388947 - DNA, 19 bp, Homo sapiens
ccctggtggcagtgggagc

SEQ ID NO: 3388948 - DNA, 20 bp, Homo sapiens
ccctggtggtattttatttt

SEQ ID NO: 3388949 - DNA, 21 bp, Homo sapiens
ccctggtgtcacatggggcct

SEQ ID NO: 3388950 - DNA, 20 bp, Homo sapiens
ccctggttgggtggcaattc

SEQ ID NO: 3388951 - DNA, 20 bp, Homo sapiens
ccctgtacagtgttaccatc

SEQ ID NO: 3388952 - DNA, 13 bp, Homo sapiens
ccctgtacccagc

SEQ ID NO: 3388953 - DNA, 17 bp, Homo sapiens
ccctgtacctcatccca

SEQ ID NO: 3388954 - DNA, 19 bp, Homo sapiens
ccctgtagactagtgccgt

SEQ ID NO: 3388955 - DNA, 15 bp, Homo sapiens
ccctgtagatgttct

SEQ ID NO: 3388956 - DNA, 18 bp, Homo sapiens
ccctgtagatgttctagg

SEQ ID NO: 3388957 - DNA, 24 bp, Homo sapiens
ccctgtatgtctacctctgacttc

SEQ ID NO: 3388958 - DNA, 21 bp, Homo sapiens
ccctgtcaagttaacaaggaa

SEQ ID NO: 3388959 - DNA, 22 bp, Homo sapiens
ccctgtcccacccccttccccc

SEQ ID NO: 3388960 - DNA, 13 bp, Homo sapiens
ccctgtcccctca

SEQ ID NO: 3388961 - DNA, 18 bp, Homo sapiens
ccctgtcccctcagctcc

SEQ ID NO: 3388962 - DNA, 10 bp, Homo sapiens
ccctgtccct

SEQ ID NO: 3388963 - DNA, 14 bp, Homo sapiens
ccctgtccctccca

SEQ ID NO: 3388964 - DNA, 18 bp, Homo sapiens
ccctgtccctcccacctc

SEQ ID NO: 3388965 - DNA, 16 bp, Homo sapiens
ccctgtccctgtcccc

SEQ ID NO: 3388966 - DNA, 22 bp, Homo sapiens
ccctgtcctgatggtcagctcc

SEQ ID NO: 3388967 - DNA, 15 bp, Homo sapiens
ccctgtcctgtgaat

SEQ ID NO: 3388968 - DNA, 23 bp, Homo sapiens
ccgggcccctgggcttggcctgc

SEQ ID NO: 3388969 - DNA, 19 bp, Homo sapiens
ccgggcctggagaactaga

SEQ ID NO: 3388970 - DNA, 12 bp, Homo sapiens
ccgggctgcctg

SEQ ID NO: 3388971 - DNA, 17 bp, Homo sapiens
ccgggctgcctgggctg

SEQ ID NO: 3388972 - DNA, 18 bp, Homo sapiens
ccgggctgcctgggctgt

SEQ ID NO: 3388973 - DNA, 13 bp, Homo sapiens
ccgggctggagaa

SEQ ID NO: 3388974 - DNA, 21 bp, Homo sapiens
ccggggaagctgccagcccag

SEQ ID NO: 3388975 - DNA, 22 bp, Homo sapiens
ccggggaagctgccagcccaga

SEQ ID NO: 3388976 - DNA, 15 bp, Homo sapiens
ccggggaccctgtga

SEQ ID NO: 3388977 - DNA, 18 bp, Homo sapiens
ccggggcgcctagagcgc

SEQ ID NO: 3388978 - DNA, 19 bp, Homo sapiens
ccggggctggcaagcaggg

SEQ ID NO: 3388979 - DNA, 15 bp, Homo sapiens
ccgggggagcccagt

SEQ ID NO: 3388980 - DNA, 15 bp, Homo sapiens
ccgggggaggggcgc

SEQ ID NO: 3388981 - DNA, 16 bp, Homo sapiens
ccgggggaggggcgcg

SEQ ID NO: 3388982 - DNA, 23 bp, Homo sapiens
ccggggtcctgtggcaggcagcg

SEQ ID NO: 3388983 - DNA, 14 bp, Homo sapiens
ccggggtctgtgct

SEQ ID NO: 3388984 - DNA, 15 bp, Homo sapiens
ccggggtctgtgctg

SEQ ID NO: 3388985 - DNA, 16 bp, Homo sapiens
ccgggtctcaggcctc

SEQ ID NO: 3388986 - DNA, 15 bp, Homo sapiens
ccgggtgggcctggc

SEQ ID NO: 3388987 - DNA, 16 bp, Homo sapiens
ccgggtgggcctggcc

SEQ ID NO: 3388988 - DNA, 21 bp, Homo sapiens
ccgggtgggcctggcctgagc

SEQ ID NO: 3388989 - DNA, 14 bp, Homo sapiens
ccgggtgtggcctc

SEQ ID NO: 3388990 - DNA, 16 bp, Homo sapiens
ccgggtgtggcctcag

SEQ ID NO: 3388991 - DNA, 21 bp, Homo sapiens
ccgggtgtggcctcagccctc

SEQ ID NO: 3388992 - DNA, 21 bp, Homo sapiens
ccggtagaggctccccagggc

SEQ ID NO: 3388993 - DNA, 13 bp, Homo sapiens
ccggtcagtgcct

SEQ ID NO: 3388994 - DNA, 20 bp, Homo sapiens
ccggtcagtgccttttggaa

SEQ ID NO: 3388995 - DNA, 14 bp, Homo sapiens
ccggtccagctggc

SEQ ID NO: 3388996 - DNA, 23 bp, Homo sapiens
ccggtcccacccctccctctgtc

SEQ ID NO: 3388997 - DNA, 19 bp, Homo sapiens
ccggtctgcaagtcagagg

SEQ ID NO: 3388998 - DNA, 21 bp, Homo sapiens
ccggtctgcaagtcagaggat

SEQ ID NO: 3388999 - DNA, 14 bp, Homo sapiens
ccggtgctgcagga

SEQ ID NO: 3389000 - DNA, 17 bp, Homo sapiens
ccggtgcttctggaaac

SEQ ID NO: 3389001 - DNA, 13 bp, Homo sapiens
ccggtggctctgg

SEQ ID NO: 3389002 - DNA, 15 bp, Homo sapiens
ccggtgtgcctgcag

SEQ ID NO: 3389003 - DNA, 17 bp, Homo sapiens
ccggtgtgcctgcagcc

SEQ ID NO: 3389004 - DNA, 12 bp, Homo sapiens
ccggtgttctaa

SEQ ID NO: 3389005 - DNA, 17 bp, Homo sapiens
ccggttcagacccctgc

SEQ ID NO: 3389006 - DNA, 20 bp, Homo sapiens
ccggttcagacccctgcctg

SEQ ID NO: 3389007 - DNA, 20 bp, Homo sapiens
ccgtaataacacccttcctt

SEQ ID NO: 3389008 - DNA, 12 bp, Homo sapiens
ccgtaatttaac

SEQ ID NO: 3389009 - DNA, 12 bp, Homo sapiens
ccgtaccccacc

SEQ ID NO: 3389010 - DNA, 13 bp, Homo sapiens
ccgtaccccaccc

SEQ ID NO: 3389011 - DNA, 18 bp, Homo sapiens
ccgtaccccaccctcagc

SEQ ID NO: 3389012 - DNA, 23 bp, Homo sapiens
ccgtactaggttggacagccccc

SEQ ID NO: 3389013 - DNA, 15 bp, Homo sapiens
ccgtagggagtacct

SEQ ID NO: 3389014 - DNA, 18 bp, Homo sapiens
ccgtagggagtacctgct

SEQ ID NO: 3389015 - DNA, 11 bp, Homo sapiens
ccgtagtctcc

SEQ ID NO: 3389016 - DNA, 22 bp, Homo sapiens
ccgtatctcaggaagtccagcc

SEQ ID NO: 3389017 - DNA, 19 bp, Homo sapiens
ccgtcaccacgactggcca

SEQ ID NO: 3389018 - DNA, 21 bp, Homo sapiens
ccgtcaccacgactggccagg

SEQ ID NO: 3389019 - DNA, 16 bp, Homo sapiens
ccgtcattgctgctgc

SEQ ID NO: 3389020 - DNA, 17 bp, Homo sapiens
ccgtcattgctgctgct

SEQ ID NO: 3389021 - DNA, 12 bp, Homo sapiens
ccgtccacccag

SEQ ID NO: 3389022 - DNA, 14 bp, Homo sapiens
ccgtccacccaggc

SEQ ID NO: 3389023 - DNA, 17 bp, Homo sapiens
ccgtccacccaggctgc

SEQ ID NO: 3389024 - DNA, 22 bp, Homo sapiens
ccgtccagccgccattgccacc

SEQ ID NO: 3389025 - DNA, 20 bp, Homo sapiens
ccgtccatggcaccagcccc

SEQ ID NO: 3389026 - DNA, 13 bp, Homo sapiens
ccgtccgccctgc

SEQ ID NO: 3389027 - DNA, 14 bp, Homo sapiens
ccgtccgccctgct

SEQ ID NO: 3389028 - DNA, 14 bp, Homo sapiens
ccgtctacatttca

SEQ ID NO: 3389029 - DNA, 18 bp, Homo sapiens
ccgtctaggattgggcct

SEQ ID NO: 3389030 - DNA, 20 bp, Homo sapiens
ccgtctccaggggctgcttc

SEQ ID NO: 3389031 - DNA, 17 bp, Homo sapiens
ccgtctcctccctcagc

SEQ ID NO: 3389032 - DNA, 17 bp, Homo sapiens
ccgtctctctgcccact

SEQ ID NO: 3389033 - DNA, 16 bp, Homo sapiens
ccgtctgactccagag

SEQ ID NO: 3389034 - DNA, 18 bp, Homo sapiens
ccgtctggcccaccaggg

SEQ ID NO: 3389035 - DNA, 17 bp, Homo sapiens
ccgtgaaaacggagctg

SEQ ID NO: 3389036 - DNA, 14 bp, Homo sapiens
ccgtgaagcagtgc

SEQ ID NO: 3389037 - DNA, 23 bp, Homo sapiens
ccgtgaagcagtgcctcgaggca

SEQ ID NO: 3389038 - DNA, 11 bp, Homo sapiens
ccgtgacctat

SEQ ID NO: 3389039 - DNA, 20 bp, Homo sapiens
ccgtgagcaggaaggcctgg

SEQ ID NO: 3389040 - DNA, 21 bp, Homo sapiens
ccgtgagcaggaaggcctggg

SEQ ID NO: 3389041 - DNA, 21 bp, Homo sapiens
ccgtgagcgcctgtgcacaca

SEQ ID NO: 3389042 - DNA, 22 bp, Homo sapiens
ccgtgagcgcctgtgcacacac

SEQ ID NO: 3389043 - DNA, 19 bp, Homo sapiens
ccgtgagttctcagggctc

SEQ ID NO: 3389044 - DNA, 15 bp, Homo sapiens
ccgtgatagaaaaaa

SEQ ID NO: 3389045 - DNA, 20 bp, Homo sapiens
ccgtgatccatccatctcca

SEQ ID NO: 3389046 - DNA, 20 bp, Homo sapiens
ccgtgatggagaggacagag

SEQ ID NO: 3389047 - DNA, 15 bp, Homo sapiens
ccgtgcagagctgca

SEQ ID NO: 3389048 - DNA, 15 bp, Homo sapiens
ccgtgcagtacaggc

SEQ ID NO: 3389049 - DNA, 18 bp, Homo sapiens
ccgtgcattagcacagat

SEQ ID NO: 3389050 - DNA, 22 bp, Homo sapiens
ccgtgcattagcacagatttta

SEQ ID NO: 3389051 - DNA, 11 bp, Homo sapiens
ccgtgccaaag

SEQ ID NO: 3389052 - DNA, 19 bp, Homo sapiens
ccgtgcccgcaggaactgg

SEQ ID NO: 3389053 - DNA, 23 bp, Homo sapiens
ccgtgcctccaccaccactggcc

SEQ ID NO: 3389054 - DNA, 14 bp, Homo sapiens
ccgtgctgtcttct

SEQ ID NO: 3389055 - DNA, 17 bp, Homo sapiens
ccgtggacaggcccagc

SEQ ID NO: 3389056 - DNA, 22 bp, Homo sapiens
ccgtggaggaggaaggcaagag

SEQ ID NO: 3389057 - DNA, 19 bp, Homo sapiens
ccgtggattgcacgtggcc

SEQ ID NO: 3389058 - DNA, 20 bp, Homo sapiens
ccgtggattgcacgtggcct

SEQ ID NO: 3389059 - DNA, 23 bp, Homo sapiens
ccgtggattgcacgtggcctctt

SEQ ID NO: 3389060 - DNA, 20 bp, Homo sapiens
ccgtggccatccctgtgagg

SEQ ID NO: 3389061 - DNA, 20 bp, Homo sapiens
ccgtggccctgccctctcct

SEQ ID NO: 3389062 - DNA, 20 bp, Homo sapiens
ccgtggctaggcctttcctg

SEQ ID NO: 3389063 - DNA, 17 bp, Homo sapiens
ccgtggggccgccgcct

SEQ ID NO: 3389064 - DNA, 20 bp, Homo sapiens
ccgtggggccgccgcctctt

SEQ ID NO: 3389065 - DNA, 16 bp, Homo sapiens
ccgtggggtgctgccc

SEQ ID NO: 3389066 - DNA, 15 bp, Homo sapiens
ccgtggtagaggcct

SEQ ID NO: 3389067 - DNA, 23 bp, Homo sapiens
ccgtggtttgaacacgaaagaaa

SEQ ID NO: 3389068 - DNA, 11 bp, Homo sapiens
ccgtgtcccaa

SEQ ID NO: 3389069 - DNA, 15 bp, Homo sapiens
ccgtgtcccaaggag

SEQ ID NO: 3389070 - DNA, 17 bp, Homo sapiens
ccgtgtcccaaggagct

SEQ ID NO: 3389071 - DNA, 21 bp, Homo sapiens
ccgtgtggtaagcaacatggc

SEQ ID NO: 3389072 - DNA, 22 bp, Homo sapiens
ccgtgtggtaagcaacatggct

SEQ ID NO: 3389073 - DNA, 23 bp, Homo sapiens
ccgtgtggtaagcaacatggctt

SEQ ID NO: 3389074 - DNA, 15 bp, Homo sapiens
ccgttaacctttttg

SEQ ID NO: 3389075 - DNA, 20 bp, Homo sapiens
ccgttcaaattctcttcttt

SEQ ID NO: 3389076 - DNA, 20 bp, Homo sapiens
ccgttcagtgtcccaggcag

SEQ ID NO: 3389077 - DNA, 17 bp, Homo sapiens
ccgttccaccccaagag

SEQ ID NO: 3389078 - DNA, 18 bp, Homo sapiens
ccgttccaccccaagaga

SEQ ID NO: 3389079 - DNA, 21 bp, Homo sapiens
ccgttccaccccaagagaact

SEQ ID NO: 3389080 - DNA, 13 bp, Homo sapiens
ccgttccctgtca

SEQ ID NO: 3389081 - DNA, 14 bp, Homo sapiens
ccgttccctgtcag

SEQ ID NO: 3389082 - DNA, 15 bp, Homo sapiens
ccgttccctgtcaga

SEQ ID NO: 3389083 - DNA, 18 bp, Homo sapiens
ccgttcctgacatcacag

SEQ ID NO: 3389084 - DNA, 23 bp, Homo sapiens
ccgttctgctggcctggatctcc

SEQ ID NO: 3389085 - DNA, 13 bp, Homo sapiens
ccgttctgttctg

SEQ ID NO: 3389086 - DNA, 23 bp, Homo sapiens
ccgttggaaacataaccattaca

SEQ ID NO: 3389087 - DNA, 14 bp, Homo sapiens
ccgttttgtcactt

SEQ ID NO: 3389088 - DNA, 23 bp, Homo sapiens
cctaaaaggaaatctcaccccat

SEQ ID NO: 3389089 - DNA, 19 bp, Homo sapiens
cctaaaataacagtatgtg

SEQ ID NO: 3389090 - DNA, 17 bp, Homo sapiens
cctaaacataattgtgg

SEQ ID NO: 3389091 - DNA, 17 bp, Homo sapiens
cctaaacccctgtccca

SEQ ID NO: 3389092 - DNA, 13 bp, Homo sapiens
cctaaagagagta

SEQ ID NO: 3389093 - DNA, 13 bp, Homo sapiens
cctccaccttcca

SEQ ID NO: 3389094 - DNA, 19 bp, Homo sapiens
cctccacgcctcctggcca

SEQ ID NO: 3389095 - DNA, 20 bp, Homo sapiens
cctccacgcctcctggccag

SEQ ID NO: 3389096 - DNA, 20 bp, Homo sapiens
cctccactcccccacctgac

SEQ ID NO: 3389097 - DNA, 21 bp, Homo sapiens
cctccactggggaatgctccc

SEQ ID NO: 3389098 - DNA, 15 bp, Homo sapiens
cctccacttcccgtc

SEQ ID NO: 3389099 - DNA, 20 bp, Homo sapiens
cctccacttcccgtctcaga

SEQ ID NO: 3389100 - DNA, 21 bp, Homo sapiens
cctccagaagcctctggctag

SEQ ID NO: 3389101 - DNA, 15 bp, Homo sapiens
cctccagaccaccag

SEQ ID NO: 3389102 - DNA, 16 bp, Homo sapiens
cctccagaccaccagc

SEQ ID NO: 3389103 - DNA, 15 bp, Homo sapiens
cctccagagccagcc

SEQ ID NO: 3389104 - DNA, 16 bp, Homo sapiens
cctccagagccagcct

SEQ ID NO: 3389105 - DNA, 17 bp, Homo sapiens
cctccagagccagcctg

SEQ ID NO: 3389106 - DNA, 19 bp, Homo sapiens
cctccagagccagcctggg

SEQ ID NO: 3389107 - DNA, 21 bp, Homo sapiens
cctccagagccagcctgggac

SEQ ID NO: 3389108 - DNA, 17 bp, Homo sapiens
cctccagcccctgtccc

SEQ ID NO: 3389109 - DNA, 18 bp, Homo sapiens
cctccagcccctgtccca

SEQ ID NO: 3389110 - DNA, 16 bp, Homo sapiens
cctccagcccgggagc

SEQ ID NO: 3389111 - DNA, 18 bp, Homo sapiens
cctccagcccgggagcct

SEQ ID NO: 3389112 - DNA, 12 bp, Homo sapiens
cctccagcctct

SEQ ID NO: 3389113 - DNA, 18 bp, Homo sapiens
cctccagcctctcccggc

SEQ ID NO: 3389114 - DNA, 23 bp, Homo sapiens
cctccagcctgcccaagcccagg

SEQ ID NO: 3389115 - DNA, 18 bp, Homo sapiens
cctccagctgcaccagag

SEQ ID NO: 3389116 - DNA, 16 bp, Homo sapiens
cctccagctgctgctc

SEQ ID NO: 3389117 - DNA, 12 bp, Homo sapiens
cctccagcttct

SEQ ID NO: 3389118 - DNA, 16 bp, Homo sapiens
cctccaggcctgcctc

SEQ ID NO: 3389119 - DNA, 21 bp, Homo sapiens
cctccaggcctgcctcccact

SEQ ID NO: 3389120 - DNA, 12 bp, Homo sapiens
cctccagggccc

SEQ ID NO: 3389121 - DNA, 14 bp, Homo sapiens
cctccagggccccc

SEQ ID NO: 3389122 - DNA, 17 bp, Homo sapiens
cctccagtaccttgctt

SEQ ID NO: 3389123 - DNA, 14 bp, Homo sapiens
cctccagtccccct

SEQ ID NO: 3389124 - DNA, 19 bp, Homo sapiens
cctccagtgggctgatgct

SEQ ID NO: 3389125 - DNA, 16 bp, Homo sapiens
cctccagtgtgggctt

SEQ ID NO: 3389126 - DNA, 16 bp, Homo sapiens
cctccatgacagcgct

SEQ ID NO: 3389127 - DNA, 22 bp, Homo sapiens
cctccatgctcctcacctgtct

SEQ ID NO: 3389128 - DNA, 23 bp, Homo sapiens
cctccatgctcctcacctgtcta

SEQ ID NO: 3389129 - DNA, 15 bp, Homo sapiens
cctccatgctgcctc

SEQ ID NO: 3389130 - DNA, 16 bp, Homo sapiens
cctccatgctgcctcc

SEQ ID NO: 3389131 - DNA, 13 bp, Homo sapiens
cctccatgggcta

SEQ ID NO: 3389132 - DNA, 15 bp, Homo sapiens
cctccatgtgggcta

SEQ ID NO: 3389133 - DNA, 20 bp, Homo sapiens
cctccatttctctccaggaa

SEQ ID NO: 3389134 - DNA, 18 bp, Homo sapiens
cctcccaaagtgctgaga

SEQ ID NO: 3389135 - DNA, 17 bp, Homo sapiens
cctcccaaagtgctggg

SEQ ID NO: 3389136 - DNA, 14 bp, Homo sapiens
cctcccaacccagc

SEQ ID NO: 3389137 - DNA, 15 bp, Homo sapiens
cctcccaaggtcctc

SEQ ID NO: 3389138 - DNA, 18 bp, Homo sapiens
cctcccaaggtcctctca

SEQ ID NO: 3389139 - DNA, 18 bp, Homo sapiens
cctcccaagtagctggga

SEQ ID NO: 3389140 - DNA, 16 bp, Homo sapiens
cctcccacacttgctg

SEQ ID NO: 3389141 - DNA, 15 bp, Homo sapiens
cctcccacctccagt

SEQ ID NO: 3389142 - DNA, 11 bp, Homo sapiens
cctcccagagg

SEQ ID NO: 3389143 - DNA, 21 bp, Homo sapiens
cctcccagaggagccaccagt

SEQ ID NO: 3389144 - DNA, 16 bp, Homo sapiens
cctcccagaggtccag

SEQ ID NO: 3389145 - DNA, 21 bp, Homo sapiens
cctcccagaggtccagcccat

SEQ ID NO: 3389146 - DNA, 13 bp, Homo sapiens
cctcccagcccta

SEQ ID NO: 3389147 - DNA, 19 bp, Homo sapiens
cctcccagccctatggatg

SEQ ID NO: 3389148 - DNA, 12 bp, Homo sapiens
cctcccagcctg

SEQ ID NO: 3389149 - DNA, 20 bp, Homo sapiens
cctcccagcgtgtgtatccg

SEQ ID NO: 3389150 - DNA, 20 bp, Homo sapiens
cctcccagcttgtaggagct

SEQ ID NO: 3389151 - DNA, 14 bp, Homo sapiens
cctcccagggccag

SEQ ID NO: 3389152 - DNA, 21 bp, Homo sapiens
cctcccagggccagggccctg

SEQ ID NO: 3389153 - DNA, 23 bp, Homo sapiens
cctcccatcattacccttccctg

SEQ ID NO: 3389154 - DNA, 21 bp, Homo sapiens
cctcccatctgggagtcccct

SEQ ID NO: 3389155 - DNA, 13 bp, Homo sapiens
cctccccacgccc

SEQ ID NO: 3389156 - DNA, 22 bp, Homo sapiens
cctccccacggccgctccaggg

SEQ ID NO: 3389157 - DNA, 16 bp, Homo sapiens
cctccccagcccctag

SEQ ID NO: 3389158 - DNA, 17 bp, Homo sapiens
cctccccagcccctagc

SEQ ID NO: 3389159 - DNA, 22 bp, Homo sapiens
cctccccagcccctagcccagg

SEQ ID NO: 3389160 - DNA, 22 bp, Homo sapiens
cctccccatttcccatctgcac

SEQ ID NO: 3389161 - DNA, 13 bp, Homo sapiens
cctcccccaaagc

SEQ ID NO: 3389162 - DNA, 18 bp, Homo sapiens
cctcccccaacccccacc

SEQ ID NO: 3389163 - DNA, 16 bp, Homo sapiens
cctcccccgccactcc

SEQ ID NO: 3389164 - DNA, 15 bp, Homo sapiens
cctccccctcaacct

SEQ ID NO: 3389165 - DNA, 12 bp, Homo sapiens
cctccccctgag

SEQ ID NO: 3389166 - DNA, 14 bp, Homo sapiens
cctcccccttcccc

SEQ ID NO: 3389167 - DNA, 17 bp, Homo sapiens
cctccccgcctggccag

SEQ ID NO: 3389168 - DNA, 13 bp, Homo sapiens
cctcccctcacag

SEQ ID NO: 3389169 - DNA, 20 bp, Homo sapiens
cctcccctccatccctggcc

SEQ ID NO: 3389170 - DNA, 16 bp, Homo sapiens
cctcccctcccagtcc

SEQ ID NO: 3389171 - DNA, 17 bp, Homo sapiens
cctcccctctccttcct

SEQ ID NO: 3389172 - DNA, 17 bp, Homo sapiens
cctcccctctcttgcac

SEQ ID NO: 3389173 - DNA, 14 bp, Homo sapiens
cctcccctgccacc

SEQ ID NO: 3389174 - DNA, 20 bp, Homo sapiens
cctcccctgctgcaggggct

SEQ ID NO: 3389175 - DNA, 17 bp, Homo sapiens
cctcccgaatagctggg

SEQ ID NO: 3389176 - DNA, 21 bp, Homo sapiens
cctcccgagtagctgggacta

SEQ ID NO: 3389177 - DNA, 19 bp, Homo sapiens
cctcccggcatgggaaagc

SEQ ID NO: 3389178 - DNA, 16 bp, Homo sapiens
cctcccggtgcccaag

SEQ ID NO: 3389179 - DNA, 21 bp, Homo sapiens
cctcccgtagtctcctgggtg

SEQ ID NO: 3389180 - DNA, 23 bp, Homo sapiens
cctcccgtccttcccctcttctt

SEQ ID NO: 3389181 - DNA, 15 bp, Homo sapiens
cctccctatgtctgc

SEQ ID NO: 3389182 - DNA, 12 bp, Homo sapiens
cctccctccttg

SEQ ID NO: 3389183 - DNA, 14 bp, Homo sapiens
cctccctccttggg

SEQ ID NO: 3389184 - DNA, 15 bp, Homo sapiens
cctccctccttgggt

SEQ ID NO: 3389185 - DNA, 22 bp, Homo sapiens
cctccctctcagaggcctgctg

SEQ ID NO: 3389186 - DNA, 23 bp, Homo sapiens
cctccctctcagaggcctgctgc

SEQ ID NO: 3389187 - DNA, 13 bp, Homo sapiens
cctccctctctct

SEQ ID NO: 3389188 - DNA, 20 bp, Homo sapiens
cctccctctctcttctgctc

SEQ ID NO: 3389189 - DNA, 22 bp, Homo sapiens
cctccctctctcttctgctcca

SEQ ID NO: 3389190 - DNA, 14 bp, Homo sapiens
cctccctctgacct

SEQ ID NO: 3389191 - DNA, 19 bp, Homo sapiens
cctccctctgacctgcagg

SEQ ID NO: 3389192 - DNA, 13 bp, Homo sapiens
cctccctctgccc

SEQ ID NO: 3389193 - DNA, 15 bp, Homo sapiens
cctccctcttgtttt

SEQ ID NO: 3389194 - DNA, 20 bp, Homo sapiens
cctccctgaaaatgtttttc

SEQ ID NO: 3389195 - DNA, 19 bp, Homo sapiens
cctccctgactccctgtgg

SEQ ID NO: 3389196 - DNA, 21 bp, Homo sapiens
cctccctgactccctgtgggg

SEQ ID NO: 3389197 - DNA, 13 bp, Homo sapiens
cctccctgcccag

SEQ ID NO: 3389198 - DNA, 13 bp, Homo sapiens
cctccctgccccc

SEQ ID NO: 3389199 - DNA, 18 bp, Homo sapiens
cctccctgccccccaagg

SEQ ID NO: 3389200 - DNA, 21 bp, Homo sapiens
cctccctgcccctcccttcaa

SEQ ID NO: 3389201 - DNA, 12 bp, Homo sapiens
cctccctggctc

SEQ ID NO: 3389202 - DNA, 14 bp, Homo sapiens
cctccctggctccc

SEQ ID NO: 3389203 - DNA, 15 bp, Homo sapiens
cctccctggctccca

SEQ ID NO: 3389204 - DNA, 16 bp, Homo sapiens
cctccctggctcccat

SEQ ID NO: 3389205 - DNA, 18 bp, Homo sapiens
cctccctggctgccctgg

SEQ ID NO: 3389206 - DNA, 17 bp, Homo sapiens
cctccctgtctctgcat

SEQ ID NO: 3389207 - DNA, 23 bp, Homo sapiens
cctccctgttgacgaagtctctt

SEQ ID NO: 3389208 - DNA, 13 bp, Homo sapiens
cctcccttccttt

SEQ ID NO: 3389209 - DNA, 15 bp, Homo sapiens
cctcccttccttttc

SEQ ID NO: 3389210 - DNA, 21 bp, Homo sapiens
cctcccttccttttccctgct

SEQ ID NO: 3389211 - DNA, 16 bp, Homo sapiens
cctccgaccctcatgg

SEQ ID NO: 3389212 - DNA, 12 bp, Homo sapiens
cctccgagacag

SEQ ID NO: 3389213 - DNA, 16 bp, Homo sapiens
cctccgagagggagag

SEQ ID NO: 3389214 - DNA, 21 bp, Homo sapiens
cctccgagccggggagtttct

SEQ ID NO: 3389215 - DNA, 16 bp, Homo sapiens
cctccgcggctggagc

SEQ ID NO: 3389216 - DNA, 13 bp, Homo sapiens
cctccggactggt

SEQ ID NO: 3389217 - DNA, 15 bp, Homo sapiens
cctccggactggtgc

SEQ ID NO: 3389218 - DNA, 16 bp, Homo sapiens
cctccggactggtgcc

SEQ ID NO: 3389219 - DNA, 12 bp, Homo sapiens
cctctgggccat

SEQ ID NO: 3389220 - DNA, 14 bp, Homo sapiens
cctctgggcctggg

SEQ ID NO: 3389221 - DNA, 16 bp, Homo sapiens
cctctggtcgctcctg

SEQ ID NO: 3389222 - DNA, 20 bp, Homo sapiens
cctctggtcgctcctgccca

SEQ ID NO: 3389223 - DNA, 15 bp, Homo sapiens
cctctgtcatcactc

SEQ ID NO: 3389224 - DNA, 14 bp, Homo sapiens
cctctgtcatttgt

SEQ ID NO: 3389225 - DNA, 11 bp, Homo sapiens
cctctgtctca

SEQ ID NO: 3389226 - DNA, 20 bp, Homo sapiens
cctctgtctcatcctcctgg

SEQ ID NO: 3389227 - DNA, 17 bp, Homo sapiens
cctctgtgacctcaggc

SEQ ID NO: 3389228 - DNA, 13 bp, Homo sapiens
cctctgtgtcctt

SEQ ID NO: 3389229 - DNA, 20 bp, Homo sapiens
cctctgttcacaaactacct

SEQ ID NO: 3389230 - DNA, 21 bp, Homo sapiens
cctctgttcacaaactacctc

SEQ ID NO: 3389231 - DNA, 15 bp, Homo sapiens
cctcttaagtcccag

SEQ ID NO: 3389232 - DNA, 22 bp, Homo sapiens
cctcttcaccccggcaggccct

SEQ ID NO: 3389233 - DNA, 16 bp, Homo sapiens
cctcttcactgtggcc

SEQ ID NO: 3389234 - DNA, 15 bp, Homo sapiens
cctcttccacccatt

SEQ ID NO: 3389235 - DNA, 14 bp, Homo sapiens
cctcttccagtctt

SEQ ID NO: 3389236 - DNA, 17 bp, Homo sapiens
cctcttcccatgactgc

SEQ ID NO: 3389237 - DNA, 21 bp, Homo sapiens
cctcttcccatgactgcaccc

SEQ ID NO: 3389238 - DNA, 11 bp, Homo sapiens
cctcttcccca

SEQ ID NO: 3389239 - DNA, 13 bp, Homo sapiens
cctcttccccaga

SEQ ID NO: 3389240 - DNA, 16 bp, Homo sapiens
cctcttccgaatgggt

SEQ ID NO: 3389241 - DNA, 19 bp, Homo sapiens
cctcttccggagatgtagc

SEQ ID NO: 3389242 - DNA, 18 bp, Homo sapiens
cctcttccgtgacgtcac

SEQ ID NO: 3389243 - DNA, 15 bp, Homo sapiens
cctcttcctccctca

SEQ ID NO: 3389244 - DNA, 11 bp, Homo sapiens
cctcttcctga

SEQ ID NO: 3389245 - DNA, 13 bp, Homo sapiens
cctcttcctgtga

SEQ ID NO: 3389246 - DNA, 15 bp, Homo sapiens
cctcttcctttagga

SEQ ID NO: 3389247 - DNA, 18 bp, Homo sapiens
cctcttctattttgtaaa

SEQ ID NO: 3389248 - DNA, 14 bp, Homo sapiens
cctcttctcaagtg

SEQ ID NO: 3389249 - DNA, 19 bp, Homo sapiens
cctcttctcaagtgcctta

SEQ ID NO: 3389250 - DNA, 20 bp, Homo sapiens
cctcttctgcttaggagaga

SEQ ID NO: 3389251 - DNA, 15 bp, Homo sapiens
cctcttctggctcaa

SEQ ID NO: 3389252 - DNA, 14 bp, Homo sapiens
cctcttcttctttc

SEQ ID NO: 3389253 - DNA, 15 bp, Homo sapiens
cctcttgagcagtgg

SEQ ID NO: 3389254 - DNA, 19 bp, Homo sapiens
cctcttgagcagtggctgg

SEQ ID NO: 3389255 - DNA, 24 bp, Homo sapiens
cctcttgagcagtggctggtccag

SEQ ID NO: 3389256 - DNA, 13 bp, Homo sapiens
cctcttgctgtct

SEQ ID NO: 3389257 - DNA, 19 bp, Homo sapiens
cctcttgctgtctctgctc

SEQ ID NO: 3389258 - DNA, 13 bp, Homo sapiens
cctcttgggttca

SEQ ID NO: 3389259 - DNA, 22 bp, Homo sapiens
cctcttggtgtgattgcacaga

SEQ ID NO: 3389260 - DNA, 22 bp, Homo sapiens
cctctttactcccttcctggcc

SEQ ID NO: 3389261 - DNA, 15 bp, Homo sapiens
cctctttcctctctt

SEQ ID NO: 3389262 - DNA, 15 bp, Homo sapiens
cctctttcttataat

SEQ ID NO: 3389263 - DNA, 14 bp, Homo sapiens
cctctttggctccc

SEQ ID NO: 3389264 - DNA, 19 bp, Homo sapiens
cctctttggctcccctgta

SEQ ID NO: 3389265 - DNA, 20 bp, Homo sapiens
cctctttggctcccctgtac

SEQ ID NO: 3389266 - DNA, 22 bp, Homo sapiens
cctctttgtaatttaatgaaaa

SEQ ID NO: 3389267 - DNA, 17 bp, Homo sapiens
cctcttttccctctcta

SEQ ID NO: 3389268 - DNA, 19 bp, Homo sapiens
cctgaaaacgaaggggccc

SEQ ID NO: 3389269 - DNA, 22 bp, Homo sapiens
cctgaaaatgtttttctgccag

SEQ ID NO: 3389270 - DNA, 19 bp, Homo sapiens
cctgaaacccaaagccctg

SEQ ID NO: 3389271 - DNA, 20 bp, Homo sapiens
cctgaaacctagtactgccc

SEQ ID NO: 3389272 - DNA, 15 bp, Homo sapiens
cctgaaagaggctga

SEQ ID NO: 3389273 - DNA, 22 bp, Homo sapiens
cctgaaataaacactggtgcca

SEQ ID NO: 3389274 - DNA, 16 bp, Homo sapiens
cctgaaattccaaagt

SEQ ID NO: 3389275 - DNA, 16 bp, Homo sapiens
cctgaacaagaattgg

SEQ ID NO: 3389276 - DNA, 16 bp, Homo sapiens
cctgaaccgcacagct

SEQ ID NO: 3389277 - DNA, 18 bp, Homo sapiens
cctgaaccgcacagctca

SEQ ID NO: 3389278 - DNA, 17 bp, Homo sapiens
cctgaactgaacaccat

SEQ ID NO: 3389279 - DNA, 16 bp, Homo sapiens
cctgaactttctccct

SEQ ID NO: 3389280 - DNA, 18 bp, Homo sapiens
cctgaactttctccctca

SEQ ID NO: 3389281 - DNA, 19 bp, Homo sapiens
cctgaactttctccctcat

SEQ ID NO: 3389282 - DNA, 18 bp, Homo sapiens
cctgaagaattaagatac

SEQ ID NO: 3389283 - DNA, 12 bp, Homo sapiens
cctgaagactga

SEQ ID NO: 3389284 - DNA, 14 bp, Homo sapiens
cctgaagactgagg

SEQ ID NO: 3389285 - DNA, 17 bp, Homo sapiens
cctgaagaggcgggcca

SEQ ID NO: 3389286 - DNA, 19 bp, Homo sapiens
cctgaagaggcgggccagc

SEQ ID NO: 3389287 - DNA, 20 bp, Homo sapiens
cctgaagaggcgggccagcc

SEQ ID NO: 3389288 - DNA, 21 bp, Homo sapiens
cctgaagaggcgggccagcca

SEQ ID NO: 3389289 - DNA, 23 bp, Homo sapiens
cctgaagaggcgggccagccagg

SEQ ID NO: 3389290 - DNA, 17 bp, Homo sapiens
cctgaagccagccttct

SEQ ID NO: 3389291 - DNA, 18 bp, Homo sapiens
cctgaaggattctgggaa

SEQ ID NO: 3389292 - DNA, 21 bp, Homo sapiens
cctgaaggattctgggaatca

SEQ ID NO: 3389293 - DNA, 23 bp, Homo sapiens
cctgaaggattctgggaatcatg

SEQ ID NO: 3389294 - DNA, 15 bp, Homo sapiens
cctgaagtcacacag

SEQ ID NO: 3389295 - DNA, 17 bp, Homo sapiens
cctgaagtcacacagtg

SEQ ID NO: 3389296 - DNA, 17 bp, Homo sapiens
cctgaatccaaactaat

SEQ ID NO: 3389297 - DNA, 19 bp, Homo sapiens
cctgaatctgtgcaaacag

SEQ ID NO: 3389298 - DNA, 20 bp, Homo sapiens
cctgaatggttccatgcctg

SEQ ID NO: 3389299 - DNA, 21 bp, Homo sapiens
cctgaatggttccatgcctga

SEQ ID NO: 3389300 - DNA, 14 bp, Homo sapiens
cctgaattctattt

SEQ ID NO: 3389301 - DNA, 18 bp, Homo sapiens
cctgaattctatttgctg

SEQ ID NO: 3389302 - DNA, 15 bp, Homo sapiens
cctgaattctttttc

SEQ ID NO: 3389303 - DNA, 15 bp, Homo sapiens
cctgacaaatatttt

SEQ ID NO: 3389304 - DNA, 13 bp, Homo sapiens
cctgacaatggca

SEQ ID NO: 3389305 - DNA, 14 bp, Homo sapiens
cctgacaatggcag

SEQ ID NO: 3389306 - DNA, 16 bp, Homo sapiens
cctgacaatggcagct

SEQ ID NO: 3389307 - DNA, 19 bp, Homo sapiens
cctgacactgagccccacc

SEQ ID NO: 3389308 - DNA, 14 bp, Homo sapiens
cctgacactttaat

SEQ ID NO: 3389309 - DNA, 17 bp, Homo sapiens
cctgacagaaggtgcca

SEQ ID NO: 3389310 - DNA, 22 bp, Homo sapiens
cctgacaggtgaggtctgttcc

SEQ ID NO: 3389311 - DNA, 23 bp, Homo sapiens
cctgacaggtgaggtctgttcct

SEQ ID NO: 3389312 - DNA, 13 bp, Homo sapiens
cctgacatcacag

SEQ ID NO: 3389313 - DNA, 18 bp, Homo sapiens
cctgacatcacagcagcc

SEQ ID NO: 3389314 - DNA, 19 bp, Homo sapiens
cctgacatcacagcagcct

SEQ ID NO: 3389315 - DNA, 21 bp, Homo sapiens
cctgacatcacagcagcctcc

SEQ ID NO: 3389316 - DNA, 20 bp, Homo sapiens
cctgaccacgctttctagct

SEQ ID NO: 3389317 - DNA, 14 bp, Homo sapiens
cctgacccaggccg

SEQ ID NO: 3389318 - DNA, 12 bp, Homo sapiens
cctgacctccca

SEQ ID NO: 3389319 - DNA, 14 bp, Homo sapiens
cctgacctcccagc

SEQ ID NO: 3389320 - DNA, 16 bp, Homo sapiens
cctgacctccctctaa

SEQ ID NO: 3389321 - DNA, 17 bp, Homo sapiens
cctgacctccgcccctg

SEQ ID NO: 3389322 - DNA, 14 bp, Homo sapiens
cctgacctcttgct

SEQ ID NO: 3389323 - DNA, 24 bp, Homo sapiens
cctgacctcttgctgtctctgctc

SEQ ID NO: 3389324 - DNA, 17 bp, Homo sapiens
cctgaccttccttcctg

SEQ ID NO: 3389325 - DNA, 17 bp, Homo sapiens
cctgacgaaactggccc

SEQ ID NO: 3389326 - DNA, 13 bp, Homo sapiens
cctgacgccctgc

SEQ ID NO: 3389327 - DNA, 21 bp, Homo sapiens
cctgacggcgcccccagtgtg

SEQ ID NO: 3389328 - DNA, 16 bp, Homo sapiens
cctgactcatcatttg

SEQ ID NO: 3389329 - DNA, 21 bp, Homo sapiens
cctgactccctgtgggggtgg

SEQ ID NO: 3389330 - DNA, 16 bp, Homo sapiens
cctgactctctgtgac

SEQ ID NO: 3389331 - DNA, 12 bp, Homo sapiens
cctgacttgagt

SEQ ID NO: 3389332 - DNA, 19 bp, Homo sapiens
cctgacttggggagatgga

SEQ ID NO: 3389333 - DNA, 23 bp, Homo sapiens
cctgacttggggagatggagttc

SEQ ID NO: 3389334 - DNA, 12 bp, Homo sapiens
cctgactttctc

SEQ ID NO: 3389335 - DNA, 14 bp, Homo sapiens
cctgagaaggcgag

SEQ ID NO: 3389336 - DNA, 21 bp, Homo sapiens
cctgagacagacacacagcct

SEQ ID NO: 3389337 - DNA, 12 bp, Homo sapiens
cctgagaccaca

SEQ ID NO: 3389338 - DNA, 18 bp, Homo sapiens
cctgagaccatttaacat

SEQ ID NO: 3389339 - DNA, 20 bp, Homo sapiens
cctgagacctcgccggcctt

SEQ ID NO: 3389340 - DNA, 23 bp, Homo sapiens
cctgagactgtcggagaggctgt

SEQ ID NO: 3389341 - DNA, 12 bp, Homo sapiens
cctgagaggcag

SEQ ID NO: 3389342 - DNA, 15 bp, Homo sapiens
cctgagaggggaagc

SEQ ID NO: 3389343 - DNA, 21 bp, Homo sapiens
cctgagcaacagagtgagacc

SEQ ID NO: 3389344 - DNA, 13 bp, Homo sapiens
cctgagcaactct

SEQ ID NO: 3389345 - DNA, 20 bp, Homo sapiens
cctggcagggaggtcaggcc

SEQ ID NO: 3389346 - DNA, 22 bp, Homo sapiens
cctggcagggtcatcctgtgct

SEQ ID NO: 3389347 - DNA, 20 bp, Homo sapiens
cctggcatcatggtggatat

SEQ ID NO: 3389348 - DNA, 23 bp, Homo sapiens
cctggcatcgcaccattctgact

SEQ ID NO: 3389349 - DNA, 12 bp, Homo sapiens
cctggccacctg

SEQ ID NO: 3389350 - DNA, 13 bp, Homo sapiens
cctggccacctga

SEQ ID NO: 3389351 - DNA, 17 bp, Homo sapiens
cctggccacctgaggtg

SEQ ID NO: 3389352 - DNA, 20 bp, Homo sapiens
cctggccagatgcaccagcc

SEQ ID NO: 3389353 - DNA, 17 bp, Homo sapiens
cctggccagcccttcct

SEQ ID NO: 3389354 - DNA, 18 bp, Homo sapiens
cctggccagcccttcctc

SEQ ID NO: 3389355 - DNA, 11 bp, Homo sapiens
cctggccagga

SEQ ID NO: 3389356 - DNA, 12 bp, Homo sapiens
cctggccaggac

SEQ ID NO: 3389357 - DNA, 18 bp, Homo sapiens
cctggccaggagctcttc

SEQ ID NO: 3389358 - DNA, 22 bp, Homo sapiens
cctggccaggagctcttcaggc

SEQ ID NO: 3389359 - DNA, 22 bp, Homo sapiens
cctggccaggcagatctgtgcc

SEQ ID NO: 3389360 - DNA, 13 bp, Homo sapiens
cctggccagggca

SEQ ID NO: 3389361 - DNA, 14 bp, Homo sapiens
cctggccagggcag

SEQ ID NO: 3389362 - DNA, 16 bp, Homo sapiens
cctggccagggcaggg

SEQ ID NO: 3389363 - DNA, 18 bp, Homo sapiens
cctggccagggcagggcc

SEQ ID NO: 3389364 - DNA, 18 bp, Homo sapiens
cctggcccacgccctccc

SEQ ID NO: 3389365 - DNA, 17 bp, Homo sapiens
cctggcccatctcagcc

SEQ ID NO: 3389366 - DNA, 18 bp, Homo sapiens
cctggcccatctcagcct

SEQ ID NO: 3389367 - DNA, 23 bp, Homo sapiens
cctggcccatctcagcctcctga

SEQ ID NO: 3389368 - DNA, 22 bp, Homo sapiens
cctggcccccaacctcagggct

SEQ ID NO: 3389369 - DNA, 20 bp, Homo sapiens
cctggccccctccctggatg

SEQ ID NO: 3389370 - DNA, 18 bp, Homo sapiens
cctggcccctcaacctcc

SEQ ID NO: 3389371 - DNA, 15 bp, Homo sapiens
cctggcccctcgcct

SEQ ID NO: 3389372 - DNA, 16 bp, Homo sapiens
cctggccctgccctga

SEQ ID NO: 3389373 - DNA, 13 bp, Homo sapiens
cctggccctgcct

SEQ ID NO: 3389374 - DNA, 16 bp, Homo sapiens
cctggccctttcccct

SEQ ID NO: 3389375 - DNA, 15 bp, Homo sapiens
cctggccgccccctg

SEQ ID NO: 3389376 - DNA, 20 bp, Homo sapiens
cctggccgccccctgccccc

SEQ ID NO: 3389377 - DNA, 21 bp, Homo sapiens
cctggccgcgtttagaccaag

SEQ ID NO: 3389378 - DNA, 17 bp, Homo sapiens
cctggccgctaagttgc

SEQ ID NO: 3389379 - DNA, 13 bp, Homo sapiens
cctggcctcactg

SEQ ID NO: 3389380 - DNA, 16 bp, Homo sapiens
cctggcctcactggct

SEQ ID NO: 3389381 - DNA, 18 bp, Homo sapiens
cctggcctcactggctgg

SEQ ID NO: 3389382 - DNA, 19 bp, Homo sapiens
cctggcctcactggctggg

SEQ ID NO: 3389383 - DNA, 22 bp, Homo sapiens
cctggcctcactggctggggca

SEQ ID NO: 3389384 - DNA, 17 bp, Homo sapiens
cctggcctcagttccca

SEQ ID NO: 3389385 - DNA, 15 bp, Homo sapiens
cctggcctcccctgc

SEQ ID NO: 3389386 - DNA, 14 bp, Homo sapiens
cctggcctctgtgc

SEQ ID NO: 3389387 - DNA, 19 bp, Homo sapiens
cctggcctgaactgaggag

SEQ ID NO: 3389388 - DNA, 20 bp, Homo sapiens
cctggcctgaactgaggaga

SEQ ID NO: 3389389 - DNA, 12 bp, Homo sapiens
cctggcctgagc

SEQ ID NO: 3389390 - DNA, 19 bp, Homo sapiens
cctggcctgagctggggcc

SEQ ID NO: 3389391 - DNA, 22 bp, Homo sapiens
cctggcctgagctggggccaca

SEQ ID NO: 3389392 - DNA, 13 bp, Homo sapiens
cctggcctgctgg

SEQ ID NO: 3389393 - DNA, 14 bp, Homo sapiens
cctggcctgctggg

SEQ ID NO: 3389394 - DNA, 18 bp, Homo sapiens
cctggcctgctgggaacc

SEQ ID NO: 3389395 - DNA, 12 bp, Homo sapiens
cctggcctggca

SEQ ID NO: 3389396 - DNA, 13 bp, Homo sapiens
cctggcctggccc

SEQ ID NO: 3389397 - DNA, 14 bp, Homo sapiens
cctggcctggccct

SEQ ID NO: 3389398 - DNA, 17 bp, Homo sapiens
cctggcctggccctgcc

SEQ ID NO: 3389399 - DNA, 20 bp, Homo sapiens
cctggcctggccctgccctg

SEQ ID NO: 3389400 - DNA, 13 bp, Homo sapiens
cctggcctggctc

SEQ ID NO: 3389401 - DNA, 18 bp, Homo sapiens
cctggccttaaagaggga

SEQ ID NO: 3389402 - DNA, 15 bp, Homo sapiens
cctggcgcaggtggg

SEQ ID NO: 3389403 - DNA, 17 bp, Homo sapiens
cctggcgggatgggcca

SEQ ID NO: 3389404 - DNA, 21 bp, Homo sapiens
cctggcgggatgggccaccgc

SEQ ID NO: 3389405 - DNA, 16 bp, Homo sapiens
cctggctaagcctctg

SEQ ID NO: 3389406 - DNA, 18 bp, Homo sapiens
cctggctaagcctctgct

SEQ ID NO: 3389407 - DNA, 17 bp, Homo sapiens
cctggctcccacaggcc

SEQ ID NO: 3389408 - DNA, 22 bp, Homo sapiens
cctggctcccatgaccatactg

SEQ ID NO: 3389409 - DNA, 23 bp, Homo sapiens
cctggctccctcctccaggcctg

SEQ ID NO: 3389410 - DNA, 21 bp, Homo sapiens
cctggctccgtccaggagcct

SEQ ID NO: 3389411 - DNA, 24 bp, Homo sapiens
cctggctgactggccagttgccca

SEQ ID NO: 3389412 - DNA, 21 bp, Homo sapiens
cctggctgaggttcctctgcc

SEQ ID NO: 3389413 - DNA, 22 bp, Homo sapiens
cctggctgaggttcctctgcct

SEQ ID NO: 3389414 - DNA, 14 bp, Homo sapiens
cctggctgccaggc

SEQ ID NO: 3389415 - DNA, 15 bp, Homo sapiens
cctggctgcccatca

SEQ ID NO: 3389416 - DNA, 23 bp, Homo sapiens
cctggctgcccatcatgtggccc

SEQ ID NO: 3389417 - DNA, 13 bp, Homo sapiens
cctggctgccctg

SEQ ID NO: 3389418 - DNA, 15 bp, Homo sapiens
cctggctgccctggc

SEQ ID NO: 3389419 - DNA, 18 bp, Homo sapiens
cctggctgctgcccccac

SEQ ID NO: 3389420 - DNA, 21 bp, Homo sapiens
cctggctgctgcccccacccc

SEQ ID NO: 3389421 - DNA, 11 bp, Homo sapiens
cctggctggaa

SEQ ID NO: 3389422 - DNA, 20 bp, Homo sapiens
cctggctgggatcagagcag

SEQ ID NO: 3389423 - DNA, 21 bp, Homo sapiens
cctggctgggatcagagcagg

SEQ ID NO: 3389424 - DNA, 13 bp, Homo sapiens
cctggctgtggag

SEQ ID NO: 3389425 - DNA, 14 bp, Homo sapiens
cctggctgtggagg

SEQ ID NO: 3389426 - DNA, 19 bp, Homo sapiens
cctggctgtggaggcctga

SEQ ID NO: 3389427 - DNA, 23 bp, Homo sapiens
cctggctgtggaggcctgatgct

SEQ ID NO: 3389428 - DNA, 15 bp, Homo sapiens
cctggcttctggagc

SEQ ID NO: 3389429 - DNA, 18 bp, Homo sapiens
cctggcttgctccagggt

SEQ ID NO: 3389430 - DNA, 20 bp, Homo sapiens
cctggcttgctccagggtct

SEQ ID NO: 3389431 - DNA, 21 bp, Homo sapiens
cctgggaaaggacccacccat

SEQ ID NO: 3389432 - DNA, 20 bp, Homo sapiens
cctgggaaccactcccacca

SEQ ID NO: 3389433 - DNA, 19 bp, Homo sapiens
cctgggaagatgaggttct

SEQ ID NO: 3389434 - DNA, 23 bp, Homo sapiens
cctgggacccagctactctgtcc

SEQ ID NO: 3389435 - DNA, 14 bp, Homo sapiens
cctgggactcccag

SEQ ID NO: 3389436 - DNA, 15 bp, Homo sapiens
cctgggactcccagt

SEQ ID NO: 3389437 - DNA, 17 bp, Homo sapiens
cctgggagaacctcagg

SEQ ID NO: 3389438 - DNA, 19 bp, Homo sapiens
cctgggagaacctcaggct

SEQ ID NO: 3389439 - DNA, 20 bp, Homo sapiens
cctgggagccagtcctccac

SEQ ID NO: 3389440 - DNA, 14 bp, Homo sapiens
cctgggagcccaga

SEQ ID NO: 3389441 - DNA, 19 bp, Homo sapiens
cctgggaggaaatttgaat

SEQ ID NO: 3389442 - DNA, 12 bp, Homo sapiens
cctgggaggccc

SEQ ID NO: 3389443 - DNA, 18 bp, Homo sapiens
cctgggagggttcccctg

SEQ ID NO: 3389444 - DNA, 21 bp, Homo sapiens
cctgggagggttcccctggcc

SEQ ID NO: 3389445 - DNA, 16 bp, Homo sapiens
cctgggagtgagctgg

SEQ ID NO: 3389446 - DNA, 23 bp, Homo sapiens
cctgggatgctagccccagagat

SEQ ID NO: 3389447 - DNA, 16 bp, Homo sapiens
cctgggatgggaccag

SEQ ID NO: 3389448 - DNA, 18 bp, Homo sapiens
cctgggcagccaggctgc

SEQ ID NO: 3389449 - DNA, 22 bp, Homo sapiens
cctgggcatatccaccacctcc

SEQ ID NO: 3389450 - DNA, 20 bp, Homo sapiens
cctgggcatcttctggcttg

SEQ ID NO: 3389451 - DNA, 15 bp, Homo sapiens
cctgggccagggtct

SEQ ID NO: 3389452 - DNA, 18 bp, Homo sapiens
cctgggcccctccacgcc

SEQ ID NO: 3389453 - DNA, 14 bp, Homo sapiens
cctgggccctgggc

SEQ ID NO: 3389454 - DNA, 15 bp, Homo sapiens
cctgggccctgggct

SEQ ID NO: 3389455 - DNA, 14 bp, Homo sapiens
cctgggcctcagtt

SEQ ID NO: 3389456 - DNA, 22 bp, Homo sapiens
cctgggcctcagttcaacctgg

SEQ ID NO: 3389457 - DNA, 15 bp, Homo sapiens
cctgggcctctgccc

SEQ ID NO: 3389458 - DNA, 13 bp, Homo sapiens
cctgggcctgctt

SEQ ID NO: 3389459 - DNA, 23 bp, Homo sapiens
cctgggcctgcttttccaggatc

SEQ ID NO: 3389460 - DNA, 14 bp, Homo sapiens
cctgggcctgtccc

SEQ ID NO: 3389461 - DNA, 15 bp, Homo sapiens
cctgggcctgtcccc

SEQ ID NO: 3389462 - DNA, 19 bp, Homo sapiens
cctgggcctgtgcagcagc

SEQ ID NO: 3389463 - DNA, 20 bp, Homo sapiens
cctgggcctgtgcagcagcc

SEQ ID NO: 3389464 - DNA, 12 bp, Homo sapiens
cctgggctctgc

SEQ ID NO: 3389465 - DNA, 20 bp, Homo sapiens
cctgggctggaatcaggaat

SEQ ID NO: 3389466 - DNA, 14 bp, Homo sapiens
cctgggctggactg

SEQ ID NO: 3389467 - DNA, 18 bp, Homo sapiens
cctgggctgtctgtcacc

SEQ ID NO: 3389468 - DNA, 19 bp, Homo sapiens
cctgggctgtctgtcacca

SEQ ID NO: 3389469 - DNA, 15 bp, Homo sapiens
cctgggctgtgctgc

SEQ ID NO: 3389470 - DNA, 16 bp, Homo sapiens
cctgggctgtgctgct

SEQ ID NO: 3389471 - DNA, 18 bp, Homo sapiens
ccttactctgagcccagg

SEQ ID NO: 3389472 - DNA, 22 bp, Homo sapiens
ccttactctgagcccaggccgt

SEQ ID NO: 3389473 - DNA, 18 bp, Homo sapiens
ccttactggcttacctcc

SEQ ID NO: 3389474 - DNA, 20 bp, Homo sapiens
ccttacttccagcaagcaaa

SEQ ID NO: 3389475 - DNA, 15 bp, Homo sapiens
ccttagaaaatgtgt

SEQ ID NO: 3389476 - DNA, 19 bp, Homo sapiens
ccttagaaatgtaaactgc

SEQ ID NO: 3389477 - DNA, 21 bp, Homo sapiens
ccttagaaatgtaaactgcca

SEQ ID NO: 3389478 - DNA, 22 bp, Homo sapiens
ccttagaaatgtaaactgccat

SEQ ID NO: 3389479 - DNA, 15 bp, Homo sapiens
ccttagaacctttct

SEQ ID NO: 3389480 - DNA, 16 bp, Homo sapiens
ccttagaagagagcca

SEQ ID NO: 3389481 - DNA, 17 bp, Homo sapiens
ccttagaagagagccag

SEQ ID NO: 3389482 - DNA, 18 bp, Homo sapiens
ccttagaagtcacacagt

SEQ ID NO: 3389483 - DNA, 16 bp, Homo sapiens
ccttagaccttccata

SEQ ID NO: 3389484 - DNA, 16 bp, Homo sapiens
ccttagactcttttcc

SEQ ID NO: 3389485 - DNA, 17 bp, Homo sapiens
ccttagactcttttcct

SEQ ID NO: 3389486 - DNA, 20 bp, Homo sapiens
ccttagcagggaaacagcta

SEQ ID NO: 3389487 - DNA, 16 bp, Homo sapiens
ccttagcatgtttgct

SEQ ID NO: 3389488 - DNA, 15 bp, Homo sapiens
ccttagcctccctga

SEQ ID NO: 3389489 - DNA, 19 bp, Homo sapiens
ccttagctccctcccgcac

SEQ ID NO: 3389490 - DNA, 23 bp, Homo sapiens
ccttagctgccagtgctggtcac

SEQ ID NO: 3389491 - DNA, 22 bp, Homo sapiens
ccttagctggcattacagctgg

SEQ ID NO: 3389492 - DNA, 19 bp, Homo sapiens
ccttagctttccctgtgcc

SEQ ID NO: 3389493 - DNA, 15 bp, Homo sapiens
ccttaggatggggct

SEQ ID NO: 3389494 - DNA, 21 bp, Homo sapiens
ccttaggatggggctcccagc

SEQ ID NO: 3389495 - DNA, 22 bp, Homo sapiens
ccttaggatggggctcccagct

SEQ ID NO: 3389496 - DNA, 14 bp, Homo sapiens
ccttaggcctctga

SEQ ID NO: 3389497 - DNA, 16 bp, Homo sapiens
ccttaggcctctgaga

SEQ ID NO: 3389498 - DNA, 15 bp, Homo sapiens
ccttaggccttcctc

SEQ ID NO: 3389499 - DNA, 16 bp, Homo sapiens
ccttagggcactgggc

SEQ ID NO: 3389500 - DNA, 14 bp, Homo sapiens
ccttagtctcagtt

SEQ ID NO: 3389501 - DNA, 14 bp, Homo sapiens
ccttagtcttctca

SEQ ID NO: 3389502 - DNA, 19 bp, Homo sapiens
ccttagtgggccagggctg

SEQ ID NO: 3389503 - DNA, 16 bp, Homo sapiens
ccttataaaccaatct

SEQ ID NO: 3389504 - DNA, 17 bp, Homo sapiens
ccttatagtctaagact

SEQ ID NO: 3389505 - DNA, 12 bp, Homo sapiens
ccttatcaagtg

SEQ ID NO: 3389506 - DNA, 15 bp, Homo sapiens
ccttatcaagtgtct

SEQ ID NO: 3389507 - DNA, 16 bp, Homo sapiens
ccttatcaagtgtctt

SEQ ID NO: 3389508 - DNA, 14 bp, Homo sapiens
ccttatcagagcta

SEQ ID NO: 3389509 - DNA, 22 bp, Homo sapiens
ccttatgcccggcgccgggcac

SEQ ID NO: 3389510 - DNA, 16 bp, Homo sapiens
ccttatgtccaccact

SEQ ID NO: 3389511 - DNA, 18 bp, Homo sapiens
ccttattgctgtcctgga

SEQ ID NO: 3389512 - DNA, 17 bp, Homo sapiens
ccttattggatatttga

SEQ ID NO: 3389513 - DNA, 18 bp, Homo sapiens
ccttattggatatttgat

SEQ ID NO: 3389514 - DNA, 16 bp, Homo sapiens
ccttattgtacctctc

SEQ ID NO: 3389515 - DNA, 15 bp, Homo sapiens
ccttattttgtatta

SEQ ID NO: 3389516 - DNA, 18 bp, Homo sapiens
ccttcaagacgaggggca

SEQ ID NO: 3389517 - DNA, 21 bp, Homo sapiens
ccttcaagacgaggggcaggg

SEQ ID NO: 3389518 - DNA, 15 bp, Homo sapiens
ccttcaagtgccaaa

SEQ ID NO: 3389519 - DNA, 18 bp, Homo sapiens
ccttcacaccccaggccc

SEQ ID NO: 3389520 - DNA, 19 bp, Homo sapiens
ccttcacaggcagtgcatg

SEQ ID NO: 3389521 - DNA, 20 bp, Homo sapiens
ccttcacaggcagtgcatgt

SEQ ID NO: 3389522 - DNA, 15 bp, Homo sapiens
ccttcacagtcccag

SEQ ID NO: 3389523 - DNA, 16 bp, Homo sapiens
ccttcacagtcccagg

SEQ ID NO: 3389524 - DNA, 14 bp, Homo sapiens
ccttcacctcggag

SEQ ID NO: 3389525 - DNA, 17 bp, Homo sapiens
ccttcactctccagggt

SEQ ID NO: 3389526 - DNA, 18 bp, Homo sapiens
ccttcactctccagggta

SEQ ID NO: 3389527 - DNA, 14 bp, Homo sapiens
ccttcactgccatg

SEQ ID NO: 3389528 - DNA, 10 bp, Homo sapiens
ccttcagaca

SEQ ID NO: 3389529 - DNA, 11 bp, Homo sapiens
ccttcagacac

SEQ ID NO: 3389530 - DNA, 15 bp, Homo sapiens
ccttcagaccccagt

SEQ ID NO: 3389531 - DNA, 21 bp, Homo sapiens
ccttcagactttgcttcccat

SEQ ID NO: 3389532 - DNA, 12 bp, Homo sapiens
ccttcagagctc

SEQ ID NO: 3389533 - DNA, 11 bp, Homo sapiens
ccttcagcacg

SEQ ID NO: 3389534 - DNA, 18 bp, Homo sapiens
ccttcagcccccagcccc

SEQ ID NO: 3389535 - DNA, 19 bp, Homo sapiens
ccttcagcccccagcccct

SEQ ID NO: 3389536 - DNA, 18 bp, Homo sapiens
ccttcagggccagaagga

SEQ ID NO: 3389537 - DNA, 19 bp, Homo sapiens
ccttcagggccagaaggag

SEQ ID NO: 3389538 - DNA, 20 bp, Homo sapiens
ccttcagtaccctctcagct

SEQ ID NO: 3389539 - DNA, 24 bp, Homo sapiens
ccttcagtaccctctcagctccag

SEQ ID NO: 3389540 - DNA, 21 bp, Homo sapiens
ccttcagtcttaatactttat

SEQ ID NO: 3389541 - DNA, 15 bp, Homo sapiens
ccttcatctgaaacc

SEQ ID NO: 3389542 - DNA, 17 bp, Homo sapiens
ccttcatgacagcctcc

SEQ ID NO: 3389543 - DNA, 18 bp, Homo sapiens
ccttcatttcaggaggga

SEQ ID NO: 3389544 - DNA, 19 bp, Homo sapiens
ccttcatttcaggagggat

SEQ ID NO: 3389545 - DNA, 20 bp, Homo sapiens
ccttccaaataataaagtct

SEQ ID NO: 3389546 - DNA, 18 bp, Homo sapiens
ccttccacagttatctta

SEQ ID NO: 3389547 - DNA, 16 bp, Homo sapiens
ccttccacctccctcc

SEQ ID NO: 3389548 - DNA, 17 bp, Homo sapiens
ccttccacctcctagag

SEQ ID NO: 3389549 - DNA, 13 bp, Homo sapiens
ccttccactgcct

SEQ ID NO: 3389550 - DNA, 18 bp, Homo sapiens
ccttccactgcctctgcc

SEQ ID NO: 3389551 - DNA, 21 bp, Homo sapiens
ccttccactgcctctgcctta

SEQ ID NO: 3389552 - DNA, 21 bp, Homo sapiens
ccttccacttctaactccact

SEQ ID NO: 3389553 - DNA, 13 bp, Homo sapiens
ccttccagacata

SEQ ID NO: 3389554 - DNA, 12 bp, Homo sapiens
ccttccagctcc

SEQ ID NO: 3389555 - DNA, 13 bp, Homo sapiens
ccttccagctcct

SEQ ID NO: 3389556 - DNA, 16 bp, Homo sapiens
ccttccagctcctgta

SEQ ID NO: 3389557 - DNA, 17 bp, Homo sapiens
ccttccagctcctgtaa

SEQ ID NO: 3389558 - DNA, 13 bp, Homo sapiens
ccttccaggcccc

SEQ ID NO: 3389559 - DNA, 12 bp, Homo sapiens
ccttccagggcc

SEQ ID NO: 3389560 - DNA, 15 bp, Homo sapiens
ccttccaggtcagga

SEQ ID NO: 3389561 - DNA, 12 bp, Homo sapiens
ccttccataatt

SEQ ID NO: 3389562 - DNA, 21 bp, Homo sapiens
ccttcccaatcagcactgaaa

SEQ ID NO: 3389563 - DNA, 18 bp, Homo sapiens
ccttcccatttctctaca

SEQ ID NO: 3389564 - DNA, 11 bp, Homo sapiens
ccttccccagg

SEQ ID NO: 3389565 - DNA, 12 bp, Homo sapiens
ccttccccaggc

SEQ ID NO: 3389566 - DNA, 19 bp, Homo sapiens
ccttccccaggcccaccat

SEQ ID NO: 3389567 - DNA, 22 bp, Homo sapiens
ccttcccccaccggtccagctg

SEQ ID NO: 3389568 - DNA, 17 bp, Homo sapiens
ccttcccccagcccatc

SEQ ID NO: 3389569 - DNA, 20 bp, Homo sapiens
ccttccccctcccagggcca

SEQ ID NO: 3389570 - DNA, 19 bp, Homo sapiens
ccttccccctgtagactag

SEQ ID NO: 3389571 - DNA, 13 bp, Homo sapiens
ccttcccccttcc

SEQ ID NO: 3389572 - DNA, 14 bp, Homo sapiens
ccttcccctcccct

SEQ ID NO: 3389573 - DNA, 17 bp, Homo sapiens
ccttcccctccctggct

SEQ ID NO: 3389574 - DNA, 18 bp, Homo sapiens
ccttcccctccctggctc

SEQ ID NO: 3389575 - DNA, 19 bp, Homo sapiens
ccttcccctccctggctcc

SEQ ID NO: 3389576 - DNA, 12 bp, Homo sapiens
ccttcccctgtc

SEQ ID NO: 3389577 - DNA, 13 bp, Homo sapiens
ccttcccctgtct

SEQ ID NO: 3389578 - DNA, 17 bp, Homo sapiens
ccttccccttctgtgtc

SEQ ID NO: 3389579 - DNA, 18 bp, Homo sapiens
ccttccccttttgcctgg

SEQ ID NO: 3389580 - DNA, 19 bp, Homo sapiens
ccttccccttttgcctggc

SEQ ID NO: 3389581 - DNA, 12 bp, Homo sapiens
ccttccctagct

SEQ ID NO: 3389582 - DNA, 15 bp, Homo sapiens
ccttccctagcttta

SEQ ID NO: 3389583 - DNA, 12 bp, Homo sapiens
ccttccctccaa

SEQ ID NO: 3389584 - DNA, 12 bp, Homo sapiens
ccttccctgcac

SEQ ID NO: 3389585 - DNA, 13 bp, Homo sapiens
ccttccctgcact

SEQ ID NO: 3389586 - DNA, 13 bp, Homo sapiens
ccttccctgtccc

SEQ ID NO: 3389587 - DNA, 15 bp, Homo sapiens
ccttccctgtccctc

SEQ ID NO: 3389588 - DNA, 9 bp, Homo sapiens
ccttcctaa

SEQ ID NO: 3389589 - DNA, 21 bp, Homo sapiens
ccttcctaaatatccaaagac

SEQ ID NO: 3389590 - DNA, 20 bp, Homo sapiens
ccttcctagtgaaccacagg

SEQ ID NO: 3389591 - DNA, 21 bp, Homo sapiens
ccttcctataacttgatgcat

SEQ ID NO: 3389592 - DNA, 16 bp, Homo sapiens
ccttcctatgcccagg

SEQ ID NO: 3389593 - DNA, 19 bp, Homo sapiens
ccttcctatgcccaggtac

SEQ ID NO: 3389594 - DNA, 15 bp, Homo sapiens
ccttcctcacttcca

SEQ ID NO: 3389595 - DNA, 13 bp, Homo sapiens
ccttcctcatccc

SEQ ID NO: 3389596 - DNA, 17 bp, Homo sapiens
ccttcctccctgtctct

SEQ ID NO: 3389597 - DNA, 14 bp, Homo sapiens
ccttcctcctccac

SEQ ID NO: 3389598 - DNA, 18 bp, Homo sapiens
cctttgcagttggactct

SEQ ID NO: 3389599 - DNA, 22 bp, Homo sapiens
cctttgcagttggactctcagg

SEQ ID NO: 3389600 - DNA, 23 bp, Homo sapiens
cctttgcagttggactctcaggg

SEQ ID NO: 3389601 - DNA, 21 bp, Homo sapiens
cctttgcatagctctccttcc

SEQ ID NO: 3389602 - DNA, 16 bp, Homo sapiens
cctttgcccagaaaga

SEQ ID NO: 3389603 - DNA, 15 bp, Homo sapiens
cctttgccctgtcac

SEQ ID NO: 3389604 - DNA, 16 bp, Homo sapiens
cctttgcgcctgtgac

SEQ ID NO: 3389605 - DNA, 17 bp, Homo sapiens
cctttgctatgtaaggg

SEQ ID NO: 3389606 - DNA, 17 bp, Homo sapiens
cctttgctggaagaaac

SEQ ID NO: 3389607 - DNA, 22 bp, Homo sapiens
cctttgctgtgaggctgtcctg

SEQ ID NO: 3389608 - DNA, 15 bp, Homo sapiens
cctttggagatgctg

SEQ ID NO: 3389609 - DNA, 15 bp, Homo sapiens
cctttggccattcca

SEQ ID NO: 3389610 - DNA, 12 bp, Homo sapiens
cctttggctctg

SEQ ID NO: 3389611 - DNA, 19 bp, Homo sapiens
cctttgggttccatcttgc

SEQ ID NO: 3389612 - DNA, 20 bp, Homo sapiens
cctttgggttccatcttgct

SEQ ID NO: 3389613 - DNA, 14 bp, Homo sapiens
cctttggtgcctca

SEQ ID NO: 3389614 - DNA, 15 bp, Homo sapiens
cctttggttctggcc

SEQ ID NO: 3389615 - DNA, 20 bp, Homo sapiens
cctttggttctggccagaat

SEQ ID NO: 3389616 - DNA, 16 bp, Homo sapiens
cctttggtttttttct

SEQ ID NO: 3389617 - DNA, 20 bp, Homo sapiens
cctttgtaagacatttgtat

SEQ ID NO: 3389618 - DNA, 22 bp, Homo sapiens
cctttgtaagacatttgtatat

SEQ ID NO: 3389619 - DNA, 18 bp, Homo sapiens
cctttgtgagcctatgat

SEQ ID NO: 3389620 - DNA, 14 bp, Homo sapiens
cctttgtgtttata

SEQ ID NO: 3389621 - DNA, 13 bp, Homo sapiens
cctttgtgtttct

SEQ ID NO: 3389622 - DNA, 15 bp, Homo sapiens
cctttgttctgagca

SEQ ID NO: 3389623 - DNA, 17 bp, Homo sapiens
ccttttaagacattttc

SEQ ID NO: 3389624 - DNA, 18 bp, Homo sapiens
ccttttagaaacctcatt

SEQ ID NO: 3389625 - DNA, 11 bp, Homo sapiens
ccttttatagc

SEQ ID NO: 3389626 - DNA, 22 bp, Homo sapiens
ccttttataggtgagaaaaaaa

SEQ ID NO: 3389627 - DNA, 15 bp, Homo sapiens
ccttttatctgcaga

SEQ ID NO: 3389628 - DNA, 17 bp, Homo sapiens
ccttttatctggtgcct

SEQ ID NO: 3389629 - DNA, 18 bp, Homo sapiens
ccttttcagctgagccct

SEQ ID NO: 3389630 - DNA, 22 bp, Homo sapiens
ccttttcagctgagccctgggg

SEQ ID NO: 3389631 - DNA, 14 bp, Homo sapiens
ccttttcaggaaaa

SEQ ID NO: 3389632 - DNA, 17 bp, Homo sapiens
ccttttcccctacagaa

SEQ ID NO: 3389633 - DNA, 19 bp, Homo sapiens
ccttttcccctacagaatt

SEQ ID NO: 3389634 - DNA, 19 bp, Homo sapiens
ccttttccctgcttccagg

SEQ ID NO: 3389635 - DNA, 14 bp, Homo sapiens
ccttttctgttcta

SEQ ID NO: 3389636 - DNA, 12 bp, Homo sapiens
ccttttctgttt

SEQ ID NO: 3389637 - DNA, 16 bp, Homo sapiens
ccttttctgtttagga

SEQ ID NO: 3389638 - DNA, 11 bp, Homo sapiens
ccttttcttca

SEQ ID NO: 3389639 - DNA, 15 bp, Homo sapiens
ccttttcttttgtta

SEQ ID NO: 3389640 - DNA, 17 bp, Homo sapiens
ccttttcttttgttact

SEQ ID NO: 3389641 - DNA, 19 bp, Homo sapiens
ccttttgcacccctcccat

SEQ ID NO: 3389642 - DNA, 17 bp, Homo sapiens
ccttttgcataagatta

SEQ ID NO: 3389643 - DNA, 16 bp, Homo sapiens
ccttttgctgcgcacc

SEQ ID NO: 3389644 - DNA, 18 bp, Homo sapiens
ccttttggaacatttctt

SEQ ID NO: 3389645 - DNA, 21 bp, Homo sapiens
ccttttggtgaaagctgagaa

SEQ ID NO: 3389646 - DNA, 13 bp, Homo sapiens
ccttttggtgtgt

SEQ ID NO: 3389647 - DNA, 23 bp, Homo sapiens
ccttttgtatacatcctgggtaa

SEQ ID NO: 3389648 - DNA, 17 bp, Homo sapiens
ccttttgtatcttcctt

SEQ ID NO: 3389649 - DNA, 21 bp, Homo sapiens
ccttttgtatcttcctttctt

SEQ ID NO: 3389650 - DNA, 18 bp, Homo sapiens
ccttttgtccccagggcc

SEQ ID NO: 3389651 - DNA, 16 bp, Homo sapiens
cctttttaaatgtgaa

SEQ ID NO: 3389652 - DNA, 19 bp, Homo sapiens
cctttttaatatgcttaaa

SEQ ID NO: 3389653 - DNA, 17 bp, Homo sapiens
cctttttatttgcatgt

SEQ ID NO: 3389654 - DNA, 17 bp, Homo sapiens
cctttttccatcatttt

SEQ ID NO: 3389655 - DNA, 17 bp, Homo sapiens
cctttttcccaataaat

SEQ ID NO: 3389656 - DNA, 14 bp, Homo sapiens
cctttttctccagc

SEQ ID NO: 3389657 - DNA, 16 bp, Homo sapiens
cctttttctccagctg

SEQ ID NO: 3389658 - DNA, 16 bp, Homo sapiens
cctttttctttataaa

SEQ ID NO: 3389659 - DNA, 17 bp, Homo sapiens
cctttttgtaaatactg

SEQ ID NO: 3389660 - DNA, 18 bp, Homo sapiens
cctttttgtatgtgaaca

SEQ ID NO: 3389661 - DNA, 19 bp, Homo sapiens
ccttttttaagatttttct

SEQ ID NO: 3389662 - DNA, 17 bp, Homo sapiens
ccttttttcaatatgca

SEQ ID NO: 3389663 - DNA, 24 bp, Homo sapiens
ccttttttcaatatgcaagcagct

SEQ ID NO: 3389664 - DNA, 14 bp, Homo sapiens
ccttttttcttttt

SEQ ID NO: 3389665 - DNA, 10 bp, Homo sapiens
ccttttttgt

SEQ ID NO: 3389666 - DNA, 14 bp, Homo sapiens
ccttttttgtagtt

SEQ ID NO: 3389667 - DNA, 19 bp, Homo sapiens
ccttttttgtctatgaagt

SEQ ID NO: 3389668 - DNA, 15 bp, Homo sapiens
cctttttttttgaaa

SEQ ID NO: 3389669 - DNA, 18 bp, Homo sapiens
cgaaaattcatttcacat

SEQ ID NO: 3389670 - DNA, 15 bp, Homo sapiens
cgaaacttgttattg

SEQ ID NO: 3389671 - DNA, 23 bp, Homo sapiens
cgaaacttgttattgtgaatgat

SEQ ID NO: 3389672 - DNA, 23 bp, Homo sapiens
cgaaaggcgagtccaggagctca

SEQ ID NO: 3389673 - DNA, 11 bp, Homo sapiens
cgaaataacaa

SEQ ID NO: 3389674 - DNA, 16 bp, Homo sapiens
cgaaataacaatgtta

SEQ ID NO: 3389675 - DNA, 20 bp, Homo sapiens
cgaaataacaatgttaagga

SEQ ID NO: 3389676 - DNA, 16 bp, Homo sapiens
cgaaatctaaatttct

SEQ ID NO: 3389677 - DNA, 22 bp, Homo sapiens
cgaaatgttattttttaattat

SEQ ID NO: 3389678 - DNA, 15 bp, Homo sapiens
cgaaccaaggcagcc

SEQ ID NO: 3389679 - DNA, 17 bp, Homo sapiens
cgaaccaaggcagcctc

SEQ ID NO: 3389680 - DNA, 23 bp, Homo sapiens
cgaaccgtgagcaggaaggcctg

SEQ ID NO: 3389681 - DNA, 14 bp, Homo sapiens
cgaactggctgcaa

SEQ ID NO: 3389682 - DNA, 14 bp, Homo sapiens
cgaacttcacaact

SEQ ID NO: 3389683 - DNA, 18 bp, Homo sapiens
cgaagaaaaaaaataaca

SEQ ID NO: 3389684 - DNA, 19 bp, Homo sapiens
cgaagaaaaaaaataacac

SEQ ID NO: 3389685 - DNA, 18 bp, Homo sapiens
cgaagaccctcttgccca

SEQ ID NO: 3389686 - DNA, 20 bp, Homo sapiens
cgaagaccctcttgcccatc

SEQ ID NO: 3389687 - DNA, 22 bp, Homo sapiens
cgaagagggaatggatggggag

SEQ ID NO: 3389688 - DNA, 12 bp, Homo sapiens
cgaagctctggc

SEQ ID NO: 3389689 - DNA, 16 bp, Homo sapiens
cgaagctgcaggggca

SEQ ID NO: 3389690 - DNA, 17 bp, Homo sapiens
cgaagctgcaggggcag

SEQ ID NO: 3389691 - DNA, 20 bp, Homo sapiens
cgaagctgcaggggcaggag

SEQ ID NO: 3389692 - DNA, 17 bp, Homo sapiens
cgaaggtgcctcagact

SEQ ID NO: 3389693 - DNA, 18 bp, Homo sapiens
cgaagtctcatgggaagc

SEQ ID NO: 3389694 - DNA, 21 bp, Homo sapiens
cgaagtctcatgggaagcagg

SEQ ID NO: 3389695 - DNA, 16 bp, Homo sapiens
cgaagtctgctgctgt

SEQ ID NO: 3389696 - DNA, 16 bp, Homo sapiens
cgaatagctgggacta

SEQ ID NO: 3389697 - DNA, 14 bp, Homo sapiens
cgaatcccccaggg

SEQ ID NO: 3389698 - DNA, 12 bp, Homo sapiens
cgaatctctgtg

SEQ ID NO: 3389699 - DNA, 21 bp, Homo sapiens
cgacaaagctgctaaatctcc

SEQ ID NO: 3389700 - DNA, 18 bp, Homo sapiens
cgacactcaccatgaagc

SEQ ID NO: 3389701 - DNA, 17 bp, Homo sapiens
cgacactctctggaagc

SEQ ID NO: 3389702 - DNA, 13 bp, Homo sapiens
cgacactgctgca

SEQ ID NO: 3389703 - DNA, 16 bp, Homo sapiens
cgacactgctgcacca

SEQ ID NO: 3389704 - DNA, 16 bp, Homo sapiens
cgacagagcgagactt

SEQ ID NO: 3389705 - DNA, 19 bp, Homo sapiens
cgacagcgcccctgctgtc

SEQ ID NO: 3389706 - DNA, 14 bp, Homo sapiens
cgacaggccctggc

SEQ ID NO: 3389707 - DNA, 17 bp, Homo sapiens
cgacaggcgagagagga

SEQ ID NO: 3389708 - DNA, 21 bp, Homo sapiens
cgacaggcgagagaggagcca

SEQ ID NO: 3389709 - DNA, 23 bp, Homo sapiens
cgacaggcgagagaggagccaga

SEQ ID NO: 3389710 - DNA, 14 bp, Homo sapiens
cgacagggcctgga

SEQ ID NO: 3389711 - DNA, 16 bp, Homo sapiens
cgacagtgccatcccc

SEQ ID NO: 3389712 - DNA, 19 bp, Homo sapiens
cgacatacatgctactttt

SEQ ID NO: 3389713 - DNA, 20 bp, Homo sapiens
cgacatccgtcattgctgct

SEQ ID NO: 3389714 - DNA, 22 bp, Homo sapiens
cgacatccgtcattgctgctgc

SEQ ID NO: 3389715 - DNA, 12 bp, Homo sapiens
cgaccagcccct

SEQ ID NO: 3389716 - DNA, 16 bp, Homo sapiens
cgaccagccccttcct

SEQ ID NO: 3389717 - DNA, 13 bp, Homo sapiens
cgaccatctgatt

SEQ ID NO: 3389718 - DNA, 15 bp, Homo sapiens
cgaccctcatggccc

SEQ ID NO: 3389719 - DNA, 21 bp, Homo sapiens
cgaccctcatggcccccaggg

SEQ ID NO: 3389720 - DNA, 15 bp, Homo sapiens
cgaccctctgggaac

SEQ ID NO: 3389721 - DNA, 23 bp, Homo sapiens
cgaccctctgggaacctcccaga

SEQ ID NO: 3389722 - DNA, 22 bp, Homo sapiens
cgacggtgggcatttgtgaggc

SEQ ID NO: 3389723 - DNA, 11 bp, Homo sapiens
cgactcaggat

SEQ ID NO: 3389724 - DNA, 13 bp, Homo sapiens
cgcctgccctccc

SEQ ID NO: 3389725 - DNA, 11 bp, Homo sapiens
cgcctggagag

SEQ ID NO: 3389726 - DNA, 16 bp, Homo sapiens
cgcctggagagcgagg

SEQ ID NO: 3389727 - DNA, 23 bp, Homo sapiens
cgcctggatttctggttctgatg

SEQ ID NO: 3389728 - DNA, 22 bp, Homo sapiens
cgcctggcacatttcagggaga

SEQ ID NO: 3389729 - DNA, 16 bp, Homo sapiens
cgcctggccaggagca

SEQ ID NO: 3389730 - DNA, 17 bp, Homo sapiens
cgcctggccagggcagg

SEQ ID NO: 3389731 - DNA, 23 bp, Homo sapiens
cgcctggccagggcagggccacc

SEQ ID NO: 3389732 - DNA, 17 bp, Homo sapiens
cgcctgtaatcccagca

SEQ ID NO: 3389733 - DNA, 13 bp, Homo sapiens
cgcctgtgcacac

SEQ ID NO: 3389734 - DNA, 14 bp, Homo sapiens
cgcctgtgcacaca

SEQ ID NO: 3389735 - DNA, 15 bp, Homo sapiens
cgcctgtgcacacac

SEQ ID NO: 3389736 - DNA, 18 bp, Homo sapiens
cgcctgtggagctcagcc

SEQ ID NO: 3389737 - DNA, 19 bp, Homo sapiens
cgcctgtggagctcagccc

SEQ ID NO: 3389738 - DNA, 22 bp, Homo sapiens
cgccttcactccggtgtgcctg

SEQ ID NO: 3389739 - DNA, 22 bp, Homo sapiens
cgccttccgccccttcccttcc

SEQ ID NO: 3389740 - DNA, 15 bp, Homo sapiens
cgccttcctcctcca

SEQ ID NO: 3389741 - DNA, 13 bp, Homo sapiens
cgcctttgtcttg

SEQ ID NO: 3389742 - DNA, 19 bp, Homo sapiens
cgcctttgtcttgtacttc

SEQ ID NO: 3389743 - DNA, 23 bp, Homo sapiens
cgcgccactacactccagcctga

SEQ ID NO: 3389744 - DNA, 22 bp, Homo sapiens
cgcgccctccaccccggccccc

SEQ ID NO: 3389745 - DNA, 20 bp, Homo sapiens
cgcgcctttccgcggagccc

SEQ ID NO: 3389746 - DNA, 13 bp, Homo sapiens
cgcgcgcacacac

SEQ ID NO: 3389747 - DNA, 14 bp, Homo sapiens
cgcgctcgcccagc

SEQ ID NO: 3389748 - DNA, 12 bp, Homo sapiens
cgcgctgccccc

SEQ ID NO: 3389749 - DNA, 15 bp, Homo sapiens
cgcgctgggggagcc

SEQ ID NO: 3389750 - DNA, 19 bp, Homo sapiens
cgcggccagcgtcccaggg

SEQ ID NO: 3389751 - DNA, 21 bp, Homo sapiens
cgcggccagcgtcccagggta

SEQ ID NO: 3389752 - DNA, 14 bp, Homo sapiens
cgcgggcagcgggc

SEQ ID NO: 3389753 - DNA, 17 bp, Homo sapiens
cgcgggcagcgggccag

SEQ ID NO: 3389754 - DNA, 19 bp, Homo sapiens
cgcgggcagcgggccaggc

SEQ ID NO: 3389755 - DNA, 22 bp, Homo sapiens
cgcgggcagcgggccaggcccg

SEQ ID NO: 3389756 - DNA, 16 bp, Homo sapiens
cgcgggtgtgcggtct

SEQ ID NO: 3389757 - DNA, 13 bp, Homo sapiens
cgcggtgctctgg

SEQ ID NO: 3389758 - DNA, 16 bp, Homo sapiens
cgcggtgctctggcgg

SEQ ID NO: 3389759 - DNA, 13 bp, Homo sapiens
cgcggtggctcac

SEQ ID NO: 3389760 - DNA, 21 bp, Homo sapiens
cgcgtctcctgtttttctggg

SEQ ID NO: 3389761 - DNA, 19 bp, Homo sapiens
cgcgtgcacgtggagagct

SEQ ID NO: 3389762 - DNA, 15 bp, Homo sapiens
cgctaaagagccctt

SEQ ID NO: 3389763 - DNA, 20 bp, Homo sapiens
cgctaagctggctctgtttg

SEQ ID NO: 3389764 - DNA, 12 bp, Homo sapiens
cgctacctccct

SEQ ID NO: 3389765 - DNA, 15 bp, Homo sapiens
cgctacctccctccc

SEQ ID NO: 3389766 - DNA, 15 bp, Homo sapiens
cgctagagcagccca

SEQ ID NO: 3389767 - DNA, 14 bp, Homo sapiens
cgctattacaaata

SEQ ID NO: 3389768 - DNA, 17 bp, Homo sapiens
cgctcacctagagccag

SEQ ID NO: 3389769 - DNA, 21 bp, Homo sapiens
cgctcagacggcggccaggca

SEQ ID NO: 3389770 - DNA, 18 bp, Homo sapiens
cgctcagcatgcatcctt

SEQ ID NO: 3389771 - DNA, 12 bp, Homo sapiens
cgctcagccctc

SEQ ID NO: 3389772 - DNA, 16 bp, Homo sapiens
cgctcagccctccctg

SEQ ID NO: 3389773 - DNA, 13 bp, Homo sapiens
cgctcaggaccca

SEQ ID NO: 3389774 - DNA, 20 bp, Homo sapiens
cgctcaggacccaggccctc

SEQ ID NO: 3389775 - DNA, 22 bp, Homo sapiens
cgctcaggacccaggccctcca

SEQ ID NO: 3389776 - DNA, 21 bp, Homo sapiens
cgctcagggccatgctgaggc

SEQ ID NO: 3389777 - DNA, 22 bp, Homo sapiens
cgctcccaagggtctcactgct

SEQ ID NO: 3389778 - DNA, 15 bp, Homo sapiens
cgctcccaccgcccc

SEQ ID NO: 3389779 - DNA, 17 bp, Homo sapiens
cgctcccaccgccccca

SEQ ID NO: 3389780 - DNA, 13 bp, Homo sapiens
cgctcccagcctg

SEQ ID NO: 3389781 - DNA, 20 bp, Homo sapiens
cgctcccaggttcccccagc

SEQ ID NO: 3389782 - DNA, 24 bp, Homo sapiens
cgctcccaggttcccccagcaagc

SEQ ID NO: 3389783 - DNA, 19 bp, Homo sapiens
cgctcccccgcagtcccca

SEQ ID NO: 3389784 - DNA, 20 bp, Homo sapiens
cgctcccccgcagtccccag

SEQ ID NO: 3389785 - DNA, 22 bp, Homo sapiens
cgctcccccgcagtccccagcc

SEQ ID NO: 3389786 - DNA, 16 bp, Homo sapiens
cgctcccgctcccagg

SEQ ID NO: 3389787 - DNA, 14 bp, Homo sapiens
cgctcctcctgtgt

SEQ ID NO: 3389788 - DNA, 15 bp, Homo sapiens
cgctcgcccagcagg

SEQ ID NO: 3389789 - DNA, 21 bp, Homo sapiens
cgctcgccccaccggcgcgct

SEQ ID NO: 3389790 - DNA, 14 bp, Homo sapiens
cgctcggaggcccc

SEQ ID NO: 3389791 - DNA, 16 bp, Homo sapiens
cgctcggaggccccaa

SEQ ID NO: 3389792 - DNA, 17 bp, Homo sapiens
cgctcggcaggaaggag

SEQ ID NO: 3389793 - DNA, 21 bp, Homo sapiens
cgctctgcctcaccgcttccc

SEQ ID NO: 3389794 - DNA, 13 bp, Homo sapiens
cgctgagctgagt

SEQ ID NO: 3389795 - DNA, 18 bp, Homo sapiens
cgctgagctgagtggcca

SEQ ID NO: 3389796 - DNA, 18 bp, Homo sapiens
cgctgaggggtctcggat

SEQ ID NO: 3389797 - DNA, 20 bp, Homo sapiens
cgctgagtgggagaaggcag

SEQ ID NO: 3389798 - DNA, 17 bp, Homo sapiens
cgctgcagggctcccat

SEQ ID NO: 3389799 - DNA, 22 bp, Homo sapiens
cgctgcaggtacttcctcctga

SEQ ID NO: 3389800 - DNA, 17 bp, Homo sapiens
cgctgccaccacgtctg

SEQ ID NO: 3389801 - DNA, 18 bp, Homo sapiens
cgctgccaccacgtctgc

SEQ ID NO: 3389802 - DNA, 20 bp, Homo sapiens
cgctgccaccacgtctgcca

SEQ ID NO: 3389803 - DNA, 22 bp, Homo sapiens
cgctgccaccacgtctgccagg

SEQ ID NO: 3389804 - DNA, 14 bp, Homo sapiens
cgctgccagccttg

SEQ ID NO: 3389805 - DNA, 22 bp, Homo sapiens
cgctgccatcaccgctgggtgg

SEQ ID NO: 3389806 - DNA, 15 bp, Homo sapiens
cgctgccgctgcacc

SEQ ID NO: 3389807 - DNA, 16 bp, Homo sapiens
cgctgccgctgcacca

SEQ ID NO: 3389808 - DNA, 18 bp, Homo sapiens
cgctgccgctgccgctgc

SEQ ID NO: 3389809 - DNA, 22 bp, Homo sapiens
cgctgccttttgtttctagaat

SEQ ID NO: 3389810 - DNA, 16 bp, Homo sapiens
cgctgctctagctggc

SEQ ID NO: 3389811 - DNA, 13 bp, Homo sapiens
cgctgcttccagg

SEQ ID NO: 3389812 - DNA, 19 bp, Homo sapiens
cgctggaccttgaactggg

SEQ ID NO: 3389813 - DNA, 14 bp, Homo sapiens
cgctggagagtcaa

SEQ ID NO: 3389814 - DNA, 17 bp, Homo sapiens
cgctggagtgcagtgag

SEQ ID NO: 3389815 - DNA, 18 bp, Homo sapiens
cgctggagtgcagtgagc

SEQ ID NO: 3389816 - DNA, 10 bp, Homo sapiens
cgctggccca

SEQ ID NO: 3389817 - DNA, 14 bp, Homo sapiens
cgctggcccagccg

SEQ ID NO: 3389818 - DNA, 16 bp, Homo sapiens
cgctggcccagccggc

SEQ ID NO: 3389819 - DNA, 20 bp, Homo sapiens
cgctggctttgggaaagccc

SEQ ID NO: 3389820 - DNA, 11 bp, Homo sapiens
cgctgggaagg

SEQ ID NO: 3389821 - DNA, 22 bp, Homo sapiens
cgctggggctctctgagactct

SEQ ID NO: 3389822 - DNA, 19 bp, Homo sapiens
cgctgggtggtaccctctg

SEQ ID NO: 3389823 - DNA, 22 bp, Homo sapiens
cgctgggtggtaccctctggag

SEQ ID NO: 3389824 - DNA, 18 bp, Homo sapiens
cgctgtaccctttaagat

SEQ ID NO: 3389825 - DNA, 13 bp, Homo sapiens
cgctgtcactggc

SEQ ID NO: 3389826 - DNA, 18 bp, Homo sapiens
cgctgtcactggctggct

SEQ ID NO: 3389827 - DNA, 16 bp, Homo sapiens
cgctgtcctctcgagc

SEQ ID NO: 3389828 - DNA, 19 bp, Homo sapiens
cgctgtcctctcgagccca

SEQ ID NO: 3389829 - DNA, 17 bp, Homo sapiens
cgctgtcgccccaggcc

SEQ ID NO: 3389830 - DNA, 16 bp, Homo sapiens
cgctgtgagcccctgg

SEQ ID NO: 3389831 - DNA, 20 bp, Homo sapiens
cgcttatcaactaatgattt

SEQ ID NO: 3389832 - DNA, 15 bp, Homo sapiens
cgcttcacccctgca

SEQ ID NO: 3389833 - DNA, 18 bp, Homo sapiens
cgcttcccccatagccac

SEQ ID NO: 3389834 - DNA, 16 bp, Homo sapiens
cgcttcttgcctctgt

SEQ ID NO: 3389835 - DNA, 19 bp, Homo sapiens
cgcttcttgcctctgtgct

SEQ ID NO: 3389836 - DNA, 15 bp, Homo sapiens
cgcttgagcccagga

SEQ ID NO: 3389837 - DNA, 17 bp, Homo sapiens
cgcttgagcccaggagt

SEQ ID NO: 3389838 - DNA, 18 bp, Homo sapiens
cgcttgtaaataccagga

SEQ ID NO: 3389839 - DNA, 20 bp, Homo sapiens
cgcttgtagaactcactctg

SEQ ID NO: 3389840 - DNA, 16 bp, Homo sapiens
cgctttctacccagcg

SEQ ID NO: 3389841 - DNA, 21 bp, Homo sapiens
cgctttgctgctaccgccctg

SEQ ID NO: 3389842 - DNA, 12 bp, Homo sapiens
cggaaagaagag

SEQ ID NO: 3389843 - DNA, 18 bp, Homo sapiens
cggaaagaagagcgagag

SEQ ID NO: 3389844 - DNA, 13 bp, Homo sapiens
cggaacagcagat

SEQ ID NO: 3389845 - DNA, 14 bp, Homo sapiens
cggaaccacagggc

SEQ ID NO: 3389846 - DNA, 17 bp, Homo sapiens
cggaaccacagggccag

SEQ ID NO: 3389847 - DNA, 19 bp, Homo sapiens
cggaacccaagcttagaac

SEQ ID NO: 3389848 - DNA, 14 bp, Homo sapiens
cggaagcagtgcct

SEQ ID NO: 3389849 - DNA, 20 bp, Homo sapiens
cggaagcagtgccttccata

SEQ ID NO: 3389850 - DNA, 19 bp, Homo sapiens
cggggcgatgctccctcag

SEQ ID NO: 3389851 - DNA, 13 bp, Homo sapiens
cggggctccaggc

SEQ ID NO: 3389852 - DNA, 19 bp, Homo sapiens
cggggctccaggctggctt

SEQ ID NO: 3389853 - DNA, 16 bp, Homo sapiens
cggggctcgaggctgg

SEQ ID NO: 3389854 - DNA, 16 bp, Homo sapiens
cggggctggcaagcag

SEQ ID NO: 3389855 - DNA, 15 bp, Homo sapiens
cgggggctggcctag

SEQ ID NO: 3389856 - DNA, 18 bp, Homo sapiens
cgggggctggcctaggag

SEQ ID NO: 3389857 - DNA, 18 bp, Homo sapiens
cggggggccgggggaggg

SEQ ID NO: 3389858 - DNA, 20 bp, Homo sapiens
cggggggggcgcctggagag

SEQ ID NO: 3389859 - DNA, 22 bp, Homo sapiens
cggggggggcgcctggagagcg

SEQ ID NO: 3389860 - DNA, 21 bp, Homo sapiens
cgggggtggagtgagactgac

SEQ ID NO: 3389861 - DNA, 14 bp, Homo sapiens
cggggtatgaagag

SEQ ID NO: 3389862 - DNA, 19 bp, Homo sapiens
cggggtcctgtggcaggca

SEQ ID NO: 3389863 - DNA, 13 bp, Homo sapiens
cggggtctgtgct

SEQ ID NO: 3389864 - DNA, 20 bp, Homo sapiens
cggggtctgtgctgtgcctg

SEQ ID NO: 3389865 - DNA, 23 bp, Homo sapiens
cggggtctgtgctgtgcctgcta

SEQ ID NO: 3389866 - DNA, 22 bp, Homo sapiens
cggggtgagtccattctcccag

SEQ ID NO: 3389867 - DNA, 18 bp, Homo sapiens
cggggtggtgggaaccat

SEQ ID NO: 3389868 - DNA, 18 bp, Homo sapiens
cgggtctgccatgctctg

SEQ ID NO: 3389869 - DNA, 23 bp, Homo sapiens
cgggtgcatttgagagaagccac

SEQ ID NO: 3389870 - DNA, 21 bp, Homo sapiens
cgggtgcctgctgcggcagac

SEQ ID NO: 3389871 - DNA, 19 bp, Homo sapiens
cgggtggatcacctgaggt

SEQ ID NO: 3389872 - DNA, 13 bp, Homo sapiens
cgggtgggcctgg

SEQ ID NO: 3389873 - DNA, 14 bp, Homo sapiens
cgggtgggcctggc

SEQ ID NO: 3389874 - DNA, 15 bp, Homo sapiens
cgggtgggcctggcc

SEQ ID NO: 3389875 - DNA, 17 bp, Homo sapiens
cgggtgggcctggcctg

SEQ ID NO: 3389876 - DNA, 19 bp, Homo sapiens
cgggtgggcctggcctgag

SEQ ID NO: 3389877 - DNA, 15 bp, Homo sapiens
cgggtgtggcctcag

SEQ ID NO: 3389878 - DNA, 18 bp, Homo sapiens
cgggtgtggcctcagccc

SEQ ID NO: 3389879 - DNA, 16 bp, Homo sapiens
cgggttgtgtgtctgt

SEQ ID NO: 3389880 - DNA, 17 bp, Homo sapiens
cgggttgtgtgtctgtt

SEQ ID NO: 3389881 - DNA, 21 bp, Homo sapiens
cgggttgttttgggtgaatct

SEQ ID NO: 3389882 - DNA, 17 bp, Homo sapiens
cggtagggaggcagcct

SEQ ID NO: 3389883 - DNA, 18 bp, Homo sapiens
cggtaggttcagccaagg

SEQ ID NO: 3389884 - DNA, 21 bp, Homo sapiens
cggtcaggctgggcagcccca

SEQ ID NO: 3389885 - DNA, 20 bp, Homo sapiens
cggtccacccaggagccccg

SEQ ID NO: 3389886 - DNA, 13 bp, Homo sapiens
cggtccagctggc

SEQ ID NO: 3389887 - DNA, 14 bp, Homo sapiens
cggtccccatcccc

SEQ ID NO: 3389888 - DNA, 17 bp, Homo sapiens
cggtcccctgcctggaa

SEQ ID NO: 3389889 - DNA, 18 bp, Homo sapiens
cggtcccctgcctggaac

SEQ ID NO: 3389890 - DNA, 13 bp, Homo sapiens
cggtccctgtccc

SEQ ID NO: 3389891 - DNA, 21 bp, Homo sapiens
cggtgagaggggaacagactg

SEQ ID NO: 3389892 - DNA, 14 bp, Homo sapiens
cggtgccatgtctg

SEQ ID NO: 3389893 - DNA, 20 bp, Homo sapiens
cggtgcccaagccagaggct

SEQ ID NO: 3389894 - DNA, 17 bp, Homo sapiens
cggtgcgtggctgtggc

SEQ ID NO: 3389895 - DNA, 24 bp, Homo sapiens
cggtgcgtggctgtggcacagact

SEQ ID NO: 3389896 - DNA, 17 bp, Homo sapiens
cggtgctagcttgacac

SEQ ID NO: 3389897 - DNA, 11 bp, Homo sapiens
cggtgctctgg

SEQ ID NO: 3389898 - DNA, 15 bp, Homo sapiens
cggtgctctggcggc

SEQ ID NO: 3389899 - DNA, 13 bp, Homo sapiens
cggtgctgcagga

SEQ ID NO: 3389900 - DNA, 14 bp, Homo sapiens
cggtgctgcaggag

SEQ ID NO: 3389901 - DNA, 14 bp, Homo sapiens
cggtgcttgtgtca

SEQ ID NO: 3389902 - DNA, 20 bp, Homo sapiens
cggtgcttgtgtcactagca

SEQ ID NO: 3389903 - DNA, 12 bp, Homo sapiens
cggtggcggcag

SEQ ID NO: 3389904 - DNA, 15 bp, Homo sapiens
cggtggctgcacaga

SEQ ID NO: 3389905 - DNA, 12 bp, Homo sapiens
cggtggctgggc

SEQ ID NO: 3389906 - DNA, 16 bp, Homo sapiens
cggtggtttgccatgt

SEQ ID NO: 3389907 - DNA, 21 bp, Homo sapiens
cggtggtttgccatgtcgctt

SEQ ID NO: 3389908 - DNA, 13 bp, Homo sapiens
cggttcctggtga

SEQ ID NO: 3389909 - DNA, 17 bp, Homo sapiens
cggttcctggtgactcc

SEQ ID NO: 3389910 - DNA, 19 bp, Homo sapiens
cggttcctggtgactcctg

SEQ ID NO: 3389911 - DNA, 20 bp, Homo sapiens
cggttctgcgccacttcctt

SEQ ID NO: 3389912 - DNA, 13 bp, Homo sapiens
cggtttcttttta

SEQ ID NO: 3389913 - DNA, 18 bp, Homo sapiens
cggttttttattattgtg

SEQ ID NO: 3389914 - DNA, 19 bp, Homo sapiens
cgtaaacttcagtgtccca

SEQ ID NO: 3389915 - DNA, 12 bp, Homo sapiens
cgtaaagatttg

SEQ ID NO: 3389916 - DNA, 23 bp, Homo sapiens
cgtaagcagtatattagtattat

SEQ ID NO: 3389917 - DNA, 17 bp, Homo sapiens
cgtaataattattatta

SEQ ID NO: 3389918 - DNA, 13 bp, Homo sapiens
cgtaatgcttaga

SEQ ID NO: 3389919 - DNA, 15 bp, Homo sapiens
cgtacataataagtt

SEQ ID NO: 3389920 - DNA, 20 bp, Homo sapiens
cgtacatctgcaatatgaat

SEQ ID NO: 3389921 - DNA, 14 bp, Homo sapiens
cgtaccccaccctc

SEQ ID NO: 3389922 - DNA, 21 bp, Homo sapiens
cgtacctcttcccatgactgc

SEQ ID NO: 3389923 - DNA, 19 bp, Homo sapiens
cgtagaagtttttgtactg

SEQ ID NO: 3389924 - DNA, 20 bp, Homo sapiens
cgtagcgtgcccgtgtgcat

SEQ ID NO: 3389925 - DNA, 22 bp, Homo sapiens
cgtagcttctaccatgaacaga

SEQ ID NO: 3389926 - DNA, 20 bp, Homo sapiens
cgtagggagtacctgctgcc

SEQ ID NO: 3389927 - DNA, 14 bp, Homo sapiens
cgtagtctcctggg

SEQ ID NO: 3389928 - DNA, 17 bp, Homo sapiens
cgtagtctcctgggtgt

SEQ ID NO: 3389929 - DNA, 15 bp, Homo sapiens
cgtataggcatgtaa

SEQ ID NO: 3389930 - DNA, 16 bp, Homo sapiens
cgtataggcatgtaaa

SEQ ID NO: 3389931 - DNA, 19 bp, Homo sapiens
cgtatgcaagtctgtgagt

SEQ ID NO: 3389932 - DNA, 20 bp, Homo sapiens
cgtatgtctgttaccatgtc

SEQ ID NO: 3389933 - DNA, 19 bp, Homo sapiens
cgtattggacctgcccaca

SEQ ID NO: 3389934 - DNA, 20 bp, Homo sapiens
cgtattttaaaagccacata

SEQ ID NO: 3389935 - DNA, 14 bp, Homo sapiens
cgtcaccacctctc

SEQ ID NO: 3389936 - DNA, 21 bp, Homo sapiens
cgtcacccctgtttctggcac

SEQ ID NO: 3389937 - DNA, 19 bp, Homo sapiens
cgtcatcacttttcagtga

SEQ ID NO: 3389938 - DNA, 18 bp, Homo sapiens
cgtcatcggaggctgggc

SEQ ID NO: 3389939 - DNA, 20 bp, Homo sapiens
cgtcatcggaggctgggccc

SEQ ID NO: 3389940 - DNA, 15 bp, Homo sapiens
cgtcattgctgctgc

SEQ ID NO: 3389941 - DNA, 20 bp, Homo sapiens
cgtcattgctgctgctacca

SEQ ID NO: 3389942 - DNA, 22 bp, Homo sapiens
cgtcattgctgctgctaccagc

SEQ ID NO: 3389943 - DNA, 15 bp, Homo sapiens
cgtccacaggggcag

SEQ ID NO: 3389944 - DNA, 17 bp, Homo sapiens
cgtccacaggggcaggc

SEQ ID NO: 3389945 - DNA, 21 bp, Homo sapiens
cgtccagccgccattgccacc

SEQ ID NO: 3389946 - DNA, 21 bp, Homo sapiens
cgtccaggttcaacccacagc

SEQ ID NO: 3389947 - DNA, 18 bp, Homo sapiens
cgtccatccgactgcccc

SEQ ID NO: 3389948 - DNA, 19 bp, Homo sapiens
cgtccatccgactgcccct

SEQ ID NO: 3389949 - DNA, 17 bp, Homo sapiens
cgtccatggcaccagcc

SEQ ID NO: 3389950 - DNA, 18 bp, Homo sapiens
cgtccatggcaccagccc

SEQ ID NO: 3389951 - DNA, 17 bp, Homo sapiens
cgtcccagcatccctgg

SEQ ID NO: 3389952 - DNA, 13 bp, Homo sapiens
cgtccccactccc

SEQ ID NO: 3389953 - DNA, 21 bp, Homo sapiens
cgtccccagttgccgtctagg

SEQ ID NO: 3389954 - DNA, 13 bp, Homo sapiens
cgtcccctgctac

SEQ ID NO: 3389955 - DNA, 13 bp, Homo sapiens
cgtccctgcccat

SEQ ID NO: 3389956 - DNA, 14 bp, Homo sapiens
cgtccctggcgcag

SEQ ID NO: 3389957 - DNA, 12 bp, Homo sapiens
cgtccgccctgc

SEQ ID NO: 3389958 - DNA, 19 bp, Homo sapiens
cgtccgccctgctcctccc

SEQ ID NO: 3389959 - DNA, 14 bp, Homo sapiens
cgtcctcacccctg

SEQ ID NO: 3389960 - DNA, 23 bp, Homo sapiens
cgtcctgacggcgcccccagtgt

SEQ ID NO: 3389961 - DNA, 14 bp, Homo sapiens
cgtcctgcagagga

SEQ ID NO: 3389962 - DNA, 15 bp, Homo sapiens
cgtcctgcagaggac

SEQ ID NO: 3389963 - DNA, 19 bp, Homo sapiens
cgtcctgcagaggaccaca

SEQ ID NO: 3389964 - DNA, 13 bp, Homo sapiens
cgtcctgcctgtg

SEQ ID NO: 3389965 - DNA, 12 bp, Homo sapiens
cgtcctgtccca

SEQ ID NO: 3389966 - DNA, 13 bp, Homo sapiens
cgtcctgtcccag

SEQ ID NO: 3389967 - DNA, 16 bp, Homo sapiens
cgtcctgtcccagagg

SEQ ID NO: 3389968 - DNA, 13 bp, Homo sapiens
cgtcgcacagtct

SEQ ID NO: 3389969 - DNA, 16 bp, Homo sapiens
cgtcgcacagtctctc

SEQ ID NO: 3389970 - DNA, 19 bp, Homo sapiens
cgtctacatttcacattat

SEQ ID NO: 3389971 - DNA, 11 bp, Homo sapiens
cgtctcagtgt

SEQ ID NO: 3389972 - DNA, 15 bp, Homo sapiens
cgtctcatcttctct

SEQ ID NO: 3389973 - DNA, 14 bp, Homo sapiens
cgtctccaggggct

SEQ ID NO: 3389974 - DNA, 18 bp, Homo sapiens
cgtctgaagcttgactcc

SEQ ID NO: 3389975 - DNA, 15 bp, Homo sapiens
cgtctgactccagag

SEQ ID NO: 3389976 - DNA, 16 bp, Homo sapiens
ctaatattaaaaatat

SEQ ID NO: 3389977 - DNA, 20 bp, Homo sapiens
ctaatattcacatgttctaa

SEQ ID NO: 3389978 - DNA, 21 bp, Homo sapiens
ctaatattgcttcttgtgttt

SEQ ID NO: 3389979 - DNA, 14 bp, Homo sapiens
ctaatattttatgt

SEQ ID NO: 3389980 - DNA, 23 bp, Homo sapiens
ctaatcagaaatttttatcagtt

SEQ ID NO: 3389981 - DNA, 19 bp, Homo sapiens
ctaatcagcattctcactc

SEQ ID NO: 3389982 - DNA, 20 bp, Homo sapiens
ctaatcagggaggtcatttt

SEQ ID NO: 3389983 - DNA, 21 bp, Homo sapiens
ctaatcagggaggtcattttg

SEQ ID NO: 3389984 - DNA, 15 bp, Homo sapiens
ctaatcagtgtctca

SEQ ID NO: 3389985 - DNA, 15 bp, Homo sapiens
ctaatcatctgcagt

SEQ ID NO: 3389986 - DNA, 17 bp, Homo sapiens
ctaatcctatctgggga

SEQ ID NO: 3389987 - DNA, 20 bp, Homo sapiens
ctaatctatggtcgggagac

SEQ ID NO: 3389988 - DNA, 19 bp, Homo sapiens
ctaatctattgggttcatt

SEQ ID NO: 3389989 - DNA, 21 bp, Homo sapiens
ctaatctcatacctctgacca

SEQ ID NO: 3389990 - DNA, 14 bp, Homo sapiens
ctaatctgcagtgg

SEQ ID NO: 3389991 - DNA, 18 bp, Homo sapiens
ctaatctgtagggctgga

SEQ ID NO: 3389992 - DNA, 14 bp, Homo sapiens
ctaatcttgtccct

SEQ ID NO: 3389993 - DNA, 13 bp, Homo sapiens
ctaatgagactga

SEQ ID NO: 3389994 - DNA, 21 bp, Homo sapiens
ctaatgataatcccaccaccc

SEQ ID NO: 3389995 - DNA, 19 bp, Homo sapiens
ctaatgatcaaaacatgct

SEQ ID NO: 3389996 - DNA, 16 bp, Homo sapiens
ctaatgcaaattaaaa

SEQ ID NO: 3389997 - DNA, 19 bp, Homo sapiens
ctaatgcaaattaaaacat

SEQ ID NO: 3389998 - DNA, 17 bp, Homo sapiens
ctaatggattcaattac

SEQ ID NO: 3389999 - DNA, 13 bp, Homo sapiens
ctaatgggacact

SEQ ID NO: 3390000 - DNA, 15 bp, Homo sapiens
ctaatgtagctattt

SEQ ID NO: 3390001 - DNA, 16 bp, Homo sapiens
ctaatgtaggactgta

SEQ ID NO: 3390002 - DNA, 15 bp, Homo sapiens
ctaatgtctcactgt

SEQ ID NO: 3390003 - DNA, 16 bp, Homo sapiens
ctaatgtctcactgtt

SEQ ID NO: 3390004 - DNA, 22 bp, Homo sapiens
ctaatgtcttcatttcattgta

SEQ ID NO: 3390005 - DNA, 16 bp, Homo sapiens
ctaatgttatttttta

SEQ ID NO: 3390006 - DNA, 17 bp, Homo sapiens
ctaatgtttatgagcca

SEQ ID NO: 3390007 - DNA, 17 bp, Homo sapiens
ctaattaaaattgtgca

SEQ ID NO: 3390008 - DNA, 13 bp, Homo sapiens
ctaattaatatat

SEQ ID NO: 3390009 - DNA, 18 bp, Homo sapiens
ctaattaatatattaaaa

SEQ ID NO: 3390010 - DNA, 19 bp, Homo sapiens
ctaattaattgtaatctga

SEQ ID NO: 3390011 - DNA, 18 bp, Homo sapiens
ctaattatactactttgt

SEQ ID NO: 3390012 - DNA, 17 bp, Homo sapiens
ctaattatcacgtctga

SEQ ID NO: 3390013 - DNA, 16 bp, Homo sapiens
ctaattcaaggaattt

SEQ ID NO: 3390014 - DNA, 15 bp, Homo sapiens
ctaattcctttctat

SEQ ID NO: 3390015 - DNA, 16 bp, Homo sapiens
ctaattcgatgaaggc

SEQ ID NO: 3390016 - DNA, 20 bp, Homo sapiens
ctaattctattaaagtgcta

SEQ ID NO: 3390017 - DNA, 18 bp, Homo sapiens
ctaattcttctgtcctga

SEQ ID NO: 3390018 - DNA, 18 bp, Homo sapiens
ctaattgacttgcaaaga

SEQ ID NO: 3390019 - DNA, 12 bp, Homo sapiens
ctaattggaaag

SEQ ID NO: 3390020 - DNA, 20 bp, Homo sapiens
ctaattgtatgttagaataa

SEQ ID NO: 3390021 - DNA, 13 bp, Homo sapiens
ctaatttataaaa

SEQ ID NO: 3390022 - DNA, 21 bp, Homo sapiens
ctaatttatcctgaaatttca

SEQ ID NO: 3390023 - DNA, 23 bp, Homo sapiens
ctaatttatcctgaaatttcaga

SEQ ID NO: 3390024 - DNA, 18 bp, Homo sapiens
ctaatttcaaaatgcttt

SEQ ID NO: 3390025 - DNA, 22 bp, Homo sapiens
ctaatttcaaaatgctttttat

SEQ ID NO: 3390026 - DNA, 15 bp, Homo sapiens
ctaatttcccttctt

SEQ ID NO: 3390027 - DNA, 15 bp, Homo sapiens
ctaatttctcctccc

SEQ ID NO: 3390028 - DNA, 20 bp, Homo sapiens
ctaatttgtttcttctgtct

SEQ ID NO: 3390029 - DNA, 14 bp, Homo sapiens
ctaattttaaataa

SEQ ID NO: 3390030 - DNA, 19 bp, Homo sapiens
ctaattttaaataatttct

SEQ ID NO: 3390031 - DNA, 20 bp, Homo sapiens
ctaattttacacattagatt

SEQ ID NO: 3390032 - DNA, 19 bp, Homo sapiens
ctaattttacatgtttata

SEQ ID NO: 3390033 - DNA, 20 bp, Homo sapiens
ctaattttacatgtttataa

SEQ ID NO: 3390034 - DNA, 22 bp, Homo sapiens
ctaattttggataatattcatt

SEQ ID NO: 3390035 - DNA, 22 bp, Homo sapiens
ctaatttttaagaattgagtaa

SEQ ID NO: 3390036 - DNA, 13 bp, Homo sapiens
ctacaaaaaataa

SEQ ID NO: 3390037 - DNA, 16 bp, Homo sapiens
ctacaaagctttgcta

SEQ ID NO: 3390038 - DNA, 16 bp, Homo sapiens
ctacaaatttatgcat

SEQ ID NO: 3390039 - DNA, 19 bp, Homo sapiens
ctacaaatttatgcatttc

SEQ ID NO: 3390040 - DNA, 21 bp, Homo sapiens
ctacaaatttatgcatttcat

SEQ ID NO: 3390041 - DNA, 15 bp, Homo sapiens
ctacaaccatccctg

SEQ ID NO: 3390042 - DNA, 16 bp, Homo sapiens
ctacaaccatccctgc

SEQ ID NO: 3390043 - DNA, 19 bp, Homo sapiens
ctacaaccatccctgccac

SEQ ID NO: 3390044 - DNA, 17 bp, Homo sapiens
ctacaacttaatggaaa

SEQ ID NO: 3390045 - DNA, 18 bp, Homo sapiens
ctacaagagcagcctgtg

SEQ ID NO: 3390046 - DNA, 23 bp, Homo sapiens
ctacaagagcagcctgtggcatc

SEQ ID NO: 3390047 - DNA, 13 bp, Homo sapiens
ctacaagggaagc

SEQ ID NO: 3390048 - DNA, 18 bp, Homo sapiens
ctacaagtatatgtgaaa

SEQ ID NO: 3390049 - DNA, 22 bp, Homo sapiens
ctacaattaatagtttgtctat

SEQ ID NO: 3390050 - DNA, 22 bp, Homo sapiens
ctacaatttgttaattcctatg

SEQ ID NO: 3390051 - DNA, 13 bp, Homo sapiens
ctacacaaagcag

SEQ ID NO: 3390052 - DNA, 18 bp, Homo sapiens
ctacacagcacaccagcc

SEQ ID NO: 3390053 - DNA, 19 bp, Homo sapiens
ctacacagcacaccagccg

SEQ ID NO: 3390054 - DNA, 23 bp, Homo sapiens
ctacacagtgggaactctgacaa

SEQ ID NO: 3390055 - DNA, 14 bp, Homo sapiens
ctacacctccctcc

SEQ ID NO: 3390056 - DNA, 12 bp, Homo sapiens
ctacacctggct

SEQ ID NO: 3390057 - DNA, 13 bp, Homo sapiens
ctacacctggctg

SEQ ID NO: 3390058 - DNA, 15 bp, Homo sapiens
ctacacctggctgag

SEQ ID NO: 3390059 - DNA, 20 bp, Homo sapiens
ctacagaacttcagaaagac

SEQ ID NO: 3390060 - DNA, 12 bp, Homo sapiens
ctacagaataat

SEQ ID NO: 3390061 - DNA, 13 bp, Homo sapiens
ctacagaataatc

SEQ ID NO: 3390062 - DNA, 23 bp, Homo sapiens
ctacagacctgctttttgaaatg

SEQ ID NO: 3390063 - DNA, 23 bp, Homo sapiens
ctacagagccgagcaatatttat

SEQ ID NO: 3390064 - DNA, 18 bp, Homo sapiens
ctacagaggccatgggcc

SEQ ID NO: 3390065 - DNA, 22 bp, Homo sapiens
ctacagatagagagttgttgtg

SEQ ID NO: 3390066 - DNA, 19 bp, Homo sapiens
ctacagccttgtccccctc

SEQ ID NO: 3390067 - DNA, 21 bp, Homo sapiens
ctacagctaatcagcattctc

SEQ ID NO: 3390068 - DNA, 19 bp, Homo sapiens
ctacagctcacctctgaag

SEQ ID NO: 3390069 - DNA, 23 bp, Homo sapiens
ctacagctttcttgctcccttca

SEQ ID NO: 3390070 - DNA, 18 bp, Homo sapiens
ctacaggagagggaagag

SEQ ID NO: 3390071 - DNA, 15 bp, Homo sapiens
ctacaggagtgagca

SEQ ID NO: 3390072 - DNA, 16 bp, Homo sapiens
ctacaggagtgagcac

SEQ ID NO: 3390073 - DNA, 14 bp, Homo sapiens
ctacaggtgtgagt

SEQ ID NO: 3390074 - DNA, 23 bp, Homo sapiens
ctacagttagggttgagttactt

SEQ ID NO: 3390075 - DNA, 15 bp, Homo sapiens
ctacataaactgact

SEQ ID NO: 3390076 - DNA, 22 bp, Homo sapiens
ctacataaactgactttatcct

SEQ ID NO: 3390077 - DNA, 14 bp, Homo sapiens
ctacatattgtctg

SEQ ID NO: 3390078 - DNA, 14 bp, Homo sapiens
ctacatcagtttga

SEQ ID NO: 3390079 - DNA, 13 bp, Homo sapiens
ctacatgaaacag

SEQ ID NO: 3390080 - DNA, 14 bp, Homo sapiens
ctacatgaaacaga

SEQ ID NO: 3390081 - DNA, 19 bp, Homo sapiens
ctacatgacgacaaagctg

SEQ ID NO: 3390082 - DNA, 12 bp, Homo sapiens
ctacatgactgg

SEQ ID NO: 3390083 - DNA, 14 bp, Homo sapiens
ctacatgcagccca

SEQ ID NO: 3390084 - DNA, 23 bp, Homo sapiens
ctacatgcagcccatgcccacct

SEQ ID NO: 3390085 - DNA, 16 bp, Homo sapiens
ctacatgctgaaaaat

SEQ ID NO: 3390086 - DNA, 18 bp, Homo sapiens
ctacatggagtatatgtc

SEQ ID NO: 3390087 - DNA, 20 bp, Homo sapiens
ctacatggagtatatgtcaa

SEQ ID NO: 3390088 - DNA, 18 bp, Homo sapiens
ctacatgtattgcacatt

SEQ ID NO: 3390089 - DNA, 21 bp, Homo sapiens
ctacatgtattgcacattgta

SEQ ID NO: 3390090 - DNA, 13 bp, Homo sapiens
ctacatgtgagtg

SEQ ID NO: 3390091 - DNA, 16 bp, Homo sapiens
ctacattaacttgaaa

SEQ ID NO: 3390092 - DNA, 23 bp, Homo sapiens
ctacatttaaacaagtattttat

SEQ ID NO: 3390093 - DNA, 23 bp, Homo sapiens
ctacatttcacctactttgtaag

SEQ ID NO: 3390094 - DNA, 15 bp, Homo sapiens
ctacatttctgcaga

SEQ ID NO: 3390095 - DNA, 16 bp, Homo sapiens
ctaccaatctctgctc

SEQ ID NO: 3390096 - DNA, 17 bp, Homo sapiens
ctaccaatctctgctct

SEQ ID NO: 3390097 - DNA, 13 bp, Homo sapiens
ctaccacagtgtc

SEQ ID NO: 3390098 - DNA, 16 bp, Homo sapiens
ctaccactcacatgac

SEQ ID NO: 3390099 - DNA, 21 bp, Homo sapiens
ctaccagcgccaaatgttcat

SEQ ID NO: 3390100 - DNA, 17 bp, Homo sapiens
ctaccaggacagaactt

SEQ ID NO: 3390101 - DNA, 15 bp, Homo sapiens
ctatgtggctgaaaa

SEQ ID NO: 3390102 - DNA, 21 bp, Homo sapiens
ctatgttaaatactgtgcaga

SEQ ID NO: 3390103 - DNA, 14 bp, Homo sapiens
ctatgttgcccagg

SEQ ID NO: 3390104 - DNA, 15 bp, Homo sapiens
ctatgttgcccaggc

SEQ ID NO: 3390105 - DNA, 17 bp, Homo sapiens
ctatgttgcccaggcag

SEQ ID NO: 3390106 - DNA, 18 bp, Homo sapiens
ctatgttgtggtccatca

SEQ ID NO: 3390107 - DNA, 13 bp, Homo sapiens
ctatgtttgtatt

SEQ ID NO: 3390108 - DNA, 17 bp, Homo sapiens
ctatgtttgtatttgga

SEQ ID NO: 3390109 - DNA, 23 bp, Homo sapiens
ctatgtttgtatttggaatattt

SEQ ID NO: 3390110 - DNA, 23 bp, Homo sapiens
ctatgtttgtgtgatttcctaaa

SEQ ID NO: 3390111 - DNA, 13 bp, Homo sapiens
ctattaaaaaagt

SEQ ID NO: 3390112 - DNA, 21 bp, Homo sapiens
ctattaaagtgctaaggttct

SEQ ID NO: 3390113 - DNA, 23 bp, Homo sapiens
ctattaagatttccaagtgccaa

SEQ ID NO: 3390114 - DNA, 11 bp, Homo sapiens
ctattaatata

SEQ ID NO: 3390115 - DNA, 21 bp, Homo sapiens
ctattaatatatgtattattt

SEQ ID NO: 3390116 - DNA, 14 bp, Homo sapiens
ctattataaaacca

SEQ ID NO: 3390117 - DNA, 16 bp, Homo sapiens
ctattataaaaccatg

SEQ ID NO: 3390118 - DNA, 18 bp, Homo sapiens
ctattatttttataattg

SEQ ID NO: 3390119 - DNA, 19 bp, Homo sapiens
ctattatttttataattgt

SEQ ID NO: 3390120 - DNA, 23 bp, Homo sapiens
ctattcaaggtggccaaattatt

SEQ ID NO: 3390121 - DNA, 16 bp, Homo sapiens
ctattcacaattattc

SEQ ID NO: 3390122 - DNA, 17 bp, Homo sapiens
ctattcacaattattcc

SEQ ID NO: 3390123 - DNA, 15 bp, Homo sapiens
ctattcaccctccac

SEQ ID NO: 3390124 - DNA, 13 bp, Homo sapiens
ctattcagacaag

SEQ ID NO: 3390125 - DNA, 14 bp, Homo sapiens
ctattcagacaagc

SEQ ID NO: 3390126 - DNA, 17 bp, Homo sapiens
ctattcagacaagcaac

SEQ ID NO: 3390127 - DNA, 17 bp, Homo sapiens
ctattcagtaataactc

SEQ ID NO: 3390128 - DNA, 23 bp, Homo sapiens
ctattcagtaataactctaccct

SEQ ID NO: 3390129 - DNA, 12 bp, Homo sapiens
ctattcatgttt

SEQ ID NO: 3390130 - DNA, 18 bp, Homo sapiens
ctattcattaaatgtttg

SEQ ID NO: 3390131 - DNA, 22 bp, Homo sapiens
ctattcccacacctccacagtt

SEQ ID NO: 3390132 - DNA, 18 bp, Homo sapiens
ctattctcaaagttaaaa

SEQ ID NO: 3390133 - DNA, 19 bp, Homo sapiens
ctattctgtgttgcattat

SEQ ID NO: 3390134 - DNA, 24 bp, Homo sapiens
ctattctgtgttgcattattcatt

SEQ ID NO: 3390135 - DNA, 14 bp, Homo sapiens
ctattgacttcaat

SEQ ID NO: 3390136 - DNA, 15 bp, Homo sapiens
ctattgccaaccagt

SEQ ID NO: 3390137 - DNA, 14 bp, Homo sapiens
ctattgcttcacca

SEQ ID NO: 3390138 - DNA, 21 bp, Homo sapiens
ctattggccaacaatcctttc

SEQ ID NO: 3390139 - DNA, 14 bp, Homo sapiens
ctattgggagaggt

SEQ ID NO: 3390140 - DNA, 15 bp, Homo sapiens
ctattgggttcatta

SEQ ID NO: 3390141 - DNA, 16 bp, Homo sapiens
ctattgggttcattat

SEQ ID NO: 3390142 - DNA, 23 bp, Homo sapiens
ctattgggttcattattggaatt

SEQ ID NO: 3390143 - DNA, 16 bp, Homo sapiens
ctattgtagcatttct

SEQ ID NO: 3390144 - DNA, 21 bp, Homo sapiens
ctattgtgggacttattacaa

SEQ ID NO: 3390145 - DNA, 21 bp, Homo sapiens
ctatttaagttatcaacttta

SEQ ID NO: 3390146 - DNA, 22 bp, Homo sapiens
ctatttaatatctggcactgtt

SEQ ID NO: 3390147 - DNA, 14 bp, Homo sapiens
ctatttaatattta

SEQ ID NO: 3390148 - DNA, 11 bp, Homo sapiens
ctatttaatgg

SEQ ID NO: 3390149 - DNA, 12 bp, Homo sapiens
ctatttaatgga

SEQ ID NO: 3390150 - DNA, 20 bp, Homo sapiens
ctatttaattctttctattt

SEQ ID NO: 3390151 - DNA, 13 bp, Homo sapiens
ctatttattaata

SEQ ID NO: 3390152 - DNA, 15 bp, Homo sapiens
ctatttattaatatt

SEQ ID NO: 3390153 - DNA, 21 bp, Homo sapiens
ctatttattaatatttaacat

SEQ ID NO: 3390154 - DNA, 16 bp, Homo sapiens
ctatttattagccaac

SEQ ID NO: 3390155 - DNA, 18 bp, Homo sapiens
ctatttattgactttgac

SEQ ID NO: 3390156 - DNA, 15 bp, Homo sapiens
ctatttatttactga

SEQ ID NO: 3390157 - DNA, 13 bp, Homo sapiens
ctatttattttcc

SEQ ID NO: 3390158 - DNA, 19 bp, Homo sapiens
ctatttattttcctaaaga

SEQ ID NO: 3390159 - DNA, 14 bp, Homo sapiens
ctatttatttttac

SEQ ID NO: 3390160 - DNA, 22 bp, Homo sapiens
ctatttatttttgcaaaccctg

SEQ ID NO: 3390161 - DNA, 15 bp, Homo sapiens
ctatttcatgttttt

SEQ ID NO: 3390162 - DNA, 21 bp, Homo sapiens
ctatttccccaggggaaaatg

SEQ ID NO: 3390163 - DNA, 14 bp, Homo sapiens
ctatttctcttgct

SEQ ID NO: 3390164 - DNA, 15 bp, Homo sapiens
ctatttgaaatacta

SEQ ID NO: 3390165 - DNA, 17 bp, Homo sapiens
ctatttgaaatactaaa

SEQ ID NO: 3390166 - DNA, 14 bp, Homo sapiens
ctatttgaacaagt

SEQ ID NO: 3390167 - DNA, 14 bp, Homo sapiens
ctatttgtaaatct

SEQ ID NO: 3390168 - DNA, 19 bp, Homo sapiens
ctatttgtaaatctgccac

SEQ ID NO: 3390169 - DNA, 16 bp, Homo sapiens
ctatttgttttcatgg

SEQ ID NO: 3390170 - DNA, 13 bp, Homo sapiens
ctattttaaaata

SEQ ID NO: 3390171 - DNA, 22 bp, Homo sapiens
ctattttaaaataaattagttg

SEQ ID NO: 3390172 - DNA, 12 bp, Homo sapiens
ctattttcacaa

SEQ ID NO: 3390173 - DNA, 14 bp, Homo sapiens
ctattttcagaatc

SEQ ID NO: 3390174 - DNA, 16 bp, Homo sapiens
ctattttcagaatctg

SEQ ID NO: 3390175 - DNA, 15 bp, Homo sapiens
ctattttcatttgta

SEQ ID NO: 3390176 - DNA, 16 bp, Homo sapiens
ctattttctgcagaaa

SEQ ID NO: 3390177 - DNA, 12 bp, Homo sapiens
ctattttgtaaa

SEQ ID NO: 3390178 - DNA, 13 bp, Homo sapiens
ctatttttatcat

SEQ ID NO: 3390179 - DNA, 16 bp, Homo sapiens
ctatttttatttatat

SEQ ID NO: 3390180 - DNA, 18 bp, Homo sapiens
ctatttttatttatattt

SEQ ID NO: 3390181 - DNA, 21 bp, Homo sapiens
ctatttttgtaaactggaatt

SEQ ID NO: 3390182 - DNA, 17 bp, Homo sapiens
ctatttttttaaaatca

SEQ ID NO: 3390183 - DNA, 20 bp, Homo sapiens
ctatttttttaaaatcacta

SEQ ID NO: 3390184 - DNA, 21 bp, Homo sapiens
ctatttttttaaaatcactaa

SEQ ID NO: 3390185 - DNA, 17 bp, Homo sapiens
ctatttttttaactgaa

SEQ ID NO: 3390186 - DNA, 22 bp, Homo sapiens
ctatttttttaactgaaaatgt

SEQ ID NO: 3390187 - DNA, 13 bp, Homo sapiens
ctatttttttaga

SEQ ID NO: 3390188 - DNA, 21 bp, Homo sapiens
ctcaaaaaaaaaaaaatgcac

SEQ ID NO: 3390189 - DNA, 20 bp, Homo sapiens
ctcaaaaatacaaaataaaa

SEQ ID NO: 3390190 - DNA, 16 bp, Homo sapiens
ctcaaaacttaacata

SEQ ID NO: 3390191 - DNA, 21 bp, Homo sapiens
ctcaaaagcatttatcattct

SEQ ID NO: 3390192 - DNA, 14 bp, Homo sapiens
ctcaaaaggaaacc

SEQ ID NO: 3390193 - DNA, 18 bp, Homo sapiens
ctcaaaaggaaaccaagt

SEQ ID NO: 3390194 - DNA, 20 bp, Homo sapiens
ctcaaaataaaaagcctcag

SEQ ID NO: 3390195 - DNA, 19 bp, Homo sapiens
ctcaaactgaggaatttca

SEQ ID NO: 3390196 - DNA, 16 bp, Homo sapiens
ctcaaagatctgaatt

SEQ ID NO: 3390197 - DNA, 15 bp, Homo sapiens
ctcaaaggagaaaaa

SEQ ID NO: 3390198 - DNA, 16 bp, Homo sapiens
ctcaaaggagaaaaaa

SEQ ID NO: 3390199 - DNA, 16 bp, Homo sapiens
ctcaaagtataatctt

SEQ ID NO: 3390200 - DNA, 15 bp, Homo sapiens
ctcaaagttaattca

SEQ ID NO: 3390201 - DNA, 14 bp, Homo sapiens
ctcaaagttttgaa

SEQ ID NO: 3390202 - DNA, 15 bp, Homo sapiens
ctcaaatacacattt

SEQ ID NO: 3390203 - DNA, 16 bp, Homo sapiens
ctcaaatctattcaga

SEQ ID NO: 3390204 - DNA, 16 bp, Homo sapiens
ctcaaatgagtaacat

SEQ ID NO: 3390205 - DNA, 22 bp, Homo sapiens
ctcaaatgagtaacatttgctg

SEQ ID NO: 3390206 - DNA, 16 bp, Homo sapiens
ctcaaatgttctaagt

SEQ ID NO: 3390207 - DNA, 21 bp, Homo sapiens
ctcaaatttattttaatgtaa

SEQ ID NO: 3390208 - DNA, 15 bp, Homo sapiens
ctcaacaagggagag

SEQ ID NO: 3390209 - DNA, 23 bp, Homo sapiens
ctcaacaagggagagacctcatc

SEQ ID NO: 3390210 - DNA, 14 bp, Homo sapiens
ctcaacaataaaac

SEQ ID NO: 3390211 - DNA, 15 bp, Homo sapiens
ctcaacaggcccagg

SEQ ID NO: 3390212 - DNA, 16 bp, Homo sapiens
ctcaacaggcccaggg

SEQ ID NO: 3390213 - DNA, 17 bp, Homo sapiens
ctcaacaggcccaggga

SEQ ID NO: 3390214 - DNA, 20 bp, Homo sapiens
ctcaacaggcccagggaggg

SEQ ID NO: 3390215 - DNA, 16 bp, Homo sapiens
ctcaacatgttactga

SEQ ID NO: 3390216 - DNA, 21 bp, Homo sapiens
ctcaaccccaccatatgaatt

SEQ ID NO: 3390217 - DNA, 23 bp, Homo sapiens
ctcaacccctcccctccatccct

SEQ ID NO: 3390218 - DNA, 13 bp, Homo sapiens
ctcaacctcacca

SEQ ID NO: 3390219 - DNA, 20 bp, Homo sapiens
ctcaacctcttctggctcaa

SEQ ID NO: 3390220 - DNA, 18 bp, Homo sapiens
ctcaacgttgctccccat

SEQ ID NO: 3390221 - DNA, 17 bp, Homo sapiens
ctcaactcacctaatgt

SEQ ID NO: 3390222 - DNA, 17 bp, Homo sapiens
ctcaactctgagcccat

SEQ ID NO: 3390223 - DNA, 18 bp, Homo sapiens
ctcaactctgagcccata

SEQ ID NO: 3390224 - DNA, 21 bp, Homo sapiens
ctcaagaagacatggagactc

SEQ ID NO: 3390225 - DNA, 16 bp, Homo sapiens
ctcaagagcacacaga

SEQ ID NO: 3390226 - DNA, 17 bp, Homo sapiens
ctcaagagcacacagag

SEQ ID NO: 3390227 - DNA, 18 bp, Homo sapiens
ctcattgctgagcctctg

SEQ ID NO: 3390228 - DNA, 19 bp, Homo sapiens
ctcattgcttacaagccta

SEQ ID NO: 3390229 - DNA, 23 bp, Homo sapiens
ctcattggccagctcataaaatg

SEQ ID NO: 3390230 - DNA, 12 bp, Homo sapiens
ctcattggggtt

SEQ ID NO: 3390231 - DNA, 18 bp, Homo sapiens
ctcatttgtcacacactt

SEQ ID NO: 3390232 - DNA, 17 bp, Homo sapiens
ctcatttgttaaaatta

SEQ ID NO: 3390233 - DNA, 15 bp, Homo sapiens
ctcatttgtttttct

SEQ ID NO: 3390234 - DNA, 20 bp, Homo sapiens
ctcatttttttaatttatta

SEQ ID NO: 3390235 - DNA, 19 bp, Homo sapiens
ctccaaaacttagacccat

SEQ ID NO: 3390236 - DNA, 20 bp, Homo sapiens
ctccaaaccagacggtgacg

SEQ ID NO: 3390237 - DNA, 18 bp, Homo sapiens
ctccaaactgaagcagcc

SEQ ID NO: 3390238 - DNA, 16 bp, Homo sapiens
ctccaaaggggctgct

SEQ ID NO: 3390239 - DNA, 15 bp, Homo sapiens
ctccaaatgagatct

SEQ ID NO: 3390240 - DNA, 20 bp, Homo sapiens
ctccaacagaactaaatgtt

SEQ ID NO: 3390241 - DNA, 13 bp, Homo sapiens
ctccaacgcccct

SEQ ID NO: 3390242 - DNA, 20 bp, Homo sapiens
ctccaagataagcctgagcc

SEQ ID NO: 3390243 - DNA, 23 bp, Homo sapiens
ctccaagataagcctgagcctta

SEQ ID NO: 3390244 - DNA, 16 bp, Homo sapiens
ctccaagattctagat

SEQ ID NO: 3390245 - DNA, 23 bp, Homo sapiens
ctccaagcaagtagctttccaca

SEQ ID NO: 3390246 - DNA, 20 bp, Homo sapiens
ctccaagccattcacttccc

SEQ ID NO: 3390247 - DNA, 14 bp, Homo sapiens
ctccaagcctgcct

SEQ ID NO: 3390248 - DNA, 19 bp, Homo sapiens
ctccaagcctgcctcccaa

SEQ ID NO: 3390249 - DNA, 18 bp, Homo sapiens
ctccaagctccatctcca

SEQ ID NO: 3390250 - DNA, 19 bp, Homo sapiens
ctccaaggaggggctgtaa

SEQ ID NO: 3390251 - DNA, 21 bp, Homo sapiens
ctccaaggaggggctgtaaaa

SEQ ID NO: 3390252 - DNA, 19 bp, Homo sapiens
ctccaagggcttctgcacc

SEQ ID NO: 3390253 - DNA, 20 bp, Homo sapiens
ctccaagggtttcgactggt

SEQ ID NO: 3390254 - DNA, 21 bp, Homo sapiens
ctccaagtctctctgtgaata

SEQ ID NO: 3390255 - DNA, 23 bp, Homo sapiens
ctccaagtctgtacctcaaatga

SEQ ID NO: 3390256 - DNA, 14 bp, Homo sapiens
ctccaagtgccaga

SEQ ID NO: 3390257 - DNA, 15 bp, Homo sapiens
ctccaagtgccagag

SEQ ID NO: 3390258 - DNA, 19 bp, Homo sapiens
ctccaagtgccagaggtgg

SEQ ID NO: 3390259 - DNA, 19 bp, Homo sapiens
ctccaatgtctgctgagga

SEQ ID NO: 3390260 - DNA, 21 bp, Homo sapiens
ctccacacaagggaaggacag

SEQ ID NO: 3390261 - DNA, 17 bp, Homo sapiens
ctccacacctccaccgt

SEQ ID NO: 3390262 - DNA, 13 bp, Homo sapiens
ctccacacctgaa

SEQ ID NO: 3390263 - DNA, 17 bp, Homo sapiens
ctccacagagtgagcca

SEQ ID NO: 3390264 - DNA, 14 bp, Homo sapiens
ctccacagccgcag

SEQ ID NO: 3390265 - DNA, 15 bp, Homo sapiens
ctccacagccgcagc

SEQ ID NO: 3390266 - DNA, 16 bp, Homo sapiens
ctccacagcgagggca

SEQ ID NO: 3390267 - DNA, 19 bp, Homo sapiens
ctccacagcgagggcagct

SEQ ID NO: 3390268 - DNA, 15 bp, Homo sapiens
ctccacagtgctgct

SEQ ID NO: 3390269 - DNA, 16 bp, Homo sapiens
ctccacagtgttcatt

SEQ ID NO: 3390270 - DNA, 14 bp, Homo sapiens
ctccacatcccagc

SEQ ID NO: 3390271 - DNA, 19 bp, Homo sapiens
ctccacatcccagcagccc

SEQ ID NO: 3390272 - DNA, 13 bp, Homo sapiens
ctccaccacatcc

SEQ ID NO: 3390273 - DNA, 23 bp, Homo sapiens
ctccaccacatctgccagacctt

SEQ ID NO: 3390274 - DNA, 15 bp, Homo sapiens
ctccaccaccactgg

SEQ ID NO: 3390275 - DNA, 23 bp, Homo sapiens
ctccaccaccactggccaccagg

SEQ ID NO: 3390276 - DNA, 13 bp, Homo sapiens
ctccaccagcagc

SEQ ID NO: 3390277 - DNA, 15 bp, Homo sapiens
ctccaccagcagcat

SEQ ID NO: 3390278 - DNA, 16 bp, Homo sapiens
ctccaccagcagcatg

SEQ ID NO: 3390279 - DNA, 15 bp, Homo sapiens
ctccaccatccccac

SEQ ID NO: 3390280 - DNA, 16 bp, Homo sapiens
ctccaccatccccacc

SEQ ID NO: 3390281 - DNA, 16 bp, Homo sapiens
ctccacccagcccctg

SEQ ID NO: 3390282 - DNA, 18 bp, Homo sapiens
ctccaccccacagaacct

SEQ ID NO: 3390283 - DNA, 16 bp, Homo sapiens
ctccaccctccacctt

SEQ ID NO: 3390284 - DNA, 22 bp, Homo sapiens
ctccaccctcccccagacacag

SEQ ID NO: 3390285 - DNA, 15 bp, Homo sapiens
ctccaccctggctgg

SEQ ID NO: 3390286 - DNA, 16 bp, Homo sapiens
ctccaccctggctggg

SEQ ID NO: 3390287 - DNA, 18 bp, Homo sapiens
ctccaccctggctgggat

SEQ ID NO: 3390288 - DNA, 13 bp, Homo sapiens
ctccaccctgtcc

SEQ ID NO: 3390289 - DNA, 13 bp, Homo sapiens
ctccacccttggc

SEQ ID NO: 3390290 - DNA, 14 bp, Homo sapiens
ctccacccttggcc

SEQ ID NO: 3390291 - DNA, 16 bp, Homo sapiens
ctccacccttggcctg

SEQ ID NO: 3390292 - DNA, 15 bp, Homo sapiens
ctccacctagactgt

SEQ ID NO: 3390293 - DNA, 13 bp, Homo sapiens
ctccaccttctca

SEQ ID NO: 3390294 - DNA, 16 bp, Homo sapiens
ctccacgcctcctggc

SEQ ID NO: 3390295 - DNA, 22 bp, Homo sapiens
ctccacgggcaggggtcagagc

SEQ ID NO: 3390296 - DNA, 20 bp, Homo sapiens
ctccacggtgcgtggctgtg

SEQ ID NO: 3390297 - DNA, 21 bp, Homo sapiens
ctccacggtgcgtggctgtgg

SEQ ID NO: 3390298 - DNA, 23 bp, Homo sapiens
ctccacggtgcgtggctgtggca

SEQ ID NO: 3390299 - DNA, 23 bp, Homo sapiens
ctccactcagctgtcctgcagca

SEQ ID NO: 3390300 - DNA, 12 bp, Homo sapiens
ctccactccatg

SEQ ID NO: 3390301 - DNA, 16 bp, Homo sapiens
ctccactcccccacct

SEQ ID NO: 3390302 - DNA, 17 bp, Homo sapiens
ctccactcccccacctg

SEQ ID NO: 3390303 - DNA, 21 bp, Homo sapiens
ctccactcccccacctgacaa

SEQ ID NO: 3390304 - DNA, 19 bp, Homo sapiens
ctccactcgacccagaatg

SEQ ID NO: 3390305 - DNA, 17 bp, Homo sapiens
ctccactctgcttctct

SEQ ID NO: 3390306 - DNA, 21 bp, Homo sapiens
ctccactctgcttctctgact

SEQ ID NO: 3390307 - DNA, 20 bp, Homo sapiens
ctccactgccctggcagcag

SEQ ID NO: 3390308 - DNA, 21 bp, Homo sapiens
ctccactgccctggcagcagc

SEQ ID NO: 3390309 - DNA, 16 bp, Homo sapiens
ctccactgcctctgga

SEQ ID NO: 3390310 - DNA, 14 bp, Homo sapiens
ctccactgccttcg

SEQ ID NO: 3390311 - DNA, 16 bp, Homo sapiens
ctccactgccttcgat

SEQ ID NO: 3390312 - DNA, 19 bp, Homo sapiens
ctccactggacagacccag

SEQ ID NO: 3390313 - DNA, 20 bp, Homo sapiens
ctccactggacagacccagg

SEQ ID NO: 3390314 - DNA, 24 bp, Homo sapiens
ctccactggacagacccaggtctt

SEQ ID NO: 3390315 - DNA, 13 bp, Homo sapiens
ctccactggatgg

SEQ ID NO: 3390316 - DNA, 11 bp, Homo sapiens
ctccactgtca

SEQ ID NO: 3390317 - DNA, 13 bp, Homo sapiens
ctccactgtcacc

SEQ ID NO: 3390318 - DNA, 16 bp, Homo sapiens
ctccacttggtctgtg

SEQ ID NO: 3390319 - DNA, 17 bp, Homo sapiens
ctccagaagcctctggc

SEQ ID NO: 3390320 - DNA, 20 bp, Homo sapiens
ctccagaagcctctggctag

SEQ ID NO: 3390321 - DNA, 21 bp, Homo sapiens
ctccagaagcctctggctaga

SEQ ID NO: 3390322 - DNA, 14 bp, Homo sapiens
ctccagaatctgct

SEQ ID NO: 3390323 - DNA, 16 bp, Homo sapiens
ctccagaatctgctgt

SEQ ID NO: 3390324 - DNA, 22 bp, Homo sapiens
ctccagaatctgctgttgccat

SEQ ID NO: 3390325 - DNA, 19 bp, Homo sapiens
ctccagaatgtaagaaaac

SEQ ID NO: 3390326 - DNA, 20 bp, Homo sapiens
ctccagaatttggaaatcct

SEQ ID NO: 3390327 - DNA, 14 bp, Homo sapiens
ctccagacccctgg

SEQ ID NO: 3390328 - DNA, 17 bp, Homo sapiens
ctccagacccctggctt

SEQ ID NO: 3390329 - DNA, 19 bp, Homo sapiens
ctccagacgtaggggaggg

SEQ ID NO: 3390330 - DNA, 11 bp, Homo sapiens
ctccagagcca

SEQ ID NO: 3390331 - DNA, 15 bp, Homo sapiens
ctccagagccagcct

SEQ ID NO: 3390332 - DNA, 20 bp, Homo sapiens
ctccagagccagcctgggac

SEQ ID NO: 3390333 - DNA, 18 bp, Homo sapiens
ctccagagtctgagcccc

SEQ ID NO: 3390334 - DNA, 21 bp, Homo sapiens
ctccagcaacttcttctccat

SEQ ID NO: 3390335 - DNA, 14 bp, Homo sapiens
ctccagcaccttct

SEQ ID NO: 3390336 - DNA, 15 bp, Homo sapiens
ctccagcatccagcc

SEQ ID NO: 3390337 - DNA, 11 bp, Homo sapiens
ctccagccagc

SEQ ID NO: 3390338 - DNA, 24 bp, Homo sapiens
ctccagccagcaatgatgtccaga

SEQ ID NO: 3390339 - DNA, 12 bp, Homo sapiens
ctccagcccctg

SEQ ID NO: 3390340 - DNA, 13 bp, Homo sapiens
ctccagcccctgt

SEQ ID NO: 3390341 - DNA, 15 bp, Homo sapiens
ctccagcccgggagc

SEQ ID NO: 3390342 - DNA, 22 bp, Homo sapiens
ctccagcccgggagcctaggac

SEQ ID NO: 3390343 - DNA, 23 bp, Homo sapiens
ctccagcccgggagcctaggacc

SEQ ID NO: 3390344 - DNA, 19 bp, Homo sapiens
ctccagcctctcccggctg

SEQ ID NO: 3390345 - DNA, 23 bp, Homo sapiens
ctccagcctctcccggctgcctg

SEQ ID NO: 3390346 - DNA, 12 bp, Homo sapiens
ctccagcctggg

SEQ ID NO: 3390347 - DNA, 13 bp, Homo sapiens
ctccagcctgggg

SEQ ID NO: 3390348 - DNA, 15 bp, Homo sapiens
ctccagctcaccagc

SEQ ID NO: 3390349 - DNA, 16 bp, Homo sapiens
ctccagctcaccagcc

SEQ ID NO: 3390350 - DNA, 20 bp, Homo sapiens
ctccagctcaccagccccag

SEQ ID NO: 3390351 - DNA, 17 bp, Homo sapiens
ctccagctcagaaccca

SEQ ID NO: 3390352 - DNA, 24 bp, Homo sapiens
ctccagctcagaacccagggctct

SEQ ID NO: 3390353 - DNA, 18 bp, Homo sapiens
ctcccaggggtctccctg

SEQ ID NO: 3390354 - DNA, 19 bp, Homo sapiens
ctcccaggggtctccctgg

SEQ ID NO: 3390355 - DNA, 24 bp, Homo sapiens
ctcccaggtaccagctgcgcttgc

SEQ ID NO: 3390356 - DNA, 21 bp, Homo sapiens
ctcccaggttcccccagcaag

SEQ ID NO: 3390357 - DNA, 20 bp, Homo sapiens
ctcccagtccccagcccttc

SEQ ID NO: 3390358 - DNA, 14 bp, Homo sapiens
ctcccagtcctcca

SEQ ID NO: 3390359 - DNA, 18 bp, Homo sapiens
ctcccagtcctccagacc

SEQ ID NO: 3390360 - DNA, 17 bp, Homo sapiens
ctcccatccccctgccc

SEQ ID NO: 3390361 - DNA, 13 bp, Homo sapiens
ctcccatcctggg

SEQ ID NO: 3390362 - DNA, 18 bp, Homo sapiens
ctcccatcctggggcagc

SEQ ID NO: 3390363 - DNA, 20 bp, Homo sapiens
ctcccatctgggagtcccct

SEQ ID NO: 3390364 - DNA, 15 bp, Homo sapiens
ctcccatgcctggtc

SEQ ID NO: 3390365 - DNA, 19 bp, Homo sapiens
ctccccaaccctaggttcc

SEQ ID NO: 3390366 - DNA, 23 bp, Homo sapiens
ctccccaaccctaggttccctgt

SEQ ID NO: 3390367 - DNA, 18 bp, Homo sapiens
ctccccaaggaagagcca

SEQ ID NO: 3390368 - DNA, 13 bp, Homo sapiens
ctccccacagcct

SEQ ID NO: 3390369 - DNA, 15 bp, Homo sapiens
ctccccacagcctct

SEQ ID NO: 3390370 - DNA, 12 bp, Homo sapiens
ctccccacccac

SEQ ID NO: 3390371 - DNA, 13 bp, Homo sapiens
ctccccacccacc

SEQ ID NO: 3390372 - DNA, 20 bp, Homo sapiens
ctccccaccctcctcttgga

SEQ ID NO: 3390373 - DNA, 20 bp, Homo sapiens
ctccccacgagtcacctgca

SEQ ID NO: 3390374 - DNA, 22 bp, Homo sapiens
ctccccacgagtcacctgcaag

SEQ ID NO: 3390375 - DNA, 23 bp, Homo sapiens
ctccccacgagtcacctgcaagc

SEQ ID NO: 3390376 - DNA, 15 bp, Homo sapiens
ctccccacgccctcc

SEQ ID NO: 3390377 - DNA, 20 bp, Homo sapiens
ctccccacggccgctccagg

SEQ ID NO: 3390378 - DNA, 22 bp, Homo sapiens
ctccccacggccgctccagggg

SEQ ID NO: 3390379 - DNA, 20 bp, Homo sapiens
ctccccactgaaaacatttc

SEQ ID NO: 3390380 - DNA, 14 bp, Homo sapiens
ctccccagaattca

SEQ ID NO: 3390381 - DNA, 16 bp, Homo sapiens
ctccccagagctgtgc

SEQ ID NO: 3390382 - DNA, 13 bp, Homo sapiens
ctccccagatctc

SEQ ID NO: 3390383 - DNA, 15 bp, Homo sapiens
ctccccagcccctag

SEQ ID NO: 3390384 - DNA, 21 bp, Homo sapiens
ctccccagcccctagcccagg

SEQ ID NO: 3390385 - DNA, 18 bp, Homo sapiens
ctccccagggctccctta

SEQ ID NO: 3390386 - DNA, 22 bp, Homo sapiens
ctccccagtctctcttaaagtt

SEQ ID NO: 3390387 - DNA, 11 bp, Homo sapiens
ctccccagttc

SEQ ID NO: 3390388 - DNA, 23 bp, Homo sapiens
ctccccatgtgcctgcaccagga

SEQ ID NO: 3390389 - DNA, 14 bp, Homo sapiens
ctccccatgtgtcc

SEQ ID NO: 3390390 - DNA, 13 bp, Homo sapiens
ctcccccaaccca

SEQ ID NO: 3390391 - DNA, 19 bp, Homo sapiens
ctcccccaacccacctctg

SEQ ID NO: 3390392 - DNA, 21 bp, Homo sapiens
ctccccccgcccacccacgca

SEQ ID NO: 3390393 - DNA, 17 bp, Homo sapiens
ctcccccgacactgctg

SEQ ID NO: 3390394 - DNA, 21 bp, Homo sapiens
ctcccccgacactgctgcacc

SEQ ID NO: 3390395 - DNA, 14 bp, Homo sapiens
ctcccccgccactc

SEQ ID NO: 3390396 - DNA, 15 bp, Homo sapiens
ctcccccgccactcc

SEQ ID NO: 3390397 - DNA, 21 bp, Homo sapiens
ctccccctaaacccctgtccc

SEQ ID NO: 3390398 - DNA, 12 bp, Homo sapiens
ctccccctgcaa

SEQ ID NO: 3390399 - DNA, 13 bp, Homo sapiens
ctccccctgtccc

SEQ ID NO: 3390400 - DNA, 19 bp, Homo sapiens
ctccccctgtcccctcagc

SEQ ID NO: 3390401 - DNA, 23 bp, Homo sapiens
ctcccccttccccttctgtgtca

SEQ ID NO: 3390402 - DNA, 18 bp, Homo sapiens
ctccccgcctggccaggg

SEQ ID NO: 3390403 - DNA, 16 bp, Homo sapiens
ctccccgcctgttccc

SEQ ID NO: 3390404 - DNA, 20 bp, Homo sapiens
ctccccggcaccctctggcc

SEQ ID NO: 3390405 - DNA, 14 bp, Homo sapiens
ctccccggctcgag

SEQ ID NO: 3390406 - DNA, 16 bp, Homo sapiens
ctcccctaaccctact

SEQ ID NO: 3390407 - DNA, 20 bp, Homo sapiens
ctcccctaacctcttttctg

SEQ ID NO: 3390408 - DNA, 18 bp, Homo sapiens
ctcccctcaaagtctgca

SEQ ID NO: 3390409 - DNA, 17 bp, Homo sapiens
ctcccctcacagcctct

SEQ ID NO: 3390410 - DNA, 19 bp, Homo sapiens
ctcccctcacagcctctga

SEQ ID NO: 3390411 - DNA, 10 bp, Homo sapiens
ctcccctcca

SEQ ID NO: 3390412 - DNA, 23 bp, Homo sapiens
ctcccctccatccctggccccct

SEQ ID NO: 3390413 - DNA, 14 bp, Homo sapiens
ctcccctcccagtc

SEQ ID NO: 3390414 - DNA, 15 bp, Homo sapiens
ctcccctcccagtcc

SEQ ID NO: 3390415 - DNA, 22 bp, Homo sapiens
ctcccctcccagtcctccagac

SEQ ID NO: 3390416 - DNA, 14 bp, Homo sapiens
ctcccctcccctgc

SEQ ID NO: 3390417 - DNA, 18 bp, Homo sapiens
ctcccctcccctgctgca

SEQ ID NO: 3390418 - DNA, 24 bp, Homo sapiens
ctcccctccggactggtgccctcc

SEQ ID NO: 3390419 - DNA, 12 bp, Homo sapiens
ctcccctgccac

SEQ ID NO: 3390420 - DNA, 13 bp, Homo sapiens
ctcccctgccacc

SEQ ID NO: 3390421 - DNA, 14 bp, Homo sapiens
ctcccctgccattt

SEQ ID NO: 3390422 - DNA, 14 bp, Homo sapiens
ctcccctgccctgg

SEQ ID NO: 3390423 - DNA, 18 bp, Homo sapiens
ctcccctgctgcaggggc

SEQ ID NO: 3390424 - DNA, 22 bp, Homo sapiens
ctcccctggaagcgacccaggg

SEQ ID NO: 3390425 - DNA, 13 bp, Homo sapiens
ctcccctgggggt

SEQ ID NO: 3390426 - DNA, 21 bp, Homo sapiens
ctcccctgtttcaatcactgt

SEQ ID NO: 3390427 - DNA, 22 bp, Homo sapiens
ctccccttgatttaaacacaca

SEQ ID NO: 3390428 - DNA, 20 bp, Homo sapiens
ctccccttgccttcccctgt

SEQ ID NO: 3390429 - DNA, 18 bp, Homo sapiens
ctcccgaatagctgggac

SEQ ID NO: 3390430 - DNA, 18 bp, Homo sapiens
ctcccgagtagctgggac

SEQ ID NO: 3390431 - DNA, 17 bp, Homo sapiens
ctcccgattcccaactg

SEQ ID NO: 3390432 - DNA, 20 bp, Homo sapiens
ctcccggaggttgggtgggc

SEQ ID NO: 3390433 - DNA, 13 bp, Homo sapiens
ctcccggctgcct

SEQ ID NO: 3390434 - DNA, 15 bp, Homo sapiens
ctcccggtgcccaag

SEQ ID NO: 3390435 - DNA, 17 bp, Homo sapiens
ctcccgtagtctcctgg

SEQ ID NO: 3390436 - DNA, 21 bp, Homo sapiens
ctccctagccagcacttgtat

SEQ ID NO: 3390437 - DNA, 23 bp, Homo sapiens
ctccctatctaaccctcccatgg

SEQ ID NO: 3390438 - DNA, 14 bp, Homo sapiens
ctccctatgtctgc

SEQ ID NO: 3390439 - DNA, 18 bp, Homo sapiens
ctccctatgtctgcaaag

SEQ ID NO: 3390440 - DNA, 21 bp, Homo sapiens
ctccctcacaagcgctcccag

SEQ ID NO: 3390441 - DNA, 15 bp, Homo sapiens
ctccctcagcctcag

SEQ ID NO: 3390442 - DNA, 16 bp, Homo sapiens
ctccctcagcctcaga

SEQ ID NO: 3390443 - DNA, 19 bp, Homo sapiens
ctccctcagcctcagagga

SEQ ID NO: 3390444 - DNA, 19 bp, Homo sapiens
ctccctcagctctctggga

SEQ ID NO: 3390445 - DNA, 23 bp, Homo sapiens
ctccctcagtgccctcattttat

SEQ ID NO: 3390446 - DNA, 14 bp, Homo sapiens
ctccctcatcggcc

SEQ ID NO: 3390447 - DNA, 13 bp, Homo sapiens
ctccctcattcca

SEQ ID NO: 3390448 - DNA, 16 bp, Homo sapiens
ctccctccccgtctca

SEQ ID NO: 3390449 - DNA, 16 bp, Homo sapiens
ctccctcccctgccct

SEQ ID NO: 3390450 - DNA, 22 bp, Homo sapiens
ctccctcccgtagtctcctggg

SEQ ID NO: 3390451 - DNA, 17 bp, Homo sapiens
ctccctccggcttgacc

SEQ ID NO: 3390452 - DNA, 19 bp, Homo sapiens
ctccctcctcacctctgga

SEQ ID NO: 3390453 - DNA, 15 bp, Homo sapiens
ctccctcctgccgct

SEQ ID NO: 3390454 - DNA, 14 bp, Homo sapiens
ctccctccttgggt

SEQ ID NO: 3390455 - DNA, 22 bp, Homo sapiens
ctccctccttgggtcattgacc

SEQ ID NO: 3390456 - DNA, 16 bp, Homo sapiens
ctccctctcccaggcc

SEQ ID NO: 3390457 - DNA, 15 bp, Homo sapiens
ctccctctccctgtc

SEQ ID NO: 3390458 - DNA, 15 bp, Homo sapiens
ctccctctctcttct

SEQ ID NO: 3390459 - DNA, 16 bp, Homo sapiens
ctccctctctcttctg

SEQ ID NO: 3390460 - DNA, 16 bp, Homo sapiens
ctccctctctggtttc

SEQ ID NO: 3390461 - DNA, 14 bp, Homo sapiens
ctccctctgcccca

SEQ ID NO: 3390462 - DNA, 21 bp, Homo sapiens
ctccctctgccccaagcagcc

SEQ ID NO: 3390463 - DNA, 23 bp, Homo sapiens
ctccctctgccccaagcagccag

SEQ ID NO: 3390464 - DNA, 18 bp, Homo sapiens
ctccctctgtccaccagc

SEQ ID NO: 3390465 - DNA, 14 bp, Homo sapiens
ctccctcttccaaa

SEQ ID NO: 3390466 - DNA, 11 bp, Homo sapiens
ctccctcttgt

SEQ ID NO: 3390467 - DNA, 19 bp, Homo sapiens
ctccctgaaccatccctga

SEQ ID NO: 3390468 - DNA, 14 bp, Homo sapiens
ctccctgaagccag

SEQ ID NO: 3390469 - DNA, 17 bp, Homo sapiens
ctccctgaagccagcct

SEQ ID NO: 3390470 - DNA, 17 bp, Homo sapiens
ctccctgactccctgtg

SEQ ID NO: 3390471 - DNA, 20 bp, Homo sapiens
ctccctgactccctgtgggg

SEQ ID NO: 3390472 - DNA, 19 bp, Homo sapiens
ctccctgccaagtctcaga

SEQ ID NO: 3390473 - DNA, 13 bp, Homo sapiens
ctccctgccagag

SEQ ID NO: 3390474 - DNA, 14 bp, Homo sapiens
ctccctgccagagg

SEQ ID NO: 3390475 - DNA, 19 bp, Homo sapiens
ctccctgccagaggggaag

SEQ ID NO: 3390476 - DNA, 15 bp, Homo sapiens
ctccctgccccaaat

SEQ ID NO: 3390477 - DNA, 12 bp, Homo sapiens
ctccctgccccc

SEQ ID NO: 3390478 - DNA, 14 bp, Homo sapiens
ctccctgcccccca

SEQ ID NO: 3390479 - DNA, 13 bp, Homo sapiens
ctctaattttgga

SEQ ID NO: 3390480 - DNA, 17 bp, Homo sapiens
ctctaattttggataat

SEQ ID NO: 3390481 - DNA, 14 bp, Homo sapiens
ctctacagaggcca

SEQ ID NO: 3390482 - DNA, 16 bp, Homo sapiens
ctctacagaggccatg

SEQ ID NO: 3390483 - DNA, 21 bp, Homo sapiens
ctctacagctaatcagcattc

SEQ ID NO: 3390484 - DNA, 13 bp, Homo sapiens
ctctacagtgcca

SEQ ID NO: 3390485 - DNA, 17 bp, Homo sapiens
ctctacatcttctgcct

SEQ ID NO: 3390486 - DNA, 18 bp, Homo sapiens
ctctacatcttctgcctt

SEQ ID NO: 3390487 - DNA, 13 bp, Homo sapiens
ctctacatgctct

SEQ ID NO: 3390488 - DNA, 15 bp, Homo sapiens
ctctacatttaaaca

SEQ ID NO: 3390489 - DNA, 14 bp, Homo sapiens
ctctaccaaataat

SEQ ID NO: 3390490 - DNA, 14 bp, Homo sapiens
ctctacccaaaccc

SEQ ID NO: 3390491 - DNA, 17 bp, Homo sapiens
ctctacccaaaccctag

SEQ ID NO: 3390492 - DNA, 18 bp, Homo sapiens
ctctacccaaaccctagg

SEQ ID NO: 3390493 - DNA, 13 bp, Homo sapiens
ctctacccctttc

SEQ ID NO: 3390494 - DNA, 16 bp, Homo sapiens
ctctacccctttcttc

SEQ ID NO: 3390495 - DNA, 17 bp, Homo sapiens
ctctaccctcccacccc

SEQ ID NO: 3390496 - DNA, 22 bp, Homo sapiens
ctctacctaatgtctcactgtt

SEQ ID NO: 3390497 - DNA, 23 bp, Homo sapiens
ctctacctccttagctttccctg

SEQ ID NO: 3390498 - DNA, 16 bp, Homo sapiens
ctctactaaaaatgca

SEQ ID NO: 3390499 - DNA, 18 bp, Homo sapiens
ctctactaccacaaggaa

SEQ ID NO: 3390500 - DNA, 16 bp, Homo sapiens
ctctacttagcatgtc

SEQ ID NO: 3390501 - DNA, 19 bp, Homo sapiens
ctctacttagcatgtccct

SEQ ID NO: 3390502 - DNA, 15 bp, Homo sapiens
ctctagaagccaagg

SEQ ID NO: 3390503 - DNA, 22 bp, Homo sapiens
ctctagaagccaagggaaaggg

SEQ ID NO: 3390504 - DNA, 15 bp, Homo sapiens
ctctagagtccaagg

SEQ ID NO: 3390505 - DNA, 14 bp, Homo sapiens
ctctagatcataag

SEQ ID NO: 3390506 - DNA, 12 bp, Homo sapiens
ctctagattcca

SEQ ID NO: 3390507 - DNA, 17 bp, Homo sapiens
ctctagcagcacctcct

SEQ ID NO: 3390508 - DNA, 20 bp, Homo sapiens
ctctagccaggagtctgtgc

SEQ ID NO: 3390509 - DNA, 21 bp, Homo sapiens
ctctagccaggagtctgtgct

SEQ ID NO: 3390510 - DNA, 21 bp, Homo sapiens
ctctagcctgggccagagaag

SEQ ID NO: 3390511 - DNA, 14 bp, Homo sapiens
ctctagctggcagg

SEQ ID NO: 3390512 - DNA, 21 bp, Homo sapiens
ctctaggaagacatttttccg

SEQ ID NO: 3390513 - DNA, 18 bp, Homo sapiens
ctctaggagggagccttg

SEQ ID NO: 3390514 - DNA, 14 bp, Homo sapiens
ctctaggcaagcag

SEQ ID NO: 3390515 - DNA, 18 bp, Homo sapiens
ctctaggcaagcaggacc

SEQ ID NO: 3390516 - DNA, 16 bp, Homo sapiens
ctctaggcctctccag

SEQ ID NO: 3390517 - DNA, 17 bp, Homo sapiens
ctctaggcctctccagt

SEQ ID NO: 3390518 - DNA, 17 bp, Homo sapiens
ctctaggggtcaggctc

SEQ ID NO: 3390519 - DNA, 20 bp, Homo sapiens
ctctaggggtcaggctccat

SEQ ID NO: 3390520 - DNA, 12 bp, Homo sapiens
ctctagggtcca

SEQ ID NO: 3390521 - DNA, 23 bp, Homo sapiens
ctctaggtacgatgacagtgttc

SEQ ID NO: 3390522 - DNA, 14 bp, Homo sapiens
ctctaggttataca

SEQ ID NO: 3390523 - DNA, 16 bp, Homo sapiens
ctctaggttatacaat

SEQ ID NO: 3390524 - DNA, 19 bp, Homo sapiens
ctctaggttatacaataac

SEQ ID NO: 3390525 - DNA, 13 bp, Homo sapiens
ctctagtgccctc

SEQ ID NO: 3390526 - DNA, 21 bp, Homo sapiens
ctctagtgccctccacagccg

SEQ ID NO: 3390527 - DNA, 16 bp, Homo sapiens
ctctagtgggacagcc

SEQ ID NO: 3390528 - DNA, 15 bp, Homo sapiens
ctctagttctttgtt

SEQ ID NO: 3390529 - DNA, 22 bp, Homo sapiens
ctctataacagatcctttcaaa

SEQ ID NO: 3390530 - DNA, 22 bp, Homo sapiens
ctctataagcaaattgcttttt

SEQ ID NO: 3390531 - DNA, 16 bp, Homo sapiens
ctctatattatgtctt

SEQ ID NO: 3390532 - DNA, 22 bp, Homo sapiens
ctctatattatgtcttcttttg

SEQ ID NO: 3390533 - DNA, 14 bp, Homo sapiens
ctctatctgggcct

SEQ ID NO: 3390534 - DNA, 15 bp, Homo sapiens
ctctatctgggcctg

SEQ ID NO: 3390535 - DNA, 17 bp, Homo sapiens
ctctatctgggcctggg

SEQ ID NO: 3390536 - DNA, 13 bp, Homo sapiens
ctctatgagtcta

SEQ ID NO: 3390537 - DNA, 19 bp, Homo sapiens
ctctatgagtctagatgtt

SEQ ID NO: 3390538 - DNA, 18 bp, Homo sapiens
ctctattaagatttccaa

SEQ ID NO: 3390539 - DNA, 20 bp, Homo sapiens
ctctattgtagcatttcttg

SEQ ID NO: 3390540 - DNA, 10 bp, Homo sapiens
ctctatttaa

SEQ ID NO: 3390541 - DNA, 16 bp, Homo sapiens
ctctatttaaattctt

SEQ ID NO: 3390542 - DNA, 17 bp, Homo sapiens
ctctatttaaattcttt

SEQ ID NO: 3390543 - DNA, 18 bp, Homo sapiens
ctctatttaaattctttt

SEQ ID NO: 3390544 - DNA, 13 bp, Homo sapiens
ctctatttaatat

SEQ ID NO: 3390545 - DNA, 17 bp, Homo sapiens
ctctatttatgtttgca

SEQ ID NO: 3390546 - DNA, 16 bp, Homo sapiens
ctctatttattagcca

SEQ ID NO: 3390547 - DNA, 13 bp, Homo sapiens
ctctatttctgga

SEQ ID NO: 3390548 - DNA, 13 bp, Homo sapiens
ctctattttgtga

SEQ ID NO: 3390549 - DNA, 16 bp, Homo sapiens
ctctcaagtagctggg

SEQ ID NO: 3390550 - DNA, 16 bp, Homo sapiens
ctctcaatatgcttac

SEQ ID NO: 3390551 - DNA, 23 bp, Homo sapiens
ctctcaattaaagtctattcaaa

SEQ ID NO: 3390552 - DNA, 14 bp, Homo sapiens
ctctcacacacata

SEQ ID NO: 3390553 - DNA, 13 bp, Homo sapiens
ctctcacatgtgg

SEQ ID NO: 3390554 - DNA, 13 bp, Homo sapiens
ctctcacccccat

SEQ ID NO: 3390555 - DNA, 16 bp, Homo sapiens
ctctcacccccatccc

SEQ ID NO: 3390556 - DNA, 21 bp, Homo sapiens
ctctcactaaactttacccaa

SEQ ID NO: 3390557 - DNA, 17 bp, Homo sapiens
ctctcactcacattttc

SEQ ID NO: 3390558 - DNA, 18 bp, Homo sapiens
ctctcactcacattttct

SEQ ID NO: 3390559 - DNA, 12 bp, Homo sapiens
ctctcactcctg

SEQ ID NO: 3390560 - DNA, 14 bp, Homo sapiens
ctctcactcctgcc

SEQ ID NO: 3390561 - DNA, 22 bp, Homo sapiens
ctctcagagcatctggctgttt

SEQ ID NO: 3390562 - DNA, 22 bp, Homo sapiens
ctctcagaggcctgctgccagt

SEQ ID NO: 3390563 - DNA, 15 bp, Homo sapiens
ctctcagcccagaag

SEQ ID NO: 3390564 - DNA, 14 bp, Homo sapiens
ctctcagcctccca

SEQ ID NO: 3390565 - DNA, 13 bp, Homo sapiens
ctctcaggagcac

SEQ ID NO: 3390566 - DNA, 16 bp, Homo sapiens
ctctcaggagcacagg

SEQ ID NO: 3390567 - DNA, 18 bp, Homo sapiens
ctctcaggagcacaggca

SEQ ID NO: 3390568 - DNA, 20 bp, Homo sapiens
ctctcaggagcacaggcagc

SEQ ID NO: 3390569 - DNA, 20 bp, Homo sapiens
ctctcagggcctggcaggcc

SEQ ID NO: 3390570 - DNA, 23 bp, Homo sapiens
ctctcagggcctggcaggccagt

SEQ ID NO: 3390571 - DNA, 23 bp, Homo sapiens
ctctcagtgaaggtggggagaag

SEQ ID NO: 3390572 - DNA, 13 bp, Homo sapiens
ctctcagtgtttt

SEQ ID NO: 3390573 - DNA, 17 bp, Homo sapiens
ctctcagttctctccct

SEQ ID NO: 3390574 - DNA, 21 bp, Homo sapiens
ctctcagttctctcccttcct

SEQ ID NO: 3390575 - DNA, 21 bp, Homo sapiens
ctctcatctgatcacttcatg

SEQ ID NO: 3390576 - DNA, 22 bp, Homo sapiens
ctctcatggtacctgctcatgg

SEQ ID NO: 3390577 - DNA, 13 bp, Homo sapiens
ctctccaagggct

SEQ ID NO: 3390578 - DNA, 22 bp, Homo sapiens
ctctccaagggcttctgcaccc

SEQ ID NO: 3390579 - DNA, 16 bp, Homo sapiens
ctctccaagtctctct

SEQ ID NO: 3390580 - DNA, 20 bp, Homo sapiens
ctctccaagtctctctgtga

SEQ ID NO: 3390581 - DNA, 15 bp, Homo sapiens
ctctccaagtgccag

SEQ ID NO: 3390582 - DNA, 19 bp, Homo sapiens
ctctccaagtgccagaggt

SEQ ID NO: 3390583 - DNA, 16 bp, Homo sapiens
ctctccaccctggctg

SEQ ID NO: 3390584 - DNA, 18 bp, Homo sapiens
ctctccaccctggctggg

SEQ ID NO: 3390585 - DNA, 19 bp, Homo sapiens
ctctccaccctggctggga

SEQ ID NO: 3390586 - DNA, 15 bp, Homo sapiens
ctctccactgccttc

SEQ ID NO: 3390587 - DNA, 14 bp, Homo sapiens
ctctccagcctgac

SEQ ID NO: 3390588 - DNA, 15 bp, Homo sapiens
ctctccagctccaag

SEQ ID NO: 3390589 - DNA, 16 bp, Homo sapiens
ctctccagctgactaa

SEQ ID NO: 3390590 - DNA, 14 bp, Homo sapiens
ctctccaggcacca

SEQ ID NO: 3390591 - DNA, 20 bp, Homo sapiens
ctctccagtttgcacctgtc

SEQ ID NO: 3390592 - DNA, 13 bp, Homo sapiens
ctctcccacagag

SEQ ID NO: 3390593 - DNA, 23 bp, Homo sapiens
ctctcccacagagtgctggactg

SEQ ID NO: 3390594 - DNA, 21 bp, Homo sapiens
ctctcccaccccggcctccac

SEQ ID NO: 3390595 - DNA, 12 bp, Homo sapiens
ctctcccatccc

SEQ ID NO: 3390596 - DNA, 16 bp, Homo sapiens
ctctcccatccccctg

SEQ ID NO: 3390597 - DNA, 15 bp, Homo sapiens
ctctccccacactaa

SEQ ID NO: 3390598 - DNA, 18 bp, Homo sapiens
ctctccccacgagggctg

SEQ ID NO: 3390599 - DNA, 19 bp, Homo sapiens
ctctccccacgagggctgg

SEQ ID NO: 3390600 - DNA, 22 bp, Homo sapiens
ctctccccagcaagtgagagct

SEQ ID NO: 3390601 - DNA, 24 bp, Homo sapiens
ctctccccagcaagtgagagctgg

SEQ ID NO: 3390602 - DNA, 20 bp, Homo sapiens
ctctccccaggtccagctct

SEQ ID NO: 3390603 - DNA, 23 bp, Homo sapiens
ctctccccaggtccagctctgga

SEQ ID NO: 3390604 - DNA, 17 bp, Homo sapiens
ctctccccctatttatt

SEQ ID NO: 3390605 - DNA, 22 bp, Homo sapiens
ctcttctctccagctgactaaa

SEQ ID NO: 3390606 - DNA, 13 bp, Homo sapiens
ctcttctctgcaa

SEQ ID NO: 3390607 - DNA, 17 bp, Homo sapiens
ctcttctctgcaatgct

SEQ ID NO: 3390608 - DNA, 22 bp, Homo sapiens
ctcttctgacgtgccttttgca

SEQ ID NO: 3390609 - DNA, 23 bp, Homo sapiens
ctcttctgagctatttcatctat

SEQ ID NO: 3390610 - DNA, 12 bp, Homo sapiens
ctcttctgctcc

SEQ ID NO: 3390611 - DNA, 14 bp, Homo sapiens
ctcttctgctccac

SEQ ID NO: 3390612 - DNA, 19 bp, Homo sapiens
ctcttctgctccacccttg

SEQ ID NO: 3390613 - DNA, 20 bp, Homo sapiens
ctcttctgctccacccttgg

SEQ ID NO: 3390614 - DNA, 20 bp, Homo sapiens
ctcttctgcttaggagagac

SEQ ID NO: 3390615 - DNA, 23 bp, Homo sapiens
ctcttcttactcattactgcaaa

SEQ ID NO: 3390616 - DNA, 12 bp, Homo sapiens
ctcttgaacatt

SEQ ID NO: 3390617 - DNA, 12 bp, Homo sapiens
ctcttgaagagg

SEQ ID NO: 3390618 - DNA, 22 bp, Homo sapiens
ctcttgacattccactgtgcgt

SEQ ID NO: 3390619 - DNA, 13 bp, Homo sapiens
ctcttgacctcag

SEQ ID NO: 3390620 - DNA, 22 bp, Homo sapiens
ctcttgagcagtggctggtcca

SEQ ID NO: 3390621 - DNA, 19 bp, Homo sapiens
ctcttgatacccccctctg

SEQ ID NO: 3390622 - DNA, 20 bp, Homo sapiens
ctcttgatggtggactaagc

SEQ ID NO: 3390623 - DNA, 21 bp, Homo sapiens
ctcttgatggtggactaagca

SEQ ID NO: 3390624 - DNA, 13 bp, Homo sapiens
ctcttgatgtgaa

SEQ ID NO: 3390625 - DNA, 21 bp, Homo sapiens
ctcttgattatccatattgag

SEQ ID NO: 3390626 - DNA, 13 bp, Homo sapiens
ctcttgcacccgc

SEQ ID NO: 3390627 - DNA, 14 bp, Homo sapiens
ctcttgcacccgcc

SEQ ID NO: 3390628 - DNA, 16 bp, Homo sapiens
ctcttgccactgcctc

SEQ ID NO: 3390629 - DNA, 18 bp, Homo sapiens
ctcttgccactgcctctt

SEQ ID NO: 3390630 - DNA, 19 bp, Homo sapiens
ctcttgccactgcctcttc

SEQ ID NO: 3390631 - DNA, 15 bp, Homo sapiens
ctcttgcccatcctg

SEQ ID NO: 3390632 - DNA, 14 bp, Homo sapiens
ctcttgcccttccc

SEQ ID NO: 3390633 - DNA, 17 bp, Homo sapiens
ctcttgcccttccctgt

SEQ ID NO: 3390634 - DNA, 20 bp, Homo sapiens
ctcttgcccttccctgtccc

SEQ ID NO: 3390635 - DNA, 22 bp, Homo sapiens
ctcttgcccttccctgtccctc

SEQ ID NO: 3390636 - DNA, 21 bp, Homo sapiens
ctcttgccgaggagccaggca

SEQ ID NO: 3390637 - DNA, 14 bp, Homo sapiens
ctcttgcctctctc

SEQ ID NO: 3390638 - DNA, 21 bp, Homo sapiens
ctcttgctaatcagtgtctca

SEQ ID NO: 3390639 - DNA, 12 bp, Homo sapiens
ctcttgctcttt

SEQ ID NO: 3390640 - DNA, 13 bp, Homo sapiens
ctcttgctctttc

SEQ ID NO: 3390641 - DNA, 14 bp, Homo sapiens
ctcttgctgtctct

SEQ ID NO: 3390642 - DNA, 19 bp, Homo sapiens
ctcttgctgtctctgctcg

SEQ ID NO: 3390643 - DNA, 13 bp, Homo sapiens
ctcttgcttgtca

SEQ ID NO: 3390644 - DNA, 16 bp, Homo sapiens
ctcttgctttatacta

SEQ ID NO: 3390645 - DNA, 15 bp, Homo sapiens
ctcttggagctgtga

SEQ ID NO: 3390646 - DNA, 14 bp, Homo sapiens
ctcttggcctttgc

SEQ ID NO: 3390647 - DNA, 21 bp, Homo sapiens
ctcttgggaactgaactcact

SEQ ID NO: 3390648 - DNA, 16 bp, Homo sapiens
ctcttggtccctggtc

SEQ ID NO: 3390649 - DNA, 21 bp, Homo sapiens
ctcttggtgtgattgcacaga

SEQ ID NO: 3390650 - DNA, 22 bp, Homo sapiens
ctcttgtaaagactggttttct

SEQ ID NO: 3390651 - DNA, 21 bp, Homo sapiens
ctcttgtaagtcatctactta

SEQ ID NO: 3390652 - DNA, 16 bp, Homo sapiens
ctcttgtcccacgtgt

SEQ ID NO: 3390653 - DNA, 18 bp, Homo sapiens
ctcttgtcccacgtgtct

SEQ ID NO: 3390654 - DNA, 23 bp, Homo sapiens
ctcttgtcccacgtgtcttccac

SEQ ID NO: 3390655 - DNA, 16 bp, Homo sapiens
ctcttgtccctttccc

SEQ ID NO: 3390656 - DNA, 21 bp, Homo sapiens
ctcttgtccctttccctacct

SEQ ID NO: 3390657 - DNA, 17 bp, Homo sapiens
ctcttgtgatttcttta

SEQ ID NO: 3390658 - DNA, 22 bp, Homo sapiens
ctcttgtgatttctttaaaaga

SEQ ID NO: 3390659 - DNA, 14 bp, Homo sapiens
ctcttgtgctggat

SEQ ID NO: 3390660 - DNA, 15 bp, Homo sapiens
ctcttgttttgtttg

SEQ ID NO: 3390661 - DNA, 17 bp, Homo sapiens
ctcttgttttgtttgtc

SEQ ID NO: 3390662 - DNA, 18 bp, Homo sapiens
ctcttgttttgtttgtct

SEQ ID NO: 3390663 - DNA, 13 bp, Homo sapiens
ctctttaaaaaca

SEQ ID NO: 3390664 - DNA, 15 bp, Homo sapiens
ctctttaacttctcg

SEQ ID NO: 3390665 - DNA, 19 bp, Homo sapiens
ctctttaagggcatgcctt

SEQ ID NO: 3390666 - DNA, 18 bp, Homo sapiens
ctctttaatgtcacaggc

SEQ ID NO: 3390667 - DNA, 21 bp, Homo sapiens
ctctttaatgtcacaggcagg

SEQ ID NO: 3390668 - DNA, 23 bp, Homo sapiens
ctctttaatgtcacaggcaggtc

SEQ ID NO: 3390669 - DNA, 20 bp, Homo sapiens
ctctttactcccttcctggc

SEQ ID NO: 3390670 - DNA, 14 bp, Homo sapiens
ctctttcacattgt

SEQ ID NO: 3390671 - DNA, 16 bp, Homo sapiens
ctctttcacattgttt

SEQ ID NO: 3390672 - DNA, 16 bp, Homo sapiens
ctctttccctaggaaa

SEQ ID NO: 3390673 - DNA, 12 bp, Homo sapiens
ctctttccctgc

SEQ ID NO: 3390674 - DNA, 14 bp, Homo sapiens
ctctttctctcttc

SEQ ID NO: 3390675 - DNA, 14 bp, Homo sapiens
ctctttctgtatat

SEQ ID NO: 3390676 - DNA, 15 bp, Homo sapiens
ctctttctgtatata

SEQ ID NO: 3390677 - DNA, 15 bp, Homo sapiens
ctctttcttcctttc

SEQ ID NO: 3390678 - DNA, 13 bp, Homo sapiens
ctctttgaaacaa

SEQ ID NO: 3390679 - DNA, 23 bp, Homo sapiens
ctctttggtctattttctgcaga

SEQ ID NO: 3390680 - DNA, 12 bp, Homo sapiens
ctctttgtaaga

SEQ ID NO: 3390681 - DNA, 20 bp, Homo sapiens
ctctttgtaatttaatgaaa

SEQ ID NO: 3390682 - DNA, 22 bp, Homo sapiens
ctctttgtaatttaatgaaaag

SEQ ID NO: 3390683 - DNA, 17 bp, Homo sapiens
ctcttttcacatttttt

SEQ ID NO: 3390684 - DNA, 11 bp, Homo sapiens
ctcttttcatt

SEQ ID NO: 3390685 - DNA, 14 bp, Homo sapiens
ctcttttccccgcc

SEQ ID NO: 3390686 - DNA, 22 bp, Homo sapiens
ctcttttcctttggtccttcaa

SEQ ID NO: 3390687 - DNA, 18 bp, Homo sapiens
ctcttttctttagagcat

SEQ ID NO: 3390688 - DNA, 21 bp, Homo sapiens
ctcttttgcttgccaaagtac

SEQ ID NO: 3390689 - DNA, 16 bp, Homo sapiens
ctcttttgctttctgt

SEQ ID NO: 3390690 - DNA, 10 bp, Homo sapiens
ctcttttgta

SEQ ID NO: 3390691 - DNA, 14 bp, Homo sapiens
ctcttttgtaaatt

SEQ ID NO: 3390692 - DNA, 19 bp, Homo sapiens
ctcttttgttaaataatat

SEQ ID NO: 3390693 - DNA, 18 bp, Homo sapiens
ctctttttagggccaggc

SEQ ID NO: 3390694 - DNA, 18 bp, Homo sapiens
ctctttttctaaagtgtt

SEQ ID NO: 3390695 - DNA, 13 bp, Homo sapiens
ctctttttgtttg

SEQ ID NO: 3390696 - DNA, 15 bp, Homo sapiens
ctcttttttactcat

SEQ ID NO: 3390697 - DNA, 16 bp, Homo sapiens
ctcttttttactcatt

SEQ ID NO: 3390698 - DNA, 16 bp, Homo sapiens
ctctttttttaaaagg

SEQ ID NO: 3390699 - DNA, 14 bp, Homo sapiens
ctctttttttcttt

SEQ ID NO: 3390700 - DNA, 16 bp, Homo sapiens
ctctttttttcttttc

SEQ ID NO: 3390701 - DNA, 20 bp, Homo sapiens
ctgaaaaaaaaaaagaagaa

SEQ ID NO: 3390702 - DNA, 21 bp, Homo sapiens
ctgaaaaaaaaaaagaagaag

SEQ ID NO: 3390703 - DNA, 15 bp, Homo sapiens
ctgaaaaaaagttta

SEQ ID NO: 3390704 - DNA, 20 bp, Homo sapiens
ctgaaaaaaagtttacaagt

SEQ ID NO: 3390705 - DNA, 22 bp, Homo sapiens
ctgaaaaaacacctagctttat

SEQ ID NO: 3390706 - DNA, 20 bp, Homo sapiens
ctgaaaacatttcaaagctg

SEQ ID NO: 3390707 - DNA, 19 bp, Homo sapiens
ctgaaaacctaagtccttt

SEQ ID NO: 3390708 - DNA, 14 bp, Homo sapiens
ctgaaaacctacca

SEQ ID NO: 3390709 - DNA, 18 bp, Homo sapiens
ctgaaaagaaggaaagat

SEQ ID NO: 3390710 - DNA, 22 bp, Homo sapiens
ctgaaaagtgtgtatatatttt

SEQ ID NO: 3390711 - DNA, 15 bp, Homo sapiens
ctgaaaatatctctt

SEQ ID NO: 3390712 - DNA, 17 bp, Homo sapiens
ctgaaaatctaatatta

SEQ ID NO: 3390713 - DNA, 20 bp, Homo sapiens
ctgaaaatctaatattaaaa

SEQ ID NO: 3390714 - DNA, 20 bp, Homo sapiens
ctgaaaatgcaaagctgaag

SEQ ID NO: 3390715 - DNA, 12 bp, Homo sapiens
ctgaaaatgtaa

SEQ ID NO: 3390716 - DNA, 14 bp, Homo sapiens
ctgaaaatgtttaa

SEQ ID NO: 3390717 - DNA, 23 bp, Homo sapiens
ctgaaacaaaaattgtctttatg

SEQ ID NO: 3390718 - DNA, 19 bp, Homo sapiens
ctgaaacacgaaacttgtt

SEQ ID NO: 3390719 - DNA, 17 bp, Homo sapiens
ctgaaacagacatgaaa

SEQ ID NO: 3390720 - DNA, 20 bp, Homo sapiens
ctgaaacattccgaagaggg

SEQ ID NO: 3390721 - DNA, 15 bp, Homo sapiens
ctgaaaccaaaacat

SEQ ID NO: 3390722 - DNA, 15 bp, Homo sapiens
ctgaaaccattttcc

SEQ ID NO: 3390723 - DNA, 16 bp, Homo sapiens
ctgaaacctctgcctt

SEQ ID NO: 3390724 - DNA, 11 bp, Homo sapiens
ctgaaagacaa

SEQ ID NO: 3390725 - DNA, 14 bp, Homo sapiens
ctgaaagaggccaa

SEQ ID NO: 3390726 - DNA, 14 bp, Homo sapiens
ctgaaagcagcagc

SEQ ID NO: 3390727 - DNA, 16 bp, Homo sapiens
ctgaaagcagcagcta

SEQ ID NO: 3390728 - DNA, 22 bp, Homo sapiens
ctgaaagcagcagctaggactg

SEQ ID NO: 3390729 - DNA, 23 bp, Homo sapiens
ctgaaagccagctgccgaccaga

SEQ ID NO: 3390730 - DNA, 22 bp, Homo sapiens
ctgaaagggcacttaatttgta

SEQ ID NO: 3390731 - DNA, 16 bp, Homo sapiens
ctgaggtctgtttctc

SEQ ID NO: 3390732 - DNA, 17 bp, Homo sapiens
ctgaggtgaaagggagc

SEQ ID NO: 3390733 - DNA, 19 bp, Homo sapiens
ctgaggtgcctgtcccacc

SEQ ID NO: 3390734 - DNA, 14 bp, Homo sapiens
ctgaggtgggcaga

SEQ ID NO: 3390735 - DNA, 14 bp, Homo sapiens
ctgaggtgggccca

SEQ ID NO: 3390736 - DNA, 20 bp, Homo sapiens
ctgaggtgggcccaggacca

SEQ ID NO: 3390737 - DNA, 17 bp, Homo sapiens
ctgaggtgtgggggctg

SEQ ID NO: 3390738 - DNA, 21 bp, Homo sapiens
ctgaggtgtgggggctgcagc

SEQ ID NO: 3390739 - DNA, 22 bp, Homo sapiens
ctgaggtgtgggggctgcagca

SEQ ID NO: 3390740 - DNA, 15 bp, Homo sapiens
ctgaggttcctctgc

SEQ ID NO: 3390741 - DNA, 16 bp, Homo sapiens
ctgaggttcctctgcc

SEQ ID NO: 3390742 - DNA, 17 bp, Homo sapiens
ctgaggttcctctgcct

SEQ ID NO: 3390743 - DNA, 19 bp, Homo sapiens
ctgaggttcctctgcctgc

SEQ ID NO: 3390744 - DNA, 23 bp, Homo sapiens
ctgaggttcctctgcctgccccg

SEQ ID NO: 3390745 - DNA, 14 bp, Homo sapiens
ctgaggtttcaccc

SEQ ID NO: 3390746 - DNA, 14 bp, Homo sapiens
ctgagtaccagggg

SEQ ID NO: 3390747 - DNA, 16 bp, Homo sapiens
ctgagtaccaggggct

SEQ ID NO: 3390748 - DNA, 17 bp, Homo sapiens
ctgagtaccaggggctg

SEQ ID NO: 3390749 - DNA, 20 bp, Homo sapiens
ctgagtaccaggggctgggc

SEQ ID NO: 3390750 - DNA, 13 bp, Homo sapiens
ctgagtatgtgga

SEQ ID NO: 3390751 - DNA, 22 bp, Homo sapiens
ctgagtcacccatgaagacagg

SEQ ID NO: 3390752 - DNA, 23 bp, Homo sapiens
ctgagtcaccctacctgtgcctg

SEQ ID NO: 3390753 - DNA, 20 bp, Homo sapiens
ctgagtcacgctggggctct

SEQ ID NO: 3390754 - DNA, 16 bp, Homo sapiens
ctgagtcagggcccag

SEQ ID NO: 3390755 - DNA, 20 bp, Homo sapiens
ctgagtcccctccaggaaga

SEQ ID NO: 3390756 - DNA, 22 bp, Homo sapiens
ctgagtcctggtccctctgagg

SEQ ID NO: 3390757 - DNA, 18 bp, Homo sapiens
ctgagtcctgtctctgcc

SEQ ID NO: 3390758 - DNA, 19 bp, Homo sapiens
ctgagtcctgtctctgcct

SEQ ID NO: 3390759 - DNA, 20 bp, Homo sapiens
ctgagtcctgtctctgcctg

SEQ ID NO: 3390760 - DNA, 21 bp, Homo sapiens
ctgagtcctgtctctgcctgc

SEQ ID NO: 3390761 - DNA, 14 bp, Homo sapiens
ctgagtcggcccca

SEQ ID NO: 3390762 - DNA, 20 bp, Homo sapiens
ctgagtcggccccacatggg

SEQ ID NO: 3390763 - DNA, 21 bp, Homo sapiens
ctgagtcggccccacatggga

SEQ ID NO: 3390764 - DNA, 19 bp, Homo sapiens
ctgagtcgtacagaaagct

SEQ ID NO: 3390765 - DNA, 20 bp, Homo sapiens
ctgagtcgtacagaaagctg

SEQ ID NO: 3390766 - DNA, 21 bp, Homo sapiens
ctgagtcgtacagaaagctgc

SEQ ID NO: 3390767 - DNA, 17 bp, Homo sapiens
ctgagtgcaagttcatg

SEQ ID NO: 3390768 - DNA, 17 bp, Homo sapiens
ctgagtggaatgcaggg

SEQ ID NO: 3390769 - DNA, 18 bp, Homo sapiens
ctgagtggaatgcaggga

SEQ ID NO: 3390770 - DNA, 17 bp, Homo sapiens
ctgagtggccagccagt

SEQ ID NO: 3390771 - DNA, 18 bp, Homo sapiens
ctgagtggtggttccttt

SEQ ID NO: 3390772 - DNA, 15 bp, Homo sapiens
ctgagttacttgtct

SEQ ID NO: 3390773 - DNA, 18 bp, Homo sapiens
ctgagttacttgtctgag

SEQ ID NO: 3390774 - DNA, 19 bp, Homo sapiens
ctgagttacttgtctgagg

SEQ ID NO: 3390775 - DNA, 22 bp, Homo sapiens
ctgagttacttgtctgaggcct

SEQ ID NO: 3390776 - DNA, 11 bp, Homo sapiens
ctgagttgcca

SEQ ID NO: 3390777 - DNA, 20 bp, Homo sapiens
ctgagttgccaagacaaatc

SEQ ID NO: 3390778 - DNA, 20 bp, Homo sapiens
ctgagttggagctcattctg

SEQ ID NO: 3390779 - DNA, 21 bp, Homo sapiens
ctgagttggagctcattctgt

SEQ ID NO: 3390780 - DNA, 13 bp, Homo sapiens
ctgagttgttcta

SEQ ID NO: 3390781 - DNA, 17 bp, Homo sapiens
ctgagtttaccatttgt

SEQ ID NO: 3390782 - DNA, 20 bp, Homo sapiens
ctgagtttcattctcctgcc

SEQ ID NO: 3390783 - DNA, 11 bp, Homo sapiens
ctgagtttcct

SEQ ID NO: 3390784 - DNA, 19 bp, Homo sapiens
ctgataaaacaacagctcg

SEQ ID NO: 3390785 - DNA, 18 bp, Homo sapiens
ctgataaaagatggccat

SEQ ID NO: 3390786 - DNA, 16 bp, Homo sapiens
ctgataaagcacagct

SEQ ID NO: 3390787 - DNA, 17 bp, Homo sapiens
ctgataacttggggagg

SEQ ID NO: 3390788 - DNA, 20 bp, Homo sapiens
ctgataacttggggaggcaa

SEQ ID NO: 3390789 - DNA, 21 bp, Homo sapiens
ctgataagcttcctagaaagt

SEQ ID NO: 3390790 - DNA, 14 bp, Homo sapiens
ctgataataattga

SEQ ID NO: 3390791 - DNA, 16 bp, Homo sapiens
ctgatacataactaaa

SEQ ID NO: 3390792 - DNA, 17 bp, Homo sapiens
ctgatacataactaaat

SEQ ID NO: 3390793 - DNA, 20 bp, Homo sapiens
ctgatactttgacagtgttt

SEQ ID NO: 3390794 - DNA, 17 bp, Homo sapiens
ctgatataaattctgtg

SEQ ID NO: 3390795 - DNA, 16 bp, Homo sapiens
ctgatatgggactgag

SEQ ID NO: 3390796 - DNA, 13 bp, Homo sapiens
ctgatattaatca

SEQ ID NO: 3390797 - DNA, 15 bp, Homo sapiens
ctgatattaatcaaa

SEQ ID NO: 3390798 - DNA, 18 bp, Homo sapiens
ctgatcaagtcaccggag

SEQ ID NO: 3390799 - DNA, 21 bp, Homo sapiens
ctgatcacccaatgcatcacg

SEQ ID NO: 3390800 - DNA, 22 bp, Homo sapiens
ctgatcactagcctgtcatcct

SEQ ID NO: 3390801 - DNA, 14 bp, Homo sapiens
ctgatcactcccag

SEQ ID NO: 3390802 - DNA, 19 bp, Homo sapiens
ctgatcactcccagcactc

SEQ ID NO: 3390803 - DNA, 21 bp, Homo sapiens
ctgatcactcccagcactccc

SEQ ID NO: 3390804 - DNA, 22 bp, Homo sapiens
ctgatcagtgggcctccaagga

SEQ ID NO: 3390805 - DNA, 15 bp, Homo sapiens
ctgatcgtgctaaat

SEQ ID NO: 3390806 - DNA, 17 bp, Homo sapiens
ctgatcgtgctaaattt

SEQ ID NO: 3390807 - DNA, 21 bp, Homo sapiens
ctgatctcttcctgttttgta

SEQ ID NO: 3390808 - DNA, 12 bp, Homo sapiens
ctgatctgcgga

SEQ ID NO: 3390809 - DNA, 15 bp, Homo sapiens
ctgatctggctgcag

SEQ ID NO: 3390810 - DNA, 16 bp, Homo sapiens
ctgatcttgtgctcag

SEQ ID NO: 3390811 - DNA, 12 bp, Homo sapiens
ctgatgaaaaca

SEQ ID NO: 3390812 - DNA, 21 bp, Homo sapiens
ctgatgaactcttaatcaaat

SEQ ID NO: 3390813 - DNA, 18 bp, Homo sapiens
ctgatgacacccaccctg

SEQ ID NO: 3390814 - DNA, 17 bp, Homo sapiens
ctgatgagatttttaaa

SEQ ID NO: 3390815 - DNA, 20 bp, Homo sapiens
ctgatgatcaaaacctgtgc

SEQ ID NO: 3390816 - DNA, 12 bp, Homo sapiens
ctgatgcaagga

SEQ ID NO: 3390817 - DNA, 15 bp, Homo sapiens
ctgatgcaaggatta

SEQ ID NO: 3390818 - DNA, 17 bp, Homo sapiens
ctgatgccaaggggctg

SEQ ID NO: 3390819 - DNA, 13 bp, Homo sapiens
ctgatgccttttg

SEQ ID NO: 3390820 - DNA, 19 bp, Homo sapiens
ctgatgctccctcccctgc

SEQ ID NO: 3390821 - DNA, 23 bp, Homo sapiens
ctgatgctgagattcttcaggct

SEQ ID NO: 3390822 - DNA, 19 bp, Homo sapiens
ctgatgctgccccgttccc

SEQ ID NO: 3390823 - DNA, 14 bp, Homo sapiens
ctgatgctgggacc

SEQ ID NO: 3390824 - DNA, 16 bp, Homo sapiens
ctgatgctgggaccct

SEQ ID NO: 3390825 - DNA, 17 bp, Homo sapiens
ctgatgctgttctcttc

SEQ ID NO: 3390826 - DNA, 11 bp, Homo sapiens
ctgatggccaa

SEQ ID NO: 3390827 - DNA, 13 bp, Homo sapiens
ctgatggccaaga

SEQ ID NO: 3390828 - DNA, 15 bp, Homo sapiens
ctgatggccaagggg

SEQ ID NO: 3390829 - DNA, 18 bp, Homo sapiens
ctgatggccaagggggtg

SEQ ID NO: 3390830 - DNA, 13 bp, Homo sapiens
ctgatggctgccc

SEQ ID NO: 3390831 - DNA, 17 bp, Homo sapiens
ctgatggctgcccctgc

SEQ ID NO: 3390832 - DNA, 13 bp, Homo sapiens
ctgatggcttgac

SEQ ID NO: 3390833 - DNA, 20 bp, Homo sapiens
ctgatggcttgacatgtgca

SEQ ID NO: 3390834 - DNA, 23 bp, Homo sapiens
ctgatgggcaacccccagcctgc

SEQ ID NO: 3390835 - DNA, 16 bp, Homo sapiens
ctgatggtcagctccc

SEQ ID NO: 3390836 - DNA, 19 bp, Homo sapiens
ctgatggtgagctgggaag

SEQ ID NO: 3390837 - DNA, 14 bp, Homo sapiens
ctgatgtcaaagtg

SEQ ID NO: 3390838 - DNA, 18 bp, Homo sapiens
ctgatgtctctaaagcac

SEQ ID NO: 3390839 - DNA, 19 bp, Homo sapiens
ctgatgtctctaaagcact

SEQ ID NO: 3390840 - DNA, 19 bp, Homo sapiens
ctgatgtgtgttgtcagcc

SEQ ID NO: 3390841 - DNA, 20 bp, Homo sapiens
ctgatgtgtgttgtcagcct

SEQ ID NO: 3390842 - DNA, 21 bp, Homo sapiens
ctgatgtgtgttgtcagcctg

SEQ ID NO: 3390843 - DNA, 15 bp, Homo sapiens
ctgatgttactagcc

SEQ ID NO: 3390844 - DNA, 16 bp, Homo sapiens
ctgattaatatattta

SEQ ID NO: 3390845 - DNA, 14 bp, Homo sapiens
ctgattatgaaatg

SEQ ID NO: 3390846 - DNA, 18 bp, Homo sapiens
ctgattcccaagctctgc

SEQ ID NO: 3390847 - DNA, 19 bp, Homo sapiens
ctgattcccaagctctgct

SEQ ID NO: 3390848 - DNA, 20 bp, Homo sapiens
ctgattcccaagctctgctc

SEQ ID NO: 3390849 - DNA, 22 bp, Homo sapiens
ctgattcccaagctctgctcct

SEQ ID NO: 3390850 - DNA, 15 bp, Homo sapiens
ctgattctggcttta

SEQ ID NO: 3390851 - DNA, 18 bp, Homo sapiens
ctgattctggctttaagc

SEQ ID NO: 3390852 - DNA, 13 bp, Homo sapiens
ctgattctgggat

SEQ ID NO: 3390853 - DNA, 17 bp, Homo sapiens
ctgattgacctgctccg

SEQ ID NO: 3390854 - DNA, 20 bp, Homo sapiens
ctgattgacctgctccgctg

SEQ ID NO: 3390855 - DNA, 17 bp, Homo sapiens
ctgattggcttgtagaa

SEQ ID NO: 3390856 - DNA, 18 bp, Homo sapiens
ctgattggcttgtagaat

SEQ ID NO: 3390857 - DNA, 20 bp, Homo sapiens
ctgccctcattactgggcct

SEQ ID NO: 3390858 - DNA, 22 bp, Homo sapiens
ctgccctccagctgctgctctc

SEQ ID NO: 3390859 - DNA, 17 bp, Homo sapiens
ctgccctcgtggccagc

SEQ ID NO: 3390860 - DNA, 15 bp, Homo sapiens
ctgccctctatttat

SEQ ID NO: 3390861 - DNA, 12 bp, Homo sapiens
ctgccctgagaa

SEQ ID NO: 3390862 - DNA, 13 bp, Homo sapiens
ctgccctgccact

SEQ ID NO: 3390863 - DNA, 13 bp, Homo sapiens
ctgccctgcctgc

SEQ ID NO: 3390864 - DNA, 11 bp, Homo sapiens
ctgccctgctg

SEQ ID NO: 3390865 - DNA, 17 bp, Homo sapiens
ctgccctggaacatcct

SEQ ID NO: 3390866 - DNA, 15 bp, Homo sapiens
ctgccctggaggaag

SEQ ID NO: 3390867 - DNA, 16 bp, Homo sapiens
ctgccctggaggaagt

SEQ ID NO: 3390868 - DNA, 13 bp, Homo sapiens
ctgccctggcagc

SEQ ID NO: 3390869 - DNA, 15 bp, Homo sapiens
ctgccctggcagcag

SEQ ID NO: 3390870 - DNA, 17 bp, Homo sapiens
ctgccctggcagcagca

SEQ ID NO: 3390871 - DNA, 12 bp, Homo sapiens
ctgccctggccc

SEQ ID NO: 3390872 - DNA, 13 bp, Homo sapiens
ctgccctggccct

SEQ ID NO: 3390873 - DNA, 17 bp, Homo sapiens
ctgccctggccctgagg

SEQ ID NO: 3390874 - DNA, 17 bp, Homo sapiens
ctgccctggctgctgcc

SEQ ID NO: 3390875 - DNA, 12 bp, Homo sapiens
ctgccctggtgc

SEQ ID NO: 3390876 - DNA, 13 bp, Homo sapiens
ctgccctggtgct

SEQ ID NO: 3390877 - DNA, 19 bp, Homo sapiens
ctgccctggtgctgccaca

SEQ ID NO: 3390878 - DNA, 21 bp, Homo sapiens
ctgccctggtgctgccacact

SEQ ID NO: 3390879 - DNA, 13 bp, Homo sapiens
ctgccctgtaccc

SEQ ID NO: 3390880 - DNA, 21 bp, Homo sapiens
ctgccctgtaccccagcactt

SEQ ID NO: 3390881 - DNA, 18 bp, Homo sapiens
ctgccctgtccctgtccc

SEQ ID NO: 3390882 - DNA, 21 bp, Homo sapiens
ctgccctgttcatgtgcctct

SEQ ID NO: 3390883 - DNA, 15 bp, Homo sapiens
ctgcccttgctgccc

SEQ ID NO: 3390884 - DNA, 17 bp, Homo sapiens
ctgcccttgctgcccgc

SEQ ID NO: 3390885 - DNA, 15 bp, Homo sapiens
ctgccgacatcagca

SEQ ID NO: 3390886 - DNA, 15 bp, Homo sapiens
ctgccgaccagagcc

SEQ ID NO: 3390887 - DNA, 22 bp, Homo sapiens
ctgccgacttggagactcctgg

SEQ ID NO: 3390888 - DNA, 23 bp, Homo sapiens
ctgccgacttggagactcctggt

SEQ ID NO: 3390889 - DNA, 14 bp, Homo sapiens
ctgccgagtgctct

SEQ ID NO: 3390890 - DNA, 19 bp, Homo sapiens
ctgccgcagacgggcacag

SEQ ID NO: 3390891 - DNA, 22 bp, Homo sapiens
ctgccgcagacgggcacagaca

SEQ ID NO: 3390892 - DNA, 17 bp, Homo sapiens
ctgccgccgcctcccgg

SEQ ID NO: 3390893 - DNA, 18 bp, Homo sapiens
ctgccgcctcccagcctg

SEQ ID NO: 3390894 - DNA, 18 bp, Homo sapiens
ctgccgctacctccctcc

SEQ ID NO: 3390895 - DNA, 16 bp, Homo sapiens
ctgccgctcctctcta

SEQ ID NO: 3390896 - DNA, 16 bp, Homo sapiens
ctgccgctgcaccacg

SEQ ID NO: 3390897 - DNA, 18 bp, Homo sapiens
ctgccgctgccgctgcac

SEQ ID NO: 3390898 - DNA, 19 bp, Homo sapiens
ctgccgctgccgctgcacc

SEQ ID NO: 3390899 - DNA, 14 bp, Homo sapiens
ctgccggctctttc

SEQ ID NO: 3390900 - DNA, 22 bp, Homo sapiens
ctgccggctctttccttgctca

SEQ ID NO: 3390901 - DNA, 21 bp, Homo sapiens
ctgccgggttctagtctcctt

SEQ ID NO: 3390902 - DNA, 22 bp, Homo sapiens
ctgccggtgggaccctgtccgg

SEQ ID NO: 3390903 - DNA, 15 bp, Homo sapiens
ctgccgtaatttaac

SEQ ID NO: 3390904 - DNA, 20 bp, Homo sapiens
ctgccgtgcattagcacaga

SEQ ID NO: 3390905 - DNA, 23 bp, Homo sapiens
ctgccgtgggcctgtcgtgccag

SEQ ID NO: 3390906 - DNA, 21 bp, Homo sapiens
ctgccgtggggccgccgcctc

SEQ ID NO: 3390907 - DNA, 17 bp, Homo sapiens
ctgcctaaccaggccca

SEQ ID NO: 3390908 - DNA, 15 bp, Homo sapiens
ctgcctagagtgtag

SEQ ID NO: 3390909 - DNA, 23 bp, Homo sapiens
ctgcctagagtgtagcctaaagg

SEQ ID NO: 3390910 - DNA, 17 bp, Homo sapiens
ctgcctagcaagctggc

SEQ ID NO: 3390911 - DNA, 18 bp, Homo sapiens
ctgcctagctgcctagca

SEQ ID NO: 3390912 - DNA, 17 bp, Homo sapiens
ctgcctattatctgtca

SEQ ID NO: 3390913 - DNA, 16 bp, Homo sapiens
ctgcctcaccgcttcc

SEQ ID NO: 3390914 - DNA, 18 bp, Homo sapiens
ctgcctcaccgcttccct

SEQ ID NO: 3390915 - DNA, 14 bp, Homo sapiens
ctgcctcacttcct

SEQ ID NO: 3390916 - DNA, 12 bp, Homo sapiens
ctgcctcaggtt

SEQ ID NO: 3390917 - DNA, 18 bp, Homo sapiens
ctgcctcaggttcctatg

SEQ ID NO: 3390918 - DNA, 23 bp, Homo sapiens
ctgcctcccaaggtcctctcagt

SEQ ID NO: 3390919 - DNA, 12 bp, Homo sapiens
ctgcctcccact

SEQ ID NO: 3390920 - DNA, 18 bp, Homo sapiens
ctgcctcccacttcactg

SEQ ID NO: 3390921 - DNA, 17 bp, Homo sapiens
ctgcctcccatgcctgg

SEQ ID NO: 3390922 - DNA, 16 bp, Homo sapiens
ctgcctcccattctga

SEQ ID NO: 3390923 - DNA, 17 bp, Homo sapiens
ctgcctccgctggcttt

SEQ ID NO: 3390924 - DNA, 11 bp, Homo sapiens
ctgcctcctcg

SEQ ID NO: 3390925 - DNA, 15 bp, Homo sapiens
ctgcctcctcgttcc

SEQ ID NO: 3390926 - DNA, 15 bp, Homo sapiens
ctgcctcctcttcaa

SEQ ID NO: 3390927 - DNA, 14 bp, Homo sapiens
ctgcctcctgggaa

SEQ ID NO: 3390928 - DNA, 16 bp, Homo sapiens
ctgcctcctgggaaga

SEQ ID NO: 3390929 - DNA, 18 bp, Homo sapiens
ctgcctcgaaacacagaa

SEQ ID NO: 3390930 - DNA, 13 bp, Homo sapiens
ctgcctctcacac

SEQ ID NO: 3390931 - DNA, 16 bp, Homo sapiens
ctgcctctcacacaca

SEQ ID NO: 3390932 - DNA, 21 bp, Homo sapiens
ctgcctctcacacacatagat

SEQ ID NO: 3390933 - DNA, 15 bp, Homo sapiens
ctgcctctcccatca

SEQ ID NO: 3390934 - DNA, 17 bp, Homo sapiens
ctgcctctgacacacag

SEQ ID NO: 3390935 - DNA, 13 bp, Homo sapiens
ctgcctctgcctt

SEQ ID NO: 3390936 - DNA, 15 bp, Homo sapiens
ctgcctctgccttag

SEQ ID NO: 3390937 - DNA, 23 bp, Homo sapiens
ctgcctctgccttagaggagccc

SEQ ID NO: 3390938 - DNA, 16 bp, Homo sapiens
ctgcctctgctccctc

SEQ ID NO: 3390939 - DNA, 14 bp, Homo sapiens
ctgcctctttccct

SEQ ID NO: 3390940 - DNA, 15 bp, Homo sapiens
ctgcctgaagtcaca

SEQ ID NO: 3390941 - DNA, 15 bp, Homo sapiens
ctgcctgcacccctg

SEQ ID NO: 3390942 - DNA, 12 bp, Homo sapiens
ctgcctgccacc

SEQ ID NO: 3390943 - DNA, 13 bp, Homo sapiens
ctgcctgcccagg

SEQ ID NO: 3390944 - DNA, 21 bp, Homo sapiens
ctgcctgccccacacggactc

SEQ ID NO: 3390945 - DNA, 19 bp, Homo sapiens
ctgcctgccccacccaccc

SEQ ID NO: 3390946 - DNA, 22 bp, Homo sapiens
ctgcctgccccacccaccccac

SEQ ID NO: 3390947 - DNA, 19 bp, Homo sapiens
ctgcctgccccgcccccag

SEQ ID NO: 3390948 - DNA, 21 bp, Homo sapiens
ctgcctgccccgcccccagtc

SEQ ID NO: 3390949 - DNA, 22 bp, Homo sapiens
ctgcctgccccgcccccagtcc

SEQ ID NO: 3390950 - DNA, 17 bp, Homo sapiens
ctgcctgcccgcacagc

SEQ ID NO: 3390951 - DNA, 18 bp, Homo sapiens
ctgcctgcccgcacagca

SEQ ID NO: 3390952 - DNA, 19 bp, Homo sapiens
ctgcctgcccgcacagcag

SEQ ID NO: 3390953 - DNA, 20 bp, Homo sapiens
ctgcctgcccgcacagcagc

SEQ ID NO: 3390954 - DNA, 12 bp, Homo sapiens
ctgcctgctttg

SEQ ID NO: 3390955 - DNA, 18 bp, Homo sapiens
ctgcctggagagggtctc

SEQ ID NO: 3390956 - DNA, 21 bp, Homo sapiens
ctgcctggatgaggcacttct

SEQ ID NO: 3390957 - DNA, 22 bp, Homo sapiens
ctgcctggatgaggcacttctg

SEQ ID NO: 3390958 - DNA, 13 bp, Homo sapiens
ctgcctggcctgg

SEQ ID NO: 3390959 - DNA, 15 bp, Homo sapiens
ctgcctggcctggct

SEQ ID NO: 3390960 - DNA, 16 bp, Homo sapiens
ctgcctggcctggctc

SEQ ID NO: 3390961 - DNA, 19 bp, Homo sapiens
ctgcctggcctggctcccc

SEQ ID NO: 3390962 - DNA, 13 bp, Homo sapiens
ctgcctgggcctg

SEQ ID NO: 3390963 - DNA, 14 bp, Homo sapiens
ctgcctgggcctgt

SEQ ID NO: 3390964 - DNA, 15 bp, Homo sapiens
ctgcctgggcctgtg

SEQ ID NO: 3390965 - DNA, 22 bp, Homo sapiens
ctgcctgggcctgtgcagcagc

SEQ ID NO: 3390966 - DNA, 17 bp, Homo sapiens
ctgcctgggctgttggc

SEQ ID NO: 3390967 - DNA, 21 bp, Homo sapiens
ctgcctgggctgttggcactc

SEQ ID NO: 3390968 - DNA, 18 bp, Homo sapiens
ctgcctgggtgggacagc

SEQ ID NO: 3390969 - DNA, 21 bp, Homo sapiens
ctgcctgggtgggacagcctc

SEQ ID NO: 3390970 - DNA, 18 bp, Homo sapiens
ctgcctgggttgggggca

SEQ ID NO: 3390971 - DNA, 24 bp, Homo sapiens
ctgcctgggttgggggcactcagc

SEQ ID NO: 3390972 - DNA, 15 bp, Homo sapiens
ctgcctggtggtcag

SEQ ID NO: 3390973 - DNA, 19 bp, Homo sapiens
ctgcctgtaacttgagagt

SEQ ID NO: 3390974 - DNA, 19 bp, Homo sapiens
ctgcctgtagttaggaaat

SEQ ID NO: 3390975 - DNA, 13 bp, Homo sapiens
ctgcctgtatttt

SEQ ID NO: 3390976 - DNA, 15 bp, Homo sapiens
ctgcctgtgcctgcc

SEQ ID NO: 3390977 - DNA, 17 bp, Homo sapiens
ctgcctgtgcctgccat

SEQ ID NO: 3390978 - DNA, 19 bp, Homo sapiens
ctgcctgtgcctgccatgg

SEQ ID NO: 3390979 - DNA, 12 bp, Homo sapiens
ctgcctgtggcg

SEQ ID NO: 3390980 - DNA, 20 bp, Homo sapiens
ctgcctgttataactctgca

SEQ ID NO: 3390981 - DNA, 21 bp, Homo sapiens
ctgcctgttataactctgcac

SEQ ID NO: 3390982 - DNA, 14 bp, Homo sapiens
ctgcctgttcagct

SEQ ID NO: 3390983 - DNA, 24 bp, Homo sapiens
ctgtgacatggtgcctgagaggca

SEQ ID NO: 3390984 - DNA, 19 bp, Homo sapiens
ctgtgaccaccttctgtcc

SEQ ID NO: 3390985 - DNA, 20 bp, Homo sapiens
ctgtgaccagcactgtctca

SEQ ID NO: 3390986 - DNA, 17 bp, Homo sapiens
ctgtgaccatttataat

SEQ ID NO: 3390987 - DNA, 14 bp, Homo sapiens
ctgtgacccatctg

SEQ ID NO: 3390988 - DNA, 15 bp, Homo sapiens
ctgtgacccatctgt

SEQ ID NO: 3390989 - DNA, 14 bp, Homo sapiens
ctgtgacctcaggc

SEQ ID NO: 3390990 - DNA, 23 bp, Homo sapiens
ctgtgacctcaggcactagcctt

SEQ ID NO: 3390991 - DNA, 17 bp, Homo sapiens
ctgtgacctttgtctag

SEQ ID NO: 3390992 - DNA, 16 bp, Homo sapiens
ctgtgacgcagacaga

SEQ ID NO: 3390993 - DNA, 14 bp, Homo sapiens
ctgtgactcttttt

SEQ ID NO: 3390994 - DNA, 21 bp, Homo sapiens
ctgtgacttctccaggtctca

SEQ ID NO: 3390995 - DNA, 13 bp, Homo sapiens
ctgtgagaaaacg

SEQ ID NO: 3390996 - DNA, 14 bp, Homo sapiens
ctgtgagaccccca

SEQ ID NO: 3390997 - DNA, 15 bp, Homo sapiens
ctgtgagacccccac

SEQ ID NO: 3390998 - DNA, 19 bp, Homo sapiens
ctgtgagacccccacacct

SEQ ID NO: 3390999 - DNA, 16 bp, Homo sapiens
ctgtgagatgctagaa

SEQ ID NO: 3391000 - DNA, 23 bp, Homo sapiens
ctgtgagatgctagaactccctt

SEQ ID NO: 3391001 - DNA, 14 bp, Homo sapiens
ctgtgagcccctgg

SEQ ID NO: 3391002 - DNA, 16 bp, Homo sapiens
ctgtgagcccctggtc

SEQ ID NO: 3391003 - DNA, 12 bp, Homo sapiens
ctgtgagccttg

SEQ ID NO: 3391004 - DNA, 17 bp, Homo sapiens
ctgtgaggaaagcacac

SEQ ID NO: 3391005 - DNA, 17 bp, Homo sapiens
ctgtgaggcccctggac

SEQ ID NO: 3391006 - DNA, 14 bp, Homo sapiens
ctgtgagtgtaagt

SEQ ID NO: 3391007 - DNA, 15 bp, Homo sapiens
ctgtgagttctccct

SEQ ID NO: 3391008 - DNA, 14 bp, Homo sapiens
ctgtgatgagctga

SEQ ID NO: 3391009 - DNA, 22 bp, Homo sapiens
ctgtgattccactacacctggc

SEQ ID NO: 3391010 - DNA, 16 bp, Homo sapiens
ctgtgcaaacagtaac

SEQ ID NO: 3391011 - DNA, 11 bp, Homo sapiens
ctgtgcacaca

SEQ ID NO: 3391012 - DNA, 12 bp, Homo sapiens
ctgtgcacacac

SEQ ID NO: 3391013 - DNA, 20 bp, Homo sapiens
ctgtgcacacacacacacat

SEQ ID NO: 3391014 - DNA, 15 bp, Homo sapiens
ctgtgcagaataatg

SEQ ID NO: 3391015 - DNA, 18 bp, Homo sapiens
ctgtgcagaataatggaa

SEQ ID NO: 3391016 - DNA, 19 bp, Homo sapiens
ctgtgcagaataatggaaa

SEQ ID NO: 3391017 - DNA, 20 bp, Homo sapiens
ctgtgcagagatgactgtcc

SEQ ID NO: 3391018 - DNA, 16 bp, Homo sapiens
ctgtgcagcagcccag

SEQ ID NO: 3391019 - DNA, 22 bp, Homo sapiens
ctgtgcagcagcccagcttcct

SEQ ID NO: 3391020 - DNA, 16 bp, Homo sapiens
ctgtgcagtcactgga

SEQ ID NO: 3391021 - DNA, 18 bp, Homo sapiens
ctgtgcatagtgctggga

SEQ ID NO: 3391022 - DNA, 21 bp, Homo sapiens
ctgtgcatctagcctcaagct

SEQ ID NO: 3391023 - DNA, 15 bp, Homo sapiens
ctgtgcatgtatgtc

SEQ ID NO: 3391024 - DNA, 16 bp, Homo sapiens
ctgtgcatgtatgtct

SEQ ID NO: 3391025 - DNA, 17 bp, Homo sapiens
ctgtgccaataaaagtt

SEQ ID NO: 3391026 - DNA, 13 bp, Homo sapiens
ctgtgccacccac

SEQ ID NO: 3391027 - DNA, 20 bp, Homo sapiens
ctgtgccactttgactcaga

SEQ ID NO: 3391028 - DNA, 22 bp, Homo sapiens
ctgtgccactttgactcagagg

SEQ ID NO: 3391029 - DNA, 23 bp, Homo sapiens
ctgtgccactttgactcagaggc

SEQ ID NO: 3391030 - DNA, 22 bp, Homo sapiens
ctgtgccagaaacagtgggagc

SEQ ID NO: 3391031 - DNA, 23 bp, Homo sapiens
ctgtgccatcaccataacctctg

SEQ ID NO: 3391032 - DNA, 15 bp, Homo sapiens
ctgtgccatgctggg

SEQ ID NO: 3391033 - DNA, 17 bp, Homo sapiens
ctgtgccctcaccacca

SEQ ID NO: 3391034 - DNA, 17 bp, Homo sapiens
ctgtgccctccaaagag

SEQ ID NO: 3391035 - DNA, 18 bp, Homo sapiens
ctgtgcctaacaccagcg

SEQ ID NO: 3391036 - DNA, 13 bp, Homo sapiens
ctgtgcctctgcc

SEQ ID NO: 3391037 - DNA, 15 bp, Homo sapiens
ctgtgcctctgcctg

SEQ ID NO: 3391038 - DNA, 18 bp, Homo sapiens
ctgtgcctctgggactgg

SEQ ID NO: 3391039 - DNA, 18 bp, Homo sapiens
ctgtgcctgccatgggcc

SEQ ID NO: 3391040 - DNA, 19 bp, Homo sapiens
ctgtgcctgccatgggcca

SEQ ID NO: 3391041 - DNA, 11 bp, Homo sapiens
ctgtgcctgct

SEQ ID NO: 3391042 - DNA, 13 bp, Homo sapiens
ctgtgcctgctag

SEQ ID NO: 3391043 - DNA, 22 bp, Homo sapiens
ctgtgcctgtcaggctctggcc

SEQ ID NO: 3391044 - DNA, 14 bp, Homo sapiens
ctgtgcgtcccagc

SEQ ID NO: 3391045 - DNA, 16 bp, Homo sapiens
ctgtgcgtcccagctg

SEQ ID NO: 3391046 - DNA, 17 bp, Homo sapiens
ctgtgcgtcccagctga

SEQ ID NO: 3391047 - DNA, 23 bp, Homo sapiens
ctgtgcgtcccagctgaaggcag

SEQ ID NO: 3391048 - DNA, 16 bp, Homo sapiens
ctgtgcgtgaaacaca

SEQ ID NO: 3391049 - DNA, 18 bp, Homo sapiens
ctgtgcgttttagaagag

SEQ ID NO: 3391050 - DNA, 22 bp, Homo sapiens
ctgtgctactgtctttggaaaa

SEQ ID NO: 3391051 - DNA, 14 bp, Homo sapiens
ctgtgctagaagct

SEQ ID NO: 3391052 - DNA, 17 bp, Homo sapiens
ctgtgctagaagctcca

SEQ ID NO: 3391053 - DNA, 20 bp, Homo sapiens
ctgtgctagttttacagatt

SEQ ID NO: 3391054 - DNA, 15 bp, Homo sapiens
ctgtgctatgaattt

SEQ ID NO: 3391055 - DNA, 19 bp, Homo sapiens
ctgtgctccgtgcctccac

SEQ ID NO: 3391056 - DNA, 14 bp, Homo sapiens
ctgtgctctggaca

SEQ ID NO: 3391057 - DNA, 17 bp, Homo sapiens
ctgtgctctggacaggc

SEQ ID NO: 3391058 - DNA, 16 bp, Homo sapiens
ctgtgctctggaggct

SEQ ID NO: 3391059 - DNA, 20 bp, Homo sapiens
ctgtgctctggaggctgcag

SEQ ID NO: 3391060 - DNA, 21 bp, Homo sapiens
ctgtgctcttttggtggggag

SEQ ID NO: 3391061 - DNA, 22 bp, Homo sapiens
ctgtgctcttttggtggggagc

SEQ ID NO: 3391062 - DNA, 14 bp, Homo sapiens
ctgtgctgaatgct

SEQ ID NO: 3391063 - DNA, 19 bp, Homo sapiens
ctgtgctgctgttactgtt

SEQ ID NO: 3391064 - DNA, 12 bp, Homo sapiens
ctgtgctgcttt

SEQ ID NO: 3391065 - DNA, 17 bp, Homo sapiens
ctgtgctgcttttgagc

SEQ ID NO: 3391066 - DNA, 20 bp, Homo sapiens
ctgtgctgcttttgagcctc

SEQ ID NO: 3391067 - DNA, 21 bp, Homo sapiens
ctgtgctgcttttgagcctca

SEQ ID NO: 3391068 - DNA, 12 bp, Homo sapiens
ctgtgctggtgt

SEQ ID NO: 3391069 - DNA, 18 bp, Homo sapiens
ctgtgctggtgtcctgac

SEQ ID NO: 3391070 - DNA, 19 bp, Homo sapiens
ctgtgctggtgtcctgacc

SEQ ID NO: 3391071 - DNA, 21 bp, Homo sapiens
ctgtgctggtgtcctgaccac

SEQ ID NO: 3391072 - DNA, 12 bp, Homo sapiens
ctgtgctgtgcc

SEQ ID NO: 3391073 - DNA, 14 bp, Homo sapiens
ctgtgctgtgcctg

SEQ ID NO: 3391074 - DNA, 18 bp, Homo sapiens
ctgtgctgtgcctgctag

SEQ ID NO: 3391075 - DNA, 18 bp, Homo sapiens
ctgtgcttcaattaataa

SEQ ID NO: 3391076 - DNA, 16 bp, Homo sapiens
ctgtggaacccagcag

SEQ ID NO: 3391077 - DNA, 18 bp, Homo sapiens
ctgtggaaggcagagaaa

SEQ ID NO: 3391078 - DNA, 17 bp, Homo sapiens
ctgtggaccgtggacag

SEQ ID NO: 3391079 - DNA, 21 bp, Homo sapiens
ctgtggaccgtggacaggccc

SEQ ID NO: 3391080 - DNA, 20 bp, Homo sapiens
ctgtggacggggaggctctc

SEQ ID NO: 3391081 - DNA, 14 bp, Homo sapiens
ctgtggagactggg

SEQ ID NO: 3391082 - DNA, 15 bp, Homo sapiens
ctgtggagcaaaagg

SEQ ID NO: 3391083 - DNA, 19 bp, Homo sapiens
ctgtggagcaaaaggcagc

SEQ ID NO: 3391084 - DNA, 20 bp, Homo sapiens
ctgtggagcaaaaggcagct

SEQ ID NO: 3391085 - DNA, 21 bp, Homo sapiens
ctgtggagcaaaaggcagctc

SEQ ID NO: 3391086 - DNA, 15 bp, Homo sapiens
ctgtggagctcagcc

SEQ ID NO: 3391087 - DNA, 19 bp, Homo sapiens
ctgtggagctgccacagag

SEQ ID NO: 3391088 - DNA, 17 bp, Homo sapiens
ctgtggaggaaggattg

SEQ ID NO: 3391089 - DNA, 19 bp, Homo sapiens
ctgtggaggaaggattgta

SEQ ID NO: 3391090 - DNA, 21 bp, Homo sapiens
ctgtggaggaaggattgtaaa

SEQ ID NO: 3391091 - DNA, 22 bp, Homo sapiens
ctgtggaggaaggattgtaaaa

SEQ ID NO: 3391092 - DNA, 15 bp, Homo sapiens
ctgtggaggcctgat

SEQ ID NO: 3391093 - DNA, 16 bp, Homo sapiens
ctgtggaggcctgatg

SEQ ID NO: 3391094 - DNA, 22 bp, Homo sapiens
ctgtggagggagtgttcaaaat

SEQ ID NO: 3391095 - DNA, 20 bp, Homo sapiens
ctgtggaggggccctccgag

SEQ ID NO: 3391096 - DNA, 22 bp, Homo sapiens
ctgtggcacagacttctggaag

SEQ ID NO: 3391097 - DNA, 17 bp, Homo sapiens
ctgtggcactggccacc

SEQ ID NO: 3391098 - DNA, 19 bp, Homo sapiens
ctgtggcagaaaagaggag

SEQ ID NO: 3391099 - DNA, 18 bp, Homo sapiens
ctgtggcagagttacagt

SEQ ID NO: 3391100 - DNA, 13 bp, Homo sapiens
ctgtggcaggcag

SEQ ID NO: 3391101 - DNA, 21 bp, Homo sapiens
ctgtggcagtaaagagaaact

SEQ ID NO: 3391102 - DNA, 14 bp, Homo sapiens
ctgtggccacagcc

SEQ ID NO: 3391103 - DNA, 12 bp, Homo sapiens
ctgtggccagag

SEQ ID NO: 3391104 - DNA, 16 bp, Homo sapiens
ctgtggccccaccctg

SEQ ID NO: 3391105 - DNA, 18 bp, Homo sapiens
ctgtggccccaccctggg

SEQ ID NO: 3391106 - DNA, 16 bp, Homo sapiens
ctgtggccgccacctg

SEQ ID NO: 3391107 - DNA, 18 bp, Homo sapiens
ctgtggccgtctcctccc

SEQ ID NO: 3391108 - DNA, 19 bp, Homo sapiens
ctgtggccgtctcctccct

SEQ ID NO: 3391109 - DNA, 13 bp, Homo sapiens
cttactgtttctg

SEQ ID NO: 3391110 - DNA, 23 bp, Homo sapiens
cttactttcctttccccagccca

SEQ ID NO: 3391111 - DNA, 21 bp, Homo sapiens
cttacttttaaggataaatca

SEQ ID NO: 3391112 - DNA, 18 bp, Homo sapiens
cttagaaacacataaatt

SEQ ID NO: 3391113 - DNA, 14 bp, Homo sapiens
cttagaaagcaggg

SEQ ID NO: 3391114 - DNA, 23 bp, Homo sapiens
cttagaaatcattgtagaaacac

SEQ ID NO: 3391115 - DNA, 12 bp, Homo sapiens
cttagaacattt

SEQ ID NO: 3391116 - DNA, 20 bp, Homo sapiens
cttagaagtcacacagtatt

SEQ ID NO: 3391117 - DNA, 12 bp, Homo sapiens
cttagaatccaa

SEQ ID NO: 3391118 - DNA, 15 bp, Homo sapiens
cttagacccatgctg

SEQ ID NO: 3391119 - DNA, 20 bp, Homo sapiens
cttagacccatgctggtcag

SEQ ID NO: 3391120 - DNA, 16 bp, Homo sapiens
cttagaccttccataa

SEQ ID NO: 3391121 - DNA, 18 bp, Homo sapiens
cttagaccttccataatg

SEQ ID NO: 3391122 - DNA, 21 bp, Homo sapiens
cttagactctagtatttatgg

SEQ ID NO: 3391123 - DNA, 15 bp, Homo sapiens
cttagactcttttcc

SEQ ID NO: 3391124 - DNA, 20 bp, Homo sapiens
cttagagaatgttctcctaa

SEQ ID NO: 3391125 - DNA, 15 bp, Homo sapiens
cttagagtgtagctg

SEQ ID NO: 3391126 - DNA, 16 bp, Homo sapiens
cttagagtgtagctgt

SEQ ID NO: 3391127 - DNA, 19 bp, Homo sapiens
cttagataatatttctgaa

SEQ ID NO: 3391128 - DNA, 21 bp, Homo sapiens
cttagatccaaggcagggaaa

SEQ ID NO: 3391129 - DNA, 20 bp, Homo sapiens
cttagatgttccagtaatct

SEQ ID NO: 3391130 - DNA, 16 bp, Homo sapiens
cttagatgtttcacac

SEQ ID NO: 3391131 - DNA, 20 bp, Homo sapiens
cttagattctctgtgtctaa

SEQ ID NO: 3391132 - DNA, 22 bp, Homo sapiens
cttagcatagcttattattgaa

SEQ ID NO: 3391133 - DNA, 14 bp, Homo sapiens
cttagcccaagagg

SEQ ID NO: 3391134 - DNA, 15 bp, Homo sapiens
cttagccgcaccctg

SEQ ID NO: 3391135 - DNA, 17 bp, Homo sapiens
cttagccgtccatggca

SEQ ID NO: 3391136 - DNA, 18 bp, Homo sapiens
cttagccgtccatggcac

SEQ ID NO: 3391137 - DNA, 15 bp, Homo sapiens
cttagcctggagcac

SEQ ID NO: 3391138 - DNA, 18 bp, Homo sapiens
cttagccttgtgccctgc

SEQ ID NO: 3391139 - DNA, 11 bp, Homo sapiens
cttagctccct

SEQ ID NO: 3391140 - DNA, 12 bp, Homo sapiens
cttagctgccag

SEQ ID NO: 3391141 - DNA, 18 bp, Homo sapiens
cttagctggatataatgt

SEQ ID NO: 3391142 - DNA, 16 bp, Homo sapiens
cttagcttatctttct

SEQ ID NO: 3391143 - DNA, 20 bp, Homo sapiens
cttagctttccctgtgccac

SEQ ID NO: 3391144 - DNA, 17 bp, Homo sapiens
cttagctttttaattgt

SEQ ID NO: 3391145 - DNA, 17 bp, Homo sapiens
cttaggaagagaaacca

SEQ ID NO: 3391146 - DNA, 19 bp, Homo sapiens
cttaggagacgctgcactt

SEQ ID NO: 3391147 - DNA, 15 bp, Homo sapiens
cttaggatatttgag

SEQ ID NO: 3391148 - DNA, 20 bp, Homo sapiens
cttaggatggggctcccagc

SEQ ID NO: 3391149 - DNA, 17 bp, Homo sapiens
cttaggcatgcacagct

SEQ ID NO: 3391150 - DNA, 13 bp, Homo sapiens
cttaggccttcct

SEQ ID NO: 3391151 - DNA, 17 bp, Homo sapiens
cttaggccttcctctct

SEQ ID NO: 3391152 - DNA, 14 bp, Homo sapiens
cttagggaaagatg

SEQ ID NO: 3391153 - DNA, 22 bp, Homo sapiens
cttagggaaagatgtagaaaga

SEQ ID NO: 3391154 - DNA, 13 bp, Homo sapiens
cttagggaagctg

SEQ ID NO: 3391155 - DNA, 20 bp, Homo sapiens
cttagggaagctggcctgag

SEQ ID NO: 3391156 - DNA, 23 bp, Homo sapiens
cttagggactacccatagacatg

SEQ ID NO: 3391157 - DNA, 20 bp, Homo sapiens
cttaggtggctctgggaatg

SEQ ID NO: 3391158 - DNA, 19 bp, Homo sapiens
cttagtaaaatttatttca

SEQ ID NO: 3391159 - DNA, 16 bp, Homo sapiens
cttagtaactttttat

SEQ ID NO: 3391160 - DNA, 17 bp, Homo sapiens
cttagtcccccaactct

SEQ ID NO: 3391161 - DNA, 13 bp, Homo sapiens
cttagtctcagtt

SEQ ID NO: 3391162 - DNA, 18 bp, Homo sapiens
cttagtctcagtttgtgt

SEQ ID NO: 3391163 - DNA, 19 bp, Homo sapiens
cttagtctcagtttgtgtg

SEQ ID NO: 3391164 - DNA, 19 bp, Homo sapiens
cttagtgcccgcctaggag

SEQ ID NO: 3391165 - DNA, 21 bp, Homo sapiens
cttagtgcccgcctaggagtt

SEQ ID NO: 3391166 - DNA, 19 bp, Homo sapiens
cttagtgcggacaagtttt

SEQ ID NO: 3391167 - DNA, 22 bp, Homo sapiens
cttagtgcggacaagttttaat

SEQ ID NO: 3391168 - DNA, 23 bp, Homo sapiens
cttagtgggccagggctgccctg

SEQ ID NO: 3391169 - DNA, 15 bp, Homo sapiens
cttagtggtatgtct

SEQ ID NO: 3391170 - DNA, 16 bp, Homo sapiens
cttagtggtatgtctc

SEQ ID NO: 3391171 - DNA, 14 bp, Homo sapiens
cttagttctcactg

SEQ ID NO: 3391172 - DNA, 15 bp, Homo sapiens
cttagttctcactgt

SEQ ID NO: 3391173 - DNA, 22 bp, Homo sapiens
cttagtttggattcttatgtag

SEQ ID NO: 3391174 - DNA, 17 bp, Homo sapiens
cttagtttgtgtgttgt

SEQ ID NO: 3391175 - DNA, 23 bp, Homo sapiens
cttagtttgtgtgttgtctcttg

SEQ ID NO: 3391176 - DNA, 21 bp, Homo sapiens
cttataaaaataaagggaaga

SEQ ID NO: 3391177 - DNA, 20 bp, Homo sapiens
cttataaacacattgaatgc

SEQ ID NO: 3391178 - DNA, 15 bp, Homo sapiens
cttataaaccaatct

SEQ ID NO: 3391179 - DNA, 18 bp, Homo sapiens
cttataaatcatattgat

SEQ ID NO: 3391180 - DNA, 21 bp, Homo sapiens
cttataacctagttaaagaaa

SEQ ID NO: 3391181 - DNA, 19 bp, Homo sapiens
cttataatactctgttgta

SEQ ID NO: 3391182 - DNA, 15 bp, Homo sapiens
cttatacatttgata

SEQ ID NO: 3391183 - DNA, 21 bp, Homo sapiens
cttatagaataaaagctataa

SEQ ID NO: 3391184 - DNA, 14 bp, Homo sapiens
cttatagaatattt

SEQ ID NO: 3391185 - DNA, 17 bp, Homo sapiens
cttatagggtaaaaaaa

SEQ ID NO: 3391186 - DNA, 14 bp, Homo sapiens
cttataggtgttgg

SEQ ID NO: 3391187 - DNA, 19 bp, Homo sapiens
cttatagttactgtgtaat

SEQ ID NO: 3391188 - DNA, 17 bp, Homo sapiens
cttatatagcacctttc

SEQ ID NO: 3391189 - DNA, 19 bp, Homo sapiens
cttatatttccctaaaata

SEQ ID NO: 3391190 - DNA, 17 bp, Homo sapiens
cttatcaactggttgta

SEQ ID NO: 3391191 - DNA, 21 bp, Homo sapiens
cttatcaaggactctggtttc

SEQ ID NO: 3391192 - DNA, 16 bp, Homo sapiens
cttatcaagtgtcttc

SEQ ID NO: 3391193 - DNA, 13 bp, Homo sapiens
cttatcagagcta

SEQ ID NO: 3391194 - DNA, 18 bp, Homo sapiens
cttatcctacagtacaat

SEQ ID NO: 3391195 - DNA, 20 bp, Homo sapiens
cttatctcagtcatgcataa

SEQ ID NO: 3391196 - DNA, 14 bp, Homo sapiens
cttatctgccatgt

SEQ ID NO: 3391197 - DNA, 17 bp, Homo sapiens
cttatctgtgcgtgaaa

SEQ ID NO: 3391198 - DNA, 20 bp, Homo sapiens
cttatctgtgcgtgaaacac

SEQ ID NO: 3391199 - DNA, 14 bp, Homo sapiens
cttatctttctttc

SEQ ID NO: 3391200 - DNA, 18 bp, Homo sapiens
cttatgaatatttataac

SEQ ID NO: 3391201 - DNA, 18 bp, Homo sapiens
cttatgacttgctacttt

SEQ ID NO: 3391202 - DNA, 20 bp, Homo sapiens
cttatgagatctaatgtgaa

SEQ ID NO: 3391203 - DNA, 22 bp, Homo sapiens
cttatgatacttgaggtaccag

SEQ ID NO: 3391204 - DNA, 15 bp, Homo sapiens
cttatgccatttgtt

SEQ ID NO: 3391205 - DNA, 17 bp, Homo sapiens
cttatgccatttgttta

SEQ ID NO: 3391206 - DNA, 17 bp, Homo sapiens
cttatgcggttaatttt

SEQ ID NO: 3391207 - DNA, 23 bp, Homo sapiens
cttatggaattgatttgcattga

SEQ ID NO: 3391208 - DNA, 21 bp, Homo sapiens
cttatgtacttgatactgaat

SEQ ID NO: 3391209 - DNA, 17 bp, Homo sapiens
cttatgtagatatttgg

SEQ ID NO: 3391210 - DNA, 15 bp, Homo sapiens
cttatgtccaccact

SEQ ID NO: 3391211 - DNA, 18 bp, Homo sapiens
cttatgtccaccacttca

SEQ ID NO: 3391212 - DNA, 23 bp, Homo sapiens
cttatgtgggtcttatgcttcca

SEQ ID NO: 3391213 - DNA, 14 bp, Homo sapiens
cttattactattat

SEQ ID NO: 3391214 - DNA, 11 bp, Homo sapiens
cttattagcag

SEQ ID NO: 3391215 - DNA, 17 bp, Homo sapiens
cttattagggagaaaat

SEQ ID NO: 3391216 - DNA, 20 bp, Homo sapiens
cttattatgtaggtaagact

SEQ ID NO: 3391217 - DNA, 22 bp, Homo sapiens
cttattcaggaagataaaaatc

SEQ ID NO: 3391218 - DNA, 23 bp, Homo sapiens
cttattcctctaggcaagcagga

SEQ ID NO: 3391219 - DNA, 23 bp, Homo sapiens
cttattctaataaatatactatg

SEQ ID NO: 3391220 - DNA, 13 bp, Homo sapiens
cttattcttctca

SEQ ID NO: 3391221 - DNA, 11 bp, Homo sapiens
cttattgaaaa

SEQ ID NO: 3391222 - DNA, 14 bp, Homo sapiens
cttattgaccattt

SEQ ID NO: 3391223 - DNA, 13 bp, Homo sapiens
cttattgcccacg

SEQ ID NO: 3391224 - DNA, 17 bp, Homo sapiens
cttattgcgctgctacc

SEQ ID NO: 3391225 - DNA, 17 bp, Homo sapiens
cttattggaaatgtact

SEQ ID NO: 3391226 - DNA, 18 bp, Homo sapiens
cttattggaactctgctt

SEQ ID NO: 3391227 - DNA, 16 bp, Homo sapiens
cttattggaaggtatt

SEQ ID NO: 3391228 - DNA, 17 bp, Homo sapiens
cttattggatatttgat

SEQ ID NO: 3391229 - DNA, 13 bp, Homo sapiens
cttattgtacctc

SEQ ID NO: 3391230 - DNA, 14 bp, Homo sapiens
cttattgtacctct

SEQ ID NO: 3391231 - DNA, 15 bp, Homo sapiens
cttattgtacctctc

SEQ ID NO: 3391232 - DNA, 12 bp, Homo sapiens
cttattgttcca

SEQ ID NO: 3391233 - DNA, 17 bp, Homo sapiens
cttattgttccaagaca

SEQ ID NO: 3391234 - DNA, 19 bp, Homo sapiens
cttattgttccaagacatt

SEQ ID NO: 3391235 - DNA, 23 bp, Homo sapiens
cttccgctttgaaagaagcaaga

SEQ ID NO: 3391236 - DNA, 16 bp, Homo sapiens
cttccggtagggaggc

SEQ ID NO: 3391237 - DNA, 20 bp, Homo sapiens
cttccgtggtcagagtgcca

SEQ ID NO: 3391238 - DNA, 17 bp, Homo sapiens
cttcctaaacccaatga

SEQ ID NO: 3391239 - DNA, 21 bp, Homo sapiens
cttcctaatttcccttcttgc

SEQ ID NO: 3391240 - DNA, 16 bp, Homo sapiens
cttcctaccctcctgc

SEQ ID NO: 3391241 - DNA, 19 bp, Homo sapiens
cttcctaccctccttccac

SEQ ID NO: 3391242 - DNA, 18 bp, Homo sapiens
cttcctagtgaaccacag

SEQ ID NO: 3391243 - DNA, 17 bp, Homo sapiens
cttcctagttttctcct

SEQ ID NO: 3391244 - DNA, 23 bp, Homo sapiens
cttcctagttttctcctcccagg

SEQ ID NO: 3391245 - DNA, 19 bp, Homo sapiens
cttcctataacttcttcct

SEQ ID NO: 3391246 - DNA, 20 bp, Homo sapiens
cttcctataacttcttcctg

SEQ ID NO: 3391247 - DNA, 23 bp, Homo sapiens
cttcctataacttcttcctgctg

SEQ ID NO: 3391248 - DNA, 20 bp, Homo sapiens
cttcctataacttgatgcat

SEQ ID NO: 3391249 - DNA, 12 bp, Homo sapiens
cttcctataata

SEQ ID NO: 3391250 - DNA, 15 bp, Homo sapiens
cttcctatgcccagg

SEQ ID NO: 3391251 - DNA, 20 bp, Homo sapiens
cttcctatgcccaggtacca

SEQ ID NO: 3391252 - DNA, 23 bp, Homo sapiens
cttcctcagctggttactcaggg

SEQ ID NO: 3391253 - DNA, 13 bp, Homo sapiens
cttcctccagctg

SEQ ID NO: 3391254 - DNA, 13 bp, Homo sapiens
cttcctccctcat

SEQ ID NO: 3391255 - DNA, 22 bp, Homo sapiens
cttcctccctgtctctgcatct

SEQ ID NO: 3391256 - DNA, 21 bp, Homo sapiens
cttcctccgaggccagtacct

SEQ ID NO: 3391257 - DNA, 13 bp, Homo sapiens
cttcctccgtcca

SEQ ID NO: 3391258 - DNA, 15 bp, Homo sapiens
cttcctcctccacag

SEQ ID NO: 3391259 - DNA, 16 bp, Homo sapiens
cttcctcctccacagt

SEQ ID NO: 3391260 - DNA, 18 bp, Homo sapiens
cttcctcctccacagtgc

SEQ ID NO: 3391261 - DNA, 19 bp, Homo sapiens
cttcctcctccacagtgct

SEQ ID NO: 3391262 - DNA, 15 bp, Homo sapiens
cttcctcctgatggc

SEQ ID NO: 3391263 - DNA, 22 bp, Homo sapiens
cttcctcctgatggccaagagc

SEQ ID NO: 3391264 - DNA, 22 bp, Homo sapiens
cttcctcctgcagacacctgga

SEQ ID NO: 3391265 - DNA, 12 bp, Homo sapiens
cttcctcctgga

SEQ ID NO: 3391266 - DNA, 13 bp, Homo sapiens
cttcctcctggaa

SEQ ID NO: 3391267 - DNA, 22 bp, Homo sapiens
cttcctctcaagctagccagag

SEQ ID NO: 3391268 - DNA, 14 bp, Homo sapiens
cttcctctcactcc

SEQ ID NO: 3391269 - DNA, 23 bp, Homo sapiens
cttcctctcactcctgcctccgc

SEQ ID NO: 3391270 - DNA, 16 bp, Homo sapiens
cttcctctccactgcc

SEQ ID NO: 3391271 - DNA, 20 bp, Homo sapiens
cttcctctggggctctaggg

SEQ ID NO: 3391272 - DNA, 14 bp, Homo sapiens
cttcctgaaataaa

SEQ ID NO: 3391273 - DNA, 15 bp, Homo sapiens
cttcctgccagcagg

SEQ ID NO: 3391274 - DNA, 16 bp, Homo sapiens
cttcctgctacaggag

SEQ ID NO: 3391275 - DNA, 18 bp, Homo sapiens
cttcctgctacaggaggg

SEQ ID NO: 3391276 - DNA, 14 bp, Homo sapiens
cttcctgctccttt

SEQ ID NO: 3391277 - DNA, 18 bp, Homo sapiens
cttcctgctggacagaga

SEQ ID NO: 3391278 - DNA, 23 bp, Homo sapiens
cttcctgctggacagagactcag

SEQ ID NO: 3391279 - DNA, 14 bp, Homo sapiens
cttcctggaaacag

SEQ ID NO: 3391280 - DNA, 17 bp, Homo sapiens
cttcctggaaacagcat

SEQ ID NO: 3391281 - DNA, 18 bp, Homo sapiens
cttcctggacctgagtcg

SEQ ID NO: 3391282 - DNA, 13 bp, Homo sapiens
cttcctggcctca

SEQ ID NO: 3391283 - DNA, 19 bp, Homo sapiens
cttcctggcctcactggct

SEQ ID NO: 3391284 - DNA, 21 bp, Homo sapiens
cttcctggcctcactggctgg

SEQ ID NO: 3391285 - DNA, 16 bp, Homo sapiens
cttcctgggaggacag

SEQ ID NO: 3391286 - DNA, 18 bp, Homo sapiens
cttcctgggaggacaggc

SEQ ID NO: 3391287 - DNA, 20 bp, Homo sapiens
cttcctggggcatctggcga

SEQ ID NO: 3391288 - DNA, 17 bp, Homo sapiens
cttcctggggccccgct

SEQ ID NO: 3391289 - DNA, 21 bp, Homo sapiens
cttcctggggccccgctggga

SEQ ID NO: 3391290 - DNA, 23 bp, Homo sapiens
cttcctggttttgtacactgctg

SEQ ID NO: 3391291 - DNA, 20 bp, Homo sapiens
cttcctgtctagtctctcct

SEQ ID NO: 3391292 - DNA, 19 bp, Homo sapiens
cttccttagaacttctaca

SEQ ID NO: 3391293 - DNA, 13 bp, Homo sapiens
cttccttcagggt

SEQ ID NO: 3391294 - DNA, 18 bp, Homo sapiens
cttccttcggtcttttgt

SEQ ID NO: 3391295 - DNA, 11 bp, Homo sapiens
cttccttctgg

SEQ ID NO: 3391296 - DNA, 22 bp, Homo sapiens
cttccttgaagaactgcaggcc

SEQ ID NO: 3391297 - DNA, 17 bp, Homo sapiens
cttccttgaccttcctc

SEQ ID NO: 3391298 - DNA, 17 bp, Homo sapiens
cttccttgctgtcctag

SEQ ID NO: 3391299 - DNA, 19 bp, Homo sapiens
cttccttgctgtcctaggc

SEQ ID NO: 3391300 - DNA, 15 bp, Homo sapiens
cttcctttaaaaaac

SEQ ID NO: 3391301 - DNA, 16 bp, Homo sapiens
cttcctttctccagga

SEQ ID NO: 3391302 - DNA, 19 bp, Homo sapiens
cttcctttctccaggacca

SEQ ID NO: 3391303 - DNA, 18 bp, Homo sapiens
cttcctttggtgcctcac

SEQ ID NO: 3391304 - DNA, 21 bp, Homo sapiens
cttcctttggtgcctcactgg

SEQ ID NO: 3391305 - DNA, 12 bp, Homo sapiens
cttcctttgtgt

SEQ ID NO: 3391306 - DNA, 14 bp, Homo sapiens
cttcctttgtgttt

SEQ ID NO: 3391307 - DNA, 16 bp, Homo sapiens
cttcctttgtgtttat

SEQ ID NO: 3391308 - DNA, 15 bp, Homo sapiens
cttccttttccctgc

SEQ ID NO: 3391309 - DNA, 16 bp, Homo sapiens
cttccttttccctgct

SEQ ID NO: 3391310 - DNA, 15 bp, Homo sapiens
cttcgaaacctggga

SEQ ID NO: 3391311 - DNA, 21 bp, Homo sapiens
cttcgatacaccgggcctgga

SEQ ID NO: 3391312 - DNA, 17 bp, Homo sapiens
cttcgctgctctagctg

SEQ ID NO: 3391313 - DNA, 12 bp, Homo sapiens
cttcgctggctc

SEQ ID NO: 3391314 - DNA, 13 bp, Homo sapiens
cttcgctggctcc

SEQ ID NO: 3391315 - DNA, 14 bp, Homo sapiens
cttcgctggctcct

SEQ ID NO: 3391316 - DNA, 21 bp, Homo sapiens
cttcgcttcttgcctctgtgc

SEQ ID NO: 3391317 - DNA, 17 bp, Homo sapiens
cttcgcttggagaccca

SEQ ID NO: 3391318 - DNA, 21 bp, Homo sapiens
cttcggaccgcttgtggggac

SEQ ID NO: 3391319 - DNA, 19 bp, Homo sapiens
cttcggcctccatcctgag

SEQ ID NO: 3391320 - DNA, 22 bp, Homo sapiens
cttcgtatcccgagtctgggac

SEQ ID NO: 3391321 - DNA, 14 bp, Homo sapiens
cttcgtccttttgg

SEQ ID NO: 3391322 - DNA, 14 bp, Homo sapiens
cttcgtctttccca

SEQ ID NO: 3391323 - DNA, 15 bp, Homo sapiens
cttcgtttattttca

SEQ ID NO: 3391324 - DNA, 16 bp, Homo sapiens
cttcgtttattttcaa

SEQ ID NO: 3391325 - DNA, 15 bp, Homo sapiens
cttcgttttctaaag

SEQ ID NO: 3391326 - DNA, 19 bp, Homo sapiens
cttctaaacccaatccaaa

SEQ ID NO: 3391327 - DNA, 13 bp, Homo sapiens
cttctaaatgcat

SEQ ID NO: 3391328 - DNA, 21 bp, Homo sapiens
cttctaactccactggctcca

SEQ ID NO: 3391329 - DNA, 15 bp, Homo sapiens
cttctaataaattat

SEQ ID NO: 3391330 - DNA, 17 bp, Homo sapiens
cttctaataaattatac

SEQ ID NO: 3391331 - DNA, 12 bp, Homo sapiens
cttctaatatat

SEQ ID NO: 3391332 - DNA, 14 bp, Homo sapiens
cttctaatatattt

SEQ ID NO: 3391333 - DNA, 12 bp, Homo sapiens
cttctacccaga

SEQ ID NO: 3391334 - DNA, 14 bp, Homo sapiens
cttctacctgccct

SEQ ID NO: 3391335 - DNA, 15 bp, Homo sapiens
cttctagaattataa

SEQ ID NO: 3391336 - DNA, 23 bp, Homo sapiens
cttctagaattataagtcacaaa

SEQ ID NO: 3391337 - DNA, 22 bp, Homo sapiens
cttctaggatagctaactgtaa

SEQ ID NO: 3391338 - DNA, 17 bp, Homo sapiens
cttctataattttgcct

SEQ ID NO: 3391339 - DNA, 19 bp, Homo sapiens
cttctataattttgccttt

SEQ ID NO: 3391340 - DNA, 20 bp, Homo sapiens
cttctataattttgccttta

SEQ ID NO: 3391341 - DNA, 19 bp, Homo sapiens
cttctatattttaatagaa

SEQ ID NO: 3391342 - DNA, 15 bp, Homo sapiens
cttctatcccaggag

SEQ ID NO: 3391343 - DNA, 20 bp, Homo sapiens
cttctattctagcctgcatt

SEQ ID NO: 3391344 - DNA, 21 bp, Homo sapiens
cttctattctagcctgcattg

SEQ ID NO: 3391345 - DNA, 19 bp, Homo sapiens
cttctatttttatcatgaa

SEQ ID NO: 3391346 - DNA, 15 bp, Homo sapiens
cttctcaagatactg

SEQ ID NO: 3391347 - DNA, 14 bp, Homo sapiens
cttctcaagtgcct

SEQ ID NO: 3391348 - DNA, 18 bp, Homo sapiens
cttctcaagtgccttaat

SEQ ID NO: 3391349 - DNA, 17 bp, Homo sapiens
cttctcaagttctaaga

SEQ ID NO: 3391350 - DNA, 23 bp, Homo sapiens
cttctcaagttctaagattctaa

SEQ ID NO: 3391351 - DNA, 20 bp, Homo sapiens
cttctcaccgtgcagagctg

SEQ ID NO: 3391352 - DNA, 16 bp, Homo sapiens
cttctcatcttaaaaa

SEQ ID NO: 3391353 - DNA, 20 bp, Homo sapiens
cttctcattccaacagtgag

SEQ ID NO: 3391354 - DNA, 21 bp, Homo sapiens
cttctcattccaacagtgagt

SEQ ID NO: 3391355 - DNA, 12 bp, Homo sapiens
cttctccaggct

SEQ ID NO: 3391356 - DNA, 14 bp, Homo sapiens
cttctccaggctgt

SEQ ID NO: 3391357 - DNA, 20 bp, Homo sapiens
cttctccaggtctcacgggc

SEQ ID NO: 3391358 - DNA, 12 bp, Homo sapiens
cttctcccagaa

SEQ ID NO: 3391359 - DNA, 13 bp, Homo sapiens
cttctcccagcac

SEQ ID NO: 3391360 - DNA, 12 bp, Homo sapiens
cttctccccaca

SEQ ID NO: 3391361 - DNA, 19 bp, Homo sapiens
cttggcaccaaagatgcag

SEQ ID NO: 3391362 - DNA, 22 bp, Homo sapiens
cttggcaccaaagatgcagccg

SEQ ID NO: 3391363 - DNA, 17 bp, Homo sapiens
cttggcacttaagtgca

SEQ ID NO: 3391364 - DNA, 21 bp, Homo sapiens
cttggcagtgtcccagggccc

SEQ ID NO: 3391365 - DNA, 20 bp, Homo sapiens
cttggcagttgcagtgctgc

SEQ ID NO: 3391366 - DNA, 20 bp, Homo sapiens
cttggcatcacagggcagag

SEQ ID NO: 3391367 - DNA, 13 bp, Homo sapiens
cttggcatttcta

SEQ ID NO: 3391368 - DNA, 22 bp, Homo sapiens
cttggccacaacctgaaagaca

SEQ ID NO: 3391369 - DNA, 18 bp, Homo sapiens
cttggccagttatccctt

SEQ ID NO: 3391370 - DNA, 21 bp, Homo sapiens
cttggcccggccggcctggca

SEQ ID NO: 3391371 - DNA, 14 bp, Homo sapiens
cttggccctctcct

SEQ ID NO: 3391372 - DNA, 20 bp, Homo sapiens
cttggccggctgtgctcaga

SEQ ID NO: 3391373 - DNA, 18 bp, Homo sapiens
cttggcctagcccaccct

SEQ ID NO: 3391374 - DNA, 11 bp, Homo sapiens
cttggcctcag

SEQ ID NO: 3391375 - DNA, 12 bp, Homo sapiens
cttggcctcaga

SEQ ID NO: 3391376 - DNA, 13 bp, Homo sapiens
cttggcctcagct

SEQ ID NO: 3391377 - DNA, 16 bp, Homo sapiens
cttggcctcagctggc

SEQ ID NO: 3391378 - DNA, 13 bp, Homo sapiens
cttggcctgctgt

SEQ ID NO: 3391379 - DNA, 16 bp, Homo sapiens
cttggcctgctgtgat

SEQ ID NO: 3391380 - DNA, 17 bp, Homo sapiens
cttggcctgtctcatcc

SEQ ID NO: 3391381 - DNA, 22 bp, Homo sapiens
cttggcctgtctcatccccagg

SEQ ID NO: 3391382 - DNA, 13 bp, Homo sapiens
cttggccttggca

SEQ ID NO: 3391383 - DNA, 14 bp, Homo sapiens
cttggccttgggct

SEQ ID NO: 3391384 - DNA, 16 bp, Homo sapiens
cttggcctttgcattt

SEQ ID NO: 3391385 - DNA, 16 bp, Homo sapiens
cttggcgtggagcagg

SEQ ID NO: 3391386 - DNA, 14 bp, Homo sapiens
cttggcgtggagcc

SEQ ID NO: 3391387 - DNA, 14 bp, Homo sapiens
cttggctccatgct

SEQ ID NO: 3391388 - DNA, 16 bp, Homo sapiens
cttggctccatgctcc

SEQ ID NO: 3391389 - DNA, 13 bp, Homo sapiens
cttggctctgcca

SEQ ID NO: 3391390 - DNA, 14 bp, Homo sapiens
cttggctgactggg

SEQ ID NO: 3391391 - DNA, 12 bp, Homo sapiens
cttggctgcagg

SEQ ID NO: 3391392 - DNA, 16 bp, Homo sapiens
cttggctgcagggagt

SEQ ID NO: 3391393 - DNA, 16 bp, Homo sapiens
cttggcttacctgacc

SEQ ID NO: 3391394 - DNA, 22 bp, Homo sapiens
cttggcttacctgacctcttgc

SEQ ID NO: 3391395 - DNA, 24 bp, Homo sapiens
cttggcttacctgacctcttgctg

SEQ ID NO: 3391396 - DNA, 13 bp, Homo sapiens
cttggcttctgtg

SEQ ID NO: 3391397 - DNA, 16 bp, Homo sapiens
cttggcttttctagcc

SEQ ID NO: 3391398 - DNA, 22 bp, Homo sapiens
cttgggaaaaaaacttggcact

SEQ ID NO: 3391399 - DNA, 23 bp, Homo sapiens
cttgggaaaaaaacttggcactt

SEQ ID NO: 3391400 - DNA, 10 bp, Homo sapiens
cttgggaatg

SEQ ID NO: 3391401 - DNA, 15 bp, Homo sapiens
cttgggacagccaga

SEQ ID NO: 3391402 - DNA, 19 bp, Homo sapiens
cttgggacagccagagctg

SEQ ID NO: 3391403 - DNA, 22 bp, Homo sapiens
cttgggaggttttattctgact

SEQ ID NO: 3391404 - DNA, 15 bp, Homo sapiens
cttgggcagagctgg

SEQ ID NO: 3391405 - DNA, 19 bp, Homo sapiens
cttgggcagagctggctct

SEQ ID NO: 3391406 - DNA, 20 bp, Homo sapiens
cttgggcagagctggctctg

SEQ ID NO: 3391407 - DNA, 17 bp, Homo sapiens
cttgggcatccacccag

SEQ ID NO: 3391408 - DNA, 20 bp, Homo sapiens
cttgggcatccacccagtgc

SEQ ID NO: 3391409 - DNA, 17 bp, Homo sapiens
cttgggcctcaggctct

SEQ ID NO: 3391410 - DNA, 19 bp, Homo sapiens
cttgggcctcaggctctgc

SEQ ID NO: 3391411 - DNA, 15 bp, Homo sapiens
cttgggcctggcccg

SEQ ID NO: 3391412 - DNA, 19 bp, Homo sapiens
cttgggccttgctgctgct

SEQ ID NO: 3391413 - DNA, 19 bp, Homo sapiens
cttgggctactggcagctc

SEQ ID NO: 3391414 - DNA, 21 bp, Homo sapiens
cttgggctactggcagctcct

SEQ ID NO: 3391415 - DNA, 15 bp, Homo sapiens
cttgggctcctggct

SEQ ID NO: 3391416 - DNA, 16 bp, Homo sapiens
cttgggctcctggctg

SEQ ID NO: 3391417 - DNA, 18 bp, Homo sapiens
cttgggctcctggctgcc

SEQ ID NO: 3391418 - DNA, 22 bp, Homo sapiens
cttgggctcctggctgccaggc

SEQ ID NO: 3391419 - DNA, 16 bp, Homo sapiens
cttgggctgacccagc

SEQ ID NO: 3391420 - DNA, 19 bp, Homo sapiens
cttgggctgacccagcatc

SEQ ID NO: 3391421 - DNA, 22 bp, Homo sapiens
cttgggctgacccagcatctcc

SEQ ID NO: 3391422 - DNA, 22 bp, Homo sapiens
cttgggctgggacttcttaccc

SEQ ID NO: 3391423 - DNA, 14 bp, Homo sapiens
cttggggcaagact

SEQ ID NO: 3391424 - DNA, 22 bp, Homo sapiens
cttggggccaccaaagctgccc

SEQ ID NO: 3391425 - DNA, 24 bp, Homo sapiens
cttgggggatgactagaggcaggg

SEQ ID NO: 3391426 - DNA, 14 bp, Homo sapiens
cttgggggggtggc

SEQ ID NO: 3391427 - DNA, 16 bp, Homo sapiens
cttgggggggtggccg

SEQ ID NO: 3391428 - DNA, 18 bp, Homo sapiens
cttgggggggtggccgct

SEQ ID NO: 3391429 - DNA, 13 bp, Homo sapiens
cttgggggtcagg

SEQ ID NO: 3391430 - DNA, 15 bp, Homo sapiens
cttggggtcaagaaa

SEQ ID NO: 3391431 - DNA, 22 bp, Homo sapiens
cttggggtcaggaacagtggct

SEQ ID NO: 3391432 - DNA, 18 bp, Homo sapiens
cttgggtcattgacctct

SEQ ID NO: 3391433 - DNA, 21 bp, Homo sapiens
cttgggtcattgacctctcag

SEQ ID NO: 3391434 - DNA, 23 bp, Homo sapiens
cttgggtcattgacctctcaggg

SEQ ID NO: 3391435 - DNA, 13 bp, Homo sapiens
cttgggtgggtga

SEQ ID NO: 3391436 - DNA, 15 bp, Homo sapiens
cttgggtgggtgaag

SEQ ID NO: 3391437 - DNA, 21 bp, Homo sapiens
cttgggtgggtgaaggcctgg

SEQ ID NO: 3391438 - DNA, 13 bp, Homo sapiens
cttgggtggttcc

SEQ ID NO: 3391439 - DNA, 17 bp, Homo sapiens
cttgggtggttcctaag

SEQ ID NO: 3391440 - DNA, 17 bp, Homo sapiens
cttgggttccaaccagg

SEQ ID NO: 3391441 - DNA, 17 bp, Homo sapiens
cttgggtttttgttacc

SEQ ID NO: 3391442 - DNA, 19 bp, Homo sapiens
cttggtattattctgtttt

SEQ ID NO: 3391443 - DNA, 21 bp, Homo sapiens
cttggtattattctgttttgc

SEQ ID NO: 3391444 - DNA, 13 bp, Homo sapiens
cttggtcagagcc

SEQ ID NO: 3391445 - DNA, 20 bp, Homo sapiens
cttggtcattttttttatat

SEQ ID NO: 3391446 - DNA, 19 bp, Homo sapiens
cttggtctgtgagatgcta

SEQ ID NO: 3391447 - DNA, 19 bp, Homo sapiens
cttggttggtagggtggga

SEQ ID NO: 3391448 - DNA, 19 bp, Homo sapiens
cttggtttctctctacagt

SEQ ID NO: 3391449 - DNA, 11 bp, Homo sapiens
cttgtaaaaaa

SEQ ID NO: 3391450 - DNA, 14 bp, Homo sapiens
cttgtaaaaaaagc

SEQ ID NO: 3391451 - DNA, 15 bp, Homo sapiens
cttgtaaaaaaagca

SEQ ID NO: 3391452 - DNA, 16 bp, Homo sapiens
cttgtaaaaaaagcaa

SEQ ID NO: 3391453 - DNA, 13 bp, Homo sapiens
cttgtaaagactg

SEQ ID NO: 3391454 - DNA, 18 bp, Homo sapiens
cttgtaaagactgtagaa

SEQ ID NO: 3391455 - DNA, 15 bp, Homo sapiens
cttgtaaatacacca

SEQ ID NO: 3391456 - DNA, 12 bp, Homo sapiens
cttgtaaatacc

SEQ ID NO: 3391457 - DNA, 18 bp, Homo sapiens
cttgtaaatagctcaggt

SEQ ID NO: 3391458 - DNA, 21 bp, Homo sapiens
cttgtaaatagctcaggtgtc

SEQ ID NO: 3391459 - DNA, 19 bp, Homo sapiens
cttgtaaatgtttcttttc

SEQ ID NO: 3391460 - DNA, 16 bp, Homo sapiens
cttgtaataaatactg

SEQ ID NO: 3391461 - DNA, 23 bp, Homo sapiens
cttgtaattctaaatgaatgttt

SEQ ID NO: 3391462 - DNA, 22 bp, Homo sapiens
cttgtaatttaaacaggcccag

SEQ ID NO: 3391463 - DNA, 23 bp, Homo sapiens
cttgtaatttaaacaggcccagc

SEQ ID NO: 3391464 - DNA, 12 bp, Homo sapiens
cttgtacaaaat

SEQ ID NO: 3391465 - DNA, 20 bp, Homo sapiens
cttgtacagtgtctgtgcca

SEQ ID NO: 3391466 - DNA, 23 bp, Homo sapiens
cttgtacatgtgtagcctgtgca

SEQ ID NO: 3391467 - DNA, 18 bp, Homo sapiens
cttgtacttctgtgttca

SEQ ID NO: 3391468 - DNA, 14 bp, Homo sapiens
cttgtagaattgtt

SEQ ID NO: 3391469 - DNA, 17 bp, Homo sapiens
cttgtagaattgttata

SEQ ID NO: 3391470 - DNA, 21 bp, Homo sapiens
cttgtaggagctgaggtttca

SEQ ID NO: 3391471 - DNA, 15 bp, Homo sapiens
cttgtagtgtgtgct

SEQ ID NO: 3391472 - DNA, 21 bp, Homo sapiens
cttgtataaatgtatatacac

SEQ ID NO: 3391473 - DNA, 12 bp, Homo sapiens
cttgtataatat

SEQ ID NO: 3391474 - DNA, 11 bp, Homo sapiens
cttgtatattt

SEQ ID NO: 3391475 - DNA, 16 bp, Homo sapiens
cttgtatatttgtaca

SEQ ID NO: 3391476 - DNA, 18 bp, Homo sapiens
cttgtatatttgtacaaa

SEQ ID NO: 3391477 - DNA, 23 bp, Homo sapiens
cttgtatattttaagaaataaca

SEQ ID NO: 3391478 - DNA, 19 bp, Homo sapiens
cttgtatcaacactgttac

SEQ ID NO: 3391479 - DNA, 18 bp, Homo sapiens
cttgtatcctctggttct

SEQ ID NO: 3391480 - DNA, 23 bp, Homo sapiens
cttgtattaaactcttcacaaaa

SEQ ID NO: 3391481 - DNA, 13 bp, Homo sapiens
cttgtattgactt

SEQ ID NO: 3391482 - DNA, 12 bp, Homo sapiens
cttgtatttaat

SEQ ID NO: 3391483 - DNA, 16 bp, Homo sapiens
cttgtatttaattctt

SEQ ID NO: 3391484 - DNA, 15 bp, Homo sapiens
cttgtatttccaaac

SEQ ID NO: 3391485 - DNA, 19 bp, Homo sapiens
cttgtattttgttaaagct

SEQ ID NO: 3391486 - DNA, 15 bp, Homo sapiens
cttgtcacaataaat

SEQ ID NO: 3391487 - DNA, 16 bp, Homo sapiens
ctttgcaccaaagaca

SEQ ID NO: 3391488 - DNA, 16 bp, Homo sapiens
ctttgcactgagggcc

SEQ ID NO: 3391489 - DNA, 18 bp, Homo sapiens
ctttgcactgagggccac

SEQ ID NO: 3391490 - DNA, 16 bp, Homo sapiens
ctttgcactgatatat

SEQ ID NO: 3391491 - DNA, 16 bp, Homo sapiens
ctttgcacttaaaaat

SEQ ID NO: 3391492 - DNA, 18 bp, Homo sapiens
ctttgcacttaatggctg

SEQ ID NO: 3391493 - DNA, 16 bp, Homo sapiens
ctttgcagacaggcaa

SEQ ID NO: 3391494 - DNA, 22 bp, Homo sapiens
ctttgcagccggcacagggtct

SEQ ID NO: 3391495 - DNA, 16 bp, Homo sapiens
ctttgcaggctctggg

SEQ ID NO: 3391496 - DNA, 18 bp, Homo sapiens
ctttgcaggctctgggct

SEQ ID NO: 3391497 - DNA, 13 bp, Homo sapiens
ctttgcagggcag

SEQ ID NO: 3391498 - DNA, 19 bp, Homo sapiens
ctttgcagggcagccccac

SEQ ID NO: 3391499 - DNA, 12 bp, Homo sapiens
ctttgcatttat

SEQ ID NO: 3391500 - DNA, 18 bp, Homo sapiens
ctttgccaaaaaaaaaag

SEQ ID NO: 3391501 - DNA, 19 bp, Homo sapiens
ctttgccaaaaaaaaaaga

SEQ ID NO: 3391502 - DNA, 18 bp, Homo sapiens
ctttgccagaaagcataa

SEQ ID NO: 3391503 - DNA, 13 bp, Homo sapiens
ctttgccagcttt

SEQ ID NO: 3391504 - DNA, 15 bp, Homo sapiens
ctttgcccagaaaga

SEQ ID NO: 3391505 - DNA, 15 bp, Homo sapiens
ctttgccttcttttg

SEQ ID NO: 3391506 - DNA, 12 bp, Homo sapiens
ctttgccttgca

SEQ ID NO: 3391507 - DNA, 18 bp, Homo sapiens
ctttgccttgcagccaca

SEQ ID NO: 3391508 - DNA, 19 bp, Homo sapiens
ctttgccttgggctgctcc

SEQ ID NO: 3391509 - DNA, 15 bp, Homo sapiens
ctttgcgcctgtgac

SEQ ID NO: 3391510 - DNA, 21 bp, Homo sapiens
ctttgctacaaatttatgcat

SEQ ID NO: 3391511 - DNA, 14 bp, Homo sapiens
ctttgctatgtaag

SEQ ID NO: 3391512 - DNA, 21 bp, Homo sapiens
ctttgctccgctcccaccgcc

SEQ ID NO: 3391513 - DNA, 13 bp, Homo sapiens
ctttgctctgggt

SEQ ID NO: 3391514 - DNA, 14 bp, Homo sapiens
ctttgctggaagaa

SEQ ID NO: 3391515 - DNA, 19 bp, Homo sapiens
ctttgcttatgaatattta

SEQ ID NO: 3391516 - DNA, 22 bp, Homo sapiens
ctttgcttccgccactcagcca

SEQ ID NO: 3391517 - DNA, 23 bp, Homo sapiens
ctttgcttgaacacagtattttc

SEQ ID NO: 3391518 - DNA, 18 bp, Homo sapiens
ctttggaaaaatgtttgt

SEQ ID NO: 3391519 - DNA, 14 bp, Homo sapiens
ctttggagactggg

SEQ ID NO: 3391520 - DNA, 15 bp, Homo sapiens
ctttggagactgggg

SEQ ID NO: 3391521 - DNA, 22 bp, Homo sapiens
ctttggagactggggtggcctc

SEQ ID NO: 3391522 - DNA, 23 bp, Homo sapiens
ctttggagcttttttctttaaga

SEQ ID NO: 3391523 - DNA, 22 bp, Homo sapiens
ctttggagtcccctcacctcct

SEQ ID NO: 3391524 - DNA, 14 bp, Homo sapiens
ctttggattctaaa

SEQ ID NO: 3391525 - DNA, 21 bp, Homo sapiens
ctttggattctaaatacatgc

SEQ ID NO: 3391526 - DNA, 16 bp, Homo sapiens
ctttggcaatttcctg

SEQ ID NO: 3391527 - DNA, 11 bp, Homo sapiens
ctttggcagtg

SEQ ID NO: 3391528 - DNA, 22 bp, Homo sapiens
ctttggcatcttttggaggaaa

SEQ ID NO: 3391529 - DNA, 19 bp, Homo sapiens
ctttggctattagagatca

SEQ ID NO: 3391530 - DNA, 15 bp, Homo sapiens
ctttggctcccctgt

SEQ ID NO: 3391531 - DNA, 15 bp, Homo sapiens
ctttggctctggaga

SEQ ID NO: 3391532 - DNA, 18 bp, Homo sapiens
ctttggctgaggggcttg

SEQ ID NO: 3391533 - DNA, 19 bp, Homo sapiens
ctttggctgaggggcttgg

SEQ ID NO: 3391534 - DNA, 16 bp, Homo sapiens
ctttgggaaagcccag

SEQ ID NO: 3391535 - DNA, 17 bp, Homo sapiens
ctttgggaaagcccaga

SEQ ID NO: 3391536 - DNA, 17 bp, Homo sapiens
ctttgggacttgggagc

SEQ ID NO: 3391537 - DNA, 17 bp, Homo sapiens
ctttgggaggctgaggt

SEQ ID NO: 3391538 - DNA, 11 bp, Homo sapiens
ctttgggatcc

SEQ ID NO: 3391539 - DNA, 19 bp, Homo sapiens
ctttgggatcccaccctgg

SEQ ID NO: 3391540 - DNA, 20 bp, Homo sapiens
ctttgggctgccctggtgct

SEQ ID NO: 3391541 - DNA, 12 bp, Homo sapiens
ctttgggctttg

SEQ ID NO: 3391542 - DNA, 20 bp, Homo sapiens
ctttggggaaagggaggaag

SEQ ID NO: 3391543 - DNA, 19 bp, Homo sapiens
ctttggggacagttggcag

SEQ ID NO: 3391544 - DNA, 21 bp, Homo sapiens
ctttggggacagttggcagag

SEQ ID NO: 3391545 - DNA, 18 bp, Homo sapiens
ctttggggctaatttaac

SEQ ID NO: 3391546 - DNA, 22 bp, Homo sapiens
ctttggtaattttttttgtttt

SEQ ID NO: 3391547 - DNA, 22 bp, Homo sapiens
ctttggtacatggccagtgtga

SEQ ID NO: 3391548 - DNA, 15 bp, Homo sapiens
ctttggtctattttc

SEQ ID NO: 3391549 - DNA, 18 bp, Homo sapiens
ctttggtgaacagttttg

SEQ ID NO: 3391550 - DNA, 15 bp, Homo sapiens
ctttggtgcctttcc

SEQ ID NO: 3391551 - DNA, 19 bp, Homo sapiens
ctttggtgttacacagccc

SEQ ID NO: 3391552 - DNA, 13 bp, Homo sapiens
ctttggttctaag

SEQ ID NO: 3391553 - DNA, 16 bp, Homo sapiens
ctttggttctaaggac

SEQ ID NO: 3391554 - DNA, 21 bp, Homo sapiens
ctttggttctggccagaatgc

SEQ ID NO: 3391555 - DNA, 17 bp, Homo sapiens
ctttggtttttttcttc

SEQ ID NO: 3391556 - DNA, 13 bp, Homo sapiens
ctttgtaaattgt

SEQ ID NO: 3391557 - DNA, 18 bp, Homo sapiens
ctttgtaagacatttgta

SEQ ID NO: 3391558 - DNA, 17 bp, Homo sapiens
ctttgtaagagtgtaga

SEQ ID NO: 3391559 - DNA, 18 bp, Homo sapiens
ctttgtaagagtgtagaa

SEQ ID NO: 3391560 - DNA, 23 bp, Homo sapiens
ctttgtaagagtgtagaagcatt

SEQ ID NO: 3391561 - DNA, 17 bp, Homo sapiens
ctttgtaagatccaccc

SEQ ID NO: 3391562 - DNA, 22 bp, Homo sapiens
ctttgtaatattctccccaccc

SEQ ID NO: 3391563 - DNA, 13 bp, Homo sapiens
ctttgtaatcact

SEQ ID NO: 3391564 - DNA, 19 bp, Homo sapiens
ctttgtaatcactcccatt

SEQ ID NO: 3391565 - DNA, 15 bp, Homo sapiens
ctttgtaatttttgg

SEQ ID NO: 3391566 - DNA, 21 bp, Homo sapiens
ctttgtaatttttggggaaaa

SEQ ID NO: 3391567 - DNA, 15 bp, Homo sapiens
ctttgtacagagtgc

SEQ ID NO: 3391568 - DNA, 13 bp, Homo sapiens
ctttgtaccaaaa

SEQ ID NO: 3391569 - DNA, 14 bp, Homo sapiens
ctttgtacccccca

SEQ ID NO: 3391570 - DNA, 21 bp, Homo sapiens
ctttgtaccccccaacccctg

SEQ ID NO: 3391571 - DNA, 16 bp, Homo sapiens
ctttgtacttgtgttt

SEQ ID NO: 3391572 - DNA, 13 bp, Homo sapiens
ctttgtagatcct

SEQ ID NO: 3391573 - DNA, 18 bp, Homo sapiens
ctttgtaggtgagatgca

SEQ ID NO: 3391574 - DNA, 18 bp, Homo sapiens
ctttgtagttactcaagc

SEQ ID NO: 3391575 - DNA, 15 bp, Homo sapiens
ctttgtataatccca

SEQ ID NO: 3391576 - DNA, 15 bp, Homo sapiens
ctttgtatcttccat

SEQ ID NO: 3391577 - DNA, 12 bp, Homo sapiens
ctttgtatgcac

SEQ ID NO: 3391578 - DNA, 13 bp, Homo sapiens
ctttgtattttga

SEQ ID NO: 3391579 - DNA, 17 bp, Homo sapiens
ctttgtattttgattat

SEQ ID NO: 3391580 - DNA, 18 bp, Homo sapiens
ctttgtattttgattatt

SEQ ID NO: 3391581 - DNA, 20 bp, Homo sapiens
ctttgtcaccacgtggggct

SEQ ID NO: 3391582 - DNA, 17 bp, Homo sapiens
ctttgtccaaaggaaag

SEQ ID NO: 3391583 - DNA, 22 bp, Homo sapiens
ctttgtcctaagagatttatct

SEQ ID NO: 3391584 - DNA, 15 bp, Homo sapiens
ctttgtctgaaaaat

SEQ ID NO: 3391585 - DNA, 14 bp, Homo sapiens
ctttgtcttgtact

SEQ ID NO: 3391586 - DNA, 17 bp, Homo sapiens
ctttgtcttgtacttct

SEQ ID NO: 3391587 - DNA, 22 bp, Homo sapiens
ctttgtgacaggaaagccctcc

SEQ ID NO: 3391588 - DNA, 17 bp, Homo sapiens
ctttgtgagcctatgat

SEQ ID NO: 3391589 - DNA, 18 bp, Homo sapiens
ctttgtgataatttaaga

SEQ ID NO: 3391590 - DNA, 18 bp, Homo sapiens
ctttgtgcacatttattt

SEQ ID NO: 3391591 - DNA, 13 bp, Homo sapiens
ctttgtgctgtgg

SEQ ID NO: 3391592 - DNA, 17 bp, Homo sapiens
ctttgtgctgtggggct

SEQ ID NO: 3391593 - DNA, 22 bp, Homo sapiens
ctttgtgcttggggctatttgt

SEQ ID NO: 3391594 - DNA, 17 bp, Homo sapiens
ctttgtggatgtcttcc

SEQ ID NO: 3391595 - DNA, 20 bp, Homo sapiens
ctttgtggattctgaggccc

SEQ ID NO: 3391596 - DNA, 12 bp, Homo sapiens
ctttgtggggct

SEQ ID NO: 3391597 - DNA, 13 bp, Homo sapiens
ctttgtggggctt

SEQ ID NO: 3391598 - DNA, 21 bp, Homo sapiens
ctttgtggggcttggcgtgga

SEQ ID NO: 3391599 - DNA, 16 bp, Homo sapiens
ctttgtgtagctttgc

SEQ ID NO: 3391600 - DNA, 17 bp, Homo sapiens
ctttgtgtagctttgct

SEQ ID NO: 3391601 - DNA, 22 bp, Homo sapiens
ctttgtgtatttttcaataata

SEQ ID NO: 3391602 - DNA, 13 bp, Homo sapiens
ctttgtgtttata

SEQ ID NO: 3391603 - DNA, 14 bp, Homo sapiens
ctttgtgtttctat

SEQ ID NO: 3391604 - DNA, 20 bp, Homo sapiens
ctttgttatttttgtttctt

SEQ ID NO: 3391605 - DNA, 18 bp, Homo sapiens
ctttgttcaggtctctag

SEQ ID NO: 3391606 - DNA, 17 bp, Homo sapiens
ctttgttctcagctccc

SEQ ID NO: 3391607 - DNA, 20 bp, Homo sapiens
ctttgttctcagctccccct

SEQ ID NO: 3391608 - DNA, 23 bp, Homo sapiens
ctttgttctcagctccccctgtc

SEQ ID NO: 3391609 - DNA, 23 bp, Homo sapiens
ctttgttctgagcattcgctgta

SEQ ID NO: 3391610 - DNA, 13 bp, Homo sapiens
ctttgttctgttt

SEQ ID NO: 3391611 - DNA, 17 bp, Homo sapiens
ctttgtttcaaccaagt

SEQ ID NO: 3391612 - DNA, 15 bp, Homo sapiens
ctttgtttccttgtt

SEQ ID NO: 3391613 - DNA, 20 bp, Homo sapiens
gaaaggattttaccaaagca

SEQ ID NO: 3391614 - DNA, 21 bp, Homo sapiens
gaaaggattttaccaaagcat

SEQ ID NO: 3391615 - DNA, 14 bp, Homo sapiens
gaaaggcctgcaca

SEQ ID NO: 3391616 - DNA, 18 bp, Homo sapiens
gaaaggctcagtctcagg

SEQ ID NO: 3391617 - DNA, 21 bp, Homo sapiens
gaaaggctcagtctcaggagc

SEQ ID NO: 3391618 - DNA, 15 bp, Homo sapiens
gaaaggctgccgagg

SEQ ID NO: 3391619 - DNA, 21 bp, Homo sapiens
gaaaggctgccgaggaccctc

SEQ ID NO: 3391620 - DNA, 16 bp, Homo sapiens
gaaagggaacagaaag

SEQ ID NO: 3391621 - DNA, 21 bp, Homo sapiens
gaaagggcacttaatttgtaa

SEQ ID NO: 3391622 - DNA, 16 bp, Homo sapiens
gaaagggcccagagag

SEQ ID NO: 3391623 - DNA, 18 bp, Homo sapiens
gaaaggggaaagaaaggg

SEQ ID NO: 3391624 - DNA, 17 bp, Homo sapiens
gaaaggggggagctggg

SEQ ID NO: 3391625 - DNA, 19 bp, Homo sapiens
gaaagggttaatcatattt

SEQ ID NO: 3391626 - DNA, 23 bp, Homo sapiens
gaaagggttaatcatatttgaaa

SEQ ID NO: 3391627 - DNA, 13 bp, Homo sapiens
gaaaggttttgga

SEQ ID NO: 3391628 - DNA, 14 bp, Homo sapiens
gaaaggttttgtat

SEQ ID NO: 3391629 - DNA, 19 bp, Homo sapiens
gaaagtacactctgctgtt

SEQ ID NO: 3391630 - DNA, 20 bp, Homo sapiens
gaaagtacactctgctgttt

SEQ ID NO: 3391631 - DNA, 16 bp, Homo sapiens
gaaagtagaacttact

SEQ ID NO: 3391632 - DNA, 17 bp, Homo sapiens
gaaagtcaccaggactt

SEQ ID NO: 3391633 - DNA, 20 bp, Homo sapiens
gaaagtcagatgcccagagg

SEQ ID NO: 3391634 - DNA, 19 bp, Homo sapiens
gaaagtgaagcaaatcaga

SEQ ID NO: 3391635 - DNA, 16 bp, Homo sapiens
gaaagtgaatttgaat

SEQ ID NO: 3391636 - DNA, 22 bp, Homo sapiens
gaaagtgactttaaaagaaaat

SEQ ID NO: 3391637 - DNA, 23 bp, Homo sapiens
gaaagtgccagcattccagactt

SEQ ID NO: 3391638 - DNA, 22 bp, Homo sapiens
gaaagtgggcttaatggagttc

SEQ ID NO: 3391639 - DNA, 17 bp, Homo sapiens
gaaagtgtaaaatagaa

SEQ ID NO: 3391640 - DNA, 22 bp, Homo sapiens
gaaagttttcagaacctcttcc

SEQ ID NO: 3391641 - DNA, 18 bp, Homo sapiens
gaaagtttttttttatta

SEQ ID NO: 3391642 - DNA, 19 bp, Homo sapiens
gaaagtttttttttattat

SEQ ID NO: 3391643 - DNA, 18 bp, Homo sapiens
gaaataaaaaagtctcta

SEQ ID NO: 3391644 - DNA, 13 bp, Homo sapiens
gaaataaaacagg

SEQ ID NO: 3391645 - DNA, 21 bp, Homo sapiens
gaaataaaagtgaatgaaaga

SEQ ID NO: 3391646 - DNA, 12 bp, Homo sapiens
gaaataaacact

SEQ ID NO: 3391647 - DNA, 14 bp, Homo sapiens
gaaataaactgtgc

SEQ ID NO: 3391648 - DNA, 23 bp, Homo sapiens
gaaataaatagctatatccatgt

SEQ ID NO: 3391649 - DNA, 14 bp, Homo sapiens
gaaataaatcagag

SEQ ID NO: 3391650 - DNA, 18 bp, Homo sapiens
gaaataaatcagagagca

SEQ ID NO: 3391651 - DNA, 12 bp, Homo sapiens
gaaataaatgta

SEQ ID NO: 3391652 - DNA, 22 bp, Homo sapiens
gaaataaattggtgataagtgg

SEQ ID NO: 3391653 - DNA, 15 bp, Homo sapiens
gaaataacaatgtta

SEQ ID NO: 3391654 - DNA, 20 bp, Homo sapiens
gaaataacaatgttaaggaa

SEQ ID NO: 3391655 - DNA, 13 bp, Homo sapiens
gaaataatatgca

SEQ ID NO: 3391656 - DNA, 14 bp, Homo sapiens
gaaataatatgcat

SEQ ID NO: 3391657 - DNA, 19 bp, Homo sapiens
gaaataatgctacaatttt

SEQ ID NO: 3391658 - DNA, 21 bp, Homo sapiens
gaaataatgctacaattttaa

SEQ ID NO: 3391659 - DNA, 16 bp, Homo sapiens
gaaatacctcatgttt

SEQ ID NO: 3391660 - DNA, 15 bp, Homo sapiens
gaaatacctttgtag

SEQ ID NO: 3391661 - DNA, 17 bp, Homo sapiens
gaaatacctttgtagtt

SEQ ID NO: 3391662 - DNA, 15 bp, Homo sapiens
gaaatactatttaaa

SEQ ID NO: 3391663 - DNA, 18 bp, Homo sapiens
gaaatactgcaagaaaat

SEQ ID NO: 3391664 - DNA, 12 bp, Homo sapiens
gaaatacttttt

SEQ ID NO: 3391665 - DNA, 16 bp, Homo sapiens
gaaatagaaaaggaag

SEQ ID NO: 3391666 - DNA, 19 bp, Homo sapiens
gaaatagacaaaaagtata

SEQ ID NO: 3391667 - DNA, 15 bp, Homo sapiens
gaaatagtctgtgtg

SEQ ID NO: 3391668 - DNA, 17 bp, Homo sapiens
gaaatagtctgtgtgaa

SEQ ID NO: 3391669 - DNA, 14 bp, Homo sapiens
gaaatataataaaa

SEQ ID NO: 3391670 - DNA, 18 bp, Homo sapiens
gaaatatatatacatatg

SEQ ID NO: 3391671 - DNA, 14 bp, Homo sapiens
gaaatatatatgtg

SEQ ID NO: 3391672 - DNA, 20 bp, Homo sapiens
gaaatatattacttaactgt

SEQ ID NO: 3391673 - DNA, 12 bp, Homo sapiens
gaaatatcattt

SEQ ID NO: 3391674 - DNA, 13 bp, Homo sapiens
gaaatatcattta

SEQ ID NO: 3391675 - DNA, 19 bp, Homo sapiens
gaaatatctgaaaatgtat

SEQ ID NO: 3391676 - DNA, 14 bp, Homo sapiens
gaaatatgatttta

SEQ ID NO: 3391677 - DNA, 17 bp, Homo sapiens
gaaatatgcacaatagc

SEQ ID NO: 3391678 - DNA, 13 bp, Homo sapiens
gaaatatttattt

SEQ ID NO: 3391679 - DNA, 21 bp, Homo sapiens
gaaatattttgataataaatt

SEQ ID NO: 3391680 - DNA, 15 bp, Homo sapiens
gaaatcaaccctctc

SEQ ID NO: 3391681 - DNA, 22 bp, Homo sapiens
gaaatcacaggggcggggcagg

SEQ ID NO: 3391682 - DNA, 15 bp, Homo sapiens
gaaatcattgtagaa

SEQ ID NO: 3391683 - DNA, 18 bp, Homo sapiens
gaaatccctgtttaatat

SEQ ID NO: 3391684 - DNA, 21 bp, Homo sapiens
gaaatccctgtttaatattta

SEQ ID NO: 3391685 - DNA, 22 bp, Homo sapiens
gaaatccctgtttaatatttaa

SEQ ID NO: 3391686 - DNA, 21 bp, Homo sapiens
gaaatcctagtttcctctcct

SEQ ID NO: 3391687 - DNA, 15 bp, Homo sapiens
gaaatctacttccta

SEQ ID NO: 3391688 - DNA, 21 bp, Homo sapiens
gaaatctagttatttacagga

SEQ ID NO: 3391689 - DNA, 20 bp, Homo sapiens
gaaatctcctttagccatca

SEQ ID NO: 3391690 - DNA, 13 bp, Homo sapiens
gaaatgaaattta

SEQ ID NO: 3391691 - DNA, 17 bp, Homo sapiens
gaaatgaaatttaaaca

SEQ ID NO: 3391692 - DNA, 19 bp, Homo sapiens
gaaatgaaatttaaacatt

SEQ ID NO: 3391693 - DNA, 14 bp, Homo sapiens
gaaatgaacattcc

SEQ ID NO: 3391694 - DNA, 18 bp, Homo sapiens
gaaatgaataatttccca

SEQ ID NO: 3391695 - DNA, 15 bp, Homo sapiens
gaaatgaattaaagt

SEQ ID NO: 3391696 - DNA, 13 bp, Homo sapiens
gaaatgactaatt

SEQ ID NO: 3391697 - DNA, 23 bp, Homo sapiens
gaaatgattcaaattgctgcttg

SEQ ID NO: 3391698 - DNA, 21 bp, Homo sapiens
gaaatgcattttattctttaa

SEQ ID NO: 3391699 - DNA, 19 bp, Homo sapiens
gaaatgccctcctaaatgt

SEQ ID NO: 3391700 - DNA, 17 bp, Homo sapiens
gaaatgcggtctggtct

SEQ ID NO: 3391701 - DNA, 15 bp, Homo sapiens
gaaatggaaagcaga

SEQ ID NO: 3391702 - DNA, 14 bp, Homo sapiens
gaaatggaaatttt

SEQ ID NO: 3391703 - DNA, 16 bp, Homo sapiens
gaaatggatactacat

SEQ ID NO: 3391704 - DNA, 17 bp, Homo sapiens
gaaatggatgcaaagta

SEQ ID NO: 3391705 - DNA, 19 bp, Homo sapiens
gaaatgggacttaactcct

SEQ ID NO: 3391706 - DNA, 18 bp, Homo sapiens
gaaatgggagatggtcag

SEQ ID NO: 3391707 - DNA, 18 bp, Homo sapiens
gaaatgtacttttggata

SEQ ID NO: 3391708 - DNA, 15 bp, Homo sapiens
gaaatgtgaaggaaa

SEQ ID NO: 3391709 - DNA, 21 bp, Homo sapiens
gaaatgttaaaggttcacagg

SEQ ID NO: 3391710 - DNA, 23 bp, Homo sapiens
gaaattacccactgtcaggcctc

SEQ ID NO: 3391711 - DNA, 19 bp, Homo sapiens
gaaattacctgtggatatt

SEQ ID NO: 3391712 - DNA, 13 bp, Homo sapiens
gaaattagggccc

SEQ ID NO: 3391713 - DNA, 13 bp, Homo sapiens
gaaattatttaat

SEQ ID NO: 3391714 - DNA, 12 bp, Homo sapiens
gaaattccaaag

SEQ ID NO: 3391715 - DNA, 20 bp, Homo sapiens
gaaattccttgccccacagt

SEQ ID NO: 3391716 - DNA, 15 bp, Homo sapiens
gaaattctcctggag

SEQ ID NO: 3391717 - DNA, 14 bp, Homo sapiens
gaaattcttcatga

SEQ ID NO: 3391718 - DNA, 13 bp, Homo sapiens
gaaattgcatact

SEQ ID NO: 3391719 - DNA, 18 bp, Homo sapiens
gaaattgtacatatttgt

SEQ ID NO: 3391720 - DNA, 18 bp, Homo sapiens
gaaattgtgaactcattg

SEQ ID NO: 3391721 - DNA, 22 bp, Homo sapiens
gaaattgtttaagtgttgtaaa

SEQ ID NO: 3391722 - DNA, 21 bp, Homo sapiens
gaaatttatgaagcagattta

SEQ ID NO: 3391723 - DNA, 21 bp, Homo sapiens
gaaatttcagattcccagagc

SEQ ID NO: 3391724 - DNA, 12 bp, Homo sapiens
gaaatttcattt

SEQ ID NO: 3391725 - DNA, 13 bp, Homo sapiens
gaaatttcatttt

SEQ ID NO: 3391726 - DNA, 16 bp, Homo sapiens
gaaatttcattttcct

SEQ ID NO: 3391727 - DNA, 14 bp, Homo sapiens
gaaatttctgtgaa

SEQ ID NO: 3391728 - DNA, 18 bp, Homo sapiens
gaaatttgttatacttca

SEQ ID NO: 3391729 - DNA, 13 bp, Homo sapiens
gaaattttgcaaa

SEQ ID NO: 3391730 - DNA, 17 bp, Homo sapiens
gaaattttgcaaatata

SEQ ID NO: 3391731 - DNA, 21 bp, Homo sapiens
gaaattttgcaaatataaaca

SEQ ID NO: 3391732 - DNA, 13 bp, Homo sapiens
gaaattttgctat

SEQ ID NO: 3391733 - DNA, 19 bp, Homo sapiens
gaaatttttacctttatct

SEQ ID NO: 3391734 - DNA, 17 bp, Homo sapiens
gaaatttttatttttct

SEQ ID NO: 3391735 - DNA, 17 bp, Homo sapiens
gaaatttttttcctaag

SEQ ID NO: 3391736 - DNA, 20 bp, Homo sapiens
gaacaaaaaaaccacaaagg

SEQ ID NO: 3391737 - DNA, 19 bp, Homo sapiens
gaacaaaaattacaaagaa

SEQ ID NO: 3391738 - DNA, 13 bp, Homo sapiens
gaacaaaactgtt

SEQ ID NO: 3391739 - DNA, 22 bp, Homo sapiens
gaagatcctgcgggtggggctt

SEQ ID NO: 3391740 - DNA, 20 bp, Homo sapiens
gaagatgaggttctgagacc

SEQ ID NO: 3391741 - DNA, 17 bp, Homo sapiens
gaagatggtttcaattc

SEQ ID NO: 3391742 - DNA, 19 bp, Homo sapiens
gaagatggtttcaattcag

SEQ ID NO: 3391743 - DNA, 21 bp, Homo sapiens
gaagatgtttactcattgccc

SEQ ID NO: 3391744 - DNA, 15 bp, Homo sapiens
gaagatgtttcaaaa

SEQ ID NO: 3391745 - DNA, 17 bp, Homo sapiens
gaagattctcctgtgct

SEQ ID NO: 3391746 - DNA, 13 bp, Homo sapiens
gaagattgtgaat

SEQ ID NO: 3391747 - DNA, 20 bp, Homo sapiens
gaagatttgatgctggagag

SEQ ID NO: 3391748 - DNA, 16 bp, Homo sapiens
gaagcaaagtgctgga

SEQ ID NO: 3391749 - DNA, 17 bp, Homo sapiens
gaagcaagacacgtggc

SEQ ID NO: 3391750 - DNA, 18 bp, Homo sapiens
gaagcaaggaagatatac

SEQ ID NO: 3391751 - DNA, 13 bp, Homo sapiens
gaagcacaactcc

SEQ ID NO: 3391752 - DNA, 22 bp, Homo sapiens
gaagcagacgtccatagctcct

SEQ ID NO: 3391753 - DNA, 13 bp, Homo sapiens
gaagcaggctgga

SEQ ID NO: 3391754 - DNA, 15 bp, Homo sapiens
gaagcaggggtgggg

SEQ ID NO: 3391755 - DNA, 17 bp, Homo sapiens
gaagcagggtttctttt

SEQ ID NO: 3391756 - DNA, 12 bp, Homo sapiens
gaagcaggtgct

SEQ ID NO: 3391757 - DNA, 18 bp, Homo sapiens
gaagcaggttgaggggct

SEQ ID NO: 3391758 - DNA, 19 bp, Homo sapiens
gaagcaggttgaggggctc

SEQ ID NO: 3391759 - DNA, 23 bp, Homo sapiens
gaagcaggttgaggggctcctgg

SEQ ID NO: 3391760 - DNA, 19 bp, Homo sapiens
gaagcagtgcctcgaggca

SEQ ID NO: 3391761 - DNA, 12 bp, Homo sapiens
gaagcatgtttc

SEQ ID NO: 3391762 - DNA, 20 bp, Homo sapiens
gaagcattaaaatgcatggt

SEQ ID NO: 3391763 - DNA, 17 bp, Homo sapiens
gaagcattaacttctct

SEQ ID NO: 3391764 - DNA, 17 bp, Homo sapiens
gaagcattcagagagca

SEQ ID NO: 3391765 - DNA, 19 bp, Homo sapiens
gaagcattctccccagtgt

SEQ ID NO: 3391766 - DNA, 18 bp, Homo sapiens
gaagcatttgatattatc

SEQ ID NO: 3391767 - DNA, 12 bp, Homo sapiens
gaagcatttgta

SEQ ID NO: 3391768 - DNA, 10 bp, Homo sapiens
gaagccaaag

SEQ ID NO: 3391769 - DNA, 22 bp, Homo sapiens
gaagccaagctccctggagccc

SEQ ID NO: 3391770 - DNA, 16 bp, Homo sapiens
gaagccaagggaaagg

SEQ ID NO: 3391771 - DNA, 21 bp, Homo sapiens
gaagccaagggaaaggggtgc

SEQ ID NO: 3391772 - DNA, 15 bp, Homo sapiens
gaagccacgctgtcc

SEQ ID NO: 3391773 - DNA, 14 bp, Homo sapiens
gaagccagccacag

SEQ ID NO: 3391774 - DNA, 18 bp, Homo sapiens
gaagccagccacagaccc

SEQ ID NO: 3391775 - DNA, 21 bp, Homo sapiens
gaagccagccacagacccctg

SEQ ID NO: 3391776 - DNA, 12 bp, Homo sapiens
gaagccagcctt

SEQ ID NO: 3391777 - DNA, 10 bp, Homo sapiens
gaagccagct

SEQ ID NO: 3391778 - DNA, 19 bp, Homo sapiens
gaagccaggtacaggagag

SEQ ID NO: 3391779 - DNA, 17 bp, Homo sapiens
gaagccccaacgggaaa

SEQ ID NO: 3391780 - DNA, 14 bp, Homo sapiens
gaagccgactctgg

SEQ ID NO: 3391781 - DNA, 15 bp, Homo sapiens
gaagccgactctggc

SEQ ID NO: 3391782 - DNA, 17 bp, Homo sapiens
gaagccgactctggccc

SEQ ID NO: 3391783 - DNA, 19 bp, Homo sapiens
gaagccgactctggccctg

SEQ ID NO: 3391784 - DNA, 21 bp, Homo sapiens
gaagccgactctggccctggc

SEQ ID NO: 3391785 - DNA, 22 bp, Homo sapiens
gaagccgactctggccctggcc

SEQ ID NO: 3391786 - DNA, 16 bp, Homo sapiens
gaagccggagggtgtt

SEQ ID NO: 3391787 - DNA, 21 bp, Homo sapiens
gaagcctccaagcctgcctcc

SEQ ID NO: 3391788 - DNA, 12 bp, Homo sapiens
gaagcctctggc

SEQ ID NO: 3391789 - DNA, 14 bp, Homo sapiens
gaagcctctggcta

SEQ ID NO: 3391790 - DNA, 12 bp, Homo sapiens
gaagcctgaggc

SEQ ID NO: 3391791 - DNA, 16 bp, Homo sapiens
gaagcctgcccttgtc

SEQ ID NO: 3391792 - DNA, 16 bp, Homo sapiens
gaagcctggactctgc

SEQ ID NO: 3391793 - DNA, 18 bp, Homo sapiens
gaagcctggactctgccc

SEQ ID NO: 3391794 - DNA, 19 bp, Homo sapiens
gaagcctggactctgcccc

SEQ ID NO: 3391795 - DNA, 15 bp, Homo sapiens
gaagccttcagctcc

SEQ ID NO: 3391796 - DNA, 17 bp, Homo sapiens
gaagccttcagctccag

SEQ ID NO: 3391797 - DNA, 13 bp, Homo sapiens
gaagccttctgca

SEQ ID NO: 3391798 - DNA, 17 bp, Homo sapiens
gaagccttctgcagcag

SEQ ID NO: 3391799 - DNA, 21 bp, Homo sapiens
gaagccttgcactaggttgca

SEQ ID NO: 3391800 - DNA, 20 bp, Homo sapiens
gaagcggccctaagggagtg

SEQ ID NO: 3391801 - DNA, 16 bp, Homo sapiens
gaagctaatttgcatt

SEQ ID NO: 3391802 - DNA, 23 bp, Homo sapiens
gaagctactgtgtgtgtgaatga

SEQ ID NO: 3391803 - DNA, 12 bp, Homo sapiens
gaagctattttt

SEQ ID NO: 3391804 - DNA, 15 bp, Homo sapiens
gaagctccactgtca

SEQ ID NO: 3391805 - DNA, 13 bp, Homo sapiens
gaagctccatgga

SEQ ID NO: 3391806 - DNA, 17 bp, Homo sapiens
gaagctcgccccacctc

SEQ ID NO: 3391807 - DNA, 12 bp, Homo sapiens
gaagctctggct

SEQ ID NO: 3391808 - DNA, 23 bp, Homo sapiens
gaagctctggctgaaccctgtgc

SEQ ID NO: 3391809 - DNA, 20 bp, Homo sapiens
gaagctcttggagctgtgag

SEQ ID NO: 3391810 - DNA, 22 bp, Homo sapiens
gaagctgaaaacctaagtcctt

SEQ ID NO: 3391811 - DNA, 14 bp, Homo sapiens
gaagctgaaaatat

SEQ ID NO: 3391812 - DNA, 15 bp, Homo sapiens
gaagctgaaaatata

SEQ ID NO: 3391813 - DNA, 21 bp, Homo sapiens
gaagctgccagcccagaacac

SEQ ID NO: 3391814 - DNA, 17 bp, Homo sapiens
gaagctgcttctgccca

SEQ ID NO: 3391815 - DNA, 21 bp, Homo sapiens
gaagctggaggctccaggact

SEQ ID NO: 3391816 - DNA, 22 bp, Homo sapiens
gaagctggaggctccaggactc

SEQ ID NO: 3391817 - DNA, 23 bp, Homo sapiens
gaagctggccgagggtcctggct

SEQ ID NO: 3391818 - DNA, 14 bp, Homo sapiens
gaagctggcctgag

SEQ ID NO: 3391819 - DNA, 15 bp, Homo sapiens
gaagctggcctgaga

SEQ ID NO: 3391820 - DNA, 19 bp, Homo sapiens
gaagctggcctgagagggg

SEQ ID NO: 3391821 - DNA, 22 bp, Homo sapiens
gaagctggcctgagaggggaag

SEQ ID NO: 3391822 - DNA, 22 bp, Homo sapiens
gaagctgtactcagagcagagc

SEQ ID NO: 3391823 - DNA, 23 bp, Homo sapiens
gaagctgtgttgaaacagaaaaa

SEQ ID NO: 3391824 - DNA, 18 bp, Homo sapiens
gaagctgttgtacattta

SEQ ID NO: 3391825 - DNA, 15 bp, Homo sapiens
gaagctgtttggaaa

SEQ ID NO: 3391826 - DNA, 15 bp, Homo sapiens
gaagcttcagaagtt

SEQ ID NO: 3391827 - DNA, 11 bp, Homo sapiens
gaagcttctaa

SEQ ID NO: 3391828 - DNA, 22 bp, Homo sapiens
gaagcttctaaatggtgctgca

SEQ ID NO: 3391829 - DNA, 13 bp, Homo sapiens
gaagcttctaata

SEQ ID NO: 3391830 - DNA, 14 bp, Homo sapiens
gaagcttgagcctc

SEQ ID NO: 3391831 - DNA, 16 bp, Homo sapiens
gaagcttgagcctccc

SEQ ID NO: 3391832 - DNA, 17 bp, Homo sapiens
gaagcttgagcctcccc

SEQ ID NO: 3391833 - DNA, 19 bp, Homo sapiens
gaagcttggggaacccatg

SEQ ID NO: 3391834 - DNA, 22 bp, Homo sapiens
gaagctttgtaggtgagatgca

SEQ ID NO: 3391835 - DNA, 23 bp, Homo sapiens
gaagctttgtaggtgagatgcaa

SEQ ID NO: 3391836 - DNA, 23 bp, Homo sapiens
gaaggaaataaaaaagtctctat

SEQ ID NO: 3391837 - DNA, 20 bp, Homo sapiens
gaaggaaatcccatcagtga

SEQ ID NO: 3391838 - DNA, 13 bp, Homo sapiens
gaaggaagagaag

SEQ ID NO: 3391839 - DNA, 16 bp, Homo sapiens
gaaggaagagaagaca

SEQ ID NO: 3391840 - DNA, 12 bp, Homo sapiens
gaaggaagaggg

SEQ ID NO: 3391841 - DNA, 15 bp, Homo sapiens
gaaggaagctgtgtt

SEQ ID NO: 3391842 - DNA, 14 bp, Homo sapiens
gaaggaagggcaga

SEQ ID NO: 3391843 - DNA, 15 bp, Homo sapiens
gaaggaagggcagag

SEQ ID NO: 3391844 - DNA, 18 bp, Homo sapiens
gaaggaatagccagagag

SEQ ID NO: 3391845 - DNA, 17 bp, Homo sapiens
gaaggaatttgggagga

SEQ ID NO: 3391846 - DNA, 18 bp, Homo sapiens
gaaggacagactggccgg

SEQ ID NO: 3391847 - DNA, 19 bp, Homo sapiens
gaaggacattgcggacagc

SEQ ID NO: 3391848 - DNA, 20 bp, Homo sapiens
gaaggacattgcggacagcc

SEQ ID NO: 3391849 - DNA, 17 bp, Homo sapiens
gaaggagaagtaagagg

SEQ ID NO: 3391850 - DNA, 13 bp, Homo sapiens
gaaggagagaaag

SEQ ID NO: 3391851 - DNA, 21 bp, Homo sapiens
gaaggagagaaagtgggtgag

SEQ ID NO: 3391852 - DNA, 13 bp, Homo sapiens
gaaggagagcctg

SEQ ID NO: 3391853 - DNA, 16 bp, Homo sapiens
gaaggagagcctgctg

SEQ ID NO: 3391854 - DNA, 19 bp, Homo sapiens
gaaggaggccaaccagccc

SEQ ID NO: 3391855 - DNA, 21 bp, Homo sapiens
gaaggataagagaaacaggcc

SEQ ID NO: 3391856 - DNA, 22 bp, Homo sapiens
gaaggattcagtcataaagagg

SEQ ID NO: 3391857 - DNA, 18 bp, Homo sapiens
gaaggcaaatataagctg

SEQ ID NO: 3391858 - DNA, 23 bp, Homo sapiens
gaaggcaaatataagctgggaaa

SEQ ID NO: 3391859 - DNA, 16 bp, Homo sapiens
gaaggcaagagggggt

SEQ ID NO: 3391860 - DNA, 23 bp, Homo sapiens
gaaggcaagagggggtggagggg

SEQ ID NO: 3391861 - DNA, 20 bp, Homo sapiens
gaaggcagacagcaggcagc

SEQ ID NO: 3391862 - DNA, 21 bp, Homo sapiens
gaaggcagggggaaggtgggg

SEQ ID NO: 3391863 - DNA, 17 bp, Homo sapiens
gaaggcagtctgaaccc

SEQ ID NO: 3391864 - DNA, 21 bp, Homo sapiens
gaaggcagtggcaggggagca

SEQ ID NO: 3391865 - DNA, 14 bp, Homo sapiens
gaatataggtctct

SEQ ID NO: 3391866 - DNA, 23 bp, Homo sapiens
gaatataggtctcttctcccaga

SEQ ID NO: 3391867 - DNA, 15 bp, Homo sapiens
gaatatatagaattc

SEQ ID NO: 3391868 - DNA, 16 bp, Homo sapiens
gaatatatttatttaa

SEQ ID NO: 3391869 - DNA, 16 bp, Homo sapiens
gaatatcatctgtcat

SEQ ID NO: 3391870 - DNA, 19 bp, Homo sapiens
gaatatcatctgtcattat

SEQ ID NO: 3391871 - DNA, 16 bp, Homo sapiens
gaatatccatgtactt

SEQ ID NO: 3391872 - DNA, 17 bp, Homo sapiens
gaatatctattaatata

SEQ ID NO: 3391873 - DNA, 15 bp, Homo sapiens
gaatatctgtaatgg

SEQ ID NO: 3391874 - DNA, 15 bp, Homo sapiens
gaatatgacggaaga

SEQ ID NO: 3391875 - DNA, 17 bp, Homo sapiens
gaatatgacggaagaac

SEQ ID NO: 3391876 - DNA, 18 bp, Homo sapiens
gaatatgtagctcatcct

SEQ ID NO: 3391877 - DNA, 17 bp, Homo sapiens
gaatatttaagaaaagc

SEQ ID NO: 3391878 - DNA, 22 bp, Homo sapiens
gaatatttgttatgtagataac

SEQ ID NO: 3391879 - DNA, 16 bp, Homo sapiens
gaatattttggaaact

SEQ ID NO: 3391880 - DNA, 19 bp, Homo sapiens
gaatattttggaaactgct

SEQ ID NO: 3391881 - DNA, 21 bp, Homo sapiens
gaatcaagatgtcagactggc

SEQ ID NO: 3391882 - DNA, 21 bp, Homo sapiens
gaatcacggtggtaaagaaag

SEQ ID NO: 3391883 - DNA, 14 bp, Homo sapiens
gaatcactgcagcc

SEQ ID NO: 3391884 - DNA, 17 bp, Homo sapiens
gaatcactgcagcccag

SEQ ID NO: 3391885 - DNA, 15 bp, Homo sapiens
gaatcactgttttta

SEQ ID NO: 3391886 - DNA, 21 bp, Homo sapiens
gaatcaggaatattttccaaa

SEQ ID NO: 3391887 - DNA, 15 bp, Homo sapiens
gaatcagggaccagc

SEQ ID NO: 3391888 - DNA, 23 bp, Homo sapiens
gaatcagggaccagctttactgg

SEQ ID NO: 3391889 - DNA, 17 bp, Homo sapiens
gaatcatgtcaggcctg

SEQ ID NO: 3391890 - DNA, 21 bp, Homo sapiens
gaatcatgtcaggcctgtgtg

SEQ ID NO: 3391891 - DNA, 12 bp, Homo sapiens
gaatcatgtcca

SEQ ID NO: 3391892 - DNA, 18 bp, Homo sapiens
gaatcattcagaaatgtt

SEQ ID NO: 3391893 - DNA, 20 bp, Homo sapiens
gaatccaagcctccacagcg

SEQ ID NO: 3391894 - DNA, 19 bp, Homo sapiens
gaatccagctccctagact

SEQ ID NO: 3391895 - DNA, 16 bp, Homo sapiens
gaatccataaatgtgt

SEQ ID NO: 3391896 - DNA, 19 bp, Homo sapiens
gaatccataaatgtgttcc

SEQ ID NO: 3391897 - DNA, 22 bp, Homo sapiens
gaatcccacccacatgtgacac

SEQ ID NO: 3391898 - DNA, 17 bp, Homo sapiens
gaatcccagaggtggga

SEQ ID NO: 3391899 - DNA, 12 bp, Homo sapiens
gaatcctggcag

SEQ ID NO: 3391900 - DNA, 14 bp, Homo sapiens
gaatcctttacatt

SEQ ID NO: 3391901 - DNA, 14 bp, Homo sapiens
gaatcctttgcctg

SEQ ID NO: 3391902 - DNA, 14 bp, Homo sapiens
gaatcggctgggga

SEQ ID NO: 3391903 - DNA, 16 bp, Homo sapiens
gaatctcgttcccaaa

SEQ ID NO: 3391904 - DNA, 17 bp, Homo sapiens
gaatctcgttcccaaag

SEQ ID NO: 3391905 - DNA, 19 bp, Homo sapiens
gaatctcgttcccaaagaa

SEQ ID NO: 3391906 - DNA, 23 bp, Homo sapiens
gaatctctgcctagaatctttat

SEQ ID NO: 3391907 - DNA, 13 bp, Homo sapiens
gaatctctgtgcc

SEQ ID NO: 3391908 - DNA, 15 bp, Homo sapiens
gaatctgcaattcaa

SEQ ID NO: 3391909 - DNA, 22 bp, Homo sapiens
gaatctgcaattcaaaagttcc

SEQ ID NO: 3391910 - DNA, 13 bp, Homo sapiens
gaatctgctcact

SEQ ID NO: 3391911 - DNA, 16 bp, Homo sapiens
gaatctgctcacttta

SEQ ID NO: 3391912 - DNA, 20 bp, Homo sapiens
gaatctgctgcatagctcta

SEQ ID NO: 3391913 - DNA, 13 bp, Homo sapiens
gaatctggattat

SEQ ID NO: 3391914 - DNA, 23 bp, Homo sapiens
gaatctgtctcccagttatgaat

SEQ ID NO: 3391915 - DNA, 11 bp, Homo sapiens
gaatcttctca

SEQ ID NO: 3391916 - DNA, 21 bp, Homo sapiens
gaatcttctcatcttttatct

SEQ ID NO: 3391917 - DNA, 22 bp, Homo sapiens
gaatcttctcatcttttatcta

SEQ ID NO: 3391918 - DNA, 20 bp, Homo sapiens
gaatcttgaggaataaatgc

SEQ ID NO: 3391919 - DNA, 16 bp, Homo sapiens
gaatcttgttttgaaa

SEQ ID NO: 3391920 - DNA, 19 bp, Homo sapiens
gaatctttgtaccaaaatt

SEQ ID NO: 3391921 - DNA, 22 bp, Homo sapiens
gaatgaaaaatttaagcattgt

SEQ ID NO: 3391922 - DNA, 14 bp, Homo sapiens
gaatgaaaataact

SEQ ID NO: 3391923 - DNA, 14 bp, Homo sapiens
gaatgaaagggccc

SEQ ID NO: 3391924 - DNA, 20 bp, Homo sapiens
gaatgaaattaacacaaagg

SEQ ID NO: 3391925 - DNA, 21 bp, Homo sapiens
gaatgaacttgttacttgcag

SEQ ID NO: 3391926 - DNA, 14 bp, Homo sapiens
gaatgaattaaata

SEQ ID NO: 3391927 - DNA, 16 bp, Homo sapiens
gaatgaattaaataaa

SEQ ID NO: 3391928 - DNA, 11 bp, Homo sapiens
gaatgactttt

SEQ ID NO: 3391929 - DNA, 19 bp, Homo sapiens
gaatgagcccagagaacag

SEQ ID NO: 3391930 - DNA, 23 bp, Homo sapiens
gaatgaggaaaattcttaaaagg

SEQ ID NO: 3391931 - DNA, 17 bp, Homo sapiens
gaatgatctcttctttt

SEQ ID NO: 3391932 - DNA, 14 bp, Homo sapiens
gaatgattaatcaa

SEQ ID NO: 3391933 - DNA, 14 bp, Homo sapiens
gaatgatttttaga

SEQ ID NO: 3391934 - DNA, 19 bp, Homo sapiens
gaatgcacaagaatggatc

SEQ ID NO: 3391935 - DNA, 20 bp, Homo sapiens
gaatgcacactagcctctcc

SEQ ID NO: 3391936 - DNA, 16 bp, Homo sapiens
gaatgcagattcctgg

SEQ ID NO: 3391937 - DNA, 18 bp, Homo sapiens
gaatgcagattcctgggc

SEQ ID NO: 3391938 - DNA, 23 bp, Homo sapiens
gaatgcagattcctgggcctgtc

SEQ ID NO: 3391939 - DNA, 17 bp, Homo sapiens
gaatgcagggaagaggg

SEQ ID NO: 3391940 - DNA, 11 bp, Homo sapiens
gaatgcagtgg

SEQ ID NO: 3391941 - DNA, 16 bp, Homo sapiens
gaatgcataaataaat

SEQ ID NO: 3391942 - DNA, 21 bp, Homo sapiens
gaatgccactgccttcgcttc

SEQ ID NO: 3391943 - DNA, 22 bp, Homo sapiens
gaatgccactgccttcgcttct

SEQ ID NO: 3391944 - DNA, 17 bp, Homo sapiens
gaatgcccacaggcaaa

SEQ ID NO: 3391945 - DNA, 22 bp, Homo sapiens
gaatgcccacaggcaaatgcat

SEQ ID NO: 3391946 - DNA, 14 bp, Homo sapiens
gaatgccctcaggg

SEQ ID NO: 3391947 - DNA, 20 bp, Homo sapiens
gaatgccggttaaattccat

SEQ ID NO: 3391948 - DNA, 16 bp, Homo sapiens
gaatgcctcctgtggg

SEQ ID NO: 3391949 - DNA, 12 bp, Homo sapiens
gaatgcctcgct

SEQ ID NO: 3391950 - DNA, 17 bp, Homo sapiens
gaatgcctcgctccctt

SEQ ID NO: 3391951 - DNA, 14 bp, Homo sapiens
gaatgctcccagct

SEQ ID NO: 3391952 - DNA, 19 bp, Homo sapiens
gaatgctcccagctgtgct

SEQ ID NO: 3391953 - DNA, 19 bp, Homo sapiens
gaatgctgggactcagcct

SEQ ID NO: 3391954 - DNA, 22 bp, Homo sapiens
gaatgctggttttcctaaatgc

SEQ ID NO: 3391955 - DNA, 13 bp, Homo sapiens
gaatgctgtacat

SEQ ID NO: 3391956 - DNA, 14 bp, Homo sapiens
gaatgctgtacatc

SEQ ID NO: 3391957 - DNA, 15 bp, Homo sapiens
gaatgctgtacatct

SEQ ID NO: 3391958 - DNA, 13 bp, Homo sapiens
gaatggaaaaatc

SEQ ID NO: 3391959 - DNA, 16 bp, Homo sapiens
gaatggaactactgta

SEQ ID NO: 3391960 - DNA, 17 bp, Homo sapiens
gaatggaactactgtac

SEQ ID NO: 3391961 - DNA, 19 bp, Homo sapiens
gaatggaactactgtactt

SEQ ID NO: 3391962 - DNA, 20 bp, Homo sapiens
gaatggaactactgtacttt

SEQ ID NO: 3391963 - DNA, 21 bp, Homo sapiens
gaatggaatcgatttcctccc

SEQ ID NO: 3391964 - DNA, 16 bp, Homo sapiens
gaatggaatcttctcc

SEQ ID NO: 3391965 - DNA, 13 bp, Homo sapiens
gaatggagacaga

SEQ ID NO: 3391966 - DNA, 21 bp, Homo sapiens
gaatggagcagtacatgggaa

SEQ ID NO: 3391967 - DNA, 19 bp, Homo sapiens
gaatggaggcagagacctc

SEQ ID NO: 3391968 - DNA, 20 bp, Homo sapiens
gaatggatggggagaatggt

SEQ ID NO: 3391969 - DNA, 21 bp, Homo sapiens
gaatggatttttctttaactg

SEQ ID NO: 3391970 - DNA, 22 bp, Homo sapiens
gaatggcaatagggtagaatga

SEQ ID NO: 3391971 - DNA, 17 bp, Homo sapiens
gaatgggttttctattt

SEQ ID NO: 3391972 - DNA, 23 bp, Homo sapiens
gaatggtcagcgttgcatgtcgt

SEQ ID NO: 3391973 - DNA, 18 bp, Homo sapiens
gaatggttaataaaactg

SEQ ID NO: 3391974 - DNA, 20 bp, Homo sapiens
gaatggttaataaaactgca

SEQ ID NO: 3391975 - DNA, 16 bp, Homo sapiens
gaatggttccatgcct

SEQ ID NO: 3391976 - DNA, 19 bp, Homo sapiens
gaatggttccatgcctgag

SEQ ID NO: 3391977 - DNA, 13 bp, Homo sapiens
gaatgtaaaagaa

SEQ ID NO: 3391978 - DNA, 17 bp, Homo sapiens
gaatgtaagaaaacaaa

SEQ ID NO: 3391979 - DNA, 18 bp, Homo sapiens
gaatgtaagaaaacaaaa

SEQ ID NO: 3391980 - DNA, 16 bp, Homo sapiens
gaatgtaatcaatgtt

SEQ ID NO: 3391981 - DNA, 14 bp, Homo sapiens
gaatgtactctgtt

SEQ ID NO: 3391982 - DNA, 21 bp, Homo sapiens
gaatgtagcagccccgggagg

SEQ ID NO: 3391983 - DNA, 20 bp, Homo sapiens
gaatgtagctggtttcctca

SEQ ID NO: 3391984 - DNA, 17 bp, Homo sapiens
gaatgtatctgtgaagt

SEQ ID NO: 3391985 - DNA, 17 bp, Homo sapiens
gaatgtatgtaatgtgt

SEQ ID NO: 3391986 - DNA, 21 bp, Homo sapiens
gaatgtattattctgcagcat

SEQ ID NO: 3391987 - DNA, 17 bp, Homo sapiens
gaatgtcccttttccta

SEQ ID NO: 3391988 - DNA, 12 bp, Homo sapiens
gaatgtctggag

SEQ ID NO: 3391989 - DNA, 18 bp, Homo sapiens
gaatgtggccacttattt

SEQ ID NO: 3391990 - DNA, 22 bp, Homo sapiens
gaatgtggcccctgaacaagaa

SEQ ID NO: 3391991 - DNA, 14 bp, Homo sapiens
gacattgcgtttga

SEQ ID NO: 3391992 - DNA, 15 bp, Homo sapiens
gacattgctctctgg

SEQ ID NO: 3391993 - DNA, 12 bp, Homo sapiens
gacattgtcaat

SEQ ID NO: 3391994 - DNA, 21 bp, Homo sapiens
gacattgtctcctatatattt

SEQ ID NO: 3391995 - DNA, 13 bp, Homo sapiens
gacatttaaatgt

SEQ ID NO: 3391996 - DNA, 16 bp, Homo sapiens
gacatttaacttttct

SEQ ID NO: 3391997 - DNA, 13 bp, Homo sapiens
gacatttaattta

SEQ ID NO: 3391998 - DNA, 14 bp, Homo sapiens
gacatttaatttag

SEQ ID NO: 3391999 - DNA, 23 bp, Homo sapiens
gacatttacaccacactttcaaa

SEQ ID NO: 3392000 - DNA, 11 bp, Homo sapiens
gacatttccca

SEQ ID NO: 3392001 - DNA, 13 bp, Homo sapiens
gacatttgtatat

SEQ ID NO: 3392002 - DNA, 14 bp, Homo sapiens
gacatttgtatatt

SEQ ID NO: 3392003 - DNA, 11 bp, Homo sapiens
gacattttcat

SEQ ID NO: 3392004 - DNA, 18 bp, Homo sapiens
gacattttcatgcttcca

SEQ ID NO: 3392005 - DNA, 20 bp, Homo sapiens
gaccaacgttactcagggct

SEQ ID NO: 3392006 - DNA, 18 bp, Homo sapiens
gaccaactagacattctg

SEQ ID NO: 3392007 - DNA, 20 bp, Homo sapiens
gaccaactagacattctgtc

SEQ ID NO: 3392008 - DNA, 14 bp, Homo sapiens
gaccaactgtcact

SEQ ID NO: 3392009 - DNA, 12 bp, Homo sapiens
gaccaagaactg

SEQ ID NO: 3392010 - DNA, 14 bp, Homo sapiens
gaccaagagagaaa

SEQ ID NO: 3392011 - DNA, 18 bp, Homo sapiens
gaccaagagagaaagaag

SEQ ID NO: 3392012 - DNA, 19 bp, Homo sapiens
gaccaaggcaaggcaggtg

SEQ ID NO: 3392013 - DNA, 13 bp, Homo sapiens
gaccaaggtgaag

SEQ ID NO: 3392014 - DNA, 16 bp, Homo sapiens
gaccaagtcctggcta

SEQ ID NO: 3392015 - DNA, 14 bp, Homo sapiens
gaccaagttataaa

SEQ ID NO: 3392016 - DNA, 21 bp, Homo sapiens
gaccaagttataaatcaatgt

SEQ ID NO: 3392017 - DNA, 20 bp, Homo sapiens
gaccaataaaatttctaaga

SEQ ID NO: 3392018 - DNA, 16 bp, Homo sapiens
gaccaatagcccacag

SEQ ID NO: 3392019 - DNA, 20 bp, Homo sapiens
gaccaatattatactaagaa

SEQ ID NO: 3392020 - DNA, 18 bp, Homo sapiens
gaccaattattgatatat

SEQ ID NO: 3392021 - DNA, 14 bp, Homo sapiens
gaccacacagtccc

SEQ ID NO: 3392022 - DNA, 20 bp, Homo sapiens
gaccacacctccctgaacca

SEQ ID NO: 3392023 - DNA, 21 bp, Homo sapiens
gaccacagggttcaaaatgtc

SEQ ID NO: 3392024 - DNA, 23 bp, Homo sapiens
gaccacagggttcaaaatgtctg

SEQ ID NO: 3392025 - DNA, 23 bp, Homo sapiens
gaccacatctttatctgttcttg

SEQ ID NO: 3392026 - DNA, 22 bp, Homo sapiens
gaccaccagccgccccagcccc

SEQ ID NO: 3392027 - DNA, 20 bp, Homo sapiens
gaccaccccgcctgccctca

SEQ ID NO: 3392028 - DNA, 15 bp, Homo sapiens
gaccaccctcccctc

SEQ ID NO: 3392029 - DNA, 17 bp, Homo sapiens
gaccaccctcccctctc

SEQ ID NO: 3392030 - DNA, 18 bp, Homo sapiens
gaccaccctcccctctct

SEQ ID NO: 3392031 - DNA, 17 bp, Homo sapiens
gaccacgcccgtcctgc

SEQ ID NO: 3392032 - DNA, 19 bp, Homo sapiens
gaccacgcccgtcctgcct

SEQ ID NO: 3392033 - DNA, 14 bp, Homo sapiens
gaccacgctttcta

SEQ ID NO: 3392034 - DNA, 21 bp, Homo sapiens
gaccacgctttctagctgttg

SEQ ID NO: 3392035 - DNA, 21 bp, Homo sapiens
gaccacggacgtttccatcag

SEQ ID NO: 3392036 - DNA, 21 bp, Homo sapiens
gaccacggggagcaaaccagc

SEQ ID NO: 3392037 - DNA, 13 bp, Homo sapiens
gaccactcagccc

SEQ ID NO: 3392038 - DNA, 14 bp, Homo sapiens
gaccactcagcccc

SEQ ID NO: 3392039 - DNA, 15 bp, Homo sapiens
gaccactcagcccct

SEQ ID NO: 3392040 - DNA, 16 bp, Homo sapiens
gaccactcgaggcctg

SEQ ID NO: 3392041 - DNA, 20 bp, Homo sapiens
gaccactgagtaccaggggc

SEQ ID NO: 3392042 - DNA, 12 bp, Homo sapiens
gaccactgcatg

SEQ ID NO: 3392043 - DNA, 15 bp, Homo sapiens
gaccacttccagggg

SEQ ID NO: 3392044 - DNA, 22 bp, Homo sapiens
gaccacttccaggggaacctgc

SEQ ID NO: 3392045 - DNA, 23 bp, Homo sapiens
gaccactttggagactggggtgg

SEQ ID NO: 3392046 - DNA, 24 bp, Homo sapiens
gaccagacaccttgacagggcaca

SEQ ID NO: 3392047 - DNA, 17 bp, Homo sapiens
gaccagagccagatgca

SEQ ID NO: 3392048 - DNA, 22 bp, Homo sapiens
gaccagagccagatgcaggaca

SEQ ID NO: 3392049 - DNA, 15 bp, Homo sapiens
gaccagccccttcct

SEQ ID NO: 3392050 - DNA, 18 bp, Homo sapiens
gaccagccccttcctggg

SEQ ID NO: 3392051 - DNA, 12 bp, Homo sapiens
gaccagcctggc

SEQ ID NO: 3392052 - DNA, 13 bp, Homo sapiens
gaccagcctggcc

SEQ ID NO: 3392053 - DNA, 23 bp, Homo sapiens
gaccagcgtcctcgttcaaaaca

SEQ ID NO: 3392054 - DNA, 23 bp, Homo sapiens
gaccagctggggcgtggggaggg

SEQ ID NO: 3392055 - DNA, 14 bp, Homo sapiens
gaccaggactccct

SEQ ID NO: 3392056 - DNA, 23 bp, Homo sapiens
gaccaggcatcctccacaatagc

SEQ ID NO: 3392057 - DNA, 19 bp, Homo sapiens
gaccaggccattctgccgc

SEQ ID NO: 3392058 - DNA, 19 bp, Homo sapiens
gaccagggatgctgggctg

SEQ ID NO: 3392059 - DNA, 21 bp, Homo sapiens
gaccagggccgaggaggtgcc

SEQ ID NO: 3392060 - DNA, 23 bp, Homo sapiens
gaccagtgtatcaggtcagggac

SEQ ID NO: 3392061 - DNA, 15 bp, Homo sapiens
gaccagttgggagca

SEQ ID NO: 3392062 - DNA, 12 bp, Homo sapiens
gaccataatttt

SEQ ID NO: 3392063 - DNA, 21 bp, Homo sapiens
gaccatccactctaccctccc

SEQ ID NO: 3392064 - DNA, 18 bp, Homo sapiens
gaccatcgtccttcctct

SEQ ID NO: 3392065 - DNA, 17 bp, Homo sapiens
gaccatctgcttttatt

SEQ ID NO: 3392066 - DNA, 21 bp, Homo sapiens
gaccatgaagtaaattatgta

SEQ ID NO: 3392067 - DNA, 22 bp, Homo sapiens
gaccatgctcatctgctggtcc

SEQ ID NO: 3392068 - DNA, 12 bp, Homo sapiens
gaccatgtgtca

SEQ ID NO: 3392069 - DNA, 13 bp, Homo sapiens
gaccatgtgtcac

SEQ ID NO: 3392070 - DNA, 21 bp, Homo sapiens
gaccatgtgtcacttgtgctt

SEQ ID NO: 3392071 - DNA, 22 bp, Homo sapiens
gaccattctgtgaccaaaatac

SEQ ID NO: 3392072 - DNA, 16 bp, Homo sapiens
gaccattgagtccctg

SEQ ID NO: 3392073 - DNA, 13 bp, Homo sapiens
gaccatttaacat

SEQ ID NO: 3392074 - DNA, 17 bp, Homo sapiens
gaccatttaacatgcaa

SEQ ID NO: 3392075 - DNA, 15 bp, Homo sapiens
gaccatttcaggggt

SEQ ID NO: 3392076 - DNA, 19 bp, Homo sapiens
gaccattttttaatttact

SEQ ID NO: 3392077 - DNA, 20 bp, Homo sapiens
gaccattttttaatttactt

SEQ ID NO: 3392078 - DNA, 20 bp, Homo sapiens
gacccaagccctgaggcctg

SEQ ID NO: 3392079 - DNA, 19 bp, Homo sapiens
gacccaatgtaggagctgc

SEQ ID NO: 3392080 - DNA, 23 bp, Homo sapiens
gacccacagactggttttgcaac

SEQ ID NO: 3392081 - DNA, 12 bp, Homo sapiens
gacccaccagtg

SEQ ID NO: 3392082 - DNA, 15 bp, Homo sapiens
gacccaccagtgcct

SEQ ID NO: 3392083 - DNA, 20 bp, Homo sapiens
gacccacccatcttcctgct

SEQ ID NO: 3392084 - DNA, 22 bp, Homo sapiens
gacccacccatcttcctgctgc

SEQ ID NO: 3392085 - DNA, 15 bp, Homo sapiens
gacccaccccacctg

SEQ ID NO: 3392086 - DNA, 12 bp, Homo sapiens
gacccacccctg

SEQ ID NO: 3392087 - DNA, 18 bp, Homo sapiens
gacccacccctgtgctcc

SEQ ID NO: 3392088 - DNA, 16 bp, Homo sapiens
gacccacctcaccccg

SEQ ID NO: 3392089 - DNA, 19 bp, Homo sapiens
gacccacggagccctccct

SEQ ID NO: 3392090 - DNA, 22 bp, Homo sapiens
gacccacggagccctccctatg

SEQ ID NO: 3392091 - DNA, 18 bp, Homo sapiens
gacccacgtgctagggga

SEQ ID NO: 3392092 - DNA, 12 bp, Homo sapiens
gacccactgctt

SEQ ID NO: 3392093 - DNA, 16 bp, Homo sapiens
gacccagaatggagcc

SEQ ID NO: 3392094 - DNA, 19 bp, Homo sapiens
gacccagaatggagcctgc

SEQ ID NO: 3392095 - DNA, 20 bp, Homo sapiens
gacccagaatggagcctgct

SEQ ID NO: 3392096 - DNA, 19 bp, Homo sapiens
gacccagagtggagtctga

SEQ ID NO: 3392097 - DNA, 22 bp, Homo sapiens
gacccagcatctcccagcaaga

SEQ ID NO: 3392098 - DNA, 22 bp, Homo sapiens
gacccagccccttgagaaacct

SEQ ID NO: 3392099 - DNA, 16 bp, Homo sapiens
gacccagctactctgt

SEQ ID NO: 3392100 - DNA, 18 bp, Homo sapiens
gacccagctactctgtcc

SEQ ID NO: 3392101 - DNA, 20 bp, Homo sapiens
gacccagctactctgtccag

SEQ ID NO: 3392102 - DNA, 14 bp, Homo sapiens
gacccaggagagac

SEQ ID NO: 3392103 - DNA, 13 bp, Homo sapiens
gacccaggccctc

SEQ ID NO: 3392104 - DNA, 11 bp, Homo sapiens
gacccaggccg

SEQ ID NO: 3392105 - DNA, 17 bp, Homo sapiens
gacccaggctccgccct

SEQ ID NO: 3392106 - DNA, 22 bp, Homo sapiens
gacccaggtcttccagacctgc

SEQ ID NO: 3392107 - DNA, 20 bp, Homo sapiens
gacccaggtggagggcacag

SEQ ID NO: 3392108 - DNA, 10 bp, Homo sapiens
gacccatgct

SEQ ID NO: 3392109 - DNA, 19 bp, Homo sapiens
gacccatgctggtcagaga

SEQ ID NO: 3392110 - DNA, 20 bp, Homo sapiens
gacccattctacacagagca

SEQ ID NO: 3392111 - DNA, 22 bp, Homo sapiens
gaccccaacctcagaggcagct

SEQ ID NO: 3392112 - DNA, 23 bp, Homo sapiens
gaccccacgtgcgacagagagag

SEQ ID NO: 3392113 - DNA, 15 bp, Homo sapiens
gaccccagctgggag

SEQ ID NO: 3392114 - DNA, 21 bp, Homo sapiens
gaccccagctgggaggcaaga

SEQ ID NO: 3392115 - DNA, 18 bp, Homo sapiens
gaccccagctgtgagcct

SEQ ID NO: 3392116 - DNA, 14 bp, Homo sapiens
gactcctgtggaga

SEQ ID NO: 3392117 - DNA, 13 bp, Homo sapiens
gactcggagacta

SEQ ID NO: 3392118 - DNA, 20 bp, Homo sapiens
gactcggagactatggcctc

SEQ ID NO: 3392119 - DNA, 15 bp, Homo sapiens
gactctaaagaccaa

SEQ ID NO: 3392120 - DNA, 14 bp, Homo sapiens
gactctaagctgtg

SEQ ID NO: 3392121 - DNA, 20 bp, Homo sapiens
gactctaagctgtgtgcagg

SEQ ID NO: 3392122 - DNA, 21 bp, Homo sapiens
gactctacagaggccatgggc

SEQ ID NO: 3392123 - DNA, 23 bp, Homo sapiens
gactctacctcatatcagtttgc

SEQ ID NO: 3392124 - DNA, 16 bp, Homo sapiens
gactctaggttataca

SEQ ID NO: 3392125 - DNA, 17 bp, Homo sapiens
gactctaggttatacaa

SEQ ID NO: 3392126 - DNA, 14 bp, Homo sapiens
gactctagtattta

SEQ ID NO: 3392127 - DNA, 16 bp, Homo sapiens
gactctcagcccagaa

SEQ ID NO: 3392128 - DNA, 12 bp, Homo sapiens
gactctctgtga

SEQ ID NO: 3392129 - DNA, 13 bp, Homo sapiens
gactctctgtgac

SEQ ID NO: 3392130 - DNA, 15 bp, Homo sapiens
gactctctgtgacct

SEQ ID NO: 3392131 - DNA, 18 bp, Homo sapiens
gactctgaaatctgaaga

SEQ ID NO: 3392132 - DNA, 20 bp, Homo sapiens
gactctgagcgggaggcaga

SEQ ID NO: 3392133 - DNA, 22 bp, Homo sapiens
gactctgaggctctttctgggc

SEQ ID NO: 3392134 - DNA, 20 bp, Homo sapiens
gactctgagtccactgctcc

SEQ ID NO: 3392135 - DNA, 20 bp, Homo sapiens
gactctgatcccatattctt

SEQ ID NO: 3392136 - DNA, 20 bp, Homo sapiens
gactctgcaagtgtctggag

SEQ ID NO: 3392137 - DNA, 22 bp, Homo sapiens
gactctgcaagtgtctggagcg

SEQ ID NO: 3392138 - DNA, 20 bp, Homo sapiens
gactctgcatcccagcacct

SEQ ID NO: 3392139 - DNA, 12 bp, Homo sapiens
gactctgcctcc

SEQ ID NO: 3392140 - DNA, 18 bp, Homo sapiens
gactctggatatttgcac

SEQ ID NO: 3392141 - DNA, 20 bp, Homo sapiens
gactcttctcggctcaggct

SEQ ID NO: 3392142 - DNA, 15 bp, Homo sapiens
gactcttgctctttc

SEQ ID NO: 3392143 - DNA, 16 bp, Homo sapiens
gactcttgctctttct

SEQ ID NO: 3392144 - DNA, 22 bp, Homo sapiens
gactctttagagcagctttggg

SEQ ID NO: 3392145 - DNA, 21 bp, Homo sapiens
gactctttctgaaggaagaga

SEQ ID NO: 3392146 - DNA, 22 bp, Homo sapiens
gactctttctgaaggaagagaa

SEQ ID NO: 3392147 - DNA, 22 bp, Homo sapiens
gactctttttggactcagccca

SEQ ID NO: 3392148 - DNA, 14 bp, Homo sapiens
gactgaaaccattt

SEQ ID NO: 3392149 - DNA, 15 bp, Homo sapiens
gactgaaagcagcag

SEQ ID NO: 3392150 - DNA, 17 bp, Homo sapiens
gactgaaagcagcagct

SEQ ID NO: 3392151 - DNA, 21 bp, Homo sapiens
gactgaaagcagcagctagga

SEQ ID NO: 3392152 - DNA, 14 bp, Homo sapiens
gactgaacatgttt

SEQ ID NO: 3392153 - DNA, 16 bp, Homo sapiens
gactgaaggggcacac

SEQ ID NO: 3392154 - DNA, 24 bp, Homo sapiens
gactgaaggggcacaccactgccc

SEQ ID NO: 3392155 - DNA, 18 bp, Homo sapiens
gactgagcaagaccctgt

SEQ ID NO: 3392156 - DNA, 13 bp, Homo sapiens
gactgagcagccg

SEQ ID NO: 3392157 - DNA, 21 bp, Homo sapiens
gactgagcagccgccagctgg

SEQ ID NO: 3392158 - DNA, 21 bp, Homo sapiens
gactgagccaaggaggcctgg

SEQ ID NO: 3392159 - DNA, 23 bp, Homo sapiens
gactgagcctggcccatagaaac

SEQ ID NO: 3392160 - DNA, 18 bp, Homo sapiens
gactgaggtataaagaca

SEQ ID NO: 3392161 - DNA, 15 bp, Homo sapiens
gactgagtcagatgg

SEQ ID NO: 3392162 - DNA, 22 bp, Homo sapiens
gactgagtcctcgtagccatct

SEQ ID NO: 3392163 - DNA, 16 bp, Homo sapiens
gactgcagaggggaaa

SEQ ID NO: 3392164 - DNA, 23 bp, Homo sapiens
gactgcagaggggaaagacttcc

SEQ ID NO: 3392165 - DNA, 23 bp, Homo sapiens
gactgcatgtaccatttgcatgg

SEQ ID NO: 3392166 - DNA, 13 bp, Homo sapiens
gactgccaagcca

SEQ ID NO: 3392167 - DNA, 16 bp, Homo sapiens
gactgccaagccagat

SEQ ID NO: 3392168 - DNA, 18 bp, Homo sapiens
gactgccaagccagattc

SEQ ID NO: 3392169 - DNA, 20 bp, Homo sapiens
gactgccaagccagattctc

SEQ ID NO: 3392170 - DNA, 20 bp, Homo sapiens
gactgccagtccccctgccc

SEQ ID NO: 3392171 - DNA, 12 bp, Homo sapiens
gactgcctctgc

SEQ ID NO: 3392172 - DNA, 21 bp, Homo sapiens
gactgcctctgccacactctg

SEQ ID NO: 3392173 - DNA, 12 bp, Homo sapiens
gactgcgctgct

SEQ ID NO: 3392174 - DNA, 13 bp, Homo sapiens
gactgcgctgctt

SEQ ID NO: 3392175 - DNA, 16 bp, Homo sapiens
gactgcgttctgcaag

SEQ ID NO: 3392176 - DNA, 14 bp, Homo sapiens
gactgctacctctg

SEQ ID NO: 3392177 - DNA, 19 bp, Homo sapiens
gactgctacctctgagaag

SEQ ID NO: 3392178 - DNA, 21 bp, Homo sapiens
gactgctacctctgagaagac

SEQ ID NO: 3392179 - DNA, 16 bp, Homo sapiens
gactgctagtgttctg

SEQ ID NO: 3392180 - DNA, 17 bp, Homo sapiens
gactgctagtgttctgt

SEQ ID NO: 3392181 - DNA, 15 bp, Homo sapiens
gactgcttcccatcc

SEQ ID NO: 3392182 - DNA, 21 bp, Homo sapiens
gactgctttggacctaaatgg

SEQ ID NO: 3392183 - DNA, 14 bp, Homo sapiens
gactggaagcacag

SEQ ID NO: 3392184 - DNA, 15 bp, Homo sapiens
gactggaagcacagc

SEQ ID NO: 3392185 - DNA, 16 bp, Homo sapiens
gactggaatgcagtga

SEQ ID NO: 3392186 - DNA, 18 bp, Homo sapiens
gactggacctggtggcta

SEQ ID NO: 3392187 - DNA, 20 bp, Homo sapiens
gactggagaccgcttcaccc

SEQ ID NO: 3392188 - DNA, 21 bp, Homo sapiens
gactggagaccgcttcacccc

SEQ ID NO: 3392189 - DNA, 16 bp, Homo sapiens
gactggaggtgggcat

SEQ ID NO: 3392190 - DNA, 17 bp, Homo sapiens
gactggaggtgggcatg

SEQ ID NO: 3392191 - DNA, 15 bp, Homo sapiens
gactggagtccctgt

SEQ ID NO: 3392192 - DNA, 20 bp, Homo sapiens
gactggagtgaggcttccag

SEQ ID NO: 3392193 - DNA, 21 bp, Homo sapiens
gactggagtgaggcttccagg

SEQ ID NO: 3392194 - DNA, 18 bp, Homo sapiens
gactggcaaaggaccagc

SEQ ID NO: 3392195 - DNA, 16 bp, Homo sapiens
gactggcaataaactc

SEQ ID NO: 3392196 - DNA, 20 bp, Homo sapiens
gactggcacttagcccaaga

SEQ ID NO: 3392197 - DNA, 12 bp, Homo sapiens
gactggcaggcg

SEQ ID NO: 3392198 - DNA, 15 bp, Homo sapiens
gactggcaggcgggg

SEQ ID NO: 3392199 - DNA, 16 bp, Homo sapiens
gactggcagtaaccta

SEQ ID NO: 3392200 - DNA, 12 bp, Homo sapiens
gactggccaggg

SEQ ID NO: 3392201 - DNA, 15 bp, Homo sapiens
gactggccagggcca

SEQ ID NO: 3392202 - DNA, 16 bp, Homo sapiens
gactggccgggcaggc

SEQ ID NO: 3392203 - DNA, 23 bp, Homo sapiens
gactggccgggcaggcgtgactc

SEQ ID NO: 3392204 - DNA, 20 bp, Homo sapiens
gactggcgttcacctccctg

SEQ ID NO: 3392205 - DNA, 21 bp, Homo sapiens
gactggcgttcacctccctgc

SEQ ID NO: 3392206 - DNA, 16 bp, Homo sapiens
gactggcttggccaca

SEQ ID NO: 3392207 - DNA, 20 bp, Homo sapiens
gactgggaagataggctctg

SEQ ID NO: 3392208 - DNA, 22 bp, Homo sapiens
gactgggaagataggctctgca

SEQ ID NO: 3392209 - DNA, 23 bp, Homo sapiens
gactgggaagataggctctgcac

SEQ ID NO: 3392210 - DNA, 21 bp, Homo sapiens
gactgggagccacttctcccc

SEQ ID NO: 3392211 - DNA, 22 bp, Homo sapiens
gactgggagccacttctcccca

SEQ ID NO: 3392212 - DNA, 18 bp, Homo sapiens
gactggggatgtgggagg

SEQ ID NO: 3392213 - DNA, 17 bp, Homo sapiens
gactgggggactgggag

SEQ ID NO: 3392214 - DNA, 14 bp, Homo sapiens
gactgggggccaga

SEQ ID NO: 3392215 - DNA, 15 bp, Homo sapiens
gactggggtgggagg

SEQ ID NO: 3392216 - DNA, 22 bp, Homo sapiens
gactgggtttggaccccagctg

SEQ ID NO: 3392217 - DNA, 23 bp, Homo sapiens
gactgggtttggaccccagctgg

SEQ ID NO: 3392218 - DNA, 12 bp, Homo sapiens
gactggtccagc

SEQ ID NO: 3392219 - DNA, 13 bp, Homo sapiens
gactggtccagct

SEQ ID NO: 3392220 - DNA, 19 bp, Homo sapiens
gactggtccagctctgaca

SEQ ID NO: 3392221 - DNA, 20 bp, Homo sapiens
gactggtccagctctgacat

SEQ ID NO: 3392222 - DNA, 15 bp, Homo sapiens
gactggtcctgtgtg

SEQ ID NO: 3392223 - DNA, 16 bp, Homo sapiens
gactggtctcgaactc

SEQ ID NO: 3392224 - DNA, 22 bp, Homo sapiens
gactggtctcgaactcctggcc

SEQ ID NO: 3392225 - DNA, 14 bp, Homo sapiens
gactggttttctgc

SEQ ID NO: 3392226 - DNA, 22 bp, Homo sapiens
gactgtaagatgttgttttagg

SEQ ID NO: 3392227 - DNA, 18 bp, Homo sapiens
gactgtacacactttatt

SEQ ID NO: 3392228 - DNA, 23 bp, Homo sapiens
gactgtacacactttatttactt

SEQ ID NO: 3392229 - DNA, 18 bp, Homo sapiens
gactgtactcctcccagg

SEQ ID NO: 3392230 - DNA, 15 bp, Homo sapiens
gactgtcatagaaat

SEQ ID NO: 3392231 - DNA, 12 bp, Homo sapiens
gactgtccacct

SEQ ID NO: 3392232 - DNA, 19 bp, Homo sapiens
gactgtcccaccgggagcc

SEQ ID NO: 3392233 - DNA, 22 bp, Homo sapiens
gactgtctcaagagggcactgg

SEQ ID NO: 3392234 - DNA, 13 bp, Homo sapiens
gactgtctttcag

SEQ ID NO: 3392235 - DNA, 21 bp, Homo sapiens
gactgtgaacttgactgggtg

SEQ ID NO: 3392236 - DNA, 15 bp, Homo sapiens
gactgtgattcagaa

SEQ ID NO: 3392237 - DNA, 16 bp, Homo sapiens
gactgttccaaagcca

SEQ ID NO: 3392238 - DNA, 13 bp, Homo sapiens
gactgttccaggc

SEQ ID NO: 3392239 - DNA, 13 bp, Homo sapiens
gacttaaagcaga

SEQ ID NO: 3392240 - DNA, 20 bp, Homo sapiens
gacttaaaggacaggaggag

SEQ ID NO: 3392241 - DNA, 22 bp, Homo sapiens
gagcactggccagagagggccc

SEQ ID NO: 3392242 - DNA, 23 bp, Homo sapiens
gagcactggtgtgaactcaccct

SEQ ID NO: 3392243 - DNA, 14 bp, Homo sapiens
gagcacttagcagg

SEQ ID NO: 3392244 - DNA, 18 bp, Homo sapiens
gagcacttgcgtcctgca

SEQ ID NO: 3392245 - DNA, 19 bp, Homo sapiens
gagcactttagcagatgtg

SEQ ID NO: 3392246 - DNA, 23 bp, Homo sapiens
gagcagaacggagccccaggcct

SEQ ID NO: 3392247 - DNA, 21 bp, Homo sapiens
gagcagacaggaggaatcatg

SEQ ID NO: 3392248 - DNA, 16 bp, Homo sapiens
gagcagagaattctct

SEQ ID NO: 3392249 - DNA, 24 bp, Homo sapiens
gagcagagacatgactcagcctgt

SEQ ID NO: 3392250 - DNA, 21 bp, Homo sapiens
gagcagagagcttagcctgga

SEQ ID NO: 3392251 - DNA, 20 bp, Homo sapiens
gagcagagtctgggcctctg

SEQ ID NO: 3392252 - DNA, 14 bp, Homo sapiens
gagcagatgcagag

SEQ ID NO: 3392253 - DNA, 18 bp, Homo sapiens
gagcagatgcagagagcc

SEQ ID NO: 3392254 - DNA, 21 bp, Homo sapiens
gagcagatgcagagagccatt

SEQ ID NO: 3392255 - DNA, 15 bp, Homo sapiens
gagcagatggacagc

SEQ ID NO: 3392256 - DNA, 21 bp, Homo sapiens
gagcagcagcaccaaccacag

SEQ ID NO: 3392257 - DNA, 15 bp, Homo sapiens
gagcagccgccagct

SEQ ID NO: 3392258 - DNA, 19 bp, Homo sapiens
gagcagcctgatggccaag

SEQ ID NO: 3392259 - DNA, 14 bp, Homo sapiens
gagcagcctgtggc

SEQ ID NO: 3392260 - DNA, 22 bp, Homo sapiens
gagcagctttaaactcagggac

SEQ ID NO: 3392261 - DNA, 14 bp, Homo sapiens
gagcaggaaggcct

SEQ ID NO: 3392262 - DNA, 13 bp, Homo sapiens
gagcaggacctcc

SEQ ID NO: 3392263 - DNA, 20 bp, Homo sapiens
gagcaggagattgagaagga

SEQ ID NO: 3392264 - DNA, 22 bp, Homo sapiens
gagcaggagattgagaaggaga

SEQ ID NO: 3392265 - DNA, 11 bp, Homo sapiens
gagcaggagcc

SEQ ID NO: 3392266 - DNA, 20 bp, Homo sapiens
gagcaggagccccgccacag

SEQ ID NO: 3392267 - DNA, 14 bp, Homo sapiens
gagcaggaggccaa

SEQ ID NO: 3392268 - DNA, 18 bp, Homo sapiens
gagcaggaggccaataaa

SEQ ID NO: 3392269 - DNA, 22 bp, Homo sapiens
gagcaggcaaaaaagggacagc

SEQ ID NO: 3392270 - DNA, 22 bp, Homo sapiens
gagcaggctggcagctctccag

SEQ ID NO: 3392271 - DNA, 15 bp, Homo sapiens
gagcaggggctccag

SEQ ID NO: 3392272 - DNA, 17 bp, Homo sapiens
gagcagtcagggtggga

SEQ ID NO: 3392273 - DNA, 15 bp, Homo sapiens
gagcagtgagcagaa

SEQ ID NO: 3392274 - DNA, 18 bp, Homo sapiens
gagcagtgtcttccataa

SEQ ID NO: 3392275 - DNA, 16 bp, Homo sapiens
gagcagttttcccctg

SEQ ID NO: 3392276 - DNA, 22 bp, Homo sapiens
gagcagttttcccctggcctca

SEQ ID NO: 3392277 - DNA, 14 bp, Homo sapiens
gagcatcaagaatt

SEQ ID NO: 3392278 - DNA, 22 bp, Homo sapiens
gagcatcctgagccccgccctc

SEQ ID NO: 3392279 - DNA, 19 bp, Homo sapiens
gagcatcgtgacccttcag

SEQ ID NO: 3392280 - DNA, 16 bp, Homo sapiens
gagcatctggctgttt

SEQ ID NO: 3392281 - DNA, 22 bp, Homo sapiens
gagcatggggataaaggagaag

SEQ ID NO: 3392282 - DNA, 16 bp, Homo sapiens
gagcatggtgttttca

SEQ ID NO: 3392283 - DNA, 19 bp, Homo sapiens
gagcatgtaaaagcggaaa

SEQ ID NO: 3392284 - DNA, 17 bp, Homo sapiens
gagcatgttttgtatac

SEQ ID NO: 3392285 - DNA, 13 bp, Homo sapiens
gagcattccagta

SEQ ID NO: 3392286 - DNA, 17 bp, Homo sapiens
gagcattgccattccct

SEQ ID NO: 3392287 - DNA, 16 bp, Homo sapiens
gagcatttttaaggga

SEQ ID NO: 3392288 - DNA, 22 bp, Homo sapiens
gagccaacctcggcttgtgggc

SEQ ID NO: 3392289 - DNA, 23 bp, Homo sapiens
gagccaacctcggcttgtgggct

SEQ ID NO: 3392290 - DNA, 19 bp, Homo sapiens
gagccaactctaacaggca

SEQ ID NO: 3392291 - DNA, 20 bp, Homo sapiens
gagccaaggaggcctgggga

SEQ ID NO: 3392292 - DNA, 16 bp, Homo sapiens
gagccaccgctgccag

SEQ ID NO: 3392293 - DNA, 12 bp, Homo sapiens
gagccacctcac

SEQ ID NO: 3392294 - DNA, 23 bp, Homo sapiens
gagccacctggatctatccctgc

SEQ ID NO: 3392295 - DNA, 21 bp, Homo sapiens
gagccactctatgagttggac

SEQ ID NO: 3392296 - DNA, 19 bp, Homo sapiens
gagccacttctccccagaa

SEQ ID NO: 3392297 - DNA, 19 bp, Homo sapiens
gagccagatgcaggacagg

SEQ ID NO: 3392298 - DNA, 21 bp, Homo sapiens
gagccagatgcaggacaggag

SEQ ID NO: 3392299 - DNA, 15 bp, Homo sapiens
gagccagatggcaag

SEQ ID NO: 3392300 - DNA, 15 bp, Homo sapiens
gagccagattacagg

SEQ ID NO: 3392301 - DNA, 15 bp, Homo sapiens
gagccagcctgggac

SEQ ID NO: 3392302 - DNA, 13 bp, Homo sapiens
gagccagctccct

SEQ ID NO: 3392303 - DNA, 16 bp, Homo sapiens
gagccaggatgcccag

SEQ ID NO: 3392304 - DNA, 19 bp, Homo sapiens
gagccaggttcacactcag

SEQ ID NO: 3392305 - DNA, 12 bp, Homo sapiens
gagccagtaact

SEQ ID NO: 3392306 - DNA, 17 bp, Homo sapiens
gagccagtaatctttat

SEQ ID NO: 3392307 - DNA, 18 bp, Homo sapiens
gagccagttgtcctatgg

SEQ ID NO: 3392308 - DNA, 23 bp, Homo sapiens
gagccagttgtcctatggacaac

SEQ ID NO: 3392309 - DNA, 15 bp, Homo sapiens
gagccatgaagcatt

SEQ ID NO: 3392310 - DNA, 13 bp, Homo sapiens
gagccatgggcct

SEQ ID NO: 3392311 - DNA, 16 bp, Homo sapiens
gagccatgggcctggg

SEQ ID NO: 3392312 - DNA, 13 bp, Homo sapiens
gagccatttgaga

SEQ ID NO: 3392313 - DNA, 16 bp, Homo sapiens
gagccattttgtgaat

SEQ ID NO: 3392314 - DNA, 20 bp, Homo sapiens
gagcccaagttatctttccc

SEQ ID NO: 3392315 - DNA, 23 bp, Homo sapiens
gagcccaatgcatagagccctgg

SEQ ID NO: 3392316 - DNA, 16 bp, Homo sapiens
gagcccacaaagcctt

SEQ ID NO: 3392317 - DNA, 13 bp, Homo sapiens
gagcccacaacct

SEQ ID NO: 3392318 - DNA, 20 bp, Homo sapiens
gagcccactgcccaccccct

SEQ ID NO: 3392319 - DNA, 21 bp, Homo sapiens
gagcccactgcccaccccctc

SEQ ID NO: 3392320 - DNA, 15 bp, Homo sapiens
gagcccagccctccc

SEQ ID NO: 3392321 - DNA, 17 bp, Homo sapiens
gagcccagccctgttct

SEQ ID NO: 3392322 - DNA, 20 bp, Homo sapiens
gagcccagccctgttctggg

SEQ ID NO: 3392323 - DNA, 16 bp, Homo sapiens
gagcccagcctgggag

SEQ ID NO: 3392324 - DNA, 12 bp, Homo sapiens
gagcccagctgc

SEQ ID NO: 3392325 - DNA, 12 bp, Homo sapiens
gagcccaggccg

SEQ ID NO: 3392326 - DNA, 13 bp, Homo sapiens
gagcccatactca

SEQ ID NO: 3392327 - DNA, 16 bp, Homo sapiens
gagcccatactcagcc

SEQ ID NO: 3392328 - DNA, 22 bp, Homo sapiens
gagcccatactcagcctgctgc

SEQ ID NO: 3392329 - DNA, 18 bp, Homo sapiens
gagcccatgttctgcccc

SEQ ID NO: 3392330 - DNA, 11 bp, Homo sapiens
gagccccaagt

SEQ ID NO: 3392331 - DNA, 17 bp, Homo sapiens
gagccccaagtcctgaa

SEQ ID NO: 3392332 - DNA, 21 bp, Homo sapiens
gagccccaagtcctgaagagg

SEQ ID NO: 3392333 - DNA, 13 bp, Homo sapiens
gagccccaggcct

SEQ ID NO: 3392334 - DNA, 11 bp, Homo sapiens
gagccccaggg

SEQ ID NO: 3392335 - DNA, 23 bp, Homo sapiens
gagccccaggggggcctcctcct

SEQ ID NO: 3392336 - DNA, 13 bp, Homo sapiens
gagccccagggtc

SEQ ID NO: 3392337 - DNA, 24 bp, Homo sapiens
gagccccagggtcttccctacctc

SEQ ID NO: 3392338 - DNA, 19 bp, Homo sapiens
gagccccagggtgcccaga

SEQ ID NO: 3392339 - DNA, 16 bp, Homo sapiens
gagcccccacattctc

SEQ ID NO: 3392340 - DNA, 17 bp, Homo sapiens
gagccccgaggccttct

SEQ ID NO: 3392341 - DNA, 17 bp, Homo sapiens
gagccccgccctcttcc

SEQ ID NO: 3392342 - DNA, 17 bp, Homo sapiens
gagcccctcctccagcc

SEQ ID NO: 3392343 - DNA, 20 bp, Homo sapiens
gagcccctcctccagcccct

SEQ ID NO: 3392344 - DNA, 19 bp, Homo sapiens
gagcccctgggtgggtggt

SEQ ID NO: 3392345 - DNA, 13 bp, Homo sapiens
gagcccctggtcc

SEQ ID NO: 3392346 - DNA, 14 bp, Homo sapiens
gagcccctggtcct

SEQ ID NO: 3392347 - DNA, 17 bp, Homo sapiens
gagcccggatgcttctc

SEQ ID NO: 3392348 - DNA, 14 bp, Homo sapiens
gagcccgggctgcc

SEQ ID NO: 3392349 - DNA, 20 bp, Homo sapiens
gagcccgggctgcctgggct

SEQ ID NO: 3392350 - DNA, 22 bp, Homo sapiens
gagcccgggctgcctgggctgt

SEQ ID NO: 3392351 - DNA, 20 bp, Homo sapiens
gagcccgtgcagtacaggca

SEQ ID NO: 3392352 - DNA, 21 bp, Homo sapiens
gagccctaaccccttccagat

SEQ ID NO: 3392353 - DNA, 17 bp, Homo sapiens
gagccctactccctgca

SEQ ID NO: 3392354 - DNA, 22 bp, Homo sapiens
gagccctgaccttggctgactg

SEQ ID NO: 3392355 - DNA, 12 bp, Homo sapiens
gagccctggcca

SEQ ID NO: 3392356 - DNA, 18 bp, Homo sapiens
gagccctggccagccctt

SEQ ID NO: 3392357 - DNA, 22 bp, Homo sapiens
gagccctggccagcccttcctc

SEQ ID NO: 3392358 - DNA, 17 bp, Homo sapiens
gagccctggctgggttc

SEQ ID NO: 3392359 - DNA, 19 bp, Homo sapiens
gagccctggctgggttcag

SEQ ID NO: 3392360 - DNA, 11 bp, Homo sapiens
gagccctgggg

SEQ ID NO: 3392361 - DNA, 16 bp, Homo sapiens
gagccctggggactgt

SEQ ID NO: 3392362 - DNA, 22 bp, Homo sapiens
gagccctggggactgttccaaa

SEQ ID NO: 3392363 - DNA, 16 bp, Homo sapiens
gagccctggtggcagt

SEQ ID NO: 3392364 - DNA, 18 bp, Homo sapiens
gagccctggtggcagtgg

SEQ ID NO: 3392365 - DNA, 12 bp, Homo sapiens
gagcccttcact

SEQ ID NO: 3392366 - DNA, 18 bp, Homo sapiens
gagggctgatggaggaaa

SEQ ID NO: 3392367 - DNA, 10 bp, Homo sapiens
gagggctgga

SEQ ID NO: 3392368 - DNA, 17 bp, Homo sapiens
gagggctggaggcccag

SEQ ID NO: 3392369 - DNA, 19 bp, Homo sapiens
gagggctggaggcccaggc

SEQ ID NO: 3392370 - DNA, 23 bp, Homo sapiens
gagggctggaggcccaggctggg

SEQ ID NO: 3392371 - DNA, 16 bp, Homo sapiens
gagggctggctggcct

SEQ ID NO: 3392372 - DNA, 15 bp, Homo sapiens
gagggcttgtgaaca

SEQ ID NO: 3392373 - DNA, 21 bp, Homo sapiens
gaggggaactgagtcacgctg

SEQ ID NO: 3392374 - DNA, 15 bp, Homo sapiens
gaggggaagggccag

SEQ ID NO: 3392375 - DNA, 18 bp, Homo sapiens
gaggggaataatagaaga

SEQ ID NO: 3392376 - DNA, 19 bp, Homo sapiens
gaggggaataatagaagaa

SEQ ID NO: 3392377 - DNA, 22 bp, Homo sapiens
gaggggactatttatgaaggca

SEQ ID NO: 3392378 - DNA, 21 bp, Homo sapiens
gaggggaggatcactggagcc

SEQ ID NO: 3392379 - DNA, 16 bp, Homo sapiens
gaggggatccagccac

SEQ ID NO: 3392380 - DNA, 20 bp, Homo sapiens
gaggggcaacgaagaaaaaa

SEQ ID NO: 3392381 - DNA, 16 bp, Homo sapiens
gaggggcaagctaggc

SEQ ID NO: 3392382 - DNA, 14 bp, Homo sapiens
gaggggcagccctt

SEQ ID NO: 3392383 - DNA, 17 bp, Homo sapiens
gaggggcatctgcccct

SEQ ID NO: 3392384 - DNA, 22 bp, Homo sapiens
gaggggcatctgcccctccccc

SEQ ID NO: 3392385 - DNA, 16 bp, Homo sapiens
gaggggccaggcccag

SEQ ID NO: 3392386 - DNA, 22 bp, Homo sapiens
gaggggcccctgcttctccagc

SEQ ID NO: 3392387 - DNA, 18 bp, Homo sapiens
gaggggcgcgggaggggg

SEQ ID NO: 3392388 - DNA, 19 bp, Homo sapiens
gaggggcgcgggagggggc

SEQ ID NO: 3392389 - DNA, 18 bp, Homo sapiens
gaggggcgctggcccagc

SEQ ID NO: 3392390 - DNA, 19 bp, Homo sapiens
gaggggcgctggcccagcc

SEQ ID NO: 3392391 - DNA, 21 bp, Homo sapiens
gaggggcggcaggagggaggt

SEQ ID NO: 3392392 - DNA, 15 bp, Homo sapiens
gaggggctcctggaa

SEQ ID NO: 3392393 - DNA, 11 bp, Homo sapiens
gaggggctctc

SEQ ID NO: 3392394 - DNA, 17 bp, Homo sapiens
gaggggctttctggaga

SEQ ID NO: 3392395 - DNA, 17 bp, Homo sapiens
gagggggagtagccaag

SEQ ID NO: 3392396 - DNA, 14 bp, Homo sapiens
gagggggccgggcg

SEQ ID NO: 3392397 - DNA, 19 bp, Homo sapiens
gagggggctatttctctcc

SEQ ID NO: 3392398 - DNA, 12 bp, Homo sapiens
gagggggctctc

SEQ ID NO: 3392399 - DNA, 14 bp, Homo sapiens
gagggggctctcca

SEQ ID NO: 3392400 - DNA, 21 bp, Homo sapiens
gaggggggtgctggcccccag

SEQ ID NO: 3392401 - DNA, 23 bp, Homo sapiens
gaggggggtgctggcccccagga

SEQ ID NO: 3392402 - DNA, 23 bp, Homo sapiens
gagggggtccgtggtagaggcct

SEQ ID NO: 3392403 - DNA, 13 bp, Homo sapiens
gagggggtggagg

SEQ ID NO: 3392404 - DNA, 17 bp, Homo sapiens
gagggggttcttcctca

SEQ ID NO: 3392405 - DNA, 14 bp, Homo sapiens
gaggggtctcggat

SEQ ID NO: 3392406 - DNA, 13 bp, Homo sapiens
gaggggtgttgta

SEQ ID NO: 3392407 - DNA, 17 bp, Homo sapiens
gagggtctatggggaga

SEQ ID NO: 3392408 - DNA, 18 bp, Homo sapiens
gagggtctcgctgtcact

SEQ ID NO: 3392409 - DNA, 19 bp, Homo sapiens
gagggtctcgctgtcactg

SEQ ID NO: 3392410 - DNA, 22 bp, Homo sapiens
gagggtctcgctgtcactggct

SEQ ID NO: 3392411 - DNA, 13 bp, Homo sapiens
gagggtggagact

SEQ ID NO: 3392412 - DNA, 23 bp, Homo sapiens
gagggtggaggaaggtgctgagc

SEQ ID NO: 3392413 - DNA, 20 bp, Homo sapiens
gagggtggttcaacaaagaa

SEQ ID NO: 3392414 - DNA, 24 bp, Homo sapiens
gagggtgtgagaagtgccttctcc

SEQ ID NO: 3392415 - DNA, 17 bp, Homo sapiens
gagggtgtttcctctaa

SEQ ID NO: 3392416 - DNA, 18 bp, Homo sapiens
gagggttcccctggcctt

SEQ ID NO: 3392417 - DNA, 15 bp, Homo sapiens
gagggttctaagtgg

SEQ ID NO: 3392418 - DNA, 16 bp, Homo sapiens
gagggtttgggcagag

SEQ ID NO: 3392419 - DNA, 17 bp, Homo sapiens
gagggtttgggcagagc

SEQ ID NO: 3392420 - DNA, 15 bp, Homo sapiens
gaggtaacagaacag

SEQ ID NO: 3392421 - DNA, 17 bp, Homo sapiens
gaggtaacagaacagct

SEQ ID NO: 3392422 - DNA, 16 bp, Homo sapiens
gaggtagttaagggat

SEQ ID NO: 3392423 - DNA, 15 bp, Homo sapiens
gaggtataaagacaa

SEQ ID NO: 3392424 - DNA, 16 bp, Homo sapiens
gaggtcaagtaagaag

SEQ ID NO: 3392425 - DNA, 16 bp, Homo sapiens
gaggtcaccaggggag

SEQ ID NO: 3392426 - DNA, 16 bp, Homo sapiens
gaggtcactggaaagg

SEQ ID NO: 3392427 - DNA, 17 bp, Homo sapiens
gaggtcagagcctgcag

SEQ ID NO: 3392428 - DNA, 22 bp, Homo sapiens
gaggtcaggaaacttttaactg

SEQ ID NO: 3392429 - DNA, 23 bp, Homo sapiens
gaggtcataaaatgtctcgagtc

SEQ ID NO: 3392430 - DNA, 13 bp, Homo sapiens
gaggtccagaccc

SEQ ID NO: 3392431 - DNA, 19 bp, Homo sapiens
gaggtccttaggcctctga

SEQ ID NO: 3392432 - DNA, 18 bp, Homo sapiens
gaggtcctttggacagct

SEQ ID NO: 3392433 - DNA, 21 bp, Homo sapiens
gaggtcggtaggttcagccaa

SEQ ID NO: 3392434 - DNA, 13 bp, Homo sapiens
gaggtctaatcta

SEQ ID NO: 3392435 - DNA, 13 bp, Homo sapiens
gaggtctccaggg

SEQ ID NO: 3392436 - DNA, 14 bp, Homo sapiens
gaggtctcttgagg

SEQ ID NO: 3392437 - DNA, 15 bp, Homo sapiens
gaggtctcttgaggg

SEQ ID NO: 3392438 - DNA, 17 bp, Homo sapiens
gaggtctcttgagggag

SEQ ID NO: 3392439 - DNA, 14 bp, Homo sapiens
gaggtctgttcctt

SEQ ID NO: 3392440 - DNA, 16 bp, Homo sapiens
gaggtctgttcctttt

SEQ ID NO: 3392441 - DNA, 18 bp, Homo sapiens
gaggtcttttgacatgtg

SEQ ID NO: 3392442 - DNA, 19 bp, Homo sapiens
gaggtcttttgacatgtgg

SEQ ID NO: 3392443 - DNA, 22 bp, Homo sapiens
gaggtcttttgacatgtggaaa

SEQ ID NO: 3392444 - DNA, 23 bp, Homo sapiens
gaggtgaccccaggtttctatgt

SEQ ID NO: 3392445 - DNA, 15 bp, Homo sapiens
gaggtgagagtggga

SEQ ID NO: 3392446 - DNA, 18 bp, Homo sapiens
gaggtgaggggggctggc

SEQ ID NO: 3392447 - DNA, 12 bp, Homo sapiens
gaggtgcctgga

SEQ ID NO: 3392448 - DNA, 15 bp, Homo sapiens
gaggtgcctgtccca

SEQ ID NO: 3392449 - DNA, 12 bp, Homo sapiens
gaggtgcttcac

SEQ ID NO: 3392450 - DNA, 15 bp, Homo sapiens
gaggtggaagaaggg

SEQ ID NO: 3392451 - DNA, 18 bp, Homo sapiens
gaggtggaagaagggaga

SEQ ID NO: 3392452 - DNA, 19 bp, Homo sapiens
gaggtggaagaagggagaa

SEQ ID NO: 3392453 - DNA, 19 bp, Homo sapiens
gaggtggaggttgcagtga

SEQ ID NO: 3392454 - DNA, 16 bp, Homo sapiens
gaggtggcagccctgt

SEQ ID NO: 3392455 - DNA, 17 bp, Homo sapiens
gaggtggccagagctgg

SEQ ID NO: 3392456 - DNA, 19 bp, Homo sapiens
gaggtggccagagctggga

SEQ ID NO: 3392457 - DNA, 14 bp, Homo sapiens
gaggtgggagggcc

SEQ ID NO: 3392458 - DNA, 15 bp, Homo sapiens
gaggtgggaggtgga

SEQ ID NO: 3392459 - DNA, 14 bp, Homo sapiens
gaggtgggcagctg

SEQ ID NO: 3392460 - DNA, 17 bp, Homo sapiens
gaggtgggcagctgggc

SEQ ID NO: 3392461 - DNA, 12 bp, Homo sapiens
gaggtgggcagg

SEQ ID NO: 3392462 - DNA, 23 bp, Homo sapiens
gaggtgggcaggtggtggcactg

SEQ ID NO: 3392463 - DNA, 19 bp, Homo sapiens
gaggtgggcatgccaccct

SEQ ID NO: 3392464 - DNA, 21 bp, Homo sapiens
gaggtgggccagtctgtggat

SEQ ID NO: 3392465 - DNA, 15 bp, Homo sapiens
gaggtgggcccagga

SEQ ID NO: 3392466 - DNA, 14 bp, Homo sapiens
gaggtgggctgggg

SEQ ID NO: 3392467 - DNA, 18 bp, Homo sapiens
gaggtggggcgaggcagg

SEQ ID NO: 3392468 - DNA, 19 bp, Homo sapiens
gaggtggggcgaggcaggc

SEQ ID NO: 3392469 - DNA, 21 bp, Homo sapiens
gaggtgggtgtgggtggaagg

SEQ ID NO: 3392470 - DNA, 22 bp, Homo sapiens
gaggtgggtgtgggtggaaggg

SEQ ID NO: 3392471 - DNA, 16 bp, Homo sapiens
gaggtggtctgaatgt

SEQ ID NO: 3392472 - DNA, 19 bp, Homo sapiens
gaggtggtctgaatgttct

SEQ ID NO: 3392473 - DNA, 17 bp, Homo sapiens
gaggtggtgccttctca

SEQ ID NO: 3392474 - DNA, 16 bp, Homo sapiens
gaggtgtggagccgag

SEQ ID NO: 3392475 - DNA, 15 bp, Homo sapiens
gaggtgtgggggctg

SEQ ID NO: 3392476 - DNA, 16 bp, Homo sapiens
gaggtgtgggggctgc

SEQ ID NO: 3392477 - DNA, 21 bp, Homo sapiens
gaggtgttcccaggctgcccc

SEQ ID NO: 3392478 - DNA, 14 bp, Homo sapiens
gaggttaaggtggg

SEQ ID NO: 3392479 - DNA, 21 bp, Homo sapiens
gaggttaaggtgggtccagga

SEQ ID NO: 3392480 - DNA, 13 bp, Homo sapiens
gaggttataggtc

SEQ ID NO: 3392481 - DNA, 19 bp, Homo sapiens
gaggttataggtcactcct

SEQ ID NO: 3392482 - DNA, 15 bp, Homo sapiens
gaggttatctgcctg

SEQ ID NO: 3392483 - DNA, 19 bp, Homo sapiens
gaggttatctgcctggcct

SEQ ID NO: 3392484 - DNA, 22 bp, Homo sapiens
gaggttatctgcctggcctggc

SEQ ID NO: 3392485 - DNA, 23 bp, Homo sapiens
gaggttatctgcctggcctggct

SEQ ID NO: 3392486 - DNA, 17 bp, Homo sapiens
gaggttcctctgcctgc

SEQ ID NO: 3392487 - DNA, 13 bp, Homo sapiens
gaggttctcagag

SEQ ID NO: 3392488 - DNA, 14 bp, Homo sapiens
gaggttctcagagc

SEQ ID NO: 3392489 - DNA, 16 bp, Homo sapiens
gaggttctcagagcca

SEQ ID NO: 3392490 - DNA, 15 bp, Homo sapiens
gaggttgaagccaag

SEQ ID NO: 3392491 - DNA, 19 bp, Homo sapiens
gaggttgcagggagccgag

SEQ ID NO: 3392492 - DNA, 15 bp, Homo sapiens
gatccatccatctcc

SEQ ID NO: 3392493 - DNA, 15 bp, Homo sapiens
gatcccacacaggct

SEQ ID NO: 3392494 - DNA, 12 bp, Homo sapiens
gatcccaccctg

SEQ ID NO: 3392495 - DNA, 14 bp, Homo sapiens
gatccccgcctggc

SEQ ID NO: 3392496 - DNA, 15 bp, Homo sapiens
gatccccgcctggcc

SEQ ID NO: 3392497 - DNA, 22 bp, Homo sapiens
gatccccgcctggccaggagca

SEQ ID NO: 3392498 - DNA, 13 bp, Homo sapiens
gatcccctgagcc

SEQ ID NO: 3392499 - DNA, 19 bp, Homo sapiens
gatcccctgcggtcaggct

SEQ ID NO: 3392500 - DNA, 18 bp, Homo sapiens
gatccctgtgttgtctct

SEQ ID NO: 3392501 - DNA, 19 bp, Homo sapiens
gatccctgtgttgtctcta

SEQ ID NO: 3392502 - DNA, 20 bp, Homo sapiens
gatccgcctacctcagcctc

SEQ ID NO: 3392503 - DNA, 18 bp, Homo sapiens
gatccgcctgcctctgcc

SEQ ID NO: 3392504 - DNA, 13 bp, Homo sapiens
gatccgctgccac

SEQ ID NO: 3392505 - DNA, 19 bp, Homo sapiens
gatcctaactgaagagaca

SEQ ID NO: 3392506 - DNA, 19 bp, Homo sapiens
gatcctaagcatctaagtt

SEQ ID NO: 3392507 - DNA, 17 bp, Homo sapiens
gatcctacaatatttta

SEQ ID NO: 3392508 - DNA, 15 bp, Homo sapiens
gatcctagatcctaa

SEQ ID NO: 3392509 - DNA, 23 bp, Homo sapiens
gatcctcatatggcccagtgtca

SEQ ID NO: 3392510 - DNA, 17 bp, Homo sapiens
gatcctcccacctcagc

SEQ ID NO: 3392511 - DNA, 18 bp, Homo sapiens
gatcctcccacctcagcc

SEQ ID NO: 3392512 - DNA, 19 bp, Homo sapiens
gatcctcccacctcagcct

SEQ ID NO: 3392513 - DNA, 20 bp, Homo sapiens
gatcctcccacctcagcctc

SEQ ID NO: 3392514 - DNA, 21 bp, Homo sapiens
gatcctcccacctcagcctcc

SEQ ID NO: 3392515 - DNA, 15 bp, Homo sapiens
gatcctccctatcaa

SEQ ID NO: 3392516 - DNA, 15 bp, Homo sapiens
gatcctcctgcagac

SEQ ID NO: 3392517 - DNA, 15 bp, Homo sapiens
gatcctctcacctca

SEQ ID NO: 3392518 - DNA, 19 bp, Homo sapiens
gatcctctccactccatgt

SEQ ID NO: 3392519 - DNA, 22 bp, Homo sapiens
gatcctgaatctgtgcaaacag

SEQ ID NO: 3392520 - DNA, 17 bp, Homo sapiens
gatcctgccaccctgta

SEQ ID NO: 3392521 - DNA, 18 bp, Homo sapiens
gatcctggattcactcac

SEQ ID NO: 3392522 - DNA, 19 bp, Homo sapiens
gatcctggattcactcact

SEQ ID NO: 3392523 - DNA, 14 bp, Homo sapiens
gatccttccctgta

SEQ ID NO: 3392524 - DNA, 14 bp, Homo sapiens
gatcctttttccat

SEQ ID NO: 3392525 - DNA, 16 bp, Homo sapiens
gatcctttttccatca

SEQ ID NO: 3392526 - DNA, 16 bp, Homo sapiens
gatccttttttgtcat

SEQ ID NO: 3392527 - DNA, 15 bp, Homo sapiens
gatcgagccactgca

SEQ ID NO: 3392528 - DNA, 16 bp, Homo sapiens
gatcgctaagctggct

SEQ ID NO: 3392529 - DNA, 14 bp, Homo sapiens
gatcgcttgagccc

SEQ ID NO: 3392530 - DNA, 18 bp, Homo sapiens
gatcgcttgagcccagga

SEQ ID NO: 3392531 - DNA, 17 bp, Homo sapiens
gatcggagcctcctctc

SEQ ID NO: 3392532 - DNA, 21 bp, Homo sapiens
gatctaaggatgtcacagggc

SEQ ID NO: 3392533 - DNA, 12 bp, Homo sapiens
gatctattgctc

SEQ ID NO: 3392534 - DNA, 16 bp, Homo sapiens
gatctcagctttgaga

SEQ ID NO: 3392535 - DNA, 22 bp, Homo sapiens
gatctcagctttgagaagcctt

SEQ ID NO: 3392536 - DNA, 12 bp, Homo sapiens
gatctccactga

SEQ ID NO: 3392537 - DNA, 11 bp, Homo sapiens
gatctccagcg

SEQ ID NO: 3392538 - DNA, 20 bp, Homo sapiens
gatctcggtttgccaaaatt

SEQ ID NO: 3392539 - DNA, 21 bp, Homo sapiens
gatctctactaccacaaggaa

SEQ ID NO: 3392540 - DNA, 14 bp, Homo sapiens
gatctctcaggagc

SEQ ID NO: 3392541 - DNA, 20 bp, Homo sapiens
gatctctcaggagcacaggc

SEQ ID NO: 3392542 - DNA, 24 bp, Homo sapiens
gatctctcaggagcacaggcagct

SEQ ID NO: 3392543 - DNA, 18 bp, Homo sapiens
gatctctgagaccacaga

SEQ ID NO: 3392544 - DNA, 19 bp, Homo sapiens
gatctctgagaccacagag

SEQ ID NO: 3392545 - DNA, 24 bp, Homo sapiens
gatctctgagaccacagaggctca

SEQ ID NO: 3392546 - DNA, 14 bp, Homo sapiens
gatctcttcctgtt

SEQ ID NO: 3392547 - DNA, 22 bp, Homo sapiens
gatctgagtacatattgtggtg

SEQ ID NO: 3392548 - DNA, 15 bp, Homo sapiens
gatctgatggtgagc

SEQ ID NO: 3392549 - DNA, 20 bp, Homo sapiens
gatctgcctgggcctgtgca

SEQ ID NO: 3392550 - DNA, 17 bp, Homo sapiens
gatctgcggatctcagc

SEQ ID NO: 3392551 - DNA, 21 bp, Homo sapiens
gatctgcggatctcagctttg

SEQ ID NO: 3392552 - DNA, 18 bp, Homo sapiens
gatctggacagaacattt

SEQ ID NO: 3392553 - DNA, 18 bp, Homo sapiens
gatctggttttgctatta

SEQ ID NO: 3392554 - DNA, 24 bp, Homo sapiens
gatctggttttgctattagactgt

SEQ ID NO: 3392555 - DNA, 13 bp, Homo sapiens
gatcttaaagatc

SEQ ID NO: 3392556 - DNA, 14 bp, Homo sapiens
gatcttagattctc

SEQ ID NO: 3392557 - DNA, 19 bp, Homo sapiens
gatcttagggtgaaccact

SEQ ID NO: 3392558 - DNA, 14 bp, Homo sapiens
gatcttcaatggct

SEQ ID NO: 3392559 - DNA, 18 bp, Homo sapiens
gatcttcagaactgccct

SEQ ID NO: 3392560 - DNA, 20 bp, Homo sapiens
gatcttcagaactgcccttg

SEQ ID NO: 3392561 - DNA, 21 bp, Homo sapiens
gatcttcagaactgcccttgc

SEQ ID NO: 3392562 - DNA, 18 bp, Homo sapiens
gatcttcattaccaatag

SEQ ID NO: 3392563 - DNA, 20 bp, Homo sapiens
gatcttctgggagcaggaac

SEQ ID NO: 3392564 - DNA, 14 bp, Homo sapiens
gatcttcttcatcc

SEQ ID NO: 3392565 - DNA, 19 bp, Homo sapiens
gatcttctttataattcta

SEQ ID NO: 3392566 - DNA, 17 bp, Homo sapiens
gatcttgcattcatttt

SEQ ID NO: 3392567 - DNA, 19 bp, Homo sapiens
gatcttgcattcattttct

SEQ ID NO: 3392568 - DNA, 17 bp, Homo sapiens
gatcttgccacatttct

SEQ ID NO: 3392569 - DNA, 19 bp, Homo sapiens
gatcttggcttactgcagc

SEQ ID NO: 3392570 - DNA, 15 bp, Homo sapiens
gatcttgtgctcagc

SEQ ID NO: 3392571 - DNA, 11 bp, Homo sapiens
gatctttactc

SEQ ID NO: 3392572 - DNA, 18 bp, Homo sapiens
gatctttcagaaatataa

SEQ ID NO: 3392573 - DNA, 11 bp, Homo sapiens
gatctttcagg

SEQ ID NO: 3392574 - DNA, 16 bp, Homo sapiens
gatctttcccaggccg

SEQ ID NO: 3392575 - DNA, 18 bp, Homo sapiens
gatctttctttccaaaac

SEQ ID NO: 3392576 - DNA, 16 bp, Homo sapiens
gatgaaactcacaaat

SEQ ID NO: 3392577 - DNA, 18 bp, Homo sapiens
gatgaaataactccttct

SEQ ID NO: 3392578 - DNA, 10 bp, Homo sapiens
gatgaaatca

SEQ ID NO: 3392579 - DNA, 18 bp, Homo sapiens
gatgaactctgaactttg

SEQ ID NO: 3392580 - DNA, 18 bp, Homo sapiens
gatgaactgactgaagga

SEQ ID NO: 3392581 - DNA, 20 bp, Homo sapiens
gatgaagcaaggaagatata

SEQ ID NO: 3392582 - DNA, 21 bp, Homo sapiens
gatgaagcaaggaagatatac

SEQ ID NO: 3392583 - DNA, 23 bp, Homo sapiens
gatgaagcaaggaagatatacat

SEQ ID NO: 3392584 - DNA, 23 bp, Homo sapiens
gatgaagttttacattgttgagc

SEQ ID NO: 3392585 - DNA, 19 bp, Homo sapiens
gatgaatctcccactccag

SEQ ID NO: 3392586 - DNA, 15 bp, Homo sapiens
gatgaatgccgtgga

SEQ ID NO: 3392587 - DNA, 16 bp, Homo sapiens
gatgacaccctggcct

SEQ ID NO: 3392588 - DNA, 21 bp, Homo sapiens
gatgacacgcgctctccacca

SEQ ID NO: 3392589 - DNA, 20 bp, Homo sapiens
gatgacaggcgcctgccatc

SEQ ID NO: 3392590 - DNA, 15 bp, Homo sapiens
gatgacattccctgc

SEQ ID NO: 3392591 - DNA, 15 bp, Homo sapiens
gatgaccaatgggat

SEQ ID NO: 3392592 - DNA, 15 bp, Homo sapiens
gatgactaaaatatt

SEQ ID NO: 3392593 - DNA, 14 bp, Homo sapiens
gatgactaacaaga

SEQ ID NO: 3392594 - DNA, 18 bp, Homo sapiens
gatgactcccttaaaata

SEQ ID NO: 3392595 - DNA, 14 bp, Homo sapiens
gatgactgagtcct

SEQ ID NO: 3392596 - DNA, 17 bp, Homo sapiens
gatgactgagtcctcgt

SEQ ID NO: 3392597 - DNA, 19 bp, Homo sapiens
gatgactggggtgggaggt

SEQ ID NO: 3392598 - DNA, 18 bp, Homo sapiens
gatgactggttgttcaaa

SEQ ID NO: 3392599 - DNA, 14 bp, Homo sapiens
gatgactttgcaga

SEQ ID NO: 3392600 - DNA, 14 bp, Homo sapiens
gatgagaacaaagc

SEQ ID NO: 3392601 - DNA, 15 bp, Homo sapiens
gatgagaacaaagct

SEQ ID NO: 3392602 - DNA, 17 bp, Homo sapiens
gatgagaacaaagctgt

SEQ ID NO: 3392603 - DNA, 22 bp, Homo sapiens
gatgagaatttctaaaaagatt

SEQ ID NO: 3392604 - DNA, 14 bp, Homo sapiens
gatgagagcccaga

SEQ ID NO: 3392605 - DNA, 16 bp, Homo sapiens
gatgagatttgccagc

SEQ ID NO: 3392606 - DNA, 16 bp, Homo sapiens
gatgaggggtgctggg

SEQ ID NO: 3392607 - DNA, 18 bp, Homo sapiens
gatgaggtcaccagggga

SEQ ID NO: 3392608 - DNA, 19 bp, Homo sapiens
gatgataaagagacagtga

SEQ ID NO: 3392609 - DNA, 19 bp, Homo sapiens
gatgataatgatgatgacg

SEQ ID NO: 3392610 - DNA, 20 bp, Homo sapiens
gatgatcaaaacctgtgcca

SEQ ID NO: 3392611 - DNA, 19 bp, Homo sapiens
gatgatcagctgtttgtca

SEQ ID NO: 3392612 - DNA, 20 bp, Homo sapiens
gatgatcagctgtttgtcat

SEQ ID NO: 3392613 - DNA, 13 bp, Homo sapiens
gatgatctctcca

SEQ ID NO: 3392614 - DNA, 20 bp, Homo sapiens
gatgatctttgcagacaggc

SEQ ID NO: 3392615 - DNA, 14 bp, Homo sapiens
gatgatgctgccag

SEQ ID NO: 3392616 - DNA, 16 bp, Homo sapiens
gatgatgctgtgacaa

SEQ ID NO: 3392617 - DNA, 20 bp, Homo sapiens
gatgatgtctcttgtagaag

SEQ ID NO: 3392618 - DNA, 14 bp, Homo sapiens
gattttaccaaagc

SEQ ID NO: 3392619 - DNA, 15 bp, Homo sapiens
gattttaccaaagca

SEQ ID NO: 3392620 - DNA, 21 bp, Homo sapiens
gattttaggagctaaggctct

SEQ ID NO: 3392621 - DNA, 15 bp, Homo sapiens
gattttatttgacaa

SEQ ID NO: 3392622 - DNA, 19 bp, Homo sapiens
gattttcacattcttggct

SEQ ID NO: 3392623 - DNA, 14 bp, Homo sapiens
gattttcagttact

SEQ ID NO: 3392624 - DNA, 23 bp, Homo sapiens
gattttctattatggaaaactgt

SEQ ID NO: 3392625 - DNA, 17 bp, Homo sapiens
gattttctattgttact

SEQ ID NO: 3392626 - DNA, 18 bp, Homo sapiens
gattttctattgttactc

SEQ ID NO: 3392627 - DNA, 13 bp, Homo sapiens
gattttctccagc

SEQ ID NO: 3392628 - DNA, 14 bp, Homo sapiens
gattttctccagct

SEQ ID NO: 3392629 - DNA, 15 bp, Homo sapiens
gattttctccagctc

SEQ ID NO: 3392630 - DNA, 21 bp, Homo sapiens
gattttgaaatttttattaaa

SEQ ID NO: 3392631 - DNA, 15 bp, Homo sapiens
gattttgcaaaatga

SEQ ID NO: 3392632 - DNA, 10 bp, Homo sapiens
gattttgctg

SEQ ID NO: 3392633 - DNA, 18 bp, Homo sapiens
gattttgctgtatatttg

SEQ ID NO: 3392634 - DNA, 21 bp, Homo sapiens
gatttttaaaaaatattttct

SEQ ID NO: 3392635 - DNA, 14 bp, Homo sapiens
gatttttaaattat

SEQ ID NO: 3392636 - DNA, 12 bp, Homo sapiens
gatttttctcaa

SEQ ID NO: 3392637 - DNA, 11 bp, Homo sapiens
gatttttctct

SEQ ID NO: 3392638 - DNA, 15 bp, Homo sapiens
gatttttctcttcat

SEQ ID NO: 3392639 - DNA, 15 bp, Homo sapiens
gatttttctttaact

SEQ ID NO: 3392640 - DNA, 18 bp, Homo sapiens
gatttttgtttttgtaat

SEQ ID NO: 3392641 - DNA, 15 bp, Homo sapiens
gattttttaaaagaa

SEQ ID NO: 3392642 - DNA, 11 bp, Homo sapiens
gattttttcca

SEQ ID NO: 3392643 - DNA, 12 bp, Homo sapiens
gattttttccaa

SEQ ID NO: 3392644 - DNA, 14 bp, Homo sapiens
gattttttccaaaa

SEQ ID NO: 3392645 - DNA, 19 bp, Homo sapiens
gattttttgcattcctgac

SEQ ID NO: 3392646 - DNA, 17 bp, Homo sapiens
gatttttttgtgtatgt

SEQ ID NO: 3392647 - DNA, 15 bp, Homo sapiens
gatttttttttcata

SEQ ID NO: 3392648 - DNA, 14 bp, Homo sapiens
gcaaaaaaagcctc

SEQ ID NO: 3392649 - DNA, 16 bp, Homo sapiens
gcaaaaaaagcctcca

SEQ ID NO: 3392650 - DNA, 22 bp, Homo sapiens
gcaaaaaaagcctccaagggtt

SEQ ID NO: 3392651 - DNA, 23 bp, Homo sapiens
gcaaaaaactcttaatctgtgtg

SEQ ID NO: 3392652 - DNA, 15 bp, Homo sapiens
gcaaaaacatgtatg

SEQ ID NO: 3392653 - DNA, 16 bp, Homo sapiens
gcaaaaagaggatccg

SEQ ID NO: 3392654 - DNA, 20 bp, Homo sapiens
gcaaaaagcaagggagaaaa

SEQ ID NO: 3392655 - DNA, 13 bp, Homo sapiens
gcaaaaataatca

SEQ ID NO: 3392656 - DNA, 14 bp, Homo sapiens
gcaaaaatataaaa

SEQ ID NO: 3392657 - DNA, 14 bp, Homo sapiens
gcaaaaatatttat

SEQ ID NO: 3392658 - DNA, 17 bp, Homo sapiens
gcaaaactctacttaat

SEQ ID NO: 3392659 - DNA, 12 bp, Homo sapiens
gcaaaaggcagc

SEQ ID NO: 3392660 - DNA, 14 bp, Homo sapiens
gcaaaaggcagctc

SEQ ID NO: 3392661 - DNA, 15 bp, Homo sapiens
gcaaaaggctgagaa

SEQ ID NO: 3392662 - DNA, 16 bp, Homo sapiens
gcaaaaggctgagaag

SEQ ID NO: 3392663 - DNA, 13 bp, Homo sapiens
gcaaaatagcatt

SEQ ID NO: 3392664 - DNA, 12 bp, Homo sapiens
gcaaaatgagtt

SEQ ID NO: 3392665 - DNA, 17 bp, Homo sapiens
gcaaaattgatgtgttt

SEQ ID NO: 3392666 - DNA, 21 bp, Homo sapiens
gcaaaattgttttcacttgta

SEQ ID NO: 3392667 - DNA, 23 bp, Homo sapiens
gcaaaattgttttcacttgtatt

SEQ ID NO: 3392668 - DNA, 21 bp, Homo sapiens
gcaaaatttgatgccaggaca

SEQ ID NO: 3392669 - DNA, 16 bp, Homo sapiens
gcaaaattttatagct

SEQ ID NO: 3392670 - DNA, 15 bp, Homo sapiens
gcaaacaatcccaat

SEQ ID NO: 3392671 - DNA, 17 bp, Homo sapiens
gcaaacactccaccctc

SEQ ID NO: 3392672 - DNA, 21 bp, Homo sapiens
gcaaacatcaaataaatttct

SEQ ID NO: 3392673 - DNA, 19 bp, Homo sapiens
gcaaacctgacccctgctc

SEQ ID NO: 3392674 - DNA, 16 bp, Homo sapiens
gcaaaccttcctggga

SEQ ID NO: 3392675 - DNA, 14 bp, Homo sapiens
gcaaacgctaaaga

SEQ ID NO: 3392676 - DNA, 19 bp, Homo sapiens
gcaaactcactgctcaaga

SEQ ID NO: 3392677 - DNA, 23 bp, Homo sapiens
gcaaagaaaaaaaaaaaagccag

SEQ ID NO: 3392678 - DNA, 23 bp, Homo sapiens
gcaaagaaagtgggaggtcagga

SEQ ID NO: 3392679 - DNA, 21 bp, Homo sapiens
gcaaagacagtatttattggt

SEQ ID NO: 3392680 - DNA, 19 bp, Homo sapiens
gcaaagacctacctccaga

SEQ ID NO: 3392681 - DNA, 21 bp, Homo sapiens
gcaaagaggactcgcttgtaa

SEQ ID NO: 3392682 - DNA, 12 bp, Homo sapiens
gcaaagatcaaa

SEQ ID NO: 3392683 - DNA, 21 bp, Homo sapiens
gcaaagctgatgacaacttcc

SEQ ID NO: 3392684 - DNA, 17 bp, Homo sapiens
gcaaaggctggctgtgt

SEQ ID NO: 3392685 - DNA, 12 bp, Homo sapiens
gcaaagggtctt

SEQ ID NO: 3392686 - DNA, 20 bp, Homo sapiens
gcaaagtgattcactgtgct

SEQ ID NO: 3392687 - DNA, 16 bp, Homo sapiens
gcaaagtgctgtaccc

SEQ ID NO: 3392688 - DNA, 23 bp, Homo sapiens
gcaaagttccctacttcctgtga

SEQ ID NO: 3392689 - DNA, 15 bp, Homo sapiens
gcaaataaagccttt

SEQ ID NO: 3392690 - DNA, 19 bp, Homo sapiens
gcaaataaagccttttaaa

SEQ ID NO: 3392691 - DNA, 11 bp, Homo sapiens
gcaaatataaa

SEQ ID NO: 3392692 - DNA, 15 bp, Homo sapiens
gcaaatcagaaactt

SEQ ID NO: 3392693 - DNA, 19 bp, Homo sapiens
gcaaatcagtgtttttctt

SEQ ID NO: 3392694 - DNA, 14 bp, Homo sapiens
gcaaatcatctgca

SEQ ID NO: 3392695 - DNA, 18 bp, Homo sapiens
gcaaatctattacttttg

SEQ ID NO: 3392696 - DNA, 12 bp, Homo sapiens
gcaaatcttgaa

SEQ ID NO: 3392697 - DNA, 19 bp, Homo sapiens
gcaaatgacatgcactgac

SEQ ID NO: 3392698 - DNA, 14 bp, Homo sapiens
gcaaatgagggagg

SEQ ID NO: 3392699 - DNA, 21 bp, Homo sapiens
gcaaatggaggcttttcactg

SEQ ID NO: 3392700 - DNA, 22 bp, Homo sapiens
gcaaatggaggcttttcactgc

SEQ ID NO: 3392701 - DNA, 20 bp, Homo sapiens
gcaaattaaaacatatttca

SEQ ID NO: 3392702 - DNA, 22 bp, Homo sapiens
gcaaattaaaacatatttcatt

SEQ ID NO: 3392703 - DNA, 18 bp, Homo sapiens
gcaaattaaacaatataa

SEQ ID NO: 3392704 - DNA, 19 bp, Homo sapiens
gcaaattaaacaatataag

SEQ ID NO: 3392705 - DNA, 15 bp, Homo sapiens
gcaaattaactgtat

SEQ ID NO: 3392706 - DNA, 19 bp, Homo sapiens
gcaaattaactgtatgtgt

SEQ ID NO: 3392707 - DNA, 16 bp, Homo sapiens
gcaaattgtatcttat

SEQ ID NO: 3392708 - DNA, 16 bp, Homo sapiens
gcaacaaatatttata

SEQ ID NO: 3392709 - DNA, 15 bp, Homo sapiens
gcaacaacaattggt

SEQ ID NO: 3392710 - DNA, 22 bp, Homo sapiens
gcaacaatacatgctgctaatt

SEQ ID NO: 3392711 - DNA, 14 bp, Homo sapiens
gcaacagagtgaga

SEQ ID NO: 3392712 - DNA, 19 bp, Homo sapiens
gcaacagcaaatcacgacc

SEQ ID NO: 3392713 - DNA, 15 bp, Homo sapiens
gcaacagcaagaaat

SEQ ID NO: 3392714 - DNA, 22 bp, Homo sapiens
gcaacaggacagagttcacagg

SEQ ID NO: 3392715 - DNA, 16 bp, Homo sapiens
gcaacaggctgggctt

SEQ ID NO: 3392716 - DNA, 18 bp, Homo sapiens
gcaacaggggaggaaaaa

SEQ ID NO: 3392717 - DNA, 13 bp, Homo sapiens
gcaacatccaaaa

SEQ ID NO: 3392718 - DNA, 19 bp, Homo sapiens
gcaacatgaagaatgcatt

SEQ ID NO: 3392719 - DNA, 14 bp, Homo sapiens
gcaaccactaagaa

SEQ ID NO: 3392720 - DNA, 16 bp, Homo sapiens
gcaaccccagttctgc

SEQ ID NO: 3392721 - DNA, 19 bp, Homo sapiens
gcaaccccagttctgctcc

SEQ ID NO: 3392722 - DNA, 14 bp, Homo sapiens
gcaacccccagcct

SEQ ID NO: 3392723 - DNA, 23 bp, Homo sapiens
gcaacctttcacctttgtgtatt

SEQ ID NO: 3392724 - DNA, 16 bp, Homo sapiens
gcaactagccaaggct

SEQ ID NO: 3392725 - DNA, 15 bp, Homo sapiens
gcaactcttgattat

SEQ ID NO: 3392726 - DNA, 18 bp, Homo sapiens
gcaactgttatgaaataa

SEQ ID NO: 3392727 - DNA, 19 bp, Homo sapiens
gcaacttcagtcctgggag

SEQ ID NO: 3392728 - DNA, 15 bp, Homo sapiens
gcaacttcagtttta

SEQ ID NO: 3392729 - DNA, 19 bp, Homo sapiens
gcaacttgtctttttctgg

SEQ ID NO: 3392730 - DNA, 11 bp, Homo sapiens
gcaagaaacag

SEQ ID NO: 3392731 - DNA, 15 bp, Homo sapiens
gcaagaacttgttta

SEQ ID NO: 3392732 - DNA, 19 bp, Homo sapiens
gcaagaagatcacgctccc

SEQ ID NO: 3392733 - DNA, 21 bp, Homo sapiens
gcaagaagatcacgctccccg

SEQ ID NO: 3392734 - DNA, 13 bp, Homo sapiens
gcaagaagctgct

SEQ ID NO: 3392735 - DNA, 15 bp, Homo sapiens
gcaagaaggaaagat

SEQ ID NO: 3392736 - DNA, 15 bp, Homo sapiens
gcaagaatttgatcg

SEQ ID NO: 3392737 - DNA, 23 bp, Homo sapiens
gcaagacacgtggcctcgtgagg

SEQ ID NO: 3392738 - DNA, 21 bp, Homo sapiens
gcaagactgcaaactttttta

SEQ ID NO: 3392739 - DNA, 19 bp, Homo sapiens
gcaagagaattgcttgaac

SEQ ID NO: 3392740 - DNA, 13 bp, Homo sapiens
gcaagaggcctca

SEQ ID NO: 3392741 - DNA, 23 bp, Homo sapiens
gcaagaggcctcatgcctgctga

SEQ ID NO: 3392742 - DNA, 17 bp, Homo sapiens
gcaagagggaacaaaac

SEQ ID NO: 3392743 - DNA, 22 bp, Homo sapiens
gcaagagggggtggaggggtgt

SEQ ID NO: 3392744 - DNA, 23 bp, Homo sapiens
gcaagagggggtggaggggtgtg

SEQ ID NO: 3392745 - DNA, 14 bp, Homo sapiens
gcaccctccaccct

SEQ ID NO: 3392746 - DNA, 17 bp, Homo sapiens
gcaccctccaccctgtc

SEQ ID NO: 3392747 - DNA, 16 bp, Homo sapiens
gcaccctccgccttca

SEQ ID NO: 3392748 - DNA, 16 bp, Homo sapiens
gcaccctctcctgggg

SEQ ID NO: 3392749 - DNA, 13 bp, Homo sapiens
gcaccctgcacct

SEQ ID NO: 3392750 - DNA, 22 bp, Homo sapiens
gcaccctgggtgccattcccag

SEQ ID NO: 3392751 - DNA, 21 bp, Homo sapiens
gcaccctgtagatgttctagg

SEQ ID NO: 3392752 - DNA, 17 bp, Homo sapiens
gcaccctgtggccctgg

SEQ ID NO: 3392753 - DNA, 17 bp, Homo sapiens
gcacccttatcatggga

SEQ ID NO: 3392754 - DNA, 12 bp, Homo sapiens
gcaccgccacgt

SEQ ID NO: 3392755 - DNA, 19 bp, Homo sapiens
gcaccgccgccaccagccc

SEQ ID NO: 3392756 - DNA, 15 bp, Homo sapiens
gcaccggcgctgcag

SEQ ID NO: 3392757 - DNA, 23 bp, Homo sapiens
gcaccgggccacagagaaagtac

SEQ ID NO: 3392758 - DNA, 18 bp, Homo sapiens
gcaccgggctccatgcct

SEQ ID NO: 3392759 - DNA, 21 bp, Homo sapiens
gcaccgtcctcagcagtccac

SEQ ID NO: 3392760 - DNA, 20 bp, Homo sapiens
gcacctaccatcagggacag

SEQ ID NO: 3392761 - DNA, 22 bp, Homo sapiens
gcacctactatgtgctgggtgc

SEQ ID NO: 3392762 - DNA, 17 bp, Homo sapiens
gcacctatagtcccagc

SEQ ID NO: 3392763 - DNA, 13 bp, Homo sapiens
gcacctccaggcc

SEQ ID NO: 3392764 - DNA, 20 bp, Homo sapiens
gcacctcctgagaaggcgag

SEQ ID NO: 3392765 - DNA, 14 bp, Homo sapiens
gcacctcctgcctc

SEQ ID NO: 3392766 - DNA, 22 bp, Homo sapiens
gcacctcggggacaccagagct

SEQ ID NO: 3392767 - DNA, 23 bp, Homo sapiens
gcacctcggggacaccagagctg

SEQ ID NO: 3392768 - DNA, 15 bp, Homo sapiens
gcacctctgttcatt

SEQ ID NO: 3392769 - DNA, 14 bp, Homo sapiens
gcacctcttccttg

SEQ ID NO: 3392770 - DNA, 20 bp, Homo sapiens
gcacctcttccttgatgttt

SEQ ID NO: 3392771 - DNA, 13 bp, Homo sapiens
gcacctgccagcc

SEQ ID NO: 3392772 - DNA, 15 bp, Homo sapiens
gcacctgccagcctg

SEQ ID NO: 3392773 - DNA, 22 bp, Homo sapiens
gcacctgccagcctggcttctg

SEQ ID NO: 3392774 - DNA, 15 bp, Homo sapiens
gcacctgccccctgg

SEQ ID NO: 3392775 - DNA, 16 bp, Homo sapiens
gcacctgccccctggt

SEQ ID NO: 3392776 - DNA, 11 bp, Homo sapiens
gcacctgctgc

SEQ ID NO: 3392777 - DNA, 14 bp, Homo sapiens
gcacctgctgcgtc

SEQ ID NO: 3392778 - DNA, 21 bp, Homo sapiens
gcacctgctgcgtccccactc

SEQ ID NO: 3392779 - DNA, 23 bp, Homo sapiens
gcacctgctgcgtccccactccc

SEQ ID NO: 3392780 - DNA, 15 bp, Homo sapiens
gcacctggcctgctg

SEQ ID NO: 3392781 - DNA, 21 bp, Homo sapiens
gcacctgtaatcccagctact

SEQ ID NO: 3392782 - DNA, 23 bp, Homo sapiens
gcacctgtccccaccctccactc

SEQ ID NO: 3392783 - DNA, 19 bp, Homo sapiens
gcaccttaccaactttctg

SEQ ID NO: 3392784 - DNA, 14 bp, Homo sapiens
gcaccttcagactt

SEQ ID NO: 3392785 - DNA, 23 bp, Homo sapiens
gcaccttcttggcgctggagagt

SEQ ID NO: 3392786 - DNA, 15 bp, Homo sapiens
gcaccttctttctgg

SEQ ID NO: 3392787 - DNA, 18 bp, Homo sapiens
gcaccttctttctggact

SEQ ID NO: 3392788 - DNA, 19 bp, Homo sapiens
gcaccttctttctggactg

SEQ ID NO: 3392789 - DNA, 14 bp, Homo sapiens
gcacctttcaacca

SEQ ID NO: 3392790 - DNA, 20 bp, Homo sapiens
gcacgagtgggaaggacttg

SEQ ID NO: 3392791 - DNA, 13 bp, Homo sapiens
gcacgcacacaca

SEQ ID NO: 3392792 - DNA, 21 bp, Homo sapiens
gcacgcttgcgtatgtctgtt

SEQ ID NO: 3392793 - DNA, 12 bp, Homo sapiens
gcacggacaata

SEQ ID NO: 3392794 - DNA, 17 bp, Homo sapiens
gcacggactgtccacct

SEQ ID NO: 3392795 - DNA, 13 bp, Homo sapiens
gcacgggtggtcc

SEQ ID NO: 3392796 - DNA, 14 bp, Homo sapiens
gcacgggtggtccc

SEQ ID NO: 3392797 - DNA, 22 bp, Homo sapiens
gcacgtagctgaggccggatgc

SEQ ID NO: 3392798 - DNA, 15 bp, Homo sapiens
gcacgtggagagctg

SEQ ID NO: 3392799 - DNA, 18 bp, Homo sapiens
gcacgtggagagctggtg

SEQ ID NO: 3392800 - DNA, 18 bp, Homo sapiens
gcacgtggcatgtggcct

SEQ ID NO: 3392801 - DNA, 13 bp, Homo sapiens
gcacgtggcctct

SEQ ID NO: 3392802 - DNA, 14 bp, Homo sapiens
gcacgtggcctctt

SEQ ID NO: 3392803 - DNA, 15 bp, Homo sapiens
gcacgtggcctcttg

SEQ ID NO: 3392804 - DNA, 15 bp, Homo sapiens
gcacgttgcttcagg

SEQ ID NO: 3392805 - DNA, 19 bp, Homo sapiens
gcactaaagtatgtaaagt

SEQ ID NO: 3392806 - DNA, 20 bp, Homo sapiens
gcactaaagtatgtaaagta

SEQ ID NO: 3392807 - DNA, 17 bp, Homo sapiens
gcactaaatcagagaca

SEQ ID NO: 3392808 - DNA, 23 bp, Homo sapiens
gcactaaggccgtgtctctgagg

SEQ ID NO: 3392809 - DNA, 19 bp, Homo sapiens
gcactaaggtgtgctctga

SEQ ID NO: 3392810 - DNA, 20 bp, Homo sapiens
gcactaaggtgtgctctgat

SEQ ID NO: 3392811 - DNA, 17 bp, Homo sapiens
gcactacaccttgcctt

SEQ ID NO: 3392812 - DNA, 14 bp, Homo sapiens
gcactacataaact

SEQ ID NO: 3392813 - DNA, 21 bp, Homo sapiens
gcactacatgtggtttataga

SEQ ID NO: 3392814 - DNA, 12 bp, Homo sapiens
gcactacattca

SEQ ID NO: 3392815 - DNA, 16 bp, Homo sapiens
gcactacattcattta

SEQ ID NO: 3392816 - DNA, 22 bp, Homo sapiens
gcactacctgaacattgtaata

SEQ ID NO: 3392817 - DNA, 18 bp, Homo sapiens
gcactagagaatgcacag

SEQ ID NO: 3392818 - DNA, 13 bp, Homo sapiens
gcactagcctttg

SEQ ID NO: 3392819 - DNA, 15 bp, Homo sapiens
gcactagcctttggc

SEQ ID NO: 3392820 - DNA, 18 bp, Homo sapiens
gcactagcctttggctct

SEQ ID NO: 3392821 - DNA, 20 bp, Homo sapiens
gcactataatgtaagctcta

SEQ ID NO: 3392822 - DNA, 15 bp, Homo sapiens
gcactattttatatt

SEQ ID NO: 3392823 - DNA, 13 bp, Homo sapiens
gcactcagaagac

SEQ ID NO: 3392824 - DNA, 20 bp, Homo sapiens
gcactcagaagacactgatg

SEQ ID NO: 3392825 - DNA, 19 bp, Homo sapiens
gcactcagccacgaccagc

SEQ ID NO: 3392826 - DNA, 17 bp, Homo sapiens
gcactcattttctataa

SEQ ID NO: 3392827 - DNA, 14 bp, Homo sapiens
gcactccagcctgg

SEQ ID NO: 3392828 - DNA, 19 bp, Homo sapiens
gcactccagcctgggggac

SEQ ID NO: 3392829 - DNA, 16 bp, Homo sapiens
gcactccatgagcacc

SEQ ID NO: 3392830 - DNA, 21 bp, Homo sapiens
gcactccccagagctgtgcca

SEQ ID NO: 3392831 - DNA, 17 bp, Homo sapiens
gcactccccttgccttc

SEQ ID NO: 3392832 - DNA, 20 bp, Homo sapiens
gcactccccttgccttcccc

SEQ ID NO: 3392833 - DNA, 21 bp, Homo sapiens
gcactctaaaaggttcaggga

SEQ ID NO: 3392834 - DNA, 22 bp, Homo sapiens
gcactctcatatgccaccccat

SEQ ID NO: 3392835 - DNA, 19 bp, Homo sapiens
gcactctgttatttagact

SEQ ID NO: 3392836 - DNA, 14 bp, Homo sapiens
gcactgaaaaggtt

SEQ ID NO: 3392837 - DNA, 18 bp, Homo sapiens
gcactgaagtttttgaaa

SEQ ID NO: 3392838 - DNA, 21 bp, Homo sapiens
gcactgaagtttttgaaatac

SEQ ID NO: 3392839 - DNA, 23 bp, Homo sapiens
gcactgaagtttttgaaatacct

SEQ ID NO: 3392840 - DNA, 15 bp, Homo sapiens
gcactgacccttcca

SEQ ID NO: 3392841 - DNA, 16 bp, Homo sapiens
gcactgacccttccag

SEQ ID NO: 3392842 - DNA, 21 bp, Homo sapiens
gcactgagatatttattgttt

SEQ ID NO: 3392843 - DNA, 11 bp, Homo sapiens
gcactgagccc

SEQ ID NO: 3392844 - DNA, 14 bp, Homo sapiens
gcactgagcccccc

SEQ ID NO: 3392845 - DNA, 17 bp, Homo sapiens
gcactgaggaccagcca

SEQ ID NO: 3392846 - DNA, 14 bp, Homo sapiens
gcactgagggccac

SEQ ID NO: 3392847 - DNA, 17 bp, Homo sapiens
gcactgatgttgtgttt

SEQ ID NO: 3392848 - DNA, 18 bp, Homo sapiens
gcactgatgttgtgtttt

SEQ ID NO: 3392849 - DNA, 20 bp, Homo sapiens
gcactgatgttgtgttttta

SEQ ID NO: 3392850 - DNA, 13 bp, Homo sapiens
gcactgccactgg

SEQ ID NO: 3392851 - DNA, 22 bp, Homo sapiens
gcactgccctgttcatgtgcct

SEQ ID NO: 3392852 - DNA, 13 bp, Homo sapiens
gcactgccttctc

SEQ ID NO: 3392853 - DNA, 14 bp, Homo sapiens
gcactgccttctcc

SEQ ID NO: 3392854 - DNA, 22 bp, Homo sapiens
gcactgccttctcctctctggg

SEQ ID NO: 3392855 - DNA, 23 bp, Homo sapiens
gcactgccttctcctctctgggc

SEQ ID NO: 3392856 - DNA, 12 bp, Homo sapiens
gcactgctgccc

SEQ ID NO: 3392857 - DNA, 14 bp, Homo sapiens
gcactggagtgcag

SEQ ID NO: 3392858 - DNA, 15 bp, Homo sapiens
gcactggagtgcagg

SEQ ID NO: 3392859 - DNA, 13 bp, Homo sapiens
gcactggccagag

SEQ ID NO: 3392860 - DNA, 16 bp, Homo sapiens
gcactggctctctcca

SEQ ID NO: 3392861 - DNA, 18 bp, Homo sapiens
gcactggctctctccagg

SEQ ID NO: 3392862 - DNA, 12 bp, Homo sapiens
gcactgggccac

SEQ ID NO: 3392863 - DNA, 17 bp, Homo sapiens
gcactgggccacggagg

SEQ ID NO: 3392864 - DNA, 23 bp, Homo sapiens
gcactggggagcccgtctcagtg

SEQ ID NO: 3392865 - DNA, 23 bp, Homo sapiens
gcactggtaggttgggacaccag

SEQ ID NO: 3392866 - DNA, 19 bp, Homo sapiens
gcactggtggcccgacagc

SEQ ID NO: 3392867 - DNA, 19 bp, Homo sapiens
gcactggtttgttccctgt

SEQ ID NO: 3392868 - DNA, 17 bp, Homo sapiens
gcactgtagttctaaga

SEQ ID NO: 3392869 - DNA, 18 bp, Homo sapiens
gcactgtagttctaagac

SEQ ID NO: 3392870 - DNA, 16 bp, Homo sapiens
gcactgtcactttgct

SEQ ID NO: 3392871 - DNA, 21 bp, Homo sapiens
gcagggggtggacaaactgga

SEQ ID NO: 3392872 - DNA, 20 bp, Homo sapiens
gcaggggtgggggtggaggc

SEQ ID NO: 3392873 - DNA, 17 bp, Homo sapiens
gcagggtcagtggaagc

SEQ ID NO: 3392874 - DNA, 14 bp, Homo sapiens
gcagggtgttggga

SEQ ID NO: 3392875 - DNA, 14 bp, Homo sapiens
gcagggtttctttt

SEQ ID NO: 3392876 - DNA, 22 bp, Homo sapiens
gcaggtacttcctcctgatggc

SEQ ID NO: 3392877 - DNA, 24 bp, Homo sapiens
gcaggtacttcctcctgatggcca

SEQ ID NO: 3392878 - DNA, 21 bp, Homo sapiens
gcaggtcaacagctatgctgg

SEQ ID NO: 3392879 - DNA, 22 bp, Homo sapiens
gcaggtccagggtttgagttca

SEQ ID NO: 3392880 - DNA, 16 bp, Homo sapiens
gcaggtcctgcccatg

SEQ ID NO: 3392881 - DNA, 19 bp, Homo sapiens
gcaggtcttgaactcctgg

SEQ ID NO: 3392882 - DNA, 20 bp, Homo sapiens
gcaggtcttgaactcctggc

SEQ ID NO: 3392883 - DNA, 13 bp, Homo sapiens
gcaggtgcagccc

SEQ ID NO: 3392884 - DNA, 14 bp, Homo sapiens
gcaggtgcctccag

SEQ ID NO: 3392885 - DNA, 16 bp, Homo sapiens
gcaggtgcctccaggt

SEQ ID NO: 3392886 - DNA, 18 bp, Homo sapiens
gcaggtgcctccaggtgt

SEQ ID NO: 3392887 - DNA, 17 bp, Homo sapiens
gcaggtgctggtcccgg

SEQ ID NO: 3392888 - DNA, 21 bp, Homo sapiens
gcaggtggatctatttcatgt

SEQ ID NO: 3392889 - DNA, 12 bp, Homo sapiens
gcaggtgggcac

SEQ ID NO: 3392890 - DNA, 17 bp, Homo sapiens
gcaggtgggctggactt

SEQ ID NO: 3392891 - DNA, 15 bp, Homo sapiens
gcaggtgtcctttcc

SEQ ID NO: 3392892 - DNA, 18 bp, Homo sapiens
gcaggtgtcctttcccct

SEQ ID NO: 3392893 - DNA, 21 bp, Homo sapiens
gcaggtgtcctttcccctctc

SEQ ID NO: 3392894 - DNA, 23 bp, Homo sapiens
gcaggtgtcctttcccctctctg

SEQ ID NO: 3392895 - DNA, 19 bp, Homo sapiens
gcaggttccccaagggccc

SEQ ID NO: 3392896 - DNA, 19 bp, Homo sapiens
gcaggttgaggggctcctg

SEQ ID NO: 3392897 - DNA, 20 bp, Homo sapiens
gcaggttgaggggctcctgg

SEQ ID NO: 3392898 - DNA, 21 bp, Homo sapiens
gcaggttgaggggctcctgga

SEQ ID NO: 3392899 - DNA, 19 bp, Homo sapiens
gcaggttggaccccagaga

SEQ ID NO: 3392900 - DNA, 23 bp, Homo sapiens
gcaggttggatgggagtgggcac

SEQ ID NO: 3392901 - DNA, 16 bp, Homo sapiens
gcagtaaaacacattt

SEQ ID NO: 3392902 - DNA, 17 bp, Homo sapiens
gcagtaaagagaaactt

SEQ ID NO: 3392903 - DNA, 18 bp, Homo sapiens
gcagtaaagagaaacttt

SEQ ID NO: 3392904 - DNA, 12 bp, Homo sapiens
gcagtacatcaa

SEQ ID NO: 3392905 - DNA, 13 bp, Homo sapiens
gcagtacttttgt

SEQ ID NO: 3392906 - DNA, 21 bp, Homo sapiens
gcagtacttttgttgtatggg

SEQ ID NO: 3392907 - DNA, 17 bp, Homo sapiens
gcagtagaactccaggc

SEQ ID NO: 3392908 - DNA, 20 bp, Homo sapiens
gcagtagagtcatctccatc

SEQ ID NO: 3392909 - DNA, 14 bp, Homo sapiens
gcagtcactggagg

SEQ ID NO: 3392910 - DNA, 16 bp, Homo sapiens
gcagtcactgggagag

SEQ ID NO: 3392911 - DNA, 17 bp, Homo sapiens
gcagtcatctacttttt

SEQ ID NO: 3392912 - DNA, 13 bp, Homo sapiens
gcagtccccagcc

SEQ ID NO: 3392913 - DNA, 15 bp, Homo sapiens
gcagtccccagccct

SEQ ID NO: 3392914 - DNA, 22 bp, Homo sapiens
gcagtccccagcccttctgcct

SEQ ID NO: 3392915 - DNA, 22 bp, Homo sapiens
gcagtcctttgtaaacagtgtt

SEQ ID NO: 3392916 - DNA, 18 bp, Homo sapiens
gcagtcgggggctggcct

SEQ ID NO: 3392917 - DNA, 20 bp, Homo sapiens
gcagtcgtcgcacagtctct

SEQ ID NO: 3392918 - DNA, 19 bp, Homo sapiens
gcagtcgtggctttggcag

SEQ ID NO: 3392919 - DNA, 22 bp, Homo sapiens
gcagtctaaacagagtccggga

SEQ ID NO: 3392920 - DNA, 19 bp, Homo sapiens
gcagtctgaacccttgtgc

SEQ ID NO: 3392921 - DNA, 16 bp, Homo sapiens
gcagtgactggcaggt

SEQ ID NO: 3392922 - DNA, 12 bp, Homo sapiens
gcagtgactttg

SEQ ID NO: 3392923 - DNA, 13 bp, Homo sapiens
gcagtgactttgt

SEQ ID NO: 3392924 - DNA, 20 bp, Homo sapiens
gcagtgagaaaaagctcctg

SEQ ID NO: 3392925 - DNA, 18 bp, Homo sapiens
gcagtgagtctcttcaga

SEQ ID NO: 3392926 - DNA, 18 bp, Homo sapiens
gcagtgagtgagcctggc

SEQ ID NO: 3392927 - DNA, 22 bp, Homo sapiens
gcagtgatatggcagaagacac

SEQ ID NO: 3392928 - DNA, 20 bp, Homo sapiens
gcagtgcctcgaggcaccgg

SEQ ID NO: 3392929 - DNA, 21 bp, Homo sapiens
gcagtgcctcgaggcaccggc

SEQ ID NO: 3392930 - DNA, 15 bp, Homo sapiens
gcagtgccttccata

SEQ ID NO: 3392931 - DNA, 22 bp, Homo sapiens
gcagtgccttccataattatga

SEQ ID NO: 3392932 - DNA, 15 bp, Homo sapiens
gcagtgccttgggga

SEQ ID NO: 3392933 - DNA, 22 bp, Homo sapiens
gcagtgcgcgtgcacgtggaga

SEQ ID NO: 3392934 - DNA, 13 bp, Homo sapiens
gcagtgctgggac

SEQ ID NO: 3392935 - DNA, 16 bp, Homo sapiens
gcagtgctgggaccag

SEQ ID NO: 3392936 - DNA, 18 bp, Homo sapiens
gcagtgctgggaccagag

SEQ ID NO: 3392937 - DNA, 19 bp, Homo sapiens
gcagtgctgggaccagagc

SEQ ID NO: 3392938 - DNA, 20 bp, Homo sapiens
gcagtgctgggaccagagcc

SEQ ID NO: 3392939 - DNA, 22 bp, Homo sapiens
gcagtgctgggaccagagccag

SEQ ID NO: 3392940 - DNA, 19 bp, Homo sapiens
gcagtggcgcaatctcggc

SEQ ID NO: 3392941 - DNA, 14 bp, Homo sapiens
gcagtggcttttca

SEQ ID NO: 3392942 - DNA, 13 bp, Homo sapiens
gcagtgggagctg

SEQ ID NO: 3392943 - DNA, 14 bp, Homo sapiens
gcagtgggagctgc

SEQ ID NO: 3392944 - DNA, 15 bp, Homo sapiens
gcagtgggagctgcc

SEQ ID NO: 3392945 - DNA, 16 bp, Homo sapiens
gcagtgggagctgcct

SEQ ID NO: 3392946 - DNA, 20 bp, Homo sapiens
gcagtggtgcgatctgggtt

SEQ ID NO: 3392947 - DNA, 22 bp, Homo sapiens
gcagtggtgcgatctgggttca

SEQ ID NO: 3392948 - DNA, 17 bp, Homo sapiens
gcagtgtcccagggccc

SEQ ID NO: 3392949 - DNA, 18 bp, Homo sapiens
gcagtgtcccttttgcta

SEQ ID NO: 3392950 - DNA, 23 bp, Homo sapiens
gcagtgtctgtaaaagagcctag

SEQ ID NO: 3392951 - DNA, 18 bp, Homo sapiens
gcagtgtctgtgttttga

SEQ ID NO: 3392952 - DNA, 14 bp, Homo sapiens
gcagtgtcttccat

SEQ ID NO: 3392953 - DNA, 12 bp, Homo sapiens
gcagtgtgaaaa

SEQ ID NO: 3392954 - DNA, 21 bp, Homo sapiens
gcagtgttccccatctgggtc

SEQ ID NO: 3392955 - DNA, 17 bp, Homo sapiens
gcagtgttcgcttggct

SEQ ID NO: 3392956 - DNA, 17 bp, Homo sapiens
gcagtgttttggttcag

SEQ ID NO: 3392957 - DNA, 20 bp, Homo sapiens
gcagttactccctacactga

SEQ ID NO: 3392958 - DNA, 12 bp, Homo sapiens
gcagttcctggc

SEQ ID NO: 3392959 - DNA, 19 bp, Homo sapiens
gcagttctcactcctagga

SEQ ID NO: 3392960 - DNA, 11 bp, Homo sapiens
gcagttctgtt

SEQ ID NO: 3392961 - DNA, 22 bp, Homo sapiens
gcagttgaatgacaacagaagc

SEQ ID NO: 3392962 - DNA, 20 bp, Homo sapiens
gcagttgacatccaaatcta

SEQ ID NO: 3392963 - DNA, 19 bp, Homo sapiens
gcagttgacggggcagtca

SEQ ID NO: 3392964 - DNA, 18 bp, Homo sapiens
gcagttgcagtgctgctg

SEQ ID NO: 3392965 - DNA, 17 bp, Homo sapiens
gcagttggactctcagg

SEQ ID NO: 3392966 - DNA, 14 bp, Homo sapiens
gcagttggccagag

SEQ ID NO: 3392967 - DNA, 22 bp, Homo sapiens
gcagttggccagagagcctggt

SEQ ID NO: 3392968 - DNA, 23 bp, Homo sapiens
gcagttgggtagatgggtggggg

SEQ ID NO: 3392969 - DNA, 21 bp, Homo sapiens
gcagtttgcctggtgcagtgg

SEQ ID NO: 3392970 - DNA, 17 bp, Homo sapiens
gcagtttggtatttgcg

SEQ ID NO: 3392971 - DNA, 21 bp, Homo sapiens
gcagtttggtttatattctta

SEQ ID NO: 3392972 - DNA, 17 bp, Homo sapiens
gcagttttcaagtcaaa

SEQ ID NO: 3392973 - DNA, 12 bp, Homo sapiens
gcagtttttcag

SEQ ID NO: 3392974 - DNA, 11 bp, Homo sapiens
gcataaaacag

SEQ ID NO: 3392975 - DNA, 12 bp, Homo sapiens
gcataaaacagc

SEQ ID NO: 3392976 - DNA, 14 bp, Homo sapiens
gcataacctgtctc

SEQ ID NO: 3392977 - DNA, 22 bp, Homo sapiens
gcataactgtagctcaagttta

SEQ ID NO: 3392978 - DNA, 16 bp, Homo sapiens
gcataagattaaagga

SEQ ID NO: 3392979 - DNA, 19 bp, Homo sapiens
gcataagattaaaggaagg

SEQ ID NO: 3392980 - DNA, 18 bp, Homo sapiens
gcataataagctaaagag

SEQ ID NO: 3392981 - DNA, 16 bp, Homo sapiens
gcataatagtcaattt

SEQ ID NO: 3392982 - DNA, 18 bp, Homo sapiens
gcataatgctttggaaaa

SEQ ID NO: 3392983 - DNA, 20 bp, Homo sapiens
gcatacaagtttcattctcc

SEQ ID NO: 3392984 - DNA, 18 bp, Homo sapiens
gcatacacacatgccctc

SEQ ID NO: 3392985 - DNA, 13 bp, Homo sapiens
gcatacagttttc

SEQ ID NO: 3392986 - DNA, 19 bp, Homo sapiens
gcatacatgcaaaaagaaa

SEQ ID NO: 3392987 - DNA, 16 bp, Homo sapiens
gcatacattttctggt

SEQ ID NO: 3392988 - DNA, 14 bp, Homo sapiens
gcatactttgtatt

SEQ ID NO: 3392989 - DNA, 13 bp, Homo sapiens
gcatactttttaa

SEQ ID NO: 3392990 - DNA, 14 bp, Homo sapiens
gcatagactgaggt

SEQ ID NO: 3392991 - DNA, 12 bp, Homo sapiens
gcatagagccct

SEQ ID NO: 3392992 - DNA, 15 bp, Homo sapiens
gcatagagccctggc

SEQ ID NO: 3392993 - DNA, 17 bp, Homo sapiens
gcatagagccctggcca

SEQ ID NO: 3392994 - DNA, 23 bp, Homo sapiens
gcatagagccctggccagccctt

SEQ ID NO: 3392995 - DNA, 14 bp, Homo sapiens
gcatagcaaacaga

SEQ ID NO: 3392996 - DNA, 22 bp, Homo sapiens
gccactgcactccagcctgggc

SEQ ID NO: 3392997 - DNA, 17 bp, Homo sapiens
gccactgccaggcacct

SEQ ID NO: 3392998 - DNA, 20 bp, Homo sapiens
gccactgccaggcacctggc

SEQ ID NO: 3392999 - DNA, 18 bp, Homo sapiens
gccactgccccccgaggc

SEQ ID NO: 3393000 - DNA, 23 bp, Homo sapiens
gccactgccccccgaggctgcta

SEQ ID NO: 3393001 - DNA, 19 bp, Homo sapiens
gccactgcccgagctggtg

SEQ ID NO: 3393002 - DNA, 21 bp, Homo sapiens
gccactgcccgagctggtgca

SEQ ID NO: 3393003 - DNA, 16 bp, Homo sapiens
gccactgcctcttcct

SEQ ID NO: 3393004 - DNA, 17 bp, Homo sapiens
gccactgcctcttcctc

SEQ ID NO: 3393005 - DNA, 18 bp, Homo sapiens
gccactgctttccagcct

SEQ ID NO: 3393006 - DNA, 14 bp, Homo sapiens
gccactgtggccag

SEQ ID NO: 3393007 - DNA, 21 bp, Homo sapiens
gccacttccccctcttcttct

SEQ ID NO: 3393008 - DNA, 20 bp, Homo sapiens
gccacttcctttgtgtttat

SEQ ID NO: 3393009 - DNA, 20 bp, Homo sapiens
gccacttcttaaaggcctgg

SEQ ID NO: 3393010 - DNA, 21 bp, Homo sapiens
gccacttcttaaaggcctgga

SEQ ID NO: 3393011 - DNA, 20 bp, Homo sapiens
gccacttggtttttggctct

SEQ ID NO: 3393012 - DNA, 20 bp, Homo sapiens
gccactttacccacctagaa

SEQ ID NO: 3393013 - DNA, 22 bp, Homo sapiens
gccactttacccacctagaaca

SEQ ID NO: 3393014 - DNA, 21 bp, Homo sapiens
gccactttgactcagaggctg

SEQ ID NO: 3393015 - DNA, 23 bp, Homo sapiens
gccactttggtacatggccagtg

SEQ ID NO: 3393016 - DNA, 22 bp, Homo sapiens
gccagaaggagggcagagccat

SEQ ID NO: 3393017 - DNA, 23 bp, Homo sapiens
gccagaccaacgttactcagggc

SEQ ID NO: 3393018 - DNA, 19 bp, Homo sapiens
gccagaccttaataaaggc

SEQ ID NO: 3393019 - DNA, 19 bp, Homo sapiens
gccagacgctgccgctgcc

SEQ ID NO: 3393020 - DNA, 20 bp, Homo sapiens
gccagacgtggtggctcaca

SEQ ID NO: 3393021 - DNA, 21 bp, Homo sapiens
gccagacgtggtggctcacac

SEQ ID NO: 3393022 - DNA, 21 bp, Homo sapiens
gccagactctaggttatacaa

SEQ ID NO: 3393023 - DNA, 14 bp, Homo sapiens
gccagactggaaga

SEQ ID NO: 3393024 - DNA, 17 bp, Homo sapiens
gccagacttctggagga

SEQ ID NO: 3393025 - DNA, 23 bp, Homo sapiens
gccagagaatagatcagtatttc

SEQ ID NO: 3393026 - DNA, 18 bp, Homo sapiens
gccagagaggagcacctg

SEQ ID NO: 3393027 - DNA, 19 bp, Homo sapiens
gccagagaggagcacctga

SEQ ID NO: 3393028 - DNA, 15 bp, Homo sapiens
gccagagagggccca

SEQ ID NO: 3393029 - DNA, 17 bp, Homo sapiens
gccagagagggcccagc

SEQ ID NO: 3393030 - DNA, 24 bp, Homo sapiens
gccagagagggcccagctgtagcc

SEQ ID NO: 3393031 - DNA, 20 bp, Homo sapiens
gccagagcccttcactgcca

SEQ ID NO: 3393032 - DNA, 23 bp, Homo sapiens
gccagagcccttcactgccatga

SEQ ID NO: 3393033 - DNA, 12 bp, Homo sapiens
gccagagcctgg

SEQ ID NO: 3393034 - DNA, 16 bp, Homo sapiens
gccagagcctggggtg

SEQ ID NO: 3393035 - DNA, 17 bp, Homo sapiens
gccagagctggaaggca

SEQ ID NO: 3393036 - DNA, 21 bp, Homo sapiens
gccagagctggaaggcagggc

SEQ ID NO: 3393037 - DNA, 12 bp, Homo sapiens
gccagagctggg

SEQ ID NO: 3393038 - DNA, 14 bp, Homo sapiens
gccagagctgggtg

SEQ ID NO: 3393039 - DNA, 14 bp, Homo sapiens
gccagaggaactgt

SEQ ID NO: 3393040 - DNA, 22 bp, Homo sapiens
gccagaggaactgtccagagag

SEQ ID NO: 3393041 - DNA, 20 bp, Homo sapiens
gccagaggaatcctggcagc

SEQ ID NO: 3393042 - DNA, 21 bp, Homo sapiens
gccagaggaatcctggcagcc

SEQ ID NO: 3393043 - DNA, 16 bp, Homo sapiens
gccagaggcccccagc

SEQ ID NO: 3393044 - DNA, 19 bp, Homo sapiens
gccagaggcccccagccca

SEQ ID NO: 3393045 - DNA, 23 bp, Homo sapiens
gccagaggcccccagcccagggc

SEQ ID NO: 3393046 - DNA, 13 bp, Homo sapiens
gccagaggctggg

SEQ ID NO: 3393047 - DNA, 13 bp, Homo sapiens
gccagagggagct

SEQ ID NO: 3393048 - DNA, 17 bp, Homo sapiens
gccagagggagtgacag

SEQ ID NO: 3393049 - DNA, 19 bp, Homo sapiens
gccagagggagtgacagag

SEQ ID NO: 3393050 - DNA, 15 bp, Homo sapiens
gccagaggtgggcag

SEQ ID NO: 3393051 - DNA, 17 bp, Homo sapiens
gccagagtcctttccaa

SEQ ID NO: 3393052 - DNA, 17 bp, Homo sapiens
gccagagtggcctggcc

SEQ ID NO: 3393053 - DNA, 19 bp, Homo sapiens
gccagagtggcctggccag

SEQ ID NO: 3393054 - DNA, 23 bp, Homo sapiens
gccagagtggcctggccaggagc

SEQ ID NO: 3393055 - DNA, 24 bp, Homo sapiens
gccagagtggcctggccaggagct

SEQ ID NO: 3393056 - DNA, 18 bp, Homo sapiens
gccagagttcctgcggag

SEQ ID NO: 3393057 - DNA, 24 bp, Homo sapiens
gccagagttcctgcggagtgaaga

SEQ ID NO: 3393058 - DNA, 17 bp, Homo sapiens
gccagataaaatgttca

SEQ ID NO: 3393059 - DNA, 14 bp, Homo sapiens
gccagatcttaggt

SEQ ID NO: 3393060 - DNA, 16 bp, Homo sapiens
gccagatgatcaactc

SEQ ID NO: 3393061 - DNA, 14 bp, Homo sapiens
gccagatgcaccag

SEQ ID NO: 3393062 - DNA, 16 bp, Homo sapiens
gccagatgcaggacag

SEQ ID NO: 3393063 - DNA, 17 bp, Homo sapiens
gccagatgcaggacagg

SEQ ID NO: 3393064 - DNA, 15 bp, Homo sapiens
gccagatttgtcttt

SEQ ID NO: 3393065 - DNA, 20 bp, Homo sapiens
gccagatttgtctttttgtt

SEQ ID NO: 3393066 - DNA, 13 bp, Homo sapiens
gccagcaacgctt

SEQ ID NO: 3393067 - DNA, 22 bp, Homo sapiens
gccagcaacgcttgtagaactc

SEQ ID NO: 3393068 - DNA, 24 bp, Homo sapiens
gccagcacaggggccccagatctg

SEQ ID NO: 3393069 - DNA, 12 bp, Homo sapiens
gccagcaccctc

SEQ ID NO: 3393070 - DNA, 13 bp, Homo sapiens
gccagcaccctct

SEQ ID NO: 3393071 - DNA, 14 bp, Homo sapiens
gccagcaccctctc

SEQ ID NO: 3393072 - DNA, 18 bp, Homo sapiens
gccagcaccctctcctgg

SEQ ID NO: 3393073 - DNA, 21 bp, Homo sapiens
gccagcaccctctcctggggg

SEQ ID NO: 3393074 - DNA, 15 bp, Homo sapiens
gccagcacttgtata

SEQ ID NO: 3393075 - DNA, 16 bp, Homo sapiens
gccagcaggggggctg

SEQ ID NO: 3393076 - DNA, 19 bp, Homo sapiens
gccagcaggggggctgtgc

SEQ ID NO: 3393077 - DNA, 21 bp, Homo sapiens
gccagcaggggggctgtgcca

SEQ ID NO: 3393078 - DNA, 14 bp, Homo sapiens
gccagcattccaga

SEQ ID NO: 3393079 - DNA, 16 bp, Homo sapiens
gccagcattccagact

SEQ ID NO: 3393080 - DNA, 18 bp, Homo sapiens
gccagccaactctgggaa

SEQ ID NO: 3393081 - DNA, 22 bp, Homo sapiens
gccagccacagacccctgggag

SEQ ID NO: 3393082 - DNA, 22 bp, Homo sapiens
gccagccagtcttgcctaggcc

SEQ ID NO: 3393083 - DNA, 12 bp, Homo sapiens
gccagcccagaa

SEQ ID NO: 3393084 - DNA, 13 bp, Homo sapiens
gccagcccagaac

SEQ ID NO: 3393085 - DNA, 15 bp, Homo sapiens
gccagcccagccagg

SEQ ID NO: 3393086 - DNA, 17 bp, Homo sapiens
gccagcccatggccccc

SEQ ID NO: 3393087 - DNA, 20 bp, Homo sapiens
gccagcccatggcccccaat

SEQ ID NO: 3393088 - DNA, 22 bp, Homo sapiens
gccagccccacccccagccagg

SEQ ID NO: 3393089 - DNA, 15 bp, Homo sapiens
gccagcccctgcctg

SEQ ID NO: 3393090 - DNA, 17 bp, Homo sapiens
gccagcccctgcctggg

SEQ ID NO: 3393091 - DNA, 19 bp, Homo sapiens
gccagcccttcctctcact

SEQ ID NO: 3393092 - DNA, 18 bp, Homo sapiens
gccagccgtgatgctcag

SEQ ID NO: 3393093 - DNA, 20 bp, Homo sapiens
gccagccgtgatgctcaggc

SEQ ID NO: 3393094 - DNA, 21 bp, Homo sapiens
gccagccgtgatgctcaggct

SEQ ID NO: 3393095 - DNA, 16 bp, Homo sapiens
gccagcctagcccttg

SEQ ID NO: 3393096 - DNA, 15 bp, Homo sapiens
gccagcctcctctgg

SEQ ID NO: 3393097 - DNA, 22 bp, Homo sapiens
gccagcctgaccttccttcctg

SEQ ID NO: 3393098 - DNA, 19 bp, Homo sapiens
gccagcctggcttctggag

SEQ ID NO: 3393099 - DNA, 21 bp, Homo sapiens
gccagcctggcttctggagcc

SEQ ID NO: 3393100 - DNA, 13 bp, Homo sapiens
gccagcctgggac

SEQ ID NO: 3393101 - DNA, 21 bp, Homo sapiens
gccagcctgggactcccagtg

SEQ ID NO: 3393102 - DNA, 14 bp, Homo sapiens
gccagcctggggcc

SEQ ID NO: 3393103 - DNA, 15 bp, Homo sapiens
gccagcctggggcct

SEQ ID NO: 3393104 - DNA, 18 bp, Homo sapiens
gccagcctggggcctggc

SEQ ID NO: 3393105 - DNA, 19 bp, Homo sapiens
gccagcctggggcctggca

SEQ ID NO: 3393106 - DNA, 21 bp, Homo sapiens
gccagccttcttccatcccag

SEQ ID NO: 3393107 - DNA, 14 bp, Homo sapiens
gccagcgggcacag

SEQ ID NO: 3393108 - DNA, 17 bp, Homo sapiens
gccagcgggcacagggc

SEQ ID NO: 3393109 - DNA, 19 bp, Homo sapiens
gccagctgcagctgggctg

SEQ ID NO: 3393110 - DNA, 13 bp, Homo sapiens
gccagctgccttc

SEQ ID NO: 3393111 - DNA, 15 bp, Homo sapiens
gccagctgccttcct

SEQ ID NO: 3393112 - DNA, 22 bp, Homo sapiens
gccagctgccttcctcatcccc

SEQ ID NO: 3393113 - DNA, 12 bp, Homo sapiens
gccagctgtgca

SEQ ID NO: 3393114 - DNA, 14 bp, Homo sapiens
gccagctgtgcact

SEQ ID NO: 3393115 - DNA, 15 bp, Homo sapiens
gccagcttctcctgc

SEQ ID NO: 3393116 - DNA, 21 bp, Homo sapiens
gccagcttctcctgcgccccg

SEQ ID NO: 3393117 - DNA, 18 bp, Homo sapiens
gccagcttgttatttata

SEQ ID NO: 3393118 - DNA, 15 bp, Homo sapiens
gccagctttccctgc

SEQ ID NO: 3393119 - DNA, 23 bp, Homo sapiens
gccaggaaggacagactggccgg

SEQ ID NO: 3393120 - DNA, 23 bp, Homo sapiens
gccccagagctgtttatggcctc

SEQ ID NO: 3393121 - DNA, 14 bp, Homo sapiens
gccccagaggccct

SEQ ID NO: 3393122 - DNA, 19 bp, Homo sapiens
gccccagataccagcccct

SEQ ID NO: 3393123 - DNA, 19 bp, Homo sapiens
gccccagatcaccagcccg

SEQ ID NO: 3393124 - DNA, 19 bp, Homo sapiens
gccccagatctgcctgggc

SEQ ID NO: 3393125 - DNA, 15 bp, Homo sapiens
gccccagcagccctc

SEQ ID NO: 3393126 - DNA, 16 bp, Homo sapiens
gccccagcagccctca

SEQ ID NO: 3393127 - DNA, 12 bp, Homo sapiens
gccccagccaga

SEQ ID NO: 3393128 - DNA, 12 bp, Homo sapiens
gccccagcccaa

SEQ ID NO: 3393129 - DNA, 15 bp, Homo sapiens
gccccagcccaagtc

SEQ ID NO: 3393130 - DNA, 21 bp, Homo sapiens
gccccagccccttctcccagc

SEQ ID NO: 3393131 - DNA, 12 bp, Homo sapiens
gccccagcccga

SEQ ID NO: 3393132 - DNA, 17 bp, Homo sapiens
gccccaggccctccctg

SEQ ID NO: 3393133 - DNA, 15 bp, Homo sapiens
gccccaggcctgaaa

SEQ ID NO: 3393134 - DNA, 13 bp, Homo sapiens
gccccagggcctg

SEQ ID NO: 3393135 - DNA, 16 bp, Homo sapiens
gccccagggctaccct

SEQ ID NO: 3393136 - DNA, 17 bp, Homo sapiens
gccccaggggggcctcc

SEQ ID NO: 3393137 - DNA, 19 bp, Homo sapiens
gccccaggggggcctcctc

SEQ ID NO: 3393138 - DNA, 21 bp, Homo sapiens
gccccagggtcttccctacct

SEQ ID NO: 3393139 - DNA, 17 bp, Homo sapiens
gccccagtgcccacagg

SEQ ID NO: 3393140 - DNA, 21 bp, Homo sapiens
gccccataattttttttttcc

SEQ ID NO: 3393141 - DNA, 22 bp, Homo sapiens
gccccatccaaccactgtacac

SEQ ID NO: 3393142 - DNA, 20 bp, Homo sapiens
gccccatcctcatccctgac

SEQ ID NO: 3393143 - DNA, 18 bp, Homo sapiens
gccccatctcatcctggc

SEQ ID NO: 3393144 - DNA, 20 bp, Homo sapiens
gccccatgcctgtccagcct

SEQ ID NO: 3393145 - DNA, 14 bp, Homo sapiens
gccccatgctctgc

SEQ ID NO: 3393146 - DNA, 16 bp, Homo sapiens
gccccatgctctgccc

SEQ ID NO: 3393147 - DNA, 17 bp, Homo sapiens
gccccatgctctgcccc

SEQ ID NO: 3393148 - DNA, 18 bp, Homo sapiens
gccccatgctctgcccca

SEQ ID NO: 3393149 - DNA, 20 bp, Homo sapiens
gccccatgctctgccccaag

SEQ ID NO: 3393150 - DNA, 21 bp, Homo sapiens
gccccattctgcctgcccagg

SEQ ID NO: 3393151 - DNA, 19 bp, Homo sapiens
gcccccaacactccaggcc

SEQ ID NO: 3393152 - DNA, 17 bp, Homo sapiens
gcccccaacctcagggc

SEQ ID NO: 3393153 - DNA, 15 bp, Homo sapiens
gcccccaataaaggc

SEQ ID NO: 3393154 - DNA, 20 bp, Homo sapiens
gcccccaataaaggcagctg

SEQ ID NO: 3393155 - DNA, 17 bp, Homo sapiens
gcccccaccccggggac

SEQ ID NO: 3393156 - DNA, 19 bp, Homo sapiens
gcccccaccccttccccag

SEQ ID NO: 3393157 - DNA, 20 bp, Homo sapiens
gcccccaccccttccccagg

SEQ ID NO: 3393158 - DNA, 14 bp, Homo sapiens
gcccccacctctgg

SEQ ID NO: 3393159 - DNA, 14 bp, Homo sapiens
gcccccacttgcct

SEQ ID NO: 3393160 - DNA, 16 bp, Homo sapiens
gcccccacttgcctct

SEQ ID NO: 3393161 - DNA, 17 bp, Homo sapiens
gcccccacttgcctctt

SEQ ID NO: 3393162 - DNA, 19 bp, Homo sapiens
gcccccagatagagctggg

SEQ ID NO: 3393163 - DNA, 21 bp, Homo sapiens
gcccccagatagagctgggtg

SEQ ID NO: 3393164 - DNA, 13 bp, Homo sapiens
gcccccagcccaa

SEQ ID NO: 3393165 - DNA, 22 bp, Homo sapiens
gcccccagcccagggctcctgc

SEQ ID NO: 3393166 - DNA, 20 bp, Homo sapiens
gcccccagccccggggtgag

SEQ ID NO: 3393167 - DNA, 16 bp, Homo sapiens
gcccccagccctggga

SEQ ID NO: 3393168 - DNA, 17 bp, Homo sapiens
gcccccagccctgggaa

SEQ ID NO: 3393169 - DNA, 18 bp, Homo sapiens
gcccccagccctgggaac

SEQ ID NO: 3393170 - DNA, 14 bp, Homo sapiens
gcccccagcctatg

SEQ ID NO: 3393171 - DNA, 23 bp, Homo sapiens
gcccccagcctatgagcatcctg

SEQ ID NO: 3393172 - DNA, 13 bp, Homo sapiens
gcccccaggccag

SEQ ID NO: 3393173 - DNA, 15 bp, Homo sapiens
gcccccaggccaggt

SEQ ID NO: 3393174 - DNA, 19 bp, Homo sapiens
gcccccaggggcaggactg

SEQ ID NO: 3393175 - DNA, 15 bp, Homo sapiens
gcccccagtccccac

SEQ ID NO: 3393176 - DNA, 16 bp, Homo sapiens
gcccccatctccccag

SEQ ID NO: 3393177 - DNA, 19 bp, Homo sapiens
gcccccatctccccaggcc

SEQ ID NO: 3393178 - DNA, 21 bp, Homo sapiens
gcccccatctccccaggcctc

SEQ ID NO: 3393179 - DNA, 23 bp, Homo sapiens
gcccccatctccccaggcctcca

SEQ ID NO: 3393180 - DNA, 19 bp, Homo sapiens
gccccccagccccggtggc

SEQ ID NO: 3393181 - DNA, 13 bp, Homo sapiens
gccccccagctca

SEQ ID NO: 3393182 - DNA, 22 bp, Homo sapiens
gcccccccaacactgtgccctg

SEQ ID NO: 3393183 - DNA, 13 bp, Homo sapiens
gccccccctaaga

SEQ ID NO: 3393184 - DNA, 17 bp, Homo sapiens
gccccccgcacagccac

SEQ ID NO: 3393185 - DNA, 19 bp, Homo sapiens
gccccccgcacagccaccc

SEQ ID NO: 3393186 - DNA, 19 bp, Homo sapiens
gccccccgcgctcgcccag

SEQ ID NO: 3393187 - DNA, 11 bp, Homo sapiens
gcccccctcaa

SEQ ID NO: 3393188 - DNA, 14 bp, Homo sapiens
gcccccgaactgtg

SEQ ID NO: 3393189 - DNA, 19 bp, Homo sapiens
gcccccgaactgtgccttc

SEQ ID NO: 3393190 - DNA, 15 bp, Homo sapiens
gcccccgcccccacc

SEQ ID NO: 3393191 - DNA, 18 bp, Homo sapiens
gcccccgcgatgccctgg

SEQ ID NO: 3393192 - DNA, 16 bp, Homo sapiens
gccccctccctggatg

SEQ ID NO: 3393193 - DNA, 16 bp, Homo sapiens
gccccctccgccctgc

SEQ ID NO: 3393194 - DNA, 18 bp, Homo sapiens
gccccctccgccctgcca

SEQ ID NO: 3393195 - DNA, 21 bp, Homo sapiens
gccccctccgtgatccatcca

SEQ ID NO: 3393196 - DNA, 16 bp, Homo sapiens
gccccctcctctagct

SEQ ID NO: 3393197 - DNA, 15 bp, Homo sapiens
gccccctcctctccc

SEQ ID NO: 3393198 - DNA, 16 bp, Homo sapiens
gccccctcctctccca

SEQ ID NO: 3393199 - DNA, 21 bp, Homo sapiens
gccccctcctctcccatcccc

SEQ ID NO: 3393200 - DNA, 13 bp, Homo sapiens
gccccctcctgaa

SEQ ID NO: 3393201 - DNA, 12 bp, Homo sapiens
gccccctctcgg

SEQ ID NO: 3393202 - DNA, 14 bp, Homo sapiens
gccccctgcccccc

SEQ ID NO: 3393203 - DNA, 18 bp, Homo sapiens
gccccctgccccccagcc

SEQ ID NO: 3393204 - DNA, 13 bp, Homo sapiens
gccccctggatgg

SEQ ID NO: 3393205 - DNA, 17 bp, Homo sapiens
gccccctggcctctgtg

SEQ ID NO: 3393206 - DNA, 19 bp, Homo sapiens
gccccctggcctctgtgcc

SEQ ID NO: 3393207 - DNA, 23 bp, Homo sapiens
gccccctggtggacagtcctggg

SEQ ID NO: 3393208 - DNA, 15 bp, Homo sapiens
gcccccttgccctcc

SEQ ID NO: 3393209 - DNA, 19 bp, Homo sapiens
gcccccttgccctccgcct

SEQ ID NO: 3393210 - DNA, 17 bp, Homo sapiens
gccccgccagggctggg

SEQ ID NO: 3393211 - DNA, 17 bp, Homo sapiens
gccccgcccacaccctc

SEQ ID NO: 3393212 - DNA, 18 bp, Homo sapiens
gccccgcccacaccctcg

SEQ ID NO: 3393213 - DNA, 13 bp, Homo sapiens
gccccgccctcag

SEQ ID NO: 3393214 - DNA, 16 bp, Homo sapiens
gccccgccctcttcct

SEQ ID NO: 3393215 - DNA, 18 bp, Homo sapiens
gccccgccctcttcctga

SEQ ID NO: 3393216 - DNA, 16 bp, Homo sapiens
gccccgccttcctggg

SEQ ID NO: 3393217 - DNA, 13 bp, Homo sapiens
gccccgctcaggc

SEQ ID NO: 3393218 - DNA, 16 bp, Homo sapiens
gccccggatcagagca

SEQ ID NO: 3393219 - DNA, 17 bp, Homo sapiens
gccccggatcagagcag

SEQ ID NO: 3393220 - DNA, 23 bp, Homo sapiens
gccccggatcagagcaggacctc

SEQ ID NO: 3393221 - DNA, 14 bp, Homo sapiens
gccccggccacctc

SEQ ID NO: 3393222 - DNA, 17 bp, Homo sapiens
gccccggccacctctgc

SEQ ID NO: 3393223 - DNA, 14 bp, Homo sapiens
gccccggcctcctc

SEQ ID NO: 3393224 - DNA, 18 bp, Homo sapiens
gccccgggacccacggag

SEQ ID NO: 3393225 - DNA, 19 bp, Homo sapiens
gccccgggcaaagggtctt

SEQ ID NO: 3393226 - DNA, 15 bp, Homo sapiens
gccccgggctggaga

SEQ ID NO: 3393227 - DNA, 19 bp, Homo sapiens
gccccgggctggagaaaga

SEQ ID NO: 3393228 - DNA, 15 bp, Homo sapiens
gccccggggctggca

SEQ ID NO: 3393229 - DNA, 16 bp, Homo sapiens
gccccggggctggcaa

SEQ ID NO: 3393230 - DNA, 17 bp, Homo sapiens
gccccggggctggcaag

SEQ ID NO: 3393231 - DNA, 19 bp, Homo sapiens
gccccggggctggcaagca

SEQ ID NO: 3393232 - DNA, 18 bp, Homo sapiens
gccccggtcacctagcaa

SEQ ID NO: 3393233 - DNA, 13 bp, Homo sapiens
gcccctagcccag

SEQ ID NO: 3393234 - DNA, 15 bp, Homo sapiens
gcccctagcccagga

SEQ ID NO: 3393235 - DNA, 20 bp, Homo sapiens
gcccctagcccaggagagag

SEQ ID NO: 3393236 - DNA, 19 bp, Homo sapiens
gcccctaggatgctgcagc

SEQ ID NO: 3393237 - DNA, 20 bp, Homo sapiens
gcccctaggatgctgcagca

SEQ ID NO: 3393238 - DNA, 18 bp, Homo sapiens
gcccctcaacagccaagt

SEQ ID NO: 3393239 - DNA, 16 bp, Homo sapiens
gcccctcaacctcctg

SEQ ID NO: 3393240 - DNA, 18 bp, Homo sapiens
gcccctcaccctgcctta

SEQ ID NO: 3393241 - DNA, 12 bp, Homo sapiens
gcccctcagagc

SEQ ID NO: 3393242 - DNA, 22 bp, Homo sapiens
gcccctcagagccctgccctgc

SEQ ID NO: 3393243 - DNA, 23 bp, Homo sapiens
gcccctcagagccctgccctgca

SEQ ID NO: 3393244 - DNA, 15 bp, Homo sapiens
gcccctcagcccttg

SEQ ID NO: 3393245 - DNA, 16 bp, Homo sapiens
gcccctcagcccttgc

SEQ ID NO: 3393246 - DNA, 18 bp, Homo sapiens
gcctccgtcccctgccca

SEQ ID NO: 3393247 - DNA, 21 bp, Homo sapiens
gcctccgtttatgggccttgc

SEQ ID NO: 3393248 - DNA, 14 bp, Homo sapiens
gcctcctcaccccc

SEQ ID NO: 3393249 - DNA, 17 bp, Homo sapiens
gcctcctcacccccagc

SEQ ID NO: 3393250 - DNA, 21 bp, Homo sapiens
gcctcctcacccccagctttg

SEQ ID NO: 3393251 - DNA, 15 bp, Homo sapiens
gcctcctcatcccgt

SEQ ID NO: 3393252 - DNA, 11 bp, Homo sapiens
gcctcctcccc

SEQ ID NO: 3393253 - DNA, 13 bp, Homo sapiens
gcctcctccccca

SEQ ID NO: 3393254 - DNA, 17 bp, Homo sapiens
gcctcctcggagagcag

SEQ ID NO: 3393255 - DNA, 22 bp, Homo sapiens
gcctcctcggagagcagcagca

SEQ ID NO: 3393256 - DNA, 21 bp, Homo sapiens
gcctcctcggggctccaggct

SEQ ID NO: 3393257 - DNA, 19 bp, Homo sapiens
gcctcctcgttcctttctc

SEQ ID NO: 3393258 - DNA, 17 bp, Homo sapiens
gcctcctcttcaccccg

SEQ ID NO: 3393259 - DNA, 21 bp, Homo sapiens
gcctcctcttcaccccggcag

SEQ ID NO: 3393260 - DNA, 12 bp, Homo sapiens
gcctcctgccca

SEQ ID NO: 3393261 - DNA, 11 bp, Homo sapiens
gcctcctggcc

SEQ ID NO: 3393262 - DNA, 15 bp, Homo sapiens
gcctcctggccagac

SEQ ID NO: 3393263 - DNA, 16 bp, Homo sapiens
gcctcctggccagacg

SEQ ID NO: 3393264 - DNA, 17 bp, Homo sapiens
gcctcctgggaagatga

SEQ ID NO: 3393265 - DNA, 19 bp, Homo sapiens
gcctcctgtacctcagtgg

SEQ ID NO: 3393266 - DNA, 18 bp, Homo sapiens
gcctcctgtgtactgtgt

SEQ ID NO: 3393267 - DNA, 23 bp, Homo sapiens
gcctcctgtgtgtgcgcctacag

SEQ ID NO: 3393268 - DNA, 17 bp, Homo sapiens
gcctccttccacctccc

SEQ ID NO: 3393269 - DNA, 15 bp, Homo sapiens
gcctccttcccatgc

SEQ ID NO: 3393270 - DNA, 17 bp, Homo sapiens
gcctccttcccatgcct

SEQ ID NO: 3393271 - DNA, 18 bp, Homo sapiens
gcctccttcccatgcctg

SEQ ID NO: 3393272 - DNA, 19 bp, Homo sapiens
gcctccttcccatgcctgt

SEQ ID NO: 3393273 - DNA, 16 bp, Homo sapiens
gcctcgaaacacagaa

SEQ ID NO: 3393274 - DNA, 21 bp, Homo sapiens
gcctcgaggcaccggcgctgc

SEQ ID NO: 3393275 - DNA, 22 bp, Homo sapiens
gcctcgggacacctgccctgcc

SEQ ID NO: 3393276 - DNA, 14 bp, Homo sapiens
gcctcgtgaggggc

SEQ ID NO: 3393277 - DNA, 15 bp, Homo sapiens
gcctcgtgaggggca

SEQ ID NO: 3393278 - DNA, 13 bp, Homo sapiens
gcctcgtgccatg

SEQ ID NO: 3393279 - DNA, 22 bp, Homo sapiens
gcctcgtggttattagcaaggc

SEQ ID NO: 3393280 - DNA, 18 bp, Homo sapiens
gcctctccccaggtccag

SEQ ID NO: 3393281 - DNA, 20 bp, Homo sapiens
gcctctccccaggtccagct

SEQ ID NO: 3393282 - DNA, 14 bp, Homo sapiens
gcctctcccggctg

SEQ ID NO: 3393283 - DNA, 17 bp, Homo sapiens
gcctctcccggctgcct

SEQ ID NO: 3393284 - DNA, 19 bp, Homo sapiens
gcctctcccgtcagggccc

SEQ ID NO: 3393285 - DNA, 20 bp, Homo sapiens
gcctctctcaggagtatctt

SEQ ID NO: 3393286 - DNA, 13 bp, Homo sapiens
gcctctctccctc

SEQ ID NO: 3393287 - DNA, 14 bp, Homo sapiens
gcctctctccctct

SEQ ID NO: 3393288 - DNA, 12 bp, Homo sapiens
gcctctctggcc

SEQ ID NO: 3393289 - DNA, 15 bp, Homo sapiens
gcctctctggcctcc

SEQ ID NO: 3393290 - DNA, 14 bp, Homo sapiens
gcctctcttttccc

SEQ ID NO: 3393291 - DNA, 15 bp, Homo sapiens
gcctctcttttcccc

SEQ ID NO: 3393292 - DNA, 18 bp, Homo sapiens
gcctctcttttccccgcc

SEQ ID NO: 3393293 - DNA, 17 bp, Homo sapiens
gcctctgacccctcctc

SEQ ID NO: 3393294 - DNA, 19 bp, Homo sapiens
gcctctgacccctcctcac

SEQ ID NO: 3393295 - DNA, 17 bp, Homo sapiens
gcctctgagcccaagct

SEQ ID NO: 3393296 - DNA, 19 bp, Homo sapiens
gcctctgagcccaagctaa

SEQ ID NO: 3393297 - DNA, 17 bp, Homo sapiens
gcctctgatatgggact

SEQ ID NO: 3393298 - DNA, 21 bp, Homo sapiens
gcctctgcacaccctccagag

SEQ ID NO: 3393299 - DNA, 21 bp, Homo sapiens
gcctctgcactcccacgcctg

SEQ ID NO: 3393300 - DNA, 23 bp, Homo sapiens
gcctctgccaaaggatgtgatat

SEQ ID NO: 3393301 - DNA, 18 bp, Homo sapiens
gcctctgcccctcccaac

SEQ ID NO: 3393302 - DNA, 13 bp, Homo sapiens
gcctctgcctgtc

SEQ ID NO: 3393303 - DNA, 15 bp, Homo sapiens
gcctctgccttagag

SEQ ID NO: 3393304 - DNA, 14 bp, Homo sapiens
gcctctggaggcct

SEQ ID NO: 3393305 - DNA, 20 bp, Homo sapiens
gcctctggaggcctctggcc

SEQ ID NO: 3393306 - DNA, 12 bp, Homo sapiens
gcctctggccag

SEQ ID NO: 3393307 - DNA, 14 bp, Homo sapiens
gcctctggccgcca

SEQ ID NO: 3393308 - DNA, 21 bp, Homo sapiens
gcctctggctagaggccagcc

SEQ ID NO: 3393309 - DNA, 15 bp, Homo sapiens
gcctctggctccaca

SEQ ID NO: 3393310 - DNA, 14 bp, Homo sapiens
gcctctgtgctgtg

SEQ ID NO: 3393311 - DNA, 15 bp, Homo sapiens
gcctcttcagcccct

SEQ ID NO: 3393312 - DNA, 13 bp, Homo sapiens
gcctcttccaccc

SEQ ID NO: 3393313 - DNA, 15 bp, Homo sapiens
gcctcttcttcttca

SEQ ID NO: 3393314 - DNA, 16 bp, Homo sapiens
gcctcttcttcttcag

SEQ ID NO: 3393315 - DNA, 20 bp, Homo sapiens
gcctcttcttcttcagaaga

SEQ ID NO: 3393316 - DNA, 21 bp, Homo sapiens
gcctcttcttcttcagaagac

SEQ ID NO: 3393317 - DNA, 18 bp, Homo sapiens
gcctcttgagcagtggct

SEQ ID NO: 3393318 - DNA, 19 bp, Homo sapiens
gcctcttgagcagtggctg

SEQ ID NO: 3393319 - DNA, 14 bp, Homo sapiens
gcctcttgggttca

SEQ ID NO: 3393320 - DNA, 16 bp, Homo sapiens
gcctcttgtgctcacg

SEQ ID NO: 3393321 - DNA, 17 bp, Homo sapiens
gcctcttgtgctcacgc

SEQ ID NO: 3393322 - DNA, 12 bp, Homo sapiens
gcctctttccct

SEQ ID NO: 3393323 - DNA, 16 bp, Homo sapiens
gcctcttttcacattt

SEQ ID NO: 3393324 - DNA, 18 bp, Homo sapiens
gcctcttttccctctcta

SEQ ID NO: 3393325 - DNA, 18 bp, Homo sapiens
gcctcttttctctgtgct

SEQ ID NO: 3393326 - DNA, 23 bp, Homo sapiens
gcctgaaagaggctgaggcctgg

SEQ ID NO: 3393327 - DNA, 13 bp, Homo sapiens
gcctgaaagcaac

SEQ ID NO: 3393328 - DNA, 14 bp, Homo sapiens
gcctgaactgagga

SEQ ID NO: 3393329 - DNA, 20 bp, Homo sapiens
gcctgacaaccactggtctg

SEQ ID NO: 3393330 - DNA, 21 bp, Homo sapiens
gcctgacaaccactggtctgt

SEQ ID NO: 3393331 - DNA, 20 bp, Homo sapiens
gcctgacactgagccccacc

SEQ ID NO: 3393332 - DNA, 15 bp, Homo sapiens
gcctgacagaaacca

SEQ ID NO: 3393333 - DNA, 16 bp, Homo sapiens
gcctgacctgagactg

SEQ ID NO: 3393334 - DNA, 19 bp, Homo sapiens
gcctgagagaattggctca

SEQ ID NO: 3393335 - DNA, 14 bp, Homo sapiens
gcctgagaggcagg

SEQ ID NO: 3393336 - DNA, 15 bp, Homo sapiens
gcctgagaggcaggc

SEQ ID NO: 3393337 - DNA, 21 bp, Homo sapiens
gcctgagcaacatctcgggag

SEQ ID NO: 3393338 - DNA, 18 bp, Homo sapiens
gcctgagcaactcttgat

SEQ ID NO: 3393339 - DNA, 10 bp, Homo sapiens
gcctgagcct

SEQ ID NO: 3393340 - DNA, 20 bp, Homo sapiens
gcctgagccttagctcccag

SEQ ID NO: 3393341 - DNA, 13 bp, Homo sapiens
gcctgaggctgag

SEQ ID NO: 3393342 - DNA, 19 bp, Homo sapiens
gcctgagtcagggcccaga

SEQ ID NO: 3393343 - DNA, 14 bp, Homo sapiens
gcctgagtcctggt

SEQ ID NO: 3393344 - DNA, 16 bp, Homo sapiens
gcctgagtcctggtcc

SEQ ID NO: 3393345 - DNA, 23 bp, Homo sapiens
gcctgagtcctggtccctctgag

SEQ ID NO: 3393346 - DNA, 15 bp, Homo sapiens
gcctgagtctcctgt

SEQ ID NO: 3393347 - DNA, 20 bp, Homo sapiens
gcctgatgagatttttaaaa

SEQ ID NO: 3393348 - DNA, 19 bp, Homo sapiens
gcctgatgctccctcccct

SEQ ID NO: 3393349 - DNA, 17 bp, Homo sapiens
gcctgatgctgccccgt

SEQ ID NO: 3393350 - DNA, 13 bp, Homo sapiens
gcctgatggccaa

SEQ ID NO: 3393351 - DNA, 19 bp, Homo sapiens
gcctgatggccaagggggt

SEQ ID NO: 3393352 - DNA, 12 bp, Homo sapiens
gcctgcaccagg

SEQ ID NO: 3393353 - DNA, 13 bp, Homo sapiens
gcctgcaccagga

SEQ ID NO: 3393354 - DNA, 15 bp, Homo sapiens
gcctgcaccaggaga

SEQ ID NO: 3393355 - DNA, 16 bp, Homo sapiens
gcctgcaccaggagac

SEQ ID NO: 3393356 - DNA, 21 bp, Homo sapiens
gcctgcaccaggagacagaca

SEQ ID NO: 3393357 - DNA, 14 bp, Homo sapiens
gcctgcaggggagc

SEQ ID NO: 3393358 - DNA, 19 bp, Homo sapiens
gcctgcagtcttctgggct

SEQ ID NO: 3393359 - DNA, 20 bp, Homo sapiens
gcctgcagtcttctgggctg

SEQ ID NO: 3393360 - DNA, 23 bp, Homo sapiens
gcctgcatcccaggatgctgggt

SEQ ID NO: 3393361 - DNA, 16 bp, Homo sapiens
gcctgccatgggccag

SEQ ID NO: 3393362 - DNA, 17 bp, Homo sapiens
gcctgccatgggccagc

SEQ ID NO: 3393363 - DNA, 21 bp, Homo sapiens
gcctgccatgggccagcctag

SEQ ID NO: 3393364 - DNA, 18 bp, Homo sapiens
gcctgcccaatgctttgg

SEQ ID NO: 3393365 - DNA, 13 bp, Homo sapiens
gcctgcccaggcc

SEQ ID NO: 3393366 - DNA, 19 bp, Homo sapiens
gcctgcccaggcccctgcc

SEQ ID NO: 3393367 - DNA, 19 bp, Homo sapiens
gcctgccccacccacccca

SEQ ID NO: 3393368 - DNA, 21 bp, Homo sapiens
gcctgccccgcccccagtccc

SEQ ID NO: 3393369 - DNA, 15 bp, Homo sapiens
gcctgcccgcacagc

SEQ ID NO: 3393370 - DNA, 19 bp, Homo sapiens
gcctgcccgcacagcagcc

SEQ ID NO: 3393371 - DNA, 21 bp, Homo sapiens
gcctgcccgcacagcagcctg

SEQ ID NO: 3393372 - DNA, 12 bp, Homo sapiens
gcggccccagga

SEQ ID NO: 3393373 - DNA, 13 bp, Homo sapiens
gcggccccaggag

SEQ ID NO: 3393374 - DNA, 13 bp, Homo sapiens
gcggcccggccag

SEQ ID NO: 3393375 - DNA, 15 bp, Homo sapiens
gcggcccggccagcg

SEQ ID NO: 3393376 - DNA, 12 bp, Homo sapiens
gcggcctccaca

SEQ ID NO: 3393377 - DNA, 20 bp, Homo sapiens
gcggcctcccgaggaggggc

SEQ ID NO: 3393378 - DNA, 13 bp, Homo sapiens
gcggcgccctgga

SEQ ID NO: 3393379 - DNA, 15 bp, Homo sapiens
gcggcgccctggact

SEQ ID NO: 3393380 - DNA, 19 bp, Homo sapiens
gcggcgtggagactggcag

SEQ ID NO: 3393381 - DNA, 21 bp, Homo sapiens
gcggcgtggagactggcaggc

SEQ ID NO: 3393382 - DNA, 22 bp, Homo sapiens
gcggcgtggagactggcaggcg

SEQ ID NO: 3393383 - DNA, 22 bp, Homo sapiens
gcggctcaaaaggaaaccaagt

SEQ ID NO: 3393384 - DNA, 18 bp, Homo sapiens
gcggctgctcgcccagga

SEQ ID NO: 3393385 - DNA, 13 bp, Homo sapiens
gcggctggctctg

SEQ ID NO: 3393386 - DNA, 14 bp, Homo sapiens
gcggctgttccccc

SEQ ID NO: 3393387 - DNA, 19 bp, Homo sapiens
gcggcttcctgtccactct

SEQ ID NO: 3393388 - DNA, 20 bp, Homo sapiens
gcggcttcctgtccactctc

SEQ ID NO: 3393389 - DNA, 22 bp, Homo sapiens
gcggcttcctgtccactctcgg

SEQ ID NO: 3393390 - DNA, 21 bp, Homo sapiens
gcgggagacagcttctctgca

SEQ ID NO: 3393391 - DNA, 18 bp, Homo sapiens
gcgggagcggtggccctg

SEQ ID NO: 3393392 - DNA, 22 bp, Homo sapiens
gcgggaggatgttctgggacac

SEQ ID NO: 3393393 - DNA, 13 bp, Homo sapiens
gcgggaggcacca

SEQ ID NO: 3393394 - DNA, 13 bp, Homo sapiens
gcgggaggccctg

SEQ ID NO: 3393395 - DNA, 14 bp, Homo sapiens
gcgggaggccctgg

SEQ ID NO: 3393396 - DNA, 19 bp, Homo sapiens
gcgggaggccctggccctt

SEQ ID NO: 3393397 - DNA, 13 bp, Homo sapiens
gcgggagggggcg

SEQ ID NO: 3393398 - DNA, 16 bp, Homo sapiens
gcgggatgggccaccg

SEQ ID NO: 3393399 - DNA, 15 bp, Homo sapiens
gcgggatggtcctgg

SEQ ID NO: 3393400 - DNA, 15 bp, Homo sapiens
gcgggcacagggcac

SEQ ID NO: 3393401 - DNA, 18 bp, Homo sapiens
gcgggcacagggcaccag

SEQ ID NO: 3393402 - DNA, 23 bp, Homo sapiens
gcgggcacagggcaccagaggcc

SEQ ID NO: 3393403 - DNA, 15 bp, Homo sapiens
gcgggcagagggctg

SEQ ID NO: 3393404 - DNA, 13 bp, Homo sapiens
gcgggcagcgggc

SEQ ID NO: 3393405 - DNA, 17 bp, Homo sapiens
gcgggcagcgggccagg

SEQ ID NO: 3393406 - DNA, 18 bp, Homo sapiens
gcgggcaggttctgcctg

SEQ ID NO: 3393407 - DNA, 16 bp, Homo sapiens
gcgggccagccaggcg

SEQ ID NO: 3393408 - DNA, 21 bp, Homo sapiens
gcgggccagccaggcgggctc

SEQ ID NO: 3393409 - DNA, 19 bp, Homo sapiens
gcgggcccaggcctacctc

SEQ ID NO: 3393410 - DNA, 15 bp, Homo sapiens
gcgggcgccatcttc

SEQ ID NO: 3393411 - DNA, 15 bp, Homo sapiens
gcgggcgcgtgagtg

SEQ ID NO: 3393412 - DNA, 19 bp, Homo sapiens
gcgggctaacgggaggctg

SEQ ID NO: 3393413 - DNA, 17 bp, Homo sapiens
gcgggctccctggcagg

SEQ ID NO: 3393414 - DNA, 19 bp, Homo sapiens
gcgggcttatttattaaca

SEQ ID NO: 3393415 - DNA, 22 bp, Homo sapiens
gcgggcttttctggggcccagg

SEQ ID NO: 3393416 - DNA, 12 bp, Homo sapiens
gcggggacagct

SEQ ID NO: 3393417 - DNA, 13 bp, Homo sapiens
gcggggacagctc

SEQ ID NO: 3393418 - DNA, 18 bp, Homo sapiens
gcggggacagctccttct

SEQ ID NO: 3393419 - DNA, 12 bp, Homo sapiens
gcggggcccagg

SEQ ID NO: 3393420 - DNA, 18 bp, Homo sapiens
gcggggcgaagcccaggc

SEQ ID NO: 3393421 - DNA, 20 bp, Homo sapiens
gcggggcgaagcccaggccc

SEQ ID NO: 3393422 - DNA, 18 bp, Homo sapiens
gcggggctcgaggctggt

SEQ ID NO: 3393423 - DNA, 18 bp, Homo sapiens
gcggggggggcgcctgga

SEQ ID NO: 3393424 - DNA, 14 bp, Homo sapiens
gcgggtctgaagga

SEQ ID NO: 3393425 - DNA, 19 bp, Homo sapiens
gcgggtggatcacctgagg

SEQ ID NO: 3393426 - DNA, 17 bp, Homo sapiens
gcggtcaggctgggcag

SEQ ID NO: 3393427 - DNA, 21 bp, Homo sapiens
gcggtcaggctgggcagcccc

SEQ ID NO: 3393428 - DNA, 14 bp, Homo sapiens
gcggtccacccagg

SEQ ID NO: 3393429 - DNA, 19 bp, Homo sapiens
gcggtccacccaggagccc

SEQ ID NO: 3393430 - DNA, 20 bp, Homo sapiens
gcggtccacccaggagcccc

SEQ ID NO: 3393431 - DNA, 23 bp, Homo sapiens
gcggtccacccaggagccccgag

SEQ ID NO: 3393432 - DNA, 19 bp, Homo sapiens
gcggtccccatccccacca

SEQ ID NO: 3393433 - DNA, 20 bp, Homo sapiens
gcggtccccatccccaccag

SEQ ID NO: 3393434 - DNA, 13 bp, Homo sapiens
gcggtgctctggc

SEQ ID NO: 3393435 - DNA, 21 bp, Homo sapiens
gcggtgctctggcggcttcct

SEQ ID NO: 3393436 - DNA, 18 bp, Homo sapiens
gcggtggactgcgctgga

SEQ ID NO: 3393437 - DNA, 15 bp, Homo sapiens
gcggtggctcacgcc

SEQ ID NO: 3393438 - DNA, 16 bp, Homo sapiens
gcggtggggagagatg

SEQ ID NO: 3393439 - DNA, 18 bp, Homo sapiens
gcggttataaaaaatggt

SEQ ID NO: 3393440 - DNA, 22 bp, Homo sapiens
gcggtttaaccacattaattaa

SEQ ID NO: 3393441 - DNA, 20 bp, Homo sapiens
gcgtagcgtgcccgtgtgca

SEQ ID NO: 3393442 - DNA, 22 bp, Homo sapiens
gcgtcagctgctccctggcatt

SEQ ID NO: 3393443 - DNA, 18 bp, Homo sapiens
gcgtcagtctttttctgt

SEQ ID NO: 3393444 - DNA, 14 bp, Homo sapiens
gcgtccagaaatgg

SEQ ID NO: 3393445 - DNA, 12 bp, Homo sapiens
gcgtcccagctg

SEQ ID NO: 3393446 - DNA, 16 bp, Homo sapiens
gcgtccctagcagtga

SEQ ID NO: 3393447 - DNA, 14 bp, Homo sapiens
gcgtccctggcgca

SEQ ID NO: 3393448 - DNA, 18 bp, Homo sapiens
gcgtccctggcgcaggtg

SEQ ID NO: 3393449 - DNA, 20 bp, Homo sapiens
gcgtcctcctcacctcatgc

SEQ ID NO: 3393450 - DNA, 18 bp, Homo sapiens
gcgtcctgacgccctgcg

SEQ ID NO: 3393451 - DNA, 13 bp, Homo sapiens
gcgtcctgcagag

SEQ ID NO: 3393452 - DNA, 15 bp, Homo sapiens
gcgtcctgcagagga

SEQ ID NO: 3393453 - DNA, 20 bp, Homo sapiens
gcgtcctgcagaggaccaca

SEQ ID NO: 3393454 - DNA, 11 bp, Homo sapiens
gcgtctcctgt

SEQ ID NO: 3393455 - DNA, 18 bp, Homo sapiens
gcgtctggaggggcccct

SEQ ID NO: 3393456 - DNA, 23 bp, Homo sapiens
gcgtctggaggggcccctgcttc

SEQ ID NO: 3393457 - DNA, 16 bp, Homo sapiens
gcgtctttaagagact

SEQ ID NO: 3393458 - DNA, 19 bp, Homo sapiens
gcgtctttaagagactcac

SEQ ID NO: 3393459 - DNA, 19 bp, Homo sapiens
gcgtgaaacacaccaggct

SEQ ID NO: 3393460 - DNA, 17 bp, Homo sapiens
gcgtgactcagcagcct

SEQ ID NO: 3393461 - DNA, 18 bp, Homo sapiens
gcgtgcacacaccagagc

SEQ ID NO: 3393462 - DNA, 23 bp, Homo sapiens
gcgtgcacacaccagagcccacc

SEQ ID NO: 3393463 - DNA, 23 bp, Homo sapiens
gcgtgccagtcaagaagaaaaag

SEQ ID NO: 3393464 - DNA, 18 bp, Homo sapiens
gcgtgccgcctgctcctc

SEQ ID NO: 3393465 - DNA, 18 bp, Homo sapiens
gcgtggactctgcacatg

SEQ ID NO: 3393466 - DNA, 15 bp, Homo sapiens
gcgtggagactggca

SEQ ID NO: 3393467 - DNA, 18 bp, Homo sapiens
gcgtggctgtggcacaga

SEQ ID NO: 3393468 - DNA, 15 bp, Homo sapiens
gcgtgggagccagcc

SEQ ID NO: 3393469 - DNA, 23 bp, Homo sapiens
gcgtggtggcgggcacctgtagt

SEQ ID NO: 3393470 - DNA, 20 bp, Homo sapiens
gcgtggtgtgtccctggaca

SEQ ID NO: 3393471 - DNA, 13 bp, Homo sapiens
gcgtgtgcacgtg

SEQ ID NO: 3393472 - DNA, 20 bp, Homo sapiens
gcgtgtgtagagttaagaag

SEQ ID NO: 3393473 - DNA, 17 bp, Homo sapiens
gcgtgtgtatccgactc

SEQ ID NO: 3393474 - DNA, 14 bp, Homo sapiens
gcgttaagggcaga

SEQ ID NO: 3393475 - DNA, 15 bp, Homo sapiens
gcgttaagggcagag

SEQ ID NO: 3393476 - DNA, 16 bp, Homo sapiens
gcgttaagggcagagt

SEQ ID NO: 3393477 - DNA, 14 bp, Homo sapiens
gcgttcccagcagg

SEQ ID NO: 3393478 - DNA, 23 bp, Homo sapiens
gcgttggtgccacttcttaaagg

SEQ ID NO: 3393479 - DNA, 23 bp, Homo sapiens
gcgtttagtttctagaggcctca

SEQ ID NO: 3393480 - DNA, 22 bp, Homo sapiens
gcgtttgaccttttatgtagta

SEQ ID NO: 3393481 - DNA, 18 bp, Homo sapiens
gcgttttgtctgtgttgc

SEQ ID NO: 3393482 - DNA, 14 bp, Homo sapiens
gcgtttttacagtt

SEQ ID NO: 3393483 - DNA, 13 bp, Homo sapiens
gctaaaaaaagtg

SEQ ID NO: 3393484 - DNA, 21 bp, Homo sapiens
gctaaaaatatgcagaatctc

SEQ ID NO: 3393485 - DNA, 22 bp, Homo sapiens
gctaaaaatatgcagaatctct

SEQ ID NO: 3393486 - DNA, 22 bp, Homo sapiens
gctaaaaatgagcttgattaaa

SEQ ID NO: 3393487 - DNA, 17 bp, Homo sapiens
gctaaacgttggtgacg

SEQ ID NO: 3393488 - DNA, 22 bp, Homo sapiens
gctaaagagcccttgcctcccc

SEQ ID NO: 3393489 - DNA, 19 bp, Homo sapiens
gctaaatcctttactgtta

SEQ ID NO: 3393490 - DNA, 16 bp, Homo sapiens
gctaaatctcctattt

SEQ ID NO: 3393491 - DNA, 18 bp, Homo sapiens
gctaaattacaattgtca

SEQ ID NO: 3393492 - DNA, 22 bp, Homo sapiens
gctaaattctatgttaaatact

SEQ ID NO: 3393493 - DNA, 12 bp, Homo sapiens
gctaaattttta

SEQ ID NO: 3393494 - DNA, 17 bp, Homo sapiens
gctaacaatttctcata

SEQ ID NO: 3393495 - DNA, 23 bp, Homo sapiens
gctaacattttaaataaaagaaa

SEQ ID NO: 3393496 - DNA, 18 bp, Homo sapiens
gctaacgggaggctgggc

SEQ ID NO: 3393497 - DNA, 16 bp, Homo sapiens
gctaactgtaaatcat

SEQ ID NO: 3393498 - DNA, 17 bp, Homo sapiens
gctctttgaaacaactt

SEQ ID NO: 3393499 - DNA, 19 bp, Homo sapiens
gctctttgacaactaaaat

SEQ ID NO: 3393500 - DNA, 18 bp, Homo sapiens
gctctttggtagaaaagg

SEQ ID NO: 3393501 - DNA, 23 bp, Homo sapiens
gctcttttttactcattgaaatg

SEQ ID NO: 3393502 - DNA, 17 bp, Homo sapiens
gctctttttttaaaagg

SEQ ID NO: 3393503 - DNA, 21 bp, Homo sapiens
gctgaaaaccatctggcctgg

SEQ ID NO: 3393504 - DNA, 22 bp, Homo sapiens
gctgaaaaccatctggcctggc

SEQ ID NO: 3393505 - DNA, 19 bp, Homo sapiens
gctgaaaatgcaaagctga

SEQ ID NO: 3393506 - DNA, 16 bp, Homo sapiens
gctgaaattctcctgg

SEQ ID NO: 3393507 - DNA, 17 bp, Homo sapiens
gctgaaattctcctgga

SEQ ID NO: 3393508 - DNA, 15 bp, Homo sapiens
gctgaaattttatat

SEQ ID NO: 3393509 - DNA, 15 bp, Homo sapiens
gctgaaccaaagcct

SEQ ID NO: 3393510 - DNA, 14 bp, Homo sapiens
gctgaagagaggga

SEQ ID NO: 3393511 - DNA, 18 bp, Homo sapiens
gctgaagagagggacagg

SEQ ID NO: 3393512 - DNA, 22 bp, Homo sapiens
gctgaatatatagaattcagaa

SEQ ID NO: 3393513 - DNA, 20 bp, Homo sapiens
gctgaatatctgttcacttt

SEQ ID NO: 3393514 - DNA, 15 bp, Homo sapiens
gctgaatgcctcgct

SEQ ID NO: 3393515 - DNA, 22 bp, Homo sapiens
gctgacaaccattaaagtcaga

SEQ ID NO: 3393516 - DNA, 20 bp, Homo sapiens
gctgacacctaccatgctgc

SEQ ID NO: 3393517 - DNA, 13 bp, Homo sapiens
gctgacagacaca

SEQ ID NO: 3393518 - DNA, 19 bp, Homo sapiens
gctgacagacacaggcccg

SEQ ID NO: 3393519 - DNA, 13 bp, Homo sapiens
gctgacatctgtg

SEQ ID NO: 3393520 - DNA, 19 bp, Homo sapiens
gctgacatctgtgtttcaa

SEQ ID NO: 3393521 - DNA, 17 bp, Homo sapiens
gctgacatgaagctgtt

SEQ ID NO: 3393522 - DNA, 16 bp, Homo sapiens
gctgaccaagagagaa

SEQ ID NO: 3393523 - DNA, 12 bp, Homo sapiens
gctgaccagaca

SEQ ID NO: 3393524 - DNA, 22 bp, Homo sapiens
gctgacctgcctctcacacaca

SEQ ID NO: 3393525 - DNA, 18 bp, Homo sapiens
gctgacgggaggccccag

SEQ ID NO: 3393526 - DNA, 22 bp, Homo sapiens
gctgacgggaggccccagctct

SEQ ID NO: 3393527 - DNA, 17 bp, Homo sapiens
gctgactcacacctgaa

SEQ ID NO: 3393528 - DNA, 19 bp, Homo sapiens
gctgactgtactcctccca

SEQ ID NO: 3393529 - DNA, 21 bp, Homo sapiens
gctgactgtactcctcccagg

SEQ ID NO: 3393530 - DNA, 16 bp, Homo sapiens
gctgactgtcctctcc

SEQ ID NO: 3393531 - DNA, 23 bp, Homo sapiens
gctgactgtcctctcccctccag

SEQ ID NO: 3393532 - DNA, 20 bp, Homo sapiens
gctgactgtggccccctccg

SEQ ID NO: 3393533 - DNA, 16 bp, Homo sapiens
gctgacttcatctggg

SEQ ID NO: 3393534 - DNA, 17 bp, Homo sapiens
gctgacttggcacttaa

SEQ ID NO: 3393535 - DNA, 14 bp, Homo sapiens
gctgagaagaatga

SEQ ID NO: 3393536 - DNA, 21 bp, Homo sapiens
gctgagaccactgagtaccag

SEQ ID NO: 3393537 - DNA, 14 bp, Homo sapiens
gctgagagactttt

SEQ ID NO: 3393538 - DNA, 17 bp, Homo sapiens
gctgagccactcgcagt

SEQ ID NO: 3393539 - DNA, 14 bp, Homo sapiens
gctgagccctggca

SEQ ID NO: 3393540 - DNA, 15 bp, Homo sapiens
gctgagccctgggga

SEQ ID NO: 3393541 - DNA, 16 bp, Homo sapiens
gctgagccctggggac

SEQ ID NO: 3393542 - DNA, 19 bp, Homo sapiens
gctgagcctctgctcccca

SEQ ID NO: 3393543 - DNA, 18 bp, Homo sapiens
gctgagctgagtggccag

SEQ ID NO: 3393544 - DNA, 15 bp, Homo sapiens
gctgagctgggccca

SEQ ID NO: 3393545 - DNA, 16 bp, Homo sapiens
gctgagctgggcccag

SEQ ID NO: 3393546 - DNA, 20 bp, Homo sapiens
gctgagcttcggttctccag

SEQ ID NO: 3393547 - DNA, 20 bp, Homo sapiens
gctgagcttgtcttttctgc

SEQ ID NO: 3393548 - DNA, 22 bp, Homo sapiens
gctgaggccggatgcggtggct

SEQ ID NO: 3393549 - DNA, 12 bp, Homo sapiens
gctgaggcctgg

SEQ ID NO: 3393550 - DNA, 16 bp, Homo sapiens
gctgaggcctgggccg

SEQ ID NO: 3393551 - DNA, 23 bp, Homo sapiens
gctgaggcctgggccgctgccac

SEQ ID NO: 3393552 - DNA, 23 bp, Homo sapiens
gctgaggctctgacccagtgaga

SEQ ID NO: 3393553 - DNA, 13 bp, Homo sapiens
gctgagggcagct

SEQ ID NO: 3393554 - DNA, 17 bp, Homo sapiens
gctgaggggcttgggaa

SEQ ID NO: 3393555 - DNA, 17 bp, Homo sapiens
gctgaggggtctcggat

SEQ ID NO: 3393556 - DNA, 19 bp, Homo sapiens
gctgaggtgagaggatcag

SEQ ID NO: 3393557 - DNA, 13 bp, Homo sapiens
gctgaggttcctc

SEQ ID NO: 3393558 - DNA, 16 bp, Homo sapiens
gctgaggttcctctgc

SEQ ID NO: 3393559 - DNA, 20 bp, Homo sapiens
gctgaggttcctctgcctgc

SEQ ID NO: 3393560 - DNA, 17 bp, Homo sapiens
gctgaggtttcaccctt

SEQ ID NO: 3393561 - DNA, 21 bp, Homo sapiens
gctgagtatgttaagctcttt

SEQ ID NO: 3393562 - DNA, 20 bp, Homo sapiens
gctgagtggaatgcagggaa

SEQ ID NO: 3393563 - DNA, 17 bp, Homo sapiens
gctgagtggcaggggac

SEQ ID NO: 3393564 - DNA, 19 bp, Homo sapiens
gctgagtggcaggggacag

SEQ ID NO: 3393565 - DNA, 16 bp, Homo sapiens
gctgagtggccagcca

SEQ ID NO: 3393566 - DNA, 19 bp, Homo sapiens
gctgagtggccagccagtg

SEQ ID NO: 3393567 - DNA, 18 bp, Homo sapiens
gctgagtggcgcaaggcc

SEQ ID NO: 3393568 - DNA, 15 bp, Homo sapiens
gctgagtggggagca

SEQ ID NO: 3393569 - DNA, 18 bp, Homo sapiens
gctgatcgtagaaaattt

SEQ ID NO: 3393570 - DNA, 12 bp, Homo sapiens
gctgatgaaact

SEQ ID NO: 3393571 - DNA, 22 bp, Homo sapiens
gctgatgaaactcctgattttg

SEQ ID NO: 3393572 - DNA, 15 bp, Homo sapiens
gctgatgattttgca

SEQ ID NO: 3393573 - DNA, 19 bp, Homo sapiens
gctgatggcttgacatgtg

SEQ ID NO: 3393574 - DNA, 19 bp, Homo sapiens
gctgatgtccctagaaaac

SEQ ID NO: 3393575 - DNA, 14 bp, Homo sapiens
gctgattactgtca

SEQ ID NO: 3393576 - DNA, 21 bp, Homo sapiens
gctgattgcagaaaggagaga

SEQ ID NO: 3393577 - DNA, 16 bp, Homo sapiens
gctgatttccaggccc

SEQ ID NO: 3393578 - DNA, 17 bp, Homo sapiens
gctgatttccaggcccc

SEQ ID NO: 3393579 - DNA, 21 bp, Homo sapiens
gctgatttccaggcccctgag

SEQ ID NO: 3393580 - DNA, 23 bp, Homo sapiens
gctgatttccaggcccctgagga

SEQ ID NO: 3393581 - DNA, 20 bp, Homo sapiens
gctgattttaacaataacta

SEQ ID NO: 3393582 - DNA, 11 bp, Homo sapiens
gctgatttttt

SEQ ID NO: 3393583 - DNA, 22 bp, Homo sapiens
gctgcaaagggtatcaggtgct

SEQ ID NO: 3393584 - DNA, 20 bp, Homo sapiens
gctgcaaggtactctggtga

SEQ ID NO: 3393585 - DNA, 22 bp, Homo sapiens
gctgcaagtcagattgctggga

SEQ ID NO: 3393586 - DNA, 20 bp, Homo sapiens
gctgcaccacggcgtttttt

SEQ ID NO: 3393587 - DNA, 13 bp, Homo sapiens
gctgcaccagagc

SEQ ID NO: 3393588 - DNA, 15 bp, Homo sapiens
gctgcaccagagtga

SEQ ID NO: 3393589 - DNA, 18 bp, Homo sapiens
gctgcacccaactactga

SEQ ID NO: 3393590 - DNA, 19 bp, Homo sapiens
gctgcacctgccagcctgg

SEQ ID NO: 3393591 - DNA, 18 bp, Homo sapiens
gctgcacctttttgcatg

SEQ ID NO: 3393592 - DNA, 18 bp, Homo sapiens
gctgcacttggcctcagc

SEQ ID NO: 3393593 - DNA, 22 bp, Homo sapiens
gctgcacttggcctcagctggc

SEQ ID NO: 3393594 - DNA, 18 bp, Homo sapiens
gctgcagaggccagaggc

SEQ ID NO: 3393595 - DNA, 14 bp, Homo sapiens
gctgcagctgggcc

SEQ ID NO: 3393596 - DNA, 15 bp, Homo sapiens
gctgcagctgggctg

SEQ ID NO: 3393597 - DNA, 12 bp, Homo sapiens
gctgcaggagtg

SEQ ID NO: 3393598 - DNA, 18 bp, Homo sapiens
gctgcagggctcccatgg

SEQ ID NO: 3393599 - DNA, 19 bp, Homo sapiens
gctgcagggctcccatggg

SEQ ID NO: 3393600 - DNA, 21 bp, Homo sapiens
gctgcaggggcaggagaggct

SEQ ID NO: 3393601 - DNA, 13 bp, Homo sapiens
gctgcaggggctc

SEQ ID NO: 3393602 - DNA, 15 bp, Homo sapiens
gctgcaggggctctg

SEQ ID NO: 3393603 - DNA, 17 bp, Homo sapiens
gctgcaggggctctgga

SEQ ID NO: 3393604 - DNA, 22 bp, Homo sapiens
gctgcaggggctctggagagaa

SEQ ID NO: 3393605 - DNA, 20 bp, Homo sapiens
gctgcaggtacttcctcctg

SEQ ID NO: 3393606 - DNA, 21 bp, Homo sapiens
gctgcaggtacttcctcctga

SEQ ID NO: 3393607 - DNA, 16 bp, Homo sapiens
gctgcagtaggggagg

SEQ ID NO: 3393608 - DNA, 20 bp, Homo sapiens
gctgcagtaggggaggagca

SEQ ID NO: 3393609 - DNA, 21 bp, Homo sapiens
gctgcagtatggccagacgtg

SEQ ID NO: 3393610 - DNA, 20 bp, Homo sapiens
gctgcagtgacgtgcacctg

SEQ ID NO: 3393611 - DNA, 17 bp, Homo sapiens
gctgcagttttgctatc

SEQ ID NO: 3393612 - DNA, 17 bp, Homo sapiens
gctgcatcttatagcac

SEQ ID NO: 3393613 - DNA, 23 bp, Homo sapiens
gctgcatcttatagcactttgaa

SEQ ID NO: 3393614 - DNA, 22 bp, Homo sapiens
gctgcatggggtggggtagggc

SEQ ID NO: 3393615 - DNA, 15 bp, Homo sapiens
gctgccaaggccaga

SEQ ID NO: 3393616 - DNA, 18 bp, Homo sapiens
gctgccaaggccagagtg

SEQ ID NO: 3393617 - DNA, 23 bp, Homo sapiens
gctgccaaggccagagtggcctg

SEQ ID NO: 3393618 - DNA, 17 bp, Homo sapiens
gctgccacacttcaggc

SEQ ID NO: 3393619 - DNA, 18 bp, Homo sapiens
gctgccacacttcaggct

SEQ ID NO: 3393620 - DNA, 23 bp, Homo sapiens
gctgccacacttcaggctcttct

SEQ ID NO: 3393621 - DNA, 15 bp, Homo sapiens
gctgccaccacgtct

SEQ ID NO: 3393622 - DNA, 23 bp, Homo sapiens
gctgccaccacgtctgccaggcc

SEQ ID NO: 3393623 - DNA, 12 bp, Homo sapiens
gctgttgagatg

SEQ ID NO: 3393624 - DNA, 12 bp, Homo sapiens
gctgttgagctg

SEQ ID NO: 3393625 - DNA, 17 bp, Homo sapiens
gctgttgccatagcccc

SEQ ID NO: 3393626 - DNA, 19 bp, Homo sapiens
gctgttgcttaaaccactt

SEQ ID NO: 3393627 - DNA, 13 bp, Homo sapiens
gctgttggctggg

SEQ ID NO: 3393628 - DNA, 15 bp, Homo sapiens
gctgttggctggggg

SEQ ID NO: 3393629 - DNA, 20 bp, Homo sapiens
gctgttggctgggggcctca

SEQ ID NO: 3393630 - DNA, 15 bp, Homo sapiens
gctgttggtggcagt

SEQ ID NO: 3393631 - DNA, 21 bp, Homo sapiens
gctgtttagagtaaataaact

SEQ ID NO: 3393632 - DNA, 16 bp, Homo sapiens
gctgtttattaatctt

SEQ ID NO: 3393633 - DNA, 13 bp, Homo sapiens
gctgtttgaggat

SEQ ID NO: 3393634 - DNA, 12 bp, Homo sapiens
gctgtttggaaa

SEQ ID NO: 3393635 - DNA, 15 bp, Homo sapiens
gcttaaaaatcattg

SEQ ID NO: 3393636 - DNA, 22 bp, Homo sapiens
gcttaaaataaacagttgtgaa

SEQ ID NO: 3393637 - DNA, 11 bp, Homo sapiens
gcttaaacaaa

SEQ ID NO: 3393638 - DNA, 17 bp, Homo sapiens
gcttaaactaaataatg

SEQ ID NO: 3393639 - DNA, 21 bp, Homo sapiens
gcttaaagttggtattaataa

SEQ ID NO: 3393640 - DNA, 22 bp, Homo sapiens
gcttaaatatagttcctaagaa

SEQ ID NO: 3393641 - DNA, 22 bp, Homo sapiens
gcttaaattgcttttgttgtga

SEQ ID NO: 3393642 - DNA, 14 bp, Homo sapiens
gcttaaattttaac

SEQ ID NO: 3393643 - DNA, 17 bp, Homo sapiens
gcttaagaactgcttca

SEQ ID NO: 3393644 - DNA, 16 bp, Homo sapiens
gcttaagcagaagcat

SEQ ID NO: 3393645 - DNA, 16 bp, Homo sapiens
gcttaatcattttcat

SEQ ID NO: 3393646 - DNA, 22 bp, Homo sapiens
gcttaatcttcaaagccttctc

SEQ ID NO: 3393647 - DNA, 16 bp, Homo sapiens
gcttaatgctacatgt

SEQ ID NO: 3393648 - DNA, 18 bp, Homo sapiens
gcttaatgctacatgtga

SEQ ID NO: 3393649 - DNA, 18 bp, Homo sapiens
gcttaatggagttcttgt

SEQ ID NO: 3393650 - DNA, 14 bp, Homo sapiens
gcttaatgtttatt

SEQ ID NO: 3393651 - DNA, 17 bp, Homo sapiens
gcttaatgtttattcct

SEQ ID NO: 3393652 - DNA, 23 bp, Homo sapiens
gcttaatgtttattcctgataat

SEQ ID NO: 3393653 - DNA, 18 bp, Homo sapiens
gcttaatttctaaagata

SEQ ID NO: 3393654 - DNA, 16 bp, Homo sapiens
gcttacaatctttatt

SEQ ID NO: 3393655 - DNA, 23 bp, Homo sapiens
gcttacactgattggtgttttat

SEQ ID NO: 3393656 - DNA, 15 bp, Homo sapiens
gcttacatagtttta

SEQ ID NO: 3393657 - DNA, 19 bp, Homo sapiens
gcttacatttttacaataa

SEQ ID NO: 3393658 - DNA, 16 bp, Homo sapiens
gcttacctgacacaag

SEQ ID NO: 3393659 - DNA, 13 bp, Homo sapiens
gcttacctgacct

SEQ ID NO: 3393660 - DNA, 23 bp, Homo sapiens
gcttactgaagaaatctttccag

SEQ ID NO: 3393661 - DNA, 16 bp, Homo sapiens
gcttagagaatgttct

SEQ ID NO: 3393662 - DNA, 13 bp, Homo sapiens
gcttagagagagg

SEQ ID NO: 3393663 - DNA, 16 bp, Homo sapiens
gcttagagaggacaat

SEQ ID NO: 3393664 - DNA, 18 bp, Homo sapiens
gcttagccttgtgccctg

SEQ ID NO: 3393665 - DNA, 21 bp, Homo sapiens
gcttagccttgtgccctgccc

SEQ ID NO: 3393666 - DNA, 16 bp, Homo sapiens
gcttagcttatctttc

SEQ ID NO: 3393667 - DNA, 23 bp, Homo sapiens
gcttagcttatctttctttccat

SEQ ID NO: 3393668 - DNA, 16 bp, Homo sapiens
gcttagtaaaatttat

SEQ ID NO: 3393669 - DNA, 20 bp, Homo sapiens
gcttagtttgtgtgttgtct

SEQ ID NO: 3393670 - DNA, 17 bp, Homo sapiens
gcttataaacacattga

SEQ ID NO: 3393671 - DNA, 19 bp, Homo sapiens
gcttataaacacattgaat

SEQ ID NO: 3393672 - DNA, 20 bp, Homo sapiens
gcttatacacttacacttta

SEQ ID NO: 3393673 - DNA, 21 bp, Homo sapiens
gcttatatgtccttgggttgc

SEQ ID NO: 3393674 - DNA, 15 bp, Homo sapiens
gcttatctcttttat

SEQ ID NO: 3393675 - DNA, 22 bp, Homo sapiens
gcttatctcttttatatttgta

SEQ ID NO: 3393676 - DNA, 21 bp, Homo sapiens
gcttatgaatatttataacag

SEQ ID NO: 3393677 - DNA, 18 bp, Homo sapiens
gcttatgagatctaatgt

SEQ ID NO: 3393678 - DNA, 15 bp, Homo sapiens
gcttattacatttaa

SEQ ID NO: 3393679 - DNA, 14 bp, Homo sapiens
gcttattattgaag

SEQ ID NO: 3393680 - DNA, 18 bp, Homo sapiens
gcttattctcaaagcagg

SEQ ID NO: 3393681 - DNA, 18 bp, Homo sapiens
gcttattgcttagtaaaa

SEQ ID NO: 3393682 - DNA, 17 bp, Homo sapiens
gcttatttaatatgctt

SEQ ID NO: 3393683 - DNA, 15 bp, Homo sapiens
gcttattttaatgtg

SEQ ID NO: 3393684 - DNA, 18 bp, Homo sapiens
gcttattttaatgtgatg

SEQ ID NO: 3393685 - DNA, 22 bp, Homo sapiens
gcttattttaatgtgatgatgt

SEQ ID NO: 3393686 - DNA, 22 bp, Homo sapiens
gcttattttttaaaatatttga

SEQ ID NO: 3393687 - DNA, 16 bp, Homo sapiens
gcttcaaaatagagaa

SEQ ID NO: 3393688 - DNA, 22 bp, Homo sapiens
gcttcaaattcaaggccttcca

SEQ ID NO: 3393689 - DNA, 14 bp, Homo sapiens
gcttcaagtgcctt

SEQ ID NO: 3393690 - DNA, 15 bp, Homo sapiens
gcttcaagtgccttt

SEQ ID NO: 3393691 - DNA, 24 bp, Homo sapiens
gcttcaagtgccttttgctgcgca

SEQ ID NO: 3393692 - DNA, 21 bp, Homo sapiens
gcttcaagtgttgctcttgga

SEQ ID NO: 3393693 - DNA, 16 bp, Homo sapiens
gcttcaataaatcttt

SEQ ID NO: 3393694 - DNA, 17 bp, Homo sapiens
gcttcacagtagagcca

SEQ ID NO: 3393695 - DNA, 19 bp, Homo sapiens
gcttcacagtagagccagc

SEQ ID NO: 3393696 - DNA, 20 bp, Homo sapiens
gcttcacagtagagccagct

SEQ ID NO: 3393697 - DNA, 14 bp, Homo sapiens
gcttcaccagagca

SEQ ID NO: 3393698 - DNA, 16 bp, Homo sapiens
gcttcaccagtctgtc

SEQ ID NO: 3393699 - DNA, 21 bp, Homo sapiens
gcttcaccagtctgtctactg

SEQ ID NO: 3393700 - DNA, 23 bp, Homo sapiens
gcttcaccctcaccccctcctgg

SEQ ID NO: 3393701 - DNA, 14 bp, Homo sapiens
gcttcactgtataa

SEQ ID NO: 3393702 - DNA, 17 bp, Homo sapiens
gcttcagcatatttata

SEQ ID NO: 3393703 - DNA, 13 bp, Homo sapiens
gcttcaggcacca

SEQ ID NO: 3393704 - DNA, 18 bp, Homo sapiens
gcttcaggcaccagcatc

SEQ ID NO: 3393705 - DNA, 19 bp, Homo sapiens
gcttcaggccgagccaggt

SEQ ID NO: 3393706 - DNA, 12 bp, Homo sapiens
gcttcaggttat

SEQ ID NO: 3393707 - DNA, 21 bp, Homo sapiens
gcttcaggttatcgaaataac

SEQ ID NO: 3393708 - DNA, 22 bp, Homo sapiens
gcttcaggttatcgaaataaca

SEQ ID NO: 3393709 - DNA, 23 bp, Homo sapiens
gcttcagtacttgtgaaacacag

SEQ ID NO: 3393710 - DNA, 18 bp, Homo sapiens
gcttcagtcatcagccag

SEQ ID NO: 3393711 - DNA, 14 bp, Homo sapiens
gcttcagtggcagc

SEQ ID NO: 3393712 - DNA, 15 bp, Homo sapiens
gcttcagtggcagct

SEQ ID NO: 3393713 - DNA, 17 bp, Homo sapiens
gcttcagtggcagctgc

SEQ ID NO: 3393714 - DNA, 19 bp, Homo sapiens
gcttcatcattccctctca

SEQ ID NO: 3393715 - DNA, 14 bp, Homo sapiens
gcttcatctggcaa

SEQ ID NO: 3393716 - DNA, 14 bp, Homo sapiens
gcttcatgtgaaca

SEQ ID NO: 3393717 - DNA, 17 bp, Homo sapiens
gcttcattatctgagtt

SEQ ID NO: 3393718 - DNA, 10 bp, Homo sapiens
gcttcattgt

SEQ ID NO: 3393719 - DNA, 23 bp, Homo sapiens
gcttccagattgacgacaagtgc

SEQ ID NO: 3393720 - DNA, 21 bp, Homo sapiens
gcttccaggaaactccacatc

SEQ ID NO: 3393721 - DNA, 11 bp, Homo sapiens
gcttccaggct

SEQ ID NO: 3393722 - DNA, 21 bp, Homo sapiens
gcttccaggtaaaaacagata

SEQ ID NO: 3393723 - DNA, 23 bp, Homo sapiens
gcttccatcccaaccagtgccaa

SEQ ID NO: 3393724 - DNA, 11 bp, Homo sapiens
gcttccatgcc

SEQ ID NO: 3393725 - DNA, 15 bp, Homo sapiens
gcttccattaacaaa

SEQ ID NO: 3393726 - DNA, 17 bp, Homo sapiens
gcttcccacctccctgc

SEQ ID NO: 3393727 - DNA, 18 bp, Homo sapiens
gcttcccacctccctgcc

SEQ ID NO: 3393728 - DNA, 22 bp, Homo sapiens
gcttcccacctccctgcccagg

SEQ ID NO: 3393729 - DNA, 13 bp, Homo sapiens
gcttcccagaggg

SEQ ID NO: 3393730 - DNA, 14 bp, Homo sapiens
gcttcccagaggga

SEQ ID NO: 3393731 - DNA, 13 bp, Homo sapiens
gcttcccagccat

SEQ ID NO: 3393732 - DNA, 17 bp, Homo sapiens
gcttcccagccatgccc

SEQ ID NO: 3393733 - DNA, 18 bp, Homo sapiens
gcttcccagccatgccca

SEQ ID NO: 3393734 - DNA, 21 bp, Homo sapiens
gcttcccagccatgcccagga

SEQ ID NO: 3393735 - DNA, 18 bp, Homo sapiens
gcttcccccatagccacc

SEQ ID NO: 3393736 - DNA, 13 bp, Homo sapiens
gcttccctaatct

SEQ ID NO: 3393737 - DNA, 22 bp, Homo sapiens
gcttccgctttgaaagaagcaa

SEQ ID NO: 3393738 - DNA, 22 bp, Homo sapiens
gcttccggtagggaggcagcct

SEQ ID NO: 3393739 - DNA, 21 bp, Homo sapiens
gcttcctagaaagttctgtgt

SEQ ID NO: 3393740 - DNA, 22 bp, Homo sapiens
gcttcctataacttcttcctgc

SEQ ID NO: 3393741 - DNA, 18 bp, Homo sapiens
gcttcctccgtccaccca

SEQ ID NO: 3393742 - DNA, 19 bp, Homo sapiens
gcttcctccgtccacccag

SEQ ID NO: 3393743 - DNA, 21 bp, Homo sapiens
gcttcctccgtccacccaggc

SEQ ID NO: 3393744 - DNA, 23 bp, Homo sapiens
gcttcctccgtccacccaggctg

SEQ ID NO: 3393745 - DNA, 16 bp, Homo sapiens
gcttcctcctggaaat

SEQ ID NO: 3393746 - DNA, 20 bp, Homo sapiens
gcttcctctagaagccaagg

SEQ ID NO: 3393747 - DNA, 22 bp, Homo sapiens
gcttcctctagaagccaaggga

SEQ ID NO: 3393748 - DNA, 20 bp, Homo sapiens
ggaaggactgtggctgcagg

SEQ ID NO: 3393749 - DNA, 16 bp, Homo sapiens
ggaaggagaagtaaga

SEQ ID NO: 3393750 - DNA, 19 bp, Homo sapiens
ggaaggagattccacacag

SEQ ID NO: 3393751 - DNA, 21 bp, Homo sapiens
ggaaggagccagtttgccgga

SEQ ID NO: 3393752 - DNA, 16 bp, Homo sapiens
ggaaggaggagccgac

SEQ ID NO: 3393753 - DNA, 21 bp, Homo sapiens
ggaaggaggccaaccagcccg

SEQ ID NO: 3393754 - DNA, 20 bp, Homo sapiens
ggaaggagggtacagctggg

SEQ ID NO: 3393755 - DNA, 13 bp, Homo sapiens
ggaaggcagacag

SEQ ID NO: 3393756 - DNA, 13 bp, Homo sapiens
ggaaggcagctgc

SEQ ID NO: 3393757 - DNA, 17 bp, Homo sapiens
ggaaggcagggcagagg

SEQ ID NO: 3393758 - DNA, 24 bp, Homo sapiens
ggaaggcctaggctaggacgttgg

SEQ ID NO: 3393759 - DNA, 12 bp, Homo sapiens
ggaaggcctgac

SEQ ID NO: 3393760 - DNA, 12 bp, Homo sapiens
ggaaggcctggg

SEQ ID NO: 3393761 - DNA, 12 bp, Homo sapiens
ggaaggctggct

SEQ ID NO: 3393762 - DNA, 17 bp, Homo sapiens
ggaagggaaagtttttt

SEQ ID NO: 3393763 - DNA, 16 bp, Homo sapiens
ggaagggaccaaggca

SEQ ID NO: 3393764 - DNA, 22 bp, Homo sapiens
ggaagggaccaaggcaaggcag

SEQ ID NO: 3393765 - DNA, 12 bp, Homo sapiens
ggaagggccagt

SEQ ID NO: 3393766 - DNA, 13 bp, Homo sapiens
ggaagggctgggt

SEQ ID NO: 3393767 - DNA, 15 bp, Homo sapiens
ggaaggtgctgagct

SEQ ID NO: 3393768 - DNA, 12 bp, Homo sapiens
ggaaggtggggc

SEQ ID NO: 3393769 - DNA, 13 bp, Homo sapiens
ggaaggtggggcc

SEQ ID NO: 3393770 - DNA, 18 bp, Homo sapiens
ggaaggtggggccctgcc

SEQ ID NO: 3393771 - DNA, 16 bp, Homo sapiens
ggaagtacttccctca

SEQ ID NO: 3393772 - DNA, 17 bp, Homo sapiens
ggaagtccaatgtggca

SEQ ID NO: 3393773 - DNA, 13 bp, Homo sapiens
ggaagtctacctg

SEQ ID NO: 3393774 - DNA, 22 bp, Homo sapiens
ggaagtgaatccttaaccctaa

SEQ ID NO: 3393775 - DNA, 18 bp, Homo sapiens
ggaagtggcagtgaaaaa

SEQ ID NO: 3393776 - DNA, 16 bp, Homo sapiens
ggaagtgtaacagctg

SEQ ID NO: 3393777 - DNA, 17 bp, Homo sapiens
ggaagtgtaacagctga

SEQ ID NO: 3393778 - DNA, 15 bp, Homo sapiens
ggaataaaaggcttg

SEQ ID NO: 3393779 - DNA, 13 bp, Homo sapiens
ggaataaacatta

SEQ ID NO: 3393780 - DNA, 21 bp, Homo sapiens
ggaataaagttgcagatgatt

SEQ ID NO: 3393781 - DNA, 22 bp, Homo sapiens
ggaataaccttccatacatttt

SEQ ID NO: 3393782 - DNA, 15 bp, Homo sapiens
ggaataacctttctg

SEQ ID NO: 3393783 - DNA, 12 bp, Homo sapiens
ggaatacttttt

SEQ ID NO: 3393784 - DNA, 14 bp, Homo sapiens
ggaatagaggaaga

SEQ ID NO: 3393785 - DNA, 16 bp, Homo sapiens
ggaatagaggaagaaa

SEQ ID NO: 3393786 - DNA, 15 bp, Homo sapiens
ggaatagccagagag

SEQ ID NO: 3393787 - DNA, 17 bp, Homo sapiens
ggaatagccagagagga

SEQ ID NO: 3393788 - DNA, 12 bp, Homo sapiens
ggaatagggaga

SEQ ID NO: 3393789 - DNA, 14 bp, Homo sapiens
ggaatagggagaca

SEQ ID NO: 3393790 - DNA, 20 bp, Homo sapiens
ggaatagggagacagggtag

SEQ ID NO: 3393791 - DNA, 17 bp, Homo sapiens
ggaatagttgagcccca

SEQ ID NO: 3393792 - DNA, 22 bp, Homo sapiens
ggaatatttataggccagggca

SEQ ID NO: 3393793 - DNA, 18 bp, Homo sapiens
ggaatcatgtcaggcctg

SEQ ID NO: 3393794 - DNA, 20 bp, Homo sapiens
ggaatccaagcctccacagc

SEQ ID NO: 3393795 - DNA, 20 bp, Homo sapiens
ggaatccagctccctagact

SEQ ID NO: 3393796 - DNA, 23 bp, Homo sapiens
ggaatccagctccctagactgca

SEQ ID NO: 3393797 - DNA, 12 bp, Homo sapiens
ggaatcctggca

SEQ ID NO: 3393798 - DNA, 20 bp, Homo sapiens
ggaatgagcccagagaacag

SEQ ID NO: 3393799 - DNA, 16 bp, Homo sapiens
ggaatgaggaaaattc

SEQ ID NO: 3393800 - DNA, 21 bp, Homo sapiens
ggaatgaggtgggaggtggaa

SEQ ID NO: 3393801 - DNA, 15 bp, Homo sapiens
ggaatgcctgtgcca

SEQ ID NO: 3393802 - DNA, 18 bp, Homo sapiens
ggaatgctctgtgccaga

SEQ ID NO: 3393803 - DNA, 17 bp, Homo sapiens
ggaatggatggggagaa

SEQ ID NO: 3393804 - DNA, 19 bp, Homo sapiens
ggaatggatttttctttaa

SEQ ID NO: 3393805 - DNA, 17 bp, Homo sapiens
ggaatgtgcccctggcc

SEQ ID NO: 3393806 - DNA, 15 bp, Homo sapiens
ggaatgtgtggcctg

SEQ ID NO: 3393807 - DNA, 19 bp, Homo sapiens
ggaatgttccctgcaccct

SEQ ID NO: 3393808 - DNA, 17 bp, Homo sapiens
ggaattaacctggtgct

SEQ ID NO: 3393809 - DNA, 16 bp, Homo sapiens
ggaattacaagccctg

SEQ ID NO: 3393810 - DNA, 22 bp, Homo sapiens
ggaattattgtaccattttcta

SEQ ID NO: 3393811 - DNA, 18 bp, Homo sapiens
ggaattattttgaatgtc

SEQ ID NO: 3393812 - DNA, 20 bp, Homo sapiens
ggaattcagcaccctgggtg

SEQ ID NO: 3393813 - DNA, 21 bp, Homo sapiens
ggaattcagcaccctgggtgc

SEQ ID NO: 3393814 - DNA, 19 bp, Homo sapiens
ggaattcagtgccttcaac

SEQ ID NO: 3393815 - DNA, 21 bp, Homo sapiens
ggaattcattttcatcactgg

SEQ ID NO: 3393816 - DNA, 12 bp, Homo sapiens
ggaatttcaatg

SEQ ID NO: 3393817 - DNA, 16 bp, Homo sapiens
ggaatttgtaacctca

SEQ ID NO: 3393818 - DNA, 19 bp, Homo sapiens
ggacaacagtgctttgtaa

SEQ ID NO: 3393819 - DNA, 15 bp, Homo sapiens
ggacaacttatttaa

SEQ ID NO: 3393820 - DNA, 16 bp, Homo sapiens
ggacaagacccccagc

SEQ ID NO: 3393821 - DNA, 13 bp, Homo sapiens
ggacaagcagagg

SEQ ID NO: 3393822 - DNA, 12 bp, Homo sapiens
ggacaataaacc

SEQ ID NO: 3393823 - DNA, 21 bp, Homo sapiens
ggacaatcatgaaatatgcat

SEQ ID NO: 3393824 - DNA, 15 bp, Homo sapiens
ggacaattgttttaa

SEQ ID NO: 3393825 - DNA, 18 bp, Homo sapiens
ggacacaaaactccgccc

SEQ ID NO: 3393826 - DNA, 15 bp, Homo sapiens
ggacacaaattttca

SEQ ID NO: 3393827 - DNA, 22 bp, Homo sapiens
ggacacaccccacaccccagcc

SEQ ID NO: 3393828 - DNA, 23 bp, Homo sapiens
ggacacaccccacaccccagccc

SEQ ID NO: 3393829 - DNA, 12 bp, Homo sapiens
ggacacagctct

SEQ ID NO: 3393830 - DNA, 13 bp, Homo sapiens
ggacacagctctt

SEQ ID NO: 3393831 - DNA, 14 bp, Homo sapiens
ggacacagctcttc

SEQ ID NO: 3393832 - DNA, 21 bp, Homo sapiens
ggacacagctcttcattccat

SEQ ID NO: 3393833 - DNA, 22 bp, Homo sapiens
ggacacagctcttcattccatt

SEQ ID NO: 3393834 - DNA, 15 bp, Homo sapiens
ggacacagctcttct

SEQ ID NO: 3393835 - DNA, 18 bp, Homo sapiens
ggacacagctcttctcca

SEQ ID NO: 3393836 - DNA, 17 bp, Homo sapiens
ggacacagttcctggga

SEQ ID NO: 3393837 - DNA, 19 bp, Homo sapiens
ggacacagttcctgggaac

SEQ ID NO: 3393838 - DNA, 21 bp, Homo sapiens
ggacaccattaccaaaataat

SEQ ID NO: 3393839 - DNA, 15 bp, Homo sapiens
ggacacccctgctct

SEQ ID NO: 3393840 - DNA, 15 bp, Homo sapiens
ggacaccgggccagt

SEQ ID NO: 3393841 - DNA, 15 bp, Homo sapiens
ggacacctgccctgc

SEQ ID NO: 3393842 - DNA, 16 bp, Homo sapiens
ggacacctgccctgcc

SEQ ID NO: 3393843 - DNA, 18 bp, Homo sapiens
ggacactccagtgccagc

SEQ ID NO: 3393844 - DNA, 16 bp, Homo sapiens
ggacacttaatactac

SEQ ID NO: 3393845 - DNA, 14 bp, Homo sapiens
ggacagaaagagac

SEQ ID NO: 3393846 - DNA, 13 bp, Homo sapiens
ggacagacccagg

SEQ ID NO: 3393847 - DNA, 14 bp, Homo sapiens
ggacagacccaggt

SEQ ID NO: 3393848 - DNA, 15 bp, Homo sapiens
ggacagacccaggtc

SEQ ID NO: 3393849 - DNA, 21 bp, Homo sapiens
ggacagactggccgggcaggc

SEQ ID NO: 3393850 - DNA, 20 bp, Homo sapiens
ggacagagcaggggctccag

SEQ ID NO: 3393851 - DNA, 22 bp, Homo sapiens
ggacagagcaggggctccagca

SEQ ID NO: 3393852 - DNA, 14 bp, Homo sapiens
ggacagagccatgc

SEQ ID NO: 3393853 - DNA, 22 bp, Homo sapiens
ggacagagtggtttccaatgtg

SEQ ID NO: 3393854 - DNA, 20 bp, Homo sapiens
ggacagagttcacaggaggc

SEQ ID NO: 3393855 - DNA, 21 bp, Homo sapiens
ggacagagttcacaggaggcc

SEQ ID NO: 3393856 - DNA, 22 bp, Homo sapiens
ggacagagttcacaggaggcca

SEQ ID NO: 3393857 - DNA, 18 bp, Homo sapiens
ggacagcccagagcctgg

SEQ ID NO: 3393858 - DNA, 19 bp, Homo sapiens
ggacagcccatctgcctgt

SEQ ID NO: 3393859 - DNA, 13 bp, Homo sapiens
ggacagccccctt

SEQ ID NO: 3393860 - DNA, 16 bp, Homo sapiens
ggacagctccttctgt

SEQ ID NO: 3393861 - DNA, 20 bp, Homo sapiens
ggacagctttgctccgctcc

SEQ ID NO: 3393862 - DNA, 23 bp, Homo sapiens
ggacagctttgctccgctcccac

SEQ ID NO: 3393863 - DNA, 16 bp, Homo sapiens
ggacaggaggaggaga

SEQ ID NO: 3393864 - DNA, 20 bp, Homo sapiens
ggacaggatgacctggataa

SEQ ID NO: 3393865 - DNA, 14 bp, Homo sapiens
ggacaggcaggcca

SEQ ID NO: 3393866 - DNA, 12 bp, Homo sapiens
ggacaggcccag

SEQ ID NO: 3393867 - DNA, 22 bp, Homo sapiens
ggacaggcccagcgcggccagc

SEQ ID NO: 3393868 - DNA, 15 bp, Homo sapiens
ggacaggctgaagag

SEQ ID NO: 3393869 - DNA, 19 bp, Homo sapiens
ggacagtacctgattgtat

SEQ ID NO: 3393870 - DNA, 13 bp, Homo sapiens
ggacagtcctggg

SEQ ID NO: 3393871 - DNA, 18 bp, Homo sapiens
ggacagtcggaaaagcgt

SEQ ID NO: 3393872 - DNA, 17 bp, Homo sapiens
ggacagtgataggccca

SEQ ID NO: 3393873 - DNA, 14 bp, Homo sapiens
ggacagtgcttcag

SEQ ID NO: 3393874 - DNA, 13 bp, Homo sapiens
ggaggctccagga

SEQ ID NO: 3393875 - DNA, 12 bp, Homo sapiens
ggaggctgaggc

SEQ ID NO: 3393876 - DNA, 20 bp, Homo sapiens
ggaggctgcagagctgaccc

SEQ ID NO: 3393877 - DNA, 17 bp, Homo sapiens
ggaggctgcgtgccagt

SEQ ID NO: 3393878 - DNA, 14 bp, Homo sapiens
ggaggctgggcaca

SEQ ID NO: 3393879 - DNA, 15 bp, Homo sapiens
ggaggctgggcacag

SEQ ID NO: 3393880 - DNA, 12 bp, Homo sapiens
ggaggctgggcc

SEQ ID NO: 3393881 - DNA, 15 bp, Homo sapiens
ggaggcttcctgcgt

SEQ ID NO: 3393882 - DNA, 15 bp, Homo sapiens
ggaggcttttcactg

SEQ ID NO: 3393883 - DNA, 21 bp, Homo sapiens
ggagggaagtgtgagcgcctt

SEQ ID NO: 3393884 - DNA, 13 bp, Homo sapiens
ggagggagaggga

SEQ ID NO: 3393885 - DNA, 16 bp, Homo sapiens
ggagggatgctgctcc

SEQ ID NO: 3393886 - DNA, 12 bp, Homo sapiens
ggagggcacagc

SEQ ID NO: 3393887 - DNA, 23 bp, Homo sapiens
ggagggcagagccatgggcctgg

SEQ ID NO: 3393888 - DNA, 21 bp, Homo sapiens
ggagggcccctgcgtgggggc

SEQ ID NO: 3393889 - DNA, 20 bp, Homo sapiens
ggagggcggcaggggcctgg

SEQ ID NO: 3393890 - DNA, 14 bp, Homo sapiens
ggagggcggtggac

SEQ ID NO: 3393891 - DNA, 17 bp, Homo sapiens
ggagggcttggcccagc

SEQ ID NO: 3393892 - DNA, 14 bp, Homo sapiens
ggaggggaagctgc

SEQ ID NO: 3393893 - DNA, 17 bp, Homo sapiens
ggaggggaagctgcagc

SEQ ID NO: 3393894 - DNA, 21 bp, Homo sapiens
ggaggggactatttatgaagg

SEQ ID NO: 3393895 - DNA, 18 bp, Homo sapiens
ggaggggaggcagatgga

SEQ ID NO: 3393896 - DNA, 13 bp, Homo sapiens
ggaggggcccctg

SEQ ID NO: 3393897 - DNA, 16 bp, Homo sapiens
ggaggggccctccgag

SEQ ID NO: 3393898 - DNA, 14 bp, Homo sapiens
ggaggggcctggca

SEQ ID NO: 3393899 - DNA, 18 bp, Homo sapiens
ggaggggcctggcagccg

SEQ ID NO: 3393900 - DNA, 17 bp, Homo sapiens
ggaggggcgcccacctc

SEQ ID NO: 3393901 - DNA, 12 bp, Homo sapiens
ggaggggcgctg

SEQ ID NO: 3393902 - DNA, 20 bp, Homo sapiens
ggaggggcgctggcccagcc

SEQ ID NO: 3393903 - DNA, 17 bp, Homo sapiens
ggaggggcggcaggagg

SEQ ID NO: 3393904 - DNA, 22 bp, Homo sapiens
ggagggggaagtcgaaggatgc

SEQ ID NO: 3393905 - DNA, 21 bp, Homo sapiens
ggagggggcttgaagccaaag

SEQ ID NO: 3393906 - DNA, 12 bp, Homo sapiens
ggaggggggagc

SEQ ID NO: 3393907 - DNA, 15 bp, Homo sapiens
ggaggggggagccat

SEQ ID NO: 3393908 - DNA, 14 bp, Homo sapiens
ggaggggttgccac

SEQ ID NO: 3393909 - DNA, 16 bp, Homo sapiens
ggaggggttgttttgg

SEQ ID NO: 3393910 - DNA, 23 bp, Homo sapiens
ggagggtaaatgatgtggtgcct

SEQ ID NO: 3393911 - DNA, 18 bp, Homo sapiens
ggagggtacagctgggct

SEQ ID NO: 3393912 - DNA, 15 bp, Homo sapiens
ggagggttcccctgg

SEQ ID NO: 3393913 - DNA, 17 bp, Homo sapiens
ggagggttcccctggcc

SEQ ID NO: 3393914 - DNA, 20 bp, Homo sapiens
ggagggttctaagtgggaga

SEQ ID NO: 3393915 - DNA, 19 bp, Homo sapiens
ggagggttggggaggggcg

SEQ ID NO: 3393916 - DNA, 18 bp, Homo sapiens
ggagggtttgggcagagc

SEQ ID NO: 3393917 - DNA, 15 bp, Homo sapiens
ggaggtcactccacc

SEQ ID NO: 3393918 - DNA, 20 bp, Homo sapiens
ggaggtccttaggcctctga

SEQ ID NO: 3393919 - DNA, 22 bp, Homo sapiens
ggaggtcgaccccaaagcccct

SEQ ID NO: 3393920 - DNA, 21 bp, Homo sapiens
ggaggtctccaggggcctgca

SEQ ID NO: 3393921 - DNA, 15 bp, Homo sapiens
ggaggtgaggggggc

SEQ ID NO: 3393922 - DNA, 20 bp, Homo sapiens
ggaggtggaagaagggagaa

SEQ ID NO: 3393923 - DNA, 19 bp, Homo sapiens
ggaggtggagattgcagtg

SEQ ID NO: 3393924 - DNA, 15 bp, Homo sapiens
ggaggtggcagccct

SEQ ID NO: 3393925 - DNA, 18 bp, Homo sapiens
ggaggtggctatggccac

SEQ ID NO: 3393926 - DNA, 13 bp, Homo sapiens
ggaggtgtgaatg

SEQ ID NO: 3393927 - DNA, 19 bp, Homo sapiens
ggaggtgttcccaggctgc

SEQ ID NO: 3393928 - DNA, 19 bp, Homo sapiens
ggaggttctcagagccaag

SEQ ID NO: 3393929 - DNA, 20 bp, Homo sapiens
ggaggttctcagagccaagt

SEQ ID NO: 3393930 - DNA, 14 bp, Homo sapiens
ggaggttgaagcca

SEQ ID NO: 3393931 - DNA, 20 bp, Homo sapiens
ggaggttgagaatgcagtga

SEQ ID NO: 3393932 - DNA, 17 bp, Homo sapiens
ggaggttgcagggagcc

SEQ ID NO: 3393933 - DNA, 14 bp, Homo sapiens
ggaggttggtgact

SEQ ID NO: 3393934 - DNA, 17 bp, Homo sapiens
ggagtaccatgtggcaa

SEQ ID NO: 3393935 - DNA, 21 bp, Homo sapiens
ggagtcacacagtgttggagg

SEQ ID NO: 3393936 - DNA, 18 bp, Homo sapiens
ggagtcagagccctggct

SEQ ID NO: 3393937 - DNA, 18 bp, Homo sapiens
ggagtcagccaggagctg

SEQ ID NO: 3393938 - DNA, 19 bp, Homo sapiens
ggagtcagccaggagctgt

SEQ ID NO: 3393939 - DNA, 16 bp, Homo sapiens
ggagtcagtctctttc

SEQ ID NO: 3393940 - DNA, 18 bp, Homo sapiens
ggagtcagtctctttctg

SEQ ID NO: 3393941 - DNA, 13 bp, Homo sapiens
ggagtcagtgtct

SEQ ID NO: 3393942 - DNA, 18 bp, Homo sapiens
ggagtcagtgtctggctt

SEQ ID NO: 3393943 - DNA, 16 bp, Homo sapiens
ggagtccactttgttt

SEQ ID NO: 3393944 - DNA, 20 bp, Homo sapiens
ggagtcccaccttggctgca

SEQ ID NO: 3393945 - DNA, 17 bp, Homo sapiens
ggagtccctgcaggtga

SEQ ID NO: 3393946 - DNA, 15 bp, Homo sapiens
ggagtctctgccacc

SEQ ID NO: 3393947 - DNA, 18 bp, Homo sapiens
ggagtctgagtctgagtc

SEQ ID NO: 3393948 - DNA, 19 bp, Homo sapiens
ggagtctgagtctgagtcc

SEQ ID NO: 3393949 - DNA, 17 bp, Homo sapiens
ggagtgacagaggcagc

SEQ ID NO: 3393950 - DNA, 23 bp, Homo sapiens
ggagtgaggaatagttgagcccc

SEQ ID NO: 3393951 - DNA, 19 bp, Homo sapiens
ggagtgaggcttccaggct

SEQ ID NO: 3393952 - DNA, 22 bp, Homo sapiens
ggagtgatatgatccagagcag

SEQ ID NO: 3393953 - DNA, 18 bp, Homo sapiens
ggagtgcagggaggagag

SEQ ID NO: 3393954 - DNA, 14 bp, Homo sapiens
ggagtgcagtgagc

SEQ ID NO: 3393955 - DNA, 18 bp, Homo sapiens
ggagtgctggctcacagt

SEQ ID NO: 3393956 - DNA, 16 bp, Homo sapiens
ggagtgggcacctcag

SEQ ID NO: 3393957 - DNA, 20 bp, Homo sapiens
ggagtgggtgacaagagcct

SEQ ID NO: 3393958 - DNA, 16 bp, Homo sapiens
ggagtggtaacagctc

SEQ ID NO: 3393959 - DNA, 18 bp, Homo sapiens
ggagtgtgtattgttccc

SEQ ID NO: 3393960 - DNA, 22 bp, Homo sapiens
ggagttacattaatgttaattc

SEQ ID NO: 3393961 - DNA, 15 bp, Homo sapiens
ggagttcctaacagg

SEQ ID NO: 3393962 - DNA, 19 bp, Homo sapiens
ggagttcctaacaggatga

SEQ ID NO: 3393963 - DNA, 18 bp, Homo sapiens
ggagttcgagaccagcct

SEQ ID NO: 3393964 - DNA, 19 bp, Homo sapiens
ggagttcgagaccagcctc

SEQ ID NO: 3393965 - DNA, 20 bp, Homo sapiens
ggagttcgagaccagcctgg

SEQ ID NO: 3393966 - DNA, 16 bp, Homo sapiens
ggagttctatgctctc

SEQ ID NO: 3393967 - DNA, 19 bp, Homo sapiens
ggagttgagtacagtgagg

SEQ ID NO: 3393968 - DNA, 19 bp, Homo sapiens
ggagttgagtcacaagagg

SEQ ID NO: 3393969 - DNA, 22 bp, Homo sapiens
ggagttgtcaagtctctgctgg

SEQ ID NO: 3393970 - DNA, 19 bp, Homo sapiens
ggagtttaagaccagcctg

SEQ ID NO: 3393971 - DNA, 12 bp, Homo sapiens
ggagtttctaag

SEQ ID NO: 3393972 - DNA, 16 bp, Homo sapiens
ggagtttctttcctgc

SEQ ID NO: 3393973 - DNA, 19 bp, Homo sapiens
ggagtttgaggctgcagcg

SEQ ID NO: 3393974 - DNA, 23 bp, Homo sapiens
ggagtttttttatacaatgttct

SEQ ID NO: 3393975 - DNA, 18 bp, Homo sapiens
ggataaatcataaagtca

SEQ ID NO: 3393976 - DNA, 12 bp, Homo sapiens
ggataaatcatt

SEQ ID NO: 3393977 - DNA, 15 bp, Homo sapiens
ggataagccagctgc

SEQ ID NO: 3393978 - DNA, 16 bp, Homo sapiens
ggataatgaaataatc

SEQ ID NO: 3393979 - DNA, 21 bp, Homo sapiens
ggataatgaaataatcagtga

SEQ ID NO: 3393980 - DNA, 17 bp, Homo sapiens
ggataccttcttattta

SEQ ID NO: 3393981 - DNA, 18 bp, Homo sapiens
ggatactctgtcagatgg

SEQ ID NO: 3393982 - DNA, 21 bp, Homo sapiens
ggatacttagtggtatgtctc

SEQ ID NO: 3393983 - DNA, 23 bp, Homo sapiens
ggatacttagtggtatgtctctt

SEQ ID NO: 3393984 - DNA, 14 bp, Homo sapiens
ggatatactgcagc

SEQ ID NO: 3393985 - DNA, 15 bp, Homo sapiens
ggatataggagagga

SEQ ID NO: 3393986 - DNA, 21 bp, Homo sapiens
ggatatcattttaaaaacttt

SEQ ID NO: 3393987 - DNA, 14 bp, Homo sapiens
ggatatggctgccc

SEQ ID NO: 3393988 - DNA, 15 bp, Homo sapiens
ggatatggtgcagag

SEQ ID NO: 3393989 - DNA, 11 bp, Homo sapiens
ggatatttaac

SEQ ID NO: 3393990 - DNA, 17 bp, Homo sapiens
ggatatttgagtcactt

SEQ ID NO: 3393991 - DNA, 14 bp, Homo sapiens
ggatcacaagatgg

SEQ ID NO: 3393992 - DNA, 17 bp, Homo sapiens
ggatcactggagcccag

SEQ ID NO: 3393993 - DNA, 16 bp, Homo sapiens
ggatcagaacagcaga

SEQ ID NO: 3393994 - DNA, 17 bp, Homo sapiens
ggatcagaacagcagag

SEQ ID NO: 3393995 - DNA, 15 bp, Homo sapiens
ggatcagagcaggac

SEQ ID NO: 3393996 - DNA, 16 bp, Homo sapiens
ggatcagggaatccag

SEQ ID NO: 3393997 - DNA, 21 bp, Homo sapiens
ggatcagtctgattcccaagc

SEQ ID NO: 3393998 - DNA, 23 bp, Homo sapiens
ggatcatgttatgatttgtaaca

SEQ ID NO: 3393999 - DNA, 13 bp, Homo sapiens
ggatccagaaggg

SEQ ID NO: 3394000 - DNA, 15 bp, Homo sapiens
ggcatccacccagtg

SEQ ID NO: 3394001 - DNA, 18 bp, Homo sapiens
ggcatccacccagtgctg

SEQ ID NO: 3394002 - DNA, 19 bp, Homo sapiens
ggcatccacccagtgctgc

SEQ ID NO: 3394003 - DNA, 21 bp, Homo sapiens
ggcatccacccagtgctgcca

SEQ ID NO: 3394004 - DNA, 15 bp, Homo sapiens
ggcatcccaggggac

SEQ ID NO: 3394005 - DNA, 12 bp, Homo sapiens
ggcatcctgcct

SEQ ID NO: 3394006 - DNA, 13 bp, Homo sapiens
ggcatcctgcctg

SEQ ID NO: 3394007 - DNA, 14 bp, Homo sapiens
ggcatcctgcctgg

SEQ ID NO: 3394008 - DNA, 17 bp, Homo sapiens
ggcatcctgcctgggtg

SEQ ID NO: 3394009 - DNA, 18 bp, Homo sapiens
ggcatcctgcctgggtgg

SEQ ID NO: 3394010 - DNA, 19 bp, Homo sapiens
ggcatcctgcctgggtggg

SEQ ID NO: 3394011 - DNA, 20 bp, Homo sapiens
ggcatcctgcctgggtggga

SEQ ID NO: 3394012 - DNA, 16 bp, Homo sapiens
ggcatcgtagaagaga

SEQ ID NO: 3394013 - DNA, 14 bp, Homo sapiens
ggcatctcctgtcc

SEQ ID NO: 3394014 - DNA, 15 bp, Homo sapiens
ggcatctcctgtcct

SEQ ID NO: 3394015 - DNA, 14 bp, Homo sapiens
ggcatctcctgtgc

SEQ ID NO: 3394016 - DNA, 16 bp, Homo sapiens
ggcatctcctgtgcat

SEQ ID NO: 3394017 - DNA, 15 bp, Homo sapiens
ggcatctgcaccctc

SEQ ID NO: 3394018 - DNA, 23 bp, Homo sapiens
ggcatctttgccttgggctgctc

SEQ ID NO: 3394019 - DNA, 18 bp, Homo sapiens
ggcatcttttggaggaaa

SEQ ID NO: 3394020 - DNA, 14 bp, Homo sapiens
ggcatgaagctgca

SEQ ID NO: 3394021 - DNA, 17 bp, Homo sapiens
ggcatgccaccctcaca

SEQ ID NO: 3394022 - DNA, 24 bp, Homo sapiens
ggcatgccaccctcacacacacag

SEQ ID NO: 3394023 - DNA, 18 bp, Homo sapiens
ggcatgccccggccacct

SEQ ID NO: 3394024 - DNA, 21 bp, Homo sapiens
ggcatgccccggccacctctg

SEQ ID NO: 3394025 - DNA, 14 bp, Homo sapiens
ggcatgccttgtgc

SEQ ID NO: 3394026 - DNA, 19 bp, Homo sapiens
ggcatgcttctcaccgtgc

SEQ ID NO: 3394027 - DNA, 18 bp, Homo sapiens
ggcatggccaggtggcca

SEQ ID NO: 3394028 - DNA, 13 bp, Homo sapiens
ggcatggccctgg

SEQ ID NO: 3394029 - DNA, 19 bp, Homo sapiens
ggcatggtaccagccctgg

SEQ ID NO: 3394030 - DNA, 15 bp, Homo sapiens
ggcatgtggcctgtg

SEQ ID NO: 3394031 - DNA, 17 bp, Homo sapiens
ggcatgtggcctgtggc

SEQ ID NO: 3394032 - DNA, 19 bp, Homo sapiens
ggcatgtggcctgtggcct

SEQ ID NO: 3394033 - DNA, 20 bp, Homo sapiens
ggcatgtggcctgtggcctg

SEQ ID NO: 3394034 - DNA, 15 bp, Homo sapiens
ggcatgtgtgcctgt

SEQ ID NO: 3394035 - DNA, 14 bp, Homo sapiens
ggcatgttcctctg

SEQ ID NO: 3394036 - DNA, 16 bp, Homo sapiens
ggcatgtttccagcag

SEQ ID NO: 3394037 - DNA, 21 bp, Homo sapiens
ggcatgttttctttgtttcct

SEQ ID NO: 3394038 - DNA, 16 bp, Homo sapiens
ggcattaacacaaagg

SEQ ID NO: 3394039 - DNA, 20 bp, Homo sapiens
ggcattacttgctttcaatt

SEQ ID NO: 3394040 - DNA, 19 bp, Homo sapiens
ggcattcgggccacagggc

SEQ ID NO: 3394041 - DNA, 11 bp, Homo sapiens
ggcattgagta

SEQ ID NO: 3394042 - DNA, 19 bp, Homo sapiens
ggcattgagtattgtttaa

SEQ ID NO: 3394043 - DNA, 15 bp, Homo sapiens
ggcattgccaagccc

SEQ ID NO: 3394044 - DNA, 14 bp, Homo sapiens
ggcattgggctgac

SEQ ID NO: 3394045 - DNA, 15 bp, Homo sapiens
ggcattgttagttta

SEQ ID NO: 3394046 - DNA, 17 bp, Homo sapiens
ggcattgttagtttagt

SEQ ID NO: 3394047 - DNA, 21 bp, Homo sapiens
ggcatttgcagggtcctcttc

SEQ ID NO: 3394048 - DNA, 14 bp, Homo sapiens
ggcatttggtgaga

SEQ ID NO: 3394049 - DNA, 21 bp, Homo sapiens
ggcatttggtgagagtcaaag

SEQ ID NO: 3394050 - DNA, 15 bp, Homo sapiens
ggcatttttatttta

SEQ ID NO: 3394051 - DNA, 23 bp, Homo sapiens
ggccaaacatcagacctgtcttc

SEQ ID NO: 3394052 - DNA, 15 bp, Homo sapiens
ggccaaacccttgct

SEQ ID NO: 3394053 - DNA, 12 bp, Homo sapiens
ggccaaactgct

SEQ ID NO: 3394054 - DNA, 16 bp, Homo sapiens
ggccaaagagtctcca

SEQ ID NO: 3394055 - DNA, 12 bp, Homo sapiens
ggccaaagataa

SEQ ID NO: 3394056 - DNA, 15 bp, Homo sapiens
ggccaaagataaaag

SEQ ID NO: 3394057 - DNA, 19 bp, Homo sapiens
ggccaaatgcacaagctca

SEQ ID NO: 3394058 - DNA, 23 bp, Homo sapiens
ggccaacaatcctttctgcccac

SEQ ID NO: 3394059 - DNA, 21 bp, Homo sapiens
ggccaacttgagggcccagag

SEQ ID NO: 3394060 - DNA, 22 bp, Homo sapiens
ggccaacttgagggcccagagc

SEQ ID NO: 3394061 - DNA, 23 bp, Homo sapiens
ggccaagagaaaggcctgcacac

SEQ ID NO: 3394062 - DNA, 15 bp, Homo sapiens
ggccaaggcaggtag

SEQ ID NO: 3394063 - DNA, 13 bp, Homo sapiens
ggccaatccccag

SEQ ID NO: 3394064 - DNA, 22 bp, Homo sapiens
ggccacaaatcaaagcaagggc

SEQ ID NO: 3394065 - DNA, 23 bp, Homo sapiens
ggccacaaatcaaagcaagggct

SEQ ID NO: 3394066 - DNA, 13 bp, Homo sapiens
ggccacagggcgg

SEQ ID NO: 3394067 - DNA, 16 bp, Homo sapiens
ggccacatagatgctg

SEQ ID NO: 3394068 - DNA, 19 bp, Homo sapiens
ggccacatccccaccccag

SEQ ID NO: 3394069 - DNA, 18 bp, Homo sapiens
ggccaccaaagctgccca

SEQ ID NO: 3394070 - DNA, 14 bp, Homo sapiens
ggccaccaggctgg

SEQ ID NO: 3394071 - DNA, 17 bp, Homo sapiens
ggccaccatgtctggct

SEQ ID NO: 3394072 - DNA, 14 bp, Homo sapiens
ggccaccccactct

SEQ ID NO: 3394073 - DNA, 12 bp, Homo sapiens
ggccacctcctc

SEQ ID NO: 3394074 - DNA, 14 bp, Homo sapiens
ggccacctcctccc

SEQ ID NO: 3394075 - DNA, 16 bp, Homo sapiens
ggccacctcctccccc

SEQ ID NO: 3394076 - DNA, 11 bp, Homo sapiens
ggccacctctc

SEQ ID NO: 3394077 - DNA, 14 bp, Homo sapiens
ggccacctctccaa

SEQ ID NO: 3394078 - DNA, 16 bp, Homo sapiens
ggccacctgaggtggg

SEQ ID NO: 3394079 - DNA, 19 bp, Homo sapiens
ggccacctgaggtgggccc

SEQ ID NO: 3394080 - DNA, 14 bp, Homo sapiens
ggccacctgtagcc

SEQ ID NO: 3394081 - DNA, 18 bp, Homo sapiens
ggccacctgtagccatct

SEQ ID NO: 3394082 - DNA, 23 bp, Homo sapiens
ggccacgcactgggccacggagg

SEQ ID NO: 3394083 - DNA, 24 bp, Homo sapiens
ggccacgcactgggccacggagga

SEQ ID NO: 3394084 - DNA, 14 bp, Homo sapiens
ggccacgccccagc

SEQ ID NO: 3394085 - DNA, 15 bp, Homo sapiens
ggccacggaggaggg

SEQ ID NO: 3394086 - DNA, 23 bp, Homo sapiens
ggccacggaggagggatgctgct

SEQ ID NO: 3394087 - DNA, 13 bp, Homo sapiens
ggccactgtggcc

SEQ ID NO: 3394088 - DNA, 17 bp, Homo sapiens
ggccactgtggccagag

SEQ ID NO: 3394089 - DNA, 21 bp, Homo sapiens
ggccactttaagagagaaatc

SEQ ID NO: 3394090 - DNA, 22 bp, Homo sapiens
ggccactttcagagcccccagc

SEQ ID NO: 3394091 - DNA, 24 bp, Homo sapiens
ggccagaaggagggcagagccatg

SEQ ID NO: 3394092 - DNA, 23 bp, Homo sapiens
ggccagagaagataatgttcttt

SEQ ID NO: 3394093 - DNA, 23 bp, Homo sapiens
ggccagagagcctggtgctgctg

SEQ ID NO: 3394094 - DNA, 16 bp, Homo sapiens
ggccagagagggccca

SEQ ID NO: 3394095 - DNA, 18 bp, Homo sapiens
ggccagagagggcccagc

SEQ ID NO: 3394096 - DNA, 13 bp, Homo sapiens
ggccagagctgga

SEQ ID NO: 3394097 - DNA, 17 bp, Homo sapiens
ggccagagctggaaggc

SEQ ID NO: 3394098 - DNA, 20 bp, Homo sapiens
ggccagagctggaaggcagg

SEQ ID NO: 3394099 - DNA, 23 bp, Homo sapiens
ggccagagctggaaggcagggca

SEQ ID NO: 3394100 - DNA, 14 bp, Homo sapiens
ggccagagctggga

SEQ ID NO: 3394101 - DNA, 22 bp, Homo sapiens
ggccagaggaactgtccagaga

SEQ ID NO: 3394102 - DNA, 21 bp, Homo sapiens
ggccagaggcccccagcccag

SEQ ID NO: 3394103 - DNA, 21 bp, Homo sapiens
ggccagagggagctggaaccc

SEQ ID NO: 3394104 - DNA, 15 bp, Homo sapiens
ggccagagggcagtg

SEQ ID NO: 3394105 - DNA, 18 bp, Homo sapiens
ggccagagggcagtggcc

SEQ ID NO: 3394106 - DNA, 18 bp, Homo sapiens
ggccagagtggcctggcc

SEQ ID NO: 3394107 - DNA, 20 bp, Homo sapiens
ggccagagtggcctggccag

SEQ ID NO: 3394108 - DNA, 20 bp, Homo sapiens
ggccagatgcacatccctgg

SEQ ID NO: 3394109 - DNA, 21 bp, Homo sapiens
ggccagatgcacatccctgga

SEQ ID NO: 3394110 - DNA, 16 bp, Homo sapiens
ggccagatgcaccagc

SEQ ID NO: 3394111 - DNA, 17 bp, Homo sapiens
ggccagatgcaccagcc

SEQ ID NO: 3394112 - DNA, 20 bp, Homo sapiens
ggccagatgcaccagccctt

SEQ ID NO: 3394113 - DNA, 14 bp, Homo sapiens
ggccagcaaggcag

SEQ ID NO: 3394114 - DNA, 16 bp, Homo sapiens
ggccagcaccctctcc

SEQ ID NO: 3394115 - DNA, 17 bp, Homo sapiens
ggccagcaccctctcct

SEQ ID NO: 3394116 - DNA, 19 bp, Homo sapiens
ggccagcaccctctcctgg

SEQ ID NO: 3394117 - DNA, 16 bp, Homo sapiens
ggccagccagtgccat

SEQ ID NO: 3394118 - DNA, 22 bp, Homo sapiens
ggccagccagtgccattccact

SEQ ID NO: 3394119 - DNA, 11 bp, Homo sapiens
ggccagcccag

SEQ ID NO: 3394120 - DNA, 14 bp, Homo sapiens
ggccagcccagcca

SEQ ID NO: 3394121 - DNA, 16 bp, Homo sapiens
ggccagcccagccagg

SEQ ID NO: 3394122 - DNA, 15 bp, Homo sapiens
ggccagccccaccca

SEQ ID NO: 3394123 - DNA, 14 bp, Homo sapiens
ggccagcccggctg

SEQ ID NO: 3394124 - DNA, 19 bp, Homo sapiens
ggccagcccggctggtttt

SEQ ID NO: 3394125 - DNA, 19 bp, Homo sapiens
ggccagcccttcctctcac

SEQ ID NO: 3394126 - DNA, 23 bp, Homo sapiens
ggcctttgcaagatgcttggttg

SEQ ID NO: 3394127 - DNA, 21 bp, Homo sapiens
ggccttttaacattttgttct

SEQ ID NO: 3394128 - DNA, 20 bp, Homo sapiens
ggccttttagaaacctcatt

SEQ ID NO: 3394129 - DNA, 16 bp, Homo sapiens
ggcgaagcccaggccc

SEQ ID NO: 3394130 - DNA, 16 bp, Homo sapiens
ggcgaccgccctccgc

SEQ ID NO: 3394131 - DNA, 15 bp, Homo sapiens
ggcgagagaggagcc

SEQ ID NO: 3394132 - DNA, 17 bp, Homo sapiens
ggcgatccacctgtctc

SEQ ID NO: 3394133 - DNA, 22 bp, Homo sapiens
ggcgcaatctcggctcactgca

SEQ ID NO: 3394134 - DNA, 20 bp, Homo sapiens
ggcgcaggcgaccgggcctc

SEQ ID NO: 3394135 - DNA, 16 bp, Homo sapiens
ggcgcaggtgggctgg

SEQ ID NO: 3394136 - DNA, 20 bp, Homo sapiens
ggcgcaggtgggctggactt

SEQ ID NO: 3394137 - DNA, 21 bp, Homo sapiens
ggcgcagtggctcacgcctgt

SEQ ID NO: 3394138 - DNA, 17 bp, Homo sapiens
ggcgcatattaagcact

SEQ ID NO: 3394139 - DNA, 21 bp, Homo sapiens
ggcgccaacgttcgatttcta

SEQ ID NO: 3394140 - DNA, 22 bp, Homo sapiens
ggcgcccaccaccccctcaagc

SEQ ID NO: 3394141 - DNA, 14 bp, Homo sapiens
ggcgcccacctccc

SEQ ID NO: 3394142 - DNA, 16 bp, Homo sapiens
ggcgccctctctgctc

SEQ ID NO: 3394143 - DNA, 18 bp, Homo sapiens
ggcgccctctctgctcct

SEQ ID NO: 3394144 - DNA, 18 bp, Homo sapiens
ggcgcccttggcttctgt

SEQ ID NO: 3394145 - DNA, 17 bp, Homo sapiens
ggcgcggcctcccgagg

SEQ ID NO: 3394146 - DNA, 21 bp, Homo sapiens
ggcgctcagacggcggccagg

SEQ ID NO: 3394147 - DNA, 11 bp, Homo sapiens
ggcgctcagga

SEQ ID NO: 3394148 - DNA, 15 bp, Homo sapiens
ggcgctgcttccagg

SEQ ID NO: 3394149 - DNA, 15 bp, Homo sapiens
ggcgctggcccagcc

SEQ ID NO: 3394150 - DNA, 20 bp, Homo sapiens
ggcgctggcccagccggcct

SEQ ID NO: 3394151 - DNA, 20 bp, Homo sapiens
ggcgctgggtattggaaatg

SEQ ID NO: 3394152 - DNA, 18 bp, Homo sapiens
ggcggacggctgtggacc

SEQ ID NO: 3394153 - DNA, 16 bp, Homo sapiens
ggcggcagcagccatc

SEQ ID NO: 3394154 - DNA, 17 bp, Homo sapiens
ggcggcaggggcctgga

SEQ ID NO: 3394155 - DNA, 11 bp, Homo sapiens
ggcggccaggc

SEQ ID NO: 3394156 - DNA, 18 bp, Homo sapiens
ggcggccaggcacagggc

SEQ ID NO: 3394157 - DNA, 15 bp, Homo sapiens
ggcggcccggccagc

SEQ ID NO: 3394158 - DNA, 23 bp, Homo sapiens
ggcggcccggccagcgggcacag

SEQ ID NO: 3394159 - DNA, 22 bp, Homo sapiens
ggcgggcacctatagtcccagc

SEQ ID NO: 3394160 - DNA, 18 bp, Homo sapiens
ggcgggcagagggctgga

SEQ ID NO: 3394161 - DNA, 12 bp, Homo sapiens
ggcgggccagcc

SEQ ID NO: 3394162 - DNA, 15 bp, Homo sapiens
ggcgggccagccagg

SEQ ID NO: 3394163 - DNA, 18 bp, Homo sapiens
ggcggggaccttggtctg

SEQ ID NO: 3394164 - DNA, 22 bp, Homo sapiens
ggcggggggggcgcctggagag

SEQ ID NO: 3394165 - DNA, 20 bp, Homo sapiens
ggcgggtggatcatgaggtc

SEQ ID NO: 3394166 - DNA, 16 bp, Homo sapiens
ggcggtggacaataaa

SEQ ID NO: 3394167 - DNA, 16 bp, Homo sapiens
ggcgtaatgggcctgc

SEQ ID NO: 3394168 - DNA, 17 bp, Homo sapiens
ggcgtaatgggcctgcc

SEQ ID NO: 3394169 - DNA, 18 bp, Homo sapiens
ggcgtaatgggcctgccc

SEQ ID NO: 3394170 - DNA, 15 bp, Homo sapiens
ggcgtcagtcttttt

SEQ ID NO: 3394171 - DNA, 19 bp, Homo sapiens
ggcgtggagactggcaggc

SEQ ID NO: 3394172 - DNA, 19 bp, Homo sapiens
ggcgtggagccagggagcg

SEQ ID NO: 3394173 - DNA, 15 bp, Homo sapiens
ggcgtggtcactgct

SEQ ID NO: 3394174 - DNA, 17 bp, Homo sapiens
ggcgtggtcactgctgt

SEQ ID NO: 3394175 - DNA, 19 bp, Homo sapiens
ggcgtggtcactgctgtca

SEQ ID NO: 3394176 - DNA, 23 bp, Homo sapiens
ggcgtggtgtgtccctggacaca

SEQ ID NO: 3394177 - DNA, 22 bp, Homo sapiens
ggcgtgtatctggtatatgtaa

SEQ ID NO: 3394178 - DNA, 22 bp, Homo sapiens
ggcgttatttatggaccacttt

SEQ ID NO: 3394179 - DNA, 15 bp, Homo sapiens
ggcgttggtgccact

SEQ ID NO: 3394180 - DNA, 20 bp, Homo sapiens
ggctaaaggggagaaactga

SEQ ID NO: 3394181 - DNA, 21 bp, Homo sapiens
ggctaaaggggagaaactgaa

SEQ ID NO: 3394182 - DNA, 20 bp, Homo sapiens
ggctaacctggacctggaac

SEQ ID NO: 3394183 - DNA, 21 bp, Homo sapiens
ggctaacctggacctggaact

SEQ ID NO: 3394184 - DNA, 16 bp, Homo sapiens
ggctaacgggaggctg

SEQ ID NO: 3394185 - DNA, 18 bp, Homo sapiens
ggctaacgggaggctggg

SEQ ID NO: 3394186 - DNA, 15 bp, Homo sapiens
ggctaagatgagatt

SEQ ID NO: 3394187 - DNA, 15 bp, Homo sapiens
ggctaagcctctgct

SEQ ID NO: 3394188 - DNA, 16 bp, Homo sapiens
ggctaatgtactgcat

SEQ ID NO: 3394189 - DNA, 12 bp, Homo sapiens
ggctaatttaac

SEQ ID NO: 3394190 - DNA, 13 bp, Homo sapiens
ggctacatcccag

SEQ ID NO: 3394191 - DNA, 22 bp, Homo sapiens
ggctacatcccagcctgtggtt

SEQ ID NO: 3394192 - DNA, 21 bp, Homo sapiens
ggctaccagaagaggggcagc

SEQ ID NO: 3394193 - DNA, 15 bp, Homo sapiens
ggctacgaatcttcc

SEQ ID NO: 3394194 - DNA, 14 bp, Homo sapiens
ggctactggcagct

SEQ ID NO: 3394195 - DNA, 17 bp, Homo sapiens
ggctactggcagctcct

SEQ ID NO: 3394196 - DNA, 18 bp, Homo sapiens
ggctagaggccagcccca

SEQ ID NO: 3394197 - DNA, 19 bp, Homo sapiens
ggctagagtcctcactccc

SEQ ID NO: 3394198 - DNA, 20 bp, Homo sapiens
ggctagcttctgcttttctg

SEQ ID NO: 3394199 - DNA, 16 bp, Homo sapiens
ggctaggacccctcca

SEQ ID NO: 3394200 - DNA, 22 bp, Homo sapiens
ggctaggacccctccatgtggg

SEQ ID NO: 3394201 - DNA, 17 bp, Homo sapiens
ggctaggacgttggcct

SEQ ID NO: 3394202 - DNA, 13 bp, Homo sapiens
ggctaggtacaca

SEQ ID NO: 3394203 - DNA, 15 bp, Homo sapiens
ggctagtgtgagtgg

SEQ ID NO: 3394204 - DNA, 18 bp, Homo sapiens
ggctagtgtgagtggcag

SEQ ID NO: 3394205 - DNA, 21 bp, Homo sapiens
ggctagtgtgagtggcagcca

SEQ ID NO: 3394206 - DNA, 24 bp, Homo sapiens
ggctagtgtgagtggcagccatgc

SEQ ID NO: 3394207 - DNA, 16 bp, Homo sapiens
ggctatcaaaagaaat

SEQ ID NO: 3394208 - DNA, 17 bp, Homo sapiens
ggctatggagggtcctc

SEQ ID NO: 3394209 - DNA, 19 bp, Homo sapiens
ggctatgtatggaatacag

SEQ ID NO: 3394210 - DNA, 16 bp, Homo sapiens
ggctatttgtaaatct

SEQ ID NO: 3394211 - DNA, 19 bp, Homo sapiens
ggctcaagcgattctcctg

SEQ ID NO: 3394212 - DNA, 12 bp, Homo sapiens
ggctcacaggcc

SEQ ID NO: 3394213 - DNA, 13 bp, Homo sapiens
ggctcacaggcct

SEQ ID NO: 3394214 - DNA, 23 bp, Homo sapiens
ggctcacgcctatgatcccagca

SEQ ID NO: 3394215 - DNA, 20 bp, Homo sapiens
ggctcacggggcctccaacc

SEQ ID NO: 3394216 - DNA, 19 bp, Homo sapiens
ggctcactgcaacctccgc

SEQ ID NO: 3394217 - DNA, 20 bp, Homo sapiens
ggctcactgcaacctccgcc

SEQ ID NO: 3394218 - DNA, 13 bp, Homo sapiens
ggctcactgcagc

SEQ ID NO: 3394219 - DNA, 14 bp, Homo sapiens
ggctcactgcagcc

SEQ ID NO: 3394220 - DNA, 16 bp, Homo sapiens
ggctcactgcagcctc

SEQ ID NO: 3394221 - DNA, 15 bp, Homo sapiens
ggctcactgccaggc

SEQ ID NO: 3394222 - DNA, 22 bp, Homo sapiens
ggctcactgccaggccagcctc

SEQ ID NO: 3394223 - DNA, 20 bp, Homo sapiens
ggctcacttttcatccttcc

SEQ ID NO: 3394224 - DNA, 23 bp, Homo sapiens
ggctcagcggggacagctccttc

SEQ ID NO: 3394225 - DNA, 15 bp, Homo sapiens
ggctcaggcaagccc

SEQ ID NO: 3394226 - DNA, 20 bp, Homo sapiens
ggctcaggcaagcccctcag

SEQ ID NO: 3394227 - DNA, 11 bp, Homo sapiens
ggctcaggctc

SEQ ID NO: 3394228 - DNA, 16 bp, Homo sapiens
ggctcaggctctgctg

SEQ ID NO: 3394229 - DNA, 14 bp, Homo sapiens
ggctcagtctcagg

SEQ ID NO: 3394230 - DNA, 17 bp, Homo sapiens
ggctcagtctcaggagc

SEQ ID NO: 3394231 - DNA, 20 bp, Homo sapiens
ggctcagtttgtataaactg

SEQ ID NO: 3394232 - DNA, 21 bp, Homo sapiens
ggctcatggcgtaatgggcct

SEQ ID NO: 3394233 - DNA, 23 bp, Homo sapiens
ggctcatggcgtaatgggcctgc

SEQ ID NO: 3394234 - DNA, 16 bp, Homo sapiens
ggctccacttggtctg

SEQ ID NO: 3394235 - DNA, 21 bp, Homo sapiens
ggctccagcatccagcctgtg

SEQ ID NO: 3394236 - DNA, 12 bp, Homo sapiens
ggctccaggact

SEQ ID NO: 3394237 - DNA, 20 bp, Homo sapiens
ggctccaggactccactgga

SEQ ID NO: 3394238 - DNA, 11 bp, Homo sapiens
ggctccaggct

SEQ ID NO: 3394239 - DNA, 13 bp, Homo sapiens
ggctccaggctcc

SEQ ID NO: 3394240 - DNA, 19 bp, Homo sapiens
ggctccatgattctctgag

SEQ ID NO: 3394241 - DNA, 17 bp, Homo sapiens
ggctcccacaggccctt

SEQ ID NO: 3394242 - DNA, 20 bp, Homo sapiens
ggctcccacaggcccttcct

SEQ ID NO: 3394243 - DNA, 20 bp, Homo sapiens
ggctcccaggggtctccctg

SEQ ID NO: 3394244 - DNA, 19 bp, Homo sapiens
ggctcccatgaccatactg

SEQ ID NO: 3394245 - DNA, 13 bp, Homo sapiens
ggctccccacgag

SEQ ID NO: 3394246 - DNA, 21 bp, Homo sapiens
ggctccccacgagtcacctgc

SEQ ID NO: 3394247 - DNA, 22 bp, Homo sapiens
ggctccccacgagtcacctgca

SEQ ID NO: 3394248 - DNA, 23 bp, Homo sapiens
ggctccccacgagtcacctgcaa

SEQ ID NO: 3394249 - DNA, 17 bp, Homo sapiens
ggctccctctctggttt

SEQ ID NO: 3394250 - DNA, 13 bp, Homo sapiens
ggctccctgatga

SEQ ID NO: 3394251 - DNA, 16 bp, Homo sapiens
gggcagatccccactg

SEQ ID NO: 3394252 - DNA, 16 bp, Homo sapiens
gggcagattttcagca

SEQ ID NO: 3394253 - DNA, 22 bp, Homo sapiens
gggcagccacccaagcctgctg

SEQ ID NO: 3394254 - DNA, 12 bp, Homo sapiens
gggcagccagca

SEQ ID NO: 3394255 - DNA, 16 bp, Homo sapiens
gggcagccaggctgcc

SEQ ID NO: 3394256 - DNA, 15 bp, Homo sapiens
gggcagccccagaga

SEQ ID NO: 3394257 - DNA, 16 bp, Homo sapiens
gggcagccccagagag

SEQ ID NO: 3394258 - DNA, 23 bp, Homo sapiens
gggcagccgctaggagagactga

SEQ ID NO: 3394259 - DNA, 19 bp, Homo sapiens
gggcagcctttccagcctc

SEQ ID NO: 3394260 - DNA, 15 bp, Homo sapiens
gggcagcgggccagg

SEQ ID NO: 3394261 - DNA, 17 bp, Homo sapiens
gggcagcgggccaggcc

SEQ ID NO: 3394262 - DNA, 18 bp, Homo sapiens
gggcagcgggccaggccc

SEQ ID NO: 3394263 - DNA, 14 bp, Homo sapiens
gggcagctgaggac

SEQ ID NO: 3394264 - DNA, 12 bp, Homo sapiens
gggcagctgcta

SEQ ID NO: 3394265 - DNA, 14 bp, Homo sapiens
gggcagctgggccc

SEQ ID NO: 3394266 - DNA, 16 bp, Homo sapiens
gggcaggaaggagagc

SEQ ID NO: 3394267 - DNA, 21 bp, Homo sapiens
gggcaggaaggagagcctgct

SEQ ID NO: 3394268 - DNA, 15 bp, Homo sapiens
gggcaggctgggcca

SEQ ID NO: 3394269 - DNA, 18 bp, Homo sapiens
gggcagggtgggcagcct

SEQ ID NO: 3394270 - DNA, 16 bp, Homo sapiens
gggcaggtggtggcac

SEQ ID NO: 3394271 - DNA, 21 bp, Homo sapiens
gggcaggttctgcctgctttg

SEQ ID NO: 3394272 - DNA, 18 bp, Homo sapiens
gggcagtgactggcaggt

SEQ ID NO: 3394273 - DNA, 23 bp, Homo sapiens
gggcagtgctagtgagctgggca

SEQ ID NO: 3394274 - DNA, 22 bp, Homo sapiens
gggcagttctcactcctaggag

SEQ ID NO: 3394275 - DNA, 14 bp, Homo sapiens
gggcatcaggcact

SEQ ID NO: 3394276 - DNA, 16 bp, Homo sapiens
gggcatcaggcactgg

SEQ ID NO: 3394277 - DNA, 19 bp, Homo sapiens
gggcatccacccagtgctg

SEQ ID NO: 3394278 - DNA, 21 bp, Homo sapiens
gggcatccacccagtgctgcc

SEQ ID NO: 3394279 - DNA, 20 bp, Homo sapiens
gggcatccataccagctcgc

SEQ ID NO: 3394280 - DNA, 14 bp, Homo sapiens
gggcatcgcaggag

SEQ ID NO: 3394281 - DNA, 14 bp, Homo sapiens
gggcatctgcccct

SEQ ID NO: 3394282 - DNA, 13 bp, Homo sapiens
gggcatgccttgt

SEQ ID NO: 3394283 - DNA, 17 bp, Homo sapiens
gggcatgctggggcaag

SEQ ID NO: 3394284 - DNA, 14 bp, Homo sapiens
gggcatggcgtgga

SEQ ID NO: 3394285 - DNA, 19 bp, Homo sapiens
gggcatggtaccagccctg

SEQ ID NO: 3394286 - DNA, 21 bp, Homo sapiens
gggcatgtgtgcctgtggcag

SEQ ID NO: 3394287 - DNA, 17 bp, Homo sapiens
gggcattcgggccacag

SEQ ID NO: 3394288 - DNA, 18 bp, Homo sapiens
gggcattcgggccacagg

SEQ ID NO: 3394289 - DNA, 20 bp, Homo sapiens
gggcattcgggccacagggc

SEQ ID NO: 3394290 - DNA, 14 bp, Homo sapiens
gggcattgctttcc

SEQ ID NO: 3394291 - DNA, 16 bp, Homo sapiens
gggccaaacctgggac

SEQ ID NO: 3394292 - DNA, 13 bp, Homo sapiens
gggccaagaaaga

SEQ ID NO: 3394293 - DNA, 15 bp, Homo sapiens
gggccaaggtcctgc

SEQ ID NO: 3394294 - DNA, 23 bp, Homo sapiens
gggccacagagaaagtacttctc

SEQ ID NO: 3394295 - DNA, 17 bp, Homo sapiens
gggccaccaaagctgcc

SEQ ID NO: 3394296 - DNA, 14 bp, Homo sapiens
gggccaccccactc

SEQ ID NO: 3394297 - DNA, 15 bp, Homo sapiens
gggccaccccactct

SEQ ID NO: 3394298 - DNA, 16 bp, Homo sapiens
gggccacctcctcccc

SEQ ID NO: 3394299 - DNA, 18 bp, Homo sapiens
gggccacctcctccccct

SEQ ID NO: 3394300 - DNA, 15 bp, Homo sapiens
gggccacgccccagc

SEQ ID NO: 3394301 - DNA, 17 bp, Homo sapiens
gggccacgccccagccc

SEQ ID NO: 3394302 - DNA, 11 bp, Homo sapiens
gggccactggg

SEQ ID NO: 3394303 - DNA, 22 bp, Homo sapiens
gggccactggggactttattta

SEQ ID NO: 3394304 - DNA, 21 bp, Homo sapiens
gggccactttttttttatact

SEQ ID NO: 3394305 - DNA, 20 bp, Homo sapiens
gggccagaaggagggcagag

SEQ ID NO: 3394306 - DNA, 21 bp, Homo sapiens
gggccagaaggagggcagagc

SEQ ID NO: 3394307 - DNA, 14 bp, Homo sapiens
gggccagccaggcg

SEQ ID NO: 3394308 - DNA, 23 bp, Homo sapiens
gggccagccccacccccagccag

SEQ ID NO: 3394309 - DNA, 13 bp, Homo sapiens
gggccaggaagga

SEQ ID NO: 3394310 - DNA, 13 bp, Homo sapiens
gggccaggcaggt

SEQ ID NO: 3394311 - DNA, 19 bp, Homo sapiens
gggccaggccaggaccaca

SEQ ID NO: 3394312 - DNA, 14 bp, Homo sapiens
gggccaggcccagg

SEQ ID NO: 3394313 - DNA, 14 bp, Homo sapiens
gggccaggcccgca

SEQ ID NO: 3394314 - DNA, 16 bp, Homo sapiens
gggccagggccctgca

SEQ ID NO: 3394315 - DNA, 18 bp, Homo sapiens
gggccagggtctgtgtga

SEQ ID NO: 3394316 - DNA, 18 bp, Homo sapiens
gggccagtcctgcctggc

SEQ ID NO: 3394317 - DNA, 19 bp, Homo sapiens
gggccagtcctgcctggcc

SEQ ID NO: 3394318 - DNA, 22 bp, Homo sapiens
gggccagtctgtggatcagaga

SEQ ID NO: 3394319 - DNA, 19 bp, Homo sapiens
gggccagtggggcctgtgg

SEQ ID NO: 3394320 - DNA, 9 bp, Homo sapiens
gggccatca

SEQ ID NO: 3394321 - DNA, 16 bp, Homo sapiens
gggccatgagggacag

SEQ ID NO: 3394322 - DNA, 15 bp, Homo sapiens
gggccatgctgaggc

SEQ ID NO: 3394323 - DNA, 17 bp, Homo sapiens
gggccatgctgaggcct

SEQ ID NO: 3394324 - DNA, 19 bp, Homo sapiens
gggccatgctgaggcctgg

SEQ ID NO: 3394325 - DNA, 20 bp, Homo sapiens
gggccatgctgaggcctggg

SEQ ID NO: 3394326 - DNA, 16 bp, Homo sapiens
gggccatgtccaaaga

SEQ ID NO: 3394327 - DNA, 17 bp, Homo sapiens
gggccatgtccaaagag

SEQ ID NO: 3394328 - DNA, 19 bp, Homo sapiens
gggcccaagacagatgccc

SEQ ID NO: 3394329 - DNA, 20 bp, Homo sapiens
gggcccaagtccctgttttc

SEQ ID NO: 3394330 - DNA, 18 bp, Homo sapiens
gggcccacccatgtcacc

SEQ ID NO: 3394331 - DNA, 14 bp, Homo sapiens
gggcccacctggcc

SEQ ID NO: 3394332 - DNA, 14 bp, Homo sapiens
gggcccagaggctg

SEQ ID NO: 3394333 - DNA, 11 bp, Homo sapiens
gggcccagccc

SEQ ID NO: 3394334 - DNA, 12 bp, Homo sapiens
gggcccagccca

SEQ ID NO: 3394335 - DNA, 13 bp, Homo sapiens
gggcccagcccag

SEQ ID NO: 3394336 - DNA, 17 bp, Homo sapiens
gggcccagcccagagcc

SEQ ID NO: 3394337 - DNA, 19 bp, Homo sapiens
gggcccagcccagagccac

SEQ ID NO: 3394338 - DNA, 13 bp, Homo sapiens
gggcccagcccct

SEQ ID NO: 3394339 - DNA, 19 bp, Homo sapiens
gggcccaggaagcccacac

SEQ ID NO: 3394340 - DNA, 14 bp, Homo sapiens
gggcccaggaccag

SEQ ID NO: 3394341 - DNA, 16 bp, Homo sapiens
gggcccaggaccagct

SEQ ID NO: 3394342 - DNA, 17 bp, Homo sapiens
gggcccaggaccagctg

SEQ ID NO: 3394343 - DNA, 17 bp, Homo sapiens
gggcccaggggctgtgg

SEQ ID NO: 3394344 - DNA, 16 bp, Homo sapiens
gggccccagaccccag

SEQ ID NO: 3394345 - DNA, 24 bp, Homo sapiens
gggccccagatctgcctgggcctg

SEQ ID NO: 3394346 - DNA, 12 bp, Homo sapiens
gggccccatgct

SEQ ID NO: 3394347 - DNA, 16 bp, Homo sapiens
gggccccatgctctgc

SEQ ID NO: 3394348 - DNA, 17 bp, Homo sapiens
gggccccatgctctgcc

SEQ ID NO: 3394349 - DNA, 18 bp, Homo sapiens
gggccccatgctctgccc

SEQ ID NO: 3394350 - DNA, 22 bp, Homo sapiens
gggccccccagctcaggggcag

SEQ ID NO: 3394351 - DNA, 16 bp, Homo sapiens
gggccccgccagggct

SEQ ID NO: 3394352 - DNA, 19 bp, Homo sapiens
gggccccgccagggctggg

SEQ ID NO: 3394353 - DNA, 21 bp, Homo sapiens
gggccccgccagggctgggga

SEQ ID NO: 3394354 - DNA, 21 bp, Homo sapiens
gggcccctcatcgcgtcctcc

SEQ ID NO: 3394355 - DNA, 13 bp, Homo sapiens
gggcccctccacg

SEQ ID NO: 3394356 - DNA, 18 bp, Homo sapiens
gggcccctccacgcctcc

SEQ ID NO: 3394357 - DNA, 15 bp, Homo sapiens
gggcccctccctctg

SEQ ID NO: 3394358 - DNA, 16 bp, Homo sapiens
gggcccctccctctgc

SEQ ID NO: 3394359 - DNA, 20 bp, Homo sapiens
gggcccctccctctgcccca

SEQ ID NO: 3394360 - DNA, 23 bp, Homo sapiens
gggcccctgggcttggcctgctg

SEQ ID NO: 3394361 - DNA, 23 bp, Homo sapiens
gggcccggccacacccagcggcc

SEQ ID NO: 3394362 - DNA, 21 bp, Homo sapiens
gggccctccgaccacttccag

SEQ ID NO: 3394363 - DNA, 17 bp, Homo sapiens
gggccctctctgcaccg

SEQ ID NO: 3394364 - DNA, 15 bp, Homo sapiens
gggccctgggctgga

SEQ ID NO: 3394365 - DNA, 15 bp, Homo sapiens
gggcccttggggcct

SEQ ID NO: 3394366 - DNA, 18 bp, Homo sapiens
gggcccttggggctgggg

SEQ ID NO: 3394367 - DNA, 18 bp, Homo sapiens
gggccgaatcccccaggg

SEQ ID NO: 3394368 - DNA, 19 bp, Homo sapiens
gggccgaatcccccaggga

SEQ ID NO: 3394369 - DNA, 12 bp, Homo sapiens
gggccgaggagg

SEQ ID NO: 3394370 - DNA, 19 bp, Homo sapiens
gggccgccacggcctggct

SEQ ID NO: 3394371 - DNA, 12 bp, Homo sapiens
gggccgctgcca

SEQ ID NO: 3394372 - DNA, 23 bp, Homo sapiens
gggccgggcaggtcctgcccatg

SEQ ID NO: 3394373 - DNA, 20 bp, Homo sapiens
gggccgtaccccaccctcag

SEQ ID NO: 3394374 - DNA, 22 bp, Homo sapiens
gggcctagatccacacacagag

SEQ ID NO: 3394375 - DNA, 19 bp, Homo sapiens
gggcctcaaaggcccgctc

SEQ ID NO: 3394376 - DNA, 16 bp, Homo sapiens
gggcctcaggctctgc

SEQ ID NO: 3394377 - DNA, 21 bp, Homo sapiens
gggttgaatatagcctgcctc

SEQ ID NO: 3394378 - DNA, 23 bp, Homo sapiens
gggttgaatatagcctgcctcag

SEQ ID NO: 3394379 - DNA, 19 bp, Homo sapiens
gggttgcagtggagaggga

SEQ ID NO: 3394380 - DNA, 19 bp, Homo sapiens
gggttgccacaggcctccc

SEQ ID NO: 3394381 - DNA, 20 bp, Homo sapiens
gggttgcgtcctgacggcgc

SEQ ID NO: 3394382 - DNA, 15 bp, Homo sapiens
gggttgctggagcct

SEQ ID NO: 3394383 - DNA, 16 bp, Homo sapiens
gggttggcccctgccc

SEQ ID NO: 3394384 - DNA, 12 bp, Homo sapiens
gggttgggggca

SEQ ID NO: 3394385 - DNA, 17 bp, Homo sapiens
gggttgggggcactcag

SEQ ID NO: 3394386 - DNA, 18 bp, Homo sapiens
gggttgggggcactcagc

SEQ ID NO: 3394387 - DNA, 19 bp, Homo sapiens
gggttgggggcactcagcc

SEQ ID NO: 3394388 - DNA, 14 bp, Homo sapiens
gggttggtgtgctg

SEQ ID NO: 3394389 - DNA, 15 bp, Homo sapiens
gggttgtgtgtctgt

SEQ ID NO: 3394390 - DNA, 20 bp, Homo sapiens
gggtttcactgtgttagcca

SEQ ID NO: 3394391 - DNA, 15 bp, Homo sapiens
gggtttcctgcaggc

SEQ ID NO: 3394392 - DNA, 17 bp, Homo sapiens
gggtttcgactggtcca

SEQ ID NO: 3394393 - DNA, 18 bp, Homo sapiens
gggtttcgactggtccag

SEQ ID NO: 3394394 - DNA, 20 bp, Homo sapiens
gggtttcgactggtccagct

SEQ ID NO: 3394395 - DNA, 16 bp, Homo sapiens
gggtttgggcccctca

SEQ ID NO: 3394396 - DNA, 17 bp, Homo sapiens
gggttttccgcccacag

SEQ ID NO: 3394397 - DNA, 20 bp, Homo sapiens
gggttttgccatgttggcca

SEQ ID NO: 3394398 - DNA, 16 bp, Homo sapiens
ggtaaaaatgctgctc

SEQ ID NO: 3394399 - DNA, 17 bp, Homo sapiens
ggtaaaagcagggcagc

SEQ ID NO: 3394400 - DNA, 20 bp, Homo sapiens
ggtaaataccaagtatttat

SEQ ID NO: 3394401 - DNA, 15 bp, Homo sapiens
ggtaaatcagtaaga

SEQ ID NO: 3394402 - DNA, 14 bp, Homo sapiens
ggtaacagtggctg

SEQ ID NO: 3394403 - DNA, 22 bp, Homo sapiens
ggtaacgtattggacctgccca

SEQ ID NO: 3394404 - DNA, 23 bp, Homo sapiens
ggtaagagacagaatgtatctgt

SEQ ID NO: 3394405 - DNA, 17 bp, Homo sapiens
ggtaagcaacatggctt

SEQ ID NO: 3394406 - DNA, 20 bp, Homo sapiens
ggtaagccagagcctggggt

SEQ ID NO: 3394407 - DNA, 15 bp, Homo sapiens
ggtaagtcccccagg

SEQ ID NO: 3394408 - DNA, 19 bp, Homo sapiens
ggtaagttgttaagagtgg

SEQ ID NO: 3394409 - DNA, 22 bp, Homo sapiens
ggtaatcaatgaatattgaagt

SEQ ID NO: 3394410 - DNA, 23 bp, Homo sapiens
ggtaatgttttgtatatacagtt

SEQ ID NO: 3394411 - DNA, 20 bp, Homo sapiens
ggtaattgttttttaaagca

SEQ ID NO: 3394412 - DNA, 21 bp, Homo sapiens
ggtaatttgatggtatttctt

SEQ ID NO: 3394413 - DNA, 16 bp, Homo sapiens
ggtacagttgcaggag

SEQ ID NO: 3394414 - DNA, 18 bp, Homo sapiens
ggtacagttgcaggagcg

SEQ ID NO: 3394415 - DNA, 12 bp, Homo sapiens
ggtacagtttgg

SEQ ID NO: 3394416 - DNA, 16 bp, Homo sapiens
ggtacatttatcactg

SEQ ID NO: 3394417 - DNA, 16 bp, Homo sapiens
ggtacccactgctctg

SEQ ID NO: 3394418 - DNA, 17 bp, Homo sapiens
ggtacccactgctctgg

SEQ ID NO: 3394419 - DNA, 12 bp, Homo sapiens
ggtacccagcca

SEQ ID NO: 3394420 - DNA, 16 bp, Homo sapiens
ggtacccccttctggg

SEQ ID NO: 3394421 - DNA, 18 bp, Homo sapiens
ggtaccgtctacatttca

SEQ ID NO: 3394422 - DNA, 14 bp, Homo sapiens
ggtacggtggcacg

SEQ ID NO: 3394423 - DNA, 20 bp, Homo sapiens
ggtactgcattctctcccat

SEQ ID NO: 3394424 - DNA, 22 bp, Homo sapiens
ggtactgcattctctcccatcc

SEQ ID NO: 3394425 - DNA, 14 bp, Homo sapiens
ggtacttcctcctg

SEQ ID NO: 3394426 - DNA, 15 bp, Homo sapiens
ggtacttcctcctga

SEQ ID NO: 3394427 - DNA, 21 bp, Homo sapiens
ggtacttcctcctgatggcca

SEQ ID NO: 3394428 - DNA, 13 bp, Homo sapiens
ggtagaaaaacat

SEQ ID NO: 3394429 - DNA, 16 bp, Homo sapiens
ggtagagacccccagg

SEQ ID NO: 3394430 - DNA, 18 bp, Homo sapiens
ggtagagaggggactggg

SEQ ID NO: 3394431 - DNA, 21 bp, Homo sapiens
ggtagagaggggactggggga

SEQ ID NO: 3394432 - DNA, 16 bp, Homo sapiens
ggtagaggcctggggc

SEQ ID NO: 3394433 - DNA, 16 bp, Homo sapiens
ggtagaggctccccag

SEQ ID NO: 3394434 - DNA, 18 bp, Homo sapiens
ggtagatcacgagatcaa

SEQ ID NO: 3394435 - DNA, 18 bp, Homo sapiens
ggtagatgggtgggggct

SEQ ID NO: 3394436 - DNA, 21 bp, Homo sapiens
ggtagcataaataaaactgaa

SEQ ID NO: 3394437 - DNA, 23 bp, Homo sapiens
ggtagcatgggtccaagagacat

SEQ ID NO: 3394438 - DNA, 13 bp, Homo sapiens
ggtagctcaggtg

SEQ ID NO: 3394439 - DNA, 19 bp, Homo sapiens
ggtaggttcagccaaggtt

SEQ ID NO: 3394440 - DNA, 17 bp, Homo sapiens
ggtaggttgggacacca

SEQ ID NO: 3394441 - DNA, 20 bp, Homo sapiens
ggtagtctcactgcttgaac

SEQ ID NO: 3394442 - DNA, 16 bp, Homo sapiens
ggtagttagtagcatg

SEQ ID NO: 3394443 - DNA, 18 bp, Homo sapiens
ggtagttgcaattgaatt

SEQ ID NO: 3394444 - DNA, 12 bp, Homo sapiens
ggtataaagaca

SEQ ID NO: 3394445 - DNA, 14 bp, Homo sapiens
ggtataatgtttaa

SEQ ID NO: 3394446 - DNA, 13 bp, Homo sapiens
ggtatatactttg

SEQ ID NO: 3394447 - DNA, 16 bp, Homo sapiens
ggtatatccaaaagct

SEQ ID NO: 3394448 - DNA, 15 bp, Homo sapiens
ggtatcaagaaagtc

SEQ ID NO: 3394449 - DNA, 19 bp, Homo sapiens
ggtatcaggtgctgccatc

SEQ ID NO: 3394450 - DNA, 18 bp, Homo sapiens
ggtatccccccatcttgc

SEQ ID NO: 3394451 - DNA, 20 bp, Homo sapiens
ggtatctcagaaagtgcctg

SEQ ID NO: 3394452 - DNA, 21 bp, Homo sapiens
ggtatgattctattatatatt

SEQ ID NO: 3394453 - DNA, 15 bp, Homo sapiens
ggtatgctggccagc

SEQ ID NO: 3394454 - DNA, 16 bp, Homo sapiens
ggtatgctggccagca

SEQ ID NO: 3394455 - DNA, 21 bp, Homo sapiens
ggtatgctggccagcaccctc

SEQ ID NO: 3394456 - DNA, 18 bp, Homo sapiens
ggtatggtggggatattt

SEQ ID NO: 3394457 - DNA, 17 bp, Homo sapiens
ggtattagcaaagcaaa

SEQ ID NO: 3394458 - DNA, 23 bp, Homo sapiens
ggtattagcaaagcaaaaggctg

SEQ ID NO: 3394459 - DNA, 18 bp, Homo sapiens
ggtattattctgttttgc

SEQ ID NO: 3394460 - DNA, 18 bp, Homo sapiens
ggtattccttttgtgtac

SEQ ID NO: 3394461 - DNA, 17 bp, Homo sapiens
ggtattgcactacatta

SEQ ID NO: 3394462 - DNA, 20 bp, Homo sapiens
ggtattgcactacattatgg

SEQ ID NO: 3394463 - DNA, 18 bp, Homo sapiens
ggtattggtggctttcct

SEQ ID NO: 3394464 - DNA, 14 bp, Homo sapiens
ggtatttataatat

SEQ ID NO: 3394465 - DNA, 16 bp, Homo sapiens
ggtattttgaatacca

SEQ ID NO: 3394466 - DNA, 18 bp, Homo sapiens
ggtatttttgccctgagt

SEQ ID NO: 3394467 - DNA, 14 bp, Homo sapiens
ggtcaaaggaagac

SEQ ID NO: 3394468 - DNA, 20 bp, Homo sapiens
ggtcaagattttgaatgctt

SEQ ID NO: 3394469 - DNA, 23 bp, Homo sapiens
ggtcaataaacttagaggaaaat

SEQ ID NO: 3394470 - DNA, 19 bp, Homo sapiens
ggtcacacgaccggggcca

SEQ ID NO: 3394471 - DNA, 16 bp, Homo sapiens
ggtcacagcatggagg

SEQ ID NO: 3394472 - DNA, 21 bp, Homo sapiens
ggtcacagcggaggtgtggag

SEQ ID NO: 3394473 - DNA, 13 bp, Homo sapiens
ggtcacaggccca

SEQ ID NO: 3394474 - DNA, 17 bp, Homo sapiens
ggtcacaggcccagaag

SEQ ID NO: 3394475 - DNA, 14 bp, Homo sapiens
ggtcaccaggggag

SEQ ID NO: 3394476 - DNA, 21 bp, Homo sapiens
ggtcaccaggggaggagcctg

SEQ ID NO: 3394477 - DNA, 19 bp, Homo sapiens
ggtcacccttaatatttat

SEQ ID NO: 3394478 - DNA, 13 bp, Homo sapiens
ggtcactcctggg

SEQ ID NO: 3394479 - DNA, 12 bp, Homo sapiens
ggtcactgctgt

SEQ ID NO: 3394480 - DNA, 13 bp, Homo sapiens
ggtcactggaaag

SEQ ID NO: 3394481 - DNA, 15 bp, Homo sapiens
ggtcagaacatgtta

SEQ ID NO: 3394482 - DNA, 14 bp, Homo sapiens
ggtcagagccactc

SEQ ID NO: 3394483 - DNA, 11 bp, Homo sapiens
ggtcagagcct

SEQ ID NO: 3394484 - DNA, 14 bp, Homo sapiens
ggtcagaggagtga

SEQ ID NO: 3394485 - DNA, 14 bp, Homo sapiens
ggtcagagggccca

SEQ ID NO: 3394486 - DNA, 12 bp, Homo sapiens
ggtcagatggag

SEQ ID NO: 3394487 - DNA, 21 bp, Homo sapiens
ggtcagcatgtctattcagct

SEQ ID NO: 3394488 - DNA, 18 bp, Homo sapiens
ggtcagctcccttctctg

SEQ ID NO: 3394489 - DNA, 22 bp, Homo sapiens
ggtcaggatgcacatttctgga

SEQ ID NO: 3394490 - DNA, 16 bp, Homo sapiens
ggtcaggccctggaac

SEQ ID NO: 3394491 - DNA, 15 bp, Homo sapiens
ggtcaggctgggcag

SEQ ID NO: 3394492 - DNA, 20 bp, Homo sapiens
ggtcaggctgggcagcccca

SEQ ID NO: 3394493 - DNA, 13 bp, Homo sapiens
ggtcagggccaga

SEQ ID NO: 3394494 - DNA, 14 bp, Homo sapiens
ggtcagggccagac

SEQ ID NO: 3394495 - DNA, 20 bp, Homo sapiens
ggtcagggccagactggaag

SEQ ID NO: 3394496 - DNA, 19 bp, Homo sapiens
ggtcaggtttaacatttgc

SEQ ID NO: 3394497 - DNA, 13 bp, Homo sapiens
ggtcagtgccttt

SEQ ID NO: 3394498 - DNA, 22 bp, Homo sapiens
ggtcagtgccttttggaactgt

SEQ ID NO: 3394499 - DNA, 16 bp, Homo sapiens
ggtcattgacctctca

SEQ ID NO: 3394500 - DNA, 21 bp, Homo sapiens
ggtccaaaaaaaggaaaaata

SEQ ID NO: 3394501 - DNA, 13 bp, Homo sapiens
ggtccaagagaca

SEQ ID NO: 3394502 - DNA, 14 bp, Homo sapiens
ggtccaagagacat

SEQ ID NO: 3394503 - DNA, 11 bp, Homo sapiens
gtaaaaagaaa

SEQ ID NO: 3394504 - DNA, 18 bp, Homo sapiens
gtaaaaataaaatacttt

SEQ ID NO: 3394505 - DNA, 14 bp, Homo sapiens
gtaaaaatacacta

SEQ ID NO: 3394506 - DNA, 14 bp, Homo sapiens
gtaaaacaaaattt

SEQ ID NO: 3394507 - DNA, 20 bp, Homo sapiens
gtaaaacagggccacataga

SEQ ID NO: 3394508 - DNA, 21 bp, Homo sapiens
gtaaaactacacatccctaat

SEQ ID NO: 3394509 - DNA, 16 bp, Homo sapiens
gtaaaactcgctttta

SEQ ID NO: 3394510 - DNA, 23 bp, Homo sapiens
gtaaaagaaaattttttttcaaa

SEQ ID NO: 3394511 - DNA, 13 bp, Homo sapiens
gtaaaatactttt

SEQ ID NO: 3394512 - DNA, 17 bp, Homo sapiens
gtaaaatgtatttttct

SEQ ID NO: 3394513 - DNA, 23 bp, Homo sapiens
gtaaaattataaacttttatact

SEQ ID NO: 3394514 - DNA, 14 bp, Homo sapiens
gtaaacaaactctt

SEQ ID NO: 3394515 - DNA, 19 bp, Homo sapiens
gtaaacaaactcttgaaga

SEQ ID NO: 3394516 - DNA, 19 bp, Homo sapiens
gtaaacacagtcaaaataa

SEQ ID NO: 3394517 - DNA, 19 bp, Homo sapiens
gtaaacagatggcactttg

SEQ ID NO: 3394518 - DNA, 14 bp, Homo sapiens
gtaaacatgtgttt

SEQ ID NO: 3394519 - DNA, 14 bp, Homo sapiens
gtaaacgacactct

SEQ ID NO: 3394520 - DNA, 22 bp, Homo sapiens
gtaaacgggaacatgccccctg

SEQ ID NO: 3394521 - DNA, 16 bp, Homo sapiens
gtaaacgtttcagtaa

SEQ ID NO: 3394522 - DNA, 23 bp, Homo sapiens
gtaaacgtttcagtaataaaaca

SEQ ID NO: 3394523 - DNA, 18 bp, Homo sapiens
gtaaactggaattaaaag

SEQ ID NO: 3394524 - DNA, 21 bp, Homo sapiens
gtaaactgtatcaaatctgta

SEQ ID NO: 3394525 - DNA, 12 bp, Homo sapiens
gtaaacttctga

SEQ ID NO: 3394526 - DNA, 13 bp, Homo sapiens
gtaaacttctgaa

SEQ ID NO: 3394527 - DNA, 14 bp, Homo sapiens
gtaaagaaatttac

SEQ ID NO: 3394528 - DNA, 14 bp, Homo sapiens
gtaaagagaaactt

SEQ ID NO: 3394529 - DNA, 19 bp, Homo sapiens
gtaaagagaaactttgtgc

SEQ ID NO: 3394530 - DNA, 21 bp, Homo sapiens
gtaaagatgtttatttcaggc

SEQ ID NO: 3394531 - DNA, 14 bp, Homo sapiens
gtaaagctggccct

SEQ ID NO: 3394532 - DNA, 16 bp, Homo sapiens
gtaaagctggccctgc

SEQ ID NO: 3394533 - DNA, 17 bp, Homo sapiens
gtaaagcttaaattgct

SEQ ID NO: 3394534 - DNA, 16 bp, Homo sapiens
gtaaagtatgtaaaca

SEQ ID NO: 3394535 - DNA, 13 bp, Homo sapiens
gtaaataaaaaga

SEQ ID NO: 3394536 - DNA, 23 bp, Homo sapiens
gtaaataaaatgtgtacagtgaa

SEQ ID NO: 3394537 - DNA, 12 bp, Homo sapiens
gtaaataaactg

SEQ ID NO: 3394538 - DNA, 14 bp, Homo sapiens
gtaaataaactgtt

SEQ ID NO: 3394539 - DNA, 15 bp, Homo sapiens
gtaaataaactgttt

SEQ ID NO: 3394540 - DNA, 16 bp, Homo sapiens
gtaaataaactgttta

SEQ ID NO: 3394541 - DNA, 20 bp, Homo sapiens
gtaaataaccccattctttg

SEQ ID NO: 3394542 - DNA, 21 bp, Homo sapiens
gtaaataaccccattctttgc

SEQ ID NO: 3394543 - DNA, 16 bp, Homo sapiens
gtaaataagagatttg

SEQ ID NO: 3394544 - DNA, 15 bp, Homo sapiens
gtaaatacaagactg

SEQ ID NO: 3394545 - DNA, 16 bp, Homo sapiens
gtaaatacaagactgt

SEQ ID NO: 3394546 - DNA, 17 bp, Homo sapiens
gtaaatacaagactgtt

SEQ ID NO: 3394547 - DNA, 12 bp, Homo sapiens
gtaaatacacca

SEQ ID NO: 3394548 - DNA, 14 bp, Homo sapiens
gtaaataggaattg

SEQ ID NO: 3394549 - DNA, 22 bp, Homo sapiens
gtaaatagtttgaattcagtaa

SEQ ID NO: 3394550 - DNA, 15 bp, Homo sapiens
gtaaatatgaatctg

SEQ ID NO: 3394551 - DNA, 23 bp, Homo sapiens
gtaaatatgaatctgctcacttt

SEQ ID NO: 3394552 - DNA, 11 bp, Homo sapiens
gtaaatattta

SEQ ID NO: 3394553 - DNA, 22 bp, Homo sapiens
gtaaatattttcaaagagatgg

SEQ ID NO: 3394554 - DNA, 21 bp, Homo sapiens
gtaaatcctagacttgaaagt

SEQ ID NO: 3394555 - DNA, 22 bp, Homo sapiens
gtaaatcctagacttgaaagtt

SEQ ID NO: 3394556 - DNA, 17 bp, Homo sapiens
gtaaatcctgccattta

SEQ ID NO: 3394557 - DNA, 20 bp, Homo sapiens
gtaaatcctgccatttaaaa

SEQ ID NO: 3394558 - DNA, 16 bp, Homo sapiens
gtaaatcctttttctt

SEQ ID NO: 3394559 - DNA, 12 bp, Homo sapiens
gtaaatctgcca

SEQ ID NO: 3394560 - DNA, 14 bp, Homo sapiens
gtaaattaggaggc

SEQ ID NO: 3394561 - DNA, 13 bp, Homo sapiens
gtaaattgaactt

SEQ ID NO: 3394562 - DNA, 19 bp, Homo sapiens
gtaaattgaatcagtataa

SEQ ID NO: 3394563 - DNA, 12 bp, Homo sapiens
gtaacaagaaaa

SEQ ID NO: 3394564 - DNA, 15 bp, Homo sapiens
gtaacaagaaaacat

SEQ ID NO: 3394565 - DNA, 16 bp, Homo sapiens
gtaacaagccacccca

SEQ ID NO: 3394566 - DNA, 18 bp, Homo sapiens
gtaacaatacatgagaaa

SEQ ID NO: 3394567 - DNA, 20 bp, Homo sapiens
gtaacaatacatgagaaaga

SEQ ID NO: 3394568 - DNA, 22 bp, Homo sapiens
gtaacacagctgagagactttt

SEQ ID NO: 3394569 - DNA, 22 bp, Homo sapiens
gtaacagaacagcttcaggtta

SEQ ID NO: 3394570 - DNA, 22 bp, Homo sapiens
gtaacagctctcttcttactca

SEQ ID NO: 3394571 - DNA, 16 bp, Homo sapiens
gtaacagctgaggtct

SEQ ID NO: 3394572 - DNA, 17 bp, Homo sapiens
gtaacagttcatgtttg

SEQ ID NO: 3394573 - DNA, 18 bp, Homo sapiens
gtaacagttcatgtttgc

SEQ ID NO: 3394574 - DNA, 20 bp, Homo sapiens
gtaacatcactatccatgca

SEQ ID NO: 3394575 - DNA, 18 bp, Homo sapiens
gtaacatcataattacat

SEQ ID NO: 3394576 - DNA, 20 bp, Homo sapiens
gtaacatgcatactttattg

SEQ ID NO: 3394577 - DNA, 15 bp, Homo sapiens
gtaacatttctgttc

SEQ ID NO: 3394578 - DNA, 17 bp, Homo sapiens
gtaacatttctgttctc

SEQ ID NO: 3394579 - DNA, 22 bp, Homo sapiens
gtaacatttgctgttttaaaca

SEQ ID NO: 3394580 - DNA, 23 bp, Homo sapiens
gtaacccagattttgctgtatat

SEQ ID NO: 3394581 - DNA, 17 bp, Homo sapiens
gtaacctcagctctggg

SEQ ID NO: 3394582 - DNA, 16 bp, Homo sapiens
gtaacgcgtcttcctg

SEQ ID NO: 3394583 - DNA, 17 bp, Homo sapiens
gtaacgcgtcttcctga

SEQ ID NO: 3394584 - DNA, 21 bp, Homo sapiens
gtaactaattttgttgaaaat

SEQ ID NO: 3394585 - DNA, 10 bp, Homo sapiens
gtaactacaa

SEQ ID NO: 3394586 - DNA, 20 bp, Homo sapiens
gtaactacaaagctttgcta

SEQ ID NO: 3394587 - DNA, 12 bp, Homo sapiens
gtaactacttta

SEQ ID NO: 3394588 - DNA, 22 bp, Homo sapiens
gtaactcaccgtgctgtcttct

SEQ ID NO: 3394589 - DNA, 18 bp, Homo sapiens
gtaactccagatagagaa

SEQ ID NO: 3394590 - DNA, 18 bp, Homo sapiens
gtaactgctgagccactc

SEQ ID NO: 3394591 - DNA, 22 bp, Homo sapiens
gtaactgctgagccactcgcag

SEQ ID NO: 3394592 - DNA, 14 bp, Homo sapiens
gtaactgctttctg

SEQ ID NO: 3394593 - DNA, 16 bp, Homo sapiens
gtaacttaaggacctt

SEQ ID NO: 3394594 - DNA, 22 bp, Homo sapiens
gtaacttatgtagatatttggc

SEQ ID NO: 3394595 - DNA, 21 bp, Homo sapiens
gtaactttactctgtgtttaa

SEQ ID NO: 3394596 - DNA, 12 bp, Homo sapiens
gtaactttatgt

SEQ ID NO: 3394597 - DNA, 19 bp, Homo sapiens
gtaacttttgtaaatacac

SEQ ID NO: 3394598 - DNA, 22 bp, Homo sapiens
gtaacttttttgtgtatgtact

SEQ ID NO: 3394599 - DNA, 17 bp, Homo sapiens
gtaagaaaagtggttgt

SEQ ID NO: 3394600 - DNA, 18 bp, Homo sapiens
gtaagaaaccgaggcgat

SEQ ID NO: 3394601 - DNA, 23 bp, Homo sapiens
gtaagaacaactacctgagctaa

SEQ ID NO: 3394602 - DNA, 20 bp, Homo sapiens
gtaagaacatccctgtctta

SEQ ID NO: 3394603 - DNA, 13 bp, Homo sapiens
gtaagaagagact

SEQ ID NO: 3394604 - DNA, 13 bp, Homo sapiens
gtaagaattctga

SEQ ID NO: 3394605 - DNA, 14 bp, Homo sapiens
gtaagacatttgta

SEQ ID NO: 3394606 - DNA, 20 bp, Homo sapiens
gtaagacttttattaataaa

SEQ ID NO: 3394607 - DNA, 19 bp, Homo sapiens
gtaagagaaaagagagaaa

SEQ ID NO: 3394608 - DNA, 23 bp, Homo sapiens
gtaagagacagaatgtatctgtg

SEQ ID NO: 3394609 - DNA, 23 bp, Homo sapiens
gtaagagtactgggagaatcact

SEQ ID NO: 3394610 - DNA, 14 bp, Homo sapiens
gtaagagtgtagaa

SEQ ID NO: 3394611 - DNA, 15 bp, Homo sapiens
gtaagagtgtagaag

SEQ ID NO: 3394612 - DNA, 17 bp, Homo sapiens
gtaagagtgtagaagca

SEQ ID NO: 3394613 - DNA, 22 bp, Homo sapiens
gtaagatatctcaatgaaccat

SEQ ID NO: 3394614 - DNA, 16 bp, Homo sapiens
gtaagatccaccccct

SEQ ID NO: 3394615 - DNA, 23 bp, Homo sapiens
gtaagattatagattctaaagat

SEQ ID NO: 3394616 - DNA, 20 bp, Homo sapiens
gtaagctctttgaaacaact

SEQ ID NO: 3394617 - DNA, 19 bp, Homo sapiens
gtaaggatccggaaagaag

SEQ ID NO: 3394618 - DNA, 14 bp, Homo sapiens
gtaaggctctagat

SEQ ID NO: 3394619 - DNA, 16 bp, Homo sapiens
gtaagggatttcttag

SEQ ID NO: 3394620 - DNA, 11 bp, Homo sapiens
gtaagggcagt

SEQ ID NO: 3394621 - DNA, 12 bp, Homo sapiens
gtaagggcagtg

SEQ ID NO: 3394622 - DNA, 15 bp, Homo sapiens
gtaagggcagtgccc

SEQ ID NO: 3394623 - DNA, 16 bp, Homo sapiens
gtaaggtgcagttccc

SEQ ID NO: 3394624 - DNA, 17 bp, Homo sapiens
gtaaggtgcttggagtt

SEQ ID NO: 3394625 - DNA, 23 bp, Homo sapiens
gtaagtaattatcgggaacagtg

SEQ ID NO: 3394626 - DNA, 18 bp, Homo sapiens
gtaagtaccactcaggcc

SEQ ID NO: 3394627 - DNA, 13 bp, Homo sapiens
gtaagtacttcca

SEQ ID NO: 3394628 - DNA, 22 bp, Homo sapiens
gtaagtattcttatttaatgaa

SEQ ID NO: 3394629 - DNA, 22 bp, Homo sapiens
gtatatattttgtgtgaaattg

SEQ ID NO: 3394630 - DNA, 14 bp, Homo sapiens
gtatatcagaaaag

SEQ ID NO: 3394631 - DNA, 20 bp, Homo sapiens
gtatatctcttggaaaataa

SEQ ID NO: 3394632 - DNA, 17 bp, Homo sapiens
gtatatctggacaagcc

SEQ ID NO: 3394633 - DNA, 21 bp, Homo sapiens
gtatatctgggctggccagtt

SEQ ID NO: 3394634 - DNA, 12 bp, Homo sapiens
gtatatgaaaac

SEQ ID NO: 3394635 - DNA, 15 bp, Homo sapiens
gtatatgaaaacaag

SEQ ID NO: 3394636 - DNA, 15 bp, Homo sapiens
gtatatgtattccct

SEQ ID NO: 3394637 - DNA, 16 bp, Homo sapiens
gtatatgtattccctt

SEQ ID NO: 3394638 - DNA, 20 bp, Homo sapiens
gtatatgtattcccttgtat

SEQ ID NO: 3394639 - DNA, 21 bp, Homo sapiens
gtatatgtattcccttgtatt

SEQ ID NO: 3394640 - DNA, 19 bp, Homo sapiens
gtatatgtgaaaaaaatga

SEQ ID NO: 3394641 - DNA, 16 bp, Homo sapiens
gtatatgttgggtgca

SEQ ID NO: 3394642 - DNA, 13 bp, Homo sapiens
gtatatgttgtaa

SEQ ID NO: 3394643 - DNA, 17 bp, Homo sapiens
gtatattacacatttgt

SEQ ID NO: 3394644 - DNA, 18 bp, Homo sapiens
gtatattacacatttgta

SEQ ID NO: 3394645 - DNA, 22 bp, Homo sapiens
gtatattacacatttgtacaga

SEQ ID NO: 3394646 - DNA, 21 bp, Homo sapiens
gtatattatgtatttatattt

SEQ ID NO: 3394647 - DNA, 15 bp, Homo sapiens
gtatattatttggca

SEQ ID NO: 3394648 - DNA, 15 bp, Homo sapiens
gtatattcatatatt

SEQ ID NO: 3394649 - DNA, 22 bp, Homo sapiens
gtatattctttggttgtgaatc

SEQ ID NO: 3394650 - DNA, 14 bp, Homo sapiens
gtatattgagaatc

SEQ ID NO: 3394651 - DNA, 12 bp, Homo sapiens
gtatattggaag

SEQ ID NO: 3394652 - DNA, 19 bp, Homo sapiens
gtatattgtgtttgtgtat

SEQ ID NO: 3394653 - DNA, 14 bp, Homo sapiens
gtatatttctcata

SEQ ID NO: 3394654 - DNA, 18 bp, Homo sapiens
gtatatttggtttctaga

SEQ ID NO: 3394655 - DNA, 13 bp, Homo sapiens
gtatatttgtaca

SEQ ID NO: 3394656 - DNA, 14 bp, Homo sapiens
gtatatttgtatat

SEQ ID NO: 3394657 - DNA, 18 bp, Homo sapiens
gtatatttgttgggaaag

SEQ ID NO: 3394658 - DNA, 23 bp, Homo sapiens
gtatatttttatattgtttttgt

SEQ ID NO: 3394659 - DNA, 17 bp, Homo sapiens
gtatcagaggcctataa

SEQ ID NO: 3394660 - DNA, 15 bp, Homo sapiens
gtatcaggtctccca

SEQ ID NO: 3394661 - DNA, 19 bp, Homo sapiens
gtatcagtgttttaaattc

SEQ ID NO: 3394662 - DNA, 23 bp, Homo sapiens
gtatcagtgttttaaattctgag

SEQ ID NO: 3394663 - DNA, 19 bp, Homo sapiens
gtatcccatgagcctcagc

SEQ ID NO: 3394664 - DNA, 19 bp, Homo sapiens
gtatcccgagtctgggaca

SEQ ID NO: 3394665 - DNA, 20 bp, Homo sapiens
gtatcccgagtctgggacac

SEQ ID NO: 3394666 - DNA, 17 bp, Homo sapiens
gtatcccttctcacagc

SEQ ID NO: 3394667 - DNA, 23 bp, Homo sapiens
gtatccgactctaagctgtgtgc

SEQ ID NO: 3394668 - DNA, 17 bp, Homo sapiens
gtatcctccctggcaga

SEQ ID NO: 3394669 - DNA, 19 bp, Homo sapiens
gtatcctccctggcagaca

SEQ ID NO: 3394670 - DNA, 18 bp, Homo sapiens
gtatcctgggggacccaa

SEQ ID NO: 3394671 - DNA, 14 bp, Homo sapiens
gtatcgatgtttta

SEQ ID NO: 3394672 - DNA, 17 bp, Homo sapiens
gtatcggagacagtgat

SEQ ID NO: 3394673 - DNA, 21 bp, Homo sapiens
gtatctaagaataataaaatc

SEQ ID NO: 3394674 - DNA, 16 bp, Homo sapiens
gtatctagtgcagctg

SEQ ID NO: 3394675 - DNA, 17 bp, Homo sapiens
gtatctagtgcagctga

SEQ ID NO: 3394676 - DNA, 18 bp, Homo sapiens
gtatctagtgcagctgat

SEQ ID NO: 3394677 - DNA, 20 bp, Homo sapiens
gtatctcagaaagtgcctga

SEQ ID NO: 3394678 - DNA, 21 bp, Homo sapiens
gtatctcaggaagtccagcca

SEQ ID NO: 3394679 - DNA, 19 bp, Homo sapiens
gtatctctgaagcatgttt

SEQ ID NO: 3394680 - DNA, 12 bp, Homo sapiens
gtatctgagcag

SEQ ID NO: 3394681 - DNA, 17 bp, Homo sapiens
gtatctgagttgccaag

SEQ ID NO: 3394682 - DNA, 22 bp, Homo sapiens
gtatctgagttgccaagacaaa

SEQ ID NO: 3394683 - DNA, 18 bp, Homo sapiens
gtatctgggattattctt

SEQ ID NO: 3394684 - DNA, 18 bp, Homo sapiens
gtatctgggtaagaagaa

SEQ ID NO: 3394685 - DNA, 20 bp, Homo sapiens
gtatctgtgaagtagttctg

SEQ ID NO: 3394686 - DNA, 22 bp, Homo sapiens
gtatcttccatatttggaagaa

SEQ ID NO: 3394687 - DNA, 21 bp, Homo sapiens
gtatcttcctttcttgtcttt

SEQ ID NO: 3394688 - DNA, 18 bp, Homo sapiens
gtatcttggggcaagact

SEQ ID NO: 3394689 - DNA, 14 bp, Homo sapiens
gtatcttttctttc

SEQ ID NO: 3394690 - DNA, 21 bp, Homo sapiens
gtatgaaaatccttttaacca

SEQ ID NO: 3394691 - DNA, 20 bp, Homo sapiens
gtatgaaaatgagttgtgaa

SEQ ID NO: 3394692 - DNA, 19 bp, Homo sapiens
gtatgaagagcttgctttg

SEQ ID NO: 3394693 - DNA, 15 bp, Homo sapiens
gtatgaataattgca

SEQ ID NO: 3394694 - DNA, 20 bp, Homo sapiens
gtatgatcacggctcactgc

SEQ ID NO: 3394695 - DNA, 16 bp, Homo sapiens
gtatgatgtgttgtga

SEQ ID NO: 3394696 - DNA, 21 bp, Homo sapiens
gtatgatttgttttgaatttt

SEQ ID NO: 3394697 - DNA, 23 bp, Homo sapiens
gtatgatttgttttgaattttgt

SEQ ID NO: 3394698 - DNA, 17 bp, Homo sapiens
gtatgccacacctggcc

SEQ ID NO: 3394699 - DNA, 21 bp, Homo sapiens
gtatgccttctgtattttaat

SEQ ID NO: 3394700 - DNA, 22 bp, Homo sapiens
gtatgcctttaaatctgtgatg

SEQ ID NO: 3394701 - DNA, 13 bp, Homo sapiens
gtatgctgatcat

SEQ ID NO: 3394702 - DNA, 21 bp, Homo sapiens
gtatgctgatcatcgccagag

SEQ ID NO: 3394703 - DNA, 13 bp, Homo sapiens
gtatgctggccag

SEQ ID NO: 3394704 - DNA, 15 bp, Homo sapiens
gtatgctggccagca

SEQ ID NO: 3394705 - DNA, 23 bp, Homo sapiens
gtatgctggccagcaccctctcc

SEQ ID NO: 3394706 - DNA, 21 bp, Homo sapiens
gtatggaaaaaccatttgaag

SEQ ID NO: 3394707 - DNA, 17 bp, Homo sapiens
gtatggaaatgcaccct

SEQ ID NO: 3394708 - DNA, 14 bp, Homo sapiens
gtatggtcaggatg

SEQ ID NO: 3394709 - DNA, 13 bp, Homo sapiens
gtatggtggctgg

SEQ ID NO: 3394710 - DNA, 15 bp, Homo sapiens
gtatggttgacacta

SEQ ID NO: 3394711 - DNA, 22 bp, Homo sapiens
gtatgtaatgtgtggtggcctc

SEQ ID NO: 3394712 - DNA, 23 bp, Homo sapiens
gtatgtaatgtgtggtggcctca

SEQ ID NO: 3394713 - DNA, 23 bp, Homo sapiens
gtatgtacttagctgtactataa

SEQ ID NO: 3394714 - DNA, 13 bp, Homo sapiens
gtatgtcaaagct

SEQ ID NO: 3394715 - DNA, 23 bp, Homo sapiens
gtatgtgaaagtgtaaaatagaa

SEQ ID NO: 3394716 - DNA, 11 bp, Homo sapiens
gtatgtgaaca

SEQ ID NO: 3394717 - DNA, 23 bp, Homo sapiens
gtatgtgacaccaaagccacctc

SEQ ID NO: 3394718 - DNA, 16 bp, Homo sapiens
gtatgtgcactgtcac

SEQ ID NO: 3394719 - DNA, 20 bp, Homo sapiens
gtatgtgctatacacacaca

SEQ ID NO: 3394720 - DNA, 21 bp, Homo sapiens
gtatgtgtggtttcagttctg

SEQ ID NO: 3394721 - DNA, 21 bp, Homo sapiens
gtatgttatgatattgtttaa

SEQ ID NO: 3394722 - DNA, 13 bp, Homo sapiens
gtatgttcctaag

SEQ ID NO: 3394723 - DNA, 18 bp, Homo sapiens
gtatgttgtacaatcaaa

SEQ ID NO: 3394724 - DNA, 18 bp, Homo sapiens
gtattaaaactaaatttc

SEQ ID NO: 3394725 - DNA, 18 bp, Homo sapiens
gtattaaaagttgcattt

SEQ ID NO: 3394726 - DNA, 22 bp, Homo sapiens
gtattaaatcttaaacaatgta

SEQ ID NO: 3394727 - DNA, 13 bp, Homo sapiens
gtattaataaaaa

SEQ ID NO: 3394728 - DNA, 18 bp, Homo sapiens
gtattaataaaaagacaa

SEQ ID NO: 3394729 - DNA, 12 bp, Homo sapiens
gtattaataaag

SEQ ID NO: 3394730 - DNA, 14 bp, Homo sapiens
gtattaataaagca

SEQ ID NO: 3394731 - DNA, 15 bp, Homo sapiens
gtattaataaagcat

SEQ ID NO: 3394732 - DNA, 19 bp, Homo sapiens
gtattaatactaaaatatg

SEQ ID NO: 3394733 - DNA, 14 bp, Homo sapiens
gtattaatatatag

SEQ ID NO: 3394734 - DNA, 19 bp, Homo sapiens
gtattacacagtcaaattt

SEQ ID NO: 3394735 - DNA, 22 bp, Homo sapiens
gtattacactgtatttgtatct

SEQ ID NO: 3394736 - DNA, 20 bp, Homo sapiens
gtattacttaggttattttg

SEQ ID NO: 3394737 - DNA, 13 bp, Homo sapiens
gtattactttaat

SEQ ID NO: 3394738 - DNA, 20 bp, Homo sapiens
gtattagtatggttcaagat

SEQ ID NO: 3394739 - DNA, 16 bp, Homo sapiens
gtattatgtctcttct

SEQ ID NO: 3394740 - DNA, 15 bp, Homo sapiens
gtattattctgtttt

SEQ ID NO: 3394741 - DNA, 22 bp, Homo sapiens
gtattcagtgagggtcttctta

SEQ ID NO: 3394742 - DNA, 21 bp, Homo sapiens
gtattcatgaaaactgttttt

SEQ ID NO: 3394743 - DNA, 21 bp, Homo sapiens
gtattcccaaaaattactttg

SEQ ID NO: 3394744 - DNA, 22 bp, Homo sapiens
gtattcccttgtattttgttaa

SEQ ID NO: 3394745 - DNA, 13 bp, Homo sapiens
gtattcctgaaaa

SEQ ID NO: 3394746 - DNA, 20 bp, Homo sapiens
gtattccttttgtgtacagt

SEQ ID NO: 3394747 - DNA, 15 bp, Homo sapiens
gtattcttatttaat

SEQ ID NO: 3394748 - DNA, 20 bp, Homo sapiens
gtattcttttccaagctcct

SEQ ID NO: 3394749 - DNA, 15 bp, Homo sapiens
gtattgaaaacttca

SEQ ID NO: 3394750 - DNA, 17 bp, Homo sapiens
gtattgaaaacttcaaa

SEQ ID NO: 3394751 - DNA, 18 bp, Homo sapiens
gtattgaaaacttcaaag

SEQ ID NO: 3394752 - DNA, 15 bp, Homo sapiens
gtattgactgtacca

SEQ ID NO: 3394753 - DNA, 14 bp, Homo sapiens
gtattgcacattgt

SEQ ID NO: 3394754 - DNA, 14 bp, Homo sapiens
gtcctagtaagaag

SEQ ID NO: 3394755 - DNA, 17 bp, Homo sapiens
gtcctagtaagaagaca

SEQ ID NO: 3394756 - DNA, 19 bp, Homo sapiens
gtcctatctcccccaaccc

SEQ ID NO: 3394757 - DNA, 14 bp, Homo sapiens
gtcctcactcccag

SEQ ID NO: 3394758 - DNA, 18 bp, Homo sapiens
gtcctcactgctccctga

SEQ ID NO: 3394759 - DNA, 19 bp, Homo sapiens
gtcctcactgctccctgaa

SEQ ID NO: 3394760 - DNA, 13 bp, Homo sapiens
gtcctcagggagc

SEQ ID NO: 3394761 - DNA, 18 bp, Homo sapiens
gtcctccacacaagggaa

SEQ ID NO: 3394762 - DNA, 20 bp, Homo sapiens
gtcctccactcgacccagaa

SEQ ID NO: 3394763 - DNA, 21 bp, Homo sapiens
gtcctccactcgacccagaat

SEQ ID NO: 3394764 - DNA, 19 bp, Homo sapiens
gtcctccagaagcctctgg

SEQ ID NO: 3394765 - DNA, 21 bp, Homo sapiens
gtcctccagaagcctctggct

SEQ ID NO: 3394766 - DNA, 22 bp, Homo sapiens
gtcctccatcccaacagccatg

SEQ ID NO: 3394767 - DNA, 17 bp, Homo sapiens
gtcctcccatcccctgg

SEQ ID NO: 3394768 - DNA, 19 bp, Homo sapiens
gtcctcccatcccctggac

SEQ ID NO: 3394769 - DNA, 22 bp, Homo sapiens
gtcctcctaccgaaaccttgcc

SEQ ID NO: 3394770 - DNA, 19 bp, Homo sapiens
gtcctcctggaagggacct

SEQ ID NO: 3394771 - DNA, 23 bp, Homo sapiens
gtcctcgttcaaaacattccaag

SEQ ID NO: 3394772 - DNA, 23 bp, Homo sapiens
gtcctctcagttctctcccttcc

SEQ ID NO: 3394773 - DNA, 17 bp, Homo sapiens
gtcctctcccctccagc

SEQ ID NO: 3394774 - DNA, 21 bp, Homo sapiens
gtcctctcccctccagccttt

SEQ ID NO: 3394775 - DNA, 18 bp, Homo sapiens
gtcctcttccctctctgc

SEQ ID NO: 3394776 - DNA, 21 bp, Homo sapiens
gtcctctttactcccttcctg

SEQ ID NO: 3394777 - DNA, 17 bp, Homo sapiens
gtcctctttagtttttg

SEQ ID NO: 3394778 - DNA, 16 bp, Homo sapiens
gtcctgaagaggcggg

SEQ ID NO: 3394779 - DNA, 21 bp, Homo sapiens
gtcctgaagaggcgggccagc

SEQ ID NO: 3394780 - DNA, 15 bp, Homo sapiens
gtcctgaccaccctc

SEQ ID NO: 3394781 - DNA, 17 bp, Homo sapiens
gtcctgaccaccctccc

SEQ ID NO: 3394782 - DNA, 19 bp, Homo sapiens
gtcctgaccaccctcccct

SEQ ID NO: 3394783 - DNA, 20 bp, Homo sapiens
gtcctgagatggaaaagtgt

SEQ ID NO: 3394784 - DNA, 18 bp, Homo sapiens
gtcctgagggtccccacc

SEQ ID NO: 3394785 - DNA, 12 bp, Homo sapiens
gtcctgcagagg

SEQ ID NO: 3394786 - DNA, 13 bp, Homo sapiens
gtcctgcagagga

SEQ ID NO: 3394787 - DNA, 15 bp, Homo sapiens
gtcctgccagctgcc

SEQ ID NO: 3394788 - DNA, 18 bp, Homo sapiens
gtcctgcccatgccccag

SEQ ID NO: 3394789 - DNA, 17 bp, Homo sapiens
gtcctgcccatgtgtcc

SEQ ID NO: 3394790 - DNA, 17 bp, Homo sapiens
gtcctgcctcagcctcc

SEQ ID NO: 3394791 - DNA, 14 bp, Homo sapiens
gtcctgcctggcca

SEQ ID NO: 3394792 - DNA, 13 bp, Homo sapiens
gtcctgcctgtgg

SEQ ID NO: 3394793 - DNA, 22 bp, Homo sapiens
gtcctgctccagaatttggaaa

SEQ ID NO: 3394794 - DNA, 17 bp, Homo sapiens
gtcctgctggcttccag

SEQ ID NO: 3394795 - DNA, 23 bp, Homo sapiens
gtcctgctggcttccagcttcag

SEQ ID NO: 3394796 - DNA, 13 bp, Homo sapiens
gtcctgcttctga

SEQ ID NO: 3394797 - DNA, 21 bp, Homo sapiens
gtcctggaagcgcgagggcct

SEQ ID NO: 3394798 - DNA, 22 bp, Homo sapiens
gtcctggccagatggcccggat

SEQ ID NO: 3394799 - DNA, 17 bp, Homo sapiens
gtcctggctacatccca

SEQ ID NO: 3394800 - DNA, 21 bp, Homo sapiens
gtcctggctacatcccagcct

SEQ ID NO: 3394801 - DNA, 14 bp, Homo sapiens
gtcctgggcctgcc

SEQ ID NO: 3394802 - DNA, 16 bp, Homo sapiens
gtcctgggcctgcccc

SEQ ID NO: 3394803 - DNA, 19 bp, Homo sapiens
gtcctggtccctctgaggc

SEQ ID NO: 3394804 - DNA, 13 bp, Homo sapiens
gtcctggtgtcac

SEQ ID NO: 3394805 - DNA, 15 bp, Homo sapiens
gtcctgtacattgtg

SEQ ID NO: 3394806 - DNA, 13 bp, Homo sapiens
gtcctgtactgta

SEQ ID NO: 3394807 - DNA, 21 bp, Homo sapiens
gtcctgtagttgcgtggactc

SEQ ID NO: 3394808 - DNA, 23 bp, Homo sapiens
gtcctgtagttgcgtggactctg

SEQ ID NO: 3394809 - DNA, 22 bp, Homo sapiens
gtcctgtccacacccagctcag

SEQ ID NO: 3394810 - DNA, 15 bp, Homo sapiens
gtcctgtcccagagg

SEQ ID NO: 3394811 - DNA, 16 bp, Homo sapiens
gtcctgtctctgcctg

SEQ ID NO: 3394812 - DNA, 11 bp, Homo sapiens
gtcctgtgaat

SEQ ID NO: 3394813 - DNA, 22 bp, Homo sapiens
gtccttaaaaatcacactgtaa

SEQ ID NO: 3394814 - DNA, 15 bp, Homo sapiens
gtccttaaagccatt

SEQ ID NO: 3394815 - DNA, 15 bp, Homo sapiens
gtccttagaacattt

SEQ ID NO: 3394816 - DNA, 19 bp, Homo sapiens
gtccttgagtgctcttgct

SEQ ID NO: 3394817 - DNA, 14 bp, Homo sapiens
gtccttgatttcaa

SEQ ID NO: 3394818 - DNA, 13 bp, Homo sapiens
gtccttggaggaa

SEQ ID NO: 3394819 - DNA, 14 bp, Homo sapiens
gtcctttagtacct

SEQ ID NO: 3394820 - DNA, 24 bp, Homo sapiens
gtcctttcccctctctgcccctga

SEQ ID NO: 3394821 - DNA, 15 bp, Homo sapiens
gtcctttctggaagt

SEQ ID NO: 3394822 - DNA, 21 bp, Homo sapiens
gtcctttggggcatagatcag

SEQ ID NO: 3394823 - DNA, 20 bp, Homo sapiens
gtccttttgacactgctcta

SEQ ID NO: 3394824 - DNA, 17 bp, Homo sapiens
gtccttttgtaccatgg

SEQ ID NO: 3394825 - DNA, 13 bp, Homo sapiens
gtccttttgtctt

SEQ ID NO: 3394826 - DNA, 15 bp, Homo sapiens
gtccttttgtcttct

SEQ ID NO: 3394827 - DNA, 22 bp, Homo sapiens
gtccttttgtcttctctgtctc

SEQ ID NO: 3394828 - DNA, 13 bp, Homo sapiens
gtcgaaggatgct

SEQ ID NO: 3394829 - DNA, 16 bp, Homo sapiens
gtcgaggacagggagg

SEQ ID NO: 3394830 - DNA, 15 bp, Homo sapiens
gtcgaggggctctca

SEQ ID NO: 3394831 - DNA, 13 bp, Homo sapiens
gtcgatgcacagt

SEQ ID NO: 3394832 - DNA, 17 bp, Homo sapiens
gtcgcagaccagagctg

SEQ ID NO: 3394833 - DNA, 22 bp, Homo sapiens
gtcgcaggatccgctgccacca

SEQ ID NO: 3394834 - DNA, 15 bp, Homo sapiens
gtcgccccaggccct

SEQ ID NO: 3394835 - DNA, 21 bp, Homo sapiens
gtcgcccgctgagctgagtgg

SEQ ID NO: 3394836 - DNA, 19 bp, Homo sapiens
gtcgcgagcacatgttcat

SEQ ID NO: 3394837 - DNA, 13 bp, Homo sapiens
gtcgcgctcagca

SEQ ID NO: 3394838 - DNA, 16 bp, Homo sapiens
gtcgctcatgtgtgca

SEQ ID NO: 3394839 - DNA, 21 bp, Homo sapiens
gtcgctcatgtgtgcaacagg

SEQ ID NO: 3394840 - DNA, 11 bp, Homo sapiens
gtcgctcctgc

SEQ ID NO: 3394841 - DNA, 20 bp, Homo sapiens
gtcgctctgctggcctggcc

SEQ ID NO: 3394842 - DNA, 16 bp, Homo sapiens
gtcggaaaagcgtctt

SEQ ID NO: 3394843 - DNA, 19 bp, Homo sapiens
gtcggagaggctgtctggg

SEQ ID NO: 3394844 - DNA, 20 bp, Homo sapiens
gtcggagaggctgtctgggg

SEQ ID NO: 3394845 - DNA, 14 bp, Homo sapiens
gtcggccctgccca

SEQ ID NO: 3394846 - DNA, 18 bp, Homo sapiens
gtcggctgaccatgctca

SEQ ID NO: 3394847 - DNA, 14 bp, Homo sapiens
gtcgggcaccagcc

SEQ ID NO: 3394848 - DNA, 13 bp, Homo sapiens
gtcgggcagccag

SEQ ID NO: 3394849 - DNA, 14 bp, Homo sapiens
gtcgggggctgagg

SEQ ID NO: 3394850 - DNA, 12 bp, Homo sapiens
gtcgtaaagatt

SEQ ID NO: 3394851 - DNA, 14 bp, Homo sapiens
gtcgtaaagatttg

SEQ ID NO: 3394852 - DNA, 15 bp, Homo sapiens
gtcgtcgcacagtct

SEQ ID NO: 3394853 - DNA, 17 bp, Homo sapiens
gtcgtcgcacagtctct

SEQ ID NO: 3394854 - DNA, 13 bp, Homo sapiens
gtcgtgcctgtgt

SEQ ID NO: 3394855 - DNA, 15 bp, Homo sapiens
gtcgtggcagataat

SEQ ID NO: 3394856 - DNA, 23 bp, Homo sapiens
gtcgtggcagataatcagcctct

SEQ ID NO: 3394857 - DNA, 19 bp, Homo sapiens
gtcgtggggtgtgctggga

SEQ ID NO: 3394858 - DNA, 14 bp, Homo sapiens
gtcgtgggtgtgtg

SEQ ID NO: 3394859 - DNA, 12 bp, Homo sapiens
gtcgttttccaa

SEQ ID NO: 3394860 - DNA, 11 bp, Homo sapiens
gtctaaaactc

SEQ ID NO: 3394861 - DNA, 22 bp, Homo sapiens
gtctaaaacttcaaaaactaaa

SEQ ID NO: 3394862 - DNA, 23 bp, Homo sapiens
gtctaaagatggagtttctaagg

SEQ ID NO: 3394863 - DNA, 16 bp, Homo sapiens
gtctaactcagaatta

SEQ ID NO: 3394864 - DNA, 22 bp, Homo sapiens
gtctaactttagaagtgcattt

SEQ ID NO: 3394865 - DNA, 21 bp, Homo sapiens
gtctaagatagtaacaatgaa

SEQ ID NO: 3394866 - DNA, 13 bp, Homo sapiens
gtctaagattcta

SEQ ID NO: 3394867 - DNA, 14 bp, Homo sapiens
gtctaagattctag

SEQ ID NO: 3394868 - DNA, 15 bp, Homo sapiens
gtctaagattctaga

SEQ ID NO: 3394869 - DNA, 18 bp, Homo sapiens
gtctaagattctagatca

SEQ ID NO: 3394870 - DNA, 22 bp, Homo sapiens
gtctaattgcatctcaaaatta

SEQ ID NO: 3394871 - DNA, 21 bp, Homo sapiens
gtctacaaaaaggtataaata

SEQ ID NO: 3394872 - DNA, 20 bp, Homo sapiens
gtctacaaatataagatttt

SEQ ID NO: 3394873 - DNA, 12 bp, Homo sapiens
gtctacatttca

SEQ ID NO: 3394874 - DNA, 21 bp, Homo sapiens
gtctacctgctggacagcctc

SEQ ID NO: 3394875 - DNA, 11 bp, Homo sapiens
gtctactgtgg

SEQ ID NO: 3394876 - DNA, 19 bp, Homo sapiens
gtctactgtggtgatctgt

SEQ ID NO: 3394877 - DNA, 22 bp, Homo sapiens
gtctagaaagtaagaaaacaat

SEQ ID NO: 3394878 - DNA, 20 bp, Homo sapiens
gtctagattaatactctatt

SEQ ID NO: 3394879 - DNA, 11 bp, Homo sapiens
gtctagattca

SEQ ID NO: 3394880 - DNA, 23 bp, Homo sapiens
gtgagagggcatgcgcacaaggc

SEQ ID NO: 3394881 - DNA, 21 bp, Homo sapiens
gtgagatccttcacaggcagt

SEQ ID NO: 3394882 - DNA, 14 bp, Homo sapiens
gtgagcacagccta

SEQ ID NO: 3394883 - DNA, 17 bp, Homo sapiens
gtgagcaggaaggcctg

SEQ ID NO: 3394884 - DNA, 19 bp, Homo sapiens
gtgagcaggaaggcctggg

SEQ ID NO: 3394885 - DNA, 18 bp, Homo sapiens
gtgagccaaagcttatgt

SEQ ID NO: 3394886 - DNA, 14 bp, Homo sapiens
gtgagccaccgctg

SEQ ID NO: 3394887 - DNA, 12 bp, Homo sapiens
gtgagccagtga

SEQ ID NO: 3394888 - DNA, 14 bp, Homo sapiens
gtgagccccagggg

SEQ ID NO: 3394889 - DNA, 21 bp, Homo sapiens
gtgagccccaggggggcctcc

SEQ ID NO: 3394890 - DNA, 22 bp, Homo sapiens
gtgagccccaggggggcctcct

SEQ ID NO: 3394891 - DNA, 13 bp, Homo sapiens
gtgagcctatgat

SEQ ID NO: 3394892 - DNA, 14 bp, Homo sapiens
gtgagcctggctct

SEQ ID NO: 3394893 - DNA, 16 bp, Homo sapiens
gtgagcctggctcttg

SEQ ID NO: 3394894 - DNA, 14 bp, Homo sapiens
gtgagccttggctg

SEQ ID NO: 3394895 - DNA, 14 bp, Homo sapiens
gtgagcgccttggt

SEQ ID NO: 3394896 - DNA, 12 bp, Homo sapiens
gtgagctgggga

SEQ ID NO: 3394897 - DNA, 14 bp, Homo sapiens
gtgagctggggact

SEQ ID NO: 3394898 - DNA, 18 bp, Homo sapiens
gtgaggaaagcacacagt

SEQ ID NO: 3394899 - DNA, 20 bp, Homo sapiens
gtgaggaaatccattgttta

SEQ ID NO: 3394900 - DNA, 21 bp, Homo sapiens
gtgaggaaatccattgtttaa

SEQ ID NO: 3394901 - DNA, 14 bp, Homo sapiens
gtgaggaggaaaag

SEQ ID NO: 3394902 - DNA, 12 bp, Homo sapiens
gtgaggagggtg

SEQ ID NO: 3394903 - DNA, 21 bp, Homo sapiens
gtgaggataacacaagtaaaa

SEQ ID NO: 3394904 - DNA, 20 bp, Homo sapiens
gtgaggcattcggggaagct

SEQ ID NO: 3394905 - DNA, 20 bp, Homo sapiens
gtgaggccgggcgcagtggc

SEQ ID NO: 3394906 - DNA, 22 bp, Homo sapiens
gtgagggacatgctcacctcta

SEQ ID NO: 3394907 - DNA, 17 bp, Homo sapiens
gtgaggggcaagctagg

SEQ ID NO: 3394908 - DNA, 21 bp, Homo sapiens
gtgaggggggggtgggtgaga

SEQ ID NO: 3394909 - DNA, 15 bp, Homo sapiens
gtgagggtcccatgt

SEQ ID NO: 3394910 - DNA, 15 bp, Homo sapiens
gtgagtaagagctgg

SEQ ID NO: 3394911 - DNA, 17 bp, Homo sapiens
gtgagtcaccaagccca

SEQ ID NO: 3394912 - DNA, 15 bp, Homo sapiens
gtgagtccattctcc

SEQ ID NO: 3394913 - DNA, 17 bp, Homo sapiens
gtgagtcccagagcccg

SEQ ID NO: 3394914 - DNA, 18 bp, Homo sapiens
gtgagtcccctactccct

SEQ ID NO: 3394915 - DNA, 18 bp, Homo sapiens
gtgagtcttggcggcagc

SEQ ID NO: 3394916 - DNA, 20 bp, Homo sapiens
gtgagtcttggcggcagcag

SEQ ID NO: 3394917 - DNA, 15 bp, Homo sapiens
gtgagtgagcctggc

SEQ ID NO: 3394918 - DNA, 11 bp, Homo sapiens
gtgagtggagt

SEQ ID NO: 3394919 - DNA, 15 bp, Homo sapiens
gtgagtggcagccat

SEQ ID NO: 3394920 - DNA, 15 bp, Homo sapiens
gtgagtggcctgcta

SEQ ID NO: 3394921 - DNA, 12 bp, Homo sapiens
gtgagtgtaaat

SEQ ID NO: 3394922 - DNA, 15 bp, Homo sapiens
gtgagtgtgacaggg

SEQ ID NO: 3394923 - DNA, 20 bp, Homo sapiens
gtgagtgtgtgtttgtgctg

SEQ ID NO: 3394924 - DNA, 15 bp, Homo sapiens
gtgagttctcagggc

SEQ ID NO: 3394925 - DNA, 17 bp, Homo sapiens
gtgagttctcagggctc

SEQ ID NO: 3394926 - DNA, 15 bp, Homo sapiens
gtgagtttgagctgc

SEQ ID NO: 3394927 - DNA, 17 bp, Homo sapiens
gtgagtttgagctgcct

SEQ ID NO: 3394928 - DNA, 18 bp, Homo sapiens
gtgagtttgagctgcctt

SEQ ID NO: 3394929 - DNA, 17 bp, Homo sapiens
gtgagtttgctggttgt

SEQ ID NO: 3394930 - DNA, 21 bp, Homo sapiens
gtgagtttgctggttgtaaat

SEQ ID NO: 3394931 - DNA, 13 bp, Homo sapiens
gtgataagtggaa

SEQ ID NO: 3394932 - DNA, 22 bp, Homo sapiens
gtgataattttatttataaact

SEQ ID NO: 3394933 - DNA, 13 bp, Homo sapiens
gtgatagcacttt

SEQ ID NO: 3394934 - DNA, 16 bp, Homo sapiens
gtgataggcccaaggt

SEQ ID NO: 3394935 - DNA, 23 bp, Homo sapiens
gtgataggcccaaggtcccctcc

SEQ ID NO: 3394936 - DNA, 22 bp, Homo sapiens
gtgatagtcttttgcttttggc

SEQ ID NO: 3394937 - DNA, 17 bp, Homo sapiens
gtgatagttcaccccct

SEQ ID NO: 3394938 - DNA, 18 bp, Homo sapiens
gtgatatacaaagtgtac

SEQ ID NO: 3394939 - DNA, 23 bp, Homo sapiens
gtgatatataagtgtacatatgt

SEQ ID NO: 3394940 - DNA, 15 bp, Homo sapiens
gtgatcaactgttca

SEQ ID NO: 3394941 - DNA, 17 bp, Homo sapiens
gtgatcatttaaaaagc

SEQ ID NO: 3394942 - DNA, 23 bp, Homo sapiens
gtgatccacccaaccctatctcc

SEQ ID NO: 3394943 - DNA, 18 bp, Homo sapiens
gtgatccacccacctcag

SEQ ID NO: 3394944 - DNA, 22 bp, Homo sapiens
gtgatccacccacctcagcctc

SEQ ID NO: 3394945 - DNA, 15 bp, Homo sapiens
gtgatcctcccacct

SEQ ID NO: 3394946 - DNA, 18 bp, Homo sapiens
gtgatcctcccacctcag

SEQ ID NO: 3394947 - DNA, 20 bp, Homo sapiens
gtgatcctcccacctcagcc

SEQ ID NO: 3394948 - DNA, 14 bp, Homo sapiens
gtgatcctctattt

SEQ ID NO: 3394949 - DNA, 21 bp, Homo sapiens
gtgatcctctcacctcagcct

SEQ ID NO: 3394950 - DNA, 21 bp, Homo sapiens
gtgatcttgcattcattttct

SEQ ID NO: 3394951 - DNA, 21 bp, Homo sapiens
gtgatgaatcaatgaaaaatg

SEQ ID NO: 3394952 - DNA, 14 bp, Homo sapiens
gtgatgatgctgtg

SEQ ID NO: 3394953 - DNA, 19 bp, Homo sapiens
gtgatgcgccttgctgatg

SEQ ID NO: 3394954 - DNA, 13 bp, Homo sapiens
gtgatggagagga

SEQ ID NO: 3394955 - DNA, 17 bp, Homo sapiens
gtgatggagaggacaga

SEQ ID NO: 3394956 - DNA, 19 bp, Homo sapiens
gtgatggagaggacagagc

SEQ ID NO: 3394957 - DNA, 16 bp, Homo sapiens
gtgatgggctttctct

SEQ ID NO: 3394958 - DNA, 14 bp, Homo sapiens
gtgatgggggagag

SEQ ID NO: 3394959 - DNA, 13 bp, Homo sapiens
gtgatgttctaag

SEQ ID NO: 3394960 - DNA, 14 bp, Homo sapiens
gtgatgtttgctct

SEQ ID NO: 3394961 - DNA, 14 bp, Homo sapiens
gtgatgtttgtcct

SEQ ID NO: 3394962 - DNA, 15 bp, Homo sapiens
gtgatgtttttatga

SEQ ID NO: 3394963 - DNA, 16 bp, Homo sapiens
gtgatgtttttatgat

SEQ ID NO: 3394964 - DNA, 15 bp, Homo sapiens
gtgattaaacgtgca

SEQ ID NO: 3394965 - DNA, 21 bp, Homo sapiens
gtgattaatgttttcattatg

SEQ ID NO: 3394966 - DNA, 13 bp, Homo sapiens
gtgattcactgtg

SEQ ID NO: 3394967 - DNA, 16 bp, Homo sapiens
gtgattcactgtgctt

SEQ ID NO: 3394968 - DNA, 23 bp, Homo sapiens
gtgattccactacacctggctga

SEQ ID NO: 3394969 - DNA, 23 bp, Homo sapiens
gtgattccagcaagtacagagat

SEQ ID NO: 3394970 - DNA, 20 bp, Homo sapiens
gtgattctcctgcctcagcc

SEQ ID NO: 3394971 - DNA, 18 bp, Homo sapiens
gtgattctgatttcagtt

SEQ ID NO: 3394972 - DNA, 21 bp, Homo sapiens
gtgattctgatttcagttttt

SEQ ID NO: 3394973 - DNA, 17 bp, Homo sapiens
gtgattctttttttgtg

SEQ ID NO: 3394974 - DNA, 19 bp, Homo sapiens
gtgattgtggaatggagat

SEQ ID NO: 3394975 - DNA, 13 bp, Homo sapiens
gtgattgtgtctg

SEQ ID NO: 3394976 - DNA, 15 bp, Homo sapiens
gtgatttcctaaaca

SEQ ID NO: 3394977 - DNA, 21 bp, Homo sapiens
gtgatttctttaaaagaatga

SEQ ID NO: 3394978 - DNA, 14 bp, Homo sapiens
gtgatttttttctt

SEQ ID NO: 3394979 - DNA, 22 bp, Homo sapiens
gtgcaaagttccctacttcctg

SEQ ID NO: 3394980 - DNA, 15 bp, Homo sapiens
gtgcaacagcactgg

SEQ ID NO: 3394981 - DNA, 20 bp, Homo sapiens
gtgcaacagcactggctctc

SEQ ID NO: 3394982 - DNA, 19 bp, Homo sapiens
gtgcaacctcgctgagggc

SEQ ID NO: 3394983 - DNA, 23 bp, Homo sapiens
gtgcaagttcatgtgtggaaatg

SEQ ID NO: 3394984 - DNA, 12 bp, Homo sapiens
gtgcaatagaag

SEQ ID NO: 3394985 - DNA, 22 bp, Homo sapiens
gtgcaattgtaggggtgtgtgt

SEQ ID NO: 3394986 - DNA, 16 bp, Homo sapiens
gtgcaattgtgaggga

SEQ ID NO: 3394987 - DNA, 18 bp, Homo sapiens
gtgcaatttcaaggttct

SEQ ID NO: 3394988 - DNA, 20 bp, Homo sapiens
gtgcacaaatatttattttc

SEQ ID NO: 3394989 - DNA, 21 bp, Homo sapiens
gtgcacacaccagagcccacc

SEQ ID NO: 3394990 - DNA, 13 bp, Homo sapiens
gtgcacagctgtc

SEQ ID NO: 3394991 - DNA, 15 bp, Homo sapiens
gtgcacatgcttcag

SEQ ID NO: 3394992 - DNA, 18 bp, Homo sapiens
gtgcacccactcaccagg

SEQ ID NO: 3394993 - DNA, 19 bp, Homo sapiens
gtgcacccactcaccaggg

SEQ ID NO: 3394994 - DNA, 13 bp, Homo sapiens
gtgcacctgcccc

SEQ ID NO: 3394995 - DNA, 18 bp, Homo sapiens
gtgcacgtacacacacat

SEQ ID NO: 3394996 - DNA, 18 bp, Homo sapiens
gtgcacgtggagagctgg

SEQ ID NO: 3394997 - DNA, 21 bp, Homo sapiens
gtgcacgtggagagctggtgc

SEQ ID NO: 3394998 - DNA, 21 bp, Homo sapiens
gtgcacgtggcatgtggcctg

SEQ ID NO: 3394999 - DNA, 14 bp, Homo sapiens
gtgcactgccctgt

SEQ ID NO: 3395000 - DNA, 19 bp, Homo sapiens
gtgcactttctaatgtttc

SEQ ID NO: 3395001 - DNA, 18 bp, Homo sapiens
gtgcagaataatggaaac

SEQ ID NO: 3395002 - DNA, 16 bp, Homo sapiens
gtgcagacagaagtct

SEQ ID NO: 3395003 - DNA, 15 bp, Homo sapiens
gtgcagagaagctgg

SEQ ID NO: 3395004 - DNA, 18 bp, Homo sapiens
gtgcagagaagctggact

SEQ ID NO: 3395005 - DNA, 23 bp, Homo sapiens
gtgcagagctgcacttggcctca

SEQ ID NO: 3395006 - DNA, 21 bp, Homo sapiens
gtgtatttgtattaataaagc

SEQ ID NO: 3395007 - DNA, 14 bp, Homo sapiens
gtgtattttcagtc

SEQ ID NO: 3395008 - DNA, 23 bp, Homo sapiens
gtgtatttttcaataaagcattt

SEQ ID NO: 3395009 - DNA, 21 bp, Homo sapiens
gtgtcaacacccctgtgtgga

SEQ ID NO: 3395010 - DNA, 19 bp, Homo sapiens
gtgtcaaccactaaagtat

SEQ ID NO: 3395011 - DNA, 16 bp, Homo sapiens
gtgtcaagttgtgctt

SEQ ID NO: 3395012 - DNA, 16 bp, Homo sapiens
gtgtcaatttccctca

SEQ ID NO: 3395013 - DNA, 13 bp, Homo sapiens
gtgtcacacttgt

SEQ ID NO: 3395014 - DNA, 13 bp, Homo sapiens
gtgtcacctctct

SEQ ID NO: 3395015 - DNA, 17 bp, Homo sapiens
gtgtcacctctctcaga

SEQ ID NO: 3395016 - DNA, 18 bp, Homo sapiens
gtgtcacctctctcagag

SEQ ID NO: 3395017 - DNA, 19 bp, Homo sapiens
gtgtcacctctctcagagc

SEQ ID NO: 3395018 - DNA, 22 bp, Homo sapiens
gtgtcacctctctcagagcatc

SEQ ID NO: 3395019 - DNA, 15 bp, Homo sapiens
gtgtcacttgtgctt

SEQ ID NO: 3395020 - DNA, 14 bp, Homo sapiens
gtgtcaggtggggc

SEQ ID NO: 3395021 - DNA, 20 bp, Homo sapiens
gtgtcaggtggggcagcttg

SEQ ID NO: 3395022 - DNA, 16 bp, Homo sapiens
gtgtcagtatccaggc

SEQ ID NO: 3395023 - DNA, 20 bp, Homo sapiens
gtgtcagttcaactttcaga

SEQ ID NO: 3395024 - DNA, 23 bp, Homo sapiens
gtgtcataaacagatgaataaac

SEQ ID NO: 3395025 - DNA, 15 bp, Homo sapiens
gtgtccacctgtggg

SEQ ID NO: 3395026 - DNA, 16 bp, Homo sapiens
gtgtccacctgtgggt

SEQ ID NO: 3395027 - DNA, 14 bp, Homo sapiens
gtgtccagcagctg

SEQ ID NO: 3395028 - DNA, 18 bp, Homo sapiens
gtgtccatgcgctcaggg

SEQ ID NO: 3395029 - DNA, 18 bp, Homo sapiens
gtgtcccaaggagctgat

SEQ ID NO: 3395030 - DNA, 23 bp, Homo sapiens
gtgtcccaggcagcacagtgtgt

SEQ ID NO: 3395031 - DNA, 18 bp, Homo sapiens
gtgtcccagggccctgga

SEQ ID NO: 3395032 - DNA, 13 bp, Homo sapiens
gtgtcccctcact

SEQ ID NO: 3395033 - DNA, 20 bp, Homo sapiens
gtgtcccctccactgtcaca

SEQ ID NO: 3395034 - DNA, 13 bp, Homo sapiens
gtgtccctggaca

SEQ ID NO: 3395035 - DNA, 14 bp, Homo sapiens
gtgtccctggacac

SEQ ID NO: 3395036 - DNA, 16 bp, Homo sapiens
gtgtccctggacacag

SEQ ID NO: 3395037 - DNA, 15 bp, Homo sapiens
gtgtcctctccctgc

SEQ ID NO: 3395038 - DNA, 17 bp, Homo sapiens
gtgtcctgaccaccctc

SEQ ID NO: 3395039 - DNA, 21 bp, Homo sapiens
gtgtcctgtagttgcgtggac

SEQ ID NO: 3395040 - DNA, 14 bp, Homo sapiens
gtgtcctttcccct

SEQ ID NO: 3395041 - DNA, 15 bp, Homo sapiens
gtgtcgtagccaagg

SEQ ID NO: 3395042 - DNA, 15 bp, Homo sapiens
gtgtcgtctgtgaat

SEQ ID NO: 3395043 - DNA, 16 bp, Homo sapiens
gtgtcgtctgtgaatg

SEQ ID NO: 3395044 - DNA, 21 bp, Homo sapiens
gtgtctcggagggattcccct

SEQ ID NO: 3395045 - DNA, 23 bp, Homo sapiens
gtgtctgcattgttattgtggaa

SEQ ID NO: 3395046 - DNA, 23 bp, Homo sapiens
gtgtctgctctcatccattcctc

SEQ ID NO: 3395047 - DNA, 14 bp, Homo sapiens
gtgtctggagcggc

SEQ ID NO: 3395048 - DNA, 23 bp, Homo sapiens
gtgtctggctttttcctctgagc

SEQ ID NO: 3395049 - DNA, 18 bp, Homo sapiens
gtgtctgtaaaagagcct

SEQ ID NO: 3395050 - DNA, 21 bp, Homo sapiens
gtgtctgtacacgtgtcctgt

SEQ ID NO: 3395051 - DNA, 21 bp, Homo sapiens
gtgtctgtatttcatgtggct

SEQ ID NO: 3395052 - DNA, 20 bp, Homo sapiens
gtgtctgtgccctccaaaga

SEQ ID NO: 3395053 - DNA, 12 bp, Homo sapiens
gtgtcttccata

SEQ ID NO: 3395054 - DNA, 16 bp, Homo sapiens
gtgtcttgggcagagc

SEQ ID NO: 3395055 - DNA, 15 bp, Homo sapiens
gtgtctttctaagaa

SEQ ID NO: 3395056 - DNA, 21 bp, Homo sapiens
gtgtctttctaagaaatcaag

SEQ ID NO: 3395057 - DNA, 18 bp, Homo sapiens
gtgtcttttttcactaca

SEQ ID NO: 3395058 - DNA, 20 bp, Homo sapiens
gtgtgaaactttcattcctt

SEQ ID NO: 3395059 - DNA, 21 bp, Homo sapiens
gtgtgaacacataaggacgtg

SEQ ID NO: 3395060 - DNA, 23 bp, Homo sapiens
gtgtgaaccaccacacccagccc

SEQ ID NO: 3395061 - DNA, 21 bp, Homo sapiens
gtgtgaatgtgggcactggcc

SEQ ID NO: 3395062 - DNA, 22 bp, Homo sapiens
gtgtgacaattctgtttttaat

SEQ ID NO: 3395063 - DNA, 23 bp, Homo sapiens
gtgtgacagggccagtggggcct

SEQ ID NO: 3395064 - DNA, 16 bp, Homo sapiens
gtgtgaccaactgtgt

SEQ ID NO: 3395065 - DNA, 16 bp, Homo sapiens
gtgtgaccatgttcat

SEQ ID NO: 3395066 - DNA, 17 bp, Homo sapiens
gtgtgactggcaagagg

SEQ ID NO: 3395067 - DNA, 22 bp, Homo sapiens
gtgtgagaagtgaatgctggga

SEQ ID NO: 3395068 - DNA, 14 bp, Homo sapiens
gtgtgagaagtgcc

SEQ ID NO: 3395069 - DNA, 17 bp, Homo sapiens
gtgtgagaagtgccttc

SEQ ID NO: 3395070 - DNA, 15 bp, Homo sapiens
gtgtgagctatgcaa

SEQ ID NO: 3395071 - DNA, 16 bp, Homo sapiens
gtgtgaggagctgctg

SEQ ID NO: 3395072 - DNA, 18 bp, Homo sapiens
gtgtgaggagctgctggc

SEQ ID NO: 3395073 - DNA, 16 bp, Homo sapiens
gtgtgagtggcagcca

SEQ ID NO: 3395074 - DNA, 17 bp, Homo sapiens
gtgtgagtggcagccat

SEQ ID NO: 3395075 - DNA, 18 bp, Homo sapiens
gtgtgagtggcagccatg

SEQ ID NO: 3395076 - DNA, 20 bp, Homo sapiens
gtgtgagtggcagccatgcc

SEQ ID NO: 3395077 - DNA, 18 bp, Homo sapiens
gtgtgagtgtgacagggc

SEQ ID NO: 3395078 - DNA, 19 bp, Homo sapiens
gtgtgagtgtgacagggcc

SEQ ID NO: 3395079 - DNA, 17 bp, Homo sapiens
gtgtgatcccaagtgcc

SEQ ID NO: 3395080 - DNA, 15 bp, Homo sapiens
gtgtgattgcacaga

SEQ ID NO: 3395081 - DNA, 20 bp, Homo sapiens
gtgtgatttgtgaaataaaa

SEQ ID NO: 3395082 - DNA, 15 bp, Homo sapiens
gtgtgcacgagtggg

SEQ ID NO: 3395083 - DNA, 14 bp, Homo sapiens
gtgtgcactccagc

SEQ ID NO: 3395084 - DNA, 12 bp, Homo sapiens
gtgtgcataata

SEQ ID NO: 3395085 - DNA, 17 bp, Homo sapiens
gtgtgcatgtgtgtata

SEQ ID NO: 3395086 - DNA, 15 bp, Homo sapiens
gtgtgcctgcagccc

SEQ ID NO: 3395087 - DNA, 16 bp, Homo sapiens
gtgtgcctgcagcccc

SEQ ID NO: 3395088 - DNA, 14 bp, Homo sapiens
gtgtgcctgtggca

SEQ ID NO: 3395089 - DNA, 12 bp, Homo sapiens
gtgtgctctgat

SEQ ID NO: 3395090 - DNA, 15 bp, Homo sapiens
gtgtgctctgatcat

SEQ ID NO: 3395091 - DNA, 16 bp, Homo sapiens
gtgtgctgacttttta

SEQ ID NO: 3395092 - DNA, 11 bp, Homo sapiens
gtgtgctggga

SEQ ID NO: 3395093 - DNA, 19 bp, Homo sapiens
gtgtgctgggagctccact

SEQ ID NO: 3395094 - DNA, 16 bp, Homo sapiens
gtgtggactgtgatgc

SEQ ID NO: 3395095 - DNA, 14 bp, Homo sapiens
gtgtggagaggggt

SEQ ID NO: 3395096 - DNA, 22 bp, Homo sapiens
gtgtggatcttgccacatttct

SEQ ID NO: 3395097 - DNA, 22 bp, Homo sapiens
gtgtggatgtaattagctctgg

SEQ ID NO: 3395098 - DNA, 19 bp, Homo sapiens
gtgtggattgcctctgaaa

SEQ ID NO: 3395099 - DNA, 23 bp, Homo sapiens
gtgtggattgcctctgaaaagtg

SEQ ID NO: 3395100 - DNA, 15 bp, Homo sapiens
gtgtggattttctac

SEQ ID NO: 3395101 - DNA, 15 bp, Homo sapiens
gtgtggcagagagag

SEQ ID NO: 3395102 - DNA, 15 bp, Homo sapiens
gtgtggcctcagccc

SEQ ID NO: 3395103 - DNA, 16 bp, Homo sapiens
gtgtggcctcagccct

SEQ ID NO: 3395104 - DNA, 17 bp, Homo sapiens
gtgtggcctcagccctc

SEQ ID NO: 3395105 - DNA, 15 bp, Homo sapiens
gtgtgggatacttag

SEQ ID NO: 3395106 - DNA, 19 bp, Homo sapiens
gtgtgggatacttagtggt

SEQ ID NO: 3395107 - DNA, 13 bp, Homo sapiens
gtgtggggcatgg

SEQ ID NO: 3395108 - DNA, 13 bp, Homo sapiens
gtgtggggtgggg

SEQ ID NO: 3395109 - DNA, 14 bp, Homo sapiens
gtgtggggtggggt

SEQ ID NO: 3395110 - DNA, 18 bp, Homo sapiens
gtgtgggtggaagggctg

SEQ ID NO: 3395111 - DNA, 15 bp, Homo sapiens
gtgtgggttctacag

SEQ ID NO: 3395112 - DNA, 13 bp, Homo sapiens
gtgtggtgcagtg

SEQ ID NO: 3395113 - DNA, 14 bp, Homo sapiens
gtgtggtggctcat

SEQ ID NO: 3395114 - DNA, 19 bp, Homo sapiens
gtgtgtaacactgtgtaca

SEQ ID NO: 3395115 - DNA, 20 bp, Homo sapiens
gtgtgtactctgtgtgtgta

SEQ ID NO: 3395116 - DNA, 13 bp, Homo sapiens
gtgtgtagagtta

SEQ ID NO: 3395117 - DNA, 20 bp, Homo sapiens
gtgtgtagagttaagaagct

SEQ ID NO: 3395118 - DNA, 13 bp, Homo sapiens
gtgtgtaggctgg

SEQ ID NO: 3395119 - DNA, 14 bp, Homo sapiens
gtgtgtatgtgtat

SEQ ID NO: 3395120 - DNA, 15 bp, Homo sapiens
gtgtgtattgttccc

SEQ ID NO: 3395121 - DNA, 12 bp, Homo sapiens
gtgtgtatttgt

SEQ ID NO: 3395122 - DNA, 19 bp, Homo sapiens
gtgtgtccaaaactgcctc

SEQ ID NO: 3395123 - DNA, 18 bp, Homo sapiens
gtgtgtccctggacacag

SEQ ID NO: 3395124 - DNA, 19 bp, Homo sapiens
gtgtgtccctggacacagc

SEQ ID NO: 3395125 - DNA, 21 bp, Homo sapiens
gtgtgtccctggacacagctc

SEQ ID NO: 3395126 - DNA, 17 bp, Homo sapiens
gtgtgtgaatgaacact

SEQ ID NO: 3395127 - DNA, 17 bp, Homo sapiens
gtgtgtggcagagagag

SEQ ID NO: 3395128 - DNA, 14 bp, Homo sapiens
gtgtgtggcagggg

SEQ ID NO: 3395129 - DNA, 11 bp, Homo sapiens
gtgtgtgtact

SEQ ID NO: 3395130 - DNA, 12 bp, Homo sapiens
gtgtgtgtatgt

SEQ ID NO: 3395131 - DNA, 15 bp, Homo sapiens
gtgtgtgtggcaggg

SEQ ID NO: 3395132 - DNA, 21 bp, Homo sapiens
gttctaagactcaaatgttct

SEQ ID NO: 3395133 - DNA, 21 bp, Homo sapiens
gttctaagatgtgatattcta

SEQ ID NO: 3395134 - DNA, 17 bp, Homo sapiens
gttctaaggctctgaga

SEQ ID NO: 3395135 - DNA, 15 bp, Homo sapiens
gttctaagtttctaa

SEQ ID NO: 3395136 - DNA, 17 bp, Homo sapiens
gttctaataatttctaa

SEQ ID NO: 3395137 - DNA, 19 bp, Homo sapiens
gttctaataatttctaatg

SEQ ID NO: 3395138 - DNA, 18 bp, Homo sapiens
gttctaatatttttagct

SEQ ID NO: 3395139 - DNA, 17 bp, Homo sapiens
gttctaccaggcaaatt

SEQ ID NO: 3395140 - DNA, 20 bp, Homo sapiens
gttctacctcaggcagctca

SEQ ID NO: 3395141 - DNA, 19 bp, Homo sapiens
gttctacggatcatcaaca

SEQ ID NO: 3395142 - DNA, 23 bp, Homo sapiens
gttctagacatggaggttctaag

SEQ ID NO: 3395143 - DNA, 20 bp, Homo sapiens
gttctaggctaccagaagag

SEQ ID NO: 3395144 - DNA, 22 bp, Homo sapiens
gttctaggggagaagagccctg

SEQ ID NO: 3395145 - DNA, 14 bp, Homo sapiens
gttctaggtttcaa

SEQ ID NO: 3395146 - DNA, 22 bp, Homo sapiens
gttctaggtttcaaagatgctg

SEQ ID NO: 3395147 - DNA, 21 bp, Homo sapiens
gttctagtctcctttgcactg

SEQ ID NO: 3395148 - DNA, 14 bp, Homo sapiens
gttctagtttttta

SEQ ID NO: 3395149 - DNA, 22 bp, Homo sapiens
gttctatccaaacatgtattta

SEQ ID NO: 3395150 - DNA, 20 bp, Homo sapiens
gttctatggttatgaaagaa

SEQ ID NO: 3395151 - DNA, 15 bp, Homo sapiens
gttctatttaatgga

SEQ ID NO: 3395152 - DNA, 15 bp, Homo sapiens
gttctattttcttaa

SEQ ID NO: 3395153 - DNA, 17 bp, Homo sapiens
gttctattttcttaaac

SEQ ID NO: 3395154 - DNA, 17 bp, Homo sapiens
gttctatttttcaatca

SEQ ID NO: 3395155 - DNA, 12 bp, Homo sapiens
gttctcacaccc

SEQ ID NO: 3395156 - DNA, 19 bp, Homo sapiens
gttctcactgttccctctg

SEQ ID NO: 3395157 - DNA, 18 bp, Homo sapiens
gttctcagctccccctgt

SEQ ID NO: 3395158 - DNA, 14 bp, Homo sapiens
gttctcagggctcc

SEQ ID NO: 3395159 - DNA, 19 bp, Homo sapiens
gttctcatgggtggcactc

SEQ ID NO: 3395160 - DNA, 19 bp, Homo sapiens
gttctccagaatgtaagaa

SEQ ID NO: 3395161 - DNA, 22 bp, Homo sapiens
gttctccagaatgtaagaaaac

SEQ ID NO: 3395162 - DNA, 20 bp, Homo sapiens
gttctccctgtacagtgtta

SEQ ID NO: 3395163 - DNA, 16 bp, Homo sapiens
gttctccctttctctc

SEQ ID NO: 3395164 - DNA, 18 bp, Homo sapiens
gttctccctttctctctc

SEQ ID NO: 3395165 - DNA, 19 bp, Homo sapiens
gttctccctttctctctcc

SEQ ID NO: 3395166 - DNA, 23 bp, Homo sapiens
gttctccgggtgtggcctcagcc

SEQ ID NO: 3395167 - DNA, 18 bp, Homo sapiens
gttctccttttcctctct

SEQ ID NO: 3395168 - DNA, 22 bp, Homo sapiens
gttctccttttcctctctcccg

SEQ ID NO: 3395169 - DNA, 12 bp, Homo sapiens
gttctctgagga

SEQ ID NO: 3395170 - DNA, 15 bp, Homo sapiens
gttctgaaataaact

SEQ ID NO: 3395171 - DNA, 15 bp, Homo sapiens
gttctgaataatttc

SEQ ID NO: 3395172 - DNA, 16 bp, Homo sapiens
gttctgacacacgtat

SEQ ID NO: 3395173 - DNA, 21 bp, Homo sapiens
gttctgacattaacagttttc

SEQ ID NO: 3395174 - DNA, 22 bp, Homo sapiens
gttctgagaactgactttctcc

SEQ ID NO: 3395175 - DNA, 15 bp, Homo sapiens
gttctgagaaggtga

SEQ ID NO: 3395176 - DNA, 22 bp, Homo sapiens
gttctgcaaaaatatttataaa

SEQ ID NO: 3395177 - DNA, 15 bp, Homo sapiens
gttctgcactgaaaa

SEQ ID NO: 3395178 - DNA, 16 bp, Homo sapiens
gttctgcactgaaaag

SEQ ID NO: 3395179 - DNA, 17 bp, Homo sapiens
gttctgcccccagccca

SEQ ID NO: 3395180 - DNA, 14 bp, Homo sapiens
gttctgctcctctc

SEQ ID NO: 3395181 - DNA, 15 bp, Homo sapiens
gttctgctcctctcc

SEQ ID NO: 3395182 - DNA, 17 bp, Homo sapiens
gttctgctcctctccag

SEQ ID NO: 3395183 - DNA, 20 bp, Homo sapiens
gttctgctgggagttctaga

SEQ ID NO: 3395184 - DNA, 20 bp, Homo sapiens
gttctggaaaagaactgttt

SEQ ID NO: 3395185 - DNA, 20 bp, Homo sapiens
gttctggaggaaagggagga

SEQ ID NO: 3395186 - DNA, 12 bp, Homo sapiens
gttctggccaga

SEQ ID NO: 3395187 - DNA, 11 bp, Homo sapiens
gttctgggaca

SEQ ID NO: 3395188 - DNA, 14 bp, Homo sapiens
gttctgggacacag

SEQ ID NO: 3395189 - DNA, 13 bp, Homo sapiens
gttctgggctcag

SEQ ID NO: 3395190 - DNA, 14 bp, Homo sapiens
gttctgggctcttt

SEQ ID NO: 3395191 - DNA, 17 bp, Homo sapiens
gttctggtcctttttgg

SEQ ID NO: 3395192 - DNA, 21 bp, Homo sapiens
gttctgtaatggaactgaccc

SEQ ID NO: 3395193 - DNA, 14 bp, Homo sapiens
gttctgtggttcct

SEQ ID NO: 3395194 - DNA, 15 bp, Homo sapiens
gttctgtgtacattt

SEQ ID NO: 3395195 - DNA, 16 bp, Homo sapiens
gttctgtgtacttttt

SEQ ID NO: 3395196 - DNA, 21 bp, Homo sapiens
gttctgtgtttaatttcttca

SEQ ID NO: 3395197 - DNA, 15 bp, Homo sapiens
gttctgttctggggg

SEQ ID NO: 3395198 - DNA, 14 bp, Homo sapiens
gttctgtttcaagg

SEQ ID NO: 3395199 - DNA, 15 bp, Homo sapiens
gttctgtttggcact

SEQ ID NO: 3395200 - DNA, 14 bp, Homo sapiens
gttctgtttgttat

SEQ ID NO: 3395201 - DNA, 15 bp, Homo sapiens
gttcttaaaaaggaa

SEQ ID NO: 3395202 - DNA, 20 bp, Homo sapiens
gttcttaaatgtttatactg

SEQ ID NO: 3395203 - DNA, 16 bp, Homo sapiens
gttcttacacatacag

SEQ ID NO: 3395204 - DNA, 22 bp, Homo sapiens
gttcttacctgtatgtctccag

SEQ ID NO: 3395205 - DNA, 21 bp, Homo sapiens
gttcttcaagccagctctagg

SEQ ID NO: 3395206 - DNA, 18 bp, Homo sapiens
gttcttcacctctatcca

SEQ ID NO: 3395207 - DNA, 16 bp, Homo sapiens
gttcttcataagctga

SEQ ID NO: 3395208 - DNA, 21 bp, Homo sapiens
gttcttcctccagctgcacca

SEQ ID NO: 3395209 - DNA, 21 bp, Homo sapiens
gttcttcttctcttctctgca

SEQ ID NO: 3395210 - DNA, 15 bp, Homo sapiens
gttcttgctgctaga

SEQ ID NO: 3395211 - DNA, 17 bp, Homo sapiens
gttcttgctgctagaac

SEQ ID NO: 3395212 - DNA, 22 bp, Homo sapiens
gttcttgctgctagaacttttt

SEQ ID NO: 3395213 - DNA, 22 bp, Homo sapiens
gttcttgggcctcaggctctgc

SEQ ID NO: 3395214 - DNA, 23 bp, Homo sapiens
gttcttgggcctcaggctctgca

SEQ ID NO: 3395215 - DNA, 16 bp, Homo sapiens
gttcttggtaactgat

SEQ ID NO: 3395216 - DNA, 16 bp, Homo sapiens
gttcttggtagagatt

SEQ ID NO: 3395217 - DNA, 15 bp, Homo sapiens
gttcttggtgctctg

SEQ ID NO: 3395218 - DNA, 13 bp, Homo sapiens
gttctttaatgtt

SEQ ID NO: 3395219 - DNA, 20 bp, Homo sapiens
gttctttccataataaaagg

SEQ ID NO: 3395220 - DNA, 19 bp, Homo sapiens
gttctttcctccccctgca

SEQ ID NO: 3395221 - DNA, 15 bp, Homo sapiens
gttctttctggagtc

SEQ ID NO: 3395222 - DNA, 23 bp, Homo sapiens
gttctttgctgcattctgcctct

SEQ ID NO: 3395223 - DNA, 14 bp, Homo sapiens
gttctttggattct

SEQ ID NO: 3395224 - DNA, 20 bp, Homo sapiens
gttctttgttcatagcccag

SEQ ID NO: 3395225 - DNA, 21 bp, Homo sapiens
gttctttgttcatagcccagt

SEQ ID NO: 3395226 - DNA, 22 bp, Homo sapiens
gttgaaaatggtttcaagttat

SEQ ID NO: 3395227 - DNA, 13 bp, Homo sapiens
gttgaaacagaaa

SEQ ID NO: 3395228 - DNA, 13 bp, Homo sapiens
gttgaaaggtttt

SEQ ID NO: 3395229 - DNA, 20 bp, Homo sapiens
gttgaaattatgtatgttta

SEQ ID NO: 3395230 - DNA, 15 bp, Homo sapiens
gttgaactttgccaa

SEQ ID NO: 3395231 - DNA, 19 bp, Homo sapiens
gttgaagagacagagacaa

SEQ ID NO: 3395232 - DNA, 20 bp, Homo sapiens
gttgaagagacagagacaag

SEQ ID NO: 3395233 - DNA, 13 bp, Homo sapiens
gttgaaggcagtc

SEQ ID NO: 3395234 - DNA, 21 bp, Homo sapiens
gttgaaggcagtctgaaccct

SEQ ID NO: 3395235 - DNA, 16 bp, Homo sapiens
gttgaagtttgaacca

SEQ ID NO: 3395236 - DNA, 13 bp, Homo sapiens
gttgaatactttt

SEQ ID NO: 3395237 - DNA, 21 bp, Homo sapiens
gttgaatatagcctgcctcag

SEQ ID NO: 3395238 - DNA, 14 bp, Homo sapiens
gttgaatggctttt

SEQ ID NO: 3395239 - DNA, 14 bp, Homo sapiens
gttgacaactgtga

SEQ ID NO: 3395240 - DNA, 19 bp, Homo sapiens
gttgacacagttgtagggt

SEQ ID NO: 3395241 - DNA, 19 bp, Homo sapiens
gttgacaccattctcctgc

SEQ ID NO: 3395242 - DNA, 14 bp, Homo sapiens
gttgacgagactgg

SEQ ID NO: 3395243 - DNA, 16 bp, Homo sapiens
gttgacggggcagtca

SEQ ID NO: 3395244 - DNA, 18 bp, Homo sapiens
gttgactttataaatttc

SEQ ID NO: 3395245 - DNA, 12 bp, Homo sapiens
gttgagaaatga

SEQ ID NO: 3395246 - DNA, 16 bp, Homo sapiens
gttgagaagcgttttt

SEQ ID NO: 3395247 - DNA, 19 bp, Homo sapiens
gttgagaatcccaaatttg

SEQ ID NO: 3395248 - DNA, 22 bp, Homo sapiens
gttgagatgttgtgtggcaatg

SEQ ID NO: 3395249 - DNA, 15 bp, Homo sapiens
gttgagccaggcctg

SEQ ID NO: 3395250 - DNA, 15 bp, Homo sapiens
gttgagcccctggag

SEQ ID NO: 3395251 - DNA, 17 bp, Homo sapiens
gttgaggggcctggaga

SEQ ID NO: 3395252 - DNA, 16 bp, Homo sapiens
gttgaggtggtctgaa

SEQ ID NO: 3395253 - DNA, 15 bp, Homo sapiens
gttgagtctgtacta

SEQ ID NO: 3395254 - DNA, 12 bp, Homo sapiens
gttgatgcatgt

SEQ ID NO: 3395255 - DNA, 15 bp, Homo sapiens
gttgatggaaaataa

SEQ ID NO: 3395256 - DNA, 13 bp, Homo sapiens
gttgatgtatctg

SEQ ID NO: 3395257 - DNA, 21 bp, Homo sapiens
gttgatgtatctgagttgcca

SEQ ID NO: 3395258 - DNA, 17 bp, Homo sapiens
gttttgtgtaacatatt

SEQ ID NO: 3395259 - DNA, 15 bp, Homo sapiens
gttttgttctttaaa

SEQ ID NO: 3395260 - DNA, 13 bp, Homo sapiens
gttttgttgtttg

SEQ ID NO: 3395261 - DNA, 20 bp, Homo sapiens
gttttgtttggcaaggaaag

SEQ ID NO: 3395262 - DNA, 12 bp, Homo sapiens
gttttgtttgtc

SEQ ID NO: 3395263 - DNA, 22 bp, Homo sapiens
gttttgtttgtctctccttttc

SEQ ID NO: 3395264 - DNA, 13 bp, Homo sapiens
gtttttaaaagtt

SEQ ID NO: 3395265 - DNA, 19 bp, Homo sapiens
gtttttaagctgtttccat

SEQ ID NO: 3395266 - DNA, 21 bp, Homo sapiens
gtttttaagggtttgtggaaa

SEQ ID NO: 3395267 - DNA, 13 bp, Homo sapiens
gtttttacagtta

SEQ ID NO: 3395268 - DNA, 18 bp, Homo sapiens
gtttttaggctgttcctt

SEQ ID NO: 3395269 - DNA, 21 bp, Homo sapiens
gtttttagtaatctgtacatt

SEQ ID NO: 3395270 - DNA, 19 bp, Homo sapiens
gtttttatgatatccctga

SEQ ID NO: 3395271 - DNA, 18 bp, Homo sapiens
gtttttatgcctttctct

SEQ ID NO: 3395272 - DNA, 21 bp, Homo sapiens
gtttttatggttccaatgaaa

SEQ ID NO: 3395273 - DNA, 12 bp, Homo sapiens
gtttttcacatt

SEQ ID NO: 3395274 - DNA, 14 bp, Homo sapiens
gtttttcacatttt

SEQ ID NO: 3395275 - DNA, 20 bp, Homo sapiens
gtttttcagcacccccaccc

SEQ ID NO: 3395276 - DNA, 22 bp, Homo sapiens
gtttttcagcacccccacccac

SEQ ID NO: 3395277 - DNA, 15 bp, Homo sapiens
gtttttcatttgttt

SEQ ID NO: 3395278 - DNA, 18 bp, Homo sapiens
gtttttcatttgttttgc

SEQ ID NO: 3395279 - DNA, 22 bp, Homo sapiens
gtttttcctttcttaattttgt

SEQ ID NO: 3395280 - DNA, 17 bp, Homo sapiens
gtttttctgccagggag

SEQ ID NO: 3395281 - DNA, 22 bp, Homo sapiens
gtttttcttcaacatcaatgtt

SEQ ID NO: 3395282 - DNA, 22 bp, Homo sapiens
gtttttcttggggtactcttga

SEQ ID NO: 3395283 - DNA, 14 bp, Homo sapiens
gtttttgactcttt

SEQ ID NO: 3395284 - DNA, 18 bp, Homo sapiens
gtttttgatagctttatt

SEQ ID NO: 3395285 - DNA, 13 bp, Homo sapiens
gtttttgtatctt

SEQ ID NO: 3395286 - DNA, 22 bp, Homo sapiens
gtttttgtatttattaatttga

SEQ ID NO: 3395287 - DNA, 17 bp, Homo sapiens
gtttttgtttttgcatg

SEQ ID NO: 3395288 - DNA, 15 bp, Homo sapiens
gttttttatgctaat

SEQ ID NO: 3395289 - DNA, 15 bp, Homo sapiens
gttttttcctcagtg

SEQ ID NO: 3395290 - DNA, 21 bp, Homo sapiens
gttttttgttcaatgttccat

SEQ ID NO: 3395291 - DNA, 13 bp, Homo sapiens
gtttttttccagt

SEQ ID NO: 3395292 - DNA, 17 bp, Homo sapiens
gtttttttcctcatgta

SEQ ID NO: 3395293 - DNA, 21 bp, Homo sapiens
gtttttttcctcatgtaacat

SEQ ID NO: 3395294 - DNA, 22 bp, Homo sapiens
gtttttttcctcatgtaacatt

SEQ ID NO: 3395295 - DNA, 14 bp, Homo sapiens
gttttttttgtttg

SEQ ID NO: 3395296 - DNA, 17 bp, Homo sapiens
gttttttttgtttgcct

SEQ ID NO: 3395297 - DNA, 21 bp, Homo sapiens
gtttttttttttaaaaaaaga

SEQ ID NO: 3395298 - DNA, 23 bp, Homo sapiens
gtttttttttttaaaaaaagaaa

SEQ ID NO: 3395299 - DNA, 16 bp, Homo sapiens
taaaaaaaaatgcctt

SEQ ID NO: 3395300 - DNA, 18 bp, Homo sapiens
taaaaaaaaatgcctttg

SEQ ID NO: 3395301 - DNA, 15 bp, Homo sapiens
taaaaaaaagatgaa

SEQ ID NO: 3395302 - DNA, 12 bp, Homo sapiens
taaaaaaagaaa

SEQ ID NO: 3395303 - DNA, 12 bp, Homo sapiens
taaaaaaagcaa

SEQ ID NO: 3395304 - DNA, 14 bp, Homo sapiens
taaaaaaagtgcat

SEQ ID NO: 3395305 - DNA, 18 bp, Homo sapiens
taaaaaacatttttaatt

SEQ ID NO: 3395306 - DNA, 15 bp, Homo sapiens
taaaaaagagttttc

SEQ ID NO: 3395307 - DNA, 14 bp, Homo sapiens
taaaaaagccttcc

SEQ ID NO: 3395308 - DNA, 15 bp, Homo sapiens
taaaaaagccttcct

SEQ ID NO: 3395309 - DNA, 14 bp, Homo sapiens
taaaaaagtctcta

SEQ ID NO: 3395310 - DNA, 21 bp, Homo sapiens
taaaaaagtctctatttaaat

SEQ ID NO: 3395311 - DNA, 18 bp, Homo sapiens
taaaaaatattttctctg

SEQ ID NO: 3395312 - DNA, 14 bp, Homo sapiens
taaaaaatctgaag

SEQ ID NO: 3395313 - DNA, 17 bp, Homo sapiens
taaaaaatctgaagagg

SEQ ID NO: 3395314 - DNA, 13 bp, Homo sapiens
taaaaaatggaaa

SEQ ID NO: 3395315 - DNA, 11 bp, Homo sapiens
taaaaaatgta

SEQ ID NO: 3395316 - DNA, 15 bp, Homo sapiens
taaaaaatgtaacat

SEQ ID NO: 3395317 - DNA, 13 bp, Homo sapiens
taaaaaatgtcca

SEQ ID NO: 3395318 - DNA, 21 bp, Homo sapiens
taaaaaatgtctatagagaaa

SEQ ID NO: 3395319 - DNA, 22 bp, Homo sapiens
taaaaaattatggaatatcatc

SEQ ID NO: 3395320 - DNA, 24 bp, Homo sapiens
taaaaaattatggaatatcatctg

SEQ ID NO: 3395321 - DNA, 15 bp, Homo sapiens
taaaaacactacttt

SEQ ID NO: 3395322 - DNA, 17 bp, Homo sapiens
taaaaacagcattgctt

SEQ ID NO: 3395323 - DNA, 14 bp, Homo sapiens
taaaaactcctttt

SEQ ID NO: 3395324 - DNA, 13 bp, Homo sapiens
taaaaactcttca

SEQ ID NO: 3395325 - DNA, 22 bp, Homo sapiens
taaaaactcttcagtgcaaatt

SEQ ID NO: 3395326 - DNA, 14 bp, Homo sapiens
taaaaactttattg

SEQ ID NO: 3395327 - DNA, 21 bp, Homo sapiens
taaaaagacattcttccaaaa

SEQ ID NO: 3395328 - DNA, 16 bp, Homo sapiens
taaaaagataatctca

SEQ ID NO: 3395329 - DNA, 15 bp, Homo sapiens
taaaaagattagcaa

SEQ ID NO: 3395330 - DNA, 20 bp, Homo sapiens
taaaaagccactagactctt

SEQ ID NO: 3395331 - DNA, 22 bp, Homo sapiens
taaaaagcgctgcagtagctgt

SEQ ID NO: 3395332 - DNA, 18 bp, Homo sapiens
taaaaaggaaatttgttt

SEQ ID NO: 3395333 - DNA, 17 bp, Homo sapiens
taaaaaggccaaagata

SEQ ID NO: 3395334 - DNA, 19 bp, Homo sapiens
taaaaaggccaaagataaa

SEQ ID NO: 3395335 - DNA, 22 bp, Homo sapiens
taaaaaggccaaagataaaagg

SEQ ID NO: 3395336 - DNA, 20 bp, Homo sapiens
taaaaagggcagggcatctc

SEQ ID NO: 3395337 - DNA, 15 bp, Homo sapiens
taaaaagtgacacag

SEQ ID NO: 3395338 - DNA, 17 bp, Homo sapiens
taaaaagttcagagttc

SEQ ID NO: 3395339 - DNA, 17 bp, Homo sapiens
taaaaataaaaatggaa

SEQ ID NO: 3395340 - DNA, 14 bp, Homo sapiens
taaaaataaaagca

SEQ ID NO: 3395341 - DNA, 18 bp, Homo sapiens
taaaaataaagggaagaa

SEQ ID NO: 3395342 - DNA, 14 bp, Homo sapiens
taaaaataatcagt

SEQ ID NO: 3395343 - DNA, 13 bp, Homo sapiens
taaaaatacacta

SEQ ID NO: 3395344 - DNA, 14 bp, Homo sapiens
taaaaatacatatc

SEQ ID NO: 3395345 - DNA, 23 bp, Homo sapiens
taaaaatatggaacttctaatat

SEQ ID NO: 3395346 - DNA, 14 bp, Homo sapiens
taaaaatattgtgt

SEQ ID NO: 3395347 - DNA, 21 bp, Homo sapiens
taaaaatattgtgttgtgaat

SEQ ID NO: 3395348 - DNA, 19 bp, Homo sapiens
taaaaatattgtttctgca

SEQ ID NO: 3395349 - DNA, 21 bp, Homo sapiens
taaaaatatttcagatatcaa

SEQ ID NO: 3395350 - DNA, 17 bp, Homo sapiens
taaaaatcattgattgt

SEQ ID NO: 3395351 - DNA, 15 bp, Homo sapiens
taaaaatctcttttc

SEQ ID NO: 3395352 - DNA, 11 bp, Homo sapiens
taaaaatcttt

SEQ ID NO: 3395353 - DNA, 16 bp, Homo sapiens
taaaaatgaaagtgac

SEQ ID NO: 3395354 - DNA, 13 bp, Homo sapiens
taaaaatgacaga

SEQ ID NO: 3395355 - DNA, 22 bp, Homo sapiens
taaaaatgaggtactctcctgg

SEQ ID NO: 3395356 - DNA, 14 bp, Homo sapiens
taaaaatgctgctc

SEQ ID NO: 3395357 - DNA, 18 bp, Homo sapiens
taaaaatgtaaatattct

SEQ ID NO: 3395358 - DNA, 19 bp, Homo sapiens
taaaaatgtaaatattcta

SEQ ID NO: 3395359 - DNA, 19 bp, Homo sapiens
taaaaatgtagaaattctt

SEQ ID NO: 3395360 - DNA, 22 bp, Homo sapiens
taaaaatgtagaaattcttcat

SEQ ID NO: 3395361 - DNA, 20 bp, Homo sapiens
taaaaatgtaggctttcatg

SEQ ID NO: 3395362 - DNA, 16 bp, Homo sapiens
taaaaatgttctcaaa

SEQ ID NO: 3395363 - DNA, 22 bp, Homo sapiens
taaaaattgccattggacagtt

SEQ ID NO: 3395364 - DNA, 12 bp, Homo sapiens
taaaaattgttt

SEQ ID NO: 3395365 - DNA, 15 bp, Homo sapiens
taaaaattgtttctt

SEQ ID NO: 3395366 - DNA, 18 bp, Homo sapiens
taaaaatttttaaaatac

SEQ ID NO: 3395367 - DNA, 14 bp, Homo sapiens
taaaacaaaatctg

SEQ ID NO: 3395368 - DNA, 17 bp, Homo sapiens
taaaacaacagctcgat

SEQ ID NO: 3395369 - DNA, 21 bp, Homo sapiens
taaaacaattctgtgacatac

SEQ ID NO: 3395370 - DNA, 19 bp, Homo sapiens
taaaacacttattccctca

SEQ ID NO: 3395371 - DNA, 23 bp, Homo sapiens
taaaacacttattccctcatcct

SEQ ID NO: 3395372 - DNA, 20 bp, Homo sapiens
taaaacagctaaatttggag

SEQ ID NO: 3395373 - DNA, 18 bp, Homo sapiens
taaaacagctgtctctaa

SEQ ID NO: 3395374 - DNA, 17 bp, Homo sapiens
taaaacagctgttttta

SEQ ID NO: 3395375 - DNA, 22 bp, Homo sapiens
taaaacaggtagaattatctaa

SEQ ID NO: 3395376 - DNA, 15 bp, Homo sapiens
taaaacatatttcat

SEQ ID NO: 3395377 - DNA, 21 bp, Homo sapiens
taaaacatatttcattttaac

SEQ ID NO: 3395378 - DNA, 12 bp, Homo sapiens
taaaacatcttt

SEQ ID NO: 3395379 - DNA, 11 bp, Homo sapiens
taaaaccaaag

SEQ ID NO: 3395380 - DNA, 13 bp, Homo sapiens
taaaaccaaagag

SEQ ID NO: 3395381 - DNA, 19 bp, Homo sapiens
taaaacccatttaaatttt

SEQ ID NO: 3395382 - DNA, 23 bp, Homo sapiens
taaaacctgggtatgttcctaag

SEQ ID NO: 3395383 - DNA, 15 bp, Homo sapiens
taaaaccttgttcta

SEQ ID NO: 3395384 - DNA, 21 bp, Homo sapiens
taacaataactactgtgttcc

SEQ ID NO: 3395385 - DNA, 19 bp, Homo sapiens
taacaataatatttcaagt

SEQ ID NO: 3395386 - DNA, 24 bp, Homo sapiens
taacaataatatttcaagtgccta

SEQ ID NO: 3395387 - DNA, 14 bp, Homo sapiens
taacaatacaaatg

SEQ ID NO: 3395388 - DNA, 20 bp, Homo sapiens
taacaatacaaatggatttt

SEQ ID NO: 3395389 - DNA, 18 bp, Homo sapiens
taacaatacatgagaaag

SEQ ID NO: 3395390 - DNA, 14 bp, Homo sapiens
taacaatatataga

SEQ ID NO: 3395391 - DNA, 22 bp, Homo sapiens
taacaatatatagaattgtaga

SEQ ID NO: 3395392 - DNA, 18 bp, Homo sapiens
taacaatccattcacaag

SEQ ID NO: 3395393 - DNA, 21 bp, Homo sapiens
taacaatccattcacaagcct

SEQ ID NO: 3395394 - DNA, 15 bp, Homo sapiens
taacaatctaacaat

SEQ ID NO: 3395395 - DNA, 17 bp, Homo sapiens
taacaatgaagataaaa

SEQ ID NO: 3395396 - DNA, 21 bp, Homo sapiens
taacaatgacactagaaaact

SEQ ID NO: 3395397 - DNA, 12 bp, Homo sapiens
taacaatgcaac

SEQ ID NO: 3395398 - DNA, 15 bp, Homo sapiens
taacaatgcaacttt

SEQ ID NO: 3395399 - DNA, 22 bp, Homo sapiens
taacaatgtatgtgaaagtgta

SEQ ID NO: 3395400 - DNA, 12 bp, Homo sapiens
taacaatgttaa

SEQ ID NO: 3395401 - DNA, 15 bp, Homo sapiens
taacaatgttaagga

SEQ ID NO: 3395402 - DNA, 23 bp, Homo sapiens
taacaatgttaaggaaactctta

SEQ ID NO: 3395403 - DNA, 16 bp, Homo sapiens
taacaatttattctga

SEQ ID NO: 3395404 - DNA, 15 bp, Homo sapiens
taacaatttccttta

SEQ ID NO: 3395405 - DNA, 13 bp, Homo sapiens
taacacaaaggaa

SEQ ID NO: 3395406 - DNA, 17 bp, Homo sapiens
taacacaagtcctgtga

SEQ ID NO: 3395407 - DNA, 20 bp, Homo sapiens
taacacacacagaaaagcat

SEQ ID NO: 3395408 - DNA, 18 bp, Homo sapiens
taacacactttttattag

SEQ ID NO: 3395409 - DNA, 12 bp, Homo sapiens
taacacagagag

SEQ ID NO: 3395410 - DNA, 17 bp, Homo sapiens
taacacagcatgtgtat

SEQ ID NO: 3395411 - DNA, 11 bp, Homo sapiens
taacacattat

SEQ ID NO: 3395412 - DNA, 18 bp, Homo sapiens
taacacattgttatttct

SEQ ID NO: 3395413 - DNA, 19 bp, Homo sapiens
taacacatttttttgcatg

SEQ ID NO: 3395414 - DNA, 18 bp, Homo sapiens
taacaccaatcccagggc

SEQ ID NO: 3395415 - DNA, 19 bp, Homo sapiens
taacactatgtttatttac

SEQ ID NO: 3395416 - DNA, 18 bp, Homo sapiens
taacactttgtattactt

SEQ ID NO: 3395417 - DNA, 19 bp, Homo sapiens
taacagaacagcttcaggt

SEQ ID NO: 3395418 - DNA, 20 bp, Homo sapiens
taacagaacagcttcaggtt

SEQ ID NO: 3395419 - DNA, 16 bp, Homo sapiens
taacagatcctttcaa

SEQ ID NO: 3395420 - DNA, 12 bp, Homo sapiens
taacagatgcaa

SEQ ID NO: 3395421 - DNA, 13 bp, Homo sapiens
taacagatgtgaa

SEQ ID NO: 3395422 - DNA, 13 bp, Homo sapiens
taacagatttgct

SEQ ID NO: 3395423 - DNA, 23 bp, Homo sapiens
taacagcattcttgtcacaataa

SEQ ID NO: 3395424 - DNA, 18 bp, Homo sapiens
taacagccctcctctgca

SEQ ID NO: 3395425 - DNA, 20 bp, Homo sapiens
taacagccctcctctgcact

SEQ ID NO: 3395426 - DNA, 12 bp, Homo sapiens
taacagctgaat

SEQ ID NO: 3395427 - DNA, 19 bp, Homo sapiens
taacagctgaattatctat

SEQ ID NO: 3395428 - DNA, 14 bp, Homo sapiens
taacaggatgaaag

SEQ ID NO: 3395429 - DNA, 16 bp, Homo sapiens
taacaggcactttgag

SEQ ID NO: 3395430 - DNA, 17 bp, Homo sapiens
taacaggcactttgaga

SEQ ID NO: 3395431 - DNA, 19 bp, Homo sapiens
taacaggcagatacaggaa

SEQ ID NO: 3395432 - DNA, 13 bp, Homo sapiens
taacagtcattta

SEQ ID NO: 3395433 - DNA, 15 bp, Homo sapiens
taacagtcatttaaa

SEQ ID NO: 3395434 - DNA, 18 bp, Homo sapiens
taacagtcatttaaaaaa

SEQ ID NO: 3395435 - DNA, 18 bp, Homo sapiens
taacagtgccattgtctt

SEQ ID NO: 3395436 - DNA, 19 bp, Homo sapiens
taacagtgccattgtcttt

SEQ ID NO: 3395437 - DNA, 23 bp, Homo sapiens
taacagtgccattgtctttatat

SEQ ID NO: 3395438 - DNA, 14 bp, Homo sapiens
taacagttcatgtt

SEQ ID NO: 3395439 - DNA, 18 bp, Homo sapiens
taacagttcatgtttgct

SEQ ID NO: 3395440 - DNA, 17 bp, Homo sapiens
taacagttttccatgaa

SEQ ID NO: 3395441 - DNA, 19 bp, Homo sapiens
taacatcactatccatgca

SEQ ID NO: 3395442 - DNA, 21 bp, Homo sapiens
taacatcactatccatgcacc

SEQ ID NO: 3395443 - DNA, 19 bp, Homo sapiens
taacatcagaactgaaata

SEQ ID NO: 3395444 - DNA, 14 bp, Homo sapiens
taacatctaaaaat

SEQ ID NO: 3395445 - DNA, 19 bp, Homo sapiens
taacatgaggggacatttt

SEQ ID NO: 3395446 - DNA, 21 bp, Homo sapiens
taacatgatttcaaaatcagt

SEQ ID NO: 3395447 - DNA, 17 bp, Homo sapiens
taacatgtaattaagta

SEQ ID NO: 3395448 - DNA, 21 bp, Homo sapiens
taacattaatgcctgcttttt

SEQ ID NO: 3395449 - DNA, 14 bp, Homo sapiens
taacattatttata

SEQ ID NO: 3395450 - DNA, 18 bp, Homo sapiens
taacattctacttgctta

SEQ ID NO: 3395451 - DNA, 16 bp, Homo sapiens
taacattgaccaagaa

SEQ ID NO: 3395452 - DNA, 21 bp, Homo sapiens
taacattgaccaagaactgca

SEQ ID NO: 3395453 - DNA, 15 bp, Homo sapiens
taacatttgccttgc

SEQ ID NO: 3395454 - DNA, 22 bp, Homo sapiens
taacatttgctgttttaaacat

SEQ ID NO: 3395455 - DNA, 20 bp, Homo sapiens
taaccaagctgagtttccta

SEQ ID NO: 3395456 - DNA, 19 bp, Homo sapiens
taaccacaaagcacagttt

SEQ ID NO: 3395457 - DNA, 23 bp, Homo sapiens
taaccacaaagcacagtttgaac

SEQ ID NO: 3395458 - DNA, 12 bp, Homo sapiens
taaccaggccca

SEQ ID NO: 3395459 - DNA, 13 bp, Homo sapiens
taaccaggcccag

SEQ ID NO: 3395460 - DNA, 16 bp, Homo sapiens
taaccaggcccagcca

SEQ ID NO: 3395461 - DNA, 21 bp, Homo sapiens
taaccagtgcagaaatgaaat

SEQ ID NO: 3395462 - DNA, 22 bp, Homo sapiens
taaccagtgcagaaatgaaata

SEQ ID NO: 3395463 - DNA, 16 bp, Homo sapiens
taaccattaagtcatg

SEQ ID NO: 3395464 - DNA, 18 bp, Homo sapiens
taaccattgtcttgttct

SEQ ID NO: 3395465 - DNA, 14 bp, Homo sapiens
taaccatttgcact

SEQ ID NO: 3395466 - DNA, 15 bp, Homo sapiens
taacccagattttat

SEQ ID NO: 3395467 - DNA, 13 bp, Homo sapiens
taaccccagcctg

SEQ ID NO: 3395468 - DNA, 14 bp, Homo sapiens
taaccccagcctga

SEQ ID NO: 3395469 - DNA, 16 bp, Homo sapiens
taaccccattctttgc

SEQ ID NO: 3395470 - DNA, 21 bp, Homo sapiens
taaccggcatgtttccagcag

SEQ ID NO: 3395471 - DNA, 17 bp, Homo sapiens
taacctagttaaagaaa

SEQ ID NO: 3395472 - DNA, 22 bp, Homo sapiens
taacctatatgatttatagttt

SEQ ID NO: 3395473 - DNA, 16 bp, Homo sapiens
taacctatttccacat

SEQ ID NO: 3395474 - DNA, 20 bp, Homo sapiens
taacctcagtgtcatttatg

SEQ ID NO: 3395475 - DNA, 10 bp, Homo sapiens
taacctctgg

SEQ ID NO: 3395476 - DNA, 16 bp, Homo sapiens
taacctctggcccttg

SEQ ID NO: 3395477 - DNA, 22 bp, Homo sapiens
taacctctggcccttggaataa

SEQ ID NO: 3395478 - DNA, 22 bp, Homo sapiens
taacctggattttttaaatcat

SEQ ID NO: 3395479 - DNA, 18 bp, Homo sapiens
taacctggtgctggatat

SEQ ID NO: 3395480 - DNA, 19 bp, Homo sapiens
taacctggtgctggatatt

SEQ ID NO: 3395481 - DNA, 23 bp, Homo sapiens
taacctggtgctggatattttca

SEQ ID NO: 3395482 - DNA, 19 bp, Homo sapiens
taacctgtacttcaagtta

SEQ ID NO: 3395483 - DNA, 16 bp, Homo sapiens
taaccttatcaggatg

SEQ ID NO: 3395484 - DNA, 17 bp, Homo sapiens
taaccttgagtcagaaa

SEQ ID NO: 3395485 - DNA, 18 bp, Homo sapiens
taaccttgagtcagaaaa

SEQ ID NO: 3395486 - DNA, 16 bp, Homo sapiens
taacctttttgtaaat

SEQ ID NO: 3395487 - DNA, 20 bp, Homo sapiens
taacctttttgtaaatactg

SEQ ID NO: 3395488 - DNA, 17 bp, Homo sapiens
taacgccctatttttgc

SEQ ID NO: 3395489 - DNA, 20 bp, Homo sapiens
taacgccctatttttgcaat

SEQ ID NO: 3395490 - DNA, 22 bp, Homo sapiens
taacgcgtatctaggctttggt

SEQ ID NO: 3395491 - DNA, 17 bp, Homo sapiens
taacgcgtcttcctgag

SEQ ID NO: 3395492 - DNA, 17 bp, Homo sapiens
taacgggaggctgggca

SEQ ID NO: 3395493 - DNA, 23 bp, Homo sapiens
taacggtctgttctgtttcaagg

SEQ ID NO: 3395494 - DNA, 15 bp, Homo sapiens
taacgtttttccttt

SEQ ID NO: 3395495 - DNA, 15 bp, Homo sapiens
taactaaaaggtatg

SEQ ID NO: 3395496 - DNA, 16 bp, Homo sapiens
taactaaatttgatac

SEQ ID NO: 3395497 - DNA, 22 bp, Homo sapiens
taactaaatttgatacttatat

SEQ ID NO: 3395498 - DNA, 19 bp, Homo sapiens
taactaatctattgggttc

SEQ ID NO: 3395499 - DNA, 22 bp, Homo sapiens
taactaatctattgggttcatt

SEQ ID NO: 3395500 - DNA, 14 bp, Homo sapiens
taactaattttgtt

SEQ ID NO: 3395501 - DNA, 19 bp, Homo sapiens
taactacaaagctttgcta

SEQ ID NO: 3395502 - DNA, 20 bp, Homo sapiens
taactacaaagctttgctac

SEQ ID NO: 3395503 - DNA, 15 bp, Homo sapiens
taactactagttttt

SEQ ID NO: 3395504 - DNA, 12 bp, Homo sapiens
taactactgtgt

SEQ ID NO: 3395505 - DNA, 14 bp, Homo sapiens
taactactgtgttc

SEQ ID NO: 3395506 - DNA, 13 bp, Homo sapiens
taactactttata

SEQ ID NO: 3395507 - DNA, 14 bp, Homo sapiens
taactactttataa

SEQ ID NO: 3395508 - DNA, 16 bp, Homo sapiens
taactagaattagtat

SEQ ID NO: 3395509 - DNA, 17 bp, Homo sapiens
taactagaattagtatg

SEQ ID NO: 3395510 - DNA, 19 bp, Homo sapiens
taagtactgtaataatacc

SEQ ID NO: 3395511 - DNA, 16 bp, Homo sapiens
taagtactgtttacca

SEQ ID NO: 3395512 - DNA, 16 bp, Homo sapiens
taagtagttggtttgt

SEQ ID NO: 3395513 - DNA, 14 bp, Homo sapiens
taagtatacagttc

SEQ ID NO: 3395514 - DNA, 20 bp, Homo sapiens
taagtatacagttcaataaa

SEQ ID NO: 3395515 - DNA, 22 bp, Homo sapiens
taagtatctgggattattcttt

SEQ ID NO: 3395516 - DNA, 21 bp, Homo sapiens
taagtattatgtctcttctga

SEQ ID NO: 3395517 - DNA, 12 bp, Homo sapiens
taagtatttagg

SEQ ID NO: 3395518 - DNA, 20 bp, Homo sapiens
taagtatttaggtttttgtt

SEQ ID NO: 3395519 - DNA, 13 bp, Homo sapiens
taagtatttatat

SEQ ID NO: 3395520 - DNA, 17 bp, Homo sapiens
taagtatttatatattt

SEQ ID NO: 3395521 - DNA, 23 bp, Homo sapiens
taagtatttatatatttataact

SEQ ID NO: 3395522 - DNA, 15 bp, Homo sapiens
taagtcaaaaggaac

SEQ ID NO: 3395523 - DNA, 16 bp, Homo sapiens
taagtcaaaaggaaca

SEQ ID NO: 3395524 - DNA, 17 bp, Homo sapiens
taagtcaagcacatgta

SEQ ID NO: 3395525 - DNA, 19 bp, Homo sapiens
taagtcagtatggtctaac

SEQ ID NO: 3395526 - DNA, 21 bp, Homo sapiens
taagtcccagtatacctcatt

SEQ ID NO: 3395527 - DNA, 17 bp, Homo sapiens
taagtcctttatgtgga

SEQ ID NO: 3395528 - DNA, 14 bp, Homo sapiens
taagtgaataataa

SEQ ID NO: 3395529 - DNA, 15 bp, Homo sapiens
taagtgagagagaca

SEQ ID NO: 3395530 - DNA, 18 bp, Homo sapiens
taagtgcacacagaaata

SEQ ID NO: 3395531 - DNA, 12 bp, Homo sapiens
taagtgcacttt

SEQ ID NO: 3395532 - DNA, 14 bp, Homo sapiens
taagtgcacttttt

SEQ ID NO: 3395533 - DNA, 10 bp, Homo sapiens
taagtgccca

SEQ ID NO: 3395534 - DNA, 15 bp, Homo sapiens
taagtgcccaaagtg

SEQ ID NO: 3395535 - DNA, 17 bp, Homo sapiens
taagtgcgtgtgtagag

SEQ ID NO: 3395536 - DNA, 18 bp, Homo sapiens
taagtggaaaaaagagaa

SEQ ID NO: 3395537 - DNA, 20 bp, Homo sapiens
taagtggaaaaaagagaaaa

SEQ ID NO: 3395538 - DNA, 15 bp, Homo sapiens
taagtggaggcactt

SEQ ID NO: 3395539 - DNA, 19 bp, Homo sapiens
taagtggaggcactttagg

SEQ ID NO: 3395540 - DNA, 20 bp, Homo sapiens
taagtggggttgcaaccact

SEQ ID NO: 3395541 - DNA, 21 bp, Homo sapiens
taagtggggttgcaaccactg

SEQ ID NO: 3395542 - DNA, 17 bp, Homo sapiens
taagtggtttgatcatt

SEQ ID NO: 3395543 - DNA, 14 bp, Homo sapiens
taagtgtaaaagta

SEQ ID NO: 3395544 - DNA, 14 bp, Homo sapiens
taagtgtacatatg

SEQ ID NO: 3395545 - DNA, 18 bp, Homo sapiens
taagtgtacatatgtgct

SEQ ID NO: 3395546 - DNA, 13 bp, Homo sapiens
taagtgtattttt

SEQ ID NO: 3395547 - DNA, 20 bp, Homo sapiens
taagtgtatttttcaataaa

SEQ ID NO: 3395548 - DNA, 23 bp, Homo sapiens
taagtgtatttttcaataaagca

SEQ ID NO: 3395549 - DNA, 14 bp, Homo sapiens
taagtgtgtgtgtg

SEQ ID NO: 3395550 - DNA, 14 bp, Homo sapiens
taagtgttggaaaa

SEQ ID NO: 3395551 - DNA, 13 bp, Homo sapiens
taagttaataatg

SEQ ID NO: 3395552 - DNA, 17 bp, Homo sapiens
taagttaataatgtatt

SEQ ID NO: 3395553 - DNA, 14 bp, Homo sapiens
taagttataagact

SEQ ID NO: 3395554 - DNA, 15 bp, Homo sapiens
taagttattttatga

SEQ ID NO: 3395555 - DNA, 19 bp, Homo sapiens
taagttcaaattcttctga

SEQ ID NO: 3395556 - DNA, 16 bp, Homo sapiens
taagttcacattagaa

SEQ ID NO: 3395557 - DNA, 17 bp, Homo sapiens
taagttcacattagaat

SEQ ID NO: 3395558 - DNA, 22 bp, Homo sapiens
taagttcgaacatgtttcactt

SEQ ID NO: 3395559 - DNA, 20 bp, Homo sapiens
taagttggcttctgtttcta

SEQ ID NO: 3395560 - DNA, 20 bp, Homo sapiens
taagttgtacaaatgtattt

SEQ ID NO: 3395561 - DNA, 23 bp, Homo sapiens
taagtttcaaacttactattttg

SEQ ID NO: 3395562 - DNA, 12 bp, Homo sapiens
taagtttctaag

SEQ ID NO: 3395563 - DNA, 12 bp, Homo sapiens
taagtttgaagg

SEQ ID NO: 3395564 - DNA, 13 bp, Homo sapiens
taagtttgatcaa

SEQ ID NO: 3395565 - DNA, 16 bp, Homo sapiens
taagtttgatttcatt

SEQ ID NO: 3395566 - DNA, 15 bp, Homo sapiens
taataaaaaatggaa

SEQ ID NO: 3395567 - DNA, 23 bp, Homo sapiens
taataaaaagctttttcctcctg

SEQ ID NO: 3395568 - DNA, 13 bp, Homo sapiens
taataaaacatct

SEQ ID NO: 3395569 - DNA, 20 bp, Homo sapiens
taataaaactgcacagtgct

SEQ ID NO: 3395570 - DNA, 21 bp, Homo sapiens
taataaaactgcacagtgctg

SEQ ID NO: 3395571 - DNA, 22 bp, Homo sapiens
taataaaactgcacagtgctgt

SEQ ID NO: 3395572 - DNA, 13 bp, Homo sapiens
taataaaataatt

SEQ ID NO: 3395573 - DNA, 16 bp, Homo sapiens
taataaaataattcta

SEQ ID NO: 3395574 - DNA, 18 bp, Homo sapiens
taataaaataattctaaa

SEQ ID NO: 3395575 - DNA, 19 bp, Homo sapiens
taataaaataattctaaag

SEQ ID NO: 3395576 - DNA, 19 bp, Homo sapiens
taataaacactggctctgg

SEQ ID NO: 3395577 - DNA, 17 bp, Homo sapiens
taataaactgtattaaa

SEQ ID NO: 3395578 - DNA, 21 bp, Homo sapiens
taataaactgtattaaatctt

SEQ ID NO: 3395579 - DNA, 20 bp, Homo sapiens
taataaagaattaacagaga

SEQ ID NO: 3395580 - DNA, 14 bp, Homo sapiens
taataaagtatata

SEQ ID NO: 3395581 - DNA, 17 bp, Homo sapiens
taataaatatactatga

SEQ ID NO: 3395582 - DNA, 19 bp, Homo sapiens
taataaatatactatgaaa

SEQ ID NO: 3395583 - DNA, 16 bp, Homo sapiens
taataaatatttatgt

SEQ ID NO: 3395584 - DNA, 14 bp, Homo sapiens
taataaatcacaca

SEQ ID NO: 3395585 - DNA, 14 bp, Homo sapiens
taataaatgccctc

SEQ ID NO: 3395586 - DNA, 20 bp, Homo sapiens
taataaattgaaattgtgaa

SEQ ID NO: 3395587 - DNA, 19 bp, Homo sapiens
taataaattgcttactgat

SEQ ID NO: 3395588 - DNA, 21 bp, Homo sapiens
taataaattgcttactgatat

SEQ ID NO: 3395589 - DNA, 23 bp, Homo sapiens
taataaatttactcacagcactt

SEQ ID NO: 3395590 - DNA, 14 bp, Homo sapiens
taataacaatatat

SEQ ID NO: 3395591 - DNA, 20 bp, Homo sapiens
taataacattaccttactgt

SEQ ID NO: 3395592 - DNA, 17 bp, Homo sapiens
taataagacataacgtt

SEQ ID NO: 3395593 - DNA, 19 bp, Homo sapiens
taataagacataacgtttt

SEQ ID NO: 3395594 - DNA, 15 bp, Homo sapiens
taataagcactgtaa

SEQ ID NO: 3395595 - DNA, 18 bp, Homo sapiens
taataagctaaagaggct

SEQ ID NO: 3395596 - DNA, 14 bp, Homo sapiens
taataatacctcaa

SEQ ID NO: 3395597 - DNA, 16 bp, Homo sapiens
taataatttctaatgt

SEQ ID NO: 3395598 - DNA, 14 bp, Homo sapiens
taataatttgcact

SEQ ID NO: 3395599 - DNA, 22 bp, Homo sapiens
taatacaacatgtagctgagtt

SEQ ID NO: 3395600 - DNA, 22 bp, Homo sapiens
taatacacagtactttattgta

SEQ ID NO: 3395601 - DNA, 13 bp, Homo sapiens
taatactaaaata

SEQ ID NO: 3395602 - DNA, 16 bp, Homo sapiens
taatactaagacccta

SEQ ID NO: 3395603 - DNA, 14 bp, Homo sapiens
taatactctatttt

SEQ ID NO: 3395604 - DNA, 21 bp, Homo sapiens
taatactggtatttttactta

SEQ ID NO: 3395605 - DNA, 12 bp, Homo sapiens
taatagaagaac

SEQ ID NO: 3395606 - DNA, 21 bp, Homo sapiens
taatagaagaacatccaagga

SEQ ID NO: 3395607 - DNA, 16 bp, Homo sapiens
taatagaataaaggca

SEQ ID NO: 3395608 - DNA, 20 bp, Homo sapiens
taatagaataaaggcagttt

SEQ ID NO: 3395609 - DNA, 21 bp, Homo sapiens
taatagaatataattatcgga

SEQ ID NO: 3395610 - DNA, 20 bp, Homo sapiens
taatagcaacttttgtgtaa

SEQ ID NO: 3395611 - DNA, 18 bp, Homo sapiens
taatagcttttattgtat

SEQ ID NO: 3395612 - DNA, 22 bp, Homo sapiens
taataggaacaatctttgctgt

SEQ ID NO: 3395613 - DNA, 18 bp, Homo sapiens
taatagggaaaattctaa

SEQ ID NO: 3395614 - DNA, 21 bp, Homo sapiens
taatagtgcttaaaaatcatt

SEQ ID NO: 3395615 - DNA, 13 bp, Homo sapiens
taatagtgctttt

SEQ ID NO: 3395616 - DNA, 23 bp, Homo sapiens
taatagtgcttttttttttttga

SEQ ID NO: 3395617 - DNA, 15 bp, Homo sapiens
taatagttagccctc

SEQ ID NO: 3395618 - DNA, 18 bp, Homo sapiens
taatagttcagtagaatt

SEQ ID NO: 3395619 - DNA, 19 bp, Homo sapiens
taatagttcagtagaatta

SEQ ID NO: 3395620 - DNA, 20 bp, Homo sapiens
taatagttcagtagaattac

SEQ ID NO: 3395621 - DNA, 18 bp, Homo sapiens
taatagtttgtctatttt

SEQ ID NO: 3395622 - DNA, 20 bp, Homo sapiens
taatagtttgtctattttaa

SEQ ID NO: 3395623 - DNA, 21 bp, Homo sapiens
taatataaaaagcttccatga

SEQ ID NO: 3395624 - DNA, 15 bp, Homo sapiens
taatataaaagatat

SEQ ID NO: 3395625 - DNA, 21 bp, Homo sapiens
taatataaagtagtcctgtga

SEQ ID NO: 3395626 - DNA, 14 bp, Homo sapiens
taatataatgaatt

SEQ ID NO: 3395627 - DNA, 13 bp, Homo sapiens
taatataatggaa

SEQ ID NO: 3395628 - DNA, 16 bp, Homo sapiens
taatatactatattta

SEQ ID NO: 3395629 - DNA, 16 bp, Homo sapiens
taatatagctgagact

SEQ ID NO: 3395630 - DNA, 22 bp, Homo sapiens
taatatatagtccagacactta

SEQ ID NO: 3395631 - DNA, 17 bp, Homo sapiens
taatatatcccagaaat

SEQ ID NO: 3395632 - DNA, 16 bp, Homo sapiens
taatatattaaaattc

SEQ ID NO: 3395633 - DNA, 14 bp, Homo sapiens
taatatcattcact

SEQ ID NO: 3395634 - DNA, 23 bp, Homo sapiens
taatatccaacacaactatcaaa

SEQ ID NO: 3395635 - DNA, 18 bp, Homo sapiens
taatatccctacatgtat

SEQ ID NO: 3395636 - DNA, 23 bp, Homo sapiens
tacaaaattaagcaaatgttaaa

SEQ ID NO: 3395637 - DNA, 17 bp, Homo sapiens
tacaaactgcaatagag

SEQ ID NO: 3395638 - DNA, 21 bp, Homo sapiens
tacaaagaaccatgcaggaag

SEQ ID NO: 3395639 - DNA, 21 bp, Homo sapiens
tacaaagcgtttctttacttc

SEQ ID NO: 3395640 - DNA, 19 bp, Homo sapiens
tacaaagctttgctacaaa

SEQ ID NO: 3395641 - DNA, 12 bp, Homo sapiens
tacaaagtaaat

SEQ ID NO: 3395642 - DNA, 14 bp, Homo sapiens
tacaaagtagaagt

SEQ ID NO: 3395643 - DNA, 19 bp, Homo sapiens
tacaaatactcttaggaag

SEQ ID NO: 3395644 - DNA, 16 bp, Homo sapiens
tacaaatataaatctt

SEQ ID NO: 3395645 - DNA, 21 bp, Homo sapiens
tacaaatgtaagcaaaggctc

SEQ ID NO: 3395646 - DNA, 14 bp, Homo sapiens
tacaaatgtatttt

SEQ ID NO: 3395647 - DNA, 22 bp, Homo sapiens
tacaaatgtattttgaagaata

SEQ ID NO: 3395648 - DNA, 14 bp, Homo sapiens
tacaaattaaaaag

SEQ ID NO: 3395649 - DNA, 20 bp, Homo sapiens
tacaaattgtcgtttttatt

SEQ ID NO: 3395650 - DNA, 13 bp, Homo sapiens
tacaaatttatgc

SEQ ID NO: 3395651 - DNA, 15 bp, Homo sapiens
tacaaatttatgcat

SEQ ID NO: 3395652 - DNA, 20 bp, Homo sapiens
tacaaatttatgcatttcat

SEQ ID NO: 3395653 - DNA, 16 bp, Homo sapiens
tacaacaaaaggactt

SEQ ID NO: 3395654 - DNA, 19 bp, Homo sapiens
tacaacaagagtttatttc

SEQ ID NO: 3395655 - DNA, 23 bp, Homo sapiens
tacaacagaaaccagaaaagcaa

SEQ ID NO: 3395656 - DNA, 21 bp, Homo sapiens
tacaacataatctagtttaca

SEQ ID NO: 3395657 - DNA, 23 bp, Homo sapiens
tacaacataatctagtttacaga

SEQ ID NO: 3395658 - DNA, 19 bp, Homo sapiens
tacaaccatccctgccaca

SEQ ID NO: 3395659 - DNA, 15 bp, Homo sapiens
tacaacctccctctt

SEQ ID NO: 3395660 - DNA, 22 bp, Homo sapiens
tacaacctccctcttgttttgt

SEQ ID NO: 3395661 - DNA, 18 bp, Homo sapiens
tacaacttgtatttccaa

SEQ ID NO: 3395662 - DNA, 15 bp, Homo sapiens
tacaagaagtttatt

SEQ ID NO: 3395663 - DNA, 14 bp, Homo sapiens
tacaagactgttgt

SEQ ID NO: 3395664 - DNA, 18 bp, Homo sapiens
tacaagactgttgtgatc

SEQ ID NO: 3395665 - DNA, 19 bp, Homo sapiens
tacaagagcagcctgtggc

SEQ ID NO: 3395666 - DNA, 16 bp, Homo sapiens
tacaagagtccctttg

SEQ ID NO: 3395667 - DNA, 15 bp, Homo sapiens
tacaagatattgatg

SEQ ID NO: 3395668 - DNA, 17 bp, Homo sapiens
tacaagatattgatgat

SEQ ID NO: 3395669 - DNA, 12 bp, Homo sapiens
tacaagatccat

SEQ ID NO: 3395670 - DNA, 24 bp, Homo sapiens
tacaagatgaaggagaggcaacat

SEQ ID NO: 3395671 - DNA, 20 bp, Homo sapiens
tacaagattgaaaatcttgt

SEQ ID NO: 3395672 - DNA, 14 bp, Homo sapiens
tacaagattgtaag

SEQ ID NO: 3395673 - DNA, 17 bp, Homo sapiens
tacaagatttagaaaaa

SEQ ID NO: 3395674 - DNA, 22 bp, Homo sapiens
tacaagccaaagtggcatgttt

SEQ ID NO: 3395675 - DNA, 15 bp, Homo sapiens
tacaaggcaagcatt

SEQ ID NO: 3395676 - DNA, 18 bp, Homo sapiens
tacaaggtaattgttttt

SEQ ID NO: 3395677 - DNA, 18 bp, Homo sapiens
tacaagtcagctccagct

SEQ ID NO: 3395678 - DNA, 21 bp, Homo sapiens
tacaagtgtatatcagaaaag

SEQ ID NO: 3395679 - DNA, 13 bp, Homo sapiens
tacaagttagaaa

SEQ ID NO: 3395680 - DNA, 16 bp, Homo sapiens
tacaagttgttattgt

SEQ ID NO: 3395681 - DNA, 22 bp, Homo sapiens
tacaagttgttattgttgaaca

SEQ ID NO: 3395682 - DNA, 15 bp, Homo sapiens
tacaagttttgtata

SEQ ID NO: 3395683 - DNA, 21 bp, Homo sapiens
tacaataaaactttgctgcca

SEQ ID NO: 3395684 - DNA, 20 bp, Homo sapiens
tacaataaaatcttgaaaat

SEQ ID NO: 3395685 - DNA, 15 bp, Homo sapiens
tacaataaataatct

SEQ ID NO: 3395686 - DNA, 14 bp, Homo sapiens
tacaataacccagt

SEQ ID NO: 3395687 - DNA, 19 bp, Homo sapiens
tacaataacccagttactt

SEQ ID NO: 3395688 - DNA, 20 bp, Homo sapiens
tacaataacccagttacttt

SEQ ID NO: 3395689 - DNA, 23 bp, Homo sapiens
tacaataagcgttaagggcagag

SEQ ID NO: 3395690 - DNA, 20 bp, Homo sapiens
tacaatatataaaaatatat

SEQ ID NO: 3395691 - DNA, 21 bp, Homo sapiens
tacaatcaaaacacactacta

SEQ ID NO: 3395692 - DNA, 22 bp, Homo sapiens
tacaatcaaaacacactactac

SEQ ID NO: 3395693 - DNA, 21 bp, Homo sapiens
tacaatcaaatctcctgctga

SEQ ID NO: 3395694 - DNA, 15 bp, Homo sapiens
tacaatgaacactta

SEQ ID NO: 3395695 - DNA, 15 bp, Homo sapiens
tacaatgaactgctt

SEQ ID NO: 3395696 - DNA, 20 bp, Homo sapiens
tacaatgaactgcttttcct

SEQ ID NO: 3395697 - DNA, 21 bp, Homo sapiens
tacaatgactagtcacctggg

SEQ ID NO: 3395698 - DNA, 17 bp, Homo sapiens
tacaatgtcatatactg

SEQ ID NO: 3395699 - DNA, 14 bp, Homo sapiens
tacaatgtgaactt

SEQ ID NO: 3395700 - DNA, 17 bp, Homo sapiens
tacaatgtgaactttat

SEQ ID NO: 3395701 - DNA, 13 bp, Homo sapiens
tacaatgtgaata

SEQ ID NO: 3395702 - DNA, 23 bp, Homo sapiens
tacaatgtgaatagtcatctcct

SEQ ID NO: 3395703 - DNA, 20 bp, Homo sapiens
tacaatgtgtttttctccag

SEQ ID NO: 3395704 - DNA, 21 bp, Homo sapiens
tacaatgtgtttttctccagt

SEQ ID NO: 3395705 - DNA, 21 bp, Homo sapiens
tacaattaatagtttgtctat

SEQ ID NO: 3395706 - DNA, 18 bp, Homo sapiens
tacaattctacattgtca

SEQ ID NO: 3395707 - DNA, 19 bp, Homo sapiens
tacaattgcactgctgttc

SEQ ID NO: 3395708 - DNA, 22 bp, Homo sapiens
tacaattgtgggcataaactgt

SEQ ID NO: 3395709 - DNA, 16 bp, Homo sapiens
tacaatttgttaattc

SEQ ID NO: 3395710 - DNA, 21 bp, Homo sapiens
tacaatttttaataaattgaa

SEQ ID NO: 3395711 - DNA, 23 bp, Homo sapiens
tacaattttttatcatgcatgtc

SEQ ID NO: 3395712 - DNA, 20 bp, Homo sapiens
tacacaaatgtgatttttgt

SEQ ID NO: 3395713 - DNA, 14 bp, Homo sapiens
tacacaagtaaaca

SEQ ID NO: 3395714 - DNA, 16 bp, Homo sapiens
tacacacacagatgtg

SEQ ID NO: 3395715 - DNA, 20 bp, Homo sapiens
tacacagcacaccagccgct

SEQ ID NO: 3395716 - DNA, 15 bp, Homo sapiens
tacacagctctagac

SEQ ID NO: 3395717 - DNA, 19 bp, Homo sapiens
tacacagtactttattgta

SEQ ID NO: 3395718 - DNA, 19 bp, Homo sapiens
tacacagtcaaatttacat

SEQ ID NO: 3395719 - DNA, 23 bp, Homo sapiens
tacacataagaccgtgtcccaag

SEQ ID NO: 3395720 - DNA, 16 bp, Homo sapiens
tacacatacagtttta

SEQ ID NO: 3395721 - DNA, 23 bp, Homo sapiens
tacacatacagttttatgctctt

SEQ ID NO: 3395722 - DNA, 21 bp, Homo sapiens
tacacatatacctataatgtg

SEQ ID NO: 3395723 - DNA, 14 bp, Homo sapiens
tacacattagattt

SEQ ID NO: 3395724 - DNA, 15 bp, Homo sapiens
tacacatttcacatt

SEQ ID NO: 3395725 - DNA, 17 bp, Homo sapiens
tacacatttgctactgt

SEQ ID NO: 3395726 - DNA, 15 bp, Homo sapiens
tacacatttgtacag

SEQ ID NO: 3395727 - DNA, 18 bp, Homo sapiens
tacacatttgtacagaat

SEQ ID NO: 3395728 - DNA, 19 bp, Homo sapiens
tacaccacctcactcctgt

SEQ ID NO: 3395729 - DNA, 20 bp, Homo sapiens
tacaccagtttgactgtgct

SEQ ID NO: 3395730 - DNA, 14 bp, Homo sapiens
tacacccaaagagg

SEQ ID NO: 3395731 - DNA, 15 bp, Homo sapiens
tacacccagacccca

SEQ ID NO: 3395732 - DNA, 20 bp, Homo sapiens
tacacccagaccccaggctg

SEQ ID NO: 3395733 - DNA, 15 bp, Homo sapiens
tacacctggctgagg

SEQ ID NO: 3395734 - DNA, 20 bp, Homo sapiens
tacaccttgccttgctgttt

SEQ ID NO: 3395735 - DNA, 19 bp, Homo sapiens
tacacgttagatttgccgt

SEQ ID NO: 3395736 - DNA, 15 bp, Homo sapiens
tacactaacatttcc

SEQ ID NO: 3395737 - DNA, 14 bp, Homo sapiens
tacactctgctgtt

SEQ ID NO: 3395738 - DNA, 16 bp, Homo sapiens
tacactctttgtaaga

SEQ ID NO: 3395739 - DNA, 16 bp, Homo sapiens
tacactgcctgtatac

SEQ ID NO: 3395740 - DNA, 18 bp, Homo sapiens
tacactgcctgtatactt

SEQ ID NO: 3395741 - DNA, 18 bp, Homo sapiens
tacactgctgtacccaga

SEQ ID NO: 3395742 - DNA, 20 bp, Homo sapiens
tacactgctgtacccagatg

SEQ ID NO: 3395743 - DNA, 16 bp, Homo sapiens
tacactgtatttgtat

SEQ ID NO: 3395744 - DNA, 17 bp, Homo sapiens
tacactgtgccttttcc

SEQ ID NO: 3395745 - DNA, 11 bp, Homo sapiens
tacactgtgta

SEQ ID NO: 3395746 - DNA, 16 bp, Homo sapiens
tacactgttagaacac

SEQ ID NO: 3395747 - DNA, 19 bp, Homo sapiens
tacactgttagaacactat

SEQ ID NO: 3395748 - DNA, 21 bp, Homo sapiens
tacactgttagaacactattt

SEQ ID NO: 3395749 - DNA, 13 bp, Homo sapiens
tacacttggagcc

SEQ ID NO: 3395750 - DNA, 14 bp, Homo sapiens
tacacttggagccc

SEQ ID NO: 3395751 - DNA, 17 bp, Homo sapiens
tacacttgtataaatgt

SEQ ID NO: 3395752 - DNA, 14 bp, Homo sapiens
tacagaaaaatctt

SEQ ID NO: 3395753 - DNA, 14 bp, Homo sapiens
tacagaaagctgcc

SEQ ID NO: 3395754 - DNA, 16 bp, Homo sapiens
tacagaataatccagt

SEQ ID NO: 3395755 - DNA, 13 bp, Homo sapiens
tacagaatatttc

SEQ ID NO: 3395756 - DNA, 14 bp, Homo sapiens
tacagaatttgaat

SEQ ID NO: 3395757 - DNA, 19 bp, Homo sapiens
tacagacactaagttatag

SEQ ID NO: 3395758 - DNA, 21 bp, Homo sapiens
tacagacagaagagaaggaag

SEQ ID NO: 3395759 - DNA, 16 bp, Homo sapiens
tacagacctgcttttt

SEQ ID NO: 3395760 - DNA, 22 bp, Homo sapiens
tacagacctgctttttgaaatg

SEQ ID NO: 3395761 - DNA, 15 bp, Homo sapiens
tactgggttcttgtt

SEQ ID NO: 3395762 - DNA, 13 bp, Homo sapiens
tactggtccaaaa

SEQ ID NO: 3395763 - DNA, 18 bp, Homo sapiens
tactggtccaaaagattg

SEQ ID NO: 3395764 - DNA, 18 bp, Homo sapiens
tactggtcttgtggaatt

SEQ ID NO: 3395765 - DNA, 15 bp, Homo sapiens
tactggttggctccc

SEQ ID NO: 3395766 - DNA, 16 bp, Homo sapiens
tactgtaacattcagg

SEQ ID NO: 3395767 - DNA, 19 bp, Homo sapiens
tactgtaataatacctcaa

SEQ ID NO: 3395768 - DNA, 15 bp, Homo sapiens
tactgtaattcctca

SEQ ID NO: 3395769 - DNA, 12 bp, Homo sapiens
tactgtaatttt

SEQ ID NO: 3395770 - DNA, 20 bp, Homo sapiens
tactgtaattttatatgaag

SEQ ID NO: 3395771 - DNA, 15 bp, Homo sapiens
tactgtactttttta

SEQ ID NO: 3395772 - DNA, 12 bp, Homo sapiens
tactgtagtttt

SEQ ID NO: 3395773 - DNA, 14 bp, Homo sapiens
tactgtatatgtat

SEQ ID NO: 3395774 - DNA, 16 bp, Homo sapiens
tactgtatatgtattc

SEQ ID NO: 3395775 - DNA, 15 bp, Homo sapiens
tactgtatattcagg

SEQ ID NO: 3395776 - DNA, 18 bp, Homo sapiens
tactgtatgccttctgta

SEQ ID NO: 3395777 - DNA, 16 bp, Homo sapiens
tactgtatttctaaga

SEQ ID NO: 3395778 - DNA, 17 bp, Homo sapiens
tactgtcagattaaatt

SEQ ID NO: 3395779 - DNA, 22 bp, Homo sapiens
tactgtcagattaaattacagc

SEQ ID NO: 3395780 - DNA, 19 bp, Homo sapiens
tactgtctggttttaacaa

SEQ ID NO: 3395781 - DNA, 20 bp, Homo sapiens
tactgtctggttttaacaat

SEQ ID NO: 3395782 - DNA, 22 bp, Homo sapiens
tactgtctggttttaacaattt

SEQ ID NO: 3395783 - DNA, 16 bp, Homo sapiens
tactgtctttattctt

SEQ ID NO: 3395784 - DNA, 16 bp, Homo sapiens
tactgtgcagaataat

SEQ ID NO: 3395785 - DNA, 16 bp, Homo sapiens
tactgtgcatctcctt

SEQ ID NO: 3395786 - DNA, 14 bp, Homo sapiens
tactgtggaggaag

SEQ ID NO: 3395787 - DNA, 18 bp, Homo sapiens
tactgtggaggaaggatt

SEQ ID NO: 3395788 - DNA, 23 bp, Homo sapiens
tactgtggaggaaggattgtaaa

SEQ ID NO: 3395789 - DNA, 19 bp, Homo sapiens
tactgtgtctcatggattt

SEQ ID NO: 3395790 - DNA, 18 bp, Homo sapiens
tactgtgtgtgtgaatga

SEQ ID NO: 3395791 - DNA, 22 bp, Homo sapiens
tactgtgttcctggcaatagtg

SEQ ID NO: 3395792 - DNA, 17 bp, Homo sapiens
tactgtgtttcagcatg

SEQ ID NO: 3395793 - DNA, 18 bp, Homo sapiens
tactgttaaccatttaag

SEQ ID NO: 3395794 - DNA, 13 bp, Homo sapiens
tactgttcctttc

SEQ ID NO: 3395795 - DNA, 13 bp, Homo sapiens
tactgttctaaag

SEQ ID NO: 3395796 - DNA, 14 bp, Homo sapiens
tactgttctaaagc

SEQ ID NO: 3395797 - DNA, 18 bp, Homo sapiens
tactgttctaaagctctg

SEQ ID NO: 3395798 - DNA, 19 bp, Homo sapiens
tactgttctaaagctctga

SEQ ID NO: 3395799 - DNA, 16 bp, Homo sapiens
tactgttctgtgtctt

SEQ ID NO: 3395800 - DNA, 12 bp, Homo sapiens
tactgttcttgc

SEQ ID NO: 3395801 - DNA, 16 bp, Homo sapiens
tactgttcttgctgct

SEQ ID NO: 3395802 - DNA, 19 bp, Homo sapiens
tactgttcttgctgctaga

SEQ ID NO: 3395803 - DNA, 22 bp, Homo sapiens
tactgttgtaagaattctgatt

SEQ ID NO: 3395804 - DNA, 21 bp, Homo sapiens
tactgtttaccatttttcatt

SEQ ID NO: 3395805 - DNA, 16 bp, Homo sapiens
tactgttttaattgta

SEQ ID NO: 3395806 - DNA, 23 bp, Homo sapiens
tacttaaaaatagtcttccacaa

SEQ ID NO: 3395807 - DNA, 12 bp, Homo sapiens
tacttaagagaa

SEQ ID NO: 3395808 - DNA, 13 bp, Homo sapiens
tacttaagagaaa

SEQ ID NO: 3395809 - DNA, 14 bp, Homo sapiens
tacttaagagaaat

SEQ ID NO: 3395810 - DNA, 15 bp, Homo sapiens
tacttaagagaaatg

SEQ ID NO: 3395811 - DNA, 14 bp, Homo sapiens
tacttaataaattc

SEQ ID NO: 3395812 - DNA, 17 bp, Homo sapiens
tacttaataaattcaga

SEQ ID NO: 3395813 - DNA, 18 bp, Homo sapiens
tacttaattcctttctca

SEQ ID NO: 3395814 - DNA, 13 bp, Homo sapiens
tacttacaaaaat

SEQ ID NO: 3395815 - DNA, 16 bp, Homo sapiens
tacttacaaaaatggg

SEQ ID NO: 3395816 - DNA, 16 bp, Homo sapiens
tacttactataatttg

SEQ ID NO: 3395817 - DNA, 19 bp, Homo sapiens
tacttagccagttcaaagt

SEQ ID NO: 3395818 - DNA, 16 bp, Homo sapiens
tacttagctgtactat

SEQ ID NO: 3395819 - DNA, 16 bp, Homo sapiens
tacttaggttattttg

SEQ ID NO: 3395820 - DNA, 18 bp, Homo sapiens
tacttaggttattttgct

SEQ ID NO: 3395821 - DNA, 13 bp, Homo sapiens
tacttagtggtat

SEQ ID NO: 3395822 - DNA, 19 bp, Homo sapiens
tacttagtggtatgtctct

SEQ ID NO: 3395823 - DNA, 14 bp, Homo sapiens
tacttatattttcg

SEQ ID NO: 3395824 - DNA, 16 bp, Homo sapiens
tacttatattttcgta

SEQ ID NO: 3395825 - DNA, 21 bp, Homo sapiens
tacttatatttttaataaaag

SEQ ID NO: 3395826 - DNA, 17 bp, Homo sapiens
tacttatttttgacagt

SEQ ID NO: 3395827 - DNA, 13 bp, Homo sapiens
tacttcaaaaata

SEQ ID NO: 3395828 - DNA, 16 bp, Homo sapiens
tacttcaaaagccata

SEQ ID NO: 3395829 - DNA, 23 bp, Homo sapiens
tacttcaagttaaagtgaataac

SEQ ID NO: 3395830 - DNA, 21 bp, Homo sapiens
tacttccataggacatactgc

SEQ ID NO: 3395831 - DNA, 21 bp, Homo sapiens
tacttccctcaggcctatgca

SEQ ID NO: 3395832 - DNA, 19 bp, Homo sapiens
tacttcctatcaagccagt

SEQ ID NO: 3395833 - DNA, 18 bp, Homo sapiens
tacttcctcctgatggcc

SEQ ID NO: 3395834 - DNA, 22 bp, Homo sapiens
tacttcctgagtggccagggaa

SEQ ID NO: 3395835 - DNA, 23 bp, Homo sapiens
tacttcctgtgacttcagctctg

SEQ ID NO: 3395836 - DNA, 18 bp, Homo sapiens
tacttcgtcttctaattt

SEQ ID NO: 3395837 - DNA, 18 bp, Homo sapiens
tacttctccaccctgctc

SEQ ID NO: 3395838 - DNA, 20 bp, Homo sapiens
tacttctgactttacttgtg

SEQ ID NO: 3395839 - DNA, 20 bp, Homo sapiens
tacttctgtaattgtgtgga

SEQ ID NO: 3395840 - DNA, 17 bp, Homo sapiens
tacttctgtgttcattt

SEQ ID NO: 3395841 - DNA, 16 bp, Homo sapiens
tacttcttatacattt

SEQ ID NO: 3395842 - DNA, 13 bp, Homo sapiens
tacttcttgaata

SEQ ID NO: 3395843 - DNA, 19 bp, Homo sapiens
tacttgataatattagtga

SEQ ID NO: 3395844 - DNA, 15 bp, Homo sapiens
tacttgatgattttt

SEQ ID NO: 3395845 - DNA, 17 bp, Homo sapiens
tacttgcttattacatt

SEQ ID NO: 3395846 - DNA, 16 bp, Homo sapiens
tacttggaactaggct

SEQ ID NO: 3395847 - DNA, 14 bp, Homo sapiens
tacttggatttagt

SEQ ID NO: 3395848 - DNA, 17 bp, Homo sapiens
tacttgggaagctgagg

SEQ ID NO: 3395849 - DNA, 19 bp, Homo sapiens
tacttgggaagctgaggcg

SEQ ID NO: 3395850 - DNA, 23 bp, Homo sapiens
tacttgggagacctgtaatcata

SEQ ID NO: 3395851 - DNA, 14 bp, Homo sapiens
tacttggtttgtgt

SEQ ID NO: 3395852 - DNA, 14 bp, Homo sapiens
tacttgtctgaggc

SEQ ID NO: 3395853 - DNA, 18 bp, Homo sapiens
tacttgtctgaggcctca

SEQ ID NO: 3395854 - DNA, 20 bp, Homo sapiens
tacttgtgaaacacagctgt

SEQ ID NO: 3395855 - DNA, 19 bp, Homo sapiens
tacttgtggacacagctct

SEQ ID NO: 3395856 - DNA, 18 bp, Homo sapiens
tacttgtggtgtgaccat

SEQ ID NO: 3395857 - DNA, 18 bp, Homo sapiens
tacttgtggttttcaaat

SEQ ID NO: 3395858 - DNA, 18 bp, Homo sapiens
tacttgtgtttgcttaaa

SEQ ID NO: 3395859 - DNA, 22 bp, Homo sapiens
tacttgtgtttgcttaaacaaa

SEQ ID NO: 3395860 - DNA, 13 bp, Homo sapiens
tacttgttttgga

SEQ ID NO: 3395861 - DNA, 16 bp, Homo sapiens
tactttaaaaaggaaa

SEQ ID NO: 3395862 - DNA, 17 bp, Homo sapiens
tactttaaaaaggaaat

SEQ ID NO: 3395863 - DNA, 21 bp, Homo sapiens
tactttaatgattataatcat

SEQ ID NO: 3395864 - DNA, 16 bp, Homo sapiens
tactttactcattttt

SEQ ID NO: 3395865 - DNA, 17 bp, Homo sapiens
tactttagaagcctgca

SEQ ID NO: 3395866 - DNA, 21 bp, Homo sapiens
tactttagaagcctgcataat

SEQ ID NO: 3395867 - DNA, 15 bp, Homo sapiens
tactttagtatgacg

SEQ ID NO: 3395868 - DNA, 12 bp, Homo sapiens
tactttatatct

SEQ ID NO: 3395869 - DNA, 22 bp, Homo sapiens
tactttatcatgaatgctttta

SEQ ID NO: 3395870 - DNA, 18 bp, Homo sapiens
tactttattaatatgagt

SEQ ID NO: 3395871 - DNA, 14 bp, Homo sapiens
tactttattgtaca

SEQ ID NO: 3395872 - DNA, 13 bp, Homo sapiens
tactttatttctg

SEQ ID NO: 3395873 - DNA, 14 bp, Homo sapiens
tactttatttctga

SEQ ID NO: 3395874 - DNA, 16 bp, Homo sapiens
tactttccatttggta

SEQ ID NO: 3395875 - DNA, 17 bp, Homo sapiens
tactttcgaaatttcat

SEQ ID NO: 3395876 - DNA, 21 bp, Homo sapiens
tactttcgaaatttcattttc

SEQ ID NO: 3395877 - DNA, 16 bp, Homo sapiens
tactttctctgtagtt

SEQ ID NO: 3395878 - DNA, 20 bp, Homo sapiens
tactttctctgtagttccta

SEQ ID NO: 3395879 - DNA, 13 bp, Homo sapiens
tactttcttataa

SEQ ID NO: 3395880 - DNA, 17 bp, Homo sapiens
tactttcttcaggtaaa

SEQ ID NO: 3395881 - DNA, 19 bp, Homo sapiens
tactttctttcagatgttt

SEQ ID NO: 3395882 - DNA, 23 bp, Homo sapiens
tactttgatattttcaacgcagc

SEQ ID NO: 3395883 - DNA, 21 bp, Homo sapiens
tactttgccatttttctataa

SEQ ID NO: 3395884 - DNA, 13 bp, Homo sapiens
tactttgcttccg

SEQ ID NO: 3395885 - DNA, 17 bp, Homo sapiens
tactttggaattcttag

SEQ ID NO: 3395886 - DNA, 17 bp, Homo sapiens
tactttggcaatttcct

SEQ ID NO: 3395887 - DNA, 20 bp, Homo sapiens
tagcctgtttcttcctgtta

SEQ ID NO: 3395888 - DNA, 21 bp, Homo sapiens
tagccttagaagtcacacagt

SEQ ID NO: 3395889 - DNA, 12 bp, Homo sapiens
tagccttgcttg

SEQ ID NO: 3395890 - DNA, 15 bp, Homo sapiens
tagccttgcttgtta

SEQ ID NO: 3395891 - DNA, 14 bp, Homo sapiens
tagccttgtgccct

SEQ ID NO: 3395892 - DNA, 16 bp, Homo sapiens
tagccttgtgccctgc

SEQ ID NO: 3395893 - DNA, 22 bp, Homo sapiens
tagccttgtgccctgcccccat

SEQ ID NO: 3395894 - DNA, 16 bp, Homo sapiens
tagcctttggctctgg

SEQ ID NO: 3395895 - DNA, 19 bp, Homo sapiens
tagcgatctctcctggcct

SEQ ID NO: 3395896 - DNA, 20 bp, Homo sapiens
tagcggaaaagttgtcttaa

SEQ ID NO: 3395897 - DNA, 14 bp, Homo sapiens
tagcggagcccagc

SEQ ID NO: 3395898 - DNA, 16 bp, Homo sapiens
tagcggagcccagcct

SEQ ID NO: 3395899 - DNA, 13 bp, Homo sapiens
tagcgttcccaac

SEQ ID NO: 3395900 - DNA, 15 bp, Homo sapiens
tagctaaaagacaaa

SEQ ID NO: 3395901 - DNA, 20 bp, Homo sapiens
tagctaacattttaaataaa

SEQ ID NO: 3395902 - DNA, 23 bp, Homo sapiens
tagctaacattttaaataaaaga

SEQ ID NO: 3395903 - DNA, 15 bp, Homo sapiens
tagctaactgtaaat

SEQ ID NO: 3395904 - DNA, 17 bp, Homo sapiens
tagctaactgtaaatca

SEQ ID NO: 3395905 - DNA, 14 bp, Homo sapiens
tagctaataagtag

SEQ ID NO: 3395906 - DNA, 19 bp, Homo sapiens
tagctaatgtaataactgt

SEQ ID NO: 3395907 - DNA, 19 bp, Homo sapiens
tagctacccaaaagagaaa

SEQ ID NO: 3395908 - DNA, 21 bp, Homo sapiens
tagctacccaaaagagaaaaa

SEQ ID NO: 3395909 - DNA, 19 bp, Homo sapiens
tagctagaaatatgatttt

SEQ ID NO: 3395910 - DNA, 14 bp, Homo sapiens
tagctatatccatg

SEQ ID NO: 3395911 - DNA, 15 bp, Homo sapiens
tagctatatccatgt

SEQ ID NO: 3395912 - DNA, 17 bp, Homo sapiens
tagctatatccatgtac

SEQ ID NO: 3395913 - DNA, 19 bp, Homo sapiens
tagctatatccatgtactg

SEQ ID NO: 3395914 - DNA, 16 bp, Homo sapiens
tagctatcagaagacc

SEQ ID NO: 3395915 - DNA, 16 bp, Homo sapiens
tagctatgtgaccttg

SEQ ID NO: 3395916 - DNA, 14 bp, Homo sapiens
tagctattactgtc

SEQ ID NO: 3395917 - DNA, 15 bp, Homo sapiens
tagctattactgtct

SEQ ID NO: 3395918 - DNA, 21 bp, Homo sapiens
tagctcaagtttaaaagccat

SEQ ID NO: 3395919 - DNA, 21 bp, Homo sapiens
tagctcctgccacatggagcc

SEQ ID NO: 3395920 - DNA, 12 bp, Homo sapiens
tagctcctgtgg

SEQ ID NO: 3395921 - DNA, 14 bp, Homo sapiens
tagctctctaggcc

SEQ ID NO: 3395922 - DNA, 17 bp, Homo sapiens
tagctctgcctccctct

SEQ ID NO: 3395923 - DNA, 13 bp, Homo sapiens
tagctctgggggg

SEQ ID NO: 3395924 - DNA, 16 bp, Homo sapiens
tagctctggggggcag

SEQ ID NO: 3395925 - DNA, 17 bp, Homo sapiens
tagctctggggggcagt

SEQ ID NO: 3395926 - DNA, 19 bp, Homo sapiens
tagctctggggggcagttg

SEQ ID NO: 3395927 - DNA, 22 bp, Homo sapiens
tagctctggggtgggcagtttt

SEQ ID NO: 3395928 - DNA, 23 bp, Homo sapiens
tagctctggggtgggcagttttt

SEQ ID NO: 3395929 - DNA, 13 bp, Homo sapiens
tagctcttacaca

SEQ ID NO: 3395930 - DNA, 13 bp, Homo sapiens
tagctctttcctt

SEQ ID NO: 3395931 - DNA, 14 bp, Homo sapiens
tagctctttggtct

SEQ ID NO: 3395932 - DNA, 17 bp, Homo sapiens
tagctgaagaattgaaa

SEQ ID NO: 3395933 - DNA, 22 bp, Homo sapiens
tagctgaagaattgaaaagttt

SEQ ID NO: 3395934 - DNA, 21 bp, Homo sapiens
tagctgacccagccccttgag

SEQ ID NO: 3395935 - DNA, 15 bp, Homo sapiens
tagctgctctgagca

SEQ ID NO: 3395936 - DNA, 13 bp, Homo sapiens
tagctggcaggac

SEQ ID NO: 3395937 - DNA, 16 bp, Homo sapiens
tagctggcaggacaca

SEQ ID NO: 3395938 - DNA, 17 bp, Homo sapiens
tagctgggactacaggc

SEQ ID NO: 3395939 - DNA, 18 bp, Homo sapiens
tagctgggactacaggtg

SEQ ID NO: 3395940 - DNA, 12 bp, Homo sapiens
tagctggggctt

SEQ ID NO: 3395941 - DNA, 17 bp, Homo sapiens
tagctgtactataagta

SEQ ID NO: 3395942 - DNA, 17 bp, Homo sapiens
tagctgtacttcttgaa

SEQ ID NO: 3395943 - DNA, 17 bp, Homo sapiens
tagctgtctagagtagc

SEQ ID NO: 3395944 - DNA, 21 bp, Homo sapiens
tagctgtctgctcagacagaa

SEQ ID NO: 3395945 - DNA, 13 bp, Homo sapiens
tagctgttgagct

SEQ ID NO: 3395946 - DNA, 16 bp, Homo sapiens
tagcttaccagaagct

SEQ ID NO: 3395947 - DNA, 15 bp, Homo sapiens
tagcttacctgacac

SEQ ID NO: 3395948 - DNA, 12 bp, Homo sapiens
tagcttatcttt

SEQ ID NO: 3395949 - DNA, 13 bp, Homo sapiens
tagcttatctttc

SEQ ID NO: 3395950 - DNA, 17 bp, Homo sapiens
tagcttgcagaactgta

SEQ ID NO: 3395951 - DNA, 15 bp, Homo sapiens
tagcttgttccctgt

SEQ ID NO: 3395952 - DNA, 21 bp, Homo sapiens
tagctttaatcaatcatgccc

SEQ ID NO: 3395953 - DNA, 14 bp, Homo sapiens
tagctttaccctca

SEQ ID NO: 3395954 - DNA, 18 bp, Homo sapiens
tagctttattatggcttg

SEQ ID NO: 3395955 - DNA, 21 bp, Homo sapiens
tagctttattatggcttgtga

SEQ ID NO: 3395956 - DNA, 22 bp, Homo sapiens
tagctttattttttaagtattt

SEQ ID NO: 3395957 - DNA, 13 bp, Homo sapiens
tagctttccacat

SEQ ID NO: 3395958 - DNA, 19 bp, Homo sapiens
tagctttcccaaataaact

SEQ ID NO: 3395959 - DNA, 11 bp, Homo sapiens
tagctttgctc

SEQ ID NO: 3395960 - DNA, 13 bp, Homo sapiens
tagcttttcaaac

SEQ ID NO: 3395961 - DNA, 13 bp, Homo sapiens
tagcttttccctt

SEQ ID NO: 3395962 - DNA, 17 bp, Homo sapiens
tagctttttaaaacatt

SEQ ID NO: 3395963 - DNA, 17 bp, Homo sapiens
taggaaaagtacattta

SEQ ID NO: 3395964 - DNA, 17 bp, Homo sapiens
taggaaactaagcattg

SEQ ID NO: 3395965 - DNA, 18 bp, Homo sapiens
taggaaactaagcattgt

SEQ ID NO: 3395966 - DNA, 14 bp, Homo sapiens
taggaaataaaacc

SEQ ID NO: 3395967 - DNA, 16 bp, Homo sapiens
taggaaataaaacctt

SEQ ID NO: 3395968 - DNA, 20 bp, Homo sapiens
taggaaatctagaagtagtc

SEQ ID NO: 3395969 - DNA, 14 bp, Homo sapiens
taggaagaatcagt

SEQ ID NO: 3395970 - DNA, 14 bp, Homo sapiens
taggaagagaaacc

SEQ ID NO: 3395971 - DNA, 15 bp, Homo sapiens
taggaagagaaacca

SEQ ID NO: 3395972 - DNA, 22 bp, Homo sapiens
taggaagagtagcatttcattc

SEQ ID NO: 3395973 - DNA, 18 bp, Homo sapiens
taggaaggtctcattctt

SEQ ID NO: 3395974 - DNA, 21 bp, Homo sapiens
taggaaggtctcattcttcca

SEQ ID NO: 3395975 - DNA, 22 bp, Homo sapiens
taggaagttttctgtagtcatt

SEQ ID NO: 3395976 - DNA, 12 bp, Homo sapiens
taggaataaata

SEQ ID NO: 3395977 - DNA, 17 bp, Homo sapiens
taggaatagaggaagaa

SEQ ID NO: 3395978 - DNA, 20 bp, Homo sapiens
taggaatcattcagaaatgt

SEQ ID NO: 3395979 - DNA, 20 bp, Homo sapiens
taggaatcccagaggtggga

SEQ ID NO: 3395980 - DNA, 21 bp, Homo sapiens
taggaattcccagcccaaagc

SEQ ID NO: 3395981 - DNA, 17 bp, Homo sapiens
taggaccaagcatcttg

SEQ ID NO: 3395982 - DNA, 18 bp, Homo sapiens
taggaccactcagcccct

SEQ ID NO: 3395983 - DNA, 23 bp, Homo sapiens
taggaccatggttaagagtccaa

SEQ ID NO: 3395984 - DNA, 18 bp, Homo sapiens
taggacgttggcctcagg

SEQ ID NO: 3395985 - DNA, 15 bp, Homo sapiens
taggactctgaggct

SEQ ID NO: 3395986 - DNA, 14 bp, Homo sapiens
taggactgttcttt

SEQ ID NO: 3395987 - DNA, 17 bp, Homo sapiens
taggagaaccaaatctg

SEQ ID NO: 3395988 - DNA, 20 bp, Homo sapiens
taggagaagaggcatcctgc

SEQ ID NO: 3395989 - DNA, 12 bp, Homo sapiens
taggagactgcg

SEQ ID NO: 3395990 - DNA, 22 bp, Homo sapiens
taggagagactgaaagcagcag

SEQ ID NO: 3395991 - DNA, 19 bp, Homo sapiens
taggagagattgggagaaa

SEQ ID NO: 3395992 - DNA, 20 bp, Homo sapiens
taggagagattgggagaaat

SEQ ID NO: 3395993 - DNA, 22 bp, Homo sapiens
taggagagattgggagaaatca

SEQ ID NO: 3395994 - DNA, 14 bp, Homo sapiens
taggagaggatgag

SEQ ID NO: 3395995 - DNA, 22 bp, Homo sapiens
taggagagggggcgatatagag

SEQ ID NO: 3395996 - DNA, 14 bp, Homo sapiens
taggagctaaggct

SEQ ID NO: 3395997 - DNA, 18 bp, Homo sapiens
taggagctgccttggctc

SEQ ID NO: 3395998 - DNA, 18 bp, Homo sapiens
taggagtgtgtgacattc

SEQ ID NO: 3395999 - DNA, 23 bp, Homo sapiens
taggagttcgagaccagcctggc

SEQ ID NO: 3396000 - DNA, 18 bp, Homo sapiens
taggatagctaactgtaa

SEQ ID NO: 3396001 - DNA, 21 bp, Homo sapiens
taggatagctaactgtaaatc

SEQ ID NO: 3396002 - DNA, 19 bp, Homo sapiens
taggatagttgatgcatgt

SEQ ID NO: 3396003 - DNA, 14 bp, Homo sapiens
taggatgctgcagc

SEQ ID NO: 3396004 - DNA, 18 bp, Homo sapiens
taggatggatagaaggaa

SEQ ID NO: 3396005 - DNA, 18 bp, Homo sapiens
taggatggggctcccagc

SEQ ID NO: 3396006 - DNA, 12 bp, Homo sapiens
taggattcaagt

SEQ ID NO: 3396007 - DNA, 21 bp, Homo sapiens
taggatttaacagtcatttaa

SEQ ID NO: 3396008 - DNA, 17 bp, Homo sapiens
taggatttcttaaattt

SEQ ID NO: 3396009 - DNA, 13 bp, Homo sapiens
taggattttcaca

SEQ ID NO: 3396010 - DNA, 13 bp, Homo sapiens
taggatttttaga

SEQ ID NO: 3396011 - DNA, 18 bp, Homo sapiens
taggcactgtagttctaa

SEQ ID NO: 3396012 - DNA, 14 bp, Homo sapiens
taggcatcccaggg

SEQ ID NO: 3396013 - DNA, 16 bp, Homo sapiens
taggcatcccagggga

SEQ ID NO: 3396014 - DNA, 15 bp, Homo sapiens
tatatcctgtgactg

SEQ ID NO: 3396015 - DNA, 17 bp, Homo sapiens
tatatcctgtgactgtc

SEQ ID NO: 3396016 - DNA, 18 bp, Homo sapiens
tatatctaattatttcca

SEQ ID NO: 3396017 - DNA, 14 bp, Homo sapiens
tatatctctatttg

SEQ ID NO: 3396018 - DNA, 16 bp, Homo sapiens
tatatctcttggaaaa

SEQ ID NO: 3396019 - DNA, 23 bp, Homo sapiens
tatatctgaagagtatccttcct

SEQ ID NO: 3396020 - DNA, 19 bp, Homo sapiens
tatatctgtaatgatactg

SEQ ID NO: 3396021 - DNA, 16 bp, Homo sapiens
tatatcttatgttaaa

SEQ ID NO: 3396022 - DNA, 22 bp, Homo sapiens
tatatgaatttaaatataattc

SEQ ID NO: 3396023 - DNA, 18 bp, Homo sapiens
tatatgagactttatgtg

SEQ ID NO: 3396024 - DNA, 14 bp, Homo sapiens
tatatgatttatat

SEQ ID NO: 3396025 - DNA, 17 bp, Homo sapiens
tatatgccaagctaatt

SEQ ID NO: 3396026 - DNA, 17 bp, Homo sapiens
tatatgccctcaagtaa

SEQ ID NO: 3396027 - DNA, 16 bp, Homo sapiens
tatatggcccagcctt

SEQ ID NO: 3396028 - DNA, 12 bp, Homo sapiens
tatatgtacatg

SEQ ID NO: 3396029 - DNA, 16 bp, Homo sapiens
tatatgtattatttat

SEQ ID NO: 3396030 - DNA, 15 bp, Homo sapiens
tatatgtattccctt

SEQ ID NO: 3396031 - DNA, 19 bp, Homo sapiens
tatatgtctgataatgatt

SEQ ID NO: 3396032 - DNA, 17 bp, Homo sapiens
tatatgtgtatatatac

SEQ ID NO: 3396033 - DNA, 19 bp, Homo sapiens
tatatgtgtatatatacat

SEQ ID NO: 3396034 - DNA, 14 bp, Homo sapiens
tatatgttcttcat

SEQ ID NO: 3396035 - DNA, 22 bp, Homo sapiens
tatatgttttataattcataac

SEQ ID NO: 3396036 - DNA, 21 bp, Homo sapiens
tatattaaaattccaaattca

SEQ ID NO: 3396037 - DNA, 21 bp, Homo sapiens
tatattaatttcggttatagc

SEQ ID NO: 3396038 - DNA, 21 bp, Homo sapiens
tatattaccagcaagaataaa

SEQ ID NO: 3396039 - DNA, 22 bp, Homo sapiens
tatattagatcaaatagttgca

SEQ ID NO: 3396040 - DNA, 22 bp, Homo sapiens
tatattagtgaagatggtttca

SEQ ID NO: 3396041 - DNA, 20 bp, Homo sapiens
tatattataaatatatataa

SEQ ID NO: 3396042 - DNA, 22 bp, Homo sapiens
tatattataaatatatataaag

SEQ ID NO: 3396043 - DNA, 14 bp, Homo sapiens
tatattatgtgaag

SEQ ID NO: 3396044 - DNA, 17 bp, Homo sapiens
tatattattgtaagttg

SEQ ID NO: 3396045 - DNA, 18 bp, Homo sapiens
tatattattgtaagttgt

SEQ ID NO: 3396046 - DNA, 21 bp, Homo sapiens
tatattattgtaagttgtaca

SEQ ID NO: 3396047 - DNA, 22 bp, Homo sapiens
tatattcaggacttgaaagaaa

SEQ ID NO: 3396048 - DNA, 18 bp, Homo sapiens
tatattcttatgttatca

SEQ ID NO: 3396049 - DNA, 13 bp, Homo sapiens
tatattgaataaa

SEQ ID NO: 3396050 - DNA, 16 bp, Homo sapiens
tatattggtttgcaca

SEQ ID NO: 3396051 - DNA, 21 bp, Homo sapiens
tatattggtttgcacaagttc

SEQ ID NO: 3396052 - DNA, 18 bp, Homo sapiens
tatatttaaaaaattatg

SEQ ID NO: 3396053 - DNA, 22 bp, Homo sapiens
tatatttaaaaaattatggaat

SEQ ID NO: 3396054 - DNA, 16 bp, Homo sapiens
tatatttaaaaattgt

SEQ ID NO: 3396055 - DNA, 21 bp, Homo sapiens
tatatttaaaaattgtttctt

SEQ ID NO: 3396056 - DNA, 15 bp, Homo sapiens
tatatttaacaagat

SEQ ID NO: 3396057 - DNA, 21 bp, Homo sapiens
tatatttaacttaacccagat

SEQ ID NO: 3396058 - DNA, 19 bp, Homo sapiens
tatatttaatgcattaaac

SEQ ID NO: 3396059 - DNA, 15 bp, Homo sapiens
tatatttaattatta

SEQ ID NO: 3396060 - DNA, 15 bp, Homo sapiens
tatatttataactca

SEQ ID NO: 3396061 - DNA, 16 bp, Homo sapiens
tatatttataactcat

SEQ ID NO: 3396062 - DNA, 19 bp, Homo sapiens
tatatttattcataatgaa

SEQ ID NO: 3396063 - DNA, 23 bp, Homo sapiens
tatatttcacaggctgtaaattg

SEQ ID NO: 3396064 - DNA, 20 bp, Homo sapiens
tatatttcacttttgttctg

SEQ ID NO: 3396065 - DNA, 11 bp, Homo sapiens
tatatttggaa

SEQ ID NO: 3396066 - DNA, 14 bp, Homo sapiens
tatatttggaaaga

SEQ ID NO: 3396067 - DNA, 13 bp, Homo sapiens
tatatttgtacaa

SEQ ID NO: 3396068 - DNA, 21 bp, Homo sapiens
tatatttgtgatagcactttc

SEQ ID NO: 3396069 - DNA, 23 bp, Homo sapiens
tatatttgtgatagcactttcta

SEQ ID NO: 3396070 - DNA, 13 bp, Homo sapiens
tatattttaatag

SEQ ID NO: 3396071 - DNA, 15 bp, Homo sapiens
tatattttagcattt

SEQ ID NO: 3396072 - DNA, 14 bp, Homo sapiens
tatattttcagtac

SEQ ID NO: 3396073 - DNA, 14 bp, Homo sapiens
tatattttgctgtt

SEQ ID NO: 3396074 - DNA, 23 bp, Homo sapiens
tatattttgctgtttatgatcta

SEQ ID NO: 3396075 - DNA, 18 bp, Homo sapiens
tatattttgtactttgtg

SEQ ID NO: 3396076 - DNA, 13 bp, Homo sapiens
tatatttttatct

SEQ ID NO: 3396077 - DNA, 19 bp, Homo sapiens
tatattttttaatttgatg

SEQ ID NO: 3396078 - DNA, 22 bp, Homo sapiens
tatcaaaagaaatagaaaagga

SEQ ID NO: 3396079 - DNA, 14 bp, Homo sapiens
tatcaaaattgcct

SEQ ID NO: 3396080 - DNA, 18 bp, Homo sapiens
tatcaaaccctagccttg

SEQ ID NO: 3396081 - DNA, 22 bp, Homo sapiens
tatcaaatctgtatatgttgta

SEQ ID NO: 3396082 - DNA, 12 bp, Homo sapiens
tatcaactttag

SEQ ID NO: 3396083 - DNA, 14 bp, Homo sapiens
tatcaagacatagc

SEQ ID NO: 3396084 - DNA, 23 bp, Homo sapiens
tatcaagccagtacgtgctaaca

SEQ ID NO: 3396085 - DNA, 17 bp, Homo sapiens
tatcaagtcaatcattt

SEQ ID NO: 3396086 - DNA, 20 bp, Homo sapiens
tatcaagtcaatcatttctc

SEQ ID NO: 3396087 - DNA, 15 bp, Homo sapiens
tatcaagtggcatgt

SEQ ID NO: 3396088 - DNA, 14 bp, Homo sapiens
tatcaagtgtcttc

SEQ ID NO: 3396089 - DNA, 18 bp, Homo sapiens
tatcaatatctaatatat

SEQ ID NO: 3396090 - DNA, 21 bp, Homo sapiens
tatcaatatctaatatatatg

SEQ ID NO: 3396091 - DNA, 12 bp, Homo sapiens
tatcaatgtgtc

SEQ ID NO: 3396092 - DNA, 15 bp, Homo sapiens
tatcaatgtgtcttt

SEQ ID NO: 3396093 - DNA, 16 bp, Homo sapiens
tatcaatgtgtctttc

SEQ ID NO: 3396094 - DNA, 22 bp, Homo sapiens
tatcaatgtgtctttctaagaa

SEQ ID NO: 3396095 - DNA, 22 bp, Homo sapiens
tatcacgtctgacaaatgtgta

SEQ ID NO: 3396096 - DNA, 14 bp, Homo sapiens
tatcactctaaaaa

SEQ ID NO: 3396097 - DNA, 18 bp, Homo sapiens
tatcactctaaaaaacat

SEQ ID NO: 3396098 - DNA, 23 bp, Homo sapiens
tatcactctaaaaaacattttta

SEQ ID NO: 3396099 - DNA, 14 bp, Homo sapiens
tatcactttttgaa

SEQ ID NO: 3396100 - DNA, 16 bp, Homo sapiens
tatcactttttgaact

SEQ ID NO: 3396101 - DNA, 16 bp, Homo sapiens
tatcagaagagagggg

SEQ ID NO: 3396102 - DNA, 10 bp, Homo sapiens
tatcagaatt

SEQ ID NO: 3396103 - DNA, 17 bp, Homo sapiens
tatcagaattctcagaa

SEQ ID NO: 3396104 - DNA, 14 bp, Homo sapiens
tatcagacaagcac

SEQ ID NO: 3396105 - DNA, 20 bp, Homo sapiens
tatcagacaagcactatttt

SEQ ID NO: 3396106 - DNA, 13 bp, Homo sapiens
tatcagaggtcta

SEQ ID NO: 3396107 - DNA, 16 bp, Homo sapiens
tatcagaggtctattt

SEQ ID NO: 3396108 - DNA, 16 bp, Homo sapiens
tatcagatacatcact

SEQ ID NO: 3396109 - DNA, 14 bp, Homo sapiens
tatcagcaaagaaa

SEQ ID NO: 3396110 - DNA, 22 bp, Homo sapiens
tatcagcaatactcatcagagc

SEQ ID NO: 3396111 - DNA, 22 bp, Homo sapiens
tatcagggaaactaagattctt

SEQ ID NO: 3396112 - DNA, 13 bp, Homo sapiens
tatcaggggaaaa

SEQ ID NO: 3396113 - DNA, 20 bp, Homo sapiens
tatcagtcaatatttttaga

SEQ ID NO: 3396114 - DNA, 15 bp, Homo sapiens
tatcagtgaagcagt

SEQ ID NO: 3396115 - DNA, 16 bp, Homo sapiens
tatcagtgacagagtt

SEQ ID NO: 3396116 - DNA, 22 bp, Homo sapiens
tatcagtgacagagttcactat

SEQ ID NO: 3396117 - DNA, 19 bp, Homo sapiens
tatcagtgttttaaattct

SEQ ID NO: 3396118 - DNA, 21 bp, Homo sapiens
tatcagtgttttaaattctga

SEQ ID NO: 3396119 - DNA, 15 bp, Homo sapiens
tatcagttaacatta

SEQ ID NO: 3396120 - DNA, 21 bp, Homo sapiens
tatcagttgagcttcatatac

SEQ ID NO: 3396121 - DNA, 22 bp, Homo sapiens
tatcatacaaatcagttagttt

SEQ ID NO: 3396122 - DNA, 20 bp, Homo sapiens
tatcataccctttattctca

SEQ ID NO: 3396123 - DNA, 15 bp, Homo sapiens
tatcatagaaatgta

SEQ ID NO: 3396124 - DNA, 18 bp, Homo sapiens
tatcatagaaatgtaact

SEQ ID NO: 3396125 - DNA, 23 bp, Homo sapiens
tatcatagaaatgtaacttttgt

SEQ ID NO: 3396126 - DNA, 17 bp, Homo sapiens
tatcatataaacatttt

SEQ ID NO: 3396127 - DNA, 18 bp, Homo sapiens
tatcatcaagcaggaatt

SEQ ID NO: 3396128 - DNA, 13 bp, Homo sapiens
tatcatctccatc

SEQ ID NO: 3396129 - DNA, 14 bp, Homo sapiens
tatcatctgtcatt

SEQ ID NO: 3396130 - DNA, 19 bp, Homo sapiens
tatcatgaattttaaagta

SEQ ID NO: 3396131 - DNA, 14 bp, Homo sapiens
tatcatgacatgtt

SEQ ID NO: 3396132 - DNA, 19 bp, Homo sapiens
tatcatgcatgtcctgtaa

SEQ ID NO: 3396133 - DNA, 22 bp, Homo sapiens
tatcatgctttaaagtgtaata

SEQ ID NO: 3396134 - DNA, 23 bp, Homo sapiens
tatcatgctttaaagtgtaataa

SEQ ID NO: 3396135 - DNA, 12 bp, Homo sapiens
tatcatggaatt

SEQ ID NO: 3396136 - DNA, 13 bp, Homo sapiens
tatcatgttaacc

SEQ ID NO: 3396137 - DNA, 18 bp, Homo sapiens
tatcattctacagaataa

SEQ ID NO: 3396138 - DNA, 12 bp, Homo sapiens
tatcattctcag

SEQ ID NO: 3396139 - DNA, 13 bp, Homo sapiens
tatcattctcagt

SEQ ID NO: 3396140 - DNA, 16 bp, Homo sapiens
tatggagaattgctga

SEQ ID NO: 3396141 - DNA, 15 bp, Homo sapiens
tatggatgattaaat

SEQ ID NO: 3396142 - DNA, 11 bp, Homo sapiens
tatggatgtgg

SEQ ID NO: 3396143 - DNA, 22 bp, Homo sapiens
tatggcagaagacaccagagca

SEQ ID NO: 3396144 - DNA, 19 bp, Homo sapiens
tatggccacatttaatatc

SEQ ID NO: 3396145 - DNA, 15 bp, Homo sapiens
tatggcccagccttg

SEQ ID NO: 3396146 - DNA, 22 bp, Homo sapiens
tatggcccagtgtcaagttgtg

SEQ ID NO: 3396147 - DNA, 23 bp, Homo sapiens
tatggcctcagctgcctcacttc

SEQ ID NO: 3396148 - DNA, 18 bp, Homo sapiens
tatggctgatttatttct

SEQ ID NO: 3396149 - DNA, 17 bp, Homo sapiens
tatggctggccactgca

SEQ ID NO: 3396150 - DNA, 15 bp, Homo sapiens
tatgggagccccagg

SEQ ID NO: 3396151 - DNA, 20 bp, Homo sapiens
tatgggatattcccaagccg

SEQ ID NO: 3396152 - DNA, 19 bp, Homo sapiens
tatgggatgtaaacaatgt

SEQ ID NO: 3396153 - DNA, 16 bp, Homo sapiens
tatgggcattgacaaa

SEQ ID NO: 3396154 - DNA, 14 bp, Homo sapiens
tatgggtctaggac

SEQ ID NO: 3396155 - DNA, 19 bp, Homo sapiens
tatggtaactgctttctgt

SEQ ID NO: 3396156 - DNA, 17 bp, Homo sapiens
tatggtatgctggccag

SEQ ID NO: 3396157 - DNA, 19 bp, Homo sapiens
tatggtatgctggccagca

SEQ ID NO: 3396158 - DNA, 20 bp, Homo sapiens
tatggtgcagagaagctgga

SEQ ID NO: 3396159 - DNA, 18 bp, Homo sapiens
tatggtgctgctctgtgt

SEQ ID NO: 3396160 - DNA, 22 bp, Homo sapiens
tatggttccaatgaaatatgtt

SEQ ID NO: 3396161 - DNA, 21 bp, Homo sapiens
tatggttgatagtttacctga

SEQ ID NO: 3396162 - DNA, 14 bp, Homo sapiens
tatggttgccaccc

SEQ ID NO: 3396163 - DNA, 14 bp, Homo sapiens
tatgtaaacataat

SEQ ID NO: 3396164 - DNA, 19 bp, Homo sapiens
tatgtaaactgcattagaa

SEQ ID NO: 3396165 - DNA, 17 bp, Homo sapiens
tatgtaaagtatgtaaa

SEQ ID NO: 3396166 - DNA, 19 bp, Homo sapiens
tatgtaatatattgtacaa

SEQ ID NO: 3396167 - DNA, 23 bp, Homo sapiens
tatgtaatatattgtacaaatgt

SEQ ID NO: 3396168 - DNA, 23 bp, Homo sapiens
tatgtaatgtgtggtggcctcag

SEQ ID NO: 3396169 - DNA, 14 bp, Homo sapiens
tatgtaatttatgc

SEQ ID NO: 3396170 - DNA, 15 bp, Homo sapiens
tatgtaatttatgca

SEQ ID NO: 3396171 - DNA, 14 bp, Homo sapiens
tatgtacaagtgtt

SEQ ID NO: 3396172 - DNA, 15 bp, Homo sapiens
tatgtacatttgtct

SEQ ID NO: 3396173 - DNA, 16 bp, Homo sapiens
tatgtaccatgtacat

SEQ ID NO: 3396174 - DNA, 14 bp, Homo sapiens
tatgtactagtgtt

SEQ ID NO: 3396175 - DNA, 19 bp, Homo sapiens
tatgtacttagctgtacta

SEQ ID NO: 3396176 - DNA, 16 bp, Homo sapiens
tatgtacttgatactg

SEQ ID NO: 3396177 - DNA, 19 bp, Homo sapiens
tatgtacttgatactgaat

SEQ ID NO: 3396178 - DNA, 22 bp, Homo sapiens
tatgtacttgatactgaatgca

SEQ ID NO: 3396179 - DNA, 22 bp, Homo sapiens
tatgtagatatttggcttaaat

SEQ ID NO: 3396180 - DNA, 23 bp, Homo sapiens
tatgtagatatttggcttaaata

SEQ ID NO: 3396181 - DNA, 16 bp, Homo sapiens
tatgtagatgtgcatt

SEQ ID NO: 3396182 - DNA, 14 bp, Homo sapiens
tatgtagtaattga

SEQ ID NO: 3396183 - DNA, 17 bp, Homo sapiens
tatgtagtaattgacat

SEQ ID NO: 3396184 - DNA, 15 bp, Homo sapiens
tatgtagtattaaaa

SEQ ID NO: 3396185 - DNA, 19 bp, Homo sapiens
tatgtatatttttttaatt

SEQ ID NO: 3396186 - DNA, 20 bp, Homo sapiens
tatgtatggaatacagtgtt

SEQ ID NO: 3396187 - DNA, 22 bp, Homo sapiens
tatgtatgggtagggtaaatca

SEQ ID NO: 3396188 - DNA, 23 bp, Homo sapiens
tatgtatgggtagggtaaatcag

SEQ ID NO: 3396189 - DNA, 13 bp, Homo sapiens
tatgtatgttaat

SEQ ID NO: 3396190 - DNA, 16 bp, Homo sapiens
tatgtatgtttacata

SEQ ID NO: 3396191 - DNA, 21 bp, Homo sapiens
tatgtattatttataattcct

SEQ ID NO: 3396192 - DNA, 15 bp, Homo sapiens
tatgtattcccttgt

SEQ ID NO: 3396193 - DNA, 16 bp, Homo sapiens
tatgtattcccttgta

SEQ ID NO: 3396194 - DNA, 22 bp, Homo sapiens
tatgtattcccttgtattttgt

SEQ ID NO: 3396195 - DNA, 22 bp, Homo sapiens
tatgtattgtaaacatgtgttt

SEQ ID NO: 3396196 - DNA, 21 bp, Homo sapiens
tatgtcaataaacaacagctg

SEQ ID NO: 3396197 - DNA, 17 bp, Homo sapiens
tatgtccactgtgtata

SEQ ID NO: 3396198 - DNA, 12 bp, Homo sapiens
tatgtctgatgg

SEQ ID NO: 3396199 - DNA, 16 bp, Homo sapiens
tatgtctgtttttgta

SEQ ID NO: 3396200 - DNA, 14 bp, Homo sapiens
tatgtcttggacac

SEQ ID NO: 3396201 - DNA, 23 bp, Homo sapiens
tatgtgagtgtgtgtttgtgctg

SEQ ID NO: 3396202 - DNA, 13 bp, Homo sapiens
tatgtgattacaa

SEQ ID NO: 3396203 - DNA, 23 bp, Homo sapiens
tatgtgcactaccatagctacat

SEQ ID NO: 3396204 - DNA, 12 bp, Homo sapiens
tatgtgcactgt

SEQ ID NO: 3396205 - DNA, 23 bp, Homo sapiens
tatgtggctgaaaatgcaaagct

SEQ ID NO: 3396206 - DNA, 18 bp, Homo sapiens
tatgtgggatattgaatg

SEQ ID NO: 3396207 - DNA, 17 bp, Homo sapiens
tatgtgggcagattttc

SEQ ID NO: 3396208 - DNA, 23 bp, Homo sapiens
tatgtgggcagattttcagcaaa

SEQ ID NO: 3396209 - DNA, 14 bp, Homo sapiens
tatgtgtaaaatgt

SEQ ID NO: 3396210 - DNA, 17 bp, Homo sapiens
tatgtgtatatatacat

SEQ ID NO: 3396211 - DNA, 13 bp, Homo sapiens
tatgtgtatgtac

SEQ ID NO: 3396212 - DNA, 18 bp, Homo sapiens
tatgtgtatgtgccattt

SEQ ID NO: 3396213 - DNA, 18 bp, Homo sapiens
tatgtgtctgctaatgta

SEQ ID NO: 3396214 - DNA, 16 bp, Homo sapiens
tatgtgtctttataga

SEQ ID NO: 3396215 - DNA, 20 bp, Homo sapiens
tatgtgtctttatagatgta

SEQ ID NO: 3396216 - DNA, 16 bp, Homo sapiens
tatgtgtgaggagctg

SEQ ID NO: 3396217 - DNA, 13 bp, Homo sapiens
tatgtgtgcatgt

SEQ ID NO: 3396218 - DNA, 18 bp, Homo sapiens
tatgtgtgcatgtgtgta

SEQ ID NO: 3396219 - DNA, 17 bp, Homo sapiens
tatgtgtggtttcagtt

SEQ ID NO: 3396220 - DNA, 19 bp, Homo sapiens
tatgtgtgtgtatgtttgc

SEQ ID NO: 3396221 - DNA, 13 bp, Homo sapiens
tatgttaaagaga

SEQ ID NO: 3396222 - DNA, 13 bp, Homo sapiens
tatgttaaatact

SEQ ID NO: 3396223 - DNA, 14 bp, Homo sapiens
tatgttaaatactg

SEQ ID NO: 3396224 - DNA, 22 bp, Homo sapiens
tatgttaaatactgtgcagaat

SEQ ID NO: 3396225 - DNA, 14 bp, Homo sapiens
tatgttaagctctt

SEQ ID NO: 3396226 - DNA, 19 bp, Homo sapiens
tatgttatcaccttccaaa

SEQ ID NO: 3396227 - DNA, 18 bp, Homo sapiens
tatgttgaatacttttta

SEQ ID NO: 3396228 - DNA, 20 bp, Homo sapiens
tatgttgcccaggcaggtct

SEQ ID NO: 3396229 - DNA, 20 bp, Homo sapiens
tatgttgcctttatggtttc

SEQ ID NO: 3396230 - DNA, 21 bp, Homo sapiens
tatgttgctataataaagaag

SEQ ID NO: 3396231 - DNA, 20 bp, Homo sapiens
tatgttgtaataaaacttat

SEQ ID NO: 3396232 - DNA, 17 bp, Homo sapiens
tatgttgtacaatcaaa

SEQ ID NO: 3396233 - DNA, 12 bp, Homo sapiens
tatgtttccttg

SEQ ID NO: 3396234 - DNA, 19 bp, Homo sapiens
tatgtttgctttaatgtgt

SEQ ID NO: 3396235 - DNA, 17 bp, Homo sapiens
tatgtttgtctcacttt

SEQ ID NO: 3396236 - DNA, 17 bp, Homo sapiens
tatgttttaagaggcag

SEQ ID NO: 3396237 - DNA, 19 bp, Homo sapiens
tatgttttaagaggcaggg

SEQ ID NO: 3396238 - DNA, 15 bp, Homo sapiens
tatgttttgtttctg

SEQ ID NO: 3396239 - DNA, 12 bp, Homo sapiens
tattaaaaatat

SEQ ID NO: 3396240 - DNA, 13 bp, Homo sapiens
tattaaaaccagt

SEQ ID NO: 3396241 - DNA, 15 bp, Homo sapiens
tattaaaatattttg

SEQ ID NO: 3396242 - DNA, 22 bp, Homo sapiens
tattaaaatgattgtaaaatag

SEQ ID NO: 3396243 - DNA, 17 bp, Homo sapiens
tattaaaattgccattt

SEQ ID NO: 3396244 - DNA, 13 bp, Homo sapiens
tattaaacaaagt

SEQ ID NO: 3396245 - DNA, 20 bp, Homo sapiens
tattaaacagatttttacaa

SEQ ID NO: 3396246 - DNA, 21 bp, Homo sapiens
tattaaacagatttttacaaa

SEQ ID NO: 3396247 - DNA, 23 bp, Homo sapiens
tattaaacagatttttacaaatg

SEQ ID NO: 3396248 - DNA, 17 bp, Homo sapiens
tattaaagattctcttt

SEQ ID NO: 3396249 - DNA, 13 bp, Homo sapiens
tattaaagggggg

SEQ ID NO: 3396250 - DNA, 12 bp, Homo sapiens
tattaaatacag

SEQ ID NO: 3396251 - DNA, 17 bp, Homo sapiens
tattaaatacagacact

SEQ ID NO: 3396252 - DNA, 21 bp, Homo sapiens
tattaaatacagacactaagt

SEQ ID NO: 3396253 - DNA, 14 bp, Homo sapiens
tattaaatcttaaa

SEQ ID NO: 3396254 - DNA, 22 bp, Homo sapiens
tattaaatcttaaacaatgtat

SEQ ID NO: 3396255 - DNA, 12 bp, Homo sapiens
tattaaattatg

SEQ ID NO: 3396256 - DNA, 16 bp, Homo sapiens
tattaaattgtgtaca

SEQ ID NO: 3396257 - DNA, 13 bp, Homo sapiens
tattaacaaaagt

SEQ ID NO: 3396258 - DNA, 18 bp, Homo sapiens
tattaacaaattatgtta

SEQ ID NO: 3396259 - DNA, 20 bp, Homo sapiens
tattaaccttgccttagaaa

SEQ ID NO: 3396260 - DNA, 16 bp, Homo sapiens
tattaaccttttttgt

SEQ ID NO: 3396261 - DNA, 12 bp, Homo sapiens
tattaactacat

SEQ ID NO: 3396262 - DNA, 18 bp, Homo sapiens
tattaactacatttatga

SEQ ID NO: 3396263 - DNA, 24 bp, Homo sapiens
tattaagaaagactatctaaatgt

SEQ ID NO: 3396264 - DNA, 18 bp, Homo sapiens
tattaagacagtgtacaa

SEQ ID NO: 3396265 - DNA, 15 bp, Homo sapiens
tattaagatggattc

SEQ ID NO: 3396266 - DNA, 19 bp, Homo sapiens
tcaaaaaaagactcagcca

SEQ ID NO: 3396267 - DNA, 13 bp, Homo sapiens
tcaaaaaatgagc

SEQ ID NO: 3396268 - DNA, 23 bp, Homo sapiens
tcaaaaactaaaatcattgtcaa

SEQ ID NO: 3396269 - DNA, 13 bp, Homo sapiens
tcaaaaactattt

SEQ ID NO: 3396270 - DNA, 22 bp, Homo sapiens
tcaaaaactttggagtcccctc

SEQ ID NO: 3396271 - DNA, 12 bp, Homo sapiens
tcaaaaagaaaa

SEQ ID NO: 3396272 - DNA, 13 bp, Homo sapiens
tcaaaaagcagag

SEQ ID NO: 3396273 - DNA, 12 bp, Homo sapiens
tcaaaaagtgtt

SEQ ID NO: 3396274 - DNA, 23 bp, Homo sapiens
tcaaaaagtgtttatttttcata

SEQ ID NO: 3396275 - DNA, 19 bp, Homo sapiens
tcaaaaataaaaaatctga

SEQ ID NO: 3396276 - DNA, 14 bp, Homo sapiens
tcaaaaataatgtg

SEQ ID NO: 3396277 - DNA, 21 bp, Homo sapiens
tcaaaaatacaaaataaaaac

SEQ ID NO: 3396278 - DNA, 12 bp, Homo sapiens
tcaaaaatgctg

SEQ ID NO: 3396279 - DNA, 18 bp, Homo sapiens
tcaaaaatgctgttaatg

SEQ ID NO: 3396280 - DNA, 21 bp, Homo sapiens
tcaaaacacactactacctct

SEQ ID NO: 3396281 - DNA, 23 bp, Homo sapiens
tcaaaacacactactacctctta

SEQ ID NO: 3396282 - DNA, 21 bp, Homo sapiens
tcaaaacacatctttcctgtc

SEQ ID NO: 3396283 - DNA, 20 bp, Homo sapiens
tcaaaacagaagcagcttct

SEQ ID NO: 3396284 - DNA, 15 bp, Homo sapiens
tcaaaacagagatgt

SEQ ID NO: 3396285 - DNA, 15 bp, Homo sapiens
tcaaaacctgcagtt

SEQ ID NO: 3396286 - DNA, 20 bp, Homo sapiens
tcaaaacctgcagttaacag

SEQ ID NO: 3396287 - DNA, 17 bp, Homo sapiens
tcaaaacctgtgccagg

SEQ ID NO: 3396288 - DNA, 21 bp, Homo sapiens
tcaaaacctgtgccaggctga

SEQ ID NO: 3396289 - DNA, 20 bp, Homo sapiens
tcaaaacctttcaaatatca

SEQ ID NO: 3396290 - DNA, 18 bp, Homo sapiens
tcaaaactatttttgtaa

SEQ ID NO: 3396291 - DNA, 18 bp, Homo sapiens
tcaaaagaaaaggcaaaa

SEQ ID NO: 3396292 - DNA, 21 bp, Homo sapiens
tcaaaagaaatagaaaaggaa

SEQ ID NO: 3396293 - DNA, 16 bp, Homo sapiens
tcaaaagacaaacatg

SEQ ID NO: 3396294 - DNA, 13 bp, Homo sapiens
tcaaaagcattta

SEQ ID NO: 3396295 - DNA, 15 bp, Homo sapiens
tcaaaagctggatta

SEQ ID NO: 3396296 - DNA, 15 bp, Homo sapiens
tcaaaaggaaaccaa

SEQ ID NO: 3396297 - DNA, 22 bp, Homo sapiens
tcaaaaggaacaaaaattacaa

SEQ ID NO: 3396298 - DNA, 17 bp, Homo sapiens
tcaaaaggaatgaactt

SEQ ID NO: 3396299 - DNA, 16 bp, Homo sapiens
tcaaaagggaagagtt

SEQ ID NO: 3396300 - DNA, 18 bp, Homo sapiens
tcaaaagggaagagtttt

SEQ ID NO: 3396301 - DNA, 21 bp, Homo sapiens
tcaaaaggtattatacatgtg

SEQ ID NO: 3396302 - DNA, 14 bp, Homo sapiens
tcaaaagttccaag

SEQ ID NO: 3396303 - DNA, 15 bp, Homo sapiens
tcaaaagttggacta

SEQ ID NO: 3396304 - DNA, 13 bp, Homo sapiens
tcaaaatactact

SEQ ID NO: 3396305 - DNA, 19 bp, Homo sapiens
tcaaaataggatttcttaa

SEQ ID NO: 3396306 - DNA, 21 bp, Homo sapiens
tcaaaataggatttcttaaat

SEQ ID NO: 3396307 - DNA, 20 bp, Homo sapiens
tcaaaatatattttcagtac

SEQ ID NO: 3396308 - DNA, 18 bp, Homo sapiens
tcaaaatatttgtacata

SEQ ID NO: 3396309 - DNA, 19 bp, Homo sapiens
tcaaaatatttgtacatag

SEQ ID NO: 3396310 - DNA, 16 bp, Homo sapiens
tcaaaatcagtttttc

SEQ ID NO: 3396311 - DNA, 17 bp, Homo sapiens
tcaaaatcagtttttca

SEQ ID NO: 3396312 - DNA, 22 bp, Homo sapiens
tcaaaatctttgtataaataaa

SEQ ID NO: 3396313 - DNA, 12 bp, Homo sapiens
tcaaaatgcttt

SEQ ID NO: 3396314 - DNA, 13 bp, Homo sapiens
tcaaaatgtatat

SEQ ID NO: 3396315 - DNA, 14 bp, Homo sapiens
tcaaaatgtatata

SEQ ID NO: 3396316 - DNA, 22 bp, Homo sapiens
tcaaaatgttatcttctcaagt

SEQ ID NO: 3396317 - DNA, 14 bp, Homo sapiens
tcaaaattaaatct

SEQ ID NO: 3396318 - DNA, 13 bp, Homo sapiens
tcaaaattacata

SEQ ID NO: 3396319 - DNA, 15 bp, Homo sapiens
tcaaaattacatata

SEQ ID NO: 3396320 - DNA, 18 bp, Homo sapiens
tcaaaattgcctttttct

SEQ ID NO: 3396321 - DNA, 13 bp, Homo sapiens
tcaaacaagaatg

SEQ ID NO: 3396322 - DNA, 22 bp, Homo sapiens
tcaaacagccccagtcttcctt

SEQ ID NO: 3396323 - DNA, 15 bp, Homo sapiens
tcaaacagtaggttg

SEQ ID NO: 3396324 - DNA, 18 bp, Homo sapiens
tcaaacatggaagatgaa

SEQ ID NO: 3396325 - DNA, 15 bp, Homo sapiens
tcaaaccaatttctt

SEQ ID NO: 3396326 - DNA, 22 bp, Homo sapiens
tcaaacccacgattttctccag

SEQ ID NO: 3396327 - DNA, 20 bp, Homo sapiens
tcaaaccccgaccacctgcc

SEQ ID NO: 3396328 - DNA, 19 bp, Homo sapiens
tcaaaccctagccttgctt

SEQ ID NO: 3396329 - DNA, 21 bp, Homo sapiens
tcaaaccctagccttgcttgt

SEQ ID NO: 3396330 - DNA, 14 bp, Homo sapiens
tcaaactaaaagac

SEQ ID NO: 3396331 - DNA, 17 bp, Homo sapiens
tcaaactaaaagacatt

SEQ ID NO: 3396332 - DNA, 21 bp, Homo sapiens
tcaaactaaaagacatttgtt

SEQ ID NO: 3396333 - DNA, 13 bp, Homo sapiens
tcaaactcattgc

SEQ ID NO: 3396334 - DNA, 14 bp, Homo sapiens
tcaaactcattgca

SEQ ID NO: 3396335 - DNA, 15 bp, Homo sapiens
tcaaactgaggaatt

SEQ ID NO: 3396336 - DNA, 19 bp, Homo sapiens
tcaaactggggcctccctg

SEQ ID NO: 3396337 - DNA, 14 bp, Homo sapiens
tcaaactgtagaaa

SEQ ID NO: 3396338 - DNA, 18 bp, Homo sapiens
tcaaactgtgaagcattt

SEQ ID NO: 3396339 - DNA, 17 bp, Homo sapiens
tcaaacttactattttg

SEQ ID NO: 3396340 - DNA, 19 bp, Homo sapiens
tcaaagaaatgctgatgga

SEQ ID NO: 3396341 - DNA, 15 bp, Homo sapiens
tcaaagaacaaacat

SEQ ID NO: 3396342 - DNA, 12 bp, Homo sapiens
tcaaagaaggaa

SEQ ID NO: 3396343 - DNA, 22 bp, Homo sapiens
tcaaagaaggatggcacctaaa

SEQ ID NO: 3396344 - DNA, 18 bp, Homo sapiens
tcaaagaattacagtaca

SEQ ID NO: 3396345 - DNA, 20 bp, Homo sapiens
tcaaagagagaaaataaaga

SEQ ID NO: 3396346 - DNA, 17 bp, Homo sapiens
tcaaagcaagggctcca

SEQ ID NO: 3396347 - DNA, 19 bp, Homo sapiens
tcaaagcaagggctccagc

SEQ ID NO: 3396348 - DNA, 16 bp, Homo sapiens
tcaaagcagcagccac

SEQ ID NO: 3396349 - DNA, 22 bp, Homo sapiens
tcaaagcatggacatttagaag

SEQ ID NO: 3396350 - DNA, 20 bp, Homo sapiens
tcaaagccacattatttcta

SEQ ID NO: 3396351 - DNA, 16 bp, Homo sapiens
tcaaagctgaatattt

SEQ ID NO: 3396352 - DNA, 20 bp, Homo sapiens
tcaaagctgaatatttttta

SEQ ID NO: 3396353 - DNA, 14 bp, Homo sapiens
tcaaagcttgtgaa

SEQ ID NO: 3396354 - DNA, 20 bp, Homo sapiens
tcaaagctttcctgtttcca

SEQ ID NO: 3396355 - DNA, 23 bp, Homo sapiens
tcaaagctttcctgtttccaggg

SEQ ID NO: 3396356 - DNA, 15 bp, Homo sapiens
tcaaagctttttcca

SEQ ID NO: 3396357 - DNA, 12 bp, Homo sapiens
tcaaaggaagac

SEQ ID NO: 3396358 - DNA, 15 bp, Homo sapiens
tcaaaggagaaaaaa

SEQ ID NO: 3396359 - DNA, 23 bp, Homo sapiens
tcaaaggagaaaaaaaaccttgt

SEQ ID NO: 3396360 - DNA, 17 bp, Homo sapiens
tcaaaggcatctccctt

SEQ ID NO: 3396361 - DNA, 23 bp, Homo sapiens
tcaaaggttctaggtttcaaaga

SEQ ID NO: 3396362 - DNA, 17 bp, Homo sapiens
tcaaagtataatctttc

SEQ ID NO: 3396363 - DNA, 13 bp, Homo sapiens
tcaaagtatttgt

SEQ ID NO: 3396364 - DNA, 22 bp, Homo sapiens
tcaaagtgtatatttattcata

SEQ ID NO: 3396365 - DNA, 16 bp, Homo sapiens
tcaaagttaaaagtaa

SEQ ID NO: 3396366 - DNA, 14 bp, Homo sapiens
tcaaagttttgaaa

SEQ ID NO: 3396367 - DNA, 17 bp, Homo sapiens
tcaaagttttgaaaagc

SEQ ID NO: 3396368 - DNA, 19 bp, Homo sapiens
tcaaagttttgaaaagcta

SEQ ID NO: 3396369 - DNA, 22 bp, Homo sapiens
tcaaagttttgaaaagctatta

SEQ ID NO: 3396370 - DNA, 14 bp, Homo sapiens
tcaaataaaaataa

SEQ ID NO: 3396371 - DNA, 14 bp, Homo sapiens
tcaaataaatttct

SEQ ID NO: 3396372 - DNA, 20 bp, Homo sapiens
tcaaataaatttctgggata

SEQ ID NO: 3396373 - DNA, 19 bp, Homo sapiens
tcaaataagtatttataat

SEQ ID NO: 3396374 - DNA, 20 bp, Homo sapiens
tcaaataagtatttataata

SEQ ID NO: 3396375 - DNA, 18 bp, Homo sapiens
tcaaatcagtgatctatg

SEQ ID NO: 3396376 - DNA, 19 bp, Homo sapiens
tcaaatcagtgatctatgt

SEQ ID NO: 3396377 - DNA, 21 bp, Homo sapiens
tcaaatcagtgatctatgttt

SEQ ID NO: 3396378 - DNA, 23 bp, Homo sapiens
tcaaatcagtgatctatgtttgt

SEQ ID NO: 3396379 - DNA, 15 bp, Homo sapiens
tcaaatctattcaga

SEQ ID NO: 3396380 - DNA, 16 bp, Homo sapiens
tcaaatctattcagac

SEQ ID NO: 3396381 - DNA, 18 bp, Homo sapiens
tcaaatctattcagacaa

SEQ ID NO: 3396382 - DNA, 16 bp, Homo sapiens
tcaaatctccagtatt

SEQ ID NO: 3396383 - DNA, 13 bp, Homo sapiens
tcaaatgaaatgt

SEQ ID NO: 3396384 - DNA, 14 bp, Homo sapiens
tcaaatgaattctt

SEQ ID NO: 3396385 - DNA, 16 bp, Homo sapiens
tcaaatgagtaacatt

SEQ ID NO: 3396386 - DNA, 16 bp, Homo sapiens
tcaaatgatttcatat

SEQ ID NO: 3396387 - DNA, 18 bp, Homo sapiens
tcaaatgttagatattgc

SEQ ID NO: 3396388 - DNA, 13 bp, Homo sapiens
tcaaatgttctaa

SEQ ID NO: 3396389 - DNA, 19 bp, Homo sapiens
tcaaatgttctaagtttct

SEQ ID NO: 3396390 - DNA, 20 bp, Homo sapiens
tcaaatgttctaagtttcta

SEQ ID NO: 3396391 - DNA, 20 bp, Homo sapiens
tcaaattaaaacagctgcat

SEQ ID NO: 3396392 - DNA, 20 bp, Homo sapiens
tcacttgatgatacaatgaa

SEQ ID NO: 3396393 - DNA, 15 bp, Homo sapiens
tcacttgtacaaaat

SEQ ID NO: 3396394 - DNA, 16 bp, Homo sapiens
tcacttgtacaaaata

SEQ ID NO: 3396395 - DNA, 12 bp, Homo sapiens
tcacttgtattg

SEQ ID NO: 3396396 - DNA, 15 bp, Homo sapiens
tcacttgtgctttgc

SEQ ID NO: 3396397 - DNA, 16 bp, Homo sapiens
tcacttgtgctttgct

SEQ ID NO: 3396398 - DNA, 22 bp, Homo sapiens
tcacttgtgtcaaccactaaag

SEQ ID NO: 3396399 - DNA, 22 bp, Homo sapiens
tcactttaaagcaattgcataa

SEQ ID NO: 3396400 - DNA, 20 bp, Homo sapiens
tcactttacataagaaatgt

SEQ ID NO: 3396401 - DNA, 15 bp, Homo sapiens
tcactttagatgctg

SEQ ID NO: 3396402 - DNA, 21 bp, Homo sapiens
tcactttcccttgtgtcaaga

SEQ ID NO: 3396403 - DNA, 15 bp, Homo sapiens
tcacttttcatcctt

SEQ ID NO: 3396404 - DNA, 18 bp, Homo sapiens
tcacttttcctccctcag

SEQ ID NO: 3396405 - DNA, 14 bp, Homo sapiens
tcacttttgttctg

SEQ ID NO: 3396406 - DNA, 13 bp, Homo sapiens
tcactttttctga

SEQ ID NO: 3396407 - DNA, 15 bp, Homo sapiens
tcactttttgaacta

SEQ ID NO: 3396408 - DNA, 18 bp, Homo sapiens
tcactttttgaactaaga

SEQ ID NO: 3396409 - DNA, 19 bp, Homo sapiens
tcactttttgaactaagaa

SEQ ID NO: 3396410 - DNA, 20 bp, Homo sapiens
tcactttttgaactaagaaa

SEQ ID NO: 3396411 - DNA, 18 bp, Homo sapiens
tcactttttttttttgtt

SEQ ID NO: 3396412 - DNA, 22 bp, Homo sapiens
tcactttttttttttgtttgat

SEQ ID NO: 3396413 - DNA, 19 bp, Homo sapiens
tcactttttttttttttcc

SEQ ID NO: 3396414 - DNA, 18 bp, Homo sapiens
tcagaaaactttaaaaaa

SEQ ID NO: 3396415 - DNA, 18 bp, Homo sapiens
tcagaaaagaaaaccatt

SEQ ID NO: 3396416 - DNA, 17 bp, Homo sapiens
tcagaaaagtaattttg

SEQ ID NO: 3396417 - DNA, 17 bp, Homo sapiens
tcagaaaatattatgtg

SEQ ID NO: 3396418 - DNA, 19 bp, Homo sapiens
tcagaaaatattatgtgtt

SEQ ID NO: 3396419 - DNA, 19 bp, Homo sapiens
tcagaaacccggcttcctg

SEQ ID NO: 3396420 - DNA, 20 bp, Homo sapiens
tcagaaaccctcattgtgtt

SEQ ID NO: 3396421 - DNA, 16 bp, Homo sapiens
tcagaaactagaaatg

SEQ ID NO: 3396422 - DNA, 15 bp, Homo sapiens
tcagaaactcccctg

SEQ ID NO: 3396423 - DNA, 12 bp, Homo sapiens
tcagaaactgtt

SEQ ID NO: 3396424 - DNA, 18 bp, Homo sapiens
tcagaaacttgtgaagtg

SEQ ID NO: 3396425 - DNA, 16 bp, Homo sapiens
tcagaaagaggtctcc

SEQ ID NO: 3396426 - DNA, 19 bp, Homo sapiens
tcagaaagaggtctcccca

SEQ ID NO: 3396427 - DNA, 14 bp, Homo sapiens
tcagaaaggatttt

SEQ ID NO: 3396428 - DNA, 22 bp, Homo sapiens
tcagaacacacagactttctgt

SEQ ID NO: 3396429 - DNA, 15 bp, Homo sapiens
tcagaacatgaaatg

SEQ ID NO: 3396430 - DNA, 17 bp, Homo sapiens
tcagaacatgttaagat

SEQ ID NO: 3396431 - DNA, 17 bp, Homo sapiens
tcagaacattcagctct

SEQ ID NO: 3396432 - DNA, 20 bp, Homo sapiens
tcagaacccagggctctgcc

SEQ ID NO: 3396433 - DNA, 22 bp, Homo sapiens
tcagaacccagggctctgcccc

SEQ ID NO: 3396434 - DNA, 15 bp, Homo sapiens
tcagaacctcttccc

SEQ ID NO: 3396435 - DNA, 16 bp, Homo sapiens
tcagaacctcttcccc

SEQ ID NO: 3396436 - DNA, 21 bp, Homo sapiens
tcagaacctgttattttatgt

SEQ ID NO: 3396437 - DNA, 16 bp, Homo sapiens
tcagaagaaataaata

SEQ ID NO: 3396438 - DNA, 13 bp, Homo sapiens
tcagaagacactg

SEQ ID NO: 3396439 - DNA, 13 bp, Homo sapiens
tcagaagatagtc

SEQ ID NO: 3396440 - DNA, 15 bp, Homo sapiens
tcagaagcctccaag

SEQ ID NO: 3396441 - DNA, 22 bp, Homo sapiens
tcagaagcctccaagcctgcct

SEQ ID NO: 3396442 - DNA, 13 bp, Homo sapiens
tcagaagcctgag

SEQ ID NO: 3396443 - DNA, 15 bp, Homo sapiens
tcagaaggggacctg

SEQ ID NO: 3396444 - DNA, 16 bp, Homo sapiens
tcagaatatgattcac

SEQ ID NO: 3396445 - DNA, 19 bp, Homo sapiens
tcagaatctaaacgtggtc

SEQ ID NO: 3396446 - DNA, 18 bp, Homo sapiens
tcagaatctcaaataact

SEQ ID NO: 3396447 - DNA, 18 bp, Homo sapiens
tcagaatctgaatgtaat

SEQ ID NO: 3396448 - DNA, 16 bp, Homo sapiens
tcagaattaaactttt

SEQ ID NO: 3396449 - DNA, 16 bp, Homo sapiens
tcagaattatttttaa

SEQ ID NO: 3396450 - DNA, 20 bp, Homo sapiens
tcagaattatttttaaaaag

SEQ ID NO: 3396451 - DNA, 15 bp, Homo sapiens
tcagacaccctcaac

SEQ ID NO: 3396452 - DNA, 17 bp, Homo sapiens
tcagacaccctcaacct

SEQ ID NO: 3396453 - DNA, 22 bp, Homo sapiens
tcagacaccctcaacctcttct

SEQ ID NO: 3396454 - DNA, 23 bp, Homo sapiens
tcagacaccctcaacctcttctg

SEQ ID NO: 3396455 - DNA, 22 bp, Homo sapiens
tcagacacctgttcacagaaaa

SEQ ID NO: 3396456 - DNA, 15 bp, Homo sapiens
tcagacagaacttga

SEQ ID NO: 3396457 - DNA, 23 bp, Homo sapiens
tcagacagaacttgaatgtgtca

SEQ ID NO: 3396458 - DNA, 17 bp, Homo sapiens
tcagacagagaggactg

SEQ ID NO: 3396459 - DNA, 14 bp, Homo sapiens
tcagacataaagcc

SEQ ID NO: 3396460 - DNA, 15 bp, Homo sapiens
tcagacataaagcca

SEQ ID NO: 3396461 - DNA, 21 bp, Homo sapiens
tcagacatccatgtttgtaaa

SEQ ID NO: 3396462 - DNA, 22 bp, Homo sapiens
tcagacatccatgtttgtaaaa

SEQ ID NO: 3396463 - DNA, 15 bp, Homo sapiens
tcagaccataatgtt

SEQ ID NO: 3396464 - DNA, 23 bp, Homo sapiens
tcagaccataatgttacattatt

SEQ ID NO: 3396465 - DNA, 13 bp, Homo sapiens
tcagaccccaggt

SEQ ID NO: 3396466 - DNA, 13 bp, Homo sapiens
tcagacctgtctt

SEQ ID NO: 3396467 - DNA, 20 bp, Homo sapiens
tcagacctgtcttccaagga

SEQ ID NO: 3396468 - DNA, 20 bp, Homo sapiens
tcagaccttggatcagatga

SEQ ID NO: 3396469 - DNA, 16 bp, Homo sapiens
tcagacggcggccagg

SEQ ID NO: 3396470 - DNA, 18 bp, Homo sapiens
tcagacggcggccaggca

SEQ ID NO: 3396471 - DNA, 19 bp, Homo sapiens
tcagacggcggccaggcac

SEQ ID NO: 3396472 - DNA, 14 bp, Homo sapiens
tcagactagtgaca

SEQ ID NO: 3396473 - DNA, 13 bp, Homo sapiens
tcagactccgccc

SEQ ID NO: 3396474 - DNA, 22 bp, Homo sapiens
tcagactccgccctcctcgggc

SEQ ID NO: 3396475 - DNA, 13 bp, Homo sapiens
tcagactgcagag

SEQ ID NO: 3396476 - DNA, 13 bp, Homo sapiens
tcagactgctggg

SEQ ID NO: 3396477 - DNA, 14 bp, Homo sapiens
tcagactgctggga

SEQ ID NO: 3396478 - DNA, 15 bp, Homo sapiens
tcagactgctgggac

SEQ ID NO: 3396479 - DNA, 21 bp, Homo sapiens
tcagactgctgggactggcca

SEQ ID NO: 3396480 - DNA, 21 bp, Homo sapiens
tcagactggctggctgcagtg

SEQ ID NO: 3396481 - DNA, 23 bp, Homo sapiens
tcagactttaaagaataatatgc

SEQ ID NO: 3396482 - DNA, 16 bp, Homo sapiens
tcagacttttgtacat

SEQ ID NO: 3396483 - DNA, 14 bp, Homo sapiens
tcagagacaaaata

SEQ ID NO: 3396484 - DNA, 19 bp, Homo sapiens
tcagagaccttaatttata

SEQ ID NO: 3396485 - DNA, 15 bp, Homo sapiens
tcagagacggcagaa

SEQ ID NO: 3396486 - DNA, 14 bp, Homo sapiens
tcagagagctggta

SEQ ID NO: 3396487 - DNA, 16 bp, Homo sapiens
tcagagagctggtagt

SEQ ID NO: 3396488 - DNA, 22 bp, Homo sapiens
tcagagaggccttttgtttaaa

SEQ ID NO: 3396489 - DNA, 21 bp, Homo sapiens
tcagagatcgtgtattgagat

SEQ ID NO: 3396490 - DNA, 16 bp, Homo sapiens
tcagagatgcaccacc

SEQ ID NO: 3396491 - DNA, 19 bp, Homo sapiens
tcagagatttatataaatg

SEQ ID NO: 3396492 - DNA, 16 bp, Homo sapiens
tcagagcactccctaa

SEQ ID NO: 3396493 - DNA, 16 bp, Homo sapiens
tcagagcatctggctg

SEQ ID NO: 3396494 - DNA, 17 bp, Homo sapiens
tcagagcatgtgtcaga

SEQ ID NO: 3396495 - DNA, 12 bp, Homo sapiens
tcagagccaagt

SEQ ID NO: 3396496 - DNA, 18 bp, Homo sapiens
tcagagccaagtcctccc

SEQ ID NO: 3396497 - DNA, 11 bp, Homo sapiens
tcagagccact

SEQ ID NO: 3396498 - DNA, 23 bp, Homo sapiens
tcagagccactctatgagttgga

SEQ ID NO: 3396499 - DNA, 21 bp, Homo sapiens
tcagagccagtgaaggagcca

SEQ ID NO: 3396500 - DNA, 19 bp, Homo sapiens
tcagagcccccagccctgg

SEQ ID NO: 3396501 - DNA, 21 bp, Homo sapiens
tcagagctaagggtgggtgct

SEQ ID NO: 3396502 - DNA, 17 bp, Homo sapiens
tcagagctcttcaagct

SEQ ID NO: 3396503 - DNA, 19 bp, Homo sapiens
tcagagctcttcaagctgt

SEQ ID NO: 3396504 - DNA, 21 bp, Homo sapiens
tcagagctcttcaagctgtcc

SEQ ID NO: 3396505 - DNA, 14 bp, Homo sapiens
tcagaggagaagag

SEQ ID NO: 3396506 - DNA, 22 bp, Homo sapiens
tcagaggagctctaccctgctc

SEQ ID NO: 3396507 - DNA, 20 bp, Homo sapiens
tcagaggatggccagtgtct

SEQ ID NO: 3396508 - DNA, 20 bp, Homo sapiens
tcagaggcagcttcaagtgc

SEQ ID NO: 3396509 - DNA, 20 bp, Homo sapiens
tcagaggcctataatgaagc

SEQ ID NO: 3396510 - DNA, 18 bp, Homo sapiens
tcagaggctaagatgaga

SEQ ID NO: 3396511 - DNA, 15 bp, Homo sapiens
tcagaggctgaggtg

SEQ ID NO: 3396512 - DNA, 21 bp, Homo sapiens
tcagagggaaagtaaatattt

SEQ ID NO: 3396513 - DNA, 14 bp, Homo sapiens
tcagagggcccaaa

SEQ ID NO: 3396514 - DNA, 14 bp, Homo sapiens
tcagagtagaaata

SEQ ID NO: 3396515 - DNA, 15 bp, Homo sapiens
tcagagtagaaataa

SEQ ID NO: 3396516 - DNA, 22 bp, Homo sapiens
tcagagtatattgttgaagaga

SEQ ID NO: 3396517 - DNA, 17 bp, Homo sapiens
tcagagtccttaaaatg

SEQ ID NO: 3396518 - DNA, 20 bp, Homo sapiens
tcatatatattttaaaaaca

SEQ ID NO: 3396519 - DNA, 22 bp, Homo sapiens
tcatatcccctgtgccctgcac

SEQ ID NO: 3396520 - DNA, 19 bp, Homo sapiens
tcatatgccaccccatgtg

SEQ ID NO: 3396521 - DNA, 13 bp, Homo sapiens
tcatatgttgctc

SEQ ID NO: 3396522 - DNA, 15 bp, Homo sapiens
tcatatgttgctcag

SEQ ID NO: 3396523 - DNA, 18 bp, Homo sapiens
tcatattctaaaaccatt

SEQ ID NO: 3396524 - DNA, 19 bp, Homo sapiens
tcatattgaatgtttccaa

SEQ ID NO: 3396525 - DNA, 16 bp, Homo sapiens
tcatattgatgaaaag

SEQ ID NO: 3396526 - DNA, 12 bp, Homo sapiens
tcatatttaaag

SEQ ID NO: 3396527 - DNA, 23 bp, Homo sapiens
tcatatttacttcttatacattt

SEQ ID NO: 3396528 - DNA, 12 bp, Homo sapiens
tcatatttgaaa

SEQ ID NO: 3396529 - DNA, 19 bp, Homo sapiens
tcatattttgattattgta

SEQ ID NO: 3396530 - DNA, 16 bp, Homo sapiens
tcatcaaaaagaaaaa

SEQ ID NO: 3396531 - DNA, 17 bp, Homo sapiens
tcatcaaaaagaaaaat

SEQ ID NO: 3396532 - DNA, 13 bp, Homo sapiens
tcatcaactgaat

SEQ ID NO: 3396533 - DNA, 15 bp, Homo sapiens
tcatcaactgaatga

SEQ ID NO: 3396534 - DNA, 13 bp, Homo sapiens
tcatcaatcaaat

SEQ ID NO: 3396535 - DNA, 21 bp, Homo sapiens
tcatcaatcaaataagtattt

SEQ ID NO: 3396536 - DNA, 23 bp, Homo sapiens
tcatcaatcaaataagtatttat

SEQ ID NO: 3396537 - DNA, 19 bp, Homo sapiens
tcatcaatgtgacatttac

SEQ ID NO: 3396538 - DNA, 23 bp, Homo sapiens
tcatcaattgaatggtcagcgtt

SEQ ID NO: 3396539 - DNA, 23 bp, Homo sapiens
tcatcacatttctatgccaaaca

SEQ ID NO: 3396540 - DNA, 14 bp, Homo sapiens
tcatcactccctgg

SEQ ID NO: 3396541 - DNA, 15 bp, Homo sapiens
tcatcactccctgga

SEQ ID NO: 3396542 - DNA, 15 bp, Homo sapiens
tcatcactggatgaa

SEQ ID NO: 3396543 - DNA, 22 bp, Homo sapiens
tcatcactggatgaagattctc

SEQ ID NO: 3396544 - DNA, 21 bp, Homo sapiens
tcatcactttgacctaaatta

SEQ ID NO: 3396545 - DNA, 15 bp, Homo sapiens
tcatcagagcagcta

SEQ ID NO: 3396546 - DNA, 17 bp, Homo sapiens
tcatcagagctcctctg

SEQ ID NO: 3396547 - DNA, 22 bp, Homo sapiens
tcatcagatggaaatattttga

SEQ ID NO: 3396548 - DNA, 18 bp, Homo sapiens
tcatcagccaccatccta

SEQ ID NO: 3396549 - DNA, 13 bp, Homo sapiens
tcatcagggcctg

SEQ ID NO: 3396550 - DNA, 12 bp, Homo sapiens
tcatcagtgtta

SEQ ID NO: 3396551 - DNA, 19 bp, Homo sapiens
tcatcagtgttaaaaaatt

SEQ ID NO: 3396552 - DNA, 14 bp, Homo sapiens
tcatcataaaataa

SEQ ID NO: 3396553 - DNA, 15 bp, Homo sapiens
tcatcatcagggcct

SEQ ID NO: 3396554 - DNA, 15 bp, Homo sapiens
tcatcatgtagaata

SEQ ID NO: 3396555 - DNA, 15 bp, Homo sapiens
tcatcattccctctc

SEQ ID NO: 3396556 - DNA, 19 bp, Homo sapiens
tcatccaaaatattttttg

SEQ ID NO: 3396557 - DNA, 21 bp, Homo sapiens
tcatccaccaatctctaagcc

SEQ ID NO: 3396558 - DNA, 14 bp, Homo sapiens
tcatccaccccatc

SEQ ID NO: 3396559 - DNA, 17 bp, Homo sapiens
tcatccactgtgccatg

SEQ ID NO: 3396560 - DNA, 18 bp, Homo sapiens
tcatccactgtgccatgt

SEQ ID NO: 3396561 - DNA, 19 bp, Homo sapiens
tcatccactgtgccatgtg

SEQ ID NO: 3396562 - DNA, 20 bp, Homo sapiens
tcatcccattaatcatttcc

SEQ ID NO: 3396563 - DNA, 21 bp, Homo sapiens
tcatcccattaatcatttccc

SEQ ID NO: 3396564 - DNA, 15 bp, Homo sapiens
tcatcccctcgtcct

SEQ ID NO: 3396565 - DNA, 20 bp, Homo sapiens
tcatcccctcgtcctgtccc

SEQ ID NO: 3396566 - DNA, 12 bp, Homo sapiens
tcatccctttcc

SEQ ID NO: 3396567 - DNA, 20 bp, Homo sapiens
tcatcctcattgcctcctgt

SEQ ID NO: 3396568 - DNA, 21 bp, Homo sapiens
tcatcctccagtaccttgctt

SEQ ID NO: 3396569 - DNA, 11 bp, Homo sapiens
tcatcctcctg

SEQ ID NO: 3396570 - DNA, 12 bp, Homo sapiens
tcatcctcctgg

SEQ ID NO: 3396571 - DNA, 13 bp, Homo sapiens
tcatcctcctgga

SEQ ID NO: 3396572 - DNA, 16 bp, Homo sapiens
tcatcctcctggaacc

SEQ ID NO: 3396573 - DNA, 16 bp, Homo sapiens
tcatcctggcacgccc

SEQ ID NO: 3396574 - DNA, 13 bp, Homo sapiens
tcatcctgttttc

SEQ ID NO: 3396575 - DNA, 13 bp, Homo sapiens
tcatccttcccca

SEQ ID NO: 3396576 - DNA, 17 bp, Homo sapiens
tcatccttttggataag

SEQ ID NO: 3396577 - DNA, 21 bp, Homo sapiens
tcatcgaaaattcatttcaca

SEQ ID NO: 3396578 - DNA, 23 bp, Homo sapiens
tcatcgctcgtgtgttctatcca

SEQ ID NO: 3396579 - DNA, 19 bp, Homo sapiens
tcatcggaggctgggcccc

SEQ ID NO: 3396580 - DNA, 22 bp, Homo sapiens
tcatcggagtcagccaggagct

SEQ ID NO: 3396581 - DNA, 20 bp, Homo sapiens
tcatctatgagggtgtttcc

SEQ ID NO: 3396582 - DNA, 21 bp, Homo sapiens
tcatctatgagggtgtttcct

SEQ ID NO: 3396583 - DNA, 15 bp, Homo sapiens
tcatctattcaagca

SEQ ID NO: 3396584 - DNA, 20 bp, Homo sapiens
tcatctcagagtccactgtg

SEQ ID NO: 3396585 - DNA, 16 bp, Homo sapiens
tcatctcaggtagaag

SEQ ID NO: 3396586 - DNA, 21 bp, Homo sapiens
tcatctccaaggatcctctcc

SEQ ID NO: 3396587 - DNA, 13 bp, Homo sapiens
tcatctccatcag

SEQ ID NO: 3396588 - DNA, 20 bp, Homo sapiens
tcatctccatcatatgcctg

SEQ ID NO: 3396589 - DNA, 22 bp, Homo sapiens
tcatctccggggtggccacagg

SEQ ID NO: 3396590 - DNA, 16 bp, Homo sapiens
tcatctcttcaggttc

SEQ ID NO: 3396591 - DNA, 21 bp, Homo sapiens
tcatctgatcacttcatgttt

SEQ ID NO: 3396592 - DNA, 21 bp, Homo sapiens
tcatctgattggacaggcatg

SEQ ID NO: 3396593 - DNA, 15 bp, Homo sapiens
tcatctgcagttctt

SEQ ID NO: 3396594 - DNA, 23 bp, Homo sapiens
tcatctgcagttctttttgtaca

SEQ ID NO: 3396595 - DNA, 17 bp, Homo sapiens
tcatctgcattcctgat

SEQ ID NO: 3396596 - DNA, 19 bp, Homo sapiens
tcatctggcaacatcttta

SEQ ID NO: 3396597 - DNA, 23 bp, Homo sapiens
tcatctggcaacatctttatccg

SEQ ID NO: 3396598 - DNA, 15 bp, Homo sapiens
tcatctgggacaaaa

SEQ ID NO: 3396599 - DNA, 23 bp, Homo sapiens
tcatctggggttggcaacaggac

SEQ ID NO: 3396600 - DNA, 17 bp, Homo sapiens
tcatctgtagatactag

SEQ ID NO: 3396601 - DNA, 14 bp, Homo sapiens
tcatctgtcattat

SEQ ID NO: 3396602 - DNA, 17 bp, Homo sapiens
tcatctgtcattatatt

SEQ ID NO: 3396603 - DNA, 23 bp, Homo sapiens
tcatctgtcattatattctaatt

SEQ ID NO: 3396604 - DNA, 19 bp, Homo sapiens
tcatctgtggagctgccac

SEQ ID NO: 3396605 - DNA, 22 bp, Homo sapiens
tcatctgtggagctgccacaga

SEQ ID NO: 3396606 - DNA, 14 bp, Homo sapiens
tcatctgtgtgaaa

SEQ ID NO: 3396607 - DNA, 17 bp, Homo sapiens
tcatctgtgtgaaaatg

SEQ ID NO: 3396608 - DNA, 21 bp, Homo sapiens
tcatcttcactgcaattttgt

SEQ ID NO: 3396609 - DNA, 14 bp, Homo sapiens
tcatcttctggaat

SEQ ID NO: 3396610 - DNA, 18 bp, Homo sapiens
tcatcttgaagggcccag

SEQ ID NO: 3396611 - DNA, 11 bp, Homo sapiens
tcatcttgcta

SEQ ID NO: 3396612 - DNA, 21 bp, Homo sapiens
tcatcttgctaccagtattta

SEQ ID NO: 3396613 - DNA, 22 bp, Homo sapiens
tcatcttgctaccagtatttag

SEQ ID NO: 3396614 - DNA, 14 bp, Homo sapiens
tcatcttgtgaaat

SEQ ID NO: 3396615 - DNA, 22 bp, Homo sapiens
tcatcttgtgaaatggccagga

SEQ ID NO: 3396616 - DNA, 16 bp, Homo sapiens
tcatgaaaataccatt

SEQ ID NO: 3396617 - DNA, 14 bp, Homo sapiens
tcatgaaatatgca

SEQ ID NO: 3396618 - DNA, 15 bp, Homo sapiens
tcatgaaatatgcat

SEQ ID NO: 3396619 - DNA, 15 bp, Homo sapiens
tcatgaaatgattgg

SEQ ID NO: 3396620 - DNA, 19 bp, Homo sapiens
tcatgaattcccttttaat

SEQ ID NO: 3396621 - DNA, 12 bp, Homo sapiens
tcatgaatttta

SEQ ID NO: 3396622 - DNA, 15 bp, Homo sapiens
tcatgaattttaaag

SEQ ID NO: 3396623 - DNA, 16 bp, Homo sapiens
tcatgaattttaaagt

SEQ ID NO: 3396624 - DNA, 13 bp, Homo sapiens
tcatgaattttac

SEQ ID NO: 3396625 - DNA, 16 bp, Homo sapiens
tcatgaattttacatg

SEQ ID NO: 3396626 - DNA, 14 bp, Homo sapiens
tcatgacagcctcc

SEQ ID NO: 3396627 - DNA, 17 bp, Homo sapiens
tcatgacatgttatata

SEQ ID NO: 3396628 - DNA, 19 bp, Homo sapiens
tcatgacatgttatatatt

SEQ ID NO: 3396629 - DNA, 19 bp, Homo sapiens
tcatgaggggaaagggaga

SEQ ID NO: 3396630 - DNA, 18 bp, Homo sapiens
tcatgagtgaataaatgt

SEQ ID NO: 3396631 - DNA, 18 bp, Homo sapiens
tcatgataccacctttac

SEQ ID NO: 3396632 - DNA, 20 bp, Homo sapiens
tcatgataccacctttactg

SEQ ID NO: 3396633 - DNA, 23 bp, Homo sapiens
tcatgatttcatttcaactgttt

SEQ ID NO: 3396634 - DNA, 11 bp, Homo sapiens
tcatgcaaaat

SEQ ID NO: 3396635 - DNA, 13 bp, Homo sapiens
tcatgcaaaatat

SEQ ID NO: 3396636 - DNA, 15 bp, Homo sapiens
tcatgcataaatatg

SEQ ID NO: 3396637 - DNA, 12 bp, Homo sapiens
tcatgcccaaga

SEQ ID NO: 3396638 - DNA, 13 bp, Homo sapiens
tcatgcccacccc

SEQ ID NO: 3396639 - DNA, 20 bp, Homo sapiens
tcatgcccaccccctgccct

SEQ ID NO: 3396640 - DNA, 22 bp, Homo sapiens
tcatgcccaccccctgccctgc

SEQ ID NO: 3396641 - DNA, 15 bp, Homo sapiens
tcatgcctgctgaga

SEQ ID NO: 3396642 - DNA, 17 bp, Homo sapiens
tcatgcctgctgagaga

SEQ ID NO: 3396643 - DNA, 16 bp, Homo sapiens
tcatgcctttgtaagt

SEQ ID NO: 3396644 - DNA, 17 bp, Homo sapiens
tccagtgtccttagaac

SEQ ID NO: 3396645 - DNA, 20 bp, Homo sapiens
tccagtgtccttagaacatt

SEQ ID NO: 3396646 - DNA, 19 bp, Homo sapiens
tccagttcatgagaatcta

SEQ ID NO: 3396647 - DNA, 13 bp, Homo sapiens
tccagttcccact

SEQ ID NO: 3396648 - DNA, 15 bp, Homo sapiens
tccagttcctttaga

SEQ ID NO: 3396649 - DNA, 21 bp, Homo sapiens
tccagttgaagttagtggaaa

SEQ ID NO: 3396650 - DNA, 22 bp, Homo sapiens
tccagtttttgtttttgcatga

SEQ ID NO: 3396651 - DNA, 20 bp, Homo sapiens
tccagttttttgttatatag

SEQ ID NO: 3396652 - DNA, 13 bp, Homo sapiens
tccataaatgtgt

SEQ ID NO: 3396653 - DNA, 14 bp, Homo sapiens
tccataaatgtgtt

SEQ ID NO: 3396654 - DNA, 16 bp, Homo sapiens
tccataaggaatgtag

SEQ ID NO: 3396655 - DNA, 16 bp, Homo sapiens
tccataatgctactgt

SEQ ID NO: 3396656 - DNA, 20 bp, Homo sapiens
tccataatgtataaagaaca

SEQ ID NO: 3396657 - DNA, 19 bp, Homo sapiens
tccataattatgacagtta

SEQ ID NO: 3396658 - DNA, 13 bp, Homo sapiens
tccatacagctct

SEQ ID NO: 3396659 - DNA, 22 bp, Homo sapiens
tccatacagggtctcttccttc

SEQ ID NO: 3396660 - DNA, 22 bp, Homo sapiens
tccatagcctaatccctgggca

SEQ ID NO: 3396661 - DNA, 18 bp, Homo sapiens
tccatagtagtatgatga

SEQ ID NO: 3396662 - DNA, 22 bp, Homo sapiens
tccatatcttgcgaatccaagc

SEQ ID NO: 3396663 - DNA, 14 bp, Homo sapiens
tccatatgctccag

SEQ ID NO: 3396664 - DNA, 16 bp, Homo sapiens
tccatatgctccagga

SEQ ID NO: 3396665 - DNA, 13 bp, Homo sapiens
tccatatggattt

SEQ ID NO: 3396666 - DNA, 14 bp, Homo sapiens
tccatattcatgta

SEQ ID NO: 3396667 - DNA, 14 bp, Homo sapiens
tccatatttggaag

SEQ ID NO: 3396668 - DNA, 12 bp, Homo sapiens
tccatattttca

SEQ ID NO: 3396669 - DNA, 20 bp, Homo sapiens
tccatattttttgcacagct

SEQ ID NO: 3396670 - DNA, 15 bp, Homo sapiens
tccatcaaaagatgt

SEQ ID NO: 3396671 - DNA, 13 bp, Homo sapiens
tccatcaataaat

SEQ ID NO: 3396672 - DNA, 23 bp, Homo sapiens
tccatcaccctcttcctgtgatc

SEQ ID NO: 3396673 - DNA, 15 bp, Homo sapiens
tccatcaccctttcc

SEQ ID NO: 3396674 - DNA, 14 bp, Homo sapiens
tccatcaggccact

SEQ ID NO: 3396675 - DNA, 18 bp, Homo sapiens
tccatcaggttccatccc

SEQ ID NO: 3396676 - DNA, 19 bp, Homo sapiens
tccatcaggttccatcccg

SEQ ID NO: 3396677 - DNA, 14 bp, Homo sapiens
tccatcatttctgt

SEQ ID NO: 3396678 - DNA, 12 bp, Homo sapiens
tccatcatttta

SEQ ID NO: 3396679 - DNA, 16 bp, Homo sapiens
tccatcattttacagt

SEQ ID NO: 3396680 - DNA, 14 bp, Homo sapiens
tccatccatctcca

SEQ ID NO: 3396681 - DNA, 17 bp, Homo sapiens
tccatcccaacagccat

SEQ ID NO: 3396682 - DNA, 19 bp, Homo sapiens
tccatcccaaccagtgcca

SEQ ID NO: 3396683 - DNA, 23 bp, Homo sapiens
tccatcccaaccagtgccaagga

SEQ ID NO: 3396684 - DNA, 16 bp, Homo sapiens
tccatcccattcactt

SEQ ID NO: 3396685 - DNA, 14 bp, Homo sapiens
tccatccctacccc

SEQ ID NO: 3396686 - DNA, 12 bp, Homo sapiens
tccatccctcta

SEQ ID NO: 3396687 - DNA, 14 bp, Homo sapiens
tccatccctggccc

SEQ ID NO: 3396688 - DNA, 12 bp, Homo sapiens
tccatccctttt

SEQ ID NO: 3396689 - DNA, 13 bp, Homo sapiens
tccatcccttttc

SEQ ID NO: 3396690 - DNA, 15 bp, Homo sapiens
tccatcccttttcct

SEQ ID NO: 3396691 - DNA, 19 bp, Homo sapiens
tccatccgactgcccctgc

SEQ ID NO: 3396692 - DNA, 20 bp, Homo sapiens
tccatcctgaggctccactt

SEQ ID NO: 3396693 - DNA, 13 bp, Homo sapiens
tccatctccaggg

SEQ ID NO: 3396694 - DNA, 23 bp, Homo sapiens
tccatctcccgaattcgctgtta

SEQ ID NO: 3396695 - DNA, 22 bp, Homo sapiens
tccatctcctataatctgtcaa

SEQ ID NO: 3396696 - DNA, 14 bp, Homo sapiens
tccatctctcatcc

SEQ ID NO: 3396697 - DNA, 14 bp, Homo sapiens
tccatctctgactt

SEQ ID NO: 3396698 - DNA, 17 bp, Homo sapiens
tccatcttaatgttact

SEQ ID NO: 3396699 - DNA, 15 bp, Homo sapiens
tccatctttctacag

SEQ ID NO: 3396700 - DNA, 13 bp, Homo sapiens
tccatctttttct

SEQ ID NO: 3396701 - DNA, 23 bp, Homo sapiens
tccatgaaagacctgaataccac

SEQ ID NO: 3396702 - DNA, 15 bp, Homo sapiens
tccatgactggctgt

SEQ ID NO: 3396703 - DNA, 15 bp, Homo sapiens
tccatgagcacccca

SEQ ID NO: 3396704 - DNA, 16 bp, Homo sapiens
tccatgatgatagttg

SEQ ID NO: 3396705 - DNA, 21 bp, Homo sapiens
tccatgcaccctcatacacag

SEQ ID NO: 3396706 - DNA, 13 bp, Homo sapiens
tccatgcctctgg

SEQ ID NO: 3396707 - DNA, 12 bp, Homo sapiens
tccatgcctgag

SEQ ID NO: 3396708 - DNA, 13 bp, Homo sapiens
tccatgcctgagg

SEQ ID NO: 3396709 - DNA, 15 bp, Homo sapiens
tccatgcgctcaggg

SEQ ID NO: 3396710 - DNA, 18 bp, Homo sapiens
tccatgcgtgtttctgac

SEQ ID NO: 3396711 - DNA, 19 bp, Homo sapiens
tccatgcgtgtttctgact

SEQ ID NO: 3396712 - DNA, 21 bp, Homo sapiens
tccatgcgtgtttctgactct

SEQ ID NO: 3396713 - DNA, 17 bp, Homo sapiens
tccatgctataaaaact

SEQ ID NO: 3396714 - DNA, 20 bp, Homo sapiens
tccatgctcctcactgcccg

SEQ ID NO: 3396715 - DNA, 22 bp, Homo sapiens
tccatgctcctcactgcccgca

SEQ ID NO: 3396716 - DNA, 19 bp, Homo sapiens
tccatgggagccagctgct

SEQ ID NO: 3396717 - DNA, 22 bp, Homo sapiens
tccatgggagccagctgctttt

SEQ ID NO: 3396718 - DNA, 23 bp, Homo sapiens
tccatgggagccagctgcttttt

SEQ ID NO: 3396719 - DNA, 17 bp, Homo sapiens
tccatgggatacaacct

SEQ ID NO: 3396720 - DNA, 14 bp, Homo sapiens
tccatgtactgtag

SEQ ID NO: 3396721 - DNA, 18 bp, Homo sapiens
tccatgtcgcctctgcat

SEQ ID NO: 3396722 - DNA, 18 bp, Homo sapiens
tccatgtgattaatgttt

SEQ ID NO: 3396723 - DNA, 13 bp, Homo sapiens
tccatgtttgtaa

SEQ ID NO: 3396724 - DNA, 14 bp, Homo sapiens
tccattaaatggtc

SEQ ID NO: 3396725 - DNA, 14 bp, Homo sapiens
tccattaggatttg

SEQ ID NO: 3396726 - DNA, 18 bp, Homo sapiens
tccattattttgtattct

SEQ ID NO: 3396727 - DNA, 19 bp, Homo sapiens
tccattcacaagcctcctg

SEQ ID NO: 3396728 - DNA, 20 bp, Homo sapiens
tccattcccaactagacatt

SEQ ID NO: 3396729 - DNA, 16 bp, Homo sapiens
tccattggtccaagat

SEQ ID NO: 3396730 - DNA, 18 bp, Homo sapiens
tccattggtccaagattc

SEQ ID NO: 3396731 - DNA, 19 bp, Homo sapiens
tccattggtccaagattcc

SEQ ID NO: 3396732 - DNA, 11 bp, Homo sapiens
tccattgttgt

SEQ ID NO: 3396733 - DNA, 16 bp, Homo sapiens
tccattgttgtgtctg

SEQ ID NO: 3396734 - DNA, 16 bp, Homo sapiens
tccatttatttatgaa

SEQ ID NO: 3396735 - DNA, 15 bp, Homo sapiens
tccatttccattgct

SEQ ID NO: 3396736 - DNA, 14 bp, Homo sapiens
tccatttgcctttc

SEQ ID NO: 3396737 - DNA, 15 bp, Homo sapiens
tccatttgcctttct

SEQ ID NO: 3396738 - DNA, 17 bp, Homo sapiens
tccatttgcctttctgg

SEQ ID NO: 3396739 - DNA, 17 bp, Homo sapiens
tccatttggtcctttct

SEQ ID NO: 3396740 - DNA, 13 bp, Homo sapiens
tccatttgtaaaa

SEQ ID NO: 3396741 - DNA, 21 bp, Homo sapiens
tccatttgtaattaaattatg

SEQ ID NO: 3396742 - DNA, 17 bp, Homo sapiens
tccattttaattttaaa

SEQ ID NO: 3396743 - DNA, 22 bp, Homo sapiens
tccattttcttattgcgctgct

SEQ ID NO: 3396744 - DNA, 21 bp, Homo sapiens
tccatttttaaggctgtgtga

SEQ ID NO: 3396745 - DNA, 18 bp, Homo sapiens
tccatttttcctctgttc

SEQ ID NO: 3396746 - DNA, 20 bp, Homo sapiens
tccatttttcctctgttcac

SEQ ID NO: 3396747 - DNA, 19 bp, Homo sapiens
tccattttttcttcccttt

SEQ ID NO: 3396748 - DNA, 24 bp, Homo sapiens
tcccaaacgccctttcctcctcag

SEQ ID NO: 3396749 - DNA, 21 bp, Homo sapiens
tcccaaacgcctcccctgccc

SEQ ID NO: 3396750 - DNA, 16 bp, Homo sapiens
tcccaaagtgctggga

SEQ ID NO: 3396751 - DNA, 23 bp, Homo sapiens
tcccaaagtgctgggattacaga

SEQ ID NO: 3396752 - DNA, 19 bp, Homo sapiens
tcccaaccagtgccaagga

SEQ ID NO: 3396753 - DNA, 23 bp, Homo sapiens
tcccaaccagtgccaaggacctc

SEQ ID NO: 3396754 - DNA, 17 bp, Homo sapiens
tcccaacccccctcctg

SEQ ID NO: 3396755 - DNA, 22 bp, Homo sapiens
tcccaacccccctcctgctcct

SEQ ID NO: 3396756 - DNA, 15 bp, Homo sapiens
tcccaactactcaga

SEQ ID NO: 3396757 - DNA, 18 bp, Homo sapiens
tcccaactactcagaagg

SEQ ID NO: 3396758 - DNA, 14 bp, Homo sapiens
tcccaacttgtaaa

SEQ ID NO: 3396759 - DNA, 22 bp, Homo sapiens
tcccaagacagtgagacagtct

SEQ ID NO: 3396760 - DNA, 20 bp, Homo sapiens
tcccaagctatctaaagttt

SEQ ID NO: 3396761 - DNA, 17 bp, Homo sapiens
tcccaagctctgctcct

SEQ ID NO: 3396762 - DNA, 22 bp, Homo sapiens
tcccaaggagctgatttccagg

SEQ ID NO: 3396763 - DNA, 22 bp, Homo sapiens
tcccaaggctctgagcaaatgt

SEQ ID NO: 3396764 - DNA, 16 bp, Homo sapiens
tcccaaggtcctctca

SEQ ID NO: 3396765 - DNA, 18 bp, Homo sapiens
tcccaaggtcctctcagt

SEQ ID NO: 3396766 - DNA, 23 bp, Homo sapiens
tcccaagtagctgggattacagg

SEQ ID NO: 3396767 - DNA, 22 bp, Homo sapiens
tcccaagtcagacagatgtcag

SEQ ID NO: 3396768 - DNA, 19 bp, Homo sapiens
tcccaagtttccatagcaa

SEQ ID NO: 3396769 - DNA, 23 bp, Homo sapiens
tcccaagtttccatagcaacagg

SEQ ID NO: 3396770 - DNA, 17 bp, Homo sapiens
tcccttgccctttccat

SEQ ID NO: 3396771 - DNA, 15 bp, Homo sapiens
tcccttgctggcccc

SEQ ID NO: 3396772 - DNA, 16 bp, Homo sapiens
tcccttgctggcccca

SEQ ID NO: 3396773 - DNA, 23 bp, Homo sapiens
tcccttgctggccccagccctgc

SEQ ID NO: 3396774 - DNA, 21 bp, Homo sapiens
tcccttgctttgttttaataa

SEQ ID NO: 3396775 - DNA, 16 bp, Homo sapiens
tcccttggcctcagaa

SEQ ID NO: 3396776 - DNA, 18 bp, Homo sapiens
tcccttgggctggaagaa

SEQ ID NO: 3396777 - DNA, 17 bp, Homo sapiens
tcccttgggttctgata

SEQ ID NO: 3396778 - DNA, 23 bp, Homo sapiens
tcccttgtattttgttaaagctg

SEQ ID NO: 3396779 - DNA, 18 bp, Homo sapiens
tccctttacaatgtgaat

SEQ ID NO: 3396780 - DNA, 20 bp, Homo sapiens
tccctttacaatgtgaatag

SEQ ID NO: 3396781 - DNA, 20 bp, Homo sapiens
tccctttagcacgtttaaag

SEQ ID NO: 3396782 - DNA, 16 bp, Homo sapiens
tccctttatttcacat

SEQ ID NO: 3396783 - DNA, 15 bp, Homo sapiens
tccctttcccttggt

SEQ ID NO: 3396784 - DNA, 14 bp, Homo sapiens
tccctttccttcca

SEQ ID NO: 3396785 - DNA, 19 bp, Homo sapiens
tccctttctctctcctctc

SEQ ID NO: 3396786 - DNA, 13 bp, Homo sapiens
tccctttcttggc

SEQ ID NO: 3396787 - DNA, 17 bp, Homo sapiens
tccctttcttggccagt

SEQ ID NO: 3396788 - DNA, 21 bp, Homo sapiens
tccctttcttggccagttatc

SEQ ID NO: 3396789 - DNA, 23 bp, Homo sapiens
tccctttgacttcagctgcctga

SEQ ID NO: 3396790 - DNA, 22 bp, Homo sapiens
tccctttgctgctgatgggcat

SEQ ID NO: 3396791 - DNA, 14 bp, Homo sapiens
tcccttttaatata

SEQ ID NO: 3396792 - DNA, 21 bp, Homo sapiens
tcccttttcctgtcagtgttt

SEQ ID NO: 3396793 - DNA, 16 bp, Homo sapiens
tcccttttctgttcta

SEQ ID NO: 3396794 - DNA, 22 bp, Homo sapiens
tccgaaagggacttggaagctc

SEQ ID NO: 3396795 - DNA, 15 bp, Homo sapiens
tccgaagaaaagaat

SEQ ID NO: 3396796 - DNA, 20 bp, Homo sapiens
tccgaccactaattgccaag

SEQ ID NO: 3396797 - DNA, 18 bp, Homo sapiens
tccgaccacttccagggg

SEQ ID NO: 3396798 - DNA, 20 bp, Homo sapiens
tccgaccctcatggccccca

SEQ ID NO: 3396799 - DNA, 15 bp, Homo sapiens
tccgaccctctggga

SEQ ID NO: 3396800 - DNA, 19 bp, Homo sapiens
tccgactgcccctgctgtg

SEQ ID NO: 3396801 - DNA, 23 bp, Homo sapiens
tccgactgcccctgctgtgctgc

SEQ ID NO: 3396802 - DNA, 15 bp, Homo sapiens
tccgactgctttgga

SEQ ID NO: 3396803 - DNA, 15 bp, Homo sapiens
tccgagacagtccag

SEQ ID NO: 3396804 - DNA, 16 bp, Homo sapiens
tccgagacagtccagt

SEQ ID NO: 3396805 - DNA, 17 bp, Homo sapiens
tccgagcattccagtaa

SEQ ID NO: 3396806 - DNA, 24 bp, Homo sapiens
tccgagccggggagtttctttcct

SEQ ID NO: 3396807 - DNA, 19 bp, Homo sapiens
tccgagctgaggactctgc

SEQ ID NO: 3396808 - DNA, 14 bp, Homo sapiens
tccgatggtatctg

SEQ ID NO: 3396809 - DNA, 17 bp, Homo sapiens
tccgatggtatctgggt

SEQ ID NO: 3396810 - DNA, 20 bp, Homo sapiens
tccgcaccagctgctctgcc

SEQ ID NO: 3396811 - DNA, 19 bp, Homo sapiens
tccgcaggctatttgttca

SEQ ID NO: 3396812 - DNA, 15 bp, Homo sapiens
tccgcaggtgctggt

SEQ ID NO: 3396813 - DNA, 18 bp, Homo sapiens
tccgccaatgcacggcct

SEQ ID NO: 3396814 - DNA, 15 bp, Homo sapiens
tccgccactcagcca

SEQ ID NO: 3396815 - DNA, 17 bp, Homo sapiens
tccgccagcctcctctg

SEQ ID NO: 3396816 - DNA, 11 bp, Homo sapiens
tccgcccccag

SEQ ID NO: 3396817 - DNA, 12 bp, Homo sapiens
tccgcccccagc

SEQ ID NO: 3396818 - DNA, 15 bp, Homo sapiens
tccgccccttccctt

SEQ ID NO: 3396819 - DNA, 15 bp, Homo sapiens
tccgccctcctcggg

SEQ ID NO: 3396820 - DNA, 15 bp, Homo sapiens
tccgccctgctcctc

SEQ ID NO: 3396821 - DNA, 22 bp, Homo sapiens
tccgccctgctcctccctggct

SEQ ID NO: 3396822 - DNA, 21 bp, Homo sapiens
tccgcccttagtcccccaact

SEQ ID NO: 3396823 - DNA, 18 bp, Homo sapiens
tccgcctacctcagcctc

SEQ ID NO: 3396824 - DNA, 16 bp, Homo sapiens
tccgcctcccccatgg

SEQ ID NO: 3396825 - DNA, 18 bp, Homo sapiens
tccgcctgcctctgcctc

SEQ ID NO: 3396826 - DNA, 17 bp, Homo sapiens
tccgccttcactccggt

SEQ ID NO: 3396827 - DNA, 19 bp, Homo sapiens
tccgcgaaaatagtttgtt

SEQ ID NO: 3396828 - DNA, 17 bp, Homo sapiens
tccgctcccaccgcccc

SEQ ID NO: 3396829 - DNA, 22 bp, Homo sapiens
tccgctgccaccacgtctgcca

SEQ ID NO: 3396830 - DNA, 16 bp, Homo sapiens
tccgctggctttggga

SEQ ID NO: 3396831 - DNA, 19 bp, Homo sapiens
tccgctttgaaagaagcaa

SEQ ID NO: 3396832 - DNA, 20 bp, Homo sapiens
tccgctttgaaagaagcaag

SEQ ID NO: 3396833 - DNA, 18 bp, Homo sapiens
tccggagagagagagagg

SEQ ID NO: 3396834 - DNA, 16 bp, Homo sapiens
tccggatcctaagcat

SEQ ID NO: 3396835 - DNA, 23 bp, Homo sapiens
tccggattggcttgtgtgtttca

SEQ ID NO: 3396836 - DNA, 15 bp, Homo sapiens
tccggcacactgcca

SEQ ID NO: 3396837 - DNA, 17 bp, Homo sapiens
tccggcacactgccaaa

SEQ ID NO: 3396838 - DNA, 20 bp, Homo sapiens
tccggcccagtgccactgcc

SEQ ID NO: 3396839 - DNA, 24 bp, Homo sapiens
tccggcctgtaatcagctctcctg

SEQ ID NO: 3396840 - DNA, 18 bp, Homo sapiens
tccggggtctgtgctgtg

SEQ ID NO: 3396841 - DNA, 22 bp, Homo sapiens
tccgggtgtggcctcagccctc

SEQ ID NO: 3396842 - DNA, 19 bp, Homo sapiens
tccggtgtgcctgcagccc

SEQ ID NO: 3396843 - DNA, 15 bp, Homo sapiens
tccggtgttctaaga

SEQ ID NO: 3396844 - DNA, 20 bp, Homo sapiens
tccgtccacccaggctgcac

SEQ ID NO: 3396845 - DNA, 18 bp, Homo sapiens
tccgtgaaaacggagctg

SEQ ID NO: 3396846 - DNA, 16 bp, Homo sapiens
tccgtgaattctcgga

SEQ ID NO: 3396847 - DNA, 20 bp, Homo sapiens
tccgtgagtgaaccatcatt

SEQ ID NO: 3396848 - DNA, 20 bp, Homo sapiens
tccgtgatccatccatctcc

SEQ ID NO: 3396849 - DNA, 14 bp, Homo sapiens
tccgtggcacttgt

SEQ ID NO: 3396850 - DNA, 16 bp, Homo sapiens
tccgtggcacttgtaa

SEQ ID NO: 3396851 - DNA, 20 bp, Homo sapiens
tccgtggccccgccctcagg

SEQ ID NO: 3396852 - DNA, 20 bp, Homo sapiens
tccgtggtagaggcctgggg

SEQ ID NO: 3396853 - DNA, 14 bp, Homo sapiens
tccgtggtcagagt

SEQ ID NO: 3396854 - DNA, 19 bp, Homo sapiens
tccgtggtcagagtgccac

SEQ ID NO: 3396855 - DNA, 21 bp, Homo sapiens
tccgtggtcagagtgccactg

SEQ ID NO: 3396856 - DNA, 19 bp, Homo sapiens
tccgttaacctttttgtaa

SEQ ID NO: 3396857 - DNA, 20 bp, Homo sapiens
tccgttaacctttttgtaaa

SEQ ID NO: 3396858 - DNA, 16 bp, Homo sapiens
tccgttcacatgtgtg

SEQ ID NO: 3396859 - DNA, 14 bp, Homo sapiens
tccgttctgttctg

SEQ ID NO: 3396860 - DNA, 13 bp, Homo sapiens
tccgttggccact

SEQ ID NO: 3396861 - DNA, 17 bp, Homo sapiens
tcctaaaacacctggta

SEQ ID NO: 3396862 - DNA, 13 bp, Homo sapiens
tcctaaaagttca

SEQ ID NO: 3396863 - DNA, 18 bp, Homo sapiens
tcctaaagagagtatttt

SEQ ID NO: 3396864 - DNA, 19 bp, Homo sapiens
tcctaaagccatcatgcct

SEQ ID NO: 3396865 - DNA, 19 bp, Homo sapiens
tcctaaatatccaaagact

SEQ ID NO: 3396866 - DNA, 23 bp, Homo sapiens
tcctaaatatccaaagactgtac

SEQ ID NO: 3396867 - DNA, 15 bp, Homo sapiens
tcctaaatgcagtga

SEQ ID NO: 3396868 - DNA, 14 bp, Homo sapiens
tcctaacaggatga

SEQ ID NO: 3396869 - DNA, 15 bp, Homo sapiens
tcctaagaagcttct

SEQ ID NO: 3396870 - DNA, 19 bp, Homo sapiens
tcctaagacacaaatgcat

SEQ ID NO: 3396871 - DNA, 16 bp, Homo sapiens
tcctaagagtgctggg

SEQ ID NO: 3396872 - DNA, 17 bp, Homo sapiens
tcctaagagtgctgggc

SEQ ID NO: 3396873 - DNA, 13 bp, Homo sapiens
tcctaagcatcta

SEQ ID NO: 3396874 - DNA, 17 bp, Homo sapiens
tcctaagcatctaagtt

SEQ ID NO: 3396875 - DNA, 16 bp, Homo sapiens
tcctaagctattcagt

SEQ ID NO: 3396876 - DNA, 18 bp, Homo sapiens
tcctaagctattcagtaa

SEQ ID NO: 3396877 - DNA, 21 bp, Homo sapiens
tcctaagctattcagtaataa

SEQ ID NO: 3396878 - DNA, 18 bp, Homo sapiens
tcctaaggacacactaat

SEQ ID NO: 3396879 - DNA, 16 bp, Homo sapiens
tcctaagggtcgaaag

SEQ ID NO: 3396880 - DNA, 20 bp, Homo sapiens
tcctaagggtcgaaagctct

SEQ ID NO: 3396881 - DNA, 22 bp, Homo sapiens
tcctaatcagaaatttttatca

SEQ ID NO: 3396882 - DNA, 18 bp, Homo sapiens
tcctaattaccagtcttt

SEQ ID NO: 3396883 - DNA, 18 bp, Homo sapiens
tcctaattcttctgtcct

SEQ ID NO: 3396884 - DNA, 19 bp, Homo sapiens
tcctaatttctcctccctt

SEQ ID NO: 3396885 - DNA, 23 bp, Homo sapiens
tcctacaagagcagcctgtggca

SEQ ID NO: 3396886 - DNA, 21 bp, Homo sapiens
tcctacaagatttagaaaaaa

SEQ ID NO: 3396887 - DNA, 13 bp, Homo sapiens
tcctacagcccct

SEQ ID NO: 3396888 - DNA, 16 bp, Homo sapiens
tcctacccaaccactc

SEQ ID NO: 3396889 - DNA, 13 bp, Homo sapiens
tcctaccgtcttt

SEQ ID NO: 3396890 - DNA, 18 bp, Homo sapiens
tcctactccctcttccaa

SEQ ID NO: 3396891 - DNA, 14 bp, Homo sapiens
tcctactgtcctca

SEQ ID NO: 3396892 - DNA, 17 bp, Homo sapiens
tcctacttgcagtacat

SEQ ID NO: 3396893 - DNA, 15 bp, Homo sapiens
tcctagacttgaaag

SEQ ID NO: 3396894 - DNA, 20 bp, Homo sapiens
tcctagacttgaaagttttc

SEQ ID NO: 3396895 - DNA, 19 bp, Homo sapiens
tcctttctaatcctatctg

SEQ ID NO: 3396896 - DNA, 13 bp, Homo sapiens
tcctttctcaccg

SEQ ID NO: 3396897 - DNA, 16 bp, Homo sapiens
tcctttctccagccag

SEQ ID NO: 3396898 - DNA, 17 bp, Homo sapiens
tcctttctccaggacca

SEQ ID NO: 3396899 - DNA, 17 bp, Homo sapiens
tcctttctgtgccctac

SEQ ID NO: 3396900 - DNA, 15 bp, Homo sapiens
tcctttcttgtcttt

SEQ ID NO: 3396901 - DNA, 17 bp, Homo sapiens
tcctttctttttcttct

SEQ ID NO: 3396902 - DNA, 13 bp, Homo sapiens
tcctttgcaccct

SEQ ID NO: 3396903 - DNA, 15 bp, Homo sapiens
tcctttgcaccctgt

SEQ ID NO: 3396904 - DNA, 16 bp, Homo sapiens
tcctttgcaccctgta

SEQ ID NO: 3396905 - DNA, 14 bp, Homo sapiens
tcctttgcactgag

SEQ ID NO: 3396906 - DNA, 17 bp, Homo sapiens
tcctttgcactgagggc

SEQ ID NO: 3396907 - DNA, 20 bp, Homo sapiens
tcctttgcactgagggccac

SEQ ID NO: 3396908 - DNA, 17 bp, Homo sapiens
tcctttgcagggcagcc

SEQ ID NO: 3396909 - DNA, 17 bp, Homo sapiens
tcctttgcgcctgtgac

SEQ ID NO: 3396910 - DNA, 22 bp, Homo sapiens
tcctttggagcttttttcttta

SEQ ID NO: 3396911 - DNA, 18 bp, Homo sapiens
tcctttgtaatcactccc

SEQ ID NO: 3396912 - DNA, 10 bp, Homo sapiens
tcctttgttc

SEQ ID NO: 3396913 - DNA, 22 bp, Homo sapiens
tcctttgttttctgactaatta

SEQ ID NO: 3396914 - DNA, 19 bp, Homo sapiens
tccttttaaaacacttcca

SEQ ID NO: 3396915 - DNA, 17 bp, Homo sapiens
tccttttaattttcctg

SEQ ID NO: 3396916 - DNA, 12 bp, Homo sapiens
tccttttatgtg

SEQ ID NO: 3396917 - DNA, 21 bp, Homo sapiens
tccttttatttctccatcttt

SEQ ID NO: 3396918 - DNA, 15 bp, Homo sapiens
tccttttccctgctt

SEQ ID NO: 3396919 - DNA, 18 bp, Homo sapiens
tccttttcttttgttact

SEQ ID NO: 3396920 - DNA, 22 bp, Homo sapiens
tccttttcttttgttactgttc

SEQ ID NO: 3396921 - DNA, 13 bp, Homo sapiens
tccttttgacact

SEQ ID NO: 3396922 - DNA, 16 bp, Homo sapiens
tccttttgacactgct

SEQ ID NO: 3396923 - DNA, 22 bp, Homo sapiens
tccttttgactccttttggaac

SEQ ID NO: 3396924 - DNA, 18 bp, Homo sapiens
tccttttgtatcttcctt

SEQ ID NO: 3396925 - DNA, 21 bp, Homo sapiens
tccttttgtatcttcctttct

SEQ ID NO: 3396926 - DNA, 17 bp, Homo sapiens
tcctttttaaatgtgaa

SEQ ID NO: 3396927 - DNA, 17 bp, Homo sapiens
tcctttttaatatgctt

SEQ ID NO: 3396928 - DNA, 21 bp, Homo sapiens
tcctttttccatcattttaca

SEQ ID NO: 3396929 - DNA, 14 bp, Homo sapiens
tcctttttctttat

SEQ ID NO: 3396930 - DNA, 23 bp, Homo sapiens
tcctttttggtcgaggagtaaca

SEQ ID NO: 3396931 - DNA, 18 bp, Homo sapiens
tccttttttcaatatgca

SEQ ID NO: 3396932 - DNA, 15 bp, Homo sapiens
tccttttttgtcatt

SEQ ID NO: 3396933 - DNA, 14 bp, Homo sapiens
tccttttttgtcta

SEQ ID NO: 3396934 - DNA, 17 bp, Homo sapiens
tcgaaaaaataattatt

SEQ ID NO: 3396935 - DNA, 21 bp, Homo sapiens
tcgaaaagagtcttccaatta

SEQ ID NO: 3396936 - DNA, 15 bp, Homo sapiens
tcgaaaattcatttc

SEQ ID NO: 3396937 - DNA, 24 bp, Homo sapiens
tcgaaaattcatttcacattaatg

SEQ ID NO: 3396938 - DNA, 14 bp, Homo sapiens
tcgaaagctctaga

SEQ ID NO: 3396939 - DNA, 19 bp, Homo sapiens
tcgaaagctctagaatctg

SEQ ID NO: 3396940 - DNA, 13 bp, Homo sapiens
tcgaaatttcatt

SEQ ID NO: 3396941 - DNA, 14 bp, Homo sapiens
tcgaaatttcattt

SEQ ID NO: 3396942 - DNA, 14 bp, Homo sapiens
tcgaacatgtttca

SEQ ID NO: 3396943 - DNA, 16 bp, Homo sapiens
tcgaaccaaggcagcc

SEQ ID NO: 3396944 - DNA, 19 bp, Homo sapiens
tcgaaccaaggcagcctcc

SEQ ID NO: 3396945 - DNA, 20 bp, Homo sapiens
tcgaaccaaggcagcctcca

SEQ ID NO: 3396946 - DNA, 22 bp, Homo sapiens
tcgaaccaaggcagcctccaga

SEQ ID NO: 3396947 - DNA, 15 bp, Homo sapiens
tcgaaccgttttgaa

SEQ ID NO: 3396948 - DNA, 14 bp, Homo sapiens
tcgaacttcacaac

SEQ ID NO: 3396949 - DNA, 22 bp, Homo sapiens
tcgaagaaacccttgctgcttt

SEQ ID NO: 3396950 - DNA, 23 bp, Homo sapiens
tcgaagccttgcctaaatttaat

SEQ ID NO: 3396951 - DNA, 17 bp, Homo sapiens
tcgaatctctgtgcctt

SEQ ID NO: 3396952 - DNA, 21 bp, Homo sapiens
tcgacagggcctggagcccca

SEQ ID NO: 3396953 - DNA, 22 bp, Homo sapiens
tcgacatccgtcattgctgctg

SEQ ID NO: 3396954 - DNA, 20 bp, Homo sapiens
tcgacccagaatggagcctg

SEQ ID NO: 3396955 - DNA, 14 bp, Homo sapiens
tcgactcaggatcc

SEQ ID NO: 3396956 - DNA, 16 bp, Homo sapiens
tcgactcaggatccag

SEQ ID NO: 3396957 - DNA, 18 bp, Homo sapiens
tcgactggtccagctctg

SEQ ID NO: 3396958 - DNA, 19 bp, Homo sapiens
tcgactggtccagctctga

SEQ ID NO: 3396959 - DNA, 20 bp, Homo sapiens
tcgactggtccagctctgac

SEQ ID NO: 3396960 - DNA, 12 bp, Homo sapiens
tcgacttttctt

SEQ ID NO: 3396961 - DNA, 14 bp, Homo sapiens
tcgacttttcttaa

SEQ ID NO: 3396962 - DNA, 19 bp, Homo sapiens
tcgagaccagcctggccaa

SEQ ID NO: 3396963 - DNA, 16 bp, Homo sapiens
tcgagaccatcctggc

SEQ ID NO: 3396964 - DNA, 14 bp, Homo sapiens
tcgaggagtaacaa

SEQ ID NO: 3396965 - DNA, 17 bp, Homo sapiens
tcgaggagtaacaatac

SEQ ID NO: 3396966 - DNA, 22 bp, Homo sapiens
tcgaggcaccggcgctgcaggt

SEQ ID NO: 3396967 - DNA, 22 bp, Homo sapiens
tcgaggcctgcaaaccttcctg

SEQ ID NO: 3396968 - DNA, 17 bp, Homo sapiens
tcgaggctggtgccagg

SEQ ID NO: 3396969 - DNA, 20 bp, Homo sapiens
tcgaggggctctcagctcag

SEQ ID NO: 3396970 - DNA, 18 bp, Homo sapiens
tcgagttcggctctgggt

SEQ ID NO: 3396971 - DNA, 23 bp, Homo sapiens
tcgatactgcgactttctgcctg

SEQ ID NO: 3396972 - DNA, 22 bp, Homo sapiens
tcgatatgtatatcattctaca

SEQ ID NO: 3396973 - DNA, 15 bp, Homo sapiens
tcgatccaaattgtg

SEQ ID NO: 3396974 - DNA, 13 bp, Homo sapiens
tcgatcctggatt

SEQ ID NO: 3396975 - DNA, 18 bp, Homo sapiens
tcgatgcgttcactccaa

SEQ ID NO: 3396976 - DNA, 13 bp, Homo sapiens
tcgatttctacct

SEQ ID NO: 3396977 - DNA, 15 bp, Homo sapiens
tcgcacaatgtttga

SEQ ID NO: 3396978 - DNA, 21 bp, Homo sapiens
tcgcaccactgtgtatttaac

SEQ ID NO: 3396979 - DNA, 16 bp, Homo sapiens
tcgcaccattctgact

SEQ ID NO: 3396980 - DNA, 17 bp, Homo sapiens
tcgcacccccctgttct

SEQ ID NO: 3396981 - DNA, 23 bp, Homo sapiens
tcgcaggagtctctgccacccac

SEQ ID NO: 3396982 - DNA, 22 bp, Homo sapiens
tcgcaggatccgctgccaccac

SEQ ID NO: 3396983 - DNA, 17 bp, Homo sapiens
tcgcattccatatcttt

SEQ ID NO: 3396984 - DNA, 13 bp, Homo sapiens
tcgcatttgtcaa

SEQ ID NO: 3396985 - DNA, 12 bp, Homo sapiens
tcgcccagcagg

SEQ ID NO: 3396986 - DNA, 15 bp, Homo sapiens
tcgcccagcaggaga

SEQ ID NO: 3396987 - DNA, 13 bp, Homo sapiens
tcgccccaggccc

SEQ ID NO: 3396988 - DNA, 22 bp, Homo sapiens
tcgcccgagctgtttatgtttt

SEQ ID NO: 3396989 - DNA, 22 bp, Homo sapiens
tcgcctcactttccaccaagtg

SEQ ID NO: 3396990 - DNA, 14 bp, Homo sapiens
tcgccttagcatgt

SEQ ID NO: 3396991 - DNA, 20 bp, Homo sapiens
tcgccttagcatgtttgctg

SEQ ID NO: 3396992 - DNA, 21 bp, Homo sapiens
tcgccttagcatgtttgctga

SEQ ID NO: 3396993 - DNA, 14 bp, Homo sapiens
tcgcgctcagcatg

SEQ ID NO: 3396994 - DNA, 21 bp, Homo sapiens
tcgcgggcagcgggccaggcc

SEQ ID NO: 3396995 - DNA, 13 bp, Homo sapiens
tcgctcactgttg

SEQ ID NO: 3396996 - DNA, 21 bp, Homo sapiens
tcgctcccacattctgatgag

SEQ ID NO: 3396997 - DNA, 19 bp, Homo sapiens
tcgctccctgtagctctgc

SEQ ID NO: 3396998 - DNA, 23 bp, Homo sapiens
tcgctccctgtagctctgcctcc

SEQ ID NO: 3396999 - DNA, 22 bp, Homo sapiens
tcgctcctcaacccctcccctc

SEQ ID NO: 3397000 - DNA, 17 bp, Homo sapiens
tcgctctgctggcctgg

SEQ ID NO: 3397001 - DNA, 17 bp, Homo sapiens
tcgctgacttcatggaa

SEQ ID NO: 3397002 - DNA, 18 bp, Homo sapiens
tcgctgacttcatggaat

SEQ ID NO: 3397003 - DNA, 19 bp, Homo sapiens
tcgctgctctagctggcag

SEQ ID NO: 3397004 - DNA, 20 bp, Homo sapiens
tcgctgtaccctttaagata

SEQ ID NO: 3397005 - DNA, 17 bp, Homo sapiens
tcgcttatatgtccttg

SEQ ID NO: 3397006 - DNA, 14 bp, Homo sapiens
tcgcttccaggccg

SEQ ID NO: 3397007 - DNA, 15 bp, Homo sapiens
tcgcttcccccatag

SEQ ID NO: 3397008 - DNA, 16 bp, Homo sapiens
tcgcttcccccatagc

SEQ ID NO: 3397009 - DNA, 16 bp, Homo sapiens
tcgcttcttgcctctg

SEQ ID NO: 3397010 - DNA, 17 bp, Homo sapiens
tcgcttcttgcctctgt

SEQ ID NO: 3397011 - DNA, 14 bp, Homo sapiens
tcgcttgagcccag

SEQ ID NO: 3397012 - DNA, 16 bp, Homo sapiens
tcgcttgtaaatacca

SEQ ID NO: 3397013 - DNA, 19 bp, Homo sapiens
tcggaaccgctcacctaga

SEQ ID NO: 3397014 - DNA, 19 bp, Homo sapiens
tcggaactgtcctttcctt

SEQ ID NO: 3397015 - DNA, 16 bp, Homo sapiens
tcggaagcagtgcctt

SEQ ID NO: 3397016 - DNA, 19 bp, Homo sapiens
tcggaaggctggctgggca

SEQ ID NO: 3397017 - DNA, 23 bp, Homo sapiens
tcggactaaactatctgtattta

SEQ ID NO: 3397018 - DNA, 13 bp, Homo sapiens
tcggagagcagca

SEQ ID NO: 3397019 - DNA, 18 bp, Homo sapiens
tcggagcatggtgttttc

SEQ ID NO: 3397020 - DNA, 13 bp, Homo sapiens
tcggaggccccac

SEQ ID NO: 3397021 - DNA, 20 bp, Homo sapiens
tctcaagttctaagattcta

SEQ ID NO: 3397022 - DNA, 22 bp, Homo sapiens
tctcaattaaagtctattcaaa

SEQ ID NO: 3397023 - DNA, 14 bp, Homo sapiens
tctcacacacatag

SEQ ID NO: 3397024 - DNA, 23 bp, Homo sapiens
tctcacacccaccgtccgccctg

SEQ ID NO: 3397025 - DNA, 16 bp, Homo sapiens
tctcacagatgtgact

SEQ ID NO: 3397026 - DNA, 21 bp, Homo sapiens
tctcacatgtggcaaaatatg

SEQ ID NO: 3397027 - DNA, 17 bp, Homo sapiens
tctcaccagctgctgct

SEQ ID NO: 3397028 - DNA, 19 bp, Homo sapiens
tctcaccccatcccacacc

SEQ ID NO: 3397029 - DNA, 19 bp, Homo sapiens
tctcacccccatccctggg

SEQ ID NO: 3397030 - DNA, 13 bp, Homo sapiens
tctcactaaactt

SEQ ID NO: 3397031 - DNA, 16 bp, Homo sapiens
tctcactatgttgccc

SEQ ID NO: 3397032 - DNA, 23 bp, Homo sapiens
tctcactatgttgcccaggcagg

SEQ ID NO: 3397033 - DNA, 14 bp, Homo sapiens
tctcactcacattt

SEQ ID NO: 3397034 - DNA, 23 bp, Homo sapiens
tctcactccccagccccacccct

SEQ ID NO: 3397035 - DNA, 17 bp, Homo sapiens
tctcactcctacctggt

SEQ ID NO: 3397036 - DNA, 16 bp, Homo sapiens
tctcactcctgcctcc

SEQ ID NO: 3397037 - DNA, 12 bp, Homo sapiens
tctcactctgtc

SEQ ID NO: 3397038 - DNA, 21 bp, Homo sapiens
tctcactgagaagattgtgaa

SEQ ID NO: 3397039 - DNA, 23 bp, Homo sapiens
tctcactggccaagaaaattgcc

SEQ ID NO: 3397040 - DNA, 17 bp, Homo sapiens
tctcactgtgtacataa

SEQ ID NO: 3397041 - DNA, 14 bp, Homo sapiens
tctcactgttccct

SEQ ID NO: 3397042 - DNA, 22 bp, Homo sapiens
tctcactgttccctctgctcct

SEQ ID NO: 3397043 - DNA, 17 bp, Homo sapiens
tctcactgttctgcaaa

SEQ ID NO: 3397044 - DNA, 14 bp, Homo sapiens
tctcactgttgccc

SEQ ID NO: 3397045 - DNA, 18 bp, Homo sapiens
tctcactgttgcccaggc

SEQ ID NO: 3397046 - DNA, 22 bp, Homo sapiens
tctcagaaactcccctgggggt

SEQ ID NO: 3397047 - DNA, 11 bp, Homo sapiens
tctcagaaagt

SEQ ID NO: 3397048 - DNA, 17 bp, Homo sapiens
tctcagaaagtgcctga

SEQ ID NO: 3397049 - DNA, 19 bp, Homo sapiens
tctcagaaagtgcctgaca

SEQ ID NO: 3397050 - DNA, 19 bp, Homo sapiens
tctcagaaatgctgtccct

SEQ ID NO: 3397051 - DNA, 23 bp, Homo sapiens
tctcagaatctaaacgtggtcac

SEQ ID NO: 3397052 - DNA, 15 bp, Homo sapiens
tctcagaatttatct

SEQ ID NO: 3397053 - DNA, 20 bp, Homo sapiens
tctcagaatttatctccctt

SEQ ID NO: 3397054 - DNA, 21 bp, Homo sapiens
tctcagacactaaatgcagac

SEQ ID NO: 3397055 - DNA, 17 bp, Homo sapiens
tctcagagcatctggct

SEQ ID NO: 3397056 - DNA, 17 bp, Homo sapiens
tctcagagcatgtgtca

SEQ ID NO: 3397057 - DNA, 15 bp, Homo sapiens
tctcagaggcctgct

SEQ ID NO: 3397058 - DNA, 18 bp, Homo sapiens
tctcagagtccactgtgg

SEQ ID NO: 3397059 - DNA, 14 bp, Homo sapiens
tctcagatatttat

SEQ ID NO: 3397060 - DNA, 14 bp, Homo sapiens
tctcagatgttaaa

SEQ ID NO: 3397061 - DNA, 19 bp, Homo sapiens
tctcagatgttaaaataaa

SEQ ID NO: 3397062 - DNA, 14 bp, Homo sapiens
tctcagcaagagaa

SEQ ID NO: 3397063 - DNA, 13 bp, Homo sapiens
tctcagcccagaa

SEQ ID NO: 3397064 - DNA, 14 bp, Homo sapiens
tctcagcccagaag

SEQ ID NO: 3397065 - DNA, 15 bp, Homo sapiens
tctcagcccagaaga

SEQ ID NO: 3397066 - DNA, 20 bp, Homo sapiens
tctcagcccagaagaaaatt

SEQ ID NO: 3397067 - DNA, 18 bp, Homo sapiens
tctcagcctcctgagcct

SEQ ID NO: 3397068 - DNA, 19 bp, Homo sapiens
tctcagcctcctgagcctg

SEQ ID NO: 3397069 - DNA, 21 bp, Homo sapiens
tctcagctccaggtggctctg

SEQ ID NO: 3397070 - DNA, 14 bp, Homo sapiens
tctcaggagcacag

SEQ ID NO: 3397071 - DNA, 23 bp, Homo sapiens
tctcaggagcacaggcagctgga

SEQ ID NO: 3397072 - DNA, 20 bp, Homo sapiens
tctcaggatcaagaaagtgt

SEQ ID NO: 3397073 - DNA, 15 bp, Homo sapiens
tctcaggatccaagc

SEQ ID NO: 3397074 - DNA, 17 bp, Homo sapiens
tctcagggcctggcagg

SEQ ID NO: 3397075 - DNA, 16 bp, Homo sapiens
tctcaggggctgtttg

SEQ ID NO: 3397076 - DNA, 22 bp, Homo sapiens
tctcaggtagaaggttgacaca

SEQ ID NO: 3397077 - DNA, 14 bp, Homo sapiens
tctcaggtgccact

SEQ ID NO: 3397078 - DNA, 22 bp, Homo sapiens
tctcaggtgccactccctgagc

SEQ ID NO: 3397079 - DNA, 16 bp, Homo sapiens
tctcagtcatgcataa

SEQ ID NO: 3397080 - DNA, 21 bp, Homo sapiens
tctcagtgtgcccttctctta

SEQ ID NO: 3397081 - DNA, 18 bp, Homo sapiens
tctcagtgttgagccttt

SEQ ID NO: 3397082 - DNA, 15 bp, Homo sapiens
tctcagttggaaata

SEQ ID NO: 3397083 - DNA, 15 bp, Homo sapiens
tctcagttttcataa

SEQ ID NO: 3397084 - DNA, 16 bp, Homo sapiens
tctcagttttcataag

SEQ ID NO: 3397085 - DNA, 13 bp, Homo sapiens
tctcataatcctt

SEQ ID NO: 3397086 - DNA, 19 bp, Homo sapiens
tctcataggaaaagtacat

SEQ ID NO: 3397087 - DNA, 14 bp, Homo sapiens
tctcataggagact

SEQ ID NO: 3397088 - DNA, 16 bp, Homo sapiens
tctcataggagactgc

SEQ ID NO: 3397089 - DNA, 16 bp, Homo sapiens
tctcataggttaaaaa

SEQ ID NO: 3397090 - DNA, 17 bp, Homo sapiens
tctcatcaactgaatga

SEQ ID NO: 3397091 - DNA, 14 bp, Homo sapiens
tctcatcctccagt

SEQ ID NO: 3397092 - DNA, 21 bp, Homo sapiens
tctcatcctccagtaccttgc

SEQ ID NO: 3397093 - DNA, 13 bp, Homo sapiens
tctcatcctcctg

SEQ ID NO: 3397094 - DNA, 16 bp, Homo sapiens
tctcatcctcctggaa

SEQ ID NO: 3397095 - DNA, 17 bp, Homo sapiens
tctcatcctcctggaac

SEQ ID NO: 3397096 - DNA, 23 bp, Homo sapiens
tctcatcctggcacgccctactc

SEQ ID NO: 3397097 - DNA, 21 bp, Homo sapiens
tctcatctgatcacttcatgt

SEQ ID NO: 3397098 - DNA, 13 bp, Homo sapiens
tctcatcttctct

SEQ ID NO: 3397099 - DNA, 14 bp, Homo sapiens
tctcatcttctctc

SEQ ID NO: 3397100 - DNA, 14 bp, Homo sapiens
tctcatcttgtgaa

SEQ ID NO: 3397101 - DNA, 13 bp, Homo sapiens
tctcatgggaagc

SEQ ID NO: 3397102 - DNA, 12 bp, Homo sapiens
tctcatgtatct

SEQ ID NO: 3397103 - DNA, 13 bp, Homo sapiens
tctcatgtatctt

SEQ ID NO: 3397104 - DNA, 17 bp, Homo sapiens
tctcatgtcctgctggc

SEQ ID NO: 3397105 - DNA, 16 bp, Homo sapiens
tctcattacttttgaa

SEQ ID NO: 3397106 - DNA, 16 bp, Homo sapiens
tctcattcgcctttgt

SEQ ID NO: 3397107 - DNA, 15 bp, Homo sapiens
tctcattgcttacaa

SEQ ID NO: 3397108 - DNA, 15 bp, Homo sapiens
tctcattgcttctga

SEQ ID NO: 3397109 - DNA, 21 bp, Homo sapiens
tctccaaaaaaaaaaaaaata

SEQ ID NO: 3397110 - DNA, 23 bp, Homo sapiens
tctccaaaaaaaaaaaaaataca

SEQ ID NO: 3397111 - DNA, 23 bp, Homo sapiens
tctccaaactgaagcagcctctc

SEQ ID NO: 3397112 - DNA, 17 bp, Homo sapiens
tctccaaaggggctgct

SEQ ID NO: 3397113 - DNA, 18 bp, Homo sapiens
tctccaaaggggctgctg

SEQ ID NO: 3397114 - DNA, 22 bp, Homo sapiens
tctccaaaggggctgctggggc

SEQ ID NO: 3397115 - DNA, 16 bp, Homo sapiens
tctccaaataaaaatt

SEQ ID NO: 3397116 - DNA, 23 bp, Homo sapiens
tctccaaccccggaaaacattgc

SEQ ID NO: 3397117 - DNA, 16 bp, Homo sapiens
tctccaagaccttggc

SEQ ID NO: 3397118 - DNA, 18 bp, Homo sapiens
tctccaaggatcctctcc

SEQ ID NO: 3397119 - DNA, 16 bp, Homo sapiens
tctccaagtctctctg

SEQ ID NO: 3397120 - DNA, 21 bp, Homo sapiens
tctccaagtctctctgtgaat

SEQ ID NO: 3397121 - DNA, 22 bp, Homo sapiens
tctccaagtctctctgtgaata

SEQ ID NO: 3397122 - DNA, 20 bp, Homo sapiens
tctccaagtgccagaggtgg

SEQ ID NO: 3397123 - DNA, 21 bp, Homo sapiens
tctccacagatgtaattatgt

SEQ ID NO: 3397124 - DNA, 15 bp, Homo sapiens
tctccacagtgttca

SEQ ID NO: 3397125 - DNA, 19 bp, Homo sapiens
tctccaccctggctgggat

SEQ ID NO: 3397126 - DNA, 18 bp, Homo sapiens
tctccagatgtttccaga

SEQ ID NO: 3397127 - DNA, 19 bp, Homo sapiens
tctccagatgtttccagac

SEQ ID NO: 3397128 - DNA, 13 bp, Homo sapiens
tctccagccagca

SEQ ID NO: 3397129 - DNA, 15 bp, Homo sapiens
tctccagccagcaat

SEQ ID NO: 3397130 - DNA, 19 bp, Homo sapiens
tctccagccgaagctgcag

SEQ ID NO: 3397131 - DNA, 15 bp, Homo sapiens
tctccagcctggacc

SEQ ID NO: 3397132 - DNA, 19 bp, Homo sapiens
tctccagcctggaccccca

SEQ ID NO: 3397133 - DNA, 21 bp, Homo sapiens
tctccagcctggacccccagc

SEQ ID NO: 3397134 - DNA, 23 bp, Homo sapiens
tctccagcctggacccccagctt

SEQ ID NO: 3397135 - DNA, 21 bp, Homo sapiens
tctccagcgtcagctgctccc

SEQ ID NO: 3397136 - DNA, 16 bp, Homo sapiens
tctccagctcagaacc

SEQ ID NO: 3397137 - DNA, 17 bp, Homo sapiens
tctccagctcagaaccc

SEQ ID NO: 3397138 - DNA, 15 bp, Homo sapiens
tctccagctgactaa

SEQ ID NO: 3397139 - DNA, 11 bp, Homo sapiens
tctccagctgg

SEQ ID NO: 3397140 - DNA, 13 bp, Homo sapiens
tctccaggatcca

SEQ ID NO: 3397141 - DNA, 18 bp, Homo sapiens
tctccaggccatgatggc

SEQ ID NO: 3397142 - DNA, 12 bp, Homo sapiens
tctccaggggcc

SEQ ID NO: 3397143 - DNA, 19 bp, Homo sapiens
tctccaggggcctgcagaa

SEQ ID NO: 3397144 - DNA, 23 bp, Homo sapiens
tctccaggggcctgcagaaggaa

SEQ ID NO: 3397145 - DNA, 19 bp, Homo sapiens
tctccaggtctcacgggca

SEQ ID NO: 3397146 - DNA, 19 bp, Homo sapiens
tctccagtatccactttgc

SEQ ID NO: 3397147 - DNA, 15 bp, Homo sapiens
tctgaggaccgctga

SEQ ID NO: 3397148 - DNA, 22 bp, Homo sapiens
tctgaggcagttgacggggcag

SEQ ID NO: 3397149 - DNA, 14 bp, Homo sapiens
tctgaggccctgcc

SEQ ID NO: 3397150 - DNA, 19 bp, Homo sapiens
tctgaggctctttctgggc

SEQ ID NO: 3397151 - DNA, 21 bp, Homo sapiens
tctgaggctctttctgggcca

SEQ ID NO: 3397152 - DNA, 17 bp, Homo sapiens
tctgagggaggaggcca

SEQ ID NO: 3397153 - DNA, 23 bp, Homo sapiens
tctgagggaggaggccacctctc

SEQ ID NO: 3397154 - DNA, 18 bp, Homo sapiens
tctgaggttggatttgct

SEQ ID NO: 3397155 - DNA, 15 bp, Homo sapiens
tctgagtccactgct

SEQ ID NO: 3397156 - DNA, 14 bp, Homo sapiens
tctgagtcctgtct

SEQ ID NO: 3397157 - DNA, 17 bp, Homo sapiens
tctgagtctgagtcctg

SEQ ID NO: 3397158 - DNA, 18 bp, Homo sapiens
tctgagtgaacctgtata

SEQ ID NO: 3397159 - DNA, 20 bp, Homo sapiens
tctgagtgaacctgtataag

SEQ ID NO: 3397160 - DNA, 20 bp, Homo sapiens
tctgagtggtggttcctttg

SEQ ID NO: 3397161 - DNA, 20 bp, Homo sapiens
tctgagtttaccatttgtaa

SEQ ID NO: 3397162 - DNA, 15 bp, Homo sapiens
tctgataggaacaga

SEQ ID NO: 3397163 - DNA, 14 bp, Homo sapiens
tctgatatgggact

SEQ ID NO: 3397164 - DNA, 15 bp, Homo sapiens
tctgatatgggactg

SEQ ID NO: 3397165 - DNA, 19 bp, Homo sapiens
tctgatattaatcaaaatt

SEQ ID NO: 3397166 - DNA, 20 bp, Homo sapiens
tctgatcagaggtgtacact

SEQ ID NO: 3397167 - DNA, 21 bp, Homo sapiens
tctgatcagaggtgtacacta

SEQ ID NO: 3397168 - DNA, 15 bp, Homo sapiens
tctgatcttgtgctc

SEQ ID NO: 3397169 - DNA, 18 bp, Homo sapiens
tctgatggaccttctaga

SEQ ID NO: 3397170 - DNA, 20 bp, Homo sapiens
tctgatggtgagctgggaag

SEQ ID NO: 3397171 - DNA, 14 bp, Homo sapiens
tctgatgtctctaa

SEQ ID NO: 3397172 - DNA, 16 bp, Homo sapiens
tctgatgtttcatatt

SEQ ID NO: 3397173 - DNA, 19 bp, Homo sapiens
tctgattcccaagctctgc

SEQ ID NO: 3397174 - DNA, 21 bp, Homo sapiens
tctgattcccaagctctgctc

SEQ ID NO: 3397175 - DNA, 19 bp, Homo sapiens
tctgattctggctttaagc

SEQ ID NO: 3397176 - DNA, 19 bp, Homo sapiens
tctgattggacattttctt

SEQ ID NO: 3397177 - DNA, 21 bp, Homo sapiens
tctgattggacattttcttca

SEQ ID NO: 3397178 - DNA, 13 bp, Homo sapiens
tctgattggcttg

SEQ ID NO: 3397179 - DNA, 22 bp, Homo sapiens
tctgattttaggagctaaggct

SEQ ID NO: 3397180 - DNA, 18 bp, Homo sapiens
tctgcaaagaatgagaag

SEQ ID NO: 3397181 - DNA, 17 bp, Homo sapiens
tctgcaacaagcatgca

SEQ ID NO: 3397182 - DNA, 16 bp, Homo sapiens
tctgcaactgaaatta

SEQ ID NO: 3397183 - DNA, 19 bp, Homo sapiens
tctgcaactgaaattacat

SEQ ID NO: 3397184 - DNA, 17 bp, Homo sapiens
tctgcaaggtctttggt

SEQ ID NO: 3397185 - DNA, 15 bp, Homo sapiens
tctgcaagtcagagg

SEQ ID NO: 3397186 - DNA, 16 bp, Homo sapiens
tctgcaagtcagagga

SEQ ID NO: 3397187 - DNA, 21 bp, Homo sapiens
tctgcaatgggcactgggatg

SEQ ID NO: 3397188 - DNA, 19 bp, Homo sapiens
tctgcaattcaaaagttcc

SEQ ID NO: 3397189 - DNA, 23 bp, Homo sapiens
tctgcaattcaaaagttccaaga

SEQ ID NO: 3397190 - DNA, 21 bp, Homo sapiens
tctgcaattcccctctgctgc

SEQ ID NO: 3397191 - DNA, 16 bp, Homo sapiens
tctgcacacaaatatt

SEQ ID NO: 3397192 - DNA, 17 bp, Homo sapiens
tctgcacacaaatatta

SEQ ID NO: 3397193 - DNA, 18 bp, Homo sapiens
tctgcacacacctccgag

SEQ ID NO: 3397194 - DNA, 19 bp, Homo sapiens
tctgcacacacctccgaga

SEQ ID NO: 3397195 - DNA, 22 bp, Homo sapiens
tctgcacaccctccagagacaa

SEQ ID NO: 3397196 - DNA, 10 bp, Homo sapiens
tctgcacaga

SEQ ID NO: 3397197 - DNA, 15 bp, Homo sapiens
tctgcacagatggat

SEQ ID NO: 3397198 - DNA, 14 bp, Homo sapiens
tctgcacagggtcc

SEQ ID NO: 3397199 - DNA, 17 bp, Homo sapiens
tctgcacatgtcttgta

SEQ ID NO: 3397200 - DNA, 19 bp, Homo sapiens
tctgcacatgtcttgtaca

SEQ ID NO: 3397201 - DNA, 20 bp, Homo sapiens
tctgcacatgtcttgtacat

SEQ ID NO: 3397202 - DNA, 22 bp, Homo sapiens
tctgcacatgtcttgtacatgt

SEQ ID NO: 3397203 - DNA, 21 bp, Homo sapiens
tctgcacccctctgccctcat

SEQ ID NO: 3397204 - DNA, 21 bp, Homo sapiens
tctgcaccccttctctcctcc

SEQ ID NO: 3397205 - DNA, 13 bp, Homo sapiens
tctgcaccctcca

SEQ ID NO: 3397206 - DNA, 17 bp, Homo sapiens
tctgcaccctccaccct

SEQ ID NO: 3397207 - DNA, 19 bp, Homo sapiens
tctgcaccctccaccctgt

SEQ ID NO: 3397208 - DNA, 22 bp, Homo sapiens
tctgcacctatgtagctctgca

SEQ ID NO: 3397209 - DNA, 14 bp, Homo sapiens
tctgcactaagaga

SEQ ID NO: 3397210 - DNA, 12 bp, Homo sapiens
tctgcactactc

SEQ ID NO: 3397211 - DNA, 14 bp, Homo sapiens
tctgcactactcct

SEQ ID NO: 3397212 - DNA, 18 bp, Homo sapiens
tctgcactactcctctgc

SEQ ID NO: 3397213 - DNA, 18 bp, Homo sapiens
tctgcactactgacatgt

SEQ ID NO: 3397214 - DNA, 16 bp, Homo sapiens
tctgcactgaaaaggt

SEQ ID NO: 3397215 - DNA, 17 bp, Homo sapiens
tctgcagaacagtgaaa

SEQ ID NO: 3397216 - DNA, 22 bp, Homo sapiens
tctgcagaacatcgatatgtat

SEQ ID NO: 3397217 - DNA, 19 bp, Homo sapiens
tctgcagacacgccttccc

SEQ ID NO: 3397218 - DNA, 15 bp, Homo sapiens
tctgcagactgctag

SEQ ID NO: 3397219 - DNA, 23 bp, Homo sapiens
tctgcagactgctagtgttctgt

SEQ ID NO: 3397220 - DNA, 19 bp, Homo sapiens
tctgcagacttcccagcta

SEQ ID NO: 3397221 - DNA, 19 bp, Homo sapiens
tctgcagatcttccgtggt

SEQ ID NO: 3397222 - DNA, 22 bp, Homo sapiens
tctgcagatcttccgtggtcag

SEQ ID NO: 3397223 - DNA, 19 bp, Homo sapiens
tctgcagcccttgggcagt

SEQ ID NO: 3397224 - DNA, 23 bp, Homo sapiens
tctgcaggcctaggtgcagctcc

SEQ ID NO: 3397225 - DNA, 14 bp, Homo sapiens
tctgcaggcttaat

SEQ ID NO: 3397226 - DNA, 17 bp, Homo sapiens
tctgcagtaaaacacat

SEQ ID NO: 3397227 - DNA, 14 bp, Homo sapiens
tctgcagtgccttg

SEQ ID NO: 3397228 - DNA, 16 bp, Homo sapiens
tctgcagtgtgccccc

SEQ ID NO: 3397229 - DNA, 19 bp, Homo sapiens
tctgcatacgagagacttg

SEQ ID NO: 3397230 - DNA, 15 bp, Homo sapiens
tctgcatatgttgaa

SEQ ID NO: 3397231 - DNA, 18 bp, Homo sapiens
tctgcatatgttgaatac

SEQ ID NO: 3397232 - DNA, 19 bp, Homo sapiens
tctgcatatgttgaatact

SEQ ID NO: 3397233 - DNA, 16 bp, Homo sapiens
tctgcattcattttta

SEQ ID NO: 3397234 - DNA, 21 bp, Homo sapiens
tctgcattcatttttatagca

SEQ ID NO: 3397235 - DNA, 22 bp, Homo sapiens
tctgcattgttattgtggaaga

SEQ ID NO: 3397236 - DNA, 23 bp, Homo sapiens
tctgcattgttattgtggaagat

SEQ ID NO: 3397237 - DNA, 21 bp, Homo sapiens
tctgcattttcaccccaccct

SEQ ID NO: 3397238 - DNA, 15 bp, Homo sapiens
tctgccacccactca

SEQ ID NO: 3397239 - DNA, 16 bp, Homo sapiens
tctgccacccactcag

SEQ ID NO: 3397240 - DNA, 18 bp, Homo sapiens
tctgccacccactcagga

SEQ ID NO: 3397241 - DNA, 21 bp, Homo sapiens
tctgccacccactcaggattg

SEQ ID NO: 3397242 - DNA, 17 bp, Homo sapiens
tctgccagcaaagagga

SEQ ID NO: 3397243 - DNA, 13 bp, Homo sapiens
tctgccagccaca

SEQ ID NO: 3397244 - DNA, 14 bp, Homo sapiens
tctgccaggcccat

SEQ ID NO: 3397245 - DNA, 12 bp, Homo sapiens
tctgccagggca

SEQ ID NO: 3397246 - DNA, 19 bp, Homo sapiens
tctgccagtgacagacagg

SEQ ID NO: 3397247 - DNA, 23 bp, Homo sapiens
tctgccattgggaccctccagtg

SEQ ID NO: 3397248 - DNA, 24 bp, Homo sapiens
tctgccattgggaccctccagtgc

SEQ ID NO: 3397249 - DNA, 21 bp, Homo sapiens
tctgcccacgatcccctcccc

SEQ ID NO: 3397250 - DNA, 21 bp, Homo sapiens
tctgcccacgcagaggacgca

SEQ ID NO: 3397251 - DNA, 23 bp, Homo sapiens
tctgcccacgcagaggacgcacg

SEQ ID NO: 3397252 - DNA, 20 bp, Homo sapiens
tctgcccaggggtgccccct

SEQ ID NO: 3397253 - DNA, 13 bp, Homo sapiens
tctgccccaagca

SEQ ID NO: 3397254 - DNA, 20 bp, Homo sapiens
tctgccccaagcagccagcc

SEQ ID NO: 3397255 - DNA, 21 bp, Homo sapiens
tctgccccaagcagccagcca

SEQ ID NO: 3397256 - DNA, 11 bp, Homo sapiens
tctgccccagt

SEQ ID NO: 3397257 - DNA, 13 bp, Homo sapiens
tctgcccccagcc

SEQ ID NO: 3397258 - DNA, 19 bp, Homo sapiens
tctgcccccagcccaaagg

SEQ ID NO: 3397259 - DNA, 16 bp, Homo sapiens
tctgcccctcccccaa

SEQ ID NO: 3397260 - DNA, 22 bp, Homo sapiens
tctgcccctgatcactcccagc

SEQ ID NO: 3397261 - DNA, 23 bp, Homo sapiens
tctgcccctgatcactcccagca

SEQ ID NO: 3397262 - DNA, 15 bp, Homo sapiens
tctgccctctgggtc

SEQ ID NO: 3397263 - DNA, 18 bp, Homo sapiens
tctgccgccccctcctga

SEQ ID NO: 3397264 - DNA, 15 bp, Homo sapiens
tctgccgctacctcc

SEQ ID NO: 3397265 - DNA, 18 bp, Homo sapiens
tctgccgctacctccctc

SEQ ID NO: 3397266 - DNA, 18 bp, Homo sapiens
tctgcctagaatctttat

SEQ ID NO: 3397267 - DNA, 21 bp, Homo sapiens
tctgcctcaccgcttccctcc

SEQ ID NO: 3397268 - DNA, 20 bp, Homo sapiens
tctgcctccatgctgcagtg

SEQ ID NO: 3397269 - DNA, 18 bp, Homo sapiens
tctgcctctgacacacag

SEQ ID NO: 3397270 - DNA, 14 bp, Homo sapiens
tctgcctgcccagg

SEQ ID NO: 3397271 - DNA, 15 bp, Homo sapiens
tctgcctgcccaggc

SEQ ID NO: 3397272 - DNA, 12 bp, Homo sapiens
tcttcctgctgc

SEQ ID NO: 3397273 - DNA, 15 bp, Homo sapiens
tcttcctgctggaca

SEQ ID NO: 3397274 - DNA, 13 bp, Homo sapiens
tcttcctggcttt

SEQ ID NO: 3397275 - DNA, 14 bp, Homo sapiens
tcttccttccacag

SEQ ID NO: 3397276 - DNA, 22 bp, Homo sapiens
tcttccttgaagaactgcaggc

SEQ ID NO: 3397277 - DNA, 14 bp, Homo sapiens
tcttcgtcttcact

SEQ ID NO: 3397278 - DNA, 15 bp, Homo sapiens
tcttctaaaattgaa

SEQ ID NO: 3397279 - DNA, 16 bp, Homo sapiens
tcttctaacacaaaat

SEQ ID NO: 3397280 - DNA, 22 bp, Homo sapiens
tcttctagatgattttttgaaa

SEQ ID NO: 3397281 - DNA, 23 bp, Homo sapiens
tcttctagatgattttttgaaag

SEQ ID NO: 3397282 - DNA, 19 bp, Homo sapiens
tcttctagtgatgatggtt

SEQ ID NO: 3397283 - DNA, 13 bp, Homo sapiens
tcttctattttgt

SEQ ID NO: 3397284 - DNA, 16 bp, Homo sapiens
tcttctcaagtgcctt

SEQ ID NO: 3397285 - DNA, 16 bp, Homo sapiens
tcttctcagctcttcc

SEQ ID NO: 3397286 - DNA, 18 bp, Homo sapiens
tcttctcagctcttccat

SEQ ID NO: 3397287 - DNA, 20 bp, Homo sapiens
tcttctcatagcattaacta

SEQ ID NO: 3397288 - DNA, 17 bp, Homo sapiens
tcttctccagatttttc

SEQ ID NO: 3397289 - DNA, 12 bp, Homo sapiens
tcttctcccaga

SEQ ID NO: 3397290 - DNA, 13 bp, Homo sapiens
tcttctcccagaa

SEQ ID NO: 3397291 - DNA, 22 bp, Homo sapiens
tcttctcccagaatcccagccg

SEQ ID NO: 3397292 - DNA, 20 bp, Homo sapiens
tcttctccccacagcctctg

SEQ ID NO: 3397293 - DNA, 13 bp, Homo sapiens
tcttctcctttca

SEQ ID NO: 3397294 - DNA, 14 bp, Homo sapiens
tcttctcctttcac

SEQ ID NO: 3397295 - DNA, 14 bp, Homo sapiens
tcttctcggctcag

SEQ ID NO: 3397296 - DNA, 14 bp, Homo sapiens
tcttctctccagct

SEQ ID NO: 3397297 - DNA, 18 bp, Homo sapiens
tcttctctccagctgact

SEQ ID NO: 3397298 - DNA, 13 bp, Homo sapiens
tcttctctgttgt

SEQ ID NO: 3397299 - DNA, 14 bp, Homo sapiens
tcttctcttctctg

SEQ ID NO: 3397300 - DNA, 16 bp, Homo sapiens
tcttctcttctctgca

SEQ ID NO: 3397301 - DNA, 13 bp, Homo sapiens
tcttctctttagt

SEQ ID NO: 3397302 - DNA, 16 bp, Homo sapiens
tcttctgacaaactgt

SEQ ID NO: 3397303 - DNA, 14 bp, Homo sapiens
tcttctgacgtgcc

SEQ ID NO: 3397304 - DNA, 23 bp, Homo sapiens
tcttctgctccacccttggcctg

SEQ ID NO: 3397305 - DNA, 12 bp, Homo sapiens
tcttctgcttca

SEQ ID NO: 3397306 - DNA, 13 bp, Homo sapiens
tcttctggctcaa

SEQ ID NO: 3397307 - DNA, 22 bp, Homo sapiens
tcttctggggcaggctgggcca

SEQ ID NO: 3397308 - DNA, 22 bp, Homo sapiens
tcttctggtactttctgttatg

SEQ ID NO: 3397309 - DNA, 13 bp, Homo sapiens
tcttctggtctgt

SEQ ID NO: 3397310 - DNA, 19 bp, Homo sapiens
tcttctggtctgtgtgtgt

SEQ ID NO: 3397311 - DNA, 21 bp, Homo sapiens
tcttctggtctgtgtgtgttc

SEQ ID NO: 3397312 - DNA, 22 bp, Homo sapiens
tcttctggtctgtgtgtgttct

SEQ ID NO: 3397313 - DNA, 23 bp, Homo sapiens
tcttctgtacgtctgacaggcaa

SEQ ID NO: 3397314 - DNA, 14 bp, Homo sapiens
tcttctgtatttct

SEQ ID NO: 3397315 - DNA, 21 bp, Homo sapiens
tcttctgtgaaatataattgt

SEQ ID NO: 3397316 - DNA, 15 bp, Homo sapiens
tcttctgtgtttatg

SEQ ID NO: 3397317 - DNA, 16 bp, Homo sapiens
tcttcttacacttctt

SEQ ID NO: 3397318 - DNA, 17 bp, Homo sapiens
tcttcttacacttctta

SEQ ID NO: 3397319 - DNA, 13 bp, Homo sapiens
tcttcttcaaata

SEQ ID NO: 3397320 - DNA, 22 bp, Homo sapiens
tcttcttccctccctatctaac

SEQ ID NO: 3397321 - DNA, 14 bp, Homo sapiens
tcttcttctcttct

SEQ ID NO: 3397322 - DNA, 14 bp, Homo sapiens
tcttcttctgaaga

SEQ ID NO: 3397323 - DNA, 15 bp, Homo sapiens
tcttcttcttcagaa

SEQ ID NO: 3397324 - DNA, 13 bp, Homo sapiens
tcttcttgaaatt

SEQ ID NO: 3397325 - DNA, 19 bp, Homo sapiens
tcttcttttgtggtgtctt

SEQ ID NO: 3397326 - DNA, 20 bp, Homo sapiens
tcttcttttgtggtgtcttc

SEQ ID NO: 3397327 - DNA, 17 bp, Homo sapiens
tcttctttttgctgttg

SEQ ID NO: 3397328 - DNA, 18 bp, Homo sapiens
tcttctttttgctgttgt

SEQ ID NO: 3397329 - DNA, 17 bp, Homo sapiens
tcttctttttttgtgat

SEQ ID NO: 3397330 - DNA, 18 bp, Homo sapiens
tcttctttttttgtgatg

SEQ ID NO: 3397331 - DNA, 16 bp, Homo sapiens
tcttgaactcctggcc

SEQ ID NO: 3397332 - DNA, 19 bp, Homo sapiens
tcttgaaggaaaatgatac

SEQ ID NO: 3397333 - DNA, 15 bp, Homo sapiens
tcttgaagggcccag

SEQ ID NO: 3397334 - DNA, 16 bp, Homo sapiens
tcttgaagggcccagg

SEQ ID NO: 3397335 - DNA, 19 bp, Homo sapiens
tcttgaataaagtattcta

SEQ ID NO: 3397336 - DNA, 23 bp, Homo sapiens
tcttgaatatgggcggaagtact

SEQ ID NO: 3397337 - DNA, 14 bp, Homo sapiens
tcttgaatttctgc

SEQ ID NO: 3397338 - DNA, 21 bp, Homo sapiens
tcttgacaagctgacttggca

SEQ ID NO: 3397339 - DNA, 16 bp, Homo sapiens
tcttgagatgtcttct

SEQ ID NO: 3397340 - DNA, 18 bp, Homo sapiens
tcttgagtactagaattt

SEQ ID NO: 3397341 - DNA, 20 bp, Homo sapiens
tcttgagtttgtcgctcatg

SEQ ID NO: 3397342 - DNA, 22 bp, Homo sapiens
tcttgatacccccctctgtctt

SEQ ID NO: 3397343 - DNA, 15 bp, Homo sapiens
tcttgatgactgctg

SEQ ID NO: 3397344 - DNA, 17 bp, Homo sapiens
tcttgcaacttcagttt

SEQ ID NO: 3397345 - DNA, 16 bp, Homo sapiens
tcttgcaatggcagcc

SEQ ID NO: 3397346 - DNA, 18 bp, Homo sapiens
tcttgcacccgcctctcc

SEQ ID NO: 3397347 - DNA, 15 bp, Homo sapiens
tcttgcattcatttt

SEQ ID NO: 3397348 - DNA, 15 bp, Homo sapiens
tcttgccacatttct

SEQ ID NO: 3397349 - DNA, 18 bp, Homo sapiens
tcttgccacatttctgat

SEQ ID NO: 3397350 - DNA, 22 bp, Homo sapiens
tcttgccctgccgccgcctccc

SEQ ID NO: 3397351 - DNA, 18 bp, Homo sapiens
tcttgcccttccctgtcc

SEQ ID NO: 3397352 - DNA, 21 bp, Homo sapiens
tcttgcccttccctgtccctc

SEQ ID NO: 3397353 - DNA, 14 bp, Homo sapiens
tcttgcctctctca

SEQ ID NO: 3397354 - DNA, 20 bp, Homo sapiens
tcttgcgaatccaagctccc

SEQ ID NO: 3397355 - DNA, 21 bp, Homo sapiens
tcttgcgaatccaagctccct

SEQ ID NO: 3397356 - DNA, 15 bp, Homo sapiens
tcttgctaatcagtg

SEQ ID NO: 3397357 - DNA, 13 bp, Homo sapiens
tcttgctaccagt

SEQ ID NO: 3397358 - DNA, 14 bp, Homo sapiens
tcttgctaccagta

SEQ ID NO: 3397359 - DNA, 18 bp, Homo sapiens
tcttgctcaaaaatctgt

SEQ ID NO: 3397360 - DNA, 22 bp, Homo sapiens
tcttgctcccttcagcccccag

SEQ ID NO: 3397361 - DNA, 11 bp, Homo sapiens
tcttgctctgc

SEQ ID NO: 3397362 - DNA, 12 bp, Homo sapiens
tcttgctctgct

SEQ ID NO: 3397363 - DNA, 15 bp, Homo sapiens
tcttgctctgctgac

SEQ ID NO: 3397364 - DNA, 17 bp, Homo sapiens
tcttgctgatggctgct

SEQ ID NO: 3397365 - DNA, 13 bp, Homo sapiens
tcttgctgtctct

SEQ ID NO: 3397366 - DNA, 14 bp, Homo sapiens
tcttgctgtctctg

SEQ ID NO: 3397367 - DNA, 16 bp, Homo sapiens
tcttgctgtctctgct

SEQ ID NO: 3397368 - DNA, 19 bp, Homo sapiens
tcttgctgtctctgctcgc

SEQ ID NO: 3397369 - DNA, 12 bp, Homo sapiens
tcttgcttgtca

SEQ ID NO: 3397370 - DNA, 13 bp, Homo sapiens
tcttgcttgtcat

SEQ ID NO: 3397371 - DNA, 21 bp, Homo sapiens
tcttggaacattggaatgttc

SEQ ID NO: 3397372 - DNA, 18 bp, Homo sapiens
tcttggaagtacatgaat

SEQ ID NO: 3397373 - DNA, 17 bp, Homo sapiens
tcttggagaccctgcaa

SEQ ID NO: 3397374 - DNA, 13 bp, Homo sapiens
tcttggccagcca

SEQ ID NO: 3397375 - DNA, 14 bp, Homo sapiens
tcttggccagccaa

SEQ ID NO: 3397376 - DNA, 14 bp, Homo sapiens
tcttggcctttgca

SEQ ID NO: 3397377 - DNA, 16 bp, Homo sapiens
tcttggcctttgcatt

SEQ ID NO: 3397378 - DNA, 15 bp, Homo sapiens
tcttggcggcagcag

SEQ ID NO: 3397379 - DNA, 18 bp, Homo sapiens
tcttggcttaatcatttt

SEQ ID NO: 3397380 - DNA, 20 bp, Homo sapiens
tcttggcttaatcattttca

SEQ ID NO: 3397381 - DNA, 16 bp, Homo sapiens
tcttgggaactccact

SEQ ID NO: 3397382 - DNA, 14 bp, Homo sapiens
tcttgggaactgaa

SEQ ID NO: 3397383 - DNA, 14 bp, Homo sapiens
tcttgggccccaga

SEQ ID NO: 3397384 - DNA, 15 bp, Homo sapiens
tcttgggcctggccc

SEQ ID NO: 3397385 - DNA, 21 bp, Homo sapiens
tcttgggctactggcagctcc

SEQ ID NO: 3397386 - DNA, 22 bp, Homo sapiens
tcttgggctactggcagctcct

SEQ ID NO: 3397387 - DNA, 23 bp, Homo sapiens
tcttggggcaagactgcaaactt

SEQ ID NO: 3397388 - DNA, 20 bp, Homo sapiens
tcttgggggggtggccgctg

SEQ ID NO: 3397389 - DNA, 21 bp, Homo sapiens
tcttggggtactcttgatgtg

SEQ ID NO: 3397390 - DNA, 14 bp, Homo sapiens
tcttggtagagatt

SEQ ID NO: 3397391 - DNA, 14 bp, Homo sapiens
tcttggtccctggt

SEQ ID NO: 3397392 - DNA, 20 bp, Homo sapiens
tcttggtgtgattgcacaga

SEQ ID NO: 3397393 - DNA, 19 bp, Homo sapiens
tcttggttgaaaataaaaa

SEQ ID NO: 3397394 - DNA, 23 bp, Homo sapiens
tcttggttgaaaataaaaagatc

SEQ ID NO: 3397395 - DNA, 20 bp, Homo sapiens
tcttggttttccctttgcct

SEQ ID NO: 3397396 - DNA, 17 bp, Homo sapiens
tcttgtaaagactggtt

SEQ ID NO: 3397397 - DNA, 23 bp, Homo sapiens
tcttgtaaagactggttttctgc

SEQ ID NO: 3397398 - DNA, 14 bp, Homo sapiens
tcttgtaaatgttt

SEQ ID NO: 3397399 - DNA, 14 bp, Homo sapiens
tgaacacaggcagc

SEQ ID NO: 3397400 - DNA, 15 bp, Homo sapiens
tgaacacaggcagct

SEQ ID NO: 3397401 - DNA, 13 bp, Homo sapiens
tgaacacagtatt

SEQ ID NO: 3397402 - DNA, 18 bp, Homo sapiens
tgaacacttagtgatcat

SEQ ID NO: 3397403 - DNA, 20 bp, Homo sapiens
tgaacagagggagagactaa

SEQ ID NO: 3397404 - DNA, 21 bp, Homo sapiens
tgaacagagggagagactaac

SEQ ID NO: 3397405 - DNA, 13 bp, Homo sapiens
tgaacagcataag

SEQ ID NO: 3397406 - DNA, 18 bp, Homo sapiens
tgaacatacttcaaaaat

SEQ ID NO: 3397407 - DNA, 21 bp, Homo sapiens
tgaacatacttcaaaaataat

SEQ ID NO: 3397408 - DNA, 22 bp, Homo sapiens
tgaacatacttcaaaaataatg

SEQ ID NO: 3397409 - DNA, 17 bp, Homo sapiens
tgaacatattgttgaaa

SEQ ID NO: 3397410 - DNA, 20 bp, Homo sapiens
tgaacatccctttttcaatg

SEQ ID NO: 3397411 - DNA, 12 bp, Homo sapiens
tgaacatgttta

SEQ ID NO: 3397412 - DNA, 19 bp, Homo sapiens
tgaacattctcctgtggaa

SEQ ID NO: 3397413 - DNA, 20 bp, Homo sapiens
tgaacatttgctttgttttc

SEQ ID NO: 3397414 - DNA, 11 bp, Homo sapiens
tgaacatttta

SEQ ID NO: 3397415 - DNA, 15 bp, Homo sapiens
tgaaccaaagcctct

SEQ ID NO: 3397416 - DNA, 14 bp, Homo sapiens
tgaaccaaattgca

SEQ ID NO: 3397417 - DNA, 18 bp, Homo sapiens
tgaaccaagatctataaa

SEQ ID NO: 3397418 - DNA, 13 bp, Homo sapiens
tgaaccacaggtt

SEQ ID NO: 3397419 - DNA, 14 bp, Homo sapiens
tgaaccacaggttt

SEQ ID NO: 3397420 - DNA, 17 bp, Homo sapiens
tgaaccaccacacccag

SEQ ID NO: 3397421 - DNA, 15 bp, Homo sapiens
tgaaccagctcatct

SEQ ID NO: 3397422 - DNA, 20 bp, Homo sapiens
tgaacccaggacgcttctga

SEQ ID NO: 3397423 - DNA, 19 bp, Homo sapiens
tgaaccccatgggcttgga

SEQ ID NO: 3397424 - DNA, 21 bp, Homo sapiens
tgaaccccatgggcttggact

SEQ ID NO: 3397425 - DNA, 13 bp, Homo sapiens
tgaaccctgtgct

SEQ ID NO: 3397426 - DNA, 15 bp, Homo sapiens
tgaaccctgtgctgg

SEQ ID NO: 3397427 - DNA, 19 bp, Homo sapiens
tgaaccctgtgctggtgtc

SEQ ID NO: 3397428 - DNA, 15 bp, Homo sapiens
tgaacccttgcttgc

SEQ ID NO: 3397429 - DNA, 16 bp, Homo sapiens
tgaacccttgtgcttg

SEQ ID NO: 3397430 - DNA, 14 bp, Homo sapiens
tgaacctattttca

SEQ ID NO: 3397431 - DNA, 23 bp, Homo sapiens
tgaacctattttcatttgtacaa

SEQ ID NO: 3397432 - DNA, 16 bp, Homo sapiens
tgaacgtccacatgaa

SEQ ID NO: 3397433 - DNA, 16 bp, Homo sapiens
tgaactaataaaagca

SEQ ID NO: 3397434 - DNA, 17 bp, Homo sapiens
tgaactaggctgagcaa

SEQ ID NO: 3397435 - DNA, 17 bp, Homo sapiens
tgaactcaaactgagga

SEQ ID NO: 3397436 - DNA, 11 bp, Homo sapiens
tgaactcctgg

SEQ ID NO: 3397437 - DNA, 14 bp, Homo sapiens
tgaactcctggcct

SEQ ID NO: 3397438 - DNA, 17 bp, Homo sapiens
tgaactcctggcctcaa

SEQ ID NO: 3397439 - DNA, 18 bp, Homo sapiens
tgaactctgaactttgga

SEQ ID NO: 3397440 - DNA, 14 bp, Homo sapiens
tgaactcttaatca

SEQ ID NO: 3397441 - DNA, 15 bp, Homo sapiens
tgaactcttaatcaa

SEQ ID NO: 3397442 - DNA, 15 bp, Homo sapiens
tgaactgaagtttca

SEQ ID NO: 3397443 - DNA, 17 bp, Homo sapiens
tgaactgaagtttcaca

SEQ ID NO: 3397444 - DNA, 23 bp, Homo sapiens
tgaactgaggagatgaccaggga

SEQ ID NO: 3397445 - DNA, 14 bp, Homo sapiens
tgaactgctttcaa

SEQ ID NO: 3397446 - DNA, 12 bp, Homo sapiens
tgaactggaaga

SEQ ID NO: 3397447 - DNA, 21 bp, Homo sapiens
tgaactggcaattgtctattt

SEQ ID NO: 3397448 - DNA, 16 bp, Homo sapiens
tgaactgttagatgct

SEQ ID NO: 3397449 - DNA, 17 bp, Homo sapiens
tgaactgttagatgctg

SEQ ID NO: 3397450 - DNA, 16 bp, Homo sapiens
tgaactgttgtctggg

SEQ ID NO: 3397451 - DNA, 16 bp, Homo sapiens
tgaacttattctgtag

SEQ ID NO: 3397452 - DNA, 21 bp, Homo sapiens
tgaacttgtagctgtaaaacg

SEQ ID NO: 3397453 - DNA, 13 bp, Homo sapiens
tgaactttctccc

SEQ ID NO: 3397454 - DNA, 15 bp, Homo sapiens
tgaactttgtaggac

SEQ ID NO: 3397455 - DNA, 21 bp, Homo sapiens
tgaagaaaaaaatgtacattt

SEQ ID NO: 3397456 - DNA, 21 bp, Homo sapiens
tgaagaaaatcacttaggaaa

SEQ ID NO: 3397457 - DNA, 18 bp, Homo sapiens
tgaagaaacagataccat

SEQ ID NO: 3397458 - DNA, 14 bp, Homo sapiens
tgaagaacacagca

SEQ ID NO: 3397459 - DNA, 16 bp, Homo sapiens
tgaagaactgcaggcc

SEQ ID NO: 3397460 - DNA, 18 bp, Homo sapiens
tgaagaactgttgcctaa

SEQ ID NO: 3397461 - DNA, 12 bp, Homo sapiens
tgaagaaggaag

SEQ ID NO: 3397462 - DNA, 22 bp, Homo sapiens
tgaagaaggaagctgtgttgaa

SEQ ID NO: 3397463 - DNA, 16 bp, Homo sapiens
tgaagaatatttaaga

SEQ ID NO: 3397464 - DNA, 17 bp, Homo sapiens
tgaagaatatttaagaa

SEQ ID NO: 3397465 - DNA, 22 bp, Homo sapiens
tgaagaatgcacaagaatggat

SEQ ID NO: 3397466 - DNA, 14 bp, Homo sapiens
tgaagaattaagat

SEQ ID NO: 3397467 - DNA, 17 bp, Homo sapiens
tgaagaatttagatctt

SEQ ID NO: 3397468 - DNA, 22 bp, Homo sapiens
tgaagaatttagatcttatatt

SEQ ID NO: 3397469 - DNA, 14 bp, Homo sapiens
tgaagacaggacag

SEQ ID NO: 3397470 - DNA, 19 bp, Homo sapiens
tgaagacattttttgctat

SEQ ID NO: 3397471 - DNA, 13 bp, Homo sapiens
tgaagactgagaa

SEQ ID NO: 3397472 - DNA, 14 bp, Homo sapiens
tgaagactgaggac

SEQ ID NO: 3397473 - DNA, 17 bp, Homo sapiens
tgaagactggaagctaa

SEQ ID NO: 3397474 - DNA, 23 bp, Homo sapiens
tgaagagaaccgagcaaagatca

SEQ ID NO: 3397475 - DNA, 12 bp, Homo sapiens
tgaagagacaga

SEQ ID NO: 3397476 - DNA, 21 bp, Homo sapiens
tgaagagacagagacaagtaa

SEQ ID NO: 3397477 - DNA, 23 bp, Homo sapiens
tgaagagacagagacaagtaatt

SEQ ID NO: 3397478 - DNA, 22 bp, Homo sapiens
tgaagagacttctgcttttcaa

SEQ ID NO: 3397479 - DNA, 22 bp, Homo sapiens
tgaagagagggacaggcactcc

SEQ ID NO: 3397480 - DNA, 16 bp, Homo sapiens
tgaagagcaaaaatat

SEQ ID NO: 3397481 - DNA, 13 bp, Homo sapiens
tgaagaggaacag

SEQ ID NO: 3397482 - DNA, 18 bp, Homo sapiens
tgaagaggaacagtgtgg

SEQ ID NO: 3397483 - DNA, 16 bp, Homo sapiens
tgaagaggcgggccag

SEQ ID NO: 3397484 - DNA, 18 bp, Homo sapiens
tgaagaggcgggccagcc

SEQ ID NO: 3397485 - DNA, 21 bp, Homo sapiens
tgaagaggcgggccagccagg

SEQ ID NO: 3397486 - DNA, 19 bp, Homo sapiens
tgaagaggggcagcccttg

SEQ ID NO: 3397487 - DNA, 20 bp, Homo sapiens
tgaagagtatccttccttca

SEQ ID NO: 3397488 - DNA, 22 bp, Homo sapiens
tgaagagtgactagtacaaatt

SEQ ID NO: 3397489 - DNA, 13 bp, Homo sapiens
tgaagagttccaa

SEQ ID NO: 3397490 - DNA, 21 bp, Homo sapiens
tgaagataagtgtatttttca

SEQ ID NO: 3397491 - DNA, 23 bp, Homo sapiens
tgaagataagtgtatttttcaat

SEQ ID NO: 3397492 - DNA, 20 bp, Homo sapiens
tgaagatgaagaagcctttg

SEQ ID NO: 3397493 - DNA, 13 bp, Homo sapiens
tgaagatgatcat

SEQ ID NO: 3397494 - DNA, 18 bp, Homo sapiens
tgaagatggtttcaattc

SEQ ID NO: 3397495 - DNA, 23 bp, Homo sapiens
tgaagatggtttcaattcagatt

SEQ ID NO: 3397496 - DNA, 16 bp, Homo sapiens
tgaagatgtctaatag

SEQ ID NO: 3397497 - DNA, 15 bp, Homo sapiens
tgaagattctcctgt

SEQ ID NO: 3397498 - DNA, 18 bp, Homo sapiens
tgaagattctcctgtgct

SEQ ID NO: 3397499 - DNA, 19 bp, Homo sapiens
tgaagattctcctgtgcta

SEQ ID NO: 3397500 - DNA, 22 bp, Homo sapiens
tgaagcaaactctaaaattata

SEQ ID NO: 3397501 - DNA, 13 bp, Homo sapiens
tgaagcaaggaag

SEQ ID NO: 3397502 - DNA, 20 bp, Homo sapiens
tgaagcaaggaagatataca

SEQ ID NO: 3397503 - DNA, 21 bp, Homo sapiens
tgaagcacagagggctaggga

SEQ ID NO: 3397504 - DNA, 15 bp, Homo sapiens
tgaagcagcctctcc

SEQ ID NO: 3397505 - DNA, 21 bp, Homo sapiens
tgaagcagggtttcttttctt

SEQ ID NO: 3397506 - DNA, 13 bp, Homo sapiens
tgaagcagtcttg

SEQ ID NO: 3397507 - DNA, 15 bp, Homo sapiens
tgaagcagtgcctcg

SEQ ID NO: 3397508 - DNA, 23 bp, Homo sapiens
tgaagcagtgcctcgaggcaccg

SEQ ID NO: 3397509 - DNA, 19 bp, Homo sapiens
tgaagcatgctttgctgct

SEQ ID NO: 3397510 - DNA, 20 bp, Homo sapiens
tgaagcatgtttcatgtttt

SEQ ID NO: 3397511 - DNA, 11 bp, Homo sapiens
tgaagccaaag

SEQ ID NO: 3397512 - DNA, 12 bp, Homo sapiens
tgaagccaaaga

SEQ ID NO: 3397513 - DNA, 16 bp, Homo sapiens
tgaagccaaatgaaac

SEQ ID NO: 3397514 - DNA, 21 bp, Homo sapiens
tgaagccaagtggggtgctgg

SEQ ID NO: 3397515 - DNA, 16 bp, Homo sapiens
tgaagccactgaagct

SEQ ID NO: 3397516 - DNA, 14 bp, Homo sapiens
tgaagccagccttc

SEQ ID NO: 3397517 - DNA, 21 bp, Homo sapiens
tgaagccagccttcttccatc

SEQ ID NO: 3397518 - DNA, 11 bp, Homo sapiens
tgaagccagct

SEQ ID NO: 3397519 - DNA, 16 bp, Homo sapiens
tgaagccctccaaaag

SEQ ID NO: 3397520 - DNA, 15 bp, Homo sapiens
tgaagccctcccagg

SEQ ID NO: 3397521 - DNA, 22 bp, Homo sapiens
tgaagcctgcgttggtccagag

SEQ ID NO: 3397522 - DNA, 15 bp, Homo sapiens
tgaagcgtttttctc

SEQ ID NO: 3397523 - DNA, 19 bp, Homo sapiens
tgaagcgtttttctttttc

SEQ ID NO: 3397524 - DNA, 15 bp, Homo sapiens
tgaagctaagattta

SEQ ID NO: 3397525 - DNA, 16 bp, Homo sapiens
tgactgtttggcttat

SEQ ID NO: 3397526 - DNA, 18 bp, Homo sapiens
tgactgtttggcttataa

SEQ ID NO: 3397527 - DNA, 13 bp, Homo sapiens
tgacttaatgtga

SEQ ID NO: 3397528 - DNA, 20 bp, Homo sapiens
tgacttatttctgctctgga

SEQ ID NO: 3397529 - DNA, 18 bp, Homo sapiens
tgacttattttctctgtg

SEQ ID NO: 3397530 - DNA, 19 bp, Homo sapiens
tgacttattttctctgtgt

SEQ ID NO: 3397531 - DNA, 19 bp, Homo sapiens
tgacttcagctgcctgaaa

SEQ ID NO: 3397532 - DNA, 13 bp, Homo sapiens
tgacttcatctgg

SEQ ID NO: 3397533 - DNA, 19 bp, Homo sapiens
tgacttcatggaatggaca

SEQ ID NO: 3397534 - DNA, 21 bp, Homo sapiens
tgacttcatggaatggacatc

SEQ ID NO: 3397535 - DNA, 16 bp, Homo sapiens
tgacttcattttatat

SEQ ID NO: 3397536 - DNA, 17 bp, Homo sapiens
tgacttctaatatcatt

SEQ ID NO: 3397537 - DNA, 15 bp, Homo sapiens
tgacttctccaggtc

SEQ ID NO: 3397538 - DNA, 13 bp, Homo sapiens
tgacttctgcctg

SEQ ID NO: 3397539 - DNA, 20 bp, Homo sapiens
tgacttctgtggtccctctg

SEQ ID NO: 3397540 - DNA, 12 bp, Homo sapiens
tgacttgagtgt

SEQ ID NO: 3397541 - DNA, 19 bp, Homo sapiens
tgacttgcatgaagagaag

SEQ ID NO: 3397542 - DNA, 12 bp, Homo sapiens
tgacttggggga

SEQ ID NO: 3397543 - DNA, 12 bp, Homo sapiens
tgacttgtatat

SEQ ID NO: 3397544 - DNA, 22 bp, Homo sapiens
tgacttgtttgtgcatcctgtg

SEQ ID NO: 3397545 - DNA, 18 bp, Homo sapiens
tgactttgacaattactc

SEQ ID NO: 3397546 - DNA, 20 bp, Homo sapiens
tgacttttaaggctaaaact

SEQ ID NO: 3397547 - DNA, 19 bp, Homo sapiens
tgacttttctgattaatat

SEQ ID NO: 3397548 - DNA, 20 bp, Homo sapiens
tgacttttctgattaatata

SEQ ID NO: 3397549 - DNA, 19 bp, Homo sapiens
tgactttttataaaatggc

SEQ ID NO: 3397550 - DNA, 14 bp, Homo sapiens
tgactttttgcatt

SEQ ID NO: 3397551 - DNA, 23 bp, Homo sapiens
tgactttttgcatttaaaacaga

SEQ ID NO: 3397552 - DNA, 17 bp, Homo sapiens
tgactttttttggtata

SEQ ID NO: 3397553 - DNA, 21 bp, Homo sapiens
tgagaaaacgttttgtttgaa

SEQ ID NO: 3397554 - DNA, 16 bp, Homo sapiens
tgagaaaacttctttt

SEQ ID NO: 3397555 - DNA, 17 bp, Homo sapiens
tgagaaaacttctttta

SEQ ID NO: 3397556 - DNA, 23 bp, Homo sapiens
tgagaaacagctcagccagtggg

SEQ ID NO: 3397557 - DNA, 15 bp, Homo sapiens
tgagaaatgaataat

SEQ ID NO: 3397558 - DNA, 15 bp, Homo sapiens
tgagaacaaagctgt

SEQ ID NO: 3397559 - DNA, 22 bp, Homo sapiens
tgagaacaaagctgttaaactg

SEQ ID NO: 3397560 - DNA, 19 bp, Homo sapiens
tgagaacaagtcacagctg

SEQ ID NO: 3397561 - DNA, 17 bp, Homo sapiens
tgagaactgactttctc

SEQ ID NO: 3397562 - DNA, 15 bp, Homo sapiens
tgagaagaggagccc

SEQ ID NO: 3397563 - DNA, 16 bp, Homo sapiens
tgagaagagggcctgt

SEQ ID NO: 3397564 - DNA, 16 bp, Homo sapiens
tgagaagattgtgaat

SEQ ID NO: 3397565 - DNA, 19 bp, Homo sapiens
tgagaagccttcagctcca

SEQ ID NO: 3397566 - DNA, 12 bp, Homo sapiens
tgagaagctctg

SEQ ID NO: 3397567 - DNA, 15 bp, Homo sapiens
tgagaagctgctcca

SEQ ID NO: 3397568 - DNA, 12 bp, Homo sapiens
tgagaaggagag

SEQ ID NO: 3397569 - DNA, 15 bp, Homo sapiens
tgagaaggagagaaa

SEQ ID NO: 3397570 - DNA, 17 bp, Homo sapiens
tgagaaggcgaggagag

SEQ ID NO: 3397571 - DNA, 21 bp, Homo sapiens
tgagaagtgaatgctgggact

SEQ ID NO: 3397572 - DNA, 16 bp, Homo sapiens
tgagaagtgccttctc

SEQ ID NO: 3397573 - DNA, 17 bp, Homo sapiens
tgagaagtgccttctcc

SEQ ID NO: 3397574 - DNA, 14 bp, Homo sapiens
tgagaatcatttag

SEQ ID NO: 3397575 - DNA, 22 bp, Homo sapiens
tgagaatcccaaatttgattga

SEQ ID NO: 3397576 - DNA, 12 bp, Homo sapiens
tgagaatctacc

SEQ ID NO: 3397577 - DNA, 18 bp, Homo sapiens
tgagaatctatatttaac

SEQ ID NO: 3397578 - DNA, 14 bp, Homo sapiens
tgagaatttctaaa

SEQ ID NO: 3397579 - DNA, 22 bp, Homo sapiens
tgagaatttctaaaaagattag

SEQ ID NO: 3397580 - DNA, 14 bp, Homo sapiens
tgagaatttgcaac

SEQ ID NO: 3397581 - DNA, 15 bp, Homo sapiens
tgagaattttaaatt

SEQ ID NO: 3397582 - DNA, 20 bp, Homo sapiens
tgagaattttatattctaag

SEQ ID NO: 3397583 - DNA, 13 bp, Homo sapiens
tgagacaagccct

SEQ ID NO: 3397584 - DNA, 15 bp, Homo sapiens
tgagacaagccctgg

SEQ ID NO: 3397585 - DNA, 18 bp, Homo sapiens
tgagacaagccctggcaa

SEQ ID NO: 3397586 - DNA, 20 bp, Homo sapiens
tgagacaagccctggcaaca

SEQ ID NO: 3397587 - DNA, 21 bp, Homo sapiens
tgagacacggagcccagccct

SEQ ID NO: 3397588 - DNA, 13 bp, Homo sapiens
tgagacagaatct

SEQ ID NO: 3397589 - DNA, 18 bp, Homo sapiens
tgagacagccacttggtt

SEQ ID NO: 3397590 - DNA, 17 bp, Homo sapiens
tgagacagtctggaaag

SEQ ID NO: 3397591 - DNA, 16 bp, Homo sapiens
tgagacagtgaatttg

SEQ ID NO: 3397592 - DNA, 23 bp, Homo sapiens
tgagacagtttcttagcttttta

SEQ ID NO: 3397593 - DNA, 21 bp, Homo sapiens
tgagaccacagagagagggga

SEQ ID NO: 3397594 - DNA, 13 bp, Homo sapiens
tgagaccagtgta

SEQ ID NO: 3397595 - DNA, 22 bp, Homo sapiens
tgagaccagtgtatcaggtcag

SEQ ID NO: 3397596 - DNA, 15 bp, Homo sapiens
tgagacccccacacc

SEQ ID NO: 3397597 - DNA, 19 bp, Homo sapiens
tgagaccctgggagagaag

SEQ ID NO: 3397598 - DNA, 15 bp, Homo sapiens
tgagaccttgtctct

SEQ ID NO: 3397599 - DNA, 18 bp, Homo sapiens
tgagactcacaggaagga

SEQ ID NO: 3397600 - DNA, 21 bp, Homo sapiens
tgagactccagaatctgctgt

SEQ ID NO: 3397601 - DNA, 22 bp, Homo sapiens
tgagactctagggtccagtgga

SEQ ID NO: 3397602 - DNA, 20 bp, Homo sapiens
tgagactctgtctcaaaaaa

SEQ ID NO: 3397603 - DNA, 14 bp, Homo sapiens
tgagactggagctg

SEQ ID NO: 3397604 - DNA, 13 bp, Homo sapiens
tgagactggcaga

SEQ ID NO: 3397605 - DNA, 19 bp, Homo sapiens
tgagactgtcggagaggct

SEQ ID NO: 3397606 - DNA, 12 bp, Homo sapiens
tgagacttccaa

SEQ ID NO: 3397607 - DNA, 15 bp, Homo sapiens
tgagactttttggtg

SEQ ID NO: 3397608 - DNA, 17 bp, Homo sapiens
tgagagaaaaagtgccc

SEQ ID NO: 3397609 - DNA, 23 bp, Homo sapiens
tgagagaaagagagaagccagcc

SEQ ID NO: 3397610 - DNA, 16 bp, Homo sapiens
tgagagaagccacgct

SEQ ID NO: 3397611 - DNA, 14 bp, Homo sapiens
tgagagagacaaga

SEQ ID NO: 3397612 - DNA, 16 bp, Homo sapiens
tgagagcccccacctt

SEQ ID NO: 3397613 - DNA, 20 bp, Homo sapiens
tgagagccctgctgtgggag

SEQ ID NO: 3397614 - DNA, 20 bp, Homo sapiens
tgagaggcaatgattgttaa

SEQ ID NO: 3397615 - DNA, 12 bp, Homo sapiens
tgagaggcaggc

SEQ ID NO: 3397616 - DNA, 17 bp, Homo sapiens
tgagaggcctggagccc

SEQ ID NO: 3397617 - DNA, 21 bp, Homo sapiens
tgagaggcctggagcccacaa

SEQ ID NO: 3397618 - DNA, 17 bp, Homo sapiens
tgagagggcatgcgcac

SEQ ID NO: 3397619 - DNA, 18 bp, Homo sapiens
tgagaggggaacagactg

SEQ ID NO: 3397620 - DNA, 19 bp, Homo sapiens
tgagaggggaacagactgg

SEQ ID NO: 3397621 - DNA, 18 bp, Homo sapiens
tgagaggtggcttttgcg

SEQ ID NO: 3397622 - DNA, 23 bp, Homo sapiens
tgagagtatttaggcagattgaa

SEQ ID NO: 3397623 - DNA, 21 bp, Homo sapiens
tgagagtctagcactcatttt

SEQ ID NO: 3397624 - DNA, 16 bp, Homo sapiens
tgagagtgtctctgat

SEQ ID NO: 3397625 - DNA, 20 bp, Homo sapiens
tgagatatttattgtttatt

SEQ ID NO: 3397626 - DNA, 14 bp, Homo sapiens
tgagatcacagcct

SEQ ID NO: 3397627 - DNA, 19 bp, Homo sapiens
tgagatcacagcctccagg

SEQ ID NO: 3397628 - DNA, 21 bp, Homo sapiens
tgagatcacagcctccagggc

SEQ ID NO: 3397629 - DNA, 17 bp, Homo sapiens
tgagatccgtgaattct

SEQ ID NO: 3397630 - DNA, 21 bp, Homo sapiens
tgagatccgtgaattctcgga

SEQ ID NO: 3397631 - DNA, 22 bp, Homo sapiens
tgagatccttcacaggcagtgc

SEQ ID NO: 3397632 - DNA, 16 bp, Homo sapiens
tgagatctaagccttt

SEQ ID NO: 3397633 - DNA, 20 bp, Homo sapiens
tgagatctaagcctttccat

SEQ ID NO: 3397634 - DNA, 21 bp, Homo sapiens
tgagatctaagcctttccata

SEQ ID NO: 3397635 - DNA, 20 bp, Homo sapiens
tgagatgctagaactccctt

SEQ ID NO: 3397636 - DNA, 18 bp, Homo sapiens
tgagatgctggagaagag

SEQ ID NO: 3397637 - DNA, 20 bp, Homo sapiens
tgagatgctggagaagagag

SEQ ID NO: 3397638 - DNA, 21 bp, Homo sapiens
tgagatgctggtaatggccat

SEQ ID NO: 3397639 - DNA, 17 bp, Homo sapiens
tgagatgctggttttct

SEQ ID NO: 3397640 - DNA, 12 bp, Homo sapiens
tgagatgctgta

SEQ ID NO: 3397641 - DNA, 16 bp, Homo sapiens
tgagatggtgaggctg

SEQ ID NO: 3397642 - DNA, 15 bp, Homo sapiens
tgagatggttaaaaa

SEQ ID NO: 3397643 - DNA, 16 bp, Homo sapiens
tgagatgtgttcctcc

SEQ ID NO: 3397644 - DNA, 17 bp, Homo sapiens
tgagattagagggaggt

SEQ ID NO: 3397645 - DNA, 18 bp, Homo sapiens
tgagattgccccaggtct

SEQ ID NO: 3397646 - DNA, 17 bp, Homo sapiens
tgagatttcctcctggc

SEQ ID NO: 3397647 - DNA, 18 bp, Homo sapiens
tgagatttgccagcacag

SEQ ID NO: 3397648 - DNA, 22 bp, Homo sapiens
tgagatttttaaaaaatatttt

SEQ ID NO: 3397649 - DNA, 16 bp, Homo sapiens
tgagcaactcttgatt

SEQ ID NO: 3397650 - DNA, 21 bp, Homo sapiens
tgagcaaggagcacaagccac

SEQ ID NO: 3397651 - DNA, 16 bp, Homo sapiens
tgatccacccacctca

SEQ ID NO: 3397652 - DNA, 20 bp, Homo sapiens
tgatccacccacctcagcct

SEQ ID NO: 3397653 - DNA, 15 bp, Homo sapiens
tgatccagagcagag

SEQ ID NO: 3397654 - DNA, 14 bp, Homo sapiens
tgatccatccatct

SEQ ID NO: 3397655 - DNA, 13 bp, Homo sapiens
tgatcccagcact

SEQ ID NO: 3397656 - DNA, 20 bp, Homo sapiens
tgatccctgtgttgtctcta

SEQ ID NO: 3397657 - DNA, 21 bp, Homo sapiens
tgatccctgttacccagagaa

SEQ ID NO: 3397658 - DNA, 18 bp, Homo sapiens
tgatcctcatatggccca

SEQ ID NO: 3397659 - DNA, 16 bp, Homo sapiens
tgatcctcccacctca

SEQ ID NO: 3397660 - DNA, 18 bp, Homo sapiens
tgatcctctactgtgcat

SEQ ID NO: 3397661 - DNA, 14 bp, Homo sapiens
tgatcctctcacct

SEQ ID NO: 3397662 - DNA, 17 bp, Homo sapiens
tgatccttttttgtcat

SEQ ID NO: 3397663 - DNA, 23 bp, Homo sapiens
tgatccttttttgtcattttatg

SEQ ID NO: 3397664 - DNA, 17 bp, Homo sapiens
tgatcgaaaaaataatt

SEQ ID NO: 3397665 - DNA, 18 bp, Homo sapiens
tgatcggagcctcctctc

SEQ ID NO: 3397666 - DNA, 20 bp, Homo sapiens
tgatcgtagaaaatttgctt

SEQ ID NO: 3397667 - DNA, 15 bp, Homo sapiens
tgatcgtgctaaatt

SEQ ID NO: 3397668 - DNA, 20 bp, Homo sapiens
tgatctacttctgtaattgt

SEQ ID NO: 3397669 - DNA, 14 bp, Homo sapiens
tgatctattgctca

SEQ ID NO: 3397670 - DNA, 12 bp, Homo sapiens
tgatctcccctc

SEQ ID NO: 3397671 - DNA, 15 bp, Homo sapiens
tgatctcggatgacc

SEQ ID NO: 3397672 - DNA, 21 bp, Homo sapiens
tgatctctactaccacaagga

SEQ ID NO: 3397673 - DNA, 14 bp, Homo sapiens
tgatctcttcctgt

SEQ ID NO: 3397674 - DNA, 23 bp, Homo sapiens
tgatctcttcttttggcttccat

SEQ ID NO: 3397675 - DNA, 16 bp, Homo sapiens
tgatctgccgcctcag

SEQ ID NO: 3397676 - DNA, 18 bp, Homo sapiens
tgatctggacagaacatt

SEQ ID NO: 3397677 - DNA, 20 bp, Homo sapiens
tgatctgtgatagttcaccc

SEQ ID NO: 3397678 - DNA, 11 bp, Homo sapiens
tgatcttaaag

SEQ ID NO: 3397679 - DNA, 16 bp, Homo sapiens
tgatcttacagaaaat

SEQ ID NO: 3397680 - DNA, 15 bp, Homo sapiens
tgatcttcttcatcc

SEQ ID NO: 3397681 - DNA, 15 bp, Homo sapiens
tgatcttgcattcat

SEQ ID NO: 3397682 - DNA, 18 bp, Homo sapiens
tgatcttgcattcatttt

SEQ ID NO: 3397683 - DNA, 19 bp, Homo sapiens
tgatcttgcattcattttc

SEQ ID NO: 3397684 - DNA, 15 bp, Homo sapiens
tgatcttgtgctcag

SEQ ID NO: 3397685 - DNA, 21 bp, Homo sapiens
tgatctttgcagacaggcaag

SEQ ID NO: 3397686 - DNA, 23 bp, Homo sapiens
tgatctttgcagacaggcaagca

SEQ ID NO: 3397687 - DNA, 18 bp, Homo sapiens
tgatctttttatcatgat

SEQ ID NO: 3397688 - DNA, 15 bp, Homo sapiens
tgatgaaaagattta

SEQ ID NO: 3397689 - DNA, 22 bp, Homo sapiens
tgatgaaactcctgattttgta

SEQ ID NO: 3397690 - DNA, 11 bp, Homo sapiens
tgatgaaagct

SEQ ID NO: 3397691 - DNA, 15 bp, Homo sapiens
tgatgaaagctgatt

SEQ ID NO: 3397692 - DNA, 19 bp, Homo sapiens
tgatgaaagctgattactg

SEQ ID NO: 3397693 - DNA, 13 bp, Homo sapiens
tgatgaactttct

SEQ ID NO: 3397694 - DNA, 15 bp, Homo sapiens
tgatgaagtatactt

SEQ ID NO: 3397695 - DNA, 15 bp, Homo sapiens
tgatgacattccctg

SEQ ID NO: 3397696 - DNA, 16 bp, Homo sapiens
tgatgactgctgattt

SEQ ID NO: 3397697 - DNA, 21 bp, Homo sapiens
tgatgagatattaaattctca

SEQ ID NO: 3397698 - DNA, 16 bp, Homo sapiens
tgatgagattcactta

SEQ ID NO: 3397699 - DNA, 15 bp, Homo sapiens
tgatgaggggagggg

SEQ ID NO: 3397700 - DNA, 13 bp, Homo sapiens
tgatgaggtattt

SEQ ID NO: 3397701 - DNA, 16 bp, Homo sapiens
tgatgaggtatttttt

SEQ ID NO: 3397702 - DNA, 17 bp, Homo sapiens
tgatgagttaactgtga

SEQ ID NO: 3397703 - DNA, 18 bp, Homo sapiens
tgatgagtttttatggtt

SEQ ID NO: 3397704 - DNA, 19 bp, Homo sapiens
tgatgataacacttaaaat

SEQ ID NO: 3397705 - DNA, 17 bp, Homo sapiens
tgatgatacaatgaaca

SEQ ID NO: 3397706 - DNA, 23 bp, Homo sapiens
tgatgatctttgcagacaggcaa

SEQ ID NO: 3397707 - DNA, 15 bp, Homo sapiens
tgatgatgctgtgac

SEQ ID NO: 3397708 - DNA, 17 bp, Homo sapiens
tgatgatgctgtgacaa

SEQ ID NO: 3397709 - DNA, 13 bp, Homo sapiens
tgatgcaaggatt

SEQ ID NO: 3397710 - DNA, 21 bp, Homo sapiens
tgatgcaaggattacagaaac

SEQ ID NO: 3397711 - DNA, 21 bp, Homo sapiens
tgatgcaggcacttattgtaa

SEQ ID NO: 3397712 - DNA, 21 bp, Homo sapiens
tgatgcatgtggtttggttcc

SEQ ID NO: 3397713 - DNA, 15 bp, Homo sapiens
tgatgccaacctctg

SEQ ID NO: 3397714 - DNA, 14 bp, Homo sapiens
tgatgccaggacac

SEQ ID NO: 3397715 - DNA, 18 bp, Homo sapiens
tgatgccctgctccaggg

SEQ ID NO: 3397716 - DNA, 23 bp, Homo sapiens
tgatgcgccttgctgatggcttg

SEQ ID NO: 3397717 - DNA, 15 bp, Homo sapiens
tgatgctatttatgc

SEQ ID NO: 3397718 - DNA, 16 bp, Homo sapiens
tgatgctatttatgca

SEQ ID NO: 3397719 - DNA, 14 bp, Homo sapiens
tgatgctcaggctt

SEQ ID NO: 3397720 - DNA, 15 bp, Homo sapiens
tgatgctcaggcttg

SEQ ID NO: 3397721 - DNA, 14 bp, Homo sapiens
tgatgctccctccc

SEQ ID NO: 3397722 - DNA, 15 bp, Homo sapiens
tgatgctccctcccc

SEQ ID NO: 3397723 - DNA, 16 bp, Homo sapiens
tgatgctggagaggtt

SEQ ID NO: 3397724 - DNA, 13 bp, Homo sapiens
tgatgctgggacc

SEQ ID NO: 3397725 - DNA, 22 bp, Homo sapiens
tgatgcttgtaacaagaaaaca

SEQ ID NO: 3397726 - DNA, 14 bp, Homo sapiens
tgatggaaccttaa

SEQ ID NO: 3397727 - DNA, 23 bp, Homo sapiens
tgatggaccgggtgggcctggcc

SEQ ID NO: 3397728 - DNA, 23 bp, Homo sapiens
tgatggaccttctagaattataa

SEQ ID NO: 3397729 - DNA, 14 bp, Homo sapiens
tgatggaggaaaaa

SEQ ID NO: 3397730 - DNA, 14 bp, Homo sapiens
tgatggatggcaga

SEQ ID NO: 3397731 - DNA, 18 bp, Homo sapiens
tgatggatggcagactct

SEQ ID NO: 3397732 - DNA, 13 bp, Homo sapiens
tgatggatgtctt

SEQ ID NO: 3397733 - DNA, 12 bp, Homo sapiens
tgatggcagagg

SEQ ID NO: 3397734 - DNA, 13 bp, Homo sapiens
tgatggcagagga

SEQ ID NO: 3397735 - DNA, 20 bp, Homo sapiens
tgatggcgcgggaggcacca

SEQ ID NO: 3397736 - DNA, 18 bp, Homo sapiens
tgatggcttgacatgtgc

SEQ ID NO: 3397737 - DNA, 13 bp, Homo sapiens
tgatgggaaaact

SEQ ID NO: 3397738 - DNA, 15 bp, Homo sapiens
tgatgggaaaatatt

SEQ ID NO: 3397739 - DNA, 17 bp, Homo sapiens
tgatgggaaaatatttc

SEQ ID NO: 3397740 - DNA, 19 bp, Homo sapiens
tgatgggaaaatatttcct

SEQ ID NO: 3397741 - DNA, 16 bp, Homo sapiens
tgatgggcacttgaga

SEQ ID NO: 3397742 - DNA, 15 bp, Homo sapiens
tgatgggggagaggg

SEQ ID NO: 3397743 - DNA, 22 bp, Homo sapiens
tgatggtaggtagcacagtgga

SEQ ID NO: 3397744 - DNA, 14 bp, Homo sapiens
tgatggtatttctt

SEQ ID NO: 3397745 - DNA, 18 bp, Homo sapiens
tgatggtcaatcagtgtt

SEQ ID NO: 3397746 - DNA, 14 bp, Homo sapiens
tgatggtcagaggg

SEQ ID NO: 3397747 - DNA, 15 bp, Homo sapiens
tgatggtcagagggc

SEQ ID NO: 3397748 - DNA, 15 bp, Homo sapiens
tgatggtcagctccc

SEQ ID NO: 3397749 - DNA, 16 bp, Homo sapiens
tgatggtgagctggga

SEQ ID NO: 3397750 - DNA, 20 bp, Homo sapiens
tgatggtggactaagcaatt

SEQ ID NO: 3397751 - DNA, 19 bp, Homo sapiens
tgatgtacagtctgtcatg

SEQ ID NO: 3397752 - DNA, 15 bp, Homo sapiens
tgatgtacctgatgc

SEQ ID NO: 3397753 - DNA, 15 bp, Homo sapiens
tgatgtatatgttta

SEQ ID NO: 3397754 - DNA, 21 bp, Homo sapiens
tgatgtatgtgtgaaacaatg

SEQ ID NO: 3397755 - DNA, 14 bp, Homo sapiens
tgatgtattctagc

SEQ ID NO: 3397756 - DNA, 21 bp, Homo sapiens
tgatgtattctagctaatgta

SEQ ID NO: 3397757 - DNA, 14 bp, Homo sapiens
tgatgtcaaagtgt

SEQ ID NO: 3397758 - DNA, 23 bp, Homo sapiens
tgatgtcaatttctgtgttgcca

SEQ ID NO: 3397759 - DNA, 16 bp, Homo sapiens
tgatgtcagtatttca

SEQ ID NO: 3397760 - DNA, 20 bp, Homo sapiens
tgatgtcagtatttcaactg

SEQ ID NO: 3397761 - DNA, 18 bp, Homo sapiens
tgatgtcttttcttggca

SEQ ID NO: 3397762 - DNA, 23 bp, Homo sapiens
tgatgtcttttcttggcaaaagc

SEQ ID NO: 3397763 - DNA, 21 bp, Homo sapiens
tgatgtgaagataatttgcat

SEQ ID NO: 3397764 - DNA, 23 bp, Homo sapiens
tgatgtgactttttttggtataa

SEQ ID NO: 3397765 - DNA, 15 bp, Homo sapiens
tgatgtggtgcctga

SEQ ID NO: 3397766 - DNA, 22 bp, Homo sapiens
tgatgttaaccagaataaagtt

SEQ ID NO: 3397767 - DNA, 18 bp, Homo sapiens
tgatgttctaaggctctg

SEQ ID NO: 3397768 - DNA, 16 bp, Homo sapiens
tgatgtttgtggcctc

SEQ ID NO: 3397769 - DNA, 17 bp, Homo sapiens
tgatgtttgtggcctca

SEQ ID NO: 3397770 - DNA, 19 bp, Homo sapiens
tgattaaataagattctaa

SEQ ID NO: 3397771 - DNA, 20 bp, Homo sapiens
tgattaaataagattctaac

SEQ ID NO: 3397772 - DNA, 15 bp, Homo sapiens
tgattaacaaatatg

SEQ ID NO: 3397773 - DNA, 17 bp, Homo sapiens
tgattaacaaatatgct

SEQ ID NO: 3397774 - DNA, 14 bp, Homo sapiens
tgattaatgtttct

SEQ ID NO: 3397775 - DNA, 15 bp, Homo sapiens
tgattacctgccaat

SEQ ID NO: 3397776 - DNA, 20 bp, Homo sapiens
tgattactggcctttttcat

SEQ ID NO: 3397777 - DNA, 16 bp, Homo sapiens
tgcacccactcaccag

SEQ ID NO: 3397778 - DNA, 17 bp, Homo sapiens
tgcacccactcaccagg

SEQ ID NO: 3397779 - DNA, 18 bp, Homo sapiens
tgcacccactcaccaggg

SEQ ID NO: 3397780 - DNA, 12 bp, Homo sapiens
tgcacccagctc

SEQ ID NO: 3397781 - DNA, 17 bp, Homo sapiens
tgcacccagctccaggg

SEQ ID NO: 3397782 - DNA, 18 bp, Homo sapiens
tgcacccagctccagggg

SEQ ID NO: 3397783 - DNA, 20 bp, Homo sapiens
tgcaccccaaagctttcctg

SEQ ID NO: 3397784 - DNA, 22 bp, Homo sapiens
tgcaccccaaagctttcctgcc

SEQ ID NO: 3397785 - DNA, 12 bp, Homo sapiens
tgcacccctccc

SEQ ID NO: 3397786 - DNA, 13 bp, Homo sapiens
tgcacccctccca

SEQ ID NO: 3397787 - DNA, 14 bp, Homo sapiens
tgcacccctcccat

SEQ ID NO: 3397788 - DNA, 16 bp, Homo sapiens
tgcaccctccaccctg

SEQ ID NO: 3397789 - DNA, 17 bp, Homo sapiens
tgcaccctccaccctgt

SEQ ID NO: 3397790 - DNA, 18 bp, Homo sapiens
tgcaccctccaccctgtc

SEQ ID NO: 3397791 - DNA, 21 bp, Homo sapiens
tgcaccctccctcctgccgct

SEQ ID NO: 3397792 - DNA, 12 bp, Homo sapiens
tgcaccctggaa

SEQ ID NO: 3397793 - DNA, 23 bp, Homo sapiens
tgcaccgagtgatttccatctct

SEQ ID NO: 3397794 - DNA, 14 bp, Homo sapiens
tgcaccgggccaca

SEQ ID NO: 3397795 - DNA, 15 bp, Homo sapiens
tgcaccgtcctcagc

SEQ ID NO: 3397796 - DNA, 19 bp, Homo sapiens
tgcacctagctgtgcaaga

SEQ ID NO: 3397797 - DNA, 20 bp, Homo sapiens
tgcacctagctgtgcaagac

SEQ ID NO: 3397798 - DNA, 15 bp, Homo sapiens
tgcacctgccagcct

SEQ ID NO: 3397799 - DNA, 20 bp, Homo sapiens
tgcacctgctgcgtccccac

SEQ ID NO: 3397800 - DNA, 23 bp, Homo sapiens
tgcacctgctgcgtccccactcc

SEQ ID NO: 3397801 - DNA, 13 bp, Homo sapiens
tgcacctgtcccc

SEQ ID NO: 3397802 - DNA, 16 bp, Homo sapiens
tgcacctgtccccacc

SEQ ID NO: 3397803 - DNA, 16 bp, Homo sapiens
tgcaccttgtgtctgt

SEQ ID NO: 3397804 - DNA, 15 bp, Homo sapiens
tgcacgtaaacttca

SEQ ID NO: 3397805 - DNA, 14 bp, Homo sapiens
tgcacgtggcctct

SEQ ID NO: 3397806 - DNA, 17 bp, Homo sapiens
tgcacgtggcctcttga

SEQ ID NO: 3397807 - DNA, 15 bp, Homo sapiens
tgcacgtgtgtgcac

SEQ ID NO: 3397808 - DNA, 18 bp, Homo sapiens
tgcactaaatcagagaca

SEQ ID NO: 3397809 - DNA, 22 bp, Homo sapiens
tgcactaccatagctacatcag

SEQ ID NO: 3397810 - DNA, 16 bp, Homo sapiens
tgcactactgacatgt

SEQ ID NO: 3397811 - DNA, 14 bp, Homo sapiens
tgcactcaacctta

SEQ ID NO: 3397812 - DNA, 14 bp, Homo sapiens
tgcactccagcctg

SEQ ID NO: 3397813 - DNA, 16 bp, Homo sapiens
tgcactccagcctggg

SEQ ID NO: 3397814 - DNA, 18 bp, Homo sapiens
tgcactccagcctgggcg

SEQ ID NO: 3397815 - DNA, 14 bp, Homo sapiens
tgcactcccacctg

SEQ ID NO: 3397816 - DNA, 14 bp, Homo sapiens
tgcactctgctaat

SEQ ID NO: 3397817 - DNA, 19 bp, Homo sapiens
tgcactgaaaacttagcca

SEQ ID NO: 3397818 - DNA, 20 bp, Homo sapiens
tgcactgaaaacttagccag

SEQ ID NO: 3397819 - DNA, 13 bp, Homo sapiens
tgcactgaagttt

SEQ ID NO: 3397820 - DNA, 21 bp, Homo sapiens
tgcactgacattgttggccaa

SEQ ID NO: 3397821 - DNA, 12 bp, Homo sapiens
tgcactgaccct

SEQ ID NO: 3397822 - DNA, 20 bp, Homo sapiens
tgcactgacccttccagaca

SEQ ID NO: 3397823 - DNA, 23 bp, Homo sapiens
tgcactgacccttccagacatac

SEQ ID NO: 3397824 - DNA, 22 bp, Homo sapiens
tgcactgatatatcatgagtga

SEQ ID NO: 3397825 - DNA, 15 bp, Homo sapiens
tgcactgatcaccca

SEQ ID NO: 3397826 - DNA, 22 bp, Homo sapiens
tgcactgcatgcaaacaagaaa

SEQ ID NO: 3397827 - DNA, 18 bp, Homo sapiens
tgcactgctgttcctgct

SEQ ID NO: 3397828 - DNA, 16 bp, Homo sapiens
tgcactggggagcccg

SEQ ID NO: 3397829 - DNA, 16 bp, Homo sapiens
tgcactgtatgctgga

SEQ ID NO: 3397830 - DNA, 19 bp, Homo sapiens
tgcactgtcgataatcaga

SEQ ID NO: 3397831 - DNA, 12 bp, Homo sapiens
tgcactgttttt

SEQ ID NO: 3397832 - DNA, 13 bp, Homo sapiens
tgcactgttttta

SEQ ID NO: 3397833 - DNA, 20 bp, Homo sapiens
tgcacttaagttagcctcca

SEQ ID NO: 3397834 - DNA, 18 bp, Homo sapiens
tgcacttacttgcttatt

SEQ ID NO: 3397835 - DNA, 18 bp, Homo sapiens
tgcacttatgtacttgat

SEQ ID NO: 3397836 - DNA, 15 bp, Homo sapiens
tgcacttcagacacc

SEQ ID NO: 3397837 - DNA, 13 bp, Homo sapiens
tgcacttggcctc

SEQ ID NO: 3397838 - DNA, 17 bp, Homo sapiens
tgcacttggcctcagct

SEQ ID NO: 3397839 - DNA, 21 bp, Homo sapiens
tgcacttgtgattatttatta

SEQ ID NO: 3397840 - DNA, 19 bp, Homo sapiens
tgcactttctaatgtttct

SEQ ID NO: 3397841 - DNA, 20 bp, Homo sapiens
tgcacttttttatgaagaaa

SEQ ID NO: 3397842 - DNA, 21 bp, Homo sapiens
tgcacttttttatgaagaaaa

SEQ ID NO: 3397843 - DNA, 17 bp, Homo sapiens
tgcagaaaattctgtgc

SEQ ID NO: 3397844 - DNA, 16 bp, Homo sapiens
tgcagaaatagacaaa

SEQ ID NO: 3397845 - DNA, 17 bp, Homo sapiens
tgcagaaatagacaaaa

SEQ ID NO: 3397846 - DNA, 19 bp, Homo sapiens
tgcagaaatagacaaaaag

SEQ ID NO: 3397847 - DNA, 21 bp, Homo sapiens
tgcagaaatagacaaaaagta

SEQ ID NO: 3397848 - DNA, 14 bp, Homo sapiens
tgcagaaatgaaat

SEQ ID NO: 3397849 - DNA, 21 bp, Homo sapiens
tgcagaactgccattattttc

SEQ ID NO: 3397850 - DNA, 20 bp, Homo sapiens
tgcagaagagggtgtgtttg

SEQ ID NO: 3397851 - DNA, 14 bp, Homo sapiens
tgcagaagcatatt

SEQ ID NO: 3397852 - DNA, 22 bp, Homo sapiens
tgcagaagcatattttgctggt

SEQ ID NO: 3397853 - DNA, 14 bp, Homo sapiens
tgcagaaggaaaga

SEQ ID NO: 3397854 - DNA, 13 bp, Homo sapiens
tgcagaataatgg

SEQ ID NO: 3397855 - DNA, 14 bp, Homo sapiens
tgcagaataatgga

SEQ ID NO: 3397856 - DNA, 17 bp, Homo sapiens
tgcagaataatggaaac

SEQ ID NO: 3397857 - DNA, 21 bp, Homo sapiens
tgcagaataatggaaacatta

SEQ ID NO: 3397858 - DNA, 19 bp, Homo sapiens
tgcagacaacaccttcctc

SEQ ID NO: 3397859 - DNA, 16 bp, Homo sapiens
tgcagacacctggact

SEQ ID NO: 3397860 - DNA, 21 bp, Homo sapiens
tgcagacagaagtctcctcaa

SEQ ID NO: 3397861 - DNA, 12 bp, Homo sapiens
tgcagacaggca

SEQ ID NO: 3397862 - DNA, 21 bp, Homo sapiens
tgcagacaggcaagcacctcc

SEQ ID NO: 3397863 - DNA, 23 bp, Homo sapiens
tgcagaccatgaagtaaattatg

SEQ ID NO: 3397864 - DNA, 17 bp, Homo sapiens
tgcagacgggcaagaag

SEQ ID NO: 3397865 - DNA, 18 bp, Homo sapiens
tgcagacgggcaagaagc

SEQ ID NO: 3397866 - DNA, 21 bp, Homo sapiens
tgcagacgggcaagaagctgc

SEQ ID NO: 3397867 - DNA, 20 bp, Homo sapiens
tgcagactcctcagatctga

SEQ ID NO: 3397868 - DNA, 18 bp, Homo sapiens
tgcagactctacagaggc

SEQ ID NO: 3397869 - DNA, 19 bp, Homo sapiens
tgcagactctacagaggcc

SEQ ID NO: 3397870 - DNA, 20 bp, Homo sapiens
tgcagactctacagaggcca

SEQ ID NO: 3397871 - DNA, 18 bp, Homo sapiens
tgcagagaagcatcctcc

SEQ ID NO: 3397872 - DNA, 13 bp, Homo sapiens
tgcagagaagctg

SEQ ID NO: 3397873 - DNA, 15 bp, Homo sapiens
tgcagagaagctgga

SEQ ID NO: 3397874 - DNA, 16 bp, Homo sapiens
tgcagagaagctggac

SEQ ID NO: 3397875 - DNA, 23 bp, Homo sapiens
tgcagagagccattttgtgaatg

SEQ ID NO: 3397876 - DNA, 12 bp, Homo sapiens
tgcagagcacaa

SEQ ID NO: 3397877 - DNA, 23 bp, Homo sapiens
tgcagagcacctttgcacaggat

SEQ ID NO: 3397878 - DNA, 21 bp, Homo sapiens
tgcagagcaggaaacatgact

SEQ ID NO: 3397879 - DNA, 17 bp, Homo sapiens
tgcagaggccagaggcc

SEQ ID NO: 3397880 - DNA, 23 bp, Homo sapiens
tgcagaggctcttgatggtggac

SEQ ID NO: 3397881 - DNA, 15 bp, Homo sapiens
tgcagaggggaaaga

SEQ ID NO: 3397882 - DNA, 20 bp, Homo sapiens
tgcagaggggctttctggag

SEQ ID NO: 3397883 - DNA, 21 bp, Homo sapiens
tgcagaggggctttctggaga

SEQ ID NO: 3397884 - DNA, 22 bp, Homo sapiens
tgcagaggggctttctggagag

SEQ ID NO: 3397885 - DNA, 15 bp, Homo sapiens
tgcagaggtcagact

SEQ ID NO: 3397886 - DNA, 17 bp, Homo sapiens
tgcagataattctggac

SEQ ID NO: 3397887 - DNA, 22 bp, Homo sapiens
tgcagataattctggaccagag

SEQ ID NO: 3397888 - DNA, 17 bp, Homo sapiens
tgcagatgcaattgttt

SEQ ID NO: 3397889 - DNA, 14 bp, Homo sapiens
tgcagatgggctgt

SEQ ID NO: 3397890 - DNA, 17 bp, Homo sapiens
tgcagattcctgggcct

SEQ ID NO: 3397891 - DNA, 19 bp, Homo sapiens
tgcagattcctgggcctgt

SEQ ID NO: 3397892 - DNA, 20 bp, Homo sapiens
tgcagatttgatatttgcat

SEQ ID NO: 3397893 - DNA, 18 bp, Homo sapiens
tgcagcaaacactccacc

SEQ ID NO: 3397894 - DNA, 19 bp, Homo sapiens
tgcagcaaacactccaccc

SEQ ID NO: 3397895 - DNA, 14 bp, Homo sapiens
tgcagcacctccag

SEQ ID NO: 3397896 - DNA, 19 bp, Homo sapiens
tgcagcacctccaggcctg

SEQ ID NO: 3397897 - DNA, 19 bp, Homo sapiens
tgcagcacggacaataaac

SEQ ID NO: 3397898 - DNA, 14 bp, Homo sapiens
tgcagcagataact

SEQ ID NO: 3397899 - DNA, 20 bp, Homo sapiens
tgcagcagcaacacaatgtt

SEQ ID NO: 3397900 - DNA, 22 bp, Homo sapiens
tgcagcagcaacacaatgttat

SEQ ID NO: 3397901 - DNA, 13 bp, Homo sapiens
tgcagcagcccag

SEQ ID NO: 3397902 - DNA, 20 bp, Homo sapiens
tgcagcaggaactctggacc

SEQ ID NO: 3397903 - DNA, 15 bp, Homo sapiens
tgcccaggccacagc

SEQ ID NO: 3397904 - DNA, 12 bp, Homo sapiens
tgcccaggcccc

SEQ ID NO: 3397905 - DNA, 17 bp, Homo sapiens
tgcccaggcccctgcca

SEQ ID NO: 3397906 - DNA, 18 bp, Homo sapiens
tgcccaggcccctgccac

SEQ ID NO: 3397907 - DNA, 22 bp, Homo sapiens
tgcccaggcccctgccaccctg

SEQ ID NO: 3397908 - DNA, 20 bp, Homo sapiens
tgcccaggccggccagcctc

SEQ ID NO: 3397909 - DNA, 11 bp, Homo sapiens
tgcccaggctg

SEQ ID NO: 3397910 - DNA, 11 bp, Homo sapiens
tgcccaggggt

SEQ ID NO: 3397911 - DNA, 18 bp, Homo sapiens
tgcccaggggtgccccct

SEQ ID NO: 3397912 - DNA, 21 bp, Homo sapiens
tgcccaggggtgccccctcct

SEQ ID NO: 3397913 - DNA, 23 bp, Homo sapiens
tgcccatcacagggttgggccca

SEQ ID NO: 3397914 - DNA, 16 bp, Homo sapiens
tgcccatggcttctgg

SEQ ID NO: 3397915 - DNA, 21 bp, Homo sapiens
tgcccatgtcgcgctcagcat

SEQ ID NO: 3397916 - DNA, 21 bp, Homo sapiens
tgcccatgtgtacattctgcc

SEQ ID NO: 3397917 - DNA, 19 bp, Homo sapiens
tgcccatgtgtcccctcac

SEQ ID NO: 3397918 - DNA, 22 bp, Homo sapiens
tgcccatgtgtcccctcactct

SEQ ID NO: 3397919 - DNA, 14 bp, Homo sapiens
tgccccaagcagcc

SEQ ID NO: 3397920 - DNA, 14 bp, Homo sapiens
tgccccaagtcctc

SEQ ID NO: 3397921 - DNA, 22 bp, Homo sapiens
tgccccacacggactcccgggc

SEQ ID NO: 3397922 - DNA, 11 bp, Homo sapiens
tgccccacagc

SEQ ID NO: 3397923 - DNA, 12 bp, Homo sapiens
tgccccacagct

SEQ ID NO: 3397924 - DNA, 19 bp, Homo sapiens
tgccccacagttgtgttca

SEQ ID NO: 3397925 - DNA, 20 bp, Homo sapiens
tgccccacccaccccacaga

SEQ ID NO: 3397926 - DNA, 15 bp, Homo sapiens
tgccccagagctgtt

SEQ ID NO: 3397927 - DNA, 23 bp, Homo sapiens
tgccccagagctgtttatggcct

SEQ ID NO: 3397928 - DNA, 13 bp, Homo sapiens
tgccccagccaga

SEQ ID NO: 3397929 - DNA, 13 bp, Homo sapiens
tgccccagcccaa

SEQ ID NO: 3397930 - DNA, 18 bp, Homo sapiens
tgccccagctgactgtgg

SEQ ID NO: 3397931 - DNA, 15 bp, Homo sapiens
tgccccagggctccc

SEQ ID NO: 3397932 - DNA, 16 bp, Homo sapiens
tgcccccaacactcca

SEQ ID NO: 3397933 - DNA, 21 bp, Homo sapiens
tgcccccaacactccaggccc

SEQ ID NO: 3397934 - DNA, 22 bp, Homo sapiens
tgcccccaccccggggaccctg

SEQ ID NO: 3397935 - DNA, 17 bp, Homo sapiens
tgcccccacctctggtc

SEQ ID NO: 3397936 - DNA, 14 bp, Homo sapiens
tgcccccagccccg

SEQ ID NO: 3397937 - DNA, 16 bp, Homo sapiens
tgcccccagccccggg

SEQ ID NO: 3397938 - DNA, 14 bp, Homo sapiens
tgcccccatccctc

SEQ ID NO: 3397939 - DNA, 22 bp, Homo sapiens
tgcccccatctccccaggcctc

SEQ ID NO: 3397940 - DNA, 15 bp, Homo sapiens
tgccccccagcctct

SEQ ID NO: 3397941 - DNA, 18 bp, Homo sapiens
tgccccccctaagagaca

SEQ ID NO: 3397942 - DNA, 23 bp, Homo sapiens
tgcccccctcaaacctcctcttc

SEQ ID NO: 3397943 - DNA, 16 bp, Homo sapiens
tgcccccgcctgccac

SEQ ID NO: 3397944 - DNA, 17 bp, Homo sapiens
tgccccctcctctccca

SEQ ID NO: 3397945 - DNA, 22 bp, Homo sapiens
tgccccctggtggacagtcctg

SEQ ID NO: 3397946 - DNA, 13 bp, Homo sapiens
tgccccgcccagc

SEQ ID NO: 3397947 - DNA, 22 bp, Homo sapiens
tgccccgcccccagtccccacc

SEQ ID NO: 3397948 - DNA, 18 bp, Homo sapiens
tgccccggccacctctgc

SEQ ID NO: 3397949 - DNA, 22 bp, Homo sapiens
tgccccggccccggccccagcc

SEQ ID NO: 3397950 - DNA, 17 bp, Homo sapiens
tgccccggcccctcccc

SEQ ID NO: 3397951 - DNA, 19 bp, Homo sapiens
tgccccgttccctgtcaga

SEQ ID NO: 3397952 - DNA, 23 bp, Homo sapiens
tgccccgttccctgtcagaggct

SEQ ID NO: 3397953 - DNA, 15 bp, Homo sapiens
tgcccctcccaaccc

SEQ ID NO: 3397954 - DNA, 13 bp, Homo sapiens
tgcccctcccttc

SEQ ID NO: 3397955 - DNA, 15 bp, Homo sapiens
tgcccctcgccagct

SEQ ID NO: 3397956 - DNA, 20 bp, Homo sapiens
tgcccctctccttcttagct

SEQ ID NO: 3397957 - DNA, 16 bp, Homo sapiens
tgcccctgatcactcc

SEQ ID NO: 3397958 - DNA, 24 bp, Homo sapiens
tgcccctgatcactcccagcactc

SEQ ID NO: 3397959 - DNA, 14 bp, Homo sapiens
tgcccctgcaaaga

SEQ ID NO: 3397960 - DNA, 16 bp, Homo sapiens
tgcccctgcaaagaca

SEQ ID NO: 3397961 - DNA, 21 bp, Homo sapiens
tgcccctgcgtggcctgagtc

SEQ ID NO: 3397962 - DNA, 17 bp, Homo sapiens
tgcccctggcccatctc

SEQ ID NO: 3397963 - DNA, 23 bp, Homo sapiens
tgccccttaagggttgaaggcag

SEQ ID NO: 3397964 - DNA, 15 bp, Homo sapiens
tgccccttcttgggc

SEQ ID NO: 3397965 - DNA, 22 bp, Homo sapiens
tgccccttggctggatcaggga

SEQ ID NO: 3397966 - DNA, 12 bp, Homo sapiens
tgccccttgggc

SEQ ID NO: 3397967 - DNA, 18 bp, Homo sapiens
tgccccttgggcatccac

SEQ ID NO: 3397968 - DNA, 21 bp, Homo sapiens
tgccccttgggcatccaccca

SEQ ID NO: 3397969 - DNA, 19 bp, Homo sapiens
tgcccgagctggtgcatta

SEQ ID NO: 3397970 - DNA, 13 bp, Homo sapiens
tgcccgcacagca

SEQ ID NO: 3397971 - DNA, 19 bp, Homo sapiens
tgcccgcacagcagcctgc

SEQ ID NO: 3397972 - DNA, 12 bp, Homo sapiens
tgcccgcctagg

SEQ ID NO: 3397973 - DNA, 23 bp, Homo sapiens
tgcccgcgggagacagcttctct

SEQ ID NO: 3397974 - DNA, 16 bp, Homo sapiens
tgcccgctcctcggga

SEQ ID NO: 3397975 - DNA, 22 bp, Homo sapiens
tgcccgctgcaatgcctagact

SEQ ID NO: 3397976 - DNA, 12 bp, Homo sapiens
tgcccggctgcg

SEQ ID NO: 3397977 - DNA, 21 bp, Homo sapiens
tgcccggggaaaggcaaggtc

SEQ ID NO: 3397978 - DNA, 15 bp, Homo sapiens
tgcccgtgcccgcag

SEQ ID NO: 3397979 - DNA, 19 bp, Homo sapiens
tgcccgtgtagtccccaac

SEQ ID NO: 3397980 - DNA, 16 bp, Homo sapiens
tgccctagatgagccc

SEQ ID NO: 3397981 - DNA, 20 bp, Homo sapiens
tgccctagcccagactctga

SEQ ID NO: 3397982 - DNA, 18 bp, Homo sapiens
tgccctcattttatgtca

SEQ ID NO: 3397983 - DNA, 21 bp, Homo sapiens
tgccctccacagccgcagcct

SEQ ID NO: 3397984 - DNA, 19 bp, Homo sapiens
tgccctccccagagcactg

SEQ ID NO: 3397985 - DNA, 20 bp, Homo sapiens
tgccctccccagagcactgg

SEQ ID NO: 3397986 - DNA, 17 bp, Homo sapiens
tgccctccgcctgggat

SEQ ID NO: 3397987 - DNA, 14 bp, Homo sapiens
tgccctcctcactc

SEQ ID NO: 3397988 - DNA, 19 bp, Homo sapiens
tgccctcgtggccagcccg

SEQ ID NO: 3397989 - DNA, 22 bp, Homo sapiens
tgccctctatttattagccaac

SEQ ID NO: 3397990 - DNA, 15 bp, Homo sapiens
tgccctctccttcct

SEQ ID NO: 3397991 - DNA, 16 bp, Homo sapiens
tgccctctccttcctt

SEQ ID NO: 3397992 - DNA, 20 bp, Homo sapiens
tgccctgacctcccagccct

SEQ ID NO: 3397993 - DNA, 21 bp, Homo sapiens
tgccctgacctcccagcccta

SEQ ID NO: 3397994 - DNA, 20 bp, Homo sapiens
tgccctgagaagctgctcca

SEQ ID NO: 3397995 - DNA, 23 bp, Homo sapiens
tgccctgcacgtatacacccaga

SEQ ID NO: 3397996 - DNA, 13 bp, Homo sapiens
tgccctgccccca

SEQ ID NO: 3397997 - DNA, 12 bp, Homo sapiens
tgccctgcctgc

SEQ ID NO: 3397998 - DNA, 17 bp, Homo sapiens
tgccctggcagcagcag

SEQ ID NO: 3397999 - DNA, 22 bp, Homo sapiens
tgccctggcagggtcatcctgt

SEQ ID NO: 3398000 - DNA, 12 bp, Homo sapiens
tgccctggccct

SEQ ID NO: 3398001 - DNA, 13 bp, Homo sapiens
tgccctggccctg

SEQ ID NO: 3398002 - DNA, 17 bp, Homo sapiens
tgccctggccctgaggt

SEQ ID NO: 3398003 - DNA, 22 bp, Homo sapiens
tgccctggccctgaggtgtggg

SEQ ID NO: 3398004 - DNA, 12 bp, Homo sapiens
tgccctggtgct

SEQ ID NO: 3398005 - DNA, 16 bp, Homo sapiens
tgccctggtgctgcca

SEQ ID NO: 3398006 - DNA, 13 bp, Homo sapiens
tgccctggtggag

SEQ ID NO: 3398007 - DNA, 15 bp, Homo sapiens
tgccctggtggagaa

SEQ ID NO: 3398008 - DNA, 22 bp, Homo sapiens
tgccctggtttcactggcccaa

SEQ ID NO: 3398009 - DNA, 17 bp, Homo sapiens
tgccctgtaacttatct

SEQ ID NO: 3398010 - DNA, 12 bp, Homo sapiens
tgccctgtccct

SEQ ID NO: 3398011 - DNA, 12 bp, Homo sapiens
tgcccttctgat

SEQ ID NO: 3398012 - DNA, 22 bp, Homo sapiens
tgcccttctgattcccctccac

SEQ ID NO: 3398013 - DNA, 19 bp, Homo sapiens
tgcccttgccctgacctcc

SEQ ID NO: 3398014 - DNA, 22 bp, Homo sapiens
tgccctttcctaggcccaggcc

SEQ ID NO: 3398015 - DNA, 19 bp, Homo sapiens
tgccgaatgtgcaggtttg

SEQ ID NO: 3398016 - DNA, 22 bp, Homo sapiens
tgccgaatgtgcaggtttgtta

SEQ ID NO: 3398017 - DNA, 19 bp, Homo sapiens
tgccgacttggagactcct

SEQ ID NO: 3398018 - DNA, 14 bp, Homo sapiens
tgccgagacctcaa

SEQ ID NO: 3398019 - DNA, 14 bp, Homo sapiens
tgccgaggaccctc

SEQ ID NO: 3398020 - DNA, 21 bp, Homo sapiens
tgccgcaggtgggtgctgccc

SEQ ID NO: 3398021 - DNA, 23 bp, Homo sapiens
tgccgcaggtgggtgctgccctg

SEQ ID NO: 3398022 - DNA, 14 bp, Homo sapiens
tgccgccgcctccc

SEQ ID NO: 3398023 - DNA, 20 bp, Homo sapiens
tgccgcctcagcttctcaaa

SEQ ID NO: 3398024 - DNA, 14 bp, Homo sapiens
tgccgcctcccagc

SEQ ID NO: 3398025 - DNA, 17 bp, Homo sapiens
tgccgcctcccagcctg

SEQ ID NO: 3398026 - DNA, 16 bp, Homo sapiens
tgccgcctgctcctca

SEQ ID NO: 3398027 - DNA, 18 bp, Homo sapiens
tgccgccttccccatcac

SEQ ID NO: 3398028 - DNA, 16 bp, Homo sapiens
tgctgctaccgccctg

SEQ ID NO: 3398029 - DNA, 20 bp, Homo sapiens
tgctgctaccgccctgggct

SEQ ID NO: 3398030 - DNA, 12 bp, Homo sapiens
tgctgctagaac

SEQ ID NO: 3398031 - DNA, 14 bp, Homo sapiens
tgctgctagaactt

SEQ ID NO: 3398032 - DNA, 15 bp, Homo sapiens
tgctgctatgaaaat

SEQ ID NO: 3398033 - DNA, 20 bp, Homo sapiens
tgctgctatgaaaatgagca

SEQ ID NO: 3398034 - DNA, 13 bp, Homo sapiens
tgctgctccgccc

SEQ ID NO: 3398035 - DNA, 20 bp, Homo sapiens
tgctgctctcccctcccagt

SEQ ID NO: 3398036 - DNA, 14 bp, Homo sapiens
tgctgctgcaccca

SEQ ID NO: 3398037 - DNA, 12 bp, Homo sapiens
tgctgctgctgc

SEQ ID NO: 3398038 - DNA, 15 bp, Homo sapiens
tgctgctgctgcacc

SEQ ID NO: 3398039 - DNA, 18 bp, Homo sapiens
tgctgctgtaactgctga

SEQ ID NO: 3398040 - DNA, 22 bp, Homo sapiens
tgctgctgtaactgctgagcca

SEQ ID NO: 3398041 - DNA, 19 bp, Homo sapiens
tgctgcttctcctcccagc

SEQ ID NO: 3398042 - DNA, 16 bp, Homo sapiens
tgctgcttctcttggg

SEQ ID NO: 3398043 - DNA, 15 bp, Homo sapiens
tgctgctttcccctg

SEQ ID NO: 3398044 - DNA, 19 bp, Homo sapiens
tgctgctttcccctgtggg

SEQ ID NO: 3398045 - DNA, 16 bp, Homo sapiens
tgctgcttttgagcct

SEQ ID NO: 3398046 - DNA, 19 bp, Homo sapiens
tgctgcttttgagcctcag

SEQ ID NO: 3398047 - DNA, 18 bp, Homo sapiens
tgctgctttttggcacag

SEQ ID NO: 3398048 - DNA, 17 bp, Homo sapiens
tgctggaagaaactaaa

SEQ ID NO: 3398049 - DNA, 20 bp, Homo sapiens
tgctggacggcattcctgct

SEQ ID NO: 3398050 - DNA, 21 bp, Homo sapiens
tgctggacggggactggggat

SEQ ID NO: 3398051 - DNA, 16 bp, Homo sapiens
tgctggacgtctttct

SEQ ID NO: 3398052 - DNA, 21 bp, Homo sapiens
tgctggactggaggcccctgg

SEQ ID NO: 3398053 - DNA, 17 bp, Homo sapiens
tgctggactgttccagg

SEQ ID NO: 3398054 - DNA, 21 bp, Homo sapiens
tgctggactgttccaggccct

SEQ ID NO: 3398055 - DNA, 23 bp, Homo sapiens
tgctggactgttccaggccctcc

SEQ ID NO: 3398056 - DNA, 21 bp, Homo sapiens
tgctggagggaggctgggcgg

SEQ ID NO: 3398057 - DNA, 18 bp, Homo sapiens
tgctggaggtgggagcag

SEQ ID NO: 3398058 - DNA, 19 bp, Homo sapiens
tgctggatggagcccaggc

SEQ ID NO: 3398059 - DNA, 18 bp, Homo sapiens
tgctggattgtccttgga

SEQ ID NO: 3398060 - DNA, 21 bp, Homo sapiens
tgctggattgtccttggagga

SEQ ID NO: 3398061 - DNA, 12 bp, Homo sapiens
tgctggccagca

SEQ ID NO: 3398062 - DNA, 20 bp, Homo sapiens
tgctggccagcaccctctcc

SEQ ID NO: 3398063 - DNA, 16 bp, Homo sapiens
tgctggccagcctggg

SEQ ID NO: 3398064 - DNA, 16 bp, Homo sapiens
tgctggccccagccct

SEQ ID NO: 3398065 - DNA, 13 bp, Homo sapiens
tgctggcctggcc

SEQ ID NO: 3398066 - DNA, 13 bp, Homo sapiens
tgctggctctgag

SEQ ID NO: 3398067 - DNA, 14 bp, Homo sapiens
tgctggctctgaga

SEQ ID NO: 3398068 - DNA, 14 bp, Homo sapiens
tgctggctgcccag

SEQ ID NO: 3398069 - DNA, 15 bp, Homo sapiens
tgctggctgccttag

SEQ ID NO: 3398070 - DNA, 14 bp, Homo sapiens
tgctggctgcggcc

SEQ ID NO: 3398071 - DNA, 19 bp, Homo sapiens
tgctggctgttggctgggg

SEQ ID NO: 3398072 - DNA, 14 bp, Homo sapiens
tgctggcttccagc

SEQ ID NO: 3398073 - DNA, 16 bp, Homo sapiens
tgctggcttccagctt

SEQ ID NO: 3398074 - DNA, 21 bp, Homo sapiens
tgctggcttccagcttcaggc

SEQ ID NO: 3398075 - DNA, 19 bp, Homo sapiens
tgctgggaaccccgcagcc

SEQ ID NO: 3398076 - DNA, 23 bp, Homo sapiens
tgctgggaaccccgcagcccgtg

SEQ ID NO: 3398077 - DNA, 15 bp, Homo sapiens
tgctgggaccagagc

SEQ ID NO: 3398078 - DNA, 21 bp, Homo sapiens
tgctgggagctccactctgct

SEQ ID NO: 3398079 - DNA, 23 bp, Homo sapiens
tgctgggagctccactctgcttc

SEQ ID NO: 3398080 - DNA, 18 bp, Homo sapiens
tgctgggaggagggagag

SEQ ID NO: 3398081 - DNA, 13 bp, Homo sapiens
tgctgggctgggc

SEQ ID NO: 3398082 - DNA, 16 bp, Homo sapiens
tgctgggctgggccct

SEQ ID NO: 3398083 - DNA, 18 bp, Homo sapiens
tgctggggcaagtccctg

SEQ ID NO: 3398084 - DNA, 19 bp, Homo sapiens
tgctggggcatgtgtgcct

SEQ ID NO: 3398085 - DNA, 21 bp, Homo sapiens
tgctggggcatgtgtgcctgt

SEQ ID NO: 3398086 - DNA, 22 bp, Homo sapiens
tgctggggcatgtgtgcctgtg

SEQ ID NO: 3398087 - DNA, 22 bp, Homo sapiens
tgctggggccgccacggcctgg

SEQ ID NO: 3398088 - DNA, 18 bp, Homo sapiens
tgctggggcctcagacga

SEQ ID NO: 3398089 - DNA, 10 bp, Homo sapiens
tgctggggct

SEQ ID NO: 3398090 - DNA, 14 bp, Homo sapiens
tgctgggggaatga

SEQ ID NO: 3398091 - DNA, 22 bp, Homo sapiens
tgctgggggaatgagcccagag

SEQ ID NO: 3398092 - DNA, 19 bp, Homo sapiens
tgctggggtcaaggcagta

SEQ ID NO: 3398093 - DNA, 21 bp, Homo sapiens
tgctgggtataagcagagagg

SEQ ID NO: 3398094 - DNA, 14 bp, Homo sapiens
tgctgggtgcctcc

SEQ ID NO: 3398095 - DNA, 18 bp, Homo sapiens
tgctgggtgcctcccaca

SEQ ID NO: 3398096 - DNA, 17 bp, Homo sapiens
tgctggtcccctcctca

SEQ ID NO: 3398097 - DNA, 18 bp, Homo sapiens
tgctggtcccctcctcag

SEQ ID NO: 3398098 - DNA, 14 bp, Homo sapiens
tgctggtgtcctga

SEQ ID NO: 3398099 - DNA, 15 bp, Homo sapiens
tgctggtgtcctgac

SEQ ID NO: 3398100 - DNA, 17 bp, Homo sapiens
tgctggtgtcctgacca

SEQ ID NO: 3398101 - DNA, 15 bp, Homo sapiens
tgctggttgctgtgt

SEQ ID NO: 3398102 - DNA, 17 bp, Homo sapiens
tgctggtttgaaagatt

SEQ ID NO: 3398103 - DNA, 16 bp, Homo sapiens
tgctgtaaaattataa

SEQ ID NO: 3398104 - DNA, 17 bp, Homo sapiens
tgctgtaaaattataaa

SEQ ID NO: 3398105 - DNA, 19 bp, Homo sapiens
tgctgtaaaattataaact

SEQ ID NO: 3398106 - DNA, 14 bp, Homo sapiens
tgctgtaaataagc

SEQ ID NO: 3398107 - DNA, 17 bp, Homo sapiens
tgctgtaactgctgagc

SEQ ID NO: 3398108 - DNA, 17 bp, Homo sapiens
tgctgtacatctatttt

SEQ ID NO: 3398109 - DNA, 13 bp, Homo sapiens
tgctgtacccaga

SEQ ID NO: 3398110 - DNA, 21 bp, Homo sapiens
tgctgtacccagatgcctaca

SEQ ID NO: 3398111 - DNA, 21 bp, Homo sapiens
tgctgtactagagatctggtt

SEQ ID NO: 3398112 - DNA, 18 bp, Homo sapiens
tgctgtactcttgctgat

SEQ ID NO: 3398113 - DNA, 17 bp, Homo sapiens
tgctgtagcctattttt

SEQ ID NO: 3398114 - DNA, 16 bp, Homo sapiens
tgctgtataagttatt

SEQ ID NO: 3398115 - DNA, 16 bp, Homo sapiens
tgctgtcacatagttt

SEQ ID NO: 3398116 - DNA, 13 bp, Homo sapiens
tgctgtcactgtt

SEQ ID NO: 3398117 - DNA, 15 bp, Homo sapiens
tgctgtcatggtcct

SEQ ID NO: 3398118 - DNA, 17 bp, Homo sapiens
tgctgtccatgcttctc

SEQ ID NO: 3398119 - DNA, 12 bp, Homo sapiens
tgctgtccctcc

SEQ ID NO: 3398120 - DNA, 16 bp, Homo sapiens
tgctgtcctgatctgt

SEQ ID NO: 3398121 - DNA, 15 bp, Homo sapiens
tgctgtctctgctcg

SEQ ID NO: 3398122 - DNA, 16 bp, Homo sapiens
tgctgtctctgctcgc

SEQ ID NO: 3398123 - DNA, 13 bp, Homo sapiens
tgctgtcttaaac

SEQ ID NO: 3398124 - DNA, 15 bp, Homo sapiens
tgctgtcttctggtc

SEQ ID NO: 3398125 - DNA, 20 bp, Homo sapiens
tgctgtcttctggtctgtgt

SEQ ID NO: 3398126 - DNA, 22 bp, Homo sapiens
tgctgtcttgatgactgctgat

SEQ ID NO: 3398127 - DNA, 23 bp, Homo sapiens
tgctgtgaggaatgctctgtgcc

SEQ ID NO: 3398128 - DNA, 22 bp, Homo sapiens
tgctgtgatacgatgcttcaag

SEQ ID NO: 3398129 - DNA, 20 bp, Homo sapiens
tgctgtgccatgctgggcca

SEQ ID NO: 3398130 - DNA, 15 bp, Homo sapiens
tgctgtgcctgctag

SEQ ID NO: 3398131 - DNA, 18 bp, Homo sapiens
tgctgtgctctttgaaga

SEQ ID NO: 3398132 - DNA, 22 bp, Homo sapiens
tgctgtggaactacattactgt

SEQ ID NO: 3398133 - DNA, 11 bp, Homo sapiens
tgctgtgggca

SEQ ID NO: 3398134 - DNA, 16 bp, Homo sapiens
tgctgtgggcagcacc

SEQ ID NO: 3398135 - DNA, 17 bp, Homo sapiens
tgctgtgggcagcaccc

SEQ ID NO: 3398136 - DNA, 19 bp, Homo sapiens
tgctgtgggcagcaccctc

SEQ ID NO: 3398137 - DNA, 21 bp, Homo sapiens
tgctgtgggcagcaccctccc

SEQ ID NO: 3398138 - DNA, 16 bp, Homo sapiens
tgctgtggggctggta

SEQ ID NO: 3398139 - DNA, 23 bp, Homo sapiens
tgctgtggggctggtagctcagg

SEQ ID NO: 3398140 - DNA, 16 bp, Homo sapiens
tgctgtgtaacactgt

SEQ ID NO: 3398141 - DNA, 11 bp, Homo sapiens
tgctgtgttaa

SEQ ID NO: 3398142 - DNA, 14 bp, Homo sapiens
tgctgttactgtta

SEQ ID NO: 3398143 - DNA, 22 bp, Homo sapiens
tgctgttgctgctactgtctta

SEQ ID NO: 3398144 - DNA, 12 bp, Homo sapiens
tgctgttgctta

SEQ ID NO: 3398145 - DNA, 13 bp, Homo sapiens
tgctgttgtttct

SEQ ID NO: 3398146 - DNA, 11 bp, Homo sapiens
tgctgtttaga

SEQ ID NO: 3398147 - DNA, 17 bp, Homo sapiens
tgctgtttattaatctt

SEQ ID NO: 3398148 - DNA, 17 bp, Homo sapiens
tgctgtttgacacctct

SEQ ID NO: 3398149 - DNA, 17 bp, Homo sapiens
tgcttaaaaatcattga

SEQ ID NO: 3398150 - DNA, 18 bp, Homo sapiens
tgcttaaaaatcattgat

SEQ ID NO: 3398151 - DNA, 18 bp, Homo sapiens
tgcttaaaaggttgcata

SEQ ID NO: 3398152 - DNA, 14 bp, Homo sapiens
tgcttaaaataagc

SEQ ID NO: 3398153 - DNA, 15 bp, Homo sapiens
tgcttaaaataagca

SEQ ID NO: 3398154 - DNA, 13 bp, Homo sapiens
tggagaggacaga

SEQ ID NO: 3398155 - DNA, 18 bp, Homo sapiens
tggagaggacagagcagg

SEQ ID NO: 3398156 - DNA, 21 bp, Homo sapiens
tggagaggacagagcaggggc

SEQ ID NO: 3398157 - DNA, 16 bp, Homo sapiens
tggagatcctcctgca

SEQ ID NO: 3398158 - DNA, 17 bp, Homo sapiens
tggagcaaaaggcagct

SEQ ID NO: 3398159 - DNA, 19 bp, Homo sapiens
tggagcaaaaggcagctca

SEQ ID NO: 3398160 - DNA, 17 bp, Homo sapiens
tggagcagaccaccccg

SEQ ID NO: 3398161 - DNA, 19 bp, Homo sapiens
tggagcagcctggagaccc

SEQ ID NO: 3398162 - DNA, 18 bp, Homo sapiens
tggagcaggactctattt

SEQ ID NO: 3398163 - DNA, 13 bp, Homo sapiens
tggagcaggagcc

SEQ ID NO: 3398164 - DNA, 18 bp, Homo sapiens
tggagcaggagccccgcc

SEQ ID NO: 3398165 - DNA, 23 bp, Homo sapiens
tggagccactcctgtcccgcctt

SEQ ID NO: 3398166 - DNA, 13 bp, Homo sapiens
tggagccagctcc

SEQ ID NO: 3398167 - DNA, 13 bp, Homo sapiens
tggagcccaggcg

SEQ ID NO: 3398168 - DNA, 22 bp, Homo sapiens
tggagcccaggcgggagcggtg

SEQ ID NO: 3398169 - DNA, 13 bp, Homo sapiens
tggagccccaggg

SEQ ID NO: 3398170 - DNA, 22 bp, Homo sapiens
tggagcccccagatagagctgg

SEQ ID NO: 3398171 - DNA, 14 bp, Homo sapiens
tggagcccctgggt

SEQ ID NO: 3398172 - DNA, 15 bp, Homo sapiens
tggagcccgtgcagt

SEQ ID NO: 3398173 - DNA, 11 bp, Homo sapiens
tggagccctgt

SEQ ID NO: 3398174 - DNA, 15 bp, Homo sapiens
tggagcccttgggtt

SEQ ID NO: 3398175 - DNA, 17 bp, Homo sapiens
tggagccgaggcctacc

SEQ ID NO: 3398176 - DNA, 17 bp, Homo sapiens
tggagcctacattcctt

SEQ ID NO: 3398177 - DNA, 21 bp, Homo sapiens
tggagcgaagccttctgcagc

SEQ ID NO: 3398178 - DNA, 16 bp, Homo sapiens
tggagcgcacctgccc

SEQ ID NO: 3398179 - DNA, 22 bp, Homo sapiens
tggagctcagccccgagctgtc

SEQ ID NO: 3398180 - DNA, 13 bp, Homo sapiens
tggagctgactgt

SEQ ID NO: 3398181 - DNA, 16 bp, Homo sapiens
tggagctgactgttct

SEQ ID NO: 3398182 - DNA, 16 bp, Homo sapiens
tggagcttttttcttt

SEQ ID NO: 3398183 - DNA, 23 bp, Homo sapiens
tggaggaaaaccaagccgtggct

SEQ ID NO: 3398184 - DNA, 19 bp, Homo sapiens
tggaggaacacttgatgga

SEQ ID NO: 3398185 - DNA, 18 bp, Homo sapiens
tggaggaagagggacaga

SEQ ID NO: 3398186 - DNA, 13 bp, Homo sapiens
tggaggaaggatt

SEQ ID NO: 3398187 - DNA, 21 bp, Homo sapiens
tggaggaaggggggttgcagt

SEQ ID NO: 3398188 - DNA, 14 bp, Homo sapiens
tggaggaaggtgct

SEQ ID NO: 3398189 - DNA, 15 bp, Homo sapiens
tggaggaaggtgctg

SEQ ID NO: 3398190 - DNA, 18 bp, Homo sapiens
tggaggaattcagctcag

SEQ ID NO: 3398191 - DNA, 11 bp, Homo sapiens
tggaggagaga

SEQ ID NO: 3398192 - DNA, 22 bp, Homo sapiens
tggaggagcagcttccttctgg

SEQ ID NO: 3398193 - DNA, 13 bp, Homo sapiens
tggaggaggaagg

SEQ ID NO: 3398194 - DNA, 15 bp, Homo sapiens
tggaggatggagaga

SEQ ID NO: 3398195 - DNA, 22 bp, Homo sapiens
tggaggccattgtgtgagccta

SEQ ID NO: 3398196 - DNA, 15 bp, Homo sapiens
tggaggcctgatgct

SEQ ID NO: 3398197 - DNA, 18 bp, Homo sapiens
tggaggcctgatgctgcc

SEQ ID NO: 3398198 - DNA, 14 bp, Homo sapiens
tggaggctccagga

SEQ ID NO: 3398199 - DNA, 20 bp, Homo sapiens
tggaggctccaggactccac

SEQ ID NO: 3398200 - DNA, 20 bp, Homo sapiens
tggaggcttcctgcgtcctc

SEQ ID NO: 3398201 - DNA, 20 bp, Homo sapiens
tggagggaaacaccaaactc

SEQ ID NO: 3398202 - DNA, 13 bp, Homo sapiens
tggagggcacagc

SEQ ID NO: 3398203 - DNA, 16 bp, Homo sapiens
tggaggggagtgttgg

SEQ ID NO: 3398204 - DNA, 16 bp, Homo sapiens
tggaggggccctccga

SEQ ID NO: 3398205 - DNA, 16 bp, Homo sapiens
tggaggggctggggac

SEQ ID NO: 3398206 - DNA, 17 bp, Homo sapiens
tggagggggctgggctc

SEQ ID NO: 3398207 - DNA, 14 bp, Homo sapiens
tggaggggtgtggc

SEQ ID NO: 3398208 - DNA, 19 bp, Homo sapiens
tggaggggtgtggcagtgg

SEQ ID NO: 3398209 - DNA, 20 bp, Homo sapiens
tggagggtgggagagcccag

SEQ ID NO: 3398210 - DNA, 20 bp, Homo sapiens
tggaggtcggtaggttcagc

SEQ ID NO: 3398211 - DNA, 17 bp, Homo sapiens
tggaggtctccaggggc

SEQ ID NO: 3398212 - DNA, 22 bp, Homo sapiens
tggaggtctccaggggcctgca

SEQ ID NO: 3398213 - DNA, 20 bp, Homo sapiens
tggaggtgggagcaggagat

SEQ ID NO: 3398214 - DNA, 18 bp, Homo sapiens
tggaggtgggcatgccac

SEQ ID NO: 3398215 - DNA, 17 bp, Homo sapiens
tggaggtggggaaggct

SEQ ID NO: 3398216 - DNA, 16 bp, Homo sapiens
tggaggttaaggcata

SEQ ID NO: 3398217 - DNA, 15 bp, Homo sapiens
tggaggttctaaggc

SEQ ID NO: 3398218 - DNA, 15 bp, Homo sapiens
tggaggttctcagag

SEQ ID NO: 3398219 - DNA, 17 bp, Homo sapiens
tggaggttctcagagcc

SEQ ID NO: 3398220 - DNA, 15 bp, Homo sapiens
tggagtactatattt

SEQ ID NO: 3398221 - DNA, 14 bp, Homo sapiens
tggagtatatgtca

SEQ ID NO: 3398222 - DNA, 21 bp, Homo sapiens
tggagtatgtctgatggatcc

SEQ ID NO: 3398223 - DNA, 14 bp, Homo sapiens
tggagtcccctcac

SEQ ID NO: 3398224 - DNA, 19 bp, Homo sapiens
tggagtcccctcacctcct

SEQ ID NO: 3398225 - DNA, 20 bp, Homo sapiens
tggagtcccctcacctcctc

SEQ ID NO: 3398226 - DNA, 21 bp, Homo sapiens
tggagtctgagtctgagtcct

SEQ ID NO: 3398227 - DNA, 13 bp, Homo sapiens
tggagtgagactg

SEQ ID NO: 3398228 - DNA, 14 bp, Homo sapiens
tggagtgagactga

SEQ ID NO: 3398229 - DNA, 12 bp, Homo sapiens
tggagtgcgctc

SEQ ID NO: 3398230 - DNA, 13 bp, Homo sapiens
tggagtttctaag

SEQ ID NO: 3398231 - DNA, 14 bp, Homo sapiens
tggagtttctaagg

SEQ ID NO: 3398232 - DNA, 17 bp, Homo sapiens
tggagttttaactgtaa

SEQ ID NO: 3398233 - DNA, 18 bp, Homo sapiens
tggataaatcatttcagt

SEQ ID NO: 3398234 - DNA, 21 bp, Homo sapiens
tggataacttaggtggcaagc

SEQ ID NO: 3398235 - DNA, 14 bp, Homo sapiens
tggatactacatct

SEQ ID NO: 3398236 - DNA, 15 bp, Homo sapiens
tggatactacatctt

SEQ ID NO: 3398237 - DNA, 22 bp, Homo sapiens
tggatacttggatttagtttca

SEQ ID NO: 3398238 - DNA, 14 bp, Homo sapiens
tggatataatgtat

SEQ ID NO: 3398239 - DNA, 17 bp, Homo sapiens
tggatattattagaaat

SEQ ID NO: 3398240 - DNA, 19 bp, Homo sapiens
tggatatttgatatttggt

SEQ ID NO: 3398241 - DNA, 13 bp, Homo sapiens
tggatatttgcac

SEQ ID NO: 3398242 - DNA, 23 bp, Homo sapiens
tggatattttcaaattgtatcta

SEQ ID NO: 3398243 - DNA, 17 bp, Homo sapiens
tggatcccctctgtcta

SEQ ID NO: 3398244 - DNA, 18 bp, Homo sapiens
tggatcccgaagaatgga

SEQ ID NO: 3398245 - DNA, 18 bp, Homo sapiens
tggatcgctaagctggct

SEQ ID NO: 3398246 - DNA, 18 bp, Homo sapiens
tggatctatttcatgttt

SEQ ID NO: 3398247 - DNA, 17 bp, Homo sapiens
tggatctctggttgtct

SEQ ID NO: 3398248 - DNA, 15 bp, Homo sapiens
tggatcttgaatgtg

SEQ ID NO: 3398249 - DNA, 18 bp, Homo sapiens
tggatcttgccacatttc

SEQ ID NO: 3398250 - DNA, 19 bp, Homo sapiens
tggatcttgccacatttct

SEQ ID NO: 3398251 - DNA, 14 bp, Homo sapiens
tggatgaaattttc

SEQ ID NO: 3398252 - DNA, 18 bp, Homo sapiens
tggatgaaattttctaga

SEQ ID NO: 3398253 - DNA, 14 bp, Homo sapiens
tggatgacattaaa

SEQ ID NO: 3398254 - DNA, 18 bp, Homo sapiens
tggatgattaaattttag

SEQ ID NO: 3398255 - DNA, 14 bp, Homo sapiens
tggatgcatttcaa

SEQ ID NO: 3398256 - DNA, 20 bp, Homo sapiens
tggatgcatttcaaatgtta

SEQ ID NO: 3398257 - DNA, 20 bp, Homo sapiens
tggatgccaatattaaatct

SEQ ID NO: 3398258 - DNA, 20 bp, Homo sapiens
tggatgccacagcccagctt

SEQ ID NO: 3398259 - DNA, 15 bp, Homo sapiens
tggatgcccagagga

SEQ ID NO: 3398260 - DNA, 19 bp, Homo sapiens
tggatgcctggtggcagct

SEQ ID NO: 3398261 - DNA, 21 bp, Homo sapiens
tggatgcctggtggcagctgc

SEQ ID NO: 3398262 - DNA, 23 bp, Homo sapiens
tggatgcgaggaccactttggag

SEQ ID NO: 3398263 - DNA, 19 bp, Homo sapiens
tggatggcacaatgaatgt

SEQ ID NO: 3398264 - DNA, 14 bp, Homo sapiens
tggatggcagactc

SEQ ID NO: 3398265 - DNA, 17 bp, Homo sapiens
tggatggccccagcaca

SEQ ID NO: 3398266 - DNA, 18 bp, Homo sapiens
tggatggccccagcacag

SEQ ID NO: 3398267 - DNA, 17 bp, Homo sapiens
tggatgggagtgggcac

SEQ ID NO: 3398268 - DNA, 23 bp, Homo sapiens
tggatgggagtgggcacctcaga

SEQ ID NO: 3398269 - DNA, 18 bp, Homo sapiens
tggatgggcattgggctg

SEQ ID NO: 3398270 - DNA, 19 bp, Homo sapiens
tggatgggcattgggctga

SEQ ID NO: 3398271 - DNA, 12 bp, Homo sapiens
tggatgtaaata

SEQ ID NO: 3398272 - DNA, 14 bp, Homo sapiens
tggatgtcttcctt

SEQ ID NO: 3398273 - DNA, 21 bp, Homo sapiens
tggattaaattagtttgtgaa

SEQ ID NO: 3398274 - DNA, 20 bp, Homo sapiens
tggattactgccattcactt

SEQ ID NO: 3398275 - DNA, 19 bp, Homo sapiens
tggattagaaatttaacat

SEQ ID NO: 3398276 - DNA, 14 bp, Homo sapiens
tggattattcattt

SEQ ID NO: 3398277 - DNA, 16 bp, Homo sapiens
tggattattcatttaa

SEQ ID NO: 3398278 - DNA, 14 bp, Homo sapiens
tggattatttaata

SEQ ID NO: 3398279 - DNA, 18 bp, Homo sapiens
tggattatttaataacat

SEQ ID NO: 3398280 - DNA, 20 bp, Homo sapiens
tggctcttatttctgaattc

SEQ ID NO: 3398281 - DNA, 24 bp, Homo sapiens
tggctcttatttctgaattcaaag

SEQ ID NO: 3398282 - DNA, 23 bp, Homo sapiens
tggctcttgatacccccctctgt

SEQ ID NO: 3398283 - DNA, 14 bp, Homo sapiens
tggctctttcagag

SEQ ID NO: 3398284 - DNA, 16 bp, Homo sapiens
tggctgaaaatgcaaa

SEQ ID NO: 3398285 - DNA, 22 bp, Homo sapiens
tggctgaaattctcctggaggt

SEQ ID NO: 3398286 - DNA, 15 bp, Homo sapiens
tggctgaaccctgtg

SEQ ID NO: 3398287 - DNA, 16 bp, Homo sapiens
tggctgaaccctgtgc

SEQ ID NO: 3398288 - DNA, 14 bp, Homo sapiens
tggctgactggcca

SEQ ID NO: 3398289 - DNA, 15 bp, Homo sapiens
tggctgactggccag

SEQ ID NO: 3398290 - DNA, 19 bp, Homo sapiens
tggctgactggggctgggg

SEQ ID NO: 3398291 - DNA, 14 bp, Homo sapiens
tggctgagatggag

SEQ ID NO: 3398292 - DNA, 15 bp, Homo sapiens
tggctgagggcagct

SEQ ID NO: 3398293 - DNA, 14 bp, Homo sapiens
tggctgaggggctt

SEQ ID NO: 3398294 - DNA, 12 bp, Homo sapiens
tggctgcaaagg

SEQ ID NO: 3398295 - DNA, 19 bp, Homo sapiens
tggctgcacctttttgcat

SEQ ID NO: 3398296 - DNA, 15 bp, Homo sapiens
tggctgcagggagtc

SEQ ID NO: 3398297 - DNA, 15 bp, Homo sapiens
tggctgcaggtggga

SEQ ID NO: 3398298 - DNA, 11 bp, Homo sapiens
tggctgccagg

SEQ ID NO: 3398299 - DNA, 21 bp, Homo sapiens
tggctgcccagacccctctgg

SEQ ID NO: 3398300 - DNA, 13 bp, Homo sapiens
tggctgccccggc

SEQ ID NO: 3398301 - DNA, 16 bp, Homo sapiens
tggctgccctggccct

SEQ ID NO: 3398302 - DNA, 15 bp, Homo sapiens
tggctgctgccccca

SEQ ID NO: 3398303 - DNA, 12 bp, Homo sapiens
tggctgcttctc

SEQ ID NO: 3398304 - DNA, 16 bp, Homo sapiens
tggctggaagagggtg

SEQ ID NO: 3398305 - DNA, 23 bp, Homo sapiens
tggctggagacgggtgggcggct

SEQ ID NO: 3398306 - DNA, 14 bp, Homo sapiens
tggctggcgcctgt

SEQ ID NO: 3398307 - DNA, 15 bp, Homo sapiens
tggctggctcctagg

SEQ ID NO: 3398308 - DNA, 13 bp, Homo sapiens
tggctggctgcag

SEQ ID NO: 3398309 - DNA, 16 bp, Homo sapiens
tggctgggactcctgg

SEQ ID NO: 3398310 - DNA, 17 bp, Homo sapiens
tggctgggactcctggt

SEQ ID NO: 3398311 - DNA, 20 bp, Homo sapiens
tggctgggcagagctgcatc

SEQ ID NO: 3398312 - DNA, 16 bp, Homo sapiens
tggctgggggcctcag

SEQ ID NO: 3398313 - DNA, 20 bp, Homo sapiens
tggctgggggcctcagtgcc

SEQ ID NO: 3398314 - DNA, 23 bp, Homo sapiens
tggctgggtcagggccagactgg

SEQ ID NO: 3398315 - DNA, 16 bp, Homo sapiens
tggctgggtgggccca

SEQ ID NO: 3398316 - DNA, 22 bp, Homo sapiens
tggctgggtgggcccagaactg

SEQ ID NO: 3398317 - DNA, 22 bp, Homo sapiens
tggctggtaacagttcatgttt

SEQ ID NO: 3398318 - DNA, 16 bp, Homo sapiens
tggctggtccagggct

SEQ ID NO: 3398319 - DNA, 17 bp, Homo sapiens
tggctggtgggaaggcc

SEQ ID NO: 3398320 - DNA, 16 bp, Homo sapiens
tggctgtaaggctcta

SEQ ID NO: 3398321 - DNA, 20 bp, Homo sapiens
tggctgtaaggctctagatc

SEQ ID NO: 3398322 - DNA, 21 bp, Homo sapiens
tggctgtaaggctctagatca

SEQ ID NO: 3398323 - DNA, 18 bp, Homo sapiens
tggctgtagatcccaaga

SEQ ID NO: 3398324 - DNA, 19 bp, Homo sapiens
tggctgtctgcctgtattt

SEQ ID NO: 3398325 - DNA, 19 bp, Homo sapiens
tggctgtgctctcaccagc

SEQ ID NO: 3398326 - DNA, 13 bp, Homo sapiens
tggctgtggaggc

SEQ ID NO: 3398327 - DNA, 17 bp, Homo sapiens
tggctgtggaggcctga

SEQ ID NO: 3398328 - DNA, 15 bp, Homo sapiens
tggctgtggcacaga

SEQ ID NO: 3398329 - DNA, 17 bp, Homo sapiens
tggctgtggcacagact

SEQ ID NO: 3398330 - DNA, 13 bp, Homo sapiens
tggctgttggctg

SEQ ID NO: 3398331 - DNA, 22 bp, Homo sapiens
tggcttaaaaatacttaataaa

SEQ ID NO: 3398332 - DNA, 19 bp, Homo sapiens
tggcttaaatatagttcct

SEQ ID NO: 3398333 - DNA, 16 bp, Homo sapiens
tggcttataaacacat

SEQ ID NO: 3398334 - DNA, 16 bp, Homo sapiens
tggcttatgaaagagg

SEQ ID NO: 3398335 - DNA, 18 bp, Homo sapiens
tggcttattttaatgtga

SEQ ID NO: 3398336 - DNA, 18 bp, Homo sapiens
tggcttcaagttgtaaaa

SEQ ID NO: 3398337 - DNA, 20 bp, Homo sapiens
tggcttccagcttcaggcac

SEQ ID NO: 3398338 - DNA, 21 bp, Homo sapiens
tggcttccagcttcaggcacc

SEQ ID NO: 3398339 - DNA, 20 bp, Homo sapiens
tggcttcccatagtggggcc

SEQ ID NO: 3398340 - DNA, 15 bp, Homo sapiens
tggcttcccgctcag

SEQ ID NO: 3398341 - DNA, 20 bp, Homo sapiens
tggcttcccgctcagccctc

SEQ ID NO: 3398342 - DNA, 22 bp, Homo sapiens
tggcttcctaaaattcagtgga

SEQ ID NO: 3398343 - DNA, 15 bp, Homo sapiens
tggcttcctccgtcc

SEQ ID NO: 3398344 - DNA, 15 bp, Homo sapiens
tggcttctgggagat

SEQ ID NO: 3398345 - DNA, 21 bp, Homo sapiens
tggcttctgtgatgagctgat

SEQ ID NO: 3398346 - DNA, 17 bp, Homo sapiens
tggcttgacatgtgcaa

SEQ ID NO: 3398347 - DNA, 20 bp, Homo sapiens
tggcttgcccgcgctctttc

SEQ ID NO: 3398348 - DNA, 14 bp, Homo sapiens
tggcttgctccagg

SEQ ID NO: 3398349 - DNA, 16 bp, Homo sapiens
tggcttggccttggca

SEQ ID NO: 3398350 - DNA, 18 bp, Homo sapiens
tggcttgtagaattgtta

SEQ ID NO: 3398351 - DNA, 19 bp, Homo sapiens
tggcttgtagaattgttat

SEQ ID NO: 3398352 - DNA, 24 bp, Homo sapiens
tggcttgtatcaacactgttactt

SEQ ID NO: 3398353 - DNA, 14 bp, Homo sapiens
tggcttgtgaactg

SEQ ID NO: 3398354 - DNA, 19 bp, Homo sapiens
tggcttgtgaactgctgga

SEQ ID NO: 3398355 - DNA, 18 bp, Homo sapiens
tggcttgtgtgtttcact

SEQ ID NO: 3398356 - DNA, 19 bp, Homo sapiens
tggcttgtgtgtttcactt

SEQ ID NO: 3398357 - DNA, 16 bp, Homo sapiens
tggcttgtttgatttc

SEQ ID NO: 3398358 - DNA, 17 bp, Homo sapiens
tggctttaattgtataa

SEQ ID NO: 3398359 - DNA, 19 bp, Homo sapiens
tggctttacctttttgtat

SEQ ID NO: 3398360 - DNA, 16 bp, Homo sapiens
tggctttatgcacatt

SEQ ID NO: 3398361 - DNA, 19 bp, Homo sapiens
tggctttcaaagctaaaat

SEQ ID NO: 3398362 - DNA, 17 bp, Homo sapiens
tggctttcctgtttcta

SEQ ID NO: 3398363 - DNA, 21 bp, Homo sapiens
tggctttccttgtggcagagg

SEQ ID NO: 3398364 - DNA, 16 bp, Homo sapiens
tggctttgatgataaa

SEQ ID NO: 3398365 - DNA, 20 bp, Homo sapiens
tggctttgggaaagcccaga

SEQ ID NO: 3398366 - DNA, 20 bp, Homo sapiens
tggctttgtgattcaatctg

SEQ ID NO: 3398367 - DNA, 12 bp, Homo sapiens
tggcttttactt

SEQ ID NO: 3398368 - DNA, 20 bp, Homo sapiens
tggcttttactttattaata

SEQ ID NO: 3398369 - DNA, 15 bp, Homo sapiens
tggcttttcactgct

SEQ ID NO: 3398370 - DNA, 21 bp, Homo sapiens
tggctttttcctctgagccca

SEQ ID NO: 3398371 - DNA, 22 bp, Homo sapiens
tggctttttcctctgagcccag

SEQ ID NO: 3398372 - DNA, 20 bp, Homo sapiens
tgggaaaaaagttttgatga

SEQ ID NO: 3398373 - DNA, 18 bp, Homo sapiens
tgggaaacttggctcgaa

SEQ ID NO: 3398374 - DNA, 16 bp, Homo sapiens
tgggaaagatggataa

SEQ ID NO: 3398375 - DNA, 19 bp, Homo sapiens
tgggaaagatggataaact

SEQ ID NO: 3398376 - DNA, 16 bp, Homo sapiens
tgggaaagccacctct

SEQ ID NO: 3398377 - DNA, 13 bp, Homo sapiens
tgggaaagcccag

SEQ ID NO: 3398378 - DNA, 14 bp, Homo sapiens
tgggaaccccgcag

SEQ ID NO: 3398379 - DNA, 21 bp, Homo sapiens
tgggaagacgcctgagctcac

SEQ ID NO: 3398380 - DNA, 20 bp, Homo sapiens
tgggaagataggctctgcac

SEQ ID NO: 3398381 - DNA, 12 bp, Homo sapiens
tgggaagcagga

SEQ ID NO: 3398382 - DNA, 13 bp, Homo sapiens
tgggaagcaggac

SEQ ID NO: 3398383 - DNA, 15 bp, Homo sapiens
tgggaagctgagggc

SEQ ID NO: 3398384 - DNA, 21 bp, Homo sapiens
tgggaagctgtactcagagca

SEQ ID NO: 3398385 - DNA, 23 bp, Homo sapiens
tgggaagctgtactcagagcaga

SEQ ID NO: 3398386 - DNA, 12 bp, Homo sapiens
tgggaaggactt

SEQ ID NO: 3398387 - DNA, 16 bp, Homo sapiens
tgggaaggccagctgc

SEQ ID NO: 3398388 - DNA, 14 bp, Homo sapiens
tgggaaggctaagt

SEQ ID NO: 3398389 - DNA, 19 bp, Homo sapiens
tgggaaggctaagttcagt

SEQ ID NO: 3398390 - DNA, 15 bp, Homo sapiens
tgggaagtgaagact

SEQ ID NO: 3398391 - DNA, 16 bp, Homo sapiens
tgggaataattgcttt

SEQ ID NO: 3398392 - DNA, 15 bp, Homo sapiens
tgggaatgagacata

SEQ ID NO: 3398393 - DNA, 16 bp, Homo sapiens
tgggaatgaggaaaat

SEQ ID NO: 3398394 - DNA, 22 bp, Homo sapiens
tgggaatgtattattctgcagc

SEQ ID NO: 3398395 - DNA, 14 bp, Homo sapiens
tgggaattgtgtgt

SEQ ID NO: 3398396 - DNA, 19 bp, Homo sapiens
tgggaatttgtcagcgttc

SEQ ID NO: 3398397 - DNA, 17 bp, Homo sapiens
tgggacaattgttttaa

SEQ ID NO: 3398398 - DNA, 13 bp, Homo sapiens
tgggacaccaggg

SEQ ID NO: 3398399 - DNA, 22 bp, Homo sapiens
tgggacagaggagcaaggttta

SEQ ID NO: 3398400 - DNA, 15 bp, Homo sapiens
tgggacagccagagc

SEQ ID NO: 3398401 - DNA, 14 bp, Homo sapiens
tgggacagcccaga

SEQ ID NO: 3398402 - DNA, 20 bp, Homo sapiens
tgggacagcccagagcctgg

SEQ ID NO: 3398403 - DNA, 12 bp, Homo sapiens
tgggacagcctc

SEQ ID NO: 3398404 - DNA, 15 bp, Homo sapiens
tgggacagcctcttc

SEQ ID NO: 3398405 - DNA, 22 bp, Homo sapiens
tgggacagcctcttcagcccct

SEQ ID NO: 3398406 - DNA, 18 bp, Homo sapiens
tggggagggattctggtt

SEQ ID NO: 3398407 - DNA, 19 bp, Homo sapiens
tggggaggggcgctggccc

SEQ ID NO: 3398408 - DNA, 20 bp, Homo sapiens
tggggaggggcgctggccca

SEQ ID NO: 3398409 - DNA, 21 bp, Homo sapiens
tggggaggggcgctggcccag

SEQ ID NO: 3398410 - DNA, 16 bp, Homo sapiens
tggggagggggaagag

SEQ ID NO: 3398411 - DNA, 22 bp, Homo sapiens
tggggatccccgcctggccagg

SEQ ID NO: 3398412 - DNA, 18 bp, Homo sapiens
tggggatctcaggggctg

SEQ ID NO: 3398413 - DNA, 23 bp, Homo sapiens
tggggatgagaaaggttgaagca

SEQ ID NO: 3398414 - DNA, 21 bp, Homo sapiens
tggggatggggcctccctcct

SEQ ID NO: 3398415 - DNA, 14 bp, Homo sapiens
tggggcatcctgga

SEQ ID NO: 3398416 - DNA, 16 bp, Homo sapiens
tggggcatgtgtgcct

SEQ ID NO: 3398417 - DNA, 14 bp, Homo sapiens
tggggccaggccag

SEQ ID NO: 3398418 - DNA, 19 bp, Homo sapiens
tggggccaggccaggacca

SEQ ID NO: 3398419 - DNA, 15 bp, Homo sapiens
tggggccaggtcacc

SEQ ID NO: 3398420 - DNA, 15 bp, Homo sapiens
tggggcccaggaagc

SEQ ID NO: 3398421 - DNA, 17 bp, Homo sapiens
tggggcccaggaagccc

SEQ ID NO: 3398422 - DNA, 12 bp, Homo sapiens
tggggccctgcc

SEQ ID NO: 3398423 - DNA, 16 bp, Homo sapiens
tggggccctgggcctc

SEQ ID NO: 3398424 - DNA, 19 bp, Homo sapiens
tggggccgccacggcctgg

SEQ ID NO: 3398425 - DNA, 19 bp, Homo sapiens
tggggccggtagaggctcc

SEQ ID NO: 3398426 - DNA, 14 bp, Homo sapiens
tggggcctcagacg

SEQ ID NO: 3398427 - DNA, 14 bp, Homo sapiens
tggggcctccagaa

SEQ ID NO: 3398428 - DNA, 20 bp, Homo sapiens
tggggcctccagaactcact

SEQ ID NO: 3398429 - DNA, 11 bp, Homo sapiens
tggggcctggc

SEQ ID NO: 3398430 - DNA, 14 bp, Homo sapiens
tggggcctggccca

SEQ ID NO: 3398431 - DNA, 12 bp, Homo sapiens
tggggcctggct

SEQ ID NO: 3398432 - DNA, 23 bp, Homo sapiens
tggggcctggcttgctccagggt

SEQ ID NO: 3398433 - DNA, 14 bp, Homo sapiens
tggggcggggccca

SEQ ID NO: 3398434 - DNA, 19 bp, Homo sapiens
tggggcgtggggagggccg

SEQ ID NO: 3398435 - DNA, 22 bp, Homo sapiens
tggggctcacttttcatccttc

SEQ ID NO: 3398436 - DNA, 16 bp, Homo sapiens
tggggctcccagctcc

SEQ ID NO: 3398437 - DNA, 17 bp, Homo sapiens
tggggctcccagctcct

SEQ ID NO: 3398438 - DNA, 12 bp, Homo sapiens
tggggctccccg

SEQ ID NO: 3398439 - DNA, 11 bp, Homo sapiens
tggggctcctt

SEQ ID NO: 3398440 - DNA, 15 bp, Homo sapiens
tggggctcgtggcct

SEQ ID NO: 3398441 - DNA, 20 bp, Homo sapiens
tggggctcgtggccttcccc

SEQ ID NO: 3398442 - DNA, 13 bp, Homo sapiens
tggggctctggga

SEQ ID NO: 3398443 - DNA, 15 bp, Homo sapiens
tggggctctgtgcag

SEQ ID NO: 3398444 - DNA, 13 bp, Homo sapiens
tggggctggggtg

SEQ ID NO: 3398445 - DNA, 22 bp, Homo sapiens
tggggctgtcgggggctgtgga

SEQ ID NO: 3398446 - DNA, 15 bp, Homo sapiens
tggggcttctcctga

SEQ ID NO: 3398447 - DNA, 18 bp, Homo sapiens
tggggctttgccttgcag

SEQ ID NO: 3398448 - DNA, 21 bp, Homo sapiens
tggggctttgccttgcagcca

SEQ ID NO: 3398449 - DNA, 15 bp, Homo sapiens
tgggggaaaaaaagt

SEQ ID NO: 3398450 - DNA, 23 bp, Homo sapiens
tgggggaatgagcccagagaaca

SEQ ID NO: 3398451 - DNA, 20 bp, Homo sapiens
tgggggacagaaagagactc

SEQ ID NO: 3398452 - DNA, 17 bp, Homo sapiens
tgggggacgtttctcat

SEQ ID NO: 3398453 - DNA, 19 bp, Homo sapiens
tgggggaggggggggtggg

SEQ ID NO: 3398454 - DNA, 21 bp, Homo sapiens
tgggggagtagatctttctag

SEQ ID NO: 3398455 - DNA, 13 bp, Homo sapiens
tgggggcaagaag

SEQ ID NO: 3398456 - DNA, 18 bp, Homo sapiens
tgggggcagtgactggca

SEQ ID NO: 3398457 - DNA, 21 bp, Homo sapiens
tgggggcgccctctctgctcc

SEQ ID NO: 3398458 - DNA, 22 bp, Homo sapiens
tgggggcgccctctctgctcct

SEQ ID NO: 3398459 - DNA, 21 bp, Homo sapiens
tgggggctgcagcatgttgct

SEQ ID NO: 3398460 - DNA, 14 bp, Homo sapiens
tgggggctggcctc

SEQ ID NO: 3398461 - DNA, 14 bp, Homo sapiens
tggggggccgggca

SEQ ID NO: 3398462 - DNA, 20 bp, Homo sapiens
tggggggccgggcaggtcct

SEQ ID NO: 3398463 - DNA, 15 bp, Homo sapiens
tggggggctgatggc

SEQ ID NO: 3398464 - DNA, 23 bp, Homo sapiens
tgggggggtggccgctgagtggc

SEQ ID NO: 3398465 - DNA, 12 bp, Homo sapiens
tggggggtgcag

SEQ ID NO: 3398466 - DNA, 14 bp, Homo sapiens
tgggggtgacccca

SEQ ID NO: 3398467 - DNA, 15 bp, Homo sapiens
tgggggtgagggtcc

SEQ ID NO: 3398468 - DNA, 16 bp, Homo sapiens
tgggggtggcaggcac

SEQ ID NO: 3398469 - DNA, 13 bp, Homo sapiens
tgggggtggctgg

SEQ ID NO: 3398470 - DNA, 14 bp, Homo sapiens
tgggggtggctggg

SEQ ID NO: 3398471 - DNA, 20 bp, Homo sapiens
tgggggttctttcttcctct

SEQ ID NO: 3398472 - DNA, 12 bp, Homo sapiens
tgggggttgctg

SEQ ID NO: 3398473 - DNA, 16 bp, Homo sapiens
tggggtaagccagagc

SEQ ID NO: 3398474 - DNA, 15 bp, Homo sapiens
tggggtacccactgc

SEQ ID NO: 3398475 - DNA, 17 bp, Homo sapiens
tggggtacccactgctc

SEQ ID NO: 3398476 - DNA, 18 bp, Homo sapiens
tggggtagaaacattgta

SEQ ID NO: 3398477 - DNA, 19 bp, Homo sapiens
tggggtagaaacattgtaa

SEQ ID NO: 3398478 - DNA, 16 bp, Homo sapiens
tggggtagggctgact

SEQ ID NO: 3398479 - DNA, 16 bp, Homo sapiens
tggggtataggtctca

SEQ ID NO: 3398480 - DNA, 22 bp, Homo sapiens
tggggtattggacatagatatt

SEQ ID NO: 3398481 - DNA, 20 bp, Homo sapiens
tggggtcaagaaacagccag

SEQ ID NO: 3398482 - DNA, 13 bp, Homo sapiens
tggggtccccatc

SEQ ID NO: 3398483 - DNA, 15 bp, Homo sapiens
tggggtccctccacc

SEQ ID NO: 3398484 - DNA, 17 bp, Homo sapiens
tggggtccctccacccc

SEQ ID NO: 3398485 - DNA, 21 bp, Homo sapiens
tggggtctcacagtgttgccc

SEQ ID NO: 3398486 - DNA, 10 bp, Homo sapiens
tggggtctct

SEQ ID NO: 3398487 - DNA, 19 bp, Homo sapiens
tggggtctgagcatgatgg

SEQ ID NO: 3398488 - DNA, 11 bp, Homo sapiens
tggggtgacag

SEQ ID NO: 3398489 - DNA, 14 bp, Homo sapiens
tggggtgacagtca

SEQ ID NO: 3398490 - DNA, 23 bp, Homo sapiens
tggggtgacagtcatcatcaggg

SEQ ID NO: 3398491 - DNA, 13 bp, Homo sapiens
tggggtgagagag

SEQ ID NO: 3398492 - DNA, 15 bp, Homo sapiens
tggggtgcatcctcc

SEQ ID NO: 3398493 - DNA, 23 bp, Homo sapiens
tggggtgcatcctcctcagcccc

SEQ ID NO: 3398494 - DNA, 13 bp, Homo sapiens
tggggtgctggga

SEQ ID NO: 3398495 - DNA, 18 bp, Homo sapiens
tggggtgctgggaggagg

SEQ ID NO: 3398496 - DNA, 13 bp, Homo sapiens
tggggtggcctca

SEQ ID NO: 3398497 - DNA, 15 bp, Homo sapiens
tggggtgtgctggga

SEQ ID NO: 3398498 - DNA, 14 bp, Homo sapiens
tggggttgtgttgt

SEQ ID NO: 3398499 - DNA, 16 bp, Homo sapiens
tggggtttgaagctga

SEQ ID NO: 3398500 - DNA, 19 bp, Homo sapiens
tgggtaaaagcagggcagc

SEQ ID NO: 3398501 - DNA, 20 bp, Homo sapiens
tgggtaaatgcaaagttctg

SEQ ID NO: 3398502 - DNA, 12 bp, Homo sapiens
tgggtaagaaga

SEQ ID NO: 3398503 - DNA, 23 bp, Homo sapiens
tgggtacttgtggacacagctct

SEQ ID NO: 3398504 - DNA, 15 bp, Homo sapiens
tgggtagatgggtgg

SEQ ID NO: 3398505 - DNA, 16 bp, Homo sapiens
tgggtatgttcctaag

SEQ ID NO: 3398506 - DNA, 17 bp, Homo sapiens
tgggtcaaaaaaaagaa

SEQ ID NO: 3398507 - DNA, 18 bp, Homo sapiens
tgggtcactacagggaga

SEQ ID NO: 3398508 - DNA, 18 bp, Homo sapiens
tgggtcagaacatgttaa

SEQ ID NO: 3398509 - DNA, 19 bp, Homo sapiens
tgggtcagaacatgttaag

SEQ ID NO: 3398510 - DNA, 20 bp, Homo sapiens
tgggtcattgacctctcagg

SEQ ID NO: 3398511 - DNA, 13 bp, Homo sapiens
tgggtccaaataa

SEQ ID NO: 3398512 - DNA, 16 bp, Homo sapiens
tgggtccaaataaaaa

SEQ ID NO: 3398513 - DNA, 22 bp, Homo sapiens
tgggtccaaataaaaactaaat

SEQ ID NO: 3398514 - DNA, 15 bp, Homo sapiens
tgggtccaagagaca

SEQ ID NO: 3398515 - DNA, 12 bp, Homo sapiens
tgggtccaggaa

SEQ ID NO: 3398516 - DNA, 18 bp, Homo sapiens
tgggtccaggaaggcagc

SEQ ID NO: 3398517 - DNA, 21 bp, Homo sapiens
tgggtccaggaaggcagctgc

SEQ ID NO: 3398518 - DNA, 18 bp, Homo sapiens
tgggtcccttgaaggaag

SEQ ID NO: 3398519 - DNA, 21 bp, Homo sapiens
tgggtctaggacacagttcct

SEQ ID NO: 3398520 - DNA, 22 bp, Homo sapiens
tgggtctcgctttgttgcccag

SEQ ID NO: 3398521 - DNA, 19 bp, Homo sapiens
tgggtctgtgtctcttttc

SEQ ID NO: 3398522 - DNA, 17 bp, Homo sapiens
tgggtcttatgcttcca

SEQ ID NO: 3398523 - DNA, 18 bp, Homo sapiens
tgggtgaaggcctggctg

SEQ ID NO: 3398524 - DNA, 18 bp, Homo sapiens
tgggtgacaagagcctga

SEQ ID NO: 3398525 - DNA, 14 bp, Homo sapiens
tgggtgacagagca

SEQ ID NO: 3398526 - DNA, 12 bp, Homo sapiens
tgggtgagagag

SEQ ID NO: 3398527 - DNA, 13 bp, Homo sapiens
tgggtgagagagg

SEQ ID NO: 3398528 - DNA, 20 bp, Homo sapiens
tgggtgattcctaagccact

SEQ ID NO: 3398529 - DNA, 14 bp, Homo sapiens
tgggtgctcagaat

SEQ ID NO: 3398530 - DNA, 15 bp, Homo sapiens
tgggtgctcagaata

SEQ ID NO: 3398531 - DNA, 13 bp, Homo sapiens
tgggtgctgccct

SEQ ID NO: 3398532 - DNA, 17 bp, Homo sapiens
tgggtgctgccctgtgt

SEQ ID NO: 3398533 - DNA, 23 bp, Homo sapiens
tgtaacttatgtagatatttggc

SEQ ID NO: 3398534 - DNA, 16 bp, Homo sapiens
tgtaacttttgtaaga

SEQ ID NO: 3398535 - DNA, 21 bp, Homo sapiens
tgtaagaaaacaaactaaatg

SEQ ID NO: 3398536 - DNA, 17 bp, Homo sapiens
tgtaagaagagactggg

SEQ ID NO: 3398537 - DNA, 18 bp, Homo sapiens
tgtaagagcaccttcctc

SEQ ID NO: 3398538 - DNA, 19 bp, Homo sapiens
tgtaagagtgtagaagcat

SEQ ID NO: 3398539 - DNA, 22 bp, Homo sapiens
tgtaagatatttgcagtttttc

SEQ ID NO: 3398540 - DNA, 18 bp, Homo sapiens
tgtaagattatagattct

SEQ ID NO: 3398541 - DNA, 14 bp, Homo sapiens
tgtaagcctgcaag

SEQ ID NO: 3398542 - DNA, 15 bp, Homo sapiens
tgtaagcctgcaagc

SEQ ID NO: 3398543 - DNA, 22 bp, Homo sapiens
tgtaagctctactgaggtgcta

SEQ ID NO: 3398544 - DNA, 15 bp, Homo sapiens
tgtaagctctttgaa

SEQ ID NO: 3398545 - DNA, 14 bp, Homo sapiens
tgtaaggctctaga

SEQ ID NO: 3398546 - DNA, 21 bp, Homo sapiens
tgtaagtaccctgatgccttt

SEQ ID NO: 3398547 - DNA, 21 bp, Homo sapiens
tgtaagtgtgagtaagagctg

SEQ ID NO: 3398548 - DNA, 13 bp, Homo sapiens
tgtaagttgtaca

SEQ ID NO: 3398549 - DNA, 14 bp, Homo sapiens
tgtaagttgtacaa

SEQ ID NO: 3398550 - DNA, 18 bp, Homo sapiens
tgtaagttgtacaaatgt

SEQ ID NO: 3398551 - DNA, 13 bp, Homo sapiens
tgtaagtttcagg

SEQ ID NO: 3398552 - DNA, 15 bp, Homo sapiens
tgtaagtttcaggtg

SEQ ID NO: 3398553 - DNA, 16 bp, Homo sapiens
tgtaagtttcaggtga

SEQ ID NO: 3398554 - DNA, 20 bp, Homo sapiens
tgtaagtttcaggtgacatg

SEQ ID NO: 3398555 - DNA, 23 bp, Homo sapiens
tgtaagtttcaggtgacatgtga

SEQ ID NO: 3398556 - DNA, 20 bp, Homo sapiens
tgtaataaaaagtatatgtt

SEQ ID NO: 3398557 - DNA, 13 bp, Homo sapiens
tgtaataaagtat

SEQ ID NO: 3398558 - DNA, 15 bp, Homo sapiens
tgtaataaagtatat

SEQ ID NO: 3398559 - DNA, 13 bp, Homo sapiens
tgtaataaagtgt

SEQ ID NO: 3398560 - DNA, 13 bp, Homo sapiens
tgtaataaatact

SEQ ID NO: 3398561 - DNA, 15 bp, Homo sapiens
tgtaataaatactgc

SEQ ID NO: 3398562 - DNA, 14 bp, Homo sapiens
tgtaataactgtga

SEQ ID NO: 3398563 - DNA, 22 bp, Homo sapiens
tgtaataactgtgaagtttaca

SEQ ID NO: 3398564 - DNA, 18 bp, Homo sapiens
tgtaatagaaaactgaaa

SEQ ID NO: 3398565 - DNA, 23 bp, Homo sapiens
tgtaatagttcagtagaattacc

SEQ ID NO: 3398566 - DNA, 21 bp, Homo sapiens
tgtaatataaagtattcaaca

SEQ ID NO: 3398567 - DNA, 23 bp, Homo sapiens
tgtaatataaagtattcaacaat

SEQ ID NO: 3398568 - DNA, 15 bp, Homo sapiens
tgtaatatattgtac

SEQ ID NO: 3398569 - DNA, 15 bp, Homo sapiens
tgtaatcactcccat

SEQ ID NO: 3398570 - DNA, 14 bp, Homo sapiens
tgtaatcatttgtt

SEQ ID NO: 3398571 - DNA, 19 bp, Homo sapiens
tgtaatcatttgtttacat

SEQ ID NO: 3398572 - DNA, 16 bp, Homo sapiens
tgtaatcccagcactt

SEQ ID NO: 3398573 - DNA, 22 bp, Homo sapiens
tgtaatcccagctacttgggag

SEQ ID NO: 3398574 - DNA, 22 bp, Homo sapiens
tgtaatgaatttgtcgcaaaga

SEQ ID NO: 3398575 - DNA, 12 bp, Homo sapiens
tgtaatgcactg

SEQ ID NO: 3398576 - DNA, 18 bp, Homo sapiens
tgtaatgctgcacttcct

SEQ ID NO: 3398577 - DNA, 20 bp, Homo sapiens
tgtaatgctgcacttcctgt

SEQ ID NO: 3398578 - DNA, 19 bp, Homo sapiens
tgtaatggtactgactttg

SEQ ID NO: 3398579 - DNA, 21 bp, Homo sapiens
tgtaatggtactgactttgct

SEQ ID NO: 3398580 - DNA, 22 bp, Homo sapiens
tgtaatgtccctttcagagaca

SEQ ID NO: 3398581 - DNA, 21 bp, Homo sapiens
tgtaatgtgtggtggcctcag

SEQ ID NO: 3398582 - DNA, 13 bp, Homo sapiens
tgtaatgttactg

SEQ ID NO: 3398583 - DNA, 17 bp, Homo sapiens
tgtaatgttactgatca

SEQ ID NO: 3398584 - DNA, 17 bp, Homo sapiens
tgtaattaaattatggt

SEQ ID NO: 3398585 - DNA, 18 bp, Homo sapiens
tgtaattaagtactatgt

SEQ ID NO: 3398586 - DNA, 16 bp, Homo sapiens
tgtaattaatatcttg

SEQ ID NO: 3398587 - DNA, 14 bp, Homo sapiens
tgtaattagctctg

SEQ ID NO: 3398588 - DNA, 15 bp, Homo sapiens
tgtaattagctctgg

SEQ ID NO: 3398589 - DNA, 21 bp, Homo sapiens
tgtaattagtgccacttaatg

SEQ ID NO: 3398590 - DNA, 16 bp, Homo sapiens
tgtaattctaaatgaa

SEQ ID NO: 3398591 - DNA, 15 bp, Homo sapiens
tgtaattgaataaag

SEQ ID NO: 3398592 - DNA, 16 bp, Homo sapiens
tgtaattgtgtggatt

SEQ ID NO: 3398593 - DNA, 20 bp, Homo sapiens
tgtaattgtgtggattcttt

SEQ ID NO: 3398594 - DNA, 14 bp, Homo sapiens
tgtaatttaaacag

SEQ ID NO: 3398595 - DNA, 15 bp, Homo sapiens
tgtaatttaaacagg

SEQ ID NO: 3398596 - DNA, 20 bp, Homo sapiens
tgtaatttagaaactgattt

SEQ ID NO: 3398597 - DNA, 20 bp, Homo sapiens
tgtaatttagggtactaaat

SEQ ID NO: 3398598 - DNA, 23 bp, Homo sapiens
tgtaatttagggtactaaattta

SEQ ID NO: 3398599 - DNA, 16 bp, Homo sapiens
tgtaatttataaaatt

SEQ ID NO: 3398600 - DNA, 13 bp, Homo sapiens
tgtaatttatgca

SEQ ID NO: 3398601 - DNA, 17 bp, Homo sapiens
tgtaatttgtgtaataa

SEQ ID NO: 3398602 - DNA, 21 bp, Homo sapiens
tgtaattttaaaagtctattt

SEQ ID NO: 3398603 - DNA, 23 bp, Homo sapiens
tgtaattttaaaagtctatttta

SEQ ID NO: 3398604 - DNA, 20 bp, Homo sapiens
tgtaattttattttaaaatt

SEQ ID NO: 3398605 - DNA, 23 bp, Homo sapiens
tgtaatttttggggaaaaaagca

SEQ ID NO: 3398606 - DNA, 17 bp, Homo sapiens
tgtacaaaataaacaaa

SEQ ID NO: 3398607 - DNA, 24 bp, Homo sapiens
tgtacaaaattaagcaaatgttaa

SEQ ID NO: 3398608 - DNA, 23 bp, Homo sapiens
tgtacaaagtagaagtcttagat

SEQ ID NO: 3398609 - DNA, 17 bp, Homo sapiens
tgtacaaagttttcctt

SEQ ID NO: 3398610 - DNA, 15 bp, Homo sapiens
tgtacaaatgtattt

SEQ ID NO: 3398611 - DNA, 16 bp, Homo sapiens
tgtacaaatgtatttt

SEQ ID NO: 3398612 - DNA, 18 bp, Homo sapiens
tgtacaaatgtattttga

SEQ ID NO: 3398613 - DNA, 16 bp, Homo sapiens
tgtacaagatgaagga

SEQ ID NO: 3398614 - DNA, 17 bp, Homo sapiens
tgtacaagttttgtata

SEQ ID NO: 3398615 - DNA, 23 bp, Homo sapiens
tgtacaagttttgtataaataat

SEQ ID NO: 3398616 - DNA, 19 bp, Homo sapiens
tgtacaatcaaaacacact

SEQ ID NO: 3398617 - DNA, 15 bp, Homo sapiens
tgtacaatcatgaac

SEQ ID NO: 3398618 - DNA, 23 bp, Homo sapiens
tgtacaatcatgaacagctctga

SEQ ID NO: 3398619 - DNA, 22 bp, Homo sapiens
tgtacacatgggagtttagtgt

SEQ ID NO: 3398620 - DNA, 16 bp, Homo sapiens
tgtacacattcctgca

SEQ ID NO: 3398621 - DNA, 17 bp, Homo sapiens
tgtacacgtgtcctgta

SEQ ID NO: 3398622 - DNA, 16 bp, Homo sapiens
tgtacactaacatttc

SEQ ID NO: 3398623 - DNA, 19 bp, Homo sapiens
tgtacactgaatatttata

SEQ ID NO: 3398624 - DNA, 20 bp, Homo sapiens
tgtacactgaatatttatat

SEQ ID NO: 3398625 - DNA, 13 bp, Homo sapiens
tgtacactgctgt

SEQ ID NO: 3398626 - DNA, 18 bp, Homo sapiens
tgtacagactgttttact

SEQ ID NO: 3398627 - DNA, 14 bp, Homo sapiens
tgtacagattcttt

SEQ ID NO: 3398628 - DNA, 20 bp, Homo sapiens
tgtacagattttatttgtaa

SEQ ID NO: 3398629 - DNA, 18 bp, Homo sapiens
tgtacagctcccttccct

SEQ ID NO: 3398630 - DNA, 12 bp, Homo sapiens
tgtacagctctc

SEQ ID NO: 3398631 - DNA, 20 bp, Homo sapiens
tgtacagctctcccctccct

SEQ ID NO: 3398632 - DNA, 17 bp, Homo sapiens
tgtacagtagattttcc

SEQ ID NO: 3398633 - DNA, 16 bp, Homo sapiens
tgtacagtctgtcatg

SEQ ID NO: 3398634 - DNA, 22 bp, Homo sapiens
tgtacataaaattttctagaaa

SEQ ID NO: 3398635 - DNA, 13 bp, Homo sapiens
tgtacataactga

SEQ ID NO: 3398636 - DNA, 15 bp, Homo sapiens
tgtacataactgaaa

SEQ ID NO: 3398637 - DNA, 17 bp, Homo sapiens
tgtacataactgaaaat

SEQ ID NO: 3398638 - DNA, 22 bp, Homo sapiens
tgtacataatgcttaatttcta

SEQ ID NO: 3398639 - DNA, 23 bp, Homo sapiens
tgtacataatgcttaatttctaa

SEQ ID NO: 3398640 - DNA, 15 bp, Homo sapiens
tgtacatatgtgctg

SEQ ID NO: 3398641 - DNA, 18 bp, Homo sapiens
tgtacatatttgtggaat

SEQ ID NO: 3398642 - DNA, 19 bp, Homo sapiens
tgtacatatttgtggaata

SEQ ID NO: 3398643 - DNA, 17 bp, Homo sapiens
tgtacatcatgttattt

SEQ ID NO: 3398644 - DNA, 20 bp, Homo sapiens
tgtacatcatgttattttat

SEQ ID NO: 3398645 - DNA, 20 bp, Homo sapiens
tgtacatctattttggattg

SEQ ID NO: 3398646 - DNA, 14 bp, Homo sapiens
tgtacatctggcct

SEQ ID NO: 3398647 - DNA, 19 bp, Homo sapiens
tgtacatggcagagtttgt

SEQ ID NO: 3398648 - DNA, 21 bp, Homo sapiens
tgtacatgtgtagcctgtgca

SEQ ID NO: 3398649 - DNA, 14 bp, Homo sapiens
tgtacattaattac

SEQ ID NO: 3398650 - DNA, 15 bp, Homo sapiens
tgtacattctgccta

SEQ ID NO: 3398651 - DNA, 16 bp, Homo sapiens
tgtacattctgcctag

SEQ ID NO: 3398652 - DNA, 14 bp, Homo sapiens
tgtacatttaaaat

SEQ ID NO: 3398653 - DNA, 22 bp, Homo sapiens
tgtacattttgttgtaaaaaga

SEQ ID NO: 3398654 - DNA, 13 bp, Homo sapiens
tgtaccaaaattt

SEQ ID NO: 3398655 - DNA, 16 bp, Homo sapiens
tgtaccaaatctgaca

SEQ ID NO: 3398656 - DNA, 21 bp, Homo sapiens
tgtaccaaatctgacatatta

SEQ ID NO: 3398657 - DNA, 15 bp, Homo sapiens
tgtaccacagacaca

SEQ ID NO: 3398658 - DNA, 17 bp, Homo sapiens
tgtcatatgactgatta

SEQ ID NO: 3398659 - DNA, 15 bp, Homo sapiens
tgtcatcaattgaat

SEQ ID NO: 3398660 - DNA, 13 bp, Homo sapiens
tgtcatcactccc

SEQ ID NO: 3398661 - DNA, 18 bp, Homo sapiens
tgtcatcactccctggat

SEQ ID NO: 3398662 - DNA, 16 bp, Homo sapiens
tgtcatcagaagataa

SEQ ID NO: 3398663 - DNA, 14 bp, Homo sapiens
tgtcatcagatgga

SEQ ID NO: 3398664 - DNA, 20 bp, Homo sapiens
tgtcatcctcaaagaaagtg

SEQ ID NO: 3398665 - DNA, 16 bp, Homo sapiens
tgtcatcctctggaag

SEQ ID NO: 3398666 - DNA, 16 bp, Homo sapiens
tgtcatctctctgggg

SEQ ID NO: 3398667 - DNA, 22 bp, Homo sapiens
tgtcatctctctggggccctgg

SEQ ID NO: 3398668 - DNA, 23 bp, Homo sapiens
tgtcatctctctggggccctggg

SEQ ID NO: 3398669 - DNA, 12 bp, Homo sapiens
tgtcatgaacat

SEQ ID NO: 3398670 - DNA, 17 bp, Homo sapiens
tgtcatgcccccctcaa

SEQ ID NO: 3398671 - DNA, 20 bp, Homo sapiens
tgtcatggccttgaaacagt

SEQ ID NO: 3398672 - DNA, 15 bp, Homo sapiens
tgtcattaaacatga

SEQ ID NO: 3398673 - DNA, 15 bp, Homo sapiens
tgtcattaatgtgtt

SEQ ID NO: 3398674 - DNA, 13 bp, Homo sapiens
tgtcattatattc

SEQ ID NO: 3398675 - DNA, 14 bp, Homo sapiens
tgtcattatattct

SEQ ID NO: 3398676 - DNA, 18 bp, Homo sapiens
tgtcattatattctaatt

SEQ ID NO: 3398677 - DNA, 23 bp, Homo sapiens
tgtcattatttttgttagcaaag

SEQ ID NO: 3398678 - DNA, 16 bp, Homo sapiens
tgtcattcaaatgggt

SEQ ID NO: 3398679 - DNA, 21 bp, Homo sapiens
tgtcattcaaatgggtgatat

SEQ ID NO: 3398680 - DNA, 13 bp, Homo sapiens
tgtcattggaagc

SEQ ID NO: 3398681 - DNA, 17 bp, Homo sapiens
tgtcattggaagccatc

SEQ ID NO: 3398682 - DNA, 18 bp, Homo sapiens
tgtcattgtaaacaaact

SEQ ID NO: 3398683 - DNA, 13 bp, Homo sapiens
tgtcattgtattc

SEQ ID NO: 3398684 - DNA, 20 bp, Homo sapiens
tgtcatttagttcagcatcc

SEQ ID NO: 3398685 - DNA, 18 bp, Homo sapiens
tgtcatttgactgtctca

SEQ ID NO: 3398686 - DNA, 16 bp, Homo sapiens
tgtcatttgagcaggg

SEQ ID NO: 3398687 - DNA, 20 bp, Homo sapiens
tgtcatttgagcagggctca

SEQ ID NO: 3398688 - DNA, 14 bp, Homo sapiens
tgtcatttttaata

SEQ ID NO: 3398689 - DNA, 14 bp, Homo sapiens
tgtccaacaataaa

SEQ ID NO: 3398690 - DNA, 19 bp, Homo sapiens
tgtccaacaataaacagga

SEQ ID NO: 3398691 - DNA, 19 bp, Homo sapiens
tgtccaactggccctattt

SEQ ID NO: 3398692 - DNA, 19 bp, Homo sapiens
tgtccaagttcttcacctc

SEQ ID NO: 3398693 - DNA, 20 bp, Homo sapiens
tgtccaccacttcaggggat

SEQ ID NO: 3398694 - DNA, 14 bp, Homo sapiens
tgtccacctgtggg

SEQ ID NO: 3398695 - DNA, 19 bp, Homo sapiens
tgtccactctcggggccct

SEQ ID NO: 3398696 - DNA, 21 bp, Homo sapiens
tgtccactctcggggcccttg

SEQ ID NO: 3398697 - DNA, 13 bp, Homo sapiens
tgtccactgtgta

SEQ ID NO: 3398698 - DNA, 15 bp, Homo sapiens
tgtccagaagaatat

SEQ ID NO: 3398699 - DNA, 16 bp, Homo sapiens
tgtccagaagaatatt

SEQ ID NO: 3398700 - DNA, 22 bp, Homo sapiens
tgtccagcagctgcgggtctga

SEQ ID NO: 3398701 - DNA, 14 bp, Homo sapiens
tgtccagcctgggc

SEQ ID NO: 3398702 - DNA, 19 bp, Homo sapiens
tgtccagcctgggcagcca

SEQ ID NO: 3398703 - DNA, 23 bp, Homo sapiens
tgtccagcctgggcagccaggct

SEQ ID NO: 3398704 - DNA, 21 bp, Homo sapiens
tgtccaggaaaccctggcttg

SEQ ID NO: 3398705 - DNA, 14 bp, Homo sapiens
tgtccaggccactg

SEQ ID NO: 3398706 - DNA, 18 bp, Homo sapiens
tgtccaggccactgtggc

SEQ ID NO: 3398707 - DNA, 20 bp, Homo sapiens
tgtccaggccactgtggcca

SEQ ID NO: 3398708 - DNA, 16 bp, Homo sapiens
tgtccatattttcaca

SEQ ID NO: 3398709 - DNA, 17 bp, Homo sapiens
tgtccatcccttttcct

SEQ ID NO: 3398710 - DNA, 17 bp, Homo sapiens
tgtccatgcttctcatc

SEQ ID NO: 3398711 - DNA, 16 bp, Homo sapiens
tgtccatggcctttct

SEQ ID NO: 3398712 - DNA, 20 bp, Homo sapiens
tgtccatttatccacaggaa

SEQ ID NO: 3398713 - DNA, 21 bp, Homo sapiens
tgtccatttatccacaggaaa

SEQ ID NO: 3398714 - DNA, 23 bp, Homo sapiens
tgtcccaaaaagaaaggagggga

SEQ ID NO: 3398715 - DNA, 20 bp, Homo sapiens
tgtcccacaatattacctta

SEQ ID NO: 3398716 - DNA, 23 bp, Homo sapiens
tgtcccacccccacccccagctc

SEQ ID NO: 3398717 - DNA, 19 bp, Homo sapiens
tgtcccacccccttccccc

SEQ ID NO: 3398718 - DNA, 16 bp, Homo sapiens
tgtcccaccgggagcc

SEQ ID NO: 3398719 - DNA, 22 bp, Homo sapiens
tgtcccacttctcatcttaaaa

SEQ ID NO: 3398720 - DNA, 22 bp, Homo sapiens
tgtcccagaggttatctgcctg

SEQ ID NO: 3398721 - DNA, 13 bp, Homo sapiens
tgtcccagggccc

SEQ ID NO: 3398722 - DNA, 20 bp, Homo sapiens
tgtcccatgacccacccctg

SEQ ID NO: 3398723 - DNA, 19 bp, Homo sapiens
tgtcccatggacactccag

SEQ ID NO: 3398724 - DNA, 17 bp, Homo sapiens
tgtccccaccctccact

SEQ ID NO: 3398725 - DNA, 18 bp, Homo sapiens
tgtccccaccctccactc

SEQ ID NO: 3398726 - DNA, 19 bp, Homo sapiens
tgtccccaccctccactca

SEQ ID NO: 3398727 - DNA, 22 bp, Homo sapiens
tgtccccaccctccactcagct

SEQ ID NO: 3398728 - DNA, 15 bp, Homo sapiens
tgtccccagggcccc

SEQ ID NO: 3398729 - DNA, 23 bp, Homo sapiens
tgtcccccaaggttttggagtca

SEQ ID NO: 3398730 - DNA, 17 bp, Homo sapiens
tgtcccccagctctggt

SEQ ID NO: 3398731 - DNA, 16 bp, Homo sapiens
tgtcccccatcatgtg

SEQ ID NO: 3398732 - DNA, 14 bp, Homo sapiens
tgtcccccggggca

SEQ ID NO: 3398733 - DNA, 17 bp, Homo sapiens
tgtccccctacccaccg

SEQ ID NO: 3398734 - DNA, 23 bp, Homo sapiens
tgtcccctatggggatggtccac

SEQ ID NO: 3398735 - DNA, 22 bp, Homo sapiens
tgtcccctcaaactcattgcag

SEQ ID NO: 3398736 - DNA, 13 bp, Homo sapiens
tgtcccctcagct

SEQ ID NO: 3398737 - DNA, 14 bp, Homo sapiens
tgtcccctcagctc

SEQ ID NO: 3398738 - DNA, 15 bp, Homo sapiens
tgtcccgccttcctc

SEQ ID NO: 3398739 - DNA, 23 bp, Homo sapiens
tgtcccgccttcctcctccacag

SEQ ID NO: 3398740 - DNA, 23 bp, Homo sapiens
tgtccctaagtaagtttcttcct

SEQ ID NO: 3398741 - DNA, 20 bp, Homo sapiens
tgtccctaccgagtctcttc

SEQ ID NO: 3398742 - DNA, 22 bp, Homo sapiens
tgtccctatacactagacaaaa

SEQ ID NO: 3398743 - DNA, 12 bp, Homo sapiens
tgtccctcccac

SEQ ID NO: 3398744 - DNA, 13 bp, Homo sapiens
tgtccctcccacc

SEQ ID NO: 3398745 - DNA, 14 bp, Homo sapiens
tgtccctcccacct

SEQ ID NO: 3398746 - DNA, 16 bp, Homo sapiens
tgtccctctagtgcct

SEQ ID NO: 3398747 - DNA, 16 bp, Homo sapiens
tgtccctcttcactcc

SEQ ID NO: 3398748 - DNA, 12 bp, Homo sapiens
tgtccctgcagg

SEQ ID NO: 3398749 - DNA, 21 bp, Homo sapiens
tgtccctgcagggccatctga

SEQ ID NO: 3398750 - DNA, 12 bp, Homo sapiens
tgtccctggaca

SEQ ID NO: 3398751 - DNA, 14 bp, Homo sapiens
tgtccctggacaca

SEQ ID NO: 3398752 - DNA, 16 bp, Homo sapiens
tgtccctggacacagc

SEQ ID NO: 3398753 - DNA, 20 bp, Homo sapiens
tgtccctggacacagctctt

SEQ ID NO: 3398754 - DNA, 15 bp, Homo sapiens
tgtccctgggccagg

SEQ ID NO: 3398755 - DNA, 14 bp, Homo sapiens
tgtccctgtgccta

SEQ ID NO: 3398756 - DNA, 14 bp, Homo sapiens
tgtccctttcccta

SEQ ID NO: 3398757 - DNA, 16 bp, Homo sapiens
tgtccctttcttggcc

SEQ ID NO: 3398758 - DNA, 22 bp, Homo sapiens
tgtccgctgggtggtaccctct

SEQ ID NO: 3398759 - DNA, 20 bp, Homo sapiens
tgtcctaagagatttatctt

SEQ ID NO: 3398760 - DNA, 21 bp, Homo sapiens
tgtcctaagagatttatcttt

SEQ ID NO: 3398761 - DNA, 16 bp, Homo sapiens
tgtcctaaggaacctt

SEQ ID NO: 3398762 - DNA, 19 bp, Homo sapiens
tgtcctaaggaaccttcct

SEQ ID NO: 3398763 - DNA, 15 bp, Homo sapiens
tgtcctaaggacaca

SEQ ID NO: 3398764 - DNA, 18 bp, Homo sapiens
tgtcctaaggacacacta

SEQ ID NO: 3398765 - DNA, 14 bp, Homo sapiens
tgtcctaattcttc

SEQ ID NO: 3398766 - DNA, 16 bp, Homo sapiens
tgtcctacccaccctc

SEQ ID NO: 3398767 - DNA, 17 bp, Homo sapiens
tgtcctacttctgactt

SEQ ID NO: 3398768 - DNA, 22 bp, Homo sapiens
tgtcctacttctgactttactt

SEQ ID NO: 3398769 - DNA, 23 bp, Homo sapiens
tgtcctacttctgactttacttg

SEQ ID NO: 3398770 - DNA, 20 bp, Homo sapiens
tgtcctatctatcttccaaa

SEQ ID NO: 3398771 - DNA, 19 bp, Homo sapiens
tgtcctcagggagcaggga

SEQ ID NO: 3398772 - DNA, 23 bp, Homo sapiens
tgtcctcagggagcagggaaggc

SEQ ID NO: 3398773 - DNA, 17 bp, Homo sapiens
tgtcctccagaagcctc

SEQ ID NO: 3398774 - DNA, 19 bp, Homo sapiens
tgtcctccagaagcctctg

SEQ ID NO: 3398775 - DNA, 23 bp, Homo sapiens
tgtcctccagaagcctctggcta

SEQ ID NO: 3398776 - DNA, 13 bp, Homo sapiens
tgtcctcccatcc

SEQ ID NO: 3398777 - DNA, 22 bp, Homo sapiens
tgtcctcccatcccctggactg

SEQ ID NO: 3398778 - DNA, 19 bp, Homo sapiens
tgtcctccctccacctacc

SEQ ID NO: 3398779 - DNA, 13 bp, Homo sapiens
tgtcctcctggaa

SEQ ID NO: 3398780 - DNA, 13 bp, Homo sapiens
tgtcctctcccct

SEQ ID NO: 3398781 - DNA, 20 bp, Homo sapiens
tgtcctctcccctccagcct

SEQ ID NO: 3398782 - DNA, 17 bp, Homo sapiens
tgtcctctccctgccaa

SEQ ID NO: 3398783 - DNA, 20 bp, Homo sapiens
tgtgctgatcatttgaggaa

SEQ ID NO: 3398784 - DNA, 20 bp, Homo sapiens
tgtgctgcttttgagcctca

SEQ ID NO: 3398785 - DNA, 12 bp, Homo sapiens
tgtgctgggagc

SEQ ID NO: 3398786 - DNA, 11 bp, Homo sapiens
tgtgctggggg

SEQ ID NO: 3398787 - DNA, 16 bp, Homo sapiens
tgtgctgggggaatga

SEQ ID NO: 3398788 - DNA, 19 bp, Homo sapiens
tgtgctggtgtcctgacca

SEQ ID NO: 3398789 - DNA, 13 bp, Homo sapiens
tgtgctgtgcctg

SEQ ID NO: 3398790 - DNA, 14 bp, Homo sapiens
tgtgctgtgcctgc

SEQ ID NO: 3398791 - DNA, 18 bp, Homo sapiens
tgtgctgtgcctgctaga

SEQ ID NO: 3398792 - DNA, 12 bp, Homo sapiens
tgtgctgtgggc

SEQ ID NO: 3398793 - DNA, 13 bp, Homo sapiens
tgtgctgtgggca

SEQ ID NO: 3398794 - DNA, 16 bp, Homo sapiens
tgtgctgtgggcagca

SEQ ID NO: 3398795 - DNA, 17 bp, Homo sapiens
tgtgctgtgggcagcac

SEQ ID NO: 3398796 - DNA, 13 bp, Homo sapiens
tgtgcttacagta

SEQ ID NO: 3398797 - DNA, 23 bp, Homo sapiens
tgtgcttacagtaactaattttg

SEQ ID NO: 3398798 - DNA, 15 bp, Homo sapiens
tgtgcttcacagtag

SEQ ID NO: 3398799 - DNA, 16 bp, Homo sapiens
tgtgcttctccccaga

SEQ ID NO: 3398800 - DNA, 20 bp, Homo sapiens
tgtgcttctccccagaattc

SEQ ID NO: 3398801 - DNA, 14 bp, Homo sapiens
tgtgcttgtttaca

SEQ ID NO: 3398802 - DNA, 14 bp, Homo sapiens
tgtgctttagcttg

SEQ ID NO: 3398803 - DNA, 22 bp, Homo sapiens
tgtgctttcccatatcttgcct

SEQ ID NO: 3398804 - DNA, 17 bp, Homo sapiens
tgtgctttgcattccta

SEQ ID NO: 3398805 - DNA, 13 bp, Homo sapiens
tgtgctttgctct

SEQ ID NO: 3398806 - DNA, 18 bp, Homo sapiens
tgtgctttgctcttgtcc

SEQ ID NO: 3398807 - DNA, 23 bp, Homo sapiens
tgtgctttgctcttgtcccacgt

SEQ ID NO: 3398808 - DNA, 22 bp, Homo sapiens
tgtgctttgtaagatccacccc

SEQ ID NO: 3398809 - DNA, 14 bp, Homo sapiens
tgtgcttttcctga

SEQ ID NO: 3398810 - DNA, 22 bp, Homo sapiens
tgtgcttttttgattttgctga

SEQ ID NO: 3398811 - DNA, 18 bp, Homo sapiens
tgtggaaaaatagctctg

SEQ ID NO: 3398812 - DNA, 17 bp, Homo sapiens
tgtggaaaatgaaaatt

SEQ ID NO: 3398813 - DNA, 19 bp, Homo sapiens
tgtggaaagcctctgctgc

SEQ ID NO: 3398814 - DNA, 23 bp, Homo sapiens
tgtggaaagtgaatttgaatgaa

SEQ ID NO: 3398815 - DNA, 15 bp, Homo sapiens
tgtggaacccagcag

SEQ ID NO: 3398816 - DNA, 21 bp, Homo sapiens
tgtggaacccagcagttctgt

SEQ ID NO: 3398817 - DNA, 20 bp, Homo sapiens
tgtggaactaataaatacat

SEQ ID NO: 3398818 - DNA, 14 bp, Homo sapiens
tgtggacacagctc

SEQ ID NO: 3398819 - DNA, 15 bp, Homo sapiens
tgtggacacagctct

SEQ ID NO: 3398820 - DNA, 16 bp, Homo sapiens
tgtggacacagctctt

SEQ ID NO: 3398821 - DNA, 19 bp, Homo sapiens
tgtggacacagctcttctc

SEQ ID NO: 3398822 - DNA, 19 bp, Homo sapiens
tgtggaccactgcatgagc

SEQ ID NO: 3398823 - DNA, 18 bp, Homo sapiens
tgtggaccgtggacaggc

SEQ ID NO: 3398824 - DNA, 16 bp, Homo sapiens
tgtggactaaatatct

SEQ ID NO: 3398825 - DNA, 16 bp, Homo sapiens
tgtggacttggcaggt

SEQ ID NO: 3398826 - DNA, 13 bp, Homo sapiens
tgtggagaaagga

SEQ ID NO: 3398827 - DNA, 13 bp, Homo sapiens
tgtggagactggg

SEQ ID NO: 3398828 - DNA, 23 bp, Homo sapiens
tgtggagaggggtgcacccactc

SEQ ID NO: 3398829 - DNA, 19 bp, Homo sapiens
tgtggagccgaggcctacc

SEQ ID NO: 3398830 - DNA, 15 bp, Homo sapiens
tgtggagctcagccc

SEQ ID NO: 3398831 - DNA, 16 bp, Homo sapiens
tgtggagctcagcccc

SEQ ID NO: 3398832 - DNA, 12 bp, Homo sapiens
tgtggaggaagg

SEQ ID NO: 3398833 - DNA, 15 bp, Homo sapiens
tgtggaggaaggatt

SEQ ID NO: 3398834 - DNA, 21 bp, Homo sapiens
tgtggaggaaggattgtaaaa

SEQ ID NO: 3398835 - DNA, 19 bp, Homo sapiens
tgtggatcaaccatcgctt

SEQ ID NO: 3398836 - DNA, 17 bp, Homo sapiens
tgtggatcagagatgca

SEQ ID NO: 3398837 - DNA, 22 bp, Homo sapiens
tgtggatgcctgtggaagagtg

SEQ ID NO: 3398838 - DNA, 23 bp, Homo sapiens
tgtggatgtaattagctctgggg

SEQ ID NO: 3398839 - DNA, 18 bp, Homo sapiens
tgtggattataaaaaatg

SEQ ID NO: 3398840 - DNA, 16 bp, Homo sapiens
tgtggcaaagtgctgt

SEQ ID NO: 3398841 - DNA, 19 bp, Homo sapiens
tgtggcaaagtgctgtacc

SEQ ID NO: 3398842 - DNA, 19 bp, Homo sapiens
tgtggcaatagtgggccct

SEQ ID NO: 3398843 - DNA, 14 bp, Homo sapiens
tgtggcagagttac

SEQ ID NO: 3398844 - DNA, 19 bp, Homo sapiens
tgtggcagagttacagttc

SEQ ID NO: 3398845 - DNA, 13 bp, Homo sapiens
tgtggcagggggc

SEQ ID NO: 3398846 - DNA, 20 bp, Homo sapiens
tgtggcagggggccccgcca

SEQ ID NO: 3398847 - DNA, 19 bp, Homo sapiens
tgtggcagtaaagagaaac

SEQ ID NO: 3398848 - DNA, 20 bp, Homo sapiens
tgtggcagtaaagagaaact

SEQ ID NO: 3398849 - DNA, 19 bp, Homo sapiens
tgtggcagtcccttataat

SEQ ID NO: 3398850 - DNA, 17 bp, Homo sapiens
tgtggcatctttgcctt

SEQ ID NO: 3398851 - DNA, 14 bp, Homo sapiens
tgtggcattggggg

SEQ ID NO: 3398852 - DNA, 15 bp, Homo sapiens
tgtggccaatggaac

SEQ ID NO: 3398853 - DNA, 14 bp, Homo sapiens
tgtggccagagctg

SEQ ID NO: 3398854 - DNA, 19 bp, Homo sapiens
tgtggccagagctggaagg

SEQ ID NO: 3398855 - DNA, 13 bp, Homo sapiens
tgtggccccaccc

SEQ ID NO: 3398856 - DNA, 19 bp, Homo sapiens
tgtggccccaccctgggcc

SEQ ID NO: 3398857 - DNA, 13 bp, Homo sapiens
tgtggccctggag

SEQ ID NO: 3398858 - DNA, 18 bp, Homo sapiens
tgtggccgactctgcact

SEQ ID NO: 3398859 - DNA, 16 bp, Homo sapiens
tgtggccgtctcctcc

SEQ ID NO: 3398860 - DNA, 12 bp, Homo sapiens
tgtggcctcagc

SEQ ID NO: 3398861 - DNA, 13 bp, Homo sapiens
tgtggcctcagcc

SEQ ID NO: 3398862 - DNA, 11 bp, Homo sapiens
tgtggcctgca

SEQ ID NO: 3398863 - DNA, 13 bp, Homo sapiens
tgtggcctgtggc

SEQ ID NO: 3398864 - DNA, 15 bp, Homo sapiens
tgtggcctgtgtcca

SEQ ID NO: 3398865 - DNA, 16 bp, Homo sapiens
tgtggcctgtgtccag

SEQ ID NO: 3398866 - DNA, 15 bp, Homo sapiens
tgtggccttccccct

SEQ ID NO: 3398867 - DNA, 18 bp, Homo sapiens
tgtggcgccgtctccagg

SEQ ID NO: 3398868 - DNA, 23 bp, Homo sapiens
tgtggcgccgtctccaggggctg

SEQ ID NO: 3398869 - DNA, 16 bp, Homo sapiens
tgtggctagtgacaaa

SEQ ID NO: 3398870 - DNA, 14 bp, Homo sapiens
tgtggctccaagct

SEQ ID NO: 3398871 - DNA, 18 bp, Homo sapiens
tgtggctcctatctgtgt

SEQ ID NO: 3398872 - DNA, 14 bp, Homo sapiens
tgtggctccttccc

SEQ ID NO: 3398873 - DNA, 15 bp, Homo sapiens
tgtggctccttccca

SEQ ID NO: 3398874 - DNA, 20 bp, Homo sapiens
tgtggctcttatttctgaat

SEQ ID NO: 3398875 - DNA, 21 bp, Homo sapiens
tgtggctgggggcaggagggc

SEQ ID NO: 3398876 - DNA, 19 bp, Homo sapiens
tgtggcttgctagctatgt

SEQ ID NO: 3398877 - DNA, 15 bp, Homo sapiens
tgtgggaaaaaaatg

SEQ ID NO: 3398878 - DNA, 15 bp, Homo sapiens
tgtgggaaggccagc

SEQ ID NO: 3398879 - DNA, 19 bp, Homo sapiens
tgtgggactgtacacactt

SEQ ID NO: 3398880 - DNA, 21 bp, Homo sapiens
tgtgggactgtacacacttta

SEQ ID NO: 3398881 - DNA, 21 bp, Homo sapiens
tgtgggagggagcagacagga

SEQ ID NO: 3398882 - DNA, 17 bp, Homo sapiens
tgtgggatattgaatgt

SEQ ID NO: 3398883 - DNA, 18 bp, Homo sapiens
tgtgggcactggcccagg

SEQ ID NO: 3398884 - DNA, 23 bp, Homo sapiens
tgtgggcactggcccaggttcat

SEQ ID NO: 3398885 - DNA, 20 bp, Homo sapiens
tgtgggcaggcaagcccttc

SEQ ID NO: 3398886 - DNA, 17 bp, Homo sapiens
tgtgggcccctcaacag

SEQ ID NO: 3398887 - DNA, 19 bp, Homo sapiens
tgtgggcccctcaacagcc

SEQ ID NO: 3398888 - DNA, 19 bp, Homo sapiens
tgtgggcctcaaggacttg

SEQ ID NO: 3398889 - DNA, 21 bp, Homo sapiens
tgtgggcctcaaggacttgaa

SEQ ID NO: 3398890 - DNA, 16 bp, Homo sapiens
tgtgggcttgaccagg

SEQ ID NO: 3398891 - DNA, 17 bp, Homo sapiens
tgtggggaagaggggct

SEQ ID NO: 3398892 - DNA, 23 bp, Homo sapiens
tgtggggaagaggggctggggca

SEQ ID NO: 3398893 - DNA, 17 bp, Homo sapiens
tgtggggacccaggctc

SEQ ID NO: 3398894 - DNA, 15 bp, Homo sapiens
tgtggggccaggtca

SEQ ID NO: 3398895 - DNA, 20 bp, Homo sapiens
tgtggggctggtagctcagg

SEQ ID NO: 3398896 - DNA, 13 bp, Homo sapiens
tgtgggggctgca

SEQ ID NO: 3398897 - DNA, 14 bp, Homo sapiens
tgtggggggtcctt

SEQ ID NO: 3398898 - DNA, 14 bp, Homo sapiens
tgtgggggtggcca

SEQ ID NO: 3398899 - DNA, 17 bp, Homo sapiens
tgtgggggtggccatcc

SEQ ID NO: 3398900 - DNA, 15 bp, Homo sapiens
tgtggggtgaaaagt

SEQ ID NO: 3398901 - DNA, 14 bp, Homo sapiens
tgtgggtcccgcac

SEQ ID NO: 3398902 - DNA, 13 bp, Homo sapiens
tgtgggtgagcca

SEQ ID NO: 3398903 - DNA, 17 bp, Homo sapiens
tgtgggtggaagggctg

SEQ ID NO: 3398904 - DNA, 12 bp, Homo sapiens
tgtgggtgtagc

SEQ ID NO: 3398905 - DNA, 14 bp, Homo sapiens
tgtgggttctacag

SEQ ID NO: 3398906 - DNA, 21 bp, Homo sapiens
tgtggtaagcaacatggcttt

SEQ ID NO: 3398907 - DNA, 15 bp, Homo sapiens
tgtggtctcaggata

SEQ ID NO: 3398908 - DNA, 19 bp, Homo sapiens
tgtggtctggtgttccagc

SEQ ID NO: 3398909 - DNA, 20 bp, Homo sapiens
tgtggtgatggagatgcagt

SEQ ID NO: 3398910 - DNA, 15 bp, Homo sapiens
tgttatacaaggcaa

SEQ ID NO: 3398911 - DNA, 15 bp, Homo sapiens
tgttatatcatatgt

SEQ ID NO: 3398912 - DNA, 17 bp, Homo sapiens
tgttatatcatatgtat

SEQ ID NO: 3398913 - DNA, 13 bp, Homo sapiens
tgttatcaaactt

SEQ ID NO: 3398914 - DNA, 21 bp, Homo sapiens
tgttatcaccttccaaacaaa

SEQ ID NO: 3398915 - DNA, 22 bp, Homo sapiens
tgttatcaccttccaaacaaaa

SEQ ID NO: 3398916 - DNA, 21 bp, Homo sapiens
tgttatcagtcaatattttta

SEQ ID NO: 3398917 - DNA, 13 bp, Homo sapiens
tgttatgaaataa

SEQ ID NO: 3398918 - DNA, 16 bp, Homo sapiens
tgttatgaaataaaga

SEQ ID NO: 3398919 - DNA, 17 bp, Homo sapiens
tgttatgtagataacaa

SEQ ID NO: 3398920 - DNA, 13 bp, Homo sapiens
tgttatgtatgaa

SEQ ID NO: 3398921 - DNA, 17 bp, Homo sapiens
tgttatgtatgaaggaa

SEQ ID NO: 3398922 - DNA, 17 bp, Homo sapiens
tgttattactgttccca

SEQ ID NO: 3398923 - DNA, 15 bp, Homo sapiens
tgttattccatcaat

SEQ ID NO: 3398924 - DNA, 14 bp, Homo sapiens
tgttatttaaagaa

SEQ ID NO: 3398925 - DNA, 17 bp, Homo sapiens
tgttattttgtgtacaa

SEQ ID NO: 3398926 - DNA, 16 bp, Homo sapiens
tgttatttttgtttct

SEQ ID NO: 3398927 - DNA, 19 bp, Homo sapiens
tgttcaaacaatatcatat

SEQ ID NO: 3398928 - DNA, 22 bp, Homo sapiens
tgttcaaacaatatcatatcat

SEQ ID NO: 3398929 - DNA, 15 bp, Homo sapiens
tgttcaaatgcattt

SEQ ID NO: 3398930 - DNA, 16 bp, Homo sapiens
tgttcaatactgtatg

SEQ ID NO: 3398931 - DNA, 22 bp, Homo sapiens
tgttcaatagatttaggagcag

SEQ ID NO: 3398932 - DNA, 14 bp, Homo sapiens
tgttcaatgttcca

SEQ ID NO: 3398933 - DNA, 15 bp, Homo sapiens
tgttcaatgttccat

SEQ ID NO: 3398934 - DNA, 16 bp, Homo sapiens
tgttcaatgtttaatg

SEQ ID NO: 3398935 - DNA, 20 bp, Homo sapiens
tgttcacaaactacctctgg

SEQ ID NO: 3398936 - DNA, 17 bp, Homo sapiens
tgttcaccaaaaccaaa

SEQ ID NO: 3398937 - DNA, 17 bp, Homo sapiens
tgttcactgaagacgcc

SEQ ID NO: 3398938 - DNA, 19 bp, Homo sapiens
tgttcactttaaagcaatt

SEQ ID NO: 3398939 - DNA, 22 bp, Homo sapiens
tgttcactttaaagcaattgca

SEQ ID NO: 3398940 - DNA, 17 bp, Homo sapiens
tgttcagatgtgcattt

SEQ ID NO: 3398941 - DNA, 13 bp, Homo sapiens
tgttcagcactgt

SEQ ID NO: 3398942 - DNA, 17 bp, Homo sapiens
tgttcagcactgtccct

SEQ ID NO: 3398943 - DNA, 14 bp, Homo sapiens
tgttcagcattctt

SEQ ID NO: 3398944 - DNA, 18 bp, Homo sapiens
tgttcagctccagctcac

SEQ ID NO: 3398945 - DNA, 22 bp, Homo sapiens
tgttcagctccagctcaccagc

SEQ ID NO: 3398946 - DNA, 21 bp, Homo sapiens
tgttcagctgtcctccctcca

SEQ ID NO: 3398947 - DNA, 21 bp, Homo sapiens
tgttcagcttcagacttttat

SEQ ID NO: 3398948 - DNA, 21 bp, Homo sapiens
tgttcaggaaaaggttgaata

SEQ ID NO: 3398949 - DNA, 17 bp, Homo sapiens
tgttcagtgcaatcaga

SEQ ID NO: 3398950 - DNA, 14 bp, Homo sapiens
tgttcatagcccag

SEQ ID NO: 3398951 - DNA, 16 bp, Homo sapiens
tgttcatgtgcctctg

SEQ ID NO: 3398952 - DNA, 13 bp, Homo sapiens
tgttcatgtttgg

SEQ ID NO: 3398953 - DNA, 17 bp, Homo sapiens
tgttcatgtttggtgca

SEQ ID NO: 3398954 - DNA, 17 bp, Homo sapiens
tgttcattatttgtgct

SEQ ID NO: 3398955 - DNA, 16 bp, Homo sapiens
tgttcattcaagctat

SEQ ID NO: 3398956 - DNA, 10 bp, Homo sapiens
tgttcattta

SEQ ID NO: 3398957 - DNA, 18 bp, Homo sapiens
tgttcattttagtgactg

SEQ ID NO: 3398958 - DNA, 15 bp, Homo sapiens
tgttcatttttcaaa

SEQ ID NO: 3398959 - DNA, 16 bp, Homo sapiens
tgttccaaagccagtg

SEQ ID NO: 3398960 - DNA, 19 bp, Homo sapiens
tgttccaaattcagtttca

SEQ ID NO: 3398961 - DNA, 20 bp, Homo sapiens
tgttccaaattcagtttcat

SEQ ID NO: 3398962 - DNA, 18 bp, Homo sapiens
tgttccaagacattgtca

SEQ ID NO: 3398963 - DNA, 19 bp, Homo sapiens
tgttccaagacattgtcaa

SEQ ID NO: 3398964 - DNA, 20 bp, Homo sapiens
tgttccaagacattgtcaat

SEQ ID NO: 3398965 - DNA, 15 bp, Homo sapiens
tgttccaagtttcca

SEQ ID NO: 3398966 - DNA, 21 bp, Homo sapiens
tgttccacacccaatgctgct

SEQ ID NO: 3398967 - DNA, 14 bp, Homo sapiens
tgttccagcagttt

SEQ ID NO: 3398968 - DNA, 14 bp, Homo sapiens
tgttccagctcttt

SEQ ID NO: 3398969 - DNA, 19 bp, Homo sapiens
tgttccaggccctccagtg

SEQ ID NO: 3398970 - DNA, 18 bp, Homo sapiens
tgttccagtaatctaata

SEQ ID NO: 3398971 - DNA, 19 bp, Homo sapiens
tgttccattttatgcagaa

SEQ ID NO: 3398972 - DNA, 16 bp, Homo sapiens
tgttcccagaggcagg

SEQ ID NO: 3398973 - DNA, 20 bp, Homo sapiens
tgttcccatgtagccccctg

SEQ ID NO: 3398974 - DNA, 21 bp, Homo sapiens
tgttcccccgccgcttttctc

SEQ ID NO: 3398975 - DNA, 21 bp, Homo sapiens
tgttcccctcactggatgaaa

SEQ ID NO: 3398976 - DNA, 20 bp, Homo sapiens
tgttcccctgtcctgtgaat

SEQ ID NO: 3398977 - DNA, 18 bp, Homo sapiens
tgttccctctccctgttg

SEQ ID NO: 3398978 - DNA, 14 bp, Homo sapiens
tgttccctctgctc

SEQ ID NO: 3398979 - DNA, 16 bp, Homo sapiens
tgttccctgcaccctg

SEQ ID NO: 3398980 - DNA, 17 bp, Homo sapiens
tgttcctcaaggtccat

SEQ ID NO: 3398981 - DNA, 12 bp, Homo sapiens
tgttcctcctgc

SEQ ID NO: 3398982 - DNA, 22 bp, Homo sapiens
tgttcctgaattctatttgctg

SEQ ID NO: 3398983 - DNA, 12 bp, Homo sapiens
tgttcctgcccc

SEQ ID NO: 3398984 - DNA, 15 bp, Homo sapiens
tgttcctgctccatg

SEQ ID NO: 3398985 - DNA, 19 bp, Homo sapiens
tgttcctgctccatgactg

SEQ ID NO: 3398986 - DNA, 21 bp, Homo sapiens
tgttcctggcaatagtgtgtt

SEQ ID NO: 3398987 - DNA, 20 bp, Homo sapiens
tgttcctggcccactctgta

SEQ ID NO: 3398988 - DNA, 16 bp, Homo sapiens
tgttccttgtactctt

SEQ ID NO: 3398989 - DNA, 17 bp, Homo sapiens
tgttcctttttaaatgt

SEQ ID NO: 3398990 - DNA, 22 bp, Homo sapiens
tgttccttttttcaatatgcaa

SEQ ID NO: 3398991 - DNA, 23 bp, Homo sapiens
tgttcgcatggtcacacactgat

SEQ ID NO: 3398992 - DNA, 19 bp, Homo sapiens
tgttcgcttggctccatgc

SEQ ID NO: 3398993 - DNA, 16 bp, Homo sapiens
tgttctaaagctctga

SEQ ID NO: 3398994 - DNA, 12 bp, Homo sapiens
tgttctaaggct

SEQ ID NO: 3398995 - DNA, 15 bp, Homo sapiens
tgttctaaggctctg

SEQ ID NO: 3398996 - DNA, 12 bp, Homo sapiens
tgttctaagttt

SEQ ID NO: 3398997 - DNA, 21 bp, Homo sapiens
tgttctaatccaagggccagt

SEQ ID NO: 3398998 - DNA, 22 bp, Homo sapiens
tgttctagtaacaatacatgag

SEQ ID NO: 3398999 - DNA, 14 bp, Homo sapiens
tgttctagtttttt

SEQ ID NO: 3399000 - DNA, 15 bp, Homo sapiens
tgttctatgaacaac

SEQ ID NO: 3399001 - DNA, 18 bp, Homo sapiens
tgttctatggttatgaaa

SEQ ID NO: 3399002 - DNA, 21 bp, Homo sapiens
tgttctattaatcacctctct

SEQ ID NO: 3399003 - DNA, 17 bp, Homo sapiens
tgttctcagctccccct

SEQ ID NO: 3399004 - DNA, 17 bp, Homo sapiens
tgttctccctttctctc

SEQ ID NO: 3399005 - DNA, 22 bp, Homo sapiens
tgttctccctttctctctcctc

SEQ ID NO: 3399006 - DNA, 21 bp, Homo sapiens
tgttctccgggtgtggcctca

SEQ ID NO: 3399007 - DNA, 22 bp, Homo sapiens
tgttctccgggtgtggcctcag

SEQ ID NO: 3399008 - DNA, 13 bp, Homo sapiens
tgttctctgagga

SEQ ID NO: 3399009 - DNA, 18 bp, Homo sapiens
tgttctctgaggacacta

SEQ ID NO: 3399010 - DNA, 22 bp, Homo sapiens
tgttctgacattaacagttttc

SEQ ID NO: 3399011 - DNA, 15 bp, Homo sapiens
tgttctgaccctgct

SEQ ID NO: 3399012 - DNA, 18 bp, Homo sapiens
tgttctgagaactgactt

SEQ ID NO: 3399013 - DNA, 22 bp, Homo sapiens
tgttctgagaactgactttctc

SEQ ID NO: 3399014 - DNA, 21 bp, Homo sapiens
tgttctgaggattcaggggct

SEQ ID NO: 3399015 - DNA, 16 bp, Homo sapiens
tgttctgattagaaat

SEQ ID NO: 3399016 - DNA, 12 bp, Homo sapiens
tgttctgcaaag

SEQ ID NO: 3399017 - DNA, 12 bp, Homo sapiens
tgttctgcactg

SEQ ID NO: 3399018 - DNA, 15 bp, Homo sapiens
tgttctgcactgaaa

SEQ ID NO: 3399019 - DNA, 18 bp, Homo sapiens
tgttctgcccccagccca

SEQ ID NO: 3399020 - DNA, 13 bp, Homo sapiens
tgttctgctttat

SEQ ID NO: 3399021 - DNA, 13 bp, Homo sapiens
tgttctggaggaa

SEQ ID NO: 3399022 - DNA, 16 bp, Homo sapiens
tgttctgggacacagt

SEQ ID NO: 3399023 - DNA, 12 bp, Homo sapiens
tgttctggggga

SEQ ID NO: 3399024 - DNA, 18 bp, Homo sapiens
tgttctgtaatggaactg

SEQ ID NO: 3399025 - DNA, 22 bp, Homo sapiens
tgttctgtaatggaactgaccc

SEQ ID NO: 3399026 - DNA, 13 bp, Homo sapiens
tgttctgtatttt

SEQ ID NO: 3399027 - DNA, 15 bp, Homo sapiens
tgttctgtattttca

SEQ ID NO: 3399028 - DNA, 21 bp, Homo sapiens
tgttctgtcccttccacttct

SEQ ID NO: 3399029 - DNA, 23 bp, Homo sapiens
tgttctgtggttcctctgctcac

SEQ ID NO: 3399030 - DNA, 14 bp, Homo sapiens
tgttctgtgtccct

SEQ ID NO: 3399031 - DNA, 15 bp, Homo sapiens
tgttctgttctgggg

SEQ ID NO: 3399032 - DNA, 10 bp, Homo sapiens
tgttctgttt

SEQ ID NO: 3399033 - DNA, 14 bp, Homo sapiens
tgttctgtttcaag

SEQ ID NO: 3399034 - DNA, 16 bp, Homo sapiens
tgttctgtttggcact

SEQ ID NO: 3399035 - DNA, 21 bp, Homo sapiens
tgttctgtttggcacttgtat

SEQ ID NO: 3399036 - DNA, 12 bp, Homo sapiens
ttaaagacaggt

SEQ ID NO: 3399037 - DNA, 15 bp, Homo sapiens
ttaaagagaatgagt

SEQ ID NO: 3399038 - DNA, 14 bp, Homo sapiens
ttaaagagtctaga

SEQ ID NO: 3399039 - DNA, 17 bp, Homo sapiens
ttaaagcaaaaaatgaa

SEQ ID NO: 3399040 - DNA, 14 bp, Homo sapiens
ttaaagcaattgca

SEQ ID NO: 3399041 - DNA, 16 bp, Homo sapiens
ttaaagcaattgcata

SEQ ID NO: 3399042 - DNA, 14 bp, Homo sapiens
ttaaagctgcctgt

SEQ ID NO: 3399043 - DNA, 19 bp, Homo sapiens
ttaaagctggaacatttga

SEQ ID NO: 3399044 - DNA, 15 bp, Homo sapiens
ttaaaggaaggaaaa

SEQ ID NO: 3399045 - DNA, 15 bp, Homo sapiens
ttaaaggaagtcagt

SEQ ID NO: 3399046 - DNA, 20 bp, Homo sapiens
ttaaaggatatgaaactcta

SEQ ID NO: 3399047 - DNA, 17 bp, Homo sapiens
ttaaaggtcctgccctc

SEQ ID NO: 3399048 - DNA, 14 bp, Homo sapiens
ttaaagtactttct

SEQ ID NO: 3399049 - DNA, 15 bp, Homo sapiens
ttaaagtactttctt

SEQ ID NO: 3399050 - DNA, 20 bp, Homo sapiens
ttaaagtatgcattattaaa

SEQ ID NO: 3399051 - DNA, 18 bp, Homo sapiens
ttaaagttctgtgtattt

SEQ ID NO: 3399052 - DNA, 19 bp, Homo sapiens
ttaaagttctgtgtattta

SEQ ID NO: 3399053 - DNA, 14 bp, Homo sapiens
ttaaagttggaatt

SEQ ID NO: 3399054 - DNA, 20 bp, Homo sapiens
ttaaagttgtataaaaacat

SEQ ID NO: 3399055 - DNA, 13 bp, Homo sapiens
ttaaataaaagct

SEQ ID NO: 3399056 - DNA, 13 bp, Homo sapiens
ttaaataaaagtg

SEQ ID NO: 3399057 - DNA, 20 bp, Homo sapiens
ttaaataaaagtgatcaata

SEQ ID NO: 3399058 - DNA, 14 bp, Homo sapiens
ttaaataaactttt

SEQ ID NO: 3399059 - DNA, 15 bp, Homo sapiens
ttaaataaacttttt

SEQ ID NO: 3399060 - DNA, 19 bp, Homo sapiens
ttaaataaactttttttca

SEQ ID NO: 3399061 - DNA, 13 bp, Homo sapiens
ttaaataaatcat

SEQ ID NO: 3399062 - DNA, 15 bp, Homo sapiens
ttaaataaatcataa

SEQ ID NO: 3399063 - DNA, 16 bp, Homo sapiens
ttaaataagattctaa

SEQ ID NO: 3399064 - DNA, 17 bp, Homo sapiens
ttaaataagattctaac

SEQ ID NO: 3399065 - DNA, 18 bp, Homo sapiens
ttaaataatgcttcagat

SEQ ID NO: 3399066 - DNA, 19 bp, Homo sapiens
ttaaatacagataattcat

SEQ ID NO: 3399067 - DNA, 16 bp, Homo sapiens
ttaaatactgtgcaga

SEQ ID NO: 3399068 - DNA, 18 bp, Homo sapiens
ttaaatactgtgcagaat

SEQ ID NO: 3399069 - DNA, 19 bp, Homo sapiens
ttaaatagagtatatgcac

SEQ ID NO: 3399070 - DNA, 18 bp, Homo sapiens
ttaaatagagtttgctat

SEQ ID NO: 3399071 - DNA, 19 bp, Homo sapiens
ttaaatataaatgtttgtc

SEQ ID NO: 3399072 - DNA, 12 bp, Homo sapiens
ttaaatataatt

SEQ ID NO: 3399073 - DNA, 17 bp, Homo sapiens
ttaaatataattctgta

SEQ ID NO: 3399074 - DNA, 19 bp, Homo sapiens
ttaaatataattctgtaaa

SEQ ID NO: 3399075 - DNA, 18 bp, Homo sapiens
ttaaatatagattagaaa

SEQ ID NO: 3399076 - DNA, 12 bp, Homo sapiens
ttaaatatagtt

SEQ ID NO: 3399077 - DNA, 23 bp, Homo sapiens
ttaaatatagttcctaagaagct

SEQ ID NO: 3399078 - DNA, 16 bp, Homo sapiens
ttaaatcatgtatgtt

SEQ ID NO: 3399079 - DNA, 15 bp, Homo sapiens
ttaaatccaataaaa

SEQ ID NO: 3399080 - DNA, 14 bp, Homo sapiens
ttaaatctgtgatg

SEQ ID NO: 3399081 - DNA, 15 bp, Homo sapiens
ttaaatctgtgatga

SEQ ID NO: 3399082 - DNA, 16 bp, Homo sapiens
ttaaatgaaagaaaat

SEQ ID NO: 3399083 - DNA, 14 bp, Homo sapiens
ttaaatgaaattgt

SEQ ID NO: 3399084 - DNA, 21 bp, Homo sapiens
ttaaatgaatattttgataat

SEQ ID NO: 3399085 - DNA, 16 bp, Homo sapiens
ttaaatgaggattatt

SEQ ID NO: 3399086 - DNA, 22 bp, Homo sapiens
ttaaatgcaaccagaattgtcc

SEQ ID NO: 3399087 - DNA, 14 bp, Homo sapiens
ttaaatgccttgta

SEQ ID NO: 3399088 - DNA, 22 bp, Homo sapiens
ttaaatggtaataagcactgta

SEQ ID NO: 3399089 - DNA, 17 bp, Homo sapiens
ttaaatgtaaagatatt

SEQ ID NO: 3399090 - DNA, 16 bp, Homo sapiens
ttaaatgtgaattttt

SEQ ID NO: 3399091 - DNA, 17 bp, Homo sapiens
ttaaatgttttataagt

SEQ ID NO: 3399092 - DNA, 15 bp, Homo sapiens
ttaaattaaagcaaa

SEQ ID NO: 3399093 - DNA, 11 bp, Homo sapiens
ttaaattaata

SEQ ID NO: 3399094 - DNA, 15 bp, Homo sapiens
ttaaattacaatttt

SEQ ID NO: 3399095 - DNA, 18 bp, Homo sapiens
ttaaattacaattttatc

SEQ ID NO: 3399096 - DNA, 16 bp, Homo sapiens
ttaaattacagctttt

SEQ ID NO: 3399097 - DNA, 17 bp, Homo sapiens
ttaaattagaaaatatt

SEQ ID NO: 3399098 - DNA, 17 bp, Homo sapiens
ttaaattagtttgtgaa

SEQ ID NO: 3399099 - DNA, 23 bp, Homo sapiens
ttaaattatgttttaaacacatg

SEQ ID NO: 3399100 - DNA, 19 bp, Homo sapiens
ttaaattcccgttttgtca

SEQ ID NO: 3399101 - DNA, 12 bp, Homo sapiens
ttaaattctgag

SEQ ID NO: 3399102 - DNA, 18 bp, Homo sapiens
ttaaatttaaagatattg

SEQ ID NO: 3399103 - DNA, 13 bp, Homo sapiens
ttaaatttgtaag

SEQ ID NO: 3399104 - DNA, 21 bp, Homo sapiens
ttaaatttgtaagtttcaggt

SEQ ID NO: 3399105 - DNA, 20 bp, Homo sapiens
ttaaattttaccctttagac

SEQ ID NO: 3399106 - DNA, 16 bp, Homo sapiens
ttaaattttagtacat

SEQ ID NO: 3399107 - DNA, 13 bp, Homo sapiens
ttaaattttcacc

SEQ ID NO: 3399108 - DNA, 16 bp, Homo sapiens
ttaaattttcttcagt

SEQ ID NO: 3399109 - DNA, 17 bp, Homo sapiens
ttaaattttcttcagtt

SEQ ID NO: 3399110 - DNA, 14 bp, Homo sapiens
ttaaattttttggc

SEQ ID NO: 3399111 - DNA, 22 bp, Homo sapiens
ttaacaaacatcactctgctgc

SEQ ID NO: 3399112 - DNA, 19 bp, Homo sapiens
ttaacaaaccaacatcttt

SEQ ID NO: 3399113 - DNA, 17 bp, Homo sapiens
ttaacaaactaaaaata

SEQ ID NO: 3399114 - DNA, 20 bp, Homo sapiens
ttaacaaatctaatctctta

SEQ ID NO: 3399115 - DNA, 12 bp, Homo sapiens
ttaacaaggaat

SEQ ID NO: 3399116 - DNA, 21 bp, Homo sapiens
ttaacaaggaatgcctgtgcc

SEQ ID NO: 3399117 - DNA, 19 bp, Homo sapiens
ttaacaataaagtgacaaa

SEQ ID NO: 3399118 - DNA, 13 bp, Homo sapiens
ttaacaatgcaac

SEQ ID NO: 3399119 - DNA, 17 bp, Homo sapiens
ttaacaatgcaactttt

SEQ ID NO: 3399120 - DNA, 18 bp, Homo sapiens
ttaacaatgcaactttta

SEQ ID NO: 3399121 - DNA, 23 bp, Homo sapiens
ttaacaatttctgtccttcagat

SEQ ID NO: 3399122 - DNA, 16 bp, Homo sapiens
ttaacacaagtcctgt

SEQ ID NO: 3399123 - DNA, 14 bp, Homo sapiens
ttaacactttgtat

SEQ ID NO: 3399124 - DNA, 15 bp, Homo sapiens
ttaacactttgtatt

SEQ ID NO: 3399125 - DNA, 16 bp, Homo sapiens
ttaacagtcatttaaa

SEQ ID NO: 3399126 - DNA, 22 bp, Homo sapiens
ttaacatgaacacccttagaaa

SEQ ID NO: 3399127 - DNA, 15 bp, Homo sapiens
ttaacatgatttcaa

SEQ ID NO: 3399128 - DNA, 19 bp, Homo sapiens
ttaacatgcttatgacaat

SEQ ID NO: 3399129 - DNA, 17 bp, Homo sapiens
ttaacattccaagactc

SEQ ID NO: 3399130 - DNA, 19 bp, Homo sapiens
ttaacattccaagactcta

SEQ ID NO: 3399131 - DNA, 14 bp, Homo sapiens
ttaacattgaccaa

SEQ ID NO: 3399132 - DNA, 21 bp, Homo sapiens
ttaacattgaccaagaactgc

SEQ ID NO: 3399133 - DNA, 13 bp, Homo sapiens
ttaacatttgcct

SEQ ID NO: 3399134 - DNA, 20 bp, Homo sapiens
ttaaccaagtcgctcctagg

SEQ ID NO: 3399135 - DNA, 15 bp, Homo sapiens
ttaaccacagtgaaa

SEQ ID NO: 3399136 - DNA, 14 bp, Homo sapiens
ttaaccacattaat

SEQ ID NO: 3399137 - DNA, 15 bp, Homo sapiens
ttaaccctaatcttt

SEQ ID NO: 3399138 - DNA, 17 bp, Homo sapiens
ttaacctagatgtttaa

SEQ ID NO: 3399139 - DNA, 17 bp, Homo sapiens
ttaacctggtgctggat

SEQ ID NO: 3399140 - DNA, 18 bp, Homo sapiens
ttaaccttgccttagaaa

SEQ ID NO: 3399141 - DNA, 19 bp, Homo sapiens
ttaacctttccgctgtcgc

SEQ ID NO: 3399142 - DNA, 12 bp, Homo sapiens
ttaacctttttt

SEQ ID NO: 3399143 - DNA, 16 bp, Homo sapiens
ttaaccttttttgtct

SEQ ID NO: 3399144 - DNA, 19 bp, Homo sapiens
ttaacggctccaggatttt

SEQ ID NO: 3399145 - DNA, 23 bp, Homo sapiens
ttaactaatatgggcattgtagt

SEQ ID NO: 3399146 - DNA, 16 bp, Homo sapiens
ttaactacatttatga

SEQ ID NO: 3399147 - DNA, 19 bp, Homo sapiens
ttaactactatattgattg

SEQ ID NO: 3399148 - DNA, 14 bp, Homo sapiens
ttaactagaattta

SEQ ID NO: 3399149 - DNA, 15 bp, Homo sapiens
ttaactccactgctt

SEQ ID NO: 3399150 - DNA, 20 bp, Homo sapiens
ttaactccactgcttaccta

SEQ ID NO: 3399151 - DNA, 22 bp, Homo sapiens
ttaactgcagttgactttctcc

SEQ ID NO: 3399152 - DNA, 22 bp, Homo sapiens
ttaactgtccgtaagcagtata

SEQ ID NO: 3399153 - DNA, 16 bp, Homo sapiens
ttaactgtgaaatacc

SEQ ID NO: 3399154 - DNA, 12 bp, Homo sapiens
ttaactgtggat

SEQ ID NO: 3399155 - DNA, 18 bp, Homo sapiens
ttaacttaacattctgta

SEQ ID NO: 3399156 - DNA, 22 bp, Homo sapiens
ttaacttcagagggaaagtaaa

SEQ ID NO: 3399157 - DNA, 14 bp, Homo sapiens
ttaacttctctgga

SEQ ID NO: 3399158 - DNA, 17 bp, Homo sapiens
ttaacttcttgcttctt

SEQ ID NO: 3399159 - DNA, 15 bp, Homo sapiens
ttaacttgagtttta

SEQ ID NO: 3399160 - DNA, 19 bp, Homo sapiens
ttaacttggtcagagccac

SEQ ID NO: 3399161 - DNA, 16 bp, Homo sapiens
ttaactttaagtttca

SEQ ID NO: 3399162 - DNA, 14 bp, Homo sapiens
ttaacttttctacc

SEQ ID NO: 3399163 - DNA, 19 bp, Homo sapiens
ttcatctggcaacatcttt

SEQ ID NO: 3399164 - DNA, 16 bp, Homo sapiens
ttcatctggggatgac

SEQ ID NO: 3399165 - DNA, 21 bp, Homo sapiens
ttcatctggttgaatggcttt

SEQ ID NO: 3399166 - DNA, 12 bp, Homo sapiens
ttcatcttctgg

SEQ ID NO: 3399167 - DNA, 19 bp, Homo sapiens
ttcatcttctggaatattg

SEQ ID NO: 3399168 - DNA, 21 bp, Homo sapiens
ttcatcttttgaggcttctgt

SEQ ID NO: 3399169 - DNA, 23 bp, Homo sapiens
ttcatgatttcatttcaactgtt

SEQ ID NO: 3399170 - DNA, 18 bp, Homo sapiens
ttcatgcacagtagattc

SEQ ID NO: 3399171 - DNA, 22 bp, Homo sapiens
ttcatgccagctacttcctcct

SEQ ID NO: 3399172 - DNA, 17 bp, Homo sapiens
ttcatgcctttgtaagt

SEQ ID NO: 3399173 - DNA, 21 bp, Homo sapiens
ttcatgcctttgtaagttatt

SEQ ID NO: 3399174 - DNA, 23 bp, Homo sapiens
ttcatgctgaatccacctcggag

SEQ ID NO: 3399175 - DNA, 15 bp, Homo sapiens
ttcatgtattttaca

SEQ ID NO: 3399176 - DNA, 16 bp, Homo sapiens
ttcatgtgcctctgcg

SEQ ID NO: 3399177 - DNA, 21 bp, Homo sapiens
ttcatgtgcctctgcggggca

SEQ ID NO: 3399178 - DNA, 16 bp, Homo sapiens
ttcatgttagttacct

SEQ ID NO: 3399179 - DNA, 16 bp, Homo sapiens
ttcatgttcactgtga

SEQ ID NO: 3399180 - DNA, 14 bp, Homo sapiens
ttcatgtttggtgc

SEQ ID NO: 3399181 - DNA, 18 bp, Homo sapiens
ttcatgttttgtgactat

SEQ ID NO: 3399182 - DNA, 20 bp, Homo sapiens
ttcattaaacttgaagcagt

SEQ ID NO: 3399183 - DNA, 14 bp, Homo sapiens
ttcattaaatgttt

SEQ ID NO: 3399184 - DNA, 16 bp, Homo sapiens
ttcattaattctataa

SEQ ID NO: 3399185 - DNA, 21 bp, Homo sapiens
ttcattacttgattaagattt

SEQ ID NO: 3399186 - DNA, 12 bp, Homo sapiens
ttcattattctc

SEQ ID NO: 3399187 - DNA, 13 bp, Homo sapiens
ttcattattctca

SEQ ID NO: 3399188 - DNA, 14 bp, Homo sapiens
ttcattattctcat

SEQ ID NO: 3399189 - DNA, 13 bp, Homo sapiens
ttcattattggaa

SEQ ID NO: 3399190 - DNA, 17 bp, Homo sapiens
ttcattattggaattaa

SEQ ID NO: 3399191 - DNA, 20 bp, Homo sapiens
ttcattattggaattaacct

SEQ ID NO: 3399192 - DNA, 14 bp, Homo sapiens
ttcattattttgtg

SEQ ID NO: 3399193 - DNA, 15 bp, Homo sapiens
ttcattattttgtgg

SEQ ID NO: 3399194 - DNA, 14 bp, Homo sapiens
ttcattcaaactgc

SEQ ID NO: 3399195 - DNA, 17 bp, Homo sapiens
ttcattcaaatcagtga

SEQ ID NO: 3399196 - DNA, 14 bp, Homo sapiens
ttcattcaagctat

SEQ ID NO: 3399197 - DNA, 17 bp, Homo sapiens
ttcattcacttctctta

SEQ ID NO: 3399198 - DNA, 22 bp, Homo sapiens
ttcattccttcagatttggctt

SEQ ID NO: 3399199 - DNA, 15 bp, Homo sapiens
ttcattctcctgcct

SEQ ID NO: 3399200 - DNA, 12 bp, Homo sapiens
ttcattctcctt

SEQ ID NO: 3399201 - DNA, 18 bp, Homo sapiens
ttcattctgcaagtatac

SEQ ID NO: 3399202 - DNA, 16 bp, Homo sapiens
ttcattcttctctagc

SEQ ID NO: 3399203 - DNA, 17 bp, Homo sapiens
ttcattgagagttttgt

SEQ ID NO: 3399204 - DNA, 22 bp, Homo sapiens
ttcattgagagttttgtcttga

SEQ ID NO: 3399205 - DNA, 19 bp, Homo sapiens
ttcattgcactttgattag

SEQ ID NO: 3399206 - DNA, 15 bp, Homo sapiens
ttcattgccagtgtc

SEQ ID NO: 3399207 - DNA, 16 bp, Homo sapiens
ttcattgccagtgtct

SEQ ID NO: 3399208 - DNA, 18 bp, Homo sapiens
ttcattgcctgtgtatgg

SEQ ID NO: 3399209 - DNA, 23 bp, Homo sapiens
ttcattggatttttgttaatttt

SEQ ID NO: 3399210 - DNA, 13 bp, Homo sapiens
ttcattggctcct

SEQ ID NO: 3399211 - DNA, 22 bp, Homo sapiens
ttcattggtctaatttattcaa

SEQ ID NO: 3399212 - DNA, 17 bp, Homo sapiens
ttcattgtaatgttact

SEQ ID NO: 3399213 - DNA, 13 bp, Homo sapiens
ttcatttaaaatg

SEQ ID NO: 3399214 - DNA, 21 bp, Homo sapiens
ttcatttagctaaacggattc

SEQ ID NO: 3399215 - DNA, 17 bp, Homo sapiens
ttcatttatctataatt

SEQ ID NO: 3399216 - DNA, 13 bp, Homo sapiens
ttcatttcaatca

SEQ ID NO: 3399217 - DNA, 14 bp, Homo sapiens
ttcatttcaatcat

SEQ ID NO: 3399218 - DNA, 21 bp, Homo sapiens
ttcatttcaatcattgaagta

SEQ ID NO: 3399219 - DNA, 13 bp, Homo sapiens
ttcatttcattgt

SEQ ID NO: 3399220 - DNA, 13 bp, Homo sapiens
ttcatttccactc

SEQ ID NO: 3399221 - DNA, 15 bp, Homo sapiens
ttcatttctaattaa

SEQ ID NO: 3399222 - DNA, 21 bp, Homo sapiens
ttcatttcttacgttctttca

SEQ ID NO: 3399223 - DNA, 17 bp, Homo sapiens
ttcatttcttcctcagc

SEQ ID NO: 3399224 - DNA, 19 bp, Homo sapiens
ttcatttcttcctcagctg

SEQ ID NO: 3399225 - DNA, 20 bp, Homo sapiens
ttcatttggtgttcctggaa

SEQ ID NO: 3399226 - DNA, 22 bp, Homo sapiens
ttcatttggtgttcctggaagc

SEQ ID NO: 3399227 - DNA, 22 bp, Homo sapiens
ttcatttggttcattaattcta

SEQ ID NO: 3399228 - DNA, 14 bp, Homo sapiens
ttcatttgtacaag

SEQ ID NO: 3399229 - DNA, 15 bp, Homo sapiens
ttcatttgtgtcaat

SEQ ID NO: 3399230 - DNA, 16 bp, Homo sapiens
ttcatttgttttgctt

SEQ ID NO: 3399231 - DNA, 16 bp, Homo sapiens
ttcattttaaaaagtc

SEQ ID NO: 3399232 - DNA, 18 bp, Homo sapiens
ttcattttcatcactggg

SEQ ID NO: 3399233 - DNA, 21 bp, Homo sapiens
ttcattttctgacatgcattg

SEQ ID NO: 3399234 - DNA, 17 bp, Homo sapiens
ttcattttgaaaaacac

SEQ ID NO: 3399235 - DNA, 12 bp, Homo sapiens
ttcattttggtt

SEQ ID NO: 3399236 - DNA, 16 bp, Homo sapiens
ttcattttggttttgt

SEQ ID NO: 3399237 - DNA, 16 bp, Homo sapiens
ttccaaaaaattaaaa

SEQ ID NO: 3399238 - DNA, 14 bp, Homo sapiens
ttccaaaacaaaaa

SEQ ID NO: 3399239 - DNA, 12 bp, Homo sapiens
ttccaaaataat

SEQ ID NO: 3399240 - DNA, 14 bp, Homo sapiens
ttccaaaatattat

SEQ ID NO: 3399241 - DNA, 16 bp, Homo sapiens
ttccaaaatctcccat

SEQ ID NO: 3399242 - DNA, 14 bp, Homo sapiens
ttccaaaattctta

SEQ ID NO: 3399243 - DNA, 20 bp, Homo sapiens
ttccaaaattcttatttttc

SEQ ID NO: 3399244 - DNA, 15 bp, Homo sapiens
ttccaaacaaaagca

SEQ ID NO: 3399245 - DNA, 16 bp, Homo sapiens
ttccaaacctgacaga

SEQ ID NO: 3399246 - DNA, 16 bp, Homo sapiens
ttccaaacctggttca

SEQ ID NO: 3399247 - DNA, 17 bp, Homo sapiens
ttccaaacctggttcat

SEQ ID NO: 3399248 - DNA, 17 bp, Homo sapiens
ttccaaagtctctaatt

SEQ ID NO: 3399249 - DNA, 20 bp, Homo sapiens
ttccaaagtgtaagtttgtg

SEQ ID NO: 3399250 - DNA, 17 bp, Homo sapiens
ttccaaatgaatgttgt

SEQ ID NO: 3399251 - DNA, 21 bp, Homo sapiens
ttccaaatgaatgttgtctgt

SEQ ID NO: 3399252 - DNA, 17 bp, Homo sapiens
ttccaaatgcaatttga

SEQ ID NO: 3399253 - DNA, 13 bp, Homo sapiens
ttccaaattattt

SEQ ID NO: 3399254 - DNA, 16 bp, Homo sapiens
ttccaaattatttctt

SEQ ID NO: 3399255 - DNA, 14 bp, Homo sapiens
ttccaaattcagtt

SEQ ID NO: 3399256 - DNA, 19 bp, Homo sapiens
ttccaacaccacagacaca

SEQ ID NO: 3399257 - DNA, 20 bp, Homo sapiens
ttccaacaccacagacacac

SEQ ID NO: 3399258 - DNA, 23 bp, Homo sapiens
ttccaacagctcaagtcttccct

SEQ ID NO: 3399259 - DNA, 14 bp, Homo sapiens
ttccaacagtgagt

SEQ ID NO: 3399260 - DNA, 15 bp, Homo sapiens
ttccaacatttctca

SEQ ID NO: 3399261 - DNA, 15 bp, Homo sapiens
ttccaaccaggcagt

SEQ ID NO: 3399262 - DNA, 18 bp, Homo sapiens
ttccaactggcactctgt

SEQ ID NO: 3399263 - DNA, 21 bp, Homo sapiens
ttccaagaaagatgaatacat

SEQ ID NO: 3399264 - DNA, 14 bp, Homo sapiens
ttccaagacattgt

SEQ ID NO: 3399265 - DNA, 17 bp, Homo sapiens
ttccaagacattgtcaa

SEQ ID NO: 3399266 - DNA, 19 bp, Homo sapiens
ttccaagacattgtcaata

SEQ ID NO: 3399267 - DNA, 20 bp, Homo sapiens
ttccaagacattgtcaataa

SEQ ID NO: 3399268 - DNA, 22 bp, Homo sapiens
ttccaagttccccatccctgtc

SEQ ID NO: 3399269 - DNA, 21 bp, Homo sapiens
ttccaataaaccaggtttaga

SEQ ID NO: 3399270 - DNA, 15 bp, Homo sapiens
ttccaattaaattta

SEQ ID NO: 3399271 - DNA, 21 bp, Homo sapiens
ttccaattttctggaatacat

SEQ ID NO: 3399272 - DNA, 18 bp, Homo sapiens
ttccacaaaatctgtcca

SEQ ID NO: 3399273 - DNA, 18 bp, Homo sapiens
ttccacaccaagcagcaa

SEQ ID NO: 3399274 - DNA, 20 bp, Homo sapiens
ttccacacccaatgctgctc

SEQ ID NO: 3399275 - DNA, 19 bp, Homo sapiens
ttccacagattgtttctat

SEQ ID NO: 3399276 - DNA, 15 bp, Homo sapiens
ttccacatgctctga

SEQ ID NO: 3399277 - DNA, 13 bp, Homo sapiens
ttccacatttgtc

SEQ ID NO: 3399278 - DNA, 19 bp, Homo sapiens
ttccacatttttgcacaga

SEQ ID NO: 3399279 - DNA, 18 bp, Homo sapiens
ttccaccccaagagaact

SEQ ID NO: 3399280 - DNA, 20 bp, Homo sapiens
ttccaccccaagagaactcg

SEQ ID NO: 3399281 - DNA, 13 bp, Homo sapiens
ttccacccgtctc

SEQ ID NO: 3399282 - DNA, 13 bp, Homo sapiens
ttccacctccctc

SEQ ID NO: 3399283 - DNA, 15 bp, Homo sapiens
ttccactacacctgg

SEQ ID NO: 3399284 - DNA, 22 bp, Homo sapiens
ttccactacacctggctgaggt

SEQ ID NO: 3399285 - DNA, 12 bp, Homo sapiens
ttccactccact

SEQ ID NO: 3399286 - DNA, 20 bp, Homo sapiens
ttccactcgatgatgcttct

SEQ ID NO: 3399287 - DNA, 15 bp, Homo sapiens
ttccactgcctctgc

SEQ ID NO: 3399288 - DNA, 16 bp, Homo sapiens
ttccactgcctctgcc

SEQ ID NO: 3399289 - DNA, 17 bp, Homo sapiens
ttcgtttttcttggggt

SEQ ID NO: 3399290 - DNA, 17 bp, Homo sapiens
ttctaaaaagattagca

SEQ ID NO: 3399291 - DNA, 18 bp, Homo sapiens
ttctaaaacattcccctc

SEQ ID NO: 3399292 - DNA, 13 bp, Homo sapiens
ttctaaaagaata

SEQ ID NO: 3399293 - DNA, 17 bp, Homo sapiens
ttctaaaagctttcatg

SEQ ID NO: 3399294 - DNA, 23 bp, Homo sapiens
ttctaaacaagaaccatttgcaa

SEQ ID NO: 3399295 - DNA, 22 bp, Homo sapiens
ttctaaacaagaatcagtctat

SEQ ID NO: 3399296 - DNA, 18 bp, Homo sapiens
ttctaaacccaatccaaa

SEQ ID NO: 3399297 - DNA, 14 bp, Homo sapiens
ttctaaagattcta

SEQ ID NO: 3399298 - DNA, 23 bp, Homo sapiens
ttctaaagattctatagttctag

SEQ ID NO: 3399299 - DNA, 13 bp, Homo sapiens
ttctaaaggtcca

SEQ ID NO: 3399300 - DNA, 12 bp, Homo sapiens
ttctaaagttct

SEQ ID NO: 3399301 - DNA, 13 bp, Homo sapiens
ttctaaagttcta

SEQ ID NO: 3399302 - DNA, 12 bp, Homo sapiens
ttctaaatgaat

SEQ ID NO: 3399303 - DNA, 21 bp, Homo sapiens
ttctaaatgaatgtttacact

SEQ ID NO: 3399304 - DNA, 13 bp, Homo sapiens
ttctaaatgcata

SEQ ID NO: 3399305 - DNA, 23 bp, Homo sapiens
ttctaaatgcatatcctgagcca

SEQ ID NO: 3399306 - DNA, 20 bp, Homo sapiens
ttctaacaaaaaaatatatt

SEQ ID NO: 3399307 - DNA, 22 bp, Homo sapiens
ttctaacagatcagaacatgaa

SEQ ID NO: 3399308 - DNA, 23 bp, Homo sapiens
ttctaacagatcagaacatgaaa

SEQ ID NO: 3399309 - DNA, 19 bp, Homo sapiens
ttctaactttattctttgt

SEQ ID NO: 3399310 - DNA, 16 bp, Homo sapiens
ttctaagaaaagcatt

SEQ ID NO: 3399311 - DNA, 16 bp, Homo sapiens
ttctaagactcaaatg

SEQ ID NO: 3399312 - DNA, 12 bp, Homo sapiens
ttctaagatgtg

SEQ ID NO: 3399313 - DNA, 21 bp, Homo sapiens
ttctaagatgtgatattctaa

SEQ ID NO: 3399314 - DNA, 23 bp, Homo sapiens
ttctaagatgtgatattctaaga

SEQ ID NO: 3399315 - DNA, 17 bp, Homo sapiens
ttctaaggctctgagag

SEQ ID NO: 3399316 - DNA, 14 bp, Homo sapiens
ttctaagtgggaga

SEQ ID NO: 3399317 - DNA, 20 bp, Homo sapiens
ttctaagtttctaagattct

SEQ ID NO: 3399318 - DNA, 18 bp, Homo sapiens
ttctaataatttctaatg

SEQ ID NO: 3399319 - DNA, 14 bp, Homo sapiens
ttctaatagaactc

SEQ ID NO: 3399320 - DNA, 13 bp, Homo sapiens
ttctaatatcatt

SEQ ID NO: 3399321 - DNA, 13 bp, Homo sapiens
ttctaatgtcttc

SEQ ID NO: 3399322 - DNA, 16 bp, Homo sapiens
ttctaatgttccccgt

SEQ ID NO: 3399323 - DNA, 17 bp, Homo sapiens
ttctaattaaaattgtg

SEQ ID NO: 3399324 - DNA, 13 bp, Homo sapiens
ttctaattgtcag

SEQ ID NO: 3399325 - DNA, 14 bp, Homo sapiens
ttctacaaagcact

SEQ ID NO: 3399326 - DNA, 15 bp, Homo sapiens
ttctacaatgtgaac

SEQ ID NO: 3399327 - DNA, 16 bp, Homo sapiens
ttctacaatgtgaact

SEQ ID NO: 3399328 - DNA, 17 bp, Homo sapiens
ttctacaattaatagtt

SEQ ID NO: 3399329 - DNA, 14 bp, Homo sapiens
ttctacagaataat

SEQ ID NO: 3399330 - DNA, 21 bp, Homo sapiens
ttctacagtggttttatactg

SEQ ID NO: 3399331 - DNA, 14 bp, Homo sapiens
ttctacagttaatt

SEQ ID NO: 3399332 - DNA, 22 bp, Homo sapiens
ttctacataagtaattcaagaa

SEQ ID NO: 3399333 - DNA, 14 bp, Homo sapiens
ttctacatgactgg

SEQ ID NO: 3399334 - DNA, 20 bp, Homo sapiens
ttctacatttgagggcccag

SEQ ID NO: 3399335 - DNA, 19 bp, Homo sapiens
ttctaccaggcaaattcac

SEQ ID NO: 3399336 - DNA, 15 bp, Homo sapiens
ttctaccatttcaga

SEQ ID NO: 3399337 - DNA, 18 bp, Homo sapiens
ttctaccatttcagagag

SEQ ID NO: 3399338 - DNA, 18 bp, Homo sapiens
ttctacccaacggccctg

SEQ ID NO: 3399339 - DNA, 20 bp, Homo sapiens
ttctaccctagccattcctg

SEQ ID NO: 3399340 - DNA, 17 bp, Homo sapiens
ttctacctcagcagcag

SEQ ID NO: 3399341 - DNA, 14 bp, Homo sapiens
ttctacggatcatc

SEQ ID NO: 3399342 - DNA, 17 bp, Homo sapiens
ttctactcttgtcattt

SEQ ID NO: 3399343 - DNA, 23 bp, Homo sapiens
ttctagaaatacacttttttcca

SEQ ID NO: 3399344 - DNA, 16 bp, Homo sapiens
ttctagaacctgggct

SEQ ID NO: 3399345 - DNA, 21 bp, Homo sapiens
ttctagaatttatcacacttc

SEQ ID NO: 3399346 - DNA, 22 bp, Homo sapiens
ttctagacatggaggttctaag

SEQ ID NO: 3399347 - DNA, 14 bp, Homo sapiens
ttctagagttcaga

SEQ ID NO: 3399348 - DNA, 16 bp, Homo sapiens
ttctagatcagatgct

SEQ ID NO: 3399349 - DNA, 22 bp, Homo sapiens
ttctagatcagatgctccaaga

SEQ ID NO: 3399350 - DNA, 24 bp, Homo sapiens
ttctagatcagatgctccaagatt

SEQ ID NO: 3399351 - DNA, 12 bp, Homo sapiens
ttctagatgatt

SEQ ID NO: 3399352 - DNA, 16 bp, Homo sapiens
ttctagcaattttctt

SEQ ID NO: 3399353 - DNA, 19 bp, Homo sapiens
ttctagcaattttctttgt

SEQ ID NO: 3399354 - DNA, 17 bp, Homo sapiens
ttctagctaatgtaata

SEQ ID NO: 3399355 - DNA, 17 bp, Homo sapiens
ttctagctagaaatatg

SEQ ID NO: 3399356 - DNA, 19 bp, Homo sapiens
ttctagctagaaatatgat

SEQ ID NO: 3399357 - DNA, 21 bp, Homo sapiens
ttctagctgttgagctgtttt

SEQ ID NO: 3399358 - DNA, 21 bp, Homo sapiens
ttctaggcactgtagttctaa

SEQ ID NO: 3399359 - DNA, 20 bp, Homo sapiens
ttctaggcatctctgtactt

SEQ ID NO: 3399360 - DNA, 16 bp, Homo sapiens
ttctaggggagaagag

SEQ ID NO: 3399361 - DNA, 17 bp, Homo sapiens
ttctaggtttcaaagat

SEQ ID NO: 3399362 - DNA, 20 bp, Homo sapiens
ttctaggtttcaaagatgct

SEQ ID NO: 3399363 - DNA, 22 bp, Homo sapiens
ttctagtggtctttgtaagagt

SEQ ID NO: 3399364 - DNA, 11 bp, Homo sapiens
ttctagttcaa

SEQ ID NO: 3399365 - DNA, 20 bp, Homo sapiens
ttctagttgaggagtttcct

SEQ ID NO: 3399366 - DNA, 21 bp, Homo sapiens
ttctataaaactctgcatgta

SEQ ID NO: 3399367 - DNA, 14 bp, Homo sapiens
ttctataaatcagt

SEQ ID NO: 3399368 - DNA, 20 bp, Homo sapiens
ttctataacctggatttttt

SEQ ID NO: 3399369 - DNA, 13 bp, Homo sapiens
ttctataaggcca

SEQ ID NO: 3399370 - DNA, 23 bp, Homo sapiens
ttctataaggccataaaacaggt

SEQ ID NO: 3399371 - DNA, 14 bp, Homo sapiens
ttctatacaaatat

SEQ ID NO: 3399372 - DNA, 18 bp, Homo sapiens
ttctatacacaccctgcc

SEQ ID NO: 3399373 - DNA, 23 bp, Homo sapiens
ttctatagcagattgtgtaacaa

SEQ ID NO: 3399374 - DNA, 14 bp, Homo sapiens
ttctatagttctag

SEQ ID NO: 3399375 - DNA, 17 bp, Homo sapiens
ttctatagttctagaca

SEQ ID NO: 3399376 - DNA, 20 bp, Homo sapiens
ttctatatgaatttaaatat

SEQ ID NO: 3399377 - DNA, 17 bp, Homo sapiens
ttctatattttaataga

SEQ ID NO: 3399378 - DNA, 19 bp, Homo sapiens
ttctatattttaatagaaa

SEQ ID NO: 3399379 - DNA, 14 bp, Homo sapiens
ttctatcaagccca

SEQ ID NO: 3399380 - DNA, 14 bp, Homo sapiens
ttctatcacatatt

SEQ ID NO: 3399381 - DNA, 17 bp, Homo sapiens
ttctatcacatatttga

SEQ ID NO: 3399382 - DNA, 23 bp, Homo sapiens
ttctatcaggaaaacaaatcact

SEQ ID NO: 3399383 - DNA, 22 bp, Homo sapiens
ttctatcagttatcctttgtga

SEQ ID NO: 3399384 - DNA, 13 bp, Homo sapiens
ttctatcattttt

SEQ ID NO: 3399385 - DNA, 17 bp, Homo sapiens
ttctatcatttttgtac

SEQ ID NO: 3399386 - DNA, 18 bp, Homo sapiens
ttctatccccaatcagct

SEQ ID NO: 3399387 - DNA, 20 bp, Homo sapiens
ttctatccccaatcagctcc

SEQ ID NO: 3399388 - DNA, 18 bp, Homo sapiens
ttctatggctttcaaagc

SEQ ID NO: 3399389 - DNA, 14 bp, Homo sapiens
ttctatgtatgtta

SEQ ID NO: 3399390 - DNA, 17 bp, Homo sapiens
ttctatgtatgttaatt

SEQ ID NO: 3399391 - DNA, 15 bp, Homo sapiens
ttctatgttaaatac

SEQ ID NO: 3399392 - DNA, 19 bp, Homo sapiens
ttctatgttaaatactgtg

SEQ ID NO: 3399393 - DNA, 21 bp, Homo sapiens
ttctatgttaaatactgtgca

SEQ ID NO: 3399394 - DNA, 21 bp, Homo sapiens
ttctattaaagtgctaaggtt

SEQ ID NO: 3399395 - DNA, 15 bp, Homo sapiens
ttctattaaatagtt

SEQ ID NO: 3399396 - DNA, 13 bp, Homo sapiens
ttctattatatat

SEQ ID NO: 3399397 - DNA, 15 bp, Homo sapiens
ttctattatggaaaa

SEQ ID NO: 3399398 - DNA, 19 bp, Homo sapiens
ttctattatttttataatt

SEQ ID NO: 3399399 - DNA, 14 bp, Homo sapiens
ttctattgaattcg

SEQ ID NO: 3399400 - DNA, 17 bp, Homo sapiens
ttctattgacttcaatg

SEQ ID NO: 3399401 - DNA, 23 bp, Homo sapiens
ttctattgacttcaatgatagta

SEQ ID NO: 3399402 - DNA, 17 bp, Homo sapiens
ttctattgtattatttg

SEQ ID NO: 3399403 - DNA, 14 bp, Homo sapiens
ttctattgttactc

SEQ ID NO: 3399404 - DNA, 13 bp, Homo sapiens
ttctatttaatgg

SEQ ID NO: 3399405 - DNA, 14 bp, Homo sapiens
ttctatttaatgga

SEQ ID NO: 3399406 - DNA, 18 bp, Homo sapiens
ttctatttatatgtacat

SEQ ID NO: 3399407 - DNA, 16 bp, Homo sapiens
ttctatttgctgggct

SEQ ID NO: 3399408 - DNA, 18 bp, Homo sapiens
ttctatttgctgggcttt

SEQ ID NO: 3399409 - DNA, 14 bp, Homo sapiens
ttctattttcttaa

SEQ ID NO: 3399410 - DNA, 15 bp, Homo sapiens
ttctattttcttaaa

SEQ ID NO: 3399411 - DNA, 17 bp, Homo sapiens
ttctatttttatcatga

SEQ ID NO: 3399412 - DNA, 15 bp, Homo sapiens
ttctcaaagcaggaa

SEQ ID NO: 3399413 - DNA, 14 bp, Homo sapiens
ttctcaaagttaat

SEQ ID NO: 3399414 - DNA, 17 bp, Homo sapiens
ttctcaagtgccttaat

SEQ ID NO: 3399415 - DNA, 14 bp, Homo sapiens
ttcttttacagact

SEQ ID NO: 3399416 - DNA, 18 bp, Homo sapiens
ttcttttccaagctcctt

SEQ ID NO: 3399417 - DNA, 15 bp, Homo sapiens
ttcttttgaactgtt

SEQ ID NO: 3399418 - DNA, 15 bp, Homo sapiens
ttcttttgattttgt

SEQ ID NO: 3399419 - DNA, 16 bp, Homo sapiens
ttcttttgtaattgtg

SEQ ID NO: 3399420 - DNA, 13 bp, Homo sapiens
ttcttttgtctcc

SEQ ID NO: 3399421 - DNA, 17 bp, Homo sapiens
ttcttttgtggtgtctt

SEQ ID NO: 3399422 - DNA, 14 bp, Homo sapiens
ttcttttgttactg

SEQ ID NO: 3399423 - DNA, 19 bp, Homo sapiens
ttcttttgttactgttctt

SEQ ID NO: 3399424 - DNA, 23 bp, Homo sapiens
ttcttttgttactgttcttgctg

SEQ ID NO: 3399425 - DNA, 20 bp, Homo sapiens
ttctttttaaaatggtgctt

SEQ ID NO: 3399426 - DNA, 21 bp, Homo sapiens
ttctttttaagtaatgtggaa

SEQ ID NO: 3399427 - DNA, 15 bp, Homo sapiens
ttctttttacagcat

SEQ ID NO: 3399428 - DNA, 12 bp, Homo sapiens
ttctttttctga

SEQ ID NO: 3399429 - DNA, 13 bp, Homo sapiens
ttctttttgtaca

SEQ ID NO: 3399430 - DNA, 23 bp, Homo sapiens
ttcttttttaaattttcttcagt

SEQ ID NO: 3399431 - DNA, 23 bp, Homo sapiens
ttcttttttatgcagaatttgat

SEQ ID NO: 3399432 - DNA, 16 bp, Homo sapiens
ttcttttttcctctga

SEQ ID NO: 3399433 - DNA, 12 bp, Homo sapiens
ttgaaaaagcag

SEQ ID NO: 3399434 - DNA, 17 bp, Homo sapiens
ttgaaaaatataaaatt

SEQ ID NO: 3399435 - DNA, 22 bp, Homo sapiens
ttgaaaaattatcagttatatt

SEQ ID NO: 3399436 - DNA, 18 bp, Homo sapiens
ttgaaaacataatctgca

SEQ ID NO: 3399437 - DNA, 14 bp, Homo sapiens
ttgaaaacttcaaa

SEQ ID NO: 3399438 - DNA, 22 bp, Homo sapiens
ttgaaaagctattagccaggat

SEQ ID NO: 3399439 - DNA, 19 bp, Homo sapiens
ttgaaaagcttcttaatta

SEQ ID NO: 3399440 - DNA, 22 bp, Homo sapiens
ttgaaaagcttcttaattaatt

SEQ ID NO: 3399441 - DNA, 21 bp, Homo sapiens
ttgaaaataagaatagaaata

SEQ ID NO: 3399442 - DNA, 21 bp, Homo sapiens
ttgaaaatatttctctagtgt

SEQ ID NO: 3399443 - DNA, 17 bp, Homo sapiens
ttgaaaatgtgtttgct

SEQ ID NO: 3399444 - DNA, 21 bp, Homo sapiens
ttgaaaattcaaaaagtgttt

SEQ ID NO: 3399445 - DNA, 12 bp, Homo sapiens
ttgaaacagaaa

SEQ ID NO: 3399446 - DNA, 14 bp, Homo sapiens
ttgaaacagcagtc

SEQ ID NO: 3399447 - DNA, 19 bp, Homo sapiens
ttgaaacccacagttttag

SEQ ID NO: 3399448 - DNA, 16 bp, Homo sapiens
ttgaaacctgctctgt

SEQ ID NO: 3399449 - DNA, 20 bp, Homo sapiens
ttgaaagattttattgtata

SEQ ID NO: 3399450 - DNA, 11 bp, Homo sapiens
ttgaaagtgtt

SEQ ID NO: 3399451 - DNA, 17 bp, Homo sapiens
ttgaaagttttcagaac

SEQ ID NO: 3399452 - DNA, 13 bp, Homo sapiens
ttgaaatacctca

SEQ ID NO: 3399453 - DNA, 18 bp, Homo sapiens
ttgaaatacctcatgttt

SEQ ID NO: 3399454 - DNA, 22 bp, Homo sapiens
ttgaaatacctcatgtttatga

SEQ ID NO: 3399455 - DNA, 12 bp, Homo sapiens
ttgaaatacctt

SEQ ID NO: 3399456 - DNA, 19 bp, Homo sapiens
ttgaaatagttcaaactgc

SEQ ID NO: 3399457 - DNA, 13 bp, Homo sapiens
ttgaaatctttta

SEQ ID NO: 3399458 - DNA, 20 bp, Homo sapiens
ttgaaattaagaaggcaaaa

SEQ ID NO: 3399459 - DNA, 19 bp, Homo sapiens
ttgaaattatgtatgttta

SEQ ID NO: 3399460 - DNA, 14 bp, Homo sapiens
ttgaaattctattt

SEQ ID NO: 3399461 - DNA, 15 bp, Homo sapiens
ttgaaattgtacata

SEQ ID NO: 3399462 - DNA, 15 bp, Homo sapiens
ttgaaattttgcaaa

SEQ ID NO: 3399463 - DNA, 21 bp, Homo sapiens
ttgaaatttttattaaattat

SEQ ID NO: 3399464 - DNA, 14 bp, Homo sapiens
ttgaacacagtatt

SEQ ID NO: 3399465 - DNA, 11 bp, Homo sapiens
ttgaacactgg

SEQ ID NO: 3399466 - DNA, 20 bp, Homo sapiens
ttgaacactggctaaagata

SEQ ID NO: 3399467 - DNA, 21 bp, Homo sapiens
ttgaacatgtgccttttctga

SEQ ID NO: 3399468 - DNA, 17 bp, Homo sapiens
ttgaaccattatacttt

SEQ ID NO: 3399469 - DNA, 20 bp, Homo sapiens
ttgaaccattatactttata

SEQ ID NO: 3399470 - DNA, 13 bp, Homo sapiens
ttgaactccaaga

SEQ ID NO: 3399471 - DNA, 16 bp, Homo sapiens
ttgaactcctggcctc

SEQ ID NO: 3399472 - DNA, 15 bp, Homo sapiens
ttgaactctggtggc

SEQ ID NO: 3399473 - DNA, 18 bp, Homo sapiens
ttgaactgggtacttgtg

SEQ ID NO: 3399474 - DNA, 17 bp, Homo sapiens
ttgaactgttagatgct

SEQ ID NO: 3399475 - DNA, 13 bp, Homo sapiens
ttgaactttgcca

SEQ ID NO: 3399476 - DNA, 13 bp, Homo sapiens
ttgaactttgtag

SEQ ID NO: 3399477 - DNA, 16 bp, Homo sapiens
ttgaagaaaagcactt

SEQ ID NO: 3399478 - DNA, 14 bp, Homo sapiens
ttgaagaaacagat

SEQ ID NO: 3399479 - DNA, 19 bp, Homo sapiens
ttgaagaaagtcagctctt

SEQ ID NO: 3399480 - DNA, 20 bp, Homo sapiens
ttgaagaactgcaggccctg

SEQ ID NO: 3399481 - DNA, 21 bp, Homo sapiens
ttgaagaatatttaagaaaag

SEQ ID NO: 3399482 - DNA, 20 bp, Homo sapiens
ttgaagagatttcaacatat

SEQ ID NO: 3399483 - DNA, 18 bp, Homo sapiens
ttgaagcagtcttgctct

SEQ ID NO: 3399484 - DNA, 15 bp, Homo sapiens
ttgaagccaaagaaa

SEQ ID NO: 3399485 - DNA, 20 bp, Homo sapiens
ttgaagccaagtggggtgct

SEQ ID NO: 3399486 - DNA, 18 bp, Homo sapiens
ttgaagccgactctggcc

SEQ ID NO: 3399487 - DNA, 15 bp, Homo sapiens
ttgaagcgagtcatt

SEQ ID NO: 3399488 - DNA, 17 bp, Homo sapiens
ttgaaggaaaatgatac

SEQ ID NO: 3399489 - DNA, 16 bp, Homo sapiens
ttgaaggaagagggac

SEQ ID NO: 3399490 - DNA, 17 bp, Homo sapiens
ttgaaggcaaaattgca

SEQ ID NO: 3399491 - DNA, 21 bp, Homo sapiens
ttgaagggagaagacactgca

SEQ ID NO: 3399492 - DNA, 14 bp, Homo sapiens
ttgaagggtcctgc

SEQ ID NO: 3399493 - DNA, 15 bp, Homo sapiens
ttgaagtaaactttt

SEQ ID NO: 3399494 - DNA, 16 bp, Homo sapiens
ttgaagtaaacttttt

SEQ ID NO: 3399495 - DNA, 12 bp, Homo sapiens
ttgaagtaatga

SEQ ID NO: 3399496 - DNA, 14 bp, Homo sapiens
ttgaagtatattct

SEQ ID NO: 3399497 - DNA, 17 bp, Homo sapiens
ttgaagtatattcttat

SEQ ID NO: 3399498 - DNA, 20 bp, Homo sapiens
ttgaagtatattcttattgg

SEQ ID NO: 3399499 - DNA, 18 bp, Homo sapiens
ttgaagtattttgctgga

SEQ ID NO: 3399500 - DNA, 15 bp, Homo sapiens
ttgaagtcaccttgt

SEQ ID NO: 3399501 - DNA, 16 bp, Homo sapiens
ttgaagtgactgttgt

SEQ ID NO: 3399502 - DNA, 20 bp, Homo sapiens
ttgaagtgactgttgtacca

SEQ ID NO: 3399503 - DNA, 21 bp, Homo sapiens
ttgaagttcatggtgatcagt

SEQ ID NO: 3399504 - DNA, 22 bp, Homo sapiens
ttgaagtttcaagttttaaagt

SEQ ID NO: 3399505 - DNA, 15 bp, Homo sapiens
ttgaagtttgaacca

SEQ ID NO: 3399506 - DNA, 16 bp, Homo sapiens
ttgaataaaaatgcac

SEQ ID NO: 3399507 - DNA, 15 bp, Homo sapiens
ttgaataaagtattc

SEQ ID NO: 3399508 - DNA, 15 bp, Homo sapiens
ttgaataatgacaga

SEQ ID NO: 3399509 - DNA, 23 bp, Homo sapiens
ttgaataatgacagatggtgaag

SEQ ID NO: 3399510 - DNA, 19 bp, Homo sapiens
ttgaataccattaaaactg

SEQ ID NO: 3399511 - DNA, 12 bp, Homo sapiens
ttgaatactttt

SEQ ID NO: 3399512 - DNA, 13 bp, Homo sapiens
ttgaatacttttt

SEQ ID NO: 3399513 - DNA, 13 bp, Homo sapiens
ttgaatataaaaa

SEQ ID NO: 3399514 - DNA, 20 bp, Homo sapiens
ttgaatataagaaaatgctt

SEQ ID NO: 3399515 - DNA, 19 bp, Homo sapiens
ttgaatatattataatctt

SEQ ID NO: 3399516 - DNA, 13 bp, Homo sapiens
ttgaatattactc

SEQ ID NO: 3399517 - DNA, 23 bp, Homo sapiens
ttgaatctgattggacattttct

SEQ ID NO: 3399518 - DNA, 21 bp, Homo sapiens
ttgaatgaaaaatttaagcat

SEQ ID NO: 3399519 - DNA, 18 bp, Homo sapiens
ttgaatggcctgccttga

SEQ ID NO: 3399520 - DNA, 12 bp, Homo sapiens
ttgaatgtcaca

SEQ ID NO: 3399521 - DNA, 12 bp, Homo sapiens
ttgaatgtcttt

SEQ ID NO: 3399522 - DNA, 19 bp, Homo sapiens
ttgaatgtggcttgagaaa

SEQ ID NO: 3399523 - DNA, 21 bp, Homo sapiens
ttgaatgtggcttgagaaata

SEQ ID NO: 3399524 - DNA, 14 bp, Homo sapiens
ttgaatgttaagca

SEQ ID NO: 3399525 - DNA, 23 bp, Homo sapiens
ttgaattaatatccctacatgta

SEQ ID NO: 3399526 - DNA, 12 bp, Homo sapiens
ttgaattatcag

SEQ ID NO: 3399527 - DNA, 20 bp, Homo sapiens
ttgaattatcagcaaagaaa

SEQ ID NO: 3399528 - DNA, 14 bp, Homo sapiens
ttgaattatgtgca

SEQ ID NO: 3399529 - DNA, 17 bp, Homo sapiens
ttgaatttcactgtctt

SEQ ID NO: 3399530 - DNA, 16 bp, Homo sapiens
ttgaattttaaatcta

SEQ ID NO: 3399531 - DNA, 17 bp, Homo sapiens
ttgacaaatctgtgtat

SEQ ID NO: 3399532 - DNA, 14 bp, Homo sapiens
ttgacaactgtgac

SEQ ID NO: 3399533 - DNA, 14 bp, Homo sapiens
ttgacaagctgact

SEQ ID NO: 3399534 - DNA, 20 bp, Homo sapiens
ttgacaagctgacttggcac

SEQ ID NO: 3399535 - DNA, 22 bp, Homo sapiens
ttgacaagctgacttggcactt

SEQ ID NO: 3399536 - DNA, 22 bp, Homo sapiens
ttgacaagtcattttaacttta

SEQ ID NO: 3399537 - DNA, 19 bp, Homo sapiens
ttgacaattcctagataaa

SEQ ID NO: 3399538 - DNA, 17 bp, Homo sapiens
ttgacacaagtggacct

SEQ ID NO: 3399539 - DNA, 19 bp, Homo sapiens
ttgacacacagaaatgtgt

SEQ ID NO: 3399540 - DNA, 19 bp, Homo sapiens
ttgacacagtcagcatgct

SEQ ID NO: 3399541 - DNA, 23 bp, Homo sapiens
ttggctattagagatcaacccct

SEQ ID NO: 3399542 - DNA, 17 bp, Homo sapiens
ttggctatttgaaatac

SEQ ID NO: 3399543 - DNA, 22 bp, Homo sapiens
ttggctatttgaaatactaaaa

SEQ ID NO: 3399544 - DNA, 14 bp, Homo sapiens
ttggctcctgagaa

SEQ ID NO: 3399545 - DNA, 18 bp, Homo sapiens
ttggctcctgagaaaggt

SEQ ID NO: 3399546 - DNA, 22 bp, Homo sapiens
ttggctctggagacagccccag

SEQ ID NO: 3399547 - DNA, 23 bp, Homo sapiens
ttggctctggagacagccccaga

SEQ ID NO: 3399548 - DNA, 11 bp, Homo sapiens
ttggctctttc

SEQ ID NO: 3399549 - DNA, 18 bp, Homo sapiens
ttggctgacttcatctgg

SEQ ID NO: 3399550 - DNA, 20 bp, Homo sapiens
ttggctggatgaaattttct

SEQ ID NO: 3399551 - DNA, 18 bp, Homo sapiens
ttggctgggggcctcagt

SEQ ID NO: 3399552 - DNA, 15 bp, Homo sapiens
ttggcttataaacac

SEQ ID NO: 3399553 - DNA, 17 bp, Homo sapiens
ttggcttataaacacat

SEQ ID NO: 3399554 - DNA, 20 bp, Homo sapiens
ttggcttataaacacattga

SEQ ID NO: 3399555 - DNA, 22 bp, Homo sapiens
ttggcttctgtgatgagctgat

SEQ ID NO: 3399556 - DNA, 16 bp, Homo sapiens
ttggctttgtttggat

SEQ ID NO: 3399557 - DNA, 20 bp, Homo sapiens
ttgggaaaaaaacttggcac

SEQ ID NO: 3399558 - DNA, 12 bp, Homo sapiens
ttgggaaaacat

SEQ ID NO: 3399559 - DNA, 16 bp, Homo sapiens
ttgggaaaacatttgc

SEQ ID NO: 3399560 - DNA, 22 bp, Homo sapiens
ttgggaaagatggataaactga

SEQ ID NO: 3399561 - DNA, 14 bp, Homo sapiens
ttgggaaagcccag

SEQ ID NO: 3399562 - DNA, 15 bp, Homo sapiens
ttgggaaagcccaga

SEQ ID NO: 3399563 - DNA, 22 bp, Homo sapiens
ttgggaaagcccagactttagt

SEQ ID NO: 3399564 - DNA, 20 bp, Homo sapiens
ttgggaatgaaattaacaca

SEQ ID NO: 3399565 - DNA, 19 bp, Homo sapiens
ttgggacaacagtgctttg

SEQ ID NO: 3399566 - DNA, 14 bp, Homo sapiens
ttgggacaccaggg

SEQ ID NO: 3399567 - DNA, 21 bp, Homo sapiens
ttgggacccaaaacacaggaa

SEQ ID NO: 3399568 - DNA, 12 bp, Homo sapiens
ttgggacttcta

SEQ ID NO: 3399569 - DNA, 14 bp, Homo sapiens
ttgggagacatgtg

SEQ ID NO: 3399570 - DNA, 16 bp, Homo sapiens
ttgggagcactggagt

SEQ ID NO: 3399571 - DNA, 22 bp, Homo sapiens
ttgggagcactggagtgcaggg

SEQ ID NO: 3399572 - DNA, 22 bp, Homo sapiens
ttgggaggttttattctgactt

SEQ ID NO: 3399573 - DNA, 21 bp, Homo sapiens
ttgggatcccaccctggggac

SEQ ID NO: 3399574 - DNA, 18 bp, Homo sapiens
ttgggatgtcttattttt

SEQ ID NO: 3399575 - DNA, 19 bp, Homo sapiens
ttgggatgtcttattttta

SEQ ID NO: 3399576 - DNA, 23 bp, Homo sapiens
ttgggatgtcttatttttagatg

SEQ ID NO: 3399577 - DNA, 22 bp, Homo sapiens
ttgggatgttccttttttcaat

SEQ ID NO: 3399578 - DNA, 17 bp, Homo sapiens
ttgggcagagctggctc

SEQ ID NO: 3399579 - DNA, 21 bp, Homo sapiens
ttgggcagagctggctctgag

SEQ ID NO: 3399580 - DNA, 19 bp, Homo sapiens
ttgggcctcaggctctgca

SEQ ID NO: 3399581 - DNA, 22 bp, Homo sapiens
ttgggcctccttcccatgcctg

SEQ ID NO: 3399582 - DNA, 15 bp, Homo sapiens
ttgggcctgggcctc

SEQ ID NO: 3399583 - DNA, 16 bp, Homo sapiens
ttgggccttgctgctg

SEQ ID NO: 3399584 - DNA, 17 bp, Homo sapiens
ttgggccttgctgctgc

SEQ ID NO: 3399585 - DNA, 20 bp, Homo sapiens
ttgggctactggcagctcct

SEQ ID NO: 3399586 - DNA, 18 bp, Homo sapiens
ttgggctccacgggcagg

SEQ ID NO: 3399587 - DNA, 20 bp, Homo sapiens
ttgggctcctggctgccagg

SEQ ID NO: 3399588 - DNA, 16 bp, Homo sapiens
ttgggctgacacctac

SEQ ID NO: 3399589 - DNA, 15 bp, Homo sapiens
ttgggctgacccagc

SEQ ID NO: 3399590 - DNA, 20 bp, Homo sapiens
ttgggctgggacttcttacc

SEQ ID NO: 3399591 - DNA, 18 bp, Homo sapiens
ttggggaaaaaagcacat

SEQ ID NO: 3399592 - DNA, 20 bp, Homo sapiens
ttggggaaacctagagaaga

SEQ ID NO: 3399593 - DNA, 13 bp, Homo sapiens
ttggggccctgcc

SEQ ID NO: 3399594 - DNA, 16 bp, Homo sapiens
ttggggcctggcttgc

SEQ ID NO: 3399595 - DNA, 16 bp, Homo sapiens
ttggggctatttgtgt

SEQ ID NO: 3399596 - DNA, 19 bp, Homo sapiens
ttggggctgtcgggggctg

SEQ ID NO: 3399597 - DNA, 21 bp, Homo sapiens
ttggggctttacatactttat

SEQ ID NO: 3399598 - DNA, 17 bp, Homo sapiens
ttggggggactctgagc

SEQ ID NO: 3399599 - DNA, 20 bp, Homo sapiens
ttgggggggtggccgctgag

SEQ ID NO: 3399600 - DNA, 15 bp, Homo sapiens
ttgggggtttttaat

SEQ ID NO: 3399601 - DNA, 17 bp, Homo sapiens
ttggggtacccactgct

SEQ ID NO: 3399602 - DNA, 22 bp, Homo sapiens
ttggggtacccactgctctggt

SEQ ID NO: 3399603 - DNA, 23 bp, Homo sapiens
ttggggtactcttgatgtgaaga

SEQ ID NO: 3399604 - DNA, 19 bp, Homo sapiens
ttggggtataggtctcatc

SEQ ID NO: 3399605 - DNA, 23 bp, Homo sapiens
ttggggtcaagaaacagccagca

SEQ ID NO: 3399606 - DNA, 20 bp, Homo sapiens
ttggggtccctccaccccac

SEQ ID NO: 3399607 - DNA, 14 bp, Homo sapiens
ttggggtctgaccc

SEQ ID NO: 3399608 - DNA, 15 bp, Homo sapiens
ttggggtctgacccc

SEQ ID NO: 3399609 - DNA, 22 bp, Homo sapiens
ttggggtgcccctctccttctt

SEQ ID NO: 3399610 - DNA, 18 bp, Homo sapiens
ttggggtgtggggtgggg

SEQ ID NO: 3399611 - DNA, 16 bp, Homo sapiens
ttggggttgtgttgtc

SEQ ID NO: 3399612 - DNA, 17 bp, Homo sapiens
ttgggtaaaatactttt

SEQ ID NO: 3399613 - DNA, 19 bp, Homo sapiens
ttgggtcattgacctctca

SEQ ID NO: 3399614 - DNA, 20 bp, Homo sapiens
ttgggtcattgacctctcag

SEQ ID NO: 3399615 - DNA, 22 bp, Homo sapiens
ttgggttcaagcgattcttctg

SEQ ID NO: 3399616 - DNA, 18 bp, Homo sapiens
ttggtaaaaatgctgctc

SEQ ID NO: 3399617 - DNA, 17 bp, Homo sapiens
ttggtaaatgtttcttt

SEQ ID NO: 3399618 - DNA, 14 bp, Homo sapiens
ttggtaagagacag

SEQ ID NO: 3399619 - DNA, 20 bp, Homo sapiens
ttggtaatcccctaaaataa

SEQ ID NO: 3399620 - DNA, 15 bp, Homo sapiens
ttggtaatgcttgga

SEQ ID NO: 3399621 - DNA, 23 bp, Homo sapiens
ttggtaattttttttgttttttg

SEQ ID NO: 3399622 - DNA, 18 bp, Homo sapiens
ttggtacagttgcaggag

SEQ ID NO: 3399623 - DNA, 17 bp, Homo sapiens
ttggtatcaagaaagtc

SEQ ID NO: 3399624 - DNA, 21 bp, Homo sapiens
ttggtctcccatatgcagaaa

SEQ ID NO: 3399625 - DNA, 22 bp, Homo sapiens
ttggtctcccttctctacactc

SEQ ID NO: 3399626 - DNA, 20 bp, Homo sapiens
ttggtctgacccactgcttt

SEQ ID NO: 3399627 - DNA, 17 bp, Homo sapiens
ttggtctttctaatgta

SEQ ID NO: 3399628 - DNA, 15 bp, Homo sapiens
ttggtgaacagtttt

SEQ ID NO: 3399629 - DNA, 15 bp, Homo sapiens
ttggtgataagtgga

SEQ ID NO: 3399630 - DNA, 23 bp, Homo sapiens
ttggtgataagtggaaaaaagag

SEQ ID NO: 3399631 - DNA, 15 bp, Homo sapiens
ttggtgattcaaatg

SEQ ID NO: 3399632 - DNA, 15 bp, Homo sapiens
ttggtgcacagtgat

SEQ ID NO: 3399633 - DNA, 17 bp, Homo sapiens
ttggtgcacagtgattt

SEQ ID NO: 3399634 - DNA, 14 bp, Homo sapiens
ttggtgcctcactg

SEQ ID NO: 3399635 - DNA, 22 bp, Homo sapiens
ttggtgcctggcctggcacaca

SEQ ID NO: 3399636 - DNA, 16 bp, Homo sapiens
ttggtgcctttcctgt

SEQ ID NO: 3399637 - DNA, 18 bp, Homo sapiens
ttggtgcctttcctgttc

SEQ ID NO: 3399638 - DNA, 22 bp, Homo sapiens
ttggtgcttacacatctcagac

SEQ ID NO: 3399639 - DNA, 19 bp, Homo sapiens
ttggtgctttttataaaaa

SEQ ID NO: 3399640 - DNA, 15 bp, Homo sapiens
ttggtggatgtaaat

SEQ ID NO: 3399641 - DNA, 18 bp, Homo sapiens
ttggtggctcacgcctgt

SEQ ID NO: 3399642 - DNA, 19 bp, Homo sapiens
ttggtgggctgatttacat

SEQ ID NO: 3399643 - DNA, 17 bp, Homo sapiens
ttggtggggccaggcca

SEQ ID NO: 3399644 - DNA, 22 bp, Homo sapiens
ttggtgtacagaccacctttca

SEQ ID NO: 3399645 - DNA, 23 bp, Homo sapiens
ttggtgtatagaagtttgtccat

SEQ ID NO: 3399646 - DNA, 21 bp, Homo sapiens
ttggtgtgattgcacagaatt

SEQ ID NO: 3399647 - DNA, 19 bp, Homo sapiens
ttggtgtgttggacagaga

SEQ ID NO: 3399648 - DNA, 15 bp, Homo sapiens
ttggtgttgtcattg

SEQ ID NO: 3399649 - DNA, 17 bp, Homo sapiens
ttggtgtttgtctgtgt

SEQ ID NO: 3399650 - DNA, 22 bp, Homo sapiens
ttggttaaaactgtacatttaa

SEQ ID NO: 3399651 - DNA, 22 bp, Homo sapiens
ttggttagacgccttccaggtc

SEQ ID NO: 3399652 - DNA, 14 bp, Homo sapiens
ttggttagaggaag

SEQ ID NO: 3399653 - DNA, 19 bp, Homo sapiens
ttggttattctaagccctt

SEQ ID NO: 3399654 - DNA, 18 bp, Homo sapiens
ttggttcatcagtgttaa

SEQ ID NO: 3399655 - DNA, 14 bp, Homo sapiens
ttggttcccttgtg

SEQ ID NO: 3399656 - DNA, 15 bp, Homo sapiens
ttggttctaatagaa

SEQ ID NO: 3399657 - DNA, 19 bp, Homo sapiens
ttggttctaatagaactca

SEQ ID NO: 3399658 - DNA, 18 bp, Homo sapiens
ttggttctgattaggtaa

SEQ ID NO: 3399659 - DNA, 20 bp, Homo sapiens
ttggttgctaagaagcctat

SEQ ID NO: 3399660 - DNA, 18 bp, Homo sapiens
ttggttgttttttccttt

SEQ ID NO: 3399661 - DNA, 23 bp, Homo sapiens
ttggtttaaagaaagtgtatttg

SEQ ID NO: 3399662 - DNA, 14 bp, Homo sapiens
ttggtttatttttg

SEQ ID NO: 3399663 - DNA, 17 bp, Homo sapiens
ttggtttatttttgtaa

SEQ ID NO: 3399664 - DNA, 19 bp, Homo sapiens
ttggtttatttttgtaatg

SEQ ID NO: 3399665 - DNA, 20 bp, Homo sapiens
tttaaaaaggaaatttgttt

SEQ ID NO: 3399666 - DNA, 23 bp, Homo sapiens
tttaaaaagtaagttaataatgt

SEQ ID NO: 3399667 - DNA, 14 bp, Homo sapiens
tttaaaaatatttt

SEQ ID NO: 3399668 - DNA, 13 bp, Homo sapiens
tttaaaacactaa

SEQ ID NO: 3399669 - DNA, 14 bp, Homo sapiens
tttaaaacccattt

SEQ ID NO: 3399670 - DNA, 22 bp, Homo sapiens
tttaaaagagagagagagaaaa

SEQ ID NO: 3399671 - DNA, 21 bp, Homo sapiens
tttaaaaggtattttgaatac

SEQ ID NO: 3399672 - DNA, 13 bp, Homo sapiens
tttaaaagtaaaa

SEQ ID NO: 3399673 - DNA, 15 bp, Homo sapiens
tttaaaataaaatga

SEQ ID NO: 3399674 - DNA, 17 bp, Homo sapiens
tttaaaataaaatgaaa

SEQ ID NO: 3399675 - DNA, 20 bp, Homo sapiens
tttaaaatatttgaatgaaa

SEQ ID NO: 3399676 - DNA, 21 bp, Homo sapiens
tttaaaatatttgaatgaaaa

SEQ ID NO: 3399677 - DNA, 14 bp, Homo sapiens
tttaaaatatttgt

SEQ ID NO: 3399678 - DNA, 20 bp, Homo sapiens
tttaaaatcactaacattat

SEQ ID NO: 3399679 - DNA, 21 bp, Homo sapiens
tttaaaatgtaatttaaatga

SEQ ID NO: 3399680 - DNA, 23 bp, Homo sapiens
tttaaaatgtaatttaaatgaaa

SEQ ID NO: 3399681 - DNA, 17 bp, Homo sapiens
tttaaaattaagtagaa

SEQ ID NO: 3399682 - DNA, 18 bp, Homo sapiens
tttaaaattgatttttct

SEQ ID NO: 3399683 - DNA, 10 bp, Homo sapiens
tttaaaattt

SEQ ID NO: 3399684 - DNA, 13 bp, Homo sapiens
tttaaaatttcat

SEQ ID NO: 3399685 - DNA, 21 bp, Homo sapiens
tttaaaattttgtatgttaaa

SEQ ID NO: 3399686 - DNA, 15 bp, Homo sapiens
tttaaacattaatag

SEQ ID NO: 3399687 - DNA, 19 bp, Homo sapiens
tttaaacattaatagcagc

SEQ ID NO: 3399688 - DNA, 19 bp, Homo sapiens
tttaaacccaatcagatgc

SEQ ID NO: 3399689 - DNA, 15 bp, Homo sapiens
tttaaacctttttct

SEQ ID NO: 3399690 - DNA, 15 bp, Homo sapiens
tttaaactgtgtaca

SEQ ID NO: 3399691 - DNA, 22 bp, Homo sapiens
tttaaactgtgtacataactga

SEQ ID NO: 3399692 - DNA, 12 bp, Homo sapiens
tttaaagaaagt

SEQ ID NO: 3399693 - DNA, 14 bp, Homo sapiens
tttaaagaaagtgt

SEQ ID NO: 3399694 - DNA, 10 bp, Homo sapiens
tttaaagaca

SEQ ID NO: 3399695 - DNA, 11 bp, Homo sapiens
tttaaagacag

SEQ ID NO: 3399696 - DNA, 17 bp, Homo sapiens
tttaaagagaatgtaga

SEQ ID NO: 3399697 - DNA, 17 bp, Homo sapiens
tttaaagagtctagatt

SEQ ID NO: 3399698 - DNA, 23 bp, Homo sapiens
tttaaagagtctagattcaaagg

SEQ ID NO: 3399699 - DNA, 18 bp, Homo sapiens
tttaaagcaattgcataa

SEQ ID NO: 3399700 - DNA, 16 bp, Homo sapiens
tttaaagcttactctg

SEQ ID NO: 3399701 - DNA, 20 bp, Homo sapiens
tttaaaggataatggtgaac

SEQ ID NO: 3399702 - DNA, 18 bp, Homo sapiens
tttaaaggcattagagtc

SEQ ID NO: 3399703 - DNA, 18 bp, Homo sapiens
tttaaaggctttttggtg

SEQ ID NO: 3399704 - DNA, 15 bp, Homo sapiens
tttaaagttgtataa

SEQ ID NO: 3399705 - DNA, 20 bp, Homo sapiens
tttaaagttgtataaaaaca

SEQ ID NO: 3399706 - DNA, 23 bp, Homo sapiens
tttaaataaaagaaaaaatatct

SEQ ID NO: 3399707 - DNA, 15 bp, Homo sapiens
tttaaataaaagcac

SEQ ID NO: 3399708 - DNA, 13 bp, Homo sapiens
tttaaataaactt

SEQ ID NO: 3399709 - DNA, 21 bp, Homo sapiens
tttaaataacctctggccctt

SEQ ID NO: 3399710 - DNA, 19 bp, Homo sapiens
tttaaatataaatagctaa

SEQ ID NO: 3399711 - DNA, 17 bp, Homo sapiens
tttaaatataaatgttt

SEQ ID NO: 3399712 - DNA, 12 bp, Homo sapiens
tttaaatataat

SEQ ID NO: 3399713 - DNA, 16 bp, Homo sapiens
tttaaatataattctg

SEQ ID NO: 3399714 - DNA, 18 bp, Homo sapiens
tttaaatataattctgta

SEQ ID NO: 3399715 - DNA, 21 bp, Homo sapiens
tttaaatataattctgtaaat

SEQ ID NO: 3399716 - DNA, 15 bp, Homo sapiens
tttaaatattttcta

SEQ ID NO: 3399717 - DNA, 16 bp, Homo sapiens
tttaaatcatgtatgt

SEQ ID NO: 3399718 - DNA, 23 bp, Homo sapiens
tttaaatgaattaaatattgaaa

SEQ ID NO: 3399719 - DNA, 20 bp, Homo sapiens
tttaaatgatgattccttga

SEQ ID NO: 3399720 - DNA, 18 bp, Homo sapiens
tttaaatgcataaatgca

SEQ ID NO: 3399721 - DNA, 16 bp, Homo sapiens
tttaaatgtgaatttt

SEQ ID NO: 3399722 - DNA, 16 bp, Homo sapiens
tttaaattaatatctt

SEQ ID NO: 3399723 - DNA, 12 bp, Homo sapiens
tttaaattctga

SEQ ID NO: 3399724 - DNA, 14 bp, Homo sapiens
tttaaattctgaga

SEQ ID NO: 3399725 - DNA, 12 bp, Homo sapiens
tttaaattgtgt

SEQ ID NO: 3399726 - DNA, 17 bp, Homo sapiens
tttaaattttcttcagt

SEQ ID NO: 3399727 - DNA, 22 bp, Homo sapiens
tttaaattttcttcagttggtg

SEQ ID NO: 3399728 - DNA, 23 bp, Homo sapiens
tttaacaaaaaacagattctata

SEQ ID NO: 3399729 - DNA, 15 bp, Homo sapiens
tttaacaaaagcaag

SEQ ID NO: 3399730 - DNA, 14 bp, Homo sapiens
tttaacaaactaaa

SEQ ID NO: 3399731 - DNA, 16 bp, Homo sapiens
tttaacaaactaaaaa

SEQ ID NO: 3399732 - DNA, 17 bp, Homo sapiens
tttaacaaatctaatct

SEQ ID NO: 3399733 - DNA, 20 bp, Homo sapiens
tttaacaataactactgtgt

SEQ ID NO: 3399734 - DNA, 21 bp, Homo sapiens
tttaacaatccattcacaagc

SEQ ID NO: 3399735 - DNA, 16 bp, Homo sapiens
tttaacaatctaacaa

SEQ ID NO: 3399736 - DNA, 19 bp, Homo sapiens
tttaacaatttattctgat

SEQ ID NO: 3399737 - DNA, 19 bp, Homo sapiens
tttaacacaagtcctgtga

SEQ ID NO: 3399738 - DNA, 14 bp, Homo sapiens
tttaacacataact

SEQ ID NO: 3399739 - DNA, 19 bp, Homo sapiens
tttaacacataactagaaa

SEQ ID NO: 3399740 - DNA, 18 bp, Homo sapiens
tttaacactttgtattac

SEQ ID NO: 3399741 - DNA, 20 bp, Homo sapiens
tttaacagctgaattatcta

SEQ ID NO: 3399742 - DNA, 15 bp, Homo sapiens
tttaacagtcattta

SEQ ID NO: 3399743 - DNA, 16 bp, Homo sapiens
tttaacagtcatttaa

SEQ ID NO: 3399744 - DNA, 22 bp, Homo sapiens
tttaacattttgttcttacaca

SEQ ID NO: 3399745 - DNA, 17 bp, Homo sapiens
tttaaccaaacaattat

SEQ ID NO: 3399746 - DNA, 19 bp, Homo sapiens
tttaaccaaacaattattt

SEQ ID NO: 3399747 - DNA, 22 bp, Homo sapiens
tttaaccattgtcttgttctgt

SEQ ID NO: 3399748 - DNA, 17 bp, Homo sapiens
tttaactagaatttatt

SEQ ID NO: 3399749 - DNA, 22 bp, Homo sapiens
tttaactcatacctttaaagga

SEQ ID NO: 3399750 - DNA, 18 bp, Homo sapiens
tttaactcccctgtttca

SEQ ID NO: 3399751 - DNA, 19 bp, Homo sapiens
tttaactgaaaatgtaaat

SEQ ID NO: 3399752 - DNA, 19 bp, Homo sapiens
tttaactgcagttgacttt

SEQ ID NO: 3399753 - DNA, 22 bp, Homo sapiens
tttaactgcagttgactttctc

SEQ ID NO: 3399754 - DNA, 18 bp, Homo sapiens
tttaactgtggatattgt

SEQ ID NO: 3399755 - DNA, 18 bp, Homo sapiens
tttaacttccagtggctg

SEQ ID NO: 3399756 - DNA, 14 bp, Homo sapiens
tttaactttctaga

SEQ ID NO: 3399757 - DNA, 12 bp, Homo sapiens
tttaacttttct

SEQ ID NO: 3399758 - DNA, 22 bp, Homo sapiens
tttaagaaaaaataacacacat

SEQ ID NO: 3399759 - DNA, 14 bp, Homo sapiens
tttaagaaaagcac

SEQ ID NO: 3399760 - DNA, 18 bp, Homo sapiens
tttaagaaaagcactttt

SEQ ID NO: 3399761 - DNA, 21 bp, Homo sapiens
tttaagaaaagcacttttgtt

SEQ ID NO: 3399762 - DNA, 23 bp, Homo sapiens
tttaagaaaagcacttttgttat

SEQ ID NO: 3399763 - DNA, 20 bp, Homo sapiens
tttaagaaaatacaataaac

SEQ ID NO: 3399764 - DNA, 22 bp, Homo sapiens
tttaagaaaatacaataaacta

SEQ ID NO: 3399765 - DNA, 15 bp, Homo sapiens
tttaagaatatctgt

SEQ ID NO: 3399766 - DNA, 22 bp, Homo sapiens
tttaagacaccaaatataacaa

SEQ ID NO: 3399767 - DNA, 11 bp, Homo sapiens
tttaagagact

SEQ ID NO: 3399768 - DNA, 14 bp, Homo sapiens
tttaagaggcaggg

SEQ ID NO: 3399769 - DNA, 14 bp, Homo sapiens
tttaagagtgaagt

SEQ ID NO: 3399770 - DNA, 15 bp, Homo sapiens
tttaagataaattat

SEQ ID NO: 3399771 - DNA, 14 bp, Homo sapiens
tttaagataattat

SEQ ID NO: 3399772 - DNA, 16 bp, Homo sapiens
tttaagatatccatct

SEQ ID NO: 3399773 - DNA, 19 bp, Homo sapiens
tttaagatatccatctttt

SEQ ID NO: 3399774 - DNA, 20 bp, Homo sapiens
tttaagcagctcttgctaat

SEQ ID NO: 3399775 - DNA, 21 bp, Homo sapiens
tttaagccaaagaaacaagct

SEQ ID NO: 3399776 - DNA, 19 bp, Homo sapiens
tttaagcctcatatttaaa

SEQ ID NO: 3399777 - DNA, 18 bp, Homo sapiens
tttaagctgtttccatag

SEQ ID NO: 3399778 - DNA, 21 bp, Homo sapiens
tttaagcttcagttgcttgtc

SEQ ID NO: 3399779 - DNA, 19 bp, Homo sapiens
tttaagggcatgccttgtg

SEQ ID NO: 3399780 - DNA, 21 bp, Homo sapiens
tttaagtaacttaaggacctt

SEQ ID NO: 3399781 - DNA, 20 bp, Homo sapiens
tttaagtcagtatggtctaa

SEQ ID NO: 3399782 - DNA, 15 bp, Homo sapiens
tttaagtctctcgta

SEQ ID NO: 3399783 - DNA, 21 bp, Homo sapiens
tttaagtgcgtgtgtagagtt

SEQ ID NO: 3399784 - DNA, 17 bp, Homo sapiens
tttaagtgttggaaaaa

SEQ ID NO: 3399785 - DNA, 12 bp, Homo sapiens
tttaagtttgtt

SEQ ID NO: 3399786 - DNA, 11 bp, Homo sapiens
tttaataaaag

SEQ ID NO: 3399787 - DNA, 14 bp, Homo sapiens
tttaataaacagta

SEQ ID NO: 3399788 - DNA, 16 bp, Homo sapiens
tttaataaagatgagt

SEQ ID NO: 3399789 - DNA, 16 bp, Homo sapiens
tttaataaattgctta

SEQ ID NO: 3399790 - DNA, 23 bp, Homo sapiens
tttaataaattgcttactgatat

SEQ ID NO: 3399791 - DNA, 16 bp, Homo sapiens
tttcagctctctgtat

SEQ ID NO: 3399792 - DNA, 22 bp, Homo sapiens
tttcagctgagccctggggact

SEQ ID NO: 3399793 - DNA, 17 bp, Homo sapiens
tttcagcttctctgcta

SEQ ID NO: 3399794 - DNA, 20 bp, Homo sapiens
tttcaggaaatctacttcct

SEQ ID NO: 3399795 - DNA, 15 bp, Homo sapiens
tttcaggaatttaaa

SEQ ID NO: 3399796 - DNA, 17 bp, Homo sapiens
tttcaggaatttaaaat

SEQ ID NO: 3399797 - DNA, 22 bp, Homo sapiens
tttcaggaggctggaggaaggg

SEQ ID NO: 3399798 - DNA, 19 bp, Homo sapiens
tttcaggatactctgtcag

SEQ ID NO: 3399799 - DNA, 20 bp, Homo sapiens
tttcaggatactctgtcaga

SEQ ID NO: 3399800 - DNA, 20 bp, Homo sapiens
tttcagggagaaactccaaa

SEQ ID NO: 3399801 - DNA, 22 bp, Homo sapiens
tttcaggggctgactctccagg

SEQ ID NO: 3399802 - DNA, 13 bp, Homo sapiens
tttcaggtgacat

SEQ ID NO: 3399803 - DNA, 18 bp, Homo sapiens
tttcagtaataaaacatc

SEQ ID NO: 3399804 - DNA, 16 bp, Homo sapiens
tttcagtactttttta

SEQ ID NO: 3399805 - DNA, 16 bp, Homo sapiens
tttcagtatactgtgt

SEQ ID NO: 3399806 - DNA, 17 bp, Homo sapiens
tttcagtatcatctcca

SEQ ID NO: 3399807 - DNA, 15 bp, Homo sapiens
tttcagtcttgtagt

SEQ ID NO: 3399808 - DNA, 16 bp, Homo sapiens
tttcagtggaaaccct

SEQ ID NO: 3399809 - DNA, 14 bp, Homo sapiens
tttcagtggcttcc

SEQ ID NO: 3399810 - DNA, 17 bp, Homo sapiens
tttcagttctgtgtaca

SEQ ID NO: 3399811 - DNA, 18 bp, Homo sapiens
tttcagttctgtgtacat

SEQ ID NO: 3399812 - DNA, 22 bp, Homo sapiens
tttcagttctgtgtacatttta

SEQ ID NO: 3399813 - DNA, 17 bp, Homo sapiens
tttcatatctacagata

SEQ ID NO: 3399814 - DNA, 12 bp, Homo sapiens
tttcatattgtg

SEQ ID NO: 3399815 - DNA, 14 bp, Homo sapiens
tttcatattgtgcc

SEQ ID NO: 3399816 - DNA, 15 bp, Homo sapiens
tttcatatttctacc

SEQ ID NO: 3399817 - DNA, 19 bp, Homo sapiens
tttcatctcagagtccact

SEQ ID NO: 3399818 - DNA, 21 bp, Homo sapiens
tttcatctcagagtccactgt

SEQ ID NO: 3399819 - DNA, 16 bp, Homo sapiens
tttcatctcttgtata

SEQ ID NO: 3399820 - DNA, 16 bp, Homo sapiens
tttcatcttctggaat

SEQ ID NO: 3399821 - DNA, 17 bp, Homo sapiens
tttcatgaaaataccat

SEQ ID NO: 3399822 - DNA, 20 bp, Homo sapiens
tttcatgaggggaaagggag

SEQ ID NO: 3399823 - DNA, 18 bp, Homo sapiens
tttcatggcccttcaaat

SEQ ID NO: 3399824 - DNA, 18 bp, Homo sapiens
tttcatgtacaagatgaa

SEQ ID NO: 3399825 - DNA, 21 bp, Homo sapiens
tttcatgtagaactcagcagt

SEQ ID NO: 3399826 - DNA, 19 bp, Homo sapiens
tttcatgttagttacctta

SEQ ID NO: 3399827 - DNA, 14 bp, Homo sapiens
tttcattaaacttg

SEQ ID NO: 3399828 - DNA, 16 bp, Homo sapiens
tttcattaaacttgaa

SEQ ID NO: 3399829 - DNA, 16 bp, Homo sapiens
tttcattaaatccttt

SEQ ID NO: 3399830 - DNA, 21 bp, Homo sapiens
tttcattaatacagggcattt

SEQ ID NO: 3399831 - DNA, 20 bp, Homo sapiens
tttcattatgttcatgtaag

SEQ ID NO: 3399832 - DNA, 13 bp, Homo sapiens
tttcattattagt

SEQ ID NO: 3399833 - DNA, 14 bp, Homo sapiens
tttcattattctca

SEQ ID NO: 3399834 - DNA, 19 bp, Homo sapiens
tttcattcccccttcctag

SEQ ID NO: 3399835 - DNA, 13 bp, Homo sapiens
tttcattccttca

SEQ ID NO: 3399836 - DNA, 16 bp, Homo sapiens
tttcattgccagtgtc

SEQ ID NO: 3399837 - DNA, 23 bp, Homo sapiens
tttcattgcctgtgtatggaaaa

SEQ ID NO: 3399838 - DNA, 17 bp, Homo sapiens
tttcattggatttttgt

SEQ ID NO: 3399839 - DNA, 18 bp, Homo sapiens
tttcattgtatgatgtgt

SEQ ID NO: 3399840 - DNA, 17 bp, Homo sapiens
tttcatttatctataat

SEQ ID NO: 3399841 - DNA, 14 bp, Homo sapiens
tttcatttcaactg

SEQ ID NO: 3399842 - DNA, 22 bp, Homo sapiens
tttcatttgcctattcccacac

SEQ ID NO: 3399843 - DNA, 19 bp, Homo sapiens
tttcatttggttcattaat

SEQ ID NO: 3399844 - DNA, 11 bp, Homo sapiens
tttcatttgta

SEQ ID NO: 3399845 - DNA, 16 bp, Homo sapiens
tttcattttaacatga

SEQ ID NO: 3399846 - DNA, 22 bp, Homo sapiens
tttccaaaacaaaaagatgtct

SEQ ID NO: 3399847 - DNA, 12 bp, Homo sapiens
tttccaaaacat

SEQ ID NO: 3399848 - DNA, 14 bp, Homo sapiens
tttccaaaataatt

SEQ ID NO: 3399849 - DNA, 19 bp, Homo sapiens
tttccaaaatctcccattt

SEQ ID NO: 3399850 - DNA, 16 bp, Homo sapiens
tttccaaacaacagaa

SEQ ID NO: 3399851 - DNA, 16 bp, Homo sapiens
tttccaactggcactc

SEQ ID NO: 3399852 - DNA, 13 bp, Homo sapiens
tttccaagctgcg

SEQ ID NO: 3399853 - DNA, 15 bp, Homo sapiens
tttccacatgctctg

SEQ ID NO: 3399854 - DNA, 17 bp, Homo sapiens
tttccacatttgtcaca

SEQ ID NO: 3399855 - DNA, 22 bp, Homo sapiens
tttccaccaagtgtctagagtc

SEQ ID NO: 3399856 - DNA, 16 bp, Homo sapiens
tttccactaaaaatat

SEQ ID NO: 3399857 - DNA, 15 bp, Homo sapiens
tttccacttcttcct

SEQ ID NO: 3399858 - DNA, 16 bp, Homo sapiens
tttccacttcttcctt

SEQ ID NO: 3399859 - DNA, 20 bp, Homo sapiens
tttccacttgccctgttctc

SEQ ID NO: 3399860 - DNA, 23 bp, Homo sapiens
tttccactttgttctttaggaga

SEQ ID NO: 3399861 - DNA, 18 bp, Homo sapiens
tttccagacttccttgag

SEQ ID NO: 3399862 - DNA, 19 bp, Homo sapiens
tttccagacttccttgaga

SEQ ID NO: 3399863 - DNA, 23 bp, Homo sapiens
tttccagcagaagacaaaaagac

SEQ ID NO: 3399864 - DNA, 22 bp, Homo sapiens
tttccagcctcctgctggctct

SEQ ID NO: 3399865 - DNA, 19 bp, Homo sapiens
tttccaggatcctgcagga

SEQ ID NO: 3399866 - DNA, 20 bp, Homo sapiens
tttccagtattgaaaacttc

SEQ ID NO: 3399867 - DNA, 21 bp, Homo sapiens
tttccagtattgaaaacttca

SEQ ID NO: 3399868 - DNA, 14 bp, Homo sapiens
tttccagtctcttg

SEQ ID NO: 3399869 - DNA, 22 bp, Homo sapiens
tttccatatggattttctattg

SEQ ID NO: 3399870 - DNA, 19 bp, Homo sapiens
tttccatatttaacctatt

SEQ ID NO: 3399871 - DNA, 16 bp, Homo sapiens
tttccatcataattct

SEQ ID NO: 3399872 - DNA, 16 bp, Homo sapiens
tttccatcattttaca

SEQ ID NO: 3399873 - DNA, 18 bp, Homo sapiens
tttccatcattttacagt

SEQ ID NO: 3399874 - DNA, 16 bp, Homo sapiens
tttccatgaaaacgtt

SEQ ID NO: 3399875 - DNA, 18 bp, Homo sapiens
tttccatgggagccagct

SEQ ID NO: 3399876 - DNA, 21 bp, Homo sapiens
tttccattatttatattagtt

SEQ ID NO: 3399877 - DNA, 15 bp, Homo sapiens
tttccattctgcaga

SEQ ID NO: 3399878 - DNA, 13 bp, Homo sapiens
tttccatttacta

SEQ ID NO: 3399879 - DNA, 12 bp, Homo sapiens
tttcccatctgc

SEQ ID NO: 3399880 - DNA, 20 bp, Homo sapiens
tttccccactaataaagtgc

SEQ ID NO: 3399881 - DNA, 19 bp, Homo sapiens
tttccccagcatcactccc

SEQ ID NO: 3399882 - DNA, 17 bp, Homo sapiens
tttccccccactctccc

SEQ ID NO: 3399883 - DNA, 23 bp, Homo sapiens
tttcccccctccctccagtacca

SEQ ID NO: 3399884 - DNA, 13 bp, Homo sapiens
tttcccccgagct

SEQ ID NO: 3399885 - DNA, 12 bp, Homo sapiens
tttccccctcct

SEQ ID NO: 3399886 - DNA, 22 bp, Homo sapiens
tttcccccttgaggattgtgga

SEQ ID NO: 3399887 - DNA, 23 bp, Homo sapiens
tttcccccttgaggattgtggaa

SEQ ID NO: 3399888 - DNA, 23 bp, Homo sapiens
tttccccgcctgcagtcttctgg

SEQ ID NO: 3399889 - DNA, 21 bp, Homo sapiens
tttcccctggcctcagttccc

SEQ ID NO: 3399890 - DNA, 15 bp, Homo sapiens
tttccctactcccca

SEQ ID NO: 3399891 - DNA, 16 bp, Homo sapiens
tttccctcccagtttt

SEQ ID NO: 3399892 - DNA, 13 bp, Homo sapiens
tttccctgacctc

SEQ ID NO: 3399893 - DNA, 18 bp, Homo sapiens
tttcccttaacttttcct

SEQ ID NO: 3399894 - DNA, 20 bp, Homo sapiens
tttcccttgccctttccata

SEQ ID NO: 3399895 - DNA, 24 bp, Homo sapiens
tttccgctgtcgccccaggccctc

SEQ ID NO: 3399896 - DNA, 21 bp, Homo sapiens
tttccggccaaggtgccacca

SEQ ID NO: 3399897 - DNA, 16 bp, Homo sapiens
tttccgtttgcttttg

SEQ ID NO: 3399898 - DNA, 22 bp, Homo sapiens
tttcctaaacataattgtggat

SEQ ID NO: 3399899 - DNA, 15 bp, Homo sapiens
tttcctaaatgcagt

SEQ ID NO: 3399900 - DNA, 17 bp, Homo sapiens
tttcctaaatgcagtga

SEQ ID NO: 3399901 - DNA, 20 bp, Homo sapiens
tttcctaattaaaataagaa

SEQ ID NO: 3399902 - DNA, 24 bp, Homo sapiens
tttcctactctcaggatcaagaaa

SEQ ID NO: 3399903 - DNA, 17 bp, Homo sapiens
tttcctactgtcctcag

SEQ ID NO: 3399904 - DNA, 23 bp, Homo sapiens
tttcctagccctctcacatttat

SEQ ID NO: 3399905 - DNA, 15 bp, Homo sapiens
tttcctagcctgttt

SEQ ID NO: 3399906 - DNA, 23 bp, Homo sapiens
tttcctaggcccaggcctgggtt

SEQ ID NO: 3399907 - DNA, 22 bp, Homo sapiens
tttcctcaagtatcttctattt

SEQ ID NO: 3399908 - DNA, 17 bp, Homo sapiens
tttcctcatgtaacatt

SEQ ID NO: 3399909 - DNA, 19 bp, Homo sapiens
tttcctcattttgaattat

SEQ ID NO: 3399910 - DNA, 21 bp, Homo sapiens
tttcctcattttgaattatgt

SEQ ID NO: 3399911 - DNA, 11 bp, Homo sapiens
tttcctccctt

SEQ ID NO: 3399912 - DNA, 18 bp, Homo sapiens
tttcctcctcaggcacac

SEQ ID NO: 3399913 - DNA, 21 bp, Homo sapiens
tttcctcctgaggctttggat

SEQ ID NO: 3399914 - DNA, 15 bp, Homo sapiens
tttcctcctttatca

SEQ ID NO: 3399915 - DNA, 20 bp, Homo sapiens
tttcctgagaccacagagag

SEQ ID NO: 3399916 - DNA, 17 bp, Homo sapiens
tttgtcatcagccacca

SEQ ID NO: 3399917 - DNA, 21 bp, Homo sapiens
tttgtcatgaattcttatgct

SEQ ID NO: 3399918 - DNA, 18 bp, Homo sapiens
tttgtcattttatgaata

SEQ ID NO: 3399919 - DNA, 14 bp, Homo sapiens
tttgtcccagcctg

SEQ ID NO: 3399920 - DNA, 12 bp, Homo sapiens
tttgtcccaggt

SEQ ID NO: 3399921 - DNA, 22 bp, Homo sapiens
tttgtcctaagagatttatctt

SEQ ID NO: 3399922 - DNA, 23 bp, Homo sapiens
tttgtcctaagagatttatcttt

SEQ ID NO: 3399923 - DNA, 17 bp, Homo sapiens
tttgtccttttatttct

SEQ ID NO: 3399924 - DNA, 21 bp, Homo sapiens
tttgtcgggcaccagccagcg

SEQ ID NO: 3399925 - DNA, 18 bp, Homo sapiens
tttgtcgtggttcttaaa

SEQ ID NO: 3399926 - DNA, 15 bp, Homo sapiens
tttgtctatgaagtt

SEQ ID NO: 3399927 - DNA, 16 bp, Homo sapiens
tttgtctcacttttca

SEQ ID NO: 3399928 - DNA, 12 bp, Homo sapiens
tttgtctcccag

SEQ ID NO: 3399929 - DNA, 17 bp, Homo sapiens
tttgtctgtcttcatag

SEQ ID NO: 3399930 - DNA, 12 bp, Homo sapiens
tttgtctgtgtt

SEQ ID NO: 3399931 - DNA, 18 bp, Homo sapiens
tttgtctgtgttgctgtt

SEQ ID NO: 3399932 - DNA, 20 bp, Homo sapiens
tttgtcttatcccccccagc

SEQ ID NO: 3399933 - DNA, 14 bp, Homo sapiens
tttgtcttattctt

SEQ ID NO: 3399934 - DNA, 16 bp, Homo sapiens
tttgtcttattgaaaa

SEQ ID NO: 3399935 - DNA, 15 bp, Homo sapiens
tttgtcttgtacttc

SEQ ID NO: 3399936 - DNA, 19 bp, Homo sapiens
tttgtcttgtacttctgtg

SEQ ID NO: 3399937 - DNA, 13 bp, Homo sapiens
tttgtctttttgt

SEQ ID NO: 3399938 - DNA, 19 bp, Homo sapiens
tttgtgaatggattggatt

SEQ ID NO: 3399939 - DNA, 20 bp, Homo sapiens
tttgtgactatatagagatg

SEQ ID NO: 3399940 - DNA, 13 bp, Homo sapiens
tttgtgataattt

SEQ ID NO: 3399941 - DNA, 18 bp, Homo sapiens
tttgtgatgatgctgtga

SEQ ID NO: 3399942 - DNA, 23 bp, Homo sapiens
tttgtgcattctttggtaatttt

SEQ ID NO: 3399943 - DNA, 21 bp, Homo sapiens
tttgtgctagaaattttcaag

SEQ ID NO: 3399944 - DNA, 12 bp, Homo sapiens
tttgtggaataa

SEQ ID NO: 3399945 - DNA, 17 bp, Homo sapiens
tttgtggatgtcttcct

SEQ ID NO: 3399946 - DNA, 12 bp, Homo sapiens
tttgtggcctca

SEQ ID NO: 3399947 - DNA, 15 bp, Homo sapiens
tttgtggcctcagaa

SEQ ID NO: 3399948 - DNA, 20 bp, Homo sapiens
tttgtggggcttggcgtgga

SEQ ID NO: 3399949 - DNA, 22 bp, Homo sapiens
tttgtggtacgacctttagatt

SEQ ID NO: 3399950 - DNA, 14 bp, Homo sapiens
tttgtggtgtcttc

SEQ ID NO: 3399951 - DNA, 22 bp, Homo sapiens
tttgtgtaataaagtgttttca

SEQ ID NO: 3399952 - DNA, 12 bp, Homo sapiens
tttgtgtatgta

SEQ ID NO: 3399953 - DNA, 21 bp, Homo sapiens
tttgtgtgaccaactgtgttg

SEQ ID NO: 3399954 - DNA, 14 bp, Homo sapiens
tttgtgtgattgaa

SEQ ID NO: 3399955 - DNA, 22 bp, Homo sapiens
tttgtgtgatttcctaaacata

SEQ ID NO: 3399956 - DNA, 20 bp, Homo sapiens
tttgtgtgtatttgtattaa

SEQ ID NO: 3399957 - DNA, 13 bp, Homo sapiens
tttgtgtgtctta

SEQ ID NO: 3399958 - DNA, 19 bp, Homo sapiens
tttgtgtgttgtcttgaaa

SEQ ID NO: 3399959 - DNA, 16 bp, Homo sapiens
tttgtgttattcgtga

SEQ ID NO: 3399960 - DNA, 19 bp, Homo sapiens
tttgtgttctgtttgttaa

SEQ ID NO: 3399961 - DNA, 19 bp, Homo sapiens
tttgtgttttcttgtaaat

SEQ ID NO: 3399962 - DNA, 22 bp, Homo sapiens
tttgttaaagctggaacatttg

SEQ ID NO: 3399963 - DNA, 13 bp, Homo sapiens
tttgttaaataat

SEQ ID NO: 3399964 - DNA, 16 bp, Homo sapiens
tttgttaattcttatt

SEQ ID NO: 3399965 - DNA, 12 bp, Homo sapiens
tttgttactgtt

SEQ ID NO: 3399966 - DNA, 20 bp, Homo sapiens
tttgttactgttcttgctgc

SEQ ID NO: 3399967 - DNA, 21 bp, Homo sapiens
tttgttactgttcttgctgct

SEQ ID NO: 3399968 - DNA, 21 bp, Homo sapiens
tttgttagatagctgcatgtg

SEQ ID NO: 3399969 - DNA, 17 bp, Homo sapiens
tttgttataccatttcc

SEQ ID NO: 3399970 - DNA, 16 bp, Homo sapiens
tttgttatacttcaaa

SEQ ID NO: 3399971 - DNA, 14 bp, Homo sapiens
tttgttattccatc

SEQ ID NO: 3399972 - DNA, 15 bp, Homo sapiens
tttgttattccatca

SEQ ID NO: 3399973 - DNA, 16 bp, Homo sapiens
tttgttattccatcaa

SEQ ID NO: 3399974 - DNA, 21 bp, Homo sapiens
tttgttattccatcaataaat

SEQ ID NO: 3399975 - DNA, 12 bp, Homo sapiens
tttgttattcct

SEQ ID NO: 3399976 - DNA, 16 bp, Homo sapiens
tttgttcaatgttcca

SEQ ID NO: 3399977 - DNA, 12 bp, Homo sapiens
tttgttcatgtt

SEQ ID NO: 3399978 - DNA, 16 bp, Homo sapiens
tttgttctgttctggg

SEQ ID NO: 3399979 - DNA, 14 bp, Homo sapiens
tttgttcttacaca

SEQ ID NO: 3399980 - DNA, 21 bp, Homo sapiens
tttgttgacagcaaaatgttg

SEQ ID NO: 3399981 - DNA, 22 bp, Homo sapiens
tttgttgcgttcctttcttttc

SEQ ID NO: 3399982 - DNA, 14 bp, Homo sapiens
tttgttgctgtttt

SEQ ID NO: 3399983 - DNA, 15 bp, Homo sapiens
tttgttgtaaaaaga

SEQ ID NO: 3399984 - DNA, 13 bp, Homo sapiens
tttgttgtgactt

SEQ ID NO: 3399985 - DNA, 17 bp, Homo sapiens
tttgtttaatgtgaact

SEQ ID NO: 3399986 - DNA, 22 bp, Homo sapiens
tttgtttcaatctctgactaaa

SEQ ID NO: 3399987 - DNA, 16 bp, Homo sapiens
tttgtttctgaaaatt

SEQ ID NO: 3399988 - DNA, 16 bp, Homo sapiens
tttgtttcttccaaag

SEQ ID NO: 3399989 - DNA, 15 bp, Homo sapiens
tttgtttgtttgggt

SEQ ID NO: 3399990 - DNA, 18 bp, Homo sapiens
tttgttttacaatgtcat

SEQ ID NO: 3399991 - DNA, 15 bp, Homo sapiens
tttgttttttggtga

SEQ ID NO: 3399992 - DNA, 13 bp, Homo sapiens
tttgttttttgta

SEQ ID NO: 3399993 - DNA, 19 bp, Homo sapiens
tttgttttttgtaactaca

SEQ ID NO: 3399994 - DNA, 14 bp, Homo sapiens
tttgtttttttcct

SEQ ID NO: 3399995 - DNA, 13 bp, Homo sapiens
ttttaaaaaatga

SEQ ID NO: 3399996 - DNA, 14 bp, Homo sapiens
ttttaaaaaatgaa

SEQ ID NO: 3399997 - DNA, 22 bp, Homo sapiens
ttttaaaaacactacttttgct

SEQ ID NO: 3399998 - DNA, 19 bp, Homo sapiens
ttttaaaaacatagaaaaa

SEQ ID NO: 3399999 - DNA, 16 bp, Homo sapiens
ttttaaaaatacatat

SEQ ID NO: 3400000 - DNA, 21 bp, Homo sapiens
ttttaaaaatacatatcgctg

SEQ ID NO: 3400001 - DNA, 17 bp, Homo sapiens
ttttaaaaatgtagaaa

SEQ ID NO: 3400002 - DNA, 15 bp, Homo sapiens
ttttaaaacactaaa

SEQ ID NO: 3400003 - DNA, 19 bp, Homo sapiens
ttttaaaacactaaaagca

SEQ ID NO: 3400004 - DNA, 19 bp, Homo sapiens
ttttaaaaggtagagtctt

SEQ ID NO: 3400005 - DNA, 12 bp, Homo sapiens
ttttaaaagttt

SEQ ID NO: 3400006 - DNA, 18 bp, Homo sapiens
ttttaaaagtttcaatgt

SEQ ID NO: 3400007 - DNA, 21 bp, Homo sapiens
ttttaaaagtttcaatgtgat

SEQ ID NO: 3400008 - DNA, 16 bp, Homo sapiens
ttttaaaatcaactta

SEQ ID NO: 3400009 - DNA, 20 bp, Homo sapiens
ttttaaacaaaatagaagct

SEQ ID NO: 3400010 - DNA, 13 bp, Homo sapiens
ttttaaacaaaca

SEQ ID NO: 3400011 - DNA, 13 bp, Homo sapiens
ttttaaacagtga

SEQ ID NO: 3400012 - DNA, 15 bp, Homo sapiens
ttttaaagcaagtca

SEQ ID NO: 3400013 - DNA, 13 bp, Homo sapiens
ttttaaaggcatt

SEQ ID NO: 3400014 - DNA, 17 bp, Homo sapiens
ttttaaagtaaatctct

SEQ ID NO: 3400015 - DNA, 13 bp, Homo sapiens
ttttaaagtgcaa

SEQ ID NO: 3400016 - DNA, 14 bp, Homo sapiens
ttttaaagtgcaaa

SEQ ID NO: 3400017 - DNA, 21 bp, Homo sapiens
ttttaaataaaagcacaagta

SEQ ID NO: 3400018 - DNA, 14 bp, Homo sapiens
ttttaaataaactt

SEQ ID NO: 3400019 - DNA, 16 bp, Homo sapiens
ttttaaataaactttt

SEQ ID NO: 3400020 - DNA, 22 bp, Homo sapiens
ttttaaataacctctggccctt

SEQ ID NO: 3400021 - DNA, 15 bp, Homo sapiens
ttttaaatattttct

SEQ ID NO: 3400022 - DNA, 17 bp, Homo sapiens
ttttaaatattttctat

SEQ ID NO: 3400023 - DNA, 12 bp, Homo sapiens
ttttaaatcatc

SEQ ID NO: 3400024 - DNA, 14 bp, Homo sapiens
ttttaaatctaaat

SEQ ID NO: 3400025 - DNA, 12 bp, Homo sapiens
ttttaaatgaat

SEQ ID NO: 3400026 - DNA, 17 bp, Homo sapiens
ttttaaattaatatctt

SEQ ID NO: 3400027 - DNA, 19 bp, Homo sapiens
ttttaaattagaaaatatt

SEQ ID NO: 3400028 - DNA, 20 bp, Homo sapiens
ttttaaattatactgtagct

SEQ ID NO: 3400029 - DNA, 18 bp, Homo sapiens
ttttaaattttcttcagt

SEQ ID NO: 3400030 - DNA, 19 bp, Homo sapiens
ttttaaattttcttcagtt

SEQ ID NO: 3400031 - DNA, 20 bp, Homo sapiens
ttttaaattttcttcagttg

SEQ ID NO: 3400032 - DNA, 21 bp, Homo sapiens
ttttaacaataactactgtgt

SEQ ID NO: 3400033 - DNA, 23 bp, Homo sapiens
ttttaacacataactagaaacct

SEQ ID NO: 3400034 - DNA, 14 bp, Homo sapiens
ttttaacactttgt

SEQ ID NO: 3400035 - DNA, 21 bp, Homo sapiens
ttttaaccattgtcttgttct

SEQ ID NO: 3400036 - DNA, 17 bp, Homo sapiens
ttttaaccctaatcttt

SEQ ID NO: 3400037 - DNA, 21 bp, Homo sapiens
ttttaacctgttttgttaatg

SEQ ID NO: 3400038 - DNA, 16 bp, Homo sapiens
ttttaactttaagttt

SEQ ID NO: 3400039 - DNA, 13 bp, Homo sapiens
ttttaacttttta

SEQ ID NO: 3400040 - DNA, 22 bp, Homo sapiens
ttttaagataaattataagtta

SEQ ID NO: 3400041 - DNA, 15 bp, Homo sapiens
ttttaagatttgtgt

SEQ ID NO: 3400042 - DNA, 19 bp, Homo sapiens
ttttaagatttttctcaaa

SEQ ID NO: 3400043 - DNA, 22 bp, Homo sapiens
gttcccagtcttctgacaaact

SEQ ID NO: 3400044 - DNA, 20 bp, Homo sapiens
gttccccaagggccctggca

SEQ ID NO: 3400045 - DNA, 23 bp, Homo sapiens
gttcccctgtcctgtgaatggaa

SEQ ID NO: 3400046 - DNA, 15 bp, Homo sapiens
gttcccctgttcact

SEQ ID NO: 3400047 - DNA, 18 bp, Homo sapiens
gttcccctgttcactcta

SEQ ID NO: 3400048 - DNA, 19 bp, Homo sapiens
gttccccttggcttcctcc

SEQ ID NO: 3400049 - DNA, 19 bp, Homo sapiens
gttcccggagcacagccct

SEQ ID NO: 3400050 - DNA, 15 bp, Homo sapiens
gttcccggtcccgag

SEQ ID NO: 3400051 - DNA, 15 bp, Homo sapiens
gttccctctccctgt

SEQ ID NO: 3400052 - DNA, 14 bp, Homo sapiens
gttccctctgctca

SEQ ID NO: 3400053 - DNA, 15 bp, Homo sapiens
gttccctctgctcag

SEQ ID NO: 3400054 - DNA, 17 bp, Homo sapiens
gttccctctgctcagcc

SEQ ID NO: 3400055 - DNA, 18 bp, Homo sapiens
gttccctctggcttccca

SEQ ID NO: 3400056 - DNA, 13 bp, Homo sapiens
gttccctgcaccc

SEQ ID NO: 3400057 - DNA, 16 bp, Homo sapiens
gttccctgcaccctgg

SEQ ID NO: 3400058 - DNA, 16 bp, Homo sapiens
gttccctgtcttgtcc

SEQ ID NO: 3400059 - DNA, 15 bp, Homo sapiens
gttccctgttcttcc

SEQ ID NO: 3400060 - DNA, 12 bp, Homo sapiens
gttcccttggcc

SEQ ID NO: 3400061 - DNA, 15 bp, Homo sapiens
gttcccttggcctca

SEQ ID NO: 3400062 - DNA, 18 bp, Homo sapiens
gttcctaagaagcttcta

SEQ ID NO: 3400063 - DNA, 14 bp, Homo sapiens
gttcctaatggatt

SEQ ID NO: 3400064 - DNA, 22 bp, Homo sapiens
gttcctatggctggccactgca

SEQ ID NO: 3400065 - DNA, 15 bp, Homo sapiens
gttcctcctgctgta

SEQ ID NO: 3400066 - DNA, 20 bp, Homo sapiens
aaaaacttttaggttgttac

SEQ ID NO: 3400067 - DNA, 21 bp, Homo sapiens
aaaaacttttaggttgttacc

SEQ ID NO: 3400068 - DNA, 21 bp, Homo sapiens
aaaaataaaaactgactcctt

SEQ ID NO: 3400069 - DNA, 23 bp, Homo sapiens
aaaaatacctcaggaaagaatag

SEQ ID NO: 3400070 - DNA, 21 bp, Homo sapiens
aaaaatatatgttgaatgtta

SEQ ID NO: 3400071 - DNA, 22 bp, Homo sapiens
aaaaatgcccatttttgctaat

SEQ ID NO: 3400072 - DNA, 13 bp, Homo sapiens
aaaaatgcctttg

SEQ ID NO: 3400073 - DNA, 14 bp, Homo sapiens
aaaaatgcctttga

SEQ ID NO: 3400074 - DNA, 19 bp, Homo sapiens
aaaaatgcctttgagacag

SEQ ID NO: 3400075 - DNA, 24 bp, Homo sapiens
aaaaatgcctttgagacagtttct

SEQ ID NO: 3400076 - DNA, 19 bp, Homo sapiens
aaaaatttttttgttgttt

SEQ ID NO: 3400077 - DNA, 18 bp, Homo sapiens
aaaacaattggttgtata

SEQ ID NO: 3400078 - DNA, 21 bp, Homo sapiens
aaaacaattggttgtatataa

SEQ ID NO: 3400079 - DNA, 20 bp, Homo sapiens
aaaacaattgttctgggtga

SEQ ID NO: 3400080 - DNA, 23 bp, Homo sapiens
aaaacaggcactgccctggtggc

SEQ ID NO: 3400081 - DNA, 13 bp, Homo sapiens
aaaacatgctgtt

SEQ ID NO: 3400082 - DNA, 21 bp, Homo sapiens
aaaaccgaattaggtccactt

SEQ ID NO: 3400083 - DNA, 17 bp, Homo sapiens
aaaactaaggcatttga

SEQ ID NO: 3400084 - DNA, 16 bp, Homo sapiens
aaaactgactccttag

SEQ ID NO: 3400085 - DNA, 19 bp, Homo sapiens
aaaactttaaagataagtc

SEQ ID NO: 3400086 - DNA, 13 bp, Homo sapiens
aaaagacaaacac

SEQ ID NO: 3400087 - DNA, 17 bp, Homo sapiens
aaaagatattttatttc

SEQ ID NO: 3400088 - DNA, 15 bp, Homo sapiens
aaaagattgtattgc

SEQ ID NO: 3400089 - DNA, 16 bp, Homo sapiens
aaaagctgtgtctctg

SEQ ID NO: 3400090 - DNA, 12 bp, Homo sapiens
aaaataaaattt

SEQ ID NO: 3400091 - DNA, 17 bp, Homo sapiens
aaaataaagaatatgcc

SEQ ID NO: 3400092 - DNA, 10 bp, Homo sapiens
aaaataaagc

SEQ ID NO: 3400093 - DNA, 15 bp, Homo sapiens
aaaataaagctactg

SEQ ID NO: 3400094 - DNA, 22 bp, Homo sapiens
aaaataagatgggcccaaaggt

SEQ ID NO: 3400095 - DNA, 13 bp, Homo sapiens
aaaataattctaa

SEQ ID NO: 3400096 - DNA, 13 bp, Homo sapiens
aaaatatatgttg

SEQ ID NO: 3400097 - DNA, 16 bp, Homo sapiens
aaaatatatgttgaat

SEQ ID NO: 3400098 - DNA, 20 bp, Homo sapiens
aaaatatatgttgaatgtta

SEQ ID NO: 3400099 - DNA, 12 bp, Homo sapiens
aaaatcattgat

SEQ ID NO: 3400100 - DNA, 16 bp, Homo sapiens
aaaatcttcagctggt

SEQ ID NO: 3400101 - DNA, 17 bp, Homo sapiens
aaaatgcaatatttgta

SEQ ID NO: 3400102 - DNA, 23 bp, Homo sapiens
aaaatgcctttgagacagtttct

SEQ ID NO: 3400103 - DNA, 18 bp, Homo sapiens
aaaatgtacttaaatgag

SEQ ID NO: 3400104 - DNA, 17 bp, Homo sapiens
aaaatgtcacacttgtt

SEQ ID NO: 3400105 - DNA, 21 bp, Homo sapiens
aaaatgtctgtagctcctcaa

SEQ ID NO: 3400106 - DNA, 16 bp, Homo sapiens
aaatgcaacaacatgt

SEQ ID NO: 3400107 - DNA, 15 bp, Homo sapiens
aaatgcaatatttgt

SEQ ID NO: 3400108 - DNA, 13 bp, Homo sapiens
aaatgcatagagc

SEQ ID NO: 3400109 - DNA, 20 bp, Homo sapiens
aaatgcatatcctgagccat

SEQ ID NO: 3400110 - DNA, 14 bp, Homo sapiens
aaatgcattcatgt

SEQ ID NO: 3400111 - DNA, 15 bp, Homo sapiens
aaatgcattcatgtt

SEQ ID NO: 3400112 - DNA, 16 bp, Homo sapiens
aaatgcctttgagaca

SEQ ID NO: 3400113 - DNA, 15 bp, Homo sapiens
aaatgttttcattgg

SEQ ID NO: 3400114 - DNA, 12 bp, Homo sapiens
aaattaacactg

SEQ ID NO: 3400115 - DNA, 21 bp, Homo sapiens
aaattaacactgcttgtgttt

SEQ ID NO: 3400116 - DNA, 13 bp, Homo sapiens
aaattatgaatga

SEQ ID NO: 3400117 - DNA, 17 bp, Homo sapiens
aaattatgaatgagttt

SEQ ID NO: 3400118 - DNA, 20 bp, Homo sapiens
aaattatgaatgagttttac

SEQ ID NO: 3400119 - DNA, 20 bp, Homo sapiens
aaattccatttacttgatca

SEQ ID NO: 3400120 - DNA, 17 bp, Homo sapiens
aaattcctttcagagtt

SEQ ID NO: 3400121 - DNA, 19 bp, Homo sapiens
aaattcctttcagagtttt

SEQ ID NO: 3400122 - DNA, 21 bp, Homo sapiens
acataacgtttttcctttaaa

SEQ ID NO: 3400123 - DNA, 16 bp, Homo sapiens
acatacagtgatatgg

SEQ ID NO: 3400124 - DNA, 23 bp, Homo sapiens
acataggtaggtatctttatagt

SEQ ID NO: 3400125 - DNA, 22 bp, Homo sapiens
acatattaagaatagtctctgg

SEQ ID NO: 3400126 - DNA, 18 bp, Homo sapiens
acatattaggaaaatatg

SEQ ID NO: 3400127 - DNA, 22 bp, Homo sapiens
acatattttttatatctggaat

SEQ ID NO: 3400128 - DNA, 12 bp, Homo sapiens
acatcagccctt

SEQ ID NO: 3400129 - DNA, 22 bp, Homo sapiens
acatcatggcaacccctaagaa

SEQ ID NO: 3400130 - DNA, 19 bp, Homo sapiens
acatcattggataaatttg

SEQ ID NO: 3400131 - DNA, 20 bp, Homo sapiens
acatctaaattgatcattca

SEQ ID NO: 3400132 - DNA, 21 bp, Homo sapiens
acatctaaattgatcattcat

SEQ ID NO: 3400133 - DNA, 14 bp, Homo sapiens
acatctctgtcagt

SEQ ID NO: 3400134 - DNA, 23 bp, Homo sapiens
acatctgcctgtaattaaactag

SEQ ID NO: 3400135 - DNA, 11 bp, Homo sapiens
acatctgtgtc

SEQ ID NO: 3400136 - DNA, 15 bp, Homo sapiens
acatctgtgtctgtg

SEQ ID NO: 3400137 - DNA, 15 bp, Homo sapiens
acatgaaaacattga

SEQ ID NO: 3400138 - DNA, 17 bp, Homo sapiens
acatgaaaacattgatg

SEQ ID NO: 3400139 - DNA, 12 bp, Homo sapiens
acatgcatttga

SEQ ID NO: 3400140 - DNA, 17 bp, Homo sapiens
acatgcatttgaggtca

SEQ ID NO: 3400141 - DNA, 21 bp, Homo sapiens
acatgcatttgaggtcaagta

SEQ ID NO: 3400142 - DNA, 22 bp, Homo sapiens
acatgcctatatgagaagaata

SEQ ID NO: 3400143 - DNA, 19 bp, Homo sapiens
acatggattccaaagcatt

SEQ ID NO: 3400144 - DNA, 15 bp, Homo sapiens
acatggggaggagga

SEQ ID NO: 3400145 - DNA, 19 bp, Homo sapiens
acatggtgtgtgtctctga

SEQ ID NO: 3400146 - DNA, 18 bp, Homo sapiens
acatggttgtgacctgag

SEQ ID NO: 3400147 - DNA, 15 bp, Homo sapiens
acatgtgaaaccttt

SEQ ID NO: 3400148 - DNA, 21 bp, Homo sapiens
acatgtgaaaccttttttaag

SEQ ID NO: 3400149 - DNA, 17 bp, Homo sapiens
acattaaagaaatttaa

SEQ ID NO: 3400150 - DNA, 21 bp, Homo sapiens
acattagtgttctttatatac

SEQ ID NO: 3400151 - DNA, 15 bp, Homo sapiens
acattcagctgaggt

SEQ ID NO: 3400152 - DNA, 13 bp, Homo sapiens
acattccaagaca

SEQ ID NO: 3400153 - DNA, 15 bp, Homo sapiens
acattccaagacagt

SEQ ID NO: 3400154 - DNA, 17 bp, Homo sapiens
acattccaagacagtat

SEQ ID NO: 3400155 - DNA, 22 bp, Homo sapiens
acattgattttaaaaatacatt

SEQ ID NO: 3400156 - DNA, 16 bp, Homo sapiens
acatttaggagaagtt

SEQ ID NO: 3400157 - DNA, 20 bp, Homo sapiens
acatttatgatttaataaaa

SEQ ID NO: 3400158 - DNA, 19 bp, Homo sapiens
acatttcaagatccaaatg

SEQ ID NO: 3400159 - DNA, 14 bp, Homo sapiens
acattttgaaaata

SEQ ID NO: 3400160 - DNA, 22 bp, Homo sapiens
acattttggatttctttatata

SEQ ID NO: 3400161 - DNA, 11 bp, Homo sapiens
accaaaaatat

SEQ ID NO: 3400162 - DNA, 20 bp, Homo sapiens
accaaaaattgcgagccttt

SEQ ID NO: 3400163 - DNA, 21 bp, Homo sapiens
accaaattttgaggtctttta

SEQ ID NO: 3400164 - DNA, 14 bp, Homo sapiens
accaagtgtctaga

SEQ ID NO: 3400165 - DNA, 22 bp, Homo sapiens
accaatgcattaccttctgttc

SEQ ID NO: 3400166 - DNA, 22 bp, Homo sapiens
accaattaagtgttgaaaaata

SEQ ID NO: 3400167 - DNA, 16 bp, Homo sapiens
accacctcatgtcatt

SEQ ID NO: 3400168 - DNA, 19 bp, Homo sapiens
accacctggagcggctcat

SEQ ID NO: 3400169 - DNA, 15 bp, Homo sapiens
accactcaaaggcca

SEQ ID NO: 3400170 - DNA, 15 bp, Homo sapiens
accactttttgcagc

SEQ ID NO: 3400171 - DNA, 16 bp, Homo sapiens
accactttttgcagct

SEQ ID NO: 3400172 - DNA, 12 bp, Homo sapiens
accagagcagat

SEQ ID NO: 3400173 - DNA, 16 bp, Homo sapiens
accagagcagatgcag

SEQ ID NO: 3400174 - DNA, 17 bp, Homo sapiens
accagagcagatgcaga

SEQ ID NO: 3400175 - DNA, 22 bp, Homo sapiens
accagcaaagagaatgtatttc

SEQ ID NO: 3400176 - DNA, 19 bp, Homo sapiens
accaggtgttctacactca

SEQ ID NO: 3400177 - DNA, 23 bp, Homo sapiens
accagtttagctttttccttact

SEQ ID NO: 3400178 - DNA, 21 bp, Homo sapiens
accatataactgtgatgaaat

SEQ ID NO: 3400179 - DNA, 13 bp, Homo sapiens
accattctttctt

SEQ ID NO: 3400180 - DNA, 14 bp, Homo sapiens
acccacttctgcac

SEQ ID NO: 3400181 - DNA, 15 bp, Homo sapiens
acccacttctgcact

SEQ ID NO: 3400182 - DNA, 14 bp, Homo sapiens
accccccagcactg

SEQ ID NO: 3400183 - DNA, 15 bp, Homo sapiens
accccccagcactga

SEQ ID NO: 3400184 - DNA, 15 bp, Homo sapiens
acccctggttctcat

SEQ ID NO: 3400185 - DNA, 22 bp, Homo sapiens
acccctggttctcatctttctt

SEQ ID NO: 3400186 - DNA, 17 bp, Homo sapiens
acccgacataagtcgag

SEQ ID NO: 3400187 - DNA, 16 bp, Homo sapiens
acccgttcatggggga

SEQ ID NO: 3400188 - DNA, 18 bp, Homo sapiens
acccgttcatgggggagg

SEQ ID NO: 3400189 - DNA, 19 bp, Homo sapiens
accctcgaggcggatcttt

SEQ ID NO: 3400190 - DNA, 11 bp, Homo sapiens
accgtccctga

SEQ ID NO: 3400191 - DNA, 13 bp, Homo sapiens
acctaatgaaagt

SEQ ID NO: 3400192 - DNA, 19 bp, Homo sapiens
acctaatgtttatgagcca

SEQ ID NO: 3400193 - DNA, 23 bp, Homo sapiens
acctatcaaagcttcaaaaactt

SEQ ID NO: 3400194 - DNA, 20 bp, Homo sapiens
acctcaagggggactgtctt

SEQ ID NO: 3400195 - DNA, 22 bp, Homo sapiens
acctcactagctccccaatccc

SEQ ID NO: 3400196 - DNA, 23 bp, Homo sapiens
acctcgtgtctagtagaacaatg

SEQ ID NO: 3400197 - DNA, 12 bp, Homo sapiens
acctctcttgtg

SEQ ID NO: 3400198 - DNA, 16 bp, Homo sapiens
acctcttcctggaata

SEQ ID NO: 3400199 - DNA, 20 bp, Homo sapiens
acctgatcaatgacagagcc

SEQ ID NO: 3400200 - DNA, 15 bp, Homo sapiens
acctgcatatctcta

SEQ ID NO: 3400201 - DNA, 16 bp, Homo sapiens
acctgcggcccaatcc

SEQ ID NO: 3400202 - DNA, 20 bp, Homo sapiens
acctggacccctgcattgga

SEQ ID NO: 3400203 - DNA, 21 bp, Homo sapiens
acctggacccctgcattggaa

SEQ ID NO: 3400204 - DNA, 17 bp, Homo sapiens
acctgtgagaaaggaaa

SEQ ID NO: 3400205 - DNA, 22 bp, Homo sapiens
agaacagcttcaggttatcgaa

SEQ ID NO: 3400206 - DNA, 11 bp, Homo sapiens
agaacatagaa

SEQ ID NO: 3400207 - DNA, 21 bp, Homo sapiens
agaacatggtgtgtgtctctg

SEQ ID NO: 3400208 - DNA, 19 bp, Homo sapiens
agaacggggctcttctcat

SEQ ID NO: 3400209 - DNA, 18 bp, Homo sapiens
agaactacaaacaaaatt

SEQ ID NO: 3400210 - DNA, 20 bp, Homo sapiens
agaactctgggctgccatgt

SEQ ID NO: 3400211 - DNA, 18 bp, Homo sapiens
agaactttcatttttttc

SEQ ID NO: 3400212 - DNA, 13 bp, Homo sapiens
agaagaaggcagc

SEQ ID NO: 3400213 - DNA, 14 bp, Homo sapiens
agaagaaggcagca

SEQ ID NO: 3400214 - DNA, 21 bp, Homo sapiens
agaagaaggcagcaggtggca

SEQ ID NO: 3400215 - DNA, 23 bp, Homo sapiens
agaagacaccagagcagatgcag

SEQ ID NO: 3400216 - DNA, 12 bp, Homo sapiens
agaagacatgaa

SEQ ID NO: 3400217 - DNA, 13 bp, Homo sapiens
agaagaccccact

SEQ ID NO: 3400218 - DNA, 12 bp, Homo sapiens
agaagcagctct

SEQ ID NO: 3400219 - DNA, 13 bp, Homo sapiens
agaagcagctctt

SEQ ID NO: 3400220 - DNA, 15 bp, Homo sapiens
agaagcatgaaaaag

SEQ ID NO: 3400221 - DNA, 20 bp, Homo sapiens
agaagcattccttctttgat

SEQ ID NO: 3400222 - DNA, 23 bp, Homo sapiens
agaagcattccttctttgataat

SEQ ID NO: 3400223 - DNA, 24 bp, Homo sapiens
agaagcattccttctttgataatg

SEQ ID NO: 3400224 - DNA, 21 bp, Homo sapiens
agaagccaagctccctggagc

SEQ ID NO: 3400225 - DNA, 22 bp, Homo sapiens
agaagccaagctccctggagcc

SEQ ID NO: 3400226 - DNA, 23 bp, Homo sapiens
agaagccaagctccctggagccc

SEQ ID NO: 3400227 - DNA, 16 bp, Homo sapiens
agaagggctgaataaa

SEQ ID NO: 3400228 - DNA, 19 bp, Homo sapiens
agaagtttgggctaacatt

SEQ ID NO: 3400229 - DNA, 20 bp, Homo sapiens
agaagtttgggctaacattt

SEQ ID NO: 3400230 - DNA, 22 bp, Homo sapiens
agaagtttgggctaacatttag

SEQ ID NO: 3400231 - DNA, 20 bp, Homo sapiens
agaagttttttactttggtt

SEQ ID NO: 3400232 - DNA, 13 bp, Homo sapiens
agaatagaaagaa

SEQ ID NO: 3400233 - DNA, 14 bp, Homo sapiens
agaatagaaagaaa

SEQ ID NO: 3400234 - DNA, 20 bp, Homo sapiens
agaatagcctagatatgaat

SEQ ID NO: 3400235 - DNA, 12 bp, Homo sapiens
agaatagtctct

SEQ ID NO: 3400236 - DNA, 23 bp, Homo sapiens
atggagtgtttgacgaagaaaca

SEQ ID NO: 3400237 - DNA, 16 bp, Homo sapiens
atggattccaaagcat

SEQ ID NO: 3400238 - DNA, 22 bp, Homo sapiens
atggattggattatttaataac

SEQ ID NO: 3400239 - DNA, 20 bp, Homo sapiens
atggccgcagggctgtgcac

SEQ ID NO: 3400240 - DNA, 21 bp, Homo sapiens
atggcctcaagatcaatgaaa

SEQ ID NO: 3400241 - DNA, 21 bp, Homo sapiens
atgggaaggtgggcgggcagg

SEQ ID NO: 3400242 - DNA, 20 bp, Homo sapiens
atgggatatgattggttcag

SEQ ID NO: 3400243 - DNA, 20 bp, Homo sapiens
atggggatagatgtgtggac

SEQ ID NO: 3400244 - DNA, 12 bp, Homo sapiens
atggggatgcag

SEQ ID NO: 3400245 - DNA, 22 bp, Homo sapiens
atggtggcttcttttctttgta

SEQ ID NO: 3400246 - DNA, 14 bp, Homo sapiens
atggtgtaataaga

SEQ ID NO: 3400247 - DNA, 16 bp, Homo sapiens
atggtgtaataagaca

SEQ ID NO: 3400248 - DNA, 18 bp, Homo sapiens
atggtgtaataagacata

SEQ ID NO: 3400249 - DNA, 20 bp, Homo sapiens
atggtgtaataagacataac

SEQ ID NO: 3400250 - DNA, 16 bp, Homo sapiens
atggttctcaggcctg

SEQ ID NO: 3400251 - DNA, 13 bp, Homo sapiens
atgtaaaatcttc

SEQ ID NO: 3400252 - DNA, 15 bp, Homo sapiens
atgtaaaatcttcag

SEQ ID NO: 3400253 - DNA, 16 bp, Homo sapiens
atgtaaaatcttcagc

SEQ ID NO: 3400254 - DNA, 17 bp, Homo sapiens
atgtaaaatcttcagct

SEQ ID NO: 3400255 - DNA, 19 bp, Homo sapiens
atgtaatgcttatgtgttg

SEQ ID NO: 3400256 - DNA, 20 bp, Homo sapiens
atgtactggagagtggcaaa

SEQ ID NO: 3400257 - DNA, 22 bp, Homo sapiens
atgtagatattgtgaagtacat

SEQ ID NO: 3400258 - DNA, 15 bp, Homo sapiens
atgtatagttgcttt

SEQ ID NO: 3400259 - DNA, 17 bp, Homo sapiens
atgtatataaacatgct

SEQ ID NO: 3400260 - DNA, 15 bp, Homo sapiens
atgtattaaactttt

SEQ ID NO: 3400261 - DNA, 20 bp, Homo sapiens
atgtattaaacttttcatta

SEQ ID NO: 3400262 - DNA, 17 bp, Homo sapiens
atgtcacacttgtttct

SEQ ID NO: 3400263 - DNA, 13 bp, Homo sapiens
atgtcagtatgtg

SEQ ID NO: 3400264 - DNA, 14 bp, Homo sapiens
atgtcagtatgtgg

SEQ ID NO: 3400265 - DNA, 16 bp, Homo sapiens
atgtcattatttgata

SEQ ID NO: 3400266 - DNA, 22 bp, Homo sapiens
atgtcattatttgataacattt

SEQ ID NO: 3400267 - DNA, 22 bp, Homo sapiens
atgtccaaatactctgaaatgc

SEQ ID NO: 3400268 - DNA, 20 bp, Homo sapiens
atgtccctgaagtcttgcat

SEQ ID NO: 3400269 - DNA, 21 bp, Homo sapiens
atgtctctgtgagactcgaga

SEQ ID NO: 3400270 - DNA, 18 bp, Homo sapiens
atgtctgtagctcctcaa

SEQ ID NO: 3400271 - DNA, 13 bp, Homo sapiens
atgtgaaaccttt

SEQ ID NO: 3400272 - DNA, 14 bp, Homo sapiens
atgtgaatttgagt

SEQ ID NO: 3400273 - DNA, 19 bp, Homo sapiens
atgtgagaaatcagaattg

SEQ ID NO: 3400274 - DNA, 17 bp, Homo sapiens
atgtgagcctcgtgtca

SEQ ID NO: 3400275 - DNA, 17 bp, Homo sapiens
atgtgatcatctttgct

SEQ ID NO: 3400276 - DNA, 18 bp, Homo sapiens
atgtgatcatctttgctg

SEQ ID NO: 3400277 - DNA, 20 bp, Homo sapiens
atgtgcatttttgtgaaatg

SEQ ID NO: 3400278 - DNA, 16 bp, Homo sapiens
atgtggaagtgtgggt

SEQ ID NO: 3400279 - DNA, 17 bp, Homo sapiens
atgtgggggtctgtgtg

SEQ ID NO: 3400280 - DNA, 18 bp, Homo sapiens
atgtgggggtctgtgtgt

SEQ ID NO: 3400281 - DNA, 10 bp, Homo sapiens
atgtgtatat

SEQ ID NO: 3400282 - DNA, 15 bp, Homo sapiens
atgtgtatatatgtc

SEQ ID NO: 3400283 - DNA, 19 bp, Homo sapiens
atgtgtatgagaagtactt

SEQ ID NO: 3400284 - DNA, 16 bp, Homo sapiens
atgtgtcccagtgaac

SEQ ID NO: 3400285 - DNA, 21 bp, Homo sapiens
atgtgtcccagtgaacagttt

SEQ ID NO: 3400286 - DNA, 13 bp, Homo sapiens
atgtgtctgcaac

SEQ ID NO: 3400287 - DNA, 16 bp, Homo sapiens
atgtgtctgcaacatg

SEQ ID NO: 3400288 - DNA, 18 bp, Homo sapiens
atgtgtctgcaacatgga

SEQ ID NO: 3400289 - DNA, 19 bp, Homo sapiens
atgtgtctgtgttgcttca

SEQ ID NO: 3400290 - DNA, 20 bp, Homo sapiens
atgtgtctgtgttgcttcaa

SEQ ID NO: 3400291 - DNA, 22 bp, Homo sapiens
atgtgtgtgtgttgtgtgtggg

SEQ ID NO: 3400292 - DNA, 23 bp, Homo sapiens
atgtgtgtgtgttgtgtgtggga

SEQ ID NO: 3400293 - DNA, 20 bp, Homo sapiens
atgtgttgacgtaagctcta

SEQ ID NO: 3400294 - DNA, 19 bp, Homo sapiens
atgtgttgcataaacaatc

SEQ ID NO: 3400295 - DNA, 12 bp, Homo sapiens
atgttaaatttg

SEQ ID NO: 3400296 - DNA, 14 bp, Homo sapiens
atgttaaatttgta

SEQ ID NO: 3400297 - DNA, 16 bp, Homo sapiens
atgttaaatttgtaag

SEQ ID NO: 3400298 - DNA, 18 bp, Homo sapiens
atgttaaatttgtaagtt

SEQ ID NO: 3400299 - DNA, 18 bp, Homo sapiens
atgttaaggaaactctta

SEQ ID NO: 3400300 - DNA, 23 bp, Homo sapiens
atgttaaggaaactcttatctca

SEQ ID NO: 3400301 - DNA, 17 bp, Homo sapiens
atgttacttgagaagtg

SEQ ID NO: 3400302 - DNA, 18 bp, Homo sapiens
atgttacttgagaagtgc

SEQ ID NO: 3400303 - DNA, 21 bp, Homo sapiens
atgttacttgagaagtgctta

SEQ ID NO: 3400304 - DNA, 13 bp, Homo sapiens
atgttctgtccct

SEQ ID NO: 3400305 - DNA, 20 bp, Homo sapiens
atgttctgtcccttgccccc

SEQ ID NO: 3400306 - DNA, 21 bp, Homo sapiens
atgttggtgcaattaactctg

SEQ ID NO: 3400307 - DNA, 15 bp, Homo sapiens
atgttggttgcactt

SEQ ID NO: 3400308 - DNA, 19 bp, Homo sapiens
atgttggttgcactttgta

SEQ ID NO: 3400309 - DNA, 18 bp, Homo sapiens
atgttgtgcctccctggt

SEQ ID NO: 3400310 - DNA, 17 bp, Homo sapiens
atgtttacagaggacag

SEQ ID NO: 3400311 - DNA, 21 bp, Homo sapiens
atgtttatgagccagacaaat

SEQ ID NO: 3400312 - DNA, 12 bp, Homo sapiens
atgttttcattg

SEQ ID NO: 3400313 - DNA, 17 bp, Homo sapiens
atgttttcattgggaaa

SEQ ID NO: 3400314 - DNA, 17 bp, Homo sapiens
atgtttttgtgtagagt

SEQ ID NO: 3400315 - DNA, 14 bp, Homo sapiens
attaaaaactttaa

SEQ ID NO: 3400316 - DNA, 15 bp, Homo sapiens
attaaactgattcca

SEQ ID NO: 3400317 - DNA, 21 bp, Homo sapiens
attaaattctctctaacataa

SEQ ID NO: 3400318 - DNA, 17 bp, Homo sapiens
attaaattgcctttgta

SEQ ID NO: 3400319 - DNA, 13 bp, Homo sapiens
attaactaaatgc

SEQ ID NO: 3400320 - DNA, 14 bp, Homo sapiens
attaactaaatgct

SEQ ID NO: 3400321 - DNA, 16 bp, Homo sapiens
attaactctggacctc

SEQ ID NO: 3400322 - DNA, 23 bp, Homo sapiens
attaactctggacctctcttgtg

SEQ ID NO: 3400323 - DNA, 13 bp, Homo sapiens
attaagaaacaat

SEQ ID NO: 3400324 - DNA, 19 bp, Homo sapiens
attaattgttccttgcttt

SEQ ID NO: 3400325 - DNA, 15 bp, Homo sapiens
attacagggcacagg

SEQ ID NO: 3400326 - DNA, 13 bp, Homo sapiens
attaccagtctga

SEQ ID NO: 3400327 - DNA, 16 bp, Homo sapiens
attaccagtctgatta

SEQ ID NO: 3400328 - DNA, 22 bp, Homo sapiens
attaccatagagtaatgatgta

SEQ ID NO: 3400329 - DNA, 13 bp, Homo sapiens
attaccttactgt

SEQ ID NO: 3400330 - DNA, 22 bp, Homo sapiens
attacgttcttacaagcttaaa

SEQ ID NO: 3400331 - DNA, 23 bp, Homo sapiens
attagggaaaatggatatagaaa

SEQ ID NO: 3400332 - DNA, 23 bp, Homo sapiens
attagtcattcaataaattgtaa

SEQ ID NO: 3400333 - DNA, 21 bp, Homo sapiens
attagtgttctttatatacct

SEQ ID NO: 3400334 - DNA, 16 bp, Homo sapiens
attataccagcaaaga

SEQ ID NO: 3400335 - DNA, 18 bp, Homo sapiens
attataccatgtgtgcta

SEQ ID NO: 3400336 - DNA, 21 bp, Homo sapiens
attatgactaaagtaccagat

SEQ ID NO: 3400337 - DNA, 21 bp, Homo sapiens
attatgatgtgggtcaaggaa

SEQ ID NO: 3400338 - DNA, 13 bp, Homo sapiens
attatttaataac

SEQ ID NO: 3400339 - DNA, 21 bp, Homo sapiens
attatttaataacattacctt

SEQ ID NO: 3400340 - DNA, 17 bp, Homo sapiens
attatttgataacattt

SEQ ID NO: 3400341 - DNA, 16 bp, Homo sapiens
attatttgtatgtatt

SEQ ID NO: 3400342 - DNA, 23 bp, Homo sapiens
attattttgtgcaacataacaat

SEQ ID NO: 3400343 - DNA, 20 bp, Homo sapiens
attcaaggctttaaaagtca

SEQ ID NO: 3400344 - DNA, 13 bp, Homo sapiens
attcaataaattg

SEQ ID NO: 3400345 - DNA, 21 bp, Homo sapiens
attcacatttcaagatccaaa

SEQ ID NO: 3400346 - DNA, 16 bp, Homo sapiens
attcaccctgggcagt

SEQ ID NO: 3400347 - DNA, 12 bp, Homo sapiens
attcacttcacg

SEQ ID NO: 3400348 - DNA, 21 bp, Homo sapiens
atcggtgaaactaacagataa

SEQ ID NO: 3400349 - DNA, 20 bp, Homo sapiens
atctaaagctttatctttgt

SEQ ID NO: 3400350 - DNA, 22 bp, Homo sapiens
atctaaagctttatctttgtgt

SEQ ID NO: 3400351 - DNA, 20 bp, Homo sapiens
atctatgtttcatcttgttt

SEQ ID NO: 3400352 - DNA, 14 bp, Homo sapiens
atctatttctgaga

SEQ ID NO: 3400353 - DNA, 15 bp, Homo sapiens
atctatttttaaaat

SEQ ID NO: 3400354 - DNA, 20 bp, Homo sapiens
atctatttttaaaatcataa

SEQ ID NO: 3400355 - DNA, 13 bp, Homo sapiens
atctcaactataa

SEQ ID NO: 3400356 - DNA, 18 bp, Homo sapiens
atctcagtcactttttcc

SEQ ID NO: 3400357 - DNA, 22 bp, Homo sapiens
atctcagtcactttttcccctg

SEQ ID NO: 3400358 - DNA, 16 bp, Homo sapiens
atctcagtcatgcata

SEQ ID NO: 3400359 - DNA, 18 bp, Homo sapiens
atctcagtcatgcataaa

SEQ ID NO: 3400360 - DNA, 22 bp, Homo sapiens
atctcagtcatgcataaatatg

SEQ ID NO: 3400361 - DNA, 20 bp, Homo sapiens
atctccacccaatgaatgat

SEQ ID NO: 3400362 - DNA, 14 bp, Homo sapiens
atctcctctgctca

SEQ ID NO: 3400363 - DNA, 16 bp, Homo sapiens
atctcctctgctcatt

SEQ ID NO: 3400364 - DNA, 21 bp, Homo sapiens
atctcctctgctcattaaact

SEQ ID NO: 3400365 - DNA, 17 bp, Homo sapiens
atctccttgtggcctat

SEQ ID NO: 3400366 - DNA, 14 bp, Homo sapiens
atctcgactccccc

SEQ ID NO: 3400367 - DNA, 15 bp, Homo sapiens
atctctgtcagtgtg

SEQ ID NO: 3400368 - DNA, 19 bp, Homo sapiens
atctcttagctcccctcca

SEQ ID NO: 3400369 - DNA, 22 bp, Homo sapiens
atctcttttgaatccatgcttg

SEQ ID NO: 3400370 - DNA, 21 bp, Homo sapiens
atctgaattttaaaacatgct

SEQ ID NO: 3400371 - DNA, 21 bp, Homo sapiens
atctgcatgtaaaatcttcag

SEQ ID NO: 3400372 - DNA, 14 bp, Homo sapiens
atctgctctccttc

SEQ ID NO: 3400373 - DNA, 21 bp, Homo sapiens
atctgctctccttcctggagc

SEQ ID NO: 3400374 - DNA, 15 bp, Homo sapiens
atctggtatctgcat

SEQ ID NO: 3400375 - DNA, 21 bp, Homo sapiens
atctgtactttgtgtttagct

SEQ ID NO: 3400376 - DNA, 17 bp, Homo sapiens
atctgtgtctgtgtctg

SEQ ID NO: 3400377 - DNA, 17 bp, Homo sapiens
atcttacaactccccca

SEQ ID NO: 3400378 - DNA, 20 bp, Homo sapiens
atcttacaactcccccaccg

SEQ ID NO: 3400379 - DNA, 13 bp, Homo sapiens
atcttcagctggt

SEQ ID NO: 3400380 - DNA, 19 bp, Homo sapiens
atcttcagctggtggatgg

SEQ ID NO: 3400381 - DNA, 22 bp, Homo sapiens
atcttgcagaagttcttagtgt

SEQ ID NO: 3400382 - DNA, 20 bp, Homo sapiens
atcttgcatggcattaattg

SEQ ID NO: 3400383 - DNA, 18 bp, Homo sapiens
atctttcttgatcaacat

SEQ ID NO: 3400384 - DNA, 14 bp, Homo sapiens
atctttgattctcc

SEQ ID NO: 3400385 - DNA, 16 bp, Homo sapiens
atctttgattctcctt

SEQ ID NO: 3400386 - DNA, 19 bp, Homo sapiens
atctttgattctccttcag

SEQ ID NO: 3400387 - DNA, 22 bp, Homo sapiens
atctttgcatcatagaacagaa

SEQ ID NO: 3400388 - DNA, 22 bp, Homo sapiens
atctttggacagaagcagctct

SEQ ID NO: 3400389 - DNA, 12 bp, Homo sapiens
atctttgtgaag

SEQ ID NO: 3400390 - DNA, 12 bp, Homo sapiens
atctttgtgtaa

SEQ ID NO: 3400391 - DNA, 11 bp, Homo sapiens
atgaaactggt

SEQ ID NO: 3400392 - DNA, 22 bp, Homo sapiens
atgaaactggtttataataaac

SEQ ID NO: 3400393 - DNA, 16 bp, Homo sapiens
atgaaatattttgaat

SEQ ID NO: 3400394 - DNA, 21 bp, Homo sapiens
atgaagctggaagcactgctg

SEQ ID NO: 3400395 - DNA, 22 bp, Homo sapiens
atgaagctggaagcactgctgt

SEQ ID NO: 3400396 - DNA, 17 bp, Homo sapiens
atgaagggtcatttctc

SEQ ID NO: 3400397 - DNA, 19 bp, Homo sapiens
atgaaggtttctgaaaatt

SEQ ID NO: 3400398 - DNA, 20 bp, Homo sapiens
atgaatatatggcatttgca

SEQ ID NO: 3400399 - DNA, 22 bp, Homo sapiens
atgaatgaggaacaatcacaaa

SEQ ID NO: 3400400 - DNA, 23 bp, Homo sapiens
atgaatgatgatggtatagtatg

SEQ ID NO: 3400401 - DNA, 15 bp, Homo sapiens
atgaatttgactggt

SEQ ID NO: 3400402 - DNA, 20 bp, Homo sapiens
atgacaaaagtgacagatgt

SEQ ID NO: 3400403 - DNA, 14 bp, Homo sapiens
atgacacaatgaca

SEQ ID NO: 3400404 - DNA, 15 bp, Homo sapiens
atgacacatttgttg

SEQ ID NO: 3400405 - DNA, 17 bp, Homo sapiens
atgacacatttgttgca

SEQ ID NO: 3400406 - DNA, 17 bp, Homo sapiens
atgaccttctaggaagc

SEQ ID NO: 3400407 - DNA, 19 bp, Homo sapiens
atgacggaagaacatagaa

SEQ ID NO: 3400408 - DNA, 21 bp, Homo sapiens
atgacggaagaacatagaact

SEQ ID NO: 3400409 - DNA, 12 bp, Homo sapiens
atgactaaagag

SEQ ID NO: 3400410 - DNA, 23 bp, Homo sapiens
atgactgagtctggcaaacatgt

SEQ ID NO: 3400411 - DNA, 14 bp, Homo sapiens
atgagaactctgag

SEQ ID NO: 3400412 - DNA, 16 bp, Homo sapiens
atgagaagtactttgt

SEQ ID NO: 3400413 - DNA, 16 bp, Homo sapiens
atgagacttaattttg

SEQ ID NO: 3400414 - DNA, 16 bp, Homo sapiens
atgagatttctttgaa

SEQ ID NO: 3400415 - DNA, 11 bp, Homo sapiens
atgagccagac

SEQ ID NO: 3400416 - DNA, 18 bp, Homo sapiens
atgagctgtgcacaaagt

SEQ ID NO: 3400417 - DNA, 18 bp, Homo sapiens
atgagttggctgggaata

SEQ ID NO: 3400418 - DNA, 15 bp, Homo sapiens
atgatcaaaaataat

SEQ ID NO: 3400419 - DNA, 13 bp, Homo sapiens
attcacttcacgc

SEQ ID NO: 3400420 - DNA, 21 bp, Homo sapiens
attcagctgaggttcattaca

SEQ ID NO: 3400421 - DNA, 17 bp, Homo sapiens
attcagtgaaaaagata

SEQ ID NO: 3400422 - DNA, 15 bp, Homo sapiens
attcagtgagggtct

SEQ ID NO: 3400423 - DNA, 16 bp, Homo sapiens
attcagtgagggtctt

SEQ ID NO: 3400424 - DNA, 13 bp, Homo sapiens
attcagtgatggc

SEQ ID NO: 3400425 - DNA, 14 bp, Homo sapiens
attcatcaaataaa

SEQ ID NO: 3400426 - DNA, 17 bp, Homo sapiens
attcatgttttaaaagt

SEQ ID NO: 3400427 - DNA, 23 bp, Homo sapiens
attccaatgatacccaacagttt

SEQ ID NO: 3400428 - DNA, 18 bp, Homo sapiens
attccacacaaaatgtca

SEQ ID NO: 3400429 - DNA, 15 bp, Homo sapiens
attccacatcatgtt

SEQ ID NO: 3400430 - DNA, 12 bp, Homo sapiens
attccagaggaa

SEQ ID NO: 3400431 - DNA, 20 bp, Homo sapiens
attcctaacacagcatgtgt

SEQ ID NO: 3400432 - DNA, 14 bp, Homo sapiens
attccttctttgat

SEQ ID NO: 3400433 - DNA, 15 bp, Homo sapiens
attccttctttgata

SEQ ID NO: 3400434 - DNA, 16 bp, Homo sapiens
attccttctttgataa

SEQ ID NO: 3400435 - DNA, 12 bp, Homo sapiens
attctaaacaga

SEQ ID NO: 3400436 - DNA, 15 bp, Homo sapiens
attctaaacagatgt

SEQ ID NO: 3400437 - DNA, 23 bp, Homo sapiens
attctatgtgtcatcaatagtgt

SEQ ID NO: 3400438 - DNA, 17 bp, Homo sapiens
attctccttcagccctc

SEQ ID NO: 3400439 - DNA, 22 bp, Homo sapiens
attctccttcagccctcacccc

SEQ ID NO: 3400440 - DNA, 15 bp, Homo sapiens
attctgaaatacttt

SEQ ID NO: 3400441 - DNA, 17 bp, Homo sapiens
attctgataatgtattg

SEQ ID NO: 3400442 - DNA, 18 bp, Homo sapiens
attctgcattaataatag

SEQ ID NO: 3400443 - DNA, 13 bp, Homo sapiens
attcttaaaatgc

SEQ ID NO: 3400444 - DNA, 17 bp, Homo sapiens
attcttaaaatgcaata

SEQ ID NO: 3400445 - DNA, 19 bp, Homo sapiens
attcttggttgttaattta

SEQ ID NO: 3400446 - DNA, 20 bp, Homo sapiens
attctttcttggtgcattcg

SEQ ID NO: 3400447 - DNA, 13 bp, Homo sapiens
attctttgtttcc

SEQ ID NO: 3400448 - DNA, 18 bp, Homo sapiens
attctttgtttcctcttt

SEQ ID NO: 3400449 - DNA, 16 bp, Homo sapiens
attgaaagttgctttt

SEQ ID NO: 3400450 - DNA, 20 bp, Homo sapiens
attgaaatttaaaaataaag

SEQ ID NO: 3400451 - DNA, 11 bp, Homo sapiens
attgaatttag

SEQ ID NO: 3400452 - DNA, 16 bp, Homo sapiens
attgaccatgtgatta

SEQ ID NO: 3400453 - DNA, 17 bp, Homo sapiens
attgattttaaaaatac

SEQ ID NO: 3400454 - DNA, 19 bp, Homo sapiens
attgcctttgtaatatgag

SEQ ID NO: 3400455 - DNA, 19 bp, Homo sapiens
attgctccattttcttgtc

SEQ ID NO: 3400456 - DNA, 22 bp, Homo sapiens
attgctgtccttgaatgccata

SEQ ID NO: 3400457 - DNA, 14 bp, Homo sapiens
attggaacttttct

SEQ ID NO: 3400458 - DNA, 15 bp, Homo sapiens
attggatttgctgtg

SEQ ID NO: 3400459 - DNA, 16 bp, Homo sapiens
attggctcacactgag

SEQ ID NO: 3400460 - DNA, 21 bp, Homo sapiens
attggctcacactgagaatgt

SEQ ID NO: 3400461 - DNA, 19 bp, Homo sapiens
attgtacacaccttatatt

SEQ ID NO: 3400462 - DNA, 17 bp, Homo sapiens
attgtagagccagaggt

SEQ ID NO: 3400463 - DNA, 18 bp, Homo sapiens
attgtagagccagaggtc

SEQ ID NO: 3400464 - DNA, 14 bp, Homo sapiens
attgtattgctgtc

SEQ ID NO: 3400465 - DNA, 14 bp, Homo sapiens
attgtgatgtgtcc

SEQ ID NO: 3400466 - DNA, 12 bp, Homo sapiens
attgtgttcact

SEQ ID NO: 3400467 - DNA, 18 bp, Homo sapiens
attgttctgggtgatttc

SEQ ID NO: 3400468 - DNA, 19 bp, Homo sapiens
atttaaaaataaagctact

SEQ ID NO: 3400469 - DNA, 21 bp, Homo sapiens
atttaaaaataaagctactga

SEQ ID NO: 3400470 - DNA, 13 bp, Homo sapiens
atttaaaagacaa

SEQ ID NO: 3400471 - DNA, 14 bp, Homo sapiens
atttaaaagacaaa

SEQ ID NO: 3400472 - DNA, 19 bp, Homo sapiens
atttaaaagacaaacacct

SEQ ID NO: 3400473 - DNA, 19 bp, Homo sapiens
atttaaaattgtgatgtgt

SEQ ID NO: 3400474 - DNA, 23 bp, Homo sapiens
atttaaatatctgaacatttact

SEQ ID NO: 3400475 - DNA, 19 bp, Homo sapiens
atttaaattgttataactt

SEQ ID NO: 3400476 - DNA, 12 bp, Homo sapiens
atttaagcatga

SEQ ID NO: 3400477 - DNA, 14 bp, Homo sapiens
atttaagtgcgtgt

SEQ ID NO: 3400478 - DNA, 18 bp, Homo sapiens
aagagaagggcagggctg

SEQ ID NO: 3400479 - DNA, 13 bp, Homo sapiens
aagagagaatgta

SEQ ID NO: 3400480 - DNA, 23 bp, Homo sapiens
aagagaggacccatcctgccaca

SEQ ID NO: 3400481 - DNA, 17 bp, Homo sapiens
aagagatgaaataattt

SEQ ID NO: 3400482 - DNA, 15 bp, Homo sapiens
aagagattcctgagc

SEQ ID NO: 3400483 - DNA, 16 bp, Homo sapiens
aagagctgtcctggta

SEQ ID NO: 3400484 - DNA, 16 bp, Homo sapiens
aagaggctgaaagagg

SEQ ID NO: 3400485 - DNA, 18 bp, Homo sapiens
aagagtgtagaagcattc

SEQ ID NO: 3400486 - DNA, 19 bp, Homo sapiens
aagagttgagtgatagagc

SEQ ID NO: 3400487 - DNA, 16 bp, Homo sapiens
aagataagtctacatt

SEQ ID NO: 3400488 - DNA, 23 bp, Homo sapiens
aagatccaaatgctgtgcaaaca

SEQ ID NO: 3400489 - DNA, 12 bp, Homo sapiens
aagatctgattt

SEQ ID NO: 3400490 - DNA, 19 bp, Homo sapiens
aagatcttgcagaagttct

SEQ ID NO: 3400491 - DNA, 15 bp, Homo sapiens
aagatgaacagactg

SEQ ID NO: 3400492 - DNA, 18 bp, Homo sapiens
aagattagggaaaatgga

SEQ ID NO: 3400493 - DNA, 20 bp, Homo sapiens
aagattcttccattaaattg

SEQ ID NO: 3400494 - DNA, 17 bp, Homo sapiens
aagattttgaatgcttc

SEQ ID NO: 3400495 - DNA, 15 bp, Homo sapiens
agtctgttttgtaaa

SEQ ID NO: 3400496 - DNA, 16 bp, Homo sapiens
agtctgttttgtaaag

SEQ ID NO: 3400497 - DNA, 12 bp, Homo sapiens
agtcttgcattg

SEQ ID NO: 3400498 - DNA, 18 bp, Homo sapiens
agtgaacagtttggatgt

SEQ ID NO: 3400499 - DNA, 22 bp, Homo sapiens
agtgacagatgttatttttgta

SEQ ID NO: 3400500 - DNA, 18 bp, Homo sapiens
agtgagtgccatgctttt

SEQ ID NO: 3400501 - DNA, 14 bp, Homo sapiens
agtgagtggcatgt

SEQ ID NO: 3400502 - DNA, 16 bp, Homo sapiens
agtgagtggcatgtgg

SEQ ID NO: 3400503 - DNA, 18 bp, Homo sapiens
agtgagtggcatgtgggt

SEQ ID NO: 3400504 - DNA, 17 bp, Homo sapiens
agtgagtggtgttggca

SEQ ID NO: 3400505 - DNA, 20 bp, Homo sapiens
agtgagttttactcttaaat

SEQ ID NO: 3400506 - DNA, 23 bp, Homo sapiens
agtgagttttactcttaaatcat

SEQ ID NO: 3400507 - DNA, 22 bp, Homo sapiens
agtgatatggcagaagacacca

SEQ ID NO: 3400508 - DNA, 24 bp, Homo sapiens
agtgatatggcagaagacaccaga

SEQ ID NO: 3400509 - DNA, 21 bp, Homo sapiens
agtgatctcactaaaaatata

SEQ ID NO: 3400510 - DNA, 18 bp, Homo sapiens
agtgcattattttattga

SEQ ID NO: 3400511 - DNA, 16 bp, Homo sapiens
agtgcccctgtcccac

SEQ ID NO: 3400512 - DNA, 16 bp, Homo sapiens
agtgcgtgtgtagagt

SEQ ID NO: 3400513 - DNA, 16 bp, Homo sapiens
agtgcttcttgtaata

SEQ ID NO: 3400514 - DNA, 18 bp, Homo sapiens
agtgcttcttgtaatatt

SEQ ID NO: 3400515 - DNA, 13 bp, Homo sapiens
agtggcaggacag

SEQ ID NO: 3400516 - DNA, 16 bp, Homo sapiens
agtggcaggacaggaa

SEQ ID NO: 3400517 - DNA, 17 bp, Homo sapiens
agtggcaggacaggaaa

SEQ ID NO: 3400518 - DNA, 18 bp, Homo sapiens
agtggcttcactcctgct

SEQ ID NO: 3400519 - DNA, 16 bp, Homo sapiens
agtggggtaggttggg

SEQ ID NO: 3400520 - DNA, 13 bp, Homo sapiens
agtggtctttgta

SEQ ID NO: 3400521 - DNA, 15 bp, Homo sapiens
agtggtctttgtaag

SEQ ID NO: 3400522 - DNA, 16 bp, Homo sapiens
agtggtctttgtaaga

SEQ ID NO: 3400523 - DNA, 18 bp, Homo sapiens
agtggtctttgtaagagt

SEQ ID NO: 3400524 - DNA, 19 bp, Homo sapiens
agtgtagaagcattccttc

SEQ ID NO: 3400525 - DNA, 13 bp, Homo sapiens
agtgtcagtgttg

SEQ ID NO: 3400526 - DNA, 21 bp, Homo sapiens
agtgtccccatgggctcccac

SEQ ID NO: 3400527 - DNA, 19 bp, Homo sapiens
agtgtctagagtcatgtga

SEQ ID NO: 3400528 - DNA, 17 bp, Homo sapiens
agtgtgggtctgtgtgt

SEQ ID NO: 3400529 - DNA, 19 bp, Homo sapiens
agtgtgggtctgtgtgtgt

SEQ ID NO: 3400530 - DNA, 23 bp, Homo sapiens
agtgtgggtctgtgtgtgtgtat

SEQ ID NO: 3400531 - DNA, 19 bp, Homo sapiens
agtgttcagccaaacagta

SEQ ID NO: 3400532 - DNA, 23 bp, Homo sapiens
agtgttgaaaaatatctttgcat

SEQ ID NO: 3400533 - DNA, 14 bp, Homo sapiens
agtgtttatgacaa

SEQ ID NO: 3400534 - DNA, 20 bp, Homo sapiens
agtgtttggtgctcatttaa

SEQ ID NO: 3400535 - DNA, 12 bp, Homo sapiens
agttaagaagct

SEQ ID NO: 3400536 - DNA, 17 bp, Homo sapiens
agttaagaagctgttgt

SEQ ID NO: 3400537 - DNA, 22 bp, Homo sapiens
agttaagaagctgttgtacatt

SEQ ID NO: 3400538 - DNA, 22 bp, Homo sapiens
agttaatatttttaaaagtata

SEQ ID NO: 3400539 - DNA, 17 bp, Homo sapiens
agttacgtataatgctt

SEQ ID NO: 3400540 - DNA, 22 bp, Homo sapiens
agttacgtataatgctttctga

SEQ ID NO: 3400541 - DNA, 15 bp, Homo sapiens
agttctagttgcttg

SEQ ID NO: 3400542 - DNA, 22 bp, Homo sapiens
agttctatggagactttgctgt

SEQ ID NO: 3400543 - DNA, 15 bp, Homo sapiens
agttctgtaatgtag

SEQ ID NO: 3400544 - DNA, 18 bp, Homo sapiens
agttgaaaaaagaagttt

SEQ ID NO: 3400545 - DNA, 22 bp, Homo sapiens
agttgacttgacagaacactgt

SEQ ID NO: 3400546 - DNA, 18 bp, Homo sapiens
agttggggctcttggctt

SEQ ID NO: 3400547 - DNA, 18 bp, Homo sapiens
agttggtcttactttgtg

SEQ ID NO: 3400548 - DNA, 22 bp, Homo sapiens
agttgtagactatggaatgtca

SEQ ID NO: 3400549 - DNA, 23 bp, Homo sapiens
agttgtatcagcacgtgtggcct

SEQ ID NO: 3400550 - DNA, 15 bp, Homo sapiens
agttgtctttctttg

SEQ ID NO: 3400551 - DNA, 18 bp, Homo sapiens
agttgtctttctttgctg

SEQ ID NO: 3400552 - DNA, 20 bp, Homo sapiens
agtttaaaatcttgcatggc

SEQ ID NO: 3400553 - DNA, 16 bp, Homo sapiens
agtttcaggtgacatg

SEQ ID NO: 3400554 - DNA, 21 bp, Homo sapiens
agtttcaggtgacatgtgaaa

SEQ ID NO: 3400555 - DNA, 22 bp, Homo sapiens
agtttcaggtgacatgtgaaac

SEQ ID NO: 3400556 - DNA, 18 bp, Homo sapiens
agtttgatgaggccctcc

SEQ ID NO: 3400557 - DNA, 18 bp, Homo sapiens
agtttgctgttttaaatt

SEQ ID NO: 3400558 - DNA, 21 bp, Homo sapiens
agtttggttaatcagtgttga

SEQ ID NO: 3400559 - DNA, 18 bp, Homo sapiens
agttttactcttaaatca

SEQ ID NO: 3400560 - DNA, 15 bp, Homo sapiens
agttttgaaaagcta

SEQ ID NO: 3400561 - DNA, 20 bp, Homo sapiens
agttttgctttgttgaataa

SEQ ID NO: 3400562 - DNA, 23 bp, Homo sapiens
agtttttaactctactgtgtaat

SEQ ID NO: 3400563 - DNA, 21 bp, Homo sapiens
agtttttaattaaaaacttta

SEQ ID NO: 3400564 - DNA, 19 bp, Homo sapiens
agttttttactttggttta

SEQ ID NO: 3400565 - DNA, 14 bp, Homo sapiens
ataaaatgtttcaa

SEQ ID NO: 3400566 - DNA, 18 bp, Homo sapiens
ataaaattttttactttt

SEQ ID NO: 3400567 - DNA, 17 bp, Homo sapiens
ataaactcttaagagaa

SEQ ID NO: 3400568 - DNA, 20 bp, Homo sapiens
ataaagtttttttatttctt

SEQ ID NO: 3400569 - DNA, 16 bp, Homo sapiens
aatagctaataataaa

SEQ ID NO: 3400570 - DNA, 15 bp, Homo sapiens
aataggagaggatga

SEQ ID NO: 3400571 - DNA, 23 bp, Homo sapiens
aataggagaggatgagagcccag

SEQ ID NO: 3400572 - DNA, 14 bp, Homo sapiens
aatagttttgcttt

SEQ ID NO: 3400573 - DNA, 13 bp, Homo sapiens
aatataaacacta

SEQ ID NO: 3400574 - DNA, 12 bp, Homo sapiens
aatataatgtgc

SEQ ID NO: 3400575 - DNA, 11 bp, Homo sapiens
aatatactttt

SEQ ID NO: 3400576 - DNA, 13 bp, Homo sapiens
aatatagttgtct

SEQ ID NO: 3400577 - DNA, 21 bp, Homo sapiens
aatatagttgtctttctttgc

SEQ ID NO: 3400578 - DNA, 20 bp, Homo sapiens
aatatatagctggcaagaat

SEQ ID NO: 3400579 - DNA, 14 bp, Homo sapiens
aatatatggcattt

SEQ ID NO: 3400580 - DNA, 18 bp, Homo sapiens
aatatatgttgaatgtta

SEQ ID NO: 3400581 - DNA, 23 bp, Homo sapiens
aatatccctttttcacatattaa

SEQ ID NO: 3400582 - DNA, 14 bp, Homo sapiens
aatatctttgcatc

SEQ ID NO: 3400583 - DNA, 23 bp, Homo sapiens
aatatctttgcatcatagaacag

SEQ ID NO: 3400584 - DNA, 16 bp, Homo sapiens
aatatgagaatgtatt

SEQ ID NO: 3400585 - DNA, 18 bp, Homo sapiens
aatattaagaaacaattt

SEQ ID NO: 3400586 - DNA, 14 bp, Homo sapiens
aatattacctaatg

SEQ ID NO: 3400587 - DNA, 19 bp, Homo sapiens
aatattacctaatgaaagt

SEQ ID NO: 3400588 - DNA, 19 bp, Homo sapiens
aatattctgataatgtatt

SEQ ID NO: 3400589 - DNA, 16 bp, Homo sapiens
aatattcttctttgat

SEQ ID NO: 3400590 - DNA, 17 bp, Homo sapiens
aatattcttctttgata

SEQ ID NO: 3400591 - DNA, 16 bp, Homo sapiens
aatatttcttcaagtg

SEQ ID NO: 3400592 - DNA, 14 bp, Homo sapiens
aatattttacccaa

SEQ ID NO: 3400593 - DNA, 18 bp, Homo sapiens
aatattttgaatacacat

SEQ ID NO: 3400594 - DNA, 15 bp, Homo sapiens
aatcaacctatcaaa

SEQ ID NO: 3400595 - DNA, 14 bp, Homo sapiens
aatcaattttttaa

SEQ ID NO: 3400596 - DNA, 22 bp, Homo sapiens
aatcacaaaagctgtgtctctg

SEQ ID NO: 3400597 - DNA, 19 bp, Homo sapiens
aatcacttaacattcctaa

SEQ ID NO: 3400598 - DNA, 18 bp, Homo sapiens
aatcagtttattaaatct

SEQ ID NO: 3400599 - DNA, 21 bp, Homo sapiens
aatcataacatagttgaaaaa

SEQ ID NO: 3400600 - DNA, 15 bp, Homo sapiens
aatcatctttgtgaa

SEQ ID NO: 3400601 - DNA, 14 bp, Homo sapiens
aatcatttggttaa

SEQ ID NO: 3400602 - DNA, 19 bp, Homo sapiens
aatcattttaggaaaggat

SEQ ID NO: 3400603 - DNA, 15 bp, Homo sapiens
aatccatgcttgggt

SEQ ID NO: 3400604 - DNA, 16 bp, Homo sapiens
aatctatattaaatga

SEQ ID NO: 3400605 - DNA, 20 bp, Homo sapiens
aatctccacccaatgaatga

SEQ ID NO: 3400606 - DNA, 18 bp, Homo sapiens
aatctggggaagaggttt

SEQ ID NO: 3400607 - DNA, 18 bp, Homo sapiens
aatcttagtatagtagaa

SEQ ID NO: 3400608 - DNA, 19 bp, Homo sapiens
aatcttagtatagtagaaa

SEQ ID NO: 3400609 - DNA, 23 bp, Homo sapiens
aatcttagtatagtagaaagaca

SEQ ID NO: 3400610 - DNA, 11 bp, Homo sapiens
aatcttcagct

SEQ ID NO: 3400611 - DNA, 12 bp, Homo sapiens
aatcttcagctg

SEQ ID NO: 3400612 - DNA, 13 bp, Homo sapiens
aatcttcagctgg

SEQ ID NO: 3400613 - DNA, 14 bp, Homo sapiens
aatcttcagctggt

SEQ ID NO: 3400614 - DNA, 15 bp, Homo sapiens
aatcttcagctggtg

SEQ ID NO: 3400615 - DNA, 17 bp, Homo sapiens
aatgaaagtgatgacat

SEQ ID NO: 3400616 - DNA, 18 bp, Homo sapiens
aatgaactgatttttatt

SEQ ID NO: 3400617 - DNA, 16 bp, Homo sapiens
aatgaagggtcatttc

SEQ ID NO: 3400618 - DNA, 17 bp, Homo sapiens
aatgaatttgactggtt

SEQ ID NO: 3400619 - DNA, 15 bp, Homo sapiens
aatgacacatttgtt

SEQ ID NO: 3400620 - DNA, 23 bp, Homo sapiens
aatgagggtttctgatctgtact

SEQ ID NO: 3400621 - DNA, 14 bp, Homo sapiens
aatgagttttacaa

SEQ ID NO: 3400622 - DNA, 16 bp, Homo sapiens
aatgatttttgtgtat

SEQ ID NO: 3400623 - DNA, 18 bp, Homo sapiens
aatgcaacaacatgtata

SEQ ID NO: 3400624 - DNA, 16 bp, Homo sapiens
aatgcaatgataaata

SEQ ID NO: 3400625 - DNA, 17 bp, Homo sapiens
aatgcagaggaggagaa

SEQ ID NO: 3400626 - DNA, 14 bp, Homo sapiens
aatgcatagagcaa

SEQ ID NO: 3400627 - DNA, 21 bp, Homo sapiens
aatgcattaccttctgttcct

SEQ ID NO: 3400628 - DNA, 14 bp, Homo sapiens
aatgcattcatgtt

SEQ ID NO: 3400629 - DNA, 19 bp, Homo sapiens
aatgccaggcggacaaagt

SEQ ID NO: 3400630 - DNA, 21 bp, Homo sapiens
aatgccatggacagaagaagg

SEQ ID NO: 3400631 - DNA, 17 bp, Homo sapiens
aatgcccatttttgcta

SEQ ID NO: 3400632 - DNA, 13 bp, Homo sapiens
aatgcctttgaga

SEQ ID NO: 3400633 - DNA, 15 bp, Homo sapiens
aatgcgtcttgtgaa

SEQ ID NO: 3400634 - DNA, 17 bp, Homo sapiens
aatgcgtcttgtgaaat

SEQ ID NO: 3400635 - DNA, 21 bp, Homo sapiens
aatgcgtcttgtgaaattgtg

SEQ ID NO: 3400636 - DNA, 20 bp, Homo sapiens
aatgctgtgcaaacagtgta

SEQ ID NO: 3400637 - DNA, 20 bp, Homo sapiens
aatgcttatgtgttgcataa

SEQ ID NO: 3400638 - DNA, 21 bp, Homo sapiens
aatggaccggagagtgggggt

SEQ ID NO: 3400639 - DNA, 22 bp, Homo sapiens
aatggatatagaaaatcttagt

SEQ ID NO: 3400640 - DNA, 19 bp, Homo sapiens
aatggcacagcccaaagaa

SEQ ID NO: 3400641 - DNA, 14 bp, Homo sapiens
aatggtttgaatat

SEQ ID NO: 3400642 - DNA, 17 bp, Homo sapiens
aatggtttgaatataaa

SEQ ID NO: 3400643 - DNA, 19 bp, Homo sapiens
aatggtttgcaaggaagcc

SEQ ID NO: 3400644 - DNA, 20 bp, Homo sapiens
aatgtactaggatactgctg

SEQ ID NO: 3400645 - DNA, 18 bp, Homo sapiens
aatgtaggcacttttatt

SEQ ID NO: 3400646 - DNA, 20 bp, Homo sapiens
aatgtaggcacttttatttt

SEQ ID NO: 3400647 - DNA, 22 bp, Homo sapiens
aatgtaggcacttttattttca

SEQ ID NO: 3400648 - DNA, 13 bp, Homo sapiens
aatgtcagtatgt

SEQ ID NO: 3400649 - DNA, 16 bp, Homo sapiens
aatgtcagtatgtgga

SEQ ID NO: 3400650 - DNA, 22 bp, Homo sapiens
aatgtcagtatgtggaagtgtg

SEQ ID NO: 3400651 - DNA, 15 bp, Homo sapiens
aatgtcattatttga

SEQ ID NO: 3400652 - DNA, 15 bp, Homo sapiens
aatgtgatcatcttt

SEQ ID NO: 3400653 - DNA, 18 bp, Homo sapiens
aatgtgatcatctttgct

SEQ ID NO: 3400654 - DNA, 22 bp, Homo sapiens
aatgtgatctatgtttcatctt

SEQ ID NO: 3400655 - DNA, 10 bp, Homo sapiens
aatgtgtctg

SEQ ID NO: 3400656 - DNA, 20 bp, Homo sapiens
aatgtgtctgcaacatggat

SEQ ID NO: 3400657 - DNA, 23 bp, Homo sapiens
aatgtgtctgcaacatggattcc

SEQ ID NO: 3400658 - DNA, 17 bp, Homo sapiens
aatgtgtctgtgttgct

SEQ ID NO: 3400659 - DNA, 18 bp, Homo sapiens
aatgtgtctgtgttgctt

SEQ ID NO: 3400660 - DNA, 22 bp, Homo sapiens
aatgttaaatttgtaagtttca

SEQ ID NO: 3400661 - DNA, 17 bp, Homo sapiens
aatgttggtgcaattaa

SEQ ID NO: 3400662 - DNA, 16 bp, Homo sapiens
aatgtttatgagccag

SEQ ID NO: 3400663 - DNA, 18 bp, Homo sapiens
aatgtttatgagccagac

SEQ ID NO: 3400664 - DNA, 14 bp, Homo sapiens
aatgtttttgtgta

SEQ ID NO: 3400665 - DNA, 12 bp, Homo sapiens
aattaaagtatg

SEQ ID NO: 3400666 - DNA, 18 bp, Homo sapiens
aattaagggccagaaaaa

SEQ ID NO: 3400667 - DNA, 12 bp, Homo sapiens
aattaagtgttg

SEQ ID NO: 3400668 - DNA, 20 bp, Homo sapiens
aattaggtccacttcaatgt

SEQ ID NO: 3400669 - DNA, 18 bp, Homo sapiens
aattctttgacctgttgg

SEQ ID NO: 3400670 - DNA, 15 bp, Homo sapiens
aattctttgtttcct

SEQ ID NO: 3400671 - DNA, 18 bp, Homo sapiens
aattgaaatttaaaaata

SEQ ID NO: 3400672 - DNA, 21 bp, Homo sapiens
aattgaaatttaaaaataaag

SEQ ID NO: 3400673 - DNA, 15 bp, Homo sapiens
aattgatcagatgct

SEQ ID NO: 3400674 - DNA, 13 bp, Homo sapiens
aattgatcattca

SEQ ID NO: 3400675 - DNA, 14 bp, Homo sapiens
aattgcctttgtaa

SEQ ID NO: 3400676 - DNA, 16 bp, Homo sapiens
aattggtcatggtaga

SEQ ID NO: 3400677 - DNA, 16 bp, Homo sapiens
aattggttgtatataa

SEQ ID NO: 3400678 - DNA, 23 bp, Homo sapiens
aattgtgtagagtgtttgtgagc

SEQ ID NO: 3400679 - DNA, 21 bp, Homo sapiens
aattgttccttgcttttatag

SEQ ID NO: 3400680 - DNA, 22 bp, Homo sapiens
aattgttccttgcttttatagt

SEQ ID NO: 3400681 - DNA, 15 bp, Homo sapiens
aatttaaaaataaag

SEQ ID NO: 3400682 - DNA, 16 bp, Homo sapiens
agccattttgtgaatg

SEQ ID NO: 3400683 - DNA, 17 bp, Homo sapiens
agccattttgtgaatgg

SEQ ID NO: 3400684 - DNA, 13 bp, Homo sapiens
agcccaaagaagg

SEQ ID NO: 3400685 - DNA, 14 bp, Homo sapiens
agcccaaagaagga

SEQ ID NO: 3400686 - DNA, 19 bp, Homo sapiens
agcccaacacacactcggg

SEQ ID NO: 3400687 - DNA, 12 bp, Homo sapiens
agcccagaggag

SEQ ID NO: 3400688 - DNA, 13 bp, Homo sapiens
agcccagaggtaa

SEQ ID NO: 3400689 - DNA, 15 bp, Homo sapiens
agcccagaggtaaca

SEQ ID NO: 3400690 - DNA, 16 bp, Homo sapiens
agcccagaggtaacag

SEQ ID NO: 3400691 - DNA, 20 bp, Homo sapiens
agcccagaggtaacagaaca

SEQ ID NO: 3400692 - DNA, 23 bp, Homo sapiens
agcccaggagctcccctccccaa

SEQ ID NO: 3400693 - DNA, 20 bp, Homo sapiens
agcccaggccaggactctgc

SEQ ID NO: 3400694 - DNA, 23 bp, Homo sapiens
agcccaggccaggactctgcagc

SEQ ID NO: 3400695 - DNA, 23 bp, Homo sapiens
agccccaccccagggcagccagg

SEQ ID NO: 3400696 - DNA, 22 bp, Homo sapiens
agccctcacccctggttctcat

SEQ ID NO: 3400697 - DNA, 23 bp, Homo sapiens
agccctcacccctggttctcatc

SEQ ID NO: 3400698 - DNA, 18 bp, Homo sapiens
agccctgctgctgcctgc

SEQ ID NO: 3400699 - DNA, 16 bp, Homo sapiens
agcccttcggtcacct

SEQ ID NO: 3400700 - DNA, 17 bp, Homo sapiens
agcccttcggtcacctg

SEQ ID NO: 3400701 - DNA, 18 bp, Homo sapiens
agcccttcggtcacctgt

SEQ ID NO: 3400702 - DNA, 21 bp, Homo sapiens
agcccttgggggtcctcctcc

SEQ ID NO: 3400703 - DNA, 22 bp, Homo sapiens
agcccttgggggtcctcctcca

SEQ ID NO: 3400704 - DNA, 19 bp, Homo sapiens
agccgctctttgctccaga

SEQ ID NO: 3400705 - DNA, 14 bp, Homo sapiens
agcctaggccaggt

SEQ ID NO: 3400706 - DNA, 23 bp, Homo sapiens
agcctcagctctcagttgcagcc

SEQ ID NO: 3400707 - DNA, 17 bp, Homo sapiens
agcctcagtgacccatg

SEQ ID NO: 3400708 - DNA, 14 bp, Homo sapiens
agcctccctgcctc

SEQ ID NO: 3400709 - DNA, 17 bp, Homo sapiens
agcctgggaccagggca

SEQ ID NO: 3400710 - DNA, 14 bp, Homo sapiens
agccttatgtgtta

SEQ ID NO: 3400711 - DNA, 17 bp, Homo sapiens
agccttatgtgttacat

SEQ ID NO: 3400712 - DNA, 22 bp, Homo sapiens
agcctttaccctcctctatttc

SEQ ID NO: 3400713 - DNA, 23 bp, Homo sapiens
agcctttaccctcctctatttct

SEQ ID NO: 3400714 - DNA, 20 bp, Homo sapiens
agcgctcctgccgcagagct

SEQ ID NO: 3400715 - DNA, 22 bp, Homo sapiens
agcgctggccgggaccccgagc

SEQ ID NO: 3400716 - DNA, 16 bp, Homo sapiens
agcggacagtggcagg

SEQ ID NO: 3400717 - DNA, 14 bp, Homo sapiens
agctaataataaat

SEQ ID NO: 3400718 - DNA, 15 bp, Homo sapiens
agctaataataaatg

SEQ ID NO: 3400719 - DNA, 19 bp, Homo sapiens
agctaattctttgacctgt

SEQ ID NO: 3400720 - DNA, 13 bp, Homo sapiens
agctacagttgtc

SEQ ID NO: 3400721 - DNA, 16 bp, Homo sapiens
agctactaatgatgtt

SEQ ID NO: 3400722 - DNA, 15 bp, Homo sapiens
agctagaatttctgg

SEQ ID NO: 3400723 - DNA, 15 bp, Homo sapiens
agctagctatttcta

SEQ ID NO: 3400724 - DNA, 16 bp, Homo sapiens
agctagctatttctat

SEQ ID NO: 3400725 - DNA, 13 bp, Homo sapiens
agctagtgccaaa

SEQ ID NO: 3400726 - DNA, 22 bp, Homo sapiens
agctattagccaggatcatggt

SEQ ID NO: 3400727 - DNA, 18 bp, Homo sapiens
agctatttcctttgcgca

SEQ ID NO: 3400728 - DNA, 16 bp, Homo sapiens
agctatttctatgtat

SEQ ID NO: 3400729 - DNA, 22 bp, Homo sapiens
agctatttttatttgtttgtgc

SEQ ID NO: 3400730 - DNA, 15 bp, Homo sapiens
agctcaggcagctcg

SEQ ID NO: 3400731 - DNA, 20 bp, Homo sapiens
agctcccattctatgtgtca

SEQ ID NO: 3400732 - DNA, 20 bp, Homo sapiens
agctccccaatccctgaccc

SEQ ID NO: 3400733 - DNA, 14 bp, Homo sapiens
agctccctggagcc

SEQ ID NO: 3400734 - DNA, 12 bp, Homo sapiens
agctcctccctt

SEQ ID NO: 3400735 - DNA, 17 bp, Homo sapiens
agctctacacaacatgt

SEQ ID NO: 3400736 - DNA, 21 bp, Homo sapiens
agctctacacaacatgtatgt

SEQ ID NO: 3400737 - DNA, 17 bp, Homo sapiens
agctctcagttgcagcc

SEQ ID NO: 3400738 - DNA, 15 bp, Homo sapiens
agctctgagctgtca

SEQ ID NO: 3400739 - DNA, 16 bp, Homo sapiens
agctctgagctgtcaa

SEQ ID NO: 3400740 - DNA, 12 bp, Homo sapiens
agctcttgtttg

SEQ ID NO: 3400741 - DNA, 15 bp, Homo sapiens
agctgcctggacccg

SEQ ID NO: 3400742 - DNA, 14 bp, Homo sapiens
agctgctgaaggga

SEQ ID NO: 3400743 - DNA, 16 bp, Homo sapiens
agctggaagcactgct

SEQ ID NO: 3400744 - DNA, 21 bp, Homo sapiens
agctggtggtatctgagttga

SEQ ID NO: 3400745 - DNA, 11 bp, Homo sapiens
agctgtgtctc

SEQ ID NO: 3400746 - DNA, 13 bp, Homo sapiens
agctgtgtctctg

SEQ ID NO: 3400747 - DNA, 18 bp, Homo sapiens
agctgttgtacatttatg

SEQ ID NO: 3400748 - DNA, 18 bp, Homo sapiens
agcttaaagcttgatttg

SEQ ID NO: 3400749 - DNA, 18 bp, Homo sapiens
agcttatttagcacattt

SEQ ID NO: 3400750 - DNA, 13 bp, Homo sapiens
agcttcaaaaact

SEQ ID NO: 3400751 - DNA, 18 bp, Homo sapiens
agcttcctgtctgtttat

SEQ ID NO: 3400752 - DNA, 19 bp, Homo sapiens
agcttctcatcctgcaggc

SEQ ID NO: 3400753 - DNA, 14 bp, Homo sapiens
agcttggggaagac

SEQ ID NO: 3400754 - DNA, 15 bp, Homo sapiens
agctttatctttgtg

SEQ ID NO: 3400755 - DNA, 19 bp, Homo sapiens
agctttatctttgtgtaat

SEQ ID NO: 3400756 - DNA, 12 bp, Homo sapiens
agctttcttatt

SEQ ID NO: 3400757 - DNA, 14 bp, Homo sapiens
agctttttaattgt

SEQ ID NO: 3400758 - DNA, 15 bp, Homo sapiens
agctttttaattgtt

SEQ ID NO: 3400759 - DNA, 15 bp, Homo sapiens
agctttttgttccct

SEQ ID NO: 3400760 - DNA, 18 bp, Homo sapiens
agtaaacttgtgtattga

SEQ ID NO: 3400761 - DNA, 18 bp, Homo sapiens
agtaagcagagttctttg

SEQ ID NO: 3400762 - DNA, 22 bp, Homo sapiens
agtaagcagagttctttgcaag

SEQ ID NO: 3400763 - DNA, 22 bp, Homo sapiens
agtaataaaaagagatgaaata

SEQ ID NO: 3400764 - DNA, 14 bp, Homo sapiens
agtacaataaaagt

SEQ ID NO: 3400765 - DNA, 15 bp, Homo sapiens
agtacctcctgcccc

SEQ ID NO: 3400766 - DNA, 20 bp, Homo sapiens
agtagaaagacagagctggg

SEQ ID NO: 3400767 - DNA, 20 bp, Homo sapiens
agtagaaagacatctgcctg

SEQ ID NO: 3400768 - DNA, 22 bp, Homo sapiens
agtagggaaaatagggtccttg

SEQ ID NO: 3400769 - DNA, 14 bp, Homo sapiens
agtataacaaacta

SEQ ID NO: 3400770 - DNA, 17 bp, Homo sapiens
agtataacaattaaaat

SEQ ID NO: 3400771 - DNA, 15 bp, Homo sapiens
agtataatctcctct

SEQ ID NO: 3400772 - DNA, 15 bp, Homo sapiens
agtatatgaaatatt

SEQ ID NO: 3400773 - DNA, 21 bp, Homo sapiens
agtatatgaaatattttgaat

SEQ ID NO: 3400774 - DNA, 12 bp, Homo sapiens
agtatgcaaaat

SEQ ID NO: 3400775 - DNA, 15 bp, Homo sapiens
agtatgtggaagtgt

SEQ ID NO: 3400776 - DNA, 19 bp, Homo sapiens
agtatgtggaagtgtgggt

SEQ ID NO: 3400777 - DNA, 14 bp, Homo sapiens
agtattaactctgt

SEQ ID NO: 3400778 - DNA, 14 bp, Homo sapiens
agtatttgtgggga

SEQ ID NO: 3400779 - DNA, 22 bp, Homo sapiens
agtcaaagagagtttttaatag

SEQ ID NO: 3400780 - DNA, 15 bp, Homo sapiens
agtcaattcagtgat

SEQ ID NO: 3400781 - DNA, 20 bp, Homo sapiens
agtcactttttcccctgcaa

SEQ ID NO: 3400782 - DNA, 21 bp, Homo sapiens
agtcactttttcccctgcaat

SEQ ID NO: 3400783 - DNA, 15 bp, Homo sapiens
agtcagtttctacac

SEQ ID NO: 3400784 - DNA, 14 bp, Homo sapiens
agtcatgcataaat

SEQ ID NO: 3400785 - DNA, 16 bp, Homo sapiens
agtcatgcataaatat

SEQ ID NO: 3400786 - DNA, 13 bp, Homo sapiens
agtcatgtgagcc

SEQ ID NO: 3400787 - DNA, 22 bp, Homo sapiens
agtcattctagaccctatacat

SEQ ID NO: 3400788 - DNA, 17 bp, Homo sapiens
agtcattgtaacctcgt

SEQ ID NO: 3400789 - DNA, 16 bp, Homo sapiens
agtccctgtgttctgc

SEQ ID NO: 3400790 - DNA, 16 bp, Homo sapiens
agtcctgctttcctat

SEQ ID NO: 3400791 - DNA, 18 bp, Homo sapiens
agtccttttatctccttg

SEQ ID NO: 3400792 - DNA, 13 bp, Homo sapiens
agtctcaattttg

SEQ ID NO: 3400793 - DNA, 16 bp, Homo sapiens
agtctcaattttgtat

SEQ ID NO: 3400794 - DNA, 18 bp, Homo sapiens
agtctcaattttgtattt

SEQ ID NO: 3400795 - DNA, 17 bp, Homo sapiens
agtctggcaaacatgtg

SEQ ID NO: 3400796 - DNA, 21 bp, Homo sapiens
agtctggcaaacatgtgcaac

SEQ ID NO: 3400797 - DNA, 16 bp, Homo sapiens
ctcttaaaaaataaaa

SEQ ID NO: 3400798 - DNA, 22 bp, Homo sapiens
ctcttaagtgtaaataatataa

SEQ ID NO: 3400799 - DNA, 15 bp, Homo sapiens
ctcttagctcccctc

SEQ ID NO: 3400800 - DNA, 19 bp, Homo sapiens
ctcttagctcccctccaac

SEQ ID NO: 3400801 - DNA, 18 bp, Homo sapiens
ctcttcaaggactttctg

SEQ ID NO: 3400802 - DNA, 16 bp, Homo sapiens
ctcttcctggaataaa

SEQ ID NO: 3400803 - DNA, 15 bp, Homo sapiens
ctcttctcagccact

SEQ ID NO: 3400804 - DNA, 11 bp, Homo sapiens
ctcttctcatt

SEQ ID NO: 3400805 - DNA, 13 bp, Homo sapiens
ctctttgctccag

SEQ ID NO: 3400806 - DNA, 22 bp, Homo sapiens
ctctttgtccattattcatttt

SEQ ID NO: 3400807 - DNA, 18 bp, Homo sapiens
ctgaaaaaaaaaaaagaa

SEQ ID NO: 3400808 - DNA, 23 bp, Homo sapiens
ctgaaaacccaggccacaaatgt

SEQ ID NO: 3400809 - DNA, 19 bp, Homo sapiens
ctgaaagtcctgctttcct

SEQ ID NO: 3400810 - DNA, 18 bp, Homo sapiens
ctgaacatcctaaatatt

SEQ ID NO: 3400811 - DNA, 21 bp, Homo sapiens
ctgaacatttactacagtttt

SEQ ID NO: 3400812 - DNA, 19 bp, Homo sapiens
ctgaaccacctttgtctct

SEQ ID NO: 3400813 - DNA, 18 bp, Homo sapiens
ctgaactctgcaactgaa

SEQ ID NO: 3400814 - DNA, 19 bp, Homo sapiens
ctgaactgatgggtttctc

SEQ ID NO: 3400815 - DNA, 18 bp, Homo sapiens
ctgaaggcagcatgtata

SEQ ID NO: 3400816 - DNA, 19 bp, Homo sapiens
ctgaagtcttgcattgaat

SEQ ID NO: 3400817 - DNA, 21 bp, Homo sapiens
ctgaagtcttgcattgaattt

SEQ ID NO: 3400818 - DNA, 16 bp, Homo sapiens
ctgaatacttgaagta

SEQ ID NO: 3400819 - DNA, 20 bp, Homo sapiens
ctgaatgtcattatttgata

SEQ ID NO: 3400820 - DNA, 13 bp, Homo sapiens
ctgactccttaga

SEQ ID NO: 3400821 - DNA, 17 bp, Homo sapiens
ctgagaatgtaagaact

SEQ ID NO: 3400822 - DNA, 21 bp, Homo sapiens
ctgagatttcatctgctctcc

SEQ ID NO: 3400823 - DNA, 16 bp, Homo sapiens
ctgagccagtgtcagg

SEQ ID NO: 3400824 - DNA, 22 bp, Homo sapiens
ctgagccagtgtcaggaggaag

SEQ ID NO: 3400825 - DNA, 11 bp, Homo sapiens
ctgagctgtca

SEQ ID NO: 3400826 - DNA, 15 bp, Homo sapiens
ctgaggaagaacggg

SEQ ID NO: 3400827 - DNA, 18 bp, Homo sapiens
ctgaggaagaacggggct

SEQ ID NO: 3400828 - DNA, 23 bp, Homo sapiens
ctgaggaagagggactgttcttt

SEQ ID NO: 3400829 - DNA, 15 bp, Homo sapiens
ctgaggcacctgcat

SEQ ID NO: 3400830 - DNA, 15 bp, Homo sapiens
ctgagggattctatt

SEQ ID NO: 3400831 - DNA, 15 bp, Homo sapiens
ctgagtctggcaaac

SEQ ID NO: 3400832 - DNA, 20 bp, Homo sapiens
ctgagtctggcaaacatgtg

SEQ ID NO: 3400833 - DNA, 21 bp, Homo sapiens
ctgagtctggcaaacatgtgc

SEQ ID NO: 3400834 - DNA, 22 bp, Homo sapiens
ctgagtctggcaaacatgtgca

SEQ ID NO: 3400835 - DNA, 20 bp, Homo sapiens
cctgtgagaaaggaaaaatt

SEQ ID NO: 3400836 - DNA, 18 bp, Homo sapiens
ccttatgtgttacattat

SEQ ID NO: 3400837 - DNA, 14 bp, Homo sapiens
ccttcagccctcac

SEQ ID NO: 3400838 - DNA, 17 bp, Homo sapiens
ccttcccagaggggcct

SEQ ID NO: 3400839 - DNA, 20 bp, Homo sapiens
ccttcccagaggggcctgcc

SEQ ID NO: 3400840 - DNA, 18 bp, Homo sapiens
ccttccgcagtgtggcca

SEQ ID NO: 3400841 - DNA, 22 bp, Homo sapiens
ccttccgcagtgtggccaggct

SEQ ID NO: 3400842 - DNA, 22 bp, Homo sapiens
ccttcctttttattcagctaga

SEQ ID NO: 3400843 - DNA, 15 bp, Homo sapiens
ccttcggtcacctgt

SEQ ID NO: 3400844 - DNA, 14 bp, Homo sapiens
ccttctaggaagct

SEQ ID NO: 3400845 - DNA, 22 bp, Homo sapiens
ccttctccatggccctgccatg

SEQ ID NO: 3400846 - DNA, 16 bp, Homo sapiens
ccttctcctgcccttt

SEQ ID NO: 3400847 - DNA, 20 bp, Homo sapiens
ccttctttgataatgttaaa

SEQ ID NO: 3400848 - DNA, 16 bp, Homo sapiens
ccttgcccccctggcc

SEQ ID NO: 3400849 - DNA, 21 bp, Homo sapiens
ccttgcccccctggcctcccc

SEQ ID NO: 3400850 - DNA, 17 bp, Homo sapiens
ccttgctacctcaaggg

SEQ ID NO: 3400851 - DNA, 16 bp, Homo sapiens
ccttgcttttatagtt

SEQ ID NO: 3400852 - DNA, 17 bp, Homo sapiens
ccttgggccctctggtt

SEQ ID NO: 3400853 - DNA, 21 bp, Homo sapiens
ccttgggggtcctcctccagg

SEQ ID NO: 3400854 - DNA, 22 bp, Homo sapiens
ccttgggggtcctcctccaggg

SEQ ID NO: 3400855 - DNA, 14 bp, Homo sapiens
ccttgtccccatga

SEQ ID NO: 3400856 - DNA, 16 bp, Homo sapiens
ccttgtggcctatgaa

SEQ ID NO: 3400857 - DNA, 20 bp, Homo sapiens
ccttgtttctttctgaagtg

SEQ ID NO: 3400858 - DNA, 22 bp, Homo sapiens
cctttaaatttaggtaaataaa

SEQ ID NO: 3400859 - DNA, 20 bp, Homo sapiens
cctttctcccctgcccccag

SEQ ID NO: 3400860 - DNA, 19 bp, Homo sapiens
cctttgagacagtttctta

SEQ ID NO: 3400861 - DNA, 22 bp, Homo sapiens
cctttgtaatatgagaatgtat

SEQ ID NO: 3400862 - DNA, 14 bp, Homo sapiens
cctttgtcccagaa

SEQ ID NO: 3400863 - DNA, 21 bp, Homo sapiens
ccttttccatttgaaagaaag

SEQ ID NO: 3400864 - DNA, 19 bp, Homo sapiens
ccttttttaagatttttct

SEQ ID NO: 3400865 - DNA, 20 bp, Homo sapiens
ccttttttaagatttttctc

SEQ ID NO: 3400866 - DNA, 14 bp, Homo sapiens
cgaagaaacaaaaa

SEQ ID NO: 3400867 - DNA, 16 bp, Homo sapiens
cgagaactttcatttt

SEQ ID NO: 3400868 - DNA, 14 bp, Homo sapiens
cgagactgcaatgt

SEQ ID NO: 3400869 - DNA, 13 bp, Homo sapiens
cgagcctggctcc

SEQ ID NO: 3400870 - DNA, 15 bp, Homo sapiens
cgaggcccccgacca

SEQ ID NO: 3400871 - DNA, 22 bp, Homo sapiens
cgagtgcccctgtcccacctgg

SEQ ID NO: 3400872 - DNA, 23 bp, Homo sapiens
cgagtgcccctgtcccacctggc

SEQ ID NO: 3400873 - DNA, 21 bp, Homo sapiens
cgcagcttcctgtctgtttat

SEQ ID NO: 3400874 - DNA, 21 bp, Homo sapiens
cgctgggaggaacctgaacct

SEQ ID NO: 3400875 - DNA, 13 bp, Homo sapiens
cggacaaagttca

SEQ ID NO: 3400876 - DNA, 13 bp, Homo sapiens
cggaccagcctgg

SEQ ID NO: 3400877 - DNA, 17 bp, Homo sapiens
cggaccagcctggccca

SEQ ID NO: 3400878 - DNA, 23 bp, Homo sapiens
ctatttctgagaaggtccttaat

SEQ ID NO: 3400879 - DNA, 22 bp, Homo sapiens
ctatttgccatgggcttcactg

SEQ ID NO: 3400880 - DNA, 13 bp, Homo sapiens
ctcaaaggccaga

SEQ ID NO: 3400881 - DNA, 11 bp, Homo sapiens
ctcaatatttt

SEQ ID NO: 3400882 - DNA, 19 bp, Homo sapiens
ctcaatattttccatgaaa

SEQ ID NO: 3400883 - DNA, 16 bp, Homo sapiens
ctcaatttactaattt

SEQ ID NO: 3400884 - DNA, 14 bp, Homo sapiens
ctcacactgagaat

SEQ ID NO: 3400885 - DNA, 20 bp, Homo sapiens
ctcacactgagaatgtaaga

SEQ ID NO: 3400886 - DNA, 18 bp, Homo sapiens
ctcacactgtttttcata

SEQ ID NO: 3400887 - DNA, 19 bp, Homo sapiens
ctcacccctggttctcatc

SEQ ID NO: 3400888 - DNA, 21 bp, Homo sapiens
ctcacccctggttctcatctt

SEQ ID NO: 3400889 - DNA, 14 bp, Homo sapiens
ctcactaaaaatat

SEQ ID NO: 3400890 - DNA, 15 bp, Homo sapiens
ctcactagctcccca

SEQ ID NO: 3400891 - DNA, 23 bp, Homo sapiens
ctcactagctccccaatccctga

SEQ ID NO: 3400892 - DNA, 16 bp, Homo sapiens
ctcactttccaccaag

SEQ ID NO: 3400893 - DNA, 22 bp, Homo sapiens
ctcactttccaccaagtgtcta

SEQ ID NO: 3400894 - DNA, 12 bp, Homo sapiens
ctcagctccctg

SEQ ID NO: 3400895 - DNA, 13 bp, Homo sapiens
ctcagctccctgc

SEQ ID NO: 3400896 - DNA, 22 bp, Homo sapiens
ctcagctccctgcctgtttccc

SEQ ID NO: 3400897 - DNA, 20 bp, Homo sapiens
ctcagctctcagttgcagcc

SEQ ID NO: 3400898 - DNA, 17 bp, Homo sapiens
ctcagtcactttttccc

SEQ ID NO: 3400899 - DNA, 16 bp, Homo sapiens
ctcagtcatgcataaa

SEQ ID NO: 3400900 - DNA, 23 bp, Homo sapiens
ctcagtcatgcataaatatgcag

SEQ ID NO: 3400901 - DNA, 13 bp, Homo sapiens
ctcagtgacccat

SEQ ID NO: 3400902 - DNA, 13 bp, Homo sapiens
ctcatcctgcagg

SEQ ID NO: 3400903 - DNA, 13 bp, Homo sapiens
ctcatctgtaaac

SEQ ID NO: 3400904 - DNA, 20 bp, Homo sapiens
ctcatcttggccctcctcag

SEQ ID NO: 3400905 - DNA, 13 bp, Homo sapiens
ctcatctttcttg

SEQ ID NO: 3400906 - DNA, 23 bp, Homo sapiens
ctcatgatagaaggctatgggga

SEQ ID NO: 3400907 - DNA, 18 bp, Homo sapiens
ctcatgcaaactgcttta

SEQ ID NO: 3400908 - DNA, 18 bp, Homo sapiens
ctcattaaactgattcca

SEQ ID NO: 3400909 - DNA, 16 bp, Homo sapiens
ctcattctgcattaat

SEQ ID NO: 3400910 - DNA, 19 bp, Homo sapiens
ctcatttcacccctccctt

SEQ ID NO: 3400911 - DNA, 13 bp, Homo sapiens
ctccaaaccactt

SEQ ID NO: 3400912 - DNA, 17 bp, Homo sapiens
ctccaaaccctcgaggc

SEQ ID NO: 3400913 - DNA, 15 bp, Homo sapiens
ctccaaaccttcaca

SEQ ID NO: 3400914 - DNA, 18 bp, Homo sapiens
ctccaaccccccagcact

SEQ ID NO: 3400915 - DNA, 21 bp, Homo sapiens
ctccaaccccccagcactgag

SEQ ID NO: 3400916 - DNA, 18 bp, Homo sapiens
ctccaacctggggggcag

SEQ ID NO: 3400917 - DNA, 18 bp, Homo sapiens
ctccaattctgaaatact

SEQ ID NO: 3400918 - DNA, 13 bp, Homo sapiens
ctccacacctgcg

SEQ ID NO: 3400919 - DNA, 13 bp, Homo sapiens
attttaggaaagg

SEQ ID NO: 3400920 - DNA, 17 bp, Homo sapiens
attttagtattaactct

SEQ ID NO: 3400921 - DNA, 20 bp, Homo sapiens
attttatctacccagtcatg

SEQ ID NO: 3400922 - DNA, 23 bp, Homo sapiens
attttatctttgattctccttca

SEQ ID NO: 3400923 - DNA, 20 bp, Homo sapiens
attttatgccttttatttct

SEQ ID NO: 3400924 - DNA, 22 bp, Homo sapiens
attttcagcatcaaacatgaaa

SEQ ID NO: 3400925 - DNA, 14 bp, Homo sapiens
attttcattgtgat

SEQ ID NO: 3400926 - DNA, 15 bp, Homo sapiens
attttcattgtgatt

SEQ ID NO: 3400927 - DNA, 13 bp, Homo sapiens
attttccagcctt

SEQ ID NO: 3400928 - DNA, 15 bp, Homo sapiens
attttccagccttat

SEQ ID NO: 3400929 - DNA, 17 bp, Homo sapiens
attttccagccttatgt

SEQ ID NO: 3400930 - DNA, 21 bp, Homo sapiens
attttccagccttatgtgtta

SEQ ID NO: 3400931 - DNA, 20 bp, Homo sapiens
attttctgcccaactttcat

SEQ ID NO: 3400932 - DNA, 12 bp, Homo sapiens
attttgaatgtg

SEQ ID NO: 3400933 - DNA, 22 bp, Homo sapiens
attttggaagaagttttttact

SEQ ID NO: 3400934 - DNA, 12 bp, Homo sapiens
attttgtgaatg

SEQ ID NO: 3400935 - DNA, 13 bp, Homo sapiens
attttgtgaatgg

SEQ ID NO: 3400936 - DNA, 13 bp, Homo sapiens
attttgtgcaaca

SEQ ID NO: 3400937 - DNA, 12 bp, Homo sapiens
atttttaaaagt

SEQ ID NO: 3400938 - DNA, 21 bp, Homo sapiens
atttttaaaagtatacatgtc

SEQ ID NO: 3400939 - DNA, 24 bp, Homo sapiens
atttttaaaatcataacattgatt

SEQ ID NO: 3400940 - DNA, 19 bp, Homo sapiens
atttttaaaggacaaacag

SEQ ID NO: 3400941 - DNA, 21 bp, Homo sapiens
atttttaaaggacaaacagtg

SEQ ID NO: 3400942 - DNA, 19 bp, Homo sapiens
atttttagtttaaaatctt

SEQ ID NO: 3400943 - DNA, 23 bp, Homo sapiens
atttttagtttaaaatcttgcat

SEQ ID NO: 3400944 - DNA, 19 bp, Homo sapiens
atttttatattagttgctt

SEQ ID NO: 3400945 - DNA, 20 bp, Homo sapiens
atttttatattagttgcttt

SEQ ID NO: 3400946 - DNA, 21 bp, Homo sapiens
atttttctcaaagttttgaaa

SEQ ID NO: 3400947 - DNA, 14 bp, Homo sapiens
atttttgaatctat

SEQ ID NO: 3400948 - DNA, 13 bp, Homo sapiens
attttttaaacca

SEQ ID NO: 3400949 - DNA, 14 bp, Homo sapiens
attttttcatttca

SEQ ID NO: 3400950 - DNA, 14 bp, Homo sapiens
atttttttaaacaa

SEQ ID NO: 3400951 - DNA, 14 bp, Homo sapiens
atttttttcagtat

SEQ ID NO: 3400952 - DNA, 20 bp, Homo sapiens
caaaaacatgtttctgcctt

SEQ ID NO: 3400953 - DNA, 23 bp, Homo sapiens
caaaagctgtgtctctgtatata

SEQ ID NO: 3400954 - DNA, 14 bp, Homo sapiens
caaaagtgacagat

SEQ ID NO: 3400955 - DNA, 20 bp, Homo sapiens
caaaagtgacagatgttatt

SEQ ID NO: 3400956 - DNA, 22 bp, Homo sapiens
caaaagtgacagatgttatttt

SEQ ID NO: 3400957 - DNA, 18 bp, Homo sapiens
caaaataaaaagcctcag

SEQ ID NO: 3400958 - DNA, 20 bp, Homo sapiens
caaaataatctatattaaat

SEQ ID NO: 3400959 - DNA, 18 bp, Homo sapiens
caaaatattcttctttga

SEQ ID NO: 3400960 - DNA, 21 bp, Homo sapiens
caaaatattcttctttgatag

SEQ ID NO: 3400961 - DNA, 19 bp, Homo sapiens
caaaatgtacttaaatgag

SEQ ID NO: 3400962 - DNA, 14 bp, Homo sapiens
caaacaaaatttct

SEQ ID NO: 3400963 - DNA, 18 bp, Homo sapiens
caaacactgtgatgttgg

SEQ ID NO: 3400964 - DNA, 20 bp, Homo sapiens
caaacagtgaatttaagcat

SEQ ID NO: 3400965 - DNA, 15 bp, Homo sapiens
caaacatgaaaacat

SEQ ID NO: 3400966 - DNA, 18 bp, Homo sapiens
caaacatgaaaacattga

SEQ ID NO: 3400967 - DNA, 19 bp, Homo sapiens
caaacatgaaaacattgat

SEQ ID NO: 3400968 - DNA, 19 bp, Homo sapiens
caaaccactttttgcagct

SEQ ID NO: 3400969 - DNA, 13 bp, Homo sapiens
caaactcatcttg

SEQ ID NO: 3400970 - DNA, 13 bp, Homo sapiens
caaactgctttat

SEQ ID NO: 3400971 - DNA, 15 bp, Homo sapiens
caaactgctttattt

SEQ ID NO: 3400972 - DNA, 13 bp, Homo sapiens
caaagagactggg

SEQ ID NO: 3400973 - DNA, 18 bp, Homo sapiens
caaaggccagacctgcag

SEQ ID NO: 3400974 - DNA, 20 bp, Homo sapiens
caaaggccagacctgcagac

SEQ ID NO: 3400975 - DNA, 23 bp, Homo sapiens
caaaggtctatctactaaactag

SEQ ID NO: 3400976 - DNA, 16 bp, Homo sapiens
caaagtgtcagtgttg

SEQ ID NO: 3400977 - DNA, 14 bp, Homo sapiens
caaagttttgaaaa

SEQ ID NO: 3400978 - DNA, 17 bp, Homo sapiens
caaagttttgaaaagct

SEQ ID NO: 3400979 - DNA, 20 bp, Homo sapiens
caaagttttgaaaagctatt

SEQ ID NO: 3400980 - DNA, 19 bp, Homo sapiens
caaataacagctttcttat

SEQ ID NO: 3400981 - DNA, 17 bp, Homo sapiens
caaataataaagcaatc

SEQ ID NO: 3400982 - DNA, 15 bp, Homo sapiens
caaatatcaaaagga

SEQ ID NO: 3400983 - DNA, 19 bp, Homo sapiens
caaatatcaaaaggaagat

SEQ ID NO: 3400984 - DNA, 16 bp, Homo sapiens
caaatgagatttcttt

SEQ ID NO: 3400985 - DNA, 20 bp, Homo sapiens
caaatgagatttctttgaat

SEQ ID NO: 3400986 - DNA, 16 bp, Homo sapiens
caaatgcattcatgtt

SEQ ID NO: 3400987 - DNA, 19 bp, Homo sapiens
caaatgcattcatgtttta

SEQ ID NO: 3400988 - DNA, 21 bp, Homo sapiens
caaatgctgtgcaaacagtgt

SEQ ID NO: 3400989 - DNA, 22 bp, Homo sapiens
caaatgctgtgcaaacagtgta

SEQ ID NO: 3400990 - DNA, 14 bp, Homo sapiens
caaatgtgtcccag

SEQ ID NO: 3400991 - DNA, 23 bp, Homo sapiens
caaattcctttcagagttttact

SEQ ID NO: 3400992 - DNA, 20 bp, Homo sapiens
caaatttagccaataaagaa

SEQ ID NO: 3400993 - DNA, 12 bp, Homo sapiens
caacaaacactg

SEQ ID NO: 3400994 - DNA, 21 bp, Homo sapiens
caacaacatgtataatatttt

SEQ ID NO: 3400995 - DNA, 13 bp, Homo sapiens
caacatcttttct

SEQ ID NO: 3400996 - DNA, 18 bp, Homo sapiens
caaccccccagcactgag

SEQ ID NO: 3400997 - DNA, 19 bp, Homo sapiens
caaccccccagcactgagg

SEQ ID NO: 3400998 - DNA, 20 bp, Homo sapiens
caacctggggggcagtggtg

SEQ ID NO: 3400999 - DNA, 14 bp, Homo sapiens
caactcttgtattg

SEQ ID NO: 3401000 - DNA, 16 bp, Homo sapiens
caactgaatacttgaa

SEQ ID NO: 3401001 - DNA, 16 bp, Homo sapiens
caagaaaacaggcact

SEQ ID NO: 3401002 - DNA, 23 bp, Homo sapiens
caagaaaacaggcactgccctgg

SEQ ID NO: 3401003 - DNA, 15 bp, Homo sapiens
caagaatggtggctt

SEQ ID NO: 3401004 - DNA, 13 bp, Homo sapiens
caagacaagctcc

SEQ ID NO: 3401005 - DNA, 20 bp, Homo sapiens
caagatccaaatgctgtgca

SEQ ID NO: 3401006 - DNA, 22 bp, Homo sapiens
caagatccaaatgctgtgcaaa

SEQ ID NO: 3401007 - DNA, 14 bp, Homo sapiens
caagcatttttcca

SEQ ID NO: 3401008 - DNA, 16 bp, Homo sapiens
caagctaatctgcctg

SEQ ID NO: 3401009 - DNA, 14 bp, Homo sapiens
caagctccctggag

SEQ ID NO: 3401010 - DNA, 16 bp, Homo sapiens
caagctccctggagcc

SEQ ID NO: 3401011 - DNA, 20 bp, Homo sapiens
caagctccctggagccctgt

SEQ ID NO: 3401012 - DNA, 13 bp, Homo sapiens
caagctcctccct

SEQ ID NO: 3401013 - DNA, 14 bp, Homo sapiens
caagctcctccctt

SEQ ID NO: 3401014 - DNA, 16 bp, Homo sapiens
caagctcctcccttga

SEQ ID NO: 3401015 - DNA, 13 bp, Homo sapiens
caagcttctttta

SEQ ID NO: 3401016 - DNA, 17 bp, Homo sapiens
caaggaacctaattgaa

SEQ ID NO: 3401017 - DNA, 19 bp, Homo sapiens
caaggaacctaattgaaat

SEQ ID NO: 3401018 - DNA, 15 bp, Homo sapiens
caagggggactgtct

SEQ ID NO: 3401019 - DNA, 22 bp, Homo sapiens
caaggtaactgtactgggccat

SEQ ID NO: 3401020 - DNA, 14 bp, Homo sapiens
caagtaagaagaca

SEQ ID NO: 3401021 - DNA, 20 bp, Homo sapiens
caagtatgaagtataaatct

SEQ ID NO: 3401022 - DNA, 10 bp, Homo sapiens
caagtgagtg

SEQ ID NO: 3401023 - DNA, 19 bp, Homo sapiens
caagtggaccttgagacca

SEQ ID NO: 3401024 - DNA, 19 bp, Homo sapiens
caagtgggagatgaaaacc

SEQ ID NO: 3401025 - DNA, 22 bp, Homo sapiens
caagttaaggtatctggtatct

SEQ ID NO: 3401026 - DNA, 13 bp, Homo sapiens
caataaagaaatt

SEQ ID NO: 3401027 - DNA, 21 bp, Homo sapiens
caatagtgtcctatgcaataa

SEQ ID NO: 3401028 - DNA, 22 bp, Homo sapiens
caatagtgtcctatgcaataaa

SEQ ID NO: 3401029 - DNA, 20 bp, Homo sapiens
caatatatagctggcaagaa

SEQ ID NO: 3401030 - DNA, 16 bp, Homo sapiens
caatattttccatgaa

SEQ ID NO: 3401031 - DNA, 19 bp, Homo sapiens
caatattttccatgaaaat

SEQ ID NO: 3401032 - DNA, 17 bp, Homo sapiens
ccaggactgggccactt

SEQ ID NO: 3401033 - DNA, 17 bp, Homo sapiens
ccaggcttgcctgcagg

SEQ ID NO: 3401034 - DNA, 18 bp, Homo sapiens
ccagggagagcccaggag

SEQ ID NO: 3401035 - DNA, 19 bp, Homo sapiens
ccagggagagcccaggagc

SEQ ID NO: 3401036 - DNA, 18 bp, Homo sapiens
ccagggctggactgaggc

SEQ ID NO: 3401037 - DNA, 19 bp, Homo sapiens
ccagggctggactgaggcc

SEQ ID NO: 3401038 - DNA, 22 bp, Homo sapiens
ccagggctggactgaggcctga

SEQ ID NO: 3401039 - DNA, 21 bp, Homo sapiens
ccagggcttacggccctggcc

SEQ ID NO: 3401040 - DNA, 18 bp, Homo sapiens
ccaggtgcaaccagggag

SEQ ID NO: 3401041 - DNA, 12 bp, Homo sapiens
ccagtctgatta

SEQ ID NO: 3401042 - DNA, 20 bp, Homo sapiens
ccagtgatctcgactccccc

SEQ ID NO: 3401043 - DNA, 19 bp, Homo sapiens
ccagttaaaatgtgtttct

SEQ ID NO: 3401044 - DNA, 22 bp, Homo sapiens
ccagttgaactgcaggaagaga

SEQ ID NO: 3401045 - DNA, 17 bp, Homo sapiens
ccatagagtaatgatgt

SEQ ID NO: 3401046 - DNA, 18 bp, Homo sapiens
ccatagagtaatgatgta

SEQ ID NO: 3401047 - DNA, 14 bp, Homo sapiens
ccatatatgctgta

SEQ ID NO: 3401048 - DNA, 23 bp, Homo sapiens
ccatatatgctgtatttctttgt

SEQ ID NO: 3401049 - DNA, 15 bp, Homo sapiens
ccatcctgccacagg

SEQ ID NO: 3401050 - DNA, 12 bp, Homo sapiens
ccatgaagctgg

SEQ ID NO: 3401051 - DNA, 21 bp, Homo sapiens
ccatgaagctggaagcactgc

SEQ ID NO: 3401052 - DNA, 17 bp, Homo sapiens
ccatgatgcatggagtg

SEQ ID NO: 3401053 - DNA, 16 bp, Homo sapiens
ccatggtgatggtgta

SEQ ID NO: 3401054 - DNA, 20 bp, Homo sapiens
ccatgttgtgcctccctggt

SEQ ID NO: 3401055 - DNA, 11 bp, Homo sapiens
ccattattcat

SEQ ID NO: 3401056 - DNA, 13 bp, Homo sapiens
ccattggtgttga

SEQ ID NO: 3401057 - DNA, 17 bp, Homo sapiens
ccatttcatctatttct

SEQ ID NO: 3401058 - DNA, 15 bp, Homo sapiens
ccatttgaaagaaag

SEQ ID NO: 3401059 - DNA, 14 bp, Homo sapiens
ccattttgtgaatg

SEQ ID NO: 3401060 - DNA, 16 bp, Homo sapiens
cccaatccatgcttca

SEQ ID NO: 3401061 - DNA, 15 bp, Homo sapiens
cccaccgcccactct

SEQ ID NO: 3401062 - DNA, 15 bp, Homo sapiens
cccacttcaggcact

SEQ ID NO: 3401063 - DNA, 12 bp, Homo sapiens
cccacttctgca

SEQ ID NO: 3401064 - DNA, 14 bp, Homo sapiens
cccagaaaaaaagc

SEQ ID NO: 3401065 - DNA, 18 bp, Homo sapiens
cccagaatgcctcctgca

SEQ ID NO: 3401066 - DNA, 15 bp, Homo sapiens
cccagaggggcctgc

SEQ ID NO: 3401067 - DNA, 17 bp, Homo sapiens
cccagaggggcctgcca

SEQ ID NO: 3401068 - DNA, 21 bp, Homo sapiens
cccagaggggcctgccacctg

SEQ ID NO: 3401069 - DNA, 23 bp, Homo sapiens
cccagaggggcctgccacctgga

SEQ ID NO: 3401070 - DNA, 13 bp, Homo sapiens
cccagaggtaaca

SEQ ID NO: 3401071 - DNA, 18 bp, Homo sapiens
cccagaggtaacagaaca

SEQ ID NO: 3401072 - DNA, 22 bp, Homo sapiens
cccagaggtaacagaacagctt

SEQ ID NO: 3401073 - DNA, 20 bp, Homo sapiens
cccagattggctcacactga

SEQ ID NO: 3401074 - DNA, 13 bp, Homo sapiens
cccagcactgagg

SEQ ID NO: 3401075 - DNA, 14 bp, Homo sapiens
cccagcactgagga

SEQ ID NO: 3401076 - DNA, 15 bp, Homo sapiens
cccagcactgaggaa

SEQ ID NO: 3401077 - DNA, 12 bp, Homo sapiens
cccaggagctcc

SEQ ID NO: 3401078 - DNA, 20 bp, Homo sapiens
cccaggagctcccctcccca

SEQ ID NO: 3401079 - DNA, 19 bp, Homo sapiens
cccaggccaggactctgca

SEQ ID NO: 3401080 - DNA, 20 bp, Homo sapiens
cccaggccaggactctgcag

SEQ ID NO: 3401081 - DNA, 21 bp, Homo sapiens
cccaggccaggactctgcagc

SEQ ID NO: 3401082 - DNA, 22 bp, Homo sapiens
cccagggcttacggccctggcc

SEQ ID NO: 3401083 - DNA, 11 bp, Homo sapiens
cccatataaaa

SEQ ID NO: 3401084 - DNA, 17 bp, Homo sapiens
cccatgggctcccactg

SEQ ID NO: 3401085 - DNA, 15 bp, Homo sapiens
ccccaccccagggca

SEQ ID NO: 3401086 - DNA, 17 bp, Homo sapiens
ccccaccgccgtggagt

SEQ ID NO: 3401087 - DNA, 15 bp, Homo sapiens
ccccagatggctttg

SEQ ID NO: 3401088 - DNA, 13 bp, Homo sapiens
ccccagcactgag

SEQ ID NO: 3401089 - DNA, 15 bp, Homo sapiens
ccccagggcagccag

SEQ ID NO: 3401090 - DNA, 22 bp, Homo sapiens
ccccagggcagccagggagagc

SEQ ID NO: 3401091 - DNA, 19 bp, Homo sapiens
ccccagtgatctcgactcc

SEQ ID NO: 3401092 - DNA, 15 bp, Homo sapiens
ccccatgggctccca

SEQ ID NO: 3401093 - DNA, 15 bp, Homo sapiens
ccccatgttctgtcc

SEQ ID NO: 3401094 - DNA, 13 bp, Homo sapiens
ccccatttgattt

SEQ ID NO: 3401095 - DNA, 15 bp, Homo sapiens
cccccagcactgagg

SEQ ID NO: 3401096 - DNA, 18 bp, Homo sapiens
cccccagcactgaggaag

SEQ ID NO: 3401097 - DNA, 17 bp, Homo sapiens
cccccaggactgggcca

SEQ ID NO: 3401098 - DNA, 13 bp, Homo sapiens
ccccccagcactg

SEQ ID NO: 3401099 - DNA, 12 bp, Homo sapiens
ccccctgcagga

SEQ ID NO: 3401100 - DNA, 12 bp, Homo sapiens
cccctccctttc

SEQ ID NO: 3401101 - DNA, 16 bp, Homo sapiens
cccctcgacagctctc

SEQ ID NO: 3401102 - DNA, 16 bp, Homo sapiens
cccctgcaatgcgtct

SEQ ID NO: 3401103 - DNA, 14 bp, Homo sapiens
cccctgcaggaagg

SEQ ID NO: 3401104 - DNA, 19 bp, Homo sapiens
cccctgcaggaaggagctg

SEQ ID NO: 3401105 - DNA, 20 bp, Homo sapiens
cccctgcaggaaggagctgc

SEQ ID NO: 3401106 - DNA, 21 bp, Homo sapiens
cccctgcaggaaggagctgcc

SEQ ID NO: 3401107 - DNA, 17 bp, Homo sapiens
cccctgccacctcctgc

SEQ ID NO: 3401108 - DNA, 16 bp, Homo sapiens
cccctgcccccaggac

SEQ ID NO: 3401109 - DNA, 19 bp, Homo sapiens
cccctgcccccaggactgg

SEQ ID NO: 3401110 - DNA, 23 bp, Homo sapiens
cccctgcccccaggactgggcca

SEQ ID NO: 3401111 - DNA, 15 bp, Homo sapiens
cccctgccccctgca

SEQ ID NO: 3401112 - DNA, 13 bp, Homo sapiens
ccccttctctcat

SEQ ID NO: 3401113 - DNA, 16 bp, Homo sapiens
ccccttctctcatctc

SEQ ID NO: 3401114 - DNA, 22 bp, Homo sapiens
cccgcagtcgtcccaggctgcc

SEQ ID NO: 3401115 - DNA, 13 bp, Homo sapiens
ccctcacccctgg

SEQ ID NO: 3401116 - DNA, 20 bp, Homo sapiens
ccctcacccctggttctcat

SEQ ID NO: 3401117 - DNA, 22 bp, Homo sapiens
ccctcacccctggttctcatct

SEQ ID NO: 3401118 - DNA, 15 bp, Homo sapiens
ccctccacacctgcg

SEQ ID NO: 3401119 - DNA, 17 bp, Homo sapiens
ccctccacacctgcggc

SEQ ID NO: 3401120 - DNA, 15 bp, Homo sapiens
ccctcccactttgct

SEQ ID NO: 3401121 - DNA, 16 bp, Homo sapiens
ccctccccgccctttt

SEQ ID NO: 3401122 - DNA, 15 bp, Homo sapiens
ccctcctcagctccc

SEQ ID NO: 3401123 - DNA, 15 bp, Homo sapiens
ccctcgacagctctc

SEQ ID NO: 3401124 - DNA, 20 bp, Homo sapiens
ccctctagaggctgcctggg

SEQ ID NO: 3401125 - DNA, 12 bp, Homo sapiens
ccctctcctgtc

SEQ ID NO: 3401126 - DNA, 18 bp, Homo sapiens
ccctctgccccaccctca

SEQ ID NO: 3401127 - DNA, 23 bp, Homo sapiens
ccctgagttgcaccattctttct

SEQ ID NO: 3401128 - DNA, 14 bp, Homo sapiens
ccctgcaatgcgtc

SEQ ID NO: 3401129 - DNA, 18 bp, Homo sapiens
ccctgcaggaaggagctg

SEQ ID NO: 3401130 - DNA, 20 bp, Homo sapiens
ccctgcaggaaggagctgcc

SEQ ID NO: 3401131 - DNA, 22 bp, Homo sapiens
ccctgcaggaaggagctgcctg

SEQ ID NO: 3401132 - DNA, 18 bp, Homo sapiens
ccctgccacctcctgcct

SEQ ID NO: 3401133 - DNA, 15 bp, Homo sapiens
ccctgccccctgcag

SEQ ID NO: 3401134 - DNA, 17 bp, Homo sapiens
ccctgccccctgcagga

SEQ ID NO: 3401135 - DNA, 18 bp, Homo sapiens
ccctgctgctgcctgcct

SEQ ID NO: 3401136 - DNA, 22 bp, Homo sapiens
ccctgctttgcctcgaaagtgt

SEQ ID NO: 3401137 - DNA, 19 bp, Homo sapiens
ccctggccacagaccccca

SEQ ID NO: 3401138 - DNA, 21 bp, Homo sapiens
ccctggccttgggccctctgg

SEQ ID NO: 3401139 - DNA, 24 bp, Homo sapiens
ccctgggaggcgggcgcactgcct

SEQ ID NO: 3401140 - DNA, 22 bp, Homo sapiens
ccctggtgagagggccgggcag

SEQ ID NO: 3401141 - DNA, 20 bp, Homo sapiens
ccctggtggccctctcccct

SEQ ID NO: 3401142 - DNA, 14 bp, Homo sapiens
ccctggttctcatc

SEQ ID NO: 3401143 - DNA, 15 bp, Homo sapiens
ccctggttctcatct

SEQ ID NO: 3401144 - DNA, 14 bp, Homo sapiens
ccctgtcccacctg

SEQ ID NO: 3401145 - DNA, 20 bp, Homo sapiens
ctggtggccctctcccctgc

SEQ ID NO: 3401146 - DNA, 15 bp, Homo sapiens
ctggttctcatcttt

SEQ ID NO: 3401147 - DNA, 16 bp, Homo sapiens
ctggttctcatctttc

SEQ ID NO: 3401148 - DNA, 13 bp, Homo sapiens
ctgtaaaagtgtc

SEQ ID NO: 3401149 - DNA, 14 bp, Homo sapiens
ctgtaaaagtgtct

SEQ ID NO: 3401150 - DNA, 15 bp, Homo sapiens
ctgtaaaatagtttt

SEQ ID NO: 3401151 - DNA, 12 bp, Homo sapiens
ctgtaaactttt

SEQ ID NO: 3401152 - DNA, 16 bp, Homo sapiens
ctgtaagttttgaatt

SEQ ID NO: 3401153 - DNA, 12 bp, Homo sapiens
ctgtacatagtc

SEQ ID NO: 3401154 - DNA, 23 bp, Homo sapiens
ctgtaccatgtgctacaggggcc

SEQ ID NO: 3401155 - DNA, 16 bp, Homo sapiens
ctgtactgggccatgt

SEQ ID NO: 3401156 - DNA, 16 bp, Homo sapiens
ctgtactttgtgttta

SEQ ID NO: 3401157 - DNA, 16 bp, Homo sapiens
ctgtataaataggaga

SEQ ID NO: 3401158 - DNA, 20 bp, Homo sapiens
ctgtataaataggagaggat

SEQ ID NO: 3401159 - DNA, 15 bp, Homo sapiens
ctgtatttcagtatt

SEQ ID NO: 3401160 - DNA, 18 bp, Homo sapiens
ctgtatttcagtattttc

SEQ ID NO: 3401161 - DNA, 15 bp, Homo sapiens
ctgtatttctttgta

SEQ ID NO: 3401162 - DNA, 14 bp, Homo sapiens
ctgtcagtgtgaaa

SEQ ID NO: 3401163 - DNA, 13 bp, Homo sapiens
ctgtcccacctgg

SEQ ID NO: 3401164 - DNA, 16 bp, Homo sapiens
ctgtccccttctctca

SEQ ID NO: 3401165 - DNA, 21 bp, Homo sapiens
ctgtccccttctctcatctct

SEQ ID NO: 3401166 - DNA, 22 bp, Homo sapiens
ctgtccccttctctcatctctt

SEQ ID NO: 3401167 - DNA, 23 bp, Homo sapiens
ctgtcccttgcccccctggcctc

SEQ ID NO: 3401168 - DNA, 12 bp, Homo sapiens
ctgtctcctggc

SEQ ID NO: 3401169 - DNA, 20 bp, Homo sapiens
ctgtctttcagatacatggt

SEQ ID NO: 3401170 - DNA, 15 bp, Homo sapiens
ctgtgagaaaggaaa

SEQ ID NO: 3401171 - DNA, 19 bp, Homo sapiens
ctgtgaggggctctctcat

SEQ ID NO: 3401172 - DNA, 14 bp, Homo sapiens
ctgtgcaaacagtg

SEQ ID NO: 3401173 - DNA, 18 bp, Homo sapiens
ctgtgcacaaagtggcat

SEQ ID NO: 3401174 - DNA, 19 bp, Homo sapiens
ctgtgcacccagaagaaga

SEQ ID NO: 3401175 - DNA, 16 bp, Homo sapiens
ctgtgccttttgccat

SEQ ID NO: 3401176 - DNA, 20 bp, Homo sapiens
ctgtggattcagcttctgtt

SEQ ID NO: 3401177 - DNA, 17 bp, Homo sapiens
ctgtggccatatatgct

SEQ ID NO: 3401178 - DNA, 21 bp, Homo sapiens
ctgtgggcaggcaagcccttc

SEQ ID NO: 3401179 - DNA, 23 bp, Homo sapiens
ctgtgtctctgtatatagctcta

SEQ ID NO: 3401180 - DNA, 14 bp, Homo sapiens
ctgtgttgcttcaa

SEQ ID NO: 3401181 - DNA, 20 bp, Homo sapiens
ctgttacctgatcaatgaca

SEQ ID NO: 3401182 - DNA, 20 bp, Homo sapiens
ctgttactgcttctctttgt

SEQ ID NO: 3401183 - DNA, 13 bp, Homo sapiens
ctgttggcagctc

SEQ ID NO: 3401184 - DNA, 12 bp, Homo sapiens
ctgttgtacatt

SEQ ID NO: 3401185 - DNA, 13 bp, Homo sapiens
ctgttgtacattt

SEQ ID NO: 3401186 - DNA, 15 bp, Homo sapiens
ctgttgtacatttat

SEQ ID NO: 3401187 - DNA, 21 bp, Homo sapiens
ctgttgtcaccttcacctcct

SEQ ID NO: 3401188 - DNA, 18 bp, Homo sapiens
ctgtttactcccttctgt

SEQ ID NO: 3401189 - DNA, 22 bp, Homo sapiens
ctgtttactcccttctgtagtt

SEQ ID NO: 3401190 - DNA, 19 bp, Homo sapiens
ctgtttcccgtaaggctgt

SEQ ID NO: 3401191 - DNA, 14 bp, Homo sapiens
ctgttttaaattgc

SEQ ID NO: 3401192 - DNA, 23 bp, Homo sapiens
ctgttttaatttatactggcatg

SEQ ID NO: 3401193 - DNA, 16 bp, Homo sapiens
ctgttttgtaaagtcc

SEQ ID NO: 3401194 - DNA, 17 bp, Homo sapiens
cttaaaaaataaaaact

SEQ ID NO: 3401195 - DNA, 20 bp, Homo sapiens
cttaaaagcaagatctacta

SEQ ID NO: 3401196 - DNA, 20 bp, Homo sapiens
cttaaaatgcaatatttgta

SEQ ID NO: 3401197 - DNA, 14 bp, Homo sapiens
cttaaacaaatgta

SEQ ID NO: 3401198 - DNA, 21 bp, Homo sapiens
cttaaagcttgatttgatctt

SEQ ID NO: 3401199 - DNA, 13 bp, Homo sapiens
cttaaatcagttt

SEQ ID NO: 3401200 - DNA, 16 bp, Homo sapiens
cttaaatcatttggtt

SEQ ID NO: 3401201 - DNA, 22 bp, Homo sapiens
cttaaatcatttggttaaatca

SEQ ID NO: 3401202 - DNA, 15 bp, Homo sapiens
cttaaatgttttcat

SEQ ID NO: 3401203 - DNA, 16 bp, Homo sapiens
cttaacattcctaaaa

SEQ ID NO: 3401204 - DNA, 17 bp, Homo sapiens
cttaacgttttcttaaa

SEQ ID NO: 3401205 - DNA, 14 bp, Homo sapiens
cttaactgtatttc

SEQ ID NO: 3401206 - DNA, 18 bp, Homo sapiens
cttaactgtatttcagta

SEQ ID NO: 3401207 - DNA, 21 bp, Homo sapiens
cttaaggcatacttttaatca

SEQ ID NO: 3401208 - DNA, 17 bp, Homo sapiens
cttaattctttgtttcc

SEQ ID NO: 3401209 - DNA, 20 bp, Homo sapiens
cttaattctttgtttcctct

SEQ ID NO: 3401210 - DNA, 22 bp, Homo sapiens
cttaattttgtctttcaaattt

SEQ ID NO: 3401211 - DNA, 18 bp, Homo sapiens
cttacaactcccccaccg

SEQ ID NO: 3401212 - DNA, 17 bp, Homo sapiens
cttacaagcttaaagct

SEQ ID NO: 3401213 - DNA, 19 bp, Homo sapiens
cttacaagcttaaagcttg

SEQ ID NO: 3401214 - DNA, 17 bp, Homo sapiens
cttacagtaaatgaact

SEQ ID NO: 3401215 - DNA, 16 bp, Homo sapiens
cttacggccctggcct

SEQ ID NO: 3401216 - DNA, 18 bp, Homo sapiens
cttactgtggaggaagga

SEQ ID NO: 3401217 - DNA, 19 bp, Homo sapiens
cttactgtggaggaaggat

SEQ ID NO: 3401218 - DNA, 15 bp, Homo sapiens
cttacttttaaaata

SEQ ID NO: 3401219 - DNA, 16 bp, Homo sapiens
cttacttttaaaataa

SEQ ID NO: 3401220 - DNA, 14 bp, Homo sapiens
cttagctcccctcc

SEQ ID NO: 3401221 - DNA, 15 bp, Homo sapiens
cttaggccagcacca

SEQ ID NO: 3401222 - DNA, 18 bp, Homo sapiens
cttagtatagtagaaaga

SEQ ID NO: 3401223 - DNA, 22 bp, Homo sapiens
cttagttgatattcaaggcttt

SEQ ID NO: 3401224 - DNA, 19 bp, Homo sapiens
cttatctcagtcatgcata

SEQ ID NO: 3401225 - DNA, 20 bp, Homo sapiens
cttatctcagtcatgcataa

SEQ ID NO: 3401226 - DNA, 22 bp, Homo sapiens
cttatctcagtcatgcataaat

SEQ ID NO: 3401227 - DNA, 20 bp, Homo sapiens
cttatcttacaactccccca

SEQ ID NO: 3401228 - DNA, 20 bp, Homo sapiens
cttatgagaacatggtgtgt

SEQ ID NO: 3401229 - DNA, 22 bp, Homo sapiens
cttatgatattctcattatttc

SEQ ID NO: 3401230 - DNA, 23 bp, Homo sapiens
cttatgatattctcattatttca

SEQ ID NO: 3401231 - DNA, 13 bp, Homo sapiens
cttatgtgttaca

SEQ ID NO: 3401232 - DNA, 14 bp, Homo sapiens
cttatgtgttacat

SEQ ID NO: 3401233 - DNA, 23 bp, Homo sapiens
cttattcagtgaaaaagatattt

SEQ ID NO: 3401234 - DNA, 20 bp, Homo sapiens
cttcaagtgagtggcatgtg

SEQ ID NO: 3401235 - DNA, 23 bp, Homo sapiens
cttcactcatgcaaactgcttta

SEQ ID NO: 3401236 - DNA, 15 bp, Homo sapiens
cttcactcctgctgt

SEQ ID NO: 3401237 - DNA, 16 bp, Homo sapiens
cttcagccctcacccc

SEQ ID NO: 3401238 - DNA, 13 bp, Homo sapiens
cttcagctggtgg

SEQ ID NO: 3401239 - DNA, 16 bp, Homo sapiens
cttcaggcactaagag

SEQ ID NO: 3401240 - DNA, 20 bp, Homo sapiens
cttcaggttatcgaaataac

SEQ ID NO: 3401241 - DNA, 14 bp, Homo sapiens
cttcattttgttct

SEQ ID NO: 3401242 - DNA, 18 bp, Homo sapiens
cttccattaaattgcctt

SEQ ID NO: 3401243 - DNA, 14 bp, Homo sapiens
cttccgcagtgtgg

SEQ ID NO: 3401244 - DNA, 15 bp, Homo sapiens
cttcctgtctgttta

SEQ ID NO: 3401245 - DNA, 17 bp, Homo sapiens
cttcctgtctgtttata

SEQ ID NO: 3401246 - DNA, 15 bp, Homo sapiens
cttctcatcctgcag

SEQ ID NO: 3401247 - DNA, 15 bp, Homo sapiens
cttctcatttcaccc

SEQ ID NO: 3401248 - DNA, 17 bp, Homo sapiens
cttctccatggccctgc

SEQ ID NO: 3401249 - DNA, 14 bp, Homo sapiens
cttctctcatctct

SEQ ID NO: 3401250 - DNA, 12 bp, Homo sapiens
cttctctttgtg

SEQ ID NO: 3401251 - DNA, 15 bp, Homo sapiens
cttctgaggacattc

SEQ ID NO: 3401252 - DNA, 15 bp, Homo sapiens
cttctggctttgttc

SEQ ID NO: 3401253 - DNA, 22 bp, Homo sapiens
cttctggctttgttcttgtcat

SEQ ID NO: 3401254 - DNA, 13 bp, Homo sapiens
cttcttacatgca

SEQ ID NO: 3401255 - DNA, 12 bp, Homo sapiens
cttcttgtaata

SEQ ID NO: 3401256 - DNA, 20 bp, Homo sapiens
cttcttgtaatatttcttca

SEQ ID NO: 3401257 - DNA, 23 bp, Homo sapiens
cttgaatgccatagtcaaagaga

SEQ ID NO: 3401258 - DNA, 16 bp, Homo sapiens
cttgagaattccctgt

SEQ ID NO: 3401259 - DNA, 18 bp, Homo sapiens
cttgagtgttatgtgaat

SEQ ID NO: 3401260 - DNA, 23 bp, Homo sapiens
cttgatcaacatcttttcttgcc

SEQ ID NO: 3401261 - DNA, 17 bp, Homo sapiens
cttgatttgatctttgt

SEQ ID NO: 3401262 - DNA, 22 bp, Homo sapiens
cttgcacgcgccctttctacca

SEQ ID NO: 3401263 - DNA, 17 bp, Homo sapiens
cttgcaggggtccctgc

SEQ ID NO: 3401264 - DNA, 21 bp, Homo sapiens
cttgcataataagctaaagag

SEQ ID NO: 3401265 - DNA, 20 bp, Homo sapiens
cttgcatggcattaattgtt

SEQ ID NO: 3401266 - DNA, 22 bp, Homo sapiens
cttgcccccctggcctccccca

SEQ ID NO: 3401267 - DNA, 20 bp, Homo sapiens
cttgcggttccggcatggac

SEQ ID NO: 3401268 - DNA, 20 bp, Homo sapiens
cttgctgtttactcccttct

SEQ ID NO: 3401269 - DNA, 21 bp, Homo sapiens
cttgcttaaggcatactttta

SEQ ID NO: 3401270 - DNA, 14 bp, Homo sapiens
cttgcttttatagt

SEQ ID NO: 3401271 - DNA, 14 bp, Homo sapiens
cttgggccctctgg

SEQ ID NO: 3401272 - DNA, 15 bp, Homo sapiens
cttgggccctctggt

SEQ ID NO: 3401273 - DNA, 20 bp, Homo sapiens
cttgggggtcctcctccagg

SEQ ID NO: 3401274 - DNA, 21 bp, Homo sapiens
cttgggggtcctcctccaggg

SEQ ID NO: 3401275 - DNA, 21 bp, Homo sapiens
cttgggtgtaacaggtctcct

SEQ ID NO: 3401276 - DNA, 15 bp, Homo sapiens
cttgtcaataaaaat

SEQ ID NO: 3401277 - DNA, 13 bp, Homo sapiens
cttgtgaaattgt

SEQ ID NO: 3401278 - DNA, 23 bp, Homo sapiens
cttgtgaaattgtgtagagtgtt

SEQ ID NO: 3401279 - DNA, 15 bp, Homo sapiens
cttgtggcctatgaa

SEQ ID NO: 3401280 - DNA, 12 bp, Homo sapiens
cttgttattaat

SEQ ID NO: 3401281 - DNA, 20 bp, Homo sapiens
ctttaaaagtcattattcct

SEQ ID NO: 3401282 - DNA, 14 bp, Homo sapiens
ctttaaagataagt

SEQ ID NO: 3401283 - DNA, 17 bp, Homo sapiens
ctttaaatttaggtaaa

SEQ ID NO: 3401284 - DNA, 21 bp, Homo sapiens
ctttaagggagtgtactccca

SEQ ID NO: 3401285 - DNA, 13 bp, Homo sapiens
ctttactgcctga

SEQ ID NO: 3401286 - DNA, 18 bp, Homo sapiens
ctttactgcctgaataaa

SEQ ID NO: 3401287 - DNA, 19 bp, Homo sapiens
ctttactgcctgaataaag

SEQ ID NO: 3401288 - DNA, 23 bp, Homo sapiens
ctttactgcctgaataaagagcc

SEQ ID NO: 3401289 - DNA, 14 bp, Homo sapiens
ctttaggtttgaaa

SEQ ID NO: 3401290 - DNA, 15 bp, Homo sapiens
ctttatagttgtaga

SEQ ID NO: 3401291 - DNA, 20 bp, Homo sapiens
ctttatatggcctcaagatc

SEQ ID NO: 3401292 - DNA, 13 bp, Homo sapiens
ctttatctttgtg

SEQ ID NO: 3401293 - DNA, 14 bp, Homo sapiens
ctttatctttgtgt

SEQ ID NO: 3401294 - DNA, 15 bp, Homo sapiens
ctttatctttgtgta

SEQ ID NO: 3401295 - DNA, 15 bp, Homo sapiens
ctttcaaatttactg

SEQ ID NO: 3401296 - DNA, 21 bp, Homo sapiens
ctttcagagtttggttaatca

SEQ ID NO: 3401297 - DNA, 13 bp, Homo sapiens
ctttcagagtttt

SEQ ID NO: 3401298 - DNA, 15 bp, Homo sapiens
ctttcagtgaaagca

SEQ ID NO: 3401299 - DNA, 17 bp, Homo sapiens
ctttcagtgaaagcatc

SEQ ID NO: 3401300 - DNA, 13 bp, Homo sapiens
ctttcatttgaaa

SEQ ID NO: 3401301 - DNA, 17 bp, Homo sapiens
ctttcatttgaaagtgg

SEQ ID NO: 3401302 - DNA, 15 bp, Homo sapiens
ctttcatttttttcc

SEQ ID NO: 3401303 - DNA, 19 bp, Homo sapiens
ctttcatttttttccaggc

SEQ ID NO: 3401304 - DNA, 18 bp, Homo sapiens
ctttctagtggtctttgt

SEQ ID NO: 3401305 - DNA, 22 bp, Homo sapiens
ctttctagtggtctttgtaaga

SEQ ID NO: 3401306 - DNA, 18 bp, Homo sapiens
ctttctcccctgccccca

SEQ ID NO: 3401307 - DNA, 23 bp, Homo sapiens
ctttctcccctgcccccaggact

SEQ ID NO: 3401308 - DNA, 20 bp, Homo sapiens
ctttctgaagcctcacttat

SEQ ID NO: 3401309 - DNA, 19 bp, Homo sapiens
ctttctgagtgagttttac

SEQ ID NO: 3401310 - DNA, 23 bp, Homo sapiens
ctttctgagtgagttttactctt

SEQ ID NO: 3401311 - DNA, 12 bp, Homo sapiens
ctttcttattca

SEQ ID NO: 3401312 - DNA, 23 bp, Homo sapiens
ctttcttattcagtgaaaaagat

SEQ ID NO: 3401313 - DNA, 17 bp, Homo sapiens
ctttcttggtgcattcg

SEQ ID NO: 3401314 - DNA, 15 bp, Homo sapiens
ctttctttgctgctg

SEQ ID NO: 3401315 - DNA, 16 bp, Homo sapiens
ctttctttgctgctgt

SEQ ID NO: 3401316 - DNA, 13 bp, Homo sapiens
ctttgagacagtt

SEQ ID NO: 3401317 - DNA, 21 bp, Homo sapiens
ctttgataatgtccaaatact

SEQ ID NO: 3401318 - DNA, 14 bp, Homo sapiens
ctttgataatgtta

SEQ ID NO: 3401319 - DNA, 15 bp, Homo sapiens
ctttgataatgttaa

SEQ ID NO: 3401320 - DNA, 22 bp, Homo sapiens
ctttgataatgttaaatttgta

SEQ ID NO: 3401321 - DNA, 15 bp, Homo sapiens
ctttgattctccttc

SEQ ID NO: 3401322 - DNA, 20 bp, Homo sapiens
ctttgattctccttcagccc

SEQ ID NO: 3401323 - DNA, 22 bp, Homo sapiens
ctttgattctccttcagccctc

SEQ ID NO: 3401324 - DNA, 13 bp, Homo sapiens
ctttgcaagctta

SEQ ID NO: 3401325 - DNA, 16 bp, Homo sapiens
ctttgctgaatgtcat

SEQ ID NO: 3401326 - DNA, 14 bp, Homo sapiens
ctttgctgctgtgg

SEQ ID NO: 3401327 - DNA, 19 bp, Homo sapiens
ctttggttatatttagctc

SEQ ID NO: 3401328 - DNA, 20 bp, Homo sapiens
ctttgtaatatgagaatgta

SEQ ID NO: 3401329 - DNA, 23 bp, Homo sapiens
ctttgtaatatgagaatgtatta

SEQ ID NO: 3401330 - DNA, 14 bp, Homo sapiens
ctttgtagaataaa

SEQ ID NO: 3401331 - DNA, 18 bp, Homo sapiens
ctttgtagaataaatggt

SEQ ID NO: 3401332 - DNA, 18 bp, Homo sapiens
ctttgtatcattcatctt

SEQ ID NO: 3401333 - DNA, 14 bp, Homo sapiens
ctttgtgtttagct

SEQ ID NO: 3401334 - DNA, 15 bp, Homo sapiens
ctttgttacaggcac

SEQ ID NO: 3401335 - DNA, 15 bp, Homo sapiens
ctttgtttctccccc

SEQ ID NO: 3401336 - DNA, 12 bp, Homo sapiens
cttttaaaataa

SEQ ID NO: 3401337 - DNA, 17 bp, Homo sapiens
cttttaaaataaaattt

SEQ ID NO: 3401338 - DNA, 15 bp, Homo sapiens
cttttacatacagtg

SEQ ID NO: 3401339 - DNA, 18 bp, Homo sapiens
cttttacattaaagaaat

SEQ ID NO: 3401340 - DNA, 19 bp, Homo sapiens
cttttagttgtatctcttt

SEQ ID NO: 3401341 - DNA, 21 bp, Homo sapiens
cttttagttgtatctcttttg

SEQ ID NO: 3401342 - DNA, 22 bp, Homo sapiens
cttttattgcaccattttcaat

SEQ ID NO: 3401343 - DNA, 14 bp, Homo sapiens
cttttattttcatt

SEQ ID NO: 3401344 - DNA, 14 bp, Homo sapiens
cttttctttctttt

SEQ ID NO: 3401345 - DNA, 12 bp, Homo sapiens
cttttctttgta

SEQ ID NO: 3401346 - DNA, 18 bp, Homo sapiens
cttttcttttttaaagta

SEQ ID NO: 3401347 - DNA, 16 bp, Homo sapiens
cttttgcccatataaa

SEQ ID NO: 3401348 - DNA, 14 bp, Homo sapiens
ctttttaaacagtg

SEQ ID NO: 3401349 - DNA, 18 bp, Homo sapiens
ctttttgaaatcagcata

SEQ ID NO: 3401350 - DNA, 12 bp, Homo sapiens
ctttttgcagct

SEQ ID NO: 3401351 - DNA, 13 bp, Homo sapiens
ctttttgcagctt

SEQ ID NO: 3401352 - DNA, 16 bp, Homo sapiens
ctttttgttccctcat

SEQ ID NO: 3401353 - DNA, 19 bp, Homo sapiens
ctttttgttccctcattct

SEQ ID NO: 3401354 - DNA, 12 bp, Homo sapiens
cttttttaaagt

SEQ ID NO: 3401355 - DNA, 13 bp, Homo sapiens
cttttttaaagta

SEQ ID NO: 3401356 - DNA, 21 bp, Homo sapiens
cttttttttttttgctttgtt

SEQ ID NO: 3401357 - DNA, 9 bp, Homo sapiens
gaaaaataa

SEQ ID NO: 3401358 - DNA, 12 bp, Homo sapiens
gaaaaataaata

SEQ ID NO: 3401359 - DNA, 16 bp, Homo sapiens
gaaaacaattgttctg

SEQ ID NO: 3401360 - DNA, 22 bp, Homo sapiens
gaaaacaattgttctgggtgat

SEQ ID NO: 3401361 - DNA, 12 bp, Homo sapiens
gaaaacaggcac

SEQ ID NO: 3401362 - DNA, 15 bp, Homo sapiens
gaaaacatgtaataa

SEQ ID NO: 3401363 - DNA, 18 bp, Homo sapiens
gaaaatagggtccttgaa

SEQ ID NO: 3401364 - DNA, 20 bp, Homo sapiens
gaaaatagggtccttgaaac

SEQ ID NO: 3401365 - DNA, 18 bp, Homo sapiens
gaaaatgcaacaacatgt

SEQ ID NO: 3401366 - DNA, 13 bp, Homo sapiens
gaaaatgtgtctg

SEQ ID NO: 3401367 - DNA, 18 bp, Homo sapiens
gaaaatgtgtctgcaaca

SEQ ID NO: 3401368 - DNA, 21 bp, Homo sapiens
gaaaatgtgtctgcaacatgg

SEQ ID NO: 3401369 - DNA, 15 bp, Homo sapiens
gaaaattaacactgc

SEQ ID NO: 3401370 - DNA, 19 bp, Homo sapiens
gaaacaagacaagctcctc

SEQ ID NO: 3401371 - DNA, 14 bp, Homo sapiens
gaaaccgtccctga

SEQ ID NO: 3401372 - DNA, 14 bp, Homo sapiens
gaaaccttttttaa

SEQ ID NO: 3401373 - DNA, 17 bp, Homo sapiens
gaaaccttttttaagat

SEQ ID NO: 3401374 - DNA, 12 bp, Homo sapiens
gaaactaacaga

SEQ ID NO: 3401375 - DNA, 18 bp, Homo sapiens
gaaactaccagtgggcat

SEQ ID NO: 3401376 - DNA, 15 bp, Homo sapiens
gaaactcttatctca

SEQ ID NO: 3401377 - DNA, 23 bp, Homo sapiens
gaaactcttatctcagtcatgca

SEQ ID NO: 3401378 - DNA, 13 bp, Homo sapiens
gaaagaaaatgaa

SEQ ID NO: 3401379 - DNA, 14 bp, Homo sapiens
gaaagaatagaaag

SEQ ID NO: 3401380 - DNA, 19 bp, Homo sapiens
gaaagaatagaaagaaagt

SEQ ID NO: 3401381 - DNA, 14 bp, Homo sapiens
gaaagacagagctg

SEQ ID NO: 3401382 - DNA, 17 bp, Homo sapiens
gaaagacagcttctcat

SEQ ID NO: 3401383 - DNA, 13 bp, Homo sapiens
gaaagacatctgc

SEQ ID NO: 3401384 - DNA, 13 bp, Homo sapiens
gaaaggaaaaatt

SEQ ID NO: 3401385 - DNA, 21 bp, Homo sapiens
gaaaggactctggggttttta

SEQ ID NO: 3401386 - DNA, 23 bp, Homo sapiens
gaaaggactctggggtttttact

SEQ ID NO: 3401387 - DNA, 18 bp, Homo sapiens
gaaaggattctaaacaga

SEQ ID NO: 3401388 - DNA, 17 bp, Homo sapiens
gaaagtcaattcagtga

SEQ ID NO: 3401389 - DNA, 13 bp, Homo sapiens
gaaagttgctttt

SEQ ID NO: 3401390 - DNA, 19 bp, Homo sapiens
gaaagttgcttttattgca

SEQ ID NO: 3401391 - DNA, 12 bp, Homo sapiens
gaaatatataaa

SEQ ID NO: 3401392 - DNA, 17 bp, Homo sapiens
gaaatcgccttatgaga

SEQ ID NO: 3401393 - DNA, 17 bp, Homo sapiens
gaaatttaaaaataaag

SEQ ID NO: 3401394 - DNA, 18 bp, Homo sapiens
gaaatttaaaaataaagc

SEQ ID NO: 3401395 - DNA, 21 bp, Homo sapiens
gaaatttaatgtttctctgga

SEQ ID NO: 3401396 - DNA, 22 bp, Homo sapiens
gaacacagcctgggaccagggc

SEQ ID NO: 3401397 - DNA, 15 bp, Homo sapiens
gaacagcttcaggtt

SEQ ID NO: 3401398 - DNA, 21 bp, Homo sapiens
gaaccatgttggttgcacttt

SEQ ID NO: 3401399 - DNA, 19 bp, Homo sapiens
gaacggggctcttctcatt

SEQ ID NO: 3401400 - DNA, 22 bp, Homo sapiens
gaactacaaacaaaatttctat

SEQ ID NO: 3401401 - DNA, 13 bp, Homo sapiens
gaactattagagc

SEQ ID NO: 3401402 - DNA, 15 bp, Homo sapiens
gaactgcaggaagag

SEQ ID NO: 3401403 - DNA, 16 bp, Homo sapiens
gaactgcaggaagaga

SEQ ID NO: 3401404 - DNA, 16 bp, Homo sapiens
gaactggaggcaggga

SEQ ID NO: 3401405 - DNA, 14 bp, Homo sapiens
gaactttcattttt

SEQ ID NO: 3401406 - DNA, 12 bp, Homo sapiens
gaagaaacaaaa

SEQ ID NO: 3401407 - DNA, 18 bp, Homo sapiens
gaagacaccagagcagat

SEQ ID NO: 3401408 - DNA, 19 bp, Homo sapiens
gaagacccaacacatggga

SEQ ID NO: 3401409 - DNA, 20 bp, Homo sapiens
gaagacccattccttcccag

SEQ ID NO: 3401410 - DNA, 22 bp, Homo sapiens
gaagacccattccttcccagag

SEQ ID NO: 3401411 - DNA, 21 bp, Homo sapiens
gaagagagtccatatttcaat

SEQ ID NO: 3401412 - DNA, 22 bp, Homo sapiens
gaagaggttttatttacatttt

SEQ ID NO: 3401413 - DNA, 19 bp, Homo sapiens
gaagatgaaaccgtccctg

SEQ ID NO: 3401414 - DNA, 16 bp, Homo sapiens
gaagatggctgttagc

SEQ ID NO: 3401415 - DNA, 16 bp, Homo sapiens
gaagcagtaataatca

SEQ ID NO: 3401416 - DNA, 21 bp, Homo sapiens
gaagccaaagagactgggcct

SEQ ID NO: 3401417 - DNA, 18 bp, Homo sapiens
gaagccaagctccctgga

SEQ ID NO: 3401418 - DNA, 19 bp, Homo sapiens
gaagccaagctccctggag

SEQ ID NO: 3401419 - DNA, 18 bp, Homo sapiens
gaagctggaagcactgct

SEQ ID NO: 3401420 - DNA, 22 bp, Homo sapiens
gaagctgggactcattcacatt

SEQ ID NO: 3401421 - DNA, 21 bp, Homo sapiens
gaagctgttgtacatttatga

SEQ ID NO: 3401422 - DNA, 22 bp, Homo sapiens
gaagctgttgtacatttatgat

SEQ ID NO: 3401423 - DNA, 18 bp, Homo sapiens
gaagcttggggaagaccc

SEQ ID NO: 3401424 - DNA, 14 bp, Homo sapiens
gaaggagctgcctg

SEQ ID NO: 3401425 - DNA, 18 bp, Homo sapiens
gaaggagctgcctggacc

SEQ ID NO: 3401426 - DNA, 17 bp, Homo sapiens
gaaggcagcaggtggca

SEQ ID NO: 3401427 - DNA, 12 bp, Homo sapiens
gaagggggtggt

SEQ ID NO: 3401428 - DNA, 18 bp, Homo sapiens
gaagtgtgggtctgtgtg

SEQ ID NO: 3401429 - DNA, 22 bp, Homo sapiens
gaataaacatctgtgtctgtgt

SEQ ID NO: 3401430 - DNA, 20 bp, Homo sapiens
gaataagtgccaggatggaa

SEQ ID NO: 3401431 - DNA, 23 bp, Homo sapiens
gaatacacatctctgtcagtgtg

SEQ ID NO: 3401432 - DNA, 12 bp, Homo sapiens
gaatagaaagaa

SEQ ID NO: 3401433 - DNA, 14 bp, Homo sapiens
gaatatatggcatt

SEQ ID NO: 3401434 - DNA, 13 bp, Homo sapiens
gaatccatgcttg

SEQ ID NO: 3401435 - DNA, 20 bp, Homo sapiens
gaatctatttttaaaatcat

SEQ ID NO: 3401436 - DNA, 23 bp, Homo sapiens
gaatgctgcccagggtcagtgta

SEQ ID NO: 3401437 - DNA, 22 bp, Homo sapiens
gaatggcacagcccaaagaagg

SEQ ID NO: 3401438 - DNA, 13 bp, Homo sapiens
gaatgtcagtatg

SEQ ID NO: 3401439 - DNA, 14 bp, Homo sapiens
gaatgtcagtgttc

SEQ ID NO: 3401440 - DNA, 19 bp, Homo sapiens
gaatgtgatcatctttgct

SEQ ID NO: 3401441 - DNA, 23 bp, Homo sapiens
gaattaagggccagaaaaaagtg

SEQ ID NO: 3401442 - DNA, 18 bp, Homo sapiens
gaattaagttagggaatg

SEQ ID NO: 3401443 - DNA, 21 bp, Homo sapiens
gaattaggtccacttcaatgt

SEQ ID NO: 3401444 - DNA, 14 bp, Homo sapiens
gaattgcagagtac

SEQ ID NO: 3401445 - DNA, 19 bp, Homo sapiens
gacaaaagtgacagatgtt

SEQ ID NO: 3401446 - DNA, 14 bp, Homo sapiens
gacaaactgtaaaa

SEQ ID NO: 3401447 - DNA, 11 bp, Homo sapiens
gacaaagtgtg

SEQ ID NO: 3401448 - DNA, 17 bp, Homo sapiens
gacaaatttagccaata

SEQ ID NO: 3401449 - DNA, 21 bp, Homo sapiens
gacaaatttagccaataaaga

SEQ ID NO: 3401450 - DNA, 14 bp, Homo sapiens
gacaagctcctccc

SEQ ID NO: 3401451 - DNA, 17 bp, Homo sapiens
gacaatcaactctaata

SEQ ID NO: 3401452 - DNA, 14 bp, Homo sapiens
gacaatggaccgga

SEQ ID NO: 3401453 - DNA, 12 bp, Homo sapiens
gacacaaaagaa

SEQ ID NO: 3401454 - DNA, 15 bp, Homo sapiens
gacacaaaagaagaa

SEQ ID NO: 3401455 - DNA, 20 bp, Homo sapiens
gacacaatgacacatttgtt

SEQ ID NO: 3401456 - DNA, 18 bp, Homo sapiens
gacacaatgttgcactga

SEQ ID NO: 3401457 - DNA, 14 bp, Homo sapiens
gacaccagagcaga

SEQ ID NO: 3401458 - DNA, 15 bp, Homo sapiens
gacaccagagcagat

SEQ ID NO: 3401459 - DNA, 23 bp, Homo sapiens
gacactagggaaaggtaaataca

SEQ ID NO: 3401460 - DNA, 15 bp, Homo sapiens
gacactgtaaaatag

SEQ ID NO: 3401461 - DNA, 14 bp, Homo sapiens
gacagaacactgtc

SEQ ID NO: 3401462 - DNA, 19 bp, Homo sapiens
gacagatcctccatttttg

SEQ ID NO: 3401463 - DNA, 12 bp, Homo sapiens
gacagatgttat

SEQ ID NO: 3401464 - DNA, 19 bp, Homo sapiens
gacagatgttatttttgta

SEQ ID NO: 3401465 - DNA, 21 bp, Homo sapiens
gacagcttctcatcctgcagg

SEQ ID NO: 3401466 - DNA, 14 bp, Homo sapiens
gacagtttcttagc

SEQ ID NO: 3401467 - DNA, 21 bp, Homo sapiens
gacagtttcttagctttttaa

SEQ ID NO: 3401468 - DNA, 16 bp, Homo sapiens
gacataacgtttttcc

SEQ ID NO: 3401469 - DNA, 21 bp, Homo sapiens
gacataacgtttttcctttaa

SEQ ID NO: 3401470 - DNA, 16 bp, Homo sapiens
gacattccaagacagt

SEQ ID NO: 3401471 - DNA, 21 bp, Homo sapiens
gaccacagggttcaaaatgtc

SEQ ID NO: 3401472 - DNA, 23 bp, Homo sapiens
gaccacagggttcaaaatgtctg

SEQ ID NO: 3401473 - DNA, 14 bp, Homo sapiens
gaccagcctggccc

SEQ ID NO: 3401474 - DNA, 16 bp, Homo sapiens
gaccagcctggcccac

SEQ ID NO: 3401475 - DNA, 22 bp, Homo sapiens
gaccatataactgtgatgaaat

SEQ ID NO: 3401476 - DNA, 14 bp, Homo sapiens
gaccatgtgattat

SEQ ID NO: 3401477 - DNA, 14 bp, Homo sapiens
gacccattccttcc

SEQ ID NO: 3401478 - DNA, 20 bp, Homo sapiens
gaccccgagcctggctccaa

SEQ ID NO: 3401479 - DNA, 17 bp, Homo sapiens
gacccctcccctcgtgt

SEQ ID NO: 3401480 - DNA, 17 bp, Homo sapiens
gaccctcgtttgatagt

SEQ ID NO: 3401481 - DNA, 18 bp, Homo sapiens
gaccgttttgtattgctt

SEQ ID NO: 3401482 - DNA, 17 bp, Homo sapiens
gacctataactgcccag

SEQ ID NO: 3401483 - DNA, 17 bp, Homo sapiens
gacctcttcctggaata

SEQ ID NO: 3401484 - DNA, 13 bp, Homo sapiens
gaccttgatgagc

SEQ ID NO: 3401485 - DNA, 17 bp, Homo sapiens
gacctttcctgaggaag

SEQ ID NO: 3401486 - DNA, 13 bp, Homo sapiens
gactaaagagaga

SEQ ID NO: 3401487 - DNA, 17 bp, Homo sapiens
gactaaagagagaatgt

SEQ ID NO: 3401488 - DNA, 18 bp, Homo sapiens
gactaaagagagaatgta

SEQ ID NO: 3401489 - DNA, 15 bp, Homo sapiens
gactatggaatgtca

SEQ ID NO: 3401490 - DNA, 14 bp, Homo sapiens
gactctgcagcctc

SEQ ID NO: 3401491 - DNA, 19 bp, Homo sapiens
gactgcaagcatttttcca

SEQ ID NO: 3401492 - DNA, 19 bp, Homo sapiens
gactgggcctaggccagga

SEQ ID NO: 3401493 - DNA, 20 bp, Homo sapiens
gactgggcctaggccaggag

SEQ ID NO: 3401494 - DNA, 13 bp, Homo sapiens
gactgttgtccct

SEQ ID NO: 3401495 - DNA, 13 bp, Homo sapiens
gacttgataatga

SEQ ID NO: 3401496 - DNA, 23 bp, Homo sapiens
gacttttgaagaacaaaaggctt

SEQ ID NO: 3401497 - DNA, 23 bp, Homo sapiens
gagaaacaagacaagctcctccc

SEQ ID NO: 3401498 - DNA, 15 bp, Homo sapiens
gagaactttcatttt

SEQ ID NO: 3401499 - DNA, 17 bp, Homo sapiens
gagaactttcatttttt

SEQ ID NO: 3401500 - DNA, 14 bp, Homo sapiens
gagaactttttgtt

SEQ ID NO: 3401501 - DNA, 23 bp, Homo sapiens
gagaagaatagcctagatatgaa

SEQ ID NO: 3401502 - DNA, 13 bp, Homo sapiens
gagaagccacagg

SEQ ID NO: 3401503 - DNA, 18 bp, Homo sapiens
gagaagccacaggcctga

SEQ ID NO: 3401504 - DNA, 22 bp, Homo sapiens
gagaagccacaggcctgagatt

SEQ ID NO: 3401505 - DNA, 22 bp, Homo sapiens
gagaagccagctttcctcatca

SEQ ID NO: 3401506 - DNA, 15 bp, Homo sapiens
gagaatgtaagaact

SEQ ID NO: 3401507 - DNA, 21 bp, Homo sapiens
gagaatgtagatattgtgaag

SEQ ID NO: 3401508 - DNA, 17 bp, Homo sapiens
gagacacaggatgaagc

SEQ ID NO: 3401509 - DNA, 21 bp, Homo sapiens
gagacagtttcttagcttttt

SEQ ID NO: 3401510 - DNA, 22 bp, Homo sapiens
gagacagtttcttagcttttta

SEQ ID NO: 3401511 - DNA, 13 bp, Homo sapiens
gagacatcagccc

SEQ ID NO: 3401512 - DNA, 15 bp, Homo sapiens
gagactcgagaactt

SEQ ID NO: 3401513 - DNA, 17 bp, Homo sapiens
gagactcgagaactttc

SEQ ID NO: 3401514 - DNA, 13 bp, Homo sapiens
gagactttgctgt

SEQ ID NO: 3401515 - DNA, 21 bp, Homo sapiens
gagaggatgagagcccagagg

SEQ ID NO: 3401516 - DNA, 23 bp, Homo sapiens
gagagggccgggcagaggggcag

SEQ ID NO: 3401517 - DNA, 12 bp, Homo sapiens
gagagtgggggt

SEQ ID NO: 3401518 - DNA, 15 bp, Homo sapiens
gagagtgggggtggg

SEQ ID NO: 3401519 - DNA, 18 bp, Homo sapiens
gagagtttttaatagaac

SEQ ID NO: 3401520 - DNA, 13 bp, Homo sapiens
gagatttcatctg

SEQ ID NO: 3401521 - DNA, 17 bp, Homo sapiens
gagatttcatctgctct

SEQ ID NO: 3401522 - DNA, 19 bp, Homo sapiens
gagatttcatctgctctcc

SEQ ID NO: 3401523 - DNA, 20 bp, Homo sapiens
gagatttcatctgctctcct

SEQ ID NO: 3401524 - DNA, 22 bp, Homo sapiens
gagatttcatctgctctccttc

SEQ ID NO: 3401525 - DNA, 16 bp, Homo sapiens
gagcaattaaactgtg

SEQ ID NO: 3401526 - DNA, 18 bp, Homo sapiens
gagcagatgcagagagcc

SEQ ID NO: 3401527 - DNA, 18 bp, Homo sapiens
gagcattaactaaatgct

SEQ ID NO: 3401528 - DNA, 20 bp, Homo sapiens
gagcattaactaaatgctca

SEQ ID NO: 3401529 - DNA, 16 bp, Homo sapiens
gagccattttgtgaat

SEQ ID NO: 3401530 - DNA, 21 bp, Homo sapiens
gagcccagaggtaacagaaca

SEQ ID NO: 3401531 - DNA, 13 bp, Homo sapiens
gagcccaggagct

SEQ ID NO: 3401532 - DNA, 18 bp, Homo sapiens
gagcccaggccaggactc

SEQ ID NO: 3401533 - DNA, 24 bp, Homo sapiens
gagcccaggccaggactctgcagc

SEQ ID NO: 3401534 - DNA, 12 bp, Homo sapiens
gagcctccctgc

SEQ ID NO: 3401535 - DNA, 17 bp, Homo sapiens
gagctgaggcaattcta

SEQ ID NO: 3401536 - DNA, 12 bp, Homo sapiens
gagctgcctgga

SEQ ID NO: 3401537 - DNA, 14 bp, Homo sapiens
gagctgcctggacc

SEQ ID NO: 3401538 - DNA, 16 bp, Homo sapiens
gagctgcctggacccg

SEQ ID NO: 3401539 - DNA, 18 bp, Homo sapiens
gagctgtccggctggtgg

SEQ ID NO: 3401540 - DNA, 21 bp, Homo sapiens
gagctttttgttccctcattc

SEQ ID NO: 3401541 - DNA, 19 bp, Homo sapiens
gaggaagaacggggctctt

SEQ ID NO: 3401542 - DNA, 23 bp, Homo sapiens
gaggaagaacggggctcttctca

SEQ ID NO: 3401543 - DNA, 13 bp, Homo sapiens
gaggagcccaggc

SEQ ID NO: 3401544 - DNA, 18 bp, Homo sapiens
gaggagctcaggacacta

SEQ ID NO: 3401545 - DNA, 18 bp, Homo sapiens
gaggatgagagcccagag

SEQ ID NO: 3401546 - DNA, 13 bp, Homo sapiens
gaggcccccgacc

SEQ ID NO: 3401547 - DNA, 12 bp, Homo sapiens
gaggccctccac

SEQ ID NO: 3401548 - DNA, 18 bp, Homo sapiens
gaggccctccacacctgc

SEQ ID NO: 3401549 - DNA, 18 bp, Homo sapiens
gaggccgttgattcactt

SEQ ID NO: 3401550 - DNA, 20 bp, Homo sapiens
gaggcctgagcgctcctgcc

SEQ ID NO: 3401551 - DNA, 20 bp, Homo sapiens
gaggcctgcctccagggctg

SEQ ID NO: 3401552 - DNA, 19 bp, Homo sapiens
gaggcggatctttggacag

SEQ ID NO: 3401553 - DNA, 16 bp, Homo sapiens
gagggatctaggtctt

SEQ ID NO: 3401554 - DNA, 18 bp, Homo sapiens
gagggcagcgggagcctc

SEQ ID NO: 3401555 - DNA, 23 bp, Homo sapiens
gagggcagcgggagcctccctgc

SEQ ID NO: 3401556 - DNA, 23 bp, Homo sapiens
gaggggcagatggaaaggagcct

SEQ ID NO: 3401557 - DNA, 20 bp, Homo sapiens
gaggggcctgccacctggac

SEQ ID NO: 3401558 - DNA, 18 bp, Homo sapiens
gaggggctggacctggcg

SEQ ID NO: 3401559 - DNA, 13 bp, Homo sapiens
gagggtttctgat

SEQ ID NO: 3401560 - DNA, 18 bp, Homo sapiens
gagggtttctgatctgta

SEQ ID NO: 3401561 - DNA, 16 bp, Homo sapiens
gaggtaacagaacagc

SEQ ID NO: 3401562 - DNA, 18 bp, Homo sapiens
gaggtaacagaacagctt

SEQ ID NO: 3401563 - DNA, 14 bp, Homo sapiens
gagtaatgatgtaa

SEQ ID NO: 3401564 - DNA, 18 bp, Homo sapiens
gagtgaggatgtctgggc

SEQ ID NO: 3401565 - DNA, 21 bp, Homo sapiens
gagtgcccctgtcccacctgg

SEQ ID NO: 3401566 - DNA, 22 bp, Homo sapiens
gagtgcccctgtcccacctggc

SEQ ID NO: 3401567 - DNA, 11 bp, Homo sapiens
gagtgtagaag

SEQ ID NO: 3401568 - DNA, 13 bp, Homo sapiens
gagtgtagaagca

SEQ ID NO: 3401569 - DNA, 15 bp, Homo sapiens
gagtgtagaagcatt

SEQ ID NO: 3401570 - DNA, 16 bp, Homo sapiens
gagtgtagaagcattc

SEQ ID NO: 3401571 - DNA, 21 bp, Homo sapiens
gagtgtgtaatttaaaattgt

SEQ ID NO: 3401572 - DNA, 16 bp, Homo sapiens
gagttaagaagctgtt

SEQ ID NO: 3401573 - DNA, 14 bp, Homo sapiens
gagttcccaaatgt

SEQ ID NO: 3401574 - DNA, 19 bp, Homo sapiens
gagttgcaccattctttct

SEQ ID NO: 3401575 - DNA, 19 bp, Homo sapiens
gagtttgctgttttaaatt

SEQ ID NO: 3401576 - DNA, 13 bp, Homo sapiens
gataatgtattgc

SEQ ID NO: 3401577 - DNA, 23 bp, Homo sapiens
gataatgtccaaatactctgaaa

SEQ ID NO: 3401578 - DNA, 14 bp, Homo sapiens
gataatgttaaatt

SEQ ID NO: 3401579 - DNA, 23 bp, Homo sapiens
gataccttaattctttgtttcct

SEQ ID NO: 3401580 - DNA, 23 bp, Homo sapiens
gatactccgctgtcggcacattc

SEQ ID NO: 3401581 - DNA, 13 bp, Homo sapiens
gatagatgtgtgg

SEQ ID NO: 3401582 - DNA, 22 bp, Homo sapiens
gatagatgtgtggacacattgg

SEQ ID NO: 3401583 - DNA, 14 bp, Homo sapiens
gatagtagcttcct

SEQ ID NO: 3401584 - DNA, 16 bp, Homo sapiens
gatagtattgtgcata

SEQ ID NO: 3401585 - DNA, 17 bp, Homo sapiens
gatatgaatatatggca

SEQ ID NO: 3401586 - DNA, 18 bp, Homo sapiens
gatattctcattatttca

SEQ ID NO: 3401587 - DNA, 16 bp, Homo sapiens
gatcaacatcttttct

SEQ ID NO: 3401588 - DNA, 23 bp, Homo sapiens
gatcagatgctgaattgagaata

SEQ ID NO: 3401589 - DNA, 14 bp, Homo sapiens
gatcatggtgtaat

SEQ ID NO: 3401590 - DNA, 15 bp, Homo sapiens
gatcatggtgtaata

SEQ ID NO: 3401591 - DNA, 14 bp, Homo sapiens
gatcattatcagcc

SEQ ID NO: 3401592 - DNA, 15 bp, Homo sapiens
gatccaaatgctgtg

SEQ ID NO: 3401593 - DNA, 19 bp, Homo sapiens
gatccaaatgctgtgcaaa

SEQ ID NO: 3401594 - DNA, 15 bp, Homo sapiens
gatcctccatttttg

SEQ ID NO: 3401595 - DNA, 14 bp, Homo sapiens
gatctcgactcccc

SEQ ID NO: 3401596 - DNA, 18 bp, Homo sapiens
gatctctattatatcttg

SEQ ID NO: 3401597 - DNA, 12 bp, Homo sapiens
gatctgattttt

SEQ ID NO: 3401598 - DNA, 17 bp, Homo sapiens
gatctttgtttaaatgc

SEQ ID NO: 3401599 - DNA, 16 bp, Homo sapiens
gatcttttcaagttaa

SEQ ID NO: 3401600 - DNA, 15 bp, Homo sapiens
gatgaagcatttaca

SEQ ID NO: 3401601 - DNA, 15 bp, Homo sapiens
gatgagagcccagag

SEQ ID NO: 3401602 - DNA, 16 bp, Homo sapiens
gatgcagcattatgat

SEQ ID NO: 3401603 - DNA, 13 bp, Homo sapiens
gatggaacagtga

SEQ ID NO: 3401604 - DNA, 22 bp, Homo sapiens
gatgggtccagaagaccccact

SEQ ID NO: 3401605 - DNA, 22 bp, Homo sapiens
gatgtaacagtgcaagattttt

SEQ ID NO: 3401606 - DNA, 16 bp, Homo sapiens
gatgttgtgtattgtg

SEQ ID NO: 3401607 - DNA, 18 bp, Homo sapiens
gattagacctttatccag

SEQ ID NO: 3401608 - DNA, 14 bp, Homo sapiens
gattatttaataac

SEQ ID NO: 3401609 - DNA, 16 bp, Homo sapiens
gattatttaataacat

SEQ ID NO: 3401610 - DNA, 17 bp, Homo sapiens
gattatttaataacatt

SEQ ID NO: 3401611 - DNA, 21 bp, Homo sapiens
gattcaaatatcaaaaggaag

SEQ ID NO: 3401612 - DNA, 22 bp, Homo sapiens
gattctaaacagatgtccctga

SEQ ID NO: 3401613 - DNA, 12 bp, Homo sapiens
gattctccttca

SEQ ID NO: 3401614 - DNA, 13 bp, Homo sapiens
gattctccttcag

SEQ ID NO: 3401615 - DNA, 18 bp, Homo sapiens
gattctccttcagccctc

SEQ ID NO: 3401616 - DNA, 14 bp, Homo sapiens
gattgaatgctgcc

SEQ ID NO: 3401617 - DNA, 21 bp, Homo sapiens
gattgcaatttgcacaagttt

SEQ ID NO: 3401618 - DNA, 23 bp, Homo sapiens
atttggagcattaactaaatgct

SEQ ID NO: 3401619 - DNA, 19 bp, Homo sapiens
atttggcttgctgtttact

SEQ ID NO: 3401620 - DNA, 14 bp, Homo sapiens
atttggttaaatca

SEQ ID NO: 3401621 - DNA, 19 bp, Homo sapiens
atttgtaaatttatgtgat

SEQ ID NO: 3401622 - DNA, 14 bp, Homo sapiens
atttgtaagtttca

SEQ ID NO: 3401623 - DNA, 14 bp, Homo sapiens
atttgtaattttag

SEQ ID NO: 3401624 - DNA, 17 bp, Homo sapiens
atttgtaattttagtat

SEQ ID NO: 3401625 - DNA, 22 bp, Homo sapiens
atttgtggggagggatttgggg

SEQ ID NO: 3401626 - DNA, 14 bp, Homo sapiens
atttgttgtcatgt

SEQ ID NO: 3401627 - DNA, 18 bp, Homo sapiens
attttaaaaatacatttt

SEQ ID NO: 3401628 - DNA, 22 bp, Homo sapiens
attttagggtgggtaagaaagc

SEQ ID NO: 3401629 - DNA, 22 bp, Homo sapiens
attttatctacccagtcatgta

SEQ ID NO: 3401630 - DNA, 20 bp, Homo sapiens
attttatctttgattctcct

SEQ ID NO: 3401631 - DNA, 19 bp, Homo sapiens
attttccagccttatgtgt

SEQ ID NO: 3401632 - DNA, 20 bp, Homo sapiens
attttccagccttatgtgtt

SEQ ID NO: 3401633 - DNA, 15 bp, Homo sapiens
attttccatgaaaat

SEQ ID NO: 3401634 - DNA, 23 bp, Homo sapiens
attttccccgtgacattcactgg

SEQ ID NO: 3401635 - DNA, 16 bp, Homo sapiens
attttctgtaaatgaa

SEQ ID NO: 3401636 - DNA, 14 bp, Homo sapiens
attttcttgtcaat

SEQ ID NO: 3401637 - DNA, 19 bp, Homo sapiens
attttcttgtcaatggaag

SEQ ID NO: 3401638 - DNA, 19 bp, Homo sapiens
attttgagggtgtaaccag

SEQ ID NO: 3401639 - DNA, 15 bp, Homo sapiens
attttgcataataaa

SEQ ID NO: 3401640 - DNA, 21 bp, Homo sapiens
attttggttttgttcccctcc

SEQ ID NO: 3401641 - DNA, 17 bp, Homo sapiens
attttgtcacagctctt

SEQ ID NO: 3401642 - DNA, 16 bp, Homo sapiens
atttttaaaaaacaat

SEQ ID NO: 3401643 - DNA, 23 bp, Homo sapiens
atttttaaaggacaaacagtgaa

SEQ ID NO: 3401644 - DNA, 12 bp, Homo sapiens
atttttgtgtat

SEQ ID NO: 3401645 - DNA, 21 bp, Homo sapiens
attttttaaaagagacaaact

SEQ ID NO: 3401646 - DNA, 16 bp, Homo sapiens
atttttttagttaata

SEQ ID NO: 3401647 - DNA, 13 bp, Homo sapiens
atttttttcagta

SEQ ID NO: 3401648 - DNA, 18 bp, Homo sapiens
caaaaactattatcacca

SEQ ID NO: 3401649 - DNA, 15 bp, Homo sapiens
caaaagaattaaatt

SEQ ID NO: 3401650 - DNA, 11 bp, Homo sapiens
caaaagcaggc

SEQ ID NO: 3401651 - DNA, 15 bp, Homo sapiens
caaaagctgtgtctc

SEQ ID NO: 3401652 - DNA, 12 bp, Homo sapiens
caaaataaagaa

SEQ ID NO: 3401653 - DNA, 20 bp, Homo sapiens
caaaatgtcacacttgtttc

SEQ ID NO: 3401654 - DNA, 23 bp, Homo sapiens
caaaatgtcacacttgtttcttg

SEQ ID NO: 3401655 - DNA, 13 bp, Homo sapiens
caaaatgtctgta

SEQ ID NO: 3401656 - DNA, 19 bp, Homo sapiens
caaaatgttgataaatgga

SEQ ID NO: 3401657 - DNA, 20 bp, Homo sapiens
caaaatttcacagttctgta

SEQ ID NO: 3401658 - DNA, 14 bp, Homo sapiens
caaaatttctatta

SEQ ID NO: 3401659 - DNA, 18 bp, Homo sapiens
caaacaaaatttctatta

SEQ ID NO: 3401660 - DNA, 12 bp, Homo sapiens
caaacagtgaat

SEQ ID NO: 3401661 - DNA, 13 bp, Homo sapiens
caaacatgaaaac

SEQ ID NO: 3401662 - DNA, 16 bp, Homo sapiens
caaacatgaaaacatt

SEQ ID NO: 3401663 - DNA, 19 bp, Homo sapiens
caaacatgtgcaactcttg

SEQ ID NO: 3401664 - DNA, 21 bp, Homo sapiens
caaacatgtgcaactcttgta

SEQ ID NO: 3401665 - DNA, 14 bp, Homo sapiens
caaactgctttatt

SEQ ID NO: 3401666 - DNA, 15 bp, Homo sapiens
caaactttaacaggt

SEQ ID NO: 3401667 - DNA, 19 bp, Homo sapiens
caaagaaggaaaaggcagg

SEQ ID NO: 3401668 - DNA, 15 bp, Homo sapiens
caaagagaatgtatt

SEQ ID NO: 3401669 - DNA, 17 bp, Homo sapiens
caaagagaatgtatttc

SEQ ID NO: 3401670 - DNA, 16 bp, Homo sapiens
caaagagactgggcct

SEQ ID NO: 3401671 - DNA, 21 bp, Homo sapiens
caaagagagtttttaatagaa

SEQ ID NO: 3401672 - DNA, 22 bp, Homo sapiens
caaagagagtttttaatagaac

SEQ ID NO: 3401673 - DNA, 16 bp, Homo sapiens
caaaggagtagaaaga

SEQ ID NO: 3401674 - DNA, 19 bp, Homo sapiens
caaaggccagacctgcaga

SEQ ID NO: 3401675 - DNA, 22 bp, Homo sapiens
caaaggccagacctgcagacgc

SEQ ID NO: 3401676 - DNA, 15 bp, Homo sapiens
caaagtataacaatt

SEQ ID NO: 3401677 - DNA, 19 bp, Homo sapiens
caaagtataacaattaaaa

SEQ ID NO: 3401678 - DNA, 15 bp, Homo sapiens
caaagtgtcagtgtt

SEQ ID NO: 3401679 - DNA, 19 bp, Homo sapiens
caaagttttgaaaagctat

SEQ ID NO: 3401680 - DNA, 14 bp, Homo sapiens
caaataaaccttgt

SEQ ID NO: 3401681 - DNA, 18 bp, Homo sapiens
caaataaaccttgtttct

SEQ ID NO: 3401682 - DNA, 14 bp, Homo sapiens
caaatatcaaaagg

SEQ ID NO: 3401683 - DNA, 17 bp, Homo sapiens
caaatatcaaaaggaag

SEQ ID NO: 3401684 - DNA, 22 bp, Homo sapiens
caaatatcaaaaggaagattct

SEQ ID NO: 3401685 - DNA, 14 bp, Homo sapiens
caaatggaggaata

SEQ ID NO: 3401686 - DNA, 16 bp, Homo sapiens
caaattcctttcagag

SEQ ID NO: 3401687 - DNA, 16 bp, Homo sapiens
caaattttgaggtctt

SEQ ID NO: 3401688 - DNA, 17 bp, Homo sapiens
caaattttttaaaagag

SEQ ID NO: 3401689 - DNA, 19 bp, Homo sapiens
caaattttttaaaagagac

SEQ ID NO: 3401690 - DNA, 13 bp, Homo sapiens
caaattttttaat

SEQ ID NO: 3401691 - DNA, 13 bp, Homo sapiens
caacaaacactgt

SEQ ID NO: 3401692 - DNA, 15 bp, Homo sapiens
caacaaacactgtga

SEQ ID NO: 3401693 - DNA, 22 bp, Homo sapiens
caacaacatgtataatattttt

SEQ ID NO: 3401694 - DNA, 20 bp, Homo sapiens
caacacttgcaggggtccct

SEQ ID NO: 3401695 - DNA, 23 bp, Homo sapiens
caacacttgcaggggtccctgct

SEQ ID NO: 3401696 - DNA, 20 bp, Homo sapiens
caacagtttatttttattat

SEQ ID NO: 3401697 - DNA, 17 bp, Homo sapiens
caacatgtataatattt

SEQ ID NO: 3401698 - DNA, 18 bp, Homo sapiens
caacatgtataatatttt

SEQ ID NO: 3401699 - DNA, 20 bp, Homo sapiens
caaccccccagcactgagga

SEQ ID NO: 3401700 - DNA, 22 bp, Homo sapiens
caacctttcccatttcgtgtaa

SEQ ID NO: 3401701 - DNA, 14 bp, Homo sapiens
caactcccccaccg

SEQ ID NO: 3401702 - DNA, 23 bp, Homo sapiens
caactttcatttgaaagtgggtt

SEQ ID NO: 3401703 - DNA, 15 bp, Homo sapiens
caagaaaacaggcac

SEQ ID NO: 3401704 - DNA, 17 bp, Homo sapiens
caagaaaacaggcactg

SEQ ID NO: 3401705 - DNA, 21 bp, Homo sapiens
caagaaaacaggcactgccct

SEQ ID NO: 3401706 - DNA, 22 bp, Homo sapiens
caagaaaacaggcactgccctg

SEQ ID NO: 3401707 - DNA, 21 bp, Homo sapiens
caagaaatcgccttatgagaa

SEQ ID NO: 3401708 - DNA, 14 bp, Homo sapiens
caagacaagctcct

SEQ ID NO: 3401709 - DNA, 16 bp, Homo sapiens
caagacaagctcctcc

SEQ ID NO: 3401710 - DNA, 17 bp, Homo sapiens
caagacaagctcctccc

SEQ ID NO: 3401711 - DNA, 18 bp, Homo sapiens
caagacaagctcctccct

SEQ ID NO: 3401712 - DNA, 13 bp, Homo sapiens
caagagagatgtt

SEQ ID NO: 3401713 - DNA, 12 bp, Homo sapiens
caagagctgagg

SEQ ID NO: 3401714 - DNA, 22 bp, Homo sapiens
caagattttgaatgcttcctga

SEQ ID NO: 3401715 - DNA, 13 bp, Homo sapiens
caagctccctgga

SEQ ID NO: 3401716 - DNA, 12 bp, Homo sapiens
caagctcctccc

SEQ ID NO: 3401717 - DNA, 23 bp, Homo sapiens
caagcttatttagcacattttga

SEQ ID NO: 3401718 - DNA, 23 bp, Homo sapiens
caaggaacctaattgaaatttaa

SEQ ID NO: 3401719 - DNA, 19 bp, Homo sapiens
caaggatgggtccagaaga

SEQ ID NO: 3401720 - DNA, 16 bp, Homo sapiens
caaggtaactgtactg

SEQ ID NO: 3401721 - DNA, 18 bp, Homo sapiens
caataaaattatttgcag

SEQ ID NO: 3401722 - DNA, 19 bp, Homo sapiens
caataaaattatttgcagg

SEQ ID NO: 3401723 - DNA, 22 bp, Homo sapiens
caataaaattatttgcaggtct

SEQ ID NO: 3401724 - DNA, 22 bp, Homo sapiens
caatattttccatgaaaatgca

SEQ ID NO: 3401725 - DNA, 16 bp, Homo sapiens
caatcacaaaagctgt

SEQ ID NO: 3401726 - DNA, 16 bp, Homo sapiens
caatccaaatgcattc

SEQ ID NO: 3401727 - DNA, 16 bp, Homo sapiens
caatccatgcttcact

SEQ ID NO: 3401728 - DNA, 14 bp, Homo sapiens
caatgataaataaa

SEQ ID NO: 3401729 - DNA, 21 bp, Homo sapiens
gcactagaccatataactgtg

SEQ ID NO: 3401730 - DNA, 19 bp, Homo sapiens
gcactgccctggtggccct

SEQ ID NO: 3401731 - DNA, 16 bp, Homo sapiens
gcactgcctctcacag

SEQ ID NO: 3401732 - DNA, 19 bp, Homo sapiens
gcactgcctctcacagctg

SEQ ID NO: 3401733 - DNA, 20 bp, Homo sapiens
gcacttaatattagcttgct

SEQ ID NO: 3401734 - DNA, 22 bp, Homo sapiens
gcacttgcggttccggcatgga

SEQ ID NO: 3401735 - DNA, 18 bp, Homo sapiens
gcacttgtggaatatgtt

SEQ ID NO: 3401736 - DNA, 17 bp, Homo sapiens
gcactttgtagtgtttg

SEQ ID NO: 3401737 - DNA, 16 bp, Homo sapiens
gcagaagacaccagag

SEQ ID NO: 3401738 - DNA, 22 bp, Homo sapiens
gcagaagggggtggtgtctcca

SEQ ID NO: 3401739 - DNA, 16 bp, Homo sapiens
gcagaagtgtttttta

SEQ ID NO: 3401740 - DNA, 15 bp, Homo sapiens
gcagagagccatttt

SEQ ID NO: 3401741 - DNA, 15 bp, Homo sapiens
gctgttactgcttct

SEQ ID NO: 3401742 - DNA, 20 bp, Homo sapiens
gctgttactgcttctctttg

SEQ ID NO: 3401743 - DNA, 14 bp, Homo sapiens
gctgttgtacattt

SEQ ID NO: 3401744 - DNA, 16 bp, Homo sapiens
gctgttgtacatttat

SEQ ID NO: 3401745 - DNA, 15 bp, Homo sapiens
gcttaaaaatcattg

SEQ ID NO: 3401746 - DNA, 17 bp, Homo sapiens
gcttaacgttttcttaa

SEQ ID NO: 3401747 - DNA, 15 bp, Homo sapiens
gcttacggccctggc

SEQ ID NO: 3401748 - DNA, 19 bp, Homo sapiens
gcttacggccctggccttg

SEQ ID NO: 3401749 - DNA, 17 bp, Homo sapiens
gcttagattttctgtaa

SEQ ID NO: 3401750 - DNA, 20 bp, Homo sapiens
gcttatgtgttgcataaaca

SEQ ID NO: 3401751 - DNA, 16 bp, Homo sapiens
gcttcactcctgctgt

SEQ ID NO: 3401752 - DNA, 20 bp, Homo sapiens
gcttcactcctgctgtaaat

SEQ ID NO: 3401753 - DNA, 17 bp, Homo sapiens
gcttcactgtataaata

SEQ ID NO: 3401754 - DNA, 22 bp, Homo sapiens
gcttcaggttatcgaaataaca

SEQ ID NO: 3401755 - DNA, 17 bp, Homo sapiens
gcttctcatcctgcagg

SEQ ID NO: 3401756 - DNA, 18 bp, Homo sapiens
gcttctggctttgttctt

SEQ ID NO: 3401757 - DNA, 16 bp, Homo sapiens
gcttctgttgtcacct

SEQ ID NO: 3401758 - DNA, 17 bp, Homo sapiens
gcttctgttgtcacctt

SEQ ID NO: 3401759 - DNA, 15 bp, Homo sapiens
gcttgcataataagc

SEQ ID NO: 3401760 - DNA, 13 bp, Homo sapiens
gcttgcctgcagg

SEQ ID NO: 3401761 - DNA, 14 bp, Homo sapiens
gcttgcctgcaggc

SEQ ID NO: 3401762 - DNA, 21 bp, Homo sapiens
gcttgggtgtaacaggtctcc

SEQ ID NO: 3401763 - DNA, 21 bp, Homo sapiens
gctttaaaagtcattattcct

SEQ ID NO: 3401764 - DNA, 14 bp, Homo sapiens
gctttcagagtttg

SEQ ID NO: 3401765 - DNA, 14 bp, Homo sapiens
gcttttaaaaggaa

SEQ ID NO: 3401766 - DNA, 21 bp, Homo sapiens
gcttttattgcaccattttca

SEQ ID NO: 3401767 - DNA, 18 bp, Homo sapiens
gcttttttttttttgctt

SEQ ID NO: 3401768 - DNA, 14 bp, Homo sapiens
ggaaaacgctctct

SEQ ID NO: 3401769 - DNA, 13 bp, Homo sapiens
ggaaaagaaatca

SEQ ID NO: 3401770 - DNA, 15 bp, Homo sapiens
ggaaaggacagcttt

SEQ ID NO: 3401771 - DNA, 18 bp, Homo sapiens
ggaacaatcacaaaagct

SEQ ID NO: 3401772 - DNA, 16 bp, Homo sapiens
ggaacatgcagctctg

SEQ ID NO: 3401773 - DNA, 17 bp, Homo sapiens
ggaacatggggaggagg

SEQ ID NO: 3401774 - DNA, 13 bp, Homo sapiens
ggaaccatgaagc

SEQ ID NO: 3401775 - DNA, 15 bp, Homo sapiens
ggaactgctgggctt

SEQ ID NO: 3401776 - DNA, 12 bp, Homo sapiens
ggaactggaggc

SEQ ID NO: 3401777 - DNA, 13 bp, Homo sapiens
ggaagaacataga

SEQ ID NO: 3401778 - DNA, 14 bp, Homo sapiens
ggaagaacatagaa

SEQ ID NO: 3401779 - DNA, 16 bp, Homo sapiens
ggaagaacatagaact

SEQ ID NO: 3401780 - DNA, 19 bp, Homo sapiens
ggaagaagttttttacttt

SEQ ID NO: 3401781 - DNA, 17 bp, Homo sapiens
ggaagacccattccttc

SEQ ID NO: 3401782 - DNA, 20 bp, Homo sapiens
ggaagacccattccttccca

SEQ ID NO: 3401783 - DNA, 19 bp, Homo sapiens
ggaagagaggacccatcct

SEQ ID NO: 3401784 - DNA, 13 bp, Homo sapiens
ggaagcactgctg

SEQ ID NO: 3401785 - DNA, 14 bp, Homo sapiens
ggaaggagctgcct

SEQ ID NO: 3401786 - DNA, 15 bp, Homo sapiens
ggaaggagctgcctg

SEQ ID NO: 3401787 - DNA, 17 bp, Homo sapiens
ggaaggagctgcctgga

SEQ ID NO: 3401788 - DNA, 20 bp, Homo sapiens
ggaaggagctgcctggaccc

SEQ ID NO: 3401789 - DNA, 22 bp, Homo sapiens
ggaaggagctgcctggacccgt

SEQ ID NO: 3401790 - DNA, 23 bp, Homo sapiens
ggaaggattgtaaaaaaaaatgc

SEQ ID NO: 3401791 - DNA, 23 bp, Homo sapiens
ggaagggacaccaagccttggct

SEQ ID NO: 3401792 - DNA, 15 bp, Homo sapiens
ggaatggcacagccc

SEQ ID NO: 3401793 - DNA, 20 bp, Homo sapiens
ggaattcatctctctttaat

SEQ ID NO: 3401794 - DNA, 16 bp, Homo sapiens
ggaatttttttcagta

SEQ ID NO: 3401795 - DNA, 16 bp, Homo sapiens
ggacaatggaccggag

SEQ ID NO: 3401796 - DNA, 15 bp, Homo sapiens
ggacagaagcagctc

SEQ ID NO: 3401797 - DNA, 17 bp, Homo sapiens
ggacagagaagatgact

SEQ ID NO: 3401798 - DNA, 12 bp, Homo sapiens
ggacagtggcag

SEQ ID NO: 3401799 - DNA, 13 bp, Homo sapiens
ggacagtggcagg

SEQ ID NO: 3401800 - DNA, 12 bp, Homo sapiens
ggaccagcctgg

SEQ ID NO: 3401801 - DNA, 15 bp, Homo sapiens
ggaccagcctggccc

SEQ ID NO: 3401802 - DNA, 23 bp, Homo sapiens
ggacccctgcattggaactggag

SEQ ID NO: 3401803 - DNA, 17 bp, Homo sapiens
ggacctggcggcaggaa

SEQ ID NO: 3401804 - DNA, 13 bp, Homo sapiens
ggactctgcagcc

SEQ ID NO: 3401805 - DNA, 17 bp, Homo sapiens
ggactctggggttttta

SEQ ID NO: 3401806 - DNA, 19 bp, Homo sapiens
ggagaagccacaggcctga

SEQ ID NO: 3401807 - DNA, 21 bp, Homo sapiens
ggagagcccaggagctcccct

SEQ ID NO: 3401808 - DNA, 21 bp, Homo sapiens
ggagaggatgagagcccagag

SEQ ID NO: 3401809 - DNA, 15 bp, Homo sapiens
ggagcctccctgcct

SEQ ID NO: 3401810 - DNA, 18 bp, Homo sapiens
ggagcctccctgcctcag

SEQ ID NO: 3401811 - DNA, 22 bp, Homo sapiens
ggagcctccctgcctcaggcct

SEQ ID NO: 3401812 - DNA, 13 bp, Homo sapiens
ggaggaaggattg

SEQ ID NO: 3401813 - DNA, 19 bp, Homo sapiens
ggaggagggtcggtgcctt

SEQ ID NO: 3401814 - DNA, 12 bp, Homo sapiens
ggagggatttgg

SEQ ID NO: 3401815 - DNA, 21 bp, Homo sapiens
ggagggggctggctctgagag

SEQ ID NO: 3401816 - DNA, 11 bp, Homo sapiens
ggagtgtgtaa

SEQ ID NO: 3401817 - DNA, 12 bp, Homo sapiens
ggagtgtttgac

SEQ ID NO: 3401818 - DNA, 13 bp, Homo sapiens
ggatagatgtgtg

SEQ ID NO: 3401819 - DNA, 14 bp, Homo sapiens
ggatagatgtgtgg

SEQ ID NO: 3401820 - DNA, 21 bp, Homo sapiens
ggatcatggtgtaataagaca

SEQ ID NO: 3401821 - DNA, 14 bp, Homo sapiens
ggatgagagcccag

SEQ ID NO: 3401822 - DNA, 18 bp, Homo sapiens
ggatgagagcccagaggt

SEQ ID NO: 3401823 - DNA, 13 bp, Homo sapiens
ggatgcagcatta

SEQ ID NO: 3401824 - DNA, 19 bp, Homo sapiens
ggatggaaaaggaagacta

SEQ ID NO: 3401825 - DNA, 17 bp, Homo sapiens
ggattatttaataacat

SEQ ID NO: 3401826 - DNA, 16 bp, Homo sapiens
ggattccaaagcattt

SEQ ID NO: 3401827 - DNA, 23 bp, Homo sapiens
ggattgtaaaaaaaaatgccttt

SEQ ID NO: 3401828 - DNA, 21 bp, Homo sapiens
ggcaaggatgggtccagaaga

SEQ ID NO: 3401829 - DNA, 20 bp, Homo sapiens
ggcactgccctggtggccct

SEQ ID NO: 3401830 - DNA, 21 bp, Homo sapiens
ggcagaagacaccagagcaga

SEQ ID NO: 3401831 - DNA, 17 bp, Homo sapiens
ggcagaagtgtttttta

SEQ ID NO: 3401832 - DNA, 13 bp, Homo sapiens
ggcagccagggag

SEQ ID NO: 3401833 - DNA, 18 bp, Homo sapiens
ggcagccagggagagccc

SEQ ID NO: 3401834 - DNA, 21 bp, Homo sapiens
ggcagccagggagagcccagg

SEQ ID NO: 3401835 - DNA, 20 bp, Homo sapiens
ggcagggaacatggggagga

SEQ ID NO: 3401836 - DNA, 17 bp, Homo sapiens
ggcattttgaatgtgat

SEQ ID NO: 3401837 - DNA, 20 bp, Homo sapiens
ggcattttgaatgtgatcat

SEQ ID NO: 3401838 - DNA, 20 bp, Homo sapiens
ggccagaaaaaagtgtttat

SEQ ID NO: 3401839 - DNA, 21 bp, Homo sapiens
ggccagaagatgaacagactg

SEQ ID NO: 3401840 - DNA, 22 bp, Homo sapiens
ggccagacctgcagacgcccag

SEQ ID NO: 3401841 - DNA, 18 bp, Homo sapiens
ggccagcaccatctcttt

SEQ ID NO: 3401842 - DNA, 16 bp, Homo sapiens
ggccaggactctgcag

SEQ ID NO: 3401843 - DNA, 18 bp, Homo sapiens
ggccaggactctgcagcc

SEQ ID NO: 3401844 - DNA, 21 bp, Homo sapiens
ggccaggttggaaaagaaatc

SEQ ID NO: 3401845 - DNA, 22 bp, Homo sapiens
ggccaggttggaaaagaaatca

SEQ ID NO: 3401846 - DNA, 15 bp, Homo sapiens
ggccatatatgctgt

SEQ ID NO: 3401847 - DNA, 22 bp, Homo sapiens
ggccatgttgtgcctccctggt

SEQ ID NO: 3401848 - DNA, 21 bp, Homo sapiens
ggcccaatccaaggtggggtg

SEQ ID NO: 3401849 - DNA, 19 bp, Homo sapiens
ggccctccacacctgcggc

SEQ ID NO: 3401850 - DNA, 13 bp, Homo sapiens
ggccctcctcagc

SEQ ID NO: 3401851 - DNA, 16 bp, Homo sapiens
ggccctcctcagctcc

SEQ ID NO: 3401852 - DNA, 13 bp, Homo sapiens
ggccctggccttg

SEQ ID NO: 3401853 - DNA, 20 bp, Homo sapiens
aaaataaaaagcctcagtga

SEQ ID NO: 3401854 - DNA, 19 bp, Homo sapiens
aaaataaagctactgaatt

SEQ ID NO: 3401855 - DNA, 20 bp, Homo sapiens
aaaataaagctactgaattt

SEQ ID NO: 3401856 - DNA, 20 bp, Homo sapiens
aaaatacctcaggaaagaat

SEQ ID NO: 3401857 - DNA, 24 bp, Homo sapiens
aaaatacctcaggaaagaatagaa

SEQ ID NO: 3401858 - DNA, 16 bp, Homo sapiens
aaaatacggtgggggt

SEQ ID NO: 3401859 - DNA, 16 bp, Homo sapiens
aaaatagggtccttga

SEQ ID NO: 3401860 - DNA, 12 bp, Homo sapiens
aaaatatatgtt

SEQ ID NO: 3401861 - DNA, 16 bp, Homo sapiens
aaaatctgtggtggtc

SEQ ID NO: 3401862 - DNA, 13 bp, Homo sapiens
aaaatcttcagct

SEQ ID NO: 3401863 - DNA, 13 bp, Homo sapiens
aaaatgaaaatta

SEQ ID NO: 3401864 - DNA, 12 bp, Homo sapiens
aaaatgcaatat

SEQ ID NO: 3401865 - DNA, 20 bp, Homo sapiens
aaaatgcccatttttgctaa

SEQ ID NO: 3401866 - DNA, 11 bp, Homo sapiens
aaaatgccttt

SEQ ID NO: 3401867 - DNA, 12 bp, Homo sapiens
aaaatgcctttg

SEQ ID NO: 3401868 - DNA, 17 bp, Homo sapiens
aaaatgcctttgagaca

SEQ ID NO: 3401869 - DNA, 22 bp, Homo sapiens
aaaatgcctttgagacagtttc

SEQ ID NO: 3401870 - DNA, 14 bp, Homo sapiens
aaaatgcttcaaag

SEQ ID NO: 3401871 - DNA, 14 bp, Homo sapiens
aaaatgtacttaaa

SEQ ID NO: 3401872 - DNA, 22 bp, Homo sapiens
aaaatgtgtctgcaacatggat

SEQ ID NO: 3401873 - DNA, 14 bp, Homo sapiens
aaaattaacactgc

SEQ ID NO: 3401874 - DNA, 22 bp, Homo sapiens
aaaattacgttcttacaagctt

SEQ ID NO: 3401875 - DNA, 19 bp, Homo sapiens
aaaattgcagtttcatgta

SEQ ID NO: 3401876 - DNA, 23 bp, Homo sapiens
aaaatttaagtgcgtgtgtagag

SEQ ID NO: 3401877 - DNA, 12 bp, Homo sapiens
aaacaaaaacat

SEQ ID NO: 3401878 - DNA, 15 bp, Homo sapiens
aaacaaaatttctat

SEQ ID NO: 3401879 - DNA, 16 bp, Homo sapiens
aaacaggcactgccct

SEQ ID NO: 3401880 - DNA, 18 bp, Homo sapiens
aaacagtgaatttaagca

SEQ ID NO: 3401881 - DNA, 14 bp, Homo sapiens
aaacatctgtgtct

SEQ ID NO: 3401882 - DNA, 13 bp, Homo sapiens
aaacatgtgcaac

SEQ ID NO: 3401883 - DNA, 21 bp, Homo sapiens
aaacatgtgcaactcttgtat

SEQ ID NO: 3401884 - DNA, 16 bp, Homo sapiens
aaacattgatgaatga

SEQ ID NO: 3401885 - DNA, 17 bp, Homo sapiens
aaaccaacccatgtata

SEQ ID NO: 3401886 - DNA, 15 bp, Homo sapiens
aaaccacaaaaaaat

SEQ ID NO: 3401887 - DNA, 10 bp, Homo sapiens
aaaccacttt

SEQ ID NO: 3401888 - DNA, 18 bp, Homo sapiens
aaaccttgtttctttctg

SEQ ID NO: 3401889 - DNA, 18 bp, Homo sapiens
aaacgacttttgtttgcg

SEQ ID NO: 3401890 - DNA, 19 bp, Homo sapiens
aaacgctctctactctgct

SEQ ID NO: 3401891 - DNA, 15 bp, Homo sapiens
aaactaacagataag

SEQ ID NO: 3401892 - DNA, 21 bp, Homo sapiens
aaactaaggaaccctggaaac

SEQ ID NO: 3401893 - DNA, 23 bp, Homo sapiens
aaactaccagtgggcatgtatta

SEQ ID NO: 3401894 - DNA, 15 bp, Homo sapiens
aaactcctactgctt

SEQ ID NO: 3401895 - DNA, 13 bp, Homo sapiens
aaactgctttatt

SEQ ID NO: 3401896 - DNA, 22 bp, Homo sapiens
aaactggtattttatctttgat

SEQ ID NO: 3401897 - DNA, 15 bp, Homo sapiens
aaactggtttataat

SEQ ID NO: 3401898 - DNA, 13 bp, Homo sapiens
aaacttgtgtatt

SEQ ID NO: 3401899 - DNA, 16 bp, Homo sapiens
aaacttttaggttgtt

SEQ ID NO: 3401900 - DNA, 19 bp, Homo sapiens
aaacttttaggttgttacc

SEQ ID NO: 3401901 - DNA, 12 bp, Homo sapiens
aaagaaattaac

SEQ ID NO: 3401902 - DNA, 12 bp, Homo sapiens
aaagaatagaaa

SEQ ID NO: 3401903 - DNA, 14 bp, Homo sapiens
aaagaatagaaaga

SEQ ID NO: 3401904 - DNA, 14 bp, Homo sapiens
aaagacatctgcct

SEQ ID NO: 3401905 - DNA, 20 bp, Homo sapiens
aaagacatctgcctgtaatt

SEQ ID NO: 3401906 - DNA, 21 bp, Homo sapiens
aaagatattttatttctgatg

SEQ ID NO: 3401907 - DNA, 21 bp, Homo sapiens
aaagcaggcttgtgctttata

SEQ ID NO: 3401908 - DNA, 17 bp, Homo sapiens
aaagccaccttgttaca

SEQ ID NO: 3401909 - DNA, 18 bp, Homo sapiens
aaagccaccttgttacaa

SEQ ID NO: 3401910 - DNA, 13 bp, Homo sapiens
aaagcccaacaca

SEQ ID NO: 3401911 - DNA, 14 bp, Homo sapiens
aaagctactgaatt

SEQ ID NO: 3401912 - DNA, 17 bp, Homo sapiens
aaagctactgaatttat

SEQ ID NO: 3401913 - DNA, 15 bp, Homo sapiens
aaagctgtgtctctg

SEQ ID NO: 3401914 - DNA, 20 bp, Homo sapiens
aaagcttgatttgatctttg

SEQ ID NO: 3401915 - DNA, 14 bp, Homo sapiens
aaagctttatcttt

SEQ ID NO: 3401916 - DNA, 17 bp, Homo sapiens
aaagctttatctttgtg

SEQ ID NO: 3401917 - DNA, 19 bp, Homo sapiens
aaagctttatctttgtgta

SEQ ID NO: 3401918 - DNA, 15 bp, Homo sapiens
aaaggacaaacagtg

SEQ ID NO: 3401919 - DNA, 22 bp, Homo sapiens
aaaggacaccttttaactcacc

SEQ ID NO: 3401920 - DNA, 16 bp, Homo sapiens
aaaggaccgttttgta

SEQ ID NO: 3401921 - DNA, 22 bp, Homo sapiens
aaaggaccgttttgtattgctt

SEQ ID NO: 3401922 - DNA, 12 bp, Homo sapiens
aaaggcaatttt

SEQ ID NO: 3401923 - DNA, 19 bp, Homo sapiens
aaaggctttggcaacagaa

SEQ ID NO: 3401924 - DNA, 21 bp, Homo sapiens
aaagtaaaccacaaaaaaata

SEQ ID NO: 3401925 - DNA, 20 bp, Homo sapiens
aaagtataacaattaaaatc

SEQ ID NO: 3401926 - DNA, 13 bp, Homo sapiens
aaagtatacatgt

SEQ ID NO: 3401927 - DNA, 12 bp, Homo sapiens
aaagtccccaga

SEQ ID NO: 3401928 - DNA, 15 bp, Homo sapiens
aaagtcctgctttcc

SEQ ID NO: 3401929 - DNA, 17 bp, Homo sapiens
aaagtgacagatgttat

SEQ ID NO: 3401930 - DNA, 15 bp, Homo sapiens
aaagtgatgacatat

SEQ ID NO: 3401931 - DNA, 16 bp, Homo sapiens
aaagtgatgacatatt

SEQ ID NO: 3401932 - DNA, 16 bp, Homo sapiens
aaagtgggtttcaatt

SEQ ID NO: 3401933 - DNA, 22 bp, Homo sapiens
aaagtgtaattccacatcatgt

SEQ ID NO: 3401934 - DNA, 17 bp, Homo sapiens
aaagtgtttatgacaaa

SEQ ID NO: 3401935 - DNA, 14 bp, Homo sapiens
aaagttttgaaaag

SEQ ID NO: 3401936 - DNA, 19 bp, Homo sapiens
aaagttttgaaaagctatt

SEQ ID NO: 3401937 - DNA, 13 bp, Homo sapiens
aaataaagctact

SEQ ID NO: 3401938 - DNA, 17 bp, Homo sapiens
aaataaagctactgaat

SEQ ID NO: 3401939 - DNA, 15 bp, Homo sapiens
aaataaatagaaaga

SEQ ID NO: 3401940 - DNA, 15 bp, Homo sapiens
aaataacaatgttaa

SEQ ID NO: 3401941 - DNA, 17 bp, Homo sapiens
aaataatatacttttac

SEQ ID NO: 3401942 - DNA, 13 bp, Homo sapiens
aaataattctaaa

SEQ ID NO: 3401943 - DNA, 14 bp, Homo sapiens
aaataattctaaag

SEQ ID NO: 3401944 - DNA, 15 bp, Homo sapiens
aaataattctaaagg

SEQ ID NO: 3401945 - DNA, 15 bp, Homo sapiens
aaatacctttaaatt

SEQ ID NO: 3401946 - DNA, 23 bp, Homo sapiens
aaatagcttcaggatactgtagt

SEQ ID NO: 3401947 - DNA, 23 bp, Homo sapiens
aaataggagaggatgagagccca

SEQ ID NO: 3401948 - DNA, 22 bp, Homo sapiens
aaatatatactatatgaaaaga

SEQ ID NO: 3401949 - DNA, 17 bp, Homo sapiens
aaatatcaaaaggaaga

SEQ ID NO: 3401950 - DNA, 17 bp, Homo sapiens
aaatatctgaacattta

SEQ ID NO: 3401951 - DNA, 17 bp, Homo sapiens
aaatattggtttgttat

SEQ ID NO: 3401952 - DNA, 21 bp, Homo sapiens
aaatatttgttcttataaacc

SEQ ID NO: 3401953 - DNA, 22 bp, Homo sapiens
aaatattttgaatacacatctc

SEQ ID NO: 3401954 - DNA, 21 bp, Homo sapiens
aaatcatttggcttgctgttt

SEQ ID NO: 3401955 - DNA, 16 bp, Homo sapiens
aaatcattttaggaaa

SEQ ID NO: 3401956 - DNA, 18 bp, Homo sapiens
aaatcattttaggaaagg

SEQ ID NO: 3401957 - DNA, 12 bp, Homo sapiens
aaatccttgtta

SEQ ID NO: 3401958 - DNA, 17 bp, Homo sapiens
aaatcgccttatgagaa

SEQ ID NO: 3401959 - DNA, 22 bp, Homo sapiens
aaatcgccttatgagaacatgg

SEQ ID NO: 3401960 - DNA, 19 bp, Homo sapiens
aaatctggggaagaggttt

SEQ ID NO: 3401961 - DNA, 23 bp, Homo sapiens
aaatcttagtatagtagaaagac

SEQ ID NO: 3401962 - DNA, 12 bp, Homo sapiens
aaatcttcagct

SEQ ID NO: 3401963 - DNA, 15 bp, Homo sapiens
aaatcttcagctggt

SEQ ID NO: 3401964 - DNA, 16 bp, Homo sapiens
aaatcttcagctggtg

SEQ ID NO: 3401965 - DNA, 15 bp, Homo sapiens
aattgttccttgctt

SEQ ID NO: 3401966 - DNA, 15 bp, Homo sapiens
aattgttgtttcttt

SEQ ID NO: 3401967 - DNA, 18 bp, Homo sapiens
aattgttgtttctttcta

SEQ ID NO: 3401968 - DNA, 19 bp, Homo sapiens
aattgttgtttctttctag

SEQ ID NO: 3401969 - DNA, 11 bp, Homo sapiens
aatttaaattg

SEQ ID NO: 3401970 - DNA, 14 bp, Homo sapiens
aatttaagtgcgtg

SEQ ID NO: 3401971 - DNA, 23 bp, Homo sapiens
aatttaagtgcgtgtgtagagtt

SEQ ID NO: 3401972 - DNA, 18 bp, Homo sapiens
aatttagccaataaagaa

SEQ ID NO: 3401973 - DNA, 16 bp, Homo sapiens
aatttaggtaaataaa

SEQ ID NO: 3401974 - DNA, 12 bp, Homo sapiens
aatttattgccg

SEQ ID NO: 3401975 - DNA, 12 bp, Homo sapiens
aatttcacagtt

SEQ ID NO: 3401976 - DNA, 18 bp, Homo sapiens
aatttcacagttctgtaa

SEQ ID NO: 3401977 - DNA, 19 bp, Homo sapiens
aatttcacagttctgtaat

SEQ ID NO: 3401978 - DNA, 13 bp, Homo sapiens
aatttctattaaa

SEQ ID NO: 3401979 - DNA, 22 bp, Homo sapiens
aatttgaggtctacattcttgg

SEQ ID NO: 3401980 - DNA, 12 bp, Homo sapiens
aatttggcttct

SEQ ID NO: 3401981 - DNA, 23 bp, Homo sapiens
aatttgtaagtttcaggtgacat

SEQ ID NO: 3401982 - DNA, 21 bp, Homo sapiens
aatttgttgtcatgtgtatga

SEQ ID NO: 3401983 - DNA, 22 bp, Homo sapiens
aattttagtattaactctgtaa

SEQ ID NO: 3401984 - DNA, 17 bp, Homo sapiens
aattttgaggtctttta

SEQ ID NO: 3401985 - DNA, 15 bp, Homo sapiens
acaaaagtgacagat

SEQ ID NO: 3401986 - DNA, 20 bp, Homo sapiens
acaaaagtgacagatgttat

SEQ ID NO: 3401987 - DNA, 15 bp, Homo sapiens
acaaaatgtcacact

SEQ ID NO: 3401988 - DNA, 19 bp, Homo sapiens
acaaaatttcacagttctg

SEQ ID NO: 3401989 - DNA, 13 bp, Homo sapiens
acaaacagtgaat

SEQ ID NO: 3401990 - DNA, 19 bp, Homo sapiens
acaaacatgtggttaatgc

SEQ ID NO: 3401991 - DNA, 18 bp, Homo sapiens
acaaactgtaaaaaatgt

SEQ ID NO: 3401992 - DNA, 19 bp, Homo sapiens
acaaagtggcataaaaaac

SEQ ID NO: 3401993 - DNA, 23 bp, Homo sapiens
acaaattttttaatttccaaaat

SEQ ID NO: 3401994 - DNA, 13 bp, Homo sapiens
acaacatgtatgt

SEQ ID NO: 3401995 - DNA, 14 bp, Homo sapiens
acaacatgtatgtg

SEQ ID NO: 3401996 - DNA, 14 bp, Homo sapiens
acaactcccccacc

SEQ ID NO: 3401997 - DNA, 19 bp, Homo sapiens
acaactcccccaccgccca

SEQ ID NO: 3401998 - DNA, 23 bp, Homo sapiens
acaactcccccaccgcccactct

SEQ ID NO: 3401999 - DNA, 15 bp, Homo sapiens
acaagctcctccctt

SEQ ID NO: 3402000 - DNA, 17 bp, Homo sapiens
acaagctcctcccttga

SEQ ID NO: 3402001 - DNA, 16 bp, Homo sapiens
acaaggggtgtgactt

SEQ ID NO: 3402002 - DNA, 15 bp, Homo sapiens
acaagtgaacaaaat

SEQ ID NO: 3402003 - DNA, 11 bp, Homo sapiens
acaatgttaag

SEQ ID NO: 3402004 - DNA, 21 bp, Homo sapiens
acaatgttaaggaaactctta

SEQ ID NO: 3402005 - DNA, 20 bp, Homo sapiens
acaatgttgcactgaaaacc

SEQ ID NO: 3402006 - DNA, 15 bp, Homo sapiens
acaattggttgtata

SEQ ID NO: 3402007 - DNA, 21 bp, Homo sapiens
acaattggttgtatataaagt

SEQ ID NO: 3402008 - DNA, 13 bp, Homo sapiens
acaatttaaagca

SEQ ID NO: 3402009 - DNA, 14 bp, Homo sapiens
acacaaaagaagaa

SEQ ID NO: 3402010 - DNA, 23 bp, Homo sapiens
acacaaaagaagaaataaataat

SEQ ID NO: 3402011 - DNA, 11 bp, Homo sapiens
acacactcggg

SEQ ID NO: 3402012 - DNA, 21 bp, Homo sapiens
acacactcgggttaagaaata

SEQ ID NO: 3402013 - DNA, 23 bp, Homo sapiens
acacactcgggttaagaaatacc

SEQ ID NO: 3402014 - DNA, 21 bp, Homo sapiens
acacagcctgggaccagggca

SEQ ID NO: 3402015 - DNA, 22 bp, Homo sapiens
acacagcctgggaccagggcat

SEQ ID NO: 3402016 - DNA, 16 bp, Homo sapiens
acacatctctgtcagt

SEQ ID NO: 3402017 - DNA, 13 bp, Homo sapiens
acaccagagcaga

SEQ ID NO: 3402018 - DNA, 19 bp, Homo sapiens
acaccagagcagatgcaga

SEQ ID NO: 3402019 - DNA, 21 bp, Homo sapiens
acaccaggcttgcctgcaggc

SEQ ID NO: 3402020 - DNA, 18 bp, Homo sapiens
acacgagcgaatgattta

SEQ ID NO: 3402021 - DNA, 20 bp, Homo sapiens
acactgagaatgtaagaact

SEQ ID NO: 3402022 - DNA, 12 bp, Homo sapiens
acagaacagctt

SEQ ID NO: 3402023 - DNA, 13 bp, Homo sapiens
acagaacagcttc

SEQ ID NO: 3402024 - DNA, 15 bp, Homo sapiens
acagaacagcttcag

SEQ ID NO: 3402025 - DNA, 20 bp, Homo sapiens
acagaagaaggcagcaggtg

SEQ ID NO: 3402026 - DNA, 13 bp, Homo sapiens
acagaagcagctc

SEQ ID NO: 3402027 - DNA, 15 bp, Homo sapiens
acagaagcagctctt

SEQ ID NO: 3402028 - DNA, 17 bp, Homo sapiens
acagaagccaagctccc

SEQ ID NO: 3402029 - DNA, 18 bp, Homo sapiens
acagacccaaaccatacc

SEQ ID NO: 3402030 - DNA, 20 bp, Homo sapiens
acagactgttgtccctgcac

SEQ ID NO: 3402031 - DNA, 23 bp, Homo sapiens
acagagccttctgaggacattcc

SEQ ID NO: 3402032 - DNA, 14 bp, Homo sapiens
acagagctgggatg

SEQ ID NO: 3402033 - DNA, 20 bp, Homo sapiens
acagataagcaagagagatg

SEQ ID NO: 3402034 - DNA, 21 bp, Homo sapiens
acagataagcaagagagatgt

SEQ ID NO: 3402035 - DNA, 20 bp, Homo sapiens
acagatgtagatataaatat

SEQ ID NO: 3402036 - DNA, 14 bp, Homo sapiens
acagatgtccctga

SEQ ID NO: 3402037 - DNA, 12 bp, Homo sapiens
acagatgttatt

SEQ ID NO: 3402038 - DNA, 13 bp, Homo sapiens
acagatgttattt

SEQ ID NO: 3402039 - DNA, 14 bp, Homo sapiens
acagatgttatttt

SEQ ID NO: 3402040 - DNA, 21 bp, Homo sapiens
acagatgttatttttgtattt

SEQ ID NO: 3402041 - DNA, 22 bp, Homo sapiens
acagcaggattggatgttgtgt

SEQ ID NO: 3402042 - DNA, 13 bp, Homo sapiens
acagcatgtgtat

SEQ ID NO: 3402043 - DNA, 12 bp, Homo sapiens
acagctcttgtt

SEQ ID NO: 3402044 - DNA, 20 bp, Homo sapiens
acagctttcttattcagtga

SEQ ID NO: 3402045 - DNA, 17 bp, Homo sapiens
acagctttgataatgtc

SEQ ID NO: 3402046 - DNA, 15 bp, Homo sapiens
acaggaattttaaaa

SEQ ID NO: 3402047 - DNA, 21 bp, Homo sapiens
acaggcctgagatttcatctg

SEQ ID NO: 3402048 - DNA, 15 bp, Homo sapiens
acagggataccttaa

SEQ ID NO: 3402049 - DNA, 13 bp, Homo sapiens
acagggcacaggc

SEQ ID NO: 3402050 - DNA, 14 bp, Homo sapiens
acaggtctcctctt

SEQ ID NO: 3402051 - DNA, 15 bp, Homo sapiens
acaggtttgtttctt

SEQ ID NO: 3402052 - DNA, 16 bp, Homo sapiens
acagtattcccactct

SEQ ID NO: 3402053 - DNA, 15 bp, Homo sapiens
acagtcagcacagaa

SEQ ID NO: 3402054 - DNA, 16 bp, Homo sapiens
acagtctcaattttgt

SEQ ID NO: 3402055 - DNA, 17 bp, Homo sapiens
acagtctcaattttgta

SEQ ID NO: 3402056 - DNA, 15 bp, Homo sapiens
acagtgaaagtcaat

SEQ ID NO: 3402057 - DNA, 10 bp, Homo sapiens
acagtgcaag

SEQ ID NO: 3402058 - DNA, 18 bp, Homo sapiens
acagtggcaggacaggaa

SEQ ID NO: 3402059 - DNA, 19 bp, Homo sapiens
acagtgtgaataaagtgct

SEQ ID NO: 3402060 - DNA, 16 bp, Homo sapiens
acagttcataaatttg

SEQ ID NO: 3402061 - DNA, 16 bp, Homo sapiens
acagttctgtaatgta

SEQ ID NO: 3402062 - DNA, 12 bp, Homo sapiens
acagtttcttag

SEQ ID NO: 3402063 - DNA, 20 bp, Homo sapiens
acagtttcttagctttttaa

SEQ ID NO: 3402064 - DNA, 22 bp, Homo sapiens
acagtttcttagctttttaatt

SEQ ID NO: 3402065 - DNA, 21 bp, Homo sapiens
acataacaacctttcccattt

SEQ ID NO: 3402066 - DNA, 16 bp, Homo sapiens
acataacgtttttcct

SEQ ID NO: 3402067 - DNA, 20 bp, Homo sapiens
acataacgtttttcctttaa

SEQ ID NO: 3402068 - DNA, 23 bp, Homo sapiens
acataacgtttttcctttaaaaa

SEQ ID NO: 3402069 - DNA, 19 bp, Homo sapiens
acatacagagattgtagta

SEQ ID NO: 3402070 - DNA, 20 bp, Homo sapiens
acataggtaggtatctttat

SEQ ID NO: 3402071 - DNA, 21 bp, Homo sapiens
acatagttgaaaaaagaagtt

SEQ ID NO: 3402072 - DNA, 15 bp, Homo sapiens
acatattttttatat

SEQ ID NO: 3402073 - DNA, 20 bp, Homo sapiens
acatccatttcatctatttc

SEQ ID NO: 3402074 - DNA, 16 bp, Homo sapiens
acatctaaagctttat

SEQ ID NO: 3402075 - DNA, 20 bp, Homo sapiens
acatctaaagctttatcttt

SEQ ID NO: 3402076 - DNA, 12 bp, Homo sapiens
acatctaaattg

SEQ ID NO: 3402077 - DNA, 16 bp, Homo sapiens
agcctgggaccagggc

SEQ ID NO: 3402078 - DNA, 18 bp, Homo sapiens
agcctgggaccagggcat

SEQ ID NO: 3402079 - DNA, 20 bp, Homo sapiens
agccttctgaggacattcca

SEQ ID NO: 3402080 - DNA, 20 bp, Homo sapiens
agcgccaagtggccactggc

SEQ ID NO: 3402081 - DNA, 15 bp, Homo sapiens
agcggacagtggcag

SEQ ID NO: 3402082 - DNA, 20 bp, Homo sapiens
agcggacagtggcaggacag

SEQ ID NO: 3402083 - DNA, 21 bp, Homo sapiens
agctaaagaggctgaaagagg

SEQ ID NO: 3402084 - DNA, 22 bp, Homo sapiens
agctaatctccacccaatgaat

SEQ ID NO: 3402085 - DNA, 12 bp, Homo sapiens
agctacagttgt

SEQ ID NO: 3402086 - DNA, 13 bp, Homo sapiens
agctactaatgat

SEQ ID NO: 3402087 - DNA, 12 bp, Homo sapiens
agctactgaatt

SEQ ID NO: 3402088 - DNA, 20 bp, Homo sapiens
agctactgaatttattgccg

SEQ ID NO: 3402089 - DNA, 19 bp, Homo sapiens
agctagctatttctatgta

SEQ ID NO: 3402090 - DNA, 14 bp, Homo sapiens
agctagtgccaaat

SEQ ID NO: 3402091 - DNA, 21 bp, Homo sapiens
agctagtgccaaataattgat

SEQ ID NO: 3402092 - DNA, 14 bp, Homo sapiens
agctattagccagg

SEQ ID NO: 3402093 - DNA, 18 bp, Homo sapiens
agctattagccaggatca

SEQ ID NO: 3402094 - DNA, 15 bp, Homo sapiens
agctatttctatgta

SEQ ID NO: 3402095 - DNA, 17 bp, Homo sapiens
agctctatctgcaatgt

SEQ ID NO: 3402096 - DNA, 18 bp, Homo sapiens
agctctatctgcaatgtt

SEQ ID NO: 3402097 - DNA, 15 bp, Homo sapiens
agctctgcagcaata

SEQ ID NO: 3402098 - DNA, 14 bp, Homo sapiens
agctgcaggggcat

SEQ ID NO: 3402099 - DNA, 13 bp, Homo sapiens
agctgcctggacc

SEQ ID NO: 3402100 - DNA, 14 bp, Homo sapiens
agctgcctgtgcct

SEQ ID NO: 3402101 - DNA, 17 bp, Homo sapiens
agctgctgaagggaggg

SEQ ID NO: 3402102 - DNA, 18 bp, Homo sapiens
agctggaagcactgctgt

SEQ ID NO: 3402103 - DNA, 22 bp, Homo sapiens
agctggccgcgccaaataatgt

SEQ ID NO: 3402104 - DNA, 15 bp, Homo sapiens
agctggggatgtctc

SEQ ID NO: 3402105 - DNA, 17 bp, Homo sapiens
agctggtggatggtgac

SEQ ID NO: 3402106 - DNA, 20 bp, Homo sapiens
agctgtgcacaaagtggcat

SEQ ID NO: 3402107 - DNA, 15 bp, Homo sapiens
agctgttgtacattt

SEQ ID NO: 3402108 - DNA, 20 bp, Homo sapiens
agctgttgtacatttatgat

SEQ ID NO: 3402109 - DNA, 21 bp, Homo sapiens
agctgttgtggtttttagtgc

SEQ ID NO: 3402110 - DNA, 12 bp, Homo sapiens
agcttaaagctt

SEQ ID NO: 3402111 - DNA, 22 bp, Homo sapiens
agcttagattttctgtaaatga

SEQ ID NO: 3402112 - DNA, 21 bp, Homo sapiens
agcttatttagcacattttga

SEQ ID NO: 3402113 - DNA, 14 bp, Homo sapiens
agcttcaaaaactt

SEQ ID NO: 3402114 - DNA, 16 bp, Homo sapiens
agcttcaaaaactttg

SEQ ID NO: 3402115 - DNA, 17 bp, Homo sapiens
agcttcaggatactgta

SEQ ID NO: 3402116 - DNA, 11 bp, Homo sapiens
agcttcaggtt

SEQ ID NO: 3402117 - DNA, 13 bp, Homo sapiens
agcttcaggttat

SEQ ID NO: 3402118 - DNA, 15 bp, Homo sapiens
agcttcctgtctgtt

SEQ ID NO: 3402119 - DNA, 23 bp, Homo sapiens
agcttggaaactggatgaggtca

SEQ ID NO: 3402120 - DNA, 13 bp, Homo sapiens
agctttatctttg

SEQ ID NO: 3402121 - DNA, 17 bp, Homo sapiens
agctttatctttgtgta

SEQ ID NO: 3402122 - DNA, 18 bp, Homo sapiens
agctttttgttccctcat

SEQ ID NO: 3402123 - DNA, 22 bp, Homo sapiens
agctttttgttccctcattctg

SEQ ID NO: 3402124 - DNA, 22 bp, Homo sapiens
aggaaactcttatctcagtcat

SEQ ID NO: 3402125 - DNA, 19 bp, Homo sapiens
aggaacctaattgaaattt

SEQ ID NO: 3402126 - DNA, 12 bp, Homo sapiens
aggaagaacggg

SEQ ID NO: 3402127 - DNA, 22 bp, Homo sapiens
aggaagaacggggctcttctca

SEQ ID NO: 3402128 - DNA, 13 bp, Homo sapiens
aggaaggagctgc

SEQ ID NO: 3402129 - DNA, 20 bp, Homo sapiens
aggaaggagctgcctggacc

SEQ ID NO: 3402130 - DNA, 22 bp, Homo sapiens
aggaaggagctgcctggacccg

SEQ ID NO: 3402131 - DNA, 16 bp, Homo sapiens
aggaaggattgtaaaa

SEQ ID NO: 3402132 - DNA, 13 bp, Homo sapiens
aggacaaacagtg

SEQ ID NO: 3402133 - DNA, 16 bp, Homo sapiens
aggacaaacagtgaat

SEQ ID NO: 3402134 - DNA, 12 bp, Homo sapiens
aggacagtattt

SEQ ID NO: 3402135 - DNA, 19 bp, Homo sapiens
aggacagtatttgtgggga

SEQ ID NO: 3402136 - DNA, 14 bp, Homo sapiens
aggacattccaaga

SEQ ID NO: 3402137 - DNA, 16 bp, Homo sapiens
aggacattccaagaca

SEQ ID NO: 3402138 - DNA, 14 bp, Homo sapiens
aggaccgttttgta

SEQ ID NO: 3402139 - DNA, 14 bp, Homo sapiens
aggactctgcagcc

SEQ ID NO: 3402140 - DNA, 17 bp, Homo sapiens
aggactggctgccccgt

SEQ ID NO: 3402141 - DNA, 11 bp, Homo sapiens
aggactgggcc

SEQ ID NO: 3402142 - DNA, 12 bp, Homo sapiens
aggactgggcca

SEQ ID NO: 3402143 - DNA, 15 bp, Homo sapiens
aggagaattaaactc

SEQ ID NO: 3402144 - DNA, 18 bp, Homo sapiens
aggagaggatgagagccc

SEQ ID NO: 3402145 - DNA, 21 bp, Homo sapiens
aggagaggatgagagcccaga

SEQ ID NO: 3402146 - DNA, 14 bp, Homo sapiens
aggagcccaggcca

SEQ ID NO: 3402147 - DNA, 15 bp, Homo sapiens
aggagcccaggccag

SEQ ID NO: 3402148 - DNA, 16 bp, Homo sapiens
aggagcccaggccagg

SEQ ID NO: 3402149 - DNA, 17 bp, Homo sapiens
aggagcccaggccagga

SEQ ID NO: 3402150 - DNA, 18 bp, Homo sapiens
aggagcccaggccaggac

SEQ ID NO: 3402151 - DNA, 20 bp, Homo sapiens
aggagcccaggccaggactc

SEQ ID NO: 3402152 - DNA, 20 bp, Homo sapiens
aggagctcccctccccaact

SEQ ID NO: 3402153 - DNA, 17 bp, Homo sapiens
aggagctgcctggaccc

SEQ ID NO: 3402154 - DNA, 21 bp, Homo sapiens
aggagtccctgccatcatgtt

SEQ ID NO: 3402155 - DNA, 15 bp, Homo sapiens
aggatcatggtgtaa

SEQ ID NO: 3402156 - DNA, 22 bp, Homo sapiens
aggatcatggtgtaataagaca

SEQ ID NO: 3402157 - DNA, 17 bp, Homo sapiens
aggatgagagcccagag

SEQ ID NO: 3402158 - DNA, 19 bp, Homo sapiens
aggatgagagcccagaggt

SEQ ID NO: 3402159 - DNA, 14 bp, Homo sapiens
aggatttatacata

SEQ ID NO: 3402160 - DNA, 13 bp, Homo sapiens
aggcaagcccttc

SEQ ID NO: 3402161 - DNA, 19 bp, Homo sapiens
aggcactaagaggggctgg

SEQ ID NO: 3402162 - DNA, 13 bp, Homo sapiens
aggcactgccctg

SEQ ID NO: 3402163 - DNA, 18 bp, Homo sapiens
aggcacttttattttcat

SEQ ID NO: 3402164 - DNA, 21 bp, Homo sapiens
aggcagcatgtatagttgctt

SEQ ID NO: 3402165 - DNA, 20 bp, Homo sapiens
aggcagctttttctctccca

SEQ ID NO: 3402166 - DNA, 14 bp, Homo sapiens
aggccagacctgca

SEQ ID NO: 3402167 - DNA, 18 bp, Homo sapiens
aggccaggactctgcagc

SEQ ID NO: 3402168 - DNA, 20 bp, Homo sapiens
aggccaggactctgcagcct

SEQ ID NO: 3402169 - DNA, 21 bp, Homo sapiens
aggccaggactctgcagcctc

SEQ ID NO: 3402170 - DNA, 16 bp, Homo sapiens
aggccctccacacctg

SEQ ID NO: 3402171 - DNA, 17 bp, Homo sapiens
aggccctccacacctgc

SEQ ID NO: 3402172 - DNA, 18 bp, Homo sapiens
aggccgcgcgtccagctg

SEQ ID NO: 3402173 - DNA, 13 bp, Homo sapiens
aggcctcgcagga

SEQ ID NO: 3402174 - DNA, 16 bp, Homo sapiens
aggcctgactctcagc

SEQ ID NO: 3402175 - DNA, 21 bp, Homo sapiens
aggcctgagatttcatctgct

SEQ ID NO: 3402176 - DNA, 22 bp, Homo sapiens
aggcctgagatttcatctgctc

SEQ ID NO: 3402177 - DNA, 21 bp, Homo sapiens
aggcctgagcgctcctgccgc

SEQ ID NO: 3402178 - DNA, 20 bp, Homo sapiens
aggcctgcctccagggctgg

SEQ ID NO: 3402179 - DNA, 19 bp, Homo sapiens
aggcggacaaagttcagtg

SEQ ID NO: 3402180 - DNA, 21 bp, Homo sapiens
aggctatggggatagatgtgt

SEQ ID NO: 3402181 - DNA, 16 bp, Homo sapiens
aggcttgcctgcaggc

SEQ ID NO: 3402182 - DNA, 22 bp, Homo sapiens
aggctttggcaacagaaaacaa

SEQ ID NO: 3402183 - DNA, 13 bp, Homo sapiens
agggaagttttgt

SEQ ID NO: 3402184 - DNA, 12 bp, Homo sapiens
agggagaaatgc

SEQ ID NO: 3402185 - DNA, 12 bp, Homo sapiens
agggagagccca

SEQ ID NO: 3402186 - DNA, 16 bp, Homo sapiens
agggagtgtactccca

SEQ ID NO: 3402187 - DNA, 15 bp, Homo sapiens
agggatggaaaagga

SEQ ID NO: 3402188 - DNA, 14 bp, Homo sapiens
agggcacaggccat

SEQ ID NO: 3402189 - DNA, 15 bp, Homo sapiens
atgaagtataaatct

SEQ ID NO: 3402190 - DNA, 16 bp, Homo sapiens
atgaagtataaatctg

SEQ ID NO: 3402191 - DNA, 13 bp, Homo sapiens
atgaatatatggc

SEQ ID NO: 3402192 - DNA, 16 bp, Homo sapiens
atgaatgagttttaca

SEQ ID NO: 3402193 - DNA, 20 bp, Homo sapiens
atgaatgagttttacaaatt

SEQ ID NO: 3402194 - DNA, 23 bp, Homo sapiens
atgacgagacctcagatgtgttg

SEQ ID NO: 3402195 - DNA, 16 bp, Homo sapiens
atgacggaagaacata

SEQ ID NO: 3402196 - DNA, 14 bp, Homo sapiens
atgactaaagagag

SEQ ID NO: 3402197 - DNA, 19 bp, Homo sapiens
atgactaaagagagaatgt

SEQ ID NO: 3402198 - DNA, 12 bp, Homo sapiens
atgactaaagta

SEQ ID NO: 3402199 - DNA, 18 bp, Homo sapiens
atgactgagtctggcaaa

SEQ ID NO: 3402200 - DNA, 13 bp, Homo sapiens
atgagaacatggt

SEQ ID NO: 3402201 - DNA, 15 bp, Homo sapiens
atgagaagtactttg

SEQ ID NO: 3402202 - DNA, 12 bp, Homo sapiens
atgagaatgtat

SEQ ID NO: 3402203 - DNA, 13 bp, Homo sapiens
atgagaatgtatt

SEQ ID NO: 3402204 - DNA, 14 bp, Homo sapiens
atgagacacaggat

SEQ ID NO: 3402205 - DNA, 21 bp, Homo sapiens
atgagacttaattttgtcttt

SEQ ID NO: 3402206 - DNA, 13 bp, Homo sapiens
atgagagcccaga

SEQ ID NO: 3402207 - DNA, 14 bp, Homo sapiens
atgagagcccagag

SEQ ID NO: 3402208 - DNA, 18 bp, Homo sapiens
atgagagcccagaggtaa

SEQ ID NO: 3402209 - DNA, 22 bp, Homo sapiens
atgagatttactgctctagaaa

SEQ ID NO: 3402210 - DNA, 19 bp, Homo sapiens
atgagatttctttgaatgt

SEQ ID NO: 3402211 - DNA, 21 bp, Homo sapiens
atgagatttctttgaatgtat

SEQ ID NO: 3402212 - DNA, 22 bp, Homo sapiens
atgagatttctttgaatgtatt

SEQ ID NO: 3402213 - DNA, 14 bp, Homo sapiens
atgaggccctccac

SEQ ID NO: 3402214 - DNA, 19 bp, Homo sapiens
atgaggccctccacacctg

SEQ ID NO: 3402215 - DNA, 18 bp, Homo sapiens
atgagttacttagaatgc

SEQ ID NO: 3402216 - DNA, 21 bp, Homo sapiens
atgagttttacaaattccttt

SEQ ID NO: 3402217 - DNA, 16 bp, Homo sapiens
atgatacccaacagtt

SEQ ID NO: 3402218 - DNA, 17 bp, Homo sapiens
atgatacccaacagttt

SEQ ID NO: 3402219 - DNA, 19 bp, Homo sapiens
atgatacccaacagtttat

SEQ ID NO: 3402220 - DNA, 18 bp, Homo sapiens
atgatcaacataatggac

SEQ ID NO: 3402221 - DNA, 21 bp, Homo sapiens
atgatgcatggagtgtttgac

SEQ ID NO: 3402222 - DNA, 14 bp, Homo sapiens
atgatttaataaaa

SEQ ID NO: 3402223 - DNA, 16 bp, Homo sapiens
atgatttaataaaata

SEQ ID NO: 3402224 - DNA, 19 bp, Homo sapiens
atgatttaataaaataatt

SEQ ID NO: 3402225 - DNA, 14 bp, Homo sapiens
atgcaaactgcttt

SEQ ID NO: 3402226 - DNA, 18 bp, Homo sapiens
atgcaataaaattatttg

SEQ ID NO: 3402227 - DNA, 19 bp, Homo sapiens
atgcaataaaattatttgc

SEQ ID NO: 3402228 - DNA, 22 bp, Homo sapiens
atgcaataaaattatttgcagg

SEQ ID NO: 3402229 - DNA, 14 bp, Homo sapiens
atgcaatgataaat

SEQ ID NO: 3402230 - DNA, 19 bp, Homo sapiens
atgcaatgataaataaagt

SEQ ID NO: 3402231 - DNA, 14 bp, Homo sapiens
atgcacgttaacag

SEQ ID NO: 3402232 - DNA, 13 bp, Homo sapiens
atgcagagagcca

SEQ ID NO: 3402233 - DNA, 14 bp, Homo sapiens
atgcagagagccat

SEQ ID NO: 3402234 - DNA, 18 bp, Homo sapiens
atgcagtgatatggcaga

SEQ ID NO: 3402235 - DNA, 14 bp, Homo sapiens
atgcataaatatgc

SEQ ID NO: 3402236 - DNA, 14 bp, Homo sapiens
atgcatagagcaat

SEQ ID NO: 3402237 - DNA, 17 bp, Homo sapiens
atgcatatcctgagcca

SEQ ID NO: 3402238 - DNA, 22 bp, Homo sapiens
atgcatggagtgtttgacgaag

SEQ ID NO: 3402239 - DNA, 17 bp, Homo sapiens
atgcatttgaggtcaag

SEQ ID NO: 3402240 - DNA, 19 bp, Homo sapiens
atgccaggcggacaaagtt

SEQ ID NO: 3402241 - DNA, 19 bp, Homo sapiens
atgccatggacagaagaag

SEQ ID NO: 3402242 - DNA, 14 bp, Homo sapiens
atgcccatgaacaa

SEQ ID NO: 3402243 - DNA, 14 bp, Homo sapiens
atgcctttgagaca

SEQ ID NO: 3402244 - DNA, 16 bp, Homo sapiens
atgcctttgagacagt

SEQ ID NO: 3402245 - DNA, 17 bp, Homo sapiens
atgcgggcattttgaat

SEQ ID NO: 3402246 - DNA, 16 bp, Homo sapiens
atgcgtcttgtgaaat

SEQ ID NO: 3402247 - DNA, 23 bp, Homo sapiens
atgctaaaggttgtattgcatat

SEQ ID NO: 3402248 - DNA, 22 bp, Homo sapiens
atgctgctaaagggagaaatgc

SEQ ID NO: 3402249 - DNA, 12 bp, Homo sapiens
atgctgtatttc

SEQ ID NO: 3402250 - DNA, 14 bp, Homo sapiens
atgctgtatttctt

SEQ ID NO: 3402251 - DNA, 22 bp, Homo sapiens
atgctgtatttctttgtagaat

SEQ ID NO: 3402252 - DNA, 16 bp, Homo sapiens
atgcttcctgacaatc

SEQ ID NO: 3402253 - DNA, 12 bp, Homo sapiens
atggaaaaggaa

SEQ ID NO: 3402254 - DNA, 12 bp, Homo sapiens
atggaacagtga

SEQ ID NO: 3402255 - DNA, 15 bp, Homo sapiens
atggacaatggaccg

SEQ ID NO: 3402256 - DNA, 19 bp, Homo sapiens
atggacagaagaaggcagc

SEQ ID NO: 3402257 - DNA, 19 bp, Homo sapiens
atggacatcgatatgaaaa

SEQ ID NO: 3402258 - DNA, 16 bp, Homo sapiens
atggaccggagagtgg

SEQ ID NO: 3402259 - DNA, 20 bp, Homo sapiens
atggaccggagagtgggggt

SEQ ID NO: 3402260 - DNA, 18 bp, Homo sapiens
atggatatagaaaatctt

SEQ ID NO: 3402261 - DNA, 21 bp, Homo sapiens
atggatggaaaacgctctcta

SEQ ID NO: 3402262 - DNA, 17 bp, Homo sapiens
atggatttggttatgat

SEQ ID NO: 3402263 - DNA, 17 bp, Homo sapiens
atggcagaagacaccag

SEQ ID NO: 3402264 - DNA, 20 bp, Homo sapiens
atggcagaagacaccagagc

SEQ ID NO: 3402265 - DNA, 22 bp, Homo sapiens
atggcagaagacaccagagcag

SEQ ID NO: 3402266 - DNA, 22 bp, Homo sapiens
atggcattaattgttccttgct

SEQ ID NO: 3402267 - DNA, 14 bp, Homo sapiens
atggcatttgcaga

SEQ ID NO: 3402268 - DNA, 17 bp, Homo sapiens
atggcatttgcagattt

SEQ ID NO: 3402269 - DNA, 21 bp, Homo sapiens
atggctataaacaattacatg

SEQ ID NO: 3402270 - DNA, 18 bp, Homo sapiens
atgggaaggtgggcgggc

SEQ ID NO: 3402271 - DNA, 15 bp, Homo sapiens
atgggcttcactgta

SEQ ID NO: 3402272 - DNA, 22 bp, Homo sapiens
atgggtccagaagaccccactt

SEQ ID NO: 3402273 - DNA, 24 bp, Homo sapiens
atgggtccagaagaccccacttca

SEQ ID NO: 3402274 - DNA, 17 bp, Homo sapiens
atggtactaaggagaat

SEQ ID NO: 3402275 - DNA, 18 bp, Homo sapiens
atggtagggtataatgtg

SEQ ID NO: 3402276 - DNA, 22 bp, Homo sapiens
atggtagggtataatgtgtctg

SEQ ID NO: 3402277 - DNA, 15 bp, Homo sapiens
atggtgacttttgaa

SEQ ID NO: 3402278 - DNA, 17 bp, Homo sapiens
atggtgtgtgtctctga

SEQ ID NO: 3402279 - DNA, 18 bp, Homo sapiens
atggtttgcaaggaagcc

SEQ ID NO: 3402280 - DNA, 21 bp, Homo sapiens
atgtaaaatcttcagctggtg

SEQ ID NO: 3402281 - DNA, 24 bp, Homo sapiens
atgtaaaatcttcagctggtggat

SEQ ID NO: 3402282 - DNA, 19 bp, Homo sapiens
atgtaataaaaagtatatg

SEQ ID NO: 3402283 - DNA, 17 bp, Homo sapiens
atgtacaggatgctttg

SEQ ID NO: 3402284 - DNA, 20 bp, Homo sapiens
atgtacaggatgctttggtt

SEQ ID NO: 3402285 - DNA, 15 bp, Homo sapiens
atgtactggagagtg

SEQ ID NO: 3402286 - DNA, 12 bp, Homo sapiens
atgtacttaaat

SEQ ID NO: 3402287 - DNA, 23 bp, Homo sapiens
atgtagatattgtgaagtacata

SEQ ID NO: 3402288 - DNA, 18 bp, Homo sapiens
atgtatgtgccaattttg

SEQ ID NO: 3402289 - DNA, 17 bp, Homo sapiens
atgtatgtggatacagt

SEQ ID NO: 3402290 - DNA, 21 bp, Homo sapiens
atgtattaaacttttcattac

SEQ ID NO: 3402291 - DNA, 15 bp, Homo sapiens
atgtcaaattgtcag

SEQ ID NO: 3402292 - DNA, 23 bp, Homo sapiens
atgtcacacttgtttcttgttca

SEQ ID NO: 3402293 - DNA, 12 bp, Homo sapiens
atgtcatttctc

SEQ ID NO: 3402294 - DNA, 17 bp, Homo sapiens
atgtcctcaaagaagtg

SEQ ID NO: 3402295 - DNA, 17 bp, Homo sapiens
atgtccttcagctgact

SEQ ID NO: 3402296 - DNA, 19 bp, Homo sapiens
atgtctctgacaaagtgtg

SEQ ID NO: 3402297 - DNA, 23 bp, Homo sapiens
atgtctctgtgagactcgagaac

SEQ ID NO: 3402298 - DNA, 19 bp, Homo sapiens
atgtctgtagctcctcaac

SEQ ID NO: 3402299 - DNA, 21 bp, Homo sapiens
atgtgaaaccttttttaagat

SEQ ID NO: 3402300 - DNA, 20 bp, Homo sapiens
atttaaaattgtgatgtgtc

SEQ ID NO: 3402301 - DNA, 19 bp, Homo sapiens
atttaaatagaacttgatt

SEQ ID NO: 3402302 - DNA, 14 bp, Homo sapiens
atttaaattggtca

SEQ ID NO: 3402303 - DNA, 14 bp, Homo sapiens
atttaaattgttat

SEQ ID NO: 3402304 - DNA, 17 bp, Homo sapiens
atttaagcatgagtggc

SEQ ID NO: 3402305 - DNA, 21 bp, Homo sapiens
atttaagtgcgtgtgtagagt

SEQ ID NO: 3402306 - DNA, 15 bp, Homo sapiens
atttaataacattac

SEQ ID NO: 3402307 - DNA, 18 bp, Homo sapiens
atttaataacattacctt

SEQ ID NO: 3402308 - DNA, 24 bp, Homo sapiens
atttaatgatttttgtgtatccag

SEQ ID NO: 3402309 - DNA, 19 bp, Homo sapiens
atttacccaactctgtaca

SEQ ID NO: 3402310 - DNA, 14 bp, Homo sapiens
atttactacagttt

SEQ ID NO: 3402311 - DNA, 18 bp, Homo sapiens
atttactttttaaacagt

SEQ ID NO: 3402312 - DNA, 23 bp, Homo sapiens
atttagagcgtttggttaaagta

SEQ ID NO: 3402313 - DNA, 14 bp, Homo sapiens
atttagcacatttt

SEQ ID NO: 3402314 - DNA, 18 bp, Homo sapiens
atttagccaataaagaaa

SEQ ID NO: 3402315 - DNA, 12 bp, Homo sapiens
atttaggagaag

SEQ ID NO: 3402316 - DNA, 19 bp, Homo sapiens
atttaggtaaataaagctc

SEQ ID NO: 3402317 - DNA, 15 bp, Homo sapiens
atttatacatacaga

SEQ ID NO: 3402318 - DNA, 16 bp, Homo sapiens
atttatattcatcaaa

SEQ ID NO: 3402319 - DNA, 13 bp, Homo sapiens
atttatgatttaa

SEQ ID NO: 3402320 - DNA, 17 bp, Homo sapiens
atttatgatttaataaa

SEQ ID NO: 3402321 - DNA, 20 bp, Homo sapiens
atttatgtagatgtgcattt

SEQ ID NO: 3402322 - DNA, 13 bp, Homo sapiens
atttattatataa

SEQ ID NO: 3402323 - DNA, 14 bp, Homo sapiens
atttcaaaatgctt

SEQ ID NO: 3402324 - DNA, 21 bp, Homo sapiens
atttcaatttccaagagctga

SEQ ID NO: 3402325 - DNA, 23 bp, Homo sapiens
atttcaccactcaaaggccagac

SEQ ID NO: 3402326 - DNA, 21 bp, Homo sapiens
atttcagatgattcaaatatc

SEQ ID NO: 3402327 - DNA, 23 bp, Homo sapiens
atttcagatgattcaaatatcaa

SEQ ID NO: 3402328 - DNA, 15 bp, Homo sapiens
atttcagtattttcc

SEQ ID NO: 3402329 - DNA, 17 bp, Homo sapiens
atttcagtattttccag

SEQ ID NO: 3402330 - DNA, 14 bp, Homo sapiens
atttcatctatttc

SEQ ID NO: 3402331 - DNA, 16 bp, Homo sapiens
atttcatctatttctg

SEQ ID NO: 3402332 - DNA, 11 bp, Homo sapiens
atttcatctgc

SEQ ID NO: 3402333 - DNA, 17 bp, Homo sapiens
atttcatctgctctcct

SEQ ID NO: 3402334 - DNA, 14 bp, Homo sapiens
atttcattcctaac

SEQ ID NO: 3402335 - DNA, 18 bp, Homo sapiens
atttccaaaataatctat

SEQ ID NO: 3402336 - DNA, 21 bp, Homo sapiens
atttccttcaccacctcatgt

SEQ ID NO: 3402337 - DNA, 14 bp, Homo sapiens
atttcgatgtacag

SEQ ID NO: 3402338 - DNA, 20 bp, Homo sapiens
atttcgtgtaatattctctg

SEQ ID NO: 3402339 - DNA, 16 bp, Homo sapiens
atttctctggcaaact

SEQ ID NO: 3402340 - DNA, 21 bp, Homo sapiens
atttctttaatctgttgtttg

SEQ ID NO: 3402341 - DNA, 22 bp, Homo sapiens
atttctttaatctgttgtttga

SEQ ID NO: 3402342 - DNA, 13 bp, Homo sapiens
atttcttttgtgc

SEQ ID NO: 3402343 - DNA, 15 bp, Homo sapiens
atttgaaaaactttt

SEQ ID NO: 3402344 - DNA, 21 bp, Homo sapiens
atttgaggtctacattcttgg

SEQ ID NO: 3402345 - DNA, 14 bp, Homo sapiens
atttgagtttgctg

SEQ ID NO: 3402346 - DNA, 20 bp, Homo sapiens
atttgatctttgtttaaatg

SEQ ID NO: 3402347 - DNA, 22 bp, Homo sapiens
atttgatctttgtttaaatgcc

SEQ ID NO: 3402348 - DNA, 16 bp, Homo sapiens
atttgatttcgatgta

SEQ ID NO: 3402349 - DNA, 15 bp, Homo sapiens
atttgccatgggctt

SEQ ID NO: 3402350 - DNA, 20 bp, Homo sapiens
atttgctatgagctggggat

SEQ ID NO: 3402351 - DNA, 14 bp, Homo sapiens
atttgctgtgacta

SEQ ID NO: 3402352 - DNA, 21 bp, Homo sapiens
atttggagcattaactaaatg

SEQ ID NO: 3402353 - DNA, 17 bp, Homo sapiens
atttggcttctgttgtc

SEQ ID NO: 3402354 - DNA, 16 bp, Homo sapiens
atttgtaaggcttgtt

SEQ ID NO: 3402355 - DNA, 17 bp, Homo sapiens
atttgtaagtttcaggt

SEQ ID NO: 3402356 - DNA, 22 bp, Homo sapiens
atttgttgcaccaattaagtgt

SEQ ID NO: 3402357 - DNA, 18 bp, Homo sapiens
atttgttgtcatgtgtat

SEQ ID NO: 3402358 - DNA, 12 bp, Homo sapiens
attttaaaaata

SEQ ID NO: 3402359 - DNA, 19 bp, Homo sapiens
attttaaaaatacattttt

SEQ ID NO: 3402360 - DNA, 18 bp, Homo sapiens
attttaaatatttgttct

SEQ ID NO: 3402361 - DNA, 15 bp, Homo sapiens
attttaggaaaggat

SEQ ID NO: 3402362 - DNA, 13 bp, Homo sapiens
attttatctttga

SEQ ID NO: 3402363 - DNA, 21 bp, Homo sapiens
attttatctttgattctcctt

SEQ ID NO: 3402364 - DNA, 21 bp, Homo sapiens
attttatgccttttatttctt

SEQ ID NO: 3402365 - DNA, 13 bp, Homo sapiens
attttatttctga

SEQ ID NO: 3402366 - DNA, 16 bp, Homo sapiens
attttatttctgatgt

SEQ ID NO: 3402367 - DNA, 20 bp, Homo sapiens
attttcacaggtttgtttct

SEQ ID NO: 3402368 - DNA, 16 bp, Homo sapiens
attttcagcatcaaac

SEQ ID NO: 3402369 - DNA, 19 bp, Homo sapiens
attttcagcatcaaacatg

SEQ ID NO: 3402370 - DNA, 13 bp, Homo sapiens
attttcattgtga

SEQ ID NO: 3402371 - DNA, 17 bp, Homo sapiens
attttctgtaaatgaag

SEQ ID NO: 3402372 - DNA, 14 bp, Homo sapiens
attttgaatgtgat

SEQ ID NO: 3402373 - DNA, 20 bp, Homo sapiens
attttgagggtgtaaccagt

SEQ ID NO: 3402374 - DNA, 19 bp, Homo sapiens
attttgcataataaatgct

SEQ ID NO: 3402375 - DNA, 16 bp, Homo sapiens
attttgccatttagcg

SEQ ID NO: 3402376 - DNA, 16 bp, Homo sapiens
attttggatttcttta

SEQ ID NO: 3402377 - DNA, 16 bp, Homo sapiens
attttggttttgttcc

SEQ ID NO: 3402378 - DNA, 17 bp, Homo sapiens
attttggttttgttccc

SEQ ID NO: 3402379 - DNA, 20 bp, Homo sapiens
attttgtcacagctcttgtt

SEQ ID NO: 3402380 - DNA, 12 bp, Homo sapiens
attttgttctga

SEQ ID NO: 3402381 - DNA, 14 bp, Homo sapiens
atttttaaaaaaca

SEQ ID NO: 3402382 - DNA, 17 bp, Homo sapiens
atttttaaaaaacaatt

SEQ ID NO: 3402383 - DNA, 14 bp, Homo sapiens
atttttattattat

SEQ ID NO: 3402384 - DNA, 12 bp, Homo sapiens
atttttctcatg

SEQ ID NO: 3402385 - DNA, 16 bp, Homo sapiens
atttttgtgtatccag

SEQ ID NO: 3402386 - DNA, 13 bp, Homo sapiens
atttttttgttgt

SEQ ID NO: 3402387 - DNA, 19 bp, Homo sapiens
atttttttttaagctctga

SEQ ID NO: 3402388 - DNA, 21 bp, Homo sapiens
atttttttttaagctctgagc

SEQ ID NO: 3402389 - DNA, 20 bp, Homo sapiens
caaaaatcaacctatcaaag

SEQ ID NO: 3402390 - DNA, 22 bp, Homo sapiens
caaaaattgcgagcctttaccc

SEQ ID NO: 3402391 - DNA, 18 bp, Homo sapiens
caaaacttaaaagcaaga

SEQ ID NO: 3402392 - DNA, 14 bp, Homo sapiens
caaaagaagaaata

SEQ ID NO: 3402393 - DNA, 22 bp, Homo sapiens
caaaagaagaaataaataatct

SEQ ID NO: 3402394 - DNA, 19 bp, Homo sapiens
caaaagcaggcttgtgctt

SEQ ID NO: 3402395 - DNA, 11 bp, Homo sapiens
caaaagtctga

SEQ ID NO: 3402396 - DNA, 18 bp, Homo sapiens
caaaagtgacagatgtta

SEQ ID NO: 3402397 - DNA, 21 bp, Homo sapiens
caaaataaaaagcctcagtga

SEQ ID NO: 3402398 - DNA, 16 bp, Homo sapiens
caaaatgtacttaaat

SEQ ID NO: 3402399 - DNA, 17 bp, Homo sapiens
caaaatgtacttaaatg

SEQ ID NO: 3402400 - DNA, 18 bp, Homo sapiens
caaaatgtacttaaatga

SEQ ID NO: 3402401 - DNA, 15 bp, Homo sapiens
caaaatgtcacactt

SEQ ID NO: 3402402 - DNA, 22 bp, Homo sapiens
caaaatgtcacacttgtttctt

SEQ ID NO: 3402403 - DNA, 22 bp, Homo sapiens
caaaatgtctgtagctcctcaa

SEQ ID NO: 3402404 - DNA, 16 bp, Homo sapiens
caaaatttcacagttc

SEQ ID NO: 3402405 - DNA, 15 bp, Homo sapiens
caaacaaaatttcta

SEQ ID NO: 3402406 - DNA, 13 bp, Homo sapiens
caaacagtgaatt

SEQ ID NO: 3402407 - DNA, 22 bp, Homo sapiens
caaacagtgaatttaagcatga

SEQ ID NO: 3402408 - DNA, 14 bp, Homo sapiens
caaacatgtgcaac

SEQ ID NO: 3402409 - DNA, 17 bp, Homo sapiens
caaaccactttttgcag

SEQ ID NO: 3402410 - DNA, 21 bp, Homo sapiens
caaaccttaaacacccagaag

SEQ ID NO: 3402411 - DNA, 12 bp, Homo sapiens
caaaccttcaca

SEQ ID NO: 3402412 - DNA, 23 bp, Homo sapiens
catctaaagctttatctttgtgt

SEQ ID NO: 3402413 - DNA, 14 bp, Homo sapiens
catctatttctgag

SEQ ID NO: 3402414 - DNA, 15 bp, Homo sapiens
catctatttctgaga

SEQ ID NO: 3402415 - DNA, 16 bp, Homo sapiens
catctatttctgagaa

SEQ ID NO: 3402416 - DNA, 20 bp, Homo sapiens
catctccagtatcctgctgg

SEQ ID NO: 3402417 - DNA, 14 bp, Homo sapiens
catctctgtcagtg

SEQ ID NO: 3402418 - DNA, 19 bp, Homo sapiens
catctcttagctcccctcc

SEQ ID NO: 3402419 - DNA, 13 bp, Homo sapiens
catctgctctcct

SEQ ID NO: 3402420 - DNA, 14 bp, Homo sapiens
catctgctctcctt

SEQ ID NO: 3402421 - DNA, 14 bp, Homo sapiens
catcttagtgcctg

SEQ ID NO: 3402422 - DNA, 21 bp, Homo sapiens
catcttcacttctaaatgcat

SEQ ID NO: 3402423 - DNA, 22 bp, Homo sapiens
catcttctttttgaaatcagca

SEQ ID NO: 3402424 - DNA, 18 bp, Homo sapiens
catcttggccctcctcag

SEQ ID NO: 3402425 - DNA, 23 bp, Homo sapiens
catctttgctgaatgtcattatt

SEQ ID NO: 3402426 - DNA, 14 bp, Homo sapiens
catctttgtgaagg

SEQ ID NO: 3402427 - DNA, 14 bp, Homo sapiens
catcttttcttgcc

SEQ ID NO: 3402428 - DNA, 21 bp, Homo sapiens
catcttttcttgcctctgtcc

SEQ ID NO: 3402429 - DNA, 13 bp, Homo sapiens
catgaaaaagcag

SEQ ID NO: 3402430 - DNA, 15 bp, Homo sapiens
catgaaaaagcagct

SEQ ID NO: 3402431 - DNA, 13 bp, Homo sapiens
catgaaaacattg

SEQ ID NO: 3402432 - DNA, 15 bp, Homo sapiens
catgaaaacattgat

SEQ ID NO: 3402433 - DNA, 15 bp, Homo sapiens
catgaaaatgcaaca

SEQ ID NO: 3402434 - DNA, 15 bp, Homo sapiens
catgaaggtttctga

SEQ ID NO: 3402435 - DNA, 22 bp, Homo sapiens
catgcaaactgctttattttcc

SEQ ID NO: 3402436 - DNA, 13 bp, Homo sapiens
catgcaggtctcc

SEQ ID NO: 3402437 - DNA, 13 bp, Homo sapiens
catgcataaatat

SEQ ID NO: 3402438 - DNA, 17 bp, Homo sapiens
catgcatttgaggtcaa

SEQ ID NO: 3402439 - DNA, 17 bp, Homo sapiens
catgctcatgtatattt

SEQ ID NO: 3402440 - DNA, 22 bp, Homo sapiens
catgctgtttatgacacaatga

SEQ ID NO: 3402441 - DNA, 18 bp, Homo sapiens
catggacaatggaccgga

SEQ ID NO: 3402442 - DNA, 22 bp, Homo sapiens
catggattccaaagcattttca

SEQ ID NO: 3402443 - DNA, 22 bp, Homo sapiens
catgggacctataactgcccag

SEQ ID NO: 3402444 - DNA, 13 bp, Homo sapiens
catgggcttcact

SEQ ID NO: 3402445 - DNA, 16 bp, Homo sapiens
catgggcttcactgta

SEQ ID NO: 3402446 - DNA, 20 bp, Homo sapiens
catgggcttcactgtataaa

SEQ ID NO: 3402447 - DNA, 12 bp, Homo sapiens
catggggaggag

SEQ ID NO: 3402448 - DNA, 18 bp, Homo sapiens
catggggaggaggagggt

SEQ ID NO: 3402449 - DNA, 13 bp, Homo sapiens
catgggggagggg

SEQ ID NO: 3402450 - DNA, 15 bp, Homo sapiens
catggtgtaataaga

SEQ ID NO: 3402451 - DNA, 17 bp, Homo sapiens
catggtgtgtgtctctg

SEQ ID NO: 3402452 - DNA, 17 bp, Homo sapiens
catgtaaaatcttcagc

SEQ ID NO: 3402453 - DNA, 12 bp, Homo sapiens
catgtaataaaa

SEQ ID NO: 3402454 - DNA, 15 bp, Homo sapiens
catgtacaaaaccat

SEQ ID NO: 3402455 - DNA, 22 bp, Homo sapiens
catgtatgtggatacagtcatt

SEQ ID NO: 3402456 - DNA, 19 bp, Homo sapiens
catgtattagccagtcatt

SEQ ID NO: 3402457 - DNA, 18 bp, Homo sapiens
catgtgaaacctttttta

SEQ ID NO: 3402458 - DNA, 21 bp, Homo sapiens
catgtgaaaccttttttaaga

SEQ ID NO: 3402459 - DNA, 24 bp, Homo sapiens
catgtgaaaccttttttaagattt

SEQ ID NO: 3402460 - DNA, 17 bp, Homo sapiens
catgtgattatggacat

SEQ ID NO: 3402461 - DNA, 20 bp, Homo sapiens
catgtgctacaggggccaga

SEQ ID NO: 3402462 - DNA, 14 bp, Homo sapiens
catgtgtatgagaa

SEQ ID NO: 3402463 - DNA, 15 bp, Homo sapiens
catgttacttgagaa

SEQ ID NO: 3402464 - DNA, 18 bp, Homo sapiens
catgttctgtcccttgcc

SEQ ID NO: 3402465 - DNA, 20 bp, Homo sapiens
catgttggttgcactttgta

SEQ ID NO: 3402466 - DNA, 21 bp, Homo sapiens
catgttggttgcactttgtag

SEQ ID NO: 3402467 - DNA, 22 bp, Homo sapiens
catgttggttgcactttgtagt

SEQ ID NO: 3402468 - DNA, 18 bp, Homo sapiens
catgttgtgcctccctgg

SEQ ID NO: 3402469 - DNA, 19 bp, Homo sapiens
catgttgtgcctccctggt

SEQ ID NO: 3402470 - DNA, 17 bp, Homo sapiens
cattagattatcaaaaa

SEQ ID NO: 3402471 - DNA, 21 bp, Homo sapiens
cattagattatcaaaaagtat

SEQ ID NO: 3402472 - DNA, 18 bp, Homo sapiens
cattagtgttctttatat

SEQ ID NO: 3402473 - DNA, 23 bp, Homo sapiens
cattagtgttctttatatacctt

SEQ ID NO: 3402474 - DNA, 13 bp, Homo sapiens
cattatgattctt

SEQ ID NO: 3402475 - DNA, 14 bp, Homo sapiens
cattatgattcttt

SEQ ID NO: 3402476 - DNA, 13 bp, Homo sapiens
cattatttgataa

SEQ ID NO: 3402477 - DNA, 21 bp, Homo sapiens
cattatttgataacattttgt

SEQ ID NO: 3402478 - DNA, 13 bp, Homo sapiens
cattcacatttca

SEQ ID NO: 3402479 - DNA, 21 bp, Homo sapiens
cattcagctgaggttcattac

SEQ ID NO: 3402480 - DNA, 16 bp, Homo sapiens
cattcatgttttaaaa

SEQ ID NO: 3402481 - DNA, 13 bp, Homo sapiens
cattccaagacag

SEQ ID NO: 3402482 - DNA, 23 bp, Homo sapiens
cattccaagacagtatacagtcc

SEQ ID NO: 3402483 - DNA, 16 bp, Homo sapiens
cattcctaaaatgctt

SEQ ID NO: 3402484 - DNA, 22 bp, Homo sapiens
cattccttcccagaggggcctg

SEQ ID NO: 3402485 - DNA, 14 bp, Homo sapiens
cattccttctttga

SEQ ID NO: 3402486 - DNA, 19 bp, Homo sapiens
cattccttctttgataatg

SEQ ID NO: 3402487 - DNA, 20 bp, Homo sapiens
cattgaatttagtcattatt

SEQ ID NO: 3402488 - DNA, 16 bp, Homo sapiens
cattgattgtcagcta

SEQ ID NO: 3402489 - DNA, 15 bp, Homo sapiens
cattggaactggagg

SEQ ID NO: 3402490 - DNA, 16 bp, Homo sapiens
cattggaactggaggc

SEQ ID NO: 3402491 - DNA, 22 bp, Homo sapiens
cattgtaacctcgtgtctagta

SEQ ID NO: 3402492 - DNA, 19 bp, Homo sapiens
cattgtccctgaagagaag

SEQ ID NO: 3402493 - DNA, 14 bp, Homo sapiens
cattgtgttcactg

SEQ ID NO: 3402494 - DNA, 14 bp, Homo sapiens
catttacaacccgg

SEQ ID NO: 3402495 - DNA, 23 bp, Homo sapiens
catttacaacccggttcactctt

SEQ ID NO: 3402496 - DNA, 13 bp, Homo sapiens
catttaggagaag

SEQ ID NO: 3402497 - DNA, 16 bp, Homo sapiens
catttaggagaagttg

SEQ ID NO: 3402498 - DNA, 23 bp, Homo sapiens
catttatgatttaataaaataat

SEQ ID NO: 3402499 - DNA, 14 bp, Homo sapiens
catttcaaaatgct

SEQ ID NO: 3402500 - DNA, 13 bp, Homo sapiens
catttcacccctc

SEQ ID NO: 3402501 - DNA, 15 bp, Homo sapiens
catttcatctatttc

SEQ ID NO: 3402502 - DNA, 21 bp, Homo sapiens
catttcattcctaacacagca

SEQ ID NO: 3402503 - DNA, 16 bp, Homo sapiens
catttcgtgtaatatt

SEQ ID NO: 3402504 - DNA, 14 bp, Homo sapiens
catttgaaagaaag

SEQ ID NO: 3402505 - DNA, 15 bp, Homo sapiens
catttgaaagaaagg

SEQ ID NO: 3402506 - DNA, 20 bp, Homo sapiens
catttgatttcgatgtacag

SEQ ID NO: 3402507 - DNA, 20 bp, Homo sapiens
catttgctaactagcttgga

SEQ ID NO: 3402508 - DNA, 14 bp, Homo sapiens
cattttaaataggt

SEQ ID NO: 3402509 - DNA, 23 bp, Homo sapiens
cattttcagcatcaaacatgaaa

SEQ ID NO: 3402510 - DNA, 18 bp, Homo sapiens
cattttcttgtcaatgga

SEQ ID NO: 3402511 - DNA, 22 bp, Homo sapiens
cattttcttgtcaatggaagaa

SEQ ID NO: 3402512 - DNA, 21 bp, Homo sapiens
catttttaaaggacaaacagt

SEQ ID NO: 3402513 - DNA, 20 bp, Homo sapiens
catttttagtttaaaatctt

SEQ ID NO: 3402514 - DNA, 15 bp, Homo sapiens
catttttttccaggc

SEQ ID NO: 3402515 - DNA, 18 bp, Homo sapiens
catttttttccaggctgg

SEQ ID NO: 3402516 - DNA, 23 bp, Homo sapiens
ccaaaataatctatattaaatga

SEQ ID NO: 3402517 - DNA, 11 bp, Homo sapiens
ccaaaccactt

SEQ ID NO: 3402518 - DNA, 14 bp, Homo sapiens
ccaaaccacttttt

SEQ ID NO: 3402519 - DNA, 22 bp, Homo sapiens
ccaaaccactttttgcagcttt

SEQ ID NO: 3402520 - DNA, 18 bp, Homo sapiens
ccaaaccttcacacacag

SEQ ID NO: 3402521 - DNA, 15 bp, Homo sapiens
ccaaatactctgaaa

SEQ ID NO: 3402522 - DNA, 18 bp, Homo sapiens
ccaaatgcattcatgttt

SEQ ID NO: 3402523 - DNA, 16 bp, Homo sapiens
cgtcttgtgaaattgt

SEQ ID NO: 3402524 - DNA, 15 bp, Homo sapiens
cgtgtgtagagttaa

SEQ ID NO: 3402525 - DNA, 13 bp, Homo sapiens
cgttctccctggg

SEQ ID NO: 3402526 - DNA, 16 bp, Homo sapiens
cgttcttacaagctta

SEQ ID NO: 3402527 - DNA, 21 bp, Homo sapiens
cgtttgatagtgcttcttgta

SEQ ID NO: 3402528 - DNA, 15 bp, Homo sapiens
cgttttcttaaatgt

SEQ ID NO: 3402529 - DNA, 12 bp, Homo sapiens
ctaaaccattca

SEQ ID NO: 3402530 - DNA, 19 bp, Homo sapiens
ctaaagagagaatgtagat

SEQ ID NO: 3402531 - DNA, 14 bp, Homo sapiens
ctaaagctttatct

SEQ ID NO: 3402532 - DNA, 21 bp, Homo sapiens
ctaaatattggtttgttattc

SEQ ID NO: 3402533 - DNA, 19 bp, Homo sapiens
ctaaattgatcattcataa

SEQ ID NO: 3402534 - DNA, 17 bp, Homo sapiens
ctaagatcacacaaata

SEQ ID NO: 3402535 - DNA, 13 bp, Homo sapiens
ctaataaaatata

SEQ ID NO: 3402536 - DNA, 15 bp, Homo sapiens
ctaataaaatatata

SEQ ID NO: 3402537 - DNA, 13 bp, Homo sapiens
ctaataataaatg

SEQ ID NO: 3402538 - DNA, 21 bp, Homo sapiens
ctaataattggccttcgattt

SEQ ID NO: 3402539 - DNA, 12 bp, Homo sapiens
ctaatacaccag

SEQ ID NO: 3402540 - DNA, 13 bp, Homo sapiens
ctaatatactttt

SEQ ID NO: 3402541 - DNA, 21 bp, Homo sapiens
ctaatcataacatagttgaaa

SEQ ID NO: 3402542 - DNA, 11 bp, Homo sapiens
ctaatctgcct

SEQ ID NO: 3402543 - DNA, 13 bp, Homo sapiens
ctaatgatgtttt

SEQ ID NO: 3402544 - DNA, 22 bp, Homo sapiens
ctaattctttgacctgttggga

SEQ ID NO: 3402545 - DNA, 13 bp, Homo sapiens
ctacaaacaaaat

SEQ ID NO: 3402546 - DNA, 17 bp, Homo sapiens
ctacaaacaaaatttct

SEQ ID NO: 3402547 - DNA, 21 bp, Homo sapiens
ctacaaacaaaatttctatta

SEQ ID NO: 3402548 - DNA, 15 bp, Homo sapiens
ctacaaccaggtctt

SEQ ID NO: 3402549 - DNA, 15 bp, Homo sapiens
ctacacaacatgtat

SEQ ID NO: 3402550 - DNA, 18 bp, Homo sapiens
ctacacaacatgtatgtg

SEQ ID NO: 3402551 - DNA, 16 bp, Homo sapiens
ctacaggggccagaag

SEQ ID NO: 3402552 - DNA, 13 bp, Homo sapiens
ctacattcttggt

SEQ ID NO: 3402553 - DNA, 19 bp, Homo sapiens
ctacattcttggttgttaa

SEQ ID NO: 3402554 - DNA, 15 bp, Homo sapiens
ctaccagtgggcatg

SEQ ID NO: 3402555 - DNA, 18 bp, Homo sapiens
ctacccagtcatgtactg

SEQ ID NO: 3402556 - DNA, 18 bp, Homo sapiens
ctacctctccagcctcag

SEQ ID NO: 3402557 - DNA, 14 bp, Homo sapiens
ctacctttttatat

SEQ ID NO: 3402558 - DNA, 20 bp, Homo sapiens
ctacctttttatatttaaaa

SEQ ID NO: 3402559 - DNA, 13 bp, Homo sapiens
ctactaatgatgt

SEQ ID NO: 3402560 - DNA, 12 bp, Homo sapiens
ctactgaattta

SEQ ID NO: 3402561 - DNA, 22 bp, Homo sapiens
ctactgcttcctctgaatatta

SEQ ID NO: 3402562 - DNA, 13 bp, Homo sapiens
ctagcacatgccc

SEQ ID NO: 3402563 - DNA, 18 bp, Homo sapiens
ctagcatttatttctctg

SEQ ID NO: 3402564 - DNA, 16 bp, Homo sapiens
ctagctccccaatccc

SEQ ID NO: 3402565 - DNA, 15 bp, Homo sapiens
ctaggatgtcgtctt

SEQ ID NO: 3402566 - DNA, 11 bp, Homo sapiens
ctaggccaggt

SEQ ID NO: 3402567 - DNA, 14 bp, Homo sapiens
ctagtggtctttgt

SEQ ID NO: 3402568 - DNA, 16 bp, Homo sapiens
ctagtggtctttgtaa

SEQ ID NO: 3402569 - DNA, 20 bp, Homo sapiens
ctagtggtctttgtaagagt

SEQ ID NO: 3402570 - DNA, 16 bp, Homo sapiens
ctataaacaattacat

SEQ ID NO: 3402571 - DNA, 16 bp, Homo sapiens
ctataaagtgtttatg

SEQ ID NO: 3402572 - DNA, 13 bp, Homo sapiens
ctatattaaatga

SEQ ID NO: 3402573 - DNA, 13 bp, Homo sapiens
ctatattgtacac

SEQ ID NO: 3402574 - DNA, 19 bp, Homo sapiens
ctatctatacctgcctttt

SEQ ID NO: 3402575 - DNA, 16 bp, Homo sapiens
ctatgaactgaaggca

SEQ ID NO: 3402576 - DNA, 15 bp, Homo sapiens
ctatgtttcatcttg

SEQ ID NO: 3402577 - DNA, 22 bp, Homo sapiens
ctattagccaggatcatggtgt

SEQ ID NO: 3402578 - DNA, 18 bp, Homo sapiens
ctatttcctttgcgcaaa

SEQ ID NO: 3402579 - DNA, 22 bp, Homo sapiens
ctatttcctttgcgcaaacttt

SEQ ID NO: 3402580 - DNA, 21 bp, Homo sapiens
ctatttctatgtatgtgccaa

SEQ ID NO: 3402581 - DNA, 21 bp, Homo sapiens
ctatttttaaaatcataacat

SEQ ID NO: 3402582 - DNA, 15 bp, Homo sapiens
ctcaaagttttgaaa

SEQ ID NO: 3402583 - DNA, 23 bp, Homo sapiens
ctcaaagttttgaaaagctatta

SEQ ID NO: 3402584 - DNA, 17 bp, Homo sapiens
ctcaagatcaatgaaat

SEQ ID NO: 3402585 - DNA, 18 bp, Homo sapiens
ctcaagatcaatgaaatg

SEQ ID NO: 3402586 - DNA, 19 bp, Homo sapiens
ctcaaggtgggccttgcta

SEQ ID NO: 3402587 - DNA, 13 bp, Homo sapiens
ctcaatattttcc

SEQ ID NO: 3402588 - DNA, 18 bp, Homo sapiens
ctcaatttactaatttat

SEQ ID NO: 3402589 - DNA, 15 bp, Homo sapiens
ctcaattttgtattt

SEQ ID NO: 3402590 - DNA, 15 bp, Homo sapiens
ctcacagctgagttg

SEQ ID NO: 3402591 - DNA, 14 bp, Homo sapiens
ctcactagctcccc

SEQ ID NO: 3402592 - DNA, 20 bp, Homo sapiens
ctcagccacaaaccctgcct

SEQ ID NO: 3402593 - DNA, 22 bp, Homo sapiens
ctcagccccaccccagggcagc

SEQ ID NO: 3402594 - DNA, 16 bp, Homo sapiens
ctcagctccctgcctg

SEQ ID NO: 3402595 - DNA, 20 bp, Homo sapiens
ctcaggaaagaatagaaaga

SEQ ID NO: 3402596 - DNA, 13 bp, Homo sapiens
ctcaggcagctcg

SEQ ID NO: 3402597 - DNA, 23 bp, Homo sapiens
ctcagtcactttttcccctgcaa

SEQ ID NO: 3402598 - DNA, 14 bp, Homo sapiens
ctcagtcatgcata

SEQ ID NO: 3402599 - DNA, 15 bp, Homo sapiens
ctcagtcatgcataa

SEQ ID NO: 3402600 - DNA, 17 bp, Homo sapiens
ctcatctcttagctccc

SEQ ID NO: 3402601 - DNA, 18 bp, Homo sapiens
ctcatcttagtgcctgag

SEQ ID NO: 3402602 - DNA, 22 bp, Homo sapiens
ctcatcttggccctcctcagct

SEQ ID NO: 3402603 - DNA, 15 bp, Homo sapiens
ctcatctttcttgat

SEQ ID NO: 3402604 - DNA, 19 bp, Homo sapiens
ctcatgcaaactgctttat

SEQ ID NO: 3402605 - DNA, 15 bp, Homo sapiens
ctcatgtcatttctc

SEQ ID NO: 3402606 - DNA, 17 bp, Homo sapiens
ctcatgtcatttctcat

SEQ ID NO: 3402607 - DNA, 20 bp, Homo sapiens
ctcattaaactctaaagatt

SEQ ID NO: 3402608 - DNA, 13 bp, Homo sapiens
ctcattatttcat

SEQ ID NO: 3402609 - DNA, 14 bp, Homo sapiens
ctcattctgcatta

SEQ ID NO: 3402610 - DNA, 14 bp, Homo sapiens
ctcatttaaatatc

SEQ ID NO: 3402611 - DNA, 23 bp, Homo sapiens
ctcatttcacccctccctttctc

SEQ ID NO: 3402612 - DNA, 21 bp, Homo sapiens
ctccaaaccttcacacacaga

SEQ ID NO: 3402613 - DNA, 19 bp, Homo sapiens
ctccaaccccccagcactg

SEQ ID NO: 3402614 - DNA, 12 bp, Homo sapiens
ctccacacctgc

SEQ ID NO: 3402615 - DNA, 19 bp, Homo sapiens
ctccacctcactagctccc

SEQ ID NO: 3402616 - DNA, 16 bp, Homo sapiens
ctccactctcccccac

SEQ ID NO: 3402617 - DNA, 19 bp, Homo sapiens
ctccagacctgcccctccc

SEQ ID NO: 3402618 - DNA, 21 bp, Homo sapiens
ctccagacctgcccctccctc

SEQ ID NO: 3402619 - DNA, 12 bp, Homo sapiens
ctccagcctcag

SEQ ID NO: 3402620 - DNA, 23 bp, Homo sapiens
ctccagggacagcaactatcaga

SEQ ID NO: 3402621 - DNA, 12 bp, Homo sapiens
ctccagggctgg

SEQ ID NO: 3402622 - DNA, 19 bp, Homo sapiens
ctccatggccctgccatgc

SEQ ID NO: 3402623 - DNA, 13 bp, Homo sapiens
ctccatttttgtt

SEQ ID NO: 3402624 - DNA, 23 bp, Homo sapiens
ctccccaactgaccacctttgtt

SEQ ID NO: 3402625 - DNA, 15 bp, Homo sapiens
ctccccaatccctga

SEQ ID NO: 3402626 - DNA, 18 bp, Homo sapiens
ctcccccaccgcccactc

SEQ ID NO: 3402627 - DNA, 13 bp, Homo sapiens
ctcccccactttc

SEQ ID NO: 3402628 - DNA, 15 bp, Homo sapiens
ctcccctccaacctg

SEQ ID NO: 3402629 - DNA, 19 bp, Homo sapiens
ctcccctcgacagctctct

SEQ ID NO: 3402630 - DNA, 20 bp, Homo sapiens
ctcccctcgacagctctctg

SEQ ID NO: 3402631 - DNA, 15 bp, Homo sapiens
ctcccctgccccctg

SEQ ID NO: 3402632 - DNA, 19 bp, Homo sapiens
ctcccctgccccctgcagg

SEQ ID NO: 3402633 - DNA, 20 bp, Homo sapiens
ctccctctagaggctgcctg

SEQ ID NO: 3402634 - DNA, 18 bp, Homo sapiens
ctccctgcctcaggcctc

SEQ ID NO: 3402635 - DNA, 17 bp, Homo sapiens
ctttttcccctgcaatg

SEQ ID NO: 3402636 - DNA, 23 bp, Homo sapiens
ctttttcccctgcaatgcgtctt

SEQ ID NO: 3402637 - DNA, 14 bp, Homo sapiens
ctttttgcagcttt

SEQ ID NO: 3402638 - DNA, 20 bp, Homo sapiens
cttttttaagatttttctca

SEQ ID NO: 3402639 - DNA, 11 bp, Homo sapiens
ctttttttcct

SEQ ID NO: 3402640 - DNA, 21 bp, Homo sapiens
ctttttttccttcctttttat

SEQ ID NO: 3402641 - DNA, 12 bp, Homo sapiens
ctttttttgtta

SEQ ID NO: 3402642 - DNA, 14 bp, Homo sapiens
gaaaaaagaagttt

SEQ ID NO: 3402643 - DNA, 12 bp, Homo sapiens
gaaaaaagtgtt

SEQ ID NO: 3402644 - DNA, 21 bp, Homo sapiens
gaaaaacttttaggttgttac

SEQ ID NO: 3402645 - DNA, 16 bp, Homo sapiens
gaaaaatttttttgtt

SEQ ID NO: 3402646 - DNA, 18 bp, Homo sapiens
gaaaagaaatcaattttt

SEQ ID NO: 3402647 - DNA, 17 bp, Homo sapiens
gaaaagctattagccag

SEQ ID NO: 3402648 - DNA, 19 bp, Homo sapiens
gaaaagctattagccagga

SEQ ID NO: 3402649 - DNA, 22 bp, Homo sapiens
gaaaatcttagtatagtagaaa

SEQ ID NO: 3402650 - DNA, 17 bp, Homo sapiens
gaaaatgaatttgactg

SEQ ID NO: 3402651 - DNA, 19 bp, Homo sapiens
gaaaatggatatagaaaat

SEQ ID NO: 3402652 - DNA, 13 bp, Homo sapiens
gaaaattaacact

SEQ ID NO: 3402653 - DNA, 21 bp, Homo sapiens
gaaacaaaaaacaccaaaaat

SEQ ID NO: 3402654 - DNA, 18 bp, Homo sapiens
gaaaccttttttaagatt

SEQ ID NO: 3402655 - DNA, 19 bp, Homo sapiens
gaaaccttttttaagattt

SEQ ID NO: 3402656 - DNA, 20 bp, Homo sapiens
gaaactaccagtgggcatgt

SEQ ID NO: 3402657 - DNA, 12 bp, Homo sapiens
gaaactggttta

SEQ ID NO: 3402658 - DNA, 20 bp, Homo sapiens
gaaactggtttataataaac

SEQ ID NO: 3402659 - DNA, 12 bp, Homo sapiens
gaaagaatagaa

SEQ ID NO: 3402660 - DNA, 16 bp, Homo sapiens
gaaagacagcttctca

SEQ ID NO: 3402661 - DNA, 19 bp, Homo sapiens
gaaaggcaatttttgagta

SEQ ID NO: 3402662 - DNA, 19 bp, Homo sapiens
gaaaggctatcctgctgaa

SEQ ID NO: 3402663 - DNA, 17 bp, Homo sapiens
gaaaggtaaatacaagt

SEQ ID NO: 3402664 - DNA, 19 bp, Homo sapiens
gaaagtcaattcagtgatg

SEQ ID NO: 3402665 - DNA, 16 bp, Homo sapiens
gaaagtcctgctttcc

SEQ ID NO: 3402666 - DNA, 18 bp, Homo sapiens
gaaagttaccttactgaa

SEQ ID NO: 3402667 - DNA, 14 bp, Homo sapiens
gaaatagcttcagg

SEQ ID NO: 3402668 - DNA, 22 bp, Homo sapiens
gaaatagcttcaggatactgta

SEQ ID NO: 3402669 - DNA, 21 bp, Homo sapiens
gaaatatataaaaatatatgt

SEQ ID NO: 3402670 - DNA, 15 bp, Homo sapiens
gaaatattttgaata

SEQ ID NO: 3402671 - DNA, 20 bp, Homo sapiens
gaaatcgccttatgagaaca

SEQ ID NO: 3402672 - DNA, 16 bp, Homo sapiens
gaaatgaaaacatgta

SEQ ID NO: 3402673 - DNA, 15 bp, Homo sapiens
gaaattaaagtatgc

SEQ ID NO: 3402674 - DNA, 16 bp, Homo sapiens
gaaattaaagtatgca

SEQ ID NO: 3402675 - DNA, 22 bp, Homo sapiens
gaaatttaaaaataaagctact

SEQ ID NO: 3402676 - DNA, 23 bp, Homo sapiens
gaacacagcctgggaccagggca

SEQ ID NO: 3402677 - DNA, 23 bp, Homo sapiens
gaacagaaatatataaaaatata

SEQ ID NO: 3402678 - DNA, 16 bp, Homo sapiens
gaacagcttcaggtta

SEQ ID NO: 3402679 - DNA, 17 bp, Homo sapiens
gaacagcttcaggttat

SEQ ID NO: 3402680 - DNA, 15 bp, Homo sapiens
gaacagtttggatgt

SEQ ID NO: 3402681 - DNA, 19 bp, Homo sapiens
gaacatgcagctctgcagc

SEQ ID NO: 3402682 - DNA, 18 bp, Homo sapiens
gaacatggtgtgtgtctc

SEQ ID NO: 3402683 - DNA, 20 bp, Homo sapiens
gaacatggtgtgtgtctctg

SEQ ID NO: 3402684 - DNA, 21 bp, Homo sapiens
gaacatggtgtgtgtctctga

SEQ ID NO: 3402685 - DNA, 13 bp, Homo sapiens
gaacattataatt

SEQ ID NO: 3402686 - DNA, 15 bp, Homo sapiens
gaacctaattgaaat

SEQ ID NO: 3402687 - DNA, 16 bp, Homo sapiens
gaacctaattgaaatt

SEQ ID NO: 3402688 - DNA, 22 bp, Homo sapiens
gaacggggctcttctcatttca

SEQ ID NO: 3402689 - DNA, 22 bp, Homo sapiens
gaactctgaaccacctttgtct

SEQ ID NO: 3402690 - DNA, 18 bp, Homo sapiens
gaactctgggctgccatg

SEQ ID NO: 3402691 - DNA, 11 bp, Homo sapiens
gaactggaggc

SEQ ID NO: 3402692 - DNA, 12 bp, Homo sapiens
gaactttcattt

SEQ ID NO: 3402693 - DNA, 23 bp, Homo sapiens
gaactttcatttttttccaggct

SEQ ID NO: 3402694 - DNA, 15 bp, Homo sapiens
gaagaaataaataat

SEQ ID NO: 3402695 - DNA, 22 bp, Homo sapiens
gaagaacatctttatggtaaag

SEQ ID NO: 3402696 - DNA, 12 bp, Homo sapiens
gaagaagttttt

SEQ ID NO: 3402697 - DNA, 20 bp, Homo sapiens
gaagatgaaaccgtccctga

SEQ ID NO: 3402698 - DNA, 12 bp, Homo sapiens
gaagcagctctt

SEQ ID NO: 3402699 - DNA, 16 bp, Homo sapiens
gaagcatgaaaaagca

SEQ ID NO: 3402700 - DNA, 14 bp, Homo sapiens
gaagccaagctccc

SEQ ID NO: 3402701 - DNA, 21 bp, Homo sapiens
gaagccaagctccctggagcc

SEQ ID NO: 3402702 - DNA, 22 bp, Homo sapiens
gaagccaagctccctggagccc

SEQ ID NO: 3402703 - DNA, 23 bp, Homo sapiens
gaagccaagctccctggagccct

SEQ ID NO: 3402704 - DNA, 17 bp, Homo sapiens
gaagccacaggcctgag

SEQ ID NO: 3402705 - DNA, 19 bp, Homo sapiens
gaagcttggggaagaccca

SEQ ID NO: 3402706 - DNA, 18 bp, Homo sapiens
gaaggaaaaggcagggag

SEQ ID NO: 3402707 - DNA, 17 bp, Homo sapiens
gaaggaccccctccccc

SEQ ID NO: 3402708 - DNA, 15 bp, Homo sapiens
gaaggagctgcctgg

SEQ ID NO: 3402709 - DNA, 17 bp, Homo sapiens
gaaggagctgcctggac

SEQ ID NO: 3402710 - DNA, 13 bp, Homo sapiens
gaaggattgtaaa

SEQ ID NO: 3402711 - DNA, 16 bp, Homo sapiens
gaagggagggggctgg

SEQ ID NO: 3402712 - DNA, 19 bp, Homo sapiens
gaagggggtggtgtctcca

SEQ ID NO: 3402713 - DNA, 22 bp, Homo sapiens
gaagtgcttaacgttttcttaa

SEQ ID NO: 3402714 - DNA, 19 bp, Homo sapiens
gaagtgtgggtctgtgtgt

SEQ ID NO: 3402715 - DNA, 24 bp, Homo sapiens
gaagtgtgggtctgtgtgtgtgta

SEQ ID NO: 3402716 - DNA, 16 bp, Homo sapiens
gaagttttttactttg

SEQ ID NO: 3402717 - DNA, 20 bp, Homo sapiens
gaataaacatctgtgtctgt

SEQ ID NO: 3402718 - DNA, 15 bp, Homo sapiens
gaatagaaagaaagt

SEQ ID NO: 3402719 - DNA, 13 bp, Homo sapiens
gaatagtctctgg

SEQ ID NO: 3402720 - DNA, 15 bp, Homo sapiens
gaatatgacggaaga

SEQ ID NO: 3402721 - DNA, 23 bp, Homo sapiens
gaatattaagaaacaatttaaat

SEQ ID NO: 3402722 - DNA, 14 bp, Homo sapiens
gaatccatgcttgg

SEQ ID NO: 3402723 - DNA, 20 bp, Homo sapiens
gaatgatttaaatagaactt

SEQ ID NO: 3402724 - DNA, 14 bp, Homo sapiens
gaatgccataaaat

SEQ ID NO: 3402725 - DNA, 21 bp, Homo sapiens
gaatgccatagtcaaagagag

SEQ ID NO: 3402726 - DNA, 23 bp, Homo sapiens
gaatgccatagtcaaagagagtt

SEQ ID NO: 3402727 - DNA, 20 bp, Homo sapiens
gaatggattggattatttaa

SEQ ID NO: 3402728 - DNA, 16 bp, Homo sapiens
gaatggtttttgttga

SEQ ID NO: 3402729 - DNA, 16 bp, Homo sapiens
gaatgtcagtatgtgg

SEQ ID NO: 3402730 - DNA, 21 bp, Homo sapiens
gaatgtgatcatctttgctga

SEQ ID NO: 3402731 - DNA, 19 bp, Homo sapiens
gaatgttaacaggtatttt

SEQ ID NO: 3402732 - DNA, 22 bp, Homo sapiens
gaattaaactcctactgcttcc

SEQ ID NO: 3402733 - DNA, 21 bp, Homo sapiens
gaattaagttagggaatggca

SEQ ID NO: 3402734 - DNA, 20 bp, Homo sapiens
gaattaggtccacttcaatg

SEQ ID NO: 3402735 - DNA, 22 bp, Homo sapiens
gaatttaagcatgagtggcctt

SEQ ID NO: 3402736 - DNA, 14 bp, Homo sapiens
gaatttgactggtt

SEQ ID NO: 3402737 - DNA, 19 bp, Homo sapiens
gacaaactgtaaaaaatgt

SEQ ID NO: 3402738 - DNA, 12 bp, Homo sapiens
gacaagctcctc

SEQ ID NO: 3402739 - DNA, 15 bp, Homo sapiens
gacaagctcctccct

SEQ ID NO: 3402740 - DNA, 12 bp, Homo sapiens
gacaccagagca

SEQ ID NO: 3402741 - DNA, 13 bp, Homo sapiens
gacaccagagcag

SEQ ID NO: 3402742 - DNA, 15 bp, Homo sapiens
gacagaacactgtct

SEQ ID NO: 3402743 - DNA, 16 bp, Homo sapiens
gacagaagcagctctt

SEQ ID NO: 3402744 - DNA, 18 bp, Homo sapiens
gacagatgttatttttgt

SEQ ID NO: 3402745 - DNA, 22 bp, Homo sapiens
gacagcttctcatcctgcaggc

SEQ ID NO: 3402746 - DNA, 16 bp, Homo sapiens
ggaccagcctggccca

SEQ ID NO: 3402747 - DNA, 22 bp, Homo sapiens
ggaccagcctggcccaccccac

SEQ ID NO: 3402748 - DNA, 11 bp, Homo sapiens
ggacccctgca

SEQ ID NO: 3402749 - DNA, 19 bp, Homo sapiens
ggacccgttcatgggggag

SEQ ID NO: 3402750 - DNA, 14 bp, Homo sapiens
ggactctgcagcct

SEQ ID NO: 3402751 - DNA, 15 bp, Homo sapiens
ggactctgcagcctc

SEQ ID NO: 3402752 - DNA, 13 bp, Homo sapiens
ggagaaatgccag

SEQ ID NO: 3402753 - DNA, 22 bp, Homo sapiens
ggagactttgctgttactgctt

SEQ ID NO: 3402754 - DNA, 23 bp, Homo sapiens
ggagactttgctgttactgcttc

SEQ ID NO: 3402755 - DNA, 13 bp, Homo sapiens
ggagagcccagga

SEQ ID NO: 3402756 - DNA, 22 bp, Homo sapiens
ggagagcccaggagctcccctc

SEQ ID NO: 3402757 - DNA, 16 bp, Homo sapiens
ggagcccaggccagga

SEQ ID NO: 3402758 - DNA, 22 bp, Homo sapiens
ggagccctgttggcagctctag

SEQ ID NO: 3402759 - DNA, 17 bp, Homo sapiens
ggagcctaggccaggtg

SEQ ID NO: 3402760 - DNA, 12 bp, Homo sapiens
ggagctgcaggg

SEQ ID NO: 3402761 - DNA, 11 bp, Homo sapiens
ggagctgcctg

SEQ ID NO: 3402762 - DNA, 15 bp, Homo sapiens
ggagctgcctggacc

SEQ ID NO: 3402763 - DNA, 16 bp, Homo sapiens
ggagctgcctggaccc

SEQ ID NO: 3402764 - DNA, 11 bp, Homo sapiens
ggaggaaggat

SEQ ID NO: 3402765 - DNA, 21 bp, Homo sapiens
ggaggaaggcttacacccaca

SEQ ID NO: 3402766 - DNA, 13 bp, Homo sapiens
ggaggagcccagg

SEQ ID NO: 3402767 - DNA, 20 bp, Homo sapiens
ggaggagcccaggccaggac

SEQ ID NO: 3402768 - DNA, 15 bp, Homo sapiens
ggagtgtactcccag

SEQ ID NO: 3402769 - DNA, 18 bp, Homo sapiens
ggagtgtactcccagggc

SEQ ID NO: 3402770 - DNA, 22 bp, Homo sapiens
ggagtgtgtaatttaaaattgt

SEQ ID NO: 3402771 - DNA, 19 bp, Homo sapiens
ggatcatggtgtaataaga

SEQ ID NO: 3402772 - DNA, 21 bp, Homo sapiens
ggatctttggacagaagcagc

SEQ ID NO: 3402773 - DNA, 22 bp, Homo sapiens
ggatctttggacagaagcagct

SEQ ID NO: 3402774 - DNA, 20 bp, Homo sapiens
ggatgagagcccagaggtaa

SEQ ID NO: 3402775 - DNA, 17 bp, Homo sapiens
ggatggaatgatgggtc

SEQ ID NO: 3402776 - DNA, 20 bp, Homo sapiens
ggatggtgacttttgaagaa

SEQ ID NO: 3402777 - DNA, 23 bp, Homo sapiens
ggatggtgacttttgaagaacaa

SEQ ID NO: 3402778 - DNA, 23 bp, Homo sapiens
ggattctaaacagatgtccctga

SEQ ID NO: 3402779 - DNA, 18 bp, Homo sapiens
ggattctttccattatga

SEQ ID NO: 3402780 - DNA, 18 bp, Homo sapiens
ggattggattatttaata

SEQ ID NO: 3402781 - DNA, 22 bp, Homo sapiens
ggattggattatttaataacat

SEQ ID NO: 3402782 - DNA, 22 bp, Homo sapiens
ggattgtaaaaaaaaatgcctt

SEQ ID NO: 3402783 - DNA, 23 bp, Homo sapiens
ggcaaaagtctgaggcacctgca

SEQ ID NO: 3402784 - DNA, 17 bp, Homo sapiens
ggcacaggccatggatg

SEQ ID NO: 3402785 - DNA, 23 bp, Homo sapiens
ggcacaggccatggatggaaaac

SEQ ID NO: 3402786 - DNA, 17 bp, Homo sapiens
ggcacccggtcccctct

SEQ ID NO: 3402787 - DNA, 12 bp, Homo sapiens
ggcactgccctg

SEQ ID NO: 3402788 - DNA, 13 bp, Homo sapiens
ggcagattgaaaa

SEQ ID NO: 3402789 - DNA, 15 bp, Homo sapiens
ggcaggcaagccctt

SEQ ID NO: 3402790 - DNA, 16 bp, Homo sapiens
ggcaggcaagcccttc

SEQ ID NO: 3402791 - DNA, 18 bp, Homo sapiens
ggcagggaacatggggag

SEQ ID NO: 3402792 - DNA, 20 bp, Homo sapiens
ggcagtgagtgccatgcttt

SEQ ID NO: 3402793 - DNA, 15 bp, Homo sapiens
ggcagtgtttgtata

SEQ ID NO: 3402794 - DNA, 20 bp, Homo sapiens
ggcatccttcctcacaccag

SEQ ID NO: 3402795 - DNA, 20 bp, Homo sapiens
ggcatgtattagccagtcat

SEQ ID NO: 3402796 - DNA, 22 bp, Homo sapiens
ggcattaattgttccttgcttt

SEQ ID NO: 3402797 - DNA, 19 bp, Homo sapiens
ggccacagacccccagggc

SEQ ID NO: 3402798 - DNA, 14 bp, Homo sapiens
ggccagaagatgaa

SEQ ID NO: 3402799 - DNA, 14 bp, Homo sapiens
ggccaggactctgc

SEQ ID NO: 3402800 - DNA, 15 bp, Homo sapiens
ggccaggactctgca

SEQ ID NO: 3402801 - DNA, 20 bp, Homo sapiens
ggccatatatgctgtatttc

SEQ ID NO: 3402802 - DNA, 15 bp, Homo sapiens
ggcccaagtcattgt

SEQ ID NO: 3402803 - DNA, 19 bp, Homo sapiens
ggcccaccccacccacttc

SEQ ID NO: 3402804 - DNA, 20 bp, Homo sapiens
ggcccctgccacctcctgcc

SEQ ID NO: 3402805 - DNA, 16 bp, Homo sapiens
ggccctccacacctgc

SEQ ID NO: 3402806 - DNA, 21 bp, Homo sapiens
ggccctccacacctgcggccc

SEQ ID NO: 3402807 - DNA, 12 bp, Homo sapiens
ggccctcctcag

SEQ ID NO: 3402808 - DNA, 14 bp, Homo sapiens
ggccctcctcagct

SEQ ID NO: 3402809 - DNA, 17 bp, Homo sapiens
ggccctcctcagctccc

SEQ ID NO: 3402810 - DNA, 20 bp, Homo sapiens
ggccctcctcagctccctgc

SEQ ID NO: 3402811 - DNA, 12 bp, Homo sapiens
ggccctctcccc

SEQ ID NO: 3402812 - DNA, 16 bp, Homo sapiens
ggccctctcccctgcc

SEQ ID NO: 3402813 - DNA, 14 bp, Homo sapiens
ggccgggcagaggg

SEQ ID NO: 3402814 - DNA, 12 bp, Homo sapiens
ggcctcaagatc

SEQ ID NO: 3402815 - DNA, 12 bp, Homo sapiens
ggcctcccccac

SEQ ID NO: 3402816 - DNA, 13 bp, Homo sapiens
ggcctcccccact

SEQ ID NO: 3402817 - DNA, 22 bp, Homo sapiens
ggcctgccacctggacccctgc

SEQ ID NO: 3402818 - DNA, 23 bp, Homo sapiens
ggcctgccacctggacccctgca

SEQ ID NO: 3402819 - DNA, 18 bp, Homo sapiens
ggcctgcctccagggctg

SEQ ID NO: 3402820 - DNA, 20 bp, Homo sapiens
ggcctgcctccagggctgga

SEQ ID NO: 3402821 - DNA, 14 bp, Homo sapiens
ggccttaataaata

SEQ ID NO: 3402822 - DNA, 14 bp, Homo sapiens
ggcgcactgcctct

SEQ ID NO: 3402823 - DNA, 16 bp, Homo sapiens
ggcgcactgcctctca

SEQ ID NO: 3402824 - DNA, 20 bp, Homo sapiens
ggctatctatacctgccttt

SEQ ID NO: 3402825 - DNA, 22 bp, Homo sapiens
ggctcagccccaccccagggca

SEQ ID NO: 3402826 - DNA, 21 bp, Homo sapiens
ggctccccctgctggtgtcta

SEQ ID NO: 3402827 - DNA, 23 bp, Homo sapiens
ggctctgagagccccaggactgg

SEQ ID NO: 3402828 - DNA, 13 bp, Homo sapiens
ggctcttctcatt

SEQ ID NO: 3402829 - DNA, 11 bp, Homo sapiens
ggctggaggag

SEQ ID NO: 3402830 - DNA, 17 bp, Homo sapiens
ggctggatctgtgaggg

SEQ ID NO: 3402831 - DNA, 22 bp, Homo sapiens
ggctggttcggatttggggtgg

SEQ ID NO: 3402832 - DNA, 12 bp, Homo sapiens
ggctgtacatag

SEQ ID NO: 3402833 - DNA, 15 bp, Homo sapiens
ggcttcactcctgct

SEQ ID NO: 3402834 - DNA, 18 bp, Homo sapiens
ggcttcttttctttgtat

SEQ ID NO: 3402835 - DNA, 11 bp, Homo sapiens
ggcttgctgtt

SEQ ID NO: 3402836 - DNA, 15 bp, Homo sapiens
ggctttctgttgcca

SEQ ID NO: 3402837 - DNA, 15 bp, Homo sapiens
ggctttgttcttgtc

SEQ ID NO: 3402838 - DNA, 24 bp, Homo sapiens
ggctttgttcttgtcatcagtaag

SEQ ID NO: 3402839 - DNA, 16 bp, Homo sapiens
ggcttttaaaaggaaa

SEQ ID NO: 3402840 - DNA, 21 bp, Homo sapiens
gggaaatagcttcaggatact

SEQ ID NO: 3402841 - DNA, 12 bp, Homo sapiens
gggaacatgggg

SEQ ID NO: 3402842 - DNA, 16 bp, Homo sapiens
gggaacatggggagga

SEQ ID NO: 3402843 - DNA, 20 bp, Homo sapiens
gggaattttccccgtgacat

SEQ ID NO: 3402844 - DNA, 14 bp, Homo sapiens
gggagaaatgccag

SEQ ID NO: 3402845 - DNA, 22 bp, Homo sapiens
gggagaatgtcagtatgtggaa

SEQ ID NO: 3402846 - DNA, 16 bp, Homo sapiens
gggagagcccaggagc

SEQ ID NO: 3402847 - DNA, 18 bp, Homo sapiens
gggagagcccaggagctc

SEQ ID NO: 3402848 - DNA, 21 bp, Homo sapiens
gggagcctccctgcctcaggc

SEQ ID NO: 3402849 - DNA, 16 bp, Homo sapiens
gggagctgcaggggca

SEQ ID NO: 3402850 - DNA, 13 bp, Homo sapiens
gggagggggcaga

SEQ ID NO: 3402851 - DNA, 14 bp, Homo sapiens
gggagggggcagaa

SEQ ID NO: 3402852 - DNA, 14 bp, Homo sapiens
gggagggggctggc

SEQ ID NO: 3402853 - DNA, 21 bp, Homo sapiens
gggagggggctggctctgaga

SEQ ID NO: 3402854 - DNA, 17 bp, Homo sapiens
gggagtgtactcccagg

SEQ ID NO: 3402855 - DNA, 22 bp, Homo sapiens
gggatttcaccactcaaaggcc

SEQ ID NO: 3402856 - DNA, 16 bp, Homo sapiens
gggcaggcaagccctt

SEQ ID NO: 3402857 - DNA, 22 bp, Homo sapiens
gttttgttcccctcctccactc

SEQ ID NO: 3402858 - DNA, 15 bp, Homo sapiens
gtttttaactcaata

SEQ ID NO: 3402859 - DNA, 19 bp, Homo sapiens
gtttttaattaaaaacttt

SEQ ID NO: 3402860 - DNA, 21 bp, Homo sapiens
gtttttcatactcttaagtgt

SEQ ID NO: 3402861 - DNA, 23 bp, Homo sapiens
gtttttgaggctttctgttgcca

SEQ ID NO: 3402862 - DNA, 23 bp, Homo sapiens
gtttttgttgagtctctgaacat

SEQ ID NO: 3402863 - DNA, 13 bp, Homo sapiens
gttttttactttg

SEQ ID NO: 3402864 - DNA, 16 bp, Homo sapiens
gttttttttttctcct

SEQ ID NO: 3402865 - DNA, 18 bp, Homo sapiens
taaaaaaaaatgcctttg

SEQ ID NO: 3402866 - DNA, 16 bp, Homo sapiens
taaaaaaatttaagtg

SEQ ID NO: 3402867 - DNA, 17 bp, Homo sapiens
taaaaaaatttaagtgc

SEQ ID NO: 3402868 - DNA, 20 bp, Homo sapiens
taaaaaatgtgtgtattctt

SEQ ID NO: 3402869 - DNA, 22 bp, Homo sapiens
taaaaacaaaaacatcccaaga

SEQ ID NO: 3402870 - DNA, 23 bp, Homo sapiens
taaaaacaaaaacatcccaagat

SEQ ID NO: 3402871 - DNA, 16 bp, Homo sapiens
taaaaagcctcagtga

SEQ ID NO: 3402872 - DNA, 16 bp, Homo sapiens
taaaaagtatatgtta

SEQ ID NO: 3402873 - DNA, 12 bp, Homo sapiens
taaaaataaagc

SEQ ID NO: 3402874 - DNA, 17 bp, Homo sapiens
taaaaataaagctactg

SEQ ID NO: 3402875 - DNA, 14 bp, Homo sapiens
taaaaatacatttt

SEQ ID NO: 3402876 - DNA, 15 bp, Homo sapiens
taaaacatgctgttt

SEQ ID NO: 3402877 - DNA, 22 bp, Homo sapiens
taaaagcaagatctactacatc

SEQ ID NO: 3402878 - DNA, 17 bp, Homo sapiens
taaaagtcattattcct

SEQ ID NO: 3402879 - DNA, 15 bp, Homo sapiens
taaaagtttgtcctt

SEQ ID NO: 3402880 - DNA, 17 bp, Homo sapiens
taaaagtttgtccttta

SEQ ID NO: 3402881 - DNA, 19 bp, Homo sapiens
taaaatagttttgctttgt

SEQ ID NO: 3402882 - DNA, 21 bp, Homo sapiens
taaaatatatactatatgaaa

SEQ ID NO: 3402883 - DNA, 15 bp, Homo sapiens
taaaatcataacatt

SEQ ID NO: 3402884 - DNA, 19 bp, Homo sapiens
taaaatctcaactataacc

SEQ ID NO: 3402885 - DNA, 12 bp, Homo sapiens
taaaatgcaata

SEQ ID NO: 3402886 - DNA, 20 bp, Homo sapiens
taaaattttttacttttaac

SEQ ID NO: 3402887 - DNA, 18 bp, Homo sapiens
taaacaaaatttcacagt

SEQ ID NO: 3402888 - DNA, 19 bp, Homo sapiens
taaacaaaatttcacagtt

SEQ ID NO: 3402889 - DNA, 16 bp, Homo sapiens
taaacatctgtgtctg

SEQ ID NO: 3402890 - DNA, 20 bp, Homo sapiens
taaaccactaatgcttgcca

SEQ ID NO: 3402891 - DNA, 17 bp, Homo sapiens
taaaccttgtttctttc

SEQ ID NO: 3402892 - DNA, 18 bp, Homo sapiens
taaaccttgtttctttct

SEQ ID NO: 3402893 - DNA, 20 bp, Homo sapiens
taaagaggctgaaagaggcc

SEQ ID NO: 3402894 - DNA, 20 bp, Homo sapiens
taaagattagggaaaatgga

SEQ ID NO: 3402895 - DNA, 16 bp, Homo sapiens
taaagctttatctttg

SEQ ID NO: 3402896 - DNA, 18 bp, Homo sapiens
taaagctttatctttgtg

SEQ ID NO: 3402897 - DNA, 17 bp, Homo sapiens
taaaggacaaacagtga

SEQ ID NO: 3402898 - DNA, 22 bp, Homo sapiens
taaaggcttttggcagcaaagt

SEQ ID NO: 3402899 - DNA, 21 bp, Homo sapiens
taaagtatgcaaaataaagaa

SEQ ID NO: 3402900 - DNA, 18 bp, Homo sapiens
taaagtgtttatgacaaa

SEQ ID NO: 3402901 - DNA, 20 bp, Homo sapiens
taaagtttttttatttcttt

SEQ ID NO: 3402902 - DNA, 14 bp, Homo sapiens
taaataaagctcaa

SEQ ID NO: 3402903 - DNA, 14 bp, Homo sapiens
taaataatataaaa

SEQ ID NO: 3402904 - DNA, 14 bp, Homo sapiens
taaatagaacttga

SEQ ID NO: 3402905 - DNA, 16 bp, Homo sapiens
taaataggagaggatg

SEQ ID NO: 3402906 - DNA, 21 bp, Homo sapiens
taaataggagaggatgagagc

SEQ ID NO: 3402907 - DNA, 21 bp, Homo sapiens
taaatattggtttgttattct

SEQ ID NO: 3402908 - DNA, 17 bp, Homo sapiens
taaatatttatgtagat

SEQ ID NO: 3402909 - DNA, 15 bp, Homo sapiens
taaatcatttggtta

SEQ ID NO: 3402910 - DNA, 20 bp, Homo sapiens
taaatcattttaggaaagga

SEQ ID NO: 3402911 - DNA, 21 bp, Homo sapiens
taaatcattttaggaaaggat

SEQ ID NO: 3402912 - DNA, 22 bp, Homo sapiens
taaatctggggaagaggtttta

SEQ ID NO: 3402913 - DNA, 21 bp, Homo sapiens
taaatgaagggtcatttctct

SEQ ID NO: 3402914 - DNA, 16 bp, Homo sapiens
taaatgctcatacaca

SEQ ID NO: 3402915 - DNA, 21 bp, Homo sapiens
taaatggtttctcattaaact

SEQ ID NO: 3402916 - DNA, 14 bp, Homo sapiens
taaatgttttcatt

SEQ ID NO: 3402917 - DNA, 16 bp, Homo sapiens
taaatgttttcattgg

SEQ ID NO: 3402918 - DNA, 13 bp, Homo sapiens
taaattatgaatg

SEQ ID NO: 3402919 - DNA, 16 bp, Homo sapiens
taaattgcctttgtaa

SEQ ID NO: 3402920 - DNA, 22 bp, Homo sapiens
taaattgcctttgtaatatgag

SEQ ID NO: 3402921 - DNA, 23 bp, Homo sapiens
taaattgcctttgtaatatgaga

SEQ ID NO: 3402922 - DNA, 15 bp, Homo sapiens
taaattggtcatggt

SEQ ID NO: 3402923 - DNA, 16 bp, Homo sapiens
taaattggtcatggta

SEQ ID NO: 3402924 - DNA, 18 bp, Homo sapiens
taaattgttataacttca

SEQ ID NO: 3402925 - DNA, 13 bp, Homo sapiens
taaatttatgtga

SEQ ID NO: 3402926 - DNA, 14 bp, Homo sapiens
taaatttggcttct

SEQ ID NO: 3402927 - DNA, 20 bp, Homo sapiens
taaatttgtaagtttcaggt

SEQ ID NO: 3402928 - DNA, 13 bp, Homo sapiens
taaatttgttgtc

SEQ ID NO: 3402929 - DNA, 19 bp, Homo sapiens
taaatttgttgtcatgtgt

SEQ ID NO: 3402930 - DNA, 22 bp, Homo sapiens
taaatttgttgtcatgtgtatg

SEQ ID NO: 3402931 - DNA, 20 bp, Homo sapiens
taacaaataacctataaagt

SEQ ID NO: 3402932 - DNA, 14 bp, Homo sapiens
taacaattaaaatc

SEQ ID NO: 3402933 - DNA, 17 bp, Homo sapiens
taacaattaaaatctca

SEQ ID NO: 3402934 - DNA, 12 bp, Homo sapiens
taacagaacagc

SEQ ID NO: 3402935 - DNA, 14 bp, Homo sapiens
taacagaacagctt

SEQ ID NO: 3402936 - DNA, 13 bp, Homo sapiens
taacagacactgt

SEQ ID NO: 3402937 - DNA, 13 bp, Homo sapiens
taacagagaaata

SEQ ID NO: 3402938 - DNA, 23 bp, Homo sapiens
taacagcgtgtcaactttcattt

SEQ ID NO: 3402939 - DNA, 19 bp, Homo sapiens
taacagctttcttattcag

SEQ ID NO: 3402940 - DNA, 14 bp, Homo sapiens
taacaggtctcctc

SEQ ID NO: 3402941 - DNA, 15 bp, Homo sapiens
taacaggtctcctct

SEQ ID NO: 3402942 - DNA, 15 bp, Homo sapiens
taacaggttttcttc

SEQ ID NO: 3402943 - DNA, 13 bp, Homo sapiens
taacattacctta

SEQ ID NO: 3402944 - DNA, 16 bp, Homo sapiens
taacatttcaagggca

SEQ ID NO: 3402945 - DNA, 23 bp, Homo sapiens
taaccagtttagctttttcctta

SEQ ID NO: 3402946 - DNA, 22 bp, Homo sapiens
taacgttttcttaaatgttttc

SEQ ID NO: 3402947 - DNA, 19 bp, Homo sapiens
taactgactctgttattga

SEQ ID NO: 3402948 - DNA, 17 bp, Homo sapiens
taactgcccagcggaca

SEQ ID NO: 3402949 - DNA, 12 bp, Homo sapiens
taacttgtcttt

SEQ ID NO: 3402950 - DNA, 14 bp, Homo sapiens
taagaagacatgaa

SEQ ID NO: 3402951 - DNA, 18 bp, Homo sapiens
taagaagctgttgtacat

SEQ ID NO: 3402952 - DNA, 18 bp, Homo sapiens
taagaatagactaagttt

SEQ ID NO: 3402953 - DNA, 20 bp, Homo sapiens
taagaatagtctctgggttt

SEQ ID NO: 3402954 - DNA, 23 bp, Homo sapiens
taagaatttgaggtctacattct

SEQ ID NO: 3402955 - DNA, 21 bp, Homo sapiens
taagacataacgtttttcctt

SEQ ID NO: 3402956 - DNA, 17 bp, Homo sapiens
taagagcaaaaagtgta

SEQ ID NO: 3402957 - DNA, 13 bp, Homo sapiens
taagagtgtagaa

SEQ ID NO: 3402958 - DNA, 19 bp, Homo sapiens
taagagtgtagaagcattc

SEQ ID NO: 3402959 - DNA, 18 bp, Homo sapiens
taagatactcaagcaggt

SEQ ID NO: 3402960 - DNA, 15 bp, Homo sapiens
taagatttttctcaa

SEQ ID NO: 3402961 - DNA, 16 bp, Homo sapiens
taagatttttctcaaa

SEQ ID NO: 3402962 - DNA, 20 bp, Homo sapiens
taagatttttctcaaagttt

SEQ ID NO: 3402963 - DNA, 18 bp, Homo sapiens
taagcagagttctttgca

SEQ ID NO: 3402964 - DNA, 10 bp, Homo sapiens
taagctctga

SEQ ID NO: 3402965 - DNA, 14 bp, Homo sapiens
taaggctgtacata

SEQ ID NO: 3402966 - DNA, 18 bp, Homo sapiens
taagggtggaaaaatgcc

SEQ ID NO: 3402967 - DNA, 19 bp, Homo sapiens
taaggtcatagattcttga

SEQ ID NO: 3402968 - DNA, 17 bp, Homo sapiens
tatgaagtataaatctg

SEQ ID NO: 3402969 - DNA, 21 bp, Homo sapiens
tatgaatatatggcatttgca

SEQ ID NO: 3402970 - DNA, 18 bp, Homo sapiens
tatgaatgagttttacaa

SEQ ID NO: 3402971 - DNA, 13 bp, Homo sapiens
tatgacacaatga

SEQ ID NO: 3402972 - DNA, 16 bp, Homo sapiens
tatgaccttctaggaa

SEQ ID NO: 3402973 - DNA, 19 bp, Homo sapiens
tatgacggaagaacataga

SEQ ID NO: 3402974 - DNA, 19 bp, Homo sapiens
tatgactaaagagagaatg

SEQ ID NO: 3402975 - DNA, 20 bp, Homo sapiens
tatgagaacatggtgtgtgt

SEQ ID NO: 3402976 - DNA, 17 bp, Homo sapiens
tatgagaagtactttgt

SEQ ID NO: 3402977 - DNA, 14 bp, Homo sapiens
tatgagaatgtatt

SEQ ID NO: 3402978 - DNA, 19 bp, Homo sapiens
tatgagaatgtattagtac

SEQ ID NO: 3402979 - DNA, 16 bp, Homo sapiens
tatgagatttactgct

SEQ ID NO: 3402980 - DNA, 23 bp, Homo sapiens
tatgagctggggatgtctctcat

SEQ ID NO: 3402981 - DNA, 19 bp, Homo sapiens
tatgcaaatgagatttctt

SEQ ID NO: 3402982 - DNA, 23 bp, Homo sapiens
tatgcaagtgggagatgaaaacc

SEQ ID NO: 3402983 - DNA, 15 bp, Homo sapiens
tatgcacgttaacag

SEQ ID NO: 3402984 - DNA, 22 bp, Homo sapiens
tatgcagtgatatggcagaaga

SEQ ID NO: 3402985 - DNA, 15 bp, Homo sapiens
tatgcccatgaacaa

SEQ ID NO: 3402986 - DNA, 17 bp, Homo sapiens
tatgctgtatttctttg

SEQ ID NO: 3402987 - DNA, 18 bp, Homo sapiens
tatgctgtatttctttgt

SEQ ID NO: 3402988 - DNA, 23 bp, Homo sapiens
tatgctgtatttctttgtagaat

SEQ ID NO: 3402989 - DNA, 17 bp, Homo sapiens
tatggaatgtcagtgtt

SEQ ID NO: 3402990 - DNA, 19 bp, Homo sapiens
tatggacatcgatatgaaa

SEQ ID NO: 3402991 - DNA, 15 bp, Homo sapiens
tatggcagaagacac

SEQ ID NO: 3402992 - DNA, 22 bp, Homo sapiens
tatggcagaagacaccagagca

SEQ ID NO: 3402993 - DNA, 19 bp, Homo sapiens
tatggctatctatacctgc

SEQ ID NO: 3402994 - DNA, 23 bp, Homo sapiens
tatgtacagttcataaatttgtt

SEQ ID NO: 3402995 - DNA, 16 bp, Homo sapiens
tatgtattaaactttt

SEQ ID NO: 3402996 - DNA, 14 bp, Homo sapiens
tatgtgaatttgag

SEQ ID NO: 3402997 - DNA, 19 bp, Homo sapiens
tatgtgagaaatcagaatt

SEQ ID NO: 3402998 - DNA, 17 bp, Homo sapiens
tatgtgccaattttgtc

SEQ ID NO: 3402999 - DNA, 17 bp, Homo sapiens
tatgtggatacagtcat

SEQ ID NO: 3403000 - DNA, 22 bp, Homo sapiens
tatgtgtgtgtgttgtgtgtgg

SEQ ID NO: 3403001 - DNA, 13 bp, Homo sapiens
tatgtgttacatt

SEQ ID NO: 3403002 - DNA, 16 bp, Homo sapiens
tatgtgttacattatt

SEQ ID NO: 3403003 - DNA, 18 bp, Homo sapiens
tatgtgttgcataaacaa

SEQ ID NO: 3403004 - DNA, 15 bp, Homo sapiens
tatgttacttaaaca

SEQ ID NO: 3403005 - DNA, 18 bp, Homo sapiens
tatgtttttgtgtatttg

SEQ ID NO: 3403006 - DNA, 16 bp, Homo sapiens
tattaaaaatatacaa

SEQ ID NO: 3403007 - DNA, 14 bp, Homo sapiens
tattaaacttttca

SEQ ID NO: 3403008 - DNA, 17 bp, Homo sapiens
tattaaacttttcatta

SEQ ID NO: 3403009 - DNA, 12 bp, Homo sapiens
tattaaaggctt

SEQ ID NO: 3403010 - DNA, 15 bp, Homo sapiens
tattaaatctgaatt

SEQ ID NO: 3403011 - DNA, 20 bp, Homo sapiens
tattaactctgtaaaagtgt

SEQ ID NO: 3403012 - DNA, 20 bp, Homo sapiens
tattaagaaacaatttaaat

SEQ ID NO: 3403013 - DNA, 18 bp, Homo sapiens
tattaagaatagtctctg

SEQ ID NO: 3403014 - DNA, 21 bp, Homo sapiens
tattaagaatagtctctgggt

SEQ ID NO: 3403015 - DNA, 17 bp, Homo sapiens
tattacctaatgaaagt

SEQ ID NO: 3403016 - DNA, 12 bp, Homo sapiens
tattagttgctt

SEQ ID NO: 3403017 - DNA, 14 bp, Homo sapiens
tattagttgctttg

SEQ ID NO: 3403018 - DNA, 14 bp, Homo sapiens
tattatatcttgta

SEQ ID NO: 3403019 - DNA, 15 bp, Homo sapiens
tattattgtgacaaa

SEQ ID NO: 3403020 - DNA, 16 bp, Homo sapiens
tattatttgtatgtat

SEQ ID NO: 3403021 - DNA, 21 bp, Homo sapiens
tattcaaggctttaaaagtca

SEQ ID NO: 3403022 - DNA, 14 bp, Homo sapiens
tattcagctagaat

SEQ ID NO: 3403023 - DNA, 18 bp, Homo sapiens
tattgagcgtgattctgt

SEQ ID NO: 3403024 - DNA, 20 bp, Homo sapiens
tattgtagataacactatgg

SEQ ID NO: 3403025 - DNA, 17 bp, Homo sapiens
tattgtgaagtacatat

SEQ ID NO: 3403026 - DNA, 19 bp, Homo sapiens
tattgtgaagtacatatta

SEQ ID NO: 3403027 - DNA, 16 bp, Homo sapiens
tatttaaaaaattaaa

SEQ ID NO: 3403028 - DNA, 17 bp, Homo sapiens
tatttaaaagacaaaca

SEQ ID NO: 3403029 - DNA, 10 bp, Homo sapiens
tatttaataa

SEQ ID NO: 3403030 - DNA, 15 bp, Homo sapiens
tatttaataacatta

SEQ ID NO: 3403031 - DNA, 19 bp, Homo sapiens
tatttatattcatcaaata

SEQ ID NO: 3403032 - DNA, 22 bp, Homo sapiens
tatttcaatttccaagagctga

SEQ ID NO: 3403033 - DNA, 18 bp, Homo sapiens
tatttcagtattttccag

SEQ ID NO: 3403034 - DNA, 20 bp, Homo sapiens
tatttctctggcaaactttt

SEQ ID NO: 3403035 - DNA, 21 bp, Homo sapiens
tatttctgagaaggtccttaa

SEQ ID NO: 3403036 - DNA, 11 bp, Homo sapiens
tatttctgatg

SEQ ID NO: 3403037 - DNA, 20 bp, Homo sapiens
tatttcttaaacaaatgtat

SEQ ID NO: 3403038 - DNA, 21 bp, Homo sapiens
tatttctttaatctgttgttt

SEQ ID NO: 3403039 - DNA, 16 bp, Homo sapiens
tatttctttgtagaat

SEQ ID NO: 3403040 - DNA, 18 bp, Homo sapiens
tatttgataacattttgt

SEQ ID NO: 3403041 - DNA, 16 bp, Homo sapiens
tatttgtaaatttatg

SEQ ID NO: 3403042 - DNA, 17 bp, Homo sapiens
tatttgtaaatttatgt

SEQ ID NO: 3403043 - DNA, 21 bp, Homo sapiens
tattttacccaaatactcaat

SEQ ID NO: 3403044 - DNA, 17 bp, Homo sapiens
tattttgtacattttgg

SEQ ID NO: 3403045 - DNA, 17 bp, Homo sapiens
tcaaacatgaaaacatt

SEQ ID NO: 3403046 - DNA, 13 bp, Homo sapiens
tcaaagttttgaa

SEQ ID NO: 3403047 - DNA, 15 bp, Homo sapiens
tcaaagttttgaaaa

SEQ ID NO: 3403048 - DNA, 20 bp, Homo sapiens
tcaaataaaccttgtttctt

SEQ ID NO: 3403049 - DNA, 23 bp, Homo sapiens
tcaaataaaccttgtttctttct

SEQ ID NO: 3403050 - DNA, 13 bp, Homo sapiens
tcaaatatcaaaa

SEQ ID NO: 3403051 - DNA, 18 bp, Homo sapiens
tcaaatatcaaaaggaag

SEQ ID NO: 3403052 - DNA, 19 bp, Homo sapiens
tcaaatttactgtcttaaa

SEQ ID NO: 3403053 - DNA, 23 bp, Homo sapiens
tcaaatttactgtcttaaatcag

SEQ ID NO: 3403054 - DNA, 20 bp, Homo sapiens
tcaaattttttaaaagagac

SEQ ID NO: 3403055 - DNA, 12 bp, Homo sapiens
tcaacatctttt

SEQ ID NO: 3403056 - DNA, 16 bp, Homo sapiens
tcaactcacctaatgt

SEQ ID NO: 3403057 - DNA, 16 bp, Homo sapiens
tcaactttcatttgaa

SEQ ID NO: 3403058 - DNA, 19 bp, Homo sapiens
tcaagaaaacaggcactgc

SEQ ID NO: 3403059 - DNA, 22 bp, Homo sapiens
tcaagaaaacaggcactgccct

SEQ ID NO: 3403060 - DNA, 23 bp, Homo sapiens
tcaagatccaaatgctgtgcaaa

SEQ ID NO: 3403061 - DNA, 19 bp, Homo sapiens
tcaagattttgaatgcttc

SEQ ID NO: 3403062 - DNA, 16 bp, Homo sapiens
tcaagtaagaagacat

SEQ ID NO: 3403063 - DNA, 16 bp, Homo sapiens
tcaagtgagtggcatg

SEQ ID NO: 3403064 - DNA, 15 bp, Homo sapiens
tcaatgacagagcct

SEQ ID NO: 3403065 - DNA, 22 bp, Homo sapiens
tcaatgtccacctgtgagaaag

SEQ ID NO: 3403066 - DNA, 22 bp, Homo sapiens
tcaatttactttttaaacagtg

SEQ ID NO: 3403067 - DNA, 12 bp, Homo sapiens
tcaatttggagc

SEQ ID NO: 3403068 - DNA, 15 bp, Homo sapiens
tcaattttttaaacc

SEQ ID NO: 3403069 - DNA, 14 bp, Homo sapiens
tcacaaaagctgtg

SEQ ID NO: 3403070 - DNA, 21 bp, Homo sapiens
tcacaaaagctgtgtctctgt

SEQ ID NO: 3403071 - DNA, 14 bp, Homo sapiens
tcacacacagactg

SEQ ID NO: 3403072 - DNA, 19 bp, Homo sapiens
tcacactgagaatgtaaga

SEQ ID NO: 3403073 - DNA, 18 bp, Homo sapiens
tcacaggtttgtttcttg

SEQ ID NO: 3403074 - DNA, 14 bp, Homo sapiens
tcacagttctgtaa

SEQ ID NO: 3403075 - DNA, 23 bp, Homo sapiens
tcacataggtaggtatctttata

SEQ ID NO: 3403076 - DNA, 16 bp, Homo sapiens
tcacatctaaagcttt

SEQ ID NO: 3403077 - DNA, 17 bp, Homo sapiens
tcacatctaaagcttta

SEQ ID NO: 3403078 - DNA, 20 bp, Homo sapiens
tcacatctaaagctttatct

SEQ ID NO: 3403079 - DNA, 14 bp, Homo sapiens
tctctgtcagtgtg

SEQ ID NO: 3403080 - DNA, 19 bp, Homo sapiens
tctctgtgagactcgagaa

SEQ ID NO: 3403081 - DNA, 20 bp, Homo sapiens
tctcttttgaatccatgctt

SEQ ID NO: 3403082 - DNA, 18 bp, Homo sapiens
tctgaaaattaacactgc

SEQ ID NO: 3403083 - DNA, 19 bp, Homo sapiens
tctgaaaattaacactgct

SEQ ID NO: 3403084 - DNA, 12 bp, Homo sapiens
tctgaaatgcac

SEQ ID NO: 3403085 - DNA, 17 bp, Homo sapiens
tctgaaccacctttgtc

SEQ ID NO: 3403086 - DNA, 21 bp, Homo sapiens
tctgaatattaagaaacaatt

SEQ ID NO: 3403087 - DNA, 18 bp, Homo sapiens
tctgagaaggtccttaat

SEQ ID NO: 3403088 - DNA, 18 bp, Homo sapiens
tctgatctgtactttgtg

SEQ ID NO: 3403089 - DNA, 13 bp, Homo sapiens
tctgatgttttat

SEQ ID NO: 3403090 - DNA, 12 bp, Homo sapiens
tctgcaacatgg

SEQ ID NO: 3403091 - DNA, 13 bp, Homo sapiens
tctgcaacatgga

SEQ ID NO: 3403092 - DNA, 15 bp, Homo sapiens
tctgcaacatggatt

SEQ ID NO: 3403093 - DNA, 19 bp, Homo sapiens
tctgcaacatggattccaa

SEQ ID NO: 3403094 - DNA, 22 bp, Homo sapiens
tctgcaacatggattccaaagc

SEQ ID NO: 3403095 - DNA, 13 bp, Homo sapiens
tctgcaactgaat

SEQ ID NO: 3403096 - DNA, 18 bp, Homo sapiens
tctgcaatgtttttgtgt

SEQ ID NO: 3403097 - DNA, 11 bp, Homo sapiens
tctgcagcctc

SEQ ID NO: 3403098 - DNA, 13 bp, Homo sapiens
tctgcagcctcag

SEQ ID NO: 3403099 - DNA, 14 bp, Homo sapiens
tctgcagcctcaga

SEQ ID NO: 3403100 - DNA, 17 bp, Homo sapiens
tctgcatgtaaaatctt

SEQ ID NO: 3403101 - DNA, 22 bp, Homo sapiens
tctgcatgtaaaatcttcagct

SEQ ID NO: 3403102 - DNA, 17 bp, Homo sapiens
tctgcccaactttcatt

SEQ ID NO: 3403103 - DNA, 20 bp, Homo sapiens
tctgcccaactttcattggt

SEQ ID NO: 3403104 - DNA, 13 bp, Homo sapiens
tctgccccaccct

SEQ ID NO: 3403105 - DNA, 14 bp, Homo sapiens
tctggaatgagcct

SEQ ID NO: 3403106 - DNA, 17 bp, Homo sapiens
tctggacctctcttgtg

SEQ ID NO: 3403107 - DNA, 18 bp, Homo sapiens
tctggcaaacttttcttt

SEQ ID NO: 3403108 - DNA, 20 bp, Homo sapiens
tctggcaaacttttctttct

SEQ ID NO: 3403109 - DNA, 11 bp, Homo sapiens
tctggccctat

SEQ ID NO: 3403110 - DNA, 21 bp, Homo sapiens
tctggctttgttcttgtcatc

SEQ ID NO: 3403111 - DNA, 18 bp, Homo sapiens
tctgggtttacaacaaac

SEQ ID NO: 3403112 - DNA, 23 bp, Homo sapiens
tctgggtttacaacaaacactgt

SEQ ID NO: 3403113 - DNA, 14 bp, Homo sapiens
tctggtatctgcat

SEQ ID NO: 3403114 - DNA, 17 bp, Homo sapiens
tctgtaaaagtgtctgt

SEQ ID NO: 3403115 - DNA, 14 bp, Homo sapiens
tctgtactttgtgt

SEQ ID NO: 3403116 - DNA, 13 bp, Homo sapiens
tctgtagctcctc

SEQ ID NO: 3403117 - DNA, 17 bp, Homo sapiens
tctgtatcactctgtgt

SEQ ID NO: 3403118 - DNA, 12 bp, Homo sapiens
tctgtcagtgtg

SEQ ID NO: 3403119 - DNA, 15 bp, Homo sapiens
tctgtccccttctct

SEQ ID NO: 3403120 - DNA, 20 bp, Homo sapiens
tctgtccccttctctcatct

SEQ ID NO: 3403121 - DNA, 16 bp, Homo sapiens
tctgtcccttgccccc

SEQ ID NO: 3403122 - DNA, 20 bp, Homo sapiens
tctgtggattcagcttctgt

SEQ ID NO: 3403123 - DNA, 11 bp, Homo sapiens
tctgtgtgtgt

SEQ ID NO: 3403124 - DNA, 13 bp, Homo sapiens
tctgtgtgtgtgt

SEQ ID NO: 3403125 - DNA, 22 bp, Homo sapiens
tctgtgtgtgtgtatgtggggg

SEQ ID NO: 3403126 - DNA, 16 bp, Homo sapiens
tctgtgtgtttatgtg

SEQ ID NO: 3403127 - DNA, 19 bp, Homo sapiens
tctgtgtgtttatgtgtgt

SEQ ID NO: 3403128 - DNA, 20 bp, Homo sapiens
tctgtgtgtttatgtgtgtg

SEQ ID NO: 3403129 - DNA, 16 bp, Homo sapiens
tctgttgtcaccttca

SEQ ID NO: 3403130 - DNA, 13 bp, Homo sapiens
tctgttttgtaaa

SEQ ID NO: 3403131 - DNA, 15 bp, Homo sapiens
tctgttttgtaaagt

SEQ ID NO: 3403132 - DNA, 21 bp, Homo sapiens
tcttaaaatgcaatatttgta

SEQ ID NO: 3403133 - DNA, 15 bp, Homo sapiens
tcttaaatcagttta

SEQ ID NO: 3403134 - DNA, 15 bp, Homo sapiens
tcttaaatcatttgg

SEQ ID NO: 3403135 - DNA, 13 bp, Homo sapiens
tcttaactgtatt

SEQ ID NO: 3403136 - DNA, 16 bp, Homo sapiens
tcttacaactccccca

SEQ ID NO: 3403137 - DNA, 19 bp, Homo sapiens
tcttacaagcttaaagctt

SEQ ID NO: 3403138 - DNA, 13 bp, Homo sapiens
tcttactttgtgc

SEQ ID NO: 3403139 - DNA, 19 bp, Homo sapiens
tcttactttgtgcaaaagc

SEQ ID NO: 3403140 - DNA, 18 bp, Homo sapiens
tcttagctttttaattgt

SEQ ID NO: 3403141 - DNA, 14 bp, Homo sapiens
tcttagtgcctgag

SEQ ID NO: 3403142 - DNA, 18 bp, Homo sapiens
tcttagtgcctgagagta

SEQ ID NO: 3403143 - DNA, 14 bp, Homo sapiens
tcttatctcagtca

SEQ ID NO: 3403144 - DNA, 13 bp, Homo sapiens
tcttattcagtga

SEQ ID NO: 3403145 - DNA, 22 bp, Homo sapiens
tcttcattacctcagtgagaag

SEQ ID NO: 3403146 - DNA, 21 bp, Homo sapiens
tcttcctatttgccatgggct

SEQ ID NO: 3403147 - DNA, 13 bp, Homo sapiens
tcttcctggaata

SEQ ID NO: 3403148 - DNA, 22 bp, Homo sapiens
tcttcctggaataaacatctgt

SEQ ID NO: 3403149 - DNA, 15 bp, Homo sapiens
tcttctcatttcacc

SEQ ID NO: 3403150 - DNA, 22 bp, Homo sapiens
tcttctcatttcacccctccct

SEQ ID NO: 3403151 - DNA, 15 bp, Homo sapiens
tcttcttacatgcat

SEQ ID NO: 3403152 - DNA, 21 bp, Homo sapiens
tcttctttttgaaatcagcat

SEQ ID NO: 3403153 - DNA, 13 bp, Homo sapiens
tcttgagtgttat

SEQ ID NO: 3403154 - DNA, 19 bp, Homo sapiens
tcttgatcaacatcttttc

SEQ ID NO: 3403155 - DNA, 23 bp, Homo sapiens
tcttgatcaacatcttttcttgc

SEQ ID NO: 3403156 - DNA, 22 bp, Homo sapiens
tcttgcattgaatttagtcatt

SEQ ID NO: 3403157 - DNA, 12 bp, Homo sapiens
tcttgcttctgg

SEQ ID NO: 3403158 - DNA, 16 bp, Homo sapiens
tcttggccctcctcag

SEQ ID NO: 3403159 - DNA, 22 bp, Homo sapiens
tcttggggaaatagcttcagga

SEQ ID NO: 3403160 - DNA, 18 bp, Homo sapiens
tcttggttagagaagtaa

SEQ ID NO: 3403161 - DNA, 13 bp, Homo sapiens
tcttgtgaaattg

SEQ ID NO: 3403162 - DNA, 18 bp, Homo sapiens
tcttgtgaaattgtgtag

SEQ ID NO: 3403163 - DNA, 20 bp, Homo sapiens
tcttgttattaatgtttctt

SEQ ID NO: 3403164 - DNA, 22 bp, Homo sapiens
tcttgtttggagggatcatttt

SEQ ID NO: 3403165 - DNA, 16 bp, Homo sapiens
tctttaaatcatttta

SEQ ID NO: 3403166 - DNA, 23 bp, Homo sapiens
tctttaaatcattttaggaaagg

SEQ ID NO: 3403167 - DNA, 13 bp, Homo sapiens
tctttaatctgtt

SEQ ID NO: 3403168 - DNA, 15 bp, Homo sapiens
tctttaatctgttgt

SEQ ID NO: 3403169 - DNA, 15 bp, Homo sapiens
tctttatagttgtag

SEQ ID NO: 3403170 - DNA, 22 bp, Homo sapiens
tctttatataaggtcatagatt

SEQ ID NO: 3403171 - DNA, 19 bp, Homo sapiens
tctttccattatgattctt

SEQ ID NO: 3403172 - DNA, 20 bp, Homo sapiens
tctttctagtggtctttgta

SEQ ID NO: 3403173 - DNA, 21 bp, Homo sapiens
tctttctagtggtctttgtaa

SEQ ID NO: 3403174 - DNA, 15 bp, Homo sapiens
tctttcttggtgcat

SEQ ID NO: 3403175 - DNA, 15 bp, Homo sapiens
tctttctttgctgct

SEQ ID NO: 3403176 - DNA, 16 bp, Homo sapiens
tctttctttgctgctg

SEQ ID NO: 3403177 - DNA, 19 bp, Homo sapiens
tctttctttgctgctgtgg

SEQ ID NO: 3403178 - DNA, 13 bp, Homo sapiens
tctttgaatgtat

SEQ ID NO: 3403179 - DNA, 14 bp, Homo sapiens
tctttgaatgtatt

SEQ ID NO: 3403180 - DNA, 14 bp, Homo sapiens
tctttgataatgtt

SEQ ID NO: 3403181 - DNA, 16 bp, Homo sapiens
tctttgataatgttaa

SEQ ID NO: 3403182 - DNA, 15 bp, Homo sapiens
tctttgattctcctt

SEQ ID NO: 3403183 - DNA, 19 bp, Homo sapiens
tctttgattctccttcagc

SEQ ID NO: 3403184 - DNA, 20 bp, Homo sapiens
tctttgattctccttcagcc

SEQ ID NO: 3403185 - DNA, 19 bp, Homo sapiens
tctttggacagaagcagct

SEQ ID NO: 3403186 - DNA, 21 bp, Homo sapiens
tctttggacagaagcagctct

SEQ ID NO: 3403187 - DNA, 21 bp, Homo sapiens
tctttgtaagagtgtagaagc

SEQ ID NO: 3403188 - DNA, 22 bp, Homo sapiens
tctttgtaagagtgtagaagca

SEQ ID NO: 3403189 - DNA, 19 bp, Homo sapiens
tctttgtagaataaatggt

SEQ ID NO: 3403190 - DNA, 15 bp, Homo sapiens
tctttgtgcagtgtt

SEQ ID NO: 3403191 - DNA, 20 bp, Homo sapiens
tggccatatatgctgtattt

SEQ ID NO: 3403192 - DNA, 21 bp, Homo sapiens
tggccatatatgctgtatttc

SEQ ID NO: 3403193 - DNA, 19 bp, Homo sapiens
tggcccaccccacccactt

SEQ ID NO: 3403194 - DNA, 21 bp, Homo sapiens
tggccctcctcagctccctgc

SEQ ID NO: 3403195 - DNA, 16 bp, Homo sapiens
tggccctctcccctgc

SEQ ID NO: 3403196 - DNA, 22 bp, Homo sapiens
tggccgcgccaaataatgtctc

SEQ ID NO: 3403197 - DNA, 23 bp, Homo sapiens
tggccgggaccccgagcctggct

SEQ ID NO: 3403198 - DNA, 11 bp, Homo sapiens
tggcctatgaa

SEQ ID NO: 3403199 - DNA, 22 bp, Homo sapiens
tggcctcaagatcaatgaaatg

SEQ ID NO: 3403200 - DNA, 18 bp, Homo sapiens
tggccttgggccctctgg

SEQ ID NO: 3403201 - DNA, 20 bp, Homo sapiens
tggctatctatacctgcctt

SEQ ID NO: 3403202 - DNA, 21 bp, Homo sapiens
tggctatctatacctgccttt

SEQ ID NO: 3403203 - DNA, 14 bp, Homo sapiens
tggctcacactgag

SEQ ID NO: 3403204 - DNA, 15 bp, Homo sapiens
tggctcacactgaga

SEQ ID NO: 3403205 - DNA, 18 bp, Homo sapiens
tggctccaaaccctcgag

SEQ ID NO: 3403206 - DNA, 20 bp, Homo sapiens
tggctccattggtgttgaca

SEQ ID NO: 3403207 - DNA, 14 bp, Homo sapiens
tggcttcactcctg

SEQ ID NO: 3403208 - DNA, 18 bp, Homo sapiens
tggcttcactcctgctgt

SEQ ID NO: 3403209 - DNA, 13 bp, Homo sapiens
tggcttgctgttt

SEQ ID NO: 3403210 - DNA, 17 bp, Homo sapiens
tggctttgttcttgtca

SEQ ID NO: 3403211 - DNA, 19 bp, Homo sapiens
tgggagaatgtcagtatgt

SEQ ID NO: 3403212 - DNA, 22 bp, Homo sapiens
tgggagaatgtcagtatgtgga

SEQ ID NO: 3403213 - DNA, 22 bp, Homo sapiens
tgggcaaggatgggtccagaag

SEQ ID NO: 3403214 - DNA, 19 bp, Homo sapiens
tgggcacccggtcccctct

SEQ ID NO: 3403215 - DNA, 18 bp, Homo sapiens
tgggcaggcaagcccttc

SEQ ID NO: 3403216 - DNA, 20 bp, Homo sapiens
tgggccaggttggaaaagaa

SEQ ID NO: 3403217 - DNA, 18 bp, Homo sapiens
tgggccatgttgtgcctc

SEQ ID NO: 3403218 - DNA, 13 bp, Homo sapiens
tgggccctctggt

SEQ ID NO: 3403219 - DNA, 18 bp, Homo sapiens
tgggcctaggccaggagt

SEQ ID NO: 3403220 - DNA, 14 bp, Homo sapiens
tgggcctgttcacg

SEQ ID NO: 3403221 - DNA, 22 bp, Homo sapiens
tgggcgggcaggggagggtcag

SEQ ID NO: 3403222 - DNA, 16 bp, Homo sapiens
tgggctgccatgtgaa

SEQ ID NO: 3403223 - DNA, 18 bp, Homo sapiens
tgggcttcactgtataaa

SEQ ID NO: 3403224 - DNA, 23 bp, Homo sapiens
tgggcttcactgtataaatagga

SEQ ID NO: 3403225 - DNA, 23 bp, Homo sapiens
tggggaagaggttttatttacat

SEQ ID NO: 3403226 - DNA, 18 bp, Homo sapiens
tggggatagatgtgtgga

SEQ ID NO: 3403227 - DNA, 15 bp, Homo sapiens
tggggctcagagtgg

SEQ ID NO: 3403228 - DNA, 14 bp, Homo sapiens
tggggctgattgta

SEQ ID NO: 3403229 - DNA, 12 bp, Homo sapiens
tgggtccagaag

SEQ ID NO: 3403230 - DNA, 13 bp, Homo sapiens
tggtaggaactgc

SEQ ID NO: 3403231 - DNA, 19 bp, Homo sapiens
tggtagggtataatgtgtc

SEQ ID NO: 3403232 - DNA, 22 bp, Homo sapiens
tggtcaagattttgaatgcttc

SEQ ID NO: 3403233 - DNA, 22 bp, Homo sapiens
tggtcatggtagatttttttca

SEQ ID NO: 3403234 - DNA, 16 bp, Homo sapiens
tggtctccttggaaat

SEQ ID NO: 3403235 - DNA, 13 bp, Homo sapiens
tggtctttgtaag

SEQ ID NO: 3403236 - DNA, 17 bp, Homo sapiens
tggtgcaattaactctg

SEQ ID NO: 3403237 - DNA, 21 bp, Homo sapiens
tggtgcaggtagacctgtctc

SEQ ID NO: 3403238 - DNA, 11 bp, Homo sapiens
tggtgcattcg

SEQ ID NO: 3403239 - DNA, 14 bp, Homo sapiens
tggtggatggtgac

SEQ ID NO: 3403240 - DNA, 21 bp, Homo sapiens
tggtggccctctcccctgccc

SEQ ID NO: 3403241 - DNA, 13 bp, Homo sapiens
tggtgggttgatg

SEQ ID NO: 3403242 - DNA, 14 bp, Homo sapiens
tggtgtaataagac

SEQ ID NO: 3403243 - DNA, 15 bp, Homo sapiens
tggtgtaataagaca

SEQ ID NO: 3403244 - DNA, 16 bp, Homo sapiens
tggtgtaataagacat

SEQ ID NO: 3403245 - DNA, 11 bp, Homo sapiens
tggtgtctcca

SEQ ID NO: 3403246 - DNA, 19 bp, Homo sapiens
tggtgtctccaacccccca

SEQ ID NO: 3403247 - DNA, 15 bp, Homo sapiens
tggtgtgtgtctctg

SEQ ID NO: 3403248 - DNA, 18 bp, Homo sapiens
tggtgtgtgtctctgaca

SEQ ID NO: 3403249 - DNA, 18 bp, Homo sapiens
tggtgttggcagtgtttg

SEQ ID NO: 3403250 - DNA, 17 bp, Homo sapiens
tggttgtatataaagtt

SEQ ID NO: 3403251 - DNA, 15 bp, Homo sapiens
tggtttgcaaggaag

SEQ ID NO: 3403252 - DNA, 17 bp, Homo sapiens
tggtttgcaaggaagcc

SEQ ID NO: 3403253 - DNA, 18 bp, Homo sapiens
tgtaaaaaaaaatgcctt

SEQ ID NO: 3403254 - DNA, 17 bp, Homo sapiens
tgtaaaaaatgtgtgta

SEQ ID NO: 3403255 - DNA, 14 bp, Homo sapiens
tgtaaaatcttcag

SEQ ID NO: 3403256 - DNA, 16 bp, Homo sapiens
tgtaaaatcttcagct

SEQ ID NO: 3403257 - DNA, 15 bp, Homo sapiens
tgtaaataatataaa

SEQ ID NO: 3403258 - DNA, 21 bp, Homo sapiens
tgtaaatgaagggtcatttct

SEQ ID NO: 3403259 - DNA, 16 bp, Homo sapiens
tgtaaatttggcttct

SEQ ID NO: 3403260 - DNA, 18 bp, Homo sapiens
tgtaaatttggcttctgt

SEQ ID NO: 3403261 - DNA, 20 bp, Homo sapiens
tgtaagagtgtagaagcatt

SEQ ID NO: 3403262 - DNA, 21 bp, Homo sapiens
tgtaagagtgtagaagcattc

SEQ ID NO: 3403263 - DNA, 19 bp, Homo sapiens
tgtaagcttagattttctg

SEQ ID NO: 3403264 - DNA, 13 bp, Homo sapiens
tgtaagtttcagg

SEQ ID NO: 3403265 - DNA, 16 bp, Homo sapiens
tgtaagtttcaggtga

SEQ ID NO: 3403266 - DNA, 21 bp, Homo sapiens
tgtaagtttcaggtgacatgt

SEQ ID NO: 3403267 - DNA, 12 bp, Homo sapiens
tgtaataagaca

SEQ ID NO: 3403268 - DNA, 14 bp, Homo sapiens
tgtaataagacata

SEQ ID NO: 3403269 - DNA, 18 bp, Homo sapiens
tgtaataagacataacgt

SEQ ID NO: 3403270 - DNA, 15 bp, Homo sapiens
tgtaatatttcttca

SEQ ID NO: 3403271 - DNA, 20 bp, Homo sapiens
tgtaatatttcttcaagtga

SEQ ID NO: 3403272 - DNA, 24 bp, Homo sapiens
tgtaatctaagtatatgtgagaaa

SEQ ID NO: 3403273 - DNA, 20 bp, Homo sapiens
tgtaatgtaggcacttttat

SEQ ID NO: 3403274 - DNA, 21 bp, Homo sapiens
tgtaatgtaggcacttttatt

SEQ ID NO: 3403275 - DNA, 22 bp, Homo sapiens
tgtaattccacatcatgttact

SEQ ID NO: 3403276 - DNA, 17 bp, Homo sapiens
tgtacagtctcaatttt

SEQ ID NO: 3403277 - DNA, 22 bp, Homo sapiens
tgtacagtctcaattttgtatt

SEQ ID NO: 3403278 - DNA, 12 bp, Homo sapiens
tgtactacaatt

SEQ ID NO: 3403279 - DNA, 12 bp, Homo sapiens
tgtactcccagg

SEQ ID NO: 3403280 - DNA, 18 bp, Homo sapiens
tgtactggagagtggcaa

SEQ ID NO: 3403281 - DNA, 19 bp, Homo sapiens
tgtactggagagtggcaaa

SEQ ID NO: 3403282 - DNA, 19 bp, Homo sapiens
tgtacttaaatgagttact

SEQ ID NO: 3403283 - DNA, 13 bp, Homo sapiens
tgtagaagcattc

SEQ ID NO: 3403284 - DNA, 17 bp, Homo sapiens
tgtagaagcattccttc

SEQ ID NO: 3403285 - DNA, 14 bp, Homo sapiens
tgtagaataaatgg

SEQ ID NO: 3403286 - DNA, 15 bp, Homo sapiens
tgtagaataaatggt

SEQ ID NO: 3403287 - DNA, 12 bp, Homo sapiens
tgtagagttaag

SEQ ID NO: 3403288 - DNA, 13 bp, Homo sapiens
tgtagagttaaga

SEQ ID NO: 3403289 - DNA, 15 bp, Homo sapiens
tgtagagttaagaag

SEQ ID NO: 3403290 - DNA, 19 bp, Homo sapiens
tgtagatattgtgaagtac

SEQ ID NO: 3403291 - DNA, 15 bp, Homo sapiens
tgtagccctcccact

SEQ ID NO: 3403292 - DNA, 21 bp, Homo sapiens
tgtagccctcccactttgctg

SEQ ID NO: 3403293 - DNA, 23 bp, Homo sapiens
tgtaggtggtctggagctgtccg

SEQ ID NO: 3403294 - DNA, 13 bp, Homo sapiens
tgtagtatttagt

SEQ ID NO: 3403295 - DNA, 17 bp, Homo sapiens
tgtagtctcacactgtt

SEQ ID NO: 3403296 - DNA, 17 bp, Homo sapiens
tgtatagttgcttttga

SEQ ID NO: 3403297 - DNA, 21 bp, Homo sapiens
tgtatatagctctacacaaca

SEQ ID NO: 3403298 - DNA, 23 bp, Homo sapiens
tgtatcactctgtgtctgagtgg

SEQ ID NO: 3403299 - DNA, 12 bp, Homo sapiens
tgtatctaattc

SEQ ID NO: 3403300 - DNA, 15 bp, Homo sapiens
tgtatgactaaagag

SEQ ID NO: 3403301 - DNA, 16 bp, Homo sapiens
tgtatgactaaagaga

SEQ ID NO: 3403302 - DNA, 13 bp, Homo sapiens
ttgttcccctcct

SEQ ID NO: 3403303 - DNA, 23 bp, Homo sapiens
ttgttcccctcctccactctccc

SEQ ID NO: 3403304 - DNA, 21 bp, Homo sapiens
ttgttccctcattctgcatta

SEQ ID NO: 3403305 - DNA, 23 bp, Homo sapiens
ttgttccttgcttttatagttgt

SEQ ID NO: 3403306 - DNA, 13 bp, Homo sapiens
ttgttctgggtga

SEQ ID NO: 3403307 - DNA, 13 bp, Homo sapiens
ttgttcttgtcat

SEQ ID NO: 3403308 - DNA, 16 bp, Homo sapiens
ttgttgagtctctgaa

SEQ ID NO: 3403309 - DNA, 21 bp, Homo sapiens
ttgtttaacttgtctttttgt

SEQ ID NO: 3403310 - DNA, 13 bp, Homo sapiens
ttgtttctttctg

SEQ ID NO: 3403311 - DNA, 19 bp, Homo sapiens
ttgtttgcggggcttttaa

SEQ ID NO: 3403312 - DNA, 18 bp, Homo sapiens
tttaaaaaaatttaagtg

SEQ ID NO: 3403313 - DNA, 20 bp, Homo sapiens
tttaaaaaattaaaaatgaa

SEQ ID NO: 3403314 - DNA, 13 bp, Homo sapiens
tttaaaagacaaa

SEQ ID NO: 3403315 - DNA, 14 bp, Homo sapiens
tttaaaagagacaa

SEQ ID NO: 3403316 - DNA, 16 bp, Homo sapiens
tttaaaagagacaaac

SEQ ID NO: 3403317 - DNA, 18 bp, Homo sapiens
tttaaaagtcattattcc

SEQ ID NO: 3403318 - DNA, 18 bp, Homo sapiens
tttaaacgacttttgttt

SEQ ID NO: 3403319 - DNA, 11 bp, Homo sapiens
tttaaagaaaa

SEQ ID NO: 3403320 - DNA, 13 bp, Homo sapiens
tttaaaggacaaa

SEQ ID NO: 3403321 - DNA, 17 bp, Homo sapiens
tttaaaggacaaacagt

SEQ ID NO: 3403322 - DNA, 21 bp, Homo sapiens
tttaaaggacaaacagtgaat

SEQ ID NO: 3403323 - DNA, 16 bp, Homo sapiens
tttaaagtaaacttgt

SEQ ID NO: 3403324 - DNA, 12 bp, Homo sapiens
tttaaatgccaa

SEQ ID NO: 3403325 - DNA, 18 bp, Homo sapiens
tttaaatgccaaaatgta

SEQ ID NO: 3403326 - DNA, 17 bp, Homo sapiens
tttaaattgcatttcta

SEQ ID NO: 3403327 - DNA, 21 bp, Homo sapiens
tttaacaggttttcttctaat

SEQ ID NO: 3403328 - DNA, 16 bp, Homo sapiens
tttaactatgaactga

SEQ ID NO: 3403329 - DNA, 24 bp, Homo sapiens
tttaactcaatattttccatgaaa

SEQ ID NO: 3403330 - DNA, 17 bp, Homo sapiens
tttaactctactgtgta

SEQ ID NO: 3403331 - DNA, 13 bp, Homo sapiens
tttaacttgtctt

SEQ ID NO: 3403332 - DNA, 12 bp, Homo sapiens
tttaagattttt

SEQ ID NO: 3403333 - DNA, 18 bp, Homo sapiens
tttaagctctgagctgtc

SEQ ID NO: 3403334 - DNA, 19 bp, Homo sapiens
tttaagctctgagctgtca

SEQ ID NO: 3403335 - DNA, 20 bp, Homo sapiens
tttaataaaataattctaaa

SEQ ID NO: 3403336 - DNA, 12 bp, Homo sapiens
tttaataacatt

SEQ ID NO: 3403337 - DNA, 21 bp, Homo sapiens
tttaatcacttaacattccta

SEQ ID NO: 3403338 - DNA, 13 bp, Homo sapiens
tttaattaaataa

SEQ ID NO: 3403339 - DNA, 21 bp, Homo sapiens
tttaattgttgtttctttcta

SEQ ID NO: 3403340 - DNA, 22 bp, Homo sapiens
tttaattgttgtttctttctag

SEQ ID NO: 3403341 - DNA, 23 bp, Homo sapiens
tttaattgttgtttctttctagt

SEQ ID NO: 3403342 - DNA, 14 bp, Homo sapiens
tttaatttccaaaa

SEQ ID NO: 3403343 - DNA, 13 bp, Homo sapiens
tttacaaattcct

SEQ ID NO: 3403344 - DNA, 17 bp, Homo sapiens
tttacaacaaacactgt

SEQ ID NO: 3403345 - DNA, 18 bp, Homo sapiens
tttacagatgtagatata

SEQ ID NO: 3403346 - DNA, 15 bp, Homo sapiens
tttactcttaaatca

SEQ ID NO: 3403347 - DNA, 22 bp, Homo sapiens
tttactgcctgaataaagagcc

SEQ ID NO: 3403348 - DNA, 16 bp, Homo sapiens
tttactgctctagaaa

SEQ ID NO: 3403349 - DNA, 21 bp, Homo sapiens
tttactgctctagaaagtata

SEQ ID NO: 3403350 - DNA, 19 bp, Homo sapiens
tttagagcgtttggttaaa

SEQ ID NO: 3403351 - DNA, 14 bp, Homo sapiens
tttagggtgggtaa

SEQ ID NO: 3403352 - DNA, 21 bp, Homo sapiens
tttaggtttgaaaggcaattt

SEQ ID NO: 3403353 - DNA, 13 bp, Homo sapiens
tttagtttaaaat

SEQ ID NO: 3403354 - DNA, 21 bp, Homo sapiens
tttataccattataccagcaa

SEQ ID NO: 3403355 - DNA, 16 bp, Homo sapiens
tttatagttgtatttt

SEQ ID NO: 3403356 - DNA, 14 bp, Homo sapiens
tttatataaggtca

SEQ ID NO: 3403357 - DNA, 23 bp, Homo sapiens
tttatataaggtcatagattctt

SEQ ID NO: 3403358 - DNA, 21 bp, Homo sapiens
tttatatattgaaagttgctt

SEQ ID NO: 3403359 - DNA, 23 bp, Homo sapiens
tttatatctggaatgagcctgtt

SEQ ID NO: 3403360 - DNA, 16 bp, Homo sapiens
tttatattagttgctt

SEQ ID NO: 3403361 - DNA, 19 bp, Homo sapiens
tttatattagttgctttgt

SEQ ID NO: 3403362 - DNA, 21 bp, Homo sapiens
tttatattagttgctttgtta

SEQ ID NO: 3403363 - DNA, 13 bp, Homo sapiens
tttatctccttgt

SEQ ID NO: 3403364 - DNA, 18 bp, Homo sapiens
tttatctccttgtggcct

SEQ ID NO: 3403365 - DNA, 19 bp, Homo sapiens
tttatctccttgtggccta

SEQ ID NO: 3403366 - DNA, 13 bp, Homo sapiens
tttatgtgtgtgt

SEQ ID NO: 3403367 - DNA, 23 bp, Homo sapiens
tttattcagctagaatttctggt

SEQ ID NO: 3403368 - DNA, 21 bp, Homo sapiens
tttatttctctggcaaacttt

SEQ ID NO: 3403369 - DNA, 15 bp, Homo sapiens
tttcaagatccaaat

SEQ ID NO: 3403370 - DNA, 18 bp, Homo sapiens
tttcaatttactttttaa

SEQ ID NO: 3403371 - DNA, 21 bp, Homo sapiens
tttcaatttggagcattaact

SEQ ID NO: 3403372 - DNA, 22 bp, Homo sapiens
tttcacccctccctttctcccc

SEQ ID NO: 3403373 - DNA, 13 bp, Homo sapiens
tttcactgccata

SEQ ID NO: 3403374 - DNA, 21 bp, Homo sapiens
tttcagattccacacaaaatg

SEQ ID NO: 3403375 - DNA, 12 bp, Homo sapiens
tttcagcatcaa

SEQ ID NO: 3403376 - DNA, 21 bp, Homo sapiens
tttcagcatcaaacatgaaaa

SEQ ID NO: 3403377 - DNA, 20 bp, Homo sapiens
tttcatagatttgaaaaact

SEQ ID NO: 3403378 - DNA, 17 bp, Homo sapiens
tttcatctgctctcctt

SEQ ID NO: 3403379 - DNA, 14 bp, Homo sapiens
tttcatgtatgtat

SEQ ID NO: 3403380 - DNA, 13 bp, Homo sapiens
tttcattgtgatt

SEQ ID NO: 3403381 - DNA, 16 bp, Homo sapiens
tttcatttcaaaatgc

SEQ ID NO: 3403382 - DNA, 20 bp, Homo sapiens
tttcatttttttccaggctg

SEQ ID NO: 3403383 - DNA, 19 bp, Homo sapiens
tttccaaaataatctatat

SEQ ID NO: 3403384 - DNA, 22 bp, Homo sapiens
tttccaaaataatctatattaa

SEQ ID NO: 3403385 - DNA, 22 bp, Homo sapiens
tttccaccaagtgtctagagtc

SEQ ID NO: 3403386 - DNA, 13 bp, Homo sapiens
tttcccctgcaat

SEQ ID NO: 3403387 - DNA, 21 bp, Homo sapiens
tttcccgtaaggctgtacata

SEQ ID NO: 3403388 - DNA, 14 bp, Homo sapiens
tttcctctatctaa

SEQ ID NO: 3403389 - DNA, 23 bp, Homo sapiens
tttccttacttttaaaataaaat

SEQ ID NO: 3403390 - DNA, 16 bp, Homo sapiens
tttctagaatggtttt

SEQ ID NO: 3403391 - DNA, 21 bp, Homo sapiens
tttctagtggtctttgtaaga

SEQ ID NO: 3403392 - DNA, 16 bp, Homo sapiens
tttctcaaagttttga

SEQ ID NO: 3403393 - DNA, 13 bp, Homo sapiens
tttctcattaaac

SEQ ID NO: 3403394 - DNA, 13 bp, Homo sapiens
tttctcccctgcc

SEQ ID NO: 3403395 - DNA, 24 bp, Homo sapiens
tttctcccctgcccccaggactgg

SEQ ID NO: 3403396 - DNA, 21 bp, Homo sapiens
tttctgagtgagttttactct

SEQ ID NO: 3403397 - DNA, 19 bp, Homo sapiens
tttctgcccaactttcatt

SEQ ID NO: 3403398 - DNA, 20 bp, Homo sapiens
tttctgcccaactttcattg

SEQ ID NO: 3403399 - DNA, 16 bp, Homo sapiens
tttcttagctttttaa

SEQ ID NO: 3403400 - DNA, 16 bp, Homo sapiens
tttcttattcagtgaa

SEQ ID NO: 3403401 - DNA, 21 bp, Homo sapiens
tttcttgatcaacatcttttc

SEQ ID NO: 3403402 - DNA, 17 bp, Homo sapiens
tttcttgcactattcca

SEQ ID NO: 3403403 - DNA, 19 bp, Homo sapiens
tttcttgcactattccaca

SEQ ID NO: 3403404 - DNA, 21 bp, Homo sapiens
tttcttgcctctgtccccttc

SEQ ID NO: 3403405 - DNA, 12 bp, Homo sapiens
tttctttctagt

SEQ ID NO: 3403406 - DNA, 13 bp, Homo sapiens
tttctttgaatgt

SEQ ID NO: 3403407 - DNA, 19 bp, Homo sapiens
tttctttgctgctgtggaa

SEQ ID NO: 3403408 - DNA, 24 bp, Homo sapiens
tttgaaaaacttttaggttgttac

SEQ ID NO: 3403409 - DNA, 13 bp, Homo sapiens
tttgaaaagctat

SEQ ID NO: 3403410 - DNA, 15 bp, Homo sapiens
tttgaaaagctatta

SEQ ID NO: 3403411 - DNA, 18 bp, Homo sapiens
tttgaaaagctattagcc

SEQ ID NO: 3403412 - DNA, 21 bp, Homo sapiens
tttgaaactaactcatagatt

SEQ ID NO: 3403413 - DNA, 11 bp, Homo sapiens
aaaaaaatgcc

SEQ ID NO: 3403414 - DNA, 15 bp, Homo sapiens
aaaaaagaagtttgg

SEQ ID NO: 3403415 - DNA, 14 bp, Homo sapiens
aaagtttgtccttt

SEQ ID NO: 3403416 - DNA, 13 bp, Homo sapiens
aaagttttgaaaa

SEQ ID NO: 3403417 - DNA, 16 bp, Homo sapiens
aaagttttgaaaagct

SEQ ID NO: 3403418 - DNA, 18 bp, Homo sapiens
aaagtttttttatttctt

SEQ ID NO: 3403419 - DNA, 19 bp, Homo sapiens
aaataaaactaaggaaccc

SEQ ID NO: 3403420 - DNA, 18 bp, Homo sapiens
aaataaagctactgaatt

SEQ ID NO: 3403421 - DNA, 16 bp, Homo sapiens
aaataacaatgttaag

SEQ ID NO: 3403422 - DNA, 18 bp, Homo sapiens
aaataacagctttcttat

SEQ ID NO: 3403423 - DNA, 13 bp, Homo sapiens
aaataatatactt

SEQ ID NO: 3403424 - DNA, 12 bp, Homo sapiens
aaataatgtctc

SEQ ID NO: 3403425 - DNA, 21 bp, Homo sapiens
aaatacaagttaaggtatctg

SEQ ID NO: 3403426 - DNA, 14 bp, Homo sapiens
aaatacctcaggaa

SEQ ID NO: 3403427 - DNA, 15 bp, Homo sapiens
aaatacggtgggggt

SEQ ID NO: 3403428 - DNA, 15 bp, Homo sapiens
aaatagaaagagttc

SEQ ID NO: 3403429 - DNA, 23 bp, Homo sapiens
aaatagaaagagttctatggaga

SEQ ID NO: 3403430 - DNA, 19 bp, Homo sapiens
aaatagggtccttgaaaca

SEQ ID NO: 3403431 - DNA, 22 bp, Homo sapiens
aaatatagttgtctttctttgc

SEQ ID NO: 3403432 - DNA, 23 bp, Homo sapiens
aaatatagttgtctttctttgct

SEQ ID NO: 3403433 - DNA, 21 bp, Homo sapiens
aaatatccctttttcacatat

SEQ ID NO: 3403434 - DNA, 16 bp, Homo sapiens
aaatatctgaacattt

SEQ ID NO: 3403435 - DNA, 20 bp, Homo sapiens
aaatatctttgcatcataga

SEQ ID NO: 3403436 - DNA, 23 bp, Homo sapiens
aaatatgcagtgatatggcagaa

SEQ ID NO: 3403437 - DNA, 14 bp, Homo sapiens
aaatattttgaata

SEQ ID NO: 3403438 - DNA, 12 bp, Homo sapiens
aaatcaattttt

SEQ ID NO: 3403439 - DNA, 19 bp, Homo sapiens
aaatctgaattttaaaaca

SEQ ID NO: 3403440 - DNA, 11 bp, Homo sapiens
aaatcttcagc

SEQ ID NO: 3403441 - DNA, 13 bp, Homo sapiens
aaatcttcagctg

SEQ ID NO: 3403442 - DNA, 21 bp, Homo sapiens
aaatcttcagctggtggatgg

SEQ ID NO: 3403443 - DNA, 16 bp, Homo sapiens
aaatgaatttgactgg

SEQ ID NO: 3403444 - DNA, 14 bp, Homo sapiens
aaatgagatttctt

SEQ ID NO: 3403445 - DNA, 15 bp, Homo sapiens
aaatgagatttcttt

SEQ ID NO: 3403446 - DNA, 16 bp, Homo sapiens
aaatgagggtttctga

SEQ ID NO: 3403447 - DNA, 18 bp, Homo sapiens
aaatgagttacttagaat

SEQ ID NO: 3403448 - DNA, 16 bp, Homo sapiens
aaatgcatagagcaat

SEQ ID NO: 3403449 - DNA, 11 bp, Homo sapiens
aaatgccaaaa

SEQ ID NO: 3403450 - DNA, 18 bp, Homo sapiens
aaatgccaaaatgtactt

SEQ ID NO: 3403451 - DNA, 13 bp, Homo sapiens
aaatgcctttgag

SEQ ID NO: 3403452 - DNA, 17 bp, Homo sapiens
aaatgcctttgagacag

SEQ ID NO: 3403453 - DNA, 18 bp, Homo sapiens
aaatgcctttgagacagt

SEQ ID NO: 3403454 - DNA, 14 bp, Homo sapiens
aaatgctgatattt

SEQ ID NO: 3403455 - DNA, 18 bp, Homo sapiens
aaatgctgatatttactg

SEQ ID NO: 3403456 - DNA, 14 bp, Homo sapiens
aaatgctgtgcaaa

SEQ ID NO: 3403457 - DNA, 18 bp, Homo sapiens
aaatgcttcactgtacgt

SEQ ID NO: 3403458 - DNA, 21 bp, Homo sapiens
aaatggtttctcattaaactc

SEQ ID NO: 3403459 - DNA, 20 bp, Homo sapiens
aaatgtcacacttgtttctt

SEQ ID NO: 3403460 - DNA, 23 bp, Homo sapiens
aaatgtgtcccagtgaacagttt

SEQ ID NO: 3403461 - DNA, 18 bp, Homo sapiens
aaatgtgtgtattcttaa

SEQ ID NO: 3403462 - DNA, 17 bp, Homo sapiens
aaattaaagtatgcaaa

SEQ ID NO: 3403463 - DNA, 14 bp, Homo sapiens
aaattatgaatgag

SEQ ID NO: 3403464 - DNA, 19 bp, Homo sapiens
aaattccgattagaccttt

SEQ ID NO: 3403465 - DNA, 16 bp, Homo sapiens
aaattcctttcagagt

SEQ ID NO: 3403466 - DNA, 18 bp, Homo sapiens
aaattcctttcagagttt

SEQ ID NO: 3403467 - DNA, 14 bp, Homo sapiens
aaattgatcattca

SEQ ID NO: 3403468 - DNA, 15 bp, Homo sapiens
aaattgcagtttcat

SEQ ID NO: 3403469 - DNA, 15 bp, Homo sapiens
aaattgcatttctat

SEQ ID NO: 3403470 - DNA, 23 bp, Homo sapiens
aaattgcctttgtaatatgagaa

SEQ ID NO: 3403471 - DNA, 15 bp, Homo sapiens
aaattggtctgaaag

SEQ ID NO: 3403472 - DNA, 11 bp, Homo sapiens
aaattgtgtag

SEQ ID NO: 3403473 - DNA, 17 bp, Homo sapiens
aaatttaaaaataaagc

SEQ ID NO: 3403474 - DNA, 21 bp, Homo sapiens
aaatttaagtgcgtgtgtaga

SEQ ID NO: 3403475 - DNA, 21 bp, Homo sapiens
aaatttaggtaaataaagctc

SEQ ID NO: 3403476 - DNA, 12 bp, Homo sapiens
aaatttatgtga

SEQ ID NO: 3403477 - DNA, 15 bp, Homo sapiens
aaatttatgtgatgg

SEQ ID NO: 3403478 - DNA, 16 bp, Homo sapiens
aaatttgtaagtttca

SEQ ID NO: 3403479 - DNA, 17 bp, Homo sapiens
aaatttgtaagtttcag

SEQ ID NO: 3403480 - DNA, 22 bp, Homo sapiens
aaatttgttgtcatgtgtatga

SEQ ID NO: 3403481 - DNA, 14 bp, Homo sapiens
aaattttttacttt

SEQ ID NO: 3403482 - DNA, 23 bp, Homo sapiens
aaatttttttgttgtttaacttg

SEQ ID NO: 3403483 - DNA, 13 bp, Homo sapiens
aacaaaatttcac

SEQ ID NO: 3403484 - DNA, 15 bp, Homo sapiens
aacaaaatttctatt

SEQ ID NO: 3403485 - DNA, 15 bp, Homo sapiens
aacaatcacaaaagc

SEQ ID NO: 3403486 - DNA, 18 bp, Homo sapiens
aacacagcatgtgtattt

SEQ ID NO: 3403487 - DNA, 20 bp, Homo sapiens
aacactatatggcagtgtct

SEQ ID NO: 3403488 - DNA, 22 bp, Homo sapiens
aacacttgcaggggtccctgct

SEQ ID NO: 3403489 - DNA, 21 bp, Homo sapiens
aacagaaatatataaaaatat

SEQ ID NO: 3403490 - DNA, 15 bp, Homo sapiens
aacagaacagcttca

SEQ ID NO: 3403491 - DNA, 19 bp, Homo sapiens
aacagataagcaagagaga

SEQ ID NO: 3403492 - DNA, 15 bp, Homo sapiens
aacagatgtccctga

SEQ ID NO: 3403493 - DNA, 15 bp, Homo sapiens
aacagctttcttatt

SEQ ID NO: 3403494 - DNA, 18 bp, Homo sapiens
aacagctttcttattcag

SEQ ID NO: 3403495 - DNA, 21 bp, Homo sapiens
aacagctttcttattcagtga

SEQ ID NO: 3403496 - DNA, 23 bp, Homo sapiens
aacagctttcttattcagtgaaa

SEQ ID NO: 3403497 - DNA, 16 bp, Homo sapiens
aacaggcactgccctg

SEQ ID NO: 3403498 - DNA, 18 bp, Homo sapiens
aacaggcactgccctggt

SEQ ID NO: 3403499 - DNA, 18 bp, Homo sapiens
aacaggtctcctcttaaa

SEQ ID NO: 3403500 - DNA, 21 bp, Homo sapiens
aacaggttttcttctaatcat

SEQ ID NO: 3403501 - DNA, 24 bp, Homo sapiens
aacagtgaaagtcaattcagtgat

SEQ ID NO: 3403502 - DNA, 12 bp, Homo sapiens
aacagtgaattt

SEQ ID NO: 3403503 - DNA, 20 bp, Homo sapiens
aacagtgaatttaagcatga

SEQ ID NO: 3403504 - DNA, 16 bp, Homo sapiens
aacagtgcaagatttt

SEQ ID NO: 3403505 - DNA, 20 bp, Homo sapiens
aacatagccagatgtagtct

SEQ ID NO: 3403506 - DNA, 13 bp, Homo sapiens
aacatctgtgtct

SEQ ID NO: 3403507 - DNA, 12 bp, Homo sapiens
aacatgaaaaca

SEQ ID NO: 3403508 - DNA, 20 bp, Homo sapiens
aacatggtgtgtgtctctga

SEQ ID NO: 3403509 - DNA, 21 bp, Homo sapiens
aacatggtgtgtgtctctgac

SEQ ID NO: 3403510 - DNA, 22 bp, Homo sapiens
aacatgtttctgccttctttat

SEQ ID NO: 3403511 - DNA, 17 bp, Homo sapiens
aacattaccttactgtg

SEQ ID NO: 3403512 - DNA, 17 bp, Homo sapiens
aacattcctaaaatgct

SEQ ID NO: 3403513 - DNA, 18 bp, Homo sapiens
aacattcctaaaatgctt

SEQ ID NO: 3403514 - DNA, 18 bp, Homo sapiens
aacattgatgaatgagga

SEQ ID NO: 3403515 - DNA, 19 bp, Homo sapiens
aacatttaggagaagttgg

SEQ ID NO: 3403516 - DNA, 13 bp, Homo sapiens
aaccaacccatgt

SEQ ID NO: 3403517 - DNA, 17 bp, Homo sapiens
aaccactttttgcagct

SEQ ID NO: 3403518 - DNA, 13 bp, Homo sapiens
aaccagtttagct

SEQ ID NO: 3403519 - DNA, 21 bp, Homo sapiens
aacccaggccacaaatgtgtc

SEQ ID NO: 3403520 - DNA, 19 bp, Homo sapiens
aaccccccagcactgagga

SEQ ID NO: 3403521 - DNA, 12 bp, Homo sapiens
aaccgtccctga

SEQ ID NO: 3403522 - DNA, 13 bp, Homo sapiens
aacctaattgaaa

SEQ ID NO: 3403523 - DNA, 16 bp, Homo sapiens
acactaaagtgcatta

SEQ ID NO: 3403524 - DNA, 23 bp, Homo sapiens
acactagggaaaggtaaatacaa

SEQ ID NO: 3403525 - DNA, 18 bp, Homo sapiens
acactcgggttaagaaat

SEQ ID NO: 3403526 - DNA, 16 bp, Homo sapiens
acactgtttttcatac

SEQ ID NO: 3403527 - DNA, 12 bp, Homo sapiens
acagaacactgt

SEQ ID NO: 3403528 - DNA, 16 bp, Homo sapiens
acagaacagcttcagg

SEQ ID NO: 3403529 - DNA, 20 bp, Homo sapiens
acagaagccaagctccctgg

SEQ ID NO: 3403530 - DNA, 23 bp, Homo sapiens
acagaagccaagctccctggagc

SEQ ID NO: 3403531 - DNA, 17 bp, Homo sapiens
acagaccaaaaatcaac

SEQ ID NO: 3403532 - DNA, 21 bp, Homo sapiens
acagacccctcccctcgtgtc

SEQ ID NO: 3403533 - DNA, 19 bp, Homo sapiens
acagactgaccttgatgag

SEQ ID NO: 3403534 - DNA, 18 bp, Homo sapiens
acagagctgggatgtttc

SEQ ID NO: 3403535 - DNA, 19 bp, Homo sapiens
acagataagcaagagagat

SEQ ID NO: 3403536 - DNA, 15 bp, Homo sapiens
acagatcctccattt

SEQ ID NO: 3403537 - DNA, 23 bp, Homo sapiens
acagatgttatttttgtattttt

SEQ ID NO: 3403538 - DNA, 19 bp, Homo sapiens
acagcctgggaccagggca

SEQ ID NO: 3403539 - DNA, 20 bp, Homo sapiens
acagcgtgtcaactttcatt

SEQ ID NO: 3403540 - DNA, 17 bp, Homo sapiens
acagctgagttgttgag

SEQ ID NO: 3403541 - DNA, 20 bp, Homo sapiens
acagcttctcatcctgcagg

SEQ ID NO: 3403542 - DNA, 17 bp, Homo sapiens
acagctttcttattcag

SEQ ID NO: 3403543 - DNA, 22 bp, Homo sapiens
acagctttcttattcagtgaaa

SEQ ID NO: 3403544 - DNA, 21 bp, Homo sapiens
acaggcaccgagaatgttgta

SEQ ID NO: 3403545 - DNA, 23 bp, Homo sapiens
acaggcactgccctggtggccct

SEQ ID NO: 3403546 - DNA, 15 bp, Homo sapiens
acaggcctgagattt

SEQ ID NO: 3403547 - DNA, 17 bp, Homo sapiens
acaggcctgagatttca

SEQ ID NO: 3403548 - DNA, 12 bp, Homo sapiens
acaggggccaga

SEQ ID NO: 3403549 - DNA, 14 bp, Homo sapiens
acaggggccagaag

SEQ ID NO: 3403550 - DNA, 17 bp, Homo sapiens
acaggggccagaagatg

SEQ ID NO: 3403551 - DNA, 23 bp, Homo sapiens
acaggggccagaagatgaacaga

SEQ ID NO: 3403552 - DNA, 16 bp, Homo sapiens
acagggttcaaaatgt

SEQ ID NO: 3403553 - DNA, 12 bp, Homo sapiens
acaggtattttc

SEQ ID NO: 3403554 - DNA, 20 bp, Homo sapiens
acagtatgatggaacagtga

SEQ ID NO: 3403555 - DNA, 21 bp, Homo sapiens
acagtcattatttaaagcaca

SEQ ID NO: 3403556 - DNA, 22 bp, Homo sapiens
acagtcattatttaaagcacat

SEQ ID NO: 3403557 - DNA, 15 bp, Homo sapiens
acagtctcaattttg

SEQ ID NO: 3403558 - DNA, 13 bp, Homo sapiens
acagtgaaagtca

SEQ ID NO: 3403559 - DNA, 13 bp, Homo sapiens
acagtggcaggac

SEQ ID NO: 3403560 - DNA, 22 bp, Homo sapiens
acagttcataaatttgttgtca

SEQ ID NO: 3403561 - DNA, 15 bp, Homo sapiens
acagttctgtaatgt

SEQ ID NO: 3403562 - DNA, 15 bp, Homo sapiens
acagtttatttttat

SEQ ID NO: 3403563 - DNA, 16 bp, Homo sapiens
acagtttcttagcttt

SEQ ID NO: 3403564 - DNA, 18 bp, Homo sapiens
acagtttcttagcttttt

SEQ ID NO: 3403565 - DNA, 20 bp, Homo sapiens
acataacaacctttcccatt

SEQ ID NO: 3403566 - DNA, 18 bp, Homo sapiens
acataacgtttttccttt

SEQ ID NO: 3403567 - DNA, 22 bp, Homo sapiens
acataacgtttttcctttaaaa

SEQ ID NO: 3403568 - DNA, 14 bp, Homo sapiens
acatagccagatgt

SEQ ID NO: 3403569 - DNA, 19 bp, Homo sapiens
acatattttttatatctgg

SEQ ID NO: 3403570 - DNA, 21 bp, Homo sapiens
acatattttttatatctggaa

SEQ ID NO: 3403571 - DNA, 13 bp, Homo sapiens
acatcatgttact

SEQ ID NO: 3403572 - DNA, 14 bp, Homo sapiens
acatcatgttactt

SEQ ID NO: 3403573 - DNA, 16 bp, Homo sapiens
acatcatgttacttga

SEQ ID NO: 3403574 - DNA, 16 bp, Homo sapiens
acatcgatatgaaaaa

SEQ ID NO: 3403575 - DNA, 13 bp, Homo sapiens
acatctaaagctt

SEQ ID NO: 3403576 - DNA, 17 bp, Homo sapiens
acatctaaagctttatc

SEQ ID NO: 3403577 - DNA, 22 bp, Homo sapiens
acatctaaagctttatctttgt

SEQ ID NO: 3403578 - DNA, 18 bp, Homo sapiens
acatctaaattgatcatt

SEQ ID NO: 3403579 - DNA, 12 bp, Homo sapiens
acatctgtgtct

SEQ ID NO: 3403580 - DNA, 13 bp, Homo sapiens
acatctgtgtctg

SEQ ID NO: 3403581 - DNA, 20 bp, Homo sapiens
acatctgtgtctgtgtctgc

SEQ ID NO: 3403582 - DNA, 13 bp, Homo sapiens
acatgaaaacatt

SEQ ID NO: 3403583 - DNA, 14 bp, Homo sapiens
acatgaaaacattg

SEQ ID NO: 3403584 - DNA, 14 bp, Homo sapiens
acatgccagggaaa

SEQ ID NO: 3403585 - DNA, 14 bp, Homo sapiens
acatgctgtttatg

SEQ ID NO: 3403586 - DNA, 20 bp, Homo sapiens
acatggattccaaagcattt

SEQ ID NO: 3403587 - DNA, 11 bp, Homo sapiens
acatggggagg

SEQ ID NO: 3403588 - DNA, 13 bp, Homo sapiens
acatggggaggag

SEQ ID NO: 3403589 - DNA, 19 bp, Homo sapiens
acatgtataatatttttaa

SEQ ID NO: 3403590 - DNA, 18 bp, Homo sapiens
acatgtatgtggatacag

SEQ ID NO: 3403591 - DNA, 12 bp, Homo sapiens
acatgtgaaacc

SEQ ID NO: 3403592 - DNA, 14 bp, Homo sapiens
acatgtgaaacctt

SEQ ID NO: 3403593 - DNA, 20 bp, Homo sapiens
acatgtgaaaccttttttaa

SEQ ID NO: 3403594 - DNA, 23 bp, Homo sapiens
acatgtgaaaccttttttaagat

SEQ ID NO: 3403595 - DNA, 11 bp, Homo sapiens
acatgtgcaac

SEQ ID NO: 3403596 - DNA, 18 bp, Homo sapiens
acatgtgcaactcttgta

SEQ ID NO: 3403597 - DNA, 18 bp, Homo sapiens
acattaaacaatgatcac

SEQ ID NO: 3403598 - DNA, 11 bp, Homo sapiens
acattcactgg

SEQ ID NO: 3403599 - DNA, 22 bp, Homo sapiens
acattcagctgaggttcattac

SEQ ID NO: 3403600 - DNA, 11 bp, Homo sapiens
acattccaaga

SEQ ID NO: 3403601 - DNA, 14 bp, Homo sapiens
acattcctaaaatg

SEQ ID NO: 3403602 - DNA, 22 bp, Homo sapiens
acattcttggttgttaatttag

SEQ ID NO: 3403603 - DNA, 21 bp, Homo sapiens
acatttactacagtttttaac

SEQ ID NO: 3403604 - DNA, 14 bp, Homo sapiens
acatttaggagaag

SEQ ID NO: 3403605 - DNA, 19 bp, Homo sapiens
acatttatgatttaataaa

SEQ ID NO: 3403606 - DNA, 19 bp, Homo sapiens
acattttggatttctttat

SEQ ID NO: 3403607 - DNA, 20 bp, Homo sapiens
acattttggatttctttata

SEQ ID NO: 3403608 - DNA, 22 bp, Homo sapiens
accaaattttgaggtcttttac

SEQ ID NO: 3403609 - DNA, 14 bp, Homo sapiens
accaacccatgtat

SEQ ID NO: 3403610 - DNA, 16 bp, Homo sapiens
accaagtggaccttga

SEQ ID NO: 3403611 - DNA, 18 bp, Homo sapiens
accaatgcattaccttct

SEQ ID NO: 3403612 - DNA, 13 bp, Homo sapiens
atattgtgaagta

SEQ ID NO: 3403613 - DNA, 14 bp, Homo sapiens
atatttagctccaa

SEQ ID NO: 3403614 - DNA, 23 bp, Homo sapiens
atatttagttacgtataatgctt

SEQ ID NO: 3403615 - DNA, 15 bp, Homo sapiens
atatttattatataa

SEQ ID NO: 3403616 - DNA, 16 bp, Homo sapiens
atatttcttcaagtga

SEQ ID NO: 3403617 - DNA, 23 bp, Homo sapiens
atatttcttcaagtgagtggcat

SEQ ID NO: 3403618 - DNA, 11 bp, Homo sapiens
atattttaatt

SEQ ID NO: 3403619 - DNA, 16 bp, Homo sapiens
atattttattgctaca

SEQ ID NO: 3403620 - DNA, 22 bp, Homo sapiens
atattttttatatctggaatga

SEQ ID NO: 3403621 - DNA, 18 bp, Homo sapiens
atatttttttttaagctc

SEQ ID NO: 3403622 - DNA, 21 bp, Homo sapiens
atatttttttttaagctctga

SEQ ID NO: 3403623 - DNA, 23 bp, Homo sapiens
atatttttttttaagctctgagc

SEQ ID NO: 3403624 - DNA, 13 bp, Homo sapiens
atcaaaaataatg

SEQ ID NO: 3403625 - DNA, 13 bp, Homo sapiens
atcaaacatgaaa

SEQ ID NO: 3403626 - DNA, 14 bp, Homo sapiens
atcaaacatgaaaa

SEQ ID NO: 3403627 - DNA, 15 bp, Homo sapiens
atcaacatcttttct

SEQ ID NO: 3403628 - DNA, 16 bp, Homo sapiens
atcaacctatcaaagc

SEQ ID NO: 3403629 - DNA, 20 bp, Homo sapiens
atcaagtagaacaaaaacta

SEQ ID NO: 3403630 - DNA, 12 bp, Homo sapiens
atcaatgacaga

SEQ ID NO: 3403631 - DNA, 21 bp, Homo sapiens
atcacaaaagctgtgtctctg

SEQ ID NO: 3403632 - DNA, 16 bp, Homo sapiens
atcacatctaaagctt

SEQ ID NO: 3403633 - DNA, 20 bp, Homo sapiens
atcacatctaaagctttatc

SEQ ID NO: 3403634 - DNA, 20 bp, Homo sapiens
atcactctgtgtctgagtgg

SEQ ID NO: 3403635 - DNA, 23 bp, Homo sapiens
atcacttaacattcctaaaatgc

SEQ ID NO: 3403636 - DNA, 20 bp, Homo sapiens
atcagactaagccagcaccg

SEQ ID NO: 3403637 - DNA, 16 bp, Homo sapiens
atcaggccattgtccc

SEQ ID NO: 3403638 - DNA, 22 bp, Homo sapiens
atcagtgatctcactaaaaata

SEQ ID NO: 3403639 - DNA, 15 bp, Homo sapiens
atcataacattgatt

SEQ ID NO: 3403640 - DNA, 13 bp, Homo sapiens
atcatctttgctg

SEQ ID NO: 3403641 - DNA, 15 bp, Homo sapiens
atcatctttgtgaag

SEQ ID NO: 3403642 - DNA, 17 bp, Homo sapiens
atcatggtgtaataaga

SEQ ID NO: 3403643 - DNA, 21 bp, Homo sapiens
atcatggtgtaataagacata

SEQ ID NO: 3403644 - DNA, 19 bp, Homo sapiens
atcatgttacttgagaagt

SEQ ID NO: 3403645 - DNA, 18 bp, Homo sapiens
atcatgtttacagaggac

SEQ ID NO: 3403646 - DNA, 15 bp, Homo sapiens
atcattcataatttt

SEQ ID NO: 3403647 - DNA, 18 bp, Homo sapiens
atcattgattgtcagcta

SEQ ID NO: 3403648 - DNA, 17 bp, Homo sapiens
atcattggataaatttg

SEQ ID NO: 3403649 - DNA, 16 bp, Homo sapiens
atcattttaggaaagg

SEQ ID NO: 3403650 - DNA, 14 bp, Homo sapiens
atccaaatgctgtg

SEQ ID NO: 3403651 - DNA, 23 bp, Homo sapiens
atccaaatgctgtgcaaacagtg

SEQ ID NO: 3403652 - DNA, 20 bp, Homo sapiens
atccaaggaacctaattgaa

SEQ ID NO: 3403653 - DNA, 15 bp, Homo sapiens
atccatgcttcactc

SEQ ID NO: 3403654 - DNA, 18 bp, Homo sapiens
atccatttcatctatttc

SEQ ID NO: 3403655 - DNA, 17 bp, Homo sapiens
atcccttctcctgccct

SEQ ID NO: 3403656 - DNA, 15 bp, Homo sapiens
atcctccatttttgt

SEQ ID NO: 3403657 - DNA, 22 bp, Homo sapiens
atcctgctgaaagtcctgcttt

SEQ ID NO: 3403658 - DNA, 12 bp, Homo sapiens
atccttcattgt

SEQ ID NO: 3403659 - DNA, 17 bp, Homo sapiens
atcgaaataacaatgtt

SEQ ID NO: 3403660 - DNA, 22 bp, Homo sapiens
atcgaaataacaatgttaagga

SEQ ID NO: 3403661 - DNA, 14 bp, Homo sapiens
atcgatatgaaaaa

SEQ ID NO: 3403662 - DNA, 13 bp, Homo sapiens
atcgcagcttcct

SEQ ID NO: 3403663 - DNA, 20 bp, Homo sapiens
atcgcagcttcctgtctgtt

SEQ ID NO: 3403664 - DNA, 14 bp, Homo sapiens
atcgcattgcatac

SEQ ID NO: 3403665 - DNA, 18 bp, Homo sapiens
atcggtgaaactaacaga

SEQ ID NO: 3403666 - DNA, 14 bp, Homo sapiens
atctaaagctttat

SEQ ID NO: 3403667 - DNA, 19 bp, Homo sapiens
atctaaagctttatctttg

SEQ ID NO: 3403668 - DNA, 21 bp, Homo sapiens
atctaaagctttatctttgtg

SEQ ID NO: 3403669 - DNA, 19 bp, Homo sapiens
atctaatagagaacttttt

SEQ ID NO: 3403670 - DNA, 18 bp, Homo sapiens
atctacccagtcatgtac

SEQ ID NO: 3403671 - DNA, 19 bp, Homo sapiens
atctagacccatcttcttt

SEQ ID NO: 3403672 - DNA, 14 bp, Homo sapiens
atctatacctgcct

SEQ ID NO: 3403673 - DNA, 16 bp, Homo sapiens
atctatattaaatgag

SEQ ID NO: 3403674 - DNA, 16 bp, Homo sapiens
atctatgtttcatctt

SEQ ID NO: 3403675 - DNA, 16 bp, Homo sapiens
atctcagtcacttttt

SEQ ID NO: 3403676 - DNA, 21 bp, Homo sapiens
atctcagtcactttttcccct

SEQ ID NO: 3403677 - DNA, 20 bp, Homo sapiens
atctcagtcatgcataaata

SEQ ID NO: 3403678 - DNA, 21 bp, Homo sapiens
atctcagtcatgcataaatat

SEQ ID NO: 3403679 - DNA, 15 bp, Homo sapiens
atctcgactcccccc

SEQ ID NO: 3403680 - DNA, 21 bp, Homo sapiens
atctcgactcccccctggcca

SEQ ID NO: 3403681 - DNA, 21 bp, Homo sapiens
atctctaggatgtcgtctttg

SEQ ID NO: 3403682 - DNA, 17 bp, Homo sapiens
atctctctttaatataa

SEQ ID NO: 3403683 - DNA, 13 bp, Homo sapiens
atctcttagctcc

SEQ ID NO: 3403684 - DNA, 18 bp, Homo sapiens
atctcttagctcccctcc

SEQ ID NO: 3403685 - DNA, 20 bp, Homo sapiens
atctgagaggccacagtgca

SEQ ID NO: 3403686 - DNA, 13 bp, Homo sapiens
atctgatttatac

SEQ ID NO: 3403687 - DNA, 22 bp, Homo sapiens
atctgattttttattcaacaaa

SEQ ID NO: 3403688 - DNA, 23 bp, Homo sapiens
atctgcatgtaaaatcttcagct

SEQ ID NO: 3403689 - DNA, 23 bp, Homo sapiens
atctgcctcctgtgcctcccttt

SEQ ID NO: 3403690 - DNA, 14 bp, Homo sapiens
atctgcctgtaatt

SEQ ID NO: 3403691 - DNA, 15 bp, Homo sapiens
atctgctctccttcc

SEQ ID NO: 3403692 - DNA, 20 bp, Homo sapiens
atctgctctccttcctggag

SEQ ID NO: 3403693 - DNA, 15 bp, Homo sapiens
atctgtactttgtgt

SEQ ID NO: 3403694 - DNA, 18 bp, Homo sapiens
atctgtactttgtgttta

SEQ ID NO: 3403695 - DNA, 21 bp, Homo sapiens
atctgtgaggggctctctcat

SEQ ID NO: 3403696 - DNA, 22 bp, Homo sapiens
atctgtgaggggctctctcatg

SEQ ID NO: 3403697 - DNA, 15 bp, Homo sapiens
cagaacagcttcagg

SEQ ID NO: 3403698 - DNA, 19 bp, Homo sapiens
cagaacagcttcaggttat

SEQ ID NO: 3403699 - DNA, 15 bp, Homo sapiens
cagaagaaggcagca

SEQ ID NO: 3403700 - DNA, 14 bp, Homo sapiens
cagaagacaccaga

SEQ ID NO: 3403701 - DNA, 16 bp, Homo sapiens
cagaagacaccagagc

SEQ ID NO: 3403702 - DNA, 14 bp, Homo sapiens
cagacgcccagatt

SEQ ID NO: 3403703 - DNA, 23 bp, Homo sapiens
cagactaagccagcaccggacca

SEQ ID NO: 3403704 - DNA, 13 bp, Homo sapiens
cagactgaccttg

SEQ ID NO: 3403705 - DNA, 18 bp, Homo sapiens
cagactgttgtccctgca

SEQ ID NO: 3403706 - DNA, 17 bp, Homo sapiens
cagagacatcagccctt

SEQ ID NO: 3403707 - DNA, 18 bp, Homo sapiens
cagagagccattttgtga

SEQ ID NO: 3403708 - DNA, 19 bp, Homo sapiens
cagagagccattttgtgaa

SEQ ID NO: 3403709 - DNA, 21 bp, Homo sapiens
cagagagccattttgtgaatg

SEQ ID NO: 3403710 - DNA, 23 bp, Homo sapiens
cagagattgtagtatttagtata

SEQ ID NO: 3403711 - DNA, 13 bp, Homo sapiens
cagagcagatgca

SEQ ID NO: 3403712 - DNA, 14 bp, Homo sapiens
cagagcagatgcag

SEQ ID NO: 3403713 - DNA, 19 bp, Homo sapiens
cagagcagatgcagagagc

SEQ ID NO: 3403714 - DNA, 23 bp, Homo sapiens
cagagccttctgaggacattcca

SEQ ID NO: 3403715 - DNA, 22 bp, Homo sapiens
cagaggacagtatttgtgggga

SEQ ID NO: 3403716 - DNA, 18 bp, Homo sapiens
cagagggatctaggtctt

SEQ ID NO: 3403717 - DNA, 17 bp, Homo sapiens
cagaggggcagatggaa

SEQ ID NO: 3403718 - DNA, 20 bp, Homo sapiens
cagaggggcctgccacctgg

SEQ ID NO: 3403719 - DNA, 22 bp, Homo sapiens
cagaggggcctgccacctggac

SEQ ID NO: 3403720 - DNA, 15 bp, Homo sapiens
cagaggtaacagaac

SEQ ID NO: 3403721 - DNA, 19 bp, Homo sapiens
cagaggtaacagaacagct

SEQ ID NO: 3403722 - DNA, 23 bp, Homo sapiens
cagaggtaacagaacagcttcag

SEQ ID NO: 3403723 - DNA, 12 bp, Homo sapiens
cagagttctttg

SEQ ID NO: 3403724 - DNA, 13 bp, Homo sapiens
cagagttctttgc

SEQ ID NO: 3403725 - DNA, 13 bp, Homo sapiens
cagagttttacta

SEQ ID NO: 3403726 - DNA, 20 bp, Homo sapiens
cagataagcaagagagatgt

SEQ ID NO: 3403727 - DNA, 14 bp, Homo sapiens
cagatcctccattt

SEQ ID NO: 3403728 - DNA, 17 bp, Homo sapiens
cagatgattcaaatatc

SEQ ID NO: 3403729 - DNA, 16 bp, Homo sapiens
cagatggaaaggagcc

SEQ ID NO: 3403730 - DNA, 18 bp, Homo sapiens
cagatggagcaaatgtcc

SEQ ID NO: 3403731 - DNA, 19 bp, Homo sapiens
cagatgtagatataaatat

SEQ ID NO: 3403732 - DNA, 13 bp, Homo sapiens
cagatgtccctga

SEQ ID NO: 3403733 - DNA, 22 bp, Homo sapiens
cagatgtccctgaagtcttgca

SEQ ID NO: 3403734 - DNA, 19 bp, Homo sapiens
cagattatgagacacagga

SEQ ID NO: 3403735 - DNA, 21 bp, Homo sapiens
cagattatgagacacaggatg

SEQ ID NO: 3403736 - DNA, 18 bp, Homo sapiens
cagattccacacaaaatg

SEQ ID NO: 3403737 - DNA, 12 bp, Homo sapiens
cagattgaaaag

SEQ ID NO: 3403738 - DNA, 14 bp, Homo sapiens
cagattgaaaagga

SEQ ID NO: 3403739 - DNA, 20 bp, Homo sapiens
cagtgatatggcagaagaca

SEQ ID NO: 3403740 - DNA, 21 bp, Homo sapiens
cagtgatctcgactcccccct

SEQ ID NO: 3403741 - DNA, 16 bp, Homo sapiens
cagtgggcatgtatta

SEQ ID NO: 3403742 - DNA, 18 bp, Homo sapiens
cagtgtgtccatcatatt

SEQ ID NO: 3403743 - DNA, 17 bp, Homo sapiens
cagtgttagtattcacc

SEQ ID NO: 3403744 - DNA, 12 bp, Homo sapiens
cagtgtttgtat

SEQ ID NO: 3403745 - DNA, 20 bp, Homo sapiens
cagttaaataaatagaaaga

SEQ ID NO: 3403746 - DNA, 23 bp, Homo sapiens
cagttcataaatttgttgtcatg

SEQ ID NO: 3403747 - DNA, 14 bp, Homo sapiens
cagtttagcttttt

SEQ ID NO: 3403748 - DNA, 19 bp, Homo sapiens
cagtttttaactctactgt

SEQ ID NO: 3403749 - DNA, 22 bp, Homo sapiens
cagtttttaactctactgtgta

SEQ ID NO: 3403750 - DNA, 20 bp, Homo sapiens
cataaatatgcagtgatatg

SEQ ID NO: 3403751 - DNA, 22 bp, Homo sapiens
cataacatagttgaaaaaagaa

SEQ ID NO: 3403752 - DNA, 16 bp, Homo sapiens
cataacgtttttcctt

SEQ ID NO: 3403753 - DNA, 17 bp, Homo sapiens
cataacgtttttccttt

SEQ ID NO: 3403754 - DNA, 14 bp, Homo sapiens
cataatttgtctta

SEQ ID NO: 3403755 - DNA, 21 bp, Homo sapiens
cataatttgtcttagttgata

SEQ ID NO: 3403756 - DNA, 19 bp, Homo sapiens
catactcaatgttactatc

SEQ ID NO: 3403757 - DNA, 11 bp, Homo sapiens
catagagcaat

SEQ ID NO: 3403758 - DNA, 22 bp, Homo sapiens
catagatttgaagatctgattt

SEQ ID NO: 3403759 - DNA, 22 bp, Homo sapiens
catagtccttttatctccttgt

SEQ ID NO: 3403760 - DNA, 21 bp, Homo sapiens
catagttgaaaaaagaagttt

SEQ ID NO: 3403761 - DNA, 24 bp, Homo sapiens
catataaaatgctgatatttactg

SEQ ID NO: 3403762 - DNA, 19 bp, Homo sapiens
catataaactttttaaaga

SEQ ID NO: 3403763 - DNA, 19 bp, Homo sapiens
catataactgtgatgaaat

SEQ ID NO: 3403764 - DNA, 15 bp, Homo sapiens
catatatgctgtatt

SEQ ID NO: 3403765 - DNA, 14 bp, Homo sapiens
catatcctgagcca

SEQ ID NO: 3403766 - DNA, 20 bp, Homo sapiens
catatctctagtccctgtgt

SEQ ID NO: 3403767 - DNA, 20 bp, Homo sapiens
catattaggaaaatatgggt

SEQ ID NO: 3403768 - DNA, 19 bp, Homo sapiens
catattttttatatctgga

SEQ ID NO: 3403769 - DNA, 14 bp, Homo sapiens
catcaaacatgaaa

SEQ ID NO: 3403770 - DNA, 16 bp, Homo sapiens
catcaatttgtaattt

SEQ ID NO: 3403771 - DNA, 22 bp, Homo sapiens
catcaatttgtaattttagtat

SEQ ID NO: 3403772 - DNA, 19 bp, Homo sapiens
catccatggggctgattgt

SEQ ID NO: 3403773 - DNA, 18 bp, Homo sapiens
catcgaggtatgtttata

SEQ ID NO: 3403774 - DNA, 19 bp, Homo sapiens
catcgaggtatgtttatat

SEQ ID NO: 3403775 - DNA, 21 bp, Homo sapiens
catcggtgaaactaacagata

SEQ ID NO: 3403776 - DNA, 12 bp, Homo sapiens
catctaaagctt

SEQ ID NO: 3403777 - DNA, 20 bp, Homo sapiens
catctccggggtggccacag

SEQ ID NO: 3403778 - DNA, 14 bp, Homo sapiens
catctctctttaat

SEQ ID NO: 3403779 - DNA, 16 bp, Homo sapiens
catctcttagctcccc

SEQ ID NO: 3403780 - DNA, 15 bp, Homo sapiens
catctgcctgtaatt

SEQ ID NO: 3403781 - DNA, 20 bp, Homo sapiens
catctgctctccttcctgga

SEQ ID NO: 3403782 - DNA, 17 bp, Homo sapiens
catctgtacctctgcct

SEQ ID NO: 3403783 - DNA, 11 bp, Homo sapiens
catctgtgtct

SEQ ID NO: 3403784 - DNA, 13 bp, Homo sapiens
catctgtgtctgt

SEQ ID NO: 3403785 - DNA, 21 bp, Homo sapiens
catcttggccctcctcagctc

SEQ ID NO: 3403786 - DNA, 12 bp, Homo sapiens
catctttgctga

SEQ ID NO: 3403787 - DNA, 22 bp, Homo sapiens
catctttgtgaaggcctcgcag

SEQ ID NO: 3403788 - DNA, 16 bp, Homo sapiens
catcttttcttgcctc

SEQ ID NO: 3403789 - DNA, 18 bp, Homo sapiens
catgaaaacattgatgaa

SEQ ID NO: 3403790 - DNA, 13 bp, Homo sapiens
catgaaaatgcaa

SEQ ID NO: 3403791 - DNA, 23 bp, Homo sapiens
catgactgagtctggcaaacatg

SEQ ID NO: 3403792 - DNA, 21 bp, Homo sapiens
catgagtggccttaataaata

SEQ ID NO: 3403793 - DNA, 15 bp, Homo sapiens
catgcaaactgcttt

SEQ ID NO: 3403794 - DNA, 16 bp, Homo sapiens
catgcaaactgcttta

SEQ ID NO: 3403795 - DNA, 17 bp, Homo sapiens
catgcaggtctccatga

SEQ ID NO: 3403796 - DNA, 16 bp, Homo sapiens
catgcataaatatgca

SEQ ID NO: 3403797 - DNA, 17 bp, Homo sapiens
catgcataaatatgcag

SEQ ID NO: 3403798 - DNA, 19 bp, Homo sapiens
catgcataaatatgcagtg

SEQ ID NO: 3403799 - DNA, 22 bp, Homo sapiens
catgcataaatatgcagtgata

SEQ ID NO: 3403800 - DNA, 12 bp, Homo sapiens
catgcttcactc

SEQ ID NO: 3403801 - DNA, 15 bp, Homo sapiens
catggacaatggacc

SEQ ID NO: 3403802 - DNA, 23 bp, Homo sapiens
catggacaatggaccggagagtg

SEQ ID NO: 3403803 - DNA, 15 bp, Homo sapiens
catggacagaagaag

SEQ ID NO: 3403804 - DNA, 21 bp, Homo sapiens
catggacagaagaaggcagca

SEQ ID NO: 3403805 - DNA, 13 bp, Homo sapiens
catggagtgtttg

SEQ ID NO: 3403806 - DNA, 21 bp, Homo sapiens
catggagtgtttgacgaagaa

SEQ ID NO: 3403807 - DNA, 21 bp, Homo sapiens
catggcaacccctaagaatag

SEQ ID NO: 3403808 - DNA, 16 bp, Homo sapiens
catgggaaggtgggcg

SEQ ID NO: 3403809 - DNA, 14 bp, Homo sapiens
catgggcttcactg

SEQ ID NO: 3403810 - DNA, 17 bp, Homo sapiens
catgggcttcactgtat

SEQ ID NO: 3403811 - DNA, 19 bp, Homo sapiens
attaccatagagtaatgat

SEQ ID NO: 3403812 - DNA, 15 bp, Homo sapiens
attacctaatgaaag

SEQ ID NO: 3403813 - DNA, 22 bp, Homo sapiens
attagccaggatcatggtgtaa

SEQ ID NO: 3403814 - DNA, 14 bp, Homo sapiens
attagccagtcatt

SEQ ID NO: 3403815 - DNA, 19 bp, Homo sapiens
attaggtccacttcaatgt

SEQ ID NO: 3403816 - DNA, 13 bp, Homo sapiens
attagttgctttg

SEQ ID NO: 3403817 - DNA, 15 bp, Homo sapiens
attagttgctttgtt

SEQ ID NO: 3403818 - DNA, 14 bp, Homo sapiens
attataatgccaga

SEQ ID NO: 3403819 - DNA, 16 bp, Homo sapiens
attatataaggacaga

SEQ ID NO: 3403820 - DNA, 16 bp, Homo sapiens
attatcaccaggattt

SEQ ID NO: 3403821 - DNA, 19 bp, Homo sapiens
attatcaccaggatttata

SEQ ID NO: 3403822 - DNA, 17 bp, Homo sapiens
attatgcccatgaacaa

SEQ ID NO: 3403823 - DNA, 18 bp, Homo sapiens
attatgggaatcaagatt

SEQ ID NO: 3403824 - DNA, 19 bp, Homo sapiens
attattgtgacaaaatgtt

SEQ ID NO: 3403825 - DNA, 15 bp, Homo sapiens
attatttaataacat

SEQ ID NO: 3403826 - DNA, 17 bp, Homo sapiens
attatttgtatgtatta

SEQ ID NO: 3403827 - DNA, 14 bp, Homo sapiens
attcaaatatcaaa

SEQ ID NO: 3403828 - DNA, 14 bp, Homo sapiens
attcacaaagtata

SEQ ID NO: 3403829 - DNA, 17 bp, Homo sapiens
attcagcggcagtgtgt

SEQ ID NO: 3403830 - DNA, 17 bp, Homo sapiens
attcagctgaggttcat

SEQ ID NO: 3403831 - DNA, 12 bp, Homo sapiens
attcatcaaata

SEQ ID NO: 3403832 - DNA, 16 bp, Homo sapiens
attcatcttcttcttt

SEQ ID NO: 3403833 - DNA, 17 bp, Homo sapiens
attcatggcctggggga

SEQ ID NO: 3403834 - DNA, 23 bp, Homo sapiens
attcattttgtggcaaaatattc

SEQ ID NO: 3403835 - DNA, 13 bp, Homo sapiens
attccaagacagt

SEQ ID NO: 3403836 - DNA, 22 bp, Homo sapiens
attccacagggataccttaatt

SEQ ID NO: 3403837 - DNA, 20 bp, Homo sapiens
attccttctttgataatgtt

SEQ ID NO: 3403838 - DNA, 22 bp, Homo sapiens
attccttctttgataatgttaa

SEQ ID NO: 3403839 - DNA, 12 bp, Homo sapiens
attctcattatt

SEQ ID NO: 3403840 - DNA, 14 bp, Homo sapiens
attctcattatttc

SEQ ID NO: 3403841 - DNA, 16 bp, Homo sapiens
attctcattatttcat

SEQ ID NO: 3403842 - DNA, 14 bp, Homo sapiens
attctccttcagcc

SEQ ID NO: 3403843 - DNA, 23 bp, Homo sapiens
attctccttcagccctcacccct

SEQ ID NO: 3403844 - DNA, 16 bp, Homo sapiens
attctgaaatactttt

SEQ ID NO: 3403845 - DNA, 15 bp, Homo sapiens
attctgataatgtat

SEQ ID NO: 3403846 - DNA, 18 bp, Homo sapiens
attctgataatgtattgc

SEQ ID NO: 3403847 - DNA, 11 bp, Homo sapiens
attctgcatta

SEQ ID NO: 3403848 - DNA, 15 bp, Homo sapiens
attctgcattaataa

SEQ ID NO: 3403849 - DNA, 19 bp, Homo sapiens
attctgttctacttgatat

SEQ ID NO: 3403850 - DNA, 17 bp, Homo sapiens
attcttacaaacatgtg

SEQ ID NO: 3403851 - DNA, 17 bp, Homo sapiens
attctttccattatgat

SEQ ID NO: 3403852 - DNA, 21 bp, Homo sapiens
attctttccattatgattctt

SEQ ID NO: 3403853 - DNA, 13 bp, Homo sapiens
attgaaaaggaca

SEQ ID NO: 3403854 - DNA, 14 bp, Homo sapiens
attgaaagttgctt

SEQ ID NO: 3403855 - DNA, 15 bp, Homo sapiens
attgaaagttgcttt

SEQ ID NO: 3403856 - DNA, 17 bp, Homo sapiens
attgaccatgtgattat

SEQ ID NO: 3403857 - DNA, 17 bp, Homo sapiens
attgagaataagaattt

SEQ ID NO: 3403858 - DNA, 22 bp, Homo sapiens
attgagcaagtatccttcattg

SEQ ID NO: 3403859 - DNA, 15 bp, Homo sapiens
attgagcgtgattct

SEQ ID NO: 3403860 - DNA, 15 bp, Homo sapiens
attgagtcttaactg

SEQ ID NO: 3403861 - DNA, 18 bp, Homo sapiens
atttttatattagttgct

SEQ ID NO: 3403862 - DNA, 15 bp, Homo sapiens
atttttattaactgc

SEQ ID NO: 3403863 - DNA, 15 bp, Homo sapiens
atttttccatctgtg

SEQ ID NO: 3403864 - DNA, 16 bp, Homo sapiens
atttttccatctgtgt

SEQ ID NO: 3403865 - DNA, 17 bp, Homo sapiens
atttttctcaaagtttt

SEQ ID NO: 3403866 - DNA, 13 bp, Homo sapiens
atttttgtatttt

SEQ ID NO: 3403867 - DNA, 20 bp, Homo sapiens
atttttgtgaaatgaaaaca

SEQ ID NO: 3403868 - DNA, 12 bp, Homo sapiens
atttttgtttat

SEQ ID NO: 3403869 - DNA, 15 bp, Homo sapiens
attttttaaaagaga

SEQ ID NO: 3403870 - DNA, 13 bp, Homo sapiens
attttttcatttc

SEQ ID NO: 3403871 - DNA, 21 bp, Homo sapiens
attttttcatttcaaaatgct

SEQ ID NO: 3403872 - DNA, 21 bp, Homo sapiens
atttttttaaacaaaatttca

SEQ ID NO: 3403873 - DNA, 15 bp, Homo sapiens
atttttttcagtatt

SEQ ID NO: 3403874 - DNA, 16 bp, Homo sapiens
atttttttgttgttta

SEQ ID NO: 3403875 - DNA, 20 bp, Homo sapiens
atttttttttaagctctgag

SEQ ID NO: 3403876 - DNA, 16 bp, Homo sapiens
attttttttttaagtg

SEQ ID NO: 3403877 - DNA, 13 bp, Homo sapiens
caaaaactattat

SEQ ID NO: 3403878 - DNA, 19 bp, Homo sapiens
caaaaatcaacctatcaaa

SEQ ID NO: 3403879 - DNA, 14 bp, Homo sapiens
caaaagctgtgtct

SEQ ID NO: 3403880 - DNA, 17 bp, Homo sapiens
caaaagctgtgtctctg

SEQ ID NO: 3403881 - DNA, 16 bp, Homo sapiens
caaaaggaagattctt

SEQ ID NO: 3403882 - DNA, 15 bp, Homo sapiens
caaaagtctgaggca

SEQ ID NO: 3403883 - DNA, 19 bp, Homo sapiens
caaaataatctatattaaa

SEQ ID NO: 3403884 - DNA, 21 bp, Homo sapiens
caaaataatctatattaaatg

SEQ ID NO: 3403885 - DNA, 14 bp, Homo sapiens
caaaatattcttct

SEQ ID NO: 3403886 - DNA, 14 bp, Homo sapiens
caaaatttcacagt

SEQ ID NO: 3403887 - DNA, 18 bp, Homo sapiens
caaaatttcacagttctg

SEQ ID NO: 3403888 - DNA, 14 bp, Homo sapiens
caaacatgaaaaca

SEQ ID NO: 3403889 - DNA, 18 bp, Homo sapiens
caaacatgtggttaatgc

SEQ ID NO: 3403890 - DNA, 20 bp, Homo sapiens
caaacatgtggttaatgcca

SEQ ID NO: 3403891 - DNA, 20 bp, Homo sapiens
caaaccactttttgcagctt

SEQ ID NO: 3403892 - DNA, 21 bp, Homo sapiens
caaactaactaataaaatata

SEQ ID NO: 3403893 - DNA, 14 bp, Homo sapiens
caaactatgtaatg

SEQ ID NO: 3403894 - DNA, 18 bp, Homo sapiens
caaactgctttattttcc

SEQ ID NO: 3403895 - DNA, 21 bp, Homo sapiens
caaactgtaaaaaatgtgtgt

SEQ ID NO: 3403896 - DNA, 13 bp, Homo sapiens
caaagaagtggtt

SEQ ID NO: 3403897 - DNA, 14 bp, Homo sapiens
caaagagagttttt

SEQ ID NO: 3403898 - DNA, 18 bp, Homo sapiens
caaagagtttgatgaggc

SEQ ID NO: 3403899 - DNA, 16 bp, Homo sapiens
caaagcttcaaaaact

SEQ ID NO: 3403900 - DNA, 13 bp, Homo sapiens
caaagttcagtgt

SEQ ID NO: 3403901 - DNA, 13 bp, Homo sapiens
caaagttccagtt

SEQ ID NO: 3403902 - DNA, 14 bp, Homo sapiens
caaagttccagttt

SEQ ID NO: 3403903 - DNA, 21 bp, Homo sapiens
caaagttccagttttgttttg

SEQ ID NO: 3403904 - DNA, 13 bp, Homo sapiens
caaagttttgaaa

SEQ ID NO: 3403905 - DNA, 21 bp, Homo sapiens
caaagttttgaaaagctatta

SEQ ID NO: 3403906 - DNA, 14 bp, Homo sapiens
caaataacagcttt

SEQ ID NO: 3403907 - DNA, 13 bp, Homo sapiens
caaataatgtctc

SEQ ID NO: 3403908 - DNA, 16 bp, Homo sapiens
caaataatgtctctgt

SEQ ID NO: 3403909 - DNA, 20 bp, Homo sapiens
caaataatgtctctgtgaga

SEQ ID NO: 3403910 - DNA, 22 bp, Homo sapiens
caaatgagatttctttgaatgt

SEQ ID NO: 3403911 - DNA, 15 bp, Homo sapiens
caaatgctgtgcaaa

SEQ ID NO: 3403912 - DNA, 20 bp, Homo sapiens
caaatgctgtgcaaacagtg

SEQ ID NO: 3403913 - DNA, 21 bp, Homo sapiens
caaatgtcctaacagagaaat

SEQ ID NO: 3403914 - DNA, 21 bp, Homo sapiens
caaatttactgtcttaaatca

SEQ ID NO: 3403915 - DNA, 19 bp, Homo sapiens
caaattttgaggtctttta

SEQ ID NO: 3403916 - DNA, 21 bp, Homo sapiens
caacacttgcaggggtccctg

SEQ ID NO: 3403917 - DNA, 13 bp, Homo sapiens
caacatgtataat

SEQ ID NO: 3403918 - DNA, 15 bp, Homo sapiens
caacatgtatgtgga

SEQ ID NO: 3403919 - DNA, 19 bp, Homo sapiens
caaccagggagctgcaggg

SEQ ID NO: 3403920 - DNA, 14 bp, Homo sapiens
caaccccccagcac

SEQ ID NO: 3403921 - DNA, 15 bp, Homo sapiens
caaccccccagcact

SEQ ID NO: 3403922 - DNA, 15 bp, Homo sapiens
caactcccccaccgc

SEQ ID NO: 3403923 - DNA, 22 bp, Homo sapiens
caactcccccaccgcccactct

SEQ ID NO: 3403924 - DNA, 22 bp, Homo sapiens
caactcttgtattgctccattt

SEQ ID NO: 3403925 - DNA, 15 bp, Homo sapiens
caactttcatttgaa

SEQ ID NO: 3403926 - DNA, 19 bp, Homo sapiens
caagaaaacaggcactgcc

SEQ ID NO: 3403927 - DNA, 23 bp, Homo sapiens
caagaaatcgccttatgagaaca

SEQ ID NO: 3403928 - DNA, 15 bp, Homo sapiens
caagacaagctcctc

SEQ ID NO: 3403929 - DNA, 15 bp, Homo sapiens
caagagagatgtttt

SEQ ID NO: 3403930 - DNA, 19 bp, Homo sapiens
caagatccaaatgctgtgc

SEQ ID NO: 3403931 - DNA, 23 bp, Homo sapiens
caagattttttttttaagtgaca

SEQ ID NO: 3403932 - DNA, 18 bp, Homo sapiens
caagcatttttccatctg

SEQ ID NO: 3403933 - DNA, 17 bp, Homo sapiens
caagccttggctctacc

SEQ ID NO: 3403934 - DNA, 15 bp, Homo sapiens
caagctccctggagc

SEQ ID NO: 3403935 - DNA, 17 bp, Homo sapiens
caagctccctggagccc

SEQ ID NO: 3403936 - DNA, 19 bp, Homo sapiens
caagctccctggagccctg

SEQ ID NO: 3403937 - DNA, 10 bp, Homo sapiens
caagctcctc

SEQ ID NO: 3403938 - DNA, 14 bp, Homo sapiens
caagcttaaagctt

SEQ ID NO: 3403939 - DNA, 20 bp, Homo sapiens
caaggaacctaattgaaatt

SEQ ID NO: 3403940 - DNA, 16 bp, Homo sapiens
caagtaagaagacatg

SEQ ID NO: 3403941 - DNA, 22 bp, Homo sapiens
caagtaagaagacatgaaccaa

SEQ ID NO: 3403942 - DNA, 19 bp, Homo sapiens
caagtagaacaaaaactat

SEQ ID NO: 3403943 - DNA, 22 bp, Homo sapiens
caagtagaacaaaaactattat

SEQ ID NO: 3403944 - DNA, 17 bp, Homo sapiens
caagtatccttcattgt

SEQ ID NO: 3403945 - DNA, 21 bp, Homo sapiens
caagtatgaagtataaatctg

SEQ ID NO: 3403946 - DNA, 16 bp, Homo sapiens
caagtcagtttctaca

SEQ ID NO: 3403947 - DNA, 12 bp, Homo sapiens
caagtcattgtt

SEQ ID NO: 3403948 - DNA, 13 bp, Homo sapiens
caagtcattgttt

SEQ ID NO: 3403949 - DNA, 12 bp, Homo sapiens
caagtgagtggc

SEQ ID NO: 3403950 - DNA, 17 bp, Homo sapiens
caagttagtttctcata

SEQ ID NO: 3403951 - DNA, 20 bp, Homo sapiens
caatagtgtcctatgcaata

SEQ ID NO: 3403952 - DNA, 13 bp, Homo sapiens
caatattttccat

SEQ ID NO: 3403953 - DNA, 17 bp, Homo sapiens
caatgataaataaagtc

SEQ ID NO: 3403954 - DNA, 20 bp, Homo sapiens
caatgatacccaacagttta

SEQ ID NO: 3403955 - DNA, 19 bp, Homo sapiens
caatgatcacatctaaagc

SEQ ID NO: 3403956 - DNA, 17 bp, Homo sapiens
caatgcgtcttgtgaaa

SEQ ID NO: 3403957 - DNA, 18 bp, Homo sapiens
caatgcgtcttgtgaaat

SEQ ID NO: 3403958 - DNA, 22 bp, Homo sapiens
caatggaccggagagtgggggt

SEQ ID NO: 3403959 - DNA, 17 bp, Homo sapiens
caatggtttgcaaggaa

SEQ ID NO: 3403960 - DNA, 20 bp, Homo sapiens
caatggtttgcaaggaagcc

SEQ ID NO: 3403961 - DNA, 21 bp, Homo sapiens
caatgtacaaggtatgtacag

SEQ ID NO: 3403962 - DNA, 15 bp, Homo sapiens
caatgtgatctatgt

SEQ ID NO: 3403963 - DNA, 11 bp, Homo sapiens
caatgttaagg

SEQ ID NO: 3403964 - DNA, 20 bp, Homo sapiens
caattaagtgttgaaaaata

SEQ ID NO: 3403965 - DNA, 18 bp, Homo sapiens
cacaaaatgtcacacttg

SEQ ID NO: 3403966 - DNA, 21 bp, Homo sapiens
cacactcgggttaagaaatac

SEQ ID NO: 3403967 - DNA, 13 bp, Homo sapiens
cacagacccctcc

SEQ ID NO: 3403968 - DNA, 22 bp, Homo sapiens
cacagcgctggccgggaccccg

SEQ ID NO: 3403969 - DNA, 17 bp, Homo sapiens
cacaggacccagaaaaa

SEQ ID NO: 3403970 - DNA, 13 bp, Homo sapiens
cacaggcctgaga

SEQ ID NO: 3403971 - DNA, 15 bp, Homo sapiens
cacaggcctgagatt

SEQ ID NO: 3403972 - DNA, 20 bp, Homo sapiens
cacaggcctgagatttcatc

SEQ ID NO: 3403973 - DNA, 14 bp, Homo sapiens
gtaagtttcaggtg

SEQ ID NO: 3403974 - DNA, 16 bp, Homo sapiens
gtaagtttcaggtgac

SEQ ID NO: 3403975 - DNA, 12 bp, Homo sapiens
gtaatataaaag

SEQ ID NO: 3403976 - DNA, 14 bp, Homo sapiens
gtaatatgagaatg

SEQ ID NO: 3403977 - DNA, 16 bp, Homo sapiens
gtaatgcttatgtgtt

SEQ ID NO: 3403978 - DNA, 20 bp, Homo sapiens
gtaatgtagggttatatttg

SEQ ID NO: 3403979 - DNA, 21 bp, Homo sapiens
gtaatgtagggttatatttgg

SEQ ID NO: 3403980 - DNA, 23 bp, Homo sapiens
gtaatttaaaattgtgatgtgtc

SEQ ID NO: 3403981 - DNA, 18 bp, Homo sapiens
gtacaggatgctttggtt

SEQ ID NO: 3403982 - DNA, 17 bp, Homo sapiens
gtacagttcataaattt

SEQ ID NO: 3403983 - DNA, 14 bp, Homo sapiens
gtacatttatgatt

SEQ ID NO: 3403984 - DNA, 19 bp, Homo sapiens
gtacatttatgatttaata

SEQ ID NO: 3403985 - DNA, 21 bp, Homo sapiens
gtacatttatgatttaataaa

SEQ ID NO: 3403986 - DNA, 22 bp, Homo sapiens
gtacatttatgatttaataaaa

SEQ ID NO: 3403987 - DNA, 19 bp, Homo sapiens
gtacattttggatttcttt

SEQ ID NO: 3403988 - DNA, 14 bp, Homo sapiens
gtactaaggagaat

SEQ ID NO: 3403989 - DNA, 15 bp, Homo sapiens
gtactacaatttaaa

SEQ ID NO: 3403990 - DNA, 13 bp, Homo sapiens
gtacttaaatgag

SEQ ID NO: 3403991 - DNA, 18 bp, Homo sapiens
gtagaagcattccttctt

SEQ ID NO: 3403992 - DNA, 22 bp, Homo sapiens
gtagaagcattccttctttgat

SEQ ID NO: 3403993 - DNA, 15 bp, Homo sapiens
gtagagccagaggtc

SEQ ID NO: 3403994 - DNA, 16 bp, Homo sapiens
gtagggggctggagga

SEQ ID NO: 3403995 - DNA, 19 bp, Homo sapiens
gtagggggctggaggagcc

SEQ ID NO: 3403996 - DNA, 17 bp, Homo sapiens
cttccatgctccgcctg

SEQ ID NO: 3403997 - DNA, 17 bp, Homo sapiens
cttccgcagtgtggcca

SEQ ID NO: 3403998 - DNA, 21 bp, Homo sapiens
cttccgcagtgtggccaggct

SEQ ID NO: 3403999 - DNA, 18 bp, Homo sapiens
cttcctatatgcacttat

SEQ ID NO: 3404000 - DNA, 22 bp, Homo sapiens
cttcctgattaccagtctgatt

SEQ ID NO: 3404001 - DNA, 17 bp, Homo sapiens
cttcctggagcccagag

SEQ ID NO: 3404002 - DNA, 22 bp, Homo sapiens
cttcctggagcccagaggaggg

SEQ ID NO: 3404003 - DNA, 13 bp, Homo sapiens
cttctaaatgcat

SEQ ID NO: 3404004 - DNA, 15 bp, Homo sapiens
cttctaaatgcatat

SEQ ID NO: 3404005 - DNA, 12 bp, Homo sapiens
cttctcagccac

SEQ ID NO: 3404006 - DNA, 20 bp, Homo sapiens
cttctcagccacaaaccctg

SEQ ID NO: 3404007 - DNA, 17 bp, Homo sapiens
cttctcatttcacccct

SEQ ID NO: 3404008 - DNA, 18 bp, Homo sapiens
cttctcatttcacccctc

SEQ ID NO: 3404009 - DNA, 20 bp, Homo sapiens
cttctttaatcacttaacat

SEQ ID NO: 3404010 - DNA, 14 bp, Homo sapiens
cttctttgataatg

SEQ ID NO: 3404011 - DNA, 17 bp, Homo sapiens
cttctttgataatgtta

SEQ ID NO: 3404012 - DNA, 16 bp, Homo sapiens
cttcttttctttgtat

SEQ ID NO: 3404013 - DNA, 14 bp, Homo sapiens
cttgacagaacact

SEQ ID NO: 3404014 - DNA, 15 bp, Homo sapiens
cttgacctgaactct

SEQ ID NO: 3404015 - DNA, 18 bp, Homo sapiens
cttgagctgttgtggttt

SEQ ID NO: 3404016 - DNA, 19 bp, Homo sapiens
cttgagtgttatgtgaatt

SEQ ID NO: 3404017 - DNA, 14 bp, Homo sapiens
cttgatatttcctt

SEQ ID NO: 3404018 - DNA, 21 bp, Homo sapiens
cttgatgagctgtgcacaaag

SEQ ID NO: 3404019 - DNA, 20 bp, Homo sapiens
cttgcagcgccaagtggcca

SEQ ID NO: 3404020 - DNA, 16 bp, Homo sapiens
cttgcaggggtccctg

SEQ ID NO: 3404021 - DNA, 19 bp, Homo sapiens
cttgcaggggtccctgcta

SEQ ID NO: 3404022 - DNA, 19 bp, Homo sapiens
cttgcatggcattaattgt

SEQ ID NO: 3404023 - DNA, 22 bp, Homo sapiens
cttgcttctggctttgttcttg

SEQ ID NO: 3404024 - DNA, 17 bp, Homo sapiens
cttggccctcctcagct

SEQ ID NO: 3404025 - DNA, 18 bp, Homo sapiens
cttggccctcctcagctc

SEQ ID NO: 3404026 - DNA, 19 bp, Homo sapiens
cttggccctcctcagctcc

SEQ ID NO: 3404027 - DNA, 21 bp, Homo sapiens
cttggccctcctcagctccct

SEQ ID NO: 3404028 - DNA, 17 bp, Homo sapiens
cttggctttcagagttt

SEQ ID NO: 3404029 - DNA, 22 bp, Homo sapiens
cttgggggtcctcctccaggga

SEQ ID NO: 3404030 - DNA, 23 bp, Homo sapiens
cttgggggtcctcctccagggac

SEQ ID NO: 3404031 - DNA, 17 bp, Homo sapiens
cttgggtcccagggaag

SEQ ID NO: 3404032 - DNA, 18 bp, Homo sapiens
cttggtaacaaataacct

SEQ ID NO: 3404033 - DNA, 15 bp, Homo sapiens
cttgtaatatttctt

SEQ ID NO: 3404034 - DNA, 16 bp, Homo sapiens
cttgtgaaattgtgta

SEQ ID NO: 3404035 - DNA, 18 bp, Homo sapiens
cttgtgcccttgtatagt

SEQ ID NO: 3404036 - DNA, 10 bp, Homo sapiens
cttgtggcct

SEQ ID NO: 3404037 - DNA, 15 bp, Homo sapiens
cttgttattaatgtt

SEQ ID NO: 3404038 - DNA, 17 bp, Homo sapiens
cttgttattaatgtttc

SEQ ID NO: 3404039 - DNA, 18 bp, Homo sapiens
cttgttattaatgtttct

SEQ ID NO: 3404040 - DNA, 18 bp, Homo sapiens
cttgttccaatgccacat

SEQ ID NO: 3404041 - DNA, 18 bp, Homo sapiens
ctttaaaaaaatttaagt

SEQ ID NO: 3404042 - DNA, 19 bp, Homo sapiens
ctttaaaaaaatttaagtg

SEQ ID NO: 3404043 - DNA, 15 bp, Homo sapiens
ctttaaatcatttta

SEQ ID NO: 3404044 - DNA, 23 bp, Homo sapiens
ctttaagggagtgtactcccagg

SEQ ID NO: 3404045 - DNA, 12 bp, Homo sapiens
ctttaatataaa

SEQ ID NO: 3404046 - DNA, 22 bp, Homo sapiens
ctttaatctgttgtttgaagaa

SEQ ID NO: 3404047 - DNA, 22 bp, Homo sapiens
ctttatccagctagtgccaaat

SEQ ID NO: 3404048 - DNA, 16 bp, Homo sapiens
ctttatggtaaagatg

SEQ ID NO: 3404049 - DNA, 12 bp, Homo sapiens
ctttattttccc

SEQ ID NO: 3404050 - DNA, 21 bp, Homo sapiens
ctttcaaatttactgtcttaa

SEQ ID NO: 3404051 - DNA, 19 bp, Homo sapiens
ctttcagatacatggttgt

SEQ ID NO: 3404052 - DNA, 16 bp, Homo sapiens
ctttcatttttttcca

SEQ ID NO: 3404053 - DNA, 19 bp, Homo sapiens
ctttcccaggtaatttaaa

SEQ ID NO: 3404054 - DNA, 20 bp, Homo sapiens
ctttcccttttccatttgaa

SEQ ID NO: 3404055 - DNA, 22 bp, Homo sapiens
ctttctcccctgcccccaggac

SEQ ID NO: 3404056 - DNA, 17 bp, Homo sapiens
ctttcttattcagtgaa

SEQ ID NO: 3404057 - DNA, 11 bp, Homo sapiens
ctttctttgct

SEQ ID NO: 3404058 - DNA, 14 bp, Homo sapiens
ctttgaatgtattg

SEQ ID NO: 3404059 - DNA, 14 bp, Homo sapiens
ctttgacctgttgg

SEQ ID NO: 3404060 - DNA, 21 bp, Homo sapiens
ctttgataatgttaaatttgt

SEQ ID NO: 3404061 - DNA, 15 bp, Homo sapiens
ctttgatagtgtaaa

SEQ ID NO: 3404062 - DNA, 14 bp, Homo sapiens
ctttgattctcctt

SEQ ID NO: 3404063 - DNA, 23 bp, Homo sapiens
ctttgctgttactgcttctcttt

SEQ ID NO: 3404064 - DNA, 21 bp, Homo sapiens
ctttggggcttttacaccagt

SEQ ID NO: 3404065 - DNA, 19 bp, Homo sapiens
ctttgtaagagtgtagaag

SEQ ID NO: 3404066 - DNA, 14 bp, Homo sapiens
ctttgtaatatgag

SEQ ID NO: 3404067 - DNA, 15 bp, Homo sapiens
ctttgtaatatgaga

SEQ ID NO: 3404068 - DNA, 18 bp, Homo sapiens
ctttgtaatatgagaatg

SEQ ID NO: 3404069 - DNA, 21 bp, Homo sapiens
ctttgtaatatgagaatgtat

SEQ ID NO: 3404070 - DNA, 19 bp, Homo sapiens
ctttgtatcattcatcttc

SEQ ID NO: 3404071 - DNA, 16 bp, Homo sapiens
ctttgtccattattca

SEQ ID NO: 3404072 - DNA, 17 bp, Homo sapiens
ctttgtgcaaaagcagg

SEQ ID NO: 3404073 - DNA, 13 bp, Homo sapiens
ctttgtgtaatct

SEQ ID NO: 3404074 - DNA, 18 bp, Homo sapiens
ctttgtgtaatctaagta

SEQ ID NO: 3404075 - DNA, 14 bp, Homo sapiens
ctttgttaaaaaaa

SEQ ID NO: 3404076 - DNA, 15 bp, Homo sapiens
ctttgtttaaatgcc

SEQ ID NO: 3404077 - DNA, 14 bp, Homo sapiens
ctttgtttctcccc

SEQ ID NO: 3404078 - DNA, 12 bp, Homo sapiens
cttttaaaagga

SEQ ID NO: 3404079 - DNA, 13 bp, Homo sapiens
cttttaactattt

SEQ ID NO: 3404080 - DNA, 14 bp, Homo sapiens
cttttatagttgta

SEQ ID NO: 3404081 - DNA, 20 bp, Homo sapiens
cttttatctccttgtggcct

SEQ ID NO: 3404082 - DNA, 22 bp, Homo sapiens
cttttccagaaagaaaatgaat

SEQ ID NO: 3404083 - DNA, 14 bp, Homo sapiens
cttttctaaatcct

SEQ ID NO: 3404084 - DNA, 17 bp, Homo sapiens
cttttctcctgcatgtg

SEQ ID NO: 3404085 - DNA, 14 bp, Homo sapiens
cttttctttgtatc

SEQ ID NO: 3404086 - DNA, 21 bp, Homo sapiens
cttttgagtatggctatctat

SEQ ID NO: 3404087 - DNA, 20 bp, Homo sapiens
ctttttaaaatgttggtgca

SEQ ID NO: 3404088 - DNA, 15 bp, Homo sapiens
ctttttaattgttgt

SEQ ID NO: 3404089 - DNA, 22 bp, Homo sapiens
ctttttaattgttgtttctttc

SEQ ID NO: 3404090 - DNA, 23 bp, Homo sapiens
ctttttaattgttgtttctttct

SEQ ID NO: 3404091 - DNA, 20 bp, Homo sapiens
ctttttatcttgagtgttat

SEQ ID NO: 3404092 - DNA, 14 bp, Homo sapiens
ctttttcccctgca

SEQ ID NO: 3404093 - DNA, 16 bp, Homo sapiens
ctttttcccctgcaat

SEQ ID NO: 3404094 - DNA, 18 bp, Homo sapiens
ctttttcccctgcaatgc

SEQ ID NO: 3404095 - DNA, 15 bp, Homo sapiens
ctttttgaaatcagc

SEQ ID NO: 3404096 - DNA, 21 bp, Homo sapiens
ctttttgttatgcaaatgaga

SEQ ID NO: 3404097 - DNA, 18 bp, Homo sapiens
cttttttaaagtaaactt

SEQ ID NO: 3404098 - DNA, 15 bp, Homo sapiens
ctttttttctactgt

SEQ ID NO: 3404099 - DNA, 22 bp, Homo sapiens
gaaaaacttttaggttgttacc

SEQ ID NO: 3404100 - DNA, 17 bp, Homo sapiens
gaaaaagatattttatt

SEQ ID NO: 3404101 - DNA, 22 bp, Homo sapiens
gaaaaagatattttatttctga

SEQ ID NO: 3404102 - DNA, 11 bp, Homo sapiens
gaaaaataaga

SEQ ID NO: 3404103 - DNA, 20 bp, Homo sapiens
gaaaaatgcccatttttgct

SEQ ID NO: 3404104 - DNA, 18 bp, Homo sapiens
gaaaacaggcactgccct

SEQ ID NO: 3404105 - DNA, 17 bp, Homo sapiens
gaaaacattgatgaatg

SEQ ID NO: 3404106 - DNA, 22 bp, Homo sapiens
gaaaacgctctctactctgctt

SEQ ID NO: 3404107 - DNA, 11 bp, Homo sapiens
gaaaagctatt

SEQ ID NO: 3404108 - DNA, 13 bp, Homo sapiens
gaaaaggaagact

SEQ ID NO: 3404109 - DNA, 15 bp, Homo sapiens
ctggactgaggcctg

SEQ ID NO: 3404110 - DNA, 18 bp, Homo sapiens
ctggacttggcccctgcc

SEQ ID NO: 3404111 - DNA, 21 bp, Homo sapiens
ctggagcccagaggagggcag

SEQ ID NO: 3404112 - DNA, 11 bp, Homo sapiens
ctggagccctg

SEQ ID NO: 3404113 - DNA, 16 bp, Homo sapiens
ctggaggagcccaggc

SEQ ID NO: 3404114 - DNA, 21 bp, Homo sapiens
ctggaggagcccaggccagga

SEQ ID NO: 3404115 - DNA, 18 bp, Homo sapiens
ctggcaaacatgtgcaac

SEQ ID NO: 3404116 - DNA, 22 bp, Homo sapiens
ctggcatcgcagcttcctgtct

SEQ ID NO: 3404117 - DNA, 18 bp, Homo sapiens
ctggcatgctaaagcctt

SEQ ID NO: 3404118 - DNA, 17 bp, Homo sapiens
ctggccacagaccccca

SEQ ID NO: 3404119 - DNA, 18 bp, Homo sapiens
ctggccacagacccccag

SEQ ID NO: 3404120 - DNA, 14 bp, Homo sapiens
ctggcccaccccac

SEQ ID NO: 3404121 - DNA, 16 bp, Homo sapiens
ctggccttgggccctc

SEQ ID NO: 3404122 - DNA, 15 bp, Homo sapiens
ctggcggcaggaagc

SEQ ID NO: 3404123 - DNA, 18 bp, Homo sapiens
ctggctttgttcttgtca

SEQ ID NO: 3404124 - DNA, 17 bp, Homo sapiens
ctgggaaccatgaagct

SEQ ID NO: 3404125 - DNA, 18 bp, Homo sapiens
ctgggaaccatgaagctg

SEQ ID NO: 3404126 - DNA, 15 bp, Homo sapiens
ctgggaccagggcat

SEQ ID NO: 3404127 - DNA, 18 bp, Homo sapiens
ctgggaggaacctgaacc

SEQ ID NO: 3404128 - DNA, 19 bp, Homo sapiens
ctgggatgtttctgtcaca

SEQ ID NO: 3404129 - DNA, 17 bp, Homo sapiens
ctgggcacccggtcccc

SEQ ID NO: 3404130 - DNA, 14 bp, Homo sapiens
ctgggcagtgagtg

SEQ ID NO: 3404131 - DNA, 17 bp, Homo sapiens
ctgggcagtgagtgcca

SEQ ID NO: 3404132 - DNA, 22 bp, Homo sapiens
ctgggcagtgagtgccatgctt

SEQ ID NO: 3404133 - DNA, 19 bp, Homo sapiens
ctgggcttggtaagtgaat

SEQ ID NO: 3404134 - DNA, 22 bp, Homo sapiens
ctggggatgtctctcatgacca

SEQ ID NO: 3404135 - DNA, 23 bp, Homo sapiens
ctggtgagagggccgggcagagg

SEQ ID NO: 3404136 - DNA, 17 bp, Homo sapiens
ctggtggatggtgactt

SEQ ID NO: 3404137 - DNA, 18 bp, Homo sapiens
ctggtggccctctcccct

SEQ ID NO: 3404138 - DNA, 22 bp, Homo sapiens
ctggtggccctctcccctgccc

SEQ ID NO: 3404139 - DNA, 12 bp, Homo sapiens
ctggttctcatc

SEQ ID NO: 3404140 - DNA, 14 bp, Homo sapiens
ctgtacctctgcct

SEQ ID NO: 3404141 - DNA, 18 bp, Homo sapiens
ctgtagtttttaattaaa

SEQ ID NO: 3404142 - DNA, 13 bp, Homo sapiens
ctgtataaatagg

SEQ ID NO: 3404143 - DNA, 14 bp, Homo sapiens
ctgtataaatagga

SEQ ID NO: 3404144 - DNA, 15 bp, Homo sapiens
ctgtataaataggag

SEQ ID NO: 3404145 - DNA, 16 bp, Homo sapiens
ctgtatttcagtattt

SEQ ID NO: 3404146 - DNA, 20 bp, Homo sapiens
ctgtatttcagtattttcca

SEQ ID NO: 3404147 - DNA, 14 bp, Homo sapiens
ctgtcccacctggc

SEQ ID NO: 3404148 - DNA, 18 bp, Homo sapiens
ctgtcccacctggctccc

SEQ ID NO: 3404149 - DNA, 20 bp, Homo sapiens
ctgtcccacctggctccccc

SEQ ID NO: 3404150 - DNA, 20 bp, Homo sapiens
ctgtccccttctctcatctc

SEQ ID NO: 3404151 - DNA, 23 bp, Homo sapiens
ctgtccccttctctcatctctta

SEQ ID NO: 3404152 - DNA, 18 bp, Homo sapiens
ctgtcccttgcccccctg

SEQ ID NO: 3404153 - DNA, 21 bp, Homo sapiens
ctgtcccttgcccccctggcc

SEQ ID NO: 3404154 - DNA, 15 bp, Homo sapiens
ctgtctttcagatac

SEQ ID NO: 3404155 - DNA, 16 bp, Homo sapiens
ctgtgagaaaggaaaa

SEQ ID NO: 3404156 - DNA, 13 bp, Homo sapiens
ctgtgagtgagtg

SEQ ID NO: 3404157 - DNA, 18 bp, Homo sapiens
ctgtgcaaacagtgtaag

SEQ ID NO: 3404158 - DNA, 22 bp, Homo sapiens
ctgtgcaaacagtgtaagctta

SEQ ID NO: 3404159 - DNA, 15 bp, Homo sapiens
ctgtggaggaaggat

SEQ ID NO: 3404160 - DNA, 21 bp, Homo sapiens
ctgtggaggaaggattgtaaa

SEQ ID NO: 3404161 - DNA, 21 bp, Homo sapiens
ctgtggattcagcttctgttg

SEQ ID NO: 3404162 - DNA, 15 bp, Homo sapiens
ctgtgtctctgtata

SEQ ID NO: 3404163 - DNA, 19 bp, Homo sapiens
ctgtgtctgagtggcttca

SEQ ID NO: 3404164 - DNA, 15 bp, Homo sapiens
ctgtgtctgtgtctg

SEQ ID NO: 3404165 - DNA, 16 bp, Homo sapiens
ctgtgtgtgtgtatgt

SEQ ID NO: 3404166 - DNA, 21 bp, Homo sapiens
ctgtgtgtgtgtatgtggggg

SEQ ID NO: 3404167 - DNA, 17 bp, Homo sapiens
ctgtgtgtttatgtgtg

SEQ ID NO: 3404168 - DNA, 20 bp, Homo sapiens
ctgtgtgtttatgtgtgtgt

SEQ ID NO: 3404169 - DNA, 13 bp, Homo sapiens
ctgttactgcttc

SEQ ID NO: 3404170 - DNA, 20 bp, Homo sapiens
ctgttccttatgatattctc

SEQ ID NO: 3404171 - DNA, 14 bp, Homo sapiens
ctgttggcagctct

SEQ ID NO: 3404172 - DNA, 16 bp, Homo sapiens
ctgttggcagctctag

SEQ ID NO: 3404173 - DNA, 18 bp, Homo sapiens
ctgttgtacatttatgat

SEQ ID NO: 3404174 - DNA, 22 bp, Homo sapiens
ctgttgtacatttatgatttaa

SEQ ID NO: 3404175 - DNA, 19 bp, Homo sapiens
ctgttgtggtttttagtgc

SEQ ID NO: 3404176 - DNA, 12 bp, Homo sapiens
ctgttgtttgaa

SEQ ID NO: 3404177 - DNA, 14 bp, Homo sapiens
ctgttgtttgaaga

SEQ ID NO: 3404178 - DNA, 20 bp, Homo sapiens
ctgtttactcccttctgtag

SEQ ID NO: 3404179 - DNA, 22 bp, Homo sapiens
ctgttttaaattgcatttctat

SEQ ID NO: 3404180 - DNA, 21 bp, Homo sapiens
ctgttttgtaaagtccccaga

SEQ ID NO: 3404181 - DNA, 14 bp, Homo sapiens
cttaaaatgcaata

SEQ ID NO: 3404182 - DNA, 14 bp, Homo sapiens
cttaaagcttgatt

SEQ ID NO: 3404183 - DNA, 15 bp, Homo sapiens
cttaaagcttgattt

SEQ ID NO: 3404184 - DNA, 23 bp, Homo sapiens
cttaaatcagtttattaaatctg

SEQ ID NO: 3404185 - DNA, 17 bp, Homo sapiens
cttaaatgagttactta

SEQ ID NO: 3404186 - DNA, 19 bp, Homo sapiens
cttaaatgagttacttaga

SEQ ID NO: 3404187 - DNA, 13 bp, Homo sapiens
cttaaatgttttc

SEQ ID NO: 3404188 - DNA, 19 bp, Homo sapiens
cttaacattcctaaaatgc

SEQ ID NO: 3404189 - DNA, 15 bp, Homo sapiens
cttaactgtatttca

SEQ ID NO: 3404190 - DNA, 21 bp, Homo sapiens
cttaactgtatttcagtattt

SEQ ID NO: 3404191 - DNA, 18 bp, Homo sapiens
cttaatattagcttgctt

SEQ ID NO: 3404192 - DNA, 20 bp, Homo sapiens
cttaatattagcttgcttaa

SEQ ID NO: 3404193 - DNA, 21 bp, Homo sapiens
cttaatgatccgttccattgc

SEQ ID NO: 3404194 - DNA, 24 bp, Homo sapiens
cttaatggtaggtcaagtaataaa

SEQ ID NO: 3404195 - DNA, 21 bp, Homo sapiens
cttacaactcccccaccgccc

SEQ ID NO: 3404196 - DNA, 18 bp, Homo sapiens
cttacaagcttaaagctt

SEQ ID NO: 3404197 - DNA, 20 bp, Homo sapiens
cttacaagcttaaagcttga

SEQ ID NO: 3404198 - DNA, 11 bp, Homo sapiens
cttacacccac

SEQ ID NO: 3404199 - DNA, 20 bp, Homo sapiens
cttacacccacagtggaaag

SEQ ID NO: 3404200 - DNA, 15 bp, Homo sapiens
cttacggccctggcc

SEQ ID NO: 3404201 - DNA, 17 bp, Homo sapiens
cttacggccctggcctt

SEQ ID NO: 3404202 - DNA, 13 bp, Homo sapiens
cttactttgtgca

SEQ ID NO: 3404203 - DNA, 14 bp, Homo sapiens
cttactttgtgcaa

SEQ ID NO: 3404204 - DNA, 12 bp, Homo sapiens
cttacttttaaa

SEQ ID NO: 3404205 - DNA, 22 bp, Homo sapiens
cttagacctcttcctggaataa

SEQ ID NO: 3404206 - DNA, 17 bp, Homo sapiens
cttagctcccctccaac

SEQ ID NO: 3404207 - DNA, 14 bp, Homo sapiens
cttagctttttaat

SEQ ID NO: 3404208 - DNA, 23 bp, Homo sapiens
cttagttgatattcaaggcttta

SEQ ID NO: 3404209 - DNA, 15 bp, Homo sapiens
cttatgagaacatgg

SEQ ID NO: 3404210 - DNA, 17 bp, Homo sapiens
cttatgtgttacattat

SEQ ID NO: 3404211 - DNA, 19 bp, Homo sapiens
cttattcagtgaaaaagat

SEQ ID NO: 3404212 - DNA, 18 bp, Homo sapiens
cttatttatattcatcaa

SEQ ID NO: 3404213 - DNA, 23 bp, Homo sapiens
cttcaccacctcatgtcatttct

SEQ ID NO: 3404214 - DNA, 16 bp, Homo sapiens
cttcacctcctttcaa

SEQ ID NO: 3404215 - DNA, 13 bp, Homo sapiens
cttcactcctgct

SEQ ID NO: 3404216 - DNA, 17 bp, Homo sapiens
cttcactgtataaatag

SEQ ID NO: 3404217 - DNA, 15 bp, Homo sapiens
cttcagccctcaccc

SEQ ID NO: 3404218 - DNA, 13 bp, Homo sapiens
cttcagctgactc

SEQ ID NO: 3404219 - DNA, 21 bp, Homo sapiens
cttcagctgctgaagggaggg

SEQ ID NO: 3404220 - DNA, 12 bp, Homo sapiens
cttcagctggtg

SEQ ID NO: 3404221 - DNA, 22 bp, Homo sapiens
cttcaggttatcgaaataacaa

SEQ ID NO: 3404222 - DNA, 14 bp, Homo sapiens
ctctgcaactgaat

SEQ ID NO: 3404223 - DNA, 21 bp, Homo sapiens
ctctgcaactgaatacttgaa

SEQ ID NO: 3404224 - DNA, 15 bp, Homo sapiens
ctctggcaaactttt

SEQ ID NO: 3404225 - DNA, 18 bp, Homo sapiens
ctctggcttccatgctcc

SEQ ID NO: 3404226 - DNA, 19 bp, Homo sapiens
ctctgggccaggttggaaa

SEQ ID NO: 3404227 - DNA, 15 bp, Homo sapiens
ctctgtaaaagtgtc

SEQ ID NO: 3404228 - DNA, 17 bp, Homo sapiens
ctctgtccccttctctc

SEQ ID NO: 3404229 - DNA, 23 bp, Homo sapiens
ctctgtccccttctctcatctct

SEQ ID NO: 3404230 - DNA, 18 bp, Homo sapiens
ctctgtgagactcgagaa

SEQ ID NO: 3404231 - DNA, 12 bp, Homo sapiens
ctcttaagagaa

SEQ ID NO: 3404232 - DNA, 17 bp, Homo sapiens
ctcttagctcccctcca

SEQ ID NO: 3404233 - DNA, 15 bp, Homo sapiens
ctcttatctcagtca

SEQ ID NO: 3404234 - DNA, 21 bp, Homo sapiens
ctcttatctcagtcatgcata

SEQ ID NO: 3404235 - DNA, 22 bp, Homo sapiens
ctcttatctcagtcatgcataa

SEQ ID NO: 3404236 - DNA, 22 bp, Homo sapiens
ctcttatcttacaactccccca

SEQ ID NO: 3404237 - DNA, 14 bp, Homo sapiens
ctcttctcagccac

SEQ ID NO: 3404238 - DNA, 15 bp, Homo sapiens
ctcttctcatttcac

SEQ ID NO: 3404239 - DNA, 23 bp, Homo sapiens
ctcttgtattgctccattttctt

SEQ ID NO: 3404240 - DNA, 14 bp, Homo sapiens
ctctttgtgcagtg

SEQ ID NO: 3404241 - DNA, 20 bp, Homo sapiens
ctcttttgaatccatgcttg

SEQ ID NO: 3404242 - DNA, 21 bp, Homo sapiens
ctctttttttttttttttaaa

SEQ ID NO: 3404243 - DNA, 20 bp, Homo sapiens
ctgaaattaaagtatgcaaa

SEQ ID NO: 3404244 - DNA, 18 bp, Homo sapiens
ctgaagtcttgcattgaa

SEQ ID NO: 3404245 - DNA, 14 bp, Homo sapiens
ctgaataaagggaa

SEQ ID NO: 3404246 - DNA, 19 bp, Homo sapiens
ctgaatacttgaagtagga

SEQ ID NO: 3404247 - DNA, 15 bp, Homo sapiens
ctgaatgtcattatt

SEQ ID NO: 3404248 - DNA, 23 bp, Homo sapiens
ctgaatgtcattatttgataaca

SEQ ID NO: 3404249 - DNA, 21 bp, Homo sapiens
ctgaattgagaataagaattt

SEQ ID NO: 3404250 - DNA, 15 bp, Homo sapiens
ctgaatttattgccg

SEQ ID NO: 3404251 - DNA, 13 bp, Homo sapiens
ctgacaatcaact

SEQ ID NO: 3404252 - DNA, 19 bp, Homo sapiens
ctgacaatgcgtggcacat

SEQ ID NO: 3404253 - DNA, 22 bp, Homo sapiens
ctgaccacctttgtttctcccc

SEQ ID NO: 3404254 - DNA, 17 bp, Homo sapiens
ctgaccttgatgagctg

SEQ ID NO: 3404255 - DNA, 15 bp, Homo sapiens
ctgactccttagaga

SEQ ID NO: 3404256 - DNA, 16 bp, Homo sapiens
ctgactctgttattga

SEQ ID NO: 3404257 - DNA, 23 bp, Homo sapiens
ctgagaaggtccttaatgatccg

SEQ ID NO: 3404258 - DNA, 19 bp, Homo sapiens
ctgagactttctttctgta

SEQ ID NO: 3404259 - DNA, 19 bp, Homo sapiens
ctgagagccccaggactgg

SEQ ID NO: 3404260 - DNA, 12 bp, Homo sapiens
ctgagaggccac

SEQ ID NO: 3404261 - DNA, 20 bp, Homo sapiens
ctgagagtatttaggcagat

SEQ ID NO: 3404262 - DNA, 14 bp, Homo sapiens
ctgagatttcatct

SEQ ID NO: 3404263 - DNA, 15 bp, Homo sapiens
ctgagatttcatctg

SEQ ID NO: 3404264 - DNA, 20 bp, Homo sapiens
ctgagatttcatctgctctc

SEQ ID NO: 3404265 - DNA, 12 bp, Homo sapiens
ctgagcaggtgt

SEQ ID NO: 3404266 - DNA, 14 bp, Homo sapiens
ctgagcgctcctgc

SEQ ID NO: 3404267 - DNA, 17 bp, Homo sapiens
ctgaggacattccaaga

SEQ ID NO: 3404268 - DNA, 17 bp, Homo sapiens
ctgaggcctgagcgctc

SEQ ID NO: 3404269 - DNA, 18 bp, Homo sapiens
ctgaggcctgagcgctcc

SEQ ID NO: 3404270 - DNA, 22 bp, Homo sapiens
ctgaggcctgagcgctcctgcc

SEQ ID NO: 3404271 - DNA, 17 bp, Homo sapiens
ctgagtctggcaaacat

SEQ ID NO: 3404272 - DNA, 19 bp, Homo sapiens
ctgagtctggcaaacatgt

SEQ ID NO: 3404273 - DNA, 16 bp, Homo sapiens
ctgagtggcttcactc

SEQ ID NO: 3404274 - DNA, 19 bp, Homo sapiens
ctgagtggcttcactcctg

SEQ ID NO: 3404275 - DNA, 21 bp, Homo sapiens
ctgagttggtgttgacatgtg

SEQ ID NO: 3404276 - DNA, 14 bp, Homo sapiens
ctgatcaatgacag

SEQ ID NO: 3404277 - DNA, 16 bp, Homo sapiens
ctgatctgtactttgt

SEQ ID NO: 3404278 - DNA, 17 bp, Homo sapiens
ctgatctgtactttgtg

SEQ ID NO: 3404279 - DNA, 21 bp, Homo sapiens
ctgatctgtactttgtgttta

SEQ ID NO: 3404280 - DNA, 22 bp, Homo sapiens
ctgatgtttgggggttaccaaa

SEQ ID NO: 3404281 - DNA, 20 bp, Homo sapiens
ctgattataccatgtgtgct

SEQ ID NO: 3404282 - DNA, 13 bp, Homo sapiens
ctgattgtattta

SEQ ID NO: 3404283 - DNA, 17 bp, Homo sapiens
ctgcaatgcgtcttgtg

SEQ ID NO: 3404284 - DNA, 19 bp, Homo sapiens
ctgcaatgcgtcttgtgaa

SEQ ID NO: 3404285 - DNA, 17 bp, Homo sapiens
ctgcaatgtttttgtgt

SEQ ID NO: 3404286 - DNA, 13 bp, Homo sapiens
ctgcaggaagaga

SEQ ID NO: 3404287 - DNA, 16 bp, Homo sapiens
ctgcaggaaggagctg

SEQ ID NO: 3404288 - DNA, 21 bp, Homo sapiens
ctgcatatctctagtccctgt

SEQ ID NO: 3404289 - DNA, 18 bp, Homo sapiens
ctgcatgtaaaatcttca

SEQ ID NO: 3404290 - DNA, 20 bp, Homo sapiens
ctgcatgtaaaatcttcagc

SEQ ID NO: 3404291 - DNA, 14 bp, Homo sapiens
ctgcatgtgtatat

SEQ ID NO: 3404292 - DNA, 22 bp, Homo sapiens
ctgcatgtgtatatatgtcaaa

SEQ ID NO: 3404293 - DNA, 23 bp, Homo sapiens
ctgcatgtgtatatatgtcaaat

SEQ ID NO: 3404294 - DNA, 21 bp, Homo sapiens
ctgcattggaactggaggcag

SEQ ID NO: 3404295 - DNA, 23 bp, Homo sapiens
ctgcattggaactggaggcaggg

SEQ ID NO: 3404296 - DNA, 18 bp, Homo sapiens
ctgcatttttaaaggaca

SEQ ID NO: 3404297 - DNA, 19 bp, Homo sapiens
ctgcatttttaaaggacaa

SEQ ID NO: 3404298 - DNA, 20 bp, Homo sapiens
ctgccacaggacccagaaaa

SEQ ID NO: 3404299 - DNA, 13 bp, Homo sapiens
ctgccacctggac

SEQ ID NO: 3404300 - DNA, 21 bp, Homo sapiens
ctgccacctggacccctgcat

SEQ ID NO: 3404301 - DNA, 22 bp, Homo sapiens
ctgcccagcggacagtggcagg

SEQ ID NO: 3404302 - DNA, 14 bp, Homo sapiens
ctgcccccaggact

SEQ ID NO: 3404303 - DNA, 14 bp, Homo sapiens
ctgccccctgcagg

SEQ ID NO: 3404304 - DNA, 15 bp, Homo sapiens
ctgccccctgcagga

SEQ ID NO: 3404305 - DNA, 16 bp, Homo sapiens
ctgccccctgcaggaa

SEQ ID NO: 3404306 - DNA, 13 bp, Homo sapiens
ctgcccctccctc

SEQ ID NO: 3404307 - DNA, 13 bp, Homo sapiens
ctgccgcagagct

SEQ ID NO: 3404308 - DNA, 18 bp, Homo sapiens
ctgccgcagagctggccg

SEQ ID NO: 3404309 - DNA, 17 bp, Homo sapiens
ctgcctcaggcctctgt

SEQ ID NO: 3404310 - DNA, 16 bp, Homo sapiens
ctgcctccagggctgg

SEQ ID NO: 3404311 - DNA, 19 bp, Homo sapiens
ctgcctccagggctggact

SEQ ID NO: 3404312 - DNA, 20 bp, Homo sapiens
ctgcctccagggctggactg

SEQ ID NO: 3404313 - DNA, 22 bp, Homo sapiens
ctgcctccagggctggactgag

SEQ ID NO: 3404314 - DNA, 23 bp, Homo sapiens
ctgcctccagggctggactgagg

SEQ ID NO: 3404315 - DNA, 13 bp, Homo sapiens
ctgcctgaataaa

SEQ ID NO: 3404316 - DNA, 18 bp, Homo sapiens
ctgcctgaataaagagcc

SEQ ID NO: 3404317 - DNA, 11 bp, Homo sapiens
ctgcctggacc

SEQ ID NO: 3404318 - DNA, 12 bp, Homo sapiens
ctgcctggcctt

SEQ ID NO: 3404319 - DNA, 15 bp, Homo sapiens
ctgcctggttttatt

SEQ ID NO: 3404320 - DNA, 17 bp, Homo sapiens
ctgcggagcaagaggag

SEQ ID NO: 3404321 - DNA, 18 bp, Homo sapiens
ctgcggcccaatccaagg

SEQ ID NO: 3404322 - DNA, 12 bp, Homo sapiens
ctgctctccttc

SEQ ID NO: 3404323 - DNA, 19 bp, Homo sapiens
ctgctctccttcctggagc

SEQ ID NO: 3404324 - DNA, 19 bp, Homo sapiens
ctgctgaaagtcctgcttt

SEQ ID NO: 3404325 - DNA, 20 bp, Homo sapiens
ctgctgaaagtcctgctttc

SEQ ID NO: 3404326 - DNA, 17 bp, Homo sapiens
ctgctgaagggaggggg

SEQ ID NO: 3404327 - DNA, 14 bp, Homo sapiens
ctgctgctgcctgc

SEQ ID NO: 3404328 - DNA, 11 bp, Homo sapiens
ctgctgggctt

SEQ ID NO: 3404329 - DNA, 22 bp, Homo sapiens
ctgctgtaaatttggcttctgt

SEQ ID NO: 3404330 - DNA, 13 bp, Homo sapiens
ctgctgtggaaag

SEQ ID NO: 3404331 - DNA, 15 bp, Homo sapiens
ctgctgtggaaagga

SEQ ID NO: 3404332 - DNA, 23 bp, Homo sapiens
ctggacccgttcatgggggaggg

SEQ ID NO: 3404333 - DNA, 16 bp, Homo sapiens
ctggacctctcttgtg

SEQ ID NO: 3404334 - DNA, 12 bp, Homo sapiens
ctggactgaggc

SEQ ID NO: 3404335 - DNA, 13 bp, Homo sapiens
ctcaagcaggttt

SEQ ID NO: 3404336 - DNA, 22 bp, Homo sapiens
ctcaatattttccatgaaaatg

SEQ ID NO: 3404337 - DNA, 13 bp, Homo sapiens
ctcaattttgtat

SEQ ID NO: 3404338 - DNA, 21 bp, Homo sapiens
ctcaattttgtatttaatgat

SEQ ID NO: 3404339 - DNA, 23 bp, Homo sapiens
ctcacaccaggcttgcctgcagg

SEQ ID NO: 3404340 - DNA, 13 bp, Homo sapiens
ctcacactgagaa

SEQ ID NO: 3404341 - DNA, 17 bp, Homo sapiens
ctcacactgtttttcat

SEQ ID NO: 3404342 - DNA, 13 bp, Homo sapiens
ctcacagctgagt

SEQ ID NO: 3404343 - DNA, 14 bp, Homo sapiens
ctcacccctggttc

SEQ ID NO: 3404344 - DNA, 17 bp, Homo sapiens
ctcacccctggttctca

SEQ ID NO: 3404345 - DNA, 20 bp, Homo sapiens
ctcacccctggttctcatct

SEQ ID NO: 3404346 - DNA, 23 bp, Homo sapiens
ctcacctaatgtttatgagccag

SEQ ID NO: 3404347 - DNA, 21 bp, Homo sapiens
ctcagctccctgcctgtttcc

SEQ ID NO: 3404348 - DNA, 13 bp, Homo sapiens
ctcaggcctctgt

SEQ ID NO: 3404349 - DNA, 20 bp, Homo sapiens
ctcaggcctgactctcagca

SEQ ID NO: 3404350 - DNA, 16 bp, Homo sapiens
ctcagtcactttttcc

SEQ ID NO: 3404351 - DNA, 18 bp, Homo sapiens
ctcagtcactttttcccc

SEQ ID NO: 3404352 - DNA, 18 bp, Homo sapiens
ctcagtcatgcataaata

SEQ ID NO: 3404353 - DNA, 22 bp, Homo sapiens
ctcagtcatgcataaatatgca

SEQ ID NO: 3404354 - DNA, 13 bp, Homo sapiens
ctcagttgcagcc

SEQ ID NO: 3404355 - DNA, 18 bp, Homo sapiens
ctcatacacagttaaata

SEQ ID NO: 3404356 - DNA, 15 bp, Homo sapiens
ctcatcagaactgaa

SEQ ID NO: 3404357 - DNA, 14 bp, Homo sapiens
ctcatcctgcaggc

SEQ ID NO: 3404358 - DNA, 19 bp, Homo sapiens
ctcatctcttagctcccct

SEQ ID NO: 3404359 - DNA, 20 bp, Homo sapiens
ctcatctcttagctcccctc

SEQ ID NO: 3404360 - DNA, 21 bp, Homo sapiens
ctcatgcaaactgctttattt

SEQ ID NO: 3404361 - DNA, 20 bp, Homo sapiens
ctcatggatttggttatgat

SEQ ID NO: 3404362 - DNA, 21 bp, Homo sapiens
ctcatgtcatttctcatggat

SEQ ID NO: 3404363 - DNA, 19 bp, Homo sapiens
ctcattaaactctaaagat

SEQ ID NO: 3404364 - DNA, 15 bp, Homo sapiens
ctcattccagaggaa

SEQ ID NO: 3404365 - DNA, 17 bp, Homo sapiens
ctcattccagaggaagg

SEQ ID NO: 3404366 - DNA, 18 bp, Homo sapiens
ctcattccctccccagaa

SEQ ID NO: 3404367 - DNA, 20 bp, Homo sapiens
ctcattctgcattaataata

SEQ ID NO: 3404368 - DNA, 14 bp, Homo sapiens
ctcatttcacccct

SEQ ID NO: 3404369 - DNA, 17 bp, Homo sapiens
ctcatttcacccctccc

SEQ ID NO: 3404370 - DNA, 22 bp, Homo sapiens
ctccaaaccactttttgcagct

SEQ ID NO: 3404371 - DNA, 15 bp, Homo sapiens
ctccaaaccctcgag

SEQ ID NO: 3404372 - DNA, 14 bp, Homo sapiens
ctccaaaccttcac

SEQ ID NO: 3404373 - DNA, 16 bp, Homo sapiens
ctccaaaccttcacac

SEQ ID NO: 3404374 - DNA, 20 bp, Homo sapiens
ctccaaccccccagcactga

SEQ ID NO: 3404375 - DNA, 23 bp, Homo sapiens
ctccaaccccccagcactgagga

SEQ ID NO: 3404376 - DNA, 20 bp, Homo sapiens
ctccaattctgaaatacttt

SEQ ID NO: 3404377 - DNA, 15 bp, Homo sapiens
ctccacacctgcggc

SEQ ID NO: 3404378 - DNA, 16 bp, Homo sapiens
ctccacacctgcggcc

SEQ ID NO: 3404379 - DNA, 18 bp, Homo sapiens
ctccacctcactagctcc

SEQ ID NO: 3404380 - DNA, 13 bp, Homo sapiens
ctccactctcccc

SEQ ID NO: 3404381 - DNA, 14 bp, Homo sapiens
ctccagggctggac

SEQ ID NO: 3404382 - DNA, 15 bp, Homo sapiens
ctccagggctggact

SEQ ID NO: 3404383 - DNA, 16 bp, Homo sapiens
ctccagggctggactg

SEQ ID NO: 3404384 - DNA, 18 bp, Homo sapiens
ctccagggctggactgag

SEQ ID NO: 3404385 - DNA, 21 bp, Homo sapiens
ctccagggctggactgaggcc

SEQ ID NO: 3404386 - DNA, 18 bp, Homo sapiens
ctccagtataatctcctc

SEQ ID NO: 3404387 - DNA, 19 bp, Homo sapiens
ctccatgaagaagctggga

SEQ ID NO: 3404388 - DNA, 15 bp, Homo sapiens
ctccatggccctgcc

SEQ ID NO: 3404389 - DNA, 14 bp, Homo sapiens
ctccattttcttgt

SEQ ID NO: 3404390 - DNA, 19 bp, Homo sapiens
ctcccccactttctttctt

SEQ ID NO: 3404391 - DNA, 16 bp, Homo sapiens
ctcccctccccaactg

SEQ ID NO: 3404392 - DNA, 18 bp, Homo sapiens
ctcccctcgacagctctc

SEQ ID NO: 3404393 - DNA, 16 bp, Homo sapiens
ctcccctgcccccagg

SEQ ID NO: 3404394 - DNA, 18 bp, Homo sapiens
ctcccctgcccccaggac

SEQ ID NO: 3404395 - DNA, 21 bp, Homo sapiens
ctcccctgcccccaggactgg

SEQ ID NO: 3404396 - DNA, 23 bp, Homo sapiens
ctcccctgcccccaggactgggc

SEQ ID NO: 3404397 - DNA, 23 bp, Homo sapiens
ctcccctgccccctgcaggaagg

SEQ ID NO: 3404398 - DNA, 18 bp, Homo sapiens
ctccctctagaggctgcc

SEQ ID NO: 3404399 - DNA, 16 bp, Homo sapiens
ctccctgcctgtttcc

SEQ ID NO: 3404400 - DNA, 13 bp, Homo sapiens
ctcccttctgtag

SEQ ID NO: 3404401 - DNA, 20 bp, Homo sapiens
ctcccttgagaattccctgt

SEQ ID NO: 3404402 - DNA, 14 bp, Homo sapiens
ctccctttctcccc

SEQ ID NO: 3404403 - DNA, 23 bp, Homo sapiens
ctccctttctcccctgcccccag

SEQ ID NO: 3404404 - DNA, 23 bp, Homo sapiens
ctccgctgggaggaacctgaacc

SEQ ID NO: 3404405 - DNA, 14 bp, Homo sapiens
ctcctcagctccct

SEQ ID NO: 3404406 - DNA, 14 bp, Homo sapiens
ctcctccagggaca

SEQ ID NO: 3404407 - DNA, 22 bp, Homo sapiens
ctcctcccttgagaattccctg

SEQ ID NO: 3404408 - DNA, 14 bp, Homo sapiens
ctcctctatttctt

SEQ ID NO: 3404409 - DNA, 13 bp, Homo sapiens
ctcctgagctagg

SEQ ID NO: 3404410 - DNA, 14 bp, Homo sapiens
ctcctgccgcagag

SEQ ID NO: 3404411 - DNA, 16 bp, Homo sapiens
ctcctgccgcagagct

SEQ ID NO: 3404412 - DNA, 17 bp, Homo sapiens
ctcctgccgcagagctg

SEQ ID NO: 3404413 - DNA, 14 bp, Homo sapiens
ctcctgctgtaaat

SEQ ID NO: 3404414 - DNA, 23 bp, Homo sapiens
ctcctgctgtaaatttggcttct

SEQ ID NO: 3404415 - DNA, 20 bp, Homo sapiens
ctccttagagacatcaaaat

SEQ ID NO: 3404416 - DNA, 21 bp, Homo sapiens
ctccttagagacatcaaaatc

SEQ ID NO: 3404417 - DNA, 20 bp, Homo sapiens
ctccttcagccctcacccct

SEQ ID NO: 3404418 - DNA, 23 bp, Homo sapiens
ctccttcctggagcccagaggag

SEQ ID NO: 3404419 - DNA, 13 bp, Homo sapiens
ctcgaaagtgtca

SEQ ID NO: 3404420 - DNA, 17 bp, Homo sapiens
ctcgcctcactttccac

SEQ ID NO: 3404421 - DNA, 21 bp, Homo sapiens
ctcgcctcactttccaccaag

SEQ ID NO: 3404422 - DNA, 14 bp, Homo sapiens
ctcgttctccctgg

SEQ ID NO: 3404423 - DNA, 16 bp, Homo sapiens
ctcgttctccctggga

SEQ ID NO: 3404424 - DNA, 17 bp, Homo sapiens
ctcgtttgatagtgctt

SEQ ID NO: 3404425 - DNA, 15 bp, Homo sapiens
ctctacacaacatgt

SEQ ID NO: 3404426 - DNA, 23 bp, Homo sapiens
ctctacacaacatgtatgtggat

SEQ ID NO: 3404427 - DNA, 14 bp, Homo sapiens
ctctactctgcttt

SEQ ID NO: 3404428 - DNA, 13 bp, Homo sapiens
ctctagtccctgt

SEQ ID NO: 3404429 - DNA, 14 bp, Homo sapiens
ctctcacattactg

SEQ ID NO: 3404430 - DNA, 22 bp, Homo sapiens
ctctcagttgcagccctgctgc

SEQ ID NO: 3404431 - DNA, 16 bp, Homo sapiens
ctctccaaaccacttt

SEQ ID NO: 3404432 - DNA, 12 bp, Homo sapiens
ctctccacctca

SEQ ID NO: 3404433 - DNA, 14 bp, Homo sapiens
ctctccacctcact

SEQ ID NO: 3404434 - DNA, 20 bp, Homo sapiens
ctctccacctcactagctcc

SEQ ID NO: 3404435 - DNA, 18 bp, Homo sapiens
ctctccccaatccatgct

SEQ ID NO: 3404436 - DNA, 22 bp, Homo sapiens
ctctccccaatccatgcttcac

SEQ ID NO: 3404437 - DNA, 13 bp, Homo sapiens
ctctcccccaccc

SEQ ID NO: 3404438 - DNA, 16 bp, Homo sapiens
ctctcccccaccccct

SEQ ID NO: 3404439 - DNA, 12 bp, Homo sapiens
ctctcccctgcc

SEQ ID NO: 3404440 - DNA, 15 bp, Homo sapiens
ctctcccctgccccc

SEQ ID NO: 3404441 - DNA, 19 bp, Homo sapiens
ctctcccctgccccctgca

SEQ ID NO: 3404442 - DNA, 12 bp, Homo sapiens
ctctcctgtcct

SEQ ID NO: 3404443 - DNA, 16 bp, Homo sapiens
ctctccttcctggagc

SEQ ID NO: 3404444 - DNA, 19 bp, Homo sapiens
ctctctgggcacccggtcc

SEQ ID NO: 3404445 - DNA, 21 bp, Homo sapiens
ctctgagagccccaggactgg

SEQ ID NO: 3404446 - DNA, 13 bp, Homo sapiens
ctctgagctgtca

SEQ ID NO: 3404447 - DNA, 19 bp, Homo sapiens
ctctgagctgtcaacgaga

SEQ ID NO: 3404448 - DNA, 21 bp, Homo sapiens
ccttattgagcgtgattctgt

SEQ ID NO: 3404449 - DNA, 15 bp, Homo sapiens
ccttcaccacctcat

SEQ ID NO: 3404450 - DNA, 18 bp, Homo sapiens
ccttcagccctcacccct

SEQ ID NO: 3404451 - DNA, 24 bp, Homo sapiens
ccttcccagaggggcctgccacct

SEQ ID NO: 3404452 - DNA, 14 bp, Homo sapiens
ccttctctcatctc

SEQ ID NO: 3404453 - DNA, 15 bp, Homo sapiens
ccttctctcatctct

SEQ ID NO: 3404454 - DNA, 21 bp, Homo sapiens
ccttctctcatctcttagctc

SEQ ID NO: 3404455 - DNA, 13 bp, Homo sapiens
ccttctttgataa

SEQ ID NO: 3404456 - DNA, 18 bp, Homo sapiens
ccttctttgataatgtta

SEQ ID NO: 3404457 - DNA, 21 bp, Homo sapiens
ccttctttgataatgttaaat

SEQ ID NO: 3404458 - DNA, 11 bp, Homo sapiens
ccttgagacca

SEQ ID NO: 3404459 - DNA, 16 bp, Homo sapiens
ccttgagaccacaggg

SEQ ID NO: 3404460 - DNA, 17 bp, Homo sapiens
ccttgtcctcagccagt

SEQ ID NO: 3404461 - DNA, 20 bp, Homo sapiens
cctttcagattcaggtgtat

SEQ ID NO: 3404462 - DNA, 15 bp, Homo sapiens
cctttctcccctgcc

SEQ ID NO: 3404463 - DNA, 18 bp, Homo sapiens
cctttctcccctgccccc

SEQ ID NO: 3404464 - DNA, 22 bp, Homo sapiens
cctttcttgcactattccacag

SEQ ID NO: 3404465 - DNA, 17 bp, Homo sapiens
cctttgagacagtttct

SEQ ID NO: 3404466 - DNA, 17 bp, Homo sapiens
cctttgtaatatgagaa

SEQ ID NO: 3404467 - DNA, 18 bp, Homo sapiens
ccttttccatttgaaaga

SEQ ID NO: 3404468 - DNA, 19 bp, Homo sapiens
cctttttatatttaaaaaa

SEQ ID NO: 3404469 - DNA, 14 bp, Homo sapiens
ccttttttaagatt

SEQ ID NO: 3404470 - DNA, 18 bp, Homo sapiens
ccttttttaagatttttc

SEQ ID NO: 3404471 - DNA, 21 bp, Homo sapiens
ccttttttaagatttttctca

SEQ ID NO: 3404472 - DNA, 16 bp, Homo sapiens
cgaaagtgtcatcaat

SEQ ID NO: 3404473 - DNA, 18 bp, Homo sapiens
cgaatgacaaaatcatct

SEQ ID NO: 3404474 - DNA, 17 bp, Homo sapiens
cgagggcagcgggagcc

SEQ ID NO: 3404475 - DNA, 23 bp, Homo sapiens
cgattgcaggagtccctgccatc

SEQ ID NO: 3404476 - DNA, 12 bp, Homo sapiens
cgcactgcctct

SEQ ID NO: 3404477 - DNA, 19 bp, Homo sapiens
cgccaaataatgtctctgt

SEQ ID NO: 3404478 - DNA, 15 bp, Homo sapiens
cgcctcactttccac

SEQ ID NO: 3404479 - DNA, 21 bp, Homo sapiens
cgcgccaaataatgtctctgt

SEQ ID NO: 3404480 - DNA, 23 bp, Homo sapiens
cgcgccaaataatgtctctgtga

SEQ ID NO: 3404481 - DNA, 19 bp, Homo sapiens
cgctcctgccgcagagctg

SEQ ID NO: 3404482 - DNA, 13 bp, Homo sapiens
cggacagtggcag

SEQ ID NO: 3404483 - DNA, 15 bp, Homo sapiens
cggacagtggcagga

SEQ ID NO: 3404484 - DNA, 12 bp, Homo sapiens
cggaccagcctg

SEQ ID NO: 3404485 - DNA, 16 bp, Homo sapiens
cggatctttggacaga

SEQ ID NO: 3404486 - DNA, 15 bp, Homo sapiens
cggatttggggtgga

SEQ ID NO: 3404487 - DNA, 15 bp, Homo sapiens
cggcccaatccaagg

SEQ ID NO: 3404488 - DNA, 17 bp, Homo sapiens
cgggagcctccctgcct

SEQ ID NO: 3404489 - DNA, 22 bp, Homo sapiens
cgggagcctccctgcctcaggc

SEQ ID NO: 3404490 - DNA, 12 bp, Homo sapiens
cgggcattttga

SEQ ID NO: 3404491 - DNA, 17 bp, Homo sapiens
cggggctcttctcattt

SEQ ID NO: 3404492 - DNA, 18 bp, Homo sapiens
cggggcttttaaaaggaa

SEQ ID NO: 3404493 - DNA, 20 bp, Homo sapiens
cggggcttttaaaaggaaaa

SEQ ID NO: 3404494 - DNA, 22 bp, Homo sapiens
cgggtcatctgtacctctgcct

SEQ ID NO: 3404495 - DNA, 10 bp, Homo sapiens
cggtgggggt

SEQ ID NO: 3404496 - DNA, 11 bp, Homo sapiens
cggtgggggta

SEQ ID NO: 3404497 - DNA, 19 bp, Homo sapiens
cggttcctcgttctccctg

SEQ ID NO: 3404498 - DNA, 15 bp, Homo sapiens
cgtaagctctatctg

SEQ ID NO: 3404499 - DNA, 16 bp, Homo sapiens
cgtaccgcttccttag

SEQ ID NO: 3404500 - DNA, 16 bp, Homo sapiens
cgtataatgctttctg

SEQ ID NO: 3404501 - DNA, 16 bp, Homo sapiens
cgtccagctgcccttc

SEQ ID NO: 3404502 - DNA, 12 bp, Homo sapiens
cgttctccctgg

SEQ ID NO: 3404503 - DNA, 19 bp, Homo sapiens
cgtttggttaaagtatgtc

SEQ ID NO: 3404504 - DNA, 17 bp, Homo sapiens
cgttttcttaaatgttt

SEQ ID NO: 3404505 - DNA, 18 bp, Homo sapiens
cgttttgtattgcttcct

SEQ ID NO: 3404506 - DNA, 13 bp, Homo sapiens
cgtttttccttta

SEQ ID NO: 3404507 - DNA, 18 bp, Homo sapiens
ctaaagagagaatgtaga

SEQ ID NO: 3404508 - DNA, 18 bp, Homo sapiens
ctaaagaggctgaaagag

SEQ ID NO: 3404509 - DNA, 18 bp, Homo sapiens
ctaaagggagaaatgcca

SEQ ID NO: 3404510 - DNA, 15 bp, Homo sapiens
ctaaagtatgaagca

SEQ ID NO: 3404511 - DNA, 18 bp, Homo sapiens
ctaacagataagcaagag

SEQ ID NO: 3404512 - DNA, 17 bp, Homo sapiens
ctaacatttaggagaag

SEQ ID NO: 3404513 - DNA, 15 bp, Homo sapiens
ctaagaggggctgga

SEQ ID NO: 3404514 - DNA, 21 bp, Homo sapiens
ctaagaggggctggacctggc

SEQ ID NO: 3404515 - DNA, 22 bp, Homo sapiens
ctaataataaatgcatagagca

SEQ ID NO: 3404516 - DNA, 20 bp, Homo sapiens
ctaatgaaagtgatgacata

SEQ ID NO: 3404517 - DNA, 21 bp, Homo sapiens
ctaatgcttgccaagaaatcg

SEQ ID NO: 3404518 - DNA, 18 bp, Homo sapiens
ctaatgtttatgagccag

SEQ ID NO: 3404519 - DNA, 22 bp, Homo sapiens
ctaattgaaatttaaaaataaa

SEQ ID NO: 3404520 - DNA, 15 bp, Homo sapiens
ctacaaacaaaattt

SEQ ID NO: 3404521 - DNA, 22 bp, Homo sapiens
ctacaaccaggtcttgacctga

SEQ ID NO: 3404522 - DNA, 18 bp, Homo sapiens
ctacaaggggtgtgactt

SEQ ID NO: 3404523 - DNA, 16 bp, Homo sapiens
ctacaatttaaagcaa

SEQ ID NO: 3404524 - DNA, 23 bp, Homo sapiens
ctacagaagccaagctccctgga

SEQ ID NO: 3404525 - DNA, 14 bp, Homo sapiens
ctacagtttttcct

SEQ ID NO: 3404526 - DNA, 13 bp, Homo sapiens
ctacatctgcctc

SEQ ID NO: 3404527 - DNA, 20 bp, Homo sapiens
ctacattaaacaatgatcac

SEQ ID NO: 3404528 - DNA, 15 bp, Homo sapiens
ctacctttttatatt

SEQ ID NO: 3404529 - DNA, 14 bp, Homo sapiens
ctactaatgatgtt

SEQ ID NO: 3404530 - DNA, 17 bp, Homo sapiens
ctactgcttcctctgaa

SEQ ID NO: 3404531 - DNA, 23 bp, Homo sapiens
ctactgttttaatttatactggc

SEQ ID NO: 3404532 - DNA, 22 bp, Homo sapiens
ctagaggcttgcataataagct

SEQ ID NO: 3404533 - DNA, 15 bp, Homo sapiens
ctagcatttatttct

SEQ ID NO: 3404534 - DNA, 20 bp, Homo sapiens
ctagcatttatttctctggc

SEQ ID NO: 3404535 - DNA, 20 bp, Homo sapiens
ctagccagtcactaggaatt

SEQ ID NO: 3404536 - DNA, 13 bp, Homo sapiens
ctagctatttcta

SEQ ID NO: 3404537 - DNA, 15 bp, Homo sapiens
ctagctccccaatcc

SEQ ID NO: 3404538 - DNA, 19 bp, Homo sapiens
ctagctccccaatccctga

SEQ ID NO: 3404539 - DNA, 22 bp, Homo sapiens
ctaggccaggtgcaaccaggga

SEQ ID NO: 3404540 - DNA, 17 bp, Homo sapiens
ctaggtcctttaggttt

SEQ ID NO: 3404541 - DNA, 19 bp, Homo sapiens
ctagtggtctttgtaagag

SEQ ID NO: 3404542 - DNA, 22 bp, Homo sapiens
ctagtggtctttgtaagagtgt

SEQ ID NO: 3404543 - DNA, 13 bp, Homo sapiens
ctatacctgcctt

SEQ ID NO: 3404544 - DNA, 17 bp, Homo sapiens
ctatatgagaagaatag

SEQ ID NO: 3404545 - DNA, 18 bp, Homo sapiens
ctatatgagaagaatagc

SEQ ID NO: 3404546 - DNA, 18 bp, Homo sapiens
ctatcagactaagccagc

SEQ ID NO: 3404547 - DNA, 14 bp, Homo sapiens
ctatcctgctgaaa

SEQ ID NO: 3404548 - DNA, 13 bp, Homo sapiens
ctatctaatgaca

SEQ ID NO: 3404549 - DNA, 17 bp, Homo sapiens
ctatctatacctgcctt

SEQ ID NO: 3404550 - DNA, 18 bp, Homo sapiens
ctatctatacctgccttt

SEQ ID NO: 3404551 - DNA, 22 bp, Homo sapiens
ctatctgcaatgtttttgtgta

SEQ ID NO: 3404552 - DNA, 19 bp, Homo sapiens
ctatgccatttttagttta

SEQ ID NO: 3404553 - DNA, 19 bp, Homo sapiens
ctatgtaatgcttatgtgt

SEQ ID NO: 3404554 - DNA, 22 bp, Homo sapiens
ctatgtaatgcttatgtgttgc

SEQ ID NO: 3404555 - DNA, 21 bp, Homo sapiens
ctatgtatgtgccaattttgt

SEQ ID NO: 3404556 - DNA, 16 bp, Homo sapiens
ctatttcctttgcgca

SEQ ID NO: 3404557 - DNA, 17 bp, Homo sapiens
ctatttttaaaatcata

SEQ ID NO: 3404558 - DNA, 12 bp, Homo sapiens
ctcaaagttttg

SEQ ID NO: 3404559 - DNA, 14 bp, Homo sapiens
ctcaaagttttgaa

SEQ ID NO: 3404560 - DNA, 19 bp, Homo sapiens
ctcaaagttttgaaaagct

SEQ ID NO: 3404561 - DNA, 18 bp, Homo sapiens
cccttgcccccctggcct

SEQ ID NO: 3404562 - DNA, 12 bp, Homo sapiens
cccttgggggtc

SEQ ID NO: 3404563 - DNA, 23 bp, Homo sapiens
cccttgggggtcctcctccaggg

SEQ ID NO: 3404564 - DNA, 19 bp, Homo sapiens
ccgagcctggctccaaacc

SEQ ID NO: 3404565 - DNA, 17 bp, Homo sapiens
ccgcgcgtccagctgcc

SEQ ID NO: 3404566 - DNA, 12 bp, Homo sapiens
ccgcttccttag

SEQ ID NO: 3404567 - DNA, 13 bp, Homo sapiens
ccgcttccttaga

SEQ ID NO: 3404568 - DNA, 21 bp, Homo sapiens
ccgctttcatgaacacagcct

SEQ ID NO: 3404569 - DNA, 13 bp, Homo sapiens
ccggaccagcctg

SEQ ID NO: 3404570 - DNA, 16 bp, Homo sapiens
ccggaccagcctggcc

SEQ ID NO: 3404571 - DNA, 14 bp, Homo sapiens
ccggagagtggggg

SEQ ID NO: 3404572 - DNA, 16 bp, Homo sapiens
ccggagagtgggggtg

SEQ ID NO: 3404573 - DNA, 17 bp, Homo sapiens
ccggcatggacaatgga

SEQ ID NO: 3404574 - DNA, 18 bp, Homo sapiens
ccgggaccccgagcctgg

SEQ ID NO: 3404575 - DNA, 23 bp, Homo sapiens
ccggtcccctctgccccaccctc

SEQ ID NO: 3404576 - DNA, 19 bp, Homo sapiens
ccgtctagttaacatttca

SEQ ID NO: 3404577 - DNA, 15 bp, Homo sapiens
ccgttcatgggggag

SEQ ID NO: 3404578 - DNA, 16 bp, Homo sapiens
ccgttcatgggggagg

SEQ ID NO: 3404579 - DNA, 23 bp, Homo sapiens
ccgttcatgggggagggggcaga

SEQ ID NO: 3404580 - DNA, 14 bp, Homo sapiens
cctaagaatagact

SEQ ID NO: 3404581 - DNA, 12 bp, Homo sapiens
cctaatgaaagt

SEQ ID NO: 3404582 - DNA, 21 bp, Homo sapiens
cctaatgaaagtgatgacata

SEQ ID NO: 3404583 - DNA, 22 bp, Homo sapiens
cctaatgaaagtgatgacatat

SEQ ID NO: 3404584 - DNA, 16 bp, Homo sapiens
cctaattgaaatttaa

SEQ ID NO: 3404585 - DNA, 12 bp, Homo sapiens
cctaggccagga

SEQ ID NO: 3404586 - DNA, 15 bp, Homo sapiens
cctaggccaggtgca

SEQ ID NO: 3404587 - DNA, 23 bp, Homo sapiens
cctatctagcatttatttctctg

SEQ ID NO: 3404588 - DNA, 17 bp, Homo sapiens
cctatgaaactggttta

SEQ ID NO: 3404589 - DNA, 21 bp, Homo sapiens
cctcacccctggttctcatct

SEQ ID NO: 3404590 - DNA, 22 bp, Homo sapiens
cctcacccctggttctcatctt

SEQ ID NO: 3404591 - DNA, 16 bp, Homo sapiens
cctcagagacatcagc

SEQ ID NO: 3404592 - DNA, 20 bp, Homo sapiens
cctcagagacatcagccctt

SEQ ID NO: 3404593 - DNA, 14 bp, Homo sapiens
cctcagctccctgc

SEQ ID NO: 3404594 - DNA, 19 bp, Homo sapiens
cctcagctccctgcctgtt

SEQ ID NO: 3404595 - DNA, 12 bp, Homo sapiens
cctcaggaaaga

SEQ ID NO: 3404596 - DNA, 16 bp, Homo sapiens
cctcaggaaagaatag

SEQ ID NO: 3404597 - DNA, 18 bp, Homo sapiens
cctcaggaaagaatagaa

SEQ ID NO: 3404598 - DNA, 19 bp, Homo sapiens
cctcaggcctctgtgccgc

SEQ ID NO: 3404599 - DNA, 17 bp, Homo sapiens
cctcatgtcatttctca

SEQ ID NO: 3404600 - DNA, 15 bp, Homo sapiens
cctcattctgcatta

SEQ ID NO: 3404601 - DNA, 21 bp, Homo sapiens
cctcattctgcattaataata

SEQ ID NO: 3404602 - DNA, 19 bp, Homo sapiens
cctccactctcccccaccc

SEQ ID NO: 3404603 - DNA, 22 bp, Homo sapiens
cctccactctcccccaccccct

SEQ ID NO: 3404604 - DNA, 15 bp, Homo sapiens
cctccagggacagca

SEQ ID NO: 3404605 - DNA, 20 bp, Homo sapiens
cctccagggctggactgagg

SEQ ID NO: 3404606 - DNA, 22 bp, Homo sapiens
cctccagggctggactgaggcc

SEQ ID NO: 3404607 - DNA, 19 bp, Homo sapiens
cctcccccacccacctctc

SEQ ID NO: 3404608 - DNA, 13 bp, Homo sapiens
cctcccccacttt

SEQ ID NO: 3404609 - DNA, 15 bp, Homo sapiens
cctccctgcctcagg

SEQ ID NO: 3404610 - DNA, 20 bp, Homo sapiens
cctccctggtgagagggccg

SEQ ID NO: 3404611 - DNA, 18 bp, Homo sapiens
cctcccttgagaattccc

SEQ ID NO: 3404612 - DNA, 23 bp, Homo sapiens
cctcccttgagaattccctgtgg

SEQ ID NO: 3404613 - DNA, 14 bp, Homo sapiens
cctccctttctccc

SEQ ID NO: 3404614 - DNA, 14 bp, Homo sapiens
cctcgaaagtgtca

SEQ ID NO: 3404615 - DNA, 16 bp, Homo sapiens
cctcgagtgcccctgt

SEQ ID NO: 3404616 - DNA, 18 bp, Homo sapiens
cctctcattccagaggaa

SEQ ID NO: 3404617 - DNA, 15 bp, Homo sapiens
cctctgccccaccct

SEQ ID NO: 3404618 - DNA, 16 bp, Homo sapiens
cctctgggccaggttg

SEQ ID NO: 3404619 - DNA, 17 bp, Homo sapiens
cctctgtccccttctct

SEQ ID NO: 3404620 - DNA, 22 bp, Homo sapiens
cctctgtccccttctctcatct

SEQ ID NO: 3404621 - DNA, 19 bp, Homo sapiens
cctcttaaaaaataaaaac

SEQ ID NO: 3404622 - DNA, 21 bp, Homo sapiens
cctgagcgctcctgccgcaga

SEQ ID NO: 3404623 - DNA, 23 bp, Homo sapiens
cctgagcgctcctgccgcagagc

SEQ ID NO: 3404624 - DNA, 19 bp, Homo sapiens
cctgaggaagagggactgt

SEQ ID NO: 3404625 - DNA, 14 bp, Homo sapiens
cctgatcaatgaca

SEQ ID NO: 3404626 - DNA, 22 bp, Homo sapiens
cctgattaccagtctgattata

SEQ ID NO: 3404627 - DNA, 13 bp, Homo sapiens
cctgcaatgcgtc

SEQ ID NO: 3404628 - DNA, 21 bp, Homo sapiens
cctgcaatgcgtcttgtgaaa

SEQ ID NO: 3404629 - DNA, 22 bp, Homo sapiens
cctgcaatgcgtcttgtgaaat

SEQ ID NO: 3404630 - DNA, 13 bp, Homo sapiens
cctgcaggaagga

SEQ ID NO: 3404631 - DNA, 20 bp, Homo sapiens
cctgcaggaaggagctgcct

SEQ ID NO: 3404632 - DNA, 21 bp, Homo sapiens
cctgcaggaaggagctgcctg

SEQ ID NO: 3404633 - DNA, 22 bp, Homo sapiens
cctgcatatctctagtccctgt

SEQ ID NO: 3404634 - DNA, 21 bp, Homo sapiens
cctgcattggaactggaggca

SEQ ID NO: 3404635 - DNA, 10 bp, Homo sapiens
cctgcatttt

SEQ ID NO: 3404636 - DNA, 17 bp, Homo sapiens
cctgccacctggacccc

SEQ ID NO: 3404637 - DNA, 21 bp, Homo sapiens
cctgccacctggacccctgca

SEQ ID NO: 3404638 - DNA, 20 bp, Homo sapiens
cctgccatcatgtttacaga

SEQ ID NO: 3404639 - DNA, 18 bp, Homo sapiens
cctgcccccaggactggg

SEQ ID NO: 3404640 - DNA, 20 bp, Homo sapiens
cctgcccccaggactgggcc

SEQ ID NO: 3404641 - DNA, 14 bp, Homo sapiens
cctgccccctgcag

SEQ ID NO: 3404642 - DNA, 20 bp, Homo sapiens
cctgccccctgcaggaagga

SEQ ID NO: 3404643 - DNA, 14 bp, Homo sapiens
cctgcccctccctc

SEQ ID NO: 3404644 - DNA, 17 bp, Homo sapiens
cctgccgcagagctggc

SEQ ID NO: 3404645 - DNA, 12 bp, Homo sapiens
cctgcctccagg

SEQ ID NO: 3404646 - DNA, 15 bp, Homo sapiens
cctgcctccagggct

SEQ ID NO: 3404647 - DNA, 19 bp, Homo sapiens
cctgcgagggcagcgggag

SEQ ID NO: 3404648 - DNA, 20 bp, Homo sapiens
cctgcggcccaatccaaggt

SEQ ID NO: 3404649 - DNA, 14 bp, Homo sapiens
cctggacccctgca

SEQ ID NO: 3404650 - DNA, 22 bp, Homo sapiens
cctggacccgttcatgggggag

SEQ ID NO: 3404651 - DNA, 16 bp, Homo sapiens
cctggagccctgttgg

SEQ ID NO: 3404652 - DNA, 21 bp, Homo sapiens
cctggccttgtcctcagccag

SEQ ID NO: 3404653 - DNA, 22 bp, Homo sapiens
cctggcggcaggaagccaaaga

SEQ ID NO: 3404654 - DNA, 20 bp, Homo sapiens
cctggctccaaaccctcgag

SEQ ID NO: 3404655 - DNA, 15 bp, Homo sapiens
cctgggaaccatgaa

SEQ ID NO: 3404656 - DNA, 15 bp, Homo sapiens
cctgggaccagggca

SEQ ID NO: 3404657 - DNA, 21 bp, Homo sapiens
cctggtgagagggccgggcag

SEQ ID NO: 3404658 - DNA, 16 bp, Homo sapiens
cctggtggccctctcc

SEQ ID NO: 3404659 - DNA, 18 bp, Homo sapiens
cctggtggccctctcccc

SEQ ID NO: 3404660 - DNA, 13 bp, Homo sapiens
cctggttctcatc

SEQ ID NO: 3404661 - DNA, 13 bp, Homo sapiens
cctggttttattt

SEQ ID NO: 3404662 - DNA, 16 bp, Homo sapiens
cctggttttatttata

SEQ ID NO: 3404663 - DNA, 17 bp, Homo sapiens
cctgtcccacctggctc

SEQ ID NO: 3404664 - DNA, 13 bp, Homo sapiens
cctgtctcctggc

SEQ ID NO: 3404665 - DNA, 14 bp, Homo sapiens
cctgtctgtttata

SEQ ID NO: 3404666 - DNA, 17 bp, Homo sapiens
cctgtgccttttgccat

SEQ ID NO: 3404667 - DNA, 16 bp, Homo sapiens
cctgttggcagctcta

SEQ ID NO: 3404668 - DNA, 22 bp, Homo sapiens
ccttactgaaaaaaaaaaaaga

SEQ ID NO: 3404669 - DNA, 21 bp, Homo sapiens
ccttactttactgcctgaata

SEQ ID NO: 3404670 - DNA, 10 bp, Homo sapiens
ccttactttt

SEQ ID NO: 3404671 - DNA, 16 bp, Homo sapiens
ccttagagacatcaaa

SEQ ID NO: 3404672 - DNA, 17 bp, Homo sapiens
ccttatgtgttacatta

SEQ ID NO: 3404673 - DNA, 19 bp, Homo sapiens
ccttatgtgttacattatt

SEQ ID NO: 3404674 - DNA, 23 bp, Homo sapiens
acccaacagtttatttttattat

SEQ ID NO: 3404675 - DNA, 23 bp, Homo sapiens
acccagaaaaaaagcccaacaca

SEQ ID NO: 3404676 - DNA, 17 bp, Homo sapiens
acccagaagcagtaata

SEQ ID NO: 3404677 - DNA, 22 bp, Homo sapiens
acccagctatggttctctcgca

SEQ ID NO: 3404678 - DNA, 18 bp, Homo sapiens
accccacccacttctgca

SEQ ID NO: 3404679 - DNA, 17 bp, Homo sapiens
accccccagcactgagg

SEQ ID NO: 3404680 - DNA, 19 bp, Homo sapiens
accccccagcactgaggaa

SEQ ID NO: 3404681 - DNA, 10 bp, Homo sapiens
acccctgcat

SEQ ID NO: 3404682 - DNA, 16 bp, Homo sapiens
acccctggttctcatc

SEQ ID NO: 3404683 - DNA, 20 bp, Homo sapiens
acccctggttctcatctttc

SEQ ID NO: 3404684 - DNA, 23 bp, Homo sapiens
acccgttcatgggggagggggca

SEQ ID NO: 3404685 - DNA, 19 bp, Homo sapiens
accctcctctatttcttta

SEQ ID NO: 3404686 - DNA, 18 bp, Homo sapiens
accctcgaggcggatctt

SEQ ID NO: 3404687 - DNA, 17 bp, Homo sapiens
accctgggcagtgagtg

SEQ ID NO: 3404688 - DNA, 12 bp, Homo sapiens
accgcccactct

SEQ ID NO: 3404689 - DNA, 16 bp, Homo sapiens
accggaccagcctggc

SEQ ID NO: 3404690 - DNA, 19 bp, Homo sapiens
accggagagtgggggtggg

SEQ ID NO: 3404691 - DNA, 21 bp, Homo sapiens
acctaatgaaagtgatgacat

SEQ ID NO: 3404692 - DNA, 12 bp, Homo sapiens
acctaatgttta

SEQ ID NO: 3404693 - DNA, 15 bp, Homo sapiens
acctaattgaaattt

SEQ ID NO: 3404694 - DNA, 16 bp, Homo sapiens
acctattgaattacca

SEQ ID NO: 3404695 - DNA, 14 bp, Homo sapiens
acctcactagctcc

SEQ ID NO: 3404696 - DNA, 12 bp, Homo sapiens
acctcaggaaag

SEQ ID NO: 3404697 - DNA, 15 bp, Homo sapiens
acctcatgtcatttc

SEQ ID NO: 3404698 - DNA, 16 bp, Homo sapiens
acctctccagcctcag

SEQ ID NO: 3404699 - DNA, 20 bp, Homo sapiens
acctctccagcctcagctct

SEQ ID NO: 3404700 - DNA, 15 bp, Homo sapiens
acctgaactctgcaa

SEQ ID NO: 3404701 - DNA, 16 bp, Homo sapiens
acctgaactctgcaac

SEQ ID NO: 3404702 - DNA, 14 bp, Homo sapiens
acctgatcaatgac

SEQ ID NO: 3404703 - DNA, 17 bp, Homo sapiens
acctgatcaatgacaga

SEQ ID NO: 3404704 - DNA, 23 bp, Homo sapiens
acctgcatatctctagtccctgt

SEQ ID NO: 3404705 - DNA, 10 bp, Homo sapiens
acctgcattt

SEQ ID NO: 3404706 - DNA, 15 bp, Homo sapiens
acctgcatttttaaa

SEQ ID NO: 3404707 - DNA, 16 bp, Homo sapiens
acctgcccctccctct

SEQ ID NO: 3404708 - DNA, 18 bp, Homo sapiens
acctgccttttaagtttg

SEQ ID NO: 3404709 - DNA, 16 bp, Homo sapiens
acctggacccctgcat

SEQ ID NO: 3404710 - DNA, 17 bp, Homo sapiens
acctggcggcaggaagc

SEQ ID NO: 3404711 - DNA, 22 bp, Homo sapiens
accttattgagcgtgattctgt

SEQ ID NO: 3404712 - DNA, 16 bp, Homo sapiens
accttgtttctttctg

SEQ ID NO: 3404713 - DNA, 15 bp, Homo sapiens
accttttttaagatt

SEQ ID NO: 3404714 - DNA, 20 bp, Homo sapiens
accttttttaagatttttct

SEQ ID NO: 3404715 - DNA, 13 bp, Homo sapiens
acgacttttgttt

SEQ ID NO: 3404716 - DNA, 14 bp, Homo sapiens
acgacttttgtttg

SEQ ID NO: 3404717 - DNA, 16 bp, Homo sapiens
acgagacgtttcctac

SEQ ID NO: 3404718 - DNA, 15 bp, Homo sapiens
acgctctctactctg

SEQ ID NO: 3404719 - DNA, 12 bp, Homo sapiens
acggccctggcc

SEQ ID NO: 3404720 - DNA, 23 bp, Homo sapiens
acggccctggccttgggccctct

SEQ ID NO: 3404721 - DNA, 20 bp, Homo sapiens
acgtatgtttttgtgtattt

SEQ ID NO: 3404722 - DNA, 17 bp, Homo sapiens
acgtgttttccatccca

SEQ ID NO: 3404723 - DNA, 19 bp, Homo sapiens
acgttcttacaagcttaaa

SEQ ID NO: 3404724 - DNA, 19 bp, Homo sapiens
acgttttatattatataag

SEQ ID NO: 3404725 - DNA, 13 bp, Homo sapiens
acgtttttccttt

SEQ ID NO: 3404726 - DNA, 14 bp, Homo sapiens
actaaagagagaat

SEQ ID NO: 3404727 - DNA, 21 bp, Homo sapiens
actaaagtgcattattttatt

SEQ ID NO: 3404728 - DNA, 18 bp, Homo sapiens
actaagaggggctggacc

SEQ ID NO: 3404729 - DNA, 21 bp, Homo sapiens
actaatgcttgccaagaaatc

SEQ ID NO: 3404730 - DNA, 21 bp, Homo sapiens
actacaaacaaaatttctatt

SEQ ID NO: 3404731 - DNA, 19 bp, Homo sapiens
actaccagtgggcatgtat

SEQ ID NO: 3404732 - DNA, 18 bp, Homo sapiens
actagctccccaatccct

SEQ ID NO: 3404733 - DNA, 22 bp, Homo sapiens
actaggaatttttttcagtatt

SEQ ID NO: 3404734 - DNA, 15 bp, Homo sapiens
actaggatactgctg

SEQ ID NO: 3404735 - DNA, 22 bp, Homo sapiens
actatgaactgaaggcagcatg

SEQ ID NO: 3404736 - DNA, 14 bp, Homo sapiens
actcaaaggccaga

SEQ ID NO: 3404737 - DNA, 21 bp, Homo sapiens
actcaatgttactatctgctt

SEQ ID NO: 3404738 - DNA, 13 bp, Homo sapiens
actcagtctttaa

SEQ ID NO: 3404739 - DNA, 21 bp, Homo sapiens
actcatagattgcaaatattg

SEQ ID NO: 3404740 - DNA, 21 bp, Homo sapiens
actcatctgtaaacttttata

SEQ ID NO: 3404741 - DNA, 17 bp, Homo sapiens
actcatgcaaactgctt

SEQ ID NO: 3404742 - DNA, 19 bp, Homo sapiens
actcatgcaaactgcttta

SEQ ID NO: 3404743 - DNA, 14 bp, Homo sapiens
actcccccaccgcc

SEQ ID NO: 3404744 - DNA, 20 bp, Homo sapiens
actcccccaccgcccactct

SEQ ID NO: 3404745 - DNA, 14 bp, Homo sapiens
actcccccctggcc

SEQ ID NO: 3404746 - DNA, 20 bp, Homo sapiens
actcccccctggccacagac

SEQ ID NO: 3404747 - DNA, 19 bp, Homo sapiens
actcgggttaagaaatacc

SEQ ID NO: 3404748 - DNA, 15 bp, Homo sapiens
actctactgtgtaat

SEQ ID NO: 3404749 - DNA, 14 bp, Homo sapiens
actctccacctcac

SEQ ID NO: 3404750 - DNA, 20 bp, Homo sapiens
actctcccccaccccctccc

SEQ ID NO: 3404751 - DNA, 19 bp, Homo sapiens
actctggacctctcttgtg

SEQ ID NO: 3404752 - DNA, 15 bp, Homo sapiens
actctgtaaaagtgt

SEQ ID NO: 3404753 - DNA, 15 bp, Homo sapiens
actcttaaatcattt

SEQ ID NO: 3404754 - DNA, 17 bp, Homo sapiens
actcttaaatcatttgg

SEQ ID NO: 3404755 - DNA, 14 bp, Homo sapiens
actcttaagtgtaa

SEQ ID NO: 3404756 - DNA, 12 bp, Homo sapiens
actcttatctca

SEQ ID NO: 3404757 - DNA, 22 bp, Homo sapiens
actcttatctcagtcatgcata

SEQ ID NO: 3404758 - DNA, 23 bp, Homo sapiens
actgaaggcagcatgtatagttg

SEQ ID NO: 3404759 - DNA, 17 bp, Homo sapiens
actgacacaaaagaaga

SEQ ID NO: 3404760 - DNA, 19 bp, Homo sapiens
actgaccttgatgagctgt

SEQ ID NO: 3404761 - DNA, 14 bp, Homo sapiens
actgactctgttat

SEQ ID NO: 3404762 - DNA, 14 bp, Homo sapiens
actgaggcctgagc

SEQ ID NO: 3404763 - DNA, 21 bp, Homo sapiens
actgagtctggcaaacatgtg

SEQ ID NO: 3404764 - DNA, 23 bp, Homo sapiens
actgatttttattaactgctttt

SEQ ID NO: 3404765 - DNA, 14 bp, Homo sapiens
actgcaggaagaga

SEQ ID NO: 3404766 - DNA, 11 bp, Homo sapiens
actgccctggt

SEQ ID NO: 3404767 - DNA, 18 bp, Homo sapiens
catttatgatttaataaa

SEQ ID NO: 3404768 - DNA, 20 bp, Homo sapiens
catttatgatttaataaaat

SEQ ID NO: 3404769 - DNA, 15 bp, Homo sapiens
catttcacccctccc

SEQ ID NO: 3404770 - DNA, 22 bp, Homo sapiens
catttcacccctccctttctcc

SEQ ID NO: 3404771 - DNA, 16 bp, Homo sapiens
catttcatctatttct

SEQ ID NO: 3404772 - DNA, 18 bp, Homo sapiens
catttgaaagaaaggact

SEQ ID NO: 3404773 - DNA, 19 bp, Homo sapiens
catttgaaagaaaggactc

SEQ ID NO: 3404774 - DNA, 20 bp, Homo sapiens
catttgattaaattatgaat

SEQ ID NO: 3404775 - DNA, 22 bp, Homo sapiens
catttgattaaattatgaatga

SEQ ID NO: 3404776 - DNA, 14 bp, Homo sapiens
catttggcttgctg

SEQ ID NO: 3404777 - DNA, 20 bp, Homo sapiens
catttggcttgctgtttact

SEQ ID NO: 3404778 - DNA, 17 bp, Homo sapiens
catttggttaaatcatt

SEQ ID NO: 3404779 - DNA, 14 bp, Homo sapiens
cattttgaatgtga

SEQ ID NO: 3404780 - DNA, 18 bp, Homo sapiens
cattttgaatgtgatcat

SEQ ID NO: 3404781 - DNA, 14 bp, Homo sapiens
cattttggatttct

SEQ ID NO: 3404782 - DNA, 15 bp, Homo sapiens
cattttggatttctt

SEQ ID NO: 3404783 - DNA, 18 bp, Homo sapiens
cattttgtgaatggattg

SEQ ID NO: 3404784 - DNA, 21 bp, Homo sapiens
cattttgtgaatggattggat

SEQ ID NO: 3404785 - DNA, 12 bp, Homo sapiens
catttttaaagg

SEQ ID NO: 3404786 - DNA, 22 bp, Homo sapiens
catttttaaaggacaaacagtg

SEQ ID NO: 3404787 - DNA, 15 bp, Homo sapiens
catttttgctaatta

SEQ ID NO: 3404788 - DNA, 14 bp, Homo sapiens
catttttgtttatt

SEQ ID NO: 3404789 - DNA, 21 bp, Homo sapiens
ccaaaccttcacacacagact

SEQ ID NO: 3404790 - DNA, 15 bp, Homo sapiens
ccaaataatgtctct

SEQ ID NO: 3404791 - DNA, 16 bp, Homo sapiens
ccaaataatgtctctg

SEQ ID NO: 3404792 - DNA, 13 bp, Homo sapiens
ccaaatgcattca

SEQ ID NO: 3404793 - DNA, 13 bp, Homo sapiens
ccaacagtttatt

SEQ ID NO: 3404794 - DNA, 13 bp, Homo sapiens
ccaaccccccagc

SEQ ID NO: 3404795 - DNA, 14 bp, Homo sapiens
ccaacctggggggc

SEQ ID NO: 3404796 - DNA, 15 bp, Homo sapiens
ccaactgaccacctt

SEQ ID NO: 3404797 - DNA, 19 bp, Homo sapiens
ccaagccttggctctaccc

SEQ ID NO: 3404798 - DNA, 17 bp, Homo sapiens
ccaagctccctggagcc

SEQ ID NO: 3404799 - DNA, 19 bp, Homo sapiens
ccaagctccctggagccct

SEQ ID NO: 3404800 - DNA, 22 bp, Homo sapiens
ccaagtgtctagagtcatgtga

SEQ ID NO: 3404801 - DNA, 21 bp, Homo sapiens
ccaatgatacccaacagttta

SEQ ID NO: 3404802 - DNA, 11 bp, Homo sapiens
ccaattcttac

SEQ ID NO: 3404803 - DNA, 22 bp, Homo sapiens
ccacaaatgtgtcccagtgaac

SEQ ID NO: 3404804 - DNA, 14 bp, Homo sapiens
ccacacaaaatgtc

SEQ ID NO: 3404805 - DNA, 20 bp, Homo sapiens
ccacacagacttgggcaggg

SEQ ID NO: 3404806 - DNA, 16 bp, Homo sapiens
ccacaccctcactgct

SEQ ID NO: 3404807 - DNA, 17 bp, Homo sapiens
ccacaggctagatcccc

SEQ ID NO: 3404808 - DNA, 22 bp, Homo sapiens
ccacagggttcaaaatgtctgt

SEQ ID NO: 3404809 - DNA, 14 bp, Homo sapiens
ccacatcatgttac

SEQ ID NO: 3404810 - DNA, 15 bp, Homo sapiens
ccacccacttctgca

SEQ ID NO: 3404811 - DNA, 14 bp, Homo sapiens
ccaccccagggcag

SEQ ID NO: 3404812 - DNA, 18 bp, Homo sapiens
ccaccccagggcagccag

SEQ ID NO: 3404813 - DNA, 19 bp, Homo sapiens
ccaccccagggcagccagg

SEQ ID NO: 3404814 - DNA, 18 bp, Homo sapiens
ccacctcactagctcccc

SEQ ID NO: 3404815 - DNA, 19 bp, Homo sapiens
ccacctggacccctgcatt

SEQ ID NO: 3404816 - DNA, 13 bp, Homo sapiens
ccacctggctccc

SEQ ID NO: 3404817 - DNA, 20 bp, Homo sapiens
ccacctgtgagaaaggaaaa

SEQ ID NO: 3404818 - DNA, 16 bp, Homo sapiens
ccacctttgtttctcc

SEQ ID NO: 3404819 - DNA, 13 bp, Homo sapiens
ccactctccacct

SEQ ID NO: 3404820 - DNA, 15 bp, Homo sapiens
ccactctccacctca

SEQ ID NO: 3404821 - DNA, 22 bp, Homo sapiens
ccactcttatcttacaactccc

SEQ ID NO: 3404822 - DNA, 16 bp, Homo sapiens
ccactggcatcgcagc

SEQ ID NO: 3404823 - DNA, 12 bp, Homo sapiens
ccacttctgcac

SEQ ID NO: 3404824 - DNA, 16 bp, Homo sapiens
ccactttgctgttcct

SEQ ID NO: 3404825 - DNA, 18 bp, Homo sapiens
ccagaagatgaacagact

SEQ ID NO: 3404826 - DNA, 15 bp, Homo sapiens
ccagaagcagtaata

SEQ ID NO: 3404827 - DNA, 13 bp, Homo sapiens
ccagacctgcccc

SEQ ID NO: 3404828 - DNA, 17 bp, Homo sapiens
ccagacctgcccctccc

SEQ ID NO: 3404829 - DNA, 18 bp, Homo sapiens
ccagacctgcccctccct

SEQ ID NO: 3404830 - DNA, 14 bp, Homo sapiens
ccagagcagatgca

SEQ ID NO: 3404831 - DNA, 12 bp, Homo sapiens
ccagaggagggc

SEQ ID NO: 3404832 - DNA, 23 bp, Homo sapiens
ccagaggggcctgccacctggac

SEQ ID NO: 3404833 - DNA, 23 bp, Homo sapiens
ccagaggtaacagaacagcttca

SEQ ID NO: 3404834 - DNA, 22 bp, Homo sapiens
ccagattggctcacactgagaa

SEQ ID NO: 3404835 - DNA, 21 bp, Homo sapiens
ccagcaccggaccagcctggc

SEQ ID NO: 3404836 - DNA, 13 bp, Homo sapiens
ccagcactgagga

SEQ ID NO: 3404837 - DNA, 15 bp, Homo sapiens
ccagcagtacaataa

SEQ ID NO: 3404838 - DNA, 21 bp, Homo sapiens
ccagcagtacaataaaagtaa

SEQ ID NO: 3404839 - DNA, 16 bp, Homo sapiens
ccagcggacagtggca

SEQ ID NO: 3404840 - DNA, 13 bp, Homo sapiens
ccagcttcacgat

SEQ ID NO: 3404841 - DNA, 18 bp, Homo sapiens
ccaggactctgcagcctc

SEQ ID NO: 3404842 - DNA, 22 bp, Homo sapiens
ccaggactctgcagcctcagag

SEQ ID NO: 3404843 - DNA, 14 bp, Homo sapiens
ccaggactgggcca

SEQ ID NO: 3404844 - DNA, 22 bp, Homo sapiens
tttcatctgctctccttcctgg

SEQ ID NO: 3404845 - DNA, 16 bp, Homo sapiens
tttcatgaacacagcc

SEQ ID NO: 3404846 - DNA, 18 bp, Homo sapiens
tttcattgtgatttatat

SEQ ID NO: 3404847 - DNA, 17 bp, Homo sapiens
tttcccatttcgtgtaa

SEQ ID NO: 3404848 - DNA, 23 bp, Homo sapiens
tttcctttaaaaaaatttaagtg

SEQ ID NO: 3404849 - DNA, 17 bp, Homo sapiens
tttctagtggtctttgt

SEQ ID NO: 3404850 - DNA, 23 bp, Homo sapiens
tttctagtggtctttgtaagagt

SEQ ID NO: 3404851 - DNA, 18 bp, Homo sapiens
tttctatgtatgtgccaa

SEQ ID NO: 3404852 - DNA, 22 bp, Homo sapiens
tttctattaaattaaattttgt

SEQ ID NO: 3404853 - DNA, 14 bp, Homo sapiens
tttctcaaagtttt

SEQ ID NO: 3404854 - DNA, 22 bp, Homo sapiens
tttctcaaagttttgaaaagct

SEQ ID NO: 3404855 - DNA, 21 bp, Homo sapiens
tttctcccccatgttctgtcc

SEQ ID NO: 3404856 - DNA, 17 bp, Homo sapiens
tttctcccctgccccca

SEQ ID NO: 3404857 - DNA, 23 bp, Homo sapiens
tttctcccctgcccccaggactg

SEQ ID NO: 3404858 - DNA, 13 bp, Homo sapiens
tttctcctctccc

SEQ ID NO: 3404859 - DNA, 19 bp, Homo sapiens
tttctgaaaattaacactg

SEQ ID NO: 3404860 - DNA, 16 bp, Homo sapiens
tttctgagaaggtcct

SEQ ID NO: 3404861 - DNA, 19 bp, Homo sapiens
tttctgagaaggtccttaa

SEQ ID NO: 3404862 - DNA, 16 bp, Homo sapiens
tttcttaaacaaatgt

SEQ ID NO: 3404863 - DNA, 22 bp, Homo sapiens
tttcttagctttttaattgttg

SEQ ID NO: 3404864 - DNA, 20 bp, Homo sapiens
tttcttcaagtgagtggcat

SEQ ID NO: 3404865 - DNA, 23 bp, Homo sapiens
tttcttcaagtgagtggcatgtg

SEQ ID NO: 3404866 - DNA, 16 bp, Homo sapiens
tttctttatataaggt

SEQ ID NO: 3404867 - DNA, 18 bp, Homo sapiens
tttctttatataaggtca

SEQ ID NO: 3404868 - DNA, 13 bp, Homo sapiens
tttctttctttct

SEQ ID NO: 3404869 - DNA, 17 bp, Homo sapiens
tttctttgtatcattca

SEQ ID NO: 3404870 - DNA, 14 bp, Homo sapiens
tttgaaaagctatt

SEQ ID NO: 3404871 - DNA, 19 bp, Homo sapiens
tttgaaaagctattagcca

SEQ ID NO: 3404872 - DNA, 19 bp, Homo sapiens
tttgaagaacaaaaggctt

SEQ ID NO: 3404873 - DNA, 20 bp, Homo sapiens
tttgaagatctgatttatac

SEQ ID NO: 3404874 - DNA, 17 bp, Homo sapiens
tttgaatataaacacta

SEQ ID NO: 3404875 - DNA, 23 bp, Homo sapiens
tttgacctgttgggagtgaggat

SEQ ID NO: 3404876 - DNA, 14 bp, Homo sapiens
tttgacgaagaaac

SEQ ID NO: 3404877 - DNA, 18 bp, Homo sapiens
tttgagacagtttcttag

SEQ ID NO: 3404878 - DNA, 19 bp, Homo sapiens
tttgagacagtttcttagc

SEQ ID NO: 3404879 - DNA, 19 bp, Homo sapiens
tttgaggtctacattcttg

SEQ ID NO: 3404880 - DNA, 15 bp, Homo sapiens
tttgataatgttaaa

SEQ ID NO: 3404881 - DNA, 17 bp, Homo sapiens
tttgataatgttaaatt

SEQ ID NO: 3404882 - DNA, 19 bp, Homo sapiens
tttgataatgttaaatttg

SEQ ID NO: 3404883 - DNA, 13 bp, Homo sapiens
tttgatagtgctt

SEQ ID NO: 3404884 - DNA, 20 bp, Homo sapiens
tttgatctttgtttaaatgc

SEQ ID NO: 3404885 - DNA, 21 bp, Homo sapiens
tttgatctttgtttaaatgcc

SEQ ID NO: 3404886 - DNA, 17 bp, Homo sapiens
tttgattaaattatgaa

SEQ ID NO: 3404887 - DNA, 13 bp, Homo sapiens
tttgattctcctt

SEQ ID NO: 3404888 - DNA, 23 bp, Homo sapiens
tttgcaagcttatttagcacatt

SEQ ID NO: 3404889 - DNA, 20 bp, Homo sapiens
tttgccaagctaatctgcct

SEQ ID NO: 3404890 - DNA, 18 bp, Homo sapiens
tttgcctcgaaagtgtca

SEQ ID NO: 3404891 - DNA, 15 bp, Homo sapiens
tttgcgcaaacttta

SEQ ID NO: 3404892 - DNA, 23 bp, Homo sapiens
tttgcggggcttttaaaaggaaa

SEQ ID NO: 3404893 - DNA, 21 bp, Homo sapiens
tttggaagaagttttttactt

SEQ ID NO: 3404894 - DNA, 16 bp, Homo sapiens
tttgtaagagtgtaga

SEQ ID NO: 3404895 - DNA, 17 bp, Homo sapiens
tttgtaaggcttgttcc

SEQ ID NO: 3404896 - DNA, 22 bp, Homo sapiens
tttgtaatatgagaatgtatta

SEQ ID NO: 3404897 - DNA, 14 bp, Homo sapiens
tttgtaattttagt

SEQ ID NO: 3404898 - DNA, 24 bp, Homo sapiens
tttgtgaaggcctcgcaggaagac

SEQ ID NO: 3404899 - DNA, 17 bp, Homo sapiens
tttgtgaatggattgga

SEQ ID NO: 3404900 - DNA, 18 bp, Homo sapiens
tttgtgagctttttgttc

SEQ ID NO: 3404901 - DNA, 18 bp, Homo sapiens
tttgtgcaacataacaat

SEQ ID NO: 3404902 - DNA, 13 bp, Homo sapiens
tttgttcccctcc

SEQ ID NO: 3404903 - DNA, 19 bp, Homo sapiens
tttgttgtttaacttgtct

SEQ ID NO: 3404904 - DNA, 12 bp, Homo sapiens
ttttaaaaggaa

SEQ ID NO: 3404905 - DNA, 17 bp, Homo sapiens
ttttaaaataaaatttt

SEQ ID NO: 3404906 - DNA, 19 bp, Homo sapiens
ttttaaaatgttggtgcaa

SEQ ID NO: 3404907 - DNA, 20 bp, Homo sapiens
ttttaaacaaaatttcacag

SEQ ID NO: 3404908 - DNA, 13 bp, Homo sapiens
ttttaactcaata

SEQ ID NO: 3404909 - DNA, 12 bp, Homo sapiens
ttttaactcacc

SEQ ID NO: 3404910 - DNA, 15 bp, Homo sapiens
ttttaagctctgagc

SEQ ID NO: 3404911 - DNA, 16 bp, Homo sapiens
ttttaagtttgaaact

SEQ ID NO: 3404912 - DNA, 15 bp, Homo sapiens
ttttaattaaaaact

SEQ ID NO: 3404913 - DNA, 13 bp, Homo sapiens
ttttaattaaata

SEQ ID NO: 3404914 - DNA, 15 bp, Homo sapiens
ttttaggttgttacc

SEQ ID NO: 3404915 - DNA, 23 bp, Homo sapiens
ttttatagttgtattttgtacat

SEQ ID NO: 3404916 - DNA, 21 bp, Homo sapiens
ttttatatctggaatgagcct

SEQ ID NO: 3404917 - DNA, 13 bp, Homo sapiens
ttttatttacatt

SEQ ID NO: 3404918 - DNA, 16 bp, Homo sapiens
ttttatttctgatgtt

SEQ ID NO: 3404919 - DNA, 13 bp, Homo sapiens
ttttcaatttgga

SEQ ID NO: 3404920 - DNA, 21 bp, Homo sapiens
ttttcagcatcaaacatgaaa

SEQ ID NO: 3404921 - DNA, 14 bp, Homo sapiens
ttttcatagatttg

SEQ ID NO: 3404922 - DNA, 16 bp, Homo sapiens
ttttcatagatttgaa

SEQ ID NO: 3404923 - DNA, 17 bp, Homo sapiens
ttttccagccttatgtg

SEQ ID NO: 3404924 - DNA, 21 bp, Homo sapiens
ttttccagccttatgtgttac

SEQ ID NO: 3404925 - DNA, 13 bp, Homo sapiens
ttttccaggctgg

SEQ ID NO: 3404926 - DNA, 17 bp, Homo sapiens
ttttccatctgtgtgca

SEQ ID NO: 3404927 - DNA, 22 bp, Homo sapiens
ttttccccgtgacattcactgg

SEQ ID NO: 3404928 - DNA, 13 bp, Homo sapiens
ttttcccctgcaa

SEQ ID NO: 3404929 - DNA, 22 bp, Homo sapiens
ttttctgcccaactttcattgg

SEQ ID NO: 3404930 - DNA, 19 bp, Homo sapiens
ttttcttgcctctgtcccc

SEQ ID NO: 3404931 - DNA, 20 bp, Homo sapiens
ttttgaaaatattttaccca

SEQ ID NO: 3404932 - DNA, 18 bp, Homo sapiens
ttttgcccatataaaatg

SEQ ID NO: 3404933 - DNA, 20 bp, Homo sapiens
ttttggttttgttcccctcc

SEQ ID NO: 3404934 - DNA, 19 bp, Homo sapiens
ttttgtcacagctcttgtt

SEQ ID NO: 3404935 - DNA, 17 bp, Homo sapiens
ttttgtctttcaaattt

SEQ ID NO: 3404936 - DNA, 22 bp, Homo sapiens
ttttgtgaaatgaaaacatgta

SEQ ID NO: 3404937 - DNA, 12 bp, Homo sapiens
tttttaaagaaa

SEQ ID NO: 3404938 - DNA, 12 bp, Homo sapiens
tttttaatagaa

SEQ ID NO: 3404939 - DNA, 13 bp, Homo sapiens
tttttaattaaaa

SEQ ID NO: 3404940 - DNA, 12 bp, Homo sapiens
tttttagtttaa

SEQ ID NO: 3404941 - DNA, 15 bp, Homo sapiens
tttttatatatgtgt

SEQ ID NO: 3404942 - DNA, 14 bp, Homo sapiens
tttttatcttgagt

SEQ ID NO: 3404943 - DNA, 20 bp, Homo sapiens
tttttatttcttttgtgcag

SEQ ID NO: 3404944 - DNA, 19 bp, Homo sapiens
tttttatttgtttgtgcat

SEQ ID NO: 3404945 - DNA, 21 bp, Homo sapiens
tttttcatactcttaagtgta

SEQ ID NO: 3404946 - DNA, 11 bp, Homo sapiens
tttttccttta

SEQ ID NO: 3404947 - DNA, 18 bp, Homo sapiens
tttttctcaaagttttga

SEQ ID NO: 3404948 - DNA, 12 bp, Homo sapiens
tttttgttccct

SEQ ID NO: 3404949 - DNA, 14 bp, Homo sapiens
tttttgttgtttaa

SEQ ID NO: 3404950 - DNA, 23 bp, Homo sapiens
ttttttaaacaaaatttcacagt

SEQ ID NO: 3404951 - DNA, 14 bp, Homo sapiens
ttttttaaagaaaa

SEQ ID NO: 3404952 - DNA, 23 bp, Homo sapiens
ttttttaaagaaaatgtgtctgc

SEQ ID NO: 3404953 - DNA, 12 bp, Homo sapiens
ttttttaagatt

SEQ ID NO: 3404954 - DNA, 16 bp, Homo sapiens
ttttttccagagttgt

SEQ ID NO: 3404955 - DNA, 20 bp, Homo sapiens
tgcgtgtgtagagttaagaa

SEQ ID NO: 3404956 - DNA, 22 bp, Homo sapiens
tgctaatatactttttttgtta

SEQ ID NO: 3404957 - DNA, 12 bp, Homo sapiens
tgctagcacatg

SEQ ID NO: 3404958 - DNA, 16 bp, Homo sapiens
tgctatgagctgggga

SEQ ID NO: 3404959 - DNA, 19 bp, Homo sapiens
tgctatgagctggggatgt

SEQ ID NO: 3404960 - DNA, 22 bp, Homo sapiens
tgctatgagctggggatgtctc

SEQ ID NO: 3404961 - DNA, 23 bp, Homo sapiens
tgctcattaaactgattccagga

SEQ ID NO: 3404962 - DNA, 12 bp, Homo sapiens
tgctctccttcc

SEQ ID NO: 3404963 - DNA, 23 bp, Homo sapiens
tgctctccttcctggagcccaga

SEQ ID NO: 3404964 - DNA, 14 bp, Homo sapiens
tgctgaagggaggg

SEQ ID NO: 3404965 - DNA, 13 bp, Homo sapiens
tgctgaatgtcat

SEQ ID NO: 3404966 - DNA, 20 bp, Homo sapiens
tgctgaatgtcattatttga

SEQ ID NO: 3404967 - DNA, 22 bp, Homo sapiens
tgctgaattgagaataagaatt

SEQ ID NO: 3404968 - DNA, 14 bp, Homo sapiens
tgctgatccttgca

SEQ ID NO: 3404969 - DNA, 21 bp, Homo sapiens
tgctgatcgccttatttatat

SEQ ID NO: 3404970 - DNA, 13 bp, Homo sapiens
tgctgctgcctgc

SEQ ID NO: 3404971 - DNA, 20 bp, Homo sapiens
tgctgtaaatttggcttctg

SEQ ID NO: 3404972 - DNA, 14 bp, Homo sapiens
tgctgtccttgaat

SEQ ID NO: 3404973 - DNA, 17 bp, Homo sapiens
tgctgtgcaaacagtgt

SEQ ID NO: 3404974 - DNA, 15 bp, Homo sapiens
tgctgttactgcttc

SEQ ID NO: 3404975 - DNA, 22 bp, Homo sapiens
tgctgttttaaattgcatttct

SEQ ID NO: 3404976 - DNA, 19 bp, Homo sapiens
tgcttaacgttttcttaaa

SEQ ID NO: 3404977 - DNA, 16 bp, Homo sapiens
tgcttaaggcatactt

SEQ ID NO: 3404978 - DNA, 20 bp, Homo sapiens
tgcttcactcatgcaaactg

SEQ ID NO: 3404979 - DNA, 21 bp, Homo sapiens
tgcttcactcatgcaaactgc

SEQ ID NO: 3404980 - DNA, 15 bp, Homo sapiens
tgcttctctttgtgc

SEQ ID NO: 3404981 - DNA, 17 bp, Homo sapiens
tgcttctctttgtgcag

SEQ ID NO: 3404982 - DNA, 11 bp, Homo sapiens
tgcttcttgta

SEQ ID NO: 3404983 - DNA, 12 bp, Homo sapiens
tgcttcttgtaa

SEQ ID NO: 3404984 - DNA, 21 bp, Homo sapiens
tgcttcttgtaatatttcttc

SEQ ID NO: 3404985 - DNA, 22 bp, Homo sapiens
tgctttataccccatttgattt

SEQ ID NO: 3404986 - DNA, 15 bp, Homo sapiens
tgctttattttccct

SEQ ID NO: 3404987 - DNA, 17 bp, Homo sapiens
tgctttgcctcgaaagt

SEQ ID NO: 3404988 - DNA, 19 bp, Homo sapiens
tgctttgcctcgaaagtgt

SEQ ID NO: 3404989 - DNA, 20 bp, Homo sapiens
tgctttgcctcgaaagtgtc

SEQ ID NO: 3404990 - DNA, 18 bp, Homo sapiens
tgcttttgcccatataaa

SEQ ID NO: 3404991 - DNA, 13 bp, Homo sapiens
tggaaaaatgccc

SEQ ID NO: 3404992 - DNA, 15 bp, Homo sapiens
tggaaaaatgcccat

SEQ ID NO: 3404993 - DNA, 16 bp, Homo sapiens
tggaaaaggaagacta

SEQ ID NO: 3404994 - DNA, 22 bp, Homo sapiens
tggaaaaggaagactagaggct

SEQ ID NO: 3404995 - DNA, 20 bp, Homo sapiens
tggaaacctagccagcttca

SEQ ID NO: 3404996 - DNA, 19 bp, Homo sapiens
tggaaagacagcttctcat

SEQ ID NO: 3404997 - DNA, 20 bp, Homo sapiens
tggaaaggaagaatgcagag

SEQ ID NO: 3404998 - DNA, 16 bp, Homo sapiens
tggaagcactgctgtg

SEQ ID NO: 3404999 - DNA, 13 bp, Homo sapiens
tggaagtgtgggt

SEQ ID NO: 3405000 - DNA, 19 bp, Homo sapiens
tggaataaacatctgtgtc

SEQ ID NO: 3405001 - DNA, 22 bp, Homo sapiens
tggaataaacatctgtgtctgt

SEQ ID NO: 3405002 - DNA, 19 bp, Homo sapiens
tggaatgtcagtgttcagc

SEQ ID NO: 3405003 - DNA, 15 bp, Homo sapiens
tggacagaagcagct

SEQ ID NO: 3405004 - DNA, 16 bp, Homo sapiens
tggacccctgcattgg

SEQ ID NO: 3405005 - DNA, 22 bp, Homo sapiens
tggaccggagagtgggggtggg

SEQ ID NO: 3405006 - DNA, 18 bp, Homo sapiens
tggacctctcttgtgagc

SEQ ID NO: 3405007 - DNA, 16 bp, Homo sapiens
tggaccttgagaccac

SEQ ID NO: 3405008 - DNA, 19 bp, Homo sapiens
tggagaagccacaggcctg

SEQ ID NO: 3405009 - DNA, 23 bp, Homo sapiens
tggagaagccacaggcctgagat

SEQ ID NO: 3405010 - DNA, 16 bp, Homo sapiens
tggagactttgctgtt

SEQ ID NO: 3405011 - DNA, 11 bp, Homo sapiens
tggagccctgt

SEQ ID NO: 3405012 - DNA, 18 bp, Homo sapiens
tggagggatcattttctg

SEQ ID NO: 3405013 - DNA, 22 bp, Homo sapiens
tggagttcgtaccgcttcctta

SEQ ID NO: 3405014 - DNA, 18 bp, Homo sapiens
tggattatttaataacat

SEQ ID NO: 3405015 - DNA, 23 bp, Homo sapiens
tggattatttaataacattacct

SEQ ID NO: 3405016 - DNA, 15 bp, Homo sapiens
tggattggattattt

SEQ ID NO: 3405017 - DNA, 21 bp, Homo sapiens
tggattggattatttaataac

SEQ ID NO: 3405018 - DNA, 18 bp, Homo sapiens
tggcacagcccaaagaag

SEQ ID NO: 3405019 - DNA, 13 bp, Homo sapiens
tggcagaagacac

SEQ ID NO: 3405020 - DNA, 20 bp, Homo sapiens
tggcagaagacaccagagca

SEQ ID NO: 3405021 - DNA, 22 bp, Homo sapiens
tggcagaagacaccagagcaga

SEQ ID NO: 3405022 - DNA, 23 bp, Homo sapiens
tggcagaagacaccagagcagat

SEQ ID NO: 3405023 - DNA, 13 bp, Homo sapiens
tggcagctctagc

SEQ ID NO: 3405024 - DNA, 13 bp, Homo sapiens
tggcaggacagga

SEQ ID NO: 3405025 - DNA, 17 bp, Homo sapiens
tggcataatttgtctta

SEQ ID NO: 3405026 - DNA, 16 bp, Homo sapiens
tggcatcgcagcttcc

SEQ ID NO: 3405027 - DNA, 19 bp, Homo sapiens
tggcatgtgggttgtgata

SEQ ID NO: 3405028 - DNA, 19 bp, Homo sapiens
tggcatttgcagattttta

SEQ ID NO: 3405029 - DNA, 13 bp, Homo sapiens
tggccaaaactta

SEQ ID NO: 3405030 - DNA, 14 bp, Homo sapiens
tggccaaaacttaa

SEQ ID NO: 3405031 - DNA, 22 bp, Homo sapiens
tggccaaaggaccgttttgtat

SEQ ID NO: 3405032 - DNA, 23 bp, Homo sapiens
tggccatatatgctgtatttctt

SEQ ID NO: 3405033 - DNA, 22 bp, Homo sapiens
tggcccaccccacccacttctg

SEQ ID NO: 3405034 - DNA, 23 bp, Homo sapiens
tggcccaccccacccacttctgc

SEQ ID NO: 3405035 - DNA, 18 bp, Homo sapiens
tggccctcctcagctccc

SEQ ID NO: 3405036 - DNA, 19 bp, Homo sapiens
tggccctcctcagctccct

SEQ ID NO: 3405037 - DNA, 20 bp, Homo sapiens
tggccctcctcagctccctg

SEQ ID NO: 3405038 - DNA, 17 bp, Homo sapiens
tggccctctcccctgcc

SEQ ID NO: 3405039 - DNA, 18 bp, Homo sapiens
tggccctctcccctgccc

SEQ ID NO: 3405040 - DNA, 23 bp, Homo sapiens
tggccgcgccaaataatgtctct

SEQ ID NO: 3405041 - DNA, 15 bp, Homo sapiens
tggccgggaccccga

SEQ ID NO: 3405042 - DNA, 17 bp, Homo sapiens
tggccgggaccccgagc

SEQ ID NO: 3405043 - DNA, 12 bp, Homo sapiens
tggctcacactg

SEQ ID NO: 3405044 - DNA, 13 bp, Homo sapiens
tggctcacactga

SEQ ID NO: 3405045 - DNA, 23 bp, Homo sapiens
tggcttcactcctgctgtaaatt

SEQ ID NO: 3405046 - DNA, 15 bp, Homo sapiens
tggctttcagagttt

SEQ ID NO: 3405047 - DNA, 16 bp, Homo sapiens
tggctttgttcttgtc

SEQ ID NO: 3405048 - DNA, 17 bp, Homo sapiens
tgggaaccatgaagctg

SEQ ID NO: 3405049 - DNA, 17 bp, Homo sapiens
tgggaagctatttcctt

SEQ ID NO: 3405050 - DNA, 14 bp, Homo sapiens
tgggaatcaagatt

SEQ ID NO: 3405051 - DNA, 14 bp, Homo sapiens
tgggaccagggcat

SEQ ID NO: 3405052 - DNA, 20 bp, Homo sapiens
tgggagaatgtcagtatgtg

SEQ ID NO: 3405053 - DNA, 15 bp, Homo sapiens
tgggagatgaaaacc

SEQ ID NO: 3405054 - DNA, 23 bp, Homo sapiens
tgggagatgaaaacctgcatttt

SEQ ID NO: 3405055 - DNA, 12 bp, Homo sapiens
tgggaggcgggc

SEQ ID NO: 3405056 - DNA, 22 bp, Homo sapiens
tgggccacttctgggtggggca

SEQ ID NO: 3405057 - DNA, 14 bp, Homo sapiens
tgggccctctggtt

SEQ ID NO: 3405058 - DNA, 16 bp, Homo sapiens
tgggcttcactgtata

SEQ ID NO: 3405059 - DNA, 22 bp, Homo sapiens
tggggagggatttggggctcag

SEQ ID NO: 3405060 - DNA, 21 bp, Homo sapiens
tgggggtcctcctccagggac

SEQ ID NO: 3405061 - DNA, 22 bp, Homo sapiens
tgggtaagaaagccaccttgtt

SEQ ID NO: 3405062 - DNA, 15 bp, Homo sapiens
tgggtctgtgtgtgt

SEQ ID NO: 3405063 - DNA, 20 bp, Homo sapiens
tgggtgatttctagaatggt

SEQ ID NO: 3405064 - DNA, 16 bp, Homo sapiens
tgggtttacaacaaac

SEQ ID NO: 3405065 - DNA, 15 bp, Homo sapiens
tggtactaaggagaa

SEQ ID NO: 3405066 - DNA, 13 bp, Homo sapiens
ttaaatcatttta

SEQ ID NO: 3405067 - DNA, 17 bp, Homo sapiens
ttaaatctgaattttaa

SEQ ID NO: 3405068 - DNA, 15 bp, Homo sapiens
ttaaatgagttactt

SEQ ID NO: 3405069 - DNA, 21 bp, Homo sapiens
ttaaatgccaaaatgtactta

SEQ ID NO: 3405070 - DNA, 13 bp, Homo sapiens
ttaaatgttttca

SEQ ID NO: 3405071 - DNA, 17 bp, Homo sapiens
ttaaatgttttcattgg

SEQ ID NO: 3405072 - DNA, 18 bp, Homo sapiens
ttaaattctctctaacat

SEQ ID NO: 3405073 - DNA, 23 bp, Homo sapiens
ttaaattctctctaacataacaa

SEQ ID NO: 3405074 - DNA, 16 bp, Homo sapiens
ttaaattgcatttcta

SEQ ID NO: 3405075 - DNA, 17 bp, Homo sapiens
ttaaattgttataactt

SEQ ID NO: 3405076 - DNA, 19 bp, Homo sapiens
ttaaatttaggtaaataaa

SEQ ID NO: 3405077 - DNA, 22 bp, Homo sapiens
ttaaatttaggtaaataaagct

SEQ ID NO: 3405078 - DNA, 13 bp, Homo sapiens
ttaaatttgtaag

SEQ ID NO: 3405079 - DNA, 17 bp, Homo sapiens
ttaaatttgtaagtttc

SEQ ID NO: 3405080 - DNA, 16 bp, Homo sapiens
ttaaattttgtgtctc

SEQ ID NO: 3405081 - DNA, 16 bp, Homo sapiens
ttaacaggtattttca

SEQ ID NO: 3405082 - DNA, 17 bp, Homo sapiens
ttaacaggtattttcac

SEQ ID NO: 3405083 - DNA, 23 bp, Homo sapiens
ttaacattaaagcaatctgttga

SEQ ID NO: 3405084 - DNA, 14 bp, Homo sapiens
ttaacatttcaagg

SEQ ID NO: 3405085 - DNA, 15 bp, Homo sapiens
ttaacgttttcttaa

SEQ ID NO: 3405086 - DNA, 21 bp, Homo sapiens
ttaactctgtaaaagtgtctg

SEQ ID NO: 3405087 - DNA, 14 bp, Homo sapiens
ttaactgcttttgc

SEQ ID NO: 3405088 - DNA, 17 bp, Homo sapiens
ttaacttgtctttttgt

SEQ ID NO: 3405089 - DNA, 18 bp, Homo sapiens
ttaagaagctgttgtaca

SEQ ID NO: 3405090 - DNA, 20 bp, Homo sapiens
ttaagaagctgttgtacatt

SEQ ID NO: 3405091 - DNA, 23 bp, Homo sapiens
ttaagaagctgttgtacatttat

SEQ ID NO: 3405092 - DNA, 16 bp, Homo sapiens
ttaagatttttctcaa

SEQ ID NO: 3405093 - DNA, 22 bp, Homo sapiens
ttaagatttttctcaaagtttt

SEQ ID NO: 3405094 - DNA, 15 bp, Homo sapiens
ttaagctctgagctg

SEQ ID NO: 3405095 - DNA, 17 bp, Homo sapiens
ttaagtgcgtgtgtaga

SEQ ID NO: 3405096 - DNA, 17 bp, Homo sapiens
ttaagtgtaaataatat

SEQ ID NO: 3405097 - DNA, 13 bp, Homo sapiens
ttaagtgttgaaa

SEQ ID NO: 3405098 - DNA, 16 bp, Homo sapiens
ttaataaaataattct

SEQ ID NO: 3405099 - DNA, 15 bp, Homo sapiens
ttaataacattacct

SEQ ID NO: 3405100 - DNA, 21 bp, Homo sapiens
ttaataacattaccttactgt

SEQ ID NO: 3405101 - DNA, 16 bp, Homo sapiens
ttaatatggggatgca

SEQ ID NO: 3405102 - DNA, 13 bp, Homo sapiens
ttaatcagtgttg

SEQ ID NO: 3405103 - DNA, 15 bp, Homo sapiens
ttaatctgttgtttg

SEQ ID NO: 3405104 - DNA, 17 bp, Homo sapiens
ttaatgatttttgtgta

SEQ ID NO: 3405105 - DNA, 18 bp, Homo sapiens
ttaatgatttttgtgtat

SEQ ID NO: 3405106 - DNA, 13 bp, Homo sapiens
ttaattaaaaact

SEQ ID NO: 3405107 - DNA, 20 bp, Homo sapiens
ttaattgttccttgctttta

SEQ ID NO: 3405108 - DNA, 21 bp, Homo sapiens
ttaattgttccttgcttttat

SEQ ID NO: 3405109 - DNA, 16 bp, Homo sapiens
ttaattgttgtttctt

SEQ ID NO: 3405110 - DNA, 20 bp, Homo sapiens
ttaattgttgtttctttcta

SEQ ID NO: 3405111 - DNA, 20 bp, Homo sapiens
ttaatttagagcgtttggtt

SEQ ID NO: 3405112 - DNA, 15 bp, Homo sapiens
ttacaaacatgtggt

SEQ ID NO: 3405113 - DNA, 16 bp, Homo sapiens
ttacaacaaacactgt

SEQ ID NO: 3405114 - DNA, 17 bp, Homo sapiens
ttacaactcccccaccg

SEQ ID NO: 3405115 - DNA, 16 bp, Homo sapiens
ttacaagcttaaagct

SEQ ID NO: 3405116 - DNA, 21 bp, Homo sapiens
ttacaagcttaaagcttgatt

SEQ ID NO: 3405117 - DNA, 20 bp, Homo sapiens
ttacagggcacaggccatgg

SEQ ID NO: 3405118 - DNA, 13 bp, Homo sapiens
ttacagtaaatga

SEQ ID NO: 3405119 - DNA, 14 bp, Homo sapiens
ttacatacagtgat

SEQ ID NO: 3405120 - DNA, 15 bp, Homo sapiens
ttacatacagtgata

SEQ ID NO: 3405121 - DNA, 18 bp, Homo sapiens
ttacatcaaggcttcaaa

SEQ ID NO: 3405122 - DNA, 22 bp, Homo sapiens
ttaccaagtatgaagtataaat

SEQ ID NO: 3405123 - DNA, 15 bp, Homo sapiens
ttaccagtctgatta

SEQ ID NO: 3405124 - DNA, 23 bp, Homo sapiens
ttaccttattgagcgtgattctg

SEQ ID NO: 3405125 - DNA, 18 bp, Homo sapiens
ttacggccctggccttgg

SEQ ID NO: 3405126 - DNA, 16 bp, Homo sapiens
ttacgtataatgcttt

SEQ ID NO: 3405127 - DNA, 22 bp, Homo sapiens
ttactacagtttttaactctac

SEQ ID NO: 3405128 - DNA, 17 bp, Homo sapiens
ttactgctctagaaagt

SEQ ID NO: 3405129 - DNA, 12 bp, Homo sapiens
ttactgtcttaa

SEQ ID NO: 3405130 - DNA, 18 bp, Homo sapiens
ttactgtggaggaaggat

SEQ ID NO: 3405131 - DNA, 23 bp, Homo sapiens
ttacttagaatgccataaaattg

SEQ ID NO: 3405132 - DNA, 18 bp, Homo sapiens
ttactttggtttagtctt

SEQ ID NO: 3405133 - DNA, 21 bp, Homo sapiens
ttagacctcttcctggaataa

SEQ ID NO: 3405134 - DNA, 22 bp, Homo sapiens
ttagacctcttcctggaataaa

SEQ ID NO: 3405135 - DNA, 15 bp, Homo sapiens
ttagattttctgtaa

SEQ ID NO: 3405136 - DNA, 23 bp, Homo sapiens
ttagccaggatcatggtgtaata

SEQ ID NO: 3405137 - DNA, 16 bp, Homo sapiens
ttagctttttaattgt

SEQ ID NO: 3405138 - DNA, 18 bp, Homo sapiens
ttagctttttaattgttg

SEQ ID NO: 3405139 - DNA, 16 bp, Homo sapiens
ttaggtaaataaagct

SEQ ID NO: 3405140 - DNA, 15 bp, Homo sapiens
ttagtatagtagaaa

SEQ ID NO: 3405141 - DNA, 19 bp, Homo sapiens
ttagtatagtagaaagaca

SEQ ID NO: 3405142 - DNA, 13 bp, Homo sapiens
ttagtcattatta

SEQ ID NO: 3405143 - DNA, 16 bp, Homo sapiens
ttagtgcacttaatat

SEQ ID NO: 3405144 - DNA, 18 bp, Homo sapiens
ttagttacgtataatgct

SEQ ID NO: 3405145 - DNA, 20 bp, Homo sapiens
ttagttacgtataatgcttt

SEQ ID NO: 3405146 - DNA, 13 bp, Homo sapiens
ttagtttctcata

SEQ ID NO: 3405147 - DNA, 14 bp, Homo sapiens
ttataagcgtattt

SEQ ID NO: 3405148 - DNA, 13 bp, Homo sapiens
ttataataaactc

SEQ ID NO: 3405149 - DNA, 24 bp, Homo sapiens
ttataatgcaatgataaataaagt

SEQ ID NO: 3405150 - DNA, 14 bp, Homo sapiens
ttatagattgtctt

SEQ ID NO: 3405151 - DNA, 15 bp, Homo sapiens
ttatagattgtctta

SEQ ID NO: 3405152 - DNA, 18 bp, Homo sapiens
ttatatataaggtaatgt

SEQ ID NO: 3405153 - DNA, 18 bp, Homo sapiens
ttatatttggcccaaact

SEQ ID NO: 3405154 - DNA, 19 bp, Homo sapiens
ttatattttattgctacaa

SEQ ID NO: 3405155 - DNA, 20 bp, Homo sapiens
ttatctacccagtcatgtac

SEQ ID NO: 3405156 - DNA, 22 bp, Homo sapiens
ttatctcagtcatgcataaata

SEQ ID NO: 3405157 - DNA, 13 bp, Homo sapiens
ttatgagaacatg

SEQ ID NO: 3405158 - DNA, 14 bp, Homo sapiens
ttatgagaacatgg

SEQ ID NO: 3405159 - DNA, 15 bp, Homo sapiens
ttatgagaacatggt

SEQ ID NO: 3405160 - DNA, 22 bp, Homo sapiens
ttatgagaacatggtgtgtgtc

SEQ ID NO: 3405161 - DNA, 21 bp, Homo sapiens
ttatgatgtgggtcaaggaat

SEQ ID NO: 3405162 - DNA, 15 bp, Homo sapiens
ttatgatttaataaa

SEQ ID NO: 3405163 - DNA, 17 bp, Homo sapiens
ttatgatttaataaaat

SEQ ID NO: 3405164 - DNA, 20 bp, Homo sapiens
ttatgatttaataaaataat

SEQ ID NO: 3405165 - DNA, 17 bp, Homo sapiens
ttatgggaatcaagatt

SEQ ID NO: 3405166 - DNA, 10 bp, Homo sapiens
ttatgtgtgt

SEQ ID NO: 3405167 - DNA, 16 bp, Homo sapiens
ttattattattgtgac

SEQ ID NO: 3405168 - DNA, 16 bp, Homo sapiens
ttattcagctagaatt

SEQ ID NO: 3405169 - DNA, 15 bp, Homo sapiens
ttattcttttccaga

SEQ ID NO: 3405170 - DNA, 23 bp, Homo sapiens
ttattgctacaaggggtgtgact

SEQ ID NO: 3405171 - DNA, 19 bp, Homo sapiens
ttatttaataacattacct

SEQ ID NO: 3405172 - DNA, 19 bp, Homo sapiens
ttatttctctggcaaactt

SEQ ID NO: 3405173 - DNA, 12 bp, Homo sapiens
ttatttctgatg

SEQ ID NO: 3405174 - DNA, 11 bp, Homo sapiens
ttcaaaaactt

SEQ ID NO: 3405175 - DNA, 13 bp, Homo sapiens
ttcaaatatcaaa

SEQ ID NO: 3405176 - DNA, 20 bp, Homo sapiens
ttcaaatatcaaaaggaaga

SEQ ID NO: 3405177 - DNA, 23 bp, Homo sapiens
ttcaaatttactgtcttaaatca

SEQ ID NO: 3405178 - DNA, 21 bp, Homo sapiens
ttcaaattttttaaaagagac

SEQ ID NO: 3405179 - DNA, 13 bp, Homo sapiens
ttcaaggctttaa

SEQ ID NO: 3405180 - DNA, 23 bp, Homo sapiens
ttcaatttactttttaaacagtg

SEQ ID NO: 3405181 - DNA, 21 bp, Homo sapiens
ttcactcatgcaaactgcttt

SEQ ID NO: 3405182 - DNA, 21 bp, Homo sapiens
ttcactggggcatgagatttt

SEQ ID NO: 3405183 - DNA, 15 bp, Homo sapiens
ttcactgtataaata

SEQ ID NO: 3405184 - DNA, 12 bp, Homo sapiens
ttcagatacatg

SEQ ID NO: 3405185 - DNA, 22 bp, Homo sapiens
ttcagattccacacaaaatgtc

SEQ ID NO: 3405186 - DNA, 16 bp, Homo sapiens
ttcagatttgccttat

SEQ ID NO: 3405187 - DNA, 22 bp, Homo sapiens
ttcagccaaacagtatgatgga

SEQ ID NO: 3405188 - DNA, 13 bp, Homo sapiens
ttcaggtgacatg

SEQ ID NO: 3405189 - DNA, 16 bp, Homo sapiens
ttcaggtgacatgtga

SEQ ID NO: 3405190 - DNA, 19 bp, Homo sapiens
ttcaggttatcgaaataac

SEQ ID NO: 3405191 - DNA, 16 bp, Homo sapiens
ttcagtattatttgta

SEQ ID NO: 3405192 - DNA, 22 bp, Homo sapiens
ttcagtgaaaaagatattttat

SEQ ID NO: 3405193 - DNA, 16 bp, Homo sapiens
ttcagtgaaagcatca

SEQ ID NO: 3405194 - DNA, 19 bp, Homo sapiens
ttcagtttttttttttcca

SEQ ID NO: 3405195 - DNA, 11 bp, Homo sapiens
ttcataatggc

SEQ ID NO: 3405196 - DNA, 20 bp, Homo sapiens
ttcataatggcctgagactt

SEQ ID NO: 3405197 - DNA, 16 bp, Homo sapiens
ttcatctatttctgag

SEQ ID NO: 3405198 - DNA, 18 bp, Homo sapiens
ttcatctatttctgagaa

SEQ ID NO: 3405199 - DNA, 21 bp, Homo sapiens
ttcatctgctctccttcctgg

SEQ ID NO: 3405200 - DNA, 18 bp, Homo sapiens
ttcattcctaacacagca

SEQ ID NO: 3405201 - DNA, 17 bp, Homo sapiens
ttcatttttttccaggc

SEQ ID NO: 3405202 - DNA, 20 bp, Homo sapiens
ttccaaaataatctatatta

SEQ ID NO: 3405203 - DNA, 12 bp, Homo sapiens
ttccaagagctg

SEQ ID NO: 3405204 - DNA, 12 bp, Homo sapiens
ttccacatcatg

SEQ ID NO: 3405205 - DNA, 17 bp, Homo sapiens
ttccacatcatgttact

SEQ ID NO: 3405206 - DNA, 20 bp, Homo sapiens
ttccagagttgttgtttgcc

SEQ ID NO: 3405207 - DNA, 18 bp, Homo sapiens
ttccagccttatgtgtta

SEQ ID NO: 3405208 - DNA, 21 bp, Homo sapiens
ttccattaaattgcctttgta

SEQ ID NO: 3405209 - DNA, 22 bp, Homo sapiens
ttccattaaattgcctttgtaa

SEQ ID NO: 3405210 - DNA, 16 bp, Homo sapiens
ttccattatgattctt

SEQ ID NO: 3405211 - DNA, 12 bp, Homo sapiens
ttcccaaatgtg

SEQ ID NO: 3405212 - DNA, 11 bp, Homo sapiens
ttcccagaggg

SEQ ID NO: 3405213 - DNA, 18 bp, Homo sapiens
ttcccaggtaatttaaat

SEQ ID NO: 3405214 - DNA, 13 bp, Homo sapiens
ttcccctgcaatg

SEQ ID NO: 3405215 - DNA, 14 bp, Homo sapiens
ttccctacttgcag

SEQ ID NO: 3405216 - DNA, 14 bp, Homo sapiens
ttcctaacacagca

SEQ ID NO: 3405217 - DNA, 20 bp, Homo sapiens
ttcctataatataataaata

SEQ ID NO: 3405218 - DNA, 12 bp, Homo sapiens
ttcctatatgca

SEQ ID NO: 3405219 - DNA, 21 bp, Homo sapiens
ttcctcacaccaggcttgcct

SEQ ID NO: 3405220 - DNA, 21 bp, Homo sapiens
ttcctgaggaagagggactgt

SEQ ID NO: 3405221 - DNA, 15 bp, Homo sapiens
ttcctggagcccaga

SEQ ID NO: 3405222 - DNA, 17 bp, Homo sapiens
ttcctttaaaaaaattt

SEQ ID NO: 3405223 - DNA, 22 bp, Homo sapiens
ttcctttcagagttttactaag

SEQ ID NO: 3405224 - DNA, 20 bp, Homo sapiens
ttcgatgggcccaattctta

SEQ ID NO: 3405225 - DNA, 21 bp, Homo sapiens
ttcgatgggcccaattcttac

SEQ ID NO: 3405226 - DNA, 17 bp, Homo sapiens
ttcggatttggggtgga

SEQ ID NO: 3405227 - DNA, 19 bp, Homo sapiens
ttcgtaccgcttccttaga

SEQ ID NO: 3405228 - DNA, 23 bp, Homo sapiens
ttctaaatgcatatcctgagcca

SEQ ID NO: 3405229 - DNA, 14 bp, Homo sapiens
ttctagaatggttt

SEQ ID NO: 3405230 - DNA, 18 bp, Homo sapiens
ttctagaccctatacatt

SEQ ID NO: 3405231 - DNA, 20 bp, Homo sapiens
ttctagaccctatacatttt

SEQ ID NO: 3405232 - DNA, 20 bp, Homo sapiens
ttctagtggtctttgtaaga

SEQ ID NO: 3405233 - DNA, 21 bp, Homo sapiens
ttctagtggtctttgtaagag

SEQ ID NO: 3405234 - DNA, 13 bp, Homo sapiens
ttctatgccattt

SEQ ID NO: 3405235 - DNA, 21 bp, Homo sapiens
ttctatggagactttgctgtt

SEQ ID NO: 3405236 - DNA, 13 bp, Homo sapiens
ttctatgtatgtg

SEQ ID NO: 3405237 - DNA, 15 bp, Homo sapiens
ttctcaaagttttga

SEQ ID NO: 3405238 - DNA, 23 bp, Homo sapiens
ccatgtgctacaggggccagaag

SEQ ID NO: 3405239 - DNA, 21 bp, Homo sapiens
ccatgtgtgctaatatacttt

SEQ ID NO: 3405240 - DNA, 15 bp, Homo sapiens
ccatgttctgtccct

SEQ ID NO: 3405241 - DNA, 22 bp, Homo sapiens
ccatgttctgtcccttgccccc

SEQ ID NO: 3405242 - DNA, 22 bp, Homo sapiens
ccatgttggttgcactttgtag

SEQ ID NO: 3405243 - DNA, 17 bp, Homo sapiens
ccattatgaagaagaga

SEQ ID NO: 3405244 - DNA, 13 bp, Homo sapiens
ccattccttccca

SEQ ID NO: 3405245 - DNA, 16 bp, Homo sapiens
ccattccttcccagag

SEQ ID NO: 3405246 - DNA, 12 bp, Homo sapiens
ccattttttcct

SEQ ID NO: 3405247 - DNA, 17 bp, Homo sapiens
cccaacagtttattttt

SEQ ID NO: 3405248 - DNA, 12 bp, Homo sapiens
cccaactgacca

SEQ ID NO: 3405249 - DNA, 17 bp, Homo sapiens
cccaatccatgcttcac

SEQ ID NO: 3405250 - DNA, 15 bp, Homo sapiens
cccaccccagggcag

SEQ ID NO: 3405251 - DNA, 16 bp, Homo sapiens
cccacctccgctggga

SEQ ID NO: 3405252 - DNA, 17 bp, Homo sapiens
cccactctccacctcac

SEQ ID NO: 3405253 - DNA, 23 bp, Homo sapiens
cccactctccacctcactagctc

SEQ ID NO: 3405254 - DNA, 18 bp, Homo sapiens
cccagaggggcctgccac

SEQ ID NO: 3405255 - DNA, 19 bp, Homo sapiens
cccagaggggcctgccacc

SEQ ID NO: 3405256 - DNA, 20 bp, Homo sapiens
cccagaggtaacagaacagc

SEQ ID NO: 3405257 - DNA, 19 bp, Homo sapiens
cccagattggctcacactg

SEQ ID NO: 3405258 - DNA, 13 bp, Homo sapiens
cccaggccaggac

SEQ ID NO: 3405259 - DNA, 15 bp, Homo sapiens
cccaggccaggactc

SEQ ID NO: 3405260 - DNA, 17 bp, Homo sapiens
cccaggctgccggctcc

SEQ ID NO: 3405261 - DNA, 22 bp, Homo sapiens
cccagtgatctcgactcccccc

SEQ ID NO: 3405262 - DNA, 14 bp, Homo sapiens
cccatcctgccaca

SEQ ID NO: 3405263 - DNA, 17 bp, Homo sapiens
cccatttttgctaatta

SEQ ID NO: 3405264 - DNA, 14 bp, Homo sapiens
ccccacccacttct

SEQ ID NO: 3405265 - DNA, 14 bp, Homo sapiens
ccccaccccagggc

SEQ ID NO: 3405266 - DNA, 19 bp, Homo sapiens
ccccaccctcagccgctct

SEQ ID NO: 3405267 - DNA, 13 bp, Homo sapiens
ccccaccgcccac

SEQ ID NO: 3405268 - DNA, 15 bp, Homo sapiens
ccccaccgcccactc

SEQ ID NO: 3405269 - DNA, 15 bp, Homo sapiens
ccccagcactgagga

SEQ ID NO: 3405270 - DNA, 16 bp, Homo sapiens
ccccagcactgaggaa

SEQ ID NO: 3405271 - DNA, 22 bp, Homo sapiens
ccccaggactggctgccccgtg

SEQ ID NO: 3405272 - DNA, 12 bp, Homo sapiens
ccccagggcagc

SEQ ID NO: 3405273 - DNA, 18 bp, Homo sapiens
ccccatgggctcccactg

SEQ ID NO: 3405274 - DNA, 12 bp, Homo sapiens
cccccaccccct

SEQ ID NO: 3405275 - DNA, 11 bp, Homo sapiens
cccccaggact

SEQ ID NO: 3405276 - DNA, 12 bp, Homo sapiens
ccccccagcact

SEQ ID NO: 3405277 - DNA, 23 bp, Homo sapiens
cccctcgtgtcagctcaggcagc

SEQ ID NO: 3405278 - DNA, 22 bp, Homo sapiens
cccctgcaatgcgtcttgtgaa

SEQ ID NO: 3405279 - DNA, 22 bp, Homo sapiens
cccctgcaggaaggagctgcct

SEQ ID NO: 3405280 - DNA, 23 bp, Homo sapiens
cccctgcaggaaggagctgcctg

SEQ ID NO: 3405281 - DNA, 22 bp, Homo sapiens
cccctgcattggaactggaggc

SEQ ID NO: 3405282 - DNA, 17 bp, Homo sapiens
cccctgcccccaggact

SEQ ID NO: 3405283 - DNA, 16 bp, Homo sapiens
cccctgccccctgcag

SEQ ID NO: 3405284 - DNA, 18 bp, Homo sapiens
cccctgccccctgcagga

SEQ ID NO: 3405285 - DNA, 20 bp, Homo sapiens
cccctggccacagaccccca

SEQ ID NO: 3405286 - DNA, 15 bp, Homo sapiens
cccctgtcccacctg

SEQ ID NO: 3405287 - DNA, 20 bp, Homo sapiens
cccctgtcccacctggctcc

SEQ ID NO: 3405288 - DNA, 15 bp, Homo sapiens
cccgagcctggctcc

SEQ ID NO: 3405289 - DNA, 13 bp, Homo sapiens
cccgtaaggctgt

SEQ ID NO: 3405290 - DNA, 14 bp, Homo sapiens
cccgtaaggctgta

SEQ ID NO: 3405291 - DNA, 13 bp, Homo sapiens
ccctccacacctg

SEQ ID NO: 3405292 - DNA, 21 bp, Homo sapiens
ccctccccaactgaccacctt

SEQ ID NO: 3405293 - DNA, 14 bp, Homo sapiens
ccctccctttctcc

SEQ ID NO: 3405294 - DNA, 16 bp, Homo sapiens
ccctccctttctcccc

SEQ ID NO: 3405295 - DNA, 12 bp, Homo sapiens
ccctcctccact

SEQ ID NO: 3405296 - DNA, 13 bp, Homo sapiens
ccctcctccactc

SEQ ID NO: 3405297 - DNA, 14 bp, Homo sapiens
ccctctgccccacc

SEQ ID NO: 3405298 - DNA, 15 bp, Homo sapiens
ccctctgccccaccc

SEQ ID NO: 3405299 - DNA, 19 bp, Homo sapiens
ccctgcaatgcgtcttgtg

SEQ ID NO: 3405300 - DNA, 20 bp, Homo sapiens
ccctgcaatgcgtcttgtga

SEQ ID NO: 3405301 - DNA, 22 bp, Homo sapiens
ccctgcaatgcgtcttgtgaaa

SEQ ID NO: 3405302 - DNA, 21 bp, Homo sapiens
ccctgcaggaaggagctgcct

SEQ ID NO: 3405303 - DNA, 17 bp, Homo sapiens
ccctgccacctcctgcc

SEQ ID NO: 3405304 - DNA, 20 bp, Homo sapiens
ccctgccacctcctgcctca

SEQ ID NO: 3405305 - DNA, 20 bp, Homo sapiens
ccctgccatcatgtttacag

SEQ ID NO: 3405306 - DNA, 18 bp, Homo sapiens
ccctgcccccaggactgg

SEQ ID NO: 3405307 - DNA, 20 bp, Homo sapiens
ccctgcccccaggactgggc

SEQ ID NO: 3405308 - DNA, 16 bp, Homo sapiens
ccctgccccctgcagg

SEQ ID NO: 3405309 - DNA, 16 bp, Homo sapiens
ccctgcctcaggcctc

SEQ ID NO: 3405310 - DNA, 17 bp, Homo sapiens
ccctgctgctgcctgcc

SEQ ID NO: 3405311 - DNA, 12 bp, Homo sapiens
ccctggagccct

SEQ ID NO: 3405312 - DNA, 14 bp, Homo sapiens
ccctggagccctgt

SEQ ID NO: 3405313 - DNA, 22 bp, Homo sapiens
ccctggtggccctctcccctgc

SEQ ID NO: 3405314 - DNA, 17 bp, Homo sapiens
ccctggttctcatcttt

SEQ ID NO: 3405315 - DNA, 13 bp, Homo sapiens
ccctgttggcagc

SEQ ID NO: 3405316 - DNA, 19 bp, Homo sapiens
ccctgttggcagctctagc

SEQ ID NO: 3405317 - DNA, 15 bp, Homo sapiens
cccttctctcatctc

SEQ ID NO: 3405318 - DNA, 17 bp, Homo sapiens
cccttgcccccctggcc

SEQ ID NO: 3405319 - DNA, 22 bp, Homo sapiens
tcattcacaaagtataacaatt

SEQ ID NO: 3405320 - DNA, 14 bp, Homo sapiens
tcattccagaggaa

SEQ ID NO: 3405321 - DNA, 17 bp, Homo sapiens
tcattcctaatgcatta

SEQ ID NO: 3405322 - DNA, 14 bp, Homo sapiens
tcattctgcattaa

SEQ ID NO: 3405323 - DNA, 18 bp, Homo sapiens
tcattggataaatttgaa

SEQ ID NO: 3405324 - DNA, 23 bp, Homo sapiens
tcattggttaaaatattactgat

SEQ ID NO: 3405325 - DNA, 14 bp, Homo sapiens
tcatttcacccctc

SEQ ID NO: 3405326 - DNA, 18 bp, Homo sapiens
tcatttctcatggatttg

SEQ ID NO: 3405327 - DNA, 17 bp, Homo sapiens
tcatttggcttgctgtt

SEQ ID NO: 3405328 - DNA, 19 bp, Homo sapiens
tcatttggcttgctgttta

SEQ ID NO: 3405329 - DNA, 16 bp, Homo sapiens
tcattttgttctgaaa

SEQ ID NO: 3405330 - DNA, 12 bp, Homo sapiens
tccaaaccactt

SEQ ID NO: 3405331 - DNA, 14 bp, Homo sapiens
tccaaaccttcaca

SEQ ID NO: 3405332 - DNA, 22 bp, Homo sapiens
tccaaaccttcacacacagact

SEQ ID NO: 3405333 - DNA, 23 bp, Homo sapiens
tccaaaccttcacacacagactg

SEQ ID NO: 3405334 - DNA, 16 bp, Homo sapiens
tccaaatactctgaaa

SEQ ID NO: 3405335 - DNA, 18 bp, Homo sapiens
tccaaatgcattcatgtt

SEQ ID NO: 3405336 - DNA, 17 bp, Homo sapiens
tccaaatgctgtgcaaa

SEQ ID NO: 3405337 - DNA, 14 bp, Homo sapiens
tccaaccccccagc

SEQ ID NO: 3405338 - DNA, 23 bp, Homo sapiens
tccaaccccccagcactgaggaa

SEQ ID NO: 3405339 - DNA, 19 bp, Homo sapiens
tccaaggaacctaattgaa

SEQ ID NO: 3405340 - DNA, 13 bp, Homo sapiens
tccacacctgcgg

SEQ ID NO: 3405341 - DNA, 20 bp, Homo sapiens
tccaccaagtgtctagagtc

SEQ ID NO: 3405342 - DNA, 14 bp, Homo sapiens
tccacgtgtatgca

SEQ ID NO: 3405343 - DNA, 12 bp, Homo sapiens
tccactctcccc

SEQ ID NO: 3405344 - DNA, 21 bp, Homo sapiens
tccagaaagaaaatgaatttg

SEQ ID NO: 3405345 - DNA, 14 bp, Homo sapiens
tccagcctcagctc

SEQ ID NO: 3405346 - DNA, 22 bp, Homo sapiens
tccaggagattggatttgctgt

SEQ ID NO: 3405347 - DNA, 11 bp, Homo sapiens
tccaggctggt

SEQ ID NO: 3405348 - DNA, 13 bp, Homo sapiens
tccaggctggttc

SEQ ID NO: 3405349 - DNA, 19 bp, Homo sapiens
tccagggctggactgaggc

SEQ ID NO: 3405350 - DNA, 23 bp, Homo sapiens
tccagtagggaaaatagggtcct

SEQ ID NO: 3405351 - DNA, 15 bp, Homo sapiens
tccagtatcctgctg

SEQ ID NO: 3405352 - DNA, 12 bp, Homo sapiens
tccatgaaaatg

SEQ ID NO: 3405353 - DNA, 9 bp, Homo sapiens
tccatgctt

SEQ ID NO: 3405354 - DNA, 14 bp, Homo sapiens
tccatgcttcactc

SEQ ID NO: 3405355 - DNA, 16 bp, Homo sapiens
tccattaaattgcctt

SEQ ID NO: 3405356 - DNA, 20 bp, Homo sapiens
tccattaaattgcctttgta

SEQ ID NO: 3405357 - DNA, 16 bp, Homo sapiens
tccatttacttgatca

SEQ ID NO: 3405358 - DNA, 21 bp, Homo sapiens
tccatttcatctatttctgag

SEQ ID NO: 3405359 - DNA, 14 bp, Homo sapiens
tccatttgaaagaa

SEQ ID NO: 3405360 - DNA, 14 bp, Homo sapiens
tccattttcttgtc

SEQ ID NO: 3405361 - DNA, 13 bp, Homo sapiens
tcccacctggctc

SEQ ID NO: 3405362 - DNA, 14 bp, Homo sapiens
tcccacctggctcc

SEQ ID NO: 3405363 - DNA, 17 bp, Homo sapiens
tcccacctggctccccc

SEQ ID NO: 3405364 - DNA, 23 bp, Homo sapiens
tcccagaggggcctgccacctgg

SEQ ID NO: 3405365 - DNA, 23 bp, Homo sapiens
tcccagattggctcacactgaga

SEQ ID NO: 3405366 - DNA, 19 bp, Homo sapiens
tcccagcacctattgaatt

SEQ ID NO: 3405367 - DNA, 13 bp, Homo sapiens
tcccaggctgccg

SEQ ID NO: 3405368 - DNA, 18 bp, Homo sapiens
tcccaggctgccggctcc

SEQ ID NO: 3405369 - DNA, 18 bp, Homo sapiens
tcccaggtaatttaaatt

SEQ ID NO: 3405370 - DNA, 15 bp, Homo sapiens
tcccattctatgtgt

SEQ ID NO: 3405371 - DNA, 17 bp, Homo sapiens
tccccaatccatgcttc

SEQ ID NO: 3405372 - DNA, 17 bp, Homo sapiens
tccccaatccctgaccc

SEQ ID NO: 3405373 - DNA, 17 bp, Homo sapiens
tccccagagaaagcgca

SEQ ID NO: 3405374 - DNA, 23 bp, Homo sapiens
tccccagagaaagcgcagatgct

SEQ ID NO: 3405375 - DNA, 17 bp, Homo sapiens
tcccccaccgcccactc

SEQ ID NO: 3405376 - DNA, 21 bp, Homo sapiens
tcccccaccgcccactctcca

SEQ ID NO: 3405377 - DNA, 17 bp, Homo sapiens
tccccgcagtcgtccca

SEQ ID NO: 3405378 - DNA, 13 bp, Homo sapiens
tccccgccctttt

SEQ ID NO: 3405379 - DNA, 14 bp, Homo sapiens
tcccctccccaact

SEQ ID NO: 3405380 - DNA, 16 bp, Homo sapiens
tcccctcctccactct

SEQ ID NO: 3405381 - DNA, 14 bp, Homo sapiens
tcccctctgcccca

SEQ ID NO: 3405382 - DNA, 17 bp, Homo sapiens
tcccctctgccccaccc

SEQ ID NO: 3405383 - DNA, 12 bp, Homo sapiens
tcccctgcaatg

SEQ ID NO: 3405384 - DNA, 22 bp, Homo sapiens
tcccctgcaatgcgtcttgtga

SEQ ID NO: 3405385 - DNA, 12 bp, Homo sapiens
tcccctgccccc

SEQ ID NO: 3405386 - DNA, 16 bp, Homo sapiens
tcccctgcccccagga

SEQ ID NO: 3405387 - DNA, 21 bp, Homo sapiens
tgaagagggagaagcatgaaa

SEQ ID NO: 3405388 - DNA, 23 bp, Homo sapiens
tgaaggaacagttaccctgcttt

SEQ ID NO: 3405389 - DNA, 16 bp, Homo sapiens
tgaaggtttctgaaaa

SEQ ID NO: 3405390 - DNA, 14 bp, Homo sapiens
tgaagtataaatct

SEQ ID NO: 3405391 - DNA, 13 bp, Homo sapiens
tgaataaagagcc

SEQ ID NO: 3405392 - DNA, 23 bp, Homo sapiens
tgaataaagggaacatgcagctc

SEQ ID NO: 3405393 - DNA, 14 bp, Homo sapiens
tgaatataaacact

SEQ ID NO: 3405394 - DNA, 16 bp, Homo sapiens
tgaatatatggcattt

SEQ ID NO: 3405395 - DNA, 19 bp, Homo sapiens
tgaatattaagaaacaatt

SEQ ID NO: 3405396 - DNA, 17 bp, Homo sapiens
tgaatccatgcttgggt

SEQ ID NO: 3405397 - DNA, 17 bp, Homo sapiens
tgaatgagacttaattt

SEQ ID NO: 3405398 - DNA, 17 bp, Homo sapiens
tgaatgaggaacaatca

SEQ ID NO: 3405399 - DNA, 16 bp, Homo sapiens
tgaatgagttttacaa

SEQ ID NO: 3405400 - DNA, 17 bp, Homo sapiens
tgaatggattggattat

SEQ ID NO: 3405401 - DNA, 22 bp, Homo sapiens
tgaatggattggattatttaat

SEQ ID NO: 3405402 - DNA, 14 bp, Homo sapiens
tgaatgtcattatt

SEQ ID NO: 3405403 - DNA, 18 bp, Homo sapiens
tgaatgtcattatttgat

SEQ ID NO: 3405404 - DNA, 20 bp, Homo sapiens
tgaattaagggccagaaaaa

SEQ ID NO: 3405405 - DNA, 23 bp, Homo sapiens
tgaattaccatagagtaatgatg

SEQ ID NO: 3405406 - DNA, 13 bp, Homo sapiens
tgaattgagaata

SEQ ID NO: 3405407 - DNA, 13 bp, Homo sapiens
tgaatttaagcat

SEQ ID NO: 3405408 - DNA, 19 bp, Homo sapiens
tgaatttaagcatgagtgg

SEQ ID NO: 3405409 - DNA, 18 bp, Homo sapiens
tgaatttgagtttgctgt

SEQ ID NO: 3405410 - DNA, 21 bp, Homo sapiens
tgaatttgagtttgctgtttt

SEQ ID NO: 3405411 - DNA, 21 bp, Homo sapiens
tgacaaaagtgacagatgtta

SEQ ID NO: 3405412 - DNA, 22 bp, Homo sapiens
tgacagagccttctgaggacat

SEQ ID NO: 3405413 - DNA, 23 bp, Homo sapiens
tgacagagccttctgaggacatt

SEQ ID NO: 3405414 - DNA, 17 bp, Homo sapiens
tgacatgcctatatgag

SEQ ID NO: 3405415 - DNA, 13 bp, Homo sapiens
tgacatgtgaaac

SEQ ID NO: 3405416 - DNA, 13 bp, Homo sapiens
tgacattcactgg

SEQ ID NO: 3405417 - DNA, 21 bp, Homo sapiens
tgaccctttgaggcccccagt

SEQ ID NO: 3405418 - DNA, 18 bp, Homo sapiens
tgaccttgatgagctgtg

SEQ ID NO: 3405419 - DNA, 20 bp, Homo sapiens
tgacgtaagctctatctgca

SEQ ID NO: 3405420 - DNA, 18 bp, Homo sapiens
tgactccagtataatctc

SEQ ID NO: 3405421 - DNA, 21 bp, Homo sapiens
tgactgagtctggcaaacatg

SEQ ID NO: 3405422 - DNA, 17 bp, Homo sapiens
tgacttgacagaacact

SEQ ID NO: 3405423 - DNA, 17 bp, Homo sapiens
tgacttttgaagaacaa

SEQ ID NO: 3405424 - DNA, 12 bp, Homo sapiens
tgagaaaggaaa

SEQ ID NO: 3405425 - DNA, 20 bp, Homo sapiens
tgagaaatcagaattggcat

SEQ ID NO: 3405426 - DNA, 21 bp, Homo sapiens
tgagaacatggtgtgtgtctc

SEQ ID NO: 3405427 - DNA, 16 bp, Homo sapiens
tgagaaggtccttaat

SEQ ID NO: 3405428 - DNA, 22 bp, Homo sapiens
tgagaagtgcttaacgttttct

SEQ ID NO: 3405429 - DNA, 15 bp, Homo sapiens
tgagaattccctgtg

SEQ ID NO: 3405430 - DNA, 21 bp, Homo sapiens
tgagacagtttcttagctttt

SEQ ID NO: 3405431 - DNA, 23 bp, Homo sapiens
tgagacagtttcttagcttttta

SEQ ID NO: 3405432 - DNA, 16 bp, Homo sapiens
tgagactcgagaactt

SEQ ID NO: 3405433 - DNA, 19 bp, Homo sapiens
tgagagcccagaggtaaca

SEQ ID NO: 3405434 - DNA, 15 bp, Homo sapiens
aaaattcagcggcag

SEQ ID NO: 3405435 - DNA, 23 bp, Homo sapiens
aaacaaaatttcacagttctgta

SEQ ID NO: 3405436 - DNA, 14 bp, Homo sapiens
aaacaaaatttcta

SEQ ID NO: 3405437 - DNA, 22 bp, Homo sapiens
aaacaattggttgtatataaag

SEQ ID NO: 3405438 - DNA, 15 bp, Homo sapiens
aaacaatttaaattg

SEQ ID NO: 3405439 - DNA, 14 bp, Homo sapiens
aaacagatgtccct

SEQ ID NO: 3405440 - DNA, 15 bp, Homo sapiens
aaacagatgtccctg

SEQ ID NO: 3405441 - DNA, 17 bp, Homo sapiens
aaacaggcactgccctg

SEQ ID NO: 3405442 - DNA, 16 bp, Homo sapiens
aaacatgaaaacattg

SEQ ID NO: 3405443 - DNA, 15 bp, Homo sapiens
aaacattgatgaatg

SEQ ID NO: 3405444 - DNA, 20 bp, Homo sapiens
aaaccattatgaagaagaga

SEQ ID NO: 3405445 - DNA, 24 bp, Homo sapiens
aaaccctcgaggcggatctttgga

SEQ ID NO: 3405446 - DNA, 14 bp, Homo sapiens
aaacctgcattttt

SEQ ID NO: 3405447 - DNA, 13 bp, Homo sapiens
aatttaaattgtt

SEQ ID NO: 3405448 - DNA, 20 bp, Homo sapiens
aatttaagcatgagtggcct

SEQ ID NO: 3405449 - DNA, 13 bp, Homo sapiens
aatttaatgtttc

SEQ ID NO: 3405450 - DNA, 21 bp, Homo sapiens
aatttactgtcttaaatcagt

SEQ ID NO: 3405451 - DNA, 23 bp, Homo sapiens
aatttactttttaaacagtgttt

SEQ ID NO: 3405452 - DNA, 19 bp, Homo sapiens
aatttagccaataaagaaa

SEQ ID NO: 3405453 - DNA, 15 bp, Homo sapiens
aatttaggtaaataa

SEQ ID NO: 3405454 - DNA, 13 bp, Homo sapiens
aatttagtcatta

SEQ ID NO: 3405455 - DNA, 14 bp, Homo sapiens
aatttatgtgatgg

SEQ ID NO: 3405456 - DNA, 17 bp, Homo sapiens
aatttgagtttgctgtt

SEQ ID NO: 3405457 - DNA, 14 bp, Homo sapiens
aatttgtaagtttc

SEQ ID NO: 3405458 - DNA, 23 bp, Homo sapiens
aattttatctacccagtcatgta

SEQ ID NO: 3405459 - DNA, 17 bp, Homo sapiens
aattttgtatttaatga

SEQ ID NO: 3405460 - DNA, 17 bp, Homo sapiens
aattttttaaaagagac

SEQ ID NO: 3405461 - DNA, 15 bp, Homo sapiens
aatttttttcagtat

SEQ ID NO: 3405462 - DNA, 23 bp, Homo sapiens
acaaaaaaatacctcaggaaaga

SEQ ID NO: 3405463 - DNA, 20 bp, Homo sapiens
acaaaagaagaaataaataa

SEQ ID NO: 3405464 - DNA, 15 bp, Homo sapiens
acaaaagctgtgtct

SEQ ID NO: 3405465 - DNA, 22 bp, Homo sapiens
acaaaaggctttggcaacagaa

SEQ ID NO: 3405466 - DNA, 19 bp, Homo sapiens
acaaaagtgacagatgtta

SEQ ID NO: 3405467 - DNA, 22 bp, Homo sapiens
acaaaatttcacagttctgtaa

SEQ ID NO: 3405468 - DNA, 14 bp, Homo sapiens
acaaaatttctatt

SEQ ID NO: 3405469 - DNA, 16 bp, Homo sapiens
acaaacaaaatttcta

SEQ ID NO: 3405470 - DNA, 18 bp, Homo sapiens
acaaacaaaatttctatt

SEQ ID NO: 3405471 - DNA, 19 bp, Homo sapiens
acaaacaaaatttctatta

SEQ ID NO: 3405472 - DNA, 20 bp, Homo sapiens
acaaagtgtgtctcaaaaat

SEQ ID NO: 3405473 - DNA, 14 bp, Homo sapiens
acaaagttcagtgt

SEQ ID NO: 3405474 - DNA, 18 bp, Homo sapiens
acaaatgtgtcccagtga

SEQ ID NO: 3405475 - DNA, 16 bp, Homo sapiens
acaaattcctttcaga

SEQ ID NO: 3405476 - DNA, 18 bp, Homo sapiens
acaaattcctttcagagt

SEQ ID NO: 3405477 - DNA, 22 bp, Homo sapiens
acaaattcctttcagagtttta

SEQ ID NO: 3405478 - DNA, 20 bp, Homo sapiens
acaaatttagccaataaaga

SEQ ID NO: 3405479 - DNA, 14 bp, Homo sapiens
acaacaaacactgt

SEQ ID NO: 3405480 - DNA, 16 bp, Homo sapiens
acaacctttcccattt

SEQ ID NO: 3405481 - DNA, 22 bp, Homo sapiens
acaactagcctcatctccagta

SEQ ID NO: 3405482 - DNA, 15 bp, Homo sapiens
acaactcccccaccg

SEQ ID NO: 3405483 - DNA, 18 bp, Homo sapiens
acaagacaagctcctccc

SEQ ID NO: 3405484 - DNA, 17 bp, Homo sapiens
acaagcttaaagcttga

SEQ ID NO: 3405485 - DNA, 19 bp, Homo sapiens
acaagcttaaagcttgatt

SEQ ID NO: 3405486 - DNA, 18 bp, Homo sapiens
acaagttaaggtatctgg

SEQ ID NO: 3405487 - DNA, 23 bp, Homo sapiens
acaatatatagctggcaagaatg

SEQ ID NO: 3405488 - DNA, 22 bp, Homo sapiens
acaatccaaatgcattcatgtt

SEQ ID NO: 3405489 - DNA, 21 bp, Homo sapiens
acaatgcgtggcacatctaaa

SEQ ID NO: 3405490 - DNA, 14 bp, Homo sapiens
acaatgttaaggaa

SEQ ID NO: 3405491 - DNA, 17 bp, Homo sapiens
acaattggttgtatata

SEQ ID NO: 3405492 - DNA, 19 bp, Homo sapiens
acaattggttgtatataaa

SEQ ID NO: 3405493 - DNA, 14 bp, Homo sapiens
acaatttaaagcaa

SEQ ID NO: 3405494 - DNA, 14 bp, Homo sapiens
acaatttaaattgt

SEQ ID NO: 3405495 - DNA, 13 bp, Homo sapiens
acacaaaagaaga

SEQ ID NO: 3405496 - DNA, 17 bp, Homo sapiens
acacaaaagaagaaata

SEQ ID NO: 3405497 - DNA, 20 bp, Homo sapiens
acacaatgacacatttgttg

SEQ ID NO: 3405498 - DNA, 22 bp, Homo sapiens
acacaatgttgcactgaaaacc

SEQ ID NO: 3405499 - DNA, 23 bp, Homo sapiens
acacacactcgggttaagaaata

SEQ ID NO: 3405500 - DNA, 21 bp, Homo sapiens
acacagactgttgtccctgca

SEQ ID NO: 3405501 - DNA, 14 bp, Homo sapiens
acacagcatgtgta

SEQ ID NO: 3405502 - DNA, 15 bp, Homo sapiens
acacagcatgtgtat

SEQ ID NO: 3405503 - DNA, 14 bp, Homo sapiens
acacagttaaataa

SEQ ID NO: 3405504 - DNA, 23 bp, Homo sapiens
acacagttaaataaatagaaaga

SEQ ID NO: 3405505 - DNA, 17 bp, Homo sapiens
acaccttttaactcacc

SEQ ID NO: 3405506 - DNA, 15 bp, Homo sapiens
acactcgggttaaga

SEQ ID NO: 3405507 - DNA, 17 bp, Homo sapiens
acactcgggttaagaaa

SEQ ID NO: 3405508 - DNA, 19 bp, Homo sapiens
acactcgggttaagaaata

SEQ ID NO: 3405509 - DNA, 20 bp, Homo sapiens
acactcgggttaagaaatac

SEQ ID NO: 3405510 - DNA, 19 bp, Homo sapiens
acactgagaatgtaagaac

SEQ ID NO: 3405511 - DNA, 22 bp, Homo sapiens
acactgagaatgtaagaactac

SEQ ID NO: 3405512 - DNA, 19 bp, Homo sapiens
acactgcttgtgtttttaa

SEQ ID NO: 3405513 - DNA, 18 bp, Homo sapiens
acactgtaaaatagtttt

SEQ ID NO: 3405514 - DNA, 15 bp, Homo sapiens
acactgtttttcata

SEQ ID NO: 3405515 - DNA, 21 bp, Homo sapiens
acacttgcaggggtccctgct

SEQ ID NO: 3405516 - DNA, 14 bp, Homo sapiens
acacttgtttcttg

SEQ ID NO: 3405517 - DNA, 17 bp, Homo sapiens
acagaaaacaattgttc

SEQ ID NO: 3405518 - DNA, 15 bp, Homo sapiens
acagaaatatataaa

SEQ ID NO: 3405519 - DNA, 19 bp, Homo sapiens
acagaaatatataaaaata

SEQ ID NO: 3405520 - DNA, 17 bp, Homo sapiens
acagaacagcttcaggt

SEQ ID NO: 3405521 - DNA, 22 bp, Homo sapiens
acagaactatctcagcatcaga

SEQ ID NO: 3405522 - DNA, 12 bp, Homo sapiens
acagaagcagct

SEQ ID NO: 3405523 - DNA, 14 bp, Homo sapiens
acagaagcagctct

SEQ ID NO: 3405524 - DNA, 21 bp, Homo sapiens
acagaagccaagctccctgga

SEQ ID NO: 3405525 - DNA, 22 bp, Homo sapiens
acagaagccaagctccctggag

SEQ ID NO: 3405526 - DNA, 13 bp, Homo sapiens
acagacactgtaa

SEQ ID NO: 3405527 - DNA, 15 bp, Homo sapiens
acagacactgtaaaa

SEQ ID NO: 3405528 - DNA, 15 bp, Homo sapiens
acagacccccagggc

SEQ ID NO: 3405529 - DNA, 10 bp, Homo sapiens
acagagctgg

SEQ ID NO: 3405530 - DNA, 21 bp, Homo sapiens
acagagctgggatgtttctgt

SEQ ID NO: 3405531 - DNA, 15 bp, Homo sapiens
acagataagcaagag

SEQ ID NO: 3405532 - DNA, 23 bp, Homo sapiens
acagatgtagatataaatataaa

SEQ ID NO: 3405533 - DNA, 16 bp, Homo sapiens
acagatgttatttttg

SEQ ID NO: 3405534 - DNA, 20 bp, Homo sapiens
acctgtgagaaaggaaaaat

SEQ ID NO: 3405535 - DNA, 16 bp, Homo sapiens
acctgttggctacaca

SEQ ID NO: 3405536 - DNA, 13 bp, Homo sapiens
acctttatgaggt

SEQ ID NO: 3405537 - DNA, 16 bp, Homo sapiens
acctttcccatttcgt

SEQ ID NO: 3405538 - DNA, 22 bp, Homo sapiens
accttttttaagatttttctca

SEQ ID NO: 3405539 - DNA, 14 bp, Homo sapiens
acggccctggcctt

SEQ ID NO: 3405540 - DNA, 18 bp, Homo sapiens
acggggctcttctcattt

SEQ ID NO: 3405541 - DNA, 21 bp, Homo sapiens
acggtgggggtagggggctgg

SEQ ID NO: 3405542 - DNA, 16 bp, Homo sapiens
acgtataatgctttct

SEQ ID NO: 3405543 - DNA, 14 bp, Homo sapiens
acgtttttccttta

SEQ ID NO: 3405544 - DNA, 18 bp, Homo sapiens
actaaagtgcattatttt

SEQ ID NO: 3405545 - DNA, 13 bp, Homo sapiens
actaacagataag

SEQ ID NO: 3405546 - DNA, 17 bp, Homo sapiens
actaacagataagcaag

SEQ ID NO: 3405547 - DNA, 21 bp, Homo sapiens
actaagaggggctggacctgg

SEQ ID NO: 3405548 - DNA, 12 bp, Homo sapiens
actaaggagaat

SEQ ID NO: 3405549 - DNA, 18 bp, Homo sapiens
actaaggcatttgattaa

SEQ ID NO: 3405550 - DNA, 13 bp, Homo sapiens
actaatgatgttt

SEQ ID NO: 3405551 - DNA, 17 bp, Homo sapiens
actacaatttaaagcaa

SEQ ID NO: 3405552 - DNA, 18 bp, Homo sapiens
actaccagtgggcatgta

SEQ ID NO: 3405553 - DNA, 17 bp, Homo sapiens
actagaccatataactg

SEQ ID NO: 3405554 - DNA, 20 bp, Homo sapiens
actagctccccaatccctga

SEQ ID NO: 3405555 - DNA, 19 bp, Homo sapiens
actaggaatttttttcagt

SEQ ID NO: 3405556 - DNA, 12 bp, Homo sapiens
actatctgcttt

SEQ ID NO: 3405557 - DNA, 13 bp, Homo sapiens
actatctgctttt

SEQ ID NO: 3405558 - DNA, 19 bp, Homo sapiens
actatggaatgtcagtgtt

SEQ ID NO: 3405559 - DNA, 19 bp, Homo sapiens
actcaagcaggtttcttgc

SEQ ID NO: 3405560 - DNA, 12 bp, Homo sapiens
actcaatatttt

SEQ ID NO: 3405561 - DNA, 16 bp, Homo sapiens
actcacatggctatgt

SEQ ID NO: 3405562 - DNA, 20 bp, Homo sapiens
actcacatggctatgtttta

SEQ ID NO: 3405563 - DNA, 16 bp, Homo sapiens
actcacctaatgttta

SEQ ID NO: 3405564 - DNA, 16 bp, Homo sapiens
aaattgcctttgtaat

SEQ ID NO: 3405565 - DNA, 12 bp, Homo sapiens
aaattgtgatgt

SEQ ID NO: 3405566 - DNA, 21 bp, Homo sapiens
aaatttaaaaataaagctact

SEQ ID NO: 3405567 - DNA, 16 bp, Homo sapiens
aaatttaagtgcgtgt

SEQ ID NO: 3405568 - DNA, 19 bp, Homo sapiens
aaatttcacagttctgtaa

SEQ ID NO: 3405569 - DNA, 18 bp, Homo sapiens
aaattttttaaaagagac

SEQ ID NO: 3405570 - DNA, 14 bp, Homo sapiens
aacaaaaactatta

SEQ ID NO: 3405571 - DNA, 22 bp, Homo sapiens
aacaaaccttaaacacccagaa

SEQ ID NO: 3405572 - DNA, 13 bp, Homo sapiens
aacaacatgtata

SEQ ID NO: 3405573 - DNA, 15 bp, Homo sapiens
aacaaccacaggaat

SEQ ID NO: 3405574 - DNA, 19 bp, Homo sapiens
aacaagttagtttctcata

SEQ ID NO: 3405575 - DNA, 20 bp, Homo sapiens
aacaatcacaaaagctgtgt

SEQ ID NO: 3405576 - DNA, 14 bp, Homo sapiens
aacaatccaaatgc

SEQ ID NO: 3405577 - DNA, 23 bp, Homo sapiens
aacaatccaaatgcattcatgtt

SEQ ID NO: 3405578 - DNA, 18 bp, Homo sapiens
aacaattggttgtatata

SEQ ID NO: 3405579 - DNA, 14 bp, Homo sapiens
aacacccaaaagaa

SEQ ID NO: 3405580 - DNA, 14 bp, Homo sapiens
aacactatatggca

SEQ ID NO: 3405581 - DNA, 18 bp, Homo sapiens
aacactatatggcagtgt

SEQ ID NO: 3405582 - DNA, 21 bp, Homo sapiens
aacactatatggcagtgtctt

SEQ ID NO: 3405583 - DNA, 14 bp, Homo sapiens
aacactgcttgtgt

SEQ ID NO: 3405584 - DNA, 13 bp, Homo sapiens
aacagaacagctt

SEQ ID NO: 3405585 - DNA, 16 bp, Homo sapiens
aacagaacagcttcag

SEQ ID NO: 3405586 - DNA, 14 bp, Homo sapiens
aacagagaaataga

SEQ ID NO: 3405587 - DNA, 22 bp, Homo sapiens
aacagatgtccctgaagtcttg

SEQ ID NO: 3405588 - DNA, 22 bp, Homo sapiens
aacagcgtgtcaactttcattt

SEQ ID NO: 3405589 - DNA, 20 bp, Homo sapiens
aacagctttcttattcagtg

SEQ ID NO: 3405590 - DNA, 17 bp, Homo sapiens
aacaggcactgccctgg

SEQ ID NO: 3405591 - DNA, 13 bp, Homo sapiens
aacaggtattttc

SEQ ID NO: 3405592 - DNA, 14 bp, Homo sapiens
aacagtgaaagtca

SEQ ID NO: 3405593 - DNA, 17 bp, Homo sapiens
aacagtgtttatgacga

SEQ ID NO: 3405594 - DNA, 15 bp, Homo sapiens
aacatcccaagattt

SEQ ID NO: 3405595 - DNA, 19 bp, Homo sapiens
aacatctgtgtctgtgtct

SEQ ID NO: 3405596 - DNA, 15 bp, Homo sapiens
aacatcttttcttgc

SEQ ID NO: 3405597 - DNA, 13 bp, Homo sapiens
aacatgcagctct

SEQ ID NO: 3405598 - DNA, 18 bp, Homo sapiens
aacatggattccaaagca

SEQ ID NO: 3405599 - DNA, 12 bp, Homo sapiens
aacatgtatgtg

SEQ ID NO: 3405600 - DNA, 14 bp, Homo sapiens
aacatgtatgtgga

SEQ ID NO: 3405601 - DNA, 22 bp, Homo sapiens
aacatgtgcaactcttgtattg

SEQ ID NO: 3405602 - DNA, 19 bp, Homo sapiens
aacattaccttactgtgga

SEQ ID NO: 3405603 - DNA, 15 bp, Homo sapiens
aacattgatgaatga

SEQ ID NO: 3405604 - DNA, 13 bp, Homo sapiens
aacatttactaca

SEQ ID NO: 3405605 - DNA, 17 bp, Homo sapiens
aacatttactacagttt

SEQ ID NO: 3405606 - DNA, 19 bp, Homo sapiens
aacatttactacagttttt

SEQ ID NO: 3405607 - DNA, 15 bp, Homo sapiens
aacatttaggagaag

SEQ ID NO: 3405608 - DNA, 18 bp, Homo sapiens
aacatttaggagaagttg

SEQ ID NO: 3405609 - DNA, 15 bp, Homo sapiens
aaccaacccatgtat

SEQ ID NO: 3405610 - DNA, 22 bp, Homo sapiens
aaccacaaaaaaatacctcagg

SEQ ID NO: 3405611 - DNA, 14 bp, Homo sapiens
aaccactttttgca

SEQ ID NO: 3405612 - DNA, 18 bp, Homo sapiens
aaccccccagcactgagg

SEQ ID NO: 3405613 - DNA, 11 bp, Homo sapiens
aacctgcattt

SEQ ID NO: 3405614 - DNA, 19 bp, Homo sapiens
aaccttcacacacagactg

SEQ ID NO: 3405615 - DNA, 22 bp, Homo sapiens
aaccttgtcaataaaaataaat

SEQ ID NO: 3405616 - DNA, 17 bp, Homo sapiens
aaccttttttaagattt

SEQ ID NO: 3405617 - DNA, 18 bp, Homo sapiens
aaccttttttaagatttt

SEQ ID NO: 3405618 - DNA, 16 bp, Homo sapiens
aacggggctcttctca

SEQ ID NO: 3405619 - DNA, 19 bp, Homo sapiens
aacgttttcttaaatgttt

SEQ ID NO: 3405620 - DNA, 23 bp, Homo sapiens
aacgtttttcctttaaaaaaatt

SEQ ID NO: 3405621 - DNA, 21 bp, Homo sapiens
aactaaatgagacctaataat

SEQ ID NO: 3405622 - DNA, 22 bp, Homo sapiens
aactaaatgctcatacacagtt

SEQ ID NO: 3405623 - DNA, 20 bp, Homo sapiens
aactaactgactctgttatt

SEQ ID NO: 3405624 - DNA, 15 bp, Homo sapiens
aactacatctgcctc

SEQ ID NO: 3405625 - DNA, 16 bp, Homo sapiens
aactaccagtgggcat

SEQ ID NO: 3405626 - DNA, 21 bp, Homo sapiens
aactatgtaatgcttatgtgt

SEQ ID NO: 3405627 - DNA, 23 bp, Homo sapiens
aactatttttttagttaatattt

SEQ ID NO: 3405628 - DNA, 19 bp, Homo sapiens
aactcatgactgagtctgg

SEQ ID NO: 3405629 - DNA, 13 bp, Homo sapiens
aactcccccaccg

SEQ ID NO: 3405630 - DNA, 17 bp, Homo sapiens
aactcctactgcttcct

SEQ ID NO: 3405631 - DNA, 15 bp, Homo sapiens
aactcttatctcagt

SEQ ID NO: 3405632 - DNA, 16 bp, Homo sapiens
aactgactctgttatt

SEQ ID NO: 3405633 - DNA, 22 bp, Homo sapiens
aactgcttttgcccatataaaa

SEQ ID NO: 3405634 - DNA, 22 bp, Homo sapiens
aactgtaccatgtgctacaggg

SEQ ID NO: 3405635 - DNA, 12 bp, Homo sapiens
aactgtatttca

SEQ ID NO: 3405636 - DNA, 14 bp, Homo sapiens
aactgtatttcagt

SEQ ID NO: 3405637 - DNA, 23 bp, Homo sapiens
aactgtgatgaaatatgaaactc

SEQ ID NO: 3405638 - DNA, 16 bp, Homo sapiens
aacttgtctttttgtt

SEQ ID NO: 3405639 - DNA, 20 bp, Homo sapiens
aacttttctcctgcatgtgt

SEQ ID NO: 3405640 - DNA, 12 bp, Homo sapiens
aagaaaatgaat

SEQ ID NO: 3405641 - DNA, 19 bp, Homo sapiens
aagaaagccaccttgttac

SEQ ID NO: 3405642 - DNA, 19 bp, Homo sapiens
aagaaagtctatctaatga

SEQ ID NO: 3405643 - DNA, 22 bp, Homo sapiens
aagaaagtctatctaatgacat

SEQ ID NO: 3405644 - DNA, 23 bp, Homo sapiens
aagaaagtctatctaatgacatg

SEQ ID NO: 3405645 - DNA, 15 bp, Homo sapiens
aagaaatcaattttt

SEQ ID NO: 3405646 - DNA, 23 bp, Homo sapiens
aagaacggggctcttctcatttc

SEQ ID NO: 3405647 - DNA, 23 bp, Homo sapiens
aagaagaaataaataatctacat

SEQ ID NO: 3405648 - DNA, 23 bp, Homo sapiens
aagaagctgttgtacatttatga

SEQ ID NO: 3405649 - DNA, 17 bp, Homo sapiens
aagaaggaaaaggcagg

SEQ ID NO: 3405650 - DNA, 19 bp, Homo sapiens
aagaagtgtgtcaccctta

SEQ ID NO: 3405651 - DNA, 19 bp, Homo sapiens
aagaagtttgggctaacat

SEQ ID NO: 3405652 - DNA, 17 bp, Homo sapiens
aagaagttttttacttt

SEQ ID NO: 3405653 - DNA, 23 bp, Homo sapiens
aagaagttttttactttggttta

SEQ ID NO: 3405654 - DNA, 20 bp, Homo sapiens
aagaatagcctagatatgaa

SEQ ID NO: 3405655 - DNA, 19 bp, Homo sapiens
aagaatggtggcttctttt

SEQ ID NO: 3405656 - DNA, 20 bp, Homo sapiens
aagaatttgaggtctacatt

SEQ ID NO: 3405657 - DNA, 15 bp, Homo sapiens
aagacaccagagcag

SEQ ID NO: 3405658 - DNA, 21 bp, Homo sapiens
aagacaccagagcagatgcag

SEQ ID NO: 3405659 - DNA, 21 bp, Homo sapiens
aataaaccttgtttctttctg

SEQ ID NO: 3405660 - DNA, 18 bp, Homo sapiens
aataaactcttaagagaa

SEQ ID NO: 3405661 - DNA, 15 bp, Homo sapiens
aataaagaaattaac

SEQ ID NO: 3405662 - DNA, 11 bp, Homo sapiens
aataaagctac

SEQ ID NO: 3405663 - DNA, 16 bp, Homo sapiens
aataaagctactgaat

SEQ ID NO: 3405664 - DNA, 23 bp, Homo sapiens
aataaagctactgaatttattgc

SEQ ID NO: 3405665 - DNA, 14 bp, Homo sapiens
aataaagctcaagg

SEQ ID NO: 3405666 - DNA, 14 bp, Homo sapiens
aataaatagaaaga

SEQ ID NO: 3405667 - DNA, 14 bp, Homo sapiens
aataaatatttatg

SEQ ID NO: 3405668 - DNA, 16 bp, Homo sapiens
aataaatgcatagagc

SEQ ID NO: 3405669 - DNA, 18 bp, Homo sapiens
aataaatgcatagagcaa

SEQ ID NO: 3405670 - DNA, 14 bp, Homo sapiens
aataacaatgttaa

SEQ ID NO: 3405671 - DNA, 15 bp, Homo sapiens
aataacaatgttaag

SEQ ID NO: 3405672 - DNA, 24 bp, Homo sapiens
aataacaatgttaaggaaactctt

SEQ ID NO: 3405673 - DNA, 17 bp, Homo sapiens
aataacagctttcttat

SEQ ID NO: 3405674 - DNA, 14 bp, Homo sapiens
aataatctatatta

SEQ ID NO: 3405675 - DNA, 21 bp, Homo sapiens
aatacaccaggtagaacacaa

SEQ ID NO: 3405676 - DNA, 14 bp, Homo sapiens
aatagaaagaaagt

SEQ ID NO: 3405677 - DNA, 22 bp, Homo sapiens
agaatgccataaaattgcagtt

SEQ ID NO: 3405678 - DNA, 16 bp, Homo sapiens
agaatgtaagaactac

SEQ ID NO: 3405679 - DNA, 13 bp, Homo sapiens
agaatgtatttcc

SEQ ID NO: 3405680 - DNA, 14 bp, Homo sapiens
agaatttctggtgg

SEQ ID NO: 3405681 - DNA, 14 bp, Homo sapiens
agacaaatggagga

SEQ ID NO: 3405682 - DNA, 18 bp, Homo sapiens
agacaaatggaggaatat

SEQ ID NO: 3405683 - DNA, 15 bp, Homo sapiens
agacaagctcctccc

SEQ ID NO: 3405684 - DNA, 16 bp, Homo sapiens
agacaagctcctccct

SEQ ID NO: 3405685 - DNA, 13 bp, Homo sapiens
agacaccagagca

SEQ ID NO: 3405686 - DNA, 15 bp, Homo sapiens
agacactgtaaaata

SEQ ID NO: 3405687 - DNA, 15 bp, Homo sapiens
agacagtttcttagc

SEQ ID NO: 3405688 - DNA, 14 bp, Homo sapiens
agacataacgtttt

SEQ ID NO: 3405689 - DNA, 20 bp, Homo sapiens
agacataacgtttttccttt

SEQ ID NO: 3405690 - DNA, 14 bp, Homo sapiens
agacatcagccctt

SEQ ID NO: 3405691 - DNA, 17 bp, Homo sapiens
agacatctgcctgtaat

SEQ ID NO: 3405692 - DNA, 14 bp, Homo sapiens
agaccaaattttga

SEQ ID NO: 3405693 - DNA, 15 bp, Homo sapiens
agacctcagatgtgt

SEQ ID NO: 3405694 - DNA, 18 bp, Homo sapiens
agacctcttcctggaata

SEQ ID NO: 3405695 - DNA, 22 bp, Homo sapiens
agacctcttcctggaataaaca

SEQ ID NO: 3405696 - DNA, 19 bp, Homo sapiens
agacctgcagacgcccaga

SEQ ID NO: 3405697 - DNA, 15 bp, Homo sapiens
agacctgcccctccc

SEQ ID NO: 3405698 - DNA, 13 bp, Homo sapiens
agacctttatcca

SEQ ID NO: 3405699 - DNA, 15 bp, Homo sapiens
agactaagccagcac

SEQ ID NO: 3405700 - DNA, 14 bp, Homo sapiens
agacttaattttgt

SEQ ID NO: 3405701 - DNA, 20 bp, Homo sapiens
agactttgctgttactgctt

SEQ ID NO: 3405702 - DNA, 17 bp, Homo sapiens
agagaatgtagatattg

SEQ ID NO: 3405703 - DNA, 22 bp, Homo sapiens
agagacaaactgtaaaaaatgt

SEQ ID NO: 3405704 - DNA, 15 bp, Homo sapiens
agagagccattttgt

SEQ ID NO: 3405705 - DNA, 19 bp, Homo sapiens
agagagccattttgtgaat

SEQ ID NO: 3405706 - DNA, 13 bp, Homo sapiens
agagatatttaaa

SEQ ID NO: 3405707 - DNA, 21 bp, Homo sapiens
agagatccattgccatcagtg

SEQ ID NO: 3405708 - DNA, 17 bp, Homo sapiens
agagattgtagtattta

SEQ ID NO: 3405709 - DNA, 13 bp, Homo sapiens
agagcccaggagc

SEQ ID NO: 3405710 - DNA, 16 bp, Homo sapiens
agagcccaggagctcc

SEQ ID NO: 3405711 - DNA, 15 bp, Homo sapiens
agagccccaggactg

SEQ ID NO: 3405712 - DNA, 13 bp, Homo sapiens
agagcgtttggtt

SEQ ID NO: 3405713 - DNA, 11 bp, Homo sapiens
agagctgaggc

SEQ ID NO: 3405714 - DNA, 16 bp, Homo sapiens
agaggacccatcctgc

SEQ ID NO: 3405715 - DNA, 23 bp, Homo sapiens
agaggagggcagcagaagggggt

SEQ ID NO: 3405716 - DNA, 14 bp, Homo sapiens
agaggatgagagcc

SEQ ID NO: 3405717 - DNA, 18 bp, Homo sapiens
agaggatgagagcccaga

SEQ ID NO: 3405718 - DNA, 22 bp, Homo sapiens
agaggcctgcctccagggctgg

SEQ ID NO: 3405719 - DNA, 15 bp, Homo sapiens
agagggccgggcaga

SEQ ID NO: 3405720 - DNA, 17 bp, Homo sapiens
agagggccgggcagagg

SEQ ID NO: 3405721 - DNA, 18 bp, Homo sapiens
agaggggcagatggaaag

SEQ ID NO: 3405722 - DNA, 21 bp, Homo sapiens
agaggggcctgccacctggac

SEQ ID NO: 3405723 - DNA, 22 bp, Homo sapiens
agaggggcctgccacctggacc

SEQ ID NO: 3405724 - DNA, 23 bp, Homo sapiens
agaggggcctgccacctggaccc

SEQ ID NO: 3405725 - DNA, 18 bp, Homo sapiens
agaggtaacagaacagct

SEQ ID NO: 3405726 - DNA, 17 bp, Homo sapiens
agagtcatgtgagcctc

SEQ ID NO: 3405727 - DNA, 12 bp, Homo sapiens
agagtgtagaag

SEQ ID NO: 3405728 - DNA, 14 bp, Homo sapiens
agagtgtagaagca

SEQ ID NO: 3405729 - DNA, 15 bp, Homo sapiens
agagtgtagaagcat

SEQ ID NO: 3405730 - DNA, 17 bp, Homo sapiens
agagtgtagaagcattc

SEQ ID NO: 3405731 - DNA, 18 bp, Homo sapiens
agagtgtagaagcattcc

SEQ ID NO: 3405732 - DNA, 13 bp, Homo sapiens
agagtgtttgtga

SEQ ID NO: 3405733 - DNA, 21 bp, Homo sapiens
agagtgtttgtgagctttttg

SEQ ID NO: 3405734 - DNA, 12 bp, Homo sapiens
agagttaagaag

SEQ ID NO: 3405735 - DNA, 16 bp, Homo sapiens
agagttaagaagctgt

SEQ ID NO: 3405736 - DNA, 12 bp, Homo sapiens
agagtttgatca

SEQ ID NO: 3405737 - DNA, 17 bp, Homo sapiens
agagtttttaatagaac

SEQ ID NO: 3405738 - DNA, 15 bp, Homo sapiens
agatataaatataaa

SEQ ID NO: 3405739 - DNA, 18 bp, Homo sapiens
agatattttatttctgat

SEQ ID NO: 3405740 - DNA, 13 bp, Homo sapiens
agatcacttttta

SEQ ID NO: 3405741 - DNA, 19 bp, Homo sapiens
agatccaaatgctgtgcaa

SEQ ID NO: 3405742 - DNA, 17 bp, Homo sapiens
agatctctattatatct

SEQ ID NO: 3405743 - DNA, 14 bp, Homo sapiens
agatgcagagagcc

SEQ ID NO: 3405744 - DNA, 15 bp, Homo sapiens
agatggagcaaatgt

SEQ ID NO: 3405745 - DNA, 17 bp, Homo sapiens
agatgtagatataaata

SEQ ID NO: 3405746 - DNA, 12 bp, Homo sapiens
agatgtccctga

SEQ ID NO: 3405747 - DNA, 18 bp, Homo sapiens
agatgtccctgaagtctt

SEQ ID NO: 3405748 - DNA, 18 bp, Homo sapiens
agattccacacaaaatgt

SEQ ID NO: 3405749 - DNA, 20 bp, Homo sapiens
agattccacacaaaatgtca

SEQ ID NO: 3405750 - DNA, 19 bp, Homo sapiens
agattcttgagctgttgtg

SEQ ID NO: 3405751 - DNA, 15 bp, Homo sapiens
agattggatttgctg

SEQ ID NO: 3405752 - DNA, 14 bp, Homo sapiens
agattgtattgctg

SEQ ID NO: 3405753 - DNA, 22 bp, Homo sapiens
agatttactgctctagaaagta

SEQ ID NO: 3405754 - DNA, 19 bp, Homo sapiens
agattttctgtaaatgaag

SEQ ID NO: 3405755 - DNA, 17 bp, Homo sapiens
agcaaagagaatgtatt

SEQ ID NO: 3405756 - DNA, 17 bp, Homo sapiens
agcaacgttagtagaac

SEQ ID NO: 3405757 - DNA, 19 bp, Homo sapiens
agctttttgttccctcatt

SEQ ID NO: 3405758 - DNA, 18 bp, Homo sapiens
aggaaactcttatctcag

SEQ ID NO: 3405759 - DNA, 15 bp, Homo sapiens
aggaacctaattgaa

SEQ ID NO: 3405760 - DNA, 18 bp, Homo sapiens
aggaacctaattgaaatt

SEQ ID NO: 3405761 - DNA, 16 bp, Homo sapiens
aggaactgctgggctt

SEQ ID NO: 3405762 - DNA, 18 bp, Homo sapiens
aggaagaacggggctctt

SEQ ID NO: 3405763 - DNA, 22 bp, Homo sapiens
aggaagccaaagagactgggcc

SEQ ID NO: 3405764 - DNA, 15 bp, Homo sapiens
aggaagccacagctg

SEQ ID NO: 3405765 - DNA, 16 bp, Homo sapiens
aggaagccacagctgg

SEQ ID NO: 3405766 - DNA, 18 bp, Homo sapiens
aggaagccacagctggtg

SEQ ID NO: 3405767 - DNA, 15 bp, Homo sapiens
aggaaggagctgcct

SEQ ID NO: 3405768 - DNA, 17 bp, Homo sapiens
aggaaggagctgcctgg

SEQ ID NO: 3405769 - DNA, 23 bp, Homo sapiens
aggaattaagttagggaatggca

SEQ ID NO: 3405770 - DNA, 18 bp, Homo sapiens
aggacaaacagtgaattt

SEQ ID NO: 3405771 - DNA, 17 bp, Homo sapiens
aggacagagaagatgac

SEQ ID NO: 3405772 - DNA, 17 bp, Homo sapiens
aggacattccaagacag

SEQ ID NO: 3405773 - DNA, 23 bp, Homo sapiens
aggaccgttttgtattgcttcct

SEQ ID NO: 3405774 - DNA, 15 bp, Homo sapiens
aggactctgcagcct

SEQ ID NO: 3405775 - DNA, 19 bp, Homo sapiens
aggactctgcagcctcaga

SEQ ID NO: 3405776 - DNA, 23 bp, Homo sapiens
aggactggctgccccgtgacaca

SEQ ID NO: 3405777 - DNA, 17 bp, Homo sapiens
aggactttctgaagcct

SEQ ID NO: 3405778 - DNA, 20 bp, Homo sapiens
aggagaggatgagagcccag

SEQ ID NO: 3405779 - DNA, 19 bp, Homo sapiens
aggagcccaggccaggact

SEQ ID NO: 3405780 - DNA, 15 bp, Homo sapiens
aggagcctaggccag

SEQ ID NO: 3405781 - DNA, 16 bp, Homo sapiens
aggagcctaggccagg

SEQ ID NO: 3405782 - DNA, 12 bp, Homo sapiens
aggagctcccct

SEQ ID NO: 3405783 - DNA, 15 bp, Homo sapiens
aggagctcccctccc

SEQ ID NO: 3405784 - DNA, 14 bp, Homo sapiens
aggagctgcctgga

SEQ ID NO: 3405785 - DNA, 16 bp, Homo sapiens
aggagctgcctggacc

SEQ ID NO: 3405786 - DNA, 14 bp, Homo sapiens
aggagggcagcaga

SEQ ID NO: 3405787 - DNA, 17 bp, Homo sapiens
aggagggtcggtgcctt

SEQ ID NO: 3405788 - DNA, 17 bp, Homo sapiens
aggatcatggtgtaata

SEQ ID NO: 3405789 - DNA, 18 bp, Homo sapiens
aggatcatggtgtaataa

SEQ ID NO: 3405790 - DNA, 17 bp, Homo sapiens
aggattctaaacagatg

SEQ ID NO: 3405791 - DNA, 19 bp, Homo sapiens
aggatttatacatacagag

SEQ ID NO: 3405792 - DNA, 23 bp, Homo sapiens
caatgatacccaacagtttattt

SEQ ID NO: 3405793 - DNA, 21 bp, Homo sapiens
caatgatcacatctaaagctt

SEQ ID NO: 3405794 - DNA, 20 bp, Homo sapiens
caatgcgtcttgtgaaattg

SEQ ID NO: 3405795 - DNA, 12 bp, Homo sapiens
caatgcgtggca

SEQ ID NO: 3405796 - DNA, 22 bp, Homo sapiens
caatgcgtggcacatctaaatt

SEQ ID NO: 3405797 - DNA, 14 bp, Homo sapiens
caatggaccggaga

SEQ ID NO: 3405798 - DNA, 18 bp, Homo sapiens
caatggtttgcaaggaag

SEQ ID NO: 3405799 - DNA, 22 bp, Homo sapiens
caatgtgatctatgtttcatct

SEQ ID NO: 3405800 - DNA, 18 bp, Homo sapiens
caatgttaaggaaactct

SEQ ID NO: 3405801 - DNA, 24 bp, Homo sapiens
caatgttaaggaaactcttatctc

SEQ ID NO: 3405802 - DNA, 19 bp, Homo sapiens
caatgttactatctgcttt

SEQ ID NO: 3405803 - DNA, 19 bp, Homo sapiens
caatgttgcactgaaaacc

SEQ ID NO: 3405804 - DNA, 15 bp, Homo sapiens
caatgtttttgtgta

SEQ ID NO: 3405805 - DNA, 20 bp, Homo sapiens
caatgtttttgtgtagagtg

SEQ ID NO: 3405806 - DNA, 13 bp, Homo sapiens
caattaactctgg

SEQ ID NO: 3405807 - DNA, 17 bp, Homo sapiens
caattcttacaaacatg

SEQ ID NO: 3405808 - DNA, 17 bp, Homo sapiens
caatttccaagagctga

SEQ ID NO: 3405809 - DNA, 22 bp, Homo sapiens
caatttggagcattaactaaat

SEQ ID NO: 3405810 - DNA, 16 bp, Homo sapiens
caatttgtaattttag

SEQ ID NO: 3405811 - DNA, 16 bp, Homo sapiens
caattttgtatttaat

SEQ ID NO: 3405812 - DNA, 14 bp, Homo sapiens
caattttgtcacag

SEQ ID NO: 3405813 - DNA, 13 bp, Homo sapiens
cacaaagtggcat

SEQ ID NO: 3405814 - DNA, 21 bp, Homo sapiens
cacaaataacagctttcttat

SEQ ID NO: 3405815 - DNA, 14 bp, Homo sapiens
cacaaatgtgtccc

SEQ ID NO: 3405816 - DNA, 20 bp, Homo sapiens
cacacaaaatgtcacacttg

SEQ ID NO: 3405817 - DNA, 23 bp, Homo sapiens
cacagactgttgtccctgcactc

SEQ ID NO: 3405818 - DNA, 13 bp, Homo sapiens
cacagcatgtgta

SEQ ID NO: 3405819 - DNA, 18 bp, Homo sapiens
cacagcctgggaccaggg

SEQ ID NO: 3405820 - DNA, 20 bp, Homo sapiens
cacagcctgggaccagggca

SEQ ID NO: 3405821 - DNA, 22 bp, Homo sapiens
cacaggacccagaaaaaaagcc

SEQ ID NO: 3405822 - DNA, 19 bp, Homo sapiens
cacaggcctgagatttcat

SEQ ID NO: 3405823 - DNA, 23 bp, Homo sapiens
cacaggcctgagatttcatctgc

SEQ ID NO: 3405824 - DNA, 15 bp, Homo sapiens
cacaggtttgtttct

SEQ ID NO: 3405825 - DNA, 22 bp, Homo sapiens
cacagttaaataaatagaaaga

SEQ ID NO: 3405826 - DNA, 21 bp, Homo sapiens
cacatattaagaatagtctct

SEQ ID NO: 3405827 - DNA, 24 bp, Homo sapiens
cacatcagctccactttcagtgaa

SEQ ID NO: 3405828 - DNA, 21 bp, Homo sapiens
cacatccatttcatctatttc

SEQ ID NO: 3405829 - DNA, 23 bp, Homo sapiens
cacatctaaagctttatctttgt

SEQ ID NO: 3405830 - DNA, 17 bp, Homo sapiens
cacatctaaattgatca

SEQ ID NO: 3405831 - DNA, 19 bp, Homo sapiens
cacatctctgtcagtgtga

SEQ ID NO: 3405832 - DNA, 18 bp, Homo sapiens
cacatggctatgttttag

SEQ ID NO: 3405833 - DNA, 18 bp, Homo sapiens
cacatttggcttacagta

SEQ ID NO: 3405834 - DNA, 14 bp, Homo sapiens
cacatttgttgcac

SEQ ID NO: 3405835 - DNA, 14 bp, Homo sapiens
cacattttgacaca

SEQ ID NO: 3405836 - DNA, 22 bp, Homo sapiens
cacattttgacacaatgttgca

SEQ ID NO: 3405837 - DNA, 17 bp, Homo sapiens
caccagagcagatgcag

SEQ ID NO: 3405838 - DNA, 18 bp, Homo sapiens
caccaggatttatacata

SEQ ID NO: 3405839 - DNA, 17 bp, Homo sapiens
caccagttgaactgcag

SEQ ID NO: 3405840 - DNA, 14 bp, Homo sapiens
cacccaatgaatga

SEQ ID NO: 3405841 - DNA, 18 bp, Homo sapiens
caccccagggcagccagg

SEQ ID NO: 3405842 - DNA, 15 bp, Homo sapiens
cacccggtcccctct

SEQ ID NO: 3405843 - DNA, 14 bp, Homo sapiens
caccgcccactctc

SEQ ID NO: 3405844 - DNA, 20 bp, Homo sapiens
caccgcccactctccacctc

SEQ ID NO: 3405845 - DNA, 17 bp, Homo sapiens
caccggaccagcctggc

SEQ ID NO: 3405846 - DNA, 19 bp, Homo sapiens
caccggaccagcctggccc

SEQ ID NO: 3405847 - DNA, 14 bp, Homo sapiens
cacctaatgtttat

SEQ ID NO: 3405848 - DNA, 20 bp, Homo sapiens
cacctaatgtttatgagcca

SEQ ID NO: 3405849 - DNA, 16 bp, Homo sapiens
cacctcactagctccc

SEQ ID NO: 3405850 - DNA, 22 bp, Homo sapiens
cacctcactagctccccaatcc

SEQ ID NO: 3405851 - DNA, 21 bp, Homo sapiens
cacctccgctgggaggaacct

SEQ ID NO: 3405852 - DNA, 14 bp, Homo sapiens
cacctctctggctt

SEQ ID NO: 3405853 - DNA, 16 bp, Homo sapiens
cacctggacccctgca

SEQ ID NO: 3405854 - DNA, 18 bp, Homo sapiens
cacctgtgagaaaggaaa

SEQ ID NO: 3405855 - DNA, 15 bp, Homo sapiens
caccttatatttacg

SEQ ID NO: 3405856 - DNA, 17 bp, Homo sapiens
cacctttgtttctcccc

SEQ ID NO: 3405857 - DNA, 19 bp, Homo sapiens
cacgattatgactaaagta

SEQ ID NO: 3405858 - DNA, 19 bp, Homo sapiens
cactaaagtgcattatttt

SEQ ID NO: 3405859 - DNA, 22 bp, Homo sapiens
cactagggaaaggtaaatacaa

SEQ ID NO: 3405860 - DNA, 23 bp, Homo sapiens
cactatgggtggggcactccttt

SEQ ID NO: 3405861 - DNA, 20 bp, Homo sapiens
cactcatgcaaactgcttta

SEQ ID NO: 3405862 - DNA, 21 bp, Homo sapiens
cactcatgcaaactgctttat

SEQ ID NO: 3405863 - DNA, 22 bp, Homo sapiens
cactcatgcaaactgctttatt

SEQ ID NO: 3405864 - DNA, 11 bp, Homo sapiens
cactcctgctg

SEQ ID NO: 3405865 - DNA, 13 bp, Homo sapiens
cactcctgctgta

SEQ ID NO: 3405866 - DNA, 17 bp, Homo sapiens
cactcgggttaagaaat

SEQ ID NO: 3405867 - DNA, 18 bp, Homo sapiens
cactcgggttaagaaata

SEQ ID NO: 3405868 - DNA, 12 bp, Homo sapiens
cactctccacct

SEQ ID NO: 3405869 - DNA, 20 bp, Homo sapiens
cactctcccccaccccctcc

SEQ ID NO: 3405870 - DNA, 13 bp, Homo sapiens
cactcttctcagc

SEQ ID NO: 3405871 - DNA, 14 bp, Homo sapiens
cactcttctcagcc

SEQ ID NO: 3405872 - DNA, 21 bp, Homo sapiens
cactgagaatgtaagaactac

SEQ ID NO: 3405873 - DNA, 13 bp, Homo sapiens
cactgaggaagaa

SEQ ID NO: 3405874 - DNA, 14 bp, Homo sapiens
cactgaggaagaac

SEQ ID NO: 3405875 - DNA, 15 bp, Homo sapiens
cactgaggaagaacg

SEQ ID NO: 3405876 - DNA, 19 bp, Homo sapiens
cactgcctcctacaaccag

SEQ ID NO: 3405877 - DNA, 15 bp, Homo sapiens
cactgcctctcacag

SEQ ID NO: 3405878 - DNA, 20 bp, Homo sapiens
cactggcatcgcagcttcct

SEQ ID NO: 3405879 - DNA, 13 bp, Homo sapiens
cactgtccaccac

SEQ ID NO: 3405880 - DNA, 13 bp, Homo sapiens
cacttaatattag

SEQ ID NO: 3405881 - DNA, 11 bp, Homo sapiens
cacttctgcac

SEQ ID NO: 3405882 - DNA, 14 bp, Homo sapiens
cacttctgcacttg

SEQ ID NO: 3405883 - DNA, 18 bp, Homo sapiens
cacttctgggtggggcag

SEQ ID NO: 3405884 - DNA, 17 bp, Homo sapiens
cacttgcaggggtccct

SEQ ID NO: 3405885 - DNA, 17 bp, Homo sapiens
cacttgtggaatatgtt

SEQ ID NO: 3405886 - DNA, 14 bp, Homo sapiens
cactttttcccctg

SEQ ID NO: 3405887 - DNA, 18 bp, Homo sapiens
cactttttcccctgcaat

SEQ ID NO: 3405888 - DNA, 19 bp, Homo sapiens
cactttttcccctgcaatg

SEQ ID NO: 3405889 - DNA, 12 bp, Homo sapiens
cagaacagcttc

SEQ ID NO: 3405890 - DNA, 13 bp, Homo sapiens
cagaacagcttca

SEQ ID NO: 3405891 - DNA, 16 bp, Homo sapiens
cagaacagcttcaggt

SEQ ID NO: 3405892 - DNA, 24 bp, Homo sapiens
cagaacagcttcaggttatcgaaa

SEQ ID NO: 3405893 - DNA, 19 bp, Homo sapiens
cagaagacaccagagcaga

SEQ ID NO: 3405894 - DNA, 14 bp, Homo sapiens
cagaagaccccact

SEQ ID NO: 3405895 - DNA, 18 bp, Homo sapiens
cagaagatgaacagactg

SEQ ID NO: 3405896 - DNA, 23 bp, Homo sapiens
cagaagccaagctccctggagcc

SEQ ID NO: 3405897 - DNA, 14 bp, Homo sapiens
cagaagggggtggt

SEQ ID NO: 3405898 - DNA, 19 bp, Homo sapiens
cagaagggggtggtgtctc

SEQ ID NO: 3405899 - DNA, 21 bp, Homo sapiens
cagaagggggtggtgtctcca

SEQ ID NO: 3405900 - DNA, 23 bp, Homo sapiens
cagaattggcataatttgtctta

SEQ ID NO: 3405901 - DNA, 14 bp, Homo sapiens
cagaccaaaaatca

SEQ ID NO: 3405902 - DNA, 20 bp, Homo sapiens
cagacctgcagacgcccaga

SEQ ID NO: 3405903 - DNA, 22 bp, Homo sapiens
cagactgaccttgatgagctgt

SEQ ID NO: 3405904 - DNA, 17 bp, Homo sapiens
cagagaaagcgcagatg

SEQ ID NO: 3405905 - DNA, 20 bp, Homo sapiens
cagagagccattttgtgaat

SEQ ID NO: 3405906 - DNA, 21 bp, Homo sapiens
cagagcagatgcagagagcca

SEQ ID NO: 3405907 - DNA, 22 bp, Homo sapiens
cagaggagggcagcagaagggg

SEQ ID NO: 3405908 - DNA, 21 bp, Homo sapiens
cagaggccgcgcgtccagctg

SEQ ID NO: 3405909 - DNA, 17 bp, Homo sapiens
cagaggggcctgccacc

SEQ ID NO: 3405910 - DNA, 21 bp, Homo sapiens
cagaggggcctgccacctgga

SEQ ID NO: 3405911 - DNA, 13 bp, Homo sapiens
cagaggtaacaga

SEQ ID NO: 3405912 - DNA, 18 bp, Homo sapiens
cagaggtaacagaacagc

SEQ ID NO: 3405913 - DNA, 20 bp, Homo sapiens
cagaggtaacagaacagctt

SEQ ID NO: 3405914 - DNA, 16 bp, Homo sapiens
cagagttctttgcaag

SEQ ID NO: 3405915 - DNA, 22 bp, Homo sapiens
cagagtttggttaatcagtgtt

SEQ ID NO: 3405916 - DNA, 23 bp, Homo sapiens
cagatcattatcagcctgtgcca

SEQ ID NO: 3405917 - DNA, 20 bp, Homo sapiens
cagatcctccatttttgttg

SEQ ID NO: 3405918 - DNA, 16 bp, Homo sapiens
cagatgcagagagcca

SEQ ID NO: 3405919 - DNA, 12 bp, Homo sapiens
cagatgtccctg

SEQ ID NO: 3405920 - DNA, 19 bp, Homo sapiens
cagattccacacaaaatgt

SEQ ID NO: 3405921 - DNA, 17 bp, Homo sapiens
cagattggctcacactg

SEQ ID NO: 3405922 - DNA, 18 bp, Homo sapiens
cagattggctcacactga

SEQ ID NO: 3405923 - DNA, 20 bp, Homo sapiens
cagattggctcacactgaga

SEQ ID NO: 3405924 - DNA, 22 bp, Homo sapiens
cagattggctcacactgagaat

SEQ ID NO: 3405925 - DNA, 15 bp, Homo sapiens
cagcaccggaccagc

SEQ ID NO: 3405926 - DNA, 19 bp, Homo sapiens
cagcaccggaccagcctgg

SEQ ID NO: 3405927 - DNA, 17 bp, Homo sapiens
cagcactgaggaagaac

SEQ ID NO: 3405928 - DNA, 17 bp, Homo sapiens
cagcagaagggggtggt

SEQ ID NO: 3405929 - DNA, 21 bp, Homo sapiens
cagcatcaaacatgaaaacat

SEQ ID NO: 3405930 - DNA, 22 bp, Homo sapiens
cagcatcaaacatgaaaacatt

SEQ ID NO: 3405931 - DNA, 19 bp, Homo sapiens
cagcatgtatagttgcttt

SEQ ID NO: 3405932 - DNA, 14 bp, Homo sapiens
cagccagggagagc

SEQ ID NO: 3405933 - DNA, 16 bp, Homo sapiens
cagccagggagagccc

SEQ ID NO: 3405934 - DNA, 21 bp, Homo sapiens
cagccagggagagcccaggag

SEQ ID NO: 3405935 - DNA, 24 bp, Homo sapiens
cagccagggagagcccaggagctc

SEQ ID NO: 3405936 - DNA, 21 bp, Homo sapiens
cagccagggcctgcgagggca

SEQ ID NO: 3405937 - DNA, 14 bp, Homo sapiens
cagccccaccccag

SEQ ID NO: 3405938 - DNA, 20 bp, Homo sapiens
cagccccaccccagggcagc

SEQ ID NO: 3405939 - DNA, 23 bp, Homo sapiens
cagccccaccccagggcagccag

SEQ ID NO: 3405940 - DNA, 20 bp, Homo sapiens
cagcccttgggggtcctcct

SEQ ID NO: 3405941 - DNA, 12 bp, Homo sapiens
cagcctcagaga

SEQ ID NO: 3405942 - DNA, 21 bp, Homo sapiens
cagcctcagagacatcagccc

SEQ ID NO: 3405943 - DNA, 17 bp, Homo sapiens
cagcctgggaccagggc

SEQ ID NO: 3405944 - DNA, 17 bp, Homo sapiens
cagcgccaagtggccac

SEQ ID NO: 3405945 - DNA, 20 bp, Homo sapiens
cagcgctggccgggaccccg

SEQ ID NO: 3405946 - DNA, 19 bp, Homo sapiens
cagcgggagcctccctgcc

SEQ ID NO: 3405947 - DNA, 20 bp, Homo sapiens
cagcgggagcctccctgcct

SEQ ID NO: 3405948 - DNA, 15 bp, Homo sapiens
cagcgtgtcaacttt

SEQ ID NO: 3405949 - DNA, 17 bp, Homo sapiens
cagctactaatgatgtt

SEQ ID NO: 3405950 - DNA, 15 bp, Homo sapiens
cagctagtgccaaat

SEQ ID NO: 3405951 - DNA, 20 bp, Homo sapiens
cagctagtgccaaataattg

SEQ ID NO: 3405952 - DNA, 15 bp, Homo sapiens
cagctcaggcagctc

SEQ ID NO: 3405953 - DNA, 16 bp, Homo sapiens
cagctccctgcctgtt

SEQ ID NO: 3405954 - DNA, 20 bp, Homo sapiens
cagctccctgcctgtttccc

SEQ ID NO: 3405955 - DNA, 13 bp, Homo sapiens
cagctcgaggccc

SEQ ID NO: 3405956 - DNA, 15 bp, Homo sapiens
cagctcttgtttgga

SEQ ID NO: 3405957 - DNA, 21 bp, Homo sapiens
cagctgcccttccgcagtgtg

SEQ ID NO: 3405958 - DNA, 18 bp, Homo sapiens
cagctgctgaagggaggg

SEQ ID NO: 3405959 - DNA, 15 bp, Homo sapiens
cagctggtggatggt

SEQ ID NO: 3405960 - DNA, 21 bp, Homo sapiens
cagcttctcatcctgcaggca

SEQ ID NO: 3405961 - DNA, 17 bp, Homo sapiens
caggaaaaacccgtcaa

SEQ ID NO: 3405962 - DNA, 22 bp, Homo sapiens
caggaagacccaacacatggga

SEQ ID NO: 3405963 - DNA, 14 bp, Homo sapiens
caggaagccaaaga

SEQ ID NO: 3405964 - DNA, 12 bp, Homo sapiens
caggaaggagct

SEQ ID NO: 3405965 - DNA, 13 bp, Homo sapiens
caggaaggagctg

SEQ ID NO: 3405966 - DNA, 17 bp, Homo sapiens
caggaaggagctgcctg

SEQ ID NO: 3405967 - DNA, 20 bp, Homo sapiens
caggaaggagctgcctggac

SEQ ID NO: 3405968 - DNA, 22 bp, Homo sapiens
caggaaggagctgcctggaccc

SEQ ID NO: 3405969 - DNA, 19 bp, Homo sapiens
caggactctgcagcctcag

SEQ ID NO: 3405970 - DNA, 12 bp, Homo sapiens
caggactgggcc

SEQ ID NO: 3405971 - DNA, 20 bp, Homo sapiens
caggactgggccacttctgg

SEQ ID NO: 3405972 - DNA, 19 bp, Homo sapiens
caggagttcccaaatgtga

SEQ ID NO: 3405973 - DNA, 21 bp, Homo sapiens
caggatactgtagtttcctct

SEQ ID NO: 3405974 - DNA, 15 bp, Homo sapiens
caggatcatggtgta

SEQ ID NO: 3405975 - DNA, 19 bp, Homo sapiens
caggatcatggtgtaataa

SEQ ID NO: 3405976 - DNA, 18 bp, Homo sapiens
caggatttatacatacag

SEQ ID NO: 3405977 - DNA, 13 bp, Homo sapiens
caggcaccgagaa

SEQ ID NO: 3405978 - DNA, 21 bp, Homo sapiens
caggcactaagaggggctgga

SEQ ID NO: 3405979 - DNA, 13 bp, Homo sapiens
caggcactgccct

SEQ ID NO: 3405980 - DNA, 16 bp, Homo sapiens
caggcactgccctggt

SEQ ID NO: 3405981 - DNA, 22 bp, Homo sapiens
caggcagctttttctctcccac

SEQ ID NO: 3405982 - DNA, 15 bp, Homo sapiens
caggccaggactctg

SEQ ID NO: 3405983 - DNA, 18 bp, Homo sapiens
caggccaggactctgcag

SEQ ID NO: 3405984 - DNA, 23 bp, Homo sapiens
caggccaggactctgcagcctca

SEQ ID NO: 3405985 - DNA, 15 bp, Homo sapiens
caggcctgactctca

SEQ ID NO: 3405986 - DNA, 14 bp, Homo sapiens
caggcctgagattt

SEQ ID NO: 3405987 - DNA, 15 bp, Homo sapiens
caggcttgcctgcag

SEQ ID NO: 3405988 - DNA, 16 bp, Homo sapiens
caggcttgcctgcagg

SEQ ID NO: 3405989 - DNA, 18 bp, Homo sapiens
cagggaacatggggagga

SEQ ID NO: 3405990 - DNA, 14 bp, Homo sapiens
cagggagctgcagg

SEQ ID NO: 3405991 - DNA, 17 bp, Homo sapiens
cagggagctgcaggggc

SEQ ID NO: 3405992 - DNA, 18 bp, Homo sapiens
cagggataccttaattct

SEQ ID NO: 3405993 - DNA, 18 bp, Homo sapiens
cagggcacaggccatgga

SEQ ID NO: 3405994 - DNA, 14 bp, Homo sapiens
cagggcagccaggg

SEQ ID NO: 3405995 - DNA, 17 bp, Homo sapiens
cagggcagccagggaga

SEQ ID NO: 3405996 - DNA, 20 bp, Homo sapiens
cagggcagccagggagagcc

SEQ ID NO: 3405997 - DNA, 22 bp, Homo sapiens
cagggcagccagggagagccca

SEQ ID NO: 3405998 - DNA, 18 bp, Homo sapiens
cagggctggactgaggcc

SEQ ID NO: 3405999 - DNA, 20 bp, Homo sapiens
cagggctggactgaggcctg

SEQ ID NO: 3406000 - DNA, 13 bp, Homo sapiens
cagggctgtgcac

SEQ ID NO: 3406001 - DNA, 18 bp, Homo sapiens
cagggcttacggccctgg

SEQ ID NO: 3406002 - DNA, 22 bp, Homo sapiens
caggggagggtcagccagggcc

SEQ ID NO: 3406003 - DNA, 20 bp, Homo sapiens
caggggatttcaccactcaa

SEQ ID NO: 3406004 - DNA, 14 bp, Homo sapiens
caggggtccctgct

SEQ ID NO: 3406005 - DNA, 16 bp, Homo sapiens
caggggtccctgctag

SEQ ID NO: 3406006 - DNA, 20 bp, Homo sapiens
caggtatgaccttctaggaa

SEQ ID NO: 3406007 - DNA, 20 bp, Homo sapiens
caggtctccatgaagaagct

SEQ ID NO: 3406008 - DNA, 11 bp, Homo sapiens
caggtctcctc

SEQ ID NO: 3406009 - DNA, 13 bp, Homo sapiens
caggtctcctctt

SEQ ID NO: 3406010 - DNA, 17 bp, Homo sapiens
caggtctcctcttaaaa

SEQ ID NO: 3406011 - DNA, 21 bp, Homo sapiens
caggtgacatgtgaaaccttt

SEQ ID NO: 3406012 - DNA, 24 bp, Homo sapiens
caggtgcaaccagggagctgcagg

SEQ ID NO: 3406013 - DNA, 20 bp, Homo sapiens
caggttatcgaaataacaat

SEQ ID NO: 3406014 - DNA, 23 bp, Homo sapiens
cagtaagtataacaaactatgta

SEQ ID NO: 3406015 - DNA, 17 bp, Homo sapiens
cagtagtcacctctggg

SEQ ID NO: 3406016 - DNA, 21 bp, Homo sapiens
cagtattatttgtatgtatta

SEQ ID NO: 3406017 - DNA, 11 bp, Homo sapiens
cagtattttcc

SEQ ID NO: 3406018 - DNA, 18 bp, Homo sapiens
cagtattttccagcctta

SEQ ID NO: 3406019 - DNA, 20 bp, Homo sapiens
cagtcactttttcccctgca

SEQ ID NO: 3406020 - DNA, 23 bp, Homo sapiens
cagtcactttttcccctgcaatg

SEQ ID NO: 3406021 - DNA, 13 bp, Homo sapiens
cagtcatgcataa

SEQ ID NO: 3406022 - DNA, 14 bp, Homo sapiens
cagtcatgcataaa

SEQ ID NO: 3406023 - DNA, 16 bp, Homo sapiens
cagtcatgcataaata

SEQ ID NO: 3406024 - DNA, 20 bp, Homo sapiens
cagtcatgcataaatatgca

SEQ ID NO: 3406025 - DNA, 23 bp, Homo sapiens
cagtcatgcataaatatgcagtg

SEQ ID NO: 3406026 - DNA, 21 bp, Homo sapiens
cagtcattatttaaagcacat

SEQ ID NO: 3406027 - DNA, 13 bp, Homo sapiens
cagtctcaatttt

SEQ ID NO: 3406028 - DNA, 14 bp, Homo sapiens
cagtctcaattttg

SEQ ID NO: 3406029 - DNA, 22 bp, Homo sapiens
cagtgaaagtcaattcagtgat

SEQ ID NO: 3406030 - DNA, 16 bp, Homo sapiens
cagtgaacagtttgga

SEQ ID NO: 3406031 - DNA, 18 bp, Homo sapiens
cagtgagtgccatgcttt

SEQ ID NO: 3406032 - DNA, 23 bp, Homo sapiens
cagtgatatggcagaagacacca

SEQ ID NO: 3406033 - DNA, 17 bp, Homo sapiens
cagtggcaggacaggaa

SEQ ID NO: 3406034 - DNA, 16 bp, Homo sapiens
cagtggctggatctgt

SEQ ID NO: 3406035 - DNA, 20 bp, Homo sapiens
cagtggctggatctgtgagg

SEQ ID NO: 3406036 - DNA, 24 bp, Homo sapiens
cagtgttcagccaaacagtatgat

SEQ ID NO: 3406037 - DNA, 17 bp, Homo sapiens
cagttataagcgtattt

SEQ ID NO: 3406038 - DNA, 15 bp, Homo sapiens
cagttgaactgcagg

SEQ ID NO: 3406039 - DNA, 11 bp, Homo sapiens
cagttgcagcc

SEQ ID NO: 3406040 - DNA, 16 bp, Homo sapiens
cagtttattaaatctg

SEQ ID NO: 3406041 - DNA, 21 bp, Homo sapiens
cataaaattgcagtttcatgt

SEQ ID NO: 3406042 - DNA, 23 bp, Homo sapiens
cataaaattgcagtttcatgtat

SEQ ID NO: 3406043 - DNA, 21 bp, Homo sapiens
cataaatttgttgtcatgtgt

SEQ ID NO: 3406044 - DNA, 17 bp, Homo sapiens
cataataaatgcttcag

SEQ ID NO: 3406045 - DNA, 18 bp, Homo sapiens
cataatcacaacccttca

SEQ ID NO: 3406046 - DNA, 11 bp, Homo sapiens
catacttttaa

SEQ ID NO: 3406047 - DNA, 17 bp, Homo sapiens
catagagatatttaaaa

SEQ ID NO: 3406048 - DNA, 22 bp, Homo sapiens
catagagatatttaaaagacaa

SEQ ID NO: 3406049 - DNA, 23 bp, Homo sapiens
catagatttgaagatctgattta

SEQ ID NO: 3406050 - DNA, 23 bp, Homo sapiens
catagttgaaaaaagaagtttgg

SEQ ID NO: 3406051 - DNA, 16 bp, Homo sapiens
catatatgctgtattt

SEQ ID NO: 3406052 - DNA, 19 bp, Homo sapiens
catatatgctgtatttctt

SEQ ID NO: 3406053 - DNA, 20 bp, Homo sapiens
catatatgctgtatttcttt

SEQ ID NO: 3406054 - DNA, 15 bp, Homo sapiens
catatcctgagccat

SEQ ID NO: 3406055 - DNA, 14 bp, Homo sapiens
catattaaaaatat

SEQ ID NO: 3406056 - DNA, 20 bp, Homo sapiens
catattaagaatagtctctg

SEQ ID NO: 3406057 - DNA, 13 bp, Homo sapiens
catcaaacatgaa

SEQ ID NO: 3406058 - DNA, 17 bp, Homo sapiens
catcaaataaaccttgt

SEQ ID NO: 3406059 - DNA, 23 bp, Homo sapiens
catcaatagtgtcctatgcaata

SEQ ID NO: 3406060 - DNA, 11 bp, Homo sapiens
catcaatttgt

SEQ ID NO: 3406061 - DNA, 13 bp, Homo sapiens
catcagaactgaa

SEQ ID NO: 3406062 - DNA, 21 bp, Homo sapiens
catcatattaaaaatatacaa

SEQ ID NO: 3406063 - DNA, 13 bp, Homo sapiens
catcatgttactt

SEQ ID NO: 3406064 - DNA, 17 bp, Homo sapiens
catcatgttacttgaga

SEQ ID NO: 3406065 - DNA, 13 bp, Homo sapiens
catcatgtttaca

SEQ ID NO: 3406066 - DNA, 12 bp, Homo sapiens
catcattggata

SEQ ID NO: 3406067 - DNA, 20 bp, Homo sapiens
catcattggataaatttgaa

SEQ ID NO: 3406068 - DNA, 14 bp, Homo sapiens
catccaaggaacct

SEQ ID NO: 3406069 - DNA, 19 bp, Homo sapiens
catccatttcatctatttc

SEQ ID NO: 3406070 - DNA, 20 bp, Homo sapiens
catccatttcatctatttct

SEQ ID NO: 3406071 - DNA, 15 bp, Homo sapiens
catcctgccacagga

SEQ ID NO: 3406072 - DNA, 13 bp, Homo sapiens
catcgatatgaaa

SEQ ID NO: 3406073 - DNA, 13 bp, Homo sapiens
catcgcagcttcc

SEQ ID NO: 3406074 - DNA, 18 bp, Homo sapiens
catcgcagcttcctgtct

SEQ ID NO: 3406075 - DNA, 22 bp, Homo sapiens
catcggtgaaactaacagataa

SEQ ID NO: 3406076 - DNA, 19 bp, Homo sapiens
catctaaagctttatcttt

SEQ ID NO: 3406077 - DNA, 19 bp, Homo sapiens
catctaaattgatcattca

SEQ ID NO: 3406078 - DNA, 13 bp, Homo sapiens
catctatttctga

SEQ ID NO: 3406079 - DNA, 21 bp, Homo sapiens
catctcttagctcccctccaa

SEQ ID NO: 3406080 - DNA, 23 bp, Homo sapiens
catctcttagctcccctccaacc

SEQ ID NO: 3406081 - DNA, 15 bp, Homo sapiens
catctgctctccttc

SEQ ID NO: 3406082 - DNA, 16 bp, Homo sapiens
catctgctctccttcc

SEQ ID NO: 3406083 - DNA, 18 bp, Homo sapiens
catctgctctccttcctg

SEQ ID NO: 3406084 - DNA, 12 bp, Homo sapiens
catctgtgtctg

SEQ ID NO: 3406085 - DNA, 19 bp, Homo sapiens
catcttggccctcctcagc

SEQ ID NO: 3406086 - DNA, 20 bp, Homo sapiens
catcttggccctcctcagct

SEQ ID NO: 3406087 - DNA, 12 bp, Homo sapiens
catgaaaaagca

SEQ ID NO: 3406088 - DNA, 18 bp, Homo sapiens
catgaaaaagcagctacc

SEQ ID NO: 3406089 - DNA, 19 bp, Homo sapiens
catgaaaaagcagctacca

SEQ ID NO: 3406090 - DNA, 14 bp, Homo sapiens
catgaaaacattga

SEQ ID NO: 3406091 - DNA, 18 bp, Homo sapiens
catgaacacagcctggga

SEQ ID NO: 3406092 - DNA, 16 bp, Homo sapiens
catgaagctggaagca

SEQ ID NO: 3406093 - DNA, 21 bp, Homo sapiens
catgaagctggaagcactgct

SEQ ID NO: 3406094 - DNA, 21 bp, Homo sapiens
catgaattaagggccagaaaa

SEQ ID NO: 3406095 - DNA, 22 bp, Homo sapiens
catgactgagtctggcaaacat

SEQ ID NO: 3406096 - DNA, 19 bp, Homo sapiens
catgagttggctgggaata

SEQ ID NO: 3406097 - DNA, 18 bp, Homo sapiens
catgcaggtctccatgaa

SEQ ID NO: 3406098 - DNA, 21 bp, Homo sapiens
catgcaggtctccatgaagaa

SEQ ID NO: 3406099 - DNA, 15 bp, Homo sapiens
catgcataaatatgc

SEQ ID NO: 3406100 - DNA, 20 bp, Homo sapiens
catgctcatgtatatttagt

SEQ ID NO: 3406101 - DNA, 15 bp, Homo sapiens
catgctttttggtga

SEQ ID NO: 3406102 - DNA, 14 bp, Homo sapiens
catggacaatggac

SEQ ID NO: 3406103 - DNA, 14 bp, Homo sapiens
catggagtgtttga

SEQ ID NO: 3406104 - DNA, 15 bp, Homo sapiens
catggagtgtttgac

SEQ ID NO: 3406105 - DNA, 14 bp, Homo sapiens
catggatggaaaac

SEQ ID NO: 3406106 - DNA, 17 bp, Homo sapiens
catggattccaaagcat

SEQ ID NO: 3406107 - DNA, 18 bp, Homo sapiens
catggattccaaagcatt

SEQ ID NO: 3406108 - DNA, 16 bp, Homo sapiens
catggccctgccatgc

SEQ ID NO: 3406109 - DNA, 22 bp, Homo sapiens
catggctataaacaattacatg

SEQ ID NO: 3406110 - DNA, 12 bp, Homo sapiens
catgggcttcac

SEQ ID NO: 3406111 - DNA, 15 bp, Homo sapiens
catgggcttcactgt

SEQ ID NO: 3406112 - DNA, 15 bp, Homo sapiens
catggggaggaggag

SEQ ID NO: 3406113 - DNA, 19 bp, Homo sapiens
catggggaggaggagggtc

SEQ ID NO: 3406114 - DNA, 16 bp, Homo sapiens
catggtgtaataagac

SEQ ID NO: 3406115 - DNA, 19 bp, Homo sapiens
catggtgtaataagacata

SEQ ID NO: 3406116 - DNA, 22 bp, Homo sapiens
catggtgtaataagacataacg

SEQ ID NO: 3406117 - DNA, 18 bp, Homo sapiens
catggtgtgtgtctctga

SEQ ID NO: 3406118 - DNA, 14 bp, Homo sapiens
catgtaaaatcttc

SEQ ID NO: 3406119 - DNA, 22 bp, Homo sapiens
catgtaaaatcttcagctggtg

SEQ ID NO: 3406120 - DNA, 15 bp, Homo sapiens
catgtataatatttt

SEQ ID NO: 3406121 - DNA, 18 bp, Homo sapiens
catgtataatatttttaa

SEQ ID NO: 3406122 - DNA, 15 bp, Homo sapiens
catgtatagttgctt

SEQ ID NO: 3406123 - DNA, 17 bp, Homo sapiens
catgtatagttgctttt

SEQ ID NO: 3406124 - DNA, 16 bp, Homo sapiens
catgtatgtggataca

SEQ ID NO: 3406125 - DNA, 20 bp, Homo sapiens
catgtattagccagtcattg

SEQ ID NO: 3406126 - DNA, 15 bp, Homo sapiens
catgtcatttctcat

SEQ ID NO: 3406127 - DNA, 12 bp, Homo sapiens
catgtgaaacct

SEQ ID NO: 3406128 - DNA, 22 bp, Homo sapiens
catgtgaaaccttttttaagat

SEQ ID NO: 3406129 - DNA, 17 bp, Homo sapiens
catgtgctacaggggcc

SEQ ID NO: 3406130 - DNA, 15 bp, Homo sapiens
catgtgtatatatgt

SEQ ID NO: 3406131 - DNA, 13 bp, Homo sapiens
catgttgtgcctc

SEQ ID NO: 3406132 - DNA, 21 bp, Homo sapiens
catgttttaaaagtttgtcct

SEQ ID NO: 3406133 - DNA, 17 bp, Homo sapiens
cattaaagcaatctgtt

SEQ ID NO: 3406134 - DNA, 15 bp, Homo sapiens
cattaactaaatgct

SEQ ID NO: 3406135 - DNA, 17 bp, Homo sapiens
cattaactaaatgctca

SEQ ID NO: 3406136 - DNA, 18 bp, Homo sapiens
cattaactaaatgctcat

SEQ ID NO: 3406137 - DNA, 18 bp, Homo sapiens
cattaataatagctaata

SEQ ID NO: 3406138 - DNA, 21 bp, Homo sapiens
cattaataatagctaataata

SEQ ID NO: 3406139 - DNA, 23 bp, Homo sapiens
cattacaatcgagactgcaatgt

SEQ ID NO: 3406140 - DNA, 22 bp, Homo sapiens
cattacagggcacaggccatgg

SEQ ID NO: 3406141 - DNA, 17 bp, Homo sapiens
cattaccttactgtgga

SEQ ID NO: 3406142 - DNA, 17 bp, Homo sapiens
cattagtgttctttata

SEQ ID NO: 3406143 - DNA, 23 bp, Homo sapiens
cattatgatgtgggtcaaggaat

SEQ ID NO: 3406144 - DNA, 15 bp, Homo sapiens
cattccaagacagta

SEQ ID NO: 3406145 - DNA, 15 bp, Homo sapiens
cattccttcccagag

SEQ ID NO: 3406146 - DNA, 15 bp, Homo sapiens
cattccttctttgat

SEQ ID NO: 3406147 - DNA, 12 bp, Homo sapiens
cattctgcatta

SEQ ID NO: 3406148 - DNA, 13 bp, Homo sapiens
cattctgcattaa

SEQ ID NO: 3406149 - DNA, 14 bp, Homo sapiens
cattctgcattaat

SEQ ID NO: 3406150 - DNA, 16 bp, Homo sapiens
cattcttggttgttaa

SEQ ID NO: 3406151 - DNA, 17 bp, Homo sapiens
cattctttcttggtgca

SEQ ID NO: 3406152 - DNA, 20 bp, Homo sapiens
cattgattttaaaaatacat

SEQ ID NO: 3406153 - DNA, 23 bp, Homo sapiens
cattgattttaaaaatacatttt

SEQ ID NO: 3406154 - DNA, 15 bp, Homo sapiens
cattgccatcagtga

SEQ ID NO: 3406155 - DNA, 21 bp, Homo sapiens
cattgtgaggtttaacattaa

SEQ ID NO: 3406156 - DNA, 15 bp, Homo sapiens
catttatgatttaat

SEQ ID NO: 3406157 - DNA, 16 bp, Homo sapiens
catttatgatttaata

SEQ ID NO: 3406158 - DNA, 21 bp, Homo sapiens
catttatgatttaataaaata

SEQ ID NO: 3406159 - DNA, 12 bp, Homo sapiens
catttatttctc

SEQ ID NO: 3406160 - DNA, 15 bp, Homo sapiens
catttcaaaatgctt

SEQ ID NO: 3406161 - DNA, 17 bp, Homo sapiens
catttcaagatccaaat

SEQ ID NO: 3406162 - DNA, 17 bp, Homo sapiens
catttcacccctccctt

SEQ ID NO: 3406163 - DNA, 18 bp, Homo sapiens
catttcacccctcccttt

SEQ ID NO: 3406164 - DNA, 19 bp, Homo sapiens
catttcacccctccctttc

SEQ ID NO: 3406165 - DNA, 20 bp, Homo sapiens
catttcatctatttctgaga

SEQ ID NO: 3406166 - DNA, 15 bp, Homo sapiens
catttcattcctaac

SEQ ID NO: 3406167 - DNA, 13 bp, Homo sapiens
catttgattaaat

SEQ ID NO: 3406168 - DNA, 21 bp, Homo sapiens
catttgattaaattatgaatg

SEQ ID NO: 3406169 - DNA, 14 bp, Homo sapiens
catttgatttcgat

SEQ ID NO: 3406170 - DNA, 14 bp, Homo sapiens
cattttaggaaagg

SEQ ID NO: 3406171 - DNA, 20 bp, Homo sapiens
cattttcagcatcaaacatg

SEQ ID NO: 3406172 - DNA, 12 bp, Homo sapiens
cattttcttgtc

SEQ ID NO: 3406173 - DNA, 14 bp, Homo sapiens
cattttcttgtcaa

SEQ ID NO: 3406174 - DNA, 12 bp, Homo sapiens
cattttgaatgt

SEQ ID NO: 3406175 - DNA, 20 bp, Homo sapiens
cattttgaatgtgatcatct

SEQ ID NO: 3406176 - DNA, 17 bp, Homo sapiens
cattttggatttcttta

SEQ ID NO: 3406177 - DNA, 12 bp, Homo sapiens
cattttgtgaat

SEQ ID NO: 3406178 - DNA, 15 bp, Homo sapiens
cattttgtgaatgga

SEQ ID NO: 3406179 - DNA, 16 bp, Homo sapiens
cattttgtgaatggat

SEQ ID NO: 3406180 - DNA, 23 bp, Homo sapiens
catttttaaaggacaaacagtga

SEQ ID NO: 3406181 - DNA, 16 bp, Homo sapiens
catttttagtttaaaa

SEQ ID NO: 3406182 - DNA, 13 bp, Homo sapiens
catttttgctaat

SEQ ID NO: 3406183 - DNA, 17 bp, Homo sapiens
catttttttccaggctg

SEQ ID NO: 3406184 - DNA, 14 bp, Homo sapiens
ccaaactcatcttg

SEQ ID NO: 3406185 - DNA, 17 bp, Homo sapiens
ccaaccccccagcactg

SEQ ID NO: 3406186 - DNA, 19 bp, Homo sapiens
ccaaccccccagcactgag

SEQ ID NO: 3406187 - DNA, 21 bp, Homo sapiens
ccaaccccccagcactgagga

SEQ ID NO: 3406188 - DNA, 12 bp, Homo sapiens
ccaactttcatt

SEQ ID NO: 3406189 - DNA, 22 bp, Homo sapiens
ccaagagctgaggcaattctaa

SEQ ID NO: 3406190 - DNA, 16 bp, Homo sapiens
ccaagctccctggagc

SEQ ID NO: 3406191 - DNA, 11 bp, Homo sapiens
ccaaggaacct

SEQ ID NO: 3406192 - DNA, 14 bp, Homo sapiens
ccaaggaacctaat

SEQ ID NO: 3406193 - DNA, 18 bp, Homo sapiens
ccaaggaacctaattgaa

SEQ ID NO: 3406194 - DNA, 19 bp, Homo sapiens
ccaaggaacctaattgaaa

SEQ ID NO: 3406195 - DNA, 21 bp, Homo sapiens
ccaaggaacctaattgaaatt

SEQ ID NO: 3406196 - DNA, 13 bp, Homo sapiens
ccaagtcattgtt

SEQ ID NO: 3406197 - DNA, 20 bp, Homo sapiens
ccaagtggaccttgagacca

SEQ ID NO: 3406198 - DNA, 14 bp, Homo sapiens
ccaatccctgaccc

SEQ ID NO: 3406199 - DNA, 21 bp, Homo sapiens
ccaatgccacatacttgcagc

SEQ ID NO: 3406200 - DNA, 14 bp, Homo sapiens
ccaattctgaaata

SEQ ID NO: 3406201 - DNA, 19 bp, Homo sapiens
ccaattcttacaaacatgt

SEQ ID NO: 3406202 - DNA, 13 bp, Homo sapiens
ccacacaaaatgt

SEQ ID NO: 3406203 - DNA, 23 bp, Homo sapiens
ccacagcgctggccgggaccccg

SEQ ID NO: 3406204 - DNA, 12 bp, Homo sapiens
ccacaggcctga

SEQ ID NO: 3406205 - DNA, 18 bp, Homo sapiens
ccacagggttcaaaatgt

SEQ ID NO: 3406206 - DNA, 20 bp, Homo sapiens
ccaccccagggcagccaggg

SEQ ID NO: 3406207 - DNA, 14 bp, Homo sapiens
ccaccgcccactct

SEQ ID NO: 3406208 - DNA, 18 bp, Homo sapiens
ccaccgcccactctccac

SEQ ID NO: 3406209 - DNA, 12 bp, Homo sapiens
ccacctggaccc

SEQ ID NO: 3406210 - DNA, 18 bp, Homo sapiens
ccacctggacccctgcat

SEQ ID NO: 3406211 - DNA, 21 bp, Homo sapiens
ccacctggacccctgcattgg

SEQ ID NO: 3406212 - DNA, 11 bp, Homo sapiens
ccacctggctc

SEQ ID NO: 3406213 - DNA, 14 bp, Homo sapiens
ccacctggctcccc

SEQ ID NO: 3406214 - DNA, 20 bp, Homo sapiens
ccacctttgtttctccccca

SEQ ID NO: 3406215 - DNA, 14 bp, Homo sapiens
ccactcaaaggcca

SEQ ID NO: 3406216 - DNA, 16 bp, Homo sapiens
ccactcaaaggccaga

SEQ ID NO: 3406217 - DNA, 19 bp, Homo sapiens
ccactcaaaggccagacct

SEQ ID NO: 3406218 - DNA, 16 bp, Homo sapiens
ccactctccacctcac

SEQ ID NO: 3406219 - DNA, 17 bp, Homo sapiens
ccactctccacctcact

SEQ ID NO: 3406220 - DNA, 18 bp, Homo sapiens
ccactctccacctcacta

SEQ ID NO: 3406221 - DNA, 22 bp, Homo sapiens
ccactggcatcgcagcttcctg

SEQ ID NO: 3406222 - DNA, 14 bp, Homo sapiens
ccactttttgcagc

SEQ ID NO: 3406223 - DNA, 17 bp, Homo sapiens
ccactttttgcagcttt

SEQ ID NO: 3406224 - DNA, 16 bp, Homo sapiens
ccagaaagaaaatgaa

SEQ ID NO: 3406225 - DNA, 17 bp, Homo sapiens
ccagaagaagatggctg

SEQ ID NO: 3406226 - DNA, 21 bp, Homo sapiens
ccagacctgcagacgcccaga

SEQ ID NO: 3406227 - DNA, 19 bp, Homo sapiens
ccagacctgcccctccctc

SEQ ID NO: 3406228 - DNA, 16 bp, Homo sapiens
ccagagaaagcgcaga

SEQ ID NO: 3406229 - DNA, 23 bp, Homo sapiens
ccagagcagatgcagagagccat

SEQ ID NO: 3406230 - DNA, 13 bp, Homo sapiens
ccagaggggcctg

SEQ ID NO: 3406231 - DNA, 22 bp, Homo sapiens
ccagaggggcctgccacctgga

SEQ ID NO: 3406232 - DNA, 17 bp, Homo sapiens
ccagaggtaacagaaca

SEQ ID NO: 3406233 - DNA, 21 bp, Homo sapiens
ccagaggtaacagaacagctt

SEQ ID NO: 3406234 - DNA, 21 bp, Homo sapiens
ccagattggctcacactgaga

SEQ ID NO: 3406235 - DNA, 16 bp, Homo sapiens
ccagcaaagagaatgt

SEQ ID NO: 3406236 - DNA, 18 bp, Homo sapiens
ccagcaccggaccagcct

SEQ ID NO: 3406237 - DNA, 19 bp, Homo sapiens
ccagcaccggaccagcctg

SEQ ID NO: 3406238 - DNA, 22 bp, Homo sapiens
ccagcaccggccccatttaccc

SEQ ID NO: 3406239 - DNA, 14 bp, Homo sapiens
ccagcactgaggaa

SEQ ID NO: 3406240 - DNA, 14 bp, Homo sapiens
ccagccttatgtgt

SEQ ID NO: 3406241 - DNA, 15 bp, Homo sapiens
ccagcggacagtggc

SEQ ID NO: 3406242 - DNA, 21 bp, Homo sapiens
ccagctagtgccaaataattg

SEQ ID NO: 3406243 - DNA, 17 bp, Homo sapiens
ccagctgcccttccgca

SEQ ID NO: 3406244 - DNA, 20 bp, Homo sapiens
ccagctgcccttccgcagtg

SEQ ID NO: 3406245 - DNA, 13 bp, Homo sapiens
ccaggactctgca

SEQ ID NO: 3406246 - DNA, 16 bp, Homo sapiens
ccaggactctgcagcc

SEQ ID NO: 3406247 - DNA, 19 bp, Homo sapiens
ccaggactctgcagcctca

SEQ ID NO: 3406248 - DNA, 21 bp, Homo sapiens
ccaggactctgcagcctcaga

SEQ ID NO: 3406249 - DNA, 12 bp, Homo sapiens
ccaggactgggc

SEQ ID NO: 3406250 - DNA, 13 bp, Homo sapiens
ccaggactgggcc

SEQ ID NO: 3406251 - DNA, 14 bp, Homo sapiens
ccaggagctcccct

SEQ ID NO: 3406252 - DNA, 16 bp, Homo sapiens
ccaggagttcccaaat

SEQ ID NO: 3406253 - DNA, 17 bp, Homo sapiens
ccaggatcatggtgtaa

SEQ ID NO: 3406254 - DNA, 20 bp, Homo sapiens
ccaggccaggactctgcagc

SEQ ID NO: 3406255 - DNA, 17 bp, Homo sapiens
ccaggctgccggctccc

SEQ ID NO: 3406256 - DNA, 14 bp, Homo sapiens
ccagggaaaaagac

SEQ ID NO: 3406257 - DNA, 19 bp, Homo sapiens
ccagggagctgcaggggca

SEQ ID NO: 3406258 - DNA, 15 bp, Homo sapiens
ccagggcagccaggg

SEQ ID NO: 3406259 - DNA, 20 bp, Homo sapiens
ccagggcagccagggagagc

SEQ ID NO: 3406260 - DNA, 13 bp, Homo sapiens
ccagggcctgcga

SEQ ID NO: 3406261 - DNA, 13 bp, Homo sapiens
ccagggctggact

SEQ ID NO: 3406262 - DNA, 16 bp, Homo sapiens
ccagggctggactgag

SEQ ID NO: 3406263 - DNA, 23 bp, Homo sapiens
ccagtatcctgctggttcactct

SEQ ID NO: 3406264 - DNA, 19 bp, Homo sapiens
ccagttgaactgcaggaag

SEQ ID NO: 3406265 - DNA, 21 bp, Homo sapiens
ccagttgaactgcaggaagag

SEQ ID NO: 3406266 - DNA, 18 bp, Homo sapiens
ccagtttagctttttcct

SEQ ID NO: 3406267 - DNA, 21 bp, Homo sapiens
ccatatatgctgtatttcttt

SEQ ID NO: 3406268 - DNA, 22 bp, Homo sapiens
ccatcatgtttacagaggacag

SEQ ID NO: 3406269 - DNA, 20 bp, Homo sapiens
ccatgaagctggaagcactg

SEQ ID NO: 3406270 - DNA, 13 bp, Homo sapiens
ccatgctccgcct

SEQ ID NO: 3406271 - DNA, 13 bp, Homo sapiens
ccatggccctgcc

SEQ ID NO: 3406272 - DNA, 13 bp, Homo sapiens
ccatgggcttcac

SEQ ID NO: 3406273 - DNA, 23 bp, Homo sapiens
ccatgtatagctagctatttcta

SEQ ID NO: 3406274 - DNA, 18 bp, Homo sapiens
ccatgtgctacaggggcc

SEQ ID NO: 3406275 - DNA, 16 bp, Homo sapiens
ccatttcatctatttc

SEQ ID NO: 3406276 - DNA, 21 bp, Homo sapiens
ccatttcatctatttctgaga

SEQ ID NO: 3406277 - DNA, 13 bp, Homo sapiens
ccattttgtgaat

SEQ ID NO: 3406278 - DNA, 14 bp, Homo sapiens
ccatttttgctaat

SEQ ID NO: 3406279 - DNA, 18 bp, Homo sapiens
ccatttttgctaattatc

SEQ ID NO: 3406280 - DNA, 13 bp, Homo sapiens
cccacagcgctgg

SEQ ID NO: 3406281 - DNA, 19 bp, Homo sapiens
cccacagcgctggccggga

SEQ ID NO: 3406282 - DNA, 16 bp, Homo sapiens
cccacccacttctgca

SEQ ID NO: 3406283 - DNA, 16 bp, Homo sapiens
cccaccctcagccgct

SEQ ID NO: 3406284 - DNA, 14 bp, Homo sapiens
cccaccgcccactc

SEQ ID NO: 3406285 - DNA, 15 bp, Homo sapiens
cccactctccacctc

SEQ ID NO: 3406286 - DNA, 16 bp, Homo sapiens
cccactctccacctca

SEQ ID NO: 3406287 - DNA, 22 bp, Homo sapiens
cccactctccacctcactagct

SEQ ID NO: 3406288 - DNA, 15 bp, Homo sapiens
cccactggcagcatc

SEQ ID NO: 3406289 - DNA, 22 bp, Homo sapiens
cccactttgctgttccttactt

SEQ ID NO: 3406290 - DNA, 20 bp, Homo sapiens
cccagaggggcctgccacct

SEQ ID NO: 3406291 - DNA, 23 bp, Homo sapiens
cccagaggtaacagaacagcttc

SEQ ID NO: 3406292 - DNA, 24 bp, Homo sapiens
cccagcactgaggaagaacggggc

SEQ ID NO: 3406293 - DNA, 18 bp, Homo sapiens
cccagcggacagtggcag

SEQ ID NO: 3406294 - DNA, 23 bp, Homo sapiens
cccagcggacagtggcaggacag

SEQ ID NO: 3406295 - DNA, 21 bp, Homo sapiens
cccagctatggttctctcgca

SEQ ID NO: 3406296 - DNA, 18 bp, Homo sapiens
cccaggactggctgcccc

SEQ ID NO: 3406297 - DNA, 12 bp, Homo sapiens
cccaggactggg

SEQ ID NO: 3406298 - DNA, 13 bp, Homo sapiens
cccaggactgggc

SEQ ID NO: 3406299 - DNA, 14 bp, Homo sapiens
cccaggactgggcc

SEQ ID NO: 3406300 - DNA, 17 bp, Homo sapiens
cccaggccaggactctg

SEQ ID NO: 3406301 - DNA, 18 bp, Homo sapiens
cccaggccaggactctgc

SEQ ID NO: 3406302 - DNA, 22 bp, Homo sapiens
cccaggccaggactctgcagcc

SEQ ID NO: 3406303 - DNA, 23 bp, Homo sapiens
cccaggccaggactctgcagcct

SEQ ID NO: 3406304 - DNA, 20 bp, Homo sapiens
cccaggctgccggctcccct

SEQ ID NO: 3406305 - DNA, 15 bp, Homo sapiens
cccagggaagttttg

SEQ ID NO: 3406306 - DNA, 20 bp, Homo sapiens
cccagtgatctcgactcccc

SEQ ID NO: 3406307 - DNA, 15 bp, Homo sapiens
cccatgttctgtccc

SEQ ID NO: 3406308 - DNA, 21 bp, Homo sapiens
cccatgttctgtcccttgccc

SEQ ID NO: 3406309 - DNA, 18 bp, Homo sapiens
cccattccttcccagagg

SEQ ID NO: 3406310 - DNA, 22 bp, Homo sapiens
cccatttttgctaattatcaat

SEQ ID NO: 3406311 - DNA, 16 bp, Homo sapiens
ccccaatccctgaccc

SEQ ID NO: 3406312 - DNA, 16 bp, Homo sapiens
ccccacccacttctgc

SEQ ID NO: 3406313 - DNA, 16 bp, Homo sapiens
ccccaccccagggcag

SEQ ID NO: 3406314 - DNA, 16 bp, Homo sapiens
ccccaccgccgtggag

SEQ ID NO: 3406315 - DNA, 22 bp, Homo sapiens
ccccagagaaagcgcagatgct

SEQ ID NO: 3406316 - DNA, 19 bp, Homo sapiens
ccccaggactggctgcccc

SEQ ID NO: 3406317 - DNA, 13 bp, Homo sapiens
ccccaggactggg

SEQ ID NO: 3406318 - DNA, 14 bp, Homo sapiens
ccccaggactgggc

SEQ ID NO: 3406319 - DNA, 22 bp, Homo sapiens
ccccaggactgggccacttctg

SEQ ID NO: 3406320 - DNA, 15 bp, Homo sapiens
ccccattccctctct

SEQ ID NO: 3406321 - DNA, 17 bp, Homo sapiens
cccccagcactgaggaa

SEQ ID NO: 3406322 - DNA, 12 bp, Homo sapiens
cccccaggactg

SEQ ID NO: 3406323 - DNA, 15 bp, Homo sapiens
cccccaggactgggc

SEQ ID NO: 3406324 - DNA, 14 bp, Homo sapiens
ccccccagcactga

SEQ ID NO: 3406325 - DNA, 17 bp, Homo sapiens
ccccctggcctccccca

SEQ ID NO: 3406326 - DNA, 15 bp, Homo sapiens
cccctcctccactct

SEQ ID NO: 3406327 - DNA, 20 bp, Homo sapiens
cccctcgacagctctctggg

SEQ ID NO: 3406328 - DNA, 15 bp, Homo sapiens
cccctctgccccacc

SEQ ID NO: 3406329 - DNA, 15 bp, Homo sapiens
cccctgcaggaagga

SEQ ID NO: 3406330 - DNA, 18 bp, Homo sapiens
cccctgcaggaaggagct

SEQ ID NO: 3406331 - DNA, 15 bp, Homo sapiens
cccctgccacctcct

SEQ ID NO: 3406332 - DNA, 18 bp, Homo sapiens
cccctgcccccaggactg

SEQ ID NO: 3406333 - DNA, 19 bp, Homo sapiens
cccctggcctcccccactt

SEQ ID NO: 3406334 - DNA, 21 bp, Homo sapiens
cccctgtcccacctggctccc

SEQ ID NO: 3406335 - DNA, 13 bp, Homo sapiens
cccgagcctggct

SEQ ID NO: 3406336 - DNA, 14 bp, Homo sapiens
cccggtcccctctg

SEQ ID NO: 3406337 - DNA, 18 bp, Homo sapiens
cccgtaaggctgtacata

SEQ ID NO: 3406338 - DNA, 20 bp, Homo sapiens
cccgtaaggctgtacatagt

SEQ ID NO: 3406339 - DNA, 16 bp, Homo sapiens
cccgtgacacatgctc

SEQ ID NO: 3406340 - DNA, 13 bp, Homo sapiens
ccctacttgcagc

SEQ ID NO: 3406341 - DNA, 16 bp, Homo sapiens
ccctcattctgcatta

SEQ ID NO: 3406342 - DNA, 18 bp, Homo sapiens
ccctcattctgcattaat

SEQ ID NO: 3406343 - DNA, 12 bp, Homo sapiens
ccctcccacagc

SEQ ID NO: 3406344 - DNA, 10 bp, Homo sapiens
ccctcccact

SEQ ID NO: 3406345 - DNA, 15 bp, Homo sapiens
ccctcccccacccac

SEQ ID NO: 3406346 - DNA, 22 bp, Homo sapiens
ccctcctcagctccctgcctgt

SEQ ID NO: 3406347 - DNA, 23 bp, Homo sapiens
ccctcgaggcggatctttggaca

SEQ ID NO: 3406348 - DNA, 22 bp, Homo sapiens
ccctcgtgtcagctcaggcagc

SEQ ID NO: 3406349 - DNA, 15 bp, Homo sapiens
ccctcgtttgatagt

SEQ ID NO: 3406350 - DNA, 18 bp, Homo sapiens
ccctctagaggctgcctg

SEQ ID NO: 3406351 - DNA, 22 bp, Homo sapiens
ccctctagaggctgcctgggcc

SEQ ID NO: 3406352 - DNA, 18 bp, Homo sapiens
ccctctcccctgccccct

SEQ ID NO: 3406353 - DNA, 22 bp, Homo sapiens
ccctctcccctgccccctgcag

SEQ ID NO: 3406354 - DNA, 17 bp, Homo sapiens
ccctctgccccaccctc

SEQ ID NO: 3406355 - DNA, 18 bp, Homo sapiens
ccctctggtttgccggtg

SEQ ID NO: 3406356 - DNA, 15 bp, Homo sapiens
ccctgaagtcttgca

SEQ ID NO: 3406357 - DNA, 16 bp, Homo sapiens
ccctgaagtcttgcat

SEQ ID NO: 3406358 - DNA, 21 bp, Homo sapiens
ccctgagttgcaccattcttt

SEQ ID NO: 3406359 - DNA, 16 bp, Homo sapiens
ccctgcaatgcgtctt

SEQ ID NO: 3406360 - DNA, 17 bp, Homo sapiens
ccctgcaggaaggagct

SEQ ID NO: 3406361 - DNA, 23 bp, Homo sapiens
ccctgcaggaaggagctgcctgg

SEQ ID NO: 3406362 - DNA, 22 bp, Homo sapiens
ccctgcattggaactggaggca

SEQ ID NO: 3406363 - DNA, 14 bp, Homo sapiens
ccctgccacctcct

SEQ ID NO: 3406364 - DNA, 17 bp, Homo sapiens
ccctgcccccaggactg

SEQ ID NO: 3406365 - DNA, 22 bp, Homo sapiens
ccctgcccccaggactgggcca

SEQ ID NO: 3406366 - DNA, 18 bp, Homo sapiens
ccctgccccctgcaggaa

SEQ ID NO: 3406367 - DNA, 13 bp, Homo sapiens
ccctgctgctgcc

SEQ ID NO: 3406368 - DNA, 22 bp, Homo sapiens
ccctggccttgggccctctggt

SEQ ID NO: 3406369 - DNA, 16 bp, Homo sapiens
ccctgggcagtgagtg

SEQ ID NO: 3406370 - DNA, 21 bp, Homo sapiens
cccttgggggtcctcctccag

SEQ ID NO: 3406371 - DNA, 22 bp, Homo sapiens
cccttgggggtcctcctccagg

SEQ ID NO: 3406372 - DNA, 16 bp, Homo sapiens
ccgagcctggctccaa

SEQ ID NO: 3406373 - DNA, 14 bp, Homo sapiens
ccgcgcgtccagct

SEQ ID NO: 3406374 - DNA, 15 bp, Homo sapiens
ccggaccagcctggc

SEQ ID NO: 3406375 - DNA, 18 bp, Homo sapiens
ccggcatggacaatggac

SEQ ID NO: 3406376 - DNA, 22 bp, Homo sapiens
ccggcatggacaatggaccgga

SEQ ID NO: 3406377 - DNA, 17 bp, Homo sapiens
ccgggaccccgagcctg

SEQ ID NO: 3406378 - DNA, 19 bp, Homo sapiens
cctaatgtttatgagccag

SEQ ID NO: 3406379 - DNA, 14 bp, Homo sapiens
cctaattgaaattt

SEQ ID NO: 3406380 - DNA, 14 bp, Homo sapiens
cctagatatgaata

SEQ ID NO: 3406381 - DNA, 15 bp, Homo sapiens
cctatatgagaagaa

SEQ ID NO: 3406382 - DNA, 16 bp, Homo sapiens
cctatctagcatttat

SEQ ID NO: 3406383 - DNA, 21 bp, Homo sapiens
cctatgaaactggtttataat

SEQ ID NO: 3406384 - DNA, 12 bp, Homo sapiens
cctatgcaataa

SEQ ID NO: 3406385 - DNA, 21 bp, Homo sapiens
cctcaactcacctaatgttta

SEQ ID NO: 3406386 - DNA, 15 bp, Homo sapiens
cctcacccctggttc

SEQ ID NO: 3406387 - DNA, 15 bp, Homo sapiens
cctcagatgtgttga

SEQ ID NO: 3406388 - DNA, 17 bp, Homo sapiens
cctcagctctcagttgc

SEQ ID NO: 3406389 - DNA, 13 bp, Homo sapiens
cctcaggaaagaa

SEQ ID NO: 3406390 - DNA, 19 bp, Homo sapiens
cctcaggaaagaatagaaa

SEQ ID NO: 3406391 - DNA, 19 bp, Homo sapiens
cctcatctccagtatcctg

SEQ ID NO: 3406392 - DNA, 19 bp, Homo sapiens
cctccaacctggggggcag

SEQ ID NO: 3406393 - DNA, 16 bp, Homo sapiens
cctccacacctgcggc

SEQ ID NO: 3406394 - DNA, 13 bp, Homo sapiens
cctccagggctgg

SEQ ID NO: 3406395 - DNA, 16 bp, Homo sapiens
cctccagggctggact

SEQ ID NO: 3406396 - DNA, 21 bp, Homo sapiens
cctccagggctggactgaggc

SEQ ID NO: 3406397 - DNA, 12 bp, Homo sapiens
cctccagtgaag

SEQ ID NO: 3406398 - DNA, 19 bp, Homo sapiens
cctccctctagaggctgcc

SEQ ID NO: 3406399 - DNA, 12 bp, Homo sapiens
cctccctttctc

SEQ ID NO: 3406400 - DNA, 13 bp, Homo sapiens
cctccctttctcc

SEQ ID NO: 3406401 - DNA, 13 bp, Homo sapiens
cctcctcagctcc

SEQ ID NO: 3406402 - DNA, 16 bp, Homo sapiens
cctcctccactctccc

SEQ ID NO: 3406403 - DNA, 14 bp, Homo sapiens
cctcctccagggac

SEQ ID NO: 3406404 - DNA, 19 bp, Homo sapiens
cctcctgtgcctccctttt

SEQ ID NO: 3406405 - DNA, 14 bp, Homo sapiens
cctcgacagctctc

SEQ ID NO: 3406406 - DNA, 13 bp, Homo sapiens
cctcgtgtcatct

SEQ ID NO: 3406407 - DNA, 16 bp, Homo sapiens
cctcgttctccctggg

SEQ ID NO: 3406408 - DNA, 17 bp, Homo sapiens
cctcgttctccctggga

SEQ ID NO: 3406409 - DNA, 20 bp, Homo sapiens
cctcgttctccctgggaggc

SEQ ID NO: 3406410 - DNA, 20 bp, Homo sapiens
cctcgtttgatagtgcttct

SEQ ID NO: 3406411 - DNA, 14 bp, Homo sapiens
cctctatttcttta

SEQ ID NO: 3406412 - DNA, 16 bp, Homo sapiens
cctctcccctgccccc

SEQ ID NO: 3406413 - DNA, 20 bp, Homo sapiens
cctctcccctgccccctgca

SEQ ID NO: 3406414 - DNA, 22 bp, Homo sapiens
cctctcccctgccccctgcagg

SEQ ID NO: 3406415 - DNA, 22 bp, Homo sapiens
cctctcttgtgagccatagaga

SEQ ID NO: 3406416 - DNA, 14 bp, Homo sapiens
cctctgccccaccc

SEQ ID NO: 3406417 - DNA, 14 bp, Homo sapiens
cctctgtccccttc

SEQ ID NO: 3406418 - DNA, 21 bp, Homo sapiens
cctctgtccccttctctcatc

SEQ ID NO: 3406419 - DNA, 18 bp, Homo sapiens
cctcttaaaaaataaaaa

SEQ ID NO: 3406420 - DNA, 16 bp, Homo sapiens
cctcttttccccatga

SEQ ID NO: 3406421 - DNA, 21 bp, Homo sapiens
cctgaagccaggccatggcta

SEQ ID NO: 3406422 - DNA, 15 bp, Homo sapiens
cctgagatttcatct

SEQ ID NO: 3406423 - DNA, 16 bp, Homo sapiens
cctgagatttcatctg

SEQ ID NO: 3406424 - DNA, 17 bp, Homo sapiens
cctgagatttcatctgc

SEQ ID NO: 3406425 - DNA, 22 bp, Homo sapiens
cctgagatttcatctgctctcc

SEQ ID NO: 3406426 - DNA, 23 bp, Homo sapiens
cctgagatttcatctgctctcct

SEQ ID NO: 3406427 - DNA, 12 bp, Homo sapiens
cctgagcgctcc

SEQ ID NO: 3406428 - DNA, 18 bp, Homo sapiens
cctgagctaggaagagtc

SEQ ID NO: 3406429 - DNA, 15 bp, Homo sapiens
cctgatcaatgacag

SEQ ID NO: 3406430 - DNA, 17 bp, Homo sapiens
cctgatcaatgacagag

SEQ ID NO: 3406431 - DNA, 20 bp, Homo sapiens
cctgattaccagtctgatta

SEQ ID NO: 3406432 - DNA, 17 bp, Homo sapiens
cctgcaatgcgtcttgt

SEQ ID NO: 3406433 - DNA, 17 bp, Homo sapiens
cctgcaggaaggagctg

SEQ ID NO: 3406434 - DNA, 19 bp, Homo sapiens
cctgcattggaactggagg

SEQ ID NO: 3406435 - DNA, 20 bp, Homo sapiens
cctgcattggaactggaggc

SEQ ID NO: 3406436 - DNA, 16 bp, Homo sapiens
cctgccacctcctgcc

SEQ ID NO: 3406437 - DNA, 19 bp, Homo sapiens
cctgccacctcctgcctca

SEQ ID NO: 3406438 - DNA, 15 bp, Homo sapiens
cctgccacctggacc

SEQ ID NO: 3406439 - DNA, 12 bp, Homo sapiens
cctgcccccagg

SEQ ID NO: 3406440 - DNA, 15 bp, Homo sapiens
cctgcccccaggact

SEQ ID NO: 3406441 - DNA, 19 bp, Homo sapiens
cctgcccccaggactgggc

SEQ ID NO: 3406442 - DNA, 15 bp, Homo sapiens
cctgccccctgcagg

SEQ ID NO: 3406443 - DNA, 16 bp, Homo sapiens
cctgccccctgcagga

SEQ ID NO: 3406444 - DNA, 19 bp, Homo sapiens
cctgccccctgcaggaagg

SEQ ID NO: 3406445 - DNA, 15 bp, Homo sapiens
cctgcccctccctct

SEQ ID NO: 3406446 - DNA, 13 bp, Homo sapiens
cctgccgcagagc

SEQ ID NO: 3406447 - DNA, 15 bp, Homo sapiens
cctgccgcagagctg

SEQ ID NO: 3406448 - DNA, 19 bp, Homo sapiens
cctgcctcaggcctctgtg

SEQ ID NO: 3406449 - DNA, 21 bp, Homo sapiens
cctgcctccagggctggactg

SEQ ID NO: 3406450 - DNA, 23 bp, Homo sapiens
cctgcctccagggctggactgag

SEQ ID NO: 3406451 - DNA, 13 bp, Homo sapiens
cctgcctgtttcc

SEQ ID NO: 3406452 - DNA, 21 bp, Homo sapiens
cctgctgaaagtcctgctttc

SEQ ID NO: 3406453 - DNA, 16 bp, Homo sapiens
cctgctgctgcctgcc

SEQ ID NO: 3406454 - DNA, 17 bp, Homo sapiens
cctgctgctgcctgcct

SEQ ID NO: 3406455 - DNA, 21 bp, Homo sapiens
cctgctgtaaatttggcttct

SEQ ID NO: 3406456 - DNA, 21 bp, Homo sapiens
cctgctttgcctcgaaagtgt

SEQ ID NO: 3406457 - DNA, 23 bp, Homo sapiens
cctgctttgcctcgaaagtgtca

SEQ ID NO: 3406458 - DNA, 21 bp, Homo sapiens
cctggaataaacatctgtgtc

SEQ ID NO: 3406459 - DNA, 13 bp, Homo sapiens
cctggacccctgc

SEQ ID NO: 3406460 - DNA, 15 bp, Homo sapiens
cctggacccctgcat

SEQ ID NO: 3406461 - DNA, 23 bp, Homo sapiens
cctggacccgttcatgggggagg

SEQ ID NO: 3406462 - DNA, 12 bp, Homo sapiens
cctggagccctg

SEQ ID NO: 3406463 - DNA, 21 bp, Homo sapiens
cctggcccaccccacccactt

SEQ ID NO: 3406464 - DNA, 22 bp, Homo sapiens
cctggcccaccccacccacttc

SEQ ID NO: 3406465 - DNA, 17 bp, Homo sapiens
cctggcctcccccactt

SEQ ID NO: 3406466 - DNA, 19 bp, Homo sapiens
cctggccttgtcctcagcc

SEQ ID NO: 3406467 - DNA, 22 bp, Homo sapiens
cctggccttgtcctcagccagt

SEQ ID NO: 3406468 - DNA, 16 bp, Homo sapiens
cctggcggcaggaagc

SEQ ID NO: 3406469 - DNA, 22 bp, Homo sapiens
cctggctccaaaccctcgaggc

SEQ ID NO: 3406470 - DNA, 19 bp, Homo sapiens
cctgggcctgttcacgtgt

SEQ ID NO: 3406471 - DNA, 20 bp, Homo sapiens
cctgggcttggtaagtgaat

SEQ ID NO: 3406472 - DNA, 12 bp, Homo sapiens
cctggtggccct

SEQ ID NO: 3406473 - DNA, 22 bp, Homo sapiens
cctggtggccctctcccctgcc

SEQ ID NO: 3406474 - DNA, 23 bp, Homo sapiens
cctggtggccctctcccctgccc

SEQ ID NO: 3406475 - DNA, 15 bp, Homo sapiens
cctggttctcatctt

SEQ ID NO: 3406476 - DNA, 13 bp, Homo sapiens
cctgtcccacctg

SEQ ID NO: 3406477 - DNA, 16 bp, Homo sapiens
cctgtctcctggcggt

SEQ ID NO: 3406478 - DNA, 15 bp, Homo sapiens
cctgtctgtttatat

SEQ ID NO: 3406479 - DNA, 18 bp, Homo sapiens
cctgtgcctcccttttct

SEQ ID NO: 3406480 - DNA, 17 bp, Homo sapiens
cctgttggcagctctag

SEQ ID NO: 3406481 - DNA, 20 bp, Homo sapiens
cctgtttcccgtaaggctgt

SEQ ID NO: 3406482 - DNA, 22 bp, Homo sapiens
ccttactttactgcctgaataa

SEQ ID NO: 3406483 - DNA, 13 bp, Homo sapiens
ccttacttttaaa

SEQ ID NO: 3406484 - DNA, 17 bp, Homo sapiens
ccttacttttaaaataa

SEQ ID NO: 3406485 - DNA, 18 bp, Homo sapiens
ccttcaagaaaacaggca

SEQ ID NO: 3406486 - DNA, 15 bp, Homo sapiens
ccttcagccctcacc

SEQ ID NO: 3406487 - DNA, 19 bp, Homo sapiens
ccttccacgtgtatgcaag

SEQ ID NO: 3406488 - DNA, 22 bp, Homo sapiens
ccttcccagaggggcctgccac

SEQ ID NO: 3406489 - DNA, 21 bp, Homo sapiens
ccttcctggagcccagaggag

SEQ ID NO: 3406490 - DNA, 14 bp, Homo sapiens
ccttcggtcacctg

SEQ ID NO: 3406491 - DNA, 16 bp, Homo sapiens
ccttctctcatctctt

SEQ ID NO: 3406492 - DNA, 17 bp, Homo sapiens
ccttgagaattccctgt

SEQ ID NO: 3406493 - DNA, 14 bp, Homo sapiens
ccttgctacctcaa

SEQ ID NO: 3406494 - DNA, 22 bp, Homo sapiens
ccttgcttttatagttgtattt

SEQ ID NO: 3406495 - DNA, 20 bp, Homo sapiens
ccttgggggtcctcctccag

SEQ ID NO: 3406496 - DNA, 11 bp, Homo sapiens
ccttgtggcct

SEQ ID NO: 3406497 - DNA, 14 bp, Homo sapiens
ccttgtttctttct

SEQ ID NO: 3406498 - DNA, 15 bp, Homo sapiens
ccttgtttctttctg

SEQ ID NO: 3406499 - DNA, 13 bp, Homo sapiens
cctttgagacagt

SEQ ID NO: 3406500 - DNA, 15 bp, Homo sapiens
cctttgagacagttt

SEQ ID NO: 3406501 - DNA, 21 bp, Homo sapiens
cctttgtaatatgagaatgta

SEQ ID NO: 3406502 - DNA, 23 bp, Homo sapiens
cctttgtaatatgagaatgtatt

SEQ ID NO: 3406503 - DNA, 13 bp, Homo sapiens
ccttttttaagat

SEQ ID NO: 3406504 - DNA, 11 bp, Homo sapiens
cgaaataacaa

SEQ ID NO: 3406505 - DNA, 16 bp, Homo sapiens
cgaaataacaatgtta

SEQ ID NO: 3406506 - DNA, 20 bp, Homo sapiens
cgaaataacaatgttaagga

SEQ ID NO: 3406507 - DNA, 22 bp, Homo sapiens
cgaatgacaaaatcatctttgt

SEQ ID NO: 3406508 - DNA, 17 bp, Homo sapiens
cgagaactttcattttt

SEQ ID NO: 3406509 - DNA, 15 bp, Homo sapiens
cgaggtatgtttata

SEQ ID NO: 3406510 - DNA, 18 bp, Homo sapiens
cgatatgaaaaataaata

SEQ ID NO: 3406511 - DNA, 21 bp, Homo sapiens
cgatgggcccaattcttacaa

SEQ ID NO: 3406512 - DNA, 21 bp, Homo sapiens
cgattgcaggagtccctgcca

SEQ ID NO: 3406513 - DNA, 14 bp, Homo sapiens
cgattttaaatatt

SEQ ID NO: 3406514 - DNA, 18 bp, Homo sapiens
cgcagtcgtcccaggctg

SEQ ID NO: 3406515 - DNA, 17 bp, Homo sapiens
cgccaaataatgtctct

SEQ ID NO: 3406516 - DNA, 20 bp, Homo sapiens
cgcccactctccacctcact

SEQ ID NO: 3406517 - DNA, 22 bp, Homo sapiens
cgcccactctccacctcactag

SEQ ID NO: 3406518 - DNA, 21 bp, Homo sapiens
cgcccctcccacagcgctggc

SEQ ID NO: 3406519 - DNA, 15 bp, Homo sapiens
cgccttatttatatt

SEQ ID NO: 3406520 - DNA, 18 bp, Homo sapiens
cgctggccgggaccccga

SEQ ID NO: 3406521 - DNA, 15 bp, Homo sapiens
cgctgtgagtgagtg

SEQ ID NO: 3406522 - DNA, 13 bp, Homo sapiens
cgctttcatgaac

SEQ ID NO: 3406523 - DNA, 20 bp, Homo sapiens
cgctttcatgaacacagcct

SEQ ID NO: 3406524 - DNA, 14 bp, Homo sapiens
cggaccagcctggc

SEQ ID NO: 3406525 - DNA, 21 bp, Homo sapiens
cggcatggacaatggaccgga

SEQ ID NO: 3406526 - DNA, 19 bp, Homo sapiens
cgggagcctccctgcctca

SEQ ID NO: 3406527 - DNA, 23 bp, Homo sapiens
cgggcaggggagggtcagccagg

SEQ ID NO: 3406528 - DNA, 15 bp, Homo sapiens
cgggcgcactgcctc

SEQ ID NO: 3406529 - DNA, 23 bp, Homo sapiens
cggggctcttctcatttcacccc

SEQ ID NO: 3406530 - DNA, 15 bp, Homo sapiens
cgggtcatctgtacc

SEQ ID NO: 3406531 - DNA, 14 bp, Homo sapiens
cggtcacctgttgg

SEQ ID NO: 3406532 - DNA, 22 bp, Homo sapiens
cggtgggggtagggggctggag

SEQ ID NO: 3406533 - DNA, 22 bp, Homo sapiens
cggttcactcttctcagccact

SEQ ID NO: 3406534 - DNA, 21 bp, Homo sapiens
cggttcctcgttctccctggg

SEQ ID NO: 3406535 - DNA, 12 bp, Homo sapiens
cgtaaggctgta

SEQ ID NO: 3406536 - DNA, 17 bp, Homo sapiens
cgtaaggctgtacatag

SEQ ID NO: 3406537 - DNA, 17 bp, Homo sapiens
cgtaccgcttccttaga

SEQ ID NO: 3406538 - DNA, 17 bp, Homo sapiens
cgtataatgctttctga

SEQ ID NO: 3406539 - DNA, 19 bp, Homo sapiens
cgtcattacagggcacagg

SEQ ID NO: 3406540 - DNA, 15 bp, Homo sapiens
cgtcttgtgaaattg

SEQ ID NO: 3406541 - DNA, 18 bp, Homo sapiens
cgtcttgtgaaattgtgt

SEQ ID NO: 3406542 - DNA, 19 bp, Homo sapiens
cgtcttgtgaaattgtgta

SEQ ID NO: 3406543 - DNA, 20 bp, Homo sapiens
cgtcttgtgaaattgtgtag

SEQ ID NO: 3406544 - DNA, 15 bp, Homo sapiens
cgtgattctgttcta

SEQ ID NO: 3406545 - DNA, 12 bp, Homo sapiens
cgtgtgtagagt

SEQ ID NO: 3406546 - DNA, 18 bp, Homo sapiens
cgtgtgtagagttaagaa

SEQ ID NO: 3406547 - DNA, 21 bp, Homo sapiens
cgttcatgggggagggggcag

SEQ ID NO: 3406548 - DNA, 12 bp, Homo sapiens
cgtttcctaccg

SEQ ID NO: 3406549 - DNA, 15 bp, Homo sapiens
cgtttggttaaagta

SEQ ID NO: 3406550 - DNA, 16 bp, Homo sapiens
ctaaagagagaatgta

SEQ ID NO: 3406551 - DNA, 12 bp, Homo sapiens
ctaaagctttat

SEQ ID NO: 3406552 - DNA, 22 bp, Homo sapiens
ctaaagctttatctttgtgtaa

SEQ ID NO: 3406553 - DNA, 14 bp, Homo sapiens
ctaaagggagaaat

SEQ ID NO: 3406554 - DNA, 17 bp, Homo sapiens
ctaaagtaccagattat

SEQ ID NO: 3406555 - DNA, 23 bp, Homo sapiens
ctaaatattggtttgttattctt

SEQ ID NO: 3406556 - DNA, 14 bp, Homo sapiens
ctaacacagcatgt

SEQ ID NO: 3406557 - DNA, 17 bp, Homo sapiens
ctaacacagcatgtgta

SEQ ID NO: 3406558 - DNA, 17 bp, Homo sapiens
ctaacagataagcaaga

SEQ ID NO: 3406559 - DNA, 21 bp, Homo sapiens
ctaactgactctgttattgat

SEQ ID NO: 3406560 - DNA, 21 bp, Homo sapiens
ctaagaatagactaagtttgt

SEQ ID NO: 3406561 - DNA, 19 bp, Homo sapiens
ctaagccagcaccggacca

SEQ ID NO: 3406562 - DNA, 14 bp, Homo sapiens
ctaagggtgtcaag

SEQ ID NO: 3406563 - DNA, 12 bp, Homo sapiens
ctaataataaat

SEQ ID NO: 3406564 - DNA, 15 bp, Homo sapiens
ctaataataaatgca

SEQ ID NO: 3406565 - DNA, 17 bp, Homo sapiens
ctaataataaatgcata

SEQ ID NO: 3406566 - DNA, 21 bp, Homo sapiens
ctaataataaatgcatagagc

SEQ ID NO: 3406567 - DNA, 12 bp, Homo sapiens
ctaatatacttt

SEQ ID NO: 3406568 - DNA, 12 bp, Homo sapiens
ctaatatcagca

SEQ ID NO: 3406569 - DNA, 22 bp, Homo sapiens
ctaatctccacccaatgaatga

SEQ ID NO: 3406570 - DNA, 18 bp, Homo sapiens
ggccaggctgcctggcct

SEQ ID NO: 3406571 - DNA, 19 bp, Homo sapiens
ggccagtggctggatctgt

SEQ ID NO: 3406572 - DNA, 19 bp, Homo sapiens
ggccatatatgctgtattt

SEQ ID NO: 3406573 - DNA, 22 bp, Homo sapiens
ggccatatatgctgtatttctt

SEQ ID NO: 3406574 - DNA, 21 bp, Homo sapiens
ggccatgttgtgcctccctgg

SEQ ID NO: 3406575 - DNA, 22 bp, Homo sapiens
ggcccaccccacccacttctgc

SEQ ID NO: 3406576 - DNA, 17 bp, Homo sapiens
ggccctccacacctgcg

SEQ ID NO: 3406577 - DNA, 23 bp, Homo sapiens
ggccctctcccctgccccctgca

SEQ ID NO: 3406578 - DNA, 18 bp, Homo sapiens
ggccgcgcgtccagctgc

SEQ ID NO: 3406579 - DNA, 19 bp, Homo sapiens
ggccgcgcgtccagctgcc

SEQ ID NO: 3406580 - DNA, 14 bp, Homo sapiens
ggcctaggccagga

SEQ ID NO: 3406581 - DNA, 19 bp, Homo sapiens
ggcctatgaaactggttta

SEQ ID NO: 3406582 - DNA, 11 bp, Homo sapiens
ggcctccccca

SEQ ID NO: 3406583 - DNA, 14 bp, Homo sapiens
ggcctcccccactt

SEQ ID NO: 3406584 - DNA, 15 bp, Homo sapiens
ggcctcccccacttt

SEQ ID NO: 3406585 - DNA, 20 bp, Homo sapiens
ggcctctcattccagaggaa

SEQ ID NO: 3406586 - DNA, 20 bp, Homo sapiens
ggcctgagatttcatctgct

SEQ ID NO: 3406587 - DNA, 14 bp, Homo sapiens
ggcctgccacctgg

SEQ ID NO: 3406588 - DNA, 17 bp, Homo sapiens
ggcctgccacctggacc

SEQ ID NO: 3406589 - DNA, 19 bp, Homo sapiens
ggcctgccacctggacccc

SEQ ID NO: 3406590 - DNA, 16 bp, Homo sapiens
ggctatcctgctgaaa

SEQ ID NO: 3406591 - DNA, 14 bp, Homo sapiens
ggctcacactgaga

SEQ ID NO: 3406592 - DNA, 17 bp, Homo sapiens
ggctcacactgagaatg

SEQ ID NO: 3406593 - DNA, 14 bp, Homo sapiens
ggctcagagtgggg

SEQ ID NO: 3406594 - DNA, 16 bp, Homo sapiens
ggctcatcagaactga

SEQ ID NO: 3406595 - DNA, 17 bp, Homo sapiens
ggctccaaaccctcgag

SEQ ID NO: 3406596 - DNA, 12 bp, Homo sapiens
ggctcttctcat

SEQ ID NO: 3406597 - DNA, 20 bp, Homo sapiens
ggctcttctcatttcacccc

SEQ ID NO: 3406598 - DNA, 18 bp, Homo sapiens
ggctgccatgtgaagagg

SEQ ID NO: 3406599 - DNA, 13 bp, Homo sapiens
ggctgcctgggcc

SEQ ID NO: 3406600 - DNA, 12 bp, Homo sapiens
ggctggacctgg

SEQ ID NO: 3406601 - DNA, 13 bp, Homo sapiens
ggctggactgagg

SEQ ID NO: 3406602 - DNA, 14 bp, Homo sapiens
ggctggctctgaga

SEQ ID NO: 3406603 - DNA, 16 bp, Homo sapiens
ggcttacggccctggc

SEQ ID NO: 3406604 - DNA, 17 bp, Homo sapiens
ggcttcactcctgctgt

SEQ ID NO: 3406605 - DNA, 21 bp, Homo sapiens
ggcttcactgtataaatagga

SEQ ID NO: 3406606 - DNA, 22 bp, Homo sapiens
ggcttcactgtataaataggag

SEQ ID NO: 3406607 - DNA, 13 bp, Homo sapiens
ggcttgcctgcag

SEQ ID NO: 3406608 - DNA, 21 bp, Homo sapiens
ggcttgctgtttactcccttc

SEQ ID NO: 3406609 - DNA, 17 bp, Homo sapiens
ggctttggcaacagaaa

SEQ ID NO: 3406610 - DNA, 16 bp, Homo sapiens
gggaaccatgaagctg

SEQ ID NO: 3406611 - DNA, 22 bp, Homo sapiens
gggaagatgaaaccgtccctga

SEQ ID NO: 3406612 - DNA, 22 bp, Homo sapiens
gggaatggcacagcccaaagaa

SEQ ID NO: 3406613 - DNA, 13 bp, Homo sapiens
gggaccagggcat

SEQ ID NO: 3406614 - DNA, 18 bp, Homo sapiens
gggaccccgagcctggct

SEQ ID NO: 3406615 - DNA, 20 bp, Homo sapiens
gggaccccgagcctggctcc

SEQ ID NO: 3406616 - DNA, 17 bp, Homo sapiens
gggacctataactgccc

SEQ ID NO: 3406617 - DNA, 17 bp, Homo sapiens
gggagagcccaggagct

SEQ ID NO: 3406618 - DNA, 12 bp, Homo sapiens
gggagcctccct

SEQ ID NO: 3406619 - DNA, 15 bp, Homo sapiens
gggagggggcagaag

SEQ ID NO: 3406620 - DNA, 17 bp, Homo sapiens
gggagggtcagccaggg

SEQ ID NO: 3406621 - DNA, 13 bp, Homo sapiens
gggatagatgtgt

SEQ ID NO: 3406622 - DNA, 14 bp, Homo sapiens
gggatgtctctcat

SEQ ID NO: 3406623 - DNA, 14 bp, Homo sapiens
gggcacaggccatg

SEQ ID NO: 3406624 - DNA, 14 bp, Homo sapiens
gggcagccagggag

SEQ ID NO: 3406625 - DNA, 19 bp, Homo sapiens
gggcagccagggagagccc

SEQ ID NO: 3406626 - DNA, 20 bp, Homo sapiens
gggcagccagggagagccca

SEQ ID NO: 3406627 - DNA, 22 bp, Homo sapiens
gggcagccagggagagcccagg

SEQ ID NO: 3406628 - DNA, 23 bp, Homo sapiens
gggcaggggagggtcagccaggg

SEQ ID NO: 3406629 - DNA, 16 bp, Homo sapiens
gggcagtgagtgccat

SEQ ID NO: 3406630 - DNA, 20 bp, Homo sapiens
gggcagtgagtgccatgctt

SEQ ID NO: 3406631 - DNA, 20 bp, Homo sapiens
gggcagtggtgtggagaagc

SEQ ID NO: 3406632 - DNA, 19 bp, Homo sapiens
gggcatgtattagccagtc

SEQ ID NO: 3406633 - DNA, 22 bp, Homo sapiens
gggccacttctgggtggggcag

SEQ ID NO: 3406634 - DNA, 17 bp, Homo sapiens
gggcctaggccaggagt

SEQ ID NO: 3406635 - DNA, 18 bp, Homo sapiens
gggcctgccacctggacc

SEQ ID NO: 3406636 - DNA, 19 bp, Homo sapiens
gggctggactgaggcctga

SEQ ID NO: 3406637 - DNA, 14 bp, Homo sapiens
gggctggaggagcc

SEQ ID NO: 3406638 - DNA, 18 bp, Homo sapiens
gggctggaggagcccagg

SEQ ID NO: 3406639 - DNA, 21 bp, Homo sapiens
ggggaagacccattccttccc

SEQ ID NO: 3406640 - DNA, 23 bp, Homo sapiens
ggggaagatgaaaccgtccctga

SEQ ID NO: 3406641 - DNA, 15 bp, Homo sapiens
ggggaattcatctct

SEQ ID NO: 3406642 - DNA, 13 bp, Homo sapiens
ggggatagatgtg

SEQ ID NO: 3406643 - DNA, 16 bp, Homo sapiens
ggggctggctctgaga

SEQ ID NO: 3406644 - DNA, 16 bp, Homo sapiens
gggggctggaggagcc

SEQ ID NO: 3406645 - DNA, 20 bp, Homo sapiens
gggggtcctcctccagggac

SEQ ID NO: 3406646 - DNA, 18 bp, Homo sapiens
gggtagggggctggagga

SEQ ID NO: 3406647 - DNA, 15 bp, Homo sapiens
gggtcctcctccagg

SEQ ID NO: 3406648 - DNA, 12 bp, Homo sapiens
gggtggaagctt

SEQ ID NO: 3406649 - DNA, 13 bp, Homo sapiens
gggttaagaaata

SEQ ID NO: 3406650 - DNA, 17 bp, Homo sapiens
gggtttacaacaaacac

SEQ ID NO: 3406651 - DNA, 12 bp, Homo sapiens
ggtaaataaagc

SEQ ID NO: 3406652 - DNA, 16 bp, Homo sapiens
ggtaacagaacagctt

SEQ ID NO: 3406653 - DNA, 21 bp, Homo sapiens
ggtaacagaacagcttcaggt

SEQ ID NO: 3406654 - DNA, 23 bp, Homo sapiens
ggtaagaaagccaccttgttaca

SEQ ID NO: 3406655 - DNA, 14 bp, Homo sapiens
ggtaagtgaattta

SEQ ID NO: 3406656 - DNA, 20 bp, Homo sapiens
ggtaatttaaattggtcatg

SEQ ID NO: 3406657 - DNA, 19 bp, Homo sapiens
ggtagacctgtctcctggc

SEQ ID NO: 3406658 - DNA, 22 bp, Homo sapiens
ggtagacctgtctcctggcggt

SEQ ID NO: 3406659 - DNA, 16 bp, Homo sapiens
ggtaggaactgctggg

SEQ ID NO: 3406660 - DNA, 17 bp, Homo sapiens
ggtagggggctggagga

SEQ ID NO: 3406661 - DNA, 21 bp, Homo sapiens
ggtatctgcatgtaaaatctt

SEQ ID NO: 3406662 - DNA, 19 bp, Homo sapiens
ggtcagccagggcctgcga

SEQ ID NO: 3406663 - DNA, 20 bp, Homo sapiens
ggtcattcctaatgcattag

SEQ ID NO: 3406664 - DNA, 22 bp, Homo sapiens
ggtcccctctgccccaccctca

SEQ ID NO: 3406665 - DNA, 20 bp, Homo sapiens
ggtctccatgaagaagctgg

SEQ ID NO: 3406666 - DNA, 21 bp, Homo sapiens
ggtctgtgtgtgtgtatgtgg

SEQ ID NO: 3406667 - DNA, 12 bp, Homo sapiens
ggtctttgtaag

SEQ ID NO: 3406668 - DNA, 12 bp, Homo sapiens
ggtgcaggtaga

SEQ ID NO: 3406669 - DNA, 16 bp, Homo sapiens
ggtgcatgcaggtctc

SEQ ID NO: 3406670 - DNA, 19 bp, Homo sapiens
ggtggccctctcccctgcc

SEQ ID NO: 3406671 - DNA, 21 bp, Homo sapiens
ggtggccctctcccctgcccc

SEQ ID NO: 3406672 - DNA, 21 bp, Homo sapiens
ggtggcttcttttctttgtat

SEQ ID NO: 3406673 - DNA, 10 bp, Homo sapiens
ggtgggggta

SEQ ID NO: 3406674 - DNA, 21 bp, Homo sapiens
ggtggtgcaggtagacctgtc

SEQ ID NO: 3406675 - DNA, 21 bp, Homo sapiens
ggtggtgtctccaacccccca

SEQ ID NO: 3406676 - DNA, 16 bp, Homo sapiens
ggtgtaataagacata

SEQ ID NO: 3406677 - DNA, 20 bp, Homo sapiens
ggtgtagccctcccactttg

SEQ ID NO: 3406678 - DNA, 23 bp, Homo sapiens
ggtgtctccaaccccccagcact

SEQ ID NO: 3406679 - DNA, 15 bp, Homo sapiens
ggtgtgtgtctctga

SEQ ID NO: 3406680 - DNA, 16 bp, Homo sapiens
ggttaagaaatacctt

SEQ ID NO: 3406681 - DNA, 16 bp, Homo sapiens
gtcttcttacatgcat

SEQ ID NO: 3406682 - DNA, 16 bp, Homo sapiens
gtcttggttagagaag

SEQ ID NO: 3406683 - DNA, 13 bp, Homo sapiens
gtctttaaatcat

SEQ ID NO: 3406684 - DNA, 13 bp, Homo sapiens
gtctttctttgct

SEQ ID NO: 3406685 - DNA, 22 bp, Homo sapiens
gtctttctttgctgctgtggaa

SEQ ID NO: 3406686 - DNA, 13 bp, Homo sapiens
gtctttgtaagag

SEQ ID NO: 3406687 - DNA, 19 bp, Homo sapiens
gtgaaaccttttttaagat

SEQ ID NO: 3406688 - DNA, 19 bp, Homo sapiens
gtgaaactaacagataagc

SEQ ID NO: 3406689 - DNA, 15 bp, Homo sapiens
gtgaaattgtgtaga

SEQ ID NO: 3406690 - DNA, 20 bp, Homo sapiens
gtgaaggcctcgcaggaaga

SEQ ID NO: 3406691 - DNA, 14 bp, Homo sapiens
gtgaatttatgaga

SEQ ID NO: 3406692 - DNA, 18 bp, Homo sapiens
gtgacaaaatgttgataa

SEQ ID NO: 3406693 - DNA, 16 bp, Homo sapiens
gtgacatgtgaaacct

SEQ ID NO: 3406694 - DNA, 18 bp, Homo sapiens
gtgacatgtgaaaccttt

SEQ ID NO: 3406695 - DNA, 19 bp, Homo sapiens
gtgacatgtgaaacctttt

SEQ ID NO: 3406696 - DNA, 20 bp, Homo sapiens
gtgacatgtgaaaccttttt

SEQ ID NO: 3406697 - DNA, 23 bp, Homo sapiens
gtgacctgaggatttaagggatg

SEQ ID NO: 3406698 - DNA, 21 bp, Homo sapiens
gtgactatggagctgagcagg

SEQ ID NO: 3406699 - DNA, 13 bp, Homo sapiens
gtgagaaaggaaa

SEQ ID NO: 3406700 - DNA, 14 bp, Homo sapiens
gtgagaaaggaaaa

SEQ ID NO: 3406701 - DNA, 17 bp, Homo sapiens
gtgagactcgagaactt

SEQ ID NO: 3406702 - DNA, 20 bp, Homo sapiens
gtgagactcgagaactttca

SEQ ID NO: 3406703 - DNA, 22 bp, Homo sapiens
gtgagactcgagaactttcatt

SEQ ID NO: 3406704 - DNA, 21 bp, Homo sapiens
gtgagctttttgttccctcat

SEQ ID NO: 3406705 - DNA, 15 bp, Homo sapiens
gtgagtgccatgctt

SEQ ID NO: 3406706 - DNA, 20 bp, Homo sapiens
gtgagtgccatgctttttgg

SEQ ID NO: 3406707 - DNA, 21 bp, Homo sapiens
gtgatatggtactaaggagaa

SEQ ID NO: 3406708 - DNA, 22 bp, Homo sapiens
gtgatatggtactaaggagaat

SEQ ID NO: 3406709 - DNA, 15 bp, Homo sapiens
gtgatcatctttgct

SEQ ID NO: 3406710 - DNA, 19 bp, Homo sapiens
gtgatctcactaaaaatat

SEQ ID NO: 3406711 - DNA, 15 bp, Homo sapiens
gtgatgaaatatgaa

SEQ ID NO: 3406712 - DNA, 13 bp, Homo sapiens
gtgatgacatatt

SEQ ID NO: 3406713 - DNA, 10 bp, Homo sapiens
gtgatgtgtc

SEQ ID NO: 3406714 - DNA, 20 bp, Homo sapiens
gtgcaaacagtgtaagctta

SEQ ID NO: 3406715 - DNA, 14 bp, Homo sapiens
gtgcacaaagtggc

SEQ ID NO: 3406716 - DNA, 21 bp, Homo sapiens
gtgcaggtagacctgtctcct

SEQ ID NO: 3406717 - DNA, 18 bp, Homo sapiens
gtgcatttttgtgaaatg

SEQ ID NO: 3406718 - DNA, 14 bp, Homo sapiens
gtgcctcattgctt

SEQ ID NO: 3406719 - DNA, 12 bp, Homo sapiens
gtgcctgagagt

SEQ ID NO: 3406720 - DNA, 22 bp, Homo sapiens
gtgccttcaagaaaacaggcac

SEQ ID NO: 3406721 - DNA, 14 bp, Homo sapiens
gtgctaatatactt

SEQ ID NO: 3406722 - DNA, 19 bp, Homo sapiens
gtgctacaggggccagaag

SEQ ID NO: 3406723 - DNA, 21 bp, Homo sapiens
gtgcttcttgtaatatttctt

SEQ ID NO: 3406724 - DNA, 23 bp, Homo sapiens
gtggaaaaatgcccatttttgct

SEQ ID NO: 3406725 - DNA, 19 bp, Homo sapiens
gtggaaaggattctaaaca

SEQ ID NO: 3406726 - DNA, 16 bp, Homo sapiens
gtggaagcttggggaa

SEQ ID NO: 3406727 - DNA, 14 bp, Homo sapiens
gtggaagtgtgggt

SEQ ID NO: 3406728 - DNA, 19 bp, Homo sapiens
gtggaagtgtgggtctgtg

SEQ ID NO: 3406729 - DNA, 20 bp, Homo sapiens
gtggaagtgtgggtctgtgt

SEQ ID NO: 3406730 - DNA, 21 bp, Homo sapiens
gtggaagtgtgggtctgtgtg

SEQ ID NO: 3406731 - DNA, 14 bp, Homo sapiens
gtggatacagtcat

SEQ ID NO: 3406732 - DNA, 18 bp, Homo sapiens
gtggatggtgacttttga

SEQ ID NO: 3406733 - DNA, 23 bp, Homo sapiens
gtggcatgtgggttgtgatattg

SEQ ID NO: 3406734 - DNA, 20 bp, Homo sapiens
gtggccacaggctagatccc

SEQ ID NO: 3406735 - DNA, 17 bp, Homo sapiens
gtggccatatatgctgt

SEQ ID NO: 3406736 - DNA, 9 bp, Homo sapiens
gtggcctat

SEQ ID NO: 3406737 - DNA, 17 bp, Homo sapiens
gtggctggatctgtgag

SEQ ID NO: 3406738 - DNA, 12 bp, Homo sapiens
gtgggagatgaa

SEQ ID NO: 3406739 - DNA, 18 bp, Homo sapiens
gtgggcaggcaagccctt

SEQ ID NO: 3406740 - DNA, 19 bp, Homo sapiens
gtggggggtcccaaagagt

SEQ ID NO: 3406741 - DNA, 15 bp, Homo sapiens
gtgggggtctgtgtg

SEQ ID NO: 3406742 - DNA, 17 bp, Homo sapiens
gtggtctccttggaaat

SEQ ID NO: 3406743 - DNA, 19 bp, Homo sapiens
gtggtctttgtaagagtgt

SEQ ID NO: 3406744 - DNA, 23 bp, Homo sapiens
gtggttaatgccatggacagaag

SEQ ID NO: 3406745 - DNA, 23 bp, Homo sapiens
gtgtaaataatataaaatgtttc

SEQ ID NO: 3406746 - DNA, 17 bp, Homo sapiens
gtgtaacaggtctcctc

SEQ ID NO: 3406747 - DNA, 19 bp, Homo sapiens
gtgtaacaggtctcctctt

SEQ ID NO: 3406748 - DNA, 19 bp, Homo sapiens
gtgtaatctaagtatatgt

SEQ ID NO: 3406749 - DNA, 22 bp, Homo sapiens
gtgtaatttaaaattgtgatgt

SEQ ID NO: 3406750 - DNA, 13 bp, Homo sapiens
gtgtactcccagg

SEQ ID NO: 3406751 - DNA, 17 bp, Homo sapiens
gtgtagaagcattcctt

SEQ ID NO: 3406752 - DNA, 18 bp, Homo sapiens
gtgtagagttaagaagct

SEQ ID NO: 3406753 - DNA, 15 bp, Homo sapiens
gtgtatctaattccc

SEQ ID NO: 3406754 - DNA, 16 bp, Homo sapiens
gtgtatgactaaagag

SEQ ID NO: 3406755 - DNA, 22 bp, Homo sapiens
gtgtatgcaagtgggagatgaa

SEQ ID NO: 3406756 - DNA, 22 bp, Homo sapiens
gtgtattgagtcttaactgtat

SEQ ID NO: 3406757 - DNA, 17 bp, Homo sapiens
gtgtctgagtggcttca

SEQ ID NO: 3406758 - DNA, 13 bp, Homo sapiens
gtgtgtagagtta

SEQ ID NO: 3406759 - DNA, 16 bp, Homo sapiens
gtgtgtagagttaaga

SEQ ID NO: 3406760 - DNA, 21 bp, Homo sapiens
gtgtgtagagttaagaagctg

SEQ ID NO: 3406761 - DNA, 13 bp, Homo sapiens
gtgtgtatgtggg

SEQ ID NO: 3406762 - DNA, 14 bp, Homo sapiens
gtgtgtattcttaa

SEQ ID NO: 3406763 - DNA, 20 bp, Homo sapiens
gtgtgtcacccttaggccag

SEQ ID NO: 3406764 - DNA, 16 bp, Homo sapiens
gtgtgtgggagtgtgt

SEQ ID NO: 3406765 - DNA, 13 bp, Homo sapiens
gtgtgtgtatgtg

SEQ ID NO: 3406766 - DNA, 12 bp, Homo sapiens
gtgttatgtgaa

SEQ ID NO: 3406767 - DNA, 16 bp, Homo sapiens
gtgttatttcagatga

SEQ ID NO: 3406768 - DNA, 22 bp, Homo sapiens
gtgttggctgagggattctatt

SEQ ID NO: 3406769 - DNA, 16 bp, Homo sapiens
gtgtttatgtgtgtgt

SEQ ID NO: 3406770 - DNA, 23 bp, Homo sapiens
gtgtttttttccctctcctgtcc

SEQ ID NO: 3406771 - DNA, 23 bp, Homo sapiens
gttaacagcgtgtcaactttcat

SEQ ID NO: 3406772 - DNA, 19 bp, Homo sapiens
gttaagaagctgttgtaca

SEQ ID NO: 3406773 - DNA, 21 bp, Homo sapiens
gttaagaagctgttgtacatt

SEQ ID NO: 3406774 - DNA, 14 bp, Homo sapiens
gttaaggaaactct

SEQ ID NO: 3406775 - DNA, 15 bp, Homo sapiens
gttaccttactgaaa

SEQ ID NO: 3406776 - DNA, 12 bp, Homo sapiens
gttacttaaaca

SEQ ID NO: 3406777 - DNA, 15 bp, Homo sapiens
gttacttaaacatca

SEQ ID NO: 3406778 - DNA, 17 bp, Homo sapiens
gttacttagaatgccat

SEQ ID NO: 3406779 - DNA, 15 bp, Homo sapiens
gttatcgaaataaca

SEQ ID NO: 3406780 - DNA, 17 bp, Homo sapiens
gttatgatggaaaggaa

SEQ ID NO: 3406781 - DNA, 20 bp, Homo sapiens
gttcactcttctcagccact

SEQ ID NO: 3406782 - DNA, 23 bp, Homo sapiens
gttcagccaaacagtatgatgga

SEQ ID NO: 3406783 - DNA, 21 bp, Homo sapiens
gttcagtgtcgggaattttcc

SEQ ID NO: 3406784 - DNA, 17 bp, Homo sapiens
gttcatccaaggaacct

SEQ ID NO: 3406785 - DNA, 17 bp, Homo sapiens
gttccctcattctgcat

SEQ ID NO: 3406786 - DNA, 20 bp, Homo sapiens
gttccctcattctgcattaa

SEQ ID NO: 3406787 - DNA, 18 bp, Homo sapiens
gttcctcgttctccctgg

SEQ ID NO: 3406788 - DNA, 14 bp, Homo sapiens
gttctagttgcttg

SEQ ID NO: 3406789 - DNA, 21 bp, Homo sapiens
gttctatggagactttgctgt

SEQ ID NO: 3406790 - DNA, 16 bp, Homo sapiens
gttctccctgggaggc

SEQ ID NO: 3406791 - DNA, 21 bp, Homo sapiens
gttctgaaattaaagtatgca

SEQ ID NO: 3406792 - DNA, 13 bp, Homo sapiens
taaataatctaca

SEQ ID NO: 3406793 - DNA, 15 bp, Homo sapiens
taaataatctacatc

SEQ ID NO: 3406794 - DNA, 21 bp, Homo sapiens
taaatagaaagagttctatgg

SEQ ID NO: 3406795 - DNA, 16 bp, Homo sapiens
taaatatagttgtctt

SEQ ID NO: 3406796 - DNA, 20 bp, Homo sapiens
taaatatagttgtctttctt

SEQ ID NO: 3406797 - DNA, 19 bp, Homo sapiens
taaatatatgtatacatat

SEQ ID NO: 3406798 - DNA, 13 bp, Homo sapiens
taaatatgcagtg

SEQ ID NO: 3406799 - DNA, 16 bp, Homo sapiens
taaatatttatgtaga

SEQ ID NO: 3406800 - DNA, 15 bp, Homo sapiens
taaatatttgttctt

SEQ ID NO: 3406801 - DNA, 12 bp, Homo sapiens
taaatcatttta

SEQ ID NO: 3406802 - DNA, 17 bp, Homo sapiens
taaatcattttaggaaa

SEQ ID NO: 3406803 - DNA, 20 bp, Homo sapiens
taaatgaagggtcatttctc

SEQ ID NO: 3406804 - DNA, 14 bp, Homo sapiens
taaatgcatagagc

SEQ ID NO: 3406805 - DNA, 15 bp, Homo sapiens
taaatgcatagagca

SEQ ID NO: 3406806 - DNA, 16 bp, Homo sapiens
taaatgcatagagcaa

SEQ ID NO: 3406807 - DNA, 21 bp, Homo sapiens
taaatgcatagagcaattaaa

SEQ ID NO: 3406808 - DNA, 20 bp, Homo sapiens
taaatgcatatcctgagcca

SEQ ID NO: 3406809 - DNA, 21 bp, Homo sapiens
taaatgcatatcctgagccat

SEQ ID NO: 3406810 - DNA, 16 bp, Homo sapiens
taaatgccaaaatgta

SEQ ID NO: 3406811 - DNA, 19 bp, Homo sapiens
taaatgccaaaatgtactt

SEQ ID NO: 3406812 - DNA, 20 bp, Homo sapiens
taaatgccaaaatgtactta

SEQ ID NO: 3406813 - DNA, 13 bp, Homo sapiens
taaatgttttcat

SEQ ID NO: 3406814 - DNA, 20 bp, Homo sapiens
taaattatgggaatcaagat

SEQ ID NO: 3406815 - DNA, 21 bp, Homo sapiens
taaattatgggaatcaagatt

SEQ ID NO: 3406816 - DNA, 14 bp, Homo sapiens
taaattctctctaa

SEQ ID NO: 3406817 - DNA, 14 bp, Homo sapiens
taaattgcatttct

SEQ ID NO: 3406818 - DNA, 16 bp, Homo sapiens
taaattgcatttctat

SEQ ID NO: 3406819 - DNA, 14 bp, Homo sapiens
taaattgcctttgt

SEQ ID NO: 3406820 - DNA, 18 bp, Homo sapiens
taaatttaggtaaataaa

SEQ ID NO: 3406821 - DNA, 13 bp, Homo sapiens
taaatttgtaagt

SEQ ID NO: 3406822 - DNA, 15 bp, Homo sapiens
taaatttgtaagttt

SEQ ID NO: 3406823 - DNA, 16 bp, Homo sapiens
taaatttgtaagtttc

SEQ ID NO: 3406824 - DNA, 17 bp, Homo sapiens
taaatttgtaagtttca

SEQ ID NO: 3406825 - DNA, 23 bp, Homo sapiens
taaatttgtaagtttcaggtgac

SEQ ID NO: 3406826 - DNA, 23 bp, Homo sapiens
taaatttgttgtcatgtgtatga

SEQ ID NO: 3406827 - DNA, 19 bp, Homo sapiens
taacaatgttaaggaaact

SEQ ID NO: 3406828 - DNA, 22 bp, Homo sapiens
taacaatgttaaggaaactctt

SEQ ID NO: 3406829 - DNA, 23 bp, Homo sapiens
taacaatgttaaggaaactctta

SEQ ID NO: 3406830 - DNA, 17 bp, Homo sapiens
taacacagcatgtgtat

SEQ ID NO: 3406831 - DNA, 15 bp, Homo sapiens
taacacccaaaagaa

SEQ ID NO: 3406832 - DNA, 16 bp, Homo sapiens
taacagaacagcttca

SEQ ID NO: 3406833 - DNA, 18 bp, Homo sapiens
taacagaacagcttcagg

SEQ ID NO: 3406834 - DNA, 19 bp, Homo sapiens
taacagaacagcttcaggt

SEQ ID NO: 3406835 - DNA, 16 bp, Homo sapiens
taacagacactgtaaa

SEQ ID NO: 3406836 - DNA, 18 bp, Homo sapiens
taacagataagcaagaga

SEQ ID NO: 3406837 - DNA, 17 bp, Homo sapiens
taacaggttttcttcta

SEQ ID NO: 3406838 - DNA, 15 bp, Homo sapiens
taacataacaacctt

SEQ ID NO: 3406839 - DNA, 24 bp, Homo sapiens
taacattaaagcaatctgttgaaa

SEQ ID NO: 3406840 - DNA, 12 bp, Homo sapiens
taacattacctt

SEQ ID NO: 3406841 - DNA, 13 bp, Homo sapiens
taacattcctaaa

SEQ ID NO: 3406842 - DNA, 16 bp, Homo sapiens
taacattcctaaaatg

SEQ ID NO: 3406843 - DNA, 15 bp, Homo sapiens
taacatttaggagaa

SEQ ID NO: 3406844 - DNA, 16 bp, Homo sapiens
taacatttaggagaag

SEQ ID NO: 3406845 - DNA, 14 bp, Homo sapiens
taacctataaagtg

SEQ ID NO: 3406846 - DNA, 18 bp, Homo sapiens
taacgttttcttaaatgt

SEQ ID NO: 3406847 - DNA, 12 bp, Homo sapiens
taactaaatgct

SEQ ID NO: 3406848 - DNA, 13 bp, Homo sapiens
taactaaatgctc

SEQ ID NO: 3406849 - DNA, 16 bp, Homo sapiens
taactacatctgcctc

SEQ ID NO: 3406850 - DNA, 22 bp, Homo sapiens
taactcaatattttccatgaaa

SEQ ID NO: 3406851 - DNA, 18 bp, Homo sapiens
taactctgtaaaagtgtc

SEQ ID NO: 3406852 - DNA, 21 bp, Homo sapiens
taactgcttttgcccatataa

SEQ ID NO: 3406853 - DNA, 17 bp, Homo sapiens
taactgtatttcagtat

SEQ ID NO: 3406854 - DNA, 15 bp, Homo sapiens
taactgtgatgaaat

SEQ ID NO: 3406855 - DNA, 13 bp, Homo sapiens
taacttcataaaa

SEQ ID NO: 3406856 - DNA, 18 bp, Homo sapiens
taacttgtctttttgtta

SEQ ID NO: 3406857 - DNA, 17 bp, Homo sapiens
taagaaacaatttaaat

SEQ ID NO: 3406858 - DNA, 21 bp, Homo sapiens
taagaaagccaccttgttaca

SEQ ID NO: 3406859 - DNA, 21 bp, Homo sapiens
taagaagctgttgtacattta

SEQ ID NO: 3406860 - DNA, 22 bp, Homo sapiens
taagaagctgttgtacatttat

SEQ ID NO: 3406861 - DNA, 21 bp, Homo sapiens
taagaatagtctctgggttta

SEQ ID NO: 3406862 - DNA, 16 bp, Homo sapiens
taagacataacgtttt

SEQ ID NO: 3406863 - DNA, 20 bp, Homo sapiens
taagacataacgtttttcct

SEQ ID NO: 3406864 - DNA, 19 bp, Homo sapiens
taagagcaaaaagtgtaat

SEQ ID NO: 3406865 - DNA, 12 bp, Homo sapiens
taagagtgtaga

SEQ ID NO: 3406866 - DNA, 16 bp, Homo sapiens
taagagtgtagaagca

SEQ ID NO: 3406867 - DNA, 18 bp, Homo sapiens
taagagtgtagaagcatt

SEQ ID NO: 3406868 - DNA, 18 bp, Homo sapiens
taagatttttctcaaagt

SEQ ID NO: 3406869 - DNA, 21 bp, Homo sapiens
taagcagagttctttgcaagc

SEQ ID NO: 3406870 - DNA, 23 bp, Homo sapiens
taagccagcaccggaccagcctg

SEQ ID NO: 3406871 - DNA, 21 bp, Homo sapiens
taagctaaagaggctgaaaga

SEQ ID NO: 3406872 - DNA, 16 bp, Homo sapiens
taagctctgagctgtc

SEQ ID NO: 3406873 - DNA, 17 bp, Homo sapiens
taaggaaactcttatct

SEQ ID NO: 3406874 - DNA, 18 bp, Homo sapiens
taaggcatacttttaatc

SEQ ID NO: 3406875 - DNA, 17 bp, Homo sapiens
taaggctgtacatagtc

SEQ ID NO: 3406876 - DNA, 15 bp, Homo sapiens
taagtctacattaaa

SEQ ID NO: 3406877 - DNA, 22 bp, Homo sapiens
taagtgccaggatggaatgatg

SEQ ID NO: 3406878 - DNA, 17 bp, Homo sapiens
taagtgcgtgtgtagag

SEQ ID NO: 3406879 - DNA, 18 bp, Homo sapiens
taagtttcaggtgacatg

SEQ ID NO: 3406880 - DNA, 22 bp, Homo sapiens
taagttttttttttctcctctc

SEQ ID NO: 3406881 - DNA, 16 bp, Homo sapiens
taataaaataattcta

SEQ ID NO: 3406882 - DNA, 18 bp, Homo sapiens
taataaaataattctaaa

SEQ ID NO: 3406883 - DNA, 19 bp, Homo sapiens
taataaaataattctaaag

SEQ ID NO: 3406884 - DNA, 12 bp, Homo sapiens
taataacattac

SEQ ID NO: 3406885 - DNA, 20 bp, Homo sapiens
taataacattaccttactgt

SEQ ID NO: 3406886 - DNA, 17 bp, Homo sapiens
taataagacataacgtt

SEQ ID NO: 3406887 - DNA, 20 bp, Homo sapiens
taataagacataacgttttt

SEQ ID NO: 3406888 - DNA, 22 bp, Homo sapiens
taataagacataacgtttttcc

SEQ ID NO: 3406889 - DNA, 20 bp, Homo sapiens
taataattggccttcgattt

SEQ ID NO: 3406890 - DNA, 16 bp, Homo sapiens
taatagagaacttttt

SEQ ID NO: 3406891 - DNA, 18 bp, Homo sapiens
taatagctaataataaat

SEQ ID NO: 3406892 - DNA, 19 bp, Homo sapiens
taatagctaataataaatg

SEQ ID NO: 3406893 - DNA, 23 bp, Homo sapiens
taatagctaataataaatgcata

SEQ ID NO: 3406894 - DNA, 16 bp, Homo sapiens
taatataaaagatctt

SEQ ID NO: 3406895 - DNA, 16 bp, Homo sapiens
taatatggggatgcag

SEQ ID NO: 3406896 - DNA, 14 bp, Homo sapiens
taatattctctgat

SEQ ID NO: 3406897 - DNA, 12 bp, Homo sapiens
taatatttcttc

SEQ ID NO: 3406898 - DNA, 15 bp, Homo sapiens
taatcatgctcatgt

SEQ ID NO: 3406899 - DNA, 18 bp, Homo sapiens
taatcatgctcatgtata

SEQ ID NO: 3406900 - DNA, 14 bp, Homo sapiens
taatctatattaaa

SEQ ID NO: 3406901 - DNA, 21 bp, Homo sapiens
taatctcctctgctcattaaa

SEQ ID NO: 3406902 - DNA, 19 bp, Homo sapiens
taatctgcctggttttatt

SEQ ID NO: 3406903 - DNA, 16 bp, Homo sapiens
tagctatttctatgta

SEQ ID NO: 3406904 - DNA, 14 bp, Homo sapiens
tagctcccctccaa

SEQ ID NO: 3406905 - DNA, 15 bp, Homo sapiens
tagctttttaattgt

SEQ ID NO: 3406906 - DNA, 22 bp, Homo sapiens
taggcacttttattttcattgt

SEQ ID NO: 3406907 - DNA, 22 bp, Homo sapiens
taggccaggtgcaaccagggag

SEQ ID NO: 3406908 - DNA, 20 bp, Homo sapiens
tagggaaaatggatatagaa

SEQ ID NO: 3406909 - DNA, 13 bp, Homo sapiens
tagggtataatgt

SEQ ID NO: 3406910 - DNA, 18 bp, Homo sapiens
tagggtataatgtgtctg

SEQ ID NO: 3406911 - DNA, 16 bp, Homo sapiens
tagggtccttgaaaca

SEQ ID NO: 3406912 - DNA, 19 bp, Homo sapiens
tagggtgggtaagaaagcc

SEQ ID NO: 3406913 - DNA, 14 bp, Homo sapiens
taggtatctttata

SEQ ID NO: 3406914 - DNA, 19 bp, Homo sapiens
taggtatctttatagttgt

SEQ ID NO: 3406915 - DNA, 17 bp, Homo sapiens
taggtccacttcaatgt

SEQ ID NO: 3406916 - DNA, 20 bp, Homo sapiens
tagtagaaagacatctgcct

SEQ ID NO: 3406917 - DNA, 16 bp, Homo sapiens
tagtatagtagaaaga

SEQ ID NO: 3406918 - DNA, 14 bp, Homo sapiens
tagtatatgaaata

SEQ ID NO: 3406919 - DNA, 18 bp, Homo sapiens
tagtatttaactacatct

SEQ ID NO: 3406920 - DNA, 20 bp, Homo sapiens
tagtatttaactacatctgc

SEQ ID NO: 3406921 - DNA, 14 bp, Homo sapiens
tagtccctgtgttc

SEQ ID NO: 3406922 - DNA, 21 bp, Homo sapiens
tagtctttttttccttccttt

SEQ ID NO: 3406923 - DNA, 22 bp, Homo sapiens
tagtgcctgagagtatttaggc

SEQ ID NO: 3406924 - DNA, 13 bp, Homo sapiens
tagtggtctttgt

SEQ ID NO: 3406925 - DNA, 19 bp, Homo sapiens
tagtggtctttgtaagagt

SEQ ID NO: 3406926 - DNA, 14 bp, Homo sapiens
tagtgtaaacaaat

SEQ ID NO: 3406927 - DNA, 15 bp, Homo sapiens
tagtgtaaacaaata

SEQ ID NO: 3406928 - DNA, 15 bp, Homo sapiens
tagttacgtataatg

SEQ ID NO: 3406929 - DNA, 22 bp, Homo sapiens
tagttacgtataatgctttctg

SEQ ID NO: 3406930 - DNA, 13 bp, Homo sapiens
tagttgtattttg

SEQ ID NO: 3406931 - DNA, 12 bp, Homo sapiens
tagtttcctcta

SEQ ID NO: 3406932 - DNA, 14 bp, Homo sapiens
tataaaatgtttca

SEQ ID NO: 3406933 - DNA, 19 bp, Homo sapiens
tataaaccttgtcaataaa

SEQ ID NO: 3406934 - DNA, 21 bp, Homo sapiens
tataaagtttttttatttctt

SEQ ID NO: 3406935 - DNA, 19 bp, Homo sapiens
tataaataggagaggatga

SEQ ID NO: 3406936 - DNA, 22 bp, Homo sapiens
tataaatatatgtatacatata

SEQ ID NO: 3406937 - DNA, 14 bp, Homo sapiens
tataactgcccagc

SEQ ID NO: 3406938 - DNA, 17 bp, Homo sapiens
tataagcgtatttagac

SEQ ID NO: 3406939 - DNA, 14 bp, Homo sapiens
tataaggtcataga

SEQ ID NO: 3406940 - DNA, 21 bp, Homo sapiens
tataagtcttggtaacaaata

SEQ ID NO: 3406941 - DNA, 20 bp, Homo sapiens
tataataaactcttaagaga

SEQ ID NO: 3406942 - DNA, 15 bp, Homo sapiens
tataatcatgctcat

SEQ ID NO: 3406943 - DNA, 17 bp, Homo sapiens
tataatcatgctcatgt

SEQ ID NO: 3406944 - DNA, 12 bp, Homo sapiens
tataatgctttc

SEQ ID NO: 3406945 - DNA, 16 bp, Homo sapiens
tataatgctttctgag

SEQ ID NO: 3406946 - DNA, 16 bp, Homo sapiens
tataatgtgtctgtgt

SEQ ID NO: 3406947 - DNA, 21 bp, Homo sapiens
tataatttagtcccttaaaaa

SEQ ID NO: 3406948 - DNA, 18 bp, Homo sapiens
tatacatgtcaatggcct

SEQ ID NO: 3406949 - DNA, 18 bp, Homo sapiens
tataccatgtgtgctaat

SEQ ID NO: 3406950 - DNA, 16 bp, Homo sapiens
tataccccatttgatt

SEQ ID NO: 3406951 - DNA, 17 bp, Homo sapiens
tatagaaaatcttagta

SEQ ID NO: 3406952 - DNA, 14 bp, Homo sapiens
tatagattgtctta

SEQ ID NO: 3406953 - DNA, 16 bp, Homo sapiens
tatagattgtcttaat

SEQ ID NO: 3406954 - DNA, 21 bp, Homo sapiens
tatagctagctatttctatgt

SEQ ID NO: 3406955 - DNA, 22 bp, Homo sapiens
tatagtgtccccatgggctccc

SEQ ID NO: 3406956 - DNA, 13 bp, Homo sapiens
tatagttgtattt

SEQ ID NO: 3406957 - DNA, 15 bp, Homo sapiens
tatagttgtattttg

SEQ ID NO: 3406958 - DNA, 20 bp, Homo sapiens
tatagttgtctttctttgct

SEQ ID NO: 3406959 - DNA, 21 bp, Homo sapiens
tatagttgtctttctttgctg

SEQ ID NO: 3406960 - DNA, 19 bp, Homo sapiens
tatataaaaatatatgttg

SEQ ID NO: 3406961 - DNA, 16 bp, Homo sapiens
tatatactatatgaaa

SEQ ID NO: 3406962 - DNA, 18 bp, Homo sapiens
tatatactatatgaaaag

SEQ ID NO: 3406963 - DNA, 19 bp, Homo sapiens
tatatagctggcaagaatg

SEQ ID NO: 3406964 - DNA, 15 bp, Homo sapiens
tatatattgaaagtt

SEQ ID NO: 3406965 - DNA, 20 bp, Homo sapiens
tatatgagaagaatagccta

SEQ ID NO: 3406966 - DNA, 12 bp, Homo sapiens
tatatgctgtat

SEQ ID NO: 3406967 - DNA, 14 bp, Homo sapiens
tatatgctgtattt

SEQ ID NO: 3406968 - DNA, 16 bp, Homo sapiens
tatatgctgtatttct

SEQ ID NO: 3406969 - DNA, 19 bp, Homo sapiens
tatatgctgtatttctttg

SEQ ID NO: 3406970 - DNA, 23 bp, Homo sapiens
tatatgctgtatttctttgtaga

SEQ ID NO: 3406971 - DNA, 17 bp, Homo sapiens
tatatggcctcaagatc

SEQ ID NO: 3406972 - DNA, 15 bp, Homo sapiens
tatatgtatacatat

SEQ ID NO: 3406973 - DNA, 12 bp, Homo sapiens
tatatgttgaat

SEQ ID NO: 3406974 - DNA, 12 bp, Homo sapiens
tatattaaatga

SEQ ID NO: 3406975 - DNA, 17 bp, Homo sapiens
tatattgaaagttgctt

SEQ ID NO: 3406976 - DNA, 16 bp, Homo sapiens
tatatttagttacgta

SEQ ID NO: 3406977 - DNA, 22 bp, Homo sapiens
tatatttggcccaaactcatct

SEQ ID NO: 3406978 - DNA, 14 bp, Homo sapiens
tatattttaatttg

SEQ ID NO: 3406979 - DNA, 16 bp, Homo sapiens
tatcaaaaggaagatt

SEQ ID NO: 3406980 - DNA, 15 bp, Homo sapiens
tatcagcacgtgtgg

SEQ ID NO: 3406981 - DNA, 18 bp, Homo sapiens
tatccagctagtgccaaa

SEQ ID NO: 3406982 - DNA, 22 bp, Homo sapiens
tatcctgctgaaagtcctgctt

SEQ ID NO: 3406983 - DNA, 14 bp, Homo sapiens
tatcgaaataacaa

SEQ ID NO: 3406984 - DNA, 21 bp, Homo sapiens
tatctacccagtcatgtactg

SEQ ID NO: 3406985 - DNA, 14 bp, Homo sapiens
tatctactaaacta

SEQ ID NO: 3406986 - DNA, 21 bp, Homo sapiens
tatctagcatttatttctctg

SEQ ID NO: 3406987 - DNA, 15 bp, Homo sapiens
tatctatacctgcct

SEQ ID NO: 3406988 - DNA, 16 bp, Homo sapiens
tatctatacctgcctt

SEQ ID NO: 3406989 - DNA, 17 bp, Homo sapiens
tatctccttgtggccta

SEQ ID NO: 3406990 - DNA, 16 bp, Homo sapiens
tatctctagtccctgt

SEQ ID NO: 3406991 - DNA, 23 bp, Homo sapiens
tatctcttttgaatccatgcttg

SEQ ID NO: 3406992 - DNA, 15 bp, Homo sapiens
tatctgaacatttac

SEQ ID NO: 3406993 - DNA, 17 bp, Homo sapiens
tatctgaacatttacta

SEQ ID NO: 3406994 - DNA, 21 bp, Homo sapiens
tatctgcatgtaaaatcttca

SEQ ID NO: 3406995 - DNA, 23 bp, Homo sapiens
tatctgcttttggttataatgtg

SEQ ID NO: 3406996 - DNA, 18 bp, Homo sapiens
tatctgtaagttttgaat

SEQ ID NO: 3406997 - DNA, 20 bp, Homo sapiens
tatcttacaactcccccacc

SEQ ID NO: 3406998 - DNA, 21 bp, Homo sapiens
tatcttacaactcccccaccg

SEQ ID NO: 3406999 - DNA, 18 bp, Homo sapiens
tatgaaactcatctgtaa

SEQ ID NO: 3407000 - DNA, 21 bp, Homo sapiens
tatgaaactggtttataataa

SEQ ID NO: 3407001 - DNA, 16 bp, Homo sapiens
tatgaaatattttgaa

SEQ ID NO: 3407002 - DNA, 18 bp, Homo sapiens
tatgaaatattttgaata

SEQ ID NO: 3407003 - DNA, 22 bp, Homo sapiens
tatgaaatattttgaatacaca

SEQ ID NO: 3407004 - DNA, 20 bp, Homo sapiens
tatgacaaatttagccaata

SEQ ID NO: 3407005 - DNA, 14 bp, Homo sapiens
tatgactaaagaga

SEQ ID NO: 3407006 - DNA, 16 bp, Homo sapiens
tatgactaaagagaga

SEQ ID NO: 3407007 - DNA, 17 bp, Homo sapiens
tatgactaaagagagaa

SEQ ID NO: 3407008 - DNA, 20 bp, Homo sapiens
tatgactaaagagagaatgt

SEQ ID NO: 3407009 - DNA, 13 bp, Homo sapiens
tatgagatttact

SEQ ID NO: 3407010 - DNA, 16 bp, Homo sapiens
tatgagccagacaaat

SEQ ID NO: 3407011 - DNA, 14 bp, Homo sapiens
tatgatattctcat

SEQ ID NO: 3407012 - DNA, 18 bp, Homo sapiens
tatgatgtgggtcaagga

SEQ ID NO: 3407013 - DNA, 17 bp, Homo sapiens
tatgatttaataaaata

SEQ ID NO: 3407014 - DNA, 13 bp, Homo sapiens
tcaatttgtaatt

SEQ ID NO: 3407015 - DNA, 18 bp, Homo sapiens
tcacaaaagctgtgtctc

SEQ ID NO: 3407016 - DNA, 20 bp, Homo sapiens
tcacaaaagctgtgtctctg

SEQ ID NO: 3407017 - DNA, 20 bp, Homo sapiens
tcacaaattccgattagacc

SEQ ID NO: 3407018 - DNA, 19 bp, Homo sapiens
tcacacacagactgttgtc

SEQ ID NO: 3407019 - DNA, 22 bp, Homo sapiens
tcacacacagactgttgtccct

SEQ ID NO: 3407020 - DNA, 13 bp, Homo sapiens
tcacacttgtttc

SEQ ID NO: 3407021 - DNA, 23 bp, Homo sapiens
tcacagcaagtcactggccagtg

SEQ ID NO: 3407022 - DNA, 14 bp, Homo sapiens
tcacagctcttgtt

SEQ ID NO: 3407023 - DNA, 15 bp, Homo sapiens
tcacagttctgtaat

SEQ ID NO: 3407024 - DNA, 14 bp, Homo sapiens
tcacatctaaagct

SEQ ID NO: 3407025 - DNA, 19 bp, Homo sapiens
tcacattactgtatatact

SEQ ID NO: 3407026 - DNA, 18 bp, Homo sapiens
tcaccacctcatgtcatt

SEQ ID NO: 3407027 - DNA, 21 bp, Homo sapiens
tcaccacctcatgtcatttct

SEQ ID NO: 3407028 - DNA, 20 bp, Homo sapiens
tcaccactcaaaggccagac

SEQ ID NO: 3407029 - DNA, 22 bp, Homo sapiens
tcaccactcaaaggccagacct

SEQ ID NO: 3407030 - DNA, 15 bp, Homo sapiens
tcaccaggatttata

SEQ ID NO: 3407031 - DNA, 21 bp, Homo sapiens
tcacctaatgtttatgagcca

SEQ ID NO: 3407032 - DNA, 16 bp, Homo sapiens
tcacgattatgactaa

SEQ ID NO: 3407033 - DNA, 13 bp, Homo sapiens
tcactagctcccc

SEQ ID NO: 3407034 - DNA, 22 bp, Homo sapiens
tcactcatgcaaactgctttat

SEQ ID NO: 3407035 - DNA, 23 bp, Homo sapiens
tcactcatgcaaactgctttatt

SEQ ID NO: 3407036 - DNA, 14 bp, Homo sapiens
tcactcctgctgta

SEQ ID NO: 3407037 - DNA, 15 bp, Homo sapiens
tcactcctgctgtaa

SEQ ID NO: 3407038 - DNA, 20 bp, Homo sapiens
tcactggggcatgagatttt

SEQ ID NO: 3407039 - DNA, 17 bp, Homo sapiens
tcactgtataaatagga

SEQ ID NO: 3407040 - DNA, 19 bp, Homo sapiens
tcactgtataaataggaga

SEQ ID NO: 3407041 - DNA, 18 bp, Homo sapiens
tcactttccaccaagtgt

SEQ ID NO: 3407042 - DNA, 15 bp, Homo sapiens
tcactttttcccctg

SEQ ID NO: 3407043 - DNA, 22 bp, Homo sapiens
tcagaattggcataatttgtct

SEQ ID NO: 3407044 - DNA, 15 bp, Homo sapiens
tcagatgctgaattg

SEQ ID NO: 3407045 - DNA, 16 bp, Homo sapiens
tcagatgctgaattga

SEQ ID NO: 3407046 - DNA, 24 bp, Homo sapiens
tcagatgtgttgacgtaagctcta

SEQ ID NO: 3407047 - DNA, 22 bp, Homo sapiens
tcagattccacacaaaatgtca

SEQ ID NO: 3407048 - DNA, 23 bp, Homo sapiens
tcagcatcaaacatgaaaacatt

SEQ ID NO: 3407049 - DNA, 23 bp, Homo sapiens
tcagccccaccccagggcagcca

SEQ ID NO: 3407050 - DNA, 23 bp, Homo sapiens
tcagctggtggatggtgactttt

SEQ ID NO: 3407051 - DNA, 12 bp, Homo sapiens
tcagcttctgtt

SEQ ID NO: 3407052 - DNA, 12 bp, Homo sapiens
tcaggaaagaat

SEQ ID NO: 3407053 - DNA, 13 bp, Homo sapiens
tcaggacactaat

SEQ ID NO: 3407054 - DNA, 16 bp, Homo sapiens
tcaggaggaaggctta

SEQ ID NO: 3407055 - DNA, 15 bp, Homo sapiens
tcaggatactgtagt

SEQ ID NO: 3407056 - DNA, 15 bp, Homo sapiens
tcaggccgaaggagg

SEQ ID NO: 3407057 - DNA, 16 bp, Homo sapiens
tcagtaagtataacaa

SEQ ID NO: 3407058 - DNA, 17 bp, Homo sapiens
tcagtaagtataacaaa

SEQ ID NO: 3407059 - DNA, 16 bp, Homo sapiens
tcagtatgtggaagtg

SEQ ID NO: 3407060 - DNA, 23 bp, Homo sapiens
tcagtcactttttcccctgcaat

SEQ ID NO: 3407061 - DNA, 14 bp, Homo sapiens
tcagtcatgcataa

SEQ ID NO: 3407062 - DNA, 17 bp, Homo sapiens
tcagtgatggcaacact

SEQ ID NO: 3407063 - DNA, 14 bp, Homo sapiens
tcagtgttgattct

SEQ ID NO: 3407064 - DNA, 13 bp, Homo sapiens
tcataatggcctg

SEQ ID NO: 3407065 - DNA, 13 bp, Homo sapiens
tcatacacagtta

SEQ ID NO: 3407066 - DNA, 19 bp, Homo sapiens
tcatagaacagaaatatat

SEQ ID NO: 3407067 - DNA, 14 bp, Homo sapiens
tcatagattcttga

SEQ ID NO: 3407068 - DNA, 20 bp, Homo sapiens
tcatagatttgaaaaacttt

SEQ ID NO: 3407069 - DNA, 17 bp, Homo sapiens
tcatcaaataaaccttg

SEQ ID NO: 3407070 - DNA, 20 bp, Homo sapiens
tcatcaatttgtaattttag

SEQ ID NO: 3407071 - DNA, 20 bp, Homo sapiens
tcatcagtaagtataacaaa

SEQ ID NO: 3407072 - DNA, 11 bp, Homo sapiens
tcatctatttc

SEQ ID NO: 3407073 - DNA, 19 bp, Homo sapiens
tcatctcttagctcccctc

SEQ ID NO: 3407074 - DNA, 21 bp, Homo sapiens
tcatctcttagctcccctcca

SEQ ID NO: 3407075 - DNA, 19 bp, Homo sapiens
tcatcttggccctcctcag

SEQ ID NO: 3407076 - DNA, 22 bp, Homo sapiens
tcatctttcttgatcaacatct

SEQ ID NO: 3407077 - DNA, 14 bp, Homo sapiens
tcatctttgtgaag

SEQ ID NO: 3407078 - DNA, 17 bp, Homo sapiens
tcatgcaaactgcttta

SEQ ID NO: 3407079 - DNA, 19 bp, Homo sapiens
tcatgcaaactgctttatt

SEQ ID NO: 3407080 - DNA, 14 bp, Homo sapiens
tcatggtgtaataa

SEQ ID NO: 3407081 - DNA, 19 bp, Homo sapiens
tcatggtgtaataagacat

SEQ ID NO: 3407082 - DNA, 21 bp, Homo sapiens
tcatgtatgtatataatcatg

SEQ ID NO: 3407083 - DNA, 14 bp, Homo sapiens
tcatgtcatttctc

SEQ ID NO: 3407084 - DNA, 18 bp, Homo sapiens
tcatgttttaaaagtttg

SEQ ID NO: 3407085 - DNA, 22 bp, Homo sapiens
tcatgttttaaaagtttgtcct

SEQ ID NO: 3407086 - DNA, 13 bp, Homo sapiens
tcattcaataaat

SEQ ID NO: 3407087 - DNA, 22 bp, Homo sapiens
tcattctagaccctatacattt

SEQ ID NO: 3407088 - DNA, 13 bp, Homo sapiens
tcattctgcatta

SEQ ID NO: 3407089 - DNA, 18 bp, Homo sapiens
tcatttcaaaatgcttca

SEQ ID NO: 3407090 - DNA, 21 bp, Homo sapiens
tcatttcacccctccctttct

SEQ ID NO: 3407091 - DNA, 16 bp, Homo sapiens
tcatttggttaaatca

SEQ ID NO: 3407092 - DNA, 13 bp, Homo sapiens
tcatttttttcca

SEQ ID NO: 3407093 - DNA, 20 bp, Homo sapiens
tccaaaataatctatattaa

SEQ ID NO: 3407094 - DNA, 22 bp, Homo sapiens
tccaaaataatctatattaaat

SEQ ID NO: 3407095 - DNA, 19 bp, Homo sapiens
tccaaatgcattcatgttt

SEQ ID NO: 3407096 - DNA, 18 bp, Homo sapiens
tccaaatgctgtgcaaac

SEQ ID NO: 3407097 - DNA, 18 bp, Homo sapiens
tccaaccccccagcactg

SEQ ID NO: 3407098 - DNA, 19 bp, Homo sapiens
tccaaccccccagcactga

SEQ ID NO: 3407099 - DNA, 21 bp, Homo sapiens
tccaaccccccagcactgagg

SEQ ID NO: 3407100 - DNA, 21 bp, Homo sapiens
tccaacctggggggcagtggt

SEQ ID NO: 3407101 - DNA, 18 bp, Homo sapiens
tccaagacagtatacagt

SEQ ID NO: 3407102 - DNA, 12 bp, Homo sapiens
tccaagagctga

SEQ ID NO: 3407103 - DNA, 21 bp, Homo sapiens
tccaaggaacctaattgaaat

SEQ ID NO: 3407104 - DNA, 16 bp, Homo sapiens
tccaaggtggggtgga

SEQ ID NO: 3407105 - DNA, 22 bp, Homo sapiens
tccaatgatacccaacagttta

SEQ ID NO: 3407106 - DNA, 15 bp, Homo sapiens
tccaattctgaaata

SEQ ID NO: 3407107 - DNA, 20 bp, Homo sapiens
tccaattctgaaatactttt

SEQ ID NO: 3407108 - DNA, 12 bp, Homo sapiens
tccacacaaaat

SEQ ID NO: 3407109 - DNA, 14 bp, Homo sapiens
tccacacaaaatgt

SEQ ID NO: 3407110 - DNA, 14 bp, Homo sapiens
tccacacctgcggc

SEQ ID NO: 3407111 - DNA, 15 bp, Homo sapiens
tccacacctgcggcc

SEQ ID NO: 3407112 - DNA, 18 bp, Homo sapiens
tccacctcactagctccc

SEQ ID NO: 3407113 - DNA, 20 bp, Homo sapiens
tccacctgtgagaaaggaaa

SEQ ID NO: 3407114 - DNA, 14 bp, Homo sapiens
tccactctccccca

SEQ ID NO: 3407115 - DNA, 16 bp, Homo sapiens
tccactctcccccacc

SEQ ID NO: 3407116 - DNA, 18 bp, Homo sapiens
tccactctcccccacccc

SEQ ID NO: 3407117 - DNA, 14 bp, Homo sapiens
tccagaagacccca

SEQ ID NO: 3407118 - DNA, 17 bp, Homo sapiens
tccagaagaccccactt

SEQ ID NO: 3407119 - DNA, 20 bp, Homo sapiens
tccagccttatgtgttacat

SEQ ID NO: 3407120 - DNA, 14 bp, Homo sapiens
tccagggctggact

SEQ ID NO: 3407121 - DNA, 21 bp, Homo sapiens
tccagggctggactgaggcct

SEQ ID NO: 3407122 - DNA, 22 bp, Homo sapiens
tccagggctggactgaggcctg

SEQ ID NO: 3407123 - DNA, 23 bp, Homo sapiens
tccagggctggactgaggcctga

SEQ ID NO: 3407124 - DNA, 12 bp, Homo sapiens
tccataatcact

SEQ ID NO: 3407125 - DNA, 15 bp, Homo sapiens
tgaaaggcaattttt

SEQ ID NO: 3407126 - DNA, 21 bp, Homo sapiens
tgaaaggctatcctgctgaaa

SEQ ID NO: 3407127 - DNA, 12 bp, Homo sapiens
tgaaagttgctt

SEQ ID NO: 3407128 - DNA, 16 bp, Homo sapiens
tgaaagttgcttttat

SEQ ID NO: 3407129 - DNA, 18 bp, Homo sapiens
tgaaagttgcttttattg

SEQ ID NO: 3407130 - DNA, 18 bp, Homo sapiens
tgaaatacttttgagtat

SEQ ID NO: 3407131 - DNA, 19 bp, Homo sapiens
tgaaatgaaaacatgtaat

SEQ ID NO: 3407132 - DNA, 17 bp, Homo sapiens
tgaaattaaagtatgca

SEQ ID NO: 3407133 - DNA, 12 bp, Homo sapiens
tgaaattgtgta

SEQ ID NO: 3407134 - DNA, 13 bp, Homo sapiens
tgaaattgtgtag

SEQ ID NO: 3407135 - DNA, 15 bp, Homo sapiens
tgaaatttaaaaata

SEQ ID NO: 3407136 - DNA, 17 bp, Homo sapiens
tgaaatttaaaaataaa

SEQ ID NO: 3407137 - DNA, 18 bp, Homo sapiens
tgaaatttaaaaataaag

SEQ ID NO: 3407138 - DNA, 15 bp, Homo sapiens
tgaacacagcctggg

SEQ ID NO: 3407139 - DNA, 22 bp, Homo sapiens
tgaacagtttggatgtcctcaa

SEQ ID NO: 3407140 - DNA, 16 bp, Homo sapiens
tgaactgcaggaagag

SEQ ID NO: 3407141 - DNA, 22 bp, Homo sapiens
tgaagagaagggcagggctgag

SEQ ID NO: 3407142 - DNA, 17 bp, Homo sapiens
tgaagatctgatttata

SEQ ID NO: 3407143 - DNA, 19 bp, Homo sapiens
tgaagctggaagcactgct

SEQ ID NO: 3407144 - DNA, 18 bp, Homo sapiens
tgaaggcctcgcaggaag

SEQ ID NO: 3407145 - DNA, 16 bp, Homo sapiens
tgaagggtcatttctc

SEQ ID NO: 3407146 - DNA, 13 bp, Homo sapiens
tgaagtacatatt

SEQ ID NO: 3407147 - DNA, 18 bp, Homo sapiens
tgaagtcttgcattgaat

SEQ ID NO: 3407148 - DNA, 21 bp, Homo sapiens
tgaataaagggaacatgcagc

SEQ ID NO: 3407149 - DNA, 13 bp, Homo sapiens
tgaataaagtgct

SEQ ID NO: 3407150 - DNA, 16 bp, Homo sapiens
tgaatattaagaaaca

SEQ ID NO: 3407151 - DNA, 21 bp, Homo sapiens
tgaatgaggaacaatcacaaa

SEQ ID NO: 3407152 - DNA, 14 bp, Homo sapiens
tgaatgagttttac

SEQ ID NO: 3407153 - DNA, 15 bp, Homo sapiens
tgaatggattggatt

SEQ ID NO: 3407154 - DNA, 19 bp, Homo sapiens
tgaatgtcattatttgata

SEQ ID NO: 3407155 - DNA, 20 bp, Homo sapiens
tgaatgttaacaggtatttt

SEQ ID NO: 3407156 - DNA, 14 bp, Homo sapiens
tgaatttaagcatg

SEQ ID NO: 3407157 - DNA, 13 bp, Homo sapiens
tgaatttagtcat

SEQ ID NO: 3407158 - DNA, 20 bp, Homo sapiens
tgaatttatgagatttactg

SEQ ID NO: 3407159 - DNA, 14 bp, Homo sapiens
tgaatttattgccg

SEQ ID NO: 3407160 - DNA, 14 bp, Homo sapiens
tgaattttaaaaca

SEQ ID NO: 3407161 - DNA, 14 bp, Homo sapiens
tgacaaaagtgaca

SEQ ID NO: 3407162 - DNA, 20 bp, Homo sapiens
tgacaaaagtgacagatgtt

SEQ ID NO: 3407163 - DNA, 15 bp, Homo sapiens
tgacaatcaactcta

SEQ ID NO: 3407164 - DNA, 18 bp, Homo sapiens
tgacaatcaactctaata

SEQ ID NO: 3407165 - DNA, 14 bp, Homo sapiens
tgacagaacactgt

SEQ ID NO: 3407166 - DNA, 21 bp, Homo sapiens
tgacagaacactgtcttgaag

SEQ ID NO: 3407167 - DNA, 22 bp, Homo sapiens
tgacagatcctccatttttgtt

SEQ ID NO: 3407168 - DNA, 13 bp, Homo sapiens
tgacagatgttat

SEQ ID NO: 3407169 - DNA, 20 bp, Homo sapiens
tgacataattgtccagttat

SEQ ID NO: 3407170 - DNA, 17 bp, Homo sapiens
tgacatacatccaacat

SEQ ID NO: 3407171 - DNA, 17 bp, Homo sapiens
tgaccatgtgattatgg

SEQ ID NO: 3407172 - DNA, 15 bp, Homo sapiens
tgacctgaactctgc

SEQ ID NO: 3407173 - DNA, 17 bp, Homo sapiens
tgaccttctaggaagct

SEQ ID NO: 3407174 - DNA, 18 bp, Homo sapiens
tgacggaagaacatagaa

SEQ ID NO: 3407175 - DNA, 22 bp, Homo sapiens
tgactaaagtaccagattataa

SEQ ID NO: 3407176 - DNA, 20 bp, Homo sapiens
tgactgagtctggcaaacat

SEQ ID NO: 3407177 - DNA, 13 bp, Homo sapiens
tgacttttgaaga

SEQ ID NO: 3407178 - DNA, 24 bp, Homo sapiens
tgagaacatggtgtgtgtctctga

SEQ ID NO: 3407179 - DNA, 21 bp, Homo sapiens
tgagaagtactttgtgctgat

SEQ ID NO: 3407180 - DNA, 19 bp, Homo sapiens
tgagaagtgcttaacgttt

SEQ ID NO: 3407181 - DNA, 15 bp, Homo sapiens
tgagaatgtaagaac

SEQ ID NO: 3407182 - DNA, 16 bp, Homo sapiens
tgagacagtttcttag

SEQ ID NO: 3407183 - DNA, 15 bp, Homo sapiens
tgagactcgagaact

SEQ ID NO: 3407184 - DNA, 17 bp, Homo sapiens
tgagactcgagaacttt

SEQ ID NO: 3407185 - DNA, 16 bp, Homo sapiens
tgagagcccagaggta

SEQ ID NO: 3407186 - DNA, 17 bp, Homo sapiens
tgagagggccgggcaga

SEQ ID NO: 3407187 - DNA, 21 bp, Homo sapiens
tgagatttactgctctagaaa

SEQ ID NO: 3407188 - DNA, 14 bp, Homo sapiens
tgagatttcatctg

SEQ ID NO: 3407189 - DNA, 19 bp, Homo sapiens
tgagatttcatctgctctc

SEQ ID NO: 3407190 - DNA, 14 bp, Homo sapiens
tgagcgctcctgcc

SEQ ID NO: 3407191 - DNA, 20 bp, Homo sapiens
tgagctgtgcacaaagtggc

SEQ ID NO: 3407192 - DNA, 19 bp, Homo sapiens
tgaggaagaacggggctct

SEQ ID NO: 3407193 - DNA, 17 bp, Homo sapiens
tgaggaagagggactgt

SEQ ID NO: 3407194 - DNA, 13 bp, Homo sapiens
tgaggccctccac

SEQ ID NO: 3407195 - DNA, 19 bp, Homo sapiens
tgaggccctccacacctgc

SEQ ID NO: 3407196 - DNA, 12 bp, Homo sapiens
tgagggtcttct

SEQ ID NO: 3407197 - DNA, 14 bp, Homo sapiens
tgagggtttctgat

SEQ ID NO: 3407198 - DNA, 12 bp, Homo sapiens
tgagtctctgaa

SEQ ID NO: 3407199 - DNA, 15 bp, Homo sapiens
tgagtctggcaaaca

SEQ ID NO: 3407200 - DNA, 21 bp, Homo sapiens
tgagtctggcaaacatgtgca

SEQ ID NO: 3407201 - DNA, 21 bp, Homo sapiens
tgagtcttaactgtatttcag

SEQ ID NO: 3407202 - DNA, 17 bp, Homo sapiens
tgagtgccatgcttttt

SEQ ID NO: 3407203 - DNA, 22 bp, Homo sapiens
tgagtggcatgtgggttgtgat

SEQ ID NO: 3407204 - DNA, 22 bp, Homo sapiens
tgagtggcttcactcctgctgt

SEQ ID NO: 3407205 - DNA, 16 bp, Homo sapiens
tgagtgttatgtgaat

SEQ ID NO: 3407206 - DNA, 17 bp, Homo sapiens
tgagttacttagaatgc

SEQ ID NO: 3407207 - DNA, 18 bp, Homo sapiens
tgagttcataaatttatg

SEQ ID NO: 3407208 - DNA, 14 bp, Homo sapiens
tgagttggctggga

SEQ ID NO: 3407209 - DNA, 16 bp, Homo sapiens
tgagttggctgggaat

SEQ ID NO: 3407210 - DNA, 17 bp, Homo sapiens
tgagttggctgggaata

SEQ ID NO: 3407211 - DNA, 13 bp, Homo sapiens
tgataaataaagt

SEQ ID NO: 3407212 - DNA, 18 bp, Homo sapiens
tgataatgttaaatttgt

SEQ ID NO: 3407213 - DNA, 21 bp, Homo sapiens
tgataatgttaaatttgtaag

SEQ ID NO: 3407214 - DNA, 16 bp, Homo sapiens
tgatacccaacagttt

SEQ ID NO: 3407215 - DNA, 15 bp, Homo sapiens
tgatatggcagaaga

SEQ ID NO: 3407216 - DNA, 20 bp, Homo sapiens
tgatatggcagaagacacca

SEQ ID NO: 3407217 - DNA, 21 bp, Homo sapiens
tgatatggtactaaggagaat

SEQ ID NO: 3407218 - DNA, 21 bp, Homo sapiens
tgatattgaccatgtgattat

SEQ ID NO: 3407219 - DNA, 19 bp, Homo sapiens
tgatcaacataatggacca

SEQ ID NO: 3407220 - DNA, 23 bp, Homo sapiens
tgatcaacatcttttcttgcctc

SEQ ID NO: 3407221 - DNA, 18 bp, Homo sapiens
tgatcacatctaaagctt

SEQ ID NO: 3407222 - DNA, 21 bp, Homo sapiens
tgatcacatctaaagctttat

SEQ ID NO: 3407223 - DNA, 17 bp, Homo sapiens
tgatcagatgctgaatt

SEQ ID NO: 3407224 - DNA, 13 bp, Homo sapiens
tgatcatctttgc

SEQ ID NO: 3407225 - DNA, 14 bp, Homo sapiens
tgatcatctttgct

SEQ ID NO: 3407226 - DNA, 14 bp, Homo sapiens
tgatccatctcagt

SEQ ID NO: 3407227 - DNA, 18 bp, Homo sapiens
tgatccatctcagtcact

SEQ ID NO: 3407228 - DNA, 19 bp, Homo sapiens
tgatctgattttttattca

SEQ ID NO: 3407229 - DNA, 13 bp, Homo sapiens
tgatctgtacttt

SEQ ID NO: 3407230 - DNA, 15 bp, Homo sapiens
tgatctgtactttgt

SEQ ID NO: 3407231 - DNA, 16 bp, Homo sapiens
tgatctgtactttgtg

SEQ ID NO: 3407232 - DNA, 14 bp, Homo sapiens
tgatctttgtttaa

SEQ ID NO: 3407233 - DNA, 17 bp, Homo sapiens
tgatctttgtttaaatg

SEQ ID NO: 3407234 - DNA, 18 bp, Homo sapiens
tgatctttgtttaaatgc

SEQ ID NO: 3407235 - DNA, 19 bp, Homo sapiens
tgatctttgtttaaatgcc

SEQ ID NO: 3407236 - DNA, 16 bp, Homo sapiens
tgatgaaatatgaaac

SEQ ID NO: 3407237 - DNA, 15 bp, Homo sapiens
tgcctcgaaagtgtc

SEQ ID NO: 3407238 - DNA, 16 bp, Homo sapiens
tgcctcgaaagtgtca

SEQ ID NO: 3407239 - DNA, 19 bp, Homo sapiens
tgcctcttttccccatgaa

SEQ ID NO: 3407240 - DNA, 13 bp, Homo sapiens
tgcctgaataaag

SEQ ID NO: 3407241 - DNA, 12 bp, Homo sapiens
tgcctggacccg

SEQ ID NO: 3407242 - DNA, 22 bp, Homo sapiens
tgcctggccttgtcctcagcca

SEQ ID NO: 3407243 - DNA, 15 bp, Homo sapiens
tgcctgtaattaaac

SEQ ID NO: 3407244 - DNA, 12 bp, Homo sapiens
tgcctgtttccc

SEQ ID NO: 3407245 - DNA, 13 bp, Homo sapiens
tgcctgtttcccg

SEQ ID NO: 3407246 - DNA, 15 bp, Homo sapiens
tgcctttgagacagt

SEQ ID NO: 3407247 - DNA, 20 bp, Homo sapiens
tgcctttgagacagtttctt

SEQ ID NO: 3407248 - DNA, 23 bp, Homo sapiens
tgcctttgagacagtttcttagc

SEQ ID NO: 3407249 - DNA, 20 bp, Homo sapiens
tgcctttgtaatatgagaat

SEQ ID NO: 3407250 - DNA, 21 bp, Homo sapiens
tgcgcaaactttaacaggttt

SEQ ID NO: 3407251 - DNA, 23 bp, Homo sapiens
tgcgggcattttgaatgtgatca

SEQ ID NO: 3407252 - DNA, 22 bp, Homo sapiens
tgcggggcttttaaaaggaaaa

SEQ ID NO: 3407253 - DNA, 13 bp, Homo sapiens
tgcgtcttgtgaa

SEQ ID NO: 3407254 - DNA, 17 bp, Homo sapiens
tgcgtcttgtgaaattg

SEQ ID NO: 3407255 - DNA, 17 bp, Homo sapiens
tgcgtggcacatctaaa

SEQ ID NO: 3407256 - DNA, 21 bp, Homo sapiens
tgcgtgtgtagagttaagaag

SEQ ID NO: 3407257 - DNA, 22 bp, Homo sapiens
tgctaactagcttggaaactgg

SEQ ID NO: 3407258 - DNA, 21 bp, Homo sapiens
tgctaatatactttttttgtt

SEQ ID NO: 3407259 - DNA, 15 bp, Homo sapiens
tgctacaggggccag

SEQ ID NO: 3407260 - DNA, 21 bp, Homo sapiens
tgctacaggggccagaagatg

SEQ ID NO: 3407261 - DNA, 16 bp, Homo sapiens
tgctagttagcgcccc

SEQ ID NO: 3407262 - DNA, 20 bp, Homo sapiens
tgctatgagctggggatgtc

SEQ ID NO: 3407263 - DNA, 22 bp, Homo sapiens
tgctattgtagagccagaggtc

SEQ ID NO: 3407264 - DNA, 19 bp, Homo sapiens
tgctcaaaataaaaagcct

SEQ ID NO: 3407265 - DNA, 22 bp, Homo sapiens
tgctcatacacagttaaataaa

SEQ ID NO: 3407266 - DNA, 15 bp, Homo sapiens
tgctcattaaactga

SEQ ID NO: 3407267 - DNA, 16 bp, Homo sapiens
tgctcattaaactgat

SEQ ID NO: 3407268 - DNA, 14 bp, Homo sapiens
tgctccattttctt

SEQ ID NO: 3407269 - DNA, 21 bp, Homo sapiens
tgctgaagggagggggctggc

SEQ ID NO: 3407270 - DNA, 15 bp, Homo sapiens
tgctgatcgccttat

SEQ ID NO: 3407271 - DNA, 23 bp, Homo sapiens
tgctgctaaagggagaaatgcca

SEQ ID NO: 3407272 - DNA, 14 bp, Homo sapiens
tgctgctgtggaaa

SEQ ID NO: 3407273 - DNA, 15 bp, Homo sapiens
tgctgtagacatttg

SEQ ID NO: 3407274 - DNA, 23 bp, Homo sapiens
tgctgtatccatccatggggctg

SEQ ID NO: 3407275 - DNA, 19 bp, Homo sapiens
tgctgttactgcttctctt

SEQ ID NO: 3407276 - DNA, 22 bp, Homo sapiens
tgctgtttactcccttctgtag

SEQ ID NO: 3407277 - DNA, 17 bp, Homo sapiens
tgcttaacgttttctta

SEQ ID NO: 3407278 - DNA, 22 bp, Homo sapiens
tgcttatgtgttgcataaacaa

SEQ ID NO: 3407279 - DNA, 22 bp, Homo sapiens
tgcttcactcatgcaaactgct

SEQ ID NO: 3407280 - DNA, 23 bp, Homo sapiens
tgcttcactcatgcaaactgctt

SEQ ID NO: 3407281 - DNA, 13 bp, Homo sapiens
tgcttcctctgaa

SEQ ID NO: 3407282 - DNA, 18 bp, Homo sapiens
tgcttcctctgaatatta

SEQ ID NO: 3407283 - DNA, 23 bp, Homo sapiens
tgcttcctgattaccagtctgat

SEQ ID NO: 3407284 - DNA, 16 bp, Homo sapiens
tgcttctggctttgtt

SEQ ID NO: 3407285 - DNA, 14 bp, Homo sapiens
tgcttcttgtaata

SEQ ID NO: 3407286 - DNA, 16 bp, Homo sapiens
tgcttcttgtaatatt

SEQ ID NO: 3407287 - DNA, 19 bp, Homo sapiens
tgcttcttgtaatatttct

SEQ ID NO: 3407288 - DNA, 20 bp, Homo sapiens
tgcttttgaaggaatacaat

SEQ ID NO: 3407289 - DNA, 13 bp, Homo sapiens
tgctttttggtga

SEQ ID NO: 3407290 - DNA, 20 bp, Homo sapiens
tggaaaacttgtgcccttgt

SEQ ID NO: 3407291 - DNA, 13 bp, Homo sapiens
tggaaaagaaatc

SEQ ID NO: 3407292 - DNA, 23 bp, Homo sapiens
tggaaagacagcttctcatcctg

SEQ ID NO: 3407293 - DNA, 20 bp, Homo sapiens
tggaaaggattctaaacaga

SEQ ID NO: 3407294 - DNA, 18 bp, Homo sapiens
tggaagaagttttttact

SEQ ID NO: 3407295 - DNA, 16 bp, Homo sapiens
tggaagcttggggaag

SEQ ID NO: 3407296 - DNA, 20 bp, Homo sapiens
tggaataaacatctgtgtct

SEQ ID NO: 3407297 - DNA, 21 bp, Homo sapiens
tggaataaacatctgtgtctg

SEQ ID NO: 3407298 - DNA, 20 bp, Homo sapiens
tggaatttttgaatctattt

SEQ ID NO: 3407299 - DNA, 17 bp, Homo sapiens
tggacagaagcagctct

SEQ ID NO: 3407300 - DNA, 18 bp, Homo sapiens
tggacatcgatatgaaaa

SEQ ID NO: 3407301 - DNA, 12 bp, Homo sapiens
tggacccctgca

SEQ ID NO: 3407302 - DNA, 20 bp, Homo sapiens
tggacccgttcatgggggag

SEQ ID NO: 3407303 - DNA, 15 bp, Homo sapiens
tggaccggagagtgg

SEQ ID NO: 3407304 - DNA, 18 bp, Homo sapiens
tggaccggagagtggggg

SEQ ID NO: 3407305 - DNA, 15 bp, Homo sapiens
tggacctctcttgtg

SEQ ID NO: 3407306 - DNA, 19 bp, Homo sapiens
tggacctggcggcaggaag

SEQ ID NO: 3407307 - DNA, 16 bp, Homo sapiens
tggactgaggcctgag

SEQ ID NO: 3407308 - DNA, 20 bp, Homo sapiens
tggagaagccacaggcctga

SEQ ID NO: 3407309 - DNA, 20 bp, Homo sapiens
tggagcattaactaaatgct

SEQ ID NO: 3407310 - DNA, 23 bp, Homo sapiens
tggagcattaactaaatgctcat

SEQ ID NO: 3407311 - DNA, 13 bp, Homo sapiens
tggaggaaggatt

SEQ ID NO: 3407312 - DNA, 19 bp, Homo sapiens
tggaggaaggattgtaaaa

SEQ ID NO: 3407313 - DNA, 20 bp, Homo sapiens
tggaggaaggattgtaaaaa

SEQ ID NO: 3407314 - DNA, 12 bp, Homo sapiens
tggaggagccca

SEQ ID NO: 3407315 - DNA, 13 bp, Homo sapiens
tggaggagcccag

SEQ ID NO: 3407316 - DNA, 23 bp, Homo sapiens
tggaggagcccaggccaggactc

SEQ ID NO: 3407317 - DNA, 20 bp, Homo sapiens
tggaggagctcaggacacta

SEQ ID NO: 3407318 - DNA, 12 bp, Homo sapiens
tggagtgtttga

SEQ ID NO: 3407319 - DNA, 22 bp, Homo sapiens
tggagtgtttgacgaagaaaca

SEQ ID NO: 3407320 - DNA, 23 bp, Homo sapiens
tggatgcggaacccaaattacgt

SEQ ID NO: 3407321 - DNA, 18 bp, Homo sapiens
tggatggtgacttttgaa

SEQ ID NO: 3407322 - DNA, 23 bp, Homo sapiens
tggatgtcctcaaagaagtggtt

SEQ ID NO: 3407323 - DNA, 13 bp, Homo sapiens
tggattatttaat

SEQ ID NO: 3407324 - DNA, 16 bp, Homo sapiens
tggattatttaataac

SEQ ID NO: 3407325 - DNA, 17 bp, Homo sapiens
tggattatttaataaca

SEQ ID NO: 3407326 - DNA, 20 bp, Homo sapiens
tggattatttaataacatta

SEQ ID NO: 3407327 - DNA, 16 bp, Homo sapiens
tggattggattattta

SEQ ID NO: 3407328 - DNA, 18 bp, Homo sapiens
tggatttctttatataag

SEQ ID NO: 3407329 - DNA, 14 bp, Homo sapiens
tggcaaacatgtgc

SEQ ID NO: 3407330 - DNA, 22 bp, Homo sapiens
tggcaaacatgtgcaactcttg

SEQ ID NO: 3407331 - DNA, 19 bp, Homo sapiens
tggcaacactgaaggaaca

SEQ ID NO: 3407332 - DNA, 20 bp, Homo sapiens
tggcaacagaaaacaattgt

SEQ ID NO: 3407333 - DNA, 17 bp, Homo sapiens
tggcaagggttcacctg

SEQ ID NO: 3407334 - DNA, 14 bp, Homo sapiens
tggcagaagacacc

SEQ ID NO: 3407335 - DNA, 13 bp, Homo sapiens
tggcagtgtttgt

SEQ ID NO: 3407336 - DNA, 23 bp, Homo sapiens
tggcatgtgggttgtgatattga

SEQ ID NO: 3407337 - DNA, 17 bp, Homo sapiens
tggcatttgcagatttt

SEQ ID NO: 3407338 - DNA, 15 bp, Homo sapiens
tggccagtggctgga

SEQ ID NO: 3407339 - DNA, 23 bp, Homo sapiens
tggccagtggctggatctgtgag

SEQ ID NO: 3407340 - DNA, 13 bp, Homo sapiens
tggccctcctcag

SEQ ID NO: 3407341 - DNA, 14 bp, Homo sapiens
tggccctcctcagc

SEQ ID NO: 3407342 - DNA, 15 bp, Homo sapiens
tggccctcctcagct

SEQ ID NO: 3407343 - DNA, 19 bp, Homo sapiens
tggccctctcccctgcccc

SEQ ID NO: 3407344 - DNA, 21 bp, Homo sapiens
tggccctctcccctgccccct

SEQ ID NO: 3407345 - DNA, 20 bp, Homo sapiens
tggcctatgaaactggttta

SEQ ID NO: 3407346 - DNA, 13 bp, Homo sapiens
tggcctcaagatc

SEQ ID NO: 3407347 - DNA, 19 bp, Homo sapiens
tgtatttcagtattttcca

SEQ ID NO: 3407348 - DNA, 20 bp, Homo sapiens
tgtatttcagtattttccag

SEQ ID NO: 3407349 - DNA, 14 bp, Homo sapiens
tgtatttctttgta

SEQ ID NO: 3407350 - DNA, 18 bp, Homo sapiens
tgtatttgttaatggttt

SEQ ID NO: 3407351 - DNA, 20 bp, Homo sapiens
tgtatttgttaatggtttga

SEQ ID NO: 3407352 - DNA, 16 bp, Homo sapiens
tgtcaactttcatttg

SEQ ID NO: 3407353 - DNA, 17 bp, Homo sapiens
tgtcaactttcatttga

SEQ ID NO: 3407354 - DNA, 14 bp, Homo sapiens
tgtcaataaaaata

SEQ ID NO: 3407355 - DNA, 17 bp, Homo sapiens
tgtcaatggaagaaacc

SEQ ID NO: 3407356 - DNA, 13 bp, Homo sapiens
tgtcacagctctt

SEQ ID NO: 3407357 - DNA, 13 bp, Homo sapiens
tgtcaccttcacc

SEQ ID NO: 3407358 - DNA, 16 bp, Homo sapiens
tgtcagcatgacaaaa

SEQ ID NO: 3407359 - DNA, 21 bp, Homo sapiens
tgtcagctactaatgatgttt

SEQ ID NO: 3407360 - DNA, 19 bp, Homo sapiens
tgtcagctcaggcagctcg

SEQ ID NO: 3407361 - DNA, 20 bp, Homo sapiens
tgtcagtatgtggaagtgtg

SEQ ID NO: 3407362 - DNA, 12 bp, Homo sapiens
tgtcagtgtgaa

SEQ ID NO: 3407363 - DNA, 13 bp, Homo sapiens
tgtcagtgtgaaa

SEQ ID NO: 3407364 - DNA, 15 bp, Homo sapiens
tgtcagtgtgaaaat

SEQ ID NO: 3407365 - DNA, 12 bp, Homo sapiens
tgtcatgtgtat

SEQ ID NO: 3407366 - DNA, 18 bp, Homo sapiens
tgtcatgtgtatgagaag

SEQ ID NO: 3407367 - DNA, 13 bp, Homo sapiens
tgtcatttctcat

SEQ ID NO: 3407368 - DNA, 22 bp, Homo sapiens
tgtccacctgtgagaaaggaaa

SEQ ID NO: 3407369 - DNA, 14 bp, Homo sapiens
tgtccattattcat

SEQ ID NO: 3407370 - DNA, 13 bp, Homo sapiens
tgtcccagtgaac

SEQ ID NO: 3407371 - DNA, 21 bp, Homo sapiens
tgtccccatgggctcccactg

SEQ ID NO: 3407372 - DNA, 14 bp, Homo sapiens
tgtccccttctctc

SEQ ID NO: 3407373 - DNA, 12 bp, Homo sapiens
tgtcctatgcaa

SEQ ID NO: 3407374 - DNA, 15 bp, Homo sapiens
tgtcctatgcaataa

SEQ ID NO: 3407375 - DNA, 16 bp, Homo sapiens
tgtcctatgcaataaa

SEQ ID NO: 3407376 - DNA, 22 bp, Homo sapiens
tgtctagagtcatgtgagcctc

SEQ ID NO: 3407377 - DNA, 20 bp, Homo sapiens
tgtctccaaccccccagcac

SEQ ID NO: 3407378 - DNA, 23 bp, Homo sapiens
tgtctccaaccccccagcactga

SEQ ID NO: 3407379 - DNA, 19 bp, Homo sapiens
tgtctctgtatatagctct

SEQ ID NO: 3407380 - DNA, 17 bp, Homo sapiens
tgtctgtagctcctcaa

SEQ ID NO: 3407381 - DNA, 22 bp, Homo sapiens
tgtctgtaggtacgttttatat

SEQ ID NO: 3407382 - DNA, 17 bp, Homo sapiens
tgtcttaaatcagttta

SEQ ID NO: 3407383 - DNA, 15 bp, Homo sapiens
tgtctttcagataca

SEQ ID NO: 3407384 - DNA, 14 bp, Homo sapiens
tgtctttttgttat

SEQ ID NO: 3407385 - DNA, 18 bp, Homo sapiens
tgtgaagagggagaagca

SEQ ID NO: 3407386 - DNA, 22 bp, Homo sapiens
tgtgaatggattggattattta

SEQ ID NO: 3407387 - DNA, 14 bp, Homo sapiens
tgtgacaaaatgtt

SEQ ID NO: 3407388 - DNA, 20 bp, Homo sapiens
tgtgaggtttaacattaaag

SEQ ID NO: 3407389 - DNA, 14 bp, Homo sapiens
tgtgcaaaagcagg

SEQ ID NO: 3407390 - DNA, 16 bp, Homo sapiens
tgtgcaactcttgtat

SEQ ID NO: 3407391 - DNA, 21 bp, Homo sapiens
tgtgcctcccttttctcctct

SEQ ID NO: 3407392 - DNA, 16 bp, Homo sapiens
tgtgccttttgccatc

SEQ ID NO: 3407393 - DNA, 15 bp, Homo sapiens
tgtgctacaggggcc

SEQ ID NO: 3407394 - DNA, 17 bp, Homo sapiens
tgtgctacaggggccag

SEQ ID NO: 3407395 - DNA, 13 bp, Homo sapiens
tgtggaaaggatt

SEQ ID NO: 3407396 - DNA, 15 bp, Homo sapiens
tgtggaagtgtgggt

SEQ ID NO: 3407397 - DNA, 14 bp, Homo sapiens
tgtggaggaaggat

SEQ ID NO: 3407398 - DNA, 15 bp, Homo sapiens
tgtggaggaaggatt

SEQ ID NO: 3407399 - DNA, 21 bp, Homo sapiens
tgtggaggaaggattgtaaaa

SEQ ID NO: 3407400 - DNA, 15 bp, Homo sapiens
tgtgggtcaaggaat

SEQ ID NO: 3407401 - DNA, 15 bp, Homo sapiens
tgtgggttgtgatat

SEQ ID NO: 3407402 - DNA, 17 bp, Homo sapiens
tgtggtctccttggaaa

SEQ ID NO: 3407403 - DNA, 19 bp, Homo sapiens
tgtgtaatctaagtatatg

SEQ ID NO: 3407404 - DNA, 11 bp, Homo sapiens
tgtgtaattta

SEQ ID NO: 3407405 - DNA, 21 bp, Homo sapiens
tgtgtagagttaagaagctgt

SEQ ID NO: 3407406 - DNA, 20 bp, Homo sapiens
tgtgtatccagtatgcacgt

SEQ ID NO: 3407407 - DNA, 11 bp, Homo sapiens
tgtgtatgtgg

SEQ ID NO: 3407408 - DNA, 12 bp, Homo sapiens
tgtgtattctta

SEQ ID NO: 3407409 - DNA, 14 bp, Homo sapiens
tgtgtattcttaaa

SEQ ID NO: 3407410 - DNA, 23 bp, Homo sapiens
tgtgtattcttaaaatgcaatat

SEQ ID NO: 3407411 - DNA, 20 bp, Homo sapiens
tgtgtattgagtcttaactg

SEQ ID NO: 3407412 - DNA, 18 bp, Homo sapiens
tgtgtccatcatattaaa

SEQ ID NO: 3407413 - DNA, 15 bp, Homo sapiens
tgtgtcccagtgaac

SEQ ID NO: 3407414 - DNA, 20 bp, Homo sapiens
tgtgtctcaaaaataatata

SEQ ID NO: 3407415 - DNA, 12 bp, Homo sapiens
tgtgtctctgta

SEQ ID NO: 3407416 - DNA, 14 bp, Homo sapiens
tgtgtgggagtgtg

SEQ ID NO: 3407417 - DNA, 13 bp, Homo sapiens
tgtgtgtgtgtat

SEQ ID NO: 3407418 - DNA, 12 bp, Homo sapiens
tgtgtgtgtgtg

SEQ ID NO: 3407419 - DNA, 14 bp, Homo sapiens
tgtgttgtgtgtgg

SEQ ID NO: 3407420 - DNA, 23 bp, Homo sapiens
tgtgttgtgtgtgggagtgtgta

SEQ ID NO: 3407421 - DNA, 21 bp, Homo sapiens
tgtgtttctcctgagctagga

SEQ ID NO: 3407422 - DNA, 14 bp, Homo sapiens
tgttaaatttgtaa

SEQ ID NO: 3407423 - DNA, 19 bp, Homo sapiens
tgttaaatttgtaagtttc

SEQ ID NO: 3407424 - DNA, 17 bp, Homo sapiens
tgttaaggaaactctta

SEQ ID NO: 3407425 - DNA, 17 bp, Homo sapiens
tgttaatggtttgaata

SEQ ID NO: 3407426 - DNA, 21 bp, Homo sapiens
tgttacaggcaccgagaatgt

SEQ ID NO: 3407427 - DNA, 21 bp, Homo sapiens
tgttactgcttctctttgtgc

SEQ ID NO: 3407428 - DNA, 14 bp, Homo sapiens
tgttacttaaacat

SEQ ID NO: 3407429 - DNA, 20 bp, Homo sapiens
tgttatagattgtcttaatg

SEQ ID NO: 3407430 - DNA, 15 bp, Homo sapiens
tgttatgcaaatgag

SEQ ID NO: 3407431 - DNA, 21 bp, Homo sapiens
tgttattaatgtttcttctcc

SEQ ID NO: 3407432 - DNA, 16 bp, Homo sapiens
tgttattcttttccag

SEQ ID NO: 3407433 - DNA, 18 bp, Homo sapiens
tgttattcttttccagaa

SEQ ID NO: 3407434 - DNA, 16 bp, Homo sapiens
tgttatttcagatgat

SEQ ID NO: 3407435 - DNA, 17 bp, Homo sapiens
tgttatttttgtatttt

SEQ ID NO: 3407436 - DNA, 19 bp, Homo sapiens
tgttatttttgtattttta

SEQ ID NO: 3407437 - DNA, 15 bp, Homo sapiens
tgttcatccaaggaa

SEQ ID NO: 3407438 - DNA, 15 bp, Homo sapiens
tgttcccctcctcca

SEQ ID NO: 3407439 - DNA, 13 bp, Homo sapiens
tgttctacttgat

SEQ ID NO: 3407440 - DNA, 20 bp, Homo sapiens
tgttctacttgatatttcct

SEQ ID NO: 3407441 - DNA, 22 bp, Homo sapiens
tgttctccactgacacaaaaga

SEQ ID NO: 3407442 - DNA, 16 bp, Homo sapiens
tgttcttgtcatcagt

SEQ ID NO: 3407443 - DNA, 16 bp, Homo sapiens
tgttcttttgtcccag

SEQ ID NO: 3407444 - DNA, 17 bp, Homo sapiens
tgttgagtctctgaaca

SEQ ID NO: 3407445 - DNA, 18 bp, Homo sapiens
tgttgagtctctgaacat

SEQ ID NO: 3407446 - DNA, 18 bp, Homo sapiens
tgttggcagtgtttgtat

SEQ ID NO: 3407447 - DNA, 22 bp, Homo sapiens
tgttgggatgcgggcattttga

SEQ ID NO: 3407448 - DNA, 14 bp, Homo sapiens
tgttggtgcaatta

SEQ ID NO: 3407449 - DNA, 21 bp, Homo sapiens
tgttggtgcaattaactctgg

SEQ ID NO: 3407450 - DNA, 14 bp, Homo sapiens
tgttggtttaatat

SEQ ID NO: 3407451 - DNA, 15 bp, Homo sapiens
tgttgtacatttatg

SEQ ID NO: 3407452 - DNA, 14 bp, Homo sapiens
tgttgtttctttct

SEQ ID NO: 3407453 - DNA, 15 bp, Homo sapiens
tgttgtttctttcta

SEQ ID NO: 3407454 - DNA, 15 bp, Homo sapiens
tgtttaaatgccaaa

SEQ ID NO: 3407455 - DNA, 16 bp, Homo sapiens
tgtttatatattgaaa

SEQ ID NO: 3407456 - DNA, 12 bp, Homo sapiens
tgtttcttctcc

SEQ ID NO: 3407457 - DNA, 14 bp, Homo sapiens
tgtttcttctccaa

SEQ ID NO: 3407458 - DNA, 18 bp, Homo sapiens
tgtttcttgttcatccaa

SEQ ID NO: 3407459 - DNA, 16 bp, Homo sapiens
ttatgtagatgtgcat

SEQ ID NO: 3407460 - DNA, 14 bp, Homo sapiens
ttattaatgtttct

SEQ ID NO: 3407461 - DNA, 15 bp, Homo sapiens
ttattaatgtttctt

SEQ ID NO: 3407462 - DNA, 14 bp, Homo sapiens
ttattactttttaa

SEQ ID NO: 3407463 - DNA, 17 bp, Homo sapiens
ttattcagctagaattt

SEQ ID NO: 3407464 - DNA, 20 bp, Homo sapiens
ttattcagtgaaaaagatat

SEQ ID NO: 3407465 - DNA, 12 bp, Homo sapiens
ttattcttttcc

SEQ ID NO: 3407466 - DNA, 13 bp, Homo sapiens
ttatttaaagcac

SEQ ID NO: 3407467 - DNA, 10 bp, Homo sapiens
ttatttaata

SEQ ID NO: 3407468 - DNA, 13 bp, Homo sapiens
ttatttaataaca

SEQ ID NO: 3407469 - DNA, 13 bp, Homo sapiens
ttatttacatttt

SEQ ID NO: 3407470 - DNA, 13 bp, Homo sapiens
ttatttctgatgt

SEQ ID NO: 3407471 - DNA, 16 bp, Homo sapiens
ttatttgataacattt

SEQ ID NO: 3407472 - DNA, 18 bp, Homo sapiens
ttatttgtatgtattaaa

SEQ ID NO: 3407473 - DNA, 15 bp, Homo sapiens
ttatttttgtatttt

SEQ ID NO: 3407474 - DNA, 14 bp, Homo sapiens
ttcaaaatgtctgt

SEQ ID NO: 3407475 - DNA, 18 bp, Homo sapiens
ttcaaatatcaaaaggaa

SEQ ID NO: 3407476 - DNA, 17 bp, Homo sapiens
ttcaaattggtctgaaa

SEQ ID NO: 3407477 - DNA, 14 bp, Homo sapiens
ttcaagatccaaat

SEQ ID NO: 3407478 - DNA, 18 bp, Homo sapiens
ttcaatgtccacctgtga

SEQ ID NO: 3407479 - DNA, 21 bp, Homo sapiens
ttcaatttactttttaaacag

SEQ ID NO: 3407480 - DNA, 17 bp, Homo sapiens
ttcaatttccaagagct

SEQ ID NO: 3407481 - DNA, 19 bp, Homo sapiens
ttcaatttccaagagctga

SEQ ID NO: 3407482 - DNA, 23 bp, Homo sapiens
ttcacaaagtataacaattaaaa

SEQ ID NO: 3407483 - DNA, 15 bp, Homo sapiens
ttcacccctcccttt

SEQ ID NO: 3407484 - DNA, 18 bp, Homo sapiens
ttcacccctccctttctc

SEQ ID NO: 3407485 - DNA, 14 bp, Homo sapiens
ttcaccctgggcag

SEQ ID NO: 3407486 - DNA, 15 bp, Homo sapiens
ttcaccctgggcagt

SEQ ID NO: 3407487 - DNA, 16 bp, Homo sapiens
ttcactgtataaatag

SEQ ID NO: 3407488 - DNA, 13 bp, Homo sapiens
ttcacttcacgct

SEQ ID NO: 3407489 - DNA, 22 bp, Homo sapiens
ttcagagtttggttaatcagtg

SEQ ID NO: 3407490 - DNA, 14 bp, Homo sapiens
ttcagagttttact

SEQ ID NO: 3407491 - DNA, 23 bp, Homo sapiens
ttcagattccacacaaaatgtca

SEQ ID NO: 3407492 - DNA, 16 bp, Homo sapiens
ttcagcatcaaacatg

SEQ ID NO: 3407493 - DNA, 18 bp, Homo sapiens
ttcagcatcaaacatgaa

SEQ ID NO: 3407494 - DNA, 14 bp, Homo sapiens
ttcagccaaacagt

SEQ ID NO: 3407495 - DNA, 12 bp, Homo sapiens
ttcagccctcac

SEQ ID NO: 3407496 - DNA, 16 bp, Homo sapiens
ttcagccctcacccct

SEQ ID NO: 3407497 - DNA, 18 bp, Homo sapiens
ttcagctagaatttctgg

SEQ ID NO: 3407498 - DNA, 11 bp, Homo sapiens
ttcagctggtg

SEQ ID NO: 3407499 - DNA, 22 bp, Homo sapiens
ttcagctggtggatggtgactt

SEQ ID NO: 3407500 - DNA, 23 bp, Homo sapiens
ttcagctggtggatggtgacttt

SEQ ID NO: 3407501 - DNA, 14 bp, Homo sapiens
ttcagcttctgttg

SEQ ID NO: 3407502 - DNA, 22 bp, Homo sapiens
ttcaggatactgtagtttcctc

SEQ ID NO: 3407503 - DNA, 14 bp, Homo sapiens
ttcaggtgacatgt

SEQ ID NO: 3407504 - DNA, 18 bp, Homo sapiens
ttcaggtgacatgtgaaa

SEQ ID NO: 3407505 - DNA, 19 bp, Homo sapiens
ttcaggtgacatgtgaaac

SEQ ID NO: 3407506 - DNA, 22 bp, Homo sapiens
ttcaggttatcgaaataacaat

SEQ ID NO: 3407507 - DNA, 13 bp, Homo sapiens
ttcagtattttcc

SEQ ID NO: 3407508 - DNA, 14 bp, Homo sapiens
ttcagtattttcca

SEQ ID NO: 3407509 - DNA, 15 bp, Homo sapiens
ttcagtgaaaaagat

SEQ ID NO: 3407510 - DNA, 18 bp, Homo sapiens
ttcagtgatggcaacact

SEQ ID NO: 3407511 - DNA, 23 bp, Homo sapiens
ttcagtgtcgggaattttccccg

SEQ ID NO: 3407512 - DNA, 22 bp, Homo sapiens
ttcataaatttgttgtcatgtg

SEQ ID NO: 3407513 - DNA, 13 bp, Homo sapiens
ttcatccaaggaa

SEQ ID NO: 3407514 - DNA, 16 bp, Homo sapiens
ttcatctgctctcctt

SEQ ID NO: 3407515 - DNA, 17 bp, Homo sapiens
ttcattgggaaaggaca

SEQ ID NO: 3407516 - DNA, 14 bp, Homo sapiens
ttcatttttttcca

SEQ ID NO: 3407517 - DNA, 18 bp, Homo sapiens
ttcatttttttccaggct

SEQ ID NO: 3407518 - DNA, 15 bp, Homo sapiens
ttccaaagcattttc

SEQ ID NO: 3407519 - DNA, 20 bp, Homo sapiens
ttccaaagcattttcagcat

SEQ ID NO: 3407520 - DNA, 14 bp, Homo sapiens
ttccaagacagtat

SEQ ID NO: 3407521 - DNA, 13 bp, Homo sapiens
ttccacacaaaat

SEQ ID NO: 3407522 - DNA, 17 bp, Homo sapiens
ttccacacaaaatgtca

SEQ ID NO: 3407523 - DNA, 19 bp, Homo sapiens
ttccacacaaaatgtcaca

SEQ ID NO: 3407524 - DNA, 15 bp, Homo sapiens
ttccagagttgttgt

SEQ ID NO: 3407525 - DNA, 19 bp, Homo sapiens
ttccagagttgttgtttgc

SEQ ID NO: 3407526 - DNA, 15 bp, Homo sapiens
ttccatgaaaatgca

SEQ ID NO: 3407527 - DNA, 15 bp, Homo sapiens
ttccattatgattct

SEQ ID NO: 3407528 - DNA, 22 bp, Homo sapiens
ttcccaggtaatttaaattggt

SEQ ID NO: 3407529 - DNA, 13 bp, Homo sapiens
ttcccatagattt

SEQ ID NO: 3407530 - DNA, 22 bp, Homo sapiens
ttcccatttcgtgtaatattct

SEQ ID NO: 3407531 - DNA, 15 bp, Homo sapiens
ttcccctcctccact

SEQ ID NO: 3407532 - DNA, 12 bp, Homo sapiens
ttcccctgcaat

SEQ ID NO: 3407533 - DNA, 22 bp, Homo sapiens
ttcccctgcaatgcgtcttgtg

SEQ ID NO: 3407534 - DNA, 16 bp, Homo sapiens
ttcccgtaaggctgta

SEQ ID NO: 3407535 - DNA, 17 bp, Homo sapiens
ttccctcattctgcatt

SEQ ID NO: 3407536 - DNA, 22 bp, Homo sapiens
ttccggcatggacaatggaccg

SEQ ID NO: 3407537 - DNA, 13 bp, Homo sapiens
ttcctaaaatgct

SEQ ID NO: 3407538 - DNA, 18 bp, Homo sapiens
ttcctatttgccatgggc

SEQ ID NO: 3407539 - DNA, 22 bp, Homo sapiens
ttcctatttgccatgggcttca

SEQ ID NO: 3407540 - DNA, 23 bp, Homo sapiens
ttcctatttgccatgggcttcac

SEQ ID NO: 3407541 - DNA, 16 bp, Homo sapiens
ttcctggagcccagag

SEQ ID NO: 3407542 - DNA, 16 bp, Homo sapiens
ttcctgtctgtttata

SEQ ID NO: 3407543 - DNA, 12 bp, Homo sapiens
ttccttctttga

SEQ ID NO: 3407544 - DNA, 13 bp, Homo sapiens
ttccttctttgat

SEQ ID NO: 3407545 - DNA, 19 bp, Homo sapiens
ttccttgcttttatagttg

SEQ ID NO: 3407546 - DNA, 12 bp, Homo sapiens
ttcgatgtacag

SEQ ID NO: 3407547 - DNA, 16 bp, Homo sapiens
ttcgatgtacagtctc

SEQ ID NO: 3407548 - DNA, 23 bp, Homo sapiens
ttcgatgtacagtctcaattttg

SEQ ID NO: 3407549 - DNA, 18 bp, Homo sapiens
ttcgtgtaatattctctg

SEQ ID NO: 3407550 - DNA, 13 bp, Homo sapiens
ttctaaatgcata

SEQ ID NO: 3407551 - DNA, 15 bp, Homo sapiens
ttctaatcataacat

SEQ ID NO: 3407552 - DNA, 15 bp, Homo sapiens
ttctatggagacttt

SEQ ID NO: 3407553 - DNA, 16 bp, Homo sapiens
ttctcagccacaaacc

SEQ ID NO: 3407554 - DNA, 16 bp, Homo sapiens
ttctcatttcacccct

SEQ ID NO: 3407555 - DNA, 18 bp, Homo sapiens
ttctcccctgcccccagg

SEQ ID NO: 3407556 - DNA, 21 bp, Homo sapiens
ttctcccctgcccccaggact

SEQ ID NO: 3407557 - DNA, 22 bp, Homo sapiens
ttctcccctgcccccaggactg

SEQ ID NO: 3407558 - DNA, 23 bp, Homo sapiens
ttctcccctgcccccaggactgg

SEQ ID NO: 3407559 - DNA, 20 bp, Homo sapiens
ttctccttcagccctcaccc

SEQ ID NO: 3407560 - DNA, 23 bp, Homo sapiens
ttctctcatctcttagctcccct

SEQ ID NO: 3407561 - DNA, 17 bp, Homo sapiens
ttctctggcaaactttt

SEQ ID NO: 3407562 - DNA, 12 bp, Homo sapiens
ttctctttgtgc

SEQ ID NO: 3407563 - DNA, 15 bp, Homo sapiens
ttctgatgttttatt

SEQ ID NO: 3407564 - DNA, 14 bp, Homo sapiens
ttctggctttgttc

SEQ ID NO: 3407565 - DNA, 21 bp, Homo sapiens
ttctggctttgttcttgtcat

SEQ ID NO: 3407566 - DNA, 15 bp, Homo sapiens
ttctgggtgatttct

SEQ ID NO: 3407567 - DNA, 16 bp, Homo sapiens
ttctgggtgatttcta

SEQ ID NO: 3407568 - DNA, 14 bp, Homo sapiens
ttctgtagttttta

SEQ ID NO: 3407569 - DNA, 20 bp, Homo sapiens
ttctgtagtttttaattaaa

SEQ ID NO: 3407570 - DNA, 18 bp, Homo sapiens
ttcttaaaatgcaatatt

SEQ ID NO: 3407571 - DNA, 18 bp, Homo sapiens
ttgtccctgaagagaagg

SEQ ID NO: 3407572 - DNA, 23 bp, Homo sapiens
ttgtgaaatgaaaacatgtaata

SEQ ID NO: 3407573 - DNA, 11 bp, Homo sapiens
ttgtgaaattg

SEQ ID NO: 3407574 - DNA, 12 bp, Homo sapiens
ttgtgaaattgt

SEQ ID NO: 3407575 - DNA, 13 bp, Homo sapiens
ttgtgaatggatt

SEQ ID NO: 3407576 - DNA, 14 bp, Homo sapiens
ttgtgaatggattg

SEQ ID NO: 3407577 - DNA, 19 bp, Homo sapiens
ttgtgagctttttgttccc

SEQ ID NO: 3407578 - DNA, 21 bp, Homo sapiens
ttgtgagctttttgttccctc

SEQ ID NO: 3407579 - DNA, 22 bp, Homo sapiens
ttgtgataagttctagttgctt

SEQ ID NO: 3407580 - DNA, 17 bp, Homo sapiens
ttgtgcctccctggtga

SEQ ID NO: 3407581 - DNA, 14 bp, Homo sapiens
ttgtgtaatctaag

SEQ ID NO: 3407582 - DNA, 13 bp, Homo sapiens
ttgtgtgtgggag

SEQ ID NO: 3407583 - DNA, 18 bp, Homo sapiens
ttgtgtttagctaccttt

SEQ ID NO: 3407584 - DNA, 23 bp, Homo sapiens
ttgttaaaaaaaaaaagattgta

SEQ ID NO: 3407585 - DNA, 23 bp, Homo sapiens
ttgttaacagacactgtaaaata

SEQ ID NO: 3407586 - DNA, 21 bp, Homo sapiens
ttgttacaggcaccgagaatg

SEQ ID NO: 3407587 - DNA, 19 bp, Homo sapiens
ttgttataacttcataaaa

SEQ ID NO: 3407588 - DNA, 16 bp, Homo sapiens
ttgttccaatgccaca

SEQ ID NO: 3407589 - DNA, 18 bp, Homo sapiens
ttgttcccctcctccact

SEQ ID NO: 3407590 - DNA, 19 bp, Homo sapiens
ttgttcccctcctccactc

SEQ ID NO: 3407591 - DNA, 20 bp, Homo sapiens
ttgttcccctcctccactct

SEQ ID NO: 3407592 - DNA, 16 bp, Homo sapiens
ttgttccctcattctg

SEQ ID NO: 3407593 - DNA, 18 bp, Homo sapiens
ttgttctgggtgatttct

SEQ ID NO: 3407594 - DNA, 20 bp, Homo sapiens
ttgttgcaccaattaagtgt

SEQ ID NO: 3407595 - DNA, 15 bp, Homo sapiens
ttgtttagaagaagt

SEQ ID NO: 3407596 - DNA, 18 bp, Homo sapiens
ttgtttagaagaagtgtg

SEQ ID NO: 3407597 - DNA, 14 bp, Homo sapiens
ttgtttctccccca

SEQ ID NO: 3407598 - DNA, 20 bp, Homo sapiens
ttgtttggagggatcatttt

SEQ ID NO: 3407599 - DNA, 18 bp, Homo sapiens
tttaaaagtttgtccttt

SEQ ID NO: 3407600 - DNA, 19 bp, Homo sapiens
tttaaaataaaatttttta

SEQ ID NO: 3407601 - DNA, 16 bp, Homo sapiens
tttaaaatcttgcatg

SEQ ID NO: 3407602 - DNA, 16 bp, Homo sapiens
tttaaaattgtgatgt

SEQ ID NO: 3407603 - DNA, 16 bp, Homo sapiens
tttaaacaaaatttca

SEQ ID NO: 3407604 - DNA, 14 bp, Homo sapiens
tttaaaccactaat

SEQ ID NO: 3407605 - DNA, 19 bp, Homo sapiens
tttaaaggacaaacagtga

SEQ ID NO: 3407606 - DNA, 13 bp, Homo sapiens
tttaaagtaaact

SEQ ID NO: 3407607 - DNA, 14 bp, Homo sapiens
tttaaagtaaactt

SEQ ID NO: 3407608 - DNA, 23 bp, Homo sapiens
tttaaatatctgaacatttacta

SEQ ID NO: 3407609 - DNA, 13 bp, Homo sapiens
tttaaatgccaaa

SEQ ID NO: 3407610 - DNA, 19 bp, Homo sapiens
tttaaattgttataacttc

SEQ ID NO: 3407611 - DNA, 24 bp, Homo sapiens
tttaacaggttttcttctaatcat

SEQ ID NO: 3407612 - DNA, 17 bp, Homo sapiens
tttaactacatctgcct

SEQ ID NO: 3407613 - DNA, 20 bp, Homo sapiens
tttaactatgaactgaaggc

SEQ ID NO: 3407614 - DNA, 16 bp, Homo sapiens
tttaagatttttctca

SEQ ID NO: 3407615 - DNA, 22 bp, Homo sapiens
tttaagcatgagtggccttaat

SEQ ID NO: 3407616 - DNA, 14 bp, Homo sapiens
tttaagctctgagc

SEQ ID NO: 3407617 - DNA, 17 bp, Homo sapiens
tttaagctctgagctgt

SEQ ID NO: 3407618 - DNA, 23 bp, Homo sapiens
tttaagtgacataattgtccagt

SEQ ID NO: 3407619 - DNA, 21 bp, Homo sapiens
tttaagtgcgtgtgtagagtt

SEQ ID NO: 3407620 - DNA, 13 bp, Homo sapiens
tttaagtttgaaa

SEQ ID NO: 3407621 - DNA, 15 bp, Homo sapiens
tttaataacattacc

SEQ ID NO: 3407622 - DNA, 18 bp, Homo sapiens
tttaataacattacctta

SEQ ID NO: 3407623 - DNA, 20 bp, Homo sapiens
tttaataacattaccttact

SEQ ID NO: 3407624 - DNA, 17 bp, Homo sapiens
tttaatagaaccatgtt

SEQ ID NO: 3407625 - DNA, 15 bp, Homo sapiens
tttaatattacctaa

SEQ ID NO: 3407626 - DNA, 12 bp, Homo sapiens
tttaatcactta

SEQ ID NO: 3407627 - DNA, 19 bp, Homo sapiens
tttaattaaaaactttaaa

SEQ ID NO: 3407628 - DNA, 14 bp, Homo sapiens
tttacaacaaacac

SEQ ID NO: 3407629 - DNA, 21 bp, Homo sapiens
tttacatacagtgatatggta

SEQ ID NO: 3407630 - DNA, 16 bp, Homo sapiens
tttacattaaagaaat

SEQ ID NO: 3407631 - DNA, 23 bp, Homo sapiens
tttacattaaagaaatttaatgt

SEQ ID NO: 3407632 - DNA, 21 bp, Homo sapiens
tttaccctcctctatttcttt

SEQ ID NO: 3407633 - DNA, 13 bp, Homo sapiens
tttactcttaaat

SEQ ID NO: 3407634 - DNA, 17 bp, Homo sapiens
tttactgcctgaataaa

SEQ ID NO: 3407635 - DNA, 20 bp, Homo sapiens
tttacttgatcattctcagt

SEQ ID NO: 3407636 - DNA, 15 bp, Homo sapiens
tttactttttaaaca

SEQ ID NO: 3407637 - DNA, 19 bp, Homo sapiens
tttagaagaagtgtgtcac

SEQ ID NO: 3407638 - DNA, 23 bp, Homo sapiens
tttagactgtggccatatatgct

SEQ ID NO: 3407639 - DNA, 12 bp, Homo sapiens
tttagctacctt

SEQ ID NO: 3407640 - DNA, 20 bp, Homo sapiens
tttagctacctttttatatt

SEQ ID NO: 3407641 - DNA, 11 bp, Homo sapiens
tttaggagaag

SEQ ID NO: 3407642 - DNA, 14 bp, Homo sapiens
tttaggagaagttg

SEQ ID NO: 3407643 - DNA, 18 bp, Homo sapiens
tttagggtgggtaagaaa

SEQ ID NO: 3407644 - DNA, 17 bp, Homo sapiens
tttagtatatgaaatat

SEQ ID NO: 3407645 - DNA, 19 bp, Homo sapiens
tttagttacgtataatgct

SEQ ID NO: 3407646 - DNA, 21 bp, Homo sapiens
tttagttacgtataatgcttt

SEQ ID NO: 3407647 - DNA, 11 bp, Homo sapiens
tttataataaa

SEQ ID NO: 3407648 - DNA, 14 bp, Homo sapiens
tttatatattgaaa

SEQ ID NO: 3407649 - DNA, 16 bp, Homo sapiens
tttatatctggaatga

SEQ ID NO: 3407650 - DNA, 13 bp, Homo sapiens
tttatatcttgtt

SEQ ID NO: 3407651 - DNA, 12 bp, Homo sapiens
tttatctccttg

SEQ ID NO: 3407652 - DNA, 23 bp, Homo sapiens
tttatctccttgtggcctatgaa

SEQ ID NO: 3407653 - DNA, 12 bp, Homo sapiens
tttatctgtgga

SEQ ID NO: 3407654 - DNA, 18 bp, Homo sapiens
tttatctttgattctcct

SEQ ID NO: 3407655 - DNA, 22 bp, Homo sapiens
tttatgacacaatgacacattt

SEQ ID NO: 3407656 - DNA, 12 bp, Homo sapiens
tttatgagccag

SEQ ID NO: 3407657 - DNA, 19 bp, Homo sapiens
tttatgagccagacaaatg

SEQ ID NO: 3407658 - DNA, 12 bp, Homo sapiens
tttatgatttaa

SEQ ID NO: 3407659 - DNA, 14 bp, Homo sapiens
tttatgatttaata

SEQ ID NO: 3407660 - DNA, 11 bp, Homo sapiens
tttatgtgtgt

SEQ ID NO: 3407661 - DNA, 12 bp, Homo sapiens
tttattaaatct

SEQ ID NO: 3407662 - DNA, 20 bp, Homo sapiens
tttattcagctagaatttct

SEQ ID NO: 3407663 - DNA, 21 bp, Homo sapiens
tttcaatggtttgcaaggaag

SEQ ID NO: 3407664 - DNA, 23 bp, Homo sapiens
tttcaatttactttttaaacagt

SEQ ID NO: 3407665 - DNA, 19 bp, Homo sapiens
tttcaatttccaagagctg

SEQ ID NO: 3407666 - DNA, 13 bp, Homo sapiens
tttcacagttctg

SEQ ID NO: 3407667 - DNA, 15 bp, Homo sapiens
tttcacccctccctt

SEQ ID NO: 3407668 - DNA, 14 bp, Homo sapiens
tttcagagttttac

SEQ ID NO: 3407669 - DNA, 19 bp, Homo sapiens
tttcaggtgacatgtgaaa

SEQ ID NO: 3407670 - DNA, 22 bp, Homo sapiens
tttcaggtgacatgtgaaacct

SEQ ID NO: 3407671 - DNA, 17 bp, Homo sapiens
tttcagtgaaagcatca

SEQ ID NO: 3407672 - DNA, 23 bp, Homo sapiens
tttcatagatttgaaaaactttt

SEQ ID NO: 3407673 - DNA, 16 bp, Homo sapiens
tttcatctatttctga

SEQ ID NO: 3407674 - DNA, 11 bp, Homo sapiens
tttcatctgct

SEQ ID NO: 3407675 - DNA, 16 bp, Homo sapiens
tttcatctgctctcct

SEQ ID NO: 3407676 - DNA, 23 bp, Homo sapiens
tttcattgggaaaggacagcttt

SEQ ID NO: 3407677 - DNA, 15 bp, Homo sapiens
tttcatttttttcca

SEQ ID NO: 3407678 - DNA, 22 bp, Homo sapiens
tttccaggctggttcggatttg

SEQ ID NO: 3407679 - DNA, 17 bp, Homo sapiens
tttccatgaaaatgcaa

SEQ ID NO: 3407680 - DNA, 16 bp, Homo sapiens
tttcccctgcaatgcg

SEQ ID NO: 3407681 - DNA, 20 bp, Homo sapiens
tttcctctttacctgttcaa

SEQ ID NO: 3407682 - DNA, 15 bp, Homo sapiens
tttccttacttttaa

SEQ ID NO: 3407683 - DNA, 16 bp, Homo sapiens
ttttgaaaagctatta

SEQ ID NO: 3407684 - DNA, 16 bp, Homo sapiens
ttttgaagaacaaaag

SEQ ID NO: 3407685 - DNA, 16 bp, Homo sapiens
ttttgaatccatgctt

SEQ ID NO: 3407686 - DNA, 18 bp, Homo sapiens
ttttgaatgcttcctgac

SEQ ID NO: 3407687 - DNA, 20 bp, Homo sapiens
ttttgcccatataaaatgct

SEQ ID NO: 3407688 - DNA, 21 bp, Homo sapiens
ttttgctttgttgaataatac

SEQ ID NO: 3407689 - DNA, 22 bp, Homo sapiens
ttttggaagaagttttttactt

SEQ ID NO: 3407690 - DNA, 17 bp, Homo sapiens
ttttggatttctttata

SEQ ID NO: 3407691 - DNA, 18 bp, Homo sapiens
ttttggatttctttatat

SEQ ID NO: 3407692 - DNA, 14 bp, Homo sapiens
ttttggttttgttc

SEQ ID NO: 3407693 - DNA, 24 bp, Homo sapiens
ttttgtgaaatgaaaacatgtaat

SEQ ID NO: 3407694 - DNA, 19 bp, Homo sapiens
ttttgtgaatggattggat

SEQ ID NO: 3407695 - DNA, 22 bp, Homo sapiens
ttttgttccctcattctgcatt

SEQ ID NO: 3407696 - DNA, 15 bp, Homo sapiens
tttttaaaagagaca

SEQ ID NO: 3407697 - DNA, 20 bp, Homo sapiens
tttttaaaagagacaaactg

SEQ ID NO: 3407698 - DNA, 18 bp, Homo sapiens
tttttaaaggacaaacag

SEQ ID NO: 3407699 - DNA, 22 bp, Homo sapiens
tttttaaagtaaacttgtgtat

SEQ ID NO: 3407700 - DNA, 13 bp, Homo sapiens
tttttaagatttt

SEQ ID NO: 3407701 - DNA, 14 bp, Homo sapiens
tttttaagctctga

SEQ ID NO: 3407702 - DNA, 13 bp, Homo sapiens
tttttaatagaac

SEQ ID NO: 3407703 - DNA, 18 bp, Homo sapiens
tttttagtttaaaatctt

SEQ ID NO: 3407704 - DNA, 18 bp, Homo sapiens
tttttatattagttgctt

SEQ ID NO: 3407705 - DNA, 12 bp, Homo sapiens
tttttcccctgc

SEQ ID NO: 3407706 - DNA, 15 bp, Homo sapiens
tttttcccctgcaat

SEQ ID NO: 3407707 - DNA, 18 bp, Homo sapiens
tttttccttacttttaaa

SEQ ID NO: 3407708 - DNA, 19 bp, Homo sapiens
tttttgttgagtctctgaa

SEQ ID NO: 3407709 - DNA, 12 bp, Homo sapiens
ttttttaaagta

SEQ ID NO: 3407710 - DNA, 11 bp, Homo sapiens
ttttttaagat

SEQ ID NO: 3407711 - DNA, 15 bp, Homo sapiens
ttttttatatatgtg

SEQ ID NO: 3407712 - DNA, 12 bp, Homo sapiens
ttttttgttgtt

SEQ ID NO: 3407713 - DNA, 12 bp, Homo sapiens
ttttttttaagt

SEQ ID NO: 3407714 - DNA, 21 bp, Homo sapiens
aatacctttaaatttaggtaa

SEQ ID NO: 3407715 - DNA, 22 bp, Homo sapiens
aatagaggtgatgctgctaaag

SEQ ID NO: 3407716 - DNA, 16 bp, Homo sapiens
aataggttttaaacga

SEQ ID NO: 3407717 - DNA, 20 bp, Homo sapiens
aatagtgcttaaaaatcatt

SEQ ID NO: 3407718 - DNA, 19 bp, Homo sapiens
aatagtgtcctatgcaata

SEQ ID NO: 3407719 - DNA, 20 bp, Homo sapiens
aatagtgtcctatgcaataa

SEQ ID NO: 3407720 - DNA, 14 bp, Homo sapiens
aatataaaatgttt

SEQ ID NO: 3407721 - DNA, 16 bp, Homo sapiens
aatataaaatgtttca

SEQ ID NO: 3407722 - DNA, 14 bp, Homo sapiens
aatataaacactat

SEQ ID NO: 3407723 - DNA, 16 bp, Homo sapiens
aatatactttttttgt

SEQ ID NO: 3407724 - DNA, 11 bp, Homo sapiens
aatatataaaa

SEQ ID NO: 3407725 - DNA, 14 bp, Homo sapiens
aatatataaaaata

SEQ ID NO: 3407726 - DNA, 17 bp, Homo sapiens
aatatatggcatttgca

SEQ ID NO: 3407727 - DNA, 15 bp, Homo sapiens
aatatcaaaaggaag

SEQ ID NO: 3407728 - DNA, 19 bp, Homo sapiens
aatatctgaacatttacta

SEQ ID NO: 3407729 - DNA, 21 bp, Homo sapiens
aatatctgaacatttactaca

SEQ ID NO: 3407730 - DNA, 18 bp, Homo sapiens
aatatgaaactcatctgt

SEQ ID NO: 3407731 - DNA, 11 bp, Homo sapiens
aatatgagaat

SEQ ID NO: 3407732 - DNA, 13 bp, Homo sapiens
aatatgagaatgt

SEQ ID NO: 3407733 - DNA, 15 bp, Homo sapiens
aatatgagaatgtat

SEQ ID NO: 3407734 - DNA, 22 bp, Homo sapiens
aatatgcagtgatatggcagaa

SEQ ID NO: 3407735 - DNA, 11 bp, Homo sapiens
aatatgttacc

SEQ ID NO: 3407736 - DNA, 14 bp, Homo sapiens
aatattaagaaaca

SEQ ID NO: 3407737 - DNA, 15 bp, Homo sapiens
aatattaagaaacaa

SEQ ID NO: 3407738 - DNA, 19 bp, Homo sapiens
aatattaagaaacaattta

SEQ ID NO: 3407739 - DNA, 18 bp, Homo sapiens
aatattacctaatgaaag

SEQ ID NO: 3407740 - DNA, 21 bp, Homo sapiens
aatatttgttcttataaacct

SEQ ID NO: 3407741 - DNA, 14 bp, Homo sapiens
aatatttttaaaag

SEQ ID NO: 3407742 - DNA, 20 bp, Homo sapiens
aatcaagatttaatcctaga

SEQ ID NO: 3407743 - DNA, 22 bp, Homo sapiens
aatcatcgaggtatgtttatat

SEQ ID NO: 3407744 - DNA, 23 bp, Homo sapiens
aatcatcgaggtatgtttatatt

SEQ ID NO: 3407745 - DNA, 19 bp, Homo sapiens
aatcatgctcatgtatatt

SEQ ID NO: 3407746 - DNA, 12 bp, Homo sapiens
aatccctgaccc

SEQ ID NO: 3407747 - DNA, 17 bp, Homo sapiens
aatcgagactgcaatgt

SEQ ID NO: 3407748 - DNA, 17 bp, Homo sapiens
aatctatattaaatgag

SEQ ID NO: 3407749 - DNA, 14 bp, Homo sapiens
aatctgaattttaa

SEQ ID NO: 3407750 - DNA, 19 bp, Homo sapiens
aatctggggaagaggtttt

SEQ ID NO: 3407751 - DNA, 20 bp, Homo sapiens
aatcttcagctggtggatgg

SEQ ID NO: 3407752 - DNA, 16 bp, Homo sapiens
aatgaatttgactggt

SEQ ID NO: 3407753 - DNA, 15 bp, Homo sapiens
aatgagggtttctga

SEQ ID NO: 3407754 - DNA, 15 bp, Homo sapiens
aatgagttacttaga

SEQ ID NO: 3407755 - DNA, 17 bp, Homo sapiens
aatgatacccaacagtt

SEQ ID NO: 3407756 - DNA, 17 bp, Homo sapiens
aatgatcacatctaaag

SEQ ID NO: 3407757 - DNA, 17 bp, Homo sapiens
aatgatttttgtgtatc

SEQ ID NO: 3407758 - DNA, 15 bp, Homo sapiens
aatgcaacaacatgt

SEQ ID NO: 3407759 - DNA, 14 bp, Homo sapiens
aatgcaatatttgt

SEQ ID NO: 3407760 - DNA, 18 bp, Homo sapiens
aatgcagaggaggagaaa

SEQ ID NO: 3407761 - DNA, 17 bp, Homo sapiens
aatgcatagagcaatta

SEQ ID NO: 3407762 - DNA, 18 bp, Homo sapiens
aatgcatatcctgagcca

SEQ ID NO: 3407763 - DNA, 12 bp, Homo sapiens
aatgcattcatg

SEQ ID NO: 3407764 - DNA, 15 bp, Homo sapiens
aatgcattcatgttt

SEQ ID NO: 3407765 - DNA, 14 bp, Homo sapiens
aatgcccatttttg

SEQ ID NO: 3407766 - DNA, 17 bp, Homo sapiens
aatgcctttgagacagt

SEQ ID NO: 3407767 - DNA, 14 bp, Homo sapiens
aatgcgtcttgtga

SEQ ID NO: 3407768 - DNA, 20 bp, Homo sapiens
aatgcgtggcacatctaaat

SEQ ID NO: 3407769 - DNA, 14 bp, Homo sapiens
aatgctgatattta

SEQ ID NO: 3407770 - DNA, 21 bp, Homo sapiens
aatgctgcccagggtcagtgt

SEQ ID NO: 3407771 - DNA, 22 bp, Homo sapiens
aatgctgtgcaaacagtgtaag

SEQ ID NO: 3407772 - DNA, 18 bp, Homo sapiens
aatgcttcactgtacgta

SEQ ID NO: 3407773 - DNA, 19 bp, Homo sapiens
aatgcttgccaagaaatcg

SEQ ID NO: 3407774 - DNA, 13 bp, Homo sapiens
aatggaagaaacc

SEQ ID NO: 3407775 - DNA, 20 bp, Homo sapiens
aatggattggattatttaat

SEQ ID NO: 3407776 - DNA, 22 bp, Homo sapiens
aatggattggattatttaataa

SEQ ID NO: 3407777 - DNA, 23 bp, Homo sapiens
aatggattggattatttaataac

SEQ ID NO: 3407778 - DNA, 20 bp, Homo sapiens
aatggcacagcccaaagaag

SEQ ID NO: 3407779 - DNA, 15 bp, Homo sapiens
aatggtggcttcttt

SEQ ID NO: 3407780 - DNA, 23 bp, Homo sapiens
aatggtttgaatataaacactat

SEQ ID NO: 3407781 - DNA, 17 bp, Homo sapiens
aatggtttgcaaggaag

SEQ ID NO: 3407782 - DNA, 18 bp, Homo sapiens
aatggtttgcaaggaagc

SEQ ID NO: 3407783 - DNA, 23 bp, Homo sapiens
aatgtaggcacttttattttcat

SEQ ID NO: 3407784 - DNA, 17 bp, Homo sapiens
aatgtagggttatattt

SEQ ID NO: 3407785 - DNA, 20 bp, Homo sapiens
aatgtattgttctgtttgtg

SEQ ID NO: 3407786 - DNA, 23 bp, Homo sapiens
aatgtattgttctgtttgtgtta

SEQ ID NO: 3407787 - DNA, 19 bp, Homo sapiens
aatgtcacacttgtttctt

SEQ ID NO: 3407788 - DNA, 21 bp, Homo sapiens
aatgtcacacttgtttcttgt

SEQ ID NO: 3407789 - DNA, 22 bp, Homo sapiens
aatgtcacacttgtttcttgtt

SEQ ID NO: 3407790 - DNA, 12 bp, Homo sapiens
aatgtcagtgtt

SEQ ID NO: 3407791 - DNA, 22 bp, Homo sapiens
aatgtcattatttgataacatt

SEQ ID NO: 3407792 - DNA, 19 bp, Homo sapiens
aatgtgatctatgtttcat

SEQ ID NO: 3407793 - DNA, 17 bp, Homo sapiens
aatgtgtctgcaacatg

SEQ ID NO: 3407794 - DNA, 19 bp, Homo sapiens
aatgtgtctgcaacatgga

SEQ ID NO: 3407795 - DNA, 21 bp, Homo sapiens
aatgtgtctgcaacatggatt

SEQ ID NO: 3407796 - DNA, 14 bp, Homo sapiens
aatgtgtctgtgtt

SEQ ID NO: 3407797 - DNA, 23 bp, Homo sapiens
aatgtgtgtattcttaaaatgca

SEQ ID NO: 3407798 - DNA, 13 bp, Homo sapiens
aatgttaaatttg

SEQ ID NO: 3407799 - DNA, 21 bp, Homo sapiens
aatgttaaatttgtaagtttc

SEQ ID NO: 3407800 - DNA, 18 bp, Homo sapiens
aatgttaacaggtatttt

SEQ ID NO: 3407801 - DNA, 22 bp, Homo sapiens
aatgttaaggaaactcttatct

SEQ ID NO: 3407802 - DNA, 13 bp, Homo sapiens
aatgttgcactga

SEQ ID NO: 3407803 - DNA, 16 bp, Homo sapiens
aatgttggtgcaatta

SEQ ID NO: 3407804 - DNA, 23 bp, Homo sapiens
aatgttggtgcaattaactctgg

SEQ ID NO: 3407805 - DNA, 17 bp, Homo sapiens
aatgttgtattcagtga

SEQ ID NO: 3407806 - DNA, 17 bp, Homo sapiens
aatgtttatgagccaga

SEQ ID NO: 3407807 - DNA, 12 bp, Homo sapiens
aatgttttcatt

SEQ ID NO: 3407808 - DNA, 14 bp, Homo sapiens
aattaaaaatgaaa

SEQ ID NO: 3407809 - DNA, 18 bp, Homo sapiens
aattaaattttgtgtctc

SEQ ID NO: 3407810 - DNA, 22 bp, Homo sapiens
aattaagttagggaatggcaca

SEQ ID NO: 3407811 - DNA, 19 bp, Homo sapiens
aattaccatagagtaatga

SEQ ID NO: 3407812 - DNA, 22 bp, Homo sapiens
aattaccatagagtaatgatgt

SEQ ID NO: 3407813 - DNA, 15 bp, Homo sapiens
aattaggtccacttc

SEQ ID NO: 3407814 - DNA, 20 bp, Homo sapiens
aattccatttacttgatcat

SEQ ID NO: 3407815 - DNA, 16 bp, Homo sapiens
aattctgaaatacttt

SEQ ID NO: 3407816 - DNA, 22 bp, Homo sapiens
aattctttgacctgttgggagt

SEQ ID NO: 3407817 - DNA, 23 bp, Homo sapiens
aattgaaatttaaaaataaagct

SEQ ID NO: 3407818 - DNA, 14 bp, Homo sapiens
aattgatcattcat

SEQ ID NO: 3407819 - DNA, 21 bp, Homo sapiens
aattgcagtttcatgtatgta

SEQ ID NO: 3407820 - DNA, 14 bp, Homo sapiens
aattggcataattt

SEQ ID NO: 3407821 - DNA, 18 bp, Homo sapiens
aattggcataatttgtct

SEQ ID NO: 3407822 - DNA, 20 bp, Homo sapiens
aattggtcatggtagatttt

SEQ ID NO: 3407823 - DNA, 17 bp, Homo sapiens
aattggttgtatataaa

SEQ ID NO: 3407824 - DNA, 15 bp, Homo sapiens
aattgtgatgtgtcc

SEQ ID NO: 3407825 - DNA, 18 bp, Homo sapiens
agagacaaactgtaaaaa

SEQ ID NO: 3407826 - DNA, 18 bp, Homo sapiens
agagagccattttgtgaa

SEQ ID NO: 3407827 - DNA, 22 bp, Homo sapiens
agagatccattgccatcagtga

SEQ ID NO: 3407828 - DNA, 18 bp, Homo sapiens
agagcagatgcagagagc

SEQ ID NO: 3407829 - DNA, 16 bp, Homo sapiens
agagccattttgtgaa

SEQ ID NO: 3407830 - DNA, 17 bp, Homo sapiens
agagccattttgtgaat

SEQ ID NO: 3407831 - DNA, 22 bp, Homo sapiens
agagcccagaggtaacagaaca

SEQ ID NO: 3407832 - DNA, 24 bp, Homo sapiens
agagcccagaggtaacagaacagc

SEQ ID NO: 3407833 - DNA, 15 bp, Homo sapiens
agagcccaggagctc

SEQ ID NO: 3407834 - DNA, 21 bp, Homo sapiens
agagctaacccttatctgtaa

SEQ ID NO: 3407835 - DNA, 13 bp, Homo sapiens
agaggaggagaaa

SEQ ID NO: 3407836 - DNA, 21 bp, Homo sapiens
agaggcctgcctccagggctg

SEQ ID NO: 3407837 - DNA, 17 bp, Homo sapiens
agaggggctggacctgg

SEQ ID NO: 3407838 - DNA, 17 bp, Homo sapiens
agaggttttatttacat

SEQ ID NO: 3407839 - DNA, 23 bp, Homo sapiens
agagtcatgtgagcctcgtgtca

SEQ ID NO: 3407840 - DNA, 22 bp, Homo sapiens
agagtgtagaagcattccttct

SEQ ID NO: 3407841 - DNA, 22 bp, Homo sapiens
agagtgtttgtgagctttttgt

SEQ ID NO: 3407842 - DNA, 15 bp, Homo sapiens
agagttaagaagctg

SEQ ID NO: 3407843 - DNA, 18 bp, Homo sapiens
agagttaagaagctgttg

SEQ ID NO: 3407844 - DNA, 20 bp, Homo sapiens
agagttaagaagctgttgta

SEQ ID NO: 3407845 - DNA, 20 bp, Homo sapiens
agagttgttgtttgccaagc

SEQ ID NO: 3407846 - DNA, 19 bp, Homo sapiens
agagtttgatcatagaatt

SEQ ID NO: 3407847 - DNA, 20 bp, Homo sapiens
agagtttgatcatagaattg

SEQ ID NO: 3407848 - DNA, 20 bp, Homo sapiens
agagtttgatgaggccctcc

SEQ ID NO: 3407849 - DNA, 22 bp, Homo sapiens
agagtttgatgaggccctccac

SEQ ID NO: 3407850 - DNA, 23 bp, Homo sapiens
agagtttgatgaggccctccaca

SEQ ID NO: 3407851 - DNA, 20 bp, Homo sapiens
agagtttggttaatcagtgt

SEQ ID NO: 3407852 - DNA, 16 bp, Homo sapiens
agataagcaagagaga

SEQ ID NO: 3407853 - DNA, 20 bp, Homo sapiens
agataagcaagagagatgtt

SEQ ID NO: 3407854 - DNA, 22 bp, Homo sapiens
agataagcaagagagatgtttt

SEQ ID NO: 3407855 - DNA, 14 bp, Homo sapiens
agatatgaatatat

SEQ ID NO: 3407856 - DNA, 16 bp, Homo sapiens
agatatttaaaagaca

SEQ ID NO: 3407857 - DNA, 20 bp, Homo sapiens
agatatttaaaagacaaaca

SEQ ID NO: 3407858 - DNA, 21 bp, Homo sapiens
agatattttatttctgatgtt

SEQ ID NO: 3407859 - DNA, 17 bp, Homo sapiens
agatcactgaattggaa

SEQ ID NO: 3407860 - DNA, 14 bp, Homo sapiens
agatctgatttata

SEQ ID NO: 3407861 - DNA, 18 bp, Homo sapiens
agatcttgcagaagttct

SEQ ID NO: 3407862 - DNA, 11 bp, Homo sapiens
agatgaaaacc

SEQ ID NO: 3407863 - DNA, 23 bp, Homo sapiens
agatgaaaacctgcatttttaaa

SEQ ID NO: 3407864 - DNA, 18 bp, Homo sapiens
agatgaaaccgtccctga

SEQ ID NO: 3407865 - DNA, 18 bp, Homo sapiens
agatgaacagactgacct

SEQ ID NO: 3407866 - DNA, 16 bp, Homo sapiens
agatgatcaacataat

SEQ ID NO: 3407867 - DNA, 14 bp, Homo sapiens
agatgattcaaata

SEQ ID NO: 3407868 - DNA, 12 bp, Homo sapiens
agatgcagagag

SEQ ID NO: 3407869 - DNA, 15 bp, Homo sapiens
agatgcagagagcca

SEQ ID NO: 3407870 - DNA, 18 bp, Homo sapiens
agatgcagagagccattt

SEQ ID NO: 3407871 - DNA, 19 bp, Homo sapiens
agatgctagcacatgccct

SEQ ID NO: 3407872 - DNA, 21 bp, Homo sapiens
agatgtccctgaagtcttgca

SEQ ID NO: 3407873 - DNA, 23 bp, Homo sapiens
agatgttatttttgtatttttaa

SEQ ID NO: 3407874 - DNA, 17 bp, Homo sapiens
agattccacacaaaatg

SEQ ID NO: 3407875 - DNA, 23 bp, Homo sapiens
agattcttccattaaattgcctt

SEQ ID NO: 3407876 - DNA, 14 bp, Homo sapiens
agattggctcacac

SEQ ID NO: 3407877 - DNA, 21 bp, Homo sapiens
agatttactgctctagaaagt

SEQ ID NO: 3407878 - DNA, 20 bp, Homo sapiens
agatttcatctgctctcctt

SEQ ID NO: 3407879 - DNA, 21 bp, Homo sapiens
agatttcatctgctctccttc

SEQ ID NO: 3407880 - DNA, 16 bp, Homo sapiens
agatttctttgaatgt

SEQ ID NO: 3407881 - DNA, 17 bp, Homo sapiens
agatttgaaaaactttt

SEQ ID NO: 3407882 - DNA, 14 bp, Homo sapiens
agattttgaatgct

SEQ ID NO: 3407883 - DNA, 22 bp, Homo sapiens
agatttttatattagttgcttt

SEQ ID NO: 3407884 - DNA, 13 bp, Homo sapiens
agatttttctcaa

SEQ ID NO: 3407885 - DNA, 13 bp, Homo sapiens
agcaaaaagtgta

SEQ ID NO: 3407886 - DNA, 15 bp, Homo sapiens
agcaaaaagtgtaat

SEQ ID NO: 3407887 - DNA, 14 bp, Homo sapiens
agcaaagagaatgt

SEQ ID NO: 3407888 - DNA, 16 bp, Homo sapiens
agcaaagtgtcagtgt

SEQ ID NO: 3407889 - DNA, 18 bp, Homo sapiens
agcaaagtgtcagtgttg

SEQ ID NO: 3407890 - DNA, 13 bp, Homo sapiens
agcaagtctcttt

SEQ ID NO: 3407891 - DNA, 16 bp, Homo sapiens
agcaatctgttgaaat

SEQ ID NO: 3407892 - DNA, 23 bp, Homo sapiens
agcacatgccctaatgtctgtat

SEQ ID NO: 3407893 - DNA, 22 bp, Homo sapiens
agcacattttgacacaatgttg

SEQ ID NO: 3407894 - DNA, 16 bp, Homo sapiens
agcaccggaccagcct

SEQ ID NO: 3407895 - DNA, 17 bp, Homo sapiens
agcaccggaccagcctg

SEQ ID NO: 3407896 - DNA, 18 bp, Homo sapiens
agcaccggaccagcctgg

SEQ ID NO: 3407897 - DNA, 23 bp, Homo sapiens
agcaccggaccagcctggcccac

SEQ ID NO: 3407898 - DNA, 11 bp, Homo sapiens
agcactgagga

SEQ ID NO: 3407899 - DNA, 23 bp, Homo sapiens
agcagaagggggtggtgtctcca

SEQ ID NO: 3407900 - DNA, 15 bp, Homo sapiens
agcagagttctttgc

SEQ ID NO: 3407901 - DNA, 19 bp, Homo sapiens
agcagcctccttatatttg

SEQ ID NO: 3407902 - DNA, 11 bp, Homo sapiens
agcagctacca

SEQ ID NO: 3407903 - DNA, 14 bp, Homo sapiens
agcagtacaataaa

SEQ ID NO: 3407904 - DNA, 15 bp, Homo sapiens
agcatcaaacatgaa

SEQ ID NO: 3407905 - DNA, 20 bp, Homo sapiens
agcatgacaaaagtgacaga

SEQ ID NO: 3407906 - DNA, 23 bp, Homo sapiens
agcatgacaaaagtgacagatgt

SEQ ID NO: 3407907 - DNA, 22 bp, Homo sapiens
agcatttatttctctggcaaac

SEQ ID NO: 3407908 - DNA, 13 bp, Homo sapiens
agcattttcagca

SEQ ID NO: 3407909 - DNA, 16 bp, Homo sapiens
agccaagctccctgga

SEQ ID NO: 3407910 - DNA, 20 bp, Homo sapiens
agccaagctccctggagccc

SEQ ID NO: 3407911 - DNA, 13 bp, Homo sapiens
agccacagctggt

SEQ ID NO: 3407912 - DNA, 13 bp, Homo sapiens
agccacaggcctg

SEQ ID NO: 3407913 - DNA, 20 bp, Homo sapiens
agccagcaccggaccagcct

SEQ ID NO: 3407914 - DNA, 15 bp, Homo sapiens
agccaggatcatggt

SEQ ID NO: 3407915 - DNA, 21 bp, Homo sapiens
agccagggagagcccaggagc

SEQ ID NO: 3407916 - DNA, 22 bp, Homo sapiens
agccagggagagcccaggagct

SEQ ID NO: 3407917 - DNA, 23 bp, Homo sapiens
agccagtcattgtaacctcgtgt

SEQ ID NO: 3407918 - DNA, 16 bp, Homo sapiens
agcccaaagaaggaaa

SEQ ID NO: 3407919 - DNA, 16 bp, Homo sapiens
agcccagaggagggca

SEQ ID NO: 3407920 - DNA, 14 bp, Homo sapiens
agcccaggagctcc

SEQ ID NO: 3407921 - DNA, 14 bp, Homo sapiens
agcccaggccagga

SEQ ID NO: 3407922 - DNA, 15 bp, Homo sapiens
agcccaggccaggac

SEQ ID NO: 3407923 - DNA, 16 bp, Homo sapiens
agcccaggccaggact

SEQ ID NO: 3407924 - DNA, 22 bp, Homo sapiens
agccccaccccagggcagccag

SEQ ID NO: 3407925 - DNA, 19 bp, Homo sapiens
agccctgctgctgcctgcc

SEQ ID NO: 3407926 - DNA, 17 bp, Homo sapiens
agccctgttggcagctc

SEQ ID NO: 3407927 - DNA, 20 bp, Homo sapiens
agccctgttggcagctctag

SEQ ID NO: 3407928 - DNA, 23 bp, Homo sapiens
agcccttgggggtcctcctccag

SEQ ID NO: 3407929 - DNA, 19 bp, Homo sapiens
agcctagatatgaatatat

SEQ ID NO: 3407930 - DNA, 20 bp, Homo sapiens
agcctcagagacatcagccc

SEQ ID NO: 3407931 - DNA, 12 bp, Homo sapiens
agcctccctgcc

SEQ ID NO: 3407932 - DNA, 13 bp, Homo sapiens
agcctccctgcct

SEQ ID NO: 3407933 - DNA, 23 bp, Homo sapiens
agcctccctgcctcaggcctctg

SEQ ID NO: 3407934 - DNA, 13 bp, Homo sapiens
agcctcgagtgcc

SEQ ID NO: 3407935 - DNA, 16 bp, Homo sapiens
agcctcgtgtcatctc

SEQ ID NO: 3407936 - DNA, 14 bp, Homo sapiens
agtttgctgtttta

SEQ ID NO: 3407937 - DNA, 23 bp, Homo sapiens
agtttgctgttttaaattgcatt

SEQ ID NO: 3407938 - DNA, 13 bp, Homo sapiens
agtttgtccttta

SEQ ID NO: 3407939 - DNA, 19 bp, Homo sapiens
agttttactcttaaatcat

SEQ ID NO: 3407940 - DNA, 13 bp, Homo sapiens
agttttgctttgt

SEQ ID NO: 3407941 - DNA, 22 bp, Homo sapiens
agttttgctttgttgaataata

SEQ ID NO: 3407942 - DNA, 17 bp, Homo sapiens
agtttttttatttcttt

SEQ ID NO: 3407943 - DNA, 15 bp, Homo sapiens
ataaaataattctaa

SEQ ID NO: 3407944 - DNA, 22 bp, Homo sapiens
ataaaattgcagtttcatgtat

SEQ ID NO: 3407945 - DNA, 14 bp, Homo sapiens
ataaacaatccaaa

SEQ ID NO: 3407946 - DNA, 15 bp, Homo sapiens
ataaacatctgtgtc

SEQ ID NO: 3407947 - DNA, 16 bp, Homo sapiens
ataaacatctgtgtct

SEQ ID NO: 3407948 - DNA, 20 bp, Homo sapiens
ataaaccttgtttctttctg

SEQ ID NO: 3407949 - DNA, 14 bp, Homo sapiens
ataaagctactgaa

SEQ ID NO: 3407950 - DNA, 15 bp, Homo sapiens
ataaagctactgaat

SEQ ID NO: 3407951 - DNA, 12 bp, Homo sapiens
ataaagctcaag

SEQ ID NO: 3407952 - DNA, 22 bp, Homo sapiens
ataaagtgctgcggagcaagag

SEQ ID NO: 3407953 - DNA, 16 bp, Homo sapiens
ataaataatctacatc

SEQ ID NO: 3407954 - DNA, 14 bp, Homo sapiens
ataaatataaatat

SEQ ID NO: 3407955 - DNA, 13 bp, Homo sapiens
ataaatatatgta

SEQ ID NO: 3407956 - DNA, 14 bp, Homo sapiens
ataaatatttatgt

SEQ ID NO: 3407957 - DNA, 15 bp, Homo sapiens
ataaatgcatagagc

SEQ ID NO: 3407958 - DNA, 16 bp, Homo sapiens
ataaatgcatagagca

SEQ ID NO: 3407959 - DNA, 20 bp, Homo sapiens
ataaatgcatagagcaatta

SEQ ID NO: 3407960 - DNA, 20 bp, Homo sapiens
ataaatttgaactccatggg

SEQ ID NO: 3407961 - DNA, 14 bp, Homo sapiens
ataacaatgttaag

SEQ ID NO: 3407962 - DNA, 12 bp, Homo sapiens
ataacatagttg

SEQ ID NO: 3407963 - DNA, 16 bp, Homo sapiens
ataacattttgtttat

SEQ ID NO: 3407964 - DNA, 17 bp, Homo sapiens
ataacctataaagtgtt

SEQ ID NO: 3407965 - DNA, 13 bp, Homo sapiens
ataactgcccagc

SEQ ID NO: 3407966 - DNA, 16 bp, Homo sapiens
ataactgtgatgaaat

SEQ ID NO: 3407967 - DNA, 17 bp, Homo sapiens
ataagacataacgtttt

SEQ ID NO: 3407968 - DNA, 14 bp, Homo sapiens
ataagcaagagaga

SEQ ID NO: 3407969 - DNA, 16 bp, Homo sapiens
ataagcaagagagatg

SEQ ID NO: 3407970 - DNA, 17 bp, Homo sapiens
ataagcaagagagatgt

SEQ ID NO: 3407971 - DNA, 18 bp, Homo sapiens
ataagcgtatttagactg

SEQ ID NO: 3407972 - DNA, 16 bp, Homo sapiens
ataagctaaagaggct

SEQ ID NO: 3407973 - DNA, 20 bp, Homo sapiens
ataatatttttaattaaata

SEQ ID NO: 3407974 - DNA, 13 bp, Homo sapiens
ataatctatatta

SEQ ID NO: 3407975 - DNA, 15 bp, Homo sapiens
ataatctatattaaa

SEQ ID NO: 3407976 - DNA, 17 bp, Homo sapiens
ataatctatattaaatg

SEQ ID NO: 3407977 - DNA, 18 bp, Homo sapiens
ataatctcctctgctcat

SEQ ID NO: 3407978 - DNA, 18 bp, Homo sapiens
ataatgcatccagcagta

SEQ ID NO: 3407979 - DNA, 15 bp, Homo sapiens
ataatgctttctgag

SEQ ID NO: 3407980 - DNA, 11 bp, Homo sapiens
ataatgtctct

SEQ ID NO: 3407981 - DNA, 20 bp, Homo sapiens
ataatgtgtctgtgttgctt

SEQ ID NO: 3407982 - DNA, 10 bp, Homo sapiens
ataatgttaa

SEQ ID NO: 3407983 - DNA, 18 bp, Homo sapiens
ataatgttaaatttgtaa

SEQ ID NO: 3407984 - DNA, 17 bp, Homo sapiens
atacaagctacagttgt

SEQ ID NO: 3407985 - DNA, 20 bp, Homo sapiens
atacaagtgaacaaaataag

SEQ ID NO: 3407986 - DNA, 18 bp, Homo sapiens
atacacagttaaataaat

SEQ ID NO: 3407987 - DNA, 18 bp, Homo sapiens
atacacatctctgtcagt

SEQ ID NO: 3407988 - DNA, 20 bp, Homo sapiens
atacagagattgtagtattt

SEQ ID NO: 3407989 - DNA, 19 bp, Homo sapiens
atacagatggagcaaatgt

SEQ ID NO: 3407990 - DNA, 16 bp, Homo sapiens
atacatatagatagat

SEQ ID NO: 3407991 - DNA, 13 bp, Homo sapiens
atacctgcctttt

SEQ ID NO: 3407992 - DNA, 15 bp, Homo sapiens
atacggtgggggtag

SEQ ID NO: 3407993 - DNA, 21 bp, Homo sapiens
atactcttaagtgtaaataat

SEQ ID NO: 3407994 - DNA, 13 bp, Homo sapiens
atactgtagtttc

SEQ ID NO: 3407995 - DNA, 15 bp, Homo sapiens
atagaaagagttcta

SEQ ID NO: 3407996 - DNA, 21 bp, Homo sapiens
atagagatatttaaaagacaa

SEQ ID NO: 3407997 - DNA, 12 bp, Homo sapiens
atagagcaatta

SEQ ID NO: 3407998 - DNA, 11 bp, Homo sapiens
atagatgtgtg

SEQ ID NO: 3407999 - DNA, 14 bp, Homo sapiens
atagattgcaaata

SEQ ID NO: 3408000 - DNA, 14 bp, Homo sapiens
atagattgtcttaa

SEQ ID NO: 3408001 - DNA, 16 bp, Homo sapiens
atagattgtcttaatg

SEQ ID NO: 3408002 - DNA, 15 bp, Homo sapiens
atagctaataataaa

SEQ ID NO: 3408003 - DNA, 17 bp, Homo sapiens
atagctctacacaacat

SEQ ID NO: 3408004 - DNA, 22 bp, Homo sapiens
atagctctacacaacatgtatg

SEQ ID NO: 3408005 - DNA, 23 bp, Homo sapiens
atagctctacacaacatgtatgt

SEQ ID NO: 3408006 - DNA, 19 bp, Homo sapiens
atagcttcaggatactgta

SEQ ID NO: 3408007 - DNA, 23 bp, Homo sapiens
atagctttacagatgtagatata

SEQ ID NO: 3408008 - DNA, 21 bp, Homo sapiens
ataggagaggatgagagccca

SEQ ID NO: 3408009 - DNA, 14 bp, Homo sapiens
atagtatgtgcata

SEQ ID NO: 3408010 - DNA, 11 bp, Homo sapiens
atagtcctttt

SEQ ID NO: 3408011 - DNA, 17 bp, Homo sapiens
atagtgcttaaaaatca

SEQ ID NO: 3408012 - DNA, 18 bp, Homo sapiens
atagtgtaaacaaataat

SEQ ID NO: 3408013 - DNA, 16 bp, Homo sapiens
atagtgtcctatgcaa

SEQ ID NO: 3408014 - DNA, 18 bp, Homo sapiens
atagtgtcctatgcaata

SEQ ID NO: 3408015 - DNA, 20 bp, Homo sapiens
atagttgcttttgaaggaat

SEQ ID NO: 3408016 - DNA, 15 bp, Homo sapiens
atagttgtctttctt

SEQ ID NO: 3408017 - DNA, 18 bp, Homo sapiens
atagttgtctttctttgc

SEQ ID NO: 3408018 - DNA, 19 bp, Homo sapiens
atagttttgctttgttgaa

SEQ ID NO: 3408019 - DNA, 22 bp, Homo sapiens
atagttttgctttgttgaataa

SEQ ID NO: 3408020 - DNA, 16 bp, Homo sapiens
atataaaaatatatgt

SEQ ID NO: 3408021 - DNA, 19 bp, Homo sapiens
atataaaaatatatgttga

SEQ ID NO: 3408022 - DNA, 13 bp, Homo sapiens
atataaacactat

SEQ ID NO: 3408023 - DNA, 22 bp, Homo sapiens
atataaagtttttttatttctt

SEQ ID NO: 3408024 - DNA, 13 bp, Homo sapiens
atataaatataaa

SEQ ID NO: 3408025 - DNA, 23 bp, Homo sapiens
atataatcatgctcatgtatatt

SEQ ID NO: 3408026 - DNA, 19 bp, Homo sapiens
atatacaagctacagttgt

SEQ ID NO: 3408027 - DNA, 20 bp, Homo sapiens
atatacttttacattaaaga

SEQ ID NO: 3408028 - DNA, 17 bp, Homo sapiens
atatagctctacacaac

SEQ ID NO: 3408029 - DNA, 22 bp, Homo sapiens
atatagctctacacaacatgta

SEQ ID NO: 3408030 - DNA, 23 bp, Homo sapiens
atatagctctacacaacatgtat

SEQ ID NO: 3408031 - DNA, 16 bp, Homo sapiens
atatagctggcaagaa

SEQ ID NO: 3408032 - DNA, 15 bp, Homo sapiens
atatatgctgtattt

SEQ ID NO: 3408033 - DNA, 18 bp, Homo sapiens
atatatgctgtatttctt

SEQ ID NO: 3408034 - DNA, 15 bp, Homo sapiens
atatatgtatacata

SEQ ID NO: 3408035 - DNA, 17 bp, Homo sapiens
atatatgtatacatata

SEQ ID NO: 3408036 - DNA, 13 bp, Homo sapiens
atatattttaatt

SEQ ID NO: 3408037 - DNA, 23 bp, Homo sapiens
atatatttttttttaagctctga

SEQ ID NO: 3408038 - DNA, 13 bp, Homo sapiens
atatcaaaaggaa

SEQ ID NO: 3408039 - DNA, 14 bp, Homo sapiens
atatcctgagccat

SEQ ID NO: 3408040 - DNA, 12 bp, Homo sapiens
atatctttgcat

SEQ ID NO: 3408041 - DNA, 21 bp, Homo sapiens
atatgaaactcatctgtaaac

SEQ ID NO: 3408042 - DNA, 15 bp, Homo sapiens
atatgaaatattttg

SEQ ID NO: 3408043 - DNA, 23 bp, Homo sapiens
atatgacggaagaacatagaact

SEQ ID NO: 3408044 - DNA, 15 bp, Homo sapiens
atatgagaagaatag

SEQ ID NO: 3408045 - DNA, 13 bp, Homo sapiens
atatgagaatgta

SEQ ID NO: 3408046 - DNA, 15 bp, Homo sapiens
atatgagaatgtatt

SEQ ID NO: 3408047 - DNA, 22 bp, Homo sapiens
atatgggttgcatttggtcaag

SEQ ID NO: 3408048 - DNA, 11 bp, Homo sapiens
caaactcatct

SEQ ID NO: 3408049 - DNA, 12 bp, Homo sapiens
caaactgtaaaa

SEQ ID NO: 3408050 - DNA, 14 bp, Homo sapiens
caaacttttctttc

SEQ ID NO: 3408051 - DNA, 19 bp, Homo sapiens
caaaggaccgttttgtatt

SEQ ID NO: 3408052 - DNA, 21 bp, Homo sapiens
caaaggccagacctgcagacg

SEQ ID NO: 3408053 - DNA, 18 bp, Homo sapiens
caaagttttgaaaagcta

SEQ ID NO: 3408054 - DNA, 23 bp, Homo sapiens
caaataatgtctctgtgagactc

SEQ ID NO: 3408055 - DNA, 13 bp, Homo sapiens
caaatactctgaa

SEQ ID NO: 3408056 - DNA, 14 bp, Homo sapiens
caaatgagatttct

SEQ ID NO: 3408057 - DNA, 17 bp, Homo sapiens
caaatgcattcatgttt

SEQ ID NO: 3408058 - DNA, 19 bp, Homo sapiens
caaatgtgtcccagtgaac

SEQ ID NO: 3408059 - DNA, 23 bp, Homo sapiens
caaattccgattagacctttatc

SEQ ID NO: 3408060 - DNA, 14 bp, Homo sapiens
caacagaaaacaat

SEQ ID NO: 3408061 - DNA, 20 bp, Homo sapiens
caacatggattccaaagcat

SEQ ID NO: 3408062 - DNA, 21 bp, Homo sapiens
caacatggattccaaagcatt

SEQ ID NO: 3408063 - DNA, 19 bp, Homo sapiens
caacatgtataatattttt

SEQ ID NO: 3408064 - DNA, 23 bp, Homo sapiens
caacatgtataatatttttaatt

SEQ ID NO: 3408065 - DNA, 17 bp, Homo sapiens
caacatgtatgtggata

SEQ ID NO: 3408066 - DNA, 19 bp, Homo sapiens
caacatgtatgtggataca

SEQ ID NO: 3408067 - DNA, 17 bp, Homo sapiens
caaccagggagctgcag

SEQ ID NO: 3408068 - DNA, 16 bp, Homo sapiens
caaccccccagcactg

SEQ ID NO: 3408069 - DNA, 21 bp, Homo sapiens
caactatcagactaagccagc

SEQ ID NO: 3408070 - DNA, 13 bp, Homo sapiens
caactcccccacc

SEQ ID NO: 3408071 - DNA, 21 bp, Homo sapiens
caactcccccaccgcccactc

SEQ ID NO: 3408072 - DNA, 20 bp, Homo sapiens
caagaaaacaggcactgccc

SEQ ID NO: 3408073 - DNA, 20 bp, Homo sapiens
caagaatggtggcttctttt

SEQ ID NO: 3408074 - DNA, 19 bp, Homo sapiens
caagacaagctcctccctt

SEQ ID NO: 3408075 - DNA, 21 bp, Homo sapiens
caagattttttttttaagtga

SEQ ID NO: 3408076 - DNA, 19 bp, Homo sapiens
caagcccttcggtcacctg

SEQ ID NO: 3408077 - DNA, 21 bp, Homo sapiens
caagctaatctgcctggtttt

SEQ ID NO: 3408078 - DNA, 18 bp, Homo sapiens
caagctccctggagccct

SEQ ID NO: 3408079 - DNA, 15 bp, Homo sapiens
caagctcctcccttg

SEQ ID NO: 3408080 - DNA, 17 bp, Homo sapiens
caagctcctcccttgag

SEQ ID NO: 3408081 - DNA, 18 bp, Homo sapiens
caaggaacctaattgaaa

SEQ ID NO: 3408082 - DNA, 21 bp, Homo sapiens
caaggaacctaattgaaattt

SEQ ID NO: 3408083 - DNA, 22 bp, Homo sapiens
caaggtgggccttgctacctca

SEQ ID NO: 3408084 - DNA, 13 bp, Homo sapiens
caagtaagaagac

SEQ ID NO: 3408085 - DNA, 18 bp, Homo sapiens
caagtaagaagacatgaa

SEQ ID NO: 3408086 - DNA, 17 bp, Homo sapiens
caagtagaacaaaaact

SEQ ID NO: 3408087 - DNA, 19 bp, Homo sapiens
caagtatccttcattgtga

SEQ ID NO: 3408088 - DNA, 13 bp, Homo sapiens
caagtcagtttct

SEQ ID NO: 3408089 - DNA, 16 bp, Homo sapiens
caagtgaacaaaataa

SEQ ID NO: 3408090 - DNA, 18 bp, Homo sapiens
caagtgggagatgaaaac

SEQ ID NO: 3408091 - DNA, 22 bp, Homo sapiens
caagtgggagatgaaaacctgc

SEQ ID NO: 3408092 - DNA, 15 bp, Homo sapiens
caataaaaataaatc

SEQ ID NO: 3408093 - DNA, 17 bp, Homo sapiens
caataaaaataaatcta

SEQ ID NO: 3408094 - DNA, 17 bp, Homo sapiens
caataaaattatttgca

SEQ ID NO: 3408095 - DNA, 11 bp, Homo sapiens
caatattttcc

SEQ ID NO: 3408096 - DNA, 15 bp, Homo sapiens
caatattttccatga

SEQ ID NO: 3408097 - DNA, 20 bp, Homo sapiens
caatattttccatgaaaatg

SEQ ID NO: 3408098 - DNA, 15 bp, Homo sapiens
caatcaactctaata

SEQ ID NO: 3408099 - DNA, 11 bp, Homo sapiens
caatccctgac

SEQ ID NO: 3408100 - DNA, 13 bp, Homo sapiens
caatgataaataa

SEQ ID NO: 3408101 - DNA, 15 bp, Homo sapiens
caatgccacatactt

SEQ ID NO: 3408102 - DNA, 20 bp, Homo sapiens
caatgccacatacttgcagc

SEQ ID NO: 3408103 - DNA, 15 bp, Homo sapiens
caatgcgtcttgtga

SEQ ID NO: 3408104 - DNA, 19 bp, Homo sapiens
caatgcgtcttgtgaaatt

SEQ ID NO: 3408105 - DNA, 18 bp, Homo sapiens
caatggcttactccagga

SEQ ID NO: 3408106 - DNA, 21 bp, Homo sapiens
caatgtactaggatactgctg

SEQ ID NO: 3408107 - DNA, 22 bp, Homo sapiens
caatgtactaggatactgctgc

SEQ ID NO: 3408108 - DNA, 20 bp, Homo sapiens
caatgtccacctgtgagaaa

SEQ ID NO: 3408109 - DNA, 19 bp, Homo sapiens
caatgttaaggaaactctt

SEQ ID NO: 3408110 - DNA, 20 bp, Homo sapiens
caatgttaaggaaactctta

SEQ ID NO: 3408111 - DNA, 13 bp, Homo sapiens
caattaaactgtg

SEQ ID NO: 3408112 - DNA, 21 bp, Homo sapiens
caattaagtgttgaaaaatat

SEQ ID NO: 3408113 - DNA, 18 bp, Homo sapiens
caattctgaaatactttt

SEQ ID NO: 3408114 - DNA, 18 bp, Homo sapiens
caattcttacaaacatgt

SEQ ID NO: 3408115 - DNA, 19 bp, Homo sapiens
caattcttacaaacatgtg

SEQ ID NO: 3408116 - DNA, 15 bp, Homo sapiens
caattggttgtatat

SEQ ID NO: 3408117 - DNA, 16 bp, Homo sapiens
caattggttgtatata

SEQ ID NO: 3408118 - DNA, 12 bp, Homo sapiens
caatttaaagca

SEQ ID NO: 3408119 - DNA, 17 bp, Homo sapiens
caatttaaattgttata

SEQ ID NO: 3408120 - DNA, 19 bp, Homo sapiens
caatttactttttaaacag

SEQ ID NO: 3408121 - DNA, 21 bp, Homo sapiens
caatttactttttaaacagtg

SEQ ID NO: 3408122 - DNA, 22 bp, Homo sapiens
caatttactttttaaacagtgt

SEQ ID NO: 3408123 - DNA, 15 bp, Homo sapiens
caattttttaaacca

SEQ ID NO: 3408124 - DNA, 17 bp, Homo sapiens
cacaaaagaagaaataa

SEQ ID NO: 3408125 - DNA, 20 bp, Homo sapiens
cacaaaagctgtgtctctgt

SEQ ID NO: 3408126 - DNA, 21 bp, Homo sapiens
cacaaagtataacaattaaaa

SEQ ID NO: 3408127 - DNA, 20 bp, Homo sapiens
cacaaatgtgtcccagtgaa

SEQ ID NO: 3408128 - DNA, 21 bp, Homo sapiens
cacaaatgtgtcccagtgaac

SEQ ID NO: 3408129 - DNA, 14 bp, Homo sapiens
cacacaaaatgtca

SEQ ID NO: 3408130 - DNA, 15 bp, Homo sapiens
cacacagactgttgt

SEQ ID NO: 3408131 - DNA, 22 bp, Homo sapiens
cacaccaggcttgcctgcaggc

SEQ ID NO: 3408132 - DNA, 17 bp, Homo sapiens
cacactgtttttcatac

SEQ ID NO: 3408133 - DNA, 12 bp, Homo sapiens
cacacttgtttc

SEQ ID NO: 3408134 - DNA, 12 bp, Homo sapiens
cacagacccctc

SEQ ID NO: 3408135 - DNA, 14 bp, Homo sapiens
cacagacccctccc

SEQ ID NO: 3408136 - DNA, 19 bp, Homo sapiens
cacagcccaaagaaggaaa

SEQ ID NO: 3408137 - DNA, 17 bp, Homo sapiens
cacagcctgggaccagg

SEQ ID NO: 3408138 - DNA, 19 bp, Homo sapiens
cacagcgctggccgggacc

SEQ ID NO: 3408139 - DNA, 13 bp, Homo sapiens
cacagctcttgtt

SEQ ID NO: 3408140 - DNA, 14 bp, Homo sapiens
cacaggcctgagat

SEQ ID NO: 3408141 - DNA, 22 bp, Homo sapiens
cacagtgtgaataaagtgctgc

SEQ ID NO: 3408142 - DNA, 13 bp, Homo sapiens
cacatcatgttac

SEQ ID NO: 3408143 - DNA, 23 bp, Homo sapiens
cacatccatttcatctatttctg

SEQ ID NO: 3408144 - DNA, 14 bp, Homo sapiens
cacatctaaagctt

SEQ ID NO: 3408145 - DNA, 18 bp, Homo sapiens
cacatctaaagctttatc

SEQ ID NO: 3408146 - DNA, 19 bp, Homo sapiens
cacatctaaagctttatct

SEQ ID NO: 3408147 - DNA, 18 bp, Homo sapiens
cacatctctgtcagtgtg

SEQ ID NO: 3408148 - DNA, 19 bp, Homo sapiens
cacatgccctaatgtctgt

SEQ ID NO: 3408149 - DNA, 23 bp, Homo sapiens
cacatgctctaagaagctcgttt

SEQ ID NO: 3408150 - DNA, 19 bp, Homo sapiens
cacatttggcttacagtaa

SEQ ID NO: 3408151 - DNA, 18 bp, Homo sapiens
caccactcaaaggccaga

SEQ ID NO: 3408152 - DNA, 19 bp, Homo sapiens
caccagagcagatgcagag

SEQ ID NO: 3408153 - DNA, 14 bp, Homo sapiens
caccaggatttata

SEQ ID NO: 3408154 - DNA, 20 bp, Homo sapiens
caccaggcttgcctgcaggc

SEQ ID NO: 3408155 - DNA, 18 bp, Homo sapiens
caccagttcctttcaatg

SEQ ID NO: 3408156 - DNA, 21 bp, Homo sapiens
cacccagaagaagatggctgt

SEQ ID NO: 3408157 - DNA, 15 bp, Homo sapiens
cacccctccctttct

SEQ ID NO: 3408158 - DNA, 17 bp, Homo sapiens
cacccctggttctcatc

SEQ ID NO: 3408159 - DNA, 18 bp, Homo sapiens
cccaggctgccggctccc

SEQ ID NO: 3408160 - DNA, 13 bp, Homo sapiens
cccagggcagcca

SEQ ID NO: 3408161 - DNA, 15 bp, Homo sapiens
cccagggcagccagg

SEQ ID NO: 3408162 - DNA, 18 bp, Homo sapiens
cccagggcagccagggag

SEQ ID NO: 3408163 - DNA, 18 bp, Homo sapiens
cccagtgatctcgactcc

SEQ ID NO: 3408164 - DNA, 15 bp, Homo sapiens
ccccaatccatgctt

SEQ ID NO: 3408165 - DNA, 13 bp, Homo sapiens
ccccacccacttc

SEQ ID NO: 3408166 - DNA, 20 bp, Homo sapiens
ccccaccccagggcagccag

SEQ ID NO: 3408167 - DNA, 14 bp, Homo sapiens
ccccaccgcccact

SEQ ID NO: 3408168 - DNA, 15 bp, Homo sapiens
ccccactttctttct

SEQ ID NO: 3408169 - DNA, 12 bp, Homo sapiens
ccccagcactga

SEQ ID NO: 3408170 - DNA, 16 bp, Homo sapiens
ccccaggactgggcca

SEQ ID NO: 3408171 - DNA, 16 bp, Homo sapiens
ccccagggcagccagg

SEQ ID NO: 3408172 - DNA, 13 bp, Homo sapiens
cccccagcactga

SEQ ID NO: 3408173 - DNA, 13 bp, Homo sapiens
cccccaggactgg

SEQ ID NO: 3408174 - DNA, 12 bp, Homo sapiens
cccccctggcct

SEQ ID NO: 3408175 - DNA, 14 bp, Homo sapiens
ccccctgcaggaag

SEQ ID NO: 3408176 - DNA, 18 bp, Homo sapiens
ccccgtgacacatgctct

SEQ ID NO: 3408177 - DNA, 14 bp, Homo sapiens
cccctccaacctgg

SEQ ID NO: 3408178 - DNA, 15 bp, Homo sapiens
cccctccctttctcc

SEQ ID NO: 3408179 - DNA, 12 bp, Homo sapiens
cccctcctccac

SEQ ID NO: 3408180 - DNA, 18 bp, Homo sapiens
cccctcctccactctccc

SEQ ID NO: 3408181 - DNA, 12 bp, Homo sapiens
cccctctgcccc

SEQ ID NO: 3408182 - DNA, 11 bp, Homo sapiens
cccctgcaatg

SEQ ID NO: 3408183 - DNA, 23 bp, Homo sapiens
cccctgcaatgcgtcttgtgaaa

SEQ ID NO: 3408184 - DNA, 21 bp, Homo sapiens
cccctgcattggaactggagg

SEQ ID NO: 3408185 - DNA, 11 bp, Homo sapiens
cccctgccccc

SEQ ID NO: 3408186 - DNA, 17 bp, Homo sapiens
cccctgccccctgcagg

SEQ ID NO: 3408187 - DNA, 15 bp, Homo sapiens
cccctggttctcatc

SEQ ID NO: 3408188 - DNA, 18 bp, Homo sapiens
cccctggttctcatcttt

SEQ ID NO: 3408189 - DNA, 16 bp, Homo sapiens
cccctgtcccacctgg

SEQ ID NO: 3408190 - DNA, 21 bp, Homo sapiens
cccctttatgtacaggatgct

SEQ ID NO: 3408191 - DNA, 14 bp, Homo sapiens
ccctattttgccat

SEQ ID NO: 3408192 - DNA, 14 bp, Homo sapiens
ccctcccacagcgc

SEQ ID NO: 3408193 - DNA, 19 bp, Homo sapiens
ccctcccccacccacctct

SEQ ID NO: 3408194 - DNA, 17 bp, Homo sapiens
ccctccccgcccttttt

SEQ ID NO: 3408195 - DNA, 14 bp, Homo sapiens
ccctcccctcgtgt

SEQ ID NO: 3408196 - DNA, 13 bp, Homo sapiens
ccctccctttctc

SEQ ID NO: 3408197 - DNA, 13 bp, Homo sapiens
ccctcctcagctc

SEQ ID NO: 3408198 - DNA, 14 bp, Homo sapiens
ccctcctcagctcc

SEQ ID NO: 3408199 - DNA, 14 bp, Homo sapiens
ccctcctccactct

SEQ ID NO: 3408200 - DNA, 17 bp, Homo sapiens
ccctcgacagctctctg

SEQ ID NO: 3408201 - DNA, 22 bp, Homo sapiens
ccctcgaggcggatctttggac

SEQ ID NO: 3408202 - DNA, 17 bp, Homo sapiens
ccctcgtgtcagctcag

SEQ ID NO: 3408203 - DNA, 13 bp, Homo sapiens
ccctctcctgtcc

SEQ ID NO: 3408204 - DNA, 14 bp, Homo sapiens
ccctctcctgtcct

SEQ ID NO: 3408205 - DNA, 15 bp, Homo sapiens
ccctgcaggaaggag

SEQ ID NO: 3408206 - DNA, 19 bp, Homo sapiens
ccctgcaggaaggagctgc

SEQ ID NO: 3408207 - DNA, 21 bp, Homo sapiens
ccctgcattggaactggaggc

SEQ ID NO: 3408208 - DNA, 23 bp, Homo sapiens
ccctgcattggaactggaggcag

SEQ ID NO: 3408209 - DNA, 13 bp, Homo sapiens
ccctgcccccagg

SEQ ID NO: 3408210 - DNA, 14 bp, Homo sapiens
ccctgcccccagga

SEQ ID NO: 3408211 - DNA, 16 bp, Homo sapiens
ccctgcccccaggact

SEQ ID NO: 3408212 - DNA, 23 bp, Homo sapiens
ccctgcccccaggactgggccac

SEQ ID NO: 3408213 - DNA, 14 bp, Homo sapiens
ccctgccccctgca

SEQ ID NO: 3408214 - DNA, 19 bp, Homo sapiens
ccctgccccctgcaggaag

SEQ ID NO: 3408215 - DNA, 21 bp, Homo sapiens
ccctgcctcaggcctctgtgc

SEQ ID NO: 3408216 - DNA, 16 bp, Homo sapiens
ccctgctgctgcctgc

SEQ ID NO: 3408217 - DNA, 15 bp, Homo sapiens
ccctggcctccccca

SEQ ID NO: 3408218 - DNA, 21 bp, Homo sapiens
ccctggtggccctctcccctg

SEQ ID NO: 3408219 - DNA, 16 bp, Homo sapiens
ccctggttctcatctt

SEQ ID NO: 3408220 - DNA, 15 bp, Homo sapiens
ccctgtcccacctgg

SEQ ID NO: 3408221 - DNA, 17 bp, Homo sapiens
ccctgtgttctgcacat

SEQ ID NO: 3408222 - DNA, 18 bp, Homo sapiens
ccctgttggcagctctag

SEQ ID NO: 3408223 - DNA, 23 bp, Homo sapiens
cccttccgcagtgtggccaggct

SEQ ID NO: 3408224 - DNA, 15 bp, Homo sapiens
cccttgcccccctgg

SEQ ID NO: 3408225 - DNA, 22 bp, Homo sapiens
cccttgcccccctggcctcccc

SEQ ID NO: 3408226 - DNA, 22 bp, Homo sapiens
ccctttggattatgcccatgaa

SEQ ID NO: 3408227 - DNA, 20 bp, Homo sapiens
ccgcagtcgtcccaggctgc

SEQ ID NO: 3408228 - DNA, 18 bp, Homo sapiens
ccgcagtgtggccaggct

SEQ ID NO: 3408229 - DNA, 11 bp, Homo sapiens
ccgcccactct

SEQ ID NO: 3408230 - DNA, 23 bp, Homo sapiens
ccgcgcgtccagctgcccttccg

SEQ ID NO: 3408231 - DNA, 22 bp, Homo sapiens
ccggctcccctcgacagctctc

SEQ ID NO: 3408232 - DNA, 12 bp, Homo sapiens
ccgggcagaggg

SEQ ID NO: 3408233 - DNA, 15 bp, Homo sapiens
ccgggcagaggggca

SEQ ID NO: 3408234 - DNA, 22 bp, Homo sapiens
ccggttcactcttctcagccac

SEQ ID NO: 3408235 - DNA, 17 bp, Homo sapiens
ccgtaaggctgtacata

SEQ ID NO: 3408236 - DNA, 10 bp, Homo sapiens
ccgtccctga

SEQ ID NO: 3408237 - DNA, 18 bp, Homo sapiens
cctaacacagcatgtgta

SEQ ID NO: 3408238 - DNA, 17 bp, Homo sapiens
cctactgcttcctctga

SEQ ID NO: 3408239 - DNA, 15 bp, Homo sapiens
cctagatatgaatat

SEQ ID NO: 3408240 - DNA, 16 bp, Homo sapiens
cctagatatgaatata

SEQ ID NO: 3408241 - DNA, 14 bp, Homo sapiens
cctaggccaggagt

SEQ ID NO: 3408242 - DNA, 20 bp, Homo sapiens
cctaggccaggagttcccaa

SEQ ID NO: 3408243 - DNA, 21 bp, Homo sapiens
cctaggccaggagttcccaaa

SEQ ID NO: 3408244 - DNA, 11 bp, Homo sapiens
cctataaagtg

SEQ ID NO: 3408245 - DNA, 16 bp, Homo sapiens
cctataactgcccagc

SEQ ID NO: 3408246 - DNA, 22 bp, Homo sapiens
cctatatgagaagaatagccta

SEQ ID NO: 3408247 - DNA, 20 bp, Homo sapiens
cctcacccctggttctcatc

SEQ ID NO: 3408248 - DNA, 17 bp, Homo sapiens
cctcactagctccccaa

SEQ ID NO: 3408249 - DNA, 21 bp, Homo sapiens
cctcagctccctgcctgtttc

SEQ ID NO: 3408250 - DNA, 21 bp, Homo sapiens
cctcaggaaagaatagaaaga

SEQ ID NO: 3408251 - DNA, 14 bp, Homo sapiens
cctcaggcctctgt

SEQ ID NO: 3408252 - DNA, 13 bp, Homo sapiens
cctcagtgaccca

SEQ ID NO: 3408253 - DNA, 16 bp, Homo sapiens
cctcatgtcatttctc

SEQ ID NO: 3408254 - DNA, 18 bp, Homo sapiens
cctcattctgcattaata

SEQ ID NO: 3408255 - DNA, 13 bp, Homo sapiens
cctccacacctgc

SEQ ID NO: 3408256 - DNA, 15 bp, Homo sapiens
cctccacacctgcgg

SEQ ID NO: 3408257 - DNA, 14 bp, Homo sapiens
cctccactctcccc

SEQ ID NO: 3408258 - DNA, 13 bp, Homo sapiens
cctccagggacag

SEQ ID NO: 3408259 - DNA, 17 bp, Homo sapiens
cctccagggctggactg

SEQ ID NO: 3408260 - DNA, 18 bp, Homo sapiens
cctccagggctggactga

SEQ ID NO: 3408261 - DNA, 12 bp, Homo sapiens
cctcccactttg

SEQ ID NO: 3408262 - DNA, 15 bp, Homo sapiens
cctcccccacccacc

SEQ ID NO: 3408263 - DNA, 23 bp, Homo sapiens
cctccctctagaggctgcctggg

SEQ ID NO: 3408264 - DNA, 12 bp, Homo sapiens
cctcctcagctc

SEQ ID NO: 3408265 - DNA, 16 bp, Homo sapiens
cctcctcagctccctg

SEQ ID NO: 3408266 - DNA, 17 bp, Homo sapiens
cctcctcagctccctgc

SEQ ID NO: 3408267 - DNA, 12 bp, Homo sapiens
cctcctccaggg

SEQ ID NO: 3408268 - DNA, 15 bp, Homo sapiens
cctcctccagggaca

SEQ ID NO: 3408269 - DNA, 16 bp, Homo sapiens
cctcctccagggacag

SEQ ID NO: 3408270 - DNA, 18 bp, Homo sapiens
cctcctgtgcctcccttt

SEQ ID NO: 3408271 - DNA, 15 bp, Homo sapiens
cctcgtgtcagctca

SEQ ID NO: 3408272 - DNA, 13 bp, Homo sapiens
ctgctctccttcc

SEQ ID NO: 3408273 - DNA, 15 bp, Homo sapiens
ctgctgaagggaggg

SEQ ID NO: 3408274 - DNA, 13 bp, Homo sapiens
ctgctgcctgcct

SEQ ID NO: 3408275 - DNA, 15 bp, Homo sapiens
ctgctgctgcctgcc

SEQ ID NO: 3408276 - DNA, 24 bp, Homo sapiens
ctgctttcctatctagcatttatt

SEQ ID NO: 3408277 - DNA, 22 bp, Homo sapiens
ctgctttgcctcgaaagtgtca

SEQ ID NO: 3408278 - DNA, 15 bp, Homo sapiens
ctggaagcactgctg

SEQ ID NO: 3408279 - DNA, 13 bp, Homo sapiens
ctggacccctgca

SEQ ID NO: 3408280 - DNA, 14 bp, Homo sapiens
ctggacccctgcat

SEQ ID NO: 3408281 - DNA, 22 bp, Homo sapiens
ctggacctggcggcaggaagcc

SEQ ID NO: 3408282 - DNA, 16 bp, Homo sapiens
ctggagcccagaggag

SEQ ID NO: 3408283 - DNA, 17 bp, Homo sapiens
ctggagcccagaggagg

SEQ ID NO: 3408284 - DNA, 14 bp, Homo sapiens
ctggaggagcccag

SEQ ID NO: 3408285 - DNA, 23 bp, Homo sapiens
ctggagttggggctcttggcttt

SEQ ID NO: 3408286 - DNA, 20 bp, Homo sapiens
ctggcaaacttttctttctt

SEQ ID NO: 3408287 - DNA, 20 bp, Homo sapiens
ctggcatcgcagcttcctgt

SEQ ID NO: 3408288 - DNA, 18 bp, Homo sapiens
ctggccgcgccaaataat

SEQ ID NO: 3408289 - DNA, 22 bp, Homo sapiens
ctggccgggaccccgagcctgg

SEQ ID NO: 3408290 - DNA, 17 bp, Homo sapiens
ctggcctcccccacttt

SEQ ID NO: 3408291 - DNA, 20 bp, Homo sapiens
ctggccttgggccctctggt

SEQ ID NO: 3408292 - DNA, 17 bp, Homo sapiens
ctggcttccatgctccg

SEQ ID NO: 3408293 - DNA, 18 bp, Homo sapiens
ctgggaataagtgccagg

SEQ ID NO: 3408294 - DNA, 14 bp, Homo sapiens
ctgggaccagggca

SEQ ID NO: 3408295 - DNA, 16 bp, Homo sapiens
ctgggaccagggcata

SEQ ID NO: 3408296 - DNA, 21 bp, Homo sapiens
ctgggcagtgagtgccatgct

SEQ ID NO: 3408297 - DNA, 17 bp, Homo sapiens
ctgggcctaggccagga

SEQ ID NO: 3408298 - DNA, 20 bp, Homo sapiens
ctgggctgccatgtgaagag

SEQ ID NO: 3408299 - DNA, 16 bp, Homo sapiens
ctggggatgtctctca

SEQ ID NO: 3408300 - DNA, 13 bp, Homo sapiens
ctggggggcagtg

SEQ ID NO: 3408301 - DNA, 13 bp, Homo sapiens
ctgggtgatttct

SEQ ID NO: 3408302 - DNA, 16 bp, Homo sapiens
ctgggtgctgatcctt

SEQ ID NO: 3408303 - DNA, 16 bp, Homo sapiens
ctgggtttacaacaaa

SEQ ID NO: 3408304 - DNA, 23 bp, Homo sapiens
ctggtatctgcatgtaaaatctt

SEQ ID NO: 3408305 - DNA, 16 bp, Homo sapiens
ctggtggatggtgact

SEQ ID NO: 3408306 - DNA, 17 bp, Homo sapiens
ctggtggccctctcccc

SEQ ID NO: 3408307 - DNA, 22 bp, Homo sapiens
ctggttcactctaattggtcat

SEQ ID NO: 3408308 - DNA, 21 bp, Homo sapiens
ctggttcggatttggggtgga

SEQ ID NO: 3408309 - DNA, 14 bp, Homo sapiens
ctggttctcatctt

SEQ ID NO: 3408310 - DNA, 20 bp, Homo sapiens
ctggttctcatctttcttga

SEQ ID NO: 3408311 - DNA, 13 bp, Homo sapiens
ctggtttataata

SEQ ID NO: 3408312 - DNA, 19 bp, Homo sapiens
ctggtttgccggtggtgca

SEQ ID NO: 3408313 - DNA, 20 bp, Homo sapiens
ctgtaaaatagttttgcttt

SEQ ID NO: 3408314 - DNA, 18 bp, Homo sapiens
ctgtaaatttggcttctg

SEQ ID NO: 3408315 - DNA, 21 bp, Homo sapiens
ctgtaatgtaggcacttttat

SEQ ID NO: 3408316 - DNA, 19 bp, Homo sapiens
ctgtaattaaactagttta

SEQ ID NO: 3408317 - DNA, 21 bp, Homo sapiens
ctgtaattaaactagtttaag

SEQ ID NO: 3408318 - DNA, 16 bp, Homo sapiens
ctgtacatagtccttt

SEQ ID NO: 3408319 - DNA, 14 bp, Homo sapiens
ctgtatcactctgt

SEQ ID NO: 3408320 - DNA, 16 bp, Homo sapiens
ctgtatcactctgtgt

SEQ ID NO: 3408321 - DNA, 22 bp, Homo sapiens
ctgtatttctttgtagaataaa

SEQ ID NO: 3408322 - DNA, 15 bp, Homo sapiens
ctgtcagtgtgaaaa

SEQ ID NO: 3408323 - DNA, 12 bp, Homo sapiens
ctgtcccacctg

SEQ ID NO: 3408324 - DNA, 15 bp, Homo sapiens
ctgtcccacctggct

SEQ ID NO: 3408325 - DNA, 19 bp, Homo sapiens
ctgtccccttctctcatct

SEQ ID NO: 3408326 - DNA, 14 bp, Homo sapiens
ctgtctgtttatat

SEQ ID NO: 3408327 - DNA, 16 bp, Homo sapiens
ctgtctttcagataca

SEQ ID NO: 3408328 - DNA, 17 bp, Homo sapiens
ctgtgactagatacaga

SEQ ID NO: 3408329 - DNA, 18 bp, Homo sapiens
ctgtgagactcgagaact

SEQ ID NO: 3408330 - DNA, 20 bp, Homo sapiens
ctgtgagactcgagaacttt

SEQ ID NO: 3408331 - DNA, 21 bp, Homo sapiens
ctgtgatgttgggaagctatt

SEQ ID NO: 3408332 - DNA, 19 bp, Homo sapiens
ctgtgcacaaagtggcata

SEQ ID NO: 3408333 - DNA, 16 bp, Homo sapiens
ctgtggaggaaggatt

SEQ ID NO: 3408334 - DNA, 17 bp, Homo sapiens
ctgtggaggaaggattg

SEQ ID NO: 3408335 - DNA, 20 bp, Homo sapiens
ctgtggaggaaggattgtaa

SEQ ID NO: 3408336 - DNA, 23 bp, Homo sapiens
ctgtggaggaaggattgtaaaaa

SEQ ID NO: 3408337 - DNA, 23 bp, Homo sapiens
ctgtggccatatatgctgtattt

SEQ ID NO: 3408338 - DNA, 13 bp, Homo sapiens
ctgtgggcaagga

SEQ ID NO: 3408339 - DNA, 12 bp, Homo sapiens
ctgtgtctctgt

SEQ ID NO: 3408340 - DNA, 15 bp, Homo sapiens
ctgtgtctgagtggc

SEQ ID NO: 3408341 - DNA, 21 bp, Homo sapiens
ctgtgtgcaactaactgactc

SEQ ID NO: 3408342 - DNA, 15 bp, Homo sapiens
ctgtgtgtgtgtatg

SEQ ID NO: 3408343 - DNA, 16 bp, Homo sapiens
ctgtgtgtttatgtgt

SEQ ID NO: 3408344 - DNA, 21 bp, Homo sapiens
ctgttacctgatcaatgacag

SEQ ID NO: 3408345 - DNA, 17 bp, Homo sapiens
ctgttactgcttctctt

SEQ ID NO: 3408346 - DNA, 23 bp, Homo sapiens
ctgttactgcttctctttgtgca

SEQ ID NO: 3408347 - DNA, 23 bp, Homo sapiens
ctgttcacgtgttttccatccca

SEQ ID NO: 3408348 - DNA, 18 bp, Homo sapiens
ctgttgccatggtgatgg

SEQ ID NO: 3408349 - DNA, 14 bp, Homo sapiens
ctgttgtacattta

SEQ ID NO: 3408350 - DNA, 18 bp, Homo sapiens
ctgttgtcaccttcacct

SEQ ID NO: 3408351 - DNA, 19 bp, Homo sapiens
ctgtttatatattgaaagt

SEQ ID NO: 3408352 - DNA, 20 bp, Homo sapiens
ctgtttcccgtaaggctgta

SEQ ID NO: 3408353 - DNA, 19 bp, Homo sapiens
ctgtttgtgttatttcaga

SEQ ID NO: 3408354 - DNA, 17 bp, Homo sapiens
ctgttttgtaaagtccc

SEQ ID NO: 3408355 - DNA, 20 bp, Homo sapiens
cttaaaaatcattgattgtc

SEQ ID NO: 3408356 - DNA, 22 bp, Homo sapiens
cttaaaaattaaattctctcta

SEQ ID NO: 3408357 - DNA, 13 bp, Homo sapiens
cttaaaatgcaat

SEQ ID NO: 3408358 - DNA, 15 bp, Homo sapiens
cttaaaatgcaatat

SEQ ID NO: 3408359 - DNA, 22 bp, Homo sapiens
cttaaaatgcaatatttgtaag

SEQ ID NO: 3408360 - DNA, 17 bp, Homo sapiens
cttaaagcttgatttga

SEQ ID NO: 3408361 - DNA, 16 bp, Homo sapiens
cttaaatgttttcatt

SEQ ID NO: 3408362 - DNA, 18 bp, Homo sapiens
cttaaatgttttcattgg

SEQ ID NO: 3408363 - DNA, 13 bp, Homo sapiens
cttaactgtattt

SEQ ID NO: 3408364 - DNA, 17 bp, Homo sapiens
cttaactgtatttcagt

SEQ ID NO: 3408365 - DNA, 20 bp, Homo sapiens
cttaactgtatttcagtatt

SEQ ID NO: 3408366 - DNA, 16 bp, Homo sapiens
cttaattctttgtttc

SEQ ID NO: 3408367 - DNA, 18 bp, Homo sapiens
cttaattctttgtttcct

SEQ ID NO: 3408368 - DNA, 16 bp, Homo sapiens
cttacaactcccccac

SEQ ID NO: 3408369 - DNA, 17 bp, Homo sapiens
cttactgtggaggaagg

SEQ ID NO: 3408370 - DNA, 17 bp, Homo sapiens
cttagacctcttcctgg

SEQ ID NO: 3408371 - DNA, 16 bp, Homo sapiens
cttagctttttaattg

SEQ ID NO: 3408372 - DNA, 17 bp, Homo sapiens
cttagctttttaattgt

SEQ ID NO: 3408373 - DNA, 20 bp, Homo sapiens
cttataaaccttgtcaataa

SEQ ID NO: 3408374 - DNA, 22 bp, Homo sapiens
cttatcttacaactcccccacc

SEQ ID NO: 3408375 - DNA, 15 bp, Homo sapiens
cttatgtgttacatt

SEQ ID NO: 3408376 - DNA, 21 bp, Homo sapiens
cttatgtgttacattattcca

SEQ ID NO: 3408377 - DNA, 14 bp, Homo sapiens
cttatgtgttgcat

SEQ ID NO: 3408378 - DNA, 13 bp, Homo sapiens
cttattcagtgaa

SEQ ID NO: 3408379 - DNA, 18 bp, Homo sapiens
cttattggcagctctact

SEQ ID NO: 3408380 - DNA, 23 bp, Homo sapiens
cttatttgtcggggaagatgaaa

SEQ ID NO: 3408381 - DNA, 18 bp, Homo sapiens
cttcaagaaaacaggcac

SEQ ID NO: 3408382 - DNA, 13 bp, Homo sapiens
cttcactgtataa

SEQ ID NO: 3408383 - DNA, 15 bp, Homo sapiens
gacagtatacagtcc

SEQ ID NO: 3408384 - DNA, 13 bp, Homo sapiens
gacagtggcagga

SEQ ID NO: 3408385 - DNA, 20 bp, Homo sapiens
gacagtttcttagcttttta

SEQ ID NO: 3408386 - DNA, 16 bp, Homo sapiens
gacatcgatatgaaaa

SEQ ID NO: 3408387 - DNA, 17 bp, Homo sapiens
gacatctgcctgtaatt

SEQ ID NO: 3408388 - DNA, 22 bp, Homo sapiens
gacatgcctatatgagaagaat

SEQ ID NO: 3408389 - DNA, 17 bp, Homo sapiens
gaccccacttcaggcac

SEQ ID NO: 3408390 - DNA, 16 bp, Homo sapiens
gaccccctcccccacc

SEQ ID NO: 3408391 - DNA, 16 bp, Homo sapiens
gaccctatacattttg

SEQ ID NO: 3408392 - DNA, 17 bp, Homo sapiens
gaccgttttgtattgct

SEQ ID NO: 3408393 - DNA, 13 bp, Homo sapiens
gacctctcttgtg

SEQ ID NO: 3408394 - DNA, 14 bp, Homo sapiens
gacctgaactctgc

SEQ ID NO: 3408395 - DNA, 17 bp, Homo sapiens
gacctgcagacgcccag

SEQ ID NO: 3408396 - DNA, 16 bp, Homo sapiens
gacctgcccctccctc

SEQ ID NO: 3408397 - DNA, 15 bp, Homo sapiens
gacctgtctcctggc

SEQ ID NO: 3408398 - DNA, 16 bp, Homo sapiens
gacctgtctcctggcg

SEQ ID NO: 3408399 - DNA, 12 bp, Homo sapiens
gactaagccagc

SEQ ID NO: 3408400 - DNA, 18 bp, Homo sapiens
gactaagccagcaccgga

SEQ ID NO: 3408401 - DNA, 18 bp, Homo sapiens
gactatattgtacacacc

SEQ ID NO: 3408402 - DNA, 19 bp, Homo sapiens
gactatggaatgtcagtgt

SEQ ID NO: 3408403 - DNA, 15 bp, Homo sapiens
gactcccccctggcc

SEQ ID NO: 3408404 - DNA, 21 bp, Homo sapiens
gactgaggcctgagcgctcct

SEQ ID NO: 3408405 - DNA, 20 bp, Homo sapiens
gactgcaagcatttttccat

SEQ ID NO: 3408406 - DNA, 13 bp, Homo sapiens
gactgtctttcag

SEQ ID NO: 3408407 - DNA, 22 bp, Homo sapiens
gactgtggccatatatgctgta

SEQ ID NO: 3408408 - DNA, 14 bp, Homo sapiens
gacttttgaagaac

SEQ ID NO: 3408409 - DNA, 21 bp, Homo sapiens
gagaaacaagacaagctcctc

SEQ ID NO: 3408410 - DNA, 15 bp, Homo sapiens
gagaaaggaaaaatt

SEQ ID NO: 3408411 - DNA, 13 bp, Homo sapiens
gagaagcatgaaa

SEQ ID NO: 3408412 - DNA, 22 bp, Homo sapiens
gagaagtgcttaacgttttctt

SEQ ID NO: 3408413 - DNA, 14 bp, Homo sapiens
gagactcgagaact

SEQ ID NO: 3408414 - DNA, 16 bp, Homo sapiens
gagactcgagaacttt

SEQ ID NO: 3408415 - DNA, 22 bp, Homo sapiens
gagactgggcctaggccaggag

SEQ ID NO: 3408416 - DNA, 23 bp, Homo sapiens
gagactgggcctaggccaggagt

SEQ ID NO: 3408417 - DNA, 20 bp, Homo sapiens
gagactttctttctgtaggt

SEQ ID NO: 3408418 - DNA, 20 bp, Homo sapiens
gagactttgctgttactgct

SEQ ID NO: 3408419 - DNA, 14 bp, Homo sapiens
gagagccattttgt

SEQ ID NO: 3408420 - DNA, 17 bp, Homo sapiens
gagagccattttgtgaa

SEQ ID NO: 3408421 - DNA, 21 bp, Homo sapiens
gagagcccagaggtaacagaa

SEQ ID NO: 3408422 - DNA, 14 bp, Homo sapiens
gagagcccaggagc

SEQ ID NO: 3408423 - DNA, 16 bp, Homo sapiens
gagaggatgagagccc

SEQ ID NO: 3408424 - DNA, 20 bp, Homo sapiens
gagaggatgagagcccagag

SEQ ID NO: 3408425 - DNA, 17 bp, Homo sapiens
gagagtttttaatagaa

SEQ ID NO: 3408426 - DNA, 18 bp, Homo sapiens
gagattggatttgctgtg

SEQ ID NO: 3408427 - DNA, 15 bp, Homo sapiens
gagatttactgctct

SEQ ID NO: 3408428 - DNA, 21 bp, Homo sapiens
gagatttcatctgctctcctt

SEQ ID NO: 3408429 - DNA, 14 bp, Homo sapiens
gagcagatgcagag

SEQ ID NO: 3408430 - DNA, 16 bp, Homo sapiens
gagcagatgcagagag

SEQ ID NO: 3408431 - DNA, 21 bp, Homo sapiens
gagcagatgcagagagccatt

SEQ ID NO: 3408432 - DNA, 14 bp, Homo sapiens
gagcccagaggagg

SEQ ID NO: 3408433 - DNA, 22 bp, Homo sapiens
gagcccagaggagggcagcaga

SEQ ID NO: 3408434 - DNA, 22 bp, Homo sapiens
gagcccagaggtaacagaacag

SEQ ID NO: 3408435 - DNA, 12 bp, Homo sapiens
gagcccaggagc

SEQ ID NO: 3408436 - DNA, 17 bp, Homo sapiens
gagcccaggagctcccc

SEQ ID NO: 3408437 - DNA, 17 bp, Homo sapiens
gagcccaggccaggact

SEQ ID NO: 3408438 - DNA, 21 bp, Homo sapiens
gagcccaggccaggactctgc

SEQ ID NO: 3408439 - DNA, 22 bp, Homo sapiens
gagcccaggccaggactctgca

SEQ ID NO: 3408440 - DNA, 14 bp, Homo sapiens
gagcctaggccagg

SEQ ID NO: 3408441 - DNA, 16 bp, Homo sapiens
gagcctaggccaggtg

SEQ ID NO: 3408442 - DNA, 17 bp, Homo sapiens
gagcctaggccaggtgc

SEQ ID NO: 3408443 - DNA, 15 bp, Homo sapiens
gagcctccctgcctc

SEQ ID NO: 3408444 - DNA, 21 bp, Homo sapiens
gagcgctcctgccgcagagct

SEQ ID NO: 3408445 - DNA, 17 bp, Homo sapiens
gagctcaggacactaat

SEQ ID NO: 3408446 - DNA, 15 bp, Homo sapiens
gagctcccctcccca

SEQ ID NO: 3408447 - DNA, 18 bp, Homo sapiens
gagctcccctccccaact

SEQ ID NO: 3408448 - DNA, 14 bp, Homo sapiens
gaggaaggattgta

SEQ ID NO: 3408449 - DNA, 15 bp, Homo sapiens
gaggaaggattgtaa

SEQ ID NO: 3408450 - DNA, 16 bp, Homo sapiens
gaggaaggattgtaaa

SEQ ID NO: 3408451 - DNA, 22 bp, Homo sapiens
gaggacagtatttgtggggagg

SEQ ID NO: 3408452 - DNA, 20 bp, Homo sapiens
gaggagcccaggccaggact

SEQ ID NO: 3408453 - DNA, 17 bp, Homo sapiens
gaggatgagagcccaga

SEQ ID NO: 3408454 - DNA, 17 bp, Homo sapiens
gaggccctccacacctg

SEQ ID NO: 3408455 - DNA, 19 bp, Homo sapiens
gaggccctccacacctgcg

SEQ ID NO: 3408456 - DNA, 21 bp, Homo sapiens
gaggccctccacacctgcggc

SEQ ID NO: 3408457 - DNA, 22 bp, Homo sapiens
gaggccctccacacctgcggcc

SEQ ID NO: 3408458 - DNA, 14 bp, Homo sapiens
gagggagaagcatg

SEQ ID NO: 3408459 - DNA, 21 bp, Homo sapiens
gagggcagcagaagggggtgg

SEQ ID NO: 3408460 - DNA, 16 bp, Homo sapiens
gagggcagcgggagcc

SEQ ID NO: 3408461 - DNA, 15 bp, Homo sapiens
gagggtcagccaggg

SEQ ID NO: 3408462 - DNA, 14 bp, Homo sapiens
gaggtaacagaaca

SEQ ID NO: 3408463 - DNA, 14 bp, Homo sapiens
gaggtagagtttga

SEQ ID NO: 3408464 - DNA, 16 bp, Homo sapiens
gaggtcaagtaagaag

SEQ ID NO: 3408465 - DNA, 13 bp, Homo sapiens
gagtaatgatgta

SEQ ID NO: 3408466 - DNA, 17 bp, Homo sapiens
gagtagaaagacagagc

SEQ ID NO: 3408467 - DNA, 20 bp, Homo sapiens
gagtagaaagacagagctgg

SEQ ID NO: 3408468 - DNA, 16 bp, Homo sapiens
gagtctctgaacatcc

SEQ ID NO: 3408469 - DNA, 20 bp, Homo sapiens
gagtctggcaaacatgtgca

SEQ ID NO: 3408470 - DNA, 22 bp, Homo sapiens
gagtctggcaaacatgtgcaac

SEQ ID NO: 3408471 - DNA, 17 bp, Homo sapiens
gagtctgttttgtaaag

SEQ ID NO: 3408472 - DNA, 20 bp, Homo sapiens
gagtgcccctgtcccacctg

SEQ ID NO: 3408473 - DNA, 23 bp, Homo sapiens
gagtgcccctgtcccacctggct

SEQ ID NO: 3408474 - DNA, 15 bp, Homo sapiens
gagtggcttcactcc

SEQ ID NO: 3408475 - DNA, 19 bp, Homo sapiens
gagtggcttcactcctgct

SEQ ID NO: 3408476 - DNA, 13 bp, Homo sapiens
gagtgggggtggg

SEQ ID NO: 3408477 - DNA, 15 bp, Homo sapiens
gagtgtactcccagg

SEQ ID NO: 3408478 - DNA, 13 bp, Homo sapiens
gagttaagaagct

SEQ ID NO: 3408479 - DNA, 14 bp, Homo sapiens
gagttaagaagctg

SEQ ID NO: 3408480 - DNA, 23 bp, Homo sapiens
gagttgacttgacagaacactgt

SEQ ID NO: 3408481 - DNA, 20 bp, Homo sapiens
gagttgcaccattctttctt

SEQ ID NO: 3408482 - DNA, 14 bp, Homo sapiens
gagtttgctgtttt

SEQ ID NO: 3408483 - DNA, 16 bp, Homo sapiens
gagtttggttaatcag

SEQ ID NO: 3408484 - DNA, 21 bp, Homo sapiens
gagtttggttaatcagtgttg

SEQ ID NO: 3408485 - DNA, 13 bp, Homo sapiens
gataatgttaaat

SEQ ID NO: 3408486 - DNA, 19 bp, Homo sapiens
gataatgttaaatttgtaa

SEQ ID NO: 3408487 - DNA, 21 bp, Homo sapiens
gataatgttaaatttgtaagt

SEQ ID NO: 3408488 - DNA, 12 bp, Homo sapiens
gatatagaaaat

SEQ ID NO: 3408489 - DNA, 14 bp, Homo sapiens
gatatggcagaaga

SEQ ID NO: 3408490 - DNA, 15 bp, Homo sapiens
gatatggcagaagac

SEQ ID NO: 3408491 - DNA, 16 bp, Homo sapiens
gatattgaccatgtga

SEQ ID NO: 3408492 - DNA, 14 bp, Homo sapiens
gatcaacatctttt

SEQ ID NO: 3408493 - DNA, 17 bp, Homo sapiens
gatcaacatcttttctt

SEQ ID NO: 3408494 - DNA, 20 bp, Homo sapiens
gatcaacatcttttcttgcc

SEQ ID NO: 3408495 - DNA, 11 bp, Homo sapiens
gctaacattta

SEQ ID NO: 3408496 - DNA, 17 bp, Homo sapiens
gctaacatttaggagaa

SEQ ID NO: 3408497 - DNA, 13 bp, Homo sapiens
gctaataataaat

SEQ ID NO: 3408498 - DNA, 14 bp, Homo sapiens
gctaataataaatg

SEQ ID NO: 3408499 - DNA, 20 bp, Homo sapiens
gctaatctgcctggttttat

SEQ ID NO: 3408500 - DNA, 23 bp, Homo sapiens
gctaatctgcctggttttattta

SEQ ID NO: 3408501 - DNA, 20 bp, Homo sapiens
gctacaaggggtgtgacttg

SEQ ID NO: 3408502 - DNA, 13 bp, Homo sapiens
gctacctcaaggg

SEQ ID NO: 3408503 - DNA, 12 bp, Homo sapiens
gctactgaattt

SEQ ID NO: 3408504 - DNA, 20 bp, Homo sapiens
gctactgaatttattgccgc

SEQ ID NO: 3408505 - DNA, 18 bp, Homo sapiens
gctagctatttctatgta

SEQ ID NO: 3408506 - DNA, 22 bp, Homo sapiens
gctagctatttctatgtatgtg

SEQ ID NO: 3408507 - DNA, 19 bp, Homo sapiens
gctatccagctatttttat

SEQ ID NO: 3408508 - DNA, 20 bp, Homo sapiens
gctatcctgctgaaagtcct

SEQ ID NO: 3408509 - DNA, 21 bp, Homo sapiens
gctattagccaggatcatggt

SEQ ID NO: 3408510 - DNA, 22 bp, Homo sapiens
gctatttttatttgtttgtgca

SEQ ID NO: 3408511 - DNA, 21 bp, Homo sapiens
gctcaaaataaaaagcctcag

SEQ ID NO: 3408512 - DNA, 14 bp, Homo sapiens
gctcacaaattccg

SEQ ID NO: 3408513 - DNA, 22 bp, Homo sapiens
gctcacactgagaatgtaagaa

SEQ ID NO: 3408514 - DNA, 16 bp, Homo sapiens
gctcatcagaactgaa

SEQ ID NO: 3408515 - DNA, 15 bp, Homo sapiens
gctcatgtatattta

SEQ ID NO: 3408516 - DNA, 18 bp, Homo sapiens
gctccaaaccctcgaggc

SEQ ID NO: 3408517 - DNA, 22 bp, Homo sapiens
gctccaaaccttcacacacaga

SEQ ID NO: 3408518 - DNA, 14 bp, Homo sapiens
gctcccctccccaa

SEQ ID NO: 3408519 - DNA, 20 bp, Homo sapiens
gctcccctcgacagctctct

SEQ ID NO: 3408520 - DNA, 14 bp, Homo sapiens
gctccctgcctgtt

SEQ ID NO: 3408521 - DNA, 18 bp, Homo sapiens
gctcctcaactcacctaa

SEQ ID NO: 3408522 - DNA, 11 bp, Homo sapiens
gctcctccctt

SEQ ID NO: 3408523 - DNA, 14 bp, Homo sapiens
gctcctcccttgag

SEQ ID NO: 3408524 - DNA, 18 bp, Homo sapiens
gctcctgccgcagagctg

SEQ ID NO: 3408525 - DNA, 22 bp, Homo sapiens
gctctaagaagctcgtttctta

SEQ ID NO: 3408526 - DNA, 15 bp, Homo sapiens
gctctacacaacatg

SEQ ID NO: 3408527 - DNA, 15 bp, Homo sapiens
gctctagctttgcag

SEQ ID NO: 3408528 - DNA, 12 bp, Homo sapiens
gctctatctgca

SEQ ID NO: 3408529 - DNA, 11 bp, Homo sapiens
gctctccttcc

SEQ ID NO: 3408530 - DNA, 12 bp, Homo sapiens
gctctccttcct

SEQ ID NO: 3408531 - DNA, 17 bp, Homo sapiens
gctctgagagccccagg

SEQ ID NO: 3408532 - DNA, 21 bp, Homo sapiens
gctgagttgttgagtctgttt

SEQ ID NO: 3408533 - DNA, 21 bp, Homo sapiens
gctgccatgtgaagagggaga

SEQ ID NO: 3408534 - DNA, 14 bp, Homo sapiens
gctgcctggacccg

SEQ ID NO: 3408535 - DNA, 18 bp, Homo sapiens
gctgctgaagggaggggg

SEQ ID NO: 3408536 - DNA, 13 bp, Homo sapiens
gctggactgaggc

SEQ ID NO: 3408537 - DNA, 14 bp, Homo sapiens
gctggactgaggcc

SEQ ID NO: 3408538 - DNA, 17 bp, Homo sapiens
gctggactgaggcctga

SEQ ID NO: 3408539 - DNA, 16 bp, Homo sapiens
gctggaggagcccagg

SEQ ID NO: 3408540 - DNA, 21 bp, Homo sapiens
gctggaggagcccaggccagg

SEQ ID NO: 3408541 - DNA, 13 bp, Homo sapiens
gctggatctgtga

SEQ ID NO: 3408542 - DNA, 20 bp, Homo sapiens
gctgggaataagtgccagga

SEQ ID NO: 3408543 - DNA, 17 bp, Homo sapiens
gctggtggatggtgact

SEQ ID NO: 3408544 - DNA, 20 bp, Homo sapiens
gctgtaaatttggcttctgt

SEQ ID NO: 3408545 - DNA, 22 bp, Homo sapiens
gctgtatttctttgtagaataa

SEQ ID NO: 3408546 - DNA, 19 bp, Homo sapiens
gctgtgcacaaagtggcat

SEQ ID NO: 3408547 - DNA, 21 bp, Homo sapiens
gctgtgggcaggcaagccctt

SEQ ID NO: 3408548 - DNA, 21 bp, Homo sapiens
gctgtgtccgctttcatgaac

SEQ ID NO: 3408549 - DNA, 15 bp, Homo sapiens
gctgtgtctctgtat

SEQ ID NO: 3408550 - DNA, 13 bp, Homo sapiens
gctgttactgctt

SEQ ID NO: 3408551 - DNA, 22 bp, Homo sapiens
gctgttactgcttctctttgtg

SEQ ID NO: 3408552 - DNA, 12 bp, Homo sapiens
gctgttgtacat

SEQ ID NO: 3408553 - DNA, 21 bp, Homo sapiens
gctgtttactcccttctgtag

SEQ ID NO: 3408554 - DNA, 23 bp, Homo sapiens
gctgtttactcccttctgtagtt

SEQ ID NO: 3408555 - DNA, 19 bp, Homo sapiens
gctgtttatgacacaatga

SEQ ID NO: 3408556 - DNA, 22 bp, Homo sapiens
gctgttttaaattgcatttcta

SEQ ID NO: 3408557 - DNA, 18 bp, Homo sapiens
gcttaacgttttcttaaa

SEQ ID NO: 3408558 - DNA, 18 bp, Homo sapiens
gcttacagtaaatgaact

SEQ ID NO: 3408559 - DNA, 17 bp, Homo sapiens
gcttacggccctggcct

SEQ ID NO: 3408560 - DNA, 19 bp, Homo sapiens
gcttatgcccctgcactga

SEQ ID NO: 3408561 - DNA, 20 bp, Homo sapiens
gcttatttagcacattttga

SEQ ID NO: 3408562 - DNA, 22 bp, Homo sapiens
gcttcactcatgcaaactgctt

SEQ ID NO: 3408563 - DNA, 15 bp, Homo sapiens
gcttcactgtataaa

SEQ ID NO: 3408564 - DNA, 16 bp, Homo sapiens
gcttcactgtataaat

SEQ ID NO: 3408565 - DNA, 20 bp, Homo sapiens
gcttcaggttatcgaaataa

SEQ ID NO: 3408566 - DNA, 21 bp, Homo sapiens
gcttcaggttatcgaaataac

SEQ ID NO: 3408567 - DNA, 23 bp, Homo sapiens
gcttcaggttatcgaaataacaa

SEQ ID NO: 3408568 - DNA, 15 bp, Homo sapiens
gcttcctgtctgttt

SEQ ID NO: 3408569 - DNA, 24 bp, Homo sapiens
gcttcctgtctgtttatatattga

SEQ ID NO: 3408570 - DNA, 18 bp, Homo sapiens
gcttctcatcctgcaggc

SEQ ID NO: 3408571 - DNA, 19 bp, Homo sapiens
gcttctgttgtcaccttca

SEQ ID NO: 3408572 - DNA, 23 bp, Homo sapiens
gcttcttttagttgtatctcttt

SEQ ID NO: 3408573 - DNA, 20 bp, Homo sapiens
gcttcttttctttgtatcat

SEQ ID NO: 3408574 - DNA, 23 bp, Homo sapiens
gcttgatttgatctttgtttaaa

SEQ ID NO: 3408575 - DNA, 23 bp, Homo sapiens
gcttgcataataagctaaagagg

SEQ ID NO: 3408576 - DNA, 18 bp, Homo sapiens
gctttaaaagtcattatt

SEQ ID NO: 3408577 - DNA, 20 bp, Homo sapiens
gctttaaaagtcattattcc

SEQ ID NO: 3408578 - DNA, 23 bp, Homo sapiens
gctttataccccatttgatttcg

SEQ ID NO: 3408579 - DNA, 14 bp, Homo sapiens
gctttatctttgtg

SEQ ID NO: 3408580 - DNA, 14 bp, Homo sapiens
gctttgataatgtc

SEQ ID NO: 3408581 - DNA, 20 bp, Homo sapiens
gctttgcctcgaaagtgtca

SEQ ID NO: 3408582 - DNA, 23 bp, Homo sapiens
gctttgttaaaaaaaaaaagatt

SEQ ID NO: 3408583 - DNA, 16 bp, Homo sapiens
gctttgttcttgtcat

SEQ ID NO: 3408584 - DNA, 12 bp, Homo sapiens
gcttttaaaagg

SEQ ID NO: 3408585 - DNA, 18 bp, Homo sapiens
gcttttaaaaggaaaacc

SEQ ID NO: 3408586 - DNA, 18 bp, Homo sapiens
ggaaaagaaatcaatttt

SEQ ID NO: 3408587 - DNA, 22 bp, Homo sapiens
ggaaatagcttcaggatactgt

SEQ ID NO: 3408588 - DNA, 16 bp, Homo sapiens
ggaacaatcacaaaag

SEQ ID NO: 3408589 - DNA, 13 bp, Homo sapiens
ggaacatggggag

SEQ ID NO: 3408590 - DNA, 14 bp, Homo sapiens
ggaaccatgaagct

SEQ ID NO: 3408591 - DNA, 20 bp, Homo sapiens
ggaacctaattgaaatttaa

SEQ ID NO: 3408592 - DNA, 21 bp, Homo sapiens
ggaagaacggggctcttctca

SEQ ID NO: 3408593 - DNA, 21 bp, Homo sapiens
ggaagccaaagagactgggcc

SEQ ID NO: 3408594 - DNA, 13 bp, Homo sapiens
ggaaggagctgcc

SEQ ID NO: 3408595 - DNA, 19 bp, Homo sapiens
ggaaggagctgcctggacc

SEQ ID NO: 3408596 - DNA, 13 bp, Homo sapiens
ggaaggattgtaa

SEQ ID NO: 3408597 - DNA, 22 bp, Homo sapiens
ggaagtgtgggtctgtgtgtgt

SEQ ID NO: 3408598 - DNA, 23 bp, Homo sapiens
ggacaatggaccggagagtgggg

SEQ ID NO: 3408599 - DNA, 14 bp, Homo sapiens
ggacagaagcagct

SEQ ID NO: 3408600 - DNA, 16 bp, Homo sapiens
ggacagaagcagctct

SEQ ID NO: 3408601 - DNA, 18 bp, Homo sapiens
ggacagtatttgtgggga

SEQ ID NO: 3408602 - DNA, 14 bp, Homo sapiens
ggacagtggcagga

SEQ ID NO: 3408603 - DNA, 17 bp, Homo sapiens
ggacagtggcaggacag

SEQ ID NO: 3408604 - DNA, 17 bp, Homo sapiens
ggacattccaagacagt

SEQ ID NO: 3408605 - DNA, 13 bp, Homo sapiens
ggaccagcctggc

SEQ ID NO: 3408606 - DNA, 20 bp, Homo sapiens
gtggcctatgaaactggttt

SEQ ID NO: 3408607 - DNA, 15 bp, Homo sapiens
gtgggagatgaaaac

SEQ ID NO: 3408608 - DNA, 23 bp, Homo sapiens
gtgggcgggcaggggagggtcag

SEQ ID NO: 3408609 - DNA, 14 bp, Homo sapiens
gtggggcactcctt

SEQ ID NO: 3408610 - DNA, 19 bp, Homo sapiens
gtggggtaggttgggagaa

SEQ ID NO: 3408611 - DNA, 14 bp, Homo sapiens
gtgggtcaaggaat

SEQ ID NO: 3408612 - DNA, 16 bp, Homo sapiens
gtgggtctgtgtgtgt

SEQ ID NO: 3408613 - DNA, 15 bp, Homo sapiens
gtggtctttgtaaga

SEQ ID NO: 3408614 - DNA, 13 bp, Homo sapiens
gtgtaataagaca

SEQ ID NO: 3408615 - DNA, 14 bp, Homo sapiens
gtgtaataagacat

SEQ ID NO: 3408616 - DNA, 13 bp, Homo sapiens
gtgtaatattctc

SEQ ID NO: 3408617 - DNA, 23 bp, Homo sapiens
gtgtaatttaaaattgtgatgtg

SEQ ID NO: 3408618 - DNA, 13 bp, Homo sapiens
gtgtagaagcatt

SEQ ID NO: 3408619 - DNA, 23 bp, Homo sapiens
gtgtagaagcattccttctttga

SEQ ID NO: 3408620 - DNA, 15 bp, Homo sapiens
gtgtagagttaagaa

SEQ ID NO: 3408621 - DNA, 20 bp, Homo sapiens
gtgtagagttaagaagctgt

SEQ ID NO: 3408622 - DNA, 21 bp, Homo sapiens
gtgtattcttaaaatgcaata

SEQ ID NO: 3408623 - DNA, 18 bp, Homo sapiens
gtgtcaactttcatttga

SEQ ID NO: 3408624 - DNA, 17 bp, Homo sapiens
gtgtcatcaatttgtaa

SEQ ID NO: 3408625 - DNA, 22 bp, Homo sapiens
gtgtccatcatattaaaaatat

SEQ ID NO: 3408626 - DNA, 13 bp, Homo sapiens
gtgtcccagtgaa

SEQ ID NO: 3408627 - DNA, 13 bp, Homo sapiens
gtgtctccaaccc

SEQ ID NO: 3408628 - DNA, 21 bp, Homo sapiens
gtgtctccaaccccccagcac

SEQ ID NO: 3408629 - DNA, 14 bp, Homo sapiens
gtgtctgtgtctgc

SEQ ID NO: 3408630 - DNA, 16 bp, Homo sapiens
gtgtgaataaagtgct

SEQ ID NO: 3408631 - DNA, 23 bp, Homo sapiens
gtgtggagaagccacaggcctga

SEQ ID NO: 3408632 - DNA, 17 bp, Homo sapiens
gtgtgtagagttaagaa

SEQ ID NO: 3408633 - DNA, 20 bp, Homo sapiens
gtgtgtagagttaagaagct

SEQ ID NO: 3408634 - DNA, 14 bp, Homo sapiens
gtgtgtgtatgtgg

SEQ ID NO: 3408635 - DNA, 16 bp, Homo sapiens
gtgttacattattcca

SEQ ID NO: 3408636 - DNA, 22 bp, Homo sapiens
gtgttggttttgactggatatt

SEQ ID NO: 3408637 - DNA, 12 bp, Homo sapiens
gtgtttatgtgt

SEQ ID NO: 3408638 - DNA, 22 bp, Homo sapiens
gtgtttgtataccatgatgcat

SEQ ID NO: 3408639 - DNA, 18 bp, Homo sapiens
gttaaataaatagaaaga

SEQ ID NO: 3408640 - DNA, 14 bp, Homo sapiens
gttaaatcatttgg

SEQ ID NO: 3408641 - DNA, 15 bp, Homo sapiens
gttaaatttgtaagt

SEQ ID NO: 3408642 - DNA, 17 bp, Homo sapiens
gttaaatttgtaagttt

SEQ ID NO: 3408643 - DNA, 23 bp, Homo sapiens
gttaaatttgtaagtttcaggtg

SEQ ID NO: 3408644 - DNA, 11 bp, Homo sapiens
gttaagaaata

SEQ ID NO: 3408645 - DNA, 13 bp, Homo sapiens
gttaagaagctgt

SEQ ID NO: 3408646 - DNA, 17 bp, Homo sapiens
gttaagaagctgttgta

SEQ ID NO: 3408647 - DNA, 19 bp, Homo sapiens
gttaagatactcaagcagg

SEQ ID NO: 3408648 - DNA, 15 bp, Homo sapiens
gttaatatttttaaa

SEQ ID NO: 3408649 - DNA, 13 bp, Homo sapiens
gttaatcagtgtt

SEQ ID NO: 3408650 - DNA, 14 bp, Homo sapiens
gttaccctgctttg

SEQ ID NO: 3408651 - DNA, 17 bp, Homo sapiens
gttactgcttctctttg

SEQ ID NO: 3408652 - DNA, 20 bp, Homo sapiens
gttactgcttctctttgtgc

SEQ ID NO: 3408653 - DNA, 23 bp, Homo sapiens
gttactgcttctctttgtgcagt

SEQ ID NO: 3408654 - DNA, 20 bp, Homo sapiens
gttacttaaacatcattgga

SEQ ID NO: 3408655 - DNA, 22 bp, Homo sapiens
gttacttagaatgccataaaat

SEQ ID NO: 3408656 - DNA, 22 bp, Homo sapiens
gttagcgtttcggccttcataa

SEQ ID NO: 3408657 - DNA, 21 bp, Homo sapiens
gttatcgaaataacaatgtta

SEQ ID NO: 3408658 - DNA, 16 bp, Homo sapiens
gttattaatgtttctt

SEQ ID NO: 3408659 - DNA, 14 bp, Homo sapiens
gttcaaaatgtctg

SEQ ID NO: 3408660 - DNA, 20 bp, Homo sapiens
gttcatgggggagggggcag

SEQ ID NO: 3408661 - DNA, 22 bp, Homo sapiens
gttcccctcctccactctcccc

SEQ ID NO: 3408662 - DNA, 15 bp, Homo sapiens
gttccggcatggaca

SEQ ID NO: 3408663 - DNA, 14 bp, Homo sapiens
gttcctcgttctcc

SEQ ID NO: 3408664 - DNA, 17 bp, Homo sapiens
gttcctcgttctccctg

SEQ ID NO: 3408665 - DNA, 20 bp, Homo sapiens
gttcctcgttctccctggga

SEQ ID NO: 3408666 - DNA, 18 bp, Homo sapiens
gttccttgcttttatagt

SEQ ID NO: 3408667 - DNA, 16 bp, Homo sapiens
gttctacactcatctt

SEQ ID NO: 3408668 - DNA, 16 bp, Homo sapiens
gttctgtcccttgccc

SEQ ID NO: 3408669 - DNA, 13 bp, Homo sapiens
gttgagacgcctt

SEQ ID NO: 3408670 - DNA, 14 bp, Homo sapiens
gttgcactttgtag

SEQ ID NO: 3408671 - DNA, 15 bp, Homo sapiens
gttgcttttattgca

SEQ ID NO: 3408672 - DNA, 21 bp, Homo sapiens
gttgggagaatgtcagtatgt

SEQ ID NO: 3408673 - DNA, 18 bp, Homo sapiens
gttggttgcactttgtag

SEQ ID NO: 3408674 - DNA, 23 bp, Homo sapiens
gttgtacatttatgatttaataa

SEQ ID NO: 3408675 - DNA, 15 bp, Homo sapiens
gttgtatataaagtt

SEQ ID NO: 3408676 - DNA, 12 bp, Homo sapiens
gttgtccctgca

SEQ ID NO: 3408677 - DNA, 16 bp, Homo sapiens
gttgtgtattgtggtt

SEQ ID NO: 3408678 - DNA, 15 bp, Homo sapiens
gttgttgtttgccaa

SEQ ID NO: 3408679 - DNA, 22 bp, Homo sapiens
gttgtttaacttgtctttttgt

SEQ ID NO: 3408680 - DNA, 14 bp, Homo sapiens
gttgtttctttcta

SEQ ID NO: 3408681 - DNA, 15 bp, Homo sapiens
gttgtttctttctag

SEQ ID NO: 3408682 - DNA, 19 bp, Homo sapiens
gtttaaatgccaaaatgta

SEQ ID NO: 3408683 - DNA, 16 bp, Homo sapiens
gtttaacattaaagca

SEQ ID NO: 3408684 - DNA, 19 bp, Homo sapiens
gtttaacttgtctttttgt

SEQ ID NO: 3408685 - DNA, 18 bp, Homo sapiens
gtttacaacaaacactgt

SEQ ID NO: 3408686 - DNA, 13 bp, Homo sapiens
gtttataataaac

SEQ ID NO: 3408687 - DNA, 21 bp, Homo sapiens
gtttatatattgaaagttgct

SEQ ID NO: 3408688 - DNA, 18 bp, Homo sapiens
gtttatatttattatata

SEQ ID NO: 3408689 - DNA, 22 bp, Homo sapiens
gtttcaatttactttttaaaca

SEQ ID NO: 3408690 - DNA, 15 bp, Homo sapiens
gtttcatgtatgtat

SEQ ID NO: 3408691 - DNA, 22 bp, Homo sapiens
gtttcggccttcataatggcct

SEQ ID NO: 3408692 - DNA, 14 bp, Homo sapiens
gtttctcattaaac

SEQ ID NO: 3408693 - DNA, 17 bp, Homo sapiens
gtttctcattaaactct

SEQ ID NO: 3408694 - DNA, 21 bp, Homo sapiens
gtttctgaaaattaacactgc

SEQ ID NO: 3408695 - DNA, 21 bp, Homo sapiens
gtttctgatctgtactttgtg

SEQ ID NO: 3408696 - DNA, 13 bp, Homo sapiens
gtttcttagcttt

SEQ ID NO: 3408697 - DNA, 19 bp, Homo sapiens
gtttgaagaaccgcatttt

SEQ ID NO: 3408698 - DNA, 13 bp, Homo sapiens
gtttgaatataaa

SEQ ID NO: 3408699 - DNA, 20 bp, Homo sapiens
gtttgacgaagaaacaaaaa

SEQ ID NO: 3408700 - DNA, 12 bp, Homo sapiens
gtttgatagtgc

SEQ ID NO: 3408701 - DNA, 20 bp, Homo sapiens
gtttgatagtgcttcttgta

SEQ ID NO: 3408702 - DNA, 17 bp, Homo sapiens
gtttgatcatagaattg

SEQ ID NO: 3408703 - DNA, 13 bp, Homo sapiens
gtttgcaaggaag

SEQ ID NO: 3408704 - DNA, 14 bp, Homo sapiens
gtttgcaaggaagc

SEQ ID NO: 3408705 - DNA, 22 bp, Homo sapiens
gtttgcaaggaagccacagctg

SEQ ID NO: 3408706 - DNA, 14 bp, Homo sapiens
gtttgctgttttaa

SEQ ID NO: 3408707 - DNA, 22 bp, Homo sapiens
gtttgtataccatgatgcatgg

SEQ ID NO: 3408708 - DNA, 18 bp, Homo sapiens
gttttaaacgacttttgt

SEQ ID NO: 3408709 - DNA, 21 bp, Homo sapiens
gttttactcttaaatcatttg

SEQ ID NO: 3408710 - DNA, 13 bp, Homo sapiens
gttttatttacat

SEQ ID NO: 3408711 - DNA, 13 bp, Homo sapiens
gttttatttatat

SEQ ID NO: 3408712 - DNA, 24 bp, Homo sapiens
gttttatttatatcttgttattaa

SEQ ID NO: 3408713 - DNA, 22 bp, Homo sapiens
gttttcctataatataataaat

SEQ ID NO: 3408714 - DNA, 16 bp, Homo sapiens
gttttcttaacttaaa

SEQ ID NO: 3408715 - DNA, 17 bp, Homo sapiens
gttttgtaaagtcccca

SEQ ID NO: 3408716 - DNA, 21 bp, Homo sapiens
gttttgttcccctcctccact

SEQ ID NO: 3408717 - DNA, 15 bp, Homo sapiens
tcacccctggttctc

SEQ ID NO: 3408718 - DNA, 18 bp, Homo sapiens
tcacccctggttctcatc

SEQ ID NO: 3408719 - DNA, 14 bp, Homo sapiens
tcaccctgggcagt

SEQ ID NO: 3408720 - DNA, 20 bp, Homo sapiens
tcacgattatgactaaagta

SEQ ID NO: 3408721 - DNA, 19 bp, Homo sapiens
tcactctgtgtctgagtgg

SEQ ID NO: 3408722 - DNA, 13 bp, Homo sapiens
tcactcttctcag

SEQ ID NO: 3408723 - DNA, 13 bp, Homo sapiens
tcactgccatata

SEQ ID NO: 3408724 - DNA, 17 bp, Homo sapiens
tcactgtactctgtggg

SEQ ID NO: 3408725 - DNA, 15 bp, Homo sapiens
tcactgtataaatag

SEQ ID NO: 3408726 - DNA, 23 bp, Homo sapiens
tcactgtataaataggagaggat

SEQ ID NO: 3408727 - DNA, 18 bp, Homo sapiens
tcactttttcccctgcaa

SEQ ID NO: 3408728 - DNA, 19 bp, Homo sapiens
tcagaattggcataatttg

SEQ ID NO: 3408729 - DNA, 20 bp, Homo sapiens
tcagacactagggaaaggta

SEQ ID NO: 3408730 - DNA, 23 bp, Homo sapiens
tcagagtttggttaatcagtgtt

SEQ ID NO: 3408731 - DNA, 12 bp, Homo sapiens
tcagagttttac

SEQ ID NO: 3408732 - DNA, 13 bp, Homo sapiens
tcagagttttact

SEQ ID NO: 3408733 - DNA, 18 bp, Homo sapiens
tcagagttttactaagat

SEQ ID NO: 3408734 - DNA, 22 bp, Homo sapiens
tcagatttgccttattggcagc

SEQ ID NO: 3408735 - DNA, 14 bp, Homo sapiens
tcagccaaacagta

SEQ ID NO: 3408736 - DNA, 15 bp, Homo sapiens
tcagccccaccccag

SEQ ID NO: 3408737 - DNA, 19 bp, Homo sapiens
tcagccccaccccagggca

SEQ ID NO: 3408738 - DNA, 12 bp, Homo sapiens
tcagctccctgc

SEQ ID NO: 3408739 - DNA, 17 bp, Homo sapiens
tcagctccctgcctgtt

SEQ ID NO: 3408740 - DNA, 19 bp, Homo sapiens
tcagctctcagttgcagcc

SEQ ID NO: 3408741 - DNA, 19 bp, Homo sapiens
tcagctgctgaagggaggg

SEQ ID NO: 3408742 - DNA, 19 bp, Homo sapiens
tcagctggtggatggtgac

SEQ ID NO: 3408743 - DNA, 21 bp, Homo sapiens
tcagctggtggatggtgactt

SEQ ID NO: 3408744 - DNA, 22 bp, Homo sapiens
tcagctggtggatggtgacttt

SEQ ID NO: 3408745 - DNA, 12 bp, Homo sapiens
tcaggcagctcg

SEQ ID NO: 3408746 - DNA, 21 bp, Homo sapiens
tcaggttatcgaaataacaat

SEQ ID NO: 3408747 - DNA, 12 bp, Homo sapiens
tcagtatgtgga

SEQ ID NO: 3408748 - DNA, 15 bp, Homo sapiens
tcagtattatttgta

SEQ ID NO: 3408749 - DNA, 23 bp, Homo sapiens
tcagtattttccagccttatgtg

SEQ ID NO: 3408750 - DNA, 17 bp, Homo sapiens
tcagtcatgcataaata

SEQ ID NO: 3408751 - DNA, 22 bp, Homo sapiens
tcagtctttaatctgagaggcc

SEQ ID NO: 3408752 - DNA, 20 bp, Homo sapiens
tcagtgatggcaacactgaa

SEQ ID NO: 3408753 - DNA, 12 bp, Homo sapiens
tcagtgtatcta

SEQ ID NO: 3408754 - DNA, 18 bp, Homo sapiens
tcagtgtcgggaattttc

SEQ ID NO: 3408755 - DNA, 14 bp, Homo sapiens
tcagtgtgaaaatt

SEQ ID NO: 3408756 - DNA, 20 bp, Homo sapiens
tcagttcctgcccttggcct

SEQ ID NO: 3408757 - DNA, 12 bp, Homo sapiens
tcagtttctaca

SEQ ID NO: 3408758 - DNA, 18 bp, Homo sapiens
tcagtttttttttttcca

SEQ ID NO: 3408759 - DNA, 23 bp, Homo sapiens
tcataaatttgttgtcatgtgta

SEQ ID NO: 3408760 - DNA, 19 bp, Homo sapiens
tcatacatttgtggtctga

SEQ ID NO: 3408761 - DNA, 20 bp, Homo sapiens
tcatataaactttttaaaga

SEQ ID NO: 3408762 - DNA, 14 bp, Homo sapiens
tcatcagtaagtat

SEQ ID NO: 3408763 - DNA, 17 bp, Homo sapiens
tcatctatttctgagaa

SEQ ID NO: 3408764 - DNA, 22 bp, Homo sapiens
tcatctccggggtggccacagg

SEQ ID NO: 3408765 - DNA, 16 bp, Homo sapiens
tcatctctctttaata

SEQ ID NO: 3408766 - DNA, 14 bp, Homo sapiens
tcatctcttagctc

SEQ ID NO: 3408767 - DNA, 20 bp, Homo sapiens
tcatctcttagctcccctcc

SEQ ID NO: 3408768 - DNA, 18 bp, Homo sapiens
tcatctgctctccttcct

SEQ ID NO: 3408769 - DNA, 13 bp, Homo sapiens
tcatctttcttga

SEQ ID NO: 3408770 - DNA, 19 bp, Homo sapiens
tcatgactgagtctggcaa

SEQ ID NO: 3408771 - DNA, 22 bp, Homo sapiens
tcatgatagaaggctatgggga

SEQ ID NO: 3408772 - DNA, 15 bp, Homo sapiens
tcatggtgtaataag

SEQ ID NO: 3408773 - DNA, 18 bp, Homo sapiens
tcatggtgtaataagaca

SEQ ID NO: 3408774 - DNA, 20 bp, Homo sapiens
tcatggtgtaataagacata

SEQ ID NO: 3408775 - DNA, 16 bp, Homo sapiens
tcatgtatatttagtt

SEQ ID NO: 3408776 - DNA, 17 bp, Homo sapiens
tcatgtttacagaggac

SEQ ID NO: 3408777 - DNA, 23 bp, Homo sapiens
tcatgttttaaaagtttgtcctt

SEQ ID NO: 3408778 - DNA, 15 bp, Homo sapiens
tcattaaactgattc

SEQ ID NO: 3408779 - DNA, 13 bp, Homo sapiens
tcattacactaaa

SEQ ID NO: 3408780 - DNA, 14 bp, Homo sapiens
tcattatttcatca

SEQ ID NO: 3408781 - DNA, 17 bp, Homo sapiens
tcattcctaacacagca

SEQ ID NO: 3408782 - DNA, 18 bp, Homo sapiens
tcattcctaacacagcat

SEQ ID NO: 3408783 - DNA, 15 bp, Homo sapiens
tcatttcacccctcc

SEQ ID NO: 3408784 - DNA, 16 bp, Homo sapiens
tcatttcacccctccc

SEQ ID NO: 3408785 - DNA, 23 bp, Homo sapiens
tcatttcacccctccctttctcc

SEQ ID NO: 3408786 - DNA, 16 bp, Homo sapiens
tcatttcattcctaac

SEQ ID NO: 3408787 - DNA, 13 bp, Homo sapiens
tcatttgaaagtg

SEQ ID NO: 3408788 - DNA, 21 bp, Homo sapiens
tcatttggcttgctgtttact

SEQ ID NO: 3408789 - DNA, 13 bp, Homo sapiens
tcatttggttaaa

SEQ ID NO: 3408790 - DNA, 15 bp, Homo sapiens
tcattttaggaaagg

SEQ ID NO: 3408791 - DNA, 16 bp, Homo sapiens
tcatttttttccaggc

SEQ ID NO: 3408792 - DNA, 14 bp, Homo sapiens
tccaaatgcattca

SEQ ID NO: 3408793 - DNA, 22 bp, Homo sapiens
tccaaatgctgtgcaaacagtg

SEQ ID NO: 3408794 - DNA, 22 bp, Homo sapiens
tccaaggaacctaattgaaatt

SEQ ID NO: 3408795 - DNA, 21 bp, Homo sapiens
tccaatgatacccaacagttt

SEQ ID NO: 3408796 - DNA, 19 bp, Homo sapiens
tccaattctgaaatacttt

SEQ ID NO: 3408797 - DNA, 21 bp, Homo sapiens
tccacacaaaatgtcacactt

SEQ ID NO: 3408798 - DNA, 18 bp, Homo sapiens
tccacacctgcggcccaa

SEQ ID NO: 3408799 - DNA, 16 bp, Homo sapiens
tccacatcatgttact

SEQ ID NO: 3408800 - DNA, 15 bp, Homo sapiens
tccacctgtgagaaa

SEQ ID NO: 3408801 - DNA, 21 bp, Homo sapiens
tccacctgtgagaaaggaaaa

SEQ ID NO: 3408802 - DNA, 18 bp, Homo sapiens
tccacgtgtatgcaagtg

SEQ ID NO: 3408803 - DNA, 18 bp, Homo sapiens
tccactttcagtgaaagc

SEQ ID NO: 3408804 - DNA, 18 bp, Homo sapiens
tccagaagaccccacttc

SEQ ID NO: 3408805 - DNA, 20 bp, Homo sapiens
tccagacctgcccctccctc

SEQ ID NO: 3408806 - DNA, 23 bp, Homo sapiens
tccagctagtgccaaataattga

SEQ ID NO: 3408807 - DNA, 13 bp, Homo sapiens
tccagggacagca

SEQ ID NO: 3408808 - DNA, 14 bp, Homo sapiens
tccagggacagcaa

SEQ ID NO: 3408809 - DNA, 17 bp, Homo sapiens
tccagggctggactgag

SEQ ID NO: 3408810 - DNA, 12 bp, Homo sapiens
tccagttttgtt

SEQ ID NO: 3408811 - DNA, 11 bp, Homo sapiens
tccatctcagt

SEQ ID NO: 3408812 - DNA, 17 bp, Homo sapiens
tccattgccatcagtga

SEQ ID NO: 3408813 - DNA, 13 bp, Homo sapiens
tccatttttgttg

SEQ ID NO: 3408814 - DNA, 12 bp, Homo sapiens
tcccacctggct

SEQ ID NO: 3408815 - DNA, 23 bp, Homo sapiens
tcccactttgctgttccttactt

SEQ ID NO: 3408816 - DNA, 16 bp, Homo sapiens
tcccagaggggcctgc

SEQ ID NO: 3408817 - DNA, 18 bp, Homo sapiens
tcccagattggctcacac

SEQ ID NO: 3408818 - DNA, 14 bp, Homo sapiens
tcccagggcttacg

SEQ ID NO: 3408819 - DNA, 17 bp, Homo sapiens
tcccaggtaatttaaat

SEQ ID NO: 3408820 - DNA, 13 bp, Homo sapiens
tcccattctatgt

SEQ ID NO: 3408821 - DNA, 14 bp, Homo sapiens
tcccattctatgtg

SEQ ID NO: 3408822 - DNA, 14 bp, Homo sapiens
tccccaactgacca

SEQ ID NO: 3408823 - DNA, 18 bp, Homo sapiens
tccccaactgaccacctt

SEQ ID NO: 3408824 - DNA, 19 bp, Homo sapiens
tccccaactgaccaccttt

SEQ ID NO: 3408825 - DNA, 18 bp, Homo sapiens
tccccaatccatgcttca

SEQ ID NO: 3408826 - DNA, 19 bp, Homo sapiens
tccccatgggctcccactg

SEQ ID NO: 3408827 - DNA, 16 bp, Homo sapiens
tcccccacccacctct

SEQ ID NO: 3408828 - DNA, 18 bp, Homo sapiens
tcccccaccgcccactct

SEQ ID NO: 3408829 - DNA, 15 bp, Homo sapiens
tctttgttacaggca

SEQ ID NO: 3408830 - DNA, 15 bp, Homo sapiens
tcttttacatacagt

SEQ ID NO: 3408831 - DNA, 14 bp, Homo sapiens
tcttttccagaaag

SEQ ID NO: 3408832 - DNA, 20 bp, Homo sapiens
tcttttcttgcctctgtccc

SEQ ID NO: 3408833 - DNA, 13 bp, Homo sapiens
tcttttctttgta

SEQ ID NO: 3408834 - DNA, 17 bp, Homo sapiens
tcttttctttgtatcat

SEQ ID NO: 3408835 - DNA, 20 bp, Homo sapiens
tcttttctttgtatcattca

SEQ ID NO: 3408836 - DNA, 20 bp, Homo sapiens
tcttttgaatccatgcttgg

SEQ ID NO: 3408837 - DNA, 17 bp, Homo sapiens
tctttttttccttcctt

SEQ ID NO: 3408838 - DNA, 21 bp, Homo sapiens
tgaaaaaagaagtttgggcta

SEQ ID NO: 3408839 - DNA, 13 bp, Homo sapiens
tgaaaacctgcat

SEQ ID NO: 3408840 - DNA, 23 bp, Homo sapiens
tgaaaagctattagccaggatca

SEQ ID NO: 3408841 - DNA, 20 bp, Homo sapiens
tgaaaatgcaacaacatgta

SEQ ID NO: 3408842 - DNA, 16 bp, Homo sapiens
tgaaaccttttttaag

SEQ ID NO: 3408843 - DNA, 20 bp, Homo sapiens
tgaaaccttttttaagattt

SEQ ID NO: 3408844 - DNA, 20 bp, Homo sapiens
tgaaactggtttataataaa

SEQ ID NO: 3408845 - DNA, 16 bp, Homo sapiens
tgaaagaaaggactct

SEQ ID NO: 3408846 - DNA, 17 bp, Homo sapiens
tgaaaggctatcctgct

SEQ ID NO: 3408847 - DNA, 17 bp, Homo sapiens
tgaaagtcctgctttcc

SEQ ID NO: 3408848 - DNA, 15 bp, Homo sapiens
tgaaagtgatgacat

SEQ ID NO: 3408849 - DNA, 20 bp, Homo sapiens
tgaaagtgatgacatatttt

SEQ ID NO: 3408850 - DNA, 13 bp, Homo sapiens
tgaaagttgcttt

SEQ ID NO: 3408851 - DNA, 12 bp, Homo sapiens
tgaaatattttg

SEQ ID NO: 3408852 - DNA, 18 bp, Homo sapiens
tgaaatattttgaataca

SEQ ID NO: 3408853 - DNA, 14 bp, Homo sapiens
tgaaatgaaaacat

SEQ ID NO: 3408854 - DNA, 20 bp, Homo sapiens
tgaaatgaaaacatgtaata

SEQ ID NO: 3408855 - DNA, 19 bp, Homo sapiens
tgaaatttaaaaataaagc

SEQ ID NO: 3408856 - DNA, 20 bp, Homo sapiens
tgaaatttaaaaataaagct

SEQ ID NO: 3408857 - DNA, 21 bp, Homo sapiens
tgaacaagttagtttctcata

SEQ ID NO: 3408858 - DNA, 18 bp, Homo sapiens
tgaacagactgaccttga

SEQ ID NO: 3408859 - DNA, 21 bp, Homo sapiens
tgaacagtttggatgtcctca

SEQ ID NO: 3408860 - DNA, 15 bp, Homo sapiens
tgaacatttactaca

SEQ ID NO: 3408861 - DNA, 20 bp, Homo sapiens
tgaactgaaggcagcatgta

SEQ ID NO: 3408862 - DNA, 20 bp, Homo sapiens
tgaagagaagggcagggctg

SEQ ID NO: 3408863 - DNA, 14 bp, Homo sapiens
tgaagatctgattt

SEQ ID NO: 3408864 - DNA, 15 bp, Homo sapiens
tgaagctggaagcac

SEQ ID NO: 3408865 - DNA, 13 bp, Homo sapiens
tgaaggtttctga

SEQ ID NO: 3408866 - DNA, 20 bp, Homo sapiens
tgaagtacatattaggaaaa

SEQ ID NO: 3408867 - DNA, 20 bp, Homo sapiens
tgaatacacatctctgtcag

SEQ ID NO: 3408868 - DNA, 16 bp, Homo sapiens
tgaatataaacactat

SEQ ID NO: 3408869 - DNA, 15 bp, Homo sapiens
tgaatatatggcatt

SEQ ID NO: 3408870 - DNA, 20 bp, Homo sapiens
tgaatatatggcatttgcag

SEQ ID NO: 3408871 - DNA, 22 bp, Homo sapiens
tgaatctatttttaaaatcata

SEQ ID NO: 3408872 - DNA, 19 bp, Homo sapiens
tgaatgagttttacaaatt

SEQ ID NO: 3408873 - DNA, 14 bp, Homo sapiens
tgaatggattggat

SEQ ID NO: 3408874 - DNA, 20 bp, Homo sapiens
tgaatggattggattattta

SEQ ID NO: 3408875 - DNA, 23 bp, Homo sapiens
tgaatggattggattatttaata

SEQ ID NO: 3408876 - DNA, 23 bp, Homo sapiens
tgaatgtgatcatctttgctgaa

SEQ ID NO: 3408877 - DNA, 18 bp, Homo sapiens
tgaattaccatagagtaa

SEQ ID NO: 3408878 - DNA, 17 bp, Homo sapiens
tgaatttaagcatgagt

SEQ ID NO: 3408879 - DNA, 15 bp, Homo sapiens
tgaatttatgagatt

SEQ ID NO: 3408880 - DNA, 21 bp, Homo sapiens
tgaattttaaaacatgctgtt

SEQ ID NO: 3408881 - DNA, 22 bp, Homo sapiens
tgacaatgcgtggcacatctaa

SEQ ID NO: 3408882 - DNA, 13 bp, Homo sapiens
tgacagaacactg

SEQ ID NO: 3408883 - DNA, 15 bp, Homo sapiens
tgacagaacactgtc

SEQ ID NO: 3408884 - DNA, 15 bp, Homo sapiens
tgacagatgttattt

SEQ ID NO: 3408885 - DNA, 23 bp, Homo sapiens
tgacatgcctatatgagaagaat

SEQ ID NO: 3408886 - DNA, 12 bp, Homo sapiens
tgacatgtgaaa

SEQ ID NO: 3408887 - DNA, 15 bp, Homo sapiens
tgacatgtgaaacct

SEQ ID NO: 3408888 - DNA, 16 bp, Homo sapiens
tgacatgtgaaacctt

SEQ ID NO: 3408889 - DNA, 17 bp, Homo sapiens
tgacatgtgaaaccttt

SEQ ID NO: 3408890 - DNA, 20 bp, Homo sapiens
tgaccaatgcattaccttct

SEQ ID NO: 3408891 - DNA, 14 bp, Homo sapiens
tgacctgaactctg

SEQ ID NO: 3408892 - DNA, 16 bp, Homo sapiens
tgacctgaactctgca

SEQ ID NO: 3408893 - DNA, 17 bp, Homo sapiens
tgaccttgatgagctgt

SEQ ID NO: 3408894 - DNA, 19 bp, Homo sapiens
tgaccttgatgagctgtgc

SEQ ID NO: 3408895 - DNA, 22 bp, Homo sapiens
tgaccttgatgagctgtgcaca

SEQ ID NO: 3408896 - DNA, 16 bp, Homo sapiens
tgactaaagagagaat

SEQ ID NO: 3408897 - DNA, 17 bp, Homo sapiens
tgactaaagagagaatg

SEQ ID NO: 3408898 - DNA, 23 bp, Homo sapiens
tgactaaagtaccagattataat

SEQ ID NO: 3408899 - DNA, 22 bp, Homo sapiens
tgactccttagagacatcaaaa

SEQ ID NO: 3408900 - DNA, 21 bp, Homo sapiens
tgactgcaagcatttttccat

SEQ ID NO: 3408901 - DNA, 19 bp, Homo sapiens
tgacttgacagaacactgt

SEQ ID NO: 3408902 - DNA, 15 bp, Homo sapiens
tgagaaaggaaaaat

SEQ ID NO: 3408903 - DNA, 12 bp, Homo sapiens
tgagaagaatag

SEQ ID NO: 3408904 - DNA, 19 bp, Homo sapiens
tgagaagtactttgtgctg

SEQ ID NO: 3408905 - DNA, 17 bp, Homo sapiens
tgagaattccctgtgga

SEQ ID NO: 3408906 - DNA, 21 bp, Homo sapiens
tgagaattccctgtggatttt

SEQ ID NO: 3408907 - DNA, 19 bp, Homo sapiens
tgagacacaggatgaagca

SEQ ID NO: 3408908 - DNA, 12 bp, Homo sapiens
tgagactcgaga

SEQ ID NO: 3408909 - DNA, 16 bp, Homo sapiens
tgagacttaattttgt

SEQ ID NO: 3408910 - DNA, 13 bp, Homo sapiens
tgagatttcatct

SEQ ID NO: 3408911 - DNA, 21 bp, Homo sapiens
tgagatttcatctgctctcct

SEQ ID NO: 3408912 - DNA, 22 bp, Homo sapiens
tgagcgctcctgccgcagagct

SEQ ID NO: 3408913 - DNA, 13 bp, Homo sapiens
tgagcgtgattct

SEQ ID NO: 3408914 - DNA, 16 bp, Homo sapiens
tgagctgtcaacgaga

SEQ ID NO: 3408915 - DNA, 17 bp, Homo sapiens
tgaggaacaatcacaaa

SEQ ID NO: 3408916 - DNA, 23 bp, Homo sapiens
tgaggaagaacggggctcttctc

SEQ ID NO: 3408917 - DNA, 21 bp, Homo sapiens
tgaggatttctgatctgattt

SEQ ID NO: 3408918 - DNA, 22 bp, Homo sapiens
tgaggccctccacacctgcggc

SEQ ID NO: 3408919 - DNA, 14 bp, Homo sapiens
tgagggattctatt

SEQ ID NO: 3408920 - DNA, 20 bp, Homo sapiens
tgaggtcaagtaagaagaca

SEQ ID NO: 3408921 - DNA, 18 bp, Homo sapiens
tgaggtcttttacataca

SEQ ID NO: 3408922 - DNA, 17 bp, Homo sapiens
tgaggtttaacattaaa

SEQ ID NO: 3408923 - DNA, 17 bp, Homo sapiens
tgagtctgttttgtaaa

SEQ ID NO: 3408924 - DNA, 18 bp, Homo sapiens
tgagtctgttttgtaaag

SEQ ID NO: 3408925 - DNA, 20 bp, Homo sapiens
tgagtcttaactgtatttca

SEQ ID NO: 3408926 - DNA, 15 bp, Homo sapiens
tgagtgagttttact

SEQ ID NO: 3408927 - DNA, 14 bp, Homo sapiens
tgagtgatagagct

SEQ ID NO: 3408928 - DNA, 16 bp, Homo sapiens
tgagtgccatgctttt

SEQ ID NO: 3408929 - DNA, 23 bp, Homo sapiens
tgagttgacttgacagaacactg

SEQ ID NO: 3408930 - DNA, 18 bp, Homo sapiens
tgataatgatttcctctg

SEQ ID NO: 3408931 - DNA, 18 bp, Homo sapiens
tgataatgtattgcagtg

SEQ ID NO: 3408932 - DNA, 14 bp, Homo sapiens
tgataatgttaaat

SEQ ID NO: 3408933 - DNA, 15 bp, Homo sapiens
tgataatgttaaatt

SEQ ID NO: 3408934 - DNA, 16 bp, Homo sapiens
tgataatgttaaattt

SEQ ID NO: 3408935 - DNA, 21 bp, Homo sapiens
tgatagaaggctatggggata

SEQ ID NO: 3408936 - DNA, 18 bp, Homo sapiens
tgatagtgtaaacaaata

SEQ ID NO: 3408937 - DNA, 23 bp, Homo sapiens
tgatagtgtaaacaaataataaa

SEQ ID NO: 3408938 - DNA, 17 bp, Homo sapiens
tgatatggcagaagaca

SEQ ID NO: 3408939 - DNA, 18 bp, Homo sapiens
tgatatggcagaagacac

SEQ ID NO: 3408940 - DNA, 16 bp, Homo sapiens
tgtatgagaagtactt

SEQ ID NO: 3408941 - DNA, 17 bp, Homo sapiens
tgtatgagaagtacttt

SEQ ID NO: 3408942 - DNA, 21 bp, Homo sapiens
tgtatgagaagtactttgtgc

SEQ ID NO: 3408943 - DNA, 22 bp, Homo sapiens
tgtatgtggatacagtcattat

SEQ ID NO: 3408944 - DNA, 14 bp, Homo sapiens
tgtattaaactttt

SEQ ID NO: 3408945 - DNA, 17 bp, Homo sapiens
tgtattaaacttttcat

SEQ ID NO: 3408946 - DNA, 22 bp, Homo sapiens
tgtattgagtcttaactgtatt

SEQ ID NO: 3408947 - DNA, 14 bp, Homo sapiens
tgtatttaatgatt

SEQ ID NO: 3408948 - DNA, 15 bp, Homo sapiens
tgtatttccagtgca

SEQ ID NO: 3408949 - DNA, 14 bp, Homo sapiens
tgtcacagctcttg

SEQ ID NO: 3408950 - DNA, 22 bp, Homo sapiens
tgtcagtatgtggaagtgtggg

SEQ ID NO: 3408951 - DNA, 17 bp, Homo sapiens
tgtcatcaatttgtaat

SEQ ID NO: 3408952 - DNA, 17 bp, Homo sapiens
tgtcatgtgtatgagaa

SEQ ID NO: 3408953 - DNA, 18 bp, Homo sapiens
tgtccaaatactctgaaa

SEQ ID NO: 3408954 - DNA, 20 bp, Homo sapiens
tgtccaaatactctgaaatg

SEQ ID NO: 3408955 - DNA, 20 bp, Homo sapiens
tgtccatcatattaaaaata

SEQ ID NO: 3408956 - DNA, 22 bp, Homo sapiens
tgtccatcatattaaaaatata

SEQ ID NO: 3408957 - DNA, 14 bp, Homo sapiens
tgtcccacctggct

SEQ ID NO: 3408958 - DNA, 11 bp, Homo sapiens
tgtccccttct

SEQ ID NO: 3408959 - DNA, 16 bp, Homo sapiens
tgtccccttctctcat

SEQ ID NO: 3408960 - DNA, 20 bp, Homo sapiens
tgtccctgaagtcttgcatt

SEQ ID NO: 3408961 - DNA, 18 bp, Homo sapiens
tgtcccttgcccccctgg

SEQ ID NO: 3408962 - DNA, 14 bp, Homo sapiens
tgtcctatgcaata

SEQ ID NO: 3408963 - DNA, 17 bp, Homo sapiens
tgtctccaaccccccag

SEQ ID NO: 3408964 - DNA, 19 bp, Homo sapiens
tgtctccaaccccccagca

SEQ ID NO: 3408965 - DNA, 22 bp, Homo sapiens
tgtctccaaccccccagcactg

SEQ ID NO: 3408966 - DNA, 11 bp, Homo sapiens
tgtctcctggc

SEQ ID NO: 3408967 - DNA, 21 bp, Homo sapiens
tgtctcctggcggttcctcgt

SEQ ID NO: 3408968 - DNA, 14 bp, Homo sapiens
tgtctctgacaaag

SEQ ID NO: 3408969 - DNA, 13 bp, Homo sapiens
tgtctctgtgaga

SEQ ID NO: 3408970 - DNA, 13 bp, Homo sapiens
tgtctgcaacatg

SEQ ID NO: 3408971 - DNA, 16 bp, Homo sapiens
tgtctgcaacatggat

SEQ ID NO: 3408972 - DNA, 22 bp, Homo sapiens
tgtctgcaacatggattccaaa

SEQ ID NO: 3408973 - DNA, 14 bp, Homo sapiens
tgtctgtgttgctt

SEQ ID NO: 3408974 - DNA, 22 bp, Homo sapiens
tgtctgtttatatattgaaagt

SEQ ID NO: 3408975 - DNA, 19 bp, Homo sapiens
tgtctttcagatacatggt

SEQ ID NO: 3408976 - DNA, 20 bp, Homo sapiens
tgtctttcagatacatggtt

SEQ ID NO: 3408977 - DNA, 14 bp, Homo sapiens
tgtctttctttgct

SEQ ID NO: 3408978 - DNA, 15 bp, Homo sapiens
tgtctttctttgctg

SEQ ID NO: 3408979 - DNA, 20 bp, Homo sapiens
tgtgaaaccttttttaagat

SEQ ID NO: 3408980 - DNA, 14 bp, Homo sapiens
tgtgaaatgaaaac

SEQ ID NO: 3408981 - DNA, 13 bp, Homo sapiens
tgtgagaaaggaa

SEQ ID NO: 3408982 - DNA, 12 bp, Homo sapiens
tgtgagcttttt

SEQ ID NO: 3408983 - DNA, 14 bp, Homo sapiens
tgtgagctttttgt

SEQ ID NO: 3408984 - DNA, 20 bp, Homo sapiens
tgtgagctttttgttccctc

SEQ ID NO: 3408985 - DNA, 22 bp, Homo sapiens
tgtgatattgaccatgtgatta

SEQ ID NO: 3408986 - DNA, 11 bp, Homo sapiens
tgtgatgtgtc

SEQ ID NO: 3408987 - DNA, 20 bp, Homo sapiens
tgtgatgttgggaagctatt

SEQ ID NO: 3408988 - DNA, 24 bp, Homo sapiens
tgtgcaactcttgtattgctccat

SEQ ID NO: 3408989 - DNA, 14 bp, Homo sapiens
tgtgcacaaagtgg

SEQ ID NO: 3408990 - DNA, 18 bp, Homo sapiens
tgtgcagtgttagtattc

SEQ ID NO: 3408991 - DNA, 16 bp, Homo sapiens
tgtgcataatggaaag

SEQ ID NO: 3408992 - DNA, 20 bp, Homo sapiens
tgtgctacaggggccagaag

SEQ ID NO: 3408993 - DNA, 21 bp, Homo sapiens
tgtggaaaggattctaaacag

SEQ ID NO: 3408994 - DNA, 12 bp, Homo sapiens
tgtggaggaagg

SEQ ID NO: 3408995 - DNA, 12 bp, Homo sapiens
tgtggccaggct

SEQ ID NO: 3408996 - DNA, 16 bp, Homo sapiens
tgtggccatatatgct

SEQ ID NO: 3408997 - DNA, 23 bp, Homo sapiens
tgtggccatatatgctgtatttc

SEQ ID NO: 3408998 - DNA, 13 bp, Homo sapiens
tgtggcctatgaa

SEQ ID NO: 3408999 - DNA, 14 bp, Homo sapiens
tgtgggagtgtgta

SEQ ID NO: 3409000 - DNA, 14 bp, Homo sapiens
tgtgggtctgtgtg

SEQ ID NO: 3409001 - DNA, 20 bp, Homo sapiens
tgtgggtctgtgtgtgtgta

SEQ ID NO: 3409002 - DNA, 14 bp, Homo sapiens
tgtggttaatgcca

SEQ ID NO: 3409003 - DNA, 13 bp, Homo sapiens
tgtggtttttagt

SEQ ID NO: 3409004 - DNA, 18 bp, Homo sapiens
tgtgtaatttaaaattgt

SEQ ID NO: 3409005 - DNA, 16 bp, Homo sapiens
tgtgtagagttaagaa

SEQ ID NO: 3409006 - DNA, 19 bp, Homo sapiens
tgtgtagagttaagaagct

SEQ ID NO: 3409007 - DNA, 17 bp, Homo sapiens
tgtgtatatatgtcaaa

SEQ ID NO: 3409008 - DNA, 23 bp, Homo sapiens
tgtgtatgagaagtactttgtgc

SEQ ID NO: 3409009 - DNA, 14 bp, Homo sapiens
tgtgtatgtggggg

SEQ ID NO: 3409010 - DNA, 23 bp, Homo sapiens
tgtgtatgtgggggtctgtgtgt

SEQ ID NO: 3409011 - DNA, 20 bp, Homo sapiens
tgtgtattcttaaaatgcaa

SEQ ID NO: 3409012 - DNA, 19 bp, Homo sapiens
tgtgtatttccagtgcaat

SEQ ID NO: 3409013 - DNA, 15 bp, Homo sapiens
tgtgtctcaaaaata

SEQ ID NO: 3409014 - DNA, 12 bp, Homo sapiens
tgtgtctgagtg

SEQ ID NO: 3409015 - DNA, 18 bp, Homo sapiens
tgtgtgcaactaactgac

SEQ ID NO: 3409016 - DNA, 15 bp, Homo sapiens
tgtgtgggagtgtgt

SEQ ID NO: 3409017 - DNA, 11 bp, Homo sapiens
tgtgtgtatgt

SEQ ID NO: 3409018 - DNA, 20 bp, Homo sapiens
tgtgtgtgggagtgtgtaat

SEQ ID NO: 3409019 - DNA, 14 bp, Homo sapiens
tgtgtgtgtatgtg

SEQ ID NO: 3409020 - DNA, 15 bp, Homo sapiens
tgtgtgtgtgtatga

SEQ ID NO: 3409021 - DNA, 16 bp, Homo sapiens
tgtgtgtgtgtatgtg

SEQ ID NO: 3409022 - DNA, 16 bp, Homo sapiens
tgtgttgcataaacaa

SEQ ID NO: 3409023 - DNA, 23 bp, Homo sapiens
tgtgttgcataaacaatccaaat

SEQ ID NO: 3409024 - DNA, 15 bp, Homo sapiens
tgttaaatttgtaag

SEQ ID NO: 3409025 - DNA, 21 bp, Homo sapiens
tgttaaatttgtaagtttcag

SEQ ID NO: 3409026 - DNA, 18 bp, Homo sapiens
tgttaacagacactgtaa

SEQ ID NO: 3409027 - DNA, 14 bp, Homo sapiens
tgttaaggaaactc

SEQ ID NO: 3409028 - DNA, 15 bp, Homo sapiens
tgttaaggaaactct

SEQ ID NO: 3409029 - DNA, 20 bp, Homo sapiens
tgttaaggaaactcttatct

SEQ ID NO: 3409030 - DNA, 20 bp, Homo sapiens
tgttacaaattttttaattt

SEQ ID NO: 3409031 - DNA, 23 bp, Homo sapiens
tgttacaggcaccgagaatgttg

SEQ ID NO: 3409032 - DNA, 12 bp, Homo sapiens
tgttacattatt

SEQ ID NO: 3409033 - DNA, 14 bp, Homo sapiens
tgttacattattcc

SEQ ID NO: 3409034 - DNA, 15 bp, Homo sapiens
tgttacattattcca

SEQ ID NO: 3409035 - DNA, 15 bp, Homo sapiens
tgttactatctgctt

SEQ ID NO: 3409036 - DNA, 13 bp, Homo sapiens
tgttactgcttct

SEQ ID NO: 3409037 - DNA, 15 bp, Homo sapiens
tgttactgcttctct

SEQ ID NO: 3409038 - DNA, 19 bp, Homo sapiens
tgttactgcttctctttgt

SEQ ID NO: 3409039 - DNA, 18 bp, Homo sapiens
tgttacttaaacatcatt

SEQ ID NO: 3409040 - DNA, 21 bp, Homo sapiens
tgttacttaaacatcattgga

SEQ ID NO: 3409041 - DNA, 14 bp, Homo sapiens
tgttacttgagaag

SEQ ID NO: 3409042 - DNA, 18 bp, Homo sapiens
tgttatgcaaatgagatt

SEQ ID NO: 3409043 - DNA, 18 bp, Homo sapiens
tgttattaatgtttcttc

SEQ ID NO: 3409044 - DNA, 20 bp, Homo sapiens
tgttccaatgccacatactt

SEQ ID NO: 3409045 - DNA, 12 bp, Homo sapiens
tgttcccctcct

SEQ ID NO: 3409046 - DNA, 13 bp, Homo sapiens
tgttcccctcctc

SEQ ID NO: 3409047 - DNA, 17 bp, Homo sapiens
tgttcccctcctccact

SEQ ID NO: 3409048 - DNA, 23 bp, Homo sapiens
tgttccttgcttttatagttgta

SEQ ID NO: 3409049 - DNA, 16 bp, Homo sapiens
tgttctacttgatatt

SEQ ID NO: 3409050 - DNA, 21 bp, Homo sapiens
tgttctgggtgatttctagaa

SEQ ID NO: 3409051 - DNA, 16 bp, Homo sapiens
tgttctgtcccttgcc

SEQ ID NO: 3409052 - DNA, 17 bp, Homo sapiens
ttctctcatctcttagc

SEQ ID NO: 3409053 - DNA, 21 bp, Homo sapiens
ttctgaggacattccaagaca

SEQ ID NO: 3409054 - DNA, 15 bp, Homo sapiens
ttctgataatgtatt

SEQ ID NO: 3409055 - DNA, 14 bp, Homo sapiens
ttctggtgggttga

SEQ ID NO: 3409056 - DNA, 16 bp, Homo sapiens
ttcttaaaatgcaata

SEQ ID NO: 3409057 - DNA, 21 bp, Homo sapiens
ttcttaaaatgcaatatttgt

SEQ ID NO: 3409058 - DNA, 22 bp, Homo sapiens
ttcttaaaatgcaatatttgta

SEQ ID NO: 3409059 - DNA, 13 bp, Homo sapiens
ttcttaaatgttt

SEQ ID NO: 3409060 - DNA, 20 bp, Homo sapiens
ttcttaaatgttttcattgg

SEQ ID NO: 3409061 - DNA, 15 bp, Homo sapiens
ttcttagctttttaa

SEQ ID NO: 3409062 - DNA, 20 bp, Homo sapiens
ttcttagctttttaattgtt

SEQ ID NO: 3409063 - DNA, 14 bp, Homo sapiens
ttcttattcagtga

SEQ ID NO: 3409064 - DNA, 16 bp, Homo sapiens
ttcttggttgttaatt

SEQ ID NO: 3409065 - DNA, 17 bp, Homo sapiens
ttctttccattatgatt

SEQ ID NO: 3409066 - DNA, 20 bp, Homo sapiens
ttctttccattatgattctt

SEQ ID NO: 3409067 - DNA, 21 bp, Homo sapiens
ttctttctagtggtctttgta

SEQ ID NO: 3409068 - DNA, 20 bp, Homo sapiens
ttctttgtagaataaatggt

SEQ ID NO: 3409069 - DNA, 12 bp, Homo sapiens
ttctttgtatca

SEQ ID NO: 3409070 - DNA, 13 bp, Homo sapiens
ttctttgtttcct

SEQ ID NO: 3409071 - DNA, 12 bp, Homo sapiens
ttgaaaaaagaa

SEQ ID NO: 3409072 - DNA, 16 bp, Homo sapiens
ttgaaaaaagaagttt

SEQ ID NO: 3409073 - DNA, 12 bp, Homo sapiens
ttgaaaagctat

SEQ ID NO: 3409074 - DNA, 22 bp, Homo sapiens
ttgaaaagctattagccaggat

SEQ ID NO: 3409075 - DNA, 13 bp, Homo sapiens
ttgaaaatatttt

SEQ ID NO: 3409076 - DNA, 21 bp, Homo sapiens
ttgaaaggcaatttttgagta

SEQ ID NO: 3409077 - DNA, 15 bp, Homo sapiens
ttgaaagttgctttt

SEQ ID NO: 3409078 - DNA, 21 bp, Homo sapiens
ttgaaatttaaaaataaagct

SEQ ID NO: 3409079 - DNA, 18 bp, Homo sapiens
ttgaagaacaaaaggctt

SEQ ID NO: 3409080 - DNA, 16 bp, Homo sapiens
ttgacctgaactctgc

SEQ ID NO: 3409081 - DNA, 21 bp, Homo sapiens
ttgacgaagaaacaaaaaaca

SEQ ID NO: 3409082 - DNA, 17 bp, Homo sapiens
ttgagacagtttcttag

SEQ ID NO: 3409083 - DNA, 19 bp, Homo sapiens
ttgagacagtttcttagct

SEQ ID NO: 3409084 - DNA, 22 bp, Homo sapiens
ttgaggtcaagtaagaagacat

SEQ ID NO: 3409085 - DNA, 18 bp, Homo sapiens
ttgaggtcttttacatac

SEQ ID NO: 3409086 - DNA, 15 bp, Homo sapiens
ttgataacattttgt

SEQ ID NO: 3409087 - DNA, 21 bp, Homo sapiens
ttgataatgttaaatttgtaa

SEQ ID NO: 3409088 - DNA, 22 bp, Homo sapiens
ttgataatgttaaatttgtaag

SEQ ID NO: 3409089 - DNA, 14 bp, Homo sapiens
ttgatatttccttc

SEQ ID NO: 3409090 - DNA, 18 bp, Homo sapiens
ttgatcaacatcttttct

SEQ ID NO: 3409091 - DNA, 22 bp, Homo sapiens
ttgatcaacatcttttcttgcc

SEQ ID NO: 3409092 - DNA, 13 bp, Homo sapiens
ttgatcattcata

SEQ ID NO: 3409093 - DNA, 16 bp, Homo sapiens
ttgatctttgtttaaa

SEQ ID NO: 3409094 - DNA, 13 bp, Homo sapiens
ttgattcacttca

SEQ ID NO: 3409095 - DNA, 18 bp, Homo sapiens
ttgattttaaaaatacat

SEQ ID NO: 3409096 - DNA, 20 bp, Homo sapiens
ttgcacgcgccctttctacc

SEQ ID NO: 3409097 - DNA, 13 bp, Homo sapiens
ttgcagaagttct

SEQ ID NO: 3409098 - DNA, 22 bp, Homo sapiens
ttgcagctcccattctatgtgt

SEQ ID NO: 3409099 - DNA, 17 bp, Homo sapiens
ttgcaggggtccctgct

SEQ ID NO: 3409100 - DNA, 15 bp, Homo sapiens
ttgcatttggtcaag

SEQ ID NO: 3409101 - DNA, 19 bp, Homo sapiens
ttgccaagctaatctgcct

SEQ ID NO: 3409102 - DNA, 21 bp, Homo sapiens
ttgccaagctaatctgcctgg

SEQ ID NO: 3409103 - DNA, 14 bp, Homo sapiens
ttgcccccctggcc

SEQ ID NO: 3409104 - DNA, 19 bp, Homo sapiens
ttgcctctgtccccttctc

SEQ ID NO: 3409105 - DNA, 20 bp, Homo sapiens
ttgcctctgtccccttctct

SEQ ID NO: 3409106 - DNA, 14 bp, Homo sapiens
ttgctgttactgct

SEQ ID NO: 3409107 - DNA, 21 bp, Homo sapiens
ttgcttttgaaggaatacaat

SEQ ID NO: 3409108 - DNA, 23 bp, Homo sapiens
ttgcttttgaaggaatacaatat

SEQ ID NO: 3409109 - DNA, 13 bp, Homo sapiens
ttggaaaagaaat

SEQ ID NO: 3409110 - DNA, 14 bp, Homo sapiens
ttggaaaagaaatc

SEQ ID NO: 3409111 - DNA, 19 bp, Homo sapiens
ttggaaaagaaatcaattt

SEQ ID NO: 3409112 - DNA, 16 bp, Homo sapiens
ttggacagaagcagct

SEQ ID NO: 3409113 - DNA, 17 bp, Homo sapiens
ttggagcattaactaaa

SEQ ID NO: 3409114 - DNA, 19 bp, Homo sapiens
ttggattatttaataacat

SEQ ID NO: 3409115 - DNA, 11 bp, Homo sapiens
ttggcagctct

SEQ ID NO: 3409116 - DNA, 17 bp, Homo sapiens
ttggcataatttgtctt

SEQ ID NO: 3409117 - DNA, 15 bp, Homo sapiens
ttggccctcctcagc

SEQ ID NO: 3409118 - DNA, 19 bp, Homo sapiens
ttggccctcctcagctccc

SEQ ID NO: 3409119 - DNA, 20 bp, Homo sapiens
ttggccctcctcagctccct

SEQ ID NO: 3409120 - DNA, 21 bp, Homo sapiens
ttggccttcgattttaaatat

SEQ ID NO: 3409121 - DNA, 18 bp, Homo sapiens
ttggctgagggattctat

SEQ ID NO: 3409122 - DNA, 15 bp, Homo sapiens
ttggcttgctgttta

SEQ ID NO: 3409123 - DNA, 19 bp, Homo sapiens
ttgggaagctatttccttt

SEQ ID NO: 3409124 - DNA, 22 bp, Homo sapiens
ttgggatcgcattgcatacctt

SEQ ID NO: 3409125 - DNA, 23 bp, Homo sapiens
ttgggtgtaacaggtctcctctt

SEQ ID NO: 3409126 - DNA, 17 bp, Homo sapiens
ttggtcttactttgtgc

SEQ ID NO: 3409127 - DNA, 18 bp, Homo sapiens
ttggtcttactttgtgca

SEQ ID NO: 3409128 - DNA, 12 bp, Homo sapiens
ttggtgcattcg

SEQ ID NO: 3409129 - DNA, 16 bp, Homo sapiens
ttggttaatcagtgtt

SEQ ID NO: 3409130 - DNA, 14 bp, Homo sapiens
ttggttcagttttt

SEQ ID NO: 3409131 - DNA, 13 bp, Homo sapiens
ttggttgtatata

SEQ ID NO: 3409132 - DNA, 15 bp, Homo sapiens
ttggttgtatataaa

SEQ ID NO: 3409133 - DNA, 14 bp, Homo sapiens
ttggttttgttccc

SEQ ID NO: 3409134 - DNA, 20 bp, Homo sapiens
ttgtaaaaaaaaatgccttt

SEQ ID NO: 3409135 - DNA, 19 bp, Homo sapiens
ttgtaaatttatgtgatgg

SEQ ID NO: 3409136 - DNA, 22 bp, Homo sapiens
ttgtaagagtgtagaagcattc

SEQ ID NO: 3409137 - DNA, 19 bp, Homo sapiens
ttgtacacaccttatattt

SEQ ID NO: 3409138 - DNA, 17 bp, Homo sapiens
ttgtacatttatgattt

SEQ ID NO: 3409139 - DNA, 20 bp, Homo sapiens
ttgtacatttatgatttaat

SEQ ID NO: 3409140 - DNA, 23 bp, Homo sapiens
ttgtacatttatgatttaataaa

SEQ ID NO: 3409141 - DNA, 22 bp, Homo sapiens
ttgtacattttggatttcttta

SEQ ID NO: 3409142 - DNA, 23 bp, Homo sapiens
ttgtataccatgatgcatggagt

SEQ ID NO: 3409143 - DNA, 14 bp, Homo sapiens
ttgtatctcttttg

SEQ ID NO: 3409144 - DNA, 14 bp, Homo sapiens
ttgtatgtattaaa

SEQ ID NO: 3409145 - DNA, 15 bp, Homo sapiens
ttgtattgctgtcct

SEQ ID NO: 3409146 - DNA, 12 bp, Homo sapiens
ttgtattgcttc

SEQ ID NO: 3409147 - DNA, 17 bp, Homo sapiens
ttgtcaatggaagaaac

SEQ ID NO: 3409148 - DNA, 18 bp, Homo sapiens
ttgtcaatggaagaaacc

SEQ ID NO: 3409149 - DNA, 18 bp, Homo sapiens
ttgtccattattcatttt

SEQ ID NO: 3409150 - DNA, 11 bp, Homo sapiens
ttgtctttctt

SEQ ID NO: 3409151 - DNA, 13 bp, Homo sapiens
ttgtctttctttg

SEQ ID NO: 3409152 - DNA, 15 bp, Homo sapiens
ttgtgaatggattgg

SEQ ID NO: 3409153 - DNA, 21 bp, Homo sapiens
ttgtgaatggattggattatt

SEQ ID NO: 3409154 - DNA, 15 bp, Homo sapiens
ttgtgagctttttgt

SEQ ID NO: 3409155 - DNA, 18 bp, Homo sapiens
ttgtgcaaaagcaggctt

SEQ ID NO: 3409156 - DNA, 18 bp, Homo sapiens
ttgtgcagtgttagtatt

SEQ ID NO: 3409157 - DNA, 17 bp, Homo sapiens
ttgtgcccttgtatagt

SEQ ID NO: 3409158 - DNA, 21 bp, Homo sapiens
ttgtgtaatctaagtatatgt

SEQ ID NO: 3409159 - DNA, 11 bp, Homo sapiens
ttgtgtattga

SEQ ID NO: 3409160 - DNA, 16 bp, Homo sapiens
ttgtgtgtgggagtgt

SEQ ID NO: 3409161 - DNA, 20 bp, Homo sapiens
ttgttaacagacactgtaaa

SEQ ID NO: 3409162 - DNA, 14 bp, Homo sapiens
ttgttattaatgtt

SEQ ID NO: 3409163 - DNA, 18 bp, Homo sapiens
ttgttattaatgtttctt

SEQ ID NO: 3409164 - DNA, 12 bp, Homo sapiens
tttttgctaatt

SEQ ID NO: 3409165 - DNA, 15 bp, Homo sapiens
tttttgtgtatttgt

SEQ ID NO: 3409166 - DNA, 12 bp, Homo sapiens
ttttttaagtga

SEQ ID NO: 3409167 - DNA, 12 bp, Homo sapiens
tttttttcagta

SEQ ID NO: 3409168 - DNA, 14 bp, Homo sapiens
aaaaagaagtttgg

SEQ ID NO: 3409169 - DNA, 18 bp, Homo sapiens
aaaaagattgtattgctg

SEQ ID NO: 3409170 - DNA, 13 bp, Homo sapiens
aaaaagcagctac

SEQ ID NO: 3409171 - DNA, 23 bp, Homo sapiens
aaaaagttttgccctttttaagg

SEQ ID NO: 3409172 - DNA, 13 bp, Homo sapiens
aaaaataaagcta

SEQ ID NO: 3409173 - DNA, 15 bp, Homo sapiens
aaaaataaagctact

SEQ ID NO: 3409174 - DNA, 17 bp, Homo sapiens
aaaaatacatttttgtt

SEQ ID NO: 3409175 - DNA, 18 bp, Homo sapiens
aaaaatatatgttgaatg

SEQ ID NO: 3409176 - DNA, 15 bp, Homo sapiens
aaaaatgcctttgag

SEQ ID NO: 3409177 - DNA, 20 bp, Homo sapiens
aaaaatgcctttgagacagt

SEQ ID NO: 3409178 - DNA, 22 bp, Homo sapiens
aaaaatgcctttgagacagttt

SEQ ID NO: 3409179 - DNA, 19 bp, Homo sapiens
aaaaattaaattctctcta

SEQ ID NO: 3409180 - DNA, 15 bp, Homo sapiens
aaaaatttttttgtt

SEQ ID NO: 3409181 - DNA, 19 bp, Homo sapiens
aaaacaattggttgtatat

SEQ ID NO: 3409182 - DNA, 14 bp, Homo sapiens
aaaactttaaagat

SEQ ID NO: 3409183 - DNA, 13 bp, Homo sapiens
aaaagaaatcaat

SEQ ID NO: 3409184 - DNA, 18 bp, Homo sapiens
aaaagaaggaaaaataag

SEQ ID NO: 3409185 - DNA, 23 bp, Homo sapiens
aaaagaagtttgggctaacattt

SEQ ID NO: 3409186 - DNA, 22 bp, Homo sapiens
aaaagatattttatttctgatg

SEQ ID NO: 3409187 - DNA, 17 bp, Homo sapiens
aaaagattgtattgctg

SEQ ID NO: 3409188 - DNA, 20 bp, Homo sapiens
aaaagctattagccaggatc

SEQ ID NO: 3409189 - DNA, 13 bp, Homo sapiens
aaaagctgtgtct

SEQ ID NO: 3409190 - DNA, 15 bp, Homo sapiens
aaaaggaagactaga

SEQ ID NO: 3409191 - DNA, 16 bp, Homo sapiens
aaaaggacacctttta

SEQ ID NO: 3409192 - DNA, 16 bp, Homo sapiens
aaaagtcattattcct

SEQ ID NO: 3409193 - DNA, 12 bp, Homo sapiens
aaaagtttgtcc

SEQ ID NO: 3409194 - DNA, 23 bp, Homo sapiens
aaaagtttgtcctttaactatca

SEQ ID NO: 3409195 - DNA, 12 bp, Homo sapiens
aaaataaagcta

SEQ ID NO: 3409196 - DNA, 14 bp, Homo sapiens
aaaataaagctact

SEQ ID NO: 3409197 - DNA, 21 bp, Homo sapiens
aaaataatctatattaaatga

SEQ ID NO: 3409198 - DNA, 16 bp, Homo sapiens
aaaatacctcaggaaa

SEQ ID NO: 3409199 - DNA, 18 bp, Homo sapiens
aaaatacctcaggaaaga

SEQ ID NO: 3409200 - DNA, 15 bp, Homo sapiens
aaaatatctttgcat

SEQ ID NO: 3409201 - DNA, 19 bp, Homo sapiens
aaaatattcttctttgata

SEQ ID NO: 3409202 - DNA, 18 bp, Homo sapiens
aaaatattttacccaaat

SEQ ID NO: 3409203 - DNA, 22 bp, Homo sapiens
aaaatcattgattgtcagctac

SEQ ID NO: 3409204 - DNA, 19 bp, Homo sapiens
aaaatcttcagctggtgga

SEQ ID NO: 3409205 - DNA, 18 bp, Homo sapiens
aaaatgcaacaacatgta

SEQ ID NO: 3409206 - DNA, 11 bp, Homo sapiens
aaaatgcaata

SEQ ID NO: 3409207 - DNA, 15 bp, Homo sapiens
aaaatgcaatatttg

SEQ ID NO: 3409208 - DNA, 21 bp, Homo sapiens
aaaatgtgtctgcaacatgga

SEQ ID NO: 3409209 - DNA, 23 bp, Homo sapiens
aaaatgtgtgtattcttaaaatg

SEQ ID NO: 3409210 - DNA, 13 bp, Homo sapiens
aaaattatttgca

SEQ ID NO: 3409211 - DNA, 14 bp, Homo sapiens
aaaatttcacagtt

SEQ ID NO: 3409212 - DNA, 14 bp, Homo sapiens
aaaattttttactt

SEQ ID NO: 3409213 - DNA, 13 bp, Homo sapiens
aaacaaaatttca

SEQ ID NO: 3409214 - DNA, 17 bp, Homo sapiens
aaacaaaatttcacagt

SEQ ID NO: 3409215 - DNA, 17 bp, Homo sapiens
aaacaattggttgtata

SEQ ID NO: 3409216 - DNA, 19 bp, Homo sapiens
aaacaattggttgtatata

SEQ ID NO: 3409217 - DNA, 20 bp, Homo sapiens
aaacaatttaaattgttata

SEQ ID NO: 3409218 - DNA, 15 bp, Homo sapiens
aaacagtgtttatga

SEQ ID NO: 3409219 - DNA, 21 bp, Homo sapiens
aaacatcattggataaatttg

SEQ ID NO: 3409220 - DNA, 19 bp, Homo sapiens
aaacatctgtgtctgtgtc

SEQ ID NO: 3409221 - DNA, 13 bp, Homo sapiens
aaacatgaaaaca

SEQ ID NO: 3409222 - DNA, 15 bp, Homo sapiens
aaacatgctgtttat

SEQ ID NO: 3409223 - DNA, 23 bp, Homo sapiens
aaacatgtgcaactcttgtattg

SEQ ID NO: 3409224 - DNA, 13 bp, Homo sapiens
aaaccctcgaggc

SEQ ID NO: 3409225 - DNA, 13 bp, Homo sapiens
aaaccgtccctga

SEQ ID NO: 3409226 - DNA, 12 bp, Homo sapiens
aaacctgcattt

SEQ ID NO: 3409227 - DNA, 14 bp, Homo sapiens
aaaccttgtttctt

SEQ ID NO: 3409228 - DNA, 18 bp, Homo sapiens
aaaccttttttaagattt

SEQ ID NO: 3409229 - DNA, 20 bp, Homo sapiens
aaactaacagataagcaaga

SEQ ID NO: 3409230 - DNA, 20 bp, Homo sapiens
aaactaactaataaaatata

SEQ ID NO: 3409231 - DNA, 19 bp, Homo sapiens
aaactaccagtgggcatgt

SEQ ID NO: 3409232 - DNA, 23 bp, Homo sapiens
aacctgcatttttaaaggacaaa

SEQ ID NO: 3409233 - DNA, 14 bp, Homo sapiens
aacgttttcttaaa

SEQ ID NO: 3409234 - DNA, 21 bp, Homo sapiens
aactaaggaaccctggaaact

SEQ ID NO: 3409235 - DNA, 15 bp, Homo sapiens
aactacaaacaaaat

SEQ ID NO: 3409236 - DNA, 14 bp, Homo sapiens
aactacatctgcct

SEQ ID NO: 3409237 - DNA, 18 bp, Homo sapiens
aactagcttggaaactgg

SEQ ID NO: 3409238 - DNA, 12 bp, Homo sapiens
aactcaatattt

SEQ ID NO: 3409239 - DNA, 13 bp, Homo sapiens
aactcaatatttt

SEQ ID NO: 3409240 - DNA, 14 bp, Homo sapiens
aactcaatattttc

SEQ ID NO: 3409241 - DNA, 20 bp, Homo sapiens
aactcaatattttccatgaa

SEQ ID NO: 3409242 - DNA, 21 bp, Homo sapiens
aactcaatattttccatgaaa

SEQ ID NO: 3409243 - DNA, 17 bp, Homo sapiens
aactcacctaatgttta

SEQ ID NO: 3409244 - DNA, 21 bp, Homo sapiens
aactcacctaatgtttatgag

SEQ ID NO: 3409245 - DNA, 20 bp, Homo sapiens
aactcccccaccgcccactc

SEQ ID NO: 3409246 - DNA, 15 bp, Homo sapiens
aactctaatagtgct

SEQ ID NO: 3409247 - DNA, 15 bp, Homo sapiens
aactctactgtgtaa

SEQ ID NO: 3409248 - DNA, 13 bp, Homo sapiens
aactcttgtattg

SEQ ID NO: 3409249 - DNA, 14 bp, Homo sapiens
aactcttgtattgc

SEQ ID NO: 3409250 - DNA, 14 bp, Homo sapiens
aactgcaggaagag

SEQ ID NO: 3409251 - DNA, 18 bp, Homo sapiens
aactgctttattttccct

SEQ ID NO: 3409252 - DNA, 15 bp, Homo sapiens
aactggtttataata

SEQ ID NO: 3409253 - DNA, 19 bp, Homo sapiens
aactggtttataataaact

SEQ ID NO: 3409254 - DNA, 20 bp, Homo sapiens
aactgtaaaaaatgtgtgta

SEQ ID NO: 3409255 - DNA, 16 bp, Homo sapiens
aactgtatttcagtat

SEQ ID NO: 3409256 - DNA, 22 bp, Homo sapiens
aacttaaaagcaagatctacta

SEQ ID NO: 3409257 - DNA, 13 bp, Homo sapiens
aacttcaaatttt

SEQ ID NO: 3409258 - DNA, 22 bp, Homo sapiens
aacttgattgttgagacgcctt

SEQ ID NO: 3409259 - DNA, 23 bp, Homo sapiens
aactttaacaggttttcttctaa

SEQ ID NO: 3409260 - DNA, 23 bp, Homo sapiens
aactttttgttaacagacactgt

SEQ ID NO: 3409261 - DNA, 19 bp, Homo sapiens
aagaaaatgaatttgactg

SEQ ID NO: 3409262 - DNA, 14 bp, Homo sapiens
aagaaacaatttaa

SEQ ID NO: 3409263 - DNA, 21 bp, Homo sapiens
aagaaacccttccacgtgtat

SEQ ID NO: 3409264 - DNA, 14 bp, Homo sapiens
aagaaatcaatttt

SEQ ID NO: 3409265 - DNA, 17 bp, Homo sapiens
aagaaatcgccttatga

SEQ ID NO: 3409266 - DNA, 19 bp, Homo sapiens
aagaaatcgccttatgaga

SEQ ID NO: 3409267 - DNA, 15 bp, Homo sapiens
aagaaccgcattttg

SEQ ID NO: 3409268 - DNA, 18 bp, Homo sapiens
aagaacggggctcttctc

SEQ ID NO: 3409269 - DNA, 21 bp, Homo sapiens
aagaactacaaacaaaatttc

SEQ ID NO: 3409270 - DNA, 14 bp, Homo sapiens
aagaagaaataaat

SEQ ID NO: 3409271 - DNA, 12 bp, Homo sapiens
aagaagacatga

SEQ ID NO: 3409272 - DNA, 16 bp, Homo sapiens
aagaagctgttgtaca

SEQ ID NO: 3409273 - DNA, 18 bp, Homo sapiens
aagaagctgttgtacatt

SEQ ID NO: 3409274 - DNA, 19 bp, Homo sapiens
aagaagctgttgtacattt

SEQ ID NO: 3409275 - DNA, 22 bp, Homo sapiens
aagaagctgttgtacatttatg

SEQ ID NO: 3409276 - DNA, 18 bp, Homo sapiens
aagaattaaattgattat

SEQ ID NO: 3409277 - DNA, 20 bp, Homo sapiens
aagacaccagagcagatgca

SEQ ID NO: 3409278 - DNA, 22 bp, Homo sapiens
aagacaccagagcagatgcaga

SEQ ID NO: 3409279 - DNA, 16 bp, Homo sapiens
aagacagagctgggat

SEQ ID NO: 3409280 - DNA, 22 bp, Homo sapiens
aagacagcttctcatcctgcag

SEQ ID NO: 3409281 - DNA, 14 bp, Homo sapiens
aagacataacgttt

SEQ ID NO: 3409282 - DNA, 18 bp, Homo sapiens
aagacataacgtttttcc

SEQ ID NO: 3409283 - DNA, 13 bp, Homo sapiens
aagacatctgcct

SEQ ID NO: 3409284 - DNA, 13 bp, Homo sapiens
aagacatgaacca

SEQ ID NO: 3409285 - DNA, 20 bp, Homo sapiens
aagactagaggcttgcataa

SEQ ID NO: 3409286 - DNA, 13 bp, Homo sapiens
aagagacaaactg

SEQ ID NO: 3409287 - DNA, 11 bp, Homo sapiens
aagagctgagg

SEQ ID NO: 3409288 - DNA, 15 bp, Homo sapiens
aagaggccaatgccc

SEQ ID NO: 3409289 - DNA, 14 bp, Homo sapiens
aagaggtaagagca

SEQ ID NO: 3409290 - DNA, 12 bp, Homo sapiens
aagaggttttat

SEQ ID NO: 3409291 - DNA, 21 bp, Homo sapiens
aagagtctacccgacataagt

SEQ ID NO: 3409292 - DNA, 13 bp, Homo sapiens
aagagtgtagaag

SEQ ID NO: 3409293 - DNA, 14 bp, Homo sapiens
aagagtgtagaagc

SEQ ID NO: 3409294 - DNA, 17 bp, Homo sapiens
aagatactcaagcaggt

SEQ ID NO: 3409295 - DNA, 15 bp, Homo sapiens
aagatattttatttc

SEQ ID NO: 3409296 - DNA, 20 bp, Homo sapiens
aagatccaaatgctgtgcaa

SEQ ID NO: 3409297 - DNA, 21 bp, Homo sapiens
aagatccaaatgctgtgcaaa

SEQ ID NO: 3409298 - DNA, 13 bp, Homo sapiens
aagatcttgcaga

SEQ ID NO: 3409299 - DNA, 17 bp, Homo sapiens
aagatgaacagactgac

SEQ ID NO: 3409300 - DNA, 21 bp, Homo sapiens
aagatttttctcaaagttttg

SEQ ID NO: 3409301 - DNA, 18 bp, Homo sapiens
aagcaagatctactacat

SEQ ID NO: 3409302 - DNA, 13 bp, Homo sapiens
aagcactgctgtg

SEQ ID NO: 3409303 - DNA, 17 bp, Homo sapiens
aagcaggtttcttgctt

SEQ ID NO: 3409304 - DNA, 20 bp, Homo sapiens
aagcaggtttcttgcttctg

SEQ ID NO: 3409305 - DNA, 13 bp, Homo sapiens
aagcatgaaaaag

SEQ ID NO: 3409306 - DNA, 17 bp, Homo sapiens
aagcattccttctttga

SEQ ID NO: 3409307 - DNA, 15 bp, Homo sapiens
agccagggagagccc

SEQ ID NO: 3409308 - DNA, 18 bp, Homo sapiens
agccagggagagcccagg

SEQ ID NO: 3409309 - DNA, 15 bp, Homo sapiens
agccagtcattgtaa

SEQ ID NO: 3409310 - DNA, 19 bp, Homo sapiens
agccattttgtgaatggat

SEQ ID NO: 3409311 - DNA, 17 bp, Homo sapiens
agcccaacacacactcg

SEQ ID NO: 3409312 - DNA, 14 bp, Homo sapiens
agcccagaggaggg

SEQ ID NO: 3409313 - DNA, 15 bp, Homo sapiens
agcccagaggagggc

SEQ ID NO: 3409314 - DNA, 18 bp, Homo sapiens
agcccagaggtaacagaa

SEQ ID NO: 3409315 - DNA, 21 bp, Homo sapiens
agcccagaggtaacagaacag

SEQ ID NO: 3409316 - DNA, 12 bp, Homo sapiens
agcccaggagct

SEQ ID NO: 3409317 - DNA, 19 bp, Homo sapiens
agcccaggagctcccctcc

SEQ ID NO: 3409318 - DNA, 13 bp, Homo sapiens
agcccaggccagg

SEQ ID NO: 3409319 - DNA, 19 bp, Homo sapiens
agcccaggccaggactctg

SEQ ID NO: 3409320 - DNA, 22 bp, Homo sapiens
agcccaggccaggactctgcag

SEQ ID NO: 3409321 - DNA, 18 bp, Homo sapiens
agccccaccccagggcag

SEQ ID NO: 3409322 - DNA, 12 bp, Homo sapiens
agccctcccact

SEQ ID NO: 3409323 - DNA, 18 bp, Homo sapiens
agccctgttggcagctct

SEQ ID NO: 3409324 - DNA, 14 bp, Homo sapiens
agcccttgggggtc

SEQ ID NO: 3409325 - DNA, 12 bp, Homo sapiens
agcctaggccag

SEQ ID NO: 3409326 - DNA, 13 bp, Homo sapiens
agcctaggccagg

SEQ ID NO: 3409327 - DNA, 23 bp, Homo sapiens
agcctcagagacatcagcccttg

SEQ ID NO: 3409328 - DNA, 21 bp, Homo sapiens
agcctcgagtgcccctgtccc

SEQ ID NO: 3409329 - DNA, 15 bp, Homo sapiens
agcctcgtgtcatct

SEQ ID NO: 3409330 - DNA, 13 bp, Homo sapiens
agcctggctccaa

SEQ ID NO: 3409331 - DNA, 20 bp, Homo sapiens
agcctggctccaaaccctcg

SEQ ID NO: 3409332 - DNA, 22 bp, Homo sapiens
agcctggctccaaaccctcgag

SEQ ID NO: 3409333 - DNA, 14 bp, Homo sapiens
agcctgggaccagg

SEQ ID NO: 3409334 - DNA, 15 bp, Homo sapiens
agcctgggaccaggg

SEQ ID NO: 3409335 - DNA, 16 bp, Homo sapiens
agccttatgtgttaca

SEQ ID NO: 3409336 - DNA, 18 bp, Homo sapiens
agccttatgtgttacatt

SEQ ID NO: 3409337 - DNA, 15 bp, Homo sapiens
agcgaacaaccacag

SEQ ID NO: 3409338 - DNA, 17 bp, Homo sapiens
agcgctcctgccgcaga

SEQ ID NO: 3409339 - DNA, 21 bp, Homo sapiens
agcgctcctgccgcagagctg

SEQ ID NO: 3409340 - DNA, 17 bp, Homo sapiens
agcggacagtggcagga

SEQ ID NO: 3409341 - DNA, 17 bp, Homo sapiens
agcgggagcctccctgc

SEQ ID NO: 3409342 - DNA, 13 bp, Homo sapiens
agctaataataaa

SEQ ID NO: 3409343 - DNA, 19 bp, Homo sapiens
agctaataataaatgcata

SEQ ID NO: 3409344 - DNA, 14 bp, Homo sapiens
agctaatctgcctg

SEQ ID NO: 3409345 - DNA, 23 bp, Homo sapiens
agctaatctgcctggttttattt

SEQ ID NO: 3409346 - DNA, 18 bp, Homo sapiens
agctagtgccaaataatt

SEQ ID NO: 3409347 - DNA, 19 bp, Homo sapiens
agctagtgccaaataattg

SEQ ID NO: 3409348 - DNA, 20 bp, Homo sapiens
agctattagccaggatcatg

SEQ ID NO: 3409349 - DNA, 14 bp, Homo sapiens
agctcaggcagctc

SEQ ID NO: 3409350 - DNA, 14 bp, Homo sapiens
agctcccctcccca

SEQ ID NO: 3409351 - DNA, 15 bp, Homo sapiens
agctccctgcctgtt

SEQ ID NO: 3409352 - DNA, 16 bp, Homo sapiens
agctccctgcctgttt

SEQ ID NO: 3409353 - DNA, 17 bp, Homo sapiens
agctccctgcctgtttc

SEQ ID NO: 3409354 - DNA, 18 bp, Homo sapiens
agctccctgcctgtttcc

SEQ ID NO: 3409355 - DNA, 19 bp, Homo sapiens
agctccctgcctgtttccc

SEQ ID NO: 3409356 - DNA, 20 bp, Homo sapiens
agctccctgcctgtttcccg

SEQ ID NO: 3409357 - DNA, 15 bp, Homo sapiens
agctccctggagccc

SEQ ID NO: 3409358 - DNA, 23 bp, Homo sapiens
agctcctcaactcacctaatgtt

SEQ ID NO: 3409359 - DNA, 14 bp, Homo sapiens
agctcctcccttga

SEQ ID NO: 3409360 - DNA, 13 bp, Homo sapiens
agctcgtttctta

SEQ ID NO: 3409361 - DNA, 18 bp, Homo sapiens
agctctacacaacatgta

SEQ ID NO: 3409362 - DNA, 13 bp, Homo sapiens
agctctatctgca

SEQ ID NO: 3409363 - DNA, 16 bp, Homo sapiens
agctctatctgcaatg

SEQ ID NO: 3409364 - DNA, 10 bp, Homo sapiens
agctctgagc

SEQ ID NO: 3409365 - DNA, 12 bp, Homo sapiens
agctctgagctg

SEQ ID NO: 3409366 - DNA, 13 bp, Homo sapiens
agctctgagctgt

SEQ ID NO: 3409367 - DNA, 22 bp, Homo sapiens
agctgactccagtataatctcc

SEQ ID NO: 3409368 - DNA, 17 bp, Homo sapiens
agctgggatgtttctgt

SEQ ID NO: 3409369 - DNA, 21 bp, Homo sapiens
agctggtggatggtgactttt

SEQ ID NO: 3409370 - DNA, 14 bp, Homo sapiens
agctgtgtctctgt

SEQ ID NO: 3409371 - DNA, 16 bp, Homo sapiens
agctgttgtacattta

SEQ ID NO: 3409372 - DNA, 22 bp, Homo sapiens
agctgttgtacatttatgattt

SEQ ID NO: 3409373 - DNA, 23 bp, Homo sapiens
agctgttgtacatttatgattta

SEQ ID NO: 3409374 - DNA, 15 bp, Homo sapiens
agcttaaagcttgat

SEQ ID NO: 3409375 - DNA, 17 bp, Homo sapiens
agcttagattttctgta

SEQ ID NO: 3409376 - DNA, 18 bp, Homo sapiens
agcttagattttctgtaa

SEQ ID NO: 3409377 - DNA, 23 bp, Homo sapiens
agcttcaggttatcgaaataaca

SEQ ID NO: 3409378 - DNA, 16 bp, Homo sapiens
agcttcctgtctgttt

SEQ ID NO: 3409379 - DNA, 15 bp, Homo sapiens
agcttgatttgatct

SEQ ID NO: 3409380 - DNA, 18 bp, Homo sapiens
agcttgatttgatctttg

SEQ ID NO: 3409381 - DNA, 19 bp, Homo sapiens
agcttgatttgatctttgt

SEQ ID NO: 3409382 - DNA, 14 bp, Homo sapiens
agctttatctttgt

SEQ ID NO: 3409383 - DNA, 16 bp, Homo sapiens
agctttatctttgtgt

SEQ ID NO: 3409384 - DNA, 23 bp, Homo sapiens
agctttatctttgtgtaatctaa

SEQ ID NO: 3409385 - DNA, 14 bp, Homo sapiens
agctttgataatgt

SEQ ID NO: 3409386 - DNA, 11 bp, Homo sapiens
agctttgcagt

SEQ ID NO: 3409387 - DNA, 17 bp, Homo sapiens
agctttttaattgttgt

SEQ ID NO: 3409388 - DNA, 13 bp, Homo sapiens
aggaaactcttat

SEQ ID NO: 3409389 - DNA, 17 bp, Homo sapiens
aggaaactcttatctca

SEQ ID NO: 3409390 - DNA, 12 bp, Homo sapiens
aggaaagaatag

SEQ ID NO: 3409391 - DNA, 18 bp, Homo sapiens
aggaacagttaccctgct

SEQ ID NO: 3409392 - DNA, 16 bp, Homo sapiens
aggaacctaattgaaa

SEQ ID NO: 3409393 - DNA, 20 bp, Homo sapiens
aggaagagaggacccatcct

SEQ ID NO: 3409394 - DNA, 14 bp, Homo sapiens
aggaaggagctgcc

SEQ ID NO: 3409395 - DNA, 16 bp, Homo sapiens
aggaaggagctgcctg

SEQ ID NO: 3409396 - DNA, 18 bp, Homo sapiens
aggaaggagctgcctgga

SEQ ID NO: 3409397 - DNA, 19 bp, Homo sapiens
aggaaggagctgcctggac

SEQ ID NO: 3409398 - DNA, 21 bp, Homo sapiens
aggaaggagctgcctggaccc

SEQ ID NO: 3409399 - DNA, 14 bp, Homo sapiens
aggaaggattgtaa

SEQ ID NO: 3409400 - DNA, 17 bp, Homo sapiens
aggaaggattgtaaaaa

SEQ ID NO: 3409401 - DNA, 18 bp, Homo sapiens
aggaaggattgtaaaaaa

SEQ ID NO: 3409402 - DNA, 20 bp, Homo sapiens
aggaatatgacggaagaaca

SEQ ID NO: 3409403 - DNA, 22 bp, Homo sapiens
aggaatatgacggaagaacata

SEQ ID NO: 3409404 - DNA, 16 bp, Homo sapiens
accaattaagtgttga

SEQ ID NO: 3409405 - DNA, 16 bp, Homo sapiens
accacctttgtctctg

SEQ ID NO: 3409406 - DNA, 17 bp, Homo sapiens
accacctttgtctctgc

SEQ ID NO: 3409407 - DNA, 20 bp, Homo sapiens
accacctttgtttctccccc

SEQ ID NO: 3409408 - DNA, 22 bp, Homo sapiens
accacctttgtttctcccccat

SEQ ID NO: 3409409 - DNA, 22 bp, Homo sapiens
accactaatgcttgccaagaaa

SEQ ID NO: 3409410 - DNA, 20 bp, Homo sapiens
accactttttgcagctttct

SEQ ID NO: 3409411 - DNA, 13 bp, Homo sapiens
accagcctggccc

SEQ ID NO: 3409412 - DNA, 13 bp, Homo sapiens
accaggatttata

SEQ ID NO: 3409413 - DNA, 19 bp, Homo sapiens
accaggcttgcctgcaggc

SEQ ID NO: 3409414 - DNA, 22 bp, Homo sapiens
accagggcatattaaaggcttt

SEQ ID NO: 3409415 - DNA, 22 bp, Homo sapiens
accagttgaactgcaggaagag

SEQ ID NO: 3409416 - DNA, 18 bp, Homo sapiens
accatataactgtgatga

SEQ ID NO: 3409417 - DNA, 23 bp, Homo sapiens
accatgttggttgcactttgtag

SEQ ID NO: 3409418 - DNA, 15 bp, Homo sapiens
accattataccagca

SEQ ID NO: 3409419 - DNA, 18 bp, Homo sapiens
accattatgaagaagaga

SEQ ID NO: 3409420 - DNA, 19 bp, Homo sapiens
accattctttcttggtgca

SEQ ID NO: 3409421 - DNA, 15 bp, Homo sapiens
accattgaactgtac

SEQ ID NO: 3409422 - DNA, 15 bp, Homo sapiens
accattttcaatttg

SEQ ID NO: 3409423 - DNA, 15 bp, Homo sapiens
acccaacagtttatt

SEQ ID NO: 3409424 - DNA, 22 bp, Homo sapiens
actgtataaataggagaggatg

SEQ ID NO: 3409425 - DNA, 17 bp, Homo sapiens
actgtatttcagtattt

SEQ ID NO: 3409426 - DNA, 21 bp, Homo sapiens
actgtatttcagtattttcca

SEQ ID NO: 3409427 - DNA, 19 bp, Homo sapiens
actgtcttaaatcagttta

SEQ ID NO: 3409428 - DNA, 12 bp, Homo sapiens
actgtggaggaa

SEQ ID NO: 3409429 - DNA, 16 bp, Homo sapiens
actgtggaggaaggat

SEQ ID NO: 3409430 - DNA, 23 bp, Homo sapiens
actgtggccatatatgctgtatt

SEQ ID NO: 3409431 - DNA, 21 bp, Homo sapiens
actgtgtaatataaaagatct

SEQ ID NO: 3409432 - DNA, 17 bp, Homo sapiens
actgttgatccatctca

SEQ ID NO: 3409433 - DNA, 23 bp, Homo sapiens
actgttgatccatctcagtcact

SEQ ID NO: 3409434 - DNA, 24 bp, Homo sapiens
actgttttaatttatactggcatg

SEQ ID NO: 3409435 - DNA, 10 bp, Homo sapiens
acttaaacat

SEQ ID NO: 3409436 - DNA, 21 bp, Homo sapiens
acttaatattagcttgcttaa

SEQ ID NO: 3409437 - DNA, 17 bp, Homo sapiens
acttagaatgccataaa

SEQ ID NO: 3409438 - DNA, 21 bp, Homo sapiens
acttagaatgccataaaattg

SEQ ID NO: 3409439 - DNA, 16 bp, Homo sapiens
acttctgggtggggca

SEQ ID NO: 3409440 - DNA, 16 bp, Homo sapiens
acttgataatgatttc

SEQ ID NO: 3409441 - DNA, 19 bp, Homo sapiens
actttactgcctgaataaa

SEQ ID NO: 3409442 - DNA, 21 bp, Homo sapiens
actttcatttttttccaggct

SEQ ID NO: 3409443 - DNA, 17 bp, Homo sapiens
actttctttctgtaggt

SEQ ID NO: 3409444 - DNA, 20 bp, Homo sapiens
actttgctgttactgcttct

SEQ ID NO: 3409445 - DNA, 12 bp, Homo sapiens
actttgtgcaaa

SEQ ID NO: 3409446 - DNA, 11 bp, Homo sapiens
actttgtgttt

SEQ ID NO: 3409447 - DNA, 16 bp, Homo sapiens
acttttaaaataaaat

SEQ ID NO: 3409448 - DNA, 21 bp, Homo sapiens
acttttgagtatggctatcta

SEQ ID NO: 3409449 - DNA, 18 bp, Homo sapiens
actttttaaaatgttggt

SEQ ID NO: 3409450 - DNA, 17 bp, Homo sapiens
actttttaaacagtgtt

SEQ ID NO: 3409451 - DNA, 14 bp, Homo sapiens
actttttcccctgc

SEQ ID NO: 3409452 - DNA, 16 bp, Homo sapiens
actttttcccctgcaa

SEQ ID NO: 3409453 - DNA, 14 bp, Homo sapiens
agaaaaaagtgttt

SEQ ID NO: 3409454 - DNA, 23 bp, Homo sapiens
agaaaacaattgttctgggtgat

SEQ ID NO: 3409455 - DNA, 13 bp, Homo sapiens
agaaaatgtgtct

SEQ ID NO: 3409456 - DNA, 14 bp, Homo sapiens
agaaaatgtgtctg

SEQ ID NO: 3409457 - DNA, 16 bp, Homo sapiens
agaaagccaccttgtt

SEQ ID NO: 3409458 - DNA, 22 bp, Homo sapiens
agaaagtctatctaatgacatg

SEQ ID NO: 3409459 - DNA, 13 bp, Homo sapiens
agaaatcaatttt

SEQ ID NO: 3409460 - DNA, 18 bp, Homo sapiens
agaaatcgccttatgaga

SEQ ID NO: 3409461 - DNA, 11 bp, Homo sapiens
agaaatgccag

SEQ ID NO: 3409462 - DNA, 16 bp, Homo sapiens
agaaattaacacccaa

SEQ ID NO: 3409463 - DNA, 15 bp, Homo sapiens
agaacaaaaactatt

SEQ ID NO: 3409464 - DNA, 11 bp, Homo sapiens
agaacagaaat

SEQ ID NO: 3409465 - DNA, 17 bp, Homo sapiens
agaacagaaatatataa

SEQ ID NO: 3409466 - DNA, 12 bp, Homo sapiens
agaacagcttca

SEQ ID NO: 3409467 - DNA, 16 bp, Homo sapiens
agaacagcttcaggtt

SEQ ID NO: 3409468 - DNA, 15 bp, Homo sapiens
agaaccgcattttga

SEQ ID NO: 3409469 - DNA, 20 bp, Homo sapiens
agaacggggctcttctcatt

SEQ ID NO: 3409470 - DNA, 21 bp, Homo sapiens
agaacggggctcttctcattt

SEQ ID NO: 3409471 - DNA, 22 bp, Homo sapiens
agaactacaaacaaaatttcta

SEQ ID NO: 3409472 - DNA, 14 bp, Homo sapiens
agaactttcatttt

SEQ ID NO: 3409473 - DNA, 14 bp, Homo sapiens
agaagaaataaata

SEQ ID NO: 3409474 - DNA, 14 bp, Homo sapiens
agaagaagtgtgtc

SEQ ID NO: 3409475 - DNA, 18 bp, Homo sapiens
agaagacaccagagcaga

SEQ ID NO: 3409476 - DNA, 22 bp, Homo sapiens
agaagacaccagagcagatgca

SEQ ID NO: 3409477 - DNA, 15 bp, Homo sapiens
agaagacatgaacca

SEQ ID NO: 3409478 - DNA, 22 bp, Homo sapiens
agaagagagtccatatttcaat

SEQ ID NO: 3409479 - DNA, 16 bp, Homo sapiens
agaagcatgaaaaagc

SEQ ID NO: 3409480 - DNA, 13 bp, Homo sapiens
agaagcattcctt

SEQ ID NO: 3409481 - DNA, 17 bp, Homo sapiens
agaagcattccttcttt

SEQ ID NO: 3409482 - DNA, 16 bp, Homo sapiens
agaagccacaggcctg

SEQ ID NO: 3409483 - DNA, 17 bp, Homo sapiens
agaagccacaggcctga

SEQ ID NO: 3409484 - DNA, 19 bp, Homo sapiens
agaagccacaggcctgaga

SEQ ID NO: 3409485 - DNA, 21 bp, Homo sapiens
agaagccacaggcctgagatt

SEQ ID NO: 3409486 - DNA, 20 bp, Homo sapiens
agaagctgttgtacatttat

SEQ ID NO: 3409487 - DNA, 23 bp, Homo sapiens
agaagctgttgtacatttatgat

SEQ ID NO: 3409488 - DNA, 21 bp, Homo sapiens
agaaggtccttaatgatccgt

SEQ ID NO: 3409489 - DNA, 14 bp, Homo sapiens
agaagtaagcagag

SEQ ID NO: 3409490 - DNA, 22 bp, Homo sapiens
agaagtgcttaacgttttctta

SEQ ID NO: 3409491 - DNA, 23 bp, Homo sapiens
agaagtgcttaacgttttcttaa

SEQ ID NO: 3409492 - DNA, 21 bp, Homo sapiens
agaagttggtcttactttgtg

SEQ ID NO: 3409493 - DNA, 17 bp, Homo sapiens
agaagttttttactttg

SEQ ID NO: 3409494 - DNA, 20 bp, Homo sapiens
agaataaatggtttctcatt

SEQ ID NO: 3409495 - DNA, 13 bp, Homo sapiens
agaataagaattt

SEQ ID NO: 3409496 - DNA, 17 bp, Homo sapiens
agaatggtggcttcttt

SEQ ID NO: 3409497 - DNA, 19 bp, Homo sapiens
agaatgtcagtatgtggaa

SEQ ID NO: 3409498 - DNA, 15 bp, Homo sapiens
agaatgttgtattca

SEQ ID NO: 3409499 - DNA, 19 bp, Homo sapiens
agaatgttgtattcagtga

SEQ ID NO: 3409500 - DNA, 13 bp, Homo sapiens
agaattccctgtg

SEQ ID NO: 3409501 - DNA, 10 bp, Homo sapiens
agacaaacac

SEQ ID NO: 3409502 - DNA, 21 bp, Homo sapiens
agacaaactgtaaaaaatgtg

SEQ ID NO: 3409503 - DNA, 13 bp, Homo sapiens
agacacaggatga

SEQ ID NO: 3409504 - DNA, 15 bp, Homo sapiens
agacaccagagcaga

SEQ ID NO: 3409505 - DNA, 12 bp, Homo sapiens
agacagagctgg

SEQ ID NO: 3409506 - DNA, 14 bp, Homo sapiens
agacagtatacagt

SEQ ID NO: 3409507 - DNA, 13 bp, Homo sapiens
agacagtttctta

SEQ ID NO: 3409508 - DNA, 14 bp, Homo sapiens
agacagtttcttag

SEQ ID NO: 3409509 - DNA, 17 bp, Homo sapiens
agacataacgtttttcc

SEQ ID NO: 3409510 - DNA, 16 bp, Homo sapiens
agacatcagcccttgg

SEQ ID NO: 3409511 - DNA, 14 bp, Homo sapiens
agacatctgcctgt

SEQ ID NO: 3409512 - DNA, 21 bp, Homo sapiens
agacatttgctatgagctggg

SEQ ID NO: 3409513 - DNA, 15 bp, Homo sapiens
agaccaaaaatcaac

SEQ ID NO: 3409514 - DNA, 21 bp, Homo sapiens
agaccaaattttgaggtcttt

SEQ ID NO: 3409515 - DNA, 21 bp, Homo sapiens
agaccacagggttcaaaatgt

SEQ ID NO: 3409516 - DNA, 15 bp, Homo sapiens
agaccatataactgt

SEQ ID NO: 3409517 - DNA, 19 bp, Homo sapiens
agaccatataactgtgatg

SEQ ID NO: 3409518 - DNA, 17 bp, Homo sapiens
agacctcagatgtgttg

SEQ ID NO: 3409519 - DNA, 19 bp, Homo sapiens
agacctcttcctggaataa

SEQ ID NO: 3409520 - DNA, 21 bp, Homo sapiens
agacctcttcctggaataaac

SEQ ID NO: 3409521 - DNA, 16 bp, Homo sapiens
agacctgcccctccct

SEQ ID NO: 3409522 - DNA, 16 bp, Homo sapiens
agacctgtctcctggc

SEQ ID NO: 3409523 - DNA, 17 bp, Homo sapiens
aatcatttggttaaatc

SEQ ID NO: 3409524 - DNA, 16 bp, Homo sapiens
aatccaaatgcattca

SEQ ID NO: 3409525 - DNA, 15 bp, Homo sapiens
aatccagtagggaaa

SEQ ID NO: 3409526 - DNA, 11 bp, Homo sapiens
aatccatgctt

SEQ ID NO: 3409527 - DNA, 14 bp, Homo sapiens
aatccatgcttcac

SEQ ID NO: 3409528 - DNA, 15 bp, Homo sapiens
aatccatgcttcact

SEQ ID NO: 3409529 - DNA, 16 bp, Homo sapiens
aatcgccttatgagaa

SEQ ID NO: 3409530 - DNA, 18 bp, Homo sapiens
aatcgccttatgagaaca

SEQ ID NO: 3409531 - DNA, 14 bp, Homo sapiens
aatctaagtatatg

SEQ ID NO: 3409532 - DNA, 20 bp, Homo sapiens
aatctaagtatatgtgagaa

SEQ ID NO: 3409533 - DNA, 19 bp, Homo sapiens
aatctccacccaatgaatg

SEQ ID NO: 3409534 - DNA, 21 bp, Homo sapiens
aatctccacccaatgaatgat

SEQ ID NO: 3409535 - DNA, 19 bp, Homo sapiens
aatctgaattttaaaacat

SEQ ID NO: 3409536 - DNA, 22 bp, Homo sapiens
aatctggggaagaggttttatt

SEQ ID NO: 3409537 - DNA, 15 bp, Homo sapiens
aatctgttgtttgaa

SEQ ID NO: 3409538 - DNA, 19 bp, Homo sapiens
aatctgttgtttgaagaac

SEQ ID NO: 3409539 - DNA, 21 bp, Homo sapiens
aatcttagtatagtagaaaga

SEQ ID NO: 3409540 - DNA, 23 bp, Homo sapiens
aatcttcagctggtggatggtga

SEQ ID NO: 3409541 - DNA, 18 bp, Homo sapiens
aatgaagggtcatttctc

SEQ ID NO: 3409542 - DNA, 11 bp, Homo sapiens
aatgacagagc

SEQ ID NO: 3409543 - DNA, 17 bp, Homo sapiens
aatgagatttctttgaa

SEQ ID NO: 3409544 - DNA, 19 bp, Homo sapiens
aatgaggaacaatcacaaa

SEQ ID NO: 3409545 - DNA, 22 bp, Homo sapiens
aatgaggaacaatcacaaaagc

SEQ ID NO: 3409546 - DNA, 16 bp, Homo sapiens
aatgagggtttctgat

SEQ ID NO: 3409547 - DNA, 23 bp, Homo sapiens
aatgagttttacaaattcctttc

SEQ ID NO: 3409548 - DNA, 19 bp, Homo sapiens
aatgatcacatctaaagct

SEQ ID NO: 3409549 - DNA, 21 bp, Homo sapiens
aatgatcacatctaaagcttt

SEQ ID NO: 3409550 - DNA, 22 bp, Homo sapiens
aatgatcacatctaaagcttta

SEQ ID NO: 3409551 - DNA, 23 bp, Homo sapiens
aatgatcacatctaaagctttat

SEQ ID NO: 3409552 - DNA, 13 bp, Homo sapiens
atctgttgtttga

SEQ ID NO: 3409553 - DNA, 23 bp, Homo sapiens
atcttcacttctaaatgcatatc

SEQ ID NO: 3409554 - DNA, 20 bp, Homo sapiens
atcttcagctggtggatggt

SEQ ID NO: 3409555 - DNA, 19 bp, Homo sapiens
atcttggccctcctcagct

SEQ ID NO: 3409556 - DNA, 20 bp, Homo sapiens
atcttggccctcctcagctc

SEQ ID NO: 3409557 - DNA, 22 bp, Homo sapiens
atcttggccctcctcagctccc

SEQ ID NO: 3409558 - DNA, 13 bp, Homo sapiens
atctttcttgatc

SEQ ID NO: 3409559 - DNA, 16 bp, Homo sapiens
atctttgcatcataga

SEQ ID NO: 3409560 - DNA, 14 bp, Homo sapiens
atcttttcttgcct

SEQ ID NO: 3409561 - DNA, 23 bp, Homo sapiens
atcttttcttgcctctgtcccct

SEQ ID NO: 3409562 - DNA, 14 bp, Homo sapiens
atgaaaacctgcat

SEQ ID NO: 3409563 - DNA, 20 bp, Homo sapiens
atgaaagtgatgacatattt

SEQ ID NO: 3409564 - DNA, 13 bp, Homo sapiens
atgaaatattttg

SEQ ID NO: 3409565 - DNA, 17 bp, Homo sapiens
atgaaggtttctgaaaa

SEQ ID NO: 3409566 - DNA, 22 bp, Homo sapiens
atgaatatatggcatttgcaga

SEQ ID NO: 3409567 - DNA, 15 bp, Homo sapiens
atgacaaaagtgaca

SEQ ID NO: 3409568 - DNA, 23 bp, Homo sapiens
atgacaaaatcatctttgtgaag

SEQ ID NO: 3409569 - DNA, 11 bp, Homo sapiens
atgactaaaga

SEQ ID NO: 3409570 - DNA, 13 bp, Homo sapiens
atgactaaagaga

SEQ ID NO: 3409571 - DNA, 15 bp, Homo sapiens
atgactaaagagaga

SEQ ID NO: 3409572 - DNA, 16 bp, Homo sapiens
atgactaaagagagaa

SEQ ID NO: 3409573 - DNA, 21 bp, Homo sapiens
atgactaaagagagaatgtag

SEQ ID NO: 3409574 - DNA, 23 bp, Homo sapiens
atgactaaagagagaatgtagat

SEQ ID NO: 3409575 - DNA, 18 bp, Homo sapiens
atgactaaagtaccagat

SEQ ID NO: 3409576 - DNA, 13 bp, Homo sapiens
atgagaagaatag

SEQ ID NO: 3409577 - DNA, 23 bp, Homo sapiens
atgagaagtactttgtgctgatc

SEQ ID NO: 3409578 - DNA, 13 bp, Homo sapiens
atgagacacagga

SEQ ID NO: 3409579 - DNA, 20 bp, Homo sapiens
atgagagcccagaggtaaca

SEQ ID NO: 3409580 - DNA, 22 bp, Homo sapiens
atgagagcccagaggtaacaga

SEQ ID NO: 3409581 - DNA, 18 bp, Homo sapiens
atgagatgcctgaagcca

SEQ ID NO: 3409582 - DNA, 19 bp, Homo sapiens
atgagattttggaagaagt

SEQ ID NO: 3409583 - DNA, 14 bp, Homo sapiens
atgagccagacaaa

SEQ ID NO: 3409584 - DNA, 20 bp, Homo sapiens
atgaggccctccacacctgc

SEQ ID NO: 3409585 - DNA, 13 bp, Homo sapiens
atgatggaaagga

SEQ ID NO: 3409586 - DNA, 19 bp, Homo sapiens
atgatgtgggtcaaggaat

SEQ ID NO: 3409587 - DNA, 22 bp, Homo sapiens
atgattcaaatatcaaaaggaa

SEQ ID NO: 3409588 - DNA, 20 bp, Homo sapiens
atgattctttgttacaggca

SEQ ID NO: 3409589 - DNA, 13 bp, Homo sapiens
atgattggttcag

SEQ ID NO: 3409590 - DNA, 15 bp, Homo sapiens
atgattggttcagtt

SEQ ID NO: 3409591 - DNA, 13 bp, Homo sapiens
atgatttaataaa

SEQ ID NO: 3409592 - DNA, 14 bp, Homo sapiens
atgatttttgtgta

SEQ ID NO: 3409593 - DNA, 21 bp, Homo sapiens
atgatttttgtgtatccagta

SEQ ID NO: 3409594 - DNA, 14 bp, Homo sapiens
atgcaaaataaaga

SEQ ID NO: 3409595 - DNA, 16 bp, Homo sapiens
atgcaaactgctttat

SEQ ID NO: 3409596 - DNA, 17 bp, Homo sapiens
atgcaaactgctttatt

SEQ ID NO: 3409597 - DNA, 22 bp, Homo sapiens
atgcaaactgctttattttccc

SEQ ID NO: 3409598 - DNA, 17 bp, Homo sapiens
atgcaaatgagatttct

SEQ ID NO: 3409599 - DNA, 18 bp, Homo sapiens
atgcaaatgagatttctt

SEQ ID NO: 3409600 - DNA, 22 bp, Homo sapiens
atgcaaatgagatttctttgaa

SEQ ID NO: 3409601 - DNA, 21 bp, Homo sapiens
atgcaacaacatgtataatat

SEQ ID NO: 3409602 - DNA, 20 bp, Homo sapiens
atgcaagtgggagatgaaaa

SEQ ID NO: 3409603 - DNA, 21 bp, Homo sapiens
atgcaagtgggagatgaaaac

SEQ ID NO: 3409604 - DNA, 15 bp, Homo sapiens
atgcaataaaattat

SEQ ID NO: 3409605 - DNA, 20 bp, Homo sapiens
atgcaataaaattatttgca

SEQ ID NO: 3409606 - DNA, 13 bp, Homo sapiens
atgcaatatttgt

SEQ ID NO: 3409607 - DNA, 14 bp, Homo sapiens
atgcaatatttgta

SEQ ID NO: 3409608 - DNA, 18 bp, Homo sapiens
atgcacgttaacagcgtg

SEQ ID NO: 3409609 - DNA, 16 bp, Homo sapiens
atgcagagagccattt

SEQ ID NO: 3409610 - DNA, 20 bp, Homo sapiens
atgcagagagccattttgtg

SEQ ID NO: 3409611 - DNA, 14 bp, Homo sapiens
atgcaggtctccat

SEQ ID NO: 3409612 - DNA, 21 bp, Homo sapiens
atgcaggtctccatgaagaag

SEQ ID NO: 3409613 - DNA, 21 bp, Homo sapiens
atgcagtgatatggcagaaga

SEQ ID NO: 3409614 - DNA, 21 bp, Homo sapiens
atgcataaatatgcagtgata

SEQ ID NO: 3409615 - DNA, 18 bp, Homo sapiens
atgcatatcctgagccat

SEQ ID NO: 3409616 - DNA, 23 bp, Homo sapiens
atgcatttgaggtcaagtaagaa

SEQ ID NO: 3409617 - DNA, 22 bp, Homo sapiens
atgccatttttagtttaaaatc

SEQ ID NO: 3409618 - DNA, 13 bp, Homo sapiens
atgcctatgtttt

SEQ ID NO: 3409619 - DNA, 21 bp, Homo sapiens
atgcctttgagacagtttctt

SEQ ID NO: 3409620 - DNA, 14 bp, Homo sapiens
atgccttttatttc

SEQ ID NO: 3409621 - DNA, 17 bp, Homo sapiens
atgcgtcttgtgaaatt

SEQ ID NO: 3409622 - DNA, 19 bp, Homo sapiens
atgcgtcttgtgaaattgt

SEQ ID NO: 3409623 - DNA, 12 bp, Homo sapiens
atgctcatgtat

SEQ ID NO: 3409624 - DNA, 16 bp, Homo sapiens
atgctgatatttactg

SEQ ID NO: 3409625 - DNA, 17 bp, Homo sapiens
atgctgtatttctttgt

SEQ ID NO: 3409626 - DNA, 21 bp, Homo sapiens
atgctgtatttctttgtagaa

SEQ ID NO: 3409627 - DNA, 12 bp, Homo sapiens
atgctgtgcaaa

SEQ ID NO: 3409628 - DNA, 17 bp, Homo sapiens
atgctgtgcaaacagtg

SEQ ID NO: 3409629 - DNA, 19 bp, Homo sapiens
atgctgtgcaaacagtgta

SEQ ID NO: 3409630 - DNA, 20 bp, Homo sapiens
atgcttcctgacaatcaact

SEQ ID NO: 3409631 - DNA, 17 bp, Homo sapiens
atgcttgccaagaaatc

SEQ ID NO: 3409632 - DNA, 19 bp, Homo sapiens
atggaaaacgctctctact

SEQ ID NO: 3409633 - DNA, 21 bp, Homo sapiens
atggaaaacgctctctactct

SEQ ID NO: 3409634 - DNA, 20 bp, Homo sapiens
atggaaaaggaagactagag

SEQ ID NO: 3409635 - DNA, 13 bp, Homo sapiens
atggacaatggac

SEQ ID NO: 3409636 - DNA, 20 bp, Homo sapiens
atggacagaagaaggcagca

SEQ ID NO: 3409637 - DNA, 18 bp, Homo sapiens
atggacatcgatatgaaa

SEQ ID NO: 3409638 - DNA, 20 bp, Homo sapiens
atggacatcgatatgaaaaa

SEQ ID NO: 3409639 - DNA, 17 bp, Homo sapiens
atggagactttgctgtt

SEQ ID NO: 3409640 - DNA, 15 bp, Homo sapiens
atggagcaaatgtcc

SEQ ID NO: 3409641 - DNA, 13 bp, Homo sapiens
atggaggaatatg

SEQ ID NO: 3409642 - DNA, 15 bp, Homo sapiens
atggattggattatt

SEQ ID NO: 3409643 - DNA, 22 bp, Homo sapiens
atggatttggttatgatggaaa

SEQ ID NO: 3409644 - DNA, 19 bp, Homo sapiens
atggcagaagacaccagag

SEQ ID NO: 3409645 - DNA, 15 bp, Homo sapiens
atggcagtgtctttc

SEQ ID NO: 3409646 - DNA, 19 bp, Homo sapiens
atggcctgagactttcttt

SEQ ID NO: 3409647 - DNA, 22 bp, Homo sapiens
atggctatctatacctgccttt

SEQ ID NO: 3409648 - DNA, 15 bp, Homo sapiens
atgggacctataact

SEQ ID NO: 3409649 - DNA, 22 bp, Homo sapiens
atgggacctataactgcccagc

SEQ ID NO: 3409650 - DNA, 14 bp, Homo sapiens
atgggtccagaaga

SEQ ID NO: 3409651 - DNA, 14 bp, Homo sapiens
atgggttgcatttg

SEQ ID NO: 3409652 - DNA, 14 bp, Homo sapiens
atggtgacttttga

SEQ ID NO: 3409653 - DNA, 23 bp, Homo sapiens
atggtggcttcttttctttgtat

SEQ ID NO: 3409654 - DNA, 22 bp, Homo sapiens
atggtgtaataagacataacgt

SEQ ID NO: 3409655 - DNA, 22 bp, Homo sapiens
atggtgtagccctcccactttg

SEQ ID NO: 3409656 - DNA, 16 bp, Homo sapiens
atggtgtgtgtctctg

SEQ ID NO: 3409657 - DNA, 18 bp, Homo sapiens
atggtgtgtgtctctgac

SEQ ID NO: 3409658 - DNA, 17 bp, Homo sapiens
atggtttgcaaggaagc

SEQ ID NO: 3409659 - DNA, 17 bp, Homo sapiens
atgtacaaggtatgtac

SEQ ID NO: 3409660 - DNA, 18 bp, Homo sapiens
atgtacagtctcaatttt

SEQ ID NO: 3409661 - DNA, 22 bp, Homo sapiens
atgtacagtctcaattttgtat

SEQ ID NO: 3409662 - DNA, 23 bp, Homo sapiens
atgtacagttcataaatttgttg

SEQ ID NO: 3409663 - DNA, 14 bp, Homo sapiens
atgtacttaaatga

SEQ ID NO: 3409664 - DNA, 14 bp, Homo sapiens
atgtagatataaat

SEQ ID NO: 3409665 - DNA, 17 bp, Homo sapiens
atgtaggcacttttatt

SEQ ID NO: 3409666 - DNA, 17 bp, Homo sapiens
atgtagtctcacactgt

SEQ ID NO: 3409667 - DNA, 14 bp, Homo sapiens
atgtataatatttt

SEQ ID NO: 3409668 - DNA, 23 bp, Homo sapiens
atgtataatatttttaattaaat

SEQ ID NO: 3409669 - DNA, 21 bp, Homo sapiens
atgtatataatcatgctcatg

SEQ ID NO: 3409670 - DNA, 14 bp, Homo sapiens
atgtatgattacat

SEQ ID NO: 3409671 - DNA, 17 bp, Homo sapiens
atgtatgtgccaatttt

SEQ ID NO: 3409672 - DNA, 19 bp, Homo sapiens
atgtatgtgccaattttgt

SEQ ID NO: 3409673 - DNA, 21 bp, Homo sapiens
atgtatgtggatacagtcatt

SEQ ID NO: 3409674 - DNA, 18 bp, Homo sapiens
atgtattagccagtcatt

SEQ ID NO: 3409675 - DNA, 21 bp, Homo sapiens
atgtattgcagtgcggctcac

SEQ ID NO: 3409676 - DNA, 21 bp, Homo sapiens
atgtcacacttgtttcttgtt

SEQ ID NO: 3409677 - DNA, 13 bp, Homo sapiens
atgtcagtgttca

SEQ ID NO: 3409678 - DNA, 19 bp, Homo sapiens
atgtccacctgtgagaaag

SEQ ID NO: 3409679 - DNA, 16 bp, Homo sapiens
atgtctgtagctcctc

SEQ ID NO: 3409680 - DNA, 15 bp, Homo sapiens
atgtgaaaccttttt

SEQ ID NO: 3409681 - DNA, 19 bp, Homo sapiens
atgtgaaaccttttttaag

SEQ ID NO: 3409682 - DNA, 20 bp, Homo sapiens
atgtgagcctcgtgtcatct

SEQ ID NO: 3409683 - DNA, 14 bp, Homo sapiens
atgtgccaattttg

SEQ ID NO: 3409684 - DNA, 13 bp, Homo sapiens
atgtgctacaggg

SEQ ID NO: 3409685 - DNA, 15 bp, Homo sapiens
atgtgctacaggggc

SEQ ID NO: 3409686 - DNA, 19 bp, Homo sapiens
atgtgctacaggggccaga

SEQ ID NO: 3409687 - DNA, 21 bp, Homo sapiens
atgtgctacaggggccagaag

SEQ ID NO: 3409688 - DNA, 22 bp, Homo sapiens
atgtggaagtgtgggtctgtgt

SEQ ID NO: 3409689 - DNA, 23 bp, Homo sapiens
atgtggaagtgtgggtctgtgtg

SEQ ID NO: 3409690 - DNA, 16 bp, Homo sapiens
atgtgggggtctgtgt

SEQ ID NO: 3409691 - DNA, 16 bp, Homo sapiens
atgtgggtcaaggaat

SEQ ID NO: 3409692 - DNA, 16 bp, Homo sapiens
atgtgtatatatgtca

SEQ ID NO: 3409693 - DNA, 18 bp, Homo sapiens
atgtgtgtgtgttgtgtg

SEQ ID NO: 3409694 - DNA, 18 bp, Homo sapiens
atgtgttgcataaacaat

SEQ ID NO: 3409695 - DNA, 15 bp, Homo sapiens
atgttaaatttgtaa

SEQ ID NO: 3409696 - DNA, 22 bp, Homo sapiens
atgttaaatttgtaagtttcag

SEQ ID NO: 3409697 - DNA, 13 bp, Homo sapiens
atgttaaggaaac

SEQ ID NO: 3409698 - DNA, 16 bp, Homo sapiens
atgttaccattaatca

SEQ ID NO: 3409699 - DNA, 14 bp, Homo sapiens
atgttacttaaaca

SEQ ID NO: 3409700 - DNA, 20 bp, Homo sapiens
atgttacttgagaagtgctt

SEQ ID NO: 3409701 - DNA, 16 bp, Homo sapiens
atgttatttttgtatt

SEQ ID NO: 3409702 - DNA, 12 bp, Homo sapiens
atgttggtgcaa

SEQ ID NO: 3409703 - DNA, 18 bp, Homo sapiens
atgttggttgcactttgt

SEQ ID NO: 3409704 - DNA, 20 bp, Homo sapiens
atgtttatgagccagacaaa

SEQ ID NO: 3409705 - DNA, 12 bp, Homo sapiens
atgtttctctgg

SEQ ID NO: 3409706 - DNA, 15 bp, Homo sapiens
atgtttcttctccaa

SEQ ID NO: 3409707 - DNA, 16 bp, Homo sapiens
atgttttaaaagtttg

SEQ ID NO: 3409708 - DNA, 13 bp, Homo sapiens
atgtttttgtgta

SEQ ID NO: 3409709 - DNA, 17 bp, Homo sapiens
atgtttttgtgtatttg

SEQ ID NO: 3409710 - DNA, 17 bp, Homo sapiens
attaaaaactttaaaga

SEQ ID NO: 3409711 - DNA, 16 bp, Homo sapiens
attaaacttttcatta

SEQ ID NO: 3409712 - DNA, 13 bp, Homo sapiens
attaaaggctttt

SEQ ID NO: 3409713 - DNA, 11 bp, Homo sapiens
attaaagtatg

SEQ ID NO: 3409714 - DNA, 14 bp, Homo sapiens
attaaagtatgcaa

SEQ ID NO: 3409715 - DNA, 18 bp, Homo sapiens
attaaagtatgcaaaata

SEQ ID NO: 3409716 - DNA, 14 bp, Homo sapiens
attaaattatgaat

SEQ ID NO: 3409717 - DNA, 15 bp, Homo sapiens
attaaattatgaatg

SEQ ID NO: 3409718 - DNA, 16 bp, Homo sapiens
attaaattatgaatga

SEQ ID NO: 3409719 - DNA, 14 bp, Homo sapiens
attaagaaacaatt

SEQ ID NO: 3409720 - DNA, 17 bp, Homo sapiens
attaagaaacaatttaa

SEQ ID NO: 3409721 - DNA, 12 bp, Homo sapiens
attaagtgttga

SEQ ID NO: 3409722 - DNA, 11 bp, Homo sapiens
attaataatag

SEQ ID NO: 3409723 - DNA, 20 bp, Homo sapiens
attaatatggggatgcagca

SEQ ID NO: 3409724 - DNA, 20 bp, Homo sapiens
attgagtcttaactgtattt

SEQ ID NO: 3409725 - DNA, 15 bp, Homo sapiens
attgatcattcataa

SEQ ID NO: 3409726 - DNA, 22 bp, Homo sapiens
attgatcccttctcctgccctt

SEQ ID NO: 3409727 - DNA, 12 bp, Homo sapiens
attgcaaatatt

SEQ ID NO: 3409728 - DNA, 23 bp, Homo sapiens
attgcaggagtccctgccatcat

SEQ ID NO: 3409729 - DNA, 15 bp, Homo sapiens
attgcagtgcggctc

SEQ ID NO: 3409730 - DNA, 15 bp, Homo sapiens
attgccatcagtgat

SEQ ID NO: 3409731 - DNA, 21 bp, Homo sapiens
attgcctttgtaatatgagaa

SEQ ID NO: 3409732 - DNA, 14 bp, Homo sapiens
attggaactggagg

SEQ ID NO: 3409733 - DNA, 18 bp, Homo sapiens
attggaactggaggcagg

SEQ ID NO: 3409734 - DNA, 14 bp, Homo sapiens
attggattatttaa

SEQ ID NO: 3409735 - DNA, 17 bp, Homo sapiens
attggattatttaataa

SEQ ID NO: 3409736 - DNA, 18 bp, Homo sapiens
attggattatttaataac

SEQ ID NO: 3409737 - DNA, 19 bp, Homo sapiens
attggattatttaataaca

SEQ ID NO: 3409738 - DNA, 22 bp, Homo sapiens
attggattatttaataacatta

SEQ ID NO: 3409739 - DNA, 20 bp, Homo sapiens
attggcccaagtcattgttt

SEQ ID NO: 3409740 - DNA, 22 bp, Homo sapiens
attggccttcgattttaaatat

SEQ ID NO: 3409741 - DNA, 17 bp, Homo sapiens
attggtcatggtagatt

SEQ ID NO: 3409742 - DNA, 14 bp, Homo sapiens
attggttagtattt

SEQ ID NO: 3409743 - DNA, 15 bp, Homo sapiens
attggttagtattta

SEQ ID NO: 3409744 - DNA, 23 bp, Homo sapiens
attggtttgttattcttttccag

SEQ ID NO: 3409745 - DNA, 20 bp, Homo sapiens
attgtaaaaaaaaatgcctt

SEQ ID NO: 3409746 - DNA, 23 bp, Homo sapiens
attgtaaaaaaaaatgcctttga

SEQ ID NO: 3409747 - DNA, 19 bp, Homo sapiens
attgtcagctactaatgat

SEQ ID NO: 3409748 - DNA, 15 bp, Homo sapiens
attgtgaagtacata

SEQ ID NO: 3409749 - DNA, 13 bp, Homo sapiens
attgtgatgtgtc

SEQ ID NO: 3409750 - DNA, 15 bp, Homo sapiens
attgtgatgtgtcct

SEQ ID NO: 3409751 - DNA, 10 bp, Homo sapiens
attgttctgg

SEQ ID NO: 3409752 - DNA, 17 bp, Homo sapiens
attgttctgggtgattt

SEQ ID NO: 3409753 - DNA, 23 bp, Homo sapiens
attgttctgtttgtgttatttca

SEQ ID NO: 3409754 - DNA, 14 bp, Homo sapiens
attgttgtttcttt

SEQ ID NO: 3409755 - DNA, 16 bp, Homo sapiens
atttaaaaataaagct

SEQ ID NO: 3409756 - DNA, 17 bp, Homo sapiens
atttaaaagacaaacac

SEQ ID NO: 3409757 - DNA, 15 bp, Homo sapiens
atttaaaattgtgat

SEQ ID NO: 3409758 - DNA, 13 bp, Homo sapiens
atttaaagcacat

SEQ ID NO: 3409759 - DNA, 17 bp, Homo sapiens
atttaaatagaacttga

SEQ ID NO: 3409760 - DNA, 20 bp, Homo sapiens
atttaaatatctgaacattt

SEQ ID NO: 3409761 - DNA, 19 bp, Homo sapiens
atttaagtgcgtgtgtaga

SEQ ID NO: 3409762 - DNA, 19 bp, Homo sapiens
atttaataaaataattcta

SEQ ID NO: 3409763 - DNA, 13 bp, Homo sapiens
atttaataacatt

SEQ ID NO: 3409764 - DNA, 19 bp, Homo sapiens
atttactgctctagaaagt

SEQ ID NO: 3409765 - DNA, 20 bp, Homo sapiens
atttactgtcttaaatcagt

SEQ ID NO: 3409766 - DNA, 17 bp, Homo sapiens
atttactttttaaacag

SEQ ID NO: 3409767 - DNA, 19 bp, Homo sapiens
atttactttttaaacagtg

SEQ ID NO: 3409768 - DNA, 14 bp, Homo sapiens
atttaggagaagtt

SEQ ID NO: 3409769 - DNA, 18 bp, Homo sapiens
atttaggtaaataaagct

SEQ ID NO: 3409770 - DNA, 17 bp, Homo sapiens
atttagtcccttaaaaa

SEQ ID NO: 3409771 - DNA, 23 bp, Homo sapiens
atttatatcttgttattaatgtt

SEQ ID NO: 3409772 - DNA, 12 bp, Homo sapiens
atttatgagatt

SEQ ID NO: 3409773 - DNA, 18 bp, Homo sapiens
atttatgagatttactgc

SEQ ID NO: 3409774 - DNA, 15 bp, Homo sapiens
atttatgatttaata

SEQ ID NO: 3409775 - DNA, 16 bp, Homo sapiens
atttatgatttaataa

SEQ ID NO: 3409776 - DNA, 14 bp, Homo sapiens
atttatgtagatgt

SEQ ID NO: 3409777 - DNA, 18 bp, Homo sapiens
atttatgtagatgtgcat

SEQ ID NO: 3409778 - DNA, 13 bp, Homo sapiens
atttatttctctg

SEQ ID NO: 3409779 - DNA, 19 bp, Homo sapiens
atttcaagatccaaatgct

SEQ ID NO: 3409780 - DNA, 17 bp, Homo sapiens
atttcacagttctgtaa

SEQ ID NO: 3409781 - DNA, 21 bp, Homo sapiens
atttcaccactcaaaggccag

SEQ ID NO: 3409782 - DNA, 12 bp, Homo sapiens
atttcacttaat

SEQ ID NO: 3409783 - DNA, 18 bp, Homo sapiens
atttcatctgctctcctt

SEQ ID NO: 3409784 - DNA, 19 bp, Homo sapiens
atttcatttttacccttac

SEQ ID NO: 3409785 - DNA, 18 bp, Homo sapiens
atttcctttgcgcaaact

SEQ ID NO: 3409786 - DNA, 13 bp, Homo sapiens
atttcgtgtaata

SEQ ID NO: 3409787 - DNA, 17 bp, Homo sapiens
atttcgtgtaatattct

SEQ ID NO: 3409788 - DNA, 20 bp, Homo sapiens
atttctatgtatgtgccaat

SEQ ID NO: 3409789 - DNA, 19 bp, Homo sapiens
atttctctggcaaactttt

SEQ ID NO: 3409790 - DNA, 17 bp, Homo sapiens
atttctgagaaggtcct

SEQ ID NO: 3409791 - DNA, 23 bp, Homo sapiens
atttctgagaaggtccttaatga

SEQ ID NO: 3409792 - DNA, 13 bp, Homo sapiens
atttcttaaacaa

SEQ ID NO: 3409793 - DNA, 11 bp, Homo sapiens
atttctttaat

SEQ ID NO: 3409794 - DNA, 16 bp, Homo sapiens
atttctttgaatgtat

SEQ ID NO: 3409795 - DNA, 11 bp, Homo sapiens
atttcttttgt

SEQ ID NO: 3409796 - DNA, 16 bp, Homo sapiens
atttgaagatctgatt

SEQ ID NO: 3409797 - DNA, 20 bp, Homo sapiens
atttgaagatctgatttata

SEQ ID NO: 3409798 - DNA, 13 bp, Homo sapiens
atttgaggtcaag

SEQ ID NO: 3409799 - DNA, 14 bp, Homo sapiens
atttgatctttgtt

SEQ ID NO: 3409800 - DNA, 23 bp, Homo sapiens
atttgatctttgtttaaatgcca

SEQ ID NO: 3409801 - DNA, 18 bp, Homo sapiens
atttgattaaattatgaa

SEQ ID NO: 3409802 - DNA, 22 bp, Homo sapiens
atttgatttcgatgtacagtct

SEQ ID NO: 3409803 - DNA, 24 bp, Homo sapiens
atttgccatgggcttcactgtata

SEQ ID NO: 3409804 - DNA, 21 bp, Homo sapiens
atttggcccaaactcatcttg

SEQ ID NO: 3409805 - DNA, 13 bp, Homo sapiens
atttggcttgctg

SEQ ID NO: 3409806 - DNA, 23 bp, Homo sapiens
atttggtcaagattttgaatgct

SEQ ID NO: 3409807 - DNA, 18 bp, Homo sapiens
atttgtaagtttcaggtg

SEQ ID NO: 3409808 - DNA, 21 bp, Homo sapiens
atttgtaagtttcaggtgaca

SEQ ID NO: 3409809 - DNA, 21 bp, Homo sapiens
atttgtatgtattaaactttt

SEQ ID NO: 3409810 - DNA, 19 bp, Homo sapiens
atttgtcggggaagatgaa

SEQ ID NO: 3409811 - DNA, 12 bp, Homo sapiens
atttgttaatgg

SEQ ID NO: 3409812 - DNA, 19 bp, Homo sapiens
atttgttcttataaacctt

SEQ ID NO: 3409813 - DNA, 20 bp, Homo sapiens
atttgttgcaccaattaagt

SEQ ID NO: 3409814 - DNA, 15 bp, Homo sapiens
attttaaaaatacat

SEQ ID NO: 3409815 - DNA, 18 bp, Homo sapiens
attttaaaacatgctgtt

SEQ ID NO: 3409816 - DNA, 16 bp, Homo sapiens
attttaaatatttgtt

SEQ ID NO: 3409817 - DNA, 23 bp, Homo sapiens
attttacccaaatactcaattta

SEQ ID NO: 3409818 - DNA, 18 bp, Homo sapiens
attttagtattaactctg

SEQ ID NO: 3409819 - DNA, 15 bp, Homo sapiens
attttatctttgatt

SEQ ID NO: 3409820 - DNA, 22 bp, Homo sapiens
attttatctttgattctccttc

SEQ ID NO: 3409821 - DNA, 15 bp, Homo sapiens
attttatttctgatg

SEQ ID NO: 3409822 - DNA, 21 bp, Homo sapiens
attttcagcatcaaacatgaa

SEQ ID NO: 3409823 - DNA, 12 bp, Homo sapiens
attttcattgtg

SEQ ID NO: 3409824 - DNA, 16 bp, Homo sapiens
attttcattgtgattt

SEQ ID NO: 3409825 - DNA, 22 bp, Homo sapiens
attttccagccttatgtgttac

SEQ ID NO: 3409826 - DNA, 15 bp, Homo sapiens
attttgaatgtgatc

SEQ ID NO: 3409827 - DNA, 15 bp, Homo sapiens
attttggatttcttt

SEQ ID NO: 3409828 - DNA, 22 bp, Homo sapiens
attttggttttgttcccctcct

SEQ ID NO: 3409829 - DNA, 23 bp, Homo sapiens
attttggttttgttcccctcctc

SEQ ID NO: 3409830 - DNA, 21 bp, Homo sapiens
attttgtcacagctcttgttt

SEQ ID NO: 3409831 - DNA, 15 bp, Homo sapiens
attttgtgaatggat

SEQ ID NO: 3409832 - DNA, 16 bp, Homo sapiens
atttttaaaagtatac

SEQ ID NO: 3409833 - DNA, 20 bp, Homo sapiens
atttttaaaggacaaacagt

SEQ ID NO: 3409834 - DNA, 21 bp, Homo sapiens
atttttagtttaaaatcttgc

SEQ ID NO: 3409835 - DNA, 22 bp, Homo sapiens
cacaggcctgagatttcatctg

SEQ ID NO: 3409836 - DNA, 14 bp, Homo sapiens
cacaggctagatcc

SEQ ID NO: 3409837 - DNA, 23 bp, Homo sapiens
cacaggtatgaccttctaggaag

SEQ ID NO: 3409838 - DNA, 17 bp, Homo sapiens
cacaggtttgtttcttg

SEQ ID NO: 3409839 - DNA, 22 bp, Homo sapiens
cacagtggaaagacagcttctc

SEQ ID NO: 3409840 - DNA, 23 bp, Homo sapiens
cacatattaagaatagtctctgg

SEQ ID NO: 3409841 - DNA, 14 bp, Homo sapiens
cacatcatgttact

SEQ ID NO: 3409842 - DNA, 18 bp, Homo sapiens
cacatgccctaatgtctg

SEQ ID NO: 3409843 - DNA, 20 bp, Homo sapiens
cacatgccctaatgtctgta

SEQ ID NO: 3409844 - DNA, 15 bp, Homo sapiens
caccaattaagtgtt

SEQ ID NO: 3409845 - DNA, 22 bp, Homo sapiens
caccactcaaaggccagacctg

SEQ ID NO: 3409846 - DNA, 16 bp, Homo sapiens
caccagagcagatgca

SEQ ID NO: 3409847 - DNA, 18 bp, Homo sapiens
caccagagcagatgcaga

SEQ ID NO: 3409848 - DNA, 20 bp, Homo sapiens
caccagagcagatgcagaga

SEQ ID NO: 3409849 - DNA, 15 bp, Homo sapiens
caccattgaactgta

SEQ ID NO: 3409850 - DNA, 14 bp, Homo sapiens
cacccacttctgca

SEQ ID NO: 3409851 - DNA, 15 bp, Homo sapiens
cacccacttctgcac

SEQ ID NO: 3409852 - DNA, 20 bp, Homo sapiens
cacccagaagcagtaataat

SEQ ID NO: 3409853 - DNA, 13 bp, Homo sapiens
caccccagggcag

SEQ ID NO: 3409854 - DNA, 16 bp, Homo sapiens
caccccagggcagcca

SEQ ID NO: 3409855 - DNA, 16 bp, Homo sapiens
caccccctccccgccc

SEQ ID NO: 3409856 - DNA, 13 bp, Homo sapiens
caccgagaatgtt

SEQ ID NO: 3409857 - DNA, 13 bp, Homo sapiens
caccgcccactct

SEQ ID NO: 3409858 - DNA, 16 bp, Homo sapiens
caccgcccactctcca

SEQ ID NO: 3409859 - DNA, 22 bp, Homo sapiens
caccggccccatttacccaact

SEQ ID NO: 3409860 - DNA, 21 bp, Homo sapiens
cacctaatgtttatgagccag

SEQ ID NO: 3409861 - DNA, 15 bp, Homo sapiens
cacctcctgcctcag

SEQ ID NO: 3409862 - DNA, 23 bp, Homo sapiens
cacctcctttcaaggtaactgta

SEQ ID NO: 3409863 - DNA, 19 bp, Homo sapiens
cacctctctggcttccatg

SEQ ID NO: 3409864 - DNA, 11 bp, Homo sapiens
cacctggaccc

SEQ ID NO: 3409865 - DNA, 12 bp, Homo sapiens
cacctggacccc

SEQ ID NO: 3409866 - DNA, 13 bp, Homo sapiens
cacctggctcccc

SEQ ID NO: 3409867 - DNA, 17 bp, Homo sapiens
cacctgtgagaaaggaa

SEQ ID NO: 3409868 - DNA, 22 bp, Homo sapiens
cacctgttggctacacagaccc

SEQ ID NO: 3409869 - DNA, 19 bp, Homo sapiens
cacctttgtttctccccca

SEQ ID NO: 3409870 - DNA, 18 bp, Homo sapiens
caccttttaactcacctc

SEQ ID NO: 3409871 - DNA, 17 bp, Homo sapiens
cacgcgccctttctacc

SEQ ID NO: 3409872 - DNA, 18 bp, Homo sapiens
cacgctttcagcgaatga

SEQ ID NO: 3409873 - DNA, 19 bp, Homo sapiens
cacgtgtggcctgttcttc

SEQ ID NO: 3409874 - DNA, 18 bp, Homo sapiens
cacgtgttttccatccca

SEQ ID NO: 3409875 - DNA, 18 bp, Homo sapiens
cactaaagtgcattattt

SEQ ID NO: 3409876 - DNA, 22 bp, Homo sapiens
cactagctccccaatccctgac

SEQ ID NO: 3409877 - DNA, 20 bp, Homo sapiens
cactcaaaggccagacctgc

SEQ ID NO: 3409878 - DNA, 23 bp, Homo sapiens
cactcaaaggccagacctgcaga

SEQ ID NO: 3409879 - DNA, 19 bp, Homo sapiens
cactcgggttaagaaatac

SEQ ID NO: 3409880 - DNA, 16 bp, Homo sapiens
cactctcccccacccc

SEQ ID NO: 3409881 - DNA, 18 bp, Homo sapiens
cactctcccccaccccct

SEQ ID NO: 3409882 - DNA, 17 bp, Homo sapiens
cactctgtgtctgagtg

SEQ ID NO: 3409883 - DNA, 22 bp, Homo sapiens
cactgacacaaaagaagaaata

SEQ ID NO: 3409884 - DNA, 18 bp, Homo sapiens
cactgagaatgtaagaac

SEQ ID NO: 3409885 - DNA, 20 bp, Homo sapiens
cactgagaatgtaagaacta

SEQ ID NO: 3409886 - DNA, 16 bp, Homo sapiens
cactgcctctcacagc

SEQ ID NO: 3409887 - DNA, 17 bp, Homo sapiens
cactggcatcgcagctt

SEQ ID NO: 3409888 - DNA, 14 bp, Homo sapiens
cactgtcttgaaga

SEQ ID NO: 3409889 - DNA, 15 bp, Homo sapiens
cactgtgatgttggg

SEQ ID NO: 3409890 - DNA, 16 bp, Homo sapiens
cactgtgatgttggga

SEQ ID NO: 3409891 - DNA, 11 bp, Homo sapiens
cacttaatatt

SEQ ID NO: 3409892 - DNA, 20 bp, Homo sapiens
cacttaatattagcttgctt

SEQ ID NO: 3409893 - DNA, 19 bp, Homo sapiens
cacttctgggtggggcagt

SEQ ID NO: 3409894 - DNA, 20 bp, Homo sapiens
cacttgcaggggtccctgct

SEQ ID NO: 3409895 - DNA, 13 bp, Homo sapiens
cacttgtttcttg

SEQ ID NO: 3409896 - DNA, 17 bp, Homo sapiens
cactttcagtgaaagca

SEQ ID NO: 3409897 - DNA, 22 bp, Homo sapiens
cactttccaccaagtgtctaga

SEQ ID NO: 3409898 - DNA, 14 bp, Homo sapiens
cacttttattttca

SEQ ID NO: 3409899 - DNA, 16 bp, Homo sapiens
cagaaagaaaatgaat

SEQ ID NO: 3409900 - DNA, 19 bp, Homo sapiens
cagaaagaaaatgaatttg

SEQ ID NO: 3409901 - DNA, 11 bp, Homo sapiens
cagaacactgt

SEQ ID NO: 3409902 - DNA, 23 bp, Homo sapiens
aggaggagggtcggtgccttcaa

SEQ ID NO: 3409903 - DNA, 21 bp, Homo sapiens
aggagggtcggtgccttcaag

SEQ ID NO: 3409904 - DNA, 13 bp, Homo sapiens
aggatactgctgc

SEQ ID NO: 3409905 - DNA, 20 bp, Homo sapiens
aggatgagagcccagaggta

SEQ ID NO: 3409906 - DNA, 14 bp, Homo sapiens
aggatgggtccaga

SEQ ID NO: 3409907 - DNA, 13 bp, Homo sapiens
aggatgtctgggc

SEQ ID NO: 3409908 - DNA, 22 bp, Homo sapiens
aggattggatgttgtgtattgt

SEQ ID NO: 3409909 - DNA, 13 bp, Homo sapiens
aggattgtaaaaa

SEQ ID NO: 3409910 - DNA, 11 bp, Homo sapiens
aggatttatac

SEQ ID NO: 3409911 - DNA, 21 bp, Homo sapiens
aggcaagcccttcggtcacct

SEQ ID NO: 3409912 - DNA, 16 bp, Homo sapiens
aggcaccgagaatgtt

SEQ ID NO: 3409913 - DNA, 18 bp, Homo sapiens
aggcaccgagaatgttgt

SEQ ID NO: 3409914 - DNA, 22 bp, Homo sapiens
aggcactaagaggggctggacc

SEQ ID NO: 3409915 - DNA, 15 bp, Homo sapiens
aggcactgccctggt

SEQ ID NO: 3409916 - DNA, 22 bp, Homo sapiens
aggcactgccctggtggccctc

SEQ ID NO: 3409917 - DNA, 20 bp, Homo sapiens
aggcacttttattttcattg

SEQ ID NO: 3409918 - DNA, 16 bp, Homo sapiens
aggcagattgaaaagg

SEQ ID NO: 3409919 - DNA, 20 bp, Homo sapiens
aggcatccttcctcacacca

SEQ ID NO: 3409920 - DNA, 12 bp, Homo sapiens
aggccaggtgca

SEQ ID NO: 3409921 - DNA, 19 bp, Homo sapiens
aggccctccacacctgcgg

SEQ ID NO: 3409922 - DNA, 20 bp, Homo sapiens
aggccctccacacctgcggc

SEQ ID NO: 3409923 - DNA, 21 bp, Homo sapiens
aggccctccacacctgcggcc

SEQ ID NO: 3409924 - DNA, 17 bp, Homo sapiens
aggcctgagatttcatc

SEQ ID NO: 3409925 - DNA, 19 bp, Homo sapiens
aggcctgagatttcatctg

SEQ ID NO: 3409926 - DNA, 20 bp, Homo sapiens
aggcctgagatttcatctgc

SEQ ID NO: 3409927 - DNA, 22 bp, Homo sapiens
aggcctgagcgctcctgccgca

SEQ ID NO: 3409928 - DNA, 13 bp, Homo sapiens
aggctagatcccc

SEQ ID NO: 3409929 - DNA, 19 bp, Homo sapiens
aggctatcctgctgaaagt

SEQ ID NO: 3409930 - DNA, 18 bp, Homo sapiens
aggctctgcgcctgcccc

SEQ ID NO: 3409931 - DNA, 13 bp, Homo sapiens
aggctgaaagagg

SEQ ID NO: 3409932 - DNA, 16 bp, Homo sapiens
aggctgaaagaggcca

SEQ ID NO: 3409933 - DNA, 15 bp, Homo sapiens
aggcttgcctgcagg

SEQ ID NO: 3409934 - DNA, 17 bp, Homo sapiens
aggcttgcctgcaggca

SEQ ID NO: 3409935 - DNA, 22 bp, Homo sapiens
aggctttctgttgccatggtga

SEQ ID NO: 3409936 - DNA, 18 bp, Homo sapiens
aggctttggcaacagaaa

SEQ ID NO: 3409937 - DNA, 17 bp, Homo sapiens
agggaaaggtaaataca

SEQ ID NO: 3409938 - DNA, 15 bp, Homo sapiens
agggaatggcacagc

SEQ ID NO: 3409939 - DNA, 13 bp, Homo sapiens
agggagagcccag

SEQ ID NO: 3409940 - DNA, 21 bp, Homo sapiens
agggagagcccaggagctccc

SEQ ID NO: 3409941 - DNA, 17 bp, Homo sapiens
agggagtgtactcccag

SEQ ID NO: 3409942 - DNA, 18 bp, Homo sapiens
agggatgaaggcctccct

SEQ ID NO: 3409943 - DNA, 22 bp, Homo sapiens
agggatttggggctcagagtgg

SEQ ID NO: 3409944 - DNA, 19 bp, Homo sapiens
agggcacaggccatggatg

SEQ ID NO: 3409945 - DNA, 13 bp, Homo sapiens
agggcagccaggg

SEQ ID NO: 3409946 - DNA, 19 bp, Homo sapiens
agggcagccagggagagcc

SEQ ID NO: 3409947 - DNA, 17 bp, Homo sapiens
agggccagaaaaaagtg

SEQ ID NO: 3409948 - DNA, 23 bp, Homo sapiens
agggccagaaaaaagtgtttata

SEQ ID NO: 3409949 - DNA, 18 bp, Homo sapiens
agggccgggcagaggggc

SEQ ID NO: 3409950 - DNA, 20 bp, Homo sapiens
agggccgggcagaggggcag

SEQ ID NO: 3409951 - DNA, 18 bp, Homo sapiens
agggcttacggccctggc

SEQ ID NO: 3409952 - DNA, 20 bp, Homo sapiens
agggcttacggccctggcct

SEQ ID NO: 3409953 - DNA, 18 bp, Homo sapiens
aggggagggtcagccagg

SEQ ID NO: 3409954 - DNA, 13 bp, Homo sapiens
aggggcatgggaa

SEQ ID NO: 3409955 - DNA, 17 bp, Homo sapiens
aggggccagaagatgaa

SEQ ID NO: 3409956 - DNA, 15 bp, Homo sapiens
aggggcctgccacct

SEQ ID NO: 3409957 - DNA, 17 bp, Homo sapiens
aggggcctgccacctgg

SEQ ID NO: 3409958 - DNA, 19 bp, Homo sapiens
aggggcctgccacctggac

SEQ ID NO: 3409959 - DNA, 22 bp, Homo sapiens
aggggcctgccacctggacccc

SEQ ID NO: 3409960 - DNA, 15 bp, Homo sapiens
aggggctggacctgg

SEQ ID NO: 3409961 - DNA, 13 bp, Homo sapiens
agggggctggagg

SEQ ID NO: 3409962 - DNA, 17 bp, Homo sapiens
agggggctggaggagcc

SEQ ID NO: 3409963 - DNA, 19 bp, Homo sapiens
agggggctggctctgagag

SEQ ID NO: 3409964 - DNA, 17 bp, Homo sapiens
agggtcagccagggcct

SEQ ID NO: 3409965 - DNA, 19 bp, Homo sapiens
agggtcagccagggcctgc

SEQ ID NO: 3409966 - DNA, 17 bp, Homo sapiens
agggtggaaaaatgccc

SEQ ID NO: 3409967 - DNA, 11 bp, Homo sapiens
aggtaaataaa

SEQ ID NO: 3409968 - DNA, 13 bp, Homo sapiens
aggtaaatacaag

SEQ ID NO: 3409969 - DNA, 14 bp, Homo sapiens
aggtaacagaacag

SEQ ID NO: 3409970 - DNA, 15 bp, Homo sapiens
aggtaacagaacagc

SEQ ID NO: 3409971 - DNA, 19 bp, Homo sapiens
aggtaacagaacagcttca

SEQ ID NO: 3409972 - DNA, 21 bp, Homo sapiens
aggtaacagaacagcttcagg

SEQ ID NO: 3409973 - DNA, 21 bp, Homo sapiens
aggtaatgtagggttatattt

SEQ ID NO: 3409974 - DNA, 23 bp, Homo sapiens
aggtacgttttatattatataag

SEQ ID NO: 3409975 - DNA, 18 bp, Homo sapiens
aggtatctggtatctgca

SEQ ID NO: 3409976 - DNA, 16 bp, Homo sapiens
aggtcatagattcttg

SEQ ID NO: 3409977 - DNA, 17 bp, Homo sapiens
aggtcatagattcttga

SEQ ID NO: 3409978 - DNA, 20 bp, Homo sapiens
aggtctacattcttggttgt

SEQ ID NO: 3409979 - DNA, 15 bp, Homo sapiens
aggtctccatgaaga

SEQ ID NO: 3409980 - DNA, 11 bp, Homo sapiens
aggtctcctct

SEQ ID NO: 3409981 - DNA, 13 bp, Homo sapiens
aggtctcctctta

SEQ ID NO: 3409982 - DNA, 15 bp, Homo sapiens
aggtgggccttgcta

SEQ ID NO: 3409983 - DNA, 17 bp, Homo sapiens
aggtgttctacactcat

SEQ ID NO: 3409984 - DNA, 20 bp, Homo sapiens
aggtgttctacactcatctt

SEQ ID NO: 3409985 - DNA, 14 bp, Homo sapiens
aggttatcgaaata

SEQ ID NO: 3409986 - DNA, 17 bp, Homo sapiens
aggttatcgaaataaca

SEQ ID NO: 3409987 - DNA, 23 bp, Homo sapiens
aggttgggagaatgtcagtatgt

SEQ ID NO: 3409988 - DNA, 14 bp, Homo sapiens
aggtttctgaaaat

SEQ ID NO: 3409989 - DNA, 15 bp, Homo sapiens
agtaagaagacatga

SEQ ID NO: 3409990 - DNA, 20 bp, Homo sapiens
agtaagcagagttctttgca

SEQ ID NO: 3409991 - DNA, 18 bp, Homo sapiens
agtacatattaggaaaat

SEQ ID NO: 3409992 - DNA, 15 bp, Homo sapiens
agtagaacaaaaact

SEQ ID NO: 3409993 - DNA, 19 bp, Homo sapiens
catggggctgattgtattt

SEQ ID NO: 3409994 - DNA, 17 bp, Homo sapiens
catgggggagggggcag

SEQ ID NO: 3409995 - DNA, 19 bp, Homo sapiens
catgggggagggggcagaa

SEQ ID NO: 3409996 - DNA, 15 bp, Homo sapiens
catggtgtgtgtctc

SEQ ID NO: 3409997 - DNA, 18 bp, Homo sapiens
catgtaaaatcttcagct

SEQ ID NO: 3409998 - DNA, 21 bp, Homo sapiens
catgtaaaatcttcagctggt

SEQ ID NO: 3409999 - DNA, 23 bp, Homo sapiens
catgtaaaatcttcagctggtgg

SEQ ID NO: 3410000 - DNA, 14 bp, Homo sapiens
catgtgaaaccttt

SEQ ID NO: 3410001 - DNA, 13 bp, Homo sapiens
catgtgagcctcg

SEQ ID NO: 3410002 - DNA, 16 bp, Homo sapiens
catgtgcaactcttgt

SEQ ID NO: 3410003 - DNA, 17 bp, Homo sapiens
catgtgcaactcttgta

SEQ ID NO: 3410004 - DNA, 17 bp, Homo sapiens
catgtgggttgtgatat

SEQ ID NO: 3410005 - DNA, 21 bp, Homo sapiens
catgtgggttgtgatattgac

SEQ ID NO: 3410006 - DNA, 22 bp, Homo sapiens
catgtggttaatgccatggaca

SEQ ID NO: 3410007 - DNA, 16 bp, Homo sapiens
catgtggttacacagt

SEQ ID NO: 3410008 - DNA, 23 bp, Homo sapiens
catgtggttacacagtgtgaata

SEQ ID NO: 3410009 - DNA, 13 bp, Homo sapiens
catgtgtatgaga

SEQ ID NO: 3410010 - DNA, 20 bp, Homo sapiens
catgttgtgcctccctggtg

SEQ ID NO: 3410011 - DNA, 12 bp, Homo sapiens
catgtttctgcc

SEQ ID NO: 3410012 - DNA, 18 bp, Homo sapiens
cattaaactctaaagatt

SEQ ID NO: 3410013 - DNA, 13 bp, Homo sapiens
cattaaagcaatc

SEQ ID NO: 3410014 - DNA, 21 bp, Homo sapiens
cattaaagcaatctgttgaaa

SEQ ID NO: 3410015 - DNA, 23 bp, Homo sapiens
cattaataatagctaataataaa

SEQ ID NO: 3410016 - DNA, 21 bp, Homo sapiens
cattacagggcacaggccatg

SEQ ID NO: 3410017 - DNA, 13 bp, Homo sapiens
cattaccttactg

SEQ ID NO: 3410018 - DNA, 21 bp, Homo sapiens
cattatgatgtgggtcaagga

SEQ ID NO: 3410019 - DNA, 21 bp, Homo sapiens
cattattattactttttaaaa

SEQ ID NO: 3410020 - DNA, 12 bp, Homo sapiens
cattcacatttc

SEQ ID NO: 3410021 - DNA, 22 bp, Homo sapiens
cattcatgttttaaaagtttgt

SEQ ID NO: 3410022 - DNA, 20 bp, Homo sapiens
cattcctaacacagcatgtg

SEQ ID NO: 3410023 - DNA, 21 bp, Homo sapiens
cattcctaacacagcatgtgt

SEQ ID NO: 3410024 - DNA, 16 bp, Homo sapiens
cattccttctttgata

SEQ ID NO: 3410025 - DNA, 18 bp, Homo sapiens
cattcttggttgttaatt

SEQ ID NO: 3410026 - DNA, 13 bp, Homo sapiens
cattgatgaatga

SEQ ID NO: 3410027 - DNA, 22 bp, Homo sapiens
cattgatgaatgaggaacaatc

SEQ ID NO: 3410028 - DNA, 18 bp, Homo sapiens
cattgattgtcagctact

SEQ ID NO: 3410029 - DNA, 23 bp, Homo sapiens
cagatttttatattagttgcttt

SEQ ID NO: 3410030 - DNA, 21 bp, Homo sapiens
cagcaaagagaatgtatttcc

SEQ ID NO: 3410031 - DNA, 17 bp, Homo sapiens
cagcaaagtgtcagtgt

SEQ ID NO: 3410032 - DNA, 19 bp, Homo sapiens
cagcaaagtgtcagtgttg

SEQ ID NO: 3410033 - DNA, 14 bp, Homo sapiens
cagcaagtctcttt

SEQ ID NO: 3410034 - DNA, 21 bp, Homo sapiens
cagcaccggaccagcctggcc

SEQ ID NO: 3410035 - DNA, 22 bp, Homo sapiens
cagcaccggaccagcctggccc

SEQ ID NO: 3410036 - DNA, 17 bp, Homo sapiens
cagcacgtgtggcctgt

SEQ ID NO: 3410037 - DNA, 12 bp, Homo sapiens
cagcactgagga

SEQ ID NO: 3410038 - DNA, 13 bp, Homo sapiens
cagcagaaggggg

SEQ ID NO: 3410039 - DNA, 13 bp, Homo sapiens
cagcatcaaacat

SEQ ID NO: 3410040 - DNA, 22 bp, Homo sapiens
cagcatgtgtatttccagtgca

SEQ ID NO: 3410041 - DNA, 15 bp, Homo sapiens
cagccagggagagcc

SEQ ID NO: 3410042 - DNA, 17 bp, Homo sapiens
cagccagggagagccca

SEQ ID NO: 3410043 - DNA, 19 bp, Homo sapiens
cagccagggagagcccagg

SEQ ID NO: 3410044 - DNA, 20 bp, Homo sapiens
cagccagggagagcccagga

SEQ ID NO: 3410045 - DNA, 18 bp, Homo sapiens
cagccccaccccagggca

SEQ ID NO: 3410046 - DNA, 22 bp, Homo sapiens
cagccccaccccagggcagcca

SEQ ID NO: 3410047 - DNA, 14 bp, Homo sapiens
cagccctcacccct

SEQ ID NO: 3410048 - DNA, 19 bp, Homo sapiens
cagcctcgagtgcccctgt

SEQ ID NO: 3410049 - DNA, 12 bp, Homo sapiens
cagcctggccca

SEQ ID NO: 3410050 - DNA, 18 bp, Homo sapiens
cagcctgggaccagggca

SEQ ID NO: 3410051 - DNA, 15 bp, Homo sapiens
cagccttatgtgtta

SEQ ID NO: 3410052 - DNA, 18 bp, Homo sapiens
cagccttatgtgttacat

SEQ ID NO: 3410053 - DNA, 13 bp, Homo sapiens
cagcgaatgacaa

SEQ ID NO: 3410054 - DNA, 15 bp, Homo sapiens
cagctagaatttctg

SEQ ID NO: 3410055 - DNA, 13 bp, Homo sapiens
cagctatttttat

SEQ ID NO: 3410056 - DNA, 14 bp, Homo sapiens
cagctccctgcctg

SEQ ID NO: 3410057 - DNA, 15 bp, Homo sapiens
cagctccctgcctgt

SEQ ID NO: 3410058 - DNA, 18 bp, Homo sapiens
cagctctcagttgcagcc

SEQ ID NO: 3410059 - DNA, 20 bp, Homo sapiens
cagctctctgggcacccggt

SEQ ID NO: 3410060 - DNA, 19 bp, Homo sapiens
cagctgactccagtataat

SEQ ID NO: 3410061 - DNA, 12 bp, Homo sapiens
cagctgagttgt

SEQ ID NO: 3410062 - DNA, 11 bp, Homo sapiens
cagctggtgga

SEQ ID NO: 3410063 - DNA, 14 bp, Homo sapiens
cagctggtggatgg

SEQ ID NO: 3410064 - DNA, 18 bp, Homo sapiens
cagctggtggatggtgac

SEQ ID NO: 3410065 - DNA, 19 bp, Homo sapiens
cagctggtggatggtgact

SEQ ID NO: 3410066 - DNA, 19 bp, Homo sapiens
cagctggtggtatctgagt

SEQ ID NO: 3410067 - DNA, 14 bp, Homo sapiens
cagcttcaggttat

SEQ ID NO: 3410068 - DNA, 20 bp, Homo sapiens
cagcttcctgtctgtttata

SEQ ID NO: 3410069 - DNA, 19 bp, Homo sapiens
cagcttctcatcctgcagg

SEQ ID NO: 3410070 - DNA, 20 bp, Homo sapiens
cagcttctcatcctgcaggc

SEQ ID NO: 3410071 - DNA, 13 bp, Homo sapiens
caggaaagaatag

SEQ ID NO: 3410072 - DNA, 19 bp, Homo sapiens
caggaagacccaacacatg

SEQ ID NO: 3410073 - DNA, 18 bp, Homo sapiens
caggaaggagctgcctgg

SEQ ID NO: 3410074 - DNA, 11 bp, Homo sapiens
caggactctgc

SEQ ID NO: 3410075 - DNA, 14 bp, Homo sapiens
caggactctgcagc

SEQ ID NO: 3410076 - DNA, 18 bp, Homo sapiens
caggactctgcagcctca

SEQ ID NO: 3410077 - DNA, 20 bp, Homo sapiens
caggactctgcagcctcaga

SEQ ID NO: 3410078 - DNA, 13 bp, Homo sapiens
caggactgggcca

SEQ ID NO: 3410079 - DNA, 15 bp, Homo sapiens
caggagattggattt

SEQ ID NO: 3410080 - DNA, 18 bp, Homo sapiens
caggagctcccctcccca

SEQ ID NO: 3410081 - DNA, 22 bp, Homo sapiens
caggagctcccctccccaactg

SEQ ID NO: 3410082 - DNA, 21 bp, Homo sapiens
caggatcatggtgtaataaga

SEQ ID NO: 3410083 - DNA, 23 bp, Homo sapiens
caggatcatggtgtaataagaca

SEQ ID NO: 3410084 - DNA, 13 bp, Homo sapiens
caggatttataca

SEQ ID NO: 3410085 - DNA, 16 bp, Homo sapiens
caggccacaaatgtgt

SEQ ID NO: 3410086 - DNA, 13 bp, Homo sapiens
caggccaggactc

SEQ ID NO: 3410087 - DNA, 19 bp, Homo sapiens
caggccaggactctgcagc

SEQ ID NO: 3410088 - DNA, 16 bp, Homo sapiens
caggcctgagatttca

SEQ ID NO: 3410089 - DNA, 18 bp, Homo sapiens
caggcctgagatttcatc

SEQ ID NO: 3410090 - DNA, 21 bp, Homo sapiens
caggcctgagatttcatctgc

SEQ ID NO: 3410091 - DNA, 18 bp, Homo sapiens
caggctagatccccggtg

SEQ ID NO: 3410092 - DNA, 16 bp, Homo sapiens
caggctgccggctccc

SEQ ID NO: 3410093 - DNA, 17 bp, Homo sapiens
caggctgccggctcccc

SEQ ID NO: 3410094 - DNA, 17 bp, Homo sapiens
caggcttgcctgcaggc

SEQ ID NO: 3410095 - DNA, 19 bp, Homo sapiens
cagggaaaaagaccaaatt

SEQ ID NO: 3410096 - DNA, 20 bp, Homo sapiens
cagggaacatggggaggagg

SEQ ID NO: 3410097 - DNA, 14 bp, Homo sapiens
cagggacagcaact

SEQ ID NO: 3410098 - DNA, 14 bp, Homo sapiens
cagggagagcccag

SEQ ID NO: 3410099 - DNA, 15 bp, Homo sapiens
cagggagagcccagg

SEQ ID NO: 3410100 - DNA, 19 bp, Homo sapiens
cagggagagcccaggagct

SEQ ID NO: 3410101 - DNA, 15 bp, Homo sapiens
cagggcacaggccat

SEQ ID NO: 3410102 - DNA, 12 bp, Homo sapiens
cagggcagccag

SEQ ID NO: 3410103 - DNA, 13 bp, Homo sapiens
cagggcagccagg

SEQ ID NO: 3410104 - DNA, 18 bp, Homo sapiens
cagggcatattaaaggct

SEQ ID NO: 3410105 - DNA, 16 bp, Homo sapiens
cagggctgaggcctct

SEQ ID NO: 3410106 - DNA, 15 bp, Homo sapiens
cagggctggactgag

SEQ ID NO: 3410107 - DNA, 16 bp, Homo sapiens
cagggctggactgagg

SEQ ID NO: 3410108 - DNA, 17 bp, Homo sapiens
cagggctggactgaggc

SEQ ID NO: 3410109 - DNA, 19 bp, Homo sapiens
cagggctggactgaggcct

SEQ ID NO: 3410110 - DNA, 21 bp, Homo sapiens
cagggctggactgaggcctga

SEQ ID NO: 3410111 - DNA, 17 bp, Homo sapiens
caggggtccctgctagt

SEQ ID NO: 3410112 - DNA, 17 bp, Homo sapiens
cagggtcagtgtatcta

SEQ ID NO: 3410113 - DNA, 16 bp, Homo sapiens
caggtaatttaaattg

SEQ ID NO: 3410114 - DNA, 19 bp, Homo sapiens
caggtagacctgtctcctg

SEQ ID NO: 3410115 - DNA, 15 bp, Homo sapiens
caggtctcctcttaa

SEQ ID NO: 3410116 - DNA, 22 bp, Homo sapiens
caggtctcctcttaaaaaataa

SEQ ID NO: 3410117 - DNA, 17 bp, Homo sapiens
caggtgacatgtgaaac

SEQ ID NO: 3410118 - DNA, 20 bp, Homo sapiens
caggtgttctacactcatct

SEQ ID NO: 3410119 - DNA, 12 bp, Homo sapiens
caggtgttcttc

SEQ ID NO: 3410120 - DNA, 19 bp, Homo sapiens
caggttatcgaaataacaa

SEQ ID NO: 3410121 - DNA, 23 bp, Homo sapiens
caggttatcgaaataacaatgtt

SEQ ID NO: 3410122 - DNA, 16 bp, Homo sapiens
caggttggaaaagaaa

SEQ ID NO: 3410123 - DNA, 18 bp, Homo sapiens
caggttggaaaagaaatc

SEQ ID NO: 3410124 - DNA, 20 bp, Homo sapiens
caggtttgtttcttgatagt

SEQ ID NO: 3410125 - DNA, 19 bp, Homo sapiens
cagtaagtataacaaacta

SEQ ID NO: 3410126 - DNA, 18 bp, Homo sapiens
cagtagtcacctctgggc

SEQ ID NO: 3410127 - DNA, 16 bp, Homo sapiens
cagtatcctgctggtt

SEQ ID NO: 3410128 - DNA, 15 bp, Homo sapiens
cagtattatttgtat

SEQ ID NO: 3410129 - DNA, 14 bp, Homo sapiens
cagtattcccactc

SEQ ID NO: 3410130 - DNA, 17 bp, Homo sapiens
cagtcatgcataaatat

SEQ ID NO: 3410131 - DNA, 18 bp, Homo sapiens
cagtcattatttaaagca

SEQ ID NO: 3410132 - DNA, 22 bp, Homo sapiens
cagtcattgtaacctcgtgtct

SEQ ID NO: 3410133 - DNA, 15 bp, Homo sapiens
cagtcgtcccaggct

SEQ ID NO: 3410134 - DNA, 18 bp, Homo sapiens
cagtcgtcccaggctgcc

SEQ ID NO: 3410135 - DNA, 21 bp, Homo sapiens
cagtctgattataccatgtgt

SEQ ID NO: 3410136 - DNA, 18 bp, Homo sapiens
cagtgaaaaagatatttt

SEQ ID NO: 3410137 - DNA, 15 bp, Homo sapiens
cagtgaatttaagca

SEQ ID NO: 3410138 - DNA, 16 bp, Homo sapiens
cagtgagggtcttctt

SEQ ID NO: 3410139 - DNA, 13 bp, Homo sapiens
cagtgagtgccat

SEQ ID NO: 3410140 - DNA, 18 bp, Homo sapiens
cagtgatatggcagaaga

SEQ ID NO: 3410141 - DNA, 15 bp, Homo sapiens
gtaggggtgtgtgtg

SEQ ID NO: 3410142 - DNA, 19 bp, Homo sapiens
gtataatctcctctgctca

SEQ ID NO: 3410143 - DNA, 14 bp, Homo sapiens
gtataatgctttct

SEQ ID NO: 3410144 - DNA, 14 bp, Homo sapiens
gtataatgtgtctg

SEQ ID NO: 3410145 - DNA, 21 bp, Homo sapiens
gtataatgtgtctgtgttgct

SEQ ID NO: 3410146 - DNA, 14 bp, Homo sapiens
gtatacatgtcaat

SEQ ID NO: 3410147 - DNA, 14 bp, Homo sapiens
gtatagtagaaaga

SEQ ID NO: 3410148 - DNA, 17 bp, Homo sapiens
gtatatattttttttta

SEQ ID NO: 3410149 - DNA, 18 bp, Homo sapiens
gtatatgaaatattttga

SEQ ID NO: 3410150 - DNA, 19 bp, Homo sapiens
gtatatgtgagaaatcaga

SEQ ID NO: 3410151 - DNA, 13 bp, Homo sapiens
gtatcctgctggt

SEQ ID NO: 3410152 - DNA, 15 bp, Homo sapiens
gtatctgcatgtaaa

SEQ ID NO: 3410153 - DNA, 21 bp, Homo sapiens
gtatctgcatgtaaaatcttc

SEQ ID NO: 3410154 - DNA, 18 bp, Homo sapiens
gtatgactaaagagagaa

SEQ ID NO: 3410155 - DNA, 20 bp, Homo sapiens
gtatgactaaagagagaatg

SEQ ID NO: 3410156 - DNA, 15 bp, Homo sapiens
gtatgtattaaactt

SEQ ID NO: 3410157 - DNA, 18 bp, Homo sapiens
gtatgtggaagtgtgggt

SEQ ID NO: 3410158 - DNA, 21 bp, Homo sapiens
gtatgtggatacagtcattat

SEQ ID NO: 3410159 - DNA, 20 bp, Homo sapiens
gtatgtgggggtctgtgtgt

SEQ ID NO: 3410160 - DNA, 15 bp, Homo sapiens
gtattcttaaaatgc

SEQ ID NO: 3410161 - DNA, 19 bp, Homo sapiens
gtattcttaaaatgcaata

SEQ ID NO: 3410162 - DNA, 15 bp, Homo sapiens
gtattgctccatttt

SEQ ID NO: 3410163 - DNA, 20 bp, Homo sapiens
gtattgctgtccttgaatgc

SEQ ID NO: 3410164 - DNA, 21 bp, Homo sapiens
gtatttaactacatctgcctc

SEQ ID NO: 3410165 - DNA, 16 bp, Homo sapiens
gtatttccagtgcaat

SEQ ID NO: 3410166 - DNA, 22 bp, Homo sapiens
gtattttatctttgattctcct

SEQ ID NO: 3410167 - DNA, 12 bp, Homo sapiens
gtattttccagc

SEQ ID NO: 3410168 - DNA, 23 bp, Homo sapiens
gtattttccagccttatgtgtta

SEQ ID NO: 3410169 - DNA, 15 bp, Homo sapiens
gtcaagtaagaagac

SEQ ID NO: 3410170 - DNA, 17 bp, Homo sapiens
gtcaataaaaataaatc

SEQ ID NO: 3410171 - DNA, 15 bp, Homo sapiens
gtcaatgtactagga

SEQ ID NO: 3410172 - DNA, 15 bp, Homo sapiens
gtcactttttcccct

SEQ ID NO: 3410173 - DNA, 16 bp, Homo sapiens
gtcactttttcccctg

SEQ ID NO: 3410174 - DNA, 17 bp, Homo sapiens
gtcagctactaatgatg

SEQ ID NO: 3410175 - DNA, 17 bp, Homo sapiens
gtcagtatgtggaagtg

SEQ ID NO: 3410176 - DNA, 22 bp, Homo sapiens
gtcatctccggggtggccacag

SEQ ID NO: 3410177 - DNA, 18 bp, Homo sapiens
gtcatgcataaatatgca

SEQ ID NO: 3410178 - DNA, 16 bp, Homo sapiens
gtcattatttaaagca

SEQ ID NO: 3410179 - DNA, 21 bp, Homo sapiens
gtcattatttgataacatttt

SEQ ID NO: 3410180 - DNA, 15 bp, Homo sapiens
gtcattcaataaatt

SEQ ID NO: 3410181 - DNA, 15 bp, Homo sapiens
gtcccacctggctcc

SEQ ID NO: 3410182 - DNA, 17 bp, Homo sapiens
gtcccacctggctcccc

SEQ ID NO: 3410183 - DNA, 20 bp, Homo sapiens
gtcccagaatgcctcctgca

SEQ ID NO: 3410184 - DNA, 17 bp, Homo sapiens
gtcccagattggctcac

SEQ ID NO: 3410185 - DNA, 20 bp, Homo sapiens
gtcccctctgccccaccctc

SEQ ID NO: 3410186 - DNA, 17 bp, Homo sapiens
gtccccttctctcatct

SEQ ID NO: 3410187 - DNA, 19 bp, Homo sapiens
gtccccttctctcatctct

SEQ ID NO: 3410188 - DNA, 21 bp, Homo sapiens
gtcccttgcccccctggcctc

SEQ ID NO: 3410189 - DNA, 14 bp, Homo sapiens
gtcctatgcaataa

SEQ ID NO: 3410190 - DNA, 20 bp, Homo sapiens
gtcctcaaagaagtggttct

SEQ ID NO: 3410191 - DNA, 14 bp, Homo sapiens
gtcctcctccaggg

SEQ ID NO: 3410192 - DNA, 18 bp, Homo sapiens
gtcctcctccagggacag

SEQ ID NO: 3410193 - DNA, 17 bp, Homo sapiens
gtcctttaggtttgaaa

SEQ ID NO: 3410194 - DNA, 16 bp, Homo sapiens
gtctagagtcatgtga

SEQ ID NO: 3410195 - DNA, 19 bp, Homo sapiens
gtctcaattttgtatttaa

SEQ ID NO: 3410196 - DNA, 17 bp, Homo sapiens
gtctccaaccccccagc

SEQ ID NO: 3410197 - DNA, 21 bp, Homo sapiens
gtctccaaccccccagcactg

SEQ ID NO: 3410198 - DNA, 22 bp, Homo sapiens
gtctccaaccccccagcactga

SEQ ID NO: 3410199 - DNA, 23 bp, Homo sapiens
gtctcctcttaaaaaataaaaac

SEQ ID NO: 3410200 - DNA, 15 bp, Homo sapiens
gtctctgaacatcct

SEQ ID NO: 3410201 - DNA, 12 bp, Homo sapiens
gtctgactcctt

SEQ ID NO: 3410202 - DNA, 23 bp, Homo sapiens
gtctgagtggcttcactcctgct

SEQ ID NO: 3410203 - DNA, 12 bp, Homo sapiens
gtctgtgtgtgt

SEQ ID NO: 3410204 - DNA, 20 bp, Homo sapiens
gtctgtgtgtgtgtatgtgg

SEQ ID NO: 3410205 - DNA, 11 bp, Homo sapiens
gtctgtgtgtt

SEQ ID NO: 3410206 - DNA, 22 bp, Homo sapiens
gtctgtgtgtttatgtgtgtgt

SEQ ID NO: 3410207 - DNA, 15 bp, Homo sapiens
gtctgtgttgcttca

SEQ ID NO: 3410208 - DNA, 16 bp, Homo sapiens
gtcttaactgtatttc

SEQ ID NO: 3410209 - DNA, 13 bp, Homo sapiens
gtcttactttgtg

SEQ ID NO: 3410210 - DNA, 17 bp, Homo sapiens
gtcttactttgtgcaaa

SEQ ID NO: 3410211 - DNA, 17 bp, Homo sapiens
gtcttgacctgaactct

SEQ ID NO: 3410212 - DNA, 18 bp, Homo sapiens
gtcttgacctgaactctg

SEQ ID NO: 3410213 - DNA, 21 bp, Homo sapiens
gtcttgacctgaactctgcaa

SEQ ID NO: 3410214 - DNA, 16 bp, Homo sapiens
gtctttctttgctgct

SEQ ID NO: 3410215 - DNA, 21 bp, Homo sapiens
gtctttctttgctgctgtgga

SEQ ID NO: 3410216 - DNA, 12 bp, Homo sapiens
gtctttgtaaga

SEQ ID NO: 3410217 - DNA, 20 bp, Homo sapiens
gtctttgtaagagtgtagaa

SEQ ID NO: 3410218 - DNA, 11 bp, Homo sapiens
gtgaaaaagat

SEQ ID NO: 3410219 - DNA, 17 bp, Homo sapiens
gtgaaaccttttttaag

SEQ ID NO: 3410220 - DNA, 21 bp, Homo sapiens
gtgaaaccttttttaagattt

SEQ ID NO: 3410221 - DNA, 14 bp, Homo sapiens
gtgaaattgtgtag

SEQ ID NO: 3410222 - DNA, 19 bp, Homo sapiens
gtgaagagggagaagcatg

SEQ ID NO: 3410223 - DNA, 12 bp, Homo sapiens
gtgaaggcctcg

SEQ ID NO: 3410224 - DNA, 14 bp, Homo sapiens
gtgaatggattgga

SEQ ID NO: 3410225 - DNA, 15 bp, Homo sapiens
gtgaatggattggat

SEQ ID NO: 3410226 - DNA, 17 bp, Homo sapiens
gtgaatttaagcatgag

SEQ ID NO: 3410227 - DNA, 15 bp, Homo sapiens
gtgacatgtgaaacc

SEQ ID NO: 3410228 - DNA, 22 bp, Homo sapiens
gtgactgcaagcatttttccat

SEQ ID NO: 3410229 - DNA, 18 bp, Homo sapiens
gtgagcctcgtgtcatct

SEQ ID NO: 3410230 - DNA, 16 bp, Homo sapiens
gtgagtggcatgtggg

SEQ ID NO: 3410231 - DNA, 16 bp, Homo sapiens
gtgatatggcagaaga

SEQ ID NO: 3410232 - DNA, 19 bp, Homo sapiens
gtgatattgaccatgtgat

SEQ ID NO: 3410233 - DNA, 17 bp, Homo sapiens
gtgatctcgactccccc

SEQ ID NO: 3410234 - DNA, 13 bp, Homo sapiens
gtgcaaacagtgt

SEQ ID NO: 3410235 - DNA, 13 bp, Homo sapiens
gtgcaaccaggga

SEQ ID NO: 3410236 - DNA, 14 bp, Homo sapiens
gtgcaactcttgta

SEQ ID NO: 3410237 - DNA, 15 bp, Homo sapiens
gtgcaactcttgtat

SEQ ID NO: 3410238 - DNA, 15 bp, Homo sapiens
gtgcaggtagacctg

SEQ ID NO: 3410239 - DNA, 22 bp, Homo sapiens
gtgcaggtagacctgtctcctg

SEQ ID NO: 3410240 - DNA, 16 bp, Homo sapiens
gtgcatttttgtgaaa

SEQ ID NO: 3410241 - DNA, 12 bp, Homo sapiens
gtgcctccctgg

SEQ ID NO: 3410242 - DNA, 13 bp, Homo sapiens
gtgcctccctggt

SEQ ID NO: 3410243 - DNA, 17 bp, Homo sapiens
gtgcgtgtgtagagtta

SEQ ID NO: 3410244 - DNA, 16 bp, Homo sapiens
gtgctacaggggccag

SEQ ID NO: 3410245 - DNA, 20 bp, Homo sapiens
gtgctacaggggccagaaga

SEQ ID NO: 3410246 - DNA, 23 bp, Homo sapiens
gtgctgagttggtgttgacatgt

SEQ ID NO: 3410247 - DNA, 15 bp, Homo sapiens
gtgctgatccttgca

SEQ ID NO: 3410248 - DNA, 20 bp, Homo sapiens
gtgcttaacgttttcttaaa

SEQ ID NO: 3410249 - DNA, 16 bp, Homo sapiens
gtggaaaggattctaa

SEQ ID NO: 3410250 - DNA, 14 bp, Homo sapiens
gtggaagcttgggg

SEQ ID NO: 3410251 - DNA, 19 bp, Homo sapiens
gtggaagcttggggaagac

SEQ ID NO: 3410252 - DNA, 15 bp, Homo sapiens
gtggaagtgtgggtc

SEQ ID NO: 3410253 - DNA, 22 bp, Homo sapiens
gtggaagtgtgggtctgtgtgt

SEQ ID NO: 3410254 - DNA, 20 bp, Homo sapiens
ggctgaaagaggccaatgcc

SEQ ID NO: 3410255 - DNA, 23 bp, Homo sapiens
ggctggttcggatttggggtgga

SEQ ID NO: 3410256 - DNA, 13 bp, Homo sapiens
ggcttacacccac

SEQ ID NO: 3410257 - DNA, 18 bp, Homo sapiens
ggcttcactgtataaata

SEQ ID NO: 3410258 - DNA, 15 bp, Homo sapiens
ggcttgcctgcaggc

SEQ ID NO: 3410259 - DNA, 17 bp, Homo sapiens
ggcttttaaaaggaaaa

SEQ ID NO: 3410260 - DNA, 19 bp, Homo sapiens
gggaaccatgaagctggaa

SEQ ID NO: 3410261 - DNA, 22 bp, Homo sapiens
gggaagacccattccttcccag

SEQ ID NO: 3410262 - DNA, 15 bp, Homo sapiens
gggaccagggcatat

SEQ ID NO: 3410263 - DNA, 21 bp, Homo sapiens
gggactgtctttcagatacat

SEQ ID NO: 3410264 - DNA, 20 bp, Homo sapiens
gggagagcccaggagctccc

SEQ ID NO: 3410265 - DNA, 11 bp, Homo sapiens
gggagtgtgta

SEQ ID NO: 3410266 - DNA, 15 bp, Homo sapiens
gggatggaaaaggaa

SEQ ID NO: 3410267 - DNA, 22 bp, Homo sapiens
gggcaaggatgggtccagaaga

SEQ ID NO: 3410268 - DNA, 16 bp, Homo sapiens
gggcacaggccatgga

SEQ ID NO: 3410269 - DNA, 20 bp, Homo sapiens
gggcagcagaagggggtggt

SEQ ID NO: 3410270 - DNA, 18 bp, Homo sapiens
gggcagccagggagagcc

SEQ ID NO: 3410271 - DNA, 21 bp, Homo sapiens
gggcagcgggagcctccctgc

SEQ ID NO: 3410272 - DNA, 17 bp, Homo sapiens
gggcaggcaagcccttc

SEQ ID NO: 3410273 - DNA, 18 bp, Homo sapiens
gggcagtgggtcccagat

SEQ ID NO: 3410274 - DNA, 17 bp, Homo sapiens
gggccgggcagaggggc

SEQ ID NO: 3410275 - DNA, 13 bp, Homo sapiens
gggcctgccacct

SEQ ID NO: 3410276 - DNA, 18 bp, Homo sapiens
gggctcagagtggggtag

SEQ ID NO: 3410277 - DNA, 12 bp, Homo sapiens
gggctcttctca

SEQ ID NO: 3410278 - DNA, 14 bp, Homo sapiens
gggctggactgagg

SEQ ID NO: 3410279 - DNA, 15 bp, Homo sapiens
gggctggactgaggc

SEQ ID NO: 3410280 - DNA, 23 bp, Homo sapiens
gggctggaggagcccaggccagg

SEQ ID NO: 3410281 - DNA, 16 bp, Homo sapiens
gggcttacggccctgg

SEQ ID NO: 3410282 - DNA, 16 bp, Homo sapiens
gggcttcactgtataa

SEQ ID NO: 3410283 - DNA, 22 bp, Homo sapiens
ggggaagacccattccttccca

SEQ ID NO: 3410284 - DNA, 12 bp, Homo sapiens
ggggcctgccac

SEQ ID NO: 3410285 - DNA, 19 bp, Homo sapiens
ggggcctgccacctggacc

SEQ ID NO: 3410286 - DNA, 16 bp, Homo sapiens
ggggctggaggagccc

SEQ ID NO: 3410287 - DNA, 23 bp, Homo sapiens
ggggctggaggagcccaggccag

SEQ ID NO: 3410288 - DNA, 20 bp, Homo sapiens
gggggcgctattgcttcagc

SEQ ID NO: 3410289 - DNA, 16 bp, Homo sapiens
gggggtcctcctccag

SEQ ID NO: 3410290 - DNA, 18 bp, Homo sapiens
gggtataatgtgtctgtg

SEQ ID NO: 3410291 - DNA, 16 bp, Homo sapiens
gggtcagccagggcct

SEQ ID NO: 3410292 - DNA, 18 bp, Homo sapiens
gggtcagccagggcctgc

SEQ ID NO: 3410293 - DNA, 20 bp, Homo sapiens
gggtccagaagaccccactt

SEQ ID NO: 3410294 - DNA, 11 bp, Homo sapiens
gggtccctgct

SEQ ID NO: 3410295 - DNA, 16 bp, Homo sapiens
gggttcaaaatgtctg

SEQ ID NO: 3410296 - DNA, 20 bp, Homo sapiens
gggttcacctgggctgaggc

SEQ ID NO: 3410297 - DNA, 14 bp, Homo sapiens
ggtaaataaagctc

SEQ ID NO: 3410298 - DNA, 15 bp, Homo sapiens
ggtactaaggagaat

SEQ ID NO: 3410299 - DNA, 11 bp, Homo sapiens
ggtagaacaca

SEQ ID NO: 3410300 - DNA, 18 bp, Homo sapiens
ggtaggaactgctgggct

SEQ ID NO: 3410301 - DNA, 23 bp, Homo sapiens
ggtagggggctggaggagcccag

SEQ ID NO: 3410302 - DNA, 17 bp, Homo sapiens
ggtataatgtgtctgtg

SEQ ID NO: 3410303 - DNA, 14 bp, Homo sapiens
ggtatctttatagt

SEQ ID NO: 3410304 - DNA, 21 bp, Homo sapiens
ggtatgaccttctaggaagct

SEQ ID NO: 3410305 - DNA, 11 bp, Homo sapiens
ggtatgtacag

SEQ ID NO: 3410306 - DNA, 20 bp, Homo sapiens
ggtcaagtaagaagacatga

SEQ ID NO: 3410307 - DNA, 13 bp, Homo sapiens
ggtcagccagggc

SEQ ID NO: 3410308 - DNA, 16 bp, Homo sapiens
ggtcatagcagtgctt

SEQ ID NO: 3410309 - DNA, 15 bp, Homo sapiens
ggtccacttcaatgt

SEQ ID NO: 3410310 - DNA, 19 bp, Homo sapiens
ggtcccctctgccccaccc

SEQ ID NO: 3410311 - DNA, 14 bp, Homo sapiens
ggtcctcctccagg

SEQ ID NO: 3410312 - DNA, 18 bp, Homo sapiens
ggtcctcctccagggaca

SEQ ID NO: 3410313 - DNA, 16 bp, Homo sapiens
ggtctccttggaaatc

SEQ ID NO: 3410314 - DNA, 20 bp, Homo sapiens
ggtctttgtaagagtgtaga

SEQ ID NO: 3410315 - DNA, 15 bp, Homo sapiens
ggtgacatgtgaaac

SEQ ID NO: 3410316 - DNA, 21 bp, Homo sapiens
ggtgagagggccgggcagagg

SEQ ID NO: 3410317 - DNA, 12 bp, Homo sapiens
ggtgcaaccagg

SEQ ID NO: 3410318 - DNA, 11 bp, Homo sapiens
ggtggggtgga

SEQ ID NO: 3410319 - DNA, 19 bp, Homo sapiens
ggtggttttcagattccac

SEQ ID NO: 3410320 - DNA, 15 bp, Homo sapiens
ggtgtaataagacat

SEQ ID NO: 3410321 - DNA, 18 bp, Homo sapiens
ggtgtaataagacataac

SEQ ID NO: 3410322 - DNA, 19 bp, Homo sapiens
ggtgtctccaaccccccag

SEQ ID NO: 3410323 - DNA, 13 bp, Homo sapiens
ggttaagaaatac

SEQ ID NO: 3410324 - DNA, 23 bp, Homo sapiens
ggttatcgaaataacaatgttaa

SEQ ID NO: 3410325 - DNA, 19 bp, Homo sapiens
ggttcctcgttctccctgg

SEQ ID NO: 3410326 - DNA, 12 bp, Homo sapiens
ggttctcatctt

SEQ ID NO: 3410327 - DNA, 12 bp, Homo sapiens
ggttgtgatatt

SEQ ID NO: 3410328 - DNA, 16 bp, Homo sapiens
ggtttacaacaaacac

SEQ ID NO: 3410329 - DNA, 17 bp, Homo sapiens
ggtttacaacaaacact

SEQ ID NO: 3410330 - DNA, 22 bp, Homo sapiens
ggtttctgatctgtactttgtg

SEQ ID NO: 3410331 - DNA, 18 bp, Homo sapiens
ggtttgcaaaagggcttc

SEQ ID NO: 3410332 - DNA, 14 bp, Homo sapiens
ggtttgcaaggaag

SEQ ID NO: 3410333 - DNA, 14 bp, Homo sapiens
ggtttttactgtta

SEQ ID NO: 3410334 - DNA, 12 bp, Homo sapiens
gtaaaagtgtct

SEQ ID NO: 3410335 - DNA, 17 bp, Homo sapiens
gtaaaatagttttgctt

SEQ ID NO: 3410336 - DNA, 16 bp, Homo sapiens
gtaaagtccccagaga

SEQ ID NO: 3410337 - DNA, 18 bp, Homo sapiens
gtaaatgaactgattttt

SEQ ID NO: 3410338 - DNA, 14 bp, Homo sapiens
gtaacagaacagct

SEQ ID NO: 3410339 - DNA, 18 bp, Homo sapiens
gtaacagaacagcttcag

SEQ ID NO: 3410340 - DNA, 17 bp, Homo sapiens
gtaagagtgtagaagca

SEQ ID NO: 3410341 - DNA, 11 bp, Homo sapiens
gtaaggctgta

SEQ ID NO: 3410342 - DNA, 17 bp, Homo sapiens
gtaaggctgtacatagt

SEQ ID NO: 3410343 - DNA, 20 bp, Homo sapiens
gtaagtataacaaactatgt

SEQ ID NO: 3410344 - DNA, 15 bp, Homo sapiens
gtaagtgaatttatg

SEQ ID NO: 3410345 - DNA, 15 bp, Homo sapiens
gtggaggaaggattg

SEQ ID NO: 3410346 - DNA, 16 bp, Homo sapiens
gtggaggaaggattgt

SEQ ID NO: 3410347 - DNA, 20 bp, Homo sapiens
gtggaggagctcaggacact

SEQ ID NO: 3410348 - DNA, 17 bp, Homo sapiens
gtggatggtgacttttg

SEQ ID NO: 3410349 - DNA, 21 bp, Homo sapiens
gtggccatatatgctgtattt

SEQ ID NO: 3410350 - DNA, 15 bp, Homo sapiens
gtggccctctcccct

SEQ ID NO: 3410351 - DNA, 19 bp, Homo sapiens
gtggccctctcccctgccc

SEQ ID NO: 3410352 - DNA, 12 bp, Homo sapiens
gtggcctatgaa

SEQ ID NO: 3410353 - DNA, 20 bp, Homo sapiens
gtggcttcttttctttgtat

SEQ ID NO: 3410354 - DNA, 13 bp, Homo sapiens
gtgggagtgtgta

SEQ ID NO: 3410355 - DNA, 14 bp, Homo sapiens
gtgggagtgtgtaa

SEQ ID NO: 3410356 - DNA, 22 bp, Homo sapiens
gtgggggtagggggctggagga

SEQ ID NO: 3410357 - DNA, 14 bp, Homo sapiens
gtgggggtctgtgt

SEQ ID NO: 3410358 - DNA, 16 bp, Homo sapiens
gtgggggtctgtgtgt

SEQ ID NO: 3410359 - DNA, 13 bp, Homo sapiens
gtgggtctgtgtg

SEQ ID NO: 3410360 - DNA, 13 bp, Homo sapiens
gtggttacacagt

SEQ ID NO: 3410361 - DNA, 14 bp, Homo sapiens
gtggttacacagtg

SEQ ID NO: 3410362 - DNA, 17 bp, Homo sapiens
gtgtaaacaaataataa

SEQ ID NO: 3410363 - DNA, 15 bp, Homo sapiens
gtgtaaataatataa

SEQ ID NO: 3410364 - DNA, 14 bp, Homo sapiens
gtgtagaagcattc

SEQ ID NO: 3410365 - DNA, 19 bp, Homo sapiens
gtgtagaagcattccttct

SEQ ID NO: 3410366 - DNA, 17 bp, Homo sapiens
gtgtagagttaagaagc

SEQ ID NO: 3410367 - DNA, 21 bp, Homo sapiens
gtgtatgagaagtactttgtg

SEQ ID NO: 3410368 - DNA, 23 bp, Homo sapiens
gtgtatggaatttttgaatctat

SEQ ID NO: 3410369 - DNA, 13 bp, Homo sapiens
gtgtatgtggggg

SEQ ID NO: 3410370 - DNA, 19 bp, Homo sapiens
gtgtctagtagaacaatgt

SEQ ID NO: 3410371 - DNA, 18 bp, Homo sapiens
gtgtctccaaccccccag

SEQ ID NO: 3410372 - DNA, 13 bp, Homo sapiens
gtgtctctgtata

SEQ ID NO: 3410373 - DNA, 11 bp, Homo sapiens
gtgtctgtgtt

SEQ ID NO: 3410374 - DNA, 22 bp, Homo sapiens
gtgtgcaactaactgactctgt

SEQ ID NO: 3410375 - DNA, 17 bp, Homo sapiens
gtgtgggagtgtgtaat

SEQ ID NO: 3410376 - DNA, 21 bp, Homo sapiens
gtgtgtatgactaaagagaga

SEQ ID NO: 3410377 - DNA, 22 bp, Homo sapiens
gtgtgtattcttaaaatgcaat

SEQ ID NO: 3410378 - DNA, 13 bp, Homo sapiens
gtgtgtgtgtgtg

SEQ ID NO: 3410379 - DNA, 14 bp, Homo sapiens
gtgtgtgtgtgtgt

SEQ ID NO: 3410380 - DNA, 12 bp, Homo sapiens
gtgtgttgtgtg

SEQ ID NO: 3410381 - DNA, 15 bp, Homo sapiens
gtgtgtttatgtgtg

SEQ ID NO: 3410382 - DNA, 16 bp, Homo sapiens
gtgtgtttatgtgtgt

SEQ ID NO: 3410383 - DNA, 22 bp, Homo sapiens
gtgttcactgtactctgtgggc

SEQ ID NO: 3410384 - DNA, 24 bp, Homo sapiens
gtgttggctgagggattctatttg

SEQ ID NO: 3410385 - DNA, 15 bp, Homo sapiens
gtgttgtgtgtggga

SEQ ID NO: 3410386 - DNA, 14 bp, Homo sapiens
gttaaataaataga

SEQ ID NO: 3410387 - DNA, 18 bp, Homo sapiens
gttaaatttgtaagtttc

SEQ ID NO: 3410388 - DNA, 12 bp, Homo sapiens
gttaagaaatac

SEQ ID NO: 3410389 - DNA, 20 bp, Homo sapiens
gttaagaagctgttgtacat

SEQ ID NO: 3410390 - DNA, 16 bp, Homo sapiens
gttaaggaaactctta

SEQ ID NO: 3410391 - DNA, 19 bp, Homo sapiens
gttaaggaaactcttatct

SEQ ID NO: 3410392 - DNA, 21 bp, Homo sapiens
gttaaggaaactcttatctca

SEQ ID NO: 3410393 - DNA, 20 bp, Homo sapiens
gttaatcagtgttgattcta

SEQ ID NO: 3410394 - DNA, 22 bp, Homo sapiens
gttacaggcaccgagaatgttg

SEQ ID NO: 3410395 - DNA, 19 bp, Homo sapiens
gttaccaagtatgaagtat

SEQ ID NO: 3410396 - DNA, 21 bp, Homo sapiens
gttacctgatcaatgacagag

SEQ ID NO: 3410397 - DNA, 14 bp, Homo sapiens
gttaccttactgaa

SEQ ID NO: 3410398 - DNA, 16 bp, Homo sapiens
gttacttagaatgcca

SEQ ID NO: 3410399 - DNA, 13 bp, Homo sapiens
gttagggaatggc

SEQ ID NO: 3410400 - DNA, 13 bp, Homo sapiens
gttagtagaactt

SEQ ID NO: 3410401 - DNA, 17 bp, Homo sapiens
gttataacttcataaaa

SEQ ID NO: 3410402 - DNA, 17 bp, Homo sapiens
gttatagattgtcttaa

SEQ ID NO: 3410403 - DNA, 14 bp, Homo sapiens
gttatcgaaataac

SEQ ID NO: 3410404 - DNA, 23 bp, Homo sapiens
gttatcgaaataacaatgttaag

SEQ ID NO: 3410405 - DNA, 16 bp, Homo sapiens
gttatgcaaatgagat

SEQ ID NO: 3410406 - DNA, 22 bp, Homo sapiens
gttattcttttccagaaagaaa

SEQ ID NO: 3410407 - DNA, 16 bp, Homo sapiens
gttatttttgtatttt

SEQ ID NO: 3410408 - DNA, 13 bp, Homo sapiens
gttcaaaatgtct

SEQ ID NO: 3410409 - DNA, 20 bp, Homo sapiens
gttcagtttttttttttcca

SEQ ID NO: 3410410 - DNA, 21 bp, Homo sapiens
gttcagtttttttttttccag

SEQ ID NO: 3410411 - DNA, 23 bp, Homo sapiens
gttcataaatttgttgtcatgtg

SEQ ID NO: 3410412 - DNA, 14 bp, Homo sapiens
gttccggcatggac

SEQ ID NO: 3410413 - DNA, 17 bp, Homo sapiens
gttcgtaccgcttcctt

SEQ ID NO: 3410414 - DNA, 15 bp, Homo sapiens
gttctacttgatatt

SEQ ID NO: 3410415 - DNA, 18 bp, Homo sapiens
gttctacttgatatttcc

SEQ ID NO: 3410416 - DNA, 11 bp, Homo sapiens
gttctcatctt

SEQ ID NO: 3410417 - DNA, 14 bp, Homo sapiens
gttctgaaattaaa

SEQ ID NO: 3410418 - DNA, 17 bp, Homo sapiens
gttcttacaagcttaaa

SEQ ID NO: 3410419 - DNA, 12 bp, Homo sapiens
gttcttgtcatc

SEQ ID NO: 3410420 - DNA, 16 bp, Homo sapiens
gttctttgcaagctta

SEQ ID NO: 3410421 - DNA, 18 bp, Homo sapiens
gttgaactgcaggaagag

SEQ ID NO: 3410422 - DNA, 19 bp, Homo sapiens
gttgacttgacagaacact

SEQ ID NO: 3410423 - DNA, 16 bp, Homo sapiens
gttgatccatctcagt

SEQ ID NO: 3410424 - DNA, 21 bp, Homo sapiens
gttgcttttgaaggaatacaa

SEQ ID NO: 3410425 - DNA, 12 bp, Homo sapiens
gttggcagctct

SEQ ID NO: 3410426 - DNA, 18 bp, Homo sapiens
gttggcagtgtttgtata

SEQ ID NO: 3410427 - DNA, 18 bp, Homo sapiens
gttgggatcgcattgcat

SEQ ID NO: 3410428 - DNA, 18 bp, Homo sapiens
gttgtatataaagttttt

SEQ ID NO: 3410429 - DNA, 18 bp, Homo sapiens
gttgtgcctccctggtga

SEQ ID NO: 3410430 - DNA, 12 bp, Homo sapiens
gttgtgtattgt

SEQ ID NO: 3410431 - DNA, 14 bp, Homo sapiens
gttgtgtgtgggag

SEQ ID NO: 3410432 - DNA, 13 bp, Homo sapiens
gttgtttctttct

SEQ ID NO: 3410433 - DNA, 14 bp, Homo sapiens
gtttaaatgccaaa

SEQ ID NO: 3410434 - DNA, 14 bp, Homo sapiens
gtttacaacaaaca

SEQ ID NO: 3410435 - DNA, 21 bp, Homo sapiens
gtttacaacaaacactgtgat

SEQ ID NO: 3410436 - DNA, 13 bp, Homo sapiens
gtttactcccttc

SEQ ID NO: 3410437 - DNA, 20 bp, Homo sapiens
gtttactcccttctgtagtt

SEQ ID NO: 3410438 - DNA, 16 bp, Homo sapiens
gtttagaagaagtgtg

SEQ ID NO: 3410439 - DNA, 14 bp, Homo sapiens
gtttataataaact

SEQ ID NO: 3410440 - DNA, 17 bp, Homo sapiens
gtttatatattgaaagt

SEQ ID NO: 3410441 - DNA, 13 bp, Homo sapiens
gtttatgagccag

SEQ ID NO: 3410442 - DNA, 13 bp, Homo sapiens
gtttatgtgtgtg

SEQ ID NO: 3410443 - DNA, 16 bp, Homo sapiens
gtttatgtgtgtgtgt

SEQ ID NO: 3410444 - DNA, 14 bp, Homo sapiens
gtttcaatttactt

SEQ ID NO: 3410445 - DNA, 10 bp, Homo sapiens
gtttcaggtg

SEQ ID NO: 3410446 - DNA, 14 bp, Homo sapiens
gtttcaggtgacat

SEQ ID NO: 3410447 - DNA, 15 bp, Homo sapiens
gtttcaggtgacatg

SEQ ID NO: 3410448 - DNA, 20 bp, Homo sapiens
gtttctgaaaattaacactg

SEQ ID NO: 3410449 - DNA, 20 bp, Homo sapiens
gtttctgatctgtactttgt

SEQ ID NO: 3410450 - DNA, 22 bp, Homo sapiens
gtttctgatctgtactttgtgt

SEQ ID NO: 3410451 - DNA, 23 bp, Homo sapiens
gtttctgatctgtactttgtgtt

SEQ ID NO: 3410452 - DNA, 20 bp, Homo sapiens
gtttcttagacctcttcctg

SEQ ID NO: 3410453 - DNA, 16 bp, Homo sapiens
gtttcttagcttttta

SEQ ID NO: 3410454 - DNA, 11 bp, Homo sapiens
gtttcttgctt

SEQ ID NO: 3410455 - DNA, 19 bp, Homo sapiens
gtttgaatataaacactat

SEQ ID NO: 3410456 - DNA, 16 bp, Homo sapiens
gtttgacgaagaaaca

SEQ ID NO: 3410457 - DNA, 17 bp, Homo sapiens
gtttgatagtgcttctt

SEQ ID NO: 3410458 - DNA, 15 bp, Homo sapiens
gtttgatgaggccct

SEQ ID NO: 3410459 - DNA, 19 bp, Homo sapiens
gtttgatgaggccctccac

SEQ ID NO: 3410460 - DNA, 20 bp, Homo sapiens
gtttgatgaggccctccaca

SEQ ID NO: 3410461 - DNA, 17 bp, Homo sapiens
gtttgccaagctaatct

SEQ ID NO: 3410462 - DNA, 18 bp, Homo sapiens
gtttgccggtggtgcagg

SEQ ID NO: 3410463 - DNA, 17 bp, Homo sapiens
gtttgtcctttaactat

SEQ ID NO: 3410464 - DNA, 23 bp, Homo sapiens
gttttatttatatcttgttatta

SEQ ID NO: 3410465 - DNA, 23 bp, Homo sapiens
gttttcttaaatgttttcattgg

SEQ ID NO: 3410466 - DNA, 15 bp, Homo sapiens
gttttcttctaatca

SEQ ID NO: 3410467 - DNA, 15 bp, Homo sapiens
gttttgaaaagctat

SEQ ID NO: 3410468 - DNA, 13 bp, Homo sapiens
gttttgtaaagtc

SEQ ID NO: 3410469 - DNA, 19 bp, Homo sapiens
gttttgtggaggagctcag

SEQ ID NO: 3410470 - DNA, 19 bp, Homo sapiens
gtttttaactcaatatttt

SEQ ID NO: 3410471 - DNA, 14 bp, Homo sapiens
gtttttcctttaaa

SEQ ID NO: 3410472 - DNA, 19 bp, Homo sapiens
taaaaaaaaaaagattgta

SEQ ID NO: 3410473 - DNA, 15 bp, Homo sapiens
taaaaaatgtgtgta

SEQ ID NO: 3410474 - DNA, 22 bp, Homo sapiens
taaaaaatgtgtgtattcttaa

SEQ ID NO: 3410475 - DNA, 19 bp, Homo sapiens
taaaaataaagctactgaa

SEQ ID NO: 3410476 - DNA, 20 bp, Homo sapiens
taaaaataaagctactgaat

SEQ ID NO: 3410477 - DNA, 12 bp, Homo sapiens
taaaaatacatt

SEQ ID NO: 3410478 - DNA, 17 bp, Homo sapiens
taaaaatcattgattgt

SEQ ID NO: 3410479 - DNA, 18 bp, Homo sapiens
taaaagtcattattcctg

SEQ ID NO: 3410480 - DNA, 15 bp, Homo sapiens
taaaataattctaaa

SEQ ID NO: 3410481 - DNA, 17 bp, Homo sapiens
taaaataattctaaagg

SEQ ID NO: 3410482 - DNA, 22 bp, Homo sapiens
taaaatatatactatatgaaaa

SEQ ID NO: 3410483 - DNA, 18 bp, Homo sapiens
taaaatcttcagctggtg

SEQ ID NO: 3410484 - DNA, 14 bp, Homo sapiens
taaaatcttgcatg

SEQ ID NO: 3410485 - DNA, 20 bp, Homo sapiens
taaaattgcagtttcatgta

SEQ ID NO: 3410486 - DNA, 21 bp, Homo sapiens
taaaattgcagtttcatgtat

SEQ ID NO: 3410487 - DNA, 23 bp, Homo sapiens
taaaattgcagtttcatgtatgt

SEQ ID NO: 3410488 - DNA, 24 bp, Homo sapiens
taaaattgcagtttcatgtatgta

SEQ ID NO: 3410489 - DNA, 16 bp, Homo sapiens
taaaattgtgatgtgt

SEQ ID NO: 3410490 - DNA, 15 bp, Homo sapiens
taaaattttttactt

SEQ ID NO: 3410491 - DNA, 19 bp, Homo sapiens
taaacaaatgtatgattac

SEQ ID NO: 3410492 - DNA, 17 bp, Homo sapiens
taaacagatgtccctga

SEQ ID NO: 3410493 - DNA, 16 bp, Homo sapiens
taaacagtgtttatga

SEQ ID NO: 3410494 - DNA, 23 bp, Homo sapiens
taaacatctgtgtctgtgtctgc

SEQ ID NO: 3410495 - DNA, 16 bp, Homo sapiens
taaaccttgtttcttt

SEQ ID NO: 3410496 - DNA, 21 bp, Homo sapiens
taaaccttgtttctttctgaa

SEQ ID NO: 3410497 - DNA, 24 bp, Homo sapiens
taaactcctactgcttcctctgaa

SEQ ID NO: 3410498 - DNA, 14 bp, Homo sapiens
taaactctaaagat

SEQ ID NO: 3410499 - DNA, 20 bp, Homo sapiens
taaactggtattttatcttt

SEQ ID NO: 3410500 - DNA, 13 bp, Homo sapiens
taaacttgtgtat

SEQ ID NO: 3410501 - DNA, 14 bp, Homo sapiens
taaacttgtgtatt

SEQ ID NO: 3410502 - DNA, 17 bp, Homo sapiens
taaacttttataccaag

SEQ ID NO: 3410503 - DNA, 13 bp, Homo sapiens
taaagaaaatgtg

SEQ ID NO: 3410504 - DNA, 16 bp, Homo sapiens
taaagaaaatgtgtct

SEQ ID NO: 3410505 - DNA, 12 bp, Homo sapiens
taaagagagaat

SEQ ID NO: 3410506 - DNA, 17 bp, Homo sapiens
taaagaggctgaaagag

SEQ ID NO: 3410507 - DNA, 17 bp, Homo sapiens
taaagctactgaattta

SEQ ID NO: 3410508 - DNA, 22 bp, Homo sapiens
taaagcttgatttgatctttgt

SEQ ID NO: 3410509 - DNA, 23 bp, Homo sapiens
taaagcttgatttgatctttgtt

SEQ ID NO: 3410510 - DNA, 15 bp, Homo sapiens
taaagctttatcttt

SEQ ID NO: 3410511 - DNA, 21 bp, Homo sapiens
taaaggacaaacagtgaattt

SEQ ID NO: 3410512 - DNA, 17 bp, Homo sapiens
taaagggagaaatgcca

SEQ ID NO: 3410513 - DNA, 16 bp, Homo sapiens
taaagtaaacttgtgt

SEQ ID NO: 3410514 - DNA, 12 bp, Homo sapiens
taaagtaccaga

SEQ ID NO: 3410515 - DNA, 17 bp, Homo sapiens
taaataggttttaaacg

SEQ ID NO: 3410516 - DNA, 22 bp, Homo sapiens
taaatatagttgtctttctttg

SEQ ID NO: 3410517 - DNA, 17 bp, Homo sapiens
taaatatatgtatacat

SEQ ID NO: 3410518 - DNA, 18 bp, Homo sapiens
taaatatatgtatacata

SEQ ID NO: 3410519 - DNA, 21 bp, Homo sapiens
taaatatctgaacatttacta

SEQ ID NO: 3410520 - DNA, 14 bp, Homo sapiens
taaatatgcagtga

SEQ ID NO: 3410521 - DNA, 16 bp, Homo sapiens
taaatatgcagtgata

SEQ ID NO: 3410522 - DNA, 17 bp, Homo sapiens
taaatatgcagtgatat

SEQ ID NO: 3410523 - DNA, 22 bp, Homo sapiens
taaatattggtttgttattctt

SEQ ID NO: 3410524 - DNA, 21 bp, Homo sapiens
taaatcagtttattaaatctg

SEQ ID NO: 3410525 - DNA, 21 bp, Homo sapiens
taaatcatttggttaaatcat

SEQ ID NO: 3410526 - DNA, 19 bp, Homo sapiens
taaatcattttaggaaagg

SEQ ID NO: 3410527 - DNA, 18 bp, Homo sapiens
taaatctgaattttaaaa

SEQ ID NO: 3410528 - DNA, 15 bp, Homo sapiens
taaatctggggaaga

SEQ ID NO: 3410529 - DNA, 15 bp, Homo sapiens
taaatgaactgattt

SEQ ID NO: 3410530 - DNA, 16 bp, Homo sapiens
taaatgaactgatttt

SEQ ID NO: 3410531 - DNA, 18 bp, Homo sapiens
taaatgagggtttctgat

SEQ ID NO: 3410532 - DNA, 20 bp, Homo sapiens
taaatgagggtttctgatct

SEQ ID NO: 3410533 - DNA, 23 bp, Homo sapiens
taaatgagggtttctgatctgta

SEQ ID NO: 3410534 - DNA, 19 bp, Homo sapiens
taaatgcatagagcaatta

SEQ ID NO: 3410535 - DNA, 24 bp, Homo sapiens
taaatgcatagagcaattaaactg

SEQ ID NO: 3410536 - DNA, 19 bp, Homo sapiens
taaattcgctgtgagtgag

SEQ ID NO: 3410537 - DNA, 23 bp, Homo sapiens
taaattcgctgtgagtgagtggt

SEQ ID NO: 3410538 - DNA, 17 bp, Homo sapiens
taaattctctctaacat

SEQ ID NO: 3410539 - DNA, 19 bp, Homo sapiens
taaattctctctaacataa

SEQ ID NO: 3410540 - DNA, 15 bp, Homo sapiens
taaattgcctttgta

SEQ ID NO: 3410541 - DNA, 19 bp, Homo sapiens
taaattgttataacttcat

SEQ ID NO: 3410542 - DNA, 21 bp, Homo sapiens
taaattgttataacttcataa

SEQ ID NO: 3410543 - DNA, 21 bp, Homo sapiens
taaatttaggtaaataaagct

SEQ ID NO: 3410544 - DNA, 22 bp, Homo sapiens
taaatttaggtaaataaagctc

SEQ ID NO: 3410545 - DNA, 16 bp, Homo sapiens
taaatttgaactccat

SEQ ID NO: 3410546 - DNA, 21 bp, Homo sapiens
taaatttgaactccatgggat

SEQ ID NO: 3410547 - DNA, 12 bp, Homo sapiens
taaatttgtaag

SEQ ID NO: 3410548 - DNA, 19 bp, Homo sapiens
taaatttgtaagtttcagg

SEQ ID NO: 3410549 - DNA, 12 bp, Homo sapiens
taacaatgttaa

SEQ ID NO: 3410550 - DNA, 15 bp, Homo sapiens
taacaatgttaagga

SEQ ID NO: 3410551 - DNA, 21 bp, Homo sapiens
taacaatgttaaggaaactct

SEQ ID NO: 3410552 - DNA, 20 bp, Homo sapiens
taacagaacagcttcaggtt

SEQ ID NO: 3410553 - DNA, 21 bp, Homo sapiens
taacagaacagcttcaggtta

SEQ ID NO: 3410554 - DNA, 19 bp, Homo sapiens
taacagacactgtaaaata

SEQ ID NO: 3410555 - DNA, 16 bp, Homo sapiens
taacagagaaatagag

SEQ ID NO: 3410556 - DNA, 16 bp, Homo sapiens
taacaggtctcctctt

SEQ ID NO: 3410557 - DNA, 23 bp, Homo sapiens
taacattaaagcaatctgttgaa

SEQ ID NO: 3410558 - DNA, 17 bp, Homo sapiens
taacattaccttactgt

SEQ ID NO: 3410559 - DNA, 17 bp, Homo sapiens
taacattcctaaaatgc

SEQ ID NO: 3410560 - DNA, 20 bp, Homo sapiens
taacattcctaaaatgcttc

SEQ ID NO: 3410561 - DNA, 14 bp, Homo sapiens
taacattgatttta

SEQ ID NO: 3410562 - DNA, 11 bp, Homo sapiens
taacattttgt

SEQ ID NO: 3410563 - DNA, 19 bp, Homo sapiens
taacctataaagtgtttat

SEQ ID NO: 3410564 - DNA, 15 bp, Homo sapiens
taacgtttttccttt

SEQ ID NO: 3410565 - DNA, 18 bp, Homo sapiens
taacgtttttcctttaaa

SEQ ID NO: 3410566 - DNA, 16 bp, Homo sapiens
taactaaatgctcata

SEQ ID NO: 3410567 - DNA, 15 bp, Homo sapiens
taactacatctgcct

SEQ ID NO: 3410568 - DNA, 18 bp, Homo sapiens
taactccccctcattcac

SEQ ID NO: 3410569 - DNA, 17 bp, Homo sapiens
taactctgtaaaagtgt

SEQ ID NO: 3410570 - DNA, 23 bp, Homo sapiens
taactgcccagcggacagtggca

SEQ ID NO: 3410571 - DNA, 12 bp, Homo sapiens
taactgcttttg

SEQ ID NO: 3410572 - DNA, 14 bp, Homo sapiens
taactgtgatgaaa

SEQ ID NO: 3410573 - DNA, 21 bp, Homo sapiens
taactgtgatgaaatatgaaa

SEQ ID NO: 3410574 - DNA, 22 bp, Homo sapiens
taacttaaaagaacatgtatat

SEQ ID NO: 3410575 - DNA, 16 bp, Homo sapiens
taagaaacaatttaaa

SEQ ID NO: 3410576 - DNA, 22 bp, Homo sapiens
taagaaagccaccttgttacaa

SEQ ID NO: 3410577 - DNA, 11 bp, Homo sapiens
taagaaatacc

SEQ ID NO: 3410578 - DNA, 15 bp, Homo sapiens
taagaagctgttgta

SEQ ID NO: 3410579 - DNA, 12 bp, Homo sapiens
taagaatagtct

SEQ ID NO: 3410580 - DNA, 17 bp, Homo sapiens
taagacataacgttttt

SEQ ID NO: 3410581 - DNA, 22 bp, Homo sapiens
taagagtgtagaagcattcctt

SEQ ID NO: 3410582 - DNA, 20 bp, Homo sapiens
taagatactcaagcaggttt

SEQ ID NO: 3410583 - DNA, 15 bp, Homo sapiens
taagatcacacaaat

SEQ ID NO: 3410584 - DNA, 21 bp, Homo sapiens
taagatttttctcaaagtttt

SEQ ID NO: 3410585 - DNA, 15 bp, Homo sapiens
taagcagagttcttt

SEQ ID NO: 3410586 - DNA, 17 bp, Homo sapiens
taagccagcaccggacc

SEQ ID NO: 3410587 - DNA, 12 bp, Homo sapiens
taagctctgagc

SEQ ID NO: 3410588 - DNA, 20 bp, Homo sapiens
taaggaaactcttatctcag

SEQ ID NO: 3410589 - DNA, 16 bp, Homo sapiens
taaggaaccctggaaa

SEQ ID NO: 3410590 - DNA, 21 bp, Homo sapiens
taaggtatctggtatctgcat

SEQ ID NO: 3410591 - DNA, 17 bp, Homo sapiens
taaggtcatagattctt

SEQ ID NO: 3410592 - DNA, 18 bp, Homo sapiens
taaggtcatagattcttg

SEQ ID NO: 3410593 - DNA, 14 bp, Homo sapiens
taagtataacaaac

SEQ ID NO: 3410594 - DNA, 15 bp, Homo sapiens
taagtataacaaact

SEQ ID NO: 3410595 - DNA, 18 bp, Homo sapiens
taagtataacaaactatg

SEQ ID NO: 3410596 - DNA, 19 bp, Homo sapiens
taagtataacaaactatgt

SEQ ID NO: 3410597 - DNA, 17 bp, Homo sapiens
taagtcttggtaacaaa

SEQ ID NO: 3410598 - DNA, 18 bp, Homo sapiens
taagtgcgtgtgtagagt

SEQ ID NO: 3410599 - DNA, 19 bp, Homo sapiens
taagtgcgtgtgtagagtt

SEQ ID NO: 3410600 - DNA, 23 bp, Homo sapiens
taagtgcgtgtgtagagttaaga

SEQ ID NO: 3410601 - DNA, 17 bp, Homo sapiens
taagtgttgaaaaatat

SEQ ID NO: 3410602 - DNA, 17 bp, Homo sapiens
taagtttcaggtgacat

SEQ ID NO: 3410603 - DNA, 19 bp, Homo sapiens
taagtttcaggtgacatgt

SEQ ID NO: 3410604 - DNA, 22 bp, Homo sapiens
taagtttcaggtgacatgtgaa

SEQ ID NO: 3410605 - DNA, 12 bp, Homo sapiens
taataaaatata

SEQ ID NO: 3410606 - DNA, 20 bp, Homo sapiens
taataaactcttaagagaac

SEQ ID NO: 3410607 - DNA, 16 bp, Homo sapiens
taataaatgcatagag

SEQ ID NO: 3410608 - DNA, 18 bp, Homo sapiens
taataaatgcatagagca

SEQ ID NO: 3410609 - DNA, 15 bp, Homo sapiens
taataacattacctt

SEQ ID NO: 3410610 - DNA, 21 bp, Homo sapiens
taataacattaccttactgtg

SEQ ID NO: 3410611 - DNA, 19 bp, Homo sapiens
taataagacataacgtttt

SEQ ID NO: 3410612 - DNA, 14 bp, Homo sapiens
taataataaatgca

SEQ ID NO: 3410613 - DNA, 20 bp, Homo sapiens
taatataaaagatcttgcag

SEQ ID NO: 3410614 - DNA, 11 bp, Homo sapiens
taatatgagaa

SEQ ID NO: 3410615 - DNA, 16 bp, Homo sapiens
taatatgagaatgtat

SEQ ID NO: 3410616 - DNA, 17 bp, Homo sapiens
taatatgagaatgtatt

SEQ ID NO: 3410617 - DNA, 16 bp, Homo sapiens
taatattagcttgctt

SEQ ID NO: 3410618 - DNA, 13 bp, Homo sapiens
taatatttcttca

SEQ ID NO: 3410619 - DNA, 22 bp, Homo sapiens
taatcataacatagttgaaaaa

SEQ ID NO: 3410620 - DNA, 20 bp, Homo sapiens
taatctaagtatatgtgaga

SEQ ID NO: 3410621 - DNA, 12 bp, Homo sapiens
taatctatatta

SEQ ID NO: 3410622 - DNA, 22 bp, Homo sapiens
taatctccacccaatgaatgat

SEQ ID NO: 3410623 - DNA, 11 bp, Homo sapiens
taatctgcctg

SEQ ID NO: 3410624 - DNA, 12 bp, Homo sapiens
taatctgttgtt

SEQ ID NO: 3410625 - DNA, 14 bp, Homo sapiens
taatctgttgtttg

SEQ ID NO: 3410626 - DNA, 11 bp, Homo sapiens
taatgatgttt

SEQ ID NO: 3410627 - DNA, 15 bp, Homo sapiens
taatgatttcctctg

SEQ ID NO: 3410628 - DNA, 16 bp, Homo sapiens
taatgctttctgagtg

SEQ ID NO: 3410629 - DNA, 17 bp, Homo sapiens
taatgtagggttatatt

SEQ ID NO: 3410630 - DNA, 19 bp, Homo sapiens
taatgtctctgtgagactc

SEQ ID NO: 3410631 - DNA, 11 bp, Homo sapiens
taatgtgcagg

SEQ ID NO: 3410632 - DNA, 13 bp, Homo sapiens
taatgtgtctgtg

SEQ ID NO: 3410633 - DNA, 15 bp, Homo sapiens
taatgtgtctgtgtt

SEQ ID NO: 3410634 - DNA, 22 bp, Homo sapiens
taatgttaaatttgtaagtttc

SEQ ID NO: 3410635 - DNA, 18 bp, Homo sapiens
taatgtttatgagccaga

SEQ ID NO: 3410636 - DNA, 14 bp, Homo sapiens
taattaaaaacttt

SEQ ID NO: 3410637 - DNA, 19 bp, Homo sapiens
taattaaaaactttaaaga

SEQ ID NO: 3410638 - DNA, 20 bp, Homo sapiens
taattaaaaactttaaagat

SEQ ID NO: 3410639 - DNA, 12 bp, Homo sapiens
taattctaaagg

SEQ ID NO: 3410640 - DNA, 19 bp, Homo sapiens
taattctttgacctgttgg

SEQ ID NO: 3410641 - DNA, 15 bp, Homo sapiens
taattgaaatttaaa

SEQ ID NO: 3410642 - DNA, 21 bp, Homo sapiens
taattggcccaagtcattgtt

SEQ ID NO: 3410643 - DNA, 16 bp, Homo sapiens
taattgttccttgctt

SEQ ID NO: 3410644 - DNA, 14 bp, Homo sapiens
taattgttgtttct

SEQ ID NO: 3410645 - DNA, 15 bp, Homo sapiens
taattgttgtttctt

SEQ ID NO: 3410646 - DNA, 14 bp, Homo sapiens
taatttagagcgtt

SEQ ID NO: 3410647 - DNA, 19 bp, Homo sapiens
taatttagtcccttaaaaa

SEQ ID NO: 3410648 - DNA, 18 bp, Homo sapiens
taattttagtattaactc

SEQ ID NO: 3410649 - DNA, 18 bp, Homo sapiens
taattttgtctttcaaat

SEQ ID NO: 3410650 - DNA, 18 bp, Homo sapiens
tacaaacaaaatttctat

SEQ ID NO: 3410651 - DNA, 17 bp, Homo sapiens
tacaaacatgtggttaa

SEQ ID NO: 3410652 - DNA, 15 bp, Homo sapiens
tacaacaaacactgt

SEQ ID NO: 3410653 - DNA, 15 bp, Homo sapiens
tacaactcccccacc

SEQ ID NO: 3410654 - DNA, 16 bp, Homo sapiens
tacaagctacagttgt

SEQ ID NO: 3410655 - DNA, 16 bp, Homo sapiens
tacaagcttaaagctt

SEQ ID NO: 3410656 - DNA, 14 bp, Homo sapiens
tacaaggtatgtac

SEQ ID NO: 3410657 - DNA, 18 bp, Homo sapiens
tacaagtcagtttctaca

SEQ ID NO: 3410658 - DNA, 17 bp, Homo sapiens
tacacaacatgtatgtg

SEQ ID NO: 3410659 - DNA, 16 bp, Homo sapiens
tacacagacccctccc

SEQ ID NO: 3410660 - DNA, 16 bp, Homo sapiens
tacagagattgtagta

SEQ ID NO: 3410661 - DNA, 14 bp, Homo sapiens
tacagaggacagta

SEQ ID NO: 3410662 - DNA, 21 bp, Homo sapiens
tacagatgtagatataaatat

SEQ ID NO: 3410663 - DNA, 15 bp, Homo sapiens
tacagtctcaatttt

SEQ ID NO: 3410664 - DNA, 21 bp, Homo sapiens
tacatacagagattgtagtat

SEQ ID NO: 3410665 - DNA, 12 bp, Homo sapiens
tacatagtcctt

SEQ ID NO: 3410666 - DNA, 14 bp, Homo sapiens
tacatgcatttgag

SEQ ID NO: 3410667 - DNA, 15 bp, Homo sapiens
tacattaaacaatga

SEQ ID NO: 3410668 - DNA, 17 bp, Homo sapiens
tacatttatgatttaat

SEQ ID NO: 3410669 - DNA, 18 bp, Homo sapiens
tacattttggatttcttt

SEQ ID NO: 3410670 - DNA, 21 bp, Homo sapiens
taccaagtatgaagtataaat

SEQ ID NO: 3410671 - DNA, 19 bp, Homo sapiens
taccagctagccagtcact

SEQ ID NO: 3410672 - DNA, 19 bp, Homo sapiens
taccagtgggcatgtatta

SEQ ID NO: 3410673 - DNA, 21 bp, Homo sapiens
taccatcccggtgcatgcagg

SEQ ID NO: 3410674 - DNA, 16 bp, Homo sapiens
taccatgtgtgctaat

SEQ ID NO: 3410675 - DNA, 23 bp, Homo sapiens
taccattaatcagaaacatcatg

SEQ ID NO: 3410676 - DNA, 14 bp, Homo sapiens
tacccagtcatgta

SEQ ID NO: 3410677 - DNA, 14 bp, Homo sapiens
taccgcttccttag

SEQ ID NO: 3410678 - DNA, 16 bp, Homo sapiens
tacctcaggaaagaat

SEQ ID NO: 3410679 - DNA, 16 bp, Homo sapiens
tacctgccttttaagt

SEQ ID NO: 3410680 - DNA, 19 bp, Homo sapiens
tacctgccttttaagtttg

SEQ ID NO: 3410681 - DNA, 18 bp, Homo sapiens
tacgtataatgctttctg

SEQ ID NO: 3410682 - DNA, 13 bp, Homo sapiens
tacgtatgagacg

SEQ ID NO: 3410683 - DNA, 15 bp, Homo sapiens
tactaggatactgct

SEQ ID NO: 3410684 - DNA, 12 bp, Homo sapiens
tactatatgaaa

SEQ ID NO: 3410685 - DNA, 14 bp, Homo sapiens
tactatatgaaaag

SEQ ID NO: 3410686 - DNA, 23 bp, Homo sapiens
tactcccagggcttacggccctg

SEQ ID NO: 3410687 - DNA, 15 bp, Homo sapiens
tactcccttctgtag

SEQ ID NO: 3410688 - DNA, 14 bp, Homo sapiens
tactctgaaatgca

SEQ ID NO: 3410689 - DNA, 21 bp, Homo sapiens
tactctgctttttttctactg

SEQ ID NO: 3410690 - DNA, 22 bp, Homo sapiens
tactcttaaatcatttggttaa

SEQ ID NO: 3410691 - DNA, 14 bp, Homo sapiens
tactgcttctcttt

SEQ ID NO: 3410692 - DNA, 17 bp, Homo sapiens
tactgcttctctttgtg

SEQ ID NO: 3410693 - DNA, 16 bp, Homo sapiens
tactgtggaggaagga

SEQ ID NO: 3410694 - DNA, 23 bp, Homo sapiens
tactgtggaggaaggattgtaaa

SEQ ID NO: 3410695 - DNA, 17 bp, Homo sapiens
tacttagaatgccataa

SEQ ID NO: 3410696 - DNA, 16 bp, Homo sapiens
tacttgatatttcctt

SEQ ID NO: 3410697 - DNA, 18 bp, Homo sapiens
tacttgatatttccttca

SEQ ID NO: 3410698 - DNA, 22 bp, Homo sapiens
tacttgcagctcccattctatg

SEQ ID NO: 3410699 - DNA, 21 bp, Homo sapiens
tactttgcctttccataatca

SEQ ID NO: 3410700 - DNA, 14 bp, Homo sapiens
tactttgtgctgat

SEQ ID NO: 3410701 - DNA, 14 bp, Homo sapiens
tacttttaaaataa

SEQ ID NO: 3410702 - DNA, 23 bp, Homo sapiens
tacttttaactatttttttagtt

SEQ ID NO: 3410703 - DNA, 15 bp, Homo sapiens
tacttttacattaaa

SEQ ID NO: 3410704 - DNA, 19 bp, Homo sapiens
tagaaagacatctgcctgt

SEQ ID NO: 3410705 - DNA, 22 bp, Homo sapiens
tagacaagtccagcctggcaag

SEQ ID NO: 3410706 - DNA, 16 bp, Homo sapiens
tagacctgtctcctgg

SEQ ID NO: 3410707 - DNA, 19 bp, Homo sapiens
tagagatatttaaaagaca

SEQ ID NO: 3410708 - DNA, 18 bp, Homo sapiens
tagagcaattaaactgtg

SEQ ID NO: 3410709 - DNA, 17 bp, Homo sapiens
tagaggctgcctgggcc

SEQ ID NO: 3410710 - DNA, 16 bp, Homo sapiens
tagagtaatgatgtaa

SEQ ID NO: 3410711 - DNA, 12 bp, Homo sapiens
tagagttaagaa

SEQ ID NO: 3410712 - DNA, 15 bp, Homo sapiens
tagagttaagaagct

SEQ ID NO: 3410713 - DNA, 20 bp, Homo sapiens
tagattgcaaatattggtta

SEQ ID NO: 3410714 - DNA, 15 bp, Homo sapiens
tagatttgaaaaact

SEQ ID NO: 3410715 - DNA, 12 bp, Homo sapiens
tagcatttattt

SEQ ID NO: 3410716 - DNA, 23 bp, Homo sapiens
tagccaggatcatggtgtaataa

SEQ ID NO: 3410717 - DNA, 17 bp, Homo sapiens
tagccagtcattgtaac

SEQ ID NO: 3410718 - DNA, 13 bp, Homo sapiens
tagccctcccact

SEQ ID NO: 3410719 - DNA, 17 bp, Homo sapiens
tagccctcccactttgc

SEQ ID NO: 3410720 - DNA, 14 bp, Homo sapiens
tagctaataataaa

SEQ ID NO: 3410721 - DNA, 19 bp, Homo sapiens
tagctacctttttatattt

SEQ ID NO: 3410722 - DNA, 21 bp, Homo sapiens
tagctccccaatccctgaccc

SEQ ID NO: 3410723 - DNA, 14 bp, Homo sapiens
tagctctacacaac

SEQ ID NO: 3410724 - DNA, 16 bp, Homo sapiens
tagctggcaagaatgg

SEQ ID NO: 3410725 - DNA, 15 bp, Homo sapiens
tagcttggaaactgg

SEQ ID NO: 3410726 - DNA, 20 bp, Homo sapiens
tagcttggaaactggatgag

SEQ ID NO: 3410727 - DNA, 13 bp, Homo sapiens
tagctttacagat

SEQ ID NO: 3410728 - DNA, 18 bp, Homo sapiens
taggaactgctgggcttg

SEQ ID NO: 3410729 - DNA, 14 bp, Homo sapiens
taggatactgctgc

SEQ ID NO: 3410730 - DNA, 21 bp, Homo sapiens
taggcacttttattttcattg

SEQ ID NO: 3410731 - DNA, 20 bp, Homo sapiens
taggcagattgaaaaggaca

SEQ ID NO: 3410732 - DNA, 20 bp, Homo sapiens
taggccaggagttcccaaat

SEQ ID NO: 3410733 - DNA, 18 bp, Homo sapiens
tagggaaaggtaaataca

SEQ ID NO: 3410734 - DNA, 21 bp, Homo sapiens
tagggaatggcacagcccaaa

SEQ ID NO: 3410735 - DNA, 16 bp, Homo sapiens
tagggggctggaggag

SEQ ID NO: 3410736 - DNA, 20 bp, Homo sapiens
tagggggctggaggagccca

SEQ ID NO: 3410737 - DNA, 14 bp, Homo sapiens
taggtaaataaagc

SEQ ID NO: 3410738 - DNA, 19 bp, Homo sapiens
taggtaaataaagctcaag

SEQ ID NO: 3410739 - DNA, 20 bp, Homo sapiens
taggtatctttatagttgta

SEQ ID NO: 3410740 - DNA, 15 bp, Homo sapiens
taggtcaagtaataa

SEQ ID NO: 3410741 - DNA, 20 bp, Homo sapiens
taggtcaagtaataaaaaga

SEQ ID NO: 3410742 - DNA, 18 bp, Homo sapiens
tagtaaaccaatttttta

SEQ ID NO: 3410743 - DNA, 14 bp, Homo sapiens
tagtagaacaatgt

SEQ ID NO: 3410744 - DNA, 23 bp, Homo sapiens
tagtatagtagaaagacatctgc

SEQ ID NO: 3410745 - DNA, 22 bp, Homo sapiens
tagtatttaactacatctgcct

SEQ ID NO: 3410746 - DNA, 19 bp, Homo sapiens
tagtatttagtatatgaaa

SEQ ID NO: 3410747 - DNA, 15 bp, Homo sapiens
tagtcacctctgggc

SEQ ID NO: 3410748 - DNA, 18 bp, Homo sapiens
tagtccttttatctcctt

SEQ ID NO: 3410749 - DNA, 20 bp, Homo sapiens
tagtccttttatctccttgt

SEQ ID NO: 3410750 - DNA, 14 bp, Homo sapiens
tagtgcttcttgta

SEQ ID NO: 3410751 - DNA, 16 bp, Homo sapiens
tagtggtctttgtaag

SEQ ID NO: 3410752 - DNA, 17 bp, Homo sapiens
tagtgtcctatgcaata

SEQ ID NO: 3410753 - DNA, 15 bp, Homo sapiens
tagttacatgaatta

SEQ ID NO: 3410754 - DNA, 18 bp, Homo sapiens
tagttacgtataatgctt

SEQ ID NO: 3410755 - DNA, 17 bp, Homo sapiens
tagttgcttttgaagga

SEQ ID NO: 3410756 - DNA, 14 bp, Homo sapiens
tagttgtctttctt

SEQ ID NO: 3410757 - DNA, 18 bp, Homo sapiens
tagtttaaaatcttgcat

SEQ ID NO: 3410758 - DNA, 15 bp, Homo sapiens
tagttttgctttgtt

SEQ ID NO: 3410759 - DNA, 17 bp, Homo sapiens
tattcttaaaatgcaat

SEQ ID NO: 3410760 - DNA, 19 bp, Homo sapiens
tattcttaaaatgcaatat

SEQ ID NO: 3410761 - DNA, 17 bp, Homo sapiens
tattcttctttgatagt

SEQ ID NO: 3410762 - DNA, 20 bp, Homo sapiens
tattcttttccagaaagaaa

SEQ ID NO: 3410763 - DNA, 17 bp, Homo sapiens
tattgaaagttgctttt

SEQ ID NO: 3410764 - DNA, 21 bp, Homo sapiens
tattgagtcttaactgtattt

SEQ ID NO: 3410765 - DNA, 18 bp, Homo sapiens
tattgctccattttcttg

SEQ ID NO: 3410766 - DNA, 19 bp, Homo sapiens
tattgctgtccttgaatgc

SEQ ID NO: 3410767 - DNA, 15 bp, Homo sapiens
tattgtgaagtacat

SEQ ID NO: 3410768 - DNA, 14 bp, Homo sapiens
tatttaaaaaatta

SEQ ID NO: 3410769 - DNA, 21 bp, Homo sapiens
tatttaaaaaattaaaaatga

SEQ ID NO: 3410770 - DNA, 14 bp, Homo sapiens
tatttaaagcacat

SEQ ID NO: 3410771 - DNA, 13 bp, Homo sapiens
tatttaactacat

SEQ ID NO: 3410772 - DNA, 11 bp, Homo sapiens
tatttaataac

SEQ ID NO: 3410773 - DNA, 18 bp, Homo sapiens
tatttaatgatttttgtg

SEQ ID NO: 3410774 - DNA, 20 bp, Homo sapiens
tatttaatgatttttgtgta

SEQ ID NO: 3410775 - DNA, 19 bp, Homo sapiens
tatttagactgtggccata

SEQ ID NO: 3410776 - DNA, 21 bp, Homo sapiens
tatttagactgtggccatata

SEQ ID NO: 3410777 - DNA, 13 bp, Homo sapiens
tatttagttacgt

SEQ ID NO: 3410778 - DNA, 22 bp, Homo sapiens
tatttagttacgtataatgctt

SEQ ID NO: 3410779 - DNA, 22 bp, Homo sapiens
tatttatattcatcaaataaac

SEQ ID NO: 3410780 - DNA, 15 bp, Homo sapiens
tatttctctggcaaa

SEQ ID NO: 3410781 - DNA, 14 bp, Homo sapiens
tatttctgatgttt

SEQ ID NO: 3410782 - DNA, 15 bp, Homo sapiens
tatttctgatgtttt

SEQ ID NO: 3410783 - DNA, 17 bp, Homo sapiens
tatttcttcaagtgagt

SEQ ID NO: 3410784 - DNA, 23 bp, Homo sapiens
tatttgtaaggcttgttccaatg

SEQ ID NO: 3410785 - DNA, 23 bp, Homo sapiens
tattttatctttgattctccttc

SEQ ID NO: 3410786 - DNA, 18 bp, Homo sapiens
tattttccagccttatgt

SEQ ID NO: 3410787 - DNA, 16 bp, Homo sapiens
tattttccatgaaaat

SEQ ID NO: 3410788 - DNA, 20 bp, Homo sapiens
tattttccctacttgcagcg

SEQ ID NO: 3410789 - DNA, 17 bp, Homo sapiens
tatttttaattaaataa

SEQ ID NO: 3410790 - DNA, 17 bp, Homo sapiens
tatttttatttgtttgt

SEQ ID NO: 3410791 - DNA, 16 bp, Homo sapiens
tcaaagagagttttta

SEQ ID NO: 3410792 - DNA, 14 bp, Homo sapiens
tcaaaggccagacc

SEQ ID NO: 3410793 - DNA, 13 bp, Homo sapiens
tcaaataaacctt

SEQ ID NO: 3410794 - DNA, 21 bp, Homo sapiens
tcaaattgtcagcatgacaaa

SEQ ID NO: 3410795 - DNA, 19 bp, Homo sapiens
tcaactcacctaatgttta

SEQ ID NO: 3410796 - DNA, 14 bp, Homo sapiens
tcaactttcatttg

SEQ ID NO: 3410797 - DNA, 23 bp, Homo sapiens
tcaagaaaacaggcactgccctg

SEQ ID NO: 3410798 - DNA, 16 bp, Homo sapiens
tcaagatcaatgaaat

SEQ ID NO: 3410799 - DNA, 22 bp, Homo sapiens
tcaagatccaaatgctgtgcaa

SEQ ID NO: 3410800 - DNA, 16 bp, Homo sapiens
tcaagattttgaatgc

SEQ ID NO: 3410801 - DNA, 18 bp, Homo sapiens
tcaagattttgaatgctt

SEQ ID NO: 3410802 - DNA, 22 bp, Homo sapiens
tcaagcaggtttcttgcttctg

SEQ ID NO: 3410803 - DNA, 20 bp, Homo sapiens
tcaagccccattccctctct

SEQ ID NO: 3410804 - DNA, 20 bp, Homo sapiens
tcaaggactttctgaagcct

SEQ ID NO: 3410805 - DNA, 16 bp, Homo sapiens
tcaaggctttaaaagt

SEQ ID NO: 3410806 - DNA, 16 bp, Homo sapiens
tcaagggggactgtct

SEQ ID NO: 3410807 - DNA, 18 bp, Homo sapiens
tcaagtagaacaaaaact

SEQ ID NO: 3410808 - DNA, 13 bp, Homo sapiens
tcaagtgagtggc

SEQ ID NO: 3410809 - DNA, 15 bp, Homo sapiens
tcaatattttccatg

SEQ ID NO: 3410810 - DNA, 22 bp, Homo sapiens
tcaatggcctctttgtccatta

SEQ ID NO: 3410811 - DNA, 17 bp, Homo sapiens
tcaatggtttgcaagga

SEQ ID NO: 3410812 - DNA, 18 bp, Homo sapiens
tcaatggtttgcaaggaa

SEQ ID NO: 3410813 - DNA, 15 bp, Homo sapiens
tcaattcagtgatgg

SEQ ID NO: 3410814 - DNA, 19 bp, Homo sapiens
tcaatttactttttaaaca

SEQ ID NO: 3410815 - DNA, 20 bp, Homo sapiens
tcaatttggagcattaacta

SEQ ID NO: 3410816 - DNA, 23 bp, Homo sapiens
tcaatttggagcattaactaaat

SEQ ID NO: 3410817 - DNA, 20 bp, Homo sapiens
tcaatttgtaattttagtat

SEQ ID NO: 3410818 - DNA, 22 bp, Homo sapiens
tcaatttgtaattttagtatta

SEQ ID NO: 3410819 - DNA, 13 bp, Homo sapiens
tcaattttgtatt

SEQ ID NO: 3410820 - DNA, 14 bp, Homo sapiens
tcaattttgtattt

SEQ ID NO: 3410821 - DNA, 23 bp, Homo sapiens
tcacacaaataacagctttctta

SEQ ID NO: 3410822 - DNA, 22 bp, Homo sapiens
tcacaccaggcttgcctgcagg

SEQ ID NO: 3410823 - DNA, 11 bp, Homo sapiens
tcacactgaga

SEQ ID NO: 3410824 - DNA, 12 bp, Homo sapiens
tcacactgagaa

SEQ ID NO: 3410825 - DNA, 20 bp, Homo sapiens
tcacactgagaatgtaagaa

SEQ ID NO: 3410826 - DNA, 17 bp, Homo sapiens
tcacactgtttttcata

SEQ ID NO: 3410827 - DNA, 16 bp, Homo sapiens
tcacagctcttgtttg

SEQ ID NO: 3410828 - DNA, 17 bp, Homo sapiens
tcacaggtttgtttctt

SEQ ID NO: 3410829 - DNA, 12 bp, Homo sapiens
tcacagttctgt

SEQ ID NO: 3410830 - DNA, 22 bp, Homo sapiens
tcacatctaaagctttatcttt

SEQ ID NO: 3410831 - DNA, 23 bp, Homo sapiens
tcaccactcaaaggccagacctg

SEQ ID NO: 3410832 - DNA, 14 bp, Homo sapiens
tcacccctcccttt

SEQ ID NO: 3410833 - DNA, 18 bp, Homo sapiens
tcacccctccctttctcc

SEQ ID NO: 3410834 - DNA, 21 bp, Homo sapiens
tcacccctggttctcatcttt

SEQ ID NO: 3410835 - DNA, 22 bp, Homo sapiens
tcacccctggttctcatctttc

SEQ ID NO: 3410836 - DNA, 19 bp, Homo sapiens
tcacgtgttttccatccca

SEQ ID NO: 3410837 - DNA, 22 bp, Homo sapiens
tcactaggaatttttttcagta

SEQ ID NO: 3410838 - DNA, 13 bp, Homo sapiens
tcactcctgctgt

SEQ ID NO: 3410839 - DNA, 21 bp, Homo sapiens
tcactctaattggtcattcct

SEQ ID NO: 3410840 - DNA, 17 bp, Homo sapiens
tcactcttctcagccac

SEQ ID NO: 3410841 - DNA, 18 bp, Homo sapiens
tcactcttctcagccact

SEQ ID NO: 3410842 - DNA, 18 bp, Homo sapiens
tcactgcaagctccgcct

SEQ ID NO: 3410843 - DNA, 24 bp, Homo sapiens
tcactgtataaataggagaggatg

SEQ ID NO: 3410844 - DNA, 14 bp, Homo sapiens
tcacttcaccatca

SEQ ID NO: 3410845 - DNA, 17 bp, Homo sapiens
tcacttcacgctttcag

SEQ ID NO: 3410846 - DNA, 13 bp, Homo sapiens
tcacttctaaatg

SEQ ID NO: 3410847 - DNA, 16 bp, Homo sapiens
tcacttctaaatgcat

SEQ ID NO: 3410848 - DNA, 21 bp, Homo sapiens
tcactttttcccctgcaatgc

SEQ ID NO: 3410849 - DNA, 20 bp, Homo sapiens
tcagaattggcataatttgt

SEQ ID NO: 3410850 - DNA, 20 bp, Homo sapiens
tcagatcattatcagcctgt

SEQ ID NO: 3410851 - DNA, 17 bp, Homo sapiens
tcagatttgccttattg

SEQ ID NO: 3410852 - DNA, 15 bp, Homo sapiens
tcagcatcaaacatg

SEQ ID NO: 3410853 - DNA, 16 bp, Homo sapiens
tcagcatcaaacatga

SEQ ID NO: 3410854 - DNA, 18 bp, Homo sapiens
tcagcatcaaacatgaaa

SEQ ID NO: 3410855 - DNA, 21 bp, Homo sapiens
tcagcatcaaacatgaaaaca

SEQ ID NO: 3410856 - DNA, 18 bp, Homo sapiens
tcagccccaccccagggc

SEQ ID NO: 3410857 - DNA, 15 bp, Homo sapiens
tcagctactaatgat

SEQ ID NO: 3410858 - DNA, 20 bp, Homo sapiens
tcagctactaatgatgtttt

SEQ ID NO: 3410859 - DNA, 15 bp, Homo sapiens
tcagctcaggcagct

SEQ ID NO: 3410860 - DNA, 19 bp, Homo sapiens
tcagctccctgcctgtttc

SEQ ID NO: 3410861 - DNA, 23 bp, Homo sapiens
tcagctgctgaagggagggggct

SEQ ID NO: 3410862 - DNA, 11 bp, Homo sapiens
tcagctggtgg

SEQ ID NO: 3410863 - DNA, 14 bp, Homo sapiens
tcaggaaagaatag

SEQ ID NO: 3410864 - DNA, 20 bp, Homo sapiens
tcaggaaagaatagaaagaa

SEQ ID NO: 3410865 - DNA, 23 bp, Homo sapiens
tcaggaggaaggcttacacccac

SEQ ID NO: 3410866 - DNA, 21 bp, Homo sapiens
tcaggtgacatgtgaaacctt

SEQ ID NO: 3410867 - DNA, 19 bp, Homo sapiens
tcaggttatcgaaataaca

SEQ ID NO: 3410868 - DNA, 20 bp, Homo sapiens
tcaggttatcgaaataacaa

SEQ ID NO: 3410869 - DNA, 14 bp, Homo sapiens
tcagtatgtggaag

SEQ ID NO: 3410870 - DNA, 15 bp, Homo sapiens
tctctttgtgcagtg

SEQ ID NO: 3410871 - DNA, 23 bp, Homo sapiens
tctcttttgaatccatgcttggg

SEQ ID NO: 3410872 - DNA, 21 bp, Homo sapiens
tctgaaaggctatcctgctga

SEQ ID NO: 3410873 - DNA, 12 bp, Homo sapiens
tctgaaattaaa

SEQ ID NO: 3410874 - DNA, 17 bp, Homo sapiens
tctgaatattaagaaac

SEQ ID NO: 3410875 - DNA, 19 bp, Homo sapiens
tctgaatattaagaaacaa

SEQ ID NO: 3410876 - DNA, 12 bp, Homo sapiens
tctgaattataa

SEQ ID NO: 3410877 - DNA, 17 bp, Homo sapiens
tctgaattttaaaacat

SEQ ID NO: 3410878 - DNA, 14 bp, Homo sapiens
tctgacaaagtgtg

SEQ ID NO: 3410879 - DNA, 10 bp, Homo sapiens
tctgagctgt

SEQ ID NO: 3410880 - DNA, 12 bp, Homo sapiens
tctgaggacatt

SEQ ID NO: 3410881 - DNA, 14 bp, Homo sapiens
tctgataatgtatt

SEQ ID NO: 3410882 - DNA, 15 bp, Homo sapiens
tctgataatgtattg

SEQ ID NO: 3410883 - DNA, 20 bp, Homo sapiens
tctgataatgtattgcagtg

SEQ ID NO: 3410884 - DNA, 19 bp, Homo sapiens
tctgatctgtactttgtgt

SEQ ID NO: 3410885 - DNA, 22 bp, Homo sapiens
tctgatctgtactttgtgttta

SEQ ID NO: 3410886 - DNA, 21 bp, Homo sapiens
tctgattataccatgtgtgct

SEQ ID NO: 3410887 - DNA, 22 bp, Homo sapiens
tctgattataccatgtgtgcta

SEQ ID NO: 3410888 - DNA, 23 bp, Homo sapiens
tctgcacttgcggttccggcatg

SEQ ID NO: 3410889 - DNA, 15 bp, Homo sapiens
tctgcattaataata

SEQ ID NO: 3410890 - DNA, 16 bp, Homo sapiens
tctgcattaataatag

SEQ ID NO: 3410891 - DNA, 15 bp, Homo sapiens
tctgcccaactttca

SEQ ID NO: 3410892 - DNA, 12 bp, Homo sapiens
tctgccccaccc

SEQ ID NO: 3410893 - DNA, 17 bp, Homo sapiens
tctgcctggttttattt

SEQ ID NO: 3410894 - DNA, 16 bp, Homo sapiens
tctgctcattaaactg

SEQ ID NO: 3410895 - DNA, 13 bp, Homo sapiens
tctgctctccttc

SEQ ID NO: 3410896 - DNA, 15 bp, Homo sapiens
tctgctctccttcct

SEQ ID NO: 3410897 - DNA, 14 bp, Homo sapiens
tctggagctgtccg

SEQ ID NO: 3410898 - DNA, 17 bp, Homo sapiens
tctggcaaacatgtgca

SEQ ID NO: 3410899 - DNA, 20 bp, Homo sapiens
tctggggaagaggttttatt

SEQ ID NO: 3410900 - DNA, 21 bp, Homo sapiens
tctggggaagaggttttattt

SEQ ID NO: 3410901 - DNA, 17 bp, Homo sapiens
tctgggtgatttctaga

SEQ ID NO: 3410902 - DNA, 18 bp, Homo sapiens
tctgtaaaagtgtctgta

SEQ ID NO: 3410903 - DNA, 15 bp, Homo sapiens
tctgtaggtacgttt

SEQ ID NO: 3410904 - DNA, 16 bp, Homo sapiens
tctgtatatagctcta

SEQ ID NO: 3410905 - DNA, 19 bp, Homo sapiens
tctgtccccttctctcatc

SEQ ID NO: 3410906 - DNA, 21 bp, Homo sapiens
tctgtgagactcgagaacttt

SEQ ID NO: 3410907 - DNA, 19 bp, Homo sapiens
tctgtgtgtgtgtatgtgg

SEQ ID NO: 3410908 - DNA, 21 bp, Homo sapiens
tctgtgtgtgtgtatgtgggg

SEQ ID NO: 3410909 - DNA, 12 bp, Homo sapiens
tctgtgttgctt

SEQ ID NO: 3410910 - DNA, 22 bp, Homo sapiens
tctgttctacttgatatttcct

SEQ ID NO: 3410911 - DNA, 17 bp, Homo sapiens
tctgttgtcaccttcac

SEQ ID NO: 3410912 - DNA, 15 bp, Homo sapiens
tctgtttgtgttatt

SEQ ID NO: 3410913 - DNA, 22 bp, Homo sapiens
tctgttttgtaaagtccccaga

SEQ ID NO: 3410914 - DNA, 14 bp, Homo sapiens
tcttaaaatgcaat

SEQ ID NO: 3410915 - DNA, 16 bp, Homo sapiens
tcttaaaatgcaatat

SEQ ID NO: 3410916 - DNA, 17 bp, Homo sapiens
tcttaaacaaatgtatg

SEQ ID NO: 3410917 - DNA, 13 bp, Homo sapiens
tcttaaatcattt

SEQ ID NO: 3410918 - DNA, 18 bp, Homo sapiens
tcttaaatcatttggtta

SEQ ID NO: 3410919 - DNA, 19 bp, Homo sapiens
tcttaaatgttttcattgg

SEQ ID NO: 3410920 - DNA, 18 bp, Homo sapiens
tcttaactgtatttcagt

SEQ ID NO: 3410921 - DNA, 16 bp, Homo sapiens
tcttaagtgtaaataa

SEQ ID NO: 3410922 - DNA, 14 bp, Homo sapiens
tcttacaaacatgt

SEQ ID NO: 3410923 - DNA, 14 bp, Homo sapiens
tcttacaagcttaa

SEQ ID NO: 3410924 - DNA, 14 bp, Homo sapiens
tcttacctttatga

SEQ ID NO: 3410925 - DNA, 23 bp, Homo sapiens
tcttactttgtgcaaaagcaggc

SEQ ID NO: 3410926 - DNA, 23 bp, Homo sapiens
tcttagacctcttcctggaataa

SEQ ID NO: 3410927 - DNA, 14 bp, Homo sapiens
tcttagctttttaa

SEQ ID NO: 3410928 - DNA, 21 bp, Homo sapiens
tcttagctttttaattgttgt

SEQ ID NO: 3410929 - DNA, 19 bp, Homo sapiens
tcttagtatagtagaaaga

SEQ ID NO: 3410930 - DNA, 20 bp, Homo sapiens
tcttcagctggtggatggtg

SEQ ID NO: 3410931 - DNA, 24 bp, Homo sapiens
tcttctaatcataacatagttgaa

SEQ ID NO: 3410932 - DNA, 18 bp, Homo sapiens
tcttctcatttcacccct

SEQ ID NO: 3410933 - DNA, 16 bp, Homo sapiens
tcttctccaattctga

SEQ ID NO: 3410934 - DNA, 19 bp, Homo sapiens
tcttgcatggcattaattg

SEQ ID NO: 3410935 - DNA, 21 bp, Homo sapiens
tcttgcatggcattaattgtt

SEQ ID NO: 3410936 - DNA, 16 bp, Homo sapiens
tcttgcattgaattta

SEQ ID NO: 3410937 - DNA, 21 bp, Homo sapiens
tcttgcctctgtccccttctc

SEQ ID NO: 3410938 - DNA, 17 bp, Homo sapiens
tcttggccctcctcagc

SEQ ID NO: 3410939 - DNA, 21 bp, Homo sapiens
tcttggccctcctcagctccc

SEQ ID NO: 3410940 - DNA, 16 bp, Homo sapiens
tcttgtattgctccat

SEQ ID NO: 3410941 - DNA, 15 bp, Homo sapiens
tcttgtgaaattgtg

SEQ ID NO: 3410942 - DNA, 18 bp, Homo sapiens
tcttgttattaatgtttc

SEQ ID NO: 3410943 - DNA, 18 bp, Homo sapiens
tctttaatcacttaacat

SEQ ID NO: 3410944 - DNA, 21 bp, Homo sapiens
tctttcaaatttactgtctta

SEQ ID NO: 3410945 - DNA, 16 bp, Homo sapiens
tctttctagtggtctt

SEQ ID NO: 3410946 - DNA, 17 bp, Homo sapiens
tctttcttggtgcattc

SEQ ID NO: 3410947 - DNA, 13 bp, Homo sapiens
tctttctttgctg

SEQ ID NO: 3410948 - DNA, 13 bp, Homo sapiens
tctttgataatgt

SEQ ID NO: 3410949 - DNA, 17 bp, Homo sapiens
tctttgataatgttaaa

SEQ ID NO: 3410950 - DNA, 21 bp, Homo sapiens
tctttgataatgttaaatttg

SEQ ID NO: 3410951 - DNA, 23 bp, Homo sapiens
tctttgattctccttcagccctc

SEQ ID NO: 3410952 - DNA, 21 bp, Homo sapiens
tctttgctgaatgtcattatt

SEQ ID NO: 3410953 - DNA, 17 bp, Homo sapiens
tctttgctgctgtggaa

SEQ ID NO: 3410954 - DNA, 14 bp, Homo sapiens
tctttgtaagagtg

SEQ ID NO: 3410955 - DNA, 19 bp, Homo sapiens
tctttgtaagagtgtagaa

SEQ ID NO: 3410956 - DNA, 17 bp, Homo sapiens
tctttgtatcattcatc

SEQ ID NO: 3410957 - DNA, 11 bp, Homo sapiens
tctttgtgaag

SEQ ID NO: 3410958 - DNA, 15 bp, Homo sapiens
tctttgtgtaatcta

SEQ ID NO: 3410959 - DNA, 16 bp, Homo sapiens
tctttgtttaaatgcc

SEQ ID NO: 3410960 - DNA, 18 bp, Homo sapiens
tcttttacatacagtgat

SEQ ID NO: 3410961 - DNA, 21 bp, Homo sapiens
tcttttagttacatgaattaa

SEQ ID NO: 3410962 - DNA, 15 bp, Homo sapiens
tcttttccagaaaga

SEQ ID NO: 3410963 - DNA, 16 bp, Homo sapiens
tcttttcttgcctctg

SEQ ID NO: 3410964 - DNA, 15 bp, Homo sapiens
tgaaaacattgatga

SEQ ID NO: 3410965 - DNA, 16 bp, Homo sapiens
tgaaaacattgatgaa

SEQ ID NO: 3410966 - DNA, 17 bp, Homo sapiens
tgaaaacattgatgaat

SEQ ID NO: 3410967 - DNA, 14 bp, Homo sapiens
tgaaaattaacact

SEQ ID NO: 3410968 - DNA, 15 bp, Homo sapiens
tgaaaattaacactg

SEQ ID NO: 3410969 - DNA, 18 bp, Homo sapiens
tgaaaattaacactgctt

SEQ ID NO: 3410970 - DNA, 16 bp, Homo sapiens
tgaaagtcaattcagt

SEQ ID NO: 3410971 - DNA, 17 bp, Homo sapiens
tgaaagtcaattcagtg

SEQ ID NO: 3410972 - DNA, 16 bp, Homo sapiens
tgaaagtgatgacata

SEQ ID NO: 3410973 - DNA, 20 bp, Homo sapiens
tgaaagtgggtttcaattta

SEQ ID NO: 3410974 - DNA, 17 bp, Homo sapiens
tgaaagttgcttttatt

SEQ ID NO: 3410975 - DNA, 19 bp, Homo sapiens
tgaaagttgcttttattgc

SEQ ID NO: 3410976 - DNA, 14 bp, Homo sapiens
tgaaatattttgaa

SEQ ID NO: 3410977 - DNA, 19 bp, Homo sapiens
tgaaatgcagagtcaatga

SEQ ID NO: 3410978 - DNA, 21 bp, Homo sapiens
tgaaatttaaaaataaagcta

SEQ ID NO: 3410979 - DNA, 17 bp, Homo sapiens
tgaactctgcaactgaa

SEQ ID NO: 3410980 - DNA, 11 bp, Homo sapiens
tgaagaagaga

SEQ ID NO: 3410981 - DNA, 18 bp, Homo sapiens
tgaagagggagaagcatg

SEQ ID NO: 3410982 - DNA, 13 bp, Homo sapiens
tgatctgattttt

SEQ ID NO: 3410983 - DNA, 14 bp, Homo sapiens
tgatctgtactttg

SEQ ID NO: 3410984 - DNA, 17 bp, Homo sapiens
tgatctgtactttgtgt

SEQ ID NO: 3410985 - DNA, 20 bp, Homo sapiens
tgatctttgtttaaatgcca

SEQ ID NO: 3410986 - DNA, 23 bp, Homo sapiens
tgatctttgtttaaatgccaaaa

SEQ ID NO: 3410987 - DNA, 15 bp, Homo sapiens
tgatgaggccctcca

SEQ ID NO: 3410988 - DNA, 16 bp, Homo sapiens
tgatgaggccctccac

SEQ ID NO: 3410989 - DNA, 15 bp, Homo sapiens
tgatggcaacactga

SEQ ID NO: 3410990 - DNA, 15 bp, Homo sapiens
tgatgggtcagttgt

SEQ ID NO: 3410991 - DNA, 21 bp, Homo sapiens
tgatggtgtagccctcccact

SEQ ID NO: 3410992 - DNA, 18 bp, Homo sapiens
tgatgttttatttgcact

SEQ ID NO: 3410993 - DNA, 14 bp, Homo sapiens
tgattaaattatga

SEQ ID NO: 3410994 - DNA, 23 bp, Homo sapiens
tgattcaaatatcaaaaggaaga

SEQ ID NO: 3410995 - DNA, 14 bp, Homo sapiens
tgattctccttcag

SEQ ID NO: 3410996 - DNA, 13 bp, Homo sapiens
tgattctgttcta

SEQ ID NO: 3410997 - DNA, 19 bp, Homo sapiens
tgattctttgttacaggca

SEQ ID NO: 3410998 - DNA, 15 bp, Homo sapiens
tgattggttcagttt

SEQ ID NO: 3410999 - DNA, 18 bp, Homo sapiens
tgattgttgagacgcctt

SEQ ID NO: 3411000 - DNA, 13 bp, Homo sapiens
tgatttaataaaa

SEQ ID NO: 3411001 - DNA, 22 bp, Homo sapiens
tgatttcgatgtacagtctcaa

SEQ ID NO: 3411002 - DNA, 18 bp, Homo sapiens
tgatttctagaatggttt

SEQ ID NO: 3411003 - DNA, 15 bp, Homo sapiens
tgatttttgtgtatc

SEQ ID NO: 3411004 - DNA, 20 bp, Homo sapiens
tgatttttgtgtatccagta

SEQ ID NO: 3411005 - DNA, 15 bp, Homo sapiens
tgcaaaagcaggctt

SEQ ID NO: 3411006 - DNA, 19 bp, Homo sapiens
tgcaaatattggttagtat

SEQ ID NO: 3411007 - DNA, 18 bp, Homo sapiens
tgcaaatgagatttcttt

SEQ ID NO: 3411008 - DNA, 15 bp, Homo sapiens
tgcaacaacatgtat

SEQ ID NO: 3411009 - DNA, 21 bp, Homo sapiens
tgcaacatggattccaaagca

SEQ ID NO: 3411010 - DNA, 23 bp, Homo sapiens
tgcaacatggattccaaagcatt

SEQ ID NO: 3411011 - DNA, 19 bp, Homo sapiens
tgcaactaactgactctgt

SEQ ID NO: 3411012 - DNA, 20 bp, Homo sapiens
tgcaactaactgactctgtt

SEQ ID NO: 3411013 - DNA, 24 bp, Homo sapiens
tgcaactaactgactctgttattg

SEQ ID NO: 3411014 - DNA, 14 bp, Homo sapiens
tgcaactcttgtat

SEQ ID NO: 3411015 - DNA, 22 bp, Homo sapiens
tgcaataaaattatttgcaggt

SEQ ID NO: 3411016 - DNA, 20 bp, Homo sapiens
tgcaatatttgtaaggcttg

SEQ ID NO: 3411017 - DNA, 18 bp, Homo sapiens
tgcaatgcgtcttgtgaa

SEQ ID NO: 3411018 - DNA, 21 bp, Homo sapiens
tgcaattgtaggggtgtgtgt

SEQ ID NO: 3411019 - DNA, 16 bp, Homo sapiens
tgcaccattctttctt

SEQ ID NO: 3411020 - DNA, 16 bp, Homo sapiens
tgcactagaccatata

SEQ ID NO: 3411021 - DNA, 18 bp, Homo sapiens
tgcactttgtagtgtttg

SEQ ID NO: 3411022 - DNA, 22 bp, Homo sapiens
tgcagagagccattttgtgaat

SEQ ID NO: 3411023 - DNA, 20 bp, Homo sapiens
tgcagcctcagagacatcag

SEQ ID NO: 3411024 - DNA, 14 bp, Homo sapiens
tgcaggaaggagct

SEQ ID NO: 3411025 - DNA, 19 bp, Homo sapiens
tgcaggaaggagctgcctg

SEQ ID NO: 3411026 - DNA, 21 bp, Homo sapiens
tgcaggaaggagctgcctgga

SEQ ID NO: 3411027 - DNA, 22 bp, Homo sapiens
tgcaggaaggagctgcctggac

SEQ ID NO: 3411028 - DNA, 16 bp, Homo sapiens
tgcaggggtccctgct

SEQ ID NO: 3411029 - DNA, 21 bp, Homo sapiens
tgcaggtctttaaatcatttt

SEQ ID NO: 3411030 - DNA, 22 bp, Homo sapiens
tgcaggtctttaaatcatttta

SEQ ID NO: 3411031 - DNA, 15 bp, Homo sapiens
tgcagtcgtgtaatt

SEQ ID NO: 3411032 - DNA, 22 bp, Homo sapiens
tgcagtcgtgtaattggcccaa

SEQ ID NO: 3411033 - DNA, 21 bp, Homo sapiens
tgcagtgatatggcagaagac

SEQ ID NO: 3411034 - DNA, 22 bp, Homo sapiens
tgcagtgatatggcagaagaca

SEQ ID NO: 3411035 - DNA, 15 bp, Homo sapiens
tgcagtgttagtatt

SEQ ID NO: 3411036 - DNA, 19 bp, Homo sapiens
tgcataaacaatccaaatg

SEQ ID NO: 3411037 - DNA, 23 bp, Homo sapiens
tgcataaacaatccaaatgcatt

SEQ ID NO: 3411038 - DNA, 13 bp, Homo sapiens
tgcataaatatgc

SEQ ID NO: 3411039 - DNA, 19 bp, Homo sapiens
tgcataataaatgcttcag

SEQ ID NO: 3411040 - DNA, 22 bp, Homo sapiens
tgcatagagcaattaaactgtg

SEQ ID NO: 3411041 - DNA, 17 bp, Homo sapiens
tgcatagagccacgtat

SEQ ID NO: 3411042 - DNA, 17 bp, Homo sapiens
tgcatatcctgagccat

SEQ ID NO: 3411043 - DNA, 20 bp, Homo sapiens
tgcatatctctagtccctgt

SEQ ID NO: 3411044 - DNA, 21 bp, Homo sapiens
tgcatcatagaacagaaatat

SEQ ID NO: 3411045 - DNA, 18 bp, Homo sapiens
tgcatgaaggtttctgaa

SEQ ID NO: 3411046 - DNA, 19 bp, Homo sapiens
tgcatgaaggtttctgaaa

SEQ ID NO: 3411047 - DNA, 21 bp, Homo sapiens
tgcatgaaggtttctgaaaat

SEQ ID NO: 3411048 - DNA, 15 bp, Homo sapiens
tgcatggagtgtttg

SEQ ID NO: 3411049 - DNA, 23 bp, Homo sapiens
tgcatgtaaaatcttcagctggt

SEQ ID NO: 3411050 - DNA, 12 bp, Homo sapiens
tgcatgtgtata

SEQ ID NO: 3411051 - DNA, 20 bp, Homo sapiens
tgcattattttattgagcaa

SEQ ID NO: 3411052 - DNA, 22 bp, Homo sapiens
tgcattgaatttagtcattatt

SEQ ID NO: 3411053 - DNA, 17 bp, Homo sapiens
tgcattggaactggagg

SEQ ID NO: 3411054 - DNA, 18 bp, Homo sapiens
tgcattggaactggaggc

SEQ ID NO: 3411055 - DNA, 19 bp, Homo sapiens
tgccaagctaatctgcctg

SEQ ID NO: 3411056 - DNA, 14 bp, Homo sapiens
tgccacctcctgcc

SEQ ID NO: 3411057 - DNA, 21 bp, Homo sapiens
tgccagggaaaaagaccaaat

SEQ ID NO: 3411058 - DNA, 17 bp, Homo sapiens
tgccatagtcaaagaga

SEQ ID NO: 3411059 - DNA, 19 bp, Homo sapiens
tgccatgggcttcactgta

SEQ ID NO: 3411060 - DNA, 22 bp, Homo sapiens
tgccatgggcttcactgtataa

SEQ ID NO: 3411061 - DNA, 18 bp, Homo sapiens
tgcccaactttcattggt

SEQ ID NO: 3411062 - DNA, 21 bp, Homo sapiens
tgcccagcggacagtggcagg

SEQ ID NO: 3411063 - DNA, 20 bp, Homo sapiens
tgcccagggtcagtgtatct

SEQ ID NO: 3411064 - DNA, 17 bp, Homo sapiens
tgcccatgaacaagtta

SEQ ID NO: 3411065 - DNA, 13 bp, Homo sapiens
tgcccccaggact

SEQ ID NO: 3411066 - DNA, 14 bp, Homo sapiens
tgcccccaggactg

SEQ ID NO: 3411067 - DNA, 13 bp, Homo sapiens
tgccccctgcagg

SEQ ID NO: 3411068 - DNA, 17 bp, Homo sapiens
tgccccctgcaggaagg

SEQ ID NO: 3411069 - DNA, 21 bp, Homo sapiens
tgccccctgcaggaaggagct

SEQ ID NO: 3411070 - DNA, 12 bp, Homo sapiens
tgcccctccctc

SEQ ID NO: 3411071 - DNA, 17 bp, Homo sapiens
tgcccctgtcccacctg

SEQ ID NO: 3411072 - DNA, 16 bp, Homo sapiens
tgccctaatgtctgta

SEQ ID NO: 3411073 - DNA, 17 bp, Homo sapiens
tgccgcagagctggccg

SEQ ID NO: 3411074 - DNA, 15 bp, Homo sapiens
tgccggctcccctcg

SEQ ID NO: 3411075 - DNA, 12 bp, Homo sapiens
tgcctccagggc

SEQ ID NO: 3411076 - DNA, 17 bp, Homo sapiens
tgcctccagggctggac

SEQ ID NO: 3411077 - DNA, 14 bp, Homo sapiens
tgcctctgtcccct

SEQ ID NO: 3411078 - DNA, 16 bp, Homo sapiens
tgcctctgtccccttc

SEQ ID NO: 3411079 - DNA, 17 bp, Homo sapiens
tgcctctgtccccttct

SEQ ID NO: 3411080 - DNA, 20 bp, Homo sapiens
tgcctctgtccccttctctc

SEQ ID NO: 3411081 - DNA, 12 bp, Homo sapiens
tgcctttgagac

SEQ ID NO: 3411082 - DNA, 13 bp, Homo sapiens
tgcctttgagaca

SEQ ID NO: 3411083 - DNA, 17 bp, Homo sapiens
tgcctttgagacagttt

SEQ ID NO: 3411084 - DNA, 18 bp, Homo sapiens
tgcctttgagacagtttc

SEQ ID NO: 3411085 - DNA, 21 bp, Homo sapiens
tgcctttgagacagtttctta

SEQ ID NO: 3411086 - DNA, 13 bp, Homo sapiens
tgccttttaagtt

SEQ ID NO: 3411087 - DNA, 21 bp, Homo sapiens
tgcggggcttttaaaaggaaa

SEQ ID NO: 3411088 - DNA, 20 bp, Homo sapiens
tgcgtcattacagggcacag

SEQ ID NO: 3411089 - DNA, 14 bp, Homo sapiens
tgcgtcttgtgaaa

SEQ ID NO: 3411090 - DNA, 22 bp, Homo sapiens
tgcgtggcacatctaaattgat

SEQ ID NO: 3411091 - DNA, 14 bp, Homo sapiens
tgcgtgtgtagagt

SEQ ID NO: 3411092 - DNA, 19 bp, Homo sapiens
tgcgtgtgtagagttaaga

SEQ ID NO: 3411093 - DNA, 22 bp, Homo sapiens
ttggtcattcctaatgcattag

SEQ ID NO: 3411094 - DNA, 19 bp, Homo sapiens
ttggtgcaattaactctgg

SEQ ID NO: 3411095 - DNA, 13 bp, Homo sapiens
ttggtgttgacat

SEQ ID NO: 3411096 - DNA, 12 bp, Homo sapiens
ttggtttaatat

SEQ ID NO: 3411097 - DNA, 17 bp, Homo sapiens
ttgtaaaaaaaaatgcc

SEQ ID NO: 3411098 - DNA, 21 bp, Homo sapiens
ttgtaaaaaaaaatgcctttg

SEQ ID NO: 3411099 - DNA, 23 bp, Homo sapiens
ttgtaaaaaaaaatgcctttgag

SEQ ID NO: 3411100 - DNA, 22 bp, Homo sapiens
ttgtaaagtccccagagaaagc

SEQ ID NO: 3411101 - DNA, 21 bp, Homo sapiens
ttgtaagagtgtagaagcatt

SEQ ID NO: 3411102 - DNA, 17 bp, Homo sapiens
ttgtaagtttcaggtga

SEQ ID NO: 3411103 - DNA, 22 bp, Homo sapiens
ttgtaagtttcaggtgacatgt

SEQ ID NO: 3411104 - DNA, 21 bp, Homo sapiens
ttgtaatatttcttcaagtga

SEQ ID NO: 3411105 - DNA, 22 bp, Homo sapiens
ttgtagactatggaatgtcagt

SEQ ID NO: 3411106 - DNA, 12 bp, Homo sapiens
ttgtatataaag

SEQ ID NO: 3411107 - DNA, 15 bp, Homo sapiens
ttgtatataaagttt

SEQ ID NO: 3411108 - DNA, 13 bp, Homo sapiens
ttgtatctctttt

SEQ ID NO: 3411109 - DNA, 15 bp, Homo sapiens
ttgtatgtattaaac

SEQ ID NO: 3411110 - DNA, 15 bp, Homo sapiens
ttgtattgcttcctg

SEQ ID NO: 3411111 - DNA, 17 bp, Homo sapiens
ttgtattttgtacattt

SEQ ID NO: 3411112 - DNA, 17 bp, Homo sapiens
ttgtcctttaactatca

SEQ ID NO: 3411113 - DNA, 17 bp, Homo sapiens
ttgtgaaatgaaaacat

SEQ ID NO: 3411114 - DNA, 14 bp, Homo sapiens
ttgtgaaattgtgt

SEQ ID NO: 3411115 - DNA, 16 bp, Homo sapiens
ttgtgaaattgtgtag

SEQ ID NO: 3411116 - DNA, 22 bp, Homo sapiens
ttgtgaaggcctcgcaggaaga

SEQ ID NO: 3411117 - DNA, 22 bp, Homo sapiens
ttgtgaggtttaacattaaagc

SEQ ID NO: 3411118 - DNA, 21 bp, Homo sapiens
ttgtgatattgaccatgtgat

SEQ ID NO: 3411119 - DNA, 12 bp, Homo sapiens
ttgtgatgtgtc

SEQ ID NO: 3411120 - DNA, 14 bp, Homo sapiens
ttgtgcaaaagcag

SEQ ID NO: 3411121 - DNA, 22 bp, Homo sapiens
ttgtgctttataccccatttga

SEQ ID NO: 3411122 - DNA, 14 bp, Homo sapiens
ttgtggcaaaatat

SEQ ID NO: 3411123 - DNA, 22 bp, Homo sapiens
ttgtgtattgagtcttaactgt

SEQ ID NO: 3411124 - DNA, 10 bp, Homo sapiens
ttgtgtgtgg

SEQ ID NO: 3411125 - DNA, 23 bp, Homo sapiens
ttgtgtttagctacctttttata

SEQ ID NO: 3411126 - DNA, 22 bp, Homo sapiens
ttgttaaaaaaaaaaagattgt

SEQ ID NO: 3411127 - DNA, 19 bp, Homo sapiens
ttgttaatggtttgaatat

SEQ ID NO: 3411128 - DNA, 17 bp, Homo sapiens
ttgttattcttttccag

SEQ ID NO: 3411129 - DNA, 14 bp, Homo sapiens
ttgttcccctcctc

SEQ ID NO: 3411130 - DNA, 15 bp, Homo sapiens
ttgttcccctcctcc

SEQ ID NO: 3411131 - DNA, 20 bp, Homo sapiens
tgtacttaaatgagttactt

SEQ ID NO: 3411132 - DNA, 22 bp, Homo sapiens
tgtacttaaatgagttacttag

SEQ ID NO: 3411133 - DNA, 16 bp, Homo sapiens
tgtagaagcattcctt

SEQ ID NO: 3411134 - DNA, 21 bp, Homo sapiens
tgtagactatggaatgtcagt

SEQ ID NO: 3411135 - DNA, 19 bp, Homo sapiens
tgtagagttaagaagctgt

SEQ ID NO: 3411136 - DNA, 21 bp, Homo sapiens
tgtagagttaagaagctgttg

SEQ ID NO: 3411137 - DNA, 23 bp, Homo sapiens
tgtagatataaatataaatatat

SEQ ID NO: 3411138 - DNA, 22 bp, Homo sapiens
tgtaggcacttttattttcatt

SEQ ID NO: 3411139 - DNA, 21 bp, Homo sapiens
tgtataccatgatgcatggag

SEQ ID NO: 3411140 - DNA, 13 bp, Homo sapiens
tgtatagttgctt

SEQ ID NO: 3411141 - DNA, 14 bp, Homo sapiens
tgtatagttgcttt

SEQ ID NO: 3411142 - DNA, 16 bp, Homo sapiens
tgtatataaagttttt

SEQ ID NO: 3411143 - DNA, 21 bp, Homo sapiens
tgtatataatcatgctcatgt

SEQ ID NO: 3411144 - DNA, 22 bp, Homo sapiens
tgtatatagctctacacaacat

SEQ ID NO: 3411145 - DNA, 19 bp, Homo sapiens
tgtatatatgtcaaattgt

SEQ ID NO: 3411146 - DNA, 20 bp, Homo sapiens
tgtatgactaaagagagaat

SEQ ID NO: 3411147 - DNA, 21 bp, Homo sapiens
tgtatgactaaagagagaatg

SEQ ID NO: 3411148 - DNA, 22 bp, Homo sapiens
tgtatgtattaaacttttcatt

SEQ ID NO: 3411149 - DNA, 20 bp, Homo sapiens
tgtatgtggatacagtcatt

SEQ ID NO: 3411150 - DNA, 21 bp, Homo sapiens
tgtatgtgggggtctgtgtgt

SEQ ID NO: 3411151 - DNA, 14 bp, Homo sapiens
tgtattagccagtc

SEQ ID NO: 3411152 - DNA, 20 bp, Homo sapiens
tgtattagccagtcattgta

SEQ ID NO: 3411153 - DNA, 17 bp, Homo sapiens
tgtattcagtgagggtc

SEQ ID NO: 3411154 - DNA, 12 bp, Homo sapiens
tgtattgctgtc

SEQ ID NO: 3411155 - DNA, 14 bp, Homo sapiens
tgtatttcagtatt

SEQ ID NO: 3411156 - DNA, 15 bp, Homo sapiens
tgtcaactttcattt

SEQ ID NO: 3411157 - DNA, 22 bp, Homo sapiens
tgtcaactttcatttgaaagtg

SEQ ID NO: 3411158 - DNA, 20 bp, Homo sapiens
tgtcaagccccattccctct

SEQ ID NO: 3411159 - DNA, 20 bp, Homo sapiens
tgtcaataaaaataaatcta

SEQ ID NO: 3411160 - DNA, 16 bp, Homo sapiens
tgtcacacttgtttct

SEQ ID NO: 3411161 - DNA, 18 bp, Homo sapiens
tgtcacacttgtttcttg

SEQ ID NO: 3411162 - DNA, 12 bp, Homo sapiens
tgtcacagctct

SEQ ID NO: 3411163 - DNA, 15 bp, Homo sapiens
tgtcacagctcttgt

SEQ ID NO: 3411164 - DNA, 18 bp, Homo sapiens
tgtcacagctcttgtttg

SEQ ID NO: 3411165 - DNA, 14 bp, Homo sapiens
tgtcaccttcacct

SEQ ID NO: 3411166 - DNA, 18 bp, Homo sapiens
tgtcagctactaatgatg

SEQ ID NO: 3411167 - DNA, 23 bp, Homo sapiens
tgtcatcaatagtgtcctatgca

SEQ ID NO: 3411168 - DNA, 13 bp, Homo sapiens
tgtcattatttga

SEQ ID NO: 3411169 - DNA, 21 bp, Homo sapiens
tgtcattatttgataacattt

SEQ ID NO: 3411170 - DNA, 23 bp, Homo sapiens
tgtccacctgtgagaaaggaaaa

SEQ ID NO: 3411171 - DNA, 13 bp, Homo sapiens
tgtccagttataa

SEQ ID NO: 3411172 - DNA, 15 bp, Homo sapiens
tgtccatcatattaa

SEQ ID NO: 3411173 - DNA, 15 bp, Homo sapiens
tgtcccacctggctc

SEQ ID NO: 3411174 - DNA, 14 bp, Homo sapiens
tgtcggcacattca

SEQ ID NO: 3411175 - DNA, 21 bp, Homo sapiens
tgtctagtagaacaatgtaca

SEQ ID NO: 3411176 - DNA, 18 bp, Homo sapiens
tgtctcaaaaataatata

SEQ ID NO: 3411177 - DNA, 20 bp, Homo sapiens
tgtctcaaaaataatatact

SEQ ID NO: 3411178 - DNA, 16 bp, Homo sapiens
tgtctccaacccccca

SEQ ID NO: 3411179 - DNA, 17 bp, Homo sapiens
tgtctctgacaaagtgt

SEQ ID NO: 3411180 - DNA, 20 bp, Homo sapiens
tgtctctgacaaagtgtgtc

SEQ ID NO: 3411181 - DNA, 14 bp, Homo sapiens
tgtctgcaacatgg

SEQ ID NO: 3411182 - DNA, 20 bp, Homo sapiens
tgtctgtgttgcttcaaatt

SEQ ID NO: 3411183 - DNA, 19 bp, Homo sapiens
tgtcttaaatcagtttatt

SEQ ID NO: 3411184 - DNA, 16 bp, Homo sapiens
tgtctttcagatacat

SEQ ID NO: 3411185 - DNA, 15 bp, Homo sapiens
ccaggatcatggtgt

SEQ ID NO: 3411186 - DNA, 20 bp, Homo sapiens
ccaggatcatggtgtaataa

SEQ ID NO: 3411187 - DNA, 23 bp, Homo sapiens
ccaggatcatggtgtaataagac

SEQ ID NO: 3411188 - DNA, 16 bp, Homo sapiens
ccaggccacaaatgtg

SEQ ID NO: 3411189 - DNA, 22 bp, Homo sapiens
ccaggccaggactctgcagcct

SEQ ID NO: 3411190 - DNA, 18 bp, Homo sapiens
ccaggcttgcctgcaggc

SEQ ID NO: 3411191 - DNA, 15 bp, Homo sapiens
ccagggagagcccag

SEQ ID NO: 3411192 - DNA, 21 bp, Homo sapiens
ccagggagagcccaggagctc

SEQ ID NO: 3411193 - DNA, 13 bp, Homo sapiens
ccagggagctgca

SEQ ID NO: 3411194 - DNA, 15 bp, Homo sapiens
ccagggagctgcagg

SEQ ID NO: 3411195 - DNA, 13 bp, Homo sapiens
ccagggcagccag

SEQ ID NO: 3411196 - DNA, 14 bp, Homo sapiens
ccagggcagccagg

SEQ ID NO: 3411197 - DNA, 22 bp, Homo sapiens
ccagggcttacggccctggcct

SEQ ID NO: 3411198 - DNA, 14 bp, Homo sapiens
ccaggtagaacaca

SEQ ID NO: 3411199 - DNA, 19 bp, Homo sapiens
ccagtgatctcgactcccc

SEQ ID NO: 3411200 - DNA, 21 bp, Homo sapiens
ccagtgatctcgactcccccc

SEQ ID NO: 3411201 - DNA, 21 bp, Homo sapiens
ccagtgatgctaaaggttgta

SEQ ID NO: 3411202 - DNA, 21 bp, Homo sapiens
ccagttcctttcaatggtttg

SEQ ID NO: 3411203 - DNA, 22 bp, Homo sapiens
ccagttcctttcaatggtttgc

SEQ ID NO: 3411204 - DNA, 23 bp, Homo sapiens
ccagttcctttcaatggtttgca

SEQ ID NO: 3411205 - DNA, 21 bp, Homo sapiens
ccatagagatatttaaaagac

SEQ ID NO: 3411206 - DNA, 16 bp, Homo sapiens
ccatagtcaaagagag

SEQ ID NO: 3411207 - DNA, 15 bp, Homo sapiens
ccatatatgctgtat

SEQ ID NO: 3411208 - DNA, 18 bp, Homo sapiens
ccatatatgctgtatttc

SEQ ID NO: 3411209 - DNA, 19 bp, Homo sapiens
ccatatatgctgtatttct

SEQ ID NO: 3411210 - DNA, 14 bp, Homo sapiens
ccatctcagtcact

SEQ ID NO: 3411211 - DNA, 18 bp, Homo sapiens
ccatgaagctggaagcac

SEQ ID NO: 3411212 - DNA, 23 bp, Homo sapiens
ccatgaagctggaagcactgctg

SEQ ID NO: 3411213 - DNA, 13 bp, Homo sapiens
ccatgcttcactc

SEQ ID NO: 3411214 - DNA, 15 bp, Homo sapiens
ccatgggctcccact

SEQ ID NO: 3411215 - DNA, 16 bp, Homo sapiens
ccatgggcttcactgt

SEQ ID NO: 3411216 - DNA, 20 bp, Homo sapiens
ccatggtgatggtgtagccc

SEQ ID NO: 3411217 - DNA, 15 bp, Homo sapiens
agccaccttgttaca

SEQ ID NO: 3411218 - DNA, 13 bp, Homo sapiens
agccactgaagta

SEQ ID NO: 3411219 - DNA, 16 bp, Homo sapiens
agccagcaccggacca

SEQ ID NO: 3411220 - DNA, 21 bp, Homo sapiens
agccagcaccggaccagcctg

SEQ ID NO: 3411221 - DNA, 22 bp, Homo sapiens
agccagcaccggaccagcctgg

SEQ ID NO: 3411222 - DNA, 22 bp, Homo sapiens
agccaggatcatggtgtaataa

SEQ ID NO: 3411223 - DNA, 13 bp, Homo sapiens
ttctcattaaact

SEQ ID NO: 3411224 - DNA, 19 bp, Homo sapiens
ttctcatttcacccctccc

SEQ ID NO: 3411225 - DNA, 21 bp, Homo sapiens
ttctccaattctgaaatactt

SEQ ID NO: 3411226 - DNA, 18 bp, Homo sapiens
ttctccatggccctgcca

SEQ ID NO: 3411227 - DNA, 21 bp, Homo sapiens
ttctcccccatgttctgtccc

SEQ ID NO: 3411228 - DNA, 17 bp, Homo sapiens
ttctcccctgcccccag

SEQ ID NO: 3411229 - DNA, 19 bp, Homo sapiens
ttctcctgccctttcccag

SEQ ID NO: 3411230 - DNA, 18 bp, Homo sapiens
ttctcgcctcactttcca

SEQ ID NO: 3411231 - DNA, 16 bp, Homo sapiens
ttctctggcaaacttt

SEQ ID NO: 3411232 - DNA, 19 bp, Homo sapiens
ttctgaaaattaacactgc

SEQ ID NO: 3411233 - DNA, 14 bp, Homo sapiens
ttctgaaatacttt

SEQ ID NO: 3411234 - DNA, 15 bp, Homo sapiens
ttctgatctgatttt

SEQ ID NO: 3411235 - DNA, 14 bp, Homo sapiens
ttctgatctgtact

SEQ ID NO: 3411236 - DNA, 16 bp, Homo sapiens
ttctgatctgtacttt

SEQ ID NO: 3411237 - DNA, 16 bp, Homo sapiens
ttctggctttgttctt

SEQ ID NO: 3411238 - DNA, 13 bp, Homo sapiens
ttctgggtgattt

SEQ ID NO: 3411239 - DNA, 13 bp, Homo sapiens
ttctgtaaatgaa

SEQ ID NO: 3411240 - DNA, 13 bp, Homo sapiens
ttctgttctactt

SEQ ID NO: 3411241 - DNA, 23 bp, Homo sapiens
ttcttaaaatgcaatatttgtaa

SEQ ID NO: 3411242 - DNA, 17 bp, Homo sapiens
ttcttaaacaaatgtat

SEQ ID NO: 3411243 - DNA, 14 bp, Homo sapiens
ttcttaaatgtttt

SEQ ID NO: 3411244 - DNA, 16 bp, Homo sapiens
ttcttacaagcttaaa

SEQ ID NO: 3411245 - DNA, 19 bp, Homo sapiens
ttcttacaagcttaaagct

SEQ ID NO: 3411246 - DNA, 20 bp, Homo sapiens
ttcttacaagcttaaagctt

SEQ ID NO: 3411247 - DNA, 21 bp, Homo sapiens
ttcttagacctcttcctggaa

SEQ ID NO: 3411248 - DNA, 23 bp, Homo sapiens
ttcttagacctcttcctggaata

SEQ ID NO: 3411249 - DNA, 22 bp, Homo sapiens
ttcttagtgttggtttaatatt

SEQ ID NO: 3411250 - DNA, 13 bp, Homo sapiens
ttcttattcagtg

SEQ ID NO: 3411251 - DNA, 21 bp, Homo sapiens
ttcttcctatttgccatgggc

SEQ ID NO: 3411252 - DNA, 15 bp, Homo sapiens
ttcttgagctgttgt

SEQ ID NO: 3411253 - DNA, 18 bp, Homo sapiens
ttcttgcctctgtcccct

SEQ ID NO: 3411254 - DNA, 17 bp, Homo sapiens
ttctttatataaggtca

SEQ ID NO: 3411255 - DNA, 14 bp, Homo sapiens
ttctttccattatg

SEQ ID NO: 3411256 - DNA, 22 bp, Homo sapiens
ttctttctagtggtctttgtaa

SEQ ID NO: 3411257 - DNA, 15 bp, Homo sapiens
ttctttgaatgtatt

SEQ ID NO: 3411258 - DNA, 17 bp, Homo sapiens
ttctttgataatgttaa

SEQ ID NO: 3411259 - DNA, 18 bp, Homo sapiens
ttctttgataatgttaaa

SEQ ID NO: 3411260 - DNA, 22 bp, Homo sapiens
ttctttgataatgttaaatttg

SEQ ID NO: 3411261 - DNA, 15 bp, Homo sapiens
ttctttgatagtgta

SEQ ID NO: 3411262 - DNA, 16 bp, Homo sapiens
ttctttgttacaggca

SEQ ID NO: 3411263 - DNA, 14 bp, Homo sapiens
ttcttttctttgta

SEQ ID NO: 3411264 - DNA, 19 bp, Homo sapiens
ttcttttttaaagtaaact

SEQ ID NO: 3411265 - DNA, 12 bp, Homo sapiens
ttgaaaaacttt

SEQ ID NO: 3411266 - DNA, 13 bp, Homo sapiens
ttgaaaagctatt

SEQ ID NO: 3411267 - DNA, 21 bp, Homo sapiens
ttactcttaaatcatttggtt

SEQ ID NO: 3411268 - DNA, 21 bp, Homo sapiens
ttactgaaaaaaaaaaaagaa

SEQ ID NO: 3411269 - DNA, 21 bp, Homo sapiens
ttactgatcttacctttatga

SEQ ID NO: 3411270 - DNA, 18 bp, Homo sapiens
ttactgcttctctttgtg

SEQ ID NO: 3411271 - DNA, 17 bp, Homo sapiens
ttactgtcttaaatcag

SEQ ID NO: 3411272 - DNA, 14 bp, Homo sapiens
ttactgtggaggaa

SEQ ID NO: 3411273 - DNA, 23 bp, Homo sapiens
ttactgttacctgatcaatgaca

SEQ ID NO: 3411274 - DNA, 16 bp, Homo sapiens
ttacttaaacatcatt

SEQ ID NO: 3411275 - DNA, 14 bp, Homo sapiens
ttacttagaatgcc

SEQ ID NO: 3411276 - DNA, 20 bp, Homo sapiens
ttactttactgcctgaataa

SEQ ID NO: 3411277 - DNA, 14 bp, Homo sapiens
ttagaagaagtgtg

SEQ ID NO: 3411278 - DNA, 15 bp, Homo sapiens
ttagaagaagtgtgt

SEQ ID NO: 3411279 - DNA, 16 bp, Homo sapiens
ttagaagaagtgtgtc

SEQ ID NO: 3411280 - DNA, 17 bp, Homo sapiens
ttagaatgccataaaat

SEQ ID NO: 3411281 - DNA, 21 bp, Homo sapiens
ttagaatgccataaaattgca

SEQ ID NO: 3411282 - DNA, 15 bp, Homo sapiens
ttagacctttatcca

SEQ ID NO: 3411283 - DNA, 22 bp, Homo sapiens
ttagactgtggccatatatgct

SEQ ID NO: 3411284 - DNA, 21 bp, Homo sapiens
ttagattttctgtaaatgaag

SEQ ID NO: 3411285 - DNA, 17 bp, Homo sapiens
ttagccaggatcatggt

SEQ ID NO: 3411286 - DNA, 15 bp, Homo sapiens
ttagccagtcattgt

SEQ ID NO: 3411287 - DNA, 12 bp, Homo sapiens
ttagcttgctta

SEQ ID NO: 3411288 - DNA, 15 bp, Homo sapiens
ttagctttttcctta

SEQ ID NO: 3411289 - DNA, 22 bp, Homo sapiens
ttagggaaaatggatatagaaa

SEQ ID NO: 3411290 - DNA, 15 bp, Homo sapiens
ttagggtgggtaaga

SEQ ID NO: 3411291 - DNA, 20 bp, Homo sapiens
ttagtatagtagaaagacat

SEQ ID NO: 3411292 - DNA, 20 bp, Homo sapiens
ttagttgtatctcttttgaa

SEQ ID NO: 3411293 - DNA, 17 bp, Homo sapiens
ttataatgccagaatat

SEQ ID NO: 3411294 - DNA, 23 bp, Homo sapiens
ttataatgccagaatataatgtg

SEQ ID NO: 3411295 - DNA, 22 bp, Homo sapiens
ttataccagcaaagagaatgta

SEQ ID NO: 3411296 - DNA, 23 bp, Homo sapiens
ttatatattgaaagttgctttta

SEQ ID NO: 3411297 - DNA, 12 bp, Homo sapiens
ttatattcatca

SEQ ID NO: 3411298 - DNA, 18 bp, Homo sapiens
ttatcaaaaagtataaat

SEQ ID NO: 3411299 - DNA, 15 bp, Homo sapiens
ttatcgaaataacaa

SEQ ID NO: 3411300 - DNA, 19 bp, Homo sapiens
ttatcgaaataacaatgtt

SEQ ID NO: 3411301 - DNA, 20 bp, Homo sapiens
ttatctcagtcatgcataaa

SEQ ID NO: 3411302 - DNA, 17 bp, Homo sapiens
ttatcttgagtgttatg

SEQ ID NO: 3411303 - DNA, 17 bp, Homo sapiens
ttatgaatgagttttac

SEQ ID NO: 3411304 - DNA, 19 bp, Homo sapiens
ttatgaatgagttttacaa

SEQ ID NO: 3411305 - DNA, 23 bp, Homo sapiens
ttatgacacaatgacacatttgt

SEQ ID NO: 3411306 - DNA, 15 bp, Homo sapiens
ttatgccttttattt

SEQ ID NO: 3411307 - DNA, 11 bp, Homo sapiens
ttatggacatc

SEQ ID NO: 3411308 - DNA, 15 bp, Homo sapiens
ttatgtagatgtgca

SEQ ID NO: 3411309 - DNA, 12 bp, Homo sapiens
ttatgtgtgtgt

SEQ ID NO: 3411310 - DNA, 14 bp, Homo sapiens
ttatgtgtgtgtgt

SEQ ID NO: 3411311 - DNA, 12 bp, Homo sapiens
ttatgtgttaca

SEQ ID NO: 3411312 - DNA, 13 bp, Homo sapiens
ttatgtgttacat

SEQ ID NO: 3411313 - DNA, 13 bp, Homo sapiens
ttattaaatctga

SEQ ID NO: 3411314 - DNA, 18 bp, Homo sapiens
ttattcagtgaaaaagat

SEQ ID NO: 3411315 - DNA, 11 bp, Homo sapiens
ttattcatttt

SEQ ID NO: 3411316 - DNA, 16 bp, Homo sapiens
ttattcttttccagaa

SEQ ID NO: 3411317 - DNA, 23 bp, Homo sapiens
ttattgcaccattttcaatttgg

SEQ ID NO: 3411318 - DNA, 12 bp, Homo sapiens
ttatttaataac

SEQ ID NO: 3411319 - DNA, 14 bp, Homo sapiens
ttatttaataacat

SEQ ID NO: 3411320 - DNA, 20 bp, Homo sapiens
ttatttcagatgattcaaat

SEQ ID NO: 3411321 - DNA, 13 bp, Homo sapiens
ttatttcatcatg

SEQ ID NO: 3411322 - DNA, 21 bp, Homo sapiens
ttatttctctggcaaactttt

SEQ ID NO: 3411323 - DNA, 15 bp, Homo sapiens
ttatttctgatgttt

SEQ ID NO: 3411324 - DNA, 19 bp, Homo sapiens
ttatttcttaaacaaatgt

SEQ ID NO: 3411325 - DNA, 13 bp, Homo sapiens
ttatttcttttgt

SEQ ID NO: 3411326 - DNA, 13 bp, Homo sapiens
ttattttcattgt

SEQ ID NO: 3411327 - DNA, 15 bp, Homo sapiens
ttattttcattgtga

SEQ ID NO: 3411328 - DNA, 21 bp, Homo sapiens
ttcaaattggtctgaaaggct

SEQ ID NO: 3411329 - DNA, 17 bp, Homo sapiens
ttcaaatttactgtctt

SEQ ID NO: 3411330 - DNA, 20 bp, Homo sapiens
ttcaatggtttgcaaggaag

SEQ ID NO: 3411331 - DNA, 23 bp, Homo sapiens
ttcaatggtttgcaaggaagcca

SEQ ID NO: 3411332 - DNA, 23 bp, Homo sapiens
ttcaatgtccacctgtgagaaag

SEQ ID NO: 3411333 - DNA, 20 bp, Homo sapiens
ttcacacacagactgttgtc

SEQ ID NO: 3411334 - DNA, 15 bp, Homo sapiens
ttcacagttctgtaa

SEQ ID NO: 3411335 - DNA, 16 bp, Homo sapiens
ttcacccctccctttc

SEQ ID NO: 3411336 - DNA, 17 bp, Homo sapiens
ttcacccctccctttct

SEQ ID NO: 3411337 - DNA, 20 bp, Homo sapiens
ttcacccctccctttctccc

SEQ ID NO: 3411338 - DNA, 20 bp, Homo sapiens
ttcactcatgcaaactgctt

SEQ ID NO: 3411339 - DNA, 13 bp, Homo sapiens
ttcactctaattg

SEQ ID NO: 3411340 - DNA, 19 bp, Homo sapiens
ttcactggggcatgagatt

SEQ ID NO: 3411341 - DNA, 13 bp, Homo sapiens
ttcactgtataaa

SEQ ID NO: 3411342 - DNA, 22 bp, Homo sapiens
ttcactgtataaataggagagg

SEQ ID NO: 3411343 - DNA, 23 bp, Homo sapiens
ttcagccaaacagtatgatggaa

SEQ ID NO: 3411344 - DNA, 14 bp, Homo sapiens
ttcagctagaattt

SEQ ID NO: 3411345 - DNA, 19 bp, Homo sapiens
ttcagctggtggatggtga

SEQ ID NO: 3411346 - DNA, 21 bp, Homo sapiens
ttcagctggtggatggtgact

SEQ ID NO: 3411347 - DNA, 17 bp, Homo sapiens
ttcaggtgacatgtgaa

SEQ ID NO: 3411348 - DNA, 21 bp, Homo sapiens
ttcaggtgacatgtgaaacct

SEQ ID NO: 3411349 - DNA, 22 bp, Homo sapiens
ttcaggtgacatgtgaaacctt

SEQ ID NO: 3411350 - DNA, 23 bp, Homo sapiens
ttcaggtgacatgtgaaaccttt

SEQ ID NO: 3411351 - DNA, 20 bp, Homo sapiens
ttcaggttatcgaaataaca

SEQ ID NO: 3411352 - DNA, 14 bp, Homo sapiens
ttcagtattatttg

SEQ ID NO: 3411353 - DNA, 15 bp, Homo sapiens
ttcagtattttccag

SEQ ID NO: 3411354 - DNA, 16 bp, Homo sapiens
ttcagtattttccagc

SEQ ID NO: 3411355 - DNA, 13 bp, Homo sapiens
ttcagtgatggca

SEQ ID NO: 3411356 - DNA, 20 bp, Homo sapiens
ttcagtttttttttttccag

SEQ ID NO: 3411357 - DNA, 21 bp, Homo sapiens
ttcatagatttgaaaaacttt

SEQ ID NO: 3411358 - DNA, 16 bp, Homo sapiens
ttcatccaaggaacct

SEQ ID NO: 3411359 - DNA, 13 bp, Homo sapiens
ttcatctgctctc

SEQ ID NO: 3411360 - DNA, 15 bp, Homo sapiens
ttcatctgctctcct

SEQ ID NO: 3411361 - DNA, 19 bp, Homo sapiens
ttcatctgctctccttcct

SEQ ID NO: 3411362 - DNA, 16 bp, Homo sapiens
ttcattacactaaagt

SEQ ID NO: 3411363 - DNA, 14 bp, Homo sapiens
ttcattgtgattta

SEQ ID NO: 3411364 - DNA, 19 bp, Homo sapiens
ttccaaaataatctatatt

SEQ ID NO: 3411365 - DNA, 23 bp, Homo sapiens
ttccaaaataatctatattaaat

SEQ ID NO: 3411366 - DNA, 12 bp, Homo sapiens
ttccaagacagt

SEQ ID NO: 3411367 - DNA, 15 bp, Homo sapiens
ttccacacaaaatgt

SEQ ID NO: 3411368 - DNA, 14 bp, Homo sapiens
ttccacgtgtatgc

SEQ ID NO: 3411369 - DNA, 16 bp, Homo sapiens
ttccagccttatgtgt

SEQ ID NO: 3411370 - DNA, 17 bp, Homo sapiens
ttccagttttgttttga

SEQ ID NO: 3411371 - DNA, 24 bp, Homo sapiens
ttccatgaaaatgcaacaacatgt

SEQ ID NO: 3411372 - DNA, 14 bp, Homo sapiens
ttccattatgattc

SEQ ID NO: 3411373 - DNA, 19 bp, Homo sapiens
ttcccaggtaatttaaatt

SEQ ID NO: 3411374 - DNA, 20 bp, Homo sapiens
ttcccaggtaatttaaattg

SEQ ID NO: 3411375 - DNA, 20 bp, Homo sapiens
ttcccgtaaggctgtacata

SEQ ID NO: 3411376 - DNA, 23 bp, Homo sapiens
ttcccgtaaggctgtacatagtc

SEQ ID NO: 3411377 - DNA, 18 bp, Homo sapiens
ttccctcattctgcatta

SEQ ID NO: 3411378 - DNA, 19 bp, Homo sapiens
ttccctcattctgcattaa

SEQ ID NO: 3411379 - DNA, 12 bp, Homo sapiens
ttccctgtggat

SEQ ID NO: 3411380 - DNA, 21 bp, Homo sapiens
tttcctatctagcatttattt

SEQ ID NO: 3411381 - DNA, 23 bp, Homo sapiens
tttcctatctagcatttatttct

SEQ ID NO: 3411382 - DNA, 21 bp, Homo sapiens
tttcctttaaaaaaatttaag

SEQ ID NO: 3411383 - DNA, 22 bp, Homo sapiens
tttcctttaaaaaaatttaagt

SEQ ID NO: 3411384 - DNA, 20 bp, Homo sapiens
tttcgtgtaatattctctga

SEQ ID NO: 3411385 - DNA, 14 bp, Homo sapiens
tttctagtggtctt

SEQ ID NO: 3411386 - DNA, 18 bp, Homo sapiens
tttctagtggtctttgta

SEQ ID NO: 3411387 - DNA, 19 bp, Homo sapiens
tttctagtggtctttgtaa

SEQ ID NO: 3411388 - DNA, 15 bp, Homo sapiens
tttctcaaagttttg

SEQ ID NO: 3411389 - DNA, 18 bp, Homo sapiens
tttctcaaagttttgaaa

SEQ ID NO: 3411390 - DNA, 16 bp, Homo sapiens
tttctcccctgccccc

SEQ ID NO: 3411391 - DNA, 16 bp, Homo sapiens
tttctctggcaaactt

SEQ ID NO: 3411392 - DNA, 20 bp, Homo sapiens
tttctgaaaattaacactgc

SEQ ID NO: 3411393 - DNA, 23 bp, Homo sapiens
tttctgagtgagttttactctta

SEQ ID NO: 3411394 - DNA, 19 bp, Homo sapiens
tttctgatctgtactttgt

SEQ ID NO: 3411395 - DNA, 14 bp, Homo sapiens
tttctgatgtttta

SEQ ID NO: 3411396 - DNA, 15 bp, Homo sapiens
tttctgatgttttat

SEQ ID NO: 3411397 - DNA, 15 bp, Homo sapiens
tttctgtaaatgaag

SEQ ID NO: 3411398 - DNA, 18 bp, Homo sapiens
tttcttaaatgttttcat

SEQ ID NO: 3411399 - DNA, 12 bp, Homo sapiens
tttcttagcttt

SEQ ID NO: 3411400 - DNA, 13 bp, Homo sapiens
tttcttagctttt

SEQ ID NO: 3411401 - DNA, 20 bp, Homo sapiens
tttcttagctttttaattgt

SEQ ID NO: 3411402 - DNA, 19 bp, Homo sapiens
tttcttcaagtgagtggca

SEQ ID NO: 3411403 - DNA, 12 bp, Homo sapiens
tttcttgcctct

SEQ ID NO: 3411404 - DNA, 18 bp, Homo sapiens
tttcttgcctctgtcccc

SEQ ID NO: 3411405 - DNA, 11 bp, Homo sapiens
tttctttgaat

SEQ ID NO: 3411406 - DNA, 18 bp, Homo sapiens
tttctttgtagaataaat

SEQ ID NO: 3411407 - DNA, 15 bp, Homo sapiens
tttcttttttaaagt

SEQ ID NO: 3411408 - DNA, 18 bp, Homo sapiens
tttcttttttaaagtaaa

SEQ ID NO: 3411409 - DNA, 21 bp, Homo sapiens
tttcttttttaaagtaaactt

SEQ ID NO: 3411410 - DNA, 16 bp, Homo sapiens
tttgaaactaactcat

SEQ ID NO: 3411411 - DNA, 21 bp, Homo sapiens
tttgaaagtgggtttcaattt

SEQ ID NO: 3411412 - DNA, 19 bp, Homo sapiens
tttgaagatctgatttata

SEQ ID NO: 3411413 - DNA, 21 bp, Homo sapiens
tttgaaggaatacaatatata

SEQ ID NO: 3411414 - DNA, 19 bp, Homo sapiens
tttgaatataaacactata

SEQ ID NO: 3411415 - DNA, 16 bp, Homo sapiens
tttgacgaagaaacaa

SEQ ID NO: 3411416 - DNA, 12 bp, Homo sapiens
tttgataacatt

SEQ ID NO: 3411417 - DNA, 18 bp, Homo sapiens
tttgatagtattgtgcat

SEQ ID NO: 3411418 - DNA, 16 bp, Homo sapiens
tttgatctttgtttaa

SEQ ID NO: 3411419 - DNA, 14 bp, Homo sapiens
tttgattctccttc

SEQ ID NO: 3411420 - DNA, 12 bp, Homo sapiens
tttgcaaggaag

SEQ ID NO: 3411421 - DNA, 16 bp, Homo sapiens
tttgcaggtctttaaa

SEQ ID NO: 3411422 - DNA, 19 bp, Homo sapiens
tttgctatgagctggggat

SEQ ID NO: 3411423 - DNA, 21 bp, Homo sapiens
tttgctgaatgtcattatttg

SEQ ID NO: 3411424 - DNA, 13 bp, Homo sapiens
tttgctgttactg

SEQ ID NO: 3411425 - DNA, 20 bp, Homo sapiens
tttgctgttttaaattgcat

SEQ ID NO: 3411426 - DNA, 18 bp, Homo sapiens
tttggaagaagtttttta

SEQ ID NO: 3411427 - DNA, 16 bp, Homo sapiens
tttggtgagatctcta

SEQ ID NO: 3411428 - DNA, 15 bp, Homo sapiens
tttggttttgttccc

SEQ ID NO: 3411429 - DNA, 19 bp, Homo sapiens
tttggttttgttcccctcc

SEQ ID NO: 3411430 - DNA, 21 bp, Homo sapiens
tttggttttgttcccctcctc

SEQ ID NO: 3411431 - DNA, 17 bp, Homo sapiens
tttgtaaagtccccaga

SEQ ID NO: 3411432 - DNA, 21 bp, Homo sapiens
tttgtaagagtgtagaagcat

SEQ ID NO: 3411433 - DNA, 22 bp, Homo sapiens
tttgtaagagtgtagaagcatt

SEQ ID NO: 3411434 - DNA, 23 bp, Homo sapiens
tttgtaagagtgtagaagcattc

SEQ ID NO: 3411435 - DNA, 14 bp, Homo sapiens
tttgtaagtttcag

SEQ ID NO: 3411436 - DNA, 21 bp, Homo sapiens
tttgtaagtttcaggtgacat

SEQ ID NO: 3411437 - DNA, 16 bp, Homo sapiens
tttgtaatatgagaat

SEQ ID NO: 3411438 - DNA, 12 bp, Homo sapiens
tttgtacatttt

SEQ ID NO: 3411439 - DNA, 17 bp, Homo sapiens
tttgtagaataaatggt

SEQ ID NO: 3411440 - DNA, 17 bp, Homo sapiens
tttgtataccatgatgc

SEQ ID NO: 3411441 - DNA, 13 bp, Homo sapiens
tttgtatgtatta

SEQ ID NO: 3411442 - DNA, 23 bp, Homo sapiens
tttgtatttaatgatttttgtgt

SEQ ID NO: 3411443 - DNA, 23 bp, Homo sapiens
tttgtgaatggattggattattt

SEQ ID NO: 3411444 - DNA, 22 bp, Homo sapiens
tttgttaacagacactgtaaaa

SEQ ID NO: 3411445 - DNA, 16 bp, Homo sapiens
tttgttcccctcctcc

SEQ ID NO: 3411446 - DNA, 19 bp, Homo sapiens
tttgttcccctcctccact

SEQ ID NO: 3411447 - DNA, 13 bp, Homo sapiens
tttgtttatgtta

SEQ ID NO: 3411448 - DNA, 13 bp, Homo sapiens
tttgtttgtgcat

SEQ ID NO: 3411449 - DNA, 15 bp, Homo sapiens
ttttaaaaatacatt

SEQ ID NO: 3411450 - DNA, 14 bp, Homo sapiens
ttttaaaagagaca

SEQ ID NO: 3411451 - DNA, 15 bp, Homo sapiens
ttttaaaagtataca

SEQ ID NO: 3411452 - DNA, 18 bp, Homo sapiens
ttttaaaatcataacatt

SEQ ID NO: 3411453 - DNA, 23 bp, Homo sapiens
ttttaaacaaaatttcacagttc

SEQ ID NO: 3411454 - DNA, 12 bp, Homo sapiens
ttttaaacagtg

SEQ ID NO: 3411455 - DNA, 17 bp, Homo sapiens
ttttaaagaaaatgtgt

SEQ ID NO: 3411456 - DNA, 18 bp, Homo sapiens
ttttaaatatttgttctt

SEQ ID NO: 3411457 - DNA, 18 bp, Homo sapiens
ttttaagatttttctcaa

SEQ ID NO: 3411458 - DNA, 12 bp, Homo sapiens
ttttaatttcca

SEQ ID NO: 3411459 - DNA, 13 bp, Homo sapiens
ttttaatttgata

SEQ ID NO: 3411460 - DNA, 15 bp, Homo sapiens
ttttacaaattcctt

SEQ ID NO: 3411461 - DNA, 20 bp, Homo sapiens
ttttacaaattcctttcaga

SEQ ID NO: 3411462 - DNA, 18 bp, Homo sapiens
ttttagttaatattttta

SEQ ID NO: 3411463 - DNA, 15 bp, Homo sapiens
ttttatagttgtatt

SEQ ID NO: 3411464 - DNA, 16 bp, Homo sapiens
ttttatagttgtattt

SEQ ID NO: 3411465 - DNA, 20 bp, Homo sapiens
ttttattcagctagaatttc

SEQ ID NO: 3411466 - DNA, 14 bp, Homo sapiens
ttttattgctacaa

SEQ ID NO: 3411467 - DNA, 11 bp, Homo sapiens
ttttatttaca

SEQ ID NO: 3411468 - DNA, 12 bp, Homo sapiens
ttttatttctga

SEQ ID NO: 3411469 - DNA, 21 bp, Homo sapiens
ttttcagattccacacaaaat

SEQ ID NO: 3411470 - DNA, 21 bp, Homo sapiens
ttttcatactcttaagtgtaa

SEQ ID NO: 3411471 - DNA, 19 bp, Homo sapiens
ttttccagccttatgtgtt

SEQ ID NO: 3411472 - DNA, 12 bp, Homo sapiens
ttttccaggctg

SEQ ID NO: 3411473 - DNA, 14 bp, Homo sapiens
ttttctaaatcctt

SEQ ID NO: 3411474 - DNA, 15 bp, Homo sapiens
ttttctcaaagtttt

SEQ ID NO: 3411475 - DNA, 16 bp, Homo sapiens
ttttcttaaatgtttt

SEQ ID NO: 3411476 - DNA, 18 bp, Homo sapiens
ttttcttgcctctgtccc

SEQ ID NO: 3411477 - DNA, 12 bp, Homo sapiens
ttttctttgtat

SEQ ID NO: 3411478 - DNA, 22 bp, Homo sapiens
ttttcttttttaaagtaaactt

SEQ ID NO: 3411479 - DNA, 23 bp, Homo sapiens
ttttgaaaagctattagccagga

SEQ ID NO: 3411480 - DNA, 14 bp, Homo sapiens
ttttgaaggaatac

SEQ ID NO: 3411481 - DNA, 15 bp, Homo sapiens
ttttgcccatataaa

SEQ ID NO: 3411482 - DNA, 13 bp, Homo sapiens
ttttgctttgtta

SEQ ID NO: 3411483 - DNA, 23 bp, Homo sapiens
ttttgtgaatggattggattatt

SEQ ID NO: 3411484 - DNA, 22 bp, Homo sapiens
ttttgtgctcaaaataaaaagc

SEQ ID NO: 3411485 - DNA, 20 bp, Homo sapiens
ttttgtgtatccagtatgca

SEQ ID NO: 3411486 - DNA, 14 bp, Homo sapiens
ttttgttcccctcc

SEQ ID NO: 3411487 - DNA, 19 bp, Homo sapiens
ttttgttcccctcctccac

SEQ ID NO: 3411488 - DNA, 21 bp, Homo sapiens
tttttaaagaaaatgtgtctg

SEQ ID NO: 3411489 - DNA, 22 bp, Homo sapiens
tttttaactctactgtgtaata

SEQ ID NO: 3411490 - DNA, 16 bp, Homo sapiens
tttttaagatttttct

SEQ ID NO: 3411491 - DNA, 20 bp, Homo sapiens
tttttaattgttgtttcttt

SEQ ID NO: 3411492 - DNA, 16 bp, Homo sapiens
tttttcatactcttaa

SEQ ID NO: 3411493 - DNA, 13 bp, Homo sapiens
tttttccatctgt

SEQ ID NO: 3411494 - DNA, 13 bp, Homo sapiens
tttttcccctgca

SEQ ID NO: 3411495 - DNA, 14 bp, Homo sapiens
tttttcccctgcaa

SEQ ID NO: 3411496 - DNA, 12 bp, Homo sapiens
tttttgtatttt

SEQ ID NO: 3411497 - DNA, 12 bp, Homo sapiens
ttttttactttg

SEQ ID NO: 3411498 - DNA, 20 bp, Homo sapiens
tggaaaaggaagactagagg

SEQ ID NO: 3411499 - DNA, 23 bp, Homo sapiens
tggaaactaccagtgggcatgta

SEQ ID NO: 3411500 - DNA, 21 bp, Homo sapiens
tggaaactggatgaggtcata

SEQ ID NO: 3411501 - DNA, 21 bp, Homo sapiens
tggaaaggagcctaggccagg

SEQ ID NO: 3411502 - DNA, 21 bp, Homo sapiens
tggaaaggattctaaacagat

SEQ ID NO: 3411503 - DNA, 16 bp, Homo sapiens
tggaactggaggcagg

SEQ ID NO: 3411504 - DNA, 21 bp, Homo sapiens
tggaagtgtgggtctgtgtgt

SEQ ID NO: 3411505 - DNA, 23 bp, Homo sapiens
tggaagtgtgggtctgtgtgtgt

SEQ ID NO: 3411506 - DNA, 20 bp, Homo sapiens
tggaatgatgggtcagttgt

SEQ ID NO: 3411507 - DNA, 15 bp, Homo sapiens
tggaatgtcagtgtt

SEQ ID NO: 3411508 - DNA, 17 bp, Homo sapiens
tggaatttttgaatcta

SEQ ID NO: 3411509 - DNA, 16 bp, Homo sapiens
tggacagaagcagctc

SEQ ID NO: 3411510 - DNA, 18 bp, Homo sapiens
tggacagaagcagctctt

SEQ ID NO: 3411511 - DNA, 19 bp, Homo sapiens
tggacatcgatatgaaaaa

SEQ ID NO: 3411512 - DNA, 13 bp, Homo sapiens
tggacccctgcat

SEQ ID NO: 3411513 - DNA, 21 bp, Homo sapiens
tggacccgttcatgggggagg

SEQ ID NO: 3411514 - DNA, 15 bp, Homo sapiens
tggactgaggcctga

SEQ ID NO: 3411515 - DNA, 21 bp, Homo sapiens
tggagaagccacaggcctgag

SEQ ID NO: 3411516 - DNA, 22 bp, Homo sapiens
tggagaagccacaggcctgaga

SEQ ID NO: 3411517 - DNA, 19 bp, Homo sapiens
tggagcccagaggagggca

SEQ ID NO: 3411518 - DNA, 21 bp, Homo sapiens
tggagccctgttggcagctct

SEQ ID NO: 3411519 - DNA, 22 bp, Homo sapiens
tggagcggctcatcagaactga

SEQ ID NO: 3411520 - DNA, 22 bp, Homo sapiens
tggaggagcccaggccaggact

SEQ ID NO: 3411521 - DNA, 22 bp, Homo sapiens
tggaggagctcaggacactaat

SEQ ID NO: 3411522 - DNA, 13 bp, Homo sapiens
tggatatagaaaa

SEQ ID NO: 3411523 - DNA, 15 bp, Homo sapiens
tggatctgtgagggg

SEQ ID NO: 3411524 - DNA, 19 bp, Homo sapiens
tggatctgtgaggggctct

SEQ ID NO: 3411525 - DNA, 20 bp, Homo sapiens
tggatggtgacttttgaaga

SEQ ID NO: 3411526 - DNA, 20 bp, Homo sapiens
tggattccaaagcattttca

SEQ ID NO: 3411527 - DNA, 17 bp, Homo sapiens
tggattggattatttaa

SEQ ID NO: 3411528 - DNA, 20 bp, Homo sapiens
tggatttctttatataaggt

SEQ ID NO: 3411529 - DNA, 12 bp, Homo sapiens
tggatttgctgt

SEQ ID NO: 3411530 - DNA, 22 bp, Homo sapiens
tggattttggttttgttcccct

SEQ ID NO: 3411531 - DNA, 18 bp, Homo sapiens
tggcagaagacaccagag

SEQ ID NO: 3411532 - DNA, 22 bp, Homo sapiens
tggcagaatggggtgcatgaag

SEQ ID NO: 3411533 - DNA, 14 bp, Homo sapiens
tggcagtgtttgta

SEQ ID NO: 3411534 - DNA, 19 bp, Homo sapiens
tggcatcgcagcttcctgt

SEQ ID NO: 3411535 - DNA, 23 bp, Homo sapiens
tggcattaattgttccttgcttt

SEQ ID NO: 3411536 - DNA, 17 bp, Homo sapiens
tggccacagacccccag

SEQ ID NO: 3411537 - DNA, 16 bp, Homo sapiens
tggccagtggctggat

SEQ ID NO: 3411538 - DNA, 17 bp, Homo sapiens
tggccatatatgctgta

SEQ ID NO: 3411539 - DNA, 16 bp, Homo sapiens
tggccctcctcagctc

SEQ ID NO: 3411540 - DNA, 21 bp, Homo sapiens
tggccgcgccaaataatgtct

SEQ ID NO: 3411541 - DNA, 15 bp, Homo sapiens
tggcctcccccactt

SEQ ID NO: 3411542 - DNA, 21 bp, Homo sapiens
tggcctgttcttctatgggtt

SEQ ID NO: 3411543 - DNA, 20 bp, Homo sapiens
tggccttgtcctcagccagt

SEQ ID NO: 3411544 - DNA, 22 bp, Homo sapiens
tggctgccttgtgaaggaatta

SEQ ID NO: 3411545 - DNA, 16 bp, Homo sapiens
tggcttcactcctgct

SEQ ID NO: 3411546 - DNA, 19 bp, Homo sapiens
tggcttcactcctgctgta

SEQ ID NO: 3411547 - DNA, 19 bp, Homo sapiens
tggcttcttttctttgtat

SEQ ID NO: 3411548 - DNA, 12 bp, Homo sapiens
tggcttgctgtt

SEQ ID NO: 3411549 - DNA, 14 bp, Homo sapiens
tggcttgctgttta

SEQ ID NO: 3411550 - DNA, 23 bp, Homo sapiens
tgggacctataactgcccagcgg

SEQ ID NO: 3411551 - DNA, 22 bp, Homo sapiens
tgggagatgaaaacctgcattt

SEQ ID NO: 3411552 - DNA, 21 bp, Homo sapiens
tgggagtgaggatgtctgggc

SEQ ID NO: 3411553 - DNA, 11 bp, Homo sapiens
tgggagtgtgt

SEQ ID NO: 3411554 - DNA, 14 bp, Homo sapiens
tgggattaagtaca

SEQ ID NO: 3411555 - DNA, 21 bp, Homo sapiens
tgggctaacatttaggagaag

SEQ ID NO: 3411556 - DNA, 19 bp, Homo sapiens
tggggaaatagcttcagga

SEQ ID NO: 3411557 - DNA, 24 bp, Homo sapiens
tggggaagacccattccttcccag

SEQ ID NO: 3411558 - DNA, 20 bp, Homo sapiens
tggggaagaggttttattta

SEQ ID NO: 3411559 - DNA, 12 bp, Homo sapiens
tggggaggagga

SEQ ID NO: 3411560 - DNA, 13 bp, Homo sapiens
tggggaggaggag

SEQ ID NO: 3411561 - DNA, 14 bp, Homo sapiens
tggggagggatttg

SEQ ID NO: 3411562 - DNA, 16 bp, Homo sapiens
tggggatagatgtgtg

SEQ ID NO: 3411563 - DNA, 17 bp, Homo sapiens
tggggatagatgtgtgg

SEQ ID NO: 3411564 - DNA, 20 bp, Homo sapiens
tggggatagatgtgtggaca

SEQ ID NO: 3411565 - DNA, 19 bp, Homo sapiens
tgggggtagggggctggag

SEQ ID NO: 3411566 - DNA, 15 bp, Homo sapiens
tgggggtctgtgtgt

SEQ ID NO: 3411567 - DNA, 15 bp, Homo sapiens
tggggtaggttggga

SEQ ID NO: 3411568 - DNA, 18 bp, Homo sapiens
tgggtgctgatccttgca

SEQ ID NO: 3411569 - DNA, 23 bp, Homo sapiens
tgggtgtaacaggtctcctctta

SEQ ID NO: 3411570 - DNA, 18 bp, Homo sapiens
tgggtttacaacaaacac

SEQ ID NO: 3411571 - DNA, 13 bp, Homo sapiens
tgggtttcaattt

SEQ ID NO: 3411572 - DNA, 14 bp, Homo sapiens
tgggtttcaattta

SEQ ID NO: 3411573 - DNA, 22 bp, Homo sapiens
tggtaacaaataacctataaag

SEQ ID NO: 3411574 - DNA, 18 bp, Homo sapiens
tggtaagtgaatttatga

SEQ ID NO: 3411575 - DNA, 22 bp, Homo sapiens
tggtagggtataatgtgtctgt

SEQ ID NO: 3411576 - DNA, 22 bp, Homo sapiens
tggtatctagacccatcttctt

SEQ ID NO: 3411577 - DNA, 19 bp, Homo sapiens
tggtcattcctaatgcatt

SEQ ID NO: 3411578 - DNA, 23 bp, Homo sapiens
tggtctttgtaagagtgtagaag

SEQ ID NO: 3411579 - DNA, 17 bp, Homo sapiens
tggtgacttttgaagaa

SEQ ID NO: 3411580 - DNA, 17 bp, Homo sapiens
tggtgtaataagacata

SEQ ID NO: 3411581 - DNA, 18 bp, Homo sapiens
tggtgtagccctcccact

SEQ ID NO: 3411582 - DNA, 20 bp, Homo sapiens
tggtgtctccaaccccccag

SEQ ID NO: 3411583 - DNA, 14 bp, Homo sapiens
tggtgtgtgtctct

SEQ ID NO: 3411584 - DNA, 21 bp, Homo sapiens
tggttagagaagtaagcagag

SEQ ID NO: 3411585 - DNA, 23 bp, Homo sapiens
tggttcagtttttttttttccag

SEQ ID NO: 3411586 - DNA, 17 bp, Homo sapiens
tggttctcatctttctt

SEQ ID NO: 3411587 - DNA, 16 bp, Homo sapiens
tggttgcactttgtag

SEQ ID NO: 3411588 - DNA, 13 bp, Homo sapiens
tggttgtatataa

SEQ ID NO: 3411589 - DNA, 17 bp, Homo sapiens
tggtttataataaactc

SEQ ID NO: 3411590 - DNA, 23 bp, Homo sapiens
tggttttcagattccacacaaaa

SEQ ID NO: 3411591 - DNA, 16 bp, Homo sapiens
tggttttgttcccctc

SEQ ID NO: 3411592 - DNA, 17 bp, Homo sapiens
tggttttgttcccctcc

SEQ ID NO: 3411593 - DNA, 19 bp, Homo sapiens
tggtttttagtgcacttaa

SEQ ID NO: 3411594 - DNA, 14 bp, Homo sapiens
tggtttttgttgag

SEQ ID NO: 3411595 - DNA, 15 bp, Homo sapiens
tggtttttgttgagt

SEQ ID NO: 3411596 - DNA, 13 bp, Homo sapiens
tgtaaaagtgtct

SEQ ID NO: 3411597 - DNA, 15 bp, Homo sapiens
tgtaaatttatgtga

SEQ ID NO: 3411598 - DNA, 16 bp, Homo sapiens
tgtaaatttatgtgat

SEQ ID NO: 3411599 - DNA, 21 bp, Homo sapiens
tgtaacaggtctcctcttaaa

SEQ ID NO: 3411600 - DNA, 13 bp, Homo sapiens
tgtaacctcgtgt

SEQ ID NO: 3411601 - DNA, 18 bp, Homo sapiens
tgtaagaactacaaacaa

SEQ ID NO: 3411602 - DNA, 15 bp, Homo sapiens
tgtaagagtgtagaa

SEQ ID NO: 3411603 - DNA, 22 bp, Homo sapiens
tgtaagcttagattttctgtaa

SEQ ID NO: 3411604 - DNA, 19 bp, Homo sapiens
tgtaagtttcaggtgacat

SEQ ID NO: 3411605 - DNA, 20 bp, Homo sapiens
tgtaagtttcaggtgacatg

SEQ ID NO: 3411606 - DNA, 23 bp, Homo sapiens
tgtaagtttcaggtgacatgtga

SEQ ID NO: 3411607 - DNA, 20 bp, Homo sapiens
tgtaataaaaagtatatgtt

SEQ ID NO: 3411608 - DNA, 15 bp, Homo sapiens
tgtaatatgagaatg

SEQ ID NO: 3411609 - DNA, 20 bp, Homo sapiens
tgtaatattctctgatgttt

SEQ ID NO: 3411610 - DNA, 15 bp, Homo sapiens
tgtaattaaactagt

SEQ ID NO: 3411611 - DNA, 18 bp, Homo sapiens
tgtaatttaaaattgtga

SEQ ID NO: 3411612 - DNA, 20 bp, Homo sapiens
tgtaatttaaaattgtgatg

SEQ ID NO: 3411613 - DNA, 22 bp, Homo sapiens
tgtaatttaaaattgtgatgtg

SEQ ID NO: 3411614 - DNA, 12 bp, Homo sapiens
tgtacatagtcc

SEQ ID NO: 3411615 - DNA, 22 bp, Homo sapiens
tgtacattagtcattcaataaa

SEQ ID NO: 3411616 - DNA, 21 bp, Homo sapiens
tgtacatttatgatttaataa

SEQ ID NO: 3411617 - DNA, 19 bp, Homo sapiens
tgtacattttggatttctt

SEQ ID NO: 3411618 - DNA, 19 bp, Homo sapiens
tgtaccatgtgctacaggg

SEQ ID NO: 3411619 - DNA, 14 bp, Homo sapiens
tgtacctctgcctc

SEQ ID NO: 3411620 - DNA, 18 bp, Homo sapiens
tgtactaggatactgctg

SEQ ID NO: 3411621 - DNA, 21 bp, Homo sapiens
tgtacttaaatgagttactta

SEQ ID NO: 3411622 - DNA, 22 bp, Homo sapiens
tgtagaagcattccttctttga

SEQ ID NO: 3411623 - DNA, 22 bp, Homo sapiens
tgtagactatggaatgtcagtg

SEQ ID NO: 3411624 - DNA, 17 bp, Homo sapiens
tgtagagttaagaagct

SEQ ID NO: 3411625 - DNA, 17 bp, Homo sapiens
tgtagataacactatgg

SEQ ID NO: 3411626 - DNA, 21 bp, Homo sapiens
tgtagatattgtgaagtacat

SEQ ID NO: 3411627 - DNA, 13 bp, Homo sapiens
tgtagtttcctct

SEQ ID NO: 3411628 - DNA, 17 bp, Homo sapiens
tgtagtttttaattaaa

SEQ ID NO: 3411629 - DNA, 18 bp, Homo sapiens
tgtataaataggagagga

SEQ ID NO: 3411630 - DNA, 15 bp, Homo sapiens
tgtataatattttta

SEQ ID NO: 3411631 - DNA, 17 bp, Homo sapiens
tgtataccatgatgcat

SEQ ID NO: 3411632 - DNA, 15 bp, Homo sapiens
tgtatagttgctttt

SEQ ID NO: 3411633 - DNA, 23 bp, Homo sapiens
tgtatataatcatgctcatgtat

SEQ ID NO: 3411634 - DNA, 15 bp, Homo sapiens
tgtatatatgtcaaa

SEQ ID NO: 3411635 - DNA, 19 bp, Homo sapiens
tgtatgtggatacagtcat

SEQ ID NO: 3411636 - DNA, 22 bp, Homo sapiens
tgtatgtgggggtctgtgtgtt

SEQ ID NO: 3411637 - DNA, 14 bp, Homo sapiens
tgtattcttaaaat

SEQ ID NO: 3411638 - DNA, 20 bp, Homo sapiens
tgtattcttaaaatgcaata

SEQ ID NO: 3411639 - DNA, 22 bp, Homo sapiens
tgtattcttaaaatgcaatatt

SEQ ID NO: 3411640 - DNA, 15 bp, Homo sapiens
tgtattgagtcttaa

SEQ ID NO: 3411641 - DNA, 19 bp, Homo sapiens
tgtattgagtcttaactgt

SEQ ID NO: 3411642 - DNA, 19 bp, Homo sapiens
tgtattgcatatatacata

SEQ ID NO: 3411643 - DNA, 14 bp, Homo sapiens
tgtattgcttcctg

SEQ ID NO: 3411644 - DNA, 15 bp, Homo sapiens
tgtattgcttcctga

SEQ ID NO: 3411645 - DNA, 15 bp, Homo sapiens
tgtattgttctgttt

SEQ ID NO: 3411646 - DNA, 13 bp, Homo sapiens
tgtatttcagtat

SEQ ID NO: 3411647 - DNA, 22 bp, Homo sapiens
tgtatttccttttctaaatcct

SEQ ID NO: 3411648 - DNA, 18 bp, Homo sapiens
tgtcaactttcatttgaa

SEQ ID NO: 3411649 - DNA, 17 bp, Homo sapiens
tgtcacacttgtttctt

SEQ ID NO: 3411650 - DNA, 16 bp, Homo sapiens
tgtcacagctcttgtt

SEQ ID NO: 3411651 - DNA, 22 bp, Homo sapiens
tgtcacccttaggccagcacca

SEQ ID NO: 3411652 - DNA, 21 bp, Homo sapiens
tgtcagcatgacaaaagtgac

SEQ ID NO: 3411653 - DNA, 19 bp, Homo sapiens
tgtcagctactaatgatgt

SEQ ID NO: 3411654 - DNA, 18 bp, Homo sapiens
tgtcagtatgtggaagtg

SEQ ID NO: 3411655 - DNA, 19 bp, Homo sapiens
tgtcagtatgtggaagtgt

SEQ ID NO: 3411656 - DNA, 16 bp, Homo sapiens
tgtcatcagtaagtat

SEQ ID NO: 3411657 - DNA, 20 bp, Homo sapiens
tgtcatgtgtatgagaagta

SEQ ID NO: 3411658 - DNA, 18 bp, Homo sapiens
tgtcattatttgataaca

SEQ ID NO: 3411659 - DNA, 16 bp, Homo sapiens
tgtcatttctcatgga

SEQ ID NO: 3411660 - DNA, 12 bp, Homo sapiens
tgtcccacctgg

SEQ ID NO: 3411661 - DNA, 16 bp, Homo sapiens
tgtcccacctggctcc

SEQ ID NO: 3411662 - DNA, 17 bp, Homo sapiens
tgtcccacctggctccc

SEQ ID NO: 3411663 - DNA, 20 bp, Homo sapiens
tgtccccttctctcatctct

SEQ ID NO: 3411664 - DNA, 22 bp, Homo sapiens
tgtccccttctctcatctctta

SEQ ID NO: 3411665 - DNA, 21 bp, Homo sapiens
tgtcccttgcccccctggcct

SEQ ID NO: 3411666 - DNA, 13 bp, Homo sapiens
tgtcctcaaagaa

SEQ ID NO: 3411667 - DNA, 14 bp, Homo sapiens
tgtcctcagccagt

SEQ ID NO: 3411668 - DNA, 16 bp, Homo sapiens
tgtccttgaatgccat

SEQ ID NO: 3411669 - DNA, 17 bp, Homo sapiens
tgtccttgaatgccata

SEQ ID NO: 3411670 - DNA, 19 bp, Homo sapiens
tgtcggggaagatgaaacc

SEQ ID NO: 3411671 - DNA, 17 bp, Homo sapiens
tgtctagagtcatgtga

SEQ ID NO: 3411672 - DNA, 19 bp, Homo sapiens
tgtctagtagaacaatgta

SEQ ID NO: 3411673 - DNA, 22 bp, Homo sapiens
tgtctagtgtttttttccctct

SEQ ID NO: 3411674 - DNA, 21 bp, Homo sapiens
tgtctcaaaaataatatactt

SEQ ID NO: 3411675 - DNA, 11 bp, Homo sapiens
tgtctccaacc

SEQ ID NO: 3411676 - DNA, 21 bp, Homo sapiens
tgtctccaaccccccagcact

SEQ ID NO: 3411677 - DNA, 16 bp, Homo sapiens
tgtctgagtggcttca

SEQ ID NO: 3411678 - DNA, 23 bp, Homo sapiens
tgtctgtagctcctcaactcacc

SEQ ID NO: 3411679 - DNA, 14 bp, Homo sapiens
tgtcttaaatcagt

SEQ ID NO: 3411680 - DNA, 13 bp, Homo sapiens
tgtcttagttgat

SEQ ID NO: 3411681 - DNA, 13 bp, Homo sapiens
tgtctttctttgc

SEQ ID NO: 3411682 - DNA, 22 bp, Homo sapiens
tgtgaaaccttttttaagattt

SEQ ID NO: 3411683 - DNA, 15 bp, Homo sapiens
tgtgaaattgtgtag

SEQ ID NO: 3411684 - DNA, 15 bp, Homo sapiens
tgtgaatggattgga

SEQ ID NO: 3411685 - DNA, 19 bp, Homo sapiens
tgtgaatggattggattat

SEQ ID NO: 3411686 - DNA, 19 bp, Homo sapiens
tgtgaatttgagtttgctg

SEQ ID NO: 3411687 - DNA, 15 bp, Homo sapiens
tgtgagaaaggaaaa

SEQ ID NO: 3411688 - DNA, 21 bp, Homo sapiens
tgtgagctttttgttccctca

SEQ ID NO: 3411689 - DNA, 22 bp, Homo sapiens
tgtgagctttttgttccctcat

SEQ ID NO: 3411690 - DNA, 15 bp, Homo sapiens
tgtgatattgaccat

SEQ ID NO: 3411691 - DNA, 19 bp, Homo sapiens
tgtgatattgaccatgtga

SEQ ID NO: 3411692 - DNA, 17 bp, Homo sapiens
tgtgatcatctttgctg

SEQ ID NO: 3411693 - DNA, 16 bp, Homo sapiens
tgtgatgaaatatgaa

SEQ ID NO: 3411694 - DNA, 14 bp, Homo sapiens
tgtgattatggaca

SEQ ID NO: 3411695 - DNA, 18 bp, Homo sapiens
tgtgcaaacagtgtaagc

SEQ ID NO: 3411696 - DNA, 15 bp, Homo sapiens
tgtgcaacataacaa

SEQ ID NO: 3411697 - DNA, 19 bp, Homo sapiens
tgtgcatagagccacgtat

SEQ ID NO: 3411698 - DNA, 14 bp, Homo sapiens
tgtgcctccctggt

SEQ ID NO: 3411699 - DNA, 17 bp, Homo sapiens
tgtgccttggtgtgctg

SEQ ID NO: 3411700 - DNA, 19 bp, Homo sapiens
tgtggagaagccacaggcc

SEQ ID NO: 3411701 - DNA, 17 bp, Homo sapiens
tgtggaggaaggattgt

SEQ ID NO: 3411702 - DNA, 15 bp, Homo sapiens
tgtggattcagcttc

SEQ ID NO: 3411703 - DNA, 11 bp, Homo sapiens
tgtggcctatg

SEQ ID NO: 3411704 - DNA, 20 bp, Homo sapiens
tgtgggcaggcaagcccttc

SEQ ID NO: 3411705 - DNA, 16 bp, Homo sapiens
tgtgggggtctgtgtg

SEQ ID NO: 3411706 - DNA, 16 bp, Homo sapiens
tgtgggtctgtgtgtg

SEQ ID NO: 3411707 - DNA, 16 bp, Homo sapiens
tgtggtctgactcctt

SEQ ID NO: 3411708 - DNA, 15 bp, Homo sapiens
tgtggttaatgccat

SEQ ID NO: 3411709 - DNA, 19 bp, Homo sapiens
tgtgtaatttaaaattgtg

SEQ ID NO: 3411710 - DNA, 22 bp, Homo sapiens
tgtgtaatttaaaattgtgatg

SEQ ID NO: 3411711 - DNA, 23 bp, Homo sapiens
tgtgtaatttaaaattgtgatgt

SEQ ID NO: 3411712 - DNA, 18 bp, Homo sapiens
tgtgtagagttaagaagc

SEQ ID NO: 3411713 - DNA, 13 bp, Homo sapiens
tgtgtatgtgggg

SEQ ID NO: 3411714 - DNA, 15 bp, Homo sapiens
tgtgtctctgtatat

SEQ ID NO: 3411715 - DNA, 15 bp, Homo sapiens
tgtgtctgtgttgct

SEQ ID NO: 3411716 - DNA, 12 bp, Homo sapiens
tgtgtgtctctg

SEQ ID NO: 3411717 - DNA, 12 bp, Homo sapiens
tgtgtgtgggag

SEQ ID NO: 3411718 - DNA, 18 bp, Homo sapiens
tgtgtgttgtgtgtggga

SEQ ID NO: 3411719 - DNA, 14 bp, Homo sapiens
tgtgttacattatt

SEQ ID NO: 3411720 - DNA, 15 bp, Homo sapiens
tgtgttacattattc

SEQ ID NO: 3411721 - DNA, 13 bp, Homo sapiens
tgtgtttatgtgt

SEQ ID NO: 3411722 - DNA, 15 bp, Homo sapiens
tgtgtttatgtgtgt

SEQ ID NO: 3411723 - DNA, 17 bp, Homo sapiens
tgttaaatttgtaagtt

SEQ ID NO: 3411724 - DNA, 20 bp, Homo sapiens
tgttaacagacactgtaaaa

SEQ ID NO: 3411725 - DNA, 22 bp, Homo sapiens
tgttaaggaaactcttatctca

SEQ ID NO: 3411726 - DNA, 21 bp, Homo sapiens
tgttacctgatcaatgacaga

SEQ ID NO: 3411727 - DNA, 16 bp, Homo sapiens
tgttactatctgcttt

SEQ ID NO: 3411728 - DNA, 13 bp, Homo sapiens
tgttacttgagaa

SEQ ID NO: 3411729 - DNA, 14 bp, Homo sapiens
tgttatgtgaattt

SEQ ID NO: 3411730 - DNA, 19 bp, Homo sapiens
tgttatgtgaatttgagtt

SEQ ID NO: 3411731 - DNA, 15 bp, Homo sapiens
tgttattaatgtttc

SEQ ID NO: 3411732 - DNA, 22 bp, Homo sapiens
tgttattgatcccttctcctgc

SEQ ID NO: 3411733 - DNA, 18 bp, Homo sapiens
tgttatttttgtattttt

SEQ ID NO: 3411734 - DNA, 22 bp, Homo sapiens
tgttcacgtgttttccatccca

SEQ ID NO: 3411735 - DNA, 19 bp, Homo sapiens
tgttcccctcctccactct

SEQ ID NO: 3411736 - DNA, 23 bp, Homo sapiens
tgttcccctcctccactctcccc

SEQ ID NO: 3411737 - DNA, 21 bp, Homo sapiens
tgttccttatgatattctcat

SEQ ID NO: 3411738 - DNA, 13 bp, Homo sapiens
tgttccttgcttt

SEQ ID NO: 3411739 - DNA, 19 bp, Homo sapiens
tgttctccactgacacaaa

SEQ ID NO: 3411740 - DNA, 18 bp, Homo sapiens
tgttctgtcccttgcccc

SEQ ID NO: 3411741 - DNA, 24 bp, Homo sapiens
tgttgattctagatgatcaacata

SEQ ID NO: 3411742 - DNA, 16 bp, Homo sapiens
tgttgcactgaaaacc

SEQ ID NO: 3411743 - DNA, 18 bp, Homo sapiens
tgttgggagtgaggatgt

SEQ ID NO: 3411744 - DNA, 15 bp, Homo sapiens
tgttggttgcacttt

SEQ ID NO: 3411745 - DNA, 17 bp, Homo sapiens
tgttggttttgactgga

SEQ ID NO: 3411746 - DNA, 14 bp, Homo sapiens
tgttgtacatttat

SEQ ID NO: 3411747 - DNA, 17 bp, Homo sapiens
tgttgtacatttatgat

SEQ ID NO: 3411748 - DNA, 20 bp, Homo sapiens
tgttgtacatttatgattta

SEQ ID NO: 3411749 - DNA, 13 bp, Homo sapiens
tgttgtcaccttc

SEQ ID NO: 3411750 - DNA, 15 bp, Homo sapiens
tgttgtggtttttag

SEQ ID NO: 3411751 - DNA, 15 bp, Homo sapiens
tgttgtgtgtgggag

SEQ ID NO: 3411752 - DNA, 12 bp, Homo sapiens
tgttgtttcttt

SEQ ID NO: 3411753 - DNA, 11 bp, Homo sapiens
tgttgtttgcc

SEQ ID NO: 3411754 - DNA, 16 bp, Homo sapiens
tgtttaaatgccaaaa

SEQ ID NO: 3411755 - DNA, 17 bp, Homo sapiens
tgtttaaatgccaaaat

SEQ ID NO: 3411756 - DNA, 16 bp, Homo sapiens
tgtttagaagaagtgt

SEQ ID NO: 3411757 - DNA, 20 bp, Homo sapiens
tgtttagctacctttttata

SEQ ID NO: 3411758 - DNA, 22 bp, Homo sapiens
tgtttatgacacaatgacacat

SEQ ID NO: 3411759 - DNA, 16 bp, Homo sapiens
tgtttatgagccagac

SEQ ID NO: 3411760 - DNA, 16 bp, Homo sapiens
tgtttatgtgtgtgtg

SEQ ID NO: 3411761 - DNA, 19 bp, Homo sapiens
tgtttcccgtaaggctgta

SEQ ID NO: 3411762 - DNA, 23 bp, Homo sapiens
tgtttcccgtaaggctgtacata

SEQ ID NO: 3411763 - DNA, 13 bp, Homo sapiens
tgtttctttctga

SEQ ID NO: 3411764 - DNA, 22 bp, Homo sapiens
tgtttgaagaaccgcattttga

SEQ ID NO: 3411765 - DNA, 21 bp, Homo sapiens
tgtttgtataccatgatgcat

SEQ ID NO: 3411766 - DNA, 19 bp, Homo sapiens
tgttttaaaagtttgtcct

SEQ ID NO: 3411767 - DNA, 18 bp, Homo sapiens
tgtttttgaggctttctg

SEQ ID NO: 3411768 - DNA, 16 bp, Homo sapiens
ttaaaaaaatttaagt

SEQ ID NO: 3411769 - DNA, 15 bp, Homo sapiens
ttaaaaaattaaaaa

SEQ ID NO: 3411770 - DNA, 12 bp, Homo sapiens
ttaaaaatacat

SEQ ID NO: 3411771 - DNA, 14 bp, Homo sapiens
ttaaaaatgaaaat

SEQ ID NO: 3411772 - DNA, 19 bp, Homo sapiens
ttaaaataaaattttttac

SEQ ID NO: 3411773 - DNA, 20 bp, Homo sapiens
ttaaaatcataacattgatt

SEQ ID NO: 3411774 - DNA, 21 bp, Homo sapiens
ttaaaatcataacattgattt

SEQ ID NO: 3411775 - DNA, 23 bp, Homo sapiens
ttaaaatgcaatatttgtaaggc

SEQ ID NO: 3411776 - DNA, 15 bp, Homo sapiens
ttaaacaaaatttca

SEQ ID NO: 3411777 - DNA, 22 bp, Homo sapiens
ttaaacaaatgtatgattacat

SEQ ID NO: 3411778 - DNA, 21 bp, Homo sapiens
ttaaacatcattggataaatt

SEQ ID NO: 3411779 - DNA, 14 bp, Homo sapiens
ttaaactagtttaa

SEQ ID NO: 3411780 - DNA, 19 bp, Homo sapiens
ttaaactggtattttatct

SEQ ID NO: 3411781 - DNA, 16 bp, Homo sapiens
ttaaacttttcattac

SEQ ID NO: 3411782 - DNA, 17 bp, Homo sapiens
ttaaagaaaatgtgtct

SEQ ID NO: 3411783 - DNA, 18 bp, Homo sapiens
ttaaagaaatttaatgtt

SEQ ID NO: 3411784 - DNA, 21 bp, Homo sapiens
ttaaagcacatgccagggaaa

SEQ ID NO: 3411785 - DNA, 17 bp, Homo sapiens
ttaaaggacaaacagtg

SEQ ID NO: 3411786 - DNA, 14 bp, Homo sapiens
ttaaagtaaacttg

SEQ ID NO: 3411787 - DNA, 20 bp, Homo sapiens
ttaaagtaaacttgtgtatt

SEQ ID NO: 3411788 - DNA, 17 bp, Homo sapiens
ttaaatatctgaacatt

SEQ ID NO: 3411789 - DNA, 16 bp, Homo sapiens
ttaaatctgaatttta

SEQ ID NO: 3411790 - DNA, 22 bp, Homo sapiens
ttaaatctgaattttaaaacat

SEQ ID NO: 3411791 - DNA, 12 bp, Homo sapiens
ttaaatgccaaa

SEQ ID NO: 3411792 - DNA, 19 bp, Homo sapiens
ttaaattatgaatgagttt

SEQ ID NO: 3411793 - DNA, 18 bp, Homo sapiens
ttaaattgcctttgtaat

SEQ ID NO: 3411794 - DNA, 15 bp, Homo sapiens
ttaaatttgtaagtt

SEQ ID NO: 3411795 - DNA, 18 bp, Homo sapiens
ttaacaggttttcttcta

SEQ ID NO: 3411796 - DNA, 22 bp, Homo sapiens
ttaacaggttttcttctaatca

SEQ ID NO: 3411797 - DNA, 22 bp, Homo sapiens
ttaacattcctaaaatgcttca

SEQ ID NO: 3411798 - DNA, 14 bp, Homo sapiens
ttaactaaatgctc

SEQ ID NO: 3411799 - DNA, 16 bp, Homo sapiens
ttaactaaatgctcat

SEQ ID NO: 3411800 - DNA, 12 bp, Homo sapiens
ttaactcagtct

SEQ ID NO: 3411801 - DNA, 22 bp, Homo sapiens
ttaactccccctcattcacaaa

SEQ ID NO: 3411802 - DNA, 23 bp, Homo sapiens
ttaactctgtaaaagtgtctgta

SEQ ID NO: 3411803 - DNA, 20 bp, Homo sapiens
ttaacttgtctttttgttat

SEQ ID NO: 3411804 - DNA, 12 bp, Homo sapiens
ttaagaaatacc

SEQ ID NO: 3411805 - DNA, 14 bp, Homo sapiens
ttaagaagctgttg

SEQ ID NO: 3411806 - DNA, 21 bp, Homo sapiens
ttaagaagctgttgtacattt

SEQ ID NO: 3411807 - DNA, 19 bp, Homo sapiens
ttaagaatagtctctgggt

SEQ ID NO: 3411808 - DNA, 15 bp, Homo sapiens
ttaagatttttctca

SEQ ID NO: 3411809 - DNA, 17 bp, Homo sapiens
ttaagatttttctcaaa

SEQ ID NO: 3411810 - DNA, 20 bp, Homo sapiens
ttaagatttttctcaaagtt

SEQ ID NO: 3411811 - DNA, 19 bp, Homo sapiens
ttaagcaacgttagtagaa

SEQ ID NO: 3411812 - DNA, 12 bp, Homo sapiens
ttaagcatgagt

SEQ ID NO: 3411813 - DNA, 18 bp, Homo sapiens
ttaagcatgagtggcctt

SEQ ID NO: 3411814 - DNA, 16 bp, Homo sapiens
ttaagctctgagctgt

SEQ ID NO: 3411815 - DNA, 17 bp, Homo sapiens
ttaaggcatacttttaa

SEQ ID NO: 3411816 - DNA, 22 bp, Homo sapiens
ttaagggagtgtactcccaggg

SEQ ID NO: 3411817 - DNA, 21 bp, Homo sapiens
ttaagggatggaaaaggaaga

SEQ ID NO: 3411818 - DNA, 19 bp, Homo sapiens
ttaatattagcttgcttaa

SEQ ID NO: 3411819 - DNA, 14 bp, Homo sapiens
ttaatcagtgttga

SEQ ID NO: 3411820 - DNA, 15 bp, Homo sapiens
ttaatcagtgttgat

SEQ ID NO: 3411821 - DNA, 19 bp, Homo sapiens
ttaattgttgtttctttct

SEQ ID NO: 3411822 - DNA, 15 bp, Homo sapiens
ttacaaattcctttc

SEQ ID NO: 3411823 - DNA, 22 bp, Homo sapiens
ttacaaattcctttcagagttt

SEQ ID NO: 3411824 - DNA, 17 bp, Homo sapiens
ttacaagcttaaagctt

SEQ ID NO: 3411825 - DNA, 15 bp, Homo sapiens
ttacagaggacagta

SEQ ID NO: 3411826 - DNA, 15 bp, Homo sapiens
ttacaggcaccgaga

SEQ ID NO: 3411827 - DNA, 17 bp, Homo sapiens
ttacaggcaccgagaat

SEQ ID NO: 3411828 - DNA, 22 bp, Homo sapiens
ttacatacagtgatatggtact

SEQ ID NO: 3411829 - DNA, 12 bp, Homo sapiens
ttacattattcc

SEQ ID NO: 3411830 - DNA, 19 bp, Homo sapiens
ttacattattccaatgata

SEQ ID NO: 3411831 - DNA, 14 bp, Homo sapiens
ttaccagtctgatt

SEQ ID NO: 3411832 - DNA, 20 bp, Homo sapiens
ttacctgatcaatgacagag

SEQ ID NO: 3411833 - DNA, 20 bp, Homo sapiens
ttactcccttctgtagtttt

SEQ ID NO: 3411834 - DNA, 19 bp, Homo sapiens
ttcctaacacagcatgtgt

SEQ ID NO: 3411835 - DNA, 15 bp, Homo sapiens
ttcctaatgcattag

SEQ ID NO: 3411836 - DNA, 20 bp, Homo sapiens
ttcctatttgccatgggctt

SEQ ID NO: 3411837 - DNA, 21 bp, Homo sapiens
ttcctctgaatattaagaaac

SEQ ID NO: 3411838 - DNA, 17 bp, Homo sapiens
ttcctctgaattataat

SEQ ID NO: 3411839 - DNA, 23 bp, Homo sapiens
ttcctgattaccagtctgattat

SEQ ID NO: 3411840 - DNA, 21 bp, Homo sapiens
ttcctgccccagatggctttg

SEQ ID NO: 3411841 - DNA, 23 bp, Homo sapiens
ttccttcaccacctcatgtcatt

SEQ ID NO: 3411842 - DNA, 14 bp, Homo sapiens
ttccttctttgata

SEQ ID NO: 3411843 - DNA, 13 bp, Homo sapiens
ttccttgctttta

SEQ ID NO: 3411844 - DNA, 16 bp, Homo sapiens
ttcctttaaaaaaatt

SEQ ID NO: 3411845 - DNA, 22 bp, Homo sapiens
ttcgatgtacagtctcaatttt

SEQ ID NO: 3411846 - DNA, 11 bp, Homo sapiens
ttctaaacaga

SEQ ID NO: 3411847 - DNA, 20 bp, Homo sapiens
ttctaaacagatgtccctga

SEQ ID NO: 3411848 - DNA, 17 bp, Homo sapiens
ttctagtggtctttgta

SEQ ID NO: 3411849 - DNA, 18 bp, Homo sapiens
ttctagtggtctttgtaa

SEQ ID NO: 3411850 - DNA, 19 bp, Homo sapiens
ttctagtggtctttgtaag

SEQ ID NO: 3411851 - DNA, 20 bp, Homo sapiens
ttctatgccatttttagttt

SEQ ID NO: 3411852 - DNA, 22 bp, Homo sapiens
ttctatgccatttttagtttaa

SEQ ID NO: 3411853 - DNA, 22 bp, Homo sapiens
ttctatgtatgtgccaattttg

SEQ ID NO: 3411854 - DNA, 17 bp, Homo sapiens
ttctcaaagttttgaaa

SEQ ID NO: 3411855 - DNA, 18 bp, Homo sapiens
ttctcaaagttttgaaaa

SEQ ID NO: 3411856 - DNA, 22 bp, Homo sapiens
ttctcaaagttttgaaaagcta

SEQ ID NO: 3411857 - DNA, 15 bp, Homo sapiens
ttctcatctttcttg

SEQ ID NO: 3411858 - DNA, 18 bp, Homo sapiens
ttctcatctttcttgatc

SEQ ID NO: 3411859 - DNA, 14 bp, Homo sapiens
ttctcattaaactc

SEQ ID NO: 3411860 - DNA, 16 bp, Homo sapiens
ttctcccctgccccca

SEQ ID NO: 3411861 - DNA, 19 bp, Homo sapiens
ttctcccctgcccccagga

SEQ ID NO: 3411862 - DNA, 11 bp, Homo sapiens
ttctcctgccc

SEQ ID NO: 3411863 - DNA, 15 bp, Homo sapiens
ttctccttcagccct

SEQ ID NO: 3411864 - DNA, 13 bp, Homo sapiens
ttctctcatctct

SEQ ID NO: 3411865 - DNA, 20 bp, Homo sapiens
ttctctcatctcttagctcc

SEQ ID NO: 3411866 - DNA, 24 bp, Homo sapiens
ttctctggacactgccactctccc

SEQ ID NO: 3411867 - DNA, 15 bp, Homo sapiens
ttctctttgtgcagt

SEQ ID NO: 3411868 - DNA, 16 bp, Homo sapiens
ttctgaaatacttttg

SEQ ID NO: 3411869 - DNA, 18 bp, Homo sapiens
ttctgagaaggtccttaa

SEQ ID NO: 3411870 - DNA, 19 bp, Homo sapiens
ttctgaggacattccaaga

SEQ ID NO: 3411871 - DNA, 22 bp, Homo sapiens
ttctgcacttgcggttccggca

SEQ ID NO: 3411872 - DNA, 19 bp, Homo sapiens
ttctgggtggggcagtggg

SEQ ID NO: 3411873 - DNA, 21 bp, Homo sapiens
ttctgtagtttttaattaaaa

SEQ ID NO: 3411874 - DNA, 12 bp, Homo sapiens
ttcttaaatgtt

SEQ ID NO: 3411875 - DNA, 14 bp, Homo sapiens
ttcttacatgcatt

SEQ ID NO: 3411876 - DNA, 19 bp, Homo sapiens
ttcttagctttttaattgt

SEQ ID NO: 3411877 - DNA, 19 bp, Homo sapiens
ttcttccattaaattgcct

SEQ ID NO: 3411878 - DNA, 21 bp, Homo sapiens
ttcttgatcaacatcttttct

SEQ ID NO: 3411879 - DNA, 20 bp, Homo sapiens
ttcttgcctctgtccccttc

SEQ ID NO: 3411880 - DNA, 15 bp, Homo sapiens
ttcttggttgttaat

SEQ ID NO: 3411881 - DNA, 18 bp, Homo sapiens
ttcttgtcaatggaagaa

SEQ ID NO: 3411882 - DNA, 22 bp, Homo sapiens
ttcttgtcatcagtaagtataa

SEQ ID NO: 3411883 - DNA, 16 bp, Homo sapiens
ttcttgttcatccaag

SEQ ID NO: 3411884 - DNA, 22 bp, Homo sapiens
ttcttgttcatccaaggaacct

SEQ ID NO: 3411885 - DNA, 15 bp, Homo sapiens
ttctttatatacctt

SEQ ID NO: 3411886 - DNA, 18 bp, Homo sapiens
ttctttctagtggtcttt

SEQ ID NO: 3411887 - DNA, 12 bp, Homo sapiens
ttctttcttggt

SEQ ID NO: 3411888 - DNA, 13 bp, Homo sapiens
ttctttcttggtg

SEQ ID NO: 3411889 - DNA, 14 bp, Homo sapiens
ttctttcttggtgc

SEQ ID NO: 3411890 - DNA, 16 bp, Homo sapiens
ttctttgataatgtta

SEQ ID NO: 3411891 - DNA, 20 bp, Homo sapiens
ttctttgatagtgtaaacaa

SEQ ID NO: 3411892 - DNA, 21 bp, Homo sapiens
ttctttgtagaataaatggtt

SEQ ID NO: 3411893 - DNA, 14 bp, Homo sapiens
ttcttttttaaagt

SEQ ID NO: 3411894 - DNA, 14 bp, Homo sapiens
ttgaaaagctatta

SEQ ID NO: 3411895 - DNA, 20 bp, Homo sapiens
ttgaactgtaccatgtgcta

SEQ ID NO: 3411896 - DNA, 14 bp, Homo sapiens
ttgaagatctgatt

SEQ ID NO: 3411897 - DNA, 15 bp, Homo sapiens
ttgaatataaacact

SEQ ID NO: 3411898 - DNA, 23 bp, Homo sapiens
ttgaatgccatagtcaaagagag

SEQ ID NO: 3411899 - DNA, 13 bp, Homo sapiens
ttgaatgttaaca

SEQ ID NO: 3411900 - DNA, 16 bp, Homo sapiens
ttgacagaacactgtc

SEQ ID NO: 3411901 - DNA, 17 bp, Homo sapiens
ttgacagaacactgtct

SEQ ID NO: 3411902 - DNA, 19 bp, Homo sapiens
ttgagaataagaatttgag

SEQ ID NO: 3411903 - DNA, 12 bp, Homo sapiens
ttgagacagttt

SEQ ID NO: 3411904 - DNA, 13 bp, Homo sapiens
ttgagacagtttc

SEQ ID NO: 3411905 - DNA, 22 bp, Homo sapiens
ttgagacagtttcttagctttt

SEQ ID NO: 3411906 - DNA, 23 bp, Homo sapiens
ttgagtcttaactgtatttcagt

SEQ ID NO: 3411907 - DNA, 21 bp, Homo sapiens
ttgagtttgctgttttaaatt

SEQ ID NO: 3411908 - DNA, 19 bp, Homo sapiens
ttgataatgttaaatttgt

SEQ ID NO: 3411909 - DNA, 20 bp, Homo sapiens
ttgataatgttaaatttgta

SEQ ID NO: 3411910 - DNA, 19 bp, Homo sapiens
ttgatagtgcttcttgtaa

SEQ ID NO: 3411911 - DNA, 17 bp, Homo sapiens
ttgatcagatgctgaat

SEQ ID NO: 3411912 - DNA, 21 bp, Homo sapiens
ttgatcattcataattttatc

SEQ ID NO: 3411913 - DNA, 19 bp, Homo sapiens
ttgatccatctcagtcact

SEQ ID NO: 3411914 - DNA, 20 bp, Homo sapiens
ttgatctttgtttaaatgcc

SEQ ID NO: 3411915 - DNA, 22 bp, Homo sapiens
ttgatctttgtttaaatgccaa

SEQ ID NO: 3411916 - DNA, 16 bp, Homo sapiens
ttgattaaattatgaa

SEQ ID NO: 3411917 - DNA, 17 bp, Homo sapiens
ttgattctccttcagcc

SEQ ID NO: 3411918 - DNA, 23 bp, Homo sapiens
ttgcaccattctttcttggtgca

SEQ ID NO: 3411919 - DNA, 14 bp, Homo sapiens
ttgcaccattttca

SEQ ID NO: 3411920 - DNA, 14 bp, Homo sapiens
ttgcactgaaaacc

SEQ ID NO: 3411921 - DNA, 18 bp, Homo sapiens
ttgcacttgtggaatatg

SEQ ID NO: 3411922 - DNA, 12 bp, Homo sapiens
ttgcactttgta

SEQ ID NO: 3411923 - DNA, 23 bp, Homo sapiens
ttgcagctcccattctatgtgtc

SEQ ID NO: 3411924 - DNA, 18 bp, Homo sapiens
ttgcaggggtccctgcta

SEQ ID NO: 3411925 - DNA, 21 bp, Homo sapiens
ttgcagtttcatgtatgtata

SEQ ID NO: 3411926 - DNA, 18 bp, Homo sapiens
ttgcataaacaatccaaa

SEQ ID NO: 3411927 - DNA, 19 bp, Homo sapiens
ttgcataaacaatccaaat

SEQ ID NO: 3411928 - DNA, 21 bp, Homo sapiens
ttgcataataagctaaagagg

SEQ ID NO: 3411929 - DNA, 14 bp, Homo sapiens
ttgccaagaaatcg

SEQ ID NO: 3411930 - DNA, 20 bp, Homo sapiens
ttgccatgggcttcactgta

SEQ ID NO: 3411931 - DNA, 21 bp, Homo sapiens
ttgccatgggcttcactgtat

SEQ ID NO: 3411932 - DNA, 22 bp, Homo sapiens
ttgccatgggcttcactgtata

SEQ ID NO: 3411933 - DNA, 17 bp, Homo sapiens
ttgcctctgtccccttc

SEQ ID NO: 3411934 - DNA, 18 bp, Homo sapiens
ttgcctctgtccccttct

SEQ ID NO: 3411935 - DNA, 12 bp, Homo sapiens
ttgcctgcaggc

SEQ ID NO: 3411936 - DNA, 12 bp, Homo sapiens
ttgcctttgtaa

SEQ ID NO: 3411937 - DNA, 22 bp, Homo sapiens
ttgctccagacctgcccctccc

SEQ ID NO: 3411938 - DNA, 14 bp, Homo sapiens
ttgctgctgtggaa

SEQ ID NO: 3411939 - DNA, 14 bp, Homo sapiens
ttgctgtttactcc

SEQ ID NO: 3411940 - DNA, 15 bp, Homo sapiens
ttgcttcaaattggt

SEQ ID NO: 3411941 - DNA, 23 bp, Homo sapiens
ttgcttcagctgctgaagggagg

SEQ ID NO: 3411942 - DNA, 23 bp, Homo sapiens
ttgcttctggctttgttcttgtc

SEQ ID NO: 3411943 - DNA, 14 bp, Homo sapiens
ttggaactggaggc

SEQ ID NO: 3411944 - DNA, 16 bp, Homo sapiens
ttggaactggaggcag

SEQ ID NO: 3411945 - DNA, 19 bp, Homo sapiens
ttggacagaagcagctctt

SEQ ID NO: 3411946 - DNA, 15 bp, Homo sapiens
ttggagggatcattt

SEQ ID NO: 3411947 - DNA, 14 bp, Homo sapiens
ttggattatttaat

SEQ ID NO: 3411948 - DNA, 17 bp, Homo sapiens
ttggccctcctcagctc

SEQ ID NO: 3411949 - DNA, 21 bp, Homo sapiens
ttggccctcctcagctccctg

SEQ ID NO: 3411950 - DNA, 13 bp, Homo sapiens
ttggcttgctgtt

SEQ ID NO: 3411951 - DNA, 20 bp, Homo sapiens
ttgggggtcctcctccaggg

SEQ ID NO: 3411952 - DNA, 18 bp, Homo sapiens
ttgggggttaccaaaaat

SEQ ID NO: 3411953 - DNA, 19 bp, Homo sapiens
ttgggggttaccaaaaata

SEQ ID NO: 3411954 - DNA, 19 bp, Homo sapiens
ttgggtgtaacaggtctcc

SEQ ID NO: 3411955 - DNA, 20 bp, Homo sapiens
ttggtgcaattaactctgga

SEQ ID NO: 3411956 - DNA, 19 bp, Homo sapiens
ttggtgctcatttaaatat

SEQ ID NO: 3411957 - DNA, 17 bp, Homo sapiens
ttggttagagaagtaag

SEQ ID NO: 3411958 - DNA, 23 bp, Homo sapiens
ttggttatgatggaaaggaagaa

SEQ ID NO: 3411959 - DNA, 14 bp, Homo sapiens
ttggttgtatataa

SEQ ID NO: 3411960 - DNA, 13 bp, Homo sapiens
ttggttttgactg

SEQ ID NO: 3411961 - DNA, 15 bp, Homo sapiens
ttggttttgactgga

SEQ ID NO: 3411962 - DNA, 17 bp, Homo sapiens
ttggttttgttcccctc

SEQ ID NO: 3411963 - DNA, 19 bp, Homo sapiens
ttgtaaaaaaaaatgcctt

SEQ ID NO: 3411964 - DNA, 16 bp, Homo sapiens
ttgtaaagtccccaga

SEQ ID NO: 3411965 - DNA, 16 bp, Homo sapiens
ttgtaagtttcaggtg

SEQ ID NO: 3411966 - DNA, 18 bp, Homo sapiens
ttgtaagtttcaggtgac

SEQ ID NO: 3411967 - DNA, 12 bp, Homo sapiens
ttgtaatatttc

SEQ ID NO: 3411968 - DNA, 18 bp, Homo sapiens
ttgtagaataaatggttt

SEQ ID NO: 3411969 - DNA, 22 bp, Homo sapiens
ttgtagaataaatggtttctca

SEQ ID NO: 3411970 - DNA, 18 bp, Homo sapiens
ttgtagtatttagtatat

SEQ ID NO: 3411971 - DNA, 13 bp, Homo sapiens
ttgtatataaagt

SEQ ID NO: 3411972 - DNA, 17 bp, Homo sapiens
ttgtcaccttcacctcc

SEQ ID NO: 3411973 - DNA, 15 bp, Homo sapiens
ttgtctttctttgct

SEQ ID NO: 3411974 - DNA, 16 bp, Homo sapiens
ttgtctttctttgctg

SEQ ID NO: 3411975 - DNA, 17 bp, Homo sapiens
ttgtctttctttgctgc

SEQ ID NO: 3411976 - DNA, 13 bp, Homo sapiens
ttgtgaaattgtg

SEQ ID NO: 3411977 - DNA, 14 bp, Homo sapiens
ttgtgaagtacata

SEQ ID NO: 3411978 - DNA, 14 bp, Homo sapiens
ttgtgagctttttg

SEQ ID NO: 3411979 - DNA, 20 bp, Homo sapiens
ttgtgaggtttaacattaaa

SEQ ID NO: 3411980 - DNA, 20 bp, Homo sapiens
ttgtgatattgaccatgtga

SEQ ID NO: 3411981 - DNA, 22 bp, Homo sapiens
ttgtggaggagctcaggacact

SEQ ID NO: 3411982 - DNA, 17 bp, Homo sapiens
ttgttatagattgtctt

SEQ ID NO: 3411983 - DNA, 16 bp, Homo sapiens
ttgttcccctcctcca

SEQ ID NO: 3411984 - DNA, 21 bp, Homo sapiens
ttgttgcaccaattaagtgtt

SEQ ID NO: 3411985 - DNA, 15 bp, Homo sapiens
ttgtttctttctagt

SEQ ID NO: 3411986 - DNA, 22 bp, Homo sapiens
tttaaaaaattaaaaatgaaaa

SEQ ID NO: 3411987 - DNA, 20 bp, Homo sapiens
tttaaaaataaagctactga

SEQ ID NO: 3411988 - DNA, 12 bp, Homo sapiens
tttaaaagacaa

SEQ ID NO: 3411989 - DNA, 13 bp, Homo sapiens
tttaaaaggaaaa

SEQ ID NO: 3411990 - DNA, 23 bp, Homo sapiens
tttaaaatcttgcatggcattaa

SEQ ID NO: 3411991 - DNA, 20 bp, Homo sapiens
tttaaacaaaatttcacagt

SEQ ID NO: 3411992 - DNA, 20 bp, Homo sapiens
tttaaagtaaacttgtgtat

SEQ ID NO: 3411993 - DNA, 20 bp, Homo sapiens
tttaacaggttttcttctaa

SEQ ID NO: 3411994 - DNA, 14 bp, Homo sapiens
tttaagatttttct

SEQ ID NO: 3411995 - DNA, 17 bp, Homo sapiens
tttaagatttttctcaa

SEQ ID NO: 3411996 - DNA, 18 bp, Homo sapiens
tttaagatttttctcaaa

SEQ ID NO: 3411997 - DNA, 22 bp, Homo sapiens
tttaagggagtgtactcccagg

SEQ ID NO: 3411998 - DNA, 21 bp, Homo sapiens
tttaagtgacataattgtcca

SEQ ID NO: 3411999 - DNA, 17 bp, Homo sapiens
tttaataaaataattct

SEQ ID NO: 3412000 - DNA, 22 bp, Homo sapiens
tttaataacattaccttactgt

SEQ ID NO: 3412001 - DNA, 23 bp, Homo sapiens
tttaataacattaccttactgtg

SEQ ID NO: 3412002 - DNA, 22 bp, Homo sapiens
tttaatgatttttgtgtatcca

SEQ ID NO: 3412003 - DNA, 16 bp, Homo sapiens
tttaattaaaaacttt

SEQ ID NO: 3412004 - DNA, 24 bp, Homo sapiens
tttaattgttgtttctttctagtg

SEQ ID NO: 3412005 - DNA, 21 bp, Homo sapiens
tttacaaattcctttcagagt

SEQ ID NO: 3412006 - DNA, 21 bp, Homo sapiens
tttacaccagttcctttcaat

SEQ ID NO: 3412007 - DNA, 20 bp, Homo sapiens
tttacagaggacagtatttg

SEQ ID NO: 3412008 - DNA, 13 bp, Homo sapiens
tttactacagttt

SEQ ID NO: 3412009 - DNA, 16 bp, Homo sapiens
tttacttttaactatt

SEQ ID NO: 3412010 - DNA, 17 bp, Homo sapiens
tttagaagaagtgtgtc

SEQ ID NO: 3412011 - DNA, 19 bp, Homo sapiens
tttagctacctttttatat

SEQ ID NO: 3412012 - DNA, 18 bp, Homo sapiens
tttaggtaaataaagctc

SEQ ID NO: 3412013 - DNA, 15 bp, Homo sapiens
tttaggtttgaaagg

SEQ ID NO: 3412014 - DNA, 23 bp, Homo sapiens
tttagtatatgaaatattttgaa

SEQ ID NO: 3412015 - DNA, 23 bp, Homo sapiens
tttagtctttttttccttccttt

SEQ ID NO: 3412016 - DNA, 20 bp, Homo sapiens
tttagttgtatctcttttga

SEQ ID NO: 3412017 - DNA, 16 bp, Homo sapiens
tttagtttaaaatctt

SEQ ID NO: 3412018 - DNA, 23 bp, Homo sapiens
tttataataaactcttaagagaa

SEQ ID NO: 3412019 - DNA, 17 bp, Homo sapiens
tttatactggcatgcta

SEQ ID NO: 3412020 - DNA, 13 bp, Homo sapiens
tttatagttgtat

SEQ ID NO: 3412021 - DNA, 14 bp, Homo sapiens
tttatatataaggt

SEQ ID NO: 3412022 - DNA, 21 bp, Homo sapiens
tttatatttaaaaaattaaaa

SEQ ID NO: 3412023 - DNA, 20 bp, Homo sapiens
tttatctacccagtcatgta

SEQ ID NO: 3412024 - DNA, 15 bp, Homo sapiens
tttatcttgagtgtt

SEQ ID NO: 3412025 - DNA, 19 bp, Homo sapiens
tttatctttgattctcctt

SEQ ID NO: 3412026 - DNA, 15 bp, Homo sapiens
tttatctttgtgtaa

SEQ ID NO: 3412027 - DNA, 17 bp, Homo sapiens
tttatgagatttactgc

SEQ ID NO: 3412028 - DNA, 20 bp, Homo sapiens
tttatgccttttatttctta

SEQ ID NO: 3412029 - DNA, 22 bp, Homo sapiens
tttatgttacttaaacatcatt

SEQ ID NO: 3412030 - DNA, 18 bp, Homo sapiens
tttattcagctagaattt

SEQ ID NO: 3412031 - DNA, 13 bp, Homo sapiens
tttatttctctgg

SEQ ID NO: 3412032 - DNA, 13 bp, Homo sapiens
tttatttcttaaa

SEQ ID NO: 3412033 - DNA, 15 bp, Homo sapiens
tttatttgcacttgt

SEQ ID NO: 3412034 - DNA, 20 bp, Homo sapiens
tttatttgtttgtgcatttg

SEQ ID NO: 3412035 - DNA, 13 bp, Homo sapiens
tttcaatttactt

SEQ ID NO: 3412036 - DNA, 14 bp, Homo sapiens
tttcaatttccaag

SEQ ID NO: 3412037 - DNA, 14 bp, Homo sapiens
tttcacccctccct

SEQ ID NO: 3412038 - DNA, 17 bp, Homo sapiens
tttcagcatcaaacatg

SEQ ID NO: 3412039 - DNA, 19 bp, Homo sapiens
tttcagcatcaaacatgaa

SEQ ID NO: 3412040 - DNA, 13 bp, Homo sapiens
tttcaggtgacat

SEQ ID NO: 3412041 - DNA, 20 bp, Homo sapiens
tttcaggtgacatgtgaaac

SEQ ID NO: 3412042 - DNA, 22 bp, Homo sapiens
tttcatactcttaagtgtaaat

SEQ ID NO: 3412043 - DNA, 13 bp, Homo sapiens
tttcatctatttc

SEQ ID NO: 3412044 - DNA, 15 bp, Homo sapiens
tttcatctgctctcc

SEQ ID NO: 3412045 - DNA, 19 bp, Homo sapiens
tttcatctgctctccttcc

SEQ ID NO: 3412046 - DNA, 17 bp, Homo sapiens
tttcattgtgatttata

SEQ ID NO: 3412047 - DNA, 20 bp, Homo sapiens
tttcattgtgatttatatat

SEQ ID NO: 3412048 - DNA, 22 bp, Homo sapiens
tttcattgtgatttatatataa

SEQ ID NO: 3412049 - DNA, 13 bp, Homo sapiens
tttccaagagctg

SEQ ID NO: 3412050 - DNA, 14 bp, Homo sapiens
tttccaagagctga

SEQ ID NO: 3412051 - DNA, 16 bp, Homo sapiens
tttccaagagctgagg

SEQ ID NO: 3412052 - DNA, 21 bp, Homo sapiens
tttccagaaagaaaatgaatt

SEQ ID NO: 3412053 - DNA, 23 bp, Homo sapiens
tttccagaaagaaaatgaatttg

SEQ ID NO: 3412054 - DNA, 18 bp, Homo sapiens
tttccagagttgttgttt

SEQ ID NO: 3412055 - DNA, 17 bp, Homo sapiens
tttccagccttatgtgt

SEQ ID NO: 3412056 - DNA, 15 bp, Homo sapiens
tttccaggctggttc

SEQ ID NO: 3412057 - DNA, 12 bp, Homo sapiens
tttccagtgcaa

SEQ ID NO: 3412058 - DNA, 23 bp, Homo sapiens
tgcacttaatattagcttgctta

SEQ ID NO: 3412059 - DNA, 22 bp, Homo sapiens
tgcacttgcggttccggcatgg

SEQ ID NO: 3412060 - DNA, 13 bp, Homo sapiens
tgcactttgtagt

SEQ ID NO: 3412061 - DNA, 20 bp, Homo sapiens
tgcagaagttcttagtgttg

SEQ ID NO: 3412062 - DNA, 16 bp, Homo sapiens
tgcagagagccatttt

SEQ ID NO: 3412063 - DNA, 21 bp, Homo sapiens
tgcagagagccattttgtgaa

SEQ ID NO: 3412064 - DNA, 23 bp, Homo sapiens
tgcagagagccattttgtgaatg

SEQ ID NO: 3412065 - DNA, 22 bp, Homo sapiens
tgcagccctgctgctgcctgcc

SEQ ID NO: 3412066 - DNA, 14 bp, Homo sapiens
tgcagcctcagaga

SEQ ID NO: 3412067 - DNA, 12 bp, Homo sapiens
tgcaggaagaga

SEQ ID NO: 3412068 - DNA, 15 bp, Homo sapiens
tgcaggaaggagctg

SEQ ID NO: 3412069 - DNA, 18 bp, Homo sapiens
tgcaggaaggagctgcct

SEQ ID NO: 3412070 - DNA, 15 bp, Homo sapiens
tgcaggggtccctgc

SEQ ID NO: 3412071 - DNA, 17 bp, Homo sapiens
tgcaggggtccctgcta

SEQ ID NO: 3412072 - DNA, 22 bp, Homo sapiens
tgcaggtagacctgtctcctgg

SEQ ID NO: 3412073 - DNA, 19 bp, Homo sapiens
tgcaggtctccatgaagaa

SEQ ID NO: 3412074 - DNA, 15 bp, Homo sapiens
tgcaggtctttaaat

SEQ ID NO: 3412075 - DNA, 17 bp, Homo sapiens
tgcagtgatatggcaga

SEQ ID NO: 3412076 - DNA, 19 bp, Homo sapiens
tgcagtttcatgtatgtat

SEQ ID NO: 3412077 - DNA, 19 bp, Homo sapiens
tgcataaatatgcagtgat

SEQ ID NO: 3412078 - DNA, 11 bp, Homo sapiens
tgcataataaa

SEQ ID NO: 3412079 - DNA, 22 bp, Homo sapiens
tgcataataagctaaagaggct

SEQ ID NO: 3412080 - DNA, 23 bp, Homo sapiens
tgcataataagctaaagaggctg

SEQ ID NO: 3412081 - DNA, 12 bp, Homo sapiens
tgcatagagcaa

SEQ ID NO: 3412082 - DNA, 13 bp, Homo sapiens
tgcatagagcaat

SEQ ID NO: 3412083 - DNA, 14 bp, Homo sapiens
tgcatagagcaatt

SEQ ID NO: 3412084 - DNA, 19 bp, Homo sapiens
tgcatagagccacgtatgt

SEQ ID NO: 3412085 - DNA, 13 bp, Homo sapiens
tgcatatcctgag

SEQ ID NO: 3412086 - DNA, 16 bp, Homo sapiens
tgcatatcctgagcca

SEQ ID NO: 3412087 - DNA, 22 bp, Homo sapiens
tgcatatctctagtccctgtgt

SEQ ID NO: 3412088 - DNA, 21 bp, Homo sapiens
tgcatgcaggtctccatgaag

SEQ ID NO: 3412089 - DNA, 22 bp, Homo sapiens
tgcatgtaaaatcttcagctgg

SEQ ID NO: 3412090 - DNA, 11 bp, Homo sapiens
tgcatgtgtat

SEQ ID NO: 3412091 - DNA, 13 bp, Homo sapiens
tgcatgtgtatat

SEQ ID NO: 3412092 - DNA, 22 bp, Homo sapiens
tgcattcatgttttaaaagttt

SEQ ID NO: 3412093 - DNA, 19 bp, Homo sapiens
tgcattgaatttagtcatt

SEQ ID NO: 3412094 - DNA, 22 bp, Homo sapiens
tgcatttttaaaggacaaacag

SEQ ID NO: 3412095 - DNA, 14 bp, Homo sapiens
tgcatttttgtgaa

SEQ ID NO: 3412096 - DNA, 17 bp, Homo sapiens
tgcatttttgtgaaatg

SEQ ID NO: 3412097 - DNA, 13 bp, Homo sapiens
tgccaagaaatcg

SEQ ID NO: 3412098 - DNA, 18 bp, Homo sapiens
tgccaagctaatctgcct

SEQ ID NO: 3412099 - DNA, 13 bp, Homo sapiens
tgccacctggacc

SEQ ID NO: 3412100 - DNA, 14 bp, Homo sapiens
tgccacctggaccc

SEQ ID NO: 3412101 - DNA, 19 bp, Homo sapiens
tgccacctggacccctgca

SEQ ID NO: 3412102 - DNA, 18 bp, Homo sapiens
tgccagaatataatgtgc

SEQ ID NO: 3412103 - DNA, 18 bp, Homo sapiens
tgccaggatggaatgatg

SEQ ID NO: 3412104 - DNA, 18 bp, Homo sapiens
tgccatagtcaaagagag

SEQ ID NO: 3412105 - DNA, 23 bp, Homo sapiens
tgccatggacagaagaaggcagc

SEQ ID NO: 3412106 - DNA, 18 bp, Homo sapiens
tgccatgggcttcactgt

SEQ ID NO: 3412107 - DNA, 20 bp, Homo sapiens
tgccatgggcttcactgtat

SEQ ID NO: 3412108 - DNA, 21 bp, Homo sapiens
tgccatttttagtttaaaatc

SEQ ID NO: 3412109 - DNA, 18 bp, Homo sapiens
tgcccagcggacagtggc

SEQ ID NO: 3412110 - DNA, 20 bp, Homo sapiens
tgcccagcggacagtggcag

SEQ ID NO: 3412111 - DNA, 22 bp, Homo sapiens
tgcccagcggacagtggcagga

SEQ ID NO: 3412112 - DNA, 17 bp, Homo sapiens
tgcccagggtcagtgta

SEQ ID NO: 3412113 - DNA, 12 bp, Homo sapiens
tgcccccaggac

SEQ ID NO: 3412114 - DNA, 17 bp, Homo sapiens
tgcccccaggactgggc

SEQ ID NO: 3412115 - DNA, 14 bp, Homo sapiens
tgccccctgcagga

SEQ ID NO: 3412116 - DNA, 18 bp, Homo sapiens
tgccccctgcaggaagga

SEQ ID NO: 3412117 - DNA, 13 bp, Homo sapiens
tgcccctccctct

SEQ ID NO: 3412118 - DNA, 21 bp, Homo sapiens
tgccctggtggccctctcccc

SEQ ID NO: 3412119 - DNA, 15 bp, Homo sapiens
tgccgcagagctggc

SEQ ID NO: 3412120 - DNA, 20 bp, Homo sapiens
tgcctatatgagaagaatag

SEQ ID NO: 3412121 - DNA, 21 bp, Homo sapiens
tgcctatatgagaagaatagc

SEQ ID NO: 3412122 - DNA, 16 bp, Homo sapiens
tgcctccagggctgga

SEQ ID NO: 3412123 - DNA, 22 bp, Homo sapiens
tgcctccctggtgagagggccg

SEQ ID NO: 3412124 - DNA, 17 bp, Homo sapiens
tgcctctcacagctgag

SEQ ID NO: 3412125 - DNA, 18 bp, Homo sapiens
tgcctctcacagctgagt

SEQ ID NO: 3412126 - DNA, 13 bp, Homo sapiens
tgcctctgtcccc

SEQ ID NO: 3412127 - DNA, 17 bp, Homo sapiens
tgcctgaataaagagcc

SEQ ID NO: 3412128 - DNA, 15 bp, Homo sapiens
tgcctggttttattt

SEQ ID NO: 3412129 - DNA, 11 bp, Homo sapiens
tgcctgtttcc

SEQ ID NO: 3412130 - DNA, 12 bp, Homo sapiens
tgccttcaagaa

SEQ ID NO: 3412131 - DNA, 19 bp, Homo sapiens
tgccttgtgaaggaattat

SEQ ID NO: 3412132 - DNA, 19 bp, Homo sapiens
tgcctttgagacagtttct

SEQ ID NO: 3412133 - DNA, 16 bp, Homo sapiens
tgcctttgtaatatga

SEQ ID NO: 3412134 - DNA, 21 bp, Homo sapiens
tgcctttgtaatatgagaatg

SEQ ID NO: 3412135 - DNA, 15 bp, Homo sapiens
tgccttttaagtttg

SEQ ID NO: 3412136 - DNA, 17 bp, Homo sapiens
tgccttttaagtttgaa

SEQ ID NO: 3412137 - DNA, 20 bp, Homo sapiens
tgcggggcttttaaaaggaa

SEQ ID NO: 3412138 - DNA, 18 bp, Homo sapiens
tgcggttccggcatggac

SEQ ID NO: 3412139 - DNA, 15 bp, Homo sapiens
tgcgtcttgtgaaat

SEQ ID NO: 3412140 - DNA, 19 bp, Homo sapiens
tgcgtcttgtgaaattgtg

SEQ ID NO: 3412141 - DNA, 24 bp, Homo sapiens
tgcgtgtgtagagttaagaagctg

SEQ ID NO: 3412142 - DNA, 18 bp, Homo sapiens
tgctaaagggagaaatgc

SEQ ID NO: 3412143 - DNA, 16 bp, Homo sapiens
tgctagcacatgccct

SEQ ID NO: 3412144 - DNA, 19 bp, Homo sapiens
tgctatccagctattttta

SEQ ID NO: 3412145 - DNA, 18 bp, Homo sapiens
tgctattgtagagccaga

SEQ ID NO: 3412146 - DNA, 19 bp, Homo sapiens
tgctcatacacagttaaat

SEQ ID NO: 3412147 - DNA, 20 bp, Homo sapiens
tgctccagacctgcccctcc

SEQ ID NO: 3412148 - DNA, 21 bp, Homo sapiens
tgctccagacctgcccctccc

SEQ ID NO: 3412149 - DNA, 17 bp, Homo sapiens
tgctccattttcttgtc

SEQ ID NO: 3412150 - DNA, 18 bp, Homo sapiens
tgctccattttcttgtca

SEQ ID NO: 3412151 - DNA, 21 bp, Homo sapiens
tgctctaagaagctcgtttct

SEQ ID NO: 3412152 - DNA, 21 bp, Homo sapiens
tgctgaaagtcctgctttcct

SEQ ID NO: 3412153 - DNA, 23 bp, Homo sapiens
tgctgaatgtcattatttgataa

SEQ ID NO: 3412154 - DNA, 15 bp, Homo sapiens
tgctgagttggtgtt

SEQ ID NO: 3412155 - DNA, 18 bp, Homo sapiens
tgctgtaaatttggcttc

SEQ ID NO: 3412156 - DNA, 16 bp, Homo sapiens
tgctgtatttctttgt

SEQ ID NO: 3412157 - DNA, 17 bp, Homo sapiens
tgctgtatttctttgta

SEQ ID NO: 3412158 - DNA, 18 bp, Homo sapiens
tgctgtgcaaacagtgta

SEQ ID NO: 3412159 - DNA, 22 bp, Homo sapiens
tgctgtgcaaacagtgtaagct

SEQ ID NO: 3412160 - DNA, 21 bp, Homo sapiens
tgctgtttactcccttctgta

SEQ ID NO: 3412161 - DNA, 13 bp, Homo sapiens
tgctgttttaaat

SEQ ID NO: 3412162 - DNA, 21 bp, Homo sapiens
tgcttaaggcatacttttaat

SEQ ID NO: 3412163 - DNA, 13 bp, Homo sapiens
tgcttcctgatta

SEQ ID NO: 3412164 - DNA, 13 bp, Homo sapiens
tgcttctctttgt

SEQ ID NO: 3412165 - DNA, 16 bp, Homo sapiens
tgcttctctttgtgca

SEQ ID NO: 3412166 - DNA, 15 bp, Homo sapiens
tgctttcctatctag

SEQ ID NO: 3412167 - DNA, 18 bp, Homo sapiens
tgctttgcctcgaaagtg

SEQ ID NO: 3412168 - DNA, 22 bp, Homo sapiens
tgctttgttaaaaaaaaaaaga

SEQ ID NO: 3412169 - DNA, 22 bp, Homo sapiens
tgcttttttttttttgctttgt

SEQ ID NO: 3412170 - DNA, 17 bp, Homo sapiens
tcttaactgtatttcag

SEQ ID NO: 3412171 - DNA, 18 bp, Homo sapiens
tcttaagtgtaaataata

SEQ ID NO: 3412172 - DNA, 12 bp, Homo sapiens
tcttactttgtg

SEQ ID NO: 3412173 - DNA, 19 bp, Homo sapiens
tcttagacctcttcctgga

SEQ ID NO: 3412174 - DNA, 13 bp, Homo sapiens
tcttagctcccct

SEQ ID NO: 3412175 - DNA, 22 bp, Homo sapiens
tcttagctttttaattgttgtt

SEQ ID NO: 3412176 - DNA, 22 bp, Homo sapiens
tcttataaaccttgtcaataaa

SEQ ID NO: 3412177 - DNA, 20 bp, Homo sapiens
tcttatctcagtcatgcata

SEQ ID NO: 3412178 - DNA, 22 bp, Homo sapiens
tcttatctcagtcatgcataaa

SEQ ID NO: 3412179 - DNA, 15 bp, Homo sapiens
tcttattcagtgaaa

SEQ ID NO: 3412180 - DNA, 11 bp, Homo sapiens
tcttcagctgg

SEQ ID NO: 3412181 - DNA, 12 bp, Homo sapiens
tcttcagctggt

SEQ ID NO: 3412182 - DNA, 20 bp, Homo sapiens
tcttccattaaattgccttt

SEQ ID NO: 3412183 - DNA, 15 bp, Homo sapiens
tcttctaatcataac

SEQ ID NO: 3412184 - DNA, 20 bp, Homo sapiens
tcttctaatcataacatagt

SEQ ID NO: 3412185 - DNA, 19 bp, Homo sapiens
tcttctcatttcacccctc

SEQ ID NO: 3412186 - DNA, 23 bp, Homo sapiens
tcttctccaattctgaaatactt

SEQ ID NO: 3412187 - DNA, 18 bp, Homo sapiens
tcttctttgatagtgtaa

SEQ ID NO: 3412188 - DNA, 20 bp, Homo sapiens
tcttgatcaacatcttttct

SEQ ID NO: 3412189 - DNA, 16 bp, Homo sapiens
tcttgcctctgtcccc

SEQ ID NO: 3412190 - DNA, 18 bp, Homo sapiens
tcttggctttcagagttt

SEQ ID NO: 3412191 - DNA, 17 bp, Homo sapiens
tcttggggaaatagctt

SEQ ID NO: 3412192 - DNA, 15 bp, Homo sapiens
tcttgtatggtttgc

SEQ ID NO: 3412193 - DNA, 16 bp, Homo sapiens
tcttgtcatcagtaag

SEQ ID NO: 3412194 - DNA, 12 bp, Homo sapiens
tcttgtgaaatt

SEQ ID NO: 3412195 - DNA, 21 bp, Homo sapiens
tcttgtttggagggatcattt

SEQ ID NO: 3412196 - DNA, 14 bp, Homo sapiens
tctttaatcactta

SEQ ID NO: 3412197 - DNA, 23 bp, Homo sapiens
tctttaatcacttaacattccta

SEQ ID NO: 3412198 - DNA, 14 bp, Homo sapiens
tctttatagttgta

SEQ ID NO: 3412199 - DNA, 15 bp, Homo sapiens
tctttctagtggtct

SEQ ID NO: 3412200 - DNA, 17 bp, Homo sapiens
tctttctagtggtcttt

SEQ ID NO: 3412201 - DNA, 22 bp, Homo sapiens
tctttctagtggtctttgtaag

SEQ ID NO: 3412202 - DNA, 18 bp, Homo sapiens
tctttcttggtgcattcg

SEQ ID NO: 3412203 - DNA, 12 bp, Homo sapiens
tctttctttgct

SEQ ID NO: 3412204 - DNA, 23 bp, Homo sapiens
tctttgctgctgtggaaaggatt

SEQ ID NO: 3412205 - DNA, 22 bp, Homo sapiens
tctttggacagaagcagctctt

SEQ ID NO: 3412206 - DNA, 13 bp, Homo sapiens
tctttgtaagagt

SEQ ID NO: 3412207 - DNA, 18 bp, Homo sapiens
tctttgtaagagtgtaga

SEQ ID NO: 3412208 - DNA, 24 bp, Homo sapiens
tctttgtaagagtgtagaagcatt

SEQ ID NO: 3412209 - DNA, 15 bp, Homo sapiens
tctttgtttaaatgc

SEQ ID NO: 3412210 - DNA, 20 bp, Homo sapiens
tcttttacatacagtgatat

SEQ ID NO: 3412211 - DNA, 19 bp, Homo sapiens
tcttttgaatccatgcttg

SEQ ID NO: 3412212 - DNA, 13 bp, Homo sapiens
tcttttttaaagt

SEQ ID NO: 3412213 - DNA, 20 bp, Homo sapiens
tcttttttaaagtaaacttg

SEQ ID NO: 3412214 - DNA, 17 bp, Homo sapiens
tgaaaaaaaaaaaagaa

SEQ ID NO: 3412215 - DNA, 12 bp, Homo sapiens
tgaaaaactttt

SEQ ID NO: 3412216 - DNA, 14 bp, Homo sapiens
tgaaaaagatattt

SEQ ID NO: 3412217 - DNA, 21 bp, Homo sapiens
tgaaaaagcagctaccaggtg

SEQ ID NO: 3412218 - DNA, 14 bp, Homo sapiens
tgaaaacatgtaat

SEQ ID NO: 3412219 - DNA, 17 bp, Homo sapiens
tgaaaagctattagcca

SEQ ID NO: 3412220 - DNA, 19 bp, Homo sapiens
tgaaaagctattagccagg

SEQ ID NO: 3412221 - DNA, 17 bp, Homo sapiens
tgaaaatattttaccca

SEQ ID NO: 3412222 - DNA, 18 bp, Homo sapiens
tgaaaatgcaacaacatg

SEQ ID NO: 3412223 - DNA, 21 bp, Homo sapiens
tgaaaatgcaacaacatgtat

SEQ ID NO: 3412224 - DNA, 16 bp, Homo sapiens
tgaaaattaacactgc

SEQ ID NO: 3412225 - DNA, 19 bp, Homo sapiens
tgaaaattacgttcttaca

SEQ ID NO: 3412226 - DNA, 15 bp, Homo sapiens
tgaaaccgtccctga

SEQ ID NO: 3412227 - DNA, 17 bp, Homo sapiens
tgaaaccttttttaaga

SEQ ID NO: 3412228 - DNA, 18 bp, Homo sapiens
tgaaaccttttttaagat

SEQ ID NO: 3412229 - DNA, 21 bp, Homo sapiens
tgaaaccttttttaagatttt

SEQ ID NO: 3412230 - DNA, 23 bp, Homo sapiens
tgaaaccttttttaagatttttc

SEQ ID NO: 3412231 - DNA, 16 bp, Homo sapiens
tgaaactcatctgtaa

SEQ ID NO: 3412232 - DNA, 14 bp, Homo sapiens
tgaaagttgctttt

SEQ ID NO: 3412233 - DNA, 20 bp, Homo sapiens
tgaaagttgcttttattgca

SEQ ID NO: 3412234 - DNA, 11 bp, Homo sapiens
tgaaataattt

SEQ ID NO: 3412235 - DNA, 20 bp, Homo sapiens
tgaaatattttgaatacaca

SEQ ID NO: 3412236 - DNA, 13 bp, Homo sapiens
tgaaatgaaaaca

SEQ ID NO: 3412237 - DNA, 22 bp, Homo sapiens
tgaaatttaaaaataaagctac

SEQ ID NO: 3412238 - DNA, 23 bp, Homo sapiens
tgaaatttaaaaataaagctact

SEQ ID NO: 3412239 - DNA, 24 bp, Homo sapiens
tgaaatttaaaaataaagctactg

SEQ ID NO: 3412240 - DNA, 17 bp, Homo sapiens
tgaacagactgaccttg

SEQ ID NO: 3412241 - DNA, 20 bp, Homo sapiens
tgaacatttactacagtttt

SEQ ID NO: 3412242 - DNA, 22 bp, Homo sapiens
tgaacatttactacagttttta

SEQ ID NO: 3412243 - DNA, 21 bp, Homo sapiens
tgaaccacctttgtctctgca

SEQ ID NO: 3412244 - DNA, 21 bp, Homo sapiens
tgaacctgggaaccatgaagc

SEQ ID NO: 3412245 - DNA, 22 bp, Homo sapiens
tgaacctgggaaccatgaagct

SEQ ID NO: 3412246 - DNA, 13 bp, Homo sapiens
tgaactgattttt

SEQ ID NO: 3412247 - DNA, 14 bp, Homo sapiens
tgaactgattttta

SEQ ID NO: 3412248 - DNA, 17 bp, Homo sapiens
tgaactgcaggaagaga

SEQ ID NO: 3412249 - DNA, 18 bp, Homo sapiens
tgaagaaccgcattttga

SEQ ID NO: 3412250 - DNA, 13 bp, Homo sapiens
tgaagaagctggg

SEQ ID NO: 3412251 - DNA, 20 bp, Homo sapiens
tgaagctggaagcactgctg

SEQ ID NO: 3412252 - DNA, 16 bp, Homo sapiens
tgaaggaatacaatat

SEQ ID NO: 3412253 - DNA, 16 bp, Homo sapiens
tgaaggcctcgcagga

SEQ ID NO: 3412254 - DNA, 11 bp, Homo sapiens
tgaagggaggg

SEQ ID NO: 3412255 - DNA, 18 bp, Homo sapiens
tgaaggtttctgaaaatt

SEQ ID NO: 3412256 - DNA, 13 bp, Homo sapiens
tgaagtataaatc

SEQ ID NO: 3412257 - DNA, 20 bp, Homo sapiens
tgaataaagggaacatgcag

SEQ ID NO: 3412258 - DNA, 22 bp, Homo sapiens
tgaataaagggaacatgcagct

SEQ ID NO: 3412259 - DNA, 23 bp, Homo sapiens
tgaatacacatctctgtcagtgt

SEQ ID NO: 3412260 - DNA, 14 bp, Homo sapiens
tgaatacttgaagt

SEQ ID NO: 3412261 - DNA, 15 bp, Homo sapiens
tgaatacttgaagta

SEQ ID NO: 3412262 - DNA, 15 bp, Homo sapiens
tgaatataaacacta

SEQ ID NO: 3412263 - DNA, 21 bp, Homo sapiens
tgaatatatggcatttgcaga

SEQ ID NO: 3412264 - DNA, 14 bp, Homo sapiens
tgaatccatgcttg

SEQ ID NO: 3412265 - DNA, 14 bp, Homo sapiens
tgaatgagacttaa

SEQ ID NO: 3412266 - DNA, 21 bp, Homo sapiens
tgaatgccatagtcaaagaga

SEQ ID NO: 3412267 - DNA, 21 bp, Homo sapiens
tgaatggattggattatttaa

SEQ ID NO: 3412268 - DNA, 22 bp, Homo sapiens
tgaatgtattgttctgtttgtg

SEQ ID NO: 3412269 - DNA, 23 bp, Homo sapiens
tgacaaaagtgacagatgttatt

SEQ ID NO: 3412270 - DNA, 21 bp, Homo sapiens
tgacaaagtgtgtctcaaaaa

SEQ ID NO: 3412271 - DNA, 12 bp, Homo sapiens
tgacaaatttag

SEQ ID NO: 3412272 - DNA, 13 bp, Homo sapiens
tgacacaaaagaa

SEQ ID NO: 3412273 - DNA, 16 bp, Homo sapiens
tgacagaacactgtct

SEQ ID NO: 3412274 - DNA, 17 bp, Homo sapiens
tgacagaacactgtctt

SEQ ID NO: 3412275 - DNA, 21 bp, Homo sapiens
tgacagatcctccatttttgt

SEQ ID NO: 3412276 - DNA, 18 bp, Homo sapiens
tgacagatgttatttttg

SEQ ID NO: 3412277 - DNA, 15 bp, Homo sapiens
tgacataattgtcca

SEQ ID NO: 3412278 - DNA, 19 bp, Homo sapiens
tgacatgtgaaaccttttt

SEQ ID NO: 3412279 - DNA, 21 bp, Homo sapiens
tgacatgtgaaacctttttta

SEQ ID NO: 3412280 - DNA, 12 bp, Homo sapiens
tgaccatgtgat

SEQ ID NO: 3412281 - DNA, 14 bp, Homo sapiens
tgacggaagaacat

SEQ ID NO: 3412282 - DNA, 13 bp, Homo sapiens
ctgagtggcttca

SEQ ID NO: 3412283 - DNA, 15 bp, Homo sapiens
ctgagtggcttcact

SEQ ID NO: 3412284 - DNA, 19 bp, Homo sapiens
ctgatcttacctttatgag

SEQ ID NO: 3412285 - DNA, 11 bp, Homo sapiens
ctgatgtttta

SEQ ID NO: 3412286 - DNA, 18 bp, Homo sapiens
ctgatgttttatttgcac

SEQ ID NO: 3412287 - DNA, 18 bp, Homo sapiens
ctgattaccagtctgatt

SEQ ID NO: 3412288 - DNA, 13 bp, Homo sapiens
ctgatttatacca

SEQ ID NO: 3412289 - DNA, 15 bp, Homo sapiens
ctgatttttattaac

SEQ ID NO: 3412290 - DNA, 17 bp, Homo sapiens
ctgcaagcatttttcca

SEQ ID NO: 3412291 - DNA, 23 bp, Homo sapiens
ctgcacttgcggttccggcatgg

SEQ ID NO: 3412292 - DNA, 15 bp, Homo sapiens
ctgcagacgcccaga

SEQ ID NO: 3412293 - DNA, 14 bp, Homo sapiens
ctgcagcctcagag

SEQ ID NO: 3412294 - DNA, 14 bp, Homo sapiens
ctgcaggaaggagc

SEQ ID NO: 3412295 - DNA, 17 bp, Homo sapiens
ctgcaggaaggagctgc

SEQ ID NO: 3412296 - DNA, 22 bp, Homo sapiens
ctgcaggaaggagctgcctgga

SEQ ID NO: 3412297 - DNA, 23 bp, Homo sapiens
ctgcatgtaaaatcttcagctgg

SEQ ID NO: 3412298 - DNA, 21 bp, Homo sapiens
ctgcattaataatagctaata

SEQ ID NO: 3412299 - DNA, 15 bp, Homo sapiens
ctgcattggaactgg

SEQ ID NO: 3412300 - DNA, 19 bp, Homo sapiens
ctgcattggaactggaggc

SEQ ID NO: 3412301 - DNA, 23 bp, Homo sapiens
ctgcatttttaaaggacaaacag

SEQ ID NO: 3412302 - DNA, 14 bp, Homo sapiens
ctgccacctggacc

SEQ ID NO: 3412303 - DNA, 15 bp, Homo sapiens
ctgccacctggaccc

SEQ ID NO: 3412304 - DNA, 13 bp, Homo sapiens
ctgcccccaggac

SEQ ID NO: 3412305 - DNA, 18 bp, Homo sapiens
ctgcccccaggactgggc

SEQ ID NO: 3412306 - DNA, 19 bp, Homo sapiens
ctgcccccaggactgggcc

SEQ ID NO: 3412307 - DNA, 12 bp, Homo sapiens
ctgccccctgca

SEQ ID NO: 3412308 - DNA, 23 bp, Homo sapiens
ctgccccctgcaggaaggagctg

SEQ ID NO: 3412309 - DNA, 15 bp, Homo sapiens
ctgccgcagagctgg

SEQ ID NO: 3412310 - DNA, 16 bp, Homo sapiens
ctgccgcagagctggc

SEQ ID NO: 3412311 - DNA, 15 bp, Homo sapiens
ctgcctcaggcctct

SEQ ID NO: 3412312 - DNA, 18 bp, Homo sapiens
ctgcctccagggctggac

SEQ ID NO: 3412313 - DNA, 14 bp, Homo sapiens
ctgcctctcacagc

SEQ ID NO: 3412314 - DNA, 16 bp, Homo sapiens
ctgcctctcacagctg

SEQ ID NO: 3412315 - DNA, 21 bp, Homo sapiens
ctgcctctcacagctgagttg

SEQ ID NO: 3412316 - DNA, 12 bp, Homo sapiens
ctgcctggaccc

SEQ ID NO: 3412317 - DNA, 23 bp, Homo sapiens
ctgcctggacttggcccctgcca

SEQ ID NO: 3412318 - DNA, 13 bp, Homo sapiens
ctgcctgtttccc

SEQ ID NO: 3412319 - DNA, 14 bp, Homo sapiens
ctgcctgtttcccg

SEQ ID NO: 3412320 - DNA, 15 bp, Homo sapiens
ctgcctgtttcccgt

SEQ ID NO: 3412321 - DNA, 16 bp, Homo sapiens
ctgcggagcaagagga

SEQ ID NO: 3412322 - DNA, 19 bp, Homo sapiens
ctgctctagaaagtataga

SEQ ID NO: 3412323 - DNA, 15 bp, Homo sapiens
ctgctctccttcctg

SEQ ID NO: 3412324 - DNA, 16 bp, Homo sapiens
ctgctctccttcctgg

SEQ ID NO: 3412325 - DNA, 17 bp, Homo sapiens
ctgctctccttcctgga

SEQ ID NO: 3412326 - DNA, 20 bp, Homo sapiens
ctgctctccttcctggagcc

SEQ ID NO: 3412327 - DNA, 12 bp, Homo sapiens
ctgctgaaggga

SEQ ID NO: 3412328 - DNA, 11 bp, Homo sapiens
ctgctgcctgc

SEQ ID NO: 3412329 - DNA, 22 bp, Homo sapiens
ctgctgtgtccgctttcatgaa

SEQ ID NO: 3412330 - DNA, 14 bp, Homo sapiens
ctgcttctctttgt

SEQ ID NO: 3412331 - DNA, 16 bp, Homo sapiens
ctggaagcactgctgt

SEQ ID NO: 3412332 - DNA, 20 bp, Homo sapiens
ctggacccgttcatggggga

SEQ ID NO: 3412333 - DNA, 13 bp, Homo sapiens
ctggacctctctt

SEQ ID NO: 3412334 - DNA, 13 bp, Homo sapiens
ctggactgaggcc

SEQ ID NO: 3412335 - DNA, 16 bp, Homo sapiens
ctggactgaggcctga

SEQ ID NO: 3412336 - DNA, 18 bp, Homo sapiens
ctggactgaggcctgagc

SEQ ID NO: 3412337 - DNA, 19 bp, Homo sapiens
ctggacttggcccctgcca

SEQ ID NO: 3412338 - DNA, 19 bp, Homo sapiens
ctggaggagcccaggccag

SEQ ID NO: 3412339 - DNA, 15 bp, Homo sapiens
ctggaggcagggaac

SEQ ID NO: 3412340 - DNA, 14 bp, Homo sapiens
ctggatctgtgagg

SEQ ID NO: 3412341 - DNA, 21 bp, Homo sapiens
ctggccagtggctggatctgt

SEQ ID NO: 3412342 - DNA, 16 bp, Homo sapiens
ctggcccaccccaccc

SEQ ID NO: 3412343 - DNA, 14 bp, Homo sapiens
ctggcctcccccac

SEQ ID NO: 3412344 - DNA, 15 bp, Homo sapiens
ctggcctcccccact

SEQ ID NO: 3412345 - DNA, 15 bp, Homo sapiens
ctggccttgtcctca

SEQ ID NO: 3412346 - DNA, 21 bp, Homo sapiens
ctggccttgtcctcagccagt

SEQ ID NO: 3412347 - DNA, 17 bp, Homo sapiens
ctgggaggcgggcgcac

SEQ ID NO: 3412348 - DNA, 14 bp, Homo sapiens
ctgggatgtttctg

SEQ ID NO: 3412349 - DNA, 18 bp, Homo sapiens
ctgggccacttctgggtg

SEQ ID NO: 3412350 - DNA, 19 bp, Homo sapiens
ctgggccatgttgtgcctc

SEQ ID NO: 3412351 - DNA, 17 bp, Homo sapiens
ctgggctgccatgtgaa

SEQ ID NO: 3412352 - DNA, 23 bp, Homo sapiens
ctgggtttacaacaaacactgtg

SEQ ID NO: 3412353 - DNA, 12 bp, Homo sapiens
ctggtatctgca

SEQ ID NO: 3412354 - DNA, 14 bp, Homo sapiens
ctggtattttatct

SEQ ID NO: 3412355 - DNA, 22 bp, Homo sapiens
ctggtgagagggccgggcagag

SEQ ID NO: 3412356 - DNA, 22 bp, Homo sapiens
ctggtggatggtgacttttgaa

SEQ ID NO: 3412357 - DNA, 13 bp, Homo sapiens
tgacgtaagctct

SEQ ID NO: 3412358 - DNA, 18 bp, Homo sapiens
tgacgtaagctctatctg

SEQ ID NO: 3412359 - DNA, 11 bp, Homo sapiens
tgactggatat

SEQ ID NO: 3412360 - DNA, 14 bp, Homo sapiens
tgacttgataatga

SEQ ID NO: 3412361 - DNA, 14 bp, Homo sapiens
tgacttttgaagaa

SEQ ID NO: 3412362 - DNA, 13 bp, Homo sapiens
tgagaaaggaaaa

SEQ ID NO: 3412363 - DNA, 23 bp, Homo sapiens
tgagaacatggtgtgtgtctctg

SEQ ID NO: 3412364 - DNA, 20 bp, Homo sapiens
tgagaagtactttgtgctga

SEQ ID NO: 3412365 - DNA, 18 bp, Homo sapiens
tgagaattccctgtggat

SEQ ID NO: 3412366 - DNA, 16 bp, Homo sapiens
tgagacacaggatgaa

SEQ ID NO: 3412367 - DNA, 14 bp, Homo sapiens
tgagacagtttctt

SEQ ID NO: 3412368 - DNA, 15 bp, Homo sapiens
tgagacagtttctta

SEQ ID NO: 3412369 - DNA, 18 bp, Homo sapiens
tgagacagtttcttagct

SEQ ID NO: 3412370 - DNA, 19 bp, Homo sapiens
tgagacagtttcttagctt

SEQ ID NO: 3412371 - DNA, 20 bp, Homo sapiens
tgagacagtttcttagcttt

SEQ ID NO: 3412372 - DNA, 21 bp, Homo sapiens
tgagacttaattttgtctttc

SEQ ID NO: 3412373 - DNA, 14 bp, Homo sapiens
tgagactttctttc

SEQ ID NO: 3412374 - DNA, 15 bp, Homo sapiens
tgagagcccagaggt

SEQ ID NO: 3412375 - DNA, 20 bp, Homo sapiens
tgagagcccagaggtaacag

SEQ ID NO: 3412376 - DNA, 23 bp, Homo sapiens
tgagagtatttaggcagattgaa

SEQ ID NO: 3412377 - DNA, 18 bp, Homo sapiens
tgagatttcatctgctct

SEQ ID NO: 3412378 - DNA, 22 bp, Homo sapiens
tgagattttggaagaagttttt

SEQ ID NO: 3412379 - DNA, 14 bp, Homo sapiens
tgagccagacaaat

SEQ ID NO: 3412380 - DNA, 20 bp, Homo sapiens
tgagccagacaaatggagga

SEQ ID NO: 3412381 - DNA, 16 bp, Homo sapiens
tgagctaggaagagtc

SEQ ID NO: 3412382 - DNA, 20 bp, Homo sapiens
tgagctggggatgtctctca

SEQ ID NO: 3412383 - DNA, 12 bp, Homo sapiens
tgagctttttgt

SEQ ID NO: 3412384 - DNA, 17 bp, Homo sapiens
tgagctttttgttccct

SEQ ID NO: 3412385 - DNA, 19 bp, Homo sapiens
tgagctttttgttccctca

SEQ ID NO: 3412386 - DNA, 17 bp, Homo sapiens
tgaggaagaacggggct

SEQ ID NO: 3412387 - DNA, 20 bp, Homo sapiens
tgaggacattccaagacagt

SEQ ID NO: 3412388 - DNA, 16 bp, Homo sapiens
tgaggatttctgatct

SEQ ID NO: 3412389 - DNA, 17 bp, Homo sapiens
tgaggccctccacacct

SEQ ID NO: 3412390 - DNA, 23 bp, Homo sapiens
tgaggccctccacacctgcggcc

SEQ ID NO: 3412391 - DNA, 22 bp, Homo sapiens
tgagggtgactatggagctgag

SEQ ID NO: 3412392 - DNA, 21 bp, Homo sapiens
tgagggtttctgatctgtact

SEQ ID NO: 3412393 - DNA, 13 bp, Homo sapiens
tgaggtttaacat

SEQ ID NO: 3412394 - DNA, 11 bp, Homo sapiens
tgagtctctga

SEQ ID NO: 3412395 - DNA, 14 bp, Homo sapiens
tgagtctggcaaac

SEQ ID NO: 3412396 - DNA, 18 bp, Homo sapiens
tgagtctggcaaacatgt

SEQ ID NO: 3412397 - DNA, 18 bp, Homo sapiens
tgagtcttaactgtattt

SEQ ID NO: 3412398 - DNA, 23 bp, Homo sapiens
tgagtcttaactgtatttcagta

SEQ ID NO: 3412399 - DNA, 12 bp, Homo sapiens
tgagtgccatgc

SEQ ID NO: 3412400 - DNA, 19 bp, Homo sapiens
tgagtggcttcactcctgc

SEQ ID NO: 3412401 - DNA, 18 bp, Homo sapiens
tgagttacttagaatgcc

SEQ ID NO: 3412402 - DNA, 19 bp, Homo sapiens
tgagttacttagaatgcca

SEQ ID NO: 3412403 - DNA, 19 bp, Homo sapiens
tgagtttctctcacattac

SEQ ID NO: 3412404 - DNA, 15 bp, Homo sapiens
tgagttttacaaatt

SEQ ID NO: 3412405 - DNA, 15 bp, Homo sapiens
tgataacattttgtt

SEQ ID NO: 3412406 - DNA, 24 bp, Homo sapiens
tgataagcagtcatcctcagatca

SEQ ID NO: 3412407 - DNA, 17 bp, Homo sapiens
tgataatgatttcctct

SEQ ID NO: 3412408 - DNA, 22 bp, Homo sapiens
tgataatgttaaatttgtaagt

SEQ ID NO: 3412409 - DNA, 15 bp, Homo sapiens
tgatacccaacagtt

SEQ ID NO: 3412410 - DNA, 20 bp, Homo sapiens
tgatacccaacagtttattt

SEQ ID NO: 3412411 - DNA, 16 bp, Homo sapiens
tgatagtgcttcttgt

SEQ ID NO: 3412412 - DNA, 20 bp, Homo sapiens
tgatagtgcttcttgtaata

SEQ ID NO: 3412413 - DNA, 17 bp, Homo sapiens
tgatagtgtaaacaaat

SEQ ID NO: 3412414 - DNA, 17 bp, Homo sapiens
tgatcaaaaataatgca

SEQ ID NO: 3412415 - DNA, 14 bp, Homo sapiens
tgatcaacatcttt

SEQ ID NO: 3412416 - DNA, 17 bp, Homo sapiens
tgatcacatctaaagct

SEQ ID NO: 3412417 - DNA, 19 bp, Homo sapiens
tgatcacatctaaagcttt

SEQ ID NO: 3412418 - DNA, 14 bp, Homo sapiens
tgatcatagaattg

SEQ ID NO: 3412419 - DNA, 22 bp, Homo sapiens
tgatcattcataattttatcta

SEQ ID NO: 3412420 - DNA, 16 bp, Homo sapiens
tgatccatctcagtca

SEQ ID NO: 3412421 - DNA, 22 bp, Homo sapiens
tgatcgccttatttatattcat

SEQ ID NO: 3412422 - DNA, 16 bp, Homo sapiens
tgatctcgactccccc

SEQ ID NO: 3412423 - DNA, 18 bp, Homo sapiens
tgatctcgactcccccct

SEQ ID NO: 3412424 - DNA, 20 bp, Homo sapiens
tgatctgtactttgtgttta

SEQ ID NO: 3412425 - DNA, 17 bp, Homo sapiens
tgatcttacctttatga

SEQ ID NO: 3412426 - DNA, 15 bp, Homo sapiens
tgatctttgtttaaa

SEQ ID NO: 3412427 - DNA, 21 bp, Homo sapiens
tgatctttgtttaaatgccaa

SEQ ID NO: 3412428 - DNA, 20 bp, Homo sapiens
tgatgaatgaggaacaatca

SEQ ID NO: 3412429 - DNA, 19 bp, Homo sapiens
tgatgagctgtgcacaaag

SEQ ID NO: 3412430 - DNA, 24 bp, Homo sapiens
tgatgagctgtgcacaaagtggca

SEQ ID NO: 3412431 - DNA, 21 bp, Homo sapiens
tgatgaggccctccacacctg

SEQ ID NO: 3412432 - DNA, 22 bp, Homo sapiens
tgatgttgggaagctatttcct

SEQ ID NO: 3412433 - DNA, 19 bp, Homo sapiens
tgattaccagtctgattat

SEQ ID NO: 3412434 - DNA, 22 bp, Homo sapiens
tgattataccatgtgtgctaat

SEQ ID NO: 3412435 - DNA, 22 bp, Homo sapiens
tgattatggacatcgatatgaa

SEQ ID NO: 3412436 - DNA, 18 bp, Homo sapiens
tgattattttgtgcaaca

SEQ ID NO: 3412437 - DNA, 20 bp, Homo sapiens
tgattcaaatatcaaaagga

SEQ ID NO: 3412438 - DNA, 22 bp, Homo sapiens
tgattcaaatatcaaaaggaag

SEQ ID NO: 3412439 - DNA, 16 bp, Homo sapiens
tgattctccttcagcc

SEQ ID NO: 3412440 - DNA, 21 bp, Homo sapiens
tgattctccttcagccctcac

SEQ ID NO: 3412441 - DNA, 23 bp, Homo sapiens
tgattctccttcagccctcaccc

SEQ ID NO: 3412442 - DNA, 17 bp, Homo sapiens
tgattggttcagttttt

SEQ ID NO: 3412443 - DNA, 18 bp, Homo sapiens
tgatttaaatagaacttg

SEQ ID NO: 3412444 - DNA, 14 bp, Homo sapiens
tgatttaataaaat

SEQ ID NO: 3412445 - DNA, 15 bp, Homo sapiens
tgatttaataaaata

SEQ ID NO: 3412446 - DNA, 19 bp, Homo sapiens
tgatttaataaaataattc

SEQ ID NO: 3412447 - DNA, 15 bp, Homo sapiens
tgatttcgatgtaca

SEQ ID NO: 3412448 - DNA, 15 bp, Homo sapiens
tgatttgatctttgt

SEQ ID NO: 3412449 - DNA, 18 bp, Homo sapiens
tgatttgatctttgttta

SEQ ID NO: 3412450 - DNA, 13 bp, Homo sapiens
tgatttttgtgta

SEQ ID NO: 3412451 - DNA, 15 bp, Homo sapiens
tgcaaactgctttat

SEQ ID NO: 3412452 - DNA, 17 bp, Homo sapiens
tgcaaactgctttattt

SEQ ID NO: 3412453 - DNA, 22 bp, Homo sapiens
tgcaaatattggttagtattta

SEQ ID NO: 3412454 - DNA, 13 bp, Homo sapiens
tgcaacataacaa

SEQ ID NO: 3412455 - DNA, 22 bp, Homo sapiens
tgcaacatggattccaaagcat

SEQ ID NO: 3412456 - DNA, 20 bp, Homo sapiens
tgcaaccagggagctgcagg

SEQ ID NO: 3412457 - DNA, 19 bp, Homo sapiens
tgcaaggaagccacagctg

SEQ ID NO: 3412458 - DNA, 20 bp, Homo sapiens
tgcaaggaagccacagctgg

SEQ ID NO: 3412459 - DNA, 17 bp, Homo sapiens
tgcaagtgggagatgaa

SEQ ID NO: 3412460 - DNA, 20 bp, Homo sapiens
tgcaataaaattatttgcag

SEQ ID NO: 3412461 - DNA, 19 bp, Homo sapiens
tgcaatgcgtcttgtgaaa

SEQ ID NO: 3412462 - DNA, 23 bp, Homo sapiens
tgcaatgcgtcttgtgaaattgt

SEQ ID NO: 3412463 - DNA, 18 bp, Homo sapiens
tgcaatgtgatctatgtt

SEQ ID NO: 3412464 - DNA, 19 bp, Homo sapiens
tgcaatgtttttgtgtaga

SEQ ID NO: 3412465 - DNA, 15 bp, Homo sapiens
tgcaattaactctgg

SEQ ID NO: 3412466 - DNA, 14 bp, Homo sapiens
tgcacaaagtggca

SEQ ID NO: 3412467 - DNA, 20 bp, Homo sapiens
tgcacaaagtggcataaaaa

SEQ ID NO: 3412468 - DNA, 13 bp, Homo sapiens
tgcactgaaaacc

SEQ ID NO: 3412469 - DNA, 20 bp, Homo sapiens
tatggaatttttgaatctat

SEQ ID NO: 3412470 - DNA, 15 bp, Homo sapiens
tatggagactttgct

SEQ ID NO: 3412471 - DNA, 17 bp, Homo sapiens
tatggagactttgctgt

SEQ ID NO: 3412472 - DNA, 12 bp, Homo sapiens
tatggcagaaga

SEQ ID NO: 3412473 - DNA, 23 bp, Homo sapiens
tatggcagaagacaccagagcag

SEQ ID NO: 3412474 - DNA, 16 bp, Homo sapiens
tatggcagtgtctttc

SEQ ID NO: 3412475 - DNA, 16 bp, Homo sapiens
tatgggaatcaagatt

SEQ ID NO: 3412476 - DNA, 19 bp, Homo sapiens
tatggggatagatgtgtgg

SEQ ID NO: 3412477 - DNA, 21 bp, Homo sapiens
tatggtaggaactgctgggct

SEQ ID NO: 3412478 - DNA, 12 bp, Homo sapiens
tatgtagatgtg

SEQ ID NO: 3412479 - DNA, 16 bp, Homo sapiens
tatgtagatgtgcatt

SEQ ID NO: 3412480 - DNA, 20 bp, Homo sapiens
tatgtatgtgccaattttgt

SEQ ID NO: 3412481 - DNA, 14 bp, Homo sapiens
tatgtattaaactt

SEQ ID NO: 3412482 - DNA, 16 bp, Homo sapiens
tatgtccttcagctga

SEQ ID NO: 3412483 - DNA, 20 bp, Homo sapiens
tatgtgagaaatcagaattg

SEQ ID NO: 3412484 - DNA, 19 bp, Homo sapiens
tatgtgcataatggaaagt

SEQ ID NO: 3412485 - DNA, 16 bp, Homo sapiens
tatgtggaagtgtggg

SEQ ID NO: 3412486 - DNA, 15 bp, Homo sapiens
tatgtggatacagtc

SEQ ID NO: 3412487 - DNA, 18 bp, Homo sapiens
tatgtgggggtctgtgtg

SEQ ID NO: 3412488 - DNA, 19 bp, Homo sapiens
tatgttacttaaacatcat

SEQ ID NO: 3412489 - DNA, 16 bp, Homo sapiens
tattaaatctgaattt

SEQ ID NO: 3412490 - DNA, 16 bp, Homo sapiens
tattaatgtttcttct

SEQ ID NO: 3412491 - DNA, 15 bp, Homo sapiens
tattactttttaaaa

SEQ ID NO: 3412492 - DNA, 17 bp, Homo sapiens
tattagccaggatcatg

SEQ ID NO: 3412493 - DNA, 18 bp, Homo sapiens
tattagccaggatcatgg

SEQ ID NO: 3412494 - DNA, 19 bp, Homo sapiens
tattagccagtcattgtaa

SEQ ID NO: 3412495 - DNA, 15 bp, Homo sapiens
tattagtacaaacta

SEQ ID NO: 3412496 - DNA, 15 bp, Homo sapiens
tattatcaccaggat

SEQ ID NO: 3412497 - DNA, 21 bp, Homo sapiens
tattattactttttaaaatgt

SEQ ID NO: 3412498 - DNA, 20 bp, Homo sapiens
tattattgtgacaaaatgtt

SEQ ID NO: 3412499 - DNA, 18 bp, Homo sapiens
tattatttttttaaacaa

SEQ ID NO: 3412500 - DNA, 19 bp, Homo sapiens
tattatttttttaaacaaa

SEQ ID NO: 3412501 - DNA, 23 bp, Homo sapiens
tattcatcaaataaaccttgttt

SEQ ID NO: 3412502 - DNA, 12 bp, Homo sapiens
tattcccactct

SEQ ID NO: 3412503 - DNA, 12 bp, Homo sapiens
tattcccatgag

SEQ ID NO: 3412504 - DNA, 16 bp, Homo sapiens
tattctcattatttca

SEQ ID NO: 3412505 - DNA, 19 bp, Homo sapiens
tattctcattatttcatca

SEQ ID NO: 3412506 - DNA, 13 bp, Homo sapiens
tattctgataatg

SEQ ID NO: 3412507 - DNA, 13 bp, Homo sapiens
tattcttaaaatg

SEQ ID NO: 3412508 - DNA, 15 bp, Homo sapiens
tattcttaaaatgca

SEQ ID NO: 3412509 - DNA, 13 bp, Homo sapiens
tattcttctttga

SEQ ID NO: 3412510 - DNA, 15 bp, Homo sapiens
tattgcttcagctgc

SEQ ID NO: 3412511 - DNA, 15 bp, Homo sapiens
tattgttctgtttgt

SEQ ID NO: 3412512 - DNA, 14 bp, Homo sapiens
tatttaaaagacaa

SEQ ID NO: 3412513 - DNA, 18 bp, Homo sapiens
tatttaaaagacaaacac

SEQ ID NO: 3412514 - DNA, 13 bp, Homo sapiens
tatttaaagcaca

SEQ ID NO: 3412515 - DNA, 14 bp, Homo sapiens
tatttaataacatt

SEQ ID NO: 3412516 - DNA, 16 bp, Homo sapiens
tatttaatgatttttg

SEQ ID NO: 3412517 - DNA, 17 bp, Homo sapiens
tatttaatgatttttgt

SEQ ID NO: 3412518 - DNA, 22 bp, Homo sapiens
tatttagctccaaaccttcaca

SEQ ID NO: 3412519 - DNA, 16 bp, Homo sapiens
tatttagtatatgaaa

SEQ ID NO: 3412520 - DNA, 19 bp, Homo sapiens
tatttagttacgtataatg

SEQ ID NO: 3412521 - DNA, 20 bp, Homo sapiens
tatttcagatgattcaaata

SEQ ID NO: 3412522 - DNA, 17 bp, Homo sapiens
tatttcagtattttcca

SEQ ID NO: 3412523 - DNA, 12 bp, Homo sapiens
tatttcctttgc

SEQ ID NO: 3412524 - DNA, 17 bp, Homo sapiens
tatttccttttctaaat

SEQ ID NO: 3412525 - DNA, 16 bp, Homo sapiens
tatttctctggcaaac

SEQ ID NO: 3412526 - DNA, 19 bp, Homo sapiens
tatttctctggcaaacttt

SEQ ID NO: 3412527 - DNA, 11 bp, Homo sapiens
tatttctgaga

SEQ ID NO: 3412528 - DNA, 15 bp, Homo sapiens
tatttgataacattt

SEQ ID NO: 3412529 - DNA, 22 bp, Homo sapiens
tatttgcaggtctttaaatcat

SEQ ID NO: 3412530 - DNA, 22 bp, Homo sapiens
tatttgtaaatttatgtgatgg

SEQ ID NO: 3412531 - DNA, 16 bp, Homo sapiens
tatttgttcttataaa

SEQ ID NO: 3412532 - DNA, 16 bp, Homo sapiens
tattttattgctacaa

SEQ ID NO: 3412533 - DNA, 15 bp, Homo sapiens
tattttatttctgat

SEQ ID NO: 3412534 - DNA, 15 bp, Homo sapiens
tattttcacaggttt

SEQ ID NO: 3412535 - DNA, 20 bp, Homo sapiens
tattttccagccttatgtgt

SEQ ID NO: 3412536 - DNA, 20 bp, Homo sapiens
tattttccatgaaaatgcaa

SEQ ID NO: 3412537 - DNA, 13 bp, Homo sapiens
tatttttatttgt

SEQ ID NO: 3412538 - DNA, 18 bp, Homo sapiens
tatttttttaaacaaaat

SEQ ID NO: 3412539 - DNA, 22 bp, Homo sapiens
tatttttttaaacaaaatttca

SEQ ID NO: 3412540 - DNA, 18 bp, Homo sapiens
tatttttttttaagctct

SEQ ID NO: 3412541 - DNA, 13 bp, Homo sapiens
tcaaaaataatat

SEQ ID NO: 3412542 - DNA, 12 bp, Homo sapiens
tcaaaaggaaga

SEQ ID NO: 3412543 - DNA, 17 bp, Homo sapiens
tcaaaaggaagattctt

SEQ ID NO: 3412544 - DNA, 12 bp, Homo sapiens
tcaaaatgcttc

SEQ ID NO: 3412545 - DNA, 14 bp, Homo sapiens
tcaaaatgtctgta

SEQ ID NO: 3412546 - DNA, 15 bp, Homo sapiens
tcaaacatgaaaaca

SEQ ID NO: 3412547 - DNA, 15 bp, Homo sapiens
tcaaagcttcaaaaa

SEQ ID NO: 3412548 - DNA, 14 bp, Homo sapiens
tcaaagttttgaaa

SEQ ID NO: 3412549 - DNA, 17 bp, Homo sapiens
tcaaagttttgaaaagc

SEQ ID NO: 3412550 - DNA, 18 bp, Homo sapiens
tcaaagttttgaaaagct

SEQ ID NO: 3412551 - DNA, 18 bp, Homo sapiens
tcaaatttactgtcttaa

SEQ ID NO: 3412552 - DNA, 17 bp, Homo sapiens
tcaactttcatttgaaa

SEQ ID NO: 3412553 - DNA, 22 bp, Homo sapiens
tcaagatcaatgaaatgatgtc

SEQ ID NO: 3412554 - DNA, 13 bp, Homo sapiens
tcaagatccaaat

SEQ ID NO: 3412555 - DNA, 18 bp, Homo sapiens
tcaagcaggtttcttgct

SEQ ID NO: 3412556 - DNA, 23 bp, Homo sapiens
tcaagtaagaagacatgaaccaa

SEQ ID NO: 3412557 - DNA, 17 bp, Homo sapiens
tcaagtaataaaaagag

SEQ ID NO: 3412558 - DNA, 18 bp, Homo sapiens
tcaagtgagtggcatgtg

SEQ ID NO: 3412559 - DNA, 15 bp, Homo sapiens
tcaataaaaataaat

SEQ ID NO: 3412560 - DNA, 17 bp, Homo sapiens
tcaataaaaataaatct

SEQ ID NO: 3412561 - DNA, 20 bp, Homo sapiens
tcaatagtgtcctatgcaat

SEQ ID NO: 3412562 - DNA, 16 bp, Homo sapiens
tcaatattttccatga

SEQ ID NO: 3412563 - DNA, 23 bp, Homo sapiens
tcaatgtactaggatactgctgc

SEQ ID NO: 3412564 - DNA, 17 bp, Homo sapiens
tcaatttactttttaaa

SEQ ID NO: 3412565 - DNA, 18 bp, Homo sapiens
tcaatttccaagagctga

SEQ ID NO: 3412566 - DNA, 15 bp, Homo sapiens
tcaattttgtattta

SEQ ID NO: 3412567 - DNA, 17 bp, Homo sapiens
tcaattttgtatttaat

SEQ ID NO: 3412568 - DNA, 20 bp, Homo sapiens
tcaattttgtatttaatgat

SEQ ID NO: 3412569 - DNA, 21 bp, Homo sapiens
tcaattttttaaaccactaat

SEQ ID NO: 3412570 - DNA, 19 bp, Homo sapiens
tcacaaaagctgtgtctct

SEQ ID NO: 3412571 - DNA, 23 bp, Homo sapiens
tcacaaattccgattagaccttt

SEQ ID NO: 3412572 - DNA, 19 bp, Homo sapiens
tcacacaaataacagcttt

SEQ ID NO: 3412573 - DNA, 21 bp, Homo sapiens
tcacaccaggcttgcctgcag

SEQ ID NO: 3412574 - DNA, 23 bp, Homo sapiens
tcacaccaggcttgcctgcaggc

SEQ ID NO: 3412575 - DNA, 21 bp, Homo sapiens
tcacactgagaatgtaagaac

SEQ ID NO: 3412576 - DNA, 23 bp, Homo sapiens
tcacactgagaatgtaagaacta

SEQ ID NO: 3412577 - DNA, 16 bp, Homo sapiens
tcacactgtttttcat

SEQ ID NO: 3412578 - DNA, 15 bp, Homo sapiens
tcacatctaaagctt

SEQ ID NO: 3412579 - DNA, 19 bp, Homo sapiens
tcacatctaaagctttatc

SEQ ID NO: 3412580 - DNA, 21 bp, Homo sapiens
tcacatttcaagatccaaatg

SEQ ID NO: 3412581 - DNA, 17 bp, Homo sapiens
tcacccctccctttctc

SEQ ID NO: 3412582 - DNA, 20 bp, Homo sapiens
tcacccctccctttctcccc

SEQ ID NO: 3412583 - DNA, 19 bp, Homo sapiens
tcacccctggttctcatct

SEQ ID NO: 3412584 - DNA, 14 bp, Homo sapiens
tcacctaatgttta

SEQ ID NO: 3412585 - DNA, 22 bp, Homo sapiens
tcacctaatgtttatgagccag

SEQ ID NO: 3412586 - DNA, 23 bp, Homo sapiens
tcactagctccccaatccctgac

SEQ ID NO: 3412587 - DNA, 19 bp, Homo sapiens
tcactcatgcaaactgctt

SEQ ID NO: 3412588 - DNA, 20 bp, Homo sapiens
tcactcatgcaaactgcttt

SEQ ID NO: 3412589 - DNA, 21 bp, Homo sapiens
tcactcatgcaaactgcttta

SEQ ID NO: 3412590 - DNA, 12 bp, Homo sapiens
tcactcctgctg

SEQ ID NO: 3412591 - DNA, 16 bp, Homo sapiens
tcactcctgctgtaaa

SEQ ID NO: 3412592 - DNA, 19 bp, Homo sapiens
tcactcctgctgtaaattt

SEQ ID NO: 3412593 - DNA, 14 bp, Homo sapiens
tcactcttctcagc

SEQ ID NO: 3412594 - DNA, 14 bp, Homo sapiens
tcactgtataaata

SEQ ID NO: 3412595 - DNA, 16 bp, Homo sapiens
tcactgtataaatagg

SEQ ID NO: 3412596 - DNA, 20 bp, Homo sapiens
tcacttaacattcctaaaat

SEQ ID NO: 3412597 - DNA, 22 bp, Homo sapiens
tcacttaacattcctaaaatgc

SEQ ID NO: 3412598 - DNA, 19 bp, Homo sapiens
tcactttttcccctgcaat

SEQ ID NO: 3412599 - DNA, 15 bp, Homo sapiens
tcagactaagccagc

SEQ ID NO: 3412600 - DNA, 17 bp, Homo sapiens
tcagactaagccagcac

SEQ ID NO: 3412601 - DNA, 19 bp, Homo sapiens
tcagagacatcagcccttg

SEQ ID NO: 3412602 - DNA, 14 bp, Homo sapiens
tcagagttttacta

SEQ ID NO: 3412603 - DNA, 19 bp, Homo sapiens
tcagatgattcaaatatca

SEQ ID NO: 3412604 - DNA, 19 bp, Homo sapiens
tcagattccacacaaaatg

SEQ ID NO: 3412605 - DNA, 21 bp, Homo sapiens
tcagattccacacaaaatgtc

SEQ ID NO: 3412606 - DNA, 19 bp, Homo sapiens
tcagcatcaaacatgaaaa

SEQ ID NO: 3412607 - DNA, 20 bp, Homo sapiens
tcagcatcaaacatgaaaac

SEQ ID NO: 3412608 - DNA, 14 bp, Homo sapiens
tcagccagggcctg

SEQ ID NO: 3412609 - DNA, 17 bp, Homo sapiens
tcagctagaatttctgg

SEQ ID NO: 3412610 - DNA, 17 bp, Homo sapiens
tcagctcaggcagctcg

SEQ ID NO: 3412611 - DNA, 19 bp, Homo sapiens
tcagctcaggcagctcgag

SEQ ID NO: 3412612 - DNA, 18 bp, Homo sapiens
tcagctccactttcagtg

SEQ ID NO: 3412613 - DNA, 18 bp, Homo sapiens
tcagctccctgcctgttt

SEQ ID NO: 3412614 - DNA, 21 bp, Homo sapiens
tcagctccctgcctgtttccc

SEQ ID NO: 3412615 - DNA, 23 bp, Homo sapiens
tcaggaaagaatagaaagaaagt

SEQ ID NO: 3412616 - DNA, 12 bp, Homo sapiens
tcaggacactaa

SEQ ID NO: 3412617 - DNA, 11 bp, Homo sapiens
tcaggcctctg

SEQ ID NO: 3412618 - DNA, 15 bp, Homo sapiens
tcaggtgacatgtga

SEQ ID NO: 3412619 - DNA, 16 bp, Homo sapiens
tcaggtgacatgtgaa

SEQ ID NO: 3412620 - DNA, 17 bp, Homo sapiens
tcaggtgacatgtgaaa

SEQ ID NO: 3412621 - DNA, 17 bp, Homo sapiens
tcaggtgtatggaattt

SEQ ID NO: 3412622 - DNA, 18 bp, Homo sapiens
tcaggttatcgaaataac

SEQ ID NO: 3412623 - DNA, 23 bp, Homo sapiens
tcaggttatcgaaataacaatgt

SEQ ID NO: 3412624 - DNA, 13 bp, Homo sapiens
tcagtattttcca

SEQ ID NO: 3412625 - DNA, 14 bp, Homo sapiens
tcagtattttccag

SEQ ID NO: 3412626 - DNA, 20 bp, Homo sapiens
tcagtcactttttcccctgc

SEQ ID NO: 3412627 - DNA, 15 bp, Homo sapiens
tcagtcatgcataaa

SEQ ID NO: 3412628 - DNA, 16 bp, Homo sapiens
tcagtcatgcataaat

SEQ ID NO: 3412629 - DNA, 20 bp, Homo sapiens
tcagtcatgcataaatatgc

SEQ ID NO: 3412630 - DNA, 14 bp, Homo sapiens
tcagtgaaaaagat

SEQ ID NO: 3412631 - DNA, 15 bp, Homo sapiens
tcagtgacccatgag

SEQ ID NO: 3412632 - DNA, 20 bp, Homo sapiens
tcagtgttcagccaaacagt

SEQ ID NO: 3412633 - DNA, 21 bp, Homo sapiens
tcagtgttcagccaaacagta

SEQ ID NO: 3412634 - DNA, 12 bp, Homo sapiens
tcagttgcagcc

SEQ ID NO: 3412635 - DNA, 16 bp, Homo sapiens
tcataaatttatggtt

SEQ ID NO: 3412636 - DNA, 19 bp, Homo sapiens
tcataaatttgttgtcatg

SEQ ID NO: 3412637 - DNA, 24 bp, Homo sapiens
tcataaatttgttgtcatgtgtat

SEQ ID NO: 3412638 - DNA, 16 bp, Homo sapiens
tcataagcgatcactt

SEQ ID NO: 3412639 - DNA, 18 bp, Homo sapiens
tcatacacagttaaataa

SEQ ID NO: 3412640 - DNA, 21 bp, Homo sapiens
tcatagattcttgagctgttg

SEQ ID NO: 3412641 - DNA, 19 bp, Homo sapiens
tcatagatttgaaaaactt

SEQ ID NO: 3412642 - DNA, 16 bp, Homo sapiens
tcatagctttacagat

SEQ ID NO: 3412643 - DNA, 21 bp, Homo sapiens
tcatcaatagtgtcctatgca

SEQ ID NO: 3412644 - DNA, 12 bp, Homo sapiens
tcatcaatttgt

SEQ ID NO: 3412645 - DNA, 23 bp, Homo sapiens
tcatccaaggaacctaattgaaa

SEQ ID NO: 3412646 - DNA, 24 bp, Homo sapiens
tcatccaaggaacctaattgaaat

SEQ ID NO: 3412647 - DNA, 12 bp, Homo sapiens
tcatcctgcagg

SEQ ID NO: 3412648 - DNA, 14 bp, Homo sapiens
tcatctatttctga

SEQ ID NO: 3412649 - DNA, 15 bp, Homo sapiens
tcatctatttctgag

SEQ ID NO: 3412650 - DNA, 16 bp, Homo sapiens
tcatctatttctgaga

SEQ ID NO: 3412651 - DNA, 20 bp, Homo sapiens
tcatctccagtatcctgctg

SEQ ID NO: 3412652 - DNA, 13 bp, Homo sapiens
tcatctcttagct

SEQ ID NO: 3412653 - DNA, 12 bp, Homo sapiens
tcatctgctctc

SEQ ID NO: 3412654 - DNA, 16 bp, Homo sapiens
tcatctgctctccttc

SEQ ID NO: 3412655 - DNA, 17 bp, Homo sapiens
tcatctgctctccttcc

SEQ ID NO: 3412656 - DNA, 16 bp, Homo sapiens
tcatcttcttctttaa

SEQ ID NO: 3412657 - DNA, 21 bp, Homo sapiens
tcatcttggccctcctcagct

SEQ ID NO: 3412658 - DNA, 22 bp, Homo sapiens
tcatcttggccctcctcagctc

SEQ ID NO: 3412659 - DNA, 16 bp, Homo sapiens
tcatgaacacagcctg

SEQ ID NO: 3412660 - DNA, 14 bp, Homo sapiens
tcatgcataaatat

SEQ ID NO: 3412661 - DNA, 15 bp, Homo sapiens
tcatgcataaatatg

SEQ ID NO: 3412662 - DNA, 19 bp, Homo sapiens
tcatgcataaatatgcagt

SEQ ID NO: 3412663 - DNA, 20 bp, Homo sapiens
tcatgcataaatatgcagtg

SEQ ID NO: 3412664 - DNA, 14 bp, Homo sapiens
tcatggatttggtt

SEQ ID NO: 3412665 - DNA, 19 bp, Homo sapiens
tcatggtagatttttttca

SEQ ID NO: 3412666 - DNA, 21 bp, Homo sapiens
tcatggtagatttttttcata

SEQ ID NO: 3412667 - DNA, 16 bp, Homo sapiens
tcatggtgtaataaga

SEQ ID NO: 3412668 - DNA, 21 bp, Homo sapiens
tcatggtgtaataagacataa

SEQ ID NO: 3412669 - DNA, 22 bp, Homo sapiens
tcatggtgtaataagacataac

SEQ ID NO: 3412670 - DNA, 16 bp, Homo sapiens
tcatgtatgtatataa

SEQ ID NO: 3412671 - DNA, 13 bp, Homo sapiens
tcatgtcatttct

SEQ ID NO: 3412672 - DNA, 13 bp, Homo sapiens
tcatgtgtatgag

SEQ ID NO: 3412673 - DNA, 19 bp, Homo sapiens
tcatgtgtatgagaagtac

SEQ ID NO: 3412674 - DNA, 14 bp, Homo sapiens
tcatgttacttgag

SEQ ID NO: 3412675 - DNA, 22 bp, Homo sapiens
tcatgttacttgagaagtgctt

SEQ ID NO: 3412676 - DNA, 19 bp, Homo sapiens
tcattaaactctaaagatt

SEQ ID NO: 3412677 - DNA, 16 bp, Homo sapiens
tcattatttgataaca

SEQ ID NO: 3412678 - DNA, 21 bp, Homo sapiens
tcattcacaaagtataacaat

SEQ ID NO: 3412679 - DNA, 14 bp, Homo sapiens
tcattcacatttca

SEQ ID NO: 3412680 - DNA, 16 bp, Homo sapiens
tcattcctaatgcatt

SEQ ID NO: 3412681 - DNA, 20 bp, Homo sapiens
tcattctagaccctatacat

SEQ ID NO: 3412682 - DNA, 15 bp, Homo sapiens
tcattctgcattaat

SEQ ID NO: 3412683 - DNA, 18 bp, Homo sapiens
tcattgattgtcagctac

SEQ ID NO: 3412684 - DNA, 22 bp, Homo sapiens
tcattgtgaggtttaacattaa

SEQ ID NO: 3412685 - DNA, 15 bp, Homo sapiens
tcatttctctttttt

SEQ ID NO: 3412686 - DNA, 20 bp, Homo sapiens
tcatttgctaactagcttgg

SEQ ID NO: 3412687 - DNA, 16 bp, Homo sapiens
tcatttggcttgctgt

SEQ ID NO: 3412688 - DNA, 18 bp, Homo sapiens
tcatttttttccaggctg

SEQ ID NO: 3412689 - DNA, 21 bp, Homo sapiens
tccaaaataatctatattaaa

SEQ ID NO: 3412690 - DNA, 22 bp, Homo sapiens
tccaaaccactttttgcagctt

SEQ ID NO: 3412691 - DNA, 13 bp, Homo sapiens
tccaaaccttcac

SEQ ID NO: 3412692 - DNA, 18 bp, Homo sapiens
tccaaaccttcacacaca

SEQ ID NO: 3412693 - DNA, 13 bp, Homo sapiens
tccaaatgcattc

SEQ ID NO: 3412694 - DNA, 16 bp, Homo sapiens
tccaaatgcattcatg

SEQ ID NO: 3412695 - DNA, 23 bp, Homo sapiens
tccaaatgctgtgcaaacagtgt

SEQ ID NO: 3412696 - DNA, 17 bp, Homo sapiens
tccaaccccccagcact

SEQ ID NO: 3412697 - DNA, 20 bp, Homo sapiens
tccaaccccccagcactgag

SEQ ID NO: 3412698 - DNA, 22 bp, Homo sapiens
tccaaccccccagcactgagga

SEQ ID NO: 3412699 - DNA, 20 bp, Homo sapiens
tccaaggaacctaattgaaa

SEQ ID NO: 3412700 - DNA, 20 bp, Homo sapiens
tccaatgccacatacttgca

SEQ ID NO: 3412701 - DNA, 22 bp, Homo sapiens
tccaatgccacatacttgcagc

SEQ ID NO: 3412702 - DNA, 15 bp, Homo sapiens
tccacacaaaatgtc

SEQ ID NO: 3412703 - DNA, 19 bp, Homo sapiens
tccacctgtgagaaaggaa

SEQ ID NO: 3412704 - DNA, 22 bp, Homo sapiens
tccacctgtgagaaaggaaaaa

SEQ ID NO: 3412705 - DNA, 13 bp, Homo sapiens
tccacgtgtatgc

SEQ ID NO: 3412706 - DNA, 13 bp, Homo sapiens
tccactctccccc

SEQ ID NO: 3412707 - DNA, 22 bp, Homo sapiens
tccactctcccccaccccctcc

SEQ ID NO: 3412708 - DNA, 16 bp, Homo sapiens
tccagaagaccccact

SEQ ID NO: 3412709 - DNA, 13 bp, Homo sapiens
tccagacctgccc

SEQ ID NO: 3412710 - DNA, 19 bp, Homo sapiens
tccagccttatgtgttaca

SEQ ID NO: 3412711 - DNA, 18 bp, Homo sapiens
tccagctagtgccaaata

SEQ ID NO: 3412712 - DNA, 21 bp, Homo sapiens
tccagctatttttatttgttt

SEQ ID NO: 3412713 - DNA, 21 bp, Homo sapiens
tccagctgcccttccgcagtg

SEQ ID NO: 3412714 - DNA, 23 bp, Homo sapiens
tccaggagattggatttgctgtg

SEQ ID NO: 3412715 - DNA, 12 bp, Homo sapiens
tccagggacagc

SEQ ID NO: 3412716 - DNA, 14 bp, Homo sapiens
tccagtgcaattgt

SEQ ID NO: 3412717 - DNA, 23 bp, Homo sapiens
tccatctcagtcactttttcccc

SEQ ID NO: 3412718 - DNA, 16 bp, Homo sapiens
tccatgaaaatgcaac

SEQ ID NO: 3412719 - DNA, 23 bp, Homo sapiens
tccattaaattgcctttgtaata

SEQ ID NO: 3412720 - DNA, 15 bp, Homo sapiens
tccattatgattctt

SEQ ID NO: 3412721 - DNA, 23 bp, Homo sapiens
tccatttcatctatttctgagaa

SEQ ID NO: 3412722 - DNA, 15 bp, Homo sapiens
tccattttcttgtca

SEQ ID NO: 3412723 - DNA, 14 bp, Homo sapiens
tcccaagatttttt

SEQ ID NO: 3412724 - DNA, 13 bp, Homo sapiens
tcccacagcgctg

SEQ ID NO: 3412725 - DNA, 15 bp, Homo sapiens
tcccacctggctccc

SEQ ID NO: 3412726 - DNA, 19 bp, Homo sapiens
tcccagaggggcctgccac

SEQ ID NO: 3412727 - DNA, 19 bp, Homo sapiens
tcccagattggctcacact

SEQ ID NO: 3412728 - DNA, 20 bp, Homo sapiens
tcccagattggctcacactg

SEQ ID NO: 3412729 - DNA, 21 bp, Homo sapiens
tcccagattggctcacactga

SEQ ID NO: 3412730 - DNA, 22 bp, Homo sapiens
tcccagattggctcacactgag

SEQ ID NO: 3412731 - DNA, 20 bp, Homo sapiens
tcccagcacctattgaatta

SEQ ID NO: 3412732 - DNA, 23 bp, Homo sapiens
tcccaggctgccggctcccctcg

SEQ ID NO: 3412733 - DNA, 19 bp, Homo sapiens
tcccaggtaatttaaattg

SEQ ID NO: 3412734 - DNA, 13 bp, Homo sapiens
tcccatagatttg

SEQ ID NO: 3412735 - DNA, 18 bp, Homo sapiens
tcccattctatgtgtcat

SEQ ID NO: 3412736 - DNA, 16 bp, Homo sapiens
tccccaatccatgctt

SEQ ID NO: 3412737 - DNA, 14 bp, Homo sapiens
tccccaatccctga

SEQ ID NO: 3412738 - DNA, 15 bp, Homo sapiens
tccccaatccctgac

SEQ ID NO: 3412739 - DNA, 17 bp, Homo sapiens
tccccagaatggaggca

SEQ ID NO: 3412740 - DNA, 20 bp, Homo sapiens
tcccccacccacctctctgg

SEQ ID NO: 3412741 - DNA, 19 bp, Homo sapiens
tcccccaccccctccccgc

SEQ ID NO: 3412742 - DNA, 13 bp, Homo sapiens
tcccccaccgccc

SEQ ID NO: 3412743 - DNA, 22 bp, Homo sapiens
tcccccaccgcccactctccac

SEQ ID NO: 3412744 - DNA, 15 bp, Homo sapiens
tccccgccctttttt

SEQ ID NO: 3412745 - DNA, 12 bp, Homo sapiens
tcccctccaacc

SEQ ID NO: 3412746 - DNA, 13 bp, Homo sapiens
tcccctccaacct

SEQ ID NO: 3412747 - DNA, 22 bp, Homo sapiens
tcccctccaacctggggggcag

SEQ ID NO: 3412748 - DNA, 12 bp, Homo sapiens
tcccctcctcca

SEQ ID NO: 3412749 - DNA, 14 bp, Homo sapiens
tcccctcctccact

SEQ ID NO: 3412750 - DNA, 17 bp, Homo sapiens
tcccctcgacagctctc

SEQ ID NO: 3412751 - DNA, 16 bp, Homo sapiens
tcccctcgtgtcagct

SEQ ID NO: 3412752 - DNA, 17 bp, Homo sapiens
tcccctgcccccaggac

SEQ ID NO: 3412753 - DNA, 18 bp, Homo sapiens
tccccttctctcatctct

SEQ ID NO: 3412754 - DNA, 17 bp, Homo sapiens
tcccctttatgtacagg

SEQ ID NO: 3412755 - DNA, 15 bp, Homo sapiens
tccctacttgcagcg

SEQ ID NO: 3412756 - DNA, 20 bp, Homo sapiens
tccctcattctgcattaata

SEQ ID NO: 3412757 - DNA, 13 bp, Homo sapiens
tccctccagtgaa

SEQ ID NO: 3412758 - DNA, 14 bp, Homo sapiens
tccctctcctgtcc

SEQ ID NO: 3412759 - DNA, 22 bp, Homo sapiens
tccctgagttgcaccattcttt

SEQ ID NO: 3412760 - DNA, 11 bp, Homo sapiens
tccctgcctca

SEQ ID NO: 3412761 - DNA, 15 bp, Homo sapiens
tccctgcctgtttcc

SEQ ID NO: 3412762 - DNA, 12 bp, Homo sapiens
tccctggagccc

SEQ ID NO: 3412763 - DNA, 13 bp, Homo sapiens
tccctggagccct

SEQ ID NO: 3412764 - DNA, 15 bp, Homo sapiens
tccctggagccctgt

SEQ ID NO: 3412765 - DNA, 23 bp, Homo sapiens
tccctggtgagagggccgggcag

SEQ ID NO: 3412766 - DNA, 13 bp, Homo sapiens
tcccttctgtagt

SEQ ID NO: 3412767 - DNA, 19 bp, Homo sapiens
tcccttgagaattccctgt

SEQ ID NO: 3412768 - DNA, 20 bp, Homo sapiens
tcccttgagaattccctgtg

SEQ ID NO: 3412769 - DNA, 15 bp, Homo sapiens
tccctttctcccctg

SEQ ID NO: 3412770 - DNA, 17 bp, Homo sapiens
tccctttctcccctgcc

SEQ ID NO: 3412771 - DNA, 18 bp, Homo sapiens
tccctttctcccctgccc

SEQ ID NO: 3412772 - DNA, 14 bp, Homo sapiens
tcccttttctcctc

SEQ ID NO: 3412773 - DNA, 13 bp, Homo sapiens
tccggcatggaca

SEQ ID NO: 3412774 - DNA, 18 bp, Homo sapiens
tcctaaatattggtttgt

SEQ ID NO: 3412775 - DNA, 16 bp, Homo sapiens
tcctaacacagcatgt

SEQ ID NO: 3412776 - DNA, 14 bp, Homo sapiens
tcctcagctccctg

SEQ ID NO: 3412777 - DNA, 19 bp, Homo sapiens
tcctccactctcccccacc

SEQ ID NO: 3412778 - DNA, 23 bp, Homo sapiens
tcctccactctcccccaccccct

SEQ ID NO: 3412779 - DNA, 16 bp, Homo sapiens
tcctcctccagggaca

SEQ ID NO: 3412780 - DNA, 19 bp, Homo sapiens
tcctcgttctccctgggag

SEQ ID NO: 3412781 - DNA, 13 bp, Homo sapiens
tcctctatttctt

SEQ ID NO: 3412782 - DNA, 13 bp, Homo sapiens
tcctgagctagga

SEQ ID NO: 3412783 - DNA, 18 bp, Homo sapiens
tcctgattaccagtctga

SEQ ID NO: 3412784 - DNA, 21 bp, Homo sapiens
tcctgccccagatggctttgt

SEQ ID NO: 3412785 - DNA, 17 bp, Homo sapiens
tcctgccgcagagctgg

SEQ ID NO: 3412786 - DNA, 14 bp, Homo sapiens
tcctgcctcagcct

SEQ ID NO: 3412787 - DNA, 22 bp, Homo sapiens
tcctgctgaaagtcctgctttc

SEQ ID NO: 3412788 - DNA, 23 bp, Homo sapiens
tcctggaataaacatctgtgtct

SEQ ID NO: 3412789 - DNA, 19 bp, Homo sapiens
tcctgggcttggtaagtga

SEQ ID NO: 3412790 - DNA, 12 bp, Homo sapiens
tcctgtctgttt

SEQ ID NO: 3412791 - DNA, 14 bp, Homo sapiens
tccttacttttaaa

SEQ ID NO: 3412792 - DNA, 20 bp, Homo sapiens
tccttcagctgactccagta

SEQ ID NO: 3412793 - DNA, 23 bp, Homo sapiens
tccttcccagaggggcctgccac

SEQ ID NO: 3412794 - DNA, 20 bp, Homo sapiens
tccttcctggagcccagagg

SEQ ID NO: 3412795 - DNA, 13 bp, Homo sapiens
tccttctttgata

SEQ ID NO: 3412796 - DNA, 16 bp, Homo sapiens
tccttctttgataatg

SEQ ID NO: 3412797 - DNA, 19 bp, Homo sapiens
tccttctttgataatgtta

SEQ ID NO: 3412798 - DNA, 16 bp, Homo sapiens
tccttgaaacagaaaa

SEQ ID NO: 3412799 - DNA, 23 bp, Homo sapiens
tccttgcacgcgccctttctacc

SEQ ID NO: 3412800 - DNA, 12 bp, Homo sapiens
tccttggaaatc

SEQ ID NO: 3412801 - DNA, 14 bp, Homo sapiens
tccttgtggcctat

SEQ ID NO: 3412802 - DNA, 17 bp, Homo sapiens
tccttgtggcctatgaa

SEQ ID NO: 3412803 - DNA, 20 bp, Homo sapiens
tccttgtgttgaaggcagta

SEQ ID NO: 3412804 - DNA, 16 bp, Homo sapiens
tcctttaaaaaaattt

SEQ ID NO: 3412805 - DNA, 18 bp, Homo sapiens
tcctttcaaggtaactgt

SEQ ID NO: 3412806 - DNA, 22 bp, Homo sapiens
tcctttcttgcactattccaca

SEQ ID NO: 3412807 - DNA, 13 bp, Homo sapiens
tcgaaagtgtcat

SEQ ID NO: 3412808 - DNA, 14 bp, Homo sapiens
tcgaaagtgtcatc

SEQ ID NO: 3412809 - DNA, 18 bp, Homo sapiens
tcgaaagtgtcatcaatt

SEQ ID NO: 3412810 - DNA, 23 bp, Homo sapiens
tcgagtgcccctgtcccacctgg

SEQ ID NO: 3412811 - DNA, 13 bp, Homo sapiens
tcgatatgaaaaa

SEQ ID NO: 3412812 - DNA, 20 bp, Homo sapiens
tcgcaggaagacccaacaca

SEQ ID NO: 3412813 - DNA, 16 bp, Homo sapiens
tcggatttggggtgga

SEQ ID NO: 3412814 - DNA, 14 bp, Homo sapiens
tcgggttaagaaat

SEQ ID NO: 3412815 - DNA, 17 bp, Homo sapiens
tcgggttaagaaatacc

SEQ ID NO: 3412816 - DNA, 15 bp, Homo sapiens
tcgtcccaggctgcc

SEQ ID NO: 3412817 - DNA, 19 bp, Homo sapiens
tcgttcccatagatttgaa

SEQ ID NO: 3412818 - DNA, 20 bp, Homo sapiens
tcgttcccatagatttgaag

SEQ ID NO: 3412819 - DNA, 19 bp, Homo sapiens
tctaaacagatgtccctga

SEQ ID NO: 3412820 - DNA, 15 bp, Homo sapiens
tctaaagctttatct

SEQ ID NO: 3412821 - DNA, 23 bp, Homo sapiens
tctaaagctttatctttgtgtaa

SEQ ID NO: 3412822 - DNA, 15 bp, Homo sapiens
tctaaattgatcatt

SEQ ID NO: 3412823 - DNA, 13 bp, Homo sapiens
tctaatagtgctt

SEQ ID NO: 3412824 - DNA, 15 bp, Homo sapiens
tctacagaagccaag

SEQ ID NO: 3412825 - DNA, 15 bp, Homo sapiens
tctacattcttggtt

SEQ ID NO: 3412826 - DNA, 23 bp, Homo sapiens
tctactgtgtaatataaaagatc

SEQ ID NO: 3412827 - DNA, 16 bp, Homo sapiens
tctagcatttatttct

SEQ ID NO: 3412828 - DNA, 15 bp, Homo sapiens
tctaggtcttggtta

SEQ ID NO: 3412829 - DNA, 13 bp, Homo sapiens
tctagtagaacaa

SEQ ID NO: 3412830 - DNA, 16 bp, Homo sapiens
tctagtggtctttgta

SEQ ID NO: 3412831 - DNA, 18 bp, Homo sapiens
tctagtggtctttgtaag

SEQ ID NO: 3412832 - DNA, 23 bp, Homo sapiens
tctagtggtctttgtaagagtgt

SEQ ID NO: 3412833 - DNA, 15 bp, Homo sapiens
tctatattaaatgag

SEQ ID NO: 3412834 - DNA, 14 bp, Homo sapiens
tctatctaatgaca

SEQ ID NO: 3412835 - DNA, 13 bp, Homo sapiens
tctatctactaaa

SEQ ID NO: 3412836 - DNA, 21 bp, Homo sapiens
tctatctgcaatgtttttgtg

SEQ ID NO: 3412837 - DNA, 23 bp, Homo sapiens
tctatctgcaatgtttttgtgta

SEQ ID NO: 3412838 - DNA, 16 bp, Homo sapiens
tctatgccatttttag

SEQ ID NO: 3412839 - DNA, 21 bp, Homo sapiens
tctatgccatttttagtttaa

SEQ ID NO: 3412840 - DNA, 14 bp, Homo sapiens
tctatggagacttt

SEQ ID NO: 3412841 - DNA, 17 bp, Homo sapiens
tctatggagactttgct

SEQ ID NO: 3412842 - DNA, 18 bp, Homo sapiens
tctatggagactttgctg

SEQ ID NO: 3412843 - DNA, 19 bp, Homo sapiens
tctatggagactttgctgt

SEQ ID NO: 3412844 - DNA, 13 bp, Homo sapiens
tctatttctgaga

SEQ ID NO: 3412845 - DNA, 16 bp, Homo sapiens
tctcaaagttttgaaa

SEQ ID NO: 3412846 - DNA, 19 bp, Homo sapiens
tctcaactataaccagttt

SEQ ID NO: 3412847 - DNA, 15 bp, Homo sapiens
tctcaattttgtatt

SEQ ID NO: 3412848 - DNA, 22 bp, Homo sapiens
tctcagtcactttttcccctgc

SEQ ID NO: 3412849 - DNA, 19 bp, Homo sapiens
tctcagtcatgcataaata

SEQ ID NO: 3412850 - DNA, 20 bp, Homo sapiens
tctcagtcatgcataaatat

SEQ ID NO: 3412851 - DNA, 21 bp, Homo sapiens
tctcagttgcagccctgctgc

SEQ ID NO: 3412852 - DNA, 13 bp, Homo sapiens
tctcatcctgcag

SEQ ID NO: 3412853 - DNA, 22 bp, Homo sapiens
tctcatctttcttgatcaacat

SEQ ID NO: 3412854 - DNA, 16 bp, Homo sapiens
tctcattccagaggaa

SEQ ID NO: 3412855 - DNA, 22 bp, Homo sapiens
tctcatttcacccctccctttc

SEQ ID NO: 3412856 - DNA, 23 bp, Homo sapiens
tctccaaccccccagcactgagg

SEQ ID NO: 3412857 - DNA, 16 bp, Homo sapiens
tctccaattctgaaat

SEQ ID NO: 3412858 - DNA, 18 bp, Homo sapiens
tctccagcctcagctctc

SEQ ID NO: 3412859 - DNA, 20 bp, Homo sapiens
tctccatggccctgccatgc

SEQ ID NO: 3412860 - DNA, 24 bp, Homo sapiens
tctccatggccctgccatgctctc

SEQ ID NO: 3412861 - DNA, 19 bp, Homo sapiens
tctcccactagacaagtcc

SEQ ID NO: 3412862 - DNA, 20 bp, Homo sapiens
tctcccccaccccctccccg

SEQ ID NO: 3412863 - DNA, 14 bp, Homo sapiens
tctcccctgccccc

SEQ ID NO: 3412864 - DNA, 23 bp, Homo sapiens
tctcccctgcccccaggactggg

SEQ ID NO: 3412865 - DNA, 14 bp, Homo sapiens
tctcctctgctcat

SEQ ID NO: 3412866 - DNA, 14 bp, Homo sapiens
tctcctgagctagg

SEQ ID NO: 3412867 - DNA, 18 bp, Homo sapiens
tctcctgccctttcccag

SEQ ID NO: 3412868 - DNA, 19 bp, Homo sapiens
tctccttcagccctcaccc

SEQ ID NO: 3412869 - DNA, 20 bp, Homo sapiens
tctccttcagccctcacccc

SEQ ID NO: 3412870 - DNA, 19 bp, Homo sapiens
tctctcatctcttagctcc

SEQ ID NO: 3412871 - DNA, 18 bp, Homo sapiens
tctctggcaaacttttct

SEQ ID NO: 3412872 - DNA, 21 bp, Homo sapiens
tctctgggtttacaacaaaca

SEQ ID NO: 3412873 - DNA, 16 bp, Homo sapiens
tctctgtcagtgtgaa

SEQ ID NO: 3412874 - DNA, 17 bp, Homo sapiens
tctctgtcagtgtgaaa

SEQ ID NO: 3412875 - DNA, 22 bp, Homo sapiens
tctctgtcagtgtgaaaattca

SEQ ID NO: 3412876 - DNA, 14 bp, Homo sapiens
tctctgtgagactc

SEQ ID NO: 3412877 - DNA, 17 bp, Homo sapiens
tctgaaaattaacactg

SEQ ID NO: 3412878 - DNA, 17 bp, Homo sapiens
tctgaaattaaagtatg

SEQ ID NO: 3412879 - DNA, 22 bp, Homo sapiens
tctgaaattaaagtatgcaaaa

SEQ ID NO: 3412880 - DNA, 13 bp, Homo sapiens
tctgaagcctcac

SEQ ID NO: 3412881 - DNA, 13 bp, Homo sapiens
tctgacaaagtgt

SEQ ID NO: 3412882 - DNA, 19 bp, Homo sapiens
tctgacaaagtgtgtctca

SEQ ID NO: 3412883 - DNA, 20 bp, Homo sapiens
tctgagaaggtccttaatga

SEQ ID NO: 3412884 - DNA, 19 bp, Homo sapiens
tctgagctgtcaacgagac

SEQ ID NO: 3412885 - DNA, 20 bp, Homo sapiens
tctgaggacattccaagaca

SEQ ID NO: 3412886 - DNA, 21 bp, Homo sapiens
tctgagtggcttcactcctgc

SEQ ID NO: 3412887 - DNA, 17 bp, Homo sapiens
tctgatctgtactttgt

SEQ ID NO: 3412888 - DNA, 22 bp, Homo sapiens
tctgattttttattcaacaaac

SEQ ID NO: 3412889 - DNA, 20 bp, Homo sapiens
tctgcatgtaaaatcttcag

SEQ ID NO: 3412890 - DNA, 21 bp, Homo sapiens
tctgcatgtaaaatcttcagc

SEQ ID NO: 3412891 - DNA, 23 bp, Homo sapiens
tctgcatgtaaaatcttcagctg

SEQ ID NO: 3412892 - DNA, 22 bp, Homo sapiens
tctgcattaataatagctaata

SEQ ID NO: 3412893 - DNA, 12 bp, Homo sapiens
tctgctctcctt

SEQ ID NO: 3412894 - DNA, 20 bp, Homo sapiens
tctgctctccttcctggagc

SEQ ID NO: 3412895 - DNA, 16 bp, Homo sapiens
tctggacctctcttgt

SEQ ID NO: 3412896 - DNA, 19 bp, Homo sapiens
tctggcaaacttttctttc

SEQ ID NO: 3412897 - DNA, 19 bp, Homo sapiens
tctggctttgttcttgtca

SEQ ID NO: 3412898 - DNA, 15 bp, Homo sapiens
tctgggtgatttcta

SEQ ID NO: 3412899 - DNA, 19 bp, Homo sapiens
tctgggtgatttctagaat

SEQ ID NO: 3412900 - DNA, 20 bp, Homo sapiens
tctgggtttacaacaaacac

SEQ ID NO: 3412901 - DNA, 16 bp, Homo sapiens
tctgtaaaagtgtctg

SEQ ID NO: 3412902 - DNA, 13 bp, Homo sapiens
tctgtaaactttt

SEQ ID NO: 3412903 - DNA, 15 bp, Homo sapiens
tctgtcagtgtgaaa

SEQ ID NO: 3412904 - DNA, 22 bp, Homo sapiens
tctgtccccttctctcatctct

SEQ ID NO: 3412905 - DNA, 19 bp, Homo sapiens
tctgtcccttgcccccctg

SEQ ID NO: 3412906 - DNA, 22 bp, Homo sapiens
tctgtcccttgcccccctggcc

SEQ ID NO: 3412907 - DNA, 17 bp, Homo sapiens
tctgtgagactcgagaa

SEQ ID NO: 3412908 - DNA, 21 bp, Homo sapiens
tctgtggattcagcttctgtt

SEQ ID NO: 3412909 - DNA, 13 bp, Homo sapiens
tctgtgtctgtgt

SEQ ID NO: 3412910 - DNA, 15 bp, Homo sapiens
tctgtgtgtgtgtat

SEQ ID NO: 3412911 - DNA, 18 bp, Homo sapiens
tctgtgtgtgtgtatgtg

SEQ ID NO: 3412912 - DNA, 15 bp, Homo sapiens
tctgtgtgtttatgt

SEQ ID NO: 3412913 - DNA, 13 bp, Homo sapiens
tctgtgttgcttc

SEQ ID NO: 3412914 - DNA, 14 bp, Homo sapiens
tctgttctacttga

SEQ ID NO: 3412915 - DNA, 17 bp, Homo sapiens
tctgttctacttgatat

SEQ ID NO: 3412916 - DNA, 18 bp, Homo sapiens
tctgttgtcaccttcacc

SEQ ID NO: 3412917 - DNA, 18 bp, Homo sapiens
tcttaaaaaataaaaact

SEQ ID NO: 3412918 - DNA, 13 bp, Homo sapiens
tcttaaatgtttt

SEQ ID NO: 3412919 - DNA, 14 bp, Homo sapiens
tcttaactgtattt

SEQ ID NO: 3412920 - DNA, 20 bp, Homo sapiens
aaacctgcatttttaaagga

SEQ ID NO: 3412921 - DNA, 11 bp, Homo sapiens
aaaccttcaca

SEQ ID NO: 3412922 - DNA, 20 bp, Homo sapiens
aaaccttcacacacagactg

SEQ ID NO: 3412923 - DNA, 12 bp, Homo sapiens
aaaccttgtttc

SEQ ID NO: 3412924 - DNA, 15 bp, Homo sapiens
aaaccttttttaaga

SEQ ID NO: 3412925 - DNA, 16 bp, Homo sapiens
aaaccttttttaagat

SEQ ID NO: 3412926 - DNA, 21 bp, Homo sapiens
aaaccttttttaagatttttc

SEQ ID NO: 3412927 - DNA, 22 bp, Homo sapiens
aaaccttttttaagatttttct

SEQ ID NO: 3412928 - DNA, 21 bp, Homo sapiens
aaactaccagtgggcatgtat

SEQ ID NO: 3412929 - DNA, 21 bp, Homo sapiens
aaactagtttaagggtggaaa

SEQ ID NO: 3412930 - DNA, 16 bp, Homo sapiens
aaactcctactgcttc

SEQ ID NO: 3412931 - DNA, 12 bp, Homo sapiens
aaactgctttat

SEQ ID NO: 3412932 - DNA, 16 bp, Homo sapiens
aaagaaaatgtgtctg

SEQ ID NO: 3412933 - DNA, 14 bp, Homo sapiens
aaagaaatcaattt

SEQ ID NO: 3412934 - DNA, 12 bp, Homo sapiens
aaagaagaaata

SEQ ID NO: 3412935 - DNA, 13 bp, Homo sapiens
aaagaagaaataa

SEQ ID NO: 3412936 - DNA, 16 bp, Homo sapiens
aaagacatctgcctgt

SEQ ID NO: 3412937 - DNA, 17 bp, Homo sapiens
aaagaccaaattttgag

SEQ ID NO: 3412938 - DNA, 15 bp, Homo sapiens
aaagagaatgtattt

SEQ ID NO: 3412939 - DNA, 18 bp, Homo sapiens
aaagagagaatgtagata

SEQ ID NO: 3412940 - DNA, 23 bp, Homo sapiens
aaagagagtttttaatagaacca

SEQ ID NO: 3412941 - DNA, 19 bp, Homo sapiens
aaagatattttatttctga

SEQ ID NO: 3412942 - DNA, 15 bp, Homo sapiens
aaagattgtattgct

SEQ ID NO: 3412943 - DNA, 15 bp, Homo sapiens
aaagctactgaattt

SEQ ID NO: 3412944 - DNA, 15 bp, Homo sapiens
aaagctattagccag

SEQ ID NO: 3412945 - DNA, 18 bp, Homo sapiens
aaagctattagccaggat

SEQ ID NO: 3412946 - DNA, 17 bp, Homo sapiens
aaagctgtgtctctgta

SEQ ID NO: 3412947 - DNA, 21 bp, Homo sapiens
aaagctgtgtctctgtatata

SEQ ID NO: 3412948 - DNA, 13 bp, Homo sapiens
aaagctttatctt

SEQ ID NO: 3412949 - DNA, 15 bp, Homo sapiens
aaagctttatctttg

SEQ ID NO: 3412950 - DNA, 12 bp, Homo sapiens
aaaggaaaaatt

SEQ ID NO: 3412951 - DNA, 14 bp, Homo sapiens
aaaggaagattctt

SEQ ID NO: 3412952 - DNA, 17 bp, Homo sapiens
aaaggacagctttgata

SEQ ID NO: 3412953 - DNA, 20 bp, Homo sapiens
aaaggacagctttgataatg

SEQ ID NO: 3412954 - DNA, 16 bp, Homo sapiens
aaaggactctggggtt

SEQ ID NO: 3412955 - DNA, 20 bp, Homo sapiens
aaaggatgatcaaaaataat

SEQ ID NO: 3412956 - DNA, 17 bp, Homo sapiens
aaaggccagacctgcag

SEQ ID NO: 3412957 - DNA, 20 bp, Homo sapiens
aaaggccagacctgcagacg

SEQ ID NO: 3412958 - DNA, 22 bp, Homo sapiens
aaaggctttggcaacagaaaac

SEQ ID NO: 3412959 - DNA, 12 bp, Homo sapiens
aaaggcttttgg

SEQ ID NO: 3412960 - DNA, 17 bp, Homo sapiens
aaagggagaaatgccag

SEQ ID NO: 3412961 - DNA, 14 bp, Homo sapiens
aaagtaaaccacaa

SEQ ID NO: 3412962 - DNA, 17 bp, Homo sapiens
aaagtaaacttgtgtat

SEQ ID NO: 3412963 - DNA, 19 bp, Homo sapiens
aaagtatgcaaaataaaga

SEQ ID NO: 3412964 - DNA, 12 bp, Homo sapiens
aaagtcattatt

SEQ ID NO: 3412965 - DNA, 15 bp, Homo sapiens
aaagtcattattcct

SEQ ID NO: 3412966 - DNA, 17 bp, Homo sapiens
aaagtcattattcctgg

SEQ ID NO: 3412967 - DNA, 17 bp, Homo sapiens
aaagtgatgacatattt

SEQ ID NO: 3412968 - DNA, 17 bp, Homo sapiens
aaagtgggtttcaattt

SEQ ID NO: 3412969 - DNA, 11 bp, Homo sapiens
aaagtgtcatc

SEQ ID NO: 3412970 - DNA, 13 bp, Homo sapiens
aaagttccagttt

SEQ ID NO: 3412971 - DNA, 12 bp, Homo sapiens
aaagttgctttt

SEQ ID NO: 3412972 - DNA, 14 bp, Homo sapiens
aaagttgcttttat

SEQ ID NO: 3412973 - DNA, 12 bp, Homo sapiens
aaagttttgaaa

SEQ ID NO: 3412974 - DNA, 18 bp, Homo sapiens
aaagttttgaaaagctat

SEQ ID NO: 3412975 - DNA, 21 bp, Homo sapiens
aaataaaactaaggaaccctg

SEQ ID NO: 3412976 - DNA, 21 bp, Homo sapiens
aaataaaattttttactttta

SEQ ID NO: 3412977 - DNA, 22 bp, Homo sapiens
aaataaaattttttacttttaa

SEQ ID NO: 3412978 - DNA, 21 bp, Homo sapiens
aaataaaccttgtttctttct

SEQ ID NO: 3412979 - DNA, 19 bp, Homo sapiens
aaataaagaatatgccgtt

SEQ ID NO: 3412980 - DNA, 11 bp, Homo sapiens
aaataaagctc

SEQ ID NO: 3412981 - DNA, 17 bp, Homo sapiens
aaataacaatgttaagg

SEQ ID NO: 3412982 - DNA, 18 bp, Homo sapiens
aaataacaatgttaagga

SEQ ID NO: 3412983 - DNA, 19 bp, Homo sapiens
aaataacaatgttaaggaa

SEQ ID NO: 3412984 - DNA, 19 bp, Homo sapiens
aaataacctataaagtgtt

SEQ ID NO: 3412985 - DNA, 19 bp, Homo sapiens
aaataatataaaatgtttc

SEQ ID NO: 3412986 - DNA, 13 bp, Homo sapiens
aaataatctacat

SEQ ID NO: 3412987 - DNA, 23 bp, Homo sapiens
aaataattgatcagatgctgaat

SEQ ID NO: 3412988 - DNA, 17 bp, Homo sapiens
aaatacctcaggaaaga

SEQ ID NO: 3412989 - DNA, 21 bp, Homo sapiens
aaatacctcaggaaagaatag

SEQ ID NO: 3412990 - DNA, 14 bp, Homo sapiens
aaatagcttcagga

SEQ ID NO: 3412991 - DNA, 14 bp, Homo sapiens
aaataggagaggat

SEQ ID NO: 3412992 - DNA, 16 bp, Homo sapiens
aaatagggtccttgaa

SEQ ID NO: 3412993 - DNA, 17 bp, Homo sapiens
aaatatacaagctacag

SEQ ID NO: 3412994 - DNA, 16 bp, Homo sapiens
aaatatagttgtcttt

SEQ ID NO: 3412995 - DNA, 19 bp, Homo sapiens
aaatatagttgtctttctt

SEQ ID NO: 3412996 - DNA, 22 bp, Homo sapiens
aaatatcaaaaggaagattctt

SEQ ID NO: 3412997 - DNA, 19 bp, Homo sapiens
aaatatccctttttcacat

SEQ ID NO: 3412998 - DNA, 10 bp, Homo sapiens
aaatatctga

SEQ ID NO: 3412999 - DNA, 19 bp, Homo sapiens
aaatatctgaacatttact

SEQ ID NO: 3413000 - DNA, 23 bp, Homo sapiens
aaatatgaaactcatctgtaaac

SEQ ID NO: 3413001 - DNA, 18 bp, Homo sapiens
aaatatgcagtgatatgg

SEQ ID NO: 3413002 - DNA, 22 bp, Homo sapiens
aaatatgcagtgatatggcaga

SEQ ID NO: 3413003 - DNA, 13 bp, Homo sapiens
aaatattactgat

SEQ ID NO: 3413004 - DNA, 21 bp, Homo sapiens
aaatattactgatcttacctt

SEQ ID NO: 3413005 - DNA, 12 bp, Homo sapiens
aaatattggtta

SEQ ID NO: 3413006 - DNA, 18 bp, Homo sapiens
aaatatttgttcttataa

SEQ ID NO: 3413007 - DNA, 18 bp, Homo sapiens
aaatcaacctatcaaagc

SEQ ID NO: 3413008 - DNA, 13 bp, Homo sapiens
aaatcaatttttt

SEQ ID NO: 3413009 - DNA, 19 bp, Homo sapiens
aaatcaattttttaaacca

SEQ ID NO: 3413010 - DNA, 20 bp, Homo sapiens
aaatcatttggcttgctgtt

SEQ ID NO: 3413011 - DNA, 16 bp, Homo sapiens
aaatcgccttatgaga

SEQ ID NO: 3413012 - DNA, 15 bp, Homo sapiens
aaatctgaattttaa

SEQ ID NO: 3413013 - DNA, 23 bp, Homo sapiens
aaatctggggaagaggttttatt

SEQ ID NO: 3413014 - DNA, 19 bp, Homo sapiens
aaatcttcagctggtggat

SEQ ID NO: 3413015 - DNA, 18 bp, Homo sapiens
aaatgagatttctttgaa

SEQ ID NO: 3413016 - DNA, 22 bp, Homo sapiens
aaatgagatttctttgaatgta

SEQ ID NO: 3413017 - DNA, 16 bp, Homo sapiens
aaatgatcttttcaag

SEQ ID NO: 3413018 - DNA, 21 bp, Homo sapiens
aagattttgaatgcttcctga

SEQ ID NO: 3413019 - DNA, 13 bp, Homo sapiens
aagatttttctca

SEQ ID NO: 3413020 - DNA, 20 bp, Homo sapiens
aagatttttctcaaagtttt

SEQ ID NO: 3413021 - DNA, 17 bp, Homo sapiens
aagattttttcatttca

SEQ ID NO: 3413022 - DNA, 17 bp, Homo sapiens
aagcaagagagatgttt

SEQ ID NO: 3413023 - DNA, 18 bp, Homo sapiens
aagcaagagagatgtttt

SEQ ID NO: 3413024 - DNA, 16 bp, Homo sapiens
aagcacatgccaggga

SEQ ID NO: 3413025 - DNA, 15 bp, Homo sapiens
aagcagagttctttg

SEQ ID NO: 3413026 - DNA, 16 bp, Homo sapiens
aagcagagttctttgc

SEQ ID NO: 3413027 - DNA, 15 bp, Homo sapiens
aagcatgagtggcct

SEQ ID NO: 3413028 - DNA, 13 bp, Homo sapiens
aagcattccttct

SEQ ID NO: 3413029 - DNA, 21 bp, Homo sapiens
aagcattccttctttgataat

SEQ ID NO: 3413030 - DNA, 16 bp, Homo sapiens
aagcattttcagcatc

SEQ ID NO: 3413031 - DNA, 21 bp, Homo sapiens
aagcattttcagcatcaaaca

SEQ ID NO: 3413032 - DNA, 20 bp, Homo sapiens
aagcatttttccatctgtgt

SEQ ID NO: 3413033 - DNA, 16 bp, Homo sapiens
aagccaaagagactgg

SEQ ID NO: 3413034 - DNA, 17 bp, Homo sapiens
aagccaagctccctgga

SEQ ID NO: 3413035 - DNA, 15 bp, Homo sapiens
aagccacaggcctga

SEQ ID NO: 3413036 - DNA, 22 bp, Homo sapiens
aagccacaggcctgagatttca

SEQ ID NO: 3413037 - DNA, 23 bp, Homo sapiens
aagccagcaccggaccagcctgg

SEQ ID NO: 3413038 - DNA, 18 bp, Homo sapiens
aagcccttcggtcacctg

SEQ ID NO: 3413039 - DNA, 18 bp, Homo sapiens
aagcgatcacttcctata

SEQ ID NO: 3413040 - DNA, 11 bp, Homo sapiens
aagctaaagag

SEQ ID NO: 3413041 - DNA, 18 bp, Homo sapiens
aagctacagttgtccaga

SEQ ID NO: 3413042 - DNA, 21 bp, Homo sapiens
aagctactgaatttattgccg

SEQ ID NO: 3413043 - DNA, 16 bp, Homo sapiens
aagctattagccagga

SEQ ID NO: 3413044 - DNA, 13 bp, Homo sapiens
aagctatttcctt

SEQ ID NO: 3413045 - DNA, 15 bp, Homo sapiens
aagctccctggagcc

SEQ ID NO: 3413046 - DNA, 18 bp, Homo sapiens
aagctccctggagccctg

SEQ ID NO: 3413047 - DNA, 21 bp, Homo sapiens
aagctccctggagccctgttg

SEQ ID NO: 3413048 - DNA, 12 bp, Homo sapiens
aagctcctccct

SEQ ID NO: 3413049 - DNA, 22 bp, Homo sapiens
aagctgggactcattcacattt

SEQ ID NO: 3413050 - DNA, 12 bp, Homo sapiens
aagctgttgtac

SEQ ID NO: 3413051 - DNA, 12 bp, Homo sapiens
aagcttggggaa

SEQ ID NO: 3413052 - DNA, 15 bp, Homo sapiens
aagctttatctttgt

SEQ ID NO: 3413053 - DNA, 17 bp, Homo sapiens
aagctttatctttgtgt

SEQ ID NO: 3413054 - DNA, 15 bp, Homo sapiens
aaggaaaaatttttt

SEQ ID NO: 3413055 - DNA, 18 bp, Homo sapiens
aaggaaaaatttttttgt

SEQ ID NO: 3413056 - DNA, 19 bp, Homo sapiens
aaggaaactcttatctcag

SEQ ID NO: 3413057 - DNA, 19 bp, Homo sapiens
aaggaacctaattgaaatt

SEQ ID NO: 3413058 - DNA, 13 bp, Homo sapiens
aaggaagactaga

SEQ ID NO: 3413059 - DNA, 21 bp, Homo sapiens
aaggacaaacagtgaatttaa

SEQ ID NO: 3413060 - DNA, 14 bp, Homo sapiens
aaggacagctttga

SEQ ID NO: 3413061 - DNA, 14 bp, Homo sapiens
aaggaccccctccc

SEQ ID NO: 3413062 - DNA, 18 bp, Homo sapiens
aaggagcctaggccaggt

SEQ ID NO: 3413063 - DNA, 19 bp, Homo sapiens
aaggagctgcctggacccg

SEQ ID NO: 3413064 - DNA, 21 bp, Homo sapiens
aaggcatacttttaatcaagt

SEQ ID NO: 3413065 - DNA, 20 bp, Homo sapiens
aaggccagacctgcagacgc

SEQ ID NO: 3413066 - DNA, 17 bp, Homo sapiens
aaggcctcgcaggaaga

SEQ ID NO: 3413067 - DNA, 23 bp, Homo sapiens
aaggctatggggatagatgtgtg

SEQ ID NO: 3413068 - DNA, 17 bp, Homo sapiens
aaggctttggcaacaga

SEQ ID NO: 3413069 - DNA, 16 bp, Homo sapiens
aagggagggggctggc

SEQ ID NO: 3413070 - DNA, 19 bp, Homo sapiens
aagggagtgtactcccagg

SEQ ID NO: 3413071 - DNA, 20 bp, Homo sapiens
aagggatggaaaaggaagac

SEQ ID NO: 3413072 - DNA, 21 bp, Homo sapiens
aagggatggaaaaggaagact

SEQ ID NO: 3413073 - DNA, 21 bp, Homo sapiens
aagggcaataccgtgttggtt

SEQ ID NO: 3413074 - DNA, 13 bp, Homo sapiens
aaggtatctggta

SEQ ID NO: 3413075 - DNA, 14 bp, Homo sapiens
aaggtatctggtat

SEQ ID NO: 3413076 - DNA, 17 bp, Homo sapiens
aaggtgggccttgctac

SEQ ID NO: 3413077 - DNA, 13 bp, Homo sapiens
aaggttgtattgc

SEQ ID NO: 3413078 - DNA, 13 bp, Homo sapiens
aagtaagaagaca

SEQ ID NO: 3413079 - DNA, 15 bp, Homo sapiens
aagtaagaagacatg

SEQ ID NO: 3413080 - DNA, 20 bp, Homo sapiens
aagtataacaattaaaatct

SEQ ID NO: 3413081 - DNA, 15 bp, Homo sapiens
aagtatacatgtcaa

SEQ ID NO: 3413082 - DNA, 22 bp, Homo sapiens
aagtctgaggcacctgcatatc

SEQ ID NO: 3413083 - DNA, 17 bp, Homo sapiens
aagtcttggtaacaaat

SEQ ID NO: 3413084 - DNA, 14 bp, Homo sapiens
aagtgacagatgtt

SEQ ID NO: 3413085 - DNA, 15 bp, Homo sapiens
aagtgacagatgtta

SEQ ID NO: 3413086 - DNA, 18 bp, Homo sapiens
aagtgcattattttattg

SEQ ID NO: 3413087 - DNA, 16 bp, Homo sapiens
aagtgcgtgtgtagag

SEQ ID NO: 3413088 - DNA, 18 bp, Homo sapiens
aagtgcgtgtgtagagtt

SEQ ID NO: 3413089 - DNA, 19 bp, Homo sapiens
aagtgcgtgtgtagagtta

SEQ ID NO: 3413090 - DNA, 21 bp, Homo sapiens
aagtgcgtgtgtagagttaag

SEQ ID NO: 3413091 - DNA, 23 bp, Homo sapiens
aagtgcgtgtgtagagttaagaa

SEQ ID NO: 3413092 - DNA, 17 bp, Homo sapiens
aagtgggtttcaattta

SEQ ID NO: 3413093 - DNA, 15 bp, Homo sapiens
aagtgtaaataatat

SEQ ID NO: 3413094 - DNA, 22 bp, Homo sapiens
aagtgtaaataatataaaatgt

SEQ ID NO: 3413095 - DNA, 10 bp, Homo sapiens
aagtgtgggt

SEQ ID NO: 3413096 - DNA, 17 bp, Homo sapiens
aagtgtgggtctgtgtg

SEQ ID NO: 3413097 - DNA, 18 bp, Homo sapiens
aagtgtgggtctgtgtgt

SEQ ID NO: 3413098 - DNA, 20 bp, Homo sapiens
aagtgtgggtctgtgtgtgt

SEQ ID NO: 3413099 - DNA, 16 bp, Homo sapiens
aagtgttgaaaaatat

SEQ ID NO: 3413100 - DNA, 15 bp, Homo sapiens
aagttggtcttactt

SEQ ID NO: 3413101 - DNA, 23 bp, Homo sapiens
aagttggtcttactttgtgcaaa

SEQ ID NO: 3413102 - DNA, 14 bp, Homo sapiens
aagtttcaggtgac

SEQ ID NO: 3413103 - DNA, 15 bp, Homo sapiens
aagtttcaggtgaca

SEQ ID NO: 3413104 - DNA, 19 bp, Homo sapiens
aagtttcaggtgacatgtg

SEQ ID NO: 3413105 - DNA, 21 bp, Homo sapiens
aagtttcaggtgacatgtgaa

SEQ ID NO: 3413106 - DNA, 17 bp, Homo sapiens
aagtttgggctaacatt

SEQ ID NO: 3413107 - DNA, 13 bp, Homo sapiens
aagttttgaaaag

SEQ ID NO: 3413108 - DNA, 16 bp, Homo sapiens
aataaaataattctaa

SEQ ID NO: 3413109 - DNA, 17 bp, Homo sapiens
aataaaataattctaaa

SEQ ID NO: 3413110 - DNA, 12 bp, Homo sapiens
aataaaattttt

SEQ ID NO: 3413111 - DNA, 15 bp, Homo sapiens
aataaacatctgtgt

SEQ ID NO: 3413112 - DNA, 14 bp, Homo sapiens
aataaaccttgttt

SEQ ID NO: 3413113 - DNA, 19 bp, Homo sapiens
acagatgttatttttgtat

SEQ ID NO: 3413114 - DNA, 16 bp, Homo sapiens
acagcccaaagaagga

SEQ ID NO: 3413115 - DNA, 18 bp, Homo sapiens
acagcccaaagaaggaaa

SEQ ID NO: 3413116 - DNA, 19 bp, Homo sapiens
acagcccaaagaaggaaaa

SEQ ID NO: 3413117 - DNA, 18 bp, Homo sapiens
acagcctgggaccagggc

SEQ ID NO: 3413118 - DNA, 20 bp, Homo sapiens
acagcctgggaccagggcat

SEQ ID NO: 3413119 - DNA, 20 bp, Homo sapiens
acagcttcaggttatcgaaa

SEQ ID NO: 3413120 - DNA, 13 bp, Homo sapiens
acagctttcttat

SEQ ID NO: 3413121 - DNA, 15 bp, Homo sapiens
acaggatgctttggt

SEQ ID NO: 3413122 - DNA, 14 bp, Homo sapiens
acaggcaccgagaa

SEQ ID NO: 3413123 - DNA, 17 bp, Homo sapiens
acaggcaccgagaatgt

SEQ ID NO: 3413124 - DNA, 16 bp, Homo sapiens
acaggcactgccctgg

SEQ ID NO: 3413125 - DNA, 18 bp, Homo sapiens
acaggcactgccctggtg

SEQ ID NO: 3413126 - DNA, 14 bp, Homo sapiens
acagtcattattta

SEQ ID NO: 3413127 - DNA, 13 bp, Homo sapiens
acagtctcaattt

SEQ ID NO: 3413128 - DNA, 23 bp, Homo sapiens
acagtgaaagtcaattcagtgat

SEQ ID NO: 3413129 - DNA, 16 bp, Homo sapiens
acagtgaatttaagca

SEQ ID NO: 3413130 - DNA, 17 bp, Homo sapiens
acagtgaatttaagcat

SEQ ID NO: 3413131 - DNA, 13 bp, Homo sapiens
acagtgtaagctt

SEQ ID NO: 3413132 - DNA, 23 bp, Homo sapiens
acagtgtaagcttagattttctg

SEQ ID NO: 3413133 - DNA, 13 bp, Homo sapiens
acagttaaataaa

SEQ ID NO: 3413134 - DNA, 17 bp, Homo sapiens
acagttaccctgctttg

SEQ ID NO: 3413135 - DNA, 12 bp, Homo sapiens
acagttctgtaa

SEQ ID NO: 3413136 - DNA, 13 bp, Homo sapiens
acagttctgtaat

SEQ ID NO: 3413137 - DNA, 14 bp, Homo sapiens
acagtttcttagct

SEQ ID NO: 3413138 - DNA, 14 bp, Homo sapiens
acataacgtttttc

SEQ ID NO: 3413139 - DNA, 21 bp, Homo sapiens
actcatcttggccctcctcag

SEQ ID NO: 3413140 - DNA, 23 bp, Homo sapiens
actcatgactgagtctggcaaac

SEQ ID NO: 3413141 - DNA, 13 bp, Homo sapiens
actcgagaacttt

SEQ ID NO: 3413142 - DNA, 12 bp, Homo sapiens
actctaaagatt

SEQ ID NO: 3413143 - DNA, 14 bp, Homo sapiens
actctactgtgtaa

SEQ ID NO: 3413144 - DNA, 16 bp, Homo sapiens
actctccacctcacta

SEQ ID NO: 3413145 - DNA, 22 bp, Homo sapiens
actctccacctcactagctccc

SEQ ID NO: 3413146 - DNA, 10 bp, Homo sapiens
actctccccc

SEQ ID NO: 3413147 - DNA, 14 bp, Homo sapiens
actctcccccaccc

SEQ ID NO: 3413148 - DNA, 16 bp, Homo sapiens
actctgcaactgaata

SEQ ID NO: 3413149 - DNA, 14 bp, Homo sapiens
actctgcagcctca

SEQ ID NO: 3413150 - DNA, 15 bp, Homo sapiens
actctgcagcctcag

SEQ ID NO: 3413151 - DNA, 16 bp, Homo sapiens
actctgcagcctcaga

SEQ ID NO: 3413152 - DNA, 15 bp, Homo sapiens
actctggacctctct

SEQ ID NO: 3413153 - DNA, 22 bp, Homo sapiens
actctgtgtctgagtggcttca

SEQ ID NO: 3413154 - DNA, 15 bp, Homo sapiens
actcttaagtgtaaa

SEQ ID NO: 3413155 - DNA, 23 bp, Homo sapiens
actcttaccatcccggtgcatgc

SEQ ID NO: 3413156 - DNA, 23 bp, Homo sapiens
actcttatctcagtcatgcataa

SEQ ID NO: 3413157 - DNA, 20 bp, Homo sapiens
actcttgtattgctccattt

SEQ ID NO: 3413158 - DNA, 19 bp, Homo sapiens
actgaaaaaaaaaaaagaa

SEQ ID NO: 3413159 - DNA, 15 bp, Homo sapiens
actgaatttattgcc

SEQ ID NO: 3413160 - DNA, 17 bp, Homo sapiens
actgaatttattgccgc

SEQ ID NO: 3413161 - DNA, 20 bp, Homo sapiens
actgagaatgtaagaactac

SEQ ID NO: 3413162 - DNA, 18 bp, Homo sapiens
actgcaagcatttttcca

SEQ ID NO: 3413163 - DNA, 22 bp, Homo sapiens
actgcaagcatttttccatctg

SEQ ID NO: 3413164 - DNA, 15 bp, Homo sapiens
actgcctctcacagc

SEQ ID NO: 3413165 - DNA, 15 bp, Homo sapiens
actgcctgaataaag

SEQ ID NO: 3413166 - DNA, 15 bp, Homo sapiens
actgctctagaaagt

SEQ ID NO: 3413167 - DNA, 17 bp, Homo sapiens
actgcttctctttgtgc

SEQ ID NO: 3413168 - DNA, 15 bp, Homo sapiens
actgctttattttcc

SEQ ID NO: 3413169 - DNA, 20 bp, Homo sapiens
actgctttattttccctact

SEQ ID NO: 3413170 - DNA, 14 bp, Homo sapiens
actggcagcatctt

SEQ ID NO: 3413171 - DNA, 10 bp, Homo sapiens
actggcatgc

SEQ ID NO: 3413172 - DNA, 23 bp, Homo sapiens
actggccagtggctggatctgtg

SEQ ID NO: 3413173 - DNA, 20 bp, Homo sapiens
actgggcctaggccaggagt

SEQ ID NO: 3413174 - DNA, 19 bp, Homo sapiens
actggtttataataaactc

SEQ ID NO: 3413175 - DNA, 17 bp, Homo sapiens
actgtaaaatagttttg

SEQ ID NO: 3413176 - DNA, 15 bp, Homo sapiens
actgtactgggccat

SEQ ID NO: 3413177 - DNA, 14 bp, Homo sapiens
actgtataaatagg

SEQ ID NO: 3413178 - DNA, 15 bp, Homo sapiens
actgtataaatagga

SEQ ID NO: 3413179 - DNA, 20 bp, Homo sapiens
actgtataaataggagagga

SEQ ID NO: 3413180 - DNA, 14 bp, Homo sapiens
actgtatttcagta

SEQ ID NO: 3413181 - DNA, 20 bp, Homo sapiens
actgtatttcagtattttcc

SEQ ID NO: 3413182 - DNA, 12 bp, Homo sapiens
actgtcttaaat

SEQ ID NO: 3413183 - DNA, 16 bp, Homo sapiens
actgtcttaaatcagt

SEQ ID NO: 3413184 - DNA, 19 bp, Homo sapiens
actgtgatgaaatatgaaa

SEQ ID NO: 3413185 - DNA, 23 bp, Homo sapiens
actgtgatgttgggaagctattt

SEQ ID NO: 3413186 - DNA, 15 bp, Homo sapiens
actgtggaggaagga

SEQ ID NO: 3413187 - DNA, 18 bp, Homo sapiens
actgtggaggaaggattg

SEQ ID NO: 3413188 - DNA, 15 bp, Homo sapiens
actgtgtaatataaa

SEQ ID NO: 3413189 - DNA, 20 bp, Homo sapiens
acttaaaagcaagatctact

SEQ ID NO: 3413190 - DNA, 13 bp, Homo sapiens
acttaaacatcat

SEQ ID NO: 3413191 - DNA, 13 bp, Homo sapiens
acttaataatgtg

SEQ ID NO: 3413192 - DNA, 17 bp, Homo sapiens
acttaataatgtgtaca

SEQ ID NO: 3413193 - DNA, 20 bp, Homo sapiens
acttaatattagcttgctta

SEQ ID NO: 3413194 - DNA, 15 bp, Homo sapiens
acttagaatgccata

SEQ ID NO: 3413195 - DNA, 19 bp, Homo sapiens
acttcacgctttcagcgaa

SEQ ID NO: 3413196 - DNA, 13 bp, Homo sapiens
acttgataatgat

SEQ ID NO: 3413197 - DNA, 18 bp, Homo sapiens
acttgcaggggtccctgc

SEQ ID NO: 3413198 - DNA, 19 bp, Homo sapiens
acttgcaggggtccctgct

SEQ ID NO: 3413199 - DNA, 21 bp, Homo sapiens
acttgcaggggtccctgctag

SEQ ID NO: 3413200 - DNA, 14 bp, Homo sapiens
acttgtctttttgt

SEQ ID NO: 3413201 - DNA, 18 bp, Homo sapiens
actttcagtgaaagcatc

SEQ ID NO: 3413202 - DNA, 15 bp, Homo sapiens
actttgctgttactg

SEQ ID NO: 3413203 - DNA, 21 bp, Homo sapiens
actttgctgttactgcttctc

SEQ ID NO: 3413204 - DNA, 19 bp, Homo sapiens
actttgctgttccttactt

SEQ ID NO: 3413205 - DNA, 13 bp, Homo sapiens
acttttaaaataa

SEQ ID NO: 3413206 - DNA, 18 bp, Homo sapiens
acttttaggttgttacca

SEQ ID NO: 3413207 - DNA, 22 bp, Homo sapiens
acttttgaagaacaaaaggctt

SEQ ID NO: 3413208 - DNA, 16 bp, Homo sapiens
actttttaaacagtgt

SEQ ID NO: 3413209 - DNA, 22 bp, Homo sapiens
actttttaaacagtgtttatga

SEQ ID NO: 3413210 - DNA, 15 bp, Homo sapiens
actttttcccctgca

SEQ ID NO: 3413211 - DNA, 17 bp, Homo sapiens
actttttcccctgcaat

SEQ ID NO: 3413212 - DNA, 12 bp, Homo sapiens
actttttgcagc

SEQ ID NO: 3413213 - DNA, 13 bp, Homo sapiens
actttttgcagct

SEQ ID NO: 3413214 - DNA, 20 bp, Homo sapiens
agaaaacaggcactgccctg

SEQ ID NO: 3413215 - DNA, 15 bp, Homo sapiens
agaaaatgaatttga

SEQ ID NO: 3413216 - DNA, 24 bp, Homo sapiens
agaaaatgtgtctgcaacatggat

SEQ ID NO: 3413217 - DNA, 12 bp, Homo sapiens
agaaaggaaaaa

SEQ ID NO: 3413218 - DNA, 14 bp, Homo sapiens
agaaaggactctgg

SEQ ID NO: 3413219 - DNA, 16 bp, Homo sapiens
agaacaaaaactatta

SEQ ID NO: 3413220 - DNA, 13 bp, Homo sapiens
agaacagcttcag

SEQ ID NO: 3413221 - DNA, 17 bp, Homo sapiens
agcacatgccagggaaa

SEQ ID NO: 3413222 - DNA, 19 bp, Homo sapiens
agcaccggaccagcctggc

SEQ ID NO: 3413223 - DNA, 21 bp, Homo sapiens
agcactgaggaagaacggggc

SEQ ID NO: 3413224 - DNA, 20 bp, Homo sapiens
agcactgctgtgtccgcttt

SEQ ID NO: 3413225 - DNA, 16 bp, Homo sapiens
agcagaagggggtggt

SEQ ID NO: 3413226 - DNA, 16 bp, Homo sapiens
agcagagttctttgca

SEQ ID NO: 3413227 - DNA, 23 bp, Homo sapiens
agcagagttctttgcaagcttat

SEQ ID NO: 3413228 - DNA, 16 bp, Homo sapiens
agcagatgcagagagc

SEQ ID NO: 3413229 - DNA, 17 bp, Homo sapiens
agcagatgcagagagcc

SEQ ID NO: 3413230 - DNA, 14 bp, Homo sapiens
agcagcctccttat

SEQ ID NO: 3413231 - DNA, 15 bp, Homo sapiens
agcagtacaataaaa

SEQ ID NO: 3413232 - DNA, 16 bp, Homo sapiens
agcatcaaacatgaaa

SEQ ID NO: 3413233 - DNA, 20 bp, Homo sapiens
agcatcttcacttctaaatg

SEQ ID NO: 3413234 - DNA, 23 bp, Homo sapiens
agcatcttcacttctaaatgcat

SEQ ID NO: 3413235 - DNA, 18 bp, Homo sapiens
agcatgtatagttgcttt

SEQ ID NO: 3413236 - DNA, 15 bp, Homo sapiens
agcattaactaaatg

SEQ ID NO: 3413237 - DNA, 19 bp, Homo sapiens
agcattaactaaatgctca

SEQ ID NO: 3413238 - DNA, 21 bp, Homo sapiens
agcattaactaaatgctcata

SEQ ID NO: 3413239 - DNA, 21 bp, Homo sapiens
agcattttcagcatcaaacat

SEQ ID NO: 3413240 - DNA, 13 bp, Homo sapiens
agcatttttccat

SEQ ID NO: 3413241 - DNA, 18 bp, Homo sapiens
agcatttttccatctgtg

SEQ ID NO: 3413242 - DNA, 19 bp, Homo sapiens
agccaagctccctggagcc

SEQ ID NO: 3413243 - DNA, 16 bp, Homo sapiens
agccaataaagaaatt

SEQ ID NO: 3413244 - DNA, 14 bp, Homo sapiens
agccacaggcctga

SEQ ID NO: 3413245 - DNA, 23 bp, Homo sapiens
agccacaggcctgagatttcatc

SEQ ID NO: 3413246 - DNA, 24 bp, Homo sapiens
agccagcaccggaccagcctggcc

SEQ ID NO: 3413247 - DNA, 18 bp, Homo sapiens
agccaggatcatggtgta

SEQ ID NO: 3413248 - DNA, 20 bp, Homo sapiens
agccaggatcatggtgtaat

SEQ ID NO: 3413249 - DNA, 23 bp, Homo sapiens
agccaggatcatggtgtaataag

SEQ ID NO: 3413250 - DNA, 16 bp, Homo sapiens
agccagggagagccca

SEQ ID NO: 3413251 - DNA, 17 bp, Homo sapiens
agccagggagagcccag

SEQ ID NO: 3413252 - DNA, 22 bp, Homo sapiens
agccatcggtgaaactaacaga

SEQ ID NO: 3413253 - DNA, 15 bp, Homo sapiens
agccattttgtgaat

SEQ ID NO: 3413254 - DNA, 15 bp, Homo sapiens
atgatcacatctaaa

SEQ ID NO: 3413255 - DNA, 19 bp, Homo sapiens
atgatcacatctaaagctt

SEQ ID NO: 3413256 - DNA, 19 bp, Homo sapiens
atgatggaacagtgaaagt

SEQ ID NO: 3413257 - DNA, 14 bp, Homo sapiens
atgattcaaatatc

SEQ ID NO: 3413258 - DNA, 16 bp, Homo sapiens
atgattggttcagttt

SEQ ID NO: 3413259 - DNA, 20 bp, Homo sapiens
atgatttaaatagaacttga

SEQ ID NO: 3413260 - DNA, 14 bp, Homo sapiens
atgcaacaacatgt

SEQ ID NO: 3413261 - DNA, 19 bp, Homo sapiens
atgcaagtgggagatgaaa

SEQ ID NO: 3413262 - DNA, 21 bp, Homo sapiens
atgcaataaaattatttgcag

SEQ ID NO: 3413263 - DNA, 17 bp, Homo sapiens
atgcaatgataaataaa

SEQ ID NO: 3413264 - DNA, 18 bp, Homo sapiens
atgcaatgataaataaag

SEQ ID NO: 3413265 - DNA, 19 bp, Homo sapiens
atgcagagagccattttgt

SEQ ID NO: 3413266 - DNA, 21 bp, Homo sapiens
atgcagagagccattttgtga

SEQ ID NO: 3413267 - DNA, 23 bp, Homo sapiens
atgcagagagccattttgtgaat

SEQ ID NO: 3413268 - DNA, 17 bp, Homo sapiens
atgcagaggaggagaaa

SEQ ID NO: 3413269 - DNA, 16 bp, Homo sapiens
atgcataaatatgcag

SEQ ID NO: 3413270 - DNA, 13 bp, Homo sapiens
atgcatagagcaa

SEQ ID NO: 3413271 - DNA, 16 bp, Homo sapiens
atgcatagagcaatta

SEQ ID NO: 3413272 - DNA, 21 bp, Homo sapiens
atgcatagagcaattaaactg

SEQ ID NO: 3413273 - DNA, 13 bp, Homo sapiens
atgcattcatgtt

SEQ ID NO: 3413274 - DNA, 13 bp, Homo sapiens
atgcatttgaggt

SEQ ID NO: 3413275 - DNA, 23 bp, Homo sapiens
atgccataaaattgcagtttcat

SEQ ID NO: 3413276 - DNA, 17 bp, Homo sapiens
atgccatggacagaaga

SEQ ID NO: 3413277 - DNA, 12 bp, Homo sapiens
atgcctttgaga

SEQ ID NO: 3413278 - DNA, 15 bp, Homo sapiens
atgcgggcattttga

SEQ ID NO: 3413279 - DNA, 13 bp, Homo sapiens
atgcgtcttgtga

SEQ ID NO: 3413280 - DNA, 15 bp, Homo sapiens
atgcgtcttgtgaaa

SEQ ID NO: 3413281 - DNA, 22 bp, Homo sapiens
atgcgtcttgtgaaattgtgta

SEQ ID NO: 3413282 - DNA, 21 bp, Homo sapiens
atgctgcccagggtcagtgta

SEQ ID NO: 3413283 - DNA, 13 bp, Homo sapiens
atgctgtatttct

SEQ ID NO: 3413284 - DNA, 18 bp, Homo sapiens
atgctgtatttctttgta

SEQ ID NO: 3413285 - DNA, 17 bp, Homo sapiens
atgctgtttatgacaca

SEQ ID NO: 3413286 - DNA, 20 bp, Homo sapiens
atgcttcaaagtccacatta

SEQ ID NO: 3413287 - DNA, 22 bp, Homo sapiens
atgcttcctgacaatcaactct

SEQ ID NO: 3413288 - DNA, 14 bp, Homo sapiens
atggaaaggaagaa

SEQ ID NO: 3413289 - DNA, 23 bp, Homo sapiens
atggaaaggagcctaggccaggt

SEQ ID NO: 3413290 - DNA, 21 bp, Homo sapiens
atggaatgatgggtcagttgt

SEQ ID NO: 3413291 - DNA, 18 bp, Homo sapiens
atggaatgtcagtgttca

SEQ ID NO: 3413292 - DNA, 17 bp, Homo sapiens
atggaatttttgaatct

SEQ ID NO: 3413293 - DNA, 18 bp, Homo sapiens
atggaatttttgaatcta

SEQ ID NO: 3413294 - DNA, 13 bp, Homo sapiens
atggaccggagag

SEQ ID NO: 3413295 - DNA, 21 bp, Homo sapiens
aggatttatacatacagagat

SEQ ID NO: 3413296 - DNA, 15 bp, Homo sapiens
aggcaccgagaatgt

SEQ ID NO: 3413297 - DNA, 23 bp, Homo sapiens
aggcactaagaggggctggacct

SEQ ID NO: 3413298 - DNA, 15 bp, Homo sapiens
aggcagattgaaaag

SEQ ID NO: 3413299 - DNA, 21 bp, Homo sapiens
aggcagggaacatggggagga

SEQ ID NO: 3413300 - DNA, 23 bp, Homo sapiens
aggcagggaacatggggaggagg

SEQ ID NO: 3413301 - DNA, 13 bp, Homo sapiens
aggcatactttta

SEQ ID NO: 3413302 - DNA, 16 bp, Homo sapiens
aggcatacttttaatc

SEQ ID NO: 3413303 - DNA, 22 bp, Homo sapiens
aggcatttgattaaattatgaa

SEQ ID NO: 3413304 - DNA, 15 bp, Homo sapiens
aggccaggactctgc

SEQ ID NO: 3413305 - DNA, 16 bp, Homo sapiens
aggccaggagttccca

SEQ ID NO: 3413306 - DNA, 18 bp, Homo sapiens
aggccaggtgcaaccagg

SEQ ID NO: 3413307 - DNA, 23 bp, Homo sapiens
aggccctccacacctgcggccca

SEQ ID NO: 3413308 - DNA, 14 bp, Homo sapiens
aggcctcgcaggaa

SEQ ID NO: 3413309 - DNA, 15 bp, Homo sapiens
aggcctctgtgccgc

SEQ ID NO: 3413310 - DNA, 14 bp, Homo sapiens
aggcctgagcgctc

SEQ ID NO: 3413311 - DNA, 17 bp, Homo sapiens
aggcctgcctccagggc

SEQ ID NO: 3413312 - DNA, 21 bp, Homo sapiens
aggcctgcctccagggctgga

SEQ ID NO: 3413313 - DNA, 13 bp, Homo sapiens
aggctatcctgct

SEQ ID NO: 3413314 - DNA, 19 bp, Homo sapiens
aggctatggggatagatgt

SEQ ID NO: 3413315 - DNA, 17 bp, Homo sapiens
aggctgccggctcccct

SEQ ID NO: 3413316 - DNA, 22 bp, Homo sapiens
aggctggttcggatttggggtg

SEQ ID NO: 3413317 - DNA, 12 bp, Homo sapiens
aggctgtacata

SEQ ID NO: 3413318 - DNA, 14 bp, Homo sapiens
aggctgtacatagt

SEQ ID NO: 3413319 - DNA, 14 bp, Homo sapiens
aggcttacacccac

SEQ ID NO: 3413320 - DNA, 18 bp, Homo sapiens
aggcttgcataataagct

SEQ ID NO: 3413321 - DNA, 13 bp, Homo sapiens
aggctttaaaagt

SEQ ID NO: 3413322 - DNA, 21 bp, Homo sapiens
agggaaaatggatatagaaaa

SEQ ID NO: 3413323 - DNA, 13 bp, Homo sapiens
agggaacatgcag

SEQ ID NO: 3413324 - DNA, 14 bp, Homo sapiens
agggagaaatgcca

SEQ ID NO: 3413325 - DNA, 14 bp, Homo sapiens
agggagagcccagg

SEQ ID NO: 3413326 - DNA, 15 bp, Homo sapiens
agggagctgcagggg

SEQ ID NO: 3413327 - DNA, 15 bp, Homo sapiens
agggagggggctggc

SEQ ID NO: 3413328 - DNA, 22 bp, Homo sapiens
agggatggaaaaggaagactag

SEQ ID NO: 3413329 - DNA, 21 bp, Homo sapiens
agggcagcagaagggggtggt

SEQ ID NO: 3413330 - DNA, 14 bp, Homo sapiens
agggcagccaggga

SEQ ID NO: 3413331 - DNA, 15 bp, Homo sapiens
agggcagccagggag

SEQ ID NO: 3413332 - DNA, 23 bp, Homo sapiens
agggcagccagggagagcccagg

SEQ ID NO: 3413333 - DNA, 16 bp, Homo sapiens
agggccgggcagaggg

SEQ ID NO: 3413334 - DNA, 17 bp, Homo sapiens
agggcctgcgagggcag

SEQ ID NO: 3413335 - DNA, 18 bp, Homo sapiens
agggctgaataaagggaa

SEQ ID NO: 3413336 - DNA, 18 bp, Homo sapiens
agggctggactgaggcct

SEQ ID NO: 3413337 - DNA, 20 bp, Homo sapiens
agggctggactgaggcctga

SEQ ID NO: 3413338 - DNA, 15 bp, Homo sapiens
agggcttacggccct

SEQ ID NO: 3413339 - DNA, 15 bp, Homo sapiens
aggggcagatggaaa

SEQ ID NO: 3413340 - DNA, 20 bp, Homo sapiens
aggggcctgccacctggacc

SEQ ID NO: 3413341 - DNA, 21 bp, Homo sapiens
aggggcctgccacctggaccc

SEQ ID NO: 3413342 - DNA, 13 bp, Homo sapiens
aggggtccctgct

SEQ ID NO: 3413343 - DNA, 18 bp, Homo sapiens
agggtcagccagggcctg

SEQ ID NO: 3413344 - DNA, 23 bp, Homo sapiens
agggtcagccagggcctgcgagg

SEQ ID NO: 3413345 - DNA, 15 bp, Homo sapiens
agggtcggtgccttc

SEQ ID NO: 3413346 - DNA, 18 bp, Homo sapiens
agggttcaaaatgtctgt

SEQ ID NO: 3413347 - DNA, 17 bp, Homo sapiens
aggtaaataaagctcaa

SEQ ID NO: 3413348 - DNA, 13 bp, Homo sapiens
aggtaacagaaca

SEQ ID NO: 3413349 - DNA, 18 bp, Homo sapiens
aggtaacagaacagcttc

SEQ ID NO: 3413350 - DNA, 22 bp, Homo sapiens
aggtaacagaacagcttcaggt

SEQ ID NO: 3413351 - DNA, 23 bp, Homo sapiens
aggtaacagaacagcttcaggtt

SEQ ID NO: 3413352 - DNA, 15 bp, Homo sapiens
aggtatctggtatct

SEQ ID NO: 3413353 - DNA, 19 bp, Homo sapiens
aggtatctttatagttgta

SEQ ID NO: 3413354 - DNA, 17 bp, Homo sapiens
aggtcaagtaagaagac

SEQ ID NO: 3413355 - DNA, 18 bp, Homo sapiens
aggtcaagtaagaagaca

SEQ ID NO: 3413356 - DNA, 22 bp, Homo sapiens
aggtcaagtaagaagacatgaa

SEQ ID NO: 3413357 - DNA, 17 bp, Homo sapiens
aggtcgtataatttagt

SEQ ID NO: 3413358 - DNA, 12 bp, Homo sapiens
aggtctcctctt

SEQ ID NO: 3413359 - DNA, 14 bp, Homo sapiens
aggtgacatgtgaa

SEQ ID NO: 3413360 - DNA, 15 bp, Homo sapiens
aggtgacatgtgaaa

SEQ ID NO: 3413361 - DNA, 20 bp, Homo sapiens
aggtgacatgtgaaaccttt

SEQ ID NO: 3413362 - DNA, 19 bp, Homo sapiens
aggttatcgaaataacaat

SEQ ID NO: 3413363 - DNA, 15 bp, Homo sapiens
aggttggaaaagaaa

SEQ ID NO: 3413364 - DNA, 23 bp, Homo sapiens
aggttggaaaagaaatcaatttt

SEQ ID NO: 3413365 - DNA, 15 bp, Homo sapiens
aggtttctgaaaatt

SEQ ID NO: 3413366 - DNA, 23 bp, Homo sapiens
aggtttctgaaaattaacactgc

SEQ ID NO: 3413367 - DNA, 19 bp, Homo sapiens
aggtttgaaaggcaatttt

SEQ ID NO: 3413368 - DNA, 23 bp, Homo sapiens
aggtttgtttagaagaagtgtgt

SEQ ID NO: 3413369 - DNA, 14 bp, Homo sapiens
aggtttgtttcttg

SEQ ID NO: 3413370 - DNA, 15 bp, Homo sapiens
agtaaacttgtgtat

SEQ ID NO: 3413371 - DNA, 16 bp, Homo sapiens
ataaataggagaggat

SEQ ID NO: 3413372 - DNA, 16 bp, Homo sapiens
ataaatataaatatat

SEQ ID NO: 3413373 - DNA, 14 bp, Homo sapiens
ataaatatgcagtg

SEQ ID NO: 3413374 - DNA, 17 bp, Homo sapiens
ataaatgcatagagcaa

SEQ ID NO: 3413375 - DNA, 18 bp, Homo sapiens
ataaatgcatagagcaat

SEQ ID NO: 3413376 - DNA, 19 bp, Homo sapiens
ataaatgcatagagcaatt

SEQ ID NO: 3413377 - DNA, 19 bp, Homo sapiens
ataaattgtaattgtaaag

SEQ ID NO: 3413378 - DNA, 17 bp, Homo sapiens
ataaatttgttgtcatg

SEQ ID NO: 3413379 - DNA, 13 bp, Homo sapiens
ataacaatgttaa

SEQ ID NO: 3413380 - DNA, 22 bp, Homo sapiens
ataacaatgttaaggaaactct

SEQ ID NO: 3413381 - DNA, 17 bp, Homo sapiens
ataacatagttgaaaaa

SEQ ID NO: 3413382 - DNA, 23 bp, Homo sapiens
ataacatagttgaaaaaagaagt

SEQ ID NO: 3413383 - DNA, 20 bp, Homo sapiens
ataacattaccttactgtgg

SEQ ID NO: 3413384 - DNA, 18 bp, Homo sapiens
ataaccagtttagctttt

SEQ ID NO: 3413385 - DNA, 18 bp, Homo sapiens
ataacctataaagtgttt

SEQ ID NO: 3413386 - DNA, 14 bp, Homo sapiens
ataactgtgatgaa

SEQ ID NO: 3413387 - DNA, 16 bp, Homo sapiens
ataacttcaaattttt

SEQ ID NO: 3413388 - DNA, 23 bp, Homo sapiens
ataagacataacgtttttccttt

SEQ ID NO: 3413389 - DNA, 17 bp, Homo sapiens
ataagctaaagaggctg

SEQ ID NO: 3413390 - DNA, 19 bp, Homo sapiens
ataagtcttggtaacaaat

SEQ ID NO: 3413391 - DNA, 23 bp, Homo sapiens
ataagttctagttgcttgtaaaa

SEQ ID NO: 3413392 - DNA, 13 bp, Homo sapiens
ataataagctaaa

SEQ ID NO: 3413393 - DNA, 18 bp, Homo sapiens
ataatagctaataataaa

SEQ ID NO: 3413394 - DNA, 14 bp, Homo sapiens
ataatatactttta

SEQ ID NO: 3413395 - DNA, 22 bp, Homo sapiens
ataatatacttttacattaaag

SEQ ID NO: 3413396 - DNA, 14 bp, Homo sapiens
ataatatttttaat

SEQ ID NO: 3413397 - DNA, 18 bp, Homo sapiens
ataatcacaacccttcag

SEQ ID NO: 3413398 - DNA, 14 bp, Homo sapiens
ataatcatgctcat

SEQ ID NO: 3413399 - DNA, 12 bp, Homo sapiens
ataatctacatc

SEQ ID NO: 3413400 - DNA, 18 bp, Homo sapiens
ataatctatattaaatga

SEQ ID NO: 3413401 - DNA, 20 bp, Homo sapiens
ataatctatattaaatgagg

SEQ ID NO: 3413402 - DNA, 15 bp, Homo sapiens
ataatgatttcctct

SEQ ID NO: 3413403 - DNA, 19 bp, Homo sapiens
ataatgatttcctctgaat

SEQ ID NO: 3413404 - DNA, 22 bp, Homo sapiens
ataatgcaatgataaataaagt

SEQ ID NO: 3413405 - DNA, 13 bp, Homo sapiens
ataatgctttctg

SEQ ID NO: 3413406 - DNA, 16 bp, Homo sapiens
ataatgtccaaatact

SEQ ID NO: 3413407 - DNA, 23 bp, Homo sapiens
ataatgtgtctgtgttgcttcaa

SEQ ID NO: 3413408 - DNA, 11 bp, Homo sapiens
ataatgttaaa

SEQ ID NO: 3413409 - DNA, 22 bp, Homo sapiens
ataatgttaaatttgtaagttt

SEQ ID NO: 3413410 - DNA, 12 bp, Homo sapiens
ataattctaaag

SEQ ID NO: 3413411 - DNA, 13 bp, Homo sapiens
ataatttgtctta

SEQ ID NO: 3413412 - DNA, 23 bp, Homo sapiens
atacaagctacagttgtccagat

SEQ ID NO: 3413413 - DNA, 20 bp, Homo sapiens
atacacagttaaataaatag

SEQ ID NO: 3413414 - DNA, 21 bp, Homo sapiens
atacagtcattatttaaagca

SEQ ID NO: 3413415 - DNA, 14 bp, Homo sapiens
atacatggttgtga

SEQ ID NO: 3413416 - DNA, 20 bp, Homo sapiens
atacatggttgtgacctgag

SEQ ID NO: 3413417 - DNA, 16 bp, Homo sapiens
atacattttgaaaata

SEQ ID NO: 3413418 - DNA, 13 bp, Homo sapiens
atacccaacagtt

SEQ ID NO: 3413419 - DNA, 17 bp, Homo sapiens
atacctcaggaaagaat

SEQ ID NO: 3413420 - DNA, 18 bp, Homo sapiens
atacctcaggaaagaata

SEQ ID NO: 3413421 - DNA, 13 bp, Homo sapiens
atacggtgggggt

SEQ ID NO: 3413422 - DNA, 14 bp, Homo sapiens
atactatatgaaaa

SEQ ID NO: 3413423 - DNA, 16 bp, Homo sapiens
atactggcatgctaaa

SEQ ID NO: 3413424 - DNA, 21 bp, Homo sapiens
atactgttgatccatctcagt

SEQ ID NO: 3413425 - DNA, 23 bp, Homo sapiens
atacttgcagctcccattctatg

SEQ ID NO: 3413426 - DNA, 21 bp, Homo sapiens
atacttttaatcaagtagaac

SEQ ID NO: 3413427 - DNA, 22 bp, Homo sapiens
atacttttgagtatggctatct

SEQ ID NO: 3413428 - DNA, 17 bp, Homo sapiens
atagaaaatcttagtat

SEQ ID NO: 3413429 - DNA, 13 bp, Homo sapiens
atagaaagaaagt

SEQ ID NO: 3413430 - DNA, 15 bp, Homo sapiens
atagaacagaaatat

SEQ ID NO: 3413431 - DNA, 16 bp, Homo sapiens
atagagatatttaaaa

SEQ ID NO: 3413432 - DNA, 13 bp, Homo sapiens
atagatgtgtgga

SEQ ID NO: 3413433 - DNA, 14 bp, Homo sapiens
atagatgtgtggac

SEQ ID NO: 3413434 - DNA, 21 bp, Homo sapiens
atagattgcaaatattggtta

SEQ ID NO: 3413435 - DNA, 19 bp, Homo sapiens
atagatttgaaaaactttt

SEQ ID NO: 3413436 - DNA, 16 bp, Homo sapiens
atagctaataataaat

SEQ ID NO: 3413437 - DNA, 23 bp, Homo sapiens
atagctaataataaatgcataga

SEQ ID NO: 3413438 - DNA, 19 bp, Homo sapiens
atagctctacacaacatgt

SEQ ID NO: 3413439 - DNA, 20 bp, Homo sapiens
atagctctacacaacatgta

SEQ ID NO: 3413440 - DNA, 17 bp, Homo sapiens
atagctggcaagaatgg

SEQ ID NO: 3413441 - DNA, 20 bp, Homo sapiens
atagcttcaggatactgtag

SEQ ID NO: 3413442 - DNA, 19 bp, Homo sapiens
ataggtaggtatctttata

SEQ ID NO: 3413443 - DNA, 23 bp, Homo sapiens
atagtagaaagacatctgcctgt

SEQ ID NO: 3413444 - DNA, 20 bp, Homo sapiens
atagtcaaagagagttttta

SEQ ID NO: 3413445 - DNA, 15 bp, Homo sapiens
atagtgcttcttgta

SEQ ID NO: 3413446 - DNA, 17 bp, Homo sapiens
atagtgcttcttgtaat

SEQ ID NO: 3413447 - DNA, 15 bp, Homo sapiens
atagttgcttttgaa

SEQ ID NO: 3413448 - DNA, 15 bp, Homo sapiens
atagttgtagactat

SEQ ID NO: 3413449 - DNA, 14 bp, Homo sapiens
atagttgtattttg

SEQ ID NO: 3413450 - DNA, 23 bp, Homo sapiens
atagttgtctttctttgctgctg

SEQ ID NO: 3413451 - DNA, 13 bp, Homo sapiens
atataactgtgat

SEQ ID NO: 3413452 - DNA, 21 bp, Homo sapiens
atataaggacagaccaaaaat

SEQ ID NO: 3413453 - DNA, 22 bp, Homo sapiens
atataaggtcatagattcttga

SEQ ID NO: 3413454 - DNA, 23 bp, Homo sapiens
atataagtcttggtaacaaataa

SEQ ID NO: 3413455 - DNA, 18 bp, Homo sapiens
atatacaagctacagttg

SEQ ID NO: 3413456 - DNA, 14 bp, Homo sapiens
atatagaaaatctt

SEQ ID NO: 3413457 - DNA, 19 bp, Homo sapiens
atatagctggcaagaatgg

SEQ ID NO: 3413458 - DNA, 17 bp, Homo sapiens
atatagttgtctttctt

SEQ ID NO: 3413459 - DNA, 20 bp, Homo sapiens
atatatagctggcaagaatg

SEQ ID NO: 3413460 - DNA, 16 bp, Homo sapiens
atatatgctgtatttc

SEQ ID NO: 3413461 - DNA, 17 bp, Homo sapiens
atatatggcatttgcag

SEQ ID NO: 3413462 - DNA, 15 bp, Homo sapiens
atatctctagtccct

SEQ ID NO: 3413463 - DNA, 13 bp, Homo sapiens
atatcttgttatt

SEQ ID NO: 3413464 - DNA, 15 bp, Homo sapiens
atatcttgttattaa

SEQ ID NO: 3413465 - DNA, 20 bp, Homo sapiens
atatgaaactcatctgtaaa

SEQ ID NO: 3413466 - DNA, 13 bp, Homo sapiens
atatgaaatattt

SEQ ID NO: 3413467 - DNA, 16 bp, Homo sapiens
atatgacggaagaaca

SEQ ID NO: 3413468 - DNA, 20 bp, Homo sapiens
atatgacggaagaacataga

SEQ ID NO: 3413469 - DNA, 14 bp, Homo sapiens
atatgagaatgtat

SEQ ID NO: 3413470 - DNA, 14 bp, Homo sapiens
atatgctgtatttc

SEQ ID NO: 3413471 - DNA, 20 bp, Homo sapiens
atatgctgtatttctttgta

SEQ ID NO: 3413472 - DNA, 16 bp, Homo sapiens
atatggcatttgcaga

SEQ ID NO: 3413473 - DNA, 20 bp, Homo sapiens
atatggggatgcagcattat

SEQ ID NO: 3413474 - DNA, 22 bp, Homo sapiens
atatggtactaaggagaattaa

SEQ ID NO: 3413475 - DNA, 14 bp, Homo sapiens
atatgtcaaattgt

SEQ ID NO: 3413476 - DNA, 15 bp, Homo sapiens
atatgtcaaattgtc

SEQ ID NO: 3413477 - DNA, 14 bp, Homo sapiens
atattaaaggcttt

SEQ ID NO: 3413478 - DNA, 21 bp, Homo sapiens
atattacctaatgaaagtgat

SEQ ID NO: 3413479 - DNA, 13 bp, Homo sapiens
atattagttgctt

SEQ ID NO: 3413480 - DNA, 18 bp, Homo sapiens
atattagttgctttgtta

SEQ ID NO: 3413481 - DNA, 21 bp, Homo sapiens
atattcatcaaataaaccttg

SEQ ID NO: 3413482 - DNA, 17 bp, Homo sapiens
atattctcattatttca

SEQ ID NO: 3413483 - DNA, 14 bp, Homo sapiens
atattctctgatgt

SEQ ID NO: 3413484 - DNA, 15 bp, Homo sapiens
atattctctgatgtt

SEQ ID NO: 3413485 - DNA, 17 bp, Homo sapiens
atattctgataatgtat

SEQ ID NO: 3413486 - DNA, 17 bp, Homo sapiens
atattgaccatgtgatt

SEQ ID NO: 3413487 - DNA, 22 bp, Homo sapiens
atatttaaaaaattaaaaatga

SEQ ID NO: 3413488 - DNA, 20 bp, Homo sapiens
atatttatgtagatgtgcat

SEQ ID NO: 3413489 - DNA, 23 bp, Homo sapiens
atatttccttcaccacctcatgt

SEQ ID NO: 3413490 - DNA, 20 bp, Homo sapiens
atatttgtaaatttatgtga

SEQ ID NO: 3413491 - DNA, 18 bp, Homo sapiens
atcaaagcttcaaaaact

SEQ ID NO: 3413492 - DNA, 19 bp, Homo sapiens
atcaatttgtaattttagt

SEQ ID NO: 3413493 - DNA, 15 bp, Homo sapiens
atcacaaaagctgtg

SEQ ID NO: 3413494 - DNA, 16 bp, Homo sapiens
atcactctgtgtctga

SEQ ID NO: 3413495 - DNA, 21 bp, Homo sapiens
atcagatgctgaattgagaat

SEQ ID NO: 3413496 - DNA, 14 bp, Homo sapiens
atcagcctgtgcca

SEQ ID NO: 3413497 - DNA, 13 bp, Homo sapiens
atcaggccattgt

SEQ ID NO: 3413498 - DNA, 12 bp, Homo sapiens
atcagtgttgat

SEQ ID NO: 3413499 - DNA, 18 bp, Homo sapiens
atcagtgttgattctaga

SEQ ID NO: 3413500 - DNA, 18 bp, Homo sapiens
atcagtttattaaatctg

SEQ ID NO: 3413501 - DNA, 20 bp, Homo sapiens
atcatagaacagaaatatat

SEQ ID NO: 3413502 - DNA, 14 bp, Homo sapiens
atcatggtgtaata

SEQ ID NO: 3413503 - DNA, 20 bp, Homo sapiens
atcatggtgtaataagacat

SEQ ID NO: 3413504 - DNA, 23 bp, Homo sapiens
atcatgtttacagaggacagtat

SEQ ID NO: 3413505 - DNA, 15 bp, Homo sapiens
atcattctcagtatc

SEQ ID NO: 3413506 - DNA, 18 bp, Homo sapiens
atccaaatgctgtgcaaa

SEQ ID NO: 3413507 - DNA, 19 bp, Homo sapiens
atccaaatgctgtgcaaac

SEQ ID NO: 3413508 - DNA, 18 bp, Homo sapiens
atccagctagtgccaaat

SEQ ID NO: 3413509 - DNA, 16 bp, Homo sapiens
atccagtagggaaaat

SEQ ID NO: 3413510 - DNA, 20 bp, Homo sapiens
atccatctcagtcacttttt

SEQ ID NO: 3413511 - DNA, 22 bp, Homo sapiens
atccatctcagtcactttttcc

SEQ ID NO: 3413512 - DNA, 14 bp, Homo sapiens
atccatgcttcact

SEQ ID NO: 3413513 - DNA, 19 bp, Homo sapiens
atccattgccatcagtgat

SEQ ID NO: 3413514 - DNA, 21 bp, Homo sapiens
atccatttcatctatttctga

SEQ ID NO: 3413515 - DNA, 21 bp, Homo sapiens
atcccggtgcatgcaggtctc

SEQ ID NO: 3413516 - DNA, 12 bp, Homo sapiens
atcctgagccat

SEQ ID NO: 3413517 - DNA, 24 bp, Homo sapiens
atcctgagccatcggtgaaactaa

SEQ ID NO: 3413518 - DNA, 18 bp, Homo sapiens
atcgaaataacaatgtta

SEQ ID NO: 3413519 - DNA, 17 bp, Homo sapiens
atcgatatgaaaaataa

SEQ ID NO: 3413520 - DNA, 22 bp, Homo sapiens
atcgccttatgagaacatggtg

SEQ ID NO: 3413521 - DNA, 14 bp, Homo sapiens
cggagcaagaggag

SEQ ID NO: 3413522 - DNA, 17 bp, Homo sapiens
cggcccaatccaaggtg

SEQ ID NO: 3413523 - DNA, 23 bp, Homo sapiens
cgggaccccgagcctggctccaa

SEQ ID NO: 3413524 - DNA, 15 bp, Homo sapiens
cgggagcctccctgc

SEQ ID NO: 3413525 - DNA, 15 bp, Homo sapiens
cgggttaagaaatac

SEQ ID NO: 3413526 - DNA, 16 bp, Homo sapiens
cgggttaagaaatacc

SEQ ID NO: 3413527 - DNA, 16 bp, Homo sapiens
cgtaaggctgtacata

SEQ ID NO: 3413528 - DNA, 15 bp, Homo sapiens
cgtaccgcttcctta

SEQ ID NO: 3413529 - DNA, 22 bp, Homo sapiens
cgtataatttagtcccttaaaa

SEQ ID NO: 3413530 - DNA, 22 bp, Homo sapiens
cgtatttagactgtggccatat

SEQ ID NO: 3413531 - DNA, 15 bp, Homo sapiens
cgtcccaggctgccg

SEQ ID NO: 3413532 - DNA, 20 bp, Homo sapiens
cgtcccaggctgccggctcc

SEQ ID NO: 3413533 - DNA, 13 bp, Homo sapiens
cgtcttgtgaaat

SEQ ID NO: 3413534 - DNA, 13 bp, Homo sapiens
cgtgattctgttc

SEQ ID NO: 3413535 - DNA, 16 bp, Homo sapiens
cgtgtaatattctctg

SEQ ID NO: 3413536 - DNA, 22 bp, Homo sapiens
cgtgtgtagagttaagaagctg

SEQ ID NO: 3413537 - DNA, 20 bp, Homo sapiens
cgttcttacaagcttaaagc

SEQ ID NO: 3413538 - DNA, 13 bp, Homo sapiens
cgttttcttaaat

SEQ ID NO: 3413539 - DNA, 14 bp, Homo sapiens
cgttttgtattgct

SEQ ID NO: 3413540 - DNA, 18 bp, Homo sapiens
ctaaacagatgtccctga

SEQ ID NO: 3413541 - DNA, 23 bp, Homo sapiens
ctaaactagctcttggggaaata

SEQ ID NO: 3413542 - DNA, 19 bp, Homo sapiens
ctaaagggagaaatgccag

SEQ ID NO: 3413543 - DNA, 21 bp, Homo sapiens
ctaaatgcatatcctgagcca

SEQ ID NO: 3413544 - DNA, 22 bp, Homo sapiens
ctaaatgcatatcctgagccat

SEQ ID NO: 3413545 - DNA, 15 bp, Homo sapiens
ctaaatgctcataca

SEQ ID NO: 3413546 - DNA, 16 bp, Homo sapiens
ctaacacagcatgtgt

SEQ ID NO: 3413547 - DNA, 16 bp, Homo sapiens
ctaactgactctgtta

SEQ ID NO: 3413548 - DNA, 22 bp, Homo sapiens
ctaagaatagactaagtttgtg

SEQ ID NO: 3413549 - DNA, 23 bp, Homo sapiens
ctaataataaatgcatagagcaa

SEQ ID NO: 3413550 - DNA, 23 bp, Homo sapiens
ctaatatactttttttgttatag

SEQ ID NO: 3413551 - DNA, 19 bp, Homo sapiens
ctaatctccacccaatgaa

SEQ ID NO: 3413552 - DNA, 13 bp, Homo sapiens
ctaatgaaagtga

SEQ ID NO: 3413553 - DNA, 18 bp, Homo sapiens
ctaatgaaagtgatgaca

SEQ ID NO: 3413554 - DNA, 17 bp, Homo sapiens
ctaatgtttatgagcca

SEQ ID NO: 3413555 - DNA, 20 bp, Homo sapiens
ctaatgtttatgagccagac

SEQ ID NO: 3413556 - DNA, 15 bp, Homo sapiens
ctaattgaaatttaa

SEQ ID NO: 3413557 - DNA, 22 bp, Homo sapiens
ctacacaacatgtatgtggata

SEQ ID NO: 3413558 - DNA, 14 bp, Homo sapiens
ctacactgggtgct

SEQ ID NO: 3413559 - DNA, 13 bp, Homo sapiens
ctacaggggccag

SEQ ID NO: 3413560 - DNA, 14 bp, Homo sapiens
ctacaggggccaga

SEQ ID NO: 3413561 - DNA, 12 bp, Homo sapiens
ctacattaaaca

SEQ ID NO: 3413562 - DNA, 20 bp, Homo sapiens
ctacccgacataagtcgagg

SEQ ID NO: 3413563 - DNA, 19 bp, Homo sapiens
ctacctttttatatttaaa

SEQ ID NO: 3413564 - DNA, 16 bp, Homo sapiens
ctactgaatttattgc

SEQ ID NO: 3413565 - DNA, 11 bp, Homo sapiens
ctactgtgtaa

SEQ ID NO: 3413566 - DNA, 19 bp, Homo sapiens
ctacttgatatttccttca

SEQ ID NO: 3413567 - DNA, 17 bp, Homo sapiens
ctagaggctgcctgggc

SEQ ID NO: 3413568 - DNA, 14 bp, Homo sapiens
ctagagtcatgtga

SEQ ID NO: 3413569 - DNA, 20 bp, Homo sapiens
ctagagtcatgtgagcctcg

SEQ ID NO: 3413570 - DNA, 14 bp, Homo sapiens
ctagatatgaatat

SEQ ID NO: 3413571 - DNA, 16 bp, Homo sapiens
ctagcatttatttctc

SEQ ID NO: 3413572 - DNA, 19 bp, Homo sapiens
ctagcatttatttctctgg

SEQ ID NO: 3413573 - DNA, 21 bp, Homo sapiens
ctagccagtcactaggaattt

SEQ ID NO: 3413574 - DNA, 21 bp, Homo sapiens
ctagctatttctatgtatgtg

SEQ ID NO: 3413575 - DNA, 15 bp, Homo sapiens
ctaggatactgctgc

SEQ ID NO: 3413576 - DNA, 14 bp, Homo sapiens
ctaggccaggtgca

SEQ ID NO: 3413577 - DNA, 20 bp, Homo sapiens
ctaggccaggtgcaaccagg

SEQ ID NO: 3413578 - DNA, 19 bp, Homo sapiens
ctagtgccaaataattgat

SEQ ID NO: 3413579 - DNA, 15 bp, Homo sapiens
ctagtggtctttgta

SEQ ID NO: 3413580 - DNA, 17 bp, Homo sapiens
ctagtggtctttgtaag

SEQ ID NO: 3413581 - DNA, 17 bp, Homo sapiens
ctataaacaattacatg

SEQ ID NO: 3413582 - DNA, 14 bp, Homo sapiens
ctatacctgccttt

SEQ ID NO: 3413583 - DNA, 19 bp, Homo sapiens
ctatctagcatttatttct

SEQ ID NO: 3413584 - DNA, 17 bp, Homo sapiens
ctatggagactttgctg

SEQ ID NO: 3413585 - DNA, 18 bp, Homo sapiens
ctatggagactttgctgt

SEQ ID NO: 3413586 - DNA, 23 bp, Homo sapiens
ctatggagactttgctgttactg

SEQ ID NO: 3413587 - DNA, 19 bp, Homo sapiens
ctatggggatagatgtgtg

SEQ ID NO: 3413588 - DNA, 21 bp, Homo sapiens
ctatggggatagatgtgtgga

SEQ ID NO: 3413589 - DNA, 16 bp, Homo sapiens
ctattagccaggatca

SEQ ID NO: 3413590 - DNA, 17 bp, Homo sapiens
ctccagacctgcccctc

SEQ ID NO: 3413591 - DNA, 14 bp, Homo sapiens
ctccagcctcagct

SEQ ID NO: 3413592 - DNA, 13 bp, Homo sapiens
ctccagggctgga

SEQ ID NO: 3413593 - DNA, 19 bp, Homo sapiens
ctccagggctggactgagg

SEQ ID NO: 3413594 - DNA, 20 bp, Homo sapiens
ctccatggccctgccatgct

SEQ ID NO: 3413595 - DNA, 15 bp, Homo sapiens
ctccattttcttgtc

SEQ ID NO: 3413596 - DNA, 16 bp, Homo sapiens
ctccattttcttgtca

SEQ ID NO: 3413597 - DNA, 15 bp, Homo sapiens
ctcccacctccgctg

SEQ ID NO: 3413598 - DNA, 20 bp, Homo sapiens
ctcccactttgctgttcctt

SEQ ID NO: 3413599 - DNA, 20 bp, Homo sapiens
ctccccaactgaccaccttt

SEQ ID NO: 3413600 - DNA, 14 bp, Homo sapiens
ctccccaatccctg

SEQ ID NO: 3413601 - DNA, 16 bp, Homo sapiens
ctccccaatccctgac

SEQ ID NO: 3413602 - DNA, 19 bp, Homo sapiens
ctcccccaccgcccactct

SEQ ID NO: 3413603 - DNA, 21 bp, Homo sapiens
ctccccgcagtcgtcccaggc

SEQ ID NO: 3413604 - DNA, 17 bp, Homo sapiens
ctcccctcgacagctct

SEQ ID NO: 3413605 - DNA, 20 bp, Homo sapiens
ctcccctcgtgtcagctcag

SEQ ID NO: 3413606 - DNA, 13 bp, Homo sapiens
ctcccctgccccc

SEQ ID NO: 3413607 - DNA, 14 bp, Homo sapiens
ctcccctgccccca

SEQ ID NO: 3413608 - DNA, 15 bp, Homo sapiens
ctcccctgcccccag

SEQ ID NO: 3413609 - DNA, 17 bp, Homo sapiens
ctcccctgcccccagga

SEQ ID NO: 3413610 - DNA, 19 bp, Homo sapiens
ctcccctgcccccaggact

SEQ ID NO: 3413611 - DNA, 22 bp, Homo sapiens
ctcccctgcccccaggactggg

SEQ ID NO: 3413612 - DNA, 17 bp, Homo sapiens
ctcccctgccccctgca

SEQ ID NO: 3413613 - DNA, 18 bp, Homo sapiens
ctcccctgccccctgcag

SEQ ID NO: 3413614 - DNA, 20 bp, Homo sapiens
ctcccctgccccctgcagga

SEQ ID NO: 3413615 - DNA, 19 bp, Homo sapiens
ctccctctagaggctgcct

SEQ ID NO: 3413616 - DNA, 22 bp, Homo sapiens
ctccctctagaggctgcctggg

SEQ ID NO: 3413617 - DNA, 10 bp, Homo sapiens
ctccctggag

SEQ ID NO: 3413618 - DNA, 12 bp, Homo sapiens
ctccctggagcc

SEQ ID NO: 3413619 - DNA, 13 bp, Homo sapiens
ctccctggagccc

SEQ ID NO: 3413620 - DNA, 14 bp, Homo sapiens
ctccctggagccct

SEQ ID NO: 3413621 - DNA, 15 bp, Homo sapiens
ctccctggagccctg

SEQ ID NO: 3413622 - DNA, 16 bp, Homo sapiens
ctccctggagccctgt

SEQ ID NO: 3413623 - DNA, 21 bp, Homo sapiens
ctcccttgagaattccctgtg

SEQ ID NO: 3413624 - DNA, 12 bp, Homo sapiens
ctccctttctcc

SEQ ID NO: 3413625 - DNA, 19 bp, Homo sapiens
ctcctacaaccaggtcttg

SEQ ID NO: 3413626 - DNA, 13 bp, Homo sapiens
ctcctcagctccc

SEQ ID NO: 3413627 - DNA, 13 bp, Homo sapiens
ctcctccagggac

SEQ ID NO: 3413628 - DNA, 24 bp, Homo sapiens
ctcctctccccaatccatgcttca

SEQ ID NO: 3413629 - DNA, 19 bp, Homo sapiens
ctcctcttaaaaaataaaa

SEQ ID NO: 3413630 - DNA, 20 bp, Homo sapiens
ctcctgagctaggaagagtc

SEQ ID NO: 3413631 - DNA, 14 bp, Homo sapiens
ctcctgcatgtgta

SEQ ID NO: 3413632 - DNA, 10 bp, Homo sapiens
ctcctgtcct

SEQ ID NO: 3413633 - DNA, 11 bp, Homo sapiens
ctcctgtcctt

SEQ ID NO: 3413634 - DNA, 20 bp, Homo sapiens
ctccttcctggagcccagag

SEQ ID NO: 3413635 - DNA, 13 bp, Homo sapiens
ctccttggaaatc

SEQ ID NO: 3413636 - DNA, 13 bp, Homo sapiens
ctccttgtggcct

SEQ ID NO: 3413637 - DNA, 15 bp, Homo sapiens
ctccttgtggcctat

SEQ ID NO: 3413638 - DNA, 13 bp, Homo sapiens
ctcgacagctctc

SEQ ID NO: 3413639 - DNA, 13 bp, Homo sapiens
ctcgactcccccc

SEQ ID NO: 3413640 - DNA, 13 bp, Homo sapiens
ctcgcaggaagac

SEQ ID NO: 3413641 - DNA, 15 bp, Homo sapiens
ctcgtgtcagctcag

SEQ ID NO: 3413642 - DNA, 22 bp, Homo sapiens
ctcgtgtcagctcaggcagctc

SEQ ID NO: 3413643 - DNA, 16 bp, Homo sapiens
ctcgtgtcatctccgg

SEQ ID NO: 3413644 - DNA, 21 bp, Homo sapiens
ctctaagaagctcgtttctta

SEQ ID NO: 3413645 - DNA, 15 bp, Homo sapiens
ctctaatatcagcaa

SEQ ID NO: 3413646 - DNA, 17 bp, Homo sapiens
ctctacacaacatgtat

SEQ ID NO: 3413647 - DNA, 23 bp, Homo sapiens
ctctagaaagtatagatggccaa

SEQ ID NO: 3413648 - DNA, 22 bp, Homo sapiens
ctctatctaatagagaactttt

SEQ ID NO: 3413649 - DNA, 19 bp, Homo sapiens
ctctccccaatccatgctt

SEQ ID NO: 3413650 - DNA, 13 bp, Homo sapiens
ctctctaacataa

SEQ ID NO: 3413651 - DNA, 19 bp, Homo sapiens
ctctgaaatgcactagacc

SEQ ID NO: 3413652 - DNA, 15 bp, Homo sapiens
ctctgagctgtcaac

SEQ ID NO: 3413653 - DNA, 14 bp, Homo sapiens
ctctgatgtttggg

SEQ ID NO: 3413654 - DNA, 13 bp, Homo sapiens
ctctgcaactgaa

SEQ ID NO: 3413655 - DNA, 13 bp, Homo sapiens
ctctgcagcctca

SEQ ID NO: 3413656 - DNA, 15 bp, Homo sapiens
ctctgcagcctcaga

SEQ ID NO: 3413657 - DNA, 19 bp, Homo sapiens
ctctgcagcctcagagaca

SEQ ID NO: 3413658 - DNA, 13 bp, Homo sapiens
ctctgccccaccc

SEQ ID NO: 3413659 - DNA, 14 bp, Homo sapiens
ctctgtcagtgtga

SEQ ID NO: 3413660 - DNA, 19 bp, Homo sapiens
ctctgtcagtgtgaaaatt

SEQ ID NO: 3413661 - DNA, 15 bp, Homo sapiens
ctctgtccccttctc

SEQ ID NO: 3413662 - DNA, 13 bp, Homo sapiens
ctctgtgagactc

SEQ ID NO: 3413663 - DNA, 14 bp, Homo sapiens
catgttctgtccct

SEQ ID NO: 3413664 - DNA, 16 bp, Homo sapiens
catgttggttgcactt

SEQ ID NO: 3413665 - DNA, 21 bp, Homo sapiens
catgttgtgcctccctggtga

SEQ ID NO: 3413666 - DNA, 16 bp, Homo sapiens
cattaataatagctaa

SEQ ID NO: 3413667 - DNA, 22 bp, Homo sapiens
cattaataatagctaataataa

SEQ ID NO: 3413668 - DNA, 19 bp, Homo sapiens
cattaattgttccttgctt

SEQ ID NO: 3413669 - DNA, 21 bp, Homo sapiens
cattacctcagtgagaagcca

SEQ ID NO: 3413670 - DNA, 22 bp, Homo sapiens
cattacctcagtgagaagccag

SEQ ID NO: 3413671 - DNA, 20 bp, Homo sapiens
cattaccttactgtggagga

SEQ ID NO: 3413672 - DNA, 19 bp, Homo sapiens
cattagtgttctttatata

SEQ ID NO: 3413673 - DNA, 22 bp, Homo sapiens
cattatgatgtgggtcaaggaa

SEQ ID NO: 3413674 - DNA, 17 bp, Homo sapiens
cattatttgataacatt

SEQ ID NO: 3413675 - DNA, 21 bp, Homo sapiens
cattcacaaagtataacaatt

SEQ ID NO: 3413676 - DNA, 24 bp, Homo sapiens
cattcacaaagtataacaattaaa

SEQ ID NO: 3413677 - DNA, 15 bp, Homo sapiens
cattcacatttcaag

SEQ ID NO: 3413678 - DNA, 14 bp, Homo sapiens
cattcataatttta

SEQ ID NO: 3413679 - DNA, 14 bp, Homo sapiens
cattccaagacagt

SEQ ID NO: 3413680 - DNA, 13 bp, Homo sapiens
cattccagaggaa

SEQ ID NO: 3413681 - DNA, 14 bp, Homo sapiens
cattccagaggaag

SEQ ID NO: 3413682 - DNA, 14 bp, Homo sapiens
cattcctaaaatgc

SEQ ID NO: 3413683 - DNA, 23 bp, Homo sapiens
cattcctaacacagcatgtgtat

SEQ ID NO: 3413684 - DNA, 12 bp, Homo sapiens
cattccttccca

SEQ ID NO: 3413685 - DNA, 18 bp, Homo sapiens
cattccttctttgataat

SEQ ID NO: 3413686 - DNA, 23 bp, Homo sapiens
cattccttctttgataatgttaa

SEQ ID NO: 3413687 - DNA, 19 bp, Homo sapiens
cattcttggttgttaattt

SEQ ID NO: 3413688 - DNA, 20 bp, Homo sapiens
cattctttcttggtgcattc

SEQ ID NO: 3413689 - DNA, 17 bp, Homo sapiens
cattgattgtcagctac

SEQ ID NO: 3413690 - DNA, 14 bp, Homo sapiens
cattggaactggag

SEQ ID NO: 3413691 - DNA, 19 bp, Homo sapiens
cattggaactggaggcagg

SEQ ID NO: 3413692 - DNA, 17 bp, Homo sapiens
cattggttaaaatatta

SEQ ID NO: 3413693 - DNA, 20 bp, Homo sapiens
cattgtaacctcgtgtctag

SEQ ID NO: 3413694 - DNA, 12 bp, Homo sapiens
cattgtgattta

SEQ ID NO: 3413695 - DNA, 16 bp, Homo sapiens
catttaaatatctgaa

SEQ ID NO: 3413696 - DNA, 18 bp, Homo sapiens
catttaggagaagttggt

SEQ ID NO: 3413697 - DNA, 17 bp, Homo sapiens
catttatgatttaataa

SEQ ID NO: 3413698 - DNA, 18 bp, Homo sapiens
catttcaagatccaaatg

SEQ ID NO: 3413699 - DNA, 20 bp, Homo sapiens
catttcacccctccctttct

SEQ ID NO: 3413700 - DNA, 21 bp, Homo sapiens
catttcacccctccctttctc

SEQ ID NO: 3413701 - DNA, 23 bp, Homo sapiens
catttcacccctccctttctccc

SEQ ID NO: 3413702 - DNA, 14 bp, Homo sapiens
catttcatctattt

SEQ ID NO: 3413703 - DNA, 17 bp, Homo sapiens
catttcatctatttctg

SEQ ID NO: 3413704 - DNA, 18 bp, Homo sapiens
catttcatctatttctga

SEQ ID NO: 3413705 - DNA, 18 bp, Homo sapiens
catttcattcctaacaca

SEQ ID NO: 3413706 - DNA, 20 bp, Homo sapiens
catttctatgccatttttag

SEQ ID NO: 3413707 - DNA, 11 bp, Homo sapiens
catttgaaaga

SEQ ID NO: 3413708 - DNA, 21 bp, Homo sapiens
catttgaaagtgggtttcaat

SEQ ID NO: 3413709 - DNA, 23 bp, Homo sapiens
catttgaaagtgggtttcaattt

SEQ ID NO: 3413710 - DNA, 15 bp, Homo sapiens
catttggcttgctgt

SEQ ID NO: 3413711 - DNA, 16 bp, Homo sapiens
catttggcttgctgtt

SEQ ID NO: 3413712 - DNA, 20 bp, Homo sapiens
catttggtcaagattttgaa

SEQ ID NO: 3413713 - DNA, 16 bp, Homo sapiens
catttggttaaatcat

SEQ ID NO: 3413714 - DNA, 22 bp, Homo sapiens
cattttcagcatcaaacatgaa

SEQ ID NO: 3413715 - DNA, 19 bp, Homo sapiens
cattttggatttctttata

SEQ ID NO: 3413716 - DNA, 13 bp, Homo sapiens
cattttgtgaatg

SEQ ID NO: 3413717 - DNA, 14 bp, Homo sapiens
cattttgtgaatgg

SEQ ID NO: 3413718 - DNA, 20 bp, Homo sapiens
cattttgtggcaaaatattc

SEQ ID NO: 3413719 - DNA, 15 bp, Homo sapiens
catttttaaaggaca

SEQ ID NO: 3413720 - DNA, 19 bp, Homo sapiens
catttttgctaattatcaa

SEQ ID NO: 3413721 - DNA, 17 bp, Homo sapiens
ccaaataatgtctctgt

SEQ ID NO: 3413722 - DNA, 14 bp, Homo sapiens
ccaaccccccagca

SEQ ID NO: 3413723 - DNA, 15 bp, Homo sapiens
ccaaccccccagcac

SEQ ID NO: 3413724 - DNA, 14 bp, Homo sapiens
ccaagctccctgga

SEQ ID NO: 3413725 - DNA, 20 bp, Homo sapiens
ccaagctccctggagccctg

SEQ ID NO: 3413726 - DNA, 21 bp, Homo sapiens
ccaagtatgaagtataaatct

SEQ ID NO: 3413727 - DNA, 16 bp, Homo sapiens
ccaatccatgcttcac

SEQ ID NO: 3413728 - DNA, 18 bp, Homo sapiens
ccaatgccccactggcag

SEQ ID NO: 3413729 - DNA, 18 bp, Homo sapiens
ccaattcttacaaacatg

SEQ ID NO: 3413730 - DNA, 15 bp, Homo sapiens
ccacacaaaatgtca

SEQ ID NO: 3413731 - DNA, 13 bp, Homo sapiens
ccacacctgcggc

SEQ ID NO: 3413732 - DNA, 13 bp, Homo sapiens
ccacagaccccca

SEQ ID NO: 3413733 - DNA, 11 bp, Homo sapiens
ccacaggcctg

SEQ ID NO: 3413734 - DNA, 14 bp, Homo sapiens
ccacaggcctgaga

SEQ ID NO: 3413735 - DNA, 16 bp, Homo sapiens
ccacaggctagatccc

SEQ ID NO: 3413736 - DNA, 23 bp, Homo sapiens
ccacattagtgttctttatatac

SEQ ID NO: 3413737 - DNA, 23 bp, Homo sapiens
ccaccgcccactctccacctcac

SEQ ID NO: 3413738 - DNA, 17 bp, Homo sapiens
ccacctcactagctccc

SEQ ID NO: 3413739 - DNA, 17 bp, Homo sapiens
ccacctctctggcttcc

SEQ ID NO: 3413740 - DNA, 11 bp, Homo sapiens
ccacctggacc

SEQ ID NO: 3413741 - DNA, 17 bp, Homo sapiens
ccacctggacccctgca

SEQ ID NO: 3413742 - DNA, 20 bp, Homo sapiens
ccacctggacccctgcattg

SEQ ID NO: 3413743 - DNA, 18 bp, Homo sapiens
ccacctgtgagaaaggaa

SEQ ID NO: 3413744 - DNA, 21 bp, Homo sapiens
ccacctgtgagaaaggaaaaa

SEQ ID NO: 3413745 - DNA, 13 bp, Homo sapiens
ccaccttgttaca

SEQ ID NO: 3413746 - DNA, 14 bp, Homo sapiens
ccactctccacctc

SEQ ID NO: 3413747 - DNA, 20 bp, Homo sapiens
ccactctcccccaccccctc

SEQ ID NO: 3413748 - DNA, 13 bp, Homo sapiens
ccactttctttct

SEQ ID NO: 3413749 - DNA, 13 bp, Homo sapiens
ccactttttgcag

SEQ ID NO: 3413750 - DNA, 16 bp, Homo sapiens
ccactttttgcagctt

SEQ ID NO: 3413751 - DNA, 19 bp, Homo sapiens
ccagaaaaaagtgtttata

SEQ ID NO: 3413752 - DNA, 20 bp, Homo sapiens
ccagaaaaaagtgtttataa

SEQ ID NO: 3413753 - DNA, 15 bp, Homo sapiens
ccagaaagaaaatga

SEQ ID NO: 3413754 - DNA, 16 bp, Homo sapiens
ccagaagaccccactt

SEQ ID NO: 3413755 - DNA, 20 bp, Homo sapiens
ccagaagatgaacagactga

SEQ ID NO: 3413756 - DNA, 14 bp, Homo sapiens
ccagacctgcagac

SEQ ID NO: 3413757 - DNA, 16 bp, Homo sapiens
ccagacctgcagacgc

SEQ ID NO: 3413758 - DNA, 16 bp, Homo sapiens
ccagagcagatgcaga

SEQ ID NO: 3413759 - DNA, 20 bp, Homo sapiens
ccagaggggcctgccacctg

SEQ ID NO: 3413760 - DNA, 18 bp, Homo sapiens
ccagaggtaacagaacag

SEQ ID NO: 3413761 - DNA, 22 bp, Homo sapiens
ccagaggtaacagaacagcttc

SEQ ID NO: 3413762 - DNA, 16 bp, Homo sapiens
ccagattggctcacac

SEQ ID NO: 3413763 - DNA, 20 bp, Homo sapiens
ccagattggctcacactgag

SEQ ID NO: 3413764 - DNA, 12 bp, Homo sapiens
ccagcactgagg

SEQ ID NO: 3413765 - DNA, 22 bp, Homo sapiens
ccagcactgaggaagaacgggg

SEQ ID NO: 3413766 - DNA, 14 bp, Homo sapiens
ccagcctcagctct

SEQ ID NO: 3413767 - DNA, 12 bp, Homo sapiens
ccagcctggccc

SEQ ID NO: 3413768 - DNA, 13 bp, Homo sapiens
ccagcctggccca

SEQ ID NO: 3413769 - DNA, 21 bp, Homo sapiens
ccagccttatgtgttacatta

SEQ ID NO: 3413770 - DNA, 17 bp, Homo sapiens
ccagcggacagtggcag

SEQ ID NO: 3413771 - DNA, 19 bp, Homo sapiens
ccagcggacagtggcagga

SEQ ID NO: 3413772 - DNA, 16 bp, Homo sapiens
ccagctgcccttccgc

SEQ ID NO: 3413773 - DNA, 14 bp, Homo sapiens
ccaggactctgcag

SEQ ID NO: 3413774 - DNA, 15 bp, Homo sapiens
ccaggactctgcagc

SEQ ID NO: 3413775 - DNA, 20 bp, Homo sapiens
ccaggactctgcagcctcag

SEQ ID NO: 3413776 - DNA, 17 bp, Homo sapiens
ccctgtcccacctggct

SEQ ID NO: 3413777 - DNA, 24 bp, Homo sapiens
ccctgtgccttggtgtgctgtatc

SEQ ID NO: 3413778 - DNA, 13 bp, Homo sapiens
ccctgtggatttt

SEQ ID NO: 3413779 - DNA, 22 bp, Homo sapiens
cccttaaaaattaaattctctc

SEQ ID NO: 3413780 - DNA, 12 bp, Homo sapiens
cccttgtatagt

SEQ ID NO: 3413781 - DNA, 14 bp, Homo sapiens
ccctttctcccctg

SEQ ID NO: 3413782 - DNA, 22 bp, Homo sapiens
ccctttctcccctgcccccagg

SEQ ID NO: 3413783 - DNA, 13 bp, Homo sapiens
ccgcagagctggc

SEQ ID NO: 3413784 - DNA, 15 bp, Homo sapiens
ccgcagagctggccg

SEQ ID NO: 3413785 - DNA, 21 bp, Homo sapiens
ccgcagtcgtcccaggctgcc

SEQ ID NO: 3413786 - DNA, 22 bp, Homo sapiens
ccgcgccaaataatgtctctgt

SEQ ID NO: 3413787 - DNA, 14 bp, Homo sapiens
ccggaccagcctgg

SEQ ID NO: 3413788 - DNA, 18 bp, Homo sapiens
ccggaccagcctggccca

SEQ ID NO: 3413789 - DNA, 13 bp, Homo sapiens
ccggcatggacaa

SEQ ID NO: 3413790 - DNA, 22 bp, Homo sapiens
ccgggtcatctgtacctctgcc

SEQ ID NO: 3413791 - DNA, 16 bp, Homo sapiens
ccggtcccctctgccc

SEQ ID NO: 3413792 - DNA, 21 bp, Homo sapiens
ccggtcccctctgccccaccc

SEQ ID NO: 3413793 - DNA, 22 bp, Homo sapiens
ccggtgcatgcaggtctccatg

SEQ ID NO: 3413794 - DNA, 12 bp, Homo sapiens
ccgtaaggctgt

SEQ ID NO: 3413795 - DNA, 18 bp, Homo sapiens
cctaatgtttatgagcca

SEQ ID NO: 3413796 - DNA, 11 bp, Homo sapiens
cctaattgaaa

SEQ ID NO: 3413797 - DNA, 13 bp, Homo sapiens
cctaattgaaatt

SEQ ID NO: 3413798 - DNA, 21 bp, Homo sapiens
cctagatatgaatatatggca

SEQ ID NO: 3413799 - DNA, 11 bp, Homo sapiens
cctaggccagg

SEQ ID NO: 3413800 - DNA, 18 bp, Homo sapiens
cctaggccaggagttccc

SEQ ID NO: 3413801 - DNA, 12 bp, Homo sapiens
cctaggccaggt

SEQ ID NO: 3413802 - DNA, 17 bp, Homo sapiens
cctataaagtgtttatg

SEQ ID NO: 3413803 - DNA, 22 bp, Homo sapiens
cctatctagcatttatttctct

SEQ ID NO: 3413804 - DNA, 20 bp, Homo sapiens
cctatgaaactggtttataa

SEQ ID NO: 3413805 - DNA, 14 bp, Homo sapiens
cctatgcaataaaa

SEQ ID NO: 3413806 - DNA, 17 bp, Homo sapiens
cctatttgccatgggct

SEQ ID NO: 3413807 - DNA, 19 bp, Homo sapiens
cctcaagggggactgtctt

SEQ ID NO: 3413808 - DNA, 23 bp, Homo sapiens
cctcacccctggttctcatcttt

SEQ ID NO: 3413809 - DNA, 14 bp, Homo sapiens
cctcactagctccc

SEQ ID NO: 3413810 - DNA, 23 bp, Homo sapiens
cctcactttccaccaagtgtcta

SEQ ID NO: 3413811 - DNA, 14 bp, Homo sapiens
cctcagatgtgttg

SEQ ID NO: 3413812 - DNA, 17 bp, Homo sapiens
cctcagctccctgcctg

SEQ ID NO: 3413813 - DNA, 20 bp, Homo sapiens
cctcagctccctgcctgttt

SEQ ID NO: 3413814 - DNA, 22 bp, Homo sapiens
cctcagctccctgcctgtttcc

SEQ ID NO: 3413815 - DNA, 14 bp, Homo sapiens
cctcattctgcatt

SEQ ID NO: 3413816 - DNA, 14 bp, Homo sapiens
cctccacacctgcg

SEQ ID NO: 3413817 - DNA, 17 bp, Homo sapiens
cctccacacctgcggcc

SEQ ID NO: 3413818 - DNA, 17 bp, Homo sapiens
cctccactctcccccac

SEQ ID NO: 3413819 - DNA, 12 bp, Homo sapiens
cctccagggctg

SEQ ID NO: 3413820 - DNA, 23 bp, Homo sapiens
cctccagggctggactgaggcct

SEQ ID NO: 3413821 - DNA, 15 bp, Homo sapiens
cctccatttttgttg

SEQ ID NO: 3413822 - DNA, 19 bp, Homo sapiens
cctcccactttgctgttcc

SEQ ID NO: 3413823 - DNA, 16 bp, Homo sapiens
cctccccgcccttttt

SEQ ID NO: 3413824 - DNA, 18 bp, Homo sapiens
cctcccctcgtgtcagct

SEQ ID NO: 3413825 - DNA, 22 bp, Homo sapiens
cctcccttgagaattccctgtg

SEQ ID NO: 3413826 - DNA, 15 bp, Homo sapiens
cctccctttctcccc

SEQ ID NO: 3413827 - DNA, 19 bp, Homo sapiens
cctccgctgggaggaacct

SEQ ID NO: 3413828 - DNA, 14 bp, Homo sapiens
cctcctcagctccc

SEQ ID NO: 3413829 - DNA, 20 bp, Homo sapiens
cctcctcagctccctgcctg

SEQ ID NO: 3413830 - DNA, 13 bp, Homo sapiens
cctcctccaggga

SEQ ID NO: 3413831 - DNA, 18 bp, Homo sapiens
cctcctccagggacagca

SEQ ID NO: 3413832 - DNA, 15 bp, Homo sapiens
cctcgaaagtgtcat

SEQ ID NO: 3413833 - DNA, 18 bp, Homo sapiens
cctcgacagctctctggg

SEQ ID NO: 3413834 - DNA, 16 bp, Homo sapiens
cctcgtgtcagctcag

SEQ ID NO: 3413835 - DNA, 15 bp, Homo sapiens
cctcgttctccctgg

SEQ ID NO: 3413836 - DNA, 15 bp, Homo sapiens
cctcgtttgatagtg

SEQ ID NO: 3413837 - DNA, 15 bp, Homo sapiens
cctctagaggctgcc

SEQ ID NO: 3413838 - DNA, 21 bp, Homo sapiens
cctctccccaatccatgcttc

SEQ ID NO: 3413839 - DNA, 23 bp, Homo sapiens
cctctccccaatccatgcttcac

SEQ ID NO: 3413840 - DNA, 12 bp, Homo sapiens
cctctcccctgc

SEQ ID NO: 3413841 - DNA, 17 bp, Homo sapiens
cctctgccccaccctca

SEQ ID NO: 3413842 - DNA, 19 bp, Homo sapiens
cctctgtccccttctctca

SEQ ID NO: 3413843 - DNA, 14 bp, Homo sapiens
cctgaactctgcaa

SEQ ID NO: 3413844 - DNA, 15 bp, Homo sapiens
cctgaataaagagcc

SEQ ID NO: 3413845 - DNA, 14 bp, Homo sapiens
cctgaccctttgag

SEQ ID NO: 3413846 - DNA, 11 bp, Homo sapiens
cctgagatttc

SEQ ID NO: 3413847 - DNA, 18 bp, Homo sapiens
cctgagatttcatctgct

SEQ ID NO: 3413848 - DNA, 16 bp, Homo sapiens
cctgagcgctcctgcc

SEQ ID NO: 3413849 - DNA, 23 bp, Homo sapiens
cctgagttgcaccattctttctt

SEQ ID NO: 3413850 - DNA, 18 bp, Homo sapiens
cctgcaatgcgtcttgtg

SEQ ID NO: 3413851 - DNA, 23 bp, Homo sapiens
cctgcaatgcgtcttgtgaaatt

SEQ ID NO: 3413852 - DNA, 19 bp, Homo sapiens
cctgcactctttaagggag

SEQ ID NO: 3413853 - DNA, 14 bp, Homo sapiens
cctgcaggaaggag

SEQ ID NO: 3413854 - DNA, 21 bp, Homo sapiens
cctgcatatctctagtccctg

SEQ ID NO: 3413855 - DNA, 14 bp, Homo sapiens
cctgcatgtgtata

SEQ ID NO: 3413856 - DNA, 16 bp, Homo sapiens
cctgcattggaactgg

SEQ ID NO: 3413857 - DNA, 22 bp, Homo sapiens
cctgcattggaactggaggcag

SEQ ID NO: 3413858 - DNA, 23 bp, Homo sapiens
cctgcattggaactggaggcagg

SEQ ID NO: 3413859 - DNA, 19 bp, Homo sapiens
cctgcatttttaaaggaca

SEQ ID NO: 3413860 - DNA, 17 bp, Homo sapiens
cctgccacctcctgcct

SEQ ID NO: 3413861 - DNA, 16 bp, Homo sapiens
cctgccacctggaccc

SEQ ID NO: 3413862 - DNA, 22 bp, Homo sapiens
cctgccacctggacccctgcat

SEQ ID NO: 3413863 - DNA, 18 bp, Homo sapiens
cctgccatcatgtttaca

SEQ ID NO: 3413864 - DNA, 17 bp, Homo sapiens
cctgcccccaggactgg

SEQ ID NO: 3413865 - DNA, 14 bp, Homo sapiens
cctgccgcagagct

SEQ ID NO: 3413866 - DNA, 16 bp, Homo sapiens
cctgccgcagagctgg

SEQ ID NO: 3413867 - DNA, 17 bp, Homo sapiens
cctgcctccagggctgg

SEQ ID NO: 3413868 - DNA, 12 bp, Homo sapiens
cctgcctgtttc

SEQ ID NO: 3413869 - DNA, 13 bp, Homo sapiens
cctgcgagggcag

SEQ ID NO: 3413870 - DNA, 17 bp, Homo sapiens
cctgctggttcactcta

SEQ ID NO: 3413871 - DNA, 19 bp, Homo sapiens
cctggacttggcccctgcc

SEQ ID NO: 3413872 - DNA, 17 bp, Homo sapiens
cctggagcccagaggag

SEQ ID NO: 3413873 - DNA, 22 bp, Homo sapiens
cctggagccctgttggcagctc

SEQ ID NO: 3413874 - DNA, 14 bp, Homo sapiens
cctggcccacccca

SEQ ID NO: 3413875 - DNA, 13 bp, Homo sapiens
cctggctccccct

SEQ ID NO: 3413876 - DNA, 16 bp, Homo sapiens
cctgggaccagggcat

SEQ ID NO: 3413877 - DNA, 23 bp, Homo sapiens
cctgggaggcgggcgcactgcct

SEQ ID NO: 3413878 - DNA, 19 bp, Homo sapiens
cctgggcagtgagtgccat

SEQ ID NO: 3413879 - DNA, 23 bp, Homo sapiens
cctgggcagtgagtgccatgctt

SEQ ID NO: 3413880 - DNA, 12 bp, Homo sapiens
cctggggggcag

SEQ ID NO: 3413881 - DNA, 14 bp, Homo sapiens
cctggttctcatct

SEQ ID NO: 3413882 - DNA, 16 bp, Homo sapiens
cctggttctcatcttt

SEQ ID NO: 3413883 - DNA, 19 bp, Homo sapiens
cctgtaaaatgggggcgct

SEQ ID NO: 3413884 - DNA, 16 bp, Homo sapiens
cctgtaaaccaaagtt

SEQ ID NO: 3413885 - DNA, 14 bp, Homo sapiens
cctgtcccacctgg

SEQ ID NO: 3413886 - DNA, 15 bp, Homo sapiens
cctgtgagaaaggaa

SEQ ID NO: 3413887 - DNA, 16 bp, Homo sapiens
cctgtgagaaaggaaa

SEQ ID NO: 3413888 - DNA, 18 bp, Homo sapiens
cctgtgagaaaggaaaaa

SEQ ID NO: 3413889 - DNA, 21 bp, Homo sapiens
atttaataaaataattctaaa

SEQ ID NO: 3413890 - DNA, 22 bp, Homo sapiens
atttaataaaataattctaaag

SEQ ID NO: 3413891 - DNA, 14 bp, Homo sapiens
atttaataacatta

SEQ ID NO: 3413892 - DNA, 17 bp, Homo sapiens
atttaataacattacct

SEQ ID NO: 3413893 - DNA, 23 bp, Homo sapiens
atttactggaaacctagccagct

SEQ ID NO: 3413894 - DNA, 18 bp, Homo sapiens
atttagagcgtttggtta

SEQ ID NO: 3413895 - DNA, 22 bp, Homo sapiens
atttagagcgtttggttaaagt

SEQ ID NO: 3413896 - DNA, 17 bp, Homo sapiens
atttaggagaagttggt

SEQ ID NO: 3413897 - DNA, 22 bp, Homo sapiens
atttaggcagattgaaaaggac

SEQ ID NO: 3413898 - DNA, 15 bp, Homo sapiens
atttaggtaaataaa

SEQ ID NO: 3413899 - DNA, 18 bp, Homo sapiens
atttatacatacagagat

SEQ ID NO: 3413900 - DNA, 19 bp, Homo sapiens
atttataccattataccag

SEQ ID NO: 3413901 - DNA, 21 bp, Homo sapiens
atttataccattataccagca

SEQ ID NO: 3413902 - DNA, 16 bp, Homo sapiens
atttatactggcatgc

SEQ ID NO: 3413903 - DNA, 13 bp, Homo sapiens
atttatatcttgt

SEQ ID NO: 3413904 - DNA, 17 bp, Homo sapiens
atttatatcttgttatt

SEQ ID NO: 3413905 - DNA, 18 bp, Homo sapiens
atttatatcttgttatta

SEQ ID NO: 3413906 - DNA, 12 bp, Homo sapiens
atttatgtagat

SEQ ID NO: 3413907 - DNA, 21 bp, Homo sapiens
atttatgtagatgtgcatttt

SEQ ID NO: 3413908 - DNA, 14 bp, Homo sapiens
atttatttctctgg

SEQ ID NO: 3413909 - DNA, 14 bp, Homo sapiens
atttcaagatccaa

SEQ ID NO: 3413910 - DNA, 16 bp, Homo sapiens
atttcaagatccaaat

SEQ ID NO: 3413911 - DNA, 21 bp, Homo sapiens
atttcacccctccctttctcc

SEQ ID NO: 3413912 - DNA, 17 bp, Homo sapiens
atttcacttaataatgt

SEQ ID NO: 3413913 - DNA, 18 bp, Homo sapiens
atttcagtattttccagc

SEQ ID NO: 3413914 - DNA, 19 bp, Homo sapiens
atttcatctatttctgaga

SEQ ID NO: 3413915 - DNA, 20 bp, Homo sapiens
atttcatctatttctgagaa

SEQ ID NO: 3413916 - DNA, 15 bp, Homo sapiens
atttcatctgctctc

SEQ ID NO: 3413917 - DNA, 19 bp, Homo sapiens
atttcatctgctctccttc

SEQ ID NO: 3413918 - DNA, 17 bp, Homo sapiens
atttccaaaataatcta

SEQ ID NO: 3413919 - DNA, 15 bp, Homo sapiens
atttccaagagctga

SEQ ID NO: 3413920 - DNA, 16 bp, Homo sapiens
atttccaagagctgag

SEQ ID NO: 3413921 - DNA, 15 bp, Homo sapiens
atttcgatgtacagt

SEQ ID NO: 3413922 - DNA, 14 bp, Homo sapiens
atttctatgtatgt

SEQ ID NO: 3413923 - DNA, 22 bp, Homo sapiens
atttctatgtatgtgccaattt

SEQ ID NO: 3413924 - DNA, 19 bp, Homo sapiens
atttctgatgttttatttg

SEQ ID NO: 3413925 - DNA, 21 bp, Homo sapiens
atttcttaaacaaatgtatga

SEQ ID NO: 3413926 - DNA, 15 bp, Homo sapiens
atttctttatataag

SEQ ID NO: 3413927 - DNA, 12 bp, Homo sapiens
atttctttgaat

SEQ ID NO: 3413928 - DNA, 15 bp, Homo sapiens
atttctttgaatgta

SEQ ID NO: 3413929 - DNA, 17 bp, Homo sapiens
atttctttgaatgtatt

SEQ ID NO: 3413930 - DNA, 22 bp, Homo sapiens
atttctttgtagaataaatggt

SEQ ID NO: 3413931 - DNA, 11 bp, Homo sapiens
atttgaaagaa

SEQ ID NO: 3413932 - DNA, 20 bp, Homo sapiens
atttgatagtattgtgcata

SEQ ID NO: 3413933 - DNA, 17 bp, Homo sapiens
atttgatctttgtttaa

SEQ ID NO: 3413934 - DNA, 15 bp, Homo sapiens
atttgcacaagtttt

SEQ ID NO: 3413935 - DNA, 15 bp, Homo sapiens
atttggcttgctgtt

SEQ ID NO: 3413936 - DNA, 20 bp, Homo sapiens
atttggcttgctgtttactc

SEQ ID NO: 3413937 - DNA, 12 bp, Homo sapiens
atttggggtgga

SEQ ID NO: 3413938 - DNA, 18 bp, Homo sapiens
atttgtaaatttatgtga

SEQ ID NO: 3413939 - DNA, 15 bp, Homo sapiens
atttgtaagtttcag

SEQ ID NO: 3413940 - DNA, 13 bp, Homo sapiens
atttgttcttata

SEQ ID NO: 3413941 - DNA, 16 bp, Homo sapiens
atttgttgtcatgtgt

SEQ ID NO: 3413942 - DNA, 17 bp, Homo sapiens
atttgttgtcatgtgta

SEQ ID NO: 3413943 - DNA, 13 bp, Homo sapiens
attttaaaacatg

SEQ ID NO: 3413944 - DNA, 23 bp, Homo sapiens
caatcacaaaagctgtgtctctg

SEQ ID NO: 3413945 - DNA, 15 bp, Homo sapiens
caatccaaatgcatt

SEQ ID NO: 3413946 - DNA, 17 bp, Homo sapiens
caatccaaatgcattca

SEQ ID NO: 3413947 - DNA, 15 bp, Homo sapiens
caatccatgcttcac

SEQ ID NO: 3413948 - DNA, 16 bp, Homo sapiens
caatgataaataaagt

SEQ ID NO: 3413949 - DNA, 22 bp, Homo sapiens
caatgatacccaacagtttatt

SEQ ID NO: 3413950 - DNA, 22 bp, Homo sapiens
caatgcattaccttctgttcct

SEQ ID NO: 3413951 - DNA, 16 bp, Homo sapiens
caatgcgtcttgtgaa

SEQ ID NO: 3413952 - DNA, 21 bp, Homo sapiens
caatgcgtcttgtgaaattgt

SEQ ID NO: 3413953 - DNA, 22 bp, Homo sapiens
caatgcgtcttgtgaaattgtg

SEQ ID NO: 3413954 - DNA, 23 bp, Homo sapiens
caatgcgtcttgtgaaattgtgt

SEQ ID NO: 3413955 - DNA, 13 bp, Homo sapiens
caatggtttgcaa

SEQ ID NO: 3413956 - DNA, 16 bp, Homo sapiens
caatggtttgcaagga

SEQ ID NO: 3413957 - DNA, 19 bp, Homo sapiens
caatggtttgcaaggaagc

SEQ ID NO: 3413958 - DNA, 15 bp, Homo sapiens
caatgtacaaggtat

SEQ ID NO: 3413959 - DNA, 23 bp, Homo sapiens
caatgtccacctgtgagaaagga

SEQ ID NO: 3413960 - DNA, 16 bp, Homo sapiens
caatgtgatctatgtt

SEQ ID NO: 3413961 - DNA, 14 bp, Homo sapiens
caatgttaaggaaa

SEQ ID NO: 3413962 - DNA, 16 bp, Homo sapiens
caatgttaaggaaact

SEQ ID NO: 3413963 - DNA, 17 bp, Homo sapiens
caattaagtgttgaaaa

SEQ ID NO: 3413964 - DNA, 19 bp, Homo sapiens
caattggttgtatataaag

SEQ ID NO: 3413965 - DNA, 19 bp, Homo sapiens
caattgttctgggtgattt

SEQ ID NO: 3413966 - DNA, 13 bp, Homo sapiens
caatttaaagcaa

SEQ ID NO: 3413967 - DNA, 18 bp, Homo sapiens
caatttactttttaaaca

SEQ ID NO: 3413968 - DNA, 20 bp, Homo sapiens
caatttggagcattaactaa

SEQ ID NO: 3413969 - DNA, 14 bp, Homo sapiens
caattttttaaacc

SEQ ID NO: 3413970 - DNA, 21 bp, Homo sapiens
cacaaaagaagaaataaataa

SEQ ID NO: 3413971 - DNA, 22 bp, Homo sapiens
cacaaaagaagaaataaataat

SEQ ID NO: 3413972 - DNA, 16 bp, Homo sapiens
cacaaaagctgtgtct

SEQ ID NO: 3413973 - DNA, 18 bp, Homo sapiens
cacaaaagctgtgtctct

SEQ ID NO: 3413974 - DNA, 16 bp, Homo sapiens
cacaaaccctgcctct

SEQ ID NO: 3413975 - DNA, 22 bp, Homo sapiens
cacaaataacagctttcttatt

SEQ ID NO: 3413976 - DNA, 17 bp, Homo sapiens
cacaatgttgcactgaa

SEQ ID NO: 3413977 - DNA, 20 bp, Homo sapiens
cacaatgttgcactgaaaac

SEQ ID NO: 3413978 - DNA, 21 bp, Homo sapiens
cacaatgttgcactgaaaacc

SEQ ID NO: 3413979 - DNA, 16 bp, Homo sapiens
cacacaaaatgtcaca

SEQ ID NO: 3413980 - DNA, 23 bp, Homo sapiens
cacacactcgggttaagaaatac

SEQ ID NO: 3413981 - DNA, 22 bp, Homo sapiens
cacacagactgttgtccctgca

SEQ ID NO: 3413982 - DNA, 21 bp, Homo sapiens
cacaccaggcttgcctgcagg

SEQ ID NO: 3413983 - DNA, 22 bp, Homo sapiens
cacaccagttgaactgcaggaa

SEQ ID NO: 3413984 - DNA, 22 bp, Homo sapiens
cacagactgttgtccctgcact

SEQ ID NO: 3413985 - DNA, 21 bp, Homo sapiens
cacagcctgggaccagggcat

SEQ ID NO: 3413986 - DNA, 16 bp, Homo sapiens
cacagctcttgtttgg

SEQ ID NO: 3413987 - DNA, 16 bp, Homo sapiens
cacaggatgaagcatt

SEQ ID NO: 3413988 - DNA, 15 bp, Homo sapiens
cacaggctagatccc

SEQ ID NO: 3413989 - DNA, 13 bp, Homo sapiens
cacagtgtgaata

SEQ ID NO: 3413990 - DNA, 22 bp, Homo sapiens
cacataggtaggtatctttata

SEQ ID NO: 3413991 - DNA, 22 bp, Homo sapiens
cacatctaaattgatcattcat

SEQ ID NO: 3413992 - DNA, 20 bp, Homo sapiens
cacattttgacacaatgttg

SEQ ID NO: 3413993 - DNA, 23 bp, Homo sapiens
caccaagtgtctagagtcatgtg

SEQ ID NO: 3413994 - DNA, 12 bp, Homo sapiens
caccagagcaga

SEQ ID NO: 3413995 - DNA, 16 bp, Homo sapiens
caccaggtagaacaca

SEQ ID NO: 3413996 - DNA, 19 bp, Homo sapiens
caccagttgaactgcagga

SEQ ID NO: 3413997 - DNA, 23 bp, Homo sapiens
caccagttgaactgcaggaagag

SEQ ID NO: 3413998 - DNA, 14 bp, Homo sapiens
caccattctttctt

SEQ ID NO: 3413999 - DNA, 16 bp, Homo sapiens
cacccacttctgcact

SEQ ID NO: 3414000 - DNA, 21 bp, Homo sapiens
caccccacccacttctgcact

SEQ ID NO: 3414001 - DNA, 19 bp, Homo sapiens
caccccagggcagccaggg

SEQ ID NO: 3414002 - DNA, 22 bp, Homo sapiens
caccccagggcagccagggaga

SEQ ID NO: 3414003 - DNA, 18 bp, Homo sapiens
cacccctccctttctccc

SEQ ID NO: 3414004 - DNA, 18 bp, Homo sapiens
cacccctggttctcatct

SEQ ID NO: 3414005 - DNA, 22 bp, Homo sapiens
caccctgggcagtgagtgccat

SEQ ID NO: 3414006 - DNA, 21 bp, Homo sapiens
caccgcccactctccacctca

SEQ ID NO: 3414007 - DNA, 15 bp, Homo sapiens
cacctattgaattac

SEQ ID NO: 3414008 - DNA, 18 bp, Homo sapiens
cacctcactagctcccca

SEQ ID NO: 3414009 - DNA, 15 bp, Homo sapiens
cacctggacccctgc

SEQ ID NO: 3414010 - DNA, 12 bp, Homo sapiens
cacctggctccc

SEQ ID NO: 3414011 - DNA, 19 bp, Homo sapiens
cacctgtgagaaaggaaaa

SEQ ID NO: 3414012 - DNA, 10 bp, Homo sapiens
caccttcacc

SEQ ID NO: 3414013 - DNA, 12 bp, Homo sapiens
caccttgttaca

SEQ ID NO: 3414014 - DNA, 12 bp, Homo sapiens
cactagctcccc

SEQ ID NO: 3414015 - DNA, 21 bp, Homo sapiens
cactagctccccaatccctga

SEQ ID NO: 3414016 - DNA, 22 bp, Homo sapiens
cactaggaatttttttcagtat

SEQ ID NO: 3414017 - DNA, 16 bp, Homo sapiens
cactcctgctgtaaat

SEQ ID NO: 3414018 - DNA, 17 bp, Homo sapiens
cactcttctcagccact

SEQ ID NO: 3414019 - DNA, 19 bp, Homo sapiens
cactgaattggaacttttc

SEQ ID NO: 3414020 - DNA, 19 bp, Homo sapiens
cactgacacaaaagaagaa

SEQ ID NO: 3414021 - DNA, 16 bp, Homo sapiens
cactgagaatgtaaga

SEQ ID NO: 3414022 - DNA, 17 bp, Homo sapiens
cactgaggaagaacggg

SEQ ID NO: 3414023 - DNA, 14 bp, Homo sapiens
cactgcctctcaca

SEQ ID NO: 3414024 - DNA, 17 bp, Homo sapiens
cactgcctctcacagct

SEQ ID NO: 3414025 - DNA, 21 bp, Homo sapiens
cactggcatcgcagcttcctg

SEQ ID NO: 3414026 - DNA, 13 bp, Homo sapiens
cactgtaaaatag

SEQ ID NO: 3414027 - DNA, 13 bp, Homo sapiens
cactgtataaata

SEQ ID NO: 3414028 - DNA, 16 bp, Homo sapiens
cactgtataaatagga

SEQ ID NO: 3414029 - DNA, 19 bp, Homo sapiens
cactgtataaataggagag

SEQ ID NO: 3414030 - DNA, 21 bp, Homo sapiens
cactgtataaataggagagga

SEQ ID NO: 3414031 - DNA, 23 bp, Homo sapiens
cactgtataaataggagaggatg

SEQ ID NO: 3414032 - DNA, 15 bp, Homo sapiens
cactgtttttcatac

SEQ ID NO: 3414033 - DNA, 21 bp, Homo sapiens
cacttaacattcctaaaatgc

SEQ ID NO: 3414034 - DNA, 21 bp, Homo sapiens
cacttaatattagcttgctta

SEQ ID NO: 3414035 - DNA, 20 bp, Homo sapiens
cacttgtggaatatgttacc

SEQ ID NO: 3414036 - DNA, 18 bp, Homo sapiens
cactttcagtgaaagcat

SEQ ID NO: 3414037 - DNA, 14 bp, Homo sapiens
cactttttgcagct

SEQ ID NO: 3414038 - DNA, 15 bp, Homo sapiens
cactttttgcagctt

SEQ ID NO: 3414039 - DNA, 18 bp, Homo sapiens
cactttttgcagctttct

SEQ ID NO: 3414040 - DNA, 20 bp, Homo sapiens
cagaaaaaaagcccaacaca

SEQ ID NO: 3414041 - DNA, 13 bp, Homo sapiens
cagaaacatcatg

SEQ ID NO: 3414042 - DNA, 17 bp, Homo sapiens
cagaacagcttcaggtt

SEQ ID NO: 3414043 - DNA, 14 bp, Homo sapiens
cagaagaaggcagc

SEQ ID NO: 3414044 - DNA, 15 bp, Homo sapiens
cagaagacaccagag

SEQ ID NO: 3414045 - DNA, 18 bp, Homo sapiens
cagaagacaccagagcag

SEQ ID NO: 3414046 - DNA, 15 bp, Homo sapiens
cagaagaccccactt

SEQ ID NO: 3414047 - DNA, 13 bp, Homo sapiens
cagaagcagctct

SEQ ID NO: 3414048 - DNA, 14 bp, Homo sapiens
cagaagcagctctt

SEQ ID NO: 3414049 - DNA, 11 bp, Homo sapiens
cagacactgta

SEQ ID NO: 3414050 - DNA, 14 bp, Homo sapiens
cagacactgtaaaa

SEQ ID NO: 3414051 - DNA, 21 bp, Homo sapiens
cagacccctcccctcgtgtca

SEQ ID NO: 3414052 - DNA, 16 bp, Homo sapiens
cagacctgcccctccc

SEQ ID NO: 3414053 - DNA, 21 bp, Homo sapiens
cagactaagccagcaccggac

SEQ ID NO: 3414054 - DNA, 22 bp, Homo sapiens
cagactaagccagcaccggacc

SEQ ID NO: 3414055 - DNA, 16 bp, Homo sapiens
cagactgttgtccctg

SEQ ID NO: 3414056 - DNA, 13 bp, Homo sapiens
cagagaaagcgca

SEQ ID NO: 3414057 - DNA, 16 bp, Homo sapiens
cagagaaagcgcagat

SEQ ID NO: 3414058 - DNA, 15 bp, Homo sapiens
cagagagccattttg

SEQ ID NO: 3414059 - DNA, 15 bp, Homo sapiens
cagagcagatgcaga

SEQ ID NO: 3414060 - DNA, 16 bp, Homo sapiens
cagagcagatgcagag

SEQ ID NO: 3414061 - DNA, 9 bp, Homo sapiens
cagagctgg

SEQ ID NO: 3414062 - DNA, 14 bp, Homo sapiens
cagaggaggagaaa

SEQ ID NO: 3414063 - DNA, 14 bp, Homo sapiens
cagaggagggcagc

SEQ ID NO: 3414064 - DNA, 18 bp, Homo sapiens
cagaggagggcagcagaa

SEQ ID NO: 3414065 - DNA, 14 bp, Homo sapiens
cagaggggcctgcc

SEQ ID NO: 3414066 - DNA, 14 bp, Homo sapiens
cagaggtaacagaa

SEQ ID NO: 3414067 - DNA, 16 bp, Homo sapiens
cagaggtaacagaaca

SEQ ID NO: 3414068 - DNA, 17 bp, Homo sapiens
cagaggtaacagaacag

SEQ ID NO: 3414069 - DNA, 17 bp, Homo sapiens
cagatacatggttgtga

SEQ ID NO: 3414070 - DNA, 23 bp, Homo sapiens
cagatcctccatttttgttggga

SEQ ID NO: 3414071 - DNA, 19 bp, Homo sapiens
cagatgattcaaatatcaa

SEQ ID NO: 3414072 - DNA, 18 bp, Homo sapiens
cagatgcagagagccatt

SEQ ID NO: 3414073 - DNA, 20 bp, Homo sapiens
cagatgcagagagccatttt

SEQ ID NO: 3414074 - DNA, 21 bp, Homo sapiens
cagatgctgaattgagaataa

SEQ ID NO: 3414075 - DNA, 14 bp, Homo sapiens
cagatggaaaggag

SEQ ID NO: 3414076 - DNA, 18 bp, Homo sapiens
cagatgtagatataaata

SEQ ID NO: 3414077 - DNA, 14 bp, Homo sapiens
cagatgtccctgaa

SEQ ID NO: 3414078 - DNA, 20 bp, Homo sapiens
cagatgttatttttgtattt

SEQ ID NO: 3414079 - DNA, 22 bp, Homo sapiens
cagatgttatttttgtattttt

SEQ ID NO: 3414080 - DNA, 22 bp, Homo sapiens
cagatttttatattagttgctt

SEQ ID NO: 3414081 - DNA, 20 bp, Homo sapiens
cagcaactatcagactaagc

SEQ ID NO: 3414082 - DNA, 23 bp, Homo sapiens
cagcaactatcagactaagccag

SEQ ID NO: 3414083 - DNA, 17 bp, Homo sapiens
cagcaccggaccagcct

SEQ ID NO: 3414084 - DNA, 20 bp, Homo sapiens
cagcatcaaacatgaaaaca

SEQ ID NO: 3414085 - DNA, 18 bp, Homo sapiens
cagccagggagagcccag

SEQ ID NO: 3414086 - DNA, 16 bp, Homo sapiens
cagccagggcctgcga

SEQ ID NO: 3414087 - DNA, 22 bp, Homo sapiens
cagccagggcctgcgagggcag

SEQ ID NO: 3414088 - DNA, 17 bp, Homo sapiens
cagcccaaagaaggaaa

SEQ ID NO: 3414089 - DNA, 20 bp, Homo sapiens
cagcccctccccacaccagt

SEQ ID NO: 3414090 - DNA, 13 bp, Homo sapiens
cagccctcacccc

SEQ ID NO: 3414091 - DNA, 18 bp, Homo sapiens
cagccctcacccctggtt

SEQ ID NO: 3414092 - DNA, 20 bp, Homo sapiens
cagccctgctgctgcctgcc

SEQ ID NO: 3414093 - DNA, 19 bp, Homo sapiens
cagcctgggaccagggcat

SEQ ID NO: 3414094 - DNA, 20 bp, Homo sapiens
cagcctgggaccagggcata

SEQ ID NO: 3414095 - DNA, 20 bp, Homo sapiens
cagccttatgtgttacatta

SEQ ID NO: 3414096 - DNA, 18 bp, Homo sapiens
cagcgggagcctccctgc

SEQ ID NO: 3414097 - DNA, 23 bp, Homo sapiens
cagctaatctccacccaatgaat

SEQ ID NO: 3414098 - DNA, 18 bp, Homo sapiens
cagctaccaggtgttcta

SEQ ID NO: 3414099 - DNA, 19 bp, Homo sapiens
cagctactaatgatgtttt

SEQ ID NO: 3414100 - DNA, 16 bp, Homo sapiens
cagctagaatttctgg

SEQ ID NO: 3414101 - DNA, 16 bp, Homo sapiens
cagctcaggcagctcg

SEQ ID NO: 3414102 - DNA, 11 bp, Homo sapiens
cagctcttgtt

SEQ ID NO: 3414103 - DNA, 13 bp, Homo sapiens
cagctcttgtttg

SEQ ID NO: 3414104 - DNA, 15 bp, Homo sapiens
cagctgcccttccgc

SEQ ID NO: 3414105 - DNA, 22 bp, Homo sapiens
cagctggtggatggtgactttt

SEQ ID NO: 3414106 - DNA, 18 bp, Homo sapiens
cagcttcctgtctgttta

SEQ ID NO: 3414107 - DNA, 21 bp, Homo sapiens
cagcttcctgtctgtttatat

SEQ ID NO: 3414108 - DNA, 12 bp, Homo sapiens
caggaaagaata

SEQ ID NO: 3414109 - DNA, 16 bp, Homo sapiens
caggaaggagctgcct

SEQ ID NO: 3414110 - DNA, 19 bp, Homo sapiens
caggaaggagctgcctgga

SEQ ID NO: 3414111 - DNA, 21 bp, Homo sapiens
caggaaggagctgcctggacc

SEQ ID NO: 3414112 - DNA, 14 bp, Homo sapiens
caggacaggaaaaa

SEQ ID NO: 3414113 - DNA, 20 bp, Homo sapiens
caggacccagaaaaaaagcc

SEQ ID NO: 3414114 - DNA, 13 bp, Homo sapiens
caggactctgcag

SEQ ID NO: 3414115 - DNA, 16 bp, Homo sapiens
caggactctgcagcct

SEQ ID NO: 3414116 - DNA, 17 bp, Homo sapiens
caggactctgcagcctc

SEQ ID NO: 3414117 - DNA, 15 bp, Homo sapiens
caggactgggccact

SEQ ID NO: 3414118 - DNA, 13 bp, Homo sapiens
caggagctcccct

SEQ ID NO: 3414119 - DNA, 16 bp, Homo sapiens
caggagctcccctccc

SEQ ID NO: 3414120 - DNA, 14 bp, Homo sapiens
caggagtccctgcc

SEQ ID NO: 3414121 - DNA, 15 bp, Homo sapiens
caggagtccctgcca

SEQ ID NO: 3414122 - DNA, 21 bp, Homo sapiens
caggagtccctgccatcatgt

SEQ ID NO: 3414123 - DNA, 22 bp, Homo sapiens
caggatcatggtgtaataagac

SEQ ID NO: 3414124 - DNA, 21 bp, Homo sapiens
caggatttatacatacagaga

SEQ ID NO: 3414125 - DNA, 22 bp, Homo sapiens
caggatttatacatacagagat

SEQ ID NO: 3414126 - DNA, 16 bp, Homo sapiens
caggcaccgagaatgt

SEQ ID NO: 3414127 - DNA, 17 bp, Homo sapiens
caggcaccgagaatgtt

SEQ ID NO: 3414128 - DNA, 22 bp, Homo sapiens
caggcactgccctggtggccct

SEQ ID NO: 3414129 - DNA, 16 bp, Homo sapiens
caggccaggactctgc

SEQ ID NO: 3414130 - DNA, 14 bp, Homo sapiens
caggctgccggctc

SEQ ID NO: 3414131 - DNA, 18 bp, Homo sapiens
caggcttgcctgcaggca

SEQ ID NO: 3414132 - DNA, 19 bp, Homo sapiens
cagggaaggaccccctccc

SEQ ID NO: 3414133 - DNA, 16 bp, Homo sapiens
cagggagagcccagga

SEQ ID NO: 3414134 - DNA, 20 bp, Homo sapiens
cagggagagcccaggagctc

SEQ ID NO: 3414135 - DNA, 16 bp, Homo sapiens
cagggcagccagggag

SEQ ID NO: 3414136 - DNA, 18 bp, Homo sapiens
cagggcagccagggagag

SEQ ID NO: 3414137 - DNA, 23 bp, Homo sapiens
cagggcagccagggagagcccag

SEQ ID NO: 3414138 - DNA, 23 bp, Homo sapiens
cagggctggactgaggcctgagc

SEQ ID NO: 3414139 - DNA, 16 bp, Homo sapiens
cagggcttacggccct

SEQ ID NO: 3414140 - DNA, 20 bp, Homo sapiens
cagggcttacggccctggcc

SEQ ID NO: 3414141 - DNA, 23 bp, Homo sapiens
cagggcttacggccctggccttg

SEQ ID NO: 3414142 - DNA, 18 bp, Homo sapiens
caggggagggtcagccag

SEQ ID NO: 3414143 - DNA, 19 bp, Homo sapiens
caggggagggtcagccagg

SEQ ID NO: 3414144 - DNA, 20 bp, Homo sapiens
caggggagggtcagccaggg

SEQ ID NO: 3414145 - DNA, 11 bp, Homo sapiens
caggtattttc

SEQ ID NO: 3414146 - DNA, 12 bp, Homo sapiens
caggtgacatgt

SEQ ID NO: 3414147 - DNA, 16 bp, Homo sapiens
caggtgacatgtgaaa

SEQ ID NO: 3414148 - DNA, 18 bp, Homo sapiens
caggtgacatgtgaaacc

SEQ ID NO: 3414149 - DNA, 19 bp, Homo sapiens
caggttggaaaagaaatca

SEQ ID NO: 3414150 - DNA, 22 bp, Homo sapiens
caggttggaaaagaaatcaatt

SEQ ID NO: 3414151 - DNA, 20 bp, Homo sapiens
caggttttcttctaatcata

SEQ ID NO: 3414152 - DNA, 24 bp, Homo sapiens
caggttttcttctaatcataacat

SEQ ID NO: 3414153 - DNA, 19 bp, Homo sapiens
cagtaaatgaactgatttt

SEQ ID NO: 3414154 - DNA, 21 bp, Homo sapiens
cagtaaatgaactgattttta

SEQ ID NO: 3414155 - DNA, 12 bp, Homo sapiens
cagtaataatca

SEQ ID NO: 3414156 - DNA, 15 bp, Homo sapiens
cagtattcccactct

SEQ ID NO: 3414157 - DNA, 15 bp, Homo sapiens
cagtatttgtgggga

SEQ ID NO: 3414158 - DNA, 15 bp, Homo sapiens
cagtcactaggaatt

SEQ ID NO: 3414159 - DNA, 18 bp, Homo sapiens
cagtcactttttcccctg

SEQ ID NO: 3414160 - DNA, 21 bp, Homo sapiens
cagtcactttttcccctgcaa

SEQ ID NO: 3414161 - DNA, 22 bp, Homo sapiens
cagtcactttttcccctgcaat

SEQ ID NO: 3414162 - DNA, 18 bp, Homo sapiens
cagtcatgcataaatatg

SEQ ID NO: 3414163 - DNA, 17 bp, Homo sapiens
cagtcgtcccaggctgc

SEQ ID NO: 3414164 - DNA, 15 bp, Homo sapiens
cagtctcaattttgt

SEQ ID NO: 3414165 - DNA, 20 bp, Homo sapiens
cagtctcaattttgtattta

SEQ ID NO: 3414166 - DNA, 13 bp, Homo sapiens
cagtgaaaaagat

SEQ ID NO: 3414167 - DNA, 13 bp, Homo sapiens
cagtgaaagcatc

SEQ ID NO: 3414168 - DNA, 23 bp, Homo sapiens
cagtgagggtcttcttacatgca

SEQ ID NO: 3414169 - DNA, 15 bp, Homo sapiens
cagtgatatggcaga

SEQ ID NO: 3414170 - DNA, 22 bp, Homo sapiens
cagtgatatggcagaagacacc

SEQ ID NO: 3414171 - DNA, 23 bp, Homo sapiens
cagtgatatggtactaaggagaa

SEQ ID NO: 3414172 - DNA, 14 bp, Homo sapiens
cagtgtatctaatt

SEQ ID NO: 3414173 - DNA, 14 bp, Homo sapiens
cagtgttagtattc

SEQ ID NO: 3414174 - DNA, 15 bp, Homo sapiens
cagtgtttatgacga

SEQ ID NO: 3414175 - DNA, 13 bp, Homo sapiens
cagttcataaatt

SEQ ID NO: 3414176 - DNA, 15 bp, Homo sapiens
cagttcataaatttg

SEQ ID NO: 3414177 - DNA, 18 bp, Homo sapiens
cagttcataaatttgttg

SEQ ID NO: 3414178 - DNA, 21 bp, Homo sapiens
cagtttattaaatctgaattt

SEQ ID NO: 3414179 - DNA, 15 bp, Homo sapiens
cagtttcatgtatgt

SEQ ID NO: 3414180 - DNA, 18 bp, Homo sapiens
cagtttcatgtatgtata

SEQ ID NO: 3414181 - DNA, 15 bp, Homo sapiens
cagtttcttagcttt

SEQ ID NO: 3414182 - DNA, 22 bp, Homo sapiens
cataaaactcatgactgagtct

SEQ ID NO: 3414183 - DNA, 17 bp, Homo sapiens
cataaaattgcagtttc

SEQ ID NO: 3414184 - DNA, 12 bp, Homo sapiens
cataaatatgca

SEQ ID NO: 3414185 - DNA, 16 bp, Homo sapiens
cataaatttgttgtca

SEQ ID NO: 3414186 - DNA, 14 bp, Homo sapiens
cataacattgattt

SEQ ID NO: 3414187 - DNA, 15 bp, Homo sapiens
cataacgtttttcct

SEQ ID NO: 3414188 - DNA, 18 bp, Homo sapiens
cataacgtttttccttta

SEQ ID NO: 3414189 - DNA, 21 bp, Homo sapiens
cataacgtttttcctttaaaa

SEQ ID NO: 3414190 - DNA, 17 bp, Homo sapiens
cataataagctaaagag

SEQ ID NO: 3414191 - DNA, 14 bp, Homo sapiens
cataattttatcta

SEQ ID NO: 3414192 - DNA, 18 bp, Homo sapiens
catacagagattgtagta

SEQ ID NO: 3414193 - DNA, 15 bp, Homo sapiens
catactcttaagtgt

SEQ ID NO: 3414194 - DNA, 22 bp, Homo sapiens
catactgttgatccatctcagt

SEQ ID NO: 3414195 - DNA, 18 bp, Homo sapiens
catagaacagaaatatat

SEQ ID NO: 3414196 - DNA, 20 bp, Homo sapiens
catagaacagaaatatataa

SEQ ID NO: 3414197 - DNA, 16 bp, Homo sapiens
cataggtaggtatctt

SEQ ID NO: 3414198 - DNA, 13 bp, Homo sapiens
catataactgtga

SEQ ID NO: 3414199 - DNA, 21 bp, Homo sapiens
catatagatagataatgttct

SEQ ID NO: 3414200 - DNA, 14 bp, Homo sapiens
catatatgctgtat

SEQ ID NO: 3414201 - DNA, 23 bp, Homo sapiens
catatcctgagccatcggtgaaa

SEQ ID NO: 3414202 - DNA, 24 bp, Homo sapiens
catatctctagtccctgtgttctg

SEQ ID NO: 3414203 - DNA, 18 bp, Homo sapiens
catattaaaggcttttgg

SEQ ID NO: 3414204 - DNA, 14 bp, Homo sapiens
catattaggaaaat

SEQ ID NO: 3414205 - DNA, 12 bp, Homo sapiens
catcaaacatga

SEQ ID NO: 3414206 - DNA, 17 bp, Homo sapiens
catcaaacatgaaaaca

SEQ ID NO: 3414207 - DNA, 22 bp, Homo sapiens
catcaaacatgaaaacattgat

SEQ ID NO: 3414208 - DNA, 16 bp, Homo sapiens
catcaaataaaccttg

SEQ ID NO: 3414209 - DNA, 22 bp, Homo sapiens
catcaatagtgtcctatgcaat

SEQ ID NO: 3414210 - DNA, 19 bp, Homo sapiens
catcatgtttacagaggac

SEQ ID NO: 3414211 - DNA, 21 bp, Homo sapiens
catcatgtttacagaggacag

SEQ ID NO: 3414212 - DNA, 22 bp, Homo sapiens
catccaaggaacctaattgaaa

SEQ ID NO: 3414213 - DNA, 23 bp, Homo sapiens
catccatttcatctatttctgag

SEQ ID NO: 3414214 - DNA, 16 bp, Homo sapiens
catcccggtgcatgca

SEQ ID NO: 3414215 - DNA, 12 bp, Homo sapiens
catcctgcaggc

SEQ ID NO: 3414216 - DNA, 14 bp, Homo sapiens
catcgatatgaaaa

SEQ ID NO: 3414217 - DNA, 14 bp, Homo sapiens
catcgcagcttcct

SEQ ID NO: 3414218 - DNA, 15 bp, Homo sapiens
catcgcagcttcctg

SEQ ID NO: 3414219 - DNA, 13 bp, Homo sapiens
catctaaagcttt

SEQ ID NO: 3414220 - DNA, 15 bp, Homo sapiens
catctaaagctttat

SEQ ID NO: 3414221 - DNA, 17 bp, Homo sapiens
catctaaagctttatct

SEQ ID NO: 3414222 - DNA, 18 bp, Homo sapiens
catctaaagctttatctt

SEQ ID NO: 3414223 - DNA, 23 bp, Homo sapiens
catctcagtcactttttcccctg

SEQ ID NO: 3414224 - DNA, 21 bp, Homo sapiens
catctccagtatcctgctggt

SEQ ID NO: 3414225 - DNA, 15 bp, Homo sapiens
catctctgtcagtgt

SEQ ID NO: 3414226 - DNA, 16 bp, Homo sapiens
catctctgtcagtgtg

SEQ ID NO: 3414227 - DNA, 18 bp, Homo sapiens
catctctgtcagtgtgaa

SEQ ID NO: 3414228 - DNA, 18 bp, Homo sapiens
catctcttagctcccctc

SEQ ID NO: 3414229 - DNA, 16 bp, Homo sapiens
catctgcctgtaatta

SEQ ID NO: 3414230 - DNA, 15 bp, Homo sapiens
catctgtgtctgtgt

SEQ ID NO: 3414231 - DNA, 14 bp, Homo sapiens
catcttcacttcta

SEQ ID NO: 3414232 - DNA, 22 bp, Homo sapiens
catcttggccctcctcagctcc

SEQ ID NO: 3414233 - DNA, 23 bp, Homo sapiens
catcttggccctcctcagctccc

SEQ ID NO: 3414234 - DNA, 13 bp, Homo sapiens
catctttgtgaag

SEQ ID NO: 3414235 - DNA, 23 bp, Homo sapiens
catgaaaaagcagctaccaggtg

SEQ ID NO: 3414236 - DNA, 22 bp, Homo sapiens
catgaaaatgcaacaacatgta

SEQ ID NO: 3414237 - DNA, 19 bp, Homo sapiens
catgaacaagttagtttct

SEQ ID NO: 3414238 - DNA, 12 bp, Homo sapiens
catgaagaagct

SEQ ID NO: 3414239 - DNA, 14 bp, Homo sapiens
catgaagaagctgg

SEQ ID NO: 3414240 - DNA, 12 bp, Homo sapiens
catgaagctgga

SEQ ID NO: 3414241 - DNA, 18 bp, Homo sapiens
catgaaggtttctgaaaa

SEQ ID NO: 3414242 - DNA, 21 bp, Homo sapiens
catgacaaaagtgacagatgt

SEQ ID NO: 3414243 - DNA, 20 bp, Homo sapiens
catgagtggccttaataaat

SEQ ID NO: 3414244 - DNA, 23 bp, Homo sapiens
catgcaaactgctttattttccc

SEQ ID NO: 3414245 - DNA, 12 bp, Homo sapiens
catgcataaata

SEQ ID NO: 3414246 - DNA, 18 bp, Homo sapiens
catgcataaatatgcagt

SEQ ID NO: 3414247 - DNA, 21 bp, Homo sapiens
catgcctatatgagaagaata

SEQ ID NO: 3414248 - DNA, 20 bp, Homo sapiens
catgctctccaaaccacttt

SEQ ID NO: 3414249 - DNA, 17 bp, Homo sapiens
catggacaatggaccgg

SEQ ID NO: 3414250 - DNA, 20 bp, Homo sapiens
catggacaatggaccggaga

SEQ ID NO: 3414251 - DNA, 19 bp, Homo sapiens
catggattccaaagcattt

SEQ ID NO: 3414252 - DNA, 13 bp, Homo sapiens
catggatttggtt

SEQ ID NO: 3414253 - DNA, 18 bp, Homo sapiens
catgggacctataactgc

SEQ ID NO: 3414254 - DNA, 21 bp, Homo sapiens
catgggcttcactgtataaat

SEQ ID NO: 3414255 - DNA, 23 bp, Homo sapiens
catgggcttcactgtataaatag

SEQ ID NO: 3414256 - DNA, 21 bp, Homo sapiens
catgggggagggggcagaagt

SEQ ID NO: 3414257 - DNA, 21 bp, Homo sapiens
catggtagatttttttcatag

SEQ ID NO: 3414258 - DNA, 13 bp, Homo sapiens
catggtgtaataa

SEQ ID NO: 3414259 - DNA, 14 bp, Homo sapiens
catggtgtaataag

SEQ ID NO: 3414260 - DNA, 18 bp, Homo sapiens
catggtgtaataagacat

SEQ ID NO: 3414261 - DNA, 21 bp, Homo sapiens
catggtgtaataagacataac

SEQ ID NO: 3414262 - DNA, 16 bp, Homo sapiens
catgtaaaatcttcag

SEQ ID NO: 3414263 - DNA, 21 bp, Homo sapiens
catgtaataaaaagtatatgt

SEQ ID NO: 3414264 - DNA, 22 bp, Homo sapiens
catgtaataaaaagtatatgtt

SEQ ID NO: 3414265 - DNA, 20 bp, Homo sapiens
catgtataatatttttaatt

SEQ ID NO: 3414266 - DNA, 15 bp, Homo sapiens
catgtatagctagct

SEQ ID NO: 3414267 - DNA, 20 bp, Homo sapiens
catgtatagttgcttttgaa

SEQ ID NO: 3414268 - DNA, 21 bp, Homo sapiens
catgtatgtggatacagtcat

SEQ ID NO: 3414269 - DNA, 13 bp, Homo sapiens
catgtgaaacctt

SEQ ID NO: 3414270 - DNA, 13 bp, Homo sapiens
catgtgaagaggg

SEQ ID NO: 3414271 - DNA, 15 bp, Homo sapiens
catgtgcaactcttg

SEQ ID NO: 3414272 - DNA, 18 bp, Homo sapiens
catgtgcaactcttgtat

SEQ ID NO: 3414273 - DNA, 19 bp, Homo sapiens
catgtgcaactcttgtatt

SEQ ID NO: 3414274 - DNA, 20 bp, Homo sapiens
catgtgcaactcttgtattg

SEQ ID NO: 3414275 - DNA, 22 bp, Homo sapiens
catgtgctacaggggccagaag

SEQ ID NO: 3414276 - DNA, 17 bp, Homo sapiens
catgtggttaatgccat

SEQ ID NO: 3414277 - DNA, 12 bp, Homo sapiens
catgtgtatata

SEQ ID NO: 3414278 - DNA, 13 bp, Homo sapiens
catgtgtatatat

SEQ ID NO: 3414279 - DNA, 22 bp, Homo sapiens
catgtgtatgagaagtactttg

SEQ ID NO: 3414280 - DNA, 17 bp, Homo sapiens
catgttacttgagaagt

SEQ ID NO: 3414281 - DNA, 12 bp, Homo sapiens
ggggaagatgaa

SEQ ID NO: 3414282 - DNA, 13 bp, Homo sapiens
ggggaggaggagg

SEQ ID NO: 3414283 - DNA, 13 bp, Homo sapiens
ggggctggaggag

SEQ ID NO: 3414284 - DNA, 21 bp, Homo sapiens
ggggctggaggagcccaggcc

SEQ ID NO: 3414285 - DNA, 18 bp, Homo sapiens
gggggtcctcctccaggg

SEQ ID NO: 3414286 - DNA, 19 bp, Homo sapiens
gggggtcctcctccaggga

SEQ ID NO: 3414287 - DNA, 13 bp, Homo sapiens
ggggtagggggct

SEQ ID NO: 3414288 - DNA, 23 bp, Homo sapiens
ggggtctgtgtgtttatgtgtgt

SEQ ID NO: 3414289 - DNA, 12 bp, Homo sapiens
gggtcaaggaat

SEQ ID NO: 3414290 - DNA, 18 bp, Homo sapiens
gggtcattcatggcctgg

SEQ ID NO: 3414291 - DNA, 16 bp, Homo sapiens
gggtcctcctccaggg

SEQ ID NO: 3414292 - DNA, 18 bp, Homo sapiens
gggtgtaacaggtctcct

SEQ ID NO: 3414293 - DNA, 19 bp, Homo sapiens
gggtgtaacaggtctcctc

SEQ ID NO: 3414294 - DNA, 17 bp, Homo sapiens
ggtaaataaagctcaag

SEQ ID NO: 3414295 - DNA, 14 bp, Homo sapiens
ggtaacagaacagc

SEQ ID NO: 3414296 - DNA, 15 bp, Homo sapiens
ggtaacagaacagct

SEQ ID NO: 3414297 - DNA, 17 bp, Homo sapiens
ggtaagagcaaaaagtg

SEQ ID NO: 3414298 - DNA, 13 bp, Homo sapiens
ggtagggggctgg

SEQ ID NO: 3414299 - DNA, 20 bp, Homo sapiens
ggtcaagattttgaatgctt

SEQ ID NO: 3414300 - DNA, 15 bp, Homo sapiens
ggtcggtgccttcaa

SEQ ID NO: 3414301 - DNA, 11 bp, Homo sapiens
ggtctgtgtgt

SEQ ID NO: 3414302 - DNA, 17 bp, Homo sapiens
ggtctgtgtgtgtgtat

SEQ ID NO: 3414303 - DNA, 20 bp, Homo sapiens
ggtctgtgtgtgtgtatgtg

SEQ ID NO: 3414304 - DNA, 23 bp, Homo sapiens
ggtctttaaatcattttaggaaa

SEQ ID NO: 3414305 - DNA, 15 bp, Homo sapiens
ggtctttgtaagagt

SEQ ID NO: 3414306 - DNA, 14 bp, Homo sapiens
ggtggatggtgact

SEQ ID NO: 3414307 - DNA, 15 bp, Homo sapiens
ggtggccctctcccc

SEQ ID NO: 3414308 - DNA, 22 bp, Homo sapiens
ggtggccctctcccctgccccc

SEQ ID NO: 3414309 - DNA, 20 bp, Homo sapiens
ggtgggggtagggggctgga

SEQ ID NO: 3414310 - DNA, 17 bp, Homo sapiens
ggtgtagccctcccact

SEQ ID NO: 3414311 - DNA, 16 bp, Homo sapiens
ggtgtgtgtctctgac

SEQ ID NO: 3414312 - DNA, 17 bp, Homo sapiens
ggtgttgacatgtgctt

SEQ ID NO: 3414313 - DNA, 22 bp, Homo sapiens
ggttaccaaaaatatccctttt

SEQ ID NO: 3414314 - DNA, 14 bp, Homo sapiens
ggttatgatggaaa

SEQ ID NO: 3414315 - DNA, 22 bp, Homo sapiens
ggttggaaaagaaatcaatttt

SEQ ID NO: 3414316 - DNA, 13 bp, Homo sapiens
ggtttaatattac

SEQ ID NO: 3414317 - DNA, 18 bp, Homo sapiens
ggtttacaacaaacactg

SEQ ID NO: 3414318 - DNA, 18 bp, Homo sapiens
ggtttctcattaaactct

SEQ ID NO: 3414319 - DNA, 15 bp, Homo sapiens
ggtttgaatataaac

SEQ ID NO: 3414320 - DNA, 18 bp, Homo sapiens
ggtttgaatataaacact

SEQ ID NO: 3414321 - DNA, 17 bp, Homo sapiens
ggtttgccggtggtgca

SEQ ID NO: 3414322 - DNA, 22 bp, Homo sapiens
ggtttgttattcttttccagaa

SEQ ID NO: 3414323 - DNA, 19 bp, Homo sapiens
ggttttgttcccctcctcc

SEQ ID NO: 3414324 - DNA, 22 bp, Homo sapiens
ggttttgttcccctcctccact

SEQ ID NO: 3414325 - DNA, 20 bp, Homo sapiens
gtaaaaaaaaatgcctttga

SEQ ID NO: 3414326 - DNA, 18 bp, Homo sapiens
gtaaaatcttcagctggt

SEQ ID NO: 3414327 - DNA, 15 bp, Homo sapiens
gtaaacttgtgtatt

SEQ ID NO: 3414328 - DNA, 14 bp, Homo sapiens
gtaaagtccccaga

SEQ ID NO: 3414329 - DNA, 13 bp, Homo sapiens
gtaaataaagctc

SEQ ID NO: 3414330 - DNA, 23 bp, Homo sapiens
gtaaatgaagggtcatttctctt

SEQ ID NO: 3414331 - DNA, 13 bp, Homo sapiens
gtaaatttggctt

SEQ ID NO: 3414332 - DNA, 15 bp, Homo sapiens
gtaaatttggcttct

SEQ ID NO: 3414333 - DNA, 16 bp, Homo sapiens
gtaaatttggcttctg

SEQ ID NO: 3414334 - DNA, 15 bp, Homo sapiens
gtaacagaacagctt

SEQ ID NO: 3414335 - DNA, 19 bp, Homo sapiens
gtaagaaagccaccttgtt

SEQ ID NO: 3414336 - DNA, 14 bp, Homo sapiens
gtaagagtgtagaa

SEQ ID NO: 3414337 - DNA, 15 bp, Homo sapiens
gtaagagtgtagaag

SEQ ID NO: 3414338 - DNA, 18 bp, Homo sapiens
gtaagcagagttctttgc

SEQ ID NO: 3414339 - DNA, 20 bp, Homo sapiens
gtaagcttagattttctgta

SEQ ID NO: 3414340 - DNA, 18 bp, Homo sapiens
gtaaggctgtacatagtc

SEQ ID NO: 3414341 - DNA, 16 bp, Homo sapiens
gtaagtataacaaact

SEQ ID NO: 3414342 - DNA, 14 bp, Homo sapiens
gtaataaaaagaga

SEQ ID NO: 3414343 - DNA, 19 bp, Homo sapiens
gtaataagacataacgttt

SEQ ID NO: 3414344 - DNA, 23 bp, Homo sapiens
gtaataagacataacgtttttcc

SEQ ID NO: 3414345 - DNA, 13 bp, Homo sapiens
gtaatatgagaat

SEQ ID NO: 3414346 - DNA, 19 bp, Homo sapiens
gtaatattctctgatgttt

SEQ ID NO: 3414347 - DNA, 14 bp, Homo sapiens
gtaatatttcttca

SEQ ID NO: 3414348 - DNA, 16 bp, Homo sapiens
gtaattccacatcatg

SEQ ID NO: 3414349 - DNA, 18 bp, Homo sapiens
gtaattccacatcatgtt

SEQ ID NO: 3414350 - DNA, 16 bp, Homo sapiens
gtacaataaaagtaaa

SEQ ID NO: 3414351 - DNA, 17 bp, Homo sapiens
gtacagtctcaattttg

SEQ ID NO: 3414352 - DNA, 22 bp, Homo sapiens
gtacagtctcaattttgtattt

SEQ ID NO: 3414353 - DNA, 14 bp, Homo sapiens
gtacatagtccttt

SEQ ID NO: 3414354 - DNA, 18 bp, Homo sapiens
gtacatttatgatttaat

SEQ ID NO: 3414355 - DNA, 22 bp, Homo sapiens
gtactaggatactgctgcgtca

SEQ ID NO: 3414356 - DNA, 22 bp, Homo sapiens
gtactttgtgtttagctacctt

SEQ ID NO: 3414357 - DNA, 18 bp, Homo sapiens
gtagaaagacatctgcct

SEQ ID NO: 3414358 - DNA, 19 bp, Homo sapiens
gtagaaagacatctgcctg

SEQ ID NO: 3414359 - DNA, 20 bp, Homo sapiens
gtagaaagacatctgcctgt

SEQ ID NO: 3414360 - DNA, 21 bp, Homo sapiens
gtagaaagacatctgcctgta

SEQ ID NO: 3414361 - DNA, 15 bp, Homo sapiens
gtagaagcattcctt

SEQ ID NO: 3414362 - DNA, 19 bp, Homo sapiens
gtagacctgtctcctggcg

SEQ ID NO: 3414363 - DNA, 21 bp, Homo sapiens
gtagacctgtctcctggcggt

SEQ ID NO: 3414364 - DNA, 18 bp, Homo sapiens
gtagactatggaatgtca

SEQ ID NO: 3414365 - DNA, 12 bp, Homo sapiens
gtagagttaaga

SEQ ID NO: 3414366 - DNA, 14 bp, Homo sapiens
gtagagttaagaag

SEQ ID NO: 3414367 - DNA, 16 bp, Homo sapiens
gtagagttaagaagct

SEQ ID NO: 3414368 - DNA, 18 bp, Homo sapiens
gtagagttaagaagctgt

SEQ ID NO: 3414369 - DNA, 21 bp, Homo sapiens
gtagatgtgcatttttgtgaa

SEQ ID NO: 3414370 - DNA, 16 bp, Homo sapiens
gtaggcacttttattt

SEQ ID NO: 3414371 - DNA, 14 bp, Homo sapiens
gtaggttgggagaa

SEQ ID NO: 3414372 - DNA, 16 bp, Homo sapiens
gtagtcacctctgggc

SEQ ID NO: 3414373 - DNA, 18 bp, Homo sapiens
gtagtttttaattaaaaa

SEQ ID NO: 3414374 - DNA, 13 bp, Homo sapiens
gtataaataggag

SEQ ID NO: 3414375 - DNA, 15 bp, Homo sapiens
gtataacaaactatg

SEQ ID NO: 3414376 - DNA, 18 bp, Homo sapiens
gtataacaaactatgtaa

SEQ ID NO: 3414377 - DNA, 14 bp, Homo sapiens
gtataacaattaaa

SEQ ID NO: 3414378 - DNA, 12 bp, Homo sapiens
gtataatatttt

SEQ ID NO: 3414379 - DNA, 16 bp, Homo sapiens
gtataatttagtccct

SEQ ID NO: 3414380 - DNA, 13 bp, Homo sapiens
gtatagttgcttt

SEQ ID NO: 3414381 - DNA, 18 bp, Homo sapiens
gtatatttagttacgtat

SEQ ID NO: 3414382 - DNA, 14 bp, Homo sapiens
gtatccttcattgt

SEQ ID NO: 3414383 - DNA, 19 bp, Homo sapiens
gtatctgcatgtaaaatct

SEQ ID NO: 3414384 - DNA, 20 bp, Homo sapiens
gtatctgcatgtaaaatctt

SEQ ID NO: 3414385 - DNA, 14 bp, Homo sapiens
gtatgactaaagag

SEQ ID NO: 3414386 - DNA, 20 bp, Homo sapiens
gtatgcaagtgggagatgaa

SEQ ID NO: 3414387 - DNA, 15 bp, Homo sapiens
gtatgtacagttcat

SEQ ID NO: 3414388 - DNA, 20 bp, Homo sapiens
gtatgtacagttcataaatt

SEQ ID NO: 3414389 - DNA, 15 bp, Homo sapiens
gtatgtatataatca

SEQ ID NO: 3414390 - DNA, 23 bp, Homo sapiens
gtatgtatataatcatgctcatg

SEQ ID NO: 3414391 - DNA, 14 bp, Homo sapiens
gtatgtattaaact

SEQ ID NO: 3414392 - DNA, 16 bp, Homo sapiens
gtatgtccttcagctg

SEQ ID NO: 3414393 - DNA, 15 bp, Homo sapiens
gtatgtggaagtgtg

SEQ ID NO: 3414394 - DNA, 19 bp, Homo sapiens
gtatgtgggggtctgtgtg

SEQ ID NO: 3414395 - DNA, 21 bp, Homo sapiens
gtattaactctgtaaaagtgt

SEQ ID NO: 3414396 - DNA, 20 bp, Homo sapiens
gtattagccagtcattgtaa

SEQ ID NO: 3414397 - DNA, 18 bp, Homo sapiens
gtattcaccctgggcagt

SEQ ID NO: 3414398 - DNA, 22 bp, Homo sapiens
gtattcagtgagggtcttctta

SEQ ID NO: 3414399 - DNA, 20 bp, Homo sapiens
gtattcttaaaatgcaatat

SEQ ID NO: 3414400 - DNA, 13 bp, Homo sapiens
gtattgcttcctg

SEQ ID NO: 3414401 - DNA, 20 bp, Homo sapiens
gtattgttctgtttgtgtta

SEQ ID NO: 3414402 - DNA, 22 bp, Homo sapiens
gtatttaactacatctgcctcg

SEQ ID NO: 3414403 - DNA, 23 bp, Homo sapiens
gtatttaatgatttttgtgtatc

SEQ ID NO: 3414404 - DNA, 19 bp, Homo sapiens
gtatttagactgtggccat

SEQ ID NO: 3414405 - DNA, 14 bp, Homo sapiens
gtatttcagtattt

SEQ ID NO: 3414406 - DNA, 19 bp, Homo sapiens
gtatttctttgtagaataa

SEQ ID NO: 3414407 - DNA, 14 bp, Homo sapiens
gtatttgttaatgg

SEQ ID NO: 3414408 - DNA, 10 bp, Homo sapiens
gtatttttaa

SEQ ID NO: 3414409 - DNA, 22 bp, Homo sapiens
gtatttttaaaaaacaattggt

SEQ ID NO: 3414410 - DNA, 21 bp, Homo sapiens
gtcaacgagacgtttcctacc

SEQ ID NO: 3414411 - DNA, 18 bp, Homo sapiens
gtcaactttcatttgaaa

SEQ ID NO: 3414412 - DNA, 15 bp, Homo sapiens
gtcaagtaataaaaa

SEQ ID NO: 3414413 - DNA, 15 bp, Homo sapiens
gtcaattcagtgatg

SEQ ID NO: 3414414 - DNA, 18 bp, Homo sapiens
gtcactttttcccctgca

SEQ ID NO: 3414415 - DNA, 20 bp, Homo sapiens
gtcactttttcccctgcaat

SEQ ID NO: 3414416 - DNA, 13 bp, Homo sapiens
gtcagccagggcc

SEQ ID NO: 3414417 - DNA, 14 bp, Homo sapiens
gtcagccagggcct

SEQ ID NO: 3414418 - DNA, 16 bp, Homo sapiens
gtcagccagggcctgc

SEQ ID NO: 3414419 - DNA, 19 bp, Homo sapiens
gtcagctcaggcagctcga

SEQ ID NO: 3414420 - DNA, 13 bp, Homo sapiens
gtcagtttctaca

SEQ ID NO: 3414421 - DNA, 14 bp, Homo sapiens
gtcatagattcttg

SEQ ID NO: 3414422 - DNA, 16 bp, Homo sapiens
gtcatagattcttgag

SEQ ID NO: 3414423 - DNA, 14 bp, Homo sapiens
gtcatgcataaata

SEQ ID NO: 3414424 - DNA, 13 bp, Homo sapiens
gtccattattcat

SEQ ID NO: 3414425 - DNA, 13 bp, Homo sapiens
gtcccacctggct

SEQ ID NO: 3414426 - DNA, 16 bp, Homo sapiens
gtcccacctggctccc

SEQ ID NO: 3414427 - DNA, 12 bp, Homo sapiens
gtcccagtgaac

SEQ ID NO: 3414428 - DNA, 12 bp, Homo sapiens
gtccccagagaa

SEQ ID NO: 3414429 - DNA, 21 bp, Homo sapiens
gtcccctctgccccaccctca

SEQ ID NO: 3414430 - DNA, 14 bp, Homo sapiens
gtccccttctctca

SEQ ID NO: 3414431 - DNA, 18 bp, Homo sapiens
gtccccttctctcatctc

SEQ ID NO: 3414432 - DNA, 20 bp, Homo sapiens
gtccccttctctcatctctt

SEQ ID NO: 3414433 - DNA, 16 bp, Homo sapiens
gtccctgaagagaagg

SEQ ID NO: 3414434 - DNA, 12 bp, Homo sapiens
gtccctgctagt

SEQ ID NO: 3414435 - DNA, 13 bp, Homo sapiens
gtcccttgccccc

SEQ ID NO: 3414436 - DNA, 15 bp, Homo sapiens
gtcccttgcccccct

SEQ ID NO: 3414437 - DNA, 19 bp, Homo sapiens
gtcccttgcccccctggcc

SEQ ID NO: 3414438 - DNA, 15 bp, Homo sapiens
gtcctatgcaataaa

SEQ ID NO: 3414439 - DNA, 16 bp, Homo sapiens
gtcctatgcaataaaa

SEQ ID NO: 3414440 - DNA, 17 bp, Homo sapiens
gtcctcctccagggaca

SEQ ID NO: 3414441 - DNA, 20 bp, Homo sapiens
gtcctcctccagggacagca

SEQ ID NO: 3414442 - DNA, 16 bp, Homo sapiens
gtccttgaatgccata

SEQ ID NO: 3414443 - DNA, 17 bp, Homo sapiens
gtccttttatctccttg

SEQ ID NO: 3414444 - DNA, 12 bp, Homo sapiens
gtctagtagaac

SEQ ID NO: 3414445 - DNA, 16 bp, Homo sapiens
gtctcaattttgtatt

SEQ ID NO: 3414446 - DNA, 17 bp, Homo sapiens
gtctcaattttgtattt

SEQ ID NO: 3414447 - DNA, 18 bp, Homo sapiens
gtctcaattttgtattta

SEQ ID NO: 3414448 - DNA, 19 bp, Homo sapiens
gtctcacactgtttttcat

SEQ ID NO: 3414449 - DNA, 22 bp, Homo sapiens
gtctcctcttaaaaaataaaaa

SEQ ID NO: 3414450 - DNA, 22 bp, Homo sapiens
gtctgaaaggctatcctgctga

SEQ ID NO: 3414451 - DNA, 16 bp, Homo sapiens
gtctgtatcactctgt

SEQ ID NO: 3414452 - DNA, 16 bp, Homo sapiens
gtctgtgtgtgtgtat

SEQ ID NO: 3414453 - DNA, 23 bp, Homo sapiens
gtctgttttgtaaagtccccaga

SEQ ID NO: 3414454 - DNA, 19 bp, Homo sapiens
gtcttaactgtatttcagt

SEQ ID NO: 3414455 - DNA, 15 bp, Homo sapiens
gtcttagttgatatt

SEQ ID NO: 3414456 - DNA, 12 bp, Homo sapiens
gtcttgtgaaat

SEQ ID NO: 3414457 - DNA, 14 bp, Homo sapiens
gtcttgtgaaattg

SEQ ID NO: 3414458 - DNA, 16 bp, Homo sapiens
gtcttgtgaaattgtg

SEQ ID NO: 3414459 - DNA, 17 bp, Homo sapiens
gtcttgtgaaattgtgt

SEQ ID NO: 3414460 - DNA, 14 bp, Homo sapiens
gtctttgtaagagt

SEQ ID NO: 3414461 - DNA, 19 bp, Homo sapiens
gtgaaaaagatattttatt

SEQ ID NO: 3414462 - DNA, 13 bp, Homo sapiens
gtgaaaccttttt

SEQ ID NO: 3414463 - DNA, 18 bp, Homo sapiens
gtgaaaccttttttaaga

SEQ ID NO: 3414464 - DNA, 22 bp, Homo sapiens
gtgaaaccttttttaagatttt

SEQ ID NO: 3414465 - DNA, 20 bp, Homo sapiens
gtgaaagcatcacttgggat

SEQ ID NO: 3414466 - DNA, 14 bp, Homo sapiens
gtgaataaagtgct

SEQ ID NO: 3414467 - DNA, 16 bp, Homo sapiens
gtgaatttaagcatga

SEQ ID NO: 3414468 - DNA, 20 bp, Homo sapiens
gtgaatttgagtttgctgtt

SEQ ID NO: 3414469 - DNA, 18 bp, Homo sapiens
gtgacataattgtccagt

SEQ ID NO: 3414470 - DNA, 17 bp, Homo sapiens
gtgacatgtgaaacctt

SEQ ID NO: 3414471 - DNA, 14 bp, Homo sapiens
gtgacttttgaaga

SEQ ID NO: 3414472 - DNA, 15 bp, Homo sapiens
gtgaggatgtctggg

SEQ ID NO: 3414473 - DNA, 14 bp, Homo sapiens
gtgagtggcatgtg

SEQ ID NO: 3414474 - DNA, 16 bp, Homo sapiens
gtgatctcgactcccc

SEQ ID NO: 3414475 - DNA, 16 bp, Homo sapiens
gtgatgaaatatgaaa

SEQ ID NO: 3414476 - DNA, 16 bp, Homo sapiens
gtgatggtgtagccct

SEQ ID NO: 3414477 - DNA, 18 bp, Homo sapiens
gtgatgttgggaagctat

SEQ ID NO: 3414478 - DNA, 18 bp, Homo sapiens
gtgcaactcttgtattgc

SEQ ID NO: 3414479 - DNA, 21 bp, Homo sapiens
gtgcacaaagtggcataaaaa

SEQ ID NO: 3414480 - DNA, 15 bp, Homo sapiens
gtgcacccagaagaa

SEQ ID NO: 3414481 - DNA, 16 bp, Homo sapiens
gtgcagatcacttttt

SEQ ID NO: 3414482 - DNA, 22 bp, Homo sapiens
gtgcatgaaggtttctgaaaat

SEQ ID NO: 3414483 - DNA, 22 bp, Homo sapiens
gtgcatttttgtgaaatgaaaa

SEQ ID NO: 3414484 - DNA, 12 bp, Homo sapiens
gtgccaattttg

SEQ ID NO: 3414485 - DNA, 21 bp, Homo sapiens
gtgccaggatggaatgatggg

SEQ ID NO: 3414486 - DNA, 19 bp, Homo sapiens
gtgcccctgtcccacctgg

SEQ ID NO: 3414487 - DNA, 15 bp, Homo sapiens
gtgcctccctggtga

SEQ ID NO: 3414488 - DNA, 13 bp, Homo sapiens
gtgcgtgtgtaga

SEQ ID NO: 3414489 - DNA, 19 bp, Homo sapiens
gtgcttaacgttttcttaa

SEQ ID NO: 3414490 - DNA, 17 bp, Homo sapiens
gtggagaagccacaggc

SEQ ID NO: 3414491 - DNA, 20 bp, Homo sapiens
gtggagaagccacaggcctg

SEQ ID NO: 3414492 - DNA, 14 bp, Homo sapiens
gtggaggaaggatt

SEQ ID NO: 3414493 - DNA, 19 bp, Homo sapiens
gtggaggaaggattgtaaa

SEQ ID NO: 3414494 - DNA, 16 bp, Homo sapiens
gtggatggtgactttt

SEQ ID NO: 3414495 - DNA, 22 bp, Homo sapiens
gtggatgtctctgacaaagtgt

SEQ ID NO: 3414496 - DNA, 21 bp, Homo sapiens
gtggattttggttttgttccc

SEQ ID NO: 3414497 - DNA, 14 bp, Homo sapiens
gtggccctctcccc

SEQ ID NO: 3414498 - DNA, 17 bp, Homo sapiens
gtggccctctcccctgc

SEQ ID NO: 3414499 - DNA, 18 bp, Homo sapiens
gtggccctctcccctgcc

SEQ ID NO: 3414500 - DNA, 11 bp, Homo sapiens
gtggcctatga

SEQ ID NO: 3414501 - DNA, 15 bp, Homo sapiens
gtggcctatgaaact

SEQ ID NO: 3414502 - DNA, 16 bp, Homo sapiens
gtggcttcactcctgc

SEQ ID NO: 3414503 - DNA, 17 bp, Homo sapiens
gtggcttcactcctgct

SEQ ID NO: 3414504 - DNA, 23 bp, Homo sapiens
gtggcttcactcctgctgtaaat

SEQ ID NO: 3414505 - DNA, 19 bp, Homo sapiens
gtgggggtagggggctgga

SEQ ID NO: 3414506 - DNA, 17 bp, Homo sapiens
gtgggttgtgatattga

SEQ ID NO: 3414507 - DNA, 14 bp, Homo sapiens
gtggtgtggagaag

SEQ ID NO: 3414508 - DNA, 22 bp, Homo sapiens
gtggtgtggagaagccacaggc

SEQ ID NO: 3414509 - DNA, 15 bp, Homo sapiens
gtgtaataagacata

SEQ ID NO: 3414510 - DNA, 18 bp, Homo sapiens
gtgtaattccacatcatg

SEQ ID NO: 3414511 - DNA, 20 bp, Homo sapiens
gtgtaatttaaaattgtgat

SEQ ID NO: 3414512 - DNA, 21 bp, Homo sapiens
gtgtactcccagggcttacgg

SEQ ID NO: 3414513 - DNA, 15 bp, Homo sapiens
gtgtatgactaaaga

SEQ ID NO: 3414514 - DNA, 21 bp, Homo sapiens
gtgtatgtgggggtctgtgtg

SEQ ID NO: 3414515 - DNA, 20 bp, Homo sapiens
gtgtattgagtcttaactgt

SEQ ID NO: 3414516 - DNA, 19 bp, Homo sapiens
gtgtatttccagtgcaatt

SEQ ID NO: 3414517 - DNA, 15 bp, Homo sapiens
gtgtcaactttcatt

SEQ ID NO: 3414518 - DNA, 16 bp, Homo sapiens
gtgtcaactttcattt

SEQ ID NO: 3414519 - DNA, 22 bp, Homo sapiens
gtgtcaactttcatttgaaagt

SEQ ID NO: 3414520 - DNA, 14 bp, Homo sapiens
gtgtcagctcaggc

SEQ ID NO: 3414521 - DNA, 23 bp, Homo sapiens
gtgtccatcatattaaaaatata

SEQ ID NO: 3414522 - DNA, 16 bp, Homo sapiens
gtgtctcaaaaataat

SEQ ID NO: 3414523 - DNA, 17 bp, Homo sapiens
gtgtctccaacccccca

SEQ ID NO: 3414524 - DNA, 19 bp, Homo sapiens
gtgtctccaaccccccagc

SEQ ID NO: 3414525 - DNA, 14 bp, Homo sapiens
gtgtctgcaacatg

SEQ ID NO: 3414526 - DNA, 23 bp, Homo sapiens
gtgtgcaactaactgactctgtt

SEQ ID NO: 3414527 - DNA, 22 bp, Homo sapiens
gtgtggagaagccacaggcctg

SEQ ID NO: 3414528 - DNA, 13 bp, Homo sapiens
gtgtggccaggct

SEQ ID NO: 3414529 - DNA, 14 bp, Homo sapiens
gtgtgggtctgtgt

SEQ ID NO: 3414530 - DNA, 14 bp, Homo sapiens
gtgtgtaatttaaa

SEQ ID NO: 3414531 - DNA, 12 bp, Homo sapiens
gtgtgtatgtgg

SEQ ID NO: 3414532 - DNA, 15 bp, Homo sapiens
gtgtgtatgtggggg

SEQ ID NO: 3414533 - DNA, 12 bp, Homo sapiens
gtgtgtctctga

SEQ ID NO: 3414534 - DNA, 17 bp, Homo sapiens
gtgtgtgttgtgtgtgg

SEQ ID NO: 3414535 - DNA, 14 bp, Homo sapiens
gtgtgttgtgtgtg

SEQ ID NO: 3414536 - DNA, 17 bp, Homo sapiens
gtgtgttgtgtgtggga

SEQ ID NO: 3414537 - DNA, 14 bp, Homo sapiens
gtgtgtttatgtgt

SEQ ID NO: 3414538 - DNA, 16 bp, Homo sapiens
gtgttaatcatttcat

SEQ ID NO: 3414539 - DNA, 19 bp, Homo sapiens
gtgttatgtgaatttgagt

SEQ ID NO: 3414540 - DNA, 22 bp, Homo sapiens
gtgttcagccaaacagtatgat

SEQ ID NO: 3414541 - DNA, 15 bp, Homo sapiens
gtgttgaaaaatatc

SEQ ID NO: 3414542 - DNA, 17 bp, Homo sapiens
gtgttgacgtaagctct

SEQ ID NO: 3414543 - DNA, 15 bp, Homo sapiens
gtgtttttaactcaa

SEQ ID NO: 3414544 - DNA, 13 bp, Homo sapiens
gttaaatcatttg

SEQ ID NO: 3414545 - DNA, 13 bp, Homo sapiens
gttaaatttgtaa

SEQ ID NO: 3414546 - DNA, 14 bp, Homo sapiens
gttaaatttgtaag

SEQ ID NO: 3414547 - DNA, 16 bp, Homo sapiens
gttaaatttgtaagtt

SEQ ID NO: 3414548 - DNA, 19 bp, Homo sapiens
gttaaatttgtaagtttca

SEQ ID NO: 3414549 - DNA, 13 bp, Homo sapiens
gttaagaaatacc

SEQ ID NO: 3414550 - DNA, 15 bp, Homo sapiens
gttaagaagctgttg

SEQ ID NO: 3414551 - DNA, 12 bp, Homo sapiens
gttaaggaaact

SEQ ID NO: 3414552 - DNA, 17 bp, Homo sapiens
gttacacagtgtgaata

SEQ ID NO: 3414553 - DNA, 13 bp, Homo sapiens
gttacatgaatta

SEQ ID NO: 3414554 - DNA, 14 bp, Homo sapiens
gttacatgaattaa

SEQ ID NO: 3414555 - DNA, 17 bp, Homo sapiens
gttaccaaaaatatccc

SEQ ID NO: 3414556 - DNA, 20 bp, Homo sapiens
gttaccaagtatgaagtata

SEQ ID NO: 3414557 - DNA, 17 bp, Homo sapiens
gttacgtataatgcttt

SEQ ID NO: 3414558 - DNA, 14 bp, Homo sapiens
gttactatctgctt

SEQ ID NO: 3414559 - DNA, 17 bp, Homo sapiens
gttatcgaaataacaat

SEQ ID NO: 3414560 - DNA, 18 bp, Homo sapiens
gttatcgaaataacaatg

SEQ ID NO: 3414561 - DNA, 13 bp, Homo sapiens
gttcactcttctc

SEQ ID NO: 3414562 - DNA, 23 bp, Homo sapiens
gttcatccaaggaacctaattga

SEQ ID NO: 3414563 - DNA, 19 bp, Homo sapiens
gttccctcattctgcatta

SEQ ID NO: 3414564 - DNA, 12 bp, Homo sapiens
gttccttgcttt

SEQ ID NO: 3414565 - DNA, 18 bp, Homo sapiens
gttcggatttggggtgga

SEQ ID NO: 3414566 - DNA, 16 bp, Homo sapiens
gttctcatctttcttg

SEQ ID NO: 3414567 - DNA, 17 bp, Homo sapiens
gttgaaaaaagaagttt

SEQ ID NO: 3414568 - DNA, 19 bp, Homo sapiens
gttgaactgcaggaagaga

SEQ ID NO: 3414569 - DNA, 23 bp, Homo sapiens
gttgatattcaaggctttaaaag

SEQ ID NO: 3414570 - DNA, 21 bp, Homo sapiens
gttgatggtagggtataatgt

SEQ ID NO: 3414571 - DNA, 23 bp, Homo sapiens
gttgcagccctgctgctgcctgc

SEQ ID NO: 3414572 - DNA, 21 bp, Homo sapiens
gttgcataaacaatccaaatg

SEQ ID NO: 3414573 - DNA, 12 bp, Homo sapiens
gttggaaaagaa

SEQ ID NO: 3414574 - DNA, 14 bp, Homo sapiens
gttgggagaatgtc

SEQ ID NO: 3414575 - DNA, 18 bp, Homo sapiens
gttgtacatttatgattt

SEQ ID NO: 3414576 - DNA, 20 bp, Homo sapiens
gttgtacatttatgatttaa

SEQ ID NO: 3414577 - DNA, 16 bp, Homo sapiens
gttgtagactatggaa

SEQ ID NO: 3414578 - DNA, 16 bp, Homo sapiens
gttgtatataaagttt

SEQ ID NO: 3414579 - DNA, 18 bp, Homo sapiens
gttgtatcagcacgtgtg

SEQ ID NO: 3414580 - DNA, 15 bp, Homo sapiens
gttgtcatgtgtatg

SEQ ID NO: 3414581 - DNA, 12 bp, Homo sapiens
gttgtctttctt

SEQ ID NO: 3414582 - DNA, 12 bp, Homo sapiens
gttgtgtgtggg

SEQ ID NO: 3414583 - DNA, 13 bp, Homo sapiens
gttgtgtgtggga

SEQ ID NO: 3414584 - DNA, 22 bp, Homo sapiens
gttgtgtgtgggagtgtgtaat

SEQ ID NO: 3414585 - DNA, 11 bp, Homo sapiens
gttgtttcttt

SEQ ID NO: 3414586 - DNA, 20 bp, Homo sapiens
gtttaacttgtctttttgtt

SEQ ID NO: 3414587 - DNA, 21 bp, Homo sapiens
gtttaagggtggaaaaatgcc

SEQ ID NO: 3414588 - DNA, 21 bp, Homo sapiens
gtttaatattacctaatgaaa

SEQ ID NO: 3414589 - DNA, 15 bp, Homo sapiens
gtttacaacaaacac

SEQ ID NO: 3414590 - DNA, 23 bp, Homo sapiens
gtttatatattgaaagttgcttt

SEQ ID NO: 3414591 - DNA, 16 bp, Homo sapiens
gtttcaggtgacatgt

SEQ ID NO: 3414592 - DNA, 20 bp, Homo sapiens
gtttcaggtgacatgtgaaa

SEQ ID NO: 3414593 - DNA, 17 bp, Homo sapiens
gtttctcccccatgttc

SEQ ID NO: 3414594 - DNA, 15 bp, Homo sapiens
gtttctcctgagcta

SEQ ID NO: 3414595 - DNA, 18 bp, Homo sapiens
gtttctcctgagctagga

SEQ ID NO: 3414596 - DNA, 18 bp, Homo sapiens
gtttctttctagtggtct

SEQ ID NO: 3414597 - DNA, 23 bp, Homo sapiens
gtttgcggggcttttaaaaggaa

SEQ ID NO: 3414598 - DNA, 22 bp, Homo sapiens
gtttgcttttttttttttgctt

SEQ ID NO: 3414599 - DNA, 21 bp, Homo sapiens
gtttgggggttaccaaaaata

SEQ ID NO: 3414600 - DNA, 22 bp, Homo sapiens
gtttgtgagctttttgttccct

SEQ ID NO: 3414601 - DNA, 20 bp, Homo sapiens
gttttaaattgcatttctat

SEQ ID NO: 3414602 - DNA, 21 bp, Homo sapiens
gttttaaattgcatttctatg

SEQ ID NO: 3414603 - DNA, 19 bp, Homo sapiens
gttttaatttatactggca

SEQ ID NO: 3414604 - DNA, 21 bp, Homo sapiens
gttttaatttatactggcatg

SEQ ID NO: 3414605 - DNA, 22 bp, Homo sapiens
gttttaatttatactggcatgc

SEQ ID NO: 3414606 - DNA, 15 bp, Homo sapiens
gttttatttacattt

SEQ ID NO: 3414607 - DNA, 18 bp, Homo sapiens
gttttcttaaatgttttc

SEQ ID NO: 3414608 - DNA, 21 bp, Homo sapiens
gttttgaaaagctattagcca

SEQ ID NO: 3414609 - DNA, 16 bp, Homo sapiens
gttttggggactcatt

SEQ ID NO: 3414610 - DNA, 15 bp, Homo sapiens
gttttgtattgcttc

SEQ ID NO: 3414611 - DNA, 20 bp, Homo sapiens
gttttgttcccctcctccac

SEQ ID NO: 3414612 - DNA, 13 bp, Homo sapiens
gtttttaatagaa

SEQ ID NO: 3414613 - DNA, 20 bp, Homo sapiens
gtttttgttgagtctctgaa

SEQ ID NO: 3414614 - DNA, 22 bp, Homo sapiens
gtttttgttgagtctctgaaca

SEQ ID NO: 3414615 - DNA, 22 bp, Homo sapiens
gtttttttccctctcctgtcct

SEQ ID NO: 3414616 - DNA, 17 bp, Homo sapiens
gtttttttttttccaga

SEQ ID NO: 3414617 - DNA, 18 bp, Homo sapiens
taaaaaaaaaaagattgt

SEQ ID NO: 3414618 - DNA, 16 bp, Homo sapiens
taaaaaaaaatgcctt

SEQ ID NO: 3414619 - DNA, 12 bp, Homo sapiens
taaaaaaattta

SEQ ID NO: 3414620 - DNA, 23 bp, Homo sapiens
taaaaaatgtgtgtattcttaaa

SEQ ID NO: 3414621 - DNA, 16 bp, Homo sapiens
taaaaactgactcctt

SEQ ID NO: 3414622 - DNA, 17 bp, Homo sapiens
taaaaactgactcctta

SEQ ID NO: 3414623 - DNA, 15 bp, Homo sapiens
taaaaactttaaaga

SEQ ID NO: 3414624 - DNA, 20 bp, Homo sapiens
taaaaaggagaatttttcct

SEQ ID NO: 3414625 - DNA, 22 bp, Homo sapiens
taaaaataaagctactgaattt

SEQ ID NO: 3414626 - DNA, 14 bp, Homo sapiens
taaaagacaaacac

SEQ ID NO: 3414627 - DNA, 19 bp, Homo sapiens
taaaagagacaaactgtaa

SEQ ID NO: 3414628 - DNA, 16 bp, Homo sapiens
taaaagatcttgcaga

SEQ ID NO: 3414629 - DNA, 13 bp, Homo sapiens
taaaaggaaaacc

SEQ ID NO: 3414630 - DNA, 23 bp, Homo sapiens
taaaaggaaaaccgaattaggtc

SEQ ID NO: 3414631 - DNA, 20 bp, Homo sapiens
taaaagtttgtcctttaact

SEQ ID NO: 3414632 - DNA, 14 bp, Homo sapiens
taaaatcataacat

SEQ ID NO: 3414633 - DNA, 15 bp, Homo sapiens
taaaatcttcagctg

SEQ ID NO: 3414634 - DNA, 17 bp, Homo sapiens
taaaatcttcagctggt

SEQ ID NO: 3414635 - DNA, 20 bp, Homo sapiens
taaaatcttcagctggtgga

SEQ ID NO: 3414636 - DNA, 19 bp, Homo sapiens
taaaatgttggtgcaatta

SEQ ID NO: 3414637 - DNA, 14 bp, Homo sapiens
taaaattatttgca

SEQ ID NO: 3414638 - DNA, 22 bp, Homo sapiens
taaaattttttacttttaacta

SEQ ID NO: 3414639 - DNA, 12 bp, Homo sapiens
taaacaaatgta

SEQ ID NO: 3414640 - DNA, 15 bp, Homo sapiens
taaacatctgtgtct

SEQ ID NO: 3414641 - DNA, 17 bp, Homo sapiens
taaactagtttaagggt

SEQ ID NO: 3414642 - DNA, 13 bp, Homo sapiens
taaactcacatag

SEQ ID NO: 3414643 - DNA, 23 bp, Homo sapiens
taaactcctactgcttcctctga

SEQ ID NO: 3414644 - DNA, 17 bp, Homo sapiens
taaagaaaatgtgtctg

SEQ ID NO: 3414645 - DNA, 13 bp, Homo sapiens
taaagctactgaa

SEQ ID NO: 3414646 - DNA, 14 bp, Homo sapiens
taaagctactgaat

SEQ ID NO: 3414647 - DNA, 16 bp, Homo sapiens
taaagctactgaattt

SEQ ID NO: 3414648 - DNA, 17 bp, Homo sapiens
taaagctttatctttgt

SEQ ID NO: 3414649 - DNA, 19 bp, Homo sapiens
taaagctttatctttgtgt

SEQ ID NO: 3414650 - DNA, 16 bp, Homo sapiens
taaaggacaaacagtg

SEQ ID NO: 3414651 - DNA, 19 bp, Homo sapiens
taaaggacaaacagtgaat

SEQ ID NO: 3414652 - DNA, 12 bp, Homo sapiens
taaagtgcatta

SEQ ID NO: 3414653 - DNA, 11 bp, Homo sapiens
taaataaagct

SEQ ID NO: 3414654 - DNA, 14 bp, Homo sapiens
taaataatctacat

SEQ ID NO: 3414655 - DNA, 13 bp, Homo sapiens
taaatagaacttg

SEQ ID NO: 3414656 - DNA, 21 bp, Homo sapiens
taaatatagttgtctttcttt

SEQ ID NO: 3414657 - DNA, 21 bp, Homo sapiens
taaatctgaattttaaaacat

SEQ ID NO: 3414658 - DNA, 15 bp, Homo sapiens
taaatgagttactta

SEQ ID NO: 3414659 - DNA, 10 bp, Homo sapiens
taaatgcata

SEQ ID NO: 3414660 - DNA, 15 bp, Homo sapiens
taaatgttttcattg

SEQ ID NO: 3414661 - DNA, 14 bp, Homo sapiens
taaattatgaatga

SEQ ID NO: 3414662 - DNA, 18 bp, Homo sapiens
taaattatgaatgagttt

SEQ ID NO: 3414663 - DNA, 20 bp, Homo sapiens
taaatttaggtaaataaagc

SEQ ID NO: 3414664 - DNA, 17 bp, Homo sapiens
taaatttggcttctgtt

SEQ ID NO: 3414665 - DNA, 18 bp, Homo sapiens
taaatttgtaagtttcag

SEQ ID NO: 3414666 - DNA, 15 bp, Homo sapiens
taaatttgttgtcat

SEQ ID NO: 3414667 - DNA, 18 bp, Homo sapiens
taaatttgttgtcatgtg

SEQ ID NO: 3414668 - DNA, 21 bp, Homo sapiens
taaatttgttgtcatgtgtat

SEQ ID NO: 3414669 - DNA, 15 bp, Homo sapiens
taaattttgtgtctc

SEQ ID NO: 3414670 - DNA, 22 bp, Homo sapiens
taacaacctttcccatttcgtg

SEQ ID NO: 3414671 - DNA, 13 bp, Homo sapiens
taacaatgttaag

SEQ ID NO: 3414672 - DNA, 14 bp, Homo sapiens
taacaatgttaagg

SEQ ID NO: 3414673 - DNA, 16 bp, Homo sapiens
taacaatgttaaggaa

SEQ ID NO: 3414674 - DNA, 17 bp, Homo sapiens
taacagaacagcttcag

SEQ ID NO: 3414675 - DNA, 22 bp, Homo sapiens
taacagaacagcttcaggttat

SEQ ID NO: 3414676 - DNA, 20 bp, Homo sapiens
taacagcgtgtcaactttca

SEQ ID NO: 3414677 - DNA, 15 bp, Homo sapiens
taacagctttcttat

SEQ ID NO: 3414678 - DNA, 14 bp, Homo sapiens
taacaggtattttc

SEQ ID NO: 3414679 - DNA, 15 bp, Homo sapiens
taacaggtattttca

SEQ ID NO: 3414680 - DNA, 13 bp, Homo sapiens
taacaggtctcct

SEQ ID NO: 3414681 - DNA, 18 bp, Homo sapiens
taacaggtctcctcttaa

SEQ ID NO: 3414682 - DNA, 19 bp, Homo sapiens
taacaggtctcctcttaaa

SEQ ID NO: 3414683 - DNA, 17 bp, Homo sapiens
taacatagccagatgta

SEQ ID NO: 3414684 - DNA, 19 bp, Homo sapiens
taacattaccttactgtgg

SEQ ID NO: 3414685 - DNA, 19 bp, Homo sapiens
taacatttaggagaagttg

SEQ ID NO: 3414686 - DNA, 15 bp, Homo sapiens
taacctcgtgtctag

SEQ ID NO: 3414687 - DNA, 19 bp, Homo sapiens
taacgtttttcctttaaaa

SEQ ID NO: 3414688 - DNA, 20 bp, Homo sapiens
taacgtttttcctttaaaaa

SEQ ID NO: 3414689 - DNA, 14 bp, Homo sapiens
taactaaatgctca

SEQ ID NO: 3414690 - DNA, 15 bp, Homo sapiens
taactaaatgctcat

SEQ ID NO: 3414691 - DNA, 15 bp, Homo sapiens
taactagcttggaaa

SEQ ID NO: 3414692 - DNA, 14 bp, Homo sapiens
taactcaatatttt

SEQ ID NO: 3414693 - DNA, 19 bp, Homo sapiens
taactctgtaaaagtgtct

SEQ ID NO: 3414694 - DNA, 15 bp, Homo sapiens
taactgactctgtta

SEQ ID NO: 3414695 - DNA, 16 bp, Homo sapiens
taactgactctgttat

SEQ ID NO: 3414696 - DNA, 17 bp, Homo sapiens
taactgactctgttatt

SEQ ID NO: 3414697 - DNA, 18 bp, Homo sapiens
taactgcttttgcccata

SEQ ID NO: 3414698 - DNA, 16 bp, Homo sapiens
taactgtatttcagta

SEQ ID NO: 3414699 - DNA, 18 bp, Homo sapiens
taactgtatttcagtatt

SEQ ID NO: 3414700 - DNA, 20 bp, Homo sapiens
taagaaagccaccttgttac

SEQ ID NO: 3414701 - DNA, 21 bp, Homo sapiens
taagaactacaaacaaaattt

SEQ ID NO: 3414702 - DNA, 15 bp, Homo sapiens
taagaagacatgaac

SEQ ID NO: 3414703 - DNA, 13 bp, Homo sapiens
taagaagctgttg

SEQ ID NO: 3414704 - DNA, 19 bp, Homo sapiens
taagaagctgttgtacatt

SEQ ID NO: 3414705 - DNA, 13 bp, Homo sapiens
taagaatagacta

SEQ ID NO: 3414706 - DNA, 20 bp, Homo sapiens
taagaatttgaggtctacat

SEQ ID NO: 3414707 - DNA, 12 bp, Homo sapiens
taagacataacg

SEQ ID NO: 3414708 - DNA, 22 bp, Homo sapiens
taagacataacgtttttccttt

SEQ ID NO: 3414709 - DNA, 23 bp, Homo sapiens
taagagtgtagaagcattccttc

SEQ ID NO: 3414710 - DNA, 21 bp, Homo sapiens
taagcaacgttagtagaactt

SEQ ID NO: 3414711 - DNA, 13 bp, Homo sapiens
taagcaagagaga

SEQ ID NO: 3414712 - DNA, 18 bp, Homo sapiens
taagcaagagagatgttt

SEQ ID NO: 3414713 - DNA, 16 bp, Homo sapiens
taagcagagttctttg

SEQ ID NO: 3414714 - DNA, 17 bp, Homo sapiens
taagcagagttctttgc

SEQ ID NO: 3414715 - DNA, 14 bp, Homo sapiens
taagcatgagtggc

SEQ ID NO: 3414716 - DNA, 22 bp, Homo sapiens
taagccagcaccggaccagcct

SEQ ID NO: 3414717 - DNA, 19 bp, Homo sapiens
taagctctatctgcaatgt

SEQ ID NO: 3414718 - DNA, 19 bp, Homo sapiens
taagcttagattttctgta

SEQ ID NO: 3414719 - DNA, 10 bp, Homo sapiens
taaggaaact

SEQ ID NO: 3414720 - DNA, 15 bp, Homo sapiens
taaggaaactcttat

SEQ ID NO: 3414721 - DNA, 19 bp, Homo sapiens
taaggaaactcttatctca

SEQ ID NO: 3414722 - DNA, 18 bp, Homo sapiens
taaggaaccctggaaact

SEQ ID NO: 3414723 - DNA, 15 bp, Homo sapiens
taaggcatactttta

SEQ ID NO: 3414724 - DNA, 10 bp, Homo sapiens
taaggctgta

SEQ ID NO: 3414725 - DNA, 17 bp, Homo sapiens
taagggtggaaaaatgc

SEQ ID NO: 3414726 - DNA, 19 bp, Homo sapiens
taagggtggaaaaatgccc

SEQ ID NO: 3414727 - DNA, 16 bp, Homo sapiens
taagtctacattaaac

SEQ ID NO: 3414728 - DNA, 16 bp, Homo sapiens
taagtgcgtgtgtaga

SEQ ID NO: 3414729 - DNA, 15 bp, Homo sapiens
taagtgttgaaaaat

SEQ ID NO: 3414730 - DNA, 20 bp, Homo sapiens
taagtttcaggtgacatgtg

SEQ ID NO: 3414731 - DNA, 13 bp, Homo sapiens
taataaaataatt

SEQ ID NO: 3414732 - DNA, 12 bp, Homo sapiens
taataagacata

SEQ ID NO: 3414733 - DNA, 14 bp, Homo sapiens
taataagacataac

SEQ ID NO: 3414734 - DNA, 18 bp, Homo sapiens
taataagctaaagaggct

SEQ ID NO: 3414735 - DNA, 17 bp, Homo sapiens
taatagctaataataaa

SEQ ID NO: 3414736 - DNA, 18 bp, Homo sapiens
taatataaaatgtttcaa

SEQ ID NO: 3414737 - DNA, 14 bp, Homo sapiens
taatataaagttgg

SEQ ID NO: 3414738 - DNA, 18 bp, Homo sapiens
taatatgagaatgtatta

SEQ ID NO: 3414739 - DNA, 19 bp, Homo sapiens
taatattacctaatgaaag

SEQ ID NO: 3414740 - DNA, 22 bp, Homo sapiens
taatattacctaatgaaagtga

SEQ ID NO: 3414741 - DNA, 17 bp, Homo sapiens
taatattagcttgctta

SEQ ID NO: 3414742 - DNA, 14 bp, Homo sapiens
taatatttttaatt

SEQ ID NO: 3414743 - DNA, 15 bp, Homo sapiens
taatatttttaatta

SEQ ID NO: 3414744 - DNA, 21 bp, Homo sapiens
taatcaagtagaacaaaaact

SEQ ID NO: 3414745 - DNA, 13 bp, Homo sapiens
taatcagtgttga

SEQ ID NO: 3414746 - DNA, 13 bp, Homo sapiens
taatcataacata

SEQ ID NO: 3414747 - DNA, 17 bp, Homo sapiens
taatcatgctcatgtat

SEQ ID NO: 3414748 - DNA, 15 bp, Homo sapiens
taatctatattaaat

SEQ ID NO: 3414749 - DNA, 17 bp, Homo sapiens
taatctatattaaatga

SEQ ID NO: 3414750 - DNA, 16 bp, Homo sapiens
taatctgcctggtttt

SEQ ID NO: 3414751 - DNA, 16 bp, Homo sapiens
taatgacatgcctata

SEQ ID NO: 3414752 - DNA, 17 bp, Homo sapiens
taatgatttttgtgtat

SEQ ID NO: 3414753 - DNA, 13 bp, Homo sapiens
taatgctttctga

SEQ ID NO: 3414754 - DNA, 21 bp, Homo sapiens
taatgtccaaatactctgaaa

SEQ ID NO: 3414755 - DNA, 22 bp, Homo sapiens
taatgtccaaatactctgaaat

SEQ ID NO: 3414756 - DNA, 22 bp, Homo sapiens
taatgtctgtatcactctgtgt

SEQ ID NO: 3414757 - DNA, 14 bp, Homo sapiens
taatgtgtctgtgt

SEQ ID NO: 3414758 - DNA, 16 bp, Homo sapiens
taatgttaaatttgta

SEQ ID NO: 3414759 - DNA, 18 bp, Homo sapiens
taatgttaaatttgtaag

SEQ ID NO: 3414760 - DNA, 20 bp, Homo sapiens
taatgttaaatttgtaagtt

SEQ ID NO: 3414761 - DNA, 17 bp, Homo sapiens
taatgtttatgagccag

SEQ ID NO: 3414762 - DNA, 12 bp, Homo sapiens
taattaaaaact

SEQ ID NO: 3414763 - DNA, 13 bp, Homo sapiens
taattaaaaactt

SEQ ID NO: 3414764 - DNA, 17 bp, Homo sapiens
taattaaactagtttaa

SEQ ID NO: 3414765 - DNA, 21 bp, Homo sapiens
taattaaataaaaatctgtgg

SEQ ID NO: 3414766 - DNA, 11 bp, Homo sapiens
taattctaaag

SEQ ID NO: 3414767 - DNA, 21 bp, Homo sapiens
taattgatcagatgctgaatt

SEQ ID NO: 3414768 - DNA, 14 bp, Homo sapiens
taattgttccttgc

SEQ ID NO: 3414769 - DNA, 17 bp, Homo sapiens
taattgttccttgcttt

SEQ ID NO: 3414770 - DNA, 16 bp, Homo sapiens
taattgttgtttcttt

SEQ ID NO: 3414771 - DNA, 16 bp, Homo sapiens
taatttaaaattgtga

SEQ ID NO: 3414772 - DNA, 20 bp, Homo sapiens
taatttagagcgtttggtta

SEQ ID NO: 3414773 - DNA, 16 bp, Homo sapiens
tacaaacaaaatttct

SEQ ID NO: 3414774 - DNA, 19 bp, Homo sapiens
tacaaactaactaataaaa

SEQ ID NO: 3414775 - DNA, 16 bp, Homo sapiens
tacaaattttttaatt

SEQ ID NO: 3414776 - DNA, 19 bp, Homo sapiens
tacaacaaacactgtgatg

SEQ ID NO: 3414777 - DNA, 14 bp, Homo sapiens
tacaactcccccac

SEQ ID NO: 3414778 - DNA, 21 bp, Homo sapiens
tacaagctacagttgtccaga

SEQ ID NO: 3414779 - DNA, 13 bp, Homo sapiens
tacaaggtatgta

SEQ ID NO: 3414780 - DNA, 19 bp, Homo sapiens
tacaagttaaggtatctgg

SEQ ID NO: 3414781 - DNA, 23 bp, Homo sapiens
tacaatatatagctggcaagaat

SEQ ID NO: 3414782 - DNA, 11 bp, Homo sapiens
tacacagtgtg

SEQ ID NO: 3414783 - DNA, 19 bp, Homo sapiens
tacacatctctgtcagtgt

SEQ ID NO: 3414784 - DNA, 22 bp, Homo sapiens
tacagaagccaagctccctgga

SEQ ID NO: 3414785 - DNA, 13 bp, Homo sapiens
tacagtcattatt

SEQ ID NO: 3414786 - DNA, 14 bp, Homo sapiens
tacagtctcaattt

SEQ ID NO: 3414787 - DNA, 22 bp, Homo sapiens
tacagtctcaattttgtattta

SEQ ID NO: 3414788 - DNA, 18 bp, Homo sapiens
tacatattaggaaaatat

SEQ ID NO: 3414789 - DNA, 21 bp, Homo sapiens
tacattagtcattcaataaat

SEQ ID NO: 3414790 - DNA, 15 bp, Homo sapiens
tacattattccaatg

SEQ ID NO: 3414791 - DNA, 19 bp, Homo sapiens
tacattcttggttgttaat

SEQ ID NO: 3414792 - DNA, 12 bp, Homo sapiens
tacatttatgat

SEQ ID NO: 3414793 - DNA, 19 bp, Homo sapiens
tacatttatgatttaataa

SEQ ID NO: 3414794 - DNA, 20 bp, Homo sapiens
tacatttatgatttaataaa

SEQ ID NO: 3414795 - DNA, 23 bp, Homo sapiens
tacatttatgatttaataaaata

SEQ ID NO: 3414796 - DNA, 20 bp, Homo sapiens
tacattttggatttctttat

SEQ ID NO: 3414797 - DNA, 22 bp, Homo sapiens
taccagcaaagagaatgtattt

SEQ ID NO: 3414798 - DNA, 17 bp, Homo sapiens
tacccaacagtttattt

SEQ ID NO: 3414799 - DNA, 14 bp, Homo sapiens
taccccatttgatt

SEQ ID NO: 3414800 - DNA, 12 bp, Homo sapiens
taccctcctcca

SEQ ID NO: 3414801 - DNA, 19 bp, Homo sapiens
tacctgatcaatgacagag

SEQ ID NO: 3414802 - DNA, 15 bp, Homo sapiens
tacctgccttttaag

SEQ ID NO: 3414803 - DNA, 22 bp, Homo sapiens
taccttactgtggaggaaggat

SEQ ID NO: 3414804 - DNA, 21 bp, Homo sapiens
taccttattgagcgtgattct

SEQ ID NO: 3414805 - DNA, 22 bp, Homo sapiens
taccttattgagcgtgattctg

SEQ ID NO: 3414806 - DNA, 13 bp, Homo sapiens
tactaaggagaat

SEQ ID NO: 3414807 - DNA, 19 bp, Homo sapiens
tactaaggagaattaaact

SEQ ID NO: 3414808 - DNA, 13 bp, Homo sapiens
tactaatgatgtt

SEQ ID NO: 3414809 - DNA, 14 bp, Homo sapiens
tactaatgatgttt

SEQ ID NO: 3414810 - DNA, 15 bp, Homo sapiens
tactaatgatgtttt

SEQ ID NO: 3414811 - DNA, 19 bp, Homo sapiens
tactcaagcaggtttcttg

SEQ ID NO: 3414812 - DNA, 22 bp, Homo sapiens
tactcaatgttactatctgctt

SEQ ID NO: 3414813 - DNA, 14 bp, Homo sapiens
tactcaatttacta

SEQ ID NO: 3414814 - DNA, 21 bp, Homo sapiens
tactcttaaatcatttggtta

SEQ ID NO: 3414815 - DNA, 16 bp, Homo sapiens
tactgatcttaccttt

SEQ ID NO: 3414816 - DNA, 17 bp, Homo sapiens
tactgtagtttcctcta

SEQ ID NO: 3414817 - DNA, 19 bp, Homo sapiens
tactgtcttaaatcagttt

SEQ ID NO: 3414818 - DNA, 14 bp, Homo sapiens
tactgtggaggaag

SEQ ID NO: 3414819 - DNA, 16 bp, Homo sapiens
tactgtgtaatataaa

SEQ ID NO: 3414820 - DNA, 20 bp, Homo sapiens
tacttagaatgccataaaat

SEQ ID NO: 3414821 - DNA, 12 bp, Homo sapiens
tacttgatcatt

SEQ ID NO: 3414822 - DNA, 20 bp, Homo sapiens
tacttgcagctcccattcta

SEQ ID NO: 3414823 - DNA, 15 bp, Homo sapiens
tactttactgcctga

SEQ ID NO: 3414824 - DNA, 11 bp, Homo sapiens
tactttgtgct

SEQ ID NO: 3414825 - DNA, 11 bp, Homo sapiens
tacttttaact

SEQ ID NO: 3414826 - DNA, 23 bp, Homo sapiens
tactttttttgttatagattgtc

SEQ ID NO: 3414827 - DNA, 23 bp, Homo sapiens
tagaaagacatctgcctgtaatt

SEQ ID NO: 3414828 - DNA, 14 bp, Homo sapiens
tagaaagagttcta

SEQ ID NO: 3414829 - DNA, 19 bp, Homo sapiens
tagaacagaaatatataaa

SEQ ID NO: 3414830 - DNA, 22 bp, Homo sapiens
tagaagcattccttctttgata

SEQ ID NO: 3414831 - DNA, 21 bp, Homo sapiens
tagacatttgctatgagctgg

SEQ ID NO: 3414832 - DNA, 19 bp, Homo sapiens
tagacctcttcctggaata

SEQ ID NO: 3414833 - DNA, 20 bp, Homo sapiens
tagacctcttcctggaataa

SEQ ID NO: 3414834 - DNA, 21 bp, Homo sapiens
tagacctcttcctggaataaa

SEQ ID NO: 3414835 - DNA, 19 bp, Homo sapiens
tagactatggaatgtcagt

SEQ ID NO: 3414836 - DNA, 16 bp, Homo sapiens
tagagaagtaagcaga

SEQ ID NO: 3414837 - DNA, 14 bp, Homo sapiens
tagagatatttaaa

SEQ ID NO: 3414838 - DNA, 20 bp, Homo sapiens
tagagatatttaaaagacaa

SEQ ID NO: 3414839 - DNA, 13 bp, Homo sapiens
tagagtcatgtga

SEQ ID NO: 3414840 - DNA, 19 bp, Homo sapiens
tagagtggcgattgaatgc

SEQ ID NO: 3414841 - DNA, 19 bp, Homo sapiens
tagagtgtttgtgagcttt

SEQ ID NO: 3414842 - DNA, 13 bp, Homo sapiens
tagagttaagaag

SEQ ID NO: 3414843 - DNA, 16 bp, Homo sapiens
tagagttaagaagctg

SEQ ID NO: 3414844 - DNA, 14 bp, Homo sapiens
tagagtttgatcat

SEQ ID NO: 3414845 - DNA, 13 bp, Homo sapiens
tagatataaatat

SEQ ID NO: 3414846 - DNA, 15 bp, Homo sapiens
tagatgatcaacata

SEQ ID NO: 3414847 - DNA, 15 bp, Homo sapiens
tagattgtcttaatg

SEQ ID NO: 3414848 - DNA, 13 bp, Homo sapiens
tagatttgaaaaa

SEQ ID NO: 3414849 - DNA, 15 bp, Homo sapiens
tagattttctgtaaa

SEQ ID NO: 3414850 - DNA, 18 bp, Homo sapiens
tagcatttatttctctgg

SEQ ID NO: 3414851 - DNA, 22 bp, Homo sapiens
tagcatttatttctctggcaaa

SEQ ID NO: 3414852 - DNA, 13 bp, Homo sapiens
tagccagcttcac

SEQ ID NO: 3414853 - DNA, 22 bp, Homo sapiens
tagccaggatcatggtgtaata

SEQ ID NO: 3414854 - DNA, 16 bp, Homo sapiens
tagccctcccactttg

SEQ ID NO: 3414855 - DNA, 22 bp, Homo sapiens
tagcctagatatgaatatatgg

SEQ ID NO: 3414856 - DNA, 15 bp, Homo sapiens
tagctagctatttct

SEQ ID NO: 3414857 - DNA, 17 bp, Homo sapiens
tagctagctatttctat

SEQ ID NO: 3414858 - DNA, 17 bp, Homo sapiens
tagctctacacaacatg

SEQ ID NO: 3414859 - DNA, 18 bp, Homo sapiens
tagctctacacaacatgt

SEQ ID NO: 3414860 - DNA, 21 bp, Homo sapiens
tagctcttggggaaatagctt

SEQ ID NO: 3414861 - DNA, 15 bp, Homo sapiens
taggaactgctgggc

SEQ ID NO: 3414862 - DNA, 15 bp, Homo sapiens
tagggggctggagga

SEQ ID NO: 3414863 - DNA, 18 bp, Homo sapiens
tagggggctggaggagcc

SEQ ID NO: 3414864 - DNA, 20 bp, Homo sapiens
tagggtccttgaaacagaaa

SEQ ID NO: 3414865 - DNA, 13 bp, Homo sapiens
tagggttatattt

SEQ ID NO: 3414866 - DNA, 17 bp, Homo sapiens
tagggttatatttggga

SEQ ID NO: 3414867 - DNA, 15 bp, Homo sapiens
taggtaaataaagct

SEQ ID NO: 3414868 - DNA, 16 bp, Homo sapiens
taggtaaataaagctc

SEQ ID NO: 3414869 - DNA, 18 bp, Homo sapiens
taggtaaataaagctcaa

SEQ ID NO: 3414870 - DNA, 22 bp, Homo sapiens
taggttgttaccaagtatgaag

SEQ ID NO: 3414871 - DNA, 21 bp, Homo sapiens
taggttttaaacgacttttgt

SEQ ID NO: 3414872 - DNA, 20 bp, Homo sapiens
tagtatatgaaatattttga

SEQ ID NO: 3414873 - DNA, 21 bp, Homo sapiens
tagtctcacactgtttttcat

SEQ ID NO: 3414874 - DNA, 18 bp, Homo sapiens
tagtctctgggtttacaa

SEQ ID NO: 3414875 - DNA, 21 bp, Homo sapiens
tagtgcttaaaaatcattgat

SEQ ID NO: 3414876 - DNA, 22 bp, Homo sapiens
tagtgcttcttgtaatatttct

SEQ ID NO: 3414877 - DNA, 14 bp, Homo sapiens
tagtggtctttgta

SEQ ID NO: 3414878 - DNA, 23 bp, Homo sapiens
tagtggtctttgtaagagtgtag

SEQ ID NO: 3414879 - DNA, 22 bp, Homo sapiens
tagtgtccccatgggctcccac

SEQ ID NO: 3414880 - DNA, 16 bp, Homo sapiens
tagtgtcctatgcaat

SEQ ID NO: 3414881 - DNA, 19 bp, Homo sapiens
tagttgaaaaaagaagttt

SEQ ID NO: 3414882 - DNA, 18 bp, Homo sapiens
tagttgcttttgaaggaa

SEQ ID NO: 3414883 - DNA, 13 bp, Homo sapiens
tagttgtctttct

SEQ ID NO: 3414884 - DNA, 16 bp, Homo sapiens
tagtttttaattaaaa

SEQ ID NO: 3414885 - DNA, 22 bp, Homo sapiens
tagtttttaattaaaaacttta

SEQ ID NO: 3414886 - DNA, 19 bp, Homo sapiens
tataaaaatatatgttgaa

SEQ ID NO: 3414887 - DNA, 23 bp, Homo sapiens
tataaaccttgtcaataaaaata

SEQ ID NO: 3414888 - DNA, 19 bp, Homo sapiens
tataaatatatgtatacat

SEQ ID NO: 3414889 - DNA, 22 bp, Homo sapiens
tataaatctggggaagaggttt

SEQ ID NO: 3414890 - DNA, 20 bp, Homo sapiens
tataaccagtttagcttttt

SEQ ID NO: 3414891 - DNA, 12 bp, Homo sapiens
tataactgtgat

SEQ ID NO: 3414892 - DNA, 18 bp, Homo sapiens
tataactgtgatgaaata

SEQ ID NO: 3414893 - DNA, 14 bp, Homo sapiens
tataaggtaatgta

SEQ ID NO: 3414894 - DNA, 18 bp, Homo sapiens
tataatcatgctcatgta

SEQ ID NO: 3414895 - DNA, 19 bp, Homo sapiens
tataatctcctctgctcat

SEQ ID NO: 3414896 - DNA, 17 bp, Homo sapiens
tataatgcaatgataaa

SEQ ID NO: 3414897 - DNA, 13 bp, Homo sapiens
tataatgctttct

SEQ ID NO: 3414898 - DNA, 21 bp, Homo sapiens
tataccatgtgtgctaatata

SEQ ID NO: 3414899 - DNA, 13 bp, Homo sapiens
tatacctgccttt

SEQ ID NO: 3414900 - DNA, 13 bp, Homo sapiens
tatactatatgaa

SEQ ID NO: 3414901 - DNA, 21 bp, Homo sapiens
tatactatatgaaaagagcaa

SEQ ID NO: 3414902 - DNA, 18 bp, Homo sapiens
tatacttttacattaaag

SEQ ID NO: 3414903 - DNA, 17 bp, Homo sapiens
tatactttttttgttat

SEQ ID NO: 3414904 - DNA, 13 bp, Homo sapiens
tatagctagctat

SEQ ID NO: 3414905 - DNA, 21 bp, Homo sapiens
tatagctctacacaacatgta

SEQ ID NO: 3414906 - DNA, 23 bp, Homo sapiens
tatagtagaaagacatctgcctg

SEQ ID NO: 3414907 - DNA, 22 bp, Homo sapiens
tatagttgtctttctttgctgc

SEQ ID NO: 3414908 - DNA, 21 bp, Homo sapiens
tatataaaaatatatgttgaa

SEQ ID NO: 3414909 - DNA, 23 bp, Homo sapiens
tatataaagtttttttatttctt

SEQ ID NO: 3414910 - DNA, 16 bp, Homo sapiens
tatataatcatgctca

SEQ ID NO: 3414911 - DNA, 17 bp, Homo sapiens
tatataatcatgctcat

SEQ ID NO: 3414912 - DNA, 17 bp, Homo sapiens
tatatatgtcaaattgt

SEQ ID NO: 3414913 - DNA, 21 bp, Homo sapiens
tatatattgaaagttgctttt

SEQ ID NO: 3414914 - DNA, 16 bp, Homo sapiens
tatatgagaagaatag

SEQ ID NO: 3414915 - DNA, 14 bp, Homo sapiens
tatattagttgctt

SEQ ID NO: 3414916 - DNA, 13 bp, Homo sapiens
tatattatataag

SEQ ID NO: 3414917 - DNA, 14 bp, Homo sapiens
tatattcatcaaat

SEQ ID NO: 3414918 - DNA, 23 bp, Homo sapiens
tatattgaaagttgcttttattg

SEQ ID NO: 3414919 - DNA, 19 bp, Homo sapiens
tatatttaaaaaattaaaa

SEQ ID NO: 3414920 - DNA, 20 bp, Homo sapiens
tatatttgtaaatttatgtg

SEQ ID NO: 3414921 - DNA, 21 bp, Homo sapiens
tatatttttttttaagctctg

SEQ ID NO: 3414922 - DNA, 18 bp, Homo sapiens
tatcaaaaagtataaatt

SEQ ID NO: 3414923 - DNA, 13 bp, Homo sapiens
tatcaaaaggaag

SEQ ID NO: 3414924 - DNA, 17 bp, Homo sapiens
tatcagactaagccagc

SEQ ID NO: 3414925 - DNA, 23 bp, Homo sapiens
tatccaccaaaagggctccctga

SEQ ID NO: 3414926 - DNA, 20 bp, Homo sapiens
tatccactgtctatgtacaa

SEQ ID NO: 3414927 - DNA, 19 bp, Homo sapiens
tatccagctagtgccaaat

SEQ ID NO: 3414928 - DNA, 13 bp, Homo sapiens
tatcctgctgaaa

SEQ ID NO: 3414929 - DNA, 21 bp, Homo sapiens
tatcctgctgaaagtcctgct

SEQ ID NO: 3414930 - DNA, 15 bp, Homo sapiens
tatcgaaataacaat

SEQ ID NO: 3414931 - DNA, 20 bp, Homo sapiens
tatcgaaataacaatgttaa

SEQ ID NO: 3414932 - DNA, 21 bp, Homo sapiens
tatcgaaataacaatgttaag

SEQ ID NO: 3414933 - DNA, 14 bp, Homo sapiens
tatctaatagagaa

SEQ ID NO: 3414934 - DNA, 19 bp, Homo sapiens
tatctctagtccctgtgtt

SEQ ID NO: 3414935 - DNA, 22 bp, Homo sapiens
tatctctagtccctgtgttctg

SEQ ID NO: 3414936 - DNA, 12 bp, Homo sapiens
tatctgcatgta

SEQ ID NO: 3414937 - DNA, 22 bp, Homo sapiens
tatctgcatgtaaaatcttcag

SEQ ID NO: 3414938 - DNA, 19 bp, Homo sapiens
tatctggtatctgcatgta

SEQ ID NO: 3414939 - DNA, 14 bp, Homo sapiens
tatctttatagttg

SEQ ID NO: 3414940 - DNA, 15 bp, Homo sapiens
tatctttatagttgt

SEQ ID NO: 3414941 - DNA, 16 bp, Homo sapiens
tatctttgattctcct

SEQ ID NO: 3414942 - DNA, 17 bp, Homo sapiens
tatctttgattctcctt

SEQ ID NO: 3414943 - DNA, 22 bp, Homo sapiens
tatctttgattctccttcagcc

SEQ ID NO: 3414944 - DNA, 16 bp, Homo sapiens
tatgaagtataaatct

SEQ ID NO: 3414945 - DNA, 16 bp, Homo sapiens
tatgaatgagttttac

SEQ ID NO: 3414946 - DNA, 21 bp, Homo sapiens
tatgaatgagttttacaaatt

SEQ ID NO: 3414947 - DNA, 18 bp, Homo sapiens
tatgaccttctaggaagc

SEQ ID NO: 3414948 - DNA, 20 bp, Homo sapiens
tatgacggaagaacatagaa

SEQ ID NO: 3414949 - DNA, 13 bp, Homo sapiens
tatgactaaagag

SEQ ID NO: 3414950 - DNA, 18 bp, Homo sapiens
tatgactaaagagagaat

SEQ ID NO: 3414951 - DNA, 21 bp, Homo sapiens
tatgactaaagagagaatgta

SEQ ID NO: 3414952 - DNA, 14 bp, Homo sapiens
tatgagaacatggt

SEQ ID NO: 3414953 - DNA, 14 bp, Homo sapiens
tatgagaagaatag

SEQ ID NO: 3414954 - DNA, 18 bp, Homo sapiens
tatgagaagtactttgtg

SEQ ID NO: 3414955 - DNA, 17 bp, Homo sapiens
tatgattggttcagttt

SEQ ID NO: 3414956 - DNA, 18 bp, Homo sapiens
tatgattggttcagtttt

SEQ ID NO: 3414957 - DNA, 18 bp, Homo sapiens
tatgatttaataaaataa

SEQ ID NO: 3414958 - DNA, 13 bp, Homo sapiens
tatgcaaatgaga

SEQ ID NO: 3414959 - DNA, 19 bp, Homo sapiens
tatgcagtgatatggcaga

SEQ ID NO: 3414960 - DNA, 16 bp, Homo sapiens
tatgctgtatttcttt

SEQ ID NO: 3414961 - DNA, 22 bp, Homo sapiens
gccaggatcatggtgtaataag

SEQ ID NO: 3414962 - DNA, 14 bp, Homo sapiens
gccaggctgcctgg

SEQ ID NO: 3414963 - DNA, 18 bp, Homo sapiens
gccaggctgcctggcctt

SEQ ID NO: 3414964 - DNA, 17 bp, Homo sapiens
gccagggagagcccagg

SEQ ID NO: 3414965 - DNA, 20 bp, Homo sapiens
gccagggagagcccaggagc

SEQ ID NO: 3414966 - DNA, 21 bp, Homo sapiens
gccagggagagcccaggagct

SEQ ID NO: 3414967 - DNA, 22 bp, Homo sapiens
gccagggagagcccaggagctc

SEQ ID NO: 3414968 - DNA, 14 bp, Homo sapiens
gccagggcctgcga

SEQ ID NO: 3414969 - DNA, 22 bp, Homo sapiens
gccataaaattgcagtttcatg

SEQ ID NO: 3414970 - DNA, 17 bp, Homo sapiens
gccatagtcaaagagag

SEQ ID NO: 3414971 - DNA, 16 bp, Homo sapiens
gccatatatgctgtat

SEQ ID NO: 3414972 - DNA, 17 bp, Homo sapiens
gccatcatgtttacaga

SEQ ID NO: 3414973 - DNA, 19 bp, Homo sapiens
gccatgttgtgcctccctg

SEQ ID NO: 3414974 - DNA, 20 bp, Homo sapiens
gccatgttgtgcctccctgg

SEQ ID NO: 3414975 - DNA, 13 bp, Homo sapiens
gccattttgtgaa

SEQ ID NO: 3414976 - DNA, 13 bp, Homo sapiens
gccatttttagtt

SEQ ID NO: 3414977 - DNA, 23 bp, Homo sapiens
gccatttttagtttaaaatcttg

SEQ ID NO: 3414978 - DNA, 19 bp, Homo sapiens
gcccactctccacctcact

SEQ ID NO: 3414979 - DNA, 20 bp, Homo sapiens
gcccactctccacctcacta

SEQ ID NO: 3414980 - DNA, 23 bp, Homo sapiens
gcccagaggagggcagcagaagg

SEQ ID NO: 3414981 - DNA, 18 bp, Homo sapiens
gcccagaggtaacagaac

SEQ ID NO: 3414982 - DNA, 20 bp, Homo sapiens
gcccagattatgagacacag

SEQ ID NO: 3414983 - DNA, 18 bp, Homo sapiens
gcccagcggacagtggca

SEQ ID NO: 3414984 - DNA, 21 bp, Homo sapiens
gcccaggagctcccctcccca

SEQ ID NO: 3414985 - DNA, 24 bp, Homo sapiens
gcccaggagctcccctccccaact

SEQ ID NO: 3414986 - DNA, 15 bp, Homo sapiens
gcccaggccaggact

SEQ ID NO: 3414987 - DNA, 16 bp, Homo sapiens
gcccaggccaggactc

SEQ ID NO: 3414988 - DNA, 24 bp, Homo sapiens
gcccaggccaggactctgcagcct

SEQ ID NO: 3414989 - DNA, 21 bp, Homo sapiens
gccccaccccagggcagccag

SEQ ID NO: 3414990 - DNA, 22 bp, Homo sapiens
gccccaccccagggcagccagg

SEQ ID NO: 3414991 - DNA, 13 bp, Homo sapiens
gcccccaggactg

SEQ ID NO: 3414992 - DNA, 16 bp, Homo sapiens
gcccccaggactgggc

SEQ ID NO: 3414993 - DNA, 17 bp, Homo sapiens
gcccccaggactgggcc

SEQ ID NO: 3414994 - DNA, 16 bp, Homo sapiens
gccccctgcaggaagg

SEQ ID NO: 3414995 - DNA, 22 bp, Homo sapiens
gccccctgcaggaaggagctgc

SEQ ID NO: 3414996 - DNA, 18 bp, Homo sapiens
gcccctgtcccacctggc

SEQ ID NO: 3414997 - DNA, 16 bp, Homo sapiens
gccctaagtttgtact

SEQ ID NO: 3414998 - DNA, 22 bp, Homo sapiens
gccctcacccctggttctcatc

SEQ ID NO: 3414999 - DNA, 19 bp, Homo sapiens
gccctccacacctgcggcc

SEQ ID NO: 3415000 - DNA, 16 bp, Homo sapiens
gccctcccacctccgc

SEQ ID NO: 3415001 - DNA, 14 bp, Homo sapiens
gccctcccactttg

SEQ ID NO: 3415002 - DNA, 23 bp, Homo sapiens
gccctcccactttgctgttcctt

SEQ ID NO: 3415003 - DNA, 14 bp, Homo sapiens
gccctcctcagctc

SEQ ID NO: 3415004 - DNA, 16 bp, Homo sapiens
gccctcctcagctccc

SEQ ID NO: 3415005 - DNA, 18 bp, Homo sapiens
gccctcctcagctccctg

SEQ ID NO: 3415006 - DNA, 14 bp, Homo sapiens
gccctctcccctgc

SEQ ID NO: 3415007 - DNA, 17 bp, Homo sapiens
gccctctcccctgcccc

SEQ ID NO: 3415008 - DNA, 22 bp, Homo sapiens
gccctctcccctgccccctgca

SEQ ID NO: 3415009 - DNA, 23 bp, Homo sapiens
gccctctcccctgccccctgcag

SEQ ID NO: 3415010 - DNA, 15 bp, Homo sapiens
gccctggtggccctc

SEQ ID NO: 3415011 - DNA, 18 bp, Homo sapiens
gccctggtggccctctcc

SEQ ID NO: 3415012 - DNA, 15 bp, Homo sapiens
gccctgttggcagct

SEQ ID NO: 3415013 - DNA, 18 bp, Homo sapiens
gccctgttggcagctcta

SEQ ID NO: 3415014 - DNA, 16 bp, Homo sapiens
gcccttcggtcacctg

SEQ ID NO: 3415015 - DNA, 17 bp, Homo sapiens
gcccttcggtcacctgt

SEQ ID NO: 3415016 - DNA, 22 bp, Homo sapiens
gcccttgggggtcctcctccag

SEQ ID NO: 3415017 - DNA, 14 bp, Homo sapiens
gccctttttaagga

SEQ ID NO: 3415018 - DNA, 18 bp, Homo sapiens
gccgcgcgtccagctgcc

SEQ ID NO: 3415019 - DNA, 23 bp, Homo sapiens
gccgggaccccgagcctggctcc

SEQ ID NO: 3415020 - DNA, 13 bp, Homo sapiens
gccgggcagaggg

SEQ ID NO: 3415021 - DNA, 15 bp, Homo sapiens
gccggtggtgcaggt

SEQ ID NO: 3415022 - DNA, 19 bp, Homo sapiens
gccgttgattcacttcacg

SEQ ID NO: 3415023 - DNA, 14 bp, Homo sapiens
gcctaggccaggtg

SEQ ID NO: 3415024 - DNA, 16 bp, Homo sapiens
gcctaggccaggtgca

SEQ ID NO: 3415025 - DNA, 14 bp, Homo sapiens
gcctcactttccac

SEQ ID NO: 3415026 - DNA, 20 bp, Homo sapiens
gcctcactttccaccaagtg

SEQ ID NO: 3415027 - DNA, 13 bp, Homo sapiens
gcctccagggctg

SEQ ID NO: 3415028 - DNA, 16 bp, Homo sapiens
gcctccagggctggac

SEQ ID NO: 3415029 - DNA, 19 bp, Homo sapiens
gcctccagggctggactga

SEQ ID NO: 3415030 - DNA, 11 bp, Homo sapiens
gcctcccccac

SEQ ID NO: 3415031 - DNA, 13 bp, Homo sapiens
gcctcccccactt

SEQ ID NO: 3415032 - DNA, 14 bp, Homo sapiens
gcctccctgcctca

SEQ ID NO: 3415033 - DNA, 16 bp, Homo sapiens
gcctccctgcctcagg

SEQ ID NO: 3415034 - DNA, 15 bp, Homo sapiens
gcctcccttttctcc

SEQ ID NO: 3415035 - DNA, 18 bp, Homo sapiens
gcctcccttttctcctct

SEQ ID NO: 3415036 - DNA, 14 bp, Homo sapiens
gcctcgaaagtgtc

SEQ ID NO: 3415037 - DNA, 20 bp, Homo sapiens
gcctctcattccagaggaag

SEQ ID NO: 3415038 - DNA, 20 bp, Homo sapiens
gcctctgtccccttctctca

SEQ ID NO: 3415039 - DNA, 22 bp, Homo sapiens
gcctctgtccccttctctcatc

SEQ ID NO: 3415040 - DNA, 11 bp, Homo sapiens
gcctgaataaa

SEQ ID NO: 3415041 - DNA, 12 bp, Homo sapiens
gcctgaataaag

SEQ ID NO: 3415042 - DNA, 23 bp, Homo sapiens
gcctgaataaagagccctaagtt

SEQ ID NO: 3415043 - DNA, 18 bp, Homo sapiens
gcctgagatttcatctgc

SEQ ID NO: 3415044 - DNA, 22 bp, Homo sapiens
gcctgagatttcatctgctctc

SEQ ID NO: 3415045 - DNA, 22 bp, Homo sapiens
gcctgagcgctcctgccgcaga

SEQ ID NO: 3415046 - DNA, 12 bp, Homo sapiens
gcctgccacctg

SEQ ID NO: 3415047 - DNA, 13 bp, Homo sapiens
gcctgccacctgg

SEQ ID NO: 3415048 - DNA, 14 bp, Homo sapiens
gcctgccacctgga

SEQ ID NO: 3415049 - DNA, 17 bp, Homo sapiens
gcctgccacctggaccc

SEQ ID NO: 3415050 - DNA, 23 bp, Homo sapiens
gcctgccacctggacccctgcat

SEQ ID NO: 3415051 - DNA, 16 bp, Homo sapiens
gcctgcctccagggct

SEQ ID NO: 3415052 - DNA, 22 bp, Homo sapiens
gcctgcctccagggctggactg

SEQ ID NO: 3415053 - DNA, 23 bp, Homo sapiens
gcctggctccaaaccctcgaggc

SEQ ID NO: 3415054 - DNA, 16 bp, Homo sapiens
gcctgggaccagggca

SEQ ID NO: 3415055 - DNA, 14 bp, Homo sapiens
gcctgttcacgtgt

SEQ ID NO: 3415056 - DNA, 19 bp, Homo sapiens
gcctgtttcccgtaaggct

SEQ ID NO: 3415057 - DNA, 16 bp, Homo sapiens
gccttatgagaacatg

SEQ ID NO: 3415058 - DNA, 18 bp, Homo sapiens
gccttatgagaacatggt

SEQ ID NO: 3415059 - DNA, 16 bp, Homo sapiens
gccttatgtgttacat

SEQ ID NO: 3415060 - DNA, 19 bp, Homo sapiens
gccttatgtgttacattat

SEQ ID NO: 3415061 - DNA, 23 bp, Homo sapiens
gccttatgtgttacattattcca

SEQ ID NO: 3415062 - DNA, 22 bp, Homo sapiens
gcctttaccctcctctatttct

SEQ ID NO: 3415063 - DNA, 20 bp, Homo sapiens
gcctttgagacagtttctta

SEQ ID NO: 3415064 - DNA, 21 bp, Homo sapiens
gcctttgagacagtttcttag

SEQ ID NO: 3415065 - DNA, 13 bp, Homo sapiens
gcgattgaatgct

SEQ ID NO: 3415066 - DNA, 12 bp, Homo sapiens
gcgcaaacttta

SEQ ID NO: 3415067 - DNA, 13 bp, Homo sapiens
gcgcactgcctct

SEQ ID NO: 3415068 - DNA, 16 bp, Homo sapiens
gcggcccaatccaagg

SEQ ID NO: 3415069 - DNA, 19 bp, Homo sapiens
gcggggcttttaaaaggaa

SEQ ID NO: 3415070 - DNA, 20 bp, Homo sapiens
gcggggcttttaaaaggaaa

SEQ ID NO: 3415071 - DNA, 22 bp, Homo sapiens
gcgtatttagactgtggccata

SEQ ID NO: 3415072 - DNA, 23 bp, Homo sapiens
gcgtcattacagggcacaggcca

SEQ ID NO: 3415073 - DNA, 20 bp, Homo sapiens
gattggattatttaataaca

SEQ ID NO: 3415074 - DNA, 15 bp, Homo sapiens
gattggatttgctgt

SEQ ID NO: 3415075 - DNA, 23 bp, Homo sapiens
gattgtagtatttagtatatgaa

SEQ ID NO: 3415076 - DNA, 17 bp, Homo sapiens
gatttaaatagaacttg

SEQ ID NO: 3415077 - DNA, 18 bp, Homo sapiens
gatttaaatagaacttga

SEQ ID NO: 3415078 - DNA, 22 bp, Homo sapiens
gatttaagggatggaaaaggaa

SEQ ID NO: 3415079 - DNA, 15 bp, Homo sapiens
gatttaataaaataa

SEQ ID NO: 3415080 - DNA, 15 bp, Homo sapiens
gatttctttgaatgt

SEQ ID NO: 3415081 - DNA, 22 bp, Homo sapiens
gatttgatctttgtttaaatgc

SEQ ID NO: 3415082 - DNA, 15 bp, Homo sapiens
gattttaaaaataca

SEQ ID NO: 3415083 - DNA, 12 bp, Homo sapiens
gatttttctcaa

SEQ ID NO: 3415084 - DNA, 13 bp, Homo sapiens
gatttttctcaaa

SEQ ID NO: 3415085 - DNA, 17 bp, Homo sapiens
gattttttttttaagtg

SEQ ID NO: 3415086 - DNA, 21 bp, Homo sapiens
gattttttttttaagtgacat

SEQ ID NO: 3415087 - DNA, 21 bp, Homo sapiens
gcaaactgctttattttccct

SEQ ID NO: 3415088 - DNA, 17 bp, Homo sapiens
gcaaaggagtagaaaga

SEQ ID NO: 3415089 - DNA, 14 bp, Homo sapiens
gcaaatgagatttc

SEQ ID NO: 3415090 - DNA, 16 bp, Homo sapiens
gcaaatgagatttctt

SEQ ID NO: 3415091 - DNA, 15 bp, Homo sapiens
gcaacatggattcca

SEQ ID NO: 3415092 - DNA, 17 bp, Homo sapiens
gcaaccagggagctgca

SEQ ID NO: 3415093 - DNA, 13 bp, Homo sapiens
gcaactcttgtat

SEQ ID NO: 3415094 - DNA, 20 bp, Homo sapiens
gcaagcccttcggtcacctg

SEQ ID NO: 3415095 - DNA, 19 bp, Homo sapiens
gcaagtctctttatatggc

SEQ ID NO: 3415096 - DNA, 20 bp, Homo sapiens
gcaatcgtggatgtctctga

SEQ ID NO: 3415097 - DNA, 13 bp, Homo sapiens
gcacaaagtggca

SEQ ID NO: 3415098 - DNA, 23 bp, Homo sapiens
gcacatctaaattgatcattcat

SEQ ID NO: 3415099 - DNA, 16 bp, Homo sapiens
gcacatgccagggaaa

SEQ ID NO: 3415100 - DNA, 15 bp, Homo sapiens
gcaccggaccagcct

SEQ ID NO: 3415101 - DNA, 17 bp, Homo sapiens
gcaccggaccagcctgg

SEQ ID NO: 3415102 - DNA, 20 bp, Homo sapiens
gcacgcgccctttctaccat

SEQ ID NO: 3415103 - DNA, 17 bp, Homo sapiens
gcactagaccatataac

SEQ ID NO: 3415104 - DNA, 12 bp, Homo sapiens
gcactgaaaacc

SEQ ID NO: 3415105 - DNA, 18 bp, Homo sapiens
gcactgaggaagaacggg

SEQ ID NO: 3415106 - DNA, 14 bp, Homo sapiens
gcactgcctctcac

SEQ ID NO: 3415107 - DNA, 21 bp, Homo sapiens
gcagaagacaccagagcagat

SEQ ID NO: 3415108 - DNA, 15 bp, Homo sapiens
gcagaagggggtggt

SEQ ID NO: 3415109 - DNA, 17 bp, Homo sapiens
gcagatggaaaggagcc

SEQ ID NO: 3415110 - DNA, 17 bp, Homo sapiens
gcagattgaaaaggaca

SEQ ID NO: 3415111 - DNA, 13 bp, Homo sapiens
gcagcagaagggg

SEQ ID NO: 3415112 - DNA, 19 bp, Homo sapiens
gcagcccctccccacacca

SEQ ID NO: 3415113 - DNA, 13 bp, Homo sapiens
gcaggaaggagct

SEQ ID NO: 3415114 - DNA, 17 bp, Homo sapiens
gcaggaaggagctgcct

SEQ ID NO: 3415115 - DNA, 14 bp, Homo sapiens
gcaggggtccctgc

SEQ ID NO: 3415116 - DNA, 17 bp, Homo sapiens
gcagtacaataaaagta

SEQ ID NO: 3415117 - DNA, 16 bp, Homo sapiens
gcagtcgtcccaggct

SEQ ID NO: 3415118 - DNA, 21 bp, Homo sapiens
gcagtcgtgtaattggcccaa

SEQ ID NO: 3415119 - DNA, 14 bp, Homo sapiens
gcagtgagtgccat

SEQ ID NO: 3415120 - DNA, 21 bp, Homo sapiens
gcagtgatatggcagaagaca

SEQ ID NO: 3415121 - DNA, 17 bp, Homo sapiens
gcagtgtggccaggctg

SEQ ID NO: 3415122 - DNA, 18 bp, Homo sapiens
gcataataagctaaagag

SEQ ID NO: 3415123 - DNA, 16 bp, Homo sapiens
gcatacttttaatcaa

SEQ ID NO: 3415124 - DNA, 18 bp, Homo sapiens
gcatacttttaatcaagt

SEQ ID NO: 3415125 - DNA, 18 bp, Homo sapiens
gcatcaaacatgaaaaca

SEQ ID NO: 3415126 - DNA, 20 bp, Homo sapiens
gcatcaaacatgaaaacatt

SEQ ID NO: 3415127 - DNA, 16 bp, Homo sapiens
gcatgacaaaagtgac

SEQ ID NO: 3415128 - DNA, 17 bp, Homo sapiens
gcatgacaaaagtgaca

SEQ ID NO: 3415129 - DNA, 11 bp, Homo sapiens
gcatgagtggc

SEQ ID NO: 3415130 - DNA, 14 bp, Homo sapiens
gcatggacaatgga

SEQ ID NO: 3415131 - DNA, 21 bp, Homo sapiens
gcatgtaaaatcttcagctgg

SEQ ID NO: 3415132 - DNA, 23 bp, Homo sapiens
gcatgtaaaatcttcagctggtg

SEQ ID NO: 3415133 - DNA, 19 bp, Homo sapiens
gcatgtatagttgcttttg

SEQ ID NO: 3415134 - DNA, 16 bp, Homo sapiens
gcatgtgggttgtgat

SEQ ID NO: 3415135 - DNA, 17 bp, Homo sapiens
gcattaactaaatgctc

SEQ ID NO: 3415136 - DNA, 18 bp, Homo sapiens
gcattaactaaatgctca

SEQ ID NO: 3415137 - DNA, 14 bp, Homo sapiens
gcattccttctttg

SEQ ID NO: 3415138 - DNA, 23 bp, Homo sapiens
gcattccttctttgataatgtta

SEQ ID NO: 3415139 - DNA, 15 bp, Homo sapiens
gcatttatttctctg

SEQ ID NO: 3415140 - DNA, 23 bp, Homo sapiens
gcattttgaatgtgatcatcttt

SEQ ID NO: 3415141 - DNA, 18 bp, Homo sapiens
gccaaataatgtctctgt

SEQ ID NO: 3415142 - DNA, 12 bp, Homo sapiens
gccaagaaatcg

SEQ ID NO: 3415143 - DNA, 17 bp, Homo sapiens
gccaagctaatctgcct

SEQ ID NO: 3415144 - DNA, 15 bp, Homo sapiens
gccaagctccctgga

SEQ ID NO: 3415145 - DNA, 18 bp, Homo sapiens
gccaagctccctggagcc

SEQ ID NO: 3415146 - DNA, 22 bp, Homo sapiens
gccaagctccctggagccctgt

SEQ ID NO: 3415147 - DNA, 18 bp, Homo sapiens
gccaatgccccactggca

SEQ ID NO: 3415148 - DNA, 22 bp, Homo sapiens
gccaattttgtcacagctcttg

SEQ ID NO: 3415149 - DNA, 15 bp, Homo sapiens
gccacaaatgtgtcc

SEQ ID NO: 3415150 - DNA, 16 bp, Homo sapiens
gccacatacttgcagc

SEQ ID NO: 3415151 - DNA, 12 bp, Homo sapiens
gccacctggacc

SEQ ID NO: 3415152 - DNA, 13 bp, Homo sapiens
gccacctggaccc

SEQ ID NO: 3415153 - DNA, 14 bp, Homo sapiens
gccacctggacccc

SEQ ID NO: 3415154 - DNA, 15 bp, Homo sapiens
gccacgattgcagga

SEQ ID NO: 3415155 - DNA, 20 bp, Homo sapiens
gccactggcatcgcagcttc

SEQ ID NO: 3415156 - DNA, 19 bp, Homo sapiens
gccagaagatgaacagact

SEQ ID NO: 3415157 - DNA, 17 bp, Homo sapiens
gccagaatataatgtgc

SEQ ID NO: 3415158 - DNA, 13 bp, Homo sapiens
gccagacctgcag

SEQ ID NO: 3415159 - DNA, 21 bp, Homo sapiens
gccagacctgcagacgcccag

SEQ ID NO: 3415160 - DNA, 20 bp, Homo sapiens
gccagcaccggaccagcctg

SEQ ID NO: 3415161 - DNA, 13 bp, Homo sapiens
gccaggactctgc

SEQ ID NO: 3415162 - DNA, 15 bp, Homo sapiens
gccaggactctgcag

SEQ ID NO: 3415163 - DNA, 16 bp, Homo sapiens
gccaggactctgcagc

SEQ ID NO: 3415164 - DNA, 18 bp, Homo sapiens
gccaggactctgcagcct

SEQ ID NO: 3415165 - DNA, 17 bp, Homo sapiens
gccaggatcatggtgta

SEQ ID NO: 3415166 - DNA, 14 bp, Homo sapiens
ggacagaagaaggc

SEQ ID NO: 3415167 - DNA, 17 bp, Homo sapiens
ggacagaagcagctctt

SEQ ID NO: 3415168 - DNA, 16 bp, Homo sapiens
ggacattccaagacag

SEQ ID NO: 3415169 - DNA, 12 bp, Homo sapiens
ggaccagggcat

SEQ ID NO: 3415170 - DNA, 16 bp, Homo sapiens
ggacccatcctgccac

SEQ ID NO: 3415171 - DNA, 21 bp, Homo sapiens
ggaccccgagcctggctccaa

SEQ ID NO: 3415172 - DNA, 17 bp, Homo sapiens
ggaccggagagtggggg

SEQ ID NO: 3415173 - DNA, 24 bp, Homo sapiens
ggactcatttcattcctaacacag

SEQ ID NO: 3415174 - DNA, 23 bp, Homo sapiens
ggactgggccacttctgggtggg

SEQ ID NO: 3415175 - DNA, 18 bp, Homo sapiens
ggagaagccacaggcctg

SEQ ID NO: 3415176 - DNA, 19 bp, Homo sapiens
aaatgaaaattacgttctt

SEQ ID NO: 3415177 - DNA, 14 bp, Homo sapiens
aaatgaactgattt

SEQ ID NO: 3415178 - DNA, 13 bp, Homo sapiens
aaatgagatttct

SEQ ID NO: 3415179 - DNA, 14 bp, Homo sapiens
aaatgcatagagca

SEQ ID NO: 3415180 - DNA, 15 bp, Homo sapiens
aaatgcatagagcaa

SEQ ID NO: 3415181 - DNA, 11 bp, Homo sapiens
aaatgcattca

SEQ ID NO: 3415182 - DNA, 18 bp, Homo sapiens
aaatgcattcatgtttta

SEQ ID NO: 3415183 - DNA, 20 bp, Homo sapiens
aaatgcccatttttgctaat

SEQ ID NO: 3415184 - DNA, 14 bp, Homo sapiens
aaatgcctttgaga

SEQ ID NO: 3415185 - DNA, 19 bp, Homo sapiens
aaatgctgtgcaaacagtg

SEQ ID NO: 3415186 - DNA, 15 bp, Homo sapiens
aaatgtacttaaatg

SEQ ID NO: 3415187 - DNA, 18 bp, Homo sapiens
aaatgtatgattacatca

SEQ ID NO: 3415188 - DNA, 21 bp, Homo sapiens
aaatgttgataaatggatatt

SEQ ID NO: 3415189 - DNA, 22 bp, Homo sapiens
aaatgtttcaagcgcttaactc

SEQ ID NO: 3415190 - DNA, 13 bp, Homo sapiens
aaatgttttcatt

SEQ ID NO: 3415191 - DNA, 19 bp, Homo sapiens
aaatgttttcattgggaaa

SEQ ID NO: 3415192 - DNA, 17 bp, Homo sapiens
aaattaaattctctcta

SEQ ID NO: 3415193 - DNA, 13 bp, Homo sapiens
aaattaacactgc

SEQ ID NO: 3415194 - DNA, 14 bp, Homo sapiens
aaattatttgcagg

SEQ ID NO: 3415195 - DNA, 21 bp, Homo sapiens
aaattccgattagacctttat

SEQ ID NO: 3415196 - DNA, 15 bp, Homo sapiens
aaattcctttcagag

SEQ ID NO: 3415197 - DNA, 23 bp, Homo sapiens
aaattcctttcagagttttacta

SEQ ID NO: 3415198 - DNA, 19 bp, Homo sapiens
aaattgatcattcataatt

SEQ ID NO: 3415199 - DNA, 19 bp, Homo sapiens
aaattgcagtttcatgtat

SEQ ID NO: 3415200 - DNA, 21 bp, Homo sapiens
aaattgcagtttcatgtatgt

SEQ ID NO: 3415201 - DNA, 22 bp, Homo sapiens
aaattgcagtttcatgtatgta

SEQ ID NO: 3415202 - DNA, 14 bp, Homo sapiens
aaattgcatttcta

SEQ ID NO: 3415203 - DNA, 16 bp, Homo sapiens
aaatttaaaaataaag

SEQ ID NO: 3415204 - DNA, 20 bp, Homo sapiens
aaatttaaaaataaagctac

SEQ ID NO: 3415205 - DNA, 20 bp, Homo sapiens
aaatttaggtaaataaagct

SEQ ID NO: 3415206 - DNA, 12 bp, Homo sapiens
aaatttgtaagt

SEQ ID NO: 3415207 - DNA, 13 bp, Homo sapiens
aaatttgtaagtt

SEQ ID NO: 3415208 - DNA, 14 bp, Homo sapiens
aaatttgtaagttt

SEQ ID NO: 3415209 - DNA, 15 bp, Homo sapiens
aaatttgtaagtttc

SEQ ID NO: 3415210 - DNA, 19 bp, Homo sapiens
aaatttgtaagtttcaggt

SEQ ID NO: 3415211 - DNA, 20 bp, Homo sapiens
aaatttgtaagtttcaggtg

SEQ ID NO: 3415212 - DNA, 22 bp, Homo sapiens
aaatttgtaagtttcaggtgac

SEQ ID NO: 3415213 - DNA, 16 bp, Homo sapiens
aaattttttaaaagag

SEQ ID NO: 3415214 - DNA, 15 bp, Homo sapiens
aaatttttttgttgt

SEQ ID NO: 3415215 - DNA, 13 bp, Homo sapiens
aacaaaatttcta

SEQ ID NO: 3415216 - DNA, 15 bp, Homo sapiens
aacaaataacctata

SEQ ID NO: 3415217 - DNA, 18 bp, Homo sapiens
aacaagttagtttctcat

SEQ ID NO: 3415218 - DNA, 23 bp, Homo sapiens
aacaatcacaaaagctgtgtctc

SEQ ID NO: 3415219 - DNA, 11 bp, Homo sapiens
aacaatgttaa

SEQ ID NO: 3415220 - DNA, 18 bp, Homo sapiens
aacaatgttaaggaaact

SEQ ID NO: 3415221 - DNA, 22 bp, Homo sapiens
aacaatgttaaggaaactctta

SEQ ID NO: 3415222 - DNA, 19 bp, Homo sapiens
aacaattggttgtatataa

SEQ ID NO: 3415223 - DNA, 20 bp, Homo sapiens
aacaattggttgtatataaa

SEQ ID NO: 3415224 - DNA, 16 bp, Homo sapiens
aacacagcatgtgtat

SEQ ID NO: 3415225 - DNA, 16 bp, Homo sapiens
aacactgtcttgaaga

SEQ ID NO: 3415226 - DNA, 23 bp, Homo sapiens
aacacttgcaggggtccctgcta

SEQ ID NO: 3415227 - DNA, 16 bp, Homo sapiens
aacagaaatatataaa

SEQ ID NO: 3415228 - DNA, 14 bp, Homo sapiens
aacagaacagcttc

SEQ ID NO: 3415229 - DNA, 18 bp, Homo sapiens
aacagataagcaagagag

SEQ ID NO: 3415230 - DNA, 14 bp, Homo sapiens
aacagcttcaggtt

SEQ ID NO: 3415231 - DNA, 16 bp, Homo sapiens
aacagcttcaggttat

SEQ ID NO: 3415232 - DNA, 13 bp, Homo sapiens
aacaggtctcctc

SEQ ID NO: 3415233 - DNA, 19 bp, Homo sapiens
aacaggtctcctcttaaaa

SEQ ID NO: 3415234 - DNA, 14 bp, Homo sapiens
aacagtatgatgga

SEQ ID NO: 3415235 - DNA, 21 bp, Homo sapiens
aacagtatgatggaacagtga

SEQ ID NO: 3415236 - DNA, 20 bp, Homo sapiens
aacagtttatttttattatt

SEQ ID NO: 3415237 - DNA, 19 bp, Homo sapiens
aacagtttggatgtcctca

SEQ ID NO: 3415238 - DNA, 15 bp, Homo sapiens
aacataacaaccttt

SEQ ID NO: 3415239 - DNA, 15 bp, Homo sapiens
aacatagttgaaaaa

SEQ ID NO: 3415240 - DNA, 24 bp, Homo sapiens
aacatagttgaaaaaagaagtttg

SEQ ID NO: 3415241 - DNA, 14 bp, Homo sapiens
aacatctgtgtctg

SEQ ID NO: 3415242 - DNA, 18 bp, Homo sapiens
aacatctgtgtctgtgtc

SEQ ID NO: 3415243 - DNA, 15 bp, Homo sapiens
aacatgaaaacattg

SEQ ID NO: 3415244 - DNA, 21 bp, Homo sapiens
aacatgaaaacattgatgaat

SEQ ID NO: 3415245 - DNA, 17 bp, Homo sapiens
aacatggtgtgtgtctc

SEQ ID NO: 3415246 - DNA, 16 bp, Homo sapiens
aacattaccttactgt

SEQ ID NO: 3415247 - DNA, 22 bp, Homo sapiens
aacatttcaagggcaataccgt

SEQ ID NO: 3415248 - DNA, 11 bp, Homo sapiens
aacattttgtt

SEQ ID NO: 3415249 - DNA, 22 bp, Homo sapiens
aaccactaatgcttgccaagaa

SEQ ID NO: 3415250 - DNA, 22 bp, Homo sapiens
aaccagtttagctttttcctta

SEQ ID NO: 3415251 - DNA, 22 bp, Homo sapiens
aacccaaattacgtgtactaca

SEQ ID NO: 3415252 - DNA, 23 bp, Homo sapiens
aaccctttggattatgcccatga

SEQ ID NO: 3415253 - DNA, 16 bp, Homo sapiens
aacctaattgaaattt

SEQ ID NO: 3415254 - DNA, 15 bp, Homo sapiens
aacctataaagtgtt

SEQ ID NO: 3415255 - DNA, 12 bp, Homo sapiens
aacctggggggc

SEQ ID NO: 3415256 - DNA, 17 bp, Homo sapiens
aaccttgtttctttctg

SEQ ID NO: 3415257 - DNA, 15 bp, Homo sapiens
aaccttttttaagat

SEQ ID NO: 3415258 - DNA, 22 bp, Homo sapiens
aaccttttttaagatttttctc

SEQ ID NO: 3415259 - DNA, 13 bp, Homo sapiens
aacgacttttgtt

SEQ ID NO: 3415260 - DNA, 19 bp, Homo sapiens
aacgctctctactctgctt

SEQ ID NO: 3415261 - DNA, 18 bp, Homo sapiens
aacggggctcttctcatt

SEQ ID NO: 3415262 - DNA, 17 bp, Homo sapiens
aacgttttcttaaatgt

SEQ ID NO: 3415263 - DNA, 15 bp, Homo sapiens
aactaataaaatata

SEQ ID NO: 3415264 - DNA, 18 bp, Homo sapiens
aactaccagtgggcatgt

SEQ ID NO: 3415265 - DNA, 19 bp, Homo sapiens
aactaccagtgggcatgta

SEQ ID NO: 3415266 - DNA, 20 bp, Homo sapiens
aactaccagtgggcatgtat

SEQ ID NO: 3415267 - DNA, 17 bp, Homo sapiens
aactcacctctcaaggt

SEQ ID NO: 3415268 - DNA, 15 bp, Homo sapiens
aactcctactgcttc

SEQ ID NO: 3415269 - DNA, 22 bp, Homo sapiens
aactcctactgcttcctctgaa

SEQ ID NO: 3415270 - DNA, 23 bp, Homo sapiens
aactctgcaactgaatacttgaa

SEQ ID NO: 3415271 - DNA, 18 bp, Homo sapiens
aactctgtaaaagtgtct

SEQ ID NO: 3415272 - DNA, 14 bp, Homo sapiens
aactcttatctcag

SEQ ID NO: 3415273 - DNA, 21 bp, Homo sapiens
aactcttgtattgctccattt

SEQ ID NO: 3415274 - DNA, 16 bp, Homo sapiens
aactgtaccatgtgct

SEQ ID NO: 3415275 - DNA, 15 bp, Homo sapiens
aactgtatttcagta

SEQ ID NO: 3415276 - DNA, 22 bp, Homo sapiens
aactgtatttcagtattttcca

SEQ ID NO: 3415277 - DNA, 15 bp, Homo sapiens
aacttgtctttttgt

SEQ ID NO: 3415278 - DNA, 17 bp, Homo sapiens
aactttaaagataagtc

SEQ ID NO: 3415279 - DNA, 18 bp, Homo sapiens
aacttttaggttgttacc

SEQ ID NO: 3415280 - DNA, 22 bp, Homo sapiens
aacttttctcctgcatgtgtat

SEQ ID NO: 3415281 - DNA, 15 bp, Homo sapiens
aactttttaaagagt

SEQ ID NO: 3415282 - DNA, 15 bp, Homo sapiens
aagaaaatgtgtctg

SEQ ID NO: 3415283 - DNA, 12 bp, Homo sapiens
aagaaacaaaaa

SEQ ID NO: 3415284 - DNA, 20 bp, Homo sapiens
aagaaatcgccttatgagaa

SEQ ID NO: 3415285 - DNA, 21 bp, Homo sapiens
aagaaatcgccttatgagaac

SEQ ID NO: 3415286 - DNA, 12 bp, Homo sapiens
aagaacatagaa

SEQ ID NO: 3415287 - DNA, 18 bp, Homo sapiens
actcgggttaagaaatac

SEQ ID NO: 3415288 - DNA, 16 bp, Homo sapiens
actctaattggtcatt

SEQ ID NO: 3415289 - DNA, 21 bp, Homo sapiens
actctgcaactgaatacttga

SEQ ID NO: 3415290 - DNA, 12 bp, Homo sapiens
actctgcagcct

SEQ ID NO: 3415291 - DNA, 13 bp, Homo sapiens
actctgcagcctc

SEQ ID NO: 3415292 - DNA, 21 bp, Homo sapiens
actctggaggtttgtttagaa

SEQ ID NO: 3415293 - DNA, 17 bp, Homo sapiens
actctggggtttttact

SEQ ID NO: 3415294 - DNA, 17 bp, Homo sapiens
actctgtaaaagtgtct

SEQ ID NO: 3415295 - DNA, 13 bp, Homo sapiens
actcttaagagaa

SEQ ID NO: 3415296 - DNA, 16 bp, Homo sapiens
actgaatacttgaagt

SEQ ID NO: 3415297 - DNA, 20 bp, Homo sapiens
actgacacaaaagaagaaat

SEQ ID NO: 3415298 - DNA, 14 bp, Homo sapiens
actgactccttaga

SEQ ID NO: 3415299 - DNA, 13 bp, Homo sapiens
actgaggaagaac

SEQ ID NO: 3415300 - DNA, 22 bp, Homo sapiens
actgaggaagaacggggctctt

SEQ ID NO: 3415301 - DNA, 13 bp, Homo sapiens
actgaggcctgag

SEQ ID NO: 3415302 - DNA, 17 bp, Homo sapiens
actgcaagcatttttcc

SEQ ID NO: 3415303 - DNA, 19 bp, Homo sapiens
actgcaagcatttttccat

SEQ ID NO: 3415304 - DNA, 14 bp, Homo sapiens
actgcccagcggac

SEQ ID NO: 3415305 - DNA, 23 bp, Homo sapiens
actgcccagcggacagtggcagg

SEQ ID NO: 3415306 - DNA, 17 bp, Homo sapiens
actgcctgaataaagag

SEQ ID NO: 3415307 - DNA, 19 bp, Homo sapiens
actgcttcctctgaatatt

SEQ ID NO: 3415308 - DNA, 15 bp, Homo sapiens
actggagagtggcaa

SEQ ID NO: 3415309 - DNA, 23 bp, Homo sapiens
actggagagtggcaaaagtctga

SEQ ID NO: 3415310 - DNA, 14 bp, Homo sapiens
actggtattttatc

SEQ ID NO: 3415311 - DNA, 21 bp, Homo sapiens
actgtaccatgtgctacaggg

SEQ ID NO: 3415312 - DNA, 22 bp, Homo sapiens
actgtatttcagtattttccag

SEQ ID NO: 3415313 - DNA, 14 bp, Homo sapiens
actgtcttaaatca

SEQ ID NO: 3415314 - DNA, 12 bp, Homo sapiens
actgtctttcag

SEQ ID NO: 3415315 - DNA, 17 bp, Homo sapiens
actgtggaggaaggatt

SEQ ID NO: 3415316 - DNA, 22 bp, Homo sapiens
actgtggaggaaggattgtaaa

SEQ ID NO: 3415317 - DNA, 23 bp, Homo sapiens
actgtggaggaaggattgtaaaa

SEQ ID NO: 3415318 - DNA, 21 bp, Homo sapiens
actgttacctgatcaatgaca

SEQ ID NO: 3415319 - DNA, 23 bp, Homo sapiens
actgttacctgatcaatgacaga

SEQ ID NO: 3415320 - DNA, 19 bp, Homo sapiens
actgttgatccatctcagt

SEQ ID NO: 3415321 - DNA, 15 bp, Homo sapiens
actgttgtccctgca

SEQ ID NO: 3415322 - DNA, 18 bp, Homo sapiens
acttaaacatcattggat

SEQ ID NO: 3415323 - DNA, 13 bp, Homo sapiens
acttagaatgcca

SEQ ID NO: 3415324 - DNA, 13 bp, Homo sapiens
acttcataaaact

SEQ ID NO: 3415325 - DNA, 17 bp, Homo sapiens
acttctgggtggggcag

SEQ ID NO: 3415326 - DNA, 20 bp, Homo sapiens
acttgacagaacactgtctt

SEQ ID NO: 3415327 - DNA, 15 bp, Homo sapiens
acttgatatttcctt

SEQ ID NO: 3415328 - DNA, 20 bp, Homo sapiens
acttgcagcgccaagtggcc

SEQ ID NO: 3415329 - DNA, 20 bp, Homo sapiens
acttgcggttccggcatgga

SEQ ID NO: 3415330 - DNA, 23 bp, Homo sapiens
actttcatttttttccaggctgg

SEQ ID NO: 3415331 - DNA, 20 bp, Homo sapiens
actttgcctttccataatca

SEQ ID NO: 3415332 - DNA, 16 bp, Homo sapiens
actttgctgttactgc

SEQ ID NO: 3415333 - DNA, 12 bp, Homo sapiens
actttgtagtgt

SEQ ID NO: 3415334 - DNA, 14 bp, Homo sapiens
acttttaactattt

SEQ ID NO: 3415335 - DNA, 22 bp, Homo sapiens
acttttattttcattgtgattt

SEQ ID NO: 3415336 - DNA, 18 bp, Homo sapiens
acttttctcctgcatgtg

SEQ ID NO: 3415337 - DNA, 21 bp, Homo sapiens
acttttctcctgcatgtgtat

SEQ ID NO: 3415338 - DNA, 14 bp, Homo sapiens
actttttaaactca

SEQ ID NO: 3415339 - DNA, 20 bp, Homo sapiens
actttttcccctgcaatgcg

SEQ ID NO: 3415340 - DNA, 23 bp, Homo sapiens
acttttttgctatccagctattt

SEQ ID NO: 3415341 - DNA, 13 bp, Homo sapiens
agaaaaaagtgtt

SEQ ID NO: 3415342 - DNA, 23 bp, Homo sapiens
agaaaatgtgtctgcaacatgga

SEQ ID NO: 3415343 - DNA, 18 bp, Homo sapiens
agaaagacagagctggga

SEQ ID NO: 3415344 - DNA, 19 bp, Homo sapiens
agaaagccaccttgttaca

SEQ ID NO: 3415345 - DNA, 14 bp, Homo sapiens
agaaatcaattttt

SEQ ID NO: 3415346 - DNA, 21 bp, Homo sapiens
agaaatcaattttttaaacca

SEQ ID NO: 3415347 - DNA, 12 bp, Homo sapiens
agaacaaaaact

SEQ ID NO: 3415348 - DNA, 16 bp, Homo sapiens
agaacacaaggtcatt

SEQ ID NO: 3415349 - DNA, 21 bp, Homo sapiens
agaacagaaatatataaaaat

SEQ ID NO: 3415350 - DNA, 18 bp, Homo sapiens
agaacagcttcaggttat

SEQ ID NO: 3415351 - DNA, 18 bp, Homo sapiens
agaacatggtgtgtgtct

SEQ ID NO: 3415352 - DNA, 20 bp, Homo sapiens
agaacatggtgtgtgtctct

SEQ ID NO: 3415353 - DNA, 23 bp, Homo sapiens
agaactacaaacaaaatttctat

SEQ ID NO: 3415354 - DNA, 14 bp, Homo sapiens
agaactttttgtta

SEQ ID NO: 3415355 - DNA, 23 bp, Homo sapiens
agaagaaataaataatctacatc

SEQ ID NO: 3415356 - DNA, 13 bp, Homo sapiens
agaagcatgaaaa

SEQ ID NO: 3415357 - DNA, 14 bp, Homo sapiens
agaagcattccttc

SEQ ID NO: 3415358 - DNA, 18 bp, Homo sapiens
agaagccacaggcctgag

SEQ ID NO: 3415359 - DNA, 22 bp, Homo sapiens
agaagctgggactcattcacat

SEQ ID NO: 3415360 - DNA, 14 bp, Homo sapiens
agaagctgttgtac

SEQ ID NO: 3415361 - DNA, 16 bp, Homo sapiens
agaagctgttgtacat

SEQ ID NO: 3415362 - DNA, 18 bp, Homo sapiens
agaagctgttgtacattt

SEQ ID NO: 3415363 - DNA, 19 bp, Homo sapiens
agaagctgttgtacattta

SEQ ID NO: 3415364 - DNA, 21 bp, Homo sapiens
agaagctgttgtacatttatg

SEQ ID NO: 3415365 - DNA, 22 bp, Homo sapiens
agaagctgttgtacatttatga

SEQ ID NO: 3415366 - DNA, 16 bp, Homo sapiens
agaaggaaaaggcagg

SEQ ID NO: 3415367 - DNA, 13 bp, Homo sapiens
agaagggggtggt

SEQ ID NO: 3415368 - DNA, 21 bp, Homo sapiens
agaagtgcttaacgttttctt

SEQ ID NO: 3415369 - DNA, 21 bp, Homo sapiens
agaagtttgggctaacattta

SEQ ID NO: 3415370 - DNA, 20 bp, Homo sapiens
agaatccagcaccggcccca

SEQ ID NO: 3415371 - DNA, 15 bp, Homo sapiens
agaatggggtgcatg

SEQ ID NO: 3415372 - DNA, 23 bp, Homo sapiens
agaatggtttttgttgagtctct

SEQ ID NO: 3415373 - DNA, 15 bp, Homo sapiens
agaatgtaagaacta

SEQ ID NO: 3415374 - DNA, 12 bp, Homo sapiens
agaattccctgt

SEQ ID NO: 3415375 - DNA, 17 bp, Homo sapiens
agaattggcataatttg

SEQ ID NO: 3415376 - DNA, 18 bp, Homo sapiens
agaattggcataatttgt

SEQ ID NO: 3415377 - DNA, 20 bp, Homo sapiens
agacaccagagcagatgcag

SEQ ID NO: 3415378 - DNA, 20 bp, Homo sapiens
agacagtttcttagcttttt

SEQ ID NO: 3415379 - DNA, 21 bp, Homo sapiens
agacagtttcttagcttttta

SEQ ID NO: 3415380 - DNA, 22 bp, Homo sapiens
agacagtttcttagctttttaa

SEQ ID NO: 3415381 - DNA, 13 bp, Homo sapiens
agacatctgcctg

SEQ ID NO: 3415382 - DNA, 15 bp, Homo sapiens
agacatctgcctgta

SEQ ID NO: 3415383 - DNA, 18 bp, Homo sapiens
agacatctgcctgtaatt

SEQ ID NO: 3415384 - DNA, 19 bp, Homo sapiens
agacatctgcctgtaatta

SEQ ID NO: 3415385 - DNA, 20 bp, Homo sapiens
agaccacagggttcaaaatg

SEQ ID NO: 3415386 - DNA, 20 bp, Homo sapiens
agaccatataactgtgatga

SEQ ID NO: 3415387 - DNA, 17 bp, Homo sapiens
agacccattccttccca

SEQ ID NO: 3415388 - DNA, 22 bp, Homo sapiens
agacccattccttcccagaggg

SEQ ID NO: 3415389 - DNA, 17 bp, Homo sapiens
agacctgcccctccctc

SEQ ID NO: 3415390 - DNA, 15 bp, Homo sapiens
agacctgtctcctgg

SEQ ID NO: 3415391 - DNA, 13 bp, Homo sapiens
agactaagccagc

SEQ ID NO: 3415392 - DNA, 17 bp, Homo sapiens
agactatattgtacaca

SEQ ID NO: 3415393 - DNA, 14 bp, Homo sapiens
agactcgagaactt

SEQ ID NO: 3415394 - DNA, 19 bp, Homo sapiens
agactcgagaactttcatt

SEQ ID NO: 3415395 - DNA, 17 bp, Homo sapiens
agactgggcctaggcca

SEQ ID NO: 3415396 - DNA, 23 bp, Homo sapiens
agagaactttttgttaacagaca

SEQ ID NO: 3415397 - DNA, 22 bp, Homo sapiens
agagaatgtatttccttttcta

SEQ ID NO: 3415398 - DNA, 17 bp, Homo sapiens
atatgtatacatataga

SEQ ID NO: 3415399 - DNA, 13 bp, Homo sapiens
atatgttgaatgt

SEQ ID NO: 3415400 - DNA, 16 bp, Homo sapiens
atatgttgaatgttaa

SEQ ID NO: 3415401 - DNA, 13 bp, Homo sapiens
atattaaatgagg

SEQ ID NO: 3415402 - DNA, 22 bp, Homo sapiens
atattaaatgagggtttctgat

SEQ ID NO: 3415403 - DNA, 16 bp, Homo sapiens
atattaagaaacaatt

SEQ ID NO: 3415404 - DNA, 17 bp, Homo sapiens
atattacctaatgaaag

SEQ ID NO: 3415405 - DNA, 15 bp, Homo sapiens
atattcaaggcttta

SEQ ID NO: 3415406 - DNA, 16 bp, Homo sapiens
atattgaaagttgctt

SEQ ID NO: 3415407 - DNA, 14 bp, Homo sapiens
atattgaccatgtg

SEQ ID NO: 3415408 - DNA, 16 bp, Homo sapiens
atattgaccatgtgat

SEQ ID NO: 3415409 - DNA, 15 bp, Homo sapiens
atatttaaaagacaa

SEQ ID NO: 3415410 - DNA, 21 bp, Homo sapiens
atatttaaaagacaaacacct

SEQ ID NO: 3415411 - DNA, 22 bp, Homo sapiens
atatttaaaagacaaacacctt

SEQ ID NO: 3415412 - DNA, 14 bp, Homo sapiens
atatttacgtatga

SEQ ID NO: 3415413 - DNA, 14 bp, Homo sapiens
atatttatgtagat

SEQ ID NO: 3415414 - DNA, 15 bp, Homo sapiens
atatttgtaaggctt

SEQ ID NO: 3415415 - DNA, 21 bp, Homo sapiens
atatttgtaaggcttgttcca

SEQ ID NO: 3415416 - DNA, 13 bp, Homo sapiens
atattttatttct

SEQ ID NO: 3415417 - DNA, 16 bp, Homo sapiens
atattttatttctgat

SEQ ID NO: 3415418 - DNA, 16 bp, Homo sapiens
atattttccatgaaaa

SEQ ID NO: 3415419 - DNA, 15 bp, Homo sapiens
atatttttaattaaa

SEQ ID NO: 3415420 - DNA, 12 bp, Homo sapiens
atcaaaaataat

SEQ ID NO: 3415421 - DNA, 15 bp, Homo sapiens
atcaaacatgaaaac

SEQ ID NO: 3415422 - DNA, 13 bp, Homo sapiens
atcaacatctttt

SEQ ID NO: 3415423 - DNA, 19 bp, Homo sapiens
atcaagtagaacaaaaact

SEQ ID NO: 3415424 - DNA, 21 bp, Homo sapiens
atcaagtagaacaaaaactat

SEQ ID NO: 3415425 - DNA, 22 bp, Homo sapiens
atcaatagtgtcctatgcaata

SEQ ID NO: 3415426 - DNA, 23 bp, Homo sapiens
atcaatagtgtcctatgcaataa

SEQ ID NO: 3415427 - DNA, 14 bp, Homo sapiens
atcaattttttaaa

SEQ ID NO: 3415428 - DNA, 14 bp, Homo sapiens
atcacaaaagctgt

SEQ ID NO: 3415429 - DNA, 19 bp, Homo sapiens
atcacaaaagctgtgtctc

SEQ ID NO: 3415430 - DNA, 18 bp, Homo sapiens
atcacatctaaagcttta

SEQ ID NO: 3415431 - DNA, 21 bp, Homo sapiens
atcactctgtgtctgagtggc

SEQ ID NO: 3415432 - DNA, 13 bp, Homo sapiens
atcactttttaaa

SEQ ID NO: 3415433 - DNA, 17 bp, Homo sapiens
atcagactaagccagca

SEQ ID NO: 3415434 - DNA, 19 bp, Homo sapiens
atcagactaagccagcacc

SEQ ID NO: 3415435 - DNA, 21 bp, Homo sapiens
atcagcaagtctctttatatg

SEQ ID NO: 3415436 - DNA, 18 bp, Homo sapiens
atcagctccactttcagt

SEQ ID NO: 3415437 - DNA, 24 bp, Homo sapiens
atcagtgttgattctagatgatca

SEQ ID NO: 3415438 - DNA, 17 bp, Homo sapiens
atcataacatagttgaa

SEQ ID NO: 3415439 - DNA, 20 bp, Homo sapiens
atcatattaaaaatatacaa

SEQ ID NO: 3415440 - DNA, 12 bp, Homo sapiens
atcatctttgct

SEQ ID NO: 3415441 - DNA, 22 bp, Homo sapiens
atcatctttgctgaatgtcatt

SEQ ID NO: 3415442 - DNA, 17 bp, Homo sapiens
atcatgctcatgtatat

SEQ ID NO: 3415443 - DNA, 18 bp, Homo sapiens
atcatggtgtaataagac

SEQ ID NO: 3415444 - DNA, 19 bp, Homo sapiens
atcatggtgtaataagaca

SEQ ID NO: 3415445 - DNA, 23 bp, Homo sapiens
atcatggtgtaataagacataac

SEQ ID NO: 3415446 - DNA, 15 bp, Homo sapiens
atcatgttacttgag

SEQ ID NO: 3415447 - DNA, 15 bp, Homo sapiens
atcattttaggaaag

SEQ ID NO: 3415448 - DNA, 20 bp, Homo sapiens
atccaaatgcattcatgttt

SEQ ID NO: 3415449 - DNA, 20 bp, Homo sapiens
atccaaatgctgtgcaaaca

SEQ ID NO: 3415450 - DNA, 21 bp, Homo sapiens
atccaaggaacctaattgaaa

SEQ ID NO: 3415451 - DNA, 18 bp, Homo sapiens
atccagcagtacaataaa

SEQ ID NO: 3415452 - DNA, 14 bp, Homo sapiens
atccatctcagtca

SEQ ID NO: 3415453 - DNA, 17 bp, Homo sapiens
atccatctcagtcactt

SEQ ID NO: 3415454 - DNA, 10 bp, Homo sapiens
atccatgctt

SEQ ID NO: 3415455 - DNA, 22 bp, Homo sapiens
atccatttcatctatttctgag

SEQ ID NO: 3415456 - DNA, 23 bp, Homo sapiens
atccatttcatctatttctgaga

SEQ ID NO: 3415457 - DNA, 21 bp, Homo sapiens
atcctagagatttggtgtaca

SEQ ID NO: 3415458 - DNA, 23 bp, Homo sapiens
atcctagagatttggtgtacaat

SEQ ID NO: 3415459 - DNA, 13 bp, Homo sapiens
atcgaaataacaa

SEQ ID NO: 3415460 - DNA, 20 bp, Homo sapiens
atcgaaataacaatgttaag

SEQ ID NO: 3415461 - DNA, 18 bp, Homo sapiens
atcgccttatttatattc

SEQ ID NO: 3415462 - DNA, 19 bp, Homo sapiens
atcggtgaaactaacagat

SEQ ID NO: 3415463 - DNA, 21 bp, Homo sapiens
atcgtggatgtctctgacaaa

SEQ ID NO: 3415464 - DNA, 13 bp, Homo sapiens
atctaaattgatc

SEQ ID NO: 3415465 - DNA, 23 bp, Homo sapiens
atctaagtatatgtgagaaatca

SEQ ID NO: 3415466 - DNA, 13 bp, Homo sapiens
atctaatagagaa

SEQ ID NO: 3415467 - DNA, 18 bp, Homo sapiens
atctaatagagaactttt

SEQ ID NO: 3415468 - DNA, 22 bp, Homo sapiens
atctatacctgccttttaagtt

SEQ ID NO: 3415469 - DNA, 14 bp, Homo sapiens
atctatattaaatg

SEQ ID NO: 3415470 - DNA, 15 bp, Homo sapiens
atctatattaaatga

SEQ ID NO: 3415471 - DNA, 14 bp, Homo sapiens
atctcactaaaaat

SEQ ID NO: 3415472 - DNA, 15 bp, Homo sapiens
atctcctctgctcat

SEQ ID NO: 3415473 - DNA, 20 bp, Homo sapiens
atctcgactcccccctggcc

SEQ ID NO: 3415474 - DNA, 22 bp, Homo sapiens
atctcttagctcccctccaacc

SEQ ID NO: 3415475 - DNA, 23 bp, Homo sapiens
atctcttagctcccctccaacct

SEQ ID NO: 3415476 - DNA, 18 bp, Homo sapiens
atctgaattttaaaacat

SEQ ID NO: 3415477 - DNA, 21 bp, Homo sapiens
atctgcaatgtttttgtgtag

SEQ ID NO: 3415478 - DNA, 20 bp, Homo sapiens
atctgcctgtaattaaacta

SEQ ID NO: 3415479 - DNA, 13 bp, Homo sapiens
atctgctctcctt

SEQ ID NO: 3415480 - DNA, 17 bp, Homo sapiens
atctgctctccttcctg

SEQ ID NO: 3415481 - DNA, 14 bp, Homo sapiens
atctgtaaactttt

SEQ ID NO: 3415482 - DNA, 16 bp, Homo sapiens
atctgtacctctgcct

SEQ ID NO: 3415483 - DNA, 11 bp, Homo sapiens
atctgtacttt

SEQ ID NO: 3415484 - DNA, 13 bp, Homo sapiens
atctgtactttgt

SEQ ID NO: 3415485 - DNA, 19 bp, Homo sapiens
atctgtggattcagcttct

SEQ ID NO: 3415486 - DNA, 14 bp, Homo sapiens
atctgttgaaatgc

SEQ ID NO: 3415487 - DNA, 15 bp, Homo sapiens
atctgttgaaatgcc

SEQ ID NO: 3415488 - DNA, 14 bp, Homo sapiens
atctgttgtttgaa

SEQ ID NO: 3415489 - DNA, 15 bp, Homo sapiens
atcttacctttatga

SEQ ID NO: 3415490 - DNA, 18 bp, Homo sapiens
atcttagtgcctgagagt

SEQ ID NO: 3415491 - DNA, 21 bp, Homo sapiens
atcttagtgcctgagagtatt

SEQ ID NO: 3415492 - DNA, 11 bp, Homo sapiens
atcttgcatgg

SEQ ID NO: 3415493 - DNA, 18 bp, Homo sapiens
atcttggccctcctcagc

SEQ ID NO: 3415494 - DNA, 19 bp, Homo sapiens
atcttgttattaatgtttc

SEQ ID NO: 3415495 - DNA, 20 bp, Homo sapiens
atcttgttattaatgtttct

SEQ ID NO: 3415496 - DNA, 17 bp, Homo sapiens
atctttgattctccttc

SEQ ID NO: 3415497 - DNA, 18 bp, Homo sapiens
atctttgattctccttca

SEQ ID NO: 3415498 - DNA, 20 bp, Homo sapiens
atctttgattctccttcagc

SEQ ID NO: 3415499 - DNA, 23 bp, Homo sapiens
atctttggacagaagcagctctt

SEQ ID NO: 3415500 - DNA, 13 bp, Homo sapiens
atctttgtgaagg

SEQ ID NO: 3415501 - DNA, 17 bp, Homo sapiens
atctttgtgaaggcctc

SEQ ID NO: 3415502 - DNA, 16 bp, Homo sapiens
atctttgtttaaatgc

SEQ ID NO: 3415503 - DNA, 18 bp, Homo sapiens
atctttgtttaaatgcca

SEQ ID NO: 3415504 - DNA, 13 bp, Homo sapiens
atgaaaacatgta

SEQ ID NO: 3415505 - DNA, 15 bp, Homo sapiens
atgaaaacattgatg

SEQ ID NO: 3415506 - DNA, 20 bp, Homo sapiens
atgaaaacattgatgaatga

SEQ ID NO: 3415507 - DNA, 15 bp, Homo sapiens
atgaactgattttta

SEQ ID NO: 3415508 - DNA, 23 bp, Homo sapiens
atgaagctggaagcactgctgtg

SEQ ID NO: 3415509 - DNA, 12 bp, Homo sapiens
cagctttcttat

SEQ ID NO: 3415510 - DNA, 14 bp, Homo sapiens
caggaaggagctgc

SEQ ID NO: 3415511 - DNA, 15 bp, Homo sapiens
caggaaggagctgcc

SEQ ID NO: 3415512 - DNA, 15 bp, Homo sapiens
caggactctgcagcc

SEQ ID NO: 3415513 - DNA, 21 bp, Homo sapiens
caggactctgcagcctcagag

SEQ ID NO: 3415514 - DNA, 16 bp, Homo sapiens
caggactgggccactt

SEQ ID NO: 3415515 - DNA, 21 bp, Homo sapiens
caggagattggatttgctgtg

SEQ ID NO: 3415516 - DNA, 14 bp, Homo sapiens
caggagctcccctc

SEQ ID NO: 3415517 - DNA, 21 bp, Homo sapiens
caggagctcccctccccaact

SEQ ID NO: 3415518 - DNA, 16 bp, Homo sapiens
caggatcatggtgtaa

SEQ ID NO: 3415519 - DNA, 14 bp, Homo sapiens
caggatgaagcatt

SEQ ID NO: 3415520 - DNA, 15 bp, Homo sapiens
caggatgaagcattt

SEQ ID NO: 3415521 - DNA, 15 bp, Homo sapiens
caggatgctttggtt

SEQ ID NO: 3415522 - DNA, 20 bp, Homo sapiens
caggatttatacatacagag

SEQ ID NO: 3415523 - DNA, 15 bp, Homo sapiens
caggcactgccctgg

SEQ ID NO: 3415524 - DNA, 14 bp, Homo sapiens
caggcagctcgagg

SEQ ID NO: 3415525 - DNA, 19 bp, Homo sapiens
caggcagctttttctctcc

SEQ ID NO: 3415526 - DNA, 14 bp, Homo sapiens
caggccaggactct

SEQ ID NO: 3415527 - DNA, 17 bp, Homo sapiens
caggccaggactctgca

SEQ ID NO: 3415528 - DNA, 20 bp, Homo sapiens
caggccaggactctgcagcc

SEQ ID NO: 3415529 - DNA, 21 bp, Homo sapiens
caggccaggactctgcagcct

SEQ ID NO: 3415530 - DNA, 19 bp, Homo sapiens
caggcctgagatttcatct

SEQ ID NO: 3415531 - DNA, 23 bp, Homo sapiens
caggcctgagatttcatctgctc

SEQ ID NO: 3415532 - DNA, 13 bp, Homo sapiens
caggctagatccc

SEQ ID NO: 3415533 - DNA, 13 bp, Homo sapiens
cagggagagccca

SEQ ID NO: 3415534 - DNA, 15 bp, Homo sapiens
cagggagctgcaggg

SEQ ID NO: 3415535 - DNA, 18 bp, Homo sapiens
cagggagctgcaggggca

SEQ ID NO: 3415536 - DNA, 15 bp, Homo sapiens
cagggcagccaggga

SEQ ID NO: 3415537 - DNA, 19 bp, Homo sapiens
cagggcatattaaaggctt

SEQ ID NO: 3415538 - DNA, 20 bp, Homo sapiens
cagggcattgtgttcactgt

SEQ ID NO: 3415539 - DNA, 13 bp, Homo sapiens
cagggcctgcgag

SEQ ID NO: 3415540 - DNA, 18 bp, Homo sapiens
cagggctgaggcctctca

SEQ ID NO: 3415541 - DNA, 14 bp, Homo sapiens
cagggctggactga

SEQ ID NO: 3415542 - DNA, 22 bp, Homo sapiens
cagggctggactgaggcctgag

SEQ ID NO: 3415543 - DNA, 14 bp, Homo sapiens
caggggccagaaga

SEQ ID NO: 3415544 - DNA, 18 bp, Homo sapiens
cagggttcaaaatgtctg

SEQ ID NO: 3415545 - DNA, 19 bp, Homo sapiens
caggtagaacacaaggtca

SEQ ID NO: 3415546 - DNA, 18 bp, Homo sapiens
caggtagacctgtctcct

SEQ ID NO: 3415547 - DNA, 21 bp, Homo sapiens
caggtagacctgtctcctggc

SEQ ID NO: 3415548 - DNA, 14 bp, Homo sapiens
caggtctcctctta

SEQ ID NO: 3415549 - DNA, 15 bp, Homo sapiens
caggtgcaaccaggg

SEQ ID NO: 3415550 - DNA, 18 bp, Homo sapiens
caggtgcaaccagggagc

SEQ ID NO: 3415551 - DNA, 14 bp, Homo sapiens
caggttggaaaaga

SEQ ID NO: 3415552 - DNA, 16 bp, Homo sapiens
caggtttgtttcttga

SEQ ID NO: 3415553 - DNA, 17 bp, Homo sapiens
caggtttgtttcttgat

SEQ ID NO: 3415554 - DNA, 18 bp, Homo sapiens
cagtaagtataacaaact

SEQ ID NO: 3415555 - DNA, 22 bp, Homo sapiens
cagtataatctcctctgctcat

SEQ ID NO: 3415556 - DNA, 14 bp, Homo sapiens
cagtatacagtcct

SEQ ID NO: 3415557 - DNA, 23 bp, Homo sapiens
cagtatcctgctggttcactcta

SEQ ID NO: 3415558 - DNA, 12 bp, Homo sapiens
cagtatgtggaa

SEQ ID NO: 3415559 - DNA, 18 bp, Homo sapiens
cagtattatttgtatgta

SEQ ID NO: 3415560 - DNA, 20 bp, Homo sapiens
cagtattatttgtatgtatt

SEQ ID NO: 3415561 - DNA, 12 bp, Homo sapiens
cagtattttcca

SEQ ID NO: 3415562 - DNA, 19 bp, Homo sapiens
cagtcatgcataaatatgc

SEQ ID NO: 3415563 - DNA, 20 bp, Homo sapiens
cagtcgtgtaattggcccaa

SEQ ID NO: 3415564 - DNA, 16 bp, Homo sapiens
cagtctcaattttgta

SEQ ID NO: 3415565 - DNA, 22 bp, Homo sapiens
cagtctgatgagaactctgagc

SEQ ID NO: 3415566 - DNA, 22 bp, Homo sapiens
cagtctttaatctgagaggcca

SEQ ID NO: 3415567 - DNA, 14 bp, Homo sapiens
cagtgaaagcatca

SEQ ID NO: 3415568 - DNA, 20 bp, Homo sapiens
cagtgaaagtcaattcagtg

SEQ ID NO: 3415569 - DNA, 18 bp, Homo sapiens
cagtgaatttaagcatga

SEQ ID NO: 3415570 - DNA, 17 bp, Homo sapiens
cagtgagtgccatgctt

SEQ ID NO: 3415571 - DNA, 21 bp, Homo sapiens
cagtgagtgccatgctttttg

SEQ ID NO: 3415572 - DNA, 21 bp, Homo sapiens
cagtgatatggcagaagacac

SEQ ID NO: 3415573 - DNA, 21 bp, Homo sapiens
cagtgatctcactaaaaatat

SEQ ID NO: 3415574 - DNA, 19 bp, Homo sapiens
cagtgatctcgactccccc

SEQ ID NO: 3415575 - DNA, 19 bp, Homo sapiens
cagtgcttgattgcgtgga

SEQ ID NO: 3415576 - DNA, 18 bp, Homo sapiens
cagtggctggatctgtga

SEQ ID NO: 3415577 - DNA, 19 bp, Homo sapiens
cagtgtcgggaattttccc

SEQ ID NO: 3415578 - DNA, 18 bp, Homo sapiens
cagtgtgaataaagtgct

SEQ ID NO: 3415579 - DNA, 15 bp, Homo sapiens
cagtgtggccaggct

SEQ ID NO: 3415580 - DNA, 16 bp, Homo sapiens
cagtgtggccaggctg

SEQ ID NO: 3415581 - DNA, 23 bp, Homo sapiens
cagtgttcagccaaacagtatga

SEQ ID NO: 3415582 - DNA, 20 bp, Homo sapiens
cagtgttgattctagatgat

SEQ ID NO: 3415583 - DNA, 13 bp, Homo sapiens
cagtgtttatgac

SEQ ID NO: 3415584 - DNA, 15 bp, Homo sapiens
cagtgtttgtatacc

SEQ ID NO: 3415585 - DNA, 15 bp, Homo sapiens
cagttataagcgtat

SEQ ID NO: 3415586 - DNA, 15 bp, Homo sapiens
cagttcctttcaatg

SEQ ID NO: 3415587 - DNA, 10 bp, Homo sapiens
cagttgaact

SEQ ID NO: 3415588 - DNA, 23 bp, Homo sapiens
cagttgtccagatcactgaattg

SEQ ID NO: 3415589 - DNA, 18 bp, Homo sapiens
cagtttcttagcttttta

SEQ ID NO: 3415590 - DNA, 13 bp, Homo sapiens
cagttttgttttg

SEQ ID NO: 3415591 - DNA, 23 bp, Homo sapiens
cataaatacagtattcccactct

SEQ ID NO: 3415592 - DNA, 13 bp, Homo sapiens
cataaatatgcag

SEQ ID NO: 3415593 - DNA, 15 bp, Homo sapiens
cataaatatgcagtg

SEQ ID NO: 3415594 - DNA, 22 bp, Homo sapiens
cataacattgattttaaaaata

SEQ ID NO: 3415595 - DNA, 20 bp, Homo sapiens
cataacgtttttcctttaaa

SEQ ID NO: 3415596 - DNA, 15 bp, Homo sapiens
catacctggccctgt

SEQ ID NO: 3415597 - DNA, 14 bp, Homo sapiens
catactcttaagtg

SEQ ID NO: 3415598 - DNA, 12 bp, Homo sapiens
catagagcaatt

SEQ ID NO: 3415599 - DNA, 13 bp, Homo sapiens
catagagcaatta

SEQ ID NO: 3415600 - DNA, 20 bp, Homo sapiens
catagagcaattaaactgtg

SEQ ID NO: 3415601 - DNA, 20 bp, Homo sapiens
cataggtaggtatctttata

SEQ ID NO: 3415602 - DNA, 23 bp, Homo sapiens
cataggtaggtatctttatagtt

SEQ ID NO: 3415603 - DNA, 13 bp, Homo sapiens
catagttgaaaaa

SEQ ID NO: 3415604 - DNA, 19 bp, Homo sapiens
catataaaatgctgatatt

SEQ ID NO: 3415605 - DNA, 17 bp, Homo sapiens
catatatgctgtatttc

SEQ ID NO: 3415606 - DNA, 18 bp, Homo sapiens
catatatgctgtatttct

SEQ ID NO: 3415607 - DNA, 18 bp, Homo sapiens
catatctctagtccctgt

SEQ ID NO: 3415608 - DNA, 13 bp, Homo sapiens
catattaaaggct

SEQ ID NO: 3415609 - DNA, 12 bp, Homo sapiens
catatttcaatt

SEQ ID NO: 3415610 - DNA, 15 bp, Homo sapiens
catcaaacatgaaaa

SEQ ID NO: 3415611 - DNA, 18 bp, Homo sapiens
catcaaacatgaaaacat

SEQ ID NO: 3415612 - DNA, 21 bp, Homo sapiens
catcaaataaaccttgtttct

SEQ ID NO: 3415613 - DNA, 19 bp, Homo sapiens
catcatagaacagaaatat

SEQ ID NO: 3415614 - DNA, 17 bp, Homo sapiens
catcatattaaaaatat

SEQ ID NO: 3415615 - DNA, 22 bp, Homo sapiens
catcatattaaaaatatacaag

SEQ ID NO: 3415616 - DNA, 18 bp, Homo sapiens
catcattggataaatttg

SEQ ID NO: 3415617 - DNA, 15 bp, Homo sapiens
catccaaggaaccta

SEQ ID NO: 3415618 - DNA, 21 bp, Homo sapiens
catccaaggaacctaattgaa

SEQ ID NO: 3415619 - DNA, 14 bp, Homo sapiens
catcctaaatattg

SEQ ID NO: 3415620 - DNA, 18 bp, Homo sapiens
catccttcctcacaccag

SEQ ID NO: 3415621 - DNA, 18 bp, Homo sapiens
cctcgttctccctgggag

SEQ ID NO: 3415622 - DNA, 20 bp, Homo sapiens
cctctccccaatccatgctt

SEQ ID NO: 3415623 - DNA, 22 bp, Homo sapiens
cctctccccaatccatgcttca

SEQ ID NO: 3415624 - DNA, 13 bp, Homo sapiens
cctctcccctgcc

SEQ ID NO: 3415625 - DNA, 21 bp, Homo sapiens
cctctcccctgccccctgcag

SEQ ID NO: 3415626 - DNA, 23 bp, Homo sapiens
cctctcccctgccccctgcagga

SEQ ID NO: 3415627 - DNA, 20 bp, Homo sapiens
cctctgctcattaaactgat

SEQ ID NO: 3415628 - DNA, 24 bp, Homo sapiens
cctctggtttgccggtggtgcagg

SEQ ID NO: 3415629 - DNA, 18 bp, Homo sapiens
cctctgtccccttctctc

SEQ ID NO: 3415630 - DNA, 17 bp, Homo sapiens
cctcttaaaaaataaaa

SEQ ID NO: 3415631 - DNA, 20 bp, Homo sapiens
cctcttcctggaataaacat

SEQ ID NO: 3415632 - DNA, 15 bp, Homo sapiens
cctcttggctgcctt

SEQ ID NO: 3415633 - DNA, 16 bp, Homo sapiens
cctgaactctgcaact

SEQ ID NO: 3415634 - DNA, 19 bp, Homo sapiens
cctgaagagaagggcaggg

SEQ ID NO: 3415635 - DNA, 14 bp, Homo sapiens
cctgactctcagca

SEQ ID NO: 3415636 - DNA, 20 bp, Homo sapiens
cctgcaatgcgtcttgtgaa

SEQ ID NO: 3415637 - DNA, 19 bp, Homo sapiens
cctgcaggaaggagctgcc

SEQ ID NO: 3415638 - DNA, 22 bp, Homo sapiens
cctgcaggaaggagctgcctgg

SEQ ID NO: 3415639 - DNA, 23 bp, Homo sapiens
cctgcaggaaggagctgcctgga

SEQ ID NO: 3415640 - DNA, 12 bp, Homo sapiens
cctgcatgtgta

SEQ ID NO: 3415641 - DNA, 13 bp, Homo sapiens
cctgcatgtgtat

SEQ ID NO: 3415642 - DNA, 19 bp, Homo sapiens
cctgcatgtgtatatatgt

SEQ ID NO: 3415643 - DNA, 18 bp, Homo sapiens
cctgcattggaactggag

SEQ ID NO: 3415644 - DNA, 14 bp, Homo sapiens
cctgccacctcctg

SEQ ID NO: 3415645 - DNA, 13 bp, Homo sapiens
cctgccacctgga

SEQ ID NO: 3415646 - DNA, 14 bp, Homo sapiens
cctgcccccaggac

SEQ ID NO: 3415647 - DNA, 16 bp, Homo sapiens
cctgcccccaggactg

SEQ ID NO: 3415648 - DNA, 22 bp, Homo sapiens
cctgcccccaggactgggccac

SEQ ID NO: 3415649 - DNA, 16 bp, Homo sapiens
cctgcctccagggctg

SEQ ID NO: 3415650 - DNA, 20 bp, Homo sapiens
cctgcctccagggctggact

SEQ ID NO: 3415651 - DNA, 17 bp, Homo sapiens
cctgccttttaagtttg

SEQ ID NO: 3415652 - DNA, 22 bp, Homo sapiens
cctgctagttagcgccccaccg

SEQ ID NO: 3415653 - DNA, 15 bp, Homo sapiens
cctgctgctgcctgc

SEQ ID NO: 3415654 - DNA, 18 bp, Homo sapiens
cctgctgctgcctgcctg

SEQ ID NO: 3415655 - DNA, 22 bp, Homo sapiens
cctggaataaacatctgtgtct

SEQ ID NO: 3415656 - DNA, 13 bp, Homo sapiens
cctggagcccaga

SEQ ID NO: 3415657 - DNA, 14 bp, Homo sapiens
cctggagcccagag

SEQ ID NO: 3415658 - DNA, 11 bp, Homo sapiens
cctggagccct

SEQ ID NO: 3415659 - DNA, 13 bp, Homo sapiens
cctggagccctgt

SEQ ID NO: 3415660 - DNA, 14 bp, Homo sapiens
cctggagccctgtt

SEQ ID NO: 3415661 - DNA, 22 bp, Homo sapiens
cctggccacagacccccagggc

SEQ ID NO: 3415662 - DNA, 14 bp, Homo sapiens
cctggcctccccca

SEQ ID NO: 3415663 - DNA, 18 bp, Homo sapiens
cctggcctcccccacttt

SEQ ID NO: 3415664 - DNA, 13 bp, Homo sapiens
cctggcggcagga

SEQ ID NO: 3415665 - DNA, 17 bp, Homo sapiens
cctggcggcaggaagcc

SEQ ID NO: 3415666 - DNA, 14 bp, Homo sapiens
cctgggaccagggc

SEQ ID NO: 3415667 - DNA, 15 bp, Homo sapiens
cctgggcagtgagtg

SEQ ID NO: 3415668 - DNA, 17 bp, Homo sapiens
cctgggcagtgagtgcc

SEQ ID NO: 3415669 - DNA, 21 bp, Homo sapiens
cctggtggccctctcccctgc

SEQ ID NO: 3415670 - DNA, 15 bp, Homo sapiens
cctgtcccacctggc

SEQ ID NO: 3415671 - DNA, 19 bp, Homo sapiens
cctgtcccacctggctccc

SEQ ID NO: 3415672 - DNA, 18 bp, Homo sapiens
cctgttggcagctctagc

SEQ ID NO: 3415673 - DNA, 22 bp, Homo sapiens
cctgttggctacacagacccct

SEQ ID NO: 3415674 - DNA, 12 bp, Homo sapiens
ccttaataaata

SEQ ID NO: 3415675 - DNA, 23 bp, Homo sapiens
ccttaataaatatagttgtcttt

SEQ ID NO: 3415676 - DNA, 23 bp, Homo sapiens
ccttactgaaaaaaaaaaaagaa

SEQ ID NO: 3415677 - DNA, 23 bp, Homo sapiens
ccttactttactgcctgaataaa

SEQ ID NO: 3415678 - DNA, 19 bp, Homo sapiens
ccttattgagcgtgattct

SEQ ID NO: 3415679 - DNA, 23 bp, Homo sapiens
ccttatttgtcggggaagatgaa

SEQ ID NO: 3415680 - DNA, 13 bp, Homo sapiens
ccttcagccctca

SEQ ID NO: 3415681 - DNA, 12 bp, Homo sapiens
ccttcccagagg

SEQ ID NO: 3415682 - DNA, 19 bp, Homo sapiens
ccttcccagaggggcctgc

SEQ ID NO: 3415683 - DNA, 19 bp, Homo sapiens
ccttctccatggccctgcc

SEQ ID NO: 3415684 - DNA, 18 bp, Homo sapiens
ccttctgaggacattcca

SEQ ID NO: 3415685 - DNA, 21 bp, Homo sapiens
ccttctgaggacattccaaga

SEQ ID NO: 3415686 - DNA, 19 bp, Homo sapiens
ccttctttgataatgttaa

SEQ ID NO: 3415687 - DNA, 18 bp, Homo sapiens
ccttgagaattccctgtg

SEQ ID NO: 3415688 - DNA, 17 bp, Homo sapiens
ccttgcccccctggcct

SEQ ID NO: 3415689 - DNA, 11 bp, Homo sapiens
ccttgctacct

SEQ ID NO: 3415690 - DNA, 12 bp, Homo sapiens
ccttgctacctc

SEQ ID NO: 3415691 - DNA, 15 bp, Homo sapiens
ccttgcttttatagt

SEQ ID NO: 3415692 - DNA, 23 bp, Homo sapiens
ccttgcttttatagttgtatttt

SEQ ID NO: 3415693 - DNA, 11 bp, Homo sapiens
ccttgggggtc

SEQ ID NO: 3415694 - DNA, 11 bp, Homo sapiens
ccttgtatagt

SEQ ID NO: 3415695 - DNA, 24 bp, Homo sapiens
ccttgtatagtgtccccatgggct

SEQ ID NO: 3415696 - DNA, 20 bp, Homo sapiens
cctttaaaaaaatttaagtg

SEQ ID NO: 3415697 - DNA, 15 bp, Homo sapiens
cctttcccatttcgt

SEQ ID NO: 3415698 - DNA, 19 bp, Homo sapiens
cctttctcccctgccccca

SEQ ID NO: 3415699 - DNA, 18 bp, Homo sapiens
cctttgtaatatgagaat

SEQ ID NO: 3415700 - DNA, 20 bp, Homo sapiens
ccttttatctccttgtggcc

SEQ ID NO: 3415701 - DNA, 22 bp, Homo sapiens
ccttttatctccttgtggccta

SEQ ID NO: 3415702 - DNA, 17 bp, Homo sapiens
cgaaataacaatgttaa

SEQ ID NO: 3415703 - DNA, 16 bp, Homo sapiens
cgactcccccctggcc

SEQ ID NO: 3415704 - DNA, 21 bp, Homo sapiens
cgagaaacaagacaagctcct

SEQ ID NO: 3415705 - DNA, 14 bp, Homo sapiens
cgcagagctggccg

SEQ ID NO: 3415706 - DNA, 24 bp, Homo sapiens
cgcaggaagacccaacacatggga

SEQ ID NO: 3415707 - DNA, 13 bp, Homo sapiens
cgcccactctcca

SEQ ID NO: 3415708 - DNA, 18 bp, Homo sapiens
cgcccactctccacctca

SEQ ID NO: 3415709 - DNA, 19 bp, Homo sapiens
cgcccctcccacagcgctg

SEQ ID NO: 3415710 - DNA, 19 bp, Homo sapiens
cgcgccaaataatgtctct

SEQ ID NO: 3415711 - DNA, 18 bp, Homo sapiens
cgctcctgccgcagagct

SEQ ID NO: 3415712 - DNA, 20 bp, Homo sapiens
cgctcctgccgcagagctgg

SEQ ID NO: 3415713 - DNA, 23 bp, Homo sapiens
cgctggccgggaccccgagcctg

SEQ ID NO: 3415714 - DNA, 18 bp, Homo sapiens
cggacaaagttcagtgtc

SEQ ID NO: 3415715 - DNA, 14 bp, Homo sapiens
cggagagtgggggt

SEQ ID NO: 3415716 - DNA, 19 bp, Homo sapiens
cggatctttggacagaagc

SEQ ID NO: 3415717 - DNA, 16 bp, Homo sapiens
cggctcccctcgacag

SEQ ID NO: 3415718 - DNA, 16 bp, Homo sapiens
cgggcgcactgcctct

SEQ ID NO: 3415719 - DNA, 17 bp, Homo sapiens
cgggcgcactgcctctc

SEQ ID NO: 3415720 - DNA, 18 bp, Homo sapiens
cgggcgcactgcctctca

SEQ ID NO: 3415721 - DNA, 22 bp, Homo sapiens
cgggcgcactgcctctcacagc

SEQ ID NO: 3415722 - DNA, 16 bp, Homo sapiens
cggggctcttctcatt

SEQ ID NO: 3415723 - DNA, 19 bp, Homo sapiens
cggggcttttaaaaggaaa

SEQ ID NO: 3415724 - DNA, 18 bp, Homo sapiens
cgggttaagaaatacctt

SEQ ID NO: 3415725 - DNA, 20 bp, Homo sapiens
cggtcccctctgccccaccc

SEQ ID NO: 3415726 - DNA, 19 bp, Homo sapiens
cggtgggggtagggggctg

SEQ ID NO: 3415727 - DNA, 13 bp, Homo sapiens
cgtataatgcttt

SEQ ID NO: 3415728 - DNA, 14 bp, Homo sapiens
cgtataatgctttc

SEQ ID NO: 3415729 - DNA, 17 bp, Homo sapiens
cgtccagctgcccttcc

SEQ ID NO: 3415730 - DNA, 12 bp, Homo sapiens
cgtcttgtgaaa

SEQ ID NO: 3415731 - DNA, 14 bp, Homo sapiens
cgtcttgtgaaatt

SEQ ID NO: 3415732 - DNA, 23 bp, Homo sapiens
cttcactgtataaataggagagg

SEQ ID NO: 3415733 - DNA, 17 bp, Homo sapiens
cttcagccctcacccct

SEQ ID NO: 3415734 - DNA, 19 bp, Homo sapiens
cttcagccctcacccctgg

SEQ ID NO: 3415735 - DNA, 14 bp, Homo sapiens
cttcagctggtgga

SEQ ID NO: 3415736 - DNA, 19 bp, Homo sapiens
cttcagctggtggatggtg

SEQ ID NO: 3415737 - DNA, 16 bp, Homo sapiens
cttcataaaactcatg

SEQ ID NO: 3415738 - DNA, 15 bp, Homo sapiens
cttcataatggcctg

SEQ ID NO: 3415739 - DNA, 23 bp, Homo sapiens
cttccattaaattgcctttgtaa

SEQ ID NO: 3415740 - DNA, 19 bp, Homo sapiens
cttcccagaggggcctgcc

SEQ ID NO: 3415741 - DNA, 21 bp, Homo sapiens
cttcccagaggggcctgccac

SEQ ID NO: 3415742 - DNA, 13 bp, Homo sapiens
cttcctggaataa

SEQ ID NO: 3415743 - DNA, 21 bp, Homo sapiens
cttcctggaataaacatctgt

SEQ ID NO: 3415744 - DNA, 16 bp, Homo sapiens
cttcctgtctgtttat

SEQ ID NO: 3415745 - DNA, 19 bp, Homo sapiens
cttccttagaacttctaca

SEQ ID NO: 3415746 - DNA, 17 bp, Homo sapiens
cttctacctcttggctg

SEQ ID NO: 3415747 - DNA, 13 bp, Homo sapiens
cttctaggaagct

SEQ ID NO: 3415748 - DNA, 16 bp, Homo sapiens
cttctcatcctgcagg

SEQ ID NO: 3415749 - DNA, 17 bp, Homo sapiens
cttctcatcctgcaggc

SEQ ID NO: 3415750 - DNA, 14 bp, Homo sapiens
cttctcatttcacc

SEQ ID NO: 3415751 - DNA, 21 bp, Homo sapiens
cttctcatttcacccctccct

SEQ ID NO: 3415752 - DNA, 22 bp, Homo sapiens
cttctcatttcacccctccctt

SEQ ID NO: 3415753 - DNA, 16 bp, Homo sapiens
cttctccaattctgaa

SEQ ID NO: 3415754 - DNA, 19 bp, Homo sapiens
cttctccatggccctgcca

SEQ ID NO: 3415755 - DNA, 16 bp, Homo sapiens
cttctctcatctctta

SEQ ID NO: 3415756 - DNA, 20 bp, Homo sapiens
cttctgaggacattccaaga

SEQ ID NO: 3415757 - DNA, 15 bp, Homo sapiens
cttctgggtggggca

SEQ ID NO: 3415758 - DNA, 20 bp, Homo sapiens
cttctgtagtttttaattaa

SEQ ID NO: 3415759 - DNA, 19 bp, Homo sapiens
cttctgttgtcaccttcac

SEQ ID NO: 3415760 - DNA, 20 bp, Homo sapiens
cttctgttgtcaccttcacc

SEQ ID NO: 3415761 - DNA, 21 bp, Homo sapiens
cttctgttgtcaccttcacct

SEQ ID NO: 3415762 - DNA, 13 bp, Homo sapiens
cttcttgtaatat

SEQ ID NO: 3415763 - DNA, 19 bp, Homo sapiens
cttctttgataatgttaaa

SEQ ID NO: 3415764 - DNA, 15 bp, Homo sapiens
cttcttttctttgta

SEQ ID NO: 3415765 - DNA, 17 bp, Homo sapiens
cttgacagaacactgtc

SEQ ID NO: 3415766 - DNA, 22 bp, Homo sapiens
cttgatttgatctttgtttaaa

SEQ ID NO: 3415767 - DNA, 21 bp, Homo sapiens
cttgcacgcgccctttctacc

SEQ ID NO: 3415768 - DNA, 14 bp, Homo sapiens
cttgcactattcca

SEQ ID NO: 3415769 - DNA, 14 bp, Homo sapiens
cttgccaagaaatc

SEQ ID NO: 3415770 - DNA, 17 bp, Homo sapiens
cttgcctctgtcccctt

SEQ ID NO: 3415771 - DNA, 23 bp, Homo sapiens
cttgcctctgtccccttctctca

SEQ ID NO: 3415772 - DNA, 16 bp, Homo sapiens
cttgctacctcaaggg

SEQ ID NO: 3415773 - DNA, 21 bp, Homo sapiens
cttggaaactggatgaggtca

SEQ ID NO: 3415774 - DNA, 15 bp, Homo sapiens
cttggccctcctcag

SEQ ID NO: 3415775 - DNA, 22 bp, Homo sapiens
cttgggtgtaacaggtctcctc

SEQ ID NO: 3415776 - DNA, 15 bp, Homo sapiens
cttggttgttaattt

SEQ ID NO: 3415777 - DNA, 14 bp, Homo sapiens
cttgtattgctcca

SEQ ID NO: 3415778 - DNA, 20 bp, Homo sapiens
cttgtcaatggaagaaaccc

SEQ ID NO: 3415779 - DNA, 12 bp, Homo sapiens
cttgtgaaattg

SEQ ID NO: 3415780 - DNA, 14 bp, Homo sapiens
cttgtgaaattgtg

SEQ ID NO: 3415781 - DNA, 15 bp, Homo sapiens
cttgtgaaattgtgt

SEQ ID NO: 3415782 - DNA, 17 bp, Homo sapiens
cttgtgaaattgtgtag

SEQ ID NO: 3415783 - DNA, 14 bp, Homo sapiens
cttgtggcctatga

SEQ ID NO: 3415784 - DNA, 16 bp, Homo sapiens
cttgtggcctatgaaa

SEQ ID NO: 3415785 - DNA, 20 bp, Homo sapiens
cttgttcatccaaggaacct

SEQ ID NO: 3415786 - DNA, 14 bp, Homo sapiens
cttgtttctttctg

SEQ ID NO: 3415787 - DNA, 16 bp, Homo sapiens
cttgtttctttctgaa

SEQ ID NO: 3415788 - DNA, 15 bp, Homo sapiens
cttgtttttataata

SEQ ID NO: 3415789 - DNA, 23 bp, Homo sapiens
cttgtttttataataaaaagctt

SEQ ID NO: 3415790 - DNA, 21 bp, Homo sapiens
ctttaaagataagtctacatt

SEQ ID NO: 3415791 - DNA, 14 bp, Homo sapiens
ctttaaatttaggt

SEQ ID NO: 3415792 - DNA, 22 bp, Homo sapiens
ctttaatcacttaacattccta

SEQ ID NO: 3415793 - DNA, 23 bp, Homo sapiens
ctttagcagggaagtcacttcac

SEQ ID NO: 3415794 - DNA, 13 bp, Homo sapiens
ctttatataaggt

SEQ ID NO: 3415795 - DNA, 16 bp, Homo sapiens
ctttatataaggtcat

SEQ ID NO: 3415796 - DNA, 20 bp, Homo sapiens
ctttatataaggtcatagat

SEQ ID NO: 3415797 - DNA, 22 bp, Homo sapiens
ctttatataaggtcatagattc

SEQ ID NO: 3415798 - DNA, 21 bp, Homo sapiens
ctttatgtacaggatgctttg

SEQ ID NO: 3415799 - DNA, 20 bp, Homo sapiens
ctttatgtttttgaggcttt

SEQ ID NO: 3415800 - DNA, 20 bp, Homo sapiens
ctttcatttttttccaggct

SEQ ID NO: 3415801 - DNA, 22 bp, Homo sapiens
ctttcccaggtaatttaaattg

SEQ ID NO: 3415802 - DNA, 21 bp, Homo sapiens
ctttctagtggtctttgtaag

SEQ ID NO: 3415803 - DNA, 23 bp, Homo sapiens
ctttctagtggtctttgtaagag

SEQ ID NO: 3415804 - DNA, 20 bp, Homo sapiens
ctttctgagtgagttttact

SEQ ID NO: 3415805 - DNA, 13 bp, Homo sapiens
ctttctgttgcca

SEQ ID NO: 3415806 - DNA, 14 bp, Homo sapiens
ctttctttgctgct

SEQ ID NO: 3415807 - DNA, 21 bp, Homo sapiens
ctttctttgctgctgtggaaa

SEQ ID NO: 3415808 - DNA, 15 bp, Homo sapiens
ctttgagacagtttc

SEQ ID NO: 3415809 - DNA, 16 bp, Homo sapiens
ctttgagacagtttct

SEQ ID NO: 3415810 - DNA, 14 bp, Homo sapiens
ctttgatagtgtaa

SEQ ID NO: 3415811 - DNA, 13 bp, Homo sapiens
ctttgattctcct

SEQ ID NO: 3415812 - DNA, 16 bp, Homo sapiens
ctttgattctccttca

SEQ ID NO: 3415813 - DNA, 18 bp, Homo sapiens
ctttgattctccttcagc

SEQ ID NO: 3415814 - DNA, 19 bp, Homo sapiens
ctttgattctccttcagcc

SEQ ID NO: 3415815 - DNA, 18 bp, Homo sapiens
ctttgctgttactgcttc

SEQ ID NO: 3415816 - DNA, 21 bp, Homo sapiens
ctttgctgttactgcttctct

SEQ ID NO: 3415817 - DNA, 18 bp, Homo sapiens
ctttggacagaagcagct

SEQ ID NO: 3415818 - DNA, 18 bp, Homo sapiens
ctttgtaagagtgtagaa

SEQ ID NO: 3415819 - DNA, 23 bp, Homo sapiens
ctttgtaagagtgtagaagcatt

SEQ ID NO: 3415820 - DNA, 13 bp, Homo sapiens
ctttgtaatatga

SEQ ID NO: 3415821 - DNA, 12 bp, Homo sapiens
ctttgtgcaaaa

SEQ ID NO: 3415822 - DNA, 16 bp, Homo sapiens
ctttgtgcaaaagcag

SEQ ID NO: 3415823 - DNA, 17 bp, Homo sapiens
ctttgtttaaatgccaa

SEQ ID NO: 3415824 - DNA, 13 bp, Homo sapiens
cttttaaaaggaa

SEQ ID NO: 3415825 - DNA, 14 bp, Homo sapiens
cttttaaaaggaaa

SEQ ID NO: 3415826 - DNA, 15 bp, Homo sapiens
cttttaaaaggaaaa

SEQ ID NO: 3415827 - DNA, 16 bp, Homo sapiens
cttttaaaaggaaaac

SEQ ID NO: 3415828 - DNA, 21 bp, Homo sapiens
cttttaagtttgaaactaact

SEQ ID NO: 3415829 - DNA, 21 bp, Homo sapiens
cttttagttacatgaattaag

SEQ ID NO: 3415830 - DNA, 15 bp, Homo sapiens
cttttatctccttgt

SEQ ID NO: 3415831 - DNA, 16 bp, Homo sapiens
cttttattttcattgt

SEQ ID NO: 3415832 - DNA, 21 bp, Homo sapiens
cttttctcctgcatgtgtata

SEQ ID NO: 3415833 - DNA, 21 bp, Homo sapiens
cttttgaagaacaaaaggctt

SEQ ID NO: 3415834 - DNA, 22 bp, Homo sapiens
cttttgaagaacaaaaggcttt

SEQ ID NO: 3415835 - DNA, 20 bp, Homo sapiens
cttttgaatccatgcttggg

SEQ ID NO: 3415836 - DNA, 23 bp, Homo sapiens
cttttgaatccatgcttgggtgt

SEQ ID NO: 3415837 - DNA, 17 bp, Homo sapiens
cttttgagtatggctat

SEQ ID NO: 3415838 - DNA, 23 bp, Homo sapiens
cttttgtttgcggggcttttaaa

SEQ ID NO: 3415839 - DNA, 12 bp, Homo sapiens
ctttttaaacag

SEQ ID NO: 3415840 - DNA, 15 bp, Homo sapiens
ctttttaaacagtgt

SEQ ID NO: 3415841 - DNA, 14 bp, Homo sapiens
ctttttaattgttg

SEQ ID NO: 3415842 - DNA, 20 bp, Homo sapiens
ctttttatatttaaaaaatt

SEQ ID NO: 3415843 - DNA, 16 bp, Homo sapiens
gcatatcctgagccat

SEQ ID NO: 3415844 - DNA, 19 bp, Homo sapiens
gcatatctctagtccctgt

SEQ ID NO: 3415845 - DNA, 22 bp, Homo sapiens
gcatatctctagtccctgtgtt

SEQ ID NO: 3415846 - DNA, 12 bp, Homo sapiens
gcatattaaagg

SEQ ID NO: 3415847 - DNA, 15 bp, Homo sapiens
gcatcaaacatgaaa

SEQ ID NO: 3415848 - DNA, 22 bp, Homo sapiens
gcatcaaacatgaaaacattga

SEQ ID NO: 3415849 - DNA, 21 bp, Homo sapiens
gcatggacaatggaccggaga

SEQ ID NO: 3415850 - DNA, 17 bp, Homo sapiens
gcatgtaaaatcttcag

SEQ ID NO: 3415851 - DNA, 16 bp, Homo sapiens
gcatgtatagttgctt

SEQ ID NO: 3415852 - DNA, 18 bp, Homo sapiens
gcatgtatagttgctttt

SEQ ID NO: 3415853 - DNA, 16 bp, Homo sapiens
gcatgtgtatatatgt

SEQ ID NO: 3415854 - DNA, 16 bp, Homo sapiens
gcattaactaaatgct

SEQ ID NO: 3415855 - DNA, 18 bp, Homo sapiens
gcattaataatagctaat

SEQ ID NO: 3415856 - DNA, 22 bp, Homo sapiens
gcattaataatagctaataata

SEQ ID NO: 3415857 - DNA, 18 bp, Homo sapiens
gcattatatttgtaaatt

SEQ ID NO: 3415858 - DNA, 11 bp, Homo sapiens
gcattcatgtt

SEQ ID NO: 3415859 - DNA, 15 bp, Homo sapiens
gcattcatgttttaa

SEQ ID NO: 3415860 - DNA, 22 bp, Homo sapiens
gcattccttctttgataatgtt

SEQ ID NO: 3415861 - DNA, 17 bp, Homo sapiens
gcatttgcagattttta

SEQ ID NO: 3415862 - DNA, 12 bp, Homo sapiens
gcattttgaatg

SEQ ID NO: 3415863 - DNA, 21 bp, Homo sapiens
gcatttttaaaggacaaacag

SEQ ID NO: 3415864 - DNA, 21 bp, Homo sapiens
gcatttttgtgaaatgaaaac

SEQ ID NO: 3415865 - DNA, 16 bp, Homo sapiens
gccaaataatgtctct

SEQ ID NO: 3415866 - DNA, 23 bp, Homo sapiens
gccaagaaatcgccttatgagaa

SEQ ID NO: 3415867 - DNA, 16 bp, Homo sapiens
gccaagctccctggag

SEQ ID NO: 3415868 - DNA, 21 bp, Homo sapiens
gccaagctccctggagccctg

SEQ ID NO: 3415869 - DNA, 18 bp, Homo sapiens
gccacagacccccagggc

SEQ ID NO: 3415870 - DNA, 12 bp, Homo sapiens
gccacaggcctg

SEQ ID NO: 3415871 - DNA, 13 bp, Homo sapiens
gccacaggcctga

SEQ ID NO: 3415872 - DNA, 15 bp, Homo sapiens
gccacaggcctgaga

SEQ ID NO: 3415873 - DNA, 20 bp, Homo sapiens
gccacaggcctgagatttca

SEQ ID NO: 3415874 - DNA, 22 bp, Homo sapiens
gccacaggcctgagatttcatc

SEQ ID NO: 3415875 - DNA, 12 bp, Homo sapiens
gccacaggctag

SEQ ID NO: 3415876 - DNA, 17 bp, Homo sapiens
gccacaggctagatccc

SEQ ID NO: 3415877 - DNA, 17 bp, Homo sapiens
gccacatacttgcagct

SEQ ID NO: 3415878 - DNA, 15 bp, Homo sapiens
gccacctggacccct

SEQ ID NO: 3415879 - DNA, 16 bp, Homo sapiens
gccacctggacccctg

SEQ ID NO: 3415880 - DNA, 18 bp, Homo sapiens
gccacctggacccctgca

SEQ ID NO: 3415881 - DNA, 19 bp, Homo sapiens
gccacctggacccctgcat

SEQ ID NO: 3415882 - DNA, 14 bp, Homo sapiens
gccaccttgttaca

SEQ ID NO: 3415883 - DNA, 20 bp, Homo sapiens
gccacttctgggtggggcag

SEQ ID NO: 3415884 - DNA, 20 bp, Homo sapiens
gccagaagatgaacagactg

SEQ ID NO: 3415885 - DNA, 18 bp, Homo sapiens
gccagcaccggaccagcc

SEQ ID NO: 3415886 - DNA, 20 bp, Homo sapiens
gccaggactctgcagcctca

SEQ ID NO: 3415887 - DNA, 21 bp, Homo sapiens
gccaggactctgcagcctcag

SEQ ID NO: 3415888 - DNA, 14 bp, Homo sapiens
gccaggagttccca

SEQ ID NO: 3415889 - DNA, 20 bp, Homo sapiens
gccaggagttcccaaatgtg

SEQ ID NO: 3415890 - DNA, 16 bp, Homo sapiens
gccagggagagcccag

SEQ ID NO: 3415891 - DNA, 19 bp, Homo sapiens
gccagggagagcccaggag

SEQ ID NO: 3415892 - DNA, 14 bp, Homo sapiens
gccatatatgctgt

SEQ ID NO: 3415893 - DNA, 17 bp, Homo sapiens
gccatgctttttggtga

SEQ ID NO: 3415894 - DNA, 15 bp, Homo sapiens
gccatgtgaagaggg

SEQ ID NO: 3415895 - DNA, 21 bp, Homo sapiens
gccatgttgtgcctccctggt

SEQ ID NO: 3415896 - DNA, 22 bp, Homo sapiens
gccatgttgtgcctccctggtg

SEQ ID NO: 3415897 - DNA, 23 bp, Homo sapiens
gccatgttgtgcctccctggtga

SEQ ID NO: 3415898 - DNA, 18 bp, Homo sapiens
gccattttgtgaatggat

SEQ ID NO: 3415899 - DNA, 11 bp, Homo sapiens
gccatttttag

SEQ ID NO: 3415900 - DNA, 16 bp, Homo sapiens
gcccaagtcattgttt

SEQ ID NO: 3415901 - DNA, 22 bp, Homo sapiens
gcccaccccacccacttctgca

SEQ ID NO: 3415902 - DNA, 15 bp, Homo sapiens
gcccactctccacct

SEQ ID NO: 3415903 - DNA, 22 bp, Homo sapiens
gcccagattatgagacacagga

SEQ ID NO: 3415904 - DNA, 20 bp, Homo sapiens
gcccaggagctcccctcccc

SEQ ID NO: 3415905 - DNA, 22 bp, Homo sapiens
gcccaggccaggactctgcagc

SEQ ID NO: 3415906 - DNA, 15 bp, Homo sapiens
gcccatataaaatgc

SEQ ID NO: 3415907 - DNA, 23 bp, Homo sapiens
gcccatataaaatgctgatattt

SEQ ID NO: 3415908 - DNA, 15 bp, Homo sapiens
gccccaccccagggc

SEQ ID NO: 3415909 - DNA, 18 bp, Homo sapiens
gcccccaggactgggcca

SEQ ID NO: 3415910 - DNA, 19 bp, Homo sapiens
gcccccctggcctccccca

SEQ ID NO: 3415911 - DNA, 20 bp, Homo sapiens
gccccctgcaggaaggagct

SEQ ID NO: 3415912 - DNA, 17 bp, Homo sapiens
gcccctgtcccacctgg

SEQ ID NO: 3415913 - DNA, 20 bp, Homo sapiens
gcccctgtcccacctggctc

SEQ ID NO: 3415914 - DNA, 22 bp, Homo sapiens
gcccctgtcccacctggctccc

SEQ ID NO: 3415915 - DNA, 18 bp, Homo sapiens
gccctcacccctggttct

SEQ ID NO: 3415916 - DNA, 13 bp, Homo sapiens
gccctccacacct

SEQ ID NO: 3415917 - DNA, 11 bp, Homo sapiens
gccctcctcag

SEQ ID NO: 3415918 - DNA, 20 bp, Homo sapiens
gccctggccttgggccctct

SEQ ID NO: 3415919 - DNA, 14 bp, Homo sapiens
gccctggtggccct

SEQ ID NO: 3415920 - DNA, 20 bp, Homo sapiens
gccctggtggccctctcccc

SEQ ID NO: 3415921 - DNA, 23 bp, Homo sapiens
gcccttccgcagtgtggccaggc

SEQ ID NO: 3415922 - DNA, 20 bp, Homo sapiens
gcccttgggggtcctcctcc

SEQ ID NO: 3415923 - DNA, 21 bp, Homo sapiens
gcccttgggggtcctcctcca

SEQ ID NO: 3415924 - DNA, 18 bp, Homo sapiens
gccgggaccccgagcctg

SEQ ID NO: 3415925 - DNA, 16 bp, Homo sapiens
gcctcagtgacccatg

SEQ ID NO: 3415926 - DNA, 14 bp, Homo sapiens
gcctccagggctgg

SEQ ID NO: 3415927 - DNA, 22 bp, Homo sapiens
gcctccagggctggactgaggc

SEQ ID NO: 3415928 - DNA, 16 bp, Homo sapiens
gcctcccttttctcct

SEQ ID NO: 3415929 - DNA, 15 bp, Homo sapiens
gcctcgaaagtgtca

SEQ ID NO: 3415930 - DNA, 14 bp, Homo sapiens
gcctcgcaggaaga

SEQ ID NO: 3415931 - DNA, 14 bp, Homo sapiens
gcctcgtgtcatct

SEQ ID NO: 3415932 - DNA, 19 bp, Homo sapiens
gcctctcattccagaggaa

SEQ ID NO: 3415933 - DNA, 13 bp, Homo sapiens
gcctgagagtatt

SEQ ID NO: 3415934 - DNA, 21 bp, Homo sapiens
gcctgagagtatttaggcaga

SEQ ID NO: 3415935 - DNA, 16 bp, Homo sapiens
gcctgagatttcatct

SEQ ID NO: 3415936 - DNA, 23 bp, Homo sapiens
gcctgagatttcatctgctctcc

SEQ ID NO: 3415937 - DNA, 23 bp, Homo sapiens
gcctgagcgctcctgccgcagag

SEQ ID NO: 3415938 - DNA, 22 bp, Homo sapiens
gcctgccacctggacccctgca

SEQ ID NO: 3415939 - DNA, 17 bp, Homo sapiens
gcctgcctccagggctg

SEQ ID NO: 3415940 - DNA, 18 bp, Homo sapiens
gcctgcctccagggctgg

SEQ ID NO: 3415941 - DNA, 14 bp, Homo sapiens
gcctgcgagggcag

SEQ ID NO: 3415942 - DNA, 18 bp, Homo sapiens
gcctggcccaccccaccc

SEQ ID NO: 3415943 - DNA, 13 bp, Homo sapiens
gccttatgagaac

SEQ ID NO: 3415944 - DNA, 19 bp, Homo sapiens
gccttgctacctcaagggg

SEQ ID NO: 3415945 - DNA, 18 bp, Homo sapiens
gccttgtcctcagccagt

SEQ ID NO: 3415946 - DNA, 19 bp, Homo sapiens
gcctttgtaatatgagaat

SEQ ID NO: 3415947 - DNA, 20 bp, Homo sapiens
gcgctcctgccgcagagctg

SEQ ID NO: 3415948 - DNA, 16 bp, Homo sapiens
gcggacagtggcagga

SEQ ID NO: 3415949 - DNA, 14 bp, Homo sapiens
gcgggagcctccct

SEQ ID NO: 3415950 - DNA, 22 bp, Homo sapiens
gcgggcgcactgcctctcacag

SEQ ID NO: 3415951 - DNA, 15 bp, Homo sapiens
gcgtcttgtgaaatt

SEQ ID NO: 3415952 - DNA, 18 bp, Homo sapiens
gcgtcttgtgaaattgtg

SEQ ID NO: 3415953 - DNA, 13 bp, Homo sapiens
gcgtgattctgtt

SEQ ID NO: 3415954 - DNA, 16 bp, Homo sapiens
gtataatgctttctga

SEQ ID NO: 3415955 - DNA, 15 bp, Homo sapiens
gtataatgtgtctgt

SEQ ID NO: 3415956 - DNA, 15 bp, Homo sapiens
gtatacatatagata

SEQ ID NO: 3415957 - DNA, 17 bp, Homo sapiens
gtatataatcatgctca

SEQ ID NO: 3415958 - DNA, 21 bp, Homo sapiens
gtatcactctgtgtctgagtg

SEQ ID NO: 3415959 - DNA, 17 bp, Homo sapiens
gtatctggtatctgcat

SEQ ID NO: 3415960 - DNA, 22 bp, Homo sapiens
gtatgcaagtgggagatgaaaa

SEQ ID NO: 3415961 - DNA, 16 bp, Homo sapiens
gtatgtggaagtgtgg

SEQ ID NO: 3415962 - DNA, 17 bp, Homo sapiens
gtatgtggaagtgtggg

SEQ ID NO: 3415963 - DNA, 15 bp, Homo sapiens
gtatgtggatacagt

SEQ ID NO: 3415964 - DNA, 19 bp, Homo sapiens
gtatgtttttgtgtatttg

SEQ ID NO: 3415965 - DNA, 15 bp, Homo sapiens
gtattagccagtcat

SEQ ID NO: 3415966 - DNA, 13 bp, Homo sapiens
gtattcccactct

SEQ ID NO: 3415967 - DNA, 18 bp, Homo sapiens
gtatttaactacatctgc

SEQ ID NO: 3415968 - DNA, 22 bp, Homo sapiens
gtatttaatgatttttgtgtat

SEQ ID NO: 3415969 - DNA, 19 bp, Homo sapiens
gtatttcagtattttccag

SEQ ID NO: 3415970 - DNA, 17 bp, Homo sapiens
gtatttttaaaaaacaa

SEQ ID NO: 3415971 - DNA, 15 bp, Homo sapiens
gtcaactttcatttg

SEQ ID NO: 3415972 - DNA, 16 bp, Homo sapiens
gtcaactttcatttga

SEQ ID NO: 3415973 - DNA, 14 bp, Homo sapiens
gtcaagattttgaa

SEQ ID NO: 3415974 - DNA, 14 bp, Homo sapiens
gtcaagtaagaaga

SEQ ID NO: 3415975 - DNA, 19 bp, Homo sapiens
gtcaataaaaataaatcta

SEQ ID NO: 3415976 - DNA, 17 bp, Homo sapiens
gtcaattcagtgatggc

SEQ ID NO: 3415977 - DNA, 16 bp, Homo sapiens
gtcacagctcttgttt

SEQ ID NO: 3415978 - DNA, 21 bp, Homo sapiens
gtcactaggaatttttttcag

SEQ ID NO: 3415979 - DNA, 13 bp, Homo sapiens
gtcacttcaccat

SEQ ID NO: 3415980 - DNA, 19 bp, Homo sapiens
gtcactttttcccctgcaa

SEQ ID NO: 3415981 - DNA, 14 bp, Homo sapiens
gtcagctactaatg

SEQ ID NO: 3415982 - DNA, 20 bp, Homo sapiens
gtcagctcaggcagctcgag

SEQ ID NO: 3415983 - DNA, 21 bp, Homo sapiens
gtcagtatgtggaagtgtggg

SEQ ID NO: 3415984 - DNA, 23 bp, Homo sapiens
gtcatcaatagtgtcctatgcaa

SEQ ID NO: 3415985 - DNA, 20 bp, Homo sapiens
gtcatcaatttgtaatttta

SEQ ID NO: 3415986 - DNA, 15 bp, Homo sapiens
gtcatcagtaagtat

SEQ ID NO: 3415987 - DNA, 13 bp, Homo sapiens
gtcatgcataaat

SEQ ID NO: 3415988 - DNA, 16 bp, Homo sapiens
gtcatggtagattttt

SEQ ID NO: 3415989 - DNA, 21 bp, Homo sapiens
gtcatggtagatttttttcat

SEQ ID NO: 3415990 - DNA, 14 bp, Homo sapiens
gtcattatttaaag

SEQ ID NO: 3415991 - DNA, 22 bp, Homo sapiens
gtcattatttgataacattttg

SEQ ID NO: 3415992 - DNA, 17 bp, Homo sapiens
gtcattcctaatgcatt

SEQ ID NO: 3415993 - DNA, 21 bp, Homo sapiens
gtcattgtaacctcgtgtcta

SEQ ID NO: 3415994 - DNA, 15 bp, Homo sapiens
gtcatttctcttttt

SEQ ID NO: 3415995 - DNA, 17 bp, Homo sapiens
gtccaaatactctgaaa

SEQ ID NO: 3415996 - DNA, 20 bp, Homo sapiens
gtccacctgtgagaaaggaa

SEQ ID NO: 3415997 - DNA, 17 bp, Homo sapiens
gtccagaagaccccact

SEQ ID NO: 3415998 - DNA, 22 bp, Homo sapiens
gtccagctgcccttccgcagtg

SEQ ID NO: 3415999 - DNA, 20 bp, Homo sapiens
gtccagttataagcgtattt

SEQ ID NO: 3416000 - DNA, 21 bp, Homo sapiens
gtcccagattggctcacactg

SEQ ID NO: 3416001 - DNA, 22 bp, Homo sapiens
gtcccagattggctcacactga

SEQ ID NO: 3416002 - DNA, 21 bp, Homo sapiens
gtcccaggctgccggctcccc

SEQ ID NO: 3416003 - DNA, 18 bp, Homo sapiens
gtcccctctgccccaccc

SEQ ID NO: 3416004 - DNA, 11 bp, Homo sapiens
gtccccttctc

SEQ ID NO: 3416005 - DNA, 12 bp, Homo sapiens
gtccccttctct

SEQ ID NO: 3416006 - DNA, 23 bp, Homo sapiens
gtccctgaagtcttgcattgaat

SEQ ID NO: 3416007 - DNA, 20 bp, Homo sapiens
gtcccttgcccccctggcct

SEQ ID NO: 3416008 - DNA, 13 bp, Homo sapiens
gtcctcagccagt

SEQ ID NO: 3416009 - DNA, 20 bp, Homo sapiens
gtccttaatgatccgttcca

SEQ ID NO: 3416010 - DNA, 14 bp, Homo sapiens
gtcggtgccttcaa

SEQ ID NO: 3416011 - DNA, 15 bp, Homo sapiens
gtcgtgtaattggcc

SEQ ID NO: 3416012 - DNA, 14 bp, Homo sapiens
gtctacattaaaca

SEQ ID NO: 3416013 - DNA, 23 bp, Homo sapiens
gtctacattcttggttgttaatt

SEQ ID NO: 3416014 - DNA, 20 bp, Homo sapiens
gtctagagtcatgtgagcct

SEQ ID NO: 3416015 - DNA, 19 bp, Homo sapiens
gtctagttaacatttcaag

SEQ ID NO: 3416016 - DNA, 20 bp, Homo sapiens
gtctccaaccccccagcact

SEQ ID NO: 3416017 - DNA, 13 bp, Homo sapiens
gtctcctggcggt

SEQ ID NO: 3416018 - DNA, 17 bp, Homo sapiens
gtctctgacaaagtgtg

SEQ ID NO: 3416019 - DNA, 23 bp, Homo sapiens
gtctctgggtttacaacaaacac

SEQ ID NO: 3416020 - DNA, 19 bp, Homo sapiens
gtctggcaaacatgtgcaa

SEQ ID NO: 3416021 - DNA, 11 bp, Homo sapiens
gtctgtgtgtg

SEQ ID NO: 3416022 - DNA, 15 bp, Homo sapiens
gtctgttttgtaaag

SEQ ID NO: 3416023 - DNA, 13 bp, Homo sapiens
gtcttgtgaaatt

SEQ ID NO: 3416024 - DNA, 15 bp, Homo sapiens
gtcttgtgaaattgt

SEQ ID NO: 3416025 - DNA, 12 bp, Homo sapiens
gtctttctttgc

SEQ ID NO: 3416026 - DNA, 17 bp, Homo sapiens
gtctttctttgctgctg

SEQ ID NO: 3416027 - DNA, 19 bp, Homo sapiens
gtctttctttgctgctgtg

SEQ ID NO: 3416028 - DNA, 15 bp, Homo sapiens
gtctttgtaagagtg

SEQ ID NO: 3416029 - DNA, 21 bp, Homo sapiens
gtctttgtaagagtgtagaag

SEQ ID NO: 3416030 - DNA, 22 bp, Homo sapiens
gtctttgtaagagtgtagaagc

SEQ ID NO: 3416031 - DNA, 16 bp, Homo sapiens
gtcttttacatacagt

SEQ ID NO: 3416032 - DNA, 14 bp, Homo sapiens
gtgaaacctttttt

SEQ ID NO: 3416033 - DNA, 12 bp, Homo sapiens
gtgaaattgtgt

SEQ ID NO: 3416034 - DNA, 13 bp, Homo sapiens
gtgaataaagtgc

SEQ ID NO: 3416035 - DNA, 20 bp, Homo sapiens
gtgaatggattggattattt

SEQ ID NO: 3416036 - DNA, 15 bp, Homo sapiens
gtgacaaaatgttga

SEQ ID NO: 3416037 - DNA, 14 bp, Homo sapiens
gtgacatgtgaaac

SEQ ID NO: 3416038 - DNA, 22 bp, Homo sapiens
gtgacatgtgaaacctttttta

SEQ ID NO: 3416039 - DNA, 13 bp, Homo sapiens
gtgacattcactg

SEQ ID NO: 3416040 - DNA, 23 bp, Homo sapiens
gtgagccatagagatatttaaaa

SEQ ID NO: 3416041 - DNA, 23 bp, Homo sapiens
gtgagctttttgttccctcattc

SEQ ID NO: 3416042 - DNA, 21 bp, Homo sapiens
gtgagttttactcttaaatca

SEQ ID NO: 3416043 - DNA, 19 bp, Homo sapiens
gtgatatggcagaagacac

SEQ ID NO: 3416044 - DNA, 22 bp, Homo sapiens
gtgatgctaaaggttgtattgc

SEQ ID NO: 3416045 - DNA, 22 bp, Homo sapiens
gtgattatggacatcgatatga

SEQ ID NO: 3416046 - DNA, 17 bp, Homo sapiens
gtgcaattaactctgga

SEQ ID NO: 3416047 - DNA, 22 bp, Homo sapiens
gtgcaattgtaggggtgtgtgt

SEQ ID NO: 3416048 - DNA, 23 bp, Homo sapiens
gtgcacaaagtggcataaaaaac

SEQ ID NO: 3416049 - DNA, 15 bp, Homo sapiens
gtgcatgcaggtctc

SEQ ID NO: 3416050 - DNA, 13 bp, Homo sapiens
gtgcccctgtccc

SEQ ID NO: 3416051 - DNA, 14 bp, Homo sapiens
gtgccttttgccat

SEQ ID NO: 3416052 - DNA, 15 bp, Homo sapiens
gtgcgtgtgtagagt

SEQ ID NO: 3416053 - DNA, 23 bp, Homo sapiens
gtgctattgtagagccagaggtc

SEQ ID NO: 3416054 - DNA, 19 bp, Homo sapiens
gtgctgcggagcaagagga

SEQ ID NO: 3416055 - DNA, 13 bp, Homo sapiens
gtgcttcttgtaa

SEQ ID NO: 3416056 - DNA, 15 bp, Homo sapiens
gtgcttcttgtaata

SEQ ID NO: 3416057 - DNA, 22 bp, Homo sapiens
gtggagaagccacaggcctgag

SEQ ID NO: 3416058 - DNA, 13 bp, Homo sapiens
gtggaggaaggat

SEQ ID NO: 3416059 - DNA, 20 bp, Homo sapiens
gtggaggaaggattgtaaaa

SEQ ID NO: 3416060 - DNA, 16 bp, Homo sapiens
gtggaggagctcagga

SEQ ID NO: 3416061 - DNA, 23 bp, Homo sapiens
gtggaggagctcaggacactaat

SEQ ID NO: 3416062 - DNA, 22 bp, Homo sapiens
gtggatggtgacttttgaagaa

SEQ ID NO: 3416063 - DNA, 21 bp, Homo sapiens
gtggattcagcttctgttgga

SEQ ID NO: 3416064 - DNA, 21 bp, Homo sapiens
gtggccaggctgcctggcctt

SEQ ID NO: 3416065 - DNA, 15 bp, Homo sapiens
tactttttttgttat

SEQ ID NO: 3416066 - DNA, 15 bp, Homo sapiens
tagaaaatcttagta

SEQ ID NO: 3416067 - DNA, 18 bp, Homo sapiens
tagaaagacatctgcctg

SEQ ID NO: 3416068 - DNA, 16 bp, Homo sapiens
tagaaagagttctatg

SEQ ID NO: 3416069 - DNA, 13 bp, Homo sapiens
tagaacaaaaact

SEQ ID NO: 3416070 - DNA, 15 bp, Homo sapiens
tagaacaaaaactat

SEQ ID NO: 3416071 - DNA, 23 bp, Homo sapiens
tagaaccatgttggttgcacttt

SEQ ID NO: 3416072 - DNA, 14 bp, Homo sapiens
tagaagcattcctt

SEQ ID NO: 3416073 - DNA, 21 bp, Homo sapiens
tagaagcattccttctttgat

SEQ ID NO: 3416074 - DNA, 23 bp, Homo sapiens
tagaagcattccttctttgataa

SEQ ID NO: 3416075 - DNA, 15 bp, Homo sapiens
tagaataaatggttt

SEQ ID NO: 3416076 - DNA, 17 bp, Homo sapiens
tagaataaatggtttct

SEQ ID NO: 3416077 - DNA, 21 bp, Homo sapiens
tagactatggaatgtcagtgt

SEQ ID NO: 3416078 - DNA, 22 bp, Homo sapiens
tagactatggaatgtcagtgtt

SEQ ID NO: 3416079 - DNA, 19 bp, Homo sapiens
tagagcgtttggttaaagt

SEQ ID NO: 3416080 - DNA, 15 bp, Homo sapiens
tagaggctgcctggg

SEQ ID NO: 3416081 - DNA, 14 bp, Homo sapiens
tagagtaatgatgt

SEQ ID NO: 3416082 - DNA, 23 bp, Homo sapiens
tagagttaagaagctgttgtaca

SEQ ID NO: 3416083 - DNA, 15 bp, Homo sapiens
tagagtttgatcata

SEQ ID NO: 3416084 - DNA, 15 bp, Homo sapiens
tagatataaatataa

SEQ ID NO: 3416085 - DNA, 20 bp, Homo sapiens
tagattcttgagctgttgtg

SEQ ID NO: 3416086 - DNA, 15 bp, Homo sapiens
tagccaggatcatgg

SEQ ID NO: 3416087 - DNA, 18 bp, Homo sapiens
tagccaggatcatggtgt

SEQ ID NO: 3416088 - DNA, 18 bp, Homo sapiens
tagcctagatatgaatat

SEQ ID NO: 3416089 - DNA, 16 bp, Homo sapiens
tagctaataataaatg

SEQ ID NO: 3416090 - DNA, 18 bp, Homo sapiens
tagctagctatttctatg

SEQ ID NO: 3416091 - DNA, 14 bp, Homo sapiens
tagctttttaattg

SEQ ID NO: 3416092 - DNA, 16 bp, Homo sapiens
tagctttttaattgtt

SEQ ID NO: 3416093 - DNA, 11 bp, Homo sapiens
taggaaaggat

SEQ ID NO: 3416094 - DNA, 14 bp, Homo sapiens
taggagaggatgag

SEQ ID NO: 3416095 - DNA, 18 bp, Homo sapiens
taggagaggatgagagcc

SEQ ID NO: 3416096 - DNA, 22 bp, Homo sapiens
taggagaggatgagagcccaga

SEQ ID NO: 3416097 - DNA, 19 bp, Homo sapiens
tagggaaaatagggtcctt

SEQ ID NO: 3416098 - DNA, 13 bp, Homo sapiens
tagggtccttgaa

SEQ ID NO: 3416099 - DNA, 12 bp, Homo sapiens
taggtaaataaa

SEQ ID NO: 3416100 - DNA, 19 bp, Homo sapiens
taggtcaagtaataaaaag

SEQ ID NO: 3416101 - DNA, 12 bp, Homo sapiens
taggttgttacc

SEQ ID NO: 3416102 - DNA, 20 bp, Homo sapiens
taggttgttaccaagtatga

SEQ ID NO: 3416103 - DNA, 21 bp, Homo sapiens
tagtagaaagacatctgcctg

SEQ ID NO: 3416104 - DNA, 22 bp, Homo sapiens
tagtagaaagacatctgcctgt

SEQ ID NO: 3416105 - DNA, 23 bp, Homo sapiens
tagtatttaactacatctgcctc

SEQ ID NO: 3416106 - DNA, 15 bp, Homo sapiens
tagtctttttttcct

SEQ ID NO: 3416107 - DNA, 16 bp, Homo sapiens
tagtgccaaataattg

SEQ ID NO: 3416108 - DNA, 15 bp, Homo sapiens
tagtggtctttgtaa

SEQ ID NO: 3416109 - DNA, 18 bp, Homo sapiens
tagtggtctttgtaagag

SEQ ID NO: 3416110 - DNA, 21 bp, Homo sapiens
tagtggtctttgtaagagtgt

SEQ ID NO: 3416111 - DNA, 20 bp, Homo sapiens
tagtgtccccatgggctccc

SEQ ID NO: 3416112 - DNA, 14 bp, Homo sapiens
tagtgtcctatgca

SEQ ID NO: 3416113 - DNA, 13 bp, Homo sapiens
tagttacatgaat

SEQ ID NO: 3416114 - DNA, 16 bp, Homo sapiens
tagttgaaaaaagaag

SEQ ID NO: 3416115 - DNA, 14 bp, Homo sapiens
tagttgctttgtta

SEQ ID NO: 3416116 - DNA, 21 bp, Homo sapiens
tagttgcttttgaaggaatac

SEQ ID NO: 3416117 - DNA, 21 bp, Homo sapiens
tagttgtctttctttgctgct

SEQ ID NO: 3416118 - DNA, 18 bp, Homo sapiens
tagtttaagggtggaaaa

SEQ ID NO: 3416119 - DNA, 16 bp, Homo sapiens
tagttttgctttgttg

SEQ ID NO: 3416120 - DNA, 15 bp, Homo sapiens
tataaaatgtttcaa

SEQ ID NO: 3416121 - DNA, 14 bp, Homo sapiens
tataaacactatat

SEQ ID NO: 3416122 - DNA, 17 bp, Homo sapiens
tataaataggagaggat

SEQ ID NO: 3416123 - DNA, 14 bp, Homo sapiens
tataacaattaaaa

SEQ ID NO: 3416124 - DNA, 16 bp, Homo sapiens
tataacttcaaatttt

SEQ ID NO: 3416125 - DNA, 14 bp, Homo sapiens
tataagcgtattta

SEQ ID NO: 3416126 - DNA, 20 bp, Homo sapiens
tataatgccagaatataatg

SEQ ID NO: 3416127 - DNA, 14 bp, Homo sapiens
tataatgtgtctgt

SEQ ID NO: 3416128 - DNA, 18 bp, Homo sapiens
tatacaagctacagttgt

SEQ ID NO: 3416129 - DNA, 18 bp, Homo sapiens
tatacctgccttttaagt

SEQ ID NO: 3416130 - DNA, 15 bp, Homo sapiens
tatactatatgaaaa

SEQ ID NO: 3416131 - DNA, 16 bp, Homo sapiens
tatactatatgaaaag

SEQ ID NO: 3416132 - DNA, 13 bp, Homo sapiens
tatactggcatgc

SEQ ID NO: 3416133 - DNA, 20 bp, Homo sapiens
tatactttttttgttataga

SEQ ID NO: 3416134 - DNA, 22 bp, Homo sapiens
tatactttttttgttatagatt

SEQ ID NO: 3416135 - DNA, 19 bp, Homo sapiens
tatagctagctatttctat

SEQ ID NO: 3416136 - DNA, 13 bp, Homo sapiens
tatagtagaaaga

SEQ ID NO: 3416137 - DNA, 14 bp, Homo sapiens
tatagttgtatttt

SEQ ID NO: 3416138 - DNA, 16 bp, Homo sapiens
tatagttgtctttctt

SEQ ID NO: 3416139 - DNA, 22 bp, Homo sapiens
tatataaagtttttttatttct

SEQ ID NO: 3416140 - DNA, 16 bp, Homo sapiens
tatataaggtaatgta

SEQ ID NO: 3416141 - DNA, 20 bp, Homo sapiens
tatataatcatgctcatgta

SEQ ID NO: 3416142 - DNA, 15 bp, Homo sapiens
tatatacatatatat

SEQ ID NO: 3416143 - DNA, 14 bp, Homo sapiens
tatatagctggcaa

SEQ ID NO: 3416144 - DNA, 18 bp, Homo sapiens
tatatagctggcaagaat

SEQ ID NO: 3416145 - DNA, 19 bp, Homo sapiens
tatatattgaaagttgctt

SEQ ID NO: 3416146 - DNA, 14 bp, Homo sapiens
tatatattttaatt

SEQ ID NO: 3416147 - DNA, 14 bp, Homo sapiens
tatatctggaatga

SEQ ID NO: 3416148 - DNA, 17 bp, Homo sapiens
tatatgagaagaatagc

SEQ ID NO: 3416149 - DNA, 13 bp, Homo sapiens
tatatgtgagaaa

SEQ ID NO: 3416150 - DNA, 13 bp, Homo sapiens
tatattaaatgag

SEQ ID NO: 3416151 - DNA, 18 bp, Homo sapiens
tatattagttgctttgtt

SEQ ID NO: 3416152 - DNA, 22 bp, Homo sapiens
tatatttagttacgtataatgc

SEQ ID NO: 3416153 - DNA, 18 bp, Homo sapiens
tatatttgggagtgactg

SEQ ID NO: 3416154 - DNA, 15 bp, Homo sapiens
tatcaaaaggaagat

SEQ ID NO: 3416155 - DNA, 14 bp, Homo sapiens
tatcaaagcttcaa

SEQ ID NO: 3416156 - DNA, 13 bp, Homo sapiens
tatcattcatctt

SEQ ID NO: 3416157 - DNA, 16 bp, Homo sapiens
tatcgaaataacaatg

SEQ ID NO: 3416158 - DNA, 18 bp, Homo sapiens
tatcgaaataacaatgtt

SEQ ID NO: 3416159 - DNA, 19 bp, Homo sapiens
tatcgaaataacaatgtta

SEQ ID NO: 3416160 - DNA, 20 bp, Homo sapiens
tatctagcatttatttctct

SEQ ID NO: 3416161 - DNA, 18 bp, Homo sapiens
tatctcagtcatgcataa

SEQ ID NO: 3416162 - DNA, 22 bp, Homo sapiens
tatctcagtcatgcataaatat

SEQ ID NO: 3416163 - DNA, 16 bp, Homo sapiens
tatctccttgtggcct

SEQ ID NO: 3416164 - DNA, 21 bp, Homo sapiens
tatctccttgtggcctatgaa

SEQ ID NO: 3416165 - DNA, 22 bp, Homo sapiens
tatctccttgtggcctatgaaa

SEQ ID NO: 3416166 - DNA, 15 bp, Homo sapiens
tatctggtatctgca

SEQ ID NO: 3416167 - DNA, 16 bp, Homo sapiens
tatctggtatctgcat

SEQ ID NO: 3416168 - DNA, 17 bp, Homo sapiens
tatcttacaactccccc

SEQ ID NO: 3416169 - DNA, 17 bp, Homo sapiens
tatcttgagtgttatgt

SEQ ID NO: 3416170 - DNA, 16 bp, Homo sapiens
tatcttgtatggtttg

SEQ ID NO: 3416171 - DNA, 15 bp, Homo sapiens
tatcttgttattaat

SEQ ID NO: 3416172 - DNA, 17 bp, Homo sapiens
tatcttgttattaatgt

SEQ ID NO: 3416173 - DNA, 18 bp, Homo sapiens
tatctttgattctccttc

SEQ ID NO: 3416174 - DNA, 19 bp, Homo sapiens
tatctttgattctccttca

SEQ ID NO: 3416175 - DNA, 18 bp, Homo sapiens
tatctttgtgtaatctaa

SEQ ID NO: 3416176 - DNA, 14 bp, Homo sapiens
tatgaagtataaat

SEQ ID NO: 3416177 - DNA, 19 bp, Homo sapiens
tgatatggcagaagacacc

SEQ ID NO: 3416178 - DNA, 18 bp, Homo sapiens
tgatattcaaggctttaa

SEQ ID NO: 3416179 - DNA, 20 bp, Homo sapiens
tgatattctcattatttcat

SEQ ID NO: 3416180 - DNA, 16 bp, Homo sapiens
tgatattgaccatgtg

SEQ ID NO: 3416181 - DNA, 17 bp, Homo sapiens
tgatattgaccatgtga

SEQ ID NO: 3416182 - DNA, 19 bp, Homo sapiens
tgatattgaccatgtgatt

SEQ ID NO: 3416183 - DNA, 16 bp, Homo sapiens
tgatcaaaaataatgc

SEQ ID NO: 3416184 - DNA, 16 bp, Homo sapiens
tgatcaacataatgga

SEQ ID NO: 3416185 - DNA, 18 bp, Homo sapiens
tgatcaacatcttttctt

SEQ ID NO: 3416186 - DNA, 18 bp, Homo sapiens
tgatcaatgacagagcct

SEQ ID NO: 3416187 - DNA, 15 bp, Homo sapiens
tgatcatagaattgt

SEQ ID NO: 3416188 - DNA, 22 bp, Homo sapiens
tgatccgttccattgcaagctt

SEQ ID NO: 3416189 - DNA, 15 bp, Homo sapiens
tgatcgccttattta

SEQ ID NO: 3416190 - DNA, 22 bp, Homo sapiens
tgatctttgtttaaatgccaaa

SEQ ID NO: 3416191 - DNA, 15 bp, Homo sapiens
tgatgaatgaggaac

SEQ ID NO: 3416192 - DNA, 23 bp, Homo sapiens
tgatgaggccctccacacctgcg

SEQ ID NO: 3416193 - DNA, 19 bp, Homo sapiens
tgatggaacagtgaaagtc

SEQ ID NO: 3416194 - DNA, 18 bp, Homo sapiens
tgatggtatagtatgtgc

SEQ ID NO: 3416195 - DNA, 18 bp, Homo sapiens
tgatgtgggtcaaggaat

SEQ ID NO: 3416196 - DNA, 17 bp, Homo sapiens
tgatgttgggaagctat

SEQ ID NO: 3416197 - DNA, 18 bp, Homo sapiens
tgatgttttcctataata

SEQ ID NO: 3416198 - DNA, 16 bp, Homo sapiens
tgattaccagtctgat

SEQ ID NO: 3416199 - DNA, 20 bp, Homo sapiens
tgattcacttcacgctttca

SEQ ID NO: 3416200 - DNA, 12 bp, Homo sapiens
tgattctccttc

SEQ ID NO: 3416201 - DNA, 18 bp, Homo sapiens
tgattctccttcagccct

SEQ ID NO: 3416202 - DNA, 19 bp, Homo sapiens
tgattctccttcagccctc

SEQ ID NO: 3416203 - DNA, 19 bp, Homo sapiens
tgattctgttctacttgat

SEQ ID NO: 3416204 - DNA, 14 bp, Homo sapiens
tgattgtcagctac

SEQ ID NO: 3416205 - DNA, 21 bp, Homo sapiens
tgatttaataaaataattcta

SEQ ID NO: 3416206 - DNA, 16 bp, Homo sapiens
tgatttcctctgaatt

SEQ ID NO: 3416207 - DNA, 19 bp, Homo sapiens
tgatttcgatgtacagtct

SEQ ID NO: 3416208 - DNA, 20 bp, Homo sapiens
tgatttttattaactgcttt

SEQ ID NO: 3416209 - DNA, 21 bp, Homo sapiens
tgatttttgtgtatccagtat

SEQ ID NO: 3416210 - DNA, 15 bp, Homo sapiens
tgcaaaataaagaat

SEQ ID NO: 3416211 - DNA, 16 bp, Homo sapiens
tgcaaactgctttatt

SEQ ID NO: 3416212 - DNA, 21 bp, Homo sapiens
tgcaaactgctttattttccc

SEQ ID NO: 3416213 - DNA, 21 bp, Homo sapiens
tgcaaatgagatttctttgaa

SEQ ID NO: 3416214 - DNA, 13 bp, Homo sapiens
tgcaacaacatgt

SEQ ID NO: 3416215 - DNA, 17 bp, Homo sapiens
tgcaaccagggagctgc

SEQ ID NO: 3416216 - DNA, 21 bp, Homo sapiens
tgcaaccagggagctgcaggg

SEQ ID NO: 3416217 - DNA, 22 bp, Homo sapiens
tgcaactaactgactctgttat

SEQ ID NO: 3416218 - DNA, 13 bp, Homo sapiens
tgcaactcttgta

SEQ ID NO: 3416219 - DNA, 22 bp, Homo sapiens
tgcaagattttttttttaagtg

SEQ ID NO: 3416220 - DNA, 22 bp, Homo sapiens
tgcaagcatttttccatctgtg

SEQ ID NO: 3416221 - DNA, 23 bp, Homo sapiens
tgcaagcatttttccatctgtgt

SEQ ID NO: 3416222 - DNA, 14 bp, Homo sapiens
tgcaagcttattta

SEQ ID NO: 3416223 - DNA, 13 bp, Homo sapiens
tgcaaggcaaaga

SEQ ID NO: 3416224 - DNA, 20 bp, Homo sapiens
tgcaagtgggagatgaaaac

SEQ ID NO: 3416225 - DNA, 13 bp, Homo sapiens
tgcaatatttgta

SEQ ID NO: 3416226 - DNA, 14 bp, Homo sapiens
tgcaatatttgtaa

SEQ ID NO: 3416227 - DNA, 15 bp, Homo sapiens
tgcaatgataaataa

SEQ ID NO: 3416228 - DNA, 17 bp, Homo sapiens
tgcaatgcgtcttgtga

SEQ ID NO: 3416229 - DNA, 20 bp, Homo sapiens
tgcaatgcgtcttgtgaaat

SEQ ID NO: 3416230 - DNA, 22 bp, Homo sapiens
tgcaatgcgtcttgtgaaattg

SEQ ID NO: 3416231 - DNA, 23 bp, Homo sapiens
tgcaccattctttcttggtgcat

SEQ ID NO: 3416232 - DNA, 16 bp, Homo sapiens
tgcacgttaacagcgt

SEQ ID NO: 3416233 - DNA, 21 bp, Homo sapiens
tgcacgttaacagcgtgtcaa

SEQ ID NO: 3416234 - DNA, 16 bp, Homo sapiens
tgcactattccacagg

SEQ ID NO: 3416235 - DNA, 17 bp, Homo sapiens
tgcactctttaagggag

SEQ ID NO: 3416236 - DNA, 14 bp, Homo sapiens
tgcagacgcccaga

SEQ ID NO: 3416237 - DNA, 15 bp, Homo sapiens
tgcagagagccattt

SEQ ID NO: 3416238 - DNA, 21 bp, Homo sapiens
tgcagaggaggagaaaagtga

SEQ ID NO: 3416239 - DNA, 14 bp, Homo sapiens
tgcagccctgctgc

SEQ ID NO: 3416240 - DNA, 13 bp, Homo sapiens
tgcagctctgcag

SEQ ID NO: 3416241 - DNA, 12 bp, Homo sapiens
tgcaggaaggag

SEQ ID NO: 3416242 - DNA, 16 bp, Homo sapiens
tgcaggaaggagctgc

SEQ ID NO: 3416243 - DNA, 20 bp, Homo sapiens
tgcaggaaggagctgcctgg

SEQ ID NO: 3416244 - DNA, 18 bp, Homo sapiens
tgcaggtagacctgtctc

SEQ ID NO: 3416245 - DNA, 23 bp, Homo sapiens
tgcagtgatatggcagaagacac

SEQ ID NO: 3416246 - DNA, 14 bp, Homo sapiens
tgcagtttcatgta

SEQ ID NO: 3416247 - DNA, 17 bp, Homo sapiens
tgcagtttcatgtatgt

SEQ ID NO: 3416248 - DNA, 18 bp, Homo sapiens
tgcataaacaatccaaat

SEQ ID NO: 3416249 - DNA, 14 bp, Homo sapiens
tgcataaatatgca

SEQ ID NO: 3416250 - DNA, 15 bp, Homo sapiens
tgcataaatatgcag

SEQ ID NO: 3416251 - DNA, 15 bp, Homo sapiens
tgcatagagcaatta

SEQ ID NO: 3416252 - DNA, 18 bp, Homo sapiens
tgcatatctctagtccct

SEQ ID NO: 3416253 - DNA, 13 bp, Homo sapiens
tgcatgaaggttt

SEQ ID NO: 3416254 - DNA, 14 bp, Homo sapiens
tgcatggagtgttt

SEQ ID NO: 3416255 - DNA, 17 bp, Homo sapiens
tgcatgtaaaatcttca

SEQ ID NO: 3416256 - DNA, 20 bp, Homo sapiens
tgcatgtaaaatcttcagct

SEQ ID NO: 3416257 - DNA, 17 bp, Homo sapiens
tgcatgtgtatatatgt

SEQ ID NO: 3416258 - DNA, 21 bp, Homo sapiens
tgcattatatttgtaaattta

SEQ ID NO: 3416259 - DNA, 14 bp, Homo sapiens
tgcattattttatt

SEQ ID NO: 3416260 - DNA, 21 bp, Homo sapiens
tgcattggaactggaggcagg

SEQ ID NO: 3416261 - DNA, 22 bp, Homo sapiens
tgcattggaactggaggcaggg

SEQ ID NO: 3416262 - DNA, 21 bp, Homo sapiens
tgcatttctatgccattttta

SEQ ID NO: 3416263 - DNA, 23 bp, Homo sapiens
tgcatttctatgccatttttagt

SEQ ID NO: 3416264 - DNA, 17 bp, Homo sapiens
tgcatttttaaaggaca

SEQ ID NO: 3416265 - DNA, 16 bp, Homo sapiens
tgcatttttgtgaaat

SEQ ID NO: 3416266 - DNA, 19 bp, Homo sapiens
tgcatttttgtgaaatgaa

SEQ ID NO: 3416267 - DNA, 15 bp, Homo sapiens
tgccacctggacccc

SEQ ID NO: 3416268 - DNA, 23 bp, Homo sapiens
tgccaggcggacaaagttcagtg

SEQ ID NO: 3416269 - DNA, 22 bp, Homo sapiens
tgccatcatgtttacagaggac

SEQ ID NO: 3416270 - DNA, 20 bp, Homo sapiens
tgccatggacagaagaaggc

SEQ ID NO: 3416271 - DNA, 16 bp, Homo sapiens
tgccatgtgaagaggg

SEQ ID NO: 3416272 - DNA, 19 bp, Homo sapiens
tgcccagcggacagtggca

SEQ ID NO: 3416273 - DNA, 21 bp, Homo sapiens
tgcccagggtcagtgtatcta

SEQ ID NO: 3416274 - DNA, 17 bp, Homo sapiens
tgcccatttttgctaat

SEQ ID NO: 3416275 - DNA, 15 bp, Homo sapiens
tgcccccaggactgg

SEQ ID NO: 3416276 - DNA, 19 bp, Homo sapiens
tgcccccaggactgggcca

SEQ ID NO: 3416277 - DNA, 12 bp, Homo sapiens
tgccccctgcag

SEQ ID NO: 3416278 - DNA, 22 bp, Homo sapiens
tgccccctgcaggaaggagctg

SEQ ID NO: 3416279 - DNA, 19 bp, Homo sapiens
tgccccgtgacacatgctc

SEQ ID NO: 3416280 - DNA, 19 bp, Homo sapiens
tgccctcccacctccgctg

SEQ ID NO: 3416281 - DNA, 16 bp, Homo sapiens
tgccctggtggccctc

SEQ ID NO: 3416282 - DNA, 13 bp, Homo sapiens
tgccgcagagctg

SEQ ID NO: 3416283 - DNA, 18 bp, Homo sapiens
tgcctcaggcctctgtgc

SEQ ID NO: 3416284 - DNA, 14 bp, Homo sapiens
tgcctccagggctg

SEQ ID NO: 3416285 - DNA, 18 bp, Homo sapiens
tgcctccagggctggact

SEQ ID NO: 3416286 - DNA, 19 bp, Homo sapiens
tgcctccagggctggactg

SEQ ID NO: 3416287 - DNA, 20 bp, Homo sapiens
tgcctccagggctggactga

SEQ ID NO: 3416288 - DNA, 21 bp, Homo sapiens
tgttgaataatacgtgtgtac

SEQ ID NO: 3416289 - DNA, 20 bp, Homo sapiens
tgttgcaccaattaagtgtt

SEQ ID NO: 3416290 - DNA, 23 bp, Homo sapiens
tgttgcaccaattaagtgttgaa

SEQ ID NO: 3416291 - DNA, 14 bp, Homo sapiens
tgttgcataaacaa

SEQ ID NO: 3416292 - DNA, 13 bp, Homo sapiens
tgttggcagctct

SEQ ID NO: 3416293 - DNA, 19 bp, Homo sapiens
tgttgggaagctatttcct

SEQ ID NO: 3416294 - DNA, 18 bp, Homo sapiens
tgttgggatcgcattgca

SEQ ID NO: 3416295 - DNA, 11 bp, Homo sapiens
tgttggtgcaa

SEQ ID NO: 3416296 - DNA, 14 bp, Homo sapiens
tgttggttttgact

SEQ ID NO: 3416297 - DNA, 13 bp, Homo sapiens
tgttgtacattta

SEQ ID NO: 3416298 - DNA, 23 bp, Homo sapiens
tgttgtacatttatgatttaata

SEQ ID NO: 3416299 - DNA, 15 bp, Homo sapiens
tgttgtcatgtgtat

SEQ ID NO: 3416300 - DNA, 16 bp, Homo sapiens
tgttgtgcctccctgg

SEQ ID NO: 3416301 - DNA, 16 bp, Homo sapiens
tgttgtgtgtgggagt

SEQ ID NO: 3416302 - DNA, 15 bp, Homo sapiens
tgttgtttgaagaac

SEQ ID NO: 3416303 - DNA, 13 bp, Homo sapiens
tgtttaaatgcca

SEQ ID NO: 3416304 - DNA, 21 bp, Homo sapiens
tgtttacagaggacagtattt

SEQ ID NO: 3416305 - DNA, 19 bp, Homo sapiens
tgtttagaagaagtgtgtc

SEQ ID NO: 3416306 - DNA, 13 bp, Homo sapiens
tgtttctccccca

SEQ ID NO: 3416307 - DNA, 21 bp, Homo sapiens
tgtttctcccccatgttctgt

SEQ ID NO: 3416308 - DNA, 13 bp, Homo sapiens
tgtttcttgttca

SEQ ID NO: 3416309 - DNA, 20 bp, Homo sapiens
tgttttaaaagtttgtcctt

SEQ ID NO: 3416310 - DNA, 12 bp, Homo sapiens
tgttttgtaaag

SEQ ID NO: 3416311 - DNA, 16 bp, Homo sapiens
ttaaaaaacaattggt

SEQ ID NO: 3416312 - DNA, 16 bp, Homo sapiens
ttaaaaatgaaaatta

SEQ ID NO: 3416313 - DNA, 20 bp, Homo sapiens
ttaaaacatgctgtttatga

SEQ ID NO: 3416314 - DNA, 21 bp, Homo sapiens
ttaaaacatgctgtttatgac

SEQ ID NO: 3416315 - DNA, 14 bp, Homo sapiens
ttaaaagacaaaca

SEQ ID NO: 3416316 - DNA, 11 bp, Homo sapiens
ttaaaaggaaa

SEQ ID NO: 3416317 - DNA, 12 bp, Homo sapiens
ttaaaatgcaat

SEQ ID NO: 3416318 - DNA, 13 bp, Homo sapiens
ttaaaatgcaata

SEQ ID NO: 3416319 - DNA, 18 bp, Homo sapiens
ttaaaatgttggtgcaat

SEQ ID NO: 3416320 - DNA, 18 bp, Homo sapiens
ttaaaattgtgatgtgtc

SEQ ID NO: 3416321 - DNA, 17 bp, Homo sapiens
ttaaacaaaatttcaca

SEQ ID NO: 3416322 - DNA, 17 bp, Homo sapiens
ttaaacgacttttgttt

SEQ ID NO: 3416323 - DNA, 14 bp, Homo sapiens
ttaaacttttcatt

SEQ ID NO: 3416324 - DNA, 13 bp, Homo sapiens
ttaaagaaaatgt

SEQ ID NO: 3416325 - DNA, 18 bp, Homo sapiens
ttaaagataagtctacat

SEQ ID NO: 3416326 - DNA, 16 bp, Homo sapiens
ttaaagcacatgccag

SEQ ID NO: 3416327 - DNA, 14 bp, Homo sapiens
ttaaagcttgattt

SEQ ID NO: 3416328 - DNA, 19 bp, Homo sapiens
ttaaaggacaaacagtgaa

SEQ ID NO: 3416329 - DNA, 19 bp, Homo sapiens
ttaaagtaaacttgtgtat

SEQ ID NO: 3416330 - DNA, 22 bp, Homo sapiens
ttaaatcagtttattaaatctg

SEQ ID NO: 3416331 - DNA, 12 bp, Homo sapiens
ttaaatcatttg

SEQ ID NO: 3416332 - DNA, 18 bp, Homo sapiens
ttaaatcattttaggaaa

SEQ ID NO: 3416333 - DNA, 20 bp, Homo sapiens
ttaaatcattttaggaaagg

SEQ ID NO: 3416334 - DNA, 21 bp, Homo sapiens
ttaaatcattttaggaaagga

SEQ ID NO: 3416335 - DNA, 13 bp, Homo sapiens
ttaaatctgaatt

SEQ ID NO: 3416336 - DNA, 21 bp, Homo sapiens
ttaaatgagggtttctgatct

SEQ ID NO: 3416337 - DNA, 18 bp, Homo sapiens
ttaaatgccaaaatgtac

SEQ ID NO: 3416338 - DNA, 20 bp, Homo sapiens
ttaaatgccaaaatgtactt

SEQ ID NO: 3416339 - DNA, 22 bp, Homo sapiens
ttaaatgccaaaatgtacttaa

SEQ ID NO: 3416340 - DNA, 15 bp, Homo sapiens
ttaaatgttttcatt

SEQ ID NO: 3416341 - DNA, 14 bp, Homo sapiens
ttaaattctctcta

SEQ ID NO: 3416342 - DNA, 17 bp, Homo sapiens
ttaaattctctctaaca

SEQ ID NO: 3416343 - DNA, 19 bp, Homo sapiens
ttaaattgattattttgtg

SEQ ID NO: 3416344 - DNA, 17 bp, Homo sapiens
ttaaattgcctttgtaa

SEQ ID NO: 3416345 - DNA, 22 bp, Homo sapiens
ttaaattgcctttgtaatatga

SEQ ID NO: 3416346 - DNA, 18 bp, Homo sapiens
ttaaatttaggtaaataa

SEQ ID NO: 3416347 - DNA, 19 bp, Homo sapiens
ttaacagcgtgtcaacttt

SEQ ID NO: 3416348 - DNA, 13 bp, Homo sapiens
ttaacaggtattt

SEQ ID NO: 3416349 - DNA, 13 bp, Homo sapiens
ttaacattaaagc

SEQ ID NO: 3416350 - DNA, 13 bp, Homo sapiens
ttaactaaatgct

SEQ ID NO: 3416351 - DNA, 17 bp, Homo sapiens
ttaactacatctgcctc

SEQ ID NO: 3416352 - DNA, 13 bp, Homo sapiens
ttaactctactgt

SEQ ID NO: 3416353 - DNA, 17 bp, Homo sapiens
ttaactctactgtgtaa

SEQ ID NO: 3416354 - DNA, 20 bp, Homo sapiens
ttaactctgtaaaagtgtct

SEQ ID NO: 3416355 - DNA, 12 bp, Homo sapiens
ttaactgtattt

SEQ ID NO: 3416356 - DNA, 14 bp, Homo sapiens
ttaactgtatttca

SEQ ID NO: 3416357 - DNA, 14 bp, Homo sapiens
ttaacttgtctttt

SEQ ID NO: 3416358 - DNA, 20 bp, Homo sapiens
ttaagaaacaatttaaattg

SEQ ID NO: 3416359 - DNA, 16 bp, Homo sapiens
ttaagaagctgttgta

SEQ ID NO: 3416360 - DNA, 22 bp, Homo sapiens
ttaagaagctgttgtacattta

SEQ ID NO: 3416361 - DNA, 14 bp, Homo sapiens
ttaagatttttctc

SEQ ID NO: 3416362 - DNA, 21 bp, Homo sapiens
ttaagatttttctcaaagttt

SEQ ID NO: 3416363 - DNA, 17 bp, Homo sapiens
ttaagctctgagctgtc

SEQ ID NO: 3416364 - DNA, 18 bp, Homo sapiens
ttaagctctgagctgtca

SEQ ID NO: 3416365 - DNA, 16 bp, Homo sapiens
ttaaggaaactcttat

SEQ ID NO: 3416366 - DNA, 20 bp, Homo sapiens
ttaaggaaactcttatctca

SEQ ID NO: 3416367 - DNA, 19 bp, Homo sapiens
ttaagggtggaaaaatgcc

SEQ ID NO: 3416368 - DNA, 18 bp, Homo sapiens
ttaagtgcgtgtgtagag

SEQ ID NO: 3416369 - DNA, 18 bp, Homo sapiens
ttaagttagggaatggca

SEQ ID NO: 3416370 - DNA, 20 bp, Homo sapiens
ttaataaaataattctaaag

SEQ ID NO: 3416371 - DNA, 20 bp, Homo sapiens
ttaataacattaccttactg

SEQ ID NO: 3416372 - DNA, 20 bp, Homo sapiens
ttaatcacttaacattccta

SEQ ID NO: 3416373 - DNA, 18 bp, Homo sapiens
ttaatcagaaacatcatg

SEQ ID NO: 3416374 - DNA, 15 bp, Homo sapiens
ttaattgttccttgc

SEQ ID NO: 3416375 - DNA, 13 bp, Homo sapiens
ttaattgttgttt

SEQ ID NO: 3416376 - DNA, 22 bp, Homo sapiens
ttaattgttgtttctttctagt

SEQ ID NO: 3416377 - DNA, 16 bp, Homo sapiens
ttaatttatactggca

SEQ ID NO: 3416378 - DNA, 13 bp, Homo sapiens
ttacaacaaacac

SEQ ID NO: 3416379 - DNA, 16 bp, Homo sapiens
ttacaactcccccacc

SEQ ID NO: 3416380 - DNA, 17 bp, Homo sapiens
ttacacagtgtgaataa

SEQ ID NO: 3416381 - DNA, 24 bp, Homo sapiens
ttacaggcaccgagaatgttgtat

SEQ ID NO: 3416382 - DNA, 13 bp, Homo sapiens
ttacatgcatttg

SEQ ID NO: 3416383 - DNA, 12 bp, Homo sapiens
ttacatggctct

SEQ ID NO: 3416384 - DNA, 17 bp, Homo sapiens
ttacctgatcaatgaca

SEQ ID NO: 3416385 - DNA, 18 bp, Homo sapiens
ttacctgatcaatgacag

SEQ ID NO: 3416386 - DNA, 13 bp, Homo sapiens
ttacgtataatgc

SEQ ID NO: 3416387 - DNA, 23 bp, Homo sapiens
ttactaagatcacacaaataaca

SEQ ID NO: 3416388 - DNA, 21 bp, Homo sapiens
ttactcccttctgtagttttt

SEQ ID NO: 3416389 - DNA, 20 bp, Homo sapiens
ttactgtggaggaaggattg

SEQ ID NO: 3416390 - DNA, 12 bp, Homo sapiens
ttacttgatcat

SEQ ID NO: 3416391 - DNA, 13 bp, Homo sapiens
ttactttggttta

SEQ ID NO: 3416392 - DNA, 14 bp, Homo sapiens
ttactttgtgcaaa

SEQ ID NO: 3416393 - DNA, 17 bp, Homo sapiens
ttactttttaaacagtg

SEQ ID NO: 3416394 - DNA, 15 bp, Homo sapiens
ttagactgtggccat

SEQ ID NO: 3416395 - DNA, 15 bp, Homo sapiens
ttagccaggatcatg

SEQ ID NO: 3416396 - DNA, 16 bp, Homo sapiens
ttagcctttgtcccag

SEQ ID NO: 3416397 - DNA, 13 bp, Homo sapiens
ttagctcccctcc

SEQ ID NO: 3416398 - DNA, 14 bp, Homo sapiens
ttagctcccctcca

SEQ ID NO: 3416399 - DNA, 18 bp, Homo sapiens
ttaggaaaggatgatcaa

SEQ ID NO: 3416400 - DNA, 22 bp, Homo sapiens
tttgaaaggcaatttttgagta

SEQ ID NO: 3416401 - DNA, 22 bp, Homo sapiens
tttgaaagtgggtttcaattta

SEQ ID NO: 3416402 - DNA, 16 bp, Homo sapiens
tttgaagatctgattt

SEQ ID NO: 3416403 - DNA, 17 bp, Homo sapiens
tttgaatccatgcttgg

SEQ ID NO: 3416404 - DNA, 16 bp, Homo sapiens
tttgaatgcttcctga

SEQ ID NO: 3416405 - DNA, 23 bp, Homo sapiens
tttgacacaatgttgcactgaaa

SEQ ID NO: 3416406 - DNA, 15 bp, Homo sapiens
tttgactggatattc

SEQ ID NO: 3416407 - DNA, 15 bp, Homo sapiens
tttgagacagtttct

SEQ ID NO: 3416408 - DNA, 16 bp, Homo sapiens
tttgagacagtttctt

SEQ ID NO: 3416409 - DNA, 17 bp, Homo sapiens
tttgagacagtttctta

SEQ ID NO: 3416410 - DNA, 22 bp, Homo sapiens
tttgagacagtttcttagcttt

SEQ ID NO: 3416411 - DNA, 23 bp, Homo sapiens
tttgaggtcaagtaagaagacat

SEQ ID NO: 3416412 - DNA, 15 bp, Homo sapiens
tttgaggtctacatt

SEQ ID NO: 3416413 - DNA, 17 bp, Homo sapiens
tttgagtatggctatct

SEQ ID NO: 3416414 - DNA, 17 bp, Homo sapiens
tttgagtttgctgtttt

SEQ ID NO: 3416415 - DNA, 21 bp, Homo sapiens
tttgagtttgctgttttaaat

SEQ ID NO: 3416416 - DNA, 12 bp, Homo sapiens
tttgataatgtt

SEQ ID NO: 3416417 - DNA, 14 bp, Homo sapiens
tttgataatgttaa

SEQ ID NO: 3416418 - DNA, 23 bp, Homo sapiens
tttgataatgttaaatttgtaag

SEQ ID NO: 3416419 - DNA, 17 bp, Homo sapiens
tttgatcatagaattgt

SEQ ID NO: 3416420 - DNA, 13 bp, Homo sapiens
tttgatctttgtt

SEQ ID NO: 3416421 - DNA, 22 bp, Homo sapiens
tttgatctttgtttaaatgcca

SEQ ID NO: 3416422 - DNA, 20 bp, Homo sapiens
tttgattaaattatgaatga

SEQ ID NO: 3416423 - DNA, 12 bp, Homo sapiens
tttgattctcct

SEQ ID NO: 3416424 - DNA, 20 bp, Homo sapiens
tttgccatgggcttcactgt

SEQ ID NO: 3416425 - DNA, 15 bp, Homo sapiens
tttgctgctgtggaa

SEQ ID NO: 3416426 - DNA, 14 bp, Homo sapiens
tttgctttgttata

SEQ ID NO: 3416427 - DNA, 22 bp, Homo sapiens
tttggagcattaactaaatgct

SEQ ID NO: 3416428 - DNA, 16 bp, Homo sapiens
tttggagggatcattt

SEQ ID NO: 3416429 - DNA, 14 bp, Homo sapiens
tttggcttgctgtt

SEQ ID NO: 3416430 - DNA, 13 bp, Homo sapiens
tttggttaaagta

SEQ ID NO: 3416431 - DNA, 17 bp, Homo sapiens
tttgtaaatttatgtga

SEQ ID NO: 3416432 - DNA, 12 bp, Homo sapiens
tttgtaagagtg

SEQ ID NO: 3416433 - DNA, 19 bp, Homo sapiens
tttgtaagagtgtagaagc

SEQ ID NO: 3416434 - DNA, 15 bp, Homo sapiens
tttgtaatatgagaa

SEQ ID NO: 3416435 - DNA, 17 bp, Homo sapiens
tttgtaatatgagaatg

SEQ ID NO: 3416436 - DNA, 21 bp, Homo sapiens
tttgtaatatgagaatgtatt

SEQ ID NO: 3416437 - DNA, 16 bp, Homo sapiens
tttgtattgcttcctg

SEQ ID NO: 3416438 - DNA, 14 bp, Homo sapiens
tttgtatttaatga

SEQ ID NO: 3416439 - DNA, 19 bp, Homo sapiens
tttgtcacagctcttgttt

SEQ ID NO: 3416440 - DNA, 22 bp, Homo sapiens
tttgtgagctttttgttccctc

SEQ ID NO: 3416441 - DNA, 11 bp, Homo sapiens
tttgtggggag

SEQ ID NO: 3416442 - DNA, 20 bp, Homo sapiens
tttgttaacagacactgtaa

SEQ ID NO: 3416443 - DNA, 20 bp, Homo sapiens
tttgttatagattgtcttaa

SEQ ID NO: 3416444 - DNA, 14 bp, Homo sapiens
tttgttatgcaaat

SEQ ID NO: 3416445 - DNA, 15 bp, Homo sapiens
tttgttatgcaaatg

SEQ ID NO: 3416446 - DNA, 12 bp, Homo sapiens
tttgttcccctc

SEQ ID NO: 3416447 - DNA, 15 bp, Homo sapiens
tttgttcccctcctc

SEQ ID NO: 3416448 - DNA, 18 bp, Homo sapiens
tttgttcccctcctccac

SEQ ID NO: 3416449 - DNA, 22 bp, Homo sapiens
tttgttccctcattctgcatta

SEQ ID NO: 3416450 - DNA, 14 bp, Homo sapiens
tttgttgtcatgtg

SEQ ID NO: 3416451 - DNA, 15 bp, Homo sapiens
tttgttgtcatgtgt

SEQ ID NO: 3416452 - DNA, 16 bp, Homo sapiens
tttgttgtcatgtgta

SEQ ID NO: 3416453 - DNA, 22 bp, Homo sapiens
tttgtttaaatgccaaaatgta

SEQ ID NO: 3416454 - DNA, 17 bp, Homo sapiens
ttttaaaacagatatta

SEQ ID NO: 3416455 - DNA, 22 bp, Homo sapiens
ttttaaaagagacaaactgtaa

SEQ ID NO: 3416456 - DNA, 23 bp, Homo sapiens
ttttaaaagagacaaactgtaaa

SEQ ID NO: 3416457 - DNA, 17 bp, Homo sapiens
ttttaaacaaaatttca

SEQ ID NO: 3416458 - DNA, 19 bp, Homo sapiens
ttttaaacagtgtttatga

SEQ ID NO: 3416459 - DNA, 20 bp, Homo sapiens
ttttaaagaaaatgtgtctg

SEQ ID NO: 3416460 - DNA, 19 bp, Homo sapiens
ttttaaaggacaaacagtg

SEQ ID NO: 3416461 - DNA, 22 bp, Homo sapiens
ttttaaaggacaaacagtgaat

SEQ ID NO: 3416462 - DNA, 17 bp, Homo sapiens
ttttaagatttttctca

SEQ ID NO: 3416463 - DNA, 22 bp, Homo sapiens
ttttaagtgacataattgtcca

SEQ ID NO: 3416464 - DNA, 12 bp, Homo sapiens
ttttaatagaac

SEQ ID NO: 3416465 - DNA, 23 bp, Homo sapiens
ttttacaaattcctttcagagtt

SEQ ID NO: 3416466 - DNA, 14 bp, Homo sapiens
ttttacatacagtg

SEQ ID NO: 3416467 - DNA, 16 bp, Homo sapiens
ttttactaagatcaca

SEQ ID NO: 3416468 - DNA, 11 bp, Homo sapiens
ttttactttgg

SEQ ID NO: 3416469 - DNA, 12 bp, Homo sapiens
ttttactttggt

SEQ ID NO: 3416470 - DNA, 20 bp, Homo sapiens
ttttagtttaaaatcttgca

SEQ ID NO: 3416471 - DNA, 21 bp, Homo sapiens
ttttagtttaaaatcttgcat

SEQ ID NO: 3416472 - DNA, 22 bp, Homo sapiens
ttttatctacccagtcatgtac

SEQ ID NO: 3416473 - DNA, 12 bp, Homo sapiens
ttttatctcctt

SEQ ID NO: 3416474 - DNA, 17 bp, Homo sapiens
ttttatcttgagtgtta

SEQ ID NO: 3416475 - DNA, 21 bp, Homo sapiens
ttttattgagcaagtatcctt

SEQ ID NO: 3416476 - DNA, 15 bp, Homo sapiens
ttttattttcattgt

SEQ ID NO: 3416477 - DNA, 23 bp, Homo sapiens
ttttcagattccacacaaaatgt

SEQ ID NO: 3416478 - DNA, 22 bp, Homo sapiens
ttttcagcatcaaacatgaaaa

SEQ ID NO: 3416479 - DNA, 18 bp, Homo sapiens
ttttccatgaaaatgcaa

SEQ ID NO: 3416480 - DNA, 19 bp, Homo sapiens
ttttccatgaaaatgcaac

SEQ ID NO: 3416481 - DNA, 19 bp, Homo sapiens
ttttccttcctttttattc

SEQ ID NO: 3416482 - DNA, 21 bp, Homo sapiens
ttttcctttaaaaaaatttaa

SEQ ID NO: 3416483 - DNA, 19 bp, Homo sapiens
ttttctcaaagttttgaaa

SEQ ID NO: 3416484 - DNA, 19 bp, Homo sapiens
ttttctcctgcatgtgtat

SEQ ID NO: 3416485 - DNA, 20 bp, Homo sapiens
ttttctcctgcatgtgtata

SEQ ID NO: 3416486 - DNA, 21 bp, Homo sapiens
ttttcttgcctctgtcccctt

SEQ ID NO: 3416487 - DNA, 15 bp, Homo sapiens
ttttctttgtatcat

SEQ ID NO: 3416488 - DNA, 18 bp, Homo sapiens
ttttctttgtatcattca

SEQ ID NO: 3416489 - DNA, 14 bp, Homo sapiens
ttttgaagaacaaa

SEQ ID NO: 3416490 - DNA, 22 bp, Homo sapiens
ttttgaatgcttcctgacaatc

SEQ ID NO: 3416491 - DNA, 12 bp, Homo sapiens
ttttgcagcttt

SEQ ID NO: 3416492 - DNA, 16 bp, Homo sapiens
ttttggatttctttat

SEQ ID NO: 3416493 - DNA, 16 bp, Homo sapiens
ttttggttttgttccc

SEQ ID NO: 3416494 - DNA, 15 bp, Homo sapiens
ttttgtatttaatga

SEQ ID NO: 3416495 - DNA, 15 bp, Homo sapiens
ttttgttcccctcct

SEQ ID NO: 3416496 - DNA, 18 bp, Homo sapiens
ttttgttgagtctctgaa

SEQ ID NO: 3416497 - DNA, 21 bp, Homo sapiens
tttttaaaaaacaattggttg

SEQ ID NO: 3416498 - DNA, 22 bp, Homo sapiens
tttttaaagaaaatgtgtctgc

SEQ ID NO: 3416499 - DNA, 16 bp, Homo sapiens
tttttaaagtaaactt

SEQ ID NO: 3416500 - DNA, 19 bp, Homo sapiens
tttttaaagtaaacttgtg

SEQ ID NO: 3416501 - DNA, 22 bp, Homo sapiens
tttttaactcaatattttccat

SEQ ID NO: 3416502 - DNA, 20 bp, Homo sapiens
tttttaagctctgagctgtc

SEQ ID NO: 3416503 - DNA, 17 bp, Homo sapiens
tttttaattaaaaactt

SEQ ID NO: 3416504 - DNA, 18 bp, Homo sapiens
tttttaattgttgtttct

SEQ ID NO: 3416505 - DNA, 23 bp, Homo sapiens
tttttatatctggaatgagcctg

SEQ ID NO: 3416506 - DNA, 17 bp, Homo sapiens
tttttatattagttgct

SEQ ID NO: 3416507 - DNA, 10 bp, Homo sapiens
tttttattca

SEQ ID NO: 3416508 - DNA, 21 bp, Homo sapiens
tttttatttcttttgtgcaga

SEQ ID NO: 3416509 - DNA, 12 bp, Homo sapiens
tttttccaggct

SEQ ID NO: 3416510 - DNA, 16 bp, Homo sapiens
tttttctcaaagtttt

SEQ ID NO: 3416511 - DNA, 23 bp, Homo sapiens
aagcattccttctttgataatgt

SEQ ID NO: 3416512 - DNA, 15 bp, Homo sapiens
aagcattttcagcat

SEQ ID NO: 3416513 - DNA, 23 bp, Homo sapiens
aagccaagctccctggagccctg

SEQ ID NO: 3416514 - DNA, 19 bp, Homo sapiens
aagccacaggcctgagatt

SEQ ID NO: 3416515 - DNA, 19 bp, Homo sapiens
aagccaccttgttacaaat

SEQ ID NO: 3416516 - DNA, 17 bp, Homo sapiens
aagccagcaccggacca

SEQ ID NO: 3416517 - DNA, 19 bp, Homo sapiens
aagctattagccaggatca

SEQ ID NO: 3416518 - DNA, 19 bp, Homo sapiens
aagctccctggagccctgt

SEQ ID NO: 3416519 - DNA, 9 bp, Homo sapiens
aagctctga

SEQ ID NO: 3416520 - DNA, 15 bp, Homo sapiens
aagctctgagctgtc

SEQ ID NO: 3416521 - DNA, 16 bp, Homo sapiens
aagctgggactcattc

SEQ ID NO: 3416522 - DNA, 14 bp, Homo sapiens
aagctgtgtctctg

SEQ ID NO: 3416523 - DNA, 16 bp, Homo sapiens
aagctgtgtctctgta

SEQ ID NO: 3416524 - DNA, 17 bp, Homo sapiens
aagctgttgtacattta

SEQ ID NO: 3416525 - DNA, 18 bp, Homo sapiens
aagctgttgtacatttat

SEQ ID NO: 3416526 - DNA, 21 bp, Homo sapiens
aagctgttgtacatttatgat

SEQ ID NO: 3416527 - DNA, 14 bp, Homo sapiens
aagcttcaaaaact

SEQ ID NO: 3416528 - DNA, 20 bp, Homo sapiens
aagcttgatttgatctttgt

SEQ ID NO: 3416529 - DNA, 22 bp, Homo sapiens
aagcttgatttgatctttgttt

SEQ ID NO: 3416530 - DNA, 17 bp, Homo sapiens
aaggaacctaattgaaa

SEQ ID NO: 3416531 - DNA, 18 bp, Homo sapiens
aaggaacctaattgaaat

SEQ ID NO: 3416532 - DNA, 21 bp, Homo sapiens
aaggaacctaattgaaattta

SEQ ID NO: 3416533 - DNA, 11 bp, Homo sapiens
aaggagctgcc

SEQ ID NO: 3416534 - DNA, 13 bp, Homo sapiens
aaggagctgcctg

SEQ ID NO: 3416535 - DNA, 12 bp, Homo sapiens
aaggattgtaaa

SEQ ID NO: 3416536 - DNA, 14 bp, Homo sapiens
aaggattgtaaaaa

SEQ ID NO: 3416537 - DNA, 16 bp, Homo sapiens
aaggcagcatgtatag

SEQ ID NO: 3416538 - DNA, 17 bp, Homo sapiens
aaggccagacctgcaga

SEQ ID NO: 3416539 - DNA, 18 bp, Homo sapiens
aaggccagacctgcagac

SEQ ID NO: 3416540 - DNA, 15 bp, Homo sapiens
aaggcctcgcaggaa

SEQ ID NO: 3416541 - DNA, 18 bp, Homo sapiens
aaggcctcgcaggaagac

SEQ ID NO: 3416542 - DNA, 13 bp, Homo sapiens
aaggctgtacata

SEQ ID NO: 3416543 - DNA, 16 bp, Homo sapiens
aaggctgtacatagtc

SEQ ID NO: 3416544 - DNA, 21 bp, Homo sapiens
aaggctttaaaagtcattatt

SEQ ID NO: 3416545 - DNA, 15 bp, Homo sapiens
aagggagaaatgcca

SEQ ID NO: 3416546 - DNA, 15 bp, Homo sapiens
aagggagggggctgg

SEQ ID NO: 3416547 - DNA, 17 bp, Homo sapiens
aagggggtggtgtctcc

SEQ ID NO: 3416548 - DNA, 14 bp, Homo sapiens
aaggtaaatacaag

SEQ ID NO: 3416549 - DNA, 21 bp, Homo sapiens
aaggtaatgtagggttatatt

SEQ ID NO: 3416550 - DNA, 22 bp, Homo sapiens
aaggtgggccttgctacctcaa

SEQ ID NO: 3416551 - DNA, 13 bp, Homo sapiens
aaggtggggtgga

SEQ ID NO: 3416552 - DNA, 16 bp, Homo sapiens
aagtaaacttgtgtat

SEQ ID NO: 3416553 - DNA, 14 bp, Homo sapiens
aagtaagaagacat

SEQ ID NO: 3416554 - DNA, 20 bp, Homo sapiens
aagtacatattaggaaaata

SEQ ID NO: 3416555 - DNA, 14 bp, Homo sapiens
aagtaccagattat

SEQ ID NO: 3416556 - DNA, 16 bp, Homo sapiens
aagtataacaattaaa

SEQ ID NO: 3416557 - DNA, 15 bp, Homo sapiens
aagtatatgtgagaa

SEQ ID NO: 3416558 - DNA, 11 bp, Homo sapiens
aagtatgcaaa

SEQ ID NO: 3416559 - DNA, 15 bp, Homo sapiens
aagtatgcaaaataa

SEQ ID NO: 3416560 - DNA, 12 bp, Homo sapiens
aagtcctgcttt

SEQ ID NO: 3416561 - DNA, 14 bp, Homo sapiens
aagtcttggtaaca

SEQ ID NO: 3416562 - DNA, 16 bp, Homo sapiens
aagtgaatttatgaga

SEQ ID NO: 3416563 - DNA, 22 bp, Homo sapiens
aagtgacagatcctccattttt

SEQ ID NO: 3416564 - DNA, 17 bp, Homo sapiens
aagtgagtggcatgtgg

SEQ ID NO: 3416565 - DNA, 17 bp, Homo sapiens
aagtgcgtgtgtagagt

SEQ ID NO: 3416566 - DNA, 19 bp, Homo sapiens
aagtgctgcggagcaagag

SEQ ID NO: 3416567 - DNA, 21 bp, Homo sapiens
aagtgctgcggagcaagagga

SEQ ID NO: 3416568 - DNA, 21 bp, Homo sapiens
aagtgcttaacgttttcttaa

SEQ ID NO: 3416569 - DNA, 22 bp, Homo sapiens
aagtgcttaacgttttcttaaa

SEQ ID NO: 3416570 - DNA, 20 bp, Homo sapiens
aagtggaccttgagaccaca

SEQ ID NO: 3416571 - DNA, 13 bp, Homo sapiens
aagtgtcatcaat

SEQ ID NO: 3416572 - DNA, 24 bp, Homo sapiens
aagtgtctagagtcatgtgagcct

SEQ ID NO: 3416573 - DNA, 18 bp, Homo sapiens
aagttaaggtatctggta

SEQ ID NO: 3416574 - DNA, 15 bp, Homo sapiens
aagttagtttctcat

SEQ ID NO: 3416575 - DNA, 17 bp, Homo sapiens
aagttccagttttgttt

SEQ ID NO: 3416576 - DNA, 19 bp, Homo sapiens
aagtttgggctaacattta

SEQ ID NO: 3416577 - DNA, 18 bp, Homo sapiens
aagtttgtcctttaacta

SEQ ID NO: 3416578 - DNA, 12 bp, Homo sapiens
aagttttgaaaa

SEQ ID NO: 3416579 - DNA, 18 bp, Homo sapiens
aagttttgaaaagctatt

SEQ ID NO: 3416580 - DNA, 16 bp, Homo sapiens
aagttttttactttgg

SEQ ID NO: 3416581 - DNA, 15 bp, Homo sapiens
aataaaataattcta

SEQ ID NO: 3416582 - DNA, 16 bp, Homo sapiens
aataaaattatttgca

SEQ ID NO: 3416583 - DNA, 20 bp, Homo sapiens
aataaacatctgtgtctgtg

SEQ ID NO: 3416584 - DNA, 21 bp, Homo sapiens
aataaacatctgtgtctgtgt

SEQ ID NO: 3416585 - DNA, 17 bp, Homo sapiens
aataaagctactgaatt

SEQ ID NO: 3416586 - DNA, 19 bp, Homo sapiens
aataaagctactgaattta

SEQ ID NO: 3416587 - DNA, 22 bp, Homo sapiens
aataaagctactgaatttattg

SEQ ID NO: 3416588 - DNA, 16 bp, Homo sapiens
aataaataatctacat

SEQ ID NO: 3416589 - DNA, 14 bp, Homo sapiens
aataaatatagttg

SEQ ID NO: 3416590 - DNA, 21 bp, Homo sapiens
aataaatatagttgtctttct

SEQ ID NO: 3416591 - DNA, 15 bp, Homo sapiens
aataaatgcatagag

SEQ ID NO: 3416592 - DNA, 13 bp, Homo sapiens
aataacaatgtta

SEQ ID NO: 3416593 - DNA, 20 bp, Homo sapiens
aataacaatgttaaggaaac

SEQ ID NO: 3416594 - DNA, 13 bp, Homo sapiens
aataacagctttc

SEQ ID NO: 3416595 - DNA, 16 bp, Homo sapiens
aataacagctttctta

SEQ ID NO: 3416596 - DNA, 20 bp, Homo sapiens
aataacattaccttactgtg

SEQ ID NO: 3416597 - DNA, 16 bp, Homo sapiens
aataataaatgcatag

SEQ ID NO: 3416598 - DNA, 23 bp, Homo sapiens
aataatgcatccagcagtacaat

SEQ ID NO: 3416599 - DNA, 16 bp, Homo sapiens
aatacctcaggaaaga

SEQ ID NO: 3416600 - DNA, 14 bp, Homo sapiens
aatactctgaaatg

SEQ ID NO: 3416601 - DNA, 13 bp, Homo sapiens
aataggttttaaa

SEQ ID NO: 3416602 - DNA, 23 bp, Homo sapiens
aataggttttaaacgacttttgt

SEQ ID NO: 3416603 - DNA, 21 bp, Homo sapiens
aatagtgtcctatgcaataaa

SEQ ID NO: 3416604 - DNA, 22 bp, Homo sapiens
aatagtgtcctatgcaataaaa

SEQ ID NO: 3416605 - DNA, 23 bp, Homo sapiens
aatagtgtcctatgcaataaaat

SEQ ID NO: 3416606 - DNA, 22 bp, Homo sapiens
aatatactttttttgttataga

SEQ ID NO: 3416607 - DNA, 18 bp, Homo sapiens
aatatagttgtctttctt

SEQ ID NO: 3416608 - DNA, 22 bp, Homo sapiens
aatatagttgtctttctttgct

SEQ ID NO: 3416609 - DNA, 22 bp, Homo sapiens
aatatatggcatttgcagattt

SEQ ID NO: 3416610 - DNA, 16 bp, Homo sapiens
aatatcaaaaggaaga

SEQ ID NO: 3416611 - DNA, 15 bp, Homo sapiens
aatatctgaacattt

SEQ ID NO: 3416612 - DNA, 19 bp, Homo sapiens
aatatgacggaagaacata

SEQ ID NO: 3416613 - DNA, 16 bp, Homo sapiens
aatattagcttgctta

SEQ ID NO: 3416614 - DNA, 17 bp, Homo sapiens
aatattctctgatgttt

SEQ ID NO: 3416615 - DNA, 18 bp, Homo sapiens
aatattctgataatgtat

SEQ ID NO: 3416616 - DNA, 14 bp, Homo sapiens
aatattggttagta

SEQ ID NO: 3416617 - DNA, 21 bp, Homo sapiens
aatattttccatgaaaatgca

SEQ ID NO: 3416618 - DNA, 21 bp, Homo sapiens
aatcaacctatcaaagcttca

SEQ ID NO: 3416619 - DNA, 14 bp, Homo sapiens
aatcaactctaata

SEQ ID NO: 3416620 - DNA, 18 bp, Homo sapiens
aatcacttaacattccta

SEQ ID NO: 3416621 - DNA, 17 bp, Homo sapiens
aatcagaattggcataa

SEQ ID NO: 3416622 - DNA, 19 bp, Homo sapiens
aatcagtttattaaatctg

SEQ ID NO: 3416623 - DNA, 16 bp, Homo sapiens
aatcatgctcatgtat

SEQ ID NO: 3416624 - DNA, 17 bp, Homo sapiens
aattttgtcacagctct

SEQ ID NO: 3416625 - DNA, 14 bp, Homo sapiens
aattttttaatttc

SEQ ID NO: 3416626 - DNA, 21 bp, Homo sapiens
acaaaaaaatacctcaggaaa

SEQ ID NO: 3416627 - DNA, 16 bp, Homo sapiens
acaaaagctgtgtctc

SEQ ID NO: 3416628 - DNA, 15 bp, Homo sapiens
acaaaatttcacagt

SEQ ID NO: 3416629 - DNA, 17 bp, Homo sapiens
acaaacagtgaatttaa

SEQ ID NO: 3416630 - DNA, 13 bp, Homo sapiens
acaaatgtatgat

SEQ ID NO: 3416631 - DNA, 16 bp, Homo sapiens
acaaatttagccaata

SEQ ID NO: 3416632 - DNA, 14 bp, Homo sapiens
acaacatgtataat

SEQ ID NO: 3416633 - DNA, 14 bp, Homo sapiens
acaaccaggtcttg

SEQ ID NO: 3416634 - DNA, 22 bp, Homo sapiens
acaacctttcccatttcgtgta

SEQ ID NO: 3416635 - DNA, 16 bp, Homo sapiens
acaagctacagttgtc

SEQ ID NO: 3416636 - DNA, 23 bp, Homo sapiens
acaatggaccggagagtgggggt

SEQ ID NO: 3416637 - DNA, 22 bp, Homo sapiens
acaatgtacaaggtatgtacag

SEQ ID NO: 3416638 - DNA, 19 bp, Homo sapiens
acaatgttaaggaaactct

SEQ ID NO: 3416639 - DNA, 20 bp, Homo sapiens
acaatgttaaggaaactctt

SEQ ID NO: 3416640 - DNA, 20 bp, Homo sapiens
acaatttaaagcaaaggagt

SEQ ID NO: 3416641 - DNA, 11 bp, Homo sapiens
acacaaaagaa

SEQ ID NO: 3416642 - DNA, 15 bp, Homo sapiens
acacaaaagaagaaa

SEQ ID NO: 3416643 - DNA, 23 bp, Homo sapiens
acacaatgacacatttgttgcac

SEQ ID NO: 3416644 - DNA, 21 bp, Homo sapiens
acacaatgttgcactgaaaac

SEQ ID NO: 3416645 - DNA, 20 bp, Homo sapiens
acacagtgtgaataaagtgc

SEQ ID NO: 3416646 - DNA, 15 bp, Homo sapiens
acaccaaaaattgcg

SEQ ID NO: 3416647 - DNA, 18 bp, Homo sapiens
acaccagagcagatgcag

SEQ ID NO: 3416648 - DNA, 12 bp, Homo sapiens
aatgcatagagc

SEQ ID NO: 3416649 - DNA, 13 bp, Homo sapiens
aatgcatagagca

SEQ ID NO: 3416650 - DNA, 21 bp, Homo sapiens
aatgcatccagcagtacaata

SEQ ID NO: 3416651 - DNA, 17 bp, Homo sapiens
aatgccaaaatgtactt

SEQ ID NO: 3416652 - DNA, 16 bp, Homo sapiens
aatgccagaatataat

SEQ ID NO: 3416653 - DNA, 20 bp, Homo sapiens
aatgccaggcggacaaagtt

SEQ ID NO: 3416654 - DNA, 17 bp, Homo sapiens
aatgccataaaattgca

SEQ ID NO: 3416655 - DNA, 16 bp, Homo sapiens
aatgcctttgagacag

SEQ ID NO: 3416656 - DNA, 20 bp, Homo sapiens
aatgcctttgagacagtttc

SEQ ID NO: 3416657 - DNA, 23 bp, Homo sapiens
aatgcctttgagacagtttctta

SEQ ID NO: 3416658 - DNA, 18 bp, Homo sapiens
aatgcgtcttgtgaaatt

SEQ ID NO: 3416659 - DNA, 21 bp, Homo sapiens
aatgcttcctgacaatcaact

SEQ ID NO: 3416660 - DNA, 18 bp, Homo sapiens
aatgcttgccaagaaatc

SEQ ID NO: 3416661 - DNA, 11 bp, Homo sapiens
aatgctttctg

SEQ ID NO: 3416662 - DNA, 12 bp, Homo sapiens
aatggatattaa

SEQ ID NO: 3416663 - DNA, 16 bp, Homo sapiens
aatggattggattatt

SEQ ID NO: 3416664 - DNA, 18 bp, Homo sapiens
aatggattggattattta

SEQ ID NO: 3416665 - DNA, 21 bp, Homo sapiens
aatggattggattatttaata

SEQ ID NO: 3416666 - DNA, 17 bp, Homo sapiens
aatggcacagcccaaag

SEQ ID NO: 3416667 - DNA, 22 bp, Homo sapiens
aatggtggcttcttttctttgt

SEQ ID NO: 3416668 - DNA, 22 bp, Homo sapiens
aatggtttctcattaaactcta

SEQ ID NO: 3416669 - DNA, 14 bp, Homo sapiens
aatgtacttaaatg

SEQ ID NO: 3416670 - DNA, 15 bp, Homo sapiens
aatgtacttaaatga

SEQ ID NO: 3416671 - DNA, 16 bp, Homo sapiens
aatgtacttaaatgag

SEQ ID NO: 3416672 - DNA, 19 bp, Homo sapiens
aatgtattgttctgtttgt

SEQ ID NO: 3416673 - DNA, 17 bp, Homo sapiens
aatgtcacacttgtttc

SEQ ID NO: 3416674 - DNA, 15 bp, Homo sapiens
aatgtcagtatgtgg

SEQ ID NO: 3416675 - DNA, 20 bp, Homo sapiens
aatgtcattatttgataaca

SEQ ID NO: 3416676 - DNA, 20 bp, Homo sapiens
aatgtccaaatactctgaaa

SEQ ID NO: 3416677 - DNA, 23 bp, Homo sapiens
aatgtctgtagctcctcaactca

SEQ ID NO: 3416678 - DNA, 13 bp, Homo sapiens
aatgtgatcatct

SEQ ID NO: 3416679 - DNA, 18 bp, Homo sapiens
aatgttaaatttgtaagt

SEQ ID NO: 3416680 - DNA, 18 bp, Homo sapiens
aatgttaaggaaactctt

SEQ ID NO: 3416681 - DNA, 18 bp, Homo sapiens
aatgttgcactgaaaacc

SEQ ID NO: 3416682 - DNA, 15 bp, Homo sapiens
aatgtttatgagcca

SEQ ID NO: 3416683 - DNA, 21 bp, Homo sapiens
aatgtttcaagcgcttaactc

SEQ ID NO: 3416684 - DNA, 15 bp, Homo sapiens
aattaaaaactttaa

SEQ ID NO: 3416685 - DNA, 13 bp, Homo sapiens
aattaaaatctca

SEQ ID NO: 3416686 - DNA, 16 bp, Homo sapiens
aattaaactagtttaa

SEQ ID NO: 3416687 - DNA, 13 bp, Homo sapiens
aattaaactccta

SEQ ID NO: 3416688 - DNA, 17 bp, Homo sapiens
aattaaagtatgcaaaa

SEQ ID NO: 3416689 - DNA, 12 bp, Homo sapiens
aattatgaatga

SEQ ID NO: 3416690 - DNA, 19 bp, Homo sapiens
aattatttgcaggtcttta

SEQ ID NO: 3416691 - DNA, 16 bp, Homo sapiens
aattccacaccctcac

SEQ ID NO: 3416692 - DNA, 13 bp, Homo sapiens
aattcctttcaga

SEQ ID NO: 3416693 - DNA, 14 bp, Homo sapiens
aattctaacttttt

SEQ ID NO: 3416694 - DNA, 11 bp, Homo sapiens
aattctgaaat

SEQ ID NO: 3416695 - DNA, 17 bp, Homo sapiens
aattctgaaatactttt

SEQ ID NO: 3416696 - DNA, 17 bp, Homo sapiens
aattcttacaaacatgt

SEQ ID NO: 3416697 - DNA, 14 bp, Homo sapiens
aattctttgtttcc

SEQ ID NO: 3416698 - DNA, 18 bp, Homo sapiens
aattgagaataagaattt

SEQ ID NO: 3416699 - DNA, 14 bp, Homo sapiens
aattgcagtttcat

SEQ ID NO: 3416700 - DNA, 22 bp, Homo sapiens
aattgcctttgtaatatgagaa

SEQ ID NO: 3416701 - DNA, 16 bp, Homo sapiens
aattggccttcgattt

SEQ ID NO: 3416702 - DNA, 22 bp, Homo sapiens
aattggccttcgattttaaata

SEQ ID NO: 3416703 - DNA, 18 bp, Homo sapiens
aattgtaggggtgtgtgt

SEQ ID NO: 3416704 - DNA, 16 bp, Homo sapiens
aattgtattttagtaa

SEQ ID NO: 3416705 - DNA, 14 bp, Homo sapiens
aattgtgatgtgtc

SEQ ID NO: 3416706 - DNA, 16 bp, Homo sapiens
aattgttccttgcttt

SEQ ID NO: 3416707 - DNA, 20 bp, Homo sapiens
aattgttccttgcttttata

SEQ ID NO: 3416708 - DNA, 18 bp, Homo sapiens
aattgttctgggtgattt

SEQ ID NO: 3416709 - DNA, 12 bp, Homo sapiens
aattgttgtttc

SEQ ID NO: 3416710 - DNA, 13 bp, Homo sapiens
aattgttgtttct

SEQ ID NO: 3416711 - DNA, 20 bp, Homo sapiens
aattgttgtttctttctagt

SEQ ID NO: 3416712 - DNA, 23 bp, Homo sapiens
aattgttgtttctttctagtggt

SEQ ID NO: 3416713 - DNA, 16 bp, Homo sapiens
aatttaaaaataaagc

SEQ ID NO: 3416714 - DNA, 14 bp, Homo sapiens
aatttaaattgtta

SEQ ID NO: 3416715 - DNA, 16 bp, Homo sapiens
aatttaagtgcgtgtg

SEQ ID NO: 3416716 - DNA, 20 bp, Homo sapiens
aatttaagtgcgtgtgtaga

SEQ ID NO: 3416717 - DNA, 13 bp, Homo sapiens
aatttacttttta

SEQ ID NO: 3416718 - DNA, 20 bp, Homo sapiens
aatttagagcgtttggttaa

SEQ ID NO: 3416719 - DNA, 18 bp, Homo sapiens
aatttaggtaaataaagc

SEQ ID NO: 3416720 - DNA, 19 bp, Homo sapiens
aatttaggtaaataaagct

SEQ ID NO: 3416721 - DNA, 20 bp, Homo sapiens
aatttaggtaaataaagctc

SEQ ID NO: 3416722 - DNA, 15 bp, Homo sapiens
aatttagtcattatt

SEQ ID NO: 3416723 - DNA, 14 bp, Homo sapiens
aatttcacagttct

SEQ ID NO: 3416724 - DNA, 11 bp, Homo sapiens
aatttccaaaa

SEQ ID NO: 3416725 - DNA, 22 bp, Homo sapiens
aatttccaaaataatctatatt

SEQ ID NO: 3416726 - DNA, 18 bp, Homo sapiens
aatttggcttctgttgtc

SEQ ID NO: 3416727 - DNA, 15 bp, Homo sapiens
aatttgtaattttag

SEQ ID NO: 3416728 - DNA, 16 bp, Homo sapiens
aatttgtaattttagt

SEQ ID NO: 3416729 - DNA, 18 bp, Homo sapiens
aatttgttgtcatgtgta

SEQ ID NO: 3416730 - DNA, 21 bp, Homo sapiens
aattttaaaacatgctgttta

SEQ ID NO: 3416731 - DNA, 21 bp, Homo sapiens
aattttgaggtcttttacata

SEQ ID NO: 3416732 - DNA, 20 bp, Homo sapiens
aaactaccagtgggcatgta

SEQ ID NO: 3416733 - DNA, 16 bp, Homo sapiens
aaactcttatctcagt

SEQ ID NO: 3416734 - DNA, 22 bp, Homo sapiens
aaactcttatctcagtcatgca

SEQ ID NO: 3416735 - DNA, 14 bp, Homo sapiens
aaactgctttattt

SEQ ID NO: 3416736 - DNA, 11 bp, Homo sapiens
aaactggttta

SEQ ID NO: 3416737 - DNA, 14 bp, Homo sapiens
aaactgtaaaaaat

SEQ ID NO: 3416738 - DNA, 21 bp, Homo sapiens
aaactgtaaaaaatgtgtgta

SEQ ID NO: 3416739 - DNA, 12 bp, Homo sapiens
aaacttttcatt

SEQ ID NO: 3416740 - DNA, 14 bp, Homo sapiens
aaagagaatgtatt

SEQ ID NO: 3416741 - DNA, 22 bp, Homo sapiens
aaagagacaaactgtaaaaaat

SEQ ID NO: 3416742 - DNA, 14 bp, Homo sapiens
aaagagactgggcc

SEQ ID NO: 3416743 - DNA, 13 bp, Homo sapiens
aaagagagaatgt

SEQ ID NO: 3416744 - DNA, 20 bp, Homo sapiens
aaagaggctgaaagaggcca

SEQ ID NO: 3416745 - DNA, 20 bp, Homo sapiens
aaagatattttatttctgat

SEQ ID NO: 3416746 - DNA, 16 bp, Homo sapiens
aaagcaagatctacta

SEQ ID NO: 3416747 - DNA, 23 bp, Homo sapiens
aaagcaagatctactacatccca

SEQ ID NO: 3416748 - DNA, 19 bp, Homo sapiens
aaagcacatgccagggaaa

SEQ ID NO: 3416749 - DNA, 13 bp, Homo sapiens
aaagcctcagtga

SEQ ID NO: 3416750 - DNA, 20 bp, Homo sapiens
aaagctactgaatttattgc

SEQ ID NO: 3416751 - DNA, 17 bp, Homo sapiens
aaagctattagccagga

SEQ ID NO: 3416752 - DNA, 20 bp, Homo sapiens
aaagctattagccaggatca

SEQ ID NO: 3416753 - DNA, 16 bp, Homo sapiens
aaagctgtgtctctgt

SEQ ID NO: 3416754 - DNA, 19 bp, Homo sapiens
aaagctgtgtctctgtata

SEQ ID NO: 3416755 - DNA, 19 bp, Homo sapiens
aaagcttgatttgatcttt

SEQ ID NO: 3416756 - DNA, 21 bp, Homo sapiens
aaagcttgatttgatctttgt

SEQ ID NO: 3416757 - DNA, 22 bp, Homo sapiens
aaagcttgatttgatctttgtt

SEQ ID NO: 3416758 - DNA, 16 bp, Homo sapiens
aaagctttatctttgt

SEQ ID NO: 3416759 - DNA, 19 bp, Homo sapiens
aaaggaaaaatttttttgt

SEQ ID NO: 3416760 - DNA, 12 bp, Homo sapiens
aaaggaagacta

SEQ ID NO: 3416761 - DNA, 15 bp, Homo sapiens
aaaggactctggggt

SEQ ID NO: 3416762 - DNA, 20 bp, Homo sapiens
aaaggagcctaggccaggtg

SEQ ID NO: 3416763 - DNA, 12 bp, Homo sapiens
aaagtaaacttg

SEQ ID NO: 3416764 - DNA, 20 bp, Homo sapiens
aaagtataaattcgctgtga

SEQ ID NO: 3416765 - DNA, 14 bp, Homo sapiens
aaagtatatgttag

SEQ ID NO: 3416766 - DNA, 15 bp, Homo sapiens
aaagtatgcaaaata

SEQ ID NO: 3416767 - DNA, 20 bp, Homo sapiens
aaagtatgcaaaataaagaa

SEQ ID NO: 3416768 - DNA, 14 bp, Homo sapiens
aaagtgacagatgt

SEQ ID NO: 3416769 - DNA, 23 bp, Homo sapiens
aaagtgacagatgttatttttgt

SEQ ID NO: 3416770 - DNA, 13 bp, Homo sapiens
aaagtgcattatt

SEQ ID NO: 3416771 - DNA, 15 bp, Homo sapiens
aaagtgcattatttt

SEQ ID NO: 3416772 - DNA, 14 bp, Homo sapiens
aaagtgctgcggag

SEQ ID NO: 3416773 - DNA, 23 bp, Homo sapiens
aaagtgtttatgacaaatttagc

SEQ ID NO: 3416774 - DNA, 16 bp, Homo sapiens
aaagttccagttttgt

SEQ ID NO: 3416775 - DNA, 15 bp, Homo sapiens
aaagttgcttttatt

SEQ ID NO: 3416776 - DNA, 17 bp, Homo sapiens
agtctacccgacataag

SEQ ID NO: 3416777 - DNA, 17 bp, Homo sapiens
agtctcaattttgtatt

SEQ ID NO: 3416778 - DNA, 21 bp, Homo sapiens
agtctcaattttgtatttaat

SEQ ID NO: 3416779 - DNA, 19 bp, Homo sapiens
agtctgaggcacctgcata

SEQ ID NO: 3416780 - DNA, 22 bp, Homo sapiens
agtctgattataccatgtgtgc

SEQ ID NO: 3416781 - DNA, 14 bp, Homo sapiens
agtgaaagcatcac

SEQ ID NO: 3416782 - DNA, 15 bp, Homo sapiens
agtgaacagtttgga

SEQ ID NO: 3416783 - DNA, 14 bp, Homo sapiens
agtgaggatgtctg

SEQ ID NO: 3416784 - DNA, 16 bp, Homo sapiens
agtgagtgccatgctt

SEQ ID NO: 3416785 - DNA, 20 bp, Homo sapiens
agtgatagagctaaccctta

SEQ ID NO: 3416786 - DNA, 20 bp, Homo sapiens
agtgatctcgactcccccct

SEQ ID NO: 3416787 - DNA, 14 bp, Homo sapiens
agtgcaagattttt

SEQ ID NO: 3416788 - DNA, 23 bp, Homo sapiens
agtgcacttaatattagcttgct

SEQ ID NO: 3416789 - DNA, 14 bp, Homo sapiens
agtgcccctgtccc

SEQ ID NO: 3416790 - DNA, 18 bp, Homo sapiens
agtgcgtgtgtagagtta

SEQ ID NO: 3416791 - DNA, 22 bp, Homo sapiens
agtgcgtgtgtagagttaagaa

SEQ ID NO: 3416792 - DNA, 16 bp, Homo sapiens
agtgcttaaaaatcat

SEQ ID NO: 3416793 - DNA, 13 bp, Homo sapiens
agtgcttcttgta

SEQ ID NO: 3416794 - DNA, 22 bp, Homo sapiens
agtgcttcttgtaatatttctt

SEQ ID NO: 3416795 - DNA, 22 bp, Homo sapiens
agtggaaagacagcttctcatc

SEQ ID NO: 3416796 - DNA, 19 bp, Homo sapiens
agtggcttcactcctgctg

SEQ ID NO: 3416797 - DNA, 17 bp, Homo sapiens
agtgggagatgaaaacc

SEQ ID NO: 3416798 - DNA, 19 bp, Homo sapiens
agtggtctttgtaagagtg

SEQ ID NO: 3416799 - DNA, 22 bp, Homo sapiens
agtggtctttgtaagagtgtag

SEQ ID NO: 3416800 - DNA, 13 bp, Homo sapiens
agtgtagaagcat

SEQ ID NO: 3416801 - DNA, 15 bp, Homo sapiens
agtgtagaagcattc

SEQ ID NO: 3416802 - DNA, 17 bp, Homo sapiens
agtgtagaagcattcct

SEQ ID NO: 3416803 - DNA, 19 bp, Homo sapiens
agtgtcctatgcaataaaa

SEQ ID NO: 3416804 - DNA, 17 bp, Homo sapiens
agtgtcgggaattttcc

SEQ ID NO: 3416805 - DNA, 14 bp, Homo sapiens
agtgtggccaggct

SEQ ID NO: 3416806 - DNA, 23 bp, Homo sapiens
agtgttggtttaatattacctaa

SEQ ID NO: 3416807 - DNA, 12 bp, Homo sapiens
agtgtttgtgag

SEQ ID NO: 3416808 - DNA, 22 bp, Homo sapiens
agttaaataaatagaaagagtt

SEQ ID NO: 3416809 - DNA, 16 bp, Homo sapiens
agttaaggtatctggt

SEQ ID NO: 3416810 - DNA, 17 bp, Homo sapiens
agttagggaatggcaca

SEQ ID NO: 3416811 - DNA, 15 bp, Homo sapiens
agttagtttctcata

SEQ ID NO: 3416812 - DNA, 18 bp, Homo sapiens
agttataagcgtatttag

SEQ ID NO: 3416813 - DNA, 18 bp, Homo sapiens
agttcataaatttatggt

SEQ ID NO: 3416814 - DNA, 21 bp, Homo sapiens
agttcataaatttgttgtcat

SEQ ID NO: 3416815 - DNA, 18 bp, Homo sapiens
agttccagttttgttttg

SEQ ID NO: 3416816 - DNA, 14 bp, Homo sapiens
agttcccaaatgtg

SEQ ID NO: 3416817 - DNA, 21 bp, Homo sapiens
agttctatggagactttgctg

SEQ ID NO: 3416818 - DNA, 23 bp, Homo sapiens
agttctatggagactttgctgtt

SEQ ID NO: 3416819 - DNA, 17 bp, Homo sapiens
agttgatattcaaggct

SEQ ID NO: 3416820 - DNA, 17 bp, Homo sapiens
agttggccaaaacttaa

SEQ ID NO: 3416821 - DNA, 15 bp, Homo sapiens
agttggtcttacttt

SEQ ID NO: 3416822 - DNA, 22 bp, Homo sapiens
agttggtcttactttgtgcaaa

SEQ ID NO: 3416823 - DNA, 14 bp, Homo sapiens
agttgtatctcttt

SEQ ID NO: 3416824 - DNA, 15 bp, Homo sapiens
agttgtatctctttt

SEQ ID NO: 3416825 - DNA, 16 bp, Homo sapiens
agttgtatctcttttg

SEQ ID NO: 3416826 - DNA, 22 bp, Homo sapiens
agttgtatctcttttgaatcca

SEQ ID NO: 3416827 - DNA, 12 bp, Homo sapiens
agttgtattttg

SEQ ID NO: 3416828 - DNA, 18 bp, Homo sapiens
agttgtattttgtacatt

SEQ ID NO: 3416829 - DNA, 18 bp, Homo sapiens
agttgtccagatcactga

SEQ ID NO: 3416830 - DNA, 21 bp, Homo sapiens
agtttaagggtggaaaaatgc

SEQ ID NO: 3416831 - DNA, 18 bp, Homo sapiens
agtttatagtcacccggg

SEQ ID NO: 3416832 - DNA, 15 bp, Homo sapiens
agtttattaaatctg

SEQ ID NO: 3416833 - DNA, 17 bp, Homo sapiens
agtttcactgccatata

SEQ ID NO: 3416834 - DNA, 11 bp, Homo sapiens
agtttcaggtg

SEQ ID NO: 3416835 - DNA, 16 bp, Homo sapiens
agtttcatgtatgtat

SEQ ID NO: 3416836 - DNA, 19 bp, Homo sapiens
agtttcatgtatgtatata

SEQ ID NO: 3416837 - DNA, 15 bp, Homo sapiens
agtttcttagctttt

SEQ ID NO: 3416838 - DNA, 17 bp, Homo sapiens
agtttcttagcttttta

SEQ ID NO: 3416839 - DNA, 19 bp, Homo sapiens
agtttgatcatagaattgt

SEQ ID NO: 3416840 - DNA, 16 bp, Homo sapiens
agtttgatgaggccct

SEQ ID NO: 3416841 - DNA, 17 bp, Homo sapiens
agtttgatgaggccctc

SEQ ID NO: 3416842 - DNA, 21 bp, Homo sapiens
agtttgctgttttaaattgca

SEQ ID NO: 3416843 - DNA, 19 bp, Homo sapiens
agtttggttaatcagtgtt

SEQ ID NO: 3416844 - DNA, 15 bp, Homo sapiens
agttttactcttaaa

SEQ ID NO: 3416845 - DNA, 22 bp, Homo sapiens
agttttactcttaaatcatttg

SEQ ID NO: 3416846 - DNA, 23 bp, Homo sapiens
agttttactcttaaatcatttgg

SEQ ID NO: 3416847 - DNA, 12 bp, Homo sapiens
agttttgaaaag

SEQ ID NO: 3416848 - DNA, 17 bp, Homo sapiens
agttttgaaaagctatt

SEQ ID NO: 3416849 - DNA, 19 bp, Homo sapiens
agttttgctttgttgaata

SEQ ID NO: 3416850 - DNA, 15 bp, Homo sapiens
agtttttttatttct

SEQ ID NO: 3416851 - DNA, 17 bp, Homo sapiens
agtttttttttttccag

SEQ ID NO: 3416852 - DNA, 16 bp, Homo sapiens
ataaaaagagatgaaa

SEQ ID NO: 3416853 - DNA, 15 bp, Homo sapiens
ataaaaataaatcta

SEQ ID NO: 3416854 - DNA, 16 bp, Homo sapiens
ataaaaatatatgttg

SEQ ID NO: 3416855 - DNA, 19 bp, Homo sapiens
ataaaccttgtcaataaaa

SEQ ID NO: 3416856 - DNA, 12 bp, Homo sapiens
ataaagctactg

SEQ ID NO: 3416857 - DNA, 16 bp, Homo sapiens
ataaagctactgaatt

SEQ ID NO: 3416858 - DNA, 17 bp, Homo sapiens
ataaagctactgaattt

SEQ ID NO: 3416859 - DNA, 13 bp, Homo sapiens
ataaagggaacat

SEQ ID NO: 3416860 - DNA, 23 bp, Homo sapiens
ataaagtgctgcggagcaagagg

SEQ ID NO: 3416861 - DNA, 22 bp, Homo sapiens
ataaagtttttttatttctttt

SEQ ID NO: 3416862 - DNA, 17 bp, Homo sapiens
ataaatatagttgtctt

SEQ ID NO: 3416863 - DNA, 13 bp, Homo sapiens
ataaatatgcagt

SEQ ID NO: 3416864 - DNA, 20 bp, Homo sapiens
ataaatatttatgtagatgt

SEQ ID NO: 3416865 - DNA, 16 bp, Homo sapiens
ataacaatgttaagga

SEQ ID NO: 3416866 - DNA, 14 bp, Homo sapiens
ataacagctttctt

SEQ ID NO: 3416867 - DNA, 14 bp, Homo sapiens
ataacattacctta

SEQ ID NO: 3416868 - DNA, 19 bp, Homo sapiens
ataacattaccttactgtg

SEQ ID NO: 3416869 - DNA, 20 bp, Homo sapiens
ataacattgattttaaaaat

SEQ ID NO: 3416870 - DNA, 17 bp, Homo sapiens
ataacattttgtttatg

SEQ ID NO: 3416871 - DNA, 18 bp, Homo sapiens
ataacattttgtttatgt

SEQ ID NO: 3416872 - DNA, 22 bp, Homo sapiens
ataacattttgtttatgttact

SEQ ID NO: 3416873 - DNA, 15 bp, Homo sapiens
ataacctataaagtg

SEQ ID NO: 3416874 - DNA, 17 bp, Homo sapiens
ataacgtttttccttta

SEQ ID NO: 3416875 - DNA, 18 bp, Homo sapiens
ataacgtttttcctttaa

SEQ ID NO: 3416876 - DNA, 17 bp, Homo sapiens
ataactgtgatgaaata

SEQ ID NO: 3416877 - DNA, 20 bp, Homo sapiens
ataactgtgatgaaatatga

SEQ ID NO: 3416878 - DNA, 14 bp, Homo sapiens
ataagacataacgt

SEQ ID NO: 3416879 - DNA, 20 bp, Homo sapiens
ataagtctacattaaacaat

SEQ ID NO: 3416880 - DNA, 12 bp, Homo sapiens
ataataaatgca

SEQ ID NO: 3416881 - DNA, 20 bp, Homo sapiens
ataataaatgcatagagcaa

SEQ ID NO: 3416882 - DNA, 14 bp, Homo sapiens
ataatataaaatgt

SEQ ID NO: 3416883 - DNA, 23 bp, Homo sapiens
ataatatacttttacattaaaga

SEQ ID NO: 3416884 - DNA, 13 bp, Homo sapiens
ataatgatttcct

SEQ ID NO: 3416885 - DNA, 15 bp, Homo sapiens
ataatgccagaatat

SEQ ID NO: 3416886 - DNA, 12 bp, Homo sapiens
ataatgctttct

SEQ ID NO: 3416887 - DNA, 19 bp, Homo sapiens
ataatgtctctgtgagact

SEQ ID NO: 3416888 - DNA, 15 bp, Homo sapiens
ataatgtgtctgtgt

SEQ ID NO: 3416889 - DNA, 19 bp, Homo sapiens
agtataaattcgctgtgag

SEQ ID NO: 3416890 - DNA, 20 bp, Homo sapiens
agtataatctcctctgctca

SEQ ID NO: 3416891 - DNA, 18 bp, Homo sapiens
agtatatgaaatattttg

SEQ ID NO: 3416892 - DNA, 14 bp, Homo sapiens
agtatccttcattg

SEQ ID NO: 3416893 - DNA, 15 bp, Homo sapiens
agtatccttcattgt

SEQ ID NO: 3416894 - DNA, 13 bp, Homo sapiens
agtatgcaaaata

SEQ ID NO: 3416895 - DNA, 12 bp, Homo sapiens
agtatgtgcata

SEQ ID NO: 3416896 - DNA, 20 bp, Homo sapiens
agtattaactctgtaaaagt

SEQ ID NO: 3416897 - DNA, 16 bp, Homo sapiens
agtatttagtatatga

SEQ ID NO: 3416898 - DNA, 21 bp, Homo sapiens
agtattttccagccttatgtg

SEQ ID NO: 3416899 - DNA, 16 bp, Homo sapiens
agtcaaagagagtttt

SEQ ID NO: 3416900 - DNA, 23 bp, Homo sapiens
agtcaaagagagtttttaataga

SEQ ID NO: 3416901 - DNA, 14 bp, Homo sapiens
agtcagtttctaca

SEQ ID NO: 3416902 - DNA, 13 bp, Homo sapiens
agtcatgcataaa

SEQ ID NO: 3416903 - DNA, 20 bp, Homo sapiens
agtcatgcataaatatgcag

SEQ ID NO: 3416904 - DNA, 22 bp, Homo sapiens
agtcatgcataaatatgcagtg

SEQ ID NO: 3416905 - DNA, 23 bp, Homo sapiens
agtcatgtactggagagtggcaa

SEQ ID NO: 3416906 - DNA, 15 bp, Homo sapiens
agtcatgtgagcctc

SEQ ID NO: 3416907 - DNA, 21 bp, Homo sapiens
agtccatatttcaatttccaa

SEQ ID NO: 3416908 - DNA, 23 bp, Homo sapiens
agtccatatttcaatttccaaga

SEQ ID NO: 3416909 - DNA, 13 bp, Homo sapiens
agtccccagagaa

SEQ ID NO: 3416910 - DNA, 19 bp, Homo sapiens
agtcctgctttcctatcta

SEQ ID NO: 3416911 - DNA, 14 bp, Homo sapiens
actgcctgaataaa

SEQ ID NO: 3416912 - DNA, 22 bp, Homo sapiens
actgctgcgtcattacagggca

SEQ ID NO: 3416913 - DNA, 17 bp, Homo sapiens
actgctgtgtccgcttt

SEQ ID NO: 3416914 - DNA, 22 bp, Homo sapiens
actgctgtgtccgctttcatga

SEQ ID NO: 3416915 - DNA, 15 bp, Homo sapiens
actgcttctctttgt

SEQ ID NO: 3416916 - DNA, 21 bp, Homo sapiens
actgcttctctttgtgcagtg

SEQ ID NO: 3416917 - DNA, 16 bp, Homo sapiens
actgcttgtgttttta

SEQ ID NO: 3416918 - DNA, 18 bp, Homo sapiens
actgcttgtgtttttaac

SEQ ID NO: 3416919 - DNA, 20 bp, Homo sapiens
actgcttttgcccatataaa

SEQ ID NO: 3416920 - DNA, 19 bp, Homo sapiens
actgggcctaggccaggag

SEQ ID NO: 3416921 - DNA, 13 bp, Homo sapiens
actggtttataat

SEQ ID NO: 3416922 - DNA, 18 bp, Homo sapiens
actggtttataataaact

SEQ ID NO: 3416923 - DNA, 12 bp, Homo sapiens
actgtaaaatag

SEQ ID NO: 3416924 - DNA, 21 bp, Homo sapiens
actgtataaataggagaggat

SEQ ID NO: 3416925 - DNA, 14 bp, Homo sapiens
aggaattttaaaaa

SEQ ID NO: 3416926 - DNA, 18 bp, Homo sapiens
aggaatttttttcagtat

SEQ ID NO: 3416927 - DNA, 22 bp, Homo sapiens
aggaatttttttcagtattatt

SEQ ID NO: 3416928 - DNA, 11 bp, Homo sapiens
aggacaaacag

SEQ ID NO: 3416929 - DNA, 15 bp, Homo sapiens
aggacaaacagtgaa

SEQ ID NO: 3416930 - DNA, 20 bp, Homo sapiens
aggacagctttgataatgtc

SEQ ID NO: 3416931 - DNA, 13 bp, Homo sapiens
aggactctgcagc

SEQ ID NO: 3416932 - DNA, 17 bp, Homo sapiens
aggactctgcagcctca

SEQ ID NO: 3416933 - DNA, 14 bp, Homo sapiens
aggagacccacagg

SEQ ID NO: 3416934 - DNA, 13 bp, Homo sapiens
aggagaggatgag

SEQ ID NO: 3416935 - DNA, 15 bp, Homo sapiens
aggagaggatgagag

SEQ ID NO: 3416936 - DNA, 19 bp, Homo sapiens
aggagaggatgagagccca

SEQ ID NO: 3416937 - DNA, 13 bp, Homo sapiens
aggagcccaggcc

SEQ ID NO: 3416938 - DNA, 17 bp, Homo sapiens
aggagctcccctcccca

SEQ ID NO: 3416939 - DNA, 21 bp, Homo sapiens
aggagctcccctccccaactg

SEQ ID NO: 3416940 - DNA, 12 bp, Homo sapiens
aggagctgcctg

SEQ ID NO: 3416941 - DNA, 11 bp, Homo sapiens
aggaggagaaa

SEQ ID NO: 3416942 - DNA, 12 bp, Homo sapiens
ataatgttaaat

SEQ ID NO: 3416943 - DNA, 16 bp, Homo sapiens
ataatgttaaatttgt

SEQ ID NO: 3416944 - DNA, 15 bp, Homo sapiens
ataatttgtcttagt

SEQ ID NO: 3416945 - DNA, 18 bp, Homo sapiens
atacagtattcccactct

SEQ ID NO: 3416946 - DNA, 24 bp, Homo sapiens
atacagtcattatttaaagcacat

SEQ ID NO: 3416947 - DNA, 15 bp, Homo sapiens
atacattttgaaaat

SEQ ID NO: 3416948 - DNA, 20 bp, Homo sapiens
ataccaagggggtaaaaaaa

SEQ ID NO: 3416949 - DNA, 22 bp, Homo sapiens
atacccaacagtttatttttat

SEQ ID NO: 3416950 - DNA, 15 bp, Homo sapiens
ataccccatttgatt

SEQ ID NO: 3416951 - DNA, 19 bp, Homo sapiens
atacctcaggaaagaatag

SEQ ID NO: 3416952 - DNA, 14 bp, Homo sapiens
atactcaagcaggt

SEQ ID NO: 3416953 - DNA, 22 bp, Homo sapiens
atactcttaagtgtaaataata

SEQ ID NO: 3416954 - DNA, 12 bp, Homo sapiens
atactggcatgc

SEQ ID NO: 3416955 - DNA, 22 bp, Homo sapiens
atactgttgatccatctcagtc

SEQ ID NO: 3416956 - DNA, 24 bp, Homo sapiens
atactgttgatccatctcagtcac

SEQ ID NO: 3416957 - DNA, 16 bp, Homo sapiens
atacttttaatcaagt

SEQ ID NO: 3416958 - DNA, 15 bp, Homo sapiens
atagaactctgggct

SEQ ID NO: 3416959 - DNA, 14 bp, Homo sapiens
atagagatatttaa

SEQ ID NO: 3416960 - DNA, 18 bp, Homo sapiens
atagaggtgatgctgcta

SEQ ID NO: 3416961 - DNA, 17 bp, Homo sapiens
atagagtaatgatgtaa

SEQ ID NO: 3416962 - DNA, 12 bp, Homo sapiens
atagatgtgtgg

SEQ ID NO: 3416963 - DNA, 21 bp, Homo sapiens
atagatttgaagatctgattt

SEQ ID NO: 3416964 - DNA, 21 bp, Homo sapiens
atagctagctatttctatgta

SEQ ID NO: 3416965 - DNA, 22 bp, Homo sapiens
atagctagctatttctatgtat

SEQ ID NO: 3416966 - DNA, 14 bp, Homo sapiens
ataggagaggatga

SEQ ID NO: 3416967 - DNA, 23 bp, Homo sapiens
ataggagaggatgagagcccaga

SEQ ID NO: 3416968 - DNA, 20 bp, Homo sapiens
atagggtccttgaaacagaa

SEQ ID NO: 3416969 - DNA, 22 bp, Homo sapiens
ataggttttaaacgacttttgt

SEQ ID NO: 3416970 - DNA, 17 bp, Homo sapiens
atagtagaaagacatct

SEQ ID NO: 3416971 - DNA, 14 bp, Homo sapiens
atagtcaaagagag

SEQ ID NO: 3416972 - DNA, 18 bp, Homo sapiens
atagtgcttcttgtaata

SEQ ID NO: 3416973 - DNA, 16 bp, Homo sapiens
atagtgtaaacaaata

SEQ ID NO: 3416974 - DNA, 20 bp, Homo sapiens
atagtgtcctatgcaataaa

SEQ ID NO: 3416975 - DNA, 12 bp, Homo sapiens
atagttgctttt

SEQ ID NO: 3416976 - DNA, 21 bp, Homo sapiens
atagttgcttttgaaggaata

SEQ ID NO: 3416977 - DNA, 13 bp, Homo sapiens
atagttgtatttt

SEQ ID NO: 3416978 - DNA, 19 bp, Homo sapiens
atagttgtattttgtacat

SEQ ID NO: 3416979 - DNA, 19 bp, Homo sapiens
atagttgtctttctttgct

SEQ ID NO: 3416980 - DNA, 19 bp, Homo sapiens
atataaaagatcttgcaga

SEQ ID NO: 3416981 - DNA, 16 bp, Homo sapiens
atataaaatgctgata

SEQ ID NO: 3416982 - DNA, 18 bp, Homo sapiens
atataaaatgctgatatt

SEQ ID NO: 3416983 - DNA, 15 bp, Homo sapiens
atataaaatgtttca

SEQ ID NO: 3416984 - DNA, 15 bp, Homo sapiens
atataaacactatat

SEQ ID NO: 3416985 - DNA, 23 bp, Homo sapiens
atataaagtttttttatttcttt

SEQ ID NO: 3416986 - DNA, 21 bp, Homo sapiens
atataaatatatgtatacata

SEQ ID NO: 3416987 - DNA, 22 bp, Homo sapiens
atataagtcttggtaacaaata

SEQ ID NO: 3416988 - DNA, 16 bp, Homo sapiens
atataatcatgctcat

SEQ ID NO: 3416989 - DNA, 14 bp, Homo sapiens
atatacaagctaca

SEQ ID NO: 3416990 - DNA, 14 bp, Homo sapiens
atatactatatgaa

SEQ ID NO: 3416991 - DNA, 20 bp, Homo sapiens
atatagctctacacaacatg

SEQ ID NO: 3416992 - DNA, 21 bp, Homo sapiens
atatagctctacacaacatgt

SEQ ID NO: 3416993 - DNA, 13 bp, Homo sapiens
atatagctggcaa

SEQ ID NO: 3416994 - DNA, 13 bp, Homo sapiens
atatatattttaa

SEQ ID NO: 3416995 - DNA, 12 bp, Homo sapiens
atatatgctgta

SEQ ID NO: 3416996 - DNA, 13 bp, Homo sapiens
atatatgctgtat

SEQ ID NO: 3416997 - DNA, 20 bp, Homo sapiens
atatattgaaagttgctttt

SEQ ID NO: 3416998 - DNA, 14 bp, Homo sapiens
atatcaaaaggaag

SEQ ID NO: 3416999 - DNA, 13 bp, Homo sapiens
atatcctgagcca

SEQ ID NO: 3417000 - DNA, 15 bp, Homo sapiens
atatcttgtatggtt

SEQ ID NO: 3417001 - DNA, 21 bp, Homo sapiens
atatcttgttattaatgtttc

SEQ ID NO: 3417002 - DNA, 23 bp, Homo sapiens
atatgaaactcatctgtaaactt

SEQ ID NO: 3417003 - DNA, 17 bp, Homo sapiens
atatgaaatattttgaa

SEQ ID NO: 3417004 - DNA, 18 bp, Homo sapiens
atatgacggaagaacata

SEQ ID NO: 3417005 - DNA, 13 bp, Homo sapiens
atatgagaagaat

SEQ ID NO: 3417006 - DNA, 14 bp, Homo sapiens
atatgattggttca

SEQ ID NO: 3417007 - DNA, 19 bp, Homo sapiens
atatgctgtatttctttgt

SEQ ID NO: 3417008 - DNA, 12 bp, Homo sapiens
atatggcagaag

SEQ ID NO: 3417009 - DNA, 16 bp, Homo sapiens
atatggcctcaagatc

SEQ ID NO: 3417010 - DNA, 14 bp, Homo sapiens
atatgtgagaaatc

SEQ ID NO: 3417011 - DNA, 23 bp, Homo sapiens
atatgttaccattaatcagaaac

SEQ ID NO: 3417012 - DNA, 14 bp, Homo sapiens
atattaagaaacaa

SEQ ID NO: 3417013 - DNA, 18 bp, Homo sapiens
atattaagaaacaattta

SEQ ID NO: 3417014 - DNA, 15 bp, Homo sapiens
atattaggaaaatat

SEQ ID NO: 3417015 - DNA, 13 bp, Homo sapiens
atattatataagg

SEQ ID NO: 3417016 - DNA, 16 bp, Homo sapiens
atattatataaggaca

SEQ ID NO: 3417017 - DNA, 20 bp, Homo sapiens
atattcatcaaataaacctt

SEQ ID NO: 3417018 - DNA, 20 bp, Homo sapiens
atattctgataatgtattgc

SEQ ID NO: 3417019 - DNA, 21 bp, Homo sapiens
atattgaaagttgcttttatt

SEQ ID NO: 3417020 - DNA, 18 bp, Homo sapiens
atattgaccatgtgatta

SEQ ID NO: 3417021 - DNA, 19 bp, Homo sapiens
atattgaccatgtgattat

SEQ ID NO: 3417022 - DNA, 20 bp, Homo sapiens
atattggtttgttattcttt

SEQ ID NO: 3417023 - DNA, 17 bp, Homo sapiens
tataaaatgctgatatt

SEQ ID NO: 3417024 - DNA, 21 bp, Homo sapiens
tataaaatgctgatatttact

SEQ ID NO: 3417025 - DNA, 22 bp, Homo sapiens
tataaacatgcttgcattatat

SEQ ID NO: 3417026 - DNA, 20 bp, Homo sapiens
tataaagtgtttatgacaaa

SEQ ID NO: 3417027 - DNA, 13 bp, Homo sapiens
tataaataggaga

SEQ ID NO: 3417028 - DNA, 14 bp, Homo sapiens
tataaatataaata

SEQ ID NO: 3417029 - DNA, 15 bp, Homo sapiens
tataacaaactatgt

SEQ ID NO: 3417030 - DNA, 17 bp, Homo sapiens
tataacaaactatgtaa

SEQ ID NO: 3417031 - DNA, 20 bp, Homo sapiens
tataagcgtatttagactgt

SEQ ID NO: 3417032 - DNA, 15 bp, Homo sapiens
tataaggtaatgtag

SEQ ID NO: 3417033 - DNA, 19 bp, Homo sapiens
tataagtcttggtaacaaa

SEQ ID NO: 3417034 - DNA, 20 bp, Homo sapiens
tataagtcttggtaacaaat

SEQ ID NO: 3417035 - DNA, 22 bp, Homo sapiens
tataatatttttaattaaataa

SEQ ID NO: 3417036 - DNA, 20 bp, Homo sapiens
tataatcatgctcatgtata

SEQ ID NO: 3417037 - DNA, 23 bp, Homo sapiens
tataatcatgctcatgtatattt

SEQ ID NO: 3417038 - DNA, 18 bp, Homo sapiens
tataatctcctctgctca

SEQ ID NO: 3417039 - DNA, 13 bp, Homo sapiens
tatacatacagag

SEQ ID NO: 3417040 - DNA, 14 bp, Homo sapiens
tatacatacagaga

SEQ ID NO: 3417041 - DNA, 13 bp, Homo sapiens
tatacattttgaa

SEQ ID NO: 3417042 - DNA, 19 bp, Homo sapiens
tatacctgccttttaagtt

SEQ ID NO: 3417043 - DNA, 23 bp, Homo sapiens
tatactggcatgctaaagccttc

SEQ ID NO: 3417044 - DNA, 13 bp, Homo sapiens
tatagaaaatctt

SEQ ID NO: 3417045 - DNA, 15 bp, Homo sapiens
tatagatagataatg

SEQ ID NO: 3417046 - DNA, 14 bp, Homo sapiens
tatagatggccaaa

SEQ ID NO: 3417047 - DNA, 22 bp, Homo sapiens
tatagctagctatttctatgta

SEQ ID NO: 3417048 - DNA, 19 bp, Homo sapiens
tatagctctacacaacatg

SEQ ID NO: 3417049 - DNA, 18 bp, Homo sapiens
tatagctggcaagaatgg

SEQ ID NO: 3417050 - DNA, 21 bp, Homo sapiens
tatagtagaaagacatctgcc

SEQ ID NO: 3417051 - DNA, 24 bp, Homo sapiens
tatagtagaaagacatctgcctgt

SEQ ID NO: 3417052 - DNA, 13 bp, Homo sapiens
tatagttgctttt

SEQ ID NO: 3417053 - DNA, 19 bp, Homo sapiens
tatagttgtctttctttgc

SEQ ID NO: 3417054 - DNA, 17 bp, Homo sapiens
tatataaggtaatgtag

SEQ ID NO: 3417055 - DNA, 21 bp, Homo sapiens
tatataaggtcatagattctt

SEQ ID NO: 3417056 - DNA, 20 bp, Homo sapiens
tatatagctggcaagaatgg

SEQ ID NO: 3417057 - DNA, 15 bp, Homo sapiens
tatatgaaatatttt

SEQ ID NO: 3417058 - DNA, 14 bp, Homo sapiens
tatatgagaagaat

SEQ ID NO: 3417059 - DNA, 15 bp, Homo sapiens
tatatgagaagaata

SEQ ID NO: 3417060 - DNA, 15 bp, Homo sapiens
tatatggcatttgca

SEQ ID NO: 3417061 - DNA, 14 bp, Homo sapiens
tatatgtatacata

SEQ ID NO: 3417062 - DNA, 14 bp, Homo sapiens
tatatgtgagaaat

SEQ ID NO: 3417063 - DNA, 20 bp, Homo sapiens
tatatgttgaatgttaacag

SEQ ID NO: 3417064 - DNA, 23 bp, Homo sapiens
tatatgttgaatgttaacaggta

SEQ ID NO: 3417065 - DNA, 23 bp, Homo sapiens
tatattcatcaaataaaccttgt

SEQ ID NO: 3417066 - DNA, 23 bp, Homo sapiens
tatatttagctccaaaccttcac

SEQ ID NO: 3417067 - DNA, 21 bp, Homo sapiens
tatcaccaggatttatacata

SEQ ID NO: 3417068 - DNA, 14 bp, Homo sapiens
tatcagcacgtgtg

SEQ ID NO: 3417069 - DNA, 19 bp, Homo sapiens
tatcattcatcttcttctt

SEQ ID NO: 3417070 - DNA, 13 bp, Homo sapiens
tatcctgagccat

SEQ ID NO: 3417071 - DNA, 13 bp, Homo sapiens
tatccttcattgt

SEQ ID NO: 3417072 - DNA, 13 bp, Homo sapiens
tatctaatgacat

SEQ ID NO: 3417073 - DNA, 14 bp, Homo sapiens
tatctaatgacatg

SEQ ID NO: 3417074 - DNA, 23 bp, Homo sapiens
tatctatacctgccttttaagtt

SEQ ID NO: 3417075 - DNA, 22 bp, Homo sapiens
tatctcttttgaatccatgctt

SEQ ID NO: 3417076 - DNA, 14 bp, Homo sapiens
tatctgaacattta

SEQ ID NO: 3417077 - DNA, 19 bp, Homo sapiens
tatctgaacatttactaca

SEQ ID NO: 3417078 - DNA, 21 bp, Homo sapiens
tatctgcaatgtttttgtgta

SEQ ID NO: 3417079 - DNA, 23 bp, Homo sapiens
tatctgcaatgtttttgtgtaga

SEQ ID NO: 3417080 - DNA, 16 bp, Homo sapiens
tatctggaatgagcct

SEQ ID NO: 3417081 - DNA, 11 bp, Homo sapiens
tatctggtatc

SEQ ID NO: 3417082 - DNA, 23 bp, Homo sapiens
tatctgtggattcagcttctgtt

SEQ ID NO: 3417083 - DNA, 19 bp, Homo sapiens
tatcttacaactcccccac

SEQ ID NO: 3417084 - DNA, 19 bp, Homo sapiens
tatcttgtatggtttgcaa

SEQ ID NO: 3417085 - DNA, 21 bp, Homo sapiens
tatcttgttattaatgtttct

SEQ ID NO: 3417086 - DNA, 19 bp, Homo sapiens
tatgaaactcatctgtaaa

SEQ ID NO: 3417087 - DNA, 15 bp, Homo sapiens
tatgaaactggttta

SEQ ID NO: 3417088 - DNA, 22 bp, Homo sapiens
tatgaaactggtttataataaa

SEQ ID NO: 3417089 - DNA, 15 bp, Homo sapiens
tatgaaatattttga

SEQ ID NO: 3417090 - DNA, 15 bp, Homo sapiens
tatgaagaagagagt

SEQ ID NO: 3417091 - DNA, 16 bp, Homo sapiens
tatgacggaagaacat

SEQ ID NO: 3417092 - DNA, 12 bp, Homo sapiens
tatgactaaaga

SEQ ID NO: 3417093 - DNA, 15 bp, Homo sapiens
tatgactaaagagag

SEQ ID NO: 3417094 - DNA, 21 bp, Homo sapiens
tatgagaagtactttgtgctg

SEQ ID NO: 3417095 - DNA, 15 bp, Homo sapiens
tatgagacacaggat

SEQ ID NO: 3417096 - DNA, 14 bp, Homo sapiens
tatgagatttactg

SEQ ID NO: 3417097 - DNA, 17 bp, Homo sapiens
tatgagccagacaaatg

SEQ ID NO: 3417098 - DNA, 19 bp, Homo sapiens
tatgagccagacaaatgga

SEQ ID NO: 3417099 - DNA, 21 bp, Homo sapiens
tatgatggaacagtgaaagtc

SEQ ID NO: 3417100 - DNA, 19 bp, Homo sapiens
tatgattggttcagttttt

SEQ ID NO: 3417101 - DNA, 14 bp, Homo sapiens
tatgatttaataaa

SEQ ID NO: 3417102 - DNA, 16 bp, Homo sapiens
tatgcaaaataaagaa

SEQ ID NO: 3417103 - DNA, 20 bp, Homo sapiens
tatgcaaatgagatttcttt

SEQ ID NO: 3417104 - DNA, 13 bp, Homo sapiens
tatgcaagtggga

SEQ ID NO: 3417105 - DNA, 15 bp, Homo sapiens
tatgcaagtgggaga

SEQ ID NO: 3417106 - DNA, 12 bp, Homo sapiens
tatgcaataaaa

SEQ ID NO: 3417107 - DNA, 21 bp, Homo sapiens
tatgcaataaaattatttgca

SEQ ID NO: 3417108 - DNA, 19 bp, Homo sapiens
tatgctgtatttctttgta

SEQ ID NO: 3417109 - DNA, 21 bp, Homo sapiens
tatggacatcgatatgaaaaa

SEQ ID NO: 3417110 - DNA, 18 bp, Homo sapiens
tatggggatagatgtgtg

SEQ ID NO: 3417111 - DNA, 16 bp, Homo sapiens
tatgtaatgcttatgt

SEQ ID NO: 3417112 - DNA, 18 bp, Homo sapiens
tatgtacagttcataaat

SEQ ID NO: 3417113 - DNA, 24 bp, Homo sapiens
tatgtatacatatagatagataat

SEQ ID NO: 3417114 - DNA, 18 bp, Homo sapiens
tatgtatataatcatgct

SEQ ID NO: 3417115 - DNA, 19 bp, Homo sapiens
tatgtatgtgccaattttg

SEQ ID NO: 3417116 - DNA, 21 bp, Homo sapiens
tatgtcaaattgtcagcatga

SEQ ID NO: 3417117 - DNA, 19 bp, Homo sapiens
tatgtgccaattttgtcac

SEQ ID NO: 3417118 - DNA, 19 bp, Homo sapiens
tatgtgggggtctgtgtgt

SEQ ID NO: 3417119 - DNA, 20 bp, Homo sapiens
tatgtgggggtctgtgtgtt

SEQ ID NO: 3417120 - DNA, 11 bp, Homo sapiens
tatgtgtgtgt

SEQ ID NO: 3417121 - DNA, 23 bp, Homo sapiens
tatgtgtgtgtgttgtgtgtggg

SEQ ID NO: 3417122 - DNA, 20 bp, Homo sapiens
tatgttacttaaacatcatt

SEQ ID NO: 3417123 - DNA, 14 bp, Homo sapiens
tatgtttttgtgta

SEQ ID NO: 3417124 - DNA, 16 bp, Homo sapiens
tattaaacttttcatt

SEQ ID NO: 3417125 - DNA, 16 bp, Homo sapiens
tattaaatgagggttt

SEQ ID NO: 3417126 - DNA, 21 bp, Homo sapiens
tattaaattaaattttgtgtc

SEQ ID NO: 3417127 - DNA, 21 bp, Homo sapiens
tattaactctgtaaaagtgtc

SEQ ID NO: 3417128 - DNA, 19 bp, Homo sapiens
tattaagaatagtctctgg

SEQ ID NO: 3417129 - DNA, 23 bp, Homo sapiens
tattagccaggatcatggtgtaa

SEQ ID NO: 3417130 - DNA, 13 bp, Homo sapiens
tattagttgcttt

SEQ ID NO: 3417131 - DNA, 18 bp, Homo sapiens
tattatttgtatgtatta

SEQ ID NO: 3417132 - DNA, 20 bp, Homo sapiens
tattcagctagaatttctgg

SEQ ID NO: 3417133 - DNA, 21 bp, Homo sapiens
tattcagtgaaaaagatattt

SEQ ID NO: 3417134 - DNA, 15 bp, Homo sapiens
tcagtattttccagc

SEQ ID NO: 3417135 - DNA, 19 bp, Homo sapiens
tcagtattttccagcctta

SEQ ID NO: 3417136 - DNA, 22 bp, Homo sapiens
tcagtattttccagccttatgt

SEQ ID NO: 3417137 - DNA, 19 bp, Homo sapiens
tcagtcactttttcccctg

SEQ ID NO: 3417138 - DNA, 15 bp, Homo sapiens
tcagtttattaaatc

SEQ ID NO: 3417139 - DNA, 19 bp, Homo sapiens
tcagtttttttttttccag

SEQ ID NO: 3417140 - DNA, 17 bp, Homo sapiens
tcatacacagttaaata

SEQ ID NO: 3417141 - DNA, 21 bp, Homo sapiens
tcatactcttaagtgtaaata

SEQ ID NO: 3417142 - DNA, 14 bp, Homo sapiens
tcatagaacagaaa

SEQ ID NO: 3417143 - DNA, 22 bp, Homo sapiens
tcatagaacagaaatatataaa

SEQ ID NO: 3417144 - DNA, 15 bp, Homo sapiens
tcatagattgcaaat

SEQ ID NO: 3417145 - DNA, 14 bp, Homo sapiens
tcatattaaaaata

SEQ ID NO: 3417146 - DNA, 22 bp, Homo sapiens
tcatcaaataaaccttgtttct

SEQ ID NO: 3417147 - DNA, 22 bp, Homo sapiens
tcatcaatttgtaattttagta

SEQ ID NO: 3417148 - DNA, 14 bp, Homo sapiens
tcatcagaactgaa

SEQ ID NO: 3417149 - DNA, 22 bp, Homo sapiens
tcatccaaggaacctaattgaa

SEQ ID NO: 3417150 - DNA, 14 bp, Homo sapiens
tcatcccatgtaca

SEQ ID NO: 3417151 - DNA, 13 bp, Homo sapiens
tcatcctgcaggc

SEQ ID NO: 3417152 - DNA, 17 bp, Homo sapiens
tcatcgaggtatgttta

SEQ ID NO: 3417153 - DNA, 18 bp, Homo sapiens
tcatctatttctgagaag

SEQ ID NO: 3417154 - DNA, 22 bp, Homo sapiens
tcatctccagtatcctgctggt

SEQ ID NO: 3417155 - DNA, 14 bp, Homo sapiens
tcatctgctctcct

SEQ ID NO: 3417156 - DNA, 15 bp, Homo sapiens
tcatctgctctcctt

SEQ ID NO: 3417157 - DNA, 21 bp, Homo sapiens
tcatctgctctccttcctgga

SEQ ID NO: 3417158 - DNA, 16 bp, Homo sapiens
tcatcttggccctcct

SEQ ID NO: 3417159 - DNA, 20 bp, Homo sapiens
tcatcttggccctcctcagc

SEQ ID NO: 3417160 - DNA, 11 bp, Homo sapiens
tcatctttgct

SEQ ID NO: 3417161 - DNA, 15 bp, Homo sapiens
tcatgaacacagcct

SEQ ID NO: 3417162 - DNA, 18 bp, Homo sapiens
tcatgcaaactgctttat

SEQ ID NO: 3417163 - DNA, 14 bp, Homo sapiens
tcatggtagatttt

SEQ ID NO: 3417164 - DNA, 20 bp, Homo sapiens
tcatggtagatttttttcat

SEQ ID NO: 3417165 - DNA, 13 bp, Homo sapiens
tcatggtgtaata

SEQ ID NO: 3417166 - DNA, 17 bp, Homo sapiens
tcatggtgtaataagac

SEQ ID NO: 3417167 - DNA, 15 bp, Homo sapiens
tcatgtatgtatata

SEQ ID NO: 3417168 - DNA, 16 bp, Homo sapiens
tcatgtcatttctcat

SEQ ID NO: 3417169 - DNA, 12 bp, Homo sapiens
tcatgtgtatga

SEQ ID NO: 3417170 - DNA, 13 bp, Homo sapiens
tcattaaactcta

SEQ ID NO: 3417171 - DNA, 17 bp, Homo sapiens
tcattaaactgattcca

SEQ ID NO: 3417172 - DNA, 18 bp, Homo sapiens
tcattatttgataacatt

SEQ ID NO: 3417173 - DNA, 22 bp, Homo sapiens
tcattatttgataacattttgt

SEQ ID NO: 3417174 - DNA, 20 bp, Homo sapiens
tcattcacaaagtataacaa

SEQ ID NO: 3417175 - DNA, 14 bp, Homo sapiens
tgagagggccgggc

SEQ ID NO: 3417176 - DNA, 16 bp, Homo sapiens
tgagatttactgctct

SEQ ID NO: 3417177 - DNA, 22 bp, Homo sapiens
tgagatttcatctgctctcctt

SEQ ID NO: 3417178 - DNA, 16 bp, Homo sapiens
tgagatttctttgaat

SEQ ID NO: 3417179 - DNA, 18 bp, Homo sapiens
tgagatttctttgaatgt

SEQ ID NO: 3417180 - DNA, 21 bp, Homo sapiens
tgagcaagtatccttcattgt

SEQ ID NO: 3417181 - DNA, 22 bp, Homo sapiens
tgagccatagagatatttaaaa

SEQ ID NO: 3417182 - DNA, 17 bp, Homo sapiens
tgagcctcgtgtcatct

SEQ ID NO: 3417183 - DNA, 18 bp, Homo sapiens
tgagcgctcctgccgcag

SEQ ID NO: 3417184 - DNA, 16 bp, Homo sapiens
tgagctttttgttccc

SEQ ID NO: 3417185 - DNA, 24 bp, Homo sapiens
tgaggaagaacggggctcttctca

SEQ ID NO: 3417186 - DNA, 18 bp, Homo sapiens
tgaggcacctgcatatct

SEQ ID NO: 3417187 - DNA, 20 bp, Homo sapiens
tgaggcacctgcatatctct

SEQ ID NO: 3417188 - DNA, 12 bp, Homo sapiens
tgaggccctcca

SEQ ID NO: 3417189 - DNA, 18 bp, Homo sapiens
tgaggccctccacacctg

SEQ ID NO: 3417190 - DNA, 21 bp, Homo sapiens
tgaggccctccacacctgcgg

SEQ ID NO: 3417191 - DNA, 19 bp, Homo sapiens
tgagggtcttcttacatgc

SEQ ID NO: 3417192 - DNA, 18 bp, Homo sapiens
tgaggtcatagcagtgct

SEQ ID NO: 3417193 - DNA, 16 bp, Homo sapiens
tgaggtcttttacata

SEQ ID NO: 3417194 - DNA, 19 bp, Homo sapiens
tgaggtttaacattaaagc

SEQ ID NO: 3417195 - DNA, 16 bp, Homo sapiens
tgagtctgttttgtaa

SEQ ID NO: 3417196 - DNA, 13 bp, Homo sapiens
tgagtcttaactg

SEQ ID NO: 3417197 - DNA, 14 bp, Homo sapiens
tgagtcttaactgt

SEQ ID NO: 3417198 - DNA, 17 bp, Homo sapiens
tgagtcttaactgtatt

SEQ ID NO: 3417199 - DNA, 14 bp, Homo sapiens
tgagtgccatgctt

SEQ ID NO: 3417200 - DNA, 15 bp, Homo sapiens
tgagtgccatgcttt

SEQ ID NO: 3417201 - DNA, 13 bp, Homo sapiens
tgagtggcatgtg

SEQ ID NO: 3417202 - DNA, 23 bp, Homo sapiens
tgagtggcttcactcctgctgta

SEQ ID NO: 3417203 - DNA, 21 bp, Homo sapiens
tgagtggtgttggcagtgttt

SEQ ID NO: 3417204 - DNA, 22 bp, Homo sapiens
tgagttacttagaatgccataa

SEQ ID NO: 3417205 - DNA, 20 bp, Homo sapiens
tgagttgcaccattctttct

SEQ ID NO: 3417206 - DNA, 23 bp, Homo sapiens
tgagttgcaccattctttcttgg

SEQ ID NO: 3417207 - DNA, 20 bp, Homo sapiens
tgagttggtgttgacatgtg

SEQ ID NO: 3417208 - DNA, 19 bp, Homo sapiens
tgagttttactcttaaatc

SEQ ID NO: 3417209 - DNA, 13 bp, Homo sapiens
tgataatgttaaa

SEQ ID NO: 3417210 - DNA, 17 bp, Homo sapiens
tgataatgttaaatttg

SEQ ID NO: 3417211 - DNA, 17 bp, Homo sapiens
tgatacccaacagttta

SEQ ID NO: 3417212 - DNA, 12 bp, Homo sapiens
tgatagtgcttc

SEQ ID NO: 3417213 - DNA, 14 bp, Homo sapiens
tgatagtgcttctt

SEQ ID NO: 3417214 - DNA, 17 bp, Homo sapiens
tgatagtgcttcttgta

SEQ ID NO: 3417215 - DNA, 19 bp, Homo sapiens
tgatagtgcttcttgtaat

SEQ ID NO: 3417216 - DNA, 12 bp, Homo sapiens
tgatagtgtaaa

SEQ ID NO: 3417217 - DNA, 16 bp, Homo sapiens
tgatatggcagaagac

SEQ ID NO: 3417218 - DNA, 16 bp, Homo sapiens
tgatattcaaggcttt

SEQ ID NO: 3417219 - DNA, 22 bp, Homo sapiens
tgatattcaaggctttaaaagt

SEQ ID NO: 3417220 - DNA, 18 bp, Homo sapiens
tgatattgaccatgtgat

SEQ ID NO: 3417221 - DNA, 14 bp, Homo sapiens
tgatatttccttca

SEQ ID NO: 3417222 - DNA, 15 bp, Homo sapiens
tgatatttccttcac

SEQ ID NO: 3417223 - DNA, 18 bp, Homo sapiens
tgatcaaaaataatgcat

SEQ ID NO: 3417224 - DNA, 17 bp, Homo sapiens
tgatcaacatcttttct

SEQ ID NO: 3417225 - DNA, 21 bp, Homo sapiens
tgatcaacatcttttcttgcc

SEQ ID NO: 3417226 - DNA, 14 bp, Homo sapiens
tgatcaatgacaga

SEQ ID NO: 3417227 - DNA, 19 bp, Homo sapiens
tgatcaatgacagagcctt

SEQ ID NO: 3417228 - DNA, 20 bp, Homo sapiens
tgatcacatctaaagcttta

SEQ ID NO: 3417229 - DNA, 16 bp, Homo sapiens
tgatcagatgctgaat

SEQ ID NO: 3417230 - DNA, 16 bp, Homo sapiens
tgatcatagaattgtg

SEQ ID NO: 3417231 - DNA, 16 bp, Homo sapiens
tgatcatctttgctga

SEQ ID NO: 3417232 - DNA, 18 bp, Homo sapiens
tgatcccttctcctgccc

SEQ ID NO: 3417233 - DNA, 19 bp, Homo sapiens
tgatcccttctcctgccct

SEQ ID NO: 3417234 - DNA, 23 bp, Homo sapiens
tgatcgccttatttatattcatc

SEQ ID NO: 3417235 - DNA, 16 bp, Homo sapiens
tggtactaaggagaat

SEQ ID NO: 3417236 - DNA, 20 bp, Homo sapiens
tggtaggaactgctgggctt

SEQ ID NO: 3417237 - DNA, 15 bp, Homo sapiens
tggtcaagattttga

SEQ ID NO: 3417238 - DNA, 20 bp, Homo sapiens
tggtcttactttgtgcaaaa

SEQ ID NO: 3417239 - DNA, 14 bp, Homo sapiens
tggtctttgtaaga

SEQ ID NO: 3417240 - DNA, 14 bp, Homo sapiens
tggtgacttttgaa

SEQ ID NO: 3417241 - DNA, 18 bp, Homo sapiens
tggtgcaattaactctgg

SEQ ID NO: 3417242 - DNA, 23 bp, Homo sapiens
tggtgcaggtagacctgtctcct

SEQ ID NO: 3417243 - DNA, 14 bp, Homo sapiens
tggtggccctctcc

SEQ ID NO: 3417244 - DNA, 19 bp, Homo sapiens
tggtggccctctcccctgc

SEQ ID NO: 3417245 - DNA, 13 bp, Homo sapiens
tggtgtaataaga

SEQ ID NO: 3417246 - DNA, 19 bp, Homo sapiens
tggtgtaataagacataac

SEQ ID NO: 3417247 - DNA, 21 bp, Homo sapiens
tggtgtagccctcccactttg

SEQ ID NO: 3417248 - DNA, 16 bp, Homo sapiens
tggtgtgtgtctctga

SEQ ID NO: 3417249 - DNA, 17 bp, Homo sapiens
tggtgttggcagtgttt

SEQ ID NO: 3417250 - DNA, 15 bp, Homo sapiens
tggttaatcagtgtt

SEQ ID NO: 3417251 - DNA, 13 bp, Homo sapiens
tggttaatgccat

SEQ ID NO: 3417252 - DNA, 17 bp, Homo sapiens
tggttagtatttaacta

SEQ ID NO: 3417253 - DNA, 13 bp, Homo sapiens
tggttctcatctt

SEQ ID NO: 3417254 - DNA, 15 bp, Homo sapiens
tggttctcatctttc

SEQ ID NO: 3417255 - DNA, 14 bp, Homo sapiens
tggttgtatataaa

SEQ ID NO: 3417256 - DNA, 21 bp, Homo sapiens
tggtttgccggtggtgcaggt

SEQ ID NO: 3417257 - DNA, 15 bp, Homo sapiens
tgtaaaatcttcagc

SEQ ID NO: 3417258 - DNA, 17 bp, Homo sapiens
tgtaaaatttcacttaa

SEQ ID NO: 3417259 - DNA, 18 bp, Homo sapiens
tgtaaacaaataataaag

SEQ ID NO: 3417260 - DNA, 15 bp, Homo sapiens
tgtaaagtccccaga

SEQ ID NO: 3417261 - DNA, 22 bp, Homo sapiens
tgtaaataatataaaatgtttc

SEQ ID NO: 3417262 - DNA, 21 bp, Homo sapiens
tgtaaatttggcttctgttgt

SEQ ID NO: 3417263 - DNA, 22 bp, Homo sapiens
tgtaacaggtctcctcttaaaa

SEQ ID NO: 3417264 - DNA, 18 bp, Homo sapiens
tgtaagagtgtagaagca

SEQ ID NO: 3417265 - DNA, 21 bp, Homo sapiens
tgtaagcttagattttctgta

SEQ ID NO: 3417266 - DNA, 21 bp, Homo sapiens
tgtaaggcttgttccaatgcc

SEQ ID NO: 3417267 - DNA, 15 bp, Homo sapiens
tgtaagtttcaggtg

SEQ ID NO: 3417268 - DNA, 15 bp, Homo sapiens
tgtaataagacataa

SEQ ID NO: 3417269 - DNA, 14 bp, Homo sapiens
tgtaatatgagaat

SEQ ID NO: 3417270 - DNA, 18 bp, Homo sapiens
tgtaatattctctgatgt

SEQ ID NO: 3417271 - DNA, 19 bp, Homo sapiens
tgtaatatttcttcaagtg

SEQ ID NO: 3417272 - DNA, 21 bp, Homo sapiens
tgtaatatttcttcaagtgag

SEQ ID NO: 3417273 - DNA, 18 bp, Homo sapiens
tgtaatctaagtatatgt

SEQ ID NO: 3417274 - DNA, 20 bp, Homo sapiens
tgtaatctaagtatatgtga

SEQ ID NO: 3417275 - DNA, 21 bp, Homo sapiens
tgtaatctaagtatatgtgag

SEQ ID NO: 3417276 - DNA, 15 bp, Homo sapiens
tgtaatgcttatgtg

SEQ ID NO: 3417277 - DNA, 19 bp, Homo sapiens
tgtaattaaactagtttaa

SEQ ID NO: 3417278 - DNA, 22 bp, Homo sapiens
tgtaattaaactagtttaaggg

SEQ ID NO: 3417279 - DNA, 17 bp, Homo sapiens
tgtaatttaaaattgtg

SEQ ID NO: 3417280 - DNA, 21 bp, Homo sapiens
tgtaatttaaaattgtgatgt

SEQ ID NO: 3417281 - DNA, 18 bp, Homo sapiens
tgtacaaggtatgtacag

SEQ ID NO: 3417282 - DNA, 20 bp, Homo sapiens
tgtacatttatgatttaata

SEQ ID NO: 3417283 - DNA, 14 bp, Homo sapiens
tgtacattttggat

SEQ ID NO: 3417284 - DNA, 18 bp, Homo sapiens
tgtacattttggatttct

SEQ ID NO: 3417285 - DNA, 20 bp, Homo sapiens
tgtacattttggatttcttt

SEQ ID NO: 3417286 - DNA, 22 bp, Homo sapiens
tgtacattttggatttctttat

SEQ ID NO: 3417287 - DNA, 15 bp, Homo sapiens
tgtactgggccatgt

SEQ ID NO: 3417288 - DNA, 14 bp, Homo sapiens
tgtacttaaatgag

SEQ ID NO: 3417289 - DNA, 18 bp, Homo sapiens
tcccctgcccccaggact

SEQ ID NO: 3417290 - DNA, 19 bp, Homo sapiens
tcccctgcccccaggactg

SEQ ID NO: 3417291 - DNA, 20 bp, Homo sapiens
tcccctgcccccaggactgg

SEQ ID NO: 3417292 - DNA, 16 bp, Homo sapiens
tcccctgccccctgca

SEQ ID NO: 3417293 - DNA, 18 bp, Homo sapiens
tcccctgccccctgcagg

SEQ ID NO: 3417294 - DNA, 21 bp, Homo sapiens
tcccctgccccctgcaggaag

SEQ ID NO: 3417295 - DNA, 20 bp, Homo sapiens
tcccctttatgtacaggatg

SEQ ID NO: 3417296 - DNA, 19 bp, Homo sapiens
tcccgtaaggctgtacata

SEQ ID NO: 3417297 - DNA, 16 bp, Homo sapiens
tccctcattctgcatt

SEQ ID NO: 3417298 - DNA, 17 bp, Homo sapiens
tccctcattctgcatta

SEQ ID NO: 3417299 - DNA, 21 bp, Homo sapiens
tccctctagaggctgcctggg

SEQ ID NO: 3417300 - DNA, 18 bp, Homo sapiens
tccctgcctcaggcctct

SEQ ID NO: 3417301 - DNA, 16 bp, Homo sapiens
tccctgcctgtttccc

SEQ ID NO: 3417302 - DNA, 17 bp, Homo sapiens
tccctggagccctgttg

SEQ ID NO: 3417303 - DNA, 21 bp, Homo sapiens
tccctggtgagagggccgggc

SEQ ID NO: 3417304 - DNA, 13 bp, Homo sapiens
tccctgtgttctg

SEQ ID NO: 3417305 - DNA, 15 bp, Homo sapiens
tcccttctcctgccc

SEQ ID NO: 3417306 - DNA, 19 bp, Homo sapiens
tcccttctgtagtttttaa

SEQ ID NO: 3417307 - DNA, 18 bp, Homo sapiens
tccgcagtgtggccaggc

SEQ ID NO: 3417308 - DNA, 20 bp, Homo sapiens
tcctataatataataaatat

SEQ ID NO: 3417309 - DNA, 19 bp, Homo sapiens
tcctattttgcataataaa

SEQ ID NO: 3417310 - DNA, 15 bp, Homo sapiens
tcctcagctccctgc

SEQ ID NO: 3417311 - DNA, 19 bp, Homo sapiens
tcctcagctccctgcctgt

SEQ ID NO: 3417312 - DNA, 16 bp, Homo sapiens
tcctccactctccccc

SEQ ID NO: 3417313 - DNA, 12 bp, Homo sapiens
tcctcctccagg

SEQ ID NO: 3417314 - DNA, 14 bp, Homo sapiens
tcctcctccaggga

SEQ ID NO: 3417315 - DNA, 16 bp, Homo sapiens
tcctcgttctccctgg

SEQ ID NO: 3417316 - DNA, 21 bp, Homo sapiens
tcctcgttctccctgggaggc

SEQ ID NO: 3417317 - DNA, 20 bp, Homo sapiens
tcctcttaaaaaataaaaac

SEQ ID NO: 3417318 - DNA, 21 bp, Homo sapiens
tcctgctgaaagtcctgcttt

SEQ ID NO: 3417319 - DNA, 15 bp, Homo sapiens
tcctggagcccagag

SEQ ID NO: 3417320 - DNA, 18 bp, Homo sapiens
tcctggagcccagaggag

SEQ ID NO: 3417321 - DNA, 22 bp, Homo sapiens
tcctggagcccagaggagggca

SEQ ID NO: 3417322 - DNA, 21 bp, Homo sapiens
tcctgtctttaaagcctgcct

SEQ ID NO: 3417323 - DNA, 14 bp, Homo sapiens
tccttaatgatccg

SEQ ID NO: 3417324 - DNA, 18 bp, Homo sapiens
tccttatgatattctcat

SEQ ID NO: 3417325 - DNA, 12 bp, Homo sapiens
tccttcccagag

SEQ ID NO: 3417326 - DNA, 22 bp, Homo sapiens
tccttctttgataatgttaaat

SEQ ID NO: 3417327 - DNA, 21 bp, Homo sapiens
tcctttaaaaaaatttaagtg

SEQ ID NO: 3417328 - DNA, 23 bp, Homo sapiens
tcctttaactatcagagggatct

SEQ ID NO: 3417329 - DNA, 18 bp, Homo sapiens
tcctttaggtttgaaagg

SEQ ID NO: 3417330 - DNA, 19 bp, Homo sapiens
tcctttcaatggtttgcaa

SEQ ID NO: 3417331 - DNA, 17 bp, Homo sapiens
tccttttatctccttgt

SEQ ID NO: 3417332 - DNA, 13 bp, Homo sapiens
tcctttttattca

SEQ ID NO: 3417333 - DNA, 11 bp, Homo sapiens
tcgaaagtgtc

SEQ ID NO: 3417334 - DNA, 16 bp, Homo sapiens
tcgaaagtgtcatcaa

SEQ ID NO: 3417335 - DNA, 12 bp, Homo sapiens
tcgactcccccc

SEQ ID NO: 3417336 - DNA, 13 bp, Homo sapiens
tcgactcccccct

SEQ ID NO: 3417337 - DNA, 22 bp, Homo sapiens
tcgagaactttcatttttttcc

SEQ ID NO: 3417338 - DNA, 22 bp, Homo sapiens
tcgagtgcccctgtcccacctg

SEQ ID NO: 3417339 - DNA, 15 bp, Homo sapiens
tcgggttaagaaata

SEQ ID NO: 3417340 - DNA, 17 bp, Homo sapiens
tcgtgtaattggcccaa

SEQ ID NO: 3417341 - DNA, 14 bp, Homo sapiens
tcgtgtcagctcag

SEQ ID NO: 3417342 - DNA, 21 bp, Homo sapiens
tcgtgtctagtagaacaatgt

SEQ ID NO: 3417343 - DNA, 15 bp, Homo sapiens
tcgttcccatagatt

SEQ ID NO: 3417344 - DNA, 13 bp, Homo sapiens
tcgttctccctgg

SEQ ID NO: 3417345 - DNA, 23 bp, Homo sapiens
tcgtttgatagtgcttcttgtaa

SEQ ID NO: 3417346 - DNA, 13 bp, Homo sapiens
tctaaagctttat

SEQ ID NO: 3417347 - DNA, 19 bp, Homo sapiens
tctaaagctttatctttgt

SEQ ID NO: 3417348 - DNA, 17 bp, Homo sapiens
tctaaattgatcattca

SEQ ID NO: 3417349 - DNA, 17 bp, Homo sapiens
tctaatagagaactttt

SEQ ID NO: 3417350 - DNA, 18 bp, Homo sapiens
tctaatagagaacttttt

SEQ ID NO: 3417351 - DNA, 14 bp, Homo sapiens
tctaattggtcatt

SEQ ID NO: 3417352 - DNA, 14 bp, Homo sapiens
tctacattaaacaa

SEQ ID NO: 3417353 - DNA, 21 bp, Homo sapiens
tctacattcttggttgttaat

SEQ ID NO: 3417354 - DNA, 15 bp, Homo sapiens
tctagcatttatttc

SEQ ID NO: 3417355 - DNA, 19 bp, Homo sapiens
tctagcatttatttctctg

SEQ ID NO: 3417356 - DNA, 17 bp, Homo sapiens
tctagtagaacaatgta

SEQ ID NO: 3417357 - DNA, 19 bp, Homo sapiens
tctagtccctgtgttctgc

SEQ ID NO: 3417358 - DNA, 18 bp, Homo sapiens
tctagttgcttgtaaaat

SEQ ID NO: 3417359 - DNA, 16 bp, Homo sapiens
tctatctaatgacatg

SEQ ID NO: 3417360 - DNA, 12 bp, Homo sapiens
tctatgtatgtg

SEQ ID NO: 3417361 - DNA, 22 bp, Homo sapiens
tctatgtatgtgccaattttgt

SEQ ID NO: 3417362 - DNA, 12 bp, Homo sapiens
tctatttctgag

SEQ ID NO: 3417363 - DNA, 15 bp, Homo sapiens
tctatttctgagaag

SEQ ID NO: 3417364 - DNA, 17 bp, Homo sapiens
tctcaaagttttgaaaa

SEQ ID NO: 3417365 - DNA, 20 bp, Homo sapiens
tctcaaagttttgaaaagct

SEQ ID NO: 3417366 - DNA, 13 bp, Homo sapiens
tctcaattttgta

SEQ ID NO: 3417367 - DNA, 22 bp, Homo sapiens
tctcaggatcccctctcttcct

SEQ ID NO: 3417368 - DNA, 21 bp, Homo sapiens
tctcagtcactttttcccctg

SEQ ID NO: 3417369 - DNA, 23 bp, Homo sapiens
tctcagtcactttttcccctgca

SEQ ID NO: 3417370 - DNA, 21 bp, Homo sapiens
tctcagtcatgcataaatatg

SEQ ID NO: 3417371 - DNA, 23 bp, Homo sapiens
tctcagtcatgcataaatatgca

SEQ ID NO: 3417372 - DNA, 15 bp, Homo sapiens
tctcatcctgcaggc

SEQ ID NO: 3417373 - DNA, 13 bp, Homo sapiens
tctcatctttctt

SEQ ID NO: 3417374 - DNA, 16 bp, Homo sapiens
tctcatttcacccctc

SEQ ID NO: 3417375 - DNA, 15 bp, Homo sapiens
tctccaattctgaaa

SEQ ID NO: 3417376 - DNA, 17 bp, Homo sapiens
tctccagtatcctgctg

SEQ ID NO: 3417377 - DNA, 17 bp, Homo sapiens
tctccatggccctgcca

SEQ ID NO: 3417378 - DNA, 18 bp, Homo sapiens
tctccccaatccatgctt

SEQ ID NO: 3417379 - DNA, 21 bp, Homo sapiens
tctccccaatccatgcttcac

SEQ ID NO: 3417380 - DNA, 22 bp, Homo sapiens
tctccccaatccatgcttcact

SEQ ID NO: 3417381 - DNA, 19 bp, Homo sapiens
tctcccccaccccctcccc

SEQ ID NO: 3417382 - DNA, 12 bp, Homo sapiens
tctcccctgccc

SEQ ID NO: 3417383 - DNA, 19 bp, Homo sapiens
tctcccctgccccctgcag

SEQ ID NO: 3417384 - DNA, 17 bp, Homo sapiens
tctcctctccatctcta

SEQ ID NO: 3417385 - DNA, 14 bp, Homo sapiens
tctcctcttaaaaa

SEQ ID NO: 3417386 - DNA, 22 bp, Homo sapiens
tctcctcttaaaaaataaaaac

SEQ ID NO: 3417387 - DNA, 15 bp, Homo sapiens
tctccttcagccctc

SEQ ID NO: 3417388 - DNA, 14 bp, Homo sapiens
tctccttgtggcct

SEQ ID NO: 3417389 - DNA, 12 bp, Homo sapiens
tctcgactcccc

SEQ ID NO: 3417390 - DNA, 17 bp, Homo sapiens
tctcgcctcactttcca

SEQ ID NO: 3417391 - DNA, 22 bp, Homo sapiens
tctctcatctcttagctcccct

SEQ ID NO: 3417392 - DNA, 23 bp, Homo sapiens
tctctcatctcttagctcccctc

SEQ ID NO: 3417393 - DNA, 17 bp, Homo sapiens
tctctctaacataacaa

SEQ ID NO: 3417394 - DNA, 22 bp, Homo sapiens
tctctgggtttacaacaaacac

SEQ ID NO: 3417395 - DNA, 13 bp, Homo sapiens
tctctgtcagtgt

SEQ ID NO: 3417396 - DNA, 22 bp, Homo sapiens
tctctgtgagactcgagaactt

SEQ ID NO: 3417397 - DNA, 17 bp, Homo sapiens
tctcttagctcccctcc

SEQ ID NO: 3417398 - DNA, 18 bp, Homo sapiens
tctcttagctcccctcca

SEQ ID NO: 3417399 - DNA, 19 bp, Homo sapiens
tctcttagctcccctccaa

SEQ ID NO: 3417400 - DNA, 18 bp, Homo sapiens
ttgttccctcattctgca

SEQ ID NO: 3417401 - DNA, 22 bp, Homo sapiens
ttgttctgggtgatttctagaa

SEQ ID NO: 3417402 - DNA, 19 bp, Homo sapiens
ttgttgcaccaattaagtg

SEQ ID NO: 3417403 - DNA, 13 bp, Homo sapiens
ttgtttaaatgcc

SEQ ID NO: 3417404 - DNA, 16 bp, Homo sapiens
ttgtttaaatgccaaa

SEQ ID NO: 3417405 - DNA, 16 bp, Homo sapiens
tttaaaaaaatttaag

SEQ ID NO: 3417406 - DNA, 17 bp, Homo sapiens
tttaaaaaaatttaagt

SEQ ID NO: 3417407 - DNA, 12 bp, Homo sapiens
tttaaaaaatta

SEQ ID NO: 3417408 - DNA, 21 bp, Homo sapiens
tttaaaaataaagctactgaa

SEQ ID NO: 3417409 - DNA, 22 bp, Homo sapiens
tttaaaaataaagctactgaat

SEQ ID NO: 3417410 - DNA, 17 bp, Homo sapiens
tttaaaatgttggtgca

SEQ ID NO: 3417411 - DNA, 15 bp, Homo sapiens
tttaaagtaaacttg

SEQ ID NO: 3417412 - DNA, 18 bp, Homo sapiens
tttaaagtaaacttgtgt

SEQ ID NO: 3417413 - DNA, 20 bp, Homo sapiens
tttaaattggtcatggtaga

SEQ ID NO: 3417414 - DNA, 18 bp, Homo sapiens
tttaactctactgtgtaa

SEQ ID NO: 3417415 - DNA, 21 bp, Homo sapiens
tttaactctactgtgtaatat

SEQ ID NO: 3417416 - DNA, 21 bp, Homo sapiens
tttaacttgtctttttgttat

SEQ ID NO: 3417417 - DNA, 13 bp, Homo sapiens
tttaagctctgag

SEQ ID NO: 3417418 - DNA, 12 bp, Homo sapiens
tttaagtgacat

SEQ ID NO: 3417419 - DNA, 18 bp, Homo sapiens
tttaagtgcgtgtgtaga

SEQ ID NO: 3417420 - DNA, 20 bp, Homo sapiens
tttaagtgcgtgtgtagagt

SEQ ID NO: 3417421 - DNA, 16 bp, Homo sapiens
tttaataaaataattc

SEQ ID NO: 3417422 - DNA, 24 bp, Homo sapiens
tttaatattacctaatgaaagtga

SEQ ID NO: 3417423 - DNA, 17 bp, Homo sapiens
tttaatctgttgtttga

SEQ ID NO: 3417424 - DNA, 18 bp, Homo sapiens
tttaatgatttttgtgta

SEQ ID NO: 3417425 - DNA, 23 bp, Homo sapiens
tttaattaaaaactttaaagata

SEQ ID NO: 3417426 - DNA, 16 bp, Homo sapiens
tttaattgttgtttct

SEQ ID NO: 3417427 - DNA, 18 bp, Homo sapiens
tttaattgttgtttcttt

SEQ ID NO: 3417428 - DNA, 21 bp, Homo sapiens
tttaatttccaaaataatcta

SEQ ID NO: 3417429 - DNA, 15 bp, Homo sapiens
tttacaacaaacact

SEQ ID NO: 3417430 - DNA, 15 bp, Homo sapiens
tttacattttagggt

SEQ ID NO: 3417431 - DNA, 15 bp, Homo sapiens
tttaccctcctctat

SEQ ID NO: 3417432 - DNA, 21 bp, Homo sapiens
tttactaagatcacacaaata

SEQ ID NO: 3417433 - DNA, 14 bp, Homo sapiens
tttaggtaaataaa

SEQ ID NO: 3417434 - DNA, 17 bp, Homo sapiens
tttaggtaaataaagct

SEQ ID NO: 3417435 - DNA, 15 bp, Homo sapiens
tttaggttgttacca

SEQ ID NO: 3417436 - DNA, 22 bp, Homo sapiens
tttagtatatgaaatattttga

SEQ ID NO: 3417437 - DNA, 13 bp, Homo sapiens
tttagtcattatt

SEQ ID NO: 3417438 - DNA, 16 bp, Homo sapiens
tttagttacgtataat

SEQ ID NO: 3417439 - DNA, 22 bp, Homo sapiens
tttagttacgtataatgctttc

SEQ ID NO: 3417440 - DNA, 17 bp, Homo sapiens
tttagttgtatctcttt

SEQ ID NO: 3417441 - DNA, 15 bp, Homo sapiens
tttagtttaaaatct

SEQ ID NO: 3417442 - DNA, 13 bp, Homo sapiens
tttataatgcaat

SEQ ID NO: 3417443 - DNA, 21 bp, Homo sapiens
tttatacatacagagattgta

SEQ ID NO: 3417444 - DNA, 16 bp, Homo sapiens
tttataccccatttga

SEQ ID NO: 3417445 - DNA, 14 bp, Homo sapiens
tttatatctggaat

SEQ ID NO: 3417446 - DNA, 20 bp, Homo sapiens
tttatattagttgctttgtt

SEQ ID NO: 3417447 - DNA, 16 bp, Homo sapiens
tttatattcatcaaat

SEQ ID NO: 3417448 - DNA, 23 bp, Homo sapiens
tttatattcatcaaataaacctt

SEQ ID NO: 3417449 - DNA, 12 bp, Homo sapiens
tttatatttaaa

SEQ ID NO: 3417450 - DNA, 13 bp, Homo sapiens
tttatctttgtgt

SEQ ID NO: 3417451 - DNA, 22 bp, Homo sapiens
tttatgacgagacctcagatgt

SEQ ID NO: 3417452 - DNA, 16 bp, Homo sapiens
tttatgagatttactg

SEQ ID NO: 3417453 - DNA, 17 bp, Homo sapiens
tttatgagccagacaaa

SEQ ID NO: 3417454 - DNA, 18 bp, Homo sapiens
tttatgatttaataaaat

SEQ ID NO: 3417455 - DNA, 14 bp, Homo sapiens
tttatgtacaggat

SEQ ID NO: 3417456 - DNA, 12 bp, Homo sapiens
tttatgtgatgg

SEQ ID NO: 3417457 - DNA, 14 bp, Homo sapiens
tttatttatatctt

SEQ ID NO: 3417458 - DNA, 21 bp, Homo sapiens
tttatttgcacttgtggaata

SEQ ID NO: 3417459 - DNA, 19 bp, Homo sapiens
tttcacagttctgtaatgt

SEQ ID NO: 3417460 - DNA, 13 bp, Homo sapiens
tttcacccctccc

SEQ ID NO: 3417461 - DNA, 17 bp, Homo sapiens
tttcacccctccctttc

SEQ ID NO: 3417462 - DNA, 18 bp, Homo sapiens
tttcacccctccctttct

SEQ ID NO: 3417463 - DNA, 20 bp, Homo sapiens
tttcacccctccctttctcc

SEQ ID NO: 3417464 - DNA, 16 bp, Homo sapiens
tttcagagttttacta

SEQ ID NO: 3417465 - DNA, 16 bp, Homo sapiens
tttcagattccacaca

SEQ ID NO: 3417466 - DNA, 20 bp, Homo sapiens
tttcagcatcaaacatgaaa

SEQ ID NO: 3417467 - DNA, 22 bp, Homo sapiens
tttcagcatcaaacatgaaaac

SEQ ID NO: 3417468 - DNA, 23 bp, Homo sapiens
tttcagcatcaaacatgaaaaca

SEQ ID NO: 3417469 - DNA, 15 bp, Homo sapiens
tttcaggtgacatgt

SEQ ID NO: 3417470 - DNA, 16 bp, Homo sapiens
tttcaggtgacatgtg

SEQ ID NO: 3417471 - DNA, 15 bp, Homo sapiens
tttcagtattttcca

SEQ ID NO: 3417472 - DNA, 18 bp, Homo sapiens
tttcatctatttctgaga

SEQ ID NO: 3417473 - DNA, 18 bp, Homo sapiens
tttcatctgctctccttc

SEQ ID NO: 3417474 - DNA, 20 bp, Homo sapiens
tttcatctgctctccttcct

SEQ ID NO: 3417475 - DNA, 16 bp, Homo sapiens
agactaagccagcacc

SEQ ID NO: 3417476 - DNA, 20 bp, Homo sapiens
agactatggaatgtcagtgt

SEQ ID NO: 3417477 - DNA, 23 bp, Homo sapiens
agactatggaatgtcagtgttca

SEQ ID NO: 3417478 - DNA, 15 bp, Homo sapiens
agactcgagaacttt

SEQ ID NO: 3417479 - DNA, 17 bp, Homo sapiens
agactgttgtccctgca

SEQ ID NO: 3417480 - DNA, 19 bp, Homo sapiens
agactgttgtccctgcact

SEQ ID NO: 3417481 - DNA, 13 bp, Homo sapiens
agactttgctgtt

SEQ ID NO: 3417482 - DNA, 16 bp, Homo sapiens
agactttgctgttact

SEQ ID NO: 3417483 - DNA, 17 bp, Homo sapiens
agactttgctgttactg

SEQ ID NO: 3417484 - DNA, 14 bp, Homo sapiens
agagaaagcgcaga

SEQ ID NO: 3417485 - DNA, 16 bp, Homo sapiens
agagaactttttgtta

SEQ ID NO: 3417486 - DNA, 20 bp, Homo sapiens
agagacaaactgtaaaaaat

SEQ ID NO: 3417487 - DNA, 13 bp, Homo sapiens
agagactgggcct

SEQ ID NO: 3417488 - DNA, 22 bp, Homo sapiens
agagactgggcctaggccagga

SEQ ID NO: 3417489 - DNA, 14 bp, Homo sapiens
agagagatgttttg

SEQ ID NO: 3417490 - DNA, 13 bp, Homo sapiens
agagagccatttt

SEQ ID NO: 3417491 - DNA, 17 bp, Homo sapiens
agagagccattttgtga

SEQ ID NO: 3417492 - DNA, 23 bp, Homo sapiens
agagatatttaaaagacaaacac

SEQ ID NO: 3417493 - DNA, 15 bp, Homo sapiens
agagatgaaataatt

SEQ ID NO: 3417494 - DNA, 14 bp, Homo sapiens
agagattgtagtat

SEQ ID NO: 3417495 - DNA, 12 bp, Homo sapiens
agagcagatgca

SEQ ID NO: 3417496 - DNA, 15 bp, Homo sapiens
agagcagatgcagag

SEQ ID NO: 3417497 - DNA, 19 bp, Homo sapiens
agagcagatgcagagagcc

SEQ ID NO: 3417498 - DNA, 16 bp, Homo sapiens
agagcccagaggtaac

SEQ ID NO: 3417499 - DNA, 20 bp, Homo sapiens
agagcccagaggtaacagaa

SEQ ID NO: 3417500 - DNA, 17 bp, Homo sapiens
agagcccaggagctccc

SEQ ID NO: 3417501 - DNA, 13 bp, Homo sapiens
agaggatgagagc

SEQ ID NO: 3417502 - DNA, 20 bp, Homo sapiens
agaggcctgcctccagggct

SEQ ID NO: 3417503 - DNA, 19 bp, Homo sapiens
agaggctgaaagaggccaa

SEQ ID NO: 3417504 - DNA, 17 bp, Homo sapiens
agaggctgcctgggcct

SEQ ID NO: 3417505 - DNA, 16 bp, Homo sapiens
agagggagaagcatga

SEQ ID NO: 3417506 - DNA, 19 bp, Homo sapiens
agagggagaagcatgaaaa

SEQ ID NO: 3417507 - DNA, 18 bp, Homo sapiens
agagggccgggcagaggg

SEQ ID NO: 3417508 - DNA, 13 bp, Homo sapiens
agaggggcctgcc

SEQ ID NO: 3417509 - DNA, 17 bp, Homo sapiens
agaggggcctgccacct

SEQ ID NO: 3417510 - DNA, 20 bp, Homo sapiens
agaggggcctgccacctgga

SEQ ID NO: 3417511 - DNA, 18 bp, Homo sapiens
agaggggctggacctggc

SEQ ID NO: 3417512 - DNA, 16 bp, Homo sapiens
agaggtaacagaacag

SEQ ID NO: 3417513 - DNA, 20 bp, Homo sapiens
agaggtaacagaacagcttc

SEQ ID NO: 3417514 - DNA, 22 bp, Homo sapiens
agaggtaacagaacagcttcag

SEQ ID NO: 3417515 - DNA, 12 bp, Homo sapiens
agagtcatgtga

SEQ ID NO: 3417516 - DNA, 16 bp, Homo sapiens
agagtcatgtgagcct

SEQ ID NO: 3417517 - DNA, 22 bp, Homo sapiens
agagtcatgtgagcctcgtgtc

SEQ ID NO: 3417518 - DNA, 14 bp, Homo sapiens
agagtgggggtggg

SEQ ID NO: 3417519 - DNA, 13 bp, Homo sapiens
agagtgtagaagc

SEQ ID NO: 3417520 - DNA, 16 bp, Homo sapiens
agagtgtagaagcatt

SEQ ID NO: 3417521 - DNA, 13 bp, Homo sapiens
agagttctttgca

SEQ ID NO: 3417522 - DNA, 19 bp, Homo sapiens
agagttgttgtttgccaag

SEQ ID NO: 3417523 - DNA, 18 bp, Homo sapiens
agagtttgatgaggccct

SEQ ID NO: 3417524 - DNA, 13 bp, Homo sapiens
agagttttactaa

SEQ ID NO: 3417525 - DNA, 17 bp, Homo sapiens
agataagcaagagagat

SEQ ID NO: 3417526 - DNA, 21 bp, Homo sapiens
agataagtctacattaaacaa

SEQ ID NO: 3417527 - DNA, 16 bp, Homo sapiens
agatactcaagcaggt

SEQ ID NO: 3417528 - DNA, 18 bp, Homo sapiens
agatattgtgaagtacat

SEQ ID NO: 3417529 - DNA, 16 bp, Homo sapiens
agatcactttttaaac

SEQ ID NO: 3417530 - DNA, 12 bp, Homo sapiens
agatgaaataat

SEQ ID NO: 3417531 - DNA, 13 bp, Homo sapiens
agatgcagagagc

SEQ ID NO: 3417532 - DNA, 15 bp, Homo sapiens
agatgcctgaagcca

SEQ ID NO: 3417533 - DNA, 10 bp, Homo sapiens
agatggaaag

SEQ ID NO: 3417534 - DNA, 15 bp, Homo sapiens
agatgtccctgaagt

SEQ ID NO: 3417535 - DNA, 17 bp, Homo sapiens
agattagggaaaatgga

SEQ ID NO: 3417536 - DNA, 19 bp, Homo sapiens
agattatgagacacaggat

SEQ ID NO: 3417537 - DNA, 22 bp, Homo sapiens
agattccacacaaaatgtcaca

SEQ ID NO: 3417538 - DNA, 13 bp, Homo sapiens
agattcttccatt

SEQ ID NO: 3417539 - DNA, 16 bp, Homo sapiens
agattggatttgctgt

SEQ ID NO: 3417540 - DNA, 17 bp, Homo sapiens
agattggatttgctgtg

SEQ ID NO: 3417541 - DNA, 19 bp, Homo sapiens
agattggctcacactgaga

SEQ ID NO: 3417542 - DNA, 22 bp, Homo sapiens
agattggctcacactgagaatg

SEQ ID NO: 3417543 - DNA, 15 bp, Homo sapiens
agattgtattgctgt

SEQ ID NO: 3417544 - DNA, 15 bp, Homo sapiens
agatttcatctgctc

SEQ ID NO: 3417545 - DNA, 18 bp, Homo sapiens
agatttcatctgctctcc

SEQ ID NO: 3417546 - DNA, 19 bp, Homo sapiens
agatttcatctgctctcct

SEQ ID NO: 3417547 - DNA, 23 bp, Homo sapiens
agatttcatctgctctccttcct

SEQ ID NO: 3417548 - DNA, 21 bp, Homo sapiens
agatttttatattagttgctt

SEQ ID NO: 3417549 - DNA, 21 bp, Homo sapiens
agatttttttcatagatttga

SEQ ID NO: 3417550 - DNA, 18 bp, Homo sapiens
agattttttttttaagtg

SEQ ID NO: 3417551 - DNA, 17 bp, Homo sapiens
agcaaagtgtcagtgtt

SEQ ID NO: 3417552 - DNA, 19 bp, Homo sapiens
agcaacgttagtagaactt

SEQ ID NO: 3417553 - DNA, 19 bp, Homo sapiens
agcaagtatccttcattgt

SEQ ID NO: 3417554 - DNA, 20 bp, Homo sapiens
agcacatgccagggaaaaag

SEQ ID NO: 3417555 - DNA, 23 bp, Homo sapiens
agcacatgccagggaaaaagacc

SEQ ID NO: 3417556 - DNA, 10 bp, Homo sapiens
agcactgagg

SEQ ID NO: 3417557 - DNA, 12 bp, Homo sapiens
agcagaaggggg

SEQ ID NO: 3417558 - DNA, 22 bp, Homo sapiens
agcagaagggggtggtgtctcc

SEQ ID NO: 3417559 - DNA, 12 bp, Homo sapiens
agcagatgcaga

SEQ ID NO: 3417560 - DNA, 13 bp, Homo sapiens
agcagatgcagag

SEQ ID NO: 3417561 - DNA, 18 bp, Homo sapiens
agcagatgcagagagcca

SEQ ID NO: 3417562 - DNA, 14 bp, Homo sapiens
agcatcaaacatga

SEQ ID NO: 3417563 - DNA, 19 bp, Homo sapiens
agcatcaaacatgaaaaca

SEQ ID NO: 3417564 - DNA, 13 bp, Homo sapiens
agcatctcccagt

SEQ ID NO: 3417565 - DNA, 18 bp, Homo sapiens
agcatcttcacttctaaa

SEQ ID NO: 3417566 - DNA, 19 bp, Homo sapiens
agcatgacaaaagtgacag

SEQ ID NO: 3417567 - DNA, 15 bp, Homo sapiens
agcatgagtggcctt

SEQ ID NO: 3417568 - DNA, 17 bp, Homo sapiens
agcatgtatagttgctt

SEQ ID NO: 3417569 - DNA, 19 bp, Homo sapiens
agcatgtgtatttccagtg

SEQ ID NO: 3417570 - DNA, 17 bp, Homo sapiens
agcattaactaaatgct

SEQ ID NO: 3417571 - DNA, 15 bp, Homo sapiens
agcattccttctttg

SEQ ID NO: 3417572 - DNA, 18 bp, Homo sapiens
agcattccttctttgata

SEQ ID NO: 3417573 - DNA, 19 bp, Homo sapiens
agcattccttctttgataa

SEQ ID NO: 3417574 - DNA, 21 bp, Homo sapiens
agcattccttctttgataatg

SEQ ID NO: 3417575 - DNA, 22 bp, Homo sapiens
agcattccttctttgataatgt

SEQ ID NO: 3417576 - DNA, 23 bp, Homo sapiens
agcattccttctttgataatgtt

SEQ ID NO: 3417577 - DNA, 15 bp, Homo sapiens
agccaaagagactgg

SEQ ID NO: 3417578 - DNA, 22 bp, Homo sapiens
agccaagctccctggagccctg

SEQ ID NO: 3417579 - DNA, 16 bp, Homo sapiens
agccacaggcctgaga

SEQ ID NO: 3417580 - DNA, 17 bp, Homo sapiens
agccacaggcctgagat

SEQ ID NO: 3417581 - DNA, 21 bp, Homo sapiens
agccacaggcctgagatttca

SEQ ID NO: 3417582 - DNA, 19 bp, Homo sapiens
tgtctttctttgctgctgt

SEQ ID NO: 3417583 - DNA, 20 bp, Homo sapiens
tgtctttttgttatgcaaat

SEQ ID NO: 3417584 - DNA, 13 bp, Homo sapiens
tgtgaaattgtgt

SEQ ID NO: 3417585 - DNA, 14 bp, Homo sapiens
tgtgaaattgtgta

SEQ ID NO: 3417586 - DNA, 13 bp, Homo sapiens
tgtgaatggattg

SEQ ID NO: 3417587 - DNA, 16 bp, Homo sapiens
tgtgaatggattggat

SEQ ID NO: 3417588 - DNA, 14 bp, Homo sapiens
tgtgagaaaggaaa

SEQ ID NO: 3417589 - DNA, 19 bp, Homo sapiens
tgtgagactcgagaacttt

SEQ ID NO: 3417590 - DNA, 18 bp, Homo sapiens
tgtgaggggctctctcat

SEQ ID NO: 3417591 - DNA, 13 bp, Homo sapiens
tgtgcaaacagtg

SEQ ID NO: 3417592 - DNA, 15 bp, Homo sapiens
tgtgcaactcttgta

SEQ ID NO: 3417593 - DNA, 23 bp, Homo sapiens
tgtgcaactcttgtattgctcca

SEQ ID NO: 3417594 - DNA, 17 bp, Homo sapiens
tgtgcacaaagtggcat

SEQ ID NO: 3417595 - DNA, 21 bp, Homo sapiens
tgtgcatttttgtgaaatgaa

SEQ ID NO: 3417596 - DNA, 22 bp, Homo sapiens
tgtgcatttttgtgaaatgaaa

SEQ ID NO: 3417597 - DNA, 16 bp, Homo sapiens
tgtgcctccctggtga

SEQ ID NO: 3417598 - DNA, 17 bp, Homo sapiens
tgtgcctcccttttctc

SEQ ID NO: 3417599 - DNA, 17 bp, Homo sapiens
tgtgctcccctttgcct

SEQ ID NO: 3417600 - DNA, 16 bp, Homo sapiens
tgtggaggaaggattg

SEQ ID NO: 3417601 - DNA, 20 bp, Homo sapiens
tgtggaggaaggattgtaaa

SEQ ID NO: 3417602 - DNA, 20 bp, Homo sapiens
tgtggccatatatgctgtat

SEQ ID NO: 3417603 - DNA, 22 bp, Homo sapiens
tgtggcctatgaaactggttta

SEQ ID NO: 3417604 - DNA, 15 bp, Homo sapiens
tgtgggagtgtgtaa

SEQ ID NO: 3417605 - DNA, 19 bp, Homo sapiens
tgtgggcaggcaagccctt

SEQ ID NO: 3417606 - DNA, 18 bp, Homo sapiens
tgtgggttgtgatattga

SEQ ID NO: 3417607 - DNA, 20 bp, Homo sapiens
tgtggttaatgccatggaca

SEQ ID NO: 3417608 - DNA, 22 bp, Homo sapiens
tgtgtagagtggcgattgaatg

SEQ ID NO: 3417609 - DNA, 20 bp, Homo sapiens
tgtgtagagtgtttgtgagc

SEQ ID NO: 3417610 - DNA, 13 bp, Homo sapiens
tgtgtagagttaa

SEQ ID NO: 3417611 - DNA, 12 bp, Homo sapiens
tgtgtatgagaa

SEQ ID NO: 3417612 - DNA, 21 bp, Homo sapiens
tgtgtatgagaagtactttgt

SEQ ID NO: 3417613 - DNA, 22 bp, Homo sapiens
tgtgtatgagaagtactttgtg

SEQ ID NO: 3417614 - DNA, 12 bp, Homo sapiens
tgtgtatgtggg

SEQ ID NO: 3417615 - DNA, 20 bp, Homo sapiens
tgtgtcatcaatagtgtcct

SEQ ID NO: 3417616 - DNA, 16 bp, Homo sapiens
tgtgtgggagtgtgta

SEQ ID NO: 3417617 - DNA, 13 bp, Homo sapiens
tgtgtgtctctga

SEQ ID NO: 3417618 - DNA, 11 bp, Homo sapiens
tgtgtgtgtgt

SEQ ID NO: 3417619 - DNA, 13 bp, Homo sapiens
tgtgttgcttcaa

SEQ ID NO: 3417620 - DNA, 16 bp, Homo sapiens
tgttaaatttgtaagt

SEQ ID NO: 3417621 - DNA, 18 bp, Homo sapiens
tgttaaatttgtaagttt

SEQ ID NO: 3417622 - DNA, 17 bp, Homo sapiens
tgttaacagacactgta

SEQ ID NO: 3417623 - DNA, 16 bp, Homo sapiens
tgttaacaggtatttt

SEQ ID NO: 3417624 - DNA, 16 bp, Homo sapiens
tgttaaggaaactctt

SEQ ID NO: 3417625 - DNA, 21 bp, Homo sapiens
tgttaaggaaactcttatctc

SEQ ID NO: 3417626 - DNA, 23 bp, Homo sapiens
tgttaaggaaactcttatctcag

SEQ ID NO: 3417627 - DNA, 12 bp, Homo sapiens
tgttactgcttc

SEQ ID NO: 3417628 - DNA, 16 bp, Homo sapiens
tgttatagattgtctt

SEQ ID NO: 3417629 - DNA, 17 bp, Homo sapiens
tgttatagattgtctta

SEQ ID NO: 3417630 - DNA, 18 bp, Homo sapiens
tgttatagattgtcttaa

SEQ ID NO: 3417631 - DNA, 14 bp, Homo sapiens
tgttatgcaaatga

SEQ ID NO: 3417632 - DNA, 17 bp, Homo sapiens
tgttattaatgtttctt

SEQ ID NO: 3417633 - DNA, 20 bp, Homo sapiens
tgttcagccaaacagtatga

SEQ ID NO: 3417634 - DNA, 13 bp, Homo sapiens
tgttcatccaagg

SEQ ID NO: 3417635 - DNA, 15 bp, Homo sapiens
tgttccaatgccaca

SEQ ID NO: 3417636 - DNA, 21 bp, Homo sapiens
tgttccaatgccacatacttg

SEQ ID NO: 3417637 - DNA, 17 bp, Homo sapiens
tgttccctcattctgca

SEQ ID NO: 3417638 - DNA, 20 bp, Homo sapiens
tgttccctcattctgcatta

SEQ ID NO: 3417639 - DNA, 21 bp, Homo sapiens
tgttccctcattctgcattaa

SEQ ID NO: 3417640 - DNA, 14 bp, Homo sapiens
tgttctgtttgtgt

SEQ ID NO: 3417641 - DNA, 15 bp, Homo sapiens
tgttgaaaaatatct

SEQ ID NO: 3417642 - DNA, 21 bp, Homo sapiens
tgttgaaaaatatctttgcat

SEQ ID NO: 3417643 - DNA, 14 bp, Homo sapiens
tgttgacatgtgct

SEQ ID NO: 3417644 - DNA, 19 bp, Homo sapiens
tgttgataaatggatatta

SEQ ID NO: 3417645 - DNA, 14 bp, Homo sapiens
tgttgcttcaaatt

SEQ ID NO: 3417646 - DNA, 22 bp, Homo sapiens
tgttggctacacagacccctcc

SEQ ID NO: 3417647 - DNA, 23 bp, Homo sapiens
tgttggtgcaattaactctggac

SEQ ID NO: 3417648 - DNA, 19 bp, Homo sapiens
tgttggttgcactttgtag

SEQ ID NO: 3417649 - DNA, 16 bp, Homo sapiens
tgttgtacatttatga

SEQ ID NO: 3417650 - DNA, 18 bp, Homo sapiens
tgttgtacatttatgatt

SEQ ID NO: 3417651 - DNA, 22 bp, Homo sapiens
tgttgtacatttatgatttaat

SEQ ID NO: 3417652 - DNA, 14 bp, Homo sapiens
tgttgtcatgtgta

SEQ ID NO: 3417653 - DNA, 16 bp, Homo sapiens
tgttgtcatgtgtatg

SEQ ID NO: 3417654 - DNA, 14 bp, Homo sapiens
tgttgtgtgtggga

SEQ ID NO: 3417655 - DNA, 13 bp, Homo sapiens
tgttgtttctttc

SEQ ID NO: 3417656 - DNA, 14 bp, Homo sapiens
tgtttacagaggac

SEQ ID NO: 3417657 - DNA, 21 bp, Homo sapiens
tgtttactcccttctgtagtt

SEQ ID NO: 3417658 - DNA, 14 bp, Homo sapiens
tgtttatgagccag

SEQ ID NO: 3417659 - DNA, 21 bp, Homo sapiens
tgtttatgagccagacaaatg

SEQ ID NO: 3417660 - DNA, 13 bp, Homo sapiens
tgtttatgtgtgt

SEQ ID NO: 3417661 - DNA, 15 bp, Homo sapiens
tgtttctcctgagct

SEQ ID NO: 3417662 - DNA, 22 bp, Homo sapiens
tgtttcttctccaattctgaaa

SEQ ID NO: 3417663 - DNA, 11 bp, Homo sapiens
tgtttcttgat

SEQ ID NO: 3417664 - DNA, 22 bp, Homo sapiens
tgtttcttgttcatccaaggaa

SEQ ID NO: 3417665 - DNA, 13 bp, Homo sapiens
tgtttctttctag

SEQ ID NO: 3417666 - DNA, 22 bp, Homo sapiens
tgttttaatttatactggcatg

SEQ ID NO: 3417667 - DNA, 14 bp, Homo sapiens
tgttttccatccca

SEQ ID NO: 3417668 - DNA, 21 bp, Homo sapiens
tgttttgagggctattagaag

SEQ ID NO: 3417669 - DNA, 19 bp, Homo sapiens
tgttttgtaaagtccccag

SEQ ID NO: 3417670 - DNA, 14 bp, Homo sapiens
tgtttttgtgtaga

SEQ ID NO: 3417671 - DNA, 22 bp, Homo sapiens
tgtttttttccctctcctgtcc

SEQ ID NO: 3417672 - DNA, 23 bp, Homo sapiens
ttaaaaaacaattggttgtatat

SEQ ID NO: 3417673 - DNA, 16 bp, Homo sapiens
ttaaaaactttaaaga

SEQ ID NO: 3417674 - DNA, 18 bp, Homo sapiens
ttaaaaactttaaagata

SEQ ID NO: 3417675 - DNA, 21 bp, Homo sapiens
ttaaaaataaagctactgaat

SEQ ID NO: 3417676 - DNA, 15 bp, Homo sapiens
ttaaaagacaaacac

SEQ ID NO: 3417677 - DNA, 16 bp, Homo sapiens
ttaaaagacaaacacc

SEQ ID NO: 3417678 - DNA, 16 bp, Homo sapiens
ttaaaataaaattttt

SEQ ID NO: 3417679 - DNA, 18 bp, Homo sapiens
ttaaacaaaatttcacag

SEQ ID NO: 3417680 - DNA, 21 bp, Homo sapiens
ttaaacaaaatttcacagttc

SEQ ID NO: 3417681 - DNA, 16 bp, Homo sapiens
ttaaactagtttaagg

SEQ ID NO: 3417682 - DNA, 13 bp, Homo sapiens
ttaaactggtatt

SEQ ID NO: 3417683 - DNA, 14 bp, Homo sapiens
ttaaagcaaaggag

SEQ ID NO: 3417684 - DNA, 19 bp, Homo sapiens
ttaaagcttgatttgatct

SEQ ID NO: 3417685 - DNA, 20 bp, Homo sapiens
ttaaagcttgatttgatctt

SEQ ID NO: 3417686 - DNA, 14 bp, Homo sapiens
ttaaaggacaaaca

SEQ ID NO: 3417687 - DNA, 15 bp, Homo sapiens
ttaaaggacaaacag

SEQ ID NO: 3417688 - DNA, 13 bp, Homo sapiens
ttaaagtatgcaa

SEQ ID NO: 3417689 - DNA, 17 bp, Homo sapiens
ttaaataaatagaaaga

SEQ ID NO: 3417690 - DNA, 21 bp, Homo sapiens
ttaaatatctgaacatttact

SEQ ID NO: 3417691 - DNA, 22 bp, Homo sapiens
ttaaatatctgaacatttacta

SEQ ID NO: 3417692 - DNA, 19 bp, Homo sapiens
ttaaatcatttggttaaat

SEQ ID NO: 3417693 - DNA, 22 bp, Homo sapiens
ttaaatcatttggttaaatcat

SEQ ID NO: 3417694 - DNA, 13 bp, Homo sapiens
ttgaaacagaaaa

SEQ ID NO: 3417695 - DNA, 22 bp, Homo sapiens
ttgaactccatgggattttatc

SEQ ID NO: 3417696 - DNA, 17 bp, Homo sapiens
ttgaactgcaggaagag

SEQ ID NO: 3417697 - DNA, 18 bp, Homo sapiens
ttgaactgcaggaagaga

SEQ ID NO: 3417698 - DNA, 19 bp, Homo sapiens
ttgaagaacaaaaggcttt

SEQ ID NO: 3417699 - DNA, 23 bp, Homo sapiens
ttgaaggaatacaatatatagct

SEQ ID NO: 3417700 - DNA, 16 bp, Homo sapiens
ttgaatataaacacta

SEQ ID NO: 3417701 - DNA, 18 bp, Homo sapiens
ttgaatataaacactata

SEQ ID NO: 3417702 - DNA, 16 bp, Homo sapiens
ttgaatgcttcctgac

SEQ ID NO: 3417703 - DNA, 20 bp, Homo sapiens
ttgaatgtattgttctgttt

SEQ ID NO: 3417704 - DNA, 12 bp, Homo sapiens
ttgaatgtgatc

SEQ ID NO: 3417705 - DNA, 18 bp, Homo sapiens
ttgaatgtgatcatcttt

SEQ ID NO: 3417706 - DNA, 21 bp, Homo sapiens
ttgaatgtgatcatctttgct

SEQ ID NO: 3417707 - DNA, 23 bp, Homo sapiens
ttgaatgtgatcatctttgctga

SEQ ID NO: 3417708 - DNA, 15 bp, Homo sapiens
ttgacagaacactgt

SEQ ID NO: 3417709 - DNA, 15 bp, Homo sapiens
ttgaccatgtgatta

SEQ ID NO: 3417710 - DNA, 20 bp, Homo sapiens
ttgacttgacagaacactgt

SEQ ID NO: 3417711 - DNA, 21 bp, Homo sapiens
ttgacttgacagaacactgtc

SEQ ID NO: 3417712 - DNA, 22 bp, Homo sapiens
ttgagcaagtatccttcattgt

SEQ ID NO: 3417713 - DNA, 18 bp, Homo sapiens
ttgagggtgtaaccagta

SEQ ID NO: 3417714 - DNA, 15 bp, Homo sapiens
ttgagtctgttttgt

SEQ ID NO: 3417715 - DNA, 17 bp, Homo sapiens
ttgataaatggatatta

SEQ ID NO: 3417716 - DNA, 13 bp, Homo sapiens
ttgataatgtcca

SEQ ID NO: 3417717 - DNA, 13 bp, Homo sapiens
ttgataatgttaa

SEQ ID NO: 3417718 - DNA, 14 bp, Homo sapiens
ttgataatgttaaa

SEQ ID NO: 3417719 - DNA, 15 bp, Homo sapiens
ttgataatgttaaat

SEQ ID NO: 3417720 - DNA, 18 bp, Homo sapiens
ttgataatgttaaatttg

SEQ ID NO: 3417721 - DNA, 17 bp, Homo sapiens
ttgatagtgcttcttgt

SEQ ID NO: 3417722 - DNA, 17 bp, Homo sapiens
ttgatcaacatcttttc

SEQ ID NO: 3417723 - DNA, 22 bp, Homo sapiens
ttgatcagatgctgaattgaga

SEQ ID NO: 3417724 - DNA, 15 bp, Homo sapiens
ttgatctttgtttaa

SEQ ID NO: 3417725 - DNA, 19 bp, Homo sapiens
ttgatctttgtttaaatgc

SEQ ID NO: 3417726 - DNA, 22 bp, Homo sapiens
ttgattaaattatgaatgagtt

SEQ ID NO: 3417727 - DNA, 17 bp, Homo sapiens
ttgattgtcagctacta

SEQ ID NO: 3417728 - DNA, 21 bp, Homo sapiens
ttgattgtcagctactaatga

SEQ ID NO: 3417729 - DNA, 20 bp, Homo sapiens
ttgcaccaattaagtgttga

SEQ ID NO: 3417730 - DNA, 18 bp, Homo sapiens
ttgcacgcgccctttcta

SEQ ID NO: 3417731 - DNA, 20 bp, Homo sapiens
ttgcacttgtggaatatgtt

SEQ ID NO: 3417732 - DNA, 13 bp, Homo sapiens
ttgcactttgtag

SEQ ID NO: 3417733 - DNA, 14 bp, Homo sapiens
ttgcactttgtagt

SEQ ID NO: 3417734 - DNA, 12 bp, Homo sapiens
ttgcataataaa

SEQ ID NO: 3417735 - DNA, 14 bp, Homo sapiens
ttgcatatatacat

SEQ ID NO: 3417736 - DNA, 23 bp, Homo sapiens
ttgcattgaatttagtcattatt

SEQ ID NO: 3417737 - DNA, 13 bp, Homo sapiens
ttgccatttagcg

SEQ ID NO: 3417738 - DNA, 15 bp, Homo sapiens
ttgcccccctggcct

SEQ ID NO: 3417739 - DNA, 16 bp, Homo sapiens
ttgcccccctggcctc

SEQ ID NO: 3417740 - DNA, 16 bp, Homo sapiens
ttgccggtggtgcagg

SEQ ID NO: 3417741 - DNA, 21 bp, Homo sapiens
ttgcctttgtaatatgagaat

SEQ ID NO: 3417742 - DNA, 21 bp, Homo sapiens
ttgcggggcttttaaaaggaa

SEQ ID NO: 3417743 - DNA, 20 bp, Homo sapiens
ttgctatgagctggggatgt

SEQ ID NO: 3417744 - DNA, 16 bp, Homo sapiens
ttgctccattttcttg

SEQ ID NO: 3417745 - DNA, 20 bp, Homo sapiens
ttgctccattttcttgtcaa

SEQ ID NO: 3417746 - DNA, 18 bp, Homo sapiens
ttgctgaatgtcattatt

SEQ ID NO: 3417747 - DNA, 16 bp, Homo sapiens
ttgctgtgactagata

SEQ ID NO: 3417748 - DNA, 15 bp, Homo sapiens
ttgctgttactgctt

SEQ ID NO: 3417749 - DNA, 18 bp, Homo sapiens
ttgcttttgaaggaatac

SEQ ID NO: 3417750 - DNA, 20 bp, Homo sapiens
ttggaagaagttttttactt

SEQ ID NO: 3417751 - DNA, 23 bp, Homo sapiens
ttggagcattaactaaatgctca

SEQ ID NO: 3417752 - DNA, 24 bp, Homo sapiens
ttggagcattaactaaatgctcat

SEQ ID NO: 3417753 - DNA, 15 bp, Homo sapiens
ttggattatttaata

SEQ ID NO: 3417754 - DNA, 17 bp, Homo sapiens
ttggattatttaataac

SEQ ID NO: 3417755 - DNA, 20 bp, Homo sapiens
ttggattatttaataacatt

SEQ ID NO: 3417756 - DNA, 13 bp, Homo sapiens
ttggatttgctgt

SEQ ID NO: 3417757 - DNA, 18 bp, Homo sapiens
ttggatttgctgtgacta

SEQ ID NO: 3417758 - DNA, 19 bp, Homo sapiens
ttggcccaagtcattgttt

SEQ ID NO: 3417759 - DNA, 14 bp, Homo sapiens
ttggccctcctcag

SEQ ID NO: 3417760 - DNA, 22 bp, Homo sapiens
ttggccctcctcagctccctgc

SEQ ID NO: 3417761 - DNA, 17 bp, Homo sapiens
ttggctcacactgagaa

SEQ ID NO: 3417762 - DNA, 21 bp, Homo sapiens
ttgggtgtaacaggtctcctc

SEQ ID NO: 3417763 - DNA, 22 bp, Homo sapiens
ggagaatgtcagtatgtggaag

SEQ ID NO: 3417764 - DNA, 12 bp, Homo sapiens
ggagagcccagg

SEQ ID NO: 3417765 - DNA, 20 bp, Homo sapiens
ggagagcccaggagctcccc

SEQ ID NO: 3417766 - DNA, 13 bp, Homo sapiens
ggagaggatgaga

SEQ ID NO: 3417767 - DNA, 13 bp, Homo sapiens
ggagatgaaaacc

SEQ ID NO: 3417768 - DNA, 14 bp, Homo sapiens
ggagcccaggccag

SEQ ID NO: 3417769 - DNA, 15 bp, Homo sapiens
ggagcccaggccagg

SEQ ID NO: 3417770 - DNA, 24 bp, Homo sapiens
ggagcccaggccaggactctgcag

SEQ ID NO: 3417771 - DNA, 20 bp, Homo sapiens
ggagccctgttggcagctct

SEQ ID NO: 3417772 - DNA, 16 bp, Homo sapiens
ggagcctaggccaggt

SEQ ID NO: 3417773 - DNA, 18 bp, Homo sapiens
ggagcctaggccaggtgc

SEQ ID NO: 3417774 - DNA, 14 bp, Homo sapiens
ggagcctccctgcc

SEQ ID NO: 3417775 - DNA, 13 bp, Homo sapiens
ggagctcccctcc

SEQ ID NO: 3417776 - DNA, 17 bp, Homo sapiens
ggagctcccctccccaa

SEQ ID NO: 3417777 - DNA, 13 bp, Homo sapiens
ggagctgcctgga

SEQ ID NO: 3417778 - DNA, 16 bp, Homo sapiens
ggagggcagcagaagg

SEQ ID NO: 3417779 - DNA, 19 bp, Homo sapiens
ggagtgtactcccagggct

SEQ ID NO: 3417780 - DNA, 15 bp, Homo sapiens
ggatagatgtgtgga

SEQ ID NO: 3417781 - DNA, 16 bp, Homo sapiens
ggatatgattggttca

SEQ ID NO: 3417782 - DNA, 16 bp, Homo sapiens
ggatcatggtgtaata

SEQ ID NO: 3417783 - DNA, 15 bp, Homo sapiens
ggatgagagcccaga

SEQ ID NO: 3417784 - DNA, 16 bp, Homo sapiens
ggatgagagcccagag

SEQ ID NO: 3417785 - DNA, 19 bp, Homo sapiens
ggatgagagcccagaggta

SEQ ID NO: 3417786 - DNA, 16 bp, Homo sapiens
ggatgggtccagaaga

SEQ ID NO: 3417787 - DNA, 13 bp, Homo sapiens
ggatggtgacttt

SEQ ID NO: 3417788 - DNA, 15 bp, Homo sapiens
ggatggtgacttttg

SEQ ID NO: 3417789 - DNA, 21 bp, Homo sapiens
ggatggtgacttttgaagaac

SEQ ID NO: 3417790 - DNA, 23 bp, Homo sapiens
ggatgtttctgtcacatcagctc

SEQ ID NO: 3417791 - DNA, 22 bp, Homo sapiens
ggattatttaataacattacct

SEQ ID NO: 3417792 - DNA, 16 bp, Homo sapiens
ggattggattatttaa

SEQ ID NO: 3417793 - DNA, 17 bp, Homo sapiens
ggcaaaatattcttctt

SEQ ID NO: 3417794 - DNA, 14 bp, Homo sapiens
ggcaaacatgtgca

SEQ ID NO: 3417795 - DNA, 21 bp, Homo sapiens
ggcaacagaaaacaattgttc

SEQ ID NO: 3417796 - DNA, 21 bp, Homo sapiens
ggcactaagaggggctggacc

SEQ ID NO: 3417797 - DNA, 14 bp, Homo sapiens
ggcactgccctggt

SEQ ID NO: 3417798 - DNA, 12 bp, Homo sapiens
ggcagaagacac

SEQ ID NO: 3417799 - DNA, 17 bp, Homo sapiens
ggcagaagacaccagag

SEQ ID NO: 3417800 - DNA, 19 bp, Homo sapiens
ggcagaagacaccagagca

SEQ ID NO: 3417801 - DNA, 20 bp, Homo sapiens
ggcagaagacaccagagcag

SEQ ID NO: 3417802 - DNA, 16 bp, Homo sapiens
ggcagcaaagtgtcag

SEQ ID NO: 3417803 - DNA, 17 bp, Homo sapiens
ggcagccagggagagcc

SEQ ID NO: 3417804 - DNA, 16 bp, Homo sapiens
ggcagctcgaggcccc

SEQ ID NO: 3417805 - DNA, 14 bp, Homo sapiens
ggcaggacaggaaa

SEQ ID NO: 3417806 - DNA, 17 bp, Homo sapiens
ggcagggaacatgggga

SEQ ID NO: 3417807 - DNA, 15 bp, Homo sapiens
ggcagggctgaggcc

SEQ ID NO: 3417808 - DNA, 11 bp, Homo sapiens
ggcatgctaaa

SEQ ID NO: 3417809 - DNA, 18 bp, Homo sapiens
ggcatgggaaggtgggcg

SEQ ID NO: 3417810 - DNA, 18 bp, Homo sapiens
ggcatgtgggttgtgata

SEQ ID NO: 3417811 - DNA, 19 bp, Homo sapiens
ggcatgtgggttgtgatat

SEQ ID NO: 3417812 - DNA, 20 bp, Homo sapiens
ggcattaattgttccttgct

SEQ ID NO: 3417813 - DNA, 21 bp, Homo sapiens
ggccacttctgggtggggcag

SEQ ID NO: 3417814 - DNA, 18 bp, Homo sapiens
ggccagacctgcagacgc

SEQ ID NO: 3417815 - DNA, 20 bp, Homo sapiens
ggccaggactctgcagcctc

SEQ ID NO: 3417816 - DNA, 21 bp, Homo sapiens
ggccaggactctgcagcctca

SEQ ID NO: 3417817 - DNA, 16 bp, Homo sapiens
ggccatgttgtgcctc

SEQ ID NO: 3417818 - DNA, 17 bp, Homo sapiens
ggcccaagtcattgttt

SEQ ID NO: 3417819 - DNA, 18 bp, Homo sapiens
ggcccaccccacccactt

SEQ ID NO: 3417820 - DNA, 23 bp, Homo sapiens
ggcccaccccacccacttctgca

SEQ ID NO: 3417821 - DNA, 14 bp, Homo sapiens
ggccctccacacct

SEQ ID NO: 3417822 - DNA, 15 bp, Homo sapiens
ggccctccacacctg

SEQ ID NO: 3417823 - DNA, 15 bp, Homo sapiens
ggccctcctcagctc

SEQ ID NO: 3417824 - DNA, 19 bp, Homo sapiens
ggccctcctcagctccctg

SEQ ID NO: 3417825 - DNA, 15 bp, Homo sapiens
ggccctctcccctgc

SEQ ID NO: 3417826 - DNA, 17 bp, Homo sapiens
ggccctgtgccttggtg

SEQ ID NO: 3417827 - DNA, 22 bp, Homo sapiens
ggccgcgccaaataatgtctct

SEQ ID NO: 3417828 - DNA, 22 bp, Homo sapiens
ggccgggaccccgagcctggct

SEQ ID NO: 3417829 - DNA, 23 bp, Homo sapiens
ggccgggaccccgagcctggctc

SEQ ID NO: 3417830 - DNA, 16 bp, Homo sapiens
ggccgggcagaggggc

SEQ ID NO: 3417831 - DNA, 18 bp, Homo sapiens
ggcctcaagatcaatgaa

SEQ ID NO: 3417832 - DNA, 19 bp, Homo sapiens
ggcctcgcaggaagaccca

SEQ ID NO: 3417833 - DNA, 18 bp, Homo sapiens
ggcctgccacctggaccc

SEQ ID NO: 3417834 - DNA, 14 bp, Homo sapiens
ggccttcataatgg

SEQ ID NO: 3417835 - DNA, 18 bp, Homo sapiens
ggccttcgattttaaata

SEQ ID NO: 3417836 - DNA, 18 bp, Homo sapiens
ggctaacatttaggagaa

SEQ ID NO: 3417837 - DNA, 15 bp, Homo sapiens
ggctcacactgagaa

SEQ ID NO: 3417838 - DNA, 20 bp, Homo sapiens
ggctcccctcgacagctctc

SEQ ID NO: 3417839 - DNA, 22 bp, Homo sapiens
ggctcccctcgacagctctctg

SEQ ID NO: 3417840 - DNA, 17 bp, Homo sapiens
ggctgagggattctatt

SEQ ID NO: 3417841 - DNA, 15 bp, Homo sapiens
ggctgatggagtaaa

SEQ ID NO: 3417842 - DNA, 14 bp, Homo sapiens
ggctggactgaggc

SEQ ID NO: 3417843 - DNA, 16 bp, Homo sapiens
ggctggactgaggcct

SEQ ID NO: 3417844 - DNA, 17 bp, Homo sapiens
ggctggactgaggcctg

SEQ ID NO: 3417845 - DNA, 18 bp, Homo sapiens
ggctggactgaggcctga

SEQ ID NO: 3417846 - DNA, 14 bp, Homo sapiens
ggctggaggagccc

SEQ ID NO: 3417847 - DNA, 15 bp, Homo sapiens
ggctggaggagccca

SEQ ID NO: 3417848 - DNA, 16 bp, Homo sapiens
ggctggaggagcccag

SEQ ID NO: 3417849 - DNA, 17 bp, Homo sapiens
ggctggaggagcccagg

SEQ ID NO: 3417850 - DNA, 17 bp, Homo sapiens
ggctgtacatagtcctt

SEQ ID NO: 3417851 - DNA, 19 bp, Homo sapiens
ggctgtacatagtcctttt

SEQ ID NO: 3417852 - DNA, 17 bp, Homo sapiens
ggcttacggccctggcc

SEQ ID NO: 3417853 - DNA, 15 bp, Homo sapiens
ggcttcactgtataa

SEQ ID NO: 3417854 - DNA, 19 bp, Homo sapiens
ggcttcactgtataaatag

SEQ ID NO: 3417855 - DNA, 21 bp, Homo sapiens
ggcttcctcagttcctgccct

SEQ ID NO: 3417856 - DNA, 14 bp, Homo sapiens
ggcttgcctgcagg

SEQ ID NO: 3417857 - DNA, 14 bp, Homo sapiens
gggaacatggggag

SEQ ID NO: 3417858 - DNA, 23 bp, Homo sapiens
gggaaccatgaagctggaagcac

SEQ ID NO: 3417859 - DNA, 12 bp, Homo sapiens
gggaatcaagat

SEQ ID NO: 3417860 - DNA, 16 bp, Homo sapiens
gggaatggcacagccc

SEQ ID NO: 3417861 - DNA, 20 bp, Homo sapiens
gggacaccaagccttggctc

SEQ ID NO: 3417862 - DNA, 16 bp, Homo sapiens
gggaccccgagcctgg

SEQ ID NO: 3417863 - DNA, 19 bp, Homo sapiens
gggacctataactgcccag

SEQ ID NO: 3417864 - DNA, 19 bp, Homo sapiens
gggagaatgtcagtatgtg

SEQ ID NO: 3417865 - DNA, 13 bp, Homo sapiens
gggagagcccagg

SEQ ID NO: 3417866 - DNA, 18 bp, Homo sapiens
gggagtgtactcccaggg

SEQ ID NO: 3417867 - DNA, 14 bp, Homo sapiens
gggatagatgtgtg

SEQ ID NO: 3417868 - DNA, 11 bp, Homo sapiens
gggcagccagg

SEQ ID NO: 3417869 - DNA, 11 bp, Homo sapiens
gggcctgccac

SEQ ID NO: 3417870 - DNA, 16 bp, Homo sapiens
gggcctgccacctgga

SEQ ID NO: 3417871 - DNA, 16 bp, Homo sapiens
gggcctgcgagggcag

SEQ ID NO: 3417872 - DNA, 18 bp, Homo sapiens
gggctgccatgtgaagag

SEQ ID NO: 3417873 - DNA, 13 bp, Homo sapiens
gggctggaggagc

SEQ ID NO: 3417874 - DNA, 15 bp, Homo sapiens
gggctggaggagccc

SEQ ID NO: 3417875 - DNA, 16 bp, Homo sapiens
gggctggaggagccca

SEQ ID NO: 3417876 - DNA, 16 bp, Homo sapiens
gggcttttaaaaggaa

SEQ ID NO: 3417877 - DNA, 13 bp, Homo sapiens
gcgtcttgtgaaa

SEQ ID NO: 3417878 - DNA, 12 bp, Homo sapiens
gcgtgtgtagag

SEQ ID NO: 3417879 - DNA, 15 bp, Homo sapiens
gcgtgtgtagagtta

SEQ ID NO: 3417880 - DNA, 20 bp, Homo sapiens
gcgtgtgtagagttaagaag

SEQ ID NO: 3417881 - DNA, 22 bp, Homo sapiens
gcgtgtgtagagttaagaagct

SEQ ID NO: 3417882 - DNA, 13 bp, Homo sapiens
gctaatatacttt

SEQ ID NO: 3417883 - DNA, 22 bp, Homo sapiens
gctaattctttgacctgttggg

SEQ ID NO: 3417884 - DNA, 16 bp, Homo sapiens
gctacacagacccctc

SEQ ID NO: 3417885 - DNA, 15 bp, Homo sapiens
gctacctttttatat

SEQ ID NO: 3417886 - DNA, 15 bp, Homo sapiens
gctagaatttctggt

SEQ ID NO: 3417887 - DNA, 18 bp, Homo sapiens
gctagtgccaaataattg

SEQ ID NO: 3417888 - DNA, 17 bp, Homo sapiens
gctataaacaattacat

SEQ ID NO: 3417889 - DNA, 13 bp, Homo sapiens
gctatcctgctga

SEQ ID NO: 3417890 - DNA, 15 bp, Homo sapiens
gctatcctgctgaaa

SEQ ID NO: 3417891 - DNA, 19 bp, Homo sapiens
gctatggggatagatgtgt

SEQ ID NO: 3417892 - DNA, 17 bp, Homo sapiens
gctattagccaggatca

SEQ ID NO: 3417893 - DNA, 18 bp, Homo sapiens
gctattagccaggatcat

SEQ ID NO: 3417894 - DNA, 14 bp, Homo sapiens
gctatttctatgta

SEQ ID NO: 3417895 - DNA, 18 bp, Homo sapiens
gctatttctatgtatgtg

SEQ ID NO: 3417896 - DNA, 14 bp, Homo sapiens
gctcaggcagctcg

SEQ ID NO: 3417897 - DNA, 20 bp, Homo sapiens
gctcaggcagctcgaggccc

SEQ ID NO: 3417898 - DNA, 19 bp, Homo sapiens
gctcattaaactgattcca

SEQ ID NO: 3417899 - DNA, 13 bp, Homo sapiens
gctccaaaccctc

SEQ ID NO: 3417900 - DNA, 17 bp, Homo sapiens
gctccaaaccctcgagg

SEQ ID NO: 3417901 - DNA, 17 bp, Homo sapiens
gctccccaatccctgac

SEQ ID NO: 3417902 - DNA, 21 bp, Homo sapiens
gctcccctccccaactgacca

SEQ ID NO: 3417903 - DNA, 18 bp, Homo sapiens
gctcccctcgacagctct

SEQ ID NO: 3417904 - DNA, 19 bp, Homo sapiens
gctcccctcgacagctctc

SEQ ID NO: 3417905 - DNA, 11 bp, Homo sapiens
gctccctggag

SEQ ID NO: 3417906 - DNA, 14 bp, Homo sapiens
gctccctggagccc

SEQ ID NO: 3417907 - DNA, 17 bp, Homo sapiens
gctccctggagccctgt

SEQ ID NO: 3417908 - DNA, 19 bp, Homo sapiens
gctccctggagccctgttg

SEQ ID NO: 3417909 - DNA, 13 bp, Homo sapiens
gctcctcccttga

SEQ ID NO: 3417910 - DNA, 22 bp, Homo sapiens
gctcctgccgcagagctggccg

SEQ ID NO: 3417911 - DNA, 20 bp, Homo sapiens
gctctacacaacatgtatgt

SEQ ID NO: 3417912 - DNA, 16 bp, Homo sapiens
gctctccaaaccactt

SEQ ID NO: 3417913 - DNA, 22 bp, Homo sapiens
gctctccttcctggagcccaga

SEQ ID NO: 3417914 - DNA, 14 bp, Homo sapiens
gctctgagctgtca

SEQ ID NO: 3417915 - DNA, 12 bp, Homo sapiens
gctcttctcatt

SEQ ID NO: 3417916 - DNA, 14 bp, Homo sapiens
gctcttctcatttc

SEQ ID NO: 3417917 - DNA, 21 bp, Homo sapiens
gctcttggggaaatagcttca

SEQ ID NO: 3417918 - DNA, 15 bp, Homo sapiens
gctgaataaagggaa

SEQ ID NO: 3417919 - DNA, 14 bp, Homo sapiens
gctgaattgagaat

SEQ ID NO: 3417920 - DNA, 14 bp, Homo sapiens
gctgaggcaattct

SEQ ID NO: 3417921 - DNA, 13 bp, Homo sapiens
gctgagttggtgt

SEQ ID NO: 3417922 - DNA, 14 bp, Homo sapiens
gctgattgtattta

SEQ ID NO: 3417923 - DNA, 17 bp, Homo sapiens
gctgcaggggcatggga

SEQ ID NO: 3417924 - DNA, 15 bp, Homo sapiens
gctgcggagcaagag

SEQ ID NO: 3417925 - DNA, 16 bp, Homo sapiens
gctgcggagcaagagg

SEQ ID NO: 3417926 - DNA, 14 bp, Homo sapiens
gctgctgaagggag

SEQ ID NO: 3417927 - DNA, 16 bp, Homo sapiens
gctgctgcctgcctgg

SEQ ID NO: 3417928 - DNA, 16 bp, Homo sapiens
gctggactgaggcctg

SEQ ID NO: 3417929 - DNA, 18 bp, Homo sapiens
gctggactgaggcctgag

SEQ ID NO: 3417930 - DNA, 19 bp, Homo sapiens
gctggactgaggcctgagc

SEQ ID NO: 3417931 - DNA, 15 bp, Homo sapiens
gctggaggagcccag

SEQ ID NO: 3417932 - DNA, 20 bp, Homo sapiens
gctggaggagcccaggccag

SEQ ID NO: 3417933 - DNA, 13 bp, Homo sapiens
gctggccgggacc

SEQ ID NO: 3417934 - DNA, 18 bp, Homo sapiens
gctggtggatggtgactt

SEQ ID NO: 3417935 - DNA, 13 bp, Homo sapiens
gctggttcactct

SEQ ID NO: 3417936 - DNA, 17 bp, Homo sapiens
gctgtaaatttggcttc

SEQ ID NO: 3417937 - DNA, 19 bp, Homo sapiens
gctgtaaatttggcttctg

SEQ ID NO: 3417938 - DNA, 21 bp, Homo sapiens
gctgtgcacccagaagaagat
